United States Patent 7,341,835 (METHODS OF ANALYSIS OF ALTERNATIVE SPLICING IN MOUSE) - sequence listing, part 21

SEQ ID NO: 798237 - DNA, 25 bp, Mus musculus
tgactcctttcggaagtgggctagg

SEQ ID NO: 798238 - DNA, 25 bp, Mus musculus
tgactcctttctcgtggccctggac

SEQ ID NO: 798239 - DNA, 25 bp, Mus musculus
tgactcctttctggtggccctggac

SEQ ID NO: 798240 - DNA, 25 bp, Mus musculus
tgactcgctccacagctgatgggaa

SEQ ID NO: 798241 - DNA, 25 bp, Mus musculus
tgactcgctccagagctgatgggaa

SEQ ID NO: 798242 - DNA, 25 bp, Mus musculus
tgactcgcttggaccacaaccgagc

SEQ ID NO: 798243 - DNA, 25 bp, Mus musculus
tgactcgcttggtccacaaccgagc

SEQ ID NO: 798244 - DNA, 25 bp, Mus musculus
tgactcggacagagagctgcgtcct

SEQ ID NO: 798245 - DNA, 25 bp, Mus musculus
tgactcggacagtgagctgcgtcct

SEQ ID NO: 798246 - DNA, 25 bp, Mus musculus
tgactcggatgcattggtcaaatgt

SEQ ID NO: 798247 - DNA, 25 bp, Mus musculus
tgactcggatgctttggtcaaatgt

SEQ ID NO: 798248 - DNA, 25 bp, Mus musculus
tgactcggcataatcacctgaagga

SEQ ID NO: 798249 - DNA, 25 bp, Mus musculus
tgactcggcatattcacctgaagga

SEQ ID NO: 798250 - DNA, 25 bp, Mus musculus
tgactcgtatggacccttactgccg

SEQ ID NO: 798251 - DNA, 25 bp, Mus musculus
tgactcgtatggtcccttactgccg

SEQ ID NO: 798252 - DNA, 25 bp, Mus musculus
tgactcgttgttactggagaagaag

SEQ ID NO: 798253 - DNA, 25 bp, Mus musculus
tgactcgttgtttctggagaagaag

SEQ ID NO: 798254 - DNA, 25 bp, Mus musculus
tgactctaaacaaaggccaggcctc

SEQ ID NO: 798255 - DNA, 25 bp, Mus musculus
tgactctaaacataggccaggcctc

SEQ ID NO: 798256 - DNA, 25 bp, Mus musculus
tgactctaactgacctcagaattcc

SEQ ID NO: 798257 - DNA, 25 bp, Mus musculus
tgactctaactgtcctcagaattcc

SEQ ID NO: 798258 - DNA, 25 bp, Mus musculus
tgactctacactcgcctgctcttac

SEQ ID NO: 798259 - DNA, 25 bp, Mus musculus
tgactctacactggcctgctcttac

SEQ ID NO: 798260 - DNA, 25 bp, Mus musculus
tgactctccactattgatctgaacc

SEQ ID NO: 798261 - DNA, 25 bp, Mus musculus
tgactctccacttttgatctgaacc

SEQ ID NO: 798262 - DNA, 25 bp, Mus musculus
tgactctccagaatgtccaaggctg

SEQ ID NO: 798263 - DNA, 25 bp, Mus musculus
tgactctccagattgtccaaggctg

SEQ ID NO: 798264 - DNA, 25 bp, Mus musculus
tgactctcgggcagttcaggtgagt

SEQ ID NO: 798265 - DNA, 25 bp, Mus musculus
tgactctcgggctgttcaggtgagt

SEQ ID NO: 798266 - DNA, 25 bp, Mus musculus
tgactctctgacagacctggtggag

SEQ ID NO: 798267 - DNA, 25 bp, Mus musculus
tgactctctgactgacctggtggag

SEQ ID NO: 798268 - DNA, 25 bp, Mus musculus
tgactctcttaccagctggtcactg

SEQ ID NO: 798269 - DNA, 25 bp, Mus musculus
tgactctcttacgagctggtcactg

SEQ ID NO: 798270 - DNA, 25 bp, Mus musculus
tgactctgaacaatgtggaagtctg

SEQ ID NO: 798271 - DNA, 25 bp, Mus musculus
tgactctgaacattgtggaagtctg

SEQ ID NO: 798272 - DNA, 25 bp, Mus musculus
tgactctgatggaatctctaagcaa

SEQ ID NO: 798273 - DNA, 25 bp, Mus musculus
tgactctgatggtatctctaagcaa

SEQ ID NO: 798274 - DNA, 25 bp, Mus musculus
tgactctgattcacatagctgtctg

SEQ ID NO: 798275 - DNA, 25 bp, Mus musculus
tgactctgattctcatagctgtctg

SEQ ID NO: 798276 - DNA, 25 bp, Mus musculus
tgactctgcgcacggtattattgtc

SEQ ID NO: 798277 - DNA, 25 bp, Mus musculus
tgactctgcgcagggtattattgtc

SEQ ID NO: 798278 - DNA, 25 bp, Mus musculus
tgactctgctccagcgggcagggct

SEQ ID NO: 798279 - DNA, 25 bp, Mus musculus
tgactctgctcctgcgggcagggct

SEQ ID NO: 798280 - DNA, 25 bp, Mus musculus
tgactctgctctcagcgcaaaggtg

SEQ ID NO: 798281 - DNA, 25 bp, Mus musculus
tgactctgctctgagcgcaaaggtg

SEQ ID NO: 798282 - DNA, 25 bp, Mus musculus
tgactctgcttgacttttggttgca

SEQ ID NO: 798283 - DNA, 25 bp, Mus musculus
tgactctgcttgtcttttggttgca

SEQ ID NO: 798284 - DNA, 25 bp, Mus musculus
tgactctgctttcgattataatgag

SEQ ID NO: 798285 - DNA, 25 bp, Mus musculus
tgactctgctttggattataatgag

SEQ ID NO: 798286 - DNA, 25 bp, Mus musculus
tgactctggctacaccccaatggat

SEQ ID NO: 798287 - DNA, 25 bp, Mus musculus
tgactctggctagaccccaatggat

SEQ ID NO: 798288 - DNA, 25 bp, Mus musculus
tgactctggcttagccatgctgggt

SEQ ID NO: 798289 - DNA, 25 bp, Mus musculus
tgactctggctttgccatgctgggt

SEQ ID NO: 798290 - DNA, 25 bp, Mus musculus
tgactctgggttattgggatatccg

SEQ ID NO: 798291 - DNA, 25 bp, Mus musculus
tgactctgggtttttgggatatccg

SEQ ID NO: 798292 - DNA, 25 bp, Mus musculus
tgactcttaagaagcagaattgttt

SEQ ID NO: 798293 - DNA, 25 bp, Mus musculus
tgactcttaagatgcagaattgttt

SEQ ID NO: 798294 - DNA, 25 bp, Mus musculus
tgactcttataaaccacagagaacc

SEQ ID NO: 798295 - DNA, 25 bp, Mus musculus
tgactcttataatccacagagaacc

SEQ ID NO: 798296 - DNA, 25 bp, Mus musculus
tgactcttatgaagatcgatttcaa

SEQ ID NO: 798297 - DNA, 25 bp, Mus musculus
tgactcttatgatgatcgatttcaa

SEQ ID NO: 798298 - DNA, 25 bp, Mus musculus
tgactctttcttcccacgatgctac

SEQ ID NO: 798299 - DNA, 25 bp, Mus musculus
tgactctttcttgccacgatgctac

SEQ ID NO: 798300 - DNA, 25 bp, Mus musculus
tgactgaaagtcaggatgcagacca

SEQ ID NO: 798301 - DNA, 25 bp, Mus musculus
tgactgaaagtctggatgcagacca

SEQ ID NO: 798302 - DNA, 25 bp, Mus musculus
tgactgaagaccagatcctgccgct

SEQ ID NO: 798303 - DNA, 25 bp, Mus musculus
tgactgaagacctgatcctgccgct

SEQ ID NO: 798304 - DNA, 25 bp, Mus musculus
tgactgaagcccacgtacacgggta

SEQ ID NO: 798305 - DNA, 25 bp, Mus musculus
tgactgaagccctcgtacacgggta

SEQ ID NO: 798306 - DNA, 25 bp, Mus musculus
tgactgaattggaggacaagtttga

SEQ ID NO: 798307 - DNA, 25 bp, Mus musculus
tgactgaattggtggacaagtttga

SEQ ID NO: 798308 - DNA, 25 bp, Mus musculus
tgactgacccatctgtaataaaagc

SEQ ID NO: 798309 - DNA, 25 bp, Mus musculus
tgactgacccatgtgtaataaaagc

SEQ ID NO: 798310 - DNA, 25 bp, Mus musculus
tgactgacccttcgctctccgagat

SEQ ID NO: 798311 - DNA, 25 bp, Mus musculus
tgactgacccttggctctccgagat

SEQ ID NO: 798312 - DNA, 25 bp, Mus musculus
tgactgaccggtcccagctggacat

SEQ ID NO: 798313 - DNA, 25 bp, Mus musculus
tgactgaccggtgccagctggacat

SEQ ID NO: 798314 - DNA, 25 bp, Mus musculus
tgactgacgcacagaagaataagct

SEQ ID NO: 798315 - DNA, 25 bp, Mus musculus
tgactgacgcactgaagaataagct

SEQ ID NO: 798316 - DNA, 25 bp, Mus musculus
tgactgacgtccctgttgacccagg

SEQ ID NO: 798317 - DNA, 25 bp, Mus musculus
tgactgacgtccgtgttgacccagg

SEQ ID NO: 798318 - DNA, 25 bp, Mus musculus
tgactgactacgactcaagtgaacg

SEQ ID NO: 798319 - DNA, 25 bp, Mus musculus
tgactgactacgtctcaagtgaacg

SEQ ID NO: 798320 - DNA, 25 bp, Mus musculus
tgactgagaaacaaggtacaacctt

SEQ ID NO: 798321 - DNA, 25 bp, Mus musculus
tgactgagaaactaggtacaacctt

SEQ ID NO: 798322 - DNA, 25 bp, Mus musculus
tgactgagctagaaagagtgtcaca

SEQ ID NO: 798323 - DNA, 25 bp, Mus musculus
tgactgagctagtaagagtgtcaca

SEQ ID NO: 798324 - DNA, 25 bp, Mus musculus
tgactgagctctcccgggtagaacc

SEQ ID NO: 798325 - DNA, 25 bp, Mus musculus
tgactgagctctgccgggtagaacc

SEQ ID NO: 798326 - DNA, 25 bp, Mus musculus
tgactgagtcctacccctgaatctg

SEQ ID NO: 798327 - DNA, 25 bp, Mus musculus
tgactgagtccttcccctgaatctg

SEQ ID NO: 798328 - DNA, 25 bp, Mus musculus
tgactgagtcgacctgtgtggcccc

SEQ ID NO: 798329 - DNA, 25 bp, Mus musculus
tgactgagtcgagctgtgtggcccc

SEQ ID NO: 798330 - DNA, 25 bp, Mus musculus
tgactgatcatacccatggccgcta

SEQ ID NO: 798331 - DNA, 25 bp, Mus musculus
tgactgatcatagccatggccgcta

SEQ ID NO: 798332 - DNA, 25 bp, Mus musculus
tgactgatggcaacaccctctacag

SEQ ID NO: 798333 - DNA, 25 bp, Mus musculus
tgactgatggcatcaccctctacag

SEQ ID NO: 798334 - DNA, 25 bp, Mus musculus
tgactgcaacgccaaagcctatcct

SEQ ID NO: 798335 - DNA, 25 bp, Mus musculus
tgactgcaacgcgaaagcctatcct

SEQ ID NO: 798336 - DNA, 25 bp, Mus musculus
tgactgcacagtcttcgaggctgga

SEQ ID NO: 798337 - DNA, 25 bp, Mus musculus
tgactgcacagtgttcgaggctgga

SEQ ID NO: 798338 - DNA, 25 bp, Mus musculus
tgactgcagaagagcgtcaagaact

SEQ ID NO: 798339 - DNA, 25 bp, Mus musculus
tgactgcagaagtgcgtcaagaact

SEQ ID NO: 798340 - DNA, 25 bp, Mus musculus
tgactgcagaggaataagaggataa

SEQ ID NO: 798341 - DNA, 25 bp, Mus musculus
tgactgcagaggtataagaggataa

SEQ ID NO: 798342 - DNA, 25 bp, Mus musculus
tgactgcaggccagaagattcggca

SEQ ID NO: 798343 - DNA, 25 bp, Mus musculus
tgactgcaggcctgaagattcggca

SEQ ID NO: 798344 - DNA, 25 bp, Mus musculus
tgactgcatcaaaaccaatggttcc

SEQ ID NO: 798345 - DNA, 25 bp, Mus musculus
tgactgcatcaataccaatggttcc

SEQ ID NO: 798346 - DNA, 25 bp, Mus musculus
tgactgcatcacacccgggctgtat

SEQ ID NO: 798347 - DNA, 25 bp, Mus musculus
tgactgcatcactcccgggctgtat

SEQ ID NO: 798348 - DNA, 25 bp, Mus musculus
tgactgcatttgcaacaactccaga

SEQ ID NO: 798349 - DNA, 25 bp, Mus musculus
tgactgcatttggaacaactccaga

SEQ ID NO: 798350 - DNA, 25 bp, Mus musculus
tgactgccacgtcctcagcaggaag

SEQ ID NO: 798351 - DNA, 25 bp, Mus musculus
tgactgccacgtgctcagcaggaag

SEQ ID NO: 798352 - DNA, 25 bp, Mus musculus
tgactgccagcaacgctgtctgtgc

SEQ ID NO: 798353 - DNA, 25 bp, Mus musculus
tgactgccagcatcgctgtctgtgc

SEQ ID NO: 798354 - DNA, 25 bp, Mus musculus
tgactgccagtgaatcgatgtgagc

SEQ ID NO: 798355 - DNA, 25 bp, Mus musculus
tgactgccagtgtatcgatgtgagc

SEQ ID NO: 798356 - DNA, 25 bp, Mus musculus
tgactgccccagctttgcaaattga

SEQ ID NO: 798357 - DNA, 25 bp, Mus musculus
tgactgccccaggtttgcaaattga

SEQ ID NO: 798358 - DNA, 25 bp, Mus musculus
tgactgcccggcaatgcatctggtc

SEQ ID NO: 798359 - DNA, 25 bp, Mus musculus
tgactgcccggctatgcatctggtc

SEQ ID NO: 798360 - DNA, 25 bp, Mus musculus
tgactgcccttacatcgttcagtgc

SEQ ID NO: 798361 - DNA, 25 bp, Mus musculus
tgactgcccttagatcgttcagtgc

SEQ ID NO: 798362 - DNA, 25 bp, Mus musculus
tgactgccgtatcctacctgaaggg

SEQ ID NO: 798363 - DNA, 25 bp, Mus musculus
tgactgccgtatgctacctgaaggg

SEQ ID NO: 798364 - DNA, 25 bp, Mus musculus
tgactgcctcttacattcgcccgga

SEQ ID NO: 798365 - DNA, 25 bp, Mus musculus
tgactgcctctttcattcgcccgga

SEQ ID NO: 798366 - DNA, 25 bp, Mus musculus
tgactgcgccccaagtggatgagag

SEQ ID NO: 798367 - DNA, 25 bp, Mus musculus
tgactgcgcccctagtggatgagag

SEQ ID NO: 798368 - DNA, 25 bp, Mus musculus
tgactgctcatcatggcacaggcct

SEQ ID NO: 798369 - DNA, 25 bp, Mus musculus
tgactgctcatcttggcacaggcct

SEQ ID NO: 798370 - DNA, 25 bp, Mus musculus
tgactgctctccatcctgttatgca

SEQ ID NO: 798371 - DNA, 25 bp, Mus musculus
tgactgctctccttcctgttatgca

SEQ ID NO: 798372 - DNA, 25 bp, Mus musculus
tgactgctgagccactggtcctcag

SEQ ID NO: 798373 - DNA, 25 bp, Mus musculus
tgactgctgagcgactggtcctcag

SEQ ID NO: 798374 - DNA, 25 bp, Mus musculus
tgactgctggctcggcctcttctgc

SEQ ID NO: 798375 - DNA, 25 bp, Mus musculus
tgactgctggctgggcctcttctgc

SEQ ID NO: 798376 - DNA, 25 bp, Mus musculus
tgactgcttcaaaaagtactgttgg

SEQ ID NO: 798377 - DNA, 25 bp, Mus musculus
tgactgcttcaataagtactgttgg

SEQ ID NO: 798378 - DNA, 25 bp, Mus musculus
tgactgcttcatccaactttcaaat

SEQ ID NO: 798379 - DNA, 25 bp, Mus musculus
tgactgcttcatgcaactttcaaat

SEQ ID NO: 798380 - DNA, 25 bp, Mus musculus
tgactgctttggaggccaaaatctg

SEQ ID NO: 798381 - DNA, 25 bp, Mus musculus
tgactgctttggtggccaaaatctg

SEQ ID NO: 798382 - DNA, 25 bp, Mus musculus
tgactggaagctagaccaacctgat

SEQ ID NO: 798383 - DNA, 25 bp, Mus musculus
tgactggaagcttgaccaacctgat

SEQ ID NO: 798384 - DNA, 25 bp, Mus musculus
tgactggaatccctttctgctaatg

SEQ ID NO: 798385 - DNA, 25 bp, Mus musculus
tgactggaatccgtttctgctaatg

SEQ ID NO: 798386 - DNA, 25 bp, Mus musculus
tgactggaggcaaaagctctgagat

SEQ ID NO: 798387 - DNA, 25 bp, Mus musculus
tgactggaggcataagctctgagat

SEQ ID NO: 798388 - DNA, 25 bp, Mus musculus
tgactggatcatcttcaggaactgg

SEQ ID NO: 798389 - DNA, 25 bp, Mus musculus
tgactggatcatgttcaggaactgg

SEQ ID NO: 798390 - DNA, 25 bp, Mus musculus
tgactggcagcgcaaagctcacatg

SEQ ID NO: 798391 - DNA, 25 bp, Mus musculus
tgactggcagcggaaagctcacatg

SEQ ID NO: 798392 - DNA, 25 bp, Mus musculus
tgactggccactacaggggagagat

SEQ ID NO: 798393 - DNA, 25 bp, Mus musculus
tgactggccacttcaggggagagat

SEQ ID NO: 798394 - DNA, 25 bp, Mus musculus
tgactggccagcaacgtccagagat

SEQ ID NO: 798395 - DNA, 25 bp, Mus musculus
tgactggccagctacgtccagagat

SEQ ID NO: 798396 - DNA, 25 bp, Mus musculus
tgactggccggaaggataccagctt

SEQ ID NO: 798397 - DNA, 25 bp, Mus musculus
tgactggccggatggataccagctt

SEQ ID NO: 798398 - DNA, 25 bp, Mus musculus
tgactggctctgaatatgagacgat

SEQ ID NO: 798399 - DNA, 25 bp, Mus musculus
tgactggctctgtatatgagacgat

SEQ ID NO: 798400 - DNA, 25 bp, Mus musculus
tgactgggatacaccagctgactca

SEQ ID NO: 798401 - DNA, 25 bp, Mus musculus
tgactgggatactccagctgactca

SEQ ID NO: 798402 - DNA, 25 bp, Mus musculus
tgactgggcactccacgaggcagaa

SEQ ID NO: 798403 - DNA, 25 bp, Mus musculus
tgactgggcactgcacgaggcagaa

SEQ ID NO: 798404 - DNA, 25 bp, Mus musculus
tgactgggccctccaagcaaacata

SEQ ID NO: 798405 - DNA, 25 bp, Mus musculus
tgactgggccctgcaagcaaacata

SEQ ID NO: 798406 - DNA, 25 bp, Mus musculus
tgactgggctcacccatttggcagg

SEQ ID NO: 798407 - DNA, 25 bp, Mus musculus
tgactgggctcagccatttggcagg

SEQ ID NO: 798408 - DNA, 25 bp, Mus musculus
tgactgggctgcactcgggcacact

SEQ ID NO: 798409 - DNA, 25 bp, Mus musculus
tgactgggctgctctcgggcacact

SEQ ID NO: 798410 - DNA, 25 bp, Mus musculus
tgactgggctgtctaggagctcctt

SEQ ID NO: 798411 - DNA, 25 bp, Mus musculus
tgactgggctgtgtaggagctcctt

SEQ ID NO: 798412 - DNA, 25 bp, Mus musculus
tgactggtaccaaggtgccatcccc

SEQ ID NO: 798413 - DNA, 25 bp, Mus musculus
tgactggtaccatggtgccatcccc

SEQ ID NO: 798414 - DNA, 25 bp, Mus musculus
tgactggtacggatggttcccaccc

SEQ ID NO: 798415 - DNA, 25 bp, Mus musculus
tgactggtacggttggttcccaccc

SEQ ID NO: 798416 - DNA, 25 bp, Mus musculus
tgactggtccatcggcatcgctggt

SEQ ID NO: 798417 - DNA, 25 bp, Mus musculus
tgactggtccatgggcatcgctggt

SEQ ID NO: 798418 - DNA, 25 bp, Mus musculus
tgactgtaacgcacatagatgccaa

SEQ ID NO: 798419 - DNA, 25 bp, Mus musculus
tgactgtaacgctcatagatgccaa

SEQ ID NO: 798420 - DNA, 25 bp, Mus musculus
tgactgtaactcaaaggagcccaac

SEQ ID NO: 798421 - DNA, 25 bp, Mus musculus
tgactgtaactctaaggagcccaac

SEQ ID NO: 798422 - DNA, 25 bp, Mus musculus
tgactgtaccaacactctaaatgac

SEQ ID NO: 798423 - DNA, 25 bp, Mus musculus
tgactgtaccaagactctaaatgac

SEQ ID NO: 798424 - DNA, 25 bp, Mus musculus
tgactgtacccaagatgaggatgcc

SEQ ID NO: 798425 - DNA, 25 bp, Mus musculus
tgactgtacccatgatgaggatgcc

SEQ ID NO: 798426 - DNA, 25 bp, Mus musculus
tgactgtcaagacctctggctcaag

SEQ ID NO: 798427 - DNA, 25 bp, Mus musculus
tgactgtcaagagctctggctcaag

SEQ ID NO: 798428 - DNA, 25 bp, Mus musculus
tgactgtcatccagaatttctgcca

SEQ ID NO: 798429 - DNA, 25 bp, Mus musculus
tgactgtcatcctgaatttctgcca

SEQ ID NO: 798430 - DNA, 25 bp, Mus musculus
tgactgtcctggatgcatgcacacc

SEQ ID NO: 798431 - DNA, 25 bp, Mus musculus
tgactgtcctggttgcatgcacacc

SEQ ID NO: 798432 - DNA, 25 bp, Mus musculus
tgactgtcgctaagttcatgggcct

SEQ ID NO: 798433 - DNA, 25 bp, Mus musculus
tgactgtcgctatgttcatgggcct

SEQ ID NO: 798434 - DNA, 25 bp, Mus musculus
tgactgtgaaaacattagagggaaa

SEQ ID NO: 798435 - DNA, 25 bp, Mus musculus
tgactgtgaaaagattagagggaaa

SEQ ID NO: 798436 - DNA, 25 bp, Mus musculus
tgactgtgacccagagcctctgtca

SEQ ID NO: 798437 - DNA, 25 bp, Mus musculus
tgactgtgaccctgagcctctgtca

SEQ ID NO: 798438 - DNA, 25 bp, Mus musculus
tgactgtgagccactgtctagtgtg

SEQ ID NO: 798439 - DNA, 25 bp, Mus musculus
tgactgtgagcctctgtctagtgtg

SEQ ID NO: 798440 - DNA, 25 bp, Mus musculus
tgactgtgccacacaggccatggag

SEQ ID NO: 798441 - DNA, 25 bp, Mus musculus
tgactgtgccactcaggccatggag

SEQ ID NO: 798442 - DNA, 25 bp, Mus musculus
tgactgtgcccaagagctacggcgt

SEQ ID NO: 798443 - DNA, 25 bp, Mus musculus
tgactgtgcccatgagctacggcgt

SEQ ID NO: 798444 - DNA, 25 bp, Mus musculus
tgactgtgccctcgtcatctctgga

SEQ ID NO: 798445 - DNA, 25 bp, Mus musculus
tgactgtgccctggtcatctctgga

SEQ ID NO: 798446 - DNA, 25 bp, Mus musculus
tgactgtgcgctagctctcccgcgg

SEQ ID NO: 798447 - DNA, 25 bp, Mus musculus
tgactgtgcgcttgctctcccgcgg

SEQ ID NO: 798448 - DNA, 25 bp, Mus musculus
tgactgtgcggcagaatgtccacaa

SEQ ID NO: 798449 - DNA, 25 bp, Mus musculus
tgactgtgcggctgaatgtccacaa

SEQ ID NO: 798450 - DNA, 25 bp, Mus musculus
tgactgtgctcgagccatagcgcct

SEQ ID NO: 798451 - DNA, 25 bp, Mus musculus
tgactgtgctcgtgccatagcgcct

SEQ ID NO: 798452 - DNA, 25 bp, Mus musculus
tgactgtggactacattagaccagc

SEQ ID NO: 798453 - DNA, 25 bp, Mus musculus
tgactgtggactagtgagcattttt

SEQ ID NO: 798454 - DNA, 25 bp, Mus musculus
tgactgtggacttcattagaccagc

SEQ ID NO: 798455 - DNA, 25 bp, Mus musculus
tgactgtggacttgtgagcattttt

SEQ ID NO: 798456 - DNA, 25 bp, Mus musculus
tgactgtgggtgatacctccctgag

SEQ ID NO: 798457 - DNA, 25 bp, Mus musculus
tgactgtgggtgttacctccctgag

SEQ ID NO: 798458 - DNA, 25 bp, Mus musculus
tgactgtgtcaactacaattgcacg

SEQ ID NO: 798459 - DNA, 25 bp, Mus musculus
tgactgtgtcaagtacaattgcacg

SEQ ID NO: 798460 - DNA, 25 bp, Mus musculus
tgactgttcatcatcaaagtgaaaa

SEQ ID NO: 798461 - DNA, 25 bp, Mus musculus
tgactgttcatcttcaaagtgaaaa

SEQ ID NO: 798462 - DNA, 25 bp, Mus musculus
tgactgttctgccaccagtgaccgg

SEQ ID NO: 798463 - DNA, 25 bp, Mus musculus
tgactgttctgcgaccagtgaccgg

SEQ ID NO: 798464 - DNA, 25 bp, Mus musculus
tgactgttgtctctaaaggcttccc

SEQ ID NO: 798465 - DNA, 25 bp, Mus musculus
tgactgttgtctgtaaaggcttccc

SEQ ID NO: 798466 - DNA, 25 bp, Mus musculus
tgactgtttaccaggtccctatcca

SEQ ID NO: 798467 - DNA, 25 bp, Mus musculus
tgactgtttacctggtccctatcca

SEQ ID NO: 798468 - DNA, 25 bp, Mus musculus
tgacttaaccacactgacatcagct

SEQ ID NO: 798469 - DNA, 25 bp, Mus musculus
tgacttaaccactctgacatcagct

SEQ ID NO: 798470 - DNA, 25 bp, Mus musculus
tgacttacatatcggctttctcttc

SEQ ID NO: 798471 - DNA, 25 bp, Mus musculus
tgacttacatatgggctttctcttc

SEQ ID NO: 798472 - DNA, 25 bp, Mus musculus
tgacttacatctagaccctacttac

SEQ ID NO: 798473 - DNA, 25 bp, Mus musculus
tgacttacatcttgaccctacttac

SEQ ID NO: 798474 - DNA, 25 bp, Mus musculus
tgacttatatccaggacaaaagtat

SEQ ID NO: 798475 - DNA, 25 bp, Mus musculus
tgacttatatcctggacaaaagtat

SEQ ID NO: 798476 - DNA, 25 bp, Mus musculus
tgacttatcagcaagcaacactgag

SEQ ID NO: 798477 - DNA, 25 bp, Mus musculus
tgacttatcagctagcaacactgag

SEQ ID NO: 798478 - DNA, 25 bp, Mus musculus
tgacttcaaccaccttttggcagca

SEQ ID NO: 798479 - DNA, 25 bp, Mus musculus
tgacttcaaccagcttttggcagca

SEQ ID NO: 798480 - DNA, 25 bp, Mus musculus
tgacttcaagctcaggattctcctg

SEQ ID NO: 798481 - DNA, 25 bp, Mus musculus
tgacttcaagctgaggattctcctg

SEQ ID NO: 798482 - DNA, 25 bp, Mus musculus
tgacttcaatccagccacggtcaac

SEQ ID NO: 798483 - DNA, 25 bp, Mus musculus
tgacttcaatcctgccacggtcaac

SEQ ID NO: 798484 - DNA, 25 bp, Mus musculus
tgacttcaccaacaatgcaatgaag

SEQ ID NO: 798485 - DNA, 25 bp, Mus musculus
tgacttcaccaagaatgcaatgaag

SEQ ID NO: 798486 - DNA, 25 bp, Mus musculus
tgacttcacggcaggccaggactgt

SEQ ID NO: 798487 - DNA, 25 bp, Mus musculus
tgacttcacggctggccaggactgt

SEQ ID NO: 798488 - DNA, 25 bp, Mus musculus
tgacttcactaacattcccaatggg

SEQ ID NO: 798489 - DNA, 25 bp, Mus musculus
tgacttcactaagattcccaatggg

SEQ ID NO: 798490 - DNA, 25 bp, Mus musculus
tgacttcactgcaagggccttggga

SEQ ID NO: 798491 - DNA, 25 bp, Mus musculus
tgacttcactgctagggccttggga

SEQ ID NO: 798492 - DNA, 25 bp, Mus musculus
tgacttcagagacaaaggaggctac

SEQ ID NO: 798493 - DNA, 25 bp, Mus musculus
tgacttcagagagaaaggaggctac

SEQ ID NO: 798494 - DNA, 25 bp, Mus musculus
tgacttcagaggctcagatgcactg

SEQ ID NO: 798495 - DNA, 25 bp, Mus musculus
tgacttcagagggtcagatgcactg

SEQ ID NO: 798496 - DNA, 25 bp, Mus musculus
tgacttcagattctgagtgctggga

SEQ ID NO: 798497 - DNA, 25 bp, Mus musculus
tgacttcagattgtgagtgctggga

SEQ ID NO: 798498 - DNA, 25 bp, Mus musculus
tgacttcagcatcttgaggaccctg

SEQ ID NO: 798499 - DNA, 25 bp, Mus musculus
tgacttcagcatgttgaggaccctg

SEQ ID NO: 798500 - DNA, 25 bp, Mus musculus
tgacttcagccaaatcaacggcact

SEQ ID NO: 798501 - DNA, 25 bp, Mus musculus
tgacttcagccatatcaacggcact

SEQ ID NO: 798502 - DNA, 25 bp, Mus musculus
tgacttcagccccaactgcaaacaa

SEQ ID NO: 798503 - DNA, 25 bp, Mus musculus
tgacttcagcccgaactgcaaacaa

SEQ ID NO: 798504 - DNA, 25 bp, Mus musculus
tgacttcagggcatcgagaacccct

SEQ ID NO: 798505 - DNA, 25 bp, Mus musculus
tgacttcagggcttcgagaacccct

SEQ ID NO: 798506 - DNA, 25 bp, Mus musculus
tgacttcagttccaaacagattgcc

SEQ ID NO: 798507 - DNA, 25 bp, Mus musculus
tgacttcagttcgaaacagattgcc

SEQ ID NO: 798508 - DNA, 25 bp, Mus musculus
tgacttcatagaatgtggtggtttg

SEQ ID NO: 798509 - DNA, 25 bp, Mus musculus
tgacttcatagattgtggtggtttg

SEQ ID NO: 798510 - DNA, 25 bp, Mus musculus
tgacttcatcggaggctttgactcc

SEQ ID NO: 798511 - DNA, 25 bp, Mus musculus
tgacttcatcggtggctttgactcc

SEQ ID NO: 798512 - DNA, 25 bp, Mus musculus
tgacttcatggtcttcacacttcgg

SEQ ID NO: 798513 - DNA, 25 bp, Mus musculus
tgacttcatggtgttcacacttcgg

SEQ ID NO: 798514 - DNA, 25 bp, Mus musculus
tgacttccacaccagcactttgagg

SEQ ID NO: 798515 - DNA, 25 bp, Mus musculus
tgacttccacacgagcactttgagg

SEQ ID NO: 798516 - DNA, 25 bp, Mus musculus
tgacttccagagaagggctcacgcc

SEQ ID NO: 798517 - DNA, 25 bp, Mus musculus
tgacttccagagtagggctcacgcc

SEQ ID NO: 798518 - DNA, 25 bp, Mus musculus
tgacttccatttctccccacgtatg

SEQ ID NO: 798519 - DNA, 25 bp, Mus musculus
tgacttccatttgtccccacgtatg

SEQ ID NO: 798520 - DNA, 25 bp, Mus musculus
tgacttcccattaaacggtggcgga

SEQ ID NO: 798521 - DNA, 25 bp, Mus musculus
tgacttcccatttaacggtggcgga

SEQ ID NO: 798522 - DNA, 25 bp, Mus musculus
tgacttcctgtactctcaccggagc

SEQ ID NO: 798523 - DNA, 25 bp, Mus musculus
tgacttcctgtagtctcaccggagc

SEQ ID NO: 798524 - DNA, 25 bp, Mus musculus
tgacttcgagagcatcgtgcacaag

SEQ ID NO: 798525 - DNA, 25 bp, Mus musculus
tgacttcgagaggatcgtgcacaag

SEQ ID NO: 798526 - DNA, 25 bp, Mus musculus
tgacttcgaggtccggcaactgctc

SEQ ID NO: 798527 - DNA, 25 bp, Mus musculus
tgacttcgaggtgcggcaactgctc

SEQ ID NO: 798528 - DNA, 25 bp, Mus musculus
tgacttcgctagacggtgacgcggc

SEQ ID NO: 798529 - DNA, 25 bp, Mus musculus
tgacttcgctagtcggtgacgcggc

SEQ ID NO: 798530 - DNA, 25 bp, Mus musculus
tgacttcggccaagatgtgggtgct

SEQ ID NO: 798531 - DNA, 25 bp, Mus musculus
tgacttcggccatgatgtgggtgct

SEQ ID NO: 798532 - DNA, 25 bp, Mus musculus
tgacttcggcttccactcaaaggcg

SEQ ID NO: 798533 - DNA, 25 bp, Mus musculus
tgacttcggcttgcactcaaaggcg

SEQ ID NO: 798534 - DNA, 25 bp, Mus musculus
tgacttctacccatggctccatgcc

SEQ ID NO: 798535 - DNA, 25 bp, Mus musculus
tgacttctacccttggctccatgcc

SEQ ID NO: 798536 - DNA, 25 bp, Mus musculus
tgacttctagagactgtgaagcctc

SEQ ID NO: 798537 - DNA, 25 bp, Mus musculus
tgacttctagagtctgtgaagcctc

SEQ ID NO: 798538 - DNA, 25 bp, Mus musculus
tgacttctccagaaaacgacagtaa

SEQ ID NO: 798539 - DNA, 25 bp, Mus musculus
tgacttctccagtaaacgacagtaa

SEQ ID NO: 798540 - DNA, 25 bp, Mus musculus
tgacttctcgtcactcccaaggttt

SEQ ID NO: 798541 - DNA, 25 bp, Mus musculus
tgacttctcgtctctcccaaggttt

SEQ ID NO: 798542 - DNA, 25 bp, Mus musculus
tgacttctgcatccgatgcttcagc

SEQ ID NO: 798543 - DNA, 25 bp, Mus musculus
tgacttctgcatgcgatgcttcagc

SEQ ID NO: 798544 - DNA, 25 bp, Mus musculus
tgacttcttagaacgggtagccgaa

SEQ ID NO: 798545 - DNA, 25 bp, Mus musculus
tgacttcttagatcgggtagccgaa

SEQ ID NO: 798546 - DNA, 25 bp, Mus musculus
tgacttcttagcacactcatcagaa

SEQ ID NO: 798547 - DNA, 25 bp, Mus musculus
tgacttcttagctcactcatcagaa

SEQ ID NO: 798548 - DNA, 25 bp, Mus musculus
tgacttcttattcgcactggagcgc

SEQ ID NO: 798549 - DNA, 25 bp, Mus musculus
tgacttcttattggcactggagcgc

SEQ ID NO: 798550 - DNA, 25 bp, Mus musculus
tgacttcttggtccgagagagcacg

SEQ ID NO: 798551 - DNA, 25 bp, Mus musculus
tgacttcttggtgcgagagagcacg

SEQ ID NO: 798552 - DNA, 25 bp, Mus musculus
tgacttctttgaccagcaggatgaa

SEQ ID NO: 798553 - DNA, 25 bp, Mus musculus
tgacttctttgagcagcaggatgaa

SEQ ID NO: 798554 - DNA, 25 bp, Mus musculus
tgacttgaaagacggtaaaaataag

SEQ ID NO: 798555 - DNA, 25 bp, Mus musculus
tgacttgaaagagggtaaaaataag

SEQ ID NO: 798556 - DNA, 25 bp, Mus musculus
tgacttgaacaacctagcccaaaca

SEQ ID NO: 798557 - DNA, 25 bp, Mus musculus
tgacttgaacaagctagcccaaaca

SEQ ID NO: 798558 - DNA, 25 bp, Mus musculus
tgacttgaccgccatctgtgatgcc

SEQ ID NO: 798559 - DNA, 25 bp, Mus musculus
tgacttgaccgcgatctgtgatgcc

SEQ ID NO: 798560 - DNA, 25 bp, Mus musculus
tgacttgagtaaccctccatgtcgg

SEQ ID NO: 798561 - DNA, 25 bp, Mus musculus
tgacttgagtaagcctccatgtcgg

SEQ ID NO: 798562 - DNA, 25 bp, Mus musculus
tgacttgcccatctggtggcagatc

SEQ ID NO: 798563 - DNA, 25 bp, Mus musculus
tgacttgcccatgtggtggcagatc

SEQ ID NO: 798564 - DNA, 25 bp, Mus musculus
tgacttggaaagaactagaaggaca

SEQ ID NO: 798565 - DNA, 25 bp, Mus musculus
tgacttggaaagtactagaaggaca

SEQ ID NO: 798566 - DNA, 25 bp, Mus musculus
tgacttggacacacaggagagcgtg

SEQ ID NO: 798567 - DNA, 25 bp, Mus musculus
tgacttggacactcaggagagcgtg

SEQ ID NO: 798568 - DNA, 25 bp, Mus musculus
tgacttggagcactgggaccgcacc

SEQ ID NO: 798569 - DNA, 25 bp, Mus musculus
tgacttggagcagtgggaccgcacc

SEQ ID NO: 798570 - DNA, 25 bp, Mus musculus
tgacttggatgtcctcctgagagct

SEQ ID NO: 798571 - DNA, 25 bp, Mus musculus
tgacttggatgtgctcctgagagct

SEQ ID NO: 798572 - DNA, 25 bp, Mus musculus
tgacttggcccaccaaatacaagtt

SEQ ID NO: 798573 - DNA, 25 bp, Mus musculus
tgacttggcccagcaaatacaagtt

SEQ ID NO: 798574 - DNA, 25 bp, Mus musculus
tgacttgggtaaaatgagcatccgc

SEQ ID NO: 798575 - DNA, 25 bp, Mus musculus
tgacttgggtaatatgagcatccgc

SEQ ID NO: 798576 - DNA, 25 bp, Mus musculus
tgacttgttcaacgccgcctgcctg

SEQ ID NO: 798577 - DNA, 25 bp, Mus musculus
tgacttgttcaaggccgcctgcctg

SEQ ID NO: 798578 - DNA, 25 bp, Mus musculus
tgacttgttcacatgtggcaaatgt

SEQ ID NO: 798579 - DNA, 25 bp, Mus musculus
tgacttgttcacttgtggcaaatgt

SEQ ID NO: 798580 - DNA, 25 bp, Mus musculus
tgactttaaaaccataatccgggct

SEQ ID NO: 798581 - DNA, 25 bp, Mus musculus
tgactttaaaacgataatccgggct

SEQ ID NO: 798582 - DNA, 25 bp, Mus musculus
tgactttagtcaccgacagaaggac

SEQ ID NO: 798583 - DNA, 25 bp, Mus musculus
tgactttagtcagcgacagaaggac

SEQ ID NO: 798584 - DNA, 25 bp, Mus musculus
tgactttatgttccccagggaaatc

SEQ ID NO: 798585 - DNA, 25 bp, Mus musculus
tgactttatgttgcccagggaaatc

SEQ ID NO: 798586 - DNA, 25 bp, Mus musculus
tgactttccaggctcctgagaaggg

SEQ ID NO: 798587 - DNA, 25 bp, Mus musculus
tgactttccagggtcctgagaaggg

SEQ ID NO: 798588 - DNA, 25 bp, Mus musculus
tgactttccctaactgtgacctgtc

SEQ ID NO: 798589 - DNA, 25 bp, Mus musculus
tgactttccctatctgtgacctgtc

SEQ ID NO: 798590 - DNA, 25 bp, Mus musculus
tgactttgaactcccaagccaggag

SEQ ID NO: 798591 - DNA, 25 bp, Mus musculus
tgactttgaactgccaagccaggag

SEQ ID NO: 798592 - DNA, 25 bp, Mus musculus
tgactttgaagaagcgttcactgcc

SEQ ID NO: 798593 - DNA, 25 bp, Mus musculus
tgactttgaagatgcgttcactgcc

SEQ ID NO: 798594 - DNA, 25 bp, Mus musculus
tgactttgaggcacgcagccgtaga

SEQ ID NO: 798595 - DNA, 25 bp, Mus musculus
tgactttgaggctcgcagccgtaga

SEQ ID NO: 798596 - DNA, 25 bp, Mus musculus
tgactttgccaaaatccctgacctg

SEQ ID NO: 798597 - DNA, 25 bp, Mus musculus
tgactttgccaatatccctgacctg

SEQ ID NO: 798598 - DNA, 25 bp, Mus musculus
tgactttgccgtcgacagccttggg

SEQ ID NO: 798599 - DNA, 25 bp, Mus musculus
tgactttgccgtggacagccttggg

SEQ ID NO: 798600 - DNA, 25 bp, Mus musculus
tgactttgctgtccacaagaaccgg

SEQ ID NO: 798601 - DNA, 25 bp, Mus musculus
tgactttgctgtgcacaagaaccgg

SEQ ID NO: 798602 - DNA, 25 bp, Mus musculus
tgactttggcctcactaaggaagcc

SEQ ID NO: 798603 - DNA, 25 bp, Mus musculus
tgactttggcctgactaaggaagcc

SEQ ID NO: 798604 - DNA, 25 bp, Mus musculus
tgactttggcgacaccatggtccac

SEQ ID NO: 798605 - DNA, 25 bp, Mus musculus
tgactttggcgagaccatggtccac

SEQ ID NO: 798606 - DNA, 25 bp, Mus musculus
tgactttgtcatcttcccacctcgg

SEQ ID NO: 798607 - DNA, 25 bp, Mus musculus
tgactttgtcatgttcccacctcgg

SEQ ID NO: 798608 - DNA, 25 bp, Mus musculus
tgactttgtgaacatccagctgtac

SEQ ID NO: 798609 - DNA, 25 bp, Mus musculus
tgactttgtgaagatccagctgtac

SEQ ID NO: 798610 - DNA, 25 bp, Mus musculus
tgacttttacttcttggacttcaga

SEQ ID NO: 798611 - DNA, 25 bp, Mus musculus
tgacttttacttgttggacttcaga

SEQ ID NO: 798612 - DNA, 25 bp, Mus musculus
tgacttttgtgaccctcaagtgtga

SEQ ID NO: 798613 - DNA, 25 bp, Mus musculus
tgacttttgtgagcctcaagtgtga

SEQ ID NO: 798614 - DNA, 25 bp, Mus musculus
tgagaaaaagcaataaggagaaggt

SEQ ID NO: 798615 - DNA, 25 bp, Mus musculus
tgagaaaaagcattaaggagaaggt

SEQ ID NO: 798616 - DNA, 25 bp, Mus musculus
tgagaaaacccaaagttaaagctct

SEQ ID NO: 798617 - DNA, 25 bp, Mus musculus
tgagaaaacccatagttaaagctct

SEQ ID NO: 798618 - DNA, 25 bp, Mus musculus
tgagaaaagcccagaaagtgagcat

SEQ ID NO: 798619 - DNA, 25 bp, Mus musculus
tgagaaaagccctgaaagtgagcat

SEQ ID NO: 798620 - DNA, 25 bp, Mus musculus
tgagaaaaggtcaaagcgagtgtca

SEQ ID NO: 798621 - DNA, 25 bp, Mus musculus
tgagaaaaggtctaagcgagtgtca

SEQ ID NO: 798622 - DNA, 25 bp, Mus musculus
tgagaaaagtaaaacaagaggagtc

SEQ ID NO: 798623 - DNA, 25 bp, Mus musculus
tgagaaaagtaatacaagaggagtc

SEQ ID NO: 798624 - DNA, 25 bp, Mus musculus
tgagaaacaaaacctatacaccgtg

SEQ ID NO: 798625 - DNA, 25 bp, Mus musculus
tgagaaacaaaagctatacaccgtg

SEQ ID NO: 798626 - DNA, 25 bp, Mus musculus
tgagaaacagtaacttagcccaagt

SEQ ID NO: 798627 - DNA, 25 bp, Mus musculus
tgagaaacagtatcttagcccaagt

SEQ ID NO: 798628 - DNA, 25 bp, Mus musculus
tgagaaaccaggaccgagccttgag

SEQ ID NO: 798629 - DNA, 25 bp, Mus musculus
tgagaaaccaggtccgagccttgag

SEQ ID NO: 798630 - DNA, 25 bp, Mus musculus
tgagaaacctcacgtgtccacagct

SEQ ID NO: 798631 - DNA, 25 bp, Mus musculus
tgagaaacctcaggtgtccacagct

SEQ ID NO: 798632 - DNA, 25 bp, Mus musculus
tgagaaacggcaaccaatcggcgcc

SEQ ID NO: 798633 - DNA, 25 bp, Mus musculus
tgagaaacggcatccaatcggcgcc

SEQ ID NO: 798634 - DNA, 25 bp, Mus musculus
tgagaaacggccaaggttcaggctg

SEQ ID NO: 798635 - DNA, 25 bp, Mus musculus
tgagaaacggcctaggttcaggctg

SEQ ID NO: 798636 - DNA, 25 bp, Mus musculus
tgagaaactaaactctttgtgtatg

SEQ ID NO: 798637 - DNA, 25 bp, Mus musculus
tgagaaactaaagtctttgtgtatg

SEQ ID NO: 798638 - DNA, 25 bp, Mus musculus
tgagaaactaacaggcccaatggag

SEQ ID NO: 798639 - DNA, 25 bp, Mus musculus
tgagaaactaactggcccaatggag

SEQ ID NO: 798640 - DNA, 25 bp, Mus musculus
tgagaaagaaggacatgggtgttct

SEQ ID NO: 798641 - DNA, 25 bp, Mus musculus
tgagaaagaaggtcatgggtgttct

SEQ ID NO: 798642 - DNA, 25 bp, Mus musculus
tgagaaagaagtcgacgaatgtctg

SEQ ID NO: 798643 - DNA, 25 bp, Mus musculus
tgagaaagaagtggacgaatgtctg

SEQ ID NO: 798644 - DNA, 25 bp, Mus musculus
tgagaaagacatcgacgagtgtagc

SEQ ID NO: 798645 - DNA, 25 bp, Mus musculus
tgagaaagacatggacgagtgtagc

SEQ ID NO: 798646 - DNA, 25 bp, Mus musculus
tgagaaagactccaacatccgtgaa

SEQ ID NO: 798647 - DNA, 25 bp, Mus musculus
tgagaaagactcgaacatccgtgaa

SEQ ID NO: 798648 - DNA, 25 bp, Mus musculus
tgagaaagacttcaagcgcatctgg

SEQ ID NO: 798649 - DNA, 25 bp, Mus musculus
tgagaaagacttgaagcgcatctgg

SEQ ID NO: 798650 - DNA, 25 bp, Mus musculus
tgagaaagagacacggctgcgagaa

SEQ ID NO: 798651 - DNA, 25 bp, Mus musculus
tgagaaagagactcggctgcgagaa

SEQ ID NO: 798652 - DNA, 25 bp, Mus musculus
tgagaaagcaaactgcgtcctggag

SEQ ID NO: 798653 - DNA, 25 bp, Mus musculus
tgagaaagcaaagtgcgtcctggag

SEQ ID NO: 798654 - DNA, 25 bp, Mus musculus
tgagaaagccagaaatgcaaataat

SEQ ID NO: 798655 - DNA, 25 bp, Mus musculus
tgagaaagccagtaatgcaaataat

SEQ ID NO: 798656 - DNA, 25 bp, Mus musculus
tgagaaagcctcagaactccgggtc

SEQ ID NO: 798657 - DNA, 25 bp, Mus musculus
tgagaaagcctctgaactccgggtc

SEQ ID NO: 798658 - DNA, 25 bp, Mus musculus
tgagaaagcttcagacccctcaagc

SEQ ID NO: 798659 - DNA, 25 bp, Mus musculus
tgagaaagcttctgacccctcaagc

SEQ ID NO: 798660 - DNA, 25 bp, Mus musculus
tgagaaaggcacaatcgttcctggc

SEQ ID NO: 798661 - DNA, 25 bp, Mus musculus
tgagaaaggcactatcgttcctggc

SEQ ID NO: 798662 - DNA, 25 bp, Mus musculus
tgagaaaggtccactcagtacatcc

SEQ ID NO: 798663 - DNA, 25 bp, Mus musculus
tgagaaaggtcctctcagtacatcc

SEQ ID NO: 798664 - DNA, 25 bp, Mus musculus
tgagaaaggtgcaggccccttgatc

SEQ ID NO: 798665 - DNA, 25 bp, Mus musculus
tgagaaaggtgctggccccttgatc

SEQ ID NO: 798666 - DNA, 25 bp, Mus musculus
tgagaaaggtttccacaactctggc

SEQ ID NO: 798667 - DNA, 25 bp, Mus musculus
tgagaaaggtttgcacaactctggc

SEQ ID NO: 798668 - DNA, 25 bp, Mus musculus
tgagaaagtccgcttgcatgaaaag

SEQ ID NO: 798669 - DNA, 25 bp, Mus musculus
tgagaaagtccggttgcatgaaaag

SEQ ID NO: 798670 - DNA, 25 bp, Mus musculus
tgagaaatacctcgatatccccaag

SEQ ID NO: 798671 - DNA, 25 bp, Mus musculus
tgagaaatacctggatatccccaag

SEQ ID NO: 798672 - DNA, 25 bp, Mus musculus
tgagaaataggccatgcccctgcac

SEQ ID NO: 798673 - DNA, 25 bp, Mus musculus
tgagaaataggcgatgcccctgcac

SEQ ID NO: 798674 - DNA, 25 bp, Mus musculus
tgagaaatcaaaactgaaccgacag

SEQ ID NO: 798675 - DNA, 25 bp, Mus musculus
tgagaaatcaaatctgaaccgacag

SEQ ID NO: 798676 - DNA, 25 bp, Mus musculus
tgagaaatccatacaatcaacagac

SEQ ID NO: 798677 - DNA, 25 bp, Mus musculus
tgagaaatccattcaatcaacagac

SEQ ID NO: 798678 - DNA, 25 bp, Mus musculus
tgagaaatgcttatcagtgtgcctt

SEQ ID NO: 798679 - DNA, 25 bp, Mus musculus
tgagaaatgcttttcagtgtgcctt

SEQ ID NO: 798680 - DNA, 25 bp, Mus musculus
tgagaaatggtgatcccctggtgtg

SEQ ID NO: 798681 - DNA, 25 bp, Mus musculus
tgagaaatggtgttcccctggtgtg

SEQ ID NO: 798682 - DNA, 25 bp, Mus musculus
tgagaaatgttgattccctgagtgc

SEQ ID NO: 798683 - DNA, 25 bp, Mus musculus
tgagaaatgttgtttccctgagtgc

SEQ ID NO: 798684 - DNA, 25 bp, Mus musculus
tgagaaattccaccgcttcacgcct

SEQ ID NO: 798685 - DNA, 25 bp, Mus musculus
tgagaaattccagcgcttcacgcct

SEQ ID NO: 798686 - DNA, 25 bp, Mus musculus
tgagaaattgttcccctccaagcat

SEQ ID NO: 798687 - DNA, 25 bp, Mus musculus
tgagaaattgttgccctccaagcat

SEQ ID NO: 798688 - DNA, 25 bp, Mus musculus
tgagaacaaacaccatgcacaggga

SEQ ID NO: 798689 - DNA, 25 bp, Mus musculus
tgagaacaaacagcatgcacaggga

SEQ ID NO: 798690 - DNA, 25 bp, Mus musculus
tgagaacaagttaggcagcatccgg

SEQ ID NO: 798691 - DNA, 25 bp, Mus musculus
tgagaacaagtttggcagcatccgg

SEQ ID NO: 798692 - DNA, 25 bp, Mus musculus
tgagaacaccttcaacaacattatg

SEQ ID NO: 798693 - DNA, 25 bp, Mus musculus
tgagaacaccttgaacaacattatg

SEQ ID NO: 798694 - DNA, 25 bp, Mus musculus
tgagaacagactagaaactgactct

SEQ ID NO: 798695 - DNA, 25 bp, Mus musculus
tgagaacagacttgaaactgactct

SEQ ID NO: 798696 - DNA, 25 bp, Mus musculus
tgagaacatcatcctcagcagccag

SEQ ID NO: 798697 - DNA, 25 bp, Mus musculus
tgagaacatcatgctcagcagccag

SEQ ID NO: 798698 - DNA, 25 bp, Mus musculus
tgagaacatcccaccatcagtatcc

SEQ ID NO: 798699 - DNA, 25 bp, Mus musculus
tgagaacatccctccatcagtatcc

SEQ ID NO: 798700 - DNA, 25 bp, Mus musculus
tgagaacatgaaacaggcgctcagc

SEQ ID NO: 798701 - DNA, 25 bp, Mus musculus
tgagaacatgaatcaggcgctcagc

SEQ ID NO: 798702 - DNA, 25 bp, Mus musculus
tgagaacatggcagctacaggaact

SEQ ID NO: 798703 - DNA, 25 bp, Mus musculus
tgagaacatggctgctacaggaact

SEQ ID NO: 798704 - DNA, 25 bp, Mus musculus
tgagaacattcacagcaaggacacc

SEQ ID NO: 798705 - DNA, 25 bp, Mus musculus
tgagaacattcagagcaaggacacc

SEQ ID NO: 798706 - DNA, 25 bp, Mus musculus
tgagaaccaagcctgaccctgaagt

SEQ ID NO: 798707 - DNA, 25 bp, Mus musculus
tgagaaccaagcgtgaccctgaagt

SEQ ID NO: 798708 - DNA, 25 bp, Mus musculus
tgagaacccactctatggatccgtg

SEQ ID NO: 798709 - DNA, 25 bp, Mus musculus
tgagaacccactgtatggatccgtg

SEQ ID NO: 798710 - DNA, 25 bp, Mus musculus
tgagaaccccgacctcagtatcatc

SEQ ID NO: 798711 - DNA, 25 bp, Mus musculus
tgagaaccccgagctcagtatcatc

SEQ ID NO: 798712 - DNA, 25 bp, Mus musculus
tgagaacccgagagatccagtgtct

SEQ ID NO: 798713 - DNA, 25 bp, Mus musculus
tgagaacccgagtgatccagtgtct

SEQ ID NO: 798714 - DNA, 25 bp, Mus musculus
tgagaacccttcaggaagaatcaga

SEQ ID NO: 798715 - DNA, 25 bp, Mus musculus
tgagaacccttctggaagaatcaga

SEQ ID NO: 798716 - DNA, 25 bp, Mus musculus
tgagaaccgtgtcctgcagaactct

SEQ ID NO: 798717 - DNA, 25 bp, Mus musculus
tgagaaccgtgtgctgcagaactct

SEQ ID NO: 798718 - DNA, 25 bp, Mus musculus
tgagaaccttaactgggctttgccc

SEQ ID NO: 798719 - DNA, 25 bp, Mus musculus
tgagaaccttaagtgggctttgccc

SEQ ID NO: 798720 - DNA, 25 bp, Mus musculus
tgagaaccttgaccatggccgggct

SEQ ID NO: 798721 - DNA, 25 bp, Mus musculus
tgagaaccttgagcatggccgggct

SEQ ID NO: 798722 - DNA, 25 bp, Mus musculus
tgagaacgacctcgcactgcttaag

SEQ ID NO: 798723 - DNA, 25 bp, Mus musculus
tgagaacgacctggcactgcttaag

SEQ ID NO: 798724 - DNA, 25 bp, Mus musculus
tgagaacgagtgctgcccacgctgt

SEQ ID NO: 798725 - DNA, 25 bp, Mus musculus
tgagaacgagtggtgcccacgctgt

SEQ ID NO: 798726 - DNA, 25 bp, Mus musculus
tgagaacggctaagttgaagctacc

SEQ ID NO: 798727 - DNA, 25 bp, Mus musculus
tgagaacggctatgttgaagctacc

SEQ ID NO: 798728 - DNA, 25 bp, Mus musculus
tgagaacggcttaactggctcagtc

SEQ ID NO: 798729 - DNA, 25 bp, Mus musculus
tgagaacggctttactggctcagtc

SEQ ID NO: 798730 - DNA, 25 bp, Mus musculus
tgagaacgggatccagcctctaagt

SEQ ID NO: 798731 - DNA, 25 bp, Mus musculus
tgagaacgggatgcagcctctaagt

SEQ ID NO: 798732 - DNA, 25 bp, Mus musculus
tgagaacgtggacatctcggtgacc

SEQ ID NO: 798733 - DNA, 25 bp, Mus musculus
tgagaacgtggagatctcggtgacc

SEQ ID NO: 798734 - DNA, 25 bp, Mus musculus
tgagaactacgtcgcatgcttacgc

SEQ ID NO: 798735 - DNA, 25 bp, Mus musculus
tgagaactacgtggcatgcttacgc

SEQ ID NO: 798736 - DNA, 25 bp, Mus musculus
tgagaactcagtctgcacttgctgc

SEQ ID NO: 798737 - DNA, 25 bp, Mus musculus
tgagaactcagtgtgcacttgctgc

SEQ ID NO: 798738 - DNA, 25 bp, Mus musculus
tgagaactccagagcccagcctagc

SEQ ID NO: 798739 - DNA, 25 bp, Mus musculus
tgagaactccagtgcccagcctagc

SEQ ID NO: 798740 - DNA, 25 bp, Mus musculus
tgagaactcgttagacatggcagca

SEQ ID NO: 798741 - DNA, 25 bp, Mus musculus
tgagaactcgtttgacatggcagca

SEQ ID NO: 798742 - DNA, 25 bp, Mus musculus
tgagaactgcttctggatcaaagta

SEQ ID NO: 798743 - DNA, 25 bp, Mus musculus
tgagaactgcttgtggatcaaagta

SEQ ID NO: 798744 - DNA, 25 bp, Mus musculus
tgagaactggatctgtttctacagc

SEQ ID NO: 798745 - DNA, 25 bp, Mus musculus
tgagaactggatgtgtttctacagc

SEQ ID NO: 798746 - DNA, 25 bp, Mus musculus
tgagaacttagtccgtccgtaccca

SEQ ID NO: 798747 - DNA, 25 bp, Mus musculus
tgagaacttagtgcgtccgtaccca

SEQ ID NO: 798748 - DNA, 25 bp, Mus musculus
tgagaacttgacagggcgattgact

SEQ ID NO: 798749 - DNA, 25 bp, Mus musculus
tgagaacttgactgggcgattgact

SEQ ID NO: 798750 - DNA, 25 bp, Mus musculus
tgagaactttgtacaacggcttggc

SEQ ID NO: 798751 - DNA, 25 bp, Mus musculus
tgagaactttgttcaacggcttggc

SEQ ID NO: 798752 - DNA, 25 bp, Mus musculus
tgagaagaaaaaccgtcttcaagct

SEQ ID NO: 798753 - DNA, 25 bp, Mus musculus
tgagaagaaaaagcgtcttcaagct

SEQ ID NO: 798754 - DNA, 25 bp, Mus musculus
tgagaagaacaaaggagcaggctac

SEQ ID NO: 798755 - DNA, 25 bp, Mus musculus
tgagaagaacaatggagcaggctac

SEQ ID NO: 798756 - DNA, 25 bp, Mus musculus
tgagaagaagacctgccagtgcccc

SEQ ID NO: 798757 - DNA, 25 bp, Mus musculus
tgagaagaagacgtgccagtgcccc

SEQ ID NO: 798758 - DNA, 25 bp, Mus musculus
tgagaagaagcaaatggttgccaat

SEQ ID NO: 798759 - DNA, 25 bp, Mus musculus
tgagaagaagcatatggttgccaat

SEQ ID NO: 798760 - DNA, 25 bp, Mus musculus
tgagaagaaggcaacatgtggcaca

SEQ ID NO: 798761 - DNA, 25 bp, Mus musculus
tgagaagaaggctacatgtggcaca

SEQ ID NO: 798762 - DNA, 25 bp, Mus musculus
tgagaagaatcgacctttaaaggac

SEQ ID NO: 798763 - DNA, 25 bp, Mus musculus
tgagaagaatcgtcctttaaaggac

SEQ ID NO: 798764 - DNA, 25 bp, Mus musculus
tgagaagaatgtcatgaacgatgcc

SEQ ID NO: 798765 - DNA, 25 bp, Mus musculus
tgagaagaatgtgatgaacgatgcc

SEQ ID NO: 798766 - DNA, 25 bp, Mus musculus
tgagaagacactctgcaccagctgt

SEQ ID NO: 798767 - DNA, 25 bp, Mus musculus
tgagaagacactgtgcaccagctgt

SEQ ID NO: 798768 - DNA, 25 bp, Mus musculus
tgagaagacattcaaccggaaggac

SEQ ID NO: 798769 - DNA, 25 bp, Mus musculus
tgagaagacattgaaccggaaggac

SEQ ID NO: 798770 - DNA, 25 bp, Mus musculus
tgagaagacccacttcaagcacttt

SEQ ID NO: 798771 - DNA, 25 bp, Mus musculus
tgagaagacccagttcaagcacttt

SEQ ID NO: 798772 - DNA, 25 bp, Mus musculus
tgagaagacccgattctatctaggc

SEQ ID NO: 798773 - DNA, 25 bp, Mus musculus
tgagaagacccgtttctatctaggc

SEQ ID NO: 798774 - DNA, 25 bp, Mus musculus
tgagaagactccaaacaccttcaaa

SEQ ID NO: 798775 - DNA, 25 bp, Mus musculus
tgagaagactcctaacaccttcaaa

SEQ ID NO: 798776 - DNA, 25 bp, Mus musculus
tgagaagagaacatgaaaaaaccat

SEQ ID NO: 798777 - DNA, 25 bp, Mus musculus
tgagaagagaacttgaaaaaaccat

SEQ ID NO: 798778 - DNA, 25 bp, Mus musculus
tgagaagagaccagagcacaatcct

SEQ ID NO: 798779 - DNA, 25 bp, Mus musculus
tgagaagagacctgagcacaatcct

SEQ ID NO: 798780 - DNA, 25 bp, Mus musculus
tgagaagaggcacggaaaactgtcc

SEQ ID NO: 798781 - DNA, 25 bp, Mus musculus
tgagaagaggcagggaaaactgtcc

SEQ ID NO: 798782 - DNA, 25 bp, Mus musculus
tgagaagaggctacgcagaggacct

SEQ ID NO: 798783 - DNA, 25 bp, Mus musculus
tgagaagaggcttcgcagaggacct

SEQ ID NO: 798784 - DNA, 25 bp, Mus musculus
tgagaagagtgtacccagcctctgt

SEQ ID NO: 798785 - DNA, 25 bp, Mus musculus
tgagaagagtgttcccagcctctgt

SEQ ID NO: 798786 - DNA, 25 bp, Mus musculus
tgagaagatacactgctcgcccact

SEQ ID NO: 798787 - DNA, 25 bp, Mus musculus
tgagaagatacagtgctcgcccact

SEQ ID NO: 798788 - DNA, 25 bp, Mus musculus
tgagaagatcgcctacaaatcattg

SEQ ID NO: 798789 - DNA, 25 bp, Mus musculus
tgagaagatcgcgtacaaatcattg

SEQ ID NO: 798790 - DNA, 25 bp, Mus musculus
tgagaagatctacaaatacctttcc

SEQ ID NO: 798791 - DNA, 25 bp, Mus musculus
tgagaagatctagaaatacctttcc

SEQ ID NO: 798792 - DNA, 25 bp, Mus musculus
tgagaagattcaccagattctggcc

SEQ ID NO: 798793 - DNA, 25 bp, Mus musculus
tgagaagattcagcagattctggcc

SEQ ID NO: 798794 - DNA, 25 bp, Mus musculus
tgagaagcagctcgaagaactggca

SEQ ID NO: 798795 - DNA, 25 bp, Mus musculus
tgagaagcagctggaagaactggca

SEQ ID NO: 798796 - DNA, 25 bp, Mus musculus
tgagaagcagtaagccctgcagtgc

SEQ ID NO: 798797 - DNA, 25 bp, Mus musculus
tgagaagcagtatgccctgcagtgc

SEQ ID NO: 798798 - DNA, 25 bp, Mus musculus
tgagaagccggacaatgaccctgaa

SEQ ID NO: 798799 - DNA, 25 bp, Mus musculus
tgagaagccggagaatgaccctgaa

SEQ ID NO: 798800 - DNA, 25 bp, Mus musculus
tgagaagccgttcctgtccagtccc

SEQ ID NO: 798801 - DNA, 25 bp, Mus musculus
tgagaagccgttgctgtccagtccc

SEQ ID NO: 798802 - DNA, 25 bp, Mus musculus
tgagaagcggaacaataaaggcact

SEQ ID NO: 798803 - DNA, 25 bp, Mus musculus
tgagaagcggaagaataaaggcact

SEQ ID NO: 798804 - DNA, 25 bp, Mus musculus
tgagaagctacgagatgtctaccgt

SEQ ID NO: 798805 - DNA, 25 bp, Mus musculus
tgagaagctacgtgatgtctaccgt

SEQ ID NO: 798806 - DNA, 25 bp, Mus musculus
tgagaagctcttcatccaatccctg

SEQ ID NO: 798807 - DNA, 25 bp, Mus musculus
tgagaagctcttgatccaatccctg

SEQ ID NO: 798808 - DNA, 25 bp, Mus musculus
tgagaagctgtaagatgcctatgtc

SEQ ID NO: 798809 - DNA, 25 bp, Mus musculus
tgagaagctgtatgatgcctatgtc

SEQ ID NO: 798810 - DNA, 25 bp, Mus musculus
tgagaagcttaacagatgccctgtg

SEQ ID NO: 798811 - DNA, 25 bp, Mus musculus
tgagaagcttaagagatgccctgtg

SEQ ID NO: 798812 - DNA, 25 bp, Mus musculus
tgagaagcttgaattggccatgctg

SEQ ID NO: 798813 - DNA, 25 bp, Mus musculus
tgagaagcttgatttggccatgctg

SEQ ID NO: 798814 - DNA, 25 bp, Mus musculus
tgagaaggaattcctagctaggtcc

SEQ ID NO: 798815 - DNA, 25 bp, Mus musculus
tgagaaggaattgctagctaggtcc

SEQ ID NO: 798816 - DNA, 25 bp, Mus musculus
tgagaaggacttagaggcggattct

SEQ ID NO: 798817 - DNA, 25 bp, Mus musculus
tgagaaggactttgaggcggattct

SEQ ID NO: 798818 - DNA, 25 bp, Mus musculus
tgagaaggagcacaaaaagcttcag

SEQ ID NO: 798819 - DNA, 25 bp, Mus musculus
tgagaaggagcagaaaaagcttcag

SEQ ID NO: 798820 - DNA, 25 bp, Mus musculus
tgagaaggatctagaggcaatgaaa

SEQ ID NO: 798821 - DNA, 25 bp, Mus musculus
tgagaaggatcttgaggcaatgaaa

SEQ ID NO: 798822 - DNA, 25 bp, Mus musculus
tgagaaggccctccaactggaggaa

SEQ ID NO: 798823 - DNA, 25 bp, Mus musculus
tgagaaggccctgcaactggaggaa

SEQ ID NO: 798824 - DNA, 25 bp, Mus musculus
tgagaaggcgttcagtagacagact

SEQ ID NO: 798825 - DNA, 25 bp, Mus musculus
tgagaaggcgttgagtagacagact

SEQ ID NO: 798826 - DNA, 25 bp, Mus musculus
tgagaaggctgcatctcgaaggact

SEQ ID NO: 798827 - DNA, 25 bp, Mus musculus
tgagaaggctgcttctcgaaggact

SEQ ID NO: 798828 - DNA, 25 bp, Mus musculus
tgagaaggcttcctcgacacagtac

SEQ ID NO: 798829 - DNA, 25 bp, Mus musculus
tgagaaggcttcgtcgacacagtac

SEQ ID NO: 798830 - DNA, 25 bp, Mus musculus
tgagaagggagtacattcctgcccc

SEQ ID NO: 798831 - DNA, 25 bp, Mus musculus
tgagaagggagttcattcctgcccc

SEQ ID NO: 798832 - DNA, 25 bp, Mus musculus
tgagaagggcttaggctacaaaggc

SEQ ID NO: 798833 - DNA, 25 bp, Mus musculus
tgagaagggctttggctacaaaggc

SEQ ID NO: 798834 - DNA, 25 bp, Mus musculus
tgagaagggtcgactccagatcctt

SEQ ID NO: 798835 - DNA, 25 bp, Mus musculus
tgagaagggtcgtctccagatcctt

SEQ ID NO: 798836 - DNA, 25 bp, Mus musculus
tgagaagggtgacaccaccaccttg

SEQ ID NO: 798837 - DNA, 25 bp, Mus musculus
tgagaagggtgagaccaccaccttg

SEQ ID NO: 798838 - DNA, 25 bp, Mus musculus
tgagaaggtccgcaggttacagctt

SEQ ID NO: 798839 - DNA, 25 bp, Mus musculus
tgagaaggtccggaggttacagctt

SEQ ID NO: 798840 - DNA, 25 bp, Mus musculus
tgagaaggtcttcatccgaggcact

SEQ ID NO: 798841 - DNA, 25 bp, Mus musculus
tgagaaggtcttgatccgaggcact

SEQ ID NO: 798842 - DNA, 25 bp, Mus musculus
tgagaaggttcgcaccacagagacc

SEQ ID NO: 798843 - DNA, 25 bp, Mus musculus
tgagaaggttcggaccacagagacc

SEQ ID NO: 798844 - DNA, 25 bp, Mus musculus
tgagaagtcctgaaagtaatctcca

SEQ ID NO: 798845 - DNA, 25 bp, Mus musculus
tgagaagtcctgtaagtaatctcca

SEQ ID NO: 798846 - DNA, 25 bp, Mus musculus
tgagaagtctggattcagcagcccc

SEQ ID NO: 798847 - DNA, 25 bp, Mus musculus
tgagaagtctggtttcagcagcccc

SEQ ID NO: 798848 - DNA, 25 bp, Mus musculus
tgagaagtgtggcaaccagcgccac

SEQ ID NO: 798849 - DNA, 25 bp, Mus musculus
tgagaagtgtgggaaccagcgccac

SEQ ID NO: 798850 - DNA, 25 bp, Mus musculus
tgagaagtgttaaaccccatggctg

SEQ ID NO: 798851 - DNA, 25 bp, Mus musculus
tgagaagtgttataccccatggctg

SEQ ID NO: 798852 - DNA, 25 bp, Mus musculus
tgagaagttagaccagtcggaagcc

SEQ ID NO: 798853 - DNA, 25 bp, Mus musculus
tgagaagttagagcagtcggaagcc

SEQ ID NO: 798854 - DNA, 25 bp, Mus musculus
tgagaagttcttagcagcctttgag

SEQ ID NO: 798855 - DNA, 25 bp, Mus musculus
tgagaagttctttgcagcctttgag

SEQ ID NO: 798856 - DNA, 25 bp, Mus musculus
tgagaataacatcaaccaatggact

SEQ ID NO: 798857 - DNA, 25 bp, Mus musculus
tgagaataacatgaaccaatggact

SEQ ID NO: 798858 - DNA, 25 bp, Mus musculus
tgagaataacccacccatgatgctg

SEQ ID NO: 798859 - DNA, 25 bp, Mus musculus
tgagaataaccctcccatgatgctg

SEQ ID NO: 798860 - DNA, 25 bp, Mus musculus
tgagaataagagagccacggacaac

SEQ ID NO: 798861 - DNA, 25 bp, Mus musculus
tgagaataagagtgccacggacaac

SEQ ID NO: 798862 - DNA, 25 bp, Mus musculus
tgagaatacatgatccggtgtacag

SEQ ID NO: 798863 - DNA, 25 bp, Mus musculus
tgagaatacatgttccggtgtacag

SEQ ID NO: 798864 - DNA, 25 bp, Mus musculus
tgagaataccatcgaaagcgagggc

SEQ ID NO: 798865 - DNA, 25 bp, Mus musculus
tgagaataccatggaaagcgagggc

SEQ ID NO: 798866 - DNA, 25 bp, Mus musculus
tgagaataccctcatgtccctgagg

SEQ ID NO: 798867 - DNA, 25 bp, Mus musculus
tgagaataccctgatgtccctgagg

SEQ ID NO: 798868 - DNA, 25 bp, Mus musculus
tgagaatagcatagactttcttgac

SEQ ID NO: 798869 - DNA, 25 bp, Mus musculus
tgagaatagcattgactttcttgac

SEQ ID NO: 798870 - DNA, 25 bp, Mus musculus
tgagaatatgacaggacggcatccc

SEQ ID NO: 798871 - DNA, 25 bp, Mus musculus
tgagaatatgactggacggcatccc

SEQ ID NO: 798872 - DNA, 25 bp, Mus musculus
tgagaatatttcagacagagcagcc

SEQ ID NO: 798873 - DNA, 25 bp, Mus musculus
tgagaatatttctgacagagcagcc

SEQ ID NO: 798874 - DNA, 25 bp, Mus musculus
tgagaatcacgaagcagggcctgac

SEQ ID NO: 798875 - DNA, 25 bp, Mus musculus
tgagaatcacgatgcagggcctgac

SEQ ID NO: 798876 - DNA, 25 bp, Mus musculus
tgagaatctacactgggaagtgtca

SEQ ID NO: 798877 - DNA, 25 bp, Mus musculus
tgagaatctacagtgggaagtgtca

SEQ ID NO: 798878 - DNA, 25 bp, Mus musculus
tgagaatctgcacacccggtttgga

SEQ ID NO: 798879 - DNA, 25 bp, Mus musculus
tgagaatctgcagacccggtttgga

SEQ ID NO: 798880 - DNA, 25 bp, Mus musculus
tgagaatcttgaccagcaacttcgg

SEQ ID NO: 798881 - DNA, 25 bp, Mus musculus
tgagaatcttgagcagcaacttcgg

SEQ ID NO: 798882 - DNA, 25 bp, Mus musculus
tgagaatgaaaaagagcaggcagct

SEQ ID NO: 798883 - DNA, 25 bp, Mus musculus
tgagaatgaaaatgagcaggcagct

SEQ ID NO: 798884 - DNA, 25 bp, Mus musculus
tgagaatgatccagctacacaacgg

SEQ ID NO: 798885 - DNA, 25 bp, Mus musculus
tgagaatgatcctgctacacaacgg

SEQ ID NO: 798886 - DNA, 25 bp, Mus musculus
tgagaatgcacaaccctctgaaact

SEQ ID NO: 798887 - DNA, 25 bp, Mus musculus
tgagaatgcacatccctctgaaact

SEQ ID NO: 798888 - DNA, 25 bp, Mus musculus
tgagaatggcttcggtcgtgtattt

SEQ ID NO: 798889 - DNA, 25 bp, Mus musculus
tgagaatggcttgggtcgtgtattt

SEQ ID NO: 798890 - DNA, 25 bp, Mus musculus
tgagaatgggtcagggtaccacggg

SEQ ID NO: 798891 - DNA, 25 bp, Mus musculus
tgagaatgggtctgggtaccacggg

SEQ ID NO: 798892 - DNA, 25 bp, Mus musculus
tgagaattacaccaaggccctggcg

SEQ ID NO: 798893 - DNA, 25 bp, Mus musculus
tgagaattacacgaaggccctggcg

SEQ ID NO: 798894 - DNA, 25 bp, Mus musculus
tgagaattgaaccacgcacagagac

SEQ ID NO: 798895 - DNA, 25 bp, Mus musculus
tgagaattgaacgacgcacagagac

SEQ ID NO: 798896 - DNA, 25 bp, Mus musculus
tgagaattgcccctcggtccacaac

SEQ ID NO: 798897 - DNA, 25 bp, Mus musculus
tgagaattgcccgtcggtccacaac

SEQ ID NO: 798898 - DNA, 25 bp, Mus musculus
tgagaattgggacagtctgctcctg

SEQ ID NO: 798899 - DNA, 25 bp, Mus musculus
tgagaattgggagagtctgctcctg

SEQ ID NO: 798900 - DNA, 25 bp, Mus musculus
tgagaattttctatataccacagag

SEQ ID NO: 798901 - DNA, 25 bp, Mus musculus
tgagaattttctttataccacagag

SEQ ID NO: 798902 - DNA, 25 bp, Mus musculus
tgagacaaatctcacagcaagcaac

SEQ ID NO: 798903 - DNA, 25 bp, Mus musculus
tgagacaaatctgacagcaagcaac

SEQ ID NO: 798904 - DNA, 25 bp, Mus musculus
tgagacaacaccagagatggaggag

SEQ ID NO: 798905 - DNA, 25 bp, Mus musculus
tgagacaacacctgagatggaggag

SEQ ID NO: 798906 - DNA, 25 bp, Mus musculus
tgagacaacagcacccaactttcct

SEQ ID NO: 798907 - DNA, 25 bp, Mus musculus
tgagacaacagctcccaactttcct

SEQ ID NO: 798908 - DNA, 25 bp, Mus musculus
tgagacaacgtaccctttcacaagc

SEQ ID NO: 798909 - DNA, 25 bp, Mus musculus
tgagacaacgtagcctttcacaagc

SEQ ID NO: 798910 - DNA, 25 bp, Mus musculus
tgagacaactgtagcaagcctcaag

SEQ ID NO: 798911 - DNA, 25 bp, Mus musculus
tgagacaactgttgcaagcctcaag

SEQ ID NO: 798912 - DNA, 25 bp, Mus musculus
tgagacaaggatcgaaaagcgaatc

SEQ ID NO: 798913 - DNA, 25 bp, Mus musculus
tgagacaaggatggaaaagcgaatc

SEQ ID NO: 798914 - DNA, 25 bp, Mus musculus
tgagacaataaacctgctgctgtgg

SEQ ID NO: 798915 - DNA, 25 bp, Mus musculus
tgagacaataaagctgctgctgtgg

SEQ ID NO: 798916 - DNA, 25 bp, Mus musculus
tgagacacaactagggaggtcctga

SEQ ID NO: 798917 - DNA, 25 bp, Mus musculus
tgagacacaacttgggaggtcctga

SEQ ID NO: 798918 - DNA, 25 bp, Mus musculus
tgagacacacacaagggaagtgatc

SEQ ID NO: 798919 - DNA, 25 bp, Mus musculus
tgagacacacactagggaagtgatc

SEQ ID NO: 798920 - DNA, 25 bp, Mus musculus
tgagacacacttccagtgcgtggac

SEQ ID NO: 798921 - DNA, 25 bp, Mus musculus
tgagacacacttgcagtgcgtggac

SEQ ID NO: 798922 - DNA, 25 bp, Mus musculus
tgagacacctagacattttgtgcag

SEQ ID NO: 798923 - DNA, 25 bp, Mus musculus
tgagacacctagtcattttgtgcag

SEQ ID NO: 798924 - DNA, 25 bp, Mus musculus
tgagacactccacgcccaggctggg

SEQ ID NO: 798925 - DNA, 25 bp, Mus musculus
tgagacactccaggcccaggctggg

SEQ ID NO: 798926 - DNA, 25 bp, Mus musculus
tgagacagagcgaaatggcgacgat

SEQ ID NO: 798927 - DNA, 25 bp, Mus musculus
tgagacagagcgtaatggcgacgat

SEQ ID NO: 798928 - DNA, 25 bp, Mus musculus
tgagacagatggcaaaaagggcacc

SEQ ID NO: 798929 - DNA, 25 bp, Mus musculus
tgagacagatgggaaaaagggcacc

SEQ ID NO: 798930 - DNA, 25 bp, Mus musculus
tgagacagcaggaactactgaccgg

SEQ ID NO: 798931 - DNA, 25 bp, Mus musculus
tgagacagcaggtactactgaccgg

SEQ ID NO: 798932 - DNA, 25 bp, Mus musculus
tgagacagccacctgccttgcctgg

SEQ ID NO: 798933 - DNA, 25 bp, Mus musculus
tgagacagccacgtgccttgcctgg

SEQ ID NO: 798934 - DNA, 25 bp, Mus musculus
tgagacagctcacgtacttggatgt

SEQ ID NO: 798935 - DNA, 25 bp, Mus musculus
tgagacagctcaggtacttggatgt

SEQ ID NO: 798936 - DNA, 25 bp, Mus musculus
tgagacaggagcatcgagagttcga

SEQ ID NO: 798937 - DNA, 25 bp, Mus musculus
tgagacaggagcttcgagagttcga

SEQ ID NO: 798938 - DNA, 25 bp, Mus musculus
tgagacagtcataacatctgtaggg

SEQ ID NO: 798939 - DNA, 25 bp, Mus musculus
tgagacagtcattacatctgtaggg

SEQ ID NO: 798940 - DNA, 25 bp, Mus musculus
tgagacagtgctcgatcctgccgag

SEQ ID NO: 798941 - DNA, 25 bp, Mus musculus
tgagacagtgctggatcctgccgag

SEQ ID NO: 798942 - DNA, 25 bp, Mus musculus
tgagacagttgaatcccaagtctgc

SEQ ID NO: 798943 - DNA, 25 bp, Mus musculus
tgagacagttgattcccaagtctgc

SEQ ID NO: 798944 - DNA, 25 bp, Mus musculus
tgagacatcagaactccaggaactg

SEQ ID NO: 798945 - DNA, 25 bp, Mus musculus
tgagacatcagatctccaggaactg

SEQ ID NO: 798946 - DNA, 25 bp, Mus musculus
tgagacatgcaaccggcccggaagc

SEQ ID NO: 798947 - DNA, 25 bp, Mus musculus
tgagacatgcaagcggcccggaagc

SEQ ID NO: 798948 - DNA, 25 bp, Mus musculus
tgagacatgtttctaatcgctggcg

SEQ ID NO: 798949 - DNA, 25 bp, Mus musculus
tgagacatgtttgtaatcgctggcg

SEQ ID NO: 798950 - DNA, 25 bp, Mus musculus
tgagaccacaacattagcagctaca

SEQ ID NO: 798951 - DNA, 25 bp, Mus musculus
tgagaccacaactttagcagctaca

SEQ ID NO: 798952 - DNA, 25 bp, Mus musculus
tgagaccaggataccgggagagtcc

SEQ ID NO: 798953 - DNA, 25 bp, Mus musculus
tgagaccaggattccgggagagtcc

SEQ ID NO: 798954 - DNA, 25 bp, Mus musculus
tgagaccatccaagttttcagcact

SEQ ID NO: 798955 - DNA, 25 bp, Mus musculus
tgagaccatccatgttttcagcact

SEQ ID NO: 798956 - DNA, 25 bp, Mus musculus
tgagacccaaagaccggaatgtggc

SEQ ID NO: 798957 - DNA, 25 bp, Mus musculus
tgagacccaaagtccggaatgtggc

SEQ ID NO: 798958 - DNA, 25 bp, Mus musculus
tgagacccctggcttgggcaacccg

SEQ ID NO: 798959 - DNA, 25 bp, Mus musculus
tgagacccctgggttgggcaacccg

SEQ ID NO: 798960 - DNA, 25 bp, Mus musculus
tgagacccgatcctttaacacctgg

SEQ ID NO: 798961 - DNA, 25 bp, Mus musculus
tgagacccgatcgtttaacacctgg

SEQ ID NO: 798962 - DNA, 25 bp, Mus musculus
tgagacccgctacatcgtggagaac

SEQ ID NO: 798963 - DNA, 25 bp, Mus musculus
tgagacccgctagatcgtggagaac

SEQ ID NO: 798964 - DNA, 25 bp, Mus musculus
tgagacccgctcatcagcatgtggt

SEQ ID NO: 798965 - DNA, 25 bp, Mus musculus
tgagacccgctcttcagcatgtggt

SEQ ID NO: 798966 - DNA, 25 bp, Mus musculus
tgagacccggcactgttacagatga

SEQ ID NO: 798967 - DNA, 25 bp, Mus musculus
tgagacccggcagtgttacagatga

SEQ ID NO: 798968 - DNA, 25 bp, Mus musculus
tgagacccggttccttcaactgcca

SEQ ID NO: 798969 - DNA, 25 bp, Mus musculus
tgagacccggttgcttcaactgcca

SEQ ID NO: 798970 - DNA, 25 bp, Mus musculus
tgagacccgttcaacccagaagtgg

SEQ ID NO: 798971 - DNA, 25 bp, Mus musculus
tgagacccgttctacccagaagtgg

SEQ ID NO: 798972 - DNA, 25 bp, Mus musculus
tgagaccctcagaatccgtaccttt

SEQ ID NO: 798973 - DNA, 25 bp, Mus musculus
tgagaccctcagtatccgtaccttt

SEQ ID NO: 798974 - DNA, 25 bp, Mus musculus
tgagaccctggcaagagatgcagat

SEQ ID NO: 798975 - DNA, 25 bp, Mus musculus
tgagaccctggctagagatgcagat

SEQ ID NO: 798976 - DNA, 25 bp, Mus musculus
tgagaccgctgccaaccggatctgc

SEQ ID NO: 798977 - DNA, 25 bp, Mus musculus
tgagaccgctgcgaaccggatctgc

SEQ ID NO: 798978 - DNA, 25 bp, Mus musculus
tgagaccggcttcaatagattcttg

SEQ ID NO: 798979 - DNA, 25 bp, Mus musculus
tgagaccggcttgaatagattcttg

SEQ ID NO: 798980 - DNA, 25 bp, Mus musculus
tgagaccgttttccaccaagttagc

SEQ ID NO: 798981 - DNA, 25 bp, Mus musculus
tgagaccgttttgcaccaagttagc

SEQ ID NO: 798982 - DNA, 25 bp, Mus musculus
tgagacctaacactgagtccgggcg

SEQ ID NO: 798983 - DNA, 25 bp, Mus musculus
tgagacctaacagtgagtccgggcg

SEQ ID NO: 798984 - DNA, 25 bp, Mus musculus
tgagacctaagaaattggacgctgg

SEQ ID NO: 798985 - DNA, 25 bp, Mus musculus
tgagacctaagatattggacgctgg

SEQ ID NO: 798986 - DNA, 25 bp, Mus musculus
tgagacctacccagaaaaacagatc

SEQ ID NO: 798987 - DNA, 25 bp, Mus musculus
tgagacctaccctgaaaaacagatc

SEQ ID NO: 798988 - DNA, 25 bp, Mus musculus
tgagacctatgtactgtatcagaag

SEQ ID NO: 798989 - DNA, 25 bp, Mus musculus
tgagacctatgttctgtatcagaag

SEQ ID NO: 798990 - DNA, 25 bp, Mus musculus
tgagacctggagactgccgttttgt

SEQ ID NO: 798991 - DNA, 25 bp, Mus musculus
tgagacctggagtctgccgttttgt

SEQ ID NO: 798992 - DNA, 25 bp, Mus musculus
tgagaccttcaacgctgctgtccag

SEQ ID NO: 798993 - DNA, 25 bp, Mus musculus
tgagaccttcaaggctgctgtccag

SEQ ID NO: 798994 - DNA, 25 bp, Mus musculus
tgagacgagactcccctgagtatga

SEQ ID NO: 798995 - DNA, 25 bp, Mus musculus
tgagacgagactgccctgagtatga

SEQ ID NO: 798996 - DNA, 25 bp, Mus musculus
tgagacgatgcacgccatggaatcc

SEQ ID NO: 798997 - DNA, 25 bp, Mus musculus
tgagacgatgcaggccatggaatcc

SEQ ID NO: 798998 - DNA, 25 bp, Mus musculus
tgagacggctctccaaggcaatgtc

SEQ ID NO: 798999 - DNA, 25 bp, Mus musculus
tgagacggctctgcaaggcaatgtc

SEQ ID NO: 799000 - DNA, 25 bp, Mus musculus
tgagactaaggtccatcggaagacg

SEQ ID NO: 799001 - DNA, 25 bp, Mus musculus
tgagactaaggtgcatcggaagacg

SEQ ID NO: 799002 - DNA, 25 bp, Mus musculus
tgagactagatgagaccagaatcgt

SEQ ID NO: 799003 - DNA, 25 bp, Mus musculus
tgagactagatgtgaccagaatcgt

SEQ ID NO: 799004 - DNA, 25 bp, Mus musculus
tgagactatgacatctggacagatt

SEQ ID NO: 799005 - DNA, 25 bp, Mus musculus
tgagactatgacttctggacagatt

SEQ ID NO: 799006 - DNA, 25 bp, Mus musculus
tgagactcatagctcagctaccctg

SEQ ID NO: 799007 - DNA, 25 bp, Mus musculus
tgagactcataggtcagctaccctg

SEQ ID NO: 799008 - DNA, 25 bp, Mus musculus
tgagactccaagcttcatcagaagg

SEQ ID NO: 799009 - DNA, 25 bp, Mus musculus
tgagactccaaggttcatcagaagg

SEQ ID NO: 799010 - DNA, 25 bp, Mus musculus
tgagactcgggcagggtgtgaggaa

SEQ ID NO: 799011 - DNA, 25 bp, Mus musculus
tgagactcgggctgggtgtgaggaa

SEQ ID NO: 799012 - DNA, 25 bp, Mus musculus
tgagactcggtcagcagtactccca

SEQ ID NO: 799013 - DNA, 25 bp, Mus musculus
tgagactcggtctgcagtactccca

SEQ ID NO: 799014 - DNA, 25 bp, Mus musculus
tgagactgagaacaacaatggagca

SEQ ID NO: 799015 - DNA, 25 bp, Mus musculus
tgagactgagaagaacaatggagca

SEQ ID NO: 799016 - DNA, 25 bp, Mus musculus
tgagactgagcacaaaatcaaggac

SEQ ID NO: 799017 - DNA, 25 bp, Mus musculus
tgagactgagcacagccagccggac

SEQ ID NO: 799018 - DNA, 25 bp, Mus musculus
tgagactgagcagaaaatcaaggac

SEQ ID NO: 799019 - DNA, 25 bp, Mus musculus
tgagactgagcagagccagccggac

SEQ ID NO: 799020 - DNA, 25 bp, Mus musculus
tgagactgagcgagactggtccgcc

SEQ ID NO: 799021 - DNA, 25 bp, Mus musculus
tgagactgagcgtgactggtccgcc

SEQ ID NO: 799022 - DNA, 25 bp, Mus musculus
tgagactgatgtcaacaatgaaaat

SEQ ID NO: 799023 - DNA, 25 bp, Mus musculus
tgagactgatgtgaacaatgaaaat

SEQ ID NO: 799024 - DNA, 25 bp, Mus musculus
tgagactgccttccggcagctcaca

SEQ ID NO: 799025 - DNA, 25 bp, Mus musculus
tgagactgccttgcggcagctcaca

SEQ ID NO: 799026 - DNA, 25 bp, Mus musculus
tgagactggcaaattcagcttttgc

SEQ ID NO: 799027 - DNA, 25 bp, Mus musculus
tgagactggcaatttcagcttttgc

SEQ ID NO: 799028 - DNA, 25 bp, Mus musculus
tgagactgggccatagacaaacccc

SEQ ID NO: 799029 - DNA, 25 bp, Mus musculus
tgagactgggccttagacaaacccc

SEQ ID NO: 799030 - DNA, 25 bp, Mus musculus
tgagactggtgtatgctccctggct

SEQ ID NO: 799031 - DNA, 25 bp, Mus musculus
tgagactggtgtttgctccctggct

SEQ ID NO: 799032 - DNA, 25 bp, Mus musculus
tgagactgtcagaaatggcatttac

SEQ ID NO: 799033 - DNA, 25 bp, Mus musculus
tgagactgtcagtaatggcatttac

SEQ ID NO: 799034 - DNA, 25 bp, Mus musculus
tgagacttagcaagaagcacttgaa

SEQ ID NO: 799035 - DNA, 25 bp, Mus musculus
tgagacttagcatgaagcacttgaa

SEQ ID NO: 799036 - DNA, 25 bp, Mus musculus
tgagacttgaaaatacccgaatcct

SEQ ID NO: 799037 - DNA, 25 bp, Mus musculus
tgagacttgaaattacccgaatcct

SEQ ID NO: 799038 - DNA, 25 bp, Mus musculus
tgagacttgacacttcttcgccggg

SEQ ID NO: 799039 - DNA, 25 bp, Mus musculus
tgagacttgacagttcttcgccggg

SEQ ID NO: 799040 - DNA, 25 bp, Mus musculus
tgagacttgcaaacaacacaaagct

SEQ ID NO: 799041 - DNA, 25 bp, Mus musculus
tgagacttgcaatcaacacaaagct

SEQ ID NO: 799042 - DNA, 25 bp, Mus musculus
tgagagaaatgcacctaaggaacaa

SEQ ID NO: 799043 - DNA, 25 bp, Mus musculus
tgagagaaatgctcctaaggaacaa

SEQ ID NO: 799044 - DNA, 25 bp, Mus musculus
tgagagaacaggattatgacgccat

SEQ ID NO: 799045 - DNA, 25 bp, Mus musculus
tgagagaacaggtttatgacgccat

SEQ ID NO: 799046 - DNA, 25 bp, Mus musculus
tgagagaagattaaatgggcctggc

SEQ ID NO: 799047 - DNA, 25 bp, Mus musculus
tgagagaagatttaatgggcctggc

SEQ ID NO: 799048 - DNA, 25 bp, Mus musculus
tgagagaaggaacaactcggcttcc

SEQ ID NO: 799049 - DNA, 25 bp, Mus musculus
tgagagaaggaagaactcggcttcc

SEQ ID NO: 799050 - DNA, 25 bp, Mus musculus
tgagagaagtgtagcagaagtactt

SEQ ID NO: 799051 - DNA, 25 bp, Mus musculus
tgagagaagtgttgcagaagtactt

SEQ ID NO: 799052 - DNA, 25 bp, Mus musculus
tgagagacatttcgtcctggatccc

SEQ ID NO: 799053 - DNA, 25 bp, Mus musculus
tgagagacatttggtcctggatccc

SEQ ID NO: 799054 - DNA, 25 bp, Mus musculus
tgagagacgaaccagcgtgaagctc

SEQ ID NO: 799055 - DNA, 25 bp, Mus musculus
tgagagacgaacgagcgtgaagctc

SEQ ID NO: 799056 - DNA, 25 bp, Mus musculus
tgagagactctgagagtggagaact

SEQ ID NO: 799057 - DNA, 25 bp, Mus musculus
tgagagactctgtgagtggagaact

SEQ ID NO: 799058 - DNA, 25 bp, Mus musculus
tgagagactgatccagatgaccctt

SEQ ID NO: 799059 - DNA, 25 bp, Mus musculus
tgagagactgatgcagatgaccctt

SEQ ID NO: 799060 - DNA, 25 bp, Mus musculus
tgagagacttctctgccaacgccag

SEQ ID NO: 799061 - DNA, 25 bp, Mus musculus
tgagagacttctgtgccaacgccag

SEQ ID NO: 799062 - DNA, 25 bp, Mus musculus
tgagagactttaaaaatccatgaag

SEQ ID NO: 799063 - DNA, 25 bp, Mus musculus
tgagagactttataaatccatgaag

SEQ ID NO: 799064 - DNA, 25 bp, Mus musculus
tgagagagatacatagcaaacagca

SEQ ID NO: 799065 - DNA, 25 bp, Mus musculus
tgagagagatacttagcaaacagca

SEQ ID NO: 799066 - DNA, 25 bp, Mus musculus
tgagagagcaggacactagacacac

SEQ ID NO: 799067 - DNA, 25 bp, Mus musculus
tgagagagcaggtcactagacacac

SEQ ID NO: 799068 - DNA, 25 bp, Mus musculus
tgagagagctcccatctgaatatca

SEQ ID NO: 799069 - DNA, 25 bp, Mus musculus
tgagagagctccgatctgaatatca

SEQ ID NO: 799070 - DNA, 25 bp, Mus musculus
tgagagaggcctatccaggaagcac

SEQ ID NO: 799071 - DNA, 25 bp, Mus musculus
tgagagaggcctttccaggaagcac

SEQ ID NO: 799072 - DNA, 25 bp, Mus musculus
tgagagaggctcaattggcttcctg

SEQ ID NO: 799073 - DNA, 25 bp, Mus musculus
tgagagaggctctattggcttcctg

SEQ ID NO: 799074 - DNA, 25 bp, Mus musculus
tgagagagggttcacagctacctgt

SEQ ID NO: 799075 - DNA, 25 bp, Mus musculus
tgagagagggttgacagctacctgt

SEQ ID NO: 799076 - DNA, 25 bp, Mus musculus
tgagagaggtccaatcaaaaccaaa

SEQ ID NO: 799077 - DNA, 25 bp, Mus musculus
tgagagaggtcctatcaaaaccaaa

SEQ ID NO: 799078 - DNA, 25 bp, Mus musculus
tgagagagtcctaccacagtgaaac

SEQ ID NO: 799079 - DNA, 25 bp, Mus musculus
tgagagagtcctagagacagaagga

SEQ ID NO: 799080 - DNA, 25 bp, Mus musculus
tgagagagtccttccacagtgaaac

SEQ ID NO: 799081 - DNA, 25 bp, Mus musculus
tgagagagtccttgagacagaagga

SEQ ID NO: 799082 - DNA, 25 bp, Mus musculus
tgagagagtgaacaagcagctagcc

SEQ ID NO: 799083 - DNA, 25 bp, Mus musculus
tgagagagtgaagaagcagctagcc

SEQ ID NO: 799084 - DNA, 25 bp, Mus musculus
tgagagataagaagcccaaaaaggg

SEQ ID NO: 799085 - DNA, 25 bp, Mus musculus
tgagagataagatgcccaaaaaggg

SEQ ID NO: 799086 - DNA, 25 bp, Mus musculus
tgagagataaggcaccctctagacc

SEQ ID NO: 799087 - DNA, 25 bp, Mus musculus
tgagagataagggaccctctagacc

SEQ ID NO: 799088 - DNA, 25 bp, Mus musculus
tgagagataccaaccacgctcattc

SEQ ID NO: 799089 - DNA, 25 bp, Mus musculus
tgagagataccatccacgctcattc

SEQ ID NO: 799090 - DNA, 25 bp, Mus musculus
tgagagatgagaatctggaaccgct

SEQ ID NO: 799091 - DNA, 25 bp, Mus musculus
tgagagatgagattctggaaccgct

SEQ ID NO: 799092 - DNA, 25 bp, Mus musculus
tgagagatgtcaaaagctacctgac

SEQ ID NO: 799093 - DNA, 25 bp, Mus musculus
tgagagatgtcataagctacctgac

SEQ ID NO: 799094 - DNA, 25 bp, Mus musculus
tgagagcaagaaaccccaggctgga

SEQ ID NO: 799095 - DNA, 25 bp, Mus musculus
tgagagcaagaatccccaggctgga

SEQ ID NO: 799096 - DNA, 25 bp, Mus musculus
tgagagcaagctcactcggcatggc

SEQ ID NO: 799097 - DNA, 25 bp, Mus musculus
tgagagcaagctgactcggcatggc

SEQ ID NO: 799098 - DNA, 25 bp, Mus musculus
tgagagcacagaatgaccggaaact

SEQ ID NO: 799099 - DNA, 25 bp, Mus musculus
tgagagcacagattgaccggaaact

SEQ ID NO: 799100 - DNA, 25 bp, Mus musculus
tgagagcaccacacttcggcagggt

SEQ ID NO: 799101 - DNA, 25 bp, Mus musculus
tgagagcaccactcttcggcagggt

SEQ ID NO: 799102 - DNA, 25 bp, Mus musculus
tgagagcacgaacaagtctagagag

SEQ ID NO: 799103 - DNA, 25 bp, Mus musculus
tgagagcacgaagaagtctagagag

SEQ ID NO: 799104 - DNA, 25 bp, Mus musculus
tgagagcactgaatgccagatcggt

SEQ ID NO: 799105 - DNA, 25 bp, Mus musculus
tgagagcactgattgccagatcggt

SEQ ID NO: 799106 - DNA, 25 bp, Mus musculus
tgagagcacttgaggcccagttaaa

SEQ ID NO: 799107 - DNA, 25 bp, Mus musculus
tgagagcacttgtggcccagttaaa

SEQ ID NO: 799108 - DNA, 25 bp, Mus musculus
tgagagcagcaacaacatgcccctg

SEQ ID NO: 799109 - DNA, 25 bp, Mus musculus
tgagagcagcaagaacatgcccctg

SEQ ID NO: 799110 - DNA, 25 bp, Mus musculus
tgagagcaggagcacatttcccttt

SEQ ID NO: 799111 - DNA, 25 bp, Mus musculus
tgagagcaggaggacatttcccttt

SEQ ID NO: 799112 - DNA, 25 bp, Mus musculus
tgagagcagggcctataatgtcagc

SEQ ID NO: 799113 - DNA, 25 bp, Mus musculus
tgagagcagggcgtataatgtcagc

SEQ ID NO: 799114 - DNA, 25 bp, Mus musculus
tgagagcatcttcaaaatgacaaag

SEQ ID NO: 799115 - DNA, 25 bp, Mus musculus
tgagagcatcttgaaaatgacaaag

SEQ ID NO: 799116 - DNA, 25 bp, Mus musculus
tgagagcattgcattccgcaggctc

SEQ ID NO: 799117 - DNA, 25 bp, Mus musculus
tgagagcattgctttccgcaggctc

SEQ ID NO: 799118 - DNA, 25 bp, Mus musculus
tgagagccacggatcccaaagctct

SEQ ID NO: 799119 - DNA, 25 bp, Mus musculus
tgagagccacggttcccaaagctct

SEQ ID NO: 799120 - DNA, 25 bp, Mus musculus
tgagagccactccagatattttggg

SEQ ID NO: 799121 - DNA, 25 bp, Mus musculus
tgagagccactcgagatattttggg

SEQ ID NO: 799122 - DNA, 25 bp, Mus musculus
tgagagccagacctcttttgggtcc

SEQ ID NO: 799123 - DNA, 25 bp, Mus musculus
tgagagccagacgtcttttgggtcc

SEQ ID NO: 799124 - DNA, 25 bp, Mus musculus
tgagagccatggactgtcacccttt

SEQ ID NO: 799125 - DNA, 25 bp, Mus musculus
tgagagccatggtctgtcacccttt

SEQ ID NO: 799126 - DNA, 25 bp, Mus musculus
tgagagcccactccatttatctgta

SEQ ID NO: 799127 - DNA, 25 bp, Mus musculus
tgagagcccactgcatttatctgta

SEQ ID NO: 799128 - DNA, 25 bp, Mus musculus
tgagagccccagatacctctacatc

SEQ ID NO: 799129 - DNA, 25 bp, Mus musculus
tgagagccccagttacctctacatc

SEQ ID NO: 799130 - DNA, 25 bp, Mus musculus
tgagagccgatcatagcaaagagct

SEQ ID NO: 799131 - DNA, 25 bp, Mus musculus
tgagagccgatcttagcaaagagct

SEQ ID NO: 799132 - DNA, 25 bp, Mus musculus
tgagagccgccacgactcagccgtg

SEQ ID NO: 799133 - DNA, 25 bp, Mus musculus
tgagagccgccaggactcagccgtg

SEQ ID NO: 799134 - DNA, 25 bp, Mus musculus
tgagagcctcatctcacatggccaa

SEQ ID NO: 799135 - DNA, 25 bp, Mus musculus
tgagagcctcatgtcacatggccaa

SEQ ID NO: 799136 - DNA, 25 bp, Mus musculus
tgagagcctgctcgtgccaggctat

SEQ ID NO: 799137 - DNA, 25 bp, Mus musculus
tgagagcctgctggtgccaggctat

SEQ ID NO: 799138 - DNA, 25 bp, Mus musculus
tgagagcgacagctaatgagactgc

SEQ ID NO: 799139 - DNA, 25 bp, Mus musculus
tgagagcgacaggtaatgagactgc

SEQ ID NO: 799140 - DNA, 25 bp, Mus musculus
tgagagcgagacagacattgcacct

SEQ ID NO: 799141 - DNA, 25 bp, Mus musculus
tgagagcgagactgacattgcacct

SEQ ID NO: 799142 - DNA, 25 bp, Mus musculus
tgagagcgctgtatctcatccccag

SEQ ID NO: 799143 - DNA, 25 bp, Mus musculus
tgagagcgctgtttctcatccccag

SEQ ID NO: 799144 - DNA, 25 bp, Mus musculus
tgagagctaccgagacccctttggc

SEQ ID NO: 799145 - DNA, 25 bp, Mus musculus
tgagagctaccgtgacccctttggc

SEQ ID NO: 799146 - DNA, 25 bp, Mus musculus
tgagagctacctcgcagttgcctcc

SEQ ID NO: 799147 - DNA, 25 bp, Mus musculus
tgagagctacctggcagttgcctcc

SEQ ID NO: 799148 - DNA, 25 bp, Mus musculus
tgagagctatctctgtcttcatcaa

SEQ ID NO: 799149 - DNA, 25 bp, Mus musculus
tgagagctatctgtgtcttcatcaa

SEQ ID NO: 799150 - DNA, 25 bp, Mus musculus
tgagagctgaatccagtccggtccg

SEQ ID NO: 799151 - DNA, 25 bp, Mus musculus
tgagagctgaatgcagtccggtccg

SEQ ID NO: 799152 - DNA, 25 bp, Mus musculus
tgagagctttcgatttcctttcagt

SEQ ID NO: 799153 - DNA, 25 bp, Mus musculus
tgagagctttcgttttcctttcagt

SEQ ID NO: 799154 - DNA, 25 bp, Mus musculus
tgagaggacatacggaatacctgtc

SEQ ID NO: 799155 - DNA, 25 bp, Mus musculus
tgagaggacatagggaatacctgtc

SEQ ID NO: 799156 - DNA, 25 bp, Mus musculus
tgagaggacccaatatccagatgtg

SEQ ID NO: 799157 - DNA, 25 bp, Mus musculus
tgagaggacccattatccagatgtg

SEQ ID NO: 799158 - DNA, 25 bp, Mus musculus
tgagaggagccgacaaaaatatgct

SEQ ID NO: 799159 - DNA, 25 bp, Mus musculus
tgagaggagccgtcaaaaatatgct

SEQ ID NO: 799160 - DNA, 25 bp, Mus musculus
tgagaggagtctaaagagagactga

SEQ ID NO: 799161 - DNA, 25 bp, Mus musculus
tgagaggagtcttaagagagactga

SEQ ID NO: 799162 - DNA, 25 bp, Mus musculus
tgagaggccactcccggccggacat

SEQ ID NO: 799163 - DNA, 25 bp, Mus musculus
tgagaggccactgccggccggacat

SEQ ID NO: 799164 - DNA, 25 bp, Mus musculus
tgagaggccaggacaggcgattttc

SEQ ID NO: 799165 - DNA, 25 bp, Mus musculus
tgagaggccaggtcaggcgattttc

SEQ ID NO: 799166 - DNA, 25 bp, Mus musculus
tgagaggccctcaggacgatcttct

SEQ ID NO: 799167 - DNA, 25 bp, Mus musculus
tgagaggccctctggacgatcttct

SEQ ID NO: 799168 - DNA, 25 bp, Mus musculus
tgagaggccgcaagatcagccctcc

SEQ ID NO: 799169 - DNA, 25 bp, Mus musculus
tgagaggccgcatgatcagccctcc

SEQ ID NO: 799170 - DNA, 25 bp, Mus musculus
tgagaggcctgaccccttgttctgg

SEQ ID NO: 799171 - DNA, 25 bp, Mus musculus
tgagaggcctgagcccttgttctgg

SEQ ID NO: 799172 - DNA, 25 bp, Mus musculus
tgagaggcgccaaatgaacactgcc

SEQ ID NO: 799173 - DNA, 25 bp, Mus musculus
tgagaggcgccatatgaacactgcc

SEQ ID NO: 799174 - DNA, 25 bp, Mus musculus
tgagaggcgtttcgccaacagcagc

SEQ ID NO: 799175 - DNA, 25 bp, Mus musculus
tgagaggcgtttggccaacagcagc

SEQ ID NO: 799176 - DNA, 25 bp, Mus musculus
tgagaggctcttataaaaccacagc

SEQ ID NO: 799177 - DNA, 25 bp, Mus musculus
tgagaggctcttttaaaaccacagc

SEQ ID NO: 799178 - DNA, 25 bp, Mus musculus
tgagaggcttggaccatgtctcctc

SEQ ID NO: 799179 - DNA, 25 bp, Mus musculus
tgagaggcttggtccatgtctcctc

SEQ ID NO: 799180 - DNA, 25 bp, Mus musculus
tgagaggcttttactgctcccggtg

SEQ ID NO: 799181 - DNA, 25 bp, Mus musculus
tgagaggctttttctgctcccggtg

SEQ ID NO: 799182 - DNA, 25 bp, Mus musculus
tgagagggaaaacacttcgacggac

SEQ ID NO: 799183 - DNA, 25 bp, Mus musculus
tgagagggaaaagacttcgacggac

SEQ ID NO: 799184 - DNA, 25 bp, Mus musculus
tgagagggcctcatgtatagagtgc

SEQ ID NO: 799185 - DNA, 25 bp, Mus musculus
tgagagggcctcttgtatagagtgc

SEQ ID NO: 799186 - DNA, 25 bp, Mus musculus
tgagagggcttcagtctagacacgg

SEQ ID NO: 799187 - DNA, 25 bp, Mus musculus
tgagagggcttctgtctagacacgg

SEQ ID NO: 799188 - DNA, 25 bp, Mus musculus
tgagagggttgaccaccagcagaca

SEQ ID NO: 799189 - DNA, 25 bp, Mus musculus
tgagagggttgagcaccagcagaca

SEQ ID NO: 799190 - DNA, 25 bp, Mus musculus
tgagaggtaagactcgccttctatc

SEQ ID NO: 799191 - DNA, 25 bp, Mus musculus
tgagaggtaagagtcgccttctatc

SEQ ID NO: 799192 - DNA, 25 bp, Mus musculus
tgagaggtacgtacatagttggagc

SEQ ID NO: 799193 - DNA, 25 bp, Mus musculus
tgagaggtacgttcatagttggagc

SEQ ID NO: 799194 - DNA, 25 bp, Mus musculus
tgagaggtactactagatcttccag

SEQ ID NO: 799195 - DNA, 25 bp, Mus musculus
tgagaggtactagtagatcttccag

SEQ ID NO: 799196 - DNA, 25 bp, Mus musculus
tgagaggtcactcccacttcgttag

SEQ ID NO: 799197 - DNA, 25 bp, Mus musculus
tgagaggtcactgccacttcgttag

SEQ ID NO: 799198 - DNA, 25 bp, Mus musculus
tgagaggtcagacatactaaaaccc

SEQ ID NO: 799199 - DNA, 25 bp, Mus musculus
tgagaggtcagagatactaaaaccc

SEQ ID NO: 799200 - DNA, 25 bp, Mus musculus
tgagagtcaggacgagtccccgtcc

SEQ ID NO: 799201 - DNA, 25 bp, Mus musculus
tgagagtcaggaggagtccccgtcc

SEQ ID NO: 799202 - DNA, 25 bp, Mus musculus
tgagagtccgcaagaagatgtctgg

SEQ ID NO: 799203 - DNA, 25 bp, Mus musculus
tgagagtccgcatgaagatgtctgg

SEQ ID NO: 799204 - DNA, 25 bp, Mus musculus
tgagagtcgatcaagacaaagacag

SEQ ID NO: 799205 - DNA, 25 bp, Mus musculus
tgagagtcgatctagacaaagacag

SEQ ID NO: 799206 - DNA, 25 bp, Mus musculus
tgagagtcgccacattacccaggtc

SEQ ID NO: 799207 - DNA, 25 bp, Mus musculus
tgagagtcgccagattacccaggtc

SEQ ID NO: 799208 - DNA, 25 bp, Mus musculus
tgagagtctcctctgtcgcacacgg

SEQ ID NO: 799209 - DNA, 25 bp, Mus musculus
tgagagtctcctgtgtcgcacacgg

SEQ ID NO: 799210 - DNA, 25 bp, Mus musculus
tgagagtcttaacgcatggacttga

SEQ ID NO: 799211 - DNA, 25 bp, Mus musculus
tgagagtcttaaggcatggacttga

SEQ ID NO: 799212 - DNA, 25 bp, Mus musculus
tgagagtcttgtctttcaaagcagc

SEQ ID NO: 799213 - DNA, 25 bp, Mus musculus
tgagagtcttgtgtttcaaagcagc

SEQ ID NO: 799214 - DNA, 25 bp, Mus musculus
tgagagtgatgcacaagagccagcc

SEQ ID NO: 799215 - DNA, 25 bp, Mus musculus
tgagagtgatgctcaagagccagcc

SEQ ID NO: 799216 - DNA, 25 bp, Mus musculus
tgagagtgcatcaggctctgaaccc

SEQ ID NO: 799217 - DNA, 25 bp, Mus musculus
tgagagtgcatctggctctgaaccc

SEQ ID NO: 799218 - DNA, 25 bp, Mus musculus
tgagagtggaggaactgcacaccag

SEQ ID NO: 799219 - DNA, 25 bp, Mus musculus
tgagagtggaggtactgcacaccag

SEQ ID NO: 799220 - DNA, 25 bp, Mus musculus
tgagagtggccaacctgcccttggt

SEQ ID NO: 799221 - DNA, 25 bp, Mus musculus
tgagagtggccatcctgcccttggt

SEQ ID NO: 799222 - DNA, 25 bp, Mus musculus
tgagagtggtgtcgccttcattcct

SEQ ID NO: 799223 - DNA, 25 bp, Mus musculus
tgagagtggtgtggccttcattcct

SEQ ID NO: 799224 - DNA, 25 bp, Mus musculus
tgagagtgtcacctagtcaagtcac

SEQ ID NO: 799225 - DNA, 25 bp, Mus musculus
tgagagtgtcacgtagtcaagtcac

SEQ ID NO: 799226 - DNA, 25 bp, Mus musculus
tgagagtgtcctccatccagcagga

SEQ ID NO: 799227 - DNA, 25 bp, Mus musculus
tgagagtgtcctgcatccagcagga

SEQ ID NO: 799228 - DNA, 25 bp, Mus musculus
tgagagtgtctgagcgccatagcct

SEQ ID NO: 799229 - DNA, 25 bp, Mus musculus
tgagagtgtctgtgcgccatagcct

SEQ ID NO: 799230 - DNA, 25 bp, Mus musculus
tgagagtgtggtagaactgcccact

SEQ ID NO: 799231 - DNA, 25 bp, Mus musculus
tgagagtgtggttgaactgcccact

SEQ ID NO: 799232 - DNA, 25 bp, Mus musculus
tgagagttgaacatgccacccactt

SEQ ID NO: 799233 - DNA, 25 bp, Mus musculus
tgagagttgaacttgccacccactt

SEQ ID NO: 799234 - DNA, 25 bp, Mus musculus
tgagataatccgagataacactggc

SEQ ID NO: 799235 - DNA, 25 bp, Mus musculus
tgagataatccgtgataacactggc

SEQ ID NO: 799236 - DNA, 25 bp, Mus musculus
tgagatactacacaacagttaaatc

SEQ ID NO: 799237 - DNA, 25 bp, Mus musculus
tgagatactacagaacagttaaatc

SEQ ID NO: 799238 - DNA, 25 bp, Mus musculus
tgagatactgcaacgtgtacgacag

SEQ ID NO: 799239 - DNA, 25 bp, Mus musculus
tgagatactgcatcgtgtacgacag

SEQ ID NO: 799240 - DNA, 25 bp, Mus musculus
tgagatactggccattttctcgacc

SEQ ID NO: 799241 - DNA, 25 bp, Mus musculus
tgagatactggcgattttctcgacc

SEQ ID NO: 799242 - DNA, 25 bp, Mus musculus
tgagatagagacctactacttgcct

SEQ ID NO: 799243 - DNA, 25 bp, Mus musculus
tgagatagagacgtactacttgcct

SEQ ID NO: 799244 - DNA, 25 bp, Mus musculus
tgagatagcgcccactcaggagact

SEQ ID NO: 799245 - DNA, 25 bp, Mus musculus
tgagatagcgccgactcaggagact

SEQ ID NO: 799246 - DNA, 25 bp, Mus musculus
tgagatatcctgctgatccttattc

SEQ ID NO: 799247 - DNA, 25 bp, Mus musculus
tgagatatcctggtgatccttattc

SEQ ID NO: 799248 - DNA, 25 bp, Mus musculus
tgagatatgcagctgtgaggaccct

SEQ ID NO: 799249 - DNA, 25 bp, Mus musculus
tgagatatgcaggtgtgaggaccct

SEQ ID NO: 799250 - DNA, 25 bp, Mus musculus
tgagatatttgaaatcgaaagaggg

SEQ ID NO: 799251 - DNA, 25 bp, Mus musculus
tgagatatttgatatcgaaagaggg

SEQ ID NO: 799252 - DNA, 25 bp, Mus musculus
tgagatcaacctcacacacattgaa

SEQ ID NO: 799253 - DNA, 25 bp, Mus musculus
tgagatcaacctgacacacattgaa

SEQ ID NO: 799254 - DNA, 25 bp, Mus musculus
tgagatcaacttcctcaagaccctt

SEQ ID NO: 799255 - DNA, 25 bp, Mus musculus
tgagatcaacttgctcaagaccctt

SEQ ID NO: 799256 - DNA, 25 bp, Mus musculus
tgagatcaagagagtcggcaaggat

SEQ ID NO: 799257 - DNA, 25 bp, Mus musculus
tgagatcaagagtgtcggcaaggat

SEQ ID NO: 799258 - DNA, 25 bp, Mus musculus
tgagatcaagatctaggcaccctgg

SEQ ID NO: 799259 - DNA, 25 bp, Mus musculus
tgagatcaagatgtaggcaccctgg

SEQ ID NO: 799260 - DNA, 25 bp, Mus musculus
tgagatcaagccagctcagccacct

SEQ ID NO: 799261 - DNA, 25 bp, Mus musculus
tgagatcaagcctgctcagccacct

SEQ ID NO: 799262 - DNA, 25 bp, Mus musculus
tgagatcacaggacacaacaaagtc

SEQ ID NO: 799263 - DNA, 25 bp, Mus musculus
tgagatcacaggtcacaacaaagtc

SEQ ID NO: 799264 - DNA, 25 bp, Mus musculus
tgagatcacatgaggaccaggctgg

SEQ ID NO: 799265 - DNA, 25 bp, Mus musculus
tgagatcacatgtggaccaggctgg

SEQ ID NO: 799266 - DNA, 25 bp, Mus musculus
tgagatcaccagcaagattgcaagg

SEQ ID NO: 799267 - DNA, 25 bp, Mus musculus
tgagatcaccaggaagattgcaagg

SEQ ID NO: 799268 - DNA, 25 bp, Mus musculus
tgagatcagcaacgtttttagtaac

SEQ ID NO: 799269 - DNA, 25 bp, Mus musculus
tgagatcagcaaggtttttagtaac

SEQ ID NO: 799270 - DNA, 25 bp, Mus musculus
tgagatcagcatcgccatggacggc

SEQ ID NO: 799271 - DNA, 25 bp, Mus musculus
tgagatcagcatggccatggacggc

SEQ ID NO: 799272 - DNA, 25 bp, Mus musculus
tgagatcatcttcatgtcctcgttg

SEQ ID NO: 799273 - DNA, 25 bp, Mus musculus
tgagatcatcttgatgtcctcgttg

SEQ ID NO: 799274 - DNA, 25 bp, Mus musculus
tgagatccaacaccgtatgcagcgc

SEQ ID NO: 799275 - DNA, 25 bp, Mus musculus
tgagatccaacagcgtatgcagcgc

SEQ ID NO: 799276 - DNA, 25 bp, Mus musculus
tgagatccaatactgccagcgcctg

SEQ ID NO: 799277 - DNA, 25 bp, Mus musculus
tgagatccaatagtgccagcgcctg

SEQ ID NO: 799278 - DNA, 25 bp, Mus musculus
tgagatccactgaaggccatccttg

SEQ ID NO: 799279 - DNA, 25 bp, Mus musculus
tgagatccactgtaggccatccttg

SEQ ID NO: 799280 - DNA, 25 bp, Mus musculus
tgagatccagatcgactccccaatg

SEQ ID NO: 799281 - DNA, 25 bp, Mus musculus
tgagatccagatggactccccaatg

SEQ ID NO: 799282 - DNA, 25 bp, Mus musculus
tgagatccgcagagatcactttgag

SEQ ID NO: 799283 - DNA, 25 bp, Mus musculus
tgagatccgcagtgatcactttgag

SEQ ID NO: 799284 - DNA, 25 bp, Mus musculus
tgagatccgtttcccagaatttaca

SEQ ID NO: 799285 - DNA, 25 bp, Mus musculus
tgagatccgtttgccagaatttaca

SEQ ID NO: 799286 - DNA, 25 bp, Mus musculus
tgagatcctgcaagccccagaaaag

SEQ ID NO: 799287 - DNA, 25 bp, Mus musculus
tgagatcctgcatgccccagaaaag

SEQ ID NO: 799288 - DNA, 25 bp, Mus musculus
tgagatccttggagcagcttcggaa

SEQ ID NO: 799289 - DNA, 25 bp, Mus musculus
tgagatccttggtgcagcttcggaa

SEQ ID NO: 799290 - DNA, 25 bp, Mus musculus
tgagatcgacggcactgagaaagca

SEQ ID NO: 799291 - DNA, 25 bp, Mus musculus
tgagatcgacgggactgagaaagca

SEQ ID NO: 799292 - DNA, 25 bp, Mus musculus
tgagatcgtattcctgacagatggg

SEQ ID NO: 799293 - DNA, 25 bp, Mus musculus
tgagatcgtattgctgacagatggg

SEQ ID NO: 799294 - DNA, 25 bp, Mus musculus
tgagatctacgacttcatggatgaa

SEQ ID NO: 799295 - DNA, 25 bp, Mus musculus
tgagatctacgagttcatggatgaa

SEQ ID NO: 799296 - DNA, 25 bp, Mus musculus
tgagatctcagcctttaagacttgt

SEQ ID NO: 799297 - DNA, 25 bp, Mus musculus
tgagatctcagcgtttaagacttgt

SEQ ID NO: 799298 - DNA, 25 bp, Mus musculus
tgagatctgaggactgcttcatcct

SEQ ID NO: 799299 - DNA, 25 bp, Mus musculus
tgagatctgaggtctgcttcatcct

SEQ ID NO: 799300 - DNA, 25 bp, Mus musculus
tgagatctgatacatggacgtgtcg

SEQ ID NO: 799301 - DNA, 25 bp, Mus musculus
tgagatctgatagatggacgtgtcg

SEQ ID NO: 799302 - DNA, 25 bp, Mus musculus
tgagatgaaaccagcctcttcggaa

SEQ ID NO: 799303 - DNA, 25 bp, Mus musculus
tgagatgaaacctgcctcttcggaa

SEQ ID NO: 799304 - DNA, 25 bp, Mus musculus
tgagatgaatgcacagggtgacaag

SEQ ID NO: 799305 - DNA, 25 bp, Mus musculus
tgagatgaatgctcagggtgacaag

SEQ ID NO: 799306 - DNA, 25 bp, Mus musculus
tgagatgacaggctacgtggctacc

SEQ ID NO: 799307 - DNA, 25 bp, Mus musculus
tgagatgacagggtacgtggctacc

SEQ ID NO: 799308 - DNA, 25 bp, Mus musculus
tgagatgaccccacagctggaactg

SEQ ID NO: 799309 - DNA, 25 bp, Mus musculus
tgagatgacccctcagctggaactg

SEQ ID NO: 799310 - DNA, 25 bp, Mus musculus
tgagatgatccaaggagttgctgcg

SEQ ID NO: 799311 - DNA, 25 bp, Mus musculus
tgagatgatccacaagtctgtgacc

SEQ ID NO: 799312 - DNA, 25 bp, Mus musculus
tgagatgatccagaagtctgtgacc

SEQ ID NO: 799313 - DNA, 25 bp, Mus musculus
tgagatgatccatggagttgctgcg

SEQ ID NO: 799314 - DNA, 25 bp, Mus musculus
tgagatgatctccacgcttcttatt

SEQ ID NO: 799315 - DNA, 25 bp, Mus musculus
tgagatgatctcgacgcttcttatt

SEQ ID NO: 799316 - DNA, 25 bp, Mus musculus
tgagatgatggaagccaaagccagg

SEQ ID NO: 799317 - DNA, 25 bp, Mus musculus
tgagatgatggatgccaaagccagg

SEQ ID NO: 799318 - DNA, 25 bp, Mus musculus
tgagatgattctcagcatggtgctg

SEQ ID NO: 799319 - DNA, 25 bp, Mus musculus
tgagatgattctgagcatggtgctg

SEQ ID NO: 799320 - DNA, 25 bp, Mus musculus
tgagatgcaggaccttgccattcag

SEQ ID NO: 799321 - DNA, 25 bp, Mus musculus
tgagatgcaggagcttgccattcag

SEQ ID NO: 799322 - DNA, 25 bp, Mus musculus
tgagatgcatctcctaatccagcag

SEQ ID NO: 799323 - DNA, 25 bp, Mus musculus
tgagatgcatctgctaatccagcag

SEQ ID NO: 799324 - DNA, 25 bp, Mus musculus
tgagatgcctatcgcctctgctgtg

SEQ ID NO: 799325 - DNA, 25 bp, Mus musculus
tgagatgcctatggcctctgctgtg

SEQ ID NO: 799326 - DNA, 25 bp, Mus musculus
tgagatgcgctgattgcctaggaag

SEQ ID NO: 799327 - DNA, 25 bp, Mus musculus
tgagatgcgctgtttgcctaggaag

SEQ ID NO: 799328 - DNA, 25 bp, Mus musculus
tgagatgcttctctttgggaagaag

SEQ ID NO: 799329 - DNA, 25 bp, Mus musculus
tgagatgcttctgtttgggaagaag

SEQ ID NO: 799330 - DNA, 25 bp, Mus musculus
tgagatggacatacaggctgcagct

SEQ ID NO: 799331 - DNA, 25 bp, Mus musculus
tgagatggacattcaggctgcagct

SEQ ID NO: 799332 - DNA, 25 bp, Mus musculus
tgagatggcaccagcaagtcagggc

SEQ ID NO: 799333 - DNA, 25 bp, Mus musculus
tgagatggcacctgcaagtcagggc

SEQ ID NO: 799334 - DNA, 25 bp, Mus musculus
tgagatgggcacagtccgagtagcc

SEQ ID NO: 799335 - DNA, 25 bp, Mus musculus
tgagatgggcactgtccgagtagcc

SEQ ID NO: 799336 - DNA, 25 bp, Mus musculus
tgagatgggtgtccaacgttcccac

SEQ ID NO: 799337 - DNA, 25 bp, Mus musculus
tgagatgggtgtgcaacgttcccac

SEQ ID NO: 799338 - DNA, 25 bp, Mus musculus
tgagatggtaatcgccacagatatg

SEQ ID NO: 799339 - DNA, 25 bp, Mus musculus
tgagatggtaatggccacagatatg

SEQ ID NO: 799340 - DNA, 25 bp, Mus musculus
tgagatggtatgagcctccagccca

SEQ ID NO: 799341 - DNA, 25 bp, Mus musculus
tgagatggtatgtgcctccagccca

SEQ ID NO: 799342 - DNA, 25 bp, Mus musculus
tgagatggtgagcacgggagaggcc

SEQ ID NO: 799343 - DNA, 25 bp, Mus musculus
tgagatggtgaggacgggagaggcc

SEQ ID NO: 799344 - DNA, 25 bp, Mus musculus
tgagatgtagcacgcgcacctgtga

SEQ ID NO: 799345 - DNA, 25 bp, Mus musculus
tgagatgtagcaggcgcacctgtga

SEQ ID NO: 799346 - DNA, 25 bp, Mus musculus
tgagatgtcactctagcagggcctt

SEQ ID NO: 799347 - DNA, 25 bp, Mus musculus
tgagatgtcactgtagcagggcctt

SEQ ID NO: 799348 - DNA, 25 bp, Mus musculus
tgagatgtcctacggattgaacatc

SEQ ID NO: 799349 - DNA, 25 bp, Mus musculus
tgagatgtcctagggattgaacatc

SEQ ID NO: 799350 - DNA, 25 bp, Mus musculus
tgagatgttcacacacctctaccag

SEQ ID NO: 799351 - DNA, 25 bp, Mus musculus
tgagatgttcactcacctctaccag

SEQ ID NO: 799352 - DNA, 25 bp, Mus musculus
tgagatgttctcctgttccctggac

SEQ ID NO: 799353 - DNA, 25 bp, Mus musculus
tgagatgttctcgtgttccctggac

SEQ ID NO: 799354 - DNA, 25 bp, Mus musculus
tgagattagaagacaacagcctatg

SEQ ID NO: 799355 - DNA, 25 bp, Mus musculus
tgagattagaagtcaacagcctatg

SEQ ID NO: 799356 - DNA, 25 bp, Mus musculus
tgagattagcatcgattgtatccgc

SEQ ID NO: 799357 - DNA, 25 bp, Mus musculus
tgagattagcatggattgtatccgc

SEQ ID NO: 799358 - DNA, 25 bp, Mus musculus
tgagattcaacacagcttccgagca

SEQ ID NO: 799359 - DNA, 25 bp, Mus musculus
tgagattcaacagagcttccgagca

SEQ ID NO: 799360 - DNA, 25 bp, Mus musculus
tgagattcagttccctctgccacct

SEQ ID NO: 799361 - DNA, 25 bp, Mus musculus
tgagattcagttgcctctgccacct

SEQ ID NO: 799362 - DNA, 25 bp, Mus musculus
tgagattcataaacagacagtccct

SEQ ID NO: 799363 - DNA, 25 bp, Mus musculus
tgagattcataatcagacagtccct

SEQ ID NO: 799364 - DNA, 25 bp, Mus musculus
tgagattccaaaagcgtctgagaag

SEQ ID NO: 799365 - DNA, 25 bp, Mus musculus
tgagattccaaatgcgtctgagaag

SEQ ID NO: 799366 - DNA, 25 bp, Mus musculus
tgagattccaacaatgccaccaagc

SEQ ID NO: 799367 - DNA, 25 bp, Mus musculus
tgagattccaactatgccaccaagc

SEQ ID NO: 799368 - DNA, 25 bp, Mus musculus
tgagattccattccggttacaggag

SEQ ID NO: 799369 - DNA, 25 bp, Mus musculus
tgagattccattgcggttacaggag

SEQ ID NO: 799370 - DNA, 25 bp, Mus musculus
tgagattctcaaaaatgctgagctg

SEQ ID NO: 799371 - DNA, 25 bp, Mus musculus
tgagattctcaataatgctgagctg

SEQ ID NO: 799372 - DNA, 25 bp, Mus musculus
tgagattctgctcctggcagcctag

SEQ ID NO: 799373 - DNA, 25 bp, Mus musculus
tgagattctgctgctggcagcctag

SEQ ID NO: 799374 - DNA, 25 bp, Mus musculus
tgagattctgtacccctgcagccct

SEQ ID NO: 799375 - DNA, 25 bp, Mus musculus
tgagattctgtagccctgcagccct

SEQ ID NO: 799376 - DNA, 25 bp, Mus musculus
tgagattgccaaagctgtgagagag

SEQ ID NO: 799377 - DNA, 25 bp, Mus musculus
tgagattgccaatgctgtgagagag

SEQ ID NO: 799378 - DNA, 25 bp, Mus musculus
tgagattgccgtagctggctgcccc

SEQ ID NO: 799379 - DNA, 25 bp, Mus musculus
tgagattgccgttgctggctgcccc

SEQ ID NO: 799380 - DNA, 25 bp, Mus musculus
tgagattgcggacatgaaccgctct

SEQ ID NO: 799381 - DNA, 25 bp, Mus musculus
tgagattgcggagatgaaccgctct

SEQ ID NO: 799382 - DNA, 25 bp, Mus musculus
tgagattggttaacttccctatgga

SEQ ID NO: 799383 - DNA, 25 bp, Mus musculus
tgagattggttatcttccctatgga

SEQ ID NO: 799384 - DNA, 25 bp, Mus musculus
tgagattgtaaaagcccttctggtg

SEQ ID NO: 799385 - DNA, 25 bp, Mus musculus
tgagattgtaaatgcccttctggtg

SEQ ID NO: 799386 - DNA, 25 bp, Mus musculus
tgagatttcaagaggctacagcctg

SEQ ID NO: 799387 - DNA, 25 bp, Mus musculus
tgagatttcaagtggctacagcctg

SEQ ID NO: 799388 - DNA, 25 bp, Mus musculus
tgagatttccaaagaatcacaggaa

SEQ ID NO: 799389 - DNA, 25 bp, Mus musculus
tgagatttccaatgaatcacaggaa

SEQ ID NO: 799390 - DNA, 25 bp, Mus musculus
tgagatttgtgccagaattatggaa

SEQ ID NO: 799391 - DNA, 25 bp, Mus musculus
tgagatttgtgcgagaattatggaa

SEQ ID NO: 799392 - DNA, 25 bp, Mus musculus
tgagcaaaatcaccctggtggacct

SEQ ID NO: 799393 - DNA, 25 bp, Mus musculus
tgagcaaaatcagcctggtggacct

SEQ ID NO: 799394 - DNA, 25 bp, Mus musculus
tgagcaaacccaatgggcctctggc

SEQ ID NO: 799395 - DNA, 25 bp, Mus musculus
tgagcaaacccattgggcctctggc

SEQ ID NO: 799396 - DNA, 25 bp, Mus musculus
tgagcaaagtatacctggaagagga

SEQ ID NO: 799397 - DNA, 25 bp, Mus musculus
tgagcaaagtatctgaccaggaaca

SEQ ID NO: 799398 - DNA, 25 bp, Mus musculus
tgagcaaagtatgtgaccaggaaca

SEQ ID NO: 799399 - DNA, 25 bp, Mus musculus
tgagcaaagtattcctggaagagga

SEQ ID NO: 799400 - DNA, 25 bp, Mus musculus
tgagcaacagcacataacagacgcc

SEQ ID NO: 799401 - DNA, 25 bp, Mus musculus
tgagcaacagcagataacagacgcc

SEQ ID NO: 799402 - DNA, 25 bp, Mus musculus
tgagcaacagcgactcatgcagcga

SEQ ID NO: 799403 - DNA, 25 bp, Mus musculus
tgagcaacagcgtctcatgcagcga

SEQ ID NO: 799404 - DNA, 25 bp, Mus musculus
tgagcaacagtacactggcaacgat

SEQ ID NO: 799405 - DNA, 25 bp, Mus musculus
tgagcaacagtacccggcatgaact

SEQ ID NO: 799406 - DNA, 25 bp, Mus musculus
tgagcaacagtagactggcaacgat

SEQ ID NO: 799407 - DNA, 25 bp, Mus musculus
tgagcaacagtagccggcatgaact

SEQ ID NO: 799408 - DNA, 25 bp, Mus musculus
tgagcaacatcgaccgtattggagc

SEQ ID NO: 799409 - DNA, 25 bp, Mus musculus
tgagcaacatcgtccgtattggagc

SEQ ID NO: 799410 - DNA, 25 bp, Mus musculus
tgagcaacattaaggctttcagggc

SEQ ID NO: 799411 - DNA, 25 bp, Mus musculus
tgagcaacattacagtgccattact

SEQ ID NO: 799412 - DNA, 25 bp, Mus musculus
tgagcaacattagagtgccattact

SEQ ID NO: 799413 - DNA, 25 bp, Mus musculus
tgagcaacattatggctttcagggc

SEQ ID NO: 799414 - DNA, 25 bp, Mus musculus
tgagcaaccttaatatgggaaatgc

SEQ ID NO: 799415 - DNA, 25 bp, Mus musculus
tgagcaaccttattatgggaaatgc

SEQ ID NO: 799416 - DNA, 25 bp, Mus musculus
tgagcaacgtctaaaggccatagtc

SEQ ID NO: 799417 - DNA, 25 bp, Mus musculus
tgagcaacgtcttaaggccatagtc

SEQ ID NO: 799418 - DNA, 25 bp, Mus musculus
tgagcaactgggagatcctctggac

SEQ ID NO: 799419 - DNA, 25 bp, Mus musculus
tgagcaactgggtgatcctctggac

SEQ ID NO: 799420 - DNA, 25 bp, Mus musculus
tgagcaagacccacaagtgatcctg

SEQ ID NO: 799421 - DNA, 25 bp, Mus musculus
tgagcaagaccctcaagtgatcctg

SEQ ID NO: 799422 - DNA, 25 bp, Mus musculus
tgagcaagaggtaccatatttacct

SEQ ID NO: 799423 - DNA, 25 bp, Mus musculus
tgagcaagaggtacctcagctggga

SEQ ID NO: 799424 - DNA, 25 bp, Mus musculus
tgagcaagaggttccatatttacct

SEQ ID NO: 799425 - DNA, 25 bp, Mus musculus
tgagcaagaggttcctcagctggga

SEQ ID NO: 799426 - DNA, 25 bp, Mus musculus
tgagcaagcacaataagaagccgat

SEQ ID NO: 799427 - DNA, 25 bp, Mus musculus
tgagcaagcacattaagaagccgat

SEQ ID NO: 799428 - DNA, 25 bp, Mus musculus
tgagcaagccatctcgtcacacttc

SEQ ID NO: 799429 - DNA, 25 bp, Mus musculus
tgagcaagccatgtcgtcacacttc

SEQ ID NO: 799430 - DNA, 25 bp, Mus musculus
tgagcaagcccccagttgaatgcat

SEQ ID NO: 799431 - DNA, 25 bp, Mus musculus
tgagcaagccccgagttgaatgcat

SEQ ID NO: 799432 - DNA, 25 bp, Mus musculus
tgagcaagctctctgtgctcaacaa

SEQ ID NO: 799433 - DNA, 25 bp, Mus musculus
tgagcaagctctgtgtgctcaacaa

SEQ ID NO: 799434 - DNA, 25 bp, Mus musculus
tgagcaaggaatactgggactgtct

SEQ ID NO: 799435 - DNA, 25 bp, Mus musculus
tgagcaaggaattctgggactgtct

SEQ ID NO: 799436 - DNA, 25 bp, Mus musculus
tgagcaaggagtctacatggtactg

SEQ ID NO: 799437 - DNA, 25 bp, Mus musculus
tgagcaaggagtgtacatggtactg

SEQ ID NO: 799438 - DNA, 25 bp, Mus musculus
tgagcaaggatgagcccgatggccc

SEQ ID NO: 799439 - DNA, 25 bp, Mus musculus
tgagcaaggatgtgcccgatggccc

SEQ ID NO: 799440 - DNA, 25 bp, Mus musculus
tgagcaaggtgccacaagaattggt

SEQ ID NO: 799441 - DNA, 25 bp, Mus musculus
tgagcaaggtgcgacaagaattggt

SEQ ID NO: 799442 - DNA, 25 bp, Mus musculus
tgagcaagtccacgactcttccatg

SEQ ID NO: 799443 - DNA, 25 bp, Mus musculus
tgagcaagtccaggactcttccatg

SEQ ID NO: 799444 - DNA, 25 bp, Mus musculus
tgagcaatacatcgaccatttcaac

SEQ ID NO: 799445 - DNA, 25 bp, Mus musculus
tgagcaatacatggaccatttcaac

SEQ ID NO: 799446 - DNA, 25 bp, Mus musculus
tgagcaatctgcagactactacaaa

SEQ ID NO: 799447 - DNA, 25 bp, Mus musculus
tgagcaatctgctgactactacaaa

SEQ ID NO: 799448 - DNA, 25 bp, Mus musculus
tgagcaatgacacccacacatgggt

SEQ ID NO: 799449 - DNA, 25 bp, Mus musculus
tgagcaatgacagccacacatgggt

SEQ ID NO: 799450 - DNA, 25 bp, Mus musculus
tgagcaatgacgacgctgtacgggt

SEQ ID NO: 799451 - DNA, 25 bp, Mus musculus
tgagcaatgacgtcgctgtacgggt

SEQ ID NO: 799452 - DNA, 25 bp, Mus musculus
tgagcaatgagtagtcccaggcccg

SEQ ID NO: 799453 - DNA, 25 bp, Mus musculus
tgagcaatgagttgtcccaggcccg

SEQ ID NO: 799454 - DNA, 25 bp, Mus musculus
tgagcaatgccacctccgagacttc

SEQ ID NO: 799455 - DNA, 25 bp, Mus musculus
tgagcaatgccagctccgagacttc

SEQ ID NO: 799456 - DNA, 25 bp, Mus musculus
tgagcaattgcacgctgagcagaag

SEQ ID NO: 799457 - DNA, 25 bp, Mus musculus
tgagcaattgcaggctgagcagaag

SEQ ID NO: 799458 - DNA, 25 bp, Mus musculus
tgagcacaaaggagtacttagacct

SEQ ID NO: 799459 - DNA, 25 bp, Mus musculus
tgagcacaaaggtgtacttagacct

SEQ ID NO: 799460 - DNA, 25 bp, Mus musculus
tgagcacaagcccaactgcacgcat

SEQ ID NO: 799461 - DNA, 25 bp, Mus musculus
tgagcacaagccgaactgcacgcat

SEQ ID NO: 799462 - DNA, 25 bp, Mus musculus
tgagcacacagacataccgcctgca

SEQ ID NO: 799463 - DNA, 25 bp, Mus musculus
tgagcacacagagataccgcctgca

SEQ ID NO: 799464 - DNA, 25 bp, Mus musculus
tgagcacacagcaggactgagccgt

SEQ ID NO: 799465 - DNA, 25 bp, Mus musculus
tgagcacacagctggactgagccgt

SEQ ID NO: 799466 - DNA, 25 bp, Mus musculus
tgagcacagaggatctggtcaacct

SEQ ID NO: 799467 - DNA, 25 bp, Mus musculus
tgagcacagaggttctggtcaacct

SEQ ID NO: 799468 - DNA, 25 bp, Mus musculus
tgagcacagccacctataaccagcg

SEQ ID NO: 799469 - DNA, 25 bp, Mus musculus
tgagcacagccagctataaccagcg

SEQ ID NO: 799470 - DNA, 25 bp, Mus musculus
tgagcacagccgagtattgtctggc

SEQ ID NO: 799471 - DNA, 25 bp, Mus musculus
tgagcacagccgtgtattgtctggc

SEQ ID NO: 799472 - DNA, 25 bp, Mus musculus
tgagcacagcgtccatcgctatggc

SEQ ID NO: 799473 - DNA, 25 bp, Mus musculus
tgagcacagcgtgcatcgctatggc

SEQ ID NO: 799474 - DNA, 25 bp, Mus musculus
tgagcacagctgagtcaagtagagc

SEQ ID NO: 799475 - DNA, 25 bp, Mus musculus
tgagcacagctgtgtcaagtagagc

SEQ ID NO: 799476 - DNA, 25 bp, Mus musculus
tgagcacagcttacacgtgtagaag

SEQ ID NO: 799477 - DNA, 25 bp, Mus musculus
tgagcacagctttcacgtgtagaag

SEQ ID NO: 799478 - DNA, 25 bp, Mus musculus
tgagcacagggcaagtggcctcttc

SEQ ID NO: 799479 - DNA, 25 bp, Mus musculus
tgagcacagggctagtggcctcttc

SEQ ID NO: 799480 - DNA, 25 bp, Mus musculus
tgagcacatacaaccaagctgtggg

SEQ ID NO: 799481 - DNA, 25 bp, Mus musculus
tgagcacatacatccaagctgtggg

SEQ ID NO: 799482 - DNA, 25 bp, Mus musculus
tgagcacatgcaaggacagactaac

SEQ ID NO: 799483 - DNA, 25 bp, Mus musculus
tgagcacatgcatggacagactaac

SEQ ID NO: 799484 - DNA, 25 bp, Mus musculus
tgagcacatggccactatggaagcc

SEQ ID NO: 799485 - DNA, 25 bp, Mus musculus
tgagcacatggcgactatggaagcc

SEQ ID NO: 799486 - DNA, 25 bp, Mus musculus
tgagcacatgttagaagaagtgccg

SEQ ID NO: 799487 - DNA, 25 bp, Mus musculus
tgagcacatgtttgaagaagtgccg

SEQ ID NO: 799488 - DNA, 25 bp, Mus musculus
tgagcaccaactcaaggcttttacc

SEQ ID NO: 799489 - DNA, 25 bp, Mus musculus
tgagcaccaactgaaggcttttacc

SEQ ID NO: 799490 - DNA, 25 bp, Mus musculus
tgagcaccaaggagacaccaaggaa

SEQ ID NO: 799491 - DNA, 25 bp, Mus musculus
tgagcaccaaggtgacaccaaggaa

SEQ ID NO: 799492 - DNA, 25 bp, Mus musculus
tgagcaccatcaagtgtgggcgtct

SEQ ID NO: 799493 - DNA, 25 bp, Mus musculus
tgagcaccatcatgtgtgggcgtct

SEQ ID NO: 799494 - DNA, 25 bp, Mus musculus
tgagcacccgggaagttctttctgg

SEQ ID NO: 799495 - DNA, 25 bp, Mus musculus
tgagcacccgggtagttctttctgg

SEQ ID NO: 799496 - DNA, 25 bp, Mus musculus
tgagcaccctttccaggaagagcat

SEQ ID NO: 799497 - DNA, 25 bp, Mus musculus
tgagcaccctttgcaggaagagcat

SEQ ID NO: 799498 - DNA, 25 bp, Mus musculus
tgagcaccgaacaccagtgccagca

SEQ ID NO: 799499 - DNA, 25 bp, Mus musculus
tgagcaccgaactccagtgccagca

SEQ ID NO: 799500 - DNA, 25 bp, Mus musculus
tgagcaccgagcagggcgcagcact

SEQ ID NO: 799501 - DNA, 25 bp, Mus musculus
tgagcaccgagctgggcgcagcact

SEQ ID NO: 799502 - DNA, 25 bp, Mus musculus
tgagcaccgtcaacaagatgcccga

SEQ ID NO: 799503 - DNA, 25 bp, Mus musculus
tgagcaccgtcatcaagatgcccga

SEQ ID NO: 799504 - DNA, 25 bp, Mus musculus
tgagcaccttaacctcctggagaag

SEQ ID NO: 799505 - DNA, 25 bp, Mus musculus
tgagcaccttaagctcctggagaag

SEQ ID NO: 799506 - DNA, 25 bp, Mus musculus
tgagcacgatctctggaaccacaat

SEQ ID NO: 799507 - DNA, 25 bp, Mus musculus
tgagcacgatctgtggaaccacaat

SEQ ID NO: 799508 - DNA, 25 bp, Mus musculus
tgagcacgatggagccacaccacgt

SEQ ID NO: 799509 - DNA, 25 bp, Mus musculus
tgagcacgatggtgccacaccacgt

SEQ ID NO: 799510 - DNA, 25 bp, Mus musculus
tgagcacgcctgaggttaaagcagc

SEQ ID NO: 799511 - DNA, 25 bp, Mus musculus
tgagcacgcctgtggttaaagcagc

SEQ ID NO: 799512 - DNA, 25 bp, Mus musculus
tgagcacgctggagctgcaggaggg

SEQ ID NO: 799513 - DNA, 25 bp, Mus musculus
tgagcacgctggtgctgcaggaggg

SEQ ID NO: 799514 - DNA, 25 bp, Mus musculus
tgagcacggaagactatacaacatg

SEQ ID NO: 799515 - DNA, 25 bp, Mus musculus
tgagcacggaagtctatacaacatg

SEQ ID NO: 799516 - DNA, 25 bp, Mus musculus
tgagcacggagcagcctggcagccc

SEQ ID NO: 799517 - DNA, 25 bp, Mus musculus
tgagcacggagctgcctggcagccc

SEQ ID NO: 799518 - DNA, 25 bp, Mus musculus
tgagcacggctcatggatgatactc

SEQ ID NO: 799519 - DNA, 25 bp, Mus musculus
tgagcacggctcttggatgatactc

SEQ ID NO: 799520 - DNA, 25 bp, Mus musculus
tgagcacgtatcacaaggactgaag

SEQ ID NO: 799521 - DNA, 25 bp, Mus musculus
tgagcacgtatctcaaggactgaag

SEQ ID NO: 799522 - DNA, 25 bp, Mus musculus
tgagcactattacccatcagctgag

SEQ ID NO: 799523 - DNA, 25 bp, Mus musculus
tgagcactattagccatcagctgag

SEQ ID NO: 799524 - DNA, 25 bp, Mus musculus
tgagcactcataaggcttggaaggt

SEQ ID NO: 799525 - DNA, 25 bp, Mus musculus
tgagcactcatatggcttggaaggt

SEQ ID NO: 799526 - DNA, 25 bp, Mus musculus
tgagcactcggcacaggagccccaa

SEQ ID NO: 799527 - DNA, 25 bp, Mus musculus
tgagcactcggcacgctggctttag

SEQ ID NO: 799528 - DNA, 25 bp, Mus musculus
tgagcactcggctcaggagccccaa

SEQ ID NO: 799529 - DNA, 25 bp, Mus musculus
tgagcactcggctcgctggctttag

SEQ ID NO: 799530 - DNA, 25 bp, Mus musculus
tgagcactctaaatagcaagctggg

SEQ ID NO: 799531 - DNA, 25 bp, Mus musculus
tgagcactctaattagcaagctggg

SEQ ID NO: 799532 - DNA, 25 bp, Mus musculus
tgagcactctctatctcatcagcgc

SEQ ID NO: 799533 - DNA, 25 bp, Mus musculus
tgagcactctctttctcatcagcgc

SEQ ID NO: 799534 - DNA, 25 bp, Mus musculus
tgagcactgactcggctcacccatt

SEQ ID NO: 799535 - DNA, 25 bp, Mus musculus
tgagcactgactgggctcacccatt

SEQ ID NO: 799536 - DNA, 25 bp, Mus musculus
tgagcactgcctccgacttctggag

SEQ ID NO: 799537 - DNA, 25 bp, Mus musculus
tgagcactgcctgcgacttctggag

SEQ ID NO: 799538 - DNA, 25 bp, Mus musculus
tgagcagaaaggagggcaatagatt

SEQ ID NO: 799539 - DNA, 25 bp, Mus musculus
tgagcagaaaggtgggcaatagatt

SEQ ID NO: 799540 - DNA, 25 bp, Mus musculus
tgagcagaaatgaccgccggagaag

SEQ ID NO: 799541 - DNA, 25 bp, Mus musculus
tgagcagaaatgtccgccggagaag

SEQ ID NO: 799542 - DNA, 25 bp, Mus musculus
tgagcagaacgaccagccaacagga

SEQ ID NO: 799543 - DNA, 25 bp, Mus musculus
tgagcagaacgagcagccaacagga

SEQ ID NO: 799544 - DNA, 25 bp, Mus musculus
tgagcagaatgtcatcatggctgcc

SEQ ID NO: 799545 - DNA, 25 bp, Mus musculus
tgagcagaatgtgatcatggctgcc

SEQ ID NO: 799546 - DNA, 25 bp, Mus musculus
tgagcagacacaccaatgtgaagat

SEQ ID NO: 799547 - DNA, 25 bp, Mus musculus
tgagcagacacagcaatgtgaagat

SEQ ID NO: 799548 - DNA, 25 bp, Mus musculus
tgagcagactacaccatttgcactt

SEQ ID NO: 799549 - DNA, 25 bp, Mus musculus
tgagcagactactccatttgcactt

SEQ ID NO: 799550 - DNA, 25 bp, Mus musculus
tgagcagagatgcaaactccaaagg

SEQ ID NO: 799551 - DNA, 25 bp, Mus musculus
tgagcagagatggaaactccaaagg

SEQ ID NO: 799552 - DNA, 25 bp, Mus musculus
tgagcagagattctggaaagcactc

SEQ ID NO: 799553 - DNA, 25 bp, Mus musculus
tgagcagagattgtggaaagcactc

SEQ ID NO: 799554 - DNA, 25 bp, Mus musculus
tgagcagagctcagcggataaagag

SEQ ID NO: 799555 - DNA, 25 bp, Mus musculus
tgagcagagctctgcggataaagag

SEQ ID NO: 799556 - DNA, 25 bp, Mus musculus
tgagcagagctgaacattttaaaca

SEQ ID NO: 799557 - DNA, 25 bp, Mus musculus
tgagcagagctgtacattttaaaca

SEQ ID NO: 799558 - DNA, 25 bp, Mus musculus
tgagcagagtcaaaaaagggaagga

SEQ ID NO: 799559 - DNA, 25 bp, Mus musculus
tgagcagagtcataaaagggaagga

SEQ ID NO: 799560 - DNA, 25 bp, Mus musculus
tgagcagatcctcgctacactcttc

SEQ ID NO: 799561 - DNA, 25 bp, Mus musculus
tgagcagatcctggctacactcttc

SEQ ID NO: 799562 - DNA, 25 bp, Mus musculus
tgagcagatcttccacctggtgcct

SEQ ID NO: 799563 - DNA, 25 bp, Mus musculus
tgagcagatcttgcacctggtgcct

SEQ ID NO: 799564 - DNA, 25 bp, Mus musculus
tgagcagatgaaccaagataggatc

SEQ ID NO: 799565 - DNA, 25 bp, Mus musculus
tgagcagatgaagcaagataggatc

SEQ ID NO: 799566 - DNA, 25 bp, Mus musculus
tgagcagcaagccactcggacgtga

SEQ ID NO: 799567 - DNA, 25 bp, Mus musculus
tgagcagcaagcgactcggacgtga

SEQ ID NO: 799568 - DNA, 25 bp, Mus musculus
tgagcagcacttagagaaggcccac

SEQ ID NO: 799569 - DNA, 25 bp, Mus musculus
tgagcagcactttgagaaggcccac

SEQ ID NO: 799570 - DNA, 25 bp, Mus musculus
tgagcagcagacagatgacttcctg

SEQ ID NO: 799571 - DNA, 25 bp, Mus musculus
tgagcagcagactgatgacttcctg

SEQ ID NO: 799572 - DNA, 25 bp, Mus musculus
tgagcagcaggaatgtccaggacct

SEQ ID NO: 799573 - DNA, 25 bp, Mus musculus
tgagcagcaggattgtccaggacct

SEQ ID NO: 799574 - DNA, 25 bp, Mus musculus
tgagcagcaggtactgagagccaac

SEQ ID NO: 799575 - DNA, 25 bp, Mus musculus
tgagcagcaggttctgagagccaac

SEQ ID NO: 799576 - DNA, 25 bp, Mus musculus
tgagcagcagtgcatctccttggct

SEQ ID NO: 799577 - DNA, 25 bp, Mus musculus
tgagcagcagtggatctccttggct

SEQ ID NO: 799578 - DNA, 25 bp, Mus musculus
tgagcagcatccatccagaatgtcg

SEQ ID NO: 799579 - DNA, 25 bp, Mus musculus
tgagcagcatccttccagaatgtcg

SEQ ID NO: 799580 - DNA, 25 bp, Mus musculus
tgagcagcatgaaccagatgacagg

SEQ ID NO: 799581 - DNA, 25 bp, Mus musculus
tgagcagcatgatccagatgacagg

SEQ ID NO: 799582 - DNA, 25 bp, Mus musculus
tgagcagcatttagtccggcagagg

SEQ ID NO: 799583 - DNA, 25 bp, Mus musculus
tgagcagcattttgtccggcagagg

SEQ ID NO: 799584 - DNA, 25 bp, Mus musculus
tgagcagccacaacttgcagggaca

SEQ ID NO: 799585 - DNA, 25 bp, Mus musculus
tgagcagccacatcttgcagggaca

SEQ ID NO: 799586 - DNA, 25 bp, Mus musculus
tgagcagcccatctctgaacggagg

SEQ ID NO: 799587 - DNA, 25 bp, Mus musculus
tgagcagcccatgtctgaacggagg

SEQ ID NO: 799588 - DNA, 25 bp, Mus musculus
tgagcagcggctacgactctatggg

SEQ ID NO: 799589 - DNA, 25 bp, Mus musculus
tgagcagcggcttcgactctatggg

SEQ ID NO: 799590 - DNA, 25 bp, Mus musculus
tgagcagcgtgactatatcgacacc

SEQ ID NO: 799591 - DNA, 25 bp, Mus musculus
tgagcagcgtgagtatatcgacacc

SEQ ID NO: 799592 - DNA, 25 bp, Mus musculus
tgagcagctcacaggtaaagcagag

SEQ ID NO: 799593 - DNA, 25 bp, Mus musculus
tgagcagctcactggtaaagcagag

SEQ ID NO: 799594 - DNA, 25 bp, Mus musculus
tgagcagctcctacaagcgtggttc

SEQ ID NO: 799595 - DNA, 25 bp, Mus musculus
tgagcagctccttcaagcgtggttc

SEQ ID NO: 799596 - DNA, 25 bp, Mus musculus
tgagcagctgcacaatgaagaggag

SEQ ID NO: 799597 - DNA, 25 bp, Mus musculus
tgagcagctgcagaatgaagaggag

SEQ ID NO: 799598 - DNA, 25 bp, Mus musculus
tgagcagctgttccatagaggctac

SEQ ID NO: 799599 - DNA, 25 bp, Mus musculus
tgagcagctgttgcatagaggctac

SEQ ID NO: 799600 - DNA, 25 bp, Mus musculus
tgagcagcttcacaaagggtggcaa

SEQ ID NO: 799601 - DNA, 25 bp, Mus musculus
tgagcagcttcagaaagggtggcaa

SEQ ID NO: 799602 - DNA, 25 bp, Mus musculus
tgagcagcttccacgacagtacgcg

SEQ ID NO: 799603 - DNA, 25 bp, Mus musculus
tgagcagcttcctcgacagtacgcg

SEQ ID NO: 799604 - DNA, 25 bp, Mus musculus
tgagcagcttgcaccatctgtggcg

SEQ ID NO: 799605 - DNA, 25 bp, Mus musculus
tgagcagcttgctccatctgtggcg

SEQ ID NO: 799606 - DNA, 25 bp, Mus musculus
tgagcaggaactacgtgcagtatgc

SEQ ID NO: 799607 - DNA, 25 bp, Mus musculus
tgagcaggaacttcgtgcagtatgc

SEQ ID NO: 799608 - DNA, 25 bp, Mus musculus
tgagcaggacatatctgagttccct

SEQ ID NO: 799609 - DNA, 25 bp, Mus musculus
tgagcaggacatttctgagttccct

SEQ ID NO: 799610 - DNA, 25 bp, Mus musculus
tgagcaggagcgcattgacaagatc

SEQ ID NO: 799611 - DNA, 25 bp, Mus musculus
tgagcaggagcggattgacaagatc

SEQ ID NO: 799612 - DNA, 25 bp, Mus musculus
tgagcaggcagcaattgtcgccctc

SEQ ID NO: 799613 - DNA, 25 bp, Mus musculus
tgagcaggcagctattgtcgccctc

SEQ ID NO: 799614 - DNA, 25 bp, Mus musculus
tgagcaggccaaagtccattcctgg

SEQ ID NO: 799615 - DNA, 25 bp, Mus musculus
tgagcaggccaatgtccattcctgg

SEQ ID NO: 799616 - DNA, 25 bp, Mus musculus
tgagcaggcccacgctgttgccact

SEQ ID NO: 799617 - DNA, 25 bp, Mus musculus
tgagcaggcccaggctgttgccact

SEQ ID NO: 799618 - DNA, 25 bp, Mus musculus
tgagcagggcagatgttcctatgga

SEQ ID NO: 799619 - DNA, 25 bp, Mus musculus
tgagcagggcagttgttcctatgga

SEQ ID NO: 799620 - DNA, 25 bp, Mus musculus
tgagcagggtccaatggctctcagg

SEQ ID NO: 799621 - DNA, 25 bp, Mus musculus
tgagcagggtcctatggctctcagg

SEQ ID NO: 799622 - DNA, 25 bp, Mus musculus
tgagcagggtgaagatatcactacg

SEQ ID NO: 799623 - DNA, 25 bp, Mus musculus
tgagcagggtgatgatatcactacg

SEQ ID NO: 799624 - DNA, 25 bp, Mus musculus
tgagcaggtccgcatacactggctg

SEQ ID NO: 799625 - DNA, 25 bp, Mus musculus
tgagcaggtccggatacactggctg

SEQ ID NO: 799626 - DNA, 25 bp, Mus musculus
tgagcagtatccatcctgcggcggg

SEQ ID NO: 799627 - DNA, 25 bp, Mus musculus
tgagcagtatccttcctgcggcggg

SEQ ID NO: 799628 - DNA, 25 bp, Mus musculus
tgagcagtccagatcagaaggcaga

SEQ ID NO: 799629 - DNA, 25 bp, Mus musculus
tgagcagtccagttcagaaggcaga

SEQ ID NO: 799630 - DNA, 25 bp, Mus musculus
tgagcagtccgcaggtacagagacc

SEQ ID NO: 799631 - DNA, 25 bp, Mus musculus
tgagcagtccgctggtacagagacc

SEQ ID NO: 799632 - DNA, 25 bp, Mus musculus
tgagcagtgaggattcagaagacac

SEQ ID NO: 799633 - DNA, 25 bp, Mus musculus
tgagcagtgaggtttcagaagacac

SEQ ID NO: 799634 - DNA, 25 bp, Mus musculus
tgagcagtgggcagatgcagatgca

SEQ ID NO: 799635 - DNA, 25 bp, Mus musculus
tgagcagtgggctgatgcagatgca

SEQ ID NO: 799636 - DNA, 25 bp, Mus musculus
tgagcagtgtagcacttgcctagaa

SEQ ID NO: 799637 - DNA, 25 bp, Mus musculus
tgagcagtgtaggacttgcctagaa

SEQ ID NO: 799638 - DNA, 25 bp, Mus musculus
tgagcagtgtctcccgagtgtatga

SEQ ID NO: 799639 - DNA, 25 bp, Mus musculus
tgagcagtgtctgccgagtgtatga

SEQ ID NO: 799640 - DNA, 25 bp, Mus musculus
tgagcagttcaacaaaacaagtctc

SEQ ID NO: 799641 - DNA, 25 bp, Mus musculus
tgagcagttcaagaaaacaagtctc

SEQ ID NO: 799642 - DNA, 25 bp, Mus musculus
tgagcagttgcactactacttcacc

SEQ ID NO: 799643 - DNA, 25 bp, Mus musculus
tgagcagttgcagtactacttcacc

SEQ ID NO: 799644 - DNA, 25 bp, Mus musculus
tgagcagtttgaatatacagcctac

SEQ ID NO: 799645 - DNA, 25 bp, Mus musculus
tgagcagtttgacagcaccatcggc

SEQ ID NO: 799646 - DNA, 25 bp, Mus musculus
tgagcagtttgagagcaccatcggc

SEQ ID NO: 799647 - DNA, 25 bp, Mus musculus
tgagcagtttgattatacagcctac

SEQ ID NO: 799648 - DNA, 25 bp, Mus musculus
tgagcataagaaaagccttcatcac

SEQ ID NO: 799649 - DNA, 25 bp, Mus musculus
tgagcataagaatagccttcatcac

SEQ ID NO: 799650 - DNA, 25 bp, Mus musculus
tgagcataatatacagaaggccttg

SEQ ID NO: 799651 - DNA, 25 bp, Mus musculus
tgagcataatattcagaaggccttg

SEQ ID NO: 799652 - DNA, 25 bp, Mus musculus
tgagcataatttcttgtcagcaagc

SEQ ID NO: 799653 - DNA, 25 bp, Mus musculus
tgagcataatttgttgtcagcaagc

SEQ ID NO: 799654 - DNA, 25 bp, Mus musculus
tgagcatacgcacaagacaggcgtc

SEQ ID NO: 799655 - DNA, 25 bp, Mus musculus
tgagcatacgcagaagacaggcgtc

SEQ ID NO: 799656 - DNA, 25 bp, Mus musculus
tgagcatactacaaaagcagagtgg

SEQ ID NO: 799657 - DNA, 25 bp, Mus musculus
tgagcatactactaaagcagagtgg

SEQ ID NO: 799658 - DNA, 25 bp, Mus musculus
tgagcatagagtagcgcatgcgcct

SEQ ID NO: 799659 - DNA, 25 bp, Mus musculus
tgagcatagagttgcgcatgcgcct

SEQ ID NO: 799660 - DNA, 25 bp, Mus musculus
tgagcatagtctctcagctgtacca

SEQ ID NO: 799661 - DNA, 25 bp, Mus musculus
tgagcatagtctgtcagctgtacca

SEQ ID NO: 799662 - DNA, 25 bp, Mus musculus
tgagcatatagaccaggacctgagg

SEQ ID NO: 799663 - DNA, 25 bp, Mus musculus
tgagcatatagagcaggacctgagg

SEQ ID NO: 799664 - DNA, 25 bp, Mus musculus
tgagcatcgagcaaggtggcctgct

SEQ ID NO: 799665 - DNA, 25 bp, Mus musculus
tgagcatcgagctaggtggcctgct

SEQ ID NO: 799666 - DNA, 25 bp, Mus musculus
tgagcatcgatgaggagatgctaga

SEQ ID NO: 799667 - DNA, 25 bp, Mus musculus
tgagcatcgatgtggagatgctaga

SEQ ID NO: 799668 - DNA, 25 bp, Mus musculus
tgagcatcggccacggtgatgcgac

SEQ ID NO: 799669 - DNA, 25 bp, Mus musculus
tgagcatcggcctcggtgatgcgac

SEQ ID NO: 799670 - DNA, 25 bp, Mus musculus
tgagcatcggctatctccacaaagg

SEQ ID NO: 799671 - DNA, 25 bp, Mus musculus
tgagcatcggctttctccacaaagg

SEQ ID NO: 799672 - DNA, 25 bp, Mus musculus
tgagcatctctcaagggtcccagga

SEQ ID NO: 799673 - DNA, 25 bp, Mus musculus
tgagcatctctctagggtcccagga

SEQ ID NO: 799674 - DNA, 25 bp, Mus musculus
tgagcatcttgaaccagaagagccc

SEQ ID NO: 799675 - DNA, 25 bp, Mus musculus
tgagcatcttgatccagaagagccc

SEQ ID NO: 799676 - DNA, 25 bp, Mus musculus
tgagcatgaactccaaccactggaa

SEQ ID NO: 799677 - DNA, 25 bp, Mus musculus
tgagcatgaactgcaaccactggaa

SEQ ID NO: 799678 - DNA, 25 bp, Mus musculus
tgagcatgacaaccacaagaaaggc

SEQ ID NO: 799679 - DNA, 25 bp, Mus musculus
tgagcatgacaagcacaagaaaggc

SEQ ID NO: 799680 - DNA, 25 bp, Mus musculus
tgagcatgacctcagtgacctccgt

SEQ ID NO: 799681 - DNA, 25 bp, Mus musculus
tgagcatgacctgagtgacctccgt

SEQ ID NO: 799682 - DNA, 25 bp, Mus musculus
tgagcatgcccgagagatgtgcctg

SEQ ID NO: 799683 - DNA, 25 bp, Mus musculus
tgagcatgcccgtgagatgtgcctg

SEQ ID NO: 799684 - DNA, 25 bp, Mus musculus
tgagcatgcgccctcttggcttcct

SEQ ID NO: 799685 - DNA, 25 bp, Mus musculus
tgagcatgcgccgtcttggcttcct

SEQ ID NO: 799686 - DNA, 25 bp, Mus musculus
tgagcatgctgacttctcagggaac

SEQ ID NO: 799687 - DNA, 25 bp, Mus musculus
tgagcatgctgagttctcagggaac

SEQ ID NO: 799688 - DNA, 25 bp, Mus musculus
tgagcatgctggactactggtcccc

SEQ ID NO: 799689 - DNA, 25 bp, Mus musculus
tgagcatgctggtctactggtcccc

SEQ ID NO: 799690 - DNA, 25 bp, Mus musculus
tgagcatggagtatggcctaacccg

SEQ ID NO: 799691 - DNA, 25 bp, Mus musculus
tgagcatggagtttggcctaacccg

SEQ ID NO: 799692 - DNA, 25 bp, Mus musculus
tgagcatggataaagactgtctgcg

SEQ ID NO: 799693 - DNA, 25 bp, Mus musculus
tgagcatggatatagactgtctgcg

SEQ ID NO: 799694 - DNA, 25 bp, Mus musculus
tgagcatggtgcctggttctgaccc

SEQ ID NO: 799695 - DNA, 25 bp, Mus musculus
tgagcatggtgcgtggttctgaccc

SEQ ID NO: 799696 - DNA, 25 bp, Mus musculus
tgagcatgtgacacacgggcgacac

SEQ ID NO: 799697 - DNA, 25 bp, Mus musculus
tgagcatgtgactcacgggcgacac

SEQ ID NO: 799698 - DNA, 25 bp, Mus musculus
tgagcattaatgagacagctacagc

SEQ ID NO: 799699 - DNA, 25 bp, Mus musculus
tgagcattaatgtgacagctacagc

SEQ ID NO: 799700 - DNA, 25 bp, Mus musculus
tgagcattatagagcaggaaagacc

SEQ ID NO: 799701 - DNA, 25 bp, Mus musculus
tgagcattatagtgcaggaaagacc

SEQ ID NO: 799702 - DNA, 25 bp, Mus musculus
tgagcattattcaattcctgataga

SEQ ID NO: 799703 - DNA, 25 bp, Mus musculus
tgagcattattctattcctgataga

SEQ ID NO: 799704 - DNA, 25 bp, Mus musculus
tgagcattggctactggcatgatcc

SEQ ID NO: 799705 - DNA, 25 bp, Mus musculus
tgagcattggcttctggcatgatcc

SEQ ID NO: 799706 - DNA, 25 bp, Mus musculus
tgagcattgtcacgacaggaagctg

SEQ ID NO: 799707 - DNA, 25 bp, Mus musculus
tgagcattgtcaggacaggaagctg

SEQ ID NO: 799708 - DNA, 25 bp, Mus musculus
tgagcatttgtgactgggcccagga

SEQ ID NO: 799709 - DNA, 25 bp, Mus musculus
tgagcatttgtgtctgggcccagga

SEQ ID NO: 799710 - DNA, 25 bp, Mus musculus
tgagccaaactgcagtagctctgtt

SEQ ID NO: 799711 - DNA, 25 bp, Mus musculus
tgagccaaactggagtagctctgtt

SEQ ID NO: 799712 - DNA, 25 bp, Mus musculus
tgagccaagctacccagctcagatg

SEQ ID NO: 799713 - DNA, 25 bp, Mus musculus
tgagccaagctagccagctcagatg

SEQ ID NO: 799714 - DNA, 25 bp, Mus musculus
tgagccaaggctcgacgtcctcatc

SEQ ID NO: 799715 - DNA, 25 bp, Mus musculus
tgagccaaggctggacgtcctcatc

SEQ ID NO: 799716 - DNA, 25 bp, Mus musculus
tgagccaagtatctcgtaccaggga

SEQ ID NO: 799717 - DNA, 25 bp, Mus musculus
tgagccaagtatgtcgtaccaggga

SEQ ID NO: 799718 - DNA, 25 bp, Mus musculus
tgagccaatcacctccaagacactg

SEQ ID NO: 799719 - DNA, 25 bp, Mus musculus
tgagccaatcacgtccaagacactg

SEQ ID NO: 799720 - DNA, 25 bp, Mus musculus
tgagccacaggaagtcactcagtgc

SEQ ID NO: 799721 - DNA, 25 bp, Mus musculus
tgagccacaggatgtcactcagtgc

SEQ ID NO: 799722 - DNA, 25 bp, Mus musculus
tgagccacaggcctttttaaatgct

SEQ ID NO: 799723 - DNA, 25 bp, Mus musculus
tgagccacaggcgtttttaaatgct

SEQ ID NO: 799724 - DNA, 25 bp, Mus musculus
tgagccacagtgagagcgctggaaa

SEQ ID NO: 799725 - DNA, 25 bp, Mus musculus
tgagccacagtgaggacacactccc

SEQ ID NO: 799726 - DNA, 25 bp, Mus musculus
tgagccacagtgtgagcgctggaaa

SEQ ID NO: 799727 - DNA, 25 bp, Mus musculus
tgagccacagtgtggacacactccc

SEQ ID NO: 799728 - DNA, 25 bp, Mus musculus
tgagccaccaatagtaaaaggagtg

SEQ ID NO: 799729 - DNA, 25 bp, Mus musculus
tgagccaccaattgtaaaaggagtg

SEQ ID NO: 799730 - DNA, 25 bp, Mus musculus
tgagccacctgaagcagtacgagcg

SEQ ID NO: 799731 - DNA, 25 bp, Mus musculus
tgagccacctgatgcagtacgagcg

SEQ ID NO: 799732 - DNA, 25 bp, Mus musculus
tgagccacggcgaagggaccacatc

SEQ ID NO: 799733 - DNA, 25 bp, Mus musculus
tgagccacggcgtagggaccacatc

SEQ ID NO: 799734 - DNA, 25 bp, Mus musculus
tgagccacgtcgagtgcctagtgtt

SEQ ID NO: 799735 - DNA, 25 bp, Mus musculus
tgagccacgtcgtgtgcctagtgtt

SEQ ID NO: 799736 - DNA, 25 bp, Mus musculus
tgagccacgtggagctctcgcccgt

SEQ ID NO: 799737 - DNA, 25 bp, Mus musculus
tgagccacgtggtgctctcgcccgt

SEQ ID NO: 799738 - DNA, 25 bp, Mus musculus
tgagccactcatcgtacagccaaac

SEQ ID NO: 799739 - DNA, 25 bp, Mus musculus
tgagccactcatggtacagccaaac

SEQ ID NO: 799740 - DNA, 25 bp, Mus musculus
tgagccagagatactgcccaggcgg

SEQ ID NO: 799741 - DNA, 25 bp, Mus musculus
tgagccagagattctgcccaggcgg

SEQ ID NO: 799742 - DNA, 25 bp, Mus musculus
tgagccagaggcactataggactgc

SEQ ID NO: 799743 - DNA, 25 bp, Mus musculus
tgagccagaggctctataggactgc

SEQ ID NO: 799744 - DNA, 25 bp, Mus musculus
tgagccaggacaaaatcaaatacaa

SEQ ID NO: 799745 - DNA, 25 bp, Mus musculus
tgagccaggacaccgaagtggacat

SEQ ID NO: 799746 - DNA, 25 bp, Mus musculus
tgagccaggacagcgaagtggacat

SEQ ID NO: 799747 - DNA, 25 bp, Mus musculus
tgagccaggacataatcaaatacaa

SEQ ID NO: 799748 - DNA, 25 bp, Mus musculus
tgagccaggcggctaccatctgcag

SEQ ID NO: 799749 - DNA, 25 bp, Mus musculus
tgagccaggcgggtaccatctgcag

SEQ ID NO: 799750 - DNA, 25 bp, Mus musculus
tgagccaggctcaaactcccagaac

SEQ ID NO: 799751 - DNA, 25 bp, Mus musculus
tgagccaggctctaactcccagaac

SEQ ID NO: 799752 - DNA, 25 bp, Mus musculus
tgagccaggctgcttgcgatacgca

SEQ ID NO: 799753 - DNA, 25 bp, Mus musculus
tgagccaggctggttgcgatacgca

SEQ ID NO: 799754 - DNA, 25 bp, Mus musculus
tgagccaggtagagagttacgacga

SEQ ID NO: 799755 - DNA, 25 bp, Mus musculus
tgagccaggtagtgagttacgacga

SEQ ID NO: 799756 - DNA, 25 bp, Mus musculus
tgagccaggtccctgtttgatggca

SEQ ID NO: 799757 - DNA, 25 bp, Mus musculus
tgagccaggtccgtgtttgatggca

SEQ ID NO: 799758 - DNA, 25 bp, Mus musculus
tgagccaggtttcatcctcatgggc

SEQ ID NO: 799759 - DNA, 25 bp, Mus musculus
tgagccaggtttccctggaaaagca

SEQ ID NO: 799760 - DNA, 25 bp, Mus musculus
tgagccaggtttgatcctcatgggc

SEQ ID NO: 799761 - DNA, 25 bp, Mus musculus
tgagccaggtttgcctggaaaagca

SEQ ID NO: 799762 - DNA, 25 bp, Mus musculus
tgagccagtaccacatggctgtggc

SEQ ID NO: 799763 - DNA, 25 bp, Mus musculus
tgagccagtacctcatggctgtggc

SEQ ID NO: 799764 - DNA, 25 bp, Mus musculus
tgagccagtgcaatgcagaatcatg

SEQ ID NO: 799765 - DNA, 25 bp, Mus musculus
tgagccagtgcattgcagaatcatg

SEQ ID NO: 799766 - DNA, 25 bp, Mus musculus
tgagccagttccagctggctcctgc

SEQ ID NO: 799767 - DNA, 25 bp, Mus musculus
tgagccagttcctgctggctcctgc

SEQ ID NO: 799768 - DNA, 25 bp, Mus musculus
tgagccataccgaatgttcactagc

SEQ ID NO: 799769 - DNA, 25 bp, Mus musculus
tgagccataccgtatgttcactagc

SEQ ID NO: 799770 - DNA, 25 bp, Mus musculus
tgagccatcccacatctggagcaga

SEQ ID NO: 799771 - DNA, 25 bp, Mus musculus
tgagccatcccagatctggagcaga

SEQ ID NO: 799772 - DNA, 25 bp, Mus musculus
tgagccatcgccctgaactgtgaac

SEQ ID NO: 799773 - DNA, 25 bp, Mus musculus
tgagccatcgccgtgaactgtgaac

SEQ ID NO: 799774 - DNA, 25 bp, Mus musculus
tgagccatctcaagagtctggacct

SEQ ID NO: 799775 - DNA, 25 bp, Mus musculus
tgagccatctcatgagtctggacct

SEQ ID NO: 799776 - DNA, 25 bp, Mus musculus
tgagccatcttacgccctcagtctg

SEQ ID NO: 799777 - DNA, 25 bp, Mus musculus
tgagccatcttaggccctcagtctg

SEQ ID NO: 799778 - DNA, 25 bp, Mus musculus
tgagccatcttcacgataaaggact

SEQ ID NO: 799779 - DNA, 25 bp, Mus musculus
tgagccatcttctcgataaaggact

SEQ ID NO: 799780 - DNA, 25 bp, Mus musculus
tgagccatgcctaggtacacagtgc

SEQ ID NO: 799781 - DNA, 25 bp, Mus musculus
tgagccatgccttggtacacagtgc

SEQ ID NO: 799782 - DNA, 25 bp, Mus musculus
tgagccatgggtcggccagaacatc

SEQ ID NO: 799783 - DNA, 25 bp, Mus musculus
tgagccatgggtgggccagaacatc

SEQ ID NO: 799784 - DNA, 25 bp, Mus musculus
tgagccatgtttcatgcaatgaaac

SEQ ID NO: 799785 - DNA, 25 bp, Mus musculus
tgagccatgtttgatgcaatgaaac

SEQ ID NO: 799786 - DNA, 25 bp, Mus musculus
tgagccattacactggcccgctggc

SEQ ID NO: 799787 - DNA, 25 bp, Mus musculus
tgagccattacagtggcccgctggc

SEQ ID NO: 799788 - DNA, 25 bp, Mus musculus
tgagccatttccaagcctgggcaag

SEQ ID NO: 799789 - DNA, 25 bp, Mus musculus
tgagccatttcctagcctgggcaag

SEQ ID NO: 799790 - DNA, 25 bp, Mus musculus
tgagcccaaagacgaaaagccacca

SEQ ID NO: 799791 - DNA, 25 bp, Mus musculus
tgagcccaaagaggaaaagccacca

SEQ ID NO: 799792 - DNA, 25 bp, Mus musculus
tgagcccaagaaaagcaatgagtcg

SEQ ID NO: 799793 - DNA, 25 bp, Mus musculus
tgagcccaagaatagcaatgagtcg

SEQ ID NO: 799794 - DNA, 25 bp, Mus musculus
tgagcccacaaaaccgacgccagaa

SEQ ID NO: 799795 - DNA, 25 bp, Mus musculus
tgagcccacaaatccgacgccagaa

SEQ ID NO: 799796 - DNA, 25 bp, Mus musculus
tgagcccacccactacaagggtctg

SEQ ID NO: 799797 - DNA, 25 bp, Mus musculus
tgagcccacccagtacaagggtctg

SEQ ID NO: 799798 - DNA, 25 bp, Mus musculus
tgagcccagatcaaaatgcttggag

SEQ ID NO: 799799 - DNA, 25 bp, Mus musculus
tgagcccagatcagttaacatcccg

SEQ ID NO: 799800 - DNA, 25 bp, Mus musculus
tgagcccagatctaaatgcttggag

SEQ ID NO: 799801 - DNA, 25 bp, Mus musculus
tgagcccagatctgttaacatcccg

SEQ ID NO: 799802 - DNA, 25 bp, Mus musculus
tgagcccagttcacctaggcctgtg

SEQ ID NO: 799803 - DNA, 25 bp, Mus musculus
tgagcccagttctcctaggcctgtg

SEQ ID NO: 799804 - DNA, 25 bp, Mus musculus
tgagcccatcttagaagatgtgatg

SEQ ID NO: 799805 - DNA, 25 bp, Mus musculus
tgagcccatctttgaagatgtgatg

SEQ ID NO: 799806 - DNA, 25 bp, Mus musculus
tgagcccatggaatctacagtggag

SEQ ID NO: 799807 - DNA, 25 bp, Mus musculus
tgagcccatggattctacagtggag

SEQ ID NO: 799808 - DNA, 25 bp, Mus musculus
tgagcccattgccatgacagtgcct

SEQ ID NO: 799809 - DNA, 25 bp, Mus musculus
tgagcccattgcgatgacagtgcct

SEQ ID NO: 799810 - DNA, 25 bp, Mus musculus
tgagccccaataaccatgaggtgca

SEQ ID NO: 799811 - DNA, 25 bp, Mus musculus
tgagccccaatatccatgaggtgca

SEQ ID NO: 799812 - DNA, 25 bp, Mus musculus
tgagccccacctcttggtgggcaga

SEQ ID NO: 799813 - DNA, 25 bp, Mus musculus
tgagccccacctgttggtgggcaga

SEQ ID NO: 799814 - DNA, 25 bp, Mus musculus
tgagccccgtcgacgcgggcgtttc

SEQ ID NO: 799815 - DNA, 25 bp, Mus musculus
tgagccccgtcgtcgcgggcgtttc

SEQ ID NO: 799816 - DNA, 25 bp, Mus musculus
tgagcccctagacagtattgccatc

SEQ ID NO: 799817 - DNA, 25 bp, Mus musculus
tgagcccctagagagtattgccatc

SEQ ID NO: 799818 - DNA, 25 bp, Mus musculus
tgagcccgagttccactacatcgca

SEQ ID NO: 799819 - DNA, 25 bp, Mus musculus
tgagcccgagttgcactacatcgca

SEQ ID NO: 799820 - DNA, 25 bp, Mus musculus
tgagcccgatggacaaagctttgga

SEQ ID NO: 799821 - DNA, 25 bp, Mus musculus
tgagcccgatggtcaaagctttgga

SEQ ID NO: 799822 - DNA, 25 bp, Mus musculus
tgagcccggtgaagaatttacaagc

SEQ ID NO: 799823 - DNA, 25 bp, Mus musculus
tgagcccggtgatgaatttacaagc

SEQ ID NO: 799824 - DNA, 25 bp, Mus musculus
tgagccctccgaagatgagattcac

SEQ ID NO: 799825 - DNA, 25 bp, Mus musculus
tgagccctccgatgatgagattcac

SEQ ID NO: 799826 - DNA, 25 bp, Mus musculus
tgagccctgactcccagcgatagac

SEQ ID NO: 799827 - DNA, 25 bp, Mus musculus
tgagccctgactgccagcgatagac

SEQ ID NO: 799828 - DNA, 25 bp, Mus musculus
tgagccctgcggacatcaactatga

SEQ ID NO: 799829 - DNA, 25 bp, Mus musculus
tgagccctgcggtcatcaactatga

SEQ ID NO: 799830 - DNA, 25 bp, Mus musculus
tgagccctggctatatccgacaggg

SEQ ID NO: 799831 - DNA, 25 bp, Mus musculus
tgagccctggctttatccgacaggg

SEQ ID NO: 799832 - DNA, 25 bp, Mus musculus
tgagccctgtggagttgaggcacct

SEQ ID NO: 799833 - DNA, 25 bp, Mus musculus
tgagccctgtggtgttgaggcacct

SEQ ID NO: 799834 - DNA, 25 bp, Mus musculus
tgagcccttcacatactgtgggtga

SEQ ID NO: 799835 - DNA, 25 bp, Mus musculus
tgagcccttcacttactgtgggtga

SEQ ID NO: 799836 - DNA, 25 bp, Mus musculus
tgagccctttcacggtcacagatca

SEQ ID NO: 799837 - DNA, 25 bp, Mus musculus
tgagccctttcagggtcacagatca

SEQ ID NO: 799838 - DNA, 25 bp, Mus musculus
tgagccgaactgcaacgttgttgct

SEQ ID NO: 799839 - DNA, 25 bp, Mus musculus
tgagccgaactggaacgttgttgct

SEQ ID NO: 799840 - DNA, 25 bp, Mus musculus
tgagccgagggcctcctcagtgttc

SEQ ID NO: 799841 - DNA, 25 bp, Mus musculus
tgagccgagggcgtcctcagtgttc

SEQ ID NO: 799842 - DNA, 25 bp, Mus musculus
tgagccgagttgcaaatgtgaacgc

SEQ ID NO: 799843 - DNA, 25 bp, Mus musculus
tgagccgagttggaaatgtgaacgc

SEQ ID NO: 799844 - DNA, 25 bp, Mus musculus
tgagccgccgccacgatgagttaga

SEQ ID NO: 799845 - DNA, 25 bp, Mus musculus
tgagccgccgcctcgatgagttaga

SEQ ID NO: 799846 - DNA, 25 bp, Mus musculus
tgagccgcctacagggccagacgga

SEQ ID NO: 799847 - DNA, 25 bp, Mus musculus
tgagccgcctactgggccagacgga

SEQ ID NO: 799848 - DNA, 25 bp, Mus musculus
tgagccgcctgaccctctacgatat

SEQ ID NO: 799849 - DNA, 25 bp, Mus musculus
tgagccgcctgagcctctacgatat

SEQ ID NO: 799850 - DNA, 25 bp, Mus musculus
tgagccgcgatgacttcagagttct

SEQ ID NO: 799851 - DNA, 25 bp, Mus musculus
tgagccgcgatgtcttcagagttct

SEQ ID NO: 799852 - DNA, 25 bp, Mus musculus
tgagccgctcgcagcgatactatta

SEQ ID NO: 799853 - DNA, 25 bp, Mus musculus
tgagccgctcgctgcgatactatta

SEQ ID NO: 799854 - DNA, 25 bp, Mus musculus
tgagccgcttcaagtgtggaggaaa

SEQ ID NO: 799855 - DNA, 25 bp, Mus musculus
tgagccgcttcatgtgtggaggaaa

SEQ ID NO: 799856 - DNA, 25 bp, Mus musculus
tgagccggcattcgtgtcactggta

SEQ ID NO: 799857 - DNA, 25 bp, Mus musculus
tgagccggcattggtgtcactggta

SEQ ID NO: 799858 - DNA, 25 bp, Mus musculus
tgagccgggcacagaaacacagcag

SEQ ID NO: 799859 - DNA, 25 bp, Mus musculus
tgagccgggcactgaaacacagcag

SEQ ID NO: 799860 - DNA, 25 bp, Mus musculus
tgagccggtcctcgactcgacgagc

SEQ ID NO: 799861 - DNA, 25 bp, Mus musculus
tgagccggtcctggactcgacgagc

SEQ ID NO: 799862 - DNA, 25 bp, Mus musculus
tgagccgtaactctgcactgaaggt

SEQ ID NO: 799863 - DNA, 25 bp, Mus musculus
tgagccgtaactgtgcactgaaggt

SEQ ID NO: 799864 - DNA, 25 bp, Mus musculus
tgagccgtatgacccgtttgaaaca

SEQ ID NO: 799865 - DNA, 25 bp, Mus musculus
tgagccgtatgagccgtttgaaaca

SEQ ID NO: 799866 - DNA, 25 bp, Mus musculus
tgagccgtgactactgacttccagg

SEQ ID NO: 799867 - DNA, 25 bp, Mus musculus
tgagccgtgacttctgacttccagg

SEQ ID NO: 799868 - DNA, 25 bp, Mus musculus
tgagccgttaggaaaaaacgatggc

SEQ ID NO: 799869 - DNA, 25 bp, Mus musculus
tgagccgttaggtaaaaacgatggc

SEQ ID NO: 799870 - DNA, 25 bp, Mus musculus
tgagcctaaactcagggtgggaggc

SEQ ID NO: 799871 - DNA, 25 bp, Mus musculus
tgagcctaaactgagggtgggaggc

SEQ ID NO: 799872 - DNA, 25 bp, Mus musculus
tgagcctccagaacatcacatcgca

SEQ ID NO: 799873 - DNA, 25 bp, Mus musculus
tgagcctccagatcatcacatcgca

SEQ ID NO: 799874 - DNA, 25 bp, Mus musculus
tgagcctccctgagttgtcaggagc

SEQ ID NO: 799875 - DNA, 25 bp, Mus musculus
tgagcctccctgtgttgtcaggagc

SEQ ID NO: 799876 - DNA, 25 bp, Mus musculus
tgagcctcgaaaccccgtgacagct

SEQ ID NO: 799877 - DNA, 25 bp, Mus musculus
tgagcctcgaaagcccgtgacagct

SEQ ID NO: 799878 - DNA, 25 bp, Mus musculus
tgagcctcggaaagtgctcttgcgg

SEQ ID NO: 799879 - DNA, 25 bp, Mus musculus
tgagcctcggaatgtgctcttgcgg

SEQ ID NO: 799880 - DNA, 25 bp, Mus musculus
tgagcctcggctaaaggacatcaac

SEQ ID NO: 799881 - DNA, 25 bp, Mus musculus
tgagcctcggcttaaggacatcaac

SEQ ID NO: 799882 - DNA, 25 bp, Mus musculus
tgagcctctctgaagccaatgcttg

SEQ ID NO: 799883 - DNA, 25 bp, Mus musculus
tgagcctctctgtagccaatgcttg

SEQ ID NO: 799884 - DNA, 25 bp, Mus musculus
tgagcctcttgaaatggataaagtg

SEQ ID NO: 799885 - DNA, 25 bp, Mus musculus
tgagcctcttgatatggataaagtg

SEQ ID NO: 799886 - DNA, 25 bp, Mus musculus
tgagcctgaacaaggttctgtccag

SEQ ID NO: 799887 - DNA, 25 bp, Mus musculus
tgagcctgaacatggttctgtccag

SEQ ID NO: 799888 - DNA, 25 bp, Mus musculus
tgagcctgaccaagaaccccgtagg

SEQ ID NO: 799889 - DNA, 25 bp, Mus musculus
tgagcctgaccatgaaccccgtagg

SEQ ID NO: 799890 - DNA, 25 bp, Mus musculus
tgagcctgactgaacgaattaatct

SEQ ID NO: 799891 - DNA, 25 bp, Mus musculus
tgagcctgactgtacgaattaatct

SEQ ID NO: 799892 - DNA, 25 bp, Mus musculus
tgagcctgagcacttcgctgttgtg

SEQ ID NO: 799893 - DNA, 25 bp, Mus musculus
tgagcctgagcagttcgctgttgtg

SEQ ID NO: 799894 - DNA, 25 bp, Mus musculus
tgagcctgaggaagtggttgaaccc

SEQ ID NO: 799895 - DNA, 25 bp, Mus musculus
tgagcctgaggatgtggttgaaccc

SEQ ID NO: 799896 - DNA, 25 bp, Mus musculus
tgagcctgagggaaacagcgaacac

SEQ ID NO: 799897 - DNA, 25 bp, Mus musculus
tgagcctgagggtaacagcgaacac

SEQ ID NO: 799898 - DNA, 25 bp, Mus musculus
tgagcctgagttccagacttcagca

SEQ ID NO: 799899 - DNA, 25 bp, Mus musculus
tgagcctgagttgcagacttcagca

SEQ ID NO: 799900 - DNA, 25 bp, Mus musculus
tgagcctgcgcacagaaagataatc

SEQ ID NO: 799901 - DNA, 25 bp, Mus musculus
tgagcctgcgcagagaaagataatc

SEQ ID NO: 799902 - DNA, 25 bp, Mus musculus
tgagcctgctaaacagagattcgct

SEQ ID NO: 799903 - DNA, 25 bp, Mus musculus
tgagcctgctaatcagagattcgct

SEQ ID NO: 799904 - DNA, 25 bp, Mus musculus
tgagcctgctgcattaaccaccctg

SEQ ID NO: 799905 - DNA, 25 bp, Mus musculus
tgagcctgctgctttaaccaccctg

SEQ ID NO: 799906 - DNA, 25 bp, Mus musculus
tgagcctgggcaaatcactggcggt

SEQ ID NO: 799907 - DNA, 25 bp, Mus musculus
tgagcctgggcatatcactggcggt

SEQ ID NO: 799908 - DNA, 25 bp, Mus musculus
tgagcctggtgtctctccccacagg

SEQ ID NO: 799909 - DNA, 25 bp, Mus musculus
tgagcctggtgtgtctccccacagg

SEQ ID NO: 799910 - DNA, 25 bp, Mus musculus
tgagcctgtatgaaatgcctgcggc

SEQ ID NO: 799911 - DNA, 25 bp, Mus musculus
tgagcctgtatgtaatgcctgcggc

SEQ ID NO: 799912 - DNA, 25 bp, Mus musculus
tgagcctgtgatctgctagatccct

SEQ ID NO: 799913 - DNA, 25 bp, Mus musculus
tgagcctgtgatgtgctagatccct

SEQ ID NO: 799914 - DNA, 25 bp, Mus musculus
tgagcctgtgcaccttacagaagca

SEQ ID NO: 799915 - DNA, 25 bp, Mus musculus
tgagcctgtgcagcttacagaagca

SEQ ID NO: 799916 - DNA, 25 bp, Mus musculus
tgagcctgtgtgaccattagtgcgg

SEQ ID NO: 799917 - DNA, 25 bp, Mus musculus
tgagcctgtgtgtccattagtgcgg

SEQ ID NO: 799918 - DNA, 25 bp, Mus musculus
tgagcctgttgacaaggacttctac

SEQ ID NO: 799919 - DNA, 25 bp, Mus musculus
tgagcctgttgagaaggacttctac

SEQ ID NO: 799920 - DNA, 25 bp, Mus musculus
tgagccttccctacagttccgaagg

SEQ ID NO: 799921 - DNA, 25 bp, Mus musculus
tgagccttcccttcagttccgaagg

SEQ ID NO: 799922 - DNA, 25 bp, Mus musculus
tgagccttcctaagcctctactgac

SEQ ID NO: 799923 - DNA, 25 bp, Mus musculus
tgagccttcctatgcctctactgac

SEQ ID NO: 799924 - DNA, 25 bp, Mus musculus
tgagccttgacacaagatgatgctg

SEQ ID NO: 799925 - DNA, 25 bp, Mus musculus
tgagccttgacacactctctagtgc

SEQ ID NO: 799926 - DNA, 25 bp, Mus musculus
tgagccttgacacagtgaaggccct

SEQ ID NO: 799927 - DNA, 25 bp, Mus musculus
tgagccttgacagaagatgatgctg

SEQ ID NO: 799928 - DNA, 25 bp, Mus musculus
tgagccttgacagactctctagtgc

SEQ ID NO: 799929 - DNA, 25 bp, Mus musculus
tgagccttgacagagtgaaggccct

SEQ ID NO: 799930 - DNA, 25 bp, Mus musculus
tgagccttgcaacgatatgccaggc

SEQ ID NO: 799931 - DNA, 25 bp, Mus musculus
tgagccttgcaaggatatgccaggc

SEQ ID NO: 799932 - DNA, 25 bp, Mus musculus
tgagccttgcttagatgctgctgac

SEQ ID NO: 799933 - DNA, 25 bp, Mus musculus
tgagccttgctttgatgctgctgac

SEQ ID NO: 799934 - DNA, 25 bp, Mus musculus
tgagccttgtgccacgagttcagga

SEQ ID NO: 799935 - DNA, 25 bp, Mus musculus
tgagccttgtgccatggacatgtct

SEQ ID NO: 799936 - DNA, 25 bp, Mus musculus
tgagccttgtgcgacgagttcagga

SEQ ID NO: 799937 - DNA, 25 bp, Mus musculus
tgagccttgtgcgatggacatgtct

SEQ ID NO: 799938 - DNA, 25 bp, Mus musculus
tgagccttgtttcgcctcttgaccg

SEQ ID NO: 799939 - DNA, 25 bp, Mus musculus
tgagccttgtttggcctcttgaccg

SEQ ID NO: 799940 - DNA, 25 bp, Mus musculus
tgagcgaacaccatgtgcagagaca

SEQ ID NO: 799941 - DNA, 25 bp, Mus musculus
tgagcgaacaccttgtgcagagaca

SEQ ID NO: 799942 - DNA, 25 bp, Mus musculus
tgagcgaaccagaccagagcattaa

SEQ ID NO: 799943 - DNA, 25 bp, Mus musculus
tgagcgaaccagtccagagcattaa

SEQ ID NO: 799944 - DNA, 25 bp, Mus musculus
tgagcgaactcaagcgcctcttcaa

SEQ ID NO: 799945 - DNA, 25 bp, Mus musculus
tgagcgaactcatgcgcctcttcaa

SEQ ID NO: 799946 - DNA, 25 bp, Mus musculus
tgagcgaagaccacgaagtggactg

SEQ ID NO: 799947 - DNA, 25 bp, Mus musculus
tgagcgaagacctcgaagtggactg

SEQ ID NO: 799948 - DNA, 25 bp, Mus musculus
tgagcgaatctaagacaaggatctg

SEQ ID NO: 799949 - DNA, 25 bp, Mus musculus
tgagcgaatctatgacaaggatctg

SEQ ID NO: 799950 - DNA, 25 bp, Mus musculus
tgagcgaatgcccaggacttcaacg

SEQ ID NO: 799951 - DNA, 25 bp, Mus musculus
tgagcgaatgccgaggacttcaacg

SEQ ID NO: 799952 - DNA, 25 bp, Mus musculus
tgagcgaccactaacccaggaagag

SEQ ID NO: 799953 - DNA, 25 bp, Mus musculus
tgagcgaccacttacccaggaagag

SEQ ID NO: 799954 - DNA, 25 bp, Mus musculus
tgagcgacgagcacggctgcgtcaa

SEQ ID NO: 799955 - DNA, 25 bp, Mus musculus
tgagcgacgagctcggctgcgtcaa

SEQ ID NO: 799956 - DNA, 25 bp, Mus musculus
tgagcgacgccgagcagaaatacta

SEQ ID NO: 799957 - DNA, 25 bp, Mus musculus
tgagcgacgccgtgcagaaatacta

SEQ ID NO: 799958 - DNA, 25 bp, Mus musculus
tgagcgacggctactcatcatggcg

SEQ ID NO: 799959 - DNA, 25 bp, Mus musculus
tgagcgacggcttctcatcatggcg

SEQ ID NO: 799960 - DNA, 25 bp, Mus musculus
tgagcgactgaacaaactagagcga

SEQ ID NO: 799961 - DNA, 25 bp, Mus musculus
tgagcgactgaacgctatggaccag

SEQ ID NO: 799962 - DNA, 25 bp, Mus musculus
tgagcgactgaagaaactagagcga

SEQ ID NO: 799963 - DNA, 25 bp, Mus musculus
tgagcgactgaaggctatggaccag

SEQ ID NO: 799964 - DNA, 25 bp, Mus musculus
tgagcgagaactccgagacttatga

SEQ ID NO: 799965 - DNA, 25 bp, Mus musculus
tgagcgagaactgcgagacttatga

SEQ ID NO: 799966 - DNA, 25 bp, Mus musculus
tgagcgagcaatactcccaggtgaa

SEQ ID NO: 799967 - DNA, 25 bp, Mus musculus
tgagcgagcaattctcccaggtgaa

SEQ ID NO: 799968 - DNA, 25 bp, Mus musculus
tgagcgagcctcacagtcattgtgg

SEQ ID NO: 799969 - DNA, 25 bp, Mus musculus
tgagcgagcctctcagtcattgtgg

SEQ ID NO: 799970 - DNA, 25 bp, Mus musculus
tgagcgagcgctcgagctcctctgt

SEQ ID NO: 799971 - DNA, 25 bp, Mus musculus
tgagcgagcgctggagctcctctgt

SEQ ID NO: 799972 - DNA, 25 bp, Mus musculus
tgagcgagctggaattcccaccagg

SEQ ID NO: 799973 - DNA, 25 bp, Mus musculus
tgagcgagctggtattcccaccagg

SEQ ID NO: 799974 - DNA, 25 bp, Mus musculus
tgagcgagcttcctcttctgaggat

SEQ ID NO: 799975 - DNA, 25 bp, Mus musculus
tgagcgagcttcgtcttctgaggat

SEQ ID NO: 799976 - DNA, 25 bp, Mus musculus
tgagcgagtggacagcaccacctta

SEQ ID NO: 799977 - DNA, 25 bp, Mus musculus
tgagcgagtggagagcaccacctta

SEQ ID NO: 799978 - DNA, 25 bp, Mus musculus
tgagcgataagcagtaccagcggaa

SEQ ID NO: 799979 - DNA, 25 bp, Mus musculus
tgagcgataagctgtaccagcggaa

SEQ ID NO: 799980 - DNA, 25 bp, Mus musculus
tgagcgcaagttacaccagaagcaa

SEQ ID NO: 799981 - DNA, 25 bp, Mus musculus
tgagcgcaagtttcaccagaagcaa

SEQ ID NO: 799982 - DNA, 25 bp, Mus musculus
tgagcgcaccacagaactgggtgga

SEQ ID NO: 799983 - DNA, 25 bp, Mus musculus
tgagcgcaccactgaactgggtgga

SEQ ID NO: 799984 - DNA, 25 bp, Mus musculus
tgagcgcacggaagaacccgagtct

SEQ ID NO: 799985 - DNA, 25 bp, Mus musculus
tgagcgcacggatgaacccgagtct

SEQ ID NO: 799986 - DNA, 25 bp, Mus musculus
tgagcgcactctaccctgctgggaa

SEQ ID NO: 799987 - DNA, 25 bp, Mus musculus
tgagcgcactcttccctgctgggaa

SEQ ID NO: 799988 - DNA, 25 bp, Mus musculus
tgagcgccagctagtcttcaatgaa

SEQ ID NO: 799989 - DNA, 25 bp, Mus musculus
tgagcgccagcttgtcttcaatgaa

SEQ ID NO: 799990 - DNA, 25 bp, Mus musculus
tgagcgccagtacctgctgtgtcag

SEQ ID NO: 799991 - DNA, 25 bp, Mus musculus
tgagcgccagtagctgctgtgtcag

SEQ ID NO: 799992 - DNA, 25 bp, Mus musculus
tgagcgccatttaaccatgaatgag

SEQ ID NO: 799993 - DNA, 25 bp, Mus musculus
tgagcgccattttaccatgaatgag

SEQ ID NO: 799994 - DNA, 25 bp, Mus musculus
tgagcgcccagaccgctggcaaatc

SEQ ID NO: 799995 - DNA, 25 bp, Mus musculus
tgagcgcccagagcgctggcaaatc

SEQ ID NO: 799996 - DNA, 25 bp, Mus musculus
tgagcgccctatatggccacagcgt

SEQ ID NO: 799997 - DNA, 25 bp, Mus musculus
tgagcgccctatttggccacagcgt

SEQ ID NO: 799998 - DNA, 25 bp, Mus musculus
tgagcgccctgcctgaagaacacag

SEQ ID NO: 799999 - DNA, 25 bp, Mus musculus
tgagcgccctgcgtgaagaacacag

SEQ ID NO: 800000 - DNA, 25 bp, Mus musculus
tgagcgcgcgctagctctgctcgct

SEQ ID NO: 800001 - DNA, 25 bp, Mus musculus
tgagcgcgcgcttgctctgctcgct

SEQ ID NO: 800002 - DNA, 25 bp, Mus musculus
tgagcgcgtacccggctccgagtct

SEQ ID NO: 800003 - DNA, 25 bp, Mus musculus
tgagcgcgtaccgggctccgagtct

SEQ ID NO: 800004 - DNA, 25 bp, Mus musculus
tgagcgctgcaacaagaacaacggc

SEQ ID NO: 800005 - DNA, 25 bp, Mus musculus
tgagcgctgcaagaagaacaacggc

SEQ ID NO: 800006 - DNA, 25 bp, Mus musculus
tgagcgctgcccatgacatcctcaa

SEQ ID NO: 800007 - DNA, 25 bp, Mus musculus
tgagcgctgcccttgacatcctcaa

SEQ ID NO: 800008 - DNA, 25 bp, Mus musculus
tgagcgctggccaactgacaaaata

SEQ ID NO: 800009 - DNA, 25 bp, Mus musculus
tgagcgctggcctactgacaaaata

SEQ ID NO: 800010 - DNA, 25 bp, Mus musculus
tgagcgctgtaaactgaaccagctg

SEQ ID NO: 800011 - DNA, 25 bp, Mus musculus
tgagcgctgtaatctgaaccagctg

SEQ ID NO: 800012 - DNA, 25 bp, Mus musculus
tgagcgcttacacctctatggtgga

SEQ ID NO: 800013 - DNA, 25 bp, Mus musculus
tgagcgcttacagctctatggtgga

SEQ ID NO: 800014 - DNA, 25 bp, Mus musculus
tgagcgcttatgacttggtgctggc

SEQ ID NO: 800015 - DNA, 25 bp, Mus musculus
tgagcgcttatgtcttggtgctggc

SEQ ID NO: 800016 - DNA, 25 bp, Mus musculus
tgagcgcttcagcagcaacatcaag

SEQ ID NO: 800017 - DNA, 25 bp, Mus musculus
tgagcgcttcaggagcaacatcaag

SEQ ID NO: 800018 - DNA, 25 bp, Mus musculus
tgagcgcttcttccggaagctttcc

SEQ ID NO: 800019 - DNA, 25 bp, Mus musculus
tgagcgcttcttgcggaagctttcc

SEQ ID NO: 800020 - DNA, 25 bp, Mus musculus
tgagcgctttgtctgcgactcagcc

SEQ ID NO: 800021 - DNA, 25 bp, Mus musculus
tgagcgctttgtgtgcgactcagcc

SEQ ID NO: 800022 - DNA, 25 bp, Mus musculus
tgagcggaagtgagagcccattgcc

SEQ ID NO: 800023 - DNA, 25 bp, Mus musculus
tgagcggaagtgtgagcccattgcc

SEQ ID NO: 800024 - DNA, 25 bp, Mus musculus
tgagcggcagagcatacccaatgtg

SEQ ID NO: 800025 - DNA, 25 bp, Mus musculus
tgagcggcagaggatacccaatgtg

SEQ ID NO: 800026 - DNA, 25 bp, Mus musculus
tgagcggcctcaatgagtactgcat

SEQ ID NO: 800027 - DNA, 25 bp, Mus musculus
tgagcggcctcattgagtactgcat

SEQ ID NO: 800028 - DNA, 25 bp, Mus musculus
tgagcggctccaagccatcagagag

SEQ ID NO: 800029 - DNA, 25 bp, Mus musculus
tgagcggctccatgccatcagagag

SEQ ID NO: 800030 - DNA, 25 bp, Mus musculus
tgagcgggacaacgtgaagttcact

SEQ ID NO: 800031 - DNA, 25 bp, Mus musculus
tgagcgggacaaggtgaagttcact

SEQ ID NO: 800032 - DNA, 25 bp, Mus musculus
tgagcgggctcacctggcaacacag

SEQ ID NO: 800033 - DNA, 25 bp, Mus musculus
tgagcgggctcagctggcaacacag

SEQ ID NO: 800034 - DNA, 25 bp, Mus musculus
tgagcggtcaggatgctaatccaat

SEQ ID NO: 800035 - DNA, 25 bp, Mus musculus
tgagcggtcaggttgctaatccaat

SEQ ID NO: 800036 - DNA, 25 bp, Mus musculus
tgagcggtgctaaagtgaatgcccc

SEQ ID NO: 800037 - DNA, 25 bp, Mus musculus
tgagcggtgctatagtgaatgcccc

SEQ ID NO: 800038 - DNA, 25 bp, Mus musculus
tgagcggtggtgagatgttcactca

SEQ ID NO: 800039 - DNA, 25 bp, Mus musculus
tgagcggtggtgtgatgttcactca

SEQ ID NO: 800040 - DNA, 25 bp, Mus musculus
tgagcggtgtgtcccctacaaatag

SEQ ID NO: 800041 - DNA, 25 bp, Mus musculus
tgagcggtgtgtgccctacaaatag

SEQ ID NO: 800042 - DNA, 25 bp, Mus musculus
tgagcgtaaccactggagaagatac

SEQ ID NO: 800043 - DNA, 25 bp, Mus musculus
tgagcgtaaccagtggagaagatac

SEQ ID NO: 800044 - DNA, 25 bp, Mus musculus
tgagcgtactctctaagtgtgtcag

SEQ ID NO: 800045 - DNA, 25 bp, Mus musculus
tgagcgtactctgtaagtgtgtcag

SEQ ID NO: 800046 - DNA, 25 bp, Mus musculus
tgagcgtaggtaatgcgggctctcc

SEQ ID NO: 800047 - DNA, 25 bp, Mus musculus
tgagcgtaggtattgcgggctctcc

SEQ ID NO: 800048 - DNA, 25 bp, Mus musculus
tgagcgtcactaaggagccttgatt

SEQ ID NO: 800049 - DNA, 25 bp, Mus musculus
tgagcgtcactatggagccttgatt

SEQ ID NO: 800050 - DNA, 25 bp, Mus musculus
tgagcgtcctggaacgaactccaca

SEQ ID NO: 800051 - DNA, 25 bp, Mus musculus
tgagcgtcctggacacttcttggag

SEQ ID NO: 800052 - DNA, 25 bp, Mus musculus
tgagcgtcctggtacgaactccaca

SEQ ID NO: 800053 - DNA, 25 bp, Mus musculus
tgagcgtcctggtcacttcttggag

SEQ ID NO: 800054 - DNA, 25 bp, Mus musculus
tgagcgtcgaaccactgaagccgcg

SEQ ID NO: 800055 - DNA, 25 bp, Mus musculus
tgagcgtcgaacgactgaagccgcg

SEQ ID NO: 800056 - DNA, 25 bp, Mus musculus
tgagcgtctgatccgcatgtacaac

SEQ ID NO: 800057 - DNA, 25 bp, Mus musculus
tgagcgtctgatgcgcatgtacaac

SEQ ID NO: 800058 - DNA, 25 bp, Mus musculus
tgagcgtctgtgaccctgatttcag

SEQ ID NO: 800059 - DNA, 25 bp, Mus musculus
tgagcgtctgtgtccctgatttcag

SEQ ID NO: 800060 - DNA, 25 bp, Mus musculus
tgagcgtcttccatgcacctgctga

SEQ ID NO: 800061 - DNA, 25 bp, Mus musculus
tgagcgtcttccttgcacctgctga

SEQ ID NO: 800062 - DNA, 25 bp, Mus musculus
tgagcgtgcaacctttggaaataac

SEQ ID NO: 800063 - DNA, 25 bp, Mus musculus
tgagcgtgcaacgtttggaaataac

SEQ ID NO: 800064 - DNA, 25 bp, Mus musculus
tgagcgtggagaacttcgcgctgct

SEQ ID NO: 800065 - DNA, 25 bp, Mus musculus
tgagcgtggagatcttcgcgctgct

SEQ ID NO: 800066 - DNA, 25 bp, Mus musculus
tgagcgtgggcaaggtcctcatcgt

SEQ ID NO: 800067 - DNA, 25 bp, Mus musculus
tgagcgtgggcatggtcctcatcgt

SEQ ID NO: 800068 - DNA, 25 bp, Mus musculus
tgagcgtgtcatcctaataagcggg

SEQ ID NO: 800069 - DNA, 25 bp, Mus musculus
tgagcgtgtcatgctaataagcggg

SEQ ID NO: 800070 - DNA, 25 bp, Mus musculus
tgagcgtgtgaacattgctttcaac

SEQ ID NO: 800071 - DNA, 25 bp, Mus musculus
tgagcgtgtgaagattgctttcaac

SEQ ID NO: 800072 - DNA, 25 bp, Mus musculus
tgagcgtgtgccacttgaagagcta

SEQ ID NO: 800073 - DNA, 25 bp, Mus musculus
tgagcgtgtgcctcttgaagagcta

SEQ ID NO: 800074 - DNA, 25 bp, Mus musculus
tgagcgtgtgtgattttggatttca

SEQ ID NO: 800075 - DNA, 25 bp, Mus musculus
tgagcgtgtgtgtttttggatttca

SEQ ID NO: 800076 - DNA, 25 bp, Mus musculus
tgagcgtgttctcctggccctgttc

SEQ ID NO: 800077 - DNA, 25 bp, Mus musculus
tgagcgtgttctgctggccctgttc

SEQ ID NO: 800078 - DNA, 25 bp, Mus musculus
tgagcgttttctctaagcagtggga

SEQ ID NO: 800079 - DNA, 25 bp, Mus musculus
tgagcgttttctgtaagcagtggga

SEQ ID NO: 800080 - DNA, 25 bp, Mus musculus
tgagctaaaaggctacagacttcct

SEQ ID NO: 800081 - DNA, 25 bp, Mus musculus
tgagctaaaagggtacagacttcct

SEQ ID NO: 800082 - DNA, 25 bp, Mus musculus
tgagctaaagccatatgtggaacct

SEQ ID NO: 800083 - DNA, 25 bp, Mus musculus
tgagctaaagccttatgtggaacct

SEQ ID NO: 800084 - DNA, 25 bp, Mus musculus
tgagctaaagcgcttggacaatatc

SEQ ID NO: 800085 - DNA, 25 bp, Mus musculus
tgagctaaagcggttggacaatatc

SEQ ID NO: 800086 - DNA, 25 bp, Mus musculus
tgagctaacctcagagagaagccct

SEQ ID NO: 800087 - DNA, 25 bp, Mus musculus
tgagctaacctctgagagaagccct

SEQ ID NO: 800088 - DNA, 25 bp, Mus musculus
tgagctaacgcacaacttcaagggc

SEQ ID NO: 800089 - DNA, 25 bp, Mus musculus
tgagctaacgcagaacttcaagggc

SEQ ID NO: 800090 - DNA, 25 bp, Mus musculus
tgagctaactcacagccaaggtgct

SEQ ID NO: 800091 - DNA, 25 bp, Mus musculus
tgagctaactcagagccaaggtgct

SEQ ID NO: 800092 - DNA, 25 bp, Mus musculus
tgagctacaactcagggaggtgacc

SEQ ID NO: 800093 - DNA, 25 bp, Mus musculus
tgagctacaactgagggaggtgacc

SEQ ID NO: 800094 - DNA, 25 bp, Mus musculus
tgagctacctgacggccccggatta

SEQ ID NO: 800095 - DNA, 25 bp, Mus musculus
tgagctacctgagggccccggatta

SEQ ID NO: 800096 - DNA, 25 bp, Mus musculus
tgagctactcttaccagtctcgctt

SEQ ID NO: 800097 - DNA, 25 bp, Mus musculus
tgagctactctttccagtctcgctt

SEQ ID NO: 800098 - DNA, 25 bp, Mus musculus
tgagctactgctacaaggtttgtcc

SEQ ID NO: 800099 - DNA, 25 bp, Mus musculus
tgagctactgcttcaaggtttgtcc

SEQ ID NO: 800100 - DNA, 25 bp, Mus musculus
tgagctacttctcgtaccggcagac

SEQ ID NO: 800101 - DNA, 25 bp, Mus musculus
tgagctacttctggtaccggcagac

SEQ ID NO: 800102 - DNA, 25 bp, Mus musculus
tgagctactttgaagcgtgcggtcc

SEQ ID NO: 800103 - DNA, 25 bp, Mus musculus
tgagctactttgtagcgtgcggtcc

SEQ ID NO: 800104 - DNA, 25 bp, Mus musculus
tgagctagcaatcccatcaaagagc

SEQ ID NO: 800105 - DNA, 25 bp, Mus musculus
tgagctagcaatgccatcaaagagc

SEQ ID NO: 800106 - DNA, 25 bp, Mus musculus
tgagctaggacacctcaggacttgg

SEQ ID NO: 800107 - DNA, 25 bp, Mus musculus
tgagctaggacagctcaggacttgg

SEQ ID NO: 800108 - DNA, 25 bp, Mus musculus
tgagctaggcttccgcaaaaatgac

SEQ ID NO: 800109 - DNA, 25 bp, Mus musculus
tgagctaggcttgcgcaaaaatgac

SEQ ID NO: 800110 - DNA, 25 bp, Mus musculus
tgagctatgaggacatcgcaggcct

SEQ ID NO: 800111 - DNA, 25 bp, Mus musculus
tgagctatgaggtcatcgcaggcct

SEQ ID NO: 800112 - DNA, 25 bp, Mus musculus
tgagctatggcacccagcgcagagt

SEQ ID NO: 800113 - DNA, 25 bp, Mus musculus
tgagctatggcagccagcgcagagt

SEQ ID NO: 800114 - DNA, 25 bp, Mus musculus
tgagctatggggagaacacccgccg

SEQ ID NO: 800115 - DNA, 25 bp, Mus musculus
tgagctatggggtgaacacccgccg

SEQ ID NO: 800116 - DNA, 25 bp, Mus musculus
tgagctatgtctccatcgtggccat

SEQ ID NO: 800117 - DNA, 25 bp, Mus musculus
tgagctatgtctgcatcgtggccat

SEQ ID NO: 800118 - DNA, 25 bp, Mus musculus
tgagctattccgaaggatccttagg

SEQ ID NO: 800119 - DNA, 25 bp, Mus musculus
tgagctattccgtaggatccttagg

SEQ ID NO: 800120 - DNA, 25 bp, Mus musculus
tgagctcaagaaagaacctgtgcat

SEQ ID NO: 800121 - DNA, 25 bp, Mus musculus
tgagctcaagaatgaacctgtgcat

SEQ ID NO: 800122 - DNA, 25 bp, Mus musculus
tgagctcaagggaacagccacggtt

SEQ ID NO: 800123 - DNA, 25 bp, Mus musculus
tgagctcaagggtacagccacggtt

SEQ ID NO: 800124 - DNA, 25 bp, Mus musculus
tgagctcaaggtcgtccaatgggtc

SEQ ID NO: 800125 - DNA, 25 bp, Mus musculus
tgagctcaaggtggtccaatgggtc

SEQ ID NO: 800126 - DNA, 25 bp, Mus musculus
tgagctcaagttagcagtggcctgg

SEQ ID NO: 800127 - DNA, 25 bp, Mus musculus
tgagctcaagttccactacatggtg

SEQ ID NO: 800128 - DNA, 25 bp, Mus musculus
tgagctcaagttgcactacatggtg

SEQ ID NO: 800129 - DNA, 25 bp, Mus musculus
tgagctcaagtttgcagtggcctgg

SEQ ID NO: 800130 - DNA, 25 bp, Mus musculus
tgagctcaatctcgagtgccggcat

SEQ ID NO: 800131 - DNA, 25 bp, Mus musculus
tgagctcaatctggagtgccggcat

SEQ ID NO: 800132 - DNA, 25 bp, Mus musculus
tgagctcactgtaatggtgttgaag

SEQ ID NO: 800133 - DNA, 25 bp, Mus musculus
tgagctcactgttatggtgttgaag

SEQ ID NO: 800134 - DNA, 25 bp, Mus musculus
tgagctcagaacatcccagtccaga

SEQ ID NO: 800135 - DNA, 25 bp, Mus musculus
tgagctcagaacttcccagtccaga

SEQ ID NO: 800136 - DNA, 25 bp, Mus musculus
tgagctcagagaagcagtcttgttg

SEQ ID NO: 800137 - DNA, 25 bp, Mus musculus
tgagctcagagacagatggcatcga

SEQ ID NO: 800138 - DNA, 25 bp, Mus musculus
tgagctcagagagagatggcatcga

SEQ ID NO: 800139 - DNA, 25 bp, Mus musculus
tgagctcagagatgcagtcttgttg

SEQ ID NO: 800140 - DNA, 25 bp, Mus musculus
tgagctcagagtcttgggaaaagac

SEQ ID NO: 800141 - DNA, 25 bp, Mus musculus
tgagctcagagtgttgggaaaagac

SEQ ID NO: 800142 - DNA, 25 bp, Mus musculus
tgagctcagattaggaaacaaacgc

SEQ ID NO: 800143 - DNA, 25 bp, Mus musculus
tgagctcagatttggaaacaaacgc

SEQ ID NO: 800144 - DNA, 25 bp, Mus musculus
tgagctcagcacataacctagatgg

SEQ ID NO: 800145 - DNA, 25 bp, Mus musculus
tgagctcagcacttaacctagatgg

SEQ ID NO: 800146 - DNA, 25 bp, Mus musculus
tgagctcagcccagtgtccggtgtt

SEQ ID NO: 800147 - DNA, 25 bp, Mus musculus
tgagctcagccctgtgtccggtgtt

SEQ ID NO: 800148 - DNA, 25 bp, Mus musculus
tgagctcagctaaaaaggtggtaac

SEQ ID NO: 800149 - DNA, 25 bp, Mus musculus
tgagctcagctataaaggtggtaac

SEQ ID NO: 800150 - DNA, 25 bp, Mus musculus
tgagctcaggctaaaatattatgga

SEQ ID NO: 800151 - DNA, 25 bp, Mus musculus
tgagctcaggcttaaatattatgga

SEQ ID NO: 800152 - DNA, 25 bp, Mus musculus
tgagctcagtcgatttggaaggtcc

SEQ ID NO: 800153 - DNA, 25 bp, Mus musculus
tgagctcagtcgttttggaaggtcc

SEQ ID NO: 800154 - DNA, 25 bp, Mus musculus
tgagctcataagatgctttcacccc

SEQ ID NO: 800155 - DNA, 25 bp, Mus musculus
tgagctcataagttgctttcacccc

SEQ ID NO: 800156 - DNA, 25 bp, Mus musculus
tgagctcatcccagacagtgcagag

SEQ ID NO: 800157 - DNA, 25 bp, Mus musculus
tgagctcatccctgacagtgcagag

SEQ ID NO: 800158 - DNA, 25 bp, Mus musculus
tgagctcatgagagaaaagggcatt

SEQ ID NO: 800159 - DNA, 25 bp, Mus musculus
tgagctcatgagtgaaaagggcatt

SEQ ID NO: 800160 - DNA, 25 bp, Mus musculus
tgagctcatgccaggcggcactgag

SEQ ID NO: 800161 - DNA, 25 bp, Mus musculus
tgagctcatgcctggcggcactgag

SEQ ID NO: 800162 - DNA, 25 bp, Mus musculus
tgagctccacccagcttcggagggt

SEQ ID NO: 800163 - DNA, 25 bp, Mus musculus
tgagctccaccctgcttcggagggt

SEQ ID NO: 800164 - DNA, 25 bp, Mus musculus
tgagctccaggaagatagaggacag

SEQ ID NO: 800165 - DNA, 25 bp, Mus musculus
tgagctccaggatgatagaggacag

SEQ ID NO: 800166 - DNA, 25 bp, Mus musculus
tgagctccaggcctacatcgagcag

SEQ ID NO: 800167 - DNA, 25 bp, Mus musculus
tgagctccaggcgtacatcgagcag

SEQ ID NO: 800168 - DNA, 25 bp, Mus musculus
tgagctccagtcacgcagaacttgt

SEQ ID NO: 800169 - DNA, 25 bp, Mus musculus
tgagctccagtctcgcagaacttgt

SEQ ID NO: 800170 - DNA, 25 bp, Mus musculus
tgagctccagttcgtgttatgcccc

SEQ ID NO: 800171 - DNA, 25 bp, Mus musculus
tgagctccagttggtgttatgcccc

SEQ ID NO: 800172 - DNA, 25 bp, Mus musculus
tgagctccatagaaatgtgaccatc

SEQ ID NO: 800173 - DNA, 25 bp, Mus musculus
tgagctccatagtaatgtgaccatc

SEQ ID NO: 800174 - DNA, 25 bp, Mus musculus
tgagctcccatgaaccttggcacct

SEQ ID NO: 800175 - DNA, 25 bp, Mus musculus
tgagctcccatgtaccttggcacct

SEQ ID NO: 800176 - DNA, 25 bp, Mus musculus
tgagctcccctgagagtctctgcag

SEQ ID NO: 800177 - DNA, 25 bp, Mus musculus
tgagctcccctgtgagtctctgcag

SEQ ID NO: 800178 - DNA, 25 bp, Mus musculus
tgagctccctaacctgcaagttggt

SEQ ID NO: 800179 - DNA, 25 bp, Mus musculus
tgagctccctaagctgcaagttggt

SEQ ID NO: 800180 - DNA, 25 bp, Mus musculus
tgagctccctggaaaccccaatgct

SEQ ID NO: 800181 - DNA, 25 bp, Mus musculus
tgagctccctggtaaccccaatgct

SEQ ID NO: 800182 - DNA, 25 bp, Mus musculus
tgagctccgagaagctgttctcttg

SEQ ID NO: 800183 - DNA, 25 bp, Mus musculus
tgagctccgagatgctgttctcttg

SEQ ID NO: 800184 - DNA, 25 bp, Mus musculus
tgagctccgatgcaagcatcctgca

SEQ ID NO: 800185 - DNA, 25 bp, Mus musculus
tgagctccgatggaagcatcctgca

SEQ ID NO: 800186 - DNA, 25 bp, Mus musculus
tgagctccggagacaccaaggaagt

SEQ ID NO: 800187 - DNA, 25 bp, Mus musculus
tgagctccggagtcaccaaggaagt

SEQ ID NO: 800188 - DNA, 25 bp, Mus musculus
tgagctcctgaccatgtaccatgga

SEQ ID NO: 800189 - DNA, 25 bp, Mus musculus
tgagctcctgacgatgtaccatgga

SEQ ID NO: 800190 - DNA, 25 bp, Mus musculus
tgagctcctggaaagatcttgctac

SEQ ID NO: 800191 - DNA, 25 bp, Mus musculus
tgagctcctggatagatcttgctac

SEQ ID NO: 800192 - DNA, 25 bp, Mus musculus
tgagctcgcagtaccaggttttggt

SEQ ID NO: 800193 - DNA, 25 bp, Mus musculus
tgagctcgcagttccaggttttggt

SEQ ID NO: 800194 - DNA, 25 bp, Mus musculus
tgagctcgtggaactggtgatcaca

SEQ ID NO: 800195 - DNA, 25 bp, Mus musculus
tgagctcgtggatctggtgatcaca

SEQ ID NO: 800196 - DNA, 25 bp, Mus musculus
tgagctctaacaaaagccgcgacag

SEQ ID NO: 800197 - DNA, 25 bp, Mus musculus
tgagctctaacataagccgcgacag

SEQ ID NO: 800198 - DNA, 25 bp, Mus musculus
tgagctctaccgaattggtcagcaa

SEQ ID NO: 800199 - DNA, 25 bp, Mus musculus
tgagctctaccgtattggtcagcaa

SEQ ID NO: 800200 - DNA, 25 bp, Mus musculus
tgagctctcagaatccaggcaatgc

SEQ ID NO: 800201 - DNA, 25 bp, Mus musculus
tgagctctcagattccaggcaatgc

SEQ ID NO: 800202 - DNA, 25 bp, Mus musculus
tgagctctgctcctcttagcgttgg

SEQ ID NO: 800203 - DNA, 25 bp, Mus musculus
tgagctctgctcgtcttagcgttgg

SEQ ID NO: 800204 - DNA, 25 bp, Mus musculus
tgagctctggccacatacacaagag

SEQ ID NO: 800205 - DNA, 25 bp, Mus musculus
tgagctctggcctcatacacaagag

SEQ ID NO: 800206 - DNA, 25 bp, Mus musculus
tgagctctgggcacaagaagtggat

SEQ ID NO: 800207 - DNA, 25 bp, Mus musculus
tgagctctgggctcaagaagtggat

SEQ ID NO: 800208 - DNA, 25 bp, Mus musculus
tgagctcttcgtcctgaacgcggcg

SEQ ID NO: 800209 - DNA, 25 bp, Mus musculus
tgagctcttcgtgctgaacgcggcg

SEQ ID NO: 800210 - DNA, 25 bp, Mus musculus
tgagctcttgtcactccgtccacga

SEQ ID NO: 800211 - DNA, 25 bp, Mus musculus
tgagctcttgtctctccgtccacga

SEQ ID NO: 800212 - DNA, 25 bp, Mus musculus
tgagctgaaaatcggttacacagac

SEQ ID NO: 800213 - DNA, 25 bp, Mus musculus
tgagctgaaaatgggttacacagac

SEQ ID NO: 800214 - DNA, 25 bp, Mus musculus
tgagctgaacaacttactgagcggc

SEQ ID NO: 800215 - DNA, 25 bp, Mus musculus
tgagctgaacaagttactgagcggc

SEQ ID NO: 800216 - DNA, 25 bp, Mus musculus
tgagctgaagcacgccaagagaatt

SEQ ID NO: 800217 - DNA, 25 bp, Mus musculus
tgagctgaagcaggccaagagaatt

SEQ ID NO: 800218 - DNA, 25 bp, Mus musculus
tgagctgaattacttgaggactgcc

SEQ ID NO: 800219 - DNA, 25 bp, Mus musculus
tgagctgaattagttgaggactgcc

SEQ ID NO: 800220 - DNA, 25 bp, Mus musculus
tgagctgacccgcatctgtgatgac

SEQ ID NO: 800221 - DNA, 25 bp, Mus musculus
tgagctgacccggatctgtgatgac

SEQ ID NO: 800222 - DNA, 25 bp, Mus musculus
tgagctgagccgagagttcaatgag

SEQ ID NO: 800223 - DNA, 25 bp, Mus musculus
tgagctgagccgtgagttcaatgag

SEQ ID NO: 800224 - DNA, 25 bp, Mus musculus
tgagctgagcttcaccatcttatcc

SEQ ID NO: 800225 - DNA, 25 bp, Mus musculus
tgagctgagcttgaccatcttatcc

SEQ ID NO: 800226 - DNA, 25 bp, Mus musculus
tgagctgaggacatataaactcaag

SEQ ID NO: 800227 - DNA, 25 bp, Mus musculus
tgagctgaggacttataaactcaag

SEQ ID NO: 800228 - DNA, 25 bp, Mus musculus
tgagctgattgaccatccgatgagc

SEQ ID NO: 800229 - DNA, 25 bp, Mus musculus
tgagctgattgagcatccgatgagc

SEQ ID NO: 800230 - DNA, 25 bp, Mus musculus
tgagctgcaaaaaacacagcgcttg

SEQ ID NO: 800231 - DNA, 25 bp, Mus musculus
tgagctgcaaaatacacagcgcttg

SEQ ID NO: 800232 - DNA, 25 bp, Mus musculus
tgagctgcaggtcccatctggatga

SEQ ID NO: 800233 - DNA, 25 bp, Mus musculus
tgagctgcaggtgccatctggatga

SEQ ID NO: 800234 - DNA, 25 bp, Mus musculus
tgagctgccaccagtcactcaagga

SEQ ID NO: 800235 - DNA, 25 bp, Mus musculus
tgagctgccacctgtcactcaagga

SEQ ID NO: 800236 - DNA, 25 bp, Mus musculus
tgagctgccccacggtagtggtcca

SEQ ID NO: 800237 - DNA, 25 bp, Mus musculus
tgagctgccccagggtagtggtcca

SEQ ID NO: 800238 - DNA, 25 bp, Mus musculus
tgagctgcccttactgagtccagag

SEQ ID NO: 800239 - DNA, 25 bp, Mus musculus
tgagctgccctttctgagtccagag

SEQ ID NO: 800240 - DNA, 25 bp, Mus musculus
tgagctgccggactttagaccagag

SEQ ID NO: 800241 - DNA, 25 bp, Mus musculus
tgagctgccggagtttagaccagag

SEQ ID NO: 800242 - DNA, 25 bp, Mus musculus
tgagctgccgtaaggaatttggatg

SEQ ID NO: 800243 - DNA, 25 bp, Mus musculus
tgagctgccgtatggaatttggatg

SEQ ID NO: 800244 - DNA, 25 bp, Mus musculus
tgagctgccgttacattcaggagaa

SEQ ID NO: 800245 - DNA, 25 bp, Mus musculus
tgagctgccgtttcattcaggagaa

SEQ ID NO: 800246 - DNA, 25 bp, Mus musculus
tgagctgcggcaatcctgtggacgt

SEQ ID NO: 800247 - DNA, 25 bp, Mus musculus
tgagctgcggcattcctgtggacgt

SEQ ID NO: 800248 - DNA, 25 bp, Mus musculus
tgagctgctcctagaagagccagac

SEQ ID NO: 800249 - DNA, 25 bp, Mus musculus
tgagctgctccttgaagagccagac

SEQ ID NO: 800250 - DNA, 25 bp, Mus musculus
tgagctgctcgtcgagatcttcgcg

SEQ ID NO: 800251 - DNA, 25 bp, Mus musculus
tgagctgctcgtggagatcttcgcg

SEQ ID NO: 800252 - DNA, 25 bp, Mus musculus
tgagctgctcttacggaccctgcct

SEQ ID NO: 800253 - DNA, 25 bp, Mus musculus
tgagctgctctttcggaccctgcct

SEQ ID NO: 800254 - DNA, 25 bp, Mus musculus
tgagctgctggcacaagtctatctc

SEQ ID NO: 800255 - DNA, 25 bp, Mus musculus
tgagctgctggctcaagtctatctc

SEQ ID NO: 800256 - DNA, 25 bp, Mus musculus
tgagctggaaatcggagatgattac

SEQ ID NO: 800257 - DNA, 25 bp, Mus musculus
tgagctggaaatgggagatgattac

SEQ ID NO: 800258 - DNA, 25 bp, Mus musculus
tgagctggaagacgccgctgcgcag

SEQ ID NO: 800259 - DNA, 25 bp, Mus musculus
tgagctggaagaggccgctgcgcag

SEQ ID NO: 800260 - DNA, 25 bp, Mus musculus
tgagctggactaccttgctttcctg

SEQ ID NO: 800261 - DNA, 25 bp, Mus musculus
tgagctggactagcttgctttcctg

SEQ ID NO: 800262 - DNA, 25 bp, Mus musculus
tgagctggagtgagttagtagtcaa

SEQ ID NO: 800263 - DNA, 25 bp, Mus musculus
tgagctggagtgtgttagtagtcaa

SEQ ID NO: 800264 - DNA, 25 bp, Mus musculus
tgagctggcagcctcagcctatcgg

SEQ ID NO: 800265 - DNA, 25 bp, Mus musculus
tgagctggcagcgtcagcctatcgg

SEQ ID NO: 800266 - DNA, 25 bp, Mus musculus
tgagctggcattacaaactggaaaa

SEQ ID NO: 800267 - DNA, 25 bp, Mus musculus
tgagctggcatttcaaactggaaaa

SEQ ID NO: 800268 - DNA, 25 bp, Mus musculus
tgagctggccacagaccagcaggag

SEQ ID NO: 800269 - DNA, 25 bp, Mus musculus
tgagctggccactgaccagcaggag

SEQ ID NO: 800270 - DNA, 25 bp, Mus musculus
tgagctggcccaaagtcctctgcct

SEQ ID NO: 800271 - DNA, 25 bp, Mus musculus
tgagctggcccatagtcctctgcct

SEQ ID NO: 800272 - DNA, 25 bp, Mus musculus
tgagctggcgcacgactacttctcc

SEQ ID NO: 800273 - DNA, 25 bp, Mus musculus
tgagctggcgcaggactacttctcc

SEQ ID NO: 800274 - DNA, 25 bp, Mus musculus
tgagctggctgaaccatcatggcgg

SEQ ID NO: 800275 - DNA, 25 bp, Mus musculus
tgagctggctgaattaccactgaga

SEQ ID NO: 800276 - DNA, 25 bp, Mus musculus
tgagctggctgatccatcatggcgg

SEQ ID NO: 800277 - DNA, 25 bp, Mus musculus
tgagctggctgatttaccactgaga

SEQ ID NO: 800278 - DNA, 25 bp, Mus musculus
tgagctggctgtcgctgttcatcca

SEQ ID NO: 800279 - DNA, 25 bp, Mus musculus
tgagctggctgtggctgttcatcca

SEQ ID NO: 800280 - DNA, 25 bp, Mus musculus
tgagctgggaacagagccggtctct

SEQ ID NO: 800281 - DNA, 25 bp, Mus musculus
tgagctgggaactgagccggtctct

SEQ ID NO: 800282 - DNA, 25 bp, Mus musculus
tgagctgggactagctaagaatgga

SEQ ID NO: 800283 - DNA, 25 bp, Mus musculus
tgagctgggactcgaaacacgattg

SEQ ID NO: 800284 - DNA, 25 bp, Mus musculus
tgagctgggactggaaacacgattg

SEQ ID NO: 800285 - DNA, 25 bp, Mus musculus
tgagctgggacttgctaagaatgga

SEQ ID NO: 800286 - DNA, 25 bp, Mus musculus
tgagctgggcaacacccagcaacag

SEQ ID NO: 800287 - DNA, 25 bp, Mus musculus
tgagctgggcaagacccagcaacag

SEQ ID NO: 800288 - DNA, 25 bp, Mus musculus
tgagctggtcaaacatggacccatg

SEQ ID NO: 800289 - DNA, 25 bp, Mus musculus
tgagctggtcaatcatggacccatg

SEQ ID NO: 800290 - DNA, 25 bp, Mus musculus
tgagctggtgcgactccatgacgac

SEQ ID NO: 800291 - DNA, 25 bp, Mus musculus
tgagctggtgcgtctccatgacgac

SEQ ID NO: 800292 - DNA, 25 bp, Mus musculus
tgagctggttctccagtgcccagat

SEQ ID NO: 800293 - DNA, 25 bp, Mus musculus
tgagctggttctgcagtgcccagat

SEQ ID NO: 800294 - DNA, 25 bp, Mus musculus
tgagctgtatatacactggtgtggc

SEQ ID NO: 800295 - DNA, 25 bp, Mus musculus
tgagctgtatattcactggtgtggc

SEQ ID NO: 800296 - DNA, 25 bp, Mus musculus
tgagctgtatcgctaccctagtgga

SEQ ID NO: 800297 - DNA, 25 bp, Mus musculus
tgagctgtatcggtaccctagtgga

SEQ ID NO: 800298 - DNA, 25 bp, Mus musculus
tgagctgtcagcacgattgcggcag

SEQ ID NO: 800299 - DNA, 25 bp, Mus musculus
tgagctgtcagctcgattgcggcag

SEQ ID NO: 800300 - DNA, 25 bp, Mus musculus
tgagctgtccaactctagcagggag

SEQ ID NO: 800301 - DNA, 25 bp, Mus musculus
tgagctgtccaagtctagcagggag

SEQ ID NO: 800302 - DNA, 25 bp, Mus musculus
tgagctgtcccacagaatgctaaca

SEQ ID NO: 800303 - DNA, 25 bp, Mus musculus
tgagctgtcccagagaatgctaaca

SEQ ID NO: 800304 - DNA, 25 bp, Mus musculus
tgagctgtccctcgtgaagggctcc

SEQ ID NO: 800305 - DNA, 25 bp, Mus musculus
tgagctgtccctggtgaagggctcc

SEQ ID NO: 800306 - DNA, 25 bp, Mus musculus
tgagctgtcctactacagcagctgc

SEQ ID NO: 800307 - DNA, 25 bp, Mus musculus
tgagctgtcctagtacagcagctgc

SEQ ID NO: 800308 - DNA, 25 bp, Mus musculus
tgagctgtctaacccctccgaaaca

SEQ ID NO: 800309 - DNA, 25 bp, Mus musculus
tgagctgtctaagccctccgaaaca

SEQ ID NO: 800310 - DNA, 25 bp, Mus musculus
tgagctgtgactactttgctgtgaa

SEQ ID NO: 800311 - DNA, 25 bp, Mus musculus
tgagctgtgacttctttgctgtgaa

SEQ ID NO: 800312 - DNA, 25 bp, Mus musculus
tgagctgtgcaaacaaagaaacgag

SEQ ID NO: 800313 - DNA, 25 bp, Mus musculus
tgagctgtgcaatcaaagaaacgag

SEQ ID NO: 800314 - DNA, 25 bp, Mus musculus
tgagctgtgcccagagactttattc

SEQ ID NO: 800315 - DNA, 25 bp, Mus musculus
tgagctgtgccctgagactttattc

SEQ ID NO: 800316 - DNA, 25 bp, Mus musculus
tgagctgtgctcatggagtatgtct

SEQ ID NO: 800317 - DNA, 25 bp, Mus musculus
tgagctgtgctcttggagtatgtct

SEQ ID NO: 800318 - DNA, 25 bp, Mus musculus
tgagctgttcccatctgtaagccgg

SEQ ID NO: 800319 - DNA, 25 bp, Mus musculus
tgagctgttcccttctgtaagccgg

SEQ ID NO: 800320 - DNA, 25 bp, Mus musculus
tgagctgttgcgaactgtatcatat

SEQ ID NO: 800321 - DNA, 25 bp, Mus musculus
tgagctgttgcgtactgtatcatat

SEQ ID NO: 800322 - DNA, 25 bp, Mus musculus
tgagcttaacaaacggctacagaac

SEQ ID NO: 800323 - DNA, 25 bp, Mus musculus
tgagcttaacaatcggctacagaac

SEQ ID NO: 800324 - DNA, 25 bp, Mus musculus
tgagcttacatgactgccttatgaa

SEQ ID NO: 800325 - DNA, 25 bp, Mus musculus
tgagcttacatgtctgccttatgaa

SEQ ID NO: 800326 - DNA, 25 bp, Mus musculus
tgagcttacctcactgtccaccgga

SEQ ID NO: 800327 - DNA, 25 bp, Mus musculus
tgagcttacctctctgtccaccgga

SEQ ID NO: 800328 - DNA, 25 bp, Mus musculus
tgagcttagtccacctctcggaagg

SEQ ID NO: 800329 - DNA, 25 bp, Mus musculus
tgagcttagtcctcctctcggaagg

SEQ ID NO: 800330 - DNA, 25 bp, Mus musculus
tgagcttagtttatttaggccaggc

SEQ ID NO: 800331 - DNA, 25 bp, Mus musculus
tgagcttagtttttttaggccaggc

SEQ ID NO: 800332 - DNA, 25 bp, Mus musculus
tgagcttatcctcgacatgtttgga

SEQ ID NO: 800333 - DNA, 25 bp, Mus musculus
tgagcttatcctggacatgtttgga

SEQ ID NO: 800334 - DNA, 25 bp, Mus musculus
tgagcttatctgcacaaggactgtg

SEQ ID NO: 800335 - DNA, 25 bp, Mus musculus
tgagcttatctggacaaggactgtg

SEQ ID NO: 800336 - DNA, 25 bp, Mus musculus
tgagcttcaacactaatacttacag

SEQ ID NO: 800337 - DNA, 25 bp, Mus musculus
tgagcttcaacagtaatacttacag

SEQ ID NO: 800338 - DNA, 25 bp, Mus musculus
tgagcttcagggactcgtggctcgc

SEQ ID NO: 800339 - DNA, 25 bp, Mus musculus
tgagcttcagggtctcgtggctcgc

SEQ ID NO: 800340 - DNA, 25 bp, Mus musculus
tgagcttccaatagatcccaagttg

SEQ ID NO: 800341 - DNA, 25 bp, Mus musculus
tgagcttccaatccctactggtcgg

SEQ ID NO: 800342 - DNA, 25 bp, Mus musculus
tgagcttccaatgcctactggtcgg

SEQ ID NO: 800343 - DNA, 25 bp, Mus musculus
tgagcttccaattgatcccaagttg

SEQ ID NO: 800344 - DNA, 25 bp, Mus musculus
tgagcttcccatcgatacaaaaaca

SEQ ID NO: 800345 - DNA, 25 bp, Mus musculus
tgagcttcccatggatacaaaaaca

SEQ ID NO: 800346 - DNA, 25 bp, Mus musculus
tgagcttcctgactgtgactctgaa

SEQ ID NO: 800347 - DNA, 25 bp, Mus musculus
tgagcttcctgagtgtgactctgaa

SEQ ID NO: 800348 - DNA, 25 bp, Mus musculus
tgagcttcggtacttgccattaaac

SEQ ID NO: 800349 - DNA, 25 bp, Mus musculus
tgagcttcggtagttgccattaaac

SEQ ID NO: 800350 - DNA, 25 bp, Mus musculus
tgagcttcgtgtcccagcgctgtag

SEQ ID NO: 800351 - DNA, 25 bp, Mus musculus
tgagcttcgtgtgccagcgctgtag

SEQ ID NO: 800352 - DNA, 25 bp, Mus musculus
tgagcttgaaatcgtcctggagtcc

SEQ ID NO: 800353 - DNA, 25 bp, Mus musculus
tgagcttgaaatggtcctggagtcc

SEQ ID NO: 800354 - DNA, 25 bp, Mus musculus
tgagcttgaacgactgcccagtgtc

SEQ ID NO: 800355 - DNA, 25 bp, Mus musculus
tgagcttgaacgtctgcccagtgtc

SEQ ID NO: 800356 - DNA, 25 bp, Mus musculus
tgagcttgagctcaaagcagagaaa

SEQ ID NO: 800357 - DNA, 25 bp, Mus musculus
tgagcttgagctcgcctggactaca

SEQ ID NO: 800358 - DNA, 25 bp, Mus musculus
tgagcttgagctgaaagcagagaaa

SEQ ID NO: 800359 - DNA, 25 bp, Mus musculus
tgagcttgagctggcctggactaca

SEQ ID NO: 800360 - DNA, 25 bp, Mus musculus
tgagcttgatgaacccagtgttcaa

SEQ ID NO: 800361 - DNA, 25 bp, Mus musculus
tgagcttgatgatcccagtgttcaa

SEQ ID NO: 800362 - DNA, 25 bp, Mus musculus
tgagcttgctccaccaaaaagagag

SEQ ID NO: 800363 - DNA, 25 bp, Mus musculus
tgagcttgctcctccaaaaagagag

SEQ ID NO: 800364 - DNA, 25 bp, Mus musculus
tgagcttggaaacaagcagttcaag

SEQ ID NO: 800365 - DNA, 25 bp, Mus musculus
tgagcttggaaagaagcagttcaag

SEQ ID NO: 800366 - DNA, 25 bp, Mus musculus
tgagcttggactcagcaacagcgag

SEQ ID NO: 800367 - DNA, 25 bp, Mus musculus
tgagcttggactgagcaacagcgag

SEQ ID NO: 800368 - DNA, 25 bp, Mus musculus
tgagcttggcccaggcttggaaccg

SEQ ID NO: 800369 - DNA, 25 bp, Mus musculus
tgagcttggccctggcttggaaccg

SEQ ID NO: 800370 - DNA, 25 bp, Mus musculus
tgagcttggcctacagggtgccctt

SEQ ID NO: 800371 - DNA, 25 bp, Mus musculus
tgagcttggccttcagggtgccctt

SEQ ID NO: 800372 - DNA, 25 bp, Mus musculus
tgagcttggcgaccagctggacaac

SEQ ID NO: 800373 - DNA, 25 bp, Mus musculus
tgagcttggcgagcagctggacaac

SEQ ID NO: 800374 - DNA, 25 bp, Mus musculus
tgagcttgtgagctgtccctgagac

SEQ ID NO: 800375 - DNA, 25 bp, Mus musculus
tgagcttgtgaggtgtccctgagac

SEQ ID NO: 800376 - DNA, 25 bp, Mus musculus
tgagcttgtgatcttggaatggccc

SEQ ID NO: 800377 - DNA, 25 bp, Mus musculus
tgagcttgtgatgttggaatggccc

SEQ ID NO: 800378 - DNA, 25 bp, Mus musculus
tgagcttgttagcattgtcacccaa

SEQ ID NO: 800379 - DNA, 25 bp, Mus musculus
tgagcttgttaggattgtcacccaa

SEQ ID NO: 800380 - DNA, 25 bp, Mus musculus
tgagctttcccgagacaaggaaaag

SEQ ID NO: 800381 - DNA, 25 bp, Mus musculus
tgagctttcccgtgacaaggaaaag

SEQ ID NO: 800382 - DNA, 25 bp, Mus musculus
tgagctttcgttcttactatttccc

SEQ ID NO: 800383 - DNA, 25 bp, Mus musculus
tgagctttcgttgttactatttccc

SEQ ID NO: 800384 - DNA, 25 bp, Mus musculus
tgagctttgaacatctccggcggat

SEQ ID NO: 800385 - DNA, 25 bp, Mus musculus
tgagctttgaacttctccggcggat

SEQ ID NO: 800386 - DNA, 25 bp, Mus musculus
tgagctttgaataatgccaccatgc

SEQ ID NO: 800387 - DNA, 25 bp, Mus musculus
tgagctttgaattatgccaccatgc

SEQ ID NO: 800388 - DNA, 25 bp, Mus musculus
tgagctttgcttcgtttcctgaaga

SEQ ID NO: 800389 - DNA, 25 bp, Mus musculus
tgagctttgcttggtttcctgaaga

SEQ ID NO: 800390 - DNA, 25 bp, Mus musculus
tgagctttgtcaaccagaagctaga

SEQ ID NO: 800391 - DNA, 25 bp, Mus musculus
tgagctttgtcatccagaagctaga

SEQ ID NO: 800392 - DNA, 25 bp, Mus musculus
tgagctttgtccagaaggaaaatga

SEQ ID NO: 800393 - DNA, 25 bp, Mus musculus
tgagctttgtcctgaaggaaaatga

SEQ ID NO: 800394 - DNA, 25 bp, Mus musculus
tgaggaaaaaatcattgccgaggct

SEQ ID NO: 800395 - DNA, 25 bp, Mus musculus
tgaggaaaaaatgattgccgaggct

SEQ ID NO: 800396 - DNA, 25 bp, Mus musculus
tgaggaaaagtcactaccggaaaag

SEQ ID NO: 800397 - DNA, 25 bp, Mus musculus
tgaggaaaagtctctaccggaaaag

SEQ ID NO: 800398 - DNA, 25 bp, Mus musculus
tgaggaaacggccaactacctggtt

SEQ ID NO: 800399 - DNA, 25 bp, Mus musculus
tgaggaaacggccagtcttctcttg

SEQ ID NO: 800400 - DNA, 25 bp, Mus musculus
tgaggaaacggcgaactacctggtt

SEQ ID NO: 800401 - DNA, 25 bp, Mus musculus
tgaggaaacggcgagtcttctcttg

SEQ ID NO: 800402 - DNA, 25 bp, Mus musculus
tgaggaaactgtaaaagctatgctg

SEQ ID NO: 800403 - DNA, 25 bp, Mus musculus
tgaggaaactgttaaagctatgctg

SEQ ID NO: 800404 - DNA, 25 bp, Mus musculus
tgaggaaagccgaagaagaggaact

SEQ ID NO: 800405 - DNA, 25 bp, Mus musculus
tgaggaaagccgtagaagaggaact

SEQ ID NO: 800406 - DNA, 25 bp, Mus musculus
tgaggaaaggaaacttcttggtgct

SEQ ID NO: 800407 - DNA, 25 bp, Mus musculus
tgaggaaaggaatcttcttggtgct

SEQ ID NO: 800408 - DNA, 25 bp, Mus musculus
tgaggaaagtggaagccgccaagaa

SEQ ID NO: 800409 - DNA, 25 bp, Mus musculus
tgaggaaagtggtagccgccaagaa

SEQ ID NO: 800410 - DNA, 25 bp, Mus musculus
tgaggaacaacactgctttgcagtc

SEQ ID NO: 800411 - DNA, 25 bp, Mus musculus
tgaggaacaacagtgctttgcagtc

SEQ ID NO: 800412 - DNA, 25 bp, Mus musculus
tgaggaacaccgaggaagaagactt

SEQ ID NO: 800413 - DNA, 25 bp, Mus musculus
tgaggaacaccgtggaagaagactt

SEQ ID NO: 800414 - DNA, 25 bp, Mus musculus
tgaggaacagtgcttgtatcagatc

SEQ ID NO: 800415 - DNA, 25 bp, Mus musculus
tgaggaacagtggttgtatcagatc

SEQ ID NO: 800416 - DNA, 25 bp, Mus musculus
tgaggaacatacaaaatccatgtgg

SEQ ID NO: 800417 - DNA, 25 bp, Mus musculus
tgaggaacatactaaatccatgtgg

SEQ ID NO: 800418 - DNA, 25 bp, Mus musculus
tgaggaaccaacctaaactcttggc

SEQ ID NO: 800419 - DNA, 25 bp, Mus musculus
tgaggaaccaacgtaaactcttggc

SEQ ID NO: 800420 - DNA, 25 bp, Mus musculus
tgaggaacccgcacggtcccaggag

SEQ ID NO: 800421 - DNA, 25 bp, Mus musculus
tgaggaacccgctcggtcccaggag

SEQ ID NO: 800422 - DNA, 25 bp, Mus musculus
tgaggaaccgcaataggcttcagct

SEQ ID NO: 800423 - DNA, 25 bp, Mus musculus
tgaggaaccgcattaggcttcagct

SEQ ID NO: 800424 - DNA, 25 bp, Mus musculus
tgaggaacctctctccgcgaggccg

SEQ ID NO: 800425 - DNA, 25 bp, Mus musculus
tgaggaacctctgtccgcgaggccg

SEQ ID NO: 800426 - DNA, 25 bp, Mus musculus
tgaggaacgaacattctgctcgctt

SEQ ID NO: 800427 - DNA, 25 bp, Mus musculus
tgaggaacgaactttctgctcgctt

SEQ ID NO: 800428 - DNA, 25 bp, Mus musculus
tgaggaactaacctatgaggagatc

SEQ ID NO: 800429 - DNA, 25 bp, Mus musculus
tgaggaactaacgtatgaggagatc

SEQ ID NO: 800430 - DNA, 25 bp, Mus musculus
tgaggaactctaagcaggagtgtac

SEQ ID NO: 800431 - DNA, 25 bp, Mus musculus
tgaggaactctatgcaggagtgtac

SEQ ID NO: 800432 - DNA, 25 bp, Mus musculus
tgaggaactgttccacacagcattt

SEQ ID NO: 800433 - DNA, 25 bp, Mus musculus
tgaggaactgttgcacacagcattt

SEQ ID NO: 800434 - DNA, 25 bp, Mus musculus
tgaggaacttggaaagcctgggtga

SEQ ID NO: 800435 - DNA, 25 bp, Mus musculus
tgaggaacttggtaagcctgggtga

SEQ ID NO: 800436 - DNA, 25 bp, Mus musculus
tgaggaagaccaaagcagcactacc

SEQ ID NO: 800437 - DNA, 25 bp, Mus musculus
tgaggaagaccatagcagcactacc

SEQ ID NO: 800438 - DNA, 25 bp, Mus musculus
tgaggaagagacagggcggaaagcc

SEQ ID NO: 800439 - DNA, 25 bp, Mus musculus
tgaggaagagactgggcggaaagcc

SEQ ID NO: 800440 - DNA, 25 bp, Mus musculus
tgaggaagagcgcaccactgcctag

SEQ ID NO: 800441 - DNA, 25 bp, Mus musculus
tgaggaagagcggaccactgcctag

SEQ ID NO: 800442 - DNA, 25 bp, Mus musculus
tgaggaagatggacgagactccgac

SEQ ID NO: 800443 - DNA, 25 bp, Mus musculus
tgaggaagatggtcgagactccgac

SEQ ID NO: 800444 - DNA, 25 bp, Mus musculus
tgaggaagcaagcaaacccgaccaa

SEQ ID NO: 800445 - DNA, 25 bp, Mus musculus
tgaggaagcaaggaaacccgaccaa

SEQ ID NO: 800446 - DNA, 25 bp, Mus musculus
tgaggaagccagaaacagaaccttg

SEQ ID NO: 800447 - DNA, 25 bp, Mus musculus
tgaggaagccagtaacagaaccttg

SEQ ID NO: 800448 - DNA, 25 bp, Mus musculus
tgaggaagcctaaggtaagaagaga

SEQ ID NO: 800449 - DNA, 25 bp, Mus musculus
tgaggaagcctatggtaagaagaga

SEQ ID NO: 800450 - DNA, 25 bp, Mus musculus
tgaggaagcggcatgtagagactcc

SEQ ID NO: 800451 - DNA, 25 bp, Mus musculus
tgaggaagcggcttgtagagactcc

SEQ ID NO: 800452 - DNA, 25 bp, Mus musculus
tgaggaagctatacccaatatcact

SEQ ID NO: 800453 - DNA, 25 bp, Mus musculus
tgaggaagctattcccaatatcact

SEQ ID NO: 800454 - DNA, 25 bp, Mus musculus
tgaggaaggaacatcaggccgaagc

SEQ ID NO: 800455 - DNA, 25 bp, Mus musculus
tgaggaaggaacttcaggccgaagc

SEQ ID NO: 800456 - DNA, 25 bp, Mus musculus
tgaggaaggaggatcgccagttcaa

SEQ ID NO: 800457 - DNA, 25 bp, Mus musculus
tgaggaaggaggttcgccagttcaa

SEQ ID NO: 800458 - DNA, 25 bp, Mus musculus
tgaggaaggcatccagctggttacc

SEQ ID NO: 800459 - DNA, 25 bp, Mus musculus
tgaggaaggcatgcagctggttacc

SEQ ID NO: 800460 - DNA, 25 bp, Mus musculus
tgaggaaggccgctgccctctccaa

SEQ ID NO: 800461 - DNA, 25 bp, Mus musculus
tgaggaaggccggtgccctctccaa

SEQ ID NO: 800462 - DNA, 25 bp, Mus musculus
tgaggaaggcctacgccttacgcta

SEQ ID NO: 800463 - DNA, 25 bp, Mus musculus
tgaggaaggccttcgccttacgcta

SEQ ID NO: 800464 - DNA, 25 bp, Mus musculus
tgaggaagtcgaacggtccttgaaa

SEQ ID NO: 800465 - DNA, 25 bp, Mus musculus
tgaggaagtcgatcggtccttgaaa

SEQ ID NO: 800466 - DNA, 25 bp, Mus musculus
tgaggaatgcccaggcactgatatc

SEQ ID NO: 800467 - DNA, 25 bp, Mus musculus
tgaggaatgccctggcactgatatc

SEQ ID NO: 800468 - DNA, 25 bp, Mus musculus
tgaggaatgtttacccaccaccact

SEQ ID NO: 800469 - DNA, 25 bp, Mus musculus
tgaggaatgttttcccaccaccact

SEQ ID NO: 800470 - DNA, 25 bp, Mus musculus
tgaggaattttcactttcccgcaag

SEQ ID NO: 800471 - DNA, 25 bp, Mus musculus
tgaggaattttctctttcccgcaag

SEQ ID NO: 800472 - DNA, 25 bp, Mus musculus
tgaggaatttttcccagcgtttcaa

SEQ ID NO: 800473 - DNA, 25 bp, Mus musculus
tgaggaatttttgccagcgtttcaa

SEQ ID NO: 800474 - DNA, 25 bp, Mus musculus
tgaggacaaagaacttgccaggagg

SEQ ID NO: 800475 - DNA, 25 bp, Mus musculus
tgaggacaaagatcttgccaggagg

SEQ ID NO: 800476 - DNA, 25 bp, Mus musculus
tgaggacaagccacaggattacaag

SEQ ID NO: 800477 - DNA, 25 bp, Mus musculus
tgaggacaagcctcaggattacaag

SEQ ID NO: 800478 - DNA, 25 bp, Mus musculus
tgaggacaagttctacagccacaaa

SEQ ID NO: 800479 - DNA, 25 bp, Mus musculus
tgaggacaagttgtacagccacaaa

SEQ ID NO: 800480 - DNA, 25 bp, Mus musculus
tgaggacaatgtataccacagctcc

SEQ ID NO: 800481 - DNA, 25 bp, Mus musculus
tgaggacaatgtttaccacagctcc

SEQ ID NO: 800482 - DNA, 25 bp, Mus musculus
tgaggacacactagtagtccaggat

SEQ ID NO: 800483 - DNA, 25 bp, Mus musculus
tgaggacacactcggcccaacgcat

SEQ ID NO: 800484 - DNA, 25 bp, Mus musculus
tgaggacacactgggcccaacgcat

SEQ ID NO: 800485 - DNA, 25 bp, Mus musculus
tgaggacacacttgtagtccaggat

SEQ ID NO: 800486 - DNA, 25 bp, Mus musculus
tgaggacacggactaacaacacctg

SEQ ID NO: 800487 - DNA, 25 bp, Mus musculus
tgaggacacggagtaacaacacctg

SEQ ID NO: 800488 - DNA, 25 bp, Mus musculus
tgaggacactgacgagatccagagc

SEQ ID NO: 800489 - DNA, 25 bp, Mus musculus
tgaggacactgaggagatccagagc

SEQ ID NO: 800490 - DNA, 25 bp, Mus musculus
tgaggacagaaacaagcaagagccc

SEQ ID NO: 800491 - DNA, 25 bp, Mus musculus
tgaggacagaaagaagcaagagccc

SEQ ID NO: 800492 - DNA, 25 bp, Mus musculus
tgaggacagaacacagtcctttcca

SEQ ID NO: 800493 - DNA, 25 bp, Mus musculus
tgaggacagaactcagtcctttcca

SEQ ID NO: 800494 - DNA, 25 bp, Mus musculus
tgaggacagccaacgcctggccctg

SEQ ID NO: 800495 - DNA, 25 bp, Mus musculus
tgaggacagccatcgcctggccctg

SEQ ID NO: 800496 - DNA, 25 bp, Mus musculus
tgaggacaggtcaccaactgagcag

SEQ ID NO: 800497 - DNA, 25 bp, Mus musculus
tgaggacaggtctccaactgagcag

SEQ ID NO: 800498 - DNA, 25 bp, Mus musculus
tgaggacagtaaccaaatggtctac

SEQ ID NO: 800499 - DNA, 25 bp, Mus musculus
tgaggacagtaagcaaatggtctac

SEQ ID NO: 800500 - DNA, 25 bp, Mus musculus
tgaggacatcccactgtttccagtg

SEQ ID NO: 800501 - DNA, 25 bp, Mus musculus
tgaggacatccctctgtttccagtg

SEQ ID NO: 800502 - DNA, 25 bp, Mus musculus
tgaggaccactaagaaaccagcctg

SEQ ID NO: 800503 - DNA, 25 bp, Mus musculus
tgaggaccactatgaaaccagcctg

SEQ ID NO: 800504 - DNA, 25 bp, Mus musculus
tgaggaccatccagccgaagaacaa

SEQ ID NO: 800505 - DNA, 25 bp, Mus musculus
tgaggaccatcctgccgaagaacaa

SEQ ID NO: 800506 - DNA, 25 bp, Mus musculus
tgaggaccatgaccgcatgtatgtg

SEQ ID NO: 800507 - DNA, 25 bp, Mus musculus
tgaggaccatgagcgcatgtatgtg

SEQ ID NO: 800508 - DNA, 25 bp, Mus musculus
tgaggaccattgcttctacattgct

SEQ ID NO: 800509 - DNA, 25 bp, Mus musculus
tgaggaccattggttctacattgct

SEQ ID NO: 800510 - DNA, 25 bp, Mus musculus
tgaggaccccaacaacaacattccg

SEQ ID NO: 800511 - DNA, 25 bp, Mus musculus
tgaggaccccaagaacaacattccg

SEQ ID NO: 800512 - DNA, 25 bp, Mus musculus
tgaggaccccgacactgaggtaaaa

SEQ ID NO: 800513 - DNA, 25 bp, Mus musculus
tgaggaccccgagactgaggtaaaa

SEQ ID NO: 800514 - DNA, 25 bp, Mus musculus
tgaggaccctttcatgtccgaatgc

SEQ ID NO: 800515 - DNA, 25 bp, Mus musculus
tgaggaccctttgatgtccgaatgc

SEQ ID NO: 800516 - DNA, 25 bp, Mus musculus
tgaggaccgcaacacagccttggaa

SEQ ID NO: 800517 - DNA, 25 bp, Mus musculus
tgaggaccgcaagacagccttggaa

SEQ ID NO: 800518 - DNA, 25 bp, Mus musculus
tgaggaccgcttaggatttctgtgg

SEQ ID NO: 800519 - DNA, 25 bp, Mus musculus
tgaggaccgctttggatttctgtgg

SEQ ID NO: 800520 - DNA, 25 bp, Mus musculus
tgaggaccggtacggttacaagcct

SEQ ID NO: 800521 - DNA, 25 bp, Mus musculus
tgaggaccggtagggttacaagcct

SEQ ID NO: 800522 - DNA, 25 bp, Mus musculus
tgaggacctaaacaaggcctaccgc

SEQ ID NO: 800523 - DNA, 25 bp, Mus musculus
tgaggacctaaagaaggcctaccgc

SEQ ID NO: 800524 - DNA, 25 bp, Mus musculus
tgaggacctagcactggaccccgat

SEQ ID NO: 800525 - DNA, 25 bp, Mus musculus
tgaggacctagctctggaccccgat

SEQ ID NO: 800526 - DNA, 25 bp, Mus musculus
tgaggacctcaacaactaccgtgct

SEQ ID NO: 800527 - DNA, 25 bp, Mus musculus
tgaggacctcaacacaaaatatttg

SEQ ID NO: 800528 - DNA, 25 bp, Mus musculus
tgaggacctcaagaactaccgtgct

SEQ ID NO: 800529 - DNA, 25 bp, Mus musculus
tgaggacctcaagacaaaatatttg

SEQ ID NO: 800530 - DNA, 25 bp, Mus musculus
tgaggacctgcacctcgccatggct

SEQ ID NO: 800531 - DNA, 25 bp, Mus musculus
tgaggacctgcagctcgccatggct

SEQ ID NO: 800532 - DNA, 25 bp, Mus musculus
tgaggacctggacaacataggcatg

SEQ ID NO: 800533 - DNA, 25 bp, Mus musculus
tgaggacctggagaacataggcatg

SEQ ID NO: 800534 - DNA, 25 bp, Mus musculus
tgaggacgaagacacagaaacgtac

SEQ ID NO: 800535 - DNA, 25 bp, Mus musculus
tgaggacgaagagacagaaacgtac

SEQ ID NO: 800536 - DNA, 25 bp, Mus musculus
tgaggacgacacagatagctccgaa

SEQ ID NO: 800537 - DNA, 25 bp, Mus musculus
tgaggacgacactgatagctccgaa

SEQ ID NO: 800538 - DNA, 25 bp, Mus musculus
tgaggacgacctcattctttttaag

SEQ ID NO: 800539 - DNA, 25 bp, Mus musculus
tgaggacgacctgattctttttaag

SEQ ID NO: 800540 - DNA, 25 bp, Mus musculus
tgaggacgataaattcactgttcag

SEQ ID NO: 800541 - DNA, 25 bp, Mus musculus
tgaggacgataatttcactgttcag

SEQ ID NO: 800542 - DNA, 25 bp, Mus musculus
tgaggacgatgacctaaagccttat

SEQ ID NO: 800543 - DNA, 25 bp, Mus musculus
tgaggacgatgagctaaagccttat

SEQ ID NO: 800544 - DNA, 25 bp, Mus musculus
tgaggacgcatgcaccgtggtctcc

SEQ ID NO: 800545 - DNA, 25 bp, Mus musculus
tgaggacgcatggaccgtggtctcc

SEQ ID NO: 800546 - DNA, 25 bp, Mus musculus
tgaggacgtcccaattgcacacatt

SEQ ID NO: 800547 - DNA, 25 bp, Mus musculus
tgaggacgtcccaggccttagatga

SEQ ID NO: 800548 - DNA, 25 bp, Mus musculus
tgaggacgtccctattgcacacatt

SEQ ID NO: 800549 - DNA, 25 bp, Mus musculus
tgaggacgtccctggccttagatga

SEQ ID NO: 800550 - DNA, 25 bp, Mus musculus
tgaggacgtctgaagccatcccggt

SEQ ID NO: 800551 - DNA, 25 bp, Mus musculus
tgaggacgtctgtagccatcccggt

SEQ ID NO: 800552 - DNA, 25 bp, Mus musculus
tgaggacgtttcaatcattccaccc

SEQ ID NO: 800553 - DNA, 25 bp, Mus musculus
tgaggacgtttctatcattccaccc

SEQ ID NO: 800554 - DNA, 25 bp, Mus musculus
tgaggactaacaaggtatcctctgg

SEQ ID NO: 800555 - DNA, 25 bp, Mus musculus
tgaggactaacatggtatcctctgg

SEQ ID NO: 800556 - DNA, 25 bp, Mus musculus
tgaggactaaccagttctccgtgac

SEQ ID NO: 800557 - DNA, 25 bp, Mus musculus
tgaggactaacctgttctccgtgac

SEQ ID NO: 800558 - DNA, 25 bp, Mus musculus
tgaggactacatatgtcaagggaat

SEQ ID NO: 800559 - DNA, 25 bp, Mus musculus
tgaggactacatcgacttcctgcag

SEQ ID NO: 800560 - DNA, 25 bp, Mus musculus
tgaggactacatggacttcctgcag

SEQ ID NO: 800561 - DNA, 25 bp, Mus musculus
tgaggactacatttgtcaagggaat

SEQ ID NO: 800562 - DNA, 25 bp, Mus musculus
tgaggactacgacagtcaccggctg

SEQ ID NO: 800563 - DNA, 25 bp, Mus musculus
tgaggactacgagagtcaccggctg

SEQ ID NO: 800564 - DNA, 25 bp, Mus musculus
tgaggactcagactactttcctgga

SEQ ID NO: 800565 - DNA, 25 bp, Mus musculus
tgaggactcagagtactttcctgga

SEQ ID NO: 800566 - DNA, 25 bp, Mus musculus
tgaggactcctgattgaaaagccac

SEQ ID NO: 800567 - DNA, 25 bp, Mus musculus
tgaggactcctgtttgaaaagccac

SEQ ID NO: 800568 - DNA, 25 bp, Mus musculus
tgaggactgccaaatccctggagat

SEQ ID NO: 800569 - DNA, 25 bp, Mus musculus
tgaggactgccactttcaggagctg

SEQ ID NO: 800570 - DNA, 25 bp, Mus musculus
tgaggactgccagtttcaggagctg

SEQ ID NO: 800571 - DNA, 25 bp, Mus musculus
tgaggactgccatatccctggagat

SEQ ID NO: 800572 - DNA, 25 bp, Mus musculus
tgaggactgtccaagaccctgttac

SEQ ID NO: 800573 - DNA, 25 bp, Mus musculus
tgaggactgtcctagaccctgttac

SEQ ID NO: 800574 - DNA, 25 bp, Mus musculus
tgaggactttttaacaccccagcag

SEQ ID NO: 800575 - DNA, 25 bp, Mus musculus
tgaggacttttttacaccccagcag

SEQ ID NO: 800576 - DNA, 25 bp, Mus musculus
tgaggagaacatacaagacagtgag

SEQ ID NO: 800577 - DNA, 25 bp, Mus musculus
tgaggagaacattcaagacagtgag

SEQ ID NO: 800578 - DNA, 25 bp, Mus musculus
tgaggagaagatcaagaagtcccca

SEQ ID NO: 800579 - DNA, 25 bp, Mus musculus
tgaggagaagatgaagaagtcccca

SEQ ID NO: 800580 - DNA, 25 bp, Mus musculus
tgaggagaagctccgttccctaacc

SEQ ID NO: 800581 - DNA, 25 bp, Mus musculus
tgaggagaagctgcgttccctaacc

SEQ ID NO: 800582 - DNA, 25 bp, Mus musculus
tgaggagaatgcaattgctctgctc

SEQ ID NO: 800583 - DNA, 25 bp, Mus musculus
tgaggagaatgctattgctctgctc

SEQ ID NO: 800584 - DNA, 25 bp, Mus musculus
tgaggagacaaacccgtcacatccg

SEQ ID NO: 800585 - DNA, 25 bp, Mus musculus
tgaggagacaaagccgtcacatccg

SEQ ID NO: 800586 - DNA, 25 bp, Mus musculus
tgaggagacaatcgtcaccaagaat

SEQ ID NO: 800587 - DNA, 25 bp, Mus musculus
tgaggagacaatggtcaccaagaat

SEQ ID NO: 800588 - DNA, 25 bp, Mus musculus
tgaggagaccataaagcttctgaaa

SEQ ID NO: 800589 - DNA, 25 bp, Mus musculus
tgaggagaccattaagcttctgaaa

SEQ ID NO: 800590 - DNA, 25 bp, Mus musculus
tgaggagacccaaaactctttgcag

SEQ ID NO: 800591 - DNA, 25 bp, Mus musculus
tgaggagacccacgccatcatcgat

SEQ ID NO: 800592 - DNA, 25 bp, Mus musculus
tgaggagacccaggccatcatcgat

SEQ ID NO: 800593 - DNA, 25 bp, Mus musculus
tgaggagacccataactctttgcag

SEQ ID NO: 800594 - DNA, 25 bp, Mus musculus
tgaggagacctcacgtgaagccgag

SEQ ID NO: 800595 - DNA, 25 bp, Mus musculus
tgaggagacctctcgtgaagccgag

SEQ ID NO: 800596 - DNA, 25 bp, Mus musculus
tgaggagactgacatcatccccacg

SEQ ID NO: 800597 - DNA, 25 bp, Mus musculus
tgaggagactgagatcatccccacg

SEQ ID NO: 800598 - DNA, 25 bp, Mus musculus
tgaggagagcccatctgcggctgcc

SEQ ID NO: 800599 - DNA, 25 bp, Mus musculus
tgaggagagcccttctgcggctgcc

SEQ ID NO: 800600 - DNA, 25 bp, Mus musculus
tgaggagagttaattgaccaccaag

SEQ ID NO: 800601 - DNA, 25 bp, Mus musculus
tgaggagagttatttgaccaccaag

SEQ ID NO: 800602 - DNA, 25 bp, Mus musculus
tgaggagatctaagcagcgttcccc

SEQ ID NO: 800603 - DNA, 25 bp, Mus musculus
tgaggagatctatgcagcgttcccc

SEQ ID NO: 800604 - DNA, 25 bp, Mus musculus
tgaggagcaatcagtttgtggatct

SEQ ID NO: 800605 - DNA, 25 bp, Mus musculus
tgaggagcaatctgtttgtggatct

SEQ ID NO: 800606 - DNA, 25 bp, Mus musculus
tgaggagcagaaagtagttcaagtg

SEQ ID NO: 800607 - DNA, 25 bp, Mus musculus
tgaggagcagaatgtagttcaagtg

SEQ ID NO: 800608 - DNA, 25 bp, Mus musculus
tgaggagcagcactacctggacaag

SEQ ID NO: 800609 - DNA, 25 bp, Mus musculus
tgaggagcagcagtacctggacaag

SEQ ID NO: 800610 - DNA, 25 bp, Mus musculus
tgaggagcataacgctctgggcact

SEQ ID NO: 800611 - DNA, 25 bp, Mus musculus
tgaggagcataaggctctgggcact

SEQ ID NO: 800612 - DNA, 25 bp, Mus musculus
tgaggagcatcgacaggtctgcaga

SEQ ID NO: 800613 - DNA, 25 bp, Mus musculus
tgaggagcatcgtcaggtctgcaga

SEQ ID NO: 800614 - DNA, 25 bp, Mus musculus
tgaggagcatctacgagcagccgca

SEQ ID NO: 800615 - DNA, 25 bp, Mus musculus
tgaggagcatcttcgagcagccgca

SEQ ID NO: 800616 - DNA, 25 bp, Mus musculus
tgaggagcccgtccgccagaagatt

SEQ ID NO: 800617 - DNA, 25 bp, Mus musculus
tgaggagcccgtgcgccagaagatt

SEQ ID NO: 800618 - DNA, 25 bp, Mus musculus
tgaggagccctacatggacatagac

SEQ ID NO: 800619 - DNA, 25 bp, Mus musculus
tgaggagccctagatggacatagac

SEQ ID NO: 800620 - DNA, 25 bp, Mus musculus
tgaggagccctcaggagtgtcaaca

SEQ ID NO: 800621 - DNA, 25 bp, Mus musculus
tgaggagccctcaggtgtcaccagt

SEQ ID NO: 800622 - DNA, 25 bp, Mus musculus
tgaggagccctctggagtgtcaaca

SEQ ID NO: 800623 - DNA, 25 bp, Mus musculus
tgaggagccctctggtgtcaccagt

SEQ ID NO: 800624 - DNA, 25 bp, Mus musculus
tgaggagccttaactgctgattggt

SEQ ID NO: 800625 - DNA, 25 bp, Mus musculus
tgaggagccttatctgctgattggt

SEQ ID NO: 800626 - DNA, 25 bp, Mus musculus
tgaggagctcttccagttgtttagc

SEQ ID NO: 800627 - DNA, 25 bp, Mus musculus
tgaggagctcttcctaaccgcagag

SEQ ID NO: 800628 - DNA, 25 bp, Mus musculus
tgaggagctcttgcagttgtttagc

SEQ ID NO: 800629 - DNA, 25 bp, Mus musculus
tgaggagctcttgctaaccgcagag

SEQ ID NO: 800630 - DNA, 25 bp, Mus musculus
tgaggagctgctcaaccgtacctcg

SEQ ID NO: 800631 - DNA, 25 bp, Mus musculus
tgaggagctgctgaaccgtacctcg

SEQ ID NO: 800632 - DNA, 25 bp, Mus musculus
tgaggaggaaatcgaccgcaacaag

SEQ ID NO: 800633 - DNA, 25 bp, Mus musculus
tgaggaggaaatggaccgcaacaag

SEQ ID NO: 800634 - DNA, 25 bp, Mus musculus
tgaggaggaataatggaacagctcc

SEQ ID NO: 800635 - DNA, 25 bp, Mus musculus
tgaggaggaatattggaacagctcc

SEQ ID NO: 800636 - DNA, 25 bp, Mus musculus
tgaggaggaattactgcgcacctat

SEQ ID NO: 800637 - DNA, 25 bp, Mus musculus
tgaggaggaatttctgcgcacctat

SEQ ID NO: 800638 - DNA, 25 bp, Mus musculus
tgaggaggaccaaaacagagatctt

SEQ ID NO: 800639 - DNA, 25 bp, Mus musculus
tgaggaggaccataacagagatctt

SEQ ID NO: 800640 - DNA, 25 bp, Mus musculus
tgaggaggacctctctaaactcttc

SEQ ID NO: 800641 - DNA, 25 bp, Mus musculus
tgaggaggacctgtctaaactcttc

SEQ ID NO: 800642 - DNA, 25 bp, Mus musculus
tgaggaggacgccatggcttcctcc

SEQ ID NO: 800643 - DNA, 25 bp, Mus musculus
tgaggaggacgcgatggcttcctcc

SEQ ID NO: 800644 - DNA, 25 bp, Mus musculus
tgaggaggacttcctgatggccacc

SEQ ID NO: 800645 - DNA, 25 bp, Mus musculus
tgaggaggacttgctgatggccacc

SEQ ID NO: 800646 - DNA, 25 bp, Mus musculus
tgaggaggagtcagaatccctggat

SEQ ID NO: 800647 - DNA, 25 bp, Mus musculus
tgaggaggagtctgaatccctggat

SEQ ID NO: 800648 - DNA, 25 bp, Mus musculus
tgaggaggcccacacccaaattggg

SEQ ID NO: 800649 - DNA, 25 bp, Mus musculus
tgaggaggcccagacccaaattggg

SEQ ID NO: 800650 - DNA, 25 bp, Mus musculus
tgaggaggcctgctgttctcgcctc

SEQ ID NO: 800651 - DNA, 25 bp, Mus musculus
tgaggaggcctggtgttctcgcctc

SEQ ID NO: 800652 - DNA, 25 bp, Mus musculus
tgaggaggctccatagaaagccaga

SEQ ID NO: 800653 - DNA, 25 bp, Mus musculus
tgaggaggctccttagaaagccaga

SEQ ID NO: 800654 - DNA, 25 bp, Mus musculus
tgaggaggcttcaggttcagacacc

SEQ ID NO: 800655 - DNA, 25 bp, Mus musculus
tgaggaggcttctggttcagacacc

SEQ ID NO: 800656 - DNA, 25 bp, Mus musculus
tgaggaggtatcaggtaccaacgac

SEQ ID NO: 800657 - DNA, 25 bp, Mus musculus
tgaggaggtatctggtaccaacgac

SEQ ID NO: 800658 - DNA, 25 bp, Mus musculus
tgaggaggtcatctggaattatgct

SEQ ID NO: 800659 - DNA, 25 bp, Mus musculus
tgaggaggtcatgtggaattatgct

SEQ ID NO: 800660 - DNA, 25 bp, Mus musculus
tgaggaggtcctcaactccacagca

SEQ ID NO: 800661 - DNA, 25 bp, Mus musculus
tgaggaggtcctgaactccacagca

SEQ ID NO: 800662 - DNA, 25 bp, Mus musculus
tgaggagtaactaccataactagtc

SEQ ID NO: 800663 - DNA, 25 bp, Mus musculus
tgaggagtaacttccataactagtc

SEQ ID NO: 800664 - DNA, 25 bp, Mus musculus
tgaggagtataacagcaagggcatc

SEQ ID NO: 800665 - DNA, 25 bp, Mus musculus
tgaggagtataagagcaagggcatc

SEQ ID NO: 800666 - DNA, 25 bp, Mus musculus
tgaggagtctagaggtgagggcagc

SEQ ID NO: 800667 - DNA, 25 bp, Mus musculus
tgaggagtctagtggtgagggcagc

SEQ ID NO: 800668 - DNA, 25 bp, Mus musculus
tgaggagtgaccatcctgccatcct

SEQ ID NO: 800669 - DNA, 25 bp, Mus musculus
tgaggagtgaccttcctgccatcct

SEQ ID NO: 800670 - DNA, 25 bp, Mus musculus
tgaggagtgcatactgtcaggcaag

SEQ ID NO: 800671 - DNA, 25 bp, Mus musculus
tgaggagtgcattctgtcaggcaag

SEQ ID NO: 800672 - DNA, 25 bp, Mus musculus
tgaggagtgtctctttgatggctac

SEQ ID NO: 800673 - DNA, 25 bp, Mus musculus
tgaggagtgtctgtttgatggctac

SEQ ID NO: 800674 - DNA, 25 bp, Mus musculus
tgaggagtgtggaacacccatcggc

SEQ ID NO: 800675 - DNA, 25 bp, Mus musculus
tgaggagtgtggtacacccatcggc

SEQ ID NO: 800676 - DNA, 25 bp, Mus musculus
tgaggagtgttcactgcaaagggct

SEQ ID NO: 800677 - DNA, 25 bp, Mus musculus
tgaggagtgttctctgcaaagggct

SEQ ID NO: 800678 - DNA, 25 bp, Mus musculus
tgaggagttacaatcagcccaacag

SEQ ID NO: 800679 - DNA, 25 bp, Mus musculus
tgaggagttacattcagcccaacag

SEQ ID NO: 800680 - DNA, 25 bp, Mus musculus
tgaggagttctcagaagacaatgat

SEQ ID NO: 800681 - DNA, 25 bp, Mus musculus
tgaggagttctctgaagacaatgat

SEQ ID NO: 800682 - DNA, 25 bp, Mus musculus
tgaggagttggtacgctgcattcga

SEQ ID NO: 800683 - DNA, 25 bp, Mus musculus
tgaggagttggttcgctgcattcga

SEQ ID NO: 800684 - DNA, 25 bp, Mus musculus
tgaggatacagaaggttttctttcc

SEQ ID NO: 800685 - DNA, 25 bp, Mus musculus
tgaggatacagatggttttctttcc

SEQ ID NO: 800686 - DNA, 25 bp, Mus musculus
tgaggatatcaacccgccactaggc

SEQ ID NO: 800687 - DNA, 25 bp, Mus musculus
tgaggatatcaagccgccactaggc

SEQ ID NO: 800688 - DNA, 25 bp, Mus musculus
tgaggatccaagactgccttacggc

SEQ ID NO: 800689 - DNA, 25 bp, Mus musculus
tgaggatccaagtctgccttacggc

SEQ ID NO: 800690 - DNA, 25 bp, Mus musculus
tgaggatcctgcacaacaatgcagc

SEQ ID NO: 800691 - DNA, 25 bp, Mus musculus
tgaggatcctgctcaacaatgcagc

SEQ ID NO: 800692 - DNA, 25 bp, Mus musculus
tgaggatcggatccaacgatttgcc

SEQ ID NO: 800693 - DNA, 25 bp, Mus musculus
tgaggatcggatgcaacgatttgcc

SEQ ID NO: 800694 - DNA, 25 bp, Mus musculus
tgaggatctgctactactgctaaaa

SEQ ID NO: 800695 - DNA, 25 bp, Mus musculus
tgaggatctgcttctactgctaaaa

SEQ ID NO: 800696 - DNA, 25 bp, Mus musculus
tgaggatgaaagacccaagtgggac

SEQ ID NO: 800697 - DNA, 25 bp, Mus musculus
tgaggatgaaagtcccaagtgggac

SEQ ID NO: 800698 - DNA, 25 bp, Mus musculus
tgaggatgaaatcgagcctcgactt

SEQ ID NO: 800699 - DNA, 25 bp, Mus musculus
tgaggatgaaatggagcctcgactt

SEQ ID NO: 800700 - DNA, 25 bp, Mus musculus
tgaggatgaacaccggcctagaaca

SEQ ID NO: 800701 - DNA, 25 bp, Mus musculus
tgaggatgaacagcggcctagaaca

SEQ ID NO: 800702 - DNA, 25 bp, Mus musculus
tgaggatgaagcaaccagcagtggc

SEQ ID NO: 800703 - DNA, 25 bp, Mus musculus
tgaggatgaagctaccagcagtggc

SEQ ID NO: 800704 - DNA, 25 bp, Mus musculus
tgaggatgagaacctcagctttgag

SEQ ID NO: 800705 - DNA, 25 bp, Mus musculus
tgaggatgagaagctcagctttgag

SEQ ID NO: 800706 - DNA, 25 bp, Mus musculus
tgaggatgagatagaagagctcagc

SEQ ID NO: 800707 - DNA, 25 bp, Mus musculus
tgaggatgagattgaagagctcagc

SEQ ID NO: 800708 - DNA, 25 bp, Mus musculus
tgaggatgcaggacattgctcaccc

SEQ ID NO: 800709 - DNA, 25 bp, Mus musculus
tgaggatgcaggtcattgctcaccc

SEQ ID NO: 800710 - DNA, 25 bp, Mus musculus
tgaggatgccacaacacagctgaag

SEQ ID NO: 800711 - DNA, 25 bp, Mus musculus
tgaggatgccactacacagctgaag

SEQ ID NO: 800712 - DNA, 25 bp, Mus musculus
tgaggatgccatacgcaacctgcac

SEQ ID NO: 800713 - DNA, 25 bp, Mus musculus
tgaggatgccattcgcaacctgcac

SEQ ID NO: 800714 - DNA, 25 bp, Mus musculus
tgaggatgcgtccttaatgccagga

SEQ ID NO: 800715 - DNA, 25 bp, Mus musculus
tgaggatgcgtcgttaatgccagga

SEQ ID NO: 800716 - DNA, 25 bp, Mus musculus
tgaggatggacacttctcacactac

SEQ ID NO: 800717 - DNA, 25 bp, Mus musculus
tgaggatggacagttctcacactac

SEQ ID NO: 800718 - DNA, 25 bp, Mus musculus
tgaggatggagaagcatatgccctg

SEQ ID NO: 800719 - DNA, 25 bp, Mus musculus
tgaggatggagacctactatggcgg

SEQ ID NO: 800720 - DNA, 25 bp, Mus musculus
tgaggatggagagctactatggcgg

SEQ ID NO: 800721 - DNA, 25 bp, Mus musculus
tgaggatggagatgcatatgccctg

SEQ ID NO: 800722 - DNA, 25 bp, Mus musculus
tgaggatggcctaccaatggacacc

SEQ ID NO: 800723 - DNA, 25 bp, Mus musculus
tgaggatggccttccaatggacacc

SEQ ID NO: 800724 - DNA, 25 bp, Mus musculus
tgaggattaccactctggaagtgga

SEQ ID NO: 800725 - DNA, 25 bp, Mus musculus
tgaggattaccagtctggaagtgga

SEQ ID NO: 800726 - DNA, 25 bp, Mus musculus
tgaggattactgaccgcctctttag

SEQ ID NO: 800727 - DNA, 25 bp, Mus musculus
tgaggattactgtccgcctctttag

SEQ ID NO: 800728 - DNA, 25 bp, Mus musculus
tgaggattatgaccaggctgcagcc

SEQ ID NO: 800729 - DNA, 25 bp, Mus musculus
tgaggattatgagcaggctgcagcc

SEQ ID NO: 800730 - DNA, 25 bp, Mus musculus
tgaggattctacactgcctggcacc

SEQ ID NO: 800731 - DNA, 25 bp, Mus musculus
tgaggattctactctgcctggcacc

SEQ ID NO: 800732 - DNA, 25 bp, Mus musculus
tgaggattggccagtgaacactgag

SEQ ID NO: 800733 - DNA, 25 bp, Mus musculus
tgaggattggcctgtgaacactgag

SEQ ID NO: 800734 - DNA, 25 bp, Mus musculus
tgaggatttcaacatctatggccat

SEQ ID NO: 800735 - DNA, 25 bp, Mus musculus
tgaggatttcaagatctatggccat

SEQ ID NO: 800736 - DNA, 25 bp, Mus musculus
tgaggatttcagcagaaaccgggct

SEQ ID NO: 800737 - DNA, 25 bp, Mus musculus
tgaggatttcaggagaaaccgggct

SEQ ID NO: 800738 - DNA, 25 bp, Mus musculus
tgaggcaaaaatcggaccagaagtc

SEQ ID NO: 800739 - DNA, 25 bp, Mus musculus
tgaggcaaaaatgggaccagaagtc

SEQ ID NO: 800740 - DNA, 25 bp, Mus musculus
tgaggcaaaggtccgaggcatcatt

SEQ ID NO: 800741 - DNA, 25 bp, Mus musculus
tgaggcaaaggtgcgaggcatcatt

SEQ ID NO: 800742 - DNA, 25 bp, Mus musculus
tgaggcaagcatctatacccaggtc

SEQ ID NO: 800743 - DNA, 25 bp, Mus musculus
tgaggcaagcatgtatacccaggtc

SEQ ID NO: 800744 - DNA, 25 bp, Mus musculus
tgaggcacaagtcagaaacggacac

SEQ ID NO: 800745 - DNA, 25 bp, Mus musculus
tgaggcacaagtgagaaacggacac

SEQ ID NO: 800746 - DNA, 25 bp, Mus musculus
tgaggcacacaaagcagactatgag

SEQ ID NO: 800747 - DNA, 25 bp, Mus musculus
tgaggcacacaatgcagactatgag

SEQ ID NO: 800748 - DNA, 25 bp, Mus musculus
tgaggcacaccgagaacaagatcac

SEQ ID NO: 800749 - DNA, 25 bp, Mus musculus
tgaggcacaccgtgaacaagatcac

SEQ ID NO: 800750 - DNA, 25 bp, Mus musculus
tgaggcacatccaccagtgggaagg

SEQ ID NO: 800751 - DNA, 25 bp, Mus musculus
tgaggcacatcctccagtgggaagg

SEQ ID NO: 800752 - DNA, 25 bp, Mus musculus
tgaggcacctacagaggcactacaa

SEQ ID NO: 800753 - DNA, 25 bp, Mus musculus
tgaggcacctactgaggcactacaa

SEQ ID NO: 800754 - DNA, 25 bp, Mus musculus
tgaggcaccttcatgaaggaggccc

SEQ ID NO: 800755 - DNA, 25 bp, Mus musculus
tgaggcaccttcttgaaggaggccc

SEQ ID NO: 800756 - DNA, 25 bp, Mus musculus
tgaggcacggatcagtacagccgcc

SEQ ID NO: 800757 - DNA, 25 bp, Mus musculus
tgaggcacggatgagtacagccgcc

SEQ ID NO: 800758 - DNA, 25 bp, Mus musculus
tgaggcacgtgcacaggcaccaagt

SEQ ID NO: 800759 - DNA, 25 bp, Mus musculus
tgaggcacgtgctcaggcaccaagt

SEQ ID NO: 800760 - DNA, 25 bp, Mus musculus
tgaggcactagacctccaggcacaa

SEQ ID NO: 800761 - DNA, 25 bp, Mus musculus
tgaggcactagagctccaggcacaa

SEQ ID NO: 800762 - DNA, 25 bp, Mus musculus
tgaggcagagaacaaaattaggaag

SEQ ID NO: 800763 - DNA, 25 bp, Mus musculus
tgaggcagagaagaaaattaggaag

SEQ ID NO: 800764 - DNA, 25 bp, Mus musculus
tgaggcagagcgactccaagagaac

SEQ ID NO: 800765 - DNA, 25 bp, Mus musculus
tgaggcagagcgtctccaagagaac

SEQ ID NO: 800766 - DNA, 25 bp, Mus musculus
tgaggcagatgtatgtccagagagt

SEQ ID NO: 800767 - DNA, 25 bp, Mus musculus
tgaggcagatgtttgtccagagagt

SEQ ID NO: 800768 - DNA, 25 bp, Mus musculus
tgaggcagcggcaaaagagtcacac

SEQ ID NO: 800769 - DNA, 25 bp, Mus musculus
tgaggcagcggctaaagagtcacac

SEQ ID NO: 800770 - DNA, 25 bp, Mus musculus
tgaggcagctcacgcttcctctatg

SEQ ID NO: 800771 - DNA, 25 bp, Mus musculus
tgaggcagctcaggcttcctctatg

SEQ ID NO: 800772 - DNA, 25 bp, Mus musculus
tgaggcagctcccacgcggtactct

SEQ ID NO: 800773 - DNA, 25 bp, Mus musculus
tgaggcagctccgacgcggtactct

SEQ ID NO: 800774 - DNA, 25 bp, Mus musculus
tgaggcagctgacctctgccaggct

SEQ ID NO: 800775 - DNA, 25 bp, Mus musculus
tgaggcagctgagctctgccaggct

SEQ ID NO: 800776 - DNA, 25 bp, Mus musculus
tgaggcaggaatcgccccgagacct

SEQ ID NO: 800777 - DNA, 25 bp, Mus musculus
tgaggcaggaatggccccgagacct

SEQ ID NO: 800778 - DNA, 25 bp, Mus musculus
tgaggcaggcagctccttccctact

SEQ ID NO: 800779 - DNA, 25 bp, Mus musculus
tgaggcaggcaggtccttccctact

SEQ ID NO: 800780 - DNA, 25 bp, Mus musculus
tgaggcaggcgcacacggctagctt

SEQ ID NO: 800781 - DNA, 25 bp, Mus musculus
tgaggcaggcgctcacggctagctt

SEQ ID NO: 800782 - DNA, 25 bp, Mus musculus
tgaggcagtttgacctggcctggca

SEQ ID NO: 800783 - DNA, 25 bp, Mus musculus
tgaggcagtttgcacagcaagactg

SEQ ID NO: 800784 - DNA, 25 bp, Mus musculus
tgaggcagtttggacagcaagactg

SEQ ID NO: 800785 - DNA, 25 bp, Mus musculus
tgaggcagtttgtcctggcctggca

SEQ ID NO: 800786 - DNA, 25 bp, Mus musculus
tgaggcataccccaagaagaggctg

SEQ ID NO: 800787 - DNA, 25 bp, Mus musculus
tgaggcatacccgaagaagaggctg

SEQ ID NO: 800788 - DNA, 25 bp, Mus musculus
tgaggcatcattagatgccctgctg

SEQ ID NO: 800789 - DNA, 25 bp, Mus musculus
tgaggcatcatttgatgccctgctg

SEQ ID NO: 800790 - DNA, 25 bp, Mus musculus
tgaggcatccctaccgtcttcggaa

SEQ ID NO: 800791 - DNA, 25 bp, Mus musculus
tgaggcatcccttccgtcttcggaa

SEQ ID NO: 800792 - DNA, 25 bp, Mus musculus
tgaggccaaagtcttccaggactat

SEQ ID NO: 800793 - DNA, 25 bp, Mus musculus
tgaggccaaagtgttccaggactat

SEQ ID NO: 800794 - DNA, 25 bp, Mus musculus
tgaggccaagctccagtactacagc

SEQ ID NO: 800795 - DNA, 25 bp, Mus musculus
tgaggccaagctgcagtactacagc

SEQ ID NO: 800796 - DNA, 25 bp, Mus musculus
tgaggccactgaccgcttcaggagc

SEQ ID NO: 800797 - DNA, 25 bp, Mus musculus
tgaggccactgagcgcttcaggagc

SEQ ID NO: 800798 - DNA, 25 bp, Mus musculus
tgaggccagaaacgaagcagctatg

SEQ ID NO: 800799 - DNA, 25 bp, Mus musculus
tgaggccagaaaggaagcagctatg

SEQ ID NO: 800800 - DNA, 25 bp, Mus musculus
tgaggccagtatacacgggacgaaa

SEQ ID NO: 800801 - DNA, 25 bp, Mus musculus
tgaggccagtattcacgggacgaaa

SEQ ID NO: 800802 - DNA, 25 bp, Mus musculus
tgaggccagtggagatcatgcactg

SEQ ID NO: 800803 - DNA, 25 bp, Mus musculus
tgaggccagtggtgatcatgcactg

SEQ ID NO: 800804 - DNA, 25 bp, Mus musculus
tgaggccatcatacttcgcgctaag

SEQ ID NO: 800805 - DNA, 25 bp, Mus musculus
tgaggccatcattcttcgcgctaag

SEQ ID NO: 800806 - DNA, 25 bp, Mus musculus
tgaggcccacaaccgggaatggaat

SEQ ID NO: 800807 - DNA, 25 bp, Mus musculus
tgaggcccacaagcgggaatggaat

SEQ ID NO: 800808 - DNA, 25 bp, Mus musculus
tgaggcccacgacaacagctttgtt

SEQ ID NO: 800809 - DNA, 25 bp, Mus musculus
tgaggcccacgagaacagctttgtt

SEQ ID NO: 800810 - DNA, 25 bp, Mus musculus
tgaggcccagaccaaggagaccctg

SEQ ID NO: 800811 - DNA, 25 bp, Mus musculus
tgaggcccagacgaaggagaccctg

SEQ ID NO: 800812 - DNA, 25 bp, Mus musculus
tgaggcccagcccacaagggtagcc

SEQ ID NO: 800813 - DNA, 25 bp, Mus musculus
tgaggcccagccgacaagggtagcc

SEQ ID NO: 800814 - DNA, 25 bp, Mus musculus
tgaggcccaggcatgcatcctttcc

SEQ ID NO: 800815 - DNA, 25 bp, Mus musculus
tgaggcccaggcttgcatcctttcc

SEQ ID NO: 800816 - DNA, 25 bp, Mus musculus
tgaggcccatgcagaacttcgcctt

SEQ ID NO: 800817 - DNA, 25 bp, Mus musculus
tgaggcccatgctgaacttcgcctt

SEQ ID NO: 800818 - DNA, 25 bp, Mus musculus
tgaggccccaaaaccgtgtgctgag

SEQ ID NO: 800819 - DNA, 25 bp, Mus musculus
tgaggccccaaatccgtgtgctgag

SEQ ID NO: 800820 - DNA, 25 bp, Mus musculus
tgaggccccagaaagggagcgtctc

SEQ ID NO: 800821 - DNA, 25 bp, Mus musculus
tgaggccccagatagggagcgtctc

SEQ ID NO: 800822 - DNA, 25 bp, Mus musculus
tgaggccccgttagcagggaaacct

SEQ ID NO: 800823 - DNA, 25 bp, Mus musculus
tgaggccccgtttgcagggaaacct

SEQ ID NO: 800824 - DNA, 25 bp, Mus musculus
tgaggcccgacaaggctttgagact

SEQ ID NO: 800825 - DNA, 25 bp, Mus musculus
tgaggcccgacatggctttgagact

SEQ ID NO: 800826 - DNA, 25 bp, Mus musculus
tgaggcccgcagcaggatcgacctc

SEQ ID NO: 800827 - DNA, 25 bp, Mus musculus
tgaggcccgcaggaggatcgacctc

SEQ ID NO: 800828 - DNA, 25 bp, Mus musculus
tgaggcccgcgaatttcttcgaaaa

SEQ ID NO: 800829 - DNA, 25 bp, Mus musculus
tgaggcccgcgattttcttcgaaaa

SEQ ID NO: 800830 - DNA, 25 bp, Mus musculus
tgaggcccggccatttgaggtgctc

SEQ ID NO: 800831 - DNA, 25 bp, Mus musculus
tgaggcccggccttttgaggtgctc

SEQ ID NO: 800832 - DNA, 25 bp, Mus musculus
tgaggcccgggaagaattgaccaga

SEQ ID NO: 800833 - DNA, 25 bp, Mus musculus
tgaggcccgggatgaattgaccaga

SEQ ID NO: 800834 - DNA, 25 bp, Mus musculus
tgaggccctgagcaattaaggcact

SEQ ID NO: 800835 - DNA, 25 bp, Mus musculus
tgaggccctgaggaattaaggcact

SEQ ID NO: 800836 - DNA, 25 bp, Mus musculus
tgaggccctttaccaactacaactc

SEQ ID NO: 800837 - DNA, 25 bp, Mus musculus
tgaggccctttagcaactacaactc

SEQ ID NO: 800838 - DNA, 25 bp, Mus musculus
tgaggccgggatatgctcccgaccc

SEQ ID NO: 800839 - DNA, 25 bp, Mus musculus
tgaggccgggatttgctcccgaccc

SEQ ID NO: 800840 - DNA, 25 bp, Mus musculus
tgaggccgtccgaaacatccataag

SEQ ID NO: 800841 - DNA, 25 bp, Mus musculus
tgaggccgtccgtaacatccataag

SEQ ID NO: 800842 - DNA, 25 bp, Mus musculus
tgaggccgtgatactgtgactctgc

SEQ ID NO: 800843 - DNA, 25 bp, Mus musculus
tgaggccgtgattctgtgactctgc

SEQ ID NO: 800844 - DNA, 25 bp, Mus musculus
tgaggcctagctacctcctctgagc

SEQ ID NO: 800845 - DNA, 25 bp, Mus musculus
tgaggcctagcttcctcctctgagc

SEQ ID NO: 800846 - DNA, 25 bp, Mus musculus
tgaggcctcactacctgagcgtctg

SEQ ID NO: 800847 - DNA, 25 bp, Mus musculus
tgaggcctcacttcctgagcgtctg

SEQ ID NO: 800848 - DNA, 25 bp, Mus musculus
tgaggcctcaggactttgagaatac

SEQ ID NO: 800849 - DNA, 25 bp, Mus musculus
tgaggcctcaggtctttgagaatac

SEQ ID NO: 800850 - DNA, 25 bp, Mus musculus
tgaggcctgaggcattctctcccga

SEQ ID NO: 800851 - DNA, 25 bp, Mus musculus
tgaggcctgagggattctctcccga

SEQ ID NO: 800852 - DNA, 25 bp, Mus musculus
tgaggcctgcggattccagagaagt

SEQ ID NO: 800853 - DNA, 25 bp, Mus musculus
tgaggcctgcggtttccagagaagt

SEQ ID NO: 800854 - DNA, 25 bp, Mus musculus
tgaggcctgggtaccccaaacttat

SEQ ID NO: 800855 - DNA, 25 bp, Mus musculus
tgaggcctgggttccccaaacttat

SEQ ID NO: 800856 - DNA, 25 bp, Mus musculus
tgaggccttcccagccatctgagag

SEQ ID NO: 800857 - DNA, 25 bp, Mus musculus
tgaggccttccctgccatctgagag

SEQ ID NO: 800858 - DNA, 25 bp, Mus musculus
tgaggccttgaaccaagtgacccag

SEQ ID NO: 800859 - DNA, 25 bp, Mus musculus
tgaggccttgaagcaagtgacccag

SEQ ID NO: 800860 - DNA, 25 bp, Mus musculus
tgaggcctttagaaccacggagtcc

SEQ ID NO: 800861 - DNA, 25 bp, Mus musculus
tgaggcctttagtaccacggagtcc

SEQ ID NO: 800862 - DNA, 25 bp, Mus musculus
tgaggcgacagcaatcggcccaaga

SEQ ID NO: 800863 - DNA, 25 bp, Mus musculus
tgaggcgacagctatcggcccaaga

SEQ ID NO: 800864 - DNA, 25 bp, Mus musculus
tgaggcgattgcagagttggacacc

SEQ ID NO: 800865 - DNA, 25 bp, Mus musculus
tgaggcgattgctgagttggacacc

SEQ ID NO: 800866 - DNA, 25 bp, Mus musculus
tgaggcgcatttagaacctgagccc

SEQ ID NO: 800867 - DNA, 25 bp, Mus musculus
tgaggcgcattttgaacctgagccc

SEQ ID NO: 800868 - DNA, 25 bp, Mus musculus
tgaggcgcgtgaaatcccgcgtctt

SEQ ID NO: 800869 - DNA, 25 bp, Mus musculus
tgaggcgcgtgatatcccgcgtctt

SEQ ID NO: 800870 - DNA, 25 bp, Mus musculus
tgaggcgctcaaatacgagacaatt

SEQ ID NO: 800871 - DNA, 25 bp, Mus musculus
tgaggcgctcaattacgagacaatt

SEQ ID NO: 800872 - DNA, 25 bp, Mus musculus
tgaggcgctcccctcagcgttgtgc

SEQ ID NO: 800873 - DNA, 25 bp, Mus musculus
tgaggcgctcccgtcagcgttgtgc

SEQ ID NO: 800874 - DNA, 25 bp, Mus musculus
tgaggcgcttagctgactacccaga

SEQ ID NO: 800875 - DNA, 25 bp, Mus musculus
tgaggcgcttaggtgactacccaga

SEQ ID NO: 800876 - DNA, 25 bp, Mus musculus
tgaggcggaacacgccaggcaccaa

SEQ ID NO: 800877 - DNA, 25 bp, Mus musculus
tgaggcggaacaggccaggcaccaa

SEQ ID NO: 800878 - DNA, 25 bp, Mus musculus
tgaggcggcctgaccccatcgactg

SEQ ID NO: 800879 - DNA, 25 bp, Mus musculus
tgaggcggcctgtccccatcgactg

SEQ ID NO: 800880 - DNA, 25 bp, Mus musculus
tgaggcgggagcagaccttctgtaa

SEQ ID NO: 800881 - DNA, 25 bp, Mus musculus
tgaggcgggagctgaccttctgtaa

SEQ ID NO: 800882 - DNA, 25 bp, Mus musculus
tgaggcgtctctacttagttgatga

SEQ ID NO: 800883 - DNA, 25 bp, Mus musculus
tgaggcgtctcttcttagttgatga

SEQ ID NO: 800884 - DNA, 25 bp, Mus musculus
tgaggcgttgggagaaagctaccct

SEQ ID NO: 800885 - DNA, 25 bp, Mus musculus
tgaggcgttgggtgaaagctaccct

SEQ ID NO: 800886 - DNA, 25 bp, Mus musculus
tgaggcgttgttagaccggatctac

SEQ ID NO: 800887 - DNA, 25 bp, Mus musculus
tgaggcgttgtttgaccggatctac

SEQ ID NO: 800888 - DNA, 25 bp, Mus musculus
tgaggcgtttggagctccggtaacc

SEQ ID NO: 800889 - DNA, 25 bp, Mus musculus
tgaggcgtttggtgctccggtaacc

SEQ ID NO: 800890 - DNA, 25 bp, Mus musculus
tgaggctaataacctggcagcagta

SEQ ID NO: 800891 - DNA, 25 bp, Mus musculus
tgaggctaataagctggcagcagta

SEQ ID NO: 800892 - DNA, 25 bp, Mus musculus
tgaggctattgcaaccctggctccc

SEQ ID NO: 800893 - DNA, 25 bp, Mus musculus
tgaggctattgctaccctggctccc

SEQ ID NO: 800894 - DNA, 25 bp, Mus musculus
tgaggctattgtcgacacagggaca

SEQ ID NO: 800895 - DNA, 25 bp, Mus musculus
tgaggctattgtggacacagggaca

SEQ ID NO: 800896 - DNA, 25 bp, Mus musculus
tgaggctcaagcacagccgctcagg

SEQ ID NO: 800897 - DNA, 25 bp, Mus musculus
tgaggctcaagctcagccgctcagg

SEQ ID NO: 800898 - DNA, 25 bp, Mus musculus
tgaggctcaagtcaacccggaacgt

SEQ ID NO: 800899 - DNA, 25 bp, Mus musculus
tgaggctcaagtgaacccggaacgt

SEQ ID NO: 800900 - DNA, 25 bp, Mus musculus
tgaggctcacctcatacactttgcg

SEQ ID NO: 800901 - DNA, 25 bp, Mus musculus
tgaggctcacctgatacactttgcg

SEQ ID NO: 800902 - DNA, 25 bp, Mus musculus
tgaggctcccctacgagcagtggaa

SEQ ID NO: 800903 - DNA, 25 bp, Mus musculus
tgaggctccccttcgagcagtggaa

SEQ ID NO: 800904 - DNA, 25 bp, Mus musculus
tgaggctcgagacgccatgttcctg

SEQ ID NO: 800905 - DNA, 25 bp, Mus musculus
tgaggctcgagaggccatgttcctg

SEQ ID NO: 800906 - DNA, 25 bp, Mus musculus
tgaggctctactatgatgatgcggg

SEQ ID NO: 800907 - DNA, 25 bp, Mus musculus
tgaggctctactttgatgatgcggg

SEQ ID NO: 800908 - DNA, 25 bp, Mus musculus
tgaggctctgcgcagacagcagctt

SEQ ID NO: 800909 - DNA, 25 bp, Mus musculus
tgaggctctgcggagacagcagctt

SEQ ID NO: 800910 - DNA, 25 bp, Mus musculus
tgaggctgacccctactggatcaac

SEQ ID NO: 800911 - DNA, 25 bp, Mus musculus
tgaggctgacccgtactggatcaac

SEQ ID NO: 800912 - DNA, 25 bp, Mus musculus
tgaggctgacctctgttgaaccctg

SEQ ID NO: 800913 - DNA, 25 bp, Mus musculus
tgaggctgacctgtgttgaaccctg

SEQ ID NO: 800914 - DNA, 25 bp, Mus musculus
tgaggctgagacctgccacaatatc

SEQ ID NO: 800915 - DNA, 25 bp, Mus musculus
tgaggctgagacgtgccacaatatc

SEQ ID NO: 800916 - DNA, 25 bp, Mus musculus
tgaggctgagtacaccgacgtgctt

SEQ ID NO: 800917 - DNA, 25 bp, Mus musculus
tgaggctgagtagaccgacgtgctt

SEQ ID NO: 800918 - DNA, 25 bp, Mus musculus
tgaggctgatgtccatgggatatac

SEQ ID NO: 800919 - DNA, 25 bp, Mus musculus
tgaggctgatgtgcatgggatatac

SEQ ID NO: 800920 - DNA, 25 bp, Mus musculus
tgaggctgcagaagctagaacaaca

SEQ ID NO: 800921 - DNA, 25 bp, Mus musculus
tgaggctgcagatgctagaacaaca

SEQ ID NO: 800922 - DNA, 25 bp, Mus musculus
tgaggctgcgatcggaaccagtacc

SEQ ID NO: 800923 - DNA, 25 bp, Mus musculus
tgaggctgcgatgggaaccagtacc

SEQ ID NO: 800924 - DNA, 25 bp, Mus musculus
tgaggctgctaactttgatcagctg

SEQ ID NO: 800925 - DNA, 25 bp, Mus musculus
tgaggctgctaagtttgatcagctg

SEQ ID NO: 800926 - DNA, 25 bp, Mus musculus
tgaggctgctttccggaacatcaag

SEQ ID NO: 800927 - DNA, 25 bp, Mus musculus
tgaggctgctttgcggaacatcaag

SEQ ID NO: 800928 - DNA, 25 bp, Mus musculus
tgaggctggagccaaccccaaccag

SEQ ID NO: 800929 - DNA, 25 bp, Mus musculus
tgaggctggagcgaaccccaaccag

SEQ ID NO: 800930 - DNA, 25 bp, Mus musculus
tgaggctggccaacgccagtgaact

SEQ ID NO: 800931 - DNA, 25 bp, Mus musculus
tgaggctggccatcgccagtgaact

SEQ ID NO: 800932 - DNA, 25 bp, Mus musculus
tgaggctgtcacaccagaagaccat

SEQ ID NO: 800933 - DNA, 25 bp, Mus musculus
tgaggctgtcactccagaagaccat

SEQ ID NO: 800934 - DNA, 25 bp, Mus musculus
tgaggctgtgacacaaacaccctgt

SEQ ID NO: 800935 - DNA, 25 bp, Mus musculus
tgaggctgtgactcaaacaccctgt

SEQ ID NO: 800936 - DNA, 25 bp, Mus musculus
tgaggctgtggcactgaaccaggaa

SEQ ID NO: 800937 - DNA, 25 bp, Mus musculus
tgaggctgtggctctgaaccaggaa

SEQ ID NO: 800938 - DNA, 25 bp, Mus musculus
tgaggcttaactcctgtcataaaat

SEQ ID NO: 800939 - DNA, 25 bp, Mus musculus
tgaggcttaactgctgtcataaaat

SEQ ID NO: 800940 - DNA, 25 bp, Mus musculus
tgaggcttctttccagctgccaagg

SEQ ID NO: 800941 - DNA, 25 bp, Mus musculus
tgaggcttctttgcagctgccaagg

SEQ ID NO: 800942 - DNA, 25 bp, Mus musculus
tgaggcttgcctagaacatccgctc

SEQ ID NO: 800943 - DNA, 25 bp, Mus musculus
tgaggcttgccttgaacatccgctc

SEQ ID NO: 800944 - DNA, 25 bp, Mus musculus
tgaggcttgcgaccccagattcgca

SEQ ID NO: 800945 - DNA, 25 bp, Mus musculus
tgaggcttgcgagcccagattcgca

SEQ ID NO: 800946 - DNA, 25 bp, Mus musculus
tgaggcttgcggatcctatctgccg

SEQ ID NO: 800947 - DNA, 25 bp, Mus musculus
tgaggcttgcggttcctatctgccg

SEQ ID NO: 800948 - DNA, 25 bp, Mus musculus
tgaggctttaatagtgagatgcccc

SEQ ID NO: 800949 - DNA, 25 bp, Mus musculus
tgaggctttaattgtgagatgcccc

SEQ ID NO: 800950 - DNA, 25 bp, Mus musculus
tgagggaaaatcctgtgttccaggc

SEQ ID NO: 800951 - DNA, 25 bp, Mus musculus
tgagggaaaatcgtgtgttccaggc

SEQ ID NO: 800952 - DNA, 25 bp, Mus musculus
tgagggaaacctcaacacctataag

SEQ ID NO: 800953 - DNA, 25 bp, Mus musculus
tgagggaaacctgaacacctataag

SEQ ID NO: 800954 - DNA, 25 bp, Mus musculus
tgagggaaatatcaaccaggatcca

SEQ ID NO: 800955 - DNA, 25 bp, Mus musculus
tgagggaaatatgaaccaggatcca

SEQ ID NO: 800956 - DNA, 25 bp, Mus musculus
tgagggaacatcagctgacagagag

SEQ ID NO: 800957 - DNA, 25 bp, Mus musculus
tgagggaacatctgctgacagagag

SEQ ID NO: 800958 - DNA, 25 bp, Mus musculus
tgagggaaccacattcactagtatc

SEQ ID NO: 800959 - DNA, 25 bp, Mus musculus
tgagggaaccactttcactagtatc

SEQ ID NO: 800960 - DNA, 25 bp, Mus musculus
tgagggaacccaccggtcttgactg

SEQ ID NO: 800961 - DNA, 25 bp, Mus musculus
tgagggaacccagcggtcttgactg

SEQ ID NO: 800962 - DNA, 25 bp, Mus musculus
tgagggaacggaacatcaagcgagc

SEQ ID NO: 800963 - DNA, 25 bp, Mus musculus
tgagggaacggatcatcaagcgagc

SEQ ID NO: 800964 - DNA, 25 bp, Mus musculus
tgagggaagcagacccctgggctcc

SEQ ID NO: 800965 - DNA, 25 bp, Mus musculus
tgagggaagcagtcccctgggctcc

SEQ ID NO: 800966 - DNA, 25 bp, Mus musculus
tgagggaagcccatcgtgatgaaga

SEQ ID NO: 800967 - DNA, 25 bp, Mus musculus
tgagggaagcccttcgtgatgaaga

SEQ ID NO: 800968 - DNA, 25 bp, Mus musculus
tgagggacagctaaaacacccgcac

SEQ ID NO: 800969 - DNA, 25 bp, Mus musculus
tgagggacagcttaaacacccgcac

SEQ ID NO: 800970 - DNA, 25 bp, Mus musculus
tgagggaccaaaactaacaacaagc

SEQ ID NO: 800971 - DNA, 25 bp, Mus musculus
tgagggaccaaatctaacaacaagc

SEQ ID NO: 800972 - DNA, 25 bp, Mus musculus
tgagggacccctccaagtgatcctg

SEQ ID NO: 800973 - DNA, 25 bp, Mus musculus
tgagggacccctgcaagtgatcctg

SEQ ID NO: 800974 - DNA, 25 bp, Mus musculus
tgagggacccgacgctgcttgcaca

SEQ ID NO: 800975 - DNA, 25 bp, Mus musculus
tgagggacccgaggctgcttgcaca

SEQ ID NO: 800976 - DNA, 25 bp, Mus musculus
tgagggacctgccatccatcgccat

SEQ ID NO: 800977 - DNA, 25 bp, Mus musculus
tgagggacctgcgatccatcgccat

SEQ ID NO: 800978 - DNA, 25 bp, Mus musculus
tgagggactcaaactacatctccaa

SEQ ID NO: 800979 - DNA, 25 bp, Mus musculus
tgagggactcaatctacatctccaa

SEQ ID NO: 800980 - DNA, 25 bp, Mus musculus
tgagggagacacagtccagacagtc

SEQ ID NO: 800981 - DNA, 25 bp, Mus musculus
tgagggagacactgtccagacagtc

SEQ ID NO: 800982 - DNA, 25 bp, Mus musculus
tgagggagacccaatgggtttctag

SEQ ID NO: 800983 - DNA, 25 bp, Mus musculus
tgagggagaccctatgggtttctag

SEQ ID NO: 800984 - DNA, 25 bp, Mus musculus
tgagggagacgcaaagcaactggct

SEQ ID NO: 800985 - DNA, 25 bp, Mus musculus
tgagggagacgctaagcaactggct

SEQ ID NO: 800986 - DNA, 25 bp, Mus musculus
tgagggagataaacattactgccac

SEQ ID NO: 800987 - DNA, 25 bp, Mus musculus
tgagggagataatcattactgccac

SEQ ID NO: 800988 - DNA, 25 bp, Mus musculus
tgagggagccatctatagaaaggac

SEQ ID NO: 800989 - DNA, 25 bp, Mus musculus
tgagggagccatgtatagaaaggac

SEQ ID NO: 800990 - DNA, 25 bp, Mus musculus
tgagggagcgcccatggatcttccc

SEQ ID NO: 800991 - DNA, 25 bp, Mus musculus
tgagggagcgccgatggatcttccc

SEQ ID NO: 800992 - DNA, 25 bp, Mus musculus
tgagggagctttcccgtatagtgat

SEQ ID NO: 800993 - DNA, 25 bp, Mus musculus
tgagggagctttgccgtatagtgat

SEQ ID NO: 800994 - DNA, 25 bp, Mus musculus
tgagggagtttaacggtcagcactt

SEQ ID NO: 800995 - DNA, 25 bp, Mus musculus
tgagggagtttatcggtcagcactt

SEQ ID NO: 800996 - DNA, 25 bp, Mus musculus
tgagggatagaactgcaaactctgg

SEQ ID NO: 800997 - DNA, 25 bp, Mus musculus
tgagggatagaagtgcaaactctgg

SEQ ID NO: 800998 - DNA, 25 bp, Mus musculus
tgagggatcctaaaaggccctggct

SEQ ID NO: 800999 - DNA, 25 bp, Mus musculus
tgagggatcctataaggccctggct

SEQ ID NO: 801000 - DNA, 25 bp, Mus musculus
tgagggatgcctaccatacaggcac

SEQ ID NO: 801001 - DNA, 25 bp, Mus musculus
tgagggatgcctagaaccaggctac

SEQ ID NO: 801002 - DNA, 25 bp, Mus musculus
tgagggatgccttccatacaggcac

SEQ ID NO: 801003 - DNA, 25 bp, Mus musculus
tgagggatgccttgaaccaggctac

SEQ ID NO: 801004 - DNA, 25 bp, Mus musculus
tgagggatgtgacgactcggcctga

SEQ ID NO: 801005 - DNA, 25 bp, Mus musculus
tgagggatgtgaggactcggcctga

SEQ ID NO: 801006 - DNA, 25 bp, Mus musculus
tgagggattgctcgcatgctgtacc

SEQ ID NO: 801007 - DNA, 25 bp, Mus musculus
tgagggattgctggcatgctgtacc

SEQ ID NO: 801008 - DNA, 25 bp, Mus musculus
tgagggcaacagctccatcacccgg

SEQ ID NO: 801009 - DNA, 25 bp, Mus musculus
tgagggcaacaggtccatcacccgg

SEQ ID NO: 801010 - DNA, 25 bp, Mus musculus
tgagggcacagaaggagggagggct

SEQ ID NO: 801011 - DNA, 25 bp, Mus musculus
tgagggcacagatggagggagggct

SEQ ID NO: 801012 - DNA, 25 bp, Mus musculus
tgagggcagacaacactggacgata

SEQ ID NO: 801013 - DNA, 25 bp, Mus musculus
tgagggcagacatcactggacgata

SEQ ID NO: 801014 - DNA, 25 bp, Mus musculus
tgagggcagcacaaactactcagcc

SEQ ID NO: 801015 - DNA, 25 bp, Mus musculus
tgagggcagcactaactactcagcc

SEQ ID NO: 801016 - DNA, 25 bp, Mus musculus
tgagggcatcatcccagccaactat

SEQ ID NO: 801017 - DNA, 25 bp, Mus musculus
tgagggcatcatgccagccaactat

SEQ ID NO: 801018 - DNA, 25 bp, Mus musculus
tgagggcatctaatcctgccacctg

SEQ ID NO: 801019 - DNA, 25 bp, Mus musculus
tgagggcatctattcctgccacctg

SEQ ID NO: 801020 - DNA, 25 bp, Mus musculus
tgagggccacaaagctagtttctgt

SEQ ID NO: 801021 - DNA, 25 bp, Mus musculus
tgagggccacaatgctagtttctgt

SEQ ID NO: 801022 - DNA, 25 bp, Mus musculus
tgagggccagcacttccggtcatta

SEQ ID NO: 801023 - DNA, 25 bp, Mus musculus
tgagggccagcagttccggtcatta

SEQ ID NO: 801024 - DNA, 25 bp, Mus musculus
tgagggccagcccaggcatttccct

SEQ ID NO: 801025 - DNA, 25 bp, Mus musculus
tgagggccagccgaggcatttccct

SEQ ID NO: 801026 - DNA, 25 bp, Mus musculus
tgagggccctgaacgacattgtgag

SEQ ID NO: 801027 - DNA, 25 bp, Mus musculus
tgagggccctgatcgacattgtgag

SEQ ID NO: 801028 - DNA, 25 bp, Mus musculus
tgagggcctgcactgctcctgtggc

SEQ ID NO: 801029 - DNA, 25 bp, Mus musculus
tgagggcctgcagtgctcctgtggc

SEQ ID NO: 801030 - DNA, 25 bp, Mus musculus
tgagggccttcgcttgagctcccct

SEQ ID NO: 801031 - DNA, 25 bp, Mus musculus
tgagggccttcggttgagctcccct

SEQ ID NO: 801032 - DNA, 25 bp, Mus musculus
tgagggcgctctacttgaccagctg

SEQ ID NO: 801033 - DNA, 25 bp, Mus musculus
tgagggcgctcttcttgaccagctg

SEQ ID NO: 801034 - DNA, 25 bp, Mus musculus
tgagggcgtcagaaaggaaatgcac

SEQ ID NO: 801035 - DNA, 25 bp, Mus musculus
tgagggcgtcagtaaggaaatgcac

SEQ ID NO: 801036 - DNA, 25 bp, Mus musculus
tgagggctagccaagtccaggcttt

SEQ ID NO: 801037 - DNA, 25 bp, Mus musculus
tgagggctagcctagtccaggcttt

SEQ ID NO: 801038 - DNA, 25 bp, Mus musculus
tgagggctattcctgcacctgcctt

SEQ ID NO: 801039 - DNA, 25 bp, Mus musculus
tgagggctattcgtgcacctgcctt

SEQ ID NO: 801040 - DNA, 25 bp, Mus musculus
tgagggctctgcattgcatgtcatg

SEQ ID NO: 801041 - DNA, 25 bp, Mus musculus
tgagggctctgctttgcatgtcatg

SEQ ID NO: 801042 - DNA, 25 bp, Mus musculus
tgagggctctgtacgtgcaagaata

SEQ ID NO: 801043 - DNA, 25 bp, Mus musculus
tgagggctctgttcgtgcaagaata

SEQ ID NO: 801044 - DNA, 25 bp, Mus musculus
tgagggctcttaaattttgtctgaa

SEQ ID NO: 801045 - DNA, 25 bp, Mus musculus
tgagggctcttatattttgtctgaa

SEQ ID NO: 801046 - DNA, 25 bp, Mus musculus
tgagggctgacaccggcaaaccttg

SEQ ID NO: 801047 - DNA, 25 bp, Mus musculus
tgagggctgacagcggcaaaccttg

SEQ ID NO: 801048 - DNA, 25 bp, Mus musculus
tgagggcttgctagtatgttgatct

SEQ ID NO: 801049 - DNA, 25 bp, Mus musculus
tgagggcttgcttgtatgttgatct

SEQ ID NO: 801050 - DNA, 25 bp, Mus musculus
tgagggtcacataccctgccctgaa

SEQ ID NO: 801051 - DNA, 25 bp, Mus musculus
tgagggtcacattccctgccctgaa

SEQ ID NO: 801052 - DNA, 25 bp, Mus musculus
tgagggtcagatcgaggctcccttt

SEQ ID NO: 801053 - DNA, 25 bp, Mus musculus
tgagggtcagatggaggctcccttt

SEQ ID NO: 801054 - DNA, 25 bp, Mus musculus
tgagggtcagcaaaccgtgaggaac

SEQ ID NO: 801055 - DNA, 25 bp, Mus musculus
tgagggtcagcataccgtgaggaac

SEQ ID NO: 801056 - DNA, 25 bp, Mus musculus
tgagggtcagggagaatccttccag

SEQ ID NO: 801057 - DNA, 25 bp, Mus musculus
tgagggtcagggtgaatccttccag

SEQ ID NO: 801058 - DNA, 25 bp, Mus musculus
tgagggtccactcagacttagcaag

SEQ ID NO: 801059 - DNA, 25 bp, Mus musculus
tgagggtccactgagacttagcaag

SEQ ID NO: 801060 - DNA, 25 bp, Mus musculus
tgagggtcctacctagcactccaaa

SEQ ID NO: 801061 - DNA, 25 bp, Mus musculus
tgagggtcctacgtagcactccaaa

SEQ ID NO: 801062 - DNA, 25 bp, Mus musculus
tgagggtcctgtagtagcagccttg

SEQ ID NO: 801063 - DNA, 25 bp, Mus musculus
tgagggtcctgttgtagcagccttg

SEQ ID NO: 801064 - DNA, 25 bp, Mus musculus
tgagggtcgcctctgactatggctc

SEQ ID NO: 801065 - DNA, 25 bp, Mus musculus
tgagggtcgcctgtgactatggctc

SEQ ID NO: 801066 - DNA, 25 bp, Mus musculus
tgagggtctggactttcccaatgcc

SEQ ID NO: 801067 - DNA, 25 bp, Mus musculus
tgagggtctggagtttcccaatgcc

SEQ ID NO: 801068 - DNA, 25 bp, Mus musculus
tgagggtctggtctctacagcagcc

SEQ ID NO: 801069 - DNA, 25 bp, Mus musculus
tgagggtctggtgtctacagcagcc

SEQ ID NO: 801070 - DNA, 25 bp, Mus musculus
tgagggtgaggtcacttgaataatc

SEQ ID NO: 801071 - DNA, 25 bp, Mus musculus
tgagggtgaggtgacttgaataatc

SEQ ID NO: 801072 - DNA, 25 bp, Mus musculus
tgagggtgtacacgtcgccaagtac

SEQ ID NO: 801073 - DNA, 25 bp, Mus musculus
tgagggtgtacaggtcgccaagtac

SEQ ID NO: 801074 - DNA, 25 bp, Mus musculus
tgagggtgttggcaaggcctttcct

SEQ ID NO: 801075 - DNA, 25 bp, Mus musculus
tgagggtgttgggaaggcctttcct

SEQ ID NO: 801076 - DNA, 25 bp, Mus musculus
tgagggttagcaaccagtatcctgc

SEQ ID NO: 801077 - DNA, 25 bp, Mus musculus
tgagggttagcatccagtatcctgc

SEQ ID NO: 801078 - DNA, 25 bp, Mus musculus
tgagggttccgcagtccctggactt

SEQ ID NO: 801079 - DNA, 25 bp, Mus musculus
tgagggttccgctgtccctggactt

SEQ ID NO: 801080 - DNA, 25 bp, Mus musculus
tgagggttttgaatcccgaccttgt

SEQ ID NO: 801081 - DNA, 25 bp, Mus musculus
tgagggttttgattcccgaccttgt

SEQ ID NO: 801082 - DNA, 25 bp, Mus musculus
tgaggtaagagaagccagcacagcc

SEQ ID NO: 801083 - DNA, 25 bp, Mus musculus
tgaggtaagagatgccagcacagcc

SEQ ID NO: 801084 - DNA, 25 bp, Mus musculus
tgaggtaagtaacacccactggtac

SEQ ID NO: 801085 - DNA, 25 bp, Mus musculus
tgaggtaagtaagacccactggtac

SEQ ID NO: 801086 - DNA, 25 bp, Mus musculus
tgaggtacagtacggtcgtttccag

SEQ ID NO: 801087 - DNA, 25 bp, Mus musculus
tgaggtacagtagggtcgtttccag

SEQ ID NO: 801088 - DNA, 25 bp, Mus musculus
tgaggtacctagcatgctctcagaa

SEQ ID NO: 801089 - DNA, 25 bp, Mus musculus
tgaggtacctaggatgctctcagaa

SEQ ID NO: 801090 - DNA, 25 bp, Mus musculus
tgaggtacctccctctctgagccaa

SEQ ID NO: 801091 - DNA, 25 bp, Mus musculus
tgaggtacctccgtctctgagccaa

SEQ ID NO: 801092 - DNA, 25 bp, Mus musculus
tgaggtacctgaactttttcacaaa

SEQ ID NO: 801093 - DNA, 25 bp, Mus musculus
tgaggtacctgatctttttcacaaa

SEQ ID NO: 801094 - DNA, 25 bp, Mus musculus
tgaggtactgttatcagggaactgg

SEQ ID NO: 801095 - DNA, 25 bp, Mus musculus
tgaggtactgttttcagggaactgg

SEQ ID NO: 801096 - DNA, 25 bp, Mus musculus
tgaggtagcagaaagtgacttcacc

SEQ ID NO: 801097 - DNA, 25 bp, Mus musculus
tgaggtagcagatagtgacttcacc

SEQ ID NO: 801098 - DNA, 25 bp, Mus musculus
tgaggtagtagtagctactgagaca

SEQ ID NO: 801099 - DNA, 25 bp, Mus musculus
tgaggtagtagttgctactgagaca

SEQ ID NO: 801100 - DNA, 25 bp, Mus musculus
tgaggtagtcccaacccagggagct

SEQ ID NO: 801101 - DNA, 25 bp, Mus musculus
tgaggtagtccctacccagggagct

SEQ ID NO: 801102 - DNA, 25 bp, Mus musculus
tgaggtagttggacttgactggaca

SEQ ID NO: 801103 - DNA, 25 bp, Mus musculus
tgaggtagttggtcttgactggaca

SEQ ID NO: 801104 - DNA, 25 bp, Mus musculus
tgaggtatcatcactacaaaagtaa

SEQ ID NO: 801105 - DNA, 25 bp, Mus musculus
tgaggtatcatctctacaaaagtaa

SEQ ID NO: 801106 - DNA, 25 bp, Mus musculus
tgaggtatcgaaccaagacccgtgc

SEQ ID NO: 801107 - DNA, 25 bp, Mus musculus
tgaggtatcgaagcaagacccgtgc

SEQ ID NO: 801108 - DNA, 25 bp, Mus musculus
tgaggtatgggcatttggccgccat

SEQ ID NO: 801109 - DNA, 25 bp, Mus musculus
tgaggtatgggcttttggccgccat

SEQ ID NO: 801110 - DNA, 25 bp, Mus musculus
tgaggtcaaagcacagtaaacccct

SEQ ID NO: 801111 - DNA, 25 bp, Mus musculus
tgaggtcaaagctcagtaaacccct

SEQ ID NO: 801112 - DNA, 25 bp, Mus musculus
tgaggtcaaatcagtgttcataatt

SEQ ID NO: 801113 - DNA, 25 bp, Mus musculus
tgaggtcaaatctgtgttcataatt

SEQ ID NO: 801114 - DNA, 25 bp, Mus musculus
tgaggtcaacagaatcgccacttgg

SEQ ID NO: 801115 - DNA, 25 bp, Mus musculus
tgaggtcaacagtatcgccacttgg

SEQ ID NO: 801116 - DNA, 25 bp, Mus musculus
tgaggtcaaccaatttcctgtgggt

SEQ ID NO: 801117 - DNA, 25 bp, Mus musculus
tgaggtcaaccattttcctgtgggt

SEQ ID NO: 801118 - DNA, 25 bp, Mus musculus
tgaggtcaatacatttagactggct

SEQ ID NO: 801119 - DNA, 25 bp, Mus musculus
tgaggtcaatacttttagactggct

SEQ ID NO: 801120 - DNA, 25 bp, Mus musculus
tgaggtcacatccatcctgcgctgg

SEQ ID NO: 801121 - DNA, 25 bp, Mus musculus
tgaggtcacatcgatcctgcgctgg

SEQ ID NO: 801122 - DNA, 25 bp, Mus musculus
tgaggtcaccccagacaagaagggc

SEQ ID NO: 801123 - DNA, 25 bp, Mus musculus
tgaggtcacccctgacaagaagggc

SEQ ID NO: 801124 - DNA, 25 bp, Mus musculus
tgaggtcatagcaaccctggccatg

SEQ ID NO: 801125 - DNA, 25 bp, Mus musculus
tgaggtcatagctaccctggccatg

SEQ ID NO: 801126 - DNA, 25 bp, Mus musculus
tgaggtcatcgcaccccaaaaaaca

SEQ ID NO: 801127 - DNA, 25 bp, Mus musculus
tgaggtcatcgctccccaaaaaaca

SEQ ID NO: 801128 - DNA, 25 bp, Mus musculus
tgaggtcatcggacaggtactgagc

SEQ ID NO: 801129 - DNA, 25 bp, Mus musculus
tgaggtcatcggtcaggtactgagc

SEQ ID NO: 801130 - DNA, 25 bp, Mus musculus
tgaggtcatggcagaactcaacagt

SEQ ID NO: 801131 - DNA, 25 bp, Mus musculus
tgaggtcatggctgaactcaacagt

SEQ ID NO: 801132 - DNA, 25 bp, Mus musculus
tgaggtccacatacataccgggtgc

SEQ ID NO: 801133 - DNA, 25 bp, Mus musculus
tgaggtccacattcataccgggtgc

SEQ ID NO: 801134 - DNA, 25 bp, Mus musculus
tgaggtccaggacgaaaaaggcatc

SEQ ID NO: 801135 - DNA, 25 bp, Mus musculus
tgaggtccaggaggaaaaaggcatc

SEQ ID NO: 801136 - DNA, 25 bp, Mus musculus
tgaggtccatcaagaagttccagta

SEQ ID NO: 801137 - DNA, 25 bp, Mus musculus
tgaggtccatcatgaagttccagta

SEQ ID NO: 801138 - DNA, 25 bp, Mus musculus
tgaggtcccgagcacgtcactgacg

SEQ ID NO: 801139 - DNA, 25 bp, Mus musculus
tgaggtcccgaggacgtcactgacg

SEQ ID NO: 801140 - DNA, 25 bp, Mus musculus
tgaggtccctcaaagctggaaatgc

SEQ ID NO: 801141 - DNA, 25 bp, Mus musculus
tgaggtccctcatagctggaaatgc

SEQ ID NO: 801142 - DNA, 25 bp, Mus musculus
tgaggtcctacacaggagccctagc

SEQ ID NO: 801143 - DNA, 25 bp, Mus musculus
tgaggtcctacagaggagccctagc

SEQ ID NO: 801144 - DNA, 25 bp, Mus musculus
tgaggtcctcttcgccttggctgaa

SEQ ID NO: 801145 - DNA, 25 bp, Mus musculus
tgaggtcctcttggccttggctgaa

SEQ ID NO: 801146 - DNA, 25 bp, Mus musculus
tgaggtcctgaaccataaagtgaag

SEQ ID NO: 801147 - DNA, 25 bp, Mus musculus
tgaggtcctgaagcataaagtgaag

SEQ ID NO: 801148 - DNA, 25 bp, Mus musculus
tgaggtcgcctgagggtcttaccac

SEQ ID NO: 801149 - DNA, 25 bp, Mus musculus
tgaggtcgcctgtgggtcttaccac

SEQ ID NO: 801150 - DNA, 25 bp, Mus musculus
tgaggtcgcggaatccgaagccccg

SEQ ID NO: 801151 - DNA, 25 bp, Mus musculus
tgaggtcgcggattccgaagccccg

SEQ ID NO: 801152 - DNA, 25 bp, Mus musculus
tgaggtcgtacaccgcaagaagcag

SEQ ID NO: 801153 - DNA, 25 bp, Mus musculus
tgaggtcgtacagcgcaagaagcag

SEQ ID NO: 801154 - DNA, 25 bp, Mus musculus
tgaggtctcatcactgcaattccag

SEQ ID NO: 801155 - DNA, 25 bp, Mus musculus
tgaggtctcatctctgcaattccag

SEQ ID NO: 801156 - DNA, 25 bp, Mus musculus
tgaggtctcgcgcaagcgtctctga

SEQ ID NO: 801157 - DNA, 25 bp, Mus musculus
tgaggtctcgcggaagcgtctctga

SEQ ID NO: 801158 - DNA, 25 bp, Mus musculus
tgaggtcttccccaaggagatgacc

SEQ ID NO: 801159 - DNA, 25 bp, Mus musculus
tgaggtcttcccgaaggagatgacc

SEQ ID NO: 801160 - DNA, 25 bp, Mus musculus
tgaggtcttccgcatcttcaacccg

SEQ ID NO: 801161 - DNA, 25 bp, Mus musculus
tgaggtcttccggatcttcaacccg

SEQ ID NO: 801162 - DNA, 25 bp, Mus musculus
tgaggtcttctgctcggtccctgga

SEQ ID NO: 801163 - DNA, 25 bp, Mus musculus
tgaggtcttctggtcggtccctgga

SEQ ID NO: 801164 - DNA, 25 bp, Mus musculus
tgaggtgaacagagtctcccacgct

SEQ ID NO: 801165 - DNA, 25 bp, Mus musculus
tgaggtgaacagtgtctcccacgct

SEQ ID NO: 801166 - DNA, 25 bp, Mus musculus
tgaggtgaacatagacatagcttcc

SEQ ID NO: 801167 - DNA, 25 bp, Mus musculus
tgaggtgaacattgacatagcttcc

SEQ ID NO: 801168 - DNA, 25 bp, Mus musculus
tgaggtgaagctacgaagacagctg

SEQ ID NO: 801169 - DNA, 25 bp, Mus musculus
tgaggtgaagcttcgaagacagctg

SEQ ID NO: 801170 - DNA, 25 bp, Mus musculus
tgaggtgacactacgaggttccctg

SEQ ID NO: 801171 - DNA, 25 bp, Mus musculus
tgaggtgacacttcgaggttccctg

SEQ ID NO: 801172 - DNA, 25 bp, Mus musculus
tgaggtgacatcctgcagcgttccg

SEQ ID NO: 801173 - DNA, 25 bp, Mus musculus
tgaggtgacatcgtgcagcgttccg

SEQ ID NO: 801174 - DNA, 25 bp, Mus musculus
tgaggtgagaaaaggtgatcccctg

SEQ ID NO: 801175 - DNA, 25 bp, Mus musculus
tgaggtgagaaatggtgatcccctg

SEQ ID NO: 801176 - DNA, 25 bp, Mus musculus
tgaggtgagaccatcaagagctgtg

SEQ ID NO: 801177 - DNA, 25 bp, Mus musculus
tgaggtgagaccttcaagagctgtg

SEQ ID NO: 801178 - DNA, 25 bp, Mus musculus
tgaggtgagttcctgtgtcctttcc

SEQ ID NO: 801179 - DNA, 25 bp, Mus musculus
tgaggtgagttcgtgtgtcctttcc

SEQ ID NO: 801180 - DNA, 25 bp, Mus musculus
tgaggtgatacactggctcattacg

SEQ ID NO: 801181 - DNA, 25 bp, Mus musculus
tgaggtgatacagtggctcattacg

SEQ ID NO: 801182 - DNA, 25 bp, Mus musculus
tgaggtgatcaaccttccaagagaa

SEQ ID NO: 801183 - DNA, 25 bp, Mus musculus
tgaggtgatcaagcttccaagagaa

SEQ ID NO: 801184 - DNA, 25 bp, Mus musculus
tgaggtgatgcactccaccttggat

SEQ ID NO: 801185 - DNA, 25 bp, Mus musculus
tgaggtgatgcagtccaccttggat

SEQ ID NO: 801186 - DNA, 25 bp, Mus musculus
tgaggtgcagcacaagtggatcaac

SEQ ID NO: 801187 - DNA, 25 bp, Mus musculus
tgaggtgcagcagaagtggatcaac

SEQ ID NO: 801188 - DNA, 25 bp, Mus musculus
tgaggtgcaggcactccagtactgt

SEQ ID NO: 801189 - DNA, 25 bp, Mus musculus
tgaggtgcaggctctccagtactgt

SEQ ID NO: 801190 - DNA, 25 bp, Mus musculus
tgaggtgcatccactgtcctggccc

SEQ ID NO: 801191 - DNA, 25 bp, Mus musculus
tgaggtgcatcctctgtcctggccc

SEQ ID NO: 801192 - DNA, 25 bp, Mus musculus
tgaggtgcgcatcgccaacgccgac

SEQ ID NO: 801193 - DNA, 25 bp, Mus musculus
tgaggtgcgcatggccaacgccgac

SEQ ID NO: 801194 - DNA, 25 bp, Mus musculus
tgaggtgctcagatactcgagccag

SEQ ID NO: 801195 - DNA, 25 bp, Mus musculus
tgaggtgctcagttactcgagccag

SEQ ID NO: 801196 - DNA, 25 bp, Mus musculus
tgaggtgcttctcatcttcgagagg

SEQ ID NO: 801197 - DNA, 25 bp, Mus musculus
tgaggtgcttctgatcttcgagagg

SEQ ID NO: 801198 - DNA, 25 bp, Mus musculus
tgaggtggaaaaccagatcctcacc

SEQ ID NO: 801199 - DNA, 25 bp, Mus musculus
tgaggtggaaaagcagatcctcacc

SEQ ID NO: 801200 - DNA, 25 bp, Mus musculus
tgaggtggaggacgtaaaatcccca

SEQ ID NO: 801201 - DNA, 25 bp, Mus musculus
tgaggtggaggaggtaaaatcccca

SEQ ID NO: 801202 - DNA, 25 bp, Mus musculus
tgaggtggatgaagatcccactgga

SEQ ID NO: 801203 - DNA, 25 bp, Mus musculus
tgaggtggatgatgatcccactgga

SEQ ID NO: 801204 - DNA, 25 bp, Mus musculus
tgaggtggatgtcctggctctcctc

SEQ ID NO: 801205 - DNA, 25 bp, Mus musculus
tgaggtggatgtgctggctctcctc

SEQ ID NO: 801206 - DNA, 25 bp, Mus musculus
tgaggtgtagccactggacacagct

SEQ ID NO: 801207 - DNA, 25 bp, Mus musculus
tgaggtgtagcctctggacacagct

SEQ ID NO: 801208 - DNA, 25 bp, Mus musculus
tgaggtgtatccctgaggagaccct

SEQ ID NO: 801209 - DNA, 25 bp, Mus musculus
tgaggtgtatccgtgaggagaccct

SEQ ID NO: 801210 - DNA, 25 bp, Mus musculus
tgaggtgtcaccagagagtatcatg

SEQ ID NO: 801211 - DNA, 25 bp, Mus musculus
tgaggtgtcacctgagagtatcatg

SEQ ID NO: 801212 - DNA, 25 bp, Mus musculus
tgaggtgtccaaacccaaaaagcca

SEQ ID NO: 801213 - DNA, 25 bp, Mus musculus
tgaggtgtccaatcccaaaaagcca

SEQ ID NO: 801214 - DNA, 25 bp, Mus musculus
tgaggtgttgtgacagctggtttca

SEQ ID NO: 801215 - DNA, 25 bp, Mus musculus
tgaggtgttgtgtcagctggtttca

SEQ ID NO: 801216 - DNA, 25 bp, Mus musculus
tgaggttacaatcctaggaggactc

SEQ ID NO: 801217 - DNA, 25 bp, Mus musculus
tgaggttacaatgctaggaggactc

SEQ ID NO: 801218 - DNA, 25 bp, Mus musculus
tgaggttaccaaagcctatatcaca

SEQ ID NO: 801219 - DNA, 25 bp, Mus musculus
tgaggttaccaatgcctatatcaca

SEQ ID NO: 801220 - DNA, 25 bp, Mus musculus
tgaggttaccctcatgaatgcgcga

SEQ ID NO: 801221 - DNA, 25 bp, Mus musculus
tgaggttaccctgatgaatgcgcga

SEQ ID NO: 801222 - DNA, 25 bp, Mus musculus
tgaggttacctcagccccagtaagt

SEQ ID NO: 801223 - DNA, 25 bp, Mus musculus
tgaggttacctctgccccagtaagt

SEQ ID NO: 801224 - DNA, 25 bp, Mus musculus
tgaggttatcaaagcccgtgaggta

SEQ ID NO: 801225 - DNA, 25 bp, Mus musculus
tgaggttatcaatgcccgtgaggta

SEQ ID NO: 801226 - DNA, 25 bp, Mus musculus
tgaggttcaagaacagctgcagaac

SEQ ID NO: 801227 - DNA, 25 bp, Mus musculus
tgaggttcaagatcagctgcagaac

SEQ ID NO: 801228 - DNA, 25 bp, Mus musculus
tgaggttcacttaaaagattttagg

SEQ ID NO: 801229 - DNA, 25 bp, Mus musculus
tgaggttcactttaaagattttagg

SEQ ID NO: 801230 - DNA, 25 bp, Mus musculus
tgaggttccgctcaactcagagcta

SEQ ID NO: 801231 - DNA, 25 bp, Mus musculus
tgaggttccgctgaactcagagcta

SEQ ID NO: 801232 - DNA, 25 bp, Mus musculus
tgaggttcttggaattggcaggcct

SEQ ID NO: 801233 - DNA, 25 bp, Mus musculus
tgaggttcttggtattggcaggcct

SEQ ID NO: 801234 - DNA, 25 bp, Mus musculus
tgaggttgctgcatgaccgtgacgt

SEQ ID NO: 801235 - DNA, 25 bp, Mus musculus
tgaggttgctgcttgaccgtgacgt

SEQ ID NO: 801236 - DNA, 25 bp, Mus musculus
tgaggttggcccagggtatctgcct

SEQ ID NO: 801237 - DNA, 25 bp, Mus musculus
tgaggttggccctgggtatctgcct

SEQ ID NO: 801238 - DNA, 25 bp, Mus musculus
tgaggttgtcgcaggctgccgctat

SEQ ID NO: 801239 - DNA, 25 bp, Mus musculus
tgaggttgtcgctggctgccgctat

SEQ ID NO: 801240 - DNA, 25 bp, Mus musculus
tgaggtttacaacgccacttgcctg

SEQ ID NO: 801241 - DNA, 25 bp, Mus musculus
tgaggtttacaaggccacttgcctg

SEQ ID NO: 801242 - DNA, 25 bp, Mus musculus
tgaggtttacttactgcactgcggg

SEQ ID NO: 801243 - DNA, 25 bp, Mus musculus
tgaggtttactttctgcactgcggg

SEQ ID NO: 801244 - DNA, 25 bp, Mus musculus
tgaggtttattgacaagcagctgga

SEQ ID NO: 801245 - DNA, 25 bp, Mus musculus
tgaggtttattgtcaagcagctgga

SEQ ID NO: 801246 - DNA, 25 bp, Mus musculus
tgaggtttcagtccgactccagccc

SEQ ID NO: 801247 - DNA, 25 bp, Mus musculus
tgaggtttcagtgcgactccagccc

SEQ ID NO: 801248 - DNA, 25 bp, Mus musculus
tgaggtttctaccaagtctgctacc

SEQ ID NO: 801249 - DNA, 25 bp, Mus musculus
tgaggtttctacgaagtctgctacc

SEQ ID NO: 801250 - DNA, 25 bp, Mus musculus
tgagtaaaaggaaggccccgtgtta

SEQ ID NO: 801251 - DNA, 25 bp, Mus musculus
tgagtaaaaggatggccccgtgtta

SEQ ID NO: 801252 - DNA, 25 bp, Mus musculus
tgagtaaccacgagtacctggaagg

SEQ ID NO: 801253 - DNA, 25 bp, Mus musculus
tgagtaaccacgtgtacctggaagg

SEQ ID NO: 801254 - DNA, 25 bp, Mus musculus
tgagtaagaaagatccttcacagac

SEQ ID NO: 801255 - DNA, 25 bp, Mus musculus
tgagtaagaaagttccttcacagac

SEQ ID NO: 801256 - DNA, 25 bp, Mus musculus
tgagtaagaccacgcagattgataa

SEQ ID NO: 801257 - DNA, 25 bp, Mus musculus
tgagtaagaccaggcagattgataa

SEQ ID NO: 801258 - DNA, 25 bp, Mus musculus
tgagtaagcagcacgttctaatcgc

SEQ ID NO: 801259 - DNA, 25 bp, Mus musculus
tgagtaagcagctcgttctaatcgc

SEQ ID NO: 801260 - DNA, 25 bp, Mus musculus
tgagtaagctgtcgttcaaacaaga

SEQ ID NO: 801261 - DNA, 25 bp, Mus musculus
tgagtaagctgtggttcaaacaaga

SEQ ID NO: 801262 - DNA, 25 bp, Mus musculus
tgagtaaggaaacaccctttgctgt

SEQ ID NO: 801263 - DNA, 25 bp, Mus musculus
tgagtaaggaaagaccctttgctgt

SEQ ID NO: 801264 - DNA, 25 bp, Mus musculus
tgagtaagtaccatgcggcacttcg

SEQ ID NO: 801265 - DNA, 25 bp, Mus musculus
tgagtaagtaccttgcggcacttcg

SEQ ID NO: 801266 - DNA, 25 bp, Mus musculus
tgagtaatgagcatgcagcaatcca

SEQ ID NO: 801267 - DNA, 25 bp, Mus musculus
tgagtaatgagcttgcagcaatcca

SEQ ID NO: 801268 - DNA, 25 bp, Mus musculus
tgagtaatggacaaatgggccagcc

SEQ ID NO: 801269 - DNA, 25 bp, Mus musculus
tgagtaatggactaatgggccagcc

SEQ ID NO: 801270 - DNA, 25 bp, Mus musculus
tgagtacaacggacaggtggacaag

SEQ ID NO: 801271 - DNA, 25 bp, Mus musculus
tgagtacaacggtcaggtggacaag

SEQ ID NO: 801272 - DNA, 25 bp, Mus musculus
tgagtacacactccaggaaagtccc

SEQ ID NO: 801273 - DNA, 25 bp, Mus musculus
tgagtacacactgcaggaaagtccc

SEQ ID NO: 801274 - DNA, 25 bp, Mus musculus
tgagtacacatgaagatgcaggagg

SEQ ID NO: 801275 - DNA, 25 bp, Mus musculus
tgagtacacatgtagatgcaggagg

SEQ ID NO: 801276 - DNA, 25 bp, Mus musculus
tgagtacaccgacgtgcttcagaaa

SEQ ID NO: 801277 - DNA, 25 bp, Mus musculus
tgagtacaccgaggtgcttcagaaa

SEQ ID NO: 801278 - DNA, 25 bp, Mus musculus
tgagtacagcaacatagaggagttc

SEQ ID NO: 801279 - DNA, 25 bp, Mus musculus
tgagtacagcaagatagaggagttc

SEQ ID NO: 801280 - DNA, 25 bp, Mus musculus
tgagtacatctacgtggaccctgtg

SEQ ID NO: 801281 - DNA, 25 bp, Mus musculus
tgagtacatctaggtggaccctgtg

SEQ ID NO: 801282 - DNA, 25 bp, Mus musculus
tgagtacatgggaatgaccaagagg

SEQ ID NO: 801283 - DNA, 25 bp, Mus musculus
tgagtacatgggtatgaccaagagg

SEQ ID NO: 801284 - DNA, 25 bp, Mus musculus
tgagtaccaggaacttagagacctc

SEQ ID NO: 801285 - DNA, 25 bp, Mus musculus
tgagtaccaggatcttagagacctc

SEQ ID NO: 801286 - DNA, 25 bp, Mus musculus
tgagtacccacaaggctaaccagat

SEQ ID NO: 801287 - DNA, 25 bp, Mus musculus
tgagtacccacatggctaaccagat

SEQ ID NO: 801288 - DNA, 25 bp, Mus musculus
tgagtacccatcagtcctcatgtac

SEQ ID NO: 801289 - DNA, 25 bp, Mus musculus
tgagtacccatctgtcctcatgtac

SEQ ID NO: 801290 - DNA, 25 bp, Mus musculus
tgagtacccgggaacagcaccgcct

SEQ ID NO: 801291 - DNA, 25 bp, Mus musculus
tgagtacccgggtacagcaccgcct

SEQ ID NO: 801292 - DNA, 25 bp, Mus musculus
tgagtaccgggaatatgctgacagt

SEQ ID NO: 801293 - DNA, 25 bp, Mus musculus
tgagtaccgggattatgctgacagt

SEQ ID NO: 801294 - DNA, 25 bp, Mus musculus
tgagtaccgtgtcaggaaattcttg

SEQ ID NO: 801295 - DNA, 25 bp, Mus musculus
tgagtaccgtgtgaggaaattcttg

SEQ ID NO: 801296 - DNA, 25 bp, Mus musculus
tgagtacctcctaattcatggaacg

SEQ ID NO: 801297 - DNA, 25 bp, Mus musculus
tgagtacctccttattcatggaacg

SEQ ID NO: 801298 - DNA, 25 bp, Mus musculus
tgagtacctgaacctactgggcaag

SEQ ID NO: 801299 - DNA, 25 bp, Mus musculus
tgagtacctgaagctactgggcaag

SEQ ID NO: 801300 - DNA, 25 bp, Mus musculus
tgagtacctgggaggccacatcctg

SEQ ID NO: 801301 - DNA, 25 bp, Mus musculus
tgagtacctgggtggccacatcctg

SEQ ID NO: 801302 - DNA, 25 bp, Mus musculus
tgagtacgcgtccattccggttgaa

SEQ ID NO: 801303 - DNA, 25 bp, Mus musculus
tgagtacgcgtcgattccggttgaa

SEQ ID NO: 801304 - DNA, 25 bp, Mus musculus
tgagtactaacaagaagccagttac

SEQ ID NO: 801305 - DNA, 25 bp, Mus musculus
tgagtactaacatgaagccagttac

SEQ ID NO: 801306 - DNA, 25 bp, Mus musculus
tgagtactacgtaggcttcaccctc

SEQ ID NO: 801307 - DNA, 25 bp, Mus musculus
tgagtactacgttggcttcaccctc

SEQ ID NO: 801308 - DNA, 25 bp, Mus musculus
tgagtactcataaagctgcagcagc

SEQ ID NO: 801309 - DNA, 25 bp, Mus musculus
tgagtactcatatagctgcagcagc

SEQ ID NO: 801310 - DNA, 25 bp, Mus musculus
tgagtactcggcacacaaagaaggt

SEQ ID NO: 801311 - DNA, 25 bp, Mus musculus
tgagtactcggctcacaaagaaggt

SEQ ID NO: 801312 - DNA, 25 bp, Mus musculus
tgagtactgcttcggttgtatctcc

SEQ ID NO: 801313 - DNA, 25 bp, Mus musculus
tgagtactgcttgggttgtatctcc

SEQ ID NO: 801314 - DNA, 25 bp, Mus musculus
tgagtacttaatcccaaaacgagaa

SEQ ID NO: 801315 - DNA, 25 bp, Mus musculus
tgagtacttaatgccaaaacgagaa

SEQ ID NO: 801316 - DNA, 25 bp, Mus musculus
tgagtactttgaaggttcagaacct

SEQ ID NO: 801317 - DNA, 25 bp, Mus musculus
tgagtactttgatggttcagaacct

SEQ ID NO: 801318 - DNA, 25 bp, Mus musculus
tgagtagagaccacatattgccatg

SEQ ID NO: 801319 - DNA, 25 bp, Mus musculus
tgagtagagacctcatattgccatg

SEQ ID NO: 801320 - DNA, 25 bp, Mus musculus
tgagtagcacacagggcgataagaa

SEQ ID NO: 801321 - DNA, 25 bp, Mus musculus
tgagtagcacactgggcgataagaa

SEQ ID NO: 801322 - DNA, 25 bp, Mus musculus
tgagtaggagcacacaggcgcactc

SEQ ID NO: 801323 - DNA, 25 bp, Mus musculus
tgagtaggagcagacaggcgcactc

SEQ ID NO: 801324 - DNA, 25 bp, Mus musculus
tgagtagtctccatgggcagctcaa

SEQ ID NO: 801325 - DNA, 25 bp, Mus musculus
tgagtagtctccttgggcagctcaa

SEQ ID NO: 801326 - DNA, 25 bp, Mus musculus
tgagtagttgcccagctgtggactc

SEQ ID NO: 801327 - DNA, 25 bp, Mus musculus
tgagtagttgccgagctgtggactc

SEQ ID NO: 801328 - DNA, 25 bp, Mus musculus
tgagtatattatctgcaccaacacc

SEQ ID NO: 801329 - DNA, 25 bp, Mus musculus
tgagtatattatgtgcaccaacacc

SEQ ID NO: 801330 - DNA, 25 bp, Mus musculus
tgagtatgactacgcaagctggacc

SEQ ID NO: 801331 - DNA, 25 bp, Mus musculus
tgagtatgactaggcaagctggacc

SEQ ID NO: 801332 - DNA, 25 bp, Mus musculus
tgagtatgcattagtaggagtaaag

SEQ ID NO: 801333 - DNA, 25 bp, Mus musculus
tgagtatgcatttgtaggagtaaag

SEQ ID NO: 801334 - DNA, 25 bp, Mus musculus
tgagtatgcgctcaaagaatacggg

SEQ ID NO: 801335 - DNA, 25 bp, Mus musculus
tgagtatgcgctgaaagaatacggg

SEQ ID NO: 801336 - DNA, 25 bp, Mus musculus
tgagtatgtaccacagcaaaagttg

SEQ ID NO: 801337 - DNA, 25 bp, Mus musculus
tgagtatgtacctcagcaaaagttg

SEQ ID NO: 801338 - DNA, 25 bp, Mus musculus
tgagtatgtccgagacatcggagag

SEQ ID NO: 801339 - DNA, 25 bp, Mus musculus
tgagtatgtccgtgacatcggagag

SEQ ID NO: 801340 - DNA, 25 bp, Mus musculus
tgagtatgtggcatggttggtccct

SEQ ID NO: 801341 - DNA, 25 bp, Mus musculus
tgagtatgtggcttggttggtccct

SEQ ID NO: 801342 - DNA, 25 bp, Mus musculus
tgagtattcacccaatccctcgtgg

SEQ ID NO: 801343 - DNA, 25 bp, Mus musculus
tgagtattcaccgaatccctcgtgg

SEQ ID NO: 801344 - DNA, 25 bp, Mus musculus
tgagtcaacggaagcactaagtcct

SEQ ID NO: 801345 - DNA, 25 bp, Mus musculus
tgagtcaacggatgcactaagtcct

SEQ ID NO: 801346 - DNA, 25 bp, Mus musculus
tgagtcaagaatacagcacatgctg

SEQ ID NO: 801347 - DNA, 25 bp, Mus musculus
tgagtcaagaattcagcacatgctg

SEQ ID NO: 801348 - DNA, 25 bp, Mus musculus
tgagtcacattgagaccagagcaaa

SEQ ID NO: 801349 - DNA, 25 bp, Mus musculus
tgagtcacattgtgaccagagcaaa

SEQ ID NO: 801350 - DNA, 25 bp, Mus musculus
tgagtcacctcaagatgccaaagcc

SEQ ID NO: 801351 - DNA, 25 bp, Mus musculus
tgagtcacctcatgatgccaaagcc

SEQ ID NO: 801352 - DNA, 25 bp, Mus musculus
tgagtcacgtcactccccatgatga

SEQ ID NO: 801353 - DNA, 25 bp, Mus musculus
tgagtcacgtcagtccccatgatga

SEQ ID NO: 801354 - DNA, 25 bp, Mus musculus
tgagtcactcacacaaacggaggcc

SEQ ID NO: 801355 - DNA, 25 bp, Mus musculus
tgagtcactcactcaaacggaggcc

SEQ ID NO: 801356 - DNA, 25 bp, Mus musculus
tgagtcactgcaacctctgggacaa

SEQ ID NO: 801357 - DNA, 25 bp, Mus musculus
tgagtcactgcatcctctgggacaa

SEQ ID NO: 801358 - DNA, 25 bp, Mus musculus
tgagtcagaaacacctggtgagaga

SEQ ID NO: 801359 - DNA, 25 bp, Mus musculus
tgagtcagaaactcctggtgagaga

SEQ ID NO: 801360 - DNA, 25 bp, Mus musculus
tgagtcagacctcggatttcagcaa

SEQ ID NO: 801361 - DNA, 25 bp, Mus musculus
tgagtcagacctgggatttcagcaa

SEQ ID NO: 801362 - DNA, 25 bp, Mus musculus
tgagtcagccgtcccacgtgaatgc

SEQ ID NO: 801363 - DNA, 25 bp, Mus musculus
tgagtcagccgtgccacgtgaatgc

SEQ ID NO: 801364 - DNA, 25 bp, Mus musculus
tgagtcaggattatgtcaatgggac

SEQ ID NO: 801365 - DNA, 25 bp, Mus musculus
tgagtcaggattttgtcaatgggac

SEQ ID NO: 801366 - DNA, 25 bp, Mus musculus
tgagtcaggtccactcgtccacaga

SEQ ID NO: 801367 - DNA, 25 bp, Mus musculus
tgagtcaggtcctctcgtccacaga

SEQ ID NO: 801368 - DNA, 25 bp, Mus musculus
tgagtcagtcatcagaaatattatg

SEQ ID NO: 801369 - DNA, 25 bp, Mus musculus
tgagtcagtcatgagaaatattatg

SEQ ID NO: 801370 - DNA, 25 bp, Mus musculus
tgagtcatctatccagtccaaattt

SEQ ID NO: 801371 - DNA, 25 bp, Mus musculus
tgagtcatctatgcagtccaaattt

SEQ ID NO: 801372 - DNA, 25 bp, Mus musculus
tgagtcatgaaactgtaaccattga

SEQ ID NO: 801373 - DNA, 25 bp, Mus musculus
tgagtcatgaaagtgtaaccattga

SEQ ID NO: 801374 - DNA, 25 bp, Mus musculus
tgagtcatggccacttgctggaaag

SEQ ID NO: 801375 - DNA, 25 bp, Mus musculus
tgagtcatggcctcttgctggaaag

SEQ ID NO: 801376 - DNA, 25 bp, Mus musculus
tgagtccaaattaaatcccagcagg

SEQ ID NO: 801377 - DNA, 25 bp, Mus musculus
tgagtccaaatttaatcccagcagg

SEQ ID NO: 801378 - DNA, 25 bp, Mus musculus
tgagtccaacaacatagcaattaag

SEQ ID NO: 801379 - DNA, 25 bp, Mus musculus
tgagtccaacaagatagcaattaag

SEQ ID NO: 801380 - DNA, 25 bp, Mus musculus
tgagtccacaccctagcctgacaat

SEQ ID NO: 801381 - DNA, 25 bp, Mus musculus
tgagtccacaccgtagcctgacaat

SEQ ID NO: 801382 - DNA, 25 bp, Mus musculus
tgagtccacagaacacatctttatg

SEQ ID NO: 801383 - DNA, 25 bp, Mus musculus
tgagtccacagatcacatctttatg

SEQ ID NO: 801384 - DNA, 25 bp, Mus musculus
tgagtccagaaaatacaacagaaga

SEQ ID NO: 801385 - DNA, 25 bp, Mus musculus
tgagtccagaaattacaacagaaga

SEQ ID NO: 801386 - DNA, 25 bp, Mus musculus
tgagtccccataaccaatgacaatg

SEQ ID NO: 801387 - DNA, 25 bp, Mus musculus
tgagtccccatatccaatgacaatg

SEQ ID NO: 801388 - DNA, 25 bp, Mus musculus
tgagtccccattctagagccaaaga

SEQ ID NO: 801389 - DNA, 25 bp, Mus musculus
tgagtccccattgtagagccaaaga

SEQ ID NO: 801390 - DNA, 25 bp, Mus musculus
tgagtcccgtaacctcagcgtccag

SEQ ID NO: 801391 - DNA, 25 bp, Mus musculus
tgagtcccgtaagctcagcgtccag

SEQ ID NO: 801392 - DNA, 25 bp, Mus musculus
tgagtcccgtagatcttcaggtgcc

SEQ ID NO: 801393 - DNA, 25 bp, Mus musculus
tgagtcccgtagttcttcaggtgcc

SEQ ID NO: 801394 - DNA, 25 bp, Mus musculus
tgagtccctggtactactgcaagag

SEQ ID NO: 801395 - DNA, 25 bp, Mus musculus
tgagtccctggttctactgcaagag

SEQ ID NO: 801396 - DNA, 25 bp, Mus musculus
tgagtccggagcagaactgcccgcg

SEQ ID NO: 801397 - DNA, 25 bp, Mus musculus
tgagtccggagctgaactgcccgcg

SEQ ID NO: 801398 - DNA, 25 bp, Mus musculus
tgagtccgtgctctgtgtgaagccc

SEQ ID NO: 801399 - DNA, 25 bp, Mus musculus
tgagtccgtgctgtgtgtgaagccc

SEQ ID NO: 801400 - DNA, 25 bp, Mus musculus
tgagtcctgacaccatcatggagat

SEQ ID NO: 801401 - DNA, 25 bp, Mus musculus
tgagtcctgacagcatcatggagat

SEQ ID NO: 801402 - DNA, 25 bp, Mus musculus
tgagtcctgcgaactatggagcctg

SEQ ID NO: 801403 - DNA, 25 bp, Mus musculus
tgagtcctgcgatctatggagcctg

SEQ ID NO: 801404 - DNA, 25 bp, Mus musculus
tgagtcctggtcatcaaaaagcccc

SEQ ID NO: 801405 - DNA, 25 bp, Mus musculus
tgagtcctggtcttcaaaaagcccc

SEQ ID NO: 801406 - DNA, 25 bp, Mus musculus
tgagtccttggcagtgtgggctgga

SEQ ID NO: 801407 - DNA, 25 bp, Mus musculus
tgagtccttggctgtgtgggctgga

SEQ ID NO: 801408 - DNA, 25 bp, Mus musculus
tgagtcctttgccttgccctactgg

SEQ ID NO: 801409 - DNA, 25 bp, Mus musculus
tgagtcctttgcgttgccctactgg

SEQ ID NO: 801410 - DNA, 25 bp, Mus musculus
tgagtcgcacagaaggctacatagg

SEQ ID NO: 801411 - DNA, 25 bp, Mus musculus
tgagtcgcacagtaggctacatagg

SEQ ID NO: 801412 - DNA, 25 bp, Mus musculus
tgagtcggacacatggaaaagagca

SEQ ID NO: 801413 - DNA, 25 bp, Mus musculus
tgagtcggacacttggaaaagagca

SEQ ID NO: 801414 - DNA, 25 bp, Mus musculus
tgagtcgtctttaatagagcagatg

SEQ ID NO: 801415 - DNA, 25 bp, Mus musculus
tgagtcgtcttttatagagcagatg

SEQ ID NO: 801416 - DNA, 25 bp, Mus musculus
tgagtctaaagtcagacatcgacat

SEQ ID NO: 801417 - DNA, 25 bp, Mus musculus
tgagtctaaagtgagacatcgacat

SEQ ID NO: 801418 - DNA, 25 bp, Mus musculus
tgagtctaacagctacaacctggtt

SEQ ID NO: 801419 - DNA, 25 bp, Mus musculus
tgagtctaacaggtacaacctggtt

SEQ ID NO: 801420 - DNA, 25 bp, Mus musculus
tgagtctagaccacattctcgccct

SEQ ID NO: 801421 - DNA, 25 bp, Mus musculus
tgagtctagacctcattctcgccct

SEQ ID NO: 801422 - DNA, 25 bp, Mus musculus
tgagtctatccccagctccgcggga

SEQ ID NO: 801423 - DNA, 25 bp, Mus musculus
tgagtctatcccgagctccgcggga

SEQ ID NO: 801424 - DNA, 25 bp, Mus musculus
tgagtctccagaaagctgcctgcct

SEQ ID NO: 801425 - DNA, 25 bp, Mus musculus
tgagtctccagatagctgcctgcct

SEQ ID NO: 801426 - DNA, 25 bp, Mus musculus
tgagtctcccagaagatgtactctt

SEQ ID NO: 801427 - DNA, 25 bp, Mus musculus
tgagtctcccagtagatgtactctt

SEQ ID NO: 801428 - DNA, 25 bp, Mus musculus
tgagtctcctaacctctccatgtga

SEQ ID NO: 801429 - DNA, 25 bp, Mus musculus
tgagtctcctaagctctccatgtga

SEQ ID NO: 801430 - DNA, 25 bp, Mus musculus
tgagtctcctatcggactctgcctg

SEQ ID NO: 801431 - DNA, 25 bp, Mus musculus
tgagtctcctatgggactctgcctg

SEQ ID NO: 801432 - DNA, 25 bp, Mus musculus
tgagtctcgcccacctatggtgtga

SEQ ID NO: 801433 - DNA, 25 bp, Mus musculus
tgagtctcgccctcctatggtgtga

SEQ ID NO: 801434 - DNA, 25 bp, Mus musculus
tgagtctcggcacgcccaggacctt

SEQ ID NO: 801435 - DNA, 25 bp, Mus musculus
tgagtctcggcaggcccaggacctt

SEQ ID NO: 801436 - DNA, 25 bp, Mus musculus
tgagtctctgcaccgtgagatccag

SEQ ID NO: 801437 - DNA, 25 bp, Mus musculus
tgagtctctgcagcgtgagatccag

SEQ ID NO: 801438 - DNA, 25 bp, Mus musculus
tgagtctctgccacgcgctgatgtt

SEQ ID NO: 801439 - DNA, 25 bp, Mus musculus
tgagtctctgcctcgcgctgatgtt

SEQ ID NO: 801440 - DNA, 25 bp, Mus musculus
tgagtctctggacgacttcacagac

SEQ ID NO: 801441 - DNA, 25 bp, Mus musculus
tgagtctctggaggacttcacagac

SEQ ID NO: 801442 - DNA, 25 bp, Mus musculus
tgagtctgaacccatataagggcag

SEQ ID NO: 801443 - DNA, 25 bp, Mus musculus
tgagtctgaaccgatataagggcag

SEQ ID NO: 801444 - DNA, 25 bp, Mus musculus
tgagtctgacaaaggtactggcaga

SEQ ID NO: 801445 - DNA, 25 bp, Mus musculus
tgagtctgacaatggtactggcaga

SEQ ID NO: 801446 - DNA, 25 bp, Mus musculus
tgagtctgaccgcagaacggagacc

SEQ ID NO: 801447 - DNA, 25 bp, Mus musculus
tgagtctgaccggagaacggagacc

SEQ ID NO: 801448 - DNA, 25 bp, Mus musculus
tgagtctgatgacagaaaacgaggc

SEQ ID NO: 801449 - DNA, 25 bp, Mus musculus
tgagtctgatgagagaaaacgaggc

SEQ ID NO: 801450 - DNA, 25 bp, Mus musculus
tgagtctgcagacgcttcccttgcc

SEQ ID NO: 801451 - DNA, 25 bp, Mus musculus
tgagtctgcagaggcttcccttgcc

SEQ ID NO: 801452 - DNA, 25 bp, Mus musculus
tgagtctgcggtcgcacgacatctg

SEQ ID NO: 801453 - DNA, 25 bp, Mus musculus
tgagtctgcggtggcacgacatctg

SEQ ID NO: 801454 - DNA, 25 bp, Mus musculus
tgagtctggcgcacaccatgcagag

SEQ ID NO: 801455 - DNA, 25 bp, Mus musculus
tgagtctggcgctcaccatgcagag

SEQ ID NO: 801456 - DNA, 25 bp, Mus musculus
tgagtctgggaaactgatcgttaag

SEQ ID NO: 801457 - DNA, 25 bp, Mus musculus
tgagtctgggaatctgatcgttaag

SEQ ID NO: 801458 - DNA, 25 bp, Mus musculus
tgagtcttcgcacagctatcacagg

SEQ ID NO: 801459 - DNA, 25 bp, Mus musculus
tgagtcttcgcagagctatcacagg

SEQ ID NO: 801460 - DNA, 25 bp, Mus musculus
tgagtcttcgggacttacctgcatc

SEQ ID NO: 801461 - DNA, 25 bp, Mus musculus
tgagtcttcgggtcttacctgcatc

SEQ ID NO: 801462 - DNA, 25 bp, Mus musculus
tgagtcttcgtcagggcactgaagg

SEQ ID NO: 801463 - DNA, 25 bp, Mus musculus
tgagtcttcgtctgggcactgaagg

SEQ ID NO: 801464 - DNA, 25 bp, Mus musculus
tgagtgaaaatgcagcattcctagc

SEQ ID NO: 801465 - DNA, 25 bp, Mus musculus
tgagtgaaaatggagcattcctagc

SEQ ID NO: 801466 - DNA, 25 bp, Mus musculus
tgagtgaacgtcactcccggcccaa

SEQ ID NO: 801467 - DNA, 25 bp, Mus musculus
tgagtgaacgtctctcccggcccaa

SEQ ID NO: 801468 - DNA, 25 bp, Mus musculus
tgagtgaacttgaccagctgcggca

SEQ ID NO: 801469 - DNA, 25 bp, Mus musculus
tgagtgaacttgtccagctgcggca

SEQ ID NO: 801470 - DNA, 25 bp, Mus musculus
tgagtgaagaacatgcagagactgc

SEQ ID NO: 801471 - DNA, 25 bp, Mus musculus
tgagtgaagaacttgcagagactgc

SEQ ID NO: 801472 - DNA, 25 bp, Mus musculus
tgagtgaataagctgtcgaataccg

SEQ ID NO: 801473 - DNA, 25 bp, Mus musculus
tgagtgaataaggtgtcgaataccg

SEQ ID NO: 801474 - DNA, 25 bp, Mus musculus
tgagtgaatgaaagggtcccgctgc

SEQ ID NO: 801475 - DNA, 25 bp, Mus musculus
tgagtgaatgaatgggtcccgctgc

SEQ ID NO: 801476 - DNA, 25 bp, Mus musculus
tgagtgacagcaaaacgatcttgga

SEQ ID NO: 801477 - DNA, 25 bp, Mus musculus
tgagtgacagcataacgatcttgga

SEQ ID NO: 801478 - DNA, 25 bp, Mus musculus
tgagtgacatgacgagccacgtaga

SEQ ID NO: 801479 - DNA, 25 bp, Mus musculus
tgagtgacatgaggagccacgtaga

SEQ ID NO: 801480 - DNA, 25 bp, Mus musculus
tgagtgaccggcactctgcaaggac

SEQ ID NO: 801481 - DNA, 25 bp, Mus musculus
tgagtgaccggctctctgcaaggac

SEQ ID NO: 801482 - DNA, 25 bp, Mus musculus
tgagtgacctgcatgccttttctgg

SEQ ID NO: 801483 - DNA, 25 bp, Mus musculus
tgagtgacctgcttgccttttctgg

SEQ ID NO: 801484 - DNA, 25 bp, Mus musculus
tgagtgactacaacctcacgggaac

SEQ ID NO: 801485 - DNA, 25 bp, Mus musculus
tgagtgactacatcctcacgggaac

SEQ ID NO: 801486 - DNA, 25 bp, Mus musculus
tgagtgactccaaggaatcaaagac

SEQ ID NO: 801487 - DNA, 25 bp, Mus musculus
tgagtgactccatggaatcaaagac

SEQ ID NO: 801488 - DNA, 25 bp, Mus musculus
tgagtgactgatccccagaagtccc

SEQ ID NO: 801489 - DNA, 25 bp, Mus musculus
tgagtgactgatgcccagaagtccc

SEQ ID NO: 801490 - DNA, 25 bp, Mus musculus
tgagtgactgttccccacacatagc

SEQ ID NO: 801491 - DNA, 25 bp, Mus musculus
tgagtgactgttgcccacacatagc

SEQ ID NO: 801492 - DNA, 25 bp, Mus musculus
tgagtgagagcaactaccgcagcaa

SEQ ID NO: 801493 - DNA, 25 bp, Mus musculus
tgagtgagagcatctaccgcagcaa

SEQ ID NO: 801494 - DNA, 25 bp, Mus musculus
tgagtgagctccaaggtctctggcc

SEQ ID NO: 801495 - DNA, 25 bp, Mus musculus
tgagtgagctcctaggtctctggcc

SEQ ID NO: 801496 - DNA, 25 bp, Mus musculus
tgagtgatagtcacgggatcgcgac

SEQ ID NO: 801497 - DNA, 25 bp, Mus musculus
tgagtgatagtctcgggatcgcgac

SEQ ID NO: 801498 - DNA, 25 bp, Mus musculus
tgagtgatatggcagagacccgaac

SEQ ID NO: 801499 - DNA, 25 bp, Mus musculus
tgagtgatatgggagagacccgaac

SEQ ID NO: 801500 - DNA, 25 bp, Mus musculus
tgagtgcaaactattcctaaccctg

SEQ ID NO: 801501 - DNA, 25 bp, Mus musculus
tgagtgcaaacttttcctaaccctg

SEQ ID NO: 801502 - DNA, 25 bp, Mus musculus
tgagtgcaatatccatacatctcct

SEQ ID NO: 801503 - DNA, 25 bp, Mus musculus
tgagtgcaatatgcatacatctcct

SEQ ID NO: 801504 - DNA, 25 bp, Mus musculus
tgagtgcaccatccgcatgaacgat

SEQ ID NO: 801505 - DNA, 25 bp, Mus musculus
tgagtgcaccatgcgcatgaacgat

SEQ ID NO: 801506 - DNA, 25 bp, Mus musculus
tgagtgcacctcaaatccctgcctg

SEQ ID NO: 801507 - DNA, 25 bp, Mus musculus
tgagtgcacctctaatccctgcctg

SEQ ID NO: 801508 - DNA, 25 bp, Mus musculus
tgagtgcactgacacagacacaggc

SEQ ID NO: 801509 - DNA, 25 bp, Mus musculus
tgagtgcactgagacagacacaggc

SEQ ID NO: 801510 - DNA, 25 bp, Mus musculus
tgagtgcagggcatacttgtctagc

SEQ ID NO: 801511 - DNA, 25 bp, Mus musculus
tgagtgcagggcttacttgtctagc

SEQ ID NO: 801512 - DNA, 25 bp, Mus musculus
tgagtgcatcagctcttagtttctt

SEQ ID NO: 801513 - DNA, 25 bp, Mus musculus
tgagtgcatcaggtcttagtttctt

SEQ ID NO: 801514 - DNA, 25 bp, Mus musculus
tgagtgccacttctcgtaaacggaa

SEQ ID NO: 801515 - DNA, 25 bp, Mus musculus
tgagtgccacttgtcgtaaacggaa

SEQ ID NO: 801516 - DNA, 25 bp, Mus musculus
tgagtgccaggaaccggctgcttgc

SEQ ID NO: 801517 - DNA, 25 bp, Mus musculus
tgagtgccaggatccggctgcttgc

SEQ ID NO: 801518 - DNA, 25 bp, Mus musculus
tgagtgccagtcctcctgaggccct

SEQ ID NO: 801519 - DNA, 25 bp, Mus musculus
tgagtgccagtcgtcctgaggccct

SEQ ID NO: 801520 - DNA, 25 bp, Mus musculus
tgagtgccatatcctgcagccaggg

SEQ ID NO: 801521 - DNA, 25 bp, Mus musculus
tgagtgccatatgctgcagccaggg

SEQ ID NO: 801522 - DNA, 25 bp, Mus musculus
tgagtgccatccagttgcgactctc

SEQ ID NO: 801523 - DNA, 25 bp, Mus musculus
tgagtgccatcctgttgcgactctc

SEQ ID NO: 801524 - DNA, 25 bp, Mus musculus
tgagtgcccaggaatgaacacgcac

SEQ ID NO: 801525 - DNA, 25 bp, Mus musculus
tgagtgcccaggtatgaacacgcac

SEQ ID NO: 801526 - DNA, 25 bp, Mus musculus
tgagtgccctaacttgtcagcccaa

SEQ ID NO: 801527 - DNA, 25 bp, Mus musculus
tgagtgccctaagttgtcagcccaa

SEQ ID NO: 801528 - DNA, 25 bp, Mus musculus
tgagtgccctcaccatggcgctgca

SEQ ID NO: 801529 - DNA, 25 bp, Mus musculus
tgagtgccctcagcatggcgctgca

SEQ ID NO: 801530 - DNA, 25 bp, Mus musculus
tgagtgccgagaactgaaccagcgg

SEQ ID NO: 801531 - DNA, 25 bp, Mus musculus
tgagtgccgagatctgaaccagcgg

SEQ ID NO: 801532 - DNA, 25 bp, Mus musculus
tgagtgccgattcaaccagaatatc

SEQ ID NO: 801533 - DNA, 25 bp, Mus musculus
tgagtgccgattgaaccagaatatc

SEQ ID NO: 801534 - DNA, 25 bp, Mus musculus
tgagtgcctgtcacagccctgccac

SEQ ID NO: 801535 - DNA, 25 bp, Mus musculus
tgagtgcctgtctcagccctgccac

SEQ ID NO: 801536 - DNA, 25 bp, Mus musculus
tgagtgcgaatgcttcagacctccc

SEQ ID NO: 801537 - DNA, 25 bp, Mus musculus
tgagtgcgaatggttcagacctccc

SEQ ID NO: 801538 - DNA, 25 bp, Mus musculus
tgagtgcgtggaagagcagtgcagc

SEQ ID NO: 801539 - DNA, 25 bp, Mus musculus
tgagtgcgtggatgagcagtgcagc

SEQ ID NO: 801540 - DNA, 25 bp, Mus musculus
tgagtgctcagaaagataatacgga

SEQ ID NO: 801541 - DNA, 25 bp, Mus musculus
tgagtgctcagatagataatacgga

SEQ ID NO: 801542 - DNA, 25 bp, Mus musculus
tgagtgctccgtcaagcatagccgg

SEQ ID NO: 801543 - DNA, 25 bp, Mus musculus
tgagtgctccgtgaagcatagccgg

SEQ ID NO: 801544 - DNA, 25 bp, Mus musculus
tgagtgctgctaatctcaccccaca

SEQ ID NO: 801545 - DNA, 25 bp, Mus musculus
tgagtgctgctattctcaccccaca

SEQ ID NO: 801546 - DNA, 25 bp, Mus musculus
tgagtgctgctcagccgtgtgtcct

SEQ ID NO: 801547 - DNA, 25 bp, Mus musculus
tgagtgctgctctgccgtgtgtcct

SEQ ID NO: 801548 - DNA, 25 bp, Mus musculus
tgagtgcttgtacagcgtagaccct

SEQ ID NO: 801549 - DNA, 25 bp, Mus musculus
tgagtgcttgtagagcgtagaccct

SEQ ID NO: 801550 - DNA, 25 bp, Mus musculus
tgagtggacagccaatgtcacggcc

SEQ ID NO: 801551 - DNA, 25 bp, Mus musculus
tgagtggacagcgaatgtcacggcc

SEQ ID NO: 801552 - DNA, 25 bp, Mus musculus
tgagtggaccgaacgggactgcaca

SEQ ID NO: 801553 - DNA, 25 bp, Mus musculus
tgagtggaccgatcgggactgcaca

SEQ ID NO: 801554 - DNA, 25 bp, Mus musculus
tgagtggagctcaggcccggatgga

SEQ ID NO: 801555 - DNA, 25 bp, Mus musculus
tgagtggagctctggcccggatgga

SEQ ID NO: 801556 - DNA, 25 bp, Mus musculus
tgagtggatagaactgagcatggct

SEQ ID NO: 801557 - DNA, 25 bp, Mus musculus
tgagtggatagatctgagcatggct

SEQ ID NO: 801558 - DNA, 25 bp, Mus musculus
tgagtggattgaactgatatttggc

SEQ ID NO: 801559 - DNA, 25 bp, Mus musculus
tgagtggattgatctgatatttggc

SEQ ID NO: 801560 - DNA, 25 bp, Mus musculus
tgagtggcaaaaacaacatgaattc

SEQ ID NO: 801561 - DNA, 25 bp, Mus musculus
tgagtggcaaaatcaacatgaattc

SEQ ID NO: 801562 - DNA, 25 bp, Mus musculus
tgagtggcaaaccagacgggacctt

SEQ ID NO: 801563 - DNA, 25 bp, Mus musculus
tgagtggcaaacgagacgggacctt

SEQ ID NO: 801564 - DNA, 25 bp, Mus musculus
tgagtggcatgtcggaccatctgca

SEQ ID NO: 801565 - DNA, 25 bp, Mus musculus
tgagtggcatgtgggaccatctgca

SEQ ID NO: 801566 - DNA, 25 bp, Mus musculus
tgagtggccactatatttgagaccc

SEQ ID NO: 801567 - DNA, 25 bp, Mus musculus
tgagtggccactttatttgagaccc

SEQ ID NO: 801568 - DNA, 25 bp, Mus musculus
tgagtggcccatagcctgagacacc

SEQ ID NO: 801569 - DNA, 25 bp, Mus musculus
tgagtggcccattgcctgagacacc

SEQ ID NO: 801570 - DNA, 25 bp, Mus musculus
tgagtggcctaacttggttccagag

SEQ ID NO: 801571 - DNA, 25 bp, Mus musculus
tgagtggcctaagttggttccagag

SEQ ID NO: 801572 - DNA, 25 bp, Mus musculus
tgagtggcgagtagccaaaaaagcg

SEQ ID NO: 801573 - DNA, 25 bp, Mus musculus
tgagtggcgagttgccaaaaaagcg

SEQ ID NO: 801574 - DNA, 25 bp, Mus musculus
tgagtggcgcatccagaacattgcc

SEQ ID NO: 801575 - DNA, 25 bp, Mus musculus
tgagtggcgcatgcagaacattgcc

SEQ ID NO: 801576 - DNA, 25 bp, Mus musculus
tgagtggctgaacagaaacaaccct

SEQ ID NO: 801577 - DNA, 25 bp, Mus musculus
tgagtggctgaagagaaacaaccct

SEQ ID NO: 801578 - DNA, 25 bp, Mus musculus
tgagtggctgagcaaatacaatcct

SEQ ID NO: 801579 - DNA, 25 bp, Mus musculus
tgagtggctgaggaaatacaatcct

SEQ ID NO: 801580 - DNA, 25 bp, Mus musculus
tgagtggctgcccaattatatcccg

SEQ ID NO: 801581 - DNA, 25 bp, Mus musculus
tgagtggctgccgaattatatcccg

SEQ ID NO: 801582 - DNA, 25 bp, Mus musculus
tgagtgggatggcagaaaacacctc

SEQ ID NO: 801583 - DNA, 25 bp, Mus musculus
tgagtgggatgggagaaaacacctc

SEQ ID NO: 801584 - DNA, 25 bp, Mus musculus
tgagtgggccatcgcacttgtgctc

SEQ ID NO: 801585 - DNA, 25 bp, Mus musculus
tgagtgggccatggcacttgtgctc

SEQ ID NO: 801586 - DNA, 25 bp, Mus musculus
tgagtgggctgaatgtaccaccctt

SEQ ID NO: 801587 - DNA, 25 bp, Mus musculus
tgagtgggctgattgtaccaccctt

SEQ ID NO: 801588 - DNA, 25 bp, Mus musculus
tgagtggtactacccctaggcaggt

SEQ ID NO: 801589 - DNA, 25 bp, Mus musculus
tgagtggtactagccctaggcaggt

SEQ ID NO: 801590 - DNA, 25 bp, Mus musculus
tgagtggtcccacacagctgcatct

SEQ ID NO: 801591 - DNA, 25 bp, Mus musculus
tgagtggtcccagacagctgcatct

SEQ ID NO: 801592 - DNA, 25 bp, Mus musculus
tgagtggtcctgagattagccgagc

SEQ ID NO: 801593 - DNA, 25 bp, Mus musculus
tgagtggtcctgtgattagccgagc

SEQ ID NO: 801594 - DNA, 25 bp, Mus musculus
tgagtggtctcgatagcagccagtg

SEQ ID NO: 801595 - DNA, 25 bp, Mus musculus
tgagtggtctcgttagcagccagtg

SEQ ID NO: 801596 - DNA, 25 bp, Mus musculus
tgagtggtctctacccacccagtag

SEQ ID NO: 801597 - DNA, 25 bp, Mus musculus
tgagtggtctcttcccacccagtag

SEQ ID NO: 801598 - DNA, 25 bp, Mus musculus
tgagtggtctgcagtaccccggtct

SEQ ID NO: 801599 - DNA, 25 bp, Mus musculus
tgagtggtctgctgtaccccggtct

SEQ ID NO: 801600 - DNA, 25 bp, Mus musculus
tgagtggtcttacaacagtcctgcc

SEQ ID NO: 801601 - DNA, 25 bp, Mus musculus
tgagtggtcttagaacagtcctgcc

SEQ ID NO: 801602 - DNA, 25 bp, Mus musculus
tgagtgtcacatcgaagaaacaacc

SEQ ID NO: 801603 - DNA, 25 bp, Mus musculus
tgagtgtcacatggaagaaacaacc

SEQ ID NO: 801604 - DNA, 25 bp, Mus musculus
tgagtgtcaggtcttgagtgaactc

SEQ ID NO: 801605 - DNA, 25 bp, Mus musculus
tgagtgtcaggtgttgagtgaactc

SEQ ID NO: 801606 - DNA, 25 bp, Mus musculus
tgagtgtcatctcaatcccatcatc

SEQ ID NO: 801607 - DNA, 25 bp, Mus musculus
tgagtgtcatctgaatcccatcatc

SEQ ID NO: 801608 - DNA, 25 bp, Mus musculus
tgagtgtcccaaagtcgctctgacc

SEQ ID NO: 801609 - DNA, 25 bp, Mus musculus
tgagtgtcccaatgtcgctctgacc

SEQ ID NO: 801610 - DNA, 25 bp, Mus musculus
tgagtgtcccctctctatgtttccc

SEQ ID NO: 801611 - DNA, 25 bp, Mus musculus
tgagtgtcccctgtctatgtttccc

SEQ ID NO: 801612 - DNA, 25 bp, Mus musculus
tgagtgtctaagagagggcttccct

SEQ ID NO: 801613 - DNA, 25 bp, Mus musculus
tgagtgtctaagtgagggcttccct

SEQ ID NO: 801614 - DNA, 25 bp, Mus musculus
tgagtgtcttcgaaaccgctttgga

SEQ ID NO: 801615 - DNA, 25 bp, Mus musculus
tgagtgtcttcgtaaccgctttgga

SEQ ID NO: 801616 - DNA, 25 bp, Mus musculus
tgagtgtgaacgaccatggcgatga

SEQ ID NO: 801617 - DNA, 25 bp, Mus musculus
tgagtgtgaacgtccatggcgatga

SEQ ID NO: 801618 - DNA, 25 bp, Mus musculus
tgagtgtgatcaacctgggtcttgc

SEQ ID NO: 801619 - DNA, 25 bp, Mus musculus
tgagtgtgatcatcctgggtcttgc

SEQ ID NO: 801620 - DNA, 25 bp, Mus musculus
tgagtgtgatgtcgcccaactccaa

SEQ ID NO: 801621 - DNA, 25 bp, Mus musculus
tgagtgtgatgtggcccaactccaa

SEQ ID NO: 801622 - DNA, 25 bp, Mus musculus
tgagtgtgcaaacatgctctgcgac

SEQ ID NO: 801623 - DNA, 25 bp, Mus musculus
tgagtgtgcaaagatgctctgcgac

SEQ ID NO: 801624 - DNA, 25 bp, Mus musculus
tgagtgtgcatgaccgctcgctgaa

SEQ ID NO: 801625 - DNA, 25 bp, Mus musculus
tgagtgtgcatgcagctaggaaacc

SEQ ID NO: 801626 - DNA, 25 bp, Mus musculus
tgagtgtgcatggagctaggaaacc

SEQ ID NO: 801627 - DNA, 25 bp, Mus musculus
tgagtgtgcatgtccgctcgctgaa

SEQ ID NO: 801628 - DNA, 25 bp, Mus musculus
tgagtgtgcccaagggctcgatgac

SEQ ID NO: 801629 - DNA, 25 bp, Mus musculus
tgagtgtgcccatgggctcgatgac

SEQ ID NO: 801630 - DNA, 25 bp, Mus musculus
tgagtgtgcgccaacatgtccggca

SEQ ID NO: 801631 - DNA, 25 bp, Mus musculus
tgagtgtgcgcctacatgtccggca

SEQ ID NO: 801632 - DNA, 25 bp, Mus musculus
tgagtgtggacaacgatcccaccat

SEQ ID NO: 801633 - DNA, 25 bp, Mus musculus
tgagtgtggacatcgatcccaccat

SEQ ID NO: 801634 - DNA, 25 bp, Mus musculus
tgagtgtggcctcacgcctaggtcc

SEQ ID NO: 801635 - DNA, 25 bp, Mus musculus
tgagtgtggcctgacgcctaggtcc

SEQ ID NO: 801636 - DNA, 25 bp, Mus musculus
tgagtgtgtcagctcttgtcacctg

SEQ ID NO: 801637 - DNA, 25 bp, Mus musculus
tgagtgtgtcaggtcttgtcacctg

SEQ ID NO: 801638 - DNA, 25 bp, Mus musculus
tgagtgtgtgaaaagcccatgtcgc

SEQ ID NO: 801639 - DNA, 25 bp, Mus musculus
tgagtgtgtgaacacagaaggctcc

SEQ ID NO: 801640 - DNA, 25 bp, Mus musculus
tgagtgtgtgaagacagaaggctcc

SEQ ID NO: 801641 - DNA, 25 bp, Mus musculus
tgagtgtgtgaatagcccatgtcgc

SEQ ID NO: 801642 - DNA, 25 bp, Mus musculus
tgagtgttccaaaaagactggccgc

SEQ ID NO: 801643 - DNA, 25 bp, Mus musculus
tgagtgttccaataagactggccgc

SEQ ID NO: 801644 - DNA, 25 bp, Mus musculus
tgagtgttgcagacggaagaggttc

SEQ ID NO: 801645 - DNA, 25 bp, Mus musculus
tgagtgttgcagtcggaagaggttc

SEQ ID NO: 801646 - DNA, 25 bp, Mus musculus
tgagtgttgtggagctcttcatctt

SEQ ID NO: 801647 - DNA, 25 bp, Mus musculus
tgagtgttgtggtgctcttcatctt

SEQ ID NO: 801648 - DNA, 25 bp, Mus musculus
tgagtgtttcgaaaaagcctgccgc

SEQ ID NO: 801649 - DNA, 25 bp, Mus musculus
tgagtgtttcgataaagcctgccgc

SEQ ID NO: 801650 - DNA, 25 bp, Mus musculus
tgagttaacgtgagaagccatcggg

SEQ ID NO: 801651 - DNA, 25 bp, Mus musculus
tgagttaacgtgtgaagccatcggg

SEQ ID NO: 801652 - DNA, 25 bp, Mus musculus
tgagttaatggacccagctacccat

SEQ ID NO: 801653 - DNA, 25 bp, Mus musculus
tgagttaatggagccagctacccat

SEQ ID NO: 801654 - DNA, 25 bp, Mus musculus
tgagttacagacacacccggagctg

SEQ ID NO: 801655 - DNA, 25 bp, Mus musculus
tgagttacagactcacccggagctg

SEQ ID NO: 801656 - DNA, 25 bp, Mus musculus
tgagttacagccctgcttagctccg

SEQ ID NO: 801657 - DNA, 25 bp, Mus musculus
tgagttacagccgtgcttagctccg

SEQ ID NO: 801658 - DNA, 25 bp, Mus musculus
tgagttacagctcccaagtttggcc

SEQ ID NO: 801659 - DNA, 25 bp, Mus musculus
tgagttacagctgccaagtttggcc

SEQ ID NO: 801660 - DNA, 25 bp, Mus musculus
tgagttacctcaatccttcaccgtc

SEQ ID NO: 801661 - DNA, 25 bp, Mus musculus
tgagttacctcattccttcaccgtc

SEQ ID NO: 801662 - DNA, 25 bp, Mus musculus
tgagttactagacgctccctttgtg

SEQ ID NO: 801663 - DNA, 25 bp, Mus musculus
tgagttactagaggctccctttgtg

SEQ ID NO: 801664 - DNA, 25 bp, Mus musculus
tgagttagaaggaccagcccctgct

SEQ ID NO: 801665 - DNA, 25 bp, Mus musculus
tgagttagaaggtccagcccctgct

SEQ ID NO: 801666 - DNA, 25 bp, Mus musculus
tgagttagtggtcgcttttagacat

SEQ ID NO: 801667 - DNA, 25 bp, Mus musculus
tgagttagtggtggcttttagacat

SEQ ID NO: 801668 - DNA, 25 bp, Mus musculus
tgagttatgtcgacatcgctatccc

SEQ ID NO: 801669 - DNA, 25 bp, Mus musculus
tgagttatgtcgtcatcgctatccc

SEQ ID NO: 801670 - DNA, 25 bp, Mus musculus
tgagttatgtgtaggttccttccag

SEQ ID NO: 801671 - DNA, 25 bp, Mus musculus
tgagttatgtgttggttccttccag

SEQ ID NO: 801672 - DNA, 25 bp, Mus musculus
tgagttcaactgcaacatccgggct

SEQ ID NO: 801673 - DNA, 25 bp, Mus musculus
tgagttcaactggaacatccgggct

SEQ ID NO: 801674 - DNA, 25 bp, Mus musculus
tgagttcaagttcatcccaggactc

SEQ ID NO: 801675 - DNA, 25 bp, Mus musculus
tgagttcaagttgatcccaggactc

SEQ ID NO: 801676 - DNA, 25 bp, Mus musculus
tgagttcacttgctccagtggccgc

SEQ ID NO: 801677 - DNA, 25 bp, Mus musculus
tgagttcacttggtccagtggccgc

SEQ ID NO: 801678 - DNA, 25 bp, Mus musculus
tgagttcagaacagggtgagcacct

SEQ ID NO: 801679 - DNA, 25 bp, Mus musculus
tgagttcagaactgggtgagcacct

SEQ ID NO: 801680 - DNA, 25 bp, Mus musculus
tgagttcagaatatggatccagatc

SEQ ID NO: 801681 - DNA, 25 bp, Mus musculus
tgagttcagaatttggatccagatc

SEQ ID NO: 801682 - DNA, 25 bp, Mus musculus
tgagttcagcataactggatccaca

SEQ ID NO: 801683 - DNA, 25 bp, Mus musculus
tgagttcagcattactggatccaca

SEQ ID NO: 801684 - DNA, 25 bp, Mus musculus
tgagttcatcggagccttggccatg

SEQ ID NO: 801685 - DNA, 25 bp, Mus musculus
tgagttcatcggtgccttggccatg

SEQ ID NO: 801686 - DNA, 25 bp, Mus musculus
tgagttcatctcaaaggcctttcac

SEQ ID NO: 801687 - DNA, 25 bp, Mus musculus
tgagttcatctctaaggcctttcac

SEQ ID NO: 801688 - DNA, 25 bp, Mus musculus
tgagttcatggacgcagcgtcttcc

SEQ ID NO: 801689 - DNA, 25 bp, Mus musculus
tgagttcatggaggcagcgtcttcc

SEQ ID NO: 801690 - DNA, 25 bp, Mus musculus
tgagttcattgaaagttgccaaaaa

SEQ ID NO: 801691 - DNA, 25 bp, Mus musculus
tgagttcattgatagttgccaaaaa

SEQ ID NO: 801692 - DNA, 25 bp, Mus musculus
tgagttccagatagatgacacctac

SEQ ID NO: 801693 - DNA, 25 bp, Mus musculus
tgagttccagattgatgacacctac

SEQ ID NO: 801694 - DNA, 25 bp, Mus musculus
tgagttccagctcccactattcttc

SEQ ID NO: 801695 - DNA, 25 bp, Mus musculus
tgagttccagctgccactattcttc

SEQ ID NO: 801696 - DNA, 25 bp, Mus musculus
tgagttcccacgaccagcaaacgtg

SEQ ID NO: 801697 - DNA, 25 bp, Mus musculus
tgagttcccacgtccagcaaacgtg

SEQ ID NO: 801698 - DNA, 25 bp, Mus musculus
tgagttcccagaagagctccttcat

SEQ ID NO: 801699 - DNA, 25 bp, Mus musculus
tgagttcccagatgagctccttcat

SEQ ID NO: 801700 - DNA, 25 bp, Mus musculus
tgagttccccggaagagccgaccga

SEQ ID NO: 801701 - DNA, 25 bp, Mus musculus
tgagttccccggtagagccgaccga

SEQ ID NO: 801702 - DNA, 25 bp, Mus musculus
tgagttccggcgagagcgcttcact

SEQ ID NO: 801703 - DNA, 25 bp, Mus musculus
tgagttccggcgtgagcgcttcact

SEQ ID NO: 801704 - DNA, 25 bp, Mus musculus
tgagttcctcaactttcttttgaaa

SEQ ID NO: 801705 - DNA, 25 bp, Mus musculus
tgagttcctcaagtttcttttgaaa

SEQ ID NO: 801706 - DNA, 25 bp, Mus musculus
tgagttcctccgaagtatgtccccg

SEQ ID NO: 801707 - DNA, 25 bp, Mus musculus
tgagttcctccgtagtatgtccccg

SEQ ID NO: 801708 - DNA, 25 bp, Mus musculus
tgagttccttagaatccaatttcga

SEQ ID NO: 801709 - DNA, 25 bp, Mus musculus
tgagttccttagtatccaatttcga

SEQ ID NO: 801710 - DNA, 25 bp, Mus musculus
tgagttcgattcctgcctcgcacac

SEQ ID NO: 801711 - DNA, 25 bp, Mus musculus
tgagttcgattcgtgcctcgcacac

SEQ ID NO: 801712 - DNA, 25 bp, Mus musculus
tgagttctaggaatcgaacccgggt

SEQ ID NO: 801713 - DNA, 25 bp, Mus musculus
tgagttctaggattcgaacccgggt

SEQ ID NO: 801714 - DNA, 25 bp, Mus musculus
tgagttctcagcataaggacccaaa

SEQ ID NO: 801715 - DNA, 25 bp, Mus musculus
tgagttctcagcatcttgcttcacc

SEQ ID NO: 801716 - DNA, 25 bp, Mus musculus
tgagttctcagcttaaggacccaaa

SEQ ID NO: 801717 - DNA, 25 bp, Mus musculus
tgagttctcagcttcttgcttcacc

SEQ ID NO: 801718 - DNA, 25 bp, Mus musculus
tgagttctgagtacctgcgcttcaa

SEQ ID NO: 801719 - DNA, 25 bp, Mus musculus
tgagttctgagttcctgcgcttcaa

SEQ ID NO: 801720 - DNA, 25 bp, Mus musculus
tgagttctgcccaggagatagctct

SEQ ID NO: 801721 - DNA, 25 bp, Mus musculus
tgagttctgccctggagatagctct

SEQ ID NO: 801722 - DNA, 25 bp, Mus musculus
tgagttcttcaacccatatccccgg

SEQ ID NO: 801723 - DNA, 25 bp, Mus musculus
tgagttcttcaagccatatccccgg

SEQ ID NO: 801724 - DNA, 25 bp, Mus musculus
tgagttcttcatcccaggccttgtt

SEQ ID NO: 801725 - DNA, 25 bp, Mus musculus
tgagttcttcatgccaggccttgtt

SEQ ID NO: 801726 - DNA, 25 bp, Mus musculus
tgagttcttcccatatccagtggcg

SEQ ID NO: 801727 - DNA, 25 bp, Mus musculus
tgagttcttcccttatccagtggcg

SEQ ID NO: 801728 - DNA, 25 bp, Mus musculus
tgagttgacaaccttaaccaccaca

SEQ ID NO: 801729 - DNA, 25 bp, Mus musculus
tgagttgacaacgttaaccaccaca

SEQ ID NO: 801730 - DNA, 25 bp, Mus musculus
tgagttgagtggacctgagtctgca

SEQ ID NO: 801731 - DNA, 25 bp, Mus musculus
tgagttgagtggtcctgagtctgca

SEQ ID NO: 801732 - DNA, 25 bp, Mus musculus
tgagttgcactgctatgatgtggac

SEQ ID NO: 801733 - DNA, 25 bp, Mus musculus
tgagttgcactggtatgatgtggac

SEQ ID NO: 801734 - DNA, 25 bp, Mus musculus
tgagttgcatgtagtacgaggatcc

SEQ ID NO: 801735 - DNA, 25 bp, Mus musculus
tgagttgcatgttgtacgaggatcc

SEQ ID NO: 801736 - DNA, 25 bp, Mus musculus
tgagttgccataaaggttccatgaa

SEQ ID NO: 801737 - DNA, 25 bp, Mus musculus
tgagttgccatataggttccatgaa

SEQ ID NO: 801738 - DNA, 25 bp, Mus musculus
tgagttgccatcagtcttgaatgcc

SEQ ID NO: 801739 - DNA, 25 bp, Mus musculus
tgagttgccatctgtcttgaatgcc

SEQ ID NO: 801740 - DNA, 25 bp, Mus musculus
tgagttggaggacctacttcgatac

SEQ ID NO: 801741 - DNA, 25 bp, Mus musculus
tgagttggaggagctacttcgatac

SEQ ID NO: 801742 - DNA, 25 bp, Mus musculus
tgagttggcacaacaagagatggaa

SEQ ID NO: 801743 - DNA, 25 bp, Mus musculus
tgagttggcacatcaagagatggaa

SEQ ID NO: 801744 - DNA, 25 bp, Mus musculus
tgagttggtcaacaagtatggcacc

SEQ ID NO: 801745 - DNA, 25 bp, Mus musculus
tgagttggtcaagaagtatggcacc

SEQ ID NO: 801746 - DNA, 25 bp, Mus musculus
tgagttgtcaggagccctggaagac

SEQ ID NO: 801747 - DNA, 25 bp, Mus musculus
tgagttgtcaggtgccctggaagac

SEQ ID NO: 801748 - DNA, 25 bp, Mus musculus
tgagtttacaagcagataccaaaaa

SEQ ID NO: 801749 - DNA, 25 bp, Mus musculus
tgagtttacaaggagataccaaaaa

SEQ ID NO: 801750 - DNA, 25 bp, Mus musculus
tgagtttacttcaccgccatcattg

SEQ ID NO: 801751 - DNA, 25 bp, Mus musculus
tgagtttacttctccgccatcattg

SEQ ID NO: 801752 - DNA, 25 bp, Mus musculus
tgagtttacttgctgaggcgcccgt

SEQ ID NO: 801753 - DNA, 25 bp, Mus musculus
tgagtttacttggtgaggcgcccgt

SEQ ID NO: 801754 - DNA, 25 bp, Mus musculus
tgagtttagttcacccacatcaggc

SEQ ID NO: 801755 - DNA, 25 bp, Mus musculus
tgagtttagttctcccacatcaggc

SEQ ID NO: 801756 - DNA, 25 bp, Mus musculus
tgagtttcaggaccatggccaagaa

SEQ ID NO: 801757 - DNA, 25 bp, Mus musculus
tgagtttcaggagcatggccaagaa

SEQ ID NO: 801758 - DNA, 25 bp, Mus musculus
tgagtttcatccagtccagtgcagc

SEQ ID NO: 801759 - DNA, 25 bp, Mus musculus
tgagtttcatcctgtccagtgcagc

SEQ ID NO: 801760 - DNA, 25 bp, Mus musculus
tgagtttccaatccccaacgaggag

SEQ ID NO: 801761 - DNA, 25 bp, Mus musculus
tgagtttccaatgcccaacgaggag

SEQ ID NO: 801762 - DNA, 25 bp, Mus musculus
tgagtttcccttccacttcagtgga

SEQ ID NO: 801763 - DNA, 25 bp, Mus musculus
tgagtttcccttgcacttcagtgga

SEQ ID NO: 801764 - DNA, 25 bp, Mus musculus
tgagtttcggtaacgcccaagcttc

SEQ ID NO: 801765 - DNA, 25 bp, Mus musculus
tgagtttcggtatcgcccaagcttc

SEQ ID NO: 801766 - DNA, 25 bp, Mus musculus
tgagtttctgctcgcctatgaggca

SEQ ID NO: 801767 - DNA, 25 bp, Mus musculus
tgagtttctgctggcctatgaggca

SEQ ID NO: 801768 - DNA, 25 bp, Mus musculus
tgagtttgaatccttagtctgctga

SEQ ID NO: 801769 - DNA, 25 bp, Mus musculus
tgagtttgaatcgttagtctgctga

SEQ ID NO: 801770 - DNA, 25 bp, Mus musculus
tgagtttgagaccaagtgcaacaat

SEQ ID NO: 801771 - DNA, 25 bp, Mus musculus
tgagtttgagacgaagtgcaacaat

SEQ ID NO: 801772 - DNA, 25 bp, Mus musculus
tgagtttgatgcctacatcattgtg

SEQ ID NO: 801773 - DNA, 25 bp, Mus musculus
tgagtttgatgcgtacatcattgtg

SEQ ID NO: 801774 - DNA, 25 bp, Mus musculus
tgagtttgcagacagatcagtaacc

SEQ ID NO: 801775 - DNA, 25 bp, Mus musculus
tgagtttgcagagagatcagtaacc

SEQ ID NO: 801776 - DNA, 25 bp, Mus musculus
tgagtttgtagaaaaacgaagagcg

SEQ ID NO: 801777 - DNA, 25 bp, Mus musculus
tgagtttgtagataaacgaagagcg

SEQ ID NO: 801778 - DNA, 25 bp, Mus musculus
tgagtttgttcacaagctacagagt

SEQ ID NO: 801779 - DNA, 25 bp, Mus musculus
tgagtttgttcagaagctacagagt

SEQ ID NO: 801780 - DNA, 25 bp, Mus musculus
tgagttttaccacgcacactaccag

SEQ ID NO: 801781 - DNA, 25 bp, Mus musculus
tgagttttaccaggcacactaccag

SEQ ID NO: 801782 - DNA, 25 bp, Mus musculus
tgagttttccatccataatccaagg

SEQ ID NO: 801783 - DNA, 25 bp, Mus musculus
tgagttttccatgcataatccaagg

SEQ ID NO: 801784 - DNA, 25 bp, Mus musculus
tgagttttccccatattctgagctg

SEQ ID NO: 801785 - DNA, 25 bp, Mus musculus
tgagttttccccttattctgagctg

SEQ ID NO: 801786 - DNA, 25 bp, Mus musculus
tgagtttttggaccatctggagccc

SEQ ID NO: 801787 - DNA, 25 bp, Mus musculus
tgagtttttggagcatctggagccc

SEQ ID NO: 801788 - DNA, 25 bp, Mus musculus
tgataaaaaagcctgttccttctcc

SEQ ID NO: 801789 - DNA, 25 bp, Mus musculus
tgataaaaaagcgtgttccttctcc

SEQ ID NO: 801790 - DNA, 25 bp, Mus musculus
tgataaaactccctggcagtgcccc

SEQ ID NO: 801791 - DNA, 25 bp, Mus musculus
tgataaaactccgtggcagtgcccc

SEQ ID NO: 801792 - DNA, 25 bp, Mus musculus
tgataaacactaatcccgggagcag

SEQ ID NO: 801793 - DNA, 25 bp, Mus musculus
tgataaacactattcccgggagcag

SEQ ID NO: 801794 - DNA, 25 bp, Mus musculus
tgataaacctggcacacaccaggcc

SEQ ID NO: 801795 - DNA, 25 bp, Mus musculus
tgataaacctgggacacaccaggcc

SEQ ID NO: 801796 - DNA, 25 bp, Mus musculus
tgataaactcctctgtacatgtcgt

SEQ ID NO: 801797 - DNA, 25 bp, Mus musculus
tgataaactcctgtgtacatgtcgt

SEQ ID NO: 801798 - DNA, 25 bp, Mus musculus
tgataaacttggagaccaaatggcc

SEQ ID NO: 801799 - DNA, 25 bp, Mus musculus
tgataaacttggtgaccaaatggcc

SEQ ID NO: 801800 - DNA, 25 bp, Mus musculus
tgataaagaaaaaggcctcatttgc

SEQ ID NO: 801801 - DNA, 25 bp, Mus musculus
tgataaagaaaatggcctcatttgc

SEQ ID NO: 801802 - DNA, 25 bp, Mus musculus
tgataaagcagtatgtgtctgacgt

SEQ ID NO: 801803 - DNA, 25 bp, Mus musculus
tgataaagcagtttgtgtctgacgt

SEQ ID NO: 801804 - DNA, 25 bp, Mus musculus
tgataaagccagaagcatccagtca

SEQ ID NO: 801805 - DNA, 25 bp, Mus musculus
tgataaagccagtagcatccagtca

SEQ ID NO: 801806 - DNA, 25 bp, Mus musculus
tgataaaggaccagtgtgactgagg

SEQ ID NO: 801807 - DNA, 25 bp, Mus musculus
tgataaaggacctgtgtgactgagg

SEQ ID NO: 801808 - DNA, 25 bp, Mus musculus
tgataaatacccacacgagagcgag

SEQ ID NO: 801809 - DNA, 25 bp, Mus musculus
tgataaataccctcacgagagcgag

SEQ ID NO: 801810 - DNA, 25 bp, Mus musculus
tgataaatctggaccatggtgcagg

SEQ ID NO: 801811 - DNA, 25 bp, Mus musculus
tgataaatctggtccatggtgcagg

SEQ ID NO: 801812 - DNA, 25 bp, Mus musculus
tgataaatgacacgatggagcttcg

SEQ ID NO: 801813 - DNA, 25 bp, Mus musculus
tgataaatgacaggatggagcttcg

SEQ ID NO: 801814 - DNA, 25 bp, Mus musculus
tgataaatttttcttgccgaaagct

SEQ ID NO: 801815 - DNA, 25 bp, Mus musculus
tgataaatttttgttgccgaaagct

SEQ ID NO: 801816 - DNA, 25 bp, Mus musculus
tgataacaaccgcaagtgagagctg

SEQ ID NO: 801817 - DNA, 25 bp, Mus musculus
tgataacaaccggaagtgagagctg

SEQ ID NO: 801818 - DNA, 25 bp, Mus musculus
tgataacaagttcacacatacggac

SEQ ID NO: 801819 - DNA, 25 bp, Mus musculus
tgataacaagttgacacatacggac

SEQ ID NO: 801820 - DNA, 25 bp, Mus musculus
tgataacacagtccagggcgactcc

SEQ ID NO: 801821 - DNA, 25 bp, Mus musculus
tgataacacagtgcagggcgactcc

SEQ ID NO: 801822 - DNA, 25 bp, Mus musculus
tgataacaccaacctgcacgcctgg

SEQ ID NO: 801823 - DNA, 25 bp, Mus musculus
tgataacaccaagctgcacgcctgg

SEQ ID NO: 801824 - DNA, 25 bp, Mus musculus
tgataacagcgacctctccgcgtga

SEQ ID NO: 801825 - DNA, 25 bp, Mus musculus
tgataacagcgagctctccgcgtga

SEQ ID NO: 801826 - DNA, 25 bp, Mus musculus
tgataaccagcgctattaccagcaa

SEQ ID NO: 801827 - DNA, 25 bp, Mus musculus
tgataaccagcggtattaccagcaa

SEQ ID NO: 801828 - DNA, 25 bp, Mus musculus
tgataaccatcccaggtcaccgtat

SEQ ID NO: 801829 - DNA, 25 bp, Mus musculus
tgataaccatccgaggtcaccgtat

SEQ ID NO: 801830 - DNA, 25 bp, Mus musculus
tgataacccatacaataatctgtga

SEQ ID NO: 801831 - DNA, 25 bp, Mus musculus
tgataacccatagaataatctgtga

SEQ ID NO: 801832 - DNA, 25 bp, Mus musculus
tgataacggaagcacgcatgaatgg

SEQ ID NO: 801833 - DNA, 25 bp, Mus musculus
tgataacggaaggacgcatgaatgg

SEQ ID NO: 801834 - DNA, 25 bp, Mus musculus
tgataacgggacataagccatgagc

SEQ ID NO: 801835 - DNA, 25 bp, Mus musculus
tgataacgggacttaagccatgagc

SEQ ID NO: 801836 - DNA, 25 bp, Mus musculus
tgataactttttcccacaggttcga

SEQ ID NO: 801837 - DNA, 25 bp, Mus musculus
tgataactttttgccacaggttcga

SEQ ID NO: 801838 - DNA, 25 bp, Mus musculus
tgataagagccccagtgcgcaagag

SEQ ID NO: 801839 - DNA, 25 bp, Mus musculus
tgataagagcccgagtgcgcaagag

SEQ ID NO: 801840 - DNA, 25 bp, Mus musculus
tgataagaggacaagcaaaccagac

SEQ ID NO: 801841 - DNA, 25 bp, Mus musculus
tgataagaggactagcaaaccagac

SEQ ID NO: 801842 - DNA, 25 bp, Mus musculus
tgataagattggcatgagaaggact

SEQ ID NO: 801843 - DNA, 25 bp, Mus musculus
tgataagattgggatgagaaggact

SEQ ID NO: 801844 - DNA, 25 bp, Mus musculus
tgataagcggttcccagcttttggc

SEQ ID NO: 801845 - DNA, 25 bp, Mus musculus
tgataagcggttgccagcttttggc

SEQ ID NO: 801846 - DNA, 25 bp, Mus musculus
tgataagctcctacctccaattgat

SEQ ID NO: 801847 - DNA, 25 bp, Mus musculus
tgataagctccttcctccaattgat

SEQ ID NO: 801848 - DNA, 25 bp, Mus musculus
tgataaggacagcaagacccgcaaa

SEQ ID NO: 801849 - DNA, 25 bp, Mus musculus
tgataaggacaggaagacccgcaaa

SEQ ID NO: 801850 - DNA, 25 bp, Mus musculus
tgataaggggccctctagggctccc

SEQ ID NO: 801851 - DNA, 25 bp, Mus musculus
tgataaggggccgtctagggctccc

SEQ ID NO: 801852 - DNA, 25 bp, Mus musculus
tgataaggtcaacatggactccagg

SEQ ID NO: 801853 - DNA, 25 bp, Mus musculus
tgataaggtcaagatggactccagg

SEQ ID NO: 801854 - DNA, 25 bp, Mus musculus
tgataagtctctacttcaccgtgat

SEQ ID NO: 801855 - DNA, 25 bp, Mus musculus
tgataagtctcttcttcaccgtgat

SEQ ID NO: 801856 - DNA, 25 bp, Mus musculus
tgataagtttctcctgcaagcagca

SEQ ID NO: 801857 - DNA, 25 bp, Mus musculus
tgataagtttctgctgcaagcagca

SEQ ID NO: 801858 - DNA, 25 bp, Mus musculus
tgataataccagcaaagccgcctgt

SEQ ID NO: 801859 - DNA, 25 bp, Mus musculus
tgataataccaggaaagccgcctgt

SEQ ID NO: 801860 - DNA, 25 bp, Mus musculus
tgataatgcagaaaggatgtttaac

SEQ ID NO: 801861 - DNA, 25 bp, Mus musculus
tgataatgcagataggatgtttaac

SEQ ID NO: 801862 - DNA, 25 bp, Mus musculus
tgataatggaggaattggccaagca

SEQ ID NO: 801863 - DNA, 25 bp, Mus musculus
tgataatggaggtattggccaagca

SEQ ID NO: 801864 - DNA, 25 bp, Mus musculus
tgataatggctcatgtattgcttag

SEQ ID NO: 801865 - DNA, 25 bp, Mus musculus
tgataatggctcttgtattgcttag

SEQ ID NO: 801866 - DNA, 25 bp, Mus musculus
tgataatgtcttagtggccagccag

SEQ ID NO: 801867 - DNA, 25 bp, Mus musculus
tgataatgtctttgtggccagccag

SEQ ID NO: 801868 - DNA, 25 bp, Mus musculus
tgataatgtgttaactttcaggaca

SEQ ID NO: 801869 - DNA, 25 bp, Mus musculus
tgataatgtgtttactttcaggaca

SEQ ID NO: 801870 - DNA, 25 bp, Mus musculus
tgataattgatgaccagttacctgt

SEQ ID NO: 801871 - DNA, 25 bp, Mus musculus
tgataattgatgtccagttacctgt

SEQ ID NO: 801872 - DNA, 25 bp, Mus musculus
tgataattgggaattaactccagtg

SEQ ID NO: 801873 - DNA, 25 bp, Mus musculus
tgataattgggatttaactccagtg

SEQ ID NO: 801874 - DNA, 25 bp, Mus musculus
tgatacacgctcacagatagcctgg

SEQ ID NO: 801875 - DNA, 25 bp, Mus musculus
tgatacacgctctcagatagcctgg

SEQ ID NO: 801876 - DNA, 25 bp, Mus musculus
tgatacagaactcaactcaaggttt

SEQ ID NO: 801877 - DNA, 25 bp, Mus musculus
tgatacagaactgaactcaaggttt

SEQ ID NO: 801878 - DNA, 25 bp, Mus musculus
tgatacagtgcaacgcctccgccgg

SEQ ID NO: 801879 - DNA, 25 bp, Mus musculus
tgatacagtgcatcgcctccgccgg

SEQ ID NO: 801880 - DNA, 25 bp, Mus musculus
tgatacagtggaattccctaaaaga

SEQ ID NO: 801881 - DNA, 25 bp, Mus musculus
tgatacagtggatttccctaaaaga

SEQ ID NO: 801882 - DNA, 25 bp, Mus musculus
tgatacatccgtactcaaactccgg

SEQ ID NO: 801883 - DNA, 25 bp, Mus musculus
tgatacatccgttctcaaactccgg

SEQ ID NO: 801884 - DNA, 25 bp, Mus musculus
tgataccaacatagtctacctctgt

SEQ ID NO: 801885 - DNA, 25 bp, Mus musculus
tgataccaacattgtctacctctgt

SEQ ID NO: 801886 - DNA, 25 bp, Mus musculus
tgataccaccagagaagtgactgcc

SEQ ID NO: 801887 - DNA, 25 bp, Mus musculus
tgataccaccagtgaagtgactgcc

SEQ ID NO: 801888 - DNA, 25 bp, Mus musculus
tgataccacgctacttccgaagcat

SEQ ID NO: 801889 - DNA, 25 bp, Mus musculus
tgataccacgcttcttccgaagcat

SEQ ID NO: 801890 - DNA, 25 bp, Mus musculus
tgataccacttaaagaagtgcacaa

SEQ ID NO: 801891 - DNA, 25 bp, Mus musculus
tgataccacttatagaagtgcacaa

SEQ ID NO: 801892 - DNA, 25 bp, Mus musculus
tgataccatcacattgaagccccgg

SEQ ID NO: 801893 - DNA, 25 bp, Mus musculus
tgataccatcactttgaagccccgg

SEQ ID NO: 801894 - DNA, 25 bp, Mus musculus
tgatacccaagactacattattgag

SEQ ID NO: 801895 - DNA, 25 bp, Mus musculus
tgatacccaagagtacattattgag

SEQ ID NO: 801896 - DNA, 25 bp, Mus musculus
tgatacccgacgactcttaaaggtg

SEQ ID NO: 801897 - DNA, 25 bp, Mus musculus
tgatacccgacgtctcttaaaggtg

SEQ ID NO: 801898 - DNA, 25 bp, Mus musculus
tgataccgacatcctggacagcagt

SEQ ID NO: 801899 - DNA, 25 bp, Mus musculus
tgataccgacatgctggacagcagt

SEQ ID NO: 801900 - DNA, 25 bp, Mus musculus
tgataccgtcctctgctcgggcagc

SEQ ID NO: 801901 - DNA, 25 bp, Mus musculus
tgataccgtcctgtgctcgggcagc

SEQ ID NO: 801902 - DNA, 25 bp, Mus musculus
tgatacgccagaagaggatcccaat

SEQ ID NO: 801903 - DNA, 25 bp, Mus musculus
tgatacgccagatgaggatcccaat

SEQ ID NO: 801904 - DNA, 25 bp, Mus musculus
tgatactacctcacaggctctctgt

SEQ ID NO: 801905 - DNA, 25 bp, Mus musculus
tgatactacctctcaggctctctgt

SEQ ID NO: 801906 - DNA, 25 bp, Mus musculus
tgatactcaccaagagggcgatcaa

SEQ ID NO: 801907 - DNA, 25 bp, Mus musculus
tgatactcaccatgagggcgatcaa

SEQ ID NO: 801908 - DNA, 25 bp, Mus musculus
tgatactgctagaggcccggaaagg

SEQ ID NO: 801909 - DNA, 25 bp, Mus musculus
tgatactgctagtggcccggaaagg

SEQ ID NO: 801910 - DNA, 25 bp, Mus musculus
tgatactggcctatgctgcacctgt

SEQ ID NO: 801911 - DNA, 25 bp, Mus musculus
tgatactggcctttgctgcacctgt

SEQ ID NO: 801912 - DNA, 25 bp, Mus musculus
tgatactggctcctctaacctgtgg

SEQ ID NO: 801913 - DNA, 25 bp, Mus musculus
tgatactggctcgtctaacctgtgg

SEQ ID NO: 801914 - DNA, 25 bp, Mus musculus
tgatactgggccagtggacacacaa

SEQ ID NO: 801915 - DNA, 25 bp, Mus musculus
tgatactgggcctgtggacacacaa

SEQ ID NO: 801916 - DNA, 25 bp, Mus musculus
tgatactgtcagcagaagccctggc

SEQ ID NO: 801917 - DNA, 25 bp, Mus musculus
tgatactgtcaggagaagccctggc

SEQ ID NO: 801918 - DNA, 25 bp, Mus musculus
tgatagaaactgctggtcccacaca

SEQ ID NO: 801919 - DNA, 25 bp, Mus musculus
tgatagaaactggtggtcccacaca

SEQ ID NO: 801920 - DNA, 25 bp, Mus musculus
tgatagaaattgagatcgacgggac

SEQ ID NO: 801921 - DNA, 25 bp, Mus musculus
tgatagaaattgaggatgcttcacc

SEQ ID NO: 801922 - DNA, 25 bp, Mus musculus
tgatagaaattgtgatcgacgggac

SEQ ID NO: 801923 - DNA, 25 bp, Mus musculus
tgatagaaattgtggatgcttcacc

SEQ ID NO: 801924 - DNA, 25 bp, Mus musculus
tgatagaacacacgtacagaacgag

SEQ ID NO: 801925 - DNA, 25 bp, Mus musculus
tgatagaacacaggtacagaacgag

SEQ ID NO: 801926 - DNA, 25 bp, Mus musculus
tgatagaagacgagctgagacctct

SEQ ID NO: 801927 - DNA, 25 bp, Mus musculus
tgatagaagacgtgctgagacctct

SEQ ID NO: 801928 - DNA, 25 bp, Mus musculus
tgatagaagagtcccagcgatgcct

SEQ ID NO: 801929 - DNA, 25 bp, Mus musculus
tgatagaagagtgccagcgatgcct

SEQ ID NO: 801930 - DNA, 25 bp, Mus musculus
tgatagaaggaactcaaggcaccat

SEQ ID NO: 801931 - DNA, 25 bp, Mus musculus
tgatagaaggaagtcaaggcaccat

SEQ ID NO: 801932 - DNA, 25 bp, Mus musculus
tgatagaatgtaaccagcagctgac

SEQ ID NO: 801933 - DNA, 25 bp, Mus musculus
tgatagaatgtatccagcagctgac

SEQ ID NO: 801934 - DNA, 25 bp, Mus musculus
tgatagacattgctgctgactggat

SEQ ID NO: 801935 - DNA, 25 bp, Mus musculus
tgatagacattggtgctgactggat

SEQ ID NO: 801936 - DNA, 25 bp, Mus musculus
tgatagacgtccactggtgacggag

SEQ ID NO: 801937 - DNA, 25 bp, Mus musculus
tgatagacgtcctctggtgacggag

SEQ ID NO: 801938 - DNA, 25 bp, Mus musculus
tgatagactgcaccacttcacaggc

SEQ ID NO: 801939 - DNA, 25 bp, Mus musculus
tgatagactgcagcacttcacaggc

SEQ ID NO: 801940 - DNA, 25 bp, Mus musculus
tgatagacttgtctgcccggaagcc

SEQ ID NO: 801941 - DNA, 25 bp, Mus musculus
tgatagacttgtgtgcccggaagcc

SEQ ID NO: 801942 - DNA, 25 bp, Mus musculus
tgatagagacaaactgaagaaccaa

SEQ ID NO: 801943 - DNA, 25 bp, Mus musculus
tgatagagacaatctgaagaaccaa

SEQ ID NO: 801944 - DNA, 25 bp, Mus musculus
tgatagagtctgactgttgggtcct

SEQ ID NO: 801945 - DNA, 25 bp, Mus musculus
tgatagagtctgtctgttgggtcct

SEQ ID NO: 801946 - DNA, 25 bp, Mus musculus
tgatagatacgcacagacccgtgcc

SEQ ID NO: 801947 - DNA, 25 bp, Mus musculus
tgatagatacgctcagacccgtgcc

SEQ ID NO: 801948 - DNA, 25 bp, Mus musculus
tgatagcagtttccccaagtgcagc

SEQ ID NO: 801949 - DNA, 25 bp, Mus musculus
tgatagcagtttgcccaagtgcagc

SEQ ID NO: 801950 - DNA, 25 bp, Mus musculus
tgatagcatcccaacaaggttccct

SEQ ID NO: 801951 - DNA, 25 bp, Mus musculus
tgatagcatccctacaaggttccct

SEQ ID NO: 801952 - DNA, 25 bp, Mus musculus
tgatagcatctcacctaatgagagc

SEQ ID NO: 801953 - DNA, 25 bp, Mus musculus
tgatagcatctctcctaatgagagc

SEQ ID NO: 801954 - DNA, 25 bp, Mus musculus
tgatagccaactacacagtgaccag

SEQ ID NO: 801955 - DNA, 25 bp, Mus musculus
tgatagccaacttcacagtgaccag

SEQ ID NO: 801956 - DNA, 25 bp, Mus musculus
tgatagccaagcacctgaagggccg

SEQ ID NO: 801957 - DNA, 25 bp, Mus musculus
tgatagccaagctcctgaagggccg

SEQ ID NO: 801958 - DNA, 25 bp, Mus musculus
tgatagccagtcaaccattaaagac

SEQ ID NO: 801959 - DNA, 25 bp, Mus musculus
tgatagccagtctaccattaaagac

SEQ ID NO: 801960 - DNA, 25 bp, Mus musculus
tgatagcccgggatcaaatccaaaa

SEQ ID NO: 801961 - DNA, 25 bp, Mus musculus
tgatagcccgggttcaaatccaaaa

SEQ ID NO: 801962 - DNA, 25 bp, Mus musculus
tgatagccgggcaaacactgtttat

SEQ ID NO: 801963 - DNA, 25 bp, Mus musculus
tgatagccgggctaacactgtttat

SEQ ID NO: 801964 - DNA, 25 bp, Mus musculus
tgatagcgactcagggccaccaaga

SEQ ID NO: 801965 - DNA, 25 bp, Mus musculus
tgatagcgactctgggccaccaaga

SEQ ID NO: 801966 - DNA, 25 bp, Mus musculus
tgatagcgaggaactccccaccctg

SEQ ID NO: 801967 - DNA, 25 bp, Mus musculus
tgatagcgaggatctccccaccctg

SEQ ID NO: 801968 - DNA, 25 bp, Mus musculus
tgatagctacaaacgaagaccacag

SEQ ID NO: 801969 - DNA, 25 bp, Mus musculus
tgatagctacaatcgaagaccacag

SEQ ID NO: 801970 - DNA, 25 bp, Mus musculus
tgatagctcggaagcatcgtgtggt

SEQ ID NO: 801971 - DNA, 25 bp, Mus musculus
tgatagctcggatgcatcgtgtggt

SEQ ID NO: 801972 - DNA, 25 bp, Mus musculus
tgatagctctgaatgacgctggtgg

SEQ ID NO: 801973 - DNA, 25 bp, Mus musculus
tgatagctctgattgacgctggtgg

SEQ ID NO: 801974 - DNA, 25 bp, Mus musculus
tgatagctgtccaccaagtggccac

SEQ ID NO: 801975 - DNA, 25 bp, Mus musculus
tgatagctgtcctccaagtggccac

SEQ ID NO: 801976 - DNA, 25 bp, Mus musculus
tgataggaacggcaaccaagcgttt

SEQ ID NO: 801977 - DNA, 25 bp, Mus musculus
tgataggaacgggaaccaagcgttt

SEQ ID NO: 801978 - DNA, 25 bp, Mus musculus
tgataggcagtgacgttgcgtgtcc

SEQ ID NO: 801979 - DNA, 25 bp, Mus musculus
tgataggcagtgtcgttgcgtgtcc

SEQ ID NO: 801980 - DNA, 25 bp, Mus musculus
tgataggcctttagaaaacagggac

SEQ ID NO: 801981 - DNA, 25 bp, Mus musculus
tgataggccttttgaaaacagggac

SEQ ID NO: 801982 - DNA, 25 bp, Mus musculus
tgataggcgtacaagagcccacgta

SEQ ID NO: 801983 - DNA, 25 bp, Mus musculus
tgataggcgtactagagcccacgta

SEQ ID NO: 801984 - DNA, 25 bp, Mus musculus
tgatagggctcaagcaacggtgctg

SEQ ID NO: 801985 - DNA, 25 bp, Mus musculus
tgatagggctcatgcaacggtgctg

SEQ ID NO: 801986 - DNA, 25 bp, Mus musculus
tgatagtattcactctgcaaagaag

SEQ ID NO: 801987 - DNA, 25 bp, Mus musculus
tgatagtattcagtctgcaaagaag

SEQ ID NO: 801988 - DNA, 25 bp, Mus musculus
tgatagtcctcaccggataccaaac

SEQ ID NO: 801989 - DNA, 25 bp, Mus musculus
tgatagtcctcagcggataccaaac

SEQ ID NO: 801990 - DNA, 25 bp, Mus musculus
tgatagtggctcaacctcaggtggg

SEQ ID NO: 801991 - DNA, 25 bp, Mus musculus
tgatagtggctctacctcaggtggg

SEQ ID NO: 801992 - DNA, 25 bp, Mus musculus
tgatagtgtgtaccttggtgcttgc

SEQ ID NO: 801993 - DNA, 25 bp, Mus musculus
tgatagtgtgtagcttggtgcttgc

SEQ ID NO: 801994 - DNA, 25 bp, Mus musculus
tgatagttaatcatccagtgtgagc

SEQ ID NO: 801995 - DNA, 25 bp, Mus musculus
tgatagttaatcttccagtgtgagc

SEQ ID NO: 801996 - DNA, 25 bp, Mus musculus
tgatagttttgcagtactgggccta

SEQ ID NO: 801997 - DNA, 25 bp, Mus musculus
tgatagttttgctgtactgggccta

SEQ ID NO: 801998 - DNA, 25 bp, Mus musculus
tgatatacttccaagcgggctggct

SEQ ID NO: 801999 - DNA, 25 bp, Mus musculus
tgatatacttcctagcgggctggct

SEQ ID NO: 802000 - DNA, 25 bp, Mus musculus
tgatatagatacctaccgggcagcc

SEQ ID NO: 802001 - DNA, 25 bp, Mus musculus
tgatatagatacgtaccgggcagcc

SEQ ID NO: 802002 - DNA, 25 bp, Mus musculus
tgatatatgcccaagacaaagaaac

SEQ ID NO: 802003 - DNA, 25 bp, Mus musculus
tgatatatgccctagacaaagaaac

SEQ ID NO: 802004 - DNA, 25 bp, Mus musculus
tgatatcagccgacgcttggcgctg

SEQ ID NO: 802005 - DNA, 25 bp, Mus musculus
tgatatcagccgtcgcttggcgctg

SEQ ID NO: 802006 - DNA, 25 bp, Mus musculus
tgatatcaggcaatgtcttgccaga

SEQ ID NO: 802007 - DNA, 25 bp, Mus musculus
tgatatcaggcattgtcttgccaga

SEQ ID NO: 802008 - DNA, 25 bp, Mus musculus
tgatatcatcacctgagctggctga

SEQ ID NO: 802009 - DNA, 25 bp, Mus musculus
tgatatcatcacgtgagctggctga

SEQ ID NO: 802010 - DNA, 25 bp, Mus musculus
tgatatccgcccagacactgactgg

SEQ ID NO: 802011 - DNA, 25 bp, Mus musculus
tgatatccgccctgacactgactgg

SEQ ID NO: 802012 - DNA, 25 bp, Mus musculus
tgatatcctttcctagagcgcagag

SEQ ID NO: 802013 - DNA, 25 bp, Mus musculus
tgatatcctttcgtagagcgcagag

SEQ ID NO: 802014 - DNA, 25 bp, Mus musculus
tgatatcgataacgacacagtgcag

SEQ ID NO: 802015 - DNA, 25 bp, Mus musculus
tgatatcgataaggacacagtgcag

SEQ ID NO: 802016 - DNA, 25 bp, Mus musculus
tgatatctacacagaacatgcccat

SEQ ID NO: 802017 - DNA, 25 bp, Mus musculus
tgatatctacactgaacatgcccat

SEQ ID NO: 802018 - DNA, 25 bp, Mus musculus
tgatatctgtcaagaactcttggga

SEQ ID NO: 802019 - DNA, 25 bp, Mus musculus
tgatatctgtcatgaactcttggga

SEQ ID NO: 802020 - DNA, 25 bp, Mus musculus
tgatatctgtgcagctgacccacct

SEQ ID NO: 802021 - DNA, 25 bp, Mus musculus
tgatatctgtgctgctgacccacct

SEQ ID NO: 802022 - DNA, 25 bp, Mus musculus
tgatatgaaaaacgagcaagaccac

SEQ ID NO: 802023 - DNA, 25 bp, Mus musculus
tgatatgaaaaaggagcaagaccac

SEQ ID NO: 802024 - DNA, 25 bp, Mus musculus
tgatatgaagtcaattcctcttgct

SEQ ID NO: 802025 - DNA, 25 bp, Mus musculus
tgatatgaagtctattcctcttgct

SEQ ID NO: 802026 - DNA, 25 bp, Mus musculus
tgatatgactaaaaacttccaacag

SEQ ID NO: 802027 - DNA, 25 bp, Mus musculus
tgatatgactaataacttccaacag

SEQ ID NO: 802028 - DNA, 25 bp, Mus musculus
tgatatgacttcaaggatcttctag

SEQ ID NO: 802029 - DNA, 25 bp, Mus musculus
tgatatgacttctaggatcttctag

SEQ ID NO: 802030 - DNA, 25 bp, Mus musculus
tgatatgataaaccctgtgcaacag

SEQ ID NO: 802031 - DNA, 25 bp, Mus musculus
tgatatgataaagcctgtgcaacag

SEQ ID NO: 802032 - DNA, 25 bp, Mus musculus
tgatatgcagaaacctttgaaggac

SEQ ID NO: 802033 - DNA, 25 bp, Mus musculus
tgatatgcagaatcctttgaaggac

SEQ ID NO: 802034 - DNA, 25 bp, Mus musculus
tgatatgcgcttcgcggagcttgca

SEQ ID NO: 802035 - DNA, 25 bp, Mus musculus
tgatatgcgcttggcggagcttgca

SEQ ID NO: 802036 - DNA, 25 bp, Mus musculus
tgatatgggaagaaagtggaagaac

SEQ ID NO: 802037 - DNA, 25 bp, Mus musculus
tgatatgggaagtaagtggaagaac

SEQ ID NO: 802038 - DNA, 25 bp, Mus musculus
tgatatgtacccattccaccccttg

SEQ ID NO: 802039 - DNA, 25 bp, Mus musculus
tgatatgtaccctttccaccccttg

SEQ ID NO: 802040 - DNA, 25 bp, Mus musculus
tgatatgtcaacaaaggatcatgtc

SEQ ID NO: 802041 - DNA, 25 bp, Mus musculus
tgatatgtcaactaaggatcatgtc

SEQ ID NO: 802042 - DNA, 25 bp, Mus musculus
tgatatgtccctagtgaatggctgg

SEQ ID NO: 802043 - DNA, 25 bp, Mus musculus
tgatatgtcccttgtgaatggctgg

SEQ ID NO: 802044 - DNA, 25 bp, Mus musculus
tgatatgtccttagtgcccacctgg

SEQ ID NO: 802045 - DNA, 25 bp, Mus musculus
tgatatgtcctttgtgcccacctgg

SEQ ID NO: 802046 - DNA, 25 bp, Mus musculus
tgatattaaggcacctgaggacaag

SEQ ID NO: 802047 - DNA, 25 bp, Mus musculus
tgatattaaggctcctgaggacaag

SEQ ID NO: 802048 - DNA, 25 bp, Mus musculus
tgatattatttcctctggacaccat

SEQ ID NO: 802049 - DNA, 25 bp, Mus musculus
tgatattatttcgtctggacaccat

SEQ ID NO: 802050 - DNA, 25 bp, Mus musculus
tgatattcaaacaattcagcccagt

SEQ ID NO: 802051 - DNA, 25 bp, Mus musculus
tgatattcaaactattcagcccagt

SEQ ID NO: 802052 - DNA, 25 bp, Mus musculus
tgatattccagaaggaagaagtgga

SEQ ID NO: 802053 - DNA, 25 bp, Mus musculus
tgatattccagatggaagaagtgga

SEQ ID NO: 802054 - DNA, 25 bp, Mus musculus
tgatattgatgcatctgagcaccat

SEQ ID NO: 802055 - DNA, 25 bp, Mus musculus
tgatattgatgcttctgagcaccat

SEQ ID NO: 802056 - DNA, 25 bp, Mus musculus
tgatattgcagcctatctgtccgct

SEQ ID NO: 802057 - DNA, 25 bp, Mus musculus
tgatattgcagcgtatctgtccgct

SEQ ID NO: 802058 - DNA, 25 bp, Mus musculus
tgatattgccatcaactgggccggt

SEQ ID NO: 802059 - DNA, 25 bp, Mus musculus
tgatattgccatgaactgggccggt

SEQ ID NO: 802060 - DNA, 25 bp, Mus musculus
tgatattggaagaggatgaaacaca

SEQ ID NO: 802061 - DNA, 25 bp, Mus musculus
tgatattggaagtggatgaaacaca

SEQ ID NO: 802062 - DNA, 25 bp, Mus musculus
tgatattgtctcaggaactcgatac

SEQ ID NO: 802063 - DNA, 25 bp, Mus musculus
tgatattgtctctggaactcgatac

SEQ ID NO: 802064 - DNA, 25 bp, Mus musculus
tgatatttaagaccacagcgtttgc

SEQ ID NO: 802065 - DNA, 25 bp, Mus musculus
tgatatttaagagcacagcgtttgc

SEQ ID NO: 802066 - DNA, 25 bp, Mus musculus
tgatatttctgcaatctctatgaca

SEQ ID NO: 802067 - DNA, 25 bp, Mus musculus
tgatatttctgctatctctatgaca

SEQ ID NO: 802068 - DNA, 25 bp, Mus musculus
tgatcaaaactaaccaccatcttgc

SEQ ID NO: 802069 - DNA, 25 bp, Mus musculus
tgatcaaaactatccaccatcttgc

SEQ ID NO: 802070 - DNA, 25 bp, Mus musculus
tgatcaaacaggagcgcacagactt

SEQ ID NO: 802071 - DNA, 25 bp, Mus musculus
tgatcaaacaggtgcgcacagactt

SEQ ID NO: 802072 - DNA, 25 bp, Mus musculus
tgatcaaactgaacgacacactgct

SEQ ID NO: 802073 - DNA, 25 bp, Mus musculus
tgatcaaactgatcgacacactgct

SEQ ID NO: 802074 - DNA, 25 bp, Mus musculus
tgatcaaagcctacggcatccgttt

SEQ ID NO: 802075 - DNA, 25 bp, Mus musculus
tgatcaaagccttcggcatccgttt

SEQ ID NO: 802076 - DNA, 25 bp, Mus musculus
tgatcaaaggccctgtagttggctc

SEQ ID NO: 802077 - DNA, 25 bp, Mus musculus
tgatcaaaggccgtgtagttggctc

SEQ ID NO: 802078 - DNA, 25 bp, Mus musculus
tgatcaaaggtgctgttttgttccc

SEQ ID NO: 802079 - DNA, 25 bp, Mus musculus
tgatcaaaggtggtgttttgttccc

SEQ ID NO: 802080 - DNA, 25 bp, Mus musculus
tgatcaaagtggagaatgaggaccc

SEQ ID NO: 802081 - DNA, 25 bp, Mus musculus
tgatcaaagtggtgaatgaggaccc

SEQ ID NO: 802082 - DNA, 25 bp, Mus musculus
tgatcaaatgggaagaccgttcgga

SEQ ID NO: 802083 - DNA, 25 bp, Mus musculus
tgatcaaatgggtagaccgttcgga

SEQ ID NO: 802084 - DNA, 25 bp, Mus musculus
tgatcaacaccgaggaaccatccgc

SEQ ID NO: 802085 - DNA, 25 bp, Mus musculus
tgatcaacaccgtggaaccatccgc

SEQ ID NO: 802086 - DNA, 25 bp, Mus musculus
tgatcaacatcgacattcaggaagt

SEQ ID NO: 802087 - DNA, 25 bp, Mus musculus
tgatcaacatcgtcattcaggaagt

SEQ ID NO: 802088 - DNA, 25 bp, Mus musculus
tgatcaacgaaaagcagaaaaaaga

SEQ ID NO: 802089 - DNA, 25 bp, Mus musculus
tgatcaacgaaatgcagaaaaaaga

SEQ ID NO: 802090 - DNA, 25 bp, Mus musculus
tgatcaactgtgatcagcgaatact

SEQ ID NO: 802091 - DNA, 25 bp, Mus musculus
tgatcaactgtgttcagcgaatact

SEQ ID NO: 802092 - DNA, 25 bp, Mus musculus
tgatcaagaactccagcgagaccca

SEQ ID NO: 802093 - DNA, 25 bp, Mus musculus
tgatcaagaactgcagcgagaccca

SEQ ID NO: 802094 - DNA, 25 bp, Mus musculus
tgatcaagatgaagtccttatggag

SEQ ID NO: 802095 - DNA, 25 bp, Mus musculus
tgatcaagatgatgtccttatggag

SEQ ID NO: 802096 - DNA, 25 bp, Mus musculus
tgatcaagcaggagggagatgcatc

SEQ ID NO: 802097 - DNA, 25 bp, Mus musculus
tgatcaagcaggtgggagatgcatc

SEQ ID NO: 802098 - DNA, 25 bp, Mus musculus
tgatcaagctgacttcaatgccgtt

SEQ ID NO: 802099 - DNA, 25 bp, Mus musculus
tgatcaagctgagttcaatgccgtt

SEQ ID NO: 802100 - DNA, 25 bp, Mus musculus
tgatcaaggacaccgaggccctcca

SEQ ID NO: 802101 - DNA, 25 bp, Mus musculus
tgatcaaggacagcgaggccctcca

SEQ ID NO: 802102 - DNA, 25 bp, Mus musculus
tgatcaaggagacaatggacaagaa

SEQ ID NO: 802103 - DNA, 25 bp, Mus musculus
tgatcaaggagagaatggacaagaa

SEQ ID NO: 802104 - DNA, 25 bp, Mus musculus
tgatcaagggatacatgcaacagca

SEQ ID NO: 802105 - DNA, 25 bp, Mus musculus
tgatcaagggatcctggcagccagt

SEQ ID NO: 802106 - DNA, 25 bp, Mus musculus
tgatcaagggatgctggcagccagt

SEQ ID NO: 802107 - DNA, 25 bp, Mus musculus
tgatcaagggattcatgcaacagca

SEQ ID NO: 802108 - DNA, 25 bp, Mus musculus
tgatcaaggtgaacagcaagcagcg

SEQ ID NO: 802109 - DNA, 25 bp, Mus musculus
tgatcaaggtgaagggccagagctt

SEQ ID NO: 802110 - DNA, 25 bp, Mus musculus
tgatcaaggtgatcagcaagcagcg

SEQ ID NO: 802111 - DNA, 25 bp, Mus musculus
tgatcaaggtgatgggccagagctt

SEQ ID NO: 802112 - DNA, 25 bp, Mus musculus
tgatcaagtcctcataacatctgtg

SEQ ID NO: 802113 - DNA, 25 bp, Mus musculus
tgatcaagtcctgataacatctgtg

SEQ ID NO: 802114 - DNA, 25 bp, Mus musculus
tgatcaagtgataaaagcagtaaga

SEQ ID NO: 802115 - DNA, 25 bp, Mus musculus
tgatcaagtgattaaagcagtaaga

SEQ ID NO: 802116 - DNA, 25 bp, Mus musculus
tgatcaagtgtgaaataatccccag

SEQ ID NO: 802117 - DNA, 25 bp, Mus musculus
tgatcaagtgtgtaataatccccag

SEQ ID NO: 802118 - DNA, 25 bp, Mus musculus
tgatcaatctttatggacttctaca

SEQ ID NO: 802119 - DNA, 25 bp, Mus musculus
tgatcaatctttttggacttctaca

SEQ ID NO: 802120 - DNA, 25 bp, Mus musculus
tgatcaatggcgagacagtgcctgg

SEQ ID NO: 802121 - DNA, 25 bp, Mus musculus
tgatcaatggcgtgacagtgcctgg

SEQ ID NO: 802122 - DNA, 25 bp, Mus musculus
tgatcaatgtcactcacaggaactt

SEQ ID NO: 802123 - DNA, 25 bp, Mus musculus
tgatcaatgtcagtcacaggaactt

SEQ ID NO: 802124 - DNA, 25 bp, Mus musculus
tgatcacaaggaaccggctctgcaa

SEQ ID NO: 802125 - DNA, 25 bp, Mus musculus
tgatcacaaggatccggctctgcaa

SEQ ID NO: 802126 - DNA, 25 bp, Mus musculus
tgatcacaagtgaagaggccgagag

SEQ ID NO: 802127 - DNA, 25 bp, Mus musculus
tgatcacaagtgtagaggccgagag

SEQ ID NO: 802128 - DNA, 25 bp, Mus musculus
tgatcacaatgcctcagtacctccg

SEQ ID NO: 802129 - DNA, 25 bp, Mus musculus
tgatcacaatgcgtcagtacctccg

SEQ ID NO: 802130 - DNA, 25 bp, Mus musculus
tgatcacacatcagggcagtgactt

SEQ ID NO: 802131 - DNA, 25 bp, Mus musculus
tgatcacacatctgggcagtgactt

SEQ ID NO: 802132 - DNA, 25 bp, Mus musculus
tgatcacacgaaagctacagagaga

SEQ ID NO: 802133 - DNA, 25 bp, Mus musculus
tgatcacacgaatgctacagagaga

SEQ ID NO: 802134 - DNA, 25 bp, Mus musculus
tgatcacacggactcccactgcttt

SEQ ID NO: 802135 - DNA, 25 bp, Mus musculus
tgatcacacggagtcccactgcttt

SEQ ID NO: 802136 - DNA, 25 bp, Mus musculus
tgatcacacgggaaagaaaagagtc

SEQ ID NO: 802137 - DNA, 25 bp, Mus musculus
tgatcacacgggtaagaaaagagtc

SEQ ID NO: 802138 - DNA, 25 bp, Mus musculus
tgatcacagggaaatgggagaaacc

SEQ ID NO: 802139 - DNA, 25 bp, Mus musculus
tgatcacagggatatgggagaaacc

SEQ ID NO: 802140 - DNA, 25 bp, Mus musculus
tgatcaccctgcaaatcttcactgg

SEQ ID NO: 802141 - DNA, 25 bp, Mus musculus
tgatcaccctgctaatcttcactgg

SEQ ID NO: 802142 - DNA, 25 bp, Mus musculus
tgatcaccgcttatggtccaggagc

SEQ ID NO: 802143 - DNA, 25 bp, Mus musculus
tgatcaccgcttttggtccaggagc

SEQ ID NO: 802144 - DNA, 25 bp, Mus musculus
tgatcaccttcaacgacttggctgg

SEQ ID NO: 802145 - DNA, 25 bp, Mus musculus
tgatcaccttcatcgacttggctgg

SEQ ID NO: 802146 - DNA, 25 bp, Mus musculus
tgatcaccttggcaacgtctctgca

SEQ ID NO: 802147 - DNA, 25 bp, Mus musculus
tgatcaccttgggaacgtctctgca

SEQ ID NO: 802148 - DNA, 25 bp, Mus musculus
tgatcacgaacgaggtgaacagcat

SEQ ID NO: 802149 - DNA, 25 bp, Mus musculus
tgatcacgaacgtggtgaacagcat

SEQ ID NO: 802150 - DNA, 25 bp, Mus musculus
tgatcactaaccctgcagagagctg

SEQ ID NO: 802151 - DNA, 25 bp, Mus musculus
tgatcactaaccgtgcagagagctg

SEQ ID NO: 802152 - DNA, 25 bp, Mus musculus
tgatcactccagcagagaactctcc

SEQ ID NO: 802153 - DNA, 25 bp, Mus musculus
tgatcactccaggagagaactctcc

SEQ ID NO: 802154 - DNA, 25 bp, Mus musculus
tgatcactcggcatgacctgaggga

SEQ ID NO: 802155 - DNA, 25 bp, Mus musculus
tgatcactcggcttgacctgaggga

SEQ ID NO: 802156 - DNA, 25 bp, Mus musculus
tgatcacttcacagagcattaggag

SEQ ID NO: 802157 - DNA, 25 bp, Mus musculus
tgatcacttcactgagcattaggag

SEQ ID NO: 802158 - DNA, 25 bp, Mus musculus
tgatcagaaagtacaccgaggagct

SEQ ID NO: 802159 - DNA, 25 bp, Mus musculus
tgatcagaaagttcaccgaggagct

SEQ ID NO: 802160 - DNA, 25 bp, Mus musculus
tgatcagacagcaaatgaggacgac

SEQ ID NO: 802161 - DNA, 25 bp, Mus musculus
tgatcagacagctaatgaggacgac

SEQ ID NO: 802162 - DNA, 25 bp, Mus musculus
tgatcagacagtcctgttccaggga

SEQ ID NO: 802163 - DNA, 25 bp, Mus musculus
tgatcagacagtgctgttccaggga

SEQ ID NO: 802164 - DNA, 25 bp, Mus musculus
tgatcagactgaccacaggcagtgg

SEQ ID NO: 802165 - DNA, 25 bp, Mus musculus
tgatcagactgagcacaggcagtgg

SEQ ID NO: 802166 - DNA, 25 bp, Mus musculus
tgatcagaggcacaagatttataca

SEQ ID NO: 802167 - DNA, 25 bp, Mus musculus
tgatcagaggcagaagatttataca

SEQ ID NO: 802168 - DNA, 25 bp, Mus musculus
tgatcagatcgaagtctgcagagac

SEQ ID NO: 802169 - DNA, 25 bp, Mus musculus
tgatcagatcgatgtctgcagagac

SEQ ID NO: 802170 - DNA, 25 bp, Mus musculus
tgatcagattgcagtcaaagtggcc

SEQ ID NO: 802171 - DNA, 25 bp, Mus musculus
tgatcagattgctgtcaaagtggcc

SEQ ID NO: 802172 - DNA, 25 bp, Mus musculus
tgatcagcaagactgacgtgaagtc

SEQ ID NO: 802173 - DNA, 25 bp, Mus musculus
tgatcagcaagagtgacgtgaagtc

SEQ ID NO: 802174 - DNA, 25 bp, Mus musculus
tgatcagcagcaacacgcaggacta

SEQ ID NO: 802175 - DNA, 25 bp, Mus musculus
tgatcagcagcatcacgcaggacta

SEQ ID NO: 802176 - DNA, 25 bp, Mus musculus
tgatcagcaggtcccaagataaact

SEQ ID NO: 802177 - DNA, 25 bp, Mus musculus
tgatcagcaggtgccaagataaact

SEQ ID NO: 802178 - DNA, 25 bp, Mus musculus
tgatcagcatcgaatgtttgaaccc

SEQ ID NO: 802179 - DNA, 25 bp, Mus musculus
tgatcagcatcgtatgtttgaaccc

SEQ ID NO: 802180 - DNA, 25 bp, Mus musculus
tgatcagcccctagcaatgtctaaa

SEQ ID NO: 802181 - DNA, 25 bp, Mus musculus
tgatcagccccttgcaatgtctaaa

SEQ ID NO: 802182 - DNA, 25 bp, Mus musculus
tgatcagcgggtcgctctttttccg

SEQ ID NO: 802183 - DNA, 25 bp, Mus musculus
tgatcagcgggtggctctttttccg

SEQ ID NO: 802184 - DNA, 25 bp, Mus musculus
tgatcagctcttcagattgggcacg

SEQ ID NO: 802185 - DNA, 25 bp, Mus musculus
tgatcagctcttgagattgggcacg

SEQ ID NO: 802186 - DNA, 25 bp, Mus musculus
tgatcagcttctctcggacttttgg

SEQ ID NO: 802187 - DNA, 25 bp, Mus musculus
tgatcagcttctgtcggacttttgg

SEQ ID NO: 802188 - DNA, 25 bp, Mus musculus
tgatcaggaaggactcgtggagcac

SEQ ID NO: 802189 - DNA, 25 bp, Mus musculus
tgatcaggaaggtctcgtggagcac

SEQ ID NO: 802190 - DNA, 25 bp, Mus musculus
tgatcaggaggtccgatcgcttgct

SEQ ID NO: 802191 - DNA, 25 bp, Mus musculus
tgatcaggaggtgcgatcgcttgct

SEQ ID NO: 802192 - DNA, 25 bp, Mus musculus
tgatcaggccagcaaaaacatgact

SEQ ID NO: 802193 - DNA, 25 bp, Mus musculus
tgatcaggccaggaaaaacatgact

SEQ ID NO: 802194 - DNA, 25 bp, Mus musculus
tgatcaggctcccagggcagtcaat

SEQ ID NO: 802195 - DNA, 25 bp, Mus musculus
tgatcaggctccgagggcagtcaat

SEQ ID NO: 802196 - DNA, 25 bp, Mus musculus
tgatcaggtcctctttgacaatgag

SEQ ID NO: 802197 - DNA, 25 bp, Mus musculus
tgatcaggtcctgtttgacaatgag

SEQ ID NO: 802198 - DNA, 25 bp, Mus musculus
tgatcagtaaccatcaggctgcagg

SEQ ID NO: 802199 - DNA, 25 bp, Mus musculus
tgatcagtaaccttcaggctgcagg

SEQ ID NO: 802200 - DNA, 25 bp, Mus musculus
tgatcagtagcacgggaatttttcc

SEQ ID NO: 802201 - DNA, 25 bp, Mus musculus
tgatcagtagcaggggaatttttcc

SEQ ID NO: 802202 - DNA, 25 bp, Mus musculus
tgatcagtctcaaggaagaaggtct

SEQ ID NO: 802203 - DNA, 25 bp, Mus musculus
tgatcagtctcatggaagaaggtct

SEQ ID NO: 802204 - DNA, 25 bp, Mus musculus
tgatcagtgatgctggcattccacc

SEQ ID NO: 802205 - DNA, 25 bp, Mus musculus
tgatcagtgatggtggcattccacc

SEQ ID NO: 802206 - DNA, 25 bp, Mus musculus
tgatcataaaagcagtaacgctgcc

SEQ ID NO: 802207 - DNA, 25 bp, Mus musculus
tgatcataaaaggagtaacgctgcc

SEQ ID NO: 802208 - DNA, 25 bp, Mus musculus
tgatcatagatacgcccacacttgg

SEQ ID NO: 802209 - DNA, 25 bp, Mus musculus
tgatcatagataggcccacacttgg

SEQ ID NO: 802210 - DNA, 25 bp, Mus musculus
tgatcatagggtatgaaatgtacag

SEQ ID NO: 802211 - DNA, 25 bp, Mus musculus
tgatcatagggtttgaaatgtacag

SEQ ID NO: 802212 - DNA, 25 bp, Mus musculus
tgatcatcactaatgcaaacattgc

SEQ ID NO: 802213 - DNA, 25 bp, Mus musculus
tgatcatcactattgcaaacattgc

SEQ ID NO: 802214 - DNA, 25 bp, Mus musculus
tgatcatcatggatgctgacctctc

SEQ ID NO: 802215 - DNA, 25 bp, Mus musculus
tgatcatcatggttgctgacctctc

SEQ ID NO: 802216 - DNA, 25 bp, Mus musculus
tgatcatctactacggcacagccta

SEQ ID NO: 802217 - DNA, 25 bp, Mus musculus
tgatcatctacttcggcacagccta

SEQ ID NO: 802218 - DNA, 25 bp, Mus musculus
tgatcatgacgtagacctagagaag

SEQ ID NO: 802219 - DNA, 25 bp, Mus musculus
tgatcatgacgttgacctagagaag

SEQ ID NO: 802220 - DNA, 25 bp, Mus musculus
tgatcatgctggcagctatctgtgc

SEQ ID NO: 802221 - DNA, 25 bp, Mus musculus
tgatcatgctgggagctatctgtgc

SEQ ID NO: 802222 - DNA, 25 bp, Mus musculus
tgatcatggctacaaacagaccaga

SEQ ID NO: 802223 - DNA, 25 bp, Mus musculus
tgatcatggctagaaacagaccaga

SEQ ID NO: 802224 - DNA, 25 bp, Mus musculus
tgatcattattcaggcatgccgtgg

SEQ ID NO: 802225 - DNA, 25 bp, Mus musculus
tgatcattattctggcatgccgtgg

SEQ ID NO: 802226 - DNA, 25 bp, Mus musculus
tgatcatttcaaacctttgtgggcc

SEQ ID NO: 802227 - DNA, 25 bp, Mus musculus
tgatcatttcaatcctttgtgggcc

SEQ ID NO: 802228 - DNA, 25 bp, Mus musculus
tgatccaacccgaagaaaagtctgt

SEQ ID NO: 802229 - DNA, 25 bp, Mus musculus
tgatccaacccgtagaaaagtctgt

SEQ ID NO: 802230 - DNA, 25 bp, Mus musculus
tgatccaacctacgctcagggtagg

SEQ ID NO: 802231 - DNA, 25 bp, Mus musculus
tgatccaacctaggctcagggtagg

SEQ ID NO: 802232 - DNA, 25 bp, Mus musculus
tgatccacagttctctgaggcccaa

SEQ ID NO: 802233 - DNA, 25 bp, Mus musculus
tgatccacagttgtctgaggcccaa

SEQ ID NO: 802234 - DNA, 25 bp, Mus musculus
tgatccaccagcaggacagggctct

SEQ ID NO: 802235 - DNA, 25 bp, Mus musculus
tgatccaccagctggacagggctct

SEQ ID NO: 802236 - DNA, 25 bp, Mus musculus
tgatccaccttgaggcaaaggtccg

SEQ ID NO: 802237 - DNA, 25 bp, Mus musculus
tgatccaccttgtggcaaaggtccg

SEQ ID NO: 802238 - DNA, 25 bp, Mus musculus
tgatccacgaagagcaacgctttgc

SEQ ID NO: 802239 - DNA, 25 bp, Mus musculus
tgatccacgaagtgcaacgctttgc

SEQ ID NO: 802240 - DNA, 25 bp, Mus musculus
tgatccactaggaccagggaacgtg

SEQ ID NO: 802241 - DNA, 25 bp, Mus musculus
tgatccactaggtccagggaacgtg

SEQ ID NO: 802242 - DNA, 25 bp, Mus musculus
tgatccagacagagctgcaccacgt

SEQ ID NO: 802243 - DNA, 25 bp, Mus musculus
tgatccagacagtgctgcaccacgt

SEQ ID NO: 802244 - DNA, 25 bp, Mus musculus
tgatccagaggaacctagagcactg

SEQ ID NO: 802245 - DNA, 25 bp, Mus musculus
tgatccagaggatcctagagcactg

SEQ ID NO: 802246 - DNA, 25 bp, Mus musculus
tgatccagaggtagagaagaagcag

SEQ ID NO: 802247 - DNA, 25 bp, Mus musculus
tgatccagaggttgagaagaagcag

SEQ ID NO: 802248 - DNA, 25 bp, Mus musculus
tgatccagcacgactccgaagccat

SEQ ID NO: 802249 - DNA, 25 bp, Mus musculus
tgatccagcacgtctccgaagccat

SEQ ID NO: 802250 - DNA, 25 bp, Mus musculus
tgatccagcactccgtggacgccaa

SEQ ID NO: 802251 - DNA, 25 bp, Mus musculus
tgatccagcactgcgtggacgccaa

SEQ ID NO: 802252 - DNA, 25 bp, Mus musculus
tgatccaggaatccgactgcggcgt

SEQ ID NO: 802253 - DNA, 25 bp, Mus musculus
tgatccaggaatgcgactgcggcgt

SEQ ID NO: 802254 - DNA, 25 bp, Mus musculus
tgatccaggagcaccgaagacccaa

SEQ ID NO: 802255 - DNA, 25 bp, Mus musculus
tgatccaggagctccgaagacccaa

SEQ ID NO: 802256 - DNA, 25 bp, Mus musculus
tgatccaggcctacttcgcgtgtga

SEQ ID NO: 802257 - DNA, 25 bp, Mus musculus
tgatccaggcctcggcacatgcctt

SEQ ID NO: 802258 - DNA, 25 bp, Mus musculus
tgatccaggcctgggcacatgcctt

SEQ ID NO: 802259 - DNA, 25 bp, Mus musculus
tgatccaggccttcttcgcgtgtga

SEQ ID NO: 802260 - DNA, 25 bp, Mus musculus
tgatccaggcgtccaccatgcagca

SEQ ID NO: 802261 - DNA, 25 bp, Mus musculus
tgatccaggcgtgcaccatgcagca

SEQ ID NO: 802262 - DNA, 25 bp, Mus musculus
tgatccagggagctttcaccagtga

SEQ ID NO: 802263 - DNA, 25 bp, Mus musculus
tgatccagggaggtttcaccagtga

SEQ ID NO: 802264 - DNA, 25 bp, Mus musculus
tgatccagtcggctggcctcggtgg

SEQ ID NO: 802265 - DNA, 25 bp, Mus musculus
tgatccagtcgggtggcctcggtgg

SEQ ID NO: 802266 - DNA, 25 bp, Mus musculus
tgatccagtgtcacatctttgcacc

SEQ ID NO: 802267 - DNA, 25 bp, Mus musculus
tgatccagtgtcacccgtggtgcga

SEQ ID NO: 802268 - DNA, 25 bp, Mus musculus
tgatccagtgtctcatctttgcacc

SEQ ID NO: 802269 - DNA, 25 bp, Mus musculus
tgatccagtgtctcccgtggtgcga

SEQ ID NO: 802270 - DNA, 25 bp, Mus musculus
tgatccatatggaagaagaagtgcc

SEQ ID NO: 802271 - DNA, 25 bp, Mus musculus
tgatccatatggtagaagaagtgcc

SEQ ID NO: 802272 - DNA, 25 bp, Mus musculus
tgatccatcgatccggtccttcctg

SEQ ID NO: 802273 - DNA, 25 bp, Mus musculus
tgatccatcgatgcggtccttcctg

SEQ ID NO: 802274 - DNA, 25 bp, Mus musculus
tgatccatcggtagaagaaatgaga

SEQ ID NO: 802275 - DNA, 25 bp, Mus musculus
tgatccatcggttgaagaaatgaga

SEQ ID NO: 802276 - DNA, 25 bp, Mus musculus
tgatccatctctctgagaagacttt

SEQ ID NO: 802277 - DNA, 25 bp, Mus musculus
tgatccatctctgtgagaagacttt

SEQ ID NO: 802278 - DNA, 25 bp, Mus musculus
tgatccatgatcctgttaaccgcga

SEQ ID NO: 802279 - DNA, 25 bp, Mus musculus
tgatccatgatcgtgttaaccgcga

SEQ ID NO: 802280 - DNA, 25 bp, Mus musculus
tgatcccaaagaaagagtacctgga

SEQ ID NO: 802281 - DNA, 25 bp, Mus musculus
tgatcccaaagatagagtacctgga

SEQ ID NO: 802282 - DNA, 25 bp, Mus musculus
tgatcccaatgccaagggctggatg

SEQ ID NO: 802283 - DNA, 25 bp, Mus musculus
tgatcccaatgcgaagggctggatg

SEQ ID NO: 802284 - DNA, 25 bp, Mus musculus
tgatcccacaggactttcatgaaga

SEQ ID NO: 802285 - DNA, 25 bp, Mus musculus
tgatcccacaggtctttcatgaaga

SEQ ID NO: 802286 - DNA, 25 bp, Mus musculus
tgatcccagccccttgaagtcaggg

SEQ ID NO: 802287 - DNA, 25 bp, Mus musculus
tgatcccagcccgttgaagtcaggg

SEQ ID NO: 802288 - DNA, 25 bp, Mus musculus
tgatcccagggaactaaaagaggtg

SEQ ID NO: 802289 - DNA, 25 bp, Mus musculus
tgatcccagggatctaaaagaggtg

SEQ ID NO: 802290 - DNA, 25 bp, Mus musculus
tgatccccaatgcttcgcaaccaga

SEQ ID NO: 802291 - DNA, 25 bp, Mus musculus
tgatccccaatggttcgcaaccaga

SEQ ID NO: 802292 - DNA, 25 bp, Mus musculus
tgatccccactcagtgcaatgctgc

SEQ ID NO: 802293 - DNA, 25 bp, Mus musculus
tgatccccactctgtgcaatgctgc

SEQ ID NO: 802294 - DNA, 25 bp, Mus musculus
tgatccccacttactatggaaactc

SEQ ID NO: 802295 - DNA, 25 bp, Mus musculus
tgatccccactttctatggaaactc

SEQ ID NO: 802296 - DNA, 25 bp, Mus musculus
tgatcccccaggcaaagacttcagt

SEQ ID NO: 802297 - DNA, 25 bp, Mus musculus
tgatcccccagggaaagacttcagt

SEQ ID NO: 802298 - DNA, 25 bp, Mus musculus
tgatccccgaggcagtcaacggtat

SEQ ID NO: 802299 - DNA, 25 bp, Mus musculus
tgatccccgagggagtcaacggtat

SEQ ID NO: 802300 - DNA, 25 bp, Mus musculus
tgatccccgcagatggtgagtgatg

SEQ ID NO: 802301 - DNA, 25 bp, Mus musculus
tgatccccgcagttggtgagtgatg

SEQ ID NO: 802302 - DNA, 25 bp, Mus musculus
tgatccccgtgcacagggcagttgg

SEQ ID NO: 802303 - DNA, 25 bp, Mus musculus
tgatccccgtgctcagggcagttgg

SEQ ID NO: 802304 - DNA, 25 bp, Mus musculus
tgatcccctcaacatcaaacagaac

SEQ ID NO: 802305 - DNA, 25 bp, Mus musculus
tgatcccctcaagatcaaacagaac

SEQ ID NO: 802306 - DNA, 25 bp, Mus musculus
tgatccccttccacatcatagtggg

SEQ ID NO: 802307 - DNA, 25 bp, Mus musculus
tgatccccttcctcatcatagtggg

SEQ ID NO: 802308 - DNA, 25 bp, Mus musculus
tgatcccgagtgagccctatctcta

SEQ ID NO: 802309 - DNA, 25 bp, Mus musculus
tgatcccgagtgtgccctatctcta

SEQ ID NO: 802310 - DNA, 25 bp, Mus musculus
tgatcccgtcagctgtccctggtga

SEQ ID NO: 802311 - DNA, 25 bp, Mus musculus
tgatcccgtcaggtgtccctggtga

SEQ ID NO: 802312 - DNA, 25 bp, Mus musculus
tgatccctattcaagtgcagagccg

SEQ ID NO: 802313 - DNA, 25 bp, Mus musculus
tgatccctattctagtgcagagccg

SEQ ID NO: 802314 - DNA, 25 bp, Mus musculus
tgatccctatttcccttatgacggg

SEQ ID NO: 802315 - DNA, 25 bp, Mus musculus
tgatccctatttgccttatgacggg

SEQ ID NO: 802316 - DNA, 25 bp, Mus musculus
tgatccctgctgagaccatttcacc

SEQ ID NO: 802317 - DNA, 25 bp, Mus musculus
tgatccctgctgtgaccatttcacc

SEQ ID NO: 802318 - DNA, 25 bp, Mus musculus
tgatccgagctcacatcttaggcta

SEQ ID NO: 802319 - DNA, 25 bp, Mus musculus
tgatccgagctctcatcttaggcta

SEQ ID NO: 802320 - DNA, 25 bp, Mus musculus
tgatccgataccagaggcacgagga

SEQ ID NO: 802321 - DNA, 25 bp, Mus musculus
tgatccgatacctgaggcacgagga

SEQ ID NO: 802322 - DNA, 25 bp, Mus musculus
tgatccgctgtgatgaggaaaccca

SEQ ID NO: 802323 - DNA, 25 bp, Mus musculus
tgatccgctgtgttgaggaaaccca

SEQ ID NO: 802324 - DNA, 25 bp, Mus musculus
tgatccggcacaacaaagcctttgg

SEQ ID NO: 802325 - DNA, 25 bp, Mus musculus
tgatccggcacatcaaagcctttgg

SEQ ID NO: 802326 - DNA, 25 bp, Mus musculus
tgatccggctaaagaagaagggaga

SEQ ID NO: 802327 - DNA, 25 bp, Mus musculus
tgatccggctaatgaagaagggaga

SEQ ID NO: 802328 - DNA, 25 bp, Mus musculus
tgatccgggaagaacgagctgactc

SEQ ID NO: 802329 - DNA, 25 bp, Mus musculus
tgatccgggaagtacgagctgactc

SEQ ID NO: 802330 - DNA, 25 bp, Mus musculus
tgatccgtcagaaacggcaggcgcg

SEQ ID NO: 802331 - DNA, 25 bp, Mus musculus
tgatccgtcagatacggcaggcgcg

SEQ ID NO: 802332 - DNA, 25 bp, Mus musculus
tgatcctactatcagcaaaaagaaa

SEQ ID NO: 802333 - DNA, 25 bp, Mus musculus
tgatcctactatgagcaaaaagaaa

SEQ ID NO: 802334 - DNA, 25 bp, Mus musculus
tgatcctattttagtcctcctgcac

SEQ ID NO: 802335 - DNA, 25 bp, Mus musculus
tgatcctatttttgtcctcctgcac

SEQ ID NO: 802336 - DNA, 25 bp, Mus musculus
tgatcctcatcgcacaggtgaccgt

SEQ ID NO: 802337 - DNA, 25 bp, Mus musculus
tgatcctcatcggacaggtgaccgt

SEQ ID NO: 802338 - DNA, 25 bp, Mus musculus
tgatcctccaagcaaggaccatctg

SEQ ID NO: 802339 - DNA, 25 bp, Mus musculus
tgatcctccaaggaaggaccatctg

SEQ ID NO: 802340 - DNA, 25 bp, Mus musculus
tgatcctcccagcattcatagactt

SEQ ID NO: 802341 - DNA, 25 bp, Mus musculus
tgatcctcccaggattcatagactt

SEQ ID NO: 802342 - DNA, 25 bp, Mus musculus
tgatcctccgagacattgcaagagc

SEQ ID NO: 802343 - DNA, 25 bp, Mus musculus
tgatcctccgagtcattgcaagagc

SEQ ID NO: 802344 - DNA, 25 bp, Mus musculus
tgatcctcggataattgcggctaac

SEQ ID NO: 802345 - DNA, 25 bp, Mus musculus
tgatcctcggattattgcggctaac

SEQ ID NO: 802346 - DNA, 25 bp, Mus musculus
tgatcctcgtccacttacctcacca

SEQ ID NO: 802347 - DNA, 25 bp, Mus musculus
tgatcctcgtcctcttacctcacca

SEQ ID NO: 802348 - DNA, 25 bp, Mus musculus
tgatcctctggcagtactccacctt

SEQ ID NO: 802349 - DNA, 25 bp, Mus musculus
tgatcctctggctgtactccacctt

SEQ ID NO: 802350 - DNA, 25 bp, Mus musculus
tgatcctcttgccttcgttccaaat

SEQ ID NO: 802351 - DNA, 25 bp, Mus musculus
tgatcctcttgcgttcgttccaaat

SEQ ID NO: 802352 - DNA, 25 bp, Mus musculus
tgatcctgaaccatcacgtggccct

SEQ ID NO: 802353 - DNA, 25 bp, Mus musculus
tgatcctgaaccttcacgtggccct

SEQ ID NO: 802354 - DNA, 25 bp, Mus musculus
tgatcctgaggaataaccgtgcagc

SEQ ID NO: 802355 - DNA, 25 bp, Mus musculus
tgatcctgaggattaaccgtgcagc

SEQ ID NO: 802356 - DNA, 25 bp, Mus musculus
tgatcctggaggaaagaatgaaccc

SEQ ID NO: 802357 - DNA, 25 bp, Mus musculus
tgatcctggaggacagcggacatgc

SEQ ID NO: 802358 - DNA, 25 bp, Mus musculus
tgatcctggaggtaagaatgaaccc

SEQ ID NO: 802359 - DNA, 25 bp, Mus musculus
tgatcctggaggtcagcggacatgc

SEQ ID NO: 802360 - DNA, 25 bp, Mus musculus
tgatcctggcagcagtggccatcct

SEQ ID NO: 802361 - DNA, 25 bp, Mus musculus
tgatcctggcaggagtggccatcct

SEQ ID NO: 802362 - DNA, 25 bp, Mus musculus
tgatcctggccgaggcttcagctgg

SEQ ID NO: 802363 - DNA, 25 bp, Mus musculus
tgatcctggccgtggcttcagctgg

SEQ ID NO: 802364 - DNA, 25 bp, Mus musculus
tgatcctggctccaggtgtcatgct

SEQ ID NO: 802365 - DNA, 25 bp, Mus musculus
tgatcctggctcgaggtgtcatgct

SEQ ID NO: 802366 - DNA, 25 bp, Mus musculus
tgatcctgggagatgacagccaaag

SEQ ID NO: 802367 - DNA, 25 bp, Mus musculus
tgatcctgggagttgacagccaaag

SEQ ID NO: 802368 - DNA, 25 bp, Mus musculus
tgatcctggggactaaggctgccca

SEQ ID NO: 802369 - DNA, 25 bp, Mus musculus
tgatcctggggagtaaggctgccca

SEQ ID NO: 802370 - DNA, 25 bp, Mus musculus
tgatcctgtgcgacctgcagctggg

SEQ ID NO: 802371 - DNA, 25 bp, Mus musculus
tgatcctgtgcgtcctgcagctggg

SEQ ID NO: 802372 - DNA, 25 bp, Mus musculus
tgatccttaaggctggttgtgcact

SEQ ID NO: 802373 - DNA, 25 bp, Mus musculus
tgatccttaagggtggttgtgcact

SEQ ID NO: 802374 - DNA, 25 bp, Mus musculus
tgatccttagccactcttcttgtag

SEQ ID NO: 802375 - DNA, 25 bp, Mus musculus
tgatccttagcctctcttcttgtag

SEQ ID NO: 802376 - DNA, 25 bp, Mus musculus
tgatccttccagcaatggacagccg

SEQ ID NO: 802377 - DNA, 25 bp, Mus musculus
tgatccttccaggaatggacagccg

SEQ ID NO: 802378 - DNA, 25 bp, Mus musculus
tgatccttcttccaaaatctatgaa

SEQ ID NO: 802379 - DNA, 25 bp, Mus musculus
tgatccttcttcgaaaatctatgaa

SEQ ID NO: 802380 - DNA, 25 bp, Mus musculus
tgatccttttctagaaccgggaata

SEQ ID NO: 802381 - DNA, 25 bp, Mus musculus
tgatccttttcttgaaccgggaata

SEQ ID NO: 802382 - DNA, 25 bp, Mus musculus
tgatcgaaacctcatgacagctctg

SEQ ID NO: 802383 - DNA, 25 bp, Mus musculus
tgatcgaaacctgatgacagctctg

SEQ ID NO: 802384 - DNA, 25 bp, Mus musculus
tgatcgaaaggaatggttaactaat

SEQ ID NO: 802385 - DNA, 25 bp, Mus musculus
tgatcgaaaggattggttaactaat

SEQ ID NO: 802386 - DNA, 25 bp, Mus musculus
tgatcgaacagaacgacagcagcat

SEQ ID NO: 802387 - DNA, 25 bp, Mus musculus
tgatcgaacagatcgacagcagcat

SEQ ID NO: 802388 - DNA, 25 bp, Mus musculus
tgatcgaatgggaggtagaaaagat

SEQ ID NO: 802389 - DNA, 25 bp, Mus musculus
tgatcgaatgggtggtagaaaagat

SEQ ID NO: 802390 - DNA, 25 bp, Mus musculus
tgatcgacaagaacctgcgggagga

SEQ ID NO: 802391 - DNA, 25 bp, Mus musculus
tgatcgacaagatcctgcgggagga

SEQ ID NO: 802392 - DNA, 25 bp, Mus musculus
tgatcgacctctacagcaaccaggg

SEQ ID NO: 802393 - DNA, 25 bp, Mus musculus
tgatcgacctcttcagcaaccaggg

SEQ ID NO: 802394 - DNA, 25 bp, Mus musculus
tgatcgagaagtacgtggacactcc

SEQ ID NO: 802395 - DNA, 25 bp, Mus musculus
tgatcgagaagttcgtggacactcc

SEQ ID NO: 802396 - DNA, 25 bp, Mus musculus
tgatcgagacagaggataaggcgta

SEQ ID NO: 802397 - DNA, 25 bp, Mus musculus
tgatcgagacagtggataaggcgta

SEQ ID NO: 802398 - DNA, 25 bp, Mus musculus
tgatcgagactgagaagactctcta

SEQ ID NO: 802399 - DNA, 25 bp, Mus musculus
tgatcgagactgtgaagactctcta

SEQ ID NO: 802400 - DNA, 25 bp, Mus musculus
tgatcgagcggcaggctcgaagtca

SEQ ID NO: 802401 - DNA, 25 bp, Mus musculus
tgatcgagcggctggctcgaagtca

SEQ ID NO: 802402 - DNA, 25 bp, Mus musculus
tgatcgagtcatcccttctcaggag

SEQ ID NO: 802403 - DNA, 25 bp, Mus musculus
tgatcgagtcatgccttctcaggag

SEQ ID NO: 802404 - DNA, 25 bp, Mus musculus
tgatcgatacacagaaggaagtgga

SEQ ID NO: 802405 - DNA, 25 bp, Mus musculus
tgatcgatacactgaaggaagtgga

SEQ ID NO: 802406 - DNA, 25 bp, Mus musculus
tgatcgatacgcagatgctgggacc

SEQ ID NO: 802407 - DNA, 25 bp, Mus musculus
tgatcgatacgctgatgctgggacc

SEQ ID NO: 802408 - DNA, 25 bp, Mus musculus
tgatcgatccccactccatgaggct

SEQ ID NO: 802409 - DNA, 25 bp, Mus musculus
tgatcgatcccctctccatgaggct

SEQ ID NO: 802410 - DNA, 25 bp, Mus musculus
tgatcgcagcacagaaaacaaagtg

SEQ ID NO: 802411 - DNA, 25 bp, Mus musculus
tgatcgcagcactgaaaacaaagtg

SEQ ID NO: 802412 - DNA, 25 bp, Mus musculus
tgatcgcattgccatacctgaggcc

SEQ ID NO: 802413 - DNA, 25 bp, Mus musculus
tgatcgcattgcgatacctgaggcc

SEQ ID NO: 802414 - DNA, 25 bp, Mus musculus
tgatcgccctgcaagacctactctt

SEQ ID NO: 802415 - DNA, 25 bp, Mus musculus
tgatcgccctgctagacctactctt

SEQ ID NO: 802416 - DNA, 25 bp, Mus musculus
tgatcgccgaccacttcgtggcaga

SEQ ID NO: 802417 - DNA, 25 bp, Mus musculus
tgatcgccgacctcttcgtggcaga

SEQ ID NO: 802418 - DNA, 25 bp, Mus musculus
tgatcgctcctaccgtggctgccgg

SEQ ID NO: 802419 - DNA, 25 bp, Mus musculus
tgatcgctcctagcgtggctgccgg

SEQ ID NO: 802420 - DNA, 25 bp, Mus musculus
tgatcgctccttacggtcctgagca

SEQ ID NO: 802421 - DNA, 25 bp, Mus musculus
tgatcgctcctttcggtcctgagca

SEQ ID NO: 802422 - DNA, 25 bp, Mus musculus
tgatcgctctcgagaacgcaaggtg

SEQ ID NO: 802423 - DNA, 25 bp, Mus musculus
tgatcgctctcgtgaacgcaaggtg

SEQ ID NO: 802424 - DNA, 25 bp, Mus musculus
tgatcgctctctatgcaacctatga

SEQ ID NO: 802425 - DNA, 25 bp, Mus musculus
tgatcgctctctttgcaacctatga

SEQ ID NO: 802426 - DNA, 25 bp, Mus musculus
tgatcgctgccgctttaccaataca

SEQ ID NO: 802427 - DNA, 25 bp, Mus musculus
tgatcgctgccggtttaccaataca

SEQ ID NO: 802428 - DNA, 25 bp, Mus musculus
tgatcgctgcggacagcctgggatt

SEQ ID NO: 802429 - DNA, 25 bp, Mus musculus
tgatcgctgcggtcagcctgggatt

SEQ ID NO: 802430 - DNA, 25 bp, Mus musculus
tgatcggaagagcaaccgtctctga

SEQ ID NO: 802431 - DNA, 25 bp, Mus musculus
tgatcggaagaggaaccgtctctga

SEQ ID NO: 802432 - DNA, 25 bp, Mus musculus
tgatcggacgccagggcagcaagat

SEQ ID NO: 802433 - DNA, 25 bp, Mus musculus
tgatcggacgcctgggcagcaagat

SEQ ID NO: 802434 - DNA, 25 bp, Mus musculus
tgatcggagagcagcggtcatcttt

SEQ ID NO: 802435 - DNA, 25 bp, Mus musculus
tgatcggagagctgcggtcatcttt

SEQ ID NO: 802436 - DNA, 25 bp, Mus musculus
tgatcggagctgcaagattcagaag

SEQ ID NO: 802437 - DNA, 25 bp, Mus musculus
tgatcggagctggaagattcagaag

SEQ ID NO: 802438 - DNA, 25 bp, Mus musculus
tgatcggcaaagcagtggagcacat

SEQ ID NO: 802439 - DNA, 25 bp, Mus musculus
tgatcggcaaaggagtggagcacat

SEQ ID NO: 802440 - DNA, 25 bp, Mus musculus
tgatcggcacaaagacaatataatg

SEQ ID NO: 802441 - DNA, 25 bp, Mus musculus
tgatcggcacaatgacaatataatg

SEQ ID NO: 802442 - DNA, 25 bp, Mus musculus
tgatcggcagaacgccattgtagcc

SEQ ID NO: 802443 - DNA, 25 bp, Mus musculus
tgatcggcagaaggccattgtagcc

SEQ ID NO: 802444 - DNA, 25 bp, Mus musculus
tgatcggcatggatgtagctgcgtc

SEQ ID NO: 802445 - DNA, 25 bp, Mus musculus
tgatcggcatggttgtagctgcgtc

SEQ ID NO: 802446 - DNA, 25 bp, Mus musculus
tgatcggccggcacaccagtctgcg

SEQ ID NO: 802447 - DNA, 25 bp, Mus musculus
tgatcggccggctcaccagtctgcg

SEQ ID NO: 802448 - DNA, 25 bp, Mus musculus
tgatcggcctctacgtctttgagcg

SEQ ID NO: 802449 - DNA, 25 bp, Mus musculus
tgatcggcctcttcgtctttgagcg

SEQ ID NO: 802450 - DNA, 25 bp, Mus musculus
tgatcgggataaaagtgactctgag

SEQ ID NO: 802451 - DNA, 25 bp, Mus musculus
tgatcgggataatagtgactctgag

SEQ ID NO: 802452 - DNA, 25 bp, Mus musculus
tgatcgggctcaccgccatcgactt

SEQ ID NO: 802453 - DNA, 25 bp, Mus musculus
tgatcgggctcagcgccatcgactt

SEQ ID NO: 802454 - DNA, 25 bp, Mus musculus
tgatcgggcttacgtctctgtggac

SEQ ID NO: 802455 - DNA, 25 bp, Mus musculus
tgatcgggcttaggtctctgtggac

SEQ ID NO: 802456 - DNA, 25 bp, Mus musculus
tgatcgtagcagcaggaaacacgct

SEQ ID NO: 802457 - DNA, 25 bp, Mus musculus
tgatcgtagcaggaggaaacacgct

SEQ ID NO: 802458 - DNA, 25 bp, Mus musculus
tgatcgtcatacagacctcgacagg

SEQ ID NO: 802459 - DNA, 25 bp, Mus musculus
tgatcgtcatactgacctcgacagg

SEQ ID NO: 802460 - DNA, 25 bp, Mus musculus
tgatcgtcatcaacaaatcacagca

SEQ ID NO: 802461 - DNA, 25 bp, Mus musculus
tgatcgtcatcatcaaatcacagca

SEQ ID NO: 802462 - DNA, 25 bp, Mus musculus
tgatcgtgcgttccagaaaacaaga

SEQ ID NO: 802463 - DNA, 25 bp, Mus musculus
tgatcgtgcgttgcagaaaacaaga

SEQ ID NO: 802464 - DNA, 25 bp, Mus musculus
tgatcgtggcctacacgggcgcctg

SEQ ID NO: 802465 - DNA, 25 bp, Mus musculus
tgatcgtggccttcacgggcgcctg

SEQ ID NO: 802466 - DNA, 25 bp, Mus musculus
tgatcgtgtgcgcagcattgccaag

SEQ ID NO: 802467 - DNA, 25 bp, Mus musculus
tgatcgtgtgcggagcattgccaag

SEQ ID NO: 802468 - DNA, 25 bp, Mus musculus
tgatctaaatgtcctcagaaggagc

SEQ ID NO: 802469 - DNA, 25 bp, Mus musculus
tgatctaaatgtgctcagaaggagc

SEQ ID NO: 802470 - DNA, 25 bp, Mus musculus
tgatctaacaggacaaacccgacga

SEQ ID NO: 802471 - DNA, 25 bp, Mus musculus
tgatctaacaggtcaaacccgacga

SEQ ID NO: 802472 - DNA, 25 bp, Mus musculus
tgatctaagattacatgcctggaac

SEQ ID NO: 802473 - DNA, 25 bp, Mus musculus
tgatctaagatttcatgcctggaac

SEQ ID NO: 802474 - DNA, 25 bp, Mus musculus
tgatctacagctccttgtcttcatg

SEQ ID NO: 802475 - DNA, 25 bp, Mus musculus
tgatctacagctgcttgtcttcatg

SEQ ID NO: 802476 - DNA, 25 bp, Mus musculus
tgatctaccggcaatatgcagctct

SEQ ID NO: 802477 - DNA, 25 bp, Mus musculus
tgatctaccggctatatgcagctct

SEQ ID NO: 802478 - DNA, 25 bp, Mus musculus
tgatctacctagcagacggctctgg

SEQ ID NO: 802479 - DNA, 25 bp, Mus musculus
tgatctacctaggagacggctctgg

SEQ ID NO: 802480 - DNA, 25 bp, Mus musculus
tgatctacgacacgacttcaatatg

SEQ ID NO: 802481 - DNA, 25 bp, Mus musculus
tgatctacgacaggacttcaatatg

SEQ ID NO: 802482 - DNA, 25 bp, Mus musculus
tgatctactcacctgtggccagtgt

SEQ ID NO: 802483 - DNA, 25 bp, Mus musculus
tgatctactcacgtgtggccagtgt

SEQ ID NO: 802484 - DNA, 25 bp, Mus musculus
tgatctagaaatctacagcacaggt

SEQ ID NO: 802485 - DNA, 25 bp, Mus musculus
tgatctagaaatgtacagcacaggt

SEQ ID NO: 802486 - DNA, 25 bp, Mus musculus
tgatctagcactaatccggaagaac

SEQ ID NO: 802487 - DNA, 25 bp, Mus musculus
tgatctagcacttatccggaagaac

SEQ ID NO: 802488 - DNA, 25 bp, Mus musculus
tgatctagccaccaagagagtacgg

SEQ ID NO: 802489 - DNA, 25 bp, Mus musculus
tgatctagccacgaagagagtacgg

SEQ ID NO: 802490 - DNA, 25 bp, Mus musculus
tgatctattagcatcacaagcacaa

SEQ ID NO: 802491 - DNA, 25 bp, Mus musculus
tgatctattagcttcacaagcacaa

SEQ ID NO: 802492 - DNA, 25 bp, Mus musculus
tgatctattggaccaggacaaacgg

SEQ ID NO: 802493 - DNA, 25 bp, Mus musculus
tgatctattggagcaggacaaacgg

SEQ ID NO: 802494 - DNA, 25 bp, Mus musculus
tgatctcacggcaactgctaacaga

SEQ ID NO: 802495 - DNA, 25 bp, Mus musculus
tgatctcacggctactgctaacaga

SEQ ID NO: 802496 - DNA, 25 bp, Mus musculus
tgatctcactctacagtattcctgt

SEQ ID NO: 802497 - DNA, 25 bp, Mus musculus
tgatctcactcttcagtattcctgt

SEQ ID NO: 802498 - DNA, 25 bp, Mus musculus
tgatctcagaagcaggtcaacatct

SEQ ID NO: 802499 - DNA, 25 bp, Mus musculus
tgatctcagaaggaggtcaacatct

SEQ ID NO: 802500 - DNA, 25 bp, Mus musculus
tgatctcagaggcttcctcccaccg

SEQ ID NO: 802501 - DNA, 25 bp, Mus musculus
tgatctcagagggttcctcccaccg

SEQ ID NO: 802502 - DNA, 25 bp, Mus musculus
tgatctcagccacaaggccatcttc

SEQ ID NO: 802503 - DNA, 25 bp, Mus musculus
tgatctcagccagaaggccatcttc

SEQ ID NO: 802504 - DNA, 25 bp, Mus musculus
tgatctcagcctaggcaaaagtgat

SEQ ID NO: 802505 - DNA, 25 bp, Mus musculus
tgatctcagccttggcaaaagtgat

SEQ ID NO: 802506 - DNA, 25 bp, Mus musculus
tgatctcaggacagctgtactggag

SEQ ID NO: 802507 - DNA, 25 bp, Mus musculus
tgatctcaggactgctgtactggag

SEQ ID NO: 802508 - DNA, 25 bp, Mus musculus
tgatctcagttgcaggacaacatca

SEQ ID NO: 802509 - DNA, 25 bp, Mus musculus
tgatctcagttggaggacaacatca

SEQ ID NO: 802510 - DNA, 25 bp, Mus musculus
tgatctcatggtcgtcttcgggtac

SEQ ID NO: 802511 - DNA, 25 bp, Mus musculus
tgatctcatggtggtcttcgggtac

SEQ ID NO: 802512 - DNA, 25 bp, Mus musculus
tgatctcattttcctcatgctagac

SEQ ID NO: 802513 - DNA, 25 bp, Mus musculus
tgatctcattttgctcatgctagac

SEQ ID NO: 802514 - DNA, 25 bp, Mus musculus
tgatctccacccaatgcgagtcctg

SEQ ID NO: 802515 - DNA, 25 bp, Mus musculus
tgatctccaccctatgcgagtcctg

SEQ ID NO: 802516 - DNA, 25 bp, Mus musculus
tgatctccaggtaaccatcttggag

SEQ ID NO: 802517 - DNA, 25 bp, Mus musculus
tgatctccaggttaccatcttggag

SEQ ID NO: 802518 - DNA, 25 bp, Mus musculus
tgatctccagtcaccgagtggtggg

SEQ ID NO: 802519 - DNA, 25 bp, Mus musculus
tgatctccagtctccgagtggtggg

SEQ ID NO: 802520 - DNA, 25 bp, Mus musculus
tgatctccatctctgggccctgacg

SEQ ID NO: 802521 - DNA, 25 bp, Mus musculus
tgatctccatctgtgggccctgacg

SEQ ID NO: 802522 - DNA, 25 bp, Mus musculus
tgatctcctgcaagttgggctctgt

SEQ ID NO: 802523 - DNA, 25 bp, Mus musculus
tgatctcctgcatgttgggctctgt

SEQ ID NO: 802524 - DNA, 25 bp, Mus musculus
tgatctcgccaaaaaagcttgaccc

SEQ ID NO: 802525 - DNA, 25 bp, Mus musculus
tgatctcgccaataaagcttgaccc

SEQ ID NO: 802526 - DNA, 25 bp, Mus musculus
tgatctcggactatggaccattggt

SEQ ID NO: 802527 - DNA, 25 bp, Mus musculus
tgatctcggactttggaccattggt

SEQ ID NO: 802528 - DNA, 25 bp, Mus musculus
tgatctctacttaggagtcctctag

SEQ ID NO: 802529 - DNA, 25 bp, Mus musculus
tgatctctactttggagtcctctag

SEQ ID NO: 802530 - DNA, 25 bp, Mus musculus
tgatctctcaggctccatctgtctc

SEQ ID NO: 802531 - DNA, 25 bp, Mus musculus
tgatctctcagggtccatctgtctc

SEQ ID NO: 802532 - DNA, 25 bp, Mus musculus
tgatctctctgcacatctatgccct

SEQ ID NO: 802533 - DNA, 25 bp, Mus musculus
tgatctctctgctcatctatgccct

SEQ ID NO: 802534 - DNA, 25 bp, Mus musculus
tgatctctgagcaggcgtgggactc

SEQ ID NO: 802535 - DNA, 25 bp, Mus musculus
tgatctctgagctggcgtgggactc

SEQ ID NO: 802536 - DNA, 25 bp, Mus musculus
tgatctctgcaccaagggctttcca

SEQ ID NO: 802537 - DNA, 25 bp, Mus musculus
tgatctctgcacgaagggctttcca

SEQ ID NO: 802538 - DNA, 25 bp, Mus musculus
tgatctctgtggctgagaggcccct

SEQ ID NO: 802539 - DNA, 25 bp, Mus musculus
tgatctctgtgggtgagaggcccct

SEQ ID NO: 802540 - DNA, 25 bp, Mus musculus
tgatctcttacaataacagcccatg

SEQ ID NO: 802541 - DNA, 25 bp, Mus musculus
tgatctcttacattaacagcccatg

SEQ ID NO: 802542 - DNA, 25 bp, Mus musculus
tgatctcttcataaacctctccagg

SEQ ID NO: 802543 - DNA, 25 bp, Mus musculus
tgatctcttcattaacctctccagg

SEQ ID NO: 802544 - DNA, 25 bp, Mus musculus
tgatctctttggaccccatgactgt

SEQ ID NO: 802545 - DNA, 25 bp, Mus musculus
tgatctctttggtccccatgactgt

SEQ ID NO: 802546 - DNA, 25 bp, Mus musculus
tgatctgaaatgacccaggtgatgt

SEQ ID NO: 802547 - DNA, 25 bp, Mus musculus
tgatctgaaatgtcccaggtgatgt

SEQ ID NO: 802548 - DNA, 25 bp, Mus musculus
tgatctgaatggaaatggagatatc

SEQ ID NO: 802549 - DNA, 25 bp, Mus musculus
tgatctgaatggtaatggagatatc

SEQ ID NO: 802550 - DNA, 25 bp, Mus musculus
tgatctgaggaaagtggaagccgcc

SEQ ID NO: 802551 - DNA, 25 bp, Mus musculus
tgatctgaggaatgtggaagccgcc

SEQ ID NO: 802552 - DNA, 25 bp, Mus musculus
tgatctgatggacacaacccagtac

SEQ ID NO: 802553 - DNA, 25 bp, Mus musculus
tgatctgatggagacaacccagtac

SEQ ID NO: 802554 - DNA, 25 bp, Mus musculus
tgatctgcatgcactgactgggtgg

SEQ ID NO: 802555 - DNA, 25 bp, Mus musculus
tgatctgcatgctctgactgggtgg

SEQ ID NO: 802556 - DNA, 25 bp, Mus musculus
tgatctgcccaaaaaagaagacgcc

SEQ ID NO: 802557 - DNA, 25 bp, Mus musculus
tgatctgcccaataaagaagacgcc

SEQ ID NO: 802558 - DNA, 25 bp, Mus musculus
tgatctgcccagaccattgaaaagt

SEQ ID NO: 802559 - DNA, 25 bp, Mus musculus
tgatctgcccagtccattgaaaagt

SEQ ID NO: 802560 - DNA, 25 bp, Mus musculus
tgatctgcctgcaggaaatgaaatg

SEQ ID NO: 802561 - DNA, 25 bp, Mus musculus
tgatctgcctgctggaaatgaaatg

SEQ ID NO: 802562 - DNA, 25 bp, Mus musculus
tgatctggacacaatcgatgtcagc

SEQ ID NO: 802563 - DNA, 25 bp, Mus musculus
tgatctggacactatcgatgtcagc

SEQ ID NO: 802564 - DNA, 25 bp, Mus musculus
tgatctggacgcctctgccgctgta

SEQ ID NO: 802565 - DNA, 25 bp, Mus musculus
tgatctggacgcgtctgccgctgta

SEQ ID NO: 802566 - DNA, 25 bp, Mus musculus
tgatctgggacccagaagcaacaag

SEQ ID NO: 802567 - DNA, 25 bp, Mus musculus
tgatctgggaccgagaagcaacaag

SEQ ID NO: 802568 - DNA, 25 bp, Mus musculus
tgatctggggccagaatttgggaaa

SEQ ID NO: 802569 - DNA, 25 bp, Mus musculus
tgatctggggcctgaatttgggaaa

SEQ ID NO: 802570 - DNA, 25 bp, Mus musculus
tgatctggtggacgaatctgaccca

SEQ ID NO: 802571 - DNA, 25 bp, Mus musculus
tgatctggtggaggaatctgaccca

SEQ ID NO: 802572 - DNA, 25 bp, Mus musculus
tgatctgtaccacaagaggctgact

SEQ ID NO: 802573 - DNA, 25 bp, Mus musculus
tgatctgtaccagaagaggctgact

SEQ ID NO: 802574 - DNA, 25 bp, Mus musculus
tgatctgtaccgcaagctcaaggag

SEQ ID NO: 802575 - DNA, 25 bp, Mus musculus
tgatctgtaccggaagctcaaggag

SEQ ID NO: 802576 - DNA, 25 bp, Mus musculus
tgatctgtgtccacgctgtggtcct

SEQ ID NO: 802577 - DNA, 25 bp, Mus musculus
tgatctgtgtcctcgctgtggtcct

SEQ ID NO: 802578 - DNA, 25 bp, Mus musculus
tgatcttcacaaaggcggtcctctg

SEQ ID NO: 802579 - DNA, 25 bp, Mus musculus
tgatcttcacaatggcggtcctctg

SEQ ID NO: 802580 - DNA, 25 bp, Mus musculus
tgatcttcatgaaggaaggctgtat

SEQ ID NO: 802581 - DNA, 25 bp, Mus musculus
tgatcttcatgatggaaggctgtat

SEQ ID NO: 802582 - DNA, 25 bp, Mus musculus
tgatcttccacaccagagacaaagg

SEQ ID NO: 802583 - DNA, 25 bp, Mus musculus
tgatcttccacagcagagacaaagg

SEQ ID NO: 802584 - DNA, 25 bp, Mus musculus
tgatcttcccaacagtgctgcatgg

SEQ ID NO: 802585 - DNA, 25 bp, Mus musculus
tgatcttcccaagagtgctgcatgg

SEQ ID NO: 802586 - DNA, 25 bp, Mus musculus
tgatcttccctcaaacataacagtg

SEQ ID NO: 802587 - DNA, 25 bp, Mus musculus
tgatcttccctctaacataacagtg

SEQ ID NO: 802588 - DNA, 25 bp, Mus musculus
tgatcttcccttaaccctgggcctg

SEQ ID NO: 802589 - DNA, 25 bp, Mus musculus
tgatcttccctttaccctgggcctg

SEQ ID NO: 802590 - DNA, 25 bp, Mus musculus
tgatcttcctgaagaggaccctgag

SEQ ID NO: 802591 - DNA, 25 bp, Mus musculus
tgatcttcctgatgaggaccctgag

SEQ ID NO: 802592 - DNA, 25 bp, Mus musculus
tgatcttctcagctgcacagcactc

SEQ ID NO: 802593 - DNA, 25 bp, Mus musculus
tgatcttctcaggtgcacagcactc

SEQ ID NO: 802594 - DNA, 25 bp, Mus musculus
tgatcttcttgtcagcacatccaaa

SEQ ID NO: 802595 - DNA, 25 bp, Mus musculus
tgatcttcttgtgagcacatccaaa

SEQ ID NO: 802596 - DNA, 25 bp, Mus musculus
tgatcttgaaagagatgttaaggac

SEQ ID NO: 802597 - DNA, 25 bp, Mus musculus
tgatcttgaaagtgatgttaaggac

SEQ ID NO: 802598 - DNA, 25 bp, Mus musculus
tgatcttgatcactaccgggactgg

SEQ ID NO: 802599 - DNA, 25 bp, Mus musculus
tgatcttgatcagtaccgggactgg

SEQ ID NO: 802600 - DNA, 25 bp, Mus musculus
tgatcttggattcaaggcttagcct

SEQ ID NO: 802601 - DNA, 25 bp, Mus musculus
tgatcttggattgaaggcttagcct

SEQ ID NO: 802602 - DNA, 25 bp, Mus musculus
tgatcttggcatcatcttgcgaaag

SEQ ID NO: 802603 - DNA, 25 bp, Mus musculus
tgatcttggcatgatcttgcgaaag

SEQ ID NO: 802604 - DNA, 25 bp, Mus musculus
tgatctttacccctccttcctaagg

SEQ ID NO: 802605 - DNA, 25 bp, Mus musculus
tgatctttacccgtccttcctaagg

SEQ ID NO: 802606 - DNA, 25 bp, Mus musculus
tgatctttatgtctctcttgcctta

SEQ ID NO: 802607 - DNA, 25 bp, Mus musculus
tgatctttatgtgtctcttgcctta

SEQ ID NO: 802608 - DNA, 25 bp, Mus musculus
tgatctttccctcttgtgtcctctg

SEQ ID NO: 802609 - DNA, 25 bp, Mus musculus
tgatctttccctgttgtgtcctctg

SEQ ID NO: 802610 - DNA, 25 bp, Mus musculus
tgatctttgagcctgccctggtgga

SEQ ID NO: 802611 - DNA, 25 bp, Mus musculus
tgatctttgagcgtgccctggtgga

SEQ ID NO: 802612 - DNA, 25 bp, Mus musculus
tgatgaaaagctactccttcctgag

SEQ ID NO: 802613 - DNA, 25 bp, Mus musculus
tgatgaaaagcttctccttcctgag

SEQ ID NO: 802614 - DNA, 25 bp, Mus musculus
tgatgaaaatgacgaggaagaatac

SEQ ID NO: 802615 - DNA, 25 bp, Mus musculus
tgatgaaaatgaggaggaagaatac

SEQ ID NO: 802616 - DNA, 25 bp, Mus musculus
tgatgaaaccggctcggattccgcc

SEQ ID NO: 802617 - DNA, 25 bp, Mus musculus
tgatgaaaccgggtcggattccgcc

SEQ ID NO: 802618 - DNA, 25 bp, Mus musculus
tgatgaaacctcaaagagtttaagc

SEQ ID NO: 802619 - DNA, 25 bp, Mus musculus
tgatgaaacctctaagagtttaagc

SEQ ID NO: 802620 - DNA, 25 bp, Mus musculus
tgatgaaattagctgcaaaggctcc

SEQ ID NO: 802621 - DNA, 25 bp, Mus musculus
tgatgaaattaggtgcaaaggctcc

SEQ ID NO: 802622 - DNA, 25 bp, Mus musculus
tgatgaaattatccgagctgggatg

SEQ ID NO: 802623 - DNA, 25 bp, Mus musculus
tgatgaaattatgcgagctgggatg

SEQ ID NO: 802624 - DNA, 25 bp, Mus musculus
tgatgaacataacctggatactccg

SEQ ID NO: 802625 - DNA, 25 bp, Mus musculus
tgatgaacataagctggatactccg

SEQ ID NO: 802626 - DNA, 25 bp, Mus musculus
tgatgaaccagaccatggcccgttg

SEQ ID NO: 802627 - DNA, 25 bp, Mus musculus
tgatgaaccagagcatggcccgttg

SEQ ID NO: 802628 - DNA, 25 bp, Mus musculus
tgatgaacctgccttgaagcgccag

SEQ ID NO: 802629 - DNA, 25 bp, Mus musculus
tgatgaacctgcgttgaagcgccag

SEQ ID NO: 802630 - DNA, 25 bp, Mus musculus
tgatgaacgagaaccctgagtgggt

SEQ ID NO: 802631 - DNA, 25 bp, Mus musculus
tgatgaacgagatccctgagtgggt

SEQ ID NO: 802632 - DNA, 25 bp, Mus musculus
tgatgaactaaacatccggtctgct

SEQ ID NO: 802633 - DNA, 25 bp, Mus musculus
tgatgaactaaagatccggtctgct

SEQ ID NO: 802634 - DNA, 25 bp, Mus musculus
tgatgaactctaactttaagggtat

SEQ ID NO: 802635 - DNA, 25 bp, Mus musculus
tgatgaactctatctttaagggtat

SEQ ID NO: 802636 - DNA, 25 bp, Mus musculus
tgatgaagaactagcaacagcacct

SEQ ID NO: 802637 - DNA, 25 bp, Mus musculus
tgatgaagaacttgcaacagcacct

SEQ ID NO: 802638 - DNA, 25 bp, Mus musculus
tgatgaagaagaatgggcagtcccc

SEQ ID NO: 802639 - DNA, 25 bp, Mus musculus
tgatgaagaagattgggcagtcccc

SEQ ID NO: 802640 - DNA, 25 bp, Mus musculus
tgatgaagacatccacacagccaac

SEQ ID NO: 802641 - DNA, 25 bp, Mus musculus
tgatgaagacatgcacacagccaac

SEQ ID NO: 802642 - DNA, 25 bp, Mus musculus
tgatgaagagcaaaggcatgcaatg

SEQ ID NO: 802643 - DNA, 25 bp, Mus musculus
tgatgaagagcacgcagccgccaag

SEQ ID NO: 802644 - DNA, 25 bp, Mus musculus
tgatgaagagcaggcagccgccaag

SEQ ID NO: 802645 - DNA, 25 bp, Mus musculus
tgatgaagagcataggcatgcaatg

SEQ ID NO: 802646 - DNA, 25 bp, Mus musculus
tgatgaagaggcaccggattatggc

SEQ ID NO: 802647 - DNA, 25 bp, Mus musculus
tgatgaagaggctccggattatggc

SEQ ID NO: 802648 - DNA, 25 bp, Mus musculus
tgatgaagagggaacagcagagctc

SEQ ID NO: 802649 - DNA, 25 bp, Mus musculus
tgatgaagagggtacagcagagctc

SEQ ID NO: 802650 - DNA, 25 bp, Mus musculus
tgatgaagatgccattatcggaatc

SEQ ID NO: 802651 - DNA, 25 bp, Mus musculus
tgatgaagatgcgattatcggaatc

SEQ ID NO: 802652 - DNA, 25 bp, Mus musculus
tgatgaagatggagacgatgtagaa

SEQ ID NO: 802653 - DNA, 25 bp, Mus musculus
tgatgaagatggtgacgatgtagaa

SEQ ID NO: 802654 - DNA, 25 bp, Mus musculus
tgatgaagcaatattggctgccctg

SEQ ID NO: 802655 - DNA, 25 bp, Mus musculus
tgatgaagcaattttggctgccctg

SEQ ID NO: 802656 - DNA, 25 bp, Mus musculus
tgatgaagcaccagtggatttaaac

SEQ ID NO: 802657 - DNA, 25 bp, Mus musculus
tgatgaagcacctgtggatttaaac

SEQ ID NO: 802658 - DNA, 25 bp, Mus musculus
tgatgaagcccaaaatatagtcaaa

SEQ ID NO: 802659 - DNA, 25 bp, Mus musculus
tgatgaagcccataatatagtcaaa

SEQ ID NO: 802660 - DNA, 25 bp, Mus musculus
tgatgaaggaagcaacgctgagcaa

SEQ ID NO: 802661 - DNA, 25 bp, Mus musculus
tgatgaaggaaggaacgctgagcaa

SEQ ID NO: 802662 - DNA, 25 bp, Mus musculus
tgatgaaggtgcatagcctctggct

SEQ ID NO: 802663 - DNA, 25 bp, Mus musculus
tgatgaaggtgcttagcctctggct

SEQ ID NO: 802664 - DNA, 25 bp, Mus musculus
tgatgaagtagaagtgaacactaaa

SEQ ID NO: 802665 - DNA, 25 bp, Mus musculus
tgatgaagtagatgtgaacactaaa

SEQ ID NO: 802666 - DNA, 25 bp, Mus musculus
tgatgaagtggccaacaaacagacc

SEQ ID NO: 802667 - DNA, 25 bp, Mus musculus
tgatgaagtggcgaacaaacagacc

SEQ ID NO: 802668 - DNA, 25 bp, Mus musculus
tgatgaagttaacaacaacacctgt

SEQ ID NO: 802669 - DNA, 25 bp, Mus musculus
tgatgaagttaagaacaacacctgt

SEQ ID NO: 802670 - DNA, 25 bp, Mus musculus
tgatgaataacacaacttgcagagt

SEQ ID NO: 802671 - DNA, 25 bp, Mus musculus
tgatgaataacagaacttgcagagt

SEQ ID NO: 802672 - DNA, 25 bp, Mus musculus
tgatgaatacgaccgaagacgcagg

SEQ ID NO: 802673 - DNA, 25 bp, Mus musculus
tgatgaatacgagcgaagacgcagg

SEQ ID NO: 802674 - DNA, 25 bp, Mus musculus
tgatgaatcacaaaacccagctagc

SEQ ID NO: 802675 - DNA, 25 bp, Mus musculus
tgatgaatcacataacccagctagc

SEQ ID NO: 802676 - DNA, 25 bp, Mus musculus
tgatgaatgcatcaacagatgtagc

SEQ ID NO: 802677 - DNA, 25 bp, Mus musculus
tgatgaatgcatgaacagatgtagc

SEQ ID NO: 802678 - DNA, 25 bp, Mus musculus
tgatgaatgccaaaacccggggatc

SEQ ID NO: 802679 - DNA, 25 bp, Mus musculus
tgatgaatgccataacccggggatc

SEQ ID NO: 802680 - DNA, 25 bp, Mus musculus
tgatgaattcatagctgaggccttg

SEQ ID NO: 802681 - DNA, 25 bp, Mus musculus
tgatgaattcattgctgaggccttg

SEQ ID NO: 802682 - DNA, 25 bp, Mus musculus
tgatgacaccatcctcagcaggcag

SEQ ID NO: 802683 - DNA, 25 bp, Mus musculus
tgatgacaccatgctcagcaggcag

SEQ ID NO: 802684 - DNA, 25 bp, Mus musculus
tgatgacacccaacaacgacctcca

SEQ ID NO: 802685 - DNA, 25 bp, Mus musculus
tgatgacacccacagtgctgtatga

SEQ ID NO: 802686 - DNA, 25 bp, Mus musculus
tgatgacacccagagtgctgtatga

SEQ ID NO: 802687 - DNA, 25 bp, Mus musculus
tgatgacacccatcaacgacctcca

SEQ ID NO: 802688 - DNA, 25 bp, Mus musculus
tgatgacagaatactaccactatat

SEQ ID NO: 802689 - DNA, 25 bp, Mus musculus
tgatgacagaattctaccactatat

SEQ ID NO: 802690 - DNA, 25 bp, Mus musculus
tgatgacagagacaactgcaggctg

SEQ ID NO: 802691 - DNA, 25 bp, Mus musculus
tgatgacagagagaactgcaggctg

SEQ ID NO: 802692 - DNA, 25 bp, Mus musculus
tgatgacagcagcatggaaaaaaga

SEQ ID NO: 802693 - DNA, 25 bp, Mus musculus
tgatgacagcaggatggaaaaaaga

SEQ ID NO: 802694 - DNA, 25 bp, Mus musculus
tgatgacagtttaccctgaggactc

SEQ ID NO: 802695 - DNA, 25 bp, Mus musculus
tgatgacagttttccctgaggactc

SEQ ID NO: 802696 - DNA, 25 bp, Mus musculus
tgatgacatagcctgtgccaagaag

SEQ ID NO: 802697 - DNA, 25 bp, Mus musculus
tgatgacatagcgtgtgccaagaag

SEQ ID NO: 802698 - DNA, 25 bp, Mus musculus
tgatgacatcatatccaatgagaac

SEQ ID NO: 802699 - DNA, 25 bp, Mus musculus
tgatgacatcatcagcctggaatca

SEQ ID NO: 802700 - DNA, 25 bp, Mus musculus
tgatgacatcatgagcctggaatca

SEQ ID NO: 802701 - DNA, 25 bp, Mus musculus
tgatgacatcatttccaatgagaac

SEQ ID NO: 802702 - DNA, 25 bp, Mus musculus
tgatgacatcggatgaaaggcccac

SEQ ID NO: 802703 - DNA, 25 bp, Mus musculus
tgatgacatcggttgaaaggcccac

SEQ ID NO: 802704 - DNA, 25 bp, Mus musculus
tgatgacatctccactcaaggctgg

SEQ ID NO: 802705 - DNA, 25 bp, Mus musculus
tgatgacatctcgactcaaggctgg

SEQ ID NO: 802706 - DNA, 25 bp, Mus musculus
tgatgacattacatgcccggcctgc

SEQ ID NO: 802707 - DNA, 25 bp, Mus musculus
tgatgacattacttgcccggcctgc

SEQ ID NO: 802708 - DNA, 25 bp, Mus musculus
tgatgaccactgaaaggacccttcc

SEQ ID NO: 802709 - DNA, 25 bp, Mus musculus
tgatgaccactgtaaggacccttcc

SEQ ID NO: 802710 - DNA, 25 bp, Mus musculus
tgatgaccatatagccaggcgggtt

SEQ ID NO: 802711 - DNA, 25 bp, Mus musculus
tgatgaccatattgccaggcgggtt

SEQ ID NO: 802712 - DNA, 25 bp, Mus musculus
tgatgaccatctcgacccagaatag

SEQ ID NO: 802713 - DNA, 25 bp, Mus musculus
tgatgaccatctggacccagaatag

SEQ ID NO: 802714 - DNA, 25 bp, Mus musculus
tgatgaccatgaaactaaacgacag

SEQ ID NO: 802715 - DNA, 25 bp, Mus musculus
tgatgaccatgatactaaacgacag

SEQ ID NO: 802716 - DNA, 25 bp, Mus musculus
tgatgaccccacacttctgaggagg

SEQ ID NO: 802717 - DNA, 25 bp, Mus musculus
tgatgaccccactcttctgaggagg

SEQ ID NO: 802718 - DNA, 25 bp, Mus musculus
tgatgaccccttatcagcgggcagg

SEQ ID NO: 802719 - DNA, 25 bp, Mus musculus
tgatgaccccttttcagcgggcagg

SEQ ID NO: 802720 - DNA, 25 bp, Mus musculus
tgatgaccctcaagggacttccaag

SEQ ID NO: 802721 - DNA, 25 bp, Mus musculus
tgatgaccctcatgggacttccaag

SEQ ID NO: 802722 - DNA, 25 bp, Mus musculus
tgatgaccctggatcatttttacaa

SEQ ID NO: 802723 - DNA, 25 bp, Mus musculus
tgatgaccctggttcatttttacaa

SEQ ID NO: 802724 - DNA, 25 bp, Mus musculus
tgatgaccgagacgcgcaagaactt

SEQ ID NO: 802725 - DNA, 25 bp, Mus musculus
tgatgaccgagaggcgcaagaactt

SEQ ID NO: 802726 - DNA, 25 bp, Mus musculus
tgatgaccgtataccctggagaagc

SEQ ID NO: 802727 - DNA, 25 bp, Mus musculus
tgatgaccgtattccctggagaagc

SEQ ID NO: 802728 - DNA, 25 bp, Mus musculus
tgatgacctctactgcaagtactgc

SEQ ID NO: 802729 - DNA, 25 bp, Mus musculus
tgatgacctctagtgcaagtactgc

SEQ ID NO: 802730 - DNA, 25 bp, Mus musculus
tgatgacctgagatagacctcggga

SEQ ID NO: 802731 - DNA, 25 bp, Mus musculus
tgatgacctgagttagacctcggga

SEQ ID NO: 802732 - DNA, 25 bp, Mus musculus
tgatgacctgcaacaaccgtgcgca

SEQ ID NO: 802733 - DNA, 25 bp, Mus musculus
tgatgacctgcaactttccaccagt

SEQ ID NO: 802734 - DNA, 25 bp, Mus musculus
tgatgacctgcatcaaccgtgcgca

SEQ ID NO: 802735 - DNA, 25 bp, Mus musculus
tgatgacctgcatctttccaccagt

SEQ ID NO: 802736 - DNA, 25 bp, Mus musculus
tgatgacctggaaggtatggagcac

SEQ ID NO: 802737 - DNA, 25 bp, Mus musculus
tgatgacctggatggtatggagcac

SEQ ID NO: 802738 - DNA, 25 bp, Mus musculus
tgatgacctgtgcaacctgccagag

SEQ ID NO: 802739 - DNA, 25 bp, Mus musculus
tgatgacctgtggaacctgccagag

SEQ ID NO: 802740 - DNA, 25 bp, Mus musculus
tgatgacgaataacttcctgatgcc

SEQ ID NO: 802741 - DNA, 25 bp, Mus musculus
tgatgacgaatatcttcctgatgcc

SEQ ID NO: 802742 - DNA, 25 bp, Mus musculus
tgatgacgaccaacgtgtgggtgaa

SEQ ID NO: 802743 - DNA, 25 bp, Mus musculus
tgatgacgaccatcgtgtgggtgaa

SEQ ID NO: 802744 - DNA, 25 bp, Mus musculus
tgatgacgatgacaacgacaagatc

SEQ ID NO: 802745 - DNA, 25 bp, Mus musculus
tgatgacgatgagaacgacaagatc

SEQ ID NO: 802746 - DNA, 25 bp, Mus musculus
tgatgacgcaacctcgctgattggg

SEQ ID NO: 802747 - DNA, 25 bp, Mus musculus
tgatgacgcaacgtcgctgattggg

SEQ ID NO: 802748 - DNA, 25 bp, Mus musculus
tgatgacgcaatatgccttgcagag

SEQ ID NO: 802749 - DNA, 25 bp, Mus musculus
tgatgacgcaatttgccttgcagag

SEQ ID NO: 802750 - DNA, 25 bp, Mus musculus
tgatgacgccccacgatgtcaacca

SEQ ID NO: 802751 - DNA, 25 bp, Mus musculus
tgatgacgcccctcgatgtcaacca

SEQ ID NO: 802752 - DNA, 25 bp, Mus musculus
tgatgacgctgtatgctgtgtggat

SEQ ID NO: 802753 - DNA, 25 bp, Mus musculus
tgatgacgctgtttgctgtgtggat

SEQ ID NO: 802754 - DNA, 25 bp, Mus musculus
tgatgactaaggaagaactgtgact

SEQ ID NO: 802755 - DNA, 25 bp, Mus musculus
tgatgactaaggtagaactgtgact

SEQ ID NO: 802756 - DNA, 25 bp, Mus musculus
tgatgactctgacaaagaaaagggc

SEQ ID NO: 802757 - DNA, 25 bp, Mus musculus
tgatgactctgagaaagaaaagggc

SEQ ID NO: 802758 - DNA, 25 bp, Mus musculus
tgatgactcttcctactgccaaggt

SEQ ID NO: 802759 - DNA, 25 bp, Mus musculus
tgatgactcttcgtactgccaaggt

SEQ ID NO: 802760 - DNA, 25 bp, Mus musculus
tgatgactgcttagggctgagaaga

SEQ ID NO: 802761 - DNA, 25 bp, Mus musculus
tgatgactgctttgggctgagaaga

SEQ ID NO: 802762 - DNA, 25 bp, Mus musculus
tgatgactggtgaatcccaagcagg

SEQ ID NO: 802763 - DNA, 25 bp, Mus musculus
tgatgactggtgtatcccaagcagg

SEQ ID NO: 802764 - DNA, 25 bp, Mus musculus
tgatgactggttcttaaggctgaga

SEQ ID NO: 802765 - DNA, 25 bp, Mus musculus
tgatgactggttgttaaggctgaga

SEQ ID NO: 802766 - DNA, 25 bp, Mus musculus
tgatgacttagaagatttgaacttc

SEQ ID NO: 802767 - DNA, 25 bp, Mus musculus
tgatgacttagatgatttgaacttc

SEQ ID NO: 802768 - DNA, 25 bp, Mus musculus
tgatgacttagcacaacagaaccta

SEQ ID NO: 802769 - DNA, 25 bp, Mus musculus
tgatgacttagctcaacagaaccta

SEQ ID NO: 802770 - DNA, 25 bp, Mus musculus
tgatgacttctcactgctcactcgt

SEQ ID NO: 802771 - DNA, 25 bp, Mus musculus
tgatgacttctctctgctcactcgt

SEQ ID NO: 802772 - DNA, 25 bp, Mus musculus
tgatgacttttcattccaacatgct

SEQ ID NO: 802773 - DNA, 25 bp, Mus musculus
tgatgacttttctttccaacatgct

SEQ ID NO: 802774 - DNA, 25 bp, Mus musculus
tgatgagaaactaaactctttgtgt

SEQ ID NO: 802775 - DNA, 25 bp, Mus musculus
tgatgagaaacttaactctttgtgt

SEQ ID NO: 802776 - DNA, 25 bp, Mus musculus
tgatgagaacatcaagccacttgaa

SEQ ID NO: 802777 - DNA, 25 bp, Mus musculus
tgatgagaacatgaagccacttgaa

SEQ ID NO: 802778 - DNA, 25 bp, Mus musculus
tgatgagaagagacagttaagcctg

SEQ ID NO: 802779 - DNA, 25 bp, Mus musculus
tgatgagaagagaccggcgcttcca

SEQ ID NO: 802780 - DNA, 25 bp, Mus musculus
tgatgagaagagtcagttaagcctg

SEQ ID NO: 802781 - DNA, 25 bp, Mus musculus
tgatgagaagagtccggcgcttcca

SEQ ID NO: 802782 - DNA, 25 bp, Mus musculus
tgatgagaagcgacatgactacctt

SEQ ID NO: 802783 - DNA, 25 bp, Mus musculus
tgatgagaagcgtcatgactacctt

SEQ ID NO: 802784 - DNA, 25 bp, Mus musculus
tgatgagaagtgaccaggaaattcc

SEQ ID NO: 802785 - DNA, 25 bp, Mus musculus
tgatgagaagtgtccaggaaattcc

SEQ ID NO: 802786 - DNA, 25 bp, Mus musculus
tgatgagaatagctgaagtcactga

SEQ ID NO: 802787 - DNA, 25 bp, Mus musculus
tgatgagaataggtgaagtcactga

SEQ ID NO: 802788 - DNA, 25 bp, Mus musculus
tgatgagacgacagttcctacccag

SEQ ID NO: 802789 - DNA, 25 bp, Mus musculus
tgatgagacgactgttcctacccag

SEQ ID NO: 802790 - DNA, 25 bp, Mus musculus
tgatgagactaaagccctcacccca

SEQ ID NO: 802791 - DNA, 25 bp, Mus musculus
tgatgagactaatgccctcacccca

SEQ ID NO: 802792 - DNA, 25 bp, Mus musculus
tgatgagagaagactgtgagtgtca

SEQ ID NO: 802793 - DNA, 25 bp, Mus musculus
tgatgagagaagtctgtgagtgtca

SEQ ID NO: 802794 - DNA, 25 bp, Mus musculus
tgatgagaggcacagattcggaaat

SEQ ID NO: 802795 - DNA, 25 bp, Mus musculus
tgatgagaggcagagattcggaaat

SEQ ID NO: 802796 - DNA, 25 bp, Mus musculus
tgatgagataccagctctctgatga

SEQ ID NO: 802797 - DNA, 25 bp, Mus musculus
tgatgagatacctgctctctgatga

SEQ ID NO: 802798 - DNA, 25 bp, Mus musculus
tgatgagcagagaggcatctggacc

SEQ ID NO: 802799 - DNA, 25 bp, Mus musculus
tgatgagcagagtggcatctggacc

SEQ ID NO: 802800 - DNA, 25 bp, Mus musculus
tgatgagccctcagacggcaggatg

SEQ ID NO: 802801 - DNA, 25 bp, Mus musculus
tgatgagccctctgacggcaggatg

SEQ ID NO: 802802 - DNA, 25 bp, Mus musculus
tgatgagccttcagacagggacacc

SEQ ID NO: 802803 - DNA, 25 bp, Mus musculus
tgatgagccttctgacagggacacc

SEQ ID NO: 802804 - DNA, 25 bp, Mus musculus
tgatgagcgaccagatgaacgatct

SEQ ID NO: 802805 - DNA, 25 bp, Mus musculus
tgatgagcgacctgatgaacgatct

SEQ ID NO: 802806 - DNA, 25 bp, Mus musculus
tgatgagcgcctaaaggaactcttt

SEQ ID NO: 802807 - DNA, 25 bp, Mus musculus
tgatgagcgccttaaggaactcttt

SEQ ID NO: 802808 - DNA, 25 bp, Mus musculus
tgatgagctgcacccgctccgtgta

SEQ ID NO: 802809 - DNA, 25 bp, Mus musculus
tgatgagctgcagccgctccgtgta

SEQ ID NO: 802810 - DNA, 25 bp, Mus musculus
tgatgaggaactaggccctgcctga

SEQ ID NO: 802811 - DNA, 25 bp, Mus musculus
tgatgaggaacttggccctgcctga

SEQ ID NO: 802812 - DNA, 25 bp, Mus musculus
tgatgaggaataaggaagtattctc

SEQ ID NO: 802813 - DNA, 25 bp, Mus musculus
tgatgaggaatatggaagtattctc

SEQ ID NO: 802814 - DNA, 25 bp, Mus musculus
tgatgaggaattaaaacccaccctc

SEQ ID NO: 802815 - DNA, 25 bp, Mus musculus
tgatgaggaatttaaacccaccctc

SEQ ID NO: 802816 - DNA, 25 bp, Mus musculus
tgatgaggacagagattatcagcag

SEQ ID NO: 802817 - DNA, 25 bp, Mus musculus
tgatgaggacagtgattatcagcag

SEQ ID NO: 802818 - DNA, 25 bp, Mus musculus
tgatgaggacgacacagatagctcc

SEQ ID NO: 802819 - DNA, 25 bp, Mus musculus
tgatgaggacgagacagatagctcc

SEQ ID NO: 802820 - DNA, 25 bp, Mus musculus
tgatgaggaggaatattggaacagc

SEQ ID NO: 802821 - DNA, 25 bp, Mus musculus
tgatgaggaggattattggaacagc

SEQ ID NO: 802822 - DNA, 25 bp, Mus musculus
tgatgaggatgaaggacctcagaag

SEQ ID NO: 802823 - DNA, 25 bp, Mus musculus
tgatgaggatgatggacctcagaag

SEQ ID NO: 802824 - DNA, 25 bp, Mus musculus
tgatgaggcatccttggtccaggac

SEQ ID NO: 802825 - DNA, 25 bp, Mus musculus
tgatgaggcatcgttggtccaggac

SEQ ID NO: 802826 - DNA, 25 bp, Mus musculus
tgatgaggccagcagataccagtgt

SEQ ID NO: 802827 - DNA, 25 bp, Mus musculus
tgatgaggccaggagataccagtgt

SEQ ID NO: 802828 - DNA, 25 bp, Mus musculus
tgatgaggcctaagcagaggagttt

SEQ ID NO: 802829 - DNA, 25 bp, Mus musculus
tgatgaggcctatgcagaggagttt

SEQ ID NO: 802830 - DNA, 25 bp, Mus musculus
tgatgaggcgatcactgtctacagt

SEQ ID NO: 802831 - DNA, 25 bp, Mus musculus
tgatgaggcgatgactgtctacagt

SEQ ID NO: 802832 - DNA, 25 bp, Mus musculus
tgatgagggccacgcctcgcatgct

SEQ ID NO: 802833 - DNA, 25 bp, Mus musculus
tgatgagggccaggcctcgcatgct

SEQ ID NO: 802834 - DNA, 25 bp, Mus musculus
tgatgaggtcttccccaaggagatg

SEQ ID NO: 802835 - DNA, 25 bp, Mus musculus
tgatgaggtcttgcccaaggagatg

SEQ ID NO: 802836 - DNA, 25 bp, Mus musculus
tgatgagtacatagagaaactggcc

SEQ ID NO: 802837 - DNA, 25 bp, Mus musculus
tgatgagtacattgagaaactggcc

SEQ ID NO: 802838 - DNA, 25 bp, Mus musculus
tgatgagtcactccagtaccccaag

SEQ ID NO: 802839 - DNA, 25 bp, Mus musculus
tgatgagtcactgcagtaccccaag

SEQ ID NO: 802840 - DNA, 25 bp, Mus musculus
tgatgagtgcaaacacctgctgagc

SEQ ID NO: 802841 - DNA, 25 bp, Mus musculus
tgatgagtgcaatcacctgctgagc

SEQ ID NO: 802842 - DNA, 25 bp, Mus musculus
tgatgagtggcaccaggtattctga

SEQ ID NO: 802843 - DNA, 25 bp, Mus musculus
tgatgagtggcagcaggtattctga

SEQ ID NO: 802844 - DNA, 25 bp, Mus musculus
tgatgagttagaaggtccagcccct

SEQ ID NO: 802845 - DNA, 25 bp, Mus musculus
tgatgagttagatggtccagcccct

SEQ ID NO: 802846 - DNA, 25 bp, Mus musculus
tgatgagtttggattccgtgtggac

SEQ ID NO: 802847 - DNA, 25 bp, Mus musculus
tgatgagtttggtttccgtgtggac

SEQ ID NO: 802848 - DNA, 25 bp, Mus musculus
tgatgataatgaagtcatctcctga

SEQ ID NO: 802849 - DNA, 25 bp, Mus musculus
tgatgataatgatgtcatctcctga

SEQ ID NO: 802850 - DNA, 25 bp, Mus musculus
tgatgatagagaattgaccaagaaa

SEQ ID NO: 802851 - DNA, 25 bp, Mus musculus
tgatgatagagatttgaccaagaaa

SEQ ID NO: 802852 - DNA, 25 bp, Mus musculus
tgatgatagccaatgagtacaagtc

SEQ ID NO: 802853 - DNA, 25 bp, Mus musculus
tgatgatagccattgagtacaagtc

SEQ ID NO: 802854 - DNA, 25 bp, Mus musculus
tgatgatcagatcgccccagataat

SEQ ID NO: 802855 - DNA, 25 bp, Mus musculus
tgatgatcagatggccccagataat

SEQ ID NO: 802856 - DNA, 25 bp, Mus musculus
tgatgatcaggccaggaaaaacatg

SEQ ID NO: 802857 - DNA, 25 bp, Mus musculus
tgatgatcaggcgaggaaaaacatg

SEQ ID NO: 802858 - DNA, 25 bp, Mus musculus
tgatgatcatgcagggagctatctg

SEQ ID NO: 802859 - DNA, 25 bp, Mus musculus
tgatgatcatgctgggagctatctg

SEQ ID NO: 802860 - DNA, 25 bp, Mus musculus
tgatgatccaaacgatgagaaagaa

SEQ ID NO: 802861 - DNA, 25 bp, Mus musculus
tgatgatccaaaggatgagaaagaa

SEQ ID NO: 802862 - DNA, 25 bp, Mus musculus
tgatgatcccatcggttatgagagc

SEQ ID NO: 802863 - DNA, 25 bp, Mus musculus
tgatgatcccatgggttatgagagc

SEQ ID NO: 802864 - DNA, 25 bp, Mus musculus
tgatgatcctgaatcctgggcagac

SEQ ID NO: 802865 - DNA, 25 bp, Mus musculus
tgatgatcctgattcctgggcagac

SEQ ID NO: 802866 - DNA, 25 bp, Mus musculus
tgatgatctccgacgtgatgtcagc

SEQ ID NO: 802867 - DNA, 25 bp, Mus musculus
tgatgatctccgtcgtgatgtcagc

SEQ ID NO: 802868 - DNA, 25 bp, Mus musculus
tgatgatctgataaaattacaccca

SEQ ID NO: 802869 - DNA, 25 bp, Mus musculus
tgatgatctgattaaattacaccca

SEQ ID NO: 802870 - DNA, 25 bp, Mus musculus
tgatgatgagacatgccaggagcaa

SEQ ID NO: 802871 - DNA, 25 bp, Mus musculus
tgatgatgagacttgccaggagcaa

SEQ ID NO: 802872 - DNA, 25 bp, Mus musculus
tgatgatgagccagttgctgaccct

SEQ ID NO: 802873 - DNA, 25 bp, Mus musculus
tgatgatgagcctgttgctgaccct

SEQ ID NO: 802874 - DNA, 25 bp, Mus musculus
tgatgatgagctaggcttccgcaaa

SEQ ID NO: 802875 - DNA, 25 bp, Mus musculus
tgatgatgagcttggcttccgcaaa

SEQ ID NO: 802876 - DNA, 25 bp, Mus musculus
tgatgatgcaaaagacagctggcac

SEQ ID NO: 802877 - DNA, 25 bp, Mus musculus
tgatgatgcaaatgacagctggcac

SEQ ID NO: 802878 - DNA, 25 bp, Mus musculus
tgatgatgccaacaatgccaaggct

SEQ ID NO: 802879 - DNA, 25 bp, Mus musculus
tgatgatgccaagaatgccaaggct

SEQ ID NO: 802880 - DNA, 25 bp, Mus musculus
tgatgatgcttacaaatctcagctc

SEQ ID NO: 802881 - DNA, 25 bp, Mus musculus
tgatgatgcttagaaatctcagctc

SEQ ID NO: 802882 - DNA, 25 bp, Mus musculus
tgatgatgctttaattggtcttcca

SEQ ID NO: 802883 - DNA, 25 bp, Mus musculus
tgatgatgcttttattggtcttcca

SEQ ID NO: 802884 - DNA, 25 bp, Mus musculus
tgatgatggcctcagccaagtacct

SEQ ID NO: 802885 - DNA, 25 bp, Mus musculus
tgatgatggcctgagccaagtacct

SEQ ID NO: 802886 - DNA, 25 bp, Mus musculus
tgatgatggcgtaatcactccctgg

SEQ ID NO: 802887 - DNA, 25 bp, Mus musculus
tgatgatggcgttatcactccctgg

SEQ ID NO: 802888 - DNA, 25 bp, Mus musculus
tgatgatgtagaaagtgagccagcc

SEQ ID NO: 802889 - DNA, 25 bp, Mus musculus
tgatgatgtagatagtgagccagcc

SEQ ID NO: 802890 - DNA, 25 bp, Mus musculus
tgatgatgtcagaacagagagagga

SEQ ID NO: 802891 - DNA, 25 bp, Mus musculus
tgatgatgtcagtacagagagagga

SEQ ID NO: 802892 - DNA, 25 bp, Mus musculus
tgatgatgtcatcacggagccagtt

SEQ ID NO: 802893 - DNA, 25 bp, Mus musculus
tgatgatgtcatgacggagccagtt

SEQ ID NO: 802894 - DNA, 25 bp, Mus musculus
tgatgatgtccaccctatcgccagc

SEQ ID NO: 802895 - DNA, 25 bp, Mus musculus
tgatgatgtccagcctatcgccagc

SEQ ID NO: 802896 - DNA, 25 bp, Mus musculus
tgatgatgtttaagattcctgggaa

SEQ ID NO: 802897 - DNA, 25 bp, Mus musculus
tgatgatgtttatgattcctgggaa

SEQ ID NO: 802898 - DNA, 25 bp, Mus musculus
tgatgattacgtactgggagaagag

SEQ ID NO: 802899 - DNA, 25 bp, Mus musculus
tgatgattacgttctgggagaagag

SEQ ID NO: 802900 - DNA, 25 bp, Mus musculus
tgatgatttagtagattccctgaag

SEQ ID NO: 802901 - DNA, 25 bp, Mus musculus
tgatgatttagttgattccctgaag

SEQ ID NO: 802902 - DNA, 25 bp, Mus musculus
tgatgcaactatcagccaggctgag

SEQ ID NO: 802903 - DNA, 25 bp, Mus musculus
tgatgcaactatgagccaggctgag

SEQ ID NO: 802904 - DNA, 25 bp, Mus musculus
tgatgcaagcatcgaaactgggccc

SEQ ID NO: 802905 - DNA, 25 bp, Mus musculus
tgatgcaagcatggaaactgggccc

SEQ ID NO: 802906 - DNA, 25 bp, Mus musculus
tgatgcaattgcagaaattcgagcc

SEQ ID NO: 802907 - DNA, 25 bp, Mus musculus
tgatgcaattgctgaaattcgagcc

SEQ ID NO: 802908 - DNA, 25 bp, Mus musculus
tgatgcacacccagtgtcattccac

SEQ ID NO: 802909 - DNA, 25 bp, Mus musculus
tgatgcacaccctgtgtcattccac

SEQ ID NO: 802910 - DNA, 25 bp, Mus musculus
tgatgcacctaacgaaagtcaccag

SEQ ID NO: 802911 - DNA, 25 bp, Mus musculus
tgatgcacctaaggaaagtcaccag

SEQ ID NO: 802912 - DNA, 25 bp, Mus musculus
tgatgcacgattcacacggcagacg

SEQ ID NO: 802913 - DNA, 25 bp, Mus musculus
tgatgcacgattgacacggcagacg

SEQ ID NO: 802914 - DNA, 25 bp, Mus musculus
tgatgcactcacctttgccgaagta

SEQ ID NO: 802915 - DNA, 25 bp, Mus musculus
tgatgcactcacgtttgccgaagta

SEQ ID NO: 802916 - DNA, 25 bp, Mus musculus
tgatgcactggccttatgcctttga

SEQ ID NO: 802917 - DNA, 25 bp, Mus musculus
tgatgcactggcgttatgcctttga

SEQ ID NO: 802918 - DNA, 25 bp, Mus musculus
tgatgcagaagcactcggtgcagct

SEQ ID NO: 802919 - DNA, 25 bp, Mus musculus
tgatgcagaagctctcggtgcagct

SEQ ID NO: 802920 - DNA, 25 bp, Mus musculus
tgatgcagacaacaatggatatgtt

SEQ ID NO: 802921 - DNA, 25 bp, Mus musculus
tgatgcagacaagaatggatatgtt

SEQ ID NO: 802922 - DNA, 25 bp, Mus musculus
tgatgcagacacaaagtctttcctg

SEQ ID NO: 802923 - DNA, 25 bp, Mus musculus
tgatgcagacactaagtctttcctg

SEQ ID NO: 802924 - DNA, 25 bp, Mus musculus
tgatgcagatgaccctttgctcagt

SEQ ID NO: 802925 - DNA, 25 bp, Mus musculus
tgatgcagatgagcctttgctcagt

SEQ ID NO: 802926 - DNA, 25 bp, Mus musculus
tgatgcagcacacgcacaaatggat

SEQ ID NO: 802927 - DNA, 25 bp, Mus musculus
tgatgcagcacaggcacaaatggat

SEQ ID NO: 802928 - DNA, 25 bp, Mus musculus
tgatgcagcagaccctgatattata

SEQ ID NO: 802929 - DNA, 25 bp, Mus musculus
tgatgcagcagagcctgatattata

SEQ ID NO: 802930 - DNA, 25 bp, Mus musculus
tgatgcagcgctctgacctagaggc

SEQ ID NO: 802931 - DNA, 25 bp, Mus musculus
tgatgcagcgctgtgacctagaggc

SEQ ID NO: 802932 - DNA, 25 bp, Mus musculus
tgatgcagcgtgatattgcagcagg

SEQ ID NO: 802933 - DNA, 25 bp, Mus musculus
tgatgcagcgtgttattgcagcagg

SEQ ID NO: 802934 - DNA, 25 bp, Mus musculus
tgatgcagctcacgttggactgagt

SEQ ID NO: 802935 - DNA, 25 bp, Mus musculus
tgatgcagctcaggttggactgagt

SEQ ID NO: 802936 - DNA, 25 bp, Mus musculus
tgatgcagggaaagatggccgacat

SEQ ID NO: 802937 - DNA, 25 bp, Mus musculus
tgatgcagggaatgatggccgacat

SEQ ID NO: 802938 - DNA, 25 bp, Mus musculus
tgatgcagggccaagcccgatatgt

SEQ ID NO: 802939 - DNA, 25 bp, Mus musculus
tgatgcagggcctagcccgatatgt

SEQ ID NO: 802940 - DNA, 25 bp, Mus musculus
tgatgcagtcctaatacaaaaccga

SEQ ID NO: 802941 - DNA, 25 bp, Mus musculus
tgatgcagtccttatacaaaaccga

SEQ ID NO: 802942 - DNA, 25 bp, Mus musculus
tgatgcagtttgaccacaacgctgg

SEQ ID NO: 802943 - DNA, 25 bp, Mus musculus
tgatgcagtttgtccacaacgctgg

SEQ ID NO: 802944 - DNA, 25 bp, Mus musculus
tgatgcatgttaactgggcagcgtt

SEQ ID NO: 802945 - DNA, 25 bp, Mus musculus
tgatgcatgttatctgggcagcgtt

SEQ ID NO: 802946 - DNA, 25 bp, Mus musculus
tgatgcattgtactccagactctgg

SEQ ID NO: 802947 - DNA, 25 bp, Mus musculus
tgatgcattgtagtccagactctgg

SEQ ID NO: 802948 - DNA, 25 bp, Mus musculus
tgatgcatttcgatcctttgttcct

SEQ ID NO: 802949 - DNA, 25 bp, Mus musculus
tgatgcatttcgttcctttgttcct

SEQ ID NO: 802950 - DNA, 25 bp, Mus musculus
tgatgccaaggaacgggcagcagcc

SEQ ID NO: 802951 - DNA, 25 bp, Mus musculus
tgatgccaaggaccctgcatctctc

SEQ ID NO: 802952 - DNA, 25 bp, Mus musculus
tgatgccaaggagcctgcatctctc

SEQ ID NO: 802953 - DNA, 25 bp, Mus musculus
tgatgccaaggatcgggcagcagcc

SEQ ID NO: 802954 - DNA, 25 bp, Mus musculus
tgatgccaataaaggaacaaaccgg

SEQ ID NO: 802955 - DNA, 25 bp, Mus musculus
tgatgccaataatggaacaaaccgg

SEQ ID NO: 802956 - DNA, 25 bp, Mus musculus
tgatgccaccaaaacaactagagaa

SEQ ID NO: 802957 - DNA, 25 bp, Mus musculus
tgatgccaccaatacaactagagaa

SEQ ID NO: 802958 - DNA, 25 bp, Mus musculus
tgatgccaccacaggcaatgtgctg

SEQ ID NO: 802959 - DNA, 25 bp, Mus musculus
tgatgccaccactggcaatgtgctg

SEQ ID NO: 802960 - DNA, 25 bp, Mus musculus
tgatgccagaagaccgtggagcctt

SEQ ID NO: 802961 - DNA, 25 bp, Mus musculus
tgatgccagaagtccgtggagcctt

SEQ ID NO: 802962 - DNA, 25 bp, Mus musculus
tgatgccagctgagagcgacatgag

SEQ ID NO: 802963 - DNA, 25 bp, Mus musculus
tgatgccagctgtgagcgacatgag

SEQ ID NO: 802964 - DNA, 25 bp, Mus musculus
tgatgccagggaccatagagattgt

SEQ ID NO: 802965 - DNA, 25 bp, Mus musculus
tgatgccagggagcatagagattgt

SEQ ID NO: 802966 - DNA, 25 bp, Mus musculus
tgatgccatgctcccataccttgtc

SEQ ID NO: 802967 - DNA, 25 bp, Mus musculus
tgatgccatgctgccataccttgtc

SEQ ID NO: 802968 - DNA, 25 bp, Mus musculus
tgatgccatggaaactccacggtgg

SEQ ID NO: 802969 - DNA, 25 bp, Mus musculus
tgatgccatggatactccacggtgg

SEQ ID NO: 802970 - DNA, 25 bp, Mus musculus
tgatgccatgttcgctgctgaaaga

SEQ ID NO: 802971 - DNA, 25 bp, Mus musculus
tgatgccatgttggctgctgaaaga

SEQ ID NO: 802972 - DNA, 25 bp, Mus musculus
tgatgccattaaactactgctagat

SEQ ID NO: 802973 - DNA, 25 bp, Mus musculus
tgatgccattaatctactgctagat

SEQ ID NO: 802974 - DNA, 25 bp, Mus musculus
tgatgccatttacagtggaaagcct

SEQ ID NO: 802975 - DNA, 25 bp, Mus musculus
tgatgccatttagagtggaaagcct

SEQ ID NO: 802976 - DNA, 25 bp, Mus musculus
tgatgcccacctatcctgtattgag

SEQ ID NO: 802977 - DNA, 25 bp, Mus musculus
tgatgcccacctttcctgtattgag

SEQ ID NO: 802978 - DNA, 25 bp, Mus musculus
tgatgcccccaccatagcctttgga

SEQ ID NO: 802979 - DNA, 25 bp, Mus musculus
tgatgcccccacgatagcctttgga

SEQ ID NO: 802980 - DNA, 25 bp, Mus musculus
tgatgccccgagcacggagccgttc

SEQ ID NO: 802981 - DNA, 25 bp, Mus musculus
tgatgccccgaggacggagccgttc

SEQ ID NO: 802982 - DNA, 25 bp, Mus musculus
tgatgcccctgacagccagcaacta

SEQ ID NO: 802983 - DNA, 25 bp, Mus musculus
tgatgcccctgagagccagcaacta

SEQ ID NO: 802984 - DNA, 25 bp, Mus musculus
tgatgcccctgcaaatgtacagtgt

SEQ ID NO: 802985 - DNA, 25 bp, Mus musculus
tgatgcccctgctaatgtacagtgt

SEQ ID NO: 802986 - DNA, 25 bp, Mus musculus
tgatgcccgctcaatctacgttggc

SEQ ID NO: 802987 - DNA, 25 bp, Mus musculus
tgatgcccgctctatctacgttggc

SEQ ID NO: 802988 - DNA, 25 bp, Mus musculus
tgatgcccgttgataaaaatctgct

SEQ ID NO: 802989 - DNA, 25 bp, Mus musculus
tgatgcccgttgttaaaaatctgct

SEQ ID NO: 802990 - DNA, 25 bp, Mus musculus
tgatgccctaaacggatccaatgcc

SEQ ID NO: 802991 - DNA, 25 bp, Mus musculus
tgatgccctaaagggatccaatgcc

SEQ ID NO: 802992 - DNA, 25 bp, Mus musculus
tgatgccctacgctttggactctgt

SEQ ID NO: 802993 - DNA, 25 bp, Mus musculus
tgatgccctacggtttggactctgt

SEQ ID NO: 802994 - DNA, 25 bp, Mus musculus
tgatgccctccgagtgaacaacaac

SEQ ID NO: 802995 - DNA, 25 bp, Mus musculus
tgatgccctccgtgtgaacaacaac

SEQ ID NO: 802996 - DNA, 25 bp, Mus musculus
tgatgccgcgccagctgttgcgtga

SEQ ID NO: 802997 - DNA, 25 bp, Mus musculus
tgatgccgcgcctgctgttgcgtga

SEQ ID NO: 802998 - DNA, 25 bp, Mus musculus
tgatgccgctgcagttcatctcttc

SEQ ID NO: 802999 - DNA, 25 bp, Mus musculus
tgatgccgctgctgttcatctcttc

SEQ ID NO: 803000 - DNA, 25 bp, Mus musculus
tgatgccggctgaagcgatgaatcc

SEQ ID NO: 803001 - DNA, 25 bp, Mus musculus
tgatgccggctgtagcgatgaatcc

SEQ ID NO: 803002 - DNA, 25 bp, Mus musculus
tgatgccgttctccactcgtgcaca

SEQ ID NO: 803003 - DNA, 25 bp, Mus musculus
tgatgccgttctgcactcgtgcaca

SEQ ID NO: 803004 - DNA, 25 bp, Mus musculus
tgatgcctacggaccaagtgatgct

SEQ ID NO: 803005 - DNA, 25 bp, Mus musculus
tgatgcctacggtccaagtgatgct

SEQ ID NO: 803006 - DNA, 25 bp, Mus musculus
tgatgcctatgaatgctacctctgc

SEQ ID NO: 803007 - DNA, 25 bp, Mus musculus
tgatgcctatgattgctacctctgc

SEQ ID NO: 803008 - DNA, 25 bp, Mus musculus
tgatgcctatgtcttataccccaag

SEQ ID NO: 803009 - DNA, 25 bp, Mus musculus
tgatgcctatgtgttataccccaag

SEQ ID NO: 803010 - DNA, 25 bp, Mus musculus
tgatgcctccgacattgaaaaggac

SEQ ID NO: 803011 - DNA, 25 bp, Mus musculus
tgatgcctccgagattgaaaaggac

SEQ ID NO: 803012 - DNA, 25 bp, Mus musculus
tgatgcctggatccgtggagaacta

SEQ ID NO: 803013 - DNA, 25 bp, Mus musculus
tgatgcctggatgcgtggagaacta

SEQ ID NO: 803014 - DNA, 25 bp, Mus musculus
tgatgcgaaggaagcagactcttta

SEQ ID NO: 803015 - DNA, 25 bp, Mus musculus
tgatgcgaaggatgcagactcttta

SEQ ID NO: 803016 - DNA, 25 bp, Mus musculus
tgatgcgcagacatttgctgactgg

SEQ ID NO: 803017 - DNA, 25 bp, Mus musculus
tgatgcgcagacttttgctgactgg

SEQ ID NO: 803018 - DNA, 25 bp, Mus musculus
tgatgcgcagatcgatcccaactgg

SEQ ID NO: 803019 - DNA, 25 bp, Mus musculus
tgatgcgcagatggatcccaactgg

SEQ ID NO: 803020 - DNA, 25 bp, Mus musculus
tgatgcgctggaactaacactgggc

SEQ ID NO: 803021 - DNA, 25 bp, Mus musculus
tgatgcgctggatctaacactgggc

SEQ ID NO: 803022 - DNA, 25 bp, Mus musculus
tgatgcgcttggaggccagcagtcc

SEQ ID NO: 803023 - DNA, 25 bp, Mus musculus
tgatgcgcttggtggccagcagtcc

SEQ ID NO: 803024 - DNA, 25 bp, Mus musculus
tgatgcggatgaatttagaaaagct

SEQ ID NO: 803025 - DNA, 25 bp, Mus musculus
tgatgcggatgattttagaaaagct

SEQ ID NO: 803026 - DNA, 25 bp, Mus musculus
tgatgcggcccgcatagcctggtac

SEQ ID NO: 803027 - DNA, 25 bp, Mus musculus
tgatgcggcccggatagcctggtac

SEQ ID NO: 803028 - DNA, 25 bp, Mus musculus
tgatgcgggacccatccatgtcccc

SEQ ID NO: 803029 - DNA, 25 bp, Mus musculus
tgatgcgggaccgatccatgtcccc

SEQ ID NO: 803030 - DNA, 25 bp, Mus musculus
tgatgcgggccaagcagcagcaagt

SEQ ID NO: 803031 - DNA, 25 bp, Mus musculus
tgatgcgggccatgcagcagcaagt

SEQ ID NO: 803032 - DNA, 25 bp, Mus musculus
tgatgcggttctccttggacactgg

SEQ ID NO: 803033 - DNA, 25 bp, Mus musculus
tgatgcggttctgcttggacactgg

SEQ ID NO: 803034 - DNA, 25 bp, Mus musculus
tgatgcgtatggagaaggccctgat

SEQ ID NO: 803035 - DNA, 25 bp, Mus musculus
tgatgcgtatggtgaaggccctgat

SEQ ID NO: 803036 - DNA, 25 bp, Mus musculus
tgatgctaagaaccctgaggactgg

SEQ ID NO: 803037 - DNA, 25 bp, Mus musculus
tgatgctaagaagcctgaggactgg

SEQ ID NO: 803038 - DNA, 25 bp, Mus musculus
tgatgctaccctcaggcaccggcga

SEQ ID NO: 803039 - DNA, 25 bp, Mus musculus
tgatgctaccctgaggcaccggcga

SEQ ID NO: 803040 - DNA, 25 bp, Mus musculus
tgatgctagactcacctccagttcg

SEQ ID NO: 803041 - DNA, 25 bp, Mus musculus
tgatgctagactgacctccagttcg

SEQ ID NO: 803042 - DNA, 25 bp, Mus musculus
tgatgctagatgagccaaccacagg

SEQ ID NO: 803043 - DNA, 25 bp, Mus musculus
tgatgctagatgtgccaaccacagg

SEQ ID NO: 803044 - DNA, 25 bp, Mus musculus
tgatgctaggaacacctaaccctgg

SEQ ID NO: 803045 - DNA, 25 bp, Mus musculus
tgatgctaggaagacctaaccctgg

SEQ ID NO: 803046 - DNA, 25 bp, Mus musculus
tgatgctccacaagctcaacggctg

SEQ ID NO: 803047 - DNA, 25 bp, Mus musculus
tgatgctccacatgctcaacggctg

SEQ ID NO: 803048 - DNA, 25 bp, Mus musculus
tgatgctccaccagcatattcagag

SEQ ID NO: 803049 - DNA, 25 bp, Mus musculus
tgatgctccacctgcatattcagag

SEQ ID NO: 803050 - DNA, 25 bp, Mus musculus
tgatgctcctcaaccagactggctt

SEQ ID NO: 803051 - DNA, 25 bp, Mus musculus
tgatgctcctcatccagactggctt

SEQ ID NO: 803052 - DNA, 25 bp, Mus musculus
tgatgctccttcagttgtccccgga

SEQ ID NO: 803053 - DNA, 25 bp, Mus musculus
tgatgctccttctgttgtccccgga

SEQ ID NO: 803054 - DNA, 25 bp, Mus musculus
tgatgctctgtgaaacctgcgtgaa

SEQ ID NO: 803055 - DNA, 25 bp, Mus musculus
tgatgctctgtgtaacctgcgtgaa

SEQ ID NO: 803056 - DNA, 25 bp, Mus musculus
tgatgctgaaagaggcccaccagcc

SEQ ID NO: 803057 - DNA, 25 bp, Mus musculus
tgatgctgaaagtggcccaccagcc

SEQ ID NO: 803058 - DNA, 25 bp, Mus musculus
tgatgctgaaccaggactcggagca

SEQ ID NO: 803059 - DNA, 25 bp, Mus musculus
tgatgctgaacctggactcggagca

SEQ ID NO: 803060 - DNA, 25 bp, Mus musculus
tgatgctgaataatcccctatttgc

SEQ ID NO: 803061 - DNA, 25 bp, Mus musculus
tgatgctgaatattcccctatttgc

SEQ ID NO: 803062 - DNA, 25 bp, Mus musculus
tgatgctgacagaccgcaaggaggc

SEQ ID NO: 803063 - DNA, 25 bp, Mus musculus
tgatgctgacagtccgcaaggaggc

SEQ ID NO: 803064 - DNA, 25 bp, Mus musculus
tgatgctgagcgctgcccatgacat

SEQ ID NO: 803065 - DNA, 25 bp, Mus musculus
tgatgctgagcggtgcccatgacat

SEQ ID NO: 803066 - DNA, 25 bp, Mus musculus
tgatgctgcctcagaacatttggga

SEQ ID NO: 803067 - DNA, 25 bp, Mus musculus
tgatgctgcctctgaacatttggga

SEQ ID NO: 803068 - DNA, 25 bp, Mus musculus
tgatgctgcgacagttgctgacaag

SEQ ID NO: 803069 - DNA, 25 bp, Mus musculus
tgatgctgcgactgttgctgacaag

SEQ ID NO: 803070 - DNA, 25 bp, Mus musculus
tgatgctgcgctccgtgtcgaacca

SEQ ID NO: 803071 - DNA, 25 bp, Mus musculus
tgatgctgcgctgcgtgtcgaacca

SEQ ID NO: 803072 - DNA, 25 bp, Mus musculus
tgatgctggcatatgcttcatcccc

SEQ ID NO: 803073 - DNA, 25 bp, Mus musculus
tgatgctggcatttgcttcatcccc

SEQ ID NO: 803074 - DNA, 25 bp, Mus musculus
tgatgctggcgcaggctagccacct

SEQ ID NO: 803075 - DNA, 25 bp, Mus musculus
tgatgctggcgctggctagccacct

SEQ ID NO: 803076 - DNA, 25 bp, Mus musculus
tgatgctggctgacgtcacacccgc

SEQ ID NO: 803077 - DNA, 25 bp, Mus musculus
tgatgctggctgtcgtcacacccgc

SEQ ID NO: 803078 - DNA, 25 bp, Mus musculus
tgatgctgggcaagagagacggcgg

SEQ ID NO: 803079 - DNA, 25 bp, Mus musculus
tgatgctgggcaagagatctgccat

SEQ ID NO: 803080 - DNA, 25 bp, Mus musculus
tgatgctgggcatgagagacggcgg

SEQ ID NO: 803081 - DNA, 25 bp, Mus musculus
tgatgctgggcatgagatctgccat

SEQ ID NO: 803082 - DNA, 25 bp, Mus musculus
tgatgctgggtaacggaagcatgct

SEQ ID NO: 803083 - DNA, 25 bp, Mus musculus
tgatgctgggtatcggaagcatgct

SEQ ID NO: 803084 - DNA, 25 bp, Mus musculus
tgatgctgttctcaattgcccagcc

SEQ ID NO: 803085 - DNA, 25 bp, Mus musculus
tgatgctgttctgaattgcccagcc

SEQ ID NO: 803086 - DNA, 25 bp, Mus musculus
tgatgcttaagaaccccaagtctgt

SEQ ID NO: 803087 - DNA, 25 bp, Mus musculus
tgatgcttaagatccccaagtctgt

SEQ ID NO: 803088 - DNA, 25 bp, Mus musculus
tgatgcttacaaaggcttctgcgcc

SEQ ID NO: 803089 - DNA, 25 bp, Mus musculus
tgatgcttacaaatctcagctcagc

SEQ ID NO: 803090 - DNA, 25 bp, Mus musculus
tgatgcttacaatggcttctgcgcc

SEQ ID NO: 803091 - DNA, 25 bp, Mus musculus
tgatgcttacaattctcagctcagc

SEQ ID NO: 803092 - DNA, 25 bp, Mus musculus
tgatgcttccgactccagtgctcag

SEQ ID NO: 803093 - DNA, 25 bp, Mus musculus
tgatgcttccgagtccagtgctcag

SEQ ID NO: 803094 - DNA, 25 bp, Mus musculus
tgatgcttcggcagcaggactacga

SEQ ID NO: 803095 - DNA, 25 bp, Mus musculus
tgatgcttcggctgcaggactacga

SEQ ID NO: 803096 - DNA, 25 bp, Mus musculus
tgatgcttctggatcgctatggtga

SEQ ID NO: 803097 - DNA, 25 bp, Mus musculus
tgatgcttctggttcgctatggtga

SEQ ID NO: 803098 - DNA, 25 bp, Mus musculus
tgatgcttgacgagctgctgcagct

SEQ ID NO: 803099 - DNA, 25 bp, Mus musculus
tgatgcttgacgtgctgctgcagct

SEQ ID NO: 803100 - DNA, 25 bp, Mus musculus
tgatgcttgtgcagccggccataaa

SEQ ID NO: 803101 - DNA, 25 bp, Mus musculus
tgatgcttgtgctgccggccataaa

SEQ ID NO: 803102 - DNA, 25 bp, Mus musculus
tgatggaaaccaaagccttctgacc

SEQ ID NO: 803103 - DNA, 25 bp, Mus musculus
tgatggaaaccatagccttctgacc

SEQ ID NO: 803104 - DNA, 25 bp, Mus musculus
tgatggaaagctcctcatcacggga

SEQ ID NO: 803105 - DNA, 25 bp, Mus musculus
tgatggaaagctgctcatcacggga

SEQ ID NO: 803106 - DNA, 25 bp, Mus musculus
tgatggaaaggtcaatttacagcgc

SEQ ID NO: 803107 - DNA, 25 bp, Mus musculus
tgatggaaaggtgaatttacagcgc

SEQ ID NO: 803108 - DNA, 25 bp, Mus musculus
tgatggaactcacgctctcaagtct

SEQ ID NO: 803109 - DNA, 25 bp, Mus musculus
tgatggaactcaggctctcaagtct

SEQ ID NO: 803110 - DNA, 25 bp, Mus musculus
tgatggaagactataaggatataac

SEQ ID NO: 803111 - DNA, 25 bp, Mus musculus
tgatggaagactttaaggatataac

SEQ ID NO: 803112 - DNA, 25 bp, Mus musculus
tgatggaagagtccaagcgactcca

SEQ ID NO: 803113 - DNA, 25 bp, Mus musculus
tgatggaagagtgcaagcgactcca

SEQ ID NO: 803114 - DNA, 25 bp, Mus musculus
tgatggaagcccagacgggacaaga

SEQ ID NO: 803115 - DNA, 25 bp, Mus musculus
tgatggaagccctgacgggacaaga

SEQ ID NO: 803116 - DNA, 25 bp, Mus musculus
tgatggaagccgagcggccctctgc

SEQ ID NO: 803117 - DNA, 25 bp, Mus musculus
tgatggaagccgtgcggccctctgc

SEQ ID NO: 803118 - DNA, 25 bp, Mus musculus
tgatggaaggcaatgaacggaatct

SEQ ID NO: 803119 - DNA, 25 bp, Mus musculus
tgatggaaggcattgaacggaatct

SEQ ID NO: 803120 - DNA, 25 bp, Mus musculus
tgatggaatctcaaagcaaagtgac

SEQ ID NO: 803121 - DNA, 25 bp, Mus musculus
tgatggaatctctaagcaaagtgac

SEQ ID NO: 803122 - DNA, 25 bp, Mus musculus
tgatggaatgatcggagctctcgcc

SEQ ID NO: 803123 - DNA, 25 bp, Mus musculus
tgatggaatgatgggagctctcgcc

SEQ ID NO: 803124 - DNA, 25 bp, Mus musculus
tgatggaattggaaaagcatatgca

SEQ ID NO: 803125 - DNA, 25 bp, Mus musculus
tgatggaattggtaaagcatatgca

SEQ ID NO: 803126 - DNA, 25 bp, Mus musculus
tgatggacaggtagactgtgaaaat

SEQ ID NO: 803127 - DNA, 25 bp, Mus musculus
tgatggacaggttgactgtgaaaat

SEQ ID NO: 803128 - DNA, 25 bp, Mus musculus
tgatggaccacaccaagtccccttt

SEQ ID NO: 803129 - DNA, 25 bp, Mus musculus
tgatggaccacagcaagtccccttt

SEQ ID NO: 803130 - DNA, 25 bp, Mus musculus
tgatggaccggaacaaagcagctga

SEQ ID NO: 803131 - DNA, 25 bp, Mus musculus
tgatggaccggatcaaagcagctga

SEQ ID NO: 803132 - DNA, 25 bp, Mus musculus
tgatggacctgacggagctgcccaa

SEQ ID NO: 803133 - DNA, 25 bp, Mus musculus
tgatggacctgagggagctgcccaa

SEQ ID NO: 803134 - DNA, 25 bp, Mus musculus
tgatggacgggcactctctgcatac

SEQ ID NO: 803135 - DNA, 25 bp, Mus musculus
tgatggacgggctctctctgcatac

SEQ ID NO: 803136 - DNA, 25 bp, Mus musculus
tgatggactcttcctctcctagaac

SEQ ID NO: 803137 - DNA, 25 bp, Mus musculus
tgatggactcttgctctcctagaac

SEQ ID NO: 803138 - DNA, 25 bp, Mus musculus
tgatggacttgaacaagaaggagcc

SEQ ID NO: 803139 - DNA, 25 bp, Mus musculus
tgatggacttgatcaagaaggagcc

SEQ ID NO: 803140 - DNA, 25 bp, Mus musculus
tgatggacttggagttgccaccgcc

SEQ ID NO: 803141 - DNA, 25 bp, Mus musculus
tgatggacttggtgttgccaccgcc

SEQ ID NO: 803142 - DNA, 25 bp, Mus musculus
tgatggagaaatctatgacgacatc

SEQ ID NO: 803143 - DNA, 25 bp, Mus musculus
tgatggagaaatgtatgacgacatc

SEQ ID NO: 803144 - DNA, 25 bp, Mus musculus
tgatggagacctatgtgagcagttc

SEQ ID NO: 803145 - DNA, 25 bp, Mus musculus
tgatggagacctttgtgagcagttc

SEQ ID NO: 803146 - DNA, 25 bp, Mus musculus
tgatggagacggaagtaaatctgga

SEQ ID NO: 803147 - DNA, 25 bp, Mus musculus
tgatggagacggtagtaaatctgga

SEQ ID NO: 803148 - DNA, 25 bp, Mus musculus
tgatggagaggaagtcggctacagt

SEQ ID NO: 803149 - DNA, 25 bp, Mus musculus
tgatggagaggatgtcggctacagt

SEQ ID NO: 803150 - DNA, 25 bp, Mus musculus
tgatggagagggaaaagcgggtgtc

SEQ ID NO: 803151 - DNA, 25 bp, Mus musculus
tgatggagagggtaaagcgggtgtc

SEQ ID NO: 803152 - DNA, 25 bp, Mus musculus
tgatggagatgaagactgtgcggat

SEQ ID NO: 803153 - DNA, 25 bp, Mus musculus
tgatggagatgatgactgtgcggat

SEQ ID NO: 803154 - DNA, 25 bp, Mus musculus
tgatggagcaacactagcactgtcg

SEQ ID NO: 803155 - DNA, 25 bp, Mus musculus
tgatggagcaactctagcactgtcg

SEQ ID NO: 803156 - DNA, 25 bp, Mus musculus
tgatggagcaagaactggccagctt

SEQ ID NO: 803157 - DNA, 25 bp, Mus musculus
tgatggagcaagtactggccagctt

SEQ ID NO: 803158 - DNA, 25 bp, Mus musculus
tgatggagcagcagccgtcctgctg

SEQ ID NO: 803159 - DNA, 25 bp, Mus musculus
tgatggagcagccaagcagagaccc

SEQ ID NO: 803160 - DNA, 25 bp, Mus musculus
tgatggagcagcgaagcagagaccc

SEQ ID NO: 803161 - DNA, 25 bp, Mus musculus
tgatggagcagctgccgtcctgctg

SEQ ID NO: 803162 - DNA, 25 bp, Mus musculus
tgatggagctacaactgtaatgcgt

SEQ ID NO: 803163 - DNA, 25 bp, Mus musculus
tgatggagctactactgtaatgcgt

SEQ ID NO: 803164 - DNA, 25 bp, Mus musculus
tgatggagctggagacttaagatca

SEQ ID NO: 803165 - DNA, 25 bp, Mus musculus
tgatggagctggtgacttaagatca

SEQ ID NO: 803166 - DNA, 25 bp, Mus musculus
tgatggagctgtaaaaccacccaca

SEQ ID NO: 803167 - DNA, 25 bp, Mus musculus
tgatggagctgttaaaccacccaca

SEQ ID NO: 803168 - DNA, 25 bp, Mus musculus
tgatggaggaacaaactctgaaagg

SEQ ID NO: 803169 - DNA, 25 bp, Mus musculus
tgatggaggaactaactctgaaagg

SEQ ID NO: 803170 - DNA, 25 bp, Mus musculus
tgatggagtcctatggctgggcccg

SEQ ID NO: 803171 - DNA, 25 bp, Mus musculus
tgatggagtcctttggctgggcccg

SEQ ID NO: 803172 - DNA, 25 bp, Mus musculus
tgatggagtgacaggaaaaacagct

SEQ ID NO: 803173 - DNA, 25 bp, Mus musculus
tgatggagtgactggaaaaacagct

SEQ ID NO: 803174 - DNA, 25 bp, Mus musculus
tgatggagtgggattcccttttcaa

SEQ ID NO: 803175 - DNA, 25 bp, Mus musculus
tgatggagtgggtttcccttttcaa

SEQ ID NO: 803176 - DNA, 25 bp, Mus musculus
tgatggagtggtcctaccaaaggac

SEQ ID NO: 803177 - DNA, 25 bp, Mus musculus
tgatggagtggtgctaccaaaggac

SEQ ID NO: 803178 - DNA, 25 bp, Mus musculus
tgatggatataacgcatatgaccca

SEQ ID NO: 803179 - DNA, 25 bp, Mus musculus
tgatggatataaggcatatgaccca

SEQ ID NO: 803180 - DNA, 25 bp, Mus musculus
tgatggatcctgaccccgaagtggc

SEQ ID NO: 803181 - DNA, 25 bp, Mus musculus
tgatggatcctgtccccgaagtggc

SEQ ID NO: 803182 - DNA, 25 bp, Mus musculus
tgatggatctgaatgagcaaaaccc

SEQ ID NO: 803183 - DNA, 25 bp, Mus musculus
tgatggatctgattgagcaaaaccc

SEQ ID NO: 803184 - DNA, 25 bp, Mus musculus
tgatggatgccaaagccaggcaaga

SEQ ID NO: 803185 - DNA, 25 bp, Mus musculus
tgatggatgccacacagattgctgg

SEQ ID NO: 803186 - DNA, 25 bp, Mus musculus
tgatggatgccagacagattgctgg

SEQ ID NO: 803187 - DNA, 25 bp, Mus musculus
tgatggatgccatagccaggcaaga

SEQ ID NO: 803188 - DNA, 25 bp, Mus musculus
tgatggattctgcacgagctccaaa

SEQ ID NO: 803189 - DNA, 25 bp, Mus musculus
tgatggattctggacgagctccaaa

SEQ ID NO: 803190 - DNA, 25 bp, Mus musculus
tgatggattgagcaggccttcccgc

SEQ ID NO: 803191 - DNA, 25 bp, Mus musculus
tgatggattgaggaggccttcccgc

SEQ ID NO: 803192 - DNA, 25 bp, Mus musculus
tgatggcaaaaacgctagaagaata

SEQ ID NO: 803193 - DNA, 25 bp, Mus musculus
tgatggcaaaaaggctagaagaata

SEQ ID NO: 803194 - DNA, 25 bp, Mus musculus
tgatggcaaaccaccacagctgaag

SEQ ID NO: 803195 - DNA, 25 bp, Mus musculus
tgatggcaaaccaggcctgaatggg

SEQ ID NO: 803196 - DNA, 25 bp, Mus musculus
tgatggcaaacctccacagctgaag

SEQ ID NO: 803197 - DNA, 25 bp, Mus musculus
tgatggcaaacctggcctgaatggg

SEQ ID NO: 803198 - DNA, 25 bp, Mus musculus
tgatggcaaagcagacggccctaca

SEQ ID NO: 803199 - DNA, 25 bp, Mus musculus
tgatggcaaagctgacggccctaca

SEQ ID NO: 803200 - DNA, 25 bp, Mus musculus
tgatggcacaaacatcagtaagctt

SEQ ID NO: 803201 - DNA, 25 bp, Mus musculus
tgatggcacaaagatcagtaagctt

SEQ ID NO: 803202 - DNA, 25 bp, Mus musculus
tgatggcacaacaccactgatcctg

SEQ ID NO: 803203 - DNA, 25 bp, Mus musculus
tgatggcacaactccactgatcctg

SEQ ID NO: 803204 - DNA, 25 bp, Mus musculus
tgatggcacaccaaaggagctggca

SEQ ID NO: 803205 - DNA, 25 bp, Mus musculus
tgatggcacacctaaggagctggca

SEQ ID NO: 803206 - DNA, 25 bp, Mus musculus
tgatggcacccgaatggtcagcgag

SEQ ID NO: 803207 - DNA, 25 bp, Mus musculus
tgatggcacccgtatggtcagcgag

SEQ ID NO: 803208 - DNA, 25 bp, Mus musculus
tgatggcacgcacgatcggctactg

SEQ ID NO: 803209 - DNA, 25 bp, Mus musculus
tgatggcacgcaggatcggctactg

SEQ ID NO: 803210 - DNA, 25 bp, Mus musculus
tgatggcagacaagacccagagtga

SEQ ID NO: 803211 - DNA, 25 bp, Mus musculus
tgatggcagacactactggagtgaa

SEQ ID NO: 803212 - DNA, 25 bp, Mus musculus
tgatggcagacagtactggagtgaa

SEQ ID NO: 803213 - DNA, 25 bp, Mus musculus
tgatggcagacatgacccagagtga

SEQ ID NO: 803214 - DNA, 25 bp, Mus musculus
tgatggcagacgaggtgaagcttct

SEQ ID NO: 803215 - DNA, 25 bp, Mus musculus
tgatggcagacgtggtgaagcttct

SEQ ID NO: 803216 - DNA, 25 bp, Mus musculus
tgatggcagccaaggcacagatgtc

SEQ ID NO: 803217 - DNA, 25 bp, Mus musculus
tgatggcagccatggcacagatgtc

SEQ ID NO: 803218 - DNA, 25 bp, Mus musculus
tgatggcaggcgacatctactccgt

SEQ ID NO: 803219 - DNA, 25 bp, Mus musculus
tgatggcaggcgtcatctactccgt

SEQ ID NO: 803220 - DNA, 25 bp, Mus musculus
tgatggcatcttcaaagctgagctg

SEQ ID NO: 803221 - DNA, 25 bp, Mus musculus
tgatggcatcttcggcatgggctac

SEQ ID NO: 803222 - DNA, 25 bp, Mus musculus
tgatggcatcttgaaagctgagctg

SEQ ID NO: 803223 - DNA, 25 bp, Mus musculus
tgatggcatcttgggcatgggctac

SEQ ID NO: 803224 - DNA, 25 bp, Mus musculus
tgatggcatgaaagcttacatggca

SEQ ID NO: 803225 - DNA, 25 bp, Mus musculus
tgatggcatgaatgcttacatggca

SEQ ID NO: 803226 - DNA, 25 bp, Mus musculus
tgatggcatgataacagagacaaag

SEQ ID NO: 803227 - DNA, 25 bp, Mus musculus
tgatggcatgattacagagacaaag

SEQ ID NO: 803228 - DNA, 25 bp, Mus musculus
tgatggccacacaccatctcttggg

SEQ ID NO: 803229 - DNA, 25 bp, Mus musculus
tgatggccacactccatctcttggg

SEQ ID NO: 803230 - DNA, 25 bp, Mus musculus
tgatggccaccaatcctcagaagca

SEQ ID NO: 803231 - DNA, 25 bp, Mus musculus
tgatggccaccattcctcagaagca

SEQ ID NO: 803232 - DNA, 25 bp, Mus musculus
tgatggccacttcgaccagtccgaa

SEQ ID NO: 803233 - DNA, 25 bp, Mus musculus
tgatggccacttggaccagtccgaa

SEQ ID NO: 803234 - DNA, 25 bp, Mus musculus
tgatggccatcgaaggcctggagaa

SEQ ID NO: 803235 - DNA, 25 bp, Mus musculus
tgatggccatcgtaggcctggagaa

SEQ ID NO: 803236 - DNA, 25 bp, Mus musculus
tgatggccatctagggcaacctgct

SEQ ID NO: 803237 - DNA, 25 bp, Mus musculus
tgatggccatcttgggcaacctgct

SEQ ID NO: 803238 - DNA, 25 bp, Mus musculus
tgatggcccaggcacctctgttcct

SEQ ID NO: 803239 - DNA, 25 bp, Mus musculus
tgatggcccagggacctctgttcct

SEQ ID NO: 803240 - DNA, 25 bp, Mus musculus
tgatggccctcacggccacagcgaa

SEQ ID NO: 803241 - DNA, 25 bp, Mus musculus
tgatggccctcagggccacagcgaa

SEQ ID NO: 803242 - DNA, 25 bp, Mus musculus
tgatggccgctcacaggatgacatt

SEQ ID NO: 803243 - DNA, 25 bp, Mus musculus
tgatggccgctctcaggatgacatt

SEQ ID NO: 803244 - DNA, 25 bp, Mus musculus
tgatggcctgcaaagcttaccggga

SEQ ID NO: 803245 - DNA, 25 bp, Mus musculus
tgatggcctgcatagcttaccggga

SEQ ID NO: 803246 - DNA, 25 bp, Mus musculus
tgatggccttccactttgaactgaa

SEQ ID NO: 803247 - DNA, 25 bp, Mus musculus
tgatggccttcctctttgaactgaa

SEQ ID NO: 803248 - DNA, 25 bp, Mus musculus
tgatggcgagacaaaggagcccttt

SEQ ID NO: 803249 - DNA, 25 bp, Mus musculus
tgatggcgagactaaggagcccttt

SEQ ID NO: 803250 - DNA, 25 bp, Mus musculus
tgatggcgccgtcggctgcattcct

SEQ ID NO: 803251 - DNA, 25 bp, Mus musculus
tgatggcgccgtgggctgcattcct

SEQ ID NO: 803252 - DNA, 25 bp, Mus musculus
tgatggcgcgagatccgcgttccga

SEQ ID NO: 803253 - DNA, 25 bp, Mus musculus
tgatggcgcgagttccgcgttccga

SEQ ID NO: 803254 - DNA, 25 bp, Mus musculus
tgatggctaccgcaaggcctggaac

SEQ ID NO: 803255 - DNA, 25 bp, Mus musculus
tgatggctaccggaaggcctggaac

SEQ ID NO: 803256 - DNA, 25 bp, Mus musculus
tgatggctacctatctgctccttgg

SEQ ID NO: 803257 - DNA, 25 bp, Mus musculus
tgatggctacctttctgctccttgg

SEQ ID NO: 803258 - DNA, 25 bp, Mus musculus
tgatggctacgactgtgaaatccct

SEQ ID NO: 803259 - DNA, 25 bp, Mus musculus
tgatggctacgagtgtgaaatccct

SEQ ID NO: 803260 - DNA, 25 bp, Mus musculus
tgatggctcaaaataactgaagtat

SEQ ID NO: 803261 - DNA, 25 bp, Mus musculus
tgatggctcaaattaactgaagtat

SEQ ID NO: 803262 - DNA, 25 bp, Mus musculus
tgatggctcagtattgtggcgcctt

SEQ ID NO: 803263 - DNA, 25 bp, Mus musculus
tgatggctcagttttgtggcgcctt

SEQ ID NO: 803264 - DNA, 25 bp, Mus musculus
tgatggctcatgaacgtaaacttgc

SEQ ID NO: 803265 - DNA, 25 bp, Mus musculus
tgatggctcatgtacgtaaacttgc

SEQ ID NO: 803266 - DNA, 25 bp, Mus musculus
tgatggctccaccaacataacacag

SEQ ID NO: 803267 - DNA, 25 bp, Mus musculus
tgatggctccacgaacataacacag

SEQ ID NO: 803268 - DNA, 25 bp, Mus musculus
tgatggctgaataagttcataacag

SEQ ID NO: 803269 - DNA, 25 bp, Mus musculus
tgatggctgaattagttcataacag

SEQ ID NO: 803270 - DNA, 25 bp, Mus musculus
tgatggctgctacgtgcaacttccg

SEQ ID NO: 803271 - DNA, 25 bp, Mus musculus
tgatggctgctaggtgcaacttccg

SEQ ID NO: 803272 - DNA, 25 bp, Mus musculus
tgatggctggggagcttccctacgc

SEQ ID NO: 803273 - DNA, 25 bp, Mus musculus
tgatggctggggtgcttccctacgc

SEQ ID NO: 803274 - DNA, 25 bp, Mus musculus
tgatggctgtctagagaggctcacc

SEQ ID NO: 803275 - DNA, 25 bp, Mus musculus
tgatggctgtcttgagaggctcacc

SEQ ID NO: 803276 - DNA, 25 bp, Mus musculus
tgatggctttcaatgaacaagaagc

SEQ ID NO: 803277 - DNA, 25 bp, Mus musculus
tgatggctttcattgaacaagaagc

SEQ ID NO: 803278 - DNA, 25 bp, Mus musculus
tgatggctttggacccttcatgcca

SEQ ID NO: 803279 - DNA, 25 bp, Mus musculus
tgatggctttggtcccttcatgcca

SEQ ID NO: 803280 - DNA, 25 bp, Mus musculus
tgatggctttttagtgaagcgaacc

SEQ ID NO: 803281 - DNA, 25 bp, Mus musculus
tgatggcttttttgtgaagcgaacc

SEQ ID NO: 803282 - DNA, 25 bp, Mus musculus
tgatgggaaaggctacactcaggac

SEQ ID NO: 803283 - DNA, 25 bp, Mus musculus
tgatgggaaagggtacactcaggac

SEQ ID NO: 803284 - DNA, 25 bp, Mus musculus
tgatgggacccaaccatgtaaaagg

SEQ ID NO: 803285 - DNA, 25 bp, Mus musculus
tgatgggacccatccatgtaaaagg

SEQ ID NO: 803286 - DNA, 25 bp, Mus musculus
tgatgggagctgatttactaccagg

SEQ ID NO: 803287 - DNA, 25 bp, Mus musculus
tgatgggagctgttttactaccagg

SEQ ID NO: 803288 - DNA, 25 bp, Mus musculus
tgatgggcaaacattatgggatggt

SEQ ID NO: 803289 - DNA, 25 bp, Mus musculus
tgatgggcaaactttatgggatggt

SEQ ID NO: 803290 - DNA, 25 bp, Mus musculus
tgatgggcaggaccccagagtacac

SEQ ID NO: 803291 - DNA, 25 bp, Mus musculus
tgatgggcaggagcccagagtacac

SEQ ID NO: 803292 - DNA, 25 bp, Mus musculus
tgatgggccaccagctaaggacggc

SEQ ID NO: 803293 - DNA, 25 bp, Mus musculus
tgatgggccacctgctaaggacggc

SEQ ID NO: 803294 - DNA, 25 bp, Mus musculus
tgatgggcgtagctgacatgatctc

SEQ ID NO: 803295 - DNA, 25 bp, Mus musculus
tgatgggcgtaggtgacatgatctc

SEQ ID NO: 803296 - DNA, 25 bp, Mus musculus
tgatgggctcccatactcactatgt

SEQ ID NO: 803297 - DNA, 25 bp, Mus musculus
tgatgggctcccttactcactatgt

SEQ ID NO: 803298 - DNA, 25 bp, Mus musculus
tgatgggctgagacgggctgcgtat

SEQ ID NO: 803299 - DNA, 25 bp, Mus musculus
tgatgggctgagtcgggctgcgtat

SEQ ID NO: 803300 - DNA, 25 bp, Mus musculus
tgatgggctgccctacctcaaggtc

SEQ ID NO: 803301 - DNA, 25 bp, Mus musculus
tgatgggctgccgtacctcaaggtc

SEQ ID NO: 803302 - DNA, 25 bp, Mus musculus
tgatgggtgtacacaggcaaagctg

SEQ ID NO: 803303 - DNA, 25 bp, Mus musculus
tgatgggtgtactcaggcaaagctg

SEQ ID NO: 803304 - DNA, 25 bp, Mus musculus
tgatggtaagtcacctgcagcgccc

SEQ ID NO: 803305 - DNA, 25 bp, Mus musculus
tgatggtaagtctcctgcagcgccc

SEQ ID NO: 803306 - DNA, 25 bp, Mus musculus
tgatggtcagttagccctctcgggc

SEQ ID NO: 803307 - DNA, 25 bp, Mus musculus
tgatggtcagtttgccctctcgggc

SEQ ID NO: 803308 - DNA, 25 bp, Mus musculus
tgatggtcatggatggctatccaga

SEQ ID NO: 803309 - DNA, 25 bp, Mus musculus
tgatggtcatggttggctatccaga

SEQ ID NO: 803310 - DNA, 25 bp, Mus musculus
tgatggtccaagactggtctccact

SEQ ID NO: 803311 - DNA, 25 bp, Mus musculus
tgatggtccaagtctggtctccact

SEQ ID NO: 803312 - DNA, 25 bp, Mus musculus
tgatggtcctcacagtgccttatac

SEQ ID NO: 803313 - DNA, 25 bp, Mus musculus
tgatggtcctcagagtgccttatac

SEQ ID NO: 803314 - DNA, 25 bp, Mus musculus
tgatggtgacccaggacctaaagga

SEQ ID NO: 803315 - DNA, 25 bp, Mus musculus
tgatggtgaccctggacctaaagga

SEQ ID NO: 803316 - DNA, 25 bp, Mus musculus
tgatggtgatggctgatgtcaccta

SEQ ID NO: 803317 - DNA, 25 bp, Mus musculus
tgatggtgatgggtgatgtcaccta

SEQ ID NO: 803318 - DNA, 25 bp, Mus musculus
tgatggtgccaccttagtgattcct

SEQ ID NO: 803319 - DNA, 25 bp, Mus musculus
tgatggtgccacgttagtgattcct

SEQ ID NO: 803320 - DNA, 25 bp, Mus musculus
tgatggtggagcatctgctacgctg

SEQ ID NO: 803321 - DNA, 25 bp, Mus musculus
tgatggtggagcttctgctacgctg

SEQ ID NO: 803322 - DNA, 25 bp, Mus musculus
tgatggtgggcacacagctcctgcc

SEQ ID NO: 803323 - DNA, 25 bp, Mus musculus
tgatggtgggcagacagctcctgcc

SEQ ID NO: 803324 - DNA, 25 bp, Mus musculus
tgatggtgggcccaaacttccgagt

SEQ ID NO: 803325 - DNA, 25 bp, Mus musculus
tgatggtgggccgaaacttccgagt

SEQ ID NO: 803326 - DNA, 25 bp, Mus musculus
tgatggtgtctacgccagaacagtg

SEQ ID NO: 803327 - DNA, 25 bp, Mus musculus
tgatggtgtctaggccagaacagtg

SEQ ID NO: 803328 - DNA, 25 bp, Mus musculus
tgatggtgtgaaagatgctcctgct

SEQ ID NO: 803329 - DNA, 25 bp, Mus musculus
tgatggtgtgaatgatgctcctgct

SEQ ID NO: 803330 - DNA, 25 bp, Mus musculus
tgatggtgttccagctctggtccga

SEQ ID NO: 803331 - DNA, 25 bp, Mus musculus
tgatggtgttcctgctctggtccga

SEQ ID NO: 803332 - DNA, 25 bp, Mus musculus
tgatggtgtttgagtcagcgccctg

SEQ ID NO: 803333 - DNA, 25 bp, Mus musculus
tgatggtgtttgtgtcagcgccctg

SEQ ID NO: 803334 - DNA, 25 bp, Mus musculus
tgatggttaccacggacacgtgctc

SEQ ID NO: 803335 - DNA, 25 bp, Mus musculus
tgatggttaccagggacacgtgctc

SEQ ID NO: 803336 - DNA, 25 bp, Mus musculus
tgatggttgaaaaggaaagggtcct

SEQ ID NO: 803337 - DNA, 25 bp, Mus musculus
tgatggttgaaatggaaagggtcct

SEQ ID NO: 803338 - DNA, 25 bp, Mus musculus
tgatggtttccccacgcctgaatcc

SEQ ID NO: 803339 - DNA, 25 bp, Mus musculus
tgatggtttcccgacgcctgaatcc

SEQ ID NO: 803340 - DNA, 25 bp, Mus musculus
tgatgtacagggagatccaggtgtc

SEQ ID NO: 803341 - DNA, 25 bp, Mus musculus
tgatgtacagggtgatccaggtgtc

SEQ ID NO: 803342 - DNA, 25 bp, Mus musculus
tgatgtaccctgattgtcggctcag

SEQ ID NO: 803343 - DNA, 25 bp, Mus musculus
tgatgtaccctgtttgtcggctcag

SEQ ID NO: 803344 - DNA, 25 bp, Mus musculus
tgatgtacctaaactggtgactgag

SEQ ID NO: 803345 - DNA, 25 bp, Mus musculus
tgatgtacctaatctggtgactgag

SEQ ID NO: 803346 - DNA, 25 bp, Mus musculus
tgatgtacctccagccttcgccaag

SEQ ID NO: 803347 - DNA, 25 bp, Mus musculus
tgatgtacctcctgccttcgccaag

SEQ ID NO: 803348 - DNA, 25 bp, Mus musculus
tgatgtactcgcagccctggtgagc

SEQ ID NO: 803349 - DNA, 25 bp, Mus musculus
tgatgtactcgctgccctggtgagc

SEQ ID NO: 803350 - DNA, 25 bp, Mus musculus
tgatgtagaaagagagccagccatg

SEQ ID NO: 803351 - DNA, 25 bp, Mus musculus
tgatgtagaaagtgagccagccatg

SEQ ID NO: 803352 - DNA, 25 bp, Mus musculus
tgatgtagacttactgattgtgaca

SEQ ID NO: 803353 - DNA, 25 bp, Mus musculus
tgatgtagactttctgattgtgaca

SEQ ID NO: 803354 - DNA, 25 bp, Mus musculus
tgatgtagccacaattcagccctct

SEQ ID NO: 803355 - DNA, 25 bp, Mus musculus
tgatgtagccactattcagccctct

SEQ ID NO: 803356 - DNA, 25 bp, Mus musculus
tgatgtaggaacactgcagagactg

SEQ ID NO: 803357 - DNA, 25 bp, Mus musculus
tgatgtaggaactctgcagagactg

SEQ ID NO: 803358 - DNA, 25 bp, Mus musculus
tgatgtatcccaagccaaagcccaa

SEQ ID NO: 803359 - DNA, 25 bp, Mus musculus
tgatgtatcccatgccaaagcccaa

SEQ ID NO: 803360 - DNA, 25 bp, Mus musculus
tgatgtcaagatcactaagcttgga

SEQ ID NO: 803361 - DNA, 25 bp, Mus musculus
tgatgtcaagatcgccattctgcag

SEQ ID NO: 803362 - DNA, 25 bp, Mus musculus
tgatgtcaagatgactaagcttgga

SEQ ID NO: 803363 - DNA, 25 bp, Mus musculus
tgatgtcaagatggccattctgcag

SEQ ID NO: 803364 - DNA, 25 bp, Mus musculus
tgatgtcacaccagaacacagacag

SEQ ID NO: 803365 - DNA, 25 bp, Mus musculus
tgatgtcacacctgaacacagacag

SEQ ID NO: 803366 - DNA, 25 bp, Mus musculus
tgatgtcagagcaggacctggcgga

SEQ ID NO: 803367 - DNA, 25 bp, Mus musculus
tgatgtcagagctggacctggcgga

SEQ ID NO: 803368 - DNA, 25 bp, Mus musculus
tgatgtcagcgtcagtccagcagca

SEQ ID NO: 803369 - DNA, 25 bp, Mus musculus
tgatgtcagcgtgagtccagcagca

SEQ ID NO: 803370 - DNA, 25 bp, Mus musculus
tgatgtcatctcatcgtgggctcca

SEQ ID NO: 803371 - DNA, 25 bp, Mus musculus
tgatgtcatctcttcgtgggctcca

SEQ ID NO: 803372 - DNA, 25 bp, Mus musculus
tgatgtcatgcaacaagaggttagg

SEQ ID NO: 803373 - DNA, 25 bp, Mus musculus
tgatgtcatgcatcaagaggttagg

SEQ ID NO: 803374 - DNA, 25 bp, Mus musculus
tgatgtcatgggagctgccactcag

SEQ ID NO: 803375 - DNA, 25 bp, Mus musculus
tgatgtcatgggtgctgccactcag

SEQ ID NO: 803376 - DNA, 25 bp, Mus musculus
tgatgtcattggcactttgagtggc

SEQ ID NO: 803377 - DNA, 25 bp, Mus musculus
tgatgtcattgggactttgagtggc

SEQ ID NO: 803378 - DNA, 25 bp, Mus musculus
tgatgtcattgtcaacattagtgac

SEQ ID NO: 803379 - DNA, 25 bp, Mus musculus
tgatgtcattgtgaacattagtgac

SEQ ID NO: 803380 - DNA, 25 bp, Mus musculus
tgatgtccagatagaccaggaggcc

SEQ ID NO: 803381 - DNA, 25 bp, Mus musculus
tgatgtccagattgaccaggaggcc

SEQ ID NO: 803382 - DNA, 25 bp, Mus musculus
tgatgtccctatcccttacgcaaag

SEQ ID NO: 803383 - DNA, 25 bp, Mus musculus
tgatgtccctatgccttacgcaaag

SEQ ID NO: 803384 - DNA, 25 bp, Mus musculus
tgatgtccctccacgacaaaaagag

SEQ ID NO: 803385 - DNA, 25 bp, Mus musculus
tgatgtccctcctcgacaaaaagag

SEQ ID NO: 803386 - DNA, 25 bp, Mus musculus
tgatgtccgaatccctcctttacta

SEQ ID NO: 803387 - DNA, 25 bp, Mus musculus
tgatgtccgaatgcctcctttacta

SEQ ID NO: 803388 - DNA, 25 bp, Mus musculus
tgatgtccggccatgtggagtacca

SEQ ID NO: 803389 - DNA, 25 bp, Mus musculus
tgatgtccggccttgtggagtacca

SEQ ID NO: 803390 - DNA, 25 bp, Mus musculus
tgatgtcctacaccgagagattggg

SEQ ID NO: 803391 - DNA, 25 bp, Mus musculus
tgatgtcctacagcgagagattggg

SEQ ID NO: 803392 - DNA, 25 bp, Mus musculus
tgatgtcctatcaacaaaacctgtc

SEQ ID NO: 803393 - DNA, 25 bp, Mus musculus
tgatgtcctatctacaaaacctgtc

SEQ ID NO: 803394 - DNA, 25 bp, Mus musculus
tgatgtccttgaacagcatcgaatg

SEQ ID NO: 803395 - DNA, 25 bp, Mus musculus
tgatgtccttgatcagcatcgaatg

SEQ ID NO: 803396 - DNA, 25 bp, Mus musculus
tgatgtcgaggacttgaccacactg

SEQ ID NO: 803397 - DNA, 25 bp, Mus musculus
tgatgtcgaggagttgaccacactg

SEQ ID NO: 803398 - DNA, 25 bp, Mus musculus
tgatgtcgcaaccacagagaaagag

SEQ ID NO: 803399 - DNA, 25 bp, Mus musculus
tgatgtcgcaacgacagagaaagag

SEQ ID NO: 803400 - DNA, 25 bp, Mus musculus
tgatgtcggaccaggatgtcaacgc

SEQ ID NO: 803401 - DNA, 25 bp, Mus musculus
tgatgtcggacctggatgtcaacgc

SEQ ID NO: 803402 - DNA, 25 bp, Mus musculus
tgatgtcgtccgaggctatggagca

SEQ ID NO: 803403 - DNA, 25 bp, Mus musculus
tgatgtcgtccgtggctatggagca

SEQ ID NO: 803404 - DNA, 25 bp, Mus musculus
tgatgtctcgggaagggacagcaca

SEQ ID NO: 803405 - DNA, 25 bp, Mus musculus
tgatgtctcgggtagggacagcaca

SEQ ID NO: 803406 - DNA, 25 bp, Mus musculus
tgatgtctgttgcaagacctgtccc

SEQ ID NO: 803407 - DNA, 25 bp, Mus musculus
tgatgtctgttggaagacctgtccc

SEQ ID NO: 803408 - DNA, 25 bp, Mus musculus
tgatgtgaagagaatagctgaactt

SEQ ID NO: 803409 - DNA, 25 bp, Mus musculus
tgatgtgaagagtatagctgaactt

SEQ ID NO: 803410 - DNA, 25 bp, Mus musculus
tgatgtgaagatatggaccgcgcac

SEQ ID NO: 803411 - DNA, 25 bp, Mus musculus
tgatgtgaagatttggaccgcgcac

SEQ ID NO: 803412 - DNA, 25 bp, Mus musculus
tgatgtgaaggacatctattcccac

SEQ ID NO: 803413 - DNA, 25 bp, Mus musculus
tgatgtgaaggagatctattcccac

SEQ ID NO: 803414 - DNA, 25 bp, Mus musculus
tgatgtgaagtacctcatgaagagc

SEQ ID NO: 803415 - DNA, 25 bp, Mus musculus
tgatgtgaagtagctcatgaagagc

SEQ ID NO: 803416 - DNA, 25 bp, Mus musculus
tgatgtgacccaagaaaatatcctg

SEQ ID NO: 803417 - DNA, 25 bp, Mus musculus
tgatgtgacccatgaaaatatcctg

SEQ ID NO: 803418 - DNA, 25 bp, Mus musculus
tgatgtgactagatgtgggcactct

SEQ ID NO: 803419 - DNA, 25 bp, Mus musculus
tgatgtgactagttgtgggcactct

SEQ ID NO: 803420 - DNA, 25 bp, Mus musculus
tgatgtgacttaagcggccctggtg

SEQ ID NO: 803421 - DNA, 25 bp, Mus musculus
tgatgtgacttatgcggccctggtg

SEQ ID NO: 803422 - DNA, 25 bp, Mus musculus
tgatgtgatgaacatcgctgacttt

SEQ ID NO: 803423 - DNA, 25 bp, Mus musculus
tgatgtgatgaagatcgctgacttt

SEQ ID NO: 803424 - DNA, 25 bp, Mus musculus
tgatgtgccaagaggcagcagacct

SEQ ID NO: 803425 - DNA, 25 bp, Mus musculus
tgatgtgccaagtggcagcagacct

SEQ ID NO: 803426 - DNA, 25 bp, Mus musculus
tgatgtgcccccagttcgaggactg

SEQ ID NO: 803427 - DNA, 25 bp, Mus musculus
tgatgtgccccctgttcgaggactg

SEQ ID NO: 803428 - DNA, 25 bp, Mus musculus
tgatgtgcccttcggctgagcccta

SEQ ID NO: 803429 - DNA, 25 bp, Mus musculus
tgatgtgcccttgggctgagcccta

SEQ ID NO: 803430 - DNA, 25 bp, Mus musculus
tgatgtgcggtcatggactggttcc

SEQ ID NO: 803431 - DNA, 25 bp, Mus musculus
tgatgtgcggtcttggactggttcc

SEQ ID NO: 803432 - DNA, 25 bp, Mus musculus
tgatgtgctcagctgttcactgaac

SEQ ID NO: 803433 - DNA, 25 bp, Mus musculus
tgatgtgctcaggtgttcactgaac

SEQ ID NO: 803434 - DNA, 25 bp, Mus musculus
tgatgtgctgaacccctatgtggcc

SEQ ID NO: 803435 - DNA, 25 bp, Mus musculus
tgatgtgctgaagccctatgtggcc

SEQ ID NO: 803436 - DNA, 25 bp, Mus musculus
tgatgtgctttccagaagcctccca

SEQ ID NO: 803437 - DNA, 25 bp, Mus musculus
tgatgtgctttcgagaagcctccca

SEQ ID NO: 803438 - DNA, 25 bp, Mus musculus
tgatgtggacacctctggttttcag

SEQ ID NO: 803439 - DNA, 25 bp, Mus musculus
tgatgtggacacgtctggttttcag

SEQ ID NO: 803440 - DNA, 25 bp, Mus musculus
tgatgtggatgcctcagacttccct

SEQ ID NO: 803441 - DNA, 25 bp, Mus musculus
tgatgtggatgcgtcagacttccct

SEQ ID NO: 803442 - DNA, 25 bp, Mus musculus
tgatgtggccacagtagtatctcct

SEQ ID NO: 803443 - DNA, 25 bp, Mus musculus
tgatgtggccactgtagtatctcct

SEQ ID NO: 803444 - DNA, 25 bp, Mus musculus
tgatgtggctcactccctagcagtg

SEQ ID NO: 803445 - DNA, 25 bp, Mus musculus
tgatgtggctcagtccctagcagtg

SEQ ID NO: 803446 - DNA, 25 bp, Mus musculus
tgatgtggcttccatctccaagacc

SEQ ID NO: 803447 - DNA, 25 bp, Mus musculus
tgatgtggcttcgatctccaagacc

SEQ ID NO: 803448 - DNA, 25 bp, Mus musculus
tgatgtgggacgattgcctgctacc

SEQ ID NO: 803449 - DNA, 25 bp, Mus musculus
tgatgtgggacgtttgcctgctacc

SEQ ID NO: 803450 - DNA, 25 bp, Mus musculus
tgatgtggtgaacttccaatggacg

SEQ ID NO: 803451 - DNA, 25 bp, Mus musculus
tgatgtggtgaagttccaatggacg

SEQ ID NO: 803452 - DNA, 25 bp, Mus musculus
tgatgtggtggtaatcctcacctgc

SEQ ID NO: 803453 - DNA, 25 bp, Mus musculus
tgatgtggtggttatcctcacctgc

SEQ ID NO: 803454 - DNA, 25 bp, Mus musculus
tgatgtgtagtgaacctcccgtgtg

SEQ ID NO: 803455 - DNA, 25 bp, Mus musculus
tgatgtgtagtgtacctcccgtgtg

SEQ ID NO: 803456 - DNA, 25 bp, Mus musculus
tgatgtgtcaagcactaccacccag

SEQ ID NO: 803457 - DNA, 25 bp, Mus musculus
tgatgtgtcaaggactaccacccag

SEQ ID NO: 803458 - DNA, 25 bp, Mus musculus
tgatgtgtgtcaaccagaatggcgg

SEQ ID NO: 803459 - DNA, 25 bp, Mus musculus
tgatgtgtgtcatccagaatggcgg

SEQ ID NO: 803460 - DNA, 25 bp, Mus musculus
tgatgtgtgtgcagtatttcgtgga

SEQ ID NO: 803461 - DNA, 25 bp, Mus musculus
tgatgtgtgtgctgtatttcgtgga

SEQ ID NO: 803462 - DNA, 25 bp, Mus musculus
tgatgtgtgttcactctctcatgtc

SEQ ID NO: 803463 - DNA, 25 bp, Mus musculus
tgatgtgtgttctctctctcatgtc

SEQ ID NO: 803464 - DNA, 25 bp, Mus musculus
tgatgttacctacgcaccattggag

SEQ ID NO: 803465 - DNA, 25 bp, Mus musculus
tgatgttacctaggcaccattggag

SEQ ID NO: 803466 - DNA, 25 bp, Mus musculus
tgatgttactttatgcttctcagag

SEQ ID NO: 803467 - DNA, 25 bp, Mus musculus
tgatgttactttttgcttctcagag

SEQ ID NO: 803468 - DNA, 25 bp, Mus musculus
tgatgttagagaagtttgttgaaga

SEQ ID NO: 803469 - DNA, 25 bp, Mus musculus
tgatgttagagatgtttgttgaaga

SEQ ID NO: 803470 - DNA, 25 bp, Mus musculus
tgatgttccacaatcaggacaaagg

SEQ ID NO: 803471 - DNA, 25 bp, Mus musculus
tgatgttccacattcaggacaaagg

SEQ ID NO: 803472 - DNA, 25 bp, Mus musculus
tgatgttcccctctgcaaagaggac

SEQ ID NO: 803473 - DNA, 25 bp, Mus musculus
tgatgttcccctgtgcaaagaggac

SEQ ID NO: 803474 - DNA, 25 bp, Mus musculus
tgatgttcctccatctgtgagcaag

SEQ ID NO: 803475 - DNA, 25 bp, Mus musculus
tgatgttcctccttctgtgagcaag

SEQ ID NO: 803476 - DNA, 25 bp, Mus musculus
tgatgttcctggcaaaattacgttt

SEQ ID NO: 803477 - DNA, 25 bp, Mus musculus
tgatgttcctgggaaaattacgttt

SEQ ID NO: 803478 - DNA, 25 bp, Mus musculus
tgatgttcgtgcacatctagaccac

SEQ ID NO: 803479 - DNA, 25 bp, Mus musculus
tgatgttcgtgctcatctagaccac

SEQ ID NO: 803480 - DNA, 25 bp, Mus musculus
tgatgttcttaaagcgacagcgctc

SEQ ID NO: 803481 - DNA, 25 bp, Mus musculus
tgatgttcttaatgcgacagcgctc

SEQ ID NO: 803482 - DNA, 25 bp, Mus musculus
tgatgttcttctcgtcatccgccca

SEQ ID NO: 803483 - DNA, 25 bp, Mus musculus
tgatgttcttctggtcatccgccca

SEQ ID NO: 803484 - DNA, 25 bp, Mus musculus
tgatgttgaagaagtgaaagaacag

SEQ ID NO: 803485 - DNA, 25 bp, Mus musculus
tgatgttgaagatgtgaaagaacag

SEQ ID NO: 803486 - DNA, 25 bp, Mus musculus
tgatgttgcattaacttcagcagaa

SEQ ID NO: 803487 - DNA, 25 bp, Mus musculus
tgatgttgcatttacttcagcagaa

SEQ ID NO: 803488 - DNA, 25 bp, Mus musculus
tgatgttgctgtcgaagcaatccga

SEQ ID NO: 803489 - DNA, 25 bp, Mus musculus
tgatgttgctgtggaagcaatccga

SEQ ID NO: 803490 - DNA, 25 bp, Mus musculus
tgatgttgttgacagtcagccagat

SEQ ID NO: 803491 - DNA, 25 bp, Mus musculus
tgatgttgttgagagtcagccagat

SEQ ID NO: 803492 - DNA, 25 bp, Mus musculus
tgatgtttcccactcctgagctggc

SEQ ID NO: 803493 - DNA, 25 bp, Mus musculus
tgatgtttcccagtcctgagctggc

SEQ ID NO: 803494 - DNA, 25 bp, Mus musculus
tgatgtttccgcaaagccggcactc

SEQ ID NO: 803495 - DNA, 25 bp, Mus musculus
tgatgtttccgctaagccggcactc

SEQ ID NO: 803496 - DNA, 25 bp, Mus musculus
tgatgtttgcatatgggaagtgagc

SEQ ID NO: 803497 - DNA, 25 bp, Mus musculus
tgatgtttgcatttgggaagtgagc

SEQ ID NO: 803498 - DNA, 25 bp, Mus musculus
tgatgtttggctacctggcggacag

SEQ ID NO: 803499 - DNA, 25 bp, Mus musculus
tgatgtttggcttcctggcggacag

SEQ ID NO: 803500 - DNA, 25 bp, Mus musculus
tgatgttttaggatccacgagtacc

SEQ ID NO: 803501 - DNA, 25 bp, Mus musculus
tgatgttttaggttccacgagtacc

SEQ ID NO: 803502 - DNA, 25 bp, Mus musculus
tgatgtttttatcccatgcttccgg

SEQ ID NO: 803503 - DNA, 25 bp, Mus musculus
tgatgtttttatgccatgcttccgg

SEQ ID NO: 803504 - DNA, 25 bp, Mus musculus
tgattaacccagagggagttctcct

SEQ ID NO: 803505 - DNA, 25 bp, Mus musculus
tgattaacccagtgggagttctcct

SEQ ID NO: 803506 - DNA, 25 bp, Mus musculus
tgattaaccctcaagagaccagctt

SEQ ID NO: 803507 - DNA, 25 bp, Mus musculus
tgattaaccctctagagaccagctt

SEQ ID NO: 803508 - DNA, 25 bp, Mus musculus
tgattaaccgggagcggatcccgac

SEQ ID NO: 803509 - DNA, 25 bp, Mus musculus
tgattaaccgggtgcggatcccgac

SEQ ID NO: 803510 - DNA, 25 bp, Mus musculus
tgattaactatcaggatgacgcgga

SEQ ID NO: 803511 - DNA, 25 bp, Mus musculus
tgattaactatctggatgacgcgga

SEQ ID NO: 803512 - DNA, 25 bp, Mus musculus
tgattaagacgcaaattctgccaag

SEQ ID NO: 803513 - DNA, 25 bp, Mus musculus
tgattaagacgctaattctgccaag

SEQ ID NO: 803514 - DNA, 25 bp, Mus musculus
tgattaagagaaatggctccacccc

SEQ ID NO: 803515 - DNA, 25 bp, Mus musculus
tgattaagagaattggctccacccc

SEQ ID NO: 803516 - DNA, 25 bp, Mus musculus
tgattaagccaaacaccaagccatg

SEQ ID NO: 803517 - DNA, 25 bp, Mus musculus
tgattaagccaatcaccaagccatg

SEQ ID NO: 803518 - DNA, 25 bp, Mus musculus
tgattaagggtgactgctccactcc

SEQ ID NO: 803519 - DNA, 25 bp, Mus musculus
tgattaagggtgtctgctccactcc

SEQ ID NO: 803520 - DNA, 25 bp, Mus musculus
tgattaatgacgctggtgaaataca

SEQ ID NO: 803521 - DNA, 25 bp, Mus musculus
tgattaatgacggtggtgaaataca

SEQ ID NO: 803522 - DNA, 25 bp, Mus musculus
tgattacacgtgcatttccaggtgc

SEQ ID NO: 803523 - DNA, 25 bp, Mus musculus
tgattacacgtggatttccaggtgc

SEQ ID NO: 803524 - DNA, 25 bp, Mus musculus
tgattacagccaaagactcaggccg

SEQ ID NO: 803525 - DNA, 25 bp, Mus musculus
tgattacagccatagactcaggccg

SEQ ID NO: 803526 - DNA, 25 bp, Mus musculus
tgattacctcagcagatgaaataca

SEQ ID NO: 803527 - DNA, 25 bp, Mus musculus
tgattacctcaggagatgaaataca

SEQ ID NO: 803528 - DNA, 25 bp, Mus musculus
tgattactttggcaaagaaggccgg

SEQ ID NO: 803529 - DNA, 25 bp, Mus musculus
tgattactttgggaaagaaggccgg

SEQ ID NO: 803530 - DNA, 25 bp, Mus musculus
tgattagattgcatggctctgagca

SEQ ID NO: 803531 - DNA, 25 bp, Mus musculus
tgattagattgcttggctctgagca

SEQ ID NO: 803532 - DNA, 25 bp, Mus musculus
tgattaggccagaacctgctcatcc

SEQ ID NO: 803533 - DNA, 25 bp, Mus musculus
tgattaggccagtacctgctcatcc

SEQ ID NO: 803534 - DNA, 25 bp, Mus musculus
tgattatacaccactgagtctggct

SEQ ID NO: 803535 - DNA, 25 bp, Mus musculus
tgattatacacctctgagtctggct

SEQ ID NO: 803536 - DNA, 25 bp, Mus musculus
tgattatacctaagagaagtatcct

SEQ ID NO: 803537 - DNA, 25 bp, Mus musculus
tgattatacctatgagaagtatcct

SEQ ID NO: 803538 - DNA, 25 bp, Mus musculus
tgattatactggctataactatggg

SEQ ID NO: 803539 - DNA, 25 bp, Mus musculus
tgattatactgggtataactatggg

SEQ ID NO: 803540 - DNA, 25 bp, Mus musculus
tgattatattttctacactgcaaag

SEQ ID NO: 803541 - DNA, 25 bp, Mus musculus
tgattatattttgtacactgcaaag

SEQ ID NO: 803542 - DNA, 25 bp, Mus musculus
tgattatcacatcagtgtcccacag

SEQ ID NO: 803543 - DNA, 25 bp, Mus musculus
tgattatcacatgagtgtcccacag

SEQ ID NO: 803544 - DNA, 25 bp, Mus musculus
tgattatgacttagacttgggaact

SEQ ID NO: 803545 - DNA, 25 bp, Mus musculus
tgattatgactttgacttgggaact

SEQ ID NO: 803546 - DNA, 25 bp, Mus musculus
tgattatgatcccaatgaaaagagt

SEQ ID NO: 803547 - DNA, 25 bp, Mus musculus
tgattatgatccgaatgaaaagagt

SEQ ID NO: 803548 - DNA, 25 bp, Mus musculus
tgattatgcatccttccatccttag

SEQ ID NO: 803549 - DNA, 25 bp, Mus musculus
tgattatgcatcgttccatccttag

SEQ ID NO: 803550 - DNA, 25 bp, Mus musculus
tgattatggcatctatacaatgcca

SEQ ID NO: 803551 - DNA, 25 bp, Mus musculus
tgattatggcatgtatacaatgcca

SEQ ID NO: 803552 - DNA, 25 bp, Mus musculus
tgattatgggtacgaaaacctggtt

SEQ ID NO: 803553 - DNA, 25 bp, Mus musculus
tgattatgggtaggaaaacctggtt

SEQ ID NO: 803554 - DNA, 25 bp, Mus musculus
tgattatgttgcaattggagctgat

SEQ ID NO: 803555 - DNA, 25 bp, Mus musculus
tgattatgttgctattggagctgat

SEQ ID NO: 803556 - DNA, 25 bp, Mus musculus
tgattattcaggcacgcaggtacct

SEQ ID NO: 803557 - DNA, 25 bp, Mus musculus
tgattattcagggacgcaggtacct

SEQ ID NO: 803558 - DNA, 25 bp, Mus musculus
tgattattgcccaggtcaacagcat

SEQ ID NO: 803559 - DNA, 25 bp, Mus musculus
tgattattgccctggtcaacagcat

SEQ ID NO: 803560 - DNA, 25 bp, Mus musculus
tgattcaatgccagggctttcaaac

SEQ ID NO: 803561 - DNA, 25 bp, Mus musculus
tgattcaatgcctgggctttcaaac

SEQ ID NO: 803562 - DNA, 25 bp, Mus musculus
tgattcacttcaagtccccaaaatg

SEQ ID NO: 803563 - DNA, 25 bp, Mus musculus
tgattcacttcatgtccccaaaatg

SEQ ID NO: 803564 - DNA, 25 bp, Mus musculus
tgattcagaaaaatgagccctccgt

SEQ ID NO: 803565 - DNA, 25 bp, Mus musculus
tgattcagaaaattgagccctccgt

SEQ ID NO: 803566 - DNA, 25 bp, Mus musculus
tgattcagcagacagaacagcttag

SEQ ID NO: 803567 - DNA, 25 bp, Mus musculus
tgattcagcagagagaacagcttag

SEQ ID NO: 803568 - DNA, 25 bp, Mus musculus
tgattcaggaatcgtagctcccact

SEQ ID NO: 803569 - DNA, 25 bp, Mus musculus
tgattcaggaatggtagctcccact

SEQ ID NO: 803570 - DNA, 25 bp, Mus musculus
tgattcaggatcaggcccgagaact

SEQ ID NO: 803571 - DNA, 25 bp, Mus musculus
tgattcaggatctggcccgagaact

SEQ ID NO: 803572 - DNA, 25 bp, Mus musculus
tgattcagtgagcaaacctcgagag

SEQ ID NO: 803573 - DNA, 25 bp, Mus musculus
tgattcagtgaggaaacctcgagag

SEQ ID NO: 803574 - DNA, 25 bp, Mus musculus
tgattcatccctcgcctcggaaatg

SEQ ID NO: 803575 - DNA, 25 bp, Mus musculus
tgattcatccctggcctcggaaatg

SEQ ID NO: 803576 - DNA, 25 bp, Mus musculus
tgattcatgacacgaacactgcatc

SEQ ID NO: 803577 - DNA, 25 bp, Mus musculus
tgattcatgacaggaacactgcatc

SEQ ID NO: 803578 - DNA, 25 bp, Mus musculus
tgattccaaggaacactgtggtacc

SEQ ID NO: 803579 - DNA, 25 bp, Mus musculus
tgattccaaggatcactgtggtacc

SEQ ID NO: 803580 - DNA, 25 bp, Mus musculus
tgattccagcaaccagctactaggg

SEQ ID NO: 803581 - DNA, 25 bp, Mus musculus
tgattccagcaagcagctactaggg

SEQ ID NO: 803582 - DNA, 25 bp, Mus musculus
tgattccagtggagccagccgtggt

SEQ ID NO: 803583 - DNA, 25 bp, Mus musculus
tgattccagtggtgccagccgtggt

SEQ ID NO: 803584 - DNA, 25 bp, Mus musculus
tgattcccaacgagtgtgccgcagt

SEQ ID NO: 803585 - DNA, 25 bp, Mus musculus
tgattcccaacgtgtgtgccgcagt

SEQ ID NO: 803586 - DNA, 25 bp, Mus musculus
tgattcccgagcctgagtcttccat

SEQ ID NO: 803587 - DNA, 25 bp, Mus musculus
tgattcccgagcgtgagtcttccat

SEQ ID NO: 803588 - DNA, 25 bp, Mus musculus
tgattcctaatacactggcagtgaa

SEQ ID NO: 803589 - DNA, 25 bp, Mus musculus
tgattcctaatagactggcagtgaa

SEQ ID NO: 803590 - DNA, 25 bp, Mus musculus
tgattcctagctacattcgagactc

SEQ ID NO: 803591 - DNA, 25 bp, Mus musculus
tgattcctagcttcattcgagactc

SEQ ID NO: 803592 - DNA, 25 bp, Mus musculus
tgattcctgcccaccaaggtctgga

SEQ ID NO: 803593 - DNA, 25 bp, Mus musculus
tgattcctgccctccaaggtctgga

SEQ ID NO: 803594 - DNA, 25 bp, Mus musculus
tgattcgagttccttctgaagtggt

SEQ ID NO: 803595 - DNA, 25 bp, Mus musculus
tgattcgagttcgttctgaagtggt

SEQ ID NO: 803596 - DNA, 25 bp, Mus musculus
tgattcggaacccaacagccagcat

SEQ ID NO: 803597 - DNA, 25 bp, Mus musculus
tgattcggaaccgaacagccagcat

SEQ ID NO: 803598 - DNA, 25 bp, Mus musculus
tgattcggctttactcggttcagtc

SEQ ID NO: 803599 - DNA, 25 bp, Mus musculus
tgattcggcttttctcggttcagtc

SEQ ID NO: 803600 - DNA, 25 bp, Mus musculus
tgattctacactcaaagaaagggag

SEQ ID NO: 803601 - DNA, 25 bp, Mus musculus
tgattctacactgaaagaaagggag

SEQ ID NO: 803602 - DNA, 25 bp, Mus musculus
tgattctacagtcaggaggaacgcg

SEQ ID NO: 803603 - DNA, 25 bp, Mus musculus
tgattctacagtgaggaggaacgcg

SEQ ID NO: 803604 - DNA, 25 bp, Mus musculus
tgattctagctgctacagccgcagg

SEQ ID NO: 803605 - DNA, 25 bp, Mus musculus
tgattctagctggtacagccgcagg

SEQ ID NO: 803606 - DNA, 25 bp, Mus musculus
tgattctcagcaccaacttggtgac

SEQ ID NO: 803607 - DNA, 25 bp, Mus musculus
tgattctcagcagcaacttggtgac

SEQ ID NO: 803608 - DNA, 25 bp, Mus musculus
tgattctcaggacgcaaacatctgt

SEQ ID NO: 803609 - DNA, 25 bp, Mus musculus
tgattctcaggaggcaaacatctgt

SEQ ID NO: 803610 - DNA, 25 bp, Mus musculus
tgattctcccagactgcctgtgtag

SEQ ID NO: 803611 - DNA, 25 bp, Mus musculus
tgattctcccagtctgcctgtgtag

SEQ ID NO: 803612 - DNA, 25 bp, Mus musculus
tgattctgaacaaccacattatgga

SEQ ID NO: 803613 - DNA, 25 bp, Mus musculus
tgattctgaacatccacattatgga

SEQ ID NO: 803614 - DNA, 25 bp, Mus musculus
tgattctgcaacctatcccgatgtg

SEQ ID NO: 803615 - DNA, 25 bp, Mus musculus
tgattctgcaacgtatcccgatgtg

SEQ ID NO: 803616 - DNA, 25 bp, Mus musculus
tgattctgctgcagtggagtcacaa

SEQ ID NO: 803617 - DNA, 25 bp, Mus musculus
tgattctgctgcatccaaggccctt

SEQ ID NO: 803618 - DNA, 25 bp, Mus musculus
tgattctgctgctgtggagtcacaa

SEQ ID NO: 803619 - DNA, 25 bp, Mus musculus
tgattctgctgcttccaaggccctt

SEQ ID NO: 803620 - DNA, 25 bp, Mus musculus
tgattctggacacgatagagctgct

SEQ ID NO: 803621 - DNA, 25 bp, Mus musculus
tgattctggacaggatagagctgct

SEQ ID NO: 803622 - DNA, 25 bp, Mus musculus
tgattctgggtcaggagattcgggt

SEQ ID NO: 803623 - DNA, 25 bp, Mus musculus
tgattctgggtctggagattcgggt

SEQ ID NO: 803624 - DNA, 25 bp, Mus musculus
tgattcttgccgactgcatcgcggt

SEQ ID NO: 803625 - DNA, 25 bp, Mus musculus
tgattcttgccgtctgcatcgcggt

SEQ ID NO: 803626 - DNA, 25 bp, Mus musculus
tgattgaacatgcacagaaagagct

SEQ ID NO: 803627 - DNA, 25 bp, Mus musculus
tgattgaacatggacagaaagagct

SEQ ID NO: 803628 - DNA, 25 bp, Mus musculus
tgattgaaggtgaacgagagctgca

SEQ ID NO: 803629 - DNA, 25 bp, Mus musculus
tgattgaaggtgtacgagagctgca

SEQ ID NO: 803630 - DNA, 25 bp, Mus musculus
tgattgacatggctcctgaccccgc

SEQ ID NO: 803631 - DNA, 25 bp, Mus musculus
tgattgacatgggtcctgaccccgc

SEQ ID NO: 803632 - DNA, 25 bp, Mus musculus
tgattgaccccaacatcttgtccct

SEQ ID NO: 803633 - DNA, 25 bp, Mus musculus
tgattgaccccatcatcttgtccct

SEQ ID NO: 803634 - DNA, 25 bp, Mus musculus
tgattgacctggaacgggcctaccc

SEQ ID NO: 803635 - DNA, 25 bp, Mus musculus
tgattgacctggtacgggcctaccc

SEQ ID NO: 803636 - DNA, 25 bp, Mus musculus
tgattgacgcggctccttcttgtgc

SEQ ID NO: 803637 - DNA, 25 bp, Mus musculus
tgattgacgcgggtccttcttgtgc

SEQ ID NO: 803638 - DNA, 25 bp, Mus musculus
tgattgagccacaaagtacgcgcaa

SEQ ID NO: 803639 - DNA, 25 bp, Mus musculus
tgattgagccactaagtacgcgcaa

SEQ ID NO: 803640 - DNA, 25 bp, Mus musculus
tgattgaggctgaccacaacttgga

SEQ ID NO: 803641 - DNA, 25 bp, Mus musculus
tgattgaggctgtccacaacttgga

SEQ ID NO: 803642 - DNA, 25 bp, Mus musculus
tgattgagtcgacagtagccagctc

SEQ ID NO: 803643 - DNA, 25 bp, Mus musculus
tgattgagtcgagagtagccagctc

SEQ ID NO: 803644 - DNA, 25 bp, Mus musculus
tgattgatacagaactgaactcaag

SEQ ID NO: 803645 - DNA, 25 bp, Mus musculus
tgattgatacagtactgaactcaag

SEQ ID NO: 803646 - DNA, 25 bp, Mus musculus
tgattgatgaccacactaccctggg

SEQ ID NO: 803647 - DNA, 25 bp, Mus musculus
tgattgatgacctcactaccctggg

SEQ ID NO: 803648 - DNA, 25 bp, Mus musculus
tgattgatgtgcagacgggcatgct

SEQ ID NO: 803649 - DNA, 25 bp, Mus musculus
tgattgatgtgctgacgggcatgct

SEQ ID NO: 803650 - DNA, 25 bp, Mus musculus
tgattgcaaacaacacgacggtgga

SEQ ID NO: 803651 - DNA, 25 bp, Mus musculus
tgattgcaaacatcacgacggtgga

SEQ ID NO: 803652 - DNA, 25 bp, Mus musculus
tgattgcacagtcccagtctggtac

SEQ ID NO: 803653 - DNA, 25 bp, Mus musculus
tgattgcacagtgccagtctggtac

SEQ ID NO: 803654 - DNA, 25 bp, Mus musculus
tgattgcagatgcagtgaagaaagt

SEQ ID NO: 803655 - DNA, 25 bp, Mus musculus
tgattgcagatggagtgaagaaagt

SEQ ID NO: 803656 - DNA, 25 bp, Mus musculus
tgattgccaaccctaatatacctgc

SEQ ID NO: 803657 - DNA, 25 bp, Mus musculus
tgattgccaaccgtaatatacctgc

SEQ ID NO: 803658 - DNA, 25 bp, Mus musculus
tgattgccccatcagattggttaac

SEQ ID NO: 803659 - DNA, 25 bp, Mus musculus
tgattgccccatgagattggttaac

SEQ ID NO: 803660 - DNA, 25 bp, Mus musculus
tgattgccgagaagtggtgttcgtt

SEQ ID NO: 803661 - DNA, 25 bp, Mus musculus
tgattgccgagatgtggtgttcgtt

SEQ ID NO: 803662 - DNA, 25 bp, Mus musculus
tgattgccttccacatgggttatag

SEQ ID NO: 803663 - DNA, 25 bp, Mus musculus
tgattgccttcctcatgggttatag

SEQ ID NO: 803664 - DNA, 25 bp, Mus musculus
tgattgcgattactaacgacttggg

SEQ ID NO: 803665 - DNA, 25 bp, Mus musculus
tgattgcgattagtaacgacttggg

SEQ ID NO: 803666 - DNA, 25 bp, Mus musculus
tgattgcggtggaattgtgtgacca

SEQ ID NO: 803667 - DNA, 25 bp, Mus musculus
tgattgcggtggtattgtgtgacca

SEQ ID NO: 803668 - DNA, 25 bp, Mus musculus
tgattgctgagtctcatctgaatcc

SEQ ID NO: 803669 - DNA, 25 bp, Mus musculus
tgattgctgagtgtcatctgaatcc

SEQ ID NO: 803670 - DNA, 25 bp, Mus musculus
tgattggaggaaaccccgtgtctgc

SEQ ID NO: 803671 - DNA, 25 bp, Mus musculus
tgattggaggaatccccgtgtctgc

SEQ ID NO: 803672 - DNA, 25 bp, Mus musculus
tgattggcatcacgcagctctctca

SEQ ID NO: 803673 - DNA, 25 bp, Mus musculus
tgattggcatcaggcagctctctca

SEQ ID NO: 803674 - DNA, 25 bp, Mus musculus
tgattggccgcaccctggttatcga

SEQ ID NO: 803675 - DNA, 25 bp, Mus musculus
tgattggccgcagcctggttatcga

SEQ ID NO: 803676 - DNA, 25 bp, Mus musculus
tgattggcctctcacagagcgtccc

SEQ ID NO: 803677 - DNA, 25 bp, Mus musculus
tgattggcctctgacagagcgtccc

SEQ ID NO: 803678 - DNA, 25 bp, Mus musculus
tgattggcgggcacgccttcccttt

SEQ ID NO: 803679 - DNA, 25 bp, Mus musculus
tgattggcgggctcgccttcccttt

SEQ ID NO: 803680 - DNA, 25 bp, Mus musculus
tgattggcgtcccatccaccatgat

SEQ ID NO: 803681 - DNA, 25 bp, Mus musculus
tgattggcgtccgatccaccatgat

SEQ ID NO: 803682 - DNA, 25 bp, Mus musculus
tgattggcgtggaaagaacaagcgc

SEQ ID NO: 803683 - DNA, 25 bp, Mus musculus
tgattggcgtggtaagaacaagcgc

SEQ ID NO: 803684 - DNA, 25 bp, Mus musculus
tgattggctgtgagatcggacgcca

SEQ ID NO: 803685 - DNA, 25 bp, Mus musculus
tgattggctgtgtgatcggacgcca

SEQ ID NO: 803686 - DNA, 25 bp, Mus musculus
tgattggcttgacagatttttcccc

SEQ ID NO: 803687 - DNA, 25 bp, Mus musculus
tgattggcttgagagatttttcccc

SEQ ID NO: 803688 - DNA, 25 bp, Mus musculus
tgattgggagagacaaagcagaagt

SEQ ID NO: 803689 - DNA, 25 bp, Mus musculus
tgattgggagagtcaaagcagaagt

SEQ ID NO: 803690 - DNA, 25 bp, Mus musculus
tgattgggcagaatccacttaggct

SEQ ID NO: 803691 - DNA, 25 bp, Mus musculus
tgattgggcagattccacttaggct

SEQ ID NO: 803692 - DNA, 25 bp, Mus musculus
tgattggtatagacgacgaggacga

SEQ ID NO: 803693 - DNA, 25 bp, Mus musculus
tgattggtatagtcgacgaggacga

SEQ ID NO: 803694 - DNA, 25 bp, Mus musculus
tgattggtcccaagtgcgtgcctga

SEQ ID NO: 803695 - DNA, 25 bp, Mus musculus
tgattggtcccatgtgcgtgcctga

SEQ ID NO: 803696 - DNA, 25 bp, Mus musculus
tgattggtccgcagagtccacggca

SEQ ID NO: 803697 - DNA, 25 bp, Mus musculus
tgattggtccgctgagtccacggca

SEQ ID NO: 803698 - DNA, 25 bp, Mus musculus
tgattggttgctccaccccagacaa

SEQ ID NO: 803699 - DNA, 25 bp, Mus musculus
tgattggttgctgcaccccagacaa

SEQ ID NO: 803700 - DNA, 25 bp, Mus musculus
tgattgtaagtaagtatcgctgagg

SEQ ID NO: 803701 - DNA, 25 bp, Mus musculus
tgattgtaagtatgtatcgctgagg

SEQ ID NO: 803702 - DNA, 25 bp, Mus musculus
tgattgtactcgcacgggctactca

SEQ ID NO: 803703 - DNA, 25 bp, Mus musculus
tgattgtactcggacgggctactca

SEQ ID NO: 803704 - DNA, 25 bp, Mus musculus
tgattgtcactgagtaaacagctga

SEQ ID NO: 803705 - DNA, 25 bp, Mus musculus
tgattgtcactgtgtaaacagctga

SEQ ID NO: 803706 - DNA, 25 bp, Mus musculus
tgattgtccttaccagttcctgaga

SEQ ID NO: 803707 - DNA, 25 bp, Mus musculus
tgattgtccttagcagttcctgaga

SEQ ID NO: 803708 - DNA, 25 bp, Mus musculus
tgattgtcgctgaaggactgctgca

SEQ ID NO: 803709 - DNA, 25 bp, Mus musculus
tgattgtcgctgtaggactgctgca

SEQ ID NO: 803710 - DNA, 25 bp, Mus musculus
tgattgtctcaaccgtggttgtcgt

SEQ ID NO: 803711 - DNA, 25 bp, Mus musculus
tgattgtctcaagcgtggttgtcgt

SEQ ID NO: 803712 - DNA, 25 bp, Mus musculus
tgattgtctcctcccctggggggct

SEQ ID NO: 803713 - DNA, 25 bp, Mus musculus
tgattgtctcctgccctggggggct

SEQ ID NO: 803714 - DNA, 25 bp, Mus musculus
tgattgtctgctcggttctgtggac

SEQ ID NO: 803715 - DNA, 25 bp, Mus musculus
tgattgtctgctgggttctgtggac

SEQ ID NO: 803716 - DNA, 25 bp, Mus musculus
tgattgtgaactatgctccaccctg

SEQ ID NO: 803717 - DNA, 25 bp, Mus musculus
tgattgtgaactttgctccaccctg

SEQ ID NO: 803718 - DNA, 25 bp, Mus musculus
tgattgtgacaaaggagaagatgaa

SEQ ID NO: 803719 - DNA, 25 bp, Mus musculus
tgattgtgacaatggagaagatgaa

SEQ ID NO: 803720 - DNA, 25 bp, Mus musculus
tgattgtgcgccctgggcagccctt

SEQ ID NO: 803721 - DNA, 25 bp, Mus musculus
tgattgtgcgccgtgggcagccctt

SEQ ID NO: 803722 - DNA, 25 bp, Mus musculus
tgattgtggaacagcaggatgagca

SEQ ID NO: 803723 - DNA, 25 bp, Mus musculus
tgattgtggaactgcaggatgagca

SEQ ID NO: 803724 - DNA, 25 bp, Mus musculus
tgattgtggttcactcctggctctc

SEQ ID NO: 803725 - DNA, 25 bp, Mus musculus
tgattgtggttctctcctggctctc

SEQ ID NO: 803726 - DNA, 25 bp, Mus musculus
tgattgtgtatgaaactggccggcc

SEQ ID NO: 803727 - DNA, 25 bp, Mus musculus
tgattgtgtatgtaactggccggcc

SEQ ID NO: 803728 - DNA, 25 bp, Mus musculus
tgattgttacaccttcagtatcctg

SEQ ID NO: 803729 - DNA, 25 bp, Mus musculus
tgattgttacacgttcagtatcctg

SEQ ID NO: 803730 - DNA, 25 bp, Mus musculus
tgattgttttgcagtctgcccgcaa

SEQ ID NO: 803731 - DNA, 25 bp, Mus musculus
tgattgttttgctgtctgcccgcaa

SEQ ID NO: 803732 - DNA, 25 bp, Mus musculus
tgatttaagcagcatagagcaggac

SEQ ID NO: 803733 - DNA, 25 bp, Mus musculus
tgatttaagcaggatagagcaggac

SEQ ID NO: 803734 - DNA, 25 bp, Mus musculus
tgatttacacatccccaggatctcg

SEQ ID NO: 803735 - DNA, 25 bp, Mus musculus
tgatttacacatgcccaggatctcg

SEQ ID NO: 803736 - DNA, 25 bp, Mus musculus
tgatttaccaccctacaaaagatgg

SEQ ID NO: 803737 - DNA, 25 bp, Mus musculus
tgatttaccaccgtacaaaagatgg

SEQ ID NO: 803738 - DNA, 25 bp, Mus musculus
tgatttaccgggaccgacgcaccga

SEQ ID NO: 803739 - DNA, 25 bp, Mus musculus
tgatttaccgggtccgacgcaccga

SEQ ID NO: 803740 - DNA, 25 bp, Mus musculus
tgatttagagaccatccggctgtca

SEQ ID NO: 803741 - DNA, 25 bp, Mus musculus
tgatttagagacgatccggctgtca

SEQ ID NO: 803742 - DNA, 25 bp, Mus musculus
tgatttaggaatccagctggagaga

SEQ ID NO: 803743 - DNA, 25 bp, Mus musculus
tgatttaggaatgcagctggagaga

SEQ ID NO: 803744 - DNA, 25 bp, Mus musculus
tgatttcaatgcactagacaactcg

SEQ ID NO: 803745 - DNA, 25 bp, Mus musculus
tgatttcaatgctctagacaactcg

SEQ ID NO: 803746 - DNA, 25 bp, Mus musculus
tgatttcaccaaccctgagaccctt

SEQ ID NO: 803747 - DNA, 25 bp, Mus musculus
tgatttcaccaagcctgagaccctt

SEQ ID NO: 803748 - DNA, 25 bp, Mus musculus
tgatttcagttgagggcagtcggca

SEQ ID NO: 803749 - DNA, 25 bp, Mus musculus
tgatttcagttgtgggcagtcggca

SEQ ID NO: 803750 - DNA, 25 bp, Mus musculus
tgatttcattccctcgcagccagaa

SEQ ID NO: 803751 - DNA, 25 bp, Mus musculus
tgatttcattccgtcgcagccagaa

SEQ ID NO: 803752 - DNA, 25 bp, Mus musculus
tgatttcattgacagctgcttgcga

SEQ ID NO: 803753 - DNA, 25 bp, Mus musculus
tgatttcattgagagctgcttgcga

SEQ ID NO: 803754 - DNA, 25 bp, Mus musculus
tgatttccacagaggagcacaactt

SEQ ID NO: 803755 - DNA, 25 bp, Mus musculus
tgatttccacagtggagcacaactt

SEQ ID NO: 803756 - DNA, 25 bp, Mus musculus
tgatttcccagcacgtagtatcttg

SEQ ID NO: 803757 - DNA, 25 bp, Mus musculus
tgatttcccagctcgtagtatcttg

SEQ ID NO: 803758 - DNA, 25 bp, Mus musculus
tgatttcccggaccttagggcctga

SEQ ID NO: 803759 - DNA, 25 bp, Mus musculus
tgatttcccggagcttagggcctga

SEQ ID NO: 803760 - DNA, 25 bp, Mus musculus
tgatttccgaaacgtcttagacagt

SEQ ID NO: 803761 - DNA, 25 bp, Mus musculus
tgatttccgaaaggtcttagacagt

SEQ ID NO: 803762 - DNA, 25 bp, Mus musculus
tgatttccgagcactacactggctg

SEQ ID NO: 803763 - DNA, 25 bp, Mus musculus
tgatttccgagctctacactggctg

SEQ ID NO: 803764 - DNA, 25 bp, Mus musculus
tgatttccgatgcttcaaggacaga

SEQ ID NO: 803765 - DNA, 25 bp, Mus musculus
tgatttccgatggttcaaggacaga

SEQ ID NO: 803766 - DNA, 25 bp, Mus musculus
tgatttcctactacctgcgctccag

SEQ ID NO: 803767 - DNA, 25 bp, Mus musculus
tgatttcctacttcctgcgctccag

SEQ ID NO: 803768 - DNA, 25 bp, Mus musculus
tgatttcctcccagtgctgtccaga

SEQ ID NO: 803769 - DNA, 25 bp, Mus musculus
tgatttcctccctgtgctgtccaga

SEQ ID NO: 803770 - DNA, 25 bp, Mus musculus
tgatttcctggaactggtaacatgg

SEQ ID NO: 803771 - DNA, 25 bp, Mus musculus
tgatttcctggatctggtaacatgg

SEQ ID NO: 803772 - DNA, 25 bp, Mus musculus
tgatttcgcatgctgtactgtgggc

SEQ ID NO: 803773 - DNA, 25 bp, Mus musculus
tgatttcgcatggtgtactgtgggc

SEQ ID NO: 803774 - DNA, 25 bp, Mus musculus
tgatttcgccacagcggctgctgag

SEQ ID NO: 803775 - DNA, 25 bp, Mus musculus
tgatttcgccactgcggctgctgag

SEQ ID NO: 803776 - DNA, 25 bp, Mus musculus
tgatttcgggtccagtgagcgcctc

SEQ ID NO: 803777 - DNA, 25 bp, Mus musculus
tgatttcgggtcgagtgagcgcctc

SEQ ID NO: 803778 - DNA, 25 bp, Mus musculus
tgatttctctacctcgggccaatgg

SEQ ID NO: 803779 - DNA, 25 bp, Mus musculus
tgatttctctacgtcgggccaatgg

SEQ ID NO: 803780 - DNA, 25 bp, Mus musculus
tgatttctggttcggtcaccaggaa

SEQ ID NO: 803781 - DNA, 25 bp, Mus musculus
tgatttctggttgggtcaccaggaa

SEQ ID NO: 803782 - DNA, 25 bp, Mus musculus
tgatttctgtaactcaacggcaaac

SEQ ID NO: 803783 - DNA, 25 bp, Mus musculus
tgatttctgtaagtcaacggcaaac

SEQ ID NO: 803784 - DNA, 25 bp, Mus musculus
tgatttctgtcacggcaccaaggcg

SEQ ID NO: 803785 - DNA, 25 bp, Mus musculus
tgatttctgtcagggcaccaaggcg

SEQ ID NO: 803786 - DNA, 25 bp, Mus musculus
tgatttctttcaccacctgggccaa

SEQ ID NO: 803787 - DNA, 25 bp, Mus musculus
tgatttctttcagcacctgggccaa

SEQ ID NO: 803788 - DNA, 25 bp, Mus musculus
tgatttgcactaagagcctataggc

SEQ ID NO: 803789 - DNA, 25 bp, Mus musculus
tgatttgcactatgagcctataggc

SEQ ID NO: 803790 - DNA, 25 bp, Mus musculus
tgatttgcagaacagtcagttacca

SEQ ID NO: 803791 - DNA, 25 bp, Mus musculus
tgatttgcagaagagtcagttacca

SEQ ID NO: 803792 - DNA, 25 bp, Mus musculus
tgatttgcatacagagtcaccaacg

SEQ ID NO: 803793 - DNA, 25 bp, Mus musculus
tgatttgcatactgagtcaccaacg

SEQ ID NO: 803794 - DNA, 25 bp, Mus musculus
tgatttgccacaactgaggaacaaa

SEQ ID NO: 803795 - DNA, 25 bp, Mus musculus
tgatttgccacatctgaggaacaaa

SEQ ID NO: 803796 - DNA, 25 bp, Mus musculus
tgatttgccccaatcagaagcaggg

SEQ ID NO: 803797 - DNA, 25 bp, Mus musculus
tgatttgccccattcagaagcaggg

SEQ ID NO: 803798 - DNA, 25 bp, Mus musculus
tgatttgcttgaacacacgtgccag

SEQ ID NO: 803799 - DNA, 25 bp, Mus musculus
tgatttgcttgatcacacgtgccag

SEQ ID NO: 803800 - DNA, 25 bp, Mus musculus
tgatttggccaaagaagacacccca

SEQ ID NO: 803801 - DNA, 25 bp, Mus musculus
tgatttggccaaattctagttgttg

SEQ ID NO: 803802 - DNA, 25 bp, Mus musculus
tgatttggccaatgaagacacccca

SEQ ID NO: 803803 - DNA, 25 bp, Mus musculus
tgatttggccaatttctagttgttg

SEQ ID NO: 803804 - DNA, 25 bp, Mus musculus
tgatttggctgaattcatcacagct

SEQ ID NO: 803805 - DNA, 25 bp, Mus musculus
tgatttggctgatttcatcacagct

SEQ ID NO: 803806 - DNA, 25 bp, Mus musculus
tgatttggttcacaggtacactggg

SEQ ID NO: 803807 - DNA, 25 bp, Mus musculus
tgatttggttcagaggtacactggg

SEQ ID NO: 803808 - DNA, 25 bp, Mus musculus
tgatttgtgtaacttaatggctgcc

SEQ ID NO: 803809 - DNA, 25 bp, Mus musculus
tgatttgtgtaagttaatggctgcc

SEQ ID NO: 803810 - DNA, 25 bp, Mus musculus
tgatttgttttccatttcccattga

SEQ ID NO: 803811 - DNA, 25 bp, Mus musculus
tgatttgttttcgatttcccattga

SEQ ID NO: 803812 - DNA, 25 bp, Mus musculus
tgattttagatgaagctacagccgc

SEQ ID NO: 803813 - DNA, 25 bp, Mus musculus
tgattttagatgtagctacagccgc

SEQ ID NO: 803814 - DNA, 25 bp, Mus musculus
tgattttcccagacagcgactggaa

SEQ ID NO: 803815 - DNA, 25 bp, Mus musculus
tgattttcccagtcagcgactggaa

SEQ ID NO: 803816 - DNA, 25 bp, Mus musculus
tgattttccgcacatggtttccaca

SEQ ID NO: 803817 - DNA, 25 bp, Mus musculus
tgattttccgcagatggtttccaca

SEQ ID NO: 803818 - DNA, 25 bp, Mus musculus
tgattttctcccctttgagcccagg

SEQ ID NO: 803819 - DNA, 25 bp, Mus musculus
tgattttctcccgtttgagcccagg

SEQ ID NO: 803820 - DNA, 25 bp, Mus musculus
tgattttctgaccttcctgaggaag

SEQ ID NO: 803821 - DNA, 25 bp, Mus musculus
tgattttctgacgttcctgaggaag

SEQ ID NO: 803822 - DNA, 25 bp, Mus musculus
tgattttgaccgagagatcctcccc

SEQ ID NO: 803823 - DNA, 25 bp, Mus musculus
tgattttgaccgtgagatcctcccc

SEQ ID NO: 803824 - DNA, 25 bp, Mus musculus
tgattttgccatagctctccactgt

SEQ ID NO: 803825 - DNA, 25 bp, Mus musculus
tgattttgccattgctctccactgt

SEQ ID NO: 803826 - DNA, 25 bp, Mus musculus
tgattttgctttcctgtccagtctg

SEQ ID NO: 803827 - DNA, 25 bp, Mus musculus
tgattttgctttgctgtccagtctg

SEQ ID NO: 803828 - DNA, 25 bp, Mus musculus
tgattttggcacagatggatgacgc

SEQ ID NO: 803829 - DNA, 25 bp, Mus musculus
tgattttggcactgatggatgacgc

SEQ ID NO: 803830 - DNA, 25 bp, Mus musculus
tgattttggtctcgtcagatgagcg

SEQ ID NO: 803831 - DNA, 25 bp, Mus musculus
tgattttggtctctgcatcccggga

SEQ ID NO: 803832 - DNA, 25 bp, Mus musculus
tgattttggtctggtcagatgagcg

SEQ ID NO: 803833 - DNA, 25 bp, Mus musculus
tgattttggtctgtgcatcccggga

SEQ ID NO: 803834 - DNA, 25 bp, Mus musculus
tgatttttaaccatggcggcgttgg

SEQ ID NO: 803835 - DNA, 25 bp, Mus musculus
tgatttttaaccttggcggcgttgg

SEQ ID NO: 803836 - DNA, 25 bp, Mus musculus
tgatttttacagaagtttccctgcc

SEQ ID NO: 803837 - DNA, 25 bp, Mus musculus
tgatttttacagtagtttccctgcc

SEQ ID NO: 803838 - DNA, 25 bp, Mus musculus
tgatttttctctcaaaagcaatagc

SEQ ID NO: 803839 - DNA, 25 bp, Mus musculus
tgatttttctctgaaaagcaatagc

SEQ ID NO: 803840 - DNA, 25 bp, Mus musculus
tgcaaaaaatctacgcccgggaaat

SEQ ID NO: 803841 - DNA, 25 bp, Mus musculus
tgcaaaaaatcttcgcccgggaaat

SEQ ID NO: 803842 - DNA, 25 bp, Mus musculus
tgcaaaaacaccctaggctcctaca

SEQ ID NO: 803843 - DNA, 25 bp, Mus musculus
tgcaaaaacaccctgggcagttttg

SEQ ID NO: 803844 - DNA, 25 bp, Mus musculus
tgcaaaaacaccgtaggctcctaca

SEQ ID NO: 803845 - DNA, 25 bp, Mus musculus
tgcaaaaacaccgtgggcagttttg

SEQ ID NO: 803846 - DNA, 25 bp, Mus musculus
tgcaaaaacggccagtgtgttccta

SEQ ID NO: 803847 - DNA, 25 bp, Mus musculus
tgcaaaaacggcgagtgtgttccta

SEQ ID NO: 803848 - DNA, 25 bp, Mus musculus
tgcaaaaagggtacggcttgggctc

SEQ ID NO: 803849 - DNA, 25 bp, Mus musculus
tgcaaaaagggttcggcttgggctc

SEQ ID NO: 803850 - DNA, 25 bp, Mus musculus
tgcaaaaaggtgacctgtcccatca

SEQ ID NO: 803851 - DNA, 25 bp, Mus musculus
tgcaaaaaggtgtcctgtcccatca

SEQ ID NO: 803852 - DNA, 25 bp, Mus musculus
tgcaaaaatcagcagaggctacccg

SEQ ID NO: 803853 - DNA, 25 bp, Mus musculus
tgcaaaaatcaggagaggctacccg

SEQ ID NO: 803854 - DNA, 25 bp, Mus musculus
tgcaaaacatgtctcaatccataga

SEQ ID NO: 803855 - DNA, 25 bp, Mus musculus
tgcaaaacatgtgtcaatccataga

SEQ ID NO: 803856 - DNA, 25 bp, Mus musculus
tgcaaaaccaaaccggagctgatct

SEQ ID NO: 803857 - DNA, 25 bp, Mus musculus
tgcaaaaccaaagcggagctgatct

SEQ ID NO: 803858 - DNA, 25 bp, Mus musculus
tgcaaaaccgtcattccttgaatac

SEQ ID NO: 803859 - DNA, 25 bp, Mus musculus
tgcaaaaccgtctttccttgaatac

SEQ ID NO: 803860 - DNA, 25 bp, Mus musculus
tgcaaaacgcttctccggttgcacc

SEQ ID NO: 803861 - DNA, 25 bp, Mus musculus
tgcaaaacgcttgtccggttgcacc

SEQ ID NO: 803862 - DNA, 25 bp, Mus musculus
tgcaaaacggtcacagaggatggtc

SEQ ID NO: 803863 - DNA, 25 bp, Mus musculus
tgcaaaacggtctcagaggatggtc

SEQ ID NO: 803864 - DNA, 25 bp, Mus musculus
tgcaaaacgtccaaagccagcatct

SEQ ID NO: 803865 - DNA, 25 bp, Mus musculus
tgcaaaacgtcctaagccagcatct

SEQ ID NO: 803866 - DNA, 25 bp, Mus musculus
tgcaaaactttcagaattggttagg

SEQ ID NO: 803867 - DNA, 25 bp, Mus musculus
tgcaaaactttctgaattggttagg

SEQ ID NO: 803868 - DNA, 25 bp, Mus musculus
tgcaaaagagaaacgcgtacctcag

SEQ ID NO: 803869 - DNA, 25 bp, Mus musculus
tgcaaaagagaatcgcgtacctcag

SEQ ID NO: 803870 - DNA, 25 bp, Mus musculus
tgcaaaagctacaagagcgcctgga

SEQ ID NO: 803871 - DNA, 25 bp, Mus musculus
tgcaaaagctactagagcgcctgga

SEQ ID NO: 803872 - DNA, 25 bp, Mus musculus
tgcaaaagctcgctcggcttctcgt

SEQ ID NO: 803873 - DNA, 25 bp, Mus musculus
tgcaaaagctcggtcggcttctcgt

SEQ ID NO: 803874 - DNA, 25 bp, Mus musculus
tgcaaaaggcccaatgatggatccc

SEQ ID NO: 803875 - DNA, 25 bp, Mus musculus
tgcaaaaggccctatgatggatccc

SEQ ID NO: 803876 - DNA, 25 bp, Mus musculus
tgcaaaagggaaagcatctttgtaa

SEQ ID NO: 803877 - DNA, 25 bp, Mus musculus
tgcaaaagggaatgcatctttgtaa

SEQ ID NO: 803878 - DNA, 25 bp, Mus musculus
tgcaaaagtgtgagattgcgctgga

SEQ ID NO: 803879 - DNA, 25 bp, Mus musculus
tgcaaaagtgtgtgattgcgctgga

SEQ ID NO: 803880 - DNA, 25 bp, Mus musculus
tgcaaaagttgtacctatgaaagcc

SEQ ID NO: 803881 - DNA, 25 bp, Mus musculus
tgcaaaagttgttcctatgaaagcc

SEQ ID NO: 803882 - DNA, 25 bp, Mus musculus
tgcaaaatccatcggatagaaaagt

SEQ ID NO: 803883 - DNA, 25 bp, Mus musculus
tgcaaaatccatgggatagaaaagt

SEQ ID NO: 803884 - DNA, 25 bp, Mus musculus
tgcaaaatctacaccctgaaggcaa

SEQ ID NO: 803885 - DNA, 25 bp, Mus musculus
tgcaaaatctactccctgaaggcaa

SEQ ID NO: 803886 - DNA, 25 bp, Mus musculus
tgcaaaatggttcccgagtcatgtt

SEQ ID NO: 803887 - DNA, 25 bp, Mus musculus
tgcaaaatggttgccgagtcatgtt

SEQ ID NO: 803888 - DNA, 25 bp, Mus musculus
tgcaaaatttgtcggcttctggaaa

SEQ ID NO: 803889 - DNA, 25 bp, Mus musculus
tgcaaaatttgtgggcttctggaaa

SEQ ID NO: 803890 - DNA, 25 bp, Mus musculus
tgcaaacacacaagaacagtcagcc

SEQ ID NO: 803891 - DNA, 25 bp, Mus musculus
tgcaaacacacatgaacagtcagcc

SEQ ID NO: 803892 - DNA, 25 bp, Mus musculus
tgcaaacagcaaaggctcaagtggc

SEQ ID NO: 803893 - DNA, 25 bp, Mus musculus
tgcaaacagcaaccgaggagcattg

SEQ ID NO: 803894 - DNA, 25 bp, Mus musculus
tgcaaacagcaagcgaggagcattg

SEQ ID NO: 803895 - DNA, 25 bp, Mus musculus
tgcaaacagcaatggctcaagtggc

SEQ ID NO: 803896 - DNA, 25 bp, Mus musculus
tgcaaacagctgagtcgggaacctg

SEQ ID NO: 803897 - DNA, 25 bp, Mus musculus
tgcaaacagctgtgtcgggaacctg

SEQ ID NO: 803898 - DNA, 25 bp, Mus musculus
tgcaaacagtagaccccttcaaagc

SEQ ID NO: 803899 - DNA, 25 bp, Mus musculus
tgcaaacagtagtccccttcaaagc

SEQ ID NO: 803900 - DNA, 25 bp, Mus musculus
tgcaaacagttgaatgaaacaacag

SEQ ID NO: 803901 - DNA, 25 bp, Mus musculus
tgcaaacagttgtatgaaacaacag

SEQ ID NO: 803902 - DNA, 25 bp, Mus musculus
tgcaaacatgtcaaaagactacaat

SEQ ID NO: 803903 - DNA, 25 bp, Mus musculus
tgcaaacatgtctaaagactacaat

SEQ ID NO: 803904 - DNA, 25 bp, Mus musculus
tgcaaaccaacaaatccggctcggg

SEQ ID NO: 803905 - DNA, 25 bp, Mus musculus
tgcaaaccaacatatccggctcggg

SEQ ID NO: 803906 - DNA, 25 bp, Mus musculus
tgcaaacccacaaggaacgggcggt

SEQ ID NO: 803907 - DNA, 25 bp, Mus musculus
tgcaaacccacatggaacgggcggt

SEQ ID NO: 803908 - DNA, 25 bp, Mus musculus
tgcaaaccctgaactgggctacggg

SEQ ID NO: 803909 - DNA, 25 bp, Mus musculus
tgcaaaccctgatctgggctacggg

SEQ ID NO: 803910 - DNA, 25 bp, Mus musculus
tgcaaaccctttagcctgggctgca

SEQ ID NO: 803911 - DNA, 25 bp, Mus musculus
tgcaaacccttttgcctgggctgca

SEQ ID NO: 803912 - DNA, 25 bp, Mus musculus
tgcaaacctatgatccacgtgggtg

SEQ ID NO: 803913 - DNA, 25 bp, Mus musculus
tgcaaacctatgttccacgtgggtg

SEQ ID NO: 803914 - DNA, 25 bp, Mus musculus
tgcaaacgcacccagggtgtgtcca

SEQ ID NO: 803915 - DNA, 25 bp, Mus musculus
tgcaaacgcaccgagggtgtgtcca

SEQ ID NO: 803916 - DNA, 25 bp, Mus musculus
tgcaaacggcacattatccaagaca

SEQ ID NO: 803917 - DNA, 25 bp, Mus musculus
tgcaaacggcactttatccaagaca

SEQ ID NO: 803918 - DNA, 25 bp, Mus musculus
tgcaaacgtcttcactctccatgct

SEQ ID NO: 803919 - DNA, 25 bp, Mus musculus
tgcaaacgtcttgactctccatgct

SEQ ID NO: 803920 - DNA, 25 bp, Mus musculus
tgcaaacgtgagcatggttcatata

SEQ ID NO: 803921 - DNA, 25 bp, Mus musculus
tgcaaacgtgaggatggttcatata

SEQ ID NO: 803922 - DNA, 25 bp, Mus musculus
tgcaaacgtggtcaagaacatctcc

SEQ ID NO: 803923 - DNA, 25 bp, Mus musculus
tgcaaacgtggtgaagaacatctcc

SEQ ID NO: 803924 - DNA, 25 bp, Mus musculus
tgcaaactcagcagtcctgaaatgg

SEQ ID NO: 803925 - DNA, 25 bp, Mus musculus
tgcaaactcagctgtcctgaaatgg

SEQ ID NO: 803926 - DNA, 25 bp, Mus musculus
tgcaaactccagactgtggttatct

SEQ ID NO: 803927 - DNA, 25 bp, Mus musculus
tgcaaactccagtctgtggttatct

SEQ ID NO: 803928 - DNA, 25 bp, Mus musculus
tgcaaactcgtactgctgatgaacc

SEQ ID NO: 803929 - DNA, 25 bp, Mus musculus
tgcaaactcgtagtgctgatgaacc

SEQ ID NO: 803930 - DNA, 25 bp, Mus musculus
tgcaaacttgccagcctctacaggc

SEQ ID NO: 803931 - DNA, 25 bp, Mus musculus
tgcaaacttgcctgcctctacaggc

SEQ ID NO: 803932 - DNA, 25 bp, Mus musculus
tgcaaacttggacttgaacgaccaa

SEQ ID NO: 803933 - DNA, 25 bp, Mus musculus
tgcaaacttggagttgaacgaccaa

SEQ ID NO: 803934 - DNA, 25 bp, Mus musculus
tgcaaactttaaccgctggcgccag

SEQ ID NO: 803935 - DNA, 25 bp, Mus musculus
tgcaaactttaagcgctggcgccag

SEQ ID NO: 803936 - DNA, 25 bp, Mus musculus
tgcaaactttggagggaacccggat

SEQ ID NO: 803937 - DNA, 25 bp, Mus musculus
tgcaaactttggtgggaacccggat

SEQ ID NO: 803938 - DNA, 25 bp, Mus musculus
tgcaaagaacagaaacctagccagc

SEQ ID NO: 803939 - DNA, 25 bp, Mus musculus
tgcaaagaacagtaacctagccagc

SEQ ID NO: 803940 - DNA, 25 bp, Mus musculus
tgcaaagaagcacactacattgccg

SEQ ID NO: 803941 - DNA, 25 bp, Mus musculus
tgcaaagaagcagactacattgccg

SEQ ID NO: 803942 - DNA, 25 bp, Mus musculus
tgcaaagaagggacctaacccgctc

SEQ ID NO: 803943 - DNA, 25 bp, Mus musculus
tgcaaagaagggtcctaacccgctc

SEQ ID NO: 803944 - DNA, 25 bp, Mus musculus
tgcaaagaatccagatggcccctgg

SEQ ID NO: 803945 - DNA, 25 bp, Mus musculus
tgcaaagaatcctgatggcccctgg

SEQ ID NO: 803946 - DNA, 25 bp, Mus musculus
tgcaaagacgaaagcacttgaagtt

SEQ ID NO: 803947 - DNA, 25 bp, Mus musculus
tgcaaagacgaatgcacttgaagtt

SEQ ID NO: 803948 - DNA, 25 bp, Mus musculus
tgcaaagagaagacctctcaagacc

SEQ ID NO: 803949 - DNA, 25 bp, Mus musculus
tgcaaagagaagtcctctcaagacc

SEQ ID NO: 803950 - DNA, 25 bp, Mus musculus
tgcaaagagtccagggaagaggcca

SEQ ID NO: 803951 - DNA, 25 bp, Mus musculus
tgcaaagagtcctgggaagaggcca

SEQ ID NO: 803952 - DNA, 25 bp, Mus musculus
tgcaaagatcaacagacgggctgat

SEQ ID NO: 803953 - DNA, 25 bp, Mus musculus
tgcaaagatcaagagacgggctgat

SEQ ID NO: 803954 - DNA, 25 bp, Mus musculus
tgcaaagatccaagccagtggtgcc

SEQ ID NO: 803955 - DNA, 25 bp, Mus musculus
tgcaaagatccatgccagtggtgcc

SEQ ID NO: 803956 - DNA, 25 bp, Mus musculus
tgcaaagatgctctgcgaccagtat

SEQ ID NO: 803957 - DNA, 25 bp, Mus musculus
tgcaaagatgctgtgcgaccagtat

SEQ ID NO: 803958 - DNA, 25 bp, Mus musculus
tgcaaagcctacacgttagaggaag

SEQ ID NO: 803959 - DNA, 25 bp, Mus musculus
tgcaaagcctactcgttagaggaag

SEQ ID NO: 803960 - DNA, 25 bp, Mus musculus
tgcaaagcctggacaaagatattgt

SEQ ID NO: 803961 - DNA, 25 bp, Mus musculus
tgcaaagcctggtcaaagatattgt

SEQ ID NO: 803962 - DNA, 25 bp, Mus musculus
tgcaaagcctgtctgaaggattact

SEQ ID NO: 803963 - DNA, 25 bp, Mus musculus
tgcaaagcctgtgtgaaggattact

SEQ ID NO: 803964 - DNA, 25 bp, Mus musculus
tgcaaagcctttcgaagccgtgaag

SEQ ID NO: 803965 - DNA, 25 bp, Mus musculus
tgcaaagcctttggaagccgtgaag

SEQ ID NO: 803966 - DNA, 25 bp, Mus musculus
tgcaaagcgctcctgggcacctaca

SEQ ID NO: 803967 - DNA, 25 bp, Mus musculus
tgcaaagcgctcgtgggcacctaca

SEQ ID NO: 803968 - DNA, 25 bp, Mus musculus
tgcaaagctttgcacacgagggact

SEQ ID NO: 803969 - DNA, 25 bp, Mus musculus
tgcaaagctttggacacgagggact

SEQ ID NO: 803970 - DNA, 25 bp, Mus musculus
tgcaaaggagttcaaccctcgttct

SEQ ID NO: 803971 - DNA, 25 bp, Mus musculus
tgcaaaggagttgaaccctcgttct

SEQ ID NO: 803972 - DNA, 25 bp, Mus musculus
tgcaaaggatatcttaaagatgaca

SEQ ID NO: 803973 - DNA, 25 bp, Mus musculus
tgcaaaggatatgttaaagatgaca

SEQ ID NO: 803974 - DNA, 25 bp, Mus musculus
tgcaaaggcagaacgaggtaaggct

SEQ ID NO: 803975 - DNA, 25 bp, Mus musculus
tgcaaaggcagatcgaggtaaggct

SEQ ID NO: 803976 - DNA, 25 bp, Mus musculus
tgcaaagtaaatatcacaaagagac

SEQ ID NO: 803977 - DNA, 25 bp, Mus musculus
tgcaaagtaaatttcacaaagagac

SEQ ID NO: 803978 - DNA, 25 bp, Mus musculus
tgcaaagttgagactcctatgggac

SEQ ID NO: 803979 - DNA, 25 bp, Mus musculus
tgcaaagttgagtctcctatgggac

SEQ ID NO: 803980 - DNA, 25 bp, Mus musculus
tgcaaatacagacctgagcatttct

SEQ ID NO: 803981 - DNA, 25 bp, Mus musculus
tgcaaatacagagctgagcatttct

SEQ ID NO: 803982 - DNA, 25 bp, Mus musculus
tgcaaatacttaacgtctggaccct

SEQ ID NO: 803983 - DNA, 25 bp, Mus musculus
tgcaaatacttatcgtctggaccct

SEQ ID NO: 803984 - DNA, 25 bp, Mus musculus
tgcaaatagggaaacctgggcatct

SEQ ID NO: 803985 - DNA, 25 bp, Mus musculus
tgcaaatagggatacctgggcatct

SEQ ID NO: 803986 - DNA, 25 bp, Mus musculus
tgcaaatataaaagcccagacagaa

SEQ ID NO: 803987 - DNA, 25 bp, Mus musculus
tgcaaatataaatgcccagacagaa

SEQ ID NO: 803988 - DNA, 25 bp, Mus musculus
tgcaaatcaggacgctcagcgtgtg

SEQ ID NO: 803989 - DNA, 25 bp, Mus musculus
tgcaaatcaggaggctcagcgtgtg

SEQ ID NO: 803990 - DNA, 25 bp, Mus musculus
tgcaaatctaacatcatggcctcgc

SEQ ID NO: 803991 - DNA, 25 bp, Mus musculus
tgcaaatctaacttcatggcctcgc

SEQ ID NO: 803992 - DNA, 25 bp, Mus musculus
tgcaaatgagaacagcaatatacag

SEQ ID NO: 803993 - DNA, 25 bp, Mus musculus
tgcaaatgagaagagcaatatacag

SEQ ID NO: 803994 - DNA, 25 bp, Mus musculus
tgcaaatgcaagatcagacagaaac

SEQ ID NO: 803995 - DNA, 25 bp, Mus musculus
tgcaaatgcaagttcagacagaaac

SEQ ID NO: 803996 - DNA, 25 bp, Mus musculus
tgcaaatgcatcagtccgcgctaca

SEQ ID NO: 803997 - DNA, 25 bp, Mus musculus
tgcaaatgcatctgtccgcgctaca

SEQ ID NO: 803998 - DNA, 25 bp, Mus musculus
tgcaaatgcctccacggtggtcgga

SEQ ID NO: 803999 - DNA, 25 bp, Mus musculus
tgcaaatgcctcgacggtggtcgga

SEQ ID NO: 804000 - DNA, 25 bp, Mus musculus
tgcaaatggacgctccacaggcctg

SEQ ID NO: 804001 - DNA, 25 bp, Mus musculus
tgcaaatggacggtccacaggcctg

SEQ ID NO: 804002 - DNA, 25 bp, Mus musculus
tgcaaatgggaacaagatcagcatc

SEQ ID NO: 804003 - DNA, 25 bp, Mus musculus
tgcaaatgggaagaagatcagcatc

SEQ ID NO: 804004 - DNA, 25 bp, Mus musculus
tgcaaatgttccaggatcctattcc

SEQ ID NO: 804005 - DNA, 25 bp, Mus musculus
tgcaaatgttcctggatcctattcc

SEQ ID NO: 804006 - DNA, 25 bp, Mus musculus
tgcaaattccagcaagcccggaagc

SEQ ID NO: 804007 - DNA, 25 bp, Mus musculus
tgcaaattccaggaagcccggaagc

SEQ ID NO: 804008 - DNA, 25 bp, Mus musculus
tgcaaattctacagggaagacagcc

SEQ ID NO: 804009 - DNA, 25 bp, Mus musculus
tgcaaattctactgggaagacagcc

SEQ ID NO: 804010 - DNA, 25 bp, Mus musculus
tgcaaattgggccataggcacccct

SEQ ID NO: 804011 - DNA, 25 bp, Mus musculus
tgcaaattgggcgataggcacccct

SEQ ID NO: 804012 - DNA, 25 bp, Mus musculus
tgcaacaaacaacattgagattagc

SEQ ID NO: 804013 - DNA, 25 bp, Mus musculus
tgcaacaaacaagattgagattagc

SEQ ID NO: 804014 - DNA, 25 bp, Mus musculus
tgcaacaaacacacgtagccagctg

SEQ ID NO: 804015 - DNA, 25 bp, Mus musculus
tgcaacaaacactcgtagccagctg

SEQ ID NO: 804016 - DNA, 25 bp, Mus musculus
tgcaacaaaggccacaagaagctac

SEQ ID NO: 804017 - DNA, 25 bp, Mus musculus
tgcaacaaaggcgacaagaagctac

SEQ ID NO: 804018 - DNA, 25 bp, Mus musculus
tgcaacaactgcatgtaagatcatc

SEQ ID NO: 804019 - DNA, 25 bp, Mus musculus
tgcaacaactgcttgtaagatcatc

SEQ ID NO: 804020 - DNA, 25 bp, Mus musculus
tgcaacaagaataagggtggcctgg

SEQ ID NO: 804021 - DNA, 25 bp, Mus musculus
tgcaacaagaattagggtggcctgg

SEQ ID NO: 804022 - DNA, 25 bp, Mus musculus
tgcaacaaggagacgcgcctttgcc

SEQ ID NO: 804023 - DNA, 25 bp, Mus musculus
tgcaacaaggagtcgcgcctttgcc

SEQ ID NO: 804024 - DNA, 25 bp, Mus musculus
tgcaacaaggatcactagaatgggc

SEQ ID NO: 804025 - DNA, 25 bp, Mus musculus
tgcaacaaggatgactagaatgggc

SEQ ID NO: 804026 - DNA, 25 bp, Mus musculus
tgcaacaagttcatgactggccaga

SEQ ID NO: 804027 - DNA, 25 bp, Mus musculus
tgcaacaagttcttgactggccaga

SEQ ID NO: 804028 - DNA, 25 bp, Mus musculus
tgcaacaattccagtgtataaaatg

SEQ ID NO: 804029 - DNA, 25 bp, Mus musculus
tgcaacaattcctgtgtataaaatg

SEQ ID NO: 804030 - DNA, 25 bp, Mus musculus
tgcaacaatttcacatatgtggtga

SEQ ID NO: 804031 - DNA, 25 bp, Mus musculus
tgcaacaatttctcatatgtggtga

SEQ ID NO: 804032 - DNA, 25 bp, Mus musculus
tgcaacacctggctcgtgtggcccg

SEQ ID NO: 804033 - DNA, 25 bp, Mus musculus
tgcaacacctgggtcgtgtggcccg

SEQ ID NO: 804034 - DNA, 25 bp, Mus musculus
tgcaacagatccctacaaccagaga

SEQ ID NO: 804035 - DNA, 25 bp, Mus musculus
tgcaacagatccgtacaaccagaga

SEQ ID NO: 804036 - DNA, 25 bp, Mus musculus
tgcaacaggacaataggagtcttcc

SEQ ID NO: 804037 - DNA, 25 bp, Mus musculus
tgcaacaggacattaggagtcttcc

SEQ ID NO: 804038 - DNA, 25 bp, Mus musculus
tgcaacaggtgaaggagagccacat

SEQ ID NO: 804039 - DNA, 25 bp, Mus musculus
tgcaacaggtgatggagagccacat

SEQ ID NO: 804040 - DNA, 25 bp, Mus musculus
tgcaacagttggcaaaaatggcact

SEQ ID NO: 804041 - DNA, 25 bp, Mus musculus
tgcaacagttgggaaaaatggcact

SEQ ID NO: 804042 - DNA, 25 bp, Mus musculus
tgcaacatcagccatgcaaggagcc

SEQ ID NO: 804043 - DNA, 25 bp, Mus musculus
tgcaacatcagcgatgcaaggagcc

SEQ ID NO: 804044 - DNA, 25 bp, Mus musculus
tgcaacatccaccttggaggctgtg

SEQ ID NO: 804045 - DNA, 25 bp, Mus musculus
tgcaacatccacgttggaggctgtg

SEQ ID NO: 804046 - DNA, 25 bp, Mus musculus
tgcaacatggagacgacccctacac

SEQ ID NO: 804047 - DNA, 25 bp, Mus musculus
tgcaacatggagacggtgtgctaac

SEQ ID NO: 804048 - DNA, 25 bp, Mus musculus
tgcaacatggagtcgacccctacac

SEQ ID NO: 804049 - DNA, 25 bp, Mus musculus
tgcaacatggagtcggtgtgctaac

SEQ ID NO: 804050 - DNA, 25 bp, Mus musculus
tgcaaccacagcatccatagtcagt

SEQ ID NO: 804051 - DNA, 25 bp, Mus musculus
tgcaaccacagcttccatagtcagt

SEQ ID NO: 804052 - DNA, 25 bp, Mus musculus
tgcaaccagcgcaatggctggcacc

SEQ ID NO: 804053 - DNA, 25 bp, Mus musculus
tgcaaccagcgctatggctggcacc

SEQ ID NO: 804054 - DNA, 25 bp, Mus musculus
tgcaaccccttgcaatcaagcatgg

SEQ ID NO: 804055 - DNA, 25 bp, Mus musculus
tgcaaccccttggaatcaagcatgg

SEQ ID NO: 804056 - DNA, 25 bp, Mus musculus
tgcaaccctaagacgacagcggaat

SEQ ID NO: 804057 - DNA, 25 bp, Mus musculus
tgcaaccctaagtcgacagcggaat

SEQ ID NO: 804058 - DNA, 25 bp, Mus musculus
tgcaaccctgagctgaccctgatcg

SEQ ID NO: 804059 - DNA, 25 bp, Mus musculus
tgcaaccctgaggtgaccctgatcg

SEQ ID NO: 804060 - DNA, 25 bp, Mus musculus
tgcaaccgcccaatcaatatcaaga

SEQ ID NO: 804061 - DNA, 25 bp, Mus musculus
tgcaaccgcccattcaatatcaaga

SEQ ID NO: 804062 - DNA, 25 bp, Mus musculus
tgcaaccgtgctattgctgaccgct

SEQ ID NO: 804063 - DNA, 25 bp, Mus musculus
tgcaaccgtgcttttgctgaccgct

SEQ ID NO: 804064 - DNA, 25 bp, Mus musculus
tgcaacctatggatctggtcagaaa

SEQ ID NO: 804065 - DNA, 25 bp, Mus musculus
tgcaacctatggttctggtcagaaa

SEQ ID NO: 804066 - DNA, 25 bp, Mus musculus
tgcaacctgagcagatcgagaaaat

SEQ ID NO: 804067 - DNA, 25 bp, Mus musculus
tgcaacctgagctgatcgagaaaat

SEQ ID NO: 804068 - DNA, 25 bp, Mus musculus
tgcaacctgctgaacgtgagctgga

SEQ ID NO: 804069 - DNA, 25 bp, Mus musculus
tgcaacctgctgtacgtgagctgga

SEQ ID NO: 804070 - DNA, 25 bp, Mus musculus
tgcaacctggaaaggccagaatggc

SEQ ID NO: 804071 - DNA, 25 bp, Mus musculus
tgcaacctggaatggccagaatggc

SEQ ID NO: 804072 - DNA, 25 bp, Mus musculus
tgcaacctgtctcaagtaggcggct

SEQ ID NO: 804073 - DNA, 25 bp, Mus musculus
tgcaacctgtctgaagtaggcggct

SEQ ID NO: 804074 - DNA, 25 bp, Mus musculus
tgcaacgccaaaccctatcctatag

SEQ ID NO: 804075 - DNA, 25 bp, Mus musculus
tgcaacgccaaagcctatcctatag

SEQ ID NO: 804076 - DNA, 25 bp, Mus musculus
tgcaacgccaacaagaagtcggacg

SEQ ID NO: 804077 - DNA, 25 bp, Mus musculus
tgcaacgccaactagaagtcggacg

SEQ ID NO: 804078 - DNA, 25 bp, Mus musculus
tgcaacgctccaagaagaggctggg

SEQ ID NO: 804079 - DNA, 25 bp, Mus musculus
tgcaacgctccatgaagaggctggg

SEQ ID NO: 804080 - DNA, 25 bp, Mus musculus
tgcaacgctgccatccacaagaaat

SEQ ID NO: 804081 - DNA, 25 bp, Mus musculus
tgcaacgctgccttccacaagaaat

SEQ ID NO: 804082 - DNA, 25 bp, Mus musculus
tgcaacgctggactccgcctttgag

SEQ ID NO: 804083 - DNA, 25 bp, Mus musculus
tgcaacgctggagtccgcctttgag

SEQ ID NO: 804084 - DNA, 25 bp, Mus musculus
tgcaacggcacacagaggaaaacaa

SEQ ID NO: 804085 - DNA, 25 bp, Mus musculus
tgcaacggcacagagaggaaaacaa

SEQ ID NO: 804086 - DNA, 25 bp, Mus musculus
tgcaacgggaacagcaacgagctaa

SEQ ID NO: 804087 - DNA, 25 bp, Mus musculus
tgcaacgggaactgcaacgagctaa

SEQ ID NO: 804088 - DNA, 25 bp, Mus musculus
tgcaacgtttgaagagtggttcccc

SEQ ID NO: 804089 - DNA, 25 bp, Mus musculus
tgcaacgtttgatgagtggttcccc

SEQ ID NO: 804090 - DNA, 25 bp, Mus musculus
tgcaactaagttaaggccaaaggca

SEQ ID NO: 804091 - DNA, 25 bp, Mus musculus
tgcaactaagtttaggccaaaggca

SEQ ID NO: 804092 - DNA, 25 bp, Mus musculus
tgcaactagggacgaagctgcctct

SEQ ID NO: 804093 - DNA, 25 bp, Mus musculus
tgcaactagggaggaagctgcctct

SEQ ID NO: 804094 - DNA, 25 bp, Mus musculus
tgcaactagtcactgtcaagtagct

SEQ ID NO: 804095 - DNA, 25 bp, Mus musculus
tgcaactagtcagtgtcaagtagct

SEQ ID NO: 804096 - DNA, 25 bp, Mus musculus
tgcaactcccacaggccaacgatgg

SEQ ID NO: 804097 - DNA, 25 bp, Mus musculus
tgcaactcccactggccaacgatgg

SEQ ID NO: 804098 - DNA, 25 bp, Mus musculus
tgcaactcctcccagagagtcgagc

SEQ ID NO: 804099 - DNA, 25 bp, Mus musculus
tgcaactcctccgagagagtcgagc

SEQ ID NO: 804100 - DNA, 25 bp, Mus musculus
tgcaactgaatcagcagcagaaaga

SEQ ID NO: 804101 - DNA, 25 bp, Mus musculus
tgcaactgaatctgcagcagaaaga

SEQ ID NO: 804102 - DNA, 25 bp, Mus musculus
tgcaactgccaaagagatccgtagg

SEQ ID NO: 804103 - DNA, 25 bp, Mus musculus
tgcaactgccaatgagatccgtagg

SEQ ID NO: 804104 - DNA, 25 bp, Mus musculus
tgcaactgcctgcattcagcacctt

SEQ ID NO: 804105 - DNA, 25 bp, Mus musculus
tgcaactgcctggattcagcacctt

SEQ ID NO: 804106 - DNA, 25 bp, Mus musculus
tgcaactgcgagcacagtggaaatt

SEQ ID NO: 804107 - DNA, 25 bp, Mus musculus
tgcaactgcgaggacagtggaaatt

SEQ ID NO: 804108 - DNA, 25 bp, Mus musculus
tgcaactggacgagacctgtgctga

SEQ ID NO: 804109 - DNA, 25 bp, Mus musculus
tgcaactggacgtgacctgtgctga

SEQ ID NO: 804110 - DNA, 25 bp, Mus musculus
tgcaactgtcctctgccatatacag

SEQ ID NO: 804111 - DNA, 25 bp, Mus musculus
tgcaactgtcctgtgccatatacag

SEQ ID NO: 804112 - DNA, 25 bp, Mus musculus
tgcaacttgcccacagtgggtatac

SEQ ID NO: 804113 - DNA, 25 bp, Mus musculus
tgcaacttgccctcagtgggtatac

SEQ ID NO: 804114 - DNA, 25 bp, Mus musculus
tgcaagaaacttcaatctgccaatg

SEQ ID NO: 804115 - DNA, 25 bp, Mus musculus
tgcaagaaacttgaatctgccaatg

SEQ ID NO: 804116 - DNA, 25 bp, Mus musculus
tgcaagaaaggtcacgcaaccagat

SEQ ID NO: 804117 - DNA, 25 bp, Mus musculus
tgcaagaaaggtgacgcaaccagat

SEQ ID NO: 804118 - DNA, 25 bp, Mus musculus
tgcaagaacacacaaggttcctacc

SEQ ID NO: 804119 - DNA, 25 bp, Mus musculus
tgcaagaacacacatcctggctaca

SEQ ID NO: 804120 - DNA, 25 bp, Mus musculus
tgcaagaacacagaaggttcctacc

SEQ ID NO: 804121 - DNA, 25 bp, Mus musculus
tgcaagaacacagatcctggctaca

SEQ ID NO: 804122 - DNA, 25 bp, Mus musculus
tgcaagaactcacccattgcccgga

SEQ ID NO: 804123 - DNA, 25 bp, Mus musculus
tgcaagaactcagccattgcccgga

SEQ ID NO: 804124 - DNA, 25 bp, Mus musculus
tgcaagaagaacatccgcacacgcg

SEQ ID NO: 804125 - DNA, 25 bp, Mus musculus
tgcaagaagaacttccgcacacgcg

SEQ ID NO: 804126 - DNA, 25 bp, Mus musculus
tgcaagaaggatcgcttcggtaccc

SEQ ID NO: 804127 - DNA, 25 bp, Mus musculus
tgcaagaaggatggcttcggtaccc

SEQ ID NO: 804128 - DNA, 25 bp, Mus musculus
tgcaagaagtagaaaaacgacaaaa

SEQ ID NO: 804129 - DNA, 25 bp, Mus musculus
tgcaagaagtagtaaaacgacaaaa

SEQ ID NO: 804130 - DNA, 25 bp, Mus musculus
tgcaagaagtgacccggatcctgaa

SEQ ID NO: 804131 - DNA, 25 bp, Mus musculus
tgcaagaagtgagccggatcctgaa

SEQ ID NO: 804132 - DNA, 25 bp, Mus musculus
tgcaagaagtgcacaatccctggta

SEQ ID NO: 804133 - DNA, 25 bp, Mus musculus
tgcaagaagtgctcaatccctggta

SEQ ID NO: 804134 - DNA, 25 bp, Mus musculus
tgcaagacaaagaagttggagatgg

SEQ ID NO: 804135 - DNA, 25 bp, Mus musculus
tgcaagacaaagtagttggagatgg

SEQ ID NO: 804136 - DNA, 25 bp, Mus musculus
tgcaagacacaaacttggctggaca

SEQ ID NO: 804137 - DNA, 25 bp, Mus musculus
tgcaagacacaactaaaccctgcct

SEQ ID NO: 804138 - DNA, 25 bp, Mus musculus
tgcaagacacaagtaaaccctgcct

SEQ ID NO: 804139 - DNA, 25 bp, Mus musculus
tgcaagacacaatcttggctggaca

SEQ ID NO: 804140 - DNA, 25 bp, Mus musculus
tgcaagaccaggacggtcatttacg

SEQ ID NO: 804141 - DNA, 25 bp, Mus musculus
tgcaagaccaggtcggtcatttacg

SEQ ID NO: 804142 - DNA, 25 bp, Mus musculus
tgcaagacgattctggaaccagggt

SEQ ID NO: 804143 - DNA, 25 bp, Mus musculus
tgcaagacgattgtggaaccagggt

SEQ ID NO: 804144 - DNA, 25 bp, Mus musculus
tgcaagacgccaacagcaaaatgga

SEQ ID NO: 804145 - DNA, 25 bp, Mus musculus
tgcaagacgccatcagcaaaatgga

SEQ ID NO: 804146 - DNA, 25 bp, Mus musculus
tgcaagacgtcgcacaaaaaagctg

SEQ ID NO: 804147 - DNA, 25 bp, Mus musculus
tgcaagacgtcggacaaaaaagctg

SEQ ID NO: 804148 - DNA, 25 bp, Mus musculus
tgcaagactggaattcctgaagatg

SEQ ID NO: 804149 - DNA, 25 bp, Mus musculus
tgcaagactggatttcctgaagatg

SEQ ID NO: 804150 - DNA, 25 bp, Mus musculus
tgcaagagaaggcaatgtgcccaat

SEQ ID NO: 804151 - DNA, 25 bp, Mus musculus
tgcaagagaagggaatgtgcccaat

SEQ ID NO: 804152 - DNA, 25 bp, Mus musculus
tgcaagagagacaggcataaaggct

SEQ ID NO: 804153 - DNA, 25 bp, Mus musculus
tgcaagagagactggcataaaggct

SEQ ID NO: 804154 - DNA, 25 bp, Mus musculus
tgcaagagctctaggaatcaaccag

SEQ ID NO: 804155 - DNA, 25 bp, Mus musculus
tgcaagagctcttggaatcaaccag

SEQ ID NO: 804156 - DNA, 25 bp, Mus musculus
tgcaagagctgcaaacaatggagct

SEQ ID NO: 804157 - DNA, 25 bp, Mus musculus
tgcaagagctgctaacaatggagct

SEQ ID NO: 804158 - DNA, 25 bp, Mus musculus
tgcaagagctttagcctgagtacaa

SEQ ID NO: 804159 - DNA, 25 bp, Mus musculus
tgcaagagcttttgcctgagtacaa

SEQ ID NO: 804160 - DNA, 25 bp, Mus musculus
tgcaagaggcttactctgtcacctg

SEQ ID NO: 804161 - DNA, 25 bp, Mus musculus
tgcaagaggctttctctgtcacctg

SEQ ID NO: 804162 - DNA, 25 bp, Mus musculus
tgcaagaggtacagtggcttaggat

SEQ ID NO: 804163 - DNA, 25 bp, Mus musculus
tgcaagaggtaccagacccagacct

SEQ ID NO: 804164 - DNA, 25 bp, Mus musculus
tgcaagaggtacgagacccagacct

SEQ ID NO: 804165 - DNA, 25 bp, Mus musculus
tgcaagaggtactgtggcttaggat

SEQ ID NO: 804166 - DNA, 25 bp, Mus musculus
tgcaagaggttgatctgagcctgtt

SEQ ID NO: 804167 - DNA, 25 bp, Mus musculus
tgcaagaggttgttctgagcctgtt

SEQ ID NO: 804168 - DNA, 25 bp, Mus musculus
tgcaagatacttcacatagcctgct

SEQ ID NO: 804169 - DNA, 25 bp, Mus musculus
tgcaagatacttgacatagcctgct

SEQ ID NO: 804170 - DNA, 25 bp, Mus musculus
tgcaagatataaaagggcagtcaga

SEQ ID NO: 804171 - DNA, 25 bp, Mus musculus
tgcaagatataatagggcagtcaga

SEQ ID NO: 804172 - DNA, 25 bp, Mus musculus
tgcaagatcagcagcgtctaccgtc

SEQ ID NO: 804173 - DNA, 25 bp, Mus musculus
tgcaagatcagctgcgtctaccgtc

SEQ ID NO: 804174 - DNA, 25 bp, Mus musculus
tgcaagatccgtcaagggcgcttct

SEQ ID NO: 804175 - DNA, 25 bp, Mus musculus
tgcaagatccgtgaagggcgcttct

SEQ ID NO: 804176 - DNA, 25 bp, Mus musculus
tgcaagatcctacgaccgcggctag

SEQ ID NO: 804177 - DNA, 25 bp, Mus musculus
tgcaagatcctaggaccgcggctag

SEQ ID NO: 804178 - DNA, 25 bp, Mus musculus
tgcaagatgccaccagatcagctca

SEQ ID NO: 804179 - DNA, 25 bp, Mus musculus
tgcaagatgccaccgcgaacagctc

SEQ ID NO: 804180 - DNA, 25 bp, Mus musculus
tgcaagatgccagcagatcagctca

SEQ ID NO: 804181 - DNA, 25 bp, Mus musculus
tgcaagatgccagcgcgaacagctc

SEQ ID NO: 804182 - DNA, 25 bp, Mus musculus
tgcaagatgggacaatcttcattgg

SEQ ID NO: 804183 - DNA, 25 bp, Mus musculus
tgcaagatgggagaatcttcattgg

SEQ ID NO: 804184 - DNA, 25 bp, Mus musculus
tgcaagcaaggactggctgcgagcg

SEQ ID NO: 804185 - DNA, 25 bp, Mus musculus
tgcaagcaaggagtggctgcgagcg

SEQ ID NO: 804186 - DNA, 25 bp, Mus musculus
tgcaagcaatatccggattttacca

SEQ ID NO: 804187 - DNA, 25 bp, Mus musculus
tgcaagcaatatgcggattttacca

SEQ ID NO: 804188 - DNA, 25 bp, Mus musculus
tgcaagcacaagagcttgaacgtca

SEQ ID NO: 804189 - DNA, 25 bp, Mus musculus
tgcaagcacaagtgcttgaacgtca

SEQ ID NO: 804190 - DNA, 25 bp, Mus musculus
tgcaagcacctacacaacctgtggg

SEQ ID NO: 804191 - DNA, 25 bp, Mus musculus
tgcaagcacctagacaacctgtggg

SEQ ID NO: 804192 - DNA, 25 bp, Mus musculus
tgcaagcagagacggagcatggccg

SEQ ID NO: 804193 - DNA, 25 bp, Mus musculus
tgcaagcagagagggagcatggccg

SEQ ID NO: 804194 - DNA, 25 bp, Mus musculus
tgcaagcagagccaggaaataatgc

SEQ ID NO: 804195 - DNA, 25 bp, Mus musculus
tgcaagcagagcgaggaaataatgc

SEQ ID NO: 804196 - DNA, 25 bp, Mus musculus
tgcaagcaggagcagtcaagaatct

SEQ ID NO: 804197 - DNA, 25 bp, Mus musculus
tgcaagcaggaggagtcaagaatct

SEQ ID NO: 804198 - DNA, 25 bp, Mus musculus
tgcaagcatggaaactgggcccagc

SEQ ID NO: 804199 - DNA, 25 bp, Mus musculus
tgcaagcatggatactgggcccagc

SEQ ID NO: 804200 - DNA, 25 bp, Mus musculus
tgcaagccagaccatggatactgga

SEQ ID NO: 804201 - DNA, 25 bp, Mus musculus
tgcaagccagacgatggatactgga

SEQ ID NO: 804202 - DNA, 25 bp, Mus musculus
tgcaagccaggacatgggatcgaca

SEQ ID NO: 804203 - DNA, 25 bp, Mus musculus
tgcaagccaggagatgggatcgaca

SEQ ID NO: 804204 - DNA, 25 bp, Mus musculus
tgcaagcccacaagcctatctgcta

SEQ ID NO: 804205 - DNA, 25 bp, Mus musculus
tgcaagcccacatgcctatctgcta

SEQ ID NO: 804206 - DNA, 25 bp, Mus musculus
tgcaagcccgacaggaacggctact

SEQ ID NO: 804207 - DNA, 25 bp, Mus musculus
tgcaagcccgactggaacggctact

SEQ ID NO: 804208 - DNA, 25 bp, Mus musculus
tgcaagcccggacgcagctgtatgc

SEQ ID NO: 804209 - DNA, 25 bp, Mus musculus
tgcaagcccggaggcagctgtatgc

SEQ ID NO: 804210 - DNA, 25 bp, Mus musculus
tgcaagccgccaacaagattctgcg

SEQ ID NO: 804211 - DNA, 25 bp, Mus musculus
tgcaagccgccatcaagattctgcg

SEQ ID NO: 804212 - DNA, 25 bp, Mus musculus
tgcaagcctggtcatactcacataa

SEQ ID NO: 804213 - DNA, 25 bp, Mus musculus
tgcaagcctggtgatactcacataa

SEQ ID NO: 804214 - DNA, 25 bp, Mus musculus
tgcaagcgataaccctacaggatgg

SEQ ID NO: 804215 - DNA, 25 bp, Mus musculus
tgcaagcgataagcctacaggatgg

SEQ ID NO: 804216 - DNA, 25 bp, Mus musculus
tgcaagcgcaaaatcttttaacgca

SEQ ID NO: 804217 - DNA, 25 bp, Mus musculus
tgcaagcgcaaattcttttaacgca

SEQ ID NO: 804218 - DNA, 25 bp, Mus musculus
tgcaagcgcaagctagccgagtgcc

SEQ ID NO: 804219 - DNA, 25 bp, Mus musculus
tgcaagcgcaaggtagccgagtgcc

SEQ ID NO: 804220 - DNA, 25 bp, Mus musculus
tgcaagcggaccagtctgaagggcc

SEQ ID NO: 804221 - DNA, 25 bp, Mus musculus
tgcaagcggacctgtctgaagggcc

SEQ ID NO: 804222 - DNA, 25 bp, Mus musculus
tgcaagcggaggctctctgcaaact

SEQ ID NO: 804223 - DNA, 25 bp, Mus musculus
tgcaagcggagggtctctgcaaact

SEQ ID NO: 804224 - DNA, 25 bp, Mus musculus
tgcaagcgtgtacggacacagtgct

SEQ ID NO: 804225 - DNA, 25 bp, Mus musculus
tgcaagcgtgtagggacacagtgct

SEQ ID NO: 804226 - DNA, 25 bp, Mus musculus
tgcaagctaaagaccaaccacattg

SEQ ID NO: 804227 - DNA, 25 bp, Mus musculus
tgcaagctaaagtccaaccacattg

SEQ ID NO: 804228 - DNA, 25 bp, Mus musculus
tgcaagctatcaaacagagactggt

SEQ ID NO: 804229 - DNA, 25 bp, Mus musculus
tgcaagctatcatacagagactggt

SEQ ID NO: 804230 - DNA, 25 bp, Mus musculus
tgcaagctccccaggatgaaaggct

SEQ ID NO: 804231 - DNA, 25 bp, Mus musculus
tgcaagctcccctggatgaaaggct

SEQ ID NO: 804232 - DNA, 25 bp, Mus musculus
tgcaagctcggtcaaatcgaccgcg

SEQ ID NO: 804233 - DNA, 25 bp, Mus musculus
tgcaagctcggtgaaatcgaccgcg

SEQ ID NO: 804234 - DNA, 25 bp, Mus musculus
tgcaagctgcggcagcccaagcagc

SEQ ID NO: 804235 - DNA, 25 bp, Mus musculus
tgcaagctgcgggagcccaagcagc

SEQ ID NO: 804236 - DNA, 25 bp, Mus musculus
tgcaagctggaaacagtgacacaga

SEQ ID NO: 804237 - DNA, 25 bp, Mus musculus
tgcaagctggaatcagtgacacaga

SEQ ID NO: 804238 - DNA, 25 bp, Mus musculus
tgcaagctgtgcctataactaaagt

SEQ ID NO: 804239 - DNA, 25 bp, Mus musculus
tgcaagctgtgcgtataactaaagt

SEQ ID NO: 804240 - DNA, 25 bp, Mus musculus
tgcaagctttttaacaggacacgcc

SEQ ID NO: 804241 - DNA, 25 bp, Mus musculus
tgcaagcttttttacaggacacgcc

SEQ ID NO: 804242 - DNA, 25 bp, Mus musculus
tgcaaggaacgactgactgacagtg

SEQ ID NO: 804243 - DNA, 25 bp, Mus musculus
tgcaaggaacgagtgactgacagtg

SEQ ID NO: 804244 - DNA, 25 bp, Mus musculus
tgcaaggacatcacctgtcccaaga

SEQ ID NO: 804245 - DNA, 25 bp, Mus musculus
tgcaaggacatctcctgtcccaaga

SEQ ID NO: 804246 - DNA, 25 bp, Mus musculus
tgcaaggacatgaccagtggctacg

SEQ ID NO: 804247 - DNA, 25 bp, Mus musculus
tgcaaggacatgagcgacgagctcg

SEQ ID NO: 804248 - DNA, 25 bp, Mus musculus
tgcaaggacatgtccagtggctacg

SEQ ID NO: 804249 - DNA, 25 bp, Mus musculus
tgcaaggacatgtgcgacgagctcg

SEQ ID NO: 804250 - DNA, 25 bp, Mus musculus
tgcaaggaccacatcagtgatggcc

SEQ ID NO: 804251 - DNA, 25 bp, Mus musculus
tgcaaggaccacttcagtgatggcc

SEQ ID NO: 804252 - DNA, 25 bp, Mus musculus
tgcaaggagaatctccagatttgaa

SEQ ID NO: 804253 - DNA, 25 bp, Mus musculus
tgcaaggagaatgtccagatttgaa

SEQ ID NO: 804254 - DNA, 25 bp, Mus musculus
tgcaaggcagtaaggctccaaagcc

SEQ ID NO: 804255 - DNA, 25 bp, Mus musculus
tgcaaggcagtatggctccaaagcc

SEQ ID NO: 804256 - DNA, 25 bp, Mus musculus
tgcaaggccctcctggaaaagtagg

SEQ ID NO: 804257 - DNA, 25 bp, Mus musculus
tgcaaggccctcgtggaaaagtagg

SEQ ID NO: 804258 - DNA, 25 bp, Mus musculus
tgcaaggccgttacctacctcatgg

SEQ ID NO: 804259 - DNA, 25 bp, Mus musculus
tgcaaggccgtttcctacctcatgg

SEQ ID NO: 804260 - DNA, 25 bp, Mus musculus
tgcaaggcctgcaccaaggagaacc

SEQ ID NO: 804261 - DNA, 25 bp, Mus musculus
tgcaaggcctgctccaaggagaacc

SEQ ID NO: 804262 - DNA, 25 bp, Mus musculus
tgcaaggcggtcaacgaatatggcg

SEQ ID NO: 804263 - DNA, 25 bp, Mus musculus
tgcaaggcggtctacgaatatggcg

SEQ ID NO: 804264 - DNA, 25 bp, Mus musculus
tgcaagggaaatccttaggaatgat

SEQ ID NO: 804265 - DNA, 25 bp, Mus musculus
tgcaagggaaatgcttaggaatgat

SEQ ID NO: 804266 - DNA, 25 bp, Mus musculus
tgcaagggcagcatctatctggtgt

SEQ ID NO: 804267 - DNA, 25 bp, Mus musculus
tgcaagggcagcttctatctggtgt

SEQ ID NO: 804268 - DNA, 25 bp, Mus musculus
tgcaagggccatcactgaacaggag

SEQ ID NO: 804269 - DNA, 25 bp, Mus musculus
tgcaagggccatgactgaacaggag

SEQ ID NO: 804270 - DNA, 25 bp, Mus musculus
tgcaagggccgcagcactcagggtt

SEQ ID NO: 804271 - DNA, 25 bp, Mus musculus
tgcaagggccgctgcactcagggtt

SEQ ID NO: 804272 - DNA, 25 bp, Mus musculus
tgcaaggtacggatctgttccttcc

SEQ ID NO: 804273 - DNA, 25 bp, Mus musculus
tgcaaggtacggttctgttccttcc

SEQ ID NO: 804274 - DNA, 25 bp, Mus musculus
tgcaaggtcaagaacctttaactgc

SEQ ID NO: 804275 - DNA, 25 bp, Mus musculus
tgcaaggtcaagtacctttaactgc

SEQ ID NO: 804276 - DNA, 25 bp, Mus musculus
tgcaaggtccgccactcgggcttct

SEQ ID NO: 804277 - DNA, 25 bp, Mus musculus
tgcaaggtccgcgactcgggcttct

SEQ ID NO: 804278 - DNA, 25 bp, Mus musculus
tgcaaggttgaaatccgctactggg

SEQ ID NO: 804279 - DNA, 25 bp, Mus musculus
tgcaaggttgaattccgctactggg

SEQ ID NO: 804280 - DNA, 25 bp, Mus musculus
tgcaaggttttgagcctatgaaaat

SEQ ID NO: 804281 - DNA, 25 bp, Mus musculus
tgcaaggttttgtgcctatgaaaat

SEQ ID NO: 804282 - DNA, 25 bp, Mus musculus
tgcaagtaaatcagctaagcgagcg

SEQ ID NO: 804283 - DNA, 25 bp, Mus musculus
tgcaagtaaatctgctaagcgagcg

SEQ ID NO: 804284 - DNA, 25 bp, Mus musculus
tgcaagtactgcattgtgtatggcc

SEQ ID NO: 804285 - DNA, 25 bp, Mus musculus
tgcaagtactgctttgtgtatggcc

SEQ ID NO: 804286 - DNA, 25 bp, Mus musculus
tgcaagtagcacatggatctcggaa

SEQ ID NO: 804287 - DNA, 25 bp, Mus musculus
tgcaagtagcacttggatctcggaa

SEQ ID NO: 804288 - DNA, 25 bp, Mus musculus
tgcaagtcaagcacccgtggaggat

SEQ ID NO: 804289 - DNA, 25 bp, Mus musculus
tgcaagtcaagctcccgtggaggat

SEQ ID NO: 804290 - DNA, 25 bp, Mus musculus
tgcaagtcaaggacgggatcctcag

SEQ ID NO: 804291 - DNA, 25 bp, Mus musculus
tgcaagtcaaggtcgggatcctcag

SEQ ID NO: 804292 - DNA, 25 bp, Mus musculus
tgcaagtcatcaagaccatgagaca

SEQ ID NO: 804293 - DNA, 25 bp, Mus musculus
tgcaagtcatcatgaccatgagaca

SEQ ID NO: 804294 - DNA, 25 bp, Mus musculus
tgcaagtcctttcaatccattaact

SEQ ID NO: 804295 - DNA, 25 bp, Mus musculus
tgcaagtcctttgaatccattaact

SEQ ID NO: 804296 - DNA, 25 bp, Mus musculus
tgcaagtctcttcctgctctaaaag

SEQ ID NO: 804297 - DNA, 25 bp, Mus musculus
tgcaagtctcttgctgctctaaaag

SEQ ID NO: 804298 - DNA, 25 bp, Mus musculus
tgcaagtctgatcgaaacagtacag

SEQ ID NO: 804299 - DNA, 25 bp, Mus musculus
tgcaagtctgatggaaacagtacag

SEQ ID NO: 804300 - DNA, 25 bp, Mus musculus
tgcaagtctgtccacattttgtggg

SEQ ID NO: 804301 - DNA, 25 bp, Mus musculus
tgcaagtctgtcgacattttgtggg

SEQ ID NO: 804302 - DNA, 25 bp, Mus musculus
tgcaagtgaatgacagtggccagcc

SEQ ID NO: 804303 - DNA, 25 bp, Mus musculus
tgcaagtgaatgtcagtggccagcc

SEQ ID NO: 804304 - DNA, 25 bp, Mus musculus
tgcaagtgacacaaatgaggccctg

SEQ ID NO: 804305 - DNA, 25 bp, Mus musculus
tgcaagtgacactaatgaggccctg

SEQ ID NO: 804306 - DNA, 25 bp, Mus musculus
tgcaagtgccccaagaggaaggtga

SEQ ID NO: 804307 - DNA, 25 bp, Mus musculus
tgcaagtgcccctagaggaaggtga

SEQ ID NO: 804308 - DNA, 25 bp, Mus musculus
tgcaagtgctaaatgcctcccacga

SEQ ID NO: 804309 - DNA, 25 bp, Mus musculus
tgcaagtgctaattgcctcccacga

SEQ ID NO: 804310 - DNA, 25 bp, Mus musculus
tgcaagtgggaacacgacatgcctg

SEQ ID NO: 804311 - DNA, 25 bp, Mus musculus
tgcaagtgggaagacgacatgcctg

SEQ ID NO: 804312 - DNA, 25 bp, Mus musculus
tgcaagtgtcgcctcctgaagaaca

SEQ ID NO: 804313 - DNA, 25 bp, Mus musculus
tgcaagtgtcgcgtcctgaagaaca

SEQ ID NO: 804314 - DNA, 25 bp, Mus musculus
tgcaagtgtggtagctatcgacaac

SEQ ID NO: 804315 - DNA, 25 bp, Mus musculus
tgcaagtgtggttgctatcgacaac

SEQ ID NO: 804316 - DNA, 25 bp, Mus musculus
tgcaagtgttttctgacatggacct

SEQ ID NO: 804317 - DNA, 25 bp, Mus musculus
tgcaagtgttttgtgacatggacct

SEQ ID NO: 804318 - DNA, 25 bp, Mus musculus
tgcaagtttgctactggctaaaagt

SEQ ID NO: 804319 - DNA, 25 bp, Mus musculus
tgcaagtttgcttctggctaaaagt

SEQ ID NO: 804320 - DNA, 25 bp, Mus musculus
tgcaagttttgtctgaatcctaaaa

SEQ ID NO: 804321 - DNA, 25 bp, Mus musculus
tgcaagttttgtgtgaatcctaaaa

SEQ ID NO: 804322 - DNA, 25 bp, Mus musculus
tgcaatagcaacaaacgggtttgtt

SEQ ID NO: 804323 - DNA, 25 bp, Mus musculus
tgcaatagcaactaacgggtttgtt

SEQ ID NO: 804324 - DNA, 25 bp, Mus musculus
tgcaatagcaggaggaaccttaact

SEQ ID NO: 804325 - DNA, 25 bp, Mus musculus
tgcaatagcaggtggaaccttaact

SEQ ID NO: 804326 - DNA, 25 bp, Mus musculus
tgcaatagtgttataacttacaacc

SEQ ID NO: 804327 - DNA, 25 bp, Mus musculus
tgcaatagtgttttaacttacaacc

SEQ ID NO: 804328 - DNA, 25 bp, Mus musculus
tgcaatcacgtacataaaagatgtg

SEQ ID NO: 804329 - DNA, 25 bp, Mus musculus
tgcaatcacgtagataaaagatgtg

SEQ ID NO: 804330 - DNA, 25 bp, Mus musculus
tgcaatccatgacgctatggagcag

SEQ ID NO: 804331 - DNA, 25 bp, Mus musculus
tgcaatccatgaggctatggagcag

SEQ ID NO: 804332 - DNA, 25 bp, Mus musculus
tgcaatccttgtcgtatctgggaga

SEQ ID NO: 804333 - DNA, 25 bp, Mus musculus
tgcaatccttgtggtatctgggaga

SEQ ID NO: 804334 - DNA, 25 bp, Mus musculus
tgcaatcggttgctatcatagccac

SEQ ID NO: 804335 - DNA, 25 bp, Mus musculus
tgcaatcggttggtatcatagccac

SEQ ID NO: 804336 - DNA, 25 bp, Mus musculus
tgcaatcgtgcgagatgctcatggc

SEQ ID NO: 804337 - DNA, 25 bp, Mus musculus
tgcaatcgtgcgtgatgctcatggc

SEQ ID NO: 804338 - DNA, 25 bp, Mus musculus
tgcaatctccagatccacagatccg

SEQ ID NO: 804339 - DNA, 25 bp, Mus musculus
tgcaatctccagttccacagatccg

SEQ ID NO: 804340 - DNA, 25 bp, Mus musculus
tgcaatctccccatagtccaaggcc

SEQ ID NO: 804341 - DNA, 25 bp, Mus musculus
tgcaatctccccttagtccaaggcc

SEQ ID NO: 804342 - DNA, 25 bp, Mus musculus
tgcaatctcctgctgtgcttacagc

SEQ ID NO: 804343 - DNA, 25 bp, Mus musculus
tgcaatctcctggtgtgcttacagc

SEQ ID NO: 804344 - DNA, 25 bp, Mus musculus
tgcaatctcgggaggagactcgaaa

SEQ ID NO: 804345 - DNA, 25 bp, Mus musculus
tgcaatctcgggtggagactcgaaa

SEQ ID NO: 804346 - DNA, 25 bp, Mus musculus
tgcaatctgagcagcgtggtaaagc

SEQ ID NO: 804347 - DNA, 25 bp, Mus musculus
tgcaatctgagctgcgtggtaaagc

SEQ ID NO: 804348 - DNA, 25 bp, Mus musculus
tgcaatctgattctcaggaggcaaa

SEQ ID NO: 804349 - DNA, 25 bp, Mus musculus
tgcaatctgattgtcaggaggcaaa

SEQ ID NO: 804350 - DNA, 25 bp, Mus musculus
tgcaatctgcataagtgatgttgga

SEQ ID NO: 804351 - DNA, 25 bp, Mus musculus
tgcaatctgcattagtgatgttgga

SEQ ID NO: 804352 - DNA, 25 bp, Mus musculus
tgcaatctgcgcacgtaccatgacg

SEQ ID NO: 804353 - DNA, 25 bp, Mus musculus
tgcaatctgcgctcgtaccatgacg

SEQ ID NO: 804354 - DNA, 25 bp, Mus musculus
tgcaatgactcgattgtttcaatct

SEQ ID NO: 804355 - DNA, 25 bp, Mus musculus
tgcaatgactcgtttgtttcaatct

SEQ ID NO: 804356 - DNA, 25 bp, Mus musculus
tgcaatgatctgcacgcgtctgccg

SEQ ID NO: 804357 - DNA, 25 bp, Mus musculus
tgcaatgatctggacgcgtctgccg

SEQ ID NO: 804358 - DNA, 25 bp, Mus musculus
tgcaatgatgtccaccaaagacctg

SEQ ID NO: 804359 - DNA, 25 bp, Mus musculus
tgcaatgatgtcgaccaaagacctg

SEQ ID NO: 804360 - DNA, 25 bp, Mus musculus
tgcaatgcaggacagctttggagat

SEQ ID NO: 804361 - DNA, 25 bp, Mus musculus
tgcaatgcaggagagctttggagat

SEQ ID NO: 804362 - DNA, 25 bp, Mus musculus
tgcaatgcaggtaatcttcacatgt

SEQ ID NO: 804363 - DNA, 25 bp, Mus musculus
tgcaatgcaggttatcttcacatgt

SEQ ID NO: 804364 - DNA, 25 bp, Mus musculus
tgcaatgctgccattttcgtgatca

SEQ ID NO: 804365 - DNA, 25 bp, Mus musculus
tgcaatgctgcctttttcgtgatca

SEQ ID NO: 804366 - DNA, 25 bp, Mus musculus
tgcaatggagaccacccggttgctc

SEQ ID NO: 804367 - DNA, 25 bp, Mus musculus
tgcaatggagacgacccggttgctc

SEQ ID NO: 804368 - DNA, 25 bp, Mus musculus
tgcaatgggaagatacgcggtacca

SEQ ID NO: 804369 - DNA, 25 bp, Mus musculus
tgcaatgggaagttacgcggtacca

SEQ ID NO: 804370 - DNA, 25 bp, Mus musculus
tgcaatggtcctcggtttatgggct

SEQ ID NO: 804371 - DNA, 25 bp, Mus musculus
tgcaatggtcctgggtttatgggct

SEQ ID NO: 804372 - DNA, 25 bp, Mus musculus
tgcaatggtggtccagcacccaagt

SEQ ID NO: 804373 - DNA, 25 bp, Mus musculus
tgcaatggtggtgcagcacccaagt

SEQ ID NO: 804374 - DNA, 25 bp, Mus musculus
tgcaatgtgaagaatccctccaaaa

SEQ ID NO: 804375 - DNA, 25 bp, Mus musculus
tgcaatgtgaagtatccctccaaaa

SEQ ID NO: 804376 - DNA, 25 bp, Mus musculus
tgcaatgtggagcagtccttcttca

SEQ ID NO: 804377 - DNA, 25 bp, Mus musculus
tgcaatgtggaggagtccttcttca

SEQ ID NO: 804378 - DNA, 25 bp, Mus musculus
tgcaatgtggcccacccggcaagca

SEQ ID NO: 804379 - DNA, 25 bp, Mus musculus
tgcaatgtggccgacccggcaagca

SEQ ID NO: 804380 - DNA, 25 bp, Mus musculus
tgcaatgtttctaggaatgacgtgc

SEQ ID NO: 804381 - DNA, 25 bp, Mus musculus
tgcaatgtttcttggaatgacgtgc

SEQ ID NO: 804382 - DNA, 25 bp, Mus musculus
tgcaattatgccacctcagctgcat

SEQ ID NO: 804383 - DNA, 25 bp, Mus musculus
tgcaattatgcctcctcagctgcat

SEQ ID NO: 804384 - DNA, 25 bp, Mus musculus
tgcaattatgtaaagcttgtggatg

SEQ ID NO: 804385 - DNA, 25 bp, Mus musculus
tgcaattatgtatagcttgtggatg

SEQ ID NO: 804386 - DNA, 25 bp, Mus musculus
tgcaattcgaagacacagtgaatca

SEQ ID NO: 804387 - DNA, 25 bp, Mus musculus
tgcaattcgaagtcacagtgaatca

SEQ ID NO: 804388 - DNA, 25 bp, Mus musculus
tgcaattcgctgagtgaaccaggct

SEQ ID NO: 804389 - DNA, 25 bp, Mus musculus
tgcaattcgctgtgtgaaccaggct

SEQ ID NO: 804390 - DNA, 25 bp, Mus musculus
tgcaattgccaaaattccagcagca

SEQ ID NO: 804391 - DNA, 25 bp, Mus musculus
tgcaattgccaatattccagcagca

SEQ ID NO: 804392 - DNA, 25 bp, Mus musculus
tgcaattgctctacttacactgata

SEQ ID NO: 804393 - DNA, 25 bp, Mus musculus
tgcaattgctcttcttacactgata

SEQ ID NO: 804394 - DNA, 25 bp, Mus musculus
tgcaattggccaccagcttaaaaaa

SEQ ID NO: 804395 - DNA, 25 bp, Mus musculus
tgcaattggccagcagcttaaaaaa

SEQ ID NO: 804396 - DNA, 25 bp, Mus musculus
tgcaattttcacagattcagatctt

SEQ ID NO: 804397 - DNA, 25 bp, Mus musculus
tgcaattttcactgattcagatctt

SEQ ID NO: 804398 - DNA, 25 bp, Mus musculus
tgcacaaaaagtctttcacccatgg

SEQ ID NO: 804399 - DNA, 25 bp, Mus musculus
tgcacaaaaagtgtttcacccatgg

SEQ ID NO: 804400 - DNA, 25 bp, Mus musculus
tgcacaaaactgcatttttgcccta

SEQ ID NO: 804401 - DNA, 25 bp, Mus musculus
tgcacaaaactggatttttgcccta

SEQ ID NO: 804402 - DNA, 25 bp, Mus musculus
tgcacaaacggcattgacctggacc

SEQ ID NO: 804403 - DNA, 25 bp, Mus musculus
tgcacaaacggctttgacctggacc

SEQ ID NO: 804404 - DNA, 25 bp, Mus musculus
tgcacaaaggcgagagtcagcgatg

SEQ ID NO: 804405 - DNA, 25 bp, Mus musculus
tgcacaaaggcgtgagtcagcgatg

SEQ ID NO: 804406 - DNA, 25 bp, Mus musculus
tgcacaaagtaaatggctaccgtgt

SEQ ID NO: 804407 - DNA, 25 bp, Mus musculus
tgcacaaagtaattggctaccgtgt

SEQ ID NO: 804408 - DNA, 25 bp, Mus musculus
tgcacaacagaacatggagaaccac

SEQ ID NO: 804409 - DNA, 25 bp, Mus musculus
tgcacaacagaagatggagaaccac

SEQ ID NO: 804410 - DNA, 25 bp, Mus musculus
tgcacaaccaccatactgagaagag

SEQ ID NO: 804411 - DNA, 25 bp, Mus musculus
tgcacaaccaccttactgagaagag

SEQ ID NO: 804412 - DNA, 25 bp, Mus musculus
tgcacaacccaaacttcacagtaag

SEQ ID NO: 804413 - DNA, 25 bp, Mus musculus
tgcacaacccaatcttcacagtaag

SEQ ID NO: 804414 - DNA, 25 bp, Mus musculus
tgcacaacctccatgatctccaaga

SEQ ID NO: 804415 - DNA, 25 bp, Mus musculus
tgcacaacctccttgatctccaaga

SEQ ID NO: 804416 - DNA, 25 bp, Mus musculus
tgcacaactgaaatctaaatatggg

SEQ ID NO: 804417 - DNA, 25 bp, Mus musculus
tgcacaactgaattctaaatatggg

SEQ ID NO: 804418 - DNA, 25 bp, Mus musculus
tgcacaactgtaatccttcacctgg

SEQ ID NO: 804419 - DNA, 25 bp, Mus musculus
tgcacaactgtattccttcacctgg

SEQ ID NO: 804420 - DNA, 25 bp, Mus musculus
tgcacaagatgcagcgaggtcgcct

SEQ ID NO: 804421 - DNA, 25 bp, Mus musculus
tgcacaagatgctgcgaggtcgcct

SEQ ID NO: 804422 - DNA, 25 bp, Mus musculus
tgcacaagattcagagctattgctc

SEQ ID NO: 804423 - DNA, 25 bp, Mus musculus
tgcacaagattctgagctattgctc

SEQ ID NO: 804424 - DNA, 25 bp, Mus musculus
tgcacaagcatgagcccctcgtgct

SEQ ID NO: 804425 - DNA, 25 bp, Mus musculus
tgcacaagcatgtgcccctcgtgct

SEQ ID NO: 804426 - DNA, 25 bp, Mus musculus
tgcacaaggataaggacagcacctg

SEQ ID NO: 804427 - DNA, 25 bp, Mus musculus
tgcacaaggatatggacagcacctg

SEQ ID NO: 804428 - DNA, 25 bp, Mus musculus
tgcacaaggcagcatccgtggagct

SEQ ID NO: 804429 - DNA, 25 bp, Mus musculus
tgcacaaggcaggatccgtggagct

SEQ ID NO: 804430 - DNA, 25 bp, Mus musculus
tgcacaaggcgcagagggagaacca

SEQ ID NO: 804431 - DNA, 25 bp, Mus musculus
tgcacaaggcgctgagggagaacca

SEQ ID NO: 804432 - DNA, 25 bp, Mus musculus
tgcacaaggcggaggacagcctcct

SEQ ID NO: 804433 - DNA, 25 bp, Mus musculus
tgcacaaggcggtggacagcctcct

SEQ ID NO: 804434 - DNA, 25 bp, Mus musculus
tgcacaaggtagagatgaaggctct

SEQ ID NO: 804435 - DNA, 25 bp, Mus musculus
tgcacaaggtagtgatgaaggctct

SEQ ID NO: 804436 - DNA, 25 bp, Mus musculus
tgcacaaggtgtatcctgcctttgg

SEQ ID NO: 804437 - DNA, 25 bp, Mus musculus
tgcacaaggtgtttcctgcctttgg

SEQ ID NO: 804438 - DNA, 25 bp, Mus musculus
tgcacaagtggacgcagatccttcg

SEQ ID NO: 804439 - DNA, 25 bp, Mus musculus
tgcacaagtggaggcagatccttcg

SEQ ID NO: 804440 - DNA, 25 bp, Mus musculus
tgcacaagtttccatcaccaatgaa

SEQ ID NO: 804441 - DNA, 25 bp, Mus musculus
tgcacaagtttcgatcaccaatgaa

SEQ ID NO: 804442 - DNA, 25 bp, Mus musculus
tgcacaagtttgcaatgcacatggg

SEQ ID NO: 804443 - DNA, 25 bp, Mus musculus
tgcacaagtttggaatgcacatggg

SEQ ID NO: 804444 - DNA, 25 bp, Mus musculus
tgcacaatatggcaatatcttaaag

SEQ ID NO: 804445 - DNA, 25 bp, Mus musculus
tgcacaatatgggaatatcttaaag

SEQ ID NO: 804446 - DNA, 25 bp, Mus musculus
tgcacaatcgctaagataaacaccg

SEQ ID NO: 804447 - DNA, 25 bp, Mus musculus
tgcacaatcgcttagataaacaccg

SEQ ID NO: 804448 - DNA, 25 bp, Mus musculus
tgcacaatctgactgtggccgccac

SEQ ID NO: 804449 - DNA, 25 bp, Mus musculus
tgcacaatctgagtgtggccgccac

SEQ ID NO: 804450 - DNA, 25 bp, Mus musculus
tgcacaatgactaccaggccctgaa

SEQ ID NO: 804451 - DNA, 25 bp, Mus musculus
tgcacaatgacttccaggccctgaa

SEQ ID NO: 804452 - DNA, 25 bp, Mus musculus
tgcacaatgcatacagcgtactgct

SEQ ID NO: 804453 - DNA, 25 bp, Mus musculus
tgcacaatgcattcagcgtactgct

SEQ ID NO: 804454 - DNA, 25 bp, Mus musculus
tgcacaatgtcaccctagccctgga

SEQ ID NO: 804455 - DNA, 25 bp, Mus musculus
tgcacaatgtcagcctagccctgga

SEQ ID NO: 804456 - DNA, 25 bp, Mus musculus
tgcacacaaagcaacacactgctct

SEQ ID NO: 804457 - DNA, 25 bp, Mus musculus
tgcacacaaagctacacactgctct

SEQ ID NO: 804458 - DNA, 25 bp, Mus musculus
tgcacacacagcaataccactcgag

SEQ ID NO: 804459 - DNA, 25 bp, Mus musculus
tgcacacacagctataccactcgag

SEQ ID NO: 804460 - DNA, 25 bp, Mus musculus
tgcacacactggagcagaatctggt

SEQ ID NO: 804461 - DNA, 25 bp, Mus musculus
tgcacacactggtgcagaatctggt

SEQ ID NO: 804462 - DNA, 25 bp, Mus musculus
tgcacacagaacaagatgccatgct

SEQ ID NO: 804463 - DNA, 25 bp, Mus musculus
tgcacacagaactagatgccatgct

SEQ ID NO: 804464 - DNA, 25 bp, Mus musculus
tgcacacagagcaggcgtgtactcg

SEQ ID NO: 804465 - DNA, 25 bp, Mus musculus
tgcacacagagctggcgtgtactcg

SEQ ID NO: 804466 - DNA, 25 bp, Mus musculus
tgcacacagataaccaaccttgact

SEQ ID NO: 804467 - DNA, 25 bp, Mus musculus
tgcacacagatatccaaccttgact

SEQ ID NO: 804468 - DNA, 25 bp, Mus musculus
tgcacacagtacattaggcatggat

SEQ ID NO: 804469 - DNA, 25 bp, Mus musculus
tgcacacagtactttaggcatggat

SEQ ID NO: 804470 - DNA, 25 bp, Mus musculus
tgcacacagtgtccgactgtaactg

SEQ ID NO: 804471 - DNA, 25 bp, Mus musculus
tgcacacagtgtgcgactgtaactg

SEQ ID NO: 804472 - DNA, 25 bp, Mus musculus
tgcacacattcaacagggaatacac

SEQ ID NO: 804473 - DNA, 25 bp, Mus musculus
tgcacacattcatcagggaatacac

SEQ ID NO: 804474 - DNA, 25 bp, Mus musculus
tgcacaccaagtactgggtggtgga

SEQ ID NO: 804475 - DNA, 25 bp, Mus musculus
tgcacaccaagttctgggtggtgga

SEQ ID NO: 804476 - DNA, 25 bp, Mus musculus
tgcacaccacgacaagctgaaagag

SEQ ID NO: 804477 - DNA, 25 bp, Mus musculus
tgcacaccacgagaagctgaaagag

SEQ ID NO: 804478 - DNA, 25 bp, Mus musculus
tgcacaccatctcgatacaaaacag

SEQ ID NO: 804479 - DNA, 25 bp, Mus musculus
tgcacaccatctggatacaaaacag

SEQ ID NO: 804480 - DNA, 25 bp, Mus musculus
tgcacaccatggaggaagcctccca

SEQ ID NO: 804481 - DNA, 25 bp, Mus musculus
tgcacaccatggtggaagcctccca

SEQ ID NO: 804482 - DNA, 25 bp, Mus musculus
tgcacaccctggagattgccgacct

SEQ ID NO: 804483 - DNA, 25 bp, Mus musculus
tgcacaccctggtgattgccgacct

SEQ ID NO: 804484 - DNA, 25 bp, Mus musculus
tgcacacccttaccagtatgaactg

SEQ ID NO: 804485 - DNA, 25 bp, Mus musculus
tgcacacccttagcagtatgaactg

SEQ ID NO: 804486 - DNA, 25 bp, Mus musculus
tgcacacctgtgcccgtgaagcgcg

SEQ ID NO: 804487 - DNA, 25 bp, Mus musculus
tgcacacctgtggccgtgaagcgcg

SEQ ID NO: 804488 - DNA, 25 bp, Mus musculus
tgcacacgaaggaggacacatatga

SEQ ID NO: 804489 - DNA, 25 bp, Mus musculus
tgcacacgaaggctgactactcggg

SEQ ID NO: 804490 - DNA, 25 bp, Mus musculus
tgcacacgaagggtgactactcggg

SEQ ID NO: 804491 - DNA, 25 bp, Mus musculus
tgcacacgaaggtggacacatatga

SEQ ID NO: 804492 - DNA, 25 bp, Mus musculus
tgcacacggacacctttgtgagaag

SEQ ID NO: 804493 - DNA, 25 bp, Mus musculus
tgcacacggacagctttgtgagaag

SEQ ID NO: 804494 - DNA, 25 bp, Mus musculus
tgcacacggtacacaacgtggccca

SEQ ID NO: 804495 - DNA, 25 bp, Mus musculus
tgcacacggtactcaacgtggccca

SEQ ID NO: 804496 - DNA, 25 bp, Mus musculus
tgcacactcagtcaaagaaatgggt

SEQ ID NO: 804497 - DNA, 25 bp, Mus musculus
tgcacactcagtgaaagaaatgggt

SEQ ID NO: 804498 - DNA, 25 bp, Mus musculus
tgcacactgcaccaagattatgggc

SEQ ID NO: 804499 - DNA, 25 bp, Mus musculus
tgcacactgcacgaagattatgggc

SEQ ID NO: 804500 - DNA, 25 bp, Mus musculus
tgcacactggacagaagatgcctct

SEQ ID NO: 804501 - DNA, 25 bp, Mus musculus
tgcacactggactgaagatgcctct

SEQ ID NO: 804502 - DNA, 25 bp, Mus musculus
tgcacactggcaagtacaagtctgt

SEQ ID NO: 804503 - DNA, 25 bp, Mus musculus
tgcacactggcatgtacaagtctgt

SEQ ID NO: 804504 - DNA, 25 bp, Mus musculus
tgcacactgggcattgtgctggctc

SEQ ID NO: 804505 - DNA, 25 bp, Mus musculus
tgcacactgggctttgtgctggctc

SEQ ID NO: 804506 - DNA, 25 bp, Mus musculus
tgcacacttcataggctggtatctg

SEQ ID NO: 804507 - DNA, 25 bp, Mus musculus
tgcacacttcattggctggtatctg

SEQ ID NO: 804508 - DNA, 25 bp, Mus musculus
tgcacagacatcatcaagccacctg

SEQ ID NO: 804509 - DNA, 25 bp, Mus musculus
tgcacagacatcttcaagccacctg

SEQ ID NO: 804510 - DNA, 25 bp, Mus musculus
tgcacagagcaaattcatgtagttc

SEQ ID NO: 804511 - DNA, 25 bp, Mus musculus
tgcacagagcaatttcatgtagttc

SEQ ID NO: 804512 - DNA, 25 bp, Mus musculus
tgcacagatcaactgccaatcaaag

SEQ ID NO: 804513 - DNA, 25 bp, Mus musculus
tgcacagatcaagtgccaatcaaag

SEQ ID NO: 804514 - DNA, 25 bp, Mus musculus
tgcacagattgcatactctaagatc

SEQ ID NO: 804515 - DNA, 25 bp, Mus musculus
tgcacagattgcttactctaagatc

SEQ ID NO: 804516 - DNA, 25 bp, Mus musculus
tgcacagcactccaatgcagccatt

SEQ ID NO: 804517 - DNA, 25 bp, Mus musculus
tgcacagcactcgaatgcagccatt

SEQ ID NO: 804518 - DNA, 25 bp, Mus musculus
tgcacagcactgcaacttctcgagc

SEQ ID NO: 804519 - DNA, 25 bp, Mus musculus
tgcacagcactggaacttctcgagc

SEQ ID NO: 804520 - DNA, 25 bp, Mus musculus
tgcacagccaagaacgcacatctgg

SEQ ID NO: 804521 - DNA, 25 bp, Mus musculus
tgcacagccaagtacgcacatctgg

SEQ ID NO: 804522 - DNA, 25 bp, Mus musculus
tgcacagccggcacagctggaagga

SEQ ID NO: 804523 - DNA, 25 bp, Mus musculus
tgcacagccggctcagctggaagga

SEQ ID NO: 804524 - DNA, 25 bp, Mus musculus
tgcacagccgtgctgcctactcatt

SEQ ID NO: 804525 - DNA, 25 bp, Mus musculus
tgcacagccgtggtgcctactcatt

SEQ ID NO: 804526 - DNA, 25 bp, Mus musculus
tgcacagccttcctgagttagcaaa

SEQ ID NO: 804527 - DNA, 25 bp, Mus musculus
tgcacagccttcgtgagttagcaaa

SEQ ID NO: 804528 - DNA, 25 bp, Mus musculus
tgcacagctccgagtacttcgtggc

SEQ ID NO: 804529 - DNA, 25 bp, Mus musculus
tgcacagctccgtgtacttcgtggc

SEQ ID NO: 804530 - DNA, 25 bp, Mus musculus
tgcacaggaagacgttgaaccccat

SEQ ID NO: 804531 - DNA, 25 bp, Mus musculus
tgcacaggaagaggttgaaccccat

SEQ ID NO: 804532 - DNA, 25 bp, Mus musculus
tgcacaggactgatccatatggaag

SEQ ID NO: 804533 - DNA, 25 bp, Mus musculus
tgcacaggactgttccatatggaag

SEQ ID NO: 804534 - DNA, 25 bp, Mus musculus
tgcacaggagacaagtttacaagag

SEQ ID NO: 804535 - DNA, 25 bp, Mus musculus
tgcacaggagactagtttacaagag

SEQ ID NO: 804536 - DNA, 25 bp, Mus musculus
tgcacaggcaggaaatgaagccgct

SEQ ID NO: 804537 - DNA, 25 bp, Mus musculus
tgcacaggcaggtaatgaagccgct

SEQ ID NO: 804538 - DNA, 25 bp, Mus musculus
tgcacaggctgcctcaaccagtggg

SEQ ID NO: 804539 - DNA, 25 bp, Mus musculus
tgcacaggctgccttccagaaggtg

SEQ ID NO: 804540 - DNA, 25 bp, Mus musculus
tgcacaggctgcgtcaaccagtggg

SEQ ID NO: 804541 - DNA, 25 bp, Mus musculus
tgcacaggctgcgttccagaaggtg

SEQ ID NO: 804542 - DNA, 25 bp, Mus musculus
tgcacaggctggatctactacagaa

SEQ ID NO: 804543 - DNA, 25 bp, Mus musculus
tgcacaggctggttctactacagaa

SEQ ID NO: 804544 - DNA, 25 bp, Mus musculus
tgcacagggtccaggcttgaagacc

SEQ ID NO: 804545 - DNA, 25 bp, Mus musculus
tgcacagggtcctggcttgaagacc

SEQ ID NO: 804546 - DNA, 25 bp, Mus musculus
tgcacaggtgccaacactggtatac

SEQ ID NO: 804547 - DNA, 25 bp, Mus musculus
tgcacaggtgcctacactggtatac

SEQ ID NO: 804548 - DNA, 25 bp, Mus musculus
tgcacagtcacaaagagaaattacc

SEQ ID NO: 804549 - DNA, 25 bp, Mus musculus
tgcacagtcacatagagaaattacc

SEQ ID NO: 804550 - DNA, 25 bp, Mus musculus
tgcacagtcccactctggtactggg

SEQ ID NO: 804551 - DNA, 25 bp, Mus musculus
tgcacagtcccagtctggtactggg

SEQ ID NO: 804552 - DNA, 25 bp, Mus musculus
tgcacagtctctaccggcgacagct

SEQ ID NO: 804553 - DNA, 25 bp, Mus musculus
tgcacagtctcttccggcgacagct

SEQ ID NO: 804554 - DNA, 25 bp, Mus musculus
tgcacagtgcctaagacgagttctt

SEQ ID NO: 804555 - DNA, 25 bp, Mus musculus
tgcacagtgccttagacgagttctt

SEQ ID NO: 804556 - DNA, 25 bp, Mus musculus
tgcacagtgctcatctgaccggcgt

SEQ ID NO: 804557 - DNA, 25 bp, Mus musculus
tgcacagtgctcttctgaccggcgt

SEQ ID NO: 804558 - DNA, 25 bp, Mus musculus
tgcacagtggagagcattcaccaac

SEQ ID NO: 804559 - DNA, 25 bp, Mus musculus
tgcacagtggagtgcattcaccaac

SEQ ID NO: 804560 - DNA, 25 bp, Mus musculus
tgcacagtggccatcaccaggaact

SEQ ID NO: 804561 - DNA, 25 bp, Mus musculus
tgcacagtggccttcaccaggaact

SEQ ID NO: 804562 - DNA, 25 bp, Mus musculus
tgcacagtgggaaataagcaaaaag

SEQ ID NO: 804563 - DNA, 25 bp, Mus musculus
tgcacagtgggatataagcaaaaag

SEQ ID NO: 804564 - DNA, 25 bp, Mus musculus
tgcacataatctcaaaagaccagag

SEQ ID NO: 804565 - DNA, 25 bp, Mus musculus
tgcacataatctgaaaagaccagag

SEQ ID NO: 804566 - DNA, 25 bp, Mus musculus
tgcacatactgtcctgactacactg

SEQ ID NO: 804567 - DNA, 25 bp, Mus musculus
tgcacatactgtgctgactacactg

SEQ ID NO: 804568 - DNA, 25 bp, Mus musculus
tgcacatccggaacccgtggttaca

SEQ ID NO: 804569 - DNA, 25 bp, Mus musculus
tgcacatccggatcccgtggttaca

SEQ ID NO: 804570 - DNA, 25 bp, Mus musculus
tgcacatcgcagctcaggagcagcg

SEQ ID NO: 804571 - DNA, 25 bp, Mus musculus
tgcacatcgcaggtcaggagcagcg

SEQ ID NO: 804572 - DNA, 25 bp, Mus musculus
tgcacatcgctcagcaaatcgcagc

SEQ ID NO: 804573 - DNA, 25 bp, Mus musculus
tgcacatcgctctgcaaatcgcagc

SEQ ID NO: 804574 - DNA, 25 bp, Mus musculus
tgcacatctataagaagaatgggag

SEQ ID NO: 804575 - DNA, 25 bp, Mus musculus
tgcacatctatatgaagaatgggag

SEQ ID NO: 804576 - DNA, 25 bp, Mus musculus
tgcacatctgcccactgagctttgg

SEQ ID NO: 804577 - DNA, 25 bp, Mus musculus
tgcacatctgccgactgagctttgg

SEQ ID NO: 804578 - DNA, 25 bp, Mus musculus
tgcacatctgtacacctgagggctt

SEQ ID NO: 804579 - DNA, 25 bp, Mus musculus
tgcacatctgtagacctgagggctt

SEQ ID NO: 804580 - DNA, 25 bp, Mus musculus
tgcacatgaaccactggacgctggg

SEQ ID NO: 804581 - DNA, 25 bp, Mus musculus
tgcacatgaacctctggacgctggg

SEQ ID NO: 804582 - DNA, 25 bp, Mus musculus
tgcacatgaagtagggagacaacgg

SEQ ID NO: 804583 - DNA, 25 bp, Mus musculus
tgcacatgaagttgggagacaacgg

SEQ ID NO: 804584 - DNA, 25 bp, Mus musculus
tgcacatgacgaaaggcctggccat

SEQ ID NO: 804585 - DNA, 25 bp, Mus musculus
tgcacatgacgataggcctggccat

SEQ ID NO: 804586 - DNA, 25 bp, Mus musculus
tgcacatgcagcaatacccgggctg

SEQ ID NO: 804587 - DNA, 25 bp, Mus musculus
tgcacatgcagctatacccgggctg

SEQ ID NO: 804588 - DNA, 25 bp, Mus musculus
tgcacatggaatctagctcctgcct

SEQ ID NO: 804589 - DNA, 25 bp, Mus musculus
tgcacatggaatgtagctcctgcct

SEQ ID NO: 804590 - DNA, 25 bp, Mus musculus
tgcacatgtagcagtacctgctctg

SEQ ID NO: 804591 - DNA, 25 bp, Mus musculus
tgcacatgtagctgtacctgctctg

SEQ ID NO: 804592 - DNA, 25 bp, Mus musculus
tgcacatgtggaaaaggctaacttc

SEQ ID NO: 804593 - DNA, 25 bp, Mus musculus
tgcacatgtggataaggctaacttc

SEQ ID NO: 804594 - DNA, 25 bp, Mus musculus
tgcacattgctcaagatatcaacca

SEQ ID NO: 804595 - DNA, 25 bp, Mus musculus
tgcacattgctctagatatcaacca

SEQ ID NO: 804596 - DNA, 25 bp, Mus musculus
tgcacattggctaccaagctctgca

SEQ ID NO: 804597 - DNA, 25 bp, Mus musculus
tgcacattggcttccaagctctgca

SEQ ID NO: 804598 - DNA, 25 bp, Mus musculus
tgcacatttaaccatgatattcaag

SEQ ID NO: 804599 - DNA, 25 bp, Mus musculus
tgcacatttaacgatgatattcaag

SEQ ID NO: 804600 - DNA, 25 bp, Mus musculus
tgcaccaaagagacttgtacagacg

SEQ ID NO: 804601 - DNA, 25 bp, Mus musculus
tgcaccaaagagtcttgtacagacg

SEQ ID NO: 804602 - DNA, 25 bp, Mus musculus
tgcaccaaagctctgacctctggtt

SEQ ID NO: 804603 - DNA, 25 bp, Mus musculus
tgcaccaaagctgtgacctctggtt

SEQ ID NO: 804604 - DNA, 25 bp, Mus musculus
tgcaccaacaggatgtactccagga

SEQ ID NO: 804605 - DNA, 25 bp, Mus musculus
tgcaccaacaggttgtactccagga

SEQ ID NO: 804606 - DNA, 25 bp, Mus musculus
tgcaccaacttcctgttgggcccgt

SEQ ID NO: 804607 - DNA, 25 bp, Mus musculus
tgcaccaacttcgtgttgggcccgt

SEQ ID NO: 804608 - DNA, 25 bp, Mus musculus
tgcaccaagccaagcgggctgctgg

SEQ ID NO: 804609 - DNA, 25 bp, Mus musculus
tgcaccaagccatgcgggctgctgg

SEQ ID NO: 804610 - DNA, 25 bp, Mus musculus
tgcaccaagttcagatggcccagct

SEQ ID NO: 804611 - DNA, 25 bp, Mus musculus
tgcaccaagttctgatggcccagct

SEQ ID NO: 804612 - DNA, 25 bp, Mus musculus
tgcaccacacgtatctttgagacct

SEQ ID NO: 804613 - DNA, 25 bp, Mus musculus
tgcaccacacgtttctttgagacct

SEQ ID NO: 804614 - DNA, 25 bp, Mus musculus
tgcaccacacttcatatgttactag

SEQ ID NO: 804615 - DNA, 25 bp, Mus musculus
tgcaccacacttgatatgttactag

SEQ ID NO: 804616 - DNA, 25 bp, Mus musculus
tgcaccacaggcattcagtgtctgt

SEQ ID NO: 804617 - DNA, 25 bp, Mus musculus
tgcaccacaggctttcagtgtctgt

SEQ ID NO: 804618 - DNA, 25 bp, Mus musculus
tgcaccacggccaaacttggatgga

SEQ ID NO: 804619 - DNA, 25 bp, Mus musculus
tgcaccacggcctaacttggatgga

SEQ ID NO: 804620 - DNA, 25 bp, Mus musculus
tgcaccacgtgacaaccttgaagat

SEQ ID NO: 804621 - DNA, 25 bp, Mus musculus
tgcaccacgtgagaaccttgaagat

SEQ ID NO: 804622 - DNA, 25 bp, Mus musculus
tgcaccactcatctatgtggccttc

SEQ ID NO: 804623 - DNA, 25 bp, Mus musculus
tgcaccactcatgtatgtggccttc

SEQ ID NO: 804624 - DNA, 25 bp, Mus musculus
tgcaccagaactatgacgactttac

SEQ ID NO: 804625 - DNA, 25 bp, Mus musculus
tgcaccagaactttgacgactttac

SEQ ID NO: 804626 - DNA, 25 bp, Mus musculus
tgcaccagacaacctccagctacgg

SEQ ID NO: 804627 - DNA, 25 bp, Mus musculus
tgcaccagacaagctccagctacgg

SEQ ID NO: 804628 - DNA, 25 bp, Mus musculus
tgcaccagacacagatgggagactc

SEQ ID NO: 804629 - DNA, 25 bp, Mus musculus
tgcaccagacactgatgggagactc

SEQ ID NO: 804630 - DNA, 25 bp, Mus musculus
tgcaccagcattaggtaagtgcttg

SEQ ID NO: 804631 - DNA, 25 bp, Mus musculus
tgcaccagcatttggtaagtgcttg

SEQ ID NO: 804632 - DNA, 25 bp, Mus musculus
tgcaccagcgatagtcgaacataga

SEQ ID NO: 804633 - DNA, 25 bp, Mus musculus
tgcaccagcgattgtcgaacataga

SEQ ID NO: 804634 - DNA, 25 bp, Mus musculus
tgcaccaggctcacacactgcgttt

SEQ ID NO: 804635 - DNA, 25 bp, Mus musculus
tgcaccaggctctcacactgcgttt

SEQ ID NO: 804636 - DNA, 25 bp, Mus musculus
tgcaccagtcgacctgacaaccagt

SEQ ID NO: 804637 - DNA, 25 bp, Mus musculus
tgcaccagtcgagctgacaaccagt

SEQ ID NO: 804638 - DNA, 25 bp, Mus musculus
tgcaccatctcacaacggacagaaa

SEQ ID NO: 804639 - DNA, 25 bp, Mus musculus
tgcaccatctcagaacggacagaaa

SEQ ID NO: 804640 - DNA, 25 bp, Mus musculus
tgcaccattgaacaagtcacacggg

SEQ ID NO: 804641 - DNA, 25 bp, Mus musculus
tgcaccattgaagaagtcacacggg

SEQ ID NO: 804642 - DNA, 25 bp, Mus musculus
tgcacccaaaccaagtgcaaagtct

SEQ ID NO: 804643 - DNA, 25 bp, Mus musculus
tgcacccaaacctagtgcaaagtct

SEQ ID NO: 804644 - DNA, 25 bp, Mus musculus
tgcacccacaaactttgccaagtgg

SEQ ID NO: 804645 - DNA, 25 bp, Mus musculus
tgcacccacaaagtttgccaagtgg

SEQ ID NO: 804646 - DNA, 25 bp, Mus musculus
tgcacccacgatacttcggtccaaa

SEQ ID NO: 804647 - DNA, 25 bp, Mus musculus
tgcacccacgattcttcggtccaaa

SEQ ID NO: 804648 - DNA, 25 bp, Mus musculus
tgcacccagcggattctacattgct

SEQ ID NO: 804649 - DNA, 25 bp, Mus musculus
tgcacccagcggtttctacattgct

SEQ ID NO: 804650 - DNA, 25 bp, Mus musculus
tgcacccagctgcttggctgtgccg

SEQ ID NO: 804651 - DNA, 25 bp, Mus musculus
tgcacccagctggttggctgtgccg

SEQ ID NO: 804652 - DNA, 25 bp, Mus musculus
tgcacccatcgactctcagttacat

SEQ ID NO: 804653 - DNA, 25 bp, Mus musculus
tgcacccatcgagtctcagttacat

SEQ ID NO: 804654 - DNA, 25 bp, Mus musculus
tgcaccccgacgagtttgcaacggc

SEQ ID NO: 804655 - DNA, 25 bp, Mus musculus
tgcaccccgacgtgtttgcaacggc

SEQ ID NO: 804656 - DNA, 25 bp, Mus musculus
tgcaccccgactccggattctagaa

SEQ ID NO: 804657 - DNA, 25 bp, Mus musculus
tgcaccccgactgcggattctagaa

SEQ ID NO: 804658 - DNA, 25 bp, Mus musculus
tgcaccccgagtcccagattgtgga

SEQ ID NO: 804659 - DNA, 25 bp, Mus musculus
tgcaccccgagtgccagattgtgga

SEQ ID NO: 804660 - DNA, 25 bp, Mus musculus
tgcacccctcctagggtccgggaat

SEQ ID NO: 804661 - DNA, 25 bp, Mus musculus
tgcacccctccttgggtccgggaat

SEQ ID NO: 804662 - DNA, 25 bp, Mus musculus
tgcacccggacacaatctacagcgt

SEQ ID NO: 804663 - DNA, 25 bp, Mus musculus
tgcacccggacagaatctacagcgt

SEQ ID NO: 804664 - DNA, 25 bp, Mus musculus
tgcacccgggacattgtgctacctg

SEQ ID NO: 804665 - DNA, 25 bp, Mus musculus
tgcacccgggactttgtgctacctg

SEQ ID NO: 804666 - DNA, 25 bp, Mus musculus
tgcaccctcaccagatgcaagaaca

SEQ ID NO: 804667 - DNA, 25 bp, Mus musculus
tgcaccctcacctgatgcaagaaca

SEQ ID NO: 804668 - DNA, 25 bp, Mus musculus
tgcaccctgcctatggttcatcgga

SEQ ID NO: 804669 - DNA, 25 bp, Mus musculus
tgcaccctgcctttggttcatcgga

SEQ ID NO: 804670 - DNA, 25 bp, Mus musculus
tgcaccctgcgtatcactgtggagg

SEQ ID NO: 804671 - DNA, 25 bp, Mus musculus
tgcaccctgcgtttcactgtggagg

SEQ ID NO: 804672 - DNA, 25 bp, Mus musculus
tgcaccctggtcaagtcatgtgaag

SEQ ID NO: 804673 - DNA, 25 bp, Mus musculus
tgcaccctggtctagtcatgtgaag

SEQ ID NO: 804674 - DNA, 25 bp, Mus musculus
tgcacccttgacctggacttgactc

SEQ ID NO: 804675 - DNA, 25 bp, Mus musculus
tgcacccttgacgtggacttgactc

SEQ ID NO: 804676 - DNA, 25 bp, Mus musculus
tgcacccttgtacttggctgagtgg

SEQ ID NO: 804677 - DNA, 25 bp, Mus musculus
tgcacccttgtagttggctgagtgg

SEQ ID NO: 804678 - DNA, 25 bp, Mus musculus
tgcaccgagcgcatctccggagcgg

SEQ ID NO: 804679 - DNA, 25 bp, Mus musculus
tgcaccgagcgcttctccggagcgg

SEQ ID NO: 804680 - DNA, 25 bp, Mus musculus
tgcaccgagctgaccagtgcacgag

SEQ ID NO: 804681 - DNA, 25 bp, Mus musculus
tgcaccgagctgtccagtgcacgag

SEQ ID NO: 804682 - DNA, 25 bp, Mus musculus
tgcaccgaggtcagagtctgcccag

SEQ ID NO: 804683 - DNA, 25 bp, Mus musculus
tgcaccgaggtctgagtctgcccag

SEQ ID NO: 804684 - DNA, 25 bp, Mus musculus
tgcaccgagtgtcgctacaagttca

SEQ ID NO: 804685 - DNA, 25 bp, Mus musculus
tgcaccgagtgtggctacaagttca

SEQ ID NO: 804686 - DNA, 25 bp, Mus musculus
tgcaccgatcggaggagttcttttt

SEQ ID NO: 804687 - DNA, 25 bp, Mus musculus
tgcaccgatcggtggagttcttttt

SEQ ID NO: 804688 - DNA, 25 bp, Mus musculus
tgcaccgatgacctgtttgcctgct

SEQ ID NO: 804689 - DNA, 25 bp, Mus musculus
tgcaccgatgacgtgtttgcctgct

SEQ ID NO: 804690 - DNA, 25 bp, Mus musculus
tgcaccgattggaggtgtgagccca

SEQ ID NO: 804691 - DNA, 25 bp, Mus musculus
tgcaccgattggtggtgtgagccca

SEQ ID NO: 804692 - DNA, 25 bp, Mus musculus
tgcaccgcctagaagaggaactggt

SEQ ID NO: 804693 - DNA, 25 bp, Mus musculus
tgcaccgcctagtagaggaactggt

SEQ ID NO: 804694 - DNA, 25 bp, Mus musculus
tgcaccggagacagatggctctgcg

SEQ ID NO: 804695 - DNA, 25 bp, Mus musculus
tgcaccggagactgatggctctgcg

SEQ ID NO: 804696 - DNA, 25 bp, Mus musculus
tgcaccggcaagcttgaatggccag

SEQ ID NO: 804697 - DNA, 25 bp, Mus musculus
tgcaccggcaaggttgaatggccag

SEQ ID NO: 804698 - DNA, 25 bp, Mus musculus
tgcaccggtggcagcagatcgagat

SEQ ID NO: 804699 - DNA, 25 bp, Mus musculus
tgcaccggtggctgcagatcgagat

SEQ ID NO: 804700 - DNA, 25 bp, Mus musculus
tgcaccgtcacaatgctggaggcct

SEQ ID NO: 804701 - DNA, 25 bp, Mus musculus
tgcaccgtcacattgctggaggcct

SEQ ID NO: 804702 - DNA, 25 bp, Mus musculus
tgcaccgtgtccagaagattccaga

SEQ ID NO: 804703 - DNA, 25 bp, Mus musculus
tgcaccgtgtcctgaagattccaga

SEQ ID NO: 804704 - DNA, 25 bp, Mus musculus
tgcaccgttcctacctggtcgaggc

SEQ ID NO: 804705 - DNA, 25 bp, Mus musculus
tgcaccgttccttcctggtcgaggc

SEQ ID NO: 804706 - DNA, 25 bp, Mus musculus
tgcacctaaagaatgaactcaaccg

SEQ ID NO: 804707 - DNA, 25 bp, Mus musculus
tgcacctaaagattgaactcaaccg

SEQ ID NO: 804708 - DNA, 25 bp, Mus musculus
tgcacctagtgaagatacgaacccc

SEQ ID NO: 804709 - DNA, 25 bp, Mus musculus
tgcacctagtgatgatacgaacccc

SEQ ID NO: 804710 - DNA, 25 bp, Mus musculus
tgcacctagttcagcatccagaaag

SEQ ID NO: 804711 - DNA, 25 bp, Mus musculus
tgcacctagttctgcatccagaaag

SEQ ID NO: 804712 - DNA, 25 bp, Mus musculus
tgcacctccaacctgggtcaaggct

SEQ ID NO: 804713 - DNA, 25 bp, Mus musculus
tgcacctccaacgtgggtcaaggct

SEQ ID NO: 804714 - DNA, 25 bp, Mus musculus
tgcacctccagcacaatgagctgac

SEQ ID NO: 804715 - DNA, 25 bp, Mus musculus
tgcacctccagctcaatgagctgac

SEQ ID NO: 804716 - DNA, 25 bp, Mus musculus
tgcacctcctaccttcagttctagt

SEQ ID NO: 804717 - DNA, 25 bp, Mus musculus
tgcacctcctacgttcagttctagt

SEQ ID NO: 804718 - DNA, 25 bp, Mus musculus
tgcacctctagtagtccctgagagt

SEQ ID NO: 804719 - DNA, 25 bp, Mus musculus
tgcacctctagttgtccctgagagt

SEQ ID NO: 804720 - DNA, 25 bp, Mus musculus
tgcacctgacacaaacttcactcgg

SEQ ID NO: 804721 - DNA, 25 bp, Mus musculus
tgcacctgacactaacttcactcgg

SEQ ID NO: 804722 - DNA, 25 bp, Mus musculus
tgcacctgccacagagtgaagcaag

SEQ ID NO: 804723 - DNA, 25 bp, Mus musculus
tgcacctgccactgagtgaagcaag

SEQ ID NO: 804724 - DNA, 25 bp, Mus musculus
tgcacctgccgacaaggcttcagtg

SEQ ID NO: 804725 - DNA, 25 bp, Mus musculus
tgcacctgccgagaaggcttcagtg

SEQ ID NO: 804726 - DNA, 25 bp, Mus musculus
tgcacctggatgaggactatccctg

SEQ ID NO: 804727 - DNA, 25 bp, Mus musculus
tgcacctggatgtggactatccctg

SEQ ID NO: 804728 - DNA, 25 bp, Mus musculus
tgcacctgggcgcactcttagctgc

SEQ ID NO: 804729 - DNA, 25 bp, Mus musculus
tgcacctgggcggactcttagctgc

SEQ ID NO: 804730 - DNA, 25 bp, Mus musculus
tgcacctggttacatccctggcaaa

SEQ ID NO: 804731 - DNA, 25 bp, Mus musculus
tgcacctggttagatccctggcaaa

SEQ ID NO: 804732 - DNA, 25 bp, Mus musculus
tgcaccttcattattcaagcttgcc

SEQ ID NO: 804733 - DNA, 25 bp, Mus musculus
tgcaccttcatttttcaagcttgcc

SEQ ID NO: 804734 - DNA, 25 bp, Mus musculus
tgcaccttctccctgggctatatat

SEQ ID NO: 804735 - DNA, 25 bp, Mus musculus
tgcaccttctccgtgggctatatat

SEQ ID NO: 804736 - DNA, 25 bp, Mus musculus
tgcaccttgggaagaaaacggaccg

SEQ ID NO: 804737 - DNA, 25 bp, Mus musculus
tgcaccttgggatgaaaacggaccg

SEQ ID NO: 804738 - DNA, 25 bp, Mus musculus
tgcaccttgtcgacatgaacttcgt

SEQ ID NO: 804739 - DNA, 25 bp, Mus musculus
tgcaccttgtcgtcatgaacttcgt

SEQ ID NO: 804740 - DNA, 25 bp, Mus musculus
tgcacgaaaccacgtgaataggatg

SEQ ID NO: 804741 - DNA, 25 bp, Mus musculus
tgcacgaaaccaggtgaataggatg

SEQ ID NO: 804742 - DNA, 25 bp, Mus musculus
tgcacgaaagccatctaaccattcc

SEQ ID NO: 804743 - DNA, 25 bp, Mus musculus
tgcacgaaagccttctaaccattcc

SEQ ID NO: 804744 - DNA, 25 bp, Mus musculus
tgcacgaactgcagaggaatcggca

SEQ ID NO: 804745 - DNA, 25 bp, Mus musculus
tgcacgaactgctgaggaatcggca

SEQ ID NO: 804746 - DNA, 25 bp, Mus musculus
tgcacgaagattatgggcgcctatg

SEQ ID NO: 804747 - DNA, 25 bp, Mus musculus
tgcacgaagattttgggcgcctatg

SEQ ID NO: 804748 - DNA, 25 bp, Mus musculus
tgcacgaagggcattccacgtgtcg

SEQ ID NO: 804749 - DNA, 25 bp, Mus musculus
tgcacgaagggctttccacgtgtcg

SEQ ID NO: 804750 - DNA, 25 bp, Mus musculus
tgcacgacacagaaggtaatgcctg

SEQ ID NO: 804751 - DNA, 25 bp, Mus musculus
tgcacgacacagtaggtaatgcctg

SEQ ID NO: 804752 - DNA, 25 bp, Mus musculus
tgcacgaccaagacctcattcacgg

SEQ ID NO: 804753 - DNA, 25 bp, Mus musculus
tgcacgaccaagtcctcattcacgg

SEQ ID NO: 804754 - DNA, 25 bp, Mus musculus
tgcacgaccgttcttatgggcaact

SEQ ID NO: 804755 - DNA, 25 bp, Mus musculus
tgcacgaccgttgttatgggcaact

SEQ ID NO: 804756 - DNA, 25 bp, Mus musculus
tgcacgactggcagtatgccttcaa

SEQ ID NO: 804757 - DNA, 25 bp, Mus musculus
tgcacgactggctgtatgccttcaa

SEQ ID NO: 804758 - DNA, 25 bp, Mus musculus
tgcacgagagagagaaacttccagc

SEQ ID NO: 804759 - DNA, 25 bp, Mus musculus
tgcacgagagagtgaaacttccagc

SEQ ID NO: 804760 - DNA, 25 bp, Mus musculus
tgcacgagagccagcacctgttcaa

SEQ ID NO: 804761 - DNA, 25 bp, Mus musculus
tgcacgagagcctgcacctgttcaa

SEQ ID NO: 804762 - DNA, 25 bp, Mus musculus
tgcacgagagtcagcaccgaggtct

SEQ ID NO: 804763 - DNA, 25 bp, Mus musculus
tgcacgagagtctgcaccgaggtct

SEQ ID NO: 804764 - DNA, 25 bp, Mus musculus
tgcacgaggaggaccatacactagg

SEQ ID NO: 804765 - DNA, 25 bp, Mus musculus
tgcacgaggaggtccatacactagg

SEQ ID NO: 804766 - DNA, 25 bp, Mus musculus
tgcacgaggcgtccacatgctgcac

SEQ ID NO: 804767 - DNA, 25 bp, Mus musculus
tgcacgaggcgtgcacatgctgcac

SEQ ID NO: 804768 - DNA, 25 bp, Mus musculus
tgcacgagtctcacatgctcttcga

SEQ ID NO: 804769 - DNA, 25 bp, Mus musculus
tgcacgagtctctcatgctcttcga

SEQ ID NO: 804770 - DNA, 25 bp, Mus musculus
tgcacgagttcaccgacctgaacct

SEQ ID NO: 804771 - DNA, 25 bp, Mus musculus
tgcacgagttcagcgacctgaacct

SEQ ID NO: 804772 - DNA, 25 bp, Mus musculus
tgcacgatcgtcaacagcgccaaat

SEQ ID NO: 804773 - DNA, 25 bp, Mus musculus
tgcacgatcgtctacagcgccaaat

SEQ ID NO: 804774 - DNA, 25 bp, Mus musculus
tgcacgatctgaatttctggcgaga

SEQ ID NO: 804775 - DNA, 25 bp, Mus musculus
tgcacgatctgattttctggcgaga

SEQ ID NO: 804776 - DNA, 25 bp, Mus musculus
tgcacgcacacactcggaagaaggt

SEQ ID NO: 804777 - DNA, 25 bp, Mus musculus
tgcacgcacacagtcggaagaaggt

SEQ ID NO: 804778 - DNA, 25 bp, Mus musculus
tgcacgcacgtcatcgaaagtgagg

SEQ ID NO: 804779 - DNA, 25 bp, Mus musculus
tgcacgcacgtcttcgaaagtgagg

SEQ ID NO: 804780 - DNA, 25 bp, Mus musculus
tgcacgcatgctcgactagaagggt

SEQ ID NO: 804781 - DNA, 25 bp, Mus musculus
tgcacgcatgctggactagaagggt

SEQ ID NO: 804782 - DNA, 25 bp, Mus musculus
tgcacgccatggaatcccgggtgtt

SEQ ID NO: 804783 - DNA, 25 bp, Mus musculus
tgcacgccatggtatcccgggtgtt

SEQ ID NO: 804784 - DNA, 25 bp, Mus musculus
tgcacgcggagtagagcgcactctt

SEQ ID NO: 804785 - DNA, 25 bp, Mus musculus
tgcacgcggagttgagcgcactctt

SEQ ID NO: 804786 - DNA, 25 bp, Mus musculus
tgcacgcggctacttgctaagcaaa

SEQ ID NO: 804787 - DNA, 25 bp, Mus musculus
tgcacgcggctagttgctaagcaaa

SEQ ID NO: 804788 - DNA, 25 bp, Mus musculus
tgcacgctggagaaaaatcactgtt

SEQ ID NO: 804789 - DNA, 25 bp, Mus musculus
tgcacgctggagtaaaatcactgtt

SEQ ID NO: 804790 - DNA, 25 bp, Mus musculus
tgcacgctgtacattccggaacttt

SEQ ID NO: 804791 - DNA, 25 bp, Mus musculus
tgcacgctgtactttccggaacttt

SEQ ID NO: 804792 - DNA, 25 bp, Mus musculus
tgcacggaaggtactgtgtctcgaa

SEQ ID NO: 804793 - DNA, 25 bp, Mus musculus
tgcacggaaggttctgtgtctcgaa

SEQ ID NO: 804794 - DNA, 25 bp, Mus musculus
tgcacggacgggacgcatgactgca

SEQ ID NO: 804795 - DNA, 25 bp, Mus musculus
tgcacggacgggtcgcatgactgca

SEQ ID NO: 804796 - DNA, 25 bp, Mus musculus
tgcacggagactctgatgagtgaac

SEQ ID NO: 804797 - DNA, 25 bp, Mus musculus
tgcacggagactgtgatgagtgaac

SEQ ID NO: 804798 - DNA, 25 bp, Mus musculus
tgcacggattctccagactaacaag

SEQ ID NO: 804799 - DNA, 25 bp, Mus musculus
tgcacggattctgcagactaacaag

SEQ ID NO: 804800 - DNA, 25 bp, Mus musculus
tgcacggcacggcttaaatctcatt

SEQ ID NO: 804801 - DNA, 25 bp, Mus musculus
tgcacggcacgggttaaatctcatt

SEQ ID NO: 804802 - DNA, 25 bp, Mus musculus
tgcacggcccgtactcctttagact

SEQ ID NO: 804803 - DNA, 25 bp, Mus musculus
tgcacggcccgttctcctttagact

SEQ ID NO: 804804 - DNA, 25 bp, Mus musculus
tgcacggccctgctggaacatatga

SEQ ID NO: 804805 - DNA, 25 bp, Mus musculus
tgcacggccctggtggaacatatga

SEQ ID NO: 804806 - DNA, 25 bp, Mus musculus
tgcacggctgaacaacaacaacaga

SEQ ID NO: 804807 - DNA, 25 bp, Mus musculus
tgcacggctgaagaacaacaacaga

SEQ ID NO: 804808 - DNA, 25 bp, Mus musculus
tgcacgggttgcagcagtactacgt

SEQ ID NO: 804809 - DNA, 25 bp, Mus musculus
tgcacgggttgctgcagtactacgt

SEQ ID NO: 804810 - DNA, 25 bp, Mus musculus
tgcacggtcaagaacacagaggctg

SEQ ID NO: 804811 - DNA, 25 bp, Mus musculus
tgcacggtcaagtacacagaggctg

SEQ ID NO: 804812 - DNA, 25 bp, Mus musculus
tgcacgtagaaaacccacgcacttg

SEQ ID NO: 804813 - DNA, 25 bp, Mus musculus
tgcacgtagaaatcccacgcacttg

SEQ ID NO: 804814 - DNA, 25 bp, Mus musculus
tgcacgtcaaaaccatcagccttcg

SEQ ID NO: 804815 - DNA, 25 bp, Mus musculus
tgcacgtcaaaagcatcagccttcg

SEQ ID NO: 804816 - DNA, 25 bp, Mus musculus
tgcacgtcaggccacacaaaggtgt

SEQ ID NO: 804817 - DNA, 25 bp, Mus musculus
tgcacgtcaggcgacacaaaggtgt

SEQ ID NO: 804818 - DNA, 25 bp, Mus musculus
tgcacgtctaagcaaggtcacccga

SEQ ID NO: 804819 - DNA, 25 bp, Mus musculus
tgcacgtctaaggaaggtcacccga

SEQ ID NO: 804820 - DNA, 25 bp, Mus musculus
tgcacgtctaccatggcgtctggga

SEQ ID NO: 804821 - DNA, 25 bp, Mus musculus
tgcacgtctaccttggcgtctggga

SEQ ID NO: 804822 - DNA, 25 bp, Mus musculus
tgcacgtgcagcagaatgactacct

SEQ ID NO: 804823 - DNA, 25 bp, Mus musculus
tgcacgtgcagctgaatgactacct

SEQ ID NO: 804824 - DNA, 25 bp, Mus musculus
tgcacgtggaatagccccacatcaa

SEQ ID NO: 804825 - DNA, 25 bp, Mus musculus
tgcacgtggaattgccccacatcaa

SEQ ID NO: 804826 - DNA, 25 bp, Mus musculus
tgcacgtggcctactacagacatga

SEQ ID NO: 804827 - DNA, 25 bp, Mus musculus
tgcacgtggccttctacagacatga

SEQ ID NO: 804828 - DNA, 25 bp, Mus musculus
tgcacgtggctgacctgagcatggt

SEQ ID NO: 804829 - DNA, 25 bp, Mus musculus
tgcacgtggctgtcctgagcatggt

SEQ ID NO: 804830 - DNA, 25 bp, Mus musculus
tgcacgtggtccatcgctgcagagg

SEQ ID NO: 804831 - DNA, 25 bp, Mus musculus
tgcacgtggtccttcgctgcagagg

SEQ ID NO: 804832 - DNA, 25 bp, Mus musculus
tgcacgtgtcccagggaagtccctc

SEQ ID NO: 804833 - DNA, 25 bp, Mus musculus
tgcacgtgtccctgggaagtccctc

SEQ ID NO: 804834 - DNA, 25 bp, Mus musculus
tgcacgtgtctgagccgcagtgtga

SEQ ID NO: 804835 - DNA, 25 bp, Mus musculus
tgcacgtgtctgtgccgcagtgtga

SEQ ID NO: 804836 - DNA, 25 bp, Mus musculus
tgcacgtgtgcccagggatacgaac

SEQ ID NO: 804837 - DNA, 25 bp, Mus musculus
tgcacgtgtgccgagggatacgaac

SEQ ID NO: 804838 - DNA, 25 bp, Mus musculus
tgcacgttctctccagctctttaga

SEQ ID NO: 804839 - DNA, 25 bp, Mus musculus
tgcacgttctctgcagctctttaga

SEQ ID NO: 804840 - DNA, 25 bp, Mus musculus
tgcacgttcttgacatgcctcaggg

SEQ ID NO: 804841 - DNA, 25 bp, Mus musculus
tgcacgttcttgtcatgcctcaggg

SEQ ID NO: 804842 - DNA, 25 bp, Mus musculus
tgcacgttgcctcctttctgaggaa

SEQ ID NO: 804843 - DNA, 25 bp, Mus musculus
tgcacgttgcctgctttctgaggaa

SEQ ID NO: 804844 - DNA, 25 bp, Mus musculus
tgcactaaagatccgcggctgcagc

SEQ ID NO: 804845 - DNA, 25 bp, Mus musculus
tgcactaaagatgcgcggctgcagc

SEQ ID NO: 804846 - DNA, 25 bp, Mus musculus
tgcactaagggtctttggaggcaat

SEQ ID NO: 804847 - DNA, 25 bp, Mus musculus
tgcactaagggtgtttggaggcaat

SEQ ID NO: 804848 - DNA, 25 bp, Mus musculus
tgcactacctgtcagaccacgtgct

SEQ ID NO: 804849 - DNA, 25 bp, Mus musculus
tgcactacctgtgagaccacgtgct

SEQ ID NO: 804850 - DNA, 25 bp, Mus musculus
tgcactacttggaggtctacctgac

SEQ ID NO: 804851 - DNA, 25 bp, Mus musculus
tgcactacttggtggtctacctgac

SEQ ID NO: 804852 - DNA, 25 bp, Mus musculus
tgcactagcggaactctggtaccaa

SEQ ID NO: 804853 - DNA, 25 bp, Mus musculus
tgcactagcggatctctggtaccaa

SEQ ID NO: 804854 - DNA, 25 bp, Mus musculus
tgcactaggccgaatgacctggaag

SEQ ID NO: 804855 - DNA, 25 bp, Mus musculus
tgcactaggccgtatgacctggaag

SEQ ID NO: 804856 - DNA, 25 bp, Mus musculus
tgcactatctcgagaagagcaggcc

SEQ ID NO: 804857 - DNA, 25 bp, Mus musculus
tgcactatctcgtgaagagcaggcc

SEQ ID NO: 804858 - DNA, 25 bp, Mus musculus
tgcactattggaatagctccatggg

SEQ ID NO: 804859 - DNA, 25 bp, Mus musculus
tgcactattggattagctccatggg

SEQ ID NO: 804860 - DNA, 25 bp, Mus musculus
tgcactcacagaagagaagacaaaa

SEQ ID NO: 804861 - DNA, 25 bp, Mus musculus
tgcactcacagatgagaagacaaaa

SEQ ID NO: 804862 - DNA, 25 bp, Mus musculus
tgcactcagggtatcatggccagca

SEQ ID NO: 804863 - DNA, 25 bp, Mus musculus
tgcactcagggtttcatggccagca

SEQ ID NO: 804864 - DNA, 25 bp, Mus musculus
tgcactccacacaatcagcatcaag

SEQ ID NO: 804865 - DNA, 25 bp, Mus musculus
tgcactccacactatcagcatcaag

SEQ ID NO: 804866 - DNA, 25 bp, Mus musculus
tgcactccagggagcactgatgata

SEQ ID NO: 804867 - DNA, 25 bp, Mus musculus
tgcactccagggtgcactgatgata

SEQ ID NO: 804868 - DNA, 25 bp, Mus musculus
tgcactccatgaacacgcgcaaggt

SEQ ID NO: 804869 - DNA, 25 bp, Mus musculus
tgcactccatgatcacgcgcaaggt

SEQ ID NO: 804870 - DNA, 25 bp, Mus musculus
tgcactcccattacttcagcttggg

SEQ ID NO: 804871 - DNA, 25 bp, Mus musculus
tgcactcccatttcttcagcttggg

SEQ ID NO: 804872 - DNA, 25 bp, Mus musculus
tgcactcctggaccaatttgcttcc

SEQ ID NO: 804873 - DNA, 25 bp, Mus musculus
tgcactcctggagcaatttgcttcc

SEQ ID NO: 804874 - DNA, 25 bp, Mus musculus
tgcactcctgggaccggaagggcca

SEQ ID NO: 804875 - DNA, 25 bp, Mus musculus
tgcactcctgggtccggaagggcca

SEQ ID NO: 804876 - DNA, 25 bp, Mus musculus
tgcactcctgtacctctgagggaag

SEQ ID NO: 804877 - DNA, 25 bp, Mus musculus
tgcactcctgtagctctgagggaag

SEQ ID NO: 804878 - DNA, 25 bp, Mus musculus
tgcactcgcctcatcaaaccaaagg

SEQ ID NO: 804879 - DNA, 25 bp, Mus musculus
tgcactcgcctcttcaaaccaaagg

SEQ ID NO: 804880 - DNA, 25 bp, Mus musculus
tgcactcgggcacactgcaggtgtt

SEQ ID NO: 804881 - DNA, 25 bp, Mus musculus
tgcactcgggcagactgcaggtgtt

SEQ ID NO: 804882 - DNA, 25 bp, Mus musculus
tgcactctccatagcccctaggtta

SEQ ID NO: 804883 - DNA, 25 bp, Mus musculus
tgcactctccattgcccctaggtta

SEQ ID NO: 804884 - DNA, 25 bp, Mus musculus
tgcactctgagacaaggaaccttta

SEQ ID NO: 804885 - DNA, 25 bp, Mus musculus
tgcactctgagagaaggaaccttta

SEQ ID NO: 804886 - DNA, 25 bp, Mus musculus
tgcactctgtggaagcctccaggag

SEQ ID NO: 804887 - DNA, 25 bp, Mus musculus
tgcactctgtggtagcctccaggag

SEQ ID NO: 804888 - DNA, 25 bp, Mus musculus
tgcactcttgagcagcgccgaaaac

SEQ ID NO: 804889 - DNA, 25 bp, Mus musculus
tgcactcttgaggagcgccgaaaac

SEQ ID NO: 804890 - DNA, 25 bp, Mus musculus
tgcactctttggaatgaaatgtacc

SEQ ID NO: 804891 - DNA, 25 bp, Mus musculus
tgcactctttggtatgaaatgtacc

SEQ ID NO: 804892 - DNA, 25 bp, Mus musculus
tgcactgaacgcacggtcggctgag

SEQ ID NO: 804893 - DNA, 25 bp, Mus musculus
tgcactgaacgctcggtcggctgag

SEQ ID NO: 804894 - DNA, 25 bp, Mus musculus
tgcactgaagaactggtgccagagg

SEQ ID NO: 804895 - DNA, 25 bp, Mus musculus
tgcactgaagaagtggtgccagagg

SEQ ID NO: 804896 - DNA, 25 bp, Mus musculus
tgcactgagcgacacggccctgaag

SEQ ID NO: 804897 - DNA, 25 bp, Mus musculus
tgcactgagcgagacggccctgaag

SEQ ID NO: 804898 - DNA, 25 bp, Mus musculus
tgcactgaggagatacattcagccc

SEQ ID NO: 804899 - DNA, 25 bp, Mus musculus
tgcactgaggagatggcccatcgag

SEQ ID NO: 804900 - DNA, 25 bp, Mus musculus
tgcactgaggagttacattcagccc

SEQ ID NO: 804901 - DNA, 25 bp, Mus musculus
tgcactgaggagttggcccatcgag

SEQ ID NO: 804902 - DNA, 25 bp, Mus musculus
tgcactgagggacctttgccgtata

SEQ ID NO: 804903 - DNA, 25 bp, Mus musculus
tgcactgagggagctttgccgtata

SEQ ID NO: 804904 - DNA, 25 bp, Mus musculus
tgcactgatcccagctgtgaccatt

SEQ ID NO: 804905 - DNA, 25 bp, Mus musculus
tgcactgatccctgctgtgaccatt

SEQ ID NO: 804906 - DNA, 25 bp, Mus musculus
tgcactgattcaaccagctaagatc

SEQ ID NO: 804907 - DNA, 25 bp, Mus musculus
tgcactgattcatccagctaagatc

SEQ ID NO: 804908 - DNA, 25 bp, Mus musculus
tgcactgcaagcagaggtatgggct

SEQ ID NO: 804909 - DNA, 25 bp, Mus musculus
tgcactgcaagctgaggtatgggct

SEQ ID NO: 804910 - DNA, 25 bp, Mus musculus
tgcactgcagctcatggcggagttc

SEQ ID NO: 804911 - DNA, 25 bp, Mus musculus
tgcactgcagctccaagaacctggc

SEQ ID NO: 804912 - DNA, 25 bp, Mus musculus
tgcactgcagctgatggcggagttc

SEQ ID NO: 804913 - DNA, 25 bp, Mus musculus
tgcactgcagctgcaagaacctggc

SEQ ID NO: 804914 - DNA, 25 bp, Mus musculus
tgcactgcccatcgatacatggcca

SEQ ID NO: 804915 - DNA, 25 bp, Mus musculus
tgcactgcccatggatacatggcca

SEQ ID NO: 804916 - DNA, 25 bp, Mus musculus
tgcactgcctcaatacacttttctc

SEQ ID NO: 804917 - DNA, 25 bp, Mus musculus
tgcactgcctcattacacttttctc

SEQ ID NO: 804918 - DNA, 25 bp, Mus musculus
tgcactgcgagaccaatctagacgg

SEQ ID NO: 804919 - DNA, 25 bp, Mus musculus
tgcactgcgagagcaatctagacgg

SEQ ID NO: 804920 - DNA, 25 bp, Mus musculus
tgcactgctcagctgactcagggcc

SEQ ID NO: 804921 - DNA, 25 bp, Mus musculus
tgcactgctcaggtgactcagggcc

SEQ ID NO: 804922 - DNA, 25 bp, Mus musculus
tgcactgctccgagagggtttccgt

SEQ ID NO: 804923 - DNA, 25 bp, Mus musculus
tgcactgctccgtgagggtttccgt

SEQ ID NO: 804924 - DNA, 25 bp, Mus musculus
tgcactggaaagcacgcaggcagct

SEQ ID NO: 804925 - DNA, 25 bp, Mus musculus
tgcactggaaaggacgcaggcagct

SEQ ID NO: 804926 - DNA, 25 bp, Mus musculus
tgcactggaatgcaagcctgaaagc

SEQ ID NO: 804927 - DNA, 25 bp, Mus musculus
tgcactggaatggaagcctgaaagc

SEQ ID NO: 804928 - DNA, 25 bp, Mus musculus
tgcactggcagacttcaaccgagct

SEQ ID NO: 804929 - DNA, 25 bp, Mus musculus
tgcactggcagagttcaaccgagct

SEQ ID NO: 804930 - DNA, 25 bp, Mus musculus
tgcactgggcaaacatgactactgg

SEQ ID NO: 804931 - DNA, 25 bp, Mus musculus
tgcactgggcaatcatgactactgg

SEQ ID NO: 804932 - DNA, 25 bp, Mus musculus
tgcactgggcataggtgtctaccct

SEQ ID NO: 804933 - DNA, 25 bp, Mus musculus
tgcactgggcattggtgtctaccct

SEQ ID NO: 804934 - DNA, 25 bp, Mus musculus
tgcactgggccgctgctgtgaacaa

SEQ ID NO: 804935 - DNA, 25 bp, Mus musculus
tgcactgggccggtgctgtgaacaa

SEQ ID NO: 804936 - DNA, 25 bp, Mus musculus
tgcactgggcgcaggaaacattgac

SEQ ID NO: 804937 - DNA, 25 bp, Mus musculus
tgcactgggcgctggaaacattgac

SEQ ID NO: 804938 - DNA, 25 bp, Mus musculus
tgcactggtacaatcatctggctgg

SEQ ID NO: 804939 - DNA, 25 bp, Mus musculus
tgcactggtacattcatctggctgg

SEQ ID NO: 804940 - DNA, 25 bp, Mus musculus
tgcactggtcctctaacaatggcta

SEQ ID NO: 804941 - DNA, 25 bp, Mus musculus
tgcactggtcctgtaacaatggcta

SEQ ID NO: 804942 - DNA, 25 bp, Mus musculus
tgcactggtgcacgctcagacaggc

SEQ ID NO: 804943 - DNA, 25 bp, Mus musculus
tgcactggtgcaggctcagacaggc

SEQ ID NO: 804944 - DNA, 25 bp, Mus musculus
tgcactgtaaagatcctaaaagaaa

SEQ ID NO: 804945 - DNA, 25 bp, Mus musculus
tgcactgtaaagttcctaaaagaaa

SEQ ID NO: 804946 - DNA, 25 bp, Mus musculus
tgcactgtaatcctgctctcctgtc

SEQ ID NO: 804947 - DNA, 25 bp, Mus musculus
tgcactgtaatcgtgctctcctgtc

SEQ ID NO: 804948 - DNA, 25 bp, Mus musculus
tgcactgtccagctgaagttagagc

SEQ ID NO: 804949 - DNA, 25 bp, Mus musculus
tgcactgtccaggtgaagttagagc

SEQ ID NO: 804950 - DNA, 25 bp, Mus musculus
tgcactgttgtgcaattcataacta

SEQ ID NO: 804951 - DNA, 25 bp, Mus musculus
tgcactgttgtggaattcataacta

SEQ ID NO: 804952 - DNA, 25 bp, Mus musculus
tgcacttacttccattgaggccagg

SEQ ID NO: 804953 - DNA, 25 bp, Mus musculus
tgcacttacttcgattgaggccagg

SEQ ID NO: 804954 - DNA, 25 bp, Mus musculus
tgcacttagctgaccatgcagagaa

SEQ ID NO: 804955 - DNA, 25 bp, Mus musculus
tgcacttagctgtccatgcagagaa

SEQ ID NO: 804956 - DNA, 25 bp, Mus musculus
tgcacttagtcacagaggtcttcca

SEQ ID NO: 804957 - DNA, 25 bp, Mus musculus
tgcacttagtcagagaggtcttcca

SEQ ID NO: 804958 - DNA, 25 bp, Mus musculus
tgcacttcaattcaggagccaaact

SEQ ID NO: 804959 - DNA, 25 bp, Mus musculus
tgcacttcaattgaggagccaaact

SEQ ID NO: 804960 - DNA, 25 bp, Mus musculus
tgcacttcagcgactatgacttcga

SEQ ID NO: 804961 - DNA, 25 bp, Mus musculus
tgcacttcagcgtctatgacttcga

SEQ ID NO: 804962 - DNA, 25 bp, Mus musculus
tgcacttcaggtctacccatgacct

SEQ ID NO: 804963 - DNA, 25 bp, Mus musculus
tgcacttcaggtgtacccatgacct

SEQ ID NO: 804964 - DNA, 25 bp, Mus musculus
tgcacttccaagattcccagagaca

SEQ ID NO: 804965 - DNA, 25 bp, Mus musculus
tgcacttccaagtttcccagagaca

SEQ ID NO: 804966 - DNA, 25 bp, Mus musculus
tgcacttccatacaagctagctggg

SEQ ID NO: 804967 - DNA, 25 bp, Mus musculus
tgcacttccatagaagctagctggg

SEQ ID NO: 804968 - DNA, 25 bp, Mus musculus
tgcacttcgggacctcaaacttcga

SEQ ID NO: 804969 - DNA, 25 bp, Mus musculus
tgcacttcgggagctcaaacttcga

SEQ ID NO: 804970 - DNA, 25 bp, Mus musculus
tgcacttgcctcagatgcctgtaaa

SEQ ID NO: 804971 - DNA, 25 bp, Mus musculus
tgcacttgcctctgatgcctgtaaa

SEQ ID NO: 804972 - DNA, 25 bp, Mus musculus
tgcacttggctactcaaaacgggtc

SEQ ID NO: 804973 - DNA, 25 bp, Mus musculus
tgcacttggctagtcaaaacgggtc

SEQ ID NO: 804974 - DNA, 25 bp, Mus musculus
tgcacttgggccacttggtccacag

SEQ ID NO: 804975 - DNA, 25 bp, Mus musculus
tgcacttgggcctcttggtccacag

SEQ ID NO: 804976 - DNA, 25 bp, Mus musculus
tgcacttggtatctgtatacatgga

SEQ ID NO: 804977 - DNA, 25 bp, Mus musculus
tgcacttggtatgtgtatacatgga

SEQ ID NO: 804978 - DNA, 25 bp, Mus musculus
tgcacttgtatgacacccgaggcct

SEQ ID NO: 804979 - DNA, 25 bp, Mus musculus
tgcacttgtatgtcacccgaggcct

SEQ ID NO: 804980 - DNA, 25 bp, Mus musculus
tgcacttgtctcatttgtggaggcc

SEQ ID NO: 804981 - DNA, 25 bp, Mus musculus
tgcacttgtctcttttgtggaggcc

SEQ ID NO: 804982 - DNA, 25 bp, Mus musculus
tgcactttactactcgaggctgaaa

SEQ ID NO: 804983 - DNA, 25 bp, Mus musculus
tgcactttactagtcgaggctgaaa

SEQ ID NO: 804984 - DNA, 25 bp, Mus musculus
tgcactttacttcggagaagaagta

SEQ ID NO: 804985 - DNA, 25 bp, Mus musculus
tgcactttacttgggagaagaagta

SEQ ID NO: 804986 - DNA, 25 bp, Mus musculus
tgcactttcaggctccagcgacctg

SEQ ID NO: 804987 - DNA, 25 bp, Mus musculus
tgcactttcagggtccagcgacctg

SEQ ID NO: 804988 - DNA, 25 bp, Mus musculus
tgcactttgctgacgctgatggaaa

SEQ ID NO: 804989 - DNA, 25 bp, Mus musculus
tgcactttgctgtcgctgatggaaa

SEQ ID NO: 804990 - DNA, 25 bp, Mus musculus
tgcagaaaacaacatttccctttgg

SEQ ID NO: 804991 - DNA, 25 bp, Mus musculus
tgcagaaaacaagatttccctttgg

SEQ ID NO: 804992 - DNA, 25 bp, Mus musculus
tgcagaaaaccccagccatgattgg

SEQ ID NO: 804993 - DNA, 25 bp, Mus musculus
tgcagaaaacccgagccatgattgg

SEQ ID NO: 804994 - DNA, 25 bp, Mus musculus
tgcagaaaatcaacgtatcctcctt

SEQ ID NO: 804995 - DNA, 25 bp, Mus musculus
tgcagaaaatcatcgtatcctcctt

SEQ ID NO: 804996 - DNA, 25 bp, Mus musculus
tgcagaaacgacctgggaccctcag

SEQ ID NO: 804997 - DNA, 25 bp, Mus musculus
tgcagaaacgacgtgggaccctcag

SEQ ID NO: 804998 - DNA, 25 bp, Mus musculus
tgcagaaacgagcttgccaaaacca

SEQ ID NO: 804999 - DNA, 25 bp, Mus musculus
tgcagaaacgaggttgccaaaacca

SEQ ID NO: 805000 - DNA, 25 bp, Mus musculus
tgcagaaacgatcgcggctctgacc

SEQ ID NO: 805001 - DNA, 25 bp, Mus musculus
tgcagaaacgatggcggctctgacc

SEQ ID NO: 805002 - DNA, 25 bp, Mus musculus
tgcagaaactgccagaggacctaac

SEQ ID NO: 805003 - DNA, 25 bp, Mus musculus
tgcagaaactgcgagaggacctaac

SEQ ID NO: 805004 - DNA, 25 bp, Mus musculus
tgcagaaacttactttgaaagtgcc

SEQ ID NO: 805005 - DNA, 25 bp, Mus musculus
tgcagaaacttagtttgaaagtgcc

SEQ ID NO: 805006 - DNA, 25 bp, Mus musculus
tgcagaaagagactcctgtcactcc

SEQ ID NO: 805007 - DNA, 25 bp, Mus musculus
tgcagaaagagagtcctgtcactcc

SEQ ID NO: 805008 - DNA, 25 bp, Mus musculus
tgcagaaagtagcatctgcacttag

SEQ ID NO: 805009 - DNA, 25 bp, Mus musculus
tgcagaaagtaggatctgcacttag

SEQ ID NO: 805010 - DNA, 25 bp, Mus musculus
tgcagaaatagaagagaagcagatc

SEQ ID NO: 805011 - DNA, 25 bp, Mus musculus
tgcagaaatagatgagaagcagatc

SEQ ID NO: 805012 - DNA, 25 bp, Mus musculus
tgcagaaatcctcaggctcagagag

SEQ ID NO: 805013 - DNA, 25 bp, Mus musculus
tgcagaaatcctgaggctcagagag

SEQ ID NO: 805014 - DNA, 25 bp, Mus musculus
tgcagaaatttgctgggccctatga

SEQ ID NO: 805015 - DNA, 25 bp, Mus musculus
tgcagaaatttggtgggccctatga

SEQ ID NO: 805016 - DNA, 25 bp, Mus musculus
tgcagaacaaacagagcctgacggt

SEQ ID NO: 805017 - DNA, 25 bp, Mus musculus
tgcagaacaaactgagcctgacggt

SEQ ID NO: 805018 - DNA, 25 bp, Mus musculus
tgcagaacacacagcggagagctac

SEQ ID NO: 805019 - DNA, 25 bp, Mus musculus
tgcagaacacactgcggagagctac

SEQ ID NO: 805020 - DNA, 25 bp, Mus musculus
tgcagaacaggactacatatcggcc

SEQ ID NO: 805021 - DNA, 25 bp, Mus musculus
tgcagaacaggagtacatatcggcc

SEQ ID NO: 805022 - DNA, 25 bp, Mus musculus
tgcagaacataacatcccggttgtc

SEQ ID NO: 805023 - DNA, 25 bp, Mus musculus
tgcagaacataagatcccggttgtc

SEQ ID NO: 805024 - DNA, 25 bp, Mus musculus
tgcagaaccaacaagaccctgaaca

SEQ ID NO: 805025 - DNA, 25 bp, Mus musculus
tgcagaaccaactagaccctgaaca

SEQ ID NO: 805026 - DNA, 25 bp, Mus musculus
tgcagaaccagaccctgggtaccct

SEQ ID NO: 805027 - DNA, 25 bp, Mus musculus
tgcagaaccagagcctgggtaccct

SEQ ID NO: 805028 - DNA, 25 bp, Mus musculus
tgcagaaccggcagaaggtgttcct

SEQ ID NO: 805029 - DNA, 25 bp, Mus musculus
tgcagaaccggctgaaggtgttcct

SEQ ID NO: 805030 - DNA, 25 bp, Mus musculus
tgcagaacctcaacgtaagagacat

SEQ ID NO: 805031 - DNA, 25 bp, Mus musculus
tgcagaacctcatcgtaagagacat

SEQ ID NO: 805032 - DNA, 25 bp, Mus musculus
tgcagaactggaagcagtcaaggaa

SEQ ID NO: 805033 - DNA, 25 bp, Mus musculus
tgcagaactggatgcagtcaaggaa

SEQ ID NO: 805034 - DNA, 25 bp, Mus musculus
tgcagaactggtcccttggcatagc

SEQ ID NO: 805035 - DNA, 25 bp, Mus musculus
tgcagaactggtgccttggcatagc

SEQ ID NO: 805036 - DNA, 25 bp, Mus musculus
tgcagaacttgaagagccgggttca

SEQ ID NO: 805037 - DNA, 25 bp, Mus musculus
tgcagaacttgatgagccgggttca

SEQ ID NO: 805038 - DNA, 25 bp, Mus musculus
tgcagaacttgcaggtgggccaccc

SEQ ID NO: 805039 - DNA, 25 bp, Mus musculus
tgcagaacttgctggtgggccaccc

SEQ ID NO: 805040 - DNA, 25 bp, Mus musculus
tgcagaagaagacaaagcgaggcca

SEQ ID NO: 805041 - DNA, 25 bp, Mus musculus
tgcagaagaagagaaagcgaggcca

SEQ ID NO: 805042 - DNA, 25 bp, Mus musculus
tgcagaagaagcatgcagaagaacc

SEQ ID NO: 805043 - DNA, 25 bp, Mus musculus
tgcagaagaagcttgcagaagaacc

SEQ ID NO: 805044 - DNA, 25 bp, Mus musculus
tgcagaagagaacagccgaacttca

SEQ ID NO: 805045 - DNA, 25 bp, Mus musculus
tgcagaagagaagagccgaacttca

SEQ ID NO: 805046 - DNA, 25 bp, Mus musculus
tgcagaagagacattggaacatcct

SEQ ID NO: 805047 - DNA, 25 bp, Mus musculus
tgcagaagagactttggaacatcct

SEQ ID NO: 805048 - DNA, 25 bp, Mus musculus
tgcagaagagcgacaagaactggag

SEQ ID NO: 805049 - DNA, 25 bp, Mus musculus
tgcagaagagcgtcaagaactggag

SEQ ID NO: 805050 - DNA, 25 bp, Mus musculus
tgcagaagatgcctccaacatcatg

SEQ ID NO: 805051 - DNA, 25 bp, Mus musculus
tgcagaagatgcgtccaacatcatg

SEQ ID NO: 805052 - DNA, 25 bp, Mus musculus
tgcagaagcattatccagatctacc

SEQ ID NO: 805053 - DNA, 25 bp, Mus musculus
tgcagaagcattttccagatctacc

SEQ ID NO: 805054 - DNA, 25 bp, Mus musculus
tgcagaagcggaacaatgtcttgcc

SEQ ID NO: 805055 - DNA, 25 bp, Mus musculus
tgcagaagcggatcaatgtcttgcc

SEQ ID NO: 805056 - DNA, 25 bp, Mus musculus
tgcagaagcgtgatgtatggcccag

SEQ ID NO: 805057 - DNA, 25 bp, Mus musculus
tgcagaagcgtgttgtatggcccag

SEQ ID NO: 805058 - DNA, 25 bp, Mus musculus
tgcagaagctaacctgggcgtcagt

SEQ ID NO: 805059 - DNA, 25 bp, Mus musculus
tgcagaagctaagctgggcgtcagt

SEQ ID NO: 805060 - DNA, 25 bp, Mus musculus
tgcagaagctcaacgatatctccat

SEQ ID NO: 805061 - DNA, 25 bp, Mus musculus
tgcagaagctcatcgatatctccat

SEQ ID NO: 805062 - DNA, 25 bp, Mus musculus
tgcagaaggcttcgccacccggaga

SEQ ID NO: 805063 - DNA, 25 bp, Mus musculus
tgcagaaggcttggccacccggaga

SEQ ID NO: 805064 - DNA, 25 bp, Mus musculus
tgcagaagggacagatgacaggtca

SEQ ID NO: 805065 - DNA, 25 bp, Mus musculus
tgcagaagggactgatgacaggtca

SEQ ID NO: 805066 - DNA, 25 bp, Mus musculus
tgcagaaggggcacagcgacaccat

SEQ ID NO: 805067 - DNA, 25 bp, Mus musculus
tgcagaaggggctcagcgacaccat

SEQ ID NO: 805068 - DNA, 25 bp, Mus musculus
tgcagaatacttaatcaaccaggga

SEQ ID NO: 805069 - DNA, 25 bp, Mus musculus
tgcagaatactttatcaaccaggga

SEQ ID NO: 805070 - DNA, 25 bp, Mus musculus
tgcagaatccacacctaagccgggg

SEQ ID NO: 805071 - DNA, 25 bp, Mus musculus
tgcagaatccactcctaagccgggg

SEQ ID NO: 805072 - DNA, 25 bp, Mus musculus
tgcagaatcctgacggcatcaatgg

SEQ ID NO: 805073 - DNA, 25 bp, Mus musculus
tgcagaatcctgtcggcatcaatgg

SEQ ID NO: 805074 - DNA, 25 bp, Mus musculus
tgcagaatctggataacaacggata

SEQ ID NO: 805075 - DNA, 25 bp, Mus musculus
tgcagaatctggttaacaacggata

SEQ ID NO: 805076 - DNA, 25 bp, Mus musculus
tgcagaattcagctacaatggggaa

SEQ ID NO: 805077 - DNA, 25 bp, Mus musculus
tgcagaattcaggtacaatggggaa

SEQ ID NO: 805078 - DNA, 25 bp, Mus musculus
tgcagaatttgaccgacagttcctt

SEQ ID NO: 805079 - DNA, 25 bp, Mus musculus
tgcagaatttgagcgacagttcctt

SEQ ID NO: 805080 - DNA, 25 bp, Mus musculus
tgcagacaaaacaaaaattagaaga

SEQ ID NO: 805081 - DNA, 25 bp, Mus musculus
tgcagacaaaactaaaattagaaga

SEQ ID NO: 805082 - DNA, 25 bp, Mus musculus
tgcagacaaagaccggcatctgggc

SEQ ID NO: 805083 - DNA, 25 bp, Mus musculus
tgcagacaaagagcggcatctgggc

SEQ ID NO: 805084 - DNA, 25 bp, Mus musculus
tgcagacaagaacagcttcatttcc

SEQ ID NO: 805085 - DNA, 25 bp, Mus musculus
tgcagacaagaactccaaccccgtt

SEQ ID NO: 805086 - DNA, 25 bp, Mus musculus
tgcagacaagaagagcttcatttcc

SEQ ID NO: 805087 - DNA, 25 bp, Mus musculus
tgcagacaagaagtccaaccccgtt

SEQ ID NO: 805088 - DNA, 25 bp, Mus musculus
tgcagacaagatcggcgctatcctg

SEQ ID NO: 805089 - DNA, 25 bp, Mus musculus
tgcagacaagatgggcgctatcctg

SEQ ID NO: 805090 - DNA, 25 bp, Mus musculus
tgcagacaagctcttacatatcaag

SEQ ID NO: 805091 - DNA, 25 bp, Mus musculus
tgcagacaagctgttacatatcaag

SEQ ID NO: 805092 - DNA, 25 bp, Mus musculus
tgcagacaatgaaaatccaccagag

SEQ ID NO: 805093 - DNA, 25 bp, Mus musculus
tgcagacaatgataatccaccagag

SEQ ID NO: 805094 - DNA, 25 bp, Mus musculus
tgcagacacaacaatgagatctcgg

SEQ ID NO: 805095 - DNA, 25 bp, Mus musculus
tgcagacacaactatgagatctcgg

SEQ ID NO: 805096 - DNA, 25 bp, Mus musculus
tgcagacaccatagctgtggagccg

SEQ ID NO: 805097 - DNA, 25 bp, Mus musculus
tgcagacaccattgctgtggagccg

SEQ ID NO: 805098 - DNA, 25 bp, Mus musculus
tgcagacactgaaggagcacactga

SEQ ID NO: 805099 - DNA, 25 bp, Mus musculus
tgcagacactgatggagcacactga

SEQ ID NO: 805100 - DNA, 25 bp, Mus musculus
tgcagacactgcaactcatggtgct

SEQ ID NO: 805101 - DNA, 25 bp, Mus musculus
tgcagacactgctactcatggtgct

SEQ ID NO: 805102 - DNA, 25 bp, Mus musculus
tgcagacatcgacagcactcatagg

SEQ ID NO: 805103 - DNA, 25 bp, Mus musculus
tgcagacatcgagagcactcatagg

SEQ ID NO: 805104 - DNA, 25 bp, Mus musculus
tgcagacatctgcttcaccaaggag

SEQ ID NO: 805105 - DNA, 25 bp, Mus musculus
tgcagacatctggttcaccaaggag

SEQ ID NO: 805106 - DNA, 25 bp, Mus musculus
tgcagacatggactgcaagctcggt

SEQ ID NO: 805107 - DNA, 25 bp, Mus musculus
tgcagacatggagtgcaagctcggt

SEQ ID NO: 805108 - DNA, 25 bp, Mus musculus
tgcagaccaagaacccgaactacat

SEQ ID NO: 805109 - DNA, 25 bp, Mus musculus
tgcagaccaagatcccgaactacat

SEQ ID NO: 805110 - DNA, 25 bp, Mus musculus
tgcagaccacatatgctttacagag

SEQ ID NO: 805111 - DNA, 25 bp, Mus musculus
tgcagaccacatttgctttacagag

SEQ ID NO: 805112 - DNA, 25 bp, Mus musculus
tgcagaccagaactgtgaagatgcg

SEQ ID NO: 805113 - DNA, 25 bp, Mus musculus
tgcagaccagaagtgtgaagatgcg

SEQ ID NO: 805114 - DNA, 25 bp, Mus musculus
tgcagaccagatcttcctgctgaag

SEQ ID NO: 805115 - DNA, 25 bp, Mus musculus
tgcagaccagatgttcctgctgaag

SEQ ID NO: 805116 - DNA, 25 bp, Mus musculus
tgcagaccagcgacatcaagagctt

SEQ ID NO: 805117 - DNA, 25 bp, Mus musculus
tgcagaccagcgtcatcaagagctt

SEQ ID NO: 805118 - DNA, 25 bp, Mus musculus
tgcagaccaggaatccacactagct

SEQ ID NO: 805119 - DNA, 25 bp, Mus musculus
tgcagaccaggattccacactagct

SEQ ID NO: 805120 - DNA, 25 bp, Mus musculus
tgcagaccctgaaaacaatagccgc

SEQ ID NO: 805121 - DNA, 25 bp, Mus musculus
tgcagaccctgaaagccggacagtg

SEQ ID NO: 805122 - DNA, 25 bp, Mus musculus
tgcagaccctgataacaatagccgc

SEQ ID NO: 805123 - DNA, 25 bp, Mus musculus
tgcagaccctgatagccggacagtg

SEQ ID NO: 805124 - DNA, 25 bp, Mus musculus
tgcagaccctgtagccctgatggta

SEQ ID NO: 805125 - DNA, 25 bp, Mus musculus
tgcagaccctgttgccctgatggta

SEQ ID NO: 805126 - DNA, 25 bp, Mus musculus
tgcagaccggccaagcttttccaac

SEQ ID NO: 805127 - DNA, 25 bp, Mus musculus
tgcagaccggcctagcttttccaac

SEQ ID NO: 805128 - DNA, 25 bp, Mus musculus
tgcagacctcccagggcaagatgag

SEQ ID NO: 805129 - DNA, 25 bp, Mus musculus
tgcagacctccctgggcaagatgag

SEQ ID NO: 805130 - DNA, 25 bp, Mus musculus
tgcagacctggcaatggcgttcagc

SEQ ID NO: 805131 - DNA, 25 bp, Mus musculus
tgcagacctggcacgaagaaaggat

SEQ ID NO: 805132 - DNA, 25 bp, Mus musculus
tgcagacctggctatggcgttcagc

SEQ ID NO: 805133 - DNA, 25 bp, Mus musculus
tgcagacctggctcgaagaaaggat

SEQ ID NO: 805134 - DNA, 25 bp, Mus musculus
tgcagacctgtgacaatctcatcac

SEQ ID NO: 805135 - DNA, 25 bp, Mus musculus
tgcagacctgtgtcaatctcatcac

SEQ ID NO: 805136 - DNA, 25 bp, Mus musculus
tgcagacctgttcggaccccttctg

SEQ ID NO: 805137 - DNA, 25 bp, Mus musculus
tgcagacctgttgggaccccttctg

SEQ ID NO: 805138 - DNA, 25 bp, Mus musculus
tgcagacgacccagtatcacaactc

SEQ ID NO: 805139 - DNA, 25 bp, Mus musculus
tgcagacgaccctgtatcacaactc

SEQ ID NO: 805140 - DNA, 25 bp, Mus musculus
tgcagacgagaaaacaccatgatgt

SEQ ID NO: 805141 - DNA, 25 bp, Mus musculus
tgcagacgagaatacaccatgatgt

SEQ ID NO: 805142 - DNA, 25 bp, Mus musculus
tgcagacgtacacaaggacggaatg

SEQ ID NO: 805143 - DNA, 25 bp, Mus musculus
tgcagacgtacagaaggacggaatg

SEQ ID NO: 805144 - DNA, 25 bp, Mus musculus
tgcagacgtacgagcagctcaccat

SEQ ID NO: 805145 - DNA, 25 bp, Mus musculus
tgcagacgtacgtgcagctcaccat

SEQ ID NO: 805146 - DNA, 25 bp, Mus musculus
tgcagactacaccttccctttgcag

SEQ ID NO: 805147 - DNA, 25 bp, Mus musculus
tgcagactacacgttccctttgcag

SEQ ID NO: 805148 - DNA, 25 bp, Mus musculus
tgcagactacatccacagaaatgct

SEQ ID NO: 805149 - DNA, 25 bp, Mus musculus
tgcagactacatgcacagaaatgct

SEQ ID NO: 805150 - DNA, 25 bp, Mus musculus
tgcagactagacagctgccctcatc

SEQ ID NO: 805151 - DNA, 25 bp, Mus musculus
tgcagactagactgctgccctcatc

SEQ ID NO: 805152 - DNA, 25 bp, Mus musculus
tgcagactatgaccggggcaagacc

SEQ ID NO: 805153 - DNA, 25 bp, Mus musculus
tgcagactatgagcggggcaagacc

SEQ ID NO: 805154 - DNA, 25 bp, Mus musculus
tgcagactattaccacaaggactgg

SEQ ID NO: 805155 - DNA, 25 bp, Mus musculus
tgcagactattagcacaaggactgg

SEQ ID NO: 805156 - DNA, 25 bp, Mus musculus
tgcagactcagtacaaggagaaagg

SEQ ID NO: 805157 - DNA, 25 bp, Mus musculus
tgcagactcagttcaaggagaaagg

SEQ ID NO: 805158 - DNA, 25 bp, Mus musculus
tgcagactccctcagtgactgggct

SEQ ID NO: 805159 - DNA, 25 bp, Mus musculus
tgcagactccctgagtgactgggct

SEQ ID NO: 805160 - DNA, 25 bp, Mus musculus
tgcagactctaacgcctcagggctt

SEQ ID NO: 805161 - DNA, 25 bp, Mus musculus
tgcagactctaaggcctcagggctt

SEQ ID NO: 805162 - DNA, 25 bp, Mus musculus
tgcagactcttacacatggagttgg

SEQ ID NO: 805163 - DNA, 25 bp, Mus musculus
tgcagactcttagacatggagttgg

SEQ ID NO: 805164 - DNA, 25 bp, Mus musculus
tgcagactgaccaatcacgggcttt

SEQ ID NO: 805165 - DNA, 25 bp, Mus musculus
tgcagactgacctatcacgggcttt

SEQ ID NO: 805166 - DNA, 25 bp, Mus musculus
tgcagactgtgcctatcgtgaccta

SEQ ID NO: 805167 - DNA, 25 bp, Mus musculus
tgcagactgtgcgtatcgtgaccta

SEQ ID NO: 805168 - DNA, 25 bp, Mus musculus
tgcagacttccaattttgcccatgt

SEQ ID NO: 805169 - DNA, 25 bp, Mus musculus
tgcagacttccatttttgcccatgt

SEQ ID NO: 805170 - DNA, 25 bp, Mus musculus
tgcagacttcctcgtctatgatgtc

SEQ ID NO: 805171 - DNA, 25 bp, Mus musculus
tgcagacttcctggtctatgatgtc

SEQ ID NO: 805172 - DNA, 25 bp, Mus musculus
tgcagacttcgtccatccagcaggg

SEQ ID NO: 805173 - DNA, 25 bp, Mus musculus
tgcagacttcgtgcatccagcaggg

SEQ ID NO: 805174 - DNA, 25 bp, Mus musculus
tgcagacttcttagaggatgacacc

SEQ ID NO: 805175 - DNA, 25 bp, Mus musculus
tgcagacttcttcgctggattggcc

SEQ ID NO: 805176 - DNA, 25 bp, Mus musculus
tgcagacttcttggctggattggcc

SEQ ID NO: 805177 - DNA, 25 bp, Mus musculus
tgcagacttctttgaggatgacacc

SEQ ID NO: 805178 - DNA, 25 bp, Mus musculus
tgcagactttggagtcgcaggtcaa

SEQ ID NO: 805179 - DNA, 25 bp, Mus musculus
tgcagactttggctttagcaacgaa

SEQ ID NO: 805180 - DNA, 25 bp, Mus musculus
tgcagactttgggtttagcaacgaa

SEQ ID NO: 805181 - DNA, 25 bp, Mus musculus
tgcagactttggtgtcgcaggtcaa

SEQ ID NO: 805182 - DNA, 25 bp, Mus musculus
tgcagacttttgagccgcagcctgg

SEQ ID NO: 805183 - DNA, 25 bp, Mus musculus
tgcagacttttgtgccgcagcctgg

SEQ ID NO: 805184 - DNA, 25 bp, Mus musculus
tgcagagaaccgcaagaaaactatg

SEQ ID NO: 805185 - DNA, 25 bp, Mus musculus
tgcagagaaccggaagaaaactatg

SEQ ID NO: 805186 - DNA, 25 bp, Mus musculus
tgcagagaacctagtcccaaaccag

SEQ ID NO: 805187 - DNA, 25 bp, Mus musculus
tgcagagaaccttgtcccaaaccag

SEQ ID NO: 805188 - DNA, 25 bp, Mus musculus
tgcagagaacgtcggaaaatccgct

SEQ ID NO: 805189 - DNA, 25 bp, Mus musculus
tgcagagaacgtgggaaaatccgct

SEQ ID NO: 805190 - DNA, 25 bp, Mus musculus
tgcagagaagtcagcttagcgagca

SEQ ID NO: 805191 - DNA, 25 bp, Mus musculus
tgcagagaagtctgcttagcgagca

SEQ ID NO: 805192 - DNA, 25 bp, Mus musculus
tgcagagaataaagagcttgagaag

SEQ ID NO: 805193 - DNA, 25 bp, Mus musculus
tgcagagaataatgagcttgagaag

SEQ ID NO: 805194 - DNA, 25 bp, Mus musculus
tgcagagaatatagttgatgagcgt

SEQ ID NO: 805195 - DNA, 25 bp, Mus musculus
tgcagagaatattgttgatgagcgt

SEQ ID NO: 805196 - DNA, 25 bp, Mus musculus
tgcagagaatttcatccagttccct

SEQ ID NO: 805197 - DNA, 25 bp, Mus musculus
tgcagagaatttgatccagttccct

SEQ ID NO: 805198 - DNA, 25 bp, Mus musculus
tgcagagacaccagctgagccagtg

SEQ ID NO: 805199 - DNA, 25 bp, Mus musculus
tgcagagacacctgctgagccagtg

SEQ ID NO: 805200 - DNA, 25 bp, Mus musculus
tgcagagacagcaagctatccagcg

SEQ ID NO: 805201 - DNA, 25 bp, Mus musculus
tgcagagacagctagctatccagcg

SEQ ID NO: 805202 - DNA, 25 bp, Mus musculus
tgcagagactcaccagaagtttgtt

SEQ ID NO: 805203 - DNA, 25 bp, Mus musculus
tgcagagactcagcagaagtttgtt

SEQ ID NO: 805204 - DNA, 25 bp, Mus musculus
tgcagagagaagaacagtgtattct

SEQ ID NO: 805205 - DNA, 25 bp, Mus musculus
tgcagagagaagtacagtgtattct

SEQ ID NO: 805206 - DNA, 25 bp, Mus musculus
tgcagagagatcagtaaccaaattg

SEQ ID NO: 805207 - DNA, 25 bp, Mus musculus
tgcagagagatctgtaaccaaattg

SEQ ID NO: 805208 - DNA, 25 bp, Mus musculus
tgcagagagccacagtgcacgtgcc

SEQ ID NO: 805209 - DNA, 25 bp, Mus musculus
tgcagagagccagagtgcacgtgcc

SEQ ID NO: 805210 - DNA, 25 bp, Mus musculus
tgcagagagccccagattattgccc

SEQ ID NO: 805211 - DNA, 25 bp, Mus musculus
tgcagagagcccgagattattgccc

SEQ ID NO: 805212 - DNA, 25 bp, Mus musculus
tgcagagagggccacgacctgctac

SEQ ID NO: 805213 - DNA, 25 bp, Mus musculus
tgcagagagggcgacgacctgctac

SEQ ID NO: 805214 - DNA, 25 bp, Mus musculus
tgcagagaggtcacttgggccaaaa

SEQ ID NO: 805215 - DNA, 25 bp, Mus musculus
tgcagagaggtcatttaagggagca

SEQ ID NO: 805216 - DNA, 25 bp, Mus musculus
tgcagagaggtctcttgggccaaaa

SEQ ID NO: 805217 - DNA, 25 bp, Mus musculus
tgcagagaggtcttttaagggagca

SEQ ID NO: 805218 - DNA, 25 bp, Mus musculus
tgcagagatcttatcgccagacaac

SEQ ID NO: 805219 - DNA, 25 bp, Mus musculus
tgcagagatcttttcgccagacaac

SEQ ID NO: 805220 - DNA, 25 bp, Mus musculus
tgcagagatgtcatgccagatcact

SEQ ID NO: 805221 - DNA, 25 bp, Mus musculus
tgcagagatgtcttgccagatcact

SEQ ID NO: 805222 - DNA, 25 bp, Mus musculus
tgcagagcaaacacagacacagcac

SEQ ID NO: 805223 - DNA, 25 bp, Mus musculus
tgcagagcaaactcagacacagcac

SEQ ID NO: 805224 - DNA, 25 bp, Mus musculus
tgcagagcaaccatccagatgacac

SEQ ID NO: 805225 - DNA, 25 bp, Mus musculus
tgcagagcaaccttccagatgacac

SEQ ID NO: 805226 - DNA, 25 bp, Mus musculus
tgcagagcaactactgttccagtag

SEQ ID NO: 805227 - DNA, 25 bp, Mus musculus
tgcagagcaacttctgttccagtag

SEQ ID NO: 805228 - DNA, 25 bp, Mus musculus
tgcagagcaccgagaattctcaggg

SEQ ID NO: 805229 - DNA, 25 bp, Mus musculus
tgcagagcaccgtgaattctcaggg

SEQ ID NO: 805230 - DNA, 25 bp, Mus musculus
tgcagagcactaaggtcaccgggaa

SEQ ID NO: 805231 - DNA, 25 bp, Mus musculus
tgcagagcactatggtcaccgggaa

SEQ ID NO: 805232 - DNA, 25 bp, Mus musculus
tgcagagcagctcattcgggtgtac

SEQ ID NO: 805233 - DNA, 25 bp, Mus musculus
tgcagagcagctgattcgggtgtac

SEQ ID NO: 805234 - DNA, 25 bp, Mus musculus
tgcagagcagggacttcgggtggcc

SEQ ID NO: 805235 - DNA, 25 bp, Mus musculus
tgcagagcagggtcttcgggtggcc

SEQ ID NO: 805236 - DNA, 25 bp, Mus musculus
tgcagagcagttccgacgtatgcgc

SEQ ID NO: 805237 - DNA, 25 bp, Mus musculus
tgcagagcagttgcgacgtatgcgc

SEQ ID NO: 805238 - DNA, 25 bp, Mus musculus
tgcagagccaccaggccgcagggaa

SEQ ID NO: 805239 - DNA, 25 bp, Mus musculus
tgcagagccacctggccgcagggaa

SEQ ID NO: 805240 - DNA, 25 bp, Mus musculus
tgcagagccatgaactcttcaagct

SEQ ID NO: 805241 - DNA, 25 bp, Mus musculus
tgcagagccatgtactcttcaagct

SEQ ID NO: 805242 - DNA, 25 bp, Mus musculus
tgcagagcccatcaaaagccgggac

SEQ ID NO: 805243 - DNA, 25 bp, Mus musculus
tgcagagcccatgaaaagccgggac

SEQ ID NO: 805244 - DNA, 25 bp, Mus musculus
tgcagagcccctcttggatgcagcc

SEQ ID NO: 805245 - DNA, 25 bp, Mus musculus
tgcagagcccctgttggatgcagcc

SEQ ID NO: 805246 - DNA, 25 bp, Mus musculus
tgcagagccgcaagtatcaggcatg

SEQ ID NO: 805247 - DNA, 25 bp, Mus musculus
tgcagagccgcatgtatcaggcatg

SEQ ID NO: 805248 - DNA, 25 bp, Mus musculus
tgcagagcgccgacttgctgcccag

SEQ ID NO: 805249 - DNA, 25 bp, Mus musculus
tgcagagcgccgtcttgctgcccag

SEQ ID NO: 805250 - DNA, 25 bp, Mus musculus
tgcagagcgggcaacgttctccacc

SEQ ID NO: 805251 - DNA, 25 bp, Mus musculus
tgcagagcgggctacgttctccacc

SEQ ID NO: 805252 - DNA, 25 bp, Mus musculus
tgcagagctaggaggcacaccatga

SEQ ID NO: 805253 - DNA, 25 bp, Mus musculus
tgcagagctaggtggcacaccatga

SEQ ID NO: 805254 - DNA, 25 bp, Mus musculus
tgcagagctggcagagtacacggcc

SEQ ID NO: 805255 - DNA, 25 bp, Mus musculus
tgcagagctggctgagtacacggcc

SEQ ID NO: 805256 - DNA, 25 bp, Mus musculus
tgcagagcttgcattcactcaggaa

SEQ ID NO: 805257 - DNA, 25 bp, Mus musculus
tgcagagcttgctttcactcaggaa

SEQ ID NO: 805258 - DNA, 25 bp, Mus musculus
tgcagaggaaccaaccgctcataga

SEQ ID NO: 805259 - DNA, 25 bp, Mus musculus
tgcagaggaacctaccgctcataga

SEQ ID NO: 805260 - DNA, 25 bp, Mus musculus
tgcagaggaagaagcccggaaccga

SEQ ID NO: 805261 - DNA, 25 bp, Mus musculus
tgcagaggaagatgcccggaaccga

SEQ ID NO: 805262 - DNA, 25 bp, Mus musculus
tgcagaggactaagccaggaaactg

SEQ ID NO: 805263 - DNA, 25 bp, Mus musculus
tgcagaggactatgccaggaaactg

SEQ ID NO: 805264 - DNA, 25 bp, Mus musculus
tgcagaggagctctaccgtctggac

SEQ ID NO: 805265 - DNA, 25 bp, Mus musculus
tgcagaggagctgtaccgtctggac

SEQ ID NO: 805266 - DNA, 25 bp, Mus musculus
tgcagaggcagcagcgggatcacca

SEQ ID NO: 805267 - DNA, 25 bp, Mus musculus
tgcagaggcagctgcgggatcacca

SEQ ID NO: 805268 - DNA, 25 bp, Mus musculus
tgcagaggcatgaatgtggctttcc

SEQ ID NO: 805269 - DNA, 25 bp, Mus musculus
tgcagaggcatgtatgtggctttcc

SEQ ID NO: 805270 - DNA, 25 bp, Mus musculus
tgcagaggccctcctgcgtgagacc

SEQ ID NO: 805271 - DNA, 25 bp, Mus musculus
tgcagaggccctgctgcgtgagacc

SEQ ID NO: 805272 - DNA, 25 bp, Mus musculus
tgcagaggccgtacgtctcatcatg

SEQ ID NO: 805273 - DNA, 25 bp, Mus musculus
tgcagaggccgttcgtctcatcatg

SEQ ID NO: 805274 - DNA, 25 bp, Mus musculus
tgcagagggaaaatccaggcgtgct

SEQ ID NO: 805275 - DNA, 25 bp, Mus musculus
tgcagagggaaattccaggcgtgct

SEQ ID NO: 805276 - DNA, 25 bp, Mus musculus
tgcagagggaatcaaccgagctaag

SEQ ID NO: 805277 - DNA, 25 bp, Mus musculus
tgcagagggaatgaaccgagctaag

SEQ ID NO: 805278 - DNA, 25 bp, Mus musculus
tgcagagggctcaccgagcccacaa

SEQ ID NO: 805279 - DNA, 25 bp, Mus musculus
tgcagagggctctccgagcccacaa

SEQ ID NO: 805280 - DNA, 25 bp, Mus musculus
tgcagaggtataagaggataaggct

SEQ ID NO: 805281 - DNA, 25 bp, Mus musculus
tgcagaggtatatgaggataaggct

SEQ ID NO: 805282 - DNA, 25 bp, Mus musculus
tgcagaggtcagatagcagtcagcc

SEQ ID NO: 805283 - DNA, 25 bp, Mus musculus
tgcagaggtcagttagcagtcagcc

SEQ ID NO: 805284 - DNA, 25 bp, Mus musculus
tgcagaggtccaagcgagcactcca

SEQ ID NO: 805285 - DNA, 25 bp, Mus musculus
tgcagaggtccaaggcctagagagt

SEQ ID NO: 805286 - DNA, 25 bp, Mus musculus
tgcagaggtccatgcgagcactcca

SEQ ID NO: 805287 - DNA, 25 bp, Mus musculus
tgcagaggtccatggcctagagagt

SEQ ID NO: 805288 - DNA, 25 bp, Mus musculus
tgcagagtccagaagtcagatttca

SEQ ID NO: 805289 - DNA, 25 bp, Mus musculus
tgcagagtccagtagtcagatttca

SEQ ID NO: 805290 - DNA, 25 bp, Mus musculus
tgcagagtcgctagttgcagaaggc

SEQ ID NO: 805291 - DNA, 25 bp, Mus musculus
tgcagagtcgcttgttgcagaaggc

SEQ ID NO: 805292 - DNA, 25 bp, Mus musculus
tgcagagtcggcatccacagaatgt

SEQ ID NO: 805293 - DNA, 25 bp, Mus musculus
tgcagagtcggcttccacagaatgt

SEQ ID NO: 805294 - DNA, 25 bp, Mus musculus
tgcagagtctccagtccactggtca

SEQ ID NO: 805295 - DNA, 25 bp, Mus musculus
tgcagagtctcctgtccactggtca

SEQ ID NO: 805296 - DNA, 25 bp, Mus musculus
tgcagagtgggcagcccaagcactt

SEQ ID NO: 805297 - DNA, 25 bp, Mus musculus
tgcagagtgggctgcccaagcactt

SEQ ID NO: 805298 - DNA, 25 bp, Mus musculus
tgcagagtgtacaggctcaggccct

SEQ ID NO: 805299 - DNA, 25 bp, Mus musculus
tgcagagtgtactggctcaggccct

SEQ ID NO: 805300 - DNA, 25 bp, Mus musculus
tgcagagtgtcgacatcgcagcttt

SEQ ID NO: 805301 - DNA, 25 bp, Mus musculus
tgcagagtgtcgtcatcgcagcttt

SEQ ID NO: 805302 - DNA, 25 bp, Mus musculus
tgcagagttcgacggcaccgacttc

SEQ ID NO: 805303 - DNA, 25 bp, Mus musculus
tgcagagttcgagggcaccgacttc

SEQ ID NO: 805304 - DNA, 25 bp, Mus musculus
tgcagagttgctatgacagcgggct

SEQ ID NO: 805305 - DNA, 25 bp, Mus musculus
tgcagagttgctttgacagcgggct

SEQ ID NO: 805306 - DNA, 25 bp, Mus musculus
tgcagataaaaccttcagacctcct

SEQ ID NO: 805307 - DNA, 25 bp, Mus musculus
tgcagataaaacgttcagacctcct

SEQ ID NO: 805308 - DNA, 25 bp, Mus musculus
tgcagataccaaagatgaatcggag

SEQ ID NO: 805309 - DNA, 25 bp, Mus musculus
tgcagataccaatgatgaatcggag

SEQ ID NO: 805310 - DNA, 25 bp, Mus musculus
tgcagatacctgagaactgtcccta

SEQ ID NO: 805311 - DNA, 25 bp, Mus musculus
tgcagatacctgtgaactgtcccta

SEQ ID NO: 805312 - DNA, 25 bp, Mus musculus
tgcagatagacaaaaggcttcccag

SEQ ID NO: 805313 - DNA, 25 bp, Mus musculus
tgcagatagacataaggcttcccag

SEQ ID NO: 805314 - DNA, 25 bp, Mus musculus
tgcagataggaacatgtgtgcatgc

SEQ ID NO: 805315 - DNA, 25 bp, Mus musculus
tgcagataggaagatgtgtgcatgc

SEQ ID NO: 805316 - DNA, 25 bp, Mus musculus
tgcagatagtgacctcaaagaagat

SEQ ID NO: 805317 - DNA, 25 bp, Mus musculus
tgcagatagtgagctcaaagaagat

SEQ ID NO: 805318 - DNA, 25 bp, Mus musculus
tgcagatcagaaaaccacactcctc

SEQ ID NO: 805319 - DNA, 25 bp, Mus musculus
tgcagatcagaaagttggagagcct

SEQ ID NO: 805320 - DNA, 25 bp, Mus musculus
tgcagatcagaataccacactcctc

SEQ ID NO: 805321 - DNA, 25 bp, Mus musculus
tgcagatcagaatgttggagagcct

SEQ ID NO: 805322 - DNA, 25 bp, Mus musculus
tgcagatccatcatgtgggtcagga

SEQ ID NO: 805323 - DNA, 25 bp, Mus musculus
tgcagatccatcttgtgggtcagga

SEQ ID NO: 805324 - DNA, 25 bp, Mus musculus
tgcagatcccgaagtttgcaagaaa

SEQ ID NO: 805325 - DNA, 25 bp, Mus musculus
tgcagatcccgatgtttgcaagaaa

SEQ ID NO: 805326 - DNA, 25 bp, Mus musculus
tgcagatcctgtctgcctatctaag

SEQ ID NO: 805327 - DNA, 25 bp, Mus musculus
tgcagatcctgtgtgcctatctaag

SEQ ID NO: 805328 - DNA, 25 bp, Mus musculus
tgcagatcgggccaaacaaatccgc

SEQ ID NO: 805329 - DNA, 25 bp, Mus musculus
tgcagatcgggcgaaacaaatccgc

SEQ ID NO: 805330 - DNA, 25 bp, Mus musculus
tgcagatctccaagtgccagaggaa

SEQ ID NO: 805331 - DNA, 25 bp, Mus musculus
tgcagatctccatgtgccagaggaa

SEQ ID NO: 805332 - DNA, 25 bp, Mus musculus
tgcagatctgcacccaaagagttta

SEQ ID NO: 805333 - DNA, 25 bp, Mus musculus
tgcagatctgcagccaaagagttta

SEQ ID NO: 805334 - DNA, 25 bp, Mus musculus
tgcagatcttggactggacattggt

SEQ ID NO: 805335 - DNA, 25 bp, Mus musculus
tgcagatcttggtctggacattggt

SEQ ID NO: 805336 - DNA, 25 bp, Mus musculus
tgcagatgaattctgagcaccttgt

SEQ ID NO: 805337 - DNA, 25 bp, Mus musculus
tgcagatgaattgtgagcaccttgt

SEQ ID NO: 805338 - DNA, 25 bp, Mus musculus
tgcagatgacagaaagacggaaacc

SEQ ID NO: 805339 - DNA, 25 bp, Mus musculus
tgcagatgacagtaagacggaaacc

SEQ ID NO: 805340 - DNA, 25 bp, Mus musculus
tgcagatgacatcgacgaaagagaa

SEQ ID NO: 805341 - DNA, 25 bp, Mus musculus
tgcagatgacatggacgaaagagaa

SEQ ID NO: 805342 - DNA, 25 bp, Mus musculus
tgcagatgaccacgacgacacagcc

SEQ ID NO: 805343 - DNA, 25 bp, Mus musculus
tgcagatgaccaggacgacacagcc

SEQ ID NO: 805344 - DNA, 25 bp, Mus musculus
tgcagatgacccattgctcagtgat

SEQ ID NO: 805345 - DNA, 25 bp, Mus musculus
tgcagatgaccctttgctcagtgat

SEQ ID NO: 805346 - DNA, 25 bp, Mus musculus
tgcagatgagctagtcaaacagaaa

SEQ ID NO: 805347 - DNA, 25 bp, Mus musculus
tgcagatgagctcattaatgctgcc

SEQ ID NO: 805348 - DNA, 25 bp, Mus musculus
tgcagatgagctgattaatgctgcc

SEQ ID NO: 805349 - DNA, 25 bp, Mus musculus
tgcagatgagcttgtcaaacagaaa

SEQ ID NO: 805350 - DNA, 25 bp, Mus musculus
tgcagatgagttctcagagctgtgt

SEQ ID NO: 805351 - DNA, 25 bp, Mus musculus
tgcagatgagttgtcagagctgtgt

SEQ ID NO: 805352 - DNA, 25 bp, Mus musculus
tgcagatgattgaggtgcctgtcct

SEQ ID NO: 805353 - DNA, 25 bp, Mus musculus
tgcagatgattgtggtgcctgtcct

SEQ ID NO: 805354 - DNA, 25 bp, Mus musculus
tgcagatgcaaaagtccaggtgctg

SEQ ID NO: 805355 - DNA, 25 bp, Mus musculus
tgcagatgcaaatgtccaggtgctg

SEQ ID NO: 805356 - DNA, 25 bp, Mus musculus
tgcagatggaaccatccgattccta

SEQ ID NO: 805357 - DNA, 25 bp, Mus musculus
tgcagatggaacgatccgattccta

SEQ ID NO: 805358 - DNA, 25 bp, Mus musculus
tgcagatggagcatgacatccggca

SEQ ID NO: 805359 - DNA, 25 bp, Mus musculus
tgcagatggagcttgacatccggca

SEQ ID NO: 805360 - DNA, 25 bp, Mus musculus
tgcagatggcagagctcatggtctc

SEQ ID NO: 805361 - DNA, 25 bp, Mus musculus
tgcagatggcagtgctcatggtctc

SEQ ID NO: 805362 - DNA, 25 bp, Mus musculus
tgcagatggctcaagagacaactgt

SEQ ID NO: 805363 - DNA, 25 bp, Mus musculus
tgcagatggctctagagacaactgt

SEQ ID NO: 805364 - DNA, 25 bp, Mus musculus
tgcagatgggtactacgcccgctca

SEQ ID NO: 805365 - DNA, 25 bp, Mus musculus
tgcagatgggtagtacgcccgctca

SEQ ID NO: 805366 - DNA, 25 bp, Mus musculus
tgcagatggtacaagcatacgcctt

SEQ ID NO: 805367 - DNA, 25 bp, Mus musculus
tgcagatggtactagcatacgcctt

SEQ ID NO: 805368 - DNA, 25 bp, Mus musculus
tgcagatgtcaacccttttcagaca

SEQ ID NO: 805369 - DNA, 25 bp, Mus musculus
tgcagatgtcaagccttttcagaca

SEQ ID NO: 805370 - DNA, 25 bp, Mus musculus
tgcagatgtccaagttttgcctatt

SEQ ID NO: 805371 - DNA, 25 bp, Mus musculus
tgcagatgtccatgttttgcctatt

SEQ ID NO: 805372 - DNA, 25 bp, Mus musculus
tgcagatgttacagggattcctcta

SEQ ID NO: 805373 - DNA, 25 bp, Mus musculus
tgcagatgttactgggattcctcta

SEQ ID NO: 805374 - DNA, 25 bp, Mus musculus
tgcagatgttctacttcaagcaggg

SEQ ID NO: 805375 - DNA, 25 bp, Mus musculus
tgcagatgttcttcttcaagcaggg

SEQ ID NO: 805376 - DNA, 25 bp, Mus musculus
tgcagattcagtacgggctcatcag

SEQ ID NO: 805377 - DNA, 25 bp, Mus musculus
tgcagattcagttcgggctcatcag

SEQ ID NO: 805378 - DNA, 25 bp, Mus musculus
tgcagattcgagagaatgcagagcc

SEQ ID NO: 805379 - DNA, 25 bp, Mus musculus
tgcagattcgagtgaatgcagagcc

SEQ ID NO: 805380 - DNA, 25 bp, Mus musculus
tgcagattcggtcctatgtgtacgc

SEQ ID NO: 805381 - DNA, 25 bp, Mus musculus
tgcagattcggtgctatgtgtacgc

SEQ ID NO: 805382 - DNA, 25 bp, Mus musculus
tgcagattctccagtgtcccactct

SEQ ID NO: 805383 - DNA, 25 bp, Mus musculus
tgcagattctcctgtgtcccactct

SEQ ID NO: 805384 - DNA, 25 bp, Mus musculus
tgcagattctgcacgaggcagccag

SEQ ID NO: 805385 - DNA, 25 bp, Mus musculus
tgcagattctgctcgaggcagccag

SEQ ID NO: 805386 - DNA, 25 bp, Mus musculus
tgcagattgtataccaagttctcgg

SEQ ID NO: 805387 - DNA, 25 bp, Mus musculus
tgcagattgtattccaagttctcgg

SEQ ID NO: 805388 - DNA, 25 bp, Mus musculus
tgcagattttgtcaccctccaggcg

SEQ ID NO: 805389 - DNA, 25 bp, Mus musculus
tgcagattttgtgaccctccaggcg

SEQ ID NO: 805390 - DNA, 25 bp, Mus musculus
tgcagcaacacgcagggctcgtacc

SEQ ID NO: 805391 - DNA, 25 bp, Mus musculus
tgcagcaacacggagggctcgtacc

SEQ ID NO: 805392 - DNA, 25 bp, Mus musculus
tgcagcaaccctagagtagtccact

SEQ ID NO: 805393 - DNA, 25 bp, Mus musculus
tgcagcaacccttgagtagtccact

SEQ ID NO: 805394 - DNA, 25 bp, Mus musculus
tgcagcaacggaagcaaagcacaga

SEQ ID NO: 805395 - DNA, 25 bp, Mus musculus
tgcagcaacggatgcaaagcacaga

SEQ ID NO: 805396 - DNA, 25 bp, Mus musculus
tgcagcaagaaccaaaacgtacgtg

SEQ ID NO: 805397 - DNA, 25 bp, Mus musculus
tgcagcaagaacgaaaacgtacgtg

SEQ ID NO: 805398 - DNA, 25 bp, Mus musculus
tgcagcaagccccaaaagatgctga

SEQ ID NO: 805399 - DNA, 25 bp, Mus musculus
tgcagcaagcccgaaaagatgctga

SEQ ID NO: 805400 - DNA, 25 bp, Mus musculus
tgcagcaaggagaatttggagcgct

SEQ ID NO: 805401 - DNA, 25 bp, Mus musculus
tgcagcaaggagtatttggagcgct

SEQ ID NO: 805402 - DNA, 25 bp, Mus musculus
tgcagcaagtcaataccagggaagc

SEQ ID NO: 805403 - DNA, 25 bp, Mus musculus
tgcagcaagtcattaccagggaagc

SEQ ID NO: 805404 - DNA, 25 bp, Mus musculus
tgcagcaatctcaaccctacgctgt

SEQ ID NO: 805405 - DNA, 25 bp, Mus musculus
tgcagcaatctctaccctacgctgt

SEQ ID NO: 805406 - DNA, 25 bp, Mus musculus
tgcagcaattctacgccacccagag

SEQ ID NO: 805407 - DNA, 25 bp, Mus musculus
tgcagcaattcttcgccacccagag

SEQ ID NO: 805408 - DNA, 25 bp, Mus musculus
tgcagcacaagtcgatcaaccagga

SEQ ID NO: 805409 - DNA, 25 bp, Mus musculus
tgcagcacaagtggatcaaccagga

SEQ ID NO: 805410 - DNA, 25 bp, Mus musculus
tgcagcacaatgacctactggacct

SEQ ID NO: 805411 - DNA, 25 bp, Mus musculus
tgcagcacaatgacgcacttaccgt

SEQ ID NO: 805412 - DNA, 25 bp, Mus musculus
tgcagcacaatgtcctactggacct

SEQ ID NO: 805413 - DNA, 25 bp, Mus musculus
tgcagcacaatgtcgcacttaccgt

SEQ ID NO: 805414 - DNA, 25 bp, Mus musculus
tgcagcacacacaagaacttcagaa

SEQ ID NO: 805415 - DNA, 25 bp, Mus musculus
tgcagcacacactagaacttcagaa

SEQ ID NO: 805416 - DNA, 25 bp, Mus musculus
tgcagcacacgcacaaatggatgtc

SEQ ID NO: 805417 - DNA, 25 bp, Mus musculus
tgcagcacacgctcaaatggatgtc

SEQ ID NO: 805418 - DNA, 25 bp, Mus musculus
tgcagcaccggcctcaagttggcta

SEQ ID NO: 805419 - DNA, 25 bp, Mus musculus
tgcagcaccggcgtcaagttggcta

SEQ ID NO: 805420 - DNA, 25 bp, Mus musculus
tgcagcaccggtactttgccaacat

SEQ ID NO: 805421 - DNA, 25 bp, Mus musculus
tgcagcaccggttctttgccaacat

SEQ ID NO: 805422 - DNA, 25 bp, Mus musculus
tgcagcacgattcccttttgataag

SEQ ID NO: 805423 - DNA, 25 bp, Mus musculus
tgcagcacgattgccttttgataag

SEQ ID NO: 805424 - DNA, 25 bp, Mus musculus
tgcagcacgctgcagctgacagtgc

SEQ ID NO: 805425 - DNA, 25 bp, Mus musculus
tgcagcacgctggagctgacagtgc

SEQ ID NO: 805426 - DNA, 25 bp, Mus musculus
tgcagcacggcgataccgaggaccg

SEQ ID NO: 805427 - DNA, 25 bp, Mus musculus
tgcagcacggcgttaccgaggaccg

SEQ ID NO: 805428 - DNA, 25 bp, Mus musculus
tgcagcactctgagcacacggtcac

SEQ ID NO: 805429 - DNA, 25 bp, Mus musculus
tgcagcactctgtgcacacggtcac

SEQ ID NO: 805430 - DNA, 25 bp, Mus musculus
tgcagcagaaatcgagttcctatcc

SEQ ID NO: 805431 - DNA, 25 bp, Mus musculus
tgcagcagaaatggagttcctatcc

SEQ ID NO: 805432 - DNA, 25 bp, Mus musculus
tgcagcagagccagatattatatca

SEQ ID NO: 805433 - DNA, 25 bp, Mus musculus
tgcagcagagcctgatattatatca

SEQ ID NO: 805434 - DNA, 25 bp, Mus musculus
tgcagcagaggcctaccgggcactt

SEQ ID NO: 805435 - DNA, 25 bp, Mus musculus
tgcagcagaggcgtaccgggcactt

SEQ ID NO: 805436 - DNA, 25 bp, Mus musculus
tgcagcagatcccacttgcccagaa

SEQ ID NO: 805437 - DNA, 25 bp, Mus musculus
tgcagcagatccgacttgcccagaa

SEQ ID NO: 805438 - DNA, 25 bp, Mus musculus
tgcagcagattgaaaccaggaaccg

SEQ ID NO: 805439 - DNA, 25 bp, Mus musculus
tgcagcagattgtaaccaggaaccg

SEQ ID NO: 805440 - DNA, 25 bp, Mus musculus
tgcagcagcactaccgcaacctgga

SEQ ID NO: 805441 - DNA, 25 bp, Mus musculus
tgcagcagcacttccgcaacctgga

SEQ ID NO: 805442 - DNA, 25 bp, Mus musculus
tgcagcagcagtctttcaggatgac

SEQ ID NO: 805443 - DNA, 25 bp, Mus musculus
tgcagcagcagtgtttcaggatgac

SEQ ID NO: 805444 - DNA, 25 bp, Mus musculus
tgcagcagccgcagagccagaacca

SEQ ID NO: 805445 - DNA, 25 bp, Mus musculus
tgcagcagccgctgagccagaacca

SEQ ID NO: 805446 - DNA, 25 bp, Mus musculus
tgcagcagcctgactccttctatga

SEQ ID NO: 805447 - DNA, 25 bp, Mus musculus
tgcagcagcctgtctccttctatga

SEQ ID NO: 805448 - DNA, 25 bp, Mus musculus
tgcagcagctacaaactctgctact

SEQ ID NO: 805449 - DNA, 25 bp, Mus musculus
tgcagcagctactaactctgctact

SEQ ID NO: 805450 - DNA, 25 bp, Mus musculus
tgcagcagctcaactcggagagtct

SEQ ID NO: 805451 - DNA, 25 bp, Mus musculus
tgcagcagctcatctcggagagtct

SEQ ID NO: 805452 - DNA, 25 bp, Mus musculus
tgcagcagctcgactctcacgtgca

SEQ ID NO: 805453 - DNA, 25 bp, Mus musculus
tgcagcagctcgtctctcacgtgca

SEQ ID NO: 805454 - DNA, 25 bp, Mus musculus
tgcagcaggcctagatgtgtcccaa

SEQ ID NO: 805455 - DNA, 25 bp, Mus musculus
tgcagcaggccttgatgtgtcccaa

SEQ ID NO: 805456 - DNA, 25 bp, Mus musculus
tgcagcagggacaggacttgctcca

SEQ ID NO: 805457 - DNA, 25 bp, Mus musculus
tgcagcagggactggacttgctcca

SEQ ID NO: 805458 - DNA, 25 bp, Mus musculus
tgcagcagtctccaatccgcattga

SEQ ID NO: 805459 - DNA, 25 bp, Mus musculus
tgcagcagtctcgaatccgcattga

SEQ ID NO: 805460 - DNA, 25 bp, Mus musculus
tgcagcatacggatcttcacagtag

SEQ ID NO: 805461 - DNA, 25 bp, Mus musculus
tgcagcatacggttcttcacagtag

SEQ ID NO: 805462 - DNA, 25 bp, Mus musculus
tgcagcatcatgaaatctgggacct

SEQ ID NO: 805463 - DNA, 25 bp, Mus musculus
tgcagcatcatgtaatctgggacct

SEQ ID NO: 805464 - DNA, 25 bp, Mus musculus
tgcagcatgggtacacgtgggcact

SEQ ID NO: 805465 - DNA, 25 bp, Mus musculus
tgcagcatgggtacagcctaagcag

SEQ ID NO: 805466 - DNA, 25 bp, Mus musculus
tgcagcatgggttcacgtgggcact

SEQ ID NO: 805467 - DNA, 25 bp, Mus musculus
tgcagcatgggttcagcctaagcag

SEQ ID NO: 805468 - DNA, 25 bp, Mus musculus
tgcagccaaccacacaagagtatat

SEQ ID NO: 805469 - DNA, 25 bp, Mus musculus
tgcagccaaccagacaagagtatat

SEQ ID NO: 805470 - DNA, 25 bp, Mus musculus
tgcagccaaccgaaggctggccaag

SEQ ID NO: 805471 - DNA, 25 bp, Mus musculus
tgcagccaaccgtaggctggccaag

SEQ ID NO: 805472 - DNA, 25 bp, Mus musculus
tgcagccaagcaaagtgtcgacagt

SEQ ID NO: 805473 - DNA, 25 bp, Mus musculus
tgcagccaagcatagtgtcgacagt

SEQ ID NO: 805474 - DNA, 25 bp, Mus musculus
tgcagccacgagcagaattgccctg

SEQ ID NO: 805475 - DNA, 25 bp, Mus musculus
tgcagccacgaggagaattgccctg

SEQ ID NO: 805476 - DNA, 25 bp, Mus musculus
tgcagccactctcgcgccatgagag

SEQ ID NO: 805477 - DNA, 25 bp, Mus musculus
tgcagccactctggcgccatgagag

SEQ ID NO: 805478 - DNA, 25 bp, Mus musculus
tgcagccagccgctttcagttaaag

SEQ ID NO: 805479 - DNA, 25 bp, Mus musculus
tgcagccagccggtttcagttaaag

SEQ ID NO: 805480 - DNA, 25 bp, Mus musculus
tgcagccagcggcatcgtactgaga

SEQ ID NO: 805481 - DNA, 25 bp, Mus musculus
tgcagccagcgggatcgtactgaga

SEQ ID NO: 805482 - DNA, 25 bp, Mus musculus
tgcagccaggaaagtgccaacatct

SEQ ID NO: 805483 - DNA, 25 bp, Mus musculus
tgcagccaggaatgtgccaacatct

SEQ ID NO: 805484 - DNA, 25 bp, Mus musculus
tgcagccatcgcaaatgctattcac

SEQ ID NO: 805485 - DNA, 25 bp, Mus musculus
tgcagccatcgctaatgctattcac

SEQ ID NO: 805486 - DNA, 25 bp, Mus musculus
tgcagccatgccatcacccagaagg

SEQ ID NO: 805487 - DNA, 25 bp, Mus musculus
tgcagccatgccttcacccagaagg

SEQ ID NO: 805488 - DNA, 25 bp, Mus musculus
tgcagccatgggaactactgtcgtt

SEQ ID NO: 805489 - DNA, 25 bp, Mus musculus
tgcagccatgggtactactgtcgtt

SEQ ID NO: 805490 - DNA, 25 bp, Mus musculus
tgcagcccaaacagaagcaggtgtt

SEQ ID NO: 805491 - DNA, 25 bp, Mus musculus
tgcagcccaaaccacgatggctggg

SEQ ID NO: 805492 - DNA, 25 bp, Mus musculus
tgcagcccaaacgacgatggctggg

SEQ ID NO: 805493 - DNA, 25 bp, Mus musculus
tgcagcccaaactgaagcaggtgtt

SEQ ID NO: 805494 - DNA, 25 bp, Mus musculus
tgcagcccaagaagtataagaaccc

SEQ ID NO: 805495 - DNA, 25 bp, Mus musculus
tgcagcccaagatgtataagaaccc

SEQ ID NO: 805496 - DNA, 25 bp, Mus musculus
tgcagcccaatgaaatctgcgtcat

SEQ ID NO: 805497 - DNA, 25 bp, Mus musculus
tgcagcccaatgtaatctgcgtcat

SEQ ID NO: 805498 - DNA, 25 bp, Mus musculus
tgcagcccacagacagaaactacgt

SEQ ID NO: 805499 - DNA, 25 bp, Mus musculus
tgcagcccacagtcagaaactacgt

SEQ ID NO: 805500 - DNA, 25 bp, Mus musculus
tgcagcccagctcacctggaggaaa

SEQ ID NO: 805501 - DNA, 25 bp, Mus musculus
tgcagcccagctgacctggaggaaa

SEQ ID NO: 805502 - DNA, 25 bp, Mus musculus
tgcagccccatgcaacaggatgatg

SEQ ID NO: 805503 - DNA, 25 bp, Mus musculus
tgcagccccatggaacaggatgatg

SEQ ID NO: 805504 - DNA, 25 bp, Mus musculus
tgcagccccgaaacagtgtggccca

SEQ ID NO: 805505 - DNA, 25 bp, Mus musculus
tgcagccccgaatcagtgtggccca

SEQ ID NO: 805506 - DNA, 25 bp, Mus musculus
tgcagccccgctctgaggacgtaga

SEQ ID NO: 805507 - DNA, 25 bp, Mus musculus
tgcagccccgctgtgaggacgtaga

SEQ ID NO: 805508 - DNA, 25 bp, Mus musculus
tgcagcccctacaaagaagttgaaa

SEQ ID NO: 805509 - DNA, 25 bp, Mus musculus
tgcagcccctactaagaagttgaaa

SEQ ID NO: 805510 - DNA, 25 bp, Mus musculus
tgcagcccctgcagtggagacccag

SEQ ID NO: 805511 - DNA, 25 bp, Mus musculus
tgcagcccctgctgtggagacccag

SEQ ID NO: 805512 - DNA, 25 bp, Mus musculus
tgcagccctgccaatcattctggag

SEQ ID NO: 805513 - DNA, 25 bp, Mus musculus
tgcagccctgccctgcttgaggaag

SEQ ID NO: 805514 - DNA, 25 bp, Mus musculus
tgcagccctgccgtgcttgaggaag

SEQ ID NO: 805515 - DNA, 25 bp, Mus musculus
tgcagccctgcctatcattctggag

SEQ ID NO: 805516 - DNA, 25 bp, Mus musculus
tgcagccctgctcatattgatgctt

SEQ ID NO: 805517 - DNA, 25 bp, Mus musculus
tgcagccctgctgatattgatgctt

SEQ ID NO: 805518 - DNA, 25 bp, Mus musculus
tgcagccctgtgcagggagctacca

SEQ ID NO: 805519 - DNA, 25 bp, Mus musculus
tgcagccctgtggagggagctacca

SEQ ID NO: 805520 - DNA, 25 bp, Mus musculus
tgcagcccttggcaccagagacgga

SEQ ID NO: 805521 - DNA, 25 bp, Mus musculus
tgcagcccttgggaccagagacgga

SEQ ID NO: 805522 - DNA, 25 bp, Mus musculus
tgcagccgagtgagccacacaggta

SEQ ID NO: 805523 - DNA, 25 bp, Mus musculus
tgcagccgagtgtgccacacaggta

SEQ ID NO: 805524 - DNA, 25 bp, Mus musculus
tgcagccgcgtccacgttgtctgag

SEQ ID NO: 805525 - DNA, 25 bp, Mus musculus
tgcagccgcgtcgacgttgtctgag

SEQ ID NO: 805526 - DNA, 25 bp, Mus musculus
tgcagccgctgcagagataacgcct

SEQ ID NO: 805527 - DNA, 25 bp, Mus musculus
tgcagccgctgctgagataacgcct

SEQ ID NO: 805528 - DNA, 25 bp, Mus musculus
tgcagccggaagagcagcgctatga

SEQ ID NO: 805529 - DNA, 25 bp, Mus musculus
tgcagccggaagtgcagcgctatga

SEQ ID NO: 805530 - DNA, 25 bp, Mus musculus
tgcagccgtgccctgggttctgtct

SEQ ID NO: 805531 - DNA, 25 bp, Mus musculus
tgcagccgtgccgtgggttctgtct

SEQ ID NO: 805532 - DNA, 25 bp, Mus musculus
tgcagcctagcacctcttatcaagt

SEQ ID NO: 805533 - DNA, 25 bp, Mus musculus
tgcagcctagcagctcttatcaagt

SEQ ID NO: 805534 - DNA, 25 bp, Mus musculus
tgcagcctccagcttaggagaatgg

SEQ ID NO: 805535 - DNA, 25 bp, Mus musculus
tgcagcctccaggttaggagaatgg

SEQ ID NO: 805536 - DNA, 25 bp, Mus musculus
tgcagcctctcaaccgcagagactg

SEQ ID NO: 805537 - DNA, 25 bp, Mus musculus
tgcagcctctcatccgcagagactg

SEQ ID NO: 805538 - DNA, 25 bp, Mus musculus
tgcagcctggaacggaaccctgtgt

SEQ ID NO: 805539 - DNA, 25 bp, Mus musculus
tgcagcctggaagggaaccctgtgt

SEQ ID NO: 805540 - DNA, 25 bp, Mus musculus
tgcagcctgtccaccccgtggagaa

SEQ ID NO: 805541 - DNA, 25 bp, Mus musculus
tgcagcctgtcctccccgtggagaa

SEQ ID NO: 805542 - DNA, 25 bp, Mus musculus
tgcagccttactcgcaggacacgga

SEQ ID NO: 805543 - DNA, 25 bp, Mus musculus
tgcagccttactggcaggacacgga

SEQ ID NO: 805544 - DNA, 25 bp, Mus musculus
tgcagccttgcactcttgccagaca

SEQ ID NO: 805545 - DNA, 25 bp, Mus musculus
tgcagccttgcagtcttgccagaca

SEQ ID NO: 805546 - DNA, 25 bp, Mus musculus
tgcagccttgctcaggcactgggaa

SEQ ID NO: 805547 - DNA, 25 bp, Mus musculus
tgcagccttgctgaggcactgggaa

SEQ ID NO: 805548 - DNA, 25 bp, Mus musculus
tgcagccttgtcagaaacagcagtg

SEQ ID NO: 805549 - DNA, 25 bp, Mus musculus
tgcagccttgtctgaaacagcagtg

SEQ ID NO: 805550 - DNA, 25 bp, Mus musculus
tgcagcctttgaccggggcattgat

SEQ ID NO: 805551 - DNA, 25 bp, Mus musculus
tgcagcctttgagcggggcattgat

SEQ ID NO: 805552 - DNA, 25 bp, Mus musculus
tgcagcgaacttaccagagcaccca

SEQ ID NO: 805553 - DNA, 25 bp, Mus musculus
tgcagcgaactttccagagcaccca

SEQ ID NO: 805554 - DNA, 25 bp, Mus musculus
tgcagcgaagatcgagactgcctct

SEQ ID NO: 805555 - DNA, 25 bp, Mus musculus
tgcagcgaagatggagactgcctct

SEQ ID NO: 805556 - DNA, 25 bp, Mus musculus
tgcagcgaatcaagcgggagttcaa

SEQ ID NO: 805557 - DNA, 25 bp, Mus musculus
tgcagcgaatcatgcgggagttcaa

SEQ ID NO: 805558 - DNA, 25 bp, Mus musculus
tgcagcgactgtaccgccagttttc

SEQ ID NO: 805559 - DNA, 25 bp, Mus musculus
tgcagcgactgttccgccagttttc

SEQ ID NO: 805560 - DNA, 25 bp, Mus musculus
tgcagcgagagccacgctccaagtc

SEQ ID NO: 805561 - DNA, 25 bp, Mus musculus
tgcagcgagagcgacgctccaagtc

SEQ ID NO: 805562 - DNA, 25 bp, Mus musculus
tgcagcgagaggcacagacactgca

SEQ ID NO: 805563 - DNA, 25 bp, Mus musculus
tgcagcgagagggacagacactgca

SEQ ID NO: 805564 - DNA, 25 bp, Mus musculus
tgcagcgagtacattccgctgttcc

SEQ ID NO: 805565 - DNA, 25 bp, Mus musculus
tgcagcgagtactttccgctgttcc

SEQ ID NO: 805566 - DNA, 25 bp, Mus musculus
tgcagcgataccagcccggttgtcc

SEQ ID NO: 805567 - DNA, 25 bp, Mus musculus
tgcagcgatacctgcccggttgtcc

SEQ ID NO: 805568 - DNA, 25 bp, Mus musculus
tgcagcgatcatctccactctggtg

SEQ ID NO: 805569 - DNA, 25 bp, Mus musculus
tgcagcgatcatgtccactctggtg

SEQ ID NO: 805570 - DNA, 25 bp, Mus musculus
tgcagcgatgagaacagatgaacct

SEQ ID NO: 805571 - DNA, 25 bp, Mus musculus
tgcagcgatgagtacagatgaacct

SEQ ID NO: 805572 - DNA, 25 bp, Mus musculus
tgcagcgcatgtacctacagaactg

SEQ ID NO: 805573 - DNA, 25 bp, Mus musculus
tgcagcgcatgttcctacagaactg

SEQ ID NO: 805574 - DNA, 25 bp, Mus musculus
tgcagcgcctctccggcttggctga

SEQ ID NO: 805575 - DNA, 25 bp, Mus musculus
tgcagcgcctctgcggcttggctga

SEQ ID NO: 805576 - DNA, 25 bp, Mus musculus
tgcagcgctgtgcagcacatgcact

SEQ ID NO: 805577 - DNA, 25 bp, Mus musculus
tgcagcgctgtggagcacatgcact

SEQ ID NO: 805578 - DNA, 25 bp, Mus musculus
tgcagcggaccaatttcagcgagtg

SEQ ID NO: 805579 - DNA, 25 bp, Mus musculus
tgcagcggaccattttcagcgagtg

SEQ ID NO: 805580 - DNA, 25 bp, Mus musculus
tgcagcggcacacagactcgtgtcg

SEQ ID NO: 805581 - DNA, 25 bp, Mus musculus
tgcagcggcacagagactcgtgtcg

SEQ ID NO: 805582 - DNA, 25 bp, Mus musculus
tgcagcggccagctcttgaggacct

SEQ ID NO: 805583 - DNA, 25 bp, Mus musculus
tgcagcggccaggtcttgaggacct

SEQ ID NO: 805584 - DNA, 25 bp, Mus musculus
tgcagcggcgaaaggaggcccaggt

SEQ ID NO: 805585 - DNA, 25 bp, Mus musculus
tgcagcggcgaatggaggcccaggt

SEQ ID NO: 805586 - DNA, 25 bp, Mus musculus
tgcagcggctacagtctcgagtgga

SEQ ID NO: 805587 - DNA, 25 bp, Mus musculus
tgcagcggctactgtctcgagtgga

SEQ ID NO: 805588 - DNA, 25 bp, Mus musculus
tgcagcgtagagcaccatacgtttt

SEQ ID NO: 805589 - DNA, 25 bp, Mus musculus
tgcagcgtagaggaccatacgtttt

SEQ ID NO: 805590 - DNA, 25 bp, Mus musculus
tgcagcgtatgacagacgattcaat

SEQ ID NO: 805591 - DNA, 25 bp, Mus musculus
tgcagcgtatgagagacgattcaat

SEQ ID NO: 805592 - DNA, 25 bp, Mus musculus
tgcagcgtctacacagactactggg

SEQ ID NO: 805593 - DNA, 25 bp, Mus musculus
tgcagcgtctactcagactactggg

SEQ ID NO: 805594 - DNA, 25 bp, Mus musculus
tgcagcgtgagaaccagatggactc

SEQ ID NO: 805595 - DNA, 25 bp, Mus musculus
tgcagcgtgagatccagatggactc

SEQ ID NO: 805596 - DNA, 25 bp, Mus musculus
tgcagcgtgagcagcgcacgcacgt

SEQ ID NO: 805597 - DNA, 25 bp, Mus musculus
tgcagcgtgagctgcgcacgcacgt

SEQ ID NO: 805598 - DNA, 25 bp, Mus musculus
tgcagcgtgttaatgacttccactg

SEQ ID NO: 805599 - DNA, 25 bp, Mus musculus
tgcagcgtgttattgacttccactg

SEQ ID NO: 805600 - DNA, 25 bp, Mus musculus
tgcagctagaggacaggcggtcaat

SEQ ID NO: 805601 - DNA, 25 bp, Mus musculus
tgcagctagaggtcaggcggtcaat

SEQ ID NO: 805602 - DNA, 25 bp, Mus musculus
tgcagctagatcataacctgagcct

SEQ ID NO: 805603 - DNA, 25 bp, Mus musculus
tgcagctagatcttaacctgagcct

SEQ ID NO: 805604 - DNA, 25 bp, Mus musculus
tgcagctagtctcgaaggaacctgg

SEQ ID NO: 805605 - DNA, 25 bp, Mus musculus
tgcagctagtctggaaggaacctgg

SEQ ID NO: 805606 - DNA, 25 bp, Mus musculus
tgcagctatcatagaagatgattca

SEQ ID NO: 805607 - DNA, 25 bp, Mus musculus
tgcagctatcattgaagatgattca

SEQ ID NO: 805608 - DNA, 25 bp, Mus musculus
tgcagctcaagaaagttttgcatga

SEQ ID NO: 805609 - DNA, 25 bp, Mus musculus
tgcagctcaagatagttttgcatga

SEQ ID NO: 805610 - DNA, 25 bp, Mus musculus
tgcagctcaatgagggaggctccct

SEQ ID NO: 805611 - DNA, 25 bp, Mus musculus
tgcagctcaatgtgggaggctccct

SEQ ID NO: 805612 - DNA, 25 bp, Mus musculus
tgcagctcaccaaccatcgagtctg

SEQ ID NO: 805613 - DNA, 25 bp, Mus musculus
tgcagctcaccacaatgtatccagg

SEQ ID NO: 805614 - DNA, 25 bp, Mus musculus
tgcagctcaccagaatgtatccagg

SEQ ID NO: 805615 - DNA, 25 bp, Mus musculus
tgcagctcaccatccatcgagtctg

SEQ ID NO: 805616 - DNA, 25 bp, Mus musculus
tgcagctcacgccagaggtgcaact

SEQ ID NO: 805617 - DNA, 25 bp, Mus musculus
tgcagctcacgcgagaggtgcaact

SEQ ID NO: 805618 - DNA, 25 bp, Mus musculus
tgcagctcacggaccctggttacaa

SEQ ID NO: 805619 - DNA, 25 bp, Mus musculus
tgcagctcacggtccctggttacaa

SEQ ID NO: 805620 - DNA, 25 bp, Mus musculus
tgcagctcaggtaggactgagtcac

SEQ ID NO: 805621 - DNA, 25 bp, Mus musculus
tgcagctcaggttggactgagtcac

SEQ ID NO: 805622 - DNA, 25 bp, Mus musculus
tgcagctcagtcacctcagcagcga

SEQ ID NO: 805623 - DNA, 25 bp, Mus musculus
tgcagctcagtctcctcagcagcga

SEQ ID NO: 805624 - DNA, 25 bp, Mus musculus
tgcagctcattaagtcccagaagtt

SEQ ID NO: 805625 - DNA, 25 bp, Mus musculus
tgcagctcattatgtcccagaagtt

SEQ ID NO: 805626 - DNA, 25 bp, Mus musculus
tgcagctccgcgcactcacggagat

SEQ ID NO: 805627 - DNA, 25 bp, Mus musculus
tgcagctccgcggactcacggagat

SEQ ID NO: 805628 - DNA, 25 bp, Mus musculus
tgcagctcgccaaggcttacagcct

SEQ ID NO: 805629 - DNA, 25 bp, Mus musculus
tgcagctcgccatggcttacagcct

SEQ ID NO: 805630 - DNA, 25 bp, Mus musculus
tgcagctcggccacaatcgtatcag

SEQ ID NO: 805631 - DNA, 25 bp, Mus musculus
tgcagctcggcctcaatcgtatcag

SEQ ID NO: 805632 - DNA, 25 bp, Mus musculus
tgcagctctcagaccccattgtcaa

SEQ ID NO: 805633 - DNA, 25 bp, Mus musculus
tgcagctctcagtccccattgtcaa

SEQ ID NO: 805634 - DNA, 25 bp, Mus musculus
tgcagctctctcacccacaggaagt

SEQ ID NO: 805635 - DNA, 25 bp, Mus musculus
tgcagctctctctcccacaggaagt

SEQ ID NO: 805636 - DNA, 25 bp, Mus musculus
tgcagctctgacaggatatacactg

SEQ ID NO: 805637 - DNA, 25 bp, Mus musculus
tgcagctctgactggatatacactg

SEQ ID NO: 805638 - DNA, 25 bp, Mus musculus
tgcagctctttgagtcccacgcagg

SEQ ID NO: 805639 - DNA, 25 bp, Mus musculus
tgcagctctttgtgtcccacgcagg

SEQ ID NO: 805640 - DNA, 25 bp, Mus musculus
tgcagctgaaacaggaggccacaaa

SEQ ID NO: 805641 - DNA, 25 bp, Mus musculus
tgcagctgaaactggaggccacaaa

SEQ ID NO: 805642 - DNA, 25 bp, Mus musculus
tgcagctgaacaacactgaggagaa

SEQ ID NO: 805643 - DNA, 25 bp, Mus musculus
tgcagctgaacatcactgaggagaa

SEQ ID NO: 805644 - DNA, 25 bp, Mus musculus
tgcagctgactcagaggactcccca

SEQ ID NO: 805645 - DNA, 25 bp, Mus musculus
tgcagctgactctgaggactcccca

SEQ ID NO: 805646 - DNA, 25 bp, Mus musculus
tgcagctgccaaacagggtaaaaag

SEQ ID NO: 805647 - DNA, 25 bp, Mus musculus
tgcagctgccaatcagggtaaaaag

SEQ ID NO: 805648 - DNA, 25 bp, Mus musculus
tgcagctgccagatacaaagattgg

SEQ ID NO: 805649 - DNA, 25 bp, Mus musculus
tgcagctgccagatagcatgaagct

SEQ ID NO: 805650 - DNA, 25 bp, Mus musculus
tgcagctgccagttacaaagattgg

SEQ ID NO: 805651 - DNA, 25 bp, Mus musculus
tgcagctgccagttagcatgaagct

SEQ ID NO: 805652 - DNA, 25 bp, Mus musculus
tgcagctgcccgcttggattcacgc

SEQ ID NO: 805653 - DNA, 25 bp, Mus musculus
tgcagctgcccggttggattcacgc

SEQ ID NO: 805654 - DNA, 25 bp, Mus musculus
tgcagctgctgtcgagaaactggaa

SEQ ID NO: 805655 - DNA, 25 bp, Mus musculus
tgcagctgctgtggagaaactggaa

SEQ ID NO: 805656 - DNA, 25 bp, Mus musculus
tgcagctggaaactaatctaaagag

SEQ ID NO: 805657 - DNA, 25 bp, Mus musculus
tgcagctggaaagtaatctaaagag

SEQ ID NO: 805658 - DNA, 25 bp, Mus musculus
tgcagctggcaaaacgacgatcttg

SEQ ID NO: 805659 - DNA, 25 bp, Mus musculus
tgcagctggcaatacgacgatcttg

SEQ ID NO: 805660 - DNA, 25 bp, Mus musculus
tgcagctgggggactttctcattaa

SEQ ID NO: 805661 - DNA, 25 bp, Mus musculus
tgcagctgggggtctttctcattaa

SEQ ID NO: 805662 - DNA, 25 bp, Mus musculus
tgcagctgggtcacagctcctcgca

SEQ ID NO: 805663 - DNA, 25 bp, Mus musculus
tgcagctgggtctcagctcctcgca

SEQ ID NO: 805664 - DNA, 25 bp, Mus musculus
tgcagctgggttagacaaaccctaa

SEQ ID NO: 805665 - DNA, 25 bp, Mus musculus
tgcagctgggtttgacaaaccctaa

SEQ ID NO: 805666 - DNA, 25 bp, Mus musculus
tgcagctggttacctgtcagacagg

SEQ ID NO: 805667 - DNA, 25 bp, Mus musculus
tgcagctggttagctgtcagacagg

SEQ ID NO: 805668 - DNA, 25 bp, Mus musculus
tgcagctggttcagacacctgccca

SEQ ID NO: 805669 - DNA, 25 bp, Mus musculus
tgcagctggttctgacacctgccca

SEQ ID NO: 805670 - DNA, 25 bp, Mus musculus
tgcagctgtaccctgagaactcgga

SEQ ID NO: 805671 - DNA, 25 bp, Mus musculus
tgcagctgtaccgtgagaactcgga

SEQ ID NO: 805672 - DNA, 25 bp, Mus musculus
tgcagctgtgggacttcaagcggtt

SEQ ID NO: 805673 - DNA, 25 bp, Mus musculus
tgcagctgtgggatactgcgggtca

SEQ ID NO: 805674 - DNA, 25 bp, Mus musculus
tgcagctgtgggtcttcaagcggtt

SEQ ID NO: 805675 - DNA, 25 bp, Mus musculus
tgcagctgtgggttactgcgggtca

SEQ ID NO: 805676 - DNA, 25 bp, Mus musculus
tgcagctgtggtcacccctgaagct

SEQ ID NO: 805677 - DNA, 25 bp, Mus musculus
tgcagctgtggtgacccctgaagct

SEQ ID NO: 805678 - DNA, 25 bp, Mus musculus
tgcagctgttctcagcatgattggg

SEQ ID NO: 805679 - DNA, 25 bp, Mus musculus
tgcagctgttctgagcatgattggg

SEQ ID NO: 805680 - DNA, 25 bp, Mus musculus
tgcagctgttttatgacctgtatca

SEQ ID NO: 805681 - DNA, 25 bp, Mus musculus
tgcagctgttttttgacctgtatca

SEQ ID NO: 805682 - DNA, 25 bp, Mus musculus
tgcagcttaaagaaaatcccatggt

SEQ ID NO: 805683 - DNA, 25 bp, Mus musculus
tgcagcttaaagtaaatcccatggt

SEQ ID NO: 805684 - DNA, 25 bp, Mus musculus
tgcagcttccacacgagctcgacta

SEQ ID NO: 805685 - DNA, 25 bp, Mus musculus
tgcagcttccactcgagctcgacta

SEQ ID NO: 805686 - DNA, 25 bp, Mus musculus
tgcagcttccagatccctgaggagg

SEQ ID NO: 805687 - DNA, 25 bp, Mus musculus
tgcagcttccagttccctgaggagg

SEQ ID NO: 805688 - DNA, 25 bp, Mus musculus
tgcagcttcgaaatgctaggattcc

SEQ ID NO: 805689 - DNA, 25 bp, Mus musculus
tgcagcttcgaacaataggcatgag

SEQ ID NO: 805690 - DNA, 25 bp, Mus musculus
tgcagcttcgaagaataggcatgag

SEQ ID NO: 805691 - DNA, 25 bp, Mus musculus
tgcagcttcgaattgctaggattcc

SEQ ID NO: 805692 - DNA, 25 bp, Mus musculus
tgcagcttcgctcccaagacttgct

SEQ ID NO: 805693 - DNA, 25 bp, Mus musculus
tgcagcttcgctgccaagacttgct

SEQ ID NO: 805694 - DNA, 25 bp, Mus musculus
tgcagcttcttccagatggcagccg

SEQ ID NO: 805695 - DNA, 25 bp, Mus musculus
tgcagcttcttcgagatggcagccg

SEQ ID NO: 805696 - DNA, 25 bp, Mus musculus
tgcagcttgggaagacgatgagccc

SEQ ID NO: 805697 - DNA, 25 bp, Mus musculus
tgcagcttgggatgacgatgagccc

SEQ ID NO: 805698 - DNA, 25 bp, Mus musculus
tgcagcttgtgtcccctgagagtcc

SEQ ID NO: 805699 - DNA, 25 bp, Mus musculus
tgcagcttgtgtgccctgagagtcc

SEQ ID NO: 805700 - DNA, 25 bp, Mus musculus
tgcaggaaaagtcaatcttggcgcc

SEQ ID NO: 805701 - DNA, 25 bp, Mus musculus
tgcaggaaaagtgaatcttggcgcc

SEQ ID NO: 805702 - DNA, 25 bp, Mus musculus
tgcaggaaacctcgtacccgggctt

SEQ ID NO: 805703 - DNA, 25 bp, Mus musculus
tgcaggaaacctggtacccgggctt

SEQ ID NO: 805704 - DNA, 25 bp, Mus musculus
tgcaggaacagtagcctggatggct

SEQ ID NO: 805705 - DNA, 25 bp, Mus musculus
tgcaggaacagttgcctggatggct

SEQ ID NO: 805706 - DNA, 25 bp, Mus musculus
tgcaggaaccaacagaacagacttt

SEQ ID NO: 805707 - DNA, 25 bp, Mus musculus
tgcaggaaccaagagaacagacttt

SEQ ID NO: 805708 - DNA, 25 bp, Mus musculus
tgcaggaaccacattatggatcttt

SEQ ID NO: 805709 - DNA, 25 bp, Mus musculus
tgcaggaaccactttatggatcttt

SEQ ID NO: 805710 - DNA, 25 bp, Mus musculus
tgcaggaacccactatgcaggacaa

SEQ ID NO: 805711 - DNA, 25 bp, Mus musculus
tgcaggaacccagtatgcaggacaa

SEQ ID NO: 805712 - DNA, 25 bp, Mus musculus
tgcaggaaccccagaacatggacaa

SEQ ID NO: 805713 - DNA, 25 bp, Mus musculus
tgcaggaacccctgaacatggacaa

SEQ ID NO: 805714 - DNA, 25 bp, Mus musculus
tgcaggaagccaagtcggccgcctt

SEQ ID NO: 805715 - DNA, 25 bp, Mus musculus
tgcaggaagccatgtcggccgcctt

SEQ ID NO: 805716 - DNA, 25 bp, Mus musculus
tgcaggaagtctagtgcattctggg

SEQ ID NO: 805717 - DNA, 25 bp, Mus musculus
tgcaggaagtcttgtgcattctggg

SEQ ID NO: 805718 - DNA, 25 bp, Mus musculus
tgcaggaagttcacagactggagtc

SEQ ID NO: 805719 - DNA, 25 bp, Mus musculus
tgcaggaagttctcagactggagtc

SEQ ID NO: 805720 - DNA, 25 bp, Mus musculus
tgcaggacatgaataatgaggtgga

SEQ ID NO: 805721 - DNA, 25 bp, Mus musculus
tgcaggacatgattaatgaggtgga

SEQ ID NO: 805722 - DNA, 25 bp, Mus musculus
tgcaggacatgcagcgtacgcagtc

SEQ ID NO: 805723 - DNA, 25 bp, Mus musculus
tgcaggacatgctgcgtacgcagtc

SEQ ID NO: 805724 - DNA, 25 bp, Mus musculus
tgcaggaccaagatgaggacgccac

SEQ ID NO: 805725 - DNA, 25 bp, Mus musculus
tgcaggaccaagttgaggacgccac

SEQ ID NO: 805726 - DNA, 25 bp, Mus musculus
tgcaggaccagacagacatcatctt

SEQ ID NO: 805727 - DNA, 25 bp, Mus musculus
tgcaggaccagagagacatcatctt

SEQ ID NO: 805728 - DNA, 25 bp, Mus musculus
tgcaggacccaacgtactcaatgag

SEQ ID NO: 805729 - DNA, 25 bp, Mus musculus
tgcaggacccaaggtactcaatgag

SEQ ID NO: 805730 - DNA, 25 bp, Mus musculus
tgcaggaccccgagggcaactgtgt

SEQ ID NO: 805731 - DNA, 25 bp, Mus musculus
tgcaggaccccgtgggcaactgtgt

SEQ ID NO: 805732 - DNA, 25 bp, Mus musculus
tgcaggactacgagcagaagaccaa

SEQ ID NO: 805733 - DNA, 25 bp, Mus musculus
tgcaggactacgtgcagaagaccaa

SEQ ID NO: 805734 - DNA, 25 bp, Mus musculus
tgcaggagaatcagcgcaaggagaa

SEQ ID NO: 805735 - DNA, 25 bp, Mus musculus
tgcaggagaatctgcgcaaggagaa

SEQ ID NO: 805736 - DNA, 25 bp, Mus musculus
tgcaggagaatgagtatgacgaatt

SEQ ID NO: 805737 - DNA, 25 bp, Mus musculus
tgcaggagaatgtgtatgacgaatt

SEQ ID NO: 805738 - DNA, 25 bp, Mus musculus
tgcaggagaccaagaagtccgtaaa

SEQ ID NO: 805739 - DNA, 25 bp, Mus musculus
tgcaggagaccatgaagtccgtaaa

SEQ ID NO: 805740 - DNA, 25 bp, Mus musculus
tgcaggagagtgacaatatggaacg

SEQ ID NO: 805741 - DNA, 25 bp, Mus musculus
tgcaggagagtgtcaatatggaacg

SEQ ID NO: 805742 - DNA, 25 bp, Mus musculus
tgcaggagatagatcgctacgccag

SEQ ID NO: 805743 - DNA, 25 bp, Mus musculus
tgcaggagatagttcgctacgccag

SEQ ID NO: 805744 - DNA, 25 bp, Mus musculus
tgcaggagcaccatcgggcctgtag

SEQ ID NO: 805745 - DNA, 25 bp, Mus musculus
tgcaggagcaccttcgggcctgtag

SEQ ID NO: 805746 - DNA, 25 bp, Mus musculus
tgcaggagcattctgtagttgaccc

SEQ ID NO: 805747 - DNA, 25 bp, Mus musculus
tgcaggagcattgtgtagttgaccc

SEQ ID NO: 805748 - DNA, 25 bp, Mus musculus
tgcaggagccagacagcttggatat

SEQ ID NO: 805749 - DNA, 25 bp, Mus musculus
tgcaggagccagtcagcttggatat

SEQ ID NO: 805750 - DNA, 25 bp, Mus musculus
tgcaggagccttacttgggagtgac

SEQ ID NO: 805751 - DNA, 25 bp, Mus musculus
tgcaggagcctttcttgggagtgac

SEQ ID NO: 805752 - DNA, 25 bp, Mus musculus
tgcaggagcgatactcagagccaac

SEQ ID NO: 805753 - DNA, 25 bp, Mus musculus
tgcaggagcgattctcagagccaac

SEQ ID NO: 805754 - DNA, 25 bp, Mus musculus
tgcaggagcgttctgatcttacagc

SEQ ID NO: 805755 - DNA, 25 bp, Mus musculus
tgcaggagcgttgtgatcttacagc

SEQ ID NO: 805756 - DNA, 25 bp, Mus musculus
tgcaggagctatccactacacgggt

SEQ ID NO: 805757 - DNA, 25 bp, Mus musculus
tgcaggagctatgcactacacgggt

SEQ ID NO: 805758 - DNA, 25 bp, Mus musculus
tgcaggagctgcctgatgcagtccc

SEQ ID NO: 805759 - DNA, 25 bp, Mus musculus
tgcaggagctgcgtgatgcagtccc

SEQ ID NO: 805760 - DNA, 25 bp, Mus musculus
tgcaggagctggattcaagcaatgg

SEQ ID NO: 805761 - DNA, 25 bp, Mus musculus
tgcaggagctggtttcaagcaatgg

SEQ ID NO: 805762 - DNA, 25 bp, Mus musculus
tgcaggaggaccactaaagggagac

SEQ ID NO: 805763 - DNA, 25 bp, Mus musculus
tgcaggaggacctctaaagggagac

SEQ ID NO: 805764 - DNA, 25 bp, Mus musculus
tgcaggagtccgatatagctgtggt

SEQ ID NO: 805765 - DNA, 25 bp, Mus musculus
tgcaggagtccgttatagctgtggt

SEQ ID NO: 805766 - DNA, 25 bp, Mus musculus
tgcaggagtctgagcattgacttac

SEQ ID NO: 805767 - DNA, 25 bp, Mus musculus
tgcaggagtctgtgcattgacttac

SEQ ID NO: 805768 - DNA, 25 bp, Mus musculus
tgcaggagtggccagctaccttttc

SEQ ID NO: 805769 - DNA, 25 bp, Mus musculus
tgcaggagtggcgagctaccttttc

SEQ ID NO: 805770 - DNA, 25 bp, Mus musculus
tgcaggagttcaaggatgtggccct

SEQ ID NO: 805771 - DNA, 25 bp, Mus musculus
tgcaggagttcatggatgtggccct

SEQ ID NO: 805772 - DNA, 25 bp, Mus musculus
tgcaggagtttgagagaccagaaag

SEQ ID NO: 805773 - DNA, 25 bp, Mus musculus
tgcaggagtttgtgagaccagaaag

SEQ ID NO: 805774 - DNA, 25 bp, Mus musculus
tgcaggatcagaacacagcaagccc

SEQ ID NO: 805775 - DNA, 25 bp, Mus musculus
tgcaggatcagatcacagcaagccc

SEQ ID NO: 805776 - DNA, 25 bp, Mus musculus
tgcaggatctccaacaacttgacag

SEQ ID NO: 805777 - DNA, 25 bp, Mus musculus
tgcaggatctcctacaacttgacag

SEQ ID NO: 805778 - DNA, 25 bp, Mus musculus
tgcaggatgacaacccgttcagctt

SEQ ID NO: 805779 - DNA, 25 bp, Mus musculus
tgcaggatgacatcccgttcagctt

SEQ ID NO: 805780 - DNA, 25 bp, Mus musculus
tgcaggatggaaaacgcctcctaga

SEQ ID NO: 805781 - DNA, 25 bp, Mus musculus
tgcaggatggaatacgcctcctaga

SEQ ID NO: 805782 - DNA, 25 bp, Mus musculus
tgcaggatggcgattaatggctgct

SEQ ID NO: 805783 - DNA, 25 bp, Mus musculus
tgcaggatggcgtttaatggctgct

SEQ ID NO: 805784 - DNA, 25 bp, Mus musculus
tgcaggattggaaggtggcctacct

SEQ ID NO: 805785 - DNA, 25 bp, Mus musculus
tgcaggattggatggtggcctacct

SEQ ID NO: 805786 - DNA, 25 bp, Mus musculus
tgcaggcaccatctttcgggacttg

SEQ ID NO: 805787 - DNA, 25 bp, Mus musculus
tgcaggcaccatgtttcgggacttg

SEQ ID NO: 805788 - DNA, 25 bp, Mus musculus
tgcaggcactggagcccaaacagat

SEQ ID NO: 805789 - DNA, 25 bp, Mus musculus
tgcaggcactggtgcccaaacagat

SEQ ID NO: 805790 - DNA, 25 bp, Mus musculus
tgcaggcagcctacctgctaaccgg

SEQ ID NO: 805791 - DNA, 25 bp, Mus musculus
tgcaggcagccttcctgctaaccgg

SEQ ID NO: 805792 - DNA, 25 bp, Mus musculus
tgcaggcagcttcagtcttgagact

SEQ ID NO: 805793 - DNA, 25 bp, Mus musculus
tgcaggcagcttgagtcttgagact

SEQ ID NO: 805794 - DNA, 25 bp, Mus musculus
tgcaggcagttcatccctcatcagc

SEQ ID NO: 805795 - DNA, 25 bp, Mus musculus
tgcaggcagttcttccctcatcagc

SEQ ID NO: 805796 - DNA, 25 bp, Mus musculus
tgcaggccaagccaagtgaggcaca

SEQ ID NO: 805797 - DNA, 25 bp, Mus musculus
tgcaggccaagcgaagtgaggcaca

SEQ ID NO: 805798 - DNA, 25 bp, Mus musculus
tgcaggccactgacactgtcaccaa

SEQ ID NO: 805799 - DNA, 25 bp, Mus musculus
tgcaggccactgtcactgtcaccaa

SEQ ID NO: 805800 - DNA, 25 bp, Mus musculus
tgcaggcccagacccggcatgaact

SEQ ID NO: 805801 - DNA, 25 bp, Mus musculus
tgcaggcccagagccggcatgaact

SEQ ID NO: 805802 - DNA, 25 bp, Mus musculus
tgcaggcccgaaagcggaaatactt

SEQ ID NO: 805803 - DNA, 25 bp, Mus musculus
tgcaggcccgaatgcggaaatactt

SEQ ID NO: 805804 - DNA, 25 bp, Mus musculus
tgcaggcctagcagagctgggacat

SEQ ID NO: 805805 - DNA, 25 bp, Mus musculus
tgcaggcctagctgagctgggacat

SEQ ID NO: 805806 - DNA, 25 bp, Mus musculus
tgcaggcctcccagcatggatagtt

SEQ ID NO: 805807 - DNA, 25 bp, Mus musculus
tgcaggcctccctgcatggatagtt

SEQ ID NO: 805808 - DNA, 25 bp, Mus musculus
tgcaggcctggcctcatgctggatc

SEQ ID NO: 805809 - DNA, 25 bp, Mus musculus
tgcaggcctggcgtcatgctggatc

SEQ ID NO: 805810 - DNA, 25 bp, Mus musculus
tgcaggccttggagcgtgtctttga

SEQ ID NO: 805811 - DNA, 25 bp, Mus musculus
tgcaggccttggcaggacaatgcct

SEQ ID NO: 805812 - DNA, 25 bp, Mus musculus
tgcaggccttgggaggacaatgcct

SEQ ID NO: 805813 - DNA, 25 bp, Mus musculus
tgcaggccttggtgcgtgtctttga

SEQ ID NO: 805814 - DNA, 25 bp, Mus musculus
tgcaggccttgtagcccactggctg

SEQ ID NO: 805815 - DNA, 25 bp, Mus musculus
tgcaggccttgttgcccactggctg

SEQ ID NO: 805816 - DNA, 25 bp, Mus musculus
tgcaggcgagaccttcctggtgctg

SEQ ID NO: 805817 - DNA, 25 bp, Mus musculus
tgcaggcgagacgttcctggtgctg

SEQ ID NO: 805818 - DNA, 25 bp, Mus musculus
tgcaggcgctaacaccaccgacaag

SEQ ID NO: 805819 - DNA, 25 bp, Mus musculus
tgcaggcgctaagaccaccgacaag

SEQ ID NO: 805820 - DNA, 25 bp, Mus musculus
tgcaggcggcggctgtggaccaggc

SEQ ID NO: 805821 - DNA, 25 bp, Mus musculus
tgcaggcggcgggtgtggaccaggc

SEQ ID NO: 805822 - DNA, 25 bp, Mus musculus
tgcaggcgtaagacttccctgtttg

SEQ ID NO: 805823 - DNA, 25 bp, Mus musculus
tgcaggcgtaagtcttccctgtttg

SEQ ID NO: 805824 - DNA, 25 bp, Mus musculus
tgcaggctgcatcagcgaagttcct

SEQ ID NO: 805825 - DNA, 25 bp, Mus musculus
tgcaggctgcatgagcgaagttcct

SEQ ID NO: 805826 - DNA, 25 bp, Mus musculus
tgcaggctgccacaggaacagctca

SEQ ID NO: 805827 - DNA, 25 bp, Mus musculus
tgcaggctgccagaggaacagctca

SEQ ID NO: 805828 - DNA, 25 bp, Mus musculus
tgcaggctggctacgatgtgccgac

SEQ ID NO: 805829 - DNA, 25 bp, Mus musculus
tgcaggctggcttcgatgtgccgac

SEQ ID NO: 805830 - DNA, 25 bp, Mus musculus
tgcaggctgtcaacacagaggactc

SEQ ID NO: 805831 - DNA, 25 bp, Mus musculus
tgcaggctgtcatcacagaggactc

SEQ ID NO: 805832 - DNA, 25 bp, Mus musculus
tgcaggctgtgtacacgctgcctca

SEQ ID NO: 805833 - DNA, 25 bp, Mus musculus
tgcaggctgtgtccaacttgtccgg

SEQ ID NO: 805834 - DNA, 25 bp, Mus musculus
tgcaggctgtgtgcaacttgtccgg

SEQ ID NO: 805835 - DNA, 25 bp, Mus musculus
tgcaggctgtgttcacgctgcctca

SEQ ID NO: 805836 - DNA, 25 bp, Mus musculus
tgcagggacagaatgccctcctggt

SEQ ID NO: 805837 - DNA, 25 bp, Mus musculus
tgcagggacagattgccctcctggt

SEQ ID NO: 805838 - DNA, 25 bp, Mus musculus
tgcagggagagccaatgcttgccaa

SEQ ID NO: 805839 - DNA, 25 bp, Mus musculus
tgcagggagagcgaatgcttgccaa

SEQ ID NO: 805840 - DNA, 25 bp, Mus musculus
tgcagggagccacctccttggaaac

SEQ ID NO: 805841 - DNA, 25 bp, Mus musculus
tgcagggagccagctccttggaaac

SEQ ID NO: 805842 - DNA, 25 bp, Mus musculus
tgcagggatcttatcggcaacactg

SEQ ID NO: 805843 - DNA, 25 bp, Mus musculus
tgcagggatcttttcggcaacactg

SEQ ID NO: 805844 - DNA, 25 bp, Mus musculus
tgcagggattaaccttattttacag

SEQ ID NO: 805845 - DNA, 25 bp, Mus musculus
tgcagggattaagcttattttacag

SEQ ID NO: 805846 - DNA, 25 bp, Mus musculus
tgcagggccacgaactgctgctgtg

SEQ ID NO: 805847 - DNA, 25 bp, Mus musculus
tgcagggccacgtactgctgctgtg

SEQ ID NO: 805848 - DNA, 25 bp, Mus musculus
tgcagggccatgagcggtccatcac

SEQ ID NO: 805849 - DNA, 25 bp, Mus musculus
tgcagggccatgtgcggtccatcac

SEQ ID NO: 805850 - DNA, 25 bp, Mus musculus
tgcagggcctgaagtactccttctc

SEQ ID NO: 805851 - DNA, 25 bp, Mus musculus
tgcagggcctgatgtactccttctc

SEQ ID NO: 805852 - DNA, 25 bp, Mus musculus
tgcagggcctgtagcaactgaccct

SEQ ID NO: 805853 - DNA, 25 bp, Mus musculus
tgcagggcctgttgcaactgaccct

SEQ ID NO: 805854 - DNA, 25 bp, Mus musculus
tgcagggccttccatgtccccaaga

SEQ ID NO: 805855 - DNA, 25 bp, Mus musculus
tgcagggccttcgatgtccccaaga

SEQ ID NO: 805856 - DNA, 25 bp, Mus musculus
tgcagggcgcttagttcgctaccag

SEQ ID NO: 805857 - DNA, 25 bp, Mus musculus
tgcagggcgctttgttcgctaccag

SEQ ID NO: 805858 - DNA, 25 bp, Mus musculus
tgcagggcttgaatgaaatcctggc

SEQ ID NO: 805859 - DNA, 25 bp, Mus musculus
tgcagggcttgattgaaatcctggc

SEQ ID NO: 805860 - DNA, 25 bp, Mus musculus
tgcagggctttaacagggcaagctc

SEQ ID NO: 805861 - DNA, 25 bp, Mus musculus
tgcagggctttatcagggcaagctc

SEQ ID NO: 805862 - DNA, 25 bp, Mus musculus
tgcagggtacaccttggcgcacatg

SEQ ID NO: 805863 - DNA, 25 bp, Mus musculus
tgcagggtacacgttggcgcacatg

SEQ ID NO: 805864 - DNA, 25 bp, Mus musculus
tgcagggtcacacttcatggcttcc

SEQ ID NO: 805865 - DNA, 25 bp, Mus musculus
tgcagggtcacagttcatggcttcc

SEQ ID NO: 805866 - DNA, 25 bp, Mus musculus
tgcagggtcagtctttaaaagtcca

SEQ ID NO: 805867 - DNA, 25 bp, Mus musculus
tgcagggtcagtgtttaaaagtcca

SEQ ID NO: 805868 - DNA, 25 bp, Mus musculus
tgcagggtcccacggcactgacagc

SEQ ID NO: 805869 - DNA, 25 bp, Mus musculus
tgcagggtcccagggcactgacagc

SEQ ID NO: 805870 - DNA, 25 bp, Mus musculus
tgcagggtgaagcaccccaactccg

SEQ ID NO: 805871 - DNA, 25 bp, Mus musculus
tgcagggtgaaggaccccaactccg

SEQ ID NO: 805872 - DNA, 25 bp, Mus musculus
tgcagggtgatacgaacagccaaaa

SEQ ID NO: 805873 - DNA, 25 bp, Mus musculus
tgcagggtgataggaacagccaaaa

SEQ ID NO: 805874 - DNA, 25 bp, Mus musculus
tgcagggtgtgaccctcgctcccga

SEQ ID NO: 805875 - DNA, 25 bp, Mus musculus
tgcagggtgtgagcctcgctcccga

SEQ ID NO: 805876 - DNA, 25 bp, Mus musculus
tgcaggtcaattactccctaaaggg

SEQ ID NO: 805877 - DNA, 25 bp, Mus musculus
tgcaggtcaatttctccctaaaggg

SEQ ID NO: 805878 - DNA, 25 bp, Mus musculus
tgcaggtcaccaccctcaacttcat

SEQ ID NO: 805879 - DNA, 25 bp, Mus musculus
tgcaggtcaccagcctcaacttcat

SEQ ID NO: 805880 - DNA, 25 bp, Mus musculus
tgcaggtcatctcagtactacaatg

SEQ ID NO: 805881 - DNA, 25 bp, Mus musculus
tgcaggtcatctgagtactacaatg

SEQ ID NO: 805882 - DNA, 25 bp, Mus musculus
tgcaggtccaagcagccattcttgc

SEQ ID NO: 805883 - DNA, 25 bp, Mus musculus
tgcaggtccaaggagccattcttgc

SEQ ID NO: 805884 - DNA, 25 bp, Mus musculus
tgcaggtcccaccatctatgaggag

SEQ ID NO: 805885 - DNA, 25 bp, Mus musculus
tgcaggtcccacgatctatgaggag

SEQ ID NO: 805886 - DNA, 25 bp, Mus musculus
tgcaggtcctggagtcttcgtcgcg

SEQ ID NO: 805887 - DNA, 25 bp, Mus musculus
tgcaggtcctggtgtcttcgtcgcg

SEQ ID NO: 805888 - DNA, 25 bp, Mus musculus
tgcaggtccttcagggacacctcgg

SEQ ID NO: 805889 - DNA, 25 bp, Mus musculus
tgcaggtccttctgggacacctcgg

SEQ ID NO: 805890 - DNA, 25 bp, Mus musculus
tgcaggtcggacacccttgaggaca

SEQ ID NO: 805891 - DNA, 25 bp, Mus musculus
tgcaggtcggactcccttgaggaca

SEQ ID NO: 805892 - DNA, 25 bp, Mus musculus
tgcaggtcgggtacctcgtaccaag

SEQ ID NO: 805893 - DNA, 25 bp, Mus musculus
tgcaggtcgggttcctcgtaccaag

SEQ ID NO: 805894 - DNA, 25 bp, Mus musculus
tgcaggtcggttccttctgcgtcgt

SEQ ID NO: 805895 - DNA, 25 bp, Mus musculus
tgcaggtcggttgcttctgcgtcgt

SEQ ID NO: 805896 - DNA, 25 bp, Mus musculus
tgcaggtctatgacgcttctaacag

SEQ ID NO: 805897 - DNA, 25 bp, Mus musculus
tgcaggtctatgtcgcttctaacag

SEQ ID NO: 805898 - DNA, 25 bp, Mus musculus
tgcaggtgatcccagccgtcctgaa

SEQ ID NO: 805899 - DNA, 25 bp, Mus musculus
tgcaggtgatccgagccgtcctgaa

SEQ ID NO: 805900 - DNA, 25 bp, Mus musculus
tgcaggtgcccgagtactcagagca

SEQ ID NO: 805901 - DNA, 25 bp, Mus musculus
tgcaggtgcccgtgtactcagagca

SEQ ID NO: 805902 - DNA, 25 bp, Mus musculus
tgcaggtgctctacctagctgtttg

SEQ ID NO: 805903 - DNA, 25 bp, Mus musculus
tgcaggtgctcttcctagctgtttg

SEQ ID NO: 805904 - DNA, 25 bp, Mus musculus
tgcaggtgcttgaatgagcccaaca

SEQ ID NO: 805905 - DNA, 25 bp, Mus musculus
tgcaggtgcttgtatgagcccaaca

SEQ ID NO: 805906 - DNA, 25 bp, Mus musculus
tgcaggtggaagaaggcagtgagcc

SEQ ID NO: 805907 - DNA, 25 bp, Mus musculus
tgcaggtggaagtaggcagtgagcc

SEQ ID NO: 805908 - DNA, 25 bp, Mus musculus
tgcaggtggacacgcagaactacca

SEQ ID NO: 805909 - DNA, 25 bp, Mus musculus
tgcaggtggacaggcagaactacca

SEQ ID NO: 805910 - DNA, 25 bp, Mus musculus
tgcaggtggatcacaccaagcgctt

SEQ ID NO: 805911 - DNA, 25 bp, Mus musculus
tgcaggtggatctcaccaagcgctt

SEQ ID NO: 805912 - DNA, 25 bp, Mus musculus
tgcaggtggattagggctgtaactt

SEQ ID NO: 805913 - DNA, 25 bp, Mus musculus
tgcaggtggatttgggctgtaactt

SEQ ID NO: 805914 - DNA, 25 bp, Mus musculus
tgcaggtggcttaagggaacattgc

SEQ ID NO: 805915 - DNA, 25 bp, Mus musculus
tgcaggtggctttagggaacattgc

SEQ ID NO: 805916 - DNA, 25 bp, Mus musculus
tgcaggtgtcggatgtctgtctacc

SEQ ID NO: 805917 - DNA, 25 bp, Mus musculus
tgcaggtgtcggttgtctgtctacc

SEQ ID NO: 805918 - DNA, 25 bp, Mus musculus
tgcaggtgtctcagctgagggttcc

SEQ ID NO: 805919 - DNA, 25 bp, Mus musculus
tgcaggtgtctctgctgagggttcc

SEQ ID NO: 805920 - DNA, 25 bp, Mus musculus
tgcaggtgtctgattccccttacga

SEQ ID NO: 805921 - DNA, 25 bp, Mus musculus
tgcaggtgtctgtttccccttacga

SEQ ID NO: 805922 - DNA, 25 bp, Mus musculus
tgcaggtgtgacagaactctgaacg

SEQ ID NO: 805923 - DNA, 25 bp, Mus musculus
tgcaggtgtgactgaactctgaacg

SEQ ID NO: 805924 - DNA, 25 bp, Mus musculus
tgcaggttagacctccagacaccgg

SEQ ID NO: 805925 - DNA, 25 bp, Mus musculus
tgcaggttagacgtccagacaccgg

SEQ ID NO: 805926 - DNA, 25 bp, Mus musculus
tgcaggttccctatccgctacggtg

SEQ ID NO: 805927 - DNA, 25 bp, Mus musculus
tgcaggttccctttccgctacggtg

SEQ ID NO: 805928 - DNA, 25 bp, Mus musculus
tgcaggttgatgacaagatggccat

SEQ ID NO: 805929 - DNA, 25 bp, Mus musculus
tgcaggttgatgtcaagatggccat

SEQ ID NO: 805930 - DNA, 25 bp, Mus musculus
tgcaggttggatcgcaggcatccca

SEQ ID NO: 805931 - DNA, 25 bp, Mus musculus
tgcaggttggatggcaggcatccca

SEQ ID NO: 805932 - DNA, 25 bp, Mus musculus
tgcaggtttctaagtatggtgacct

SEQ ID NO: 805933 - DNA, 25 bp, Mus musculus
tgcaggtttctatgtatggtgacct

SEQ ID NO: 805934 - DNA, 25 bp, Mus musculus
tgcaggtttgcaccatcccatacct

SEQ ID NO: 805935 - DNA, 25 bp, Mus musculus
tgcaggtttgcagcatcccatacct

SEQ ID NO: 805936 - DNA, 25 bp, Mus musculus
tgcagtaaacaaagacaccacagag

SEQ ID NO: 805937 - DNA, 25 bp, Mus musculus
tgcagtaaacaatgacaccacagag

SEQ ID NO: 805938 - DNA, 25 bp, Mus musculus
tgcagtaaagcccttgctgagcagc

SEQ ID NO: 805939 - DNA, 25 bp, Mus musculus
tgcagtaaagccgttgctgagcagc

SEQ ID NO: 805940 - DNA, 25 bp, Mus musculus
tgcagtaacccgaaacccattttct

SEQ ID NO: 805941 - DNA, 25 bp, Mus musculus
tgcagtaacccgtaacccattttct

SEQ ID NO: 805942 - DNA, 25 bp, Mus musculus
tgcagtaagggaaccagcaggcatt

SEQ ID NO: 805943 - DNA, 25 bp, Mus musculus
tgcagtaagggatccagcaggcatt

SEQ ID NO: 805944 - DNA, 25 bp, Mus musculus
tgcagtaattggcatagtgatctac

SEQ ID NO: 805945 - DNA, 25 bp, Mus musculus
tgcagtaattgggatagtgatctac

SEQ ID NO: 805946 - DNA, 25 bp, Mus musculus
tgcagtacaatacgagtaaaacagg

SEQ ID NO: 805947 - DNA, 25 bp, Mus musculus
tgcagtacaataggagtaaaacagg

SEQ ID NO: 805948 - DNA, 25 bp, Mus musculus
tgcagtacatccagaaccccatctg

SEQ ID NO: 805949 - DNA, 25 bp, Mus musculus
tgcagtacatcctgaaccccatctg

SEQ ID NO: 805950 - DNA, 25 bp, Mus musculus
tgcagtaccccaagacagtgtggat

SEQ ID NO: 805951 - DNA, 25 bp, Mus musculus
tgcagtaccccatgacagtgtggat

SEQ ID NO: 805952 - DNA, 25 bp, Mus musculus
tgcagtacctatcgccctggagcgc

SEQ ID NO: 805953 - DNA, 25 bp, Mus musculus
tgcagtacctatggccctggagcgc

SEQ ID NO: 805954 - DNA, 25 bp, Mus musculus
tgcagtaccttaatgcactcctggc

SEQ ID NO: 805955 - DNA, 25 bp, Mus musculus
tgcagtaccttactcccaaagctgt

SEQ ID NO: 805956 - DNA, 25 bp, Mus musculus
tgcagtaccttagtcccaaagctgt

SEQ ID NO: 805957 - DNA, 25 bp, Mus musculus
tgcagtaccttattgcactcctggc

SEQ ID NO: 805958 - DNA, 25 bp, Mus musculus
tgcagtacgggaaagcaacagcacc

SEQ ID NO: 805959 - DNA, 25 bp, Mus musculus
tgcagtacgggatagcaacagcacc

SEQ ID NO: 805960 - DNA, 25 bp, Mus musculus
tgcagtactactacacccagcacat

SEQ ID NO: 805961 - DNA, 25 bp, Mus musculus
tgcagtactacttcacccagcacat

SEQ ID NO: 805962 - DNA, 25 bp, Mus musculus
tgcagtagacttcccagtagtggcc

SEQ ID NO: 805963 - DNA, 25 bp, Mus musculus
tgcagtagacttgccagtagtggcc

SEQ ID NO: 805964 - DNA, 25 bp, Mus musculus
tgcagtagctgactaccgtgaaacc

SEQ ID NO: 805965 - DNA, 25 bp, Mus musculus
tgcagtagctgagtaccgtgaaacc

SEQ ID NO: 805966 - DNA, 25 bp, Mus musculus
tgcagtaggcaactgagaacactca

SEQ ID NO: 805967 - DNA, 25 bp, Mus musculus
tgcagtaggcaagtgagaacactca

SEQ ID NO: 805968 - DNA, 25 bp, Mus musculus
tgcagtaggcctagttagaagtcct

SEQ ID NO: 805969 - DNA, 25 bp, Mus musculus
tgcagtaggccttgttagaagtcct

SEQ ID NO: 805970 - DNA, 25 bp, Mus musculus
tgcagtatactacatctccagttgt

SEQ ID NO: 805971 - DNA, 25 bp, Mus musculus
tgcagtatactagatctccagttgt

SEQ ID NO: 805972 - DNA, 25 bp, Mus musculus
tgcagtatcagaagaaatagagttc

SEQ ID NO: 805973 - DNA, 25 bp, Mus musculus
tgcagtatcagatgaaatagagttc

SEQ ID NO: 805974 - DNA, 25 bp, Mus musculus
tgcagtatctgcagggcgactatac

SEQ ID NO: 805975 - DNA, 25 bp, Mus musculus
tgcagtatctgctgggcgactatac

SEQ ID NO: 805976 - DNA, 25 bp, Mus musculus
tgcagtattctcatgggtacctcca

SEQ ID NO: 805977 - DNA, 25 bp, Mus musculus
tgcagtattctcctagacccagtgg

SEQ ID NO: 805978 - DNA, 25 bp, Mus musculus
tgcagtattctcgtagacccagtgg

SEQ ID NO: 805979 - DNA, 25 bp, Mus musculus
tgcagtattctcttgggtacctcca

SEQ ID NO: 805980 - DNA, 25 bp, Mus musculus
tgcagtcaagtgcatcaagaatgac

SEQ ID NO: 805981 - DNA, 25 bp, Mus musculus
tgcagtcaagtggatcaagaatgac

SEQ ID NO: 805982 - DNA, 25 bp, Mus musculus
tgcagtcaatgtagagcagtgctct

SEQ ID NO: 805983 - DNA, 25 bp, Mus musculus
tgcagtcaatgttgagcagtgctct

SEQ ID NO: 805984 - DNA, 25 bp, Mus musculus
tgcagtcaccctccagatgtgccat

SEQ ID NO: 805985 - DNA, 25 bp, Mus musculus
tgcagtcaccctgcagatgtgccat

SEQ ID NO: 805986 - DNA, 25 bp, Mus musculus
tgcagtcagactcgaacagtgacct

SEQ ID NO: 805987 - DNA, 25 bp, Mus musculus
tgcagtcagactggaacagtgacct

SEQ ID NO: 805988 - DNA, 25 bp, Mus musculus
tgcagtcagagcaccagatctacga

SEQ ID NO: 805989 - DNA, 25 bp, Mus musculus
tgcagtcagagctccagatctacga

SEQ ID NO: 805990 - DNA, 25 bp, Mus musculus
tgcagtcagcgaagagaataccgtg

SEQ ID NO: 805991 - DNA, 25 bp, Mus musculus
tgcagtcagcgatgagaataccgtg

SEQ ID NO: 805992 - DNA, 25 bp, Mus musculus
tgcagtcagtacaagtcccagagtt

SEQ ID NO: 805993 - DNA, 25 bp, Mus musculus
tgcagtcagtactagtcccagagtt

SEQ ID NO: 805994 - DNA, 25 bp, Mus musculus
tgcagtcagtcaacgtcggcctttt

SEQ ID NO: 805995 - DNA, 25 bp, Mus musculus
tgcagtcagtcatcgtcggcctttt

SEQ ID NO: 805996 - DNA, 25 bp, Mus musculus
tgcagtcatcgcctaagaccacgga

SEQ ID NO: 805997 - DNA, 25 bp, Mus musculus
tgcagtcatcgcgtaagaccacgga

SEQ ID NO: 805998 - DNA, 25 bp, Mus musculus
tgcagtccaaggcactgactgcctg

SEQ ID NO: 805999 - DNA, 25 bp, Mus musculus
tgcagtccaagggactgactgcctg

SEQ ID NO: 806000 - DNA, 25 bp, Mus musculus
tgcagtccacctactcaggatttgg

SEQ ID NO: 806001 - DNA, 25 bp, Mus musculus
tgcagtccaccttctcaggatttgg

SEQ ID NO: 806002 - DNA, 25 bp, Mus musculus
tgcagtccagacctgggatggcatc

SEQ ID NO: 806003 - DNA, 25 bp, Mus musculus
tgcagtccagacgtgggatggcatc

SEQ ID NO: 806004 - DNA, 25 bp, Mus musculus
tgcagtcccgagctgtgcgcagcaa

SEQ ID NO: 806005 - DNA, 25 bp, Mus musculus
tgcagtcccgaggtgtgcgcagcaa

SEQ ID NO: 806006 - DNA, 25 bp, Mus musculus
tgcagtccctggagctctacatcaa

SEQ ID NO: 806007 - DNA, 25 bp, Mus musculus
tgcagtccctggtgctctacatcaa

SEQ ID NO: 806008 - DNA, 25 bp, Mus musculus
tgcagtccgatgaacgacttcagcc

SEQ ID NO: 806009 - DNA, 25 bp, Mus musculus
tgcagtccgatgtacgacttcagcc

SEQ ID NO: 806010 - DNA, 25 bp, Mus musculus
tgcagtccgtgccaaggctactcgt

SEQ ID NO: 806011 - DNA, 25 bp, Mus musculus
tgcagtccgtgcgaaggctactcgt

SEQ ID NO: 806012 - DNA, 25 bp, Mus musculus
tgcagtcctaacctgttcagtgaaa

SEQ ID NO: 806013 - DNA, 25 bp, Mus musculus
tgcagtcctaacgtgttcagtgaaa

SEQ ID NO: 806014 - DNA, 25 bp, Mus musculus
tgcagtcctgctagatttgtgtggc

SEQ ID NO: 806015 - DNA, 25 bp, Mus musculus
tgcagtcctgcttgatttgtgtggc

SEQ ID NO: 806016 - DNA, 25 bp, Mus musculus
tgcagtccttcacttaagcgagggc

SEQ ID NO: 806017 - DNA, 25 bp, Mus musculus
tgcagtccttcagttaagcgagggc

SEQ ID NO: 806018 - DNA, 25 bp, Mus musculus
tgcagtcgcacaccagagagtgaag

SEQ ID NO: 806019 - DNA, 25 bp, Mus musculus
tgcagtcgcacagcagagagtgaag

SEQ ID NO: 806020 - DNA, 25 bp, Mus musculus
tgcagtcgccctccgatcggcaagg

SEQ ID NO: 806021 - DNA, 25 bp, Mus musculus
tgcagtcgccctgcgatcggcaagg

SEQ ID NO: 806022 - DNA, 25 bp, Mus musculus
tgcagtcgtccaagcctgccgagat

SEQ ID NO: 806023 - DNA, 25 bp, Mus musculus
tgcagtcgtccatgcctgccgagat

SEQ ID NO: 806024 - DNA, 25 bp, Mus musculus
tgcagtcgtgacagcgacaagggtc

SEQ ID NO: 806025 - DNA, 25 bp, Mus musculus
tgcagtcgtgactgcgacaagggtc

SEQ ID NO: 806026 - DNA, 25 bp, Mus musculus
tgcagtctacatacgcaacacccgt

SEQ ID NO: 806027 - DNA, 25 bp, Mus musculus
tgcagtctacattcgcaacacccgt

SEQ ID NO: 806028 - DNA, 25 bp, Mus musculus
tgcagtctacgtactgtgacaccag

SEQ ID NO: 806029 - DNA, 25 bp, Mus musculus
tgcagtctacgtcaaaggcacccac

SEQ ID NO: 806030 - DNA, 25 bp, Mus musculus
tgcagtctacgtgaaaggcacccac

SEQ ID NO: 806031 - DNA, 25 bp, Mus musculus
tgcagtctacgttctgtgacaccag

SEQ ID NO: 806032 - DNA, 25 bp, Mus musculus
tgcagtctctggagacctcaggtca

SEQ ID NO: 806033 - DNA, 25 bp, Mus musculus
tgcagtctctggtgacctcaggtca

SEQ ID NO: 806034 - DNA, 25 bp, Mus musculus
tgcagtctgcccatggcatttacct

SEQ ID NO: 806035 - DNA, 25 bp, Mus musculus
tgcagtctgcccttggcatttacct

SEQ ID NO: 806036 - DNA, 25 bp, Mus musculus
tgcagtctgctcaggtgtccaacct

SEQ ID NO: 806037 - DNA, 25 bp, Mus musculus
tgcagtctgctctggtgtccaacct

SEQ ID NO: 806038 - DNA, 25 bp, Mus musculus
tgcagtctgtccaggccaccatgat

SEQ ID NO: 806039 - DNA, 25 bp, Mus musculus
tgcagtctgtcctggccaccatgat

SEQ ID NO: 806040 - DNA, 25 bp, Mus musculus
tgcagtctgtctcccttcgaagtaa

SEQ ID NO: 806041 - DNA, 25 bp, Mus musculus
tgcagtctgtctgccttcgaagtaa

SEQ ID NO: 806042 - DNA, 25 bp, Mus musculus
tgcagtcttcaacggaggaacttct

SEQ ID NO: 806043 - DNA, 25 bp, Mus musculus
tgcagtcttcaagggaggaacttct

SEQ ID NO: 806044 - DNA, 25 bp, Mus musculus
tgcagtcttgttcgtgtttgtaaac

SEQ ID NO: 806045 - DNA, 25 bp, Mus musculus
tgcagtcttgttggtgtttgtaaac

SEQ ID NO: 806046 - DNA, 25 bp, Mus musculus
tgcagtgaacatcatggagctgtac

SEQ ID NO: 806047 - DNA, 25 bp, Mus musculus
tgcagtgaacatgatggagctgtac

SEQ ID NO: 806048 - DNA, 25 bp, Mus musculus
tgcagtgacaggaaatggattggcc

SEQ ID NO: 806049 - DNA, 25 bp, Mus musculus
tgcagtgacaggtaatggattggcc

SEQ ID NO: 806050 - DNA, 25 bp, Mus musculus
tgcagtgactacacctctggacgtg

SEQ ID NO: 806051 - DNA, 25 bp, Mus musculus
tgcagtgactactcctctggacgtg

SEQ ID NO: 806052 - DNA, 25 bp, Mus musculus
tgcagtgactctagagctgggcgcc

SEQ ID NO: 806053 - DNA, 25 bp, Mus musculus
tgcagtgactcttgagctgggcgcc

SEQ ID NO: 806054 - DNA, 25 bp, Mus musculus
tgcagtgagactacaagacccttga

SEQ ID NO: 806055 - DNA, 25 bp, Mus musculus
tgcagtgagacttcaagacccttga

SEQ ID NO: 806056 - DNA, 25 bp, Mus musculus
tgcagtgagagccaaccagagctgc

SEQ ID NO: 806057 - DNA, 25 bp, Mus musculus
tgcagtgagagcgaaccagagctgc

SEQ ID NO: 806058 - DNA, 25 bp, Mus musculus
tgcagtgaggccaaggtttgcgccc

SEQ ID NO: 806059 - DNA, 25 bp, Mus musculus
tgcagtgaggcctaggtttgcgccc

SEQ ID NO: 806060 - DNA, 25 bp, Mus musculus
tgcagtgatcatcgagcttattaat

SEQ ID NO: 806061 - DNA, 25 bp, Mus musculus
tgcagtgatcatggagcttattaat

SEQ ID NO: 806062 - DNA, 25 bp, Mus musculus
tgcagtgatcctcgtcccgaggaac

SEQ ID NO: 806063 - DNA, 25 bp, Mus musculus
tgcagtgatcctggtcccgaggaac

SEQ ID NO: 806064 - DNA, 25 bp, Mus musculus
tgcagtgcacacacagtgaaagaaa

SEQ ID NO: 806065 - DNA, 25 bp, Mus musculus
tgcagtgcacactcagtgaaagaaa

SEQ ID NO: 806066 - DNA, 25 bp, Mus musculus
tgcagtgcacttcaggagttaaatt

SEQ ID NO: 806067 - DNA, 25 bp, Mus musculus
tgcagtgcacttgaggagttaaatt

SEQ ID NO: 806068 - DNA, 25 bp, Mus musculus
tgcagtgccagcaatgctgtagccc

SEQ ID NO: 806069 - DNA, 25 bp, Mus musculus
tgcagtgccagctatgctgtagccc

SEQ ID NO: 806070 - DNA, 25 bp, Mus musculus
tgcagtgcccatcatcacaggtgcc

SEQ ID NO: 806071 - DNA, 25 bp, Mus musculus
tgcagtgcccatgatcacaggtgcc

SEQ ID NO: 806072 - DNA, 25 bp, Mus musculus
tgcagtgccctcacagagacctacg

SEQ ID NO: 806073 - DNA, 25 bp, Mus musculus
tgcagtgccctctcagagacctacg

SEQ ID NO: 806074 - DNA, 25 bp, Mus musculus
tgcagtgccggacctgcctccagtg

SEQ ID NO: 806075 - DNA, 25 bp, Mus musculus
tgcagtgccggagctgcctccagtg

SEQ ID NO: 806076 - DNA, 25 bp, Mus musculus
tgcagtgctaacatagaccagaagg

SEQ ID NO: 806077 - DNA, 25 bp, Mus musculus
tgcagtgctaacttagaccagaagg

SEQ ID NO: 806078 - DNA, 25 bp, Mus musculus
tgcagtggatgtacggctgcgacgt

SEQ ID NO: 806079 - DNA, 25 bp, Mus musculus
tgcagtggatgttcggctgcgacgt

SEQ ID NO: 806080 - DNA, 25 bp, Mus musculus
tgcagtggcataagatgaaggctcc

SEQ ID NO: 806081 - DNA, 25 bp, Mus musculus
tgcagtggcatatgatgaaggctcc

SEQ ID NO: 806082 - DNA, 25 bp, Mus musculus
tgcagtggcgccagtccctggacaa

SEQ ID NO: 806083 - DNA, 25 bp, Mus musculus
tgcagtggcgcctgtccctggacaa

SEQ ID NO: 806084 - DNA, 25 bp, Mus musculus
tgcagtggctcacccagaacctgtg

SEQ ID NO: 806085 - DNA, 25 bp, Mus musculus
tgcagtggctcagccagaacctgtg

SEQ ID NO: 806086 - DNA, 25 bp, Mus musculus
tgcagtgggactctatcaaccccaa

SEQ ID NO: 806087 - DNA, 25 bp, Mus musculus
tgcagtgggactgtatcaaccccaa

SEQ ID NO: 806088 - DNA, 25 bp, Mus musculus
tgcagtgggcttcccagttgcctgt

SEQ ID NO: 806089 - DNA, 25 bp, Mus musculus
tgcagtgggcttgccagttgcctgt

SEQ ID NO: 806090 - DNA, 25 bp, Mus musculus
tgcagtgggtagcaggctgtcctcc

SEQ ID NO: 806091 - DNA, 25 bp, Mus musculus
tgcagtgggtaggaggctgtcctcc

SEQ ID NO: 806092 - DNA, 25 bp, Mus musculus
tgcagtggttcgcagcaacagttcg

SEQ ID NO: 806093 - DNA, 25 bp, Mus musculus
tgcagtggttcggagcaacagttcg

SEQ ID NO: 806094 - DNA, 25 bp, Mus musculus
tgcagtgtaccaacagcggaaccga

SEQ ID NO: 806095 - DNA, 25 bp, Mus musculus
tgcagtgtaccatcagcggaaccga

SEQ ID NO: 806096 - DNA, 25 bp, Mus musculus
tgcagtgtcagaaccgcgggatccc

SEQ ID NO: 806097 - DNA, 25 bp, Mus musculus
tgcagtgtcagatccgcgggatccc

SEQ ID NO: 806098 - DNA, 25 bp, Mus musculus
tgcagtgtcagcctatcttccaggt

SEQ ID NO: 806099 - DNA, 25 bp, Mus musculus
tgcagtgtcagcgtatcttccaggt

SEQ ID NO: 806100 - DNA, 25 bp, Mus musculus
tgcagtgtcccacgcgcgcgagtct

SEQ ID NO: 806101 - DNA, 25 bp, Mus musculus
tgcagtgtcccaggcgcgcgagtct

SEQ ID NO: 806102 - DNA, 25 bp, Mus musculus
tgcagtgtgacgactcagtggaaga

SEQ ID NO: 806103 - DNA, 25 bp, Mus musculus
tgcagtgtgacgtctcagtggaaga

SEQ ID NO: 806104 - DNA, 25 bp, Mus musculus
tgcagtgtgcggctaagcataagac

SEQ ID NO: 806105 - DNA, 25 bp, Mus musculus
tgcagtgtgcgggtaagcataagac

SEQ ID NO: 806106 - DNA, 25 bp, Mus musculus
tgcagtgttcagacttctccaggaa

SEQ ID NO: 806107 - DNA, 25 bp, Mus musculus
tgcagtgttcagtcttctccaggaa

SEQ ID NO: 806108 - DNA, 25 bp, Mus musculus
tgcagtgttcccattactcaattct

SEQ ID NO: 806109 - DNA, 25 bp, Mus musculus
tgcagtgttccctttactcaattct

SEQ ID NO: 806110 - DNA, 25 bp, Mus musculus
tgcagttaccagaaaagaggcgaat

SEQ ID NO: 806111 - DNA, 25 bp, Mus musculus
tgcagttaccagtaaagaggcgaat

SEQ ID NO: 806112 - DNA, 25 bp, Mus musculus
tgcagttactgaagtccccagtggc

SEQ ID NO: 806113 - DNA, 25 bp, Mus musculus
tgcagttactgatgtccccagtggc

SEQ ID NO: 806114 - DNA, 25 bp, Mus musculus
tgcagttatctgaccagaaaccaga

SEQ ID NO: 806115 - DNA, 25 bp, Mus musculus
tgcagttatctgtccagaaaccaga

SEQ ID NO: 806116 - DNA, 25 bp, Mus musculus
tgcagttattcgaccaaagaacact

SEQ ID NO: 806117 - DNA, 25 bp, Mus musculus
tgcagttattcgtccaaagaacact

SEQ ID NO: 806118 - DNA, 25 bp, Mus musculus
tgcagttattgtaatggatcgctcg

SEQ ID NO: 806119 - DNA, 25 bp, Mus musculus
tgcagttattgttatggatcgctcg

SEQ ID NO: 806120 - DNA, 25 bp, Mus musculus
tgcagttcaaagaccatgtgcagga

SEQ ID NO: 806121 - DNA, 25 bp, Mus musculus
tgcagttcaaagtccatgtgcagga

SEQ ID NO: 806122 - DNA, 25 bp, Mus musculus
tgcagttcacccctgctagctggac

SEQ ID NO: 806123 - DNA, 25 bp, Mus musculus
tgcagttcacccgtgctagctggac

SEQ ID NO: 806124 - DNA, 25 bp, Mus musculus
tgcagttcatctagagccatcttag

SEQ ID NO: 806125 - DNA, 25 bp, Mus musculus
tgcagttcatcttgagccatcttag

SEQ ID NO: 806126 - DNA, 25 bp, Mus musculus
tgcagttccagcagactgtcaacgt

SEQ ID NO: 806127 - DNA, 25 bp, Mus musculus
tgcagttccagctgactgtcaacgt

SEQ ID NO: 806128 - DNA, 25 bp, Mus musculus
tgcagttccatcaccaagaatggtg

SEQ ID NO: 806129 - DNA, 25 bp, Mus musculus
tgcagttccatctccaagaatggtg

SEQ ID NO: 806130 - DNA, 25 bp, Mus musculus
tgcagttcgcggagctcttccagcg

SEQ ID NO: 806131 - DNA, 25 bp, Mus musculus
tgcagttcgcggtgctcttccagcg

SEQ ID NO: 806132 - DNA, 25 bp, Mus musculus
tgcagttcgtacacaccatcacgca

SEQ ID NO: 806133 - DNA, 25 bp, Mus musculus
tgcagttcgtactcaccatcacgca

SEQ ID NO: 806134 - DNA, 25 bp, Mus musculus
tgcagttctcagcaaggatccggaa

SEQ ID NO: 806135 - DNA, 25 bp, Mus musculus
tgcagttctcagcattttgacaatt

SEQ ID NO: 806136 - DNA, 25 bp, Mus musculus
tgcagttctcaggaaggatccggaa

SEQ ID NO: 806137 - DNA, 25 bp, Mus musculus
tgcagttctcaggattttgacaatt

SEQ ID NO: 806138 - DNA, 25 bp, Mus musculus
tgcagttctcgccacaaggaaacct

SEQ ID NO: 806139 - DNA, 25 bp, Mus musculus
tgcagttctcgcgacaaggaaacct

SEQ ID NO: 806140 - DNA, 25 bp, Mus musculus
tgcagttctgccaccggtaaaggga

SEQ ID NO: 806141 - DNA, 25 bp, Mus musculus
tgcagttctgcctccggtaaaggga

SEQ ID NO: 806142 - DNA, 25 bp, Mus musculus
tgcagttctgtcagagcctcagagt

SEQ ID NO: 806143 - DNA, 25 bp, Mus musculus
tgcagttctgtctgagcctcagagt

SEQ ID NO: 806144 - DNA, 25 bp, Mus musculus
tgcagttgaacaaggagcatattga

SEQ ID NO: 806145 - DNA, 25 bp, Mus musculus
tgcagttgaacatggagcatattga

SEQ ID NO: 806146 - DNA, 25 bp, Mus musculus
tgcagttgaattctttaagaaggca

SEQ ID NO: 806147 - DNA, 25 bp, Mus musculus
tgcagttgaattgtttaagaaggca

SEQ ID NO: 806148 - DNA, 25 bp, Mus musculus
tgcagttgacagaagggtcacgtcc

SEQ ID NO: 806149 - DNA, 25 bp, Mus musculus
tgcagttgacagtagggtcacgtcc

SEQ ID NO: 806150 - DNA, 25 bp, Mus musculus
tgcagttgatcaagagactgggaaa

SEQ ID NO: 806151 - DNA, 25 bp, Mus musculus
tgcagttgatcatgagactgggaaa

SEQ ID NO: 806152 - DNA, 25 bp, Mus musculus
tgcagttgcccactggattaacggg

SEQ ID NO: 806153 - DNA, 25 bp, Mus musculus
tgcagttgcccagtggattaacggg

SEQ ID NO: 806154 - DNA, 25 bp, Mus musculus
tgcagttgcgccatctgtcaggagc

SEQ ID NO: 806155 - DNA, 25 bp, Mus musculus
tgcagttgcgccttctgtcaggagc

SEQ ID NO: 806156 - DNA, 25 bp, Mus musculus
tgcagttgctgtcatttgggcttac

SEQ ID NO: 806157 - DNA, 25 bp, Mus musculus
tgcagttgctgtgatttgggcttac

SEQ ID NO: 806158 - DNA, 25 bp, Mus musculus
tgcagttggacccaattctaccttg

SEQ ID NO: 806159 - DNA, 25 bp, Mus musculus
tgcagttggaccgaattctaccttg

SEQ ID NO: 806160 - DNA, 25 bp, Mus musculus
tgcagttgggcacatatattttttc

SEQ ID NO: 806161 - DNA, 25 bp, Mus musculus
tgcagttgggcagatatattttttc

SEQ ID NO: 806162 - DNA, 25 bp, Mus musculus
tgcagttgtaggaaactccggtaac

SEQ ID NO: 806163 - DNA, 25 bp, Mus musculus
tgcagttgtaggtaactccggtaac

SEQ ID NO: 806164 - DNA, 25 bp, Mus musculus
tgcagtttcaggctttagaaaatcc

SEQ ID NO: 806165 - DNA, 25 bp, Mus musculus
tgcagtttcagggtttagaaaatcc

SEQ ID NO: 806166 - DNA, 25 bp, Mus musculus
tgcagtttctacacagcaaaggcat

SEQ ID NO: 806167 - DNA, 25 bp, Mus musculus
tgcagtttctactcagcaaaggcat

SEQ ID NO: 806168 - DNA, 25 bp, Mus musculus
tgcagtttctgcagggcctaagcct

SEQ ID NO: 806169 - DNA, 25 bp, Mus musculus
tgcagtttctgctgggcctaagcct

SEQ ID NO: 806170 - DNA, 25 bp, Mus musculus
tgcagtttgcagattccaagggcga

SEQ ID NO: 806171 - DNA, 25 bp, Mus musculus
tgcagtttgcagtttccaagggcga

SEQ ID NO: 806172 - DNA, 25 bp, Mus musculus
tgcagtttgctgctactcagcatgc

SEQ ID NO: 806173 - DNA, 25 bp, Mus musculus
tgcagtttgctggtactcagcatgc

SEQ ID NO: 806174 - DNA, 25 bp, Mus musculus
tgcagttttagcactaagaggctct

SEQ ID NO: 806175 - DNA, 25 bp, Mus musculus
tgcagttttagctctaagaggctct

SEQ ID NO: 806176 - DNA, 25 bp, Mus musculus
tgcataaaatttcgacaagatctct

SEQ ID NO: 806177 - DNA, 25 bp, Mus musculus
tgcataaaatttggacaagatctct

SEQ ID NO: 806178 - DNA, 25 bp, Mus musculus
tgcataaagcaacgcagtcagtaac

SEQ ID NO: 806179 - DNA, 25 bp, Mus musculus
tgcataaagcaaggcagtcagtaac

SEQ ID NO: 806180 - DNA, 25 bp, Mus musculus
tgcataaattccataccattcccag

SEQ ID NO: 806181 - DNA, 25 bp, Mus musculus
tgcataaattccttaccattcccag

SEQ ID NO: 806182 - DNA, 25 bp, Mus musculus
tgcataacattaagtacagcctgac

SEQ ID NO: 806183 - DNA, 25 bp, Mus musculus
tgcataacattatgtacagcctgac

SEQ ID NO: 806184 - DNA, 25 bp, Mus musculus
tgcataaccaaaacatcaagagcct

SEQ ID NO: 806185 - DNA, 25 bp, Mus musculus
tgcataaccaaatcatcaagagcct

SEQ ID NO: 806186 - DNA, 25 bp, Mus musculus
tgcataacggagaccaagcgtcctc

SEQ ID NO: 806187 - DNA, 25 bp, Mus musculus
tgcataacggagtccaagcgtcctc

SEQ ID NO: 806188 - DNA, 25 bp, Mus musculus
tgcataactccaccatcagcaagat

SEQ ID NO: 806189 - DNA, 25 bp, Mus musculus
tgcataactccagcatcagcaagat

SEQ ID NO: 806190 - DNA, 25 bp, Mus musculus
tgcataactctcacctgctgaatcg

SEQ ID NO: 806191 - DNA, 25 bp, Mus musculus
tgcataactctctcctgctgaatcg

SEQ ID NO: 806192 - DNA, 25 bp, Mus musculus
tgcatacattccctgggaaaaggca

SEQ ID NO: 806193 - DNA, 25 bp, Mus musculus
tgcatacattccgtgggaaaaggca

SEQ ID NO: 806194 - DNA, 25 bp, Mus musculus
tgcataccaggccagaataaactcc

SEQ ID NO: 806195 - DNA, 25 bp, Mus musculus
tgcataccaggcgagaataaactcc

SEQ ID NO: 806196 - DNA, 25 bp, Mus musculus
tgcataccatccacacaagtcactg

SEQ ID NO: 806197 - DNA, 25 bp, Mus musculus
tgcataccatcctcacaagtcactg

SEQ ID NO: 806198 - DNA, 25 bp, Mus musculus
tgcatactgtcacgcaaggatggca

SEQ ID NO: 806199 - DNA, 25 bp, Mus musculus
tgcatactgtcaggcaaggatggca

SEQ ID NO: 806200 - DNA, 25 bp, Mus musculus
tgcatactgttaccactagttaaga

SEQ ID NO: 806201 - DNA, 25 bp, Mus musculus
tgcatactgttagcactagttaaga

SEQ ID NO: 806202 - DNA, 25 bp, Mus musculus
tgcatacttcatcataacccggcag

SEQ ID NO: 806203 - DNA, 25 bp, Mus musculus
tgcatacttcatgataacccggcag

SEQ ID NO: 806204 - DNA, 25 bp, Mus musculus
tgcatagaaatcaggtcagtacccg

SEQ ID NO: 806205 - DNA, 25 bp, Mus musculus
tgcatagaaatctggtcagtacccg

SEQ ID NO: 806206 - DNA, 25 bp, Mus musculus
tgcatagagttaaaatgatcatggc

SEQ ID NO: 806207 - DNA, 25 bp, Mus musculus
tgcatagagttataatgatcatggc

SEQ ID NO: 806208 - DNA, 25 bp, Mus musculus
tgcataggacagactttcgccatga

SEQ ID NO: 806209 - DNA, 25 bp, Mus musculus
tgcataggacagtctttcgccatga

SEQ ID NO: 806210 - DNA, 25 bp, Mus musculus
tgcatagggctacgtagatacctca

SEQ ID NO: 806211 - DNA, 25 bp, Mus musculus
tgcatagggctaggtagatacctca

SEQ ID NO: 806212 - DNA, 25 bp, Mus musculus
tgcatatacaatctgaacagatcac

SEQ ID NO: 806213 - DNA, 25 bp, Mus musculus
tgcatatacaatgtgaacagatcac

SEQ ID NO: 806214 - DNA, 25 bp, Mus musculus
tgcatatcatgcagcagcatccagc

SEQ ID NO: 806215 - DNA, 25 bp, Mus musculus
tgcatatcatgctgcagcatccagc

SEQ ID NO: 806216 - DNA, 25 bp, Mus musculus
tgcatatccccacggctgagctgag

SEQ ID NO: 806217 - DNA, 25 bp, Mus musculus
tgcatatccccagggctgagctgag

SEQ ID NO: 806218 - DNA, 25 bp, Mus musculus
tgcatatccgggaattccaccgcgt

SEQ ID NO: 806219 - DNA, 25 bp, Mus musculus
tgcatatccgggtattccaccgcgt

SEQ ID NO: 806220 - DNA, 25 bp, Mus musculus
tgcatatctcacacaacactacgtt

SEQ ID NO: 806221 - DNA, 25 bp, Mus musculus
tgcatatctcactcaacactacgtt

SEQ ID NO: 806222 - DNA, 25 bp, Mus musculus
tgcatatcttaacgaatggttgtgg

SEQ ID NO: 806223 - DNA, 25 bp, Mus musculus
tgcatatcttaaggaatggttgtgg

SEQ ID NO: 806224 - DNA, 25 bp, Mus musculus
tgcatatcttgcataaagggcacaa

SEQ ID NO: 806225 - DNA, 25 bp, Mus musculus
tgcatatcttgcttaaagggcacaa

SEQ ID NO: 806226 - DNA, 25 bp, Mus musculus
tgcatatgtgtgcaagacaaccgca

SEQ ID NO: 806227 - DNA, 25 bp, Mus musculus
tgcatatgtgtggaagacaaccgca

SEQ ID NO: 806228 - DNA, 25 bp, Mus musculus
tgcatattcctgatcttccacagga

SEQ ID NO: 806229 - DNA, 25 bp, Mus musculus
tgcatattcctgttcttccacagga

SEQ ID NO: 806230 - DNA, 25 bp, Mus musculus
tgcatcaagaatcacgcaactgccc

SEQ ID NO: 806231 - DNA, 25 bp, Mus musculus
tgcatcaagaatgacgcaactgccc

SEQ ID NO: 806232 - DNA, 25 bp, Mus musculus
tgcatcaagcgacggtcacagtcca

SEQ ID NO: 806233 - DNA, 25 bp, Mus musculus
tgcatcaagcgagggtcacagtcca

SEQ ID NO: 806234 - DNA, 25 bp, Mus musculus
tgcatcaagttcagctcttccttgg

SEQ ID NO: 806235 - DNA, 25 bp, Mus musculus
tgcatcaagttctgctcttccttgg

SEQ ID NO: 806236 - DNA, 25 bp, Mus musculus
tgcatcacccgcagacgacaatcaa

SEQ ID NO: 806237 - DNA, 25 bp, Mus musculus
tgcatcacccgctgacgacaatcaa

SEQ ID NO: 806238 - DNA, 25 bp, Mus musculus
tgcatcacgtgacccagaatattac

SEQ ID NO: 806239 - DNA, 25 bp, Mus musculus
tgcatcacgtgagccagaatattac

SEQ ID NO: 806240 - DNA, 25 bp, Mus musculus
tgcatcagacatacctagaggagct

SEQ ID NO: 806241 - DNA, 25 bp, Mus musculus
tgcatcagacattcctagaggagct

SEQ ID NO: 806242 - DNA, 25 bp, Mus musculus
tgcatcagcctcagacttcagctat

SEQ ID NO: 806243 - DNA, 25 bp, Mus musculus
tgcatcagcctcaggcacatttcct

SEQ ID NO: 806244 - DNA, 25 bp, Mus musculus
tgcatcagcctctgacttcagctat

SEQ ID NO: 806245 - DNA, 25 bp, Mus musculus
tgcatcagcctctggcacatttcct

SEQ ID NO: 806246 - DNA, 25 bp, Mus musculus
tgcatcagctggctaccgactctac

SEQ ID NO: 806247 - DNA, 25 bp, Mus musculus
tgcatcagctgggtaccgactctac

SEQ ID NO: 806248 - DNA, 25 bp, Mus musculus
tgcatcagtagcaccgagcagtgag

SEQ ID NO: 806249 - DNA, 25 bp, Mus musculus
tgcatcagtagctccgagcagtgag

SEQ ID NO: 806250 - DNA, 25 bp, Mus musculus
tgcatcagtcagcaatgaataaagc

SEQ ID NO: 806251 - DNA, 25 bp, Mus musculus
tgcatcagtcaggaatgaataaagc

SEQ ID NO: 806252 - DNA, 25 bp, Mus musculus
tgcatcatcagcagatggcggatcc

SEQ ID NO: 806253 - DNA, 25 bp, Mus musculus
tgcatcatcagctgatggcggatcc

SEQ ID NO: 806254 - DNA, 25 bp, Mus musculus
tgcatcatcgtgaaccagaggccag

SEQ ID NO: 806255 - DNA, 25 bp, Mus musculus
tgcatcatcgtgtaccagaggccag

SEQ ID NO: 806256 - DNA, 25 bp, Mus musculus
tgcatcatgaaactcagagatttac

SEQ ID NO: 806257 - DNA, 25 bp, Mus musculus
tgcatcatgaaagtcagagatttac

SEQ ID NO: 806258 - DNA, 25 bp, Mus musculus
tgcatcatgcctcatattgataatg

SEQ ID NO: 806259 - DNA, 25 bp, Mus musculus
tgcatcatgcctgatattgataatg

SEQ ID NO: 806260 - DNA, 25 bp, Mus musculus
tgcatcatgctcacagtggtctgta

SEQ ID NO: 806261 - DNA, 25 bp, Mus musculus
tgcatcatgctctcagtggtctgta

SEQ ID NO: 806262 - DNA, 25 bp, Mus musculus
tgcatcatggcgcagatgattactg

SEQ ID NO: 806263 - DNA, 25 bp, Mus musculus
tgcatcatggcggagatgattactg

SEQ ID NO: 806264 - DNA, 25 bp, Mus musculus
tgcatcattggacccctcttatgtc

SEQ ID NO: 806265 - DNA, 25 bp, Mus musculus
tgcatcattggagccctcttatgtc

SEQ ID NO: 806266 - DNA, 25 bp, Mus musculus
tgcatcattttcagtgcggccctca

SEQ ID NO: 806267 - DNA, 25 bp, Mus musculus
tgcatcattttctgtgcggccctca

SEQ ID NO: 806268 - DNA, 25 bp, Mus musculus
tgcatccaaacaagacggacccctg

SEQ ID NO: 806269 - DNA, 25 bp, Mus musculus
tgcatccaaacatgacggacccctg

SEQ ID NO: 806270 - DNA, 25 bp, Mus musculus
tgcatccaacaaagacttggcgagt

SEQ ID NO: 806271 - DNA, 25 bp, Mus musculus
tgcatccaacaatgacttggcgagt

SEQ ID NO: 806272 - DNA, 25 bp, Mus musculus
tgcatccaatctacgggccgaaaac

SEQ ID NO: 806273 - DNA, 25 bp, Mus musculus
tgcatccaatcttcgggccgaaaac

SEQ ID NO: 806274 - DNA, 25 bp, Mus musculus
tgcatccaggtcagcaaacacatgg

SEQ ID NO: 806275 - DNA, 25 bp, Mus musculus
tgcatccaggtctgcaaacacatgg

SEQ ID NO: 806276 - DNA, 25 bp, Mus musculus
tgcatcccagcaactcagacagggc

SEQ ID NO: 806277 - DNA, 25 bp, Mus musculus
tgcatcccagcatctcagacagggc

SEQ ID NO: 806278 - DNA, 25 bp, Mus musculus
tgcatcccagtcactgctggtaaac

SEQ ID NO: 806279 - DNA, 25 bp, Mus musculus
tgcatcccagtctctgctggtaaac

SEQ ID NO: 806280 - DNA, 25 bp, Mus musculus
tgcatccccaaaagctttggctaca

SEQ ID NO: 806281 - DNA, 25 bp, Mus musculus
tgcatccccaaatgctttggctaca

SEQ ID NO: 806282 - DNA, 25 bp, Mus musculus
tgcatcccgttacaagaagtttgat

SEQ ID NO: 806283 - DNA, 25 bp, Mus musculus
tgcatcccgttagaagaagtttgat

SEQ ID NO: 806284 - DNA, 25 bp, Mus musculus
tgcatccgccggctcggatgatcag

SEQ ID NO: 806285 - DNA, 25 bp, Mus musculus
tgcatccgccgggtcggatgatcag

SEQ ID NO: 806286 - DNA, 25 bp, Mus musculus
tgcatccggcagaagggtggctact

SEQ ID NO: 806287 - DNA, 25 bp, Mus musculus
tgcatccggcagtagggtggctact

SEQ ID NO: 806288 - DNA, 25 bp, Mus musculus
tgcatcctaacgatgctttgcatcc

SEQ ID NO: 806289 - DNA, 25 bp, Mus musculus
tgcatcctaacgttgctttgcatcc

SEQ ID NO: 806290 - DNA, 25 bp, Mus musculus
tgcatcctaagtagccaataaaaag

SEQ ID NO: 806291 - DNA, 25 bp, Mus musculus
tgcatcctaagttgccaataaaaag

SEQ ID NO: 806292 - DNA, 25 bp, Mus musculus
tgcatcctacctcagtccacagagg

SEQ ID NO: 806293 - DNA, 25 bp, Mus musculus
tgcatcctacctgagtccacagagg

SEQ ID NO: 806294 - DNA, 25 bp, Mus musculus
tgcatcctatgaacgtccggcttgg

SEQ ID NO: 806295 - DNA, 25 bp, Mus musculus
tgcatcctatgatcgtccggcttgg

SEQ ID NO: 806296 - DNA, 25 bp, Mus musculus
tgcatcctcccactggtcagaggag

SEQ ID NO: 806297 - DNA, 25 bp, Mus musculus
tgcatcctcccagtggtcagaggag

SEQ ID NO: 806298 - DNA, 25 bp, Mus musculus
tgcatcctgagacgcaccgaatcta

SEQ ID NO: 806299 - DNA, 25 bp, Mus musculus
tgcatcctgagaggcaccgaatcta

SEQ ID NO: 806300 - DNA, 25 bp, Mus musculus
tgcatcctgatcacagatgggaaat

SEQ ID NO: 806301 - DNA, 25 bp, Mus musculus
tgcatcctgatctcagatgggaaat

SEQ ID NO: 806302 - DNA, 25 bp, Mus musculus
tgcatcctggaacggtgacagcgtt

SEQ ID NO: 806303 - DNA, 25 bp, Mus musculus
tgcatcctggaagggtgacagcgtt

SEQ ID NO: 806304 - DNA, 25 bp, Mus musculus
tgcatcctgtgtccctgctgcagca

SEQ ID NO: 806305 - DNA, 25 bp, Mus musculus
tgcatcctgtgtgcctgctgcagca

SEQ ID NO: 806306 - DNA, 25 bp, Mus musculus
tgcatccttccaaccttagtaactc

SEQ ID NO: 806307 - DNA, 25 bp, Mus musculus
tgcatccttccatccttagtaactc

SEQ ID NO: 806308 - DNA, 25 bp, Mus musculus
tgcatcgaaaggcaacctccgggaa

SEQ ID NO: 806309 - DNA, 25 bp, Mus musculus
tgcatcgaaagggaacctccgggaa

SEQ ID NO: 806310 - DNA, 25 bp, Mus musculus
tgcatcgaccgtctgggctccttct

SEQ ID NO: 806311 - DNA, 25 bp, Mus musculus
tgcatcgaccgtgtgggctccttct

SEQ ID NO: 806312 - DNA, 25 bp, Mus musculus
tgcatcgagggcattgcagagccag

SEQ ID NO: 806313 - DNA, 25 bp, Mus musculus
tgcatcgagggctttgcagagccag

SEQ ID NO: 806314 - DNA, 25 bp, Mus musculus
tgcatcgattctcgcctctgggtcc

SEQ ID NO: 806315 - DNA, 25 bp, Mus musculus
tgcatcgattctggcctctgggtcc

SEQ ID NO: 806316 - DNA, 25 bp, Mus musculus
tgcatcgcccgtattgtctttctct

SEQ ID NO: 806317 - DNA, 25 bp, Mus musculus
tgcatcgcccgttttgtctttctct

SEQ ID NO: 806318 - DNA, 25 bp, Mus musculus
tgcatcgctacgacaacgggaactt

SEQ ID NO: 806319 - DNA, 25 bp, Mus musculus
tgcatcgctacgtcaacgggaactt

SEQ ID NO: 806320 - DNA, 25 bp, Mus musculus
tgcatcgctcgcagtgtgggtctcc

SEQ ID NO: 806321 - DNA, 25 bp, Mus musculus
tgcatcgctcgctgtgtgggtctcc

SEQ ID NO: 806322 - DNA, 25 bp, Mus musculus
tgcatcggaagtcggtattgacagc

SEQ ID NO: 806323 - DNA, 25 bp, Mus musculus
tgcatcggaagtgggtattgacagc

SEQ ID NO: 806324 - DNA, 25 bp, Mus musculus
tgcatcgggaggactatgctttgct

SEQ ID NO: 806325 - DNA, 25 bp, Mus musculus
tgcatcgggaggtctatgctttgct

SEQ ID NO: 806326 - DNA, 25 bp, Mus musculus
tgcatcgtgcagacctacttgcagt

SEQ ID NO: 806327 - DNA, 25 bp, Mus musculus
tgcatcgtgcagtcctacttgcagt

SEQ ID NO: 806328 - DNA, 25 bp, Mus musculus
tgcatcgtgtgtccagatgctgact

SEQ ID NO: 806329 - DNA, 25 bp, Mus musculus
tgcatcgtgtgtgcagatgctgact

SEQ ID NO: 806330 - DNA, 25 bp, Mus musculus
tgcatcgttcgcctctatgacaact

SEQ ID NO: 806331 - DNA, 25 bp, Mus musculus
tgcatcgttcgcgtctatgacaact

SEQ ID NO: 806332 - DNA, 25 bp, Mus musculus
tgcatctacctcatcagctgcttca

SEQ ID NO: 806333 - DNA, 25 bp, Mus musculus
tgcatctacctcttcagctgcttca

SEQ ID NO: 806334 - DNA, 25 bp, Mus musculus
tgcatctcaactcgtgacaaaatag

SEQ ID NO: 806335 - DNA, 25 bp, Mus musculus
tgcatctcaactggtgacaaaatag

SEQ ID NO: 806336 - DNA, 25 bp, Mus musculus
tgcatctcagcaaggacggtcctag

SEQ ID NO: 806337 - DNA, 25 bp, Mus musculus
tgcatctcagcatggacggtcctag

SEQ ID NO: 806338 - DNA, 25 bp, Mus musculus
tgcatctccacacgtgctctggcaa

SEQ ID NO: 806339 - DNA, 25 bp, Mus musculus
tgcatctccacaggtgctctggcaa

SEQ ID NO: 806340 - DNA, 25 bp, Mus musculus
tgcatctctctgcagattccctact

SEQ ID NO: 806341 - DNA, 25 bp, Mus musculus
tgcatctctctggagattccctact

SEQ ID NO: 806342 - DNA, 25 bp, Mus musculus
tgcatctctgggaccacgagatgaa

SEQ ID NO: 806343 - DNA, 25 bp, Mus musculus
tgcatctctgggtccacgagatgaa

SEQ ID NO: 806344 - DNA, 25 bp, Mus musculus
tgcatctcttgtattgaagccatga

SEQ ID NO: 806345 - DNA, 25 bp, Mus musculus
tgcatctcttgttttgaagccatga

SEQ ID NO: 806346 - DNA, 25 bp, Mus musculus
tgcatctgaaaaccatcacacatga

SEQ ID NO: 806347 - DNA, 25 bp, Mus musculus
tgcatctgaaaagcatcacacatga

SEQ ID NO: 806348 - DNA, 25 bp, Mus musculus
tgcatctgagccagtgataccctcc

SEQ ID NO: 806349 - DNA, 25 bp, Mus musculus
tgcatctgagcctgtgataccctcc

SEQ ID NO: 806350 - DNA, 25 bp, Mus musculus
tgcatctggaaaagactggacacag

SEQ ID NO: 806351 - DNA, 25 bp, Mus musculus
tgcatctggaaatgactggacacag

SEQ ID NO: 806352 - DNA, 25 bp, Mus musculus
tgcatctggagtccactaataccgc

SEQ ID NO: 806353 - DNA, 25 bp, Mus musculus
tgcatctggagtgcactaataccgc

SEQ ID NO: 806354 - DNA, 25 bp, Mus musculus
tgcatctggccgatcacctggatca

SEQ ID NO: 806355 - DNA, 25 bp, Mus musculus
tgcatctggccgttcacctggatca

SEQ ID NO: 806356 - DNA, 25 bp, Mus musculus
tgcatctggctcagaaccctctgaa

SEQ ID NO: 806357 - DNA, 25 bp, Mus musculus
tgcatctggctctgaaccctctgaa

SEQ ID NO: 806358 - DNA, 25 bp, Mus musculus
tgcatctggcttaccactggctagc

SEQ ID NO: 806359 - DNA, 25 bp, Mus musculus
tgcatctggctttccactggctagc

SEQ ID NO: 806360 - DNA, 25 bp, Mus musculus
tgcatctggtcaccaaacatgactc

SEQ ID NO: 806361 - DNA, 25 bp, Mus musculus
tgcatctggtcagcaaacatgactc

SEQ ID NO: 806362 - DNA, 25 bp, Mus musculus
tgcatctgtcggcttcccagtgggc

SEQ ID NO: 806363 - DNA, 25 bp, Mus musculus
tgcatctgtcgggttcccagtgggc

SEQ ID NO: 806364 - DNA, 25 bp, Mus musculus
tgcatctgtcgtcaaggctggaaac

SEQ ID NO: 806365 - DNA, 25 bp, Mus musculus
tgcatctgtcgtgaaggctggaaac

SEQ ID NO: 806366 - DNA, 25 bp, Mus musculus
tgcatctgtctaagtggaaacgaac

SEQ ID NO: 806367 - DNA, 25 bp, Mus musculus
tgcatctgtctatgtggaaacgaac

SEQ ID NO: 806368 - DNA, 25 bp, Mus musculus
tgcatctgtctcattcagtgtaccg

SEQ ID NO: 806369 - DNA, 25 bp, Mus musculus
tgcatctgtctctttcagtgtaccg

SEQ ID NO: 806370 - DNA, 25 bp, Mus musculus
tgcatcttaacacaaatacagagga

SEQ ID NO: 806371 - DNA, 25 bp, Mus musculus
tgcatcttaacagaaatacagagga

SEQ ID NO: 806372 - DNA, 25 bp, Mus musculus
tgcatcttatcacccggaacctgca

SEQ ID NO: 806373 - DNA, 25 bp, Mus musculus
tgcatcttatcagccggaacctgca

SEQ ID NO: 806374 - DNA, 25 bp, Mus musculus
tgcatcttcatacgcctgggagagc

SEQ ID NO: 806375 - DNA, 25 bp, Mus musculus
tgcatcttcataggcctgggagagc

SEQ ID NO: 806376 - DNA, 25 bp, Mus musculus
tgcatcttcatgaatagccttcggg

SEQ ID NO: 806377 - DNA, 25 bp, Mus musculus
tgcatcttcatgtatagccttcggg

SEQ ID NO: 806378 - DNA, 25 bp, Mus musculus
tgcatcttgacaatctctgctgtct

SEQ ID NO: 806379 - DNA, 25 bp, Mus musculus
tgcatcttgacattctctgctgtct

SEQ ID NO: 806380 - DNA, 25 bp, Mus musculus
tgcatcttgtttcccgggatacctg

SEQ ID NO: 806381 - DNA, 25 bp, Mus musculus
tgcatcttgtttgccgggatacctg

SEQ ID NO: 806382 - DNA, 25 bp, Mus musculus
tgcatctttcttcaacccactgggc

SEQ ID NO: 806383 - DNA, 25 bp, Mus musculus
tgcatctttcttgaacccactgggc

SEQ ID NO: 806384 - DNA, 25 bp, Mus musculus
tgcatctttgtaattcccagtacaa

SEQ ID NO: 806385 - DNA, 25 bp, Mus musculus
tgcatctttgtatttcccagtacaa

SEQ ID NO: 806386 - DNA, 25 bp, Mus musculus
tgcatgaaaagaaacctcattgtgt

SEQ ID NO: 806387 - DNA, 25 bp, Mus musculus
tgcatgaaaagatacctcattgtgt

SEQ ID NO: 806388 - DNA, 25 bp, Mus musculus
tgcatgaaactactgcagcacccca

SEQ ID NO: 806389 - DNA, 25 bp, Mus musculus
tgcatgaaactagtgcagcacccca

SEQ ID NO: 806390 - DNA, 25 bp, Mus musculus
tgcatgaaagctcatcaacactgtt

SEQ ID NO: 806391 - DNA, 25 bp, Mus musculus
tgcatgaaagctgatcaacactgtt

SEQ ID NO: 806392 - DNA, 25 bp, Mus musculus
tgcatgaacaaacaccatggctgtg

SEQ ID NO: 806393 - DNA, 25 bp, Mus musculus
tgcatgaacaaagaccatggctgtg

SEQ ID NO: 806394 - DNA, 25 bp, Mus musculus
tgcatgaacgcaagtgtgagcccat

SEQ ID NO: 806395 - DNA, 25 bp, Mus musculus
tgcatgaacgcatgtgtgagcccat

SEQ ID NO: 806396 - DNA, 25 bp, Mus musculus
tgcatgaagcccacagggactttgg

SEQ ID NO: 806397 - DNA, 25 bp, Mus musculus
tgcatgaagccctcagggactttgg

SEQ ID NO: 806398 - DNA, 25 bp, Mus musculus
tgcatgaagttcagcccatctgggt

SEQ ID NO: 806399 - DNA, 25 bp, Mus musculus
tgcatgaagttctgcccatctgggt

SEQ ID NO: 806400 - DNA, 25 bp, Mus musculus
tgcatgacgcgcaggaggacttccc

SEQ ID NO: 806401 - DNA, 25 bp, Mus musculus
tgcatgacgcgctggaggacttccc

SEQ ID NO: 806402 - DNA, 25 bp, Mus musculus
tgcatgacgttgcagggcccaatgt

SEQ ID NO: 806403 - DNA, 25 bp, Mus musculus
tgcatgacgttggagggcccaatgt

SEQ ID NO: 806404 - DNA, 25 bp, Mus musculus
tgcatgactaagagaagaaaccact

SEQ ID NO: 806405 - DNA, 25 bp, Mus musculus
tgcatgactaagtgaagaaaccact

SEQ ID NO: 806406 - DNA, 25 bp, Mus musculus
tgcatgactgcaaatcaaattgtcc

SEQ ID NO: 806407 - DNA, 25 bp, Mus musculus
tgcatgactgcatatcaaattgtcc

SEQ ID NO: 806408 - DNA, 25 bp, Mus musculus
tgcatgagaaaacatcgcaactcag

SEQ ID NO: 806409 - DNA, 25 bp, Mus musculus
tgcatgagaaaagatcgcaactcag

SEQ ID NO: 806410 - DNA, 25 bp, Mus musculus
tgcatgagaagacccgtttctatct

SEQ ID NO: 806411 - DNA, 25 bp, Mus musculus
tgcatgagaagagccgtttctatct

SEQ ID NO: 806412 - DNA, 25 bp, Mus musculus
tgcatgagaatacacccttcgtggt

SEQ ID NO: 806413 - DNA, 25 bp, Mus musculus
tgcatgagaatagacccttcgtggt

SEQ ID NO: 806414 - DNA, 25 bp, Mus musculus
tgcatgagcgaacttcctgagatgg

SEQ ID NO: 806415 - DNA, 25 bp, Mus musculus
tgcatgagcgaagttcctgagatgg

SEQ ID NO: 806416 - DNA, 25 bp, Mus musculus
tgcatgagctgcaccgaggcccacg

SEQ ID NO: 806417 - DNA, 25 bp, Mus musculus
tgcatgagctgctccgaggcccacg

SEQ ID NO: 806418 - DNA, 25 bp, Mus musculus
tgcatgagggttatgacagctatta

SEQ ID NO: 806419 - DNA, 25 bp, Mus musculus
tgcatgagggttttgacagctatta

SEQ ID NO: 806420 - DNA, 25 bp, Mus musculus
tgcatgagtacacccgagtgataac

SEQ ID NO: 806421 - DNA, 25 bp, Mus musculus
tgcatgagtacagccgagtgataac

SEQ ID NO: 806422 - DNA, 25 bp, Mus musculus
tgcatgagttctatctgaggaagcc

SEQ ID NO: 806423 - DNA, 25 bp, Mus musculus
tgcatgagttctttctgaggaagcc

SEQ ID NO: 806424 - DNA, 25 bp, Mus musculus
tgcatgatagaaagtgtcggctcac

SEQ ID NO: 806425 - DNA, 25 bp, Mus musculus
tgcatgatagaatgtgtcggctcac

SEQ ID NO: 806426 - DNA, 25 bp, Mus musculus
tgcatgatggtcaccgccgctactt

SEQ ID NO: 806427 - DNA, 25 bp, Mus musculus
tgcatgatggtctccgccgctactt

SEQ ID NO: 806428 - DNA, 25 bp, Mus musculus
tgcatgattgtgaactttgctccac

SEQ ID NO: 806429 - DNA, 25 bp, Mus musculus
tgcatgattgtgtactttgctccac

SEQ ID NO: 806430 - DNA, 25 bp, Mus musculus
tgcatgcaaggccatcagagctaca

SEQ ID NO: 806431 - DNA, 25 bp, Mus musculus
tgcatgcaaggcgatcagagctaca

SEQ ID NO: 806432 - DNA, 25 bp, Mus musculus
tgcatgcacgctcaaatcctacaag

SEQ ID NO: 806433 - DNA, 25 bp, Mus musculus
tgcatgcacgctgaaatcctacaag

SEQ ID NO: 806434 - DNA, 25 bp, Mus musculus
tgcatgcagagtcaccacatgagca

SEQ ID NO: 806435 - DNA, 25 bp, Mus musculus
tgcatgcagagtgaccacatgagca

SEQ ID NO: 806436 - DNA, 25 bp, Mus musculus
tgcatgcagcgtcccgagacgaccg

SEQ ID NO: 806437 - DNA, 25 bp, Mus musculus
tgcatgcagcgtgccgagacgaccg

SEQ ID NO: 806438 - DNA, 25 bp, Mus musculus
tgcatgcagtacctagacagagcgg

SEQ ID NO: 806439 - DNA, 25 bp, Mus musculus
tgcatgcagtacgtagacagagcgg

SEQ ID NO: 806440 - DNA, 25 bp, Mus musculus
tgcatgcagtggctactcctaggac

SEQ ID NO: 806441 - DNA, 25 bp, Mus musculus
tgcatgcagtgggtactcctaggac

SEQ ID NO: 806442 - DNA, 25 bp, Mus musculus
tgcatgccaatgagccaagtcctgg

SEQ ID NO: 806443 - DNA, 25 bp, Mus musculus
tgcatgccaatgtgccaagtcctgg

SEQ ID NO: 806444 - DNA, 25 bp, Mus musculus
tgcatgccaggtcaggaggcaactt

SEQ ID NO: 806445 - DNA, 25 bp, Mus musculus
tgcatgccaggtgaggaggcaactt

SEQ ID NO: 806446 - DNA, 25 bp, Mus musculus
tgcatgccatgaagatacttccaag

SEQ ID NO: 806447 - DNA, 25 bp, Mus musculus
tgcatgccatgatgatacttccaag

SEQ ID NO: 806448 - DNA, 25 bp, Mus musculus
tgcatgccggcaaattcagcagctg

SEQ ID NO: 806449 - DNA, 25 bp, Mus musculus
tgcatgccggcatattcagcagctg

SEQ ID NO: 806450 - DNA, 25 bp, Mus musculus
tgcatgcctccacatcgaagcgtta

SEQ ID NO: 806451 - DNA, 25 bp, Mus musculus
tgcatgcctccagatcgaagcgtta

SEQ ID NO: 806452 - DNA, 25 bp, Mus musculus
tgcatgccttttcggaagtcacaca

SEQ ID NO: 806453 - DNA, 25 bp, Mus musculus
tgcatgccttttgggaagtcacaca

SEQ ID NO: 806454 - DNA, 25 bp, Mus musculus
tgcatgctaccacagctacaggaga

SEQ ID NO: 806455 - DNA, 25 bp, Mus musculus
tgcatgctaccagagctacaggaga

SEQ ID NO: 806456 - DNA, 25 bp, Mus musculus
tgcatgctaggtcaatgttttgtca

SEQ ID NO: 806457 - DNA, 25 bp, Mus musculus
tgcatgctaggtgaatgttttgtca

SEQ ID NO: 806458 - DNA, 25 bp, Mus musculus
tgcatgctccagctgatgatcccat

SEQ ID NO: 806459 - DNA, 25 bp, Mus musculus
tgcatgctccaggtgatgatcccat

SEQ ID NO: 806460 - DNA, 25 bp, Mus musculus
tgcatgctccgccatgtgacccagg

SEQ ID NO: 806461 - DNA, 25 bp, Mus musculus
tgcatgctccgcgatgtgacccagg

SEQ ID NO: 806462 - DNA, 25 bp, Mus musculus
tgcatggaaggacgcaagagcatcc

SEQ ID NO: 806463 - DNA, 25 bp, Mus musculus
tgcatggaaggaggcaagagcatcc

SEQ ID NO: 806464 - DNA, 25 bp, Mus musculus
tgcatggaatctcagtctcttcaga

SEQ ID NO: 806465 - DNA, 25 bp, Mus musculus
tgcatggaatctgagtctcttcaga

SEQ ID NO: 806466 - DNA, 25 bp, Mus musculus
tgcatggacaagatcaatgagttcc

SEQ ID NO: 806467 - DNA, 25 bp, Mus musculus
tgcatggacaagttcaatgagttcc

SEQ ID NO: 806468 - DNA, 25 bp, Mus musculus
tgcatggatgcacagttgggacaca

SEQ ID NO: 806469 - DNA, 25 bp, Mus musculus
tgcatggatgcagagttgggacaca

SEQ ID NO: 806470 - DNA, 25 bp, Mus musculus
tgcatggcacagactaccctcgtgt

SEQ ID NO: 806471 - DNA, 25 bp, Mus musculus
tgcatggcacagtctaccctcgtgt

SEQ ID NO: 806472 - DNA, 25 bp, Mus musculus
tgcatggccatcattagcagctcct

SEQ ID NO: 806473 - DNA, 25 bp, Mus musculus
tgcatggccatctttagcagctcct

SEQ ID NO: 806474 - DNA, 25 bp, Mus musculus
tgcatggcccgtctgaagacaatcc

SEQ ID NO: 806475 - DNA, 25 bp, Mus musculus
tgcatggcccgtgtgaagacaatcc

SEQ ID NO: 806476 - DNA, 25 bp, Mus musculus
tgcatggcggccagctgcagatctt

SEQ ID NO: 806477 - DNA, 25 bp, Mus musculus
tgcatggcggcctgctgcagatctt

SEQ ID NO: 806478 - DNA, 25 bp, Mus musculus
tgcatggcgtctaatgagcaggaca

SEQ ID NO: 806479 - DNA, 25 bp, Mus musculus
tgcatggcgtcttatgagcaggaca

SEQ ID NO: 806480 - DNA, 25 bp, Mus musculus
tgcatgggcacaacattggcatggg

SEQ ID NO: 806481 - DNA, 25 bp, Mus musculus
tgcatgggcacatcattggcatggg

SEQ ID NO: 806482 - DNA, 25 bp, Mus musculus
tgcatggtaccaaaagccttggatt

SEQ ID NO: 806483 - DNA, 25 bp, Mus musculus
tgcatggtaccataagccttggatt

SEQ ID NO: 806484 - DNA, 25 bp, Mus musculus
tgcatggtggtgctattgttcctca

SEQ ID NO: 806485 - DNA, 25 bp, Mus musculus
tgcatggtggtggtattgttcctca

SEQ ID NO: 806486 - DNA, 25 bp, Mus musculus
tgcatggtggttcatcgctgctgac

SEQ ID NO: 806487 - DNA, 25 bp, Mus musculus
tgcatggtggttgatcgctgctgac

SEQ ID NO: 806488 - DNA, 25 bp, Mus musculus
tgcatggtgtgtatatgagccagcc

SEQ ID NO: 806489 - DNA, 25 bp, Mus musculus
tgcatggtgtgtttatgagccagcc

SEQ ID NO: 806490 - DNA, 25 bp, Mus musculus
tgcatggttttcaactctcgggacg

SEQ ID NO: 806491 - DNA, 25 bp, Mus musculus
tgcatggttttctactctcgggacg

SEQ ID NO: 806492 - DNA, 25 bp, Mus musculus
tgcatgtaagctcgctcgtcgttgg

SEQ ID NO: 806493 - DNA, 25 bp, Mus musculus
tgcatgtaagctggctcgtcgttgg

SEQ ID NO: 806494 - DNA, 25 bp, Mus musculus
tgcatgtaggacaaaggatatactt

SEQ ID NO: 806495 - DNA, 25 bp, Mus musculus
tgcatgtaggactaaggatatactt

SEQ ID NO: 806496 - DNA, 25 bp, Mus musculus
tgcatgtattgaaagccaccagttt

SEQ ID NO: 806497 - DNA, 25 bp, Mus musculus
tgcatgtattgaaggagtcgttctc

SEQ ID NO: 806498 - DNA, 25 bp, Mus musculus
tgcatgtattgatagccaccagttt

SEQ ID NO: 806499 - DNA, 25 bp, Mus musculus
tgcatgtattgatggagtcgttctc

SEQ ID NO: 806500 - DNA, 25 bp, Mus musculus
tgcatgtcctatcagccacagggat

SEQ ID NO: 806501 - DNA, 25 bp, Mus musculus
tgcatgtcctatgagccacagggat

SEQ ID NO: 806502 - DNA, 25 bp, Mus musculus
tgcatgtctataaaattaaccctca

SEQ ID NO: 806503 - DNA, 25 bp, Mus musculus
tgcatgtctatataattaaccctca

SEQ ID NO: 806504 - DNA, 25 bp, Mus musculus
tgcatgtctgcgaccccagccaggg

SEQ ID NO: 806505 - DNA, 25 bp, Mus musculus
tgcatgtctgcgtccccagccaggg

SEQ ID NO: 806506 - DNA, 25 bp, Mus musculus
tgcatgtgccccaagaaccgttaaa

SEQ ID NO: 806507 - DNA, 25 bp, Mus musculus
tgcatgtgcccctagaaccgttaaa

SEQ ID NO: 806508 - DNA, 25 bp, Mus musculus
tgcatgtgcgacctccaacctgaac

SEQ ID NO: 806509 - DNA, 25 bp, Mus musculus
tgcatgtgcgacgtccaacctgaac

SEQ ID NO: 806510 - DNA, 25 bp, Mus musculus
tgcatgtggaagatgtggcttctga

SEQ ID NO: 806511 - DNA, 25 bp, Mus musculus
tgcatgtggaagttgtggcttctga

SEQ ID NO: 806512 - DNA, 25 bp, Mus musculus
tgcatgtggcatcttgctgtggcaa

SEQ ID NO: 806513 - DNA, 25 bp, Mus musculus
tgcatgtggcatgttgctgtggcaa

SEQ ID NO: 806514 - DNA, 25 bp, Mus musculus
tgcatgtggctgaggatgtcatcaa

SEQ ID NO: 806515 - DNA, 25 bp, Mus musculus
tgcatgtggctgtggatgtcatcaa

SEQ ID NO: 806516 - DNA, 25 bp, Mus musculus
tgcatgtgggcgctccgctcactgt

SEQ ID NO: 806517 - DNA, 25 bp, Mus musculus
tgcatgtgggcggtccgctcactgt

SEQ ID NO: 806518 - DNA, 25 bp, Mus musculus
tgcatgtggtgtctccagcctcaat

SEQ ID NO: 806519 - DNA, 25 bp, Mus musculus
tgcatgtggtgtgtccagcctcaat

SEQ ID NO: 806520 - DNA, 25 bp, Mus musculus
tgcatgtgtgctcgcctacgacgaa

SEQ ID NO: 806521 - DNA, 25 bp, Mus musculus
tgcatgtgtgctggcctacgacgaa

SEQ ID NO: 806522 - DNA, 25 bp, Mus musculus
tgcatgttaaaacactcctgaataa

SEQ ID NO: 806523 - DNA, 25 bp, Mus musculus
tgcatgttaaaagactcctgaataa

SEQ ID NO: 806524 - DNA, 25 bp, Mus musculus
tgcatgttcaaccatctggctgtgg

SEQ ID NO: 806525 - DNA, 25 bp, Mus musculus
tgcatgttcaacgatctggctgtgg

SEQ ID NO: 806526 - DNA, 25 bp, Mus musculus
tgcatgttctttcggcactcactgt

SEQ ID NO: 806527 - DNA, 25 bp, Mus musculus
tgcatgttctttgggcactcactgt

SEQ ID NO: 806528 - DNA, 25 bp, Mus musculus
tgcatgttgcgtaccactccgcgtg

SEQ ID NO: 806529 - DNA, 25 bp, Mus musculus
tgcatgttgcgttccactccgcgtg

SEQ ID NO: 806530 - DNA, 25 bp, Mus musculus
tgcatgtttctcaccaggcagacag

SEQ ID NO: 806531 - DNA, 25 bp, Mus musculus
tgcatgtttctctccaggcagacag

SEQ ID NO: 806532 - DNA, 25 bp, Mus musculus
tgcattaaggagagcctacggctgc

SEQ ID NO: 806533 - DNA, 25 bp, Mus musculus
tgcattaaggagtgcctacggctgc

SEQ ID NO: 806534 - DNA, 25 bp, Mus musculus
tgcattaattaacaagctggatata

SEQ ID NO: 806535 - DNA, 25 bp, Mus musculus
tgcattaattaagaagctggatata

SEQ ID NO: 806536 - DNA, 25 bp, Mus musculus
tgcattacaatgagttgggtgcgaa

SEQ ID NO: 806537 - DNA, 25 bp, Mus musculus
tgcattacaatgtgttgggtgcgaa

SEQ ID NO: 806538 - DNA, 25 bp, Mus musculus
tgcattacaggtatggcagatccct

SEQ ID NO: 806539 - DNA, 25 bp, Mus musculus
tgcattacaggtttggcagatccct

SEQ ID NO: 806540 - DNA, 25 bp, Mus musculus
tgcattacttacacatggaagctcc

SEQ ID NO: 806541 - DNA, 25 bp, Mus musculus
tgcattacttactcatggaagctcc

SEQ ID NO: 806542 - DNA, 25 bp, Mus musculus
tgcattagcagcagctcagcagcca

SEQ ID NO: 806543 - DNA, 25 bp, Mus musculus
tgcattagcagctgctcagcagcca

SEQ ID NO: 806544 - DNA, 25 bp, Mus musculus
tgcattagtgcgagagcccttcagc

SEQ ID NO: 806545 - DNA, 25 bp, Mus musculus
tgcattagtgcgtgagcccttcagc

SEQ ID NO: 806546 - DNA, 25 bp, Mus musculus
tgcattatatatcagtttcttccaa

SEQ ID NO: 806547 - DNA, 25 bp, Mus musculus
tgcattatatatgagtttcttccaa

SEQ ID NO: 806548 - DNA, 25 bp, Mus musculus
tgcattatcattcaaacaccccata

SEQ ID NO: 806549 - DNA, 25 bp, Mus musculus
tgcattatcattgaaacaccccata

SEQ ID NO: 806550 - DNA, 25 bp, Mus musculus
tgcattatcgctcggctactgggca

SEQ ID NO: 806551 - DNA, 25 bp, Mus musculus
tgcattatcgctgggctactgggca

SEQ ID NO: 806552 - DNA, 25 bp, Mus musculus
tgcattatcttcagtggccaccggg

SEQ ID NO: 806553 - DNA, 25 bp, Mus musculus
tgcattatcttctgtggccaccggg

SEQ ID NO: 806554 - DNA, 25 bp, Mus musculus
tgcattatggccactccaaccagct

SEQ ID NO: 806555 - DNA, 25 bp, Mus musculus
tgcattatggcctctccaaccagct

SEQ ID NO: 806556 - DNA, 25 bp, Mus musculus
tgcattatgtctcgagcccgcactg

SEQ ID NO: 806557 - DNA, 25 bp, Mus musculus
tgcattatgtctggagcccgcactg

SEQ ID NO: 806558 - DNA, 25 bp, Mus musculus
tgcattattattccaccagtgagct

SEQ ID NO: 806559 - DNA, 25 bp, Mus musculus
tgcattattattgcaccagtgagct

SEQ ID NO: 806560 - DNA, 25 bp, Mus musculus
tgcattcaagccaactactcgctga

SEQ ID NO: 806561 - DNA, 25 bp, Mus musculus
tgcattcaagcctactactcgctga

SEQ ID NO: 806562 - DNA, 25 bp, Mus musculus
tgcattcaccacaggcttaaaagct

SEQ ID NO: 806563 - DNA, 25 bp, Mus musculus
tgcattcaccactggcttaaaagct

SEQ ID NO: 806564 - DNA, 25 bp, Mus musculus
tgcattcacggtagccgccagtgtg

SEQ ID NO: 806565 - DNA, 25 bp, Mus musculus
tgcattcacggttgccgccagtgtg

SEQ ID NO: 806566 - DNA, 25 bp, Mus musculus
tgcattcatatcacaccaggctcat

SEQ ID NO: 806567 - DNA, 25 bp, Mus musculus
tgcattcatatctcaccaggctcat

SEQ ID NO: 806568 - DNA, 25 bp, Mus musculus
tgcattccaagcactggcagaaggc

SEQ ID NO: 806569 - DNA, 25 bp, Mus musculus
tgcattccaagctctggcagaaggc

SEQ ID NO: 806570 - DNA, 25 bp, Mus musculus
tgcattccccagaacacctggatct

SEQ ID NO: 806571 - DNA, 25 bp, Mus musculus
tgcattccccagtacacctggatct

SEQ ID NO: 806572 - DNA, 25 bp, Mus musculus
tgcattccggtgagtcctctcagag

SEQ ID NO: 806573 - DNA, 25 bp, Mus musculus
tgcattccggtgtgtcctctcagag

SEQ ID NO: 806574 - DNA, 25 bp, Mus musculus
tgcattcgacaaagcagctcattat

SEQ ID NO: 806575 - DNA, 25 bp, Mus musculus
tgcattcgacaatgcagctcattat

SEQ ID NO: 806576 - DNA, 25 bp, Mus musculus
tgcattctcctgctgactcagcgga

SEQ ID NO: 806577 - DNA, 25 bp, Mus musculus
tgcattctcctggtgactcagcgga

SEQ ID NO: 806578 - DNA, 25 bp, Mus musculus
tgcattcttctgactccaggccagt

SEQ ID NO: 806579 - DNA, 25 bp, Mus musculus
tgcattcttctgtctccaggccagt

SEQ ID NO: 806580 - DNA, 25 bp, Mus musculus
tgcattgaaggtctagtcctgcgag

SEQ ID NO: 806581 - DNA, 25 bp, Mus musculus
tgcattgaaggtgtagtcctgcgag

SEQ ID NO: 806582 - DNA, 25 bp, Mus musculus
tgcattgactccatgagtgtcaacc

SEQ ID NO: 806583 - DNA, 25 bp, Mus musculus
tgcattgactccttgagtgtcaacc

SEQ ID NO: 806584 - DNA, 25 bp, Mus musculus
tgcattgaggcccatgagaaggaca

SEQ ID NO: 806585 - DNA, 25 bp, Mus musculus
tgcattgaggccgatgagaaggaca

SEQ ID NO: 806586 - DNA, 25 bp, Mus musculus
tgcattgcaaaacaccatgagaagt

SEQ ID NO: 806587 - DNA, 25 bp, Mus musculus
tgcattgcaaaagaccatgagaagt

SEQ ID NO: 806588 - DNA, 25 bp, Mus musculus
tgcattgcagtccttacagaagcaa

SEQ ID NO: 806589 - DNA, 25 bp, Mus musculus
tgcattgcagtcgttacagaagcaa

SEQ ID NO: 806590 - DNA, 25 bp, Mus musculus
tgcattgcatgtctccgccactgct

SEQ ID NO: 806591 - DNA, 25 bp, Mus musculus
tgcattgcatgtgtccgccactgct

SEQ ID NO: 806592 - DNA, 25 bp, Mus musculus
tgcattgccctgaccctatacgagg

SEQ ID NO: 806593 - DNA, 25 bp, Mus musculus
tgcattgccctgtccctatacgagg

SEQ ID NO: 806594 - DNA, 25 bp, Mus musculus
tgcattgctcctaggtccagtttgt

SEQ ID NO: 806595 - DNA, 25 bp, Mus musculus
tgcattgctccttggtccagtttgt

SEQ ID NO: 806596 - DNA, 25 bp, Mus musculus
tgcattggagaacagaagcaaaggt

SEQ ID NO: 806597 - DNA, 25 bp, Mus musculus
tgcattggagaagagaagcaaaggt

SEQ ID NO: 806598 - DNA, 25 bp, Mus musculus
tgcattggccaacaatgtgctccag

SEQ ID NO: 806599 - DNA, 25 bp, Mus musculus
tgcattggccaagaatgtgctccag

SEQ ID NO: 806600 - DNA, 25 bp, Mus musculus
tgcattggcggacagaatttatctg

SEQ ID NO: 806601 - DNA, 25 bp, Mus musculus
tgcattggcggagagaatttatctg

SEQ ID NO: 806602 - DNA, 25 bp, Mus musculus
tgcattggcttgacagaagaatttt

SEQ ID NO: 806603 - DNA, 25 bp, Mus musculus
tgcattggcttgtcagaagaatttt

SEQ ID NO: 806604 - DNA, 25 bp, Mus musculus
tgcattgtcttaacaggcggaccca

SEQ ID NO: 806605 - DNA, 25 bp, Mus musculus
tgcattgtcttatcaggcggaccca

SEQ ID NO: 806606 - DNA, 25 bp, Mus musculus
tgcattgtgggaaactcctgagcac

SEQ ID NO: 806607 - DNA, 25 bp, Mus musculus
tgcattgtgggatactcctgagcac

SEQ ID NO: 806608 - DNA, 25 bp, Mus musculus
tgcattgtggtacaaccatgaacag

SEQ ID NO: 806609 - DNA, 25 bp, Mus musculus
tgcattgtggtagaaccatgaacag

SEQ ID NO: 806610 - DNA, 25 bp, Mus musculus
tgcattgtgttcctggtggtttaca

SEQ ID NO: 806611 - DNA, 25 bp, Mus musculus
tgcattgtgttcgtggtggtttaca

SEQ ID NO: 806612 - DNA, 25 bp, Mus musculus
tgcattgttttacgccgccagtgtc

SEQ ID NO: 806613 - DNA, 25 bp, Mus musculus
tgcattgttttaggccgccagtgtc

SEQ ID NO: 806614 - DNA, 25 bp, Mus musculus
tgcatttaacctctgaactcatagt

SEQ ID NO: 806615 - DNA, 25 bp, Mus musculus
tgcatttaacctgtgaactcatagt

SEQ ID NO: 806616 - DNA, 25 bp, Mus musculus
tgcatttaagacaggtgccgctccg

SEQ ID NO: 806617 - DNA, 25 bp, Mus musculus
tgcatttaagactggtgccgctccg

SEQ ID NO: 806618 - DNA, 25 bp, Mus musculus
tgcatttaccgcacccctgggaaga

SEQ ID NO: 806619 - DNA, 25 bp, Mus musculus
tgcatttaccgctcccctgggaaga

SEQ ID NO: 806620 - DNA, 25 bp, Mus musculus
tgcatttatcccaagccagcccgaa

SEQ ID NO: 806621 - DNA, 25 bp, Mus musculus
tgcatttatccctagccagcccgaa

SEQ ID NO: 806622 - DNA, 25 bp, Mus musculus
tgcatttcatgcacggattctgcag

SEQ ID NO: 806623 - DNA, 25 bp, Mus musculus
tgcatttcatgctcggattctgcag

SEQ ID NO: 806624 - DNA, 25 bp, Mus musculus
tgcatttcgtctcctgaacaagtat

SEQ ID NO: 806625 - DNA, 25 bp, Mus musculus
tgcatttcgtctgctgaacaagtat

SEQ ID NO: 806626 - DNA, 25 bp, Mus musculus
tgcatttgacaaaagcttctgcgag

SEQ ID NO: 806627 - DNA, 25 bp, Mus musculus
tgcatttgacaatagcttctgcgag

SEQ ID NO: 806628 - DNA, 25 bp, Mus musculus
tgcatttgaccaccttatccttaca

SEQ ID NO: 806629 - DNA, 25 bp, Mus musculus
tgcatttgaccagcttatccttaca

SEQ ID NO: 806630 - DNA, 25 bp, Mus musculus
tgcatttgccttctgtggccaaata

SEQ ID NO: 806631 - DNA, 25 bp, Mus musculus
tgcatttgccttgtgtggccaaata

SEQ ID NO: 806632 - DNA, 25 bp, Mus musculus
tgcatttggcacactaaaccagctg

SEQ ID NO: 806633 - DNA, 25 bp, Mus musculus
tgcatttggcactctaaaccagctg

SEQ ID NO: 806634 - DNA, 25 bp, Mus musculus
tgcatttggcttacaccaactctac

SEQ ID NO: 806635 - DNA, 25 bp, Mus musculus
tgcatttggctttcaccaactctac

SEQ ID NO: 806636 - DNA, 25 bp, Mus musculus
tgcatttgtctcagctgctggttga

SEQ ID NO: 806637 - DNA, 25 bp, Mus musculus
tgcatttgtctctgctgctggttga

SEQ ID NO: 806638 - DNA, 25 bp, Mus musculus
tgcatttgtttgaggccaaggccta

SEQ ID NO: 806639 - DNA, 25 bp, Mus musculus
tgcatttgtttgtggccaaggccta

SEQ ID NO: 806640 - DNA, 25 bp, Mus musculus
tgcattttactgagtctctcaggag

SEQ ID NO: 806641 - DNA, 25 bp, Mus musculus
tgcattttactgtgtctctcaggag

SEQ ID NO: 806642 - DNA, 25 bp, Mus musculus
tgcattttatgcacaggctccattt

SEQ ID NO: 806643 - DNA, 25 bp, Mus musculus
tgcattttatgctcaggctccattt

SEQ ID NO: 806644 - DNA, 25 bp, Mus musculus
tgcattttgcacagggatcccactg

SEQ ID NO: 806645 - DNA, 25 bp, Mus musculus
tgcattttgcactgggatcccactg

SEQ ID NO: 806646 - DNA, 25 bp, Mus musculus
tgcattttgtgtccaaacggaacct

SEQ ID NO: 806647 - DNA, 25 bp, Mus musculus
tgcattttgtgtgcaaacggaacct

SEQ ID NO: 806648 - DNA, 25 bp, Mus musculus
tgcatttttggaacaagccgtgtca

SEQ ID NO: 806649 - DNA, 25 bp, Mus musculus
tgcatttttggatcaagccgtgtca

SEQ ID NO: 806650 - DNA, 25 bp, Mus musculus
tgccaaaaagagagagcttatcctg

SEQ ID NO: 806651 - DNA, 25 bp, Mus musculus
tgccaaaaagagtgagcttatcctg

SEQ ID NO: 806652 - DNA, 25 bp, Mus musculus
tgccaaaaccacacagtgtttcact

SEQ ID NO: 806653 - DNA, 25 bp, Mus musculus
tgccaaaaccactcagtgtttcact

SEQ ID NO: 806654 - DNA, 25 bp, Mus musculus
tgccaaaagattcagcagtgtgact

SEQ ID NO: 806655 - DNA, 25 bp, Mus musculus
tgccaaaagattgagcagtgtgact

SEQ ID NO: 806656 - DNA, 25 bp, Mus musculus
tgccaaaagcatatacttgcctgga

SEQ ID NO: 806657 - DNA, 25 bp, Mus musculus
tgccaaaagcatttacttgcctgga

SEQ ID NO: 806658 - DNA, 25 bp, Mus musculus
tgccaaaagctgaaacggcagcctg

SEQ ID NO: 806659 - DNA, 25 bp, Mus musculus
tgccaaaagctgtaacggcagcctg

SEQ ID NO: 806660 - DNA, 25 bp, Mus musculus
tgccaaaagttaagctccagagctg

SEQ ID NO: 806661 - DNA, 25 bp, Mus musculus
tgccaaaagttatgctccagagctg

SEQ ID NO: 806662 - DNA, 25 bp, Mus musculus
tgccaaacaccacaaagaaaaaccg

SEQ ID NO: 806663 - DNA, 25 bp, Mus musculus
tgccaaacaccagaaagaaaaaccg

SEQ ID NO: 806664 - DNA, 25 bp, Mus musculus
tgccaaacaccgattttgttggagg

SEQ ID NO: 806665 - DNA, 25 bp, Mus musculus
tgccaaacaccgtttttgttggagg

SEQ ID NO: 806666 - DNA, 25 bp, Mus musculus
tgccaaaccggccacattgtactag

SEQ ID NO: 806667 - DNA, 25 bp, Mus musculus
tgccaaaccggcgacattgtactag

SEQ ID NO: 806668 - DNA, 25 bp, Mus musculus
tgccaaacggagacccaaggaagca

SEQ ID NO: 806669 - DNA, 25 bp, Mus musculus
tgccaaacggagtcccaaggaagca

SEQ ID NO: 806670 - DNA, 25 bp, Mus musculus
tgccaaactggacaagctagactct

SEQ ID NO: 806671 - DNA, 25 bp, Mus musculus
tgccaaactggagaagctagactct

SEQ ID NO: 806672 - DNA, 25 bp, Mus musculus
tgccaaactgtaagagatcggagct

SEQ ID NO: 806673 - DNA, 25 bp, Mus musculus
tgccaaactgtatgagatcggagct

SEQ ID NO: 806674 - DNA, 25 bp, Mus musculus
tgccaaagaaagagtgctccagttc

SEQ ID NO: 806675 - DNA, 25 bp, Mus musculus
tgccaaagaaagtgtgctccagttc

SEQ ID NO: 806676 - DNA, 25 bp, Mus musculus
tgccaaagagagcaccccaggcttt

SEQ ID NO: 806677 - DNA, 25 bp, Mus musculus
tgccaaagagaggaccccaggcttt

SEQ ID NO: 806678 - DNA, 25 bp, Mus musculus
tgccaaagagggagccaagaaacct

SEQ ID NO: 806679 - DNA, 25 bp, Mus musculus
tgccaaagagggtgccaagaaacct

SEQ ID NO: 806680 - DNA, 25 bp, Mus musculus
tgccaaagatagaatacggatcgcc

SEQ ID NO: 806681 - DNA, 25 bp, Mus musculus
tgccaaagatagtatacggatcgcc

SEQ ID NO: 806682 - DNA, 25 bp, Mus musculus
tgccaaagatgtcaaccccgagaag

SEQ ID NO: 806683 - DNA, 25 bp, Mus musculus
tgccaaagatgtgaaccccgagaag

SEQ ID NO: 806684 - DNA, 25 bp, Mus musculus
tgccaaagccaacaacagtcgcaaa

SEQ ID NO: 806685 - DNA, 25 bp, Mus musculus
tgccaaagccaagaacagtcgcaaa

SEQ ID NO: 806686 - DNA, 25 bp, Mus musculus
tgccaaagccctcaaatatcatatc

SEQ ID NO: 806687 - DNA, 25 bp, Mus musculus
tgccaaagccctgaaatatcatatc

SEQ ID NO: 806688 - DNA, 25 bp, Mus musculus
tgccaaagccgcagtggaagcagat

SEQ ID NO: 806689 - DNA, 25 bp, Mus musculus
tgccaaagccgctgtggaagcagat

SEQ ID NO: 806690 - DNA, 25 bp, Mus musculus
tgccaaagctgaagagaactgtctc

SEQ ID NO: 806691 - DNA, 25 bp, Mus musculus
tgccaaagctgatgagaactgtctc

SEQ ID NO: 806692 - DNA, 25 bp, Mus musculus
tgccaaagctgtcccactgtccagg

SEQ ID NO: 806693 - DNA, 25 bp, Mus musculus
tgccaaagctgtgccactgtccagg

SEQ ID NO: 806694 - DNA, 25 bp, Mus musculus
tgccaaaggcaacatgaacctgctt

SEQ ID NO: 806695 - DNA, 25 bp, Mus musculus
tgccaaaggcaagatgaacctgctt

SEQ ID NO: 806696 - DNA, 25 bp, Mus musculus
tgccaaaggcatcactgaggaacct

SEQ ID NO: 806697 - DNA, 25 bp, Mus musculus
tgccaaaggcatctcctctggaatg

SEQ ID NO: 806698 - DNA, 25 bp, Mus musculus
tgccaaaggcatgactgaggaacct

SEQ ID NO: 806699 - DNA, 25 bp, Mus musculus
tgccaaaggcatgtcctctggaatg

SEQ ID NO: 806700 - DNA, 25 bp, Mus musculus
tgccaaaggccgcaaagataccttc

SEQ ID NO: 806701 - DNA, 25 bp, Mus musculus
tgccaaaggccggaaagataccttc

SEQ ID NO: 806702 - DNA, 25 bp, Mus musculus
tgccaaagggtaagacggccgagct

SEQ ID NO: 806703 - DNA, 25 bp, Mus musculus
tgccaaagggtatgacggccgagct

SEQ ID NO: 806704 - DNA, 25 bp, Mus musculus
tgccaaagtctgagaagaacaccat

SEQ ID NO: 806705 - DNA, 25 bp, Mus musculus
tgccaaagtctgtgaagaacaccat

SEQ ID NO: 806706 - DNA, 25 bp, Mus musculus
tgccaaatccccagcctgaatggtg

SEQ ID NO: 806707 - DNA, 25 bp, Mus musculus
tgccaaatcccctgcctgaatggtg

SEQ ID NO: 806708 - DNA, 25 bp, Mus musculus
tgccaaatccctcacttaccagtag

SEQ ID NO: 806709 - DNA, 25 bp, Mus musculus
tgccaaatccctgacttaccagtag

SEQ ID NO: 806710 - DNA, 25 bp, Mus musculus
tgccaaatccgactgatgtgtgtga

SEQ ID NO: 806711 - DNA, 25 bp, Mus musculus
tgccaaatccgagtgatgtgtgtga

SEQ ID NO: 806712 - DNA, 25 bp, Mus musculus
tgccaaattcaaagcctgccctgtg

SEQ ID NO: 806713 - DNA, 25 bp, Mus musculus
tgccaaattcaatgcctgccctgtg

SEQ ID NO: 806714 - DNA, 25 bp, Mus musculus
tgccaaattgccagggctattagag

SEQ ID NO: 806715 - DNA, 25 bp, Mus musculus
tgccaaattgcctgggctattagag

SEQ ID NO: 806716 - DNA, 25 bp, Mus musculus
tgccaacaaacaagtaagcagcctt

SEQ ID NO: 806717 - DNA, 25 bp, Mus musculus
tgccaacaaacatgtaagcagcctt

SEQ ID NO: 806718 - DNA, 25 bp, Mus musculus
tgccaacagctgagagaagggtgac

SEQ ID NO: 806719 - DNA, 25 bp, Mus musculus
tgccaacagctgtgagaagggtgac

SEQ ID NO: 806720 - DNA, 25 bp, Mus musculus
tgccaacaggagcactgaagcagcc

SEQ ID NO: 806721 - DNA, 25 bp, Mus musculus
tgccaacaggaggactgaagcagcc

SEQ ID NO: 806722 - DNA, 25 bp, Mus musculus
tgccaacagtgcctatctaatgtta

SEQ ID NO: 806723 - DNA, 25 bp, Mus musculus
tgccaacagtgcgtatctaatgtta

SEQ ID NO: 806724 - DNA, 25 bp, Mus musculus
tgccaacatcgactctataaatttg

SEQ ID NO: 806725 - DNA, 25 bp, Mus musculus
tgccaacatcgagtctataaatttg

SEQ ID NO: 806726 - DNA, 25 bp, Mus musculus
tgccaacatctaaggctcctatcag

SEQ ID NO: 806727 - DNA, 25 bp, Mus musculus
tgccaacatctatggctcctatcag

SEQ ID NO: 806728 - DNA, 25 bp, Mus musculus
tgccaacatggtacctctgggtgag

SEQ ID NO: 806729 - DNA, 25 bp, Mus musculus
tgccaacatggttcctctgggtgag

SEQ ID NO: 806730 - DNA, 25 bp, Mus musculus
tgccaaccagtgcatcaagtttaag

SEQ ID NO: 806731 - DNA, 25 bp, Mus musculus
tgccaaccagtggatcaagtttaag

SEQ ID NO: 806732 - DNA, 25 bp, Mus musculus
tgccaaccattgatccaaatacaag

SEQ ID NO: 806733 - DNA, 25 bp, Mus musculus
tgccaaccattgttccaaatacaag

SEQ ID NO: 806734 - DNA, 25 bp, Mus musculus
tgccaaccatttatataggcaagaa

SEQ ID NO: 806735 - DNA, 25 bp, Mus musculus
tgccaaccatttttataggcaagaa

SEQ ID NO: 806736 - DNA, 25 bp, Mus musculus
tgccaacccagtccaggtggaaatg

SEQ ID NO: 806737 - DNA, 25 bp, Mus musculus
tgccaacccagtgcaggtggaaatg

SEQ ID NO: 806738 - DNA, 25 bp, Mus musculus
tgccaaccccgacatggacaacttg

SEQ ID NO: 806739 - DNA, 25 bp, Mus musculus
tgccaaccccgagatggacaacttg

SEQ ID NO: 806740 - DNA, 25 bp, Mus musculus
tgccaaccctaaaatacctgcttac

SEQ ID NO: 806741 - DNA, 25 bp, Mus musculus
tgccaaccctaatatacctgcttac

SEQ ID NO: 806742 - DNA, 25 bp, Mus musculus
tgccaaccggatctgcaaggtgctg

SEQ ID NO: 806743 - DNA, 25 bp, Mus musculus
tgccaaccggatgtgcaaggtgctg

SEQ ID NO: 806744 - DNA, 25 bp, Mus musculus
tgccaaccggtaccttgctatgaag

SEQ ID NO: 806745 - DNA, 25 bp, Mus musculus
tgccaaccggtagcttgctatgaag

SEQ ID NO: 806746 - DNA, 25 bp, Mus musculus
tgccaacctccgagcggatgctgaa

SEQ ID NO: 806747 - DNA, 25 bp, Mus musculus
tgccaacctccgtgcggatgctgaa

SEQ ID NO: 806748 - DNA, 25 bp, Mus musculus
tgccaacctgagactgaaggccaag

SEQ ID NO: 806749 - DNA, 25 bp, Mus musculus
tgccaacctgagtctgaaggccaag

SEQ ID NO: 806750 - DNA, 25 bp, Mus musculus
tgccaacctggacagcaatgccaag

SEQ ID NO: 806751 - DNA, 25 bp, Mus musculus
tgccaacctggagagcaatgccaag

SEQ ID NO: 806752 - DNA, 25 bp, Mus musculus
tgccaaccttaaaaaatgtgcaaga

SEQ ID NO: 806753 - DNA, 25 bp, Mus musculus
tgccaaccttaataaatgtgcaaga

SEQ ID NO: 806754 - DNA, 25 bp, Mus musculus
tgccaacgagaaagctgacagtgcc

SEQ ID NO: 806755 - DNA, 25 bp, Mus musculus
tgccaacgagaatgctgacagtgcc

SEQ ID NO: 806756 - DNA, 25 bp, Mus musculus
tgccaacgcaagctcacagggatga

SEQ ID NO: 806757 - DNA, 25 bp, Mus musculus
tgccaacgcaaggtcacagggatga

SEQ ID NO: 806758 - DNA, 25 bp, Mus musculus
tgccaacgcctacgatgctttcagg

SEQ ID NO: 806759 - DNA, 25 bp, Mus musculus
tgccaacgcctaggatgctttcagg

SEQ ID NO: 806760 - DNA, 25 bp, Mus musculus
tgccaacggcgccatgggcaactgc

SEQ ID NO: 806761 - DNA, 25 bp, Mus musculus
tgccaacggcgcgatgggcaactgc

SEQ ID NO: 806762 - DNA, 25 bp, Mus musculus
tgccaacggtgccagggaaacaccc

SEQ ID NO: 806763 - DNA, 25 bp, Mus musculus
tgccaacggtgcgagggaaacaccc

SEQ ID NO: 806764 - DNA, 25 bp, Mus musculus
tgccaacgtagtccacgtgaagtca

SEQ ID NO: 806765 - DNA, 25 bp, Mus musculus
tgccaacgtagtgcacgtgaagtca

SEQ ID NO: 806766 - DNA, 25 bp, Mus musculus
tgccaacgtgctctatatcgagtcc

SEQ ID NO: 806767 - DNA, 25 bp, Mus musculus
tgccaacgtgctgtatatcgagtcc

SEQ ID NO: 806768 - DNA, 25 bp, Mus musculus
tgccaacgttcactatctgtgctca

SEQ ID NO: 806769 - DNA, 25 bp, Mus musculus
tgccaacgttcagtatctgtgctca

SEQ ID NO: 806770 - DNA, 25 bp, Mus musculus
tgccaactacgtcgagctcatagag

SEQ ID NO: 806771 - DNA, 25 bp, Mus musculus
tgccaactacgtggagctcatagag

SEQ ID NO: 806772 - DNA, 25 bp, Mus musculus
tgccaactggctcaaaatagacccc

SEQ ID NO: 806773 - DNA, 25 bp, Mus musculus
tgccaactggctgaaaatagacccc

SEQ ID NO: 806774 - DNA, 25 bp, Mus musculus
tgccaacttaggaccggaggactgg

SEQ ID NO: 806775 - DNA, 25 bp, Mus musculus
tgccaacttaggtccggaggactgg

SEQ ID NO: 806776 - DNA, 25 bp, Mus musculus
tgccaactttgacaacttatctgaa

SEQ ID NO: 806777 - DNA, 25 bp, Mus musculus
tgccaactttgagaacttatctgaa

SEQ ID NO: 806778 - DNA, 25 bp, Mus musculus
tgccaagaaaaacatcaatggaatc

SEQ ID NO: 806779 - DNA, 25 bp, Mus musculus
tgccaagaaaaagatcaatggaatc

SEQ ID NO: 806780 - DNA, 25 bp, Mus musculus
tgccaagaagagaggccggaaaaag

SEQ ID NO: 806781 - DNA, 25 bp, Mus musculus
tgccaagaagagtggccggaaaaag

SEQ ID NO: 806782 - DNA, 25 bp, Mus musculus
tgccaagacacaaggtgggcacgtg

SEQ ID NO: 806783 - DNA, 25 bp, Mus musculus
tgccaagacacatggtgggcacgtg

SEQ ID NO: 806784 - DNA, 25 bp, Mus musculus
tgccaagacttacacagatcaatgt

SEQ ID NO: 806785 - DNA, 25 bp, Mus musculus
tgccaagacttagacagatcaatgt

SEQ ID NO: 806786 - DNA, 25 bp, Mus musculus
tgccaagagccaagataatcactgt

SEQ ID NO: 806787 - DNA, 25 bp, Mus musculus
tgccaagagccatgataatcactgt

SEQ ID NO: 806788 - DNA, 25 bp, Mus musculus
tgccaagagtgaaatcttcaatggg

SEQ ID NO: 806789 - DNA, 25 bp, Mus musculus
tgccaagagtgatatcttcaatggg

SEQ ID NO: 806790 - DNA, 25 bp, Mus musculus
tgccaagatttcagacttcagctgg

SEQ ID NO: 806791 - DNA, 25 bp, Mus musculus
tgccaagatttctgacttcagctgg

SEQ ID NO: 806792 - DNA, 25 bp, Mus musculus
tgccaagcaagaattgactccaaat

SEQ ID NO: 806793 - DNA, 25 bp, Mus musculus
tgccaagcaagatttgactccaaat

SEQ ID NO: 806794 - DNA, 25 bp, Mus musculus
tgccaagcatcaagccaagtgtaac

SEQ ID NO: 806795 - DNA, 25 bp, Mus musculus
tgccaagcatcatgccaagtgtaac

SEQ ID NO: 806796 - DNA, 25 bp, Mus musculus
tgccaagccaaactccaggacattc

SEQ ID NO: 806797 - DNA, 25 bp, Mus musculus
tgccaagccaaagtccaggacattc

SEQ ID NO: 806798 - DNA, 25 bp, Mus musculus
tgccaagccctgcagtagatacaga

SEQ ID NO: 806799 - DNA, 25 bp, Mus musculus
tgccaagccctggagtagatacaga

SEQ ID NO: 806800 - DNA, 25 bp, Mus musculus
tgccaagccggaagactgggatgaa

SEQ ID NO: 806801 - DNA, 25 bp, Mus musculus
tgccaagccggatgactgggatgaa

SEQ ID NO: 806802 - DNA, 25 bp, Mus musculus
tgccaagcctggagtcgcaggttcc

SEQ ID NO: 806803 - DNA, 25 bp, Mus musculus
tgccaagcctggtgtcgcaggttcc

SEQ ID NO: 806804 - DNA, 25 bp, Mus musculus
tgccaagcctgtcaccgtggccgtg

SEQ ID NO: 806805 - DNA, 25 bp, Mus musculus
tgccaagcctgtgaccgtggccgtg

SEQ ID NO: 806806 - DNA, 25 bp, Mus musculus
tgccaagcgctactcaagactgttt

SEQ ID NO: 806807 - DNA, 25 bp, Mus musculus
tgccaagcgctagtcaagactgttt

SEQ ID NO: 806808 - DNA, 25 bp, Mus musculus
tgccaagcgtgtcaaaggccgtact

SEQ ID NO: 806809 - DNA, 25 bp, Mus musculus
tgccaagcgtgtgaaaggccgtact

SEQ ID NO: 806810 - DNA, 25 bp, Mus musculus
tgccaagctgggaagaacactccag

SEQ ID NO: 806811 - DNA, 25 bp, Mus musculus
tgccaagctgggtagaacactccag

SEQ ID NO: 806812 - DNA, 25 bp, Mus musculus
tgccaagctgtacgagaataagaag

SEQ ID NO: 806813 - DNA, 25 bp, Mus musculus
tgccaagctgtaggagaataagaag

SEQ ID NO: 806814 - DNA, 25 bp, Mus musculus
tgccaaggagatcatgcagcaccgg

SEQ ID NO: 806815 - DNA, 25 bp, Mus musculus
tgccaaggagatgatgcagcaccgg

SEQ ID NO: 806816 - DNA, 25 bp, Mus musculus
tgccaaggaggtactcagcgccagg

SEQ ID NO: 806817 - DNA, 25 bp, Mus musculus
tgccaaggaggttctcagcgccagg

SEQ ID NO: 806818 - DNA, 25 bp, Mus musculus
tgccaaggataacgcctgacactga

SEQ ID NO: 806819 - DNA, 25 bp, Mus musculus
tgccaaggataaggcctgacactga

SEQ ID NO: 806820 - DNA, 25 bp, Mus musculus
tgccaaggatgcagcacgcaagctg

SEQ ID NO: 806821 - DNA, 25 bp, Mus musculus
tgccaaggatgctgcacgcaagctg

SEQ ID NO: 806822 - DNA, 25 bp, Mus musculus
tgccaaggcataatcagctccacga

SEQ ID NO: 806823 - DNA, 25 bp, Mus musculus
tgccaaggcatattcagctccacga

SEQ ID NO: 806824 - DNA, 25 bp, Mus musculus
tgccaaggccctcatttatggcggg

SEQ ID NO: 806825 - DNA, 25 bp, Mus musculus
tgccaaggccctgatttatggcggg

SEQ ID NO: 806826 - DNA, 25 bp, Mus musculus
tgccaaggcttcactgacaggttct

SEQ ID NO: 806827 - DNA, 25 bp, Mus musculus
tgccaaggcttctctgacaggttct

SEQ ID NO: 806828 - DNA, 25 bp, Mus musculus
tgccaagggaagacaccacagtgct

SEQ ID NO: 806829 - DNA, 25 bp, Mus musculus
tgccaagggaagtcaccacagtgct

SEQ ID NO: 806830 - DNA, 25 bp, Mus musculus
tgccaaggtatgagaagttggccag

SEQ ID NO: 806831 - DNA, 25 bp, Mus musculus
tgccaaggtatgtgaagttggccag

SEQ ID NO: 806832 - DNA, 25 bp, Mus musculus
tgccaaggttctacggtccaaagtt

SEQ ID NO: 806833 - DNA, 25 bp, Mus musculus
tgccaaggttcttcggtccaaagtt

SEQ ID NO: 806834 - DNA, 25 bp, Mus musculus
tgccaagtaacaccggagggttatg

SEQ ID NO: 806835 - DNA, 25 bp, Mus musculus
tgccaagtaacagcggagggttatg

SEQ ID NO: 806836 - DNA, 25 bp, Mus musculus
tgccaagtacgccaacatgtggctg

SEQ ID NO: 806837 - DNA, 25 bp, Mus musculus
tgccaagtacgcgaacatgtggctg

SEQ ID NO: 806838 - DNA, 25 bp, Mus musculus
tgccaagtatttctttaagatggcc

SEQ ID NO: 806839 - DNA, 25 bp, Mus musculus
tgccaagtatttgtttaagatggcc

SEQ ID NO: 806840 - DNA, 25 bp, Mus musculus
tgccaagtcagaagccatttctaag

SEQ ID NO: 806841 - DNA, 25 bp, Mus musculus
tgccaagtcagatgccatttctaag

SEQ ID NO: 806842 - DNA, 25 bp, Mus musculus
tgccaagtgagtacccgggtacagc

SEQ ID NO: 806843 - DNA, 25 bp, Mus musculus
tgccaagtgagttcccgggtacagc

SEQ ID NO: 806844 - DNA, 25 bp, Mus musculus
tgccaagtggcaccagacctttaaa

SEQ ID NO: 806845 - DNA, 25 bp, Mus musculus
tgccaagtggcagcagacctttaaa

SEQ ID NO: 806846 - DNA, 25 bp, Mus musculus
tgccaagtgtgtagacaagtggttg

SEQ ID NO: 806847 - DNA, 25 bp, Mus musculus
tgccaagtgtgttgacaagtggttg

SEQ ID NO: 806848 - DNA, 25 bp, Mus musculus
tgccaagttagtctatagcatcctt

SEQ ID NO: 806849 - DNA, 25 bp, Mus musculus
tgccaagttagtgtatagcatcctt

SEQ ID NO: 806850 - DNA, 25 bp, Mus musculus
tgccaagtttggagagtaccccgaa

SEQ ID NO: 806851 - DNA, 25 bp, Mus musculus
tgccaagtttggcaaaggaacaaag

SEQ ID NO: 806852 - DNA, 25 bp, Mus musculus
tgccaagtttgggaaaggaacaaag

SEQ ID NO: 806853 - DNA, 25 bp, Mus musculus
tgccaagtttggtgagtaccccgaa

SEQ ID NO: 806854 - DNA, 25 bp, Mus musculus
tgccaataacttcgcaatgaaagga

SEQ ID NO: 806855 - DNA, 25 bp, Mus musculus
tgccaataacttggcaatgaaagga

SEQ ID NO: 806856 - DNA, 25 bp, Mus musculus
tgccaatatagcagagaactcggtg

SEQ ID NO: 806857 - DNA, 25 bp, Mus musculus
tgccaatatagctgagaactcggtg

SEQ ID NO: 806858 - DNA, 25 bp, Mus musculus
tgccaatattgccacagacgatgag

SEQ ID NO: 806859 - DNA, 25 bp, Mus musculus
tgccaatattgcgacagacgatgag

SEQ ID NO: 806860 - DNA, 25 bp, Mus musculus
tgccaatcactccaatgcggatgag

SEQ ID NO: 806861 - DNA, 25 bp, Mus musculus
tgccaatcactcgaatgcggatgag

SEQ ID NO: 806862 - DNA, 25 bp, Mus musculus
tgccaatcagctacccgcaggagag

SEQ ID NO: 806863 - DNA, 25 bp, Mus musculus
tgccaatcagcttcccgcaggagag

SEQ ID NO: 806864 - DNA, 25 bp, Mus musculus
tgccaatcagggaaaaaagtcagag

SEQ ID NO: 806865 - DNA, 25 bp, Mus musculus
tgccaatcagggtaaaaagtcagag

SEQ ID NO: 806866 - DNA, 25 bp, Mus musculus
tgccaatcatacacttggtagtaaa

SEQ ID NO: 806867 - DNA, 25 bp, Mus musculus
tgccaatcatactcttggtagtaaa

SEQ ID NO: 806868 - DNA, 25 bp, Mus musculus
tgccaatcgactcacgggttcagat

SEQ ID NO: 806869 - DNA, 25 bp, Mus musculus
tgccaatcgactgacgggttcagat

SEQ ID NO: 806870 - DNA, 25 bp, Mus musculus
tgccaatcggaaagcatttcgtctc

SEQ ID NO: 806871 - DNA, 25 bp, Mus musculus
tgccaatcggaatgcatttcgtctc

SEQ ID NO: 806872 - DNA, 25 bp, Mus musculus
tgccaatctggacatcctggacaca

SEQ ID NO: 806873 - DNA, 25 bp, Mus musculus
tgccaatctggagatcctggacaca

SEQ ID NO: 806874 - DNA, 25 bp, Mus musculus
tgccaatgagcacttgcagtactac

SEQ ID NO: 806875 - DNA, 25 bp, Mus musculus
tgccaatgagcagttgcagtactac

SEQ ID NO: 806876 - DNA, 25 bp, Mus musculus
tgccaatgatgtaccgatccagtgt

SEQ ID NO: 806877 - DNA, 25 bp, Mus musculus
tgccaatgatgttccgatccagtgt

SEQ ID NO: 806878 - DNA, 25 bp, Mus musculus
tgccaatgccaccagtagccgcgag

SEQ ID NO: 806879 - DNA, 25 bp, Mus musculus
tgccaatgccacgagtagccgcgag

SEQ ID NO: 806880 - DNA, 25 bp, Mus musculus
tgccaatgccatatggtggccctgt

SEQ ID NO: 806881 - DNA, 25 bp, Mus musculus
tgccaatgccatttggtggccctgt

SEQ ID NO: 806882 - DNA, 25 bp, Mus musculus
tgccaatggcacatccagcatgatt

SEQ ID NO: 806883 - DNA, 25 bp, Mus musculus
tgccaatggcacttccagcatgatt

SEQ ID NO: 806884 - DNA, 25 bp, Mus musculus
tgccaatggccacctgatgtccaac

SEQ ID NO: 806885 - DNA, 25 bp, Mus musculus
tgccaatggccagctgatgtccaac

SEQ ID NO: 806886 - DNA, 25 bp, Mus musculus
tgccaatggtgaagtggatgtggaa

SEQ ID NO: 806887 - DNA, 25 bp, Mus musculus
tgccaatggtgatgtggatgtggaa

SEQ ID NO: 806888 - DNA, 25 bp, Mus musculus
tgccaatgtagacaggcaacctcgg

SEQ ID NO: 806889 - DNA, 25 bp, Mus musculus
tgccaatgtagacatggatacgagg

SEQ ID NO: 806890 - DNA, 25 bp, Mus musculus
tgccaatgtagagaggcaacctcgg

SEQ ID NO: 806891 - DNA, 25 bp, Mus musculus
tgccaatgtagagatggatacgagg

SEQ ID NO: 806892 - DNA, 25 bp, Mus musculus
tgccaatgtccactatatgagagtc

SEQ ID NO: 806893 - DNA, 25 bp, Mus musculus
tgccaatgtccagtatatgagagtc

SEQ ID NO: 806894 - DNA, 25 bp, Mus musculus
tgccaatgtgggagacctcaaactc

SEQ ID NO: 806895 - DNA, 25 bp, Mus musculus
tgccaatgtgggtgacctcaaactc

SEQ ID NO: 806896 - DNA, 25 bp, Mus musculus
tgccaattctcgcaagcaagaagcg

SEQ ID NO: 806897 - DNA, 25 bp, Mus musculus
tgccaattctcggaagcaagaagcg

SEQ ID NO: 806898 - DNA, 25 bp, Mus musculus
tgccaattgagaatacatcttactg

SEQ ID NO: 806899 - DNA, 25 bp, Mus musculus
tgccaattgagattacatcttactg

SEQ ID NO: 806900 - DNA, 25 bp, Mus musculus
tgccaatttcccagtggacccacag

SEQ ID NO: 806901 - DNA, 25 bp, Mus musculus
tgccaatttccctgtggacccacag

SEQ ID NO: 806902 - DNA, 25 bp, Mus musculus
tgccacaaacatcctcaacaagctg

SEQ ID NO: 806903 - DNA, 25 bp, Mus musculus
tgccacaaacatgctcaacaagctg

SEQ ID NO: 806904 - DNA, 25 bp, Mus musculus
tgccacaagaggaccggcttctcca

SEQ ID NO: 806905 - DNA, 25 bp, Mus musculus
tgccacaagaggtccggcttctcca

SEQ ID NO: 806906 - DNA, 25 bp, Mus musculus
tgccacacagggaaactttgccacc

SEQ ID NO: 806907 - DNA, 25 bp, Mus musculus
tgccacacagggtaactttgccacc

SEQ ID NO: 806908 - DNA, 25 bp, Mus musculus
tgccacaccaaaaagcaacgacagc

SEQ ID NO: 806909 - DNA, 25 bp, Mus musculus
tgccacaccaaatagcaacgacagc

SEQ ID NO: 806910 - DNA, 25 bp, Mus musculus
tgccacaccaacaaggagaagctgg

SEQ ID NO: 806911 - DNA, 25 bp, Mus musculus
tgccacaccaactaggagaagctgg

SEQ ID NO: 806912 - DNA, 25 bp, Mus musculus
tgccacaccaatcgaggtgctgtgt

SEQ ID NO: 806913 - DNA, 25 bp, Mus musculus
tgccacaccaatggaggtgctgtgt

SEQ ID NO: 806914 - DNA, 25 bp, Mus musculus
tgccacaccattacatccacaagga

SEQ ID NO: 806915 - DNA, 25 bp, Mus musculus
tgccacaccatttcatccacaagga

SEQ ID NO: 806916 - DNA, 25 bp, Mus musculus
tgccacaccgccagtgtacggtcag

SEQ ID NO: 806917 - DNA, 25 bp, Mus musculus
tgccacaccgcctgtgtacggtcag

SEQ ID NO: 806918 - DNA, 25 bp, Mus musculus
tgccacacctgccaaattgagttag

SEQ ID NO: 806919 - DNA, 25 bp, Mus musculus
tgccacacctgcgaaattgagttag

SEQ ID NO: 806920 - DNA, 25 bp, Mus musculus
tgccacactctaatttgcccacaag

SEQ ID NO: 806921 - DNA, 25 bp, Mus musculus
tgccacactctattttgcccacaag

SEQ ID NO: 806922 - DNA, 25 bp, Mus musculus
tgccacactgctactgcgccatgga

SEQ ID NO: 806923 - DNA, 25 bp, Mus musculus
tgccacactgctcgaacagatcggg

SEQ ID NO: 806924 - DNA, 25 bp, Mus musculus
tgccacactgctggaacagatcggg

SEQ ID NO: 806925 - DNA, 25 bp, Mus musculus
tgccacactgcttctgcgccatgga

SEQ ID NO: 806926 - DNA, 25 bp, Mus musculus
tgccacagaagaactcgtaaagcgg

SEQ ID NO: 806927 - DNA, 25 bp, Mus musculus
tgccacagaagatctcgtaaagcgg

SEQ ID NO: 806928 - DNA, 25 bp, Mus musculus
tgccacagacataccactcctgctg

SEQ ID NO: 806929 - DNA, 25 bp, Mus musculus
tgccacagacattccactcctgctg

SEQ ID NO: 806930 - DNA, 25 bp, Mus musculus
tgccacagagaaattaagctgcact

SEQ ID NO: 806931 - DNA, 25 bp, Mus musculus
tgccacagagaatttaagctgcact

SEQ ID NO: 806932 - DNA, 25 bp, Mus musculus
tgccacagatgaccgtgtccagaag

SEQ ID NO: 806933 - DNA, 25 bp, Mus musculus
tgccacagatgagcgtgtccagaag

SEQ ID NO: 806934 - DNA, 25 bp, Mus musculus
tgccacagcacaaggatttcagaac

SEQ ID NO: 806935 - DNA, 25 bp, Mus musculus
tgccacagcacatggatttcagaac

SEQ ID NO: 806936 - DNA, 25 bp, Mus musculus
tgccacagcaccaggttcaataccg

SEQ ID NO: 806937 - DNA, 25 bp, Mus musculus
tgccacagcacctggttcaataccg

SEQ ID NO: 806938 - DNA, 25 bp, Mus musculus
tgccacagccttcttaagctctgag

SEQ ID NO: 806939 - DNA, 25 bp, Mus musculus
tgccacagccttgttaagctctgag

SEQ ID NO: 806940 - DNA, 25 bp, Mus musculus
tgccacagctgtccggtggtgtcca

SEQ ID NO: 806941 - DNA, 25 bp, Mus musculus
tgccacagctgtgcggtggtgtcca

SEQ ID NO: 806942 - DNA, 25 bp, Mus musculus
tgccacaggagaccagctgctggaa

SEQ ID NO: 806943 - DNA, 25 bp, Mus musculus
tgccacaggagagcagctgctggaa

SEQ ID NO: 806944 - DNA, 25 bp, Mus musculus
tgccacaggtgtagcttgcgccact

SEQ ID NO: 806945 - DNA, 25 bp, Mus musculus
tgccacaggtgttgcttgcgccact

SEQ ID NO: 806946 - DNA, 25 bp, Mus musculus
tgccacagtatgaggaaaccttccg

SEQ ID NO: 806947 - DNA, 25 bp, Mus musculus
tgccacagtatgtggaaaccttccg

SEQ ID NO: 806948 - DNA, 25 bp, Mus musculus
tgccacagtcccaaaagataccaga

SEQ ID NO: 806949 - DNA, 25 bp, Mus musculus
tgccacagtccctaaagataccaga

SEQ ID NO: 806950 - DNA, 25 bp, Mus musculus
tgccacagtgccagtgcaggcccag

SEQ ID NO: 806951 - DNA, 25 bp, Mus musculus
tgccacagtgcctgtgcaggcccag

SEQ ID NO: 806952 - DNA, 25 bp, Mus musculus
tgccacagtgctcacgtttctgagg

SEQ ID NO: 806953 - DNA, 25 bp, Mus musculus
tgccacagtgctgacgtttctgagg

SEQ ID NO: 806954 - DNA, 25 bp, Mus musculus
tgccacatcaccaagacaatccagg

SEQ ID NO: 806955 - DNA, 25 bp, Mus musculus
tgccacatcacctagacaatccagg

SEQ ID NO: 806956 - DNA, 25 bp, Mus musculus
tgccacatcagtcgcggatggagat

SEQ ID NO: 806957 - DNA, 25 bp, Mus musculus
tgccacatcagtggcggatggagat

SEQ ID NO: 806958 - DNA, 25 bp, Mus musculus
tgccacattgcacaggaaccaaccg

SEQ ID NO: 806959 - DNA, 25 bp, Mus musculus
tgccacattgcagaggaaccaaccg

SEQ ID NO: 806960 - DNA, 25 bp, Mus musculus
tgccaccaaaaacagtagctccctg

SEQ ID NO: 806961 - DNA, 25 bp, Mus musculus
tgccaccaaaaacggattgttcaca

SEQ ID NO: 806962 - DNA, 25 bp, Mus musculus
tgccaccaaaaagagtagctccctg

SEQ ID NO: 806963 - DNA, 25 bp, Mus musculus
tgccaccaaaaagggattgttcaca

SEQ ID NO: 806964 - DNA, 25 bp, Mus musculus
tgccaccaaagacagcaagcagttc

SEQ ID NO: 806965 - DNA, 25 bp, Mus musculus
tgccaccaaagaccaaaaacgaaga

SEQ ID NO: 806966 - DNA, 25 bp, Mus musculus
tgccaccaaagagagcaagcagttc

SEQ ID NO: 806967 - DNA, 25 bp, Mus musculus
tgccaccaaagagcaaaaacgaaga

SEQ ID NO: 806968 - DNA, 25 bp, Mus musculus
tgccaccaaccaccgcaatgtgtaa

SEQ ID NO: 806969 - DNA, 25 bp, Mus musculus
tgccaccaaccagcgcaatgtgtaa

SEQ ID NO: 806970 - DNA, 25 bp, Mus musculus
tgccaccaacgaactgggccaagct

SEQ ID NO: 806971 - DNA, 25 bp, Mus musculus
tgccaccaacgatctgggccaagct

SEQ ID NO: 806972 - DNA, 25 bp, Mus musculus
tgccaccaatacaactagagaaaga

SEQ ID NO: 806973 - DNA, 25 bp, Mus musculus
tgccaccaatactactagagaaaga

SEQ ID NO: 806974 - DNA, 25 bp, Mus musculus
tgccaccacacgcagtcatctatat

SEQ ID NO: 806975 - DNA, 25 bp, Mus musculus
tgccaccacacggagtcatctatat

SEQ ID NO: 806976 - DNA, 25 bp, Mus musculus
tgccaccacatgagccagggagtca

SEQ ID NO: 806977 - DNA, 25 bp, Mus musculus
tgccaccacatgtgccagggagtca

SEQ ID NO: 806978 - DNA, 25 bp, Mus musculus
tgccaccacggacgcgcctggtgaa

SEQ ID NO: 806979 - DNA, 25 bp, Mus musculus
tgccaccacggaggcgcctggtgaa

SEQ ID NO: 806980 - DNA, 25 bp, Mus musculus
tgccaccactgcaatgaatctctgt

SEQ ID NO: 806981 - DNA, 25 bp, Mus musculus
tgccaccactgctatgaatctctgt

SEQ ID NO: 806982 - DNA, 25 bp, Mus musculus
tgccaccagaagaacgccttacatg

SEQ ID NO: 806983 - DNA, 25 bp, Mus musculus
tgccaccagaagtacgccttacatg

SEQ ID NO: 806984 - DNA, 25 bp, Mus musculus
tgccaccagcacagggtcctaagag

SEQ ID NO: 806985 - DNA, 25 bp, Mus musculus
tgccaccagcactgggtcctaagag

SEQ ID NO: 806986 - DNA, 25 bp, Mus musculus
tgccaccagtgacagagactttgtg

SEQ ID NO: 806987 - DNA, 25 bp, Mus musculus
tgccaccagtgagagagactttgtg

SEQ ID NO: 806988 - DNA, 25 bp, Mus musculus
tgccaccatcttccgggagatcctg

SEQ ID NO: 806989 - DNA, 25 bp, Mus musculus
tgccaccatcttgcgggagatcctg

SEQ ID NO: 806990 - DNA, 25 bp, Mus musculus
tgccaccattcacagtggaggtgaa

SEQ ID NO: 806991 - DNA, 25 bp, Mus musculus
tgccaccattcagagtggaggtgaa

SEQ ID NO: 806992 - DNA, 25 bp, Mus musculus
tgccaccccgcgagtctgcagggtg

SEQ ID NO: 806993 - DNA, 25 bp, Mus musculus
tgccaccccgcgtgtctgcagggtg

SEQ ID NO: 806994 - DNA, 25 bp, Mus musculus
tgccacccctcaaaaaacagccttg

SEQ ID NO: 806995 - DNA, 25 bp, Mus musculus
tgccacccctcataaaacagccttg

SEQ ID NO: 806996 - DNA, 25 bp, Mus musculus
tgccaccctcaccttaattgctatg

SEQ ID NO: 806997 - DNA, 25 bp, Mus musculus
tgccaccctcacgttaattgctatg

SEQ ID NO: 806998 - DNA, 25 bp, Mus musculus
tgccaccctcttcgtctacgtaggg

SEQ ID NO: 806999 - DNA, 25 bp, Mus musculus
tgccaccctcttcttgagaaaggtc

SEQ ID NO: 807000 - DNA, 25 bp, Mus musculus
tgccaccctcttggtctacgtaggg

SEQ ID NO: 807001 - DNA, 25 bp, Mus musculus
tgccaccctcttgttgagaaaggtc

SEQ ID NO: 807002 - DNA, 25 bp, Mus musculus
tgccaccctgagacggctgctggtt

SEQ ID NO: 807003 - DNA, 25 bp, Mus musculus
tgccaccctgagtcggctgctggtt

SEQ ID NO: 807004 - DNA, 25 bp, Mus musculus
tgccaccgcaagctgatactgctag

SEQ ID NO: 807005 - DNA, 25 bp, Mus musculus
tgccaccgcaaggtgatactgctag

SEQ ID NO: 807006 - DNA, 25 bp, Mus musculus
tgccaccgcagcattagagagactg

SEQ ID NO: 807007 - DNA, 25 bp, Mus musculus
tgccaccgcagctttagagagactg

SEQ ID NO: 807008 - DNA, 25 bp, Mus musculus
tgccaccgcagtcgcctgctggaga

SEQ ID NO: 807009 - DNA, 25 bp, Mus musculus
tgccaccgcagtggcctgctggaga

SEQ ID NO: 807010 - DNA, 25 bp, Mus musculus
tgccaccggtaaagggaacttgaag

SEQ ID NO: 807011 - DNA, 25 bp, Mus musculus
tgccaccggtaatgggaacttgaag

SEQ ID NO: 807012 - DNA, 25 bp, Mus musculus
tgccacctaggcagggagactgtgc

SEQ ID NO: 807013 - DNA, 25 bp, Mus musculus
tgccacctaggctgggagactgtgc

SEQ ID NO: 807014 - DNA, 25 bp, Mus musculus
tgccacctcgatcagagcctggctg

SEQ ID NO: 807015 - DNA, 25 bp, Mus musculus
tgccacctcgatgagagcctggctg

SEQ ID NO: 807016 - DNA, 25 bp, Mus musculus
tgccacctggtacaaaaattccttt

SEQ ID NO: 807017 - DNA, 25 bp, Mus musculus
tgccacctggtagaaaaattccttt

SEQ ID NO: 807018 - DNA, 25 bp, Mus musculus
tgccacctgtgacatcagcaacgtt

SEQ ID NO: 807019 - DNA, 25 bp, Mus musculus
tgccacctgtgagatcagcaacgtt

SEQ ID NO: 807020 - DNA, 25 bp, Mus musculus
tgccaccttcgacaccacgtgaatg

SEQ ID NO: 807021 - DNA, 25 bp, Mus musculus
tgccaccttcgagaccacgtgaatg

SEQ ID NO: 807022 - DNA, 25 bp, Mus musculus
tgccacgaaaagaatttctaccaga

SEQ ID NO: 807023 - DNA, 25 bp, Mus musculus
tgccacgaaaagtatttctaccaga

SEQ ID NO: 807024 - DNA, 25 bp, Mus musculus
tgccacgactgactggattgccatc

SEQ ID NO: 807025 - DNA, 25 bp, Mus musculus
tgccacgactgagtggattgccatc

SEQ ID NO: 807026 - DNA, 25 bp, Mus musculus
tgccacgagacaagtttttaaaaga

SEQ ID NO: 807027 - DNA, 25 bp, Mus musculus
tgccacgagacatgtttttaaaaga

SEQ ID NO: 807028 - DNA, 25 bp, Mus musculus
tgccacgagcggctatcaagcactc

SEQ ID NO: 807029 - DNA, 25 bp, Mus musculus
tgccacgagcgggtatcaagcactc

SEQ ID NO: 807030 - DNA, 25 bp, Mus musculus
tgccacgaggcaaggtcccagccag

SEQ ID NO: 807031 - DNA, 25 bp, Mus musculus
tgccacgaggcatggtcccagccag

SEQ ID NO: 807032 - DNA, 25 bp, Mus musculus
tgccacgagttcaggaggaacaaca

SEQ ID NO: 807033 - DNA, 25 bp, Mus musculus
tgccacgagttctggaggaacaaca

SEQ ID NO: 807034 - DNA, 25 bp, Mus musculus
tgccacgccagcagcagagaaatgg

SEQ ID NO: 807035 - DNA, 25 bp, Mus musculus
tgccacgccagctgcagagaaatgg

SEQ ID NO: 807036 - DNA, 25 bp, Mus musculus
tgccacgcccagatggatgtcactg

SEQ ID NO: 807037 - DNA, 25 bp, Mus musculus
tgccacgcccagttggatgtcactg

SEQ ID NO: 807038 - DNA, 25 bp, Mus musculus
tgccacggtggcagacatgcttcaa

SEQ ID NO: 807039 - DNA, 25 bp, Mus musculus
tgccacggtggctgacatgcttcaa

SEQ ID NO: 807040 - DNA, 25 bp, Mus musculus
tgccacgtcacaacctgcacaagat

SEQ ID NO: 807041 - DNA, 25 bp, Mus musculus
tgccacgtcacatcctgcacaagat

SEQ ID NO: 807042 - DNA, 25 bp, Mus musculus
tgccacgtgaatccccagtgcagca

SEQ ID NO: 807043 - DNA, 25 bp, Mus musculus
tgccacgtgaatgcccagtgcagca

SEQ ID NO: 807044 - DNA, 25 bp, Mus musculus
tgccacgtggagctcatcaggctgc

SEQ ID NO: 807045 - DNA, 25 bp, Mus musculus
tgccacgtggaggtcatcaggctgc

SEQ ID NO: 807046 - DNA, 25 bp, Mus musculus
tgccacgtgtgacccttgaacgcct

SEQ ID NO: 807047 - DNA, 25 bp, Mus musculus
tgccacgtgtgagccttgaacgcct

SEQ ID NO: 807048 - DNA, 25 bp, Mus musculus
tgccactaagctacgggagaccaat

SEQ ID NO: 807049 - DNA, 25 bp, Mus musculus
tgccactaagcttcgggagaccaat

SEQ ID NO: 807050 - DNA, 25 bp, Mus musculus
tgccactagaccagcctgaactgag

SEQ ID NO: 807051 - DNA, 25 bp, Mus musculus
tgccactagacctgcctgaactgag

SEQ ID NO: 807052 - DNA, 25 bp, Mus musculus
tgccactattctacttcacctttgg

SEQ ID NO: 807053 - DNA, 25 bp, Mus musculus
tgccactattcttcttcacctttgg

SEQ ID NO: 807054 - DNA, 25 bp, Mus musculus
tgccactccggaagagtttttcctt

SEQ ID NO: 807055 - DNA, 25 bp, Mus musculus
tgccactccggatgagtttttcctt

SEQ ID NO: 807056 - DNA, 25 bp, Mus musculus
tgccactcgaagacacatggaagag

SEQ ID NO: 807057 - DNA, 25 bp, Mus musculus
tgccactcgaagtcacatggaagag

SEQ ID NO: 807058 - DNA, 25 bp, Mus musculus
tgccactcggagagccgcagcctga

SEQ ID NO: 807059 - DNA, 25 bp, Mus musculus
tgccactcggagtgccgcagcctga

SEQ ID NO: 807060 - DNA, 25 bp, Mus musculus
tgccactgaagtagacaacaatttc

SEQ ID NO: 807061 - DNA, 25 bp, Mus musculus
tgccactgaagttgacaacaatttc

SEQ ID NO: 807062 - DNA, 25 bp, Mus musculus
tgccactgactgaactgcaaaagaa

SEQ ID NO: 807063 - DNA, 25 bp, Mus musculus
tgccactgactgtactgcaaaagaa

SEQ ID NO: 807064 - DNA, 25 bp, Mus musculus
tgccactgagacatcctgcgctctt

SEQ ID NO: 807065 - DNA, 25 bp, Mus musculus
tgccactgagacttcctgcgctctt

SEQ ID NO: 807066 - DNA, 25 bp, Mus musculus
tgccactgaggcactgagacactcc

SEQ ID NO: 807067 - DNA, 25 bp, Mus musculus
tgccactgaggctctgagacactcc

SEQ ID NO: 807068 - DNA, 25 bp, Mus musculus
tgccactgcaggacggagacactgt

SEQ ID NO: 807069 - DNA, 25 bp, Mus musculus
tgccactgcaggtcggagacactgt

SEQ ID NO: 807070 - DNA, 25 bp, Mus musculus
tgccactgcgatcacaatccaaagg

SEQ ID NO: 807071 - DNA, 25 bp, Mus musculus
tgccactgcgatgacaatccaaagg

SEQ ID NO: 807072 - DNA, 25 bp, Mus musculus
tgccactggaagaatttccaacata

SEQ ID NO: 807073 - DNA, 25 bp, Mus musculus
tgccactggaagtatttccaacata

SEQ ID NO: 807074 - DNA, 25 bp, Mus musculus
tgccactggcgtctgcaaggcagta

SEQ ID NO: 807075 - DNA, 25 bp, Mus musculus
tgccactggcgtgtgcaaggcagta

SEQ ID NO: 807076 - DNA, 25 bp, Mus musculus
tgccactggtgaccggatatgccgc

SEQ ID NO: 807077 - DNA, 25 bp, Mus musculus
tgccactggtgagcggatatgccgc

SEQ ID NO: 807078 - DNA, 25 bp, Mus musculus
tgccactgtaggcacagaatgctct

SEQ ID NO: 807079 - DNA, 25 bp, Mus musculus
tgccactgtagggacagaatgctct

SEQ ID NO: 807080 - DNA, 25 bp, Mus musculus
tgccactgtcaaacatgcactgctg

SEQ ID NO: 807081 - DNA, 25 bp, Mus musculus
tgccactgtcaatcatgcactgctg

SEQ ID NO: 807082 - DNA, 25 bp, Mus musculus
tgccacttacacaggtgtctgccca

SEQ ID NO: 807083 - DNA, 25 bp, Mus musculus
tgccacttacactggtgtctgccca

SEQ ID NO: 807084 - DNA, 25 bp, Mus musculus
tgccacttcagtctgcgtgtaacag

SEQ ID NO: 807085 - DNA, 25 bp, Mus musculus
tgccacttcagtgtgcgtgtaacag

SEQ ID NO: 807086 - DNA, 25 bp, Mus musculus
tgccacttctcgaaaacggaaagaa

SEQ ID NO: 807087 - DNA, 25 bp, Mus musculus
tgccacttctcgtaaacggaaagaa

SEQ ID NO: 807088 - DNA, 25 bp, Mus musculus
tgccacttcttacctgcgcagtttc

SEQ ID NO: 807089 - DNA, 25 bp, Mus musculus
tgccacttcttagctgcgcagtttc

SEQ ID NO: 807090 - DNA, 25 bp, Mus musculus
tgccacttgcgaaggggaccccagg

SEQ ID NO: 807091 - DNA, 25 bp, Mus musculus
tgccacttgcgatggggaccccagg

SEQ ID NO: 807092 - DNA, 25 bp, Mus musculus
tgccacttggtacaagtcaaacatg

SEQ ID NO: 807093 - DNA, 25 bp, Mus musculus
tgccacttggtagaagtcaaacatg

SEQ ID NO: 807094 - DNA, 25 bp, Mus musculus
tgccactttcaacgagcgacggaac

SEQ ID NO: 807095 - DNA, 25 bp, Mus musculus
tgccactttcaaggagcgacggaac

SEQ ID NO: 807096 - DNA, 25 bp, Mus musculus
tgccactttggcagaactggttcag

SEQ ID NO: 807097 - DNA, 25 bp, Mus musculus
tgccactttggctgaactggttcag

SEQ ID NO: 807098 - DNA, 25 bp, Mus musculus
tgccacttttgcaagagagcaaggc

SEQ ID NO: 807099 - DNA, 25 bp, Mus musculus
tgccacttttgctagagagcaaggc

SEQ ID NO: 807100 - DNA, 25 bp, Mus musculus
tgccagaaacctcagcgtggtcatt

SEQ ID NO: 807101 - DNA, 25 bp, Mus musculus
tgccagaaacctgagcgtggtcatt

SEQ ID NO: 807102 - DNA, 25 bp, Mus musculus
tgccagaacaccaagggctccttct

SEQ ID NO: 807103 - DNA, 25 bp, Mus musculus
tgccagaacacctagggctccttct

SEQ ID NO: 807104 - DNA, 25 bp, Mus musculus
tgccagaacatccataagtctctac

SEQ ID NO: 807105 - DNA, 25 bp, Mus musculus
tgccagaacatcgataagtctctac

SEQ ID NO: 807106 - DNA, 25 bp, Mus musculus
tgccagaaccatcattgcaaacatg

SEQ ID NO: 807107 - DNA, 25 bp, Mus musculus
tgccagaaccatgattgcaaacatg

SEQ ID NO: 807108 - DNA, 25 bp, Mus musculus
tgccagaactgactgtggctcagca

SEQ ID NO: 807109 - DNA, 25 bp, Mus musculus
tgccagaactgagtgtggctcagca

SEQ ID NO: 807110 - DNA, 25 bp, Mus musculus
tgccagaacttgactctaagaagac

SEQ ID NO: 807111 - DNA, 25 bp, Mus musculus
tgccagaacttgtctctaagaagac

SEQ ID NO: 807112 - DNA, 25 bp, Mus musculus
tgccagaaggatcactatgtcttca

SEQ ID NO: 807113 - DNA, 25 bp, Mus musculus
tgccagaaggatgactatgtcttca

SEQ ID NO: 807114 - DNA, 25 bp, Mus musculus
tgccagaaggcgaaggtctccttct

SEQ ID NO: 807115 - DNA, 25 bp, Mus musculus
tgccagaaggcgtaggtctccttct

SEQ ID NO: 807116 - DNA, 25 bp, Mus musculus
tgccagaaggttctttccaaacaag

SEQ ID NO: 807117 - DNA, 25 bp, Mus musculus
tgccagaaggttgtttccaaacaag

SEQ ID NO: 807118 - DNA, 25 bp, Mus musculus
tgccagaatggacctacctgcactg

SEQ ID NO: 807119 - DNA, 25 bp, Mus musculus
tgccagaatggagctacctgcactg

SEQ ID NO: 807120 - DNA, 25 bp, Mus musculus
tgccagaatttacaaagaacaatag

SEQ ID NO: 807121 - DNA, 25 bp, Mus musculus
tgccagaatttagaaagaacaatag

SEQ ID NO: 807122 - DNA, 25 bp, Mus musculus
tgccagacaagacccatgaagatcc

SEQ ID NO: 807123 - DNA, 25 bp, Mus musculus
tgccagacaagagccatgaagatcc

SEQ ID NO: 807124 - DNA, 25 bp, Mus musculus
tgccagacaagcagacagtaaccag

SEQ ID NO: 807125 - DNA, 25 bp, Mus musculus
tgccagacaagctgacagtaaccag

SEQ ID NO: 807126 - DNA, 25 bp, Mus musculus
tgccagacacgaatgacgagagaac

SEQ ID NO: 807127 - DNA, 25 bp, Mus musculus
tgccagacacgattgacgagagaac

SEQ ID NO: 807128 - DNA, 25 bp, Mus musculus
tgccagacacgtatccttacagacc

SEQ ID NO: 807129 - DNA, 25 bp, Mus musculus
tgccagacacgtttccttacagacc

SEQ ID NO: 807130 - DNA, 25 bp, Mus musculus
tgccagacccggaatggaggttgta

SEQ ID NO: 807131 - DNA, 25 bp, Mus musculus
tgccagacccggtatggaggttgta

SEQ ID NO: 807132 - DNA, 25 bp, Mus musculus
tgccagaccctccattggagagtga

SEQ ID NO: 807133 - DNA, 25 bp, Mus musculus
tgccagaccctcgattggagagtga

SEQ ID NO: 807134 - DNA, 25 bp, Mus musculus
tgccagaccggcacggatgaaaacc

SEQ ID NO: 807135 - DNA, 25 bp, Mus musculus
tgccagaccggctcggatgaaaacc

SEQ ID NO: 807136 - DNA, 25 bp, Mus musculus
tgccagactcacacatgtttacagg

SEQ ID NO: 807137 - DNA, 25 bp, Mus musculus
tgccagactcactcatgtttacagg

SEQ ID NO: 807138 - DNA, 25 bp, Mus musculus
tgccagactccaaagccagcgttgg

SEQ ID NO: 807139 - DNA, 25 bp, Mus musculus
tgccagactccatagccagcgttgg

SEQ ID NO: 807140 - DNA, 25 bp, Mus musculus
tgccagagagaaccctgtacctagc

SEQ ID NO: 807141 - DNA, 25 bp, Mus musculus
tgccagagagaacttcgcactgtca

SEQ ID NO: 807142 - DNA, 25 bp, Mus musculus
tgccagagagaagcctgtacctagc

SEQ ID NO: 807143 - DNA, 25 bp, Mus musculus
tgccagagagaagttcgcactgtca

SEQ ID NO: 807144 - DNA, 25 bp, Mus musculus
tgccagagagacagggtgcctcttt

SEQ ID NO: 807145 - DNA, 25 bp, Mus musculus
tgccagagagactgggtgcctcttt

SEQ ID NO: 807146 - DNA, 25 bp, Mus musculus
tgccagagaggtatgtagcccggcc

SEQ ID NO: 807147 - DNA, 25 bp, Mus musculus
tgccagagaggtttgtagcccggcc

SEQ ID NO: 807148 - DNA, 25 bp, Mus musculus
tgccagagccacagggtgaagacaa

SEQ ID NO: 807149 - DNA, 25 bp, Mus musculus
tgccagagccactgggtgaagacaa

SEQ ID NO: 807150 - DNA, 25 bp, Mus musculus
tgccagagcggccaacatgttcaag

SEQ ID NO: 807151 - DNA, 25 bp, Mus musculus
tgccagagcggcgaacatgttcaag

SEQ ID NO: 807152 - DNA, 25 bp, Mus musculus
tgccagagggcccaccgtgttatgc

SEQ ID NO: 807153 - DNA, 25 bp, Mus musculus
tgccagagggccgaccgtgttatgc

SEQ ID NO: 807154 - DNA, 25 bp, Mus musculus
tgccagagtcaacccatgttacaag

SEQ ID NO: 807155 - DNA, 25 bp, Mus musculus
tgccagagtcaagccatgttacaag

SEQ ID NO: 807156 - DNA, 25 bp, Mus musculus
tgccagagtgtgagttgccgtcaac

SEQ ID NO: 807157 - DNA, 25 bp, Mus musculus
tgccagagtgtgtgttgccgtcaac

SEQ ID NO: 807158 - DNA, 25 bp, Mus musculus
tgccagatactgatcaccaacttcc

SEQ ID NO: 807159 - DNA, 25 bp, Mus musculus
tgccagatactgttcaccaacttcc

SEQ ID NO: 807160 - DNA, 25 bp, Mus musculus
tgccagatagcccatgaccatacag

SEQ ID NO: 807161 - DNA, 25 bp, Mus musculus
tgccagatagccctcagggccgcaa

SEQ ID NO: 807162 - DNA, 25 bp, Mus musculus
tgccagatagccgatgaccatacag

SEQ ID NO: 807163 - DNA, 25 bp, Mus musculus
tgccagatagccgtcagggccgcaa

SEQ ID NO: 807164 - DNA, 25 bp, Mus musculus
tgccagatgagccactggaaccagg

SEQ ID NO: 807165 - DNA, 25 bp, Mus musculus
tgccagatgagcgactggaaccagg

SEQ ID NO: 807166 - DNA, 25 bp, Mus musculus
tgccagatggcacacttaaatataa

SEQ ID NO: 807167 - DNA, 25 bp, Mus musculus
tgccagatggcagacttaaatataa

SEQ ID NO: 807168 - DNA, 25 bp, Mus musculus
tgccagattatcacggagccttgct

SEQ ID NO: 807169 - DNA, 25 bp, Mus musculus
tgccagattatctcggagccttgct

SEQ ID NO: 807170 - DNA, 25 bp, Mus musculus
tgccagcaagtgagcatcaacacag

SEQ ID NO: 807171 - DNA, 25 bp, Mus musculus
tgccagcaagtgtgcatcaacacag

SEQ ID NO: 807172 - DNA, 25 bp, Mus musculus
tgccagcaagttcacatcacccgag

SEQ ID NO: 807173 - DNA, 25 bp, Mus musculus
tgccagcaagttgacatcacccgag

SEQ ID NO: 807174 - DNA, 25 bp, Mus musculus
tgccagcaatttcgtgtgagagact

SEQ ID NO: 807175 - DNA, 25 bp, Mus musculus
tgccagcaatttggtgtgagagact

SEQ ID NO: 807176 - DNA, 25 bp, Mus musculus
tgccagcacagcctcctgggtgact

SEQ ID NO: 807177 - DNA, 25 bp, Mus musculus
tgccagcacagcgtcctgggtgact

SEQ ID NO: 807178 - DNA, 25 bp, Mus musculus
tgccagcacatcagcaccaacgtta

SEQ ID NO: 807179 - DNA, 25 bp, Mus musculus
tgccagcacatctgcaccaacgtta

SEQ ID NO: 807180 - DNA, 25 bp, Mus musculus
tgccagcaccatccgcacagtgatg

SEQ ID NO: 807181 - DNA, 25 bp, Mus musculus
tgccagcaccatgcgcacagtgatg

SEQ ID NO: 807182 - DNA, 25 bp, Mus musculus
tgccagcactgaaaacactgtcatg

SEQ ID NO: 807183 - DNA, 25 bp, Mus musculus
tgccagcactgaagagcaagatgca

SEQ ID NO: 807184 - DNA, 25 bp, Mus musculus
tgccagcactgataacactgtcatg

SEQ ID NO: 807185 - DNA, 25 bp, Mus musculus
tgccagcactgatgagcaagatgca

SEQ ID NO: 807186 - DNA, 25 bp, Mus musculus
tgccagcactgcagggacctctggg

SEQ ID NO: 807187 - DNA, 25 bp, Mus musculus
tgccagcactgctgggacctctggg

SEQ ID NO: 807188 - DNA, 25 bp, Mus musculus
tgccagcagcagcatttctccattg

SEQ ID NO: 807189 - DNA, 25 bp, Mus musculus
tgccagcagcaggatttctccattg

SEQ ID NO: 807190 - DNA, 25 bp, Mus musculus
tgccagcaggaactgacggctgtct

SEQ ID NO: 807191 - DNA, 25 bp, Mus musculus
tgccagcaggaagtgacggctgtct

SEQ ID NO: 807192 - DNA, 25 bp, Mus musculus
tgccagcagggaaacattcagggag

SEQ ID NO: 807193 - DNA, 25 bp, Mus musculus
tgccagcagggatacattcagggag

SEQ ID NO: 807194 - DNA, 25 bp, Mus musculus
tgccagcatgagaggtaaccaaggg

SEQ ID NO: 807195 - DNA, 25 bp, Mus musculus
tgccagcatgagtggtaaccaaggg

SEQ ID NO: 807196 - DNA, 25 bp, Mus musculus
tgccagccaaggaatcagtcccggg

SEQ ID NO: 807197 - DNA, 25 bp, Mus musculus
tgccagccaaggtatcagtcccggg

SEQ ID NO: 807198 - DNA, 25 bp, Mus musculus
tgccagccaccacgagattcaggat

SEQ ID NO: 807199 - DNA, 25 bp, Mus musculus
tgccagccaccaggagattcaggat

SEQ ID NO: 807200 - DNA, 25 bp, Mus musculus
tgccagccagctataccagagaatc

SEQ ID NO: 807201 - DNA, 25 bp, Mus musculus
tgccagccagctatgaccaaggcct

SEQ ID NO: 807202 - DNA, 25 bp, Mus musculus
tgccagccagctttaccagagaatc

SEQ ID NO: 807203 - DNA, 25 bp, Mus musculus
tgccagccagctttgaccaaggcct

SEQ ID NO: 807204 - DNA, 25 bp, Mus musculus
tgccagccaggcacagccgagaaca

SEQ ID NO: 807205 - DNA, 25 bp, Mus musculus
tgccagccaggctcagccgagaaca

SEQ ID NO: 807206 - DNA, 25 bp, Mus musculus
tgccagccatgaaggccatccatgg

SEQ ID NO: 807207 - DNA, 25 bp, Mus musculus
tgccagccatgatggccatccatgg

SEQ ID NO: 807208 - DNA, 25 bp, Mus musculus
tgccagcccaacaccatctttggag

SEQ ID NO: 807209 - DNA, 25 bp, Mus musculus
tgccagcccaactccatctttggag

SEQ ID NO: 807210 - DNA, 25 bp, Mus musculus
tgccagccccggcttttaacggact

SEQ ID NO: 807211 - DNA, 25 bp, Mus musculus
tgccagccccgggttttaacggact

SEQ ID NO: 807212 - DNA, 25 bp, Mus musculus
tgccagcccgaacacagcacacact

SEQ ID NO: 807213 - DNA, 25 bp, Mus musculus
tgccagcccgaagacagcacacact

SEQ ID NO: 807214 - DNA, 25 bp, Mus musculus
tgccagcccggtatcgtgggcgacc

SEQ ID NO: 807215 - DNA, 25 bp, Mus musculus
tgccagcccggtttcgtgggcgacc

SEQ ID NO: 807216 - DNA, 25 bp, Mus musculus
tgccagcccgtccagcattcggatt

SEQ ID NO: 807217 - DNA, 25 bp, Mus musculus
tgccagcccgtcgagcattcggatt

SEQ ID NO: 807218 - DNA, 25 bp, Mus musculus
tgccagccctccaaattgtgaagac

SEQ ID NO: 807219 - DNA, 25 bp, Mus musculus
tgccagccctcctaattgtgaagac

SEQ ID NO: 807220 - DNA, 25 bp, Mus musculus
tgccagcctaagacaaccagcgtct

SEQ ID NO: 807221 - DNA, 25 bp, Mus musculus
tgccagcctaagtcaaccagcgtct

SEQ ID NO: 807222 - DNA, 25 bp, Mus musculus
tgccagcctagtcctccgagggcag

SEQ ID NO: 807223 - DNA, 25 bp, Mus musculus
tgccagcctagtgctccgagggcag

SEQ ID NO: 807224 - DNA, 25 bp, Mus musculus
tgccagcctcggaacagactcttca

SEQ ID NO: 807225 - DNA, 25 bp, Mus musculus
tgccagcctcggtacagactcttca

SEQ ID NO: 807226 - DNA, 25 bp, Mus musculus
tgccagcgagatatctctgtcaact

SEQ ID NO: 807227 - DNA, 25 bp, Mus musculus
tgccagcgagatttctctgtcaact

SEQ ID NO: 807228 - DNA, 25 bp, Mus musculus
tgccagcgcctgctggatcagtgtc

SEQ ID NO: 807229 - DNA, 25 bp, Mus musculus
tgccagcgcctggtggatcagtgtc

SEQ ID NO: 807230 - DNA, 25 bp, Mus musculus
tgccagcggaaaagaggtacaacag

SEQ ID NO: 807231 - DNA, 25 bp, Mus musculus
tgccagcggaaatgaggtacaacag

SEQ ID NO: 807232 - DNA, 25 bp, Mus musculus
tgccagcggtgcctgtcactgcagc

SEQ ID NO: 807233 - DNA, 25 bp, Mus musculus
tgccagcggtgcgtgtcactgcagc

SEQ ID NO: 807234 - DNA, 25 bp, Mus musculus
tgccagcgtcggctcaaacataagc

SEQ ID NO: 807235 - DNA, 25 bp, Mus musculus
tgccagcgtcgggtcaaacataagc

SEQ ID NO: 807236 - DNA, 25 bp, Mus musculus
tgccagctacgtccctgaaatcata

SEQ ID NO: 807237 - DNA, 25 bp, Mus musculus
tgccagctacgtgcctgaaatcata

SEQ ID NO: 807238 - DNA, 25 bp, Mus musculus
tgccagctcaataactcagaaggcc

SEQ ID NO: 807239 - DNA, 25 bp, Mus musculus
tgccagctcaattactcagaaggcc

SEQ ID NO: 807240 - DNA, 25 bp, Mus musculus
tgccagctgcaaaggagggtttgac

SEQ ID NO: 807241 - DNA, 25 bp, Mus musculus
tgccagctgcaatggagggtttgac

SEQ ID NO: 807242 - DNA, 25 bp, Mus musculus
tgccagctggaccagcaacttcggg

SEQ ID NO: 807243 - DNA, 25 bp, Mus musculus
tgccagctggacgagcaacttcggg

SEQ ID NO: 807244 - DNA, 25 bp, Mus musculus
tgccagctggcaaaggactcatcgt

SEQ ID NO: 807245 - DNA, 25 bp, Mus musculus
tgccagctggcataggactcatcgt

SEQ ID NO: 807246 - DNA, 25 bp, Mus musculus
tgccagctgttgaggaccctgtcca

SEQ ID NO: 807247 - DNA, 25 bp, Mus musculus
tgccagctgttgtggaccctgtcca

SEQ ID NO: 807248 - DNA, 25 bp, Mus musculus
tgccagcttcaaaagtttcctgaag

SEQ ID NO: 807249 - DNA, 25 bp, Mus musculus
tgccagcttcaatagtttcctgaag

SEQ ID NO: 807250 - DNA, 25 bp, Mus musculus
tgccagcttgcactcctcggggctg

SEQ ID NO: 807251 - DNA, 25 bp, Mus musculus
tgccagcttgcagtcctcggggctg

SEQ ID NO: 807252 - DNA, 25 bp, Mus musculus
tgccaggaacaaaaagacaccagtt

SEQ ID NO: 807253 - DNA, 25 bp, Mus musculus
tgccaggaacaataagacaccagtt

SEQ ID NO: 807254 - DNA, 25 bp, Mus musculus
tgccaggaatacacggcgcagaacg

SEQ ID NO: 807255 - DNA, 25 bp, Mus musculus
tgccaggaatactcggcgcagaacg

SEQ ID NO: 807256 - DNA, 25 bp, Mus musculus
tgccaggaccaaagtggaccggaca

SEQ ID NO: 807257 - DNA, 25 bp, Mus musculus
tgccaggaccaatgtggaccggaca

SEQ ID NO: 807258 - DNA, 25 bp, Mus musculus
tgccaggagaccatccgacggagga

SEQ ID NO: 807259 - DNA, 25 bp, Mus musculus
tgccaggagaccttccgacggagga

SEQ ID NO: 807260 - DNA, 25 bp, Mus musculus
tgccaggagatcagaaccccaggag

SEQ ID NO: 807261 - DNA, 25 bp, Mus musculus
tgccaggagatctgaaccccaggag

SEQ ID NO: 807262 - DNA, 25 bp, Mus musculus
tgccaggatcacaaagctgggctgg

SEQ ID NO: 807263 - DNA, 25 bp, Mus musculus
tgccaggatcactaagctgggctgg

SEQ ID NO: 807264 - DNA, 25 bp, Mus musculus
tgccaggatgcaacacgtccactca

SEQ ID NO: 807265 - DNA, 25 bp, Mus musculus
tgccaggatgcatcacgtccactca

SEQ ID NO: 807266 - DNA, 25 bp, Mus musculus
tgccaggatgccaagcagagacctc

SEQ ID NO: 807267 - DNA, 25 bp, Mus musculus
tgccaggatgcctagcagagacctc

SEQ ID NO: 807268 - DNA, 25 bp, Mus musculus
tgccaggcaaggctgaagacatctg

SEQ ID NO: 807269 - DNA, 25 bp, Mus musculus
tgccaggcaagggtgaagacatctg

SEQ ID NO: 807270 - DNA, 25 bp, Mus musculus
tgccaggccaagaatggtgcctttg

SEQ ID NO: 807271 - DNA, 25 bp, Mus musculus
tgccaggccaagacaccgttgatct

SEQ ID NO: 807272 - DNA, 25 bp, Mus musculus
tgccaggccaagacaggcatgggaa

SEQ ID NO: 807273 - DNA, 25 bp, Mus musculus
tgccaggccaagtatggtgcctttg

SEQ ID NO: 807274 - DNA, 25 bp, Mus musculus
tgccaggccaagtcaccgttgatct

SEQ ID NO: 807275 - DNA, 25 bp, Mus musculus
tgccaggccaagtcaggcatgggaa

SEQ ID NO: 807276 - DNA, 25 bp, Mus musculus
tgccaggccatcagagagcttgctc

SEQ ID NO: 807277 - DNA, 25 bp, Mus musculus
tgccaggccatctgagagcttgctc

SEQ ID NO: 807278 - DNA, 25 bp, Mus musculus
tgccaggccgcaagtatgcccctgg

SEQ ID NO: 807279 - DNA, 25 bp, Mus musculus
tgccaggccgcatgtatgcccctgg

SEQ ID NO: 807280 - DNA, 25 bp, Mus musculus
tgccaggcgcctctactgcttcttt

SEQ ID NO: 807281 - DNA, 25 bp, Mus musculus
tgccaggcgcctgtactgcttcttt

SEQ ID NO: 807282 - DNA, 25 bp, Mus musculus
tgccaggcgtgaaggtcctgttagt

SEQ ID NO: 807283 - DNA, 25 bp, Mus musculus
tgccaggcgtgatggtcctgttagt

SEQ ID NO: 807284 - DNA, 25 bp, Mus musculus
tgccaggctcatcggattcttccta

SEQ ID NO: 807285 - DNA, 25 bp, Mus musculus
tgccaggctcatgggattcttccta

SEQ ID NO: 807286 - DNA, 25 bp, Mus musculus
tgccaggctccgagttgcaaaggga

SEQ ID NO: 807287 - DNA, 25 bp, Mus musculus
tgccaggctccgtgttgcaaaggga

SEQ ID NO: 807288 - DNA, 25 bp, Mus musculus
tgccaggctgacatctagagtctgt

SEQ ID NO: 807289 - DNA, 25 bp, Mus musculus
tgccaggctgacttctagagtctgt

SEQ ID NO: 807290 - DNA, 25 bp, Mus musculus
tgccagggaaacacccggatctgaa

SEQ ID NO: 807291 - DNA, 25 bp, Mus musculus
tgccagggaaacaccggaagacttg

SEQ ID NO: 807292 - DNA, 25 bp, Mus musculus
tgccagggaaactcccggatctgaa

SEQ ID NO: 807293 - DNA, 25 bp, Mus musculus
tgccagggaaactccggaagacttg

SEQ ID NO: 807294 - DNA, 25 bp, Mus musculus
tgccagggaaagaaagacacaagcc

SEQ ID NO: 807295 - DNA, 25 bp, Mus musculus
tgccagggaaagaggacgctgctat

SEQ ID NO: 807296 - DNA, 25 bp, Mus musculus
tgccagggaaagtaagacacaagcc

SEQ ID NO: 807297 - DNA, 25 bp, Mus musculus
tgccagggaaagtggacgctgctat

SEQ ID NO: 807298 - DNA, 25 bp, Mus musculus
tgccagggagcaaagagattgtctg

SEQ ID NO: 807299 - DNA, 25 bp, Mus musculus
tgccagggagcatagagattgtctg

SEQ ID NO: 807300 - DNA, 25 bp, Mus musculus
tgccagggcaatcgggacttgcctc

SEQ ID NO: 807301 - DNA, 25 bp, Mus musculus
tgccagggcaatggggacttgcctc

SEQ ID NO: 807302 - DNA, 25 bp, Mus musculus
tgccagggccccagcacttcagtgg

SEQ ID NO: 807303 - DNA, 25 bp, Mus musculus
tgccagggcccctgcacttcagtgg

SEQ ID NO: 807304 - DNA, 25 bp, Mus musculus
tgccagggctgaccatactccagat

SEQ ID NO: 807305 - DNA, 25 bp, Mus musculus
tgccagggctgagcatactccagat

SEQ ID NO: 807306 - DNA, 25 bp, Mus musculus
tgccagggcttgaaagataatgaag

SEQ ID NO: 807307 - DNA, 25 bp, Mus musculus
tgccagggcttgtaagataatgaag

SEQ ID NO: 807308 - DNA, 25 bp, Mus musculus
tgccagggtagtacaggagccctgc

SEQ ID NO: 807309 - DNA, 25 bp, Mus musculus
tgccagggtagttcaggagccctgc

SEQ ID NO: 807310 - DNA, 25 bp, Mus musculus
tgccaggtatgtcactgtattactg

SEQ ID NO: 807311 - DNA, 25 bp, Mus musculus
tgccaggtatgtgactgtattactg

SEQ ID NO: 807312 - DNA, 25 bp, Mus musculus
tgccaggtcaataagagtgacgact

SEQ ID NO: 807313 - DNA, 25 bp, Mus musculus
tgccaggtcaattagagtgacgact

SEQ ID NO: 807314 - DNA, 25 bp, Mus musculus
tgccaggtcagcagatacagaaatg

SEQ ID NO: 807315 - DNA, 25 bp, Mus musculus
tgccaggtcagctgatacagaaatg

SEQ ID NO: 807316 - DNA, 25 bp, Mus musculus
tgccaggtcctacgagcaagctgct

SEQ ID NO: 807317 - DNA, 25 bp, Mus musculus
tgccaggtcctaggagcaagctgct

SEQ ID NO: 807318 - DNA, 25 bp, Mus musculus
tgccaggtctacagtactgagtctg

SEQ ID NO: 807319 - DNA, 25 bp, Mus musculus
tgccaggtctactgtactgagtctg

SEQ ID NO: 807320 - DNA, 25 bp, Mus musculus
tgccaggtttggacagaaagactct

SEQ ID NO: 807321 - DNA, 25 bp, Mus musculus
tgccaggtttggtcagaaagactct

SEQ ID NO: 807322 - DNA, 25 bp, Mus musculus
tgccagtaattcacagccatcagct

SEQ ID NO: 807323 - DNA, 25 bp, Mus musculus
tgccagtaattctcagccatcagct

SEQ ID NO: 807324 - DNA, 25 bp, Mus musculus
tgccagtacccacggcttcagtggg

SEQ ID NO: 807325 - DNA, 25 bp, Mus musculus
tgccagtacccagggcttcagtggg

SEQ ID NO: 807326 - DNA, 25 bp, Mus musculus
tgccagtacgttaacaacgtggacc

SEQ ID NO: 807327 - DNA, 25 bp, Mus musculus
tgccagtacgtttacaacgtggacc

SEQ ID NO: 807328 - DNA, 25 bp, Mus musculus
tgccagtagctaagaggagcccatc

SEQ ID NO: 807329 - DNA, 25 bp, Mus musculus
tgccagtagctatgaggagcccatc

SEQ ID NO: 807330 - DNA, 25 bp, Mus musculus
tgccagtcaactctagccctgctgt

SEQ ID NO: 807331 - DNA, 25 bp, Mus musculus
tgccagtcaactgtagccctgctgt

SEQ ID NO: 807332 - DNA, 25 bp, Mus musculus
tgccagtcaagacgcctgtcaagcc

SEQ ID NO: 807333 - DNA, 25 bp, Mus musculus
tgccagtcaagaggcctgtcaagcc

SEQ ID NO: 807334 - DNA, 25 bp, Mus musculus
tgccagtcccagctgaaagagcagt

SEQ ID NO: 807335 - DNA, 25 bp, Mus musculus
tgccagtcccaggtgaaagagcagt

SEQ ID NO: 807336 - DNA, 25 bp, Mus musculus
tgccagtcgtccagaggccctggct

SEQ ID NO: 807337 - DNA, 25 bp, Mus musculus
tgccagtcgtcctgaggccctggct

SEQ ID NO: 807338 - DNA, 25 bp, Mus musculus
tgccagtcttttaaatctagcaagc

SEQ ID NO: 807339 - DNA, 25 bp, Mus musculus
tgccagtctttttaatctagcaagc

SEQ ID NO: 807340 - DNA, 25 bp, Mus musculus
tgccagtgacacacagatttcctac

SEQ ID NO: 807341 - DNA, 25 bp, Mus musculus
tgccagtgacactcagatttcctac

SEQ ID NO: 807342 - DNA, 25 bp, Mus musculus
tgccagtgactgcaacgttcaagac

SEQ ID NO: 807343 - DNA, 25 bp, Mus musculus
tgccagtgactggaacgttcaagac

SEQ ID NO: 807344 - DNA, 25 bp, Mus musculus
tgccagtgatggatacccgctcatg

SEQ ID NO: 807345 - DNA, 25 bp, Mus musculus
tgccagtgatggttacccgctcatg

SEQ ID NO: 807346 - DNA, 25 bp, Mus musculus
tgccagtgcagaatgggattgatgc

SEQ ID NO: 807347 - DNA, 25 bp, Mus musculus
tgccagtgcagattgggattgatgc

SEQ ID NO: 807348 - DNA, 25 bp, Mus musculus
tgccagtgccgaacaggtctttact

SEQ ID NO: 807349 - DNA, 25 bp, Mus musculus
tgccagtgccgatcaggtctttact

SEQ ID NO: 807350 - DNA, 25 bp, Mus musculus
tgccagtgcctgcatggctactacg

SEQ ID NO: 807351 - DNA, 25 bp, Mus musculus
tgccagtgcctggatggctactacg

SEQ ID NO: 807352 - DNA, 25 bp, Mus musculus
tgccagtgctatcactacaagtgtg

SEQ ID NO: 807353 - DNA, 25 bp, Mus musculus
tgccagtgctatgactacaagtgtg

SEQ ID NO: 807354 - DNA, 25 bp, Mus musculus
tgccagtggattcatattacagatg

SEQ ID NO: 807355 - DNA, 25 bp, Mus musculus
tgccagtggattgatattacagatg

SEQ ID NO: 807356 - DNA, 25 bp, Mus musculus
tgccagtggcaaaggcttgttgctc

SEQ ID NO: 807357 - DNA, 25 bp, Mus musculus
tgccagtggcaatggcttgttgctc

SEQ ID NO: 807358 - DNA, 25 bp, Mus musculus
tgccagtggcatctacaaagagact

SEQ ID NO: 807359 - DNA, 25 bp, Mus musculus
tgccagtggcatgtacaaagagact

SEQ ID NO: 807360 - DNA, 25 bp, Mus musculus
tgccagtggtgaactttggctccct

SEQ ID NO: 807361 - DNA, 25 bp, Mus musculus
tgccagtggtgatctttggctccct

SEQ ID NO: 807362 - DNA, 25 bp, Mus musculus
tgccagtgtcgcagatggagctccc

SEQ ID NO: 807363 - DNA, 25 bp, Mus musculus
tgccagtgtcgctgatggagctccc

SEQ ID NO: 807364 - DNA, 25 bp, Mus musculus
tgccagtgtggaaattgcctcccgt

SEQ ID NO: 807365 - DNA, 25 bp, Mus musculus
tgccagtgtggatattgcctcccgt

SEQ ID NO: 807366 - DNA, 25 bp, Mus musculus
tgccagtgttgtcgtctccttcttc

SEQ ID NO: 807367 - DNA, 25 bp, Mus musculus
tgccagtgttgtggtctccttcttc

SEQ ID NO: 807368 - DNA, 25 bp, Mus musculus
tgccagttaggcatagaaaaacttc

SEQ ID NO: 807369 - DNA, 25 bp, Mus musculus
tgccagttaggcttagaaaaacttc

SEQ ID NO: 807370 - DNA, 25 bp, Mus musculus
tgccagttcatgcaggaccgcagcg

SEQ ID NO: 807371 - DNA, 25 bp, Mus musculus
tgccagttcatggaggaccgcagcg

SEQ ID NO: 807372 - DNA, 25 bp, Mus musculus
tgccagttcttcctttgcccatagg

SEQ ID NO: 807373 - DNA, 25 bp, Mus musculus
tgccagttcttcgtttgcccatagg

SEQ ID NO: 807374 - DNA, 25 bp, Mus musculus
tgccagtttccaccctgaacaattc

SEQ ID NO: 807375 - DNA, 25 bp, Mus musculus
tgccagtttccagcctgaacaattc

SEQ ID NO: 807376 - DNA, 25 bp, Mus musculus
tgccagtttggtaccagtattttct

SEQ ID NO: 807377 - DNA, 25 bp, Mus musculus
tgccagtttggttccagtattttct

SEQ ID NO: 807378 - DNA, 25 bp, Mus musculus
tgccataattagacacagccatgac

SEQ ID NO: 807379 - DNA, 25 bp, Mus musculus
tgccataattagtcacagccatgac

SEQ ID NO: 807380 - DNA, 25 bp, Mus musculus
tgccatacaaacatttccatggatg

SEQ ID NO: 807381 - DNA, 25 bp, Mus musculus
tgccatacaaacttttccatggatg

SEQ ID NO: 807382 - DNA, 25 bp, Mus musculus
tgccatacctgaaatgtccgctcca

SEQ ID NO: 807383 - DNA, 25 bp, Mus musculus
tgccatacctgatatgtccgctcca

SEQ ID NO: 807384 - DNA, 25 bp, Mus musculus
tgccatagatccatactcagccggg

SEQ ID NO: 807385 - DNA, 25 bp, Mus musculus
tgccatagatccttactcagccggg

SEQ ID NO: 807386 - DNA, 25 bp, Mus musculus
tgccatagccacactaaagctgcta

SEQ ID NO: 807387 - DNA, 25 bp, Mus musculus
tgccatagccactctaaagctgcta

SEQ ID NO: 807388 - DNA, 25 bp, Mus musculus
tgccatagctggaggaacaaactac

SEQ ID NO: 807389 - DNA, 25 bp, Mus musculus
tgccatagctggtggaacaaactac

SEQ ID NO: 807390 - DNA, 25 bp, Mus musculus
tgccatagtcaacaacacctttcag

SEQ ID NO: 807391 - DNA, 25 bp, Mus musculus
tgccatagtcaagaacacctttcag

SEQ ID NO: 807392 - DNA, 25 bp, Mus musculus
tgccatatccacagattaaaactgc

SEQ ID NO: 807393 - DNA, 25 bp, Mus musculus
tgccatatccactgattaaaactgc

SEQ ID NO: 807394 - DNA, 25 bp, Mus musculus
tgccatatctggcaacgggtatgag

SEQ ID NO: 807395 - DNA, 25 bp, Mus musculus
tgccatatctgggaacgggtatgag

SEQ ID NO: 807396 - DNA, 25 bp, Mus musculus
tgccatatgaacaatgggaccagtg

SEQ ID NO: 807397 - DNA, 25 bp, Mus musculus
tgccatatgaactatgggaccagtg

SEQ ID NO: 807398 - DNA, 25 bp, Mus musculus
tgccatattgatcactcaagtgctg

SEQ ID NO: 807399 - DNA, 25 bp, Mus musculus
tgccatattgatgactcaagtgctg

SEQ ID NO: 807400 - DNA, 25 bp, Mus musculus
tgccatcaatccagcaacttgggtg

SEQ ID NO: 807401 - DNA, 25 bp, Mus musculus
tgccatcaatcctgcaacttgggtg

SEQ ID NO: 807402 - DNA, 25 bp, Mus musculus
tgccatcaccagacacgaacgggac

SEQ ID NO: 807403 - DNA, 25 bp, Mus musculus
tgccatcaccagtcacgaacgggac

SEQ ID NO: 807404 - DNA, 25 bp, Mus musculus
tgccatcacccaaaaagctgcatca

SEQ ID NO: 807405 - DNA, 25 bp, Mus musculus
tgccatcacccataaagctgcatca

SEQ ID NO: 807406 - DNA, 25 bp, Mus musculus
tgccatcacctaagttctccagaaa

SEQ ID NO: 807407 - DNA, 25 bp, Mus musculus
tgccatcacctatgttctccagaaa

SEQ ID NO: 807408 - DNA, 25 bp, Mus musculus
tgccatcacctgacctggaatgttc

SEQ ID NO: 807409 - DNA, 25 bp, Mus musculus
tgccatcacctgtcctggaatgttc

SEQ ID NO: 807410 - DNA, 25 bp, Mus musculus
tgccatcactcaccaagaagtcagg

SEQ ID NO: 807411 - DNA, 25 bp, Mus musculus
tgccatcactcagcaagaagtcagg

SEQ ID NO: 807412 - DNA, 25 bp, Mus musculus
tgccatcagcaacaagtttggagat

SEQ ID NO: 807413 - DNA, 25 bp, Mus musculus
tgccatcagcaagaagtttggagat

SEQ ID NO: 807414 - DNA, 25 bp, Mus musculus
tgccatcagctaacaaatgcacttg

SEQ ID NO: 807415 - DNA, 25 bp, Mus musculus
tgccatcagctatcaaatgcacttg

SEQ ID NO: 807416 - DNA, 25 bp, Mus musculus
tgccatcaggctctgccagtgcaaa

SEQ ID NO: 807417 - DNA, 25 bp, Mus musculus
tgccatcaggctgtgccagtgcaaa

SEQ ID NO: 807418 - DNA, 25 bp, Mus musculus
tgccatcagggacaagtaccgctct

SEQ ID NO: 807419 - DNA, 25 bp, Mus musculus
tgccatcagggagaagtaccgctct

SEQ ID NO: 807420 - DNA, 25 bp, Mus musculus
tgccatcatgatagtgaggagggcc

SEQ ID NO: 807421 - DNA, 25 bp, Mus musculus
tgccatcatgattgtgaggagggcc

SEQ ID NO: 807422 - DNA, 25 bp, Mus musculus
tgccatcatgcacgagtggaagtcg

SEQ ID NO: 807423 - DNA, 25 bp, Mus musculus
tgccatcatgcaggagtggaagtcg

SEQ ID NO: 807424 - DNA, 25 bp, Mus musculus
tgccatccaaatactgtgacttgct

SEQ ID NO: 807425 - DNA, 25 bp, Mus musculus
tgccatccaaattctgtgacttgct

SEQ ID NO: 807426 - DNA, 25 bp, Mus musculus
tgccatccaggcaactaagaactac

SEQ ID NO: 807427 - DNA, 25 bp, Mus musculus
tgccatccaggctactaagaactac

SEQ ID NO: 807428 - DNA, 25 bp, Mus musculus
tgccatcccaaaagctggtgagaaa

SEQ ID NO: 807429 - DNA, 25 bp, Mus musculus
tgccatcccaaatgctggtgagaaa

SEQ ID NO: 807430 - DNA, 25 bp, Mus musculus
tgccatcccagcagcataggaggct

SEQ ID NO: 807431 - DNA, 25 bp, Mus musculus
tgccatcccagctgcataggaggct

SEQ ID NO: 807432 - DNA, 25 bp, Mus musculus
tgccatccctagataccacataaac

SEQ ID NO: 807433 - DNA, 25 bp, Mus musculus
tgccatccctagttaccacataaac

SEQ ID NO: 807434 - DNA, 25 bp, Mus musculus
tgccatccctgcagccttgcagaaa

SEQ ID NO: 807435 - DNA, 25 bp, Mus musculus
tgccatccctgctgccttgcagaaa

SEQ ID NO: 807436 - DNA, 25 bp, Mus musculus
tgccatccgccgagtgcgagctcag

SEQ ID NO: 807437 - DNA, 25 bp, Mus musculus
tgccatccgccgtgtgcgagctcag

SEQ ID NO: 807438 - DNA, 25 bp, Mus musculus
tgccatccgctcatatgcttacctg

SEQ ID NO: 807439 - DNA, 25 bp, Mus musculus
tgccatccgctcttatgcttacctg

SEQ ID NO: 807440 - DNA, 25 bp, Mus musculus
tgccatcctgacatacggagagttg

SEQ ID NO: 807441 - DNA, 25 bp, Mus musculus
tgccatcctgacttacggagagttg

SEQ ID NO: 807442 - DNA, 25 bp, Mus musculus
tgccatcgatgaacacgattacttg

SEQ ID NO: 807443 - DNA, 25 bp, Mus musculus
tgccatcgatgatcacgattacttg

SEQ ID NO: 807444 - DNA, 25 bp, Mus musculus
tgccatcgttccctgtctcctgaaa

SEQ ID NO: 807445 - DNA, 25 bp, Mus musculus
tgccatcgttccgtgtctcctgaaa

SEQ ID NO: 807446 - DNA, 25 bp, Mus musculus
tgccatctcactctgaatccatgca

SEQ ID NO: 807447 - DNA, 25 bp, Mus musculus
tgccatctcactgtgaatccatgca

SEQ ID NO: 807448 - DNA, 25 bp, Mus musculus
tgccatctcttgcaggccaagaaat

SEQ ID NO: 807449 - DNA, 25 bp, Mus musculus
tgccatctcttggaggccaagaaat

SEQ ID NO: 807450 - DNA, 25 bp, Mus musculus
tgccatctgcagcaaccacattatg

SEQ ID NO: 807451 - DNA, 25 bp, Mus musculus
tgccatctgcaggaaccacattatg

SEQ ID NO: 807452 - DNA, 25 bp, Mus musculus
tgccatcttcggaccttcacacagt

SEQ ID NO: 807453 - DNA, 25 bp, Mus musculus
tgccatcttcggtccttcacacagt

SEQ ID NO: 807454 - DNA, 25 bp, Mus musculus
tgccatcttgatcaccgtggctctg

SEQ ID NO: 807455 - DNA, 25 bp, Mus musculus
tgccatcttgatgaccgtggctctg

SEQ ID NO: 807456 - DNA, 25 bp, Mus musculus
tgccatcttggactgcagcacaggt

SEQ ID NO: 807457 - DNA, 25 bp, Mus musculus
tgccatcttggagtgcagcacaggt

SEQ ID NO: 807458 - DNA, 25 bp, Mus musculus
tgccatgaagagacaggtggacaag

SEQ ID NO: 807459 - DNA, 25 bp, Mus musculus
tgccatgaagagtcaggtggacaag

SEQ ID NO: 807460 - DNA, 25 bp, Mus musculus
tgccatgaagatacttccaagatga

SEQ ID NO: 807461 - DNA, 25 bp, Mus musculus
tgccatgaagattcttccaagatga

SEQ ID NO: 807462 - DNA, 25 bp, Mus musculus
tgccatgaaggccaataccatgtcc

SEQ ID NO: 807463 - DNA, 25 bp, Mus musculus
tgccatgaaggcgaataccatgtcc

SEQ ID NO: 807464 - DNA, 25 bp, Mus musculus
tgccatgagaaaccaaactgcgtcc

SEQ ID NO: 807465 - DNA, 25 bp, Mus musculus
tgccatgagaaagcaaactgcgtcc

SEQ ID NO: 807466 - DNA, 25 bp, Mus musculus
tgccatgcagggatctttctgagag

SEQ ID NO: 807467 - DNA, 25 bp, Mus musculus
tgccatgcagggttctttctgagag

SEQ ID NO: 807468 - DNA, 25 bp, Mus musculus
tgccatgcctctagaagaaggagac

SEQ ID NO: 807469 - DNA, 25 bp, Mus musculus
tgccatgcctcttgaagaaggagac

SEQ ID NO: 807470 - DNA, 25 bp, Mus musculus
tgccatgctcatccaatggtcctgg

SEQ ID NO: 807471 - DNA, 25 bp, Mus musculus
tgccatgctcatgcaatggtcctgg

SEQ ID NO: 807472 - DNA, 25 bp, Mus musculus
tgccatgctggtcgacattgaagac

SEQ ID NO: 807473 - DNA, 25 bp, Mus musculus
tgccatgctggtggacattgaagac

SEQ ID NO: 807474 - DNA, 25 bp, Mus musculus
tgccatggagaacaaatcaggagcc

SEQ ID NO: 807475 - DNA, 25 bp, Mus musculus
tgccatggagaagaaatcaggagcc

SEQ ID NO: 807476 - DNA, 25 bp, Mus musculus
tgccatggagagctcctgcaccaag

SEQ ID NO: 807477 - DNA, 25 bp, Mus musculus
tgccatggagaggtcctgcaccaag

SEQ ID NO: 807478 - DNA, 25 bp, Mus musculus
tgccatggagcacaaggtgatctgt

SEQ ID NO: 807479 - DNA, 25 bp, Mus musculus
tgccatggagcagaaggtgatctgt

SEQ ID NO: 807480 - DNA, 25 bp, Mus musculus
tgccatggagctcatgggcacatgt

SEQ ID NO: 807481 - DNA, 25 bp, Mus musculus
tgccatggagctgatgggcacatgt

SEQ ID NO: 807482 - DNA, 25 bp, Mus musculus
tgccatggcaatacaaaggatcaag

SEQ ID NO: 807483 - DNA, 25 bp, Mus musculus
tgccatggcaattcaaaggatcaag

SEQ ID NO: 807484 - DNA, 25 bp, Mus musculus
tgccatggccagcaagccagcgacg

SEQ ID NO: 807485 - DNA, 25 bp, Mus musculus
tgccatggccaggaagccagcgacg

SEQ ID NO: 807486 - DNA, 25 bp, Mus musculus
tgccatggccgtcagccatatcatg

SEQ ID NO: 807487 - DNA, 25 bp, Mus musculus
tgccatggccgtgagccatatcatg

SEQ ID NO: 807488 - DNA, 25 bp, Mus musculus
tgccatggcgacaggaagaccattc

SEQ ID NO: 807489 - DNA, 25 bp, Mus musculus
tgccatggcgactggaagaccattc

SEQ ID NO: 807490 - DNA, 25 bp, Mus musculus
tgccatggcgctcggtagctctctg

SEQ ID NO: 807491 - DNA, 25 bp, Mus musculus
tgccatggcgctgggtagctctctg

SEQ ID NO: 807492 - DNA, 25 bp, Mus musculus
tgccatggtaagctctcccgctctg

SEQ ID NO: 807493 - DNA, 25 bp, Mus musculus
tgccatggtaaggtctcccgctctg

SEQ ID NO: 807494 - DNA, 25 bp, Mus musculus
tgccatggtgcacagctatgtggaa

SEQ ID NO: 807495 - DNA, 25 bp, Mus musculus
tgccatggtgcagagctatgtggaa

SEQ ID NO: 807496 - DNA, 25 bp, Mus musculus
tgccatggttgtccctccccaggaa

SEQ ID NO: 807497 - DNA, 25 bp, Mus musculus
tgccatggttgtgcctccccaggaa

SEQ ID NO: 807498 - DNA, 25 bp, Mus musculus
tgccatgtaccgagaaccatccttg

SEQ ID NO: 807499 - DNA, 25 bp, Mus musculus
tgccatgtaccgtgaaccatccttg

SEQ ID NO: 807500 - DNA, 25 bp, Mus musculus
tgccatgtatggagagacaacaaag

SEQ ID NO: 807501 - DNA, 25 bp, Mus musculus
tgccatgtatggtgagacaacaaag

SEQ ID NO: 807502 - DNA, 25 bp, Mus musculus
tgccatgtcccacggtgtggactgc

SEQ ID NO: 807503 - DNA, 25 bp, Mus musculus
tgccatgtcccagggtgtggactgc

SEQ ID NO: 807504 - DNA, 25 bp, Mus musculus
tgccatgtgggcacagactcagtac

SEQ ID NO: 807505 - DNA, 25 bp, Mus musculus
tgccatgtgggctcagactcagtac

SEQ ID NO: 807506 - DNA, 25 bp, Mus musculus
tgccatgttactagactcacaccaa

SEQ ID NO: 807507 - DNA, 25 bp, Mus musculus
tgccatgttacttgactcacaccaa

SEQ ID NO: 807508 - DNA, 25 bp, Mus musculus
tgccatgttcctctccctggtgttc

SEQ ID NO: 807509 - DNA, 25 bp, Mus musculus
tgccatgttcctgtccctggtgttc

SEQ ID NO: 807510 - DNA, 25 bp, Mus musculus
tgccattactcaaggcagttgaatg

SEQ ID NO: 807511 - DNA, 25 bp, Mus musculus
tgccattactcatggcagttgaatg

SEQ ID NO: 807512 - DNA, 25 bp, Mus musculus
tgccattattcaacttcccaactgt

SEQ ID NO: 807513 - DNA, 25 bp, Mus musculus
tgccattattcatcttcccaactgt

SEQ ID NO: 807514 - DNA, 25 bp, Mus musculus
tgccattcacggaggctgcattggc

SEQ ID NO: 807515 - DNA, 25 bp, Mus musculus
tgccattcacggtggctgcattggc

SEQ ID NO: 807516 - DNA, 25 bp, Mus musculus
tgccattcagcacatgggtggccag

SEQ ID NO: 807517 - DNA, 25 bp, Mus musculus
tgccattcagcagatgggtggccag

SEQ ID NO: 807518 - DNA, 25 bp, Mus musculus
tgccattcccgaagtgccataactg

SEQ ID NO: 807519 - DNA, 25 bp, Mus musculus
tgccattcccgatgtgccataactg

SEQ ID NO: 807520 - DNA, 25 bp, Mus musculus
tgccattcgcctcttcctggaatac

SEQ ID NO: 807521 - DNA, 25 bp, Mus musculus
tgccattcgcctgttcctggaatac

SEQ ID NO: 807522 - DNA, 25 bp, Mus musculus
tgccattcggccagagaagcaggcc

SEQ ID NO: 807523 - DNA, 25 bp, Mus musculus
tgccattcggcctgagaagcaggcc

SEQ ID NO: 807524 - DNA, 25 bp, Mus musculus
tgccattgccaaattctcaaccttg

SEQ ID NO: 807525 - DNA, 25 bp, Mus musculus
tgccattgccaatttctcaaccttg

SEQ ID NO: 807526 - DNA, 25 bp, Mus musculus
tgccattgcccgctggcacagcagt

SEQ ID NO: 807527 - DNA, 25 bp, Mus musculus
tgccattgcccggtggcacagcagt

SEQ ID NO: 807528 - DNA, 25 bp, Mus musculus
tgccattggctcacaggtgtctgaa

SEQ ID NO: 807529 - DNA, 25 bp, Mus musculus
tgccattggctcactgatggacgac

SEQ ID NO: 807530 - DNA, 25 bp, Mus musculus
tgccattggctctcaggtgtctgaa

SEQ ID NO: 807531 - DNA, 25 bp, Mus musculus
tgccattggctctctgatggacgac

SEQ ID NO: 807532 - DNA, 25 bp, Mus musculus
tgccattgttaacccctcagaactc

SEQ ID NO: 807533 - DNA, 25 bp, Mus musculus
tgccattgttaagccctcagaactc

SEQ ID NO: 807534 - DNA, 25 bp, Mus musculus
tgcccaaaaaagaagacgccttact

SEQ ID NO: 807535 - DNA, 25 bp, Mus musculus
tgcccaaaaaagtagacgccttact

SEQ ID NO: 807536 - DNA, 25 bp, Mus musculus
tgcccaaactaactccatggtgacc

SEQ ID NO: 807537 - DNA, 25 bp, Mus musculus
tgcccaaactaagtccatggtgacc

SEQ ID NO: 807538 - DNA, 25 bp, Mus musculus
tgcccaaactggagtgcgtcttctt

SEQ ID NO: 807539 - DNA, 25 bp, Mus musculus
tgcccaaactggtgtgcgtcttctt

SEQ ID NO: 807540 - DNA, 25 bp, Mus musculus
tgcccaaagcagaacaagcggtcag

SEQ ID NO: 807541 - DNA, 25 bp, Mus musculus
tgcccaaagcagtacaagcggtcag

SEQ ID NO: 807542 - DNA, 25 bp, Mus musculus
tgcccaaaggagctccagaaaggga

SEQ ID NO: 807543 - DNA, 25 bp, Mus musculus
tgcccaaaggaggtccagaaaggga

SEQ ID NO: 807544 - DNA, 25 bp, Mus musculus
tgcccaacgattctcttctgactgc

SEQ ID NO: 807545 - DNA, 25 bp, Mus musculus
tgcccaacgattgtcttctgactgc

SEQ ID NO: 807546 - DNA, 25 bp, Mus musculus
tgcccaagcgccagtgtaatcgcca

SEQ ID NO: 807547 - DNA, 25 bp, Mus musculus
tgcccaagcgcctgtgtaatcgcca

SEQ ID NO: 807548 - DNA, 25 bp, Mus musculus
tgcccaagctctcttgataggatgc

SEQ ID NO: 807549 - DNA, 25 bp, Mus musculus
tgcccaagctctgttgataggatgc

SEQ ID NO: 807550 - DNA, 25 bp, Mus musculus
tgcccaaggagaattcaattacctg

SEQ ID NO: 807551 - DNA, 25 bp, Mus musculus
tgcccaaggagatttcaattacctg

SEQ ID NO: 807552 - DNA, 25 bp, Mus musculus
tgcccaagggctcgatgactgccat

SEQ ID NO: 807553 - DNA, 25 bp, Mus musculus
tgcccaagggctggatgactgccat

SEQ ID NO: 807554 - DNA, 25 bp, Mus musculus
tgcccaagtcatacaagaggaaaat

SEQ ID NO: 807555 - DNA, 25 bp, Mus musculus
tgcccaagtcattcaagaggaaaat

SEQ ID NO: 807556 - DNA, 25 bp, Mus musculus
tgcccaagttgaaaaacataaggaa

SEQ ID NO: 807557 - DNA, 25 bp, Mus musculus
tgcccaagttgataaacataaggaa

SEQ ID NO: 807558 - DNA, 25 bp, Mus musculus
tgcccaagttgcatcggctgccttc

SEQ ID NO: 807559 - DNA, 25 bp, Mus musculus
tgcccaagttgcttcggctgccttc

SEQ ID NO: 807560 - DNA, 25 bp, Mus musculus
tgcccaatatagagtgaggtagagt

SEQ ID NO: 807561 - DNA, 25 bp, Mus musculus
tgcccaatatagtgtgaggtagagt

SEQ ID NO: 807562 - DNA, 25 bp, Mus musculus
tgcccaatctctatggcaacataat

SEQ ID NO: 807563 - DNA, 25 bp, Mus musculus
tgcccaatctctttggcaacataat

SEQ ID NO: 807564 - DNA, 25 bp, Mus musculus
tgcccaatgggaacgagccttccaa

SEQ ID NO: 807565 - DNA, 25 bp, Mus musculus
tgcccaatgggatcgagccttccaa

SEQ ID NO: 807566 - DNA, 25 bp, Mus musculus
tgcccaattccacaatcatgatcca

SEQ ID NO: 807567 - DNA, 25 bp, Mus musculus
tgcccaattccagaatcatgatcca

SEQ ID NO: 807568 - DNA, 25 bp, Mus musculus
tgcccaatttttaactgcttacaag

SEQ ID NO: 807569 - DNA, 25 bp, Mus musculus
tgcccaattttttactgcttacaag

SEQ ID NO: 807570 - DNA, 25 bp, Mus musculus
tgcccacaatgaccttgttgacaag

SEQ ID NO: 807571 - DNA, 25 bp, Mus musculus
tgcccacaatgagcttgttgacaag

SEQ ID NO: 807572 - DNA, 25 bp, Mus musculus
tgcccacacgctaactgagaaccgt

SEQ ID NO: 807573 - DNA, 25 bp, Mus musculus
tgcccacacgcttactgagaaccgt

SEQ ID NO: 807574 - DNA, 25 bp, Mus musculus
tgcccacactttaactgtgctgttc

SEQ ID NO: 807575 - DNA, 25 bp, Mus musculus
tgcccacacttttactgtgctgttc

SEQ ID NO: 807576 - DNA, 25 bp, Mus musculus
tgcccacagagcaaggaatgcaagt

SEQ ID NO: 807577 - DNA, 25 bp, Mus musculus
tgcccacagagctaggaatgcaagt

SEQ ID NO: 807578 - DNA, 25 bp, Mus musculus
tgcccacagggaccagtttcatctg

SEQ ID NO: 807579 - DNA, 25 bp, Mus musculus
tgcccacagggagcagtttcatctg

SEQ ID NO: 807580 - DNA, 25 bp, Mus musculus
tgcccacatcttctggaggcagaat

SEQ ID NO: 807581 - DNA, 25 bp, Mus musculus
tgcccacatcttgtggaggcagaat

SEQ ID NO: 807582 - DNA, 25 bp, Mus musculus
tgcccaccagaacgtgtctaaagag

SEQ ID NO: 807583 - DNA, 25 bp, Mus musculus
tgcccaccagaaggtgtctaaagag

SEQ ID NO: 807584 - DNA, 25 bp, Mus musculus
tgcccaccccacacttaagtatagg

SEQ ID NO: 807585 - DNA, 25 bp, Mus musculus
tgcccaccccactcttaagtatagg

SEQ ID NO: 807586 - DNA, 25 bp, Mus musculus
tgcccaccctgtatcagagtctgtc

SEQ ID NO: 807587 - DNA, 25 bp, Mus musculus
tgcccaccctgtttcagagtctgtc

SEQ ID NO: 807588 - DNA, 25 bp, Mus musculus
tgcccaccgtgtagcagaagtaagc

SEQ ID NO: 807589 - DNA, 25 bp, Mus musculus
tgcccaccgtgttgcagaagtaagc

SEQ ID NO: 807590 - DNA, 25 bp, Mus musculus
tgcccaccgttacagtggccgggaa

SEQ ID NO: 807591 - DNA, 25 bp, Mus musculus
tgcccaccgttagagtggccgggaa

SEQ ID NO: 807592 - DNA, 25 bp, Mus musculus
tgcccacctccaccagaaggaaaag

SEQ ID NO: 807593 - DNA, 25 bp, Mus musculus
tgcccacctccagcagaaggaaaag

SEQ ID NO: 807594 - DNA, 25 bp, Mus musculus
tgcccaccttatagtgctgaggaaa

SEQ ID NO: 807595 - DNA, 25 bp, Mus musculus
tgcccaccttattgtgctgaggaaa

SEQ ID NO: 807596 - DNA, 25 bp, Mus musculus
tgcccacgagcaagtcctggaagct

SEQ ID NO: 807597 - DNA, 25 bp, Mus musculus
tgcccacgagcatgtcctggaagct

SEQ ID NO: 807598 - DNA, 25 bp, Mus musculus
tgcccacgctggcaaaggattggac

SEQ ID NO: 807599 - DNA, 25 bp, Mus musculus
tgcccacgctgggaaaggattggac

SEQ ID NO: 807600 - DNA, 25 bp, Mus musculus
tgcccacggtctacctgaagctagg

SEQ ID NO: 807601 - DNA, 25 bp, Mus musculus
tgcccacggtcttcctgaagctagg

SEQ ID NO: 807602 - DNA, 25 bp, Mus musculus
tgcccactctgaagctggcagcgaa

SEQ ID NO: 807603 - DNA, 25 bp, Mus musculus
tgcccactctgatgctggcagcgaa

SEQ ID NO: 807604 - DNA, 25 bp, Mus musculus
tgcccactgaatagtaatcacacag

SEQ ID NO: 807605 - DNA, 25 bp, Mus musculus
tgcccactgaattgtaatcacacag

SEQ ID NO: 807606 - DNA, 25 bp, Mus musculus
tgcccactgcatcggccttggtaag

SEQ ID NO: 807607 - DNA, 25 bp, Mus musculus
tgcccactgcatgggccttggtaag

SEQ ID NO: 807608 - DNA, 25 bp, Mus musculus
tgcccactgctgatagggtgaccct

SEQ ID NO: 807609 - DNA, 25 bp, Mus musculus
tgcccactgctgttagggtgaccct

SEQ ID NO: 807610 - DNA, 25 bp, Mus musculus
tgcccactggccaggtggcagaaaa

SEQ ID NO: 807611 - DNA, 25 bp, Mus musculus
tgcccactggcctggtggcagaaaa

SEQ ID NO: 807612 - DNA, 25 bp, Mus musculus
tgcccactgtggagaagtggtacca

SEQ ID NO: 807613 - DNA, 25 bp, Mus musculus
tgcccactgtggtgaagtggtacca

SEQ ID NO: 807614 - DNA, 25 bp, Mus musculus
tgcccacttctcataactcagggtg

SEQ ID NO: 807615 - DNA, 25 bp, Mus musculus
tgcccacttctcttaactcagggtg

SEQ ID NO: 807616 - DNA, 25 bp, Mus musculus
tgcccagaaactcccagatgctgct

SEQ ID NO: 807617 - DNA, 25 bp, Mus musculus
tgcccagaaactgccagatgctgct

SEQ ID NO: 807618 - DNA, 25 bp, Mus musculus
tgcccagacactattgagctcggac

SEQ ID NO: 807619 - DNA, 25 bp, Mus musculus
tgcccagacacttttgagctcggac

SEQ ID NO: 807620 - DNA, 25 bp, Mus musculus
tgcccagagcccaatgtggatcgac

SEQ ID NO: 807621 - DNA, 25 bp, Mus musculus
tgcccagagccctatgtggatcgac

SEQ ID NO: 807622 - DNA, 25 bp, Mus musculus
tgcccagaggagcttatacagggat

SEQ ID NO: 807623 - DNA, 25 bp, Mus musculus
tgcccagaggaggttatacagggat

SEQ ID NO: 807624 - DNA, 25 bp, Mus musculus
tgcccagagtgcaggcaatgatcca

SEQ ID NO: 807625 - DNA, 25 bp, Mus musculus
tgcccagagtgctggcaatgatcca

SEQ ID NO: 807626 - DNA, 25 bp, Mus musculus
tgcccagatcgaaggcgcagagtgc

SEQ ID NO: 807627 - DNA, 25 bp, Mus musculus
tgcccagatcgatggcgcagagtgc

SEQ ID NO: 807628 - DNA, 25 bp, Mus musculus
tgcccagatgctccgtgacatttgc

SEQ ID NO: 807629 - DNA, 25 bp, Mus musculus
tgcccagatgctgcgtgacatttgc

SEQ ID NO: 807630 - DNA, 25 bp, Mus musculus
tgcccagcaaatcatgcgcctttgc

SEQ ID NO: 807631 - DNA, 25 bp, Mus musculus
tgcccagcaaatgatgcgcctttgc

SEQ ID NO: 807632 - DNA, 25 bp, Mus musculus
tgcccagccaaccagctctgtgaag

SEQ ID NO: 807633 - DNA, 25 bp, Mus musculus
tgcccagccaacgagctctgtgaag

SEQ ID NO: 807634 - DNA, 25 bp, Mus musculus
tgcccagcccaaagaggtgtatcag

SEQ ID NO: 807635 - DNA, 25 bp, Mus musculus
tgcccagcccaatgaggtgtatcag

SEQ ID NO: 807636 - DNA, 25 bp, Mus musculus
tgcccagcctgtatgacgacattgt

SEQ ID NO: 807637 - DNA, 25 bp, Mus musculus
tgcccagcctgtttgacgacattgt

SEQ ID NO: 807638 - DNA, 25 bp, Mus musculus
tgcccagcggctatgggctcaccta

SEQ ID NO: 807639 - DNA, 25 bp, Mus musculus
tgcccagcggctttgggctcaccta

SEQ ID NO: 807640 - DNA, 25 bp, Mus musculus
tgcccagcggtactgtcagtgcaat

SEQ ID NO: 807641 - DNA, 25 bp, Mus musculus
tgcccagcggtagtgtcagtgcaat

SEQ ID NO: 807642 - DNA, 25 bp, Mus musculus
tgcccagctaccactgaaacttgag

SEQ ID NO: 807643 - DNA, 25 bp, Mus musculus
tgcccagctacctctgaaacttgag

SEQ ID NO: 807644 - DNA, 25 bp, Mus musculus
tgcccagctacgcaagaagcccacc

SEQ ID NO: 807645 - DNA, 25 bp, Mus musculus
tgcccagctacggaagaagcccacc

SEQ ID NO: 807646 - DNA, 25 bp, Mus musculus
tgcccaggaagtccaaagatcccct

SEQ ID NO: 807647 - DNA, 25 bp, Mus musculus
tgcccaggaagtgcaaagatcccct

SEQ ID NO: 807648 - DNA, 25 bp, Mus musculus
tgcccaggaatcagccaagagtgcc

SEQ ID NO: 807649 - DNA, 25 bp, Mus musculus
tgcccaggaatctgccaagagtgcc

SEQ ID NO: 807650 - DNA, 25 bp, Mus musculus
tgcccaggagagagttctcacatct

SEQ ID NO: 807651 - DNA, 25 bp, Mus musculus
tgcccaggagagtgttctcacatct

SEQ ID NO: 807652 - DNA, 25 bp, Mus musculus
tgcccaggagttctcacctgacgtc

SEQ ID NO: 807653 - DNA, 25 bp, Mus musculus
tgcccaggagttgtcacctgacgtc

SEQ ID NO: 807654 - DNA, 25 bp, Mus musculus
tgcccaggcgcaatgctcatgtgaa

SEQ ID NO: 807655 - DNA, 25 bp, Mus musculus
tgcccaggcgcattgctcatgtgaa

SEQ ID NO: 807656 - DNA, 25 bp, Mus musculus
tgcccaggctatagctgacctcaga

SEQ ID NO: 807657 - DNA, 25 bp, Mus musculus
tgcccaggctatcagacaggacagt

SEQ ID NO: 807658 - DNA, 25 bp, Mus musculus
tgcccaggctatgagacaggacagt

SEQ ID NO: 807659 - DNA, 25 bp, Mus musculus
tgcccaggctattgctgacctcaga

SEQ ID NO: 807660 - DNA, 25 bp, Mus musculus
tgcccagggactagatacatttttc

SEQ ID NO: 807661 - DNA, 25 bp, Mus musculus
tgcccagggacttgatacatttttc

SEQ ID NO: 807662 - DNA, 25 bp, Mus musculus
tgcccagggattctggttgtaagcc

SEQ ID NO: 807663 - DNA, 25 bp, Mus musculus
tgcccagggattgtggttgtaagcc

SEQ ID NO: 807664 - DNA, 25 bp, Mus musculus
tgcccagggcccaatgggatggcca

SEQ ID NO: 807665 - DNA, 25 bp, Mus musculus
tgcccagggccctatgggatggcca

SEQ ID NO: 807666 - DNA, 25 bp, Mus musculus
tgcccagggtgactgtaacatttac

SEQ ID NO: 807667 - DNA, 25 bp, Mus musculus
tgcccagggtgagtgtaacatttac

SEQ ID NO: 807668 - DNA, 25 bp, Mus musculus
tgcccaggtactattgtctgtgtgc

SEQ ID NO: 807669 - DNA, 25 bp, Mus musculus
tgcccaggtacttttgtctgtgtgc

SEQ ID NO: 807670 - DNA, 25 bp, Mus musculus
tgcccaggtatgaacacgcactctc

SEQ ID NO: 807671 - DNA, 25 bp, Mus musculus
tgcccaggtatgtacacgcactctc

SEQ ID NO: 807672 - DNA, 25 bp, Mus musculus
tgcccaggtggcactaactttgctg

SEQ ID NO: 807673 - DNA, 25 bp, Mus musculus
tgcccaggtggctctaactttgctg

SEQ ID NO: 807674 - DNA, 25 bp, Mus musculus
tgcccaggttatagcttcctacgct

SEQ ID NO: 807675 - DNA, 25 bp, Mus musculus
tgcccaggttattgcttcctacgct

SEQ ID NO: 807676 - DNA, 25 bp, Mus musculus
tgcccagtagttcatgtgttcagcc

SEQ ID NO: 807677 - DNA, 25 bp, Mus musculus
tgcccagtagttgatgtgttcagcc

SEQ ID NO: 807678 - DNA, 25 bp, Mus musculus
tgcccagtatgtagaagatcctatc

SEQ ID NO: 807679 - DNA, 25 bp, Mus musculus
tgcccagtatgttgaagatcctatc

SEQ ID NO: 807680 - DNA, 25 bp, Mus musculus
tgcccagtctcactctggtacgggt

SEQ ID NO: 807681 - DNA, 25 bp, Mus musculus
tgcccagtctcagtctggtacgggt

SEQ ID NO: 807682 - DNA, 25 bp, Mus musculus
tgcccagtgctcaagggtcatgtgg

SEQ ID NO: 807683 - DNA, 25 bp, Mus musculus
tgcccagtgctctagggtcatgtgg

SEQ ID NO: 807684 - DNA, 25 bp, Mus musculus
tgcccagtggacacgttgctcacat

SEQ ID NO: 807685 - DNA, 25 bp, Mus musculus
tgcccagtggactcgttgctcacat

SEQ ID NO: 807686 - DNA, 25 bp, Mus musculus
tgcccagtggagcttccacgggtat

SEQ ID NO: 807687 - DNA, 25 bp, Mus musculus
tgcccagtggaggttccacgggtat

SEQ ID NO: 807688 - DNA, 25 bp, Mus musculus
tgcccagtggctactcggtcttcac

SEQ ID NO: 807689 - DNA, 25 bp, Mus musculus
tgcccagtggcttctcggtcttcac

SEQ ID NO: 807690 - DNA, 25 bp, Mus musculus
tgcccagtgtaactacctgcatagg

SEQ ID NO: 807691 - DNA, 25 bp, Mus musculus
tgcccagtgtaagtacctgcatagg

SEQ ID NO: 807692 - DNA, 25 bp, Mus musculus
tgcccagttacgcaaaaaatattgt

SEQ ID NO: 807693 - DNA, 25 bp, Mus musculus
tgcccagttacggaaaaaatattgt

SEQ ID NO: 807694 - DNA, 25 bp, Mus musculus
tgcccatacggaatgaaaacccaaa

SEQ ID NO: 807695 - DNA, 25 bp, Mus musculus
tgcccatacggattgaaaacccaaa

SEQ ID NO: 807696 - DNA, 25 bp, Mus musculus
tgcccatagagaattgaaatcaaag

SEQ ID NO: 807697 - DNA, 25 bp, Mus musculus
tgcccatagagatttgaaatcaaag

SEQ ID NO: 807698 - DNA, 25 bp, Mus musculus
tgcccatagcggagggagcagctct

SEQ ID NO: 807699 - DNA, 25 bp, Mus musculus
tgcccatagcggtgggagcagctct

SEQ ID NO: 807700 - DNA, 25 bp, Mus musculus
tgcccatagtcgaacaaagagccag

SEQ ID NO: 807701 - DNA, 25 bp, Mus musculus
tgcccatagtcgtacaaagagccag

SEQ ID NO: 807702 - DNA, 25 bp, Mus musculus
tgcccatatattcgccggagaaagt

SEQ ID NO: 807703 - DNA, 25 bp, Mus musculus
tgcccatatattggccggagaaagt

SEQ ID NO: 807704 - DNA, 25 bp, Mus musculus
tgcccatcaagtcgtagtagccaag

SEQ ID NO: 807705 - DNA, 25 bp, Mus musculus
tgcccatcaagtggtagtagccaag

SEQ ID NO: 807706 - DNA, 25 bp, Mus musculus
tgcccatctataatcacataggcta

SEQ ID NO: 807707 - DNA, 25 bp, Mus musculus
tgcccatctatattcacataggcta

SEQ ID NO: 807708 - DNA, 25 bp, Mus musculus
tgcccatctttgagaccagcgtgcc

SEQ ID NO: 807709 - DNA, 25 bp, Mus musculus
tgcccatctttgtgaccagcgtgcc

SEQ ID NO: 807710 - DNA, 25 bp, Mus musculus
tgcccatgaacgaccagttctacaa

SEQ ID NO: 807711 - DNA, 25 bp, Mus musculus
tgcccatgaacgtccagttctacaa

SEQ ID NO: 807712 - DNA, 25 bp, Mus musculus
tgcccatgagagctactactagatc

SEQ ID NO: 807713 - DNA, 25 bp, Mus musculus
tgcccatgagaggtactactagatc

SEQ ID NO: 807714 - DNA, 25 bp, Mus musculus
tgcccatgcgccaatgatgctaatg

SEQ ID NO: 807715 - DNA, 25 bp, Mus musculus
tgcccatgcgcctatgatgctaatg

SEQ ID NO: 807716 - DNA, 25 bp, Mus musculus
tgcccatggacaccagtgcatattc

SEQ ID NO: 807717 - DNA, 25 bp, Mus musculus
tgcccatggacagcagtgcatattc

SEQ ID NO: 807718 - DNA, 25 bp, Mus musculus
tgcccatggagtatggaactacacc

SEQ ID NO: 807719 - DNA, 25 bp, Mus musculus
tgcccatggagtttggaactacacc

SEQ ID NO: 807720 - DNA, 25 bp, Mus musculus
tgcccatggctcactgtgccaactc

SEQ ID NO: 807721 - DNA, 25 bp, Mus musculus
tgcccatggctctctgtgccaactc

SEQ ID NO: 807722 - DNA, 25 bp, Mus musculus
tgcccatgggctccagagcttcaaa

SEQ ID NO: 807723 - DNA, 25 bp, Mus musculus
tgcccatgggctgcagagcttcaaa

SEQ ID NO: 807724 - DNA, 25 bp, Mus musculus
tgcccatggtagagatcgacgggat

SEQ ID NO: 807725 - DNA, 25 bp, Mus musculus
tgcccatggtagtgatcgacgggat

SEQ ID NO: 807726 - DNA, 25 bp, Mus musculus
tgcccattgtagagcggccagtgtg

SEQ ID NO: 807727 - DNA, 25 bp, Mus musculus
tgcccattgtagtgcggccagtgtg

SEQ ID NO: 807728 - DNA, 25 bp, Mus musculus
tgcccatttcgacgacgacgagttg

SEQ ID NO: 807729 - DNA, 25 bp, Mus musculus
tgcccatttcgaggacgacgagttg

SEQ ID NO: 807730 - DNA, 25 bp, Mus musculus
tgcccatttggaagctaccactgtg

SEQ ID NO: 807731 - DNA, 25 bp, Mus musculus
tgcccatttggatgctaccactgtg

SEQ ID NO: 807732 - DNA, 25 bp, Mus musculus
tgccccaaacccactattggcttgg

SEQ ID NO: 807733 - DNA, 25 bp, Mus musculus
tgccccaaaccctctattggcttgg

SEQ ID NO: 807734 - DNA, 25 bp, Mus musculus
tgccccaaactcaggacaccaattg

SEQ ID NO: 807735 - DNA, 25 bp, Mus musculus
tgccccaaactctggacaccaattg

SEQ ID NO: 807736 - DNA, 25 bp, Mus musculus
tgccccaaaggacgttgctgagatc

SEQ ID NO: 807737 - DNA, 25 bp, Mus musculus
tgccccaaaggaggttgctgagatc

SEQ ID NO: 807738 - DNA, 25 bp, Mus musculus
tgccccaagaacctaaggctttgaa

SEQ ID NO: 807739 - DNA, 25 bp, Mus musculus
tgccccaagaacgtaaggctttgaa

SEQ ID NO: 807740 - DNA, 25 bp, Mus musculus
tgccccaaggcaatgaagaggttgg

SEQ ID NO: 807741 - DNA, 25 bp, Mus musculus
tgccccaaggcattgaagaggttgg

SEQ ID NO: 807742 - DNA, 25 bp, Mus musculus
tgccccaatggcaaaggctctttct

SEQ ID NO: 807743 - DNA, 25 bp, Mus musculus
tgccccaatggctaaggctctttct

SEQ ID NO: 807744 - DNA, 25 bp, Mus musculus
tgccccaccagcactcagtggagga

SEQ ID NO: 807745 - DNA, 25 bp, Mus musculus
tgccccaccagctctcagtggagga

SEQ ID NO: 807746 - DNA, 25 bp, Mus musculus
tgccccaccccaatagcttgaagtt

SEQ ID NO: 807747 - DNA, 25 bp, Mus musculus
tgccccaccccattagcttgaagtt

SEQ ID NO: 807748 - DNA, 25 bp, Mus musculus
tgccccagaacgactactgtgtgca

SEQ ID NO: 807749 - DNA, 25 bp, Mus musculus
tgccccagaacgtctactgtgtgca

SEQ ID NO: 807750 - DNA, 25 bp, Mus musculus
tgccccagaagcattgctgaactgc

SEQ ID NO: 807751 - DNA, 25 bp, Mus musculus
tgccccagaagctttgctgaactgc

SEQ ID NO: 807752 - DNA, 25 bp, Mus musculus
tgccccagagctccgctttaattgg

SEQ ID NO: 807753 - DNA, 25 bp, Mus musculus
tgccccagagctgcgctttaattgg

SEQ ID NO: 807754 - DNA, 25 bp, Mus musculus
tgccccagagtgatatagctgggcc

SEQ ID NO: 807755 - DNA, 25 bp, Mus musculus
tgccccagagtgttatagctgggcc

SEQ ID NO: 807756 - DNA, 25 bp, Mus musculus
tgccccaggagacaactgtcaagct

SEQ ID NO: 807757 - DNA, 25 bp, Mus musculus
tgccccaggagagaactgtcaagct

SEQ ID NO: 807758 - DNA, 25 bp, Mus musculus
tgccccaggtacagagggaaaatcg

SEQ ID NO: 807759 - DNA, 25 bp, Mus musculus
tgccccaggtactgagggaaaatcg

SEQ ID NO: 807760 - DNA, 25 bp, Mus musculus
tgccccagtccaagaagattatgca

SEQ ID NO: 807761 - DNA, 25 bp, Mus musculus
tgccccagtccatgaagattatgca

SEQ ID NO: 807762 - DNA, 25 bp, Mus musculus
tgccccagtggcctaagaatggacc

SEQ ID NO: 807763 - DNA, 25 bp, Mus musculus
tgccccagtggcgtaagaatggacc

SEQ ID NO: 807764 - DNA, 25 bp, Mus musculus
tgccccataagtctctaagattcag

SEQ ID NO: 807765 - DNA, 25 bp, Mus musculus
tgccccataagtgtctaagattcag

SEQ ID NO: 807766 - DNA, 25 bp, Mus musculus
tgccccatgagaatggttaacttcc

SEQ ID NO: 807767 - DNA, 25 bp, Mus musculus
tgccccatgagattggttaacttcc

SEQ ID NO: 807768 - DNA, 25 bp, Mus musculus
tgccccattgtccaattcttcagaa

SEQ ID NO: 807769 - DNA, 25 bp, Mus musculus
tgccccattgtcgaattcttcagaa

SEQ ID NO: 807770 - DNA, 25 bp, Mus musculus
tgcccccaggttaggagacaggcag

SEQ ID NO: 807771 - DNA, 25 bp, Mus musculus
tgcccccaggtttggagacaggcag

SEQ ID NO: 807772 - DNA, 25 bp, Mus musculus
tgccccgacaagcacctaaggagtg

SEQ ID NO: 807773 - DNA, 25 bp, Mus musculus
tgccccgacaaggacctaaggagtg

SEQ ID NO: 807774 - DNA, 25 bp, Mus musculus
tgccccgagactctttcatagtgag

SEQ ID NO: 807775 - DNA, 25 bp, Mus musculus
tgccccgagactgtttcatagtgag

SEQ ID NO: 807776 - DNA, 25 bp, Mus musculus
tgccccgagtccaggtgcacacaga

SEQ ID NO: 807777 - DNA, 25 bp, Mus musculus
tgccccgagtcctggtgcacacaga

SEQ ID NO: 807778 - DNA, 25 bp, Mus musculus
tgccccgccggccagtgagcttgct

SEQ ID NO: 807779 - DNA, 25 bp, Mus musculus
tgccccgccggcgagtgagcttgct

SEQ ID NO: 807780 - DNA, 25 bp, Mus musculus
tgccccggaatgagccagacacaaa

SEQ ID NO: 807781 - DNA, 25 bp, Mus musculus
tgccccggaatgtgccagacacaaa

SEQ ID NO: 807782 - DNA, 25 bp, Mus musculus
tgccccggcaggagggcaacaagac

SEQ ID NO: 807783 - DNA, 25 bp, Mus musculus
tgccccggcaggtgggcaacaagac

SEQ ID NO: 807784 - DNA, 25 bp, Mus musculus
tgccccgggtagctctagattcgtt

SEQ ID NO: 807785 - DNA, 25 bp, Mus musculus
tgccccgggtaggtctagattcgtt

SEQ ID NO: 807786 - DNA, 25 bp, Mus musculus
tgcccctaggaaactataccctgta

SEQ ID NO: 807787 - DNA, 25 bp, Mus musculus
tgcccctaggaatctataccctgta

SEQ ID NO: 807788 - DNA, 25 bp, Mus musculus
tgcccctatgctccagtgggagagt

SEQ ID NO: 807789 - DNA, 25 bp, Mus musculus
tgcccctatgctgcagtgggagagt

SEQ ID NO: 807790 - DNA, 25 bp, Mus musculus
tgcccctcctcaagggacttggtac

SEQ ID NO: 807791 - DNA, 25 bp, Mus musculus
tgcccctcctcatgggacttggtac

SEQ ID NO: 807792 - DNA, 25 bp, Mus musculus
tgcccctctctgatcgaaggacgat

SEQ ID NO: 807793 - DNA, 25 bp, Mus musculus
tgcccctctctgttcgaaggacgat

SEQ ID NO: 807794 - DNA, 25 bp, Mus musculus
tgcccctctgctcattcttgacaag

SEQ ID NO: 807795 - DNA, 25 bp, Mus musculus
tgcccctctgctgattcttgacaag

SEQ ID NO: 807796 - DNA, 25 bp, Mus musculus
tgcccctgaaacactggagcccgtg

SEQ ID NO: 807797 - DNA, 25 bp, Mus musculus
tgcccctgaaactctggagcccgtg

SEQ ID NO: 807798 - DNA, 25 bp, Mus musculus
tgcccctgacacatggacagctgat

SEQ ID NO: 807799 - DNA, 25 bp, Mus musculus
tgcccctgacacttggacagctgat

SEQ ID NO: 807800 - DNA, 25 bp, Mus musculus
tgcccctgacctatgccatgaagcg

SEQ ID NO: 807801 - DNA, 25 bp, Mus musculus
tgcccctgacctttgccatgaagcg

SEQ ID NO: 807802 - DNA, 25 bp, Mus musculus
tgcccctgaggaagtgacaacagga

SEQ ID NO: 807803 - DNA, 25 bp, Mus musculus
tgcccctgaggatgtgacaacagga

SEQ ID NO: 807804 - DNA, 25 bp, Mus musculus
tgcccctgagtgctcacggcaactt

SEQ ID NO: 807805 - DNA, 25 bp, Mus musculus
tgcccctgagtggtcacggcaactt

SEQ ID NO: 807806 - DNA, 25 bp, Mus musculus
tgcccctgctggaaggtgtagctca

SEQ ID NO: 807807 - DNA, 25 bp, Mus musculus
tgcccctgctggtaggtgtagctca

SEQ ID NO: 807808 - DNA, 25 bp, Mus musculus
tgcccctgctttctgcgagttccgg

SEQ ID NO: 807809 - DNA, 25 bp, Mus musculus
tgcccctgctttgtgcgagttccgg

SEQ ID NO: 807810 - DNA, 25 bp, Mus musculus
tgcccctggagcaagagaagacagc

SEQ ID NO: 807811 - DNA, 25 bp, Mus musculus
tgcccctggagctagagaagacagc

SEQ ID NO: 807812 - DNA, 25 bp, Mus musculus
tgcccctggccgaggagaatttgtc

SEQ ID NO: 807813 - DNA, 25 bp, Mus musculus
tgcccctggccgtggagaatttgtc

SEQ ID NO: 807814 - DNA, 25 bp, Mus musculus
tgcccctggctgagtcaatggagtc

SEQ ID NO: 807815 - DNA, 25 bp, Mus musculus
tgcccctggctgtgtcaatggagtc

SEQ ID NO: 807816 - DNA, 25 bp, Mus musculus
tgcccctgggaacagcttccaacag

SEQ ID NO: 807817 - DNA, 25 bp, Mus musculus
tgcccctgggaagagcttccaacag

SEQ ID NO: 807818 - DNA, 25 bp, Mus musculus
tgcccctgttctaggctcagctgaa

SEQ ID NO: 807819 - DNA, 25 bp, Mus musculus
tgcccctgttcttggctcagctgaa

SEQ ID NO: 807820 - DNA, 25 bp, Mus musculus
tgccccttcagtcacgggcggcgga

SEQ ID NO: 807821 - DNA, 25 bp, Mus musculus
tgccccttcagtgacgggcggcgga

SEQ ID NO: 807822 - DNA, 25 bp, Mus musculus
tgccccttttcacagaggctcttca

SEQ ID NO: 807823 - DNA, 25 bp, Mus musculus
tgccccttttcagagaggctcttca

SEQ ID NO: 807824 - DNA, 25 bp, Mus musculus
tgcccgaagcaacaaaaattccaaa

SEQ ID NO: 807825 - DNA, 25 bp, Mus musculus
tgcccgaagcaagaaaaattccaaa

SEQ ID NO: 807826 - DNA, 25 bp, Mus musculus
tgcccgaagcttcatctacattgcg

SEQ ID NO: 807827 - DNA, 25 bp, Mus musculus
tgcccgaagcttgatctacattgcg

SEQ ID NO: 807828 - DNA, 25 bp, Mus musculus
tgcccgaagtcaagcctcagagtgg

SEQ ID NO: 807829 - DNA, 25 bp, Mus musculus
tgcccgaagtcatgcctcagagtgg

SEQ ID NO: 807830 - DNA, 25 bp, Mus musculus
tgcccgaatccaagtgtgaagccct

SEQ ID NO: 807831 - DNA, 25 bp, Mus musculus
tgcccgaatccatgtgtgaagccct

SEQ ID NO: 807832 - DNA, 25 bp, Mus musculus
tgcccgacaagacagtagaattcct

SEQ ID NO: 807833 - DNA, 25 bp, Mus musculus
tgcccgacaagagagtagaattcct

SEQ ID NO: 807834 - DNA, 25 bp, Mus musculus
tgcccgacagagcaagatcaacgaa

SEQ ID NO: 807835 - DNA, 25 bp, Mus musculus
tgcccgacagaggaagatcaacgaa

SEQ ID NO: 807836 - DNA, 25 bp, Mus musculus
tgcccgagacggacatactcaggtt

SEQ ID NO: 807837 - DNA, 25 bp, Mus musculus
tgcccgagacggtcatactcaggtt

SEQ ID NO: 807838 - DNA, 25 bp, Mus musculus
tgcccgagagcgagagaagaacttt

SEQ ID NO: 807839 - DNA, 25 bp, Mus musculus
tgcccgagagcgtgagaagaacttt

SEQ ID NO: 807840 - DNA, 25 bp, Mus musculus
tgcccgagagttccttcgcaagaag

SEQ ID NO: 807841 - DNA, 25 bp, Mus musculus
tgcccgagagttgcttcgcaagaag

SEQ ID NO: 807842 - DNA, 25 bp, Mus musculus
tgcccgagatgtactggaggccctc

SEQ ID NO: 807843 - DNA, 25 bp, Mus musculus
tgcccgagatgttctggaggccctc

SEQ ID NO: 807844 - DNA, 25 bp, Mus musculus
tgcccgagcaaccaaaggcaggatc

SEQ ID NO: 807845 - DNA, 25 bp, Mus musculus
tgcccgagcaacgaaaggcaggatc

SEQ ID NO: 807846 - DNA, 25 bp, Mus musculus
tgcccgagccatcatgaaattgatg

SEQ ID NO: 807847 - DNA, 25 bp, Mus musculus
tgcccgagccatgatgaaattgatg

SEQ ID NO: 807848 - DNA, 25 bp, Mus musculus
tgcccgaggcctctagactgttcta

SEQ ID NO: 807849 - DNA, 25 bp, Mus musculus
tgcccgaggcctgtagactgttcta

SEQ ID NO: 807850 - DNA, 25 bp, Mus musculus
tgcccgagggccagactgtgtccct

SEQ ID NO: 807851 - DNA, 25 bp, Mus musculus
tgcccgagggcctgactgtgtccct

SEQ ID NO: 807852 - DNA, 25 bp, Mus musculus
tgcccgaggtgacgcagtagtaact

SEQ ID NO: 807853 - DNA, 25 bp, Mus musculus
tgcccgaggtgaggcagtagtaact

SEQ ID NO: 807854 - DNA, 25 bp, Mus musculus
tgcccgaggttgactacgcgattct

SEQ ID NO: 807855 - DNA, 25 bp, Mus musculus
tgcccgaggttgtctacgcgattct

SEQ ID NO: 807856 - DNA, 25 bp, Mus musculus
tgcccgagtgtaagggacaggttct

SEQ ID NO: 807857 - DNA, 25 bp, Mus musculus
tgcccgagtgtatgggacaggttct

SEQ ID NO: 807858 - DNA, 25 bp, Mus musculus
tgcccgataagaaagtaggagccct

SEQ ID NO: 807859 - DNA, 25 bp, Mus musculus
tgcccgataagatagtaggagccct

SEQ ID NO: 807860 - DNA, 25 bp, Mus musculus
tgcccgatgacgaagcgctgcgcat

SEQ ID NO: 807861 - DNA, 25 bp, Mus musculus
tgcccgatgacgtagcgctgcgcat

SEQ ID NO: 807862 - DNA, 25 bp, Mus musculus
tgcccgatgctaccccaaggtttaa

SEQ ID NO: 807863 - DNA, 25 bp, Mus musculus
tgcccgatgctagcccaaggtttaa

SEQ ID NO: 807864 - DNA, 25 bp, Mus musculus
tgcccgcaagatcatggctgacgag

SEQ ID NO: 807865 - DNA, 25 bp, Mus musculus
tgcccgcaagatgatggctgacgag

SEQ ID NO: 807866 - DNA, 25 bp, Mus musculus
tgcccgcaatgaaaagggctacggc

SEQ ID NO: 807867 - DNA, 25 bp, Mus musculus
tgcccgcaatgataagggctacggc

SEQ ID NO: 807868 - DNA, 25 bp, Mus musculus
tgcccgcactgtcaaactgctgctt

SEQ ID NO: 807869 - DNA, 25 bp, Mus musculus
tgcccgcactgtgaaactgctgctt

SEQ ID NO: 807870 - DNA, 25 bp, Mus musculus
tgcccgcagacaacagcgcaagatg

SEQ ID NO: 807871 - DNA, 25 bp, Mus musculus
tgcccgcagacatcagcgcaagatg

SEQ ID NO: 807872 - DNA, 25 bp, Mus musculus
tgcccgcccggtcatagcttgggtc

SEQ ID NO: 807873 - DNA, 25 bp, Mus musculus
tgcccgcccggtgatagcttgggtc

SEQ ID NO: 807874 - DNA, 25 bp, Mus musculus
tgcccgccggtaagaggcttctcga

SEQ ID NO: 807875 - DNA, 25 bp, Mus musculus
tgcccgccggtatgaggcttctcga

SEQ ID NO: 807876 - DNA, 25 bp, Mus musculus
tgcccgcgaatgatcctggccgagg

SEQ ID NO: 807877 - DNA, 25 bp, Mus musculus
tgcccgcgaatgttcctggccgagg

SEQ ID NO: 807878 - DNA, 25 bp, Mus musculus
tgcccgcggctcacccgaggagttg

SEQ ID NO: 807879 - DNA, 25 bp, Mus musculus
tgcccgcggctctcccgaggagttg

SEQ ID NO: 807880 - DNA, 25 bp, Mus musculus
tgcccgcgtcttagagaatcacggt

SEQ ID NO: 807881 - DNA, 25 bp, Mus musculus
tgcccgcgtctttgagaatcacggt

SEQ ID NO: 807882 - DNA, 25 bp, Mus musculus
tgcccgctctatctacgttggcaat

SEQ ID NO: 807883 - DNA, 25 bp, Mus musculus
tgcccgctctatgtacgttggcaat

SEQ ID NO: 807884 - DNA, 25 bp, Mus musculus
tgcccgctgccaagacggtgaagtt

SEQ ID NO: 807885 - DNA, 25 bp, Mus musculus
tgcccgctgccatgacggtgaagtt

SEQ ID NO: 807886 - DNA, 25 bp, Mus musculus
tgcccggcccacagactttgatttc

SEQ ID NO: 807887 - DNA, 25 bp, Mus musculus
tgcccggcccactgactttgatttc

SEQ ID NO: 807888 - DNA, 25 bp, Mus musculus
tgcccggccctgatggacctaaagg

SEQ ID NO: 807889 - DNA, 25 bp, Mus musculus
tgcccggccctgttggacctaaagg

SEQ ID NO: 807890 - DNA, 25 bp, Mus musculus
tgcccggcctgtactctgatcaaca

SEQ ID NO: 807891 - DNA, 25 bp, Mus musculus
tgcccggcctgttctctgatcaaca

SEQ ID NO: 807892 - DNA, 25 bp, Mus musculus
tgcccggctctgatctataagaaag

SEQ ID NO: 807893 - DNA, 25 bp, Mus musculus
tgcccggctctgttctataagaaag

SEQ ID NO: 807894 - DNA, 25 bp, Mus musculus
tgcccggctggacatgtactcttaa

SEQ ID NO: 807895 - DNA, 25 bp, Mus musculus
tgcccggctggagatgtactcttaa

SEQ ID NO: 807896 - DNA, 25 bp, Mus musculus
tgcccggcttccaagaggagctgcg

SEQ ID NO: 807897 - DNA, 25 bp, Mus musculus
tgcccggcttcctagaggagctgcg

SEQ ID NO: 807898 - DNA, 25 bp, Mus musculus
tgcccgggaccgatccccggtgtat

SEQ ID NO: 807899 - DNA, 25 bp, Mus musculus
tgcccgggaccgttccccggtgtat

SEQ ID NO: 807900 - DNA, 25 bp, Mus musculus
tgcccgggacctcctctactttgat

SEQ ID NO: 807901 - DNA, 25 bp, Mus musculus
tgcccgggacctgctctactttgat

SEQ ID NO: 807902 - DNA, 25 bp, Mus musculus
tgcccgggatcacaccaagtcaatt

SEQ ID NO: 807903 - DNA, 25 bp, Mus musculus
tgcccgggatcagaccaagtcaatt

SEQ ID NO: 807904 - DNA, 25 bp, Mus musculus
tgcccgggctctcatgcaagcaaag

SEQ ID NO: 807905 - DNA, 25 bp, Mus musculus
tgcccgggctctgatgcaagcaaag

SEQ ID NO: 807906 - DNA, 25 bp, Mus musculus
tgcccgggctgtatgctctcgtgtg

SEQ ID NO: 807907 - DNA, 25 bp, Mus musculus
tgcccgggctgtttgctctcgtgtg

SEQ ID NO: 807908 - DNA, 25 bp, Mus musculus
tgcccgggttagaacagaagaggtc

SEQ ID NO: 807909 - DNA, 25 bp, Mus musculus
tgcccgggttagtacagaagaggtc

SEQ ID NO: 807910 - DNA, 25 bp, Mus musculus
tgcccgtaccacagctttcctggag

SEQ ID NO: 807911 - DNA, 25 bp, Mus musculus
tgcccgtaccactgctttcctggag

SEQ ID NO: 807912 - DNA, 25 bp, Mus musculus
tgcccgtcacctcaatggtgccatt

SEQ ID NO: 807913 - DNA, 25 bp, Mus musculus
tgcccgtcacctgaatggtgccatt

SEQ ID NO: 807914 - DNA, 25 bp, Mus musculus
tgcccgtcatccaaggatgaggaag

SEQ ID NO: 807915 - DNA, 25 bp, Mus musculus
tgcccgtcatcctaggatgaggaag

SEQ ID NO: 807916 - DNA, 25 bp, Mus musculus
tgcccgtcgggcagttttctgaccc

SEQ ID NO: 807917 - DNA, 25 bp, Mus musculus
tgcccgtcgggctgttttctgaccc

SEQ ID NO: 807918 - DNA, 25 bp, Mus musculus
tgcccgtctcgtagcattctccaga

SEQ ID NO: 807919 - DNA, 25 bp, Mus musculus
tgcccgtctcgttgcattctccaga

SEQ ID NO: 807920 - DNA, 25 bp, Mus musculus
tgcccgtctcttagatatctacaag

SEQ ID NO: 807921 - DNA, 25 bp, Mus musculus
tgcccgtctctttgatatctacaag

SEQ ID NO: 807922 - DNA, 25 bp, Mus musculus
tgcccgtgacccaactgactttggt

SEQ ID NO: 807923 - DNA, 25 bp, Mus musculus
tgcccgtgaccctactgactttggt

SEQ ID NO: 807924 - DNA, 25 bp, Mus musculus
tgcccgtgagatctgcctgcggttt

SEQ ID NO: 807925 - DNA, 25 bp, Mus musculus
tgcccgtgagatgtgcctgcggttt

SEQ ID NO: 807926 - DNA, 25 bp, Mus musculus
tgcccgtgcaaaagccatcggatca

SEQ ID NO: 807927 - DNA, 25 bp, Mus musculus
tgcccgtgcaaatgccatcggatca

SEQ ID NO: 807928 - DNA, 25 bp, Mus musculus
tgcccgtggctgagccgcattaagg

SEQ ID NO: 807929 - DNA, 25 bp, Mus musculus
tgcccgtggctgtgccgcattaagg

SEQ ID NO: 807930 - DNA, 25 bp, Mus musculus
tgcccgtgggtcatcggcggacagg

SEQ ID NO: 807931 - DNA, 25 bp, Mus musculus
tgcccgtgggtcttcggcggacagg

SEQ ID NO: 807932 - DNA, 25 bp, Mus musculus
tgcccgtgtctgagctggcgccctt

SEQ ID NO: 807933 - DNA, 25 bp, Mus musculus
tgcccgtgtctgtgctggcgccctt

SEQ ID NO: 807934 - DNA, 25 bp, Mus musculus
tgcccgttctgccatgaggtcacca

SEQ ID NO: 807935 - DNA, 25 bp, Mus musculus
tgcccgttctgcgatgaggtcacca

SEQ ID NO: 807936 - DNA, 25 bp, Mus musculus
tgcccgttttaaaaatggtgcttcg

SEQ ID NO: 807937 - DNA, 25 bp, Mus musculus
tgcccgttttaataatggtgcttcg

SEQ ID NO: 807938 - DNA, 25 bp, Mus musculus
tgccctaaactacaagacttgcctc

SEQ ID NO: 807939 - DNA, 25 bp, Mus musculus
tgccctaaactagaagacttgcctc

SEQ ID NO: 807940 - DNA, 25 bp, Mus musculus
tgccctaaagccacacaaattgaag

SEQ ID NO: 807941 - DNA, 25 bp, Mus musculus
tgccctaaagcctcacaaattgaag

SEQ ID NO: 807942 - DNA, 25 bp, Mus musculus
tgccctaacagacttcacattcatg

SEQ ID NO: 807943 - DNA, 25 bp, Mus musculus
tgccctaacagagttcacattcatg

SEQ ID NO: 807944 - DNA, 25 bp, Mus musculus
tgccctaacagcagctgatctgtag

SEQ ID NO: 807945 - DNA, 25 bp, Mus musculus
tgccctaacagctgctgatctgtag

SEQ ID NO: 807946 - DNA, 25 bp, Mus musculus
tgccctaaccatctggcatgctgtt

SEQ ID NO: 807947 - DNA, 25 bp, Mus musculus
tgccctaaccatgtggcatgctgtt

SEQ ID NO: 807948 - DNA, 25 bp, Mus musculus
tgccctaagctgatcaacaatccct

SEQ ID NO: 807949 - DNA, 25 bp, Mus musculus
tgccctaagctgttcaacaatccct

SEQ ID NO: 807950 - DNA, 25 bp, Mus musculus
tgccctaaggccaagacatgtacca

SEQ ID NO: 807951 - DNA, 25 bp, Mus musculus
tgccctaaggcctagacatgtacca

SEQ ID NO: 807952 - DNA, 25 bp, Mus musculus
tgccctacaaatagactgaccacgg

SEQ ID NO: 807953 - DNA, 25 bp, Mus musculus
tgccctacaaattgactgaccacgg

SEQ ID NO: 807954 - DNA, 25 bp, Mus musculus
tgccctacaggcaacactggatatt

SEQ ID NO: 807955 - DNA, 25 bp, Mus musculus
tgccctacaggctacactggatatt

SEQ ID NO: 807956 - DNA, 25 bp, Mus musculus
tgccctaccagccattcagcaaagg

SEQ ID NO: 807957 - DNA, 25 bp, Mus musculus
tgccctaccagcgattcagcaaagg

SEQ ID NO: 807958 - DNA, 25 bp, Mus musculus
tgccctactgggaagtgcagcctgc

SEQ ID NO: 807959 - DNA, 25 bp, Mus musculus
tgccctactgggtagtgcagcctgc

SEQ ID NO: 807960 - DNA, 25 bp, Mus musculus
tgccctagaaaacgttcccgtggag

SEQ ID NO: 807961 - DNA, 25 bp, Mus musculus
tgccctagaaaaggttcccgtggag

SEQ ID NO: 807962 - DNA, 25 bp, Mus musculus
tgccctagacgcagtgccagaggag

SEQ ID NO: 807963 - DNA, 25 bp, Mus musculus
tgccctagacgctgtgccagaggag

SEQ ID NO: 807964 - DNA, 25 bp, Mus musculus
tgccctagatccatccagtgaccgg

SEQ ID NO: 807965 - DNA, 25 bp, Mus musculus
tgccctagatccttccagtgaccgg

SEQ ID NO: 807966 - DNA, 25 bp, Mus musculus
tgccctagccccattgacttgtcaa

SEQ ID NO: 807967 - DNA, 25 bp, Mus musculus
tgccctagcccctttgacttgtcaa

SEQ ID NO: 807968 - DNA, 25 bp, Mus musculus
tgccctagccttctgcatattccag

SEQ ID NO: 807969 - DNA, 25 bp, Mus musculus
tgccctagccttgtgcatattccag

SEQ ID NO: 807970 - DNA, 25 bp, Mus musculus
tgccctaggtctaggaattgctctg

SEQ ID NO: 807971 - DNA, 25 bp, Mus musculus
tgccctaggtcttggaattgctctg

SEQ ID NO: 807972 - DNA, 25 bp, Mus musculus
tgccctatgagacactgaacaaacg

SEQ ID NO: 807973 - DNA, 25 bp, Mus musculus
tgccctatgagagactgaacaaacg

SEQ ID NO: 807974 - DNA, 25 bp, Mus musculus
tgccctcaacccaggtgtgagctaa

SEQ ID NO: 807975 - DNA, 25 bp, Mus musculus
tgccctcaaccctggtgtgagctaa

SEQ ID NO: 807976 - DNA, 25 bp, Mus musculus
tgccctcaacttatcagtgaactac

SEQ ID NO: 807977 - DNA, 25 bp, Mus musculus
tgccctcaacttttcagtgaactac

SEQ ID NO: 807978 - DNA, 25 bp, Mus musculus
tgccctcacctaaagcagtgtgttg

SEQ ID NO: 807979 - DNA, 25 bp, Mus musculus
tgccctcacctatagcagtgtgttg

SEQ ID NO: 807980 - DNA, 25 bp, Mus musculus
tgccctcagaggaagctcttgtgtc

SEQ ID NO: 807981 - DNA, 25 bp, Mus musculus
tgccctcagaggtagctcttgtgtc

SEQ ID NO: 807982 - DNA, 25 bp, Mus musculus
tgccctcaggaactttcagcaccgg

SEQ ID NO: 807983 - DNA, 25 bp, Mus musculus
tgccctcaggaagtttcagcaccgg

SEQ ID NO: 807984 - DNA, 25 bp, Mus musculus
tgccctcatcccagctgttgggagg

SEQ ID NO: 807985 - DNA, 25 bp, Mus musculus
tgccctcatccctgctgttgggagg

SEQ ID NO: 807986 - DNA, 25 bp, Mus musculus
tgccctcattgtctggttacttgtg

SEQ ID NO: 807987 - DNA, 25 bp, Mus musculus
tgccctcattgtgtggttacttgtg

SEQ ID NO: 807988 - DNA, 25 bp, Mus musculus
tgccctccagccagagcaatggaca

SEQ ID NO: 807989 - DNA, 25 bp, Mus musculus
tgccctccagcctgagcaatggaca

SEQ ID NO: 807990 - DNA, 25 bp, Mus musculus
tgccctccatcacgacgagcagttg

SEQ ID NO: 807991 - DNA, 25 bp, Mus musculus
tgccctccatcaggacgagcagttg

SEQ ID NO: 807992 - DNA, 25 bp, Mus musculus
tgccctccatcgcaacagtgctgtg

SEQ ID NO: 807993 - DNA, 25 bp, Mus musculus
tgccctccatcggaacagtgctgtg

SEQ ID NO: 807994 - DNA, 25 bp, Mus musculus
tgccctccatttaccaatcctagga

SEQ ID NO: 807995 - DNA, 25 bp, Mus musculus
tgccctccattttccaatcctagga

SEQ ID NO: 807996 - DNA, 25 bp, Mus musculus
tgccctccggaacacactggctgat

SEQ ID NO: 807997 - DNA, 25 bp, Mus musculus
tgccctccggaagacactggctgat

SEQ ID NO: 807998 - DNA, 25 bp, Mus musculus
tgccctccggtcacagcaacaagga

SEQ ID NO: 807999 - DNA, 25 bp, Mus musculus
tgccctccggtctcagcaacaagga

SEQ ID NO: 808000 - DNA, 25 bp, Mus musculus
tgccctcctaatattgaaagtatgg

SEQ ID NO: 808001 - DNA, 25 bp, Mus musculus
tgccctcctaattttgaaagtatgg

SEQ ID NO: 808002 - DNA, 25 bp, Mus musculus
tgccctccttgtacagccttaggtg

SEQ ID NO: 808003 - DNA, 25 bp, Mus musculus
tgccctccttgttcagccttaggtg

SEQ ID NO: 808004 - DNA, 25 bp, Mus musculus
tgccctcgagggagcagacacagcg

SEQ ID NO: 808005 - DNA, 25 bp, Mus musculus
tgccctcgagggtgcagacacagcg

SEQ ID NO: 808006 - DNA, 25 bp, Mus musculus
tgccctcgctggagggcctcaatac

SEQ ID NO: 808007 - DNA, 25 bp, Mus musculus
tgccctcgctggtgggcctcaatac

SEQ ID NO: 808008 - DNA, 25 bp, Mus musculus
tgccctctagaacagtcacctggtg

SEQ ID NO: 808009 - DNA, 25 bp, Mus musculus
tgccctctagaagagtcacctggtg

SEQ ID NO: 808010 - DNA, 25 bp, Mus musculus
tgccctctatgacaaccttgtcaag

SEQ ID NO: 808011 - DNA, 25 bp, Mus musculus
tgccctctatgagaaccttgtcaag

SEQ ID NO: 808012 - DNA, 25 bp, Mus musculus
tgccctctcaggatccgctgctgat

SEQ ID NO: 808013 - DNA, 25 bp, Mus musculus
tgccctctcaggttccgctgctgat

SEQ ID NO: 808014 - DNA, 25 bp, Mus musculus
tgccctctgaaacaaattcatgaaa

SEQ ID NO: 808015 - DNA, 25 bp, Mus musculus
tgccctctgaaagaaattcatgaaa

SEQ ID NO: 808016 - DNA, 25 bp, Mus musculus
tgccctctgccactgaggaccaggg

SEQ ID NO: 808017 - DNA, 25 bp, Mus musculus
tgccctctgccagtgaggaccaggg

SEQ ID NO: 808018 - DNA, 25 bp, Mus musculus
tgccctctggcaagattgtggctct

SEQ ID NO: 808019 - DNA, 25 bp, Mus musculus
tgccctctggcacgtgtaggttgat

SEQ ID NO: 808020 - DNA, 25 bp, Mus musculus
tgccctctggcaggtgtaggttgat

SEQ ID NO: 808021 - DNA, 25 bp, Mus musculus
tgccctctggcatgattgtggctct

SEQ ID NO: 808022 - DNA, 25 bp, Mus musculus
tgccctctgggactctggagacatg

SEQ ID NO: 808023 - DNA, 25 bp, Mus musculus
tgccctctgggagtctggagacatg

SEQ ID NO: 808024 - DNA, 25 bp, Mus musculus
tgccctctttataatctgccagaac

SEQ ID NO: 808025 - DNA, 25 bp, Mus musculus
tgccctctttattatctgccagaac

SEQ ID NO: 808026 - DNA, 25 bp, Mus musculus
tgccctgaagagaagctactacatg

SEQ ID NO: 808027 - DNA, 25 bp, Mus musculus
tgccctgaagagcttctccatagcc

SEQ ID NO: 808028 - DNA, 25 bp, Mus musculus
tgccctgaagaggttctccatagcc

SEQ ID NO: 808029 - DNA, 25 bp, Mus musculus
tgccctgaagagtagctactacatg

SEQ ID NO: 808030 - DNA, 25 bp, Mus musculus
tgccctgaaggcagcagcaagtttc

SEQ ID NO: 808031 - DNA, 25 bp, Mus musculus
tgccctgaaggctgcagcaagtttc

SEQ ID NO: 808032 - DNA, 25 bp, Mus musculus
tgccctgactgtcgtgccaacaagc

SEQ ID NO: 808033 - DNA, 25 bp, Mus musculus
tgccctgactgtggtgccaacaagc

SEQ ID NO: 808034 - DNA, 25 bp, Mus musculus
tgccctgagagacgcgccaacaaag

SEQ ID NO: 808035 - DNA, 25 bp, Mus musculus
tgccctgagagaggcgccaacaaag

SEQ ID NO: 808036 - DNA, 25 bp, Mus musculus
tgccctgagcaacttcgtagaagaa

SEQ ID NO: 808037 - DNA, 25 bp, Mus musculus
tgccctgagcaagttcgtagaagaa

SEQ ID NO: 808038 - DNA, 25 bp, Mus musculus
tgccctgaggccaggaggcatctgc

SEQ ID NO: 808039 - DNA, 25 bp, Mus musculus
tgccctgaggcctggaggcatctgc

SEQ ID NO: 808040 - DNA, 25 bp, Mus musculus
tgccctgagtcccaccaactgtgat

SEQ ID NO: 808041 - DNA, 25 bp, Mus musculus
tgccctgagtccgaccaactgtgat

SEQ ID NO: 808042 - DNA, 25 bp, Mus musculus
tgccctgagtgtagcagacggaaga

SEQ ID NO: 808043 - DNA, 25 bp, Mus musculus
tgccctgagtgttgcagacggaaga

SEQ ID NO: 808044 - DNA, 25 bp, Mus musculus
tgccctgagtttcccacggtcagaa

SEQ ID NO: 808045 - DNA, 25 bp, Mus musculus
tgccctgagtttgccacggtcagaa

SEQ ID NO: 808046 - DNA, 25 bp, Mus musculus
tgccctgatgaacaagttcctgagt

SEQ ID NO: 808047 - DNA, 25 bp, Mus musculus
tgccctgatgaagaagttcctgagt

SEQ ID NO: 808048 - DNA, 25 bp, Mus musculus
tgccctgatgggagatgcgtcaact

SEQ ID NO: 808049 - DNA, 25 bp, Mus musculus
tgccctgatgggtgatgcgtcaact

SEQ ID NO: 808050 - DNA, 25 bp, Mus musculus
tgccctgatgttccacctcaggtta

SEQ ID NO: 808051 - DNA, 25 bp, Mus musculus
tgccctgatgttgcacctcaggtta

SEQ ID NO: 808052 - DNA, 25 bp, Mus musculus
tgccctgcagccagagactggtgtt

SEQ ID NO: 808053 - DNA, 25 bp, Mus musculus
tgccctgcagcctgagactggtgtt

SEQ ID NO: 808054 - DNA, 25 bp, Mus musculus
tgccctgcatggaagtgtcctggag

SEQ ID NO: 808055 - DNA, 25 bp, Mus musculus
tgccctgcatggtagtgtcctggag

SEQ ID NO: 808056 - DNA, 25 bp, Mus musculus
tgccctgcctctaggtggaactgct

SEQ ID NO: 808057 - DNA, 25 bp, Mus musculus
tgccctgcctcttggtggaactgct

SEQ ID NO: 808058 - DNA, 25 bp, Mus musculus
tgccctgccttgagcattgtggagt

SEQ ID NO: 808059 - DNA, 25 bp, Mus musculus
tgccctgccttgtgcattgtggagt

SEQ ID NO: 808060 - DNA, 25 bp, Mus musculus
tgccctgcgagacttcccagaagaa

SEQ ID NO: 808061 - DNA, 25 bp, Mus musculus
tgccctgcgagagttcccagaagaa

SEQ ID NO: 808062 - DNA, 25 bp, Mus musculus
tgccctgcgggcagaactgcagaac

SEQ ID NO: 808063 - DNA, 25 bp, Mus musculus
tgccctgcgggctgaactgcagaac

SEQ ID NO: 808064 - DNA, 25 bp, Mus musculus
tgccctgcgggtcccggaagtgagt

SEQ ID NO: 808065 - DNA, 25 bp, Mus musculus
tgccctgcgggtgccggaagtgagt

SEQ ID NO: 808066 - DNA, 25 bp, Mus musculus
tgccctgctgacacagaagtccctg

SEQ ID NO: 808067 - DNA, 25 bp, Mus musculus
tgccctgctgactcagaagtccctg

SEQ ID NO: 808068 - DNA, 25 bp, Mus musculus
tgccctgctgcacccatgtgtgcgg

SEQ ID NO: 808069 - DNA, 25 bp, Mus musculus
tgccctgctgcagccatgtgtgcgg

SEQ ID NO: 808070 - DNA, 25 bp, Mus musculus
tgccctggactacttgcactccgag

SEQ ID NO: 808071 - DNA, 25 bp, Mus musculus
tgccctggactagttgcactccgag

SEQ ID NO: 808072 - DNA, 25 bp, Mus musculus
tgccctggagaacagaatcgacggt

SEQ ID NO: 808073 - DNA, 25 bp, Mus musculus
tgccctggagaagagaatcgacggt

SEQ ID NO: 808074 - DNA, 25 bp, Mus musculus
tgccctggatagacgctctccagaa

SEQ ID NO: 808075 - DNA, 25 bp, Mus musculus
tgccctggatagtcgctctccagaa

SEQ ID NO: 808076 - DNA, 25 bp, Mus musculus
tgccctggatcaccctactttttgc

SEQ ID NO: 808077 - DNA, 25 bp, Mus musculus
tgccctggatcagcctactttttgc

SEQ ID NO: 808078 - DNA, 25 bp, Mus musculus
tgccctggcacgagtgctgtccctg

SEQ ID NO: 808079 - DNA, 25 bp, Mus musculus
tgccctggcacgtgtgctgtccctg

SEQ ID NO: 808080 - DNA, 25 bp, Mus musculus
tgccctggcagcacatcaggcgggt

SEQ ID NO: 808081 - DNA, 25 bp, Mus musculus
tgccctggcagctcatcaggcgggt

SEQ ID NO: 808082 - DNA, 25 bp, Mus musculus
tgccctggcatgagggacaatatca

SEQ ID NO: 808083 - DNA, 25 bp, Mus musculus
tgccctggcatgtgggacaatatca

SEQ ID NO: 808084 - DNA, 25 bp, Mus musculus
tgccctggcctaaggtcacattctc

SEQ ID NO: 808085 - DNA, 25 bp, Mus musculus
tgccctggcctatggtcacattctc

SEQ ID NO: 808086 - DNA, 25 bp, Mus musculus
tgccctggcctcatgccttcgagaa

SEQ ID NO: 808087 - DNA, 25 bp, Mus musculus
tgccctggcctcttgccttcgagaa

SEQ ID NO: 808088 - DNA, 25 bp, Mus musculus
tgccctggctaacggagtcagtgct

SEQ ID NO: 808089 - DNA, 25 bp, Mus musculus
tgccctggctaagggagtcagtgct

SEQ ID NO: 808090 - DNA, 25 bp, Mus musculus
tgccctggctcacaagtaccactaa

SEQ ID NO: 808091 - DNA, 25 bp, Mus musculus
tgccctggctcagaagtaccactaa

SEQ ID NO: 808092 - DNA, 25 bp, Mus musculus
tgccctggctgcagggccttgtctg

SEQ ID NO: 808093 - DNA, 25 bp, Mus musculus
tgccctggctgctgggccttgtctg

SEQ ID NO: 808094 - DNA, 25 bp, Mus musculus
tgccctgggacgacagactgaactt

SEQ ID NO: 808095 - DNA, 25 bp, Mus musculus
tgccctgggacgtcagactgaactt

SEQ ID NO: 808096 - DNA, 25 bp, Mus musculus
tgccctgggatacagctccattcag

SEQ ID NO: 808097 - DNA, 25 bp, Mus musculus
tgccctgggatagagctccattcag

SEQ ID NO: 808098 - DNA, 25 bp, Mus musculus
tgccctgggatcacattagcgttat

SEQ ID NO: 808099 - DNA, 25 bp, Mus musculus
tgccctgggatctcattagcgttat

SEQ ID NO: 808100 - DNA, 25 bp, Mus musculus
tgccctgggcagatctcacatcact

SEQ ID NO: 808101 - DNA, 25 bp, Mus musculus
tgccctgggcagttctcacatcact

SEQ ID NO: 808102 - DNA, 25 bp, Mus musculus
tgccctgggcccagtattgattttg

SEQ ID NO: 808103 - DNA, 25 bp, Mus musculus
tgccctgggccctgtattgattttg

SEQ ID NO: 808104 - DNA, 25 bp, Mus musculus
tgccctggtctcacaagcttatacc

SEQ ID NO: 808105 - DNA, 25 bp, Mus musculus
tgccctggtctctcaagcttatacc

SEQ ID NO: 808106 - DNA, 25 bp, Mus musculus
tgccctggtcttagagggtatcccg

SEQ ID NO: 808107 - DNA, 25 bp, Mus musculus
tgccctggtctttgagggtatcccg

SEQ ID NO: 808108 - DNA, 25 bp, Mus musculus
tgccctggtggccaagaccaaagtg

SEQ ID NO: 808109 - DNA, 25 bp, Mus musculus
tgccctggtggcgaagaccaaagtg

SEQ ID NO: 808110 - DNA, 25 bp, Mus musculus
tgccctggtgggaaaaggatgagcc

SEQ ID NO: 808111 - DNA, 25 bp, Mus musculus
tgccctggtgggtaaaggatgagcc

SEQ ID NO: 808112 - DNA, 25 bp, Mus musculus
tgccctggttctctcatgtttctct

SEQ ID NO: 808113 - DNA, 25 bp, Mus musculus
tgccctggttctgtcatgtttctct

SEQ ID NO: 808114 - DNA, 25 bp, Mus musculus
tgccctggttggaaattaaacttgt

SEQ ID NO: 808115 - DNA, 25 bp, Mus musculus
tgccctggttggtaattaaacttgt

SEQ ID NO: 808116 - DNA, 25 bp, Mus musculus
tgccctgtaaagcagagaacacgct

SEQ ID NO: 808117 - DNA, 25 bp, Mus musculus
tgccctgtaaaggagagaacacgct

SEQ ID NO: 808118 - DNA, 25 bp, Mus musculus
tgccctgtacacatggtacgtcaga

SEQ ID NO: 808119 - DNA, 25 bp, Mus musculus
tgccctgtacacttggtacgtcaga

SEQ ID NO: 808120 - DNA, 25 bp, Mus musculus
tgccctgtcaatattgctgctcaga

SEQ ID NO: 808121 - DNA, 25 bp, Mus musculus
tgccctgtcaattttgctgctcaga

SEQ ID NO: 808122 - DNA, 25 bp, Mus musculus
tgccctgtcaggatgggaagctcac

SEQ ID NO: 808123 - DNA, 25 bp, Mus musculus
tgccctgtcaggttgggaagctcac

SEQ ID NO: 808124 - DNA, 25 bp, Mus musculus
tgccctgtctacattcggcctgcag

SEQ ID NO: 808125 - DNA, 25 bp, Mus musculus
tgccctgtctactttcggcctgcag

SEQ ID NO: 808126 - DNA, 25 bp, Mus musculus
tgccctgtgatgaggctgggttttt

SEQ ID NO: 808127 - DNA, 25 bp, Mus musculus
tgccctgtgatgtggctgggttttt

SEQ ID NO: 808128 - DNA, 25 bp, Mus musculus
tgccctgtgcgccatctgtggcgac

SEQ ID NO: 808129 - DNA, 25 bp, Mus musculus
tgccctgtgcgcgatctgtggcgac

SEQ ID NO: 808130 - DNA, 25 bp, Mus musculus
tgccctgtggagacggtaccttctg

SEQ ID NO: 808131 - DNA, 25 bp, Mus musculus
tgccctgtggagtcggtaccttctg

SEQ ID NO: 808132 - DNA, 25 bp, Mus musculus
tgccctgtggcaacatggaccaact

SEQ ID NO: 808133 - DNA, 25 bp, Mus musculus
tgccctgtggcatcatggaccaact

SEQ ID NO: 808134 - DNA, 25 bp, Mus musculus
tgcccttaaccaatgaatcaccctt

SEQ ID NO: 808135 - DNA, 25 bp, Mus musculus
tgcccttaaccattgaatcaccctt

SEQ ID NO: 808136 - DNA, 25 bp, Mus musculus
tgcccttatgaacccttcgtctgca

SEQ ID NO: 808137 - DNA, 25 bp, Mus musculus
tgcccttatgaagccttcgtctgca

SEQ ID NO: 808138 - DNA, 25 bp, Mus musculus
tgcccttcaacaacggcctcatggg

SEQ ID NO: 808139 - DNA, 25 bp, Mus musculus
tgcccttcaacatcggcctcatggg

SEQ ID NO: 808140 - DNA, 25 bp, Mus musculus
tgcccttcagttaaacaggatggtg

SEQ ID NO: 808141 - DNA, 25 bp, Mus musculus
tgcccttcagtttaacaggatggtg

SEQ ID NO: 808142 - DNA, 25 bp, Mus musculus
tgcccttcatcaatgtcaacaccag

SEQ ID NO: 808143 - DNA, 25 bp, Mus musculus
tgcccttcatcattgtcaacaccag

SEQ ID NO: 808144 - DNA, 25 bp, Mus musculus
tgcccttcattcactctagaaatta

SEQ ID NO: 808145 - DNA, 25 bp, Mus musculus
tgcccttcattctctctagaaatta

SEQ ID NO: 808146 - DNA, 25 bp, Mus musculus
tgcccttccagcaggagatcaggag

SEQ ID NO: 808147 - DNA, 25 bp, Mus musculus
tgcccttccagctggagatcaggag

SEQ ID NO: 808148 - DNA, 25 bp, Mus musculus
tgcccttcctcaacatcgagacaag

SEQ ID NO: 808149 - DNA, 25 bp, Mus musculus
tgcccttcctcatcatcgagacaag

SEQ ID NO: 808150 - DNA, 25 bp, Mus musculus
tgcccttcgctaatctcatgagcct

SEQ ID NO: 808151 - DNA, 25 bp, Mus musculus
tgcccttcgctattctcatgagcct

SEQ ID NO: 808152 - DNA, 25 bp, Mus musculus
tgcccttcggagatcgagtacaacg

SEQ ID NO: 808153 - DNA, 25 bp, Mus musculus
tgcccttcggagttcgagtacaacg

SEQ ID NO: 808154 - DNA, 25 bp, Mus musculus
tgcccttctactacttcatcatcag

SEQ ID NO: 808155 - DNA, 25 bp, Mus musculus
tgcccttctacttcttcatcatcag

SEQ ID NO: 808156 - DNA, 25 bp, Mus musculus
tgcccttctcaacactgtactcgtg

SEQ ID NO: 808157 - DNA, 25 bp, Mus musculus
tgcccttctcaagactgtactcgtg

SEQ ID NO: 808158 - DNA, 25 bp, Mus musculus
tgcccttcttcacgtagcctcatgg

SEQ ID NO: 808159 - DNA, 25 bp, Mus musculus
tgcccttcttcaggtagcctcatgg

SEQ ID NO: 808160 - DNA, 25 bp, Mus musculus
tgcccttcttgtcgcctggaggctg

SEQ ID NO: 808161 - DNA, 25 bp, Mus musculus
tgcccttcttgtggcctggaggctg

SEQ ID NO: 808162 - DNA, 25 bp, Mus musculus
tgcccttgaccccagggtataaaga

SEQ ID NO: 808163 - DNA, 25 bp, Mus musculus
tgcccttgacccgagggtataaaga

SEQ ID NO: 808164 - DNA, 25 bp, Mus musculus
tgcccttgactaaaatgagtacttc

SEQ ID NO: 808165 - DNA, 25 bp, Mus musculus
tgcccttgactataatgagtacttc

SEQ ID NO: 808166 - DNA, 25 bp, Mus musculus
tgcccttgctagatgatgtaccctg

SEQ ID NO: 808167 - DNA, 25 bp, Mus musculus
tgcccttgctagttgatgtaccctg

SEQ ID NO: 808168 - DNA, 25 bp, Mus musculus
tgcccttggcgcagatgacctgggt

SEQ ID NO: 808169 - DNA, 25 bp, Mus musculus
tgcccttggcgctgatgacctgggt

SEQ ID NO: 808170 - DNA, 25 bp, Mus musculus
tgcccttgggcacatggtgttagca

SEQ ID NO: 808171 - DNA, 25 bp, Mus musculus
tgcccttgggcagatggtgttagca

SEQ ID NO: 808172 - DNA, 25 bp, Mus musculus
tgccctttagaaaaagcccagaagt

SEQ ID NO: 808173 - DNA, 25 bp, Mus musculus
tgccctttagaataagcccagaagt

SEQ ID NO: 808174 - DNA, 25 bp, Mus musculus
tgccctttccaaacatcaacatgtc

SEQ ID NO: 808175 - DNA, 25 bp, Mus musculus
tgccctttccaatcatcaacatgtc

SEQ ID NO: 808176 - DNA, 25 bp, Mus musculus
tgccctttctgaaggcccgtgtgga

SEQ ID NO: 808177 - DNA, 25 bp, Mus musculus
tgccctttctgatggcccgtgtgga

SEQ ID NO: 808178 - DNA, 25 bp, Mus musculus
tgccctttcttcagcgggcaggccg

SEQ ID NO: 808179 - DNA, 25 bp, Mus musculus
tgccctttcttctgcgggcaggccg

SEQ ID NO: 808180 - DNA, 25 bp, Mus musculus
tgcccttttatgacccagacaccag

SEQ ID NO: 808181 - DNA, 25 bp, Mus musculus
tgcccttttatgtcccagacaccag

SEQ ID NO: 808182 - DNA, 25 bp, Mus musculus
tgccgaaaagcaccatagcgggctc

SEQ ID NO: 808183 - DNA, 25 bp, Mus musculus
tgccgaaaagcagcatagcgggctc

SEQ ID NO: 808184 - DNA, 25 bp, Mus musculus
tgccgaaaatcaacaggagcgcctc

SEQ ID NO: 808185 - DNA, 25 bp, Mus musculus
tgccgaaaatcatcaggagcgcctc

SEQ ID NO: 808186 - DNA, 25 bp, Mus musculus
tgccgaaacaatataaataacctgt

SEQ ID NO: 808187 - DNA, 25 bp, Mus musculus
tgccgaaacaatttaaataacctgt

SEQ ID NO: 808188 - DNA, 25 bp, Mus musculus
tgccgaagatgacgttactacaact

SEQ ID NO: 808189 - DNA, 25 bp, Mus musculus
tgccgaagatgaggttactacaact

SEQ ID NO: 808190 - DNA, 25 bp, Mus musculus
tgccgaaggtgacgtcctgcacact

SEQ ID NO: 808191 - DNA, 25 bp, Mus musculus
tgccgaaggtgaggtcctgcacact

SEQ ID NO: 808192 - DNA, 25 bp, Mus musculus
tgccgaatacggatcacctgggtcc

SEQ ID NO: 808193 - DNA, 25 bp, Mus musculus
tgccgaatacggttcacctgggtcc

SEQ ID NO: 808194 - DNA, 25 bp, Mus musculus
tgccgaatgcacagagagaattttt

SEQ ID NO: 808195 - DNA, 25 bp, Mus musculus
tgccgaatgcactgagagaattttt

SEQ ID NO: 808196 - DNA, 25 bp, Mus musculus
tgccgacaacgtcaagggcaggtca

SEQ ID NO: 808197 - DNA, 25 bp, Mus musculus
tgccgacaacgtgaagggcaggtca

SEQ ID NO: 808198 - DNA, 25 bp, Mus musculus
tgccgacaccttatatgctgtctcc

SEQ ID NO: 808199 - DNA, 25 bp, Mus musculus
tgccgacaccttttatgctgtctcc

SEQ ID NO: 808200 - DNA, 25 bp, Mus musculus
tgccgacagcgcagctttgtacaca

SEQ ID NO: 808201 - DNA, 25 bp, Mus musculus
tgccgacagcgctgctttgtacaca

SEQ ID NO: 808202 - DNA, 25 bp, Mus musculus
tgccgacagctacgttctcctttct

SEQ ID NO: 808203 - DNA, 25 bp, Mus musculus
tgccgacagctaggttctcctttct

SEQ ID NO: 808204 - DNA, 25 bp, Mus musculus
tgccgaccactgcaagcacgagtgt

SEQ ID NO: 808205 - DNA, 25 bp, Mus musculus
tgccgaccactggaagcacgagtgt

SEQ ID NO: 808206 - DNA, 25 bp, Mus musculus
tgccgacctgatcaattccagtgtg

SEQ ID NO: 808207 - DNA, 25 bp, Mus musculus
tgccgacctgatgaattccagtgtg

SEQ ID NO: 808208 - DNA, 25 bp, Mus musculus
tgccgacggtgacgattcgctctat

SEQ ID NO: 808209 - DNA, 25 bp, Mus musculus
tgccgacggtgaggattcgctctat

SEQ ID NO: 808210 - DNA, 25 bp, Mus musculus
tgccgacgtgaaagagtcccaggct

SEQ ID NO: 808211 - DNA, 25 bp, Mus musculus
tgccgacgtgaatgagtcccaggct

SEQ ID NO: 808212 - DNA, 25 bp, Mus musculus
tgccgacgttagaggaaaacaattt

SEQ ID NO: 808213 - DNA, 25 bp, Mus musculus
tgccgacgttagtggaaaacaattt

SEQ ID NO: 808214 - DNA, 25 bp, Mus musculus
tgccgactacatcgagcagtgcaag

SEQ ID NO: 808215 - DNA, 25 bp, Mus musculus
tgccgactacatggagcagtgcaag

SEQ ID NO: 808216 - DNA, 25 bp, Mus musculus
tgccgagaaagaacctacttcagag

SEQ ID NO: 808217 - DNA, 25 bp, Mus musculus
tgccgagaaagatcctacttcagag

SEQ ID NO: 808218 - DNA, 25 bp, Mus musculus
tgccgagaacaacagggtcttcact

SEQ ID NO: 808219 - DNA, 25 bp, Mus musculus
tgccgagaacaagagggtcttcact

SEQ ID NO: 808220 - DNA, 25 bp, Mus musculus
tgccgagagcagataatacgcaggc

SEQ ID NO: 808221 - DNA, 25 bp, Mus musculus
tgccgagagcagttaatacgcaggc

SEQ ID NO: 808222 - DNA, 25 bp, Mus musculus
tgccgagagctgctgctatacacag

SEQ ID NO: 808223 - DNA, 25 bp, Mus musculus
tgccgagagctggtgctatacacag

SEQ ID NO: 808224 - DNA, 25 bp, Mus musculus
tgccgagagtttcagggatgtcctt

SEQ ID NO: 808225 - DNA, 25 bp, Mus musculus
tgccgagagtttgagggatgtcctt

SEQ ID NO: 808226 - DNA, 25 bp, Mus musculus
tgccgagatcacatccacaacgggc

SEQ ID NO: 808227 - DNA, 25 bp, Mus musculus
tgccgagatcacttccacaacgggc

SEQ ID NO: 808228 - DNA, 25 bp, Mus musculus
tgccgagattggaagcaatataaag

SEQ ID NO: 808229 - DNA, 25 bp, Mus musculus
tgccgagattggtagcaatataaag

SEQ ID NO: 808230 - DNA, 25 bp, Mus musculus
tgccgagcatgtcggcagatcttct

SEQ ID NO: 808231 - DNA, 25 bp, Mus musculus
tgccgagcatgtgggcagatcttct

SEQ ID NO: 808232 - DNA, 25 bp, Mus musculus
tgccgagccctcactaggacactgt

SEQ ID NO: 808233 - DNA, 25 bp, Mus musculus
tgccgagccctctctaggacactgt

SEQ ID NO: 808234 - DNA, 25 bp, Mus musculus
tgccgagcctacactttcccaggag

SEQ ID NO: 808235 - DNA, 25 bp, Mus musculus
tgccgagcctactctttcccaggag

SEQ ID NO: 808236 - DNA, 25 bp, Mus musculus
tgccgagccttcataaagctctggg

SEQ ID NO: 808237 - DNA, 25 bp, Mus musculus
tgccgagccttcttaaagctctggg

SEQ ID NO: 808238 - DNA, 25 bp, Mus musculus
tgccgagctagccaccaagtacgca

SEQ ID NO: 808239 - DNA, 25 bp, Mus musculus
tgccgagctagcgaccaagtacgca

SEQ ID NO: 808240 - DNA, 25 bp, Mus musculus
tgccgaggatttcgaaaaagtgttt

SEQ ID NO: 808241 - DNA, 25 bp, Mus musculus
tgccgaggatttggaaaaagtgttt

SEQ ID NO: 808242 - DNA, 25 bp, Mus musculus
tgccgaggcctcaagcagactttga

SEQ ID NO: 808243 - DNA, 25 bp, Mus musculus
tgccgaggcctctagcagactttga

SEQ ID NO: 808244 - DNA, 25 bp, Mus musculus
tgccgaggcggtccactacatcggc

SEQ ID NO: 808245 - DNA, 25 bp, Mus musculus
tgccgaggcggtgcactacatcggc

SEQ ID NO: 808246 - DNA, 25 bp, Mus musculus
tgccgaggctatccctgagctgaaa

SEQ ID NO: 808247 - DNA, 25 bp, Mus musculus
tgccgaggctatgcctgagctgaaa

SEQ ID NO: 808248 - DNA, 25 bp, Mus musculus
tgccgagggtgaccctgtatgtaat

SEQ ID NO: 808249 - DNA, 25 bp, Mus musculus
tgccgagggtgagcctgtatgtaat

SEQ ID NO: 808250 - DNA, 25 bp, Mus musculus
tgccgagtcacaccactatagccaa

SEQ ID NO: 808251 - DNA, 25 bp, Mus musculus
tgccgagtcacagcactatagccaa

SEQ ID NO: 808252 - DNA, 25 bp, Mus musculus
tgccgagtcatgataattggtgaaa

SEQ ID NO: 808253 - DNA, 25 bp, Mus musculus
tgccgagtcatgttaattggtgaaa

SEQ ID NO: 808254 - DNA, 25 bp, Mus musculus
tgccgagtgtaccaggcatccagcc

SEQ ID NO: 808255 - DNA, 25 bp, Mus musculus
tgccgagtgtacgaggcatccagcc

SEQ ID NO: 808256 - DNA, 25 bp, Mus musculus
tgccgagtgtggctgtgcactcctc

SEQ ID NO: 808257 - DNA, 25 bp, Mus musculus
tgccgagtgtgggtgtgcactcctc

SEQ ID NO: 808258 - DNA, 25 bp, Mus musculus
tgccgatactgtcaaacgccagagc

SEQ ID NO: 808259 - DNA, 25 bp, Mus musculus
tgccgatactgtgaaacgccagagc

SEQ ID NO: 808260 - DNA, 25 bp, Mus musculus
tgccgatatccaacggagccgaggg

SEQ ID NO: 808261 - DNA, 25 bp, Mus musculus
tgccgatatccatcggagccgaggg

SEQ ID NO: 808262 - DNA, 25 bp, Mus musculus
tgccgatcgtggacacctggacagt

SEQ ID NO: 808263 - DNA, 25 bp, Mus musculus
tgccgatcgtggtcacctggacagt

SEQ ID NO: 808264 - DNA, 25 bp, Mus musculus
tgccgatctccccaggcttgctgtg

SEQ ID NO: 808265 - DNA, 25 bp, Mus musculus
tgccgatctcccgaggcttgctgtg

SEQ ID NO: 808266 - DNA, 25 bp, Mus musculus
tgccgatctgaacggtttcctggcc

SEQ ID NO: 808267 - DNA, 25 bp, Mus musculus
tgccgatctgaagggtttcctggcc

SEQ ID NO: 808268 - DNA, 25 bp, Mus musculus
tgccgatgctggcagctacacagcc

SEQ ID NO: 808269 - DNA, 25 bp, Mus musculus
tgccgatgctgggagctacacagcc

SEQ ID NO: 808270 - DNA, 25 bp, Mus musculus
tgccgatggacactacgatgttctc

SEQ ID NO: 808271 - DNA, 25 bp, Mus musculus
tgccgatggacagtacgatgttctc

SEQ ID NO: 808272 - DNA, 25 bp, Mus musculus
tgccgatttcagcacgaaggatgct

SEQ ID NO: 808273 - DNA, 25 bp, Mus musculus
tgccgatttcaggacgaaggatgct

SEQ ID NO: 808274 - DNA, 25 bp, Mus musculus
tgccgatttccccacctgctaaaaa

SEQ ID NO: 808275 - DNA, 25 bp, Mus musculus
tgccgatttcccgacctgctaaaaa

SEQ ID NO: 808276 - DNA, 25 bp, Mus musculus
tgccgcaacagtcacggaagcagac

SEQ ID NO: 808277 - DNA, 25 bp, Mus musculus
tgccgcaacagtgacggaagcagac

SEQ ID NO: 808278 - DNA, 25 bp, Mus musculus
tgccgcaagggtcacagtgagatcc

SEQ ID NO: 808279 - DNA, 25 bp, Mus musculus
tgccgcaagggtgacagtgagatcc

SEQ ID NO: 808280 - DNA, 25 bp, Mus musculus
tgccgcagatatccggtacgcctac

SEQ ID NO: 808281 - DNA, 25 bp, Mus musculus
tgccgcagatatgcggtacgcctac

SEQ ID NO: 808282 - DNA, 25 bp, Mus musculus
tgccgcagctagatccgtggagact

SEQ ID NO: 808283 - DNA, 25 bp, Mus musculus
tgccgcagctagttccgtggagact

SEQ ID NO: 808284 - DNA, 25 bp, Mus musculus
tgccgcatgctgcacgaaaagctga

SEQ ID NO: 808285 - DNA, 25 bp, Mus musculus
tgccgcatgctggacgaaaagctga

SEQ ID NO: 808286 - DNA, 25 bp, Mus musculus
tgccgccaatgccaaaagtttacag

SEQ ID NO: 808287 - DNA, 25 bp, Mus musculus
tgccgccaatgcgaaaagtttacag

SEQ ID NO: 808288 - DNA, 25 bp, Mus musculus
tgccgccaccttctttgccttggga

SEQ ID NO: 808289 - DNA, 25 bp, Mus musculus
tgccgccaccttgtttgccttggga

SEQ ID NO: 808290 - DNA, 25 bp, Mus musculus
tgccgccagcgtctcgtcatggaga

SEQ ID NO: 808291 - DNA, 25 bp, Mus musculus
tgccgccagcgtgtcgtcatggaga

SEQ ID NO: 808292 - DNA, 25 bp, Mus musculus
tgccgccgccggacgggactctaag

SEQ ID NO: 808293 - DNA, 25 bp, Mus musculus
tgccgccgccggtcgggactctaag

SEQ ID NO: 808294 - DNA, 25 bp, Mus musculus
tgccgccgccttaagacgcggacgg

SEQ ID NO: 808295 - DNA, 25 bp, Mus musculus
tgccgccgcctttagacgcggacgg

SEQ ID NO: 808296 - DNA, 25 bp, Mus musculus
tgccgcctatggctggaaacaaggt

SEQ ID NO: 808297 - DNA, 25 bp, Mus musculus
tgccgcctatgggtggaaacaaggt

SEQ ID NO: 808298 - DNA, 25 bp, Mus musculus
tgccgcctgctaacaccatatggtg

SEQ ID NO: 808299 - DNA, 25 bp, Mus musculus
tgccgcctgctatcaccatatggtg

SEQ ID NO: 808300 - DNA, 25 bp, Mus musculus
tgccgcctgggcaactatcgcaatg

SEQ ID NO: 808301 - DNA, 25 bp, Mus musculus
tgccgcctgggctactatcgcaatg

SEQ ID NO: 808302 - DNA, 25 bp, Mus musculus
tgccgccttggaccgagatacagag

SEQ ID NO: 808303 - DNA, 25 bp, Mus musculus
tgccgccttggagcgagatacagag

SEQ ID NO: 808304 - DNA, 25 bp, Mus musculus
tgccgctacgatcctctggaggtct

SEQ ID NO: 808305 - DNA, 25 bp, Mus musculus
tgccgctacgatgctctggaggtct

SEQ ID NO: 808306 - DNA, 25 bp, Mus musculus
tgccgctaggcaactaactgtccag

SEQ ID NO: 808307 - DNA, 25 bp, Mus musculus
tgccgctaggcatctaactgtccag

SEQ ID NO: 808308 - DNA, 25 bp, Mus musculus
tgccgctatcaccagcatgcaaatc

SEQ ID NO: 808309 - DNA, 25 bp, Mus musculus
tgccgctatcacgagcatgcaaatc

SEQ ID NO: 808310 - DNA, 25 bp, Mus musculus
tgccgctgaggacacctgtacacct

SEQ ID NO: 808311 - DNA, 25 bp, Mus musculus
tgccgctgaggagacctgtacacct

SEQ ID NO: 808312 - DNA, 25 bp, Mus musculus
tgccgctgctatcatcaccagaaat

SEQ ID NO: 808313 - DNA, 25 bp, Mus musculus
tgccgctgctatgatcaccagaaat

SEQ ID NO: 808314 - DNA, 25 bp, Mus musculus
tgccgctggaccaggtgtctcgagt

SEQ ID NO: 808315 - DNA, 25 bp, Mus musculus
tgccgctggacctggtgtctcgagt

SEQ ID NO: 808316 - DNA, 25 bp, Mus musculus
tgccgctggcctccagtcagatcag

SEQ ID NO: 808317 - DNA, 25 bp, Mus musculus
tgccgctggcctgcagtcagatcag

SEQ ID NO: 808318 - DNA, 25 bp, Mus musculus
tgccgctgtgcaacagcccatggct

SEQ ID NO: 808319 - DNA, 25 bp, Mus musculus
tgccgctgtgcatcagcccatggct

SEQ ID NO: 808320 - DNA, 25 bp, Mus musculus
tgccgctgttaccaagagaagcaga

SEQ ID NO: 808321 - DNA, 25 bp, Mus musculus
tgccgctgttacgaagagaagcaga

SEQ ID NO: 808322 - DNA, 25 bp, Mus musculus
tgccgcttatggcaagcctgtcttc

SEQ ID NO: 808323 - DNA, 25 bp, Mus musculus
tgccgcttatgggaagcctgtcttc

SEQ ID NO: 808324 - DNA, 25 bp, Mus musculus
tgccgcttccatactgaggactaca

SEQ ID NO: 808325 - DNA, 25 bp, Mus musculus
tgccgcttccattctgaggactaca

SEQ ID NO: 808326 - DNA, 25 bp, Mus musculus
tgccgcttctgcatcgtgaatcggg

SEQ ID NO: 808327 - DNA, 25 bp, Mus musculus
tgccgcttctgcttcgtgaatcggg

SEQ ID NO: 808328 - DNA, 25 bp, Mus musculus
tgccgcttgtcgagtacggttgtgt

SEQ ID NO: 808329 - DNA, 25 bp, Mus musculus
tgccgcttgtcgtgtacggttgtgt

SEQ ID NO: 808330 - DNA, 25 bp, Mus musculus
tgccgctttaccaatacaatagagt

SEQ ID NO: 808331 - DNA, 25 bp, Mus musculus
tgccgctttacctatacaatagagt

SEQ ID NO: 808332 - DNA, 25 bp, Mus musculus
tgccgctttgggaatcagatggatg

SEQ ID NO: 808333 - DNA, 25 bp, Mus musculus
tgccgctttgggtatcagatggatg

SEQ ID NO: 808334 - DNA, 25 bp, Mus musculus
tgccggaactacaaatggaccattt

SEQ ID NO: 808335 - DNA, 25 bp, Mus musculus
tgccggaactactaatggaccattt

SEQ ID NO: 808336 - DNA, 25 bp, Mus musculus
tgccggaagataaaggcgtcgacct

SEQ ID NO: 808337 - DNA, 25 bp, Mus musculus
tgccggaagatataggcgtcgacct

SEQ ID NO: 808338 - DNA, 25 bp, Mus musculus
tgccggaaggccagctttgagctct

SEQ ID NO: 808339 - DNA, 25 bp, Mus musculus
tgccggaaggcctgctttgagctct

SEQ ID NO: 808340 - DNA, 25 bp, Mus musculus
tgccggacgtggagaacctccgaaa

SEQ ID NO: 808341 - DNA, 25 bp, Mus musculus
tgccggacgtggtgaacctccgaaa

SEQ ID NO: 808342 - DNA, 25 bp, Mus musculus
tgccggagacccaggtcagcatctt

SEQ ID NO: 808343 - DNA, 25 bp, Mus musculus
tgccggagaccctggtcagcatctt

SEQ ID NO: 808344 - DNA, 25 bp, Mus musculus
tgccggagcattcgtgccctcatgg

SEQ ID NO: 808345 - DNA, 25 bp, Mus musculus
tgccggagcattggtgccctcatgg

SEQ ID NO: 808346 - DNA, 25 bp, Mus musculus
tgccggagccagacagacgctcgcg

SEQ ID NO: 808347 - DNA, 25 bp, Mus musculus
tgccggagccagtcagacgctcgcg

SEQ ID NO: 808348 - DNA, 25 bp, Mus musculus
tgccggaggtacagagcaggatcca

SEQ ID NO: 808349 - DNA, 25 bp, Mus musculus
tgccggaggtactgagcaggatcca

SEQ ID NO: 808350 - DNA, 25 bp, Mus musculus
tgccggatacaaagccagcagggac

SEQ ID NO: 808351 - DNA, 25 bp, Mus musculus
tgccggatacaatgccagcagggac

SEQ ID NO: 808352 - DNA, 25 bp, Mus musculus
tgccggatcacaactaactttgtca

SEQ ID NO: 808353 - DNA, 25 bp, Mus musculus
tgccggatcacatctaactttgtca

SEQ ID NO: 808354 - DNA, 25 bp, Mus musculus
tgccggcaactacatcaaagtgcag

SEQ ID NO: 808355 - DNA, 25 bp, Mus musculus
tgccggcaactagatcaaagtgcag

SEQ ID NO: 808356 - DNA, 25 bp, Mus musculus
tgccggcaagcacgattacaatcag

SEQ ID NO: 808357 - DNA, 25 bp, Mus musculus
tgccggcaagcaggattacaatcag

SEQ ID NO: 808358 - DNA, 25 bp, Mus musculus
tgccggcagtacagggcctgcgcct

SEQ ID NO: 808359 - DNA, 25 bp, Mus musculus
tgccggcagtactgggcctgcgcct

SEQ ID NO: 808360 - DNA, 25 bp, Mus musculus
tgccggccataaacgcagggatcca

SEQ ID NO: 808361 - DNA, 25 bp, Mus musculus
tgccggccataatcgcagggatcca

SEQ ID NO: 808362 - DNA, 25 bp, Mus musculus
tgccggccgtggcaactatgatgct

SEQ ID NO: 808363 - DNA, 25 bp, Mus musculus
tgccggccgtgggaactatgatgct

SEQ ID NO: 808364 - DNA, 25 bp, Mus musculus
tgccggccttagagaccagatccgt

SEQ ID NO: 808365 - DNA, 25 bp, Mus musculus
tgccggccttagtgaccagatccgt

SEQ ID NO: 808366 - DNA, 25 bp, Mus musculus
tgccggccttgtctgccatggacga

SEQ ID NO: 808367 - DNA, 25 bp, Mus musculus
tgccggccttgtgtgccatggacga

SEQ ID NO: 808368 - DNA, 25 bp, Mus musculus
tgccggcgggttcttcccgagactc

SEQ ID NO: 808369 - DNA, 25 bp, Mus musculus
tgccggcgggttgttcccgagactc

SEQ ID NO: 808370 - DNA, 25 bp, Mus musculus
tgccggcgtgacacgaagacacggc

SEQ ID NO: 808371 - DNA, 25 bp, Mus musculus
tgccggcgtgactcgaagacacggc

SEQ ID NO: 808372 - DNA, 25 bp, Mus musculus
tgccggctacttcgactgcaagtcc

SEQ ID NO: 808373 - DNA, 25 bp, Mus musculus
tgccggctacttggactgcaagtcc

SEQ ID NO: 808374 - DNA, 25 bp, Mus musculus
tgccggctctcaattcgcttgtaat

SEQ ID NO: 808375 - DNA, 25 bp, Mus musculus
tgccggctctcatttcgcttgtaat

SEQ ID NO: 808376 - DNA, 25 bp, Mus musculus
tgccggctgcagaccatgtatgaaa

SEQ ID NO: 808377 - DNA, 25 bp, Mus musculus
tgccggctgcagtccatgtatgaaa

SEQ ID NO: 808378 - DNA, 25 bp, Mus musculus
tgccggcttcccatgtagtgctcag

SEQ ID NO: 808379 - DNA, 25 bp, Mus musculus
tgccggcttcccttgtagtgctcag

SEQ ID NO: 808380 - DNA, 25 bp, Mus musculus
tgccggcttgcacacagatgatgta

SEQ ID NO: 808381 - DNA, 25 bp, Mus musculus
tgccggcttgcagacagatgatgta

SEQ ID NO: 808382 - DNA, 25 bp, Mus musculus
tgccggctttgacgaacacaagttc

SEQ ID NO: 808383 - DNA, 25 bp, Mus musculus
tgccggctttgaggaacacaagttc

SEQ ID NO: 808384 - DNA, 25 bp, Mus musculus
tgccgggaaaagcatgacaaagatc

SEQ ID NO: 808385 - DNA, 25 bp, Mus musculus
tgccgggaaaaggatgacaaagatc

SEQ ID NO: 808386 - DNA, 25 bp, Mus musculus
tgccgggagacacctcaacaacctg

SEQ ID NO: 808387 - DNA, 25 bp, Mus musculus
tgccgggagacagctcaacaacctg

SEQ ID NO: 808388 - DNA, 25 bp, Mus musculus
tgccgggagcccattctggcaagtg

SEQ ID NO: 808389 - DNA, 25 bp, Mus musculus
tgccgggagccctttctggcaagtg

SEQ ID NO: 808390 - DNA, 25 bp, Mus musculus
tgccgggagcggaacatattgttca

SEQ ID NO: 808391 - DNA, 25 bp, Mus musculus
tgccgggagcggtacatattgttca

SEQ ID NO: 808392 - DNA, 25 bp, Mus musculus
tgccgggagggcatctatcgtgatc

SEQ ID NO: 808393 - DNA, 25 bp, Mus musculus
tgccgggagggcttctatcgtgatc

SEQ ID NO: 808394 - DNA, 25 bp, Mus musculus
tgccgggtactcaggtccccaagcg

SEQ ID NO: 808395 - DNA, 25 bp, Mus musculus
tgccgggtactctggtccccaagcg

SEQ ID NO: 808396 - DNA, 25 bp, Mus musculus
tgccgggtatctacaccagagtttt

SEQ ID NO: 808397 - DNA, 25 bp, Mus musculus
tgccgggtatcttcaccagagtttt

SEQ ID NO: 808398 - DNA, 25 bp, Mus musculus
tgccgggtgggcagacaaaatccag

SEQ ID NO: 808399 - DNA, 25 bp, Mus musculus
tgccgggtgggctgacaaaatccag

SEQ ID NO: 808400 - DNA, 25 bp, Mus musculus
tgccggtacatcagtggcaaacgag

SEQ ID NO: 808401 - DNA, 25 bp, Mus musculus
tgccggtacatctgtggcaaacgag

SEQ ID NO: 808402 - DNA, 25 bp, Mus musculus
tgccggtcctcacagatgggactcg

SEQ ID NO: 808403 - DNA, 25 bp, Mus musculus
tgccggtcctcagagatgggactcg

SEQ ID NO: 808404 - DNA, 25 bp, Mus musculus
tgccggtctccccaaagtgttgagc

SEQ ID NO: 808405 - DNA, 25 bp, Mus musculus
tgccggtctcccgaaagtgttgagc

SEQ ID NO: 808406 - DNA, 25 bp, Mus musculus
tgccggtctggaccactcgaacctg

SEQ ID NO: 808407 - DNA, 25 bp, Mus musculus
tgccggtctggagcactcgaacctg

SEQ ID NO: 808408 - DNA, 25 bp, Mus musculus
tgccggtgaagaagattggcgacat

SEQ ID NO: 808409 - DNA, 25 bp, Mus musculus
tgccggtgaagatgattggcgacat

SEQ ID NO: 808410 - DNA, 25 bp, Mus musculus
tgccggtggccccaataacaaatag

SEQ ID NO: 808411 - DNA, 25 bp, Mus musculus
tgccggtggcccgaataacaaatag

SEQ ID NO: 808412 - DNA, 25 bp, Mus musculus
tgccggtgtgatactgtatgcagcc

SEQ ID NO: 808413 - DNA, 25 bp, Mus musculus
tgccggtgtgattctgtatgcagcc

SEQ ID NO: 808414 - DNA, 25 bp, Mus musculus
tgccggttcggtccgtaacagccca

SEQ ID NO: 808415 - DNA, 25 bp, Mus musculus
tgccggttcggtgcgtaacagccca

SEQ ID NO: 808416 - DNA, 25 bp, Mus musculus
tgccggttcttccagagccacatcg

SEQ ID NO: 808417 - DNA, 25 bp, Mus musculus
tgccggttcttcgagagccacatcg

SEQ ID NO: 808418 - DNA, 25 bp, Mus musculus
tgccgtaccttgactccaatgtcat

SEQ ID NO: 808419 - DNA, 25 bp, Mus musculus
tgccgtaccttgtctccaatgtcat

SEQ ID NO: 808420 - DNA, 25 bp, Mus musculus
tgccgtacgtagcttgtccggttac

SEQ ID NO: 808421 - DNA, 25 bp, Mus musculus
tgccgtacgtaggttgtccggttac

SEQ ID NO: 808422 - DNA, 25 bp, Mus musculus
tgccgtagcaaacacctgagaagct

SEQ ID NO: 808423 - DNA, 25 bp, Mus musculus
tgccgtagcaaagacctgagaagct

SEQ ID NO: 808424 - DNA, 25 bp, Mus musculus
tgccgtattgttccccagtctcacg

SEQ ID NO: 808425 - DNA, 25 bp, Mus musculus
tgccgtattgttgcccagtctcacg

SEQ ID NO: 808426 - DNA, 25 bp, Mus musculus
tgccgtcacaggaggcagtgacatt

SEQ ID NO: 808427 - DNA, 25 bp, Mus musculus
tgccgtcacaggtggcagtgacatt

SEQ ID NO: 808428 - DNA, 25 bp, Mus musculus
tgccgtcagctgaagccaaattaaa

SEQ ID NO: 808429 - DNA, 25 bp, Mus musculus
tgccgtcagctgtagccaaattaaa

SEQ ID NO: 808430 - DNA, 25 bp, Mus musculus
tgccgtcagggcaaccagctggcag

SEQ ID NO: 808431 - DNA, 25 bp, Mus musculus
tgccgtcagggctaccagctggcag

SEQ ID NO: 808432 - DNA, 25 bp, Mus musculus
tgccgtccaaacatgaagccttcaa

SEQ ID NO: 808433 - DNA, 25 bp, Mus musculus
tgccgtccaaacttgaagccttcaa

SEQ ID NO: 808434 - DNA, 25 bp, Mus musculus
tgccgtccaggtaggaagccaactt

SEQ ID NO: 808435 - DNA, 25 bp, Mus musculus
tgccgtccaggtccaaccagtgtgt

SEQ ID NO: 808436 - DNA, 25 bp, Mus musculus
tgccgtccaggtgcaaccagtgtgt

SEQ ID NO: 808437 - DNA, 25 bp, Mus musculus
tgccgtccaggttggaagccaactt

SEQ ID NO: 808438 - DNA, 25 bp, Mus musculus
tgccgtcccttgcatcagctggcta

SEQ ID NO: 808439 - DNA, 25 bp, Mus musculus
tgccgtcccttggatcagctggcta

SEQ ID NO: 808440 - DNA, 25 bp, Mus musculus
tgccgtcgggtgactgctccctcag

SEQ ID NO: 808441 - DNA, 25 bp, Mus musculus
tgccgtcgggtgtctgctccctcag

SEQ ID NO: 808442 - DNA, 25 bp, Mus musculus
tgccgtcgggttaccagcagatcgg

SEQ ID NO: 808443 - DNA, 25 bp, Mus musculus
tgccgtcgggtttccagcagatcgg

SEQ ID NO: 808444 - DNA, 25 bp, Mus musculus
tgccgtcggtggacctggatagtct

SEQ ID NO: 808445 - DNA, 25 bp, Mus musculus
tgccgtcggtggtcctggatagtct

SEQ ID NO: 808446 - DNA, 25 bp, Mus musculus
tgccgtcgtccacagcacatgatgt

SEQ ID NO: 808447 - DNA, 25 bp, Mus musculus
tgccgtcgtccagagcacatgatgt

SEQ ID NO: 808448 - DNA, 25 bp, Mus musculus
tgccgtcgtcggaagcagcgcttga

SEQ ID NO: 808449 - DNA, 25 bp, Mus musculus
tgccgtcgtcggtagcagcgcttga

SEQ ID NO: 808450 - DNA, 25 bp, Mus musculus
tgccgtctgcatcgcggtcaatagt

SEQ ID NO: 808451 - DNA, 25 bp, Mus musculus
tgccgtctgcatggcggtcaatagt

SEQ ID NO: 808452 - DNA, 25 bp, Mus musculus
tgccgtcttacaacttgcttttcag

SEQ ID NO: 808453 - DNA, 25 bp, Mus musculus
tgccgtcttacatcttgcttttcag

SEQ ID NO: 808454 - DNA, 25 bp, Mus musculus
tgccgtgagcaactccatgggtact

SEQ ID NO: 808455 - DNA, 25 bp, Mus musculus
tgccgtgagcaagtccatgggtact

SEQ ID NO: 808456 - DNA, 25 bp, Mus musculus
tgccgtgcagacagtggtccgccag

SEQ ID NO: 808457 - DNA, 25 bp, Mus musculus
tgccgtgcagactgtggtccgccag

SEQ ID NO: 808458 - DNA, 25 bp, Mus musculus
tgccgtgcccaccaattagtgatgg

SEQ ID NO: 808459 - DNA, 25 bp, Mus musculus
tgccgtgcccacgaattagtgatgg

SEQ ID NO: 808460 - DNA, 25 bp, Mus musculus
tgccgtgcctggactcactccatgt

SEQ ID NO: 808461 - DNA, 25 bp, Mus musculus
tgccgtgcctggtctcactccatgt

SEQ ID NO: 808462 - DNA, 25 bp, Mus musculus
tgccgtgcggatccccattggtgtc

SEQ ID NO: 808463 - DNA, 25 bp, Mus musculus
tgccgtgcggatgcccattggtgtc

SEQ ID NO: 808464 - DNA, 25 bp, Mus musculus
tgccgtgcgttgcagccaagatcta

SEQ ID NO: 808465 - DNA, 25 bp, Mus musculus
tgccgtgcgttggagccaagatcta

SEQ ID NO: 808466 - DNA, 25 bp, Mus musculus
tgccgtgctgctacaggtgatccaa

SEQ ID NO: 808467 - DNA, 25 bp, Mus musculus
tgccgtgctgcttcaggtgatccaa

SEQ ID NO: 808468 - DNA, 25 bp, Mus musculus
tgccgtggaatgagtccagcatctt

SEQ ID NO: 808469 - DNA, 25 bp, Mus musculus
tgccgtggaatgtgtccagcatctt

SEQ ID NO: 808470 - DNA, 25 bp, Mus musculus
tgccgtggcccgagaaaatgctggc

SEQ ID NO: 808471 - DNA, 25 bp, Mus musculus
tgccgtggcccgtgaaaatgctggc

SEQ ID NO: 808472 - DNA, 25 bp, Mus musculus
tgccgtggccggctctgcatctctg

SEQ ID NO: 808473 - DNA, 25 bp, Mus musculus
tgccgtggccgggtctgcatctctg

SEQ ID NO: 808474 - DNA, 25 bp, Mus musculus
tgccgtggcgacactgctaagcagc

SEQ ID NO: 808475 - DNA, 25 bp, Mus musculus
tgccgtggcgactctgctaagcagc

SEQ ID NO: 808476 - DNA, 25 bp, Mus musculus
tgccgtggcttcaaccaggacgggc

SEQ ID NO: 808477 - DNA, 25 bp, Mus musculus
tgccgtggcttctaccaggacgggc

SEQ ID NO: 808478 - DNA, 25 bp, Mus musculus
tgccgtggtctgactgcccactgaa

SEQ ID NO: 808479 - DNA, 25 bp, Mus musculus
tgccgtggtctgtctgcccactgaa

SEQ ID NO: 808480 - DNA, 25 bp, Mus musculus
tgccgtgtgataacagagtttgtaa

SEQ ID NO: 808481 - DNA, 25 bp, Mus musculus
tgccgtgtgatatcagagtttgtaa

SEQ ID NO: 808482 - DNA, 25 bp, Mus musculus
tgccgtgtggtgatctacctgcagc

SEQ ID NO: 808483 - DNA, 25 bp, Mus musculus
tgccgtgtggtgttctacctgcagc

SEQ ID NO: 808484 - DNA, 25 bp, Mus musculus
tgccgttacattcaggagaaacagc

SEQ ID NO: 808485 - DNA, 25 bp, Mus musculus
tgccgttacattgaggagaaacagc

SEQ ID NO: 808486 - DNA, 25 bp, Mus musculus
tgccgttaccggacacacagtgtgt

SEQ ID NO: 808487 - DNA, 25 bp, Mus musculus
tgccgttaccggtcacacagtgtgt

SEQ ID NO: 808488 - DNA, 25 bp, Mus musculus
tgccgttccaacacttcttggatct

SEQ ID NO: 808489 - DNA, 25 bp, Mus musculus
tgccgttccaactcttcttggatct

SEQ ID NO: 808490 - DNA, 25 bp, Mus musculus
tgccgttcccaacaccgtgggtgct

SEQ ID NO: 808491 - DNA, 25 bp, Mus musculus
tgccgttcccaagaccgtgggtgct

SEQ ID NO: 808492 - DNA, 25 bp, Mus musculus
tgccgttcctacagatccccatgga

SEQ ID NO: 808493 - DNA, 25 bp, Mus musculus
tgccgttcctactgatccccatgga

SEQ ID NO: 808494 - DNA, 25 bp, Mus musculus
tgccgttcgcctacattatggactg

SEQ ID NO: 808495 - DNA, 25 bp, Mus musculus
tgccgttcgccttcattatggactg

SEQ ID NO: 808496 - DNA, 25 bp, Mus musculus
tgccgttgcttacccagaaagcggt

SEQ ID NO: 808497 - DNA, 25 bp, Mus musculus
tgccgttgcttagccagaaagcggt

SEQ ID NO: 808498 - DNA, 25 bp, Mus musculus
tgccgtttaaaacagcctggctgct

SEQ ID NO: 808499 - DNA, 25 bp, Mus musculus
tgccgtttaaaagagcctggctgct

SEQ ID NO: 808500 - DNA, 25 bp, Mus musculus
tgcctaaaactaccacctcaggtga

SEQ ID NO: 808501 - DNA, 25 bp, Mus musculus
tgcctaaaactagcacctcaggtga

SEQ ID NO: 808502 - DNA, 25 bp, Mus musculus
tgcctaaaccacctaatgaaatata

SEQ ID NO: 808503 - DNA, 25 bp, Mus musculus
tgcctaaaccacgtaatgaaatata

SEQ ID NO: 808504 - DNA, 25 bp, Mus musculus
tgcctaaacgctatgacccatgggt

SEQ ID NO: 808505 - DNA, 25 bp, Mus musculus
tgcctaaacgctttgacccatgggt

SEQ ID NO: 808506 - DNA, 25 bp, Mus musculus
tgcctaacggagagaccccatcgtg

SEQ ID NO: 808507 - DNA, 25 bp, Mus musculus
tgcctaacggagtgaccccatcgtg

SEQ ID NO: 808508 - DNA, 25 bp, Mus musculus
tgcctaactgcactgagaaccactt

SEQ ID NO: 808509 - DNA, 25 bp, Mus musculus
tgcctaactgcagtgagaaccactt

SEQ ID NO: 808510 - DNA, 25 bp, Mus musculus
tgcctacaacaaaaggcaggagttt

SEQ ID NO: 808511 - DNA, 25 bp, Mus musculus
tgcctacaacaataggcaggagttt

SEQ ID NO: 808512 - DNA, 25 bp, Mus musculus
tgcctacaagagcaccattggcagg

SEQ ID NO: 808513 - DNA, 25 bp, Mus musculus
tgcctacaagaggaccattggcagg

SEQ ID NO: 808514 - DNA, 25 bp, Mus musculus
tgcctacagaaaattcgagacatga

SEQ ID NO: 808515 - DNA, 25 bp, Mus musculus
tgcctacagaaatttcgagacatga

SEQ ID NO: 808516 - DNA, 25 bp, Mus musculus
tgcctacagacgctgcgaccgcaat

SEQ ID NO: 808517 - DNA, 25 bp, Mus musculus
tgcctacagacggtgcgaccgcaat

SEQ ID NO: 808518 - DNA, 25 bp, Mus musculus
tgcctacagtgacaacagcctggat

SEQ ID NO: 808519 - DNA, 25 bp, Mus musculus
tgcctacagtgagaacagcctggat

SEQ ID NO: 808520 - DNA, 25 bp, Mus musculus
tgcctacatcaaactggaagacaaa

SEQ ID NO: 808521 - DNA, 25 bp, Mus musculus
tgcctacatcaatctggaagacaaa

SEQ ID NO: 808522 - DNA, 25 bp, Mus musculus
tgcctacatcttagagaagttctcc

SEQ ID NO: 808523 - DNA, 25 bp, Mus musculus
tgcctacatcttccagcctgatatg

SEQ ID NO: 808524 - DNA, 25 bp, Mus musculus
tgcctacatcttgcagcctgatatg

SEQ ID NO: 808525 - DNA, 25 bp, Mus musculus
tgcctacatctttgagaagttctcc

SEQ ID NO: 808526 - DNA, 25 bp, Mus musculus
tgcctacatgagcatgaagtacccc

SEQ ID NO: 808527 - DNA, 25 bp, Mus musculus
tgcctacatgaggatgaagtacccc

SEQ ID NO: 808528 - DNA, 25 bp, Mus musculus
tgcctacatttaaatgtctctaagc

SEQ ID NO: 808529 - DNA, 25 bp, Mus musculus
tgcctacatttatatgtctctaagc

SEQ ID NO: 808530 - DNA, 25 bp, Mus musculus
tgcctaccaggtccggctgtgcaaa

SEQ ID NO: 808531 - DNA, 25 bp, Mus musculus
tgcctaccaggtgcggctgtgcaaa

SEQ ID NO: 808532 - DNA, 25 bp, Mus musculus
tgcctaccatccactggctcaagga

SEQ ID NO: 808533 - DNA, 25 bp, Mus musculus
tgcctaccatcctctggctcaagga

SEQ ID NO: 808534 - DNA, 25 bp, Mus musculus
tgcctacccaaaagctgtaaccatg

SEQ ID NO: 808535 - DNA, 25 bp, Mus musculus
tgcctacccaaatgctgtaaccatg

SEQ ID NO: 808536 - DNA, 25 bp, Mus musculus
tgcctaccctaacactctggaggac

SEQ ID NO: 808537 - DNA, 25 bp, Mus musculus
tgcctaccctaagactctggaggac

SEQ ID NO: 808538 - DNA, 25 bp, Mus musculus
tgcctaccgtgcaagccatcaagaa

SEQ ID NO: 808539 - DNA, 25 bp, Mus musculus
tgcctaccgtgctagccatcaagaa

SEQ ID NO: 808540 - DNA, 25 bp, Mus musculus
tgcctacgctcgagaaaagaatgcc

SEQ ID NO: 808541 - DNA, 25 bp, Mus musculus
tgcctacgctcgtgaaaagaatgcc

SEQ ID NO: 808542 - DNA, 25 bp, Mus musculus
tgcctacgtgagagagaggagtccc

SEQ ID NO: 808543 - DNA, 25 bp, Mus musculus
tgcctacgtgagtgagaggagtccc

SEQ ID NO: 808544 - DNA, 25 bp, Mus musculus
tgcctactatctccccaacaagaat

SEQ ID NO: 808545 - DNA, 25 bp, Mus musculus
tgcctactatctgcccaacaagaat

SEQ ID NO: 808546 - DNA, 25 bp, Mus musculus
tgcctactctgcactgtggtggtct

SEQ ID NO: 808547 - DNA, 25 bp, Mus musculus
tgcctactctgctctgtggtggtct

SEQ ID NO: 808548 - DNA, 25 bp, Mus musculus
tgcctactgccgaaacaatttaaat

SEQ ID NO: 808549 - DNA, 25 bp, Mus musculus
tgcctactgccgtaacaatttaaat

SEQ ID NO: 808550 - DNA, 25 bp, Mus musculus
tgcctactgcctccatattgctgag

SEQ ID NO: 808551 - DNA, 25 bp, Mus musculus
tgcctactgcctgcatattgctgag

SEQ ID NO: 808552 - DNA, 25 bp, Mus musculus
tgcctactgctacaagctgaaggga

SEQ ID NO: 808553 - DNA, 25 bp, Mus musculus
tgcctactgctagaagctgaaggga

SEQ ID NO: 808554 - DNA, 25 bp, Mus musculus
tgcctactggttccctggctctgcg

SEQ ID NO: 808555 - DNA, 25 bp, Mus musculus
tgcctactggttgcctggctctgcg

SEQ ID NO: 808556 - DNA, 25 bp, Mus musculus
tgcctacttcctctgcttgcttaga

SEQ ID NO: 808557 - DNA, 25 bp, Mus musculus
tgcctacttcctgtgcttgcttaga

SEQ ID NO: 808558 - DNA, 25 bp, Mus musculus
tgcctactttggatgccaatgaccc

SEQ ID NO: 808559 - DNA, 25 bp, Mus musculus
tgcctactttggttgccaatgaccc

SEQ ID NO: 808560 - DNA, 25 bp, Mus musculus
tgcctacttttaacttcgaacacat

SEQ ID NO: 808561 - DNA, 25 bp, Mus musculus
tgcctacttttatcttcgaacacat

SEQ ID NO: 808562 - DNA, 25 bp, Mus musculus
tgcctagacctaagaagtcctgccg

SEQ ID NO: 808563 - DNA, 25 bp, Mus musculus
tgcctagacctatgaagtcctgccg

SEQ ID NO: 808564 - DNA, 25 bp, Mus musculus
tgcctagactggagaagctcttcaa

SEQ ID NO: 808565 - DNA, 25 bp, Mus musculus
tgcctagactggtgaagctcttcaa

SEQ ID NO: 808566 - DNA, 25 bp, Mus musculus
tgcctagcatgtatcagtccctgag

SEQ ID NO: 808567 - DNA, 25 bp, Mus musculus
tgcctagcatgtttcagtccctgag

SEQ ID NO: 808568 - DNA, 25 bp, Mus musculus
tgcctagccttcacatgtgtggata

SEQ ID NO: 808569 - DNA, 25 bp, Mus musculus
tgcctagccttctcatgtgtggata

SEQ ID NO: 808570 - DNA, 25 bp, Mus musculus
tgcctaggaaatcctccttggtacc

SEQ ID NO: 808571 - DNA, 25 bp, Mus musculus
tgcctaggaaatgctccttggtacc

SEQ ID NO: 808572 - DNA, 25 bp, Mus musculus
tgcctaggaaggacctgtttgtcgg

SEQ ID NO: 808573 - DNA, 25 bp, Mus musculus
tgcctaggaaggtcctgtttgtcgg

SEQ ID NO: 808574 - DNA, 25 bp, Mus musculus
tgcctaggccaccatggagtcacag

SEQ ID NO: 808575 - DNA, 25 bp, Mus musculus
tgcctaggccacgatggagtcacag

SEQ ID NO: 808576 - DNA, 25 bp, Mus musculus
tgcctaggctctaggtcaatcatcc

SEQ ID NO: 808577 - DNA, 25 bp, Mus musculus
tgcctaggctcttggtcaatcatcc

SEQ ID NO: 808578 - DNA, 25 bp, Mus musculus
tgcctaggtcctagcagggaacttg

SEQ ID NO: 808579 - DNA, 25 bp, Mus musculus
tgcctaggtccttgcagggaacttg

SEQ ID NO: 808580 - DNA, 25 bp, Mus musculus
tgcctagtgacaccaagcggtctct

SEQ ID NO: 808581 - DNA, 25 bp, Mus musculus
tgcctagtgacagcaagcggtctct

SEQ ID NO: 808582 - DNA, 25 bp, Mus musculus
tgcctagtggccattggcaggctgc

SEQ ID NO: 808583 - DNA, 25 bp, Mus musculus
tgcctagtggcctttggcaggctgc

SEQ ID NO: 808584 - DNA, 25 bp, Mus musculus
tgcctataatctcctgtgattccct

SEQ ID NO: 808585 - DNA, 25 bp, Mus musculus
tgcctataatctgctgtgattccct

SEQ ID NO: 808586 - DNA, 25 bp, Mus musculus
tgcctataccctcagcggagctgac

SEQ ID NO: 808587 - DNA, 25 bp, Mus musculus
tgcctataccctgagcggagctgac

SEQ ID NO: 808588 - DNA, 25 bp, Mus musculus
tgcctatagcatattgtgggacttg

SEQ ID NO: 808589 - DNA, 25 bp, Mus musculus
tgcctatagcattttgtgggacttg

SEQ ID NO: 808590 - DNA, 25 bp, Mus musculus
tgcctatatgccacctgatgatcag

SEQ ID NO: 808591 - DNA, 25 bp, Mus musculus
tgcctatatgcctcctgatgatcag

SEQ ID NO: 808592 - DNA, 25 bp, Mus musculus
tgcctatcaagtaagagagacttct

SEQ ID NO: 808593 - DNA, 25 bp, Mus musculus
tgcctatcaagttagagagacttct

SEQ ID NO: 808594 - DNA, 25 bp, Mus musculus
tgcctatcagcacgattgtgtgtct

SEQ ID NO: 808595 - DNA, 25 bp, Mus musculus
tgcctatcagcaggattgtgtgtct

SEQ ID NO: 808596 - DNA, 25 bp, Mus musculus
tgcctatcgaaacctgctggagggc

SEQ ID NO: 808597 - DNA, 25 bp, Mus musculus
tgcctatcgaaagctgctggagggc

SEQ ID NO: 808598 - DNA, 25 bp, Mus musculus
tgcctatcgagcacatggcttcacc

SEQ ID NO: 808599 - DNA, 25 bp, Mus musculus
tgcctatcgagctcatggcttcacc

SEQ ID NO: 808600 - DNA, 25 bp, Mus musculus
tgcctatgattacaacaaggctcgg

SEQ ID NO: 808601 - DNA, 25 bp, Mus musculus
tgcctatgattagaacaaggctcgg

SEQ ID NO: 808602 - DNA, 25 bp, Mus musculus
tgcctatgcaaaacggtctcagagg

SEQ ID NO: 808603 - DNA, 25 bp, Mus musculus
tgcctatgcaaatcggtctcagagg

SEQ ID NO: 808604 - DNA, 25 bp, Mus musculus
tgcctatgccagacacagggctgcg

SEQ ID NO: 808605 - DNA, 25 bp, Mus musculus
tgcctatgccagtcacagggctgcg

SEQ ID NO: 808606 - DNA, 25 bp, Mus musculus
tgcctatggagtctatggccagcca

SEQ ID NO: 808607 - DNA, 25 bp, Mus musculus
tgcctatggagtgtatggccagcca

SEQ ID NO: 808608 - DNA, 25 bp, Mus musculus
tgcctatggatgccctcatgccctt

SEQ ID NO: 808609 - DNA, 25 bp, Mus musculus
tgcctatggatggcctcatgccctt

SEQ ID NO: 808610 - DNA, 25 bp, Mus musculus
tgcctatggcccagtctgtggctgt

SEQ ID NO: 808611 - DNA, 25 bp, Mus musculus
tgcctatggccctgtctgtggctgt

SEQ ID NO: 808612 - DNA, 25 bp, Mus musculus
tgcctatggtacatacccggattac

SEQ ID NO: 808613 - DNA, 25 bp, Mus musculus
tgcctatggtacttacccggattac

SEQ ID NO: 808614 - DNA, 25 bp, Mus musculus
tgcctatggtagaggaaggtgaacc

SEQ ID NO: 808615 - DNA, 25 bp, Mus musculus
tgcctatggtagtggaaggtgaacc

SEQ ID NO: 808616 - DNA, 25 bp, Mus musculus
tgcctattatgaacagactggtgcc

SEQ ID NO: 808617 - DNA, 25 bp, Mus musculus
tgcctattatgatcagactggtgcc

SEQ ID NO: 808618 - DNA, 25 bp, Mus musculus
tgcctcaaaagcaagggtttattgt

SEQ ID NO: 808619 - DNA, 25 bp, Mus musculus
tgcctcaaaagctagggtttattgt

SEQ ID NO: 808620 - DNA, 25 bp, Mus musculus
tgcctcaacagaaccccaagggtct

SEQ ID NO: 808621 - DNA, 25 bp, Mus musculus
tgcctcaacagatccccaagggtct

SEQ ID NO: 808622 - DNA, 25 bp, Mus musculus
tgcctcaacgccagcctgtgtgtgg

SEQ ID NO: 808623 - DNA, 25 bp, Mus musculus
tgcctcaacgcctgcctgtgtgtgg

SEQ ID NO: 808624 - DNA, 25 bp, Mus musculus
tgcctcaactttaccagtgcctgcg

SEQ ID NO: 808625 - DNA, 25 bp, Mus musculus
tgcctcaacttttccagtgcctgcg

SEQ ID NO: 808626 - DNA, 25 bp, Mus musculus
tgcctcaaggagacgacagaggaga

SEQ ID NO: 808627 - DNA, 25 bp, Mus musculus
tgcctcaaggagtcgacagaggaga

SEQ ID NO: 808628 - DNA, 25 bp, Mus musculus
tgcctcaaggccctctgagaaatgt

SEQ ID NO: 808629 - DNA, 25 bp, Mus musculus
tgcctcaaggccgtctgagaaatgt

SEQ ID NO: 808630 - DNA, 25 bp, Mus musculus
tgcctcaagtgacaaggccgtcggt

SEQ ID NO: 808631 - DNA, 25 bp, Mus musculus
tgcctcaagtgagaaggccgtcggt

SEQ ID NO: 808632 - DNA, 25 bp, Mus musculus
tgcctcaccacacggctgaaaagag

SEQ ID NO: 808633 - DNA, 25 bp, Mus musculus
tgcctcaccacagggctgaaaagag

SEQ ID NO: 808634 - DNA, 25 bp, Mus musculus
tgcctcaccagacagcagtgggtcc

SEQ ID NO: 808635 - DNA, 25 bp, Mus musculus
tgcctcaccagagagcagtgggtcc

SEQ ID NO: 808636 - DNA, 25 bp, Mus musculus
tgcctcacggtgagtcctacttgcc

SEQ ID NO: 808637 - DNA, 25 bp, Mus musculus
tgcctcacggtgtgtcctacttgcc

SEQ ID NO: 808638 - DNA, 25 bp, Mus musculus
tgcctcagacttacactacgataaa

SEQ ID NO: 808639 - DNA, 25 bp, Mus musculus
tgcctcagactttcactacgataaa

SEQ ID NO: 808640 - DNA, 25 bp, Mus musculus
tgcctcagagaaatgagatgtacct

SEQ ID NO: 808641 - DNA, 25 bp, Mus musculus
tgcctcagagaattgagatgtacct

SEQ ID NO: 808642 - DNA, 25 bp, Mus musculus
tgcctcagcgcgctctttccttttg

SEQ ID NO: 808643 - DNA, 25 bp, Mus musculus
tgcctcagcgcggtctttccttttg

SEQ ID NO: 808644 - DNA, 25 bp, Mus musculus
tgcctcagcgttcaaccgaataaaa

SEQ ID NO: 808645 - DNA, 25 bp, Mus musculus
tgcctcagcgttgaaccgaataaaa

SEQ ID NO: 808646 - DNA, 25 bp, Mus musculus
tgcctcaggagtatcagcaaagtct

SEQ ID NO: 808647 - DNA, 25 bp, Mus musculus
tgcctcaggagtttcagcaaagtct

SEQ ID NO: 808648 - DNA, 25 bp, Mus musculus
tgcctcagtactcgagtgcagagct

SEQ ID NO: 808649 - DNA, 25 bp, Mus musculus
tgcctcagtactggagtgcagagct

SEQ ID NO: 808650 - DNA, 25 bp, Mus musculus
tgcctcagtagacagcgacttacgg

SEQ ID NO: 808651 - DNA, 25 bp, Mus musculus
tgcctcagtagagagcgacttacgg

SEQ ID NO: 808652 - DNA, 25 bp, Mus musculus
tgcctcagtcagaagacgttcctgt

SEQ ID NO: 808653 - DNA, 25 bp, Mus musculus
tgcctcagtcagtagacgttcctgt

SEQ ID NO: 808654 - DNA, 25 bp, Mus musculus
tgcctcatcaccatcctgctggccg

SEQ ID NO: 808655 - DNA, 25 bp, Mus musculus
tgcctcatcaccttcctgctggccg

SEQ ID NO: 808656 - DNA, 25 bp, Mus musculus
tgcctcatcaggatccagaaagaga

SEQ ID NO: 808657 - DNA, 25 bp, Mus musculus
tgcctcatcaggttccagaaagaga

SEQ ID NO: 808658 - DNA, 25 bp, Mus musculus
tgcctcatccaacagcagatgaaga

SEQ ID NO: 808659 - DNA, 25 bp, Mus musculus
tgcctcatccaagagcagatgaaga

SEQ ID NO: 808660 - DNA, 25 bp, Mus musculus
tgcctcatctggaactgctgcctac

SEQ ID NO: 808661 - DNA, 25 bp, Mus musculus
tgcctcatctggtactgctgcctac

SEQ ID NO: 808662 - DNA, 25 bp, Mus musculus
tgcctcattaacattcaacaacagc

SEQ ID NO: 808663 - DNA, 25 bp, Mus musculus
tgcctcattaactttcaacaacagc

SEQ ID NO: 808664 - DNA, 25 bp, Mus musculus
tgcctccaaggcacagtgagctgag

SEQ ID NO: 808665 - DNA, 25 bp, Mus musculus
tgcctccaaggctcagtgagctgag

SEQ ID NO: 808666 - DNA, 25 bp, Mus musculus
tgcctccacatccaagcgttatggc

SEQ ID NO: 808667 - DNA, 25 bp, Mus musculus
tgcctccacatcgaagcgttatggc

SEQ ID NO: 808668 - DNA, 25 bp, Mus musculus
tgcctccagaaaagccagttcaagc

SEQ ID NO: 808669 - DNA, 25 bp, Mus musculus
tgcctccagaaatgccagttcaagc

SEQ ID NO: 808670 - DNA, 25 bp, Mus musculus
tgcctccagaagacgactggcctcg

SEQ ID NO: 808671 - DNA, 25 bp, Mus musculus
tgcctccagaagtcgactggcctcg

SEQ ID NO: 808672 - DNA, 25 bp, Mus musculus
tgcctccagaggagggtaacatgct

SEQ ID NO: 808673 - DNA, 25 bp, Mus musculus
tgcctccagaggtgggtaacatgct

SEQ ID NO: 808674 - DNA, 25 bp, Mus musculus
tgcctccagcaacgaacatgcatgt

SEQ ID NO: 808675 - DNA, 25 bp, Mus musculus
tgcctccagcaaggaacatgcatgt

SEQ ID NO: 808676 - DNA, 25 bp, Mus musculus
tgcctccagcggaaactccagcaat

SEQ ID NO: 808677 - DNA, 25 bp, Mus musculus
tgcctccagcggtaactccagcaat

SEQ ID NO: 808678 - DNA, 25 bp, Mus musculus
tgcctccagctacgaagagtgccgg

SEQ ID NO: 808679 - DNA, 25 bp, Mus musculus
tgcctccagctactcagcaaaggtg

SEQ ID NO: 808680 - DNA, 25 bp, Mus musculus
tgcctccagctaggaagagtgccgg

SEQ ID NO: 808681 - DNA, 25 bp, Mus musculus
tgcctccagctagtcagcaaaggtg

SEQ ID NO: 808682 - DNA, 25 bp, Mus musculus
tgcctccagggcaatgttcgaatct

SEQ ID NO: 808683 - DNA, 25 bp, Mus musculus
tgcctccagggctatgttcgaatct

SEQ ID NO: 808684 - DNA, 25 bp, Mus musculus
tgcctcccatggcactccagctggc

SEQ ID NO: 808685 - DNA, 25 bp, Mus musculus
tgcctcccatgggactccagctggc

SEQ ID NO: 808686 - DNA, 25 bp, Mus musculus
tgcctcccggcgagccagtgataaa

SEQ ID NO: 808687 - DNA, 25 bp, Mus musculus
tgcctcccggcgtgccagtgataaa

SEQ ID NO: 808688 - DNA, 25 bp, Mus musculus
tgcctccctggacgcctttgttttt

SEQ ID NO: 808689 - DNA, 25 bp, Mus musculus
tgcctccctggaggcctttgttttt

SEQ ID NO: 808690 - DNA, 25 bp, Mus musculus
tgcctccctgttcagttggctctac

SEQ ID NO: 808691 - DNA, 25 bp, Mus musculus
tgcctccctgttgagttggctctac

SEQ ID NO: 808692 - DNA, 25 bp, Mus musculus
tgcctccgaaggaccccgagaggag

SEQ ID NO: 808693 - DNA, 25 bp, Mus musculus
tgcctccgaaggtccccgagaggag

SEQ ID NO: 808694 - DNA, 25 bp, Mus musculus
tgcctccggtgccagcgttttcatc

SEQ ID NO: 808695 - DNA, 25 bp, Mus musculus
tgcctccggtgcgagcgttttcatc

SEQ ID NO: 808696 - DNA, 25 bp, Mus musculus
tgcctcctcaacagtgccattggca

SEQ ID NO: 808697 - DNA, 25 bp, Mus musculus
tgcctcctcaactgtgccattggca

SEQ ID NO: 808698 - DNA, 25 bp, Mus musculus
tgcctcctcagcctgtggtcctgat

SEQ ID NO: 808699 - DNA, 25 bp, Mus musculus
tgcctcctcagcgtgtggtcctgat

SEQ ID NO: 808700 - DNA, 25 bp, Mus musculus
tgcctcctctgcactagtgggaagt

SEQ ID NO: 808701 - DNA, 25 bp, Mus musculus
tgcctcctctgctctagtgggaagt

SEQ ID NO: 808702 - DNA, 25 bp, Mus musculus
tgcctcctgagtctttgctgtgcca

SEQ ID NO: 808703 - DNA, 25 bp, Mus musculus
tgcctcctgagtgtttgctgtgcca

SEQ ID NO: 808704 - DNA, 25 bp, Mus musculus
tgcctcctgcccaaatgggaagttt

SEQ ID NO: 808705 - DNA, 25 bp, Mus musculus
tgcctcctgccctaatgggaagttt

SEQ ID NO: 808706 - DNA, 25 bp, Mus musculus
tgcctcctgctgagaccgtggcaga

SEQ ID NO: 808707 - DNA, 25 bp, Mus musculus
tgcctcctgctgtgaccgtggcaga

SEQ ID NO: 808708 - DNA, 25 bp, Mus musculus
tgcctcctggccaagacagaaacag

SEQ ID NO: 808709 - DNA, 25 bp, Mus musculus
tgcctcctggcctagacagaaacag

SEQ ID NO: 808710 - DNA, 25 bp, Mus musculus
tgcctcctgggtagaccaaatcctc

SEQ ID NO: 808711 - DNA, 25 bp, Mus musculus
tgcctcctgggttgaccaaatcctc

SEQ ID NO: 808712 - DNA, 25 bp, Mus musculus
tgcctcctggttcacagcctgctgt

SEQ ID NO: 808713 - DNA, 25 bp, Mus musculus
tgcctcctggttgacagcctgctgt

SEQ ID NO: 808714 - DNA, 25 bp, Mus musculus
tgcctcctgtttctacggtcctttc

SEQ ID NO: 808715 - DNA, 25 bp, Mus musculus
tgcctcctgtttgtacggtcctttc

SEQ ID NO: 808716 - DNA, 25 bp, Mus musculus
tgcctccttaggcaggccagagctc

SEQ ID NO: 808717 - DNA, 25 bp, Mus musculus
tgcctccttagggaggccagagctc

SEQ ID NO: 808718 - DNA, 25 bp, Mus musculus
tgcctcctttaacttccttgggctg

SEQ ID NO: 808719 - DNA, 25 bp, Mus musculus
tgcctcctttaagttccttgggctg

SEQ ID NO: 808720 - DNA, 25 bp, Mus musculus
tgcctcgacttcagtttgaagactg

SEQ ID NO: 808721 - DNA, 25 bp, Mus musculus
tgcctcgacttctgtttgaagactg

SEQ ID NO: 808722 - DNA, 25 bp, Mus musculus
tgcctcgaggccagtacgacgggcc

SEQ ID NO: 808723 - DNA, 25 bp, Mus musculus
tgcctcgaggcctgtacgacgggcc

SEQ ID NO: 808724 - DNA, 25 bp, Mus musculus
tgcctcgagggacagaactgttaga

SEQ ID NO: 808725 - DNA, 25 bp, Mus musculus
tgcctcgagggagagaactgttaga

SEQ ID NO: 808726 - DNA, 25 bp, Mus musculus
tgcctcgatccacatgctgaacgtt

SEQ ID NO: 808727 - DNA, 25 bp, Mus musculus
tgcctcgatccagatgctgaacgtt

SEQ ID NO: 808728 - DNA, 25 bp, Mus musculus
tgcctcgcagccagtgaggaggcct

SEQ ID NO: 808729 - DNA, 25 bp, Mus musculus
tgcctcgcagcctgtgaggaggcct

SEQ ID NO: 808730 - DNA, 25 bp, Mus musculus
tgcctcgcggagagaaaaatgcctc

SEQ ID NO: 808731 - DNA, 25 bp, Mus musculus
tgcctcgcggagtgaaaaatgcctc

SEQ ID NO: 808732 - DNA, 25 bp, Mus musculus
tgcctcgctggaagggcagatcccc

SEQ ID NO: 808733 - DNA, 25 bp, Mus musculus
tgcctcgctggatgggcagatcccc

SEQ ID NO: 808734 - DNA, 25 bp, Mus musculus
tgcctcggattgcagtgaactacca

SEQ ID NO: 808735 - DNA, 25 bp, Mus musculus
tgcctcggattggagtgaactacca

SEQ ID NO: 808736 - DNA, 25 bp, Mus musculus
tgcctcgggcagactttgtggacct

SEQ ID NO: 808737 - DNA, 25 bp, Mus musculus
tgcctcgggcagtctttgtggacct

SEQ ID NO: 808738 - DNA, 25 bp, Mus musculus
tgcctcggtaacattactaaggaat

SEQ ID NO: 808739 - DNA, 25 bp, Mus musculus
tgcctcggtaactttactaaggaat

SEQ ID NO: 808740 - DNA, 25 bp, Mus musculus
tgcctcgtcatgaatgtcatcctca

SEQ ID NO: 808741 - DNA, 25 bp, Mus musculus
tgcctcgtcatgtatgtcatcctca

SEQ ID NO: 808742 - DNA, 25 bp, Mus musculus
tgcctcgtctaacacgtcctggtgt

SEQ ID NO: 808743 - DNA, 25 bp, Mus musculus
tgcctcgtctaagacgtcctggtgt

SEQ ID NO: 808744 - DNA, 25 bp, Mus musculus
tgcctcgtggctcctgcttttgcta

SEQ ID NO: 808745 - DNA, 25 bp, Mus musculus
tgcctcgtggctgctgcttttgcta

SEQ ID NO: 808746 - DNA, 25 bp, Mus musculus
tgcctctaatacacagtctccacag

SEQ ID NO: 808747 - DNA, 25 bp, Mus musculus
tgcctctaatactcagtctccacag

SEQ ID NO: 808748 - DNA, 25 bp, Mus musculus
tgcctctacactctgagattatagg

SEQ ID NO: 808749 - DNA, 25 bp, Mus musculus
tgcctctacactgtgagattatagg

SEQ ID NO: 808750 - DNA, 25 bp, Mus musculus
tgcctctatttcaactaaacttcag

SEQ ID NO: 808751 - DNA, 25 bp, Mus musculus
tgcctctatttctactaaacttcag

SEQ ID NO: 808752 - DNA, 25 bp, Mus musculus
tgcctctcagcaagtcctacaatac

SEQ ID NO: 808753 - DNA, 25 bp, Mus musculus
tgcctctcagcatgtcctacaatac

SEQ ID NO: 808754 - DNA, 25 bp, Mus musculus
tgcctctccaaacaacaagttctca

SEQ ID NO: 808755 - DNA, 25 bp, Mus musculus
tgcctctccaaagaacaagttctca

SEQ ID NO: 808756 - DNA, 25 bp, Mus musculus
tgcctctccactcaggataactgta

SEQ ID NO: 808757 - DNA, 25 bp, Mus musculus
tgcctctccactgaggataactgta

SEQ ID NO: 808758 - DNA, 25 bp, Mus musculus
tgcctctctccaacctatgagcttg

SEQ ID NO: 808759 - DNA, 25 bp, Mus musculus
tgcctctctccatcctatgagcttg

SEQ ID NO: 808760 - DNA, 25 bp, Mus musculus
tgcctctctgcaattggacagattc

SEQ ID NO: 808761 - DNA, 25 bp, Mus musculus
tgcctctctgcatttggacagattc

SEQ ID NO: 808762 - DNA, 25 bp, Mus musculus
tgcctctctggccagggatccacat

SEQ ID NO: 808763 - DNA, 25 bp, Mus musculus
tgcctctctggcgagggatccacat

SEQ ID NO: 808764 - DNA, 25 bp, Mus musculus
tgcctctgacagagcacaaacccag

SEQ ID NO: 808765 - DNA, 25 bp, Mus musculus
tgcctctgacagtgcacaaacccag

SEQ ID NO: 808766 - DNA, 25 bp, Mus musculus
tgcctctgcaccatcttcctggtgg

SEQ ID NO: 808767 - DNA, 25 bp, Mus musculus
tgcctctgcaccttcttcctggtgg

SEQ ID NO: 808768 - DNA, 25 bp, Mus musculus
tgcctctgccatagggtgccacgtg

SEQ ID NO: 808769 - DNA, 25 bp, Mus musculus
tgcctctgccattgggtgccacgtg

SEQ ID NO: 808770 - DNA, 25 bp, Mus musculus
tgcctctgccgtcctggtttcacag

SEQ ID NO: 808771 - DNA, 25 bp, Mus musculus
tgcctctgccgtgctggtttcacag

SEQ ID NO: 808772 - DNA, 25 bp, Mus musculus
tgcctctgctccagataggaacctt

SEQ ID NO: 808773 - DNA, 25 bp, Mus musculus
tgcctctgctcctgataggaacctt

SEQ ID NO: 808774 - DNA, 25 bp, Mus musculus
tgcctctggagaaagaaccataaag

SEQ ID NO: 808775 - DNA, 25 bp, Mus musculus
tgcctctggagatagaaccataaag

SEQ ID NO: 808776 - DNA, 25 bp, Mus musculus
tgcctctggccaagagataattgtg

SEQ ID NO: 808777 - DNA, 25 bp, Mus musculus
tgcctctggccatgagataattgtg

SEQ ID NO: 808778 - DNA, 25 bp, Mus musculus
tgcctctggtaaagcggctggcggg

SEQ ID NO: 808779 - DNA, 25 bp, Mus musculus
tgcctctggtaatgcggctggcggg

SEQ ID NO: 808780 - DNA, 25 bp, Mus musculus
tgcctctgtgacctgagcgtcctgg

SEQ ID NO: 808781 - DNA, 25 bp, Mus musculus
tgcctctgtgacgtgagcgtcctgg

SEQ ID NO: 808782 - DNA, 25 bp, Mus musculus
tgcctctgtgcacccggctttgcta

SEQ ID NO: 808783 - DNA, 25 bp, Mus musculus
tgcctctgtgcagccggctttgcta

SEQ ID NO: 808784 - DNA, 25 bp, Mus musculus
tgcctctgtgcccactcgggcagga

SEQ ID NO: 808785 - DNA, 25 bp, Mus musculus
tgcctctgtgccgactcgggcagga

SEQ ID NO: 808786 - DNA, 25 bp, Mus musculus
tgcctctgtttcagactctggcctg

SEQ ID NO: 808787 - DNA, 25 bp, Mus musculus
tgcctctgtttctgactctggcctg

SEQ ID NO: 808788 - DNA, 25 bp, Mus musculus
tgcctcttacaaatccagaattatt

SEQ ID NO: 808789 - DNA, 25 bp, Mus musculus
tgcctcttacaattccagaattatt

SEQ ID NO: 808790 - DNA, 25 bp, Mus musculus
tgcctcttataacccagcgagaact

SEQ ID NO: 808791 - DNA, 25 bp, Mus musculus
tgcctcttataagccagcgagaact

SEQ ID NO: 808792 - DNA, 25 bp, Mus musculus
tgcctcttccagaagtggcagcgaa

SEQ ID NO: 808793 - DNA, 25 bp, Mus musculus
tgcctcttccagtagtggcagcgaa

SEQ ID NO: 808794 - DNA, 25 bp, Mus musculus
tgcctcttctccattcgatgctttg

SEQ ID NO: 808795 - DNA, 25 bp, Mus musculus
tgcctcttctcctttcgatgctttg

SEQ ID NO: 808796 - DNA, 25 bp, Mus musculus
tgcctcttgccactaactaaaatgg

SEQ ID NO: 808797 - DNA, 25 bp, Mus musculus
tgcctcttgccagtaactaaaatgg

SEQ ID NO: 808798 - DNA, 25 bp, Mus musculus
tgcctcttggttcgtggtggccaca

SEQ ID NO: 808799 - DNA, 25 bp, Mus musculus
tgcctcttggttggtggtggccaca

SEQ ID NO: 808800 - DNA, 25 bp, Mus musculus
tgcctctttaggagcattctggaag

SEQ ID NO: 808801 - DNA, 25 bp, Mus musculus
tgcctctttaggtgcattctggaag

SEQ ID NO: 808802 - DNA, 25 bp, Mus musculus
tgcctctttccaagtgacttctcaa

SEQ ID NO: 808803 - DNA, 25 bp, Mus musculus
tgcctctttccatgtgacttctcaa

SEQ ID NO: 808804 - DNA, 25 bp, Mus musculus
tgcctgaacagtcgtaccagttttg

SEQ ID NO: 808805 - DNA, 25 bp, Mus musculus
tgcctgaacagtggtaccagttttg

SEQ ID NO: 808806 - DNA, 25 bp, Mus musculus
tgcctgaacccacagggcaatctct

SEQ ID NO: 808807 - DNA, 25 bp, Mus musculus
tgcctgaacccagagggcaatctct

SEQ ID NO: 808808 - DNA, 25 bp, Mus musculus
tgcctgaagactattacacgcggcc

SEQ ID NO: 808809 - DNA, 25 bp, Mus musculus
tgcctgaagacttttacacgcggcc

SEQ ID NO: 808810 - DNA, 25 bp, Mus musculus
tgcctgaagcatattcctatgttgg

SEQ ID NO: 808811 - DNA, 25 bp, Mus musculus
tgcctgaagcattttcctatgttgg

SEQ ID NO: 808812 - DNA, 25 bp, Mus musculus
tgcctgaaggtcatgattccatcac

SEQ ID NO: 808813 - DNA, 25 bp, Mus musculus
tgcctgaaggtcttgattccatcac

SEQ ID NO: 808814 - DNA, 25 bp, Mus musculus
tgcctgaatcacaatcgcgcaccaa

SEQ ID NO: 808815 - DNA, 25 bp, Mus musculus
tgcctgaatcactatcgcgcaccaa

SEQ ID NO: 808816 - DNA, 25 bp, Mus musculus
tgcctgaatcagactacactaacaa

SEQ ID NO: 808817 - DNA, 25 bp, Mus musculus
tgcctgaatcagtctacactaacaa

SEQ ID NO: 808818 - DNA, 25 bp, Mus musculus
tgcctgaatccaacattgcagctgc

SEQ ID NO: 808819 - DNA, 25 bp, Mus musculus
tgcctgaatccatcattgcagctgc

SEQ ID NO: 808820 - DNA, 25 bp, Mus musculus
tgcctgaatctcaggctgactacat

SEQ ID NO: 808821 - DNA, 25 bp, Mus musculus
tgcctgaatctctggctgactacat

SEQ ID NO: 808822 - DNA, 25 bp, Mus musculus
tgcctgaatggtcgccgctgcatcg

SEQ ID NO: 808823 - DNA, 25 bp, Mus musculus
tgcctgaatggtggccgctgcatcg

SEQ ID NO: 808824 - DNA, 25 bp, Mus musculus
tgcctgacaaccactacacctttgt

SEQ ID NO: 808825 - DNA, 25 bp, Mus musculus
tgcctgacaacctctacacctttgt

SEQ ID NO: 808826 - DNA, 25 bp, Mus musculus
tgcctgacaaggagctgtggccgca

SEQ ID NO: 808827 - DNA, 25 bp, Mus musculus
tgcctgacaaggtgctgtggccgca

SEQ ID NO: 808828 - DNA, 25 bp, Mus musculus
tgcctgacacctctggacaacgcct

SEQ ID NO: 808829 - DNA, 25 bp, Mus musculus
tgcctgacacctgtggacaacgcct

SEQ ID NO: 808830 - DNA, 25 bp, Mus musculus
tgcctgacacgaagaggaacctcct

SEQ ID NO: 808831 - DNA, 25 bp, Mus musculus
tgcctgacacgatgaggaacctcct

SEQ ID NO: 808832 - DNA, 25 bp, Mus musculus
tgcctgacccctaggaccagaagat

SEQ ID NO: 808833 - DNA, 25 bp, Mus musculus
tgcctgaccccttggaccagaagat

SEQ ID NO: 808834 - DNA, 25 bp, Mus musculus
tgcctgaccgctaagtgaacactcc

SEQ ID NO: 808835 - DNA, 25 bp, Mus musculus
tgcctgaccgcttagtgaacactcc

SEQ ID NO: 808836 - DNA, 25 bp, Mus musculus
tgcctgaccgggagccatggagccc

SEQ ID NO: 808837 - DNA, 25 bp, Mus musculus
tgcctgaccgggtgccatggagccc

SEQ ID NO: 808838 - DNA, 25 bp, Mus musculus
tgcctgacgacaaccgagggaagtg

SEQ ID NO: 808839 - DNA, 25 bp, Mus musculus
tgcctgacgacatccgagggaagtg

SEQ ID NO: 808840 - DNA, 25 bp, Mus musculus
tgcctgacggcaagtatcccagtgg

SEQ ID NO: 808841 - DNA, 25 bp, Mus musculus
tgcctgacggcatgtatcccagtgg

SEQ ID NO: 808842 - DNA, 25 bp, Mus musculus
tgcctgactttgcagagtgggctca

SEQ ID NO: 808843 - DNA, 25 bp, Mus musculus
tgcctgactttggagagtgggctca

SEQ ID NO: 808844 - DNA, 25 bp, Mus musculus
tgcctgagaggactcaattactatc

SEQ ID NO: 808845 - DNA, 25 bp, Mus musculus
tgcctgagaggagtcaattactatc

SEQ ID NO: 808846 - DNA, 25 bp, Mus musculus
tgcctgagagtgcacaaccagcctc

SEQ ID NO: 808847 - DNA, 25 bp, Mus musculus
tgcctgagagtggacaaccagcctc

SEQ ID NO: 808848 - DNA, 25 bp, Mus musculus
tgcctgagcatgctataccacacgc

SEQ ID NO: 808849 - DNA, 25 bp, Mus musculus
tgcctgagcatggtataccacacgc

SEQ ID NO: 808850 - DNA, 25 bp, Mus musculus
tgcctgagcccgagcatgtcatcgt

SEQ ID NO: 808851 - DNA, 25 bp, Mus musculus
tgcctgagcccgtgcatgtcatcgt

SEQ ID NO: 808852 - DNA, 25 bp, Mus musculus
tgcctgagcgagcaacagctcacga

SEQ ID NO: 808853 - DNA, 25 bp, Mus musculus
tgcctgagcgaggaacagctcacga

SEQ ID NO: 808854 - DNA, 25 bp, Mus musculus
tgcctgaggaggaggcgcggacctg

SEQ ID NO: 808855 - DNA, 25 bp, Mus musculus
tgcctgaggaggtggcgcggacctg

SEQ ID NO: 808856 - DNA, 25 bp, Mus musculus
tgcctgaggcggatcagaactcaac

SEQ ID NO: 808857 - DNA, 25 bp, Mus musculus
tgcctgaggcggttcagaactcaac

SEQ ID NO: 808858 - DNA, 25 bp, Mus musculus
tgcctgagggctagcactgccttct

SEQ ID NO: 808859 - DNA, 25 bp, Mus musculus
tgcctgagggcttgcactgccttct

SEQ ID NO: 808860 - DNA, 25 bp, Mus musculus
tgcctgagtaccagggagaaccgga

SEQ ID NO: 808861 - DNA, 25 bp, Mus musculus
tgcctgagtacctgggagaaccgga

SEQ ID NO: 808862 - DNA, 25 bp, Mus musculus
tgcctgagtctgagcttggcacgcc

SEQ ID NO: 808863 - DNA, 25 bp, Mus musculus
tgcctgagtctgtgcttggcacgcc

SEQ ID NO: 808864 - DNA, 25 bp, Mus musculus
tgcctgatagaaacgccagggagcc

SEQ ID NO: 808865 - DNA, 25 bp, Mus musculus
tgcctgatagaatcgccagggagcc

SEQ ID NO: 808866 - DNA, 25 bp, Mus musculus
tgcctgatcgcaaaaagaagttcca

SEQ ID NO: 808867 - DNA, 25 bp, Mus musculus
tgcctgatcgcataaagaagttcca

SEQ ID NO: 808868 - DNA, 25 bp, Mus musculus
tgcctgatgaatctagatgtcatgc

SEQ ID NO: 808869 - DNA, 25 bp, Mus musculus
tgcctgatgaatgtagatgtcatgc

SEQ ID NO: 808870 - DNA, 25 bp, Mus musculus
tgcctgatgaggctgcccttcacct

SEQ ID NO: 808871 - DNA, 25 bp, Mus musculus
tgcctgatgagggtgcccttcacct

SEQ ID NO: 808872 - DNA, 25 bp, Mus musculus
tgcctgatgggcatgttccgaggaa

SEQ ID NO: 808873 - DNA, 25 bp, Mus musculus
tgcctgatgggcttgttccgaggaa

SEQ ID NO: 808874 - DNA, 25 bp, Mus musculus
tgcctgatgttcaagcagagcctct

SEQ ID NO: 808875 - DNA, 25 bp, Mus musculus
tgcctgatgttctagcagagcctct

SEQ ID NO: 808876 - DNA, 25 bp, Mus musculus
tgcctgatttgaaaagccttgagaa

SEQ ID NO: 808877 - DNA, 25 bp, Mus musculus
tgcctgatttgataagccttgagaa

SEQ ID NO: 808878 - DNA, 25 bp, Mus musculus
tgcctgcaaactcaactagtagttc

SEQ ID NO: 808879 - DNA, 25 bp, Mus musculus
tgcctgcaaactgaactagtagttc

SEQ ID NO: 808880 - DNA, 25 bp, Mus musculus
tgcctgcaacatcagccatgcaagg

SEQ ID NO: 808881 - DNA, 25 bp, Mus musculus
tgcctgcaacatgagccatgcaagg

SEQ ID NO: 808882 - DNA, 25 bp, Mus musculus
tgcctgcaagagcacgtcagtacct

SEQ ID NO: 808883 - DNA, 25 bp, Mus musculus
tgcctgcaagaggacgtcagtacct

SEQ ID NO: 808884 - DNA, 25 bp, Mus musculus
tgcctgcacgcacggttgttgaccc

SEQ ID NO: 808885 - DNA, 25 bp, Mus musculus
tgcctgcacgcagggttgttgaccc

SEQ ID NO: 808886 - DNA, 25 bp, Mus musculus
tgcctgcactatagtggatatcttg

SEQ ID NO: 808887 - DNA, 25 bp, Mus musculus
tgcctgcactattgtggatatcttg

SEQ ID NO: 808888 - DNA, 25 bp, Mus musculus
tgcctgcacttcagcatcattggag

SEQ ID NO: 808889 - DNA, 25 bp, Mus musculus
tgcctgcacttctgcatcattggag

SEQ ID NO: 808890 - DNA, 25 bp, Mus musculus
tgcctgcagaacacggtgaatgact

SEQ ID NO: 808891 - DNA, 25 bp, Mus musculus
tgcctgcagaactcggtgaatgact

SEQ ID NO: 808892 - DNA, 25 bp, Mus musculus
tgcctgcagactcttagacatggag

SEQ ID NO: 808893 - DNA, 25 bp, Mus musculus
tgcctgcagactgttagacatggag

SEQ ID NO: 808894 - DNA, 25 bp, Mus musculus
tgcctgcagcttcgctcaccatgtt

SEQ ID NO: 808895 - DNA, 25 bp, Mus musculus
tgcctgcagcttggctcaccatgtt

SEQ ID NO: 808896 - DNA, 25 bp, Mus musculus
tgcctgcagggcctattcctctatg

SEQ ID NO: 808897 - DNA, 25 bp, Mus musculus
tgcctgcagggcgtattcctctatg

SEQ ID NO: 808898 - DNA, 25 bp, Mus musculus
tgcctgcagggtcatacgaacagcc

SEQ ID NO: 808899 - DNA, 25 bp, Mus musculus
tgcctgcagggtgatacgaacagcc

SEQ ID NO: 808900 - DNA, 25 bp, Mus musculus
tgcctgcaggtcatggtccctgggt

SEQ ID NO: 808901 - DNA, 25 bp, Mus musculus
tgcctgcaggtcttggtccctgggt

SEQ ID NO: 808902 - DNA, 25 bp, Mus musculus
tgcctgcaggtgaatgctcctgagg

SEQ ID NO: 808903 - DNA, 25 bp, Mus musculus
tgcctgcaggtgtatgctcctgagg

SEQ ID NO: 808904 - DNA, 25 bp, Mus musculus
tgcctgccagcccaaggtgatgcgc

SEQ ID NO: 808905 - DNA, 25 bp, Mus musculus
tgcctgccagccgaaggtgatgcgc

SEQ ID NO: 808906 - DNA, 25 bp, Mus musculus
tgcctgccagctagacctagggcgg

SEQ ID NO: 808907 - DNA, 25 bp, Mus musculus
tgcctgccagcttgacctagggcgg

SEQ ID NO: 808908 - DNA, 25 bp, Mus musculus
tgcctgcccacaaggcttcacggga

SEQ ID NO: 808909 - DNA, 25 bp, Mus musculus
tgcctgcccacatggcttcacggga

SEQ ID NO: 808910 - DNA, 25 bp, Mus musculus
tgcctgccccagaatcctgctgagt

SEQ ID NO: 808911 - DNA, 25 bp, Mus musculus
tgcctgccccagtatcctgctgagt

SEQ ID NO: 808912 - DNA, 25 bp, Mus musculus
tgcctgccgggaatactgtcaaatt

SEQ ID NO: 808913 - DNA, 25 bp, Mus musculus
tgcctgccgggattactgtcaaatt

SEQ ID NO: 808914 - DNA, 25 bp, Mus musculus
tgcctgcctcacagggagggtcaca

SEQ ID NO: 808915 - DNA, 25 bp, Mus musculus
tgcctgcctcactgggagggtcaca

SEQ ID NO: 808916 - DNA, 25 bp, Mus musculus
tgcctgcctcagacgttcagaagag

SEQ ID NO: 808917 - DNA, 25 bp, Mus musculus
tgcctgcctcagtcgttcagaagag

SEQ ID NO: 808918 - DNA, 25 bp, Mus musculus
tgcctgcctccgaccgaatggatga

SEQ ID NO: 808919 - DNA, 25 bp, Mus musculus
tgcctgcctccgtccgaatggatga

SEQ ID NO: 808920 - DNA, 25 bp, Mus musculus
tgcctgcctgtaagcacacgtgtgt

SEQ ID NO: 808921 - DNA, 25 bp, Mus musculus
tgcctgcctgtacatcctggatcgg

SEQ ID NO: 808922 - DNA, 25 bp, Mus musculus
tgcctgcctgtagatcctggatcgg

SEQ ID NO: 808923 - DNA, 25 bp, Mus musculus
tgcctgcctgtatgcacacgtgtgt

SEQ ID NO: 808924 - DNA, 25 bp, Mus musculus
tgcctgccttttccgagcgtacctg

SEQ ID NO: 808925 - DNA, 25 bp, Mus musculus
tgcctgccttttgcgagcgtacctg

SEQ ID NO: 808926 - DNA, 25 bp, Mus musculus
tgcctgcgccctctctggacaatga

SEQ ID NO: 808927 - DNA, 25 bp, Mus musculus
tgcctgcgccctgtctggacaatga

SEQ ID NO: 808928 - DNA, 25 bp, Mus musculus
tgcctgcgtagtaaagatctcagac

SEQ ID NO: 808929 - DNA, 25 bp, Mus musculus
tgcctgcgtagttaagatctcagac

SEQ ID NO: 808930 - DNA, 25 bp, Mus musculus
tgcctgcgttctagtgctcgccctg

SEQ ID NO: 808931 - DNA, 25 bp, Mus musculus
tgcctgcgttcttgtgctcgccctg

SEQ ID NO: 808932 - DNA, 25 bp, Mus musculus
tgcctgctaatactaggaaaacacc

SEQ ID NO: 808933 - DNA, 25 bp, Mus musculus
tgcctgctaatagtaggaaaacacc

SEQ ID NO: 808934 - DNA, 25 bp, Mus musculus
tgcctgctaggaagagcatcctcca

SEQ ID NO: 808935 - DNA, 25 bp, Mus musculus
tgcctgctaggatgagcatcctcca

SEQ ID NO: 808936 - DNA, 25 bp, Mus musculus
tgcctgctcaaacacgaagaatatc

SEQ ID NO: 808937 - DNA, 25 bp, Mus musculus
tgcctgctcaaagacgaagaatatc

SEQ ID NO: 808938 - DNA, 25 bp, Mus musculus
tgcctgctctgcaccagcagctggg

SEQ ID NO: 808939 - DNA, 25 bp, Mus musculus
tgcctgctctgctccagcagctggg

SEQ ID NO: 808940 - DNA, 25 bp, Mus musculus
tgcctgctgagtaactagacgctcc

SEQ ID NO: 808941 - DNA, 25 bp, Mus musculus
tgcctgctgagttactagacgctcc

SEQ ID NO: 808942 - DNA, 25 bp, Mus musculus
tgcctgctgattctccagtgaagcc

SEQ ID NO: 808943 - DNA, 25 bp, Mus musculus
tgcctgctgattgtccagtgaagcc

SEQ ID NO: 808944 - DNA, 25 bp, Mus musculus
tgcctgctgctcctcggctgcggat

SEQ ID NO: 808945 - DNA, 25 bp, Mus musculus
tgcctgctgctcgtcggctgcggat

SEQ ID NO: 808946 - DNA, 25 bp, Mus musculus
tgcctgctggccagagtgatttggc

SEQ ID NO: 808947 - DNA, 25 bp, Mus musculus
tgcctgctggccatgtattgcaacg

SEQ ID NO: 808948 - DNA, 25 bp, Mus musculus
tgcctgctggcctgagtgatttggc

SEQ ID NO: 808949 - DNA, 25 bp, Mus musculus
tgcctgctggccttgtattgcaacg

SEQ ID NO: 808950 - DNA, 25 bp, Mus musculus
tgcctgctgttgagaactgtccagg

SEQ ID NO: 808951 - DNA, 25 bp, Mus musculus
tgcctgctgttgtgaactgtccagg

SEQ ID NO: 808952 - DNA, 25 bp, Mus musculus
tgcctgcttgcccacagagatgaag

SEQ ID NO: 808953 - DNA, 25 bp, Mus musculus
tgcctgcttgccgacagagatgaag

SEQ ID NO: 808954 - DNA, 25 bp, Mus musculus
tgcctgcttgttactaatcctcagc

SEQ ID NO: 808955 - DNA, 25 bp, Mus musculus
tgcctgcttgtttctaatcctcagc

SEQ ID NO: 808956 - DNA, 25 bp, Mus musculus
tgcctgctttacaggaattctacaa

SEQ ID NO: 808957 - DNA, 25 bp, Mus musculus
tgcctgctttactggaattctacaa

SEQ ID NO: 808958 - DNA, 25 bp, Mus musculus
tgcctggaacaaagctggactccca

SEQ ID NO: 808959 - DNA, 25 bp, Mus musculus
tgcctggaacaatgctggactccca

SEQ ID NO: 808960 - DNA, 25 bp, Mus musculus
tgcctggaagttcgaaaccctggcc

SEQ ID NO: 808961 - DNA, 25 bp, Mus musculus
tgcctggaagttggaaaccctggcc

SEQ ID NO: 808962 - DNA, 25 bp, Mus musculus
tgcctggaattcaggacactgtcat

SEQ ID NO: 808963 - DNA, 25 bp, Mus musculus
tgcctggaattctggacactgtcat

SEQ ID NO: 808964 - DNA, 25 bp, Mus musculus
tgcctggacacaagtgcccgctgtt

SEQ ID NO: 808965 - DNA, 25 bp, Mus musculus
tgcctggacacatgtgcccgctgtt

SEQ ID NO: 808966 - DNA, 25 bp, Mus musculus
tgcctggaccaacagtgctgaagcc

SEQ ID NO: 808967 - DNA, 25 bp, Mus musculus
tgcctggaccaaccgctgggtcgaa

SEQ ID NO: 808968 - DNA, 25 bp, Mus musculus
tgcctggaccaagagtgctgaagcc

SEQ ID NO: 808969 - DNA, 25 bp, Mus musculus
tgcctggaccaagcgctgggtcgaa

SEQ ID NO: 808970 - DNA, 25 bp, Mus musculus
tgcctggaccctagctggcggctca

SEQ ID NO: 808971 - DNA, 25 bp, Mus musculus
tgcctggacccttgctggcggctca

SEQ ID NO: 808972 - DNA, 25 bp, Mus musculus
tgcctggacttactcattctatgag

SEQ ID NO: 808973 - DNA, 25 bp, Mus musculus
tgcctggacttagtcattctatgag

SEQ ID NO: 808974 - DNA, 25 bp, Mus musculus
tgcctggagacaacaagaactgggt

SEQ ID NO: 808975 - DNA, 25 bp, Mus musculus
tgcctggagacatcaagaactgggt

SEQ ID NO: 808976 - DNA, 25 bp, Mus musculus
tgcctggagtgaacgaaccgcgtgt

SEQ ID NO: 808977 - DNA, 25 bp, Mus musculus
tgcctggagtgatcgaaccgcgtgt

SEQ ID NO: 808978 - DNA, 25 bp, Mus musculus
tgcctggagttgcagcccaacaact

SEQ ID NO: 808979 - DNA, 25 bp, Mus musculus
tgcctggagttggagcccaacaact

SEQ ID NO: 808980 - DNA, 25 bp, Mus musculus
tgcctggatagaattagagacctgc

SEQ ID NO: 808981 - DNA, 25 bp, Mus musculus
tgcctggatagatttagagacctgc

SEQ ID NO: 808982 - DNA, 25 bp, Mus musculus
tgcctggatgctcatgtgtttgtgc

SEQ ID NO: 808983 - DNA, 25 bp, Mus musculus
tgcctggatgctgatgtgtttgtgc

SEQ ID NO: 808984 - DNA, 25 bp, Mus musculus
tgcctggcaactcgcggcattcaaa

SEQ ID NO: 808985 - DNA, 25 bp, Mus musculus
tgcctggcaactggcggcattcaaa

SEQ ID NO: 808986 - DNA, 25 bp, Mus musculus
tgcctggcaatgaggatcctatgtt

SEQ ID NO: 808987 - DNA, 25 bp, Mus musculus
tgcctggcaatgtggatcctatgtt

SEQ ID NO: 808988 - DNA, 25 bp, Mus musculus
tgcctggcatgcctctggctgtgta

SEQ ID NO: 808989 - DNA, 25 bp, Mus musculus
tgcctggcatgcgtctggctgtgta

SEQ ID NO: 808990 - DNA, 25 bp, Mus musculus
tgcctggccacgatgtggaagccta

SEQ ID NO: 808991 - DNA, 25 bp, Mus musculus
tgcctggccacgttgtggaagccta

SEQ ID NO: 808992 - DNA, 25 bp, Mus musculus
tgcctggccatgagcgagcagattc

SEQ ID NO: 808993 - DNA, 25 bp, Mus musculus
tgcctggccatgtgcgagcagattc

SEQ ID NO: 808994 - DNA, 25 bp, Mus musculus
tgcctggccctaattctcttaaaag

SEQ ID NO: 808995 - DNA, 25 bp, Mus musculus
tgcctggccctatttctcttaaaag

SEQ ID NO: 808996 - DNA, 25 bp, Mus musculus
tgcctggccgtcacagggctgagac

SEQ ID NO: 808997 - DNA, 25 bp, Mus musculus
tgcctggccgtctcagggctgagac

SEQ ID NO: 808998 - DNA, 25 bp, Mus musculus
tgcctggcgggcaattctattgggt

SEQ ID NO: 808999 - DNA, 25 bp, Mus musculus
tgcctggcgggctattctattgggt

SEQ ID NO: 809000 - DNA, 25 bp, Mus musculus
tgcctggctcctctcgccaaggtta

SEQ ID NO: 809001 - DNA, 25 bp, Mus musculus
tgcctggctcctgtcgccaaggtta

SEQ ID NO: 809002 - DNA, 25 bp, Mus musculus
tgcctggcttcaagtcacccaaggg

SEQ ID NO: 809003 - DNA, 25 bp, Mus musculus
tgcctggcttcatgtcacccaaggg

SEQ ID NO: 809004 - DNA, 25 bp, Mus musculus
tgcctgggagcccttactaaaaaga

SEQ ID NO: 809005 - DNA, 25 bp, Mus musculus
tgcctgggagccgttactaaaaaga

SEQ ID NO: 809006 - DNA, 25 bp, Mus musculus
tgcctgggatatcctggatttagcc

SEQ ID NO: 809007 - DNA, 25 bp, Mus musculus
tgcctgggatatgctggatttagcc

SEQ ID NO: 809008 - DNA, 25 bp, Mus musculus
tgcctgggctacaggagaccccatt

SEQ ID NO: 809009 - DNA, 25 bp, Mus musculus
tgcctgggctactggagaccccatt

SEQ ID NO: 809010 - DNA, 25 bp, Mus musculus
tgcctgggctccataggctgcaaga

SEQ ID NO: 809011 - DNA, 25 bp, Mus musculus
tgcctgggctccttaggctgcaaga

SEQ ID NO: 809012 - DNA, 25 bp, Mus musculus
tgcctgggcttcctgcagctttgcc

SEQ ID NO: 809013 - DNA, 25 bp, Mus musculus
tgcctgggcttcgtgcagctttgcc

SEQ ID NO: 809014 - DNA, 25 bp, Mus musculus
tgcctggggctcaccatggcagttg

SEQ ID NO: 809015 - DNA, 25 bp, Mus musculus
tgcctggggctctccatggcagttg

SEQ ID NO: 809016 - DNA, 25 bp, Mus musculus
tgcctgggtagtccccaaagaacgt

SEQ ID NO: 809017 - DNA, 25 bp, Mus musculus
tgcctgggtagtgcccaaagaacgt

SEQ ID NO: 809018 - DNA, 25 bp, Mus musculus
tgcctgggtttgagctgtctgatca

SEQ ID NO: 809019 - DNA, 25 bp, Mus musculus
tgcctgggtttgtgctgtctgatca

SEQ ID NO: 809020 - DNA, 25 bp, Mus musculus
tgcctggtaaagaacatagaccttg

SEQ ID NO: 809021 - DNA, 25 bp, Mus musculus
tgcctggtaaagtacatagaccttg

SEQ ID NO: 809022 - DNA, 25 bp, Mus musculus
tgcctggtagatcctgacaagaaga

SEQ ID NO: 809023 - DNA, 25 bp, Mus musculus
tgcctggtagatgctgacaagaaga

SEQ ID NO: 809024 - DNA, 25 bp, Mus musculus
tgcctggtcaataatggtggctgtt

SEQ ID NO: 809025 - DNA, 25 bp, Mus musculus
tgcctggtcaattatggtggctgtt

SEQ ID NO: 809026 - DNA, 25 bp, Mus musculus
tgcctggtccatcggcacaaagagg

SEQ ID NO: 809027 - DNA, 25 bp, Mus musculus
tgcctggtccatgggcacaaagagg

SEQ ID NO: 809028 - DNA, 25 bp, Mus musculus
tgcctggtcctgaactctatgagta

SEQ ID NO: 809029 - DNA, 25 bp, Mus musculus
tgcctggtcctgtactctatgagta

SEQ ID NO: 809030 - DNA, 25 bp, Mus musculus
tgcctggtctgtccaccatggtctc

SEQ ID NO: 809031 - DNA, 25 bp, Mus musculus
tgcctggtctgtgcaccatggtctc

SEQ ID NO: 809032 - DNA, 25 bp, Mus musculus
tgcctggtgccaagataacaagtcc

SEQ ID NO: 809033 - DNA, 25 bp, Mus musculus
tgcctggtgccatgataacaagtcc

SEQ ID NO: 809034 - DNA, 25 bp, Mus musculus
tgcctggtggcacagattcgagctc

SEQ ID NO: 809035 - DNA, 25 bp, Mus musculus
tgcctggtggcagagattcgagctc

SEQ ID NO: 809036 - DNA, 25 bp, Mus musculus
tgcctggtgtgcaggaatatatcca

SEQ ID NO: 809037 - DNA, 25 bp, Mus musculus
tgcctggtgtgctggaatatatcca

SEQ ID NO: 809038 - DNA, 25 bp, Mus musculus
tgcctggtgttgctccacaccgcgt

SEQ ID NO: 809039 - DNA, 25 bp, Mus musculus
tgcctggtgttggtccacaccgcgt

SEQ ID NO: 809040 - DNA, 25 bp, Mus musculus
tgcctggtgtttattgcccaagcaa

SEQ ID NO: 809041 - DNA, 25 bp, Mus musculus
tgcctggtgttttttgcccaagcaa

SEQ ID NO: 809042 - DNA, 25 bp, Mus musculus
tgcctggttccccaagcagatgctc

SEQ ID NO: 809043 - DNA, 25 bp, Mus musculus
tgcctggttcccgaagcagatgctc

SEQ ID NO: 809044 - DNA, 25 bp, Mus musculus
tgcctggttgcacaagtgcctaaag

SEQ ID NO: 809045 - DNA, 25 bp, Mus musculus
tgcctggttgcagaagtgcctaaag

SEQ ID NO: 809046 - DNA, 25 bp, Mus musculus
tgcctggtttgacgatggttttaaa

SEQ ID NO: 809047 - DNA, 25 bp, Mus musculus
tgcctggtttgaggatggttttaaa

SEQ ID NO: 809048 - DNA, 25 bp, Mus musculus
tgcctgtaaaacctgagccattgat

SEQ ID NO: 809049 - DNA, 25 bp, Mus musculus
tgcctgtaaaacgtgagccattgat

SEQ ID NO: 809050 - DNA, 25 bp, Mus musculus
tgcctgtaacctctgtagatgtctt

SEQ ID NO: 809051 - DNA, 25 bp, Mus musculus
tgcctgtaacctgtgtagatgtctt

SEQ ID NO: 809052 - DNA, 25 bp, Mus musculus
tgcctgtcaactcgccgagatcgag

SEQ ID NO: 809053 - DNA, 25 bp, Mus musculus
tgcctgtcaactctggtgtcaaaca

SEQ ID NO: 809054 - DNA, 25 bp, Mus musculus
tgcctgtcaactggccgagatcgag

SEQ ID NO: 809055 - DNA, 25 bp, Mus musculus
tgcctgtcaactgtggtgtcaaaca

SEQ ID NO: 809056 - DNA, 25 bp, Mus musculus
tgcctgtcacagagcccgcagctga

SEQ ID NO: 809057 - DNA, 25 bp, Mus musculus
tgcctgtcacagtgcccgcagctga

SEQ ID NO: 809058 - DNA, 25 bp, Mus musculus
tgcctgtcaccgagaacactgaccg

SEQ ID NO: 809059 - DNA, 25 bp, Mus musculus
tgcctgtcaccgtgaacactgaccg

SEQ ID NO: 809060 - DNA, 25 bp, Mus musculus
tgcctgtcactgctgtctaactaag

SEQ ID NO: 809061 - DNA, 25 bp, Mus musculus
tgcctgtcactggtgtctaactaag

SEQ ID NO: 809062 - DNA, 25 bp, Mus musculus
tgcctgtcccgcagccagacaggga

SEQ ID NO: 809063 - DNA, 25 bp, Mus musculus
tgcctgtcccgctgccagacaggga

SEQ ID NO: 809064 - DNA, 25 bp, Mus musculus
tgcctgtcctatcttccagagaaag

SEQ ID NO: 809065 - DNA, 25 bp, Mus musculus
tgcctgtcctatgttccagagaaag

SEQ ID NO: 809066 - DNA, 25 bp, Mus musculus
tgcctgtcctctcggatgactccgt

SEQ ID NO: 809067 - DNA, 25 bp, Mus musculus
tgcctgtcctctgggatgactccgt

SEQ ID NO: 809068 - DNA, 25 bp, Mus musculus
tgcctgtgaaccaagccaagacata

SEQ ID NO: 809069 - DNA, 25 bp, Mus musculus
tgcctgtgaacctagccaagacata

SEQ ID NO: 809070 - DNA, 25 bp, Mus musculus
tgcctgtgaccaagacgatgacaat

SEQ ID NO: 809071 - DNA, 25 bp, Mus musculus
tgcctgtgaccatgacgatgacaat

SEQ ID NO: 809072 - DNA, 25 bp, Mus musculus
tgcctgtgagaccatgggcaatgcc

SEQ ID NO: 809073 - DNA, 25 bp, Mus musculus
tgcctgtgagacgatgggcaatgcc

SEQ ID NO: 809074 - DNA, 25 bp, Mus musculus
tgcctgtgagcacacctagtggcct

SEQ ID NO: 809075 - DNA, 25 bp, Mus musculus
tgcctgtgagcagacctagtggcct

SEQ ID NO: 809076 - DNA, 25 bp, Mus musculus
tgcctgtgatccacatggatgagac

SEQ ID NO: 809077 - DNA, 25 bp, Mus musculus
tgcctgtgatcctcatggatgagac

SEQ ID NO: 809078 - DNA, 25 bp, Mus musculus
tgcctgtgcagtcccgctgatgact

SEQ ID NO: 809079 - DNA, 25 bp, Mus musculus
tgcctgtgcagtgccgctgatgact

SEQ ID NO: 809080 - DNA, 25 bp, Mus musculus
tgcctgtgcatcaaaagtgcacttg

SEQ ID NO: 809081 - DNA, 25 bp, Mus musculus
tgcctgtgcatctaaagtgcacttg

SEQ ID NO: 809082 - DNA, 25 bp, Mus musculus
tgcctgtggacactcgattcctgca

SEQ ID NO: 809083 - DNA, 25 bp, Mus musculus
tgcctgtggacagtcgattcctgca

SEQ ID NO: 809084 - DNA, 25 bp, Mus musculus
tgcctgtggagcactctagaccaca

SEQ ID NO: 809085 - DNA, 25 bp, Mus musculus
tgcctgtggagctctctagaccaca

SEQ ID NO: 809086 - DNA, 25 bp, Mus musculus
tgcctgtggattcagagccccaggc

SEQ ID NO: 809087 - DNA, 25 bp, Mus musculus
tgcctgtggattgagagccccaggc

SEQ ID NO: 809088 - DNA, 25 bp, Mus musculus
tgcctgtggctacgcacacacatta

SEQ ID NO: 809089 - DNA, 25 bp, Mus musculus
tgcctgtggctaggcacacacatta

SEQ ID NO: 809090 - DNA, 25 bp, Mus musculus
tgcctgtggctcaggcatacccgag

SEQ ID NO: 809091 - DNA, 25 bp, Mus musculus
tgcctgtggctctggcatacccgag

SEQ ID NO: 809092 - DNA, 25 bp, Mus musculus
tgcctgtggctgacccaagacaact

SEQ ID NO: 809093 - DNA, 25 bp, Mus musculus
tgcctgtggctgtcccaagacaact

SEQ ID NO: 809094 - DNA, 25 bp, Mus musculus
tgcctgtggcttcgacatcaacaaa

SEQ ID NO: 809095 - DNA, 25 bp, Mus musculus
tgcctgtggcttggacatcaacaaa

SEQ ID NO: 809096 - DNA, 25 bp, Mus musculus
tgcctgtgggctctactacaagctt

SEQ ID NO: 809097 - DNA, 25 bp, Mus musculus
tgcctgtgggctgtactacaagctt

SEQ ID NO: 809098 - DNA, 25 bp, Mus musculus
tgcctgtggtccacatgagtgggct

SEQ ID NO: 809099 - DNA, 25 bp, Mus musculus
tgcctgtggtcctcatgagtgggct

SEQ ID NO: 809100 - DNA, 25 bp, Mus musculus
tgcctgtgtcccagcggcttccggt

SEQ ID NO: 809101 - DNA, 25 bp, Mus musculus
tgcctgtgtccctgcggcttccggt

SEQ ID NO: 809102 - DNA, 25 bp, Mus musculus
tgcctgttcagcagcccgagcaaca

SEQ ID NO: 809103 - DNA, 25 bp, Mus musculus
tgcctgttcagctgcccgagcaaca

SEQ ID NO: 809104 - DNA, 25 bp, Mus musculus
tgcctgttcgtgcagcgcgtgttcc

SEQ ID NO: 809105 - DNA, 25 bp, Mus musculus
tgcctgttcgtggagcgcgtgttcc

SEQ ID NO: 809106 - DNA, 25 bp, Mus musculus
tgcctgttctggagactcgtcagct

SEQ ID NO: 809107 - DNA, 25 bp, Mus musculus
tgcctgttctggtgactcgtcagct

SEQ ID NO: 809108 - DNA, 25 bp, Mus musculus
tgcctgtttggcaagaaaaccacag

SEQ ID NO: 809109 - DNA, 25 bp, Mus musculus
tgcctgtttggctagaaaaccacag

SEQ ID NO: 809110 - DNA, 25 bp, Mus musculus
tgcctgtttgtcacctgcaacaatg

SEQ ID NO: 809111 - DNA, 25 bp, Mus musculus
tgcctgtttgtctcctgcaacaatg

SEQ ID NO: 809112 - DNA, 25 bp, Mus musculus
tgcctgttttctaccctgcaacccg

SEQ ID NO: 809113 - DNA, 25 bp, Mus musculus
tgcctgttttcttccctgcaacccg

SEQ ID NO: 809114 - DNA, 25 bp, Mus musculus
tgccttaaaatcatagtcatcatgg

SEQ ID NO: 809115 - DNA, 25 bp, Mus musculus
tgccttaaaatcttagtcatcatgg

SEQ ID NO: 809116 - DNA, 25 bp, Mus musculus
tgccttaagtgtcaaagtaatgaca

SEQ ID NO: 809117 - DNA, 25 bp, Mus musculus
tgccttaagtgtgaaagtaatgaca

SEQ ID NO: 809118 - DNA, 25 bp, Mus musculus
tgccttacagatcctggacctgaga

SEQ ID NO: 809119 - DNA, 25 bp, Mus musculus
tgccttacagatgctggacctgaga

SEQ ID NO: 809120 - DNA, 25 bp, Mus musculus
tgccttaccaacacttttgtgccag

SEQ ID NO: 809121 - DNA, 25 bp, Mus musculus
tgccttaccaactcttttgtgccag

SEQ ID NO: 809122 - DNA, 25 bp, Mus musculus
tgccttaccaagctcgtgtctcgga

SEQ ID NO: 809123 - DNA, 25 bp, Mus musculus
tgccttaccaaggtcgtgtctcgga

SEQ ID NO: 809124 - DNA, 25 bp, Mus musculus
tgccttacgactccacctgggagct

SEQ ID NO: 809125 - DNA, 25 bp, Mus musculus
tgccttacgactgcacctgggagct

SEQ ID NO: 809126 - DNA, 25 bp, Mus musculus
tgccttacggttccatctcaactgg

SEQ ID NO: 809127 - DNA, 25 bp, Mus musculus
tgccttacggttgcatctcaactgg

SEQ ID NO: 809128 - DNA, 25 bp, Mus musculus
tgccttacgtcaagatcccagcctt

SEQ ID NO: 809129 - DNA, 25 bp, Mus musculus
tgccttacgtcatgatcccagcctt

SEQ ID NO: 809130 - DNA, 25 bp, Mus musculus
tgccttactttgagctcatcatcta

SEQ ID NO: 809131 - DNA, 25 bp, Mus musculus
tgccttactttgtgctcatcatcta

SEQ ID NO: 809132 - DNA, 25 bp, Mus musculus
tgccttagaggactcagctgtccag

SEQ ID NO: 809133 - DNA, 25 bp, Mus musculus
tgccttagaggagtcagctgtccag

SEQ ID NO: 809134 - DNA, 25 bp, Mus musculus
tgccttagatgaacgaacacttgag

SEQ ID NO: 809135 - DNA, 25 bp, Mus musculus
tgccttagatgatcgaacacttgag

SEQ ID NO: 809136 - DNA, 25 bp, Mus musculus
tgccttagcctcctaagtggtgagc

SEQ ID NO: 809137 - DNA, 25 bp, Mus musculus
tgccttagcctcgtaagtggtgagc

SEQ ID NO: 809138 - DNA, 25 bp, Mus musculus
tgccttaggctccttgcttcaagaa

SEQ ID NO: 809139 - DNA, 25 bp, Mus musculus
tgccttaggctcgttgcttcaagaa

SEQ ID NO: 809140 - DNA, 25 bp, Mus musculus
tgccttagtggtaggccccggagca

SEQ ID NO: 809141 - DNA, 25 bp, Mus musculus
tgccttagtggttggccccggagca

SEQ ID NO: 809142 - DNA, 25 bp, Mus musculus
tgccttatacacaaccttcatgaaa

SEQ ID NO: 809143 - DNA, 25 bp, Mus musculus
tgccttatacactaccttcatgaaa

SEQ ID NO: 809144 - DNA, 25 bp, Mus musculus
tgccttatgaggatcatgctaccac

SEQ ID NO: 809145 - DNA, 25 bp, Mus musculus
tgccttatgaggttcatgctaccac

SEQ ID NO: 809146 - DNA, 25 bp, Mus musculus
tgccttcaacagacttgcctctggg

SEQ ID NO: 809147 - DNA, 25 bp, Mus musculus
tgccttcaacagtcttgcctctggg

SEQ ID NO: 809148 - DNA, 25 bp, Mus musculus
tgccttcaagaacttggtgcagaga

SEQ ID NO: 809149 - DNA, 25 bp, Mus musculus
tgccttcaagaagttggtgcagaga

SEQ ID NO: 809150 - DNA, 25 bp, Mus musculus
tgccttcacagtcaagttctaccct

SEQ ID NO: 809151 - DNA, 25 bp, Mus musculus
tgccttcacagtgaagttctaccct

SEQ ID NO: 809152 - DNA, 25 bp, Mus musculus
tgccttcacgggaagacacaagaat

SEQ ID NO: 809153 - DNA, 25 bp, Mus musculus
tgccttcacgggtagacacaagaat

SEQ ID NO: 809154 - DNA, 25 bp, Mus musculus
tgccttcactatcgatggtgtgagc

SEQ ID NO: 809155 - DNA, 25 bp, Mus musculus
tgccttcactatggatggtgtgagc

SEQ ID NO: 809156 - DNA, 25 bp, Mus musculus
tgccttcactcgcatcaactgtcag

SEQ ID NO: 809157 - DNA, 25 bp, Mus musculus
tgccttcactcggatcaactgtcag

SEQ ID NO: 809158 - DNA, 25 bp, Mus musculus
tgccttcactgactgtaacaacatg

SEQ ID NO: 809159 - DNA, 25 bp, Mus musculus
tgccttcactgagtgtaacaacatg

SEQ ID NO: 809160 - DNA, 25 bp, Mus musculus
tgccttcagagcagggtactcctga

SEQ ID NO: 809161 - DNA, 25 bp, Mus musculus
tgccttcagagcattagtcagtgaa

SEQ ID NO: 809162 - DNA, 25 bp, Mus musculus
tgccttcagagctgggtactcctga

SEQ ID NO: 809163 - DNA, 25 bp, Mus musculus
tgccttcagagctttagtcagtgaa

SEQ ID NO: 809164 - DNA, 25 bp, Mus musculus
tgccttcagatgaatcccatgcccg

SEQ ID NO: 809165 - DNA, 25 bp, Mus musculus
tgccttcagatgtatcccatgcccg

SEQ ID NO: 809166 - DNA, 25 bp, Mus musculus
tgccttcagcaaacttatcatttat

SEQ ID NO: 809167 - DNA, 25 bp, Mus musculus
tgccttcagcaatcttatcatttat

SEQ ID NO: 809168 - DNA, 25 bp, Mus musculus
tgccttcagcagacaagtacctcat

SEQ ID NO: 809169 - DNA, 25 bp, Mus musculus
tgccttcagcagtcaagtacctcat

SEQ ID NO: 809170 - DNA, 25 bp, Mus musculus
tgccttcagcttacagatatctcca

SEQ ID NO: 809171 - DNA, 25 bp, Mus musculus
tgccttcagctttcagatatctcca

SEQ ID NO: 809172 - DNA, 25 bp, Mus musculus
tgccttcaggagctgtgaagttaac

SEQ ID NO: 809173 - DNA, 25 bp, Mus musculus
tgccttcaggaggtgtgaagttaac

SEQ ID NO: 809174 - DNA, 25 bp, Mus musculus
tgccttcagggcagtgagcaacgac

SEQ ID NO: 809175 - DNA, 25 bp, Mus musculus
tgccttcagggctgtgagcaacgac

SEQ ID NO: 809176 - DNA, 25 bp, Mus musculus
tgccttcaggtcctagacgcaaata

SEQ ID NO: 809177 - DNA, 25 bp, Mus musculus
tgccttcaggtcgtagacgcaaata

SEQ ID NO: 809178 - DNA, 25 bp, Mus musculus
tgccttccagaacctgatgaaggac

SEQ ID NO: 809179 - DNA, 25 bp, Mus musculus
tgccttccagaagctgatgaaggac

SEQ ID NO: 809180 - DNA, 25 bp, Mus musculus
tgccttccaggacatgccctttcag

SEQ ID NO: 809181 - DNA, 25 bp, Mus musculus
tgccttccaggagatgccctttcag

SEQ ID NO: 809182 - DNA, 25 bp, Mus musculus
tgccttccattacgctgtgcaaggg

SEQ ID NO: 809183 - DNA, 25 bp, Mus musculus
tgccttccattaggctgtgcaaggg

SEQ ID NO: 809184 - DNA, 25 bp, Mus musculus
tgccttccctgtcaactgacgtttg

SEQ ID NO: 809185 - DNA, 25 bp, Mus musculus
tgccttccctgtgaactgacgtttg

SEQ ID NO: 809186 - DNA, 25 bp, Mus musculus
tgccttccgctgacaataaagatgt

SEQ ID NO: 809187 - DNA, 25 bp, Mus musculus
tgccttccgctgtcaataaagatgt

SEQ ID NO: 809188 - DNA, 25 bp, Mus musculus
tgccttccgtagcaagcatgactgt

SEQ ID NO: 809189 - DNA, 25 bp, Mus musculus
tgccttccgtaggaagcatgactgt

SEQ ID NO: 809190 - DNA, 25 bp, Mus musculus
tgccttccgtgacccagcttatcaa

SEQ ID NO: 809191 - DNA, 25 bp, Mus musculus
tgccttccgtgagccagcttatcaa

SEQ ID NO: 809192 - DNA, 25 bp, Mus musculus
tgccttcgaagtataccacccgtgt

SEQ ID NO: 809193 - DNA, 25 bp, Mus musculus
tgccttcgaagtttaccacccgtgt

SEQ ID NO: 809194 - DNA, 25 bp, Mus musculus
tgccttcggaccaacagctggatcg

SEQ ID NO: 809195 - DNA, 25 bp, Mus musculus
tgccttcggacctacagctggatcg

SEQ ID NO: 809196 - DNA, 25 bp, Mus musculus
tgccttcggatcacctagagaatgc

SEQ ID NO: 809197 - DNA, 25 bp, Mus musculus
tgccttcggatctcctagagaatgc

SEQ ID NO: 809198 - DNA, 25 bp, Mus musculus
tgccttcgttccaaattgccagaat

SEQ ID NO: 809199 - DNA, 25 bp, Mus musculus
tgccttcgttcctaattgccagaat

SEQ ID NO: 809200 - DNA, 25 bp, Mus musculus
tgccttctatacactagtccgtgag

SEQ ID NO: 809201 - DNA, 25 bp, Mus musculus
tgccttctatactctagtccgtgag

SEQ ID NO: 809202 - DNA, 25 bp, Mus musculus
tgccttctcaaactcataatcctca

SEQ ID NO: 809203 - DNA, 25 bp, Mus musculus
tgccttctcaaagtcataatcctca

SEQ ID NO: 809204 - DNA, 25 bp, Mus musculus
tgccttctcctgacaggccgggata

SEQ ID NO: 809205 - DNA, 25 bp, Mus musculus
tgccttctcctgtcaggccgggata

SEQ ID NO: 809206 - DNA, 25 bp, Mus musculus
tgccttctctctacttagccggtga

SEQ ID NO: 809207 - DNA, 25 bp, Mus musculus
tgccttctctcttcttagccggtga

SEQ ID NO: 809208 - DNA, 25 bp, Mus musculus
tgccttctctggacaactccaagta

SEQ ID NO: 809209 - DNA, 25 bp, Mus musculus
tgccttctctggtcaactccaagta

SEQ ID NO: 809210 - DNA, 25 bp, Mus musculus
tgccttctgaagaccagggtgggat

SEQ ID NO: 809211 - DNA, 25 bp, Mus musculus
tgccttctgaagtccagggtgggat

SEQ ID NO: 809212 - DNA, 25 bp, Mus musculus
tgccttctgactaattgcctgcttg

SEQ ID NO: 809213 - DNA, 25 bp, Mus musculus
tgccttctgacttattgcctgcttg

SEQ ID NO: 809214 - DNA, 25 bp, Mus musculus
tgccttctgaggacttattctgccc

SEQ ID NO: 809215 - DNA, 25 bp, Mus musculus
tgccttctgaggtcttattctgccc

SEQ ID NO: 809216 - DNA, 25 bp, Mus musculus
tgccttcttccactgtttctgctga

SEQ ID NO: 809217 - DNA, 25 bp, Mus musculus
tgccttcttccagtgtttctgctga

SEQ ID NO: 809218 - DNA, 25 bp, Mus musculus
tgccttcttcgccagagatgaactt

SEQ ID NO: 809219 - DNA, 25 bp, Mus musculus
tgccttcttcgcgagagatgaactt

SEQ ID NO: 809220 - DNA, 25 bp, Mus musculus
tgccttcttcggctggagaagactc

SEQ ID NO: 809221 - DNA, 25 bp, Mus musculus
tgccttcttcgggtggagaagactc

SEQ ID NO: 809222 - DNA, 25 bp, Mus musculus
tgccttgaaagaccactcctccaag

SEQ ID NO: 809223 - DNA, 25 bp, Mus musculus
tgccttgaaagagcactcctccaag

SEQ ID NO: 809224 - DNA, 25 bp, Mus musculus
tgccttgaaataactcacagctgag

SEQ ID NO: 809225 - DNA, 25 bp, Mus musculus
tgccttgaaatatctcacagctgag

SEQ ID NO: 809226 - DNA, 25 bp, Mus musculus
tgccttgaccctcgaggtgctgaag

SEQ ID NO: 809227 - DNA, 25 bp, Mus musculus
tgccttgaccctggaggtgctgaag

SEQ ID NO: 809228 - DNA, 25 bp, Mus musculus
tgccttgactccacggagtatcccg

SEQ ID NO: 809229 - DNA, 25 bp, Mus musculus
tgccttgactcctcggagtatcccg

SEQ ID NO: 809230 - DNA, 25 bp, Mus musculus
tgccttgagcagacacaccaatgtg

SEQ ID NO: 809231 - DNA, 25 bp, Mus musculus
tgccttgagcagtcacaccaatgtg

SEQ ID NO: 809232 - DNA, 25 bp, Mus musculus
tgccttgatggcagggtctatgaca

SEQ ID NO: 809233 - DNA, 25 bp, Mus musculus
tgccttgatggctgggtctatgaca

SEQ ID NO: 809234 - DNA, 25 bp, Mus musculus
tgccttgcaggtaactcacctcagt

SEQ ID NO: 809235 - DNA, 25 bp, Mus musculus
tgccttgcaggttactcacctcagt

SEQ ID NO: 809236 - DNA, 25 bp, Mus musculus
tgccttgcccaaactaagtgagaag

SEQ ID NO: 809237 - DNA, 25 bp, Mus musculus
tgccttgcccaatctaagtgagaag

SEQ ID NO: 809238 - DNA, 25 bp, Mus musculus
tgccttgccctgacaatattgctgc

SEQ ID NO: 809239 - DNA, 25 bp, Mus musculus
tgccttgccctgtcaatattgctgc

SEQ ID NO: 809240 - DNA, 25 bp, Mus musculus
tgccttgcctgtacagacactggtg

SEQ ID NO: 809241 - DNA, 25 bp, Mus musculus
tgccttgcctgttcagacactggtg

SEQ ID NO: 809242 - DNA, 25 bp, Mus musculus
tgccttgctcctatgtcacgcatgc

SEQ ID NO: 809243 - DNA, 25 bp, Mus musculus
tgccttgctcctttgtcacgcatgc

SEQ ID NO: 809244 - DNA, 25 bp, Mus musculus
tgccttgctgccaggatagacccag

SEQ ID NO: 809245 - DNA, 25 bp, Mus musculus
tgccttgctgcctggatagacccag

SEQ ID NO: 809246 - DNA, 25 bp, Mus musculus
tgccttgcttcaccgggacagctgg

SEQ ID NO: 809247 - DNA, 25 bp, Mus musculus
tgccttgcttcagcgggacagctgg

SEQ ID NO: 809248 - DNA, 25 bp, Mus musculus
tgccttgcttttccgtgggacagtg

SEQ ID NO: 809249 - DNA, 25 bp, Mus musculus
tgccttgcttttgcgtgggacagtg

SEQ ID NO: 809250 - DNA, 25 bp, Mus musculus
tgccttggcaataggactgggattg

SEQ ID NO: 809251 - DNA, 25 bp, Mus musculus
tgccttggcaattggactgggattg

SEQ ID NO: 809252 - DNA, 25 bp, Mus musculus
tgccttggcagaacgtggagcatgt

SEQ ID NO: 809253 - DNA, 25 bp, Mus musculus
tgccttggcagatcgtggagcatgt

SEQ ID NO: 809254 - DNA, 25 bp, Mus musculus
tgccttggcataaccctagctttgg

SEQ ID NO: 809255 - DNA, 25 bp, Mus musculus
tgccttggcatatccctagctttgg

SEQ ID NO: 809256 - DNA, 25 bp, Mus musculus
tgccttggccgacggctcattgaca

SEQ ID NO: 809257 - DNA, 25 bp, Mus musculus
tgccttggccgagggctcattgaca

SEQ ID NO: 809258 - DNA, 25 bp, Mus musculus
tgccttgggagaatactcctgcacc

SEQ ID NO: 809259 - DNA, 25 bp, Mus musculus
tgccttgggagattactcctgcacc

SEQ ID NO: 809260 - DNA, 25 bp, Mus musculus
tgccttgggctgagctatctgtcac

SEQ ID NO: 809261 - DNA, 25 bp, Mus musculus
tgccttgggctgtgctatctgtcac

SEQ ID NO: 809262 - DNA, 25 bp, Mus musculus
tgccttgtattcctttgacaaagcc

SEQ ID NO: 809263 - DNA, 25 bp, Mus musculus
tgccttgtattcgtttgacaaagcc

SEQ ID NO: 809264 - DNA, 25 bp, Mus musculus
tgccttgtctcaaagagaagagaac

SEQ ID NO: 809265 - DNA, 25 bp, Mus musculus
tgccttgtctcatagagaagagaac

SEQ ID NO: 809266 - DNA, 25 bp, Mus musculus
tgccttgtgatcctgtttgcctgtg

SEQ ID NO: 809267 - DNA, 25 bp, Mus musculus
tgccttgtgatcgtgtttgcctgtg

SEQ ID NO: 809268 - DNA, 25 bp, Mus musculus
tgccttgttcatcgccagagaatat

SEQ ID NO: 809269 - DNA, 25 bp, Mus musculus
tgccttgttcatggccagagaatat

SEQ ID NO: 809270 - DNA, 25 bp, Mus musculus
tgcctttaacgccagccgaggacga

SEQ ID NO: 809271 - DNA, 25 bp, Mus musculus
tgcctttaacgcgagccgaggacga

SEQ ID NO: 809272 - DNA, 25 bp, Mus musculus
tgcctttatccgctttgacaaacgg

SEQ ID NO: 809273 - DNA, 25 bp, Mus musculus
tgcctttatccggtttgacaaacgg

SEQ ID NO: 809274 - DNA, 25 bp, Mus musculus
tgcctttatgcacaatgggagatga

SEQ ID NO: 809275 - DNA, 25 bp, Mus musculus
tgcctttatgcagaatgggagatga

SEQ ID NO: 809276 - DNA, 25 bp, Mus musculus
tgcctttcaaggacatgatgttgga

SEQ ID NO: 809277 - DNA, 25 bp, Mus musculus
tgcctttcaaggtcatgatgttgga

SEQ ID NO: 809278 - DNA, 25 bp, Mus musculus
tgcctttcaggtcgcggtagctgcc

SEQ ID NO: 809279 - DNA, 25 bp, Mus musculus
tgcctttcaggtggcggtagctgcc

SEQ ID NO: 809280 - DNA, 25 bp, Mus musculus
tgcctttcagtcagatcagtgcaca

SEQ ID NO: 809281 - DNA, 25 bp, Mus musculus
tgcctttcagtctgatcagtgcaca

SEQ ID NO: 809282 - DNA, 25 bp, Mus musculus
tgcctttccttgcttcttgcctggg

SEQ ID NO: 809283 - DNA, 25 bp, Mus musculus
tgcctttccttggttcttgcctggg

SEQ ID NO: 809284 - DNA, 25 bp, Mus musculus
tgcctttctgctcaagtgccaccaa

SEQ ID NO: 809285 - DNA, 25 bp, Mus musculus
tgcctttctgctgaagtgccaccaa

SEQ ID NO: 809286 - DNA, 25 bp, Mus musculus
tgcctttgaaaaactccagtccagc

SEQ ID NO: 809287 - DNA, 25 bp, Mus musculus
tgcctttgaaaacaactcaccctcg

SEQ ID NO: 809288 - DNA, 25 bp, Mus musculus
tgcctttgaaaagaactcaccctcg

SEQ ID NO: 809289 - DNA, 25 bp, Mus musculus
tgcctttgaaaatctccagtccagc

SEQ ID NO: 809290 - DNA, 25 bp, Mus musculus
tgcctttgaattcagtcccagagcc

SEQ ID NO: 809291 - DNA, 25 bp, Mus musculus
tgcctttgaattcctgccgtctttc

SEQ ID NO: 809292 - DNA, 25 bp, Mus musculus
tgcctttgaattgagtcccagagcc

SEQ ID NO: 809293 - DNA, 25 bp, Mus musculus
tgcctttgaattgctgccgtctttc

SEQ ID NO: 809294 - DNA, 25 bp, Mus musculus
tgcctttgacgaagagaccctgagg

SEQ ID NO: 809295 - DNA, 25 bp, Mus musculus
tgcctttgacgatgagaccctgagg

SEQ ID NO: 809296 - DNA, 25 bp, Mus musculus
tgcctttgaggcaagaatctatgca

SEQ ID NO: 809297 - DNA, 25 bp, Mus musculus
tgcctttgaggctagaatctatgca

SEQ ID NO: 809298 - DNA, 25 bp, Mus musculus
tgcctttgagtgagcaaagatgctc

SEQ ID NO: 809299 - DNA, 25 bp, Mus musculus
tgcctttgagtgtgcaaagatgctc

SEQ ID NO: 809300 - DNA, 25 bp, Mus musculus
tgcctttgccaaaacgtcacccgtt

SEQ ID NO: 809301 - DNA, 25 bp, Mus musculus
tgcctttgccaatacgtcacccgtt

SEQ ID NO: 809302 - DNA, 25 bp, Mus musculus
tgcctttgctcccatgaccaatggt

SEQ ID NO: 809303 - DNA, 25 bp, Mus musculus
tgcctttgctccgatgaccaatggt

SEQ ID NO: 809304 - DNA, 25 bp, Mus musculus
tgcctttgcttcactgacgggaaga

SEQ ID NO: 809305 - DNA, 25 bp, Mus musculus
tgcctttgcttctctgacgggaaga

SEQ ID NO: 809306 - DNA, 25 bp, Mus musculus
tgcctttggatgattcttatgtgcc

SEQ ID NO: 809307 - DNA, 25 bp, Mus musculus
tgcctttggatgtttcttatgtgcc

SEQ ID NO: 809308 - DNA, 25 bp, Mus musculus
tgcctttggcccacgtggccattgc

SEQ ID NO: 809309 - DNA, 25 bp, Mus musculus
tgcctttggccctcgtggccattgc

SEQ ID NO: 809310 - DNA, 25 bp, Mus musculus
tgcctttggtatcagtcaatcagga

SEQ ID NO: 809311 - DNA, 25 bp, Mus musculus
tgcctttggtatgagtcaatcagga

SEQ ID NO: 809312 - DNA, 25 bp, Mus musculus
tgcctttgtcacctggcacaggtac

SEQ ID NO: 809313 - DNA, 25 bp, Mus musculus
tgcctttgtcacgtggcacaggtac

SEQ ID NO: 809314 - DNA, 25 bp, Mus musculus
tgcctttgttcaccgagcactctcg

SEQ ID NO: 809315 - DNA, 25 bp, Mus musculus
tgcctttgttcagcgagcactctcg

SEQ ID NO: 809316 - DNA, 25 bp, Mus musculus
tgccttttccgcctaagtgctggaa

SEQ ID NO: 809317 - DNA, 25 bp, Mus musculus
tgccttttccgcgtaagtgctggaa

SEQ ID NO: 809318 - DNA, 25 bp, Mus musculus
tgccttttgcaaatcttacttcaag

SEQ ID NO: 809319 - DNA, 25 bp, Mus musculus
tgccttttgcaattcttacttcaag

SEQ ID NO: 809320 - DNA, 25 bp, Mus musculus
tgccttttgctgaaatatctggaac

SEQ ID NO: 809321 - DNA, 25 bp, Mus musculus
tgccttttgctgtaatatctggaac

SEQ ID NO: 809322 - DNA, 25 bp, Mus musculus
tgcgaaaaccccacagttgaccttt

SEQ ID NO: 809323 - DNA, 25 bp, Mus musculus
tgcgaaaacccctcagttgaccttt

SEQ ID NO: 809324 - DNA, 25 bp, Mus musculus
tgcgaaacgtggctatgaagcacat

SEQ ID NO: 809325 - DNA, 25 bp, Mus musculus
tgcgaaacgtgggtatgaagcacat

SEQ ID NO: 809326 - DNA, 25 bp, Mus musculus
tgcgaaagccaaagtatcagcatct

SEQ ID NO: 809327 - DNA, 25 bp, Mus musculus
tgcgaaagccaatgtatcagcatct

SEQ ID NO: 809328 - DNA, 25 bp, Mus musculus
tgcgaaagccatcgcagaccacatc

SEQ ID NO: 809329 - DNA, 25 bp, Mus musculus
tgcgaaagccatggcagaccacatc

SEQ ID NO: 809330 - DNA, 25 bp, Mus musculus
tgcgaaagcctcctggagttccagg

SEQ ID NO: 809331 - DNA, 25 bp, Mus musculus
tgcgaaagcctcgtggagttccagg

SEQ ID NO: 809332 - DNA, 25 bp, Mus musculus
tgcgaaattattaaaaagaacgagg

SEQ ID NO: 809333 - DNA, 25 bp, Mus musculus
tgcgaaattatttaaaagaacgagg

SEQ ID NO: 809334 - DNA, 25 bp, Mus musculus
tgcgaacagaagataaggccaaata

SEQ ID NO: 809335 - DNA, 25 bp, Mus musculus
tgcgaacagaagttaaggccaaata

SEQ ID NO: 809336 - DNA, 25 bp, Mus musculus
tgcgaacatggccgctcctgcatca

SEQ ID NO: 809337 - DNA, 25 bp, Mus musculus
tgcgaacatggcggctcctgcatca

SEQ ID NO: 809338 - DNA, 25 bp, Mus musculus
tgcgaaccctgcaccagggcgacgg

SEQ ID NO: 809339 - DNA, 25 bp, Mus musculus
tgcgaaccctgctccagggcgacgg

SEQ ID NO: 809340 - DNA, 25 bp, Mus musculus
tgcgaaccctggagaagctaatgtc

SEQ ID NO: 809341 - DNA, 25 bp, Mus musculus
tgcgaaccctggtgaagctaatgtc

SEQ ID NO: 809342 - DNA, 25 bp, Mus musculus
tgcgaaccggcacctgctgctcaga

SEQ ID NO: 809343 - DNA, 25 bp, Mus musculus
tgcgaaccggcagctgctgctcaga

SEQ ID NO: 809344 - DNA, 25 bp, Mus musculus
tgcgaaccttcacggatgcatgctg

SEQ ID NO: 809345 - DNA, 25 bp, Mus musculus
tgcgaaccttcagggatgcatgctg

SEQ ID NO: 809346 - DNA, 25 bp, Mus musculus
tgcgaacgagcactatgaaaaactc

SEQ ID NO: 809347 - DNA, 25 bp, Mus musculus
tgcgaacgagcagtatgaaaaactc

SEQ ID NO: 809348 - DNA, 25 bp, Mus musculus
tgcgaacggtatacagtgggcctcc

SEQ ID NO: 809349 - DNA, 25 bp, Mus musculus
tgcgaacggtattcagtgggcctcc

SEQ ID NO: 809350 - DNA, 25 bp, Mus musculus
tgcgaacggtgccatcaagaagctg

SEQ ID NO: 809351 - DNA, 25 bp, Mus musculus
tgcgaacggtgcgatcaagaagctg

SEQ ID NO: 809352 - DNA, 25 bp, Mus musculus
tgcgaagaacttctcccatctggac

SEQ ID NO: 809353 - DNA, 25 bp, Mus musculus
tgcgaagaacttgtcccatctggac

SEQ ID NO: 809354 - DNA, 25 bp, Mus musculus
tgcgaagaagtgatttgcaccttta

SEQ ID NO: 809355 - DNA, 25 bp, Mus musculus
tgcgaagaagtgttttgcaccttta

SEQ ID NO: 809356 - DNA, 25 bp, Mus musculus
tgcgaagacggtactgatgaaagcc

SEQ ID NO: 809357 - DNA, 25 bp, Mus musculus
tgcgaagacggttctgatgaaagcc

SEQ ID NO: 809358 - DNA, 25 bp, Mus musculus
tgcgaagaggaaagtttaaatctca

SEQ ID NO: 809359 - DNA, 25 bp, Mus musculus
tgcgaagaggaatgtttaaatctca

SEQ ID NO: 809360 - DNA, 25 bp, Mus musculus
tgcgaagatgctactctctgcaaga

SEQ ID NO: 809361 - DNA, 25 bp, Mus musculus
tgcgaagatgcttctctctgcaaga

SEQ ID NO: 809362 - DNA, 25 bp, Mus musculus
tgcgaagcgctcagcacgcgcctgg

SEQ ID NO: 809363 - DNA, 25 bp, Mus musculus
tgcgaagcgctctgcacgcgcctgg

SEQ ID NO: 809364 - DNA, 25 bp, Mus musculus
tgcgaagctgagatccctagtaaag

SEQ ID NO: 809365 - DNA, 25 bp, Mus musculus
tgcgaagctgagttccctagtaaag

SEQ ID NO: 809366 - DNA, 25 bp, Mus musculus
tgcgaaggaaccacagctggagcag

SEQ ID NO: 809367 - DNA, 25 bp, Mus musculus
tgcgaaggaacctcagctggagcag

SEQ ID NO: 809368 - DNA, 25 bp, Mus musculus
tgcgaaggaccaatacgatgctaca

SEQ ID NO: 809369 - DNA, 25 bp, Mus musculus
tgcgaaggaccattacgatgctaca

SEQ ID NO: 809370 - DNA, 25 bp, Mus musculus
tgcgaaggaggcaggtccccagata

SEQ ID NO: 809371 - DNA, 25 bp, Mus musculus
tgcgaaggaggctggtccccagata

SEQ ID NO: 809372 - DNA, 25 bp, Mus musculus
tgcgaagggacccacaaccctggga

SEQ ID NO: 809373 - DNA, 25 bp, Mus musculus
tgcgaagggaccgacaaccctggga

SEQ ID NO: 809374 - DNA, 25 bp, Mus musculus
tgcgaagggctccaagatggccggt

SEQ ID NO: 809375 - DNA, 25 bp, Mus musculus
tgcgaagggctcgaagatggccggt

SEQ ID NO: 809376 - DNA, 25 bp, Mus musculus
tgcgaagtggccaacggcactgaag

SEQ ID NO: 809377 - DNA, 25 bp, Mus musculus
tgcgaagtggcctacggcactgaag

SEQ ID NO: 809378 - DNA, 25 bp, Mus musculus
tgcgaatagagaaggccatgaagga

SEQ ID NO: 809379 - DNA, 25 bp, Mus musculus
tgcgaatagagatggccatgaagga

SEQ ID NO: 809380 - DNA, 25 bp, Mus musculus
tgcgaatcctagatgcagcgggcaa

SEQ ID NO: 809381 - DNA, 25 bp, Mus musculus
tgcgaatcctagttgcagcgggcaa

SEQ ID NO: 809382 - DNA, 25 bp, Mus musculus
tgcgaatgcgaaagcctcgtggagt

SEQ ID NO: 809383 - DNA, 25 bp, Mus musculus
tgcgaatgcgaatgcctcgtggagt

SEQ ID NO: 809384 - DNA, 25 bp, Mus musculus
tgcgaattaagcagattacggagga

SEQ ID NO: 809385 - DNA, 25 bp, Mus musculus
tgcgaattaagctgattacggagga

SEQ ID NO: 809386 - DNA, 25 bp, Mus musculus
tgcgaatttccacagaagccaatag

SEQ ID NO: 809387 - DNA, 25 bp, Mus musculus
tgcgaatttccagagaagccaatag

SEQ ID NO: 809388 - DNA, 25 bp, Mus musculus
tgcgaattttgcatccacctggatt

SEQ ID NO: 809389 - DNA, 25 bp, Mus musculus
tgcgaattttgcttccacctggatt

SEQ ID NO: 809390 - DNA, 25 bp, Mus musculus
tgcgacaagggaatgaaaactcacc

SEQ ID NO: 809391 - DNA, 25 bp, Mus musculus
tgcgacaagggattgaaaactcacc

SEQ ID NO: 809392 - DNA, 25 bp, Mus musculus
tgcgacactcagcttcggccctgag

SEQ ID NO: 809393 - DNA, 25 bp, Mus musculus
tgcgacactcaggttcggccctgag

SEQ ID NO: 809394 - DNA, 25 bp, Mus musculus
tgcgacaggactacaacttgatgga

SEQ ID NO: 809395 - DNA, 25 bp, Mus musculus
tgcgacaggacttcaacttgatgga

SEQ ID NO: 809396 - DNA, 25 bp, Mus musculus
tgcgacatcagtcgaccccatgttg

SEQ ID NO: 809397 - DNA, 25 bp, Mus musculus
tgcgacatcagtggaccccatgttg

SEQ ID NO: 809398 - DNA, 25 bp, Mus musculus
tgcgacatgatgaggatattgtcac

SEQ ID NO: 809399 - DNA, 25 bp, Mus musculus
tgcgacatgatgtggatattgtcac

SEQ ID NO: 809400 - DNA, 25 bp, Mus musculus
tgcgaccaagctactcccggatatc

SEQ ID NO: 809401 - DNA, 25 bp, Mus musculus
tgcgaccaagcttctcccggatatc

SEQ ID NO: 809402 - DNA, 25 bp, Mus musculus
tgcgaccacctaacaggattcaacg

SEQ ID NO: 809403 - DNA, 25 bp, Mus musculus
tgcgaccacctatcaggattcaacg

SEQ ID NO: 809404 - DNA, 25 bp, Mus musculus
tgcgaccagggcagtaacagtgccg

SEQ ID NO: 809405 - DNA, 25 bp, Mus musculus
tgcgaccagggctgtaacagtgccg

SEQ ID NO: 809406 - DNA, 25 bp, Mus musculus
tgcgaccatactcggaagcttcagt

SEQ ID NO: 809407 - DNA, 25 bp, Mus musculus
tgcgaccatactgggaagcttcagt

SEQ ID NO: 809408 - DNA, 25 bp, Mus musculus
tgcgaccatcaaagcagacattaac

SEQ ID NO: 809409 - DNA, 25 bp, Mus musculus
tgcgaccatcaatgcagacattaac

SEQ ID NO: 809410 - DNA, 25 bp, Mus musculus
tgcgacccaggaagggaacttcgat

SEQ ID NO: 809411 - DNA, 25 bp, Mus musculus
tgcgacccaggatgggaacttcgat

SEQ ID NO: 809412 - DNA, 25 bp, Mus musculus
tgcgaccccagccagggcctggttt

SEQ ID NO: 809413 - DNA, 25 bp, Mus musculus
tgcgaccccagcgagggcctggttt

SEQ ID NO: 809414 - DNA, 25 bp, Mus musculus
tgcgaccgcaccagtaaggacacgt

SEQ ID NO: 809415 - DNA, 25 bp, Mus musculus
tgcgaccgcacctgtaaggacacgt

SEQ ID NO: 809416 - DNA, 25 bp, Mus musculus
tgcgacctctctacatggacgtaca

SEQ ID NO: 809417 - DNA, 25 bp, Mus musculus
tgcgacctctcttcatggacgtaca

SEQ ID NO: 809418 - DNA, 25 bp, Mus musculus
tgcgaccttgtaacagcaactgaga

SEQ ID NO: 809419 - DNA, 25 bp, Mus musculus
tgcgaccttgtatcagcaactgaga

SEQ ID NO: 809420 - DNA, 25 bp, Mus musculus
tgcgacgacgctcgctctgagagtc

SEQ ID NO: 809421 - DNA, 25 bp, Mus musculus
tgcgacgacgctggctctgagagtc

SEQ ID NO: 809422 - DNA, 25 bp, Mus musculus
tgcgacgccgagattcactccggct

SEQ ID NO: 809423 - DNA, 25 bp, Mus musculus
tgcgacgccgagtttcactccggct

SEQ ID NO: 809424 - DNA, 25 bp, Mus musculus
tgcgacggagtcctccaaaggctct

SEQ ID NO: 809425 - DNA, 25 bp, Mus musculus
tgcgacggagtcgtccaaaggctct

SEQ ID NO: 809426 - DNA, 25 bp, Mus musculus
tgcgacgtgctcagtgtgtcctgtg

SEQ ID NO: 809427 - DNA, 25 bp, Mus musculus
tgcgacgtgctctgtgtgtcctgtg

SEQ ID NO: 809428 - DNA, 25 bp, Mus musculus
tgcgactctagaagcatcccatgaa

SEQ ID NO: 809429 - DNA, 25 bp, Mus musculus
tgcgactctagatgcatcccatgaa

SEQ ID NO: 809430 - DNA, 25 bp, Mus musculus
tgcgactctctaaaacccttgccgg

SEQ ID NO: 809431 - DNA, 25 bp, Mus musculus
tgcgactctctataacccttgccgg

SEQ ID NO: 809432 - DNA, 25 bp, Mus musculus
tgcgactggctaaccccagcatgct

SEQ ID NO: 809433 - DNA, 25 bp, Mus musculus
tgcgactggctatccccagcatgct

SEQ ID NO: 809434 - DNA, 25 bp, Mus musculus
tgcgacttcgaccttggcagtggta

SEQ ID NO: 809435 - DNA, 25 bp, Mus musculus
tgcgacttcgacgttggcagtggta

SEQ ID NO: 809436 - DNA, 25 bp, Mus musculus
tgcgacttcgagataacgggcttct

SEQ ID NO: 809437 - DNA, 25 bp, Mus musculus
tgcgacttcgagttaacgggcttct

SEQ ID NO: 809438 - DNA, 25 bp, Mus musculus
tgcgacttgactatttcagtgctcc

SEQ ID NO: 809439 - DNA, 25 bp, Mus musculus
tgcgacttgactttttcagtgctcc

SEQ ID NO: 809440 - DNA, 25 bp, Mus musculus
tgcgactttggccacgccttgtgcc

SEQ ID NO: 809441 - DNA, 25 bp, Mus musculus
tgcgactttggcgacgccttgtgcc

SEQ ID NO: 809442 - DNA, 25 bp, Mus musculus
tgcgagaacaagaaaacgacctctt

SEQ ID NO: 809443 - DNA, 25 bp, Mus musculus
tgcgagaacaagtaaacgacctctt

SEQ ID NO: 809444 - DNA, 25 bp, Mus musculus
tgcgagaacttcaggagactaatgc

SEQ ID NO: 809445 - DNA, 25 bp, Mus musculus
tgcgagaacttctggagactaatgc

SEQ ID NO: 809446 - DNA, 25 bp, Mus musculus
tgcgagaaggccactatttcaaccc

SEQ ID NO: 809447 - DNA, 25 bp, Mus musculus
tgcgagaaggcctctatttcaaccc

SEQ ID NO: 809448 - DNA, 25 bp, Mus musculus
tgcgagaagtatatgcccggcagct

SEQ ID NO: 809449 - DNA, 25 bp, Mus musculus
tgcgagaagtatttgcccggcagct

SEQ ID NO: 809450 - DNA, 25 bp, Mus musculus
tgcgagaatctgattcccggatgcc

SEQ ID NO: 809451 - DNA, 25 bp, Mus musculus
tgcgagaatctgtttcccggatgcc

SEQ ID NO: 809452 - DNA, 25 bp, Mus musculus
tgcgagacccctcgtatccgcggaa

SEQ ID NO: 809453 - DNA, 25 bp, Mus musculus
tgcgagacccctggtatccgcggaa

SEQ ID NO: 809454 - DNA, 25 bp, Mus musculus
tgcgagaccggcaaagaagaacctg

SEQ ID NO: 809455 - DNA, 25 bp, Mus musculus
tgcgagaccggctaagaagaacctg

SEQ ID NO: 809456 - DNA, 25 bp, Mus musculus
tgcgagatccataccacgcaccgtt

SEQ ID NO: 809457 - DNA, 25 bp, Mus musculus
tgcgagatccattccacgcaccgtt

SEQ ID NO: 809458 - DNA, 25 bp, Mus musculus
tgcgagcaagcgcaatatcacatgt

SEQ ID NO: 809459 - DNA, 25 bp, Mus musculus
tgcgagcaagcggaatatcacatgt

SEQ ID NO: 809460 - DNA, 25 bp, Mus musculus
tgcgagcaatccagtccttagatgc

SEQ ID NO: 809461 - DNA, 25 bp, Mus musculus
tgcgagcaatcctgtccttagatgc

SEQ ID NO: 809462 - DNA, 25 bp, Mus musculus
tgcgagcacagtcgaaattgttcct

SEQ ID NO: 809463 - DNA, 25 bp, Mus musculus
tgcgagcacagtggaaattgttcct

SEQ ID NO: 809464 - DNA, 25 bp, Mus musculus
tgcgagcagatcagaagaaatttgg

SEQ ID NO: 809465 - DNA, 25 bp, Mus musculus
tgcgagcagatctgaagaaatttgg

SEQ ID NO: 809466 - DNA, 25 bp, Mus musculus
tgcgagcagattctaggagccctac

SEQ ID NO: 809467 - DNA, 25 bp, Mus musculus
tgcgagcagattgtaggagccctac

SEQ ID NO: 809468 - DNA, 25 bp, Mus musculus
tgcgagccacccagaagttaattaa

SEQ ID NO: 809469 - DNA, 25 bp, Mus musculus
tgcgagccaccctgaagttaattaa

SEQ ID NO: 809470 - DNA, 25 bp, Mus musculus
tgcgagcccaagaatcccaacagga

SEQ ID NO: 809471 - DNA, 25 bp, Mus musculus
tgcgagcccaagtatcccaacagga

SEQ ID NO: 809472 - DNA, 25 bp, Mus musculus
tgcgagcccattcagagcgtctatt

SEQ ID NO: 809473 - DNA, 25 bp, Mus musculus
tgcgagcccattgagagcgtctatt

SEQ ID NO: 809474 - DNA, 25 bp, Mus musculus
tgcgagcccttgacttcaatacccg

SEQ ID NO: 809475 - DNA, 25 bp, Mus musculus
tgcgagcccttgtcttcaatacccg

SEQ ID NO: 809476 - DNA, 25 bp, Mus musculus
tgcgagccttccacgaggacgatga

SEQ ID NO: 809477 - DNA, 25 bp, Mus musculus
tgcgagccttcctcgaggacgatga

SEQ ID NO: 809478 - DNA, 25 bp, Mus musculus
tgcgagcgtcgaaatcgtcctgcgc

SEQ ID NO: 809479 - DNA, 25 bp, Mus musculus
tgcgagcgtcgatatcgtcctgcgc

SEQ ID NO: 809480 - DNA, 25 bp, Mus musculus
tgcgagctctgcctaagaacaagac

SEQ ID NO: 809481 - DNA, 25 bp, Mus musculus
tgcgagctctgcgtaagaacaagac

SEQ ID NO: 809482 - DNA, 25 bp, Mus musculus
tgcgagctgcgcagggaccagttcc

SEQ ID NO: 809483 - DNA, 25 bp, Mus musculus
tgcgagctgcgctgggaccagttcc

SEQ ID NO: 809484 - DNA, 25 bp, Mus musculus
tgcgagctgtcaagaagcatgccaa

SEQ ID NO: 809485 - DNA, 25 bp, Mus musculus
tgcgagctgtcatgaagcatgccaa

SEQ ID NO: 809486 - DNA, 25 bp, Mus musculus
tgcgagctgttcctgaccaagaaaa

SEQ ID NO: 809487 - DNA, 25 bp, Mus musculus
tgcgagctgttcgtgaccaagaaaa

SEQ ID NO: 809488 - DNA, 25 bp, Mus musculus
tgcgagcttgtccagagccctgtga

SEQ ID NO: 809489 - DNA, 25 bp, Mus musculus
tgcgagcttgtcgagagccctgtga

SEQ ID NO: 809490 - DNA, 25 bp, Mus musculus
tgcgaggacccgagtccggaaacgt

SEQ ID NO: 809491 - DNA, 25 bp, Mus musculus
tgcgaggacccgtgtccggaaacgt

SEQ ID NO: 809492 - DNA, 25 bp, Mus musculus
tgcgaggacctgcagtcatggaaaa

SEQ ID NO: 809493 - DNA, 25 bp, Mus musculus
tgcgaggacctggagtcatggaaaa

SEQ ID NO: 809494 - DNA, 25 bp, Mus musculus
tgcgaggatcacactaccagcccat

SEQ ID NO: 809495 - DNA, 25 bp, Mus musculus
tgcgaggatcactctaccagcccat

SEQ ID NO: 809496 - DNA, 25 bp, Mus musculus
tgcgaggcagaaagtaaccaggacc

SEQ ID NO: 809497 - DNA, 25 bp, Mus musculus
tgcgaggcagaatgtaaccaggacc

SEQ ID NO: 809498 - DNA, 25 bp, Mus musculus
tgcgagggccagaatgaggctacct

SEQ ID NO: 809499 - DNA, 25 bp, Mus musculus
tgcgagggccagtatgaggctacct

SEQ ID NO: 809500 - DNA, 25 bp, Mus musculus
tgcgagggcgcaatgtcgagaacat

SEQ ID NO: 809501 - DNA, 25 bp, Mus musculus
tgcgagggcgcattgtcgagaacat

SEQ ID NO: 809502 - DNA, 25 bp, Mus musculus
tgcgaggtcctgcaggaccgtaccc

SEQ ID NO: 809503 - DNA, 25 bp, Mus musculus
tgcgaggtcctggaggaccgtaccc

SEQ ID NO: 809504 - DNA, 25 bp, Mus musculus
tgcgagtcatgaaccacggattcaa

SEQ ID NO: 809505 - DNA, 25 bp, Mus musculus
tgcgagtcatgatccacggattcaa

SEQ ID NO: 809506 - DNA, 25 bp, Mus musculus
tgcgagtcccatcttgggaagacaa

SEQ ID NO: 809507 - DNA, 25 bp, Mus musculus
tgcgagtcccatgttgggaagacaa

SEQ ID NO: 809508 - DNA, 25 bp, Mus musculus
tgcgagtccgagctgttccacgcgt

SEQ ID NO: 809509 - DNA, 25 bp, Mus musculus
tgcgagtccgaggtgttccacgcgt

SEQ ID NO: 809510 - DNA, 25 bp, Mus musculus
tgcgagtgcacaagatcaacaatgt

SEQ ID NO: 809511 - DNA, 25 bp, Mus musculus
tgcgagtgcacatgatcaacaatgt

SEQ ID NO: 809512 - DNA, 25 bp, Mus musculus
tgcgagtgccaaataggtctttact

SEQ ID NO: 809513 - DNA, 25 bp, Mus musculus
tgcgagtgccaattaggtctttact

SEQ ID NO: 809514 - DNA, 25 bp, Mus musculus
tgcgagtggcacagtcagagcccca

SEQ ID NO: 809515 - DNA, 25 bp, Mus musculus
tgcgagtggcactgtcagagcccca

SEQ ID NO: 809516 - DNA, 25 bp, Mus musculus
tgcgataatttgattcacaagtgga

SEQ ID NO: 809517 - DNA, 25 bp, Mus musculus
tgcgataatttgtttcacaagtgga

SEQ ID NO: 809518 - DNA, 25 bp, Mus musculus
tgcgatacagcacaatggagacccg

SEQ ID NO: 809519 - DNA, 25 bp, Mus musculus
tgcgatacagcagaatggagacccg

SEQ ID NO: 809520 - DNA, 25 bp, Mus musculus
tgcgatcacaatccaaagggactgg

SEQ ID NO: 809521 - DNA, 25 bp, Mus musculus
tgcgatcacaatgcaaagggactgg

SEQ ID NO: 809522 - DNA, 25 bp, Mus musculus
tgcgatcagcaaacattctagtggg

SEQ ID NO: 809523 - DNA, 25 bp, Mus musculus
tgcgatcagcaatcattctagtggg

SEQ ID NO: 809524 - DNA, 25 bp, Mus musculus
tgcgatccacccagtcctactttgg

SEQ ID NO: 809525 - DNA, 25 bp, Mus musculus
tgcgatccaccctgtcctactttgg

SEQ ID NO: 809526 - DNA, 25 bp, Mus musculus
tgcgatccagacatgtccagagctg

SEQ ID NO: 809527 - DNA, 25 bp, Mus musculus
tgcgatccagacttgtccagagctg

SEQ ID NO: 809528 - DNA, 25 bp, Mus musculus
tgcgatccgaaacaagctggtgatt

SEQ ID NO: 809529 - DNA, 25 bp, Mus musculus
tgcgatccgaaagaagctggtgatt

SEQ ID NO: 809530 - DNA, 25 bp, Mus musculus
tgcgatcctggacctatcaaagaga

SEQ ID NO: 809531 - DNA, 25 bp, Mus musculus
tgcgatcctggagctatcaaagaga

SEQ ID NO: 809532 - DNA, 25 bp, Mus musculus
tgcgatcgtgccaggagcactctgg

SEQ ID NO: 809533 - DNA, 25 bp, Mus musculus
tgcgatcgtgcccttgcatgcagcc

SEQ ID NO: 809534 - DNA, 25 bp, Mus musculus
tgcgatcgtgccgttgcatgcagcc

SEQ ID NO: 809535 - DNA, 25 bp, Mus musculus
tgcgatcgtgcctggagcactctgg

SEQ ID NO: 809536 - DNA, 25 bp, Mus musculus
tgcgatcgtgttcaggacgcgtaca

SEQ ID NO: 809537 - DNA, 25 bp, Mus musculus
tgcgatcgtgttgaggacgcgtaca

SEQ ID NO: 809538 - DNA, 25 bp, Mus musculus
tgcgatctcttaataacttccgggc

SEQ ID NO: 809539 - DNA, 25 bp, Mus musculus
tgcgatctcttattaacttccgggc

SEQ ID NO: 809540 - DNA, 25 bp, Mus musculus
tgcgatgagctccttccagggacag

SEQ ID NO: 809541 - DNA, 25 bp, Mus musculus
tgcgatgagctcgttccagggacag

SEQ ID NO: 809542 - DNA, 25 bp, Mus musculus
tgcgatgatgccagaaacctcagcg

SEQ ID NO: 809543 - DNA, 25 bp, Mus musculus
tgcgatgatgcctgaaacctcagcg

SEQ ID NO: 809544 - DNA, 25 bp, Mus musculus
tgcgatgccagtattgtgggtttta

SEQ ID NO: 809545 - DNA, 25 bp, Mus musculus
tgcgatgccagttttgtgggtttta

SEQ ID NO: 809546 - DNA, 25 bp, Mus musculus
tgcgatggtgaaaatgattgtgaca

SEQ ID NO: 809547 - DNA, 25 bp, Mus musculus
tgcgatggtgaatatgattgtgaca

SEQ ID NO: 809548 - DNA, 25 bp, Mus musculus
tgcgatggtgcaagtcaacaaggcc

SEQ ID NO: 809549 - DNA, 25 bp, Mus musculus
tgcgatggtgcatgtcaacaaggcc

SEQ ID NO: 809550 - DNA, 25 bp, Mus musculus
tgcgattctctcctgatgggaacag

SEQ ID NO: 809551 - DNA, 25 bp, Mus musculus
tgcgattctctcgtgatgggaacag

SEQ ID NO: 809552 - DNA, 25 bp, Mus musculus
tgcgattgcaataatgggacacagc

SEQ ID NO: 809553 - DNA, 25 bp, Mus musculus
tgcgattgcaattatgggacacagc

SEQ ID NO: 809554 - DNA, 25 bp, Mus musculus
tgcgattggagcatttctcatctac

SEQ ID NO: 809555 - DNA, 25 bp, Mus musculus
tgcgattggagcttttctcatctac

SEQ ID NO: 809556 - DNA, 25 bp, Mus musculus
tgcgattgtcctagagaaccttcac

SEQ ID NO: 809557 - DNA, 25 bp, Mus musculus
tgcgattgtcctatgagaagcagga

SEQ ID NO: 809558 - DNA, 25 bp, Mus musculus
tgcgattgtccttgagaaccttcac

SEQ ID NO: 809559 - DNA, 25 bp, Mus musculus
tgcgattgtcctttgagaagcagga

SEQ ID NO: 809560 - DNA, 25 bp, Mus musculus
tgcgattgttttcaatggccaccct

SEQ ID NO: 809561 - DNA, 25 bp, Mus musculus
tgcgattgttttgaatggccaccct

SEQ ID NO: 809562 - DNA, 25 bp, Mus musculus
tgcgcaaacgtcatcttcctgctat

SEQ ID NO: 809563 - DNA, 25 bp, Mus musculus
tgcgcaaacgtcttcttcctgctat

SEQ ID NO: 809564 - DNA, 25 bp, Mus musculus
tgcgcaaagcagacatgctcgagaa

SEQ ID NO: 809565 - DNA, 25 bp, Mus musculus
tgcgcaaagcagtcatgctcgagaa

SEQ ID NO: 809566 - DNA, 25 bp, Mus musculus
tgcgcaacaactcctggaaggagaa

SEQ ID NO: 809567 - DNA, 25 bp, Mus musculus
tgcgcaacaactgctggaaggagaa

SEQ ID NO: 809568 - DNA, 25 bp, Mus musculus
tgcgcaacatgaagagaagtttctc

SEQ ID NO: 809569 - DNA, 25 bp, Mus musculus
tgcgcaacatgatgagaagtttctc

SEQ ID NO: 809570 - DNA, 25 bp, Mus musculus
tgcgcaagcagactacctctatgaa

SEQ ID NO: 809571 - DNA, 25 bp, Mus musculus
tgcgcaagcagagtacctctatgaa

SEQ ID NO: 809572 - DNA, 25 bp, Mus musculus
tgcgcaagctggagcgctcactgac

SEQ ID NO: 809573 - DNA, 25 bp, Mus musculus
tgcgcaagctggtgcgctcactgac

SEQ ID NO: 809574 - DNA, 25 bp, Mus musculus
tgcgcaaggacgacacagccttgaa

SEQ ID NO: 809575 - DNA, 25 bp, Mus musculus
tgcgcaaggacgtcacagccttgaa

SEQ ID NO: 809576 - DNA, 25 bp, Mus musculus
tgcgcaaggagtcccggaagcttat

SEQ ID NO: 809577 - DNA, 25 bp, Mus musculus
tgcgcaaggagtgccggaagcttat

SEQ ID NO: 809578 - DNA, 25 bp, Mus musculus
tgcgcaaggccgagtgcatcgttcg

SEQ ID NO: 809579 - DNA, 25 bp, Mus musculus
tgcgcaaggccgtgtgcatcgttcg

SEQ ID NO: 809580 - DNA, 25 bp, Mus musculus
tgcgcaagtaagaaaactaaagact

SEQ ID NO: 809581 - DNA, 25 bp, Mus musculus
tgcgcaagtaagtaaactaaagact

SEQ ID NO: 809582 - DNA, 25 bp, Mus musculus
tgcgcaagtctgaggataaggaccc

SEQ ID NO: 809583 - DNA, 25 bp, Mus musculus
tgcgcaagtctgtggataaggaccc

SEQ ID NO: 809584 - DNA, 25 bp, Mus musculus
tgcgcaatgtgaccccaagggacag

SEQ ID NO: 809585 - DNA, 25 bp, Mus musculus
tgcgcaatgtgagcccaagggacag

SEQ ID NO: 809586 - DNA, 25 bp, Mus musculus
tgcgcacaacatcggaaaccacctg

SEQ ID NO: 809587 - DNA, 25 bp, Mus musculus
tgcgcacaacatgggaaaccacctg

SEQ ID NO: 809588 - DNA, 25 bp, Mus musculus
tgcgcacaaggcctccaacgactta

SEQ ID NO: 809589 - DNA, 25 bp, Mus musculus
tgcgcacaaggcgtccaacgactta

SEQ ID NO: 809590 - DNA, 25 bp, Mus musculus
tgcgcacacactcacaccaagattt

SEQ ID NO: 809591 - DNA, 25 bp, Mus musculus
tgcgcacacactgacaccaagattt

SEQ ID NO: 809592 - DNA, 25 bp, Mus musculus
tgcgcacagatcagtacaactcccg

SEQ ID NO: 809593 - DNA, 25 bp, Mus musculus
tgcgcacagatctgtacaactcccg

SEQ ID NO: 809594 - DNA, 25 bp, Mus musculus
tgcgcaccggtgacacattatcgga

SEQ ID NO: 809595 - DNA, 25 bp, Mus musculus
tgcgcaccggtgtcacattatcgga

SEQ ID NO: 809596 - DNA, 25 bp, Mus musculus
tgcgcacctcgccttcctgacttcg

SEQ ID NO: 809597 - DNA, 25 bp, Mus musculus
tgcgcacctcgcgttcctgacttcg

SEQ ID NO: 809598 - DNA, 25 bp, Mus musculus
tgcgcactccctacgggcatagcat

SEQ ID NO: 809599 - DNA, 25 bp, Mus musculus
tgcgcactcccttcgggcatagcat

SEQ ID NO: 809600 - DNA, 25 bp, Mus musculus
tgcgcactggtcacaaccgggcagt

SEQ ID NO: 809601 - DNA, 25 bp, Mus musculus
tgcgcactggtctcaaccgggcagt

SEQ ID NO: 809602 - DNA, 25 bp, Mus musculus
tgcgcagaacttaggacgcgggtct

SEQ ID NO: 809603 - DNA, 25 bp, Mus musculus
tgcgcagaactttggacgcgggtct

SEQ ID NO: 809604 - DNA, 25 bp, Mus musculus
tgcgcagactcacaaggcgctcttg

SEQ ID NO: 809605 - DNA, 25 bp, Mus musculus
tgcgcagactcagaaggcgctcttg

SEQ ID NO: 809606 - DNA, 25 bp, Mus musculus
tgcgcagactccacgctgcagtggg

SEQ ID NO: 809607 - DNA, 25 bp, Mus musculus
tgcgcagactcctcgctgcagtggg

SEQ ID NO: 809608 - DNA, 25 bp, Mus musculus
tgcgcagactgaccaaggacatccg

SEQ ID NO: 809609 - DNA, 25 bp, Mus musculus
tgcgcagactgagcaaggacatccg

SEQ ID NO: 809610 - DNA, 25 bp, Mus musculus
tgcgcagagaggaatgcagtgtccc

SEQ ID NO: 809611 - DNA, 25 bp, Mus musculus
tgcgcagagaggtatgcagtgtccc

SEQ ID NO: 809612 - DNA, 25 bp, Mus musculus
tgcgcagagcgaccgagaacccgaa

SEQ ID NO: 809613 - DNA, 25 bp, Mus musculus
tgcgcagagcgagcgagaacccgaa

SEQ ID NO: 809614 - DNA, 25 bp, Mus musculus
tgcgcagaggcactggctttcgatc

SEQ ID NO: 809615 - DNA, 25 bp, Mus musculus
tgcgcagaggcagtggctttcgatc

SEQ ID NO: 809616 - DNA, 25 bp, Mus musculus
tgcgcagaggtgcaaacagacacca

SEQ ID NO: 809617 - DNA, 25 bp, Mus musculus
tgcgcagaggtggaaacagacacca

SEQ ID NO: 809618 - DNA, 25 bp, Mus musculus
tgcgcagatggcagtgtcccagacg

SEQ ID NO: 809619 - DNA, 25 bp, Mus musculus
tgcgcagatggctgtgtcccagacg

SEQ ID NO: 809620 - DNA, 25 bp, Mus musculus
tgcgcagcaacgaggacttcctgct

SEQ ID NO: 809621 - DNA, 25 bp, Mus musculus
tgcgcagcaacgtggacttcctgct

SEQ ID NO: 809622 - DNA, 25 bp, Mus musculus
tgcgcagcagccactgttcttcggg

SEQ ID NO: 809623 - DNA, 25 bp, Mus musculus
tgcgcagcagcctctgttcttcggg

SEQ ID NO: 809624 - DNA, 25 bp, Mus musculus
tgcgcagcatcaagaagactgatct

SEQ ID NO: 809625 - DNA, 25 bp, Mus musculus
tgcgcagcatcatgaagactgatct

SEQ ID NO: 809626 - DNA, 25 bp, Mus musculus
tgcgcagccacaagattcagaccca

SEQ ID NO: 809627 - DNA, 25 bp, Mus musculus
tgcgcagccacatgattcagaccca

SEQ ID NO: 809628 - DNA, 25 bp, Mus musculus
tgcgcagcgggcaccgtaagcaccg

SEQ ID NO: 809629 - DNA, 25 bp, Mus musculus
tgcgcagcgggctccgtaagcaccg

SEQ ID NO: 809630 - DNA, 25 bp, Mus musculus
tgcgcagctcgtacaggtcatcaag

SEQ ID NO: 809631 - DNA, 25 bp, Mus musculus
tgcgcagctcgttcaggtcatcaag

SEQ ID NO: 809632 - DNA, 25 bp, Mus musculus
tgcgcagctgtgcaataagcatgat

SEQ ID NO: 809633 - DNA, 25 bp, Mus musculus
tgcgcagctgtggaataagcatgat

SEQ ID NO: 809634 - DNA, 25 bp, Mus musculus
tgcgcagcttccagcttcgggagat

SEQ ID NO: 809635 - DNA, 25 bp, Mus musculus
tgcgcagcttcctgcttcgggagat

SEQ ID NO: 809636 - DNA, 25 bp, Mus musculus
tgcgcaggaagtacactctcataga

SEQ ID NO: 809637 - DNA, 25 bp, Mus musculus
tgcgcaggaagttcactctcataga

SEQ ID NO: 809638 - DNA, 25 bp, Mus musculus
tgcgcagtcccccaaagaagggctt

SEQ ID NO: 809639 - DNA, 25 bp, Mus musculus
tgcgcagtccccgaaagaagggctt

SEQ ID NO: 809640 - DNA, 25 bp, Mus musculus
tgcgcagtctcactttattccagct

SEQ ID NO: 809641 - DNA, 25 bp, Mus musculus
tgcgcagtctcagtttattccagct

SEQ ID NO: 809642 - DNA, 25 bp, Mus musculus
tgcgcagtctggaccagcagatgta

SEQ ID NO: 809643 - DNA, 25 bp, Mus musculus
tgcgcagtctggtccagcagatgta

SEQ ID NO: 809644 - DNA, 25 bp, Mus musculus
tgcgcagtgctaaaccacctgggag

SEQ ID NO: 809645 - DNA, 25 bp, Mus musculus
tgcgcagtgctataccacctgggag

SEQ ID NO: 809646 - DNA, 25 bp, Mus musculus
tgcgcagtgtccatcacggaacaac

SEQ ID NO: 809647 - DNA, 25 bp, Mus musculus
tgcgcagtgtccttcacggaacaac

SEQ ID NO: 809648 - DNA, 25 bp, Mus musculus
tgcgcatagtggagattgacctgtt

SEQ ID NO: 809649 - DNA, 25 bp, Mus musculus
tgcgcatagtggtgattgacctgtt

SEQ ID NO: 809650 - DNA, 25 bp, Mus musculus
tgcgcatccagaacctgaggagaaa

SEQ ID NO: 809651 - DNA, 25 bp, Mus musculus
tgcgcatccagatcctgaggagaaa

SEQ ID NO: 809652 - DNA, 25 bp, Mus musculus
tgcgcatcctggaagacgggagcct

SEQ ID NO: 809653 - DNA, 25 bp, Mus musculus
tgcgcatcctggtagacgggagcct

SEQ ID NO: 809654 - DNA, 25 bp, Mus musculus
tgcgcatctcctacaattcctatga

SEQ ID NO: 809655 - DNA, 25 bp, Mus musculus
tgcgcatctccttcaattcctatga

SEQ ID NO: 809656 - DNA, 25 bp, Mus musculus
tgcgcatgagcacctgtctatggag

SEQ ID NO: 809657 - DNA, 25 bp, Mus musculus
tgcgcatgagcagctgtctatggag

SEQ ID NO: 809658 - DNA, 25 bp, Mus musculus
tgcgcatgccatccaggctactaag

SEQ ID NO: 809659 - DNA, 25 bp, Mus musculus
tgcgcatgccatgcaggctactaag

SEQ ID NO: 809660 - DNA, 25 bp, Mus musculus
tgcgcatggaggagatagtagaagg

SEQ ID NO: 809661 - DNA, 25 bp, Mus musculus
tgcgcatggaggtgatagtagaagg

SEQ ID NO: 809662 - DNA, 25 bp, Mus musculus
tgcgcatggcctactgccaccagat

SEQ ID NO: 809663 - DNA, 25 bp, Mus musculus
tgcgcatggccttctgccaccagat

SEQ ID NO: 809664 - DNA, 25 bp, Mus musculus
tgcgcatggtcacactctacgacaa

SEQ ID NO: 809665 - DNA, 25 bp, Mus musculus
tgcgcatggtcagactctacgacaa

SEQ ID NO: 809666 - DNA, 25 bp, Mus musculus
tgcgcattgtagaaggccagggtca

SEQ ID NO: 809667 - DNA, 25 bp, Mus musculus
tgcgcattgtagtaggccagggtca

SEQ ID NO: 809668 - DNA, 25 bp, Mus musculus
tgcgccaaagggaaccaaatcagat

SEQ ID NO: 809669 - DNA, 25 bp, Mus musculus
tgcgccaaagggtaccaaatcagat

SEQ ID NO: 809670 - DNA, 25 bp, Mus musculus
tgcgccaactatcacgtttctcgag

SEQ ID NO: 809671 - DNA, 25 bp, Mus musculus
tgcgccaactatgacgtttctcgag

SEQ ID NO: 809672 - DNA, 25 bp, Mus musculus
tgcgccaagcccaagattacgagaa

SEQ ID NO: 809673 - DNA, 25 bp, Mus musculus
tgcgccaagccctagattacgagaa

SEQ ID NO: 809674 - DNA, 25 bp, Mus musculus
tgcgccaccaacactggagcctggt

SEQ ID NO: 809675 - DNA, 25 bp, Mus musculus
tgcgccaccaactctggagcctggt

SEQ ID NO: 809676 - DNA, 25 bp, Mus musculus
tgcgccacgtggatcagccactgtc

SEQ ID NO: 809677 - DNA, 25 bp, Mus musculus
tgcgccacgtggttcagccactgtc

SEQ ID NO: 809678 - DNA, 25 bp, Mus musculus
tgcgccacttctcttaacagcaggg

SEQ ID NO: 809679 - DNA, 25 bp, Mus musculus
tgcgccacttctgttaacagcaggg

SEQ ID NO: 809680 - DNA, 25 bp, Mus musculus
tgcgccagactgcattcacagcaga

SEQ ID NO: 809681 - DNA, 25 bp, Mus musculus
tgcgccagactggattcacagcaga

SEQ ID NO: 809682 - DNA, 25 bp, Mus musculus
tgcgccagagaaacacaaattaagt

SEQ ID NO: 809683 - DNA, 25 bp, Mus musculus
tgcgccagagaatcacaaattaagt

SEQ ID NO: 809684 - DNA, 25 bp, Mus musculus
tgcgccagatctctgctgttattct

SEQ ID NO: 809685 - DNA, 25 bp, Mus musculus
tgcgccagatctgtgctgttattct

SEQ ID NO: 809686 - DNA, 25 bp, Mus musculus
tgcgccagcaggactacttgagaag

SEQ ID NO: 809687 - DNA, 25 bp, Mus musculus
tgcgccagcaggtctacttgagaag

SEQ ID NO: 809688 - DNA, 25 bp, Mus musculus
tgcgccaggcggagaatcctgtgaa

SEQ ID NO: 809689 - DNA, 25 bp, Mus musculus
tgcgccaggcggtgaatcctgtgaa

SEQ ID NO: 809690 - DNA, 25 bp, Mus musculus
tgcgccaggtgcaggcagccaaaga

SEQ ID NO: 809691 - DNA, 25 bp, Mus musculus
tgcgccaggtgctggcagccaaaga

SEQ ID NO: 809692 - DNA, 25 bp, Mus musculus
tgcgccatggctccaaggctgtgac

SEQ ID NO: 809693 - DNA, 25 bp, Mus musculus
tgcgccatggctgcaaggctgtgac

SEQ ID NO: 809694 - DNA, 25 bp, Mus musculus
tgcgcccacagaacttcgagctggt

SEQ ID NO: 809695 - DNA, 25 bp, Mus musculus
tgcgcccacagatcttcgagctggt

SEQ ID NO: 809696 - DNA, 25 bp, Mus musculus
tgcgcccctagtcgatgagagagct

SEQ ID NO: 809697 - DNA, 25 bp, Mus musculus
tgcgcccctagtggatgagagagct

SEQ ID NO: 809698 - DNA, 25 bp, Mus musculus
tgcgcccgctgtcttgcgagctctg

SEQ ID NO: 809699 - DNA, 25 bp, Mus musculus
tgcgcccgctgtgttgcgagctctg

SEQ ID NO: 809700 - DNA, 25 bp, Mus musculus
tgcgcccgggccatgtatgactacc

SEQ ID NO: 809701 - DNA, 25 bp, Mus musculus
tgcgcccgggccttgtatgactacc

SEQ ID NO: 809702 - DNA, 25 bp, Mus musculus
tgcgccgagcctacttgggaccttt

SEQ ID NO: 809703 - DNA, 25 bp, Mus musculus
tgcgccgagccttcttgggaccttt

SEQ ID NO: 809704 - DNA, 25 bp, Mus musculus
tgcgccgaggagaccacacctcagt

SEQ ID NO: 809705 - DNA, 25 bp, Mus musculus
tgcgccgaggagtccacacctcagt

SEQ ID NO: 809706 - DNA, 25 bp, Mus musculus
tgcgccgcttctacgcgcgtgggcc

SEQ ID NO: 809707 - DNA, 25 bp, Mus musculus
tgcgccgcttcttcgcgcgtgggcc

SEQ ID NO: 809708 - DNA, 25 bp, Mus musculus
tgcgccggctcccaacattggtgtt

SEQ ID NO: 809709 - DNA, 25 bp, Mus musculus
tgcgccggctccgaacattggtgtt

SEQ ID NO: 809710 - DNA, 25 bp, Mus musculus
tgcgccgttccgcaagaattttact

SEQ ID NO: 809711 - DNA, 25 bp, Mus musculus
tgcgccgttccggaagaattttact

SEQ ID NO: 809712 - DNA, 25 bp, Mus musculus
tgcgcctatgtaccagtgctacaga

SEQ ID NO: 809713 - DNA, 25 bp, Mus musculus
tgcgcctatgtagcagtgctacaga

SEQ ID NO: 809714 - DNA, 25 bp, Mus musculus
tgcgcctgatcacacaggacacgga

SEQ ID NO: 809715 - DNA, 25 bp, Mus musculus
tgcgcctgatcagacaggacacgga

SEQ ID NO: 809716 - DNA, 25 bp, Mus musculus
tgcgcctgctgtctggcaaagagac

SEQ ID NO: 809717 - DNA, 25 bp, Mus musculus
tgcgcctgctgtgtggcaaagagac

SEQ ID NO: 809718 - DNA, 25 bp, Mus musculus
tgcgcctgctttctatagccaggct

SEQ ID NO: 809719 - DNA, 25 bp, Mus musculus
tgcgcctgctttgtatagccaggct

SEQ ID NO: 809720 - DNA, 25 bp, Mus musculus
tgcgccttaaggagcttgcagagtc

SEQ ID NO: 809721 - DNA, 25 bp, Mus musculus
tgcgccttaaggtgcttgcagagtc

SEQ ID NO: 809722 - DNA, 25 bp, Mus musculus
tgcgcctttcatcactcaatctgga

SEQ ID NO: 809723 - DNA, 25 bp, Mus musculus
tgcgcctttcatgactcaatctgga

SEQ ID NO: 809724 - DNA, 25 bp, Mus musculus
tgcgcgaagtgaactgtacttacgc

SEQ ID NO: 809725 - DNA, 25 bp, Mus musculus
tgcgcgaagtgatctgtacttacgc

SEQ ID NO: 809726 - DNA, 25 bp, Mus musculus
tgcgcgagacgtagcgatacacagc

SEQ ID NO: 809727 - DNA, 25 bp, Mus musculus
tgcgcgagacgttgcgatacacagc

SEQ ID NO: 809728 - DNA, 25 bp, Mus musculus
tgcgcgagcgcaatgtgctgcagca

SEQ ID NO: 809729 - DNA, 25 bp, Mus musculus
tgcgcgagcgcattgtgctgcagca

SEQ ID NO: 809730 - DNA, 25 bp, Mus musculus
tgcgcgagtagtcaacgctagtacg

SEQ ID NO: 809731 - DNA, 25 bp, Mus musculus
tgcgcgagtagtgaacgctagtacg

SEQ ID NO: 809732 - DNA, 25 bp, Mus musculus
tgcgcgccgcgaccatcttcgtgaa

SEQ ID NO: 809733 - DNA, 25 bp, Mus musculus
tgcgcgccgcgagcatcttcgtgaa

SEQ ID NO: 809734 - DNA, 25 bp, Mus musculus
tgcgcgcctgctcgtgaatcctctt

SEQ ID NO: 809735 - DNA, 25 bp, Mus musculus
tgcgcgcctgctggtgaatcctctt

SEQ ID NO: 809736 - DNA, 25 bp, Mus musculus
tgcgcgcgcgctagagttcttgact

SEQ ID NO: 809737 - DNA, 25 bp, Mus musculus
tgcgcgcgcgcttgagttcttgact

SEQ ID NO: 809738 - DNA, 25 bp, Mus musculus
tgcgcgcggctcatttgagacctaa

SEQ ID NO: 809739 - DNA, 25 bp, Mus musculus
tgcgcgcggctcttttgagacctaa

SEQ ID NO: 809740 - DNA, 25 bp, Mus musculus
tgcgcgctccaacagtgtatttgtg

SEQ ID NO: 809741 - DNA, 25 bp, Mus musculus
tgcgcgctccaagagtgtatttgtg

SEQ ID NO: 809742 - DNA, 25 bp, Mus musculus
tgcgcggccaccacgctaagatcta

SEQ ID NO: 809743 - DNA, 25 bp, Mus musculus
tgcgcggccacctcgctaagatcta

SEQ ID NO: 809744 - DNA, 25 bp, Mus musculus
tgcgcggccctgcttgaacacttta

SEQ ID NO: 809745 - DNA, 25 bp, Mus musculus
tgcgcggccctggttgaacacttta

SEQ ID NO: 809746 - DNA, 25 bp, Mus musculus
tgcgcggcgattactttggaacagc

SEQ ID NO: 809747 - DNA, 25 bp, Mus musculus
tgcgcggcgatttctttggaacagc

SEQ ID NO: 809748 - DNA, 25 bp, Mus musculus
tgcgcgggagacaatggcgtcctcc

SEQ ID NO: 809749 - DNA, 25 bp, Mus musculus
tgcgcgggagactatggcgtcctcc

SEQ ID NO: 809750 - DNA, 25 bp, Mus musculus
tgcgcgggcttgagagaaatacact

SEQ ID NO: 809751 - DNA, 25 bp, Mus musculus
tgcgcgggcttgtgagaaatacact

SEQ ID NO: 809752 - DNA, 25 bp, Mus musculus
tgcgcgtagcccaccagtaggagct

SEQ ID NO: 809753 - DNA, 25 bp, Mus musculus
tgcgcgtagccctccagtaggagct

SEQ ID NO: 809754 - DNA, 25 bp, Mus musculus
tgcgcgtcctcactatttaatgtct

SEQ ID NO: 809755 - DNA, 25 bp, Mus musculus
tgcgcgtcctcagtatttaatgtct

SEQ ID NO: 809756 - DNA, 25 bp, Mus musculus
tgcgcgtctcacaaaccacttggga

SEQ ID NO: 809757 - DNA, 25 bp, Mus musculus
tgcgcgtctcactaaccacttggga

SEQ ID NO: 809758 - DNA, 25 bp, Mus musculus
tgcgcgtgcgccagcttttacagtc

SEQ ID NO: 809759 - DNA, 25 bp, Mus musculus
tgcgcgtgcgcctgcttttacagtc

SEQ ID NO: 809760 - DNA, 25 bp, Mus musculus
tgcgcgtggcagataccgaatcagc

SEQ ID NO: 809761 - DNA, 25 bp, Mus musculus
tgcgcgtggcagttaccgaatcagc

SEQ ID NO: 809762 - DNA, 25 bp, Mus musculus
tgcgcgtgtgtgaagtgacctatga

SEQ ID NO: 809763 - DNA, 25 bp, Mus musculus
tgcgcgtgtgtgtagtgacctatga

SEQ ID NO: 809764 - DNA, 25 bp, Mus musculus
tgcgctaattaacatcaaagctgtg

SEQ ID NO: 809765 - DNA, 25 bp, Mus musculus
tgcgctaattaagatcaaagctgtg

SEQ ID NO: 809766 - DNA, 25 bp, Mus musculus
tgcgctacaactcctccgtgagggc

SEQ ID NO: 809767 - DNA, 25 bp, Mus musculus
tgcgctacaactgctccgtgagggc

SEQ ID NO: 809768 - DNA, 25 bp, Mus musculus
tgcgctacagcactagtgaagtcag

SEQ ID NO: 809769 - DNA, 25 bp, Mus musculus
tgcgctacagcagtagtgaagtcag

SEQ ID NO: 809770 - DNA, 25 bp, Mus musculus
tgcgctacggtgactatgtcatcaa

SEQ ID NO: 809771 - DNA, 25 bp, Mus musculus
tgcgctacggtgtctatgtcatcaa

SEQ ID NO: 809772 - DNA, 25 bp, Mus musculus
tgcgctatcttgatttgttacagca

SEQ ID NO: 809773 - DNA, 25 bp, Mus musculus
tgcgctatcttgttttgttacagca

SEQ ID NO: 809774 - DNA, 25 bp, Mus musculus
tgcgctcactgaccatggttgagga

SEQ ID NO: 809775 - DNA, 25 bp, Mus musculus
tgcgctcactgagcatggttgagga

SEQ ID NO: 809776 - DNA, 25 bp, Mus musculus
tgcgctcagaacaagtgtaacttct

SEQ ID NO: 809777 - DNA, 25 bp, Mus musculus
tgcgctcagaactagtgtaacttct

SEQ ID NO: 809778 - DNA, 25 bp, Mus musculus
tgcgctcagagccacttttgaagat

SEQ ID NO: 809779 - DNA, 25 bp, Mus musculus
tgcgctcagagcgacttttgaagat

SEQ ID NO: 809780 - DNA, 25 bp, Mus musculus
tgcgctcagctgattggcagagaaa

SEQ ID NO: 809781 - DNA, 25 bp, Mus musculus
tgcgctcagctgtttggcagagaaa

SEQ ID NO: 809782 - DNA, 25 bp, Mus musculus
tgcgctcaggtactgtgcccgcgtc

SEQ ID NO: 809783 - DNA, 25 bp, Mus musculus
tgcgctcaggtagtgtgcccgcgtc

SEQ ID NO: 809784 - DNA, 25 bp, Mus musculus
tgcgctcatcggagggcacaggttt

SEQ ID NO: 809785 - DNA, 25 bp, Mus musculus
tgcgctcatcggtgggcacaggttt

SEQ ID NO: 809786 - DNA, 25 bp, Mus musculus
tgcgctccaggcagcctaaagctgg

SEQ ID NO: 809787 - DNA, 25 bp, Mus musculus
tgcgctccaggctgcctaaagctgg

SEQ ID NO: 809788 - DNA, 25 bp, Mus musculus
tgcgctccatcaacccctttggaaa

SEQ ID NO: 809789 - DNA, 25 bp, Mus musculus
tgcgctccatcatcccctttggaaa

SEQ ID NO: 809790 - DNA, 25 bp, Mus musculus
tgcgctccatggaggaggacctgca

SEQ ID NO: 809791 - DNA, 25 bp, Mus musculus
tgcgctccatggtggaggacctgca

SEQ ID NO: 809792 - DNA, 25 bp, Mus musculus
tgcgctcccagaagctaaggacatt

SEQ ID NO: 809793 - DNA, 25 bp, Mus musculus
tgcgctcccagatgctaaggacatt

SEQ ID NO: 809794 - DNA, 25 bp, Mus musculus
tgcgctcccctacaggatctcgagt

SEQ ID NO: 809795 - DNA, 25 bp, Mus musculus
tgcgctcccctagaggatctcgagt

SEQ ID NO: 809796 - DNA, 25 bp, Mus musculus
tgcgctccgcagagcgcactggtat

SEQ ID NO: 809797 - DNA, 25 bp, Mus musculus
tgcgctccgcagtgcgcactggtat

SEQ ID NO: 809798 - DNA, 25 bp, Mus musculus
tgcgctcctgaacaatgggatccct

SEQ ID NO: 809799 - DNA, 25 bp, Mus musculus
tgcgctcctgaagaatgggatccct

SEQ ID NO: 809800 - DNA, 25 bp, Mus musculus
tgcgctctccaaaggcatcaaaaag

SEQ ID NO: 809801 - DNA, 25 bp, Mus musculus
tgcgctctccaatggcatcaaaaag

SEQ ID NO: 809802 - DNA, 25 bp, Mus musculus
tgcgctctcgtgaggtctctgtgga

SEQ ID NO: 809803 - DNA, 25 bp, Mus musculus
tgcgctctcgtgtggtctctgtgga

SEQ ID NO: 809804 - DNA, 25 bp, Mus musculus
tgcgctctgccacagtgccagtgca

SEQ ID NO: 809805 - DNA, 25 bp, Mus musculus
tgcgctctgccagagtgccagtgca

SEQ ID NO: 809806 - DNA, 25 bp, Mus musculus
tgcgctcttcagatggctccagatg

SEQ ID NO: 809807 - DNA, 25 bp, Mus musculus
tgcgctcttcagttggctccagatg

SEQ ID NO: 809808 - DNA, 25 bp, Mus musculus
tgcgctgaaaatatccgtgaactct

SEQ ID NO: 809809 - DNA, 25 bp, Mus musculus
tgcgctgaaaatttccgtgaactct

SEQ ID NO: 809810 - DNA, 25 bp, Mus musculus
tgcgctgaagcgcatcctctatgcc

SEQ ID NO: 809811 - DNA, 25 bp, Mus musculus
tgcgctgaagcggatcctctatgcc

SEQ ID NO: 809812 - DNA, 25 bp, Mus musculus
tgcgctgaaggaacccatggctgtg

SEQ ID NO: 809813 - DNA, 25 bp, Mus musculus
tgcgctgaaggatcccatggctgtg

SEQ ID NO: 809814 - DNA, 25 bp, Mus musculus
tgcgctgacccgcatgcagaagatg

SEQ ID NO: 809815 - DNA, 25 bp, Mus musculus
tgcgctgacccggatgcagaagatg

SEQ ID NO: 809816 - DNA, 25 bp, Mus musculus
tgcgctgaggaaaagtcactaccgg

SEQ ID NO: 809817 - DNA, 25 bp, Mus musculus
tgcgctgaggaatagtcactaccgg

SEQ ID NO: 809818 - DNA, 25 bp, Mus musculus
tgcgctgccaccagttacagatcgt

SEQ ID NO: 809819 - DNA, 25 bp, Mus musculus
tgcgctgccacctgttacagatcgt

SEQ ID NO: 809820 - DNA, 25 bp, Mus musculus
tgcgctgcctggaccgcatgggcta

SEQ ID NO: 809821 - DNA, 25 bp, Mus musculus
tgcgctgcctggtccgcatgggcta

SEQ ID NO: 809822 - DNA, 25 bp, Mus musculus
tgcgctgcgtgtcgaaccacggtcc

SEQ ID NO: 809823 - DNA, 25 bp, Mus musculus
tgcgctgcgtgtggaaccacggtcc

SEQ ID NO: 809824 - DNA, 25 bp, Mus musculus
tgcgctgctcaaatgcaagatgcat

SEQ ID NO: 809825 - DNA, 25 bp, Mus musculus
tgcgctgctcaattgcaagatgcat

SEQ ID NO: 809826 - DNA, 25 bp, Mus musculus
tgcgctgctgagatggcctctctct

SEQ ID NO: 809827 - DNA, 25 bp, Mus musculus
tgcgctgctgagttggcctctctct

SEQ ID NO: 809828 - DNA, 25 bp, Mus musculus
tgcgctgctggcatccttttggccg

SEQ ID NO: 809829 - DNA, 25 bp, Mus musculus
tgcgctgctggcttccttttggccg

SEQ ID NO: 809830 - DNA, 25 bp, Mus musculus
tgcgctggaccactttcgcgaagtt

SEQ ID NO: 809831 - DNA, 25 bp, Mus musculus
tgcgctggaccagtttcgcgaagtt

SEQ ID NO: 809832 - DNA, 25 bp, Mus musculus
tgcgctggccaacaccctggagact

SEQ ID NO: 809833 - DNA, 25 bp, Mus musculus
tgcgctggccaagaccctggagact

SEQ ID NO: 809834 - DNA, 25 bp, Mus musculus
tgcgctgggctacgtgactctccta

SEQ ID NO: 809835 - DNA, 25 bp, Mus musculus
tgcgctgggctaggtgactctccta

SEQ ID NO: 809836 - DNA, 25 bp, Mus musculus
tgcgctggtgcgactcggctccctg

SEQ ID NO: 809837 - DNA, 25 bp, Mus musculus
tgcgctggtgcgtctcggctccctg

SEQ ID NO: 809838 - DNA, 25 bp, Mus musculus
tgcgctgtccagattcaggtcctga

SEQ ID NO: 809839 - DNA, 25 bp, Mus musculus
tgcgctgtccagtttcaggtcctga

SEQ ID NO: 809840 - DNA, 25 bp, Mus musculus
tgcgctgtctccaatggcgtccgcc

SEQ ID NO: 809841 - DNA, 25 bp, Mus musculus
tgcgctgtctcctatggcgtccgcc

SEQ ID NO: 809842 - DNA, 25 bp, Mus musculus
tgcgctgtgaacaaacgcggcctgg

SEQ ID NO: 809843 - DNA, 25 bp, Mus musculus
tgcgctgtgaactaacgcggcctgg

SEQ ID NO: 809844 - DNA, 25 bp, Mus musculus
tgcgctgtgagtatgggccactgca

SEQ ID NO: 809845 - DNA, 25 bp, Mus musculus
tgcgctgtgagtttgggccactgca

SEQ ID NO: 809846 - DNA, 25 bp, Mus musculus
tgcgctgtgcccataacaaaagccg

SEQ ID NO: 809847 - DNA, 25 bp, Mus musculus
tgcgctgtgcccttaacaaaagccg

SEQ ID NO: 809848 - DNA, 25 bp, Mus musculus
tgcgctgtgcgcactcaacgtggtt

SEQ ID NO: 809849 - DNA, 25 bp, Mus musculus
tgcgctgtgcgctctcaacgtggtt

SEQ ID NO: 809850 - DNA, 25 bp, Mus musculus
tgcgctgtttgcctaggaagcagct

SEQ ID NO: 809851 - DNA, 25 bp, Mus musculus
tgcgctgtttgcgtaggaagcagct

SEQ ID NO: 809852 - DNA, 25 bp, Mus musculus
tgcgcttacaggcaacaagaccatg

SEQ ID NO: 809853 - DNA, 25 bp, Mus musculus
tgcgcttacagggaacaagaccatg

SEQ ID NO: 809854 - DNA, 25 bp, Mus musculus
tgcgcttcaaaaatccacgtacaaa

SEQ ID NO: 809855 - DNA, 25 bp, Mus musculus
tgcgcttcaaaattccacgtacaaa

SEQ ID NO: 809856 - DNA, 25 bp, Mus musculus
tgcgcttcaataatggcatgatggt

SEQ ID NO: 809857 - DNA, 25 bp, Mus musculus
tgcgcttcaatattggcatgatggt

SEQ ID NO: 809858 - DNA, 25 bp, Mus musculus
tgcgcttcacctcgagcatgaagac

SEQ ID NO: 809859 - DNA, 25 bp, Mus musculus
tgcgcttcacctggagcatgaagac

SEQ ID NO: 809860 - DNA, 25 bp, Mus musculus
tgcgcttcagcgatgcattctggat

SEQ ID NO: 809861 - DNA, 25 bp, Mus musculus
tgcgcttcagcgttgcattctggat

SEQ ID NO: 809862 - DNA, 25 bp, Mus musculus
tgcgcttcctccagtgctggacacg

SEQ ID NO: 809863 - DNA, 25 bp, Mus musculus
tgcgcttcctcctgtgctggacacg

SEQ ID NO: 809864 - DNA, 25 bp, Mus musculus
tgcgcttccttgcagcaatggcagc

SEQ ID NO: 809865 - DNA, 25 bp, Mus musculus
tgcgcttccttggagcaatggcagc

SEQ ID NO: 809866 - DNA, 25 bp, Mus musculus
tgcgcttcgcggagcttgcacaaat

SEQ ID NO: 809867 - DNA, 25 bp, Mus musculus
tgcgcttcgcggtgcttgcacaaat

SEQ ID NO: 809868 - DNA, 25 bp, Mus musculus
tgcgcttcgtcaccacacaggtaac

SEQ ID NO: 809869 - DNA, 25 bp, Mus musculus
tgcgcttcgtcagcacacaggtaac

SEQ ID NO: 809870 - DNA, 25 bp, Mus musculus
tgcgcttggaagcaacttaacagaa

SEQ ID NO: 809871 - DNA, 25 bp, Mus musculus
tgcgcttggaaggaacttaacagaa

SEQ ID NO: 809872 - DNA, 25 bp, Mus musculus
tgcgcttgtcaccatcatcaccgtg

SEQ ID NO: 809873 - DNA, 25 bp, Mus musculus
tgcgcttgtcacgatcatcaccgtg

SEQ ID NO: 809874 - DNA, 25 bp, Mus musculus
tgcgctttcgctatgacagctgagg

SEQ ID NO: 809875 - DNA, 25 bp, Mus musculus
tgcgctttcgctttgacagctgagg

SEQ ID NO: 809876 - DNA, 25 bp, Mus musculus
tgcgcttttggcagcagcactacct

SEQ ID NO: 809877 - DNA, 25 bp, Mus musculus
tgcgcttttggctgcagcactacct

SEQ ID NO: 809878 - DNA, 25 bp, Mus musculus
tgcggaaacacaagatcttcataaa

SEQ ID NO: 809879 - DNA, 25 bp, Mus musculus
tgcggaaacacatgatcttcataaa

SEQ ID NO: 809880 - DNA, 25 bp, Mus musculus
tgcggaaatccgacttcaatggact

SEQ ID NO: 809881 - DNA, 25 bp, Mus musculus
tgcggaaatccgtcttcaatggact

SEQ ID NO: 809882 - DNA, 25 bp, Mus musculus
tgcggaaccgaaccctgtccgtgga

SEQ ID NO: 809883 - DNA, 25 bp, Mus musculus
tgcggaaccgaagcctgtccgtgga

SEQ ID NO: 809884 - DNA, 25 bp, Mus musculus
tgcggaaccgttatgcggccctgcg

SEQ ID NO: 809885 - DNA, 25 bp, Mus musculus
tgcggaaccgttttgcggccctgcg

SEQ ID NO: 809886 - DNA, 25 bp, Mus musculus
tgcggaagcaaacaccggcggccca

SEQ ID NO: 809887 - DNA, 25 bp, Mus musculus
tgcggaagcaaagaccggcggccca

SEQ ID NO: 809888 - DNA, 25 bp, Mus musculus
tgcggaatagctctggcacctgtgt

SEQ ID NO: 809889 - DNA, 25 bp, Mus musculus
tgcggaatagctgtggcacctgtgt

SEQ ID NO: 809890 - DNA, 25 bp, Mus musculus
tgcggaatcgctacctgaagaaaag

SEQ ID NO: 809891 - DNA, 25 bp, Mus musculus
tgcggaatcgcttcctgaagaaaag

SEQ ID NO: 809892 - DNA, 25 bp, Mus musculus
tgcggacaccacagtcacatcaaca

SEQ ID NO: 809893 - DNA, 25 bp, Mus musculus
tgcggacaccacagtgggcaactca

SEQ ID NO: 809894 - DNA, 25 bp, Mus musculus
tgcggacaccactgtcacatcaaca

SEQ ID NO: 809895 - DNA, 25 bp, Mus musculus
tgcggacaccactgtgggcaactca

SEQ ID NO: 809896 - DNA, 25 bp, Mus musculus
tgcggacatcaactatgatgagacc

SEQ ID NO: 809897 - DNA, 25 bp, Mus musculus
tgcggacatcaagtatgatgagacc

SEQ ID NO: 809898 - DNA, 25 bp, Mus musculus
tgcggacattctacacaaaggtgtt

SEQ ID NO: 809899 - DNA, 25 bp, Mus musculus
tgcggacattcttcacaaaggtgtt

SEQ ID NO: 809900 - DNA, 25 bp, Mus musculus
tgcggacctatgctgttggatgctt

SEQ ID NO: 809901 - DNA, 25 bp, Mus musculus
tgcggacctatggtgttggatgctt

SEQ ID NO: 809902 - DNA, 25 bp, Mus musculus
tgcggacctgcaatatggacaatgg

SEQ ID NO: 809903 - DNA, 25 bp, Mus musculus
tgcggacctgcattatggacaatgg

SEQ ID NO: 809904 - DNA, 25 bp, Mus musculus
tgcggacctgggaaaaaatgtcgaa

SEQ ID NO: 809905 - DNA, 25 bp, Mus musculus
tgcggacctgggtaaaaatgtcgaa

SEQ ID NO: 809906 - DNA, 25 bp, Mus musculus
tgcggacgagcccaagcccaaaaag

SEQ ID NO: 809907 - DNA, 25 bp, Mus musculus
tgcggacgagccgaagcccaaaaag

SEQ ID NO: 809908 - DNA, 25 bp, Mus musculus
tgcggacggaacaactcagagacct

SEQ ID NO: 809909 - DNA, 25 bp, Mus musculus
tgcggacggaactactcagagacct

SEQ ID NO: 809910 - DNA, 25 bp, Mus musculus
tgcggactgcaccatgctgaccatt

SEQ ID NO: 809911 - DNA, 25 bp, Mus musculus
tgcggactgcacgatgctgaccatt

SEQ ID NO: 809912 - DNA, 25 bp, Mus musculus
tgcggactgcagattctacacagca

SEQ ID NO: 809913 - DNA, 25 bp, Mus musculus
tgcggactgcagtttctacacagca

SEQ ID NO: 809914 - DNA, 25 bp, Mus musculus
tgcggactgtgacgcaagcatgtat

SEQ ID NO: 809915 - DNA, 25 bp, Mus musculus
tgcggactgtgaggcaagcatgtat

SEQ ID NO: 809916 - DNA, 25 bp, Mus musculus
tgcggacttgctagggctggaccca

SEQ ID NO: 809917 - DNA, 25 bp, Mus musculus
tgcggacttgcttgggctggaccca

SEQ ID NO: 809918 - DNA, 25 bp, Mus musculus
tgcggagaaaccactggacttacaa

SEQ ID NO: 809919 - DNA, 25 bp, Mus musculus
tgcggagaaacctctggacttacaa

SEQ ID NO: 809920 - DNA, 25 bp, Mus musculus
tgcggagaaagaaccggagcctgca

SEQ ID NO: 809921 - DNA, 25 bp, Mus musculus
tgcggagaaagatccggagcctgca

SEQ ID NO: 809922 - DNA, 25 bp, Mus musculus
tgcggagcatcaagcgcatctttca

SEQ ID NO: 809923 - DNA, 25 bp, Mus musculus
tgcggagcatcatgcgcatctttca

SEQ ID NO: 809924 - DNA, 25 bp, Mus musculus
tgcggaggaaccagagctacacgtg

SEQ ID NO: 809925 - DNA, 25 bp, Mus musculus
tgcggaggaacctgagctacacgtg

SEQ ID NO: 809926 - DNA, 25 bp, Mus musculus
tgcggagggccgacggcttatccca

SEQ ID NO: 809927 - DNA, 25 bp, Mus musculus
tgcggagggccgtcggcttatccca

SEQ ID NO: 809928 - DNA, 25 bp, Mus musculus
tgcggaggtcttatacacagggaga

SEQ ID NO: 809929 - DNA, 25 bp, Mus musculus
tgcggaggtcttttacacagggaga

SEQ ID NO: 809930 - DNA, 25 bp, Mus musculus
tgcggagtccttctggctgtgcccc

SEQ ID NO: 809931 - DNA, 25 bp, Mus musculus
tgcggagtccttgtggctgtgcccc

SEQ ID NO: 809932 - DNA, 25 bp, Mus musculus
tgcggagtgtaaacagtatttggac

SEQ ID NO: 809933 - DNA, 25 bp, Mus musculus
tgcggagtgtaatcagtatttggac

SEQ ID NO: 809934 - DNA, 25 bp, Mus musculus
tgcggagttctaccaccgattgggc

SEQ ID NO: 809935 - DNA, 25 bp, Mus musculus
tgcggagttctagcaccgattgggc

SEQ ID NO: 809936 - DNA, 25 bp, Mus musculus
tgcggagttttaacagcttgtaagt

SEQ ID NO: 809937 - DNA, 25 bp, Mus musculus
tgcggagttttatcagcttgtaagt

SEQ ID NO: 809938 - DNA, 25 bp, Mus musculus
tgcggatatagacagcacttccctg

SEQ ID NO: 809939 - DNA, 25 bp, Mus musculus
tgcggatatagagagcacttccctg

SEQ ID NO: 809940 - DNA, 25 bp, Mus musculus
tgcggatcagctcaggctttgatgt

SEQ ID NO: 809941 - DNA, 25 bp, Mus musculus
tgcggatcagctgaggctttgatgt

SEQ ID NO: 809942 - DNA, 25 bp, Mus musculus
tgcggatcccctagccaaggtagct

SEQ ID NO: 809943 - DNA, 25 bp, Mus musculus
tgcggatccccttgccaaggtagct

SEQ ID NO: 809944 - DNA, 25 bp, Mus musculus
tgcggatccctgactaatagcttgg

SEQ ID NO: 809945 - DNA, 25 bp, Mus musculus
tgcggatccctgtctaatagcttgg

SEQ ID NO: 809946 - DNA, 25 bp, Mus musculus
tgcggatgacccaagcacaagtgtg

SEQ ID NO: 809947 - DNA, 25 bp, Mus musculus
tgcggatgaccctagcacaagtgtg

SEQ ID NO: 809948 - DNA, 25 bp, Mus musculus
tgcggatgatcaacgtgcagcgcct

SEQ ID NO: 809949 - DNA, 25 bp, Mus musculus
tgcggatgatcatcgtgcagcgcct

SEQ ID NO: 809950 - DNA, 25 bp, Mus musculus
tgcggatgatccaaatgccctgaat

SEQ ID NO: 809951 - DNA, 25 bp, Mus musculus
tgcggatgatcctaatgccctgaat

SEQ ID NO: 809952 - DNA, 25 bp, Mus musculus
tgcggatgcagcacctgtttatgat

SEQ ID NO: 809953 - DNA, 25 bp, Mus musculus
tgcggatgcagctcctgtttatgat

SEQ ID NO: 809954 - DNA, 25 bp, Mus musculus
tgcggattattcatccacaagcttt

SEQ ID NO: 809955 - DNA, 25 bp, Mus musculus
tgcggattattcttccacaagcttt

SEQ ID NO: 809956 - DNA, 25 bp, Mus musculus
tgcggcaaatttcacaccgtccgga

SEQ ID NO: 809957 - DNA, 25 bp, Mus musculus
tgcggcaaatttgacaccgtccgga

SEQ ID NO: 809958 - DNA, 25 bp, Mus musculus
tgcggcaacaacatgtccgctccga

SEQ ID NO: 809959 - DNA, 25 bp, Mus musculus
tgcggcaacaacttgtccgctccga

SEQ ID NO: 809960 - DNA, 25 bp, Mus musculus
tgcggcaagtgaatcaacagaaccc

SEQ ID NO: 809961 - DNA, 25 bp, Mus musculus
tgcggcaagtgattcaacagaaccc

SEQ ID NO: 809962 - DNA, 25 bp, Mus musculus
tgcggcaatcaaattcacgaccagt

SEQ ID NO: 809963 - DNA, 25 bp, Mus musculus
tgcggcaatcaatttcacgaccagt

SEQ ID NO: 809964 - DNA, 25 bp, Mus musculus
tgcggcaatgacagcatccgacgcg

SEQ ID NO: 809965 - DNA, 25 bp, Mus musculus
tgcggcaatgactgcatccgacgcg

SEQ ID NO: 809966 - DNA, 25 bp, Mus musculus
tgcggcaatgggaattccagcccca

SEQ ID NO: 809967 - DNA, 25 bp, Mus musculus
tgcggcaatgggtattccagcccca

SEQ ID NO: 809968 - DNA, 25 bp, Mus musculus
tgcggcacagtgagaacacgctctt

SEQ ID NO: 809969 - DNA, 25 bp, Mus musculus
tgcggcacagtgtgaacacgctctt

SEQ ID NO: 809970 - DNA, 25 bp, Mus musculus
tgcggcacgtccatagggatttttc

SEQ ID NO: 809971 - DNA, 25 bp, Mus musculus
tgcggcacgtccttagggatttttc

SEQ ID NO: 809972 - DNA, 25 bp, Mus musculus
tgcggcagtatcacctcctcagaaa

SEQ ID NO: 809973 - DNA, 25 bp, Mus musculus
tgcggcagtatctcctcctcagaaa

SEQ ID NO: 809974 - DNA, 25 bp, Mus musculus
tgcggcagtggcagatcgaacagat

SEQ ID NO: 809975 - DNA, 25 bp, Mus musculus
tgcggcagtggctgatcgaacagat

SEQ ID NO: 809976 - DNA, 25 bp, Mus musculus
tgcggcatcgtcacagggaagtatg

SEQ ID NO: 809977 - DNA, 25 bp, Mus musculus
tgcggcatcgtctcagggaagtatg

SEQ ID NO: 809978 - DNA, 25 bp, Mus musculus
tgcggcatctacagagactacttca

SEQ ID NO: 809979 - DNA, 25 bp, Mus musculus
tgcggcatctactgagactacttca

SEQ ID NO: 809980 - DNA, 25 bp, Mus musculus
tgcggccaagctctgcctgaatgag

SEQ ID NO: 809981 - DNA, 25 bp, Mus musculus
tgcggccaagctgtgcctgaatgag

SEQ ID NO: 809982 - DNA, 25 bp, Mus musculus
tgcggccagacaacacctatgaggt

SEQ ID NO: 809983 - DNA, 25 bp, Mus musculus
tgcggccagacatcacctatgaggt

SEQ ID NO: 809984 - DNA, 25 bp, Mus musculus
tgcggccagatgaggacaatcactg

SEQ ID NO: 809985 - DNA, 25 bp, Mus musculus
tgcggccagatgtggacaatcactg

SEQ ID NO: 809986 - DNA, 25 bp, Mus musculus
tgcggccagctcagtacaaggaaca

SEQ ID NO: 809987 - DNA, 25 bp, Mus musculus
tgcggccagctctgtacaaggaaca

SEQ ID NO: 809988 - DNA, 25 bp, Mus musculus
tgcggccagcttacaggcagaggtt

SEQ ID NO: 809989 - DNA, 25 bp, Mus musculus
tgcggccagctttcaggcagaggtt

SEQ ID NO: 809990 - DNA, 25 bp, Mus musculus
tgcggccagtacaggagatctactc

SEQ ID NO: 809991 - DNA, 25 bp, Mus musculus
tgcggccagtactggagatctactc

SEQ ID NO: 809992 - DNA, 25 bp, Mus musculus
tgcggccatcgccagtaacatctgg

SEQ ID NO: 809993 - DNA, 25 bp, Mus musculus
tgcggccatcgcgagtaacatctgg

SEQ ID NO: 809994 - DNA, 25 bp, Mus musculus
tgcggccatgttaggaggctacagc

SEQ ID NO: 809995 - DNA, 25 bp, Mus musculus
tgcggccatgtttggaggctacagc

SEQ ID NO: 809996 - DNA, 25 bp, Mus musculus
tgcggccccactagagtgcatcaac

SEQ ID NO: 809997 - DNA, 25 bp, Mus musculus
tgcggccccacttgagtgcatcaac

SEQ ID NO: 809998 - DNA, 25 bp, Mus musculus
tgcggccccgctagtgtcgcctggt

SEQ ID NO: 809999 - DNA, 25 bp, Mus musculus
tgcggccccgcttgtgtcgcctggt

SEQ ID NO: 810000 - DNA, 25 bp, Mus musculus
tgcggcccgttgatatgacgacatg

SEQ ID NO: 810001 - DNA, 25 bp, Mus musculus
tgcggcccgttgttatgacgacatg

SEQ ID NO: 810002 - DNA, 25 bp, Mus musculus
tgcggccctcagagcctacgacatg

SEQ ID NO: 810003 - DNA, 25 bp, Mus musculus
tgcggccctcagtgcctacgacatg

SEQ ID NO: 810004 - DNA, 25 bp, Mus musculus
tgcggccctggcatcggagtggcca

SEQ ID NO: 810005 - DNA, 25 bp, Mus musculus
tgcggccctggcttcggagtggcca

SEQ ID NO: 810006 - DNA, 25 bp, Mus musculus
tgcggccgcaggatgcagagcgggt

SEQ ID NO: 810007 - DNA, 25 bp, Mus musculus
tgcggccgcaggttgcagagcgggt

SEQ ID NO: 810008 - DNA, 25 bp, Mus musculus
tgcggccgcgtactttcaaagatct

SEQ ID NO: 810009 - DNA, 25 bp, Mus musculus
tgcggccgcgtagtttcaaagatct

SEQ ID NO: 810010 - DNA, 25 bp, Mus musculus
tgcggccgtcgccaagagcaagcta

SEQ ID NO: 810011 - DNA, 25 bp, Mus musculus
tgcggccgtcgcgaagagcaagcta

SEQ ID NO: 810012 - DNA, 25 bp, Mus musculus
tgcggccgttcaagccagcgagtgt

SEQ ID NO: 810013 - DNA, 25 bp, Mus musculus
tgcggccgttcatgccagcgagtgt

SEQ ID NO: 810014 - DNA, 25 bp, Mus musculus
tgcggcctaaacacgtcgagcctgt

SEQ ID NO: 810015 - DNA, 25 bp, Mus musculus
tgcggcctaaactcgtcgagcctgt

SEQ ID NO: 810016 - DNA, 25 bp, Mus musculus
tgcggcctacagattccaatcgaac

SEQ ID NO: 810017 - DNA, 25 bp, Mus musculus
tgcggcctacagtttccaatcgaac

SEQ ID NO: 810018 - DNA, 25 bp, Mus musculus
tgcggcctaggcagtgacaacagct

SEQ ID NO: 810019 - DNA, 25 bp, Mus musculus
tgcggcctaggctgtgacaacagct

SEQ ID NO: 810020 - DNA, 25 bp, Mus musculus
tgcggcctcactctgcaccagaata

SEQ ID NO: 810021 - DNA, 25 bp, Mus musculus
tgcggcctcactgtgcaccagaata

SEQ ID NO: 810022 - DNA, 25 bp, Mus musculus
tgcggcctctgtaagcagcacttca

SEQ ID NO: 810023 - DNA, 25 bp, Mus musculus
tgcggcctctgttagcagcacttca

SEQ ID NO: 810024 - DNA, 25 bp, Mus musculus
tgcggccttcaccatctcctatgtg

SEQ ID NO: 810025 - DNA, 25 bp, Mus musculus
tgcggccttcacgatctcctatgtg

SEQ ID NO: 810026 - DNA, 25 bp, Mus musculus
tgcggcctttgtacgagaagaagtc

SEQ ID NO: 810027 - DNA, 25 bp, Mus musculus
tgcggcctttgttcgagaagaagtc

SEQ ID NO: 810028 - DNA, 25 bp, Mus musculus
tgcggcgaagccctatcaagaaggt

SEQ ID NO: 810029 - DNA, 25 bp, Mus musculus
tgcggcgaagccgtatcaagaaggt

SEQ ID NO: 810030 - DNA, 25 bp, Mus musculus
tgcggcgcagagaagctgcctttcg

SEQ ID NO: 810031 - DNA, 25 bp, Mus musculus
tgcggcgcagagtagctgcctttcg

SEQ ID NO: 810032 - DNA, 25 bp, Mus musculus
tgcggcgcaggaagacacttagagc

SEQ ID NO: 810033 - DNA, 25 bp, Mus musculus
tgcggcgcaggatgacacttagagc

SEQ ID NO: 810034 - DNA, 25 bp, Mus musculus
tgcggcgcttggagcacctagtgct

SEQ ID NO: 810035 - DNA, 25 bp, Mus musculus
tgcggcgcttggtgcacctagtgct

SEQ ID NO: 810036 - DNA, 25 bp, Mus musculus
tgcggcggacagaagccatccggat

SEQ ID NO: 810037 - DNA, 25 bp, Mus musculus
tgcggcggacagtagccatccggat

SEQ ID NO: 810038 - DNA, 25 bp, Mus musculus
tgcggcggatttccctgttccagga

SEQ ID NO: 810039 - DNA, 25 bp, Mus musculus
tgcggcggatttgcctgttccagga

SEQ ID NO: 810040 - DNA, 25 bp, Mus musculus
tgcggcggctatcccaggagaatca

SEQ ID NO: 810041 - DNA, 25 bp, Mus musculus
tgcggcggctatgccaggagaatca

SEQ ID NO: 810042 - DNA, 25 bp, Mus musculus
tgcggcggtgtgaactcttgtgcac

SEQ ID NO: 810043 - DNA, 25 bp, Mus musculus
tgcggcggtgtgtactcttgtgcac

SEQ ID NO: 810044 - DNA, 25 bp, Mus musculus
tgcggctacgaaaactacggcaagc

SEQ ID NO: 810045 - DNA, 25 bp, Mus musculus
tgcggctacgaatactacggcaagc

SEQ ID NO: 810046 - DNA, 25 bp, Mus musculus
tgcggctacgtccatcgttctcttt

SEQ ID NO: 810047 - DNA, 25 bp, Mus musculus
tgcggctacgtcgatcgttctcttt

SEQ ID NO: 810048 - DNA, 25 bp, Mus musculus
tgcggctcacacaaagcaggagggt

SEQ ID NO: 810049 - DNA, 25 bp, Mus musculus
tgcggctcacactaagcaggagggt

SEQ ID NO: 810050 - DNA, 25 bp, Mus musculus
tgcggctgaatgaccacaaagtgac

SEQ ID NO: 810051 - DNA, 25 bp, Mus musculus
tgcggctgaatgtccacaaagtgac

SEQ ID NO: 810052 - DNA, 25 bp, Mus musculus
tgcggctgcagcaagtgcagagctt

SEQ ID NO: 810053 - DNA, 25 bp, Mus musculus
tgcggctgcagctagtgcagagctt

SEQ ID NO: 810054 - DNA, 25 bp, Mus musculus
tgcggctgccgtaccaggctgagat

SEQ ID NO: 810055 - DNA, 25 bp, Mus musculus
tgcggctgccgttccaggctgagat

SEQ ID NO: 810056 - DNA, 25 bp, Mus musculus
tgcggctgctgacctccgagtgctt

SEQ ID NO: 810057 - DNA, 25 bp, Mus musculus
tgcggctgctgagctccgagtgctt

SEQ ID NO: 810058 - DNA, 25 bp, Mus musculus
tgcggctgtcacacacagtcaggac

SEQ ID NO: 810059 - DNA, 25 bp, Mus musculus
tgcggctgtcactcacagtcaggac

SEQ ID NO: 810060 - DNA, 25 bp, Mus musculus
tgcggcttctgtcactgcgccacag

SEQ ID NO: 810061 - DNA, 25 bp, Mus musculus
tgcggcttctgtgactgcgccacag

SEQ ID NO: 810062 - DNA, 25 bp, Mus musculus
tgcggcttgcgcatctcctggctct

SEQ ID NO: 810063 - DNA, 25 bp, Mus musculus
tgcggcttgcgcttctcctggctct

SEQ ID NO: 810064 - DNA, 25 bp, Mus musculus
tgcgggaaaaagacttcggtatcaa

SEQ ID NO: 810065 - DNA, 25 bp, Mus musculus
tgcgggaaaaagtcttcggtatcaa

SEQ ID NO: 810066 - DNA, 25 bp, Mus musculus
tgcgggaactgtacagcggcatcga

SEQ ID NO: 810067 - DNA, 25 bp, Mus musculus
tgcgggaactgttcagcggcatcga

SEQ ID NO: 810068 - DNA, 25 bp, Mus musculus
tgcgggaagctacccttctgctgag

SEQ ID NO: 810069 - DNA, 25 bp, Mus musculus
tgcgggaagctagccttctgctgag

SEQ ID NO: 810070 - DNA, 25 bp, Mus musculus
tgcgggaattctcagacagtctctc

SEQ ID NO: 810071 - DNA, 25 bp, Mus musculus
tgcgggaattctgagacagtctctc

SEQ ID NO: 810072 - DNA, 25 bp, Mus musculus
tgcgggacagcacgctagccttctt

SEQ ID NO: 810073 - DNA, 25 bp, Mus musculus
tgcgggacagcaggctagccttctt

SEQ ID NO: 810074 - DNA, 25 bp, Mus musculus
tgcgggacatccaaaacactcagtg

SEQ ID NO: 810075 - DNA, 25 bp, Mus musculus
tgcgggacatcctaaacactcagtg

SEQ ID NO: 810076 - DNA, 25 bp, Mus musculus
tgcgggacgacgacatcttcattgt

SEQ ID NO: 810077 - DNA, 25 bp, Mus musculus
tgcgggacgacgtcatcttcattgt

SEQ ID NO: 810078 - DNA, 25 bp, Mus musculus
tgcgggacgccgatttgctaaagaa

SEQ ID NO: 810079 - DNA, 25 bp, Mus musculus
tgcgggacgccgttttgctaaagaa

SEQ ID NO: 810080 - DNA, 25 bp, Mus musculus
tgcgggacgctgactacattgctgc

SEQ ID NO: 810081 - DNA, 25 bp, Mus musculus
tgcgggacgctgtctacattgctgc

SEQ ID NO: 810082 - DNA, 25 bp, Mus musculus
tgcgggactcctagtcccacagagc

SEQ ID NO: 810083 - DNA, 25 bp, Mus musculus
tgcgggactccttgtcccacagagc

SEQ ID NO: 810084 - DNA, 25 bp, Mus musculus
tgcgggagaactccccttgaatgaa

SEQ ID NO: 810085 - DNA, 25 bp, Mus musculus
tgcgggagaactgcccttgaatgaa

SEQ ID NO: 810086 - DNA, 25 bp, Mus musculus
tgcgggagactgacaatcagctaca

SEQ ID NO: 810087 - DNA, 25 bp, Mus musculus
tgcgggagactgtcaatcagctaca

SEQ ID NO: 810088 - DNA, 25 bp, Mus musculus
tgcgggagccacatgtctctgggta

SEQ ID NO: 810089 - DNA, 25 bp, Mus musculus
tgcgggagccacttgtctctgggta

SEQ ID NO: 810090 - DNA, 25 bp, Mus musculus
tgcgggagcccgagtcttcgaatac

SEQ ID NO: 810091 - DNA, 25 bp, Mus musculus
tgcgggagcccgtgtcttcgaatac

SEQ ID NO: 810092 - DNA, 25 bp, Mus musculus
tgcgggagctagatggccatgtcct

SEQ ID NO: 810093 - DNA, 25 bp, Mus musculus
tgcgggagctagttggccatgtcct

SEQ ID NO: 810094 - DNA, 25 bp, Mus musculus
tgcgggaggctcacaaacttacaaa

SEQ ID NO: 810095 - DNA, 25 bp, Mus musculus
tgcgggaggctctcaaacttacaaa

SEQ ID NO: 810096 - DNA, 25 bp, Mus musculus
tgcgggagtccgcaatccccagcaa

SEQ ID NO: 810097 - DNA, 25 bp, Mus musculus
tgcgggagtccggaatccccagcaa

SEQ ID NO: 810098 - DNA, 25 bp, Mus musculus
tgcgggcacctaagaggtcagattc

SEQ ID NO: 810099 - DNA, 25 bp, Mus musculus
tgcgggcacctatgaggtcagattc

SEQ ID NO: 810100 - DNA, 25 bp, Mus musculus
tgcgggcagagacatggccaacatc

SEQ ID NO: 810101 - DNA, 25 bp, Mus musculus
tgcgggcagagagatggccaacatc

SEQ ID NO: 810102 - DNA, 25 bp, Mus musculus
tgcgggcagcagcaagctgcttcaa

SEQ ID NO: 810103 - DNA, 25 bp, Mus musculus
tgcgggcagcaggaagctgcttcaa

SEQ ID NO: 810104 - DNA, 25 bp, Mus musculus
tgcgggcatcgccagctaatctggt

SEQ ID NO: 810105 - DNA, 25 bp, Mus musculus
tgcgggcatcgcgagctaatctggt

SEQ ID NO: 810106 - DNA, 25 bp, Mus musculus
tgcgggcatctacaacctggatgac

SEQ ID NO: 810107 - DNA, 25 bp, Mus musculus
tgcgggcatctagaacctggatgac

SEQ ID NO: 810108 - DNA, 25 bp, Mus musculus
tgcgggccactcaggatcggcagct

SEQ ID NO: 810109 - DNA, 25 bp, Mus musculus
tgcgggccactctggatcggcagct

SEQ ID NO: 810110 - DNA, 25 bp, Mus musculus
tgcgggccagcgagcccttacaagt

SEQ ID NO: 810111 - DNA, 25 bp, Mus musculus
tgcgggccagcgtgcccttacaagt

SEQ ID NO: 810112 - DNA, 25 bp, Mus musculus
tgcgggccatgacccatgtcatcaa

SEQ ID NO: 810113 - DNA, 25 bp, Mus musculus
tgcgggccatgagccatgtcatcaa

SEQ ID NO: 810114 - DNA, 25 bp, Mus musculus
tgcgggcctagtacttccactggct

SEQ ID NO: 810115 - DNA, 25 bp, Mus musculus
tgcgggcctagttcttccactggct

SEQ ID NO: 810116 - DNA, 25 bp, Mus musculus
tgcgggctgcccagcttgggtccaa

SEQ ID NO: 810117 - DNA, 25 bp, Mus musculus
tgcgggctgccctgcttgggtccaa

SEQ ID NO: 810118 - DNA, 25 bp, Mus musculus
tgcgggcttaccaagcccgatagcc

SEQ ID NO: 810119 - DNA, 25 bp, Mus musculus
tgcgggcttacctagcccgatagcc

SEQ ID NO: 810120 - DNA, 25 bp, Mus musculus
tgcgggcttcctatctggagatcta

SEQ ID NO: 810121 - DNA, 25 bp, Mus musculus
tgcgggcttcctttctggagatcta

SEQ ID NO: 810122 - DNA, 25 bp, Mus musculus
tgcgggcttcgcagggccccgtcta

SEQ ID NO: 810123 - DNA, 25 bp, Mus musculus
tgcgggcttcgctgggccccgtcta

SEQ ID NO: 810124 - DNA, 25 bp, Mus musculus
tgcgggtaatttagtgtgttccacc

SEQ ID NO: 810125 - DNA, 25 bp, Mus musculus
tgcgggtaattttgtgtgttccacc

SEQ ID NO: 810126 - DNA, 25 bp, Mus musculus
tgcgggtagtagagagcgggacacc

SEQ ID NO: 810127 - DNA, 25 bp, Mus musculus
tgcgggtagtagtgagcgggacacc

SEQ ID NO: 810128 - DNA, 25 bp, Mus musculus
tgcgggtcagaacccagagaatgcc

SEQ ID NO: 810129 - DNA, 25 bp, Mus musculus
tgcgggtcagaagccagagaatgcc

SEQ ID NO: 810130 - DNA, 25 bp, Mus musculus
tgcgggtcaggaacgtttccgtagc

SEQ ID NO: 810131 - DNA, 25 bp, Mus musculus
tgcgggtcaggatcgtttccgtagc

SEQ ID NO: 810132 - DNA, 25 bp, Mus musculus
tgcgggtctctgacgcccacttgga

SEQ ID NO: 810133 - DNA, 25 bp, Mus musculus
tgcgggtctctgtcgcccacttgga

SEQ ID NO: 810134 - DNA, 25 bp, Mus musculus
tgcgggtcttaaagagcgttccttt

SEQ ID NO: 810135 - DNA, 25 bp, Mus musculus
tgcgggtcttaatgagcgttccttt

SEQ ID NO: 810136 - DNA, 25 bp, Mus musculus
tgcgggtgataccacttaaagaagt

SEQ ID NO: 810137 - DNA, 25 bp, Mus musculus
tgcgggtgatacgacttaaagaagt

SEQ ID NO: 810138 - DNA, 25 bp, Mus musculus
tgcgggtggcttaataagagctcaa

SEQ ID NO: 810139 - DNA, 25 bp, Mus musculus
tgcgggtggctttataagagctcaa

SEQ ID NO: 810140 - DNA, 25 bp, Mus musculus
tgcgggtgtctcaagacagaaggaa

SEQ ID NO: 810141 - DNA, 25 bp, Mus musculus
tgcgggtgtctctagacagaaggaa

SEQ ID NO: 810142 - DNA, 25 bp, Mus musculus
tgcgggttgtcgcatcagatgcaac

SEQ ID NO: 810143 - DNA, 25 bp, Mus musculus
tgcgggttgtcggatcagatgcaac

SEQ ID NO: 810144 - DNA, 25 bp, Mus musculus
tgcggtatcattaagtaaagaggca

SEQ ID NO: 810145 - DNA, 25 bp, Mus musculus
tgcggtatcatttagtaaagaggca

SEQ ID NO: 810146 - DNA, 25 bp, Mus musculus
tgcggtatgaaaaagatacaggaga

SEQ ID NO: 810147 - DNA, 25 bp, Mus musculus
tgcggtatgaaatagatacaggaga

SEQ ID NO: 810148 - DNA, 25 bp, Mus musculus
tgcggtcacaggagcaagtgagcct

SEQ ID NO: 810149 - DNA, 25 bp, Mus musculus
tgcggtcacaggtgcaagtgagcct

SEQ ID NO: 810150 - DNA, 25 bp, Mus musculus
tgcggtcagaatcagagagtcaagc

SEQ ID NO: 810151 - DNA, 25 bp, Mus musculus
tgcggtcagaatgagagagtcaagc

SEQ ID NO: 810152 - DNA, 25 bp, Mus musculus
tgcggtcagtctagcgagacagaga

SEQ ID NO: 810153 - DNA, 25 bp, Mus musculus
tgcggtcagtcttgcgagacagaga

SEQ ID NO: 810154 - DNA, 25 bp, Mus musculus
tgcggtccatgtacacgcgagctct

SEQ ID NO: 810155 - DNA, 25 bp, Mus musculus
tgcggtccatgttcacgcgagctct

SEQ ID NO: 810156 - DNA, 25 bp, Mus musculus
tgcggtccccacaagggcagcttgg

SEQ ID NO: 810157 - DNA, 25 bp, Mus musculus
tgcggtccccactagggcagcttgg

SEQ ID NO: 810158 - DNA, 25 bp, Mus musculus
tgcggtccgtcaacatctttgctgg

SEQ ID NO: 810159 - DNA, 25 bp, Mus musculus
tgcggtccgtcatcatctttgctgg

SEQ ID NO: 810160 - DNA, 25 bp, Mus musculus
tgcggtcctggcaccaagaaggttc

SEQ ID NO: 810161 - DNA, 25 bp, Mus musculus
tgcggtcctggctccaagaaggttc

SEQ ID NO: 810162 - DNA, 25 bp, Mus musculus
tgcggtcgcgtcattttctccgcag

SEQ ID NO: 810163 - DNA, 25 bp, Mus musculus
tgcggtcgcgtctttttctccgcag

SEQ ID NO: 810164 - DNA, 25 bp, Mus musculus
tgcggtcgggcgctcggtatggatg

SEQ ID NO: 810165 - DNA, 25 bp, Mus musculus
tgcggtcgggcggtcggtatggatg

SEQ ID NO: 810166 - DNA, 25 bp, Mus musculus
tgcggtctaaccactatcgggtctg

SEQ ID NO: 810167 - DNA, 25 bp, Mus musculus
tgcggtctaacctctatcgggtctg

SEQ ID NO: 810168 - DNA, 25 bp, Mus musculus
tgcggtctttgaataccctgggaac

SEQ ID NO: 810169 - DNA, 25 bp, Mus musculus
tgcggtctttgattaccctgggaac

SEQ ID NO: 810170 - DNA, 25 bp, Mus musculus
tgcggtgacccgagggtctcaccat

SEQ ID NO: 810171 - DNA, 25 bp, Mus musculus
tgcggtgacccgtgggtctcaccat

SEQ ID NO: 810172 - DNA, 25 bp, Mus musculus
tgcggtgagatactccacgttcttc

SEQ ID NO: 810173 - DNA, 25 bp, Mus musculus
tgcggtgagatagtccacgttcttc

SEQ ID NO: 810174 - DNA, 25 bp, Mus musculus
tgcggtgatcgaccgcttccgagaa

SEQ ID NO: 810175 - DNA, 25 bp, Mus musculus
tgcggtgatcgagcgcttccgagaa

SEQ ID NO: 810176 - DNA, 25 bp, Mus musculus
tgcggtgcatcaataccagccctgg

SEQ ID NO: 810177 - DNA, 25 bp, Mus musculus
tgcggtgcatcattaccagccctgg

SEQ ID NO: 810178 - DNA, 25 bp, Mus musculus
tgcggtgccaacaaataccgctgtg

SEQ ID NO: 810179 - DNA, 25 bp, Mus musculus
tgcggtgccaactaataccgctgtg

SEQ ID NO: 810180 - DNA, 25 bp, Mus musculus
tgcggtgccgacagggtgttccttc

SEQ ID NO: 810181 - DNA, 25 bp, Mus musculus
tgcggtgccgactgggtgttccttc

SEQ ID NO: 810182 - DNA, 25 bp, Mus musculus
tgcggtgcggagactccatgagacc

SEQ ID NO: 810183 - DNA, 25 bp, Mus musculus
tgcggtgcggagtctccatgagacc

SEQ ID NO: 810184 - DNA, 25 bp, Mus musculus
tgcggtgctcacagccatggacact

SEQ ID NO: 810185 - DNA, 25 bp, Mus musculus
tgcggtgctcactgccatggacact

SEQ ID NO: 810186 - DNA, 25 bp, Mus musculus
tgcggtgctccgagaagttaaaaga

SEQ ID NO: 810187 - DNA, 25 bp, Mus musculus
tgcggtgctccgtgaagttaaaaga

SEQ ID NO: 810188 - DNA, 25 bp, Mus musculus
tgcggtggaacaagggaaccattct

SEQ ID NO: 810189 - DNA, 25 bp, Mus musculus
tgcggtggaacatgggaaccattct

SEQ ID NO: 810190 - DNA, 25 bp, Mus musculus
tgcggtgggaaacctgctaaactcc

SEQ ID NO: 810191 - DNA, 25 bp, Mus musculus
tgcggtgggaaagctgctaaactcc

SEQ ID NO: 810192 - DNA, 25 bp, Mus musculus
tgcggtggtgctactgattgctcaa

SEQ ID NO: 810193 - DNA, 25 bp, Mus musculus
tgcggtggtgcttctgattgctcaa

SEQ ID NO: 810194 - DNA, 25 bp, Mus musculus
tgcggtgttccgacacttccggcga

SEQ ID NO: 810195 - DNA, 25 bp, Mus musculus
tgcggtgttccgtcacttccggcga

SEQ ID NO: 810196 - DNA, 25 bp, Mus musculus
tgcggttccgtgaggcctgttccaa

SEQ ID NO: 810197 - DNA, 25 bp, Mus musculus
tgcggttccgtgtggcctgttccaa

SEQ ID NO: 810198 - DNA, 25 bp, Mus musculus
tgcggttctatgagggtcctgagct

SEQ ID NO: 810199 - DNA, 25 bp, Mus musculus
tgcggttctatgtgggtcctgagct

SEQ ID NO: 810200 - DNA, 25 bp, Mus musculus
tgcggttgtgaacgaaaaagatttc

SEQ ID NO: 810201 - DNA, 25 bp, Mus musculus
tgcggttgtgaaggaaaaagatttc

SEQ ID NO: 810202 - DNA, 25 bp, Mus musculus
tgcggttgttccaggccgcttcccg

SEQ ID NO: 810203 - DNA, 25 bp, Mus musculus
tgcggttgttcctggccgcttcccg

SEQ ID NO: 810204 - DNA, 25 bp, Mus musculus
tgcggtttggagacaggatgttcta

SEQ ID NO: 810205 - DNA, 25 bp, Mus musculus
tgcggtttggagtcaggatgttcta

SEQ ID NO: 810206 - DNA, 25 bp, Mus musculus
tgcgtaagattgaggcccggaaaaa

SEQ ID NO: 810207 - DNA, 25 bp, Mus musculus
tgcgtaagattgtggcccggaaaaa

SEQ ID NO: 810208 - DNA, 25 bp, Mus musculus
tgcgtaagggctccgtccgcttcca

SEQ ID NO: 810209 - DNA, 25 bp, Mus musculus
tgcgtaagggctgcgtccgcttcca

SEQ ID NO: 810210 - DNA, 25 bp, Mus musculus
tgcgtaatgagaccacaggctccct

SEQ ID NO: 810211 - DNA, 25 bp, Mus musculus
tgcgtaatgagagcacaggctccct

SEQ ID NO: 810212 - DNA, 25 bp, Mus musculus
tgcgtacacggcaggacttccatcc

SEQ ID NO: 810213 - DNA, 25 bp, Mus musculus
tgcgtacacggctggacttccatcc

SEQ ID NO: 810214 - DNA, 25 bp, Mus musculus
tgcgtacagcctccagatggaggcc

SEQ ID NO: 810215 - DNA, 25 bp, Mus musculus
tgcgtacagcctgcagatggaggcc

SEQ ID NO: 810216 - DNA, 25 bp, Mus musculus
tgcgtaccaactaatggtggatgtg

SEQ ID NO: 810217 - DNA, 25 bp, Mus musculus
tgcgtaccaacttatggtggatgtg

SEQ ID NO: 810218 - DNA, 25 bp, Mus musculus
tgcgtaccttgcagcacgtgctcag

SEQ ID NO: 810219 - DNA, 25 bp, Mus musculus
tgcgtaccttgctgcacgtgctcag

SEQ ID NO: 810220 - DNA, 25 bp, Mus musculus
tgcgtacgccttacaccatgagtta

SEQ ID NO: 810221 - DNA, 25 bp, Mus musculus
tgcgtacgcctttcaccatgagtta

SEQ ID NO: 810222 - DNA, 25 bp, Mus musculus
tgcgtacgcttcaccccttggagct

SEQ ID NO: 810223 - DNA, 25 bp, Mus musculus
tgcgtacgcttctccccttggagct

SEQ ID NO: 810224 - DNA, 25 bp, Mus musculus
tgcgtagactcgaccaaccaaagtc

SEQ ID NO: 810225 - DNA, 25 bp, Mus musculus
tgcgtagactcgtccaaccaaagtc

SEQ ID NO: 810226 - DNA, 25 bp, Mus musculus
tgcgtagcctgaagcccaacagccg

SEQ ID NO: 810227 - DNA, 25 bp, Mus musculus
tgcgtagcctgatgcccaacagccg

SEQ ID NO: 810228 - DNA, 25 bp, Mus musculus
tgcgtagtaaagatctcagacttcg

SEQ ID NO: 810229 - DNA, 25 bp, Mus musculus
tgcgtagtaaagttctcagacttcg

SEQ ID NO: 810230 - DNA, 25 bp, Mus musculus
tgcgtatgcagaaccagagcgtgga

SEQ ID NO: 810231 - DNA, 25 bp, Mus musculus
tgcgtatgcagatccagagcgtgga

SEQ ID NO: 810232 - DNA, 25 bp, Mus musculus
tgcgtatttgcacttgctgaacctg

SEQ ID NO: 810233 - DNA, 25 bp, Mus musculus
tgcgtatttgcagttgctgaacctg

SEQ ID NO: 810234 - DNA, 25 bp, Mus musculus
tgcgtcaacactcccagatatccag

SEQ ID NO: 810235 - DNA, 25 bp, Mus musculus
tgcgtcaacactgccagatatccag

SEQ ID NO: 810236 - DNA, 25 bp, Mus musculus
tgcgtcagctgcagggcgatctaaa

SEQ ID NO: 810237 - DNA, 25 bp, Mus musculus
tgcgtcagctgctgggcgatctaaa

SEQ ID NO: 810238 - DNA, 25 bp, Mus musculus
tgcgtcaggagaagagtcagcactg

SEQ ID NO: 810239 - DNA, 25 bp, Mus musculus
tgcgtcaggagatgagtcagcactg

SEQ ID NO: 810240 - DNA, 25 bp, Mus musculus
tgcgtcatcaatcccaccatcgaga

SEQ ID NO: 810241 - DNA, 25 bp, Mus musculus
tgcgtcatcaatgccaccatcgaga

SEQ ID NO: 810242 - DNA, 25 bp, Mus musculus
tgcgtcatcgcacgccacgagagcg

SEQ ID NO: 810243 - DNA, 25 bp, Mus musculus
tgcgtcatcgcaggccacgagagcg

SEQ ID NO: 810244 - DNA, 25 bp, Mus musculus
tgcgtcatcggcatctgtggtggag

SEQ ID NO: 810245 - DNA, 25 bp, Mus musculus
tgcgtcatcggcttctgtggtggag

SEQ ID NO: 810246 - DNA, 25 bp, Mus musculus
tgcgtcatgatccacagaccaccag

SEQ ID NO: 810247 - DNA, 25 bp, Mus musculus
tgcgtcatgatcgacagaccaccag

SEQ ID NO: 810248 - DNA, 25 bp, Mus musculus
tgcgtccagcctccgagcagatcta

SEQ ID NO: 810249 - DNA, 25 bp, Mus musculus
tgcgtccagcctgcgagcagatcta

SEQ ID NO: 810250 - DNA, 25 bp, Mus musculus
tgcgtccccggccaaagagaagatc

SEQ ID NO: 810251 - DNA, 25 bp, Mus musculus
tgcgtccccggcgaaagagaagatc

SEQ ID NO: 810252 - DNA, 25 bp, Mus musculus
tgcgtcccctgtcggtctctagagt

SEQ ID NO: 810253 - DNA, 25 bp, Mus musculus
tgcgtcccctgtgggtctctagagt

SEQ ID NO: 810254 - DNA, 25 bp, Mus musculus
tgcgtcccgtgtcagtttccctggt

SEQ ID NO: 810255 - DNA, 25 bp, Mus musculus
tgcgtcccgtgtgagtttccctggt

SEQ ID NO: 810256 - DNA, 25 bp, Mus musculus
tgcgtcccttccacttcggacttgg

SEQ ID NO: 810257 - DNA, 25 bp, Mus musculus
tgcgtcccttcctcttcggacttgg

SEQ ID NO: 810258 - DNA, 25 bp, Mus musculus
tgcgtccgacccaagatgtgacacg

SEQ ID NO: 810259 - DNA, 25 bp, Mus musculus
tgcgtccgaccctagatgtgacacg

SEQ ID NO: 810260 - DNA, 25 bp, Mus musculus
tgcgtccgccttcttcactagaaat

SEQ ID NO: 810261 - DNA, 25 bp, Mus musculus
tgcgtccgccttgttcactagaaat

SEQ ID NO: 810262 - DNA, 25 bp, Mus musculus
tgcgtccggtatacaatgcctcagt

SEQ ID NO: 810263 - DNA, 25 bp, Mus musculus
tgcgtccggtattcaatgcctcagt

SEQ ID NO: 810264 - DNA, 25 bp, Mus musculus
tgcgtcctgatcatcagcaccctgg

SEQ ID NO: 810265 - DNA, 25 bp, Mus musculus
tgcgtcctgatcttcagcaccctgg

SEQ ID NO: 810266 - DNA, 25 bp, Mus musculus
tgcgtcctgcttcaatgacctatga

SEQ ID NO: 810267 - DNA, 25 bp, Mus musculus
tgcgtcctgcttgaatgacctatga

SEQ ID NO: 810268 - DNA, 25 bp, Mus musculus
tgcgtcggaggaatgaacagacgtc

SEQ ID NO: 810269 - DNA, 25 bp, Mus musculus
tgcgtcggaggattgaacagacgtc

SEQ ID NO: 810270 - DNA, 25 bp, Mus musculus
tgcgtcgggaccacaacttctccgt

SEQ ID NO: 810271 - DNA, 25 bp, Mus musculus
tgcgtcgggacctcaacttctccgt

SEQ ID NO: 810272 - DNA, 25 bp, Mus musculus
tgcgtcgttaatcccaggagctctg

SEQ ID NO: 810273 - DNA, 25 bp, Mus musculus
tgcgtcgttaatgccaggagctctg

SEQ ID NO: 810274 - DNA, 25 bp, Mus musculus
tgcgtctaagtgatggtcacttcat

SEQ ID NO: 810275 - DNA, 25 bp, Mus musculus
tgcgtctaagtgttggtcacttcat

SEQ ID NO: 810276 - DNA, 25 bp, Mus musculus
tgcgtctaatgcaggtattggcacc

SEQ ID NO: 810277 - DNA, 25 bp, Mus musculus
tgcgtctaatgctggtattggcacc

SEQ ID NO: 810278 - DNA, 25 bp, Mus musculus
tgcgtctacccaagaacccacatag

SEQ ID NO: 810279 - DNA, 25 bp, Mus musculus
tgcgtctacccatgaacccacatag

SEQ ID NO: 810280 - DNA, 25 bp, Mus musculus
tgcgtctccatgacgacgtgctcgg

SEQ ID NO: 810281 - DNA, 25 bp, Mus musculus
tgcgtctccatgtcgacgtgctcgg

SEQ ID NO: 810282 - DNA, 25 bp, Mus musculus
tgcgtctccctcagctactcggagg

SEQ ID NO: 810283 - DNA, 25 bp, Mus musculus
tgcgtctccctctgctactcggagg

SEQ ID NO: 810284 - DNA, 25 bp, Mus musculus
tgcgtctcttttcattcatctccag

SEQ ID NO: 810285 - DNA, 25 bp, Mus musculus
tgcgtctcttttgattcatctccag

SEQ ID NO: 810286 - DNA, 25 bp, Mus musculus
tgcgtctggagaaccgtgccatgga

SEQ ID NO: 810287 - DNA, 25 bp, Mus musculus
tgcgtctggagatccgtgccatgga

SEQ ID NO: 810288 - DNA, 25 bp, Mus musculus
tgcgtctggagcaacagaagcagac

SEQ ID NO: 810289 - DNA, 25 bp, Mus musculus
tgcgtctggagctacagaagcagac

SEQ ID NO: 810290 - DNA, 25 bp, Mus musculus
tgcgtcttaagcacatcgccagcaa

SEQ ID NO: 810291 - DNA, 25 bp, Mus musculus
tgcgtcttaagctcatcgccagcaa

SEQ ID NO: 810292 - DNA, 25 bp, Mus musculus
tgcgtcttcttgatcgctgcctgct

SEQ ID NO: 810293 - DNA, 25 bp, Mus musculus
tgcgtcttcttgttcgctgcctgct

SEQ ID NO: 810294 - DNA, 25 bp, Mus musculus
tgcgtgaccacgaaaagagggtgca

SEQ ID NO: 810295 - DNA, 25 bp, Mus musculus
tgcgtgaccacgtaaagagggtgca

SEQ ID NO: 810296 - DNA, 25 bp, Mus musculus
tgcgtgaccaggatccaattgtggt

SEQ ID NO: 810297 - DNA, 25 bp, Mus musculus
tgcgtgaccaggttccaattgtggt

SEQ ID NO: 810298 - DNA, 25 bp, Mus musculus
tgcgtgagacctacccagcaagcag

SEQ ID NO: 810299 - DNA, 25 bp, Mus musculus
tgcgtgagaccttcccagcaagcag

SEQ ID NO: 810300 - DNA, 25 bp, Mus musculus
tgcgtgagaggcagcgtgccccaca

SEQ ID NO: 810301 - DNA, 25 bp, Mus musculus
tgcgtgagaggctgcgtgccccaca

SEQ ID NO: 810302 - DNA, 25 bp, Mus musculus
tgcgtgagctcccacaaagaaagag

SEQ ID NO: 810303 - DNA, 25 bp, Mus musculus
tgcgtgagctccgacaaagaaagag

SEQ ID NO: 810304 - DNA, 25 bp, Mus musculus
tgcgtgagtactcctcccattgcgg

SEQ ID NO: 810305 - DNA, 25 bp, Mus musculus
tgcgtgagtactgctcccattgcgg

SEQ ID NO: 810306 - DNA, 25 bp, Mus musculus
tgcgtgatatataagctgttcttac

SEQ ID NO: 810307 - DNA, 25 bp, Mus musculus
tgcgtgatatattagctgttcttac

SEQ ID NO: 810308 - DNA, 25 bp, Mus musculus
tgcgtgatccggaaccagatcggcc

SEQ ID NO: 810309 - DNA, 25 bp, Mus musculus
tgcgtgatccggtaccagatcggcc

SEQ ID NO: 810310 - DNA, 25 bp, Mus musculus
tgcgtgatgcagacgatgctgttta

SEQ ID NO: 810311 - DNA, 25 bp, Mus musculus
tgcgtgatgcagtcgatgctgttta

SEQ ID NO: 810312 - DNA, 25 bp, Mus musculus
tgcgtgcacaagattcagagctatt

SEQ ID NO: 810313 - DNA, 25 bp, Mus musculus
tgcgtgcacaagtttcagagctatt

SEQ ID NO: 810314 - DNA, 25 bp, Mus musculus
tgcgtgccagagctaaggaaattga

SEQ ID NO: 810315 - DNA, 25 bp, Mus musculus
tgcgtgccagaggtaaggaaattga

SEQ ID NO: 810316 - DNA, 25 bp, Mus musculus
tgcgtgcccgctctaaggtgtacca

SEQ ID NO: 810317 - DNA, 25 bp, Mus musculus
tgcgtgcccgctgtaaggtgtacca

SEQ ID NO: 810318 - DNA, 25 bp, Mus musculus
tgcgtgccctggaattagggtacag

SEQ ID NO: 810319 - DNA, 25 bp, Mus musculus
tgcgtgccctggtattagggtacag

SEQ ID NO: 810320 - DNA, 25 bp, Mus musculus
tgcgtgcgagcgacgatatcgtcct

SEQ ID NO: 810321 - DNA, 25 bp, Mus musculus
tgcgtgcgagcgtcgatatcgtcct

SEQ ID NO: 810322 - DNA, 25 bp, Mus musculus
tgcgtgctacgcatgaaccaggcac

SEQ ID NO: 810323 - DNA, 25 bp, Mus musculus
tgcgtgctacgcttgaaccaggcac

SEQ ID NO: 810324 - DNA, 25 bp, Mus musculus
tgcgtgctacttcctggctcgccta

SEQ ID NO: 810325 - DNA, 25 bp, Mus musculus
tgcgtgctacttgctggctcgccta

SEQ ID NO: 810326 - DNA, 25 bp, Mus musculus
tgcgtgctccaaactcacaagacag

SEQ ID NO: 810327 - DNA, 25 bp, Mus musculus
tgcgtgctccaatctcacaagacag

SEQ ID NO: 810328 - DNA, 25 bp, Mus musculus
tgcgtgctcccaagatcagagtctg

SEQ ID NO: 810329 - DNA, 25 bp, Mus musculus
tgcgtgctcccacatacttctgtga

SEQ ID NO: 810330 - DNA, 25 bp, Mus musculus
tgcgtgctcccagatacttctgtga

SEQ ID NO: 810331 - DNA, 25 bp, Mus musculus
tgcgtgctcccatgatcagagtctg

SEQ ID NO: 810332 - DNA, 25 bp, Mus musculus
tgcgtgctcctgaatcccacaatgt

SEQ ID NO: 810333 - DNA, 25 bp, Mus musculus
tgcgtgctcctgtatcccacaatgt

SEQ ID NO: 810334 - DNA, 25 bp, Mus musculus
tgcgtgctctctctatgcgcaggag

SEQ ID NO: 810335 - DNA, 25 bp, Mus musculus
tgcgtgctctctgtatgcgcaggag

SEQ ID NO: 810336 - DNA, 25 bp, Mus musculus
tgcgtggaccaacatagaccctggg

SEQ ID NO: 810337 - DNA, 25 bp, Mus musculus
tgcgtggaccaagatagaccctggg

SEQ ID NO: 810338 - DNA, 25 bp, Mus musculus
tgcgtggacgccaacattgacgagg

SEQ ID NO: 810339 - DNA, 25 bp, Mus musculus
tgcgtggacgcctacattgacgagg

SEQ ID NO: 810340 - DNA, 25 bp, Mus musculus
tgcgtggactgcagcccctgcttca

SEQ ID NO: 810341 - DNA, 25 bp, Mus musculus
tgcgtggactgctgcccctgcttca

SEQ ID NO: 810342 - DNA, 25 bp, Mus musculus
tgcgtggaggagactgagctctact

SEQ ID NO: 810343 - DNA, 25 bp, Mus musculus
tgcgtggaggagtctgagctctact

SEQ ID NO: 810344 - DNA, 25 bp, Mus musculus
tgcgtggcattgacactcgtgtgtc

SEQ ID NO: 810345 - DNA, 25 bp, Mus musculus
tgcgtggcattgtcactcgtgtgtc

SEQ ID NO: 810346 - DNA, 25 bp, Mus musculus
tgcgtggccctgagcagtgtgacat

SEQ ID NO: 810347 - DNA, 25 bp, Mus musculus
tgcgtggccctgtgcagtgtgacat

SEQ ID NO: 810348 - DNA, 25 bp, Mus musculus
tgcgtggccgaacctacgattcgtg

SEQ ID NO: 810349 - DNA, 25 bp, Mus musculus
tgcgtggccgaagctacgattcgtg

SEQ ID NO: 810350 - DNA, 25 bp, Mus musculus
tgcgtggtccggatcaagccagtgt

SEQ ID NO: 810351 - DNA, 25 bp, Mus musculus
tgcgtggtccggttcaagccagtgt

SEQ ID NO: 810352 - DNA, 25 bp, Mus musculus
tgcgtgtccaggcacaaagaaacaa

SEQ ID NO: 810353 - DNA, 25 bp, Mus musculus
tgcgtgtccagggacaaagaaacaa

SEQ ID NO: 810354 - DNA, 25 bp, Mus musculus
tgcgtgtcctgcctgcacatgcctg

SEQ ID NO: 810355 - DNA, 25 bp, Mus musculus
tgcgtgtcctgcgtgcacatgcctg

SEQ ID NO: 810356 - DNA, 25 bp, Mus musculus
tgcgtgtcttgacctgcacctgagt

SEQ ID NO: 810357 - DNA, 25 bp, Mus musculus
tgcgtgtcttgagctgcacctgagt

SEQ ID NO: 810358 - DNA, 25 bp, Mus musculus
tgcgtgtgaactaggacatgggcaa

SEQ ID NO: 810359 - DNA, 25 bp, Mus musculus
tgcgtgtgaacttggacatgggcaa

SEQ ID NO: 810360 - DNA, 25 bp, Mus musculus
tgcgtgtgagggagcaccctctgct

SEQ ID NO: 810361 - DNA, 25 bp, Mus musculus
tgcgtgtgagggtgcaccctctgct

SEQ ID NO: 810362 - DNA, 25 bp, Mus musculus
tgcgtgtgcgcgatgaatcagccac

SEQ ID NO: 810363 - DNA, 25 bp, Mus musculus
tgcgtgtgcgcgttgaatcagccac

SEQ ID NO: 810364 - DNA, 25 bp, Mus musculus
tgcgtgtgtactccatcctggcctc

SEQ ID NO: 810365 - DNA, 25 bp, Mus musculus
tgcgtgtgtactgcatcctggcctc

SEQ ID NO: 810366 - DNA, 25 bp, Mus musculus
tgcgtgtgtgcaacccaaggcccct

SEQ ID NO: 810367 - DNA, 25 bp, Mus musculus
tgcgtgtgtgcatcccaaggcccct

SEQ ID NO: 810368 - DNA, 25 bp, Mus musculus
tgcgtgttcatcatgttggccaatc

SEQ ID NO: 810369 - DNA, 25 bp, Mus musculus
tgcgtgttcatcttgttggccaatc

SEQ ID NO: 810370 - DNA, 25 bp, Mus musculus
tgcgttaataacatctcagactctg

SEQ ID NO: 810371 - DNA, 25 bp, Mus musculus
tgcgttaataacttctcagactctg

SEQ ID NO: 810372 - DNA, 25 bp, Mus musculus
tgcgttaccgataccaccggtgtcg

SEQ ID NO: 810373 - DNA, 25 bp, Mus musculus
tgcgttaccgattccaccggtgtcg

SEQ ID NO: 810374 - DNA, 25 bp, Mus musculus
tgcgttagaggcagacagcagccag

SEQ ID NO: 810375 - DNA, 25 bp, Mus musculus
tgcgttagaggctgacagcagccag

SEQ ID NO: 810376 - DNA, 25 bp, Mus musculus
tgcgttcagatcaagcgggatggcc

SEQ ID NO: 810377 - DNA, 25 bp, Mus musculus
tgcgttcagatctagcgggatggcc

SEQ ID NO: 810378 - DNA, 25 bp, Mus musculus
tgcgttccatccaattggacgggct

SEQ ID NO: 810379 - DNA, 25 bp, Mus musculus
tgcgttccatcctattggacgggct

SEQ ID NO: 810380 - DNA, 25 bp, Mus musculus
tgcgttccgggcacaatgccacttt

SEQ ID NO: 810381 - DNA, 25 bp, Mus musculus
tgcgttccgggctcaatgccacttt

SEQ ID NO: 810382 - DNA, 25 bp, Mus musculus
tgcgttccgtacatgatgagcttct

SEQ ID NO: 810383 - DNA, 25 bp, Mus musculus
tgcgttccgtacttgatgagcttct

SEQ ID NO: 810384 - DNA, 25 bp, Mus musculus
tgcgttcctggaccgcgaatgacat

SEQ ID NO: 810385 - DNA, 25 bp, Mus musculus
tgcgttcctggagcgcgaatgacat

SEQ ID NO: 810386 - DNA, 25 bp, Mus musculus
tgcgttctaagaccagggcctttga

SEQ ID NO: 810387 - DNA, 25 bp, Mus musculus
tgcgttctaagagcagggcctttga

SEQ ID NO: 810388 - DNA, 25 bp, Mus musculus
tgcgttctagtgctcgccctggcta

SEQ ID NO: 810389 - DNA, 25 bp, Mus musculus
tgcgttctagtggtcgccctggcta

SEQ ID NO: 810390 - DNA, 25 bp, Mus musculus
tgcgttctatgtagcggacctcgga

SEQ ID NO: 810391 - DNA, 25 bp, Mus musculus
tgcgttctatgttgcggacctcgga

SEQ ID NO: 810392 - DNA, 25 bp, Mus musculus
tgcgttctggccctggcaagcaaga

SEQ ID NO: 810393 - DNA, 25 bp, Mus musculus
tgcgttctggccgtggcaagcaaga

SEQ ID NO: 810394 - DNA, 25 bp, Mus musculus
tgcgttgaagacaaagagtatgaga

SEQ ID NO: 810395 - DNA, 25 bp, Mus musculus
tgcgttgaagactaagagtatgaga

SEQ ID NO: 810396 - DNA, 25 bp, Mus musculus
tgcgttgatgtacaagacatgcctg

SEQ ID NO: 810397 - DNA, 25 bp, Mus musculus
tgcgttgatgtagaagacatgcctg

SEQ ID NO: 810398 - DNA, 25 bp, Mus musculus
tgcgtttcaacaaaccaactgggac

SEQ ID NO: 810399 - DNA, 25 bp, Mus musculus
tgcgtttcaacataccaactgggac

SEQ ID NO: 810400 - DNA, 25 bp, Mus musculus
tgcgtttcgcctcggctgtgctcct

SEQ ID NO: 810401 - DNA, 25 bp, Mus musculus
tgcgtttcgcctgggctgtgctcct

SEQ ID NO: 810402 - DNA, 25 bp, Mus musculus
tgcgtttgccgccaccttgtttgcc

SEQ ID NO: 810403 - DNA, 25 bp, Mus musculus
tgcgtttgccgcgaccttgtttgcc

SEQ ID NO: 810404 - DNA, 25 bp, Mus musculus
tgcgtttgtactacccagctcaaga

SEQ ID NO: 810405 - DNA, 25 bp, Mus musculus
tgcgtttgtacttcccagctcaaga

SEQ ID NO: 810406 - DNA, 25 bp, Mus musculus
tgcgttttgccccacgttctgtcag

SEQ ID NO: 810407 - DNA, 25 bp, Mus musculus
tgcgttttgcccgacgttctgtcag

SEQ ID NO: 810408 - DNA, 25 bp, Mus musculus
tgctaaaagcccaggcccaatgcgc

SEQ ID NO: 810409 - DNA, 25 bp, Mus musculus
tgctaaaagccctggcccaatgcgc

SEQ ID NO: 810410 - DNA, 25 bp, Mus musculus
tgctaaaaggccaacatgagaaaga

SEQ ID NO: 810411 - DNA, 25 bp, Mus musculus
tgctaaaaggcctacatgagaaaga

SEQ ID NO: 810412 - DNA, 25 bp, Mus musculus
tgctaaacaatcattggaccccagt

SEQ ID NO: 810413 - DNA, 25 bp, Mus musculus
tgctaaacaatctttggaccccagt

SEQ ID NO: 810414 - DNA, 25 bp, Mus musculus
tgctaaacacatagattcaccactg

SEQ ID NO: 810415 - DNA, 25 bp, Mus musculus
tgctaaacacattgattcaccactg

SEQ ID NO: 810416 - DNA, 25 bp, Mus musculus
tgctaaactgaacgaactaagccgg

SEQ ID NO: 810417 - DNA, 25 bp, Mus musculus
tgctaaactgaaggaactaagccgg

SEQ ID NO: 810418 - DNA, 25 bp, Mus musculus
tgctaaagaaaactcttccaagaaa

SEQ ID NO: 810419 - DNA, 25 bp, Mus musculus
tgctaaagaaaagtcttccaagaaa

SEQ ID NO: 810420 - DNA, 25 bp, Mus musculus
tgctaaagaactcggacatgagcct

SEQ ID NO: 810421 - DNA, 25 bp, Mus musculus
tgctaaagaactgggacatgagcct

SEQ ID NO: 810422 - DNA, 25 bp, Mus musculus
tgctaaagaagacgcgatcgaggtt

SEQ ID NO: 810423 - DNA, 25 bp, Mus musculus
tgctaaagaagaggcgatcgaggtt

SEQ ID NO: 810424 - DNA, 25 bp, Mus musculus
tgctaaagatagctgaggaactgcc

SEQ ID NO: 810425 - DNA, 25 bp, Mus musculus
tgctaaagataggtgaggaactgcc

SEQ ID NO: 810426 - DNA, 25 bp, Mus musculus
tgctaaagcaatctttactggccac

SEQ ID NO: 810427 - DNA, 25 bp, Mus musculus
tgctaaagcaatgtttactggccac

SEQ ID NO: 810428 - DNA, 25 bp, Mus musculus
tgctaaaggtataggcaagagacag

SEQ ID NO: 810429 - DNA, 25 bp, Mus musculus
tgctaaaggtattggcaagagacag

SEQ ID NO: 810430 - DNA, 25 bp, Mus musculus
tgctaacaccaacaccagggctgag

SEQ ID NO: 810431 - DNA, 25 bp, Mus musculus
tgctaacaccaagaccagggctgag

SEQ ID NO: 810432 - DNA, 25 bp, Mus musculus
tgctaacagctcacttgcagtggag

SEQ ID NO: 810433 - DNA, 25 bp, Mus musculus
tgctaacagctctcttgcagtggag

SEQ ID NO: 810434 - DNA, 25 bp, Mus musculus
tgctaacagggccaagaacatcaag

SEQ ID NO: 810435 - DNA, 25 bp, Mus musculus
tgctaacagggcgaagaacatcaag

SEQ ID NO: 810436 - DNA, 25 bp, Mus musculus
tgctaacatcatcaaaatgctaagg

SEQ ID NO: 810437 - DNA, 25 bp, Mus musculus
tgctaacatcatgaaaatgctaagg

SEQ ID NO: 810438 - DNA, 25 bp, Mus musculus
tgctaacatccgaatgcctacgcca

SEQ ID NO: 810439 - DNA, 25 bp, Mus musculus
tgctaacatccgtatgcctacgcca

SEQ ID NO: 810440 - DNA, 25 bp, Mus musculus
tgctaaccagtgcaagtggccaata

SEQ ID NO: 810441 - DNA, 25 bp, Mus musculus
tgctaaccagtggaagtggccaata

SEQ ID NO: 810442 - DNA, 25 bp, Mus musculus
tgctaacctgccagagagaacttcg

SEQ ID NO: 810443 - DNA, 25 bp, Mus musculus
tgctaacctgcctgagagaacttcg

SEQ ID NO: 810444 - DNA, 25 bp, Mus musculus
tgctaaccttgcagccgccaattgt

SEQ ID NO: 810445 - DNA, 25 bp, Mus musculus
tgctaaccttgctgccgccaattgt

SEQ ID NO: 810446 - DNA, 25 bp, Mus musculus
tgctaacgacacctcagccttcggg

SEQ ID NO: 810447 - DNA, 25 bp, Mus musculus
tgctaacgacacgtcagccttcggg

SEQ ID NO: 810448 - DNA, 25 bp, Mus musculus
tgctaactcaggatctgcagcgggc

SEQ ID NO: 810449 - DNA, 25 bp, Mus musculus
tgctaactcaggttctgcagcgggc

SEQ ID NO: 810450 - DNA, 25 bp, Mus musculus
tgctaactgcagagggatcaggatg

SEQ ID NO: 810451 - DNA, 25 bp, Mus musculus
tgctaactgcagtgggatcaggatg

SEQ ID NO: 810452 - DNA, 25 bp, Mus musculus
tgctaactgcccagtgtttccttgt

SEQ ID NO: 810453 - DNA, 25 bp, Mus musculus
tgctaactgccctgtgtttccttgt

SEQ ID NO: 810454 - DNA, 25 bp, Mus musculus
tgctaacttctgcaggatcctggct

SEQ ID NO: 810455 - DNA, 25 bp, Mus musculus
tgctaacttctggaggatcctggct

SEQ ID NO: 810456 - DNA, 25 bp, Mus musculus
tgctaagaacatcatccttggtggg

SEQ ID NO: 810457 - DNA, 25 bp, Mus musculus
tgctaagaacatgatccttggtggg

SEQ ID NO: 810458 - DNA, 25 bp, Mus musculus
tgctaagaagccagaggactgggat

SEQ ID NO: 810459 - DNA, 25 bp, Mus musculus
tgctaagaagcctgaggactgggat

SEQ ID NO: 810460 - DNA, 25 bp, Mus musculus
tgctaagacactctggctcgctcct

SEQ ID NO: 810461 - DNA, 25 bp, Mus musculus
tgctaagacactgtggctcgctcct

SEQ ID NO: 810462 - DNA, 25 bp, Mus musculus
tgctaagactctcattctcagtctg

SEQ ID NO: 810463 - DNA, 25 bp, Mus musculus
tgctaagactctgattctcagtctg

SEQ ID NO: 810464 - DNA, 25 bp, Mus musculus
tgctaagagcacaccaactgctgaa

SEQ ID NO: 810465 - DNA, 25 bp, Mus musculus
tgctaagagcactccaactgctgaa

SEQ ID NO: 810466 - DNA, 25 bp, Mus musculus
tgctaagagcagagacagcatgaag

SEQ ID NO: 810467 - DNA, 25 bp, Mus musculus
tgctaagagcagtgacagcatgaag

SEQ ID NO: 810468 - DNA, 25 bp, Mus musculus
tgctaagatgcacaaggacttgaaa

SEQ ID NO: 810469 - DNA, 25 bp, Mus musculus
tgctaagatgcagaaggacttgaaa

SEQ ID NO: 810470 - DNA, 25 bp, Mus musculus
tgctaagattagagctacccgcccc

SEQ ID NO: 810471 - DNA, 25 bp, Mus musculus
tgctaagattagtgctacccgcccc

SEQ ID NO: 810472 - DNA, 25 bp, Mus musculus
tgctaagcagccaaacggagaatca

SEQ ID NO: 810473 - DNA, 25 bp, Mus musculus
tgctaagcagcctaacggagaatca

SEQ ID NO: 810474 - DNA, 25 bp, Mus musculus
tgctaagctcaacgaacgattggat

SEQ ID NO: 810475 - DNA, 25 bp, Mus musculus
tgctaagctcaaggaacgattggat

SEQ ID NO: 810476 - DNA, 25 bp, Mus musculus
tgctaagcttggcagacaatgtcac

SEQ ID NO: 810477 - DNA, 25 bp, Mus musculus
tgctaagcttgggagacaatgtcac

SEQ ID NO: 810478 - DNA, 25 bp, Mus musculus
tgctaaggaaggactcctcctctgg

SEQ ID NO: 810479 - DNA, 25 bp, Mus musculus
tgctaaggaaggtctcctcctctgg

SEQ ID NO: 810480 - DNA, 25 bp, Mus musculus
tgctaaggacttagagaaggtcgat

SEQ ID NO: 810481 - DNA, 25 bp, Mus musculus
tgctaaggactttgagaaggtcgat

SEQ ID NO: 810482 - DNA, 25 bp, Mus musculus
tgctaaggagctagattcaggatgg

SEQ ID NO: 810483 - DNA, 25 bp, Mus musculus
tgctaaggagcttgattcaggatgg

SEQ ID NO: 810484 - DNA, 25 bp, Mus musculus
tgctaaggccttcctagaaaacggt

SEQ ID NO: 810485 - DNA, 25 bp, Mus musculus
tgctaaggccttgctagaaaacggt

SEQ ID NO: 810486 - DNA, 25 bp, Mus musculus
tgctaagggaacaacactggatctg

SEQ ID NO: 810487 - DNA, 25 bp, Mus musculus
tgctaagggaactacactggatctg

SEQ ID NO: 810488 - DNA, 25 bp, Mus musculus
tgctaagtattcaagggtctacagt

SEQ ID NO: 810489 - DNA, 25 bp, Mus musculus
tgctaagtattctagggtctacagt

SEQ ID NO: 810490 - DNA, 25 bp, Mus musculus
tgctaagtgcttcataggaacatct

SEQ ID NO: 810491 - DNA, 25 bp, Mus musculus
tgctaagtgcttgataggaacatct

SEQ ID NO: 810492 - DNA, 25 bp, Mus musculus
tgctaataaagtagcggcgcgtgca

SEQ ID NO: 810493 - DNA, 25 bp, Mus musculus
tgctaataaagttgcggcgcgtgca

SEQ ID NO: 810494 - DNA, 25 bp, Mus musculus
tgctaatactagcaaaacacccacc

SEQ ID NO: 810495 - DNA, 25 bp, Mus musculus
tgctaatactaggaaaacacccacc

SEQ ID NO: 810496 - DNA, 25 bp, Mus musculus
tgctaatagcttcactctgatcggg

SEQ ID NO: 810497 - DNA, 25 bp, Mus musculus
tgctaatagcttgactctgatcggg

SEQ ID NO: 810498 - DNA, 25 bp, Mus musculus
tgctaatctgcgaagttggctcggg

SEQ ID NO: 810499 - DNA, 25 bp, Mus musculus
tgctaatctgcgtagttggctcggg

SEQ ID NO: 810500 - DNA, 25 bp, Mus musculus
tgctaatgaaatagaaagcctggga

SEQ ID NO: 810501 - DNA, 25 bp, Mus musculus
tgctaatgaaattgaaagcctggga

SEQ ID NO: 810502 - DNA, 25 bp, Mus musculus
tgctaatgaagacaatgtcactcag

SEQ ID NO: 810503 - DNA, 25 bp, Mus musculus
tgctaatgaagagaatgtcactcag

SEQ ID NO: 810504 - DNA, 25 bp, Mus musculus
tgctaatggatacccagggtgcctt

SEQ ID NO: 810505 - DNA, 25 bp, Mus musculus
tgctaatggatagccagggtgcctt

SEQ ID NO: 810506 - DNA, 25 bp, Mus musculus
tgctaatggcctactactttttcag

SEQ ID NO: 810507 - DNA, 25 bp, Mus musculus
tgctaatggccttctactttttcag

SEQ ID NO: 810508 - DNA, 25 bp, Mus musculus
tgctaatggctaccgtgtaacatgg

SEQ ID NO: 810509 - DNA, 25 bp, Mus musculus
tgctaatggctagcgtgtaacatgg

SEQ ID NO: 810510 - DNA, 25 bp, Mus musculus
tgctacaaaactatatctgaactgc

SEQ ID NO: 810511 - DNA, 25 bp, Mus musculus
tgctacaaaactttatctgaactgc

SEQ ID NO: 810512 - DNA, 25 bp, Mus musculus
tgctacaaagctcagagtttctcct

SEQ ID NO: 810513 - DNA, 25 bp, Mus musculus
tgctacaaagctgagagtttctcct

SEQ ID NO: 810514 - DNA, 25 bp, Mus musculus
tgctacaaatggaaagtcagaggcc

SEQ ID NO: 810515 - DNA, 25 bp, Mus musculus
tgctacaaatggtaagtcagaggcc

SEQ ID NO: 810516 - DNA, 25 bp, Mus musculus
tgctacaagatgcaggacgcagtcc

SEQ ID NO: 810517 - DNA, 25 bp, Mus musculus
tgctacaagatgctaatcaagaacc

SEQ ID NO: 810518 - DNA, 25 bp, Mus musculus
tgctacaagatggaggacgcagtcc

SEQ ID NO: 810519 - DNA, 25 bp, Mus musculus
tgctacaagatggtaatcaagaacc

SEQ ID NO: 810520 - DNA, 25 bp, Mus musculus
tgctacaaggcaagggcatgggata

SEQ ID NO: 810521 - DNA, 25 bp, Mus musculus
tgctacaaggcatgggcatgggata

SEQ ID NO: 810522 - DNA, 25 bp, Mus musculus
tgctacaagtgtcgccgtggcttcg

SEQ ID NO: 810523 - DNA, 25 bp, Mus musculus
tgctacaagtgtggccgtggcttcg

SEQ ID NO: 810524 - DNA, 25 bp, Mus musculus
tgctacaatagaccaggcacgccac

SEQ ID NO: 810525 - DNA, 25 bp, Mus musculus
tgctacaatagagcaggcacgccac

SEQ ID NO: 810526 - DNA, 25 bp, Mus musculus
tgctacaatctacaagggggcttca

SEQ ID NO: 810527 - DNA, 25 bp, Mus musculus
tgctacaatctagaagggggcttca

SEQ ID NO: 810528 - DNA, 25 bp, Mus musculus
tgctacacaccaagccagaagtggc

SEQ ID NO: 810529 - DNA, 25 bp, Mus musculus
tgctacacaccatgccagaagtggc

SEQ ID NO: 810530 - DNA, 25 bp, Mus musculus
tgctacacctggacatcaagccgga

SEQ ID NO: 810531 - DNA, 25 bp, Mus musculus
tgctacacctggtcatcaagccgga

SEQ ID NO: 810532 - DNA, 25 bp, Mus musculus
tgctacacgagaagcggacatcatg

SEQ ID NO: 810533 - DNA, 25 bp, Mus musculus
tgctacacgagatgcggacatcatg

SEQ ID NO: 810534 - DNA, 25 bp, Mus musculus
tgctacactgtcagtgcagcttcag

SEQ ID NO: 810535 - DNA, 25 bp, Mus musculus
tgctacactgtctgtgcagcttcag

SEQ ID NO: 810536 - DNA, 25 bp, Mus musculus
tgctacagacttacagggtgggatg

SEQ ID NO: 810537 - DNA, 25 bp, Mus musculus
tgctacagactttcagggtgggatg

SEQ ID NO: 810538 - DNA, 25 bp, Mus musculus
tgctacagagatcgcaagaagatgg

SEQ ID NO: 810539 - DNA, 25 bp, Mus musculus
tgctacagagatggcaagaagatgg

SEQ ID NO: 810540 - DNA, 25 bp, Mus musculus
tgctacagcgaaaggagcacagcaa

SEQ ID NO: 810541 - DNA, 25 bp, Mus musculus
tgctacagcgaatggagcacagcaa

SEQ ID NO: 810542 - DNA, 25 bp, Mus musculus
tgctacagctgcacatggagcgggt

SEQ ID NO: 810543 - DNA, 25 bp, Mus musculus
tgctacagctgctcatggagcgggt

SEQ ID NO: 810544 - DNA, 25 bp, Mus musculus
tgctacagtgacctcatacctgaaa

SEQ ID NO: 810545 - DNA, 25 bp, Mus musculus
tgctacagtgacgtcatacctgaaa

SEQ ID NO: 810546 - DNA, 25 bp, Mus musculus
tgctacagtgcgaagaaagggacca

SEQ ID NO: 810547 - DNA, 25 bp, Mus musculus
tgctacagtgcgtagaaagggacca

SEQ ID NO: 810548 - DNA, 25 bp, Mus musculus
tgctacagtgtgaccagcgtcctgc

SEQ ID NO: 810549 - DNA, 25 bp, Mus musculus
tgctacagtgtgtccagcgtcctgc

SEQ ID NO: 810550 - DNA, 25 bp, Mus musculus
tgctacatcagtacccgtgaccact

SEQ ID NO: 810551 - DNA, 25 bp, Mus musculus
tgctacatcagttcccgtgaccact

SEQ ID NO: 810552 - DNA, 25 bp, Mus musculus
tgctacatcctgcaccaaagtggca

SEQ ID NO: 810553 - DNA, 25 bp, Mus musculus
tgctacatcctggaccaaagtggca

SEQ ID NO: 810554 - DNA, 25 bp, Mus musculus
tgctacatttgcaaatccagaggct

SEQ ID NO: 810555 - DNA, 25 bp, Mus musculus
tgctacatttgctaatccagaggct

SEQ ID NO: 810556 - DNA, 25 bp, Mus musculus
tgctaccaaaaacgatgttgatgtc

SEQ ID NO: 810557 - DNA, 25 bp, Mus musculus
tgctaccaaaaacggaatcaaggtt

SEQ ID NO: 810558 - DNA, 25 bp, Mus musculus
tgctaccaaaaaggatgttgatgtc

SEQ ID NO: 810559 - DNA, 25 bp, Mus musculus
tgctaccaaaaagggaatcaaggtt

SEQ ID NO: 810560 - DNA, 25 bp, Mus musculus
tgctaccaaaggaccccaaagagat

SEQ ID NO: 810561 - DNA, 25 bp, Mus musculus
tgctaccaaaggtccccaaagagat

SEQ ID NO: 810562 - DNA, 25 bp, Mus musculus
tgctaccacggcacaggtgaacagt

SEQ ID NO: 810563 - DNA, 25 bp, Mus musculus
tgctaccacggctcaggtgaacagt

SEQ ID NO: 810564 - DNA, 25 bp, Mus musculus
tgctaccactggagccatgaaccga

SEQ ID NO: 810565 - DNA, 25 bp, Mus musculus
tgctaccactggtgccatgaaccga

SEQ ID NO: 810566 - DNA, 25 bp, Mus musculus
tgctaccagtaccactacacgagta

SEQ ID NO: 810567 - DNA, 25 bp, Mus musculus
tgctaccagtacgactacacgagta

SEQ ID NO: 810568 - DNA, 25 bp, Mus musculus
tgctaccagtctagttccagagtgg

SEQ ID NO: 810569 - DNA, 25 bp, Mus musculus
tgctaccagtcttgttccagagtgg

SEQ ID NO: 810570 - DNA, 25 bp, Mus musculus
tgctaccattagaaggattgaccag

SEQ ID NO: 810571 - DNA, 25 bp, Mus musculus
tgctaccattagtaggattgaccag

SEQ ID NO: 810572 - DNA, 25 bp, Mus musculus
tgctacccctttatgtcggacacaa

SEQ ID NO: 810573 - DNA, 25 bp, Mus musculus
tgctacccctttttgtcggacacaa

SEQ ID NO: 810574 - DNA, 25 bp, Mus musculus
tgctacccggtcacaggaacctttg

SEQ ID NO: 810575 - DNA, 25 bp, Mus musculus
tgctacccggtctcaggaacctttg

SEQ ID NO: 810576 - DNA, 25 bp, Mus musculus
tgctacccgtgcattcgggcctcgg

SEQ ID NO: 810577 - DNA, 25 bp, Mus musculus
tgctacccgtgctttcgggcctcgg

SEQ ID NO: 810578 - DNA, 25 bp, Mus musculus
tgctaccctaagagcacactgcacg

SEQ ID NO: 810579 - DNA, 25 bp, Mus musculus
tgctaccctaagtgcacactgcacg

SEQ ID NO: 810580 - DNA, 25 bp, Mus musculus
tgctaccctcggaggccctgtgact

SEQ ID NO: 810581 - DNA, 25 bp, Mus musculus
tgctaccctcggtggccctgtgact

SEQ ID NO: 810582 - DNA, 25 bp, Mus musculus
tgctaccctggccattacaacattg

SEQ ID NO: 810583 - DNA, 25 bp, Mus musculus
tgctaccctggcgattacaacattg

SEQ ID NO: 810584 - DNA, 25 bp, Mus musculus
tgctaccgtaagacagaggacttct

SEQ ID NO: 810585 - DNA, 25 bp, Mus musculus
tgctaccgtaagtcagaggacttct

SEQ ID NO: 810586 - DNA, 25 bp, Mus musculus
tgctacctagagcagacactccact

SEQ ID NO: 810587 - DNA, 25 bp, Mus musculus
tgctacctagaggagacactccact

SEQ ID NO: 810588 - DNA, 25 bp, Mus musculus
tgctacctctccacagaaaacttca

SEQ ID NO: 810589 - DNA, 25 bp, Mus musculus
tgctacctctcctcagaaaacttca

SEQ ID NO: 810590 - DNA, 25 bp, Mus musculus
tgctacctgaaaatcgagagaagat

SEQ ID NO: 810591 - DNA, 25 bp, Mus musculus
tgctacctgaaattcgagagaagat

SEQ ID NO: 810592 - DNA, 25 bp, Mus musculus
tgctacctgtgtaatgatgactcaa

SEQ ID NO: 810593 - DNA, 25 bp, Mus musculus
tgctacctgtgttatgatgactcaa

SEQ ID NO: 810594 - DNA, 25 bp, Mus musculus
tgctaccttaacatcgatgacacag

SEQ ID NO: 810595 - DNA, 25 bp, Mus musculus
tgctaccttaacttcgatgacacag

SEQ ID NO: 810596 - DNA, 25 bp, Mus musculus
tgctacgagtgcaatggagtgccaa

SEQ ID NO: 810597 - DNA, 25 bp, Mus musculus
tgctacgagtgctatggagtgccaa

SEQ ID NO: 810598 - DNA, 25 bp, Mus musculus
tgctacgcccatctctatgtcacag

SEQ ID NO: 810599 - DNA, 25 bp, Mus musculus
tgctacgcccatgtctatgtcacag

SEQ ID NO: 810600 - DNA, 25 bp, Mus musculus
tgctacgctgtccacactggatcct

SEQ ID NO: 810601 - DNA, 25 bp, Mus musculus
tgctacgctgtcgacactggatcct

SEQ ID NO: 810602 - DNA, 25 bp, Mus musculus
tgctacggagcccaaggccattggc

SEQ ID NO: 810603 - DNA, 25 bp, Mus musculus
tgctacggagccgaaggccattggc

SEQ ID NO: 810604 - DNA, 25 bp, Mus musculus
tgctacgtagagaccagagagatgg

SEQ ID NO: 810605 - DNA, 25 bp, Mus musculus
tgctacgtagagtccagagagatgg

SEQ ID NO: 810606 - DNA, 25 bp, Mus musculus
tgctactacaaaacctacagaatgg

SEQ ID NO: 810607 - DNA, 25 bp, Mus musculus
tgctactacaaatcctacagaatgg

SEQ ID NO: 810608 - DNA, 25 bp, Mus musculus
tgctactaggaccttggtttcggtc

SEQ ID NO: 810609 - DNA, 25 bp, Mus musculus
tgctactaggacgttggtttcggtc

SEQ ID NO: 810610 - DNA, 25 bp, Mus musculus
tgctactcagcaagctctggatgga

SEQ ID NO: 810611 - DNA, 25 bp, Mus musculus
tgctactcagcatgctctggatgga

SEQ ID NO: 810612 - DNA, 25 bp, Mus musculus
tgctactccaaacacatcgtggaga

SEQ ID NO: 810613 - DNA, 25 bp, Mus musculus
tgctactccaaagacatcgtggaga

SEQ ID NO: 810614 - DNA, 25 bp, Mus musculus
tgctactccaccaaaggccaaaatc

SEQ ID NO: 810615 - DNA, 25 bp, Mus musculus
tgctactccaccagggacacatgga

SEQ ID NO: 810616 - DNA, 25 bp, Mus musculus
tgctactccacctaaggccaaaatc

SEQ ID NO: 810617 - DNA, 25 bp, Mus musculus
tgctactccacctgggacacatgga

SEQ ID NO: 810618 - DNA, 25 bp, Mus musculus
tgctactccccacaaagaaggaatc

SEQ ID NO: 810619 - DNA, 25 bp, Mus musculus
tgctactccccagaaagaaggaatc

SEQ ID NO: 810620 - DNA, 25 bp, Mus musculus
tgctactcggctacaaaacagaagg

SEQ ID NO: 810621 - DNA, 25 bp, Mus musculus
tgctactcggcttcaaaacagaagg

SEQ ID NO: 810622 - DNA, 25 bp, Mus musculus
tgctactctgccagttcatggagga

SEQ ID NO: 810623 - DNA, 25 bp, Mus musculus
tgctactctgcctgttcatggagga

SEQ ID NO: 810624 - DNA, 25 bp, Mus musculus
tgctactgagtgagagcagctctcc

SEQ ID NO: 810625 - DNA, 25 bp, Mus musculus
tgctactgagtgtgagcagctctcc

SEQ ID NO: 810626 - DNA, 25 bp, Mus musculus
tgctactgcacaccaaccgcaaggg

SEQ ID NO: 810627 - DNA, 25 bp, Mus musculus
tgctactgcacagcaaccgcaaggg

SEQ ID NO: 810628 - DNA, 25 bp, Mus musculus
tgctactgcctccatcaagtcaaga

SEQ ID NO: 810629 - DNA, 25 bp, Mus musculus
tgctactgcctcgatcaagtcaaga

SEQ ID NO: 810630 - DNA, 25 bp, Mus musculus
tgctactgggtgctgctttagcacc

SEQ ID NO: 810631 - DNA, 25 bp, Mus musculus
tgctactgggtggtgctttagcacc

SEQ ID NO: 810632 - DNA, 25 bp, Mus musculus
tgctactgtctccatctgtaagaag

SEQ ID NO: 810633 - DNA, 25 bp, Mus musculus
tgctactgtctcgatctgtaagaag

SEQ ID NO: 810634 - DNA, 25 bp, Mus musculus
tgctacttcaatacaccttatgggt

SEQ ID NO: 810635 - DNA, 25 bp, Mus musculus
tgctacttcaattcaccttatgggt

SEQ ID NO: 810636 - DNA, 25 bp, Mus musculus
tgctacttcgctccttgcagaaccg

SEQ ID NO: 810637 - DNA, 25 bp, Mus musculus
tgctacttcgctgcttgcagaaccg

SEQ ID NO: 810638 - DNA, 25 bp, Mus musculus
tgctagaaaatgaactgatgtatgg

SEQ ID NO: 810639 - DNA, 25 bp, Mus musculus
tgctagaaaatgtactgatgtatgg

SEQ ID NO: 810640 - DNA, 25 bp, Mus musculus
tgctagaactgtaatccctgccaat

SEQ ID NO: 810641 - DNA, 25 bp, Mus musculus
tgctagaactgttatccctgccaat

SEQ ID NO: 810642 - DNA, 25 bp, Mus musculus
tgctagaacttgagctggtcccagc

SEQ ID NO: 810643 - DNA, 25 bp, Mus musculus
tgctagaacttgtgctggtcccagc

SEQ ID NO: 810644 - DNA, 25 bp, Mus musculus
tgctagaagaatatagaaggcatag

SEQ ID NO: 810645 - DNA, 25 bp, Mus musculus
tgctagaagaatttagaaggcatag

SEQ ID NO: 810646 - DNA, 25 bp, Mus musculus
tgctagaataccagaagattgccca

SEQ ID NO: 810647 - DNA, 25 bp, Mus musculus
tgctagaatacctgaagattgccca

SEQ ID NO: 810648 - DNA, 25 bp, Mus musculus
tgctagaatcagaaaggactcatca

SEQ ID NO: 810649 - DNA, 25 bp, Mus musculus
tgctagaatcagtaaggactcatca

SEQ ID NO: 810650 - DNA, 25 bp, Mus musculus
tgctagaatcgcagtctcagctgga

SEQ ID NO: 810651 - DNA, 25 bp, Mus musculus
tgctagaatcgctgtctcagctgga

SEQ ID NO: 810652 - DNA, 25 bp, Mus musculus
tgctagaccagtccttagaactgca

SEQ ID NO: 810653 - DNA, 25 bp, Mus musculus
tgctagaccagtgcttagaactgca

SEQ ID NO: 810654 - DNA, 25 bp, Mus musculus
tgctagacctggagcctaaacctgg

SEQ ID NO: 810655 - DNA, 25 bp, Mus musculus
tgctagacctggtgcctaaacctgg

SEQ ID NO: 810656 - DNA, 25 bp, Mus musculus
tgctagagactgagcgcatccgacg

SEQ ID NO: 810657 - DNA, 25 bp, Mus musculus
tgctagagactgtgcgcatccgacg

SEQ ID NO: 810658 - DNA, 25 bp, Mus musculus
tgctagagcaagaagtgcatcgttt

SEQ ID NO: 810659 - DNA, 25 bp, Mus musculus
tgctagagcaagtagtgcatcgttt

SEQ ID NO: 810660 - DNA, 25 bp, Mus musculus
tgctagagcacaaggagattgacgg

SEQ ID NO: 810661 - DNA, 25 bp, Mus musculus
tgctagagcacatggagattgacgg

SEQ ID NO: 810662 - DNA, 25 bp, Mus musculus
tgctagagccttcaagatcatccgt

SEQ ID NO: 810663 - DNA, 25 bp, Mus musculus
tgctagagccttgaagatcatccgt

SEQ ID NO: 810664 - DNA, 25 bp, Mus musculus
tgctagagcgccagctcgcctacaa

SEQ ID NO: 810665 - DNA, 25 bp, Mus musculus
tgctagagcgcctgctcgcctacaa

SEQ ID NO: 810666 - DNA, 25 bp, Mus musculus
tgctagagcttgctcggattgcagc

SEQ ID NO: 810667 - DNA, 25 bp, Mus musculus
tgctagagcttggtcggattgcagc

SEQ ID NO: 810668 - DNA, 25 bp, Mus musculus
tgctagaggctcctggagtttatgt

SEQ ID NO: 810669 - DNA, 25 bp, Mus musculus
tgctagaggctcgtggagtttatgt

SEQ ID NO: 810670 - DNA, 25 bp, Mus musculus
tgctagagggcacctacttagacaa

SEQ ID NO: 810671 - DNA, 25 bp, Mus musculus
tgctagagggcagctacttagacaa

SEQ ID NO: 810672 - DNA, 25 bp, Mus musculus
tgctagagtaagcatccacaaggcc

SEQ ID NO: 810673 - DNA, 25 bp, Mus musculus
tgctagagtaaggatccacaaggcc

SEQ ID NO: 810674 - DNA, 25 bp, Mus musculus
tgctagagtcccacggagcggcgct

SEQ ID NO: 810675 - DNA, 25 bp, Mus musculus
tgctagagtccctcggagcggcgct

SEQ ID NO: 810676 - DNA, 25 bp, Mus musculus
tgctagatgcctcgagccagagtta

SEQ ID NO: 810677 - DNA, 25 bp, Mus musculus
tgctagatgcctggagccagagtta

SEQ ID NO: 810678 - DNA, 25 bp, Mus musculus
tgctagatgtcaagtatgagtcccc

SEQ ID NO: 810679 - DNA, 25 bp, Mus musculus
tgctagatgtcatgtatgagtcccc

SEQ ID NO: 810680 - DNA, 25 bp, Mus musculus
tgctagatgtccaggcggatttgga

SEQ ID NO: 810681 - DNA, 25 bp, Mus musculus
tgctagatgtcctggcggatttgga

SEQ ID NO: 810682 - DNA, 25 bp, Mus musculus
tgctagcaacttacactatcatgag

SEQ ID NO: 810683 - DNA, 25 bp, Mus musculus
tgctagcaactttcactatcatgag

SEQ ID NO: 810684 - DNA, 25 bp, Mus musculus
tgctagcactcaccctcgtgggact

SEQ ID NO: 810685 - DNA, 25 bp, Mus musculus
tgctagcactcagcctcgtgggact

SEQ ID NO: 810686 - DNA, 25 bp, Mus musculus
tgctagcagaggatccttgggatgc

SEQ ID NO: 810687 - DNA, 25 bp, Mus musculus
tgctagcagaggttccttgggatgc

SEQ ID NO: 810688 - DNA, 25 bp, Mus musculus
tgctagccaactacgggagacgttt

SEQ ID NO: 810689 - DNA, 25 bp, Mus musculus
tgctagccaacttcgggagacgttt

SEQ ID NO: 810690 - DNA, 25 bp, Mus musculus
tgctagccattgagcttctcgcggc

SEQ ID NO: 810691 - DNA, 25 bp, Mus musculus
tgctagccattgtgcttctcgcggc

SEQ ID NO: 810692 - DNA, 25 bp, Mus musculus
tgctagcctgacctgccgaggtgct

SEQ ID NO: 810693 - DNA, 25 bp, Mus musculus
tgctagcctgacgtgccgaggtgct

SEQ ID NO: 810694 - DNA, 25 bp, Mus musculus
tgctagcgtaagatgtcgctttgaa

SEQ ID NO: 810695 - DNA, 25 bp, Mus musculus
tgctagcgtaagttgtcgctttgaa

SEQ ID NO: 810696 - DNA, 25 bp, Mus musculus
tgctagctacttaggaggtgtgtcg

SEQ ID NO: 810697 - DNA, 25 bp, Mus musculus
tgctagctactttggaggtgtgtcg

SEQ ID NO: 810698 - DNA, 25 bp, Mus musculus
tgctagctgaccagatgaggctcaa

SEQ ID NO: 810699 - DNA, 25 bp, Mus musculus
tgctagctgacctgatgaggctcaa

SEQ ID NO: 810700 - DNA, 25 bp, Mus musculus
tgctagctggacatacgtcaggtgg

SEQ ID NO: 810701 - DNA, 25 bp, Mus musculus
tgctagctggacttacgtcaggtgg

SEQ ID NO: 810702 - DNA, 25 bp, Mus musculus
tgctagcttgcacaaaccctcttgg

SEQ ID NO: 810703 - DNA, 25 bp, Mus musculus
tgctagcttgcagaaaccctcttgg

SEQ ID NO: 810704 - DNA, 25 bp, Mus musculus
tgctagctttttcgacgctcagggt

SEQ ID NO: 810705 - DNA, 25 bp, Mus musculus
tgctagctttttggacgctcagggt

SEQ ID NO: 810706 - DNA, 25 bp, Mus musculus
tgctaggaaactacgagacgatggg

SEQ ID NO: 810707 - DNA, 25 bp, Mus musculus
tgctaggaaacttcgagacgatggg

SEQ ID NO: 810708 - DNA, 25 bp, Mus musculus
tgctaggacagcagcaggcatccat

SEQ ID NO: 810709 - DNA, 25 bp, Mus musculus
tgctaggacagctgcaggcatccat

SEQ ID NO: 810710 - DNA, 25 bp, Mus musculus
tgctaggaccagagtccccaattca

SEQ ID NO: 810711 - DNA, 25 bp, Mus musculus
tgctaggaccagtgtccccaattca

SEQ ID NO: 810712 - DNA, 25 bp, Mus musculus
tgctaggaggagatggacctgacca

SEQ ID NO: 810713 - DNA, 25 bp, Mus musculus
tgctaggaggagttggacctgacca

SEQ ID NO: 810714 - DNA, 25 bp, Mus musculus
tgctaggattgaaccagaacctcgt

SEQ ID NO: 810715 - DNA, 25 bp, Mus musculus
tgctaggattgatccagaacctcgt

SEQ ID NO: 810716 - DNA, 25 bp, Mus musculus
tgctaggcctgcaccgagtctgctt

SEQ ID NO: 810717 - DNA, 25 bp, Mus musculus
tgctaggcctgctccgagtctgctt

SEQ ID NO: 810718 - DNA, 25 bp, Mus musculus
tgctagggactgactaaactcttgt

SEQ ID NO: 810719 - DNA, 25 bp, Mus musculus
tgctagggactgtctaaactcttgt

SEQ ID NO: 810720 - DNA, 25 bp, Mus musculus
tgctagggctggacatgctcagcgt

SEQ ID NO: 810721 - DNA, 25 bp, Mus musculus
tgctagggctggtcatgctcagcgt

SEQ ID NO: 810722 - DNA, 25 bp, Mus musculus
tgctagggttccagggcctcgtcca

SEQ ID NO: 810723 - DNA, 25 bp, Mus musculus
tgctagggttcctgggcctcgtcca

SEQ ID NO: 810724 - DNA, 25 bp, Mus musculus
tgctaggtctggagttcctggtcca

SEQ ID NO: 810725 - DNA, 25 bp, Mus musculus
tgctaggtctggtgttcctggtcca

SEQ ID NO: 810726 - DNA, 25 bp, Mus musculus
tgctaggtgtctctgccaatggcct

SEQ ID NO: 810727 - DNA, 25 bp, Mus musculus
tgctaggtgtctgtgccaatggcct

SEQ ID NO: 810728 - DNA, 25 bp, Mus musculus
tgctagtcaagcatttctggacccc

SEQ ID NO: 810729 - DNA, 25 bp, Mus musculus
tgctagtcaagcttttctggacccc

SEQ ID NO: 810730 - DNA, 25 bp, Mus musculus
tgctagtcctcacggacttgaccaa

SEQ ID NO: 810731 - DNA, 25 bp, Mus musculus
tgctagtcctcagggacttgaccaa

SEQ ID NO: 810732 - DNA, 25 bp, Mus musculus
tgctagtcgtatacctggagtgaca

SEQ ID NO: 810733 - DNA, 25 bp, Mus musculus
tgctagtcgtattcctggagtgaca

SEQ ID NO: 810734 - DNA, 25 bp, Mus musculus
tgctagtctcaactcccgggagtat

SEQ ID NO: 810735 - DNA, 25 bp, Mus musculus
tgctagtctcaagtcccgggagtat

SEQ ID NO: 810736 - DNA, 25 bp, Mus musculus
tgctagtctgtccacctgctgcagg

SEQ ID NO: 810737 - DNA, 25 bp, Mus musculus
tgctagtctgtcgacctgctgcagg

SEQ ID NO: 810738 - DNA, 25 bp, Mus musculus
tgctagtgaatacccacctggtgtg

SEQ ID NO: 810739 - DNA, 25 bp, Mus musculus
tgctagtgaatagccacctggtgtg

SEQ ID NO: 810740 - DNA, 25 bp, Mus musculus
tgctagtgattcaagttcatccaca

SEQ ID NO: 810741 - DNA, 25 bp, Mus musculus
tgctagtgattctagttcatccaca

SEQ ID NO: 810742 - DNA, 25 bp, Mus musculus
tgctagtgctgccagagtacctctg

SEQ ID NO: 810743 - DNA, 25 bp, Mus musculus
tgctagtgctgcgagagtacctctg

SEQ ID NO: 810744 - DNA, 25 bp, Mus musculus
tgctagtgtctgatttgagggcctc

SEQ ID NO: 810745 - DNA, 25 bp, Mus musculus
tgctagtgtctgttttgagggcctc

SEQ ID NO: 810746 - DNA, 25 bp, Mus musculus
tgctagtgtgttacttgacacccca

SEQ ID NO: 810747 - DNA, 25 bp, Mus musculus
tgctagtgtgtttcttgacacccca

SEQ ID NO: 810748 - DNA, 25 bp, Mus musculus
tgctataaaggtctcagtgcccctc

SEQ ID NO: 810749 - DNA, 25 bp, Mus musculus
tgctataaaggtgtcagtgcccctc

SEQ ID NO: 810750 - DNA, 25 bp, Mus musculus
tgctataatgaaacaggagataggc

SEQ ID NO: 810751 - DNA, 25 bp, Mus musculus
tgctataatgaatcaggagataggc

SEQ ID NO: 810752 - DNA, 25 bp, Mus musculus
tgctataccacacgccaggcgtttg

SEQ ID NO: 810753 - DNA, 25 bp, Mus musculus
tgctataccacaggccaggcgtttg

SEQ ID NO: 810754 - DNA, 25 bp, Mus musculus
tgctatagagacagtagcccttggg

SEQ ID NO: 810755 - DNA, 25 bp, Mus musculus
tgctatagagactgtagcccttggg

SEQ ID NO: 810756 - DNA, 25 bp, Mus musculus
tgctatatctcacggagaagccaga

SEQ ID NO: 810757 - DNA, 25 bp, Mus musculus
tgctatatctcagggagaagccaga

SEQ ID NO: 810758 - DNA, 25 bp, Mus musculus
tgctatcaacttagacccagaaaat

SEQ ID NO: 810759 - DNA, 25 bp, Mus musculus
tgctatcaactttgacccagaaaat

SEQ ID NO: 810760 - DNA, 25 bp, Mus musculus
tgctatcaggcaagggtgtctcggc

SEQ ID NO: 810761 - DNA, 25 bp, Mus musculus
tgctatcaggcatgggtgtctcggc

SEQ ID NO: 810762 - DNA, 25 bp, Mus musculus
tgctatcagggaacttgcccaggag

SEQ ID NO: 810763 - DNA, 25 bp, Mus musculus
tgctatcagggatcttgcccaggag

SEQ ID NO: 810764 - DNA, 25 bp, Mus musculus
tgctatcatctaataaaataactca

SEQ ID NO: 810765 - DNA, 25 bp, Mus musculus
tgctatcatctattaaaataactca

SEQ ID NO: 810766 - DNA, 25 bp, Mus musculus
tgctatcatttgagacctaatagaa

SEQ ID NO: 810767 - DNA, 25 bp, Mus musculus
tgctatcatttgtgacctaatagaa

SEQ ID NO: 810768 - DNA, 25 bp, Mus musculus
tgctatccccgacaaccacaagttt

SEQ ID NO: 810769 - DNA, 25 bp, Mus musculus
tgctatccccgagaaccacaagttt

SEQ ID NO: 810770 - DNA, 25 bp, Mus musculus
tgctatcctattcctccatcctgtg

SEQ ID NO: 810771 - DNA, 25 bp, Mus musculus
tgctatcctattgctccatcctgtg

SEQ ID NO: 810772 - DNA, 25 bp, Mus musculus
tgctatcctggcaacacactagtca

SEQ ID NO: 810773 - DNA, 25 bp, Mus musculus
tgctatcctggcaaccggctcaagg

SEQ ID NO: 810774 - DNA, 25 bp, Mus musculus
tgctatcctggctacacactagtca

SEQ ID NO: 810775 - DNA, 25 bp, Mus musculus
tgctatcctggctaccggctcaagg

SEQ ID NO: 810776 - DNA, 25 bp, Mus musculus
tgctatctatatccgccgtaggccc

SEQ ID NO: 810777 - DNA, 25 bp, Mus musculus
tgctatctatatgcgccgtaggccc

SEQ ID NO: 810778 - DNA, 25 bp, Mus musculus
tgctatctcgtgcagcctcatgtac

SEQ ID NO: 810779 - DNA, 25 bp, Mus musculus
tgctatctcgtggagcctcatgtac

SEQ ID NO: 810780 - DNA, 25 bp, Mus musculus
tgctatctgcatcagagccatgtgc

SEQ ID NO: 810781 - DNA, 25 bp, Mus musculus
tgctatctgcatgagagccatgtgc

SEQ ID NO: 810782 - DNA, 25 bp, Mus musculus
tgctatctgtctcgaggagtatgaa

SEQ ID NO: 810783 - DNA, 25 bp, Mus musculus
tgctatctgtctggaggagtatgaa

SEQ ID NO: 810784 - DNA, 25 bp, Mus musculus
tgctatgaatcaaggccacagaaag

SEQ ID NO: 810785 - DNA, 25 bp, Mus musculus
tgctatgaatcatggccacagaaag

SEQ ID NO: 810786 - DNA, 25 bp, Mus musculus
tgctatgacaatctggcttctgcag

SEQ ID NO: 810787 - DNA, 25 bp, Mus musculus
tgctatgacaatgtggcttctgcag

SEQ ID NO: 810788 - DNA, 25 bp, Mus musculus
tgctatgagaaccagctggccttcc

SEQ ID NO: 810789 - DNA, 25 bp, Mus musculus
tgctatgagaacgagctggccttcc

SEQ ID NO: 810790 - DNA, 25 bp, Mus musculus
tgctatgatgagattggtttccgtg

SEQ ID NO: 810791 - DNA, 25 bp, Mus musculus
tgctatgatgagtttggtttccgtg

SEQ ID NO: 810792 - DNA, 25 bp, Mus musculus
tgctatgcagtacagacctgggacc

SEQ ID NO: 810793 - DNA, 25 bp, Mus musculus
tgctatgcagtagagacctgggacc

SEQ ID NO: 810794 - DNA, 25 bp, Mus musculus
tgctatgccaccaggcgcttcggct

SEQ ID NO: 810795 - DNA, 25 bp, Mus musculus
tgctatgccacctggcgcttcggct

SEQ ID NO: 810796 - DNA, 25 bp, Mus musculus
tgctatgcctgtacgttcgggagac

SEQ ID NO: 810797 - DNA, 25 bp, Mus musculus
tgctatgcctgttcgttcgggagac

SEQ ID NO: 810798 - DNA, 25 bp, Mus musculus
tgctatgcttgtagaaggatctcag

SEQ ID NO: 810799 - DNA, 25 bp, Mus musculus
tgctatgcttgttgaaggatctcag

SEQ ID NO: 810800 - DNA, 25 bp, Mus musculus
tgctatggacaacgcacgggaccta

SEQ ID NO: 810801 - DNA, 25 bp, Mus musculus
tgctatggacaaggcacgggaccta

SEQ ID NO: 810802 - DNA, 25 bp, Mus musculus
tgctatggagagacaccagaagctc

SEQ ID NO: 810803 - DNA, 25 bp, Mus musculus
tgctatggagagtcaccagaagctc

SEQ ID NO: 810804 - DNA, 25 bp, Mus musculus
tgctatggatctcggtgtgaactac

SEQ ID NO: 810805 - DNA, 25 bp, Mus musculus
tgctatggatctgggtgtgaactac

SEQ ID NO: 810806 - DNA, 25 bp, Mus musculus
tgctatggcagccagcacagcttct

SEQ ID NO: 810807 - DNA, 25 bp, Mus musculus
tgctatggcagcgagcacagcttct

SEQ ID NO: 810808 - DNA, 25 bp, Mus musculus
tgctatggcgcaaagggcccttctg

SEQ ID NO: 810809 - DNA, 25 bp, Mus musculus
tgctatggcgcatagggcccttctg

SEQ ID NO: 810810 - DNA, 25 bp, Mus musculus
tgctatgggtccacacgcatgggtg

SEQ ID NO: 810811 - DNA, 25 bp, Mus musculus
tgctatgggtcctcacgcatgggtg

SEQ ID NO: 810812 - DNA, 25 bp, Mus musculus
tgctatggtgctcagttccccggta

SEQ ID NO: 810813 - DNA, 25 bp, Mus musculus
tgctatggtgctgagttccccggta

SEQ ID NO: 810814 - DNA, 25 bp, Mus musculus
tgctatggtggcaccagatgtccaa

SEQ ID NO: 810815 - DNA, 25 bp, Mus musculus
tgctatggtggctccagatgtccaa

SEQ ID NO: 810816 - DNA, 25 bp, Mus musculus
tgctatggtttcaatggtcaccaag

SEQ ID NO: 810817 - DNA, 25 bp, Mus musculus
tgctatggtttctatggtcaccaag

SEQ ID NO: 810818 - DNA, 25 bp, Mus musculus
tgctatgtactgactgaagctcgga

SEQ ID NO: 810819 - DNA, 25 bp, Mus musculus
tgctatgtactgtctgaagctcgga

SEQ ID NO: 810820 - DNA, 25 bp, Mus musculus
tgctatgtattccaggcaggagcct

SEQ ID NO: 810821 - DNA, 25 bp, Mus musculus
tgctatgtattcgaggcaggagcct

SEQ ID NO: 810822 - DNA, 25 bp, Mus musculus
tgctatgtttgaagcctgaggtggc

SEQ ID NO: 810823 - DNA, 25 bp, Mus musculus
tgctatgtttgatgcctgaggtggc

SEQ ID NO: 810824 - DNA, 25 bp, Mus musculus
tgctattacacaacaatgaccagga

SEQ ID NO: 810825 - DNA, 25 bp, Mus musculus
tgctattacacatcaatgaccagga

SEQ ID NO: 810826 - DNA, 25 bp, Mus musculus
tgctattatatcaagaacctacaca

SEQ ID NO: 810827 - DNA, 25 bp, Mus musculus
tgctattatatctagaacctacaca

SEQ ID NO: 810828 - DNA, 25 bp, Mus musculus
tgctattccagtcagcaggtcaccg

SEQ ID NO: 810829 - DNA, 25 bp, Mus musculus
tgctattccagtgagcaggtcaccg

SEQ ID NO: 810830 - DNA, 25 bp, Mus musculus
tgctattgactaagtgcagagacag

SEQ ID NO: 810831 - DNA, 25 bp, Mus musculus
tgctattgactatgtgcagagacag

SEQ ID NO: 810832 - DNA, 25 bp, Mus musculus
tgctattgatagcagaggcggacaa

SEQ ID NO: 810833 - DNA, 25 bp, Mus musculus
tgctattgataggagaggcggacaa

SEQ ID NO: 810834 - DNA, 25 bp, Mus musculus
tgctatttcaacaccccaagatcct

SEQ ID NO: 810835 - DNA, 25 bp, Mus musculus
tgctatttcaactccccaagatcct

SEQ ID NO: 810836 - DNA, 25 bp, Mus musculus
tgctatttcttcacaggcgcggtcc

SEQ ID NO: 810837 - DNA, 25 bp, Mus musculus
tgctatttcttctcaggcgcggtcc

SEQ ID NO: 810838 - DNA, 25 bp, Mus musculus
tgctattttcctcgctgcatccaga

SEQ ID NO: 810839 - DNA, 25 bp, Mus musculus
tgctattttcctggctgcatccaga

SEQ ID NO: 810840 - DNA, 25 bp, Mus musculus
tgctcaaaccctatggacaagttat

SEQ ID NO: 810841 - DNA, 25 bp, Mus musculus
tgctcaaaccctttggacaagttat

SEQ ID NO: 810842 - DNA, 25 bp, Mus musculus
tgctcaaactacaggaggcctgtcc

SEQ ID NO: 810843 - DNA, 25 bp, Mus musculus
tgctcaaactactggaggcctgtcc

SEQ ID NO: 810844 - DNA, 25 bp, Mus musculus
tgctcaaagggactagcttgcatct

SEQ ID NO: 810845 - DNA, 25 bp, Mus musculus
tgctcaaagggagtagcttgcatct

SEQ ID NO: 810846 - DNA, 25 bp, Mus musculus
tgctcaaatacccagatgctgtggg

SEQ ID NO: 810847 - DNA, 25 bp, Mus musculus
tgctcaaataccgagatgctgtggg

SEQ ID NO: 810848 - DNA, 25 bp, Mus musculus
tgctcaaatgttcggctttccagtg

SEQ ID NO: 810849 - DNA, 25 bp, Mus musculus
tgctcaaatgttgggctttccagtg

SEQ ID NO: 810850 - DNA, 25 bp, Mus musculus
tgctcaacactacagactacagaat

SEQ ID NO: 810851 - DNA, 25 bp, Mus musculus
tgctcaacactagagactacagaat

SEQ ID NO: 810852 - DNA, 25 bp, Mus musculus
tgctcaacaggcaccttggattata

SEQ ID NO: 810853 - DNA, 25 bp, Mus musculus
tgctcaacaggctccttggattata

SEQ ID NO: 810854 - DNA, 25 bp, Mus musculus
tgctcaaccagcagcgctactcggg

SEQ ID NO: 810855 - DNA, 25 bp, Mus musculus
tgctcaaccagctgcgctactcggg

SEQ ID NO: 810856 - DNA, 25 bp, Mus musculus
tgctcaacctcgagccgctagatga

SEQ ID NO: 810857 - DNA, 25 bp, Mus musculus
tgctcaacctcgtgccgctagatga

SEQ ID NO: 810858 - DNA, 25 bp, Mus musculus
tgctcaacggctaccagtgcctctg

SEQ ID NO: 810859 - DNA, 25 bp, Mus musculus
tgctcaacggcttccagtgcctctg

SEQ ID NO: 810860 - DNA, 25 bp, Mus musculus
tgctcaacgtggagcacctgagcgc

SEQ ID NO: 810861 - DNA, 25 bp, Mus musculus
tgctcaacgtggtgcacctgagcgc

SEQ ID NO: 810862 - DNA, 25 bp, Mus musculus
tgctcaactcctcgatcagatttgg

SEQ ID NO: 810863 - DNA, 25 bp, Mus musculus
tgctcaactcctggatcagatttgg

SEQ ID NO: 810864 - DNA, 25 bp, Mus musculus
tgctcaactgccagcagggcctatt

SEQ ID NO: 810865 - DNA, 25 bp, Mus musculus
tgctcaactgcctgcagggcctatt

SEQ ID NO: 810866 - DNA, 25 bp, Mus musculus
tgctcaacttcacaacctcacaaaa

SEQ ID NO: 810867 - DNA, 25 bp, Mus musculus
tgctcaacttcagaacctcacaaaa

SEQ ID NO: 810868 - DNA, 25 bp, Mus musculus
tgctcaagaaccaggtgctcactgg

SEQ ID NO: 810869 - DNA, 25 bp, Mus musculus
tgctcaagaacctggtgctcactgg

SEQ ID NO: 810870 - DNA, 25 bp, Mus musculus
tgctcaagaaggaccctacacagag

SEQ ID NO: 810871 - DNA, 25 bp, Mus musculus
tgctcaagaaggtccctacacagag

SEQ ID NO: 810872 - DNA, 25 bp, Mus musculus
tgctcaagatgactgtgggcctgcc

SEQ ID NO: 810873 - DNA, 25 bp, Mus musculus
tgctcaagatgagtgtgggcctgcc

SEQ ID NO: 810874 - DNA, 25 bp, Mus musculus
tgctcaagcgacagaagaaacggcg

SEQ ID NO: 810875 - DNA, 25 bp, Mus musculus
tgctcaagcgactgaagaaacggcg

SEQ ID NO: 810876 - DNA, 25 bp, Mus musculus
tgctcaagcgcaagggcatggcatg

SEQ ID NO: 810877 - DNA, 25 bp, Mus musculus
tgctcaagcgcatgggcatggcatg

SEQ ID NO: 810878 - DNA, 25 bp, Mus musculus
tgctcaagctccagcattgctgcat

SEQ ID NO: 810879 - DNA, 25 bp, Mus musculus
tgctcaagctcctgcattgctgcat

SEQ ID NO: 810880 - DNA, 25 bp, Mus musculus
tgctcaaggaatatgtgcagaagct

SEQ ID NO: 810881 - DNA, 25 bp, Mus musculus
tgctcaaggaatttgtgcagaagct

SEQ ID NO: 810882 - DNA, 25 bp, Mus musculus
tgctcaagtccacaaggcgagtggt

SEQ ID NO: 810883 - DNA, 25 bp, Mus musculus
tgctcaagtccagaaggcgagtggt

SEQ ID NO: 810884 - DNA, 25 bp, Mus musculus
tgctcaagttcccaaatatgcgagg

SEQ ID NO: 810885 - DNA, 25 bp, Mus musculus
tgctcaagttccgaaatatgcgagg

SEQ ID NO: 810886 - DNA, 25 bp, Mus musculus
tgctcaagttgacgatctaagccgc

SEQ ID NO: 810887 - DNA, 25 bp, Mus musculus
tgctcaagttgaggatctaagccgc

SEQ ID NO: 810888 - DNA, 25 bp, Mus musculus
tgctcaatctcaccaccggctaggg

SEQ ID NO: 810889 - DNA, 25 bp, Mus musculus
tgctcaatctcagcaccggctaggg

SEQ ID NO: 810890 - DNA, 25 bp, Mus musculus
tgctcaatgaatcgcactggcttct

SEQ ID NO: 810891 - DNA, 25 bp, Mus musculus
tgctcaatgaatggcactggcttct

SEQ ID NO: 810892 - DNA, 25 bp, Mus musculus
tgctcaatgatcatctgcgtttcga

SEQ ID NO: 810893 - DNA, 25 bp, Mus musculus
tgctcaatgatcttctgcgtttcga

SEQ ID NO: 810894 - DNA, 25 bp, Mus musculus
tgctcaatgctgaacatggaaacag

SEQ ID NO: 810895 - DNA, 25 bp, Mus musculus
tgctcaatgctgtacatggaaacag

SEQ ID NO: 810896 - DNA, 25 bp, Mus musculus
tgctcaatggagaccctaaggaggg

SEQ ID NO: 810897 - DNA, 25 bp, Mus musculus
tgctcaatggagtccctaaggaggg

SEQ ID NO: 810898 - DNA, 25 bp, Mus musculus
tgctcacaacgcagaggctgtgagg

SEQ ID NO: 810899 - DNA, 25 bp, Mus musculus
tgctcacaacgctgaggctgtgagg

SEQ ID NO: 810900 - DNA, 25 bp, Mus musculus
tgctcacaagccagacggatgacct

SEQ ID NO: 810901 - DNA, 25 bp, Mus musculus
tgctcacaagcctgacggatgacct

SEQ ID NO: 810902 - DNA, 25 bp, Mus musculus
tgctcacacactatgcagatatcaa

SEQ ID NO: 810903 - DNA, 25 bp, Mus musculus
tgctcacacactttgcagatatcaa

SEQ ID NO: 810904 - DNA, 25 bp, Mus musculus
tgctcacacggtcgaggaagttctg

SEQ ID NO: 810905 - DNA, 25 bp, Mus musculus
tgctcacacggtggaggaagttctg

SEQ ID NO: 810906 - DNA, 25 bp, Mus musculus
tgctcacagagcctggacagtgccg

SEQ ID NO: 810907 - DNA, 25 bp, Mus musculus
tgctcacagagcgtggacagtgccg

SEQ ID NO: 810908 - DNA, 25 bp, Mus musculus
tgctcacagtcaacgtggttgttgg

SEQ ID NO: 810909 - DNA, 25 bp, Mus musculus
tgctcacagtcatcgtggttgttgg

SEQ ID NO: 810910 - DNA, 25 bp, Mus musculus
tgctcacagtggactgtatcctgga

SEQ ID NO: 810911 - DNA, 25 bp, Mus musculus
tgctcacagtggtctgtatcctgga

SEQ ID NO: 810912 - DNA, 25 bp, Mus musculus
tgctcacagtgtatgcctatgggac

SEQ ID NO: 810913 - DNA, 25 bp, Mus musculus
tgctcacagtgtttgcctatgggac

SEQ ID NO: 810914 - DNA, 25 bp, Mus musculus
tgctcacagttcagcactacaggca

SEQ ID NO: 810915 - DNA, 25 bp, Mus musculus
tgctcacagttctgcactacaggca

SEQ ID NO: 810916 - DNA, 25 bp, Mus musculus
tgctcaccagagaggatgggctcaa

SEQ ID NO: 810917 - DNA, 25 bp, Mus musculus
tgctcaccagagtggatgggctcaa

SEQ ID NO: 810918 - DNA, 25 bp, Mus musculus
tgctcaccagggagaatgtggcgct

SEQ ID NO: 810919 - DNA, 25 bp, Mus musculus
tgctcaccagggtgaatgtggcgct

SEQ ID NO: 810920 - DNA, 25 bp, Mus musculus
tgctcaccatcgaggctgtcaccaa

SEQ ID NO: 810921 - DNA, 25 bp, Mus musculus
tgctcaccatcgtggctgtcaccaa

SEQ ID NO: 810922 - DNA, 25 bp, Mus musculus
tgctcacctgataagatgattggct

SEQ ID NO: 810923 - DNA, 25 bp, Mus musculus
tgctcacctgattagatgattggct

SEQ ID NO: 810924 - DNA, 25 bp, Mus musculus
tgctcacctgttccttctgcatctg

SEQ ID NO: 810925 - DNA, 25 bp, Mus musculus
tgctcacctgttgcttctgcatctg

SEQ ID NO: 810926 - DNA, 25 bp, Mus musculus
tgctcacgctcgagtgcagacctgt

SEQ ID NO: 810927 - DNA, 25 bp, Mus musculus
tgctcacgctcgtgtgcagacctgt

SEQ ID NO: 810928 - DNA, 25 bp, Mus musculus
tgctcacggacaagaccgagaagat

SEQ ID NO: 810929 - DNA, 25 bp, Mus musculus
tgctcacggacatgaccgagaagat

SEQ ID NO: 810930 - DNA, 25 bp, Mus musculus
tgctcacggcaacttctacgaggga

SEQ ID NO: 810931 - DNA, 25 bp, Mus musculus
tgctcacggcaagttctacgaggga

SEQ ID NO: 810932 - DNA, 25 bp, Mus musculus
tgctcacggctcacatctgtgagac

SEQ ID NO: 810933 - DNA, 25 bp, Mus musculus
tgctcacggctctcatctgtgagac

SEQ ID NO: 810934 - DNA, 25 bp, Mus musculus
tgctcacgggccatgtgaatctaga

SEQ ID NO: 810935 - DNA, 25 bp, Mus musculus
tgctcacgggccttgtgaatctaga

SEQ ID NO: 810936 - DNA, 25 bp, Mus musculus
tgctcacgtcccagcgtgaatacct

SEQ ID NO: 810937 - DNA, 25 bp, Mus musculus
tgctcacgtccctgcgtgaatacct

SEQ ID NO: 810938 - DNA, 25 bp, Mus musculus
tgctcacgtcgacctcagaagtatg

SEQ ID NO: 810939 - DNA, 25 bp, Mus musculus
tgctcacgtcgagctcagaagtatg

SEQ ID NO: 810940 - DNA, 25 bp, Mus musculus
tgctcacgtgacaaggcaggcgttt

SEQ ID NO: 810941 - DNA, 25 bp, Mus musculus
tgctcacgtgactaggcaggcgttt

SEQ ID NO: 810942 - DNA, 25 bp, Mus musculus
tgctcactcaccatcctgaggaaat

SEQ ID NO: 810943 - DNA, 25 bp, Mus musculus
tgctcactcaccttcctgaggaaat

SEQ ID NO: 810944 - DNA, 25 bp, Mus musculus
tgctcactccctcgtgtccatttgt

SEQ ID NO: 810945 - DNA, 25 bp, Mus musculus
tgctcactccctggtgtccatttgt

SEQ ID NO: 810946 - DNA, 25 bp, Mus musculus
tgctcactgagcagaaactcccttg

SEQ ID NO: 810947 - DNA, 25 bp, Mus musculus
tgctcactgagctgaaactcccttg

SEQ ID NO: 810948 - DNA, 25 bp, Mus musculus
tgctcactgatgctgaagaagacgc

SEQ ID NO: 810949 - DNA, 25 bp, Mus musculus
tgctcactgatggtgaagaagacgc

SEQ ID NO: 810950 - DNA, 25 bp, Mus musculus
tgctcactgctgaagattttaaagc

SEQ ID NO: 810951 - DNA, 25 bp, Mus musculus
tgctcactgctgtagattttaaagc

SEQ ID NO: 810952 - DNA, 25 bp, Mus musculus
tgctcactggcacacttccaaattg

SEQ ID NO: 810953 - DNA, 25 bp, Mus musculus
tgctcactggcagacttccaaattg

SEQ ID NO: 810954 - DNA, 25 bp, Mus musculus
tgctcagaaagtagagactgtgaca

SEQ ID NO: 810955 - DNA, 25 bp, Mus musculus
tgctcagaaagttgagactgtgaca

SEQ ID NO: 810956 - DNA, 25 bp, Mus musculus
tgctcagaaataaaccgtgggatca

SEQ ID NO: 810957 - DNA, 25 bp, Mus musculus
tgctcagaaatataccgtgggatca

SEQ ID NO: 810958 - DNA, 25 bp, Mus musculus
tgctcagaagagactcggctgctgc

SEQ ID NO: 810959 - DNA, 25 bp, Mus musculus
tgctcagaagagtctcggctgctgc

SEQ ID NO: 810960 - DNA, 25 bp, Mus musculus
tgctcagacctcaaataaaactcgg

SEQ ID NO: 810961 - DNA, 25 bp, Mus musculus
tgctcagacctctaataaaactcgg

SEQ ID NO: 810962 - DNA, 25 bp, Mus musculus
tgctcagactacacgcacagcgtac

SEQ ID NO: 810963 - DNA, 25 bp, Mus musculus
tgctcagactactcgcacagcgtac

SEQ ID NO: 810964 - DNA, 25 bp, Mus musculus
tgctcagagaaacgtctgtggtttc

SEQ ID NO: 810965 - DNA, 25 bp, Mus musculus
tgctcagagaaaggtctgtggtttc

SEQ ID NO: 810966 - DNA, 25 bp, Mus musculus
tgctcagagacaagtgctcccatcc

SEQ ID NO: 810967 - DNA, 25 bp, Mus musculus
tgctcagagacatgtgctcccatcc

SEQ ID NO: 810968 - DNA, 25 bp, Mus musculus
tgctcagagtctacattccagattg

SEQ ID NO: 810969 - DNA, 25 bp, Mus musculus
tgctcagagtcttcattccagattg

SEQ ID NO: 810970 - DNA, 25 bp, Mus musculus
tgctcagcacaaacttatggatggg

SEQ ID NO: 810971 - DNA, 25 bp, Mus musculus
tgctcagcacaatcttatggatggg

SEQ ID NO: 810972 - DNA, 25 bp, Mus musculus
tgctcagcaccgactgggctcgtat

SEQ ID NO: 810973 - DNA, 25 bp, Mus musculus
tgctcagcaccgtctgggctcgtat

SEQ ID NO: 810974 - DNA, 25 bp, Mus musculus
tgctcagcactgcaacaagacggcg

SEQ ID NO: 810975 - DNA, 25 bp, Mus musculus
tgctcagcactggaacaagacggcg

SEQ ID NO: 810976 - DNA, 25 bp, Mus musculus
tgctcagcctggagtatccgaggaa

SEQ ID NO: 810977 - DNA, 25 bp, Mus musculus
tgctcagcctggtgtatccgaggaa

SEQ ID NO: 810978 - DNA, 25 bp, Mus musculus
tgctcagctacgattttctggcctt

SEQ ID NO: 810979 - DNA, 25 bp, Mus musculus
tgctcagctacgtttttctggcctt

SEQ ID NO: 810980 - DNA, 25 bp, Mus musculus
tgctcagctcgcagtcatgcaggga

SEQ ID NO: 810981 - DNA, 25 bp, Mus musculus
tgctcagctcgctgtcatgcaggga

SEQ ID NO: 810982 - DNA, 25 bp, Mus musculus
tgctcagctgcaccggcttctgact

SEQ ID NO: 810983 - DNA, 25 bp, Mus musculus
tgctcagctgcagcggcttctgact

SEQ ID NO: 810984 - DNA, 25 bp, Mus musculus
tgctcaggactcacaacttgccctg

SEQ ID NO: 810985 - DNA, 25 bp, Mus musculus
tgctcaggactctcaacttgccctg

SEQ ID NO: 810986 - DNA, 25 bp, Mus musculus
tgctcaggagttcatccctttccgg

SEQ ID NO: 810987 - DNA, 25 bp, Mus musculus
tgctcaggagttgatccctttccgg

SEQ ID NO: 810988 - DNA, 25 bp, Mus musculus
tgctcaggatctcggctctggaact

SEQ ID NO: 810989 - DNA, 25 bp, Mus musculus
tgctcaggatctgggctctggaact

SEQ ID NO: 810990 - DNA, 25 bp, Mus musculus
tgctcagggcaacaagagtccgcga

SEQ ID NO: 810991 - DNA, 25 bp, Mus musculus
tgctcagggcaagaagagtccgcga

SEQ ID NO: 810992 - DNA, 25 bp, Mus musculus
tgctcagggcccacgccggtgagca

SEQ ID NO: 810993 - DNA, 25 bp, Mus musculus
tgctcagggccctcgccggtgagca

SEQ ID NO: 810994 - DNA, 25 bp, Mus musculus
tgctcagggtatcgttctgttggca

SEQ ID NO: 810995 - DNA, 25 bp, Mus musculus
tgctcagggtatggttctgttggca

SEQ ID NO: 810996 - DNA, 25 bp, Mus musculus
tgctcagggtgccatgaatcaaccg

SEQ ID NO: 810997 - DNA, 25 bp, Mus musculus
tgctcagggtgcgatgaatcaaccg

SEQ ID NO: 810998 - DNA, 25 bp, Mus musculus
tgctcagggtgtacgagaccagcct

SEQ ID NO: 810999 - DNA, 25 bp, Mus musculus
tgctcagggtgttcgagaccagcct

SEQ ID NO: 811000 - DNA, 25 bp, Mus musculus
tgctcaggttccacttcgactgcgg

SEQ ID NO: 811001 - DNA, 25 bp, Mus musculus
tgctcaggttcctcttcgactgcgg

SEQ ID NO: 811002 - DNA, 25 bp, Mus musculus
tgctcagtacaccaccatcgggcgg

SEQ ID NO: 811003 - DNA, 25 bp, Mus musculus
tgctcagtacacgaccatcgggcgg

SEQ ID NO: 811004 - DNA, 25 bp, Mus musculus
tgctcagtgactcgcatggcactcc

SEQ ID NO: 811005 - DNA, 25 bp, Mus musculus
tgctcagtgactggcatggcactcc

SEQ ID NO: 811006 - DNA, 25 bp, Mus musculus
tgctcagtgattcaacagctctggt

SEQ ID NO: 811007 - DNA, 25 bp, Mus musculus
tgctcagtgattgaacagctctggt

SEQ ID NO: 811008 - DNA, 25 bp, Mus musculus
tgctcagtgcagaatttttggaaca

SEQ ID NO: 811009 - DNA, 25 bp, Mus musculus
tgctcagtgcagtatttttggaaca

SEQ ID NO: 811010 - DNA, 25 bp, Mus musculus
tgctcagtgctgcacactgcatgga

SEQ ID NO: 811011 - DNA, 25 bp, Mus musculus
tgctcagtgctggacactgcatgga

SEQ ID NO: 811012 - DNA, 25 bp, Mus musculus
tgctcagtgtgtcatttgtctcaga

SEQ ID NO: 811013 - DNA, 25 bp, Mus musculus
tgctcagtgtgtgatttgtctcaga

SEQ ID NO: 811014 - DNA, 25 bp, Mus musculus
tgctcagttacaagcgggactggca

SEQ ID NO: 811015 - DNA, 25 bp, Mus musculus
tgctcagttacatgcgggactggca

SEQ ID NO: 811016 - DNA, 25 bp, Mus musculus
tgctcatatctgcactaaatcaaaa

SEQ ID NO: 811017 - DNA, 25 bp, Mus musculus
tgctcatatctggactaaatcaaaa

SEQ ID NO: 811018 - DNA, 25 bp, Mus musculus
tgctcatcaacacaatcctgcagaa

SEQ ID NO: 811019 - DNA, 25 bp, Mus musculus
tgctcatcaacagaatcctgcagaa

SEQ ID NO: 811020 - DNA, 25 bp, Mus musculus
tgctcatcaattctaatcgggaggg

SEQ ID NO: 811021 - DNA, 25 bp, Mus musculus
tgctcatcaattgtaatcgggaggg

SEQ ID NO: 811022 - DNA, 25 bp, Mus musculus
tgctcatcaccaactccaatgtccg

SEQ ID NO: 811023 - DNA, 25 bp, Mus musculus
tgctcatcaccatctccaatgtccg

SEQ ID NO: 811024 - DNA, 25 bp, Mus musculus
tgctcatcacccaggaaataccctg

SEQ ID NO: 811025 - DNA, 25 bp, Mus musculus
tgctcatcaccctggaaataccctg

SEQ ID NO: 811026 - DNA, 25 bp, Mus musculus
tgctcatcattcagggccgctattt

SEQ ID NO: 811027 - DNA, 25 bp, Mus musculus
tgctcatcattctgggccgctattt

SEQ ID NO: 811028 - DNA, 25 bp, Mus musculus
tgctcatcccacactttggaatcca

SEQ ID NO: 811029 - DNA, 25 bp, Mus musculus
tgctcatcccacagaaggacaagct

SEQ ID NO: 811030 - DNA, 25 bp, Mus musculus
tgctcatcccactctttggaatcca

SEQ ID NO: 811031 - DNA, 25 bp, Mus musculus
tgctcatcccactgaaggacaagct

SEQ ID NO: 811032 - DNA, 25 bp, Mus musculus
tgctcatcccgaagtgacctgccag

SEQ ID NO: 811033 - DNA, 25 bp, Mus musculus
tgctcatcccgatgtgacctgccag

SEQ ID NO: 811034 - DNA, 25 bp, Mus musculus
tgctcatccctaagtacttccagta

SEQ ID NO: 811035 - DNA, 25 bp, Mus musculus
tgctcatccctatgtacttccagta

SEQ ID NO: 811036 - DNA, 25 bp, Mus musculus
tgctcatcgtcaccgggaccttcgt

SEQ ID NO: 811037 - DNA, 25 bp, Mus musculus
tgctcatcgtcagcgggaccttcgt

SEQ ID NO: 811038 - DNA, 25 bp, Mus musculus
tgctcatctaggctggcagcggcta

SEQ ID NO: 811039 - DNA, 25 bp, Mus musculus
tgctcatctagggtggcagcggcta

SEQ ID NO: 811040 - DNA, 25 bp, Mus musculus
tgctcatctagtagaccctcttaat

SEQ ID NO: 811041 - DNA, 25 bp, Mus musculus
tgctcatctagttgaccctcttaat

SEQ ID NO: 811042 - DNA, 25 bp, Mus musculus
tgctcatctgctcaacgatgctctc

SEQ ID NO: 811043 - DNA, 25 bp, Mus musculus
tgctcatctgctgaacgatgctctc

SEQ ID NO: 811044 - DNA, 25 bp, Mus musculus
tgctcatcttctcgaggccaagtga

SEQ ID NO: 811045 - DNA, 25 bp, Mus musculus
tgctcatcttctggaggccaagtga

SEQ ID NO: 811046 - DNA, 25 bp, Mus musculus
tgctcatgacccaggaggcacacag

SEQ ID NO: 811047 - DNA, 25 bp, Mus musculus
tgctcatgacccatggacagcagga

SEQ ID NO: 811048 - DNA, 25 bp, Mus musculus
tgctcatgaccctggaggcacacag

SEQ ID NO: 811049 - DNA, 25 bp, Mus musculus
tgctcatgacccttggacagcagga

SEQ ID NO: 811050 - DNA, 25 bp, Mus musculus
tgctcatgacctcgagctactgaga

SEQ ID NO: 811051 - DNA, 25 bp, Mus musculus
tgctcatgacctggagctactgaga

SEQ ID NO: 811052 - DNA, 25 bp, Mus musculus
tgctcatgatcaccgggcaggtaga

SEQ ID NO: 811053 - DNA, 25 bp, Mus musculus
tgctcatgatcagcgggcaggtaga

SEQ ID NO: 811054 - DNA, 25 bp, Mus musculus
tgctcatgatctcactaaatgggat

SEQ ID NO: 811055 - DNA, 25 bp, Mus musculus
tgctcatgatctgactaaatgggat

SEQ ID NO: 811056 - DNA, 25 bp, Mus musculus
tgctcatgctgtccatagagtggtg

SEQ ID NO: 811057 - DNA, 25 bp, Mus musculus
tgctcatgctgtgcatagagtggtg

SEQ ID NO: 811058 - DNA, 25 bp, Mus musculus
tgctcatggcctactcgggcaaggg

SEQ ID NO: 811059 - DNA, 25 bp, Mus musculus
tgctcatggccttctcgggcaaggg

SEQ ID NO: 811060 - DNA, 25 bp, Mus musculus
tgctcatgtatgacatcgccaacca

SEQ ID NO: 811061 - DNA, 25 bp, Mus musculus
tgctcatgtatgtcatcgccaacca

SEQ ID NO: 811062 - DNA, 25 bp, Mus musculus
tgctcattaacaatgacccgtgtgc

SEQ ID NO: 811063 - DNA, 25 bp, Mus musculus
tgctcattaacattgacccgtgtgc

SEQ ID NO: 811064 - DNA, 25 bp, Mus musculus
tgctcattcgcgctacactgtagaa

SEQ ID NO: 811065 - DNA, 25 bp, Mus musculus
tgctcattcgcggtacactgtagaa

SEQ ID NO: 811066 - DNA, 25 bp, Mus musculus
tgctcattgtgcaggtagagaccat

SEQ ID NO: 811067 - DNA, 25 bp, Mus musculus
tgctcattgtgctggtagagaccat

SEQ ID NO: 811068 - DNA, 25 bp, Mus musculus
tgctcattttccacaaggctgctgc

SEQ ID NO: 811069 - DNA, 25 bp, Mus musculus
tgctcattttcctcaaggctgctgc

SEQ ID NO: 811070 - DNA, 25 bp, Mus musculus
tgctccaacaagagcagcttggcca

SEQ ID NO: 811071 - DNA, 25 bp, Mus musculus
tgctccaacaagtgcagcttggcca

SEQ ID NO: 811072 - DNA, 25 bp, Mus musculus
tgctccaacagaccgtcatggccta

SEQ ID NO: 811073 - DNA, 25 bp, Mus musculus
tgctccaacagagcgtcatggccta

SEQ ID NO: 811074 - DNA, 25 bp, Mus musculus
tgctccaacaggatcggacgctttg

SEQ ID NO: 811075 - DNA, 25 bp, Mus musculus
tgctccaacaggttcggacgctttg

SEQ ID NO: 811076 - DNA, 25 bp, Mus musculus
tgctccaacgccacagttcctgatg

SEQ ID NO: 811077 - DNA, 25 bp, Mus musculus
tgctccaacgcctcagttcctgatg

SEQ ID NO: 811078 - DNA, 25 bp, Mus musculus
tgctccaagaagacggacagctact

SEQ ID NO: 811079 - DNA, 25 bp, Mus musculus
tgctccaagaagactctcgctcggg

SEQ ID NO: 811080 - DNA, 25 bp, Mus musculus
tgctccaagaagtcggacagctact

SEQ ID NO: 811081 - DNA, 25 bp, Mus musculus
tgctccaagaagtctctcgctcggg

SEQ ID NO: 811082 - DNA, 25 bp, Mus musculus
tgctccaagacaaccaggtcatgct

SEQ ID NO: 811083 - DNA, 25 bp, Mus musculus
tgctccaagacatccaggtcatgct

SEQ ID NO: 811084 - DNA, 25 bp, Mus musculus
tgctccaagagactgggaactgtgc

SEQ ID NO: 811085 - DNA, 25 bp, Mus musculus
tgctccaagagagtgggaactgtgc

SEQ ID NO: 811086 - DNA, 25 bp, Mus musculus
tgctccaagaggagtgagtggccca

SEQ ID NO: 811087 - DNA, 25 bp, Mus musculus
tgctccaagaggtgtgagtggccca

SEQ ID NO: 811088 - DNA, 25 bp, Mus musculus
tgctccaagcccagaggagaagctg

SEQ ID NO: 811089 - DNA, 25 bp, Mus musculus
tgctccaagccctgaggagaagctg

SEQ ID NO: 811090 - DNA, 25 bp, Mus musculus
tgctccaagctgaggagccgattca

SEQ ID NO: 811091 - DNA, 25 bp, Mus musculus
tgctccaagctgcagaatctaagcc

SEQ ID NO: 811092 - DNA, 25 bp, Mus musculus
tgctccaagctggagaatctaagcc

SEQ ID NO: 811093 - DNA, 25 bp, Mus musculus
tgctccaagctgtggagccgattca

SEQ ID NO: 811094 - DNA, 25 bp, Mus musculus
tgctccaaggtcagagcaaactcag

SEQ ID NO: 811095 - DNA, 25 bp, Mus musculus
tgctccaaggtctgagcaaactcag

SEQ ID NO: 811096 - DNA, 25 bp, Mus musculus
tgctccaatggacgatcctgtgaga

SEQ ID NO: 811097 - DNA, 25 bp, Mus musculus
tgctccaatggaggatcctgtgaga

SEQ ID NO: 811098 - DNA, 25 bp, Mus musculus
tgctccacagcacatgtgagtaggg

SEQ ID NO: 811099 - DNA, 25 bp, Mus musculus
tgctccacagcagatgtgagtaggg

SEQ ID NO: 811100 - DNA, 25 bp, Mus musculus
tgctccacatacatgtttccaaaga

SEQ ID NO: 811101 - DNA, 25 bp, Mus musculus
tgctccacatacttgtttccaaaga

SEQ ID NO: 811102 - DNA, 25 bp, Mus musculus
tgctccacccatatgcttcttgaag

SEQ ID NO: 811103 - DNA, 25 bp, Mus musculus
tgctccacccatttgcttcttgaag

SEQ ID NO: 811104 - DNA, 25 bp, Mus musculus
tgctccacctggcagtgattcacga

SEQ ID NO: 811105 - DNA, 25 bp, Mus musculus
tgctccacctgggagtgattcacga

SEQ ID NO: 811106 - DNA, 25 bp, Mus musculus
tgctccagacaaactgggatatgct

SEQ ID NO: 811107 - DNA, 25 bp, Mus musculus
tgctccagacaatctgggatatgct

SEQ ID NO: 811108 - DNA, 25 bp, Mus musculus
tgctccagacatccagcgtccttgt

SEQ ID NO: 811109 - DNA, 25 bp, Mus musculus
tgctccagacatgcagcgtccttgt

SEQ ID NO: 811110 - DNA, 25 bp, Mus musculus
tgctccagacgaatttgtctgaggg

SEQ ID NO: 811111 - DNA, 25 bp, Mus musculus
tgctccagacgattttgtctgaggg

SEQ ID NO: 811112 - DNA, 25 bp, Mus musculus
tgctccagatggatggtaccagtag

SEQ ID NO: 811113 - DNA, 25 bp, Mus musculus
tgctccagatggttggtaccagtag

SEQ ID NO: 811114 - DNA, 25 bp, Mus musculus
tgctccagcatcctccagggaggtg

SEQ ID NO: 811115 - DNA, 25 bp, Mus musculus
tgctccagcatcgtccagggaggtg

SEQ ID NO: 811116 - DNA, 25 bp, Mus musculus
tgctccagcatgaagaccctgggtg

SEQ ID NO: 811117 - DNA, 25 bp, Mus musculus
tgctccagcatgtagaccctgggtg

SEQ ID NO: 811118 - DNA, 25 bp, Mus musculus
tgctccaggaaaccccggtcagttg

SEQ ID NO: 811119 - DNA, 25 bp, Mus musculus
tgctccaggaaagcccggtcagttg

SEQ ID NO: 811120 - DNA, 25 bp, Mus musculus
tgctccaggaagatcatcaagatgg

SEQ ID NO: 811121 - DNA, 25 bp, Mus musculus
tgctccaggaagttcatcaagatgg

SEQ ID NO: 811122 - DNA, 25 bp, Mus musculus
tgctccaggcaaagaaggctttcac

SEQ ID NO: 811123 - DNA, 25 bp, Mus musculus
tgctccaggcaatgaaggctttcac

SEQ ID NO: 811124 - DNA, 25 bp, Mus musculus
tgctccatcctgagcaactacaagg

SEQ ID NO: 811125 - DNA, 25 bp, Mus musculus
tgctccatcctgtgcaactacaagg

SEQ ID NO: 811126 - DNA, 25 bp, Mus musculus
tgctccatgagaaaacgtccaagtt

SEQ ID NO: 811127 - DNA, 25 bp, Mus musculus
tgctccatgagataacgtccaagtt

SEQ ID NO: 811128 - DNA, 25 bp, Mus musculus
tgctccatgctgctgacacacagtt

SEQ ID NO: 811129 - DNA, 25 bp, Mus musculus
tgctccatgctggtgacacacagtt

SEQ ID NO: 811130 - DNA, 25 bp, Mus musculus
tgctccatgtcgcacatccgtttgt

SEQ ID NO: 811131 - DNA, 25 bp, Mus musculus
tgctccatgtcggacatccgtttgt

SEQ ID NO: 811132 - DNA, 25 bp, Mus musculus
tgctcccaaattccacagagcgtgc

SEQ ID NO: 811133 - DNA, 25 bp, Mus musculus
tgctcccaaattgcacagagcgtgc

SEQ ID NO: 811134 - DNA, 25 bp, Mus musculus
tgctcccacgcgaggaaagtttgcc

SEQ ID NO: 811135 - DNA, 25 bp, Mus musculus
tgctcccacgcgtggaaagtttgcc

SEQ ID NO: 811136 - DNA, 25 bp, Mus musculus
tgctcccactgcaaccgtgcttttg

SEQ ID NO: 811137 - DNA, 25 bp, Mus musculus
tgctcccactgctaccgtgcttttg

SEQ ID NO: 811138 - DNA, 25 bp, Mus musculus
tgctcccagcagatcatgcagaaga

SEQ ID NO: 811139 - DNA, 25 bp, Mus musculus
tgctcccagcagttcatgcagaaga

SEQ ID NO: 811140 - DNA, 25 bp, Mus musculus
tgctcccatcctccctgaagaggat

SEQ ID NO: 811141 - DNA, 25 bp, Mus musculus
tgctcccatcctgcctgaagaggat

SEQ ID NO: 811142 - DNA, 25 bp, Mus musculus
tgctcccatgatcagagtctgtcct

SEQ ID NO: 811143 - DNA, 25 bp, Mus musculus
tgctcccatgatgagagtctgtcct

SEQ ID NO: 811144 - DNA, 25 bp, Mus musculus
tgctcccctcaacagtggcggaagt

SEQ ID NO: 811145 - DNA, 25 bp, Mus musculus
tgctcccctcaagagtggcggaagt

SEQ ID NO: 811146 - DNA, 25 bp, Mus musculus
tgctccccttccaactcctgtggaa

SEQ ID NO: 811147 - DNA, 25 bp, Mus musculus
tgctccccttcctactcctgtggaa

SEQ ID NO: 811148 - DNA, 25 bp, Mus musculus
tgctcccgctcacatcttggttctg

SEQ ID NO: 811149 - DNA, 25 bp, Mus musculus
tgctcccgctcagatcttggttctg

SEQ ID NO: 811150 - DNA, 25 bp, Mus musculus
tgctcccggaggatgatgccgatta

SEQ ID NO: 811151 - DNA, 25 bp, Mus musculus
tgctcccggaggttgatgccgatta

SEQ ID NO: 811152 - DNA, 25 bp, Mus musculus
tgctcccgggaacaccctagatgag

SEQ ID NO: 811153 - DNA, 25 bp, Mus musculus
tgctcccgggaagaccctagatgag

SEQ ID NO: 811154 - DNA, 25 bp, Mus musculus
tgctcccgtggaccatgaatatcct

SEQ ID NO: 811155 - DNA, 25 bp, Mus musculus
tgctcccgtggagcatgaatatcct

SEQ ID NO: 811156 - DNA, 25 bp, Mus musculus
tgctccctacccatggatgagggct

SEQ ID NO: 811157 - DNA, 25 bp, Mus musculus
tgctccctacccttggatgagggct

SEQ ID NO: 811158 - DNA, 25 bp, Mus musculus
tgctccctagccactgctgagacag

SEQ ID NO: 811159 - DNA, 25 bp, Mus musculus
tgctccctagcctctgctgagacag

SEQ ID NO: 811160 - DNA, 25 bp, Mus musculus
tgctccctcaggatgaaggtcgatg

SEQ ID NO: 811161 - DNA, 25 bp, Mus musculus
tgctccctcaggttgaaggtcgatg

SEQ ID NO: 811162 - DNA, 25 bp, Mus musculus
tgctccctgccgatcagagcgtctg

SEQ ID NO: 811163 - DNA, 25 bp, Mus musculus
tgctccctgccgttcagagcgtctg

SEQ ID NO: 811164 - DNA, 25 bp, Mus musculus
tgctccctgcgcatgctacgggagg

SEQ ID NO: 811165 - DNA, 25 bp, Mus musculus
tgctccctgcgcttgctacgggagg

SEQ ID NO: 811166 - DNA, 25 bp, Mus musculus
tgctccctggtaaaaagtagacaag

SEQ ID NO: 811167 - DNA, 25 bp, Mus musculus
tgctccctggtataaagtagacaag

SEQ ID NO: 811168 - DNA, 25 bp, Mus musculus
tgctcccttcgaagttggcatcaag

SEQ ID NO: 811169 - DNA, 25 bp, Mus musculus
tgctcccttcgatgttggcatcaag

SEQ ID NO: 811170 - DNA, 25 bp, Mus musculus
tgctcccttcttcctggaaacttgg

SEQ ID NO: 811171 - DNA, 25 bp, Mus musculus
tgctcccttcttgctggaaacttgg

SEQ ID NO: 811172 - DNA, 25 bp, Mus musculus
tgctcccttgcaacgacagcgacag

SEQ ID NO: 811173 - DNA, 25 bp, Mus musculus
tgctcccttgcatcgacagcgacag

SEQ ID NO: 811174 - DNA, 25 bp, Mus musculus
tgctcccttgggacactttggaact

SEQ ID NO: 811175 - DNA, 25 bp, Mus musculus
tgctcccttgggatacaaagaacca

SEQ ID NO: 811176 - DNA, 25 bp, Mus musculus
tgctcccttgggatttgagcccaga

SEQ ID NO: 811177 - DNA, 25 bp, Mus musculus
tgctcccttgggtcactttggaact

SEQ ID NO: 811178 - DNA, 25 bp, Mus musculus
tgctcccttgggttacaaagaacca

SEQ ID NO: 811179 - DNA, 25 bp, Mus musculus
tgctcccttgggttttgagcccaga

SEQ ID NO: 811180 - DNA, 25 bp, Mus musculus
tgctccgacttcaggtgctctgcac

SEQ ID NO: 811181 - DNA, 25 bp, Mus musculus
tgctccgacttctggtgctctgcac

SEQ ID NO: 811182 - DNA, 25 bp, Mus musculus
tgctccgagaggctttccgtgtgcc

SEQ ID NO: 811183 - DNA, 25 bp, Mus musculus
tgctccgagagggtttccgtgtgcc

SEQ ID NO: 811184 - DNA, 25 bp, Mus musculus
tgctccgagagtaacaaaggctgcg

SEQ ID NO: 811185 - DNA, 25 bp, Mus musculus
tgctccgagagttacaaaggctgcg

SEQ ID NO: 811186 - DNA, 25 bp, Mus musculus
tgctccgagcacaagttccacaagt

SEQ ID NO: 811187 - DNA, 25 bp, Mus musculus
tgctccgagcactagttccacaagt

SEQ ID NO: 811188 - DNA, 25 bp, Mus musculus
tgctccgagcagatcatcggcctct

SEQ ID NO: 811189 - DNA, 25 bp, Mus musculus
tgctccgagcagttcatcggcctct

SEQ ID NO: 811190 - DNA, 25 bp, Mus musculus
tgctccgagcccaccaacaagaaga

SEQ ID NO: 811191 - DNA, 25 bp, Mus musculus
tgctccgagccctccaacaagaaga

SEQ ID NO: 811192 - DNA, 25 bp, Mus musculus
tgctccgataggaggtgtgctcttc

SEQ ID NO: 811193 - DNA, 25 bp, Mus musculus
tgctccgataggtggtgtgctcttc

SEQ ID NO: 811194 - DNA, 25 bp, Mus musculus
tgctccgatgaccaatggtctttgc

SEQ ID NO: 811195 - DNA, 25 bp, Mus musculus
tgctccgatgacgaatggtctttgc

SEQ ID NO: 811196 - DNA, 25 bp, Mus musculus
tgctccgatgtcagggcttcgctac

SEQ ID NO: 811197 - DNA, 25 bp, Mus musculus
tgctccgatgtctgggcttcgctac

SEQ ID NO: 811198 - DNA, 25 bp, Mus musculus
tgctccgccagcatcacaggcaaga

SEQ ID NO: 811199 - DNA, 25 bp, Mus musculus
tgctccgccagcttcacaggcaaga

SEQ ID NO: 811200 - DNA, 25 bp, Mus musculus
tgctccgcccagatacctacattgg

SEQ ID NO: 811201 - DNA, 25 bp, Mus musculus
tgctccgcccagttacctacattgg

SEQ ID NO: 811202 - DNA, 25 bp, Mus musculus
tgctccgcgacaatgtcactcctgg

SEQ ID NO: 811203 - DNA, 25 bp, Mus musculus
tgctccgcgacattgtcactcctgg

SEQ ID NO: 811204 - DNA, 25 bp, Mus musculus
tgctccgcgatgagacccaggagtc

SEQ ID NO: 811205 - DNA, 25 bp, Mus musculus
tgctccgcgatgtgacccaggagtc

SEQ ID NO: 811206 - DNA, 25 bp, Mus musculus
tgctccggaaatcttaaagggcaaa

SEQ ID NO: 811207 - DNA, 25 bp, Mus musculus
tgctccggaaatgttaaagggcaaa

SEQ ID NO: 811208 - DNA, 25 bp, Mus musculus
tgctccggccacattagtgactcca

SEQ ID NO: 811209 - DNA, 25 bp, Mus musculus
tgctccggccactttagtgactcca

SEQ ID NO: 811210 - DNA, 25 bp, Mus musculus
tgctccgggacgcaagtgctacttc

SEQ ID NO: 811211 - DNA, 25 bp, Mus musculus
tgctccgggacggaagtgctacttc

SEQ ID NO: 811212 - DNA, 25 bp, Mus musculus
tgctccgggccaacgttgactgtgg

SEQ ID NO: 811213 - DNA, 25 bp, Mus musculus
tgctccgggccatcgttgactgtgg

SEQ ID NO: 811214 - DNA, 25 bp, Mus musculus
tgctccgggtctctcatgttgagga

SEQ ID NO: 811215 - DNA, 25 bp, Mus musculus
tgctccgggtctgtcatgttgagga

SEQ ID NO: 811216 - DNA, 25 bp, Mus musculus
tgctccgtagtacggcggctcgcaa

SEQ ID NO: 811217 - DNA, 25 bp, Mus musculus
tgctccgtagtagggcggctcgcaa

SEQ ID NO: 811218 - DNA, 25 bp, Mus musculus
tgctccgtgaagataaaagagaggg

SEQ ID NO: 811219 - DNA, 25 bp, Mus musculus
tgctccgtgaagttaaaagagaggg

SEQ ID NO: 811220 - DNA, 25 bp, Mus musculus
tgctccgtggctacctgctgcagaa

SEQ ID NO: 811221 - DNA, 25 bp, Mus musculus
tgctccgtggcttcctgctgcagaa

SEQ ID NO: 811222 - DNA, 25 bp, Mus musculus
tgctccgttctgaggccggcatgga

SEQ ID NO: 811223 - DNA, 25 bp, Mus musculus
tgctccgttctgtggccggcatgga

SEQ ID NO: 811224 - DNA, 25 bp, Mus musculus
tgctccgttttcatgacgatttcgc

SEQ ID NO: 811225 - DNA, 25 bp, Mus musculus
tgctccgttttcttgacgatttcgc

SEQ ID NO: 811226 - DNA, 25 bp, Mus musculus
tgctcctaaaggatcatcagtggtg

SEQ ID NO: 811227 - DNA, 25 bp, Mus musculus
tgctcctaaaggttcatcagtggtg

SEQ ID NO: 811228 - DNA, 25 bp, Mus musculus
tgctcctagaatcgaatcaaagagt

SEQ ID NO: 811229 - DNA, 25 bp, Mus musculus
tgctcctagaatggaatcaaagagt

SEQ ID NO: 811230 - DNA, 25 bp, Mus musculus
tgctcctcaaccagactggctttca

SEQ ID NO: 811231 - DNA, 25 bp, Mus musculus
tgctcctcaaccaggtcctagacaa

SEQ ID NO: 811232 - DNA, 25 bp, Mus musculus
tgctcctcaacctgactggctttca

SEQ ID NO: 811233 - DNA, 25 bp, Mus musculus
tgctcctcaacctggtcctagacaa

SEQ ID NO: 811234 - DNA, 25 bp, Mus musculus
tgctcctcaatgcacaaactagaca

SEQ ID NO: 811235 - DNA, 25 bp, Mus musculus
tgctcctcaatggacaaactagaca

SEQ ID NO: 811236 - DNA, 25 bp, Mus musculus
tgctcctcacaaatccttttcctag

SEQ ID NO: 811237 - DNA, 25 bp, Mus musculus
tgctcctcacaattccttttcctag

SEQ ID NO: 811238 - DNA, 25 bp, Mus musculus
tgctcctccggaagtacagcagcag

SEQ ID NO: 811239 - DNA, 25 bp, Mus musculus
tgctcctccggatgtacagcagcag

SEQ ID NO: 811240 - DNA, 25 bp, Mus musculus
tgctcctccgtgctcaggccaggaa

SEQ ID NO: 811241 - DNA, 25 bp, Mus musculus
tgctcctccgtggtcaggccaggaa

SEQ ID NO: 811242 - DNA, 25 bp, Mus musculus
tgctcctcgggaaaacgaatcgatc

SEQ ID NO: 811243 - DNA, 25 bp, Mus musculus
tgctcctcgggaaacgggcccgctg

SEQ ID NO: 811244 - DNA, 25 bp, Mus musculus
tgctcctcgggataacgaatcgatc

SEQ ID NO: 811245 - DNA, 25 bp, Mus musculus
tgctcctcgggatacgggcccgctg

SEQ ID NO: 811246 - DNA, 25 bp, Mus musculus
tgctcctctcagctgcctgtgctga

SEQ ID NO: 811247 - DNA, 25 bp, Mus musculus
tgctcctctcaggtgcctgtgctga

SEQ ID NO: 811248 - DNA, 25 bp, Mus musculus
tgctcctcttacacgtttccgaaga

SEQ ID NO: 811249 - DNA, 25 bp, Mus musculus
tgctcctcttactcgtttccgaaga

SEQ ID NO: 811250 - DNA, 25 bp, Mus musculus
tgctcctcttgcatggactggacag

SEQ ID NO: 811251 - DNA, 25 bp, Mus musculus
tgctcctcttgcttggactggacag

SEQ ID NO: 811252 - DNA, 25 bp, Mus musculus
tgctcctcttgtcctctatgacgga

SEQ ID NO: 811253 - DNA, 25 bp, Mus musculus
tgctcctcttgtgctctatgacgga

SEQ ID NO: 811254 - DNA, 25 bp, Mus musculus
tgctcctgaagtatcagtaacagga

SEQ ID NO: 811255 - DNA, 25 bp, Mus musculus
tgctcctgaagtttcagtaacagga

SEQ ID NO: 811256 - DNA, 25 bp, Mus musculus
tgctcctgacagaaatatcacttgc

SEQ ID NO: 811257 - DNA, 25 bp, Mus musculus
tgctcctgacagtaatatcacttgc

SEQ ID NO: 811258 - DNA, 25 bp, Mus musculus
tgctcctgcaaaaggtggcagtgtc

SEQ ID NO: 811259 - DNA, 25 bp, Mus musculus
tgctcctgcaaatggtggcagtgtc

SEQ ID NO: 811260 - DNA, 25 bp, Mus musculus
tgctcctgcaacactgtggacagcc

SEQ ID NO: 811261 - DNA, 25 bp, Mus musculus
tgctcctgcaactctgtggacagcc

SEQ ID NO: 811262 - DNA, 25 bp, Mus musculus
tgctcctgcacccatgggtactggc

SEQ ID NO: 811263 - DNA, 25 bp, Mus musculus
tgctcctgcaccgatgggtactggc

SEQ ID NO: 811264 - DNA, 25 bp, Mus musculus
tgctcctgcccacggactagataca

SEQ ID NO: 811265 - DNA, 25 bp, Mus musculus
tgctcctgcccagggactagataca

SEQ ID NO: 811266 - DNA, 25 bp, Mus musculus
tgctcctgcgagctcagcttcggca

SEQ ID NO: 811267 - DNA, 25 bp, Mus musculus
tgctcctgcgaggtcagcttcggca

SEQ ID NO: 811268 - DNA, 25 bp, Mus musculus
tgctcctgctcaagttggcgagaca

SEQ ID NO: 811269 - DNA, 25 bp, Mus musculus
tgctcctgctcatgttggcgagaca

SEQ ID NO: 811270 - DNA, 25 bp, Mus musculus
tgctcctgctgaatggacaactgga

SEQ ID NO: 811271 - DNA, 25 bp, Mus musculus
tgctcctgctgattggacaactgga

SEQ ID NO: 811272 - DNA, 25 bp, Mus musculus
tgctcctggaagcaccctgaagctg

SEQ ID NO: 811273 - DNA, 25 bp, Mus musculus
tgctcctggaaggaccctgaagctg

SEQ ID NO: 811274 - DNA, 25 bp, Mus musculus
tgctcctggacgagtccaagctcac

SEQ ID NO: 811275 - DNA, 25 bp, Mus musculus
tgctcctggacgtgtccaagctcac

SEQ ID NO: 811276 - DNA, 25 bp, Mus musculus
tgctcctggcatatgggctacacaa

SEQ ID NO: 811277 - DNA, 25 bp, Mus musculus
tgctcctggcatttgggctacacaa

SEQ ID NO: 811278 - DNA, 25 bp, Mus musculus
tgctcctggctgacagtgcagacct

SEQ ID NO: 811279 - DNA, 25 bp, Mus musculus
tgctcctggctgtcagtgcagacct

SEQ ID NO: 811280 - DNA, 25 bp, Mus musculus
tgctcctgggagcatgaagagcccc

SEQ ID NO: 811281 - DNA, 25 bp, Mus musculus
tgctcctgggaggatgaagagcccc

SEQ ID NO: 811282 - DNA, 25 bp, Mus musculus
tgctcctgggctaccggcgtcgatg

SEQ ID NO: 811283 - DNA, 25 bp, Mus musculus
tgctcctgggcttccggcgtcgatg

SEQ ID NO: 811284 - DNA, 25 bp, Mus musculus
tgctcctgtaccaggcaatgatccc

SEQ ID NO: 811285 - DNA, 25 bp, Mus musculus
tgctcctgtacctggcaatgatccc

SEQ ID NO: 811286 - DNA, 25 bp, Mus musculus
tgctcctgtcagacgccgcattctg

SEQ ID NO: 811287 - DNA, 25 bp, Mus musculus
tgctcctgtcagtcgccgcattctg

SEQ ID NO: 811288 - DNA, 25 bp, Mus musculus
tgctcctgtccactgatggaagccg

SEQ ID NO: 811289 - DNA, 25 bp, Mus musculus
tgctcctgtccagtgatggaagccg

SEQ ID NO: 811290 - DNA, 25 bp, Mus musculus
tgctcctgttctatgtgggctgtgg

SEQ ID NO: 811291 - DNA, 25 bp, Mus musculus
tgctcctgttctttgtgggctgtgg

SEQ ID NO: 811292 - DNA, 25 bp, Mus musculus
tgctccttaggacagcaggcctgaa

SEQ ID NO: 811293 - DNA, 25 bp, Mus musculus
tgctccttaggagagcaggcctgaa

SEQ ID NO: 811294 - DNA, 25 bp, Mus musculus
tgctccttgccaagtcggctaaggg

SEQ ID NO: 811295 - DNA, 25 bp, Mus musculus
tgctccttgccatgtcggctaaggg

SEQ ID NO: 811296 - DNA, 25 bp, Mus musculus
tgctccttgggaagggacgatgaat

SEQ ID NO: 811297 - DNA, 25 bp, Mus musculus
tgctccttgggatgggacgatgaat

SEQ ID NO: 811298 - DNA, 25 bp, Mus musculus
tgctccttgtagagatgtagaacct

SEQ ID NO: 811299 - DNA, 25 bp, Mus musculus
tgctccttgtagtgatgtagaacct

SEQ ID NO: 811300 - DNA, 25 bp, Mus musculus
tgctccttgtcgctgcaagcgccga

SEQ ID NO: 811301 - DNA, 25 bp, Mus musculus
tgctccttgtcggtgcaagcgccga

SEQ ID NO: 811302 - DNA, 25 bp, Mus musculus
tgctccttgttacgagatgatgcac

SEQ ID NO: 811303 - DNA, 25 bp, Mus musculus
tgctccttgttaggagatgatgcac

SEQ ID NO: 811304 - DNA, 25 bp, Mus musculus
tgctcctttggcaatgggcactgtg

SEQ ID NO: 811305 - DNA, 25 bp, Mus musculus
tgctcctttggctatgggcactgtg

SEQ ID NO: 811306 - DNA, 25 bp, Mus musculus
tgctcgaaacctaagccggccggat

SEQ ID NO: 811307 - DNA, 25 bp, Mus musculus
tgctcgaaaccttagccggccggat

SEQ ID NO: 811308 - DNA, 25 bp, Mus musculus
tgctcgaaatggcaaggatgttgct

SEQ ID NO: 811309 - DNA, 25 bp, Mus musculus
tgctcgaaatgggaaggatgttgct

SEQ ID NO: 811310 - DNA, 25 bp, Mus musculus
tgctcgatacggaagtccctggacc

SEQ ID NO: 811311 - DNA, 25 bp, Mus musculus
tgctcgatacggtagtccctggacc

SEQ ID NO: 811312 - DNA, 25 bp, Mus musculus
tgctcgcagttcctcccagagatga

SEQ ID NO: 811313 - DNA, 25 bp, Mus musculus
tgctcgcagttcgtcccagagatga

SEQ ID NO: 811314 - DNA, 25 bp, Mus musculus
tgctcgccggctagttggttctgtg

SEQ ID NO: 811315 - DNA, 25 bp, Mus musculus
tgctcgccggcttgttggttctgtg

SEQ ID NO: 811316 - DNA, 25 bp, Mus musculus
tgctcgccgggcactgcacagacag

SEQ ID NO: 811317 - DNA, 25 bp, Mus musculus
tgctcgccgggctctgcacagacag

SEQ ID NO: 811318 - DNA, 25 bp, Mus musculus
tgctcgcctccaagagaagctgtca

SEQ ID NO: 811319 - DNA, 25 bp, Mus musculus
tgctcgcctccatgagaagctgtca

SEQ ID NO: 811320 - DNA, 25 bp, Mus musculus
tgctcgcctgagagaggttgccaac

SEQ ID NO: 811321 - DNA, 25 bp, Mus musculus
tgctcgcctgagtgaggttgccaac

SEQ ID NO: 811322 - DNA, 25 bp, Mus musculus
tgctcgcctgatctggtgaatcgga

SEQ ID NO: 811323 - DNA, 25 bp, Mus musculus
tgctcgcctgatgtggtgaatcgga

SEQ ID NO: 811324 - DNA, 25 bp, Mus musculus
tgctcgcgtacgacgccgggcttcg

SEQ ID NO: 811325 - DNA, 25 bp, Mus musculus
tgctcgcgtacgtcgccgggcttcg

SEQ ID NO: 811326 - DNA, 25 bp, Mus musculus
tgctcgcgttacagaaatctcaaag

SEQ ID NO: 811327 - DNA, 25 bp, Mus musculus
tgctcgcgttactgaaatctcaaag

SEQ ID NO: 811328 - DNA, 25 bp, Mus musculus
tgctcggaagaaccgccctgctcgg

SEQ ID NO: 811329 - DNA, 25 bp, Mus musculus
tgctcggaagaagcgccctgctcgg

SEQ ID NO: 811330 - DNA, 25 bp, Mus musculus
tgctcggaaggcctgcaatgatgcc

SEQ ID NO: 811331 - DNA, 25 bp, Mus musculus
tgctcggaaggcgtgcaatgatgcc

SEQ ID NO: 811332 - DNA, 25 bp, Mus musculus
tgctcggagaacaccaggagagcca

SEQ ID NO: 811333 - DNA, 25 bp, Mus musculus
tgctcggagaactccaggagagcca

SEQ ID NO: 811334 - DNA, 25 bp, Mus musculus
tgctcggcactcactacccaaagtg

SEQ ID NO: 811335 - DNA, 25 bp, Mus musculus
tgctcggcactctctacccaaagtg

SEQ ID NO: 811336 - DNA, 25 bp, Mus musculus
tgctcggccaaacagcatgtctgat

SEQ ID NO: 811337 - DNA, 25 bp, Mus musculus
tgctcggccaaagagcatgtctgat

SEQ ID NO: 811338 - DNA, 25 bp, Mus musculus
tgctcggccctacatggcttccgtg

SEQ ID NO: 811339 - DNA, 25 bp, Mus musculus
tgctcggccctagatggcttccgtg

SEQ ID NO: 811340 - DNA, 25 bp, Mus musculus
tgctcggctcaaatggaaacgcgcc

SEQ ID NO: 811341 - DNA, 25 bp, Mus musculus
tgctcggctcaattggaaacgcgcc

SEQ ID NO: 811342 - DNA, 25 bp, Mus musculus
tgctcggctcgcagagctgagctct

SEQ ID NO: 811343 - DNA, 25 bp, Mus musculus
tgctcggctcgctgagctgagctct

SEQ ID NO: 811344 - DNA, 25 bp, Mus musculus
tgctcgggagtccacctgtgctctc

SEQ ID NO: 811345 - DNA, 25 bp, Mus musculus
tgctcgggagtcgacctgtgctctc

SEQ ID NO: 811346 - DNA, 25 bp, Mus musculus
tgctcgggcagccagaccgaacaag

SEQ ID NO: 811347 - DNA, 25 bp, Mus musculus
tgctcgggcagcgagaccgaacaag

SEQ ID NO: 811348 - DNA, 25 bp, Mus musculus
tgctcgggctcacctccggtgatgt

SEQ ID NO: 811349 - DNA, 25 bp, Mus musculus
tgctcgggctcagctccggtgatgt

SEQ ID NO: 811350 - DNA, 25 bp, Mus musculus
tgctcggtcgccacgtcgcttgcat

SEQ ID NO: 811351 - DNA, 25 bp, Mus musculus
tgctcggtcgcctcgtcgcttgcat

SEQ ID NO: 811352 - DNA, 25 bp, Mus musculus
tgctcggtgacccaaagtttgtcga

SEQ ID NO: 811353 - DNA, 25 bp, Mus musculus
tgctcggtgaccgaaagtttgtcga

SEQ ID NO: 811354 - DNA, 25 bp, Mus musculus
tgctcggttcctctgtgacctccag

SEQ ID NO: 811355 - DNA, 25 bp, Mus musculus
tgctcggttcctgtgtgacctccag

SEQ ID NO: 811356 - DNA, 25 bp, Mus musculus
tgctcgtaaagcctgtgccgatgcg

SEQ ID NO: 811357 - DNA, 25 bp, Mus musculus
tgctcgtaaagcgtgtgccgatgcg

SEQ ID NO: 811358 - DNA, 25 bp, Mus musculus
tgctcgtcagcaagtcctttattcc

SEQ ID NO: 811359 - DNA, 25 bp, Mus musculus
tgctcgtcagcatgtcctttattcc

SEQ ID NO: 811360 - DNA, 25 bp, Mus musculus
tgctcgtcagtgcagtttgttctgc

SEQ ID NO: 811361 - DNA, 25 bp, Mus musculus
tgctcgtcagtggagtttgttctgc

SEQ ID NO: 811362 - DNA, 25 bp, Mus musculus
tgctcgtgcagccttccagctgggc

SEQ ID NO: 811363 - DNA, 25 bp, Mus musculus
tgctcgtgcagcgttccagctgggc

SEQ ID NO: 811364 - DNA, 25 bp, Mus musculus
tgctcgtggagacaagctctgccaa

SEQ ID NO: 811365 - DNA, 25 bp, Mus musculus
tgctcgtggagagaagctctgccaa

SEQ ID NO: 811366 - DNA, 25 bp, Mus musculus
tgctcgtgggctaccgcttcgttac

SEQ ID NO: 811367 - DNA, 25 bp, Mus musculus
tgctcgtgggcttccgcttcgttac

SEQ ID NO: 811368 - DNA, 25 bp, Mus musculus
tgctcgttccttcgatctgggctgg

SEQ ID NO: 811369 - DNA, 25 bp, Mus musculus
tgctcgttccttggatctgggctgg

SEQ ID NO: 811370 - DNA, 25 bp, Mus musculus
tgctctaaaagcagtggttccggca

SEQ ID NO: 811371 - DNA, 25 bp, Mus musculus
tgctctaaaagctgtggttccggca

SEQ ID NO: 811372 - DNA, 25 bp, Mus musculus
tgctctaaacccatggatacctttc

SEQ ID NO: 811373 - DNA, 25 bp, Mus musculus
tgctctaaacccttggatacctttc

SEQ ID NO: 811374 - DNA, 25 bp, Mus musculus
tgctctaacactctccaggggtaaa

SEQ ID NO: 811375 - DNA, 25 bp, Mus musculus
tgctctaacactgtccaggggtaaa

SEQ ID NO: 811376 - DNA, 25 bp, Mus musculus
tgctctaaccataaacatgttgtcc

SEQ ID NO: 811377 - DNA, 25 bp, Mus musculus
tgctctaaccattaacatgttgtcc

SEQ ID NO: 811378 - DNA, 25 bp, Mus musculus
tgctctaactcactcacagcagaga

SEQ ID NO: 811379 - DNA, 25 bp, Mus musculus
tgctctaactcagtcacagcagaga

SEQ ID NO: 811380 - DNA, 25 bp, Mus musculus
tgctctaaggcaccaggaatcctcc

SEQ ID NO: 811381 - DNA, 25 bp, Mus musculus
tgctctaaggcagcaggaatcctcc

SEQ ID NO: 811382 - DNA, 25 bp, Mus musculus
tgctctacaccgcaagctagctggg

SEQ ID NO: 811383 - DNA, 25 bp, Mus musculus
tgctctacaccggaagctagctggg

SEQ ID NO: 811384 - DNA, 25 bp, Mus musculus
tgctctacatgactagctatccaga

SEQ ID NO: 811385 - DNA, 25 bp, Mus musculus
tgctctacatgagtagctatccaga

SEQ ID NO: 811386 - DNA, 25 bp, Mus musculus
tgctctacattacgagcgccacagc

SEQ ID NO: 811387 - DNA, 25 bp, Mus musculus
tgctctacattaggagcgccacagc

SEQ ID NO: 811388 - DNA, 25 bp, Mus musculus
tgctctaccagaacggaggaccgat

SEQ ID NO: 811389 - DNA, 25 bp, Mus musculus
tgctctaccagatcggaggaccgat

SEQ ID NO: 811390 - DNA, 25 bp, Mus musculus
tgctctacctggcacacaagtataa

SEQ ID NO: 811391 - DNA, 25 bp, Mus musculus
tgctctacctgggacacaagtataa

SEQ ID NO: 811392 - DNA, 25 bp, Mus musculus
tgctctacgcacagctggaggagga

SEQ ID NO: 811393 - DNA, 25 bp, Mus musculus
tgctctacgcactgctggaggagga

SEQ ID NO: 811394 - DNA, 25 bp, Mus musculus
tgctctacgctgagcgtgggaacca

SEQ ID NO: 811395 - DNA, 25 bp, Mus musculus
tgctctacgctgtgcgtgggaacca

SEQ ID NO: 811396 - DNA, 25 bp, Mus musculus
tgctctactcataccctgtcgtgat

SEQ ID NO: 811397 - DNA, 25 bp, Mus musculus
tgctctactcattccctgtcgtgat

SEQ ID NO: 811398 - DNA, 25 bp, Mus musculus
tgctctactgcaaggagtacctgga

SEQ ID NO: 811399 - DNA, 25 bp, Mus musculus
tgctctactgcatggagtacctgga

SEQ ID NO: 811400 - DNA, 25 bp, Mus musculus
tgctctactttgatggcctccgaaa

SEQ ID NO: 811401 - DNA, 25 bp, Mus musculus
tgctctactttgttggcctccgaaa

SEQ ID NO: 811402 - DNA, 25 bp, Mus musculus
tgctctagatagatctgggtggcgt

SEQ ID NO: 811403 - DNA, 25 bp, Mus musculus
tgctctagatagttctgggtggcgt

SEQ ID NO: 811404 - DNA, 25 bp, Mus musculus
tgctctagcaacaagccggccattg

SEQ ID NO: 811405 - DNA, 25 bp, Mus musculus
tgctctagcaactagccggccattg

SEQ ID NO: 811406 - DNA, 25 bp, Mus musculus
tgctctagggaacatctgagtactg

SEQ ID NO: 811407 - DNA, 25 bp, Mus musculus
tgctctagggaagatctgagtactg

SEQ ID NO: 811408 - DNA, 25 bp, Mus musculus
tgctctagtcaaccgaatcaaagag

SEQ ID NO: 811409 - DNA, 25 bp, Mus musculus
tgctctagtcaagcgaatcaaagag

SEQ ID NO: 811410 - DNA, 25 bp, Mus musculus
tgctctatcaagaatggatgcatgc

SEQ ID NO: 811411 - DNA, 25 bp, Mus musculus
tgctctatcaagtatggatgcatgc

SEQ ID NO: 811412 - DNA, 25 bp, Mus musculus
tgctctatcagcatgtgggtgccac

SEQ ID NO: 811413 - DNA, 25 bp, Mus musculus
tgctctatcagcttgtgggtgccac

SEQ ID NO: 811414 - DNA, 25 bp, Mus musculus
tgctctcaactacaacatcgtgtcc

SEQ ID NO: 811415 - DNA, 25 bp, Mus musculus
tgctctcaactagaacatcgtgtcc

SEQ ID NO: 811416 - DNA, 25 bp, Mus musculus
tgctctcaagaacgcagatgtgggc

SEQ ID NO: 811417 - DNA, 25 bp, Mus musculus
tgctctcaagaaggcagatgtgggc

SEQ ID NO: 811418 - DNA, 25 bp, Mus musculus
tgctctcaagggagaaattccatca

SEQ ID NO: 811419 - DNA, 25 bp, Mus musculus
tgctctcaagggtgaaattccatca

SEQ ID NO: 811420 - DNA, 25 bp, Mus musculus
tgctctcagcataggtgccctcgta

SEQ ID NO: 811421 - DNA, 25 bp, Mus musculus
tgctctcagcattggtgccctcgta

SEQ ID NO: 811422 - DNA, 25 bp, Mus musculus
tgctctcagcgcaaaggtgaatggt

SEQ ID NO: 811423 - DNA, 25 bp, Mus musculus
tgctctcagcgctaaggtgaatggt

SEQ ID NO: 811424 - DNA, 25 bp, Mus musculus
tgctctcaggtaccgccagaggaag

SEQ ID NO: 811425 - DNA, 25 bp, Mus musculus
tgctctcaggtagcgccagaggaag

SEQ ID NO: 811426 - DNA, 25 bp, Mus musculus
tgctctcagtttatgtggcagtggg

SEQ ID NO: 811427 - DNA, 25 bp, Mus musculus
tgctctcagtttttgtggcagtggg

SEQ ID NO: 811428 - DNA, 25 bp, Mus musculus
tgctctcatcgcaatgaggaaattc

SEQ ID NO: 811429 - DNA, 25 bp, Mus musculus
tgctctcatcgctatgaggaaattc

SEQ ID NO: 811430 - DNA, 25 bp, Mus musculus
tgctctccaaagatggaacgtggga

SEQ ID NO: 811431 - DNA, 25 bp, Mus musculus
tgctctccaaagttggaacgtggga

SEQ ID NO: 811432 - DNA, 25 bp, Mus musculus
tgctctccactcagtggctcgttgg

SEQ ID NO: 811433 - DNA, 25 bp, Mus musculus
tgctctccactctgtggctcgttgg

SEQ ID NO: 811434 - DNA, 25 bp, Mus musculus
tgctctccagccacctgtagggctg

SEQ ID NO: 811435 - DNA, 25 bp, Mus musculus
tgctctccagcctcctgtagggctg

SEQ ID NO: 811436 - DNA, 25 bp, Mus musculus
tgctctcccagcatagccttcatta

SEQ ID NO: 811437 - DNA, 25 bp, Mus musculus
tgctctcccagcttagccttcatta

SEQ ID NO: 811438 - DNA, 25 bp, Mus musculus
tgctctcccgacatctgcactagtg

SEQ ID NO: 811439 - DNA, 25 bp, Mus musculus
tgctctcccgacttctgcactagtg

SEQ ID NO: 811440 - DNA, 25 bp, Mus musculus
tgctctccgtagagcgcctggtaga

SEQ ID NO: 811441 - DNA, 25 bp, Mus musculus
tgctctccgtagtgcgcctggtaga

SEQ ID NO: 811442 - DNA, 25 bp, Mus musculus
tgctctcctggaaggtgtgagaacc

SEQ ID NO: 811443 - DNA, 25 bp, Mus musculus
tgctctcctggatggtgtgagaacc

SEQ ID NO: 811444 - DNA, 25 bp, Mus musculus
tgctctccttccagcatctcagagg

SEQ ID NO: 811445 - DNA, 25 bp, Mus musculus
tgctctccttcctgcatctcagagg

SEQ ID NO: 811446 - DNA, 25 bp, Mus musculus
tgctctcgaaccaggaacaaagcct

SEQ ID NO: 811447 - DNA, 25 bp, Mus musculus
tgctctcgaacctggaacaaagcct

SEQ ID NO: 811448 - DNA, 25 bp, Mus musculus
tgctctcgactcagaattgacctcc

SEQ ID NO: 811449 - DNA, 25 bp, Mus musculus
tgctctcgactctgaattgacctcc

SEQ ID NO: 811450 - DNA, 25 bp, Mus musculus
tgctctcgactgataatggcgggtg

SEQ ID NO: 811451 - DNA, 25 bp, Mus musculus
tgctctcgactgttaatggcgggtg

SEQ ID NO: 811452 - DNA, 25 bp, Mus musculus
tgctctcgggaaacgcagatcctaa

SEQ ID NO: 811453 - DNA, 25 bp, Mus musculus
tgctctcgggaatcgcagatcctaa

SEQ ID NO: 811454 - DNA, 25 bp, Mus musculus
tgctctcgggctaatcaccaggctc

SEQ ID NO: 811455 - DNA, 25 bp, Mus musculus
tgctctcgggcttatcaccaggctc

SEQ ID NO: 811456 - DNA, 25 bp, Mus musculus
tgctctctaaccaaccaatgacata

SEQ ID NO: 811457 - DNA, 25 bp, Mus musculus
tgctctctaacctaccaatgacata

SEQ ID NO: 811458 - DNA, 25 bp, Mus musculus
tgctctctagtgaggacctgaatgg

SEQ ID NO: 811459 - DNA, 25 bp, Mus musculus
tgctctctagtgtggacctgaatgg

SEQ ID NO: 811460 - DNA, 25 bp, Mus musculus
tgctctctctatccgcaggagctga

SEQ ID NO: 811461 - DNA, 25 bp, Mus musculus
tgctctctctatgcgcaggagctga

SEQ ID NO: 811462 - DNA, 25 bp, Mus musculus
tgctctctcttcatgcgcaacatcg

SEQ ID NO: 811463 - DNA, 25 bp, Mus musculus
tgctctctcttcttgcgcaacatcg

SEQ ID NO: 811464 - DNA, 25 bp, Mus musculus
tgctctctgactccaggagcggctg

SEQ ID NO: 811465 - DNA, 25 bp, Mus musculus
tgctctctgactgcaggagcggctg

SEQ ID NO: 811466 - DNA, 25 bp, Mus musculus
tgctctctggcacatgatgctcagt

SEQ ID NO: 811467 - DNA, 25 bp, Mus musculus
tgctctctggcagatgatgctcagt

SEQ ID NO: 811468 - DNA, 25 bp, Mus musculus
tgctctctgtcacaagtaccctcgg

SEQ ID NO: 811469 - DNA, 25 bp, Mus musculus
tgctctctgtcagaagtaccctcgg

SEQ ID NO: 811470 - DNA, 25 bp, Mus musculus
tgctctctgtgactatcagctttag

SEQ ID NO: 811471 - DNA, 25 bp, Mus musculus
tgctctctgtgagtatcagctttag

SEQ ID NO: 811472 - DNA, 25 bp, Mus musculus
tgctctctgttcagctctgcctttc

SEQ ID NO: 811473 - DNA, 25 bp, Mus musculus
tgctctctgttctgctctgcctttc

SEQ ID NO: 811474 - DNA, 25 bp, Mus musculus
tgctctcttcatcggatgggcagga

SEQ ID NO: 811475 - DNA, 25 bp, Mus musculus
tgctctcttcatgggatgggcagga

SEQ ID NO: 811476 - DNA, 25 bp, Mus musculus
tgctctcttggacagcaccagtgta

SEQ ID NO: 811477 - DNA, 25 bp, Mus musculus
tgctctcttggagagcaccagtgta

SEQ ID NO: 811478 - DNA, 25 bp, Mus musculus
tgctctgaagcaagcctccaatatg

SEQ ID NO: 811479 - DNA, 25 bp, Mus musculus
tgctctgaagcatgcctccaatatg

SEQ ID NO: 811480 - DNA, 25 bp, Mus musculus
tgctctgactcgaggagcacgggtc

SEQ ID NO: 811481 - DNA, 25 bp, Mus musculus
tgctctgactcgtggagcacgggtc

SEQ ID NO: 811482 - DNA, 25 bp, Mus musculus
tgctctgagaagcttgaacagtggc

SEQ ID NO: 811483 - DNA, 25 bp, Mus musculus
tgctctgagaaggttgaacagtggc

SEQ ID NO: 811484 - DNA, 25 bp, Mus musculus
tgctctgagagcatagaggatgctg

SEQ ID NO: 811485 - DNA, 25 bp, Mus musculus
tgctctgagagcttagaggatgctg

SEQ ID NO: 811486 - DNA, 25 bp, Mus musculus
tgctctgagcaccatagccactgtg

SEQ ID NO: 811487 - DNA, 25 bp, Mus musculus
tgctctgagcacgatagccactgtg

SEQ ID NO: 811488 - DNA, 25 bp, Mus musculus
tgctctgcaggccatccggaaaaaa

SEQ ID NO: 811489 - DNA, 25 bp, Mus musculus
tgctctgcaggcgatccggaaaaaa

SEQ ID NO: 811490 - DNA, 25 bp, Mus musculus
tgctctgcagtaacaggtggtgccc

SEQ ID NO: 811491 - DNA, 25 bp, Mus musculus
tgctctgcagtatcaggtggtgccc

SEQ ID NO: 811492 - DNA, 25 bp, Mus musculus
tgctctgccagtattagaaagctgc

SEQ ID NO: 811493 - DNA, 25 bp, Mus musculus
tgctctgccagttttagaaagctgc

SEQ ID NO: 811494 - DNA, 25 bp, Mus musculus
tgctctgccctccacggaattggat

SEQ ID NO: 811495 - DNA, 25 bp, Mus musculus
tgctctgccctcgacggaattggat

SEQ ID NO: 811496 - DNA, 25 bp, Mus musculus
tgctctgcgttccaatgccctgtct

SEQ ID NO: 811497 - DNA, 25 bp, Mus musculus
tgctctgcgttcgaatgccctgtct

SEQ ID NO: 811498 - DNA, 25 bp, Mus musculus
tgctctgctagaacgcacatggctg

SEQ ID NO: 811499 - DNA, 25 bp, Mus musculus
tgctctgctagatcgcacatggctg

SEQ ID NO: 811500 - DNA, 25 bp, Mus musculus
tgctctgctcataccaaccttggag

SEQ ID NO: 811501 - DNA, 25 bp, Mus musculus
tgctctgctcatctacaaggcgggt

SEQ ID NO: 811502 - DNA, 25 bp, Mus musculus
tgctctgctcatgtacaaggcgggt

SEQ ID NO: 811503 - DNA, 25 bp, Mus musculus
tgctctgctcattccaaccttggag

SEQ ID NO: 811504 - DNA, 25 bp, Mus musculus
tgctctgcttatcctgccaggacga

SEQ ID NO: 811505 - DNA, 25 bp, Mus musculus
tgctctgcttatgctgccaggacga

SEQ ID NO: 811506 - DNA, 25 bp, Mus musculus
tgctctgcttggcaatggctttacc

SEQ ID NO: 811507 - DNA, 25 bp, Mus musculus
tgctctgcttgggaatggctttacc

SEQ ID NO: 811508 - DNA, 25 bp, Mus musculus
tgctctggatgtacttaagtatgaa

SEQ ID NO: 811509 - DNA, 25 bp, Mus musculus
tgctctggatgttcttaagtatgaa

SEQ ID NO: 811510 - DNA, 25 bp, Mus musculus
tgctctggccctcactgtaatctag

SEQ ID NO: 811511 - DNA, 25 bp, Mus musculus
tgctctggccctgactgtaatctag

SEQ ID NO: 811512 - DNA, 25 bp, Mus musculus
tgctctggctcacgagtatctcatg

SEQ ID NO: 811513 - DNA, 25 bp, Mus musculus
tgctctggctcaggagtatctcatg

SEQ ID NO: 811514 - DNA, 25 bp, Mus musculus
tgctctggtaacactcaatccctga

SEQ ID NO: 811515 - DNA, 25 bp, Mus musculus
tgctctggtaactctcaatccctga

SEQ ID NO: 811516 - DNA, 25 bp, Mus musculus
tgctctgtaacacagccagactggt

SEQ ID NO: 811517 - DNA, 25 bp, Mus musculus
tgctctgtaacagagccagactggt

SEQ ID NO: 811518 - DNA, 25 bp, Mus musculus
tgctctgtcctgactggaatctgct

SEQ ID NO: 811519 - DNA, 25 bp, Mus musculus
tgctctgtcctgtctggaatctgct

SEQ ID NO: 811520 - DNA, 25 bp, Mus musculus
tgctctgtgaggacacagctgctcc

SEQ ID NO: 811521 - DNA, 25 bp, Mus musculus
tgctctgtgaggtcacagctgctcc

SEQ ID NO: 811522 - DNA, 25 bp, Mus musculus
tgctctgtgtaacctgcgtgaattc

SEQ ID NO: 811523 - DNA, 25 bp, Mus musculus
tgctctgtgtaagctgcgtgaattc

SEQ ID NO: 811524 - DNA, 25 bp, Mus musculus
tgctctgtgtttcggcctgatggaa

SEQ ID NO: 811525 - DNA, 25 bp, Mus musculus
tgctctgtgtttgggcctgatggaa

SEQ ID NO: 811526 - DNA, 25 bp, Mus musculus
tgctctgttaggatggcctggccgc

SEQ ID NO: 811527 - DNA, 25 bp, Mus musculus
tgctctgttaggttggcctggccgc

SEQ ID NO: 811528 - DNA, 25 bp, Mus musculus
tgctctgtttctacacctgtcgcct

SEQ ID NO: 811529 - DNA, 25 bp, Mus musculus
tgctctgtttcttcacctgtcgcct

SEQ ID NO: 811530 - DNA, 25 bp, Mus musculus
tgctcttaaggaactagaagtagaa

SEQ ID NO: 811531 - DNA, 25 bp, Mus musculus
tgctcttaaggatctagaagtagaa

SEQ ID NO: 811532 - DNA, 25 bp, Mus musculus
tgctcttaccttcgcttgctgtgga

SEQ ID NO: 811533 - DNA, 25 bp, Mus musculus
tgctcttaccttggcttgctgtgga

SEQ ID NO: 811534 - DNA, 25 bp, Mus musculus
tgctcttagggaccggcctcttgcc

SEQ ID NO: 811535 - DNA, 25 bp, Mus musculus
tgctcttagggagcggcctcttgcc

SEQ ID NO: 811536 - DNA, 25 bp, Mus musculus
tgctcttagtagaacgagctggacg

SEQ ID NO: 811537 - DNA, 25 bp, Mus musculus
tgctcttagtagtacgagctggacg

SEQ ID NO: 811538 - DNA, 25 bp, Mus musculus
tgctcttcaacaatgacatgcatga

SEQ ID NO: 811539 - DNA, 25 bp, Mus musculus
tgctcttcaacattgacatgcatga

SEQ ID NO: 811540 - DNA, 25 bp, Mus musculus
tgctcttcaccaagatcttcgtcac

SEQ ID NO: 811541 - DNA, 25 bp, Mus musculus
tgctcttcaccatgatcttcgtcac

SEQ ID NO: 811542 - DNA, 25 bp, Mus musculus
tgctcttcagacaggacccggatgt

SEQ ID NO: 811543 - DNA, 25 bp, Mus musculus
tgctcttcagactggacccggatgt

SEQ ID NO: 811544 - DNA, 25 bp, Mus musculus
tgctcttcaggccaggtgcttttct

SEQ ID NO: 811545 - DNA, 25 bp, Mus musculus
tgctcttcaggcgaggtgcttttct

SEQ ID NO: 811546 - DNA, 25 bp, Mus musculus
tgctcttcagggaggtcagtttttt

SEQ ID NO: 811547 - DNA, 25 bp, Mus musculus
tgctcttcagggtggtcagtttttt

SEQ ID NO: 811548 - DNA, 25 bp, Mus musculus
tgctcttcattgagacccaggatgg

SEQ ID NO: 811549 - DNA, 25 bp, Mus musculus
tgctcttcattgtgacccaggatgg

SEQ ID NO: 811550 - DNA, 25 bp, Mus musculus
tgctcttccgcaatagacctgttcc

SEQ ID NO: 811551 - DNA, 25 bp, Mus musculus
tgctcttccgcattagacctgttcc

SEQ ID NO: 811552 - DNA, 25 bp, Mus musculus
tgctcttccggcctagtcagatgga

SEQ ID NO: 811553 - DNA, 25 bp, Mus musculus
tgctcttccggcgtagtcagatgga

SEQ ID NO: 811554 - DNA, 25 bp, Mus musculus
tgctcttcgactccatctgtaacaa

SEQ ID NO: 811555 - DNA, 25 bp, Mus musculus
tgctcttcgactgcatctgtaacaa

SEQ ID NO: 811556 - DNA, 25 bp, Mus musculus
tgctcttcgagaagtcattcagatg

SEQ ID NO: 811557 - DNA, 25 bp, Mus musculus
tgctcttcgagatgtcattcagatg

SEQ ID NO: 811558 - DNA, 25 bp, Mus musculus
tgctcttcgcagagtccctgttcat

SEQ ID NO: 811559 - DNA, 25 bp, Mus musculus
tgctcttcgcagtgtccctgttcat

SEQ ID NO: 811560 - DNA, 25 bp, Mus musculus
tgctcttcgcatagttcgcttccgg

SEQ ID NO: 811561 - DNA, 25 bp, Mus musculus
tgctcttcgcattgttcgcttccgg

SEQ ID NO: 811562 - DNA, 25 bp, Mus musculus
tgctcttcgtcaactgaccagccgg

SEQ ID NO: 811563 - DNA, 25 bp, Mus musculus
tgctcttcgtcatctgaccagccgg

SEQ ID NO: 811564 - DNA, 25 bp, Mus musculus
tgctcttctaccagattcggtactg

SEQ ID NO: 811565 - DNA, 25 bp, Mus musculus
tgctcttctacctgattcggtactg

SEQ ID NO: 811566 - DNA, 25 bp, Mus musculus
tgctcttctggtcgctgctgagttc

SEQ ID NO: 811567 - DNA, 25 bp, Mus musculus
tgctcttctggtggctgctgagttc

SEQ ID NO: 811568 - DNA, 25 bp, Mus musculus
tgctcttcttttagatgttccggaa

SEQ ID NO: 811569 - DNA, 25 bp, Mus musculus
tgctcttctttttgatgttccggaa

SEQ ID NO: 811570 - DNA, 25 bp, Mus musculus
tgctcttgacctagcagtgcccaaa

SEQ ID NO: 811571 - DNA, 25 bp, Mus musculus
tgctcttgaccttgcagtgcccaaa

SEQ ID NO: 811572 - DNA, 25 bp, Mus musculus
tgctcttgagcaccatcaagtgtgg

SEQ ID NO: 811573 - DNA, 25 bp, Mus musculus
tgctcttgagcagcatcaagtgtgg

SEQ ID NO: 811574 - DNA, 25 bp, Mus musculus
tgctcttgcccgagaaggagctagg

SEQ ID NO: 811575 - DNA, 25 bp, Mus musculus
tgctcttgcccgtgaaggagctagg

SEQ ID NO: 811576 - DNA, 25 bp, Mus musculus
tgctcttgcttaaggaatctataaa

SEQ ID NO: 811577 - DNA, 25 bp, Mus musculus
tgctcttgcttatggaatctataaa

SEQ ID NO: 811578 - DNA, 25 bp, Mus musculus
tgctcttggaggagtcaagctgccg

SEQ ID NO: 811579 - DNA, 25 bp, Mus musculus
tgctcttggaggtgtcaagctgccg

SEQ ID NO: 811580 - DNA, 25 bp, Mus musculus
tgctcttggctccaggatttgtgca

SEQ ID NO: 811581 - DNA, 25 bp, Mus musculus
tgctcttggctcgaggatttgtgca

SEQ ID NO: 811582 - DNA, 25 bp, Mus musculus
tgctcttgtagccacacacccaaag

SEQ ID NO: 811583 - DNA, 25 bp, Mus musculus
tgctcttgtagcgacacacccaaag

SEQ ID NO: 811584 - DNA, 25 bp, Mus musculus
tgctcttgtcctagatcgggtggac

SEQ ID NO: 811585 - DNA, 25 bp, Mus musculus
tgctcttgtccttgatcgggtggac

SEQ ID NO: 811586 - DNA, 25 bp, Mus musculus
tgctcttgttgcagctcctgtcctg

SEQ ID NO: 811587 - DNA, 25 bp, Mus musculus
tgctcttgttgctgctcctgtcctg

SEQ ID NO: 811588 - DNA, 25 bp, Mus musculus
tgctctttaactacgatgaccgtgg

SEQ ID NO: 811589 - DNA, 25 bp, Mus musculus
tgctctttaacttcgatgaccgtgg

SEQ ID NO: 811590 - DNA, 25 bp, Mus musculus
tgctctttaccccagtagctatgtg

SEQ ID NO: 811591 - DNA, 25 bp, Mus musculus
tgctctttacccgagtagctatgtg

SEQ ID NO: 811592 - DNA, 25 bp, Mus musculus
tgctctttatctcgagccgccttct

SEQ ID NO: 811593 - DNA, 25 bp, Mus musculus
tgctctttatctggagccgccttct

SEQ ID NO: 811594 - DNA, 25 bp, Mus musculus
tgctctttcggaccctgcctgagga

SEQ ID NO: 811595 - DNA, 25 bp, Mus musculus
tgctctttcggagcctgcctgagga

SEQ ID NO: 811596 - DNA, 25 bp, Mus musculus
tgctctttgctgcttttgacccggc

SEQ ID NO: 811597 - DNA, 25 bp, Mus musculus
tgctctttgctggttttgacccggc

SEQ ID NO: 811598 - DNA, 25 bp, Mus musculus
tgctctttggccagaccagtgcctt

SEQ ID NO: 811599 - DNA, 25 bp, Mus musculus
tgctctttggcctgaccagtgcctt

SEQ ID NO: 811600 - DNA, 25 bp, Mus musculus
tgctcttttcagatgcattagcaga

SEQ ID NO: 811601 - DNA, 25 bp, Mus musculus
tgctcttttcagcagcttaagtggg

SEQ ID NO: 811602 - DNA, 25 bp, Mus musculus
tgctcttttcaggagcttaagtggg

SEQ ID NO: 811603 - DNA, 25 bp, Mus musculus
tgctcttttcagttgcattagcaga

SEQ ID NO: 811604 - DNA, 25 bp, Mus musculus
tgctcttttctaccctggagacagt

SEQ ID NO: 811605 - DNA, 25 bp, Mus musculus
tgctcttttctagcctggagacagt

SEQ ID NO: 811606 - DNA, 25 bp, Mus musculus
tgctcttttggaacagcagaacacc

SEQ ID NO: 811607 - DNA, 25 bp, Mus musculus
tgctcttttggatcagcagaacacc

SEQ ID NO: 811608 - DNA, 25 bp, Mus musculus
tgctgaaaaaacaccatcgctaact

SEQ ID NO: 811609 - DNA, 25 bp, Mus musculus
tgctgaaaaaactccatcgctaact

SEQ ID NO: 811610 - DNA, 25 bp, Mus musculus
tgctgaaaacctcggtgagagcctt

SEQ ID NO: 811611 - DNA, 25 bp, Mus musculus
tgctgaaaacctgggtgagagcctt

SEQ ID NO: 811612 - DNA, 25 bp, Mus musculus
tgctgaaaatgcaatagaagctctt

SEQ ID NO: 811613 - DNA, 25 bp, Mus musculus
tgctgaaaatgctatagaagctctt

SEQ ID NO: 811614 - DNA, 25 bp, Mus musculus
tgctgaaacagaagcagttgtcaaa

SEQ ID NO: 811615 - DNA, 25 bp, Mus musculus
tgctgaaacagatgcagttgtcaaa

SEQ ID NO: 811616 - DNA, 25 bp, Mus musculus
tgctgaaactgcacgacgaacgcgt

SEQ ID NO: 811617 - DNA, 25 bp, Mus musculus
tgctgaaactgctcgacgaacgcgt

SEQ ID NO: 811618 - DNA, 25 bp, Mus musculus
tgctgaaactggactgactgatgga

SEQ ID NO: 811619 - DNA, 25 bp, Mus musculus
tgctgaaactggtctgactgatgga

SEQ ID NO: 811620 - DNA, 25 bp, Mus musculus
tgctgaaagacaaaggctacacgac

SEQ ID NO: 811621 - DNA, 25 bp, Mus musculus
tgctgaaagacataggctacacgac

SEQ ID NO: 811622 - DNA, 25 bp, Mus musculus
tgctgaaagagtcagtcctgggtca

SEQ ID NO: 811623 - DNA, 25 bp, Mus musculus
tgctgaaagagtgagtcctgggtca

SEQ ID NO: 811624 - DNA, 25 bp, Mus musculus
tgctgaaaggccacttccgccaagg

SEQ ID NO: 811625 - DNA, 25 bp, Mus musculus
tgctgaaaggcctcttccgccaagg

SEQ ID NO: 811626 - DNA, 25 bp, Mus musculus
tgctgaaatatcaggaacaattcct

SEQ ID NO: 811627 - DNA, 25 bp, Mus musculus
tgctgaaatatctggaacaattcct

SEQ ID NO: 811628 - DNA, 25 bp, Mus musculus
tgctgaacataaagaaatccagaaa

SEQ ID NO: 811629 - DNA, 25 bp, Mus musculus
tgctgaacataatgaaatccagaaa

SEQ ID NO: 811630 - DNA, 25 bp, Mus musculus
tgctgaaccctgagcgccctgagct

SEQ ID NO: 811631 - DNA, 25 bp, Mus musculus
tgctgaaccctgtgcgccctgagct

SEQ ID NO: 811632 - DNA, 25 bp, Mus musculus
tgctgaaccgccatcctgagattgt

SEQ ID NO: 811633 - DNA, 25 bp, Mus musculus
tgctgaaccgccttcctgagattgt

SEQ ID NO: 811634 - DNA, 25 bp, Mus musculus
tgctgaacgatgctctcagcatccg

SEQ ID NO: 811635 - DNA, 25 bp, Mus musculus
tgctgaacgatggtctcagcatccg

SEQ ID NO: 811636 - DNA, 25 bp, Mus musculus
tgctgaacgcagcttccgcggtatg

SEQ ID NO: 811637 - DNA, 25 bp, Mus musculus
tgctgaacgcaggttccgcggtatg

SEQ ID NO: 811638 - DNA, 25 bp, Mus musculus
tgctgaacggccactactacatcca

SEQ ID NO: 811639 - DNA, 25 bp, Mus musculus
tgctgaacggcctctactacatcca

SEQ ID NO: 811640 - DNA, 25 bp, Mus musculus
tgctgaactataactgccacacgtc

SEQ ID NO: 811641 - DNA, 25 bp, Mus musculus
tgctgaactatatctgccacacgtc

SEQ ID NO: 811642 - DNA, 25 bp, Mus musculus
tgctgaactgtaccctaaaatcaag

SEQ ID NO: 811643 - DNA, 25 bp, Mus musculus
tgctgaactgtagcctaaaatcaag

SEQ ID NO: 811644 - DNA, 25 bp, Mus musculus
tgctgaactttcacggcagagtcac

SEQ ID NO: 811645 - DNA, 25 bp, Mus musculus
tgctgaactttctcggcagagtcac

SEQ ID NO: 811646 - DNA, 25 bp, Mus musculus
tgctgaagaaaccacctaccctaga

SEQ ID NO: 811647 - DNA, 25 bp, Mus musculus
tgctgaagaaacgacctaccctaga

SEQ ID NO: 811648 - DNA, 25 bp, Mus musculus
tgctgaagaaagaacacgagtgctg

SEQ ID NO: 811649 - DNA, 25 bp, Mus musculus
tgctgaagaaagtacacgagtgctg

SEQ ID NO: 811650 - DNA, 25 bp, Mus musculus
tgctgaagaacaagtcgcagcgcat

SEQ ID NO: 811651 - DNA, 25 bp, Mus musculus
tgctgaagaacacccccctagtgag

SEQ ID NO: 811652 - DNA, 25 bp, Mus musculus
tgctgaagaacagccccctagtgag

SEQ ID NO: 811653 - DNA, 25 bp, Mus musculus
tgctgaagaacatgtcgcagcgcat

SEQ ID NO: 811654 - DNA, 25 bp, Mus musculus
tgctgaagaagaactgcccacacat

SEQ ID NO: 811655 - DNA, 25 bp, Mus musculus
tgctgaagaagatctgcccacacat

SEQ ID NO: 811656 - DNA, 25 bp, Mus musculus
tgctgaagaagccatggtggacaac

SEQ ID NO: 811657 - DNA, 25 bp, Mus musculus
tgctgaagaagcgatggtggacaac

SEQ ID NO: 811658 - DNA, 25 bp, Mus musculus
tgctgaagaaggctacctatgacaa

SEQ ID NO: 811659 - DNA, 25 bp, Mus musculus
tgctgaagaagggtacctatgacaa

SEQ ID NO: 811660 - DNA, 25 bp, Mus musculus
tgctgaagaagtattctcatcatcg

SEQ ID NO: 811661 - DNA, 25 bp, Mus musculus
tgctgaagaagttttctcatcatcg

SEQ ID NO: 811662 - DNA, 25 bp, Mus musculus
tgctgaagactacgatgatgatcct

SEQ ID NO: 811663 - DNA, 25 bp, Mus musculus
tgctgaagactaggatgatgatcct

SEQ ID NO: 811664 - DNA, 25 bp, Mus musculus
tgctgaagactcctgtcagccggga

SEQ ID NO: 811665 - DNA, 25 bp, Mus musculus
tgctgaagactcgtgtcagccggga

SEQ ID NO: 811666 - DNA, 25 bp, Mus musculus
tgctgaagatcaactgctacctgga

SEQ ID NO: 811667 - DNA, 25 bp, Mus musculus
tgctgaagatcatctgctacctgga

SEQ ID NO: 811668 - DNA, 25 bp, Mus musculus
tgctgaagatcccaaggcgaaagat

SEQ ID NO: 811669 - DNA, 25 bp, Mus musculus
tgctgaagatccgaaggcgaaagat

SEQ ID NO: 811670 - DNA, 25 bp, Mus musculus
tgctgaagatgcaggcacactaccg

SEQ ID NO: 811671 - DNA, 25 bp, Mus musculus
tgctgaagatgctggcacactaccg

SEQ ID NO: 811672 - DNA, 25 bp, Mus musculus
tgctgaaggacacaattcactgtgt

SEQ ID NO: 811673 - DNA, 25 bp, Mus musculus
tgctgaaggacagaattcactgtgt

SEQ ID NO: 811674 - DNA, 25 bp, Mus musculus
tgctgaaggaccacaactttcaaga

SEQ ID NO: 811675 - DNA, 25 bp, Mus musculus
tgctgaaggacctcaactttcaaga

SEQ ID NO: 811676 - DNA, 25 bp, Mus musculus
tgctgaaggaggagcatcccacgtg

SEQ ID NO: 811677 - DNA, 25 bp, Mus musculus
tgctgaaggaggtgcatcccacgtg

SEQ ID NO: 811678 - DNA, 25 bp, Mus musculus
tgctgaaggatgaggtgcgcaccct

SEQ ID NO: 811679 - DNA, 25 bp, Mus musculus
tgctgaaggatgtggtgcgcaccct

SEQ ID NO: 811680 - DNA, 25 bp, Mus musculus
tgctgaagggcaccaccaaagcctt

SEQ ID NO: 811681 - DNA, 25 bp, Mus musculus
tgctgaagggcagcaccaaagcctt

SEQ ID NO: 811682 - DNA, 25 bp, Mus musculus
tgctgaaggtggcaattctgtacct

SEQ ID NO: 811683 - DNA, 25 bp, Mus musculus
tgctgaaggtgggaattctgtacct

SEQ ID NO: 811684 - DNA, 25 bp, Mus musculus
tgctgaagtacaagatagagtacgg

SEQ ID NO: 811685 - DNA, 25 bp, Mus musculus
tgctgaagtacacccagaaagacct

SEQ ID NO: 811686 - DNA, 25 bp, Mus musculus
tgctgaagtacagccagaaagacct

SEQ ID NO: 811687 - DNA, 25 bp, Mus musculus
tgctgaagtacatgatagagtacgg

SEQ ID NO: 811688 - DNA, 25 bp, Mus musculus
tgctgaagtggcagagcattcacgt

SEQ ID NO: 811689 - DNA, 25 bp, Mus musculus
tgctgaagtggctgagcattcacgt

SEQ ID NO: 811690 - DNA, 25 bp, Mus musculus
tgctgaatatctagctgcagagaga

SEQ ID NO: 811691 - DNA, 25 bp, Mus musculus
tgctgaatatcttgctgcagagaga

SEQ ID NO: 811692 - DNA, 25 bp, Mus musculus
tgctgaatatgccaggccccccaaa

SEQ ID NO: 811693 - DNA, 25 bp, Mus musculus
tgctgaatatgcgaggccccccaaa

SEQ ID NO: 811694 - DNA, 25 bp, Mus musculus
tgctgaatcacacgccgatgactgc

SEQ ID NO: 811695 - DNA, 25 bp, Mus musculus
tgctgaatcacaggccgatgactgc

SEQ ID NO: 811696 - DNA, 25 bp, Mus musculus
tgctgaatcctgctaaataacctgg

SEQ ID NO: 811697 - DNA, 25 bp, Mus musculus
tgctgaatcctggtaaataacctgg

SEQ ID NO: 811698 - DNA, 25 bp, Mus musculus
tgctgaatctctaccacaaccagat

SEQ ID NO: 811699 - DNA, 25 bp, Mus musculus
tgctgaatctcttccacaaccagat

SEQ ID NO: 811700 - DNA, 25 bp, Mus musculus
tgctgaatgacaccaaaagccctcc

SEQ ID NO: 811701 - DNA, 25 bp, Mus musculus
tgctgaatgacagcaaaagccctcc

SEQ ID NO: 811702 - DNA, 25 bp, Mus musculus
tgctgaatgcaaagaaatggcggga

SEQ ID NO: 811703 - DNA, 25 bp, Mus musculus
tgctgaatgcaatgaaatggcggga

SEQ ID NO: 811704 - DNA, 25 bp, Mus musculus
tgctgaatgggcaccttgatcggcc

SEQ ID NO: 811705 - DNA, 25 bp, Mus musculus
tgctgaatgggctccttgatcggcc

SEQ ID NO: 811706 - DNA, 25 bp, Mus musculus
tgctgaattacacgaccattccggt

SEQ ID NO: 811707 - DNA, 25 bp, Mus musculus
tgctgaattacaggaccattccggt

SEQ ID NO: 811708 - DNA, 25 bp, Mus musculus
tgctgaatttcaccggtacaattcc

SEQ ID NO: 811709 - DNA, 25 bp, Mus musculus
tgctgaatttcagcggtacaattcc

SEQ ID NO: 811710 - DNA, 25 bp, Mus musculus
tgctgaattttaagccatgtggtct

SEQ ID NO: 811711 - DNA, 25 bp, Mus musculus
tgctgaattttatgccatgtggtct

SEQ ID NO: 811712 - DNA, 25 bp, Mus musculus
tgctgacacagacgacagtttctct

SEQ ID NO: 811713 - DNA, 25 bp, Mus musculus
tgctgacacagaggacagtttctct

SEQ ID NO: 811714 - DNA, 25 bp, Mus musculus
tgctgacacatgcatactggctctg

SEQ ID NO: 811715 - DNA, 25 bp, Mus musculus
tgctgacacatggatactggctctg

SEQ ID NO: 811716 - DNA, 25 bp, Mus musculus
tgctgacagcacaattcctcgaaca

SEQ ID NO: 811717 - DNA, 25 bp, Mus musculus
tgctgacagcactattcctcgaaca

SEQ ID NO: 811718 - DNA, 25 bp, Mus musculus
tgctgacagggcctactcctggtac

SEQ ID NO: 811719 - DNA, 25 bp, Mus musculus
tgctgacagggcgtactcctggtac

SEQ ID NO: 811720 - DNA, 25 bp, Mus musculus
tgctgacatgataccttgcatcctg

SEQ ID NO: 811721 - DNA, 25 bp, Mus musculus
tgctgacatgattccttgcatcctg

SEQ ID NO: 811722 - DNA, 25 bp, Mus musculus
tgctgacattccaatgatgttaaaa

SEQ ID NO: 811723 - DNA, 25 bp, Mus musculus
tgctgacattcctatgatgttaaaa

SEQ ID NO: 811724 - DNA, 25 bp, Mus musculus
tgctgacattgcagatcaattgctc

SEQ ID NO: 811725 - DNA, 25 bp, Mus musculus
tgctgacattgctgatcaattgctc

SEQ ID NO: 811726 - DNA, 25 bp, Mus musculus
tgctgaccacgcacactgctcagga

SEQ ID NO: 811727 - DNA, 25 bp, Mus musculus
tgctgaccacgctcactgctcagga

SEQ ID NO: 811728 - DNA, 25 bp, Mus musculus
tgctgaccatcaagatcgatcctgg

SEQ ID NO: 811729 - DNA, 25 bp, Mus musculus
tgctgaccatcatgatcgatcctgg

SEQ ID NO: 811730 - DNA, 25 bp, Mus musculus
tgctgaccatctaagctgcaaagcc

SEQ ID NO: 811731 - DNA, 25 bp, Mus musculus
tgctgaccatcttagctgcaaagcc

SEQ ID NO: 811732 - DNA, 25 bp, Mus musculus
tgctgacccaccagcagttcagtag

SEQ ID NO: 811733 - DNA, 25 bp, Mus musculus
tgctgacccacctgcagttcagtag

SEQ ID NO: 811734 - DNA, 25 bp, Mus musculus
tgctgacccagcataagcgactgga

SEQ ID NO: 811735 - DNA, 25 bp, Mus musculus
tgctgacccagcttaagcgactgga

SEQ ID NO: 811736 - DNA, 25 bp, Mus musculus
tgctgacccttaactatcacccttg

SEQ ID NO: 811737 - DNA, 25 bp, Mus musculus
tgctgacccttatctatcacccttg

SEQ ID NO: 811738 - DNA, 25 bp, Mus musculus
tgctgaccggcgagttcgcgcagct

SEQ ID NO: 811739 - DNA, 25 bp, Mus musculus
tgctgaccggcgtgttcgcgcagct

SEQ ID NO: 811740 - DNA, 25 bp, Mus musculus
tgctgacctagcacccagatctcag

SEQ ID NO: 811741 - DNA, 25 bp, Mus musculus
tgctgacctagctcccagatctcag

SEQ ID NO: 811742 - DNA, 25 bp, Mus musculus
tgctgacctcacatatggacattga

SEQ ID NO: 811743 - DNA, 25 bp, Mus musculus
tgctgacctcacttatggacattga

SEQ ID NO: 811744 - DNA, 25 bp, Mus musculus
tgctgacctggcatgcaggaagctg

SEQ ID NO: 811745 - DNA, 25 bp, Mus musculus
tgctgacctggcttgcaggaagctg

SEQ ID NO: 811746 - DNA, 25 bp, Mus musculus
tgctgacctttgcatacctagtgct

SEQ ID NO: 811747 - DNA, 25 bp, Mus musculus
tgctgacctttggatacctagtgct

SEQ ID NO: 811748 - DNA, 25 bp, Mus musculus
tgctgacgagacaagcacatattcc

SEQ ID NO: 811749 - DNA, 25 bp, Mus musculus
tgctgacgagactagcacatattcc

SEQ ID NO: 811750 - DNA, 25 bp, Mus musculus
tgctgacgatttagctaagcaaacc

SEQ ID NO: 811751 - DNA, 25 bp, Mus musculus
tgctgacgattttgctaagcaaacc

SEQ ID NO: 811752 - DNA, 25 bp, Mus musculus
tgctgacgcacaattccctggacta

SEQ ID NO: 811753 - DNA, 25 bp, Mus musculus
tgctgacgcacatttccctggacta

SEQ ID NO: 811754 - DNA, 25 bp, Mus musculus
tgctgacggactcctggttaggaac

SEQ ID NO: 811755 - DNA, 25 bp, Mus musculus
tgctgacggactgctggttaggaac

SEQ ID NO: 811756 - DNA, 25 bp, Mus musculus
tgctgacggagcagatactacggcg

SEQ ID NO: 811757 - DNA, 25 bp, Mus musculus
tgctgacggagctgatactacggcg

SEQ ID NO: 811758 - DNA, 25 bp, Mus musculus
tgctgacgtgaaagtgaccttgacc

SEQ ID NO: 811759 - DNA, 25 bp, Mus musculus
tgctgacgtgaatgtgaccttgacc

SEQ ID NO: 811760 - DNA, 25 bp, Mus musculus
tgctgacgtggcacaacagtgggca

SEQ ID NO: 811761 - DNA, 25 bp, Mus musculus
tgctgacgtggctcaacagtgggca

SEQ ID NO: 811762 - DNA, 25 bp, Mus musculus
tgctgacgtttcagaggacagcgct

SEQ ID NO: 811763 - DNA, 25 bp, Mus musculus
tgctgacgtttctgaggacagcgct

SEQ ID NO: 811764 - DNA, 25 bp, Mus musculus
tgctgactaattctgccatgagacc

SEQ ID NO: 811765 - DNA, 25 bp, Mus musculus
tgctgactaattgtgccatgagacc

SEQ ID NO: 811766 - DNA, 25 bp, Mus musculus
tgctgactatccactctaccttcgt

SEQ ID NO: 811767 - DNA, 25 bp, Mus musculus
tgctgactatcctctctaccttcgt

SEQ ID NO: 811768 - DNA, 25 bp, Mus musculus
tgctgactatctatcagggcaaaga

SEQ ID NO: 811769 - DNA, 25 bp, Mus musculus
tgctgactatctttcagggcaaaga

SEQ ID NO: 811770 - DNA, 25 bp, Mus musculus
tgctgactatgcagagcaagatgag

SEQ ID NO: 811771 - DNA, 25 bp, Mus musculus
tgctgactatgctgagcaagatgag

SEQ ID NO: 811772 - DNA, 25 bp, Mus musculus
tgctgactcattcttgtgggttttg

SEQ ID NO: 811773 - DNA, 25 bp, Mus musculus
tgctgactcattgttgtgggttttg

SEQ ID NO: 811774 - DNA, 25 bp, Mus musculus
tgctgactgcaaacccacgaattta

SEQ ID NO: 811775 - DNA, 25 bp, Mus musculus
tgctgactgcaatcccacgaattta

SEQ ID NO: 811776 - DNA, 25 bp, Mus musculus
tgctgactgcagaggtataagagga

SEQ ID NO: 811777 - DNA, 25 bp, Mus musculus
tgctgactgcagtggtataagagga

SEQ ID NO: 811778 - DNA, 25 bp, Mus musculus
tgctgactgtcaatcaggccattgg

SEQ ID NO: 811779 - DNA, 25 bp, Mus musculus
tgctgactgtcattcaggccattgg

SEQ ID NO: 811780 - DNA, 25 bp, Mus musculus
tgctgactgtccaggtgtctgtgcc

SEQ ID NO: 811781 - DNA, 25 bp, Mus musculus
tgctgactgtcctggtgtctgtgcc

SEQ ID NO: 811782 - DNA, 25 bp, Mus musculus
tgctgactgtggagcaggcgctggc

SEQ ID NO: 811783 - DNA, 25 bp, Mus musculus
tgctgactgtggtgcaggcgctggc

SEQ ID NO: 811784 - DNA, 25 bp, Mus musculus
tgctgacttcctcctcgaaagctac

SEQ ID NO: 811785 - DNA, 25 bp, Mus musculus
tgctgacttcctgctcgaaagctac

SEQ ID NO: 811786 - DNA, 25 bp, Mus musculus
tgctgagaaactaacaggcccaatg

SEQ ID NO: 811787 - DNA, 25 bp, Mus musculus
tgctgagaaacttacaggcccaatg

SEQ ID NO: 811788 - DNA, 25 bp, Mus musculus
tgctgagaaccacgtggcttccctc

SEQ ID NO: 811789 - DNA, 25 bp, Mus musculus
tgctgagaaccaggtggcttccctc

SEQ ID NO: 811790 - DNA, 25 bp, Mus musculus
tgctgagaaccgctactttgaaatg

SEQ ID NO: 811791 - DNA, 25 bp, Mus musculus
tgctgagaaccggtactttgaaatg

SEQ ID NO: 811792 - DNA, 25 bp, Mus musculus
tgctgagaacctaagcagggagact

SEQ ID NO: 811793 - DNA, 25 bp, Mus musculus
tgctgagaaccttagcagggagact

SEQ ID NO: 811794 - DNA, 25 bp, Mus musculus
tgctgagaatcgagccaataagaag

SEQ ID NO: 811795 - DNA, 25 bp, Mus musculus
tgctgagaatcgtgccaataagaag

SEQ ID NO: 811796 - DNA, 25 bp, Mus musculus
tgctgagaatgaacctccagagaaa

SEQ ID NO: 811797 - DNA, 25 bp, Mus musculus
tgctgagaatgatcctccagagaaa

SEQ ID NO: 811798 - DNA, 25 bp, Mus musculus
tgctgagacacaatatacatatttc

SEQ ID NO: 811799 - DNA, 25 bp, Mus musculus
tgctgagacacattatacatatttc

SEQ ID NO: 811800 - DNA, 25 bp, Mus musculus
tgctgagactgtacgagactgttgc

SEQ ID NO: 811801 - DNA, 25 bp, Mus musculus
tgctgagactgttcgagactgttgc

SEQ ID NO: 811802 - DNA, 25 bp, Mus musculus
tgctgagagagcattactgattgat

SEQ ID NO: 811803 - DNA, 25 bp, Mus musculus
tgctgagagagctttactgattgat

SEQ ID NO: 811804 - DNA, 25 bp, Mus musculus
tgctgagagcatagcattccgcagg

SEQ ID NO: 811805 - DNA, 25 bp, Mus musculus
tgctgagagcattgcattccgcagg

SEQ ID NO: 811806 - DNA, 25 bp, Mus musculus
tgctgagagggccaagtttctctct

SEQ ID NO: 811807 - DNA, 25 bp, Mus musculus
tgctgagagggcgaagtttctctct

SEQ ID NO: 811808 - DNA, 25 bp, Mus musculus
tgctgagatagtcggttcgaagtca

SEQ ID NO: 811809 - DNA, 25 bp, Mus musculus
tgctgagatagtgggttcgaagtca

SEQ ID NO: 811810 - DNA, 25 bp, Mus musculus
tgctgagatatcctgctgatcctta

SEQ ID NO: 811811 - DNA, 25 bp, Mus musculus
tgctgagatatcgtgctgatcctta

SEQ ID NO: 811812 - DNA, 25 bp, Mus musculus
tgctgagatcaactctcaagtacgg

SEQ ID NO: 811813 - DNA, 25 bp, Mus musculus
tgctgagatcaagtctcaagtacgg

SEQ ID NO: 811814 - DNA, 25 bp, Mus musculus
tgctgagatccacggcgctctgcat

SEQ ID NO: 811815 - DNA, 25 bp, Mus musculus
tgctgagatccagggcgctctgcat

SEQ ID NO: 811816 - DNA, 25 bp, Mus musculus
tgctgagcacgtcggtacctgtaca

SEQ ID NO: 811817 - DNA, 25 bp, Mus musculus
tgctgagcacgtgggtacctgtaca

SEQ ID NO: 811818 - DNA, 25 bp, Mus musculus
tgctgagcccgtactaagggtccag

SEQ ID NO: 811819 - DNA, 25 bp, Mus musculus
tgctgagcccgttctaagggtccag

SEQ ID NO: 811820 - DNA, 25 bp, Mus musculus
tgctgagccctgatcactctctatc

SEQ ID NO: 811821 - DNA, 25 bp, Mus musculus
tgctgagccctgttcactctctatc

SEQ ID NO: 811822 - DNA, 25 bp, Mus musculus
tgctgagccgccaactgggccagac

SEQ ID NO: 811823 - DNA, 25 bp, Mus musculus
tgctgagccgcctactgggccagac

SEQ ID NO: 811824 - DNA, 25 bp, Mus musculus
tgctgagcctatagtggatgtgctg

SEQ ID NO: 811825 - DNA, 25 bp, Mus musculus
tgctgagcctattgtggatgtgctg

SEQ ID NO: 811826 - DNA, 25 bp, Mus musculus
tgctgagcctctcgccagatagagt

SEQ ID NO: 811827 - DNA, 25 bp, Mus musculus
tgctgagcctctggccagatagagt

SEQ ID NO: 811828 - DNA, 25 bp, Mus musculus
tgctgagcgagcagttagaacacct

SEQ ID NO: 811829 - DNA, 25 bp, Mus musculus
tgctgagcgagctgttagaacacct

SEQ ID NO: 811830 - DNA, 25 bp, Mus musculus
tgctgagcgagtcgacagcaccacc

SEQ ID NO: 811831 - DNA, 25 bp, Mus musculus
tgctgagcgagtggacagcaccacc

SEQ ID NO: 811832 - DNA, 25 bp, Mus musculus
tgctgagcgatgacctacaggctgg

SEQ ID NO: 811833 - DNA, 25 bp, Mus musculus
tgctgagcgatgtcctacaggctgg

SEQ ID NO: 811834 - DNA, 25 bp, Mus musculus
tgctgagcgcagagcctactacaag

SEQ ID NO: 811835 - DNA, 25 bp, Mus musculus
tgctgagcgcagtgcctactacaag

SEQ ID NO: 811836 - DNA, 25 bp, Mus musculus
tgctgagctgtgacaggaggctcat

SEQ ID NO: 811837 - DNA, 25 bp, Mus musculus
tgctgagctgtgtcaggaggctcat

SEQ ID NO: 811838 - DNA, 25 bp, Mus musculus
tgctgagcttataggattttaatcc

SEQ ID NO: 811839 - DNA, 25 bp, Mus musculus
tgctgagcttattggattttaatcc

SEQ ID NO: 811840 - DNA, 25 bp, Mus musculus
tgctgagcttgtcaggtgtccctga

SEQ ID NO: 811841 - DNA, 25 bp, Mus musculus
tgctgagcttgtgaggtgtccctga

SEQ ID NO: 811842 - DNA, 25 bp, Mus musculus
tgctgaggaaccagagacagatggc

SEQ ID NO: 811843 - DNA, 25 bp, Mus musculus
tgctgaggaacctgagacagatggc

SEQ ID NO: 811844 - DNA, 25 bp, Mus musculus
tgctgaggacaaagaacttgccagg

SEQ ID NO: 811845 - DNA, 25 bp, Mus musculus
tgctgaggacaactcggaccggaat

SEQ ID NO: 811846 - DNA, 25 bp, Mus musculus
tgctgaggacaagtcggaccggaat

SEQ ID NO: 811847 - DNA, 25 bp, Mus musculus
tgctgaggacaatgaacttgccagg

SEQ ID NO: 811848 - DNA, 25 bp, Mus musculus
tgctgaggacagcaagccactgctt

SEQ ID NO: 811849 - DNA, 25 bp, Mus musculus
tgctgaggacaggaagccactgctt

SEQ ID NO: 811850 - DNA, 25 bp, Mus musculus
tgctgaggcagtatgacctggcctg

SEQ ID NO: 811851 - DNA, 25 bp, Mus musculus
tgctgaggcagtttgacctggcctg

SEQ ID NO: 811852 - DNA, 25 bp, Mus musculus
tgctgaggccagcaaaggactcgct

SEQ ID NO: 811853 - DNA, 25 bp, Mus musculus
tgctgaggccaggaaaggactcgct

SEQ ID NO: 811854 - DNA, 25 bp, Mus musculus
tgctgaggccctcgtcagcaaaggc

SEQ ID NO: 811855 - DNA, 25 bp, Mus musculus
tgctgaggccctggtcagcaaaggc

SEQ ID NO: 811856 - DNA, 25 bp, Mus musculus
tgctgaggctccaacgagatcaaga

SEQ ID NO: 811857 - DNA, 25 bp, Mus musculus
tgctgaggctcctacgagatcaaga

SEQ ID NO: 811858 - DNA, 25 bp, Mus musculus
tgctgaggctctactttgatgatgc

SEQ ID NO: 811859 - DNA, 25 bp, Mus musculus
tgctgaggctcttctttgatgatgc

SEQ ID NO: 811860 - DNA, 25 bp, Mus musculus
tgctgaggctgaccaaatggccaag

SEQ ID NO: 811861 - DNA, 25 bp, Mus musculus
tgctgaggctgagcaaatggccaag

SEQ ID NO: 811862 - DNA, 25 bp, Mus musculus
tgctgagggagccatccccatgttt

SEQ ID NO: 811863 - DNA, 25 bp, Mus musculus
tgctgagggagcgatccccatgttt

SEQ ID NO: 811864 - DNA, 25 bp, Mus musculus
tgctgagggcaccagcctattgcct

SEQ ID NO: 811865 - DNA, 25 bp, Mus musculus
tgctgagggcacgagcctattgcct

SEQ ID NO: 811866 - DNA, 25 bp, Mus musculus
tgctgaggtccgcacagcatcccag

SEQ ID NO: 811867 - DNA, 25 bp, Mus musculus
tgctgaggtccggacagcatcccag

SEQ ID NO: 811868 - DNA, 25 bp, Mus musculus
tgctgagtaacaccaaactctgaag

SEQ ID NO: 811869 - DNA, 25 bp, Mus musculus
tgctgagtaacagcaaactctgaag

SEQ ID NO: 811870 - DNA, 25 bp, Mus musculus
tgctgagtacctagccagtgagaac

SEQ ID NO: 811871 - DNA, 25 bp, Mus musculus
tgctgagtaccttgccagtgagaac

SEQ ID NO: 811872 - DNA, 25 bp, Mus musculus
tgctgagtacgtcgagcatctccgc

SEQ ID NO: 811873 - DNA, 25 bp, Mus musculus
tgctgagtacgtggagcatctccgc

SEQ ID NO: 811874 - DNA, 25 bp, Mus musculus
tgctgagtcaggaccactcgtccac

SEQ ID NO: 811875 - DNA, 25 bp, Mus musculus
tgctgagtcaggtccactcgtccac

SEQ ID NO: 811876 - DNA, 25 bp, Mus musculus
tgctgagtgcctacatgaggatgaa

SEQ ID NO: 811877 - DNA, 25 bp, Mus musculus
tgctgagtgccttcatgaggatgaa

SEQ ID NO: 811878 - DNA, 25 bp, Mus musculus
tgctgagtgtcaactgaatcccatc

SEQ ID NO: 811879 - DNA, 25 bp, Mus musculus
tgctgagtgtcatctgaatcccatc

SEQ ID NO: 811880 - DNA, 25 bp, Mus musculus
tgctgagttggcctctctctgcagg

SEQ ID NO: 811881 - DNA, 25 bp, Mus musculus
tgctgagttggcgtctctctgcagg

SEQ ID NO: 811882 - DNA, 25 bp, Mus musculus
tgctgataatggaggtattggccaa

SEQ ID NO: 811883 - DNA, 25 bp, Mus musculus
tgctgataatggtggtattggccaa

SEQ ID NO: 811884 - DNA, 25 bp, Mus musculus
tgctgatactgtaaaaaatgatggc

SEQ ID NO: 811885 - DNA, 25 bp, Mus musculus
tgctgatactgttaaaaatgatggc

SEQ ID NO: 811886 - DNA, 25 bp, Mus musculus
tgctgatagtaaatccttggagatc

SEQ ID NO: 811887 - DNA, 25 bp, Mus musculus
tgctgatagtaattccttggagatc

SEQ ID NO: 811888 - DNA, 25 bp, Mus musculus
tgctgatataccctgacccatcaga

SEQ ID NO: 811889 - DNA, 25 bp, Mus musculus
tgctgatataccgtgacccatcaga

SEQ ID NO: 811890 - DNA, 25 bp, Mus musculus
tgctgatattagattgacatccatc

SEQ ID NO: 811891 - DNA, 25 bp, Mus musculus
tgctgatattagtttgacatccatc

SEQ ID NO: 811892 - DNA, 25 bp, Mus musculus
tgctgatcaacaaggatatccggtg

SEQ ID NO: 811893 - DNA, 25 bp, Mus musculus
tgctgatcaacatggatatccggtg

SEQ ID NO: 811894 - DNA, 25 bp, Mus musculus
tgctgatcaagaagtgtctcctgac

SEQ ID NO: 811895 - DNA, 25 bp, Mus musculus
tgctgatcaagatgtgtctcctgac

SEQ ID NO: 811896 - DNA, 25 bp, Mus musculus
tgctgatcaggacgtgcgatcgctt

SEQ ID NO: 811897 - DNA, 25 bp, Mus musculus
tgctgatcaggaggtgcgatcgctt

SEQ ID NO: 811898 - DNA, 25 bp, Mus musculus
tgctgatcctaaatctggccatatt

SEQ ID NO: 811899 - DNA, 25 bp, Mus musculus
tgctgatcctaattctggccatatt

SEQ ID NO: 811900 - DNA, 25 bp, Mus musculus
tgctgatcctcaacgcacaggtgac

SEQ ID NO: 811901 - DNA, 25 bp, Mus musculus
tgctgatcctcatcgcacaggtgac

SEQ ID NO: 811902 - DNA, 25 bp, Mus musculus
tgctgatcctctcggcactgaagga

SEQ ID NO: 811903 - DNA, 25 bp, Mus musculus
tgctgatcctctgggcactgaagga

SEQ ID NO: 811904 - DNA, 25 bp, Mus musculus
tgctgatcggcgacaggctctactc

SEQ ID NO: 811905 - DNA, 25 bp, Mus musculus
tgctgatcggcgtcaggctctactc

SEQ ID NO: 811906 - DNA, 25 bp, Mus musculus
tgctgatcgggcacagcgccatcga

SEQ ID NO: 811907 - DNA, 25 bp, Mus musculus
tgctgatcgggctcagcgccatcga

SEQ ID NO: 811908 - DNA, 25 bp, Mus musculus
tgctgatctctcaggccatgggtct

SEQ ID NO: 811909 - DNA, 25 bp, Mus musculus
tgctgatctctctggccatgggtct

SEQ ID NO: 811910 - DNA, 25 bp, Mus musculus
tgctgatcttggcttggtacctaat

SEQ ID NO: 811911 - DNA, 25 bp, Mus musculus
tgctgatcttgggttggtacctaat

SEQ ID NO: 811912 - DNA, 25 bp, Mus musculus
tgctgatctttcaagtgtccccacc

SEQ ID NO: 811913 - DNA, 25 bp, Mus musculus
tgctgatctttctagtgtccccacc

SEQ ID NO: 811914 - DNA, 25 bp, Mus musculus
tgctgatgaagaaagttacaggact

SEQ ID NO: 811915 - DNA, 25 bp, Mus musculus
tgctgatgaagatagttacaggact

SEQ ID NO: 811916 - DNA, 25 bp, Mus musculus
tgctgatgacagatgtgctcgtgtt

SEQ ID NO: 811917 - DNA, 25 bp, Mus musculus
tgctgatgacagttgtgctcgtgtt

SEQ ID NO: 811918 - DNA, 25 bp, Mus musculus
tgctgatgagtcaggatctgacact

SEQ ID NO: 811919 - DNA, 25 bp, Mus musculus
tgctgatgagtctggatctgacact

SEQ ID NO: 811920 - DNA, 25 bp, Mus musculus
tgctgatgataccagaaaagtacac

SEQ ID NO: 811921 - DNA, 25 bp, Mus musculus
tgctgatgatacgagaaaagtacac

SEQ ID NO: 811922 - DNA, 25 bp, Mus musculus
tgctgatgcaacaggtcaagaactc

SEQ ID NO: 811923 - DNA, 25 bp, Mus musculus
tgctgatgcaactggtcaagaactc

SEQ ID NO: 811924 - DNA, 25 bp, Mus musculus
tgctgatgctggctatcggaagcat

SEQ ID NO: 811925 - DNA, 25 bp, Mus musculus
tgctgatgctgggtatcggaagcat

SEQ ID NO: 811926 - DNA, 25 bp, Mus musculus
tgctgatggaatcgatcaacaccac

SEQ ID NO: 811927 - DNA, 25 bp, Mus musculus
tgctgatggaatggatcaacaccac

SEQ ID NO: 811928 - DNA, 25 bp, Mus musculus
tgctgatggcagagggtaacccgcc

SEQ ID NO: 811929 - DNA, 25 bp, Mus musculus
tgctgatggcagtgggtaacccgcc

SEQ ID NO: 811930 - DNA, 25 bp, Mus musculus
tgctgatggcccacaaggatgtggc

SEQ ID NO: 811931 - DNA, 25 bp, Mus musculus
tgctgatggccctcaaggatgtggc

SEQ ID NO: 811932 - DNA, 25 bp, Mus musculus
tgctgatgtaagacgggctcagctg

SEQ ID NO: 811933 - DNA, 25 bp, Mus musculus
tgctgatgtaagtcgggctcagctg

SEQ ID NO: 811934 - DNA, 25 bp, Mus musculus
tgctgatgtaccacagttgagtagg

SEQ ID NO: 811935 - DNA, 25 bp, Mus musculus
tgctgatgtacctcagttgagtagg

SEQ ID NO: 811936 - DNA, 25 bp, Mus musculus
tgctgatgtactcgctgccctggtg

SEQ ID NO: 811937 - DNA, 25 bp, Mus musculus
tgctgatgtactggctgccctggtg

SEQ ID NO: 811938 - DNA, 25 bp, Mus musculus
tgctgatgtaggaacactgcagaga

SEQ ID NO: 811939 - DNA, 25 bp, Mus musculus
tgctgatgtaggtacactgcagaga

SEQ ID NO: 811940 - DNA, 25 bp, Mus musculus
tgctgatgtgctagtgtcacaggtg

SEQ ID NO: 811941 - DNA, 25 bp, Mus musculus
tgctgatgtgcttgtgtcacaggtg

SEQ ID NO: 811942 - DNA, 25 bp, Mus musculus
tgctgattattgatagcacctaata

SEQ ID NO: 811943 - DNA, 25 bp, Mus musculus
tgctgattattgttagcacctaata

SEQ ID NO: 811944 - DNA, 25 bp, Mus musculus
tgctgattcaggaatggttcaccct

SEQ ID NO: 811945 - DNA, 25 bp, Mus musculus
tgctgattcaggtatggttcaccct

SEQ ID NO: 811946 - DNA, 25 bp, Mus musculus
tgctgattctatagctgagcagatc

SEQ ID NO: 811947 - DNA, 25 bp, Mus musculus
tgctgattctattgctgagcagatc

SEQ ID NO: 811948 - DNA, 25 bp, Mus musculus
tgctgattgtctcaaccgtggttgt

SEQ ID NO: 811949 - DNA, 25 bp, Mus musculus
tgctgattgtctgaaccgtggttgt

SEQ ID NO: 811950 - DNA, 25 bp, Mus musculus
tgctgattgtgtactaagggtcgga

SEQ ID NO: 811951 - DNA, 25 bp, Mus musculus
tgctgattgtgttctaagggtcgga

SEQ ID NO: 811952 - DNA, 25 bp, Mus musculus
tgctgatttcggctccagtgagcgc

SEQ ID NO: 811953 - DNA, 25 bp, Mus musculus
tgctgatttcgggtccagtgagcgc

SEQ ID NO: 811954 - DNA, 25 bp, Mus musculus
tgctgattttcccagatcagtcttc

SEQ ID NO: 811955 - DNA, 25 bp, Mus musculus
tgctgattttccgagatcagtcttc

SEQ ID NO: 811956 - DNA, 25 bp, Mus musculus
tgctgcaaagatcatagtgatggcc

SEQ ID NO: 811957 - DNA, 25 bp, Mus musculus
tgctgcaaagatgatagtgatggcc

SEQ ID NO: 811958 - DNA, 25 bp, Mus musculus
tgctgcaaccagcacgacagatgct

SEQ ID NO: 811959 - DNA, 25 bp, Mus musculus
tgctgcaaccaggacgacagatgct

SEQ ID NO: 811960 - DNA, 25 bp, Mus musculus
tgctgcaacctcacttgccacagtg

SEQ ID NO: 811961 - DNA, 25 bp, Mus musculus
tgctgcaacctctcttgccacagtg

SEQ ID NO: 811962 - DNA, 25 bp, Mus musculus
tgctgcaagactcagaaaggtgaca

SEQ ID NO: 811963 - DNA, 25 bp, Mus musculus
tgctgcaagactgagaaaggtgaca

SEQ ID NO: 811964 - DNA, 25 bp, Mus musculus
tgctgcaagcccaggtatatgacgc

SEQ ID NO: 811965 - DNA, 25 bp, Mus musculus
tgctgcaagccctggtatatgacgc

SEQ ID NO: 811966 - DNA, 25 bp, Mus musculus
tgctgcaatgcacgagagctttgga

SEQ ID NO: 811967 - DNA, 25 bp, Mus musculus
tgctgcaatgcaggagagctttgga

SEQ ID NO: 811968 - DNA, 25 bp, Mus musculus
tgctgcacaactagggccgaaggtc

SEQ ID NO: 811969 - DNA, 25 bp, Mus musculus
tgctgcacaacttgggccgaaggtc

SEQ ID NO: 811970 - DNA, 25 bp, Mus musculus
tgctgcacaagtactcgggctacgg

SEQ ID NO: 811971 - DNA, 25 bp, Mus musculus
tgctgcacaagttctcgggctacgg

SEQ ID NO: 811972 - DNA, 25 bp, Mus musculus
tgctgcacacggactctacttcaca

SEQ ID NO: 811973 - DNA, 25 bp, Mus musculus
tgctgcacacggtctctacttcaca

SEQ ID NO: 811974 - DNA, 25 bp, Mus musculus
tgctgcacagttcgatgtattaaac

SEQ ID NO: 811975 - DNA, 25 bp, Mus musculus
tgctgcacagttggatgtattaaac

SEQ ID NO: 811976 - DNA, 25 bp, Mus musculus
tgctgcaccactctcagactgggct

SEQ ID NO: 811977 - DNA, 25 bp, Mus musculus
tgctgcaccactgtcagactgggct

SEQ ID NO: 811978 - DNA, 25 bp, Mus musculus
tgctgcaccgatcacgtgtttgcct

SEQ ID NO: 811979 - DNA, 25 bp, Mus musculus
tgctgcaccgatgacgtgtttgcct

SEQ ID NO: 811980 - DNA, 25 bp, Mus musculus
tgctgcacctagacctgaagccagc

SEQ ID NO: 811981 - DNA, 25 bp, Mus musculus
tgctgcacctagtcctgaagccagc

SEQ ID NO: 811982 - DNA, 25 bp, Mus musculus
tgctgcacctgcagaagcatcccag

SEQ ID NO: 811983 - DNA, 25 bp, Mus musculus
tgctgcacctgctgaagcatcccag

SEQ ID NO: 811984 - DNA, 25 bp, Mus musculus
tgctgcacgtctcaagagggccaac

SEQ ID NO: 811985 - DNA, 25 bp, Mus musculus
tgctgcacgtctgaagagggccaac

SEQ ID NO: 811986 - DNA, 25 bp, Mus musculus
tgctgcacttgacacatgcgggact

SEQ ID NO: 811987 - DNA, 25 bp, Mus musculus
tgctgcacttgagacatgcgggact

SEQ ID NO: 811988 - DNA, 25 bp, Mus musculus
tgctgcagaaaaactggcaaaggcc

SEQ ID NO: 811989 - DNA, 25 bp, Mus musculus
tgctgcagaaaatctggcaaaggcc

SEQ ID NO: 811990 - DNA, 25 bp, Mus musculus
tgctgcagaacacgagtacatatcg

SEQ ID NO: 811991 - DNA, 25 bp, Mus musculus
tgctgcagaacaggagtacatatcg

SEQ ID NO: 811992 - DNA, 25 bp, Mus musculus
tgctgcagaaccctggccatgagtg

SEQ ID NO: 811993 - DNA, 25 bp, Mus musculus
tgctgcagaaccgtggccatgagtg

SEQ ID NO: 811994 - DNA, 25 bp, Mus musculus
tgctgcagaacgagaggccctgttg

SEQ ID NO: 811995 - DNA, 25 bp, Mus musculus
tgctgcagaacgtgaggccctgttg

SEQ ID NO: 811996 - DNA, 25 bp, Mus musculus
tgctgcagaagtctgcccagaagac

SEQ ID NO: 811997 - DNA, 25 bp, Mus musculus
tgctgcagaagtgtgcccagaagac

SEQ ID NO: 811998 - DNA, 25 bp, Mus musculus
tgctgcagaatcagggccgagagat

SEQ ID NO: 811999 - DNA, 25 bp, Mus musculus
tgctgcagaatctgggccgagagat

SEQ ID NO: 812000 - DNA, 25 bp, Mus musculus
tgctgcagaccgactctgaccatac

SEQ ID NO: 812001 - DNA, 25 bp, Mus musculus
tgctgcagaccgtctctgaccatac

SEQ ID NO: 812002 - DNA, 25 bp, Mus musculus
tgctgcagacggctagagaaactgc

SEQ ID NO: 812003 - DNA, 25 bp, Mus musculus
tgctgcagacgggtagagaaactgc

SEQ ID NO: 812004 - DNA, 25 bp, Mus musculus
tgctgcagaggactatgccaggaaa

SEQ ID NO: 812005 - DNA, 25 bp, Mus musculus
tgctgcagaggagtatgccaggaaa

SEQ ID NO: 812006 - DNA, 25 bp, Mus musculus
tgctgcagatcacaattacttacaa

SEQ ID NO: 812007 - DNA, 25 bp, Mus musculus
tgctgcagatcagaattacttacaa

SEQ ID NO: 812008 - DNA, 25 bp, Mus musculus
tgctgcagcaacagcgctacacagg

SEQ ID NO: 812009 - DNA, 25 bp, Mus musculus
tgctgcagcaactgcgctacacagg

SEQ ID NO: 812010 - DNA, 25 bp, Mus musculus
tgctgcagcacgatttgctcctgga

SEQ ID NO: 812011 - DNA, 25 bp, Mus musculus
tgctgcagcacgttttgctcctgga

SEQ ID NO: 812012 - DNA, 25 bp, Mus musculus
tgctgcagccccagcattggagact

SEQ ID NO: 812013 - DNA, 25 bp, Mus musculus
tgctgcagcccctgcattggagact

SEQ ID NO: 812014 - DNA, 25 bp, Mus musculus
tgctgcagccgtctgggcaaagcct

SEQ ID NO: 812015 - DNA, 25 bp, Mus musculus
tgctgcagccgtgtgggcaaagcct

SEQ ID NO: 812016 - DNA, 25 bp, Mus musculus
tgctgcagcgctacaatgagtttct

SEQ ID NO: 812017 - DNA, 25 bp, Mus musculus
tgctgcagcgctcccgagatcatgg

SEQ ID NO: 812018 - DNA, 25 bp, Mus musculus
tgctgcagcgctgccgagatcatgg

SEQ ID NO: 812019 - DNA, 25 bp, Mus musculus
tgctgcagcgcttcaatgagtttct

SEQ ID NO: 812020 - DNA, 25 bp, Mus musculus
tgctgcaggaacagaacgtcacggt

SEQ ID NO: 812021 - DNA, 25 bp, Mus musculus
tgctgcaggaacagaagtcagccaa

SEQ ID NO: 812022 - DNA, 25 bp, Mus musculus
tgctgcaggaactgaacgtcacggt

SEQ ID NO: 812023 - DNA, 25 bp, Mus musculus
tgctgcaggaactgaagtcagccaa

SEQ ID NO: 812024 - DNA, 25 bp, Mus musculus
tgctgcaggacaagccgctcagcca

SEQ ID NO: 812025 - DNA, 25 bp, Mus musculus
tgctgcaggacatgccgctcagcca

SEQ ID NO: 812026 - DNA, 25 bp, Mus musculus
tgctgcaggagaaagcgcttaagtt

SEQ ID NO: 812027 - DNA, 25 bp, Mus musculus
tgctgcaggagaccatgaagtccgt

SEQ ID NO: 812028 - DNA, 25 bp, Mus musculus
tgctgcaggagagcatgaagtccgt

SEQ ID NO: 812029 - DNA, 25 bp, Mus musculus
tgctgcaggagatagcgcttaagtt

SEQ ID NO: 812030 - DNA, 25 bp, Mus musculus
tgctgcaggatcactatggttggcg

SEQ ID NO: 812031 - DNA, 25 bp, Mus musculus
tgctgcaggatctctatggttggcg

SEQ ID NO: 812032 - DNA, 25 bp, Mus musculus
tgctgcagggccatgagcggtccat

SEQ ID NO: 812033 - DNA, 25 bp, Mus musculus
tgctgcagggccttgagcggtccat

SEQ ID NO: 812034 - DNA, 25 bp, Mus musculus
tgctgcagtaagaccgagtgcctgt

SEQ ID NO: 812035 - DNA, 25 bp, Mus musculus
tgctgcagtaagtccgagtgcctgt

SEQ ID NO: 812036 - DNA, 25 bp, Mus musculus
tgctgcagtcaaagcacgccggagc

SEQ ID NO: 812037 - DNA, 25 bp, Mus musculus
tgctgcagtcaatgcacgccggagc

SEQ ID NO: 812038 - DNA, 25 bp, Mus musculus
tgctgcagttaacctggaagacttc

SEQ ID NO: 812039 - DNA, 25 bp, Mus musculus
tgctgcagttaagctggaagacttc

SEQ ID NO: 812040 - DNA, 25 bp, Mus musculus
tgctgcagttctagcggtcgctcta

SEQ ID NO: 812041 - DNA, 25 bp, Mus musculus
tgctgcagttcttgcggtcgctcta

SEQ ID NO: 812042 - DNA, 25 bp, Mus musculus
tgctgcagttgacccgagttggaaa

SEQ ID NO: 812043 - DNA, 25 bp, Mus musculus
tgctgcagttgagccgagttggaaa

SEQ ID NO: 812044 - DNA, 25 bp, Mus musculus
tgctgcagttgtctccacagtgctg

SEQ ID NO: 812045 - DNA, 25 bp, Mus musculus
tgctgcagttgtgtccacagtgctg

SEQ ID NO: 812046 - DNA, 25 bp, Mus musculus
tgctgcatagccaatctcagaagga

SEQ ID NO: 812047 - DNA, 25 bp, Mus musculus
tgctgcatagcctatctcagaagga

SEQ ID NO: 812048 - DNA, 25 bp, Mus musculus
tgctgcatcaaaagtctccgaagaa

SEQ ID NO: 812049 - DNA, 25 bp, Mus musculus
tgctgcatcaaatgtctccgaagaa

SEQ ID NO: 812050 - DNA, 25 bp, Mus musculus
tgctgcatccagctctctagacgct

SEQ ID NO: 812051 - DNA, 25 bp, Mus musculus
tgctgcatccaggtctctagacgct

SEQ ID NO: 812052 - DNA, 25 bp, Mus musculus
tgctgcatccccatgatggccgttt

SEQ ID NO: 812053 - DNA, 25 bp, Mus musculus
tgctgcatccccttgatggccgttt

SEQ ID NO: 812054 - DNA, 25 bp, Mus musculus
tgctgcatctctactacaaggtggc

SEQ ID NO: 812055 - DNA, 25 bp, Mus musculus
tgctgcatctcttctacaaggtggc

SEQ ID NO: 812056 - DNA, 25 bp, Mus musculus
tgctgcatctgaccctgtgataccc

SEQ ID NO: 812057 - DNA, 25 bp, Mus musculus
tgctgcatctgagcctgtgataccc

SEQ ID NO: 812058 - DNA, 25 bp, Mus musculus
tgctgcatgcaaaaaacatcgtgcg

SEQ ID NO: 812059 - DNA, 25 bp, Mus musculus
tgctgcatgcaataaacatcgtgcg

SEQ ID NO: 812060 - DNA, 25 bp, Mus musculus
tgctgcatggcacatgctctacctg

SEQ ID NO: 812061 - DNA, 25 bp, Mus musculus
tgctgcatggcagatgctctacctg

SEQ ID NO: 812062 - DNA, 25 bp, Mus musculus
tgctgcatggtaagggcactgccca

SEQ ID NO: 812063 - DNA, 25 bp, Mus musculus
tgctgcatggtatgggcactgccca

SEQ ID NO: 812064 - DNA, 25 bp, Mus musculus
tgctgcatggtgcttcatcgctgct

SEQ ID NO: 812065 - DNA, 25 bp, Mus musculus
tgctgcatggtggttcatcgctgct

SEQ ID NO: 812066 - DNA, 25 bp, Mus musculus
tgctgccaagccagctgatgtaagt

SEQ ID NO: 812067 - DNA, 25 bp, Mus musculus
tgctgccaagcctgctgatgtaagt

SEQ ID NO: 812068 - DNA, 25 bp, Mus musculus
tgctgccaattgatggagcaaatga

SEQ ID NO: 812069 - DNA, 25 bp, Mus musculus
tgctgccaattgttggagcaaatga

SEQ ID NO: 812070 - DNA, 25 bp, Mus musculus
tgctgccaatttcagaactgttagg

SEQ ID NO: 812071 - DNA, 25 bp, Mus musculus
tgctgccaatttgagaactgttagg

SEQ ID NO: 812072 - DNA, 25 bp, Mus musculus
tgctgccacctacaagctcatggac

SEQ ID NO: 812073 - DNA, 25 bp, Mus musculus
tgctgccacctagaagctcatggac

SEQ ID NO: 812074 - DNA, 25 bp, Mus musculus
tgctgccagaacaaaagatctattt

SEQ ID NO: 812075 - DNA, 25 bp, Mus musculus
tgctgccagaactaaagatctattt

SEQ ID NO: 812076 - DNA, 25 bp, Mus musculus
tgctgccagatgactttaaagccag

SEQ ID NO: 812077 - DNA, 25 bp, Mus musculus
tgctgccagatgtctttaaagccag

SEQ ID NO: 812078 - DNA, 25 bp, Mus musculus
tgctgccaggctacagctgggccag

SEQ ID NO: 812079 - DNA, 25 bp, Mus musculus
tgctgccaggcttcagctgggccag

SEQ ID NO: 812080 - DNA, 25 bp, Mus musculus
tgctgccagggtatattcttgttcc

SEQ ID NO: 812081 - DNA, 25 bp, Mus musculus
tgctgccagggtttattcttgttcc

SEQ ID NO: 812082 - DNA, 25 bp, Mus musculus
tgctgccatgaacaagaaagtcgag

SEQ ID NO: 812083 - DNA, 25 bp, Mus musculus
tgctgccatgaagaagaaagtcgag

SEQ ID NO: 812084 - DNA, 25 bp, Mus musculus
tgctgccatgcactacttgtccagc

SEQ ID NO: 812085 - DNA, 25 bp, Mus musculus
tgctgccatgcagtacttgtccagc

SEQ ID NO: 812086 - DNA, 25 bp, Mus musculus
tgctgccattcacggaggctgcatt

SEQ ID NO: 812087 - DNA, 25 bp, Mus musculus
tgctgccattcagggaggctgcatt

SEQ ID NO: 812088 - DNA, 25 bp, Mus musculus
tgctgccattgcaaagtactttggg

SEQ ID NO: 812089 - DNA, 25 bp, Mus musculus
tgctgccattgctaagtactttggg

SEQ ID NO: 812090 - DNA, 25 bp, Mus musculus
tgctgccattgtaaagccctcagaa

SEQ ID NO: 812091 - DNA, 25 bp, Mus musculus
tgctgccattgttaagccctcagaa

SEQ ID NO: 812092 - DNA, 25 bp, Mus musculus
tgctgccattttcgtgatcactgtc

SEQ ID NO: 812093 - DNA, 25 bp, Mus musculus
tgctgccattttggtgatcactgtc

SEQ ID NO: 812094 - DNA, 25 bp, Mus musculus
tgctgcccaaacaaactccatggtg

SEQ ID NO: 812095 - DNA, 25 bp, Mus musculus
tgctgcccaaactaactccatggtg

SEQ ID NO: 812096 - DNA, 25 bp, Mus musculus
tgctgcccaacaccagctgaaattt

SEQ ID NO: 812097 - DNA, 25 bp, Mus musculus
tgctgcccaacagcagctgaaattt

SEQ ID NO: 812098 - DNA, 25 bp, Mus musculus
tgctgcccaagcaccacattgtcaa

SEQ ID NO: 812099 - DNA, 25 bp, Mus musculus
tgctgcccaagctccacattgtcaa

SEQ ID NO: 812100 - DNA, 25 bp, Mus musculus
tgctgcccaaggacgaccaggaggt

SEQ ID NO: 812101 - DNA, 25 bp, Mus musculus
tgctgcccaaggtcgaccaggaggt

SEQ ID NO: 812102 - DNA, 25 bp, Mus musculus
tgctgcccagatccgagagcagctc

SEQ ID NO: 812103 - DNA, 25 bp, Mus musculus
tgctgcccagatgcgagagcagctc

SEQ ID NO: 812104 - DNA, 25 bp, Mus musculus
tgctgcccaggaaggacaacatcaa

SEQ ID NO: 812105 - DNA, 25 bp, Mus musculus
tgctgcccaggacgtacctattgag

SEQ ID NO: 812106 - DNA, 25 bp, Mus musculus
tgctgcccaggaggtacctattgag

SEQ ID NO: 812107 - DNA, 25 bp, Mus musculus
tgctgcccaggatggacaacatcaa

SEQ ID NO: 812108 - DNA, 25 bp, Mus musculus
tgctgcccatgaccctggacgagta

SEQ ID NO: 812109 - DNA, 25 bp, Mus musculus
tgctgcccatgagcctggacgagta

SEQ ID NO: 812110 - DNA, 25 bp, Mus musculus
tgctgccccaccagtccaagtataa

SEQ ID NO: 812111 - DNA, 25 bp, Mus musculus
tgctgccccacctgtccaagtataa

SEQ ID NO: 812112 - DNA, 25 bp, Mus musculus
tgctgccccagaatcagaacttgag

SEQ ID NO: 812113 - DNA, 25 bp, Mus musculus
tgctgccccagattcagaacttgag

SEQ ID NO: 812114 - DNA, 25 bp, Mus musculus
tgctgcccgaagacatgcctcagag

SEQ ID NO: 812115 - DNA, 25 bp, Mus musculus
tgctgcccgaagtcatgcctcagag

SEQ ID NO: 812116 - DNA, 25 bp, Mus musculus
tgctgcccggctacctagaggagct

SEQ ID NO: 812117 - DNA, 25 bp, Mus musculus
tgctgcccggcttcctagaggagct

SEQ ID NO: 812118 - DNA, 25 bp, Mus musculus
tgctgccctcagagaccgggagaag

SEQ ID NO: 812119 - DNA, 25 bp, Mus musculus
tgctgccctcagatgtgaagttcaa

SEQ ID NO: 812120 - DNA, 25 bp, Mus musculus
tgctgccctcagtgaccgggagaag

SEQ ID NO: 812121 - DNA, 25 bp, Mus musculus
tgctgccctcagttgtgaagttcaa

SEQ ID NO: 812122 - DNA, 25 bp, Mus musculus
tgctgccctcgtctgcggtgttgtc

SEQ ID NO: 812123 - DNA, 25 bp, Mus musculus
tgctgccctcgtgtgcggtgttgtc

SEQ ID NO: 812124 - DNA, 25 bp, Mus musculus
tgctgccctgggacccaagtggtaa

SEQ ID NO: 812125 - DNA, 25 bp, Mus musculus
tgctgccctgggagcaagagttcaa

SEQ ID NO: 812126 - DNA, 25 bp, Mus musculus
tgctgccctgggtcccaagtggtaa

SEQ ID NO: 812127 - DNA, 25 bp, Mus musculus
tgctgccctgggtgcaagagttcaa

SEQ ID NO: 812128 - DNA, 25 bp, Mus musculus
tgctgcccttcaaacgaggcgcctt

SEQ ID NO: 812129 - DNA, 25 bp, Mus musculus
tgctgcccttcatacgaggcgcctt

SEQ ID NO: 812130 - DNA, 25 bp, Mus musculus
tgctgccctttgaaagcaccgtgcc

SEQ ID NO: 812131 - DNA, 25 bp, Mus musculus
tgctgccctttgtaagcaccgtgcc

SEQ ID NO: 812132 - DNA, 25 bp, Mus musculus
tgctgccgacacagagagaggcctt

SEQ ID NO: 812133 - DNA, 25 bp, Mus musculus
tgctgccgacactgagagaggcctt

SEQ ID NO: 812134 - DNA, 25 bp, Mus musculus
tgctgccgagcgcatcccagtgtgc

SEQ ID NO: 812135 - DNA, 25 bp, Mus musculus
tgctgccgagcggatcccagtgtgc

SEQ ID NO: 812136 - DNA, 25 bp, Mus musculus
tgctgccgccaaatgttacaagaaa

SEQ ID NO: 812137 - DNA, 25 bp, Mus musculus
tgctgccgccaattgttacaagaaa

SEQ ID NO: 812138 - DNA, 25 bp, Mus musculus
tgctgccgccacagctgtgctggct

SEQ ID NO: 812139 - DNA, 25 bp, Mus musculus
tgctgccgccactgctgtgctggct

SEQ ID NO: 812140 - DNA, 25 bp, Mus musculus
tgctgccgctgacgagacctgtaca

SEQ ID NO: 812141 - DNA, 25 bp, Mus musculus
tgctgccgctgaggagacctgtaca

SEQ ID NO: 812142 - DNA, 25 bp, Mus musculus
tgctgccgcttcaggcggccttgct

SEQ ID NO: 812143 - DNA, 25 bp, Mus musculus
tgctgccgcttctggcggccttgct

SEQ ID NO: 812144 - DNA, 25 bp, Mus musculus
tgctgccgtacgaagcttgtccggt

SEQ ID NO: 812145 - DNA, 25 bp, Mus musculus
tgctgccgtacgtagcttgtccggt

SEQ ID NO: 812146 - DNA, 25 bp, Mus musculus
tgctgccgtagtcacccaggcctgg

SEQ ID NO: 812147 - DNA, 25 bp, Mus musculus
tgctgccgtagtgacccaggcctgg

SEQ ID NO: 812148 - DNA, 25 bp, Mus musculus
tgctgcctactcattgccgagcgca

SEQ ID NO: 812149 - DNA, 25 bp, Mus musculus
tgctgcctactctttgccgagcgca

SEQ ID NO: 812150 - DNA, 25 bp, Mus musculus
tgctgcctcagaacatttgggataa

SEQ ID NO: 812151 - DNA, 25 bp, Mus musculus
tgctgcctcagatcatttgggataa

SEQ ID NO: 812152 - DNA, 25 bp, Mus musculus
tgctgcctcccaagaagctggccgg

SEQ ID NO: 812153 - DNA, 25 bp, Mus musculus
tgctgcctcccaagggtccatcctt

SEQ ID NO: 812154 - DNA, 25 bp, Mus musculus
tgctgcctcccatgaagctggccgg

SEQ ID NO: 812155 - DNA, 25 bp, Mus musculus
tgctgcctcccatgggtccatcctt

SEQ ID NO: 812156 - DNA, 25 bp, Mus musculus
tgctgcctccgcagagaattcctga

SEQ ID NO: 812157 - DNA, 25 bp, Mus musculus
tgctgcctccgctgagaattcctga

SEQ ID NO: 812158 - DNA, 25 bp, Mus musculus
tgctgcctcctgatctacctctttg

SEQ ID NO: 812159 - DNA, 25 bp, Mus musculus
tgctgcctcctgttctacctctttg

SEQ ID NO: 812160 - DNA, 25 bp, Mus musculus
tgctgcctgagaaataggccatgcc

SEQ ID NO: 812161 - DNA, 25 bp, Mus musculus
tgctgcctgagactggacaaccagc

SEQ ID NO: 812162 - DNA, 25 bp, Mus musculus
tgctgcctgagagtggacaaccagc

SEQ ID NO: 812163 - DNA, 25 bp, Mus musculus
tgctgcctgagatataggccatgcc

SEQ ID NO: 812164 - DNA, 25 bp, Mus musculus
tgctgcctgcaaagtccatgtatga

SEQ ID NO: 812165 - DNA, 25 bp, Mus musculus
tgctgcctgcaatgtccatgtatga

SEQ ID NO: 812166 - DNA, 25 bp, Mus musculus
tgctgcctgcagcaagctgatccca

SEQ ID NO: 812167 - DNA, 25 bp, Mus musculus
tgctgcctgcaggaagctgatccca

SEQ ID NO: 812168 - DNA, 25 bp, Mus musculus
tgctgcctgcctacgcagggcatgt

SEQ ID NO: 812169 - DNA, 25 bp, Mus musculus
tgctgcctgccttcgcagggcatgt

SEQ ID NO: 812170 - DNA, 25 bp, Mus musculus
tgctgcctgggaccttgcttcagta

SEQ ID NO: 812171 - DNA, 25 bp, Mus musculus
tgctgcctgggagcttgcttcagta

SEQ ID NO: 812172 - DNA, 25 bp, Mus musculus
tgctgccttaacagttcggccagag

SEQ ID NO: 812173 - DNA, 25 bp, Mus musculus
tgctgccttaactgttcggccagag

SEQ ID NO: 812174 - DNA, 25 bp, Mus musculus
tgctgccttcacacgcatcaactgt

SEQ ID NO: 812175 - DNA, 25 bp, Mus musculus
tgctgccttcactcgcatcaactgt

SEQ ID NO: 812176 - DNA, 25 bp, Mus musculus
tgctgccttccaagctgttctcggg

SEQ ID NO: 812177 - DNA, 25 bp, Mus musculus
tgctgccttccatgctgttctcggg

SEQ ID NO: 812178 - DNA, 25 bp, Mus musculus
tgctgccttcttcatcttctccttg

SEQ ID NO: 812179 - DNA, 25 bp, Mus musculus
tgctgccttcttgatcttctccttg

SEQ ID NO: 812180 - DNA, 25 bp, Mus musculus
tgctgccttgtcaacagaagggaaa

SEQ ID NO: 812181 - DNA, 25 bp, Mus musculus
tgctgccttgtctacagaagggaaa

SEQ ID NO: 812182 - DNA, 25 bp, Mus musculus
tgctgccttgttcacctggagagaa

SEQ ID NO: 812183 - DNA, 25 bp, Mus musculus
tgctgccttgttgacctggagagaa

SEQ ID NO: 812184 - DNA, 25 bp, Mus musculus
tgctgcctttgaccctgtctactgg

SEQ ID NO: 812185 - DNA, 25 bp, Mus musculus
tgctgcctttgagcctgtctactgg

SEQ ID NO: 812186 - DNA, 25 bp, Mus musculus
tgctgcgacctcactacatggacgt

SEQ ID NO: 812187 - DNA, 25 bp, Mus musculus
tgctgcgacctctctacatggacgt

SEQ ID NO: 812188 - DNA, 25 bp, Mus musculus
tgctgcgcaagcacgtgaaccagtg

SEQ ID NO: 812189 - DNA, 25 bp, Mus musculus
tgctgcgcaagctcgtgaaccagtg

SEQ ID NO: 812190 - DNA, 25 bp, Mus musculus
tgctgcgcatctcggacctgttttt

SEQ ID NO: 812191 - DNA, 25 bp, Mus musculus
tgctgcgcatctgggacctgttttt

SEQ ID NO: 812192 - DNA, 25 bp, Mus musculus
tgctgcgcccagcaagattagatag

SEQ ID NO: 812193 - DNA, 25 bp, Mus musculus
tgctgcgcccaggaagattagatag

SEQ ID NO: 812194 - DNA, 25 bp, Mus musculus
tgctgcgcccctcttagctcataaa

SEQ ID NO: 812195 - DNA, 25 bp, Mus musculus
tgctgcgcccctgttagctcataaa

SEQ ID NO: 812196 - DNA, 25 bp, Mus musculus
tgctgcggcggaagtagaccaagaa

SEQ ID NO: 812197 - DNA, 25 bp, Mus musculus
tgctgcggcggatgtagaccaagaa

SEQ ID NO: 812198 - DNA, 25 bp, Mus musculus
tgctgcggctaactgtgtctgggct

SEQ ID NO: 812199 - DNA, 25 bp, Mus musculus
tgctgcggctaagtgtgtctgggct

SEQ ID NO: 812200 - DNA, 25 bp, Mus musculus
tgctgcggctaccaaaactacggca

SEQ ID NO: 812201 - DNA, 25 bp, Mus musculus
tgctgcggctacgaaaactacggca

SEQ ID NO: 812202 - DNA, 25 bp, Mus musculus
tgctgcgggacgacattgataatcc

SEQ ID NO: 812203 - DNA, 25 bp, Mus musculus
tgctgcgggacgtcattgataatcc

SEQ ID NO: 812204 - DNA, 25 bp, Mus musculus
tgctgcgggaggaagccactgtcct

SEQ ID NO: 812205 - DNA, 25 bp, Mus musculus
tgctgcgggaggtagccactgtcct

SEQ ID NO: 812206 - DNA, 25 bp, Mus musculus
tgctgcgggagtccgcaatccccag

SEQ ID NO: 812207 - DNA, 25 bp, Mus musculus
tgctgcgggagtgcgcaatccccag

SEQ ID NO: 812208 - DNA, 25 bp, Mus musculus
tgctgcgggcacagaagttctatca

SEQ ID NO: 812209 - DNA, 25 bp, Mus musculus
tgctgcgggcactgaagttctatca

SEQ ID NO: 812210 - DNA, 25 bp, Mus musculus
tgctgcgtacgacgctgtccttgac

SEQ ID NO: 812211 - DNA, 25 bp, Mus musculus
tgctgcgtacgaggctgtccttgac

SEQ ID NO: 812212 - DNA, 25 bp, Mus musculus
tgctgcgtacgcagtccgtggcctg

SEQ ID NO: 812213 - DNA, 25 bp, Mus musculus
tgctgcgtacgctgtccgtggcctg

SEQ ID NO: 812214 - DNA, 25 bp, Mus musculus
tgctgcgtacggagggtacatcaac

SEQ ID NO: 812215 - DNA, 25 bp, Mus musculus
tgctgcgtacggtgggtacatcaac

SEQ ID NO: 812216 - DNA, 25 bp, Mus musculus
tgctgcgtgacaattgctccaagta

SEQ ID NO: 812217 - DNA, 25 bp, Mus musculus
tgctgcgtgacatttgctccaagta

SEQ ID NO: 812218 - DNA, 25 bp, Mus musculus
tgctgctaaagtcgcgctcatcaac

SEQ ID NO: 812219 - DNA, 25 bp, Mus musculus
tgctgctaaagtggcgctcatcaac

SEQ ID NO: 812220 - DNA, 25 bp, Mus musculus
tgctgctacaataaggctcattttt

SEQ ID NO: 812221 - DNA, 25 bp, Mus musculus
tgctgctacaattaggctcattttt

SEQ ID NO: 812222 - DNA, 25 bp, Mus musculus
tgctgctacagaagaccacgtctcc

SEQ ID NO: 812223 - DNA, 25 bp, Mus musculus
tgctgctacagatgaccacgtctcc

SEQ ID NO: 812224 - DNA, 25 bp, Mus musculus
tgctgctaccccagtcatcaatgga

SEQ ID NO: 812225 - DNA, 25 bp, Mus musculus
tgctgctacccctgtcatcaatgga

SEQ ID NO: 812226 - DNA, 25 bp, Mus musculus
tgctgctactctcccagttcatgga

SEQ ID NO: 812227 - DNA, 25 bp, Mus musculus
tgctgctactctgccagttcatgga

SEQ ID NO: 812228 - DNA, 25 bp, Mus musculus
tgctgctactgcaacctttgctggg

SEQ ID NO: 812229 - DNA, 25 bp, Mus musculus
tgctgctactgctacctttgctggg

SEQ ID NO: 812230 - DNA, 25 bp, Mus musculus
tgctgctaggccagctccgagtctg

SEQ ID NO: 812231 - DNA, 25 bp, Mus musculus
tgctgctaggcctgctccgagtctg

SEQ ID NO: 812232 - DNA, 25 bp, Mus musculus
tgctgctaggctctaaggatctcgt

SEQ ID NO: 812233 - DNA, 25 bp, Mus musculus
tgctgctaggctgtaaggatctcgt

SEQ ID NO: 812234 - DNA, 25 bp, Mus musculus
tgctgctagtgtacctgctggaagc

SEQ ID NO: 812235 - DNA, 25 bp, Mus musculus
tgctgctagtgttcctgctggaagc

SEQ ID NO: 812236 - DNA, 25 bp, Mus musculus
tgctgctatgtcctcgtccacgagt

SEQ ID NO: 812237 - DNA, 25 bp, Mus musculus
tgctgctatgtcgtcgtccacgagt

SEQ ID NO: 812238 - DNA, 25 bp, Mus musculus
tgctgctattggctgtgactcccct

SEQ ID NO: 812239 - DNA, 25 bp, Mus musculus
tgctgctattgggtgtgactcccct

SEQ ID NO: 812240 - DNA, 25 bp, Mus musculus
tgctgctcaaacactactcggatga

SEQ ID NO: 812241 - DNA, 25 bp, Mus musculus
tgctgctcaaactctactcggatga

SEQ ID NO: 812242 - DNA, 25 bp, Mus musculus
tgctgctcaacaaccaggagctaaa

SEQ ID NO: 812243 - DNA, 25 bp, Mus musculus
tgctgctcaacatccaggagctaaa

SEQ ID NO: 812244 - DNA, 25 bp, Mus musculus
tgctgctcaaccaggccggagtgcg

SEQ ID NO: 812245 - DNA, 25 bp, Mus musculus
tgctgctcaacctggccggagtgcg

SEQ ID NO: 812246 - DNA, 25 bp, Mus musculus
tgctgctcacatagatacagatgaa

SEQ ID NO: 812247 - DNA, 25 bp, Mus musculus
tgctgctcacattgatacagatgaa

SEQ ID NO: 812248 - DNA, 25 bp, Mus musculus
tgctgctcacctcttgcttctgcat

SEQ ID NO: 812249 - DNA, 25 bp, Mus musculus
tgctgctcacctgttgcttctgcat

SEQ ID NO: 812250 - DNA, 25 bp, Mus musculus
tgctgctcacggctctcatctgtga

SEQ ID NO: 812251 - DNA, 25 bp, Mus musculus
tgctgctcacgggtctcatctgtga

SEQ ID NO: 812252 - DNA, 25 bp, Mus musculus
tgctgctcacgtaccttgcagtggt

SEQ ID NO: 812253 - DNA, 25 bp, Mus musculus
tgctgctcacgttccttgcagtggt

SEQ ID NO: 812254 - DNA, 25 bp, Mus musculus
tgctgctcagacctctaataaaact

SEQ ID NO: 812255 - DNA, 25 bp, Mus musculus
tgctgctcagacgtctaataaaact

SEQ ID NO: 812256 - DNA, 25 bp, Mus musculus
tgctgctcagctcgctgttcagaag

SEQ ID NO: 812257 - DNA, 25 bp, Mus musculus
tgctgctcagctggctgttcagaag

SEQ ID NO: 812258 - DNA, 25 bp, Mus musculus
tgctgctcagtcattaaatgtacag

SEQ ID NO: 812259 - DNA, 25 bp, Mus musculus
tgctgctcagtctttaaatgtacag

SEQ ID NO: 812260 - DNA, 25 bp, Mus musculus
tgctgctcatctagtagaccctctt

SEQ ID NO: 812261 - DNA, 25 bp, Mus musculus
tgctgctcatcttgtagaccctctt

SEQ ID NO: 812262 - DNA, 25 bp, Mus musculus
tgctgctcatggattctcccttatc

SEQ ID NO: 812263 - DNA, 25 bp, Mus musculus
tgctgctcatggtttctcccttatc

SEQ ID NO: 812264 - DNA, 25 bp, Mus musculus
tgctgctcattcacgggacttcctg

SEQ ID NO: 812265 - DNA, 25 bp, Mus musculus
tgctgctcattctcgggacttcctg

SEQ ID NO: 812266 - DNA, 25 bp, Mus musculus
tgctgctcattgagctggtagagac

SEQ ID NO: 812267 - DNA, 25 bp, Mus musculus
tgctgctcattgtgctggtagagac

SEQ ID NO: 812268 - DNA, 25 bp, Mus musculus
tgctgctccacgacaaatacctgta

SEQ ID NO: 812269 - DNA, 25 bp, Mus musculus
tgctgctccacgtcaaatacctgta

SEQ ID NO: 812270 - DNA, 25 bp, Mus musculus
tgctgctccatgagaaaacgtccaa

SEQ ID NO: 812271 - DNA, 25 bp, Mus musculus
tgctgctccatgtgaaaacgtccaa

SEQ ID NO: 812272 - DNA, 25 bp, Mus musculus
tgctgctccgagaggttggcagtca

SEQ ID NO: 812273 - DNA, 25 bp, Mus musculus
tgctgctccgagtggttggcagtca

SEQ ID NO: 812274 - DNA, 25 bp, Mus musculus
tgctgctcgaatctccaagaatcca

SEQ ID NO: 812275 - DNA, 25 bp, Mus musculus
tgctgctcgaatgtccaagaatcca

SEQ ID NO: 812276 - DNA, 25 bp, Mus musculus
tgctgctcgcctacgtgctacacgt

SEQ ID NO: 812277 - DNA, 25 bp, Mus musculus
tgctgctcgccttcgtgctacacgt

SEQ ID NO: 812278 - DNA, 25 bp, Mus musculus
tgctgctctaaaccgggtacccaga

SEQ ID NO: 812279 - DNA, 25 bp, Mus musculus
tgctgctctaaagcgggtacccaga

SEQ ID NO: 812280 - DNA, 25 bp, Mus musculus
tgctgctctattatacacagtggtg

SEQ ID NO: 812281 - DNA, 25 bp, Mus musculus
tgctgctctattttacacagtggtg

SEQ ID NO: 812282 - DNA, 25 bp, Mus musculus
tgctgctctggcaatgagggagacc

SEQ ID NO: 812283 - DNA, 25 bp, Mus musculus
tgctgctctggctatgagggagacc

SEQ ID NO: 812284 - DNA, 25 bp, Mus musculus
tgctgctctgtaatgcccgctgcaa

SEQ ID NO: 812285 - DNA, 25 bp, Mus musculus
tgctgctctgtattgcccgctgcaa

SEQ ID NO: 812286 - DNA, 25 bp, Mus musculus
tgctgctgaaaaacggaatgaactg

SEQ ID NO: 812287 - DNA, 25 bp, Mus musculus
tgctgctgaaaatcggaatgaactg

SEQ ID NO: 812288 - DNA, 25 bp, Mus musculus
tgctgctgaaacagccaagcatcaa

SEQ ID NO: 812289 - DNA, 25 bp, Mus musculus
tgctgctgaaactgccaagcatcaa

SEQ ID NO: 812290 - DNA, 25 bp, Mus musculus
tgctgctgaaatcggctctgagctg

SEQ ID NO: 812291 - DNA, 25 bp, Mus musculus
tgctgctgaaatgggctctgagctg

SEQ ID NO: 812292 - DNA, 25 bp, Mus musculus
tgctgctgaatgaagaagatgagac

SEQ ID NO: 812293 - DNA, 25 bp, Mus musculus
tgctgctgaatgtagaagatgagac

SEQ ID NO: 812294 - DNA, 25 bp, Mus musculus
tgctgctgacagaccttacattgct

SEQ ID NO: 812295 - DNA, 25 bp, Mus musculus
tgctgctgacagtccttacattgct

SEQ ID NO: 812296 - DNA, 25 bp, Mus musculus
tgctgctgacttcccagcggaaact

SEQ ID NO: 812297 - DNA, 25 bp, Mus musculus
tgctgctgacttgccagcggaaact

SEQ ID NO: 812298 - DNA, 25 bp, Mus musculus
tgctgctgatgacagatgtgctcgt

SEQ ID NO: 812299 - DNA, 25 bp, Mus musculus
tgctgctgatgagagatgtgctcgt

SEQ ID NO: 812300 - DNA, 25 bp, Mus musculus
tgctgctgcagtaggttgaaactgt

SEQ ID NO: 812301 - DNA, 25 bp, Mus musculus
tgctgctgcagttggttgaaactgt

SEQ ID NO: 812302 - DNA, 25 bp, Mus musculus
tgctgctgcgagaaggccgtgccac

SEQ ID NO: 812303 - DNA, 25 bp, Mus musculus
tgctgctgcgagtaggccgtgccac

SEQ ID NO: 812304 - DNA, 25 bp, Mus musculus
tgctgctgctagaaccagccttcct

SEQ ID NO: 812305 - DNA, 25 bp, Mus musculus
tgctgctgctagagggctgtgagaa

SEQ ID NO: 812306 - DNA, 25 bp, Mus musculus
tgctgctgctagtaccagccttcct

SEQ ID NO: 812307 - DNA, 25 bp, Mus musculus
tgctgctgctagtgggctgtgagaa

SEQ ID NO: 812308 - DNA, 25 bp, Mus musculus
tgctgctgctccacgtcaaatacct

SEQ ID NO: 812309 - DNA, 25 bp, Mus musculus
tgctgctgctccatgagaaaacgtc

SEQ ID NO: 812310 - DNA, 25 bp, Mus musculus
tgctgctgctccatgctttggccaa

SEQ ID NO: 812311 - DNA, 25 bp, Mus musculus
tgctgctgctcctcgtcaaatacct

SEQ ID NO: 812312 - DNA, 25 bp, Mus musculus
tgctgctgctccttgagaaaacgtc

SEQ ID NO: 812313 - DNA, 25 bp, Mus musculus
tgctgctgctccttgctttggccaa

SEQ ID NO: 812314 - DNA, 25 bp, Mus musculus
tgctgctgctttcgctgctgcgtca

SEQ ID NO: 812315 - DNA, 25 bp, Mus musculus
tgctgctgctttggctgctgcgtca

SEQ ID NO: 812316 - DNA, 25 bp, Mus musculus
tgctgctggaaaaggtagggaactc

SEQ ID NO: 812317 - DNA, 25 bp, Mus musculus
tgctgctggaaatggtagggaactc

SEQ ID NO: 812318 - DNA, 25 bp, Mus musculus
tgctgctggataccacaggagagac

SEQ ID NO: 812319 - DNA, 25 bp, Mus musculus
tgctgctggatagcacaggagagac

SEQ ID NO: 812320 - DNA, 25 bp, Mus musculus
tgctgctggcccagatcttcattac

SEQ ID NO: 812321 - DNA, 25 bp, Mus musculus
tgctgctggccctgatcttcattac

SEQ ID NO: 812322 - DNA, 25 bp, Mus musculus
tgctgctggctaattgcacaggact

SEQ ID NO: 812323 - DNA, 25 bp, Mus musculus
tgctgctggctatttgcacaggact

SEQ ID NO: 812324 - DNA, 25 bp, Mus musculus
tgctgctggcttcctatatccgtcc

SEQ ID NO: 812325 - DNA, 25 bp, Mus musculus
tgctgctggcttgctatatccgtcc

SEQ ID NO: 812326 - DNA, 25 bp, Mus musculus
tgctgctgggccagcgctttcagga

SEQ ID NO: 812327 - DNA, 25 bp, Mus musculus
tgctgctgggcctgcgctttcagga

SEQ ID NO: 812328 - DNA, 25 bp, Mus musculus
tgctgctgggtaacgggcctgttcc

SEQ ID NO: 812329 - DNA, 25 bp, Mus musculus
tgctgctgggtatcgggcctgttcc

SEQ ID NO: 812330 - DNA, 25 bp, Mus musculus
tgctgctggtctataagcagagaca

SEQ ID NO: 812331 - DNA, 25 bp, Mus musculus
tgctgctggtctttaagcagagaca

SEQ ID NO: 812332 - DNA, 25 bp, Mus musculus
tgctgctgtagaatgacggccccgc

SEQ ID NO: 812333 - DNA, 25 bp, Mus musculus
tgctgctgtagattgacggccccgc

SEQ ID NO: 812334 - DNA, 25 bp, Mus musculus
tgctgctgtagtctgggtaaagcct

SEQ ID NO: 812335 - DNA, 25 bp, Mus musculus
tgctgctgtagtgtgggtaaagcct

SEQ ID NO: 812336 - DNA, 25 bp, Mus musculus
tgctgctgtcaaccctttctttgga

SEQ ID NO: 812337 - DNA, 25 bp, Mus musculus
tgctgctgtcaagcctttctttgga

SEQ ID NO: 812338 - DNA, 25 bp, Mus musculus
tgctgctgtccaccctgtggttctg

SEQ ID NO: 812339 - DNA, 25 bp, Mus musculus
tgctgctgtccagcctgtggttctg

SEQ ID NO: 812340 - DNA, 25 bp, Mus musculus
tgctgctgtgggatgtgtttataga

SEQ ID NO: 812341 - DNA, 25 bp, Mus musculus
tgctgctgtgggttgtgtttataga

SEQ ID NO: 812342 - DNA, 25 bp, Mus musculus
tgctgcttaccgagacgtggaacga

SEQ ID NO: 812343 - DNA, 25 bp, Mus musculus
tgctgcttaccgtgacgtggaacga

SEQ ID NO: 812344 - DNA, 25 bp, Mus musculus
tgctgcttcagacatcaccgtgctg

SEQ ID NO: 812345 - DNA, 25 bp, Mus musculus
tgctgcttcagagatcaccgtgctg

SEQ ID NO: 812346 - DNA, 25 bp, Mus musculus
tgctgcttctgacccactataataa

SEQ ID NO: 812347 - DNA, 25 bp, Mus musculus
tgctgcttctgagccactataataa

SEQ ID NO: 812348 - DNA, 25 bp, Mus musculus
tgctgcttctggaacagtgttcaag

SEQ ID NO: 812349 - DNA, 25 bp, Mus musculus
tgctgcttctggtacagtgttcaag

SEQ ID NO: 812350 - DNA, 25 bp, Mus musculus
tgctgcttgcttatgcccaggctcc

SEQ ID NO: 812351 - DNA, 25 bp, Mus musculus
tgctgcttgcttttgcccaggctcc

SEQ ID NO: 812352 - DNA, 25 bp, Mus musculus
tgctgcttgtggaccccggagtcgc

SEQ ID NO: 812353 - DNA, 25 bp, Mus musculus
tgctgcttgtggtccccggagtcgc

SEQ ID NO: 812354 - DNA, 25 bp, Mus musculus
tgctgctttactccgggatccctgc

SEQ ID NO: 812355 - DNA, 25 bp, Mus musculus
tgctgctttactgcgggatccctgc

SEQ ID NO: 812356 - DNA, 25 bp, Mus musculus
tgctgctttcccaaatcagatggag

SEQ ID NO: 812357 - DNA, 25 bp, Mus musculus
tgctgctttccctaatcagatggag

SEQ ID NO: 812358 - DNA, 25 bp, Mus musculus
tgctgctttgacagcgaccacatcc

SEQ ID NO: 812359 - DNA, 25 bp, Mus musculus
tgctgctttgactgcgaccacatcc

SEQ ID NO: 812360 - DNA, 25 bp, Mus musculus
tgctgcttttcaacggcaagctaac

SEQ ID NO: 812361 - DNA, 25 bp, Mus musculus
tgctgcttttcatcggcaagctaac

SEQ ID NO: 812362 - DNA, 25 bp, Mus musculus
tgctgcttttgacccggcggctgaa

SEQ ID NO: 812363 - DNA, 25 bp, Mus musculus
tgctgcttttgagccggcggctgaa

SEQ ID NO: 812364 - DNA, 25 bp, Mus musculus
tgctggaaaacgacaggtgctccgt

SEQ ID NO: 812365 - DNA, 25 bp, Mus musculus
tgctggaaaacgtcaggtgctccgt

SEQ ID NO: 812366 - DNA, 25 bp, Mus musculus
tgctggaaaagaacgtgaagcagat

SEQ ID NO: 812367 - DNA, 25 bp, Mus musculus
tgctggaaaagatcgtgaagcagat

SEQ ID NO: 812368 - DNA, 25 bp, Mus musculus
tgctggaacactacacctatggcgc

SEQ ID NO: 812369 - DNA, 25 bp, Mus musculus
tgctggaacacttcacctatggcgc

SEQ ID NO: 812370 - DNA, 25 bp, Mus musculus
tgctggaaccacaggttggcatggc

SEQ ID NO: 812371 - DNA, 25 bp, Mus musculus
tgctggaaccactggttggcatggc

SEQ ID NO: 812372 - DNA, 25 bp, Mus musculus
tgctggaaccagcaatggcgctcct

SEQ ID NO: 812373 - DNA, 25 bp, Mus musculus
tgctggaaccaggaatggcgctcct

SEQ ID NO: 812374 - DNA, 25 bp, Mus musculus
tgctggaactgtcggacaagtgtca

SEQ ID NO: 812375 - DNA, 25 bp, Mus musculus
tgctggaactgtgggacaagtgtca

SEQ ID NO: 812376 - DNA, 25 bp, Mus musculus
tgctggaagcaacgttgacctgccg

SEQ ID NO: 812377 - DNA, 25 bp, Mus musculus
tgctggaagcaaggttgacctgccg

SEQ ID NO: 812378 - DNA, 25 bp, Mus musculus
tgctggaagccaccattgctgtgct

SEQ ID NO: 812379 - DNA, 25 bp, Mus musculus
tgctggaagccagcattgctgtgct

SEQ ID NO: 812380 - DNA, 25 bp, Mus musculus
tgctggaagcgcagctcccgggcca

SEQ ID NO: 812381 - DNA, 25 bp, Mus musculus
tgctggaagcgctgctcccgggcca

SEQ ID NO: 812382 - DNA, 25 bp, Mus musculus
tgctggaagggacctgcagctaact

SEQ ID NO: 812383 - DNA, 25 bp, Mus musculus
tgctggaagggagctgcagctaact

SEQ ID NO: 812384 - DNA, 25 bp, Mus musculus
tgctggaatcaaagcttgtggccgg

SEQ ID NO: 812385 - DNA, 25 bp, Mus musculus
tgctggaatcaatgcttgtggccgg

SEQ ID NO: 812386 - DNA, 25 bp, Mus musculus
tgctggaatcaccttgttggcctgg

SEQ ID NO: 812387 - DNA, 25 bp, Mus musculus
tgctggaatcacgttgttggcctgg

SEQ ID NO: 812388 - DNA, 25 bp, Mus musculus
tgctggaatggcattgacaaacttg

SEQ ID NO: 812389 - DNA, 25 bp, Mus musculus
tgctggaatggctttgacaaacttg

SEQ ID NO: 812390 - DNA, 25 bp, Mus musculus
tgctggacaacccattgaattactc

SEQ ID NO: 812391 - DNA, 25 bp, Mus musculus
tgctggacaaccgattgaattactc

SEQ ID NO: 812392 - DNA, 25 bp, Mus musculus
tgctggacaactaatccaaacctgt

SEQ ID NO: 812393 - DNA, 25 bp, Mus musculus
tgctggacaacttatccaaacctgt

SEQ ID NO: 812394 - DNA, 25 bp, Mus musculus
tgctggacaaggacgggcacatcaa

SEQ ID NO: 812395 - DNA, 25 bp, Mus musculus
tgctggacaaggtcgggcacatcaa

SEQ ID NO: 812396 - DNA, 25 bp, Mus musculus
tgctggacatgaaggaacccgagac

SEQ ID NO: 812397 - DNA, 25 bp, Mus musculus
tgctggacatgatggaacccgagac

SEQ ID NO: 812398 - DNA, 25 bp, Mus musculus
tgctggacatgcaccgagatgctat

SEQ ID NO: 812399 - DNA, 25 bp, Mus musculus
tgctggacatgctccgagatgctat

SEQ ID NO: 812400 - DNA, 25 bp, Mus musculus
tgctggacatgtcccgaaaatcaca

SEQ ID NO: 812401 - DNA, 25 bp, Mus musculus
tgctggacatgtgccgaaaatcaca

SEQ ID NO: 812402 - DNA, 25 bp, Mus musculus
tgctggaccatgacagcctagcatg

SEQ ID NO: 812403 - DNA, 25 bp, Mus musculus
tgctggaccatgtcagcctagcatg

SEQ ID NO: 812404 - DNA, 25 bp, Mus musculus
tgctggaccctacgacagagcacgg

SEQ ID NO: 812405 - DNA, 25 bp, Mus musculus
tgctggaccctaggacagagcacgg

SEQ ID NO: 812406 - DNA, 25 bp, Mus musculus
tgctggaccgagctgagaatctgct

SEQ ID NO: 812407 - DNA, 25 bp, Mus musculus
tgctggaccgaggtgagaatctgct

SEQ ID NO: 812408 - DNA, 25 bp, Mus musculus
tgctggaccgcgatcgcaccgctga

SEQ ID NO: 812409 - DNA, 25 bp, Mus musculus
tgctggaccgcgttcgcaccgctga

SEQ ID NO: 812410 - DNA, 25 bp, Mus musculus
tgctggacgatgctgggaggacacc

SEQ ID NO: 812411 - DNA, 25 bp, Mus musculus
tgctggacgatggtgggaggacacc

SEQ ID NO: 812412 - DNA, 25 bp, Mus musculus
tgctggacgccaactccgggaggct

SEQ ID NO: 812413 - DNA, 25 bp, Mus musculus
tgctggacgccatctccgggaggct

SEQ ID NO: 812414 - DNA, 25 bp, Mus musculus
tgctggactccgagcaaaagatgca

SEQ ID NO: 812415 - DNA, 25 bp, Mus musculus
tgctggactccgtgcaaaagatgca

SEQ ID NO: 812416 - DNA, 25 bp, Mus musculus
tgctggactgaaagtcatgaggatc

SEQ ID NO: 812417 - DNA, 25 bp, Mus musculus
tgctggactgaatgtcatgaggatc

SEQ ID NO: 812418 - DNA, 25 bp, Mus musculus
tgctggacttgacgcaggactacga

SEQ ID NO: 812419 - DNA, 25 bp, Mus musculus
tgctggacttgaggcaggactacga

SEQ ID NO: 812420 - DNA, 25 bp, Mus musculus
tgctggagaagtagacagttgaccc

SEQ ID NO: 812421 - DNA, 25 bp, Mus musculus
tgctggagaagttgacagttgaccc

SEQ ID NO: 812422 - DNA, 25 bp, Mus musculus
tgctggagacgactttgagacccgt

SEQ ID NO: 812423 - DNA, 25 bp, Mus musculus
tgctggagacgagtttgagacccgt

SEQ ID NO: 812424 - DNA, 25 bp, Mus musculus
tgctggagacggagaggattcggaa

SEQ ID NO: 812425 - DNA, 25 bp, Mus musculus
tgctggagacggtgaggattcggaa

SEQ ID NO: 812426 - DNA, 25 bp, Mus musculus
tgctggagagacacggccgcgaaca

SEQ ID NO: 812427 - DNA, 25 bp, Mus musculus
tgctggagagactcggccgcgaaca

SEQ ID NO: 812428 - DNA, 25 bp, Mus musculus
tgctggagatggacggccacaatca

SEQ ID NO: 812429 - DNA, 25 bp, Mus musculus
tgctggagatggtcggccacaatca

SEQ ID NO: 812430 - DNA, 25 bp, Mus musculus
tgctggagccaacttgaggcgttac

SEQ ID NO: 812431 - DNA, 25 bp, Mus musculus
tgctggagccaagttgaggcgttac

SEQ ID NO: 812432 - DNA, 25 bp, Mus musculus
tgctggagccacaactgcagaagtg

SEQ ID NO: 812433 - DNA, 25 bp, Mus musculus
tgctggagccactactgcagaagtg

SEQ ID NO: 812434 - DNA, 25 bp, Mus musculus
tgctggagcgcgctgcggctggcag

SEQ ID NO: 812435 - DNA, 25 bp, Mus musculus
tgctggagcgcggtgcggctggcag

SEQ ID NO: 812436 - DNA, 25 bp, Mus musculus
tgctggagcgggactgacctcttaa

SEQ ID NO: 812437 - DNA, 25 bp, Mus musculus
tgctggagcgggtctgacctcttaa

SEQ ID NO: 812438 - DNA, 25 bp, Mus musculus
tgctggagctctacaggtcacccaa

SEQ ID NO: 812439 - DNA, 25 bp, Mus musculus
tgctggagctcttcaggtcacccaa

SEQ ID NO: 812440 - DNA, 25 bp, Mus musculus
tgctggagctgactgagagtcaccc

SEQ ID NO: 812441 - DNA, 25 bp, Mus musculus
tgctggagctgagtgagagtcaccc

SEQ ID NO: 812442 - DNA, 25 bp, Mus musculus
tgctggaggacgcaaacctgcttgt

SEQ ID NO: 812443 - DNA, 25 bp, Mus musculus
tgctggaggacggaaacctgcttgt

SEQ ID NO: 812444 - DNA, 25 bp, Mus musculus
tgctggaggcaccacatcaagccac

SEQ ID NO: 812445 - DNA, 25 bp, Mus musculus
tgctggaggcacgacatcaagccac

SEQ ID NO: 812446 - DNA, 25 bp, Mus musculus
tgctggaggcataacgatgggaaac

SEQ ID NO: 812447 - DNA, 25 bp, Mus musculus
tgctggaggcattacgatgggaaac

SEQ ID NO: 812448 - DNA, 25 bp, Mus musculus
tgctggaggccaactgtaaacactg

SEQ ID NO: 812449 - DNA, 25 bp, Mus musculus
tgctggaggccatctgtaaacactg

SEQ ID NO: 812450 - DNA, 25 bp, Mus musculus
tgctggagggcgagatcaacacaga

SEQ ID NO: 812451 - DNA, 25 bp, Mus musculus
tgctggagggcgtgatcaacacaga

SEQ ID NO: 812452 - DNA, 25 bp, Mus musculus
tgctggagtatcagggtaaccctgc

SEQ ID NO: 812453 - DNA, 25 bp, Mus musculus
tgctggagtatctgggtaaccctgc

SEQ ID NO: 812454 - DNA, 25 bp, Mus musculus
tgctggagtatgacaagtggcgtct

SEQ ID NO: 812455 - DNA, 25 bp, Mus musculus
tgctggagtatgagccacgctcagg

SEQ ID NO: 812456 - DNA, 25 bp, Mus musculus
tgctggagtatgtcaagtggcgtct

SEQ ID NO: 812457 - DNA, 25 bp, Mus musculus
tgctggagtatgtgccacgctcagg

SEQ ID NO: 812458 - DNA, 25 bp, Mus musculus
tgctggagtcctctgttgtaccttg

SEQ ID NO: 812459 - DNA, 25 bp, Mus musculus
tgctggagtcctgtgttgtaccttg

SEQ ID NO: 812460 - DNA, 25 bp, Mus musculus
tgctggagtgcaagaactcacccat

SEQ ID NO: 812461 - DNA, 25 bp, Mus musculus
tgctggagtgcatgaactcacccat

SEQ ID NO: 812462 - DNA, 25 bp, Mus musculus
tgctggagtggcagaagacatttga

SEQ ID NO: 812463 - DNA, 25 bp, Mus musculus
tgctggagtggctgaagacatttga

SEQ ID NO: 812464 - DNA, 25 bp, Mus musculus
tgctggagtgggagaaagtcctcca

SEQ ID NO: 812465 - DNA, 25 bp, Mus musculus
tgctggagtgggtgaaagtcctcca

SEQ ID NO: 812466 - DNA, 25 bp, Mus musculus
tgctggagttagattctgctaggta

SEQ ID NO: 812467 - DNA, 25 bp, Mus musculus
tgctggagttagtttctgctaggta

SEQ ID NO: 812468 - DNA, 25 bp, Mus musculus
tgctggataccacaggagagacctc

SEQ ID NO: 812469 - DNA, 25 bp, Mus musculus
tgctggataccagaggagagacctc

SEQ ID NO: 812470 - DNA, 25 bp, Mus musculus
tgctggatcagaacttccaggaaga

SEQ ID NO: 812471 - DNA, 25 bp, Mus musculus
tgctggatcagatcttccaggaaga

SEQ ID NO: 812472 - DNA, 25 bp, Mus musculus
tgctggatccctacactatcaagcc

SEQ ID NO: 812473 - DNA, 25 bp, Mus musculus
tgctggatccctcttatgctaagaa

SEQ ID NO: 812474 - DNA, 25 bp, Mus musculus
tgctggatccctgttatgctaagaa

SEQ ID NO: 812475 - DNA, 25 bp, Mus musculus
tgctggatcccttcactatcaagcc

SEQ ID NO: 812476 - DNA, 25 bp, Mus musculus
tgctggatcgctctgatcagcccct

SEQ ID NO: 812477 - DNA, 25 bp, Mus musculus
tgctggatcgctgtgatcagcccct

SEQ ID NO: 812478 - DNA, 25 bp, Mus musculus
tgctggatgaagaggccagatctgc

SEQ ID NO: 812479 - DNA, 25 bp, Mus musculus
tgctggatgaagtggccagatctgc

SEQ ID NO: 812480 - DNA, 25 bp, Mus musculus
tgctggatgaccacttccgtaagac

SEQ ID NO: 812481 - DNA, 25 bp, Mus musculus
tgctggatgacctcttccgtaagac

SEQ ID NO: 812482 - DNA, 25 bp, Mus musculus
tgctggatgactatgggcctcaacg

SEQ ID NO: 812483 - DNA, 25 bp, Mus musculus
tgctggatgactttgggcctcaacg

SEQ ID NO: 812484 - DNA, 25 bp, Mus musculus
tgctggatgcctccctgtacatcct

SEQ ID NO: 812485 - DNA, 25 bp, Mus musculus
tgctggatgcctgcctgtacatcct

SEQ ID NO: 812486 - DNA, 25 bp, Mus musculus
tgctggatgtttctcactgttgtgc

SEQ ID NO: 812487 - DNA, 25 bp, Mus musculus
tgctggatgtttgtcactgttgtgc

SEQ ID NO: 812488 - DNA, 25 bp, Mus musculus
tgctggattcaaaaagatatgccat

SEQ ID NO: 812489 - DNA, 25 bp, Mus musculus
tgctggattcaataagatatgccat

SEQ ID NO: 812490 - DNA, 25 bp, Mus musculus
tgctggcaaaacctgtaaccagacc

SEQ ID NO: 812491 - DNA, 25 bp, Mus musculus
tgctggcaaaacgtgtaaccagacc

SEQ ID NO: 812492 - DNA, 25 bp, Mus musculus
tgctggcaaagcagcttcggatcgc

SEQ ID NO: 812493 - DNA, 25 bp, Mus musculus
tgctggcaaagctgcttcggatcgc

SEQ ID NO: 812494 - DNA, 25 bp, Mus musculus
tgctggcacagcagggctacgatga

SEQ ID NO: 812495 - DNA, 25 bp, Mus musculus
tgctggcacagctgggctacgatga

SEQ ID NO: 812496 - DNA, 25 bp, Mus musculus
tgctggcaccagagttcgacttcca

SEQ ID NO: 812497 - DNA, 25 bp, Mus musculus
tgctggcaccagtgttcgacttcca

SEQ ID NO: 812498 - DNA, 25 bp, Mus musculus
tgctggcagcgaacttgaagaaaca

SEQ ID NO: 812499 - DNA, 25 bp, Mus musculus
tgctggcagcgatcttgaagaaaca

SEQ ID NO: 812500 - DNA, 25 bp, Mus musculus
tgctggcagctacatgccttaccaa

SEQ ID NO: 812501 - DNA, 25 bp, Mus musculus
tgctggcagctagatgccttaccaa

SEQ ID NO: 812502 - DNA, 25 bp, Mus musculus
tgctggcagttcataagtctctttg

SEQ ID NO: 812503 - DNA, 25 bp, Mus musculus
tgctggcagttcttaagtctctttg

SEQ ID NO: 812504 - DNA, 25 bp, Mus musculus
tgctggcagttgcaggatttgccct

SEQ ID NO: 812505 - DNA, 25 bp, Mus musculus
tgctggcagttggaggatttgccct

SEQ ID NO: 812506 - DNA, 25 bp, Mus musculus
tgctggcatcctcgcctatgtctat

SEQ ID NO: 812507 - DNA, 25 bp, Mus musculus
tgctggcatcctggcctatgtctat

SEQ ID NO: 812508 - DNA, 25 bp, Mus musculus
tgctggcatcgacaactacacatct

SEQ ID NO: 812509 - DNA, 25 bp, Mus musculus
tgctggcatcgagaactacacatct

SEQ ID NO: 812510 - DNA, 25 bp, Mus musculus
tgctggccaagtacaggcttgagct

SEQ ID NO: 812511 - DNA, 25 bp, Mus musculus
tgctggccaagttcaggcttgagct

SEQ ID NO: 812512 - DNA, 25 bp, Mus musculus
tgctggccaataaaaacgcttctct

SEQ ID NO: 812513 - DNA, 25 bp, Mus musculus
tgctggccaatataaacgcttctct

SEQ ID NO: 812514 - DNA, 25 bp, Mus musculus
tgctggccacagactacatgcagca

SEQ ID NO: 812515 - DNA, 25 bp, Mus musculus
tgctggccacagagcaagaggatgc

SEQ ID NO: 812516 - DNA, 25 bp, Mus musculus
tgctggccacagtctacatgcagca

SEQ ID NO: 812517 - DNA, 25 bp, Mus musculus
tgctggccacagtgcaagaggatgc

SEQ ID NO: 812518 - DNA, 25 bp, Mus musculus
tgctggccacggacgccgacatcgt

SEQ ID NO: 812519 - DNA, 25 bp, Mus musculus
tgctggccacggtcgccgacatcgt

SEQ ID NO: 812520 - DNA, 25 bp, Mus musculus
tgctggccagagatcattgcgtgct

SEQ ID NO: 812521 - DNA, 25 bp, Mus musculus
tgctggccagagttcattgcgtgct

SEQ ID NO: 812522 - DNA, 25 bp, Mus musculus
tgctggccagttacggcagagatca

SEQ ID NO: 812523 - DNA, 25 bp, Mus musculus
tgctggccagtttcggcagagatca

SEQ ID NO: 812524 - DNA, 25 bp, Mus musculus
tgctggccatcaacgggcatgacct

SEQ ID NO: 812525 - DNA, 25 bp, Mus musculus
tgctggccatcaatgcgggctgcct

SEQ ID NO: 812526 - DNA, 25 bp, Mus musculus
tgctggccatcatcgggcatgacct

SEQ ID NO: 812527 - DNA, 25 bp, Mus musculus
tgctggccatcattgcgggctgcct

SEQ ID NO: 812528 - DNA, 25 bp, Mus musculus
tgctggccatcgatgacgacatcat

SEQ ID NO: 812529 - DNA, 25 bp, Mus musculus
tgctggccatcgttgacgacatcat

SEQ ID NO: 812530 - DNA, 25 bp, Mus musculus
tgctggccatggacaggaagtcctc

SEQ ID NO: 812531 - DNA, 25 bp, Mus musculus
tgctggccatggctacacctactcg

SEQ ID NO: 812532 - DNA, 25 bp, Mus musculus
tgctggccatgggtacacctactcg

SEQ ID NO: 812533 - DNA, 25 bp, Mus musculus
tgctggccatggtcaggaagtcctc

SEQ ID NO: 812534 - DNA, 25 bp, Mus musculus
tgctggcccagcatggaatccgatg

SEQ ID NO: 812535 - DNA, 25 bp, Mus musculus
tgctggcccagcttggaatccgatg

SEQ ID NO: 812536 - DNA, 25 bp, Mus musculus
tgctggcccatgctaagtattttct

SEQ ID NO: 812537 - DNA, 25 bp, Mus musculus
tgctggcccatggtaagtattttct

SEQ ID NO: 812538 - DNA, 25 bp, Mus musculus
tgctggcccctgagctgtttggaga

SEQ ID NO: 812539 - DNA, 25 bp, Mus musculus
tgctggcccctgtgctgtttggaga

SEQ ID NO: 812540 - DNA, 25 bp, Mus musculus
tgctggccctagacacttggatgag

SEQ ID NO: 812541 - DNA, 25 bp, Mus musculus
tgctggccctagtcacttggatgag

SEQ ID NO: 812542 - DNA, 25 bp, Mus musculus
tgctggccgagaccaaccatgtgag

SEQ ID NO: 812543 - DNA, 25 bp, Mus musculus
tgctggccgagagcaaccatgtgag

SEQ ID NO: 812544 - DNA, 25 bp, Mus musculus
tgctggccgctcaatggaccgattt

SEQ ID NO: 812545 - DNA, 25 bp, Mus musculus
tgctggccgctctatggaccgattt

SEQ ID NO: 812546 - DNA, 25 bp, Mus musculus
tgctggcctcacctcgaatgatcaa

SEQ ID NO: 812547 - DNA, 25 bp, Mus musculus
tgctggcctcacgtcgaatgatcaa

SEQ ID NO: 812548 - DNA, 25 bp, Mus musculus
tgctggcctccacgaatatcgagtc

SEQ ID NO: 812549 - DNA, 25 bp, Mus musculus
tgctggcctccaggaatatcgagtc

SEQ ID NO: 812550 - DNA, 25 bp, Mus musculus
tgctggcctgatcaggactgaccaa

SEQ ID NO: 812551 - DNA, 25 bp, Mus musculus
tgctggcctgatgaggactgaccaa

SEQ ID NO: 812552 - DNA, 25 bp, Mus musculus
tgctggcctgccaaaaagatactga

SEQ ID NO: 812553 - DNA, 25 bp, Mus musculus
tgctggcctgccaacggcgccatgg

SEQ ID NO: 812554 - DNA, 25 bp, Mus musculus
tgctggcctgccataagttctgaac

SEQ ID NO: 812555 - DNA, 25 bp, Mus musculus
tgctggcctgcctaaaagatactga

SEQ ID NO: 812556 - DNA, 25 bp, Mus musculus
tgctggcctgcctacggcgccatgg

SEQ ID NO: 812557 - DNA, 25 bp, Mus musculus
tgctggcctgccttaagttctgaac

SEQ ID NO: 812558 - DNA, 25 bp, Mus musculus
tgctggccttcaagactagaccctc

SEQ ID NO: 812559 - DNA, 25 bp, Mus musculus
tgctggccttcatgactagaccctc

SEQ ID NO: 812560 - DNA, 25 bp, Mus musculus
tgctggccttctcctagctaagcct

SEQ ID NO: 812561 - DNA, 25 bp, Mus musculus
tgctggccttctgctagctaagcct

SEQ ID NO: 812562 - DNA, 25 bp, Mus musculus
tgctggcgagccagtacatcgtcct

SEQ ID NO: 812563 - DNA, 25 bp, Mus musculus
tgctggcgagcctgtacatcgtcct

SEQ ID NO: 812564 - DNA, 25 bp, Mus musculus
tgctggcggtccctggctgataact

SEQ ID NO: 812565 - DNA, 25 bp, Mus musculus
tgctggcggtccgtggctgataact

SEQ ID NO: 812566 - DNA, 25 bp, Mus musculus
tgctggcgttggaaagacagtactg

SEQ ID NO: 812567 - DNA, 25 bp, Mus musculus
tgctggcgttggtaagacagtactg

SEQ ID NO: 812568 - DNA, 25 bp, Mus musculus
tgctggctaattccacaggactgcg

SEQ ID NO: 812569 - DNA, 25 bp, Mus musculus
tgctggctaattgcacaggactgcg

SEQ ID NO: 812570 - DNA, 25 bp, Mus musculus
tgctggctatcaccacagtattgtc

SEQ ID NO: 812571 - DNA, 25 bp, Mus musculus
tgctggctatcagcacagtattgtc

SEQ ID NO: 812572 - DNA, 25 bp, Mus musculus
tgctggctcacaagattcatgtgta

SEQ ID NO: 812573 - DNA, 25 bp, Mus musculus
tgctggctcacatgattcatgtgta

SEQ ID NO: 812574 - DNA, 25 bp, Mus musculus
tgctggctcagacaacaagaactgt

SEQ ID NO: 812575 - DNA, 25 bp, Mus musculus
tgctggctcagagaacaagaactgt

SEQ ID NO: 812576 - DNA, 25 bp, Mus musculus
tgctggctccgccaagcaaagaacg

SEQ ID NO: 812577 - DNA, 25 bp, Mus musculus
tgctggctccgcgaagcaaagaacg

SEQ ID NO: 812578 - DNA, 25 bp, Mus musculus
tgctggctctgacgttgtctccatg

SEQ ID NO: 812579 - DNA, 25 bp, Mus musculus
tgctggctctgaggttgtctccatg

SEQ ID NO: 812580 - DNA, 25 bp, Mus musculus
tgctggctgacacgagataaaccaa

SEQ ID NO: 812581 - DNA, 25 bp, Mus musculus
tgctggctgacaggagataaaccaa

SEQ ID NO: 812582 - DNA, 25 bp, Mus musculus
tgctggctgaccaccggagtataaa

SEQ ID NO: 812583 - DNA, 25 bp, Mus musculus
tgctggctgacctccggagtataaa

SEQ ID NO: 812584 - DNA, 25 bp, Mus musculus
tgctggctgatacctgtgctctact

SEQ ID NO: 812585 - DNA, 25 bp, Mus musculus
tgctggctgatagctgtgctctact

SEQ ID NO: 812586 - DNA, 25 bp, Mus musculus
tgctggctgattatgggccccacgg

SEQ ID NO: 812587 - DNA, 25 bp, Mus musculus
tgctggctgattttgggccccacgg

SEQ ID NO: 812588 - DNA, 25 bp, Mus musculus
tgctggctgcagaaattggcatagt

SEQ ID NO: 812589 - DNA, 25 bp, Mus musculus
tgctggctgcagctacgtcacttcc

SEQ ID NO: 812590 - DNA, 25 bp, Mus musculus
tgctggctgcaggtacgtcacttcc

SEQ ID NO: 812591 - DNA, 25 bp, Mus musculus
tgctggctgcagtaattggcatagt

SEQ ID NO: 812592 - DNA, 25 bp, Mus musculus
tgctggctgcctcgccactgcatgg

SEQ ID NO: 812593 - DNA, 25 bp, Mus musculus
tgctggctgcctggccactgcatgg

SEQ ID NO: 812594 - DNA, 25 bp, Mus musculus
tgctggctgcggagtttctgaagca

SEQ ID NO: 812595 - DNA, 25 bp, Mus musculus
tgctggctgcggtgtttctgaagca

SEQ ID NO: 812596 - DNA, 25 bp, Mus musculus
tgctggctggaaaccatgatcacct

SEQ ID NO: 812597 - DNA, 25 bp, Mus musculus
tgctggctggaatccatgatcacct

SEQ ID NO: 812598 - DNA, 25 bp, Mus musculus
tgctggctgggcacacagtacttcc

SEQ ID NO: 812599 - DNA, 25 bp, Mus musculus
tgctggctgggctcacagtacttcc

SEQ ID NO: 812600 - DNA, 25 bp, Mus musculus
tgctggctgtgcagcctatatggct

SEQ ID NO: 812601 - DNA, 25 bp, Mus musculus
tgctggctgtgctgcctatatggct

SEQ ID NO: 812602 - DNA, 25 bp, Mus musculus
tgctggcttactctcgtctcgagat

SEQ ID NO: 812603 - DNA, 25 bp, Mus musculus
tgctggcttactgtcgtctcgagat

SEQ ID NO: 812604 - DNA, 25 bp, Mus musculus
tgctggcttctgatccgggacggac

SEQ ID NO: 812605 - DNA, 25 bp, Mus musculus
tgctggcttctgttccgggacggac

SEQ ID NO: 812606 - DNA, 25 bp, Mus musculus
tgctggcttggtcgcaactgtatca

SEQ ID NO: 812607 - DNA, 25 bp, Mus musculus
tgctggcttggtggcaactgtatca

SEQ ID NO: 812608 - DNA, 25 bp, Mus musculus
tgctggctttaaacgccttcggcag

SEQ ID NO: 812609 - DNA, 25 bp, Mus musculus
tgctggctttaatcgccttcggcag

SEQ ID NO: 812610 - DNA, 25 bp, Mus musculus
tgctgggaaactcgacataagccag

SEQ ID NO: 812611 - DNA, 25 bp, Mus musculus
tgctgggaaactctataatacctgc

SEQ ID NO: 812612 - DNA, 25 bp, Mus musculus
tgctgggaaactggacataagccag

SEQ ID NO: 812613 - DNA, 25 bp, Mus musculus
tgctgggaaactgtataatacctgc

SEQ ID NO: 812614 - DNA, 25 bp, Mus musculus
tgctgggaaaggctcccgtcctcca

SEQ ID NO: 812615 - DNA, 25 bp, Mus musculus
tgctgggaaagggtcccgtcctcca

SEQ ID NO: 812616 - DNA, 25 bp, Mus musculus
tgctgggaaccgaaaacgcttccgt

SEQ ID NO: 812617 - DNA, 25 bp, Mus musculus
tgctgggaaccgtaaacgcttccgt

SEQ ID NO: 812618 - DNA, 25 bp, Mus musculus
tgctgggaacgcattctgccaggct

SEQ ID NO: 812619 - DNA, 25 bp, Mus musculus
tgctgggaacgctttctgccaggct

SEQ ID NO: 812620 - DNA, 25 bp, Mus musculus
tgctgggaaggaacctgtcctctgt

SEQ ID NO: 812621 - DNA, 25 bp, Mus musculus
tgctgggaaggatcctgtcctctgt

SEQ ID NO: 812622 - DNA, 25 bp, Mus musculus
tgctgggaattcctccgagaaccag

SEQ ID NO: 812623 - DNA, 25 bp, Mus musculus
tgctgggaattcgtccgagaaccag

SEQ ID NO: 812624 - DNA, 25 bp, Mus musculus
tgctgggaccccagatcttcaactt

SEQ ID NO: 812625 - DNA, 25 bp, Mus musculus
tgctgggacccctgatcttcaactt

SEQ ID NO: 812626 - DNA, 25 bp, Mus musculus
tgctgggacggcagctgcattactg

SEQ ID NO: 812627 - DNA, 25 bp, Mus musculus
tgctgggacggctgctgcattactg

SEQ ID NO: 812628 - DNA, 25 bp, Mus musculus
tgctgggagcatacctgtctgtgga

SEQ ID NO: 812629 - DNA, 25 bp, Mus musculus
tgctgggagcataggaagattgaca

SEQ ID NO: 812630 - DNA, 25 bp, Mus musculus
tgctgggagcattcctgtctgtgga

SEQ ID NO: 812631 - DNA, 25 bp, Mus musculus
tgctgggagcattggaagattgaca

SEQ ID NO: 812632 - DNA, 25 bp, Mus musculus
tgctgggagctaactgtgccatcat

SEQ ID NO: 812633 - DNA, 25 bp, Mus musculus
tgctgggagctatctgtgccatcat

SEQ ID NO: 812634 - DNA, 25 bp, Mus musculus
tgctgggaggcccacagtaccacca

SEQ ID NO: 812635 - DNA, 25 bp, Mus musculus
tgctgggaggccgacagtaccacca

SEQ ID NO: 812636 - DNA, 25 bp, Mus musculus
tgctgggagtaaaggtgacacacac

SEQ ID NO: 812637 - DNA, 25 bp, Mus musculus
tgctgggagtaatggtgacacacac

SEQ ID NO: 812638 - DNA, 25 bp, Mus musculus
tgctgggagttacaggccctacgac

SEQ ID NO: 812639 - DNA, 25 bp, Mus musculus
tgctgggagttagaggccctacgac

SEQ ID NO: 812640 - DNA, 25 bp, Mus musculus
tgctgggatatgaatgacagcacag

SEQ ID NO: 812641 - DNA, 25 bp, Mus musculus
tgctgggatatgtatgacagcacag

SEQ ID NO: 812642 - DNA, 25 bp, Mus musculus
tgctgggatgccagaacagtggtac

SEQ ID NO: 812643 - DNA, 25 bp, Mus musculus
tgctgggatgcctgaacagtggtac

SEQ ID NO: 812644 - DNA, 25 bp, Mus musculus
tgctgggcactcatcatcaacaccg

SEQ ID NO: 812645 - DNA, 25 bp, Mus musculus
tgctgggcactcttcatcaacaccg

SEQ ID NO: 812646 - DNA, 25 bp, Mus musculus
tgctgggccataaagagggtccccg

SEQ ID NO: 812647 - DNA, 25 bp, Mus musculus
tgctgggccatatagagggtccccg

SEQ ID NO: 812648 - DNA, 25 bp, Mus musculus
tgctgggcccagaccccttggggaa

SEQ ID NO: 812649 - DNA, 25 bp, Mus musculus
tgctgggcccagtccccttggggaa

SEQ ID NO: 812650 - DNA, 25 bp, Mus musculus
tgctgggccccacgagtctggataa

SEQ ID NO: 812651 - DNA, 25 bp, Mus musculus
tgctgggccccaggagtctggataa

SEQ ID NO: 812652 - DNA, 25 bp, Mus musculus
tgctgggcctcaagtatatctactg

SEQ ID NO: 812653 - DNA, 25 bp, Mus musculus
tgctgggcctcatgtatatctactg

SEQ ID NO: 812654 - DNA, 25 bp, Mus musculus
tgctgggccttcagctgatgaagtt

SEQ ID NO: 812655 - DNA, 25 bp, Mus musculus
tgctgggccttctgctgatgaagtt

SEQ ID NO: 812656 - DNA, 25 bp, Mus musculus
tgctgggcgaggatttttggcttca

SEQ ID NO: 812657 - DNA, 25 bp, Mus musculus
tgctgggcgaggttttttggcttca

SEQ ID NO: 812658 - DNA, 25 bp, Mus musculus
tgctgggcgcacactttgtctgtga

SEQ ID NO: 812659 - DNA, 25 bp, Mus musculus
tgctgggcgcactctttgtctgtga

SEQ ID NO: 812660 - DNA, 25 bp, Mus musculus
tgctgggcgcctacgtgcttgtcta

SEQ ID NO: 812661 - DNA, 25 bp, Mus musculus
tgctgggcgccttcgtgcttgtcta

SEQ ID NO: 812662 - DNA, 25 bp, Mus musculus
tgctgggctacgaccttgctttggt

SEQ ID NO: 812663 - DNA, 25 bp, Mus musculus
tgctgggctacgtccttgctttggt

SEQ ID NO: 812664 - DNA, 25 bp, Mus musculus
tgctgggctcagacatgagtgatcg

SEQ ID NO: 812665 - DNA, 25 bp, Mus musculus
tgctgggctcagtcatgagtgatcg

SEQ ID NO: 812666 - DNA, 25 bp, Mus musculus
tgctgggctgtgacttgctgcctcc

SEQ ID NO: 812667 - DNA, 25 bp, Mus musculus
tgctgggctgtgtcttgctgcctcc

SEQ ID NO: 812668 - DNA, 25 bp, Mus musculus
tgctgggcttagaatgtgtccatcc

SEQ ID NO: 812669 - DNA, 25 bp, Mus musculus
tgctgggcttagattagagctttcc

SEQ ID NO: 812670 - DNA, 25 bp, Mus musculus
tgctgggcttagtatgtgtccatcc

SEQ ID NO: 812671 - DNA, 25 bp, Mus musculus
tgctgggcttagtttagagctttcc

SEQ ID NO: 812672 - DNA, 25 bp, Mus musculus
tgctgggctttccatctgcaggaga

SEQ ID NO: 812673 - DNA, 25 bp, Mus musculus
tgctgggctttcgatctgcaggaga

SEQ ID NO: 812674 - DNA, 25 bp, Mus musculus
tgctgggcttttcctgcatagtgaa

SEQ ID NO: 812675 - DNA, 25 bp, Mus musculus
tgctgggcttttgctgcatagtgaa

SEQ ID NO: 812676 - DNA, 25 bp, Mus musculus
tgctggggccttagatgatcacggc

SEQ ID NO: 812677 - DNA, 25 bp, Mus musculus
tgctggggcctttgatgatcacggc

SEQ ID NO: 812678 - DNA, 25 bp, Mus musculus
tgctgggtatcaccagaggccttga

SEQ ID NO: 812679 - DNA, 25 bp, Mus musculus
tgctgggtatcagcagaggccttga

SEQ ID NO: 812680 - DNA, 25 bp, Mus musculus
tgctgggtcagtacctgggctcctt

SEQ ID NO: 812681 - DNA, 25 bp, Mus musculus
tgctgggtcagttcctgggctcctt

SEQ ID NO: 812682 - DNA, 25 bp, Mus musculus
tgctgggtcccacagcaggacttct

SEQ ID NO: 812683 - DNA, 25 bp, Mus musculus
tgctgggtcccagagcaggacttct

SEQ ID NO: 812684 - DNA, 25 bp, Mus musculus
tgctgggtctttcccggtgtgacca

SEQ ID NO: 812685 - DNA, 25 bp, Mus musculus
tgctgggtctttgccggtgtgacca

SEQ ID NO: 812686 - DNA, 25 bp, Mus musculus
tgctgggtgcacatctcattctgtc

SEQ ID NO: 812687 - DNA, 25 bp, Mus musculus
tgctgggtgcacttctcattctgtc

SEQ ID NO: 812688 - DNA, 25 bp, Mus musculus
tgctgggtgccgctggagttgggaa

SEQ ID NO: 812689 - DNA, 25 bp, Mus musculus
tgctgggtgccggtggagttgggaa

SEQ ID NO: 812690 - DNA, 25 bp, Mus musculus
tgctgggtggctccttcggctttct

SEQ ID NO: 812691 - DNA, 25 bp, Mus musculus
tgctgggtggctgcttcggctttct

SEQ ID NO: 812692 - DNA, 25 bp, Mus musculus
tgctgggttgagctagggtgctttc

SEQ ID NO: 812693 - DNA, 25 bp, Mus musculus
tgctgggttgaggtagggtgctttc

SEQ ID NO: 812694 - DNA, 25 bp, Mus musculus
tgctggtaaccaaagctgttgtcta

SEQ ID NO: 812695 - DNA, 25 bp, Mus musculus
tgctggtaaccatagctgttgtcta

SEQ ID NO: 812696 - DNA, 25 bp, Mus musculus
tgctggtacctgagaggttggctcc

SEQ ID NO: 812697 - DNA, 25 bp, Mus musculus
tgctggtacctgtgaggttggctcc

SEQ ID NO: 812698 - DNA, 25 bp, Mus musculus
tgctggtacttgatttcaaatccat

SEQ ID NO: 812699 - DNA, 25 bp, Mus musculus
tgctggtacttgttttcaaatccat

SEQ ID NO: 812700 - DNA, 25 bp, Mus musculus
tgctggtagaagaggccattagtga

SEQ ID NO: 812701 - DNA, 25 bp, Mus musculus
tgctggtagaagtggccattagtga

SEQ ID NO: 812702 - DNA, 25 bp, Mus musculus
tgctggtatttacagcgcagcgcct

SEQ ID NO: 812703 - DNA, 25 bp, Mus musculus
tgctggtatttagagcgcagcgcct

SEQ ID NO: 812704 - DNA, 25 bp, Mus musculus
tgctggtcagttatgatcccaggat

SEQ ID NO: 812705 - DNA, 25 bp, Mus musculus
tgctggtcagttttgatcccaggat

SEQ ID NO: 812706 - DNA, 25 bp, Mus musculus
tgctggtccaaacaggacccagaga

SEQ ID NO: 812707 - DNA, 25 bp, Mus musculus
tgctggtccaaagaggacccagaga

SEQ ID NO: 812708 - DNA, 25 bp, Mus musculus
tgctggtccctgacatccaagagat

SEQ ID NO: 812709 - DNA, 25 bp, Mus musculus
tgctggtccctgtcatccaagagat

SEQ ID NO: 812710 - DNA, 25 bp, Mus musculus
tgctggtccgatcagatgttcctac

SEQ ID NO: 812711 - DNA, 25 bp, Mus musculus
tgctggtccgatgagatgttcctac

SEQ ID NO: 812712 - DNA, 25 bp, Mus musculus
tgctggtcgcccacagcatgggcaa

SEQ ID NO: 812713 - DNA, 25 bp, Mus musculus
tgctggtcgccctcagcatgggcaa

SEQ ID NO: 812714 - DNA, 25 bp, Mus musculus
tgctggtcggcaacaaaacggatct

SEQ ID NO: 812715 - DNA, 25 bp, Mus musculus
tgctggtcggcatcaaaacggatct

SEQ ID NO: 812716 - DNA, 25 bp, Mus musculus
tgctggtctactacgagatctgcga

SEQ ID NO: 812717 - DNA, 25 bp, Mus musculus
tgctggtctacttcgagatctgcga

SEQ ID NO: 812718 - DNA, 25 bp, Mus musculus
tgctggtctgctcggttctcactga

SEQ ID NO: 812719 - DNA, 25 bp, Mus musculus
tgctggtctgctgggttctcactga

SEQ ID NO: 812720 - DNA, 25 bp, Mus musculus
tgctggtgaaacagaccatcgcgca

SEQ ID NO: 812721 - DNA, 25 bp, Mus musculus
tgctggtgaaactgaccatcgcgca

SEQ ID NO: 812722 - DNA, 25 bp, Mus musculus
tgctggtgaagaccttctccgagag

SEQ ID NO: 812723 - DNA, 25 bp, Mus musculus
tgctggtgaagacgatctaccggct

SEQ ID NO: 812724 - DNA, 25 bp, Mus musculus
tgctggtgaagagcttctccgagag

SEQ ID NO: 812725 - DNA, 25 bp, Mus musculus
tgctggtgaagaggatctaccggct

SEQ ID NO: 812726 - DNA, 25 bp, Mus musculus
tgctggtgaaggcatcaaattctac

SEQ ID NO: 812727 - DNA, 25 bp, Mus musculus
tgctggtgaagggatcaaattctac

SEQ ID NO: 812728 - DNA, 25 bp, Mus musculus
tgctggtgaccaaggcccatcacag

SEQ ID NO: 812729 - DNA, 25 bp, Mus musculus
tgctggtgaccatggcccatcacag

SEQ ID NO: 812730 - DNA, 25 bp, Mus musculus
tgctggtgaccgagaagggcggcct

SEQ ID NO: 812731 - DNA, 25 bp, Mus musculus
tgctggtgaccgtgaagggcggcct

SEQ ID NO: 812732 - DNA, 25 bp, Mus musculus
tgctggtgagtaccagtcggtaccc

SEQ ID NO: 812733 - DNA, 25 bp, Mus musculus
tgctggtgagtagcagtcggtaccc

SEQ ID NO: 812734 - DNA, 25 bp, Mus musculus
tgctggtgcactccaagctgttggc

SEQ ID NO: 812735 - DNA, 25 bp, Mus musculus
tgctggtgcactgcaagctgttggc

SEQ ID NO: 812736 - DNA, 25 bp, Mus musculus
tgctggtgccaactgtactagctac

SEQ ID NO: 812737 - DNA, 25 bp, Mus musculus
tgctggtgccaagtgtactagctac

SEQ ID NO: 812738 - DNA, 25 bp, Mus musculus
tgctggtgccatcaagtcttccttt

SEQ ID NO: 812739 - DNA, 25 bp, Mus musculus
tgctggtgccatgaagtcttccttt

SEQ ID NO: 812740 - DNA, 25 bp, Mus musculus
tgctggtgcgctctgtcactctgtc

SEQ ID NO: 812741 - DNA, 25 bp, Mus musculus
tgctggtgcgctgtgtcactctgtc

SEQ ID NO: 812742 - DNA, 25 bp, Mus musculus
tgctggtggacaatgaagacttgac

SEQ ID NO: 812743 - DNA, 25 bp, Mus musculus
tgctggtggacattgaagacttgac

SEQ ID NO: 812744 - DNA, 25 bp, Mus musculus
tgctggtggagcaagcgctgtccaa

SEQ ID NO: 812745 - DNA, 25 bp, Mus musculus
tgctggtggagctagcgctgtccaa

SEQ ID NO: 812746 - DNA, 25 bp, Mus musculus
tgctggtgggaaacatccaggctgc

SEQ ID NO: 812747 - DNA, 25 bp, Mus musculus
tgctggtgggaatcatccaggctgc

SEQ ID NO: 812748 - DNA, 25 bp, Mus musculus
tgctggtgggccaccctgagcacaa

SEQ ID NO: 812749 - DNA, 25 bp, Mus musculus
tgctggtgggcctccctgagcacaa

SEQ ID NO: 812750 - DNA, 25 bp, Mus musculus
tgctggtggtctaacagtaatgccc

SEQ ID NO: 812751 - DNA, 25 bp, Mus musculus
tgctggtggtcttacagtaatgccc

SEQ ID NO: 812752 - DNA, 25 bp, Mus musculus
tgctggtggttgcagaccaagcacc

SEQ ID NO: 812753 - DNA, 25 bp, Mus musculus
tgctggtggttggagaccaagcacc

SEQ ID NO: 812754 - DNA, 25 bp, Mus musculus
tgctggtgtgccaatcagggatcct

SEQ ID NO: 812755 - DNA, 25 bp, Mus musculus
tgctggtgtgcctatcagggatcct

SEQ ID NO: 812756 - DNA, 25 bp, Mus musculus
tgctggtgttcccactcctgaagcg

SEQ ID NO: 812757 - DNA, 25 bp, Mus musculus
tgctggtgttccgactcctgaagcg

SEQ ID NO: 812758 - DNA, 25 bp, Mus musculus
tgctggtgttgccttcaagaagact

SEQ ID NO: 812759 - DNA, 25 bp, Mus musculus
tgctggtgttgcgttcaagaagact

SEQ ID NO: 812760 - DNA, 25 bp, Mus musculus
tgctggttgcttcccgtaattttgc

SEQ ID NO: 812761 - DNA, 25 bp, Mus musculus
tgctggttgcttgccgtaattttgc

SEQ ID NO: 812762 - DNA, 25 bp, Mus musculus
tgctggtttacaagactccagagca

SEQ ID NO: 812763 - DNA, 25 bp, Mus musculus
tgctggtttacatgactccagagca

SEQ ID NO: 812764 - DNA, 25 bp, Mus musculus
tgctgtaaagcacaagaactgggca

SEQ ID NO: 812765 - DNA, 25 bp, Mus musculus
tgctgtaaagcagaagaactgggca

SEQ ID NO: 812766 - DNA, 25 bp, Mus musculus
tgctgtaaaggaaatgttagaagcc

SEQ ID NO: 812767 - DNA, 25 bp, Mus musculus
tgctgtaaaggatatgttagaagcc

SEQ ID NO: 812768 - DNA, 25 bp, Mus musculus
tgctgtaacagaagtcaaaacagac

SEQ ID NO: 812769 - DNA, 25 bp, Mus musculus
tgctgtaacagatgtcaaaacagac

SEQ ID NO: 812770 - DNA, 25 bp, Mus musculus
tgctgtaagagaataccaatccagg

SEQ ID NO: 812771 - DNA, 25 bp, Mus musculus
tgctgtaagagattaccaatccagg

SEQ ID NO: 812772 - DNA, 25 bp, Mus musculus
tgctgtaagcagatctcactatggc

SEQ ID NO: 812773 - DNA, 25 bp, Mus musculus
tgctgtaagcagttctcactatggc

SEQ ID NO: 812774 - DNA, 25 bp, Mus musculus
tgctgtacacaaacattcacgcctg

SEQ ID NO: 812775 - DNA, 25 bp, Mus musculus
tgctgtacacaatcattcacgcctg

SEQ ID NO: 812776 - DNA, 25 bp, Mus musculus
tgctgtacactcaatgccatgaggg

SEQ ID NO: 812777 - DNA, 25 bp, Mus musculus
tgctgtacactctatgccatgaggg

SEQ ID NO: 812778 - DNA, 25 bp, Mus musculus
tgctgtaccgggaaagctgcttgcc

SEQ ID NO: 812779 - DNA, 25 bp, Mus musculus
tgctgtaccgggtaagctgcttgcc

SEQ ID NO: 812780 - DNA, 25 bp, Mus musculus
tgctgtacgagtctgagagcccctg

SEQ ID NO: 812781 - DNA, 25 bp, Mus musculus
tgctgtacgagtgtgagagcccctg

SEQ ID NO: 812782 - DNA, 25 bp, Mus musculus
tgctgtacgggcagtcgctggcact

SEQ ID NO: 812783 - DNA, 25 bp, Mus musculus
tgctgtacgggctgtcgctggcact

SEQ ID NO: 812784 - DNA, 25 bp, Mus musculus
tgctgtactagcctagagacctgag

SEQ ID NO: 812785 - DNA, 25 bp, Mus musculus
tgctgtactagcgtagagacctgag

SEQ ID NO: 812786 - DNA, 25 bp, Mus musculus
tgctgtagaagactgcatgactggt

SEQ ID NO: 812787 - DNA, 25 bp, Mus musculus
tgctgtagaagagtgcatgactggt

SEQ ID NO: 812788 - DNA, 25 bp, Mus musculus
tgctgtagacctcttccgtaatgcg

SEQ ID NO: 812789 - DNA, 25 bp, Mus musculus
tgctgtagacctgttccgtaatgcg

SEQ ID NO: 812790 - DNA, 25 bp, Mus musculus
tgctgtagactcagttaccctgtga

SEQ ID NO: 812791 - DNA, 25 bp, Mus musculus
tgctgtagactctgttaccctgtga

SEQ ID NO: 812792 - DNA, 25 bp, Mus musculus
tgctgtagagaaccagctcaagtgg

SEQ ID NO: 812793 - DNA, 25 bp, Mus musculus
tgctgtagagaagcagctcaagtgg

SEQ ID NO: 812794 - DNA, 25 bp, Mus musculus
tgctgtagatctctccgatccaaca

SEQ ID NO: 812795 - DNA, 25 bp, Mus musculus
tgctgtagatctgtccgatccaaca

SEQ ID NO: 812796 - DNA, 25 bp, Mus musculus
tgctgtagattgacggccccgcgct

SEQ ID NO: 812797 - DNA, 25 bp, Mus musculus
tgctgtagattgtcggccccgcgct

SEQ ID NO: 812798 - DNA, 25 bp, Mus musculus
tgctgtagcccgagtgaccacttcc

SEQ ID NO: 812799 - DNA, 25 bp, Mus musculus
tgctgtagcccgtgtgaccacttcc

SEQ ID NO: 812800 - DNA, 25 bp, Mus musculus
tgctgtaggcgaaggcatagttctt

SEQ ID NO: 812801 - DNA, 25 bp, Mus musculus
tgctgtaggcgatggcatagttctt

SEQ ID NO: 812802 - DNA, 25 bp, Mus musculus
tgctgtatctagacagcccaatggg

SEQ ID NO: 812803 - DNA, 25 bp, Mus musculus
tgctgtatctagtcagcccaatggg

SEQ ID NO: 812804 - DNA, 25 bp, Mus musculus
tgctgtatgacgaacaggagctgcg

SEQ ID NO: 812805 - DNA, 25 bp, Mus musculus
tgctgtatgacgtacaggagctgcg

SEQ ID NO: 812806 - DNA, 25 bp, Mus musculus
tgctgtatgccaagctggaccacag

SEQ ID NO: 812807 - DNA, 25 bp, Mus musculus
tgctgtatgccatgctggaccacag

SEQ ID NO: 812808 - DNA, 25 bp, Mus musculus
tgctgtattatgaaaaggatattcc

SEQ ID NO: 812809 - DNA, 25 bp, Mus musculus
tgctgtattatgtaaaggatattcc

SEQ ID NO: 812810 - DNA, 25 bp, Mus musculus
tgctgtattgaaattaacttggtag

SEQ ID NO: 812811 - DNA, 25 bp, Mus musculus
tgctgtattgaatttaacttggtag

SEQ ID NO: 812812 - DNA, 25 bp, Mus musculus
tgctgtcaagccctttcccagagac

SEQ ID NO: 812813 - DNA, 25 bp, Mus musculus
tgctgtcaagccgtttcccagagac

SEQ ID NO: 812814 - DNA, 25 bp, Mus musculus
tgctgtcaatgacgtccgctgcttg

SEQ ID NO: 812815 - DNA, 25 bp, Mus musculus
tgctgtcaatgaggtccgctgcttg

SEQ ID NO: 812816 - DNA, 25 bp, Mus musculus
tgctgtcaccaactcaaccatggag

SEQ ID NO: 812817 - DNA, 25 bp, Mus musculus
tgctgtcaccaagtcaaccatggag

SEQ ID NO: 812818 - DNA, 25 bp, Mus musculus
tgctgtcactctcgcccttagctga

SEQ ID NO: 812819 - DNA, 25 bp, Mus musculus
tgctgtcactctggcccttagctga

SEQ ID NO: 812820 - DNA, 25 bp, Mus musculus
tgctgtcactggcattgctgtcgca

SEQ ID NO: 812821 - DNA, 25 bp, Mus musculus
tgctgtcactgggattgctgtcgca

SEQ ID NO: 812822 - DNA, 25 bp, Mus musculus
tgctgtcactttctgagtgctgagt

SEQ ID NO: 812823 - DNA, 25 bp, Mus musculus
tgctgtcactttgtgagtgctgagt

SEQ ID NO: 812824 - DNA, 25 bp, Mus musculus
tgctgtcagaacatctaaggcgtct

SEQ ID NO: 812825 - DNA, 25 bp, Mus musculus
tgctgtcagaacttctaaggcgtct

SEQ ID NO: 812826 - DNA, 25 bp, Mus musculus
tgctgtcagatgcacgaccgttgtt

SEQ ID NO: 812827 - DNA, 25 bp, Mus musculus
tgctgtcagatggacgaccgttgtt

SEQ ID NO: 812828 - DNA, 25 bp, Mus musculus
tgctgtcagcgtagggcatgctggc

SEQ ID NO: 812829 - DNA, 25 bp, Mus musculus
tgctgtcagcgttgggcatgctggc

SEQ ID NO: 812830 - DNA, 25 bp, Mus musculus
tgctgtcagggcagtgacccgtatg

SEQ ID NO: 812831 - DNA, 25 bp, Mus musculus
tgctgtcagggctgtgacccgtatg

SEQ ID NO: 812832 - DNA, 25 bp, Mus musculus
tgctgtcagtatcaccgggactcag

SEQ ID NO: 812833 - DNA, 25 bp, Mus musculus
tgctgtcagtatgaccgggactcag

SEQ ID NO: 812834 - DNA, 25 bp, Mus musculus
tgctgtcatcaacgctcggaagctg

SEQ ID NO: 812835 - DNA, 25 bp, Mus musculus
tgctgtcatcaaggctcggaagctg

SEQ ID NO: 812836 - DNA, 25 bp, Mus musculus
tgctgtccaagaacgatggcgttga

SEQ ID NO: 812837 - DNA, 25 bp, Mus musculus
tgctgtccaagatcgatggcgttga

SEQ ID NO: 812838 - DNA, 25 bp, Mus musculus
tgctgtccaagtactgccttctaac

SEQ ID NO: 812839 - DNA, 25 bp, Mus musculus
tgctgtccaagttctgccttctaac

SEQ ID NO: 812840 - DNA, 25 bp, Mus musculus
tgctgtccagtcacataaagaggac

SEQ ID NO: 812841 - DNA, 25 bp, Mus musculus
tgctgtccagtctcataaagaggac

SEQ ID NO: 812842 - DNA, 25 bp, Mus musculus
tgctgtccatgcagccgacactgag

SEQ ID NO: 812843 - DNA, 25 bp, Mus musculus
tgctgtccatgctgccgacactgag

SEQ ID NO: 812844 - DNA, 25 bp, Mus musculus
tgctgtcccacaatggtgagcgcat

SEQ ID NO: 812845 - DNA, 25 bp, Mus musculus
tgctgtcccacattggtgagcgcat

SEQ ID NO: 812846 - DNA, 25 bp, Mus musculus
tgctgtcccgcgacctgctgtggaa

SEQ ID NO: 812847 - DNA, 25 bp, Mus musculus
tgctgtcccgcgtcctgctgtggaa

SEQ ID NO: 812848 - DNA, 25 bp, Mus musculus
tgctgtcccgtgagcgaaacaagcc

SEQ ID NO: 812849 - DNA, 25 bp, Mus musculus
tgctgtcccgtgtgcgaaacaagcc

SEQ ID NO: 812850 - DNA, 25 bp, Mus musculus
tgctgtccgcagatgcccgtgtgaa

SEQ ID NO: 812851 - DNA, 25 bp, Mus musculus
tgctgtccgcagttgcccgtgtgaa

SEQ ID NO: 812852 - DNA, 25 bp, Mus musculus
tgctgtccgccccatacatgaggag

SEQ ID NO: 812853 - DNA, 25 bp, Mus musculus
tgctgtccgcccgatacatgaggag

SEQ ID NO: 812854 - DNA, 25 bp, Mus musculus
tgctgtccggacctagtctgaaccg

SEQ ID NO: 812855 - DNA, 25 bp, Mus musculus
tgctgtccggacgtagtctgaaccg

SEQ ID NO: 812856 - DNA, 25 bp, Mus musculus
tgctgtccgtgtaatggctcctggg

SEQ ID NO: 812857 - DNA, 25 bp, Mus musculus
tgctgtccgtgttatggctcctggg

SEQ ID NO: 812858 - DNA, 25 bp, Mus musculus
tgctgtccttcacctctcagctgaa

SEQ ID NO: 812859 - DNA, 25 bp, Mus musculus
tgctgtccttcagctctcagctgaa

SEQ ID NO: 812860 - DNA, 25 bp, Mus musculus
tgctgtcgaaagcttaaacttccag

SEQ ID NO: 812861 - DNA, 25 bp, Mus musculus
tgctgtcgaaaggttaaacttccag

SEQ ID NO: 812862 - DNA, 25 bp, Mus musculus
tgctgtcgaccccatcatggagaag

SEQ ID NO: 812863 - DNA, 25 bp, Mus musculus
tgctgtcgacccgatcatggagaag

SEQ ID NO: 812864 - DNA, 25 bp, Mus musculus
tgctgtcgccttctgctttccacga

SEQ ID NO: 812865 - DNA, 25 bp, Mus musculus
tgctgtcgccttgtgctttccacga

SEQ ID NO: 812866 - DNA, 25 bp, Mus musculus
tgctgtcgctggacctctttctgct

SEQ ID NO: 812867 - DNA, 25 bp, Mus musculus
tgctgtcgctggtcctctttctgct

SEQ ID NO: 812868 - DNA, 25 bp, Mus musculus
tgctgtctagctaaatggctatttg

SEQ ID NO: 812869 - DNA, 25 bp, Mus musculus
tgctgtctagcttaatggctatttg

SEQ ID NO: 812870 - DNA, 25 bp, Mus musculus
tgctgtctcacgatccgcagctctg

SEQ ID NO: 812871 - DNA, 25 bp, Mus musculus
tgctgtctcacgttccgcagctctg

SEQ ID NO: 812872 - DNA, 25 bp, Mus musculus
tgctgtctcctaactctactacggg

SEQ ID NO: 812873 - DNA, 25 bp, Mus musculus
tgctgtctcctatctctactacggg

SEQ ID NO: 812874 - DNA, 25 bp, Mus musculus
tgctgtctcttcagtgtcgcataca

SEQ ID NO: 812875 - DNA, 25 bp, Mus musculus
tgctgtctcttctgtgtcgcataca

SEQ ID NO: 812876 - DNA, 25 bp, Mus musculus
tgctgtctgatgagcatgcccgtga

SEQ ID NO: 812877 - DNA, 25 bp, Mus musculus
tgctgtctgatgtgcatgcccgtga

SEQ ID NO: 812878 - DNA, 25 bp, Mus musculus
tgctgtctgccaccagaactggagg

SEQ ID NO: 812879 - DNA, 25 bp, Mus musculus
tgctgtctgccagcagaactggagg

SEQ ID NO: 812880 - DNA, 25 bp, Mus musculus
tgctgtctggacagtccgtcggcac

SEQ ID NO: 812881 - DNA, 25 bp, Mus musculus
tgctgtctggactgtccgtcggcac

SEQ ID NO: 812882 - DNA, 25 bp, Mus musculus
tgctgtctggtaccccactttggga

SEQ ID NO: 812883 - DNA, 25 bp, Mus musculus
tgctgtctggtagcccactttggga

SEQ ID NO: 812884 - DNA, 25 bp, Mus musculus
tgctgtctggtgctcagcctcagag

SEQ ID NO: 812885 - DNA, 25 bp, Mus musculus
tgctgtctggtggtcagcctcagag

SEQ ID NO: 812886 - DNA, 25 bp, Mus musculus
tgctgtctgtctctggcagcacgac

SEQ ID NO: 812887 - DNA, 25 bp, Mus musculus
tgctgtctgtctgtggcagcacgac

SEQ ID NO: 812888 - DNA, 25 bp, Mus musculus
tgctgtctgttcagggcagttcaag

SEQ ID NO: 812889 - DNA, 25 bp, Mus musculus
tgctgtctgttctgggcagttcaag

SEQ ID NO: 812890 - DNA, 25 bp, Mus musculus
tgctgtcttacaagcctccttaggc

SEQ ID NO: 812891 - DNA, 25 bp, Mus musculus
tgctgtcttacatgcctccttaggc

SEQ ID NO: 812892 - DNA, 25 bp, Mus musculus
tgctgtcttccgagcaggctttcgg

SEQ ID NO: 812893 - DNA, 25 bp, Mus musculus
tgctgtcttccgtgcaggctttcgg

SEQ ID NO: 812894 - DNA, 25 bp, Mus musculus
tgctgtcttctccactcttagggcg

SEQ ID NO: 812895 - DNA, 25 bp, Mus musculus
tgctgtcttctcgactcttagggcg

SEQ ID NO: 812896 - DNA, 25 bp, Mus musculus
tgctgtgaaacccacaaatactggg

SEQ ID NO: 812897 - DNA, 25 bp, Mus musculus
tgctgtgaaaccgacaaatactggg

SEQ ID NO: 812898 - DNA, 25 bp, Mus musculus
tgctgtgaaggacgaacacctgtat

SEQ ID NO: 812899 - DNA, 25 bp, Mus musculus
tgctgtgaaggaggaacacctgtat

SEQ ID NO: 812900 - DNA, 25 bp, Mus musculus
tgctgtgaatggcaacatagaatcg

SEQ ID NO: 812901 - DNA, 25 bp, Mus musculus
tgctgtgaatgggaacatagaatcg

SEQ ID NO: 812902 - DNA, 25 bp, Mus musculus
tgctgtgacagccttactgctgcct

SEQ ID NO: 812903 - DNA, 25 bp, Mus musculus
tgctgtgacagcgttactgctgcct

SEQ ID NO: 812904 - DNA, 25 bp, Mus musculus
tgctgtgagctgagacccggtcaag

SEQ ID NO: 812905 - DNA, 25 bp, Mus musculus
tgctgtgagctgtgacccggtcaag

SEQ ID NO: 812906 - DNA, 25 bp, Mus musculus
tgctgtgagtgcattggctaaattt

SEQ ID NO: 812907 - DNA, 25 bp, Mus musculus
tgctgtgagtgctttggctaaattt

SEQ ID NO: 812908 - DNA, 25 bp, Mus musculus
tgctgtgagtggctgagatgttgcg

SEQ ID NO: 812909 - DNA, 25 bp, Mus musculus
tgctgtgagtgggtgagatgttgcg

SEQ ID NO: 812910 - DNA, 25 bp, Mus musculus
tgctgtgatctcatggtggtcttcg

SEQ ID NO: 812911 - DNA, 25 bp, Mus musculus
tgctgtgatctcttggtggtcttcg

SEQ ID NO: 812912 - DNA, 25 bp, Mus musculus
tgctgtgattccctcttggaagata

SEQ ID NO: 812913 - DNA, 25 bp, Mus musculus
tgctgtgattccgtcttggaagata

SEQ ID NO: 812914 - DNA, 25 bp, Mus musculus
tgctgtgcacaacaaccgggtacaa

SEQ ID NO: 812915 - DNA, 25 bp, Mus musculus
tgctgtgcacaagaaccgggtacaa

SEQ ID NO: 812916 - DNA, 25 bp, Mus musculus
tgctgtgcacacatttaagaaaact

SEQ ID NO: 812917 - DNA, 25 bp, Mus musculus
tgctgtgcacacttttaagaaaact

SEQ ID NO: 812918 - DNA, 25 bp, Mus musculus
tgctgtgcagcaacaattcaattgt

SEQ ID NO: 812919 - DNA, 25 bp, Mus musculus
tgctgtgcagcatcaattcaattgt

SEQ ID NO: 812920 - DNA, 25 bp, Mus musculus
tgctgtgccaaacccctgaaatatc

SEQ ID NO: 812921 - DNA, 25 bp, Mus musculus
tgctgtgccaaagccctgaaatatc

SEQ ID NO: 812922 - DNA, 25 bp, Mus musculus
tgctgtgccgacaacatggagcagt

SEQ ID NO: 812923 - DNA, 25 bp, Mus musculus
tgctgtgccgactacatggagcagt

SEQ ID NO: 812924 - DNA, 25 bp, Mus musculus
tgctgtgccttcagaagttcgggat

SEQ ID NO: 812925 - DNA, 25 bp, Mus musculus
tgctgtgccttctgaagttcgggat

SEQ ID NO: 812926 - DNA, 25 bp, Mus musculus
tgctgtgcgcctatcccaagctggc

SEQ ID NO: 812927 - DNA, 25 bp, Mus musculus
tgctgtgcgcctttcccaagctggc

SEQ ID NO: 812928 - DNA, 25 bp, Mus musculus
tgctgtgctataattctcgactccc

SEQ ID NO: 812929 - DNA, 25 bp, Mus musculus
tgctgtgctatatttctcgactccc

SEQ ID NO: 812930 - DNA, 25 bp, Mus musculus
tgctgtgctgcccagcggatcccag

SEQ ID NO: 812931 - DNA, 25 bp, Mus musculus
tgctgtgctgccgagcggatcccag

SEQ ID NO: 812932 - DNA, 25 bp, Mus musculus
tgctgtgctgtaacccagctcccag

SEQ ID NO: 812933 - DNA, 25 bp, Mus musculus
tgctgtgctgtatcccagctcccag

SEQ ID NO: 812934 - DNA, 25 bp, Mus musculus
tgctgtggaaaaattacacctatcg

SEQ ID NO: 812935 - DNA, 25 bp, Mus musculus
tgctgtggaaaatttacacctatcg

SEQ ID NO: 812936 - DNA, 25 bp, Mus musculus
tgctgtggaaatccaagcatagttc

SEQ ID NO: 812937 - DNA, 25 bp, Mus musculus
tgctgtggaaatgcaagcatagttc

SEQ ID NO: 812938 - DNA, 25 bp, Mus musculus
tgctgtggaagcaatccgattggtt

SEQ ID NO: 812939 - DNA, 25 bp, Mus musculus
tgctgtggaagctatccgattggtt

SEQ ID NO: 812940 - DNA, 25 bp, Mus musculus
tgctgtggaaggatcctcgaaacgt

SEQ ID NO: 812941 - DNA, 25 bp, Mus musculus
tgctgtggaaggttcctcgaaacgt

SEQ ID NO: 812942 - DNA, 25 bp, Mus musculus
tgctgtggaccactttgaaggcagt

SEQ ID NO: 812943 - DNA, 25 bp, Mus musculus
tgctgtggaccagtttgaaggcagt

SEQ ID NO: 812944 - DNA, 25 bp, Mus musculus
tgctgtggagtgaacagtcatccct

SEQ ID NO: 812945 - DNA, 25 bp, Mus musculus
tgctgtggagtgtacagtcatccct

SEQ ID NO: 812946 - DNA, 25 bp, Mus musculus
tgctgtggcagcaggagagttccta

SEQ ID NO: 812947 - DNA, 25 bp, Mus musculus
tgctgtggcagctggagagttccta

SEQ ID NO: 812948 - DNA, 25 bp, Mus musculus
tgctgtggcatgaggccaagctgca

SEQ ID NO: 812949 - DNA, 25 bp, Mus musculus
tgctgtggcatgtggccaagctgca

SEQ ID NO: 812950 - DNA, 25 bp, Mus musculus
tgctgtggcattaaggtgccttctc

SEQ ID NO: 812951 - DNA, 25 bp, Mus musculus
tgctgtggcatttaggtgccttctc

SEQ ID NO: 812952 - DNA, 25 bp, Mus musculus
tgctgtggcctccagatcgtgccct

SEQ ID NO: 812953 - DNA, 25 bp, Mus musculus
tgctgtggcctcgagatcgtgccct

SEQ ID NO: 812954 - DNA, 25 bp, Mus musculus
tgctgtggcttgatcaaccttacaa

SEQ ID NO: 812955 - DNA, 25 bp, Mus musculus
tgctgtggcttgttcaaccttacaa

SEQ ID NO: 812956 - DNA, 25 bp, Mus musculus
tgctgtgggagtcttccttctcctc

SEQ ID NO: 812957 - DNA, 25 bp, Mus musculus
tgctgtgggagtgttccttctcctc

SEQ ID NO: 812958 - DNA, 25 bp, Mus musculus
tgctgtggtaccaactgctacctgg

SEQ ID NO: 812959 - DNA, 25 bp, Mus musculus
tgctgtggtacctactgctacctgg

SEQ ID NO: 812960 - DNA, 25 bp, Mus musculus
tgctgtggtctacactgaaaaagat

SEQ ID NO: 812961 - DNA, 25 bp, Mus musculus
tgctgtggtctagactgaaaaagat

SEQ ID NO: 812962 - DNA, 25 bp, Mus musculus
tgctgtggtggccttgctactgcac

SEQ ID NO: 812963 - DNA, 25 bp, Mus musculus
tgctgtggtggcgttgctactgcac

SEQ ID NO: 812964 - DNA, 25 bp, Mus musculus
tgctgtggttatcctggtcccggcc

SEQ ID NO: 812965 - DNA, 25 bp, Mus musculus
tgctgtggttatgctggtcccggcc

SEQ ID NO: 812966 - DNA, 25 bp, Mus musculus
tgctgtggttccaccaaaatatgga

SEQ ID NO: 812967 - DNA, 25 bp, Mus musculus
tgctgtggttcctccaaaatatgga

SEQ ID NO: 812968 - DNA, 25 bp, Mus musculus
tgctgtggttgcagcggctacgaaa

SEQ ID NO: 812969 - DNA, 25 bp, Mus musculus
tgctgtggttgctgcggctacgaaa

SEQ ID NO: 812970 - DNA, 25 bp, Mus musculus
tgctgtgtagccaggtgctaaagga

SEQ ID NO: 812971 - DNA, 25 bp, Mus musculus
tgctgtgtagcctggtgctaaagga

SEQ ID NO: 812972 - DNA, 25 bp, Mus musculus
tgctgtgtatatcaaatggccaccc

SEQ ID NO: 812973 - DNA, 25 bp, Mus musculus
tgctgtgtatatgaaatggccaccc

SEQ ID NO: 812974 - DNA, 25 bp, Mus musculus
tgctgtgtcaggagccggcaccaac

SEQ ID NO: 812975 - DNA, 25 bp, Mus musculus
tgctgtgtcaggtgccggcaccaac

SEQ ID NO: 812976 - DNA, 25 bp, Mus musculus
tgctgtgtcatgcagagacccactg

SEQ ID NO: 812977 - DNA, 25 bp, Mus musculus
tgctgtgtcatggagagacccactg

SEQ ID NO: 812978 - DNA, 25 bp, Mus musculus
tgctgtgtccaacaaatttcgagac

SEQ ID NO: 812979 - DNA, 25 bp, Mus musculus
tgctgtgtccaagaaatttcgagac

SEQ ID NO: 812980 - DNA, 25 bp, Mus musculus
tgctgtgtccgtcacctccgataga

SEQ ID NO: 812981 - DNA, 25 bp, Mus musculus
tgctgtgtccgtgacctccgataga

SEQ ID NO: 812982 - DNA, 25 bp, Mus musculus
tgctgtgtcctgagacgtatgtctg

SEQ ID NO: 812983 - DNA, 25 bp, Mus musculus
tgctgtgtcctgagcactcccggga

SEQ ID NO: 812984 - DNA, 25 bp, Mus musculus
tgctgtgtcctgtgacgtatgtctg

SEQ ID NO: 812985 - DNA, 25 bp, Mus musculus
tgctgtgtcctgtgcactcccggga

SEQ ID NO: 812986 - DNA, 25 bp, Mus musculus
tgctgtgtctacacggtgagggtcc

SEQ ID NO: 812987 - DNA, 25 bp, Mus musculus
tgctgtgtctactcggtgagggtcc

SEQ ID NO: 812988 - DNA, 25 bp, Mus musculus
tgctgtgtctccctggtctacctga

SEQ ID NO: 812989 - DNA, 25 bp, Mus musculus
tgctgtgtctccgtggtctacctga

SEQ ID NO: 812990 - DNA, 25 bp, Mus musculus
tgctgtgtgtctagtgaaccccaag

SEQ ID NO: 812991 - DNA, 25 bp, Mus musculus
tgctgtgtgtcttgtgaaccccaag

SEQ ID NO: 812992 - DNA, 25 bp, Mus musculus
tgctgtgtgtgaagcccgacgtcag

SEQ ID NO: 812993 - DNA, 25 bp, Mus musculus
tgctgtgtgtgatgcccgacgtcag

SEQ ID NO: 812994 - DNA, 25 bp, Mus musculus
tgctgtgttatgagagtctgcgtac

SEQ ID NO: 812995 - DNA, 25 bp, Mus musculus
tgctgtgttatgtgagtctgcgtac

SEQ ID NO: 812996 - DNA, 25 bp, Mus musculus
tgctgtgttcggcagcctaaaggaa

SEQ ID NO: 812997 - DNA, 25 bp, Mus musculus
tgctgtgttcgggagcctaaaggaa

SEQ ID NO: 812998 - DNA, 25 bp, Mus musculus
tgctgtgttttcactgtcaagtact

SEQ ID NO: 812999 - DNA, 25 bp, Mus musculus
tgctgtgttttctctgtcaagtact

SEQ ID NO: 813000 - DNA, 25 bp, Mus musculus
tgctgttatgttactagaaggtggg

SEQ ID NO: 813001 - DNA, 25 bp, Mus musculus
tgctgttatgtttctagaaggtggg

SEQ ID NO: 813002 - DNA, 25 bp, Mus musculus
tgctgttcaataagttgcctggagc

SEQ ID NO: 813003 - DNA, 25 bp, Mus musculus
tgctgttcaatatgttgcctggagc

SEQ ID NO: 813004 - DNA, 25 bp, Mus musculus
tgctgttcaccaatgaagacgaccc

SEQ ID NO: 813005 - DNA, 25 bp, Mus musculus
tgctgttcaccattgaagacgaccc

SEQ ID NO: 813006 - DNA, 25 bp, Mus musculus
tgctgttcacgtcctggtgaggatc

SEQ ID NO: 813007 - DNA, 25 bp, Mus musculus
tgctgttcacgtgctggtgaggatc

SEQ ID NO: 813008 - DNA, 25 bp, Mus musculus
tgctgttcagcacttgacagctgcc

SEQ ID NO: 813009 - DNA, 25 bp, Mus musculus
tgctgttcagcagttgacagctgcc

SEQ ID NO: 813010 - DNA, 25 bp, Mus musculus
tgctgttcatggaaacctccgccaa

SEQ ID NO: 813011 - DNA, 25 bp, Mus musculus
tgctgttcatggtaacctccgccaa

SEQ ID NO: 813012 - DNA, 25 bp, Mus musculus
tgctgttcatgtcttacggcttctg

SEQ ID NO: 813013 - DNA, 25 bp, Mus musculus
tgctgttcatgtgttacggcttctg

SEQ ID NO: 813014 - DNA, 25 bp, Mus musculus
tgctgttcctctactcccactggtg

SEQ ID NO: 813015 - DNA, 25 bp, Mus musculus
tgctgttcctcttctcccactggtg

SEQ ID NO: 813016 - DNA, 25 bp, Mus musculus
tgctgttcctgaatggcgcgccgtt

SEQ ID NO: 813017 - DNA, 25 bp, Mus musculus
tgctgttcctgattggcgcgccgtt

SEQ ID NO: 813018 - DNA, 25 bp, Mus musculus
tgctgttcctggagacgtcagccct

SEQ ID NO: 813019 - DNA, 25 bp, Mus musculus
tgctgttcctggaggctaacttcct

SEQ ID NO: 813020 - DNA, 25 bp, Mus musculus
tgctgttcctggtgacgtcagccct

SEQ ID NO: 813021 - DNA, 25 bp, Mus musculus
tgctgttcctggtggctaacttcct

SEQ ID NO: 813022 - DNA, 25 bp, Mus musculus
tgctgttcctgtccatacagggaac

SEQ ID NO: 813023 - DNA, 25 bp, Mus musculus
tgctgttcctgtgcatacagggaac

SEQ ID NO: 813024 - DNA, 25 bp, Mus musculus
tgctgttcgagtcattgagttatgc

SEQ ID NO: 813025 - DNA, 25 bp, Mus musculus
tgctgttcgagtcggagtttgtaca

SEQ ID NO: 813026 - DNA, 25 bp, Mus musculus
tgctgttcgagtgattgagttatgc

SEQ ID NO: 813027 - DNA, 25 bp, Mus musculus
tgctgttcgagtgggagtttgtaca

SEQ ID NO: 813028 - DNA, 25 bp, Mus musculus
tgctgttctctactggatttccctg

SEQ ID NO: 813029 - DNA, 25 bp, Mus musculus
tgctgttctctagtggatttccctg

SEQ ID NO: 813030 - DNA, 25 bp, Mus musculus
tgctgttcttctatgccccgtggtg

SEQ ID NO: 813031 - DNA, 25 bp, Mus musculus
tgctgttcttctttgccccgtggtg

SEQ ID NO: 813032 - DNA, 25 bp, Mus musculus
tgctgttctttcaagccaagtcgct

SEQ ID NO: 813033 - DNA, 25 bp, Mus musculus
tgctgttctttctagccaagtcgct

SEQ ID NO: 813034 - DNA, 25 bp, Mus musculus
tgctgttgaagaacgtgcggcatcc

SEQ ID NO: 813035 - DNA, 25 bp, Mus musculus
tgctgttgaagatcgtgcggcatcc

SEQ ID NO: 813036 - DNA, 25 bp, Mus musculus
tgctgttgacctagtcattccatac

SEQ ID NO: 813037 - DNA, 25 bp, Mus musculus
tgctgttgaccttgtcattccatac

SEQ ID NO: 813038 - DNA, 25 bp, Mus musculus
tgctgttgagaaagcatggcgcaaa

SEQ ID NO: 813039 - DNA, 25 bp, Mus musculus
tgctgttgagaactacacaaaaggt

SEQ ID NO: 813040 - DNA, 25 bp, Mus musculus
tgctgttgagaagtacacaaaaggt

SEQ ID NO: 813041 - DNA, 25 bp, Mus musculus
tgctgttgagaatgcatggcgcaaa

SEQ ID NO: 813042 - DNA, 25 bp, Mus musculus
tgctgttgcagcagtgattgtcaag

SEQ ID NO: 813043 - DNA, 25 bp, Mus musculus
tgctgttgcagctgtgattgtcaag

SEQ ID NO: 813044 - DNA, 25 bp, Mus musculus
tgctgttgccatcaatactcgtctg

SEQ ID NO: 813045 - DNA, 25 bp, Mus musculus
tgctgttgccatgaatactcgtctg

SEQ ID NO: 813046 - DNA, 25 bp, Mus musculus
tgctgttgctctactacctgattcg

SEQ ID NO: 813047 - DNA, 25 bp, Mus musculus
tgctgttgctcttctacctgattcg

SEQ ID NO: 813048 - DNA, 25 bp, Mus musculus
tgctgttggatcaccagtgtctcca

SEQ ID NO: 813049 - DNA, 25 bp, Mus musculus
tgctgttggatctccagtgtctcca

SEQ ID NO: 813050 - DNA, 25 bp, Mus musculus
tgctgttggccgacaaagtgcctga

SEQ ID NO: 813051 - DNA, 25 bp, Mus musculus
tgctgttggccgtcaaagtgcctga

SEQ ID NO: 813052 - DNA, 25 bp, Mus musculus
tgctgttgggaacctcctggatgaa

SEQ ID NO: 813053 - DNA, 25 bp, Mus musculus
tgctgttgggaagctcctggatgaa

SEQ ID NO: 813054 - DNA, 25 bp, Mus musculus
tgctgttggtgtccagcaactacac

SEQ ID NO: 813055 - DNA, 25 bp, Mus musculus
tgctgttggtgtgcagcaactacac

SEQ ID NO: 813056 - DNA, 25 bp, Mus musculus
tgctgttgtaaccaaattcctggcg

SEQ ID NO: 813057 - DNA, 25 bp, Mus musculus
tgctgttgtaacgaaattcctggcg

SEQ ID NO: 813058 - DNA, 25 bp, Mus musculus
tgctgttgtcctcgtcctcgaaccg

SEQ ID NO: 813059 - DNA, 25 bp, Mus musculus
tgctgttgtcctggtcctcgaaccg

SEQ ID NO: 813060 - DNA, 25 bp, Mus musculus
tgctgttgtgcaccctggacctatt

SEQ ID NO: 813061 - DNA, 25 bp, Mus musculus
tgctgttgtgcagcctggacctatt

SEQ ID NO: 813062 - DNA, 25 bp, Mus musculus
tgctgttgtgctcctgaagaacgga

SEQ ID NO: 813063 - DNA, 25 bp, Mus musculus
tgctgttgtgctgctgaagaacgga

SEQ ID NO: 813064 - DNA, 25 bp, Mus musculus
tgctgttgttggcagcacagaagaa

SEQ ID NO: 813065 - DNA, 25 bp, Mus musculus
tgctgttgttgggagcacagaagaa

SEQ ID NO: 813066 - DNA, 25 bp, Mus musculus
tgctgtttatgaactgaacggcaaa

SEQ ID NO: 813067 - DNA, 25 bp, Mus musculus
tgctgtttatgatctgaacggcaaa

SEQ ID NO: 813068 - DNA, 25 bp, Mus musculus
tgctgtttcgggatgcgacctcggt

SEQ ID NO: 813069 - DNA, 25 bp, Mus musculus
tgctgtttcgggttgcgacctcggt

SEQ ID NO: 813070 - DNA, 25 bp, Mus musculus
tgctgtttcttgctggccttggcct

SEQ ID NO: 813071 - DNA, 25 bp, Mus musculus
tgctgtttcttggtggccttggcct

SEQ ID NO: 813072 - DNA, 25 bp, Mus musculus
tgctgtttgaccaggtctgtgagca

SEQ ID NO: 813073 - DNA, 25 bp, Mus musculus
tgctgtttgacctggtctgtgagca

SEQ ID NO: 813074 - DNA, 25 bp, Mus musculus
tgctgtttgccactggaggcttcaa

SEQ ID NO: 813075 - DNA, 25 bp, Mus musculus
tgctgtttgccagtggaggcttcaa

SEQ ID NO: 813076 - DNA, 25 bp, Mus musculus
tgcttaaactggagactgcagccct

SEQ ID NO: 813077 - DNA, 25 bp, Mus musculus
tgcttaaactggtgactgcagccct

SEQ ID NO: 813078 - DNA, 25 bp, Mus musculus
tgcttaaagcaaatgagaacctcgg

SEQ ID NO: 813079 - DNA, 25 bp, Mus musculus
tgcttaaagcaattgagaacctcgg

SEQ ID NO: 813080 - DNA, 25 bp, Mus musculus
tgcttaaagtctcccgccttcctgg

SEQ ID NO: 813081 - DNA, 25 bp, Mus musculus
tgcttaaagtctgccgccttcctgg

SEQ ID NO: 813082 - DNA, 25 bp, Mus musculus
tgcttaaagtggagatgccctggtg

SEQ ID NO: 813083 - DNA, 25 bp, Mus musculus
tgcttaaagtggtgatgccctggtg

SEQ ID NO: 813084 - DNA, 25 bp, Mus musculus
tgcttaagaactcgaacggagactg

SEQ ID NO: 813085 - DNA, 25 bp, Mus musculus
tgcttaagaactggaacggagactg

SEQ ID NO: 813086 - DNA, 25 bp, Mus musculus
tgcttaagcggaaggatctagctag

SEQ ID NO: 813087 - DNA, 25 bp, Mus musculus
tgcttaagcggatggatctagctag

SEQ ID NO: 813088 - DNA, 25 bp, Mus musculus
tgcttaagtacccagatagtcacca

SEQ ID NO: 813089 - DNA, 25 bp, Mus musculus
tgcttaagtaccgagatagtcacca

SEQ ID NO: 813090 - DNA, 25 bp, Mus musculus
tgcttaagtcgcaggaccatggccg

SEQ ID NO: 813091 - DNA, 25 bp, Mus musculus
tgcttaagtcgctggaccatggccg

SEQ ID NO: 813092 - DNA, 25 bp, Mus musculus
tgcttacaaatcacagctcagctgt

SEQ ID NO: 813093 - DNA, 25 bp, Mus musculus
tgcttacaaatctcagctcagctgt

SEQ ID NO: 813094 - DNA, 25 bp, Mus musculus
tgcttacaatggaaatgacgtggac

SEQ ID NO: 813095 - DNA, 25 bp, Mus musculus
tgcttacaatggtaatgacgtggac

SEQ ID NO: 813096 - DNA, 25 bp, Mus musculus
tgcttacaccgaagagcttaccaac

SEQ ID NO: 813097 - DNA, 25 bp, Mus musculus
tgcttacaccgatgagcttaccaac

SEQ ID NO: 813098 - DNA, 25 bp, Mus musculus
tgcttacagacaacaacccggcaga

SEQ ID NO: 813099 - DNA, 25 bp, Mus musculus
tgcttacagacatcaacccggcaga

SEQ ID NO: 813100 - DNA, 25 bp, Mus musculus
tgcttacaggaaaggcctttttcaa

SEQ ID NO: 813101 - DNA, 25 bp, Mus musculus
tgcttacaggaatggcctttttcaa

SEQ ID NO: 813102 - DNA, 25 bp, Mus musculus
tgcttacatggcatatagagtaaca

SEQ ID NO: 813103 - DNA, 25 bp, Mus musculus
tgcttacatggcttatagagtaaca

SEQ ID NO: 813104 - DNA, 25 bp, Mus musculus
tgcttacccggccactgatgcatcg

SEQ ID NO: 813105 - DNA, 25 bp, Mus musculus
tgcttacccggcgactgatgcatcg

SEQ ID NO: 813106 - DNA, 25 bp, Mus musculus
tgcttaccctcgacagctagagtca

SEQ ID NO: 813107 - DNA, 25 bp, Mus musculus
tgcttaccctcgtcagctagagtca

SEQ ID NO: 813108 - DNA, 25 bp, Mus musculus
tgcttaccgtgcagcccaaagcgtg

SEQ ID NO: 813109 - DNA, 25 bp, Mus musculus
tgcttaccgtgctgcccaaagcgtg

SEQ ID NO: 813110 - DNA, 25 bp, Mus musculus
tgcttacgatgtccttgagaggaac

SEQ ID NO: 813111 - DNA, 25 bp, Mus musculus
tgcttacgatgtgcttgagaggaac

SEQ ID NO: 813112 - DNA, 25 bp, Mus musculus
tgcttacgtcacagatggtgcttgc

SEQ ID NO: 813113 - DNA, 25 bp, Mus musculus
tgcttacgtcactgatggtgcttgc

SEQ ID NO: 813114 - DNA, 25 bp, Mus musculus
tgcttactaattacatgttccctca

SEQ ID NO: 813115 - DNA, 25 bp, Mus musculus
tgcttactaatttcatgttccctca

SEQ ID NO: 813116 - DNA, 25 bp, Mus musculus
tgcttactcactaggctgaggcgct

SEQ ID NO: 813117 - DNA, 25 bp, Mus musculus
tgcttactcacttggctgaggcgct

SEQ ID NO: 813118 - DNA, 25 bp, Mus musculus
tgcttactccaaacttgtgcaagaa

SEQ ID NO: 813119 - DNA, 25 bp, Mus musculus
tgcttactccaatcttgtgcaagaa

SEQ ID NO: 813120 - DNA, 25 bp, Mus musculus
tgcttactgtgtcgtcagcgcctaa

SEQ ID NO: 813121 - DNA, 25 bp, Mus musculus
tgcttactgtgtggtcagcgcctaa

SEQ ID NO: 813122 - DNA, 25 bp, Mus musculus
tgcttacttaaaacagagtttcagc

SEQ ID NO: 813123 - DNA, 25 bp, Mus musculus
tgcttacttaaatcagagtttcagc

SEQ ID NO: 813124 - DNA, 25 bp, Mus musculus
tgcttacttttcaggtgcagaaaga

SEQ ID NO: 813125 - DNA, 25 bp, Mus musculus
tgcttacttttctggtgcagaaaga

SEQ ID NO: 813126 - DNA, 25 bp, Mus musculus
tgcttagaaaacatgccgtcagctg

SEQ ID NO: 813127 - DNA, 25 bp, Mus musculus
tgcttagaaaacttgccgtcagctg

SEQ ID NO: 813128 - DNA, 25 bp, Mus musculus
tgcttagagagcatgaagtccagga

SEQ ID NO: 813129 - DNA, 25 bp, Mus musculus
tgcttagagagcttgaagtccagga

SEQ ID NO: 813130 - DNA, 25 bp, Mus musculus
tgcttagcaacgagtctgccagcca

SEQ ID NO: 813131 - DNA, 25 bp, Mus musculus
tgcttagcaacgtgtctgccagcca

SEQ ID NO: 813132 - DNA, 25 bp, Mus musculus
tgcttagcacctcgactcatcaaga

SEQ ID NO: 813133 - DNA, 25 bp, Mus musculus
tgcttagcacctggactcatcaaga

SEQ ID NO: 813134 - DNA, 25 bp, Mus musculus
tgcttagcgcatagcggcgacctcg

SEQ ID NO: 813135 - DNA, 25 bp, Mus musculus
tgcttagcgcattgcggcgacctcg

SEQ ID NO: 813136 - DNA, 25 bp, Mus musculus
tgcttagctcctagggtgcacagct

SEQ ID NO: 813137 - DNA, 25 bp, Mus musculus
tgcttagctccttgggtgcacagct

SEQ ID NO: 813138 - DNA, 25 bp, Mus musculus
tgcttagtgacccagctgctgcggc

SEQ ID NO: 813139 - DNA, 25 bp, Mus musculus
tgcttagtgaccgagctgctgcggc

SEQ ID NO: 813140 - DNA, 25 bp, Mus musculus
tgcttataaactcgggcctctgctc

SEQ ID NO: 813141 - DNA, 25 bp, Mus musculus
tgcttataaactggggcctctgctc

SEQ ID NO: 813142 - DNA, 25 bp, Mus musculus
tgcttataagatccggatccgcatt

SEQ ID NO: 813143 - DNA, 25 bp, Mus musculus
tgcttataagatgcggatccgcatt

SEQ ID NO: 813144 - DNA, 25 bp, Mus musculus
tgcttatactggagctatcttcggt

SEQ ID NO: 813145 - DNA, 25 bp, Mus musculus
tgcttatactggtgctatcttcggt

SEQ ID NO: 813146 - DNA, 25 bp, Mus musculus
tgcttatatctcagactacgccttc

SEQ ID NO: 813147 - DNA, 25 bp, Mus musculus
tgcttatatctctgactacgccttc

SEQ ID NO: 813148 - DNA, 25 bp, Mus musculus
tgcttatcctaaaactgaaatcata

SEQ ID NO: 813149 - DNA, 25 bp, Mus musculus
tgcttatcctaatactgaaatcata

SEQ ID NO: 813150 - DNA, 25 bp, Mus musculus
tgcttatctgtcaatatgtgcacca

SEQ ID NO: 813151 - DNA, 25 bp, Mus musculus
tgcttatctgtctatatgtgcacca

SEQ ID NO: 813152 - DNA, 25 bp, Mus musculus
tgcttatcttctcttgtgcctccgg

SEQ ID NO: 813153 - DNA, 25 bp, Mus musculus
tgcttatcttctgttgtgcctccgg

SEQ ID NO: 813154 - DNA, 25 bp, Mus musculus
tgcttatcttggatgatgccaccag

SEQ ID NO: 813155 - DNA, 25 bp, Mus musculus
tgcttatcttggttgatgccaccag

SEQ ID NO: 813156 - DNA, 25 bp, Mus musculus
tgcttatgccgtcatgtcactggca

SEQ ID NO: 813157 - DNA, 25 bp, Mus musculus
tgcttatgccgtgatgtcactggca

SEQ ID NO: 813158 - DNA, 25 bp, Mus musculus
tgcttatgcctcaagggaaccacag

SEQ ID NO: 813159 - DNA, 25 bp, Mus musculus
tgcttatgcctctagggaaccacag

SEQ ID NO: 813160 - DNA, 25 bp, Mus musculus
tgcttatggacgacctcaaggtgct

SEQ ID NO: 813161 - DNA, 25 bp, Mus musculus
tgcttatggacgtcctcaaggtgct

SEQ ID NO: 813162 - DNA, 25 bp, Mus musculus
tgcttattaacaaacataaccaggc

SEQ ID NO: 813163 - DNA, 25 bp, Mus musculus
tgcttattaacatacataaccaggc

SEQ ID NO: 813164 - DNA, 25 bp, Mus musculus
tgcttcaaaccaagtgagatcagag

SEQ ID NO: 813165 - DNA, 25 bp, Mus musculus
tgcttcaaaccatgtgagatcagag

SEQ ID NO: 813166 - DNA, 25 bp, Mus musculus
tgcttcaacggcaccgtgacaatcc

SEQ ID NO: 813167 - DNA, 25 bp, Mus musculus
tgcttcaacggctccgtgacaatcc

SEQ ID NO: 813168 - DNA, 25 bp, Mus musculus
tgcttcaagaccaactgggacctga

SEQ ID NO: 813169 - DNA, 25 bp, Mus musculus
tgcttcaagacctactgggacctga

SEQ ID NO: 813170 - DNA, 25 bp, Mus musculus
tgcttcaaggtcaaataaattcaac

SEQ ID NO: 813171 - DNA, 25 bp, Mus musculus
tgcttcaaggtctaataaattcaac

SEQ ID NO: 813172 - DNA, 25 bp, Mus musculus
tgcttcaataccctgcgcaccaagg

SEQ ID NO: 813173 - DNA, 25 bp, Mus musculus
tgcttcaataccgtgcgcaccaagg

SEQ ID NO: 813174 - DNA, 25 bp, Mus musculus
tgcttcacacgactatcaaaatagg

SEQ ID NO: 813175 - DNA, 25 bp, Mus musculus
tgcttcacacgagtatcaaaatagg

SEQ ID NO: 813176 - DNA, 25 bp, Mus musculus
tgcttcacactaatggaatcctaga

SEQ ID NO: 813177 - DNA, 25 bp, Mus musculus
tgcttcacactattggaatcctaga

SEQ ID NO: 813178 - DNA, 25 bp, Mus musculus
tgcttcaccaggcatgagcccatcg

SEQ ID NO: 813179 - DNA, 25 bp, Mus musculus
tgcttcaccagggatgagcccatcg

SEQ ID NO: 813180 - DNA, 25 bp, Mus musculus
tgcttcacccagctcattgacctgt

SEQ ID NO: 813181 - DNA, 25 bp, Mus musculus
tgcttcacccaggtcattgacctgt

SEQ ID NO: 813182 - DNA, 25 bp, Mus musculus
tgcttcacccgcaggccagggagtg

SEQ ID NO: 813183 - DNA, 25 bp, Mus musculus
tgcttcacccgctggccagggagtg

SEQ ID NO: 813184 - DNA, 25 bp, Mus musculus
tgcttcaccgatacagacacatttt

SEQ ID NO: 813185 - DNA, 25 bp, Mus musculus
tgcttcaccgattcagacacatttt

SEQ ID NO: 813186 - DNA, 25 bp, Mus musculus
tgcttcacgagtctcagtccgaccg

SEQ ID NO: 813187 - DNA, 25 bp, Mus musculus
tgcttcacgagtgtcagtccgaccg

SEQ ID NO: 813188 - DNA, 25 bp, Mus musculus
tgcttcagaatccagcattatgctg

SEQ ID NO: 813189 - DNA, 25 bp, Mus musculus
tgcttcagaatcgagcattatgctg

SEQ ID NO: 813190 - DNA, 25 bp, Mus musculus
tgcttcagacttagaacagcaaagc

SEQ ID NO: 813191 - DNA, 25 bp, Mus musculus
tgcttcagactttgaacagcaaagc

SEQ ID NO: 813192 - DNA, 25 bp, Mus musculus
tgcttcagagatcaccgtgctggag

SEQ ID NO: 813193 - DNA, 25 bp, Mus musculus
tgcttcagagatgaccgtgctggag

SEQ ID NO: 813194 - DNA, 25 bp, Mus musculus
tgcttcagaggaacctcgctgtcca

SEQ ID NO: 813195 - DNA, 25 bp, Mus musculus
tgcttcagaggatcctcgctgtcca

SEQ ID NO: 813196 - DNA, 25 bp, Mus musculus
tgcttcagattcagagaaacgtgac

SEQ ID NO: 813197 - DNA, 25 bp, Mus musculus
tgcttcagattctgagaaacgtgac

SEQ ID NO: 813198 - DNA, 25 bp, Mus musculus
tgcttcagcggcatctcctataacc

SEQ ID NO: 813199 - DNA, 25 bp, Mus musculus
tgcttcagcggcttctcctataacc

SEQ ID NO: 813200 - DNA, 25 bp, Mus musculus
tgcttcagggcaagctcaccaaact

SEQ ID NO: 813201 - DNA, 25 bp, Mus musculus
tgcttcagggcatgctcaccaaact

SEQ ID NO: 813202 - DNA, 25 bp, Mus musculus
tgcttcagggccagactgcaacgcc

SEQ ID NO: 813203 - DNA, 25 bp, Mus musculus
tgcttcagggcctgactgcaacgcc

SEQ ID NO: 813204 - DNA, 25 bp, Mus musculus
tgcttcagggttcctaagaacagcg

SEQ ID NO: 813205 - DNA, 25 bp, Mus musculus
tgcttcagggttgctaagaacagcg

SEQ ID NO: 813206 - DNA, 25 bp, Mus musculus
tgcttcaggtagacacggcgctgag

SEQ ID NO: 813207 - DNA, 25 bp, Mus musculus
tgcttcaggtagtcacggcgctgag

SEQ ID NO: 813208 - DNA, 25 bp, Mus musculus
tgcttcagttatctcaagagtgccc

SEQ ID NO: 813209 - DNA, 25 bp, Mus musculus
tgcttcagttatgtcaagagtgccc

SEQ ID NO: 813210 - DNA, 25 bp, Mus musculus
tgcttcatcccgatctgcgtagacg

SEQ ID NO: 813211 - DNA, 25 bp, Mus musculus
tgcttcatcccgttctgcgtagacg

SEQ ID NO: 813212 - DNA, 25 bp, Mus musculus
tgcttcatctaaaggcgcaaatgcc

SEQ ID NO: 813213 - DNA, 25 bp, Mus musculus
tgcttcatctaatggcgcaaatgcc

SEQ ID NO: 813214 - DNA, 25 bp, Mus musculus
tgcttcatgaccactatggaggccg

SEQ ID NO: 813215 - DNA, 25 bp, Mus musculus
tgcttcatgacctctatggaggccg

SEQ ID NO: 813216 - DNA, 25 bp, Mus musculus
tgcttcatggataggagaactttct

SEQ ID NO: 813217 - DNA, 25 bp, Mus musculus
tgcttcatggattggagaactttct

SEQ ID NO: 813218 - DNA, 25 bp, Mus musculus
tgcttcattcagaacccgggagcgg

SEQ ID NO: 813219 - DNA, 25 bp, Mus musculus
tgcttcattcagtacccgggagcgg

SEQ ID NO: 813220 - DNA, 25 bp, Mus musculus
tgcttccacggacctgaagattagg

SEQ ID NO: 813221 - DNA, 25 bp, Mus musculus
tgcttccacggagctgaagattagg

SEQ ID NO: 813222 - DNA, 25 bp, Mus musculus
tgcttccagaggagagggttctcac

SEQ ID NO: 813223 - DNA, 25 bp, Mus musculus
tgcttccagaggtgagggttctcac

SEQ ID NO: 813224 - DNA, 25 bp, Mus musculus
tgcttccagagtcccaccgatgtgg

SEQ ID NO: 813225 - DNA, 25 bp, Mus musculus
tgcttccagagtgccaccgatgtgg

SEQ ID NO: 813226 - DNA, 25 bp, Mus musculus
tgcttccagatcatctcgaaaaatt

SEQ ID NO: 813227 - DNA, 25 bp, Mus musculus
tgcttccagatcttctcgaaaaatt

SEQ ID NO: 813228 - DNA, 25 bp, Mus musculus
tgcttccagccactgtttcggttcg

SEQ ID NO: 813229 - DNA, 25 bp, Mus musculus
tgcttccagccagtgtttcggttcg

SEQ ID NO: 813230 - DNA, 25 bp, Mus musculus
tgcttccagcctctggagttgtgcc

SEQ ID NO: 813231 - DNA, 25 bp, Mus musculus
tgcttccagcctgtggagttgtgcc

SEQ ID NO: 813232 - DNA, 25 bp, Mus musculus
tgcttccaggacctaaaagggtcgg

SEQ ID NO: 813233 - DNA, 25 bp, Mus musculus
tgcttccaggacgtaaaagggtcgg

SEQ ID NO: 813234 - DNA, 25 bp, Mus musculus
tgcttccatgatcagccctctggct

SEQ ID NO: 813235 - DNA, 25 bp, Mus musculus
tgcttccatgatgagccctctggct

SEQ ID NO: 813236 - DNA, 25 bp, Mus musculus
tgcttccatgcaaggtgaacctgag

SEQ ID NO: 813237 - DNA, 25 bp, Mus musculus
tgcttccatgcatggtgaacctgag

SEQ ID NO: 813238 - DNA, 25 bp, Mus musculus
tgcttcccatctacatccagttcgg

SEQ ID NO: 813239 - DNA, 25 bp, Mus musculus
tgcttcccatcttcatccagttcgg

SEQ ID NO: 813240 - DNA, 25 bp, Mus musculus
tgcttcccctccagtgcgggacgtt

SEQ ID NO: 813241 - DNA, 25 bp, Mus musculus
tgcttcccctcctgtgcgggacgtt

SEQ ID NO: 813242 - DNA, 25 bp, Mus musculus
tgcttcccgcctccttaccaggacc

SEQ ID NO: 813243 - DNA, 25 bp, Mus musculus
tgcttcccgcctgcttaccaggacc

SEQ ID NO: 813244 - DNA, 25 bp, Mus musculus
tgcttcccggtgctgtttacctatg

SEQ ID NO: 813245 - DNA, 25 bp, Mus musculus
tgcttcccggtggtgtttacctatg

SEQ ID NO: 813246 - DNA, 25 bp, Mus musculus
tgcttccctgccagcctaacatttt

SEQ ID NO: 813247 - DNA, 25 bp, Mus musculus
tgcttccctgcctgcctaacatttt

SEQ ID NO: 813248 - DNA, 25 bp, Mus musculus
tgcttccctggaatcgagctgcagg

SEQ ID NO: 813249 - DNA, 25 bp, Mus musculus
tgcttccctggacaacgatatcaaa

SEQ ID NO: 813250 - DNA, 25 bp, Mus musculus
tgcttccctggagaacgatatcaaa

SEQ ID NO: 813251 - DNA, 25 bp, Mus musculus
tgcttccctggattcgagctgcagg

SEQ ID NO: 813252 - DNA, 25 bp, Mus musculus
tgcttccctggcaacgccatcatgg

SEQ ID NO: 813253 - DNA, 25 bp, Mus musculus
tgcttccctggctacgccatcatgg

SEQ ID NO: 813254 - DNA, 25 bp, Mus musculus
tgcttcccttgtcagtcaggattat

SEQ ID NO: 813255 - DNA, 25 bp, Mus musculus
tgcttcccttgtgagtcaggattat

SEQ ID NO: 813256 - DNA, 25 bp, Mus musculus
tgcttccgaacgctcttagaactgg

SEQ ID NO: 813257 - DNA, 25 bp, Mus musculus
tgcttccgaacggtcttagaactgg

SEQ ID NO: 813258 - DNA, 25 bp, Mus musculus
tgcttccgacgcagcagggattgcc

SEQ ID NO: 813259 - DNA, 25 bp, Mus musculus
tgcttccgacgctgcagggattgcc

SEQ ID NO: 813260 - DNA, 25 bp, Mus musculus
tgcttccgactccagtgctcaggct

SEQ ID NO: 813261 - DNA, 25 bp, Mus musculus
tgcttccgactcgagtgctcaggct

SEQ ID NO: 813262 - DNA, 25 bp, Mus musculus
tgcttccgcctcacgagtgatggga

SEQ ID NO: 813263 - DNA, 25 bp, Mus musculus
tgcttccgcctctcgagtgatggga

SEQ ID NO: 813264 - DNA, 25 bp, Mus musculus
tgcttccgcggaaaaggtgaagact

SEQ ID NO: 813265 - DNA, 25 bp, Mus musculus
tgcttccgcggataaggtgaagact

SEQ ID NO: 813266 - DNA, 25 bp, Mus musculus
tgcttccggatgaggagaaatccct

SEQ ID NO: 813267 - DNA, 25 bp, Mus musculus
tgcttccggatgtggagaaatccct

SEQ ID NO: 813268 - DNA, 25 bp, Mus musculus
tgcttccggcagattttcaccaaga

SEQ ID NO: 813269 - DNA, 25 bp, Mus musculus
tgcttccggcagtttttcaccaaga

SEQ ID NO: 813270 - DNA, 25 bp, Mus musculus
tgcttccgggatcaaaacgtccatt

SEQ ID NO: 813271 - DNA, 25 bp, Mus musculus
tgcttccgggatgaaaacgtccatt

SEQ ID NO: 813272 - DNA, 25 bp, Mus musculus
tgcttcctcagaagtcgctctggca

SEQ ID NO: 813273 - DNA, 25 bp, Mus musculus
tgcttcctcagatgtcgctctggca

SEQ ID NO: 813274 - DNA, 25 bp, Mus musculus
tgcttcctcggcctctcggagcgag

SEQ ID NO: 813275 - DNA, 25 bp, Mus musculus
tgcttcctcggcgtctcggagcgag

SEQ ID NO: 813276 - DNA, 25 bp, Mus musculus
tgcttcctgccaacgtggaactagc

SEQ ID NO: 813277 - DNA, 25 bp, Mus musculus
tgcttcctgccatcgtggaactagc

SEQ ID NO: 813278 - DNA, 25 bp, Mus musculus
tgcttcctgcgtccgtccctttgtg

SEQ ID NO: 813279 - DNA, 25 bp, Mus musculus
tgcttcctgcgtgcgtccctttgtg

SEQ ID NO: 813280 - DNA, 25 bp, Mus musculus
tgcttcctggctattattgctcggc

SEQ ID NO: 813281 - DNA, 25 bp, Mus musculus
tgcttcctggcttttattgctcggc

SEQ ID NO: 813282 - DNA, 25 bp, Mus musculus
tgcttccttcttagtctcttgctca

SEQ ID NO: 813283 - DNA, 25 bp, Mus musculus
tgcttccttctttgtctcttgctca

SEQ ID NO: 813284 - DNA, 25 bp, Mus musculus
tgcttcgaaacaagcttgtccgcct

SEQ ID NO: 813285 - DNA, 25 bp, Mus musculus
tgcttcgaaacatgcttgtccgcct

SEQ ID NO: 813286 - DNA, 25 bp, Mus musculus
tgcttcgaagcacaggacacatgtt

SEQ ID NO: 813287 - DNA, 25 bp, Mus musculus
tgcttcgaagcagaggacacatgtt

SEQ ID NO: 813288 - DNA, 25 bp, Mus musculus
tgcttcgagaatcacggctcctggc

SEQ ID NO: 813289 - DNA, 25 bp, Mus musculus
tgcttcgagaatgacggctcctggc

SEQ ID NO: 813290 - DNA, 25 bp, Mus musculus
tgcttcgagtctacatccagaaacg

SEQ ID NO: 813291 - DNA, 25 bp, Mus musculus
tgcttcgagtcttcatccagaaacg

SEQ ID NO: 813292 - DNA, 25 bp, Mus musculus
tgcttcgcaccccttccaggtggta

SEQ ID NO: 813293 - DNA, 25 bp, Mus musculus
tgcttcgcacccgttccaggtggta

SEQ ID NO: 813294 - DNA, 25 bp, Mus musculus
tgcttcgctaccaactggatgggat

SEQ ID NO: 813295 - DNA, 25 bp, Mus musculus
tgcttcgctacctactggatgggat

SEQ ID NO: 813296 - DNA, 25 bp, Mus musculus
tgcttcggagctcgcagactgctgc

SEQ ID NO: 813297 - DNA, 25 bp, Mus musculus
tgcttcggagctggcagactgctgc

SEQ ID NO: 813298 - DNA, 25 bp, Mus musculus
tgcttcggtctccaggtccgggcca

SEQ ID NO: 813299 - DNA, 25 bp, Mus musculus
tgcttcggtctcgaggtccgggcca

SEQ ID NO: 813300 - DNA, 25 bp, Mus musculus
tgcttcgtcctacaagatgaagatg

SEQ ID NO: 813301 - DNA, 25 bp, Mus musculus
tgcttcgtcctagaagatgaagatg

SEQ ID NO: 813302 - DNA, 25 bp, Mus musculus
tgcttcgtgagacacgggaaaacct

SEQ ID NO: 813303 - DNA, 25 bp, Mus musculus
tgcttcgtgagagacgggaaaacct

SEQ ID NO: 813304 - DNA, 25 bp, Mus musculus
tgcttcgtggccaaagctgctctga

SEQ ID NO: 813305 - DNA, 25 bp, Mus musculus
tgcttcgtggcctaagctgctctga

SEQ ID NO: 813306 - DNA, 25 bp, Mus musculus
tgcttcgtttttagccgtttgctgc

SEQ ID NO: 813307 - DNA, 25 bp, Mus musculus
tgcttcgttttttgccgtttgctgc

SEQ ID NO: 813308 - DNA, 25 bp, Mus musculus
tgcttctacttcagctgagccacag

SEQ ID NO: 813309 - DNA, 25 bp, Mus musculus
tgcttctacttctgctgagccacag

SEQ ID NO: 813310 - DNA, 25 bp, Mus musculus
tgcttctagcccagtctgaggttag

SEQ ID NO: 813311 - DNA, 25 bp, Mus musculus
tgcttctagccctgtctgaggttag

SEQ ID NO: 813312 - DNA, 25 bp, Mus musculus
tgcttctccattaaagcccgttttg

SEQ ID NO: 813313 - DNA, 25 bp, Mus musculus
tgcttctccatttaagcccgttttg

SEQ ID NO: 813314 - DNA, 25 bp, Mus musculus
tgcttctctagtacagagactcagc

SEQ ID NO: 813315 - DNA, 25 bp, Mus musculus
tgcttctctagttcagagactcagc

SEQ ID NO: 813316 - DNA, 25 bp, Mus musculus
tgcttctctcccaccagctgattga

SEQ ID NO: 813317 - DNA, 25 bp, Mus musculus
tgcttctctccctccagctgattga

SEQ ID NO: 813318 - DNA, 25 bp, Mus musculus
tgcttctgaagaaactgcccttact

SEQ ID NO: 813319 - DNA, 25 bp, Mus musculus
tgcttctgaagatactgcccttact

SEQ ID NO: 813320 - DNA, 25 bp, Mus musculus
tgcttctgaatcattctggccacca

SEQ ID NO: 813321 - DNA, 25 bp, Mus musculus
tgcttctgaatctttctggccacca

SEQ ID NO: 813322 - DNA, 25 bp, Mus musculus
tgcttctgactcaaactgtcctcag

SEQ ID NO: 813323 - DNA, 25 bp, Mus musculus
tgcttctgactctaactgtcctcag

SEQ ID NO: 813324 - DNA, 25 bp, Mus musculus
tgcttctgagctatggcagccagcg

SEQ ID NO: 813325 - DNA, 25 bp, Mus musculus
tgcttctgagctcagacagagcctg

SEQ ID NO: 813326 - DNA, 25 bp, Mus musculus
tgcttctgagctgagacagagcctg

SEQ ID NO: 813327 - DNA, 25 bp, Mus musculus
tgcttctgagctttggcagccagcg

SEQ ID NO: 813328 - DNA, 25 bp, Mus musculus
tgcttctgccggaccaagggccacg

SEQ ID NO: 813329 - DNA, 25 bp, Mus musculus
tgcttctgccggtccaagggccacg

SEQ ID NO: 813330 - DNA, 25 bp, Mus musculus
tgcttctgcctaataaattctggga

SEQ ID NO: 813331 - DNA, 25 bp, Mus musculus
tgcttctgcctattaaattctggga

SEQ ID NO: 813332 - DNA, 25 bp, Mus musculus
tgcttctggaaaccctggacctggg

SEQ ID NO: 813333 - DNA, 25 bp, Mus musculus
tgcttctggaaagcctggacctggg

SEQ ID NO: 813334 - DNA, 25 bp, Mus musculus
tgcttctggaatctgcagctgtcag

SEQ ID NO: 813335 - DNA, 25 bp, Mus musculus
tgcttctggaatgtgcagctgtcag

SEQ ID NO: 813336 - DNA, 25 bp, Mus musculus
tgcttctggccaaggcctgccctgg

SEQ ID NO: 813337 - DNA, 25 bp, Mus musculus
tgcttctggccatggcctgccctgg

SEQ ID NO: 813338 - DNA, 25 bp, Mus musculus
tgcttctggctcacaacctgcacct

SEQ ID NO: 813339 - DNA, 25 bp, Mus musculus
tgcttctggctctcaacctgcacct

SEQ ID NO: 813340 - DNA, 25 bp, Mus musculus
tgcttctgggttccgccagcgcgta

SEQ ID NO: 813341 - DNA, 25 bp, Mus musculus
tgcttctgggttgcgccagcgcgta

SEQ ID NO: 813342 - DNA, 25 bp, Mus musculus
tgcttctggtacagtgttcaagggc

SEQ ID NO: 813343 - DNA, 25 bp, Mus musculus
tgcttctggtactgtgttcaagggc

SEQ ID NO: 813344 - DNA, 25 bp, Mus musculus
tgcttctggtagcaagcacctaatc

SEQ ID NO: 813345 - DNA, 25 bp, Mus musculus
tgcttctggtaggaagcacctaatc

SEQ ID NO: 813346 - DNA, 25 bp, Mus musculus
tgcttcttcactcgctgtgagacct

SEQ ID NO: 813347 - DNA, 25 bp, Mus musculus
tgcttcttcactggctgtgagacct

SEQ ID NO: 813348 - DNA, 25 bp, Mus musculus
tgcttcttctttcgagcaatcgaag

SEQ ID NO: 813349 - DNA, 25 bp, Mus musculus
tgcttcttctttggagcaatcgaag

SEQ ID NO: 813350 - DNA, 25 bp, Mus musculus
tgcttctttcccatgactccgctgg

SEQ ID NO: 813351 - DNA, 25 bp, Mus musculus
tgcttctttcccttgactccgctgg

SEQ ID NO: 813352 - DNA, 25 bp, Mus musculus
tgcttgaaccacaggaggctgaaat

SEQ ID NO: 813353 - DNA, 25 bp, Mus musculus
tgcttgaaccactggaggctgaaat

SEQ ID NO: 813354 - DNA, 25 bp, Mus musculus
tgcttgaacttacaggacaaaactt

SEQ ID NO: 813355 - DNA, 25 bp, Mus musculus
tgcttgaacttagaggacaaaactt

SEQ ID NO: 813356 - DNA, 25 bp, Mus musculus
tgcttgaagctgaaggtgactgtca

SEQ ID NO: 813357 - DNA, 25 bp, Mus musculus
tgcttgaagctgtaggtgactgtca

SEQ ID NO: 813358 - DNA, 25 bp, Mus musculus
tgcttgacaaggctgctctgtagat

SEQ ID NO: 813359 - DNA, 25 bp, Mus musculus
tgcttgacaagggtgctctgtagat

SEQ ID NO: 813360 - DNA, 25 bp, Mus musculus
tgcttgacactcagaatcttttgcg

SEQ ID NO: 813361 - DNA, 25 bp, Mus musculus
tgcttgacactctgaatcttttgcg

SEQ ID NO: 813362 - DNA, 25 bp, Mus musculus
tgcttgaccgtgacgtggacatcaa

SEQ ID NO: 813363 - DNA, 25 bp, Mus musculus
tgcttgaccgtgtcgtggacatcaa

SEQ ID NO: 813364 - DNA, 25 bp, Mus musculus
tgcttgacttctaaaaagatggtga

SEQ ID NO: 813365 - DNA, 25 bp, Mus musculus
tgcttgacttcttaaaagatggtga

SEQ ID NO: 813366 - DNA, 25 bp, Mus musculus
tgcttgagacggacctgctgggctt

SEQ ID NO: 813367 - DNA, 25 bp, Mus musculus
tgcttgagacggtcctgctgggctt

SEQ ID NO: 813368 - DNA, 25 bp, Mus musculus
tgcttgagtccacccaagaggccct

SEQ ID NO: 813369 - DNA, 25 bp, Mus musculus
tgcttgagtccagccaagaggccct

SEQ ID NO: 813370 - DNA, 25 bp, Mus musculus
tgcttgagtctgcttttcttatccc

SEQ ID NO: 813371 - DNA, 25 bp, Mus musculus
tgcttgagtctggttttcttatccc

SEQ ID NO: 813372 - DNA, 25 bp, Mus musculus
tgcttgatatggcttcagacattaa

SEQ ID NO: 813373 - DNA, 25 bp, Mus musculus
tgcttgatatgggttcagacattaa

SEQ ID NO: 813374 - DNA, 25 bp, Mus musculus
tgcttgattcgacttccttctgaag

SEQ ID NO: 813375 - DNA, 25 bp, Mus musculus
tgcttgattcgagttccttctgaag

SEQ ID NO: 813376 - DNA, 25 bp, Mus musculus
tgcttgattgctacagcgtgccatc

SEQ ID NO: 813377 - DNA, 25 bp, Mus musculus
tgcttgattgcttcagcgtgccatc

SEQ ID NO: 813378 - DNA, 25 bp, Mus musculus
tgcttgcactctatgtgccccgtgt

SEQ ID NO: 813379 - DNA, 25 bp, Mus musculus
tgcttgcactctttgtgccccgtgt

SEQ ID NO: 813380 - DNA, 25 bp, Mus musculus
tgcttgcactgtcactaaggcaggg

SEQ ID NO: 813381 - DNA, 25 bp, Mus musculus
tgcttgcactgtgactaaggcaggg

SEQ ID NO: 813382 - DNA, 25 bp, Mus musculus
tgcttgccgctgaatcccgcgtgtt

SEQ ID NO: 813383 - DNA, 25 bp, Mus musculus
tgcttgccgctgtatcccgcgtgtt

SEQ ID NO: 813384 - DNA, 25 bp, Mus musculus
tgcttgcctggcacgcgtggagccc

SEQ ID NO: 813385 - DNA, 25 bp, Mus musculus
tgcttgcctggctcgcgtggagccc

SEQ ID NO: 813386 - DNA, 25 bp, Mus musculus
tgcttgcgggatcgcatacacaggc

SEQ ID NO: 813387 - DNA, 25 bp, Mus musculus
tgcttgcgggatggcatacacaggc

SEQ ID NO: 813388 - DNA, 25 bp, Mus musculus
tgcttgcgtagcctgatgcccaaca

SEQ ID NO: 813389 - DNA, 25 bp, Mus musculus
tgcttgcgtagcgtgatgcccaaca

SEQ ID NO: 813390 - DNA, 25 bp, Mus musculus
tgcttgctagggaggccaccctcca

SEQ ID NO: 813391 - DNA, 25 bp, Mus musculus
tgcttgctagggtggccaccctcca

SEQ ID NO: 813392 - DNA, 25 bp, Mus musculus
tgcttgctcaaacacccaaatcttg

SEQ ID NO: 813393 - DNA, 25 bp, Mus musculus
tgcttgctcaaagacccaaatcttg

SEQ ID NO: 813394 - DNA, 25 bp, Mus musculus
tgcttgctctcacggccaactgcga

SEQ ID NO: 813395 - DNA, 25 bp, Mus musculus
tgcttgctctcagggccaactgcga

SEQ ID NO: 813396 - DNA, 25 bp, Mus musculus
tgcttgctgcagctcttcggacagg

SEQ ID NO: 813397 - DNA, 25 bp, Mus musculus
tgcttgctgcaggtcttcggacagg

SEQ ID NO: 813398 - DNA, 25 bp, Mus musculus
tgcttgctgccgagccatggctgaa

SEQ ID NO: 813399 - DNA, 25 bp, Mus musculus
tgcttgctgccgtgccatggctgaa

SEQ ID NO: 813400 - DNA, 25 bp, Mus musculus
tgcttgctgggcctcaacacaagga

SEQ ID NO: 813401 - DNA, 25 bp, Mus musculus
tgcttgctgggcgtcaacacaagga

SEQ ID NO: 813402 - DNA, 25 bp, Mus musculus
tgcttgctgtgacccctcagaggtg

SEQ ID NO: 813403 - DNA, 25 bp, Mus musculus
tgcttgctgtgagccctcagaggtg

SEQ ID NO: 813404 - DNA, 25 bp, Mus musculus
tgcttgcttttaccagacgtcccat

SEQ ID NO: 813405 - DNA, 25 bp, Mus musculus
tgcttgcttttagcagacgtcccat

SEQ ID NO: 813406 - DNA, 25 bp, Mus musculus
tgcttggaacctcgtactcctggag

SEQ ID NO: 813407 - DNA, 25 bp, Mus musculus
tgcttggaacctggtactcctggag

SEQ ID NO: 813408 - DNA, 25 bp, Mus musculus
tgcttggacattctgactgaactgg

SEQ ID NO: 813409 - DNA, 25 bp, Mus musculus
tgcttggacattgtgactgaactgg

SEQ ID NO: 813410 - DNA, 25 bp, Mus musculus
tgcttggactacaggctgcagcagc

SEQ ID NO: 813411 - DNA, 25 bp, Mus musculus
tgcttggactactggctgcagcagc

SEQ ID NO: 813412 - DNA, 25 bp, Mus musculus
tgcttggagaacaatggtggctgcc

SEQ ID NO: 813413 - DNA, 25 bp, Mus musculus
tgcttggagaactatggtggctgcc

SEQ ID NO: 813414 - DNA, 25 bp, Mus musculus
tgcttggagcacattctagaccacc

SEQ ID NO: 813415 - DNA, 25 bp, Mus musculus
tgcttggagcactttctagaccacc

SEQ ID NO: 813416 - DNA, 25 bp, Mus musculus
tgcttggatgcacatactggtggcc

SEQ ID NO: 813417 - DNA, 25 bp, Mus musculus
tgcttggatgcagatactggtggcc

SEQ ID NO: 813418 - DNA, 25 bp, Mus musculus
tgcttggcaagcagggacatgtctg

SEQ ID NO: 813419 - DNA, 25 bp, Mus musculus
tgcttggcaagctgggacatgtctg

SEQ ID NO: 813420 - DNA, 25 bp, Mus musculus
tgcttggcacaaactgcagtggctg

SEQ ID NO: 813421 - DNA, 25 bp, Mus musculus
tgcttggcacaatctgcagtggctg

SEQ ID NO: 813422 - DNA, 25 bp, Mus musculus
tgcttggccaagctaaagatccggc

SEQ ID NO: 813423 - DNA, 25 bp, Mus musculus
tgcttggccaaggtaaagatccggc

SEQ ID NO: 813424 - DNA, 25 bp, Mus musculus
tgcttggcccaaaagcctgggttgg

SEQ ID NO: 813425 - DNA, 25 bp, Mus musculus
tgcttggcccaatagcctgggttgg

SEQ ID NO: 813426 - DNA, 25 bp, Mus musculus
tgcttggcctacagcggaataggaa

SEQ ID NO: 813427 - DNA, 25 bp, Mus musculus
tgcttggcctactgcggaataggaa

SEQ ID NO: 813428 - DNA, 25 bp, Mus musculus
tgcttggctactagagaaacaatct

SEQ ID NO: 813429 - DNA, 25 bp, Mus musculus
tgcttggctacttgagaaacaatct

SEQ ID NO: 813430 - DNA, 25 bp, Mus musculus
tgcttggctcctaccaaggccttgg

SEQ ID NO: 813431 - DNA, 25 bp, Mus musculus
tgcttggctccttccaaggccttgg

SEQ ID NO: 813432 - DNA, 25 bp, Mus musculus
tgcttggcttctacaataactgtgg

SEQ ID NO: 813433 - DNA, 25 bp, Mus musculus
tgcttggcttcttcaataactgtgg

SEQ ID NO: 813434 - DNA, 25 bp, Mus musculus
tgcttgggaagtagcacgtgactcg

SEQ ID NO: 813435 - DNA, 25 bp, Mus musculus
tgcttgggaagttgcacgtgactcg

SEQ ID NO: 813436 - DNA, 25 bp, Mus musculus
tgcttgggaatgatgtcagctgctc

SEQ ID NO: 813437 - DNA, 25 bp, Mus musculus
tgcttgggaatgttgtcagctgctc

SEQ ID NO: 813438 - DNA, 25 bp, Mus musculus
tgcttgggacacaaggatcgccacc

SEQ ID NO: 813439 - DNA, 25 bp, Mus musculus
tgcttgggacactaggatcgccacc

SEQ ID NO: 813440 - DNA, 25 bp, Mus musculus
tgcttgggaccacgcaagtttctgc

SEQ ID NO: 813441 - DNA, 25 bp, Mus musculus
tgcttgggaccaggcaagtttctgc

SEQ ID NO: 813442 - DNA, 25 bp, Mus musculus
tgcttgggcagcctgtgtccagctc

SEQ ID NO: 813443 - DNA, 25 bp, Mus musculus
tgcttgggcagcgtgtgtccagctc

SEQ ID NO: 813444 - DNA, 25 bp, Mus musculus
tgcttgggccctatgacagccgtga

SEQ ID NO: 813445 - DNA, 25 bp, Mus musculus
tgcttgggccctttgacagccgtga

SEQ ID NO: 813446 - DNA, 25 bp, Mus musculus
tgcttgggccttactgtaccccaaa

SEQ ID NO: 813447 - DNA, 25 bp, Mus musculus
tgcttgggcctttctgtaccccaaa

SEQ ID NO: 813448 - DNA, 25 bp, Mus musculus
tgcttgggctgcagtcttatctccc

SEQ ID NO: 813449 - DNA, 25 bp, Mus musculus
tgcttgggctgctgtcttatctccc

SEQ ID NO: 813450 - DNA, 25 bp, Mus musculus
tgcttgggctggacccaacgcagct

SEQ ID NO: 813451 - DNA, 25 bp, Mus musculus
tgcttgggctggtcccaacgcagct

SEQ ID NO: 813452 - DNA, 25 bp, Mus musculus
tgcttgggtcgcacgtgtcatcacg

SEQ ID NO: 813453 - DNA, 25 bp, Mus musculus
tgcttgggtcgctcgtgtcatcacg

SEQ ID NO: 813454 - DNA, 25 bp, Mus musculus
tgcttggtataactggcagccgtac

SEQ ID NO: 813455 - DNA, 25 bp, Mus musculus
tgcttggtataagtggcagccgtac

SEQ ID NO: 813456 - DNA, 25 bp, Mus musculus
tgcttggtatagaccaaaaccctaa

SEQ ID NO: 813457 - DNA, 25 bp, Mus musculus
tgcttggtatagtccaaaaccctaa

SEQ ID NO: 813458 - DNA, 25 bp, Mus musculus
tgcttggtcacacgtggccccgtcg

SEQ ID NO: 813459 - DNA, 25 bp, Mus musculus
tgcttggtcacaggtggccccgtcg

SEQ ID NO: 813460 - DNA, 25 bp, Mus musculus
tgcttggtcttacgaatttcgtacc

SEQ ID NO: 813461 - DNA, 25 bp, Mus musculus
tgcttggtcttaggaatttcgtacc

SEQ ID NO: 813462 - DNA, 25 bp, Mus musculus
tgcttggtgtcgctgcgcttgtcac

SEQ ID NO: 813463 - DNA, 25 bp, Mus musculus
tgcttggtgtcggtgcgcttgtcac

SEQ ID NO: 813464 - DNA, 25 bp, Mus musculus
tgcttgtacagcctagaccctgcca

SEQ ID NO: 813465 - DNA, 25 bp, Mus musculus
tgcttgtacagcgtagaccctgcca

SEQ ID NO: 813466 - DNA, 25 bp, Mus musculus
tgcttgtagaagagataacatctca

SEQ ID NO: 813467 - DNA, 25 bp, Mus musculus
tgcttgtagaagtgataacatctca

SEQ ID NO: 813468 - DNA, 25 bp, Mus musculus
tgcttgtaggccacaggcacgttgt

SEQ ID NO: 813469 - DNA, 25 bp, Mus musculus
tgcttgtaggcctcaggcacgttgt

SEQ ID NO: 813470 - DNA, 25 bp, Mus musculus
tgcttgtatactatgctccacctgt

SEQ ID NO: 813471 - DNA, 25 bp, Mus musculus
tgcttgtatactttgctccacctgt

SEQ ID NO: 813472 - DNA, 25 bp, Mus musculus
tgcttgtcacacaagctgccagcta

SEQ ID NO: 813473 - DNA, 25 bp, Mus musculus
tgcttgtcacactagctgccagcta

SEQ ID NO: 813474 - DNA, 25 bp, Mus musculus
tgcttgtcatttatggaggccttac

SEQ ID NO: 813475 - DNA, 25 bp, Mus musculus
tgcttgtcatttttggaggccttac

SEQ ID NO: 813476 - DNA, 25 bp, Mus musculus
tgcttgtccacactagtccgtcctg

SEQ ID NO: 813477 - DNA, 25 bp, Mus musculus
tgcttgtccacagtagtccgtcctg

SEQ ID NO: 813478 - DNA, 25 bp, Mus musculus
tgcttgtccattcgcgtcctggaca

SEQ ID NO: 813479 - DNA, 25 bp, Mus musculus
tgcttgtccattggcgtcctggaca

SEQ ID NO: 813480 - DNA, 25 bp, Mus musculus
tgcttgtcttcaccgtcccaattgt

SEQ ID NO: 813481 - DNA, 25 bp, Mus musculus
tgcttgtcttcagcgtcccaattgt

SEQ ID NO: 813482 - DNA, 25 bp, Mus musculus
tgcttgtgccacacttcggtgtcca

SEQ ID NO: 813483 - DNA, 25 bp, Mus musculus
tgcttgtgccactcttcggtgtcca

SEQ ID NO: 813484 - DNA, 25 bp, Mus musculus
tgcttgtgcgcaaacacccggctgt

SEQ ID NO: 813485 - DNA, 25 bp, Mus musculus
tgcttgtgcgcatacacccggctgt

SEQ ID NO: 813486 - DNA, 25 bp, Mus musculus
tgcttgtggtccagaaaaattccgc

SEQ ID NO: 813487 - DNA, 25 bp, Mus musculus
tgcttgtggtcctgaaaaattccgc

SEQ ID NO: 813488 - DNA, 25 bp, Mus musculus
tgcttgtgtagcaacctccatgttg

SEQ ID NO: 813489 - DNA, 25 bp, Mus musculus
tgcttgtgtagctacctccatgttg

SEQ ID NO: 813490 - DNA, 25 bp, Mus musculus
tgcttgtgtcacaggtggtgagctc

SEQ ID NO: 813491 - DNA, 25 bp, Mus musculus
tgcttgtgtcactggtggtgagctc

SEQ ID NO: 813492 - DNA, 25 bp, Mus musculus
tgcttgttcacacgatgggaatggt

SEQ ID NO: 813493 - DNA, 25 bp, Mus musculus
tgcttgttcacaggatgggaatggt

SEQ ID NO: 813494 - DNA, 25 bp, Mus musculus
tgcttgttctatagccccgggacga

SEQ ID NO: 813495 - DNA, 25 bp, Mus musculus
tgcttgttctattgccccgggacga

SEQ ID NO: 813496 - DNA, 25 bp, Mus musculus
tgcttgttgaagcatctcagtgaca

SEQ ID NO: 813497 - DNA, 25 bp, Mus musculus
tgcttgttgaaggatctcagtgaca

SEQ ID NO: 813498 - DNA, 25 bp, Mus musculus
tgcttgttggtaacagccatcgtta

SEQ ID NO: 813499 - DNA, 25 bp, Mus musculus
tgcttgttggtatcagccatcgtta

SEQ ID NO: 813500 - DNA, 25 bp, Mus musculus
tgctttaaaccaagagcccttcggt

SEQ ID NO: 813501 - DNA, 25 bp, Mus musculus
tgctttaaaccatgagcccttcggt

SEQ ID NO: 813502 - DNA, 25 bp, Mus musculus
tgctttaagtataatatgagtgacg

SEQ ID NO: 813503 - DNA, 25 bp, Mus musculus
tgctttaagtattatatgagtgacg

SEQ ID NO: 813504 - DNA, 25 bp, Mus musculus
tgctttaatctacaatcactccgta

SEQ ID NO: 813505 - DNA, 25 bp, Mus musculus
tgctttaatctagaatcactccgta

SEQ ID NO: 813506 - DNA, 25 bp, Mus musculus
tgctttactctcaatcaggatgaga

SEQ ID NO: 813507 - DNA, 25 bp, Mus musculus
tgctttactctctatcaggatgaga

SEQ ID NO: 813508 - DNA, 25 bp, Mus musculus
tgctttagacaacgctctggaatta

SEQ ID NO: 813509 - DNA, 25 bp, Mus musculus
tgctttagacaaggctctggaatta

SEQ ID NO: 813510 - DNA, 25 bp, Mus musculus
tgctttagcaccagtgatggtccaa

SEQ ID NO: 813511 - DNA, 25 bp, Mus musculus
tgctttagcacctgtgatggtccaa

SEQ ID NO: 813512 - DNA, 25 bp, Mus musculus
tgctttatgtccactgcgtgctgct

SEQ ID NO: 813513 - DNA, 25 bp, Mus musculus
tgctttatgtcctctgcgtgctgct

SEQ ID NO: 813514 - DNA, 25 bp, Mus musculus
tgctttattctgagcacgcccgcca

SEQ ID NO: 813515 - DNA, 25 bp, Mus musculus
tgctttattctgtgcacgcccgcca

SEQ ID NO: 813516 - DNA, 25 bp, Mus musculus
tgctttcaccctctatgagttctgg

SEQ ID NO: 813517 - DNA, 25 bp, Mus musculus
tgctttcaccctgtatgagttctgg

SEQ ID NO: 813518 - DNA, 25 bp, Mus musculus
tgctttcacgttactcaagtttcca

SEQ ID NO: 813519 - DNA, 25 bp, Mus musculus
tgctttcacgtttctcaagtttcca

SEQ ID NO: 813520 - DNA, 25 bp, Mus musculus
tgctttcagcatccgaggtcttccg

SEQ ID NO: 813521 - DNA, 25 bp, Mus musculus
tgctttcagcatgcgaggtcttccg

SEQ ID NO: 813522 - DNA, 25 bp, Mus musculus
tgctttcatactcgacaacacagtg

SEQ ID NO: 813523 - DNA, 25 bp, Mus musculus
tgctttcatactggacaacacagtg

SEQ ID NO: 813524 - DNA, 25 bp, Mus musculus
tgctttcatcaacaagggacagttt

SEQ ID NO: 813525 - DNA, 25 bp, Mus musculus
tgctttcatcaagaagggacagttt

SEQ ID NO: 813526 - DNA, 25 bp, Mus musculus
tgctttcatcctagacgcaaatcca

SEQ ID NO: 813527 - DNA, 25 bp, Mus musculus
tgctttcatccttgacgcaaatcca

SEQ ID NO: 813528 - DNA, 25 bp, Mus musculus
tgctttcatggcataggcctgacgg

SEQ ID NO: 813529 - DNA, 25 bp, Mus musculus
tgctttcatggcttaggcctgacgg

SEQ ID NO: 813530 - DNA, 25 bp, Mus musculus
tgctttccacgacggcaacttctcg

SEQ ID NO: 813531 - DNA, 25 bp, Mus musculus
tgctttccacgagggcaacttctcg

SEQ ID NO: 813532 - DNA, 25 bp, Mus musculus
tgctttccagtgagcgcggttgtcc

SEQ ID NO: 813533 - DNA, 25 bp, Mus musculus
tgctttccagtgtgcgcggttgtcc

SEQ ID NO: 813534 - DNA, 25 bp, Mus musculus
tgctttccccaaaacgaacctgact

SEQ ID NO: 813535 - DNA, 25 bp, Mus musculus
tgctttccccaatacgaacctgact

SEQ ID NO: 813536 - DNA, 25 bp, Mus musculus
tgctttccccacatacgctgatcgg

SEQ ID NO: 813537 - DNA, 25 bp, Mus musculus
tgctttccccacttacgctgatcgg

SEQ ID NO: 813538 - DNA, 25 bp, Mus musculus
tgctttccctgcagggcactcttca

SEQ ID NO: 813539 - DNA, 25 bp, Mus musculus
tgctttccctgctgggcactcttca

SEQ ID NO: 813540 - DNA, 25 bp, Mus musculus
tgctttccctggataactaccagac

SEQ ID NO: 813541 - DNA, 25 bp, Mus musculus
tgctttccctggttaactaccagac

SEQ ID NO: 813542 - DNA, 25 bp, Mus musculus
tgctttccggctcattcgtcgagtg

SEQ ID NO: 813543 - DNA, 25 bp, Mus musculus
tgctttccggctgattcgtcgagtg

SEQ ID NO: 813544 - DNA, 25 bp, Mus musculus
tgctttccgtgaagtaacgccagta

SEQ ID NO: 813545 - DNA, 25 bp, Mus musculus
tgctttccgtgatgtaacgccagta

SEQ ID NO: 813546 - DNA, 25 bp, Mus musculus
tgctttcctacaacactagtgatag

SEQ ID NO: 813547 - DNA, 25 bp, Mus musculus
tgctttcctacatcactagtgatag

SEQ ID NO: 813548 - DNA, 25 bp, Mus musculus
tgctttccttttctggcttgagaga

SEQ ID NO: 813549 - DNA, 25 bp, Mus musculus
tgctttccttttgtggcttgagaga

SEQ ID NO: 813550 - DNA, 25 bp, Mus musculus
tgctttcgcagtagccccggagtgg

SEQ ID NO: 813551 - DNA, 25 bp, Mus musculus
tgctttcgcagttgccccggagtgg

SEQ ID NO: 813552 - DNA, 25 bp, Mus musculus
tgctttcgggccacggtgctagccc

SEQ ID NO: 813553 - DNA, 25 bp, Mus musculus
tgctttcgggcctcggtgctagccc

SEQ ID NO: 813554 - DNA, 25 bp, Mus musculus
tgctttctcccactggtcgggatac

SEQ ID NO: 813555 - DNA, 25 bp, Mus musculus
tgctttctcccagtggtcgggatac

SEQ ID NO: 813556 - DNA, 25 bp, Mus musculus
tgctttctccgacggcaaagaaggc

SEQ ID NO: 813557 - DNA, 25 bp, Mus musculus
tgctttctccgagggcaaagaaggc

SEQ ID NO: 813558 - DNA, 25 bp, Mus musculus
tgctttctgacaatgcagcatctct

SEQ ID NO: 813559 - DNA, 25 bp, Mus musculus
tgctttctgacattgcagcatctct

SEQ ID NO: 813560 - DNA, 25 bp, Mus musculus
tgctttctgcacagaccgtcgtggg

SEQ ID NO: 813561 - DNA, 25 bp, Mus musculus
tgctttctgcactgaccgtcgtggg

SEQ ID NO: 813562 - DNA, 25 bp, Mus musculus
tgctttctgctcagctccgccggag

SEQ ID NO: 813563 - DNA, 25 bp, Mus musculus
tgctttctgctctgctccgccggag

SEQ ID NO: 813564 - DNA, 25 bp, Mus musculus
tgctttctggtacaggtgagacctg

SEQ ID NO: 813565 - DNA, 25 bp, Mus musculus
tgctttctggtagaggtgagacctg

SEQ ID NO: 813566 - DNA, 25 bp, Mus musculus
tgctttgaaagtatgggacctacag

SEQ ID NO: 813567 - DNA, 25 bp, Mus musculus
tgctttgaaagtttgggacctacag

SEQ ID NO: 813568 - DNA, 25 bp, Mus musculus
tgctttgaacccagaaggaacggac

SEQ ID NO: 813569 - DNA, 25 bp, Mus musculus
tgctttgaaccctgaaggaacggac

SEQ ID NO: 813570 - DNA, 25 bp, Mus musculus
tgctttgaagagatctgtggaagtc

SEQ ID NO: 813571 - DNA, 25 bp, Mus musculus
tgctttgaagagttctgtggaagtc

SEQ ID NO: 813572 - DNA, 25 bp, Mus musculus
tgctttgaatccacagtctggaggt

SEQ ID NO: 813573 - DNA, 25 bp, Mus musculus
tgctttgaatcctcagtctggaggt

SEQ ID NO: 813574 - DNA, 25 bp, Mus musculus
tgctttgagctactgagtgtactgg

SEQ ID NO: 813575 - DNA, 25 bp, Mus musculus
tgctttgagctagtgagtgtactgg

SEQ ID NO: 813576 - DNA, 25 bp, Mus musculus
tgctttgagctgaccatctacgtgg

SEQ ID NO: 813577 - DNA, 25 bp, Mus musculus
tgctttgagctgtccatctacgtgg

SEQ ID NO: 813578 - DNA, 25 bp, Mus musculus
tgctttgagcttaatatccctgaca

SEQ ID NO: 813579 - DNA, 25 bp, Mus musculus
tgctttgagctttatatccctgaca

SEQ ID NO: 813580 - DNA, 25 bp, Mus musculus
tgctttgatgtgaaggatgtacaga

SEQ ID NO: 813581 - DNA, 25 bp, Mus musculus
tgctttgatgtgtaggatgtacaga

SEQ ID NO: 813582 - DNA, 25 bp, Mus musculus
tgctttgcagcaaatgacaatgatc

SEQ ID NO: 813583 - DNA, 25 bp, Mus musculus
tgctttgcagcatatgacaatgatc

SEQ ID NO: 813584 - DNA, 25 bp, Mus musculus
tgctttgcatccaaacgatagtgaa

SEQ ID NO: 813585 - DNA, 25 bp, Mus musculus
tgctttgcatcctaacgatagtgaa

SEQ ID NO: 813586 - DNA, 25 bp, Mus musculus
tgctttgccagaaactttgtcacgg

SEQ ID NO: 813587 - DNA, 25 bp, Mus musculus
tgctttgccagatactttgtcacgg

SEQ ID NO: 813588 - DNA, 25 bp, Mus musculus
tgctttgccctgacattctgcatcc

SEQ ID NO: 813589 - DNA, 25 bp, Mus musculus
tgctttgccctgtcattctgcatcc

SEQ ID NO: 813590 - DNA, 25 bp, Mus musculus
tgctttgcctaaatacatctcccag

SEQ ID NO: 813591 - DNA, 25 bp, Mus musculus
tgctttgcctaattacatctcccag

SEQ ID NO: 813592 - DNA, 25 bp, Mus musculus
tgctttgcggatcgaacccggtgac

SEQ ID NO: 813593 - DNA, 25 bp, Mus musculus
tgctttgcggatggaacccggtgac

SEQ ID NO: 813594 - DNA, 25 bp, Mus musculus
tgctttgctgtcaggaaagttccag

SEQ ID NO: 813595 - DNA, 25 bp, Mus musculus
tgctttgctgtctggaaagttccag

SEQ ID NO: 813596 - DNA, 25 bp, Mus musculus
tgctttggaagcagggaagtcacct

SEQ ID NO: 813597 - DNA, 25 bp, Mus musculus
tgctttggaagctgggaagtcacct

SEQ ID NO: 813598 - DNA, 25 bp, Mus musculus
tgctttggccccacagcacaagcag

SEQ ID NO: 813599 - DNA, 25 bp, Mus musculus
tgctttggcccctcagcacaagcag

SEQ ID NO: 813600 - DNA, 25 bp, Mus musculus
tgctttggcgagagtgccgagggaa

SEQ ID NO: 813601 - DNA, 25 bp, Mus musculus
tgctttggcgagtgtgccgagggaa

SEQ ID NO: 813602 - DNA, 25 bp, Mus musculus
tgctttggcggacccgggtttacct

SEQ ID NO: 813603 - DNA, 25 bp, Mus musculus
tgctttggcggagccgggtttacct

SEQ ID NO: 813604 - DNA, 25 bp, Mus musculus
tgctttgtacacacccattttaaaa

SEQ ID NO: 813605 - DNA, 25 bp, Mus musculus
tgctttgtacactcccattttaaaa

SEQ ID NO: 813606 - DNA, 25 bp, Mus musculus
tgctttgtccccacctactcagaag

SEQ ID NO: 813607 - DNA, 25 bp, Mus musculus
tgctttgtcccctcctactcagaag

SEQ ID NO: 813608 - DNA, 25 bp, Mus musculus
tgctttgtcggaagaagcatacaga

SEQ ID NO: 813609 - DNA, 25 bp, Mus musculus
tgctttgtcggatgaagcatacaga

SEQ ID NO: 813610 - DNA, 25 bp, Mus musculus
tgctttgtgaagctaaatctcatgc

SEQ ID NO: 813611 - DNA, 25 bp, Mus musculus
tgctttgtgaaggtaaatctcatgc

SEQ ID NO: 813612 - DNA, 25 bp, Mus musculus
tgctttgtgccccaactcatgatcc

SEQ ID NO: 813613 - DNA, 25 bp, Mus musculus
tgctttgtgcccgaactcatgatcc

SEQ ID NO: 813614 - DNA, 25 bp, Mus musculus
tgctttgtgcgacttccggcctctc

SEQ ID NO: 813615 - DNA, 25 bp, Mus musculus
tgctttgtgcgagttccggcctctc

SEQ ID NO: 813616 - DNA, 25 bp, Mus musculus
tgctttgtggtaaaataccgtgatc

SEQ ID NO: 813617 - DNA, 25 bp, Mus musculus
tgctttgtggtataataccgtgatc

SEQ ID NO: 813618 - DNA, 25 bp, Mus musculus
tgctttgtgtctcataccaagttga

SEQ ID NO: 813619 - DNA, 25 bp, Mus musculus
tgctttgtgtctgataccaagttga

SEQ ID NO: 813620 - DNA, 25 bp, Mus musculus
tgcttttaaaatcagcctaagtgct

SEQ ID NO: 813621 - DNA, 25 bp, Mus musculus
tgcttttaaaatgagcctaagtgct

SEQ ID NO: 813622 - DNA, 25 bp, Mus musculus
tgcttttaatgtaagtatgccttct

SEQ ID NO: 813623 - DNA, 25 bp, Mus musculus
tgcttttaatgttagtatgccttct

SEQ ID NO: 813624 - DNA, 25 bp, Mus musculus
tgcttttaccagattctgctttggc

SEQ ID NO: 813625 - DNA, 25 bp, Mus musculus
tgcttttaccagtttctgctttggc

SEQ ID NO: 813626 - DNA, 25 bp, Mus musculus
tgcttttagaagatccggcccgcag

SEQ ID NO: 813627 - DNA, 25 bp, Mus musculus
tgcttttagaagttccggcccgcag

SEQ ID NO: 813628 - DNA, 25 bp, Mus musculus
tgcttttatgggaaacctcccagcc

SEQ ID NO: 813629 - DNA, 25 bp, Mus musculus
tgcttttatgggtaacctcccagcc

SEQ ID NO: 813630 - DNA, 25 bp, Mus musculus
tgcttttcaataaccgacaacaaca

SEQ ID NO: 813631 - DNA, 25 bp, Mus musculus
tgcttttcaataagattccgtctaa

SEQ ID NO: 813632 - DNA, 25 bp, Mus musculus
tgcttttcaatatccgacaacaaca

SEQ ID NO: 813633 - DNA, 25 bp, Mus musculus
tgcttttcaatatgattccgtctaa

SEQ ID NO: 813634 - DNA, 25 bp, Mus musculus
tgcttttccatgagagtgtcttgtg

SEQ ID NO: 813635 - DNA, 25 bp, Mus musculus
tgcttttccatgtgagtgtcttgtg

SEQ ID NO: 813636 - DNA, 25 bp, Mus musculus
tgcttttcctatcggagttgcagta

SEQ ID NO: 813637 - DNA, 25 bp, Mus musculus
tgcttttcctatgggagttgcagta

SEQ ID NO: 813638 - DNA, 25 bp, Mus musculus
tgcttttccttactcgatacagtcg

SEQ ID NO: 813639 - DNA, 25 bp, Mus musculus
tgcttttccttagtcgatacagtcg

SEQ ID NO: 813640 - DNA, 25 bp, Mus musculus
tgcttttctgcgagccaacagaact

SEQ ID NO: 813641 - DNA, 25 bp, Mus musculus
tgcttttctgcgtgccaacagaact

SEQ ID NO: 813642 - DNA, 25 bp, Mus musculus
tgcttttgaacacccacttatgcgt

SEQ ID NO: 813643 - DNA, 25 bp, Mus musculus
tgcttttgaacagccacttatgcgt

SEQ ID NO: 813644 - DNA, 25 bp, Mus musculus
tgcttttgagcccttagagatgtca

SEQ ID NO: 813645 - DNA, 25 bp, Mus musculus
tgcttttgagccgttagagatgtca

SEQ ID NO: 813646 - DNA, 25 bp, Mus musculus
tgcttttgccaaagcagtggctgtc

SEQ ID NO: 813647 - DNA, 25 bp, Mus musculus
tgcttttgccaatgcagtggctgtc

SEQ ID NO: 813648 - DNA, 25 bp, Mus musculus
tgcttttgcctgaacactggcttcc

SEQ ID NO: 813649 - DNA, 25 bp, Mus musculus
tgcttttgcctgataaccctggttg

SEQ ID NO: 813650 - DNA, 25 bp, Mus musculus
tgcttttgcctgtacactggcttcc

SEQ ID NO: 813651 - DNA, 25 bp, Mus musculus
tgcttttgcctgttaaccctggttg

SEQ ID NO: 813652 - DNA, 25 bp, Mus musculus
tgcttttgcggaacggaacccggtg

SEQ ID NO: 813653 - DNA, 25 bp, Mus musculus
tgcttttgcggatcggaacccggtg

SEQ ID NO: 813654 - DNA, 25 bp, Mus musculus
tgcttttggatactttgaggtcacc

SEQ ID NO: 813655 - DNA, 25 bp, Mus musculus
tgcttttggatagtttgaggtcacc

SEQ ID NO: 813656 - DNA, 25 bp, Mus musculus
tgcttttggtgacgtctgtccacca

SEQ ID NO: 813657 - DNA, 25 bp, Mus musculus
tgcttttggtgaggtctgtccacca

SEQ ID NO: 813658 - DNA, 25 bp, Mus musculus
tgcttttggtgtacaagggtcccct

SEQ ID NO: 813659 - DNA, 25 bp, Mus musculus
tgcttttggtgttcaagggtcccct

SEQ ID NO: 813660 - DNA, 25 bp, Mus musculus
tgcttttgttccagggaggcgcctt

SEQ ID NO: 813661 - DNA, 25 bp, Mus musculus
tgcttttgttcctgggaggcgcctt

SEQ ID NO: 813662 - DNA, 25 bp, Mus musculus
tgctttttatgtccaggagtcctgc

SEQ ID NO: 813663 - DNA, 25 bp, Mus musculus
tgctttttatgtgcaggagtcctgc

SEQ ID NO: 813664 - DNA, 25 bp, Mus musculus
tgctttttctctcaatagaaaggtg

SEQ ID NO: 813665 - DNA, 25 bp, Mus musculus
tgctttttctctgaatagaaaggtg

SEQ ID NO: 813666 - DNA, 25 bp, Mus musculus
tgctttttgaacacctgctcaccga

SEQ ID NO: 813667 - DNA, 25 bp, Mus musculus
tgctttttgaactcctgctcaccga

SEQ ID NO: 813668 - DNA, 25 bp, Mus musculus
tgctttttgatgatattgaccataa

SEQ ID NO: 813669 - DNA, 25 bp, Mus musculus
tgctttttgatgttattgaccataa

SEQ ID NO: 813670 - DNA, 25 bp, Mus musculus
tgcttttttaggaccaaaggacata

SEQ ID NO: 813671 - DNA, 25 bp, Mus musculus
tgcttttttaggtccaaaggacata

SEQ ID NO: 813672 - DNA, 25 bp, Mus musculus
tgcttttttcagcaccacgctctgg

SEQ ID NO: 813673 - DNA, 25 bp, Mus musculus
tgcttttttcaggaccacgctctgg

SEQ ID NO: 813674 - DNA, 25 bp, Mus musculus
tggaaaaacaaacgacatcgtcaac

SEQ ID NO: 813675 - DNA, 25 bp, Mus musculus
tggaaaaacaaaggacatcgtcaac

SEQ ID NO: 813676 - DNA, 25 bp, Mus musculus
tggaaaaacacaactccctgcagaa

SEQ ID NO: 813677 - DNA, 25 bp, Mus musculus
tggaaaaacacatctccctgcagaa

SEQ ID NO: 813678 - DNA, 25 bp, Mus musculus
tggaaaaaccagaccggagaccaag

SEQ ID NO: 813679 - DNA, 25 bp, Mus musculus
tggaaaaaccagtccggagaccaag

SEQ ID NO: 813680 - DNA, 25 bp, Mus musculus
tggaaaaacgttagacacttgagcc

SEQ ID NO: 813681 - DNA, 25 bp, Mus musculus
tggaaaaacgtttgacacttgagcc

SEQ ID NO: 813682 - DNA, 25 bp, Mus musculus
tggaaaaactcacacaaatacttcc

SEQ ID NO: 813683 - DNA, 25 bp, Mus musculus
tggaaaaactcagacaaatacttcc

SEQ ID NO: 813684 - DNA, 25 bp, Mus musculus
tggaaaaagacaatcctgtggaggc

SEQ ID NO: 813685 - DNA, 25 bp, Mus musculus
tggaaaaagacattcctgtggaggc

SEQ ID NO: 813686 - DNA, 25 bp, Mus musculus
tggaaaaagatcctctagttcagag

SEQ ID NO: 813687 - DNA, 25 bp, Mus musculus
tggaaaaagatcgtctagttcagag

SEQ ID NO: 813688 - DNA, 25 bp, Mus musculus
tggaaaaagtggacctgaaatccac

SEQ ID NO: 813689 - DNA, 25 bp, Mus musculus
tggaaaaagtggtcctgaaatccac

SEQ ID NO: 813690 - DNA, 25 bp, Mus musculus
tggaaaaatagaccagtgtagaact

SEQ ID NO: 813691 - DNA, 25 bp, Mus musculus
tggaaaaatagagcagtgtagaact

SEQ ID NO: 813692 - DNA, 25 bp, Mus musculus
tggaaaaatctgactcctgaggaaa

SEQ ID NO: 813693 - DNA, 25 bp, Mus musculus
tggaaaaatctgtctcctgaggaaa

SEQ ID NO: 813694 - DNA, 25 bp, Mus musculus
tggaaaaattacacctatcgacgga

SEQ ID NO: 813695 - DNA, 25 bp, Mus musculus
tggaaaaattactcctatcgacgga

SEQ ID NO: 813696 - DNA, 25 bp, Mus musculus
tggaaaaattatcggaatgcgcacg

SEQ ID NO: 813697 - DNA, 25 bp, Mus musculus
tggaaaaattatgggaatgcgcacg

SEQ ID NO: 813698 - DNA, 25 bp, Mus musculus
tggaaaacaaaaaccgaagcacgct

SEQ ID NO: 813699 - DNA, 25 bp, Mus musculus
tggaaaacaaaatccgaagcacgct

SEQ ID NO: 813700 - DNA, 25 bp, Mus musculus
tggaaaacagcaatggatcttatct

SEQ ID NO: 813701 - DNA, 25 bp, Mus musculus
tggaaaacagcattggatcttatct

SEQ ID NO: 813702 - DNA, 25 bp, Mus musculus
tggaaaacaggtcgcgatctttgaa

SEQ ID NO: 813703 - DNA, 25 bp, Mus musculus
tggaaaacaggtggcgatctttgaa

SEQ ID NO: 813704 - DNA, 25 bp, Mus musculus
tggaaaacataaacgaggaaatccg

SEQ ID NO: 813705 - DNA, 25 bp, Mus musculus
tggaaaacataatcgaggaaatccg

SEQ ID NO: 813706 - DNA, 25 bp, Mus musculus
tggaaaacatccctacagtgggctt

SEQ ID NO: 813707 - DNA, 25 bp, Mus musculus
tggaaaacatccgtacagtgggctt

SEQ ID NO: 813708 - DNA, 25 bp, Mus musculus
tggaaaacatgtccccaactctata

SEQ ID NO: 813709 - DNA, 25 bp, Mus musculus
tggaaaacatgtgcccaactctata

SEQ ID NO: 813710 - DNA, 25 bp, Mus musculus
tggaaaaccccaccaagtaccacat

SEQ ID NO: 813711 - DNA, 25 bp, Mus musculus
tggaaaaccccagcaagtaccacat

SEQ ID NO: 813712 - DNA, 25 bp, Mus musculus
tggaaaaccctgatgaggccgtggt

SEQ ID NO: 813713 - DNA, 25 bp, Mus musculus
tggaaaaccctgttgaggccgtggt

SEQ ID NO: 813714 - DNA, 25 bp, Mus musculus
tggaaaacgacacgtgctccgtgtg

SEQ ID NO: 813715 - DNA, 25 bp, Mus musculus
tggaaaacgacaggtgctccgtgtg

SEQ ID NO: 813716 - DNA, 25 bp, Mus musculus
tggaaaacgagtatgaccggctgac

SEQ ID NO: 813717 - DNA, 25 bp, Mus musculus
tggaaaacgagtttgaccggctgac

SEQ ID NO: 813718 - DNA, 25 bp, Mus musculus
tggaaaacgtgactcttgccctggg

SEQ ID NO: 813719 - DNA, 25 bp, Mus musculus
tggaaaacgtgagtcttgccctggg

SEQ ID NO: 813720 - DNA, 25 bp, Mus musculus
tggaaaactcatcatctgggacagt

SEQ ID NO: 813721 - DNA, 25 bp, Mus musculus
tggaaaactcatgatctgggacagt

SEQ ID NO: 813722 - DNA, 25 bp, Mus musculus
tggaaaactctcattatactataga

SEQ ID NO: 813723 - DNA, 25 bp, Mus musculus
tggaaaactctctttatactataga

SEQ ID NO: 813724 - DNA, 25 bp, Mus musculus
tggaaaagaggtcagctctgagcct

SEQ ID NO: 813725 - DNA, 25 bp, Mus musculus
tggaaaagaggtgagctctgagcct

SEQ ID NO: 813726 - DNA, 25 bp, Mus musculus
tggaaaagagtgagtcaactttgcc

SEQ ID NO: 813727 - DNA, 25 bp, Mus musculus
tggaaaagagtgtgtcaactttgcc

SEQ ID NO: 813728 - DNA, 25 bp, Mus musculus
tggaaaagatctacgtccaccccag

SEQ ID NO: 813729 - DNA, 25 bp, Mus musculus
tggaaaagatcttcgtccaccccag

SEQ ID NO: 813730 - DNA, 25 bp, Mus musculus
tggaaaagatttagaatgcgcaaga

SEQ ID NO: 813731 - DNA, 25 bp, Mus musculus
tggaaaagattttgaatgcgcaaga

SEQ ID NO: 813732 - DNA, 25 bp, Mus musculus
tggaaaagcaccaatctgacttgag

SEQ ID NO: 813733 - DNA, 25 bp, Mus musculus
tggaaaagcacctatctgacttgag

SEQ ID NO: 813734 - DNA, 25 bp, Mus musculus
tggaaaagcaggagaacgtggcctc

SEQ ID NO: 813735 - DNA, 25 bp, Mus musculus
tggaaaagcaggtgaacgtggcctc

SEQ ID NO: 813736 - DNA, 25 bp, Mus musculus
tggaaaagcatcaggccgggctgca

SEQ ID NO: 813737 - DNA, 25 bp, Mus musculus
tggaaaagcatctggccgggctgca

SEQ ID NO: 813738 - DNA, 25 bp, Mus musculus
tggaaaagctgcagggcaacacccc

SEQ ID NO: 813739 - DNA, 25 bp, Mus musculus
tggaaaagctgctgggcaacacccc

SEQ ID NO: 813740 - DNA, 25 bp, Mus musculus
tggaaaaggaggcagcgttcctaac

SEQ ID NO: 813741 - DNA, 25 bp, Mus musculus
tggaaaaggagggagcgttcctaac

SEQ ID NO: 813742 - DNA, 25 bp, Mus musculus
tggaaaaggataactccattttacc

SEQ ID NO: 813743 - DNA, 25 bp, Mus musculus
tggaaaaggatatctccattttacc

SEQ ID NO: 813744 - DNA, 25 bp, Mus musculus
tggaaaaggccaaagaggacatgac

SEQ ID NO: 813745 - DNA, 25 bp, Mus musculus
tggaaaaggccatagaggacatgac

SEQ ID NO: 813746 - DNA, 25 bp, Mus musculus
tggaaaagggcgatactgttttctt

SEQ ID NO: 813747 - DNA, 25 bp, Mus musculus
tggaaaagggcgttactgttttctt

SEQ ID NO: 813748 - DNA, 25 bp, Mus musculus
tggaaaaggtaaacttgtcgtttct

SEQ ID NO: 813749 - DNA, 25 bp, Mus musculus
tggaaaaggtaatcttgtcgtttct

SEQ ID NO: 813750 - DNA, 25 bp, Mus musculus
tggaaaatacagcaacgacctctat

SEQ ID NO: 813751 - DNA, 25 bp, Mus musculus
tggaaaatacaggaacgacctctat

SEQ ID NO: 813752 - DNA, 25 bp, Mus musculus
tggaaaatatatatgcaaagccgtt

SEQ ID NO: 813753 - DNA, 25 bp, Mus musculus
tggaaaatatatttgcaaagccgtt

SEQ ID NO: 813754 - DNA, 25 bp, Mus musculus
tggaaaatccctcaggatggagact

SEQ ID NO: 813755 - DNA, 25 bp, Mus musculus
tggaaaatccctgaggatggagact

SEQ ID NO: 813756 - DNA, 25 bp, Mus musculus
tggaaaatcgagaacagcaacagtg

SEQ ID NO: 813757 - DNA, 25 bp, Mus musculus
tggaaaatcgagtacagcaacagtg

SEQ ID NO: 813758 - DNA, 25 bp, Mus musculus
tggaaaatggcaaacagatgaagtc

SEQ ID NO: 813759 - DNA, 25 bp, Mus musculus
tggaaaatggcatacagatgaagtc

SEQ ID NO: 813760 - DNA, 25 bp, Mus musculus
tggaaaatgggcaccctcctcagta

SEQ ID NO: 813761 - DNA, 25 bp, Mus musculus
tggaaaatgggctccctcctcagta

SEQ ID NO: 813762 - DNA, 25 bp, Mus musculus
tggaaaatttacaagctccttgccc

SEQ ID NO: 813763 - DNA, 25 bp, Mus musculus
tggaaaatttactagctccttgccc

SEQ ID NO: 813764 - DNA, 25 bp, Mus musculus
tggaaacaaggtcccaccagcgctg

SEQ ID NO: 813765 - DNA, 25 bp, Mus musculus
tggaaacaaggtgccaccagcgctg

SEQ ID NO: 813766 - DNA, 25 bp, Mus musculus
tggaaacacccacactcagcgtgat

SEQ ID NO: 813767 - DNA, 25 bp, Mus musculus
tggaaacacccagactcagcgtgat

SEQ ID NO: 813768 - DNA, 25 bp, Mus musculus
tggaaacacctcacagaagaactta

SEQ ID NO: 813769 - DNA, 25 bp, Mus musculus
tggaaacacctctcagaagaactta

SEQ ID NO: 813770 - DNA, 25 bp, Mus musculus
tggaaacactatcgagaagctcatc

SEQ ID NO: 813771 - DNA, 25 bp, Mus musculus
tggaaacactatggagaagctcatc

SEQ ID NO: 813772 - DNA, 25 bp, Mus musculus
tggaaacagaatcagctatcttgct

SEQ ID NO: 813773 - DNA, 25 bp, Mus musculus
tggaaacagaatgagctatcttgct

SEQ ID NO: 813774 - DNA, 25 bp, Mus musculus
tggaaacagccactagagagtacaa

SEQ ID NO: 813775 - DNA, 25 bp, Mus musculus
tggaaacagccagtagagagtacaa

SEQ ID NO: 813776 - DNA, 25 bp, Mus musculus
tggaaacatgacagacaaaagcagt

SEQ ID NO: 813777 - DNA, 25 bp, Mus musculus
tggaaacatgactgacaaaagcagt

SEQ ID NO: 813778 - DNA, 25 bp, Mus musculus
tggaaacatggcctcgcgcaaggaa

SEQ ID NO: 813779 - DNA, 25 bp, Mus musculus
tggaaacatggcgtcgcgcaaggaa

SEQ ID NO: 813780 - DNA, 25 bp, Mus musculus
tggaaaccaacacgtacaaccacat

SEQ ID NO: 813781 - DNA, 25 bp, Mus musculus
tggaaaccaacaggtacaaccacat

SEQ ID NO: 813782 - DNA, 25 bp, Mus musculus
tggaaaccaagcatggcagtaggct

SEQ ID NO: 813783 - DNA, 25 bp, Mus musculus
tggaaaccaagcttggcagtaggct

SEQ ID NO: 813784 - DNA, 25 bp, Mus musculus
tggaaaccaaggaggacctgtggct

SEQ ID NO: 813785 - DNA, 25 bp, Mus musculus
tggaaaccaaggtggacctgtggct

SEQ ID NO: 813786 - DNA, 25 bp, Mus musculus
tggaaaccacgtcaaattgacaacc

SEQ ID NO: 813787 - DNA, 25 bp, Mus musculus
tggaaaccacgtgaaattgacaacc

SEQ ID NO: 813788 - DNA, 25 bp, Mus musculus
tggaaaccacttcagcctgggctgc

SEQ ID NO: 813789 - DNA, 25 bp, Mus musculus
tggaaaccacttgagcctgggctgc

SEQ ID NO: 813790 - DNA, 25 bp, Mus musculus
tggaaaccatccatggcttcacagg

SEQ ID NO: 813791 - DNA, 25 bp, Mus musculus
tggaaaccatccttggcttcacagg

SEQ ID NO: 813792 - DNA, 25 bp, Mus musculus
tggaaacccaagcatctgacttagc

SEQ ID NO: 813793 - DNA, 25 bp, Mus musculus
tggaaacccaaggatctgacttagc

SEQ ID NO: 813794 - DNA, 25 bp, Mus musculus
tggaaacccagtcctgagacttctg

SEQ ID NO: 813795 - DNA, 25 bp, Mus musculus
tggaaacccagtgctgagacttctg

SEQ ID NO: 813796 - DNA, 25 bp, Mus musculus
tggaaaccccagattccattgatat

SEQ ID NO: 813797 - DNA, 25 bp, Mus musculus
tggaaaccccagtttccattgatat

SEQ ID NO: 813798 - DNA, 25 bp, Mus musculus
tggaaacccctcataagttgtggct

SEQ ID NO: 813799 - DNA, 25 bp, Mus musculus
tggaaacccctcttaagttgtggct

SEQ ID NO: 813800 - DNA, 25 bp, Mus musculus
tggaaacctccaaatactaaagaaa

SEQ ID NO: 813801 - DNA, 25 bp, Mus musculus
tggaaacctccatatactaaagaaa

SEQ ID NO: 813802 - DNA, 25 bp, Mus musculus
tggaaacctgcaaatcactggagtc

SEQ ID NO: 813803 - DNA, 25 bp, Mus musculus
tggaaacctgcatatcactggagtc

SEQ ID NO: 813804 - DNA, 25 bp, Mus musculus
tggaaaccttaaaccaaacaagtct

SEQ ID NO: 813805 - DNA, 25 bp, Mus musculus
tggaaaccttaatccaaacaagtct

SEQ ID NO: 813806 - DNA, 25 bp, Mus musculus
tggaaacgcagcaaagaagaatact

SEQ ID NO: 813807 - DNA, 25 bp, Mus musculus
tggaaacgcagctaagaagaatact

SEQ ID NO: 813808 - DNA, 25 bp, Mus musculus
tggaaacgcgagatttagcccagcc

SEQ ID NO: 813809 - DNA, 25 bp, Mus musculus
tggaaacgcgagttttagcccagcc

SEQ ID NO: 813810 - DNA, 25 bp, Mus musculus
tggaaactacagcattagaaatggc

SEQ ID NO: 813811 - DNA, 25 bp, Mus musculus
tggaaactacaggattagaaatggc

SEQ ID NO: 813812 - DNA, 25 bp, Mus musculus
tggaaactatcaacaatcacacgtg

SEQ ID NO: 813813 - DNA, 25 bp, Mus musculus
tggaaactatcatcaatcacacgtg

SEQ ID NO: 813814 - DNA, 25 bp, Mus musculus
tggaaactccctatctcagtagcct

SEQ ID NO: 813815 - DNA, 25 bp, Mus musculus
tggaaactccctttctcagtagcct

SEQ ID NO: 813816 - DNA, 25 bp, Mus musculus
tggaaactctgaagccgaccagttg

SEQ ID NO: 813817 - DNA, 25 bp, Mus musculus
tggaaactctgatgccgaccagttg

SEQ ID NO: 813818 - DNA, 25 bp, Mus musculus
tggaaactgagtcccagctagaaga

SEQ ID NO: 813819 - DNA, 25 bp, Mus musculus
tggaaactgagtgccagctagaaga

SEQ ID NO: 813820 - DNA, 25 bp, Mus musculus
tggaaacttcagacatctgatctga

SEQ ID NO: 813821 - DNA, 25 bp, Mus musculus
tggaaacttcagtcatctgatctga

SEQ ID NO: 813822 - DNA, 25 bp, Mus musculus
tggaaacttgatcgacctctacagc

SEQ ID NO: 813823 - DNA, 25 bp, Mus musculus
tggaaacttgatggacctctacagc

SEQ ID NO: 813824 - DNA, 25 bp, Mus musculus
tggaaactttgaagttggcaaggaa

SEQ ID NO: 813825 - DNA, 25 bp, Mus musculus
tggaaactttgatgttggcaaggaa

SEQ ID NO: 813826 - DNA, 25 bp, Mus musculus
tggaaagaaaatcctccaggcgccc

SEQ ID NO: 813827 - DNA, 25 bp, Mus musculus
tggaaagaaaatgctccaggcgccc

SEQ ID NO: 813828 - DNA, 25 bp, Mus musculus
tggaaagaaatacaagctagacata

SEQ ID NO: 813829 - DNA, 25 bp, Mus musculus
tggaaagaaatagaagctagacata

SEQ ID NO: 813830 - DNA, 25 bp, Mus musculus
tggaaagaacacctggtttagagcc

SEQ ID NO: 813831 - DNA, 25 bp, Mus musculus
tggaaagaacacgtggtttagagcc

SEQ ID NO: 813832 - DNA, 25 bp, Mus musculus
tggaaagaagaaaactatctctatg

SEQ ID NO: 813833 - DNA, 25 bp, Mus musculus
tggaaagaagaatactatctctatg

SEQ ID NO: 813834 - DNA, 25 bp, Mus musculus
tggaaagacaatctgcctgagtggc

SEQ ID NO: 813835 - DNA, 25 bp, Mus musculus
tggaaagacaatgtgcctgagtggc

SEQ ID NO: 813836 - DNA, 25 bp, Mus musculus
tggaaagacctgataaccgggatgg

SEQ ID NO: 813837 - DNA, 25 bp, Mus musculus
tggaaagacctgttaaccgggatgg

SEQ ID NO: 813838 - DNA, 25 bp, Mus musculus
tggaaagactccaagaaatttaagg

SEQ ID NO: 813839 - DNA, 25 bp, Mus musculus
tggaaagactccattgacggtggcc

SEQ ID NO: 813840 - DNA, 25 bp, Mus musculus
tggaaagactcctagaaatttaagg

SEQ ID NO: 813841 - DNA, 25 bp, Mus musculus
tggaaagactcctttgacggtggcc

SEQ ID NO: 813842 - DNA, 25 bp, Mus musculus
tggaaagagcgccaaacggaaaatg

SEQ ID NO: 813843 - DNA, 25 bp, Mus musculus
tggaaagagcgcgaaacggaaaatg

SEQ ID NO: 813844 - DNA, 25 bp, Mus musculus
tggaaagagtctcgatcagagagac

SEQ ID NO: 813845 - DNA, 25 bp, Mus musculus
tggaaagagtctggatcagagagac

SEQ ID NO: 813846 - DNA, 25 bp, Mus musculus
tggaaagatccgagtgaccgtgact

SEQ ID NO: 813847 - DNA, 25 bp, Mus musculus
tggaaagatccgtgtgaccgtgact

SEQ ID NO: 813848 - DNA, 25 bp, Mus musculus
tggaaagatgaaacccgatgaaact

SEQ ID NO: 813849 - DNA, 25 bp, Mus musculus
tggaaagatgaatcccgatgaaact

SEQ ID NO: 813850 - DNA, 25 bp, Mus musculus
tggaaagcacgacttcatcggcgag

SEQ ID NO: 813851 - DNA, 25 bp, Mus musculus
tggaaagcacgagttcatcggcgag

SEQ ID NO: 813852 - DNA, 25 bp, Mus musculus
tggaaagcactacctgacgagtatg

SEQ ID NO: 813853 - DNA, 25 bp, Mus musculus
tggaaagcactagctgacgagtatg

SEQ ID NO: 813854 - DNA, 25 bp, Mus musculus
tggaaagcactcagcgagtttgcac

SEQ ID NO: 813855 - DNA, 25 bp, Mus musculus
tggaaagcactctgcgagtttgcac

SEQ ID NO: 813856 - DNA, 25 bp, Mus musculus
tggaaagccaccaggatgcggacat

SEQ ID NO: 813857 - DNA, 25 bp, Mus musculus
tggaaagccacctggatgcggacat

SEQ ID NO: 813858 - DNA, 25 bp, Mus musculus
tggaaagccagtcgcacagattgac

SEQ ID NO: 813859 - DNA, 25 bp, Mus musculus
tggaaagccagtggcacagattgac

SEQ ID NO: 813860 - DNA, 25 bp, Mus musculus
tggaaagcccacaacgggaatgggt

SEQ ID NO: 813861 - DNA, 25 bp, Mus musculus
tggaaagcccactacgggaatgggt

SEQ ID NO: 813862 - DNA, 25 bp, Mus musculus
tggaaagccccacgacatcatcttc

SEQ ID NO: 813863 - DNA, 25 bp, Mus musculus
tggaaagccccacggacaagctatg

SEQ ID NO: 813864 - DNA, 25 bp, Mus musculus
tggaaagccccaggacatcatcttc

SEQ ID NO: 813865 - DNA, 25 bp, Mus musculus
tggaaagccccagggacaagctatg

SEQ ID NO: 813866 - DNA, 25 bp, Mus musculus
tggaaagccctaattaccgccgtcg

SEQ ID NO: 813867 - DNA, 25 bp, Mus musculus
tggaaagccctatttaccgccgtcg

SEQ ID NO: 813868 - DNA, 25 bp, Mus musculus
tggaaagcccttagacgccttcacg

SEQ ID NO: 813869 - DNA, 25 bp, Mus musculus
tggaaagccctttgacgccttcacg

SEQ ID NO: 813870 - DNA, 25 bp, Mus musculus
tggaaagccgacagaagctgagctt

SEQ ID NO: 813871 - DNA, 25 bp, Mus musculus
tggaaagccgactgaagctgagctt

SEQ ID NO: 813872 - DNA, 25 bp, Mus musculus
tggaaagccggcaggacctgatagc

SEQ ID NO: 813873 - DNA, 25 bp, Mus musculus
tggaaagccggctggacctgatagc

SEQ ID NO: 813874 - DNA, 25 bp, Mus musculus
tggaaagcgccgcacccagtctctg

SEQ ID NO: 813875 - DNA, 25 bp, Mus musculus
tggaaagcgccggacccagtctctg

SEQ ID NO: 813876 - DNA, 25 bp, Mus musculus
tggaaaggaccgcttacagtgacag

SEQ ID NO: 813877 - DNA, 25 bp, Mus musculus
tggaaaggaccggttacagtgacag

SEQ ID NO: 813878 - DNA, 25 bp, Mus musculus
tggaaaggatccagggtcctgtccc

SEQ ID NO: 813879 - DNA, 25 bp, Mus musculus
tggaaaggatcctgggtcctgtccc

SEQ ID NO: 813880 - DNA, 25 bp, Mus musculus
tggaaaggcagccacaacttgaatg

SEQ ID NO: 813881 - DNA, 25 bp, Mus musculus
tggaaaggcagcgacaacttgaatg

SEQ ID NO: 813882 - DNA, 25 bp, Mus musculus
tggaaaggccagaatggccggaccc

SEQ ID NO: 813883 - DNA, 25 bp, Mus musculus
tggaaaggccagtatggccggaccc

SEQ ID NO: 813884 - DNA, 25 bp, Mus musculus
tggaaaggccataatatttctgaag

SEQ ID NO: 813885 - DNA, 25 bp, Mus musculus
tggaaaggccattatatttctgaag

SEQ ID NO: 813886 - DNA, 25 bp, Mus musculus
tggaaaggctaacccaccaaggact

SEQ ID NO: 813887 - DNA, 25 bp, Mus musculus
tggaaaggctaagccaccaaggact

SEQ ID NO: 813888 - DNA, 25 bp, Mus musculus
tggaaaggctctctctgatgaggac

SEQ ID NO: 813889 - DNA, 25 bp, Mus musculus
tggaaaggctctgtctgatgaggac

SEQ ID NO: 813890 - DNA, 25 bp, Mus musculus
tggaaaggctgaaaagcttgctgtt

SEQ ID NO: 813891 - DNA, 25 bp, Mus musculus
tggaaaggctgataagcttgctgtt

SEQ ID NO: 813892 - DNA, 25 bp, Mus musculus
tggaaaggtcaaattacagcgcaag

SEQ ID NO: 813893 - DNA, 25 bp, Mus musculus
tggaaaggtcaatttacagcgcaag

SEQ ID NO: 813894 - DNA, 25 bp, Mus musculus
tggaaaggtcttccccactagccct

SEQ ID NO: 813895 - DNA, 25 bp, Mus musculus
tggaaaggtcttgcccactagccct

SEQ ID NO: 813896 - DNA, 25 bp, Mus musculus
tggaaagtcacaatgagaaggttaa

SEQ ID NO: 813897 - DNA, 25 bp, Mus musculus
tggaaagtcacattgagaaggttaa

SEQ ID NO: 813898 - DNA, 25 bp, Mus musculus
tggaaagtcataaaccaagtactag

SEQ ID NO: 813899 - DNA, 25 bp, Mus musculus
tggaaagtcatataccaagtactag

SEQ ID NO: 813900 - DNA, 25 bp, Mus musculus
tggaaagtccagcttctgacagctg

SEQ ID NO: 813901 - DNA, 25 bp, Mus musculus
tggaaagtccaggttctgacagctg

SEQ ID NO: 813902 - DNA, 25 bp, Mus musculus
tggaaagtgcatactcacaactggg

SEQ ID NO: 813903 - DNA, 25 bp, Mus musculus
tggaaagtgcattctcacaactggg

SEQ ID NO: 813904 - DNA, 25 bp, Mus musculus
tggaaagtttatccccatcatgcag

SEQ ID NO: 813905 - DNA, 25 bp, Mus musculus
tggaaagtttatgcccatcatgcag

SEQ ID NO: 813906 - DNA, 25 bp, Mus musculus
tggaaataactcatgtccttttgcc

SEQ ID NO: 813907 - DNA, 25 bp, Mus musculus
tggaaataactcttgtccttttgcc

SEQ ID NO: 813908 - DNA, 25 bp, Mus musculus
tggaaataagcacgacagtgccttt

SEQ ID NO: 813909 - DNA, 25 bp, Mus musculus
tggaaataagcaggacagtgccttt

SEQ ID NO: 813910 - DNA, 25 bp, Mus musculus
tggaaatacaaaagtagccataaag

SEQ ID NO: 813911 - DNA, 25 bp, Mus musculus
tggaaatacaaatgtagccataaag

SEQ ID NO: 813912 - DNA, 25 bp, Mus musculus
tggaaataggtgcaaatccagcagc

SEQ ID NO: 813913 - DNA, 25 bp, Mus musculus
tggaaataggtggaaatccagcagc

SEQ ID NO: 813914 - DNA, 25 bp, Mus musculus
tggaaatatcctacagatcaatgtg

SEQ ID NO: 813915 - DNA, 25 bp, Mus musculus
tggaaatatccttcagatcaatgtg

SEQ ID NO: 813916 - DNA, 25 bp, Mus musculus
tggaaatcagttcagatcaccacag

SEQ ID NO: 813917 - DNA, 25 bp, Mus musculus
tggaaatcagttgagatcaccacag

SEQ ID NO: 813918 - DNA, 25 bp, Mus musculus
tggaaatcataaactcactcttggt

SEQ ID NO: 813919 - DNA, 25 bp, Mus musculus
tggaaatcataatctcactcttggt

SEQ ID NO: 813920 - DNA, 25 bp, Mus musculus
tggaaatcattcctatctggagtct

SEQ ID NO: 813921 - DNA, 25 bp, Mus musculus
tggaaatcattcgtatctggagtct

SEQ ID NO: 813922 - DNA, 25 bp, Mus musculus
tggaaatccgacagctggcaaagca

SEQ ID NO: 813923 - DNA, 25 bp, Mus musculus
tggaaatccgactgctggcaaagca

SEQ ID NO: 813924 - DNA, 25 bp, Mus musculus
tggaaatcctgccacggactcctct

SEQ ID NO: 813925 - DNA, 25 bp, Mus musculus
tggaaatcctgcgacggactcctct

SEQ ID NO: 813926 - DNA, 25 bp, Mus musculus
tggaaatctaatcgatgtcacagag

SEQ ID NO: 813927 - DNA, 25 bp, Mus musculus
tggaaatctaatggatgtcacagag

SEQ ID NO: 813928 - DNA, 25 bp, Mus musculus
tggaaatctacgaccgacgggagta

SEQ ID NO: 813929 - DNA, 25 bp, Mus musculus
tggaaatctacgtccgacgggagta

SEQ ID NO: 813930 - DNA, 25 bp, Mus musculus
tggaaatctactcgaagacgacccg

SEQ ID NO: 813931 - DNA, 25 bp, Mus musculus
tggaaatctactggaagacgacccg

SEQ ID NO: 813932 - DNA, 25 bp, Mus musculus
tggaaatctcctacccagacggtcc

SEQ ID NO: 813933 - DNA, 25 bp, Mus musculus
tggaaatctccttcccagacggtcc

SEQ ID NO: 813934 - DNA, 25 bp, Mus musculus
tggaaatgaacacagtctggcttca

SEQ ID NO: 813935 - DNA, 25 bp, Mus musculus
tggaaatgaacagagtctggcttca

SEQ ID NO: 813936 - DNA, 25 bp, Mus musculus
tggaaatgacaccttcagcagagag

SEQ ID NO: 813937 - DNA, 25 bp, Mus musculus
tggaaatgacacgttcagcagagag

SEQ ID NO: 813938 - DNA, 25 bp, Mus musculus
tggaaatgattgatcgagcaagaca

SEQ ID NO: 813939 - DNA, 25 bp, Mus musculus
tggaaatgattgttcgagcaagaca

SEQ ID NO: 813940 - DNA, 25 bp, Mus musculus
tggaaatgcaaaaatgcccgaggcc

SEQ ID NO: 813941 - DNA, 25 bp, Mus musculus
tggaaatgcaaatatgcccgaggcc

SEQ ID NO: 813942 - DNA, 25 bp, Mus musculus
tggaaatgcagcctagagcaccata

SEQ ID NO: 813943 - DNA, 25 bp, Mus musculus
tggaaatgcagcgtagagcaccata

SEQ ID NO: 813944 - DNA, 25 bp, Mus musculus
tggaaatgcctaagtcagaagggtc

SEQ ID NO: 813945 - DNA, 25 bp, Mus musculus
tggaaatgcctatgtcagaagggtc

SEQ ID NO: 813946 - DNA, 25 bp, Mus musculus
tggaaatggaacctttaacagggca

SEQ ID NO: 813947 - DNA, 25 bp, Mus musculus
tggaaatggaacgtttaacagggca

SEQ ID NO: 813948 - DNA, 25 bp, Mus musculus
tggaaatggatcaaaaattgtatct

SEQ ID NO: 813949 - DNA, 25 bp, Mus musculus
tggaaatggatctaaaattgtatct

SEQ ID NO: 813950 - DNA, 25 bp, Mus musculus
tggaaatggcacctatggacaagtc

SEQ ID NO: 813951 - DNA, 25 bp, Mus musculus
tggaaatggcacgtatggacaagtc

SEQ ID NO: 813952 - DNA, 25 bp, Mus musculus
tggaaatggtgaataaaaccggacg

SEQ ID NO: 813953 - DNA, 25 bp, Mus musculus
tggaaatggtgattaaaaccggacg

SEQ ID NO: 813954 - DNA, 25 bp, Mus musculus
tggaaatgtgctatgcaaggcctgt

SEQ ID NO: 813955 - DNA, 25 bp, Mus musculus
tggaaatgtgctttgcaaggcctgt

SEQ ID NO: 813956 - DNA, 25 bp, Mus musculus
tggaaattccgacgacaagaccttg

SEQ ID NO: 813957 - DNA, 25 bp, Mus musculus
tggaaattccgaggacaagaccttg

SEQ ID NO: 813958 - DNA, 25 bp, Mus musculus
tggaaattcgagacttcccagataa

SEQ ID NO: 813959 - DNA, 25 bp, Mus musculus
tggaaattcgagtcttcccagataa

SEQ ID NO: 813960 - DNA, 25 bp, Mus musculus
tggaaattgcccagacttctaccct

SEQ ID NO: 813961 - DNA, 25 bp, Mus musculus
tggaaattgccctgacttctaccct

SEQ ID NO: 813962 - DNA, 25 bp, Mus musculus
tggaaattgttcctgatcccaggaa

SEQ ID NO: 813963 - DNA, 25 bp, Mus musculus
tggaaattgttcgtgatcccaggaa

SEQ ID NO: 813964 - DNA, 25 bp, Mus musculus
tggaaattttcacgagactcacaaa

SEQ ID NO: 813965 - DNA, 25 bp, Mus musculus
tggaaattttcaggagactcacaaa

SEQ ID NO: 813966 - DNA, 25 bp, Mus musculus
tggaaattttgaccgtctgagcagg

SEQ ID NO: 813967 - DNA, 25 bp, Mus musculus
tggaaattttgagcgtctgagcagg

SEQ ID NO: 813968 - DNA, 25 bp, Mus musculus
tggaacaaggatcgcaggccgactc

SEQ ID NO: 813969 - DNA, 25 bp, Mus musculus
tggaacaaggatggcaggccgactc

SEQ ID NO: 813970 - DNA, 25 bp, Mus musculus
tggaacaaggtcagctggaacccag

SEQ ID NO: 813971 - DNA, 25 bp, Mus musculus
tggaacaaggtctgctggaacccag

SEQ ID NO: 813972 - DNA, 25 bp, Mus musculus
tggaacaagttcatcacagagcaaa

SEQ ID NO: 813973 - DNA, 25 bp, Mus musculus
tggaacaagttcttcacagagcaaa

SEQ ID NO: 813974 - DNA, 25 bp, Mus musculus
tggaacaatacaacaagctaaagga

SEQ ID NO: 813975 - DNA, 25 bp, Mus musculus
tggaacaatacatcaagctaaagga

SEQ ID NO: 813976 - DNA, 25 bp, Mus musculus
tggaacaattaccattcagctggag

SEQ ID NO: 813977 - DNA, 25 bp, Mus musculus
tggaacaattacgattcagctggag

SEQ ID NO: 813978 - DNA, 25 bp, Mus musculus
tggaacacagatctgccgacttcgg

SEQ ID NO: 813979 - DNA, 25 bp, Mus musculus
tggaacacagatgtgccgacttcgg

SEQ ID NO: 813980 - DNA, 25 bp, Mus musculus
tggaacaccatgaacagatggagga

SEQ ID NO: 813981 - DNA, 25 bp, Mus musculus
tggaacaccatgtacagatggagga

SEQ ID NO: 813982 - DNA, 25 bp, Mus musculus
tggaacactggcaccagctagtgga

SEQ ID NO: 813983 - DNA, 25 bp, Mus musculus
tggaacactggctccagctagtgga

SEQ ID NO: 813984 - DNA, 25 bp, Mus musculus
tggaacagaaacagccccgagcccg

SEQ ID NO: 813985 - DNA, 25 bp, Mus musculus
tggaacagaaactgccccgagcccg

SEQ ID NO: 813986 - DNA, 25 bp, Mus musculus
tggaacagaccacctcatccttgga

SEQ ID NO: 813987 - DNA, 25 bp, Mus musculus
tggaacagaccagctcatccttgga

SEQ ID NO: 813988 - DNA, 25 bp, Mus musculus
tggaacagagtccaggagatgccaa

SEQ ID NO: 813989 - DNA, 25 bp, Mus musculus
tggaacagagtcgaggagatgccaa

SEQ ID NO: 813990 - DNA, 25 bp, Mus musculus
tggaacagcccacgctacaaggcct

SEQ ID NO: 813991 - DNA, 25 bp, Mus musculus
tggaacagcccaggctacaaggcct

SEQ ID NO: 813992 - DNA, 25 bp, Mus musculus
tggaacagcttaccagccaagaccc

SEQ ID NO: 813993 - DNA, 25 bp, Mus musculus
tggaacagcttagcagccaagaccc

SEQ ID NO: 813994 - DNA, 25 bp, Mus musculus
tggaacagcttgatgtgggcacttc

SEQ ID NO: 813995 - DNA, 25 bp, Mus musculus
tggaacagcttgttgtgggcacttc

SEQ ID NO: 813996 - DNA, 25 bp, Mus musculus
tggaacaggctaaccctgtgcggca

SEQ ID NO: 813997 - DNA, 25 bp, Mus musculus
tggaacaggctatccctgtgcggca

SEQ ID NO: 813998 - DNA, 25 bp, Mus musculus
tggaacagggaacactctgcttgcc

SEQ ID NO: 813999 - DNA, 25 bp, Mus musculus
tggaacagggaagactctgcttgcc

SEQ ID NO: 814000 - DNA, 25 bp, Mus musculus
tggaacataccaaaccctagaaatg

SEQ ID NO: 814001 - DNA, 25 bp, Mus musculus
tggaacataccataccctagaaatg

SEQ ID NO: 814002 - DNA, 25 bp, Mus musculus
tggaacatatacagctccgcccaga

SEQ ID NO: 814003 - DNA, 25 bp, Mus musculus
tggaacatatactgctccgcccaga

SEQ ID NO: 814004 - DNA, 25 bp, Mus musculus
tggaacatcactcagattgaggtgc

SEQ ID NO: 814005 - DNA, 25 bp, Mus musculus
tggaacatcactgagattgaggtgc

SEQ ID NO: 814006 - DNA, 25 bp, Mus musculus
tggaacatcctcaatacactactaa

SEQ ID NO: 814007 - DNA, 25 bp, Mus musculus
tggaacatcctctatacactactaa

SEQ ID NO: 814008 - DNA, 25 bp, Mus musculus
tggaacatccttcgcagtgtggctg

SEQ ID NO: 814009 - DNA, 25 bp, Mus musculus
tggaacatccttggcagtgtggctg

SEQ ID NO: 814010 - DNA, 25 bp, Mus musculus
tggaacatcgctcacgggacaagca

SEQ ID NO: 814011 - DNA, 25 bp, Mus musculus
tggaacatcgctgacgggacaagca

SEQ ID NO: 814012 - DNA, 25 bp, Mus musculus
tggaacattgcaaccaacaagctga

SEQ ID NO: 814013 - DNA, 25 bp, Mus musculus
tggaacattgcatccaacaagctga

SEQ ID NO: 814014 - DNA, 25 bp, Mus musculus
tggaacattttcagcaaaggaacgc

SEQ ID NO: 814015 - DNA, 25 bp, Mus musculus
tggaacattttctgcaaaggaacgc

SEQ ID NO: 814016 - DNA, 25 bp, Mus musculus
tggaaccaaattacaacttgaaact

SEQ ID NO: 814017 - DNA, 25 bp, Mus musculus
tggaaccaaatttcaacttgaaact

SEQ ID NO: 814018 - DNA, 25 bp, Mus musculus
tggaaccaacccaaggccaactgtt

SEQ ID NO: 814019 - DNA, 25 bp, Mus musculus
tggaaccaaccctaggccaactgtt

SEQ ID NO: 814020 - DNA, 25 bp, Mus musculus
tggaaccaattcattgtgatagaag

SEQ ID NO: 814021 - DNA, 25 bp, Mus musculus
tggaaccaattctttgtgatagaag

SEQ ID NO: 814022 - DNA, 25 bp, Mus musculus
tggaaccacaaaagaggcgtagagg

SEQ ID NO: 814023 - DNA, 25 bp, Mus musculus
tggaaccacaaatgaggcgtagagg

SEQ ID NO: 814024 - DNA, 25 bp, Mus musculus
tggaaccacaatactcatcatcgcc

SEQ ID NO: 814025 - DNA, 25 bp, Mus musculus
tggaaccacaattctcatcatcgcc

SEQ ID NO: 814026 - DNA, 25 bp, Mus musculus
tggaaccacagaacaccccttctta

SEQ ID NO: 814027 - DNA, 25 bp, Mus musculus
tggaaccacagatcaccccttctta

SEQ ID NO: 814028 - DNA, 25 bp, Mus musculus
tggaaccaccccagaagacattctc

SEQ ID NO: 814029 - DNA, 25 bp, Mus musculus
tggaaccacccctgaagacattctc

SEQ ID NO: 814030 - DNA, 25 bp, Mus musculus
tggaaccaccgccttccctgatttc

SEQ ID NO: 814031 - DNA, 25 bp, Mus musculus
tggaaccaccgcgttccctgatttc

SEQ ID NO: 814032 - DNA, 25 bp, Mus musculus
tggaaccactggctatgaggaagct

SEQ ID NO: 814033 - DNA, 25 bp, Mus musculus
tggaaccactgggtatgaggaagct

SEQ ID NO: 814034 - DNA, 25 bp, Mus musculus
tggaaccagattacagagattttca

SEQ ID NO: 814035 - DNA, 25 bp, Mus musculus
tggaaccagatttcagagattttca

SEQ ID NO: 814036 - DNA, 25 bp, Mus musculus
tggaaccagggtctccacaatcgcc

SEQ ID NO: 814037 - DNA, 25 bp, Mus musculus
tggaaccagggtgtccacaatcgcc

SEQ ID NO: 814038 - DNA, 25 bp, Mus musculus
tggaaccatctgaccccttccagaa

SEQ ID NO: 814039 - DNA, 25 bp, Mus musculus
tggaaccatctgtccccttccagaa

SEQ ID NO: 814040 - DNA, 25 bp, Mus musculus
tggaaccatgaaccaagtaaagggt

SEQ ID NO: 814041 - DNA, 25 bp, Mus musculus
tggaaccatgaagcaagtaaagggt

SEQ ID NO: 814042 - DNA, 25 bp, Mus musculus
tggaacccaacgaaaatggagcgct

SEQ ID NO: 814043 - DNA, 25 bp, Mus musculus
tggaacccaacgtaaatggagcgct

SEQ ID NO: 814044 - DNA, 25 bp, Mus musculus
tggaacccaatgaaaccttgatttt

SEQ ID NO: 814045 - DNA, 25 bp, Mus musculus
tggaacccaatgtaaccttgatttt

SEQ ID NO: 814046 - DNA, 25 bp, Mus musculus
tggaacccacacatgaggaggacct

SEQ ID NO: 814047 - DNA, 25 bp, Mus musculus
tggaacccacacttgaggaggacct

SEQ ID NO: 814048 - DNA, 25 bp, Mus musculus
tggaacccagacacaagcgtagcaa

SEQ ID NO: 814049 - DNA, 25 bp, Mus musculus
tggaacccagactcaagcgtagcaa

SEQ ID NO: 814050 - DNA, 25 bp, Mus musculus
tggaacccatgtctccgcagcagca

SEQ ID NO: 814051 - DNA, 25 bp, Mus musculus
tggaacccatgtgtccgcagcagca

SEQ ID NO: 814052 - DNA, 25 bp, Mus musculus
tggaacccgagcaggaactcgcggc

SEQ ID NO: 814053 - DNA, 25 bp, Mus musculus
tggaacccgagctggaactcgcggc

SEQ ID NO: 814054 - DNA, 25 bp, Mus musculus
tggaaccgaggcatcgacatcttgg

SEQ ID NO: 814055 - DNA, 25 bp, Mus musculus
tggaaccgaggcttcgacatcttgg

SEQ ID NO: 814056 - DNA, 25 bp, Mus musculus
tggaaccgcactacgtcgccgcggg

SEQ ID NO: 814057 - DNA, 25 bp, Mus musculus
tggaaccgcacttcgtcgccgcggg

SEQ ID NO: 814058 - DNA, 25 bp, Mus musculus
tggaaccggaagagaaggcagcttc

SEQ ID NO: 814059 - DNA, 25 bp, Mus musculus
tggaaccggaagtgaaggcagcttc

SEQ ID NO: 814060 - DNA, 25 bp, Mus musculus
tggaaccggaggaaagagccatcct

SEQ ID NO: 814061 - DNA, 25 bp, Mus musculus
tggaaccggaggtaagagccatcct

SEQ ID NO: 814062 - DNA, 25 bp, Mus musculus
tggaaccggcaccaccatcgtggtt

SEQ ID NO: 814063 - DNA, 25 bp, Mus musculus
tggaaccggcacgaccatcgtggtt

SEQ ID NO: 814064 - DNA, 25 bp, Mus musculus
tggaaccgtcttcgggcaaccttgg

SEQ ID NO: 814065 - DNA, 25 bp, Mus musculus
tggaaccgtcttggggcaaccttgg

SEQ ID NO: 814066 - DNA, 25 bp, Mus musculus
tggaacctaagacccagtgcgtgct

SEQ ID NO: 814067 - DNA, 25 bp, Mus musculus
tggaacctaagagccagtgcgtgct

SEQ ID NO: 814068 - DNA, 25 bp, Mus musculus
tggaacctcccaactatggcatcgt

SEQ ID NO: 814069 - DNA, 25 bp, Mus musculus
tggaacctcccatctatggcatcgt

SEQ ID NO: 814070 - DNA, 25 bp, Mus musculus
tggaacctctggaatggcccctcat

SEQ ID NO: 814071 - DNA, 25 bp, Mus musculus
tggaacctctggtatggcccctcat

SEQ ID NO: 814072 - DNA, 25 bp, Mus musculus
tggaacctctttctaaaagggacag

SEQ ID NO: 814073 - DNA, 25 bp, Mus musculus
tggaacctctttgtaaaagggacag

SEQ ID NO: 814074 - DNA, 25 bp, Mus musculus
tggaacctggtaaccagaggtgccc

SEQ ID NO: 814075 - DNA, 25 bp, Mus musculus
tggaacctggtatccagaggtgccc

SEQ ID NO: 814076 - DNA, 25 bp, Mus musculus
tggaaccttgccctgaatcctgaag

SEQ ID NO: 814077 - DNA, 25 bp, Mus musculus
tggaaccttgccgtgaatcctgaag

SEQ ID NO: 814078 - DNA, 25 bp, Mus musculus
tggaaccttgtgagctctcatcggg

SEQ ID NO: 814079 - DNA, 25 bp, Mus musculus
tggaaccttgtgtgctctcatcggg

SEQ ID NO: 814080 - DNA, 25 bp, Mus musculus
tggaacctttgcagcaggaggctac

SEQ ID NO: 814081 - DNA, 25 bp, Mus musculus
tggaacctttgctgcaggaggctac

SEQ ID NO: 814082 - DNA, 25 bp, Mus musculus
tggaacgcaagtacagcccctggat

SEQ ID NO: 814083 - DNA, 25 bp, Mus musculus
tggaacgcaagttcagcccctggat

SEQ ID NO: 814084 - DNA, 25 bp, Mus musculus
tggaacgcacggaggtgcttcgctc

SEQ ID NO: 814085 - DNA, 25 bp, Mus musculus
tggaacgcacggtggtgcttcgctc

SEQ ID NO: 814086 - DNA, 25 bp, Mus musculus
tggaacgccttcaaagaatattaaa

SEQ ID NO: 814087 - DNA, 25 bp, Mus musculus
tggaacgccttctaagaatattaaa

SEQ ID NO: 814088 - DNA, 25 bp, Mus musculus
tggaacggcgttcattttcgcgaca

SEQ ID NO: 814089 - DNA, 25 bp, Mus musculus
tggaacggcgttgattttcgcgaca

SEQ ID NO: 814090 - DNA, 25 bp, Mus musculus
tggaacggcttgaccacctggcaga

SEQ ID NO: 814091 - DNA, 25 bp, Mus musculus
tggaacggcttgtccacctggcaga

SEQ ID NO: 814092 - DNA, 25 bp, Mus musculus
tggaacgggaggacaaacccatttg

SEQ ID NO: 814093 - DNA, 25 bp, Mus musculus
tggaacgggaggtcaaacccatttg

SEQ ID NO: 814094 - DNA, 25 bp, Mus musculus
tggaacggtccaagcgatccgtagg

SEQ ID NO: 814095 - DNA, 25 bp, Mus musculus
tggaacggtccatgcgatccgtagg

SEQ ID NO: 814096 - DNA, 25 bp, Mus musculus
tggaacgtctgcagattgatgagca

SEQ ID NO: 814097 - DNA, 25 bp, Mus musculus
tggaacgtctgctgattgatgagca

SEQ ID NO: 814098 - DNA, 25 bp, Mus musculus
tggaacgttcaacacattactgctg

SEQ ID NO: 814099 - DNA, 25 bp, Mus musculus
tggaacgttcaagacattactgctg

SEQ ID NO: 814100 - DNA, 25 bp, Mus musculus
tggaactaaactactctacctttgg

SEQ ID NO: 814101 - DNA, 25 bp, Mus musculus
tggaactaaacttctctacctttgg

SEQ ID NO: 814102 - DNA, 25 bp, Mus musculus
tggaactacatcaggacagccacac

SEQ ID NO: 814103 - DNA, 25 bp, Mus musculus
tggaactacatctggacagccacac

SEQ ID NO: 814104 - DNA, 25 bp, Mus musculus
tggaactaccagaacaacactgaag

SEQ ID NO: 814105 - DNA, 25 bp, Mus musculus
tggaactaccagtacaacactgaag

SEQ ID NO: 814106 - DNA, 25 bp, Mus musculus
tggaactactctcccgtggttaaat

SEQ ID NO: 814107 - DNA, 25 bp, Mus musculus
tggaactactctgccgtggttaaat

SEQ ID NO: 814108 - DNA, 25 bp, Mus musculus
tggaactagaaccaaaggagcagaa

SEQ ID NO: 814109 - DNA, 25 bp, Mus musculus
tggaactagaacgaaaggagcagaa

SEQ ID NO: 814110 - DNA, 25 bp, Mus musculus
tggaactcacaccacatcttccagt

SEQ ID NO: 814111 - DNA, 25 bp, Mus musculus
tggaactcacacgacatcttccagt

SEQ ID NO: 814112 - DNA, 25 bp, Mus musculus
tggaactcctacctatcctggaagg

SEQ ID NO: 814113 - DNA, 25 bp, Mus musculus
tggaactcctacgtatcctggaagg

SEQ ID NO: 814114 - DNA, 25 bp, Mus musculus
tggaactctgtaccctcctggttcg

SEQ ID NO: 814115 - DNA, 25 bp, Mus musculus
tggaactctgtagcctcctggttcg

SEQ ID NO: 814116 - DNA, 25 bp, Mus musculus
tggaactgatggacgccaacctgtg

SEQ ID NO: 814117 - DNA, 25 bp, Mus musculus
tggaactgatggtcgccaacctgtg

SEQ ID NO: 814118 - DNA, 25 bp, Mus musculus
tggaactgccccctgatgtgacccg

SEQ ID NO: 814119 - DNA, 25 bp, Mus musculus
tggaactgccccgtgatgtgacccg

SEQ ID NO: 814120 - DNA, 25 bp, Mus musculus
tggaactgctctaatctcgcttttc

SEQ ID NO: 814121 - DNA, 25 bp, Mus musculus
tggaactgctcttatctcgcttttc

SEQ ID NO: 814122 - DNA, 25 bp, Mus musculus
tggaactggaaaatctgagctgcca

SEQ ID NO: 814123 - DNA, 25 bp, Mus musculus
tggaactggaaattctgagctgcca

SEQ ID NO: 814124 - DNA, 25 bp, Mus musculus
tggaactggcaaccatctctggtac

SEQ ID NO: 814125 - DNA, 25 bp, Mus musculus
tggaactggcaagcatctctggtac

SEQ ID NO: 814126 - DNA, 25 bp, Mus musculus
tggaactgggcgagcccattggaca

SEQ ID NO: 814127 - DNA, 25 bp, Mus musculus
tggaactgggcgtgcccattggaca

SEQ ID NO: 814128 - DNA, 25 bp, Mus musculus
tggaactgtcttatacacaggagac

SEQ ID NO: 814129 - DNA, 25 bp, Mus musculus
tggaactgtcttttacacaggagac

SEQ ID NO: 814130 - DNA, 25 bp, Mus musculus
tggaactgtgataccccagcgcagt

SEQ ID NO: 814131 - DNA, 25 bp, Mus musculus
tggaactgtgattccccagcgcagt

SEQ ID NO: 814132 - DNA, 25 bp, Mus musculus
tggaactgttgaaggtaaaaggtca

SEQ ID NO: 814133 - DNA, 25 bp, Mus musculus
tggaactgttgatggtaaaaggtca

SEQ ID NO: 814134 - DNA, 25 bp, Mus musculus
tggaacttagctctgcaatctgaga

SEQ ID NO: 814135 - DNA, 25 bp, Mus musculus
tggaacttagctgtgcaatctgaga

SEQ ID NO: 814136 - DNA, 25 bp, Mus musculus
tggaacttcccaagagcaccaggtg

SEQ ID NO: 814137 - DNA, 25 bp, Mus musculus
tggaacttcccatgagcaccaggtg

SEQ ID NO: 814138 - DNA, 25 bp, Mus musculus
tggaacttctttctcactgctaagg

SEQ ID NO: 814139 - DNA, 25 bp, Mus musculus
tggaacttctttgtcactgctaagg

SEQ ID NO: 814140 - DNA, 25 bp, Mus musculus
tggaacttggaactctgggacaaat

SEQ ID NO: 814141 - DNA, 25 bp, Mus musculus
tggaacttggaagtctgggacaaat

SEQ ID NO: 814142 - DNA, 25 bp, Mus musculus
tggaactttaccaccaggccttgga

SEQ ID NO: 814143 - DNA, 25 bp, Mus musculus
tggaactttacctccaggccttgga

SEQ ID NO: 814144 - DNA, 25 bp, Mus musculus
tggaactttcccatggatggctcca

SEQ ID NO: 814145 - DNA, 25 bp, Mus musculus
tggaactttcccttggatggctcca

SEQ ID NO: 814146 - DNA, 25 bp, Mus musculus
tggaactttgcaaccgggaagaacg

SEQ ID NO: 814147 - DNA, 25 bp, Mus musculus
tggaactttgcatccgggaagaacg

SEQ ID NO: 814148 - DNA, 25 bp, Mus musculus
tggaagaaaacacaggccccatcct

SEQ ID NO: 814149 - DNA, 25 bp, Mus musculus
tggaagaaaacagaggccccatcct

SEQ ID NO: 814150 - DNA, 25 bp, Mus musculus
tggaagaaagttccgtaatccaaag

SEQ ID NO: 814151 - DNA, 25 bp, Mus musculus
tggaagaaagttgcgtaatccaaag

SEQ ID NO: 814152 - DNA, 25 bp, Mus musculus
tggaagaaccttaaatcagagaagt

SEQ ID NO: 814153 - DNA, 25 bp, Mus musculus
tggaagaacctttaatcagagaagt

SEQ ID NO: 814154 - DNA, 25 bp, Mus musculus
tggaagaactcaatactgctgccca

SEQ ID NO: 814155 - DNA, 25 bp, Mus musculus
tggaagaactcattactgctgccca

SEQ ID NO: 814156 - DNA, 25 bp, Mus musculus
tggaagaagaatccattgcctggct

SEQ ID NO: 814157 - DNA, 25 bp, Mus musculus
tggaagaagaatgcattgcctggct

SEQ ID NO: 814158 - DNA, 25 bp, Mus musculus
tggaagaagacaaccgtcctgaaat

SEQ ID NO: 814159 - DNA, 25 bp, Mus musculus
tggaagaagacatccgtcctgaaat

SEQ ID NO: 814160 - DNA, 25 bp, Mus musculus
tggaagaagccacactttaccactg

SEQ ID NO: 814161 - DNA, 25 bp, Mus musculus
tggaagaagccagactttaccactg

SEQ ID NO: 814162 - DNA, 25 bp, Mus musculus
tggaagaatcgtacacatttcaacg

SEQ ID NO: 814163 - DNA, 25 bp, Mus musculus
tggaagaatcgttcacatttcaacg

SEQ ID NO: 814164 - DNA, 25 bp, Mus musculus
tggaagacactcagcacaaactgcg

SEQ ID NO: 814165 - DNA, 25 bp, Mus musculus
tggaagacactctgcacaaactgcg

SEQ ID NO: 814166 - DNA, 25 bp, Mus musculus
tggaagacagcgaccttcagccagt

SEQ ID NO: 814167 - DNA, 25 bp, Mus musculus
tggaagacagcgtccttcagccagt

SEQ ID NO: 814168 - DNA, 25 bp, Mus musculus
tggaagacatgtctttgagtcagcc

SEQ ID NO: 814169 - DNA, 25 bp, Mus musculus
tggaagacatgtgtttgagtcagcc

SEQ ID NO: 814170 - DNA, 25 bp, Mus musculus
tggaagaccaggaagaaacactgcg

SEQ ID NO: 814171 - DNA, 25 bp, Mus musculus
tggaagaccaggtagaaacactgcg

SEQ ID NO: 814172 - DNA, 25 bp, Mus musculus
tggaagacccatcagtggcactgct

SEQ ID NO: 814173 - DNA, 25 bp, Mus musculus
tggaagacccatgagtggcactgct

SEQ ID NO: 814174 - DNA, 25 bp, Mus musculus
tggaagaccccaaggagactgaaac

SEQ ID NO: 814175 - DNA, 25 bp, Mus musculus
tggaagaccccatggagactgaaac

SEQ ID NO: 814176 - DNA, 25 bp, Mus musculus
tggaagacctgaacctcaaaggccc

SEQ ID NO: 814177 - DNA, 25 bp, Mus musculus
tggaagacctgatcctcaaaggccc

SEQ ID NO: 814178 - DNA, 25 bp, Mus musculus
tggaagacctggcacaggaccacat

SEQ ID NO: 814179 - DNA, 25 bp, Mus musculus
tggaagacctgggacaggaccacat

SEQ ID NO: 814180 - DNA, 25 bp, Mus musculus
tggaagacgacgcacagccccggac

SEQ ID NO: 814181 - DNA, 25 bp, Mus musculus
tggaagacgacggacagccccggac

SEQ ID NO: 814182 - DNA, 25 bp, Mus musculus
tggaagacgaggatacgctgtgctc

SEQ ID NO: 814183 - DNA, 25 bp, Mus musculus
tggaagacgaggttacgctgtgctc

SEQ ID NO: 814184 - DNA, 25 bp, Mus musculus
tggaagacgccaagatacactgatg

SEQ ID NO: 814185 - DNA, 25 bp, Mus musculus
tggaagacgccatgatacactgatg

SEQ ID NO: 814186 - DNA, 25 bp, Mus musculus
tggaagactcctaggcgcttggtgc

SEQ ID NO: 814187 - DNA, 25 bp, Mus musculus
tggaagactccttggcgcttggtgc

SEQ ID NO: 814188 - DNA, 25 bp, Mus musculus
tggaagactgaacatataaatgagc

SEQ ID NO: 814189 - DNA, 25 bp, Mus musculus
tggaagactgaagatataaatgagc

SEQ ID NO: 814190 - DNA, 25 bp, Mus musculus
tggaagacttgacaaaaatggaaac

SEQ ID NO: 814191 - DNA, 25 bp, Mus musculus
tggaagacttgagaaaaatggaaac

SEQ ID NO: 814192 - DNA, 25 bp, Mus musculus
tggaagagaagcaagacctggtcac

SEQ ID NO: 814193 - DNA, 25 bp, Mus musculus
tggaagagaagcatcggctacgacg

SEQ ID NO: 814194 - DNA, 25 bp, Mus musculus
tggaagagaagctagacctggtcac

SEQ ID NO: 814195 - DNA, 25 bp, Mus musculus
tggaagagaagcttcggctacgacg

SEQ ID NO: 814196 - DNA, 25 bp, Mus musculus
tggaagagaagtacagcctgcaaag

SEQ ID NO: 814197 - DNA, 25 bp, Mus musculus
tggaagagaagttcagcctgcaaag

SEQ ID NO: 814198 - DNA, 25 bp, Mus musculus
tggaagagactgaaggcaaagacac

SEQ ID NO: 814199 - DNA, 25 bp, Mus musculus
tggaagagactgtaggcaaagacac

SEQ ID NO: 814200 - DNA, 25 bp, Mus musculus
tggaagagatagaccacgcagagcg

SEQ ID NO: 814201 - DNA, 25 bp, Mus musculus
tggaagagatagtccacgcagagcg

SEQ ID NO: 814202 - DNA, 25 bp, Mus musculus
tggaagagccatcagtttgagatct

SEQ ID NO: 814203 - DNA, 25 bp, Mus musculus
tggaagagccatgagtttgagatct

SEQ ID NO: 814204 - DNA, 25 bp, Mus musculus
tggaagagctcacttgactcttgtc

SEQ ID NO: 814205 - DNA, 25 bp, Mus musculus
tggaagagctcagttgactcttgtc

SEQ ID NO: 814206 - DNA, 25 bp, Mus musculus
tggaagagctttaaacccagacaca

SEQ ID NO: 814207 - DNA, 25 bp, Mus musculus
tggaagagcttttaacccagacaca

SEQ ID NO: 814208 - DNA, 25 bp, Mus musculus
tggaagaggataccacctgctataa

SEQ ID NO: 814209 - DNA, 25 bp, Mus musculus
tggaagaggatagcacctgctataa

SEQ ID NO: 814210 - DNA, 25 bp, Mus musculus
tggaagaggatgcacaactgaagtc

SEQ ID NO: 814211 - DNA, 25 bp, Mus musculus
tggaagaggatggacaactgaagtc

SEQ ID NO: 814212 - DNA, 25 bp, Mus musculus
tggaagaggcaaaacgcctccaccg

SEQ ID NO: 814213 - DNA, 25 bp, Mus musculus
tggaagaggcaatacgcctccaccg

SEQ ID NO: 814214 - DNA, 25 bp, Mus musculus
tggaagaggtccctgctgccattgc

SEQ ID NO: 814215 - DNA, 25 bp, Mus musculus
tggaagaggtccgtgctgccattgc

SEQ ID NO: 814216 - DNA, 25 bp, Mus musculus
tggaagaggttcacatgataaagaa

SEQ ID NO: 814217 - DNA, 25 bp, Mus musculus
tggaagaggttctcatgataaagaa

SEQ ID NO: 814218 - DNA, 25 bp, Mus musculus
tggaagagttctccttgataaagga

SEQ ID NO: 814219 - DNA, 25 bp, Mus musculus
tggaagagttctgcttgataaagga

SEQ ID NO: 814220 - DNA, 25 bp, Mus musculus
tggaagatacacaacacaagcacag

SEQ ID NO: 814221 - DNA, 25 bp, Mus musculus
tggaagatacactacacaagcacag

SEQ ID NO: 814222 - DNA, 25 bp, Mus musculus
tggaagatatatatcccaatcagcc

SEQ ID NO: 814223 - DNA, 25 bp, Mus musculus
tggaagatatatttcccaatcagcc

SEQ ID NO: 814224 - DNA, 25 bp, Mus musculus
tggaagatgcttccagaaagctggc

SEQ ID NO: 814225 - DNA, 25 bp, Mus musculus
tggaagatgcttgcagaaagctggc

SEQ ID NO: 814226 - DNA, 25 bp, Mus musculus
tggaagatgtctatggatgtgacct

SEQ ID NO: 814227 - DNA, 25 bp, Mus musculus
tggaagatgtctttggatgtgacct

SEQ ID NO: 814228 - DNA, 25 bp, Mus musculus
tggaagatgtgaccctaggacaaat

SEQ ID NO: 814229 - DNA, 25 bp, Mus musculus
tggaagatgtgagcctaggacaaat

SEQ ID NO: 814230 - DNA, 25 bp, Mus musculus
tggaagatgtggcttctgatgacaa

SEQ ID NO: 814231 - DNA, 25 bp, Mus musculus
tggaagatgtgggttctgatgacaa

SEQ ID NO: 814232 - DNA, 25 bp, Mus musculus
tggaagatgttacgcatgcactgta

SEQ ID NO: 814233 - DNA, 25 bp, Mus musculus
tggaagatgttaggcatgcactgta

SEQ ID NO: 814234 - DNA, 25 bp, Mus musculus
tggaagatgttgctcccagggcatt

SEQ ID NO: 814235 - DNA, 25 bp, Mus musculus
tggaagatgttggtcccagggcatt

SEQ ID NO: 814236 - DNA, 25 bp, Mus musculus
tggaagattcttactgttccatcca

SEQ ID NO: 814237 - DNA, 25 bp, Mus musculus
tggaagattctttctgttccatcca

SEQ ID NO: 814238 - DNA, 25 bp, Mus musculus
tggaagattttaatcaagttcccag

SEQ ID NO: 814239 - DNA, 25 bp, Mus musculus
tggaagattttattcaagttcccag

SEQ ID NO: 814240 - DNA, 25 bp, Mus musculus
tggaagatttttctaccaaggcaaa

SEQ ID NO: 814241 - DNA, 25 bp, Mus musculus
tggaagatttttgtaccaaggcaaa

SEQ ID NO: 814242 - DNA, 25 bp, Mus musculus
tggaagcaacgtcacactcatcacc

SEQ ID NO: 814243 - DNA, 25 bp, Mus musculus
tggaagcaacgtgacactcatcacc

SEQ ID NO: 814244 - DNA, 25 bp, Mus musculus
tggaagcaagacctttagaaaaaga

SEQ ID NO: 814245 - DNA, 25 bp, Mus musculus
tggaagcaagacgtttagaaaaaga

SEQ ID NO: 814246 - DNA, 25 bp, Mus musculus
tggaagcacactagaaaagcactgg

SEQ ID NO: 814247 - DNA, 25 bp, Mus musculus
tggaagcacacttgaaaagcactgg

SEQ ID NO: 814248 - DNA, 25 bp, Mus musculus
tggaagcacatcctgcctcgggcag

SEQ ID NO: 814249 - DNA, 25 bp, Mus musculus
tggaagcacatcgtgcctcgggcag

SEQ ID NO: 814250 - DNA, 25 bp, Mus musculus
tggaagcacctaacctcggaaggca

SEQ ID NO: 814251 - DNA, 25 bp, Mus musculus
tggaagcacctatcctcggaaggca

SEQ ID NO: 814252 - DNA, 25 bp, Mus musculus
tggaagcagctaatggcgcagagca

SEQ ID NO: 814253 - DNA, 25 bp, Mus musculus
tggaagcagctattggcgcagagca

SEQ ID NO: 814254 - DNA, 25 bp, Mus musculus
tggaagcagcttctataagatcatc

SEQ ID NO: 814255 - DNA, 25 bp, Mus musculus
tggaagcagcttgtataagatcatc

SEQ ID NO: 814256 - DNA, 25 bp, Mus musculus
tggaagcagtcaaggcaaggtgcac

SEQ ID NO: 814257 - DNA, 25 bp, Mus musculus
tggaagcagtcatggcaaggtgcac

SEQ ID NO: 814258 - DNA, 25 bp, Mus musculus
tggaagccaagtcaagacccttggg

SEQ ID NO: 814259 - DNA, 25 bp, Mus musculus
tggaagccaagtgaagacccttggg

SEQ ID NO: 814260 - DNA, 25 bp, Mus musculus
tggaagccaccaatgctgtgctctt

SEQ ID NO: 814261 - DNA, 25 bp, Mus musculus
tggaagccaccattgctgtgctctt

SEQ ID NO: 814262 - DNA, 25 bp, Mus musculus
tggaagccagaaatgttagagcatg

SEQ ID NO: 814263 - DNA, 25 bp, Mus musculus
tggaagccagaattgttagagcatg

SEQ ID NO: 814264 - DNA, 25 bp, Mus musculus
tggaagccatgacgcggttcagcct

SEQ ID NO: 814265 - DNA, 25 bp, Mus musculus
tggaagccatgaggcggttcagcct

SEQ ID NO: 814266 - DNA, 25 bp, Mus musculus
tggaagccattgatcaaaagataaa

SEQ ID NO: 814267 - DNA, 25 bp, Mus musculus
tggaagccattgttcaaaagataaa

SEQ ID NO: 814268 - DNA, 25 bp, Mus musculus
tggaagccccacaggataccatcaa

SEQ ID NO: 814269 - DNA, 25 bp, Mus musculus
tggaagccccactggataccatcaa

SEQ ID NO: 814270 - DNA, 25 bp, Mus musculus
tggaagcccttaattgccacagcac

SEQ ID NO: 814271 - DNA, 25 bp, Mus musculus
tggaagcccttatttgccacagcac

SEQ ID NO: 814272 - DNA, 25 bp, Mus musculus
tggaagccctttccttgtgtacaaa

SEQ ID NO: 814273 - DNA, 25 bp, Mus musculus
tggaagccctttgcttgtgtacaaa

SEQ ID NO: 814274 - DNA, 25 bp, Mus musculus
tggaagccgagcatgctgtcgagcc

SEQ ID NO: 814275 - DNA, 25 bp, Mus musculus
tggaagccgagcttgctgtcgagcc

SEQ ID NO: 814276 - DNA, 25 bp, Mus musculus
tggaagccggccaggctgagaacct

SEQ ID NO: 814277 - DNA, 25 bp, Mus musculus
tggaagccggcctggctgagaacct

SEQ ID NO: 814278 - DNA, 25 bp, Mus musculus
tggaagccgtgcagagccgcctact

SEQ ID NO: 814279 - DNA, 25 bp, Mus musculus
tggaagccgtgctgagccgcctact

SEQ ID NO: 814280 - DNA, 25 bp, Mus musculus
tggaagcctggcagagaaaagtctg

SEQ ID NO: 814281 - DNA, 25 bp, Mus musculus
tggaagcctggctgagaaaagtctg

SEQ ID NO: 814282 - DNA, 25 bp, Mus musculus
tggaagccttagctgctccgctgga

SEQ ID NO: 814283 - DNA, 25 bp, Mus musculus
tggaagccttaggtgctccgctgga

SEQ ID NO: 814284 - DNA, 25 bp, Mus musculus
tggaagccttctcgcgacgtggaca

SEQ ID NO: 814285 - DNA, 25 bp, Mus musculus
tggaagccttctggcgacgtggaca

SEQ ID NO: 814286 - DNA, 25 bp, Mus musculus
tggaagcggttcagatcagtaacaa

SEQ ID NO: 814287 - DNA, 25 bp, Mus musculus
tggaagcggttctgatcagtaacaa

SEQ ID NO: 814288 - DNA, 25 bp, Mus musculus
tggaagcggtttagttcctctgggc

SEQ ID NO: 814289 - DNA, 25 bp, Mus musculus
tggaagcggttttgttcctctgggc

SEQ ID NO: 814290 - DNA, 25 bp, Mus musculus
tggaagctagaccaacctgattgga

SEQ ID NO: 814291 - DNA, 25 bp, Mus musculus
tggaagctagacgaacctgattgga

SEQ ID NO: 814292 - DNA, 25 bp, Mus musculus
tggaagctatgcctctgaaaaacag

SEQ ID NO: 814293 - DNA, 25 bp, Mus musculus
tggaagctatgcgtctgaaaaacag

SEQ ID NO: 814294 - DNA, 25 bp, Mus musculus
tggaagctcaaaagacccatgctct

SEQ ID NO: 814295 - DNA, 25 bp, Mus musculus
tggaagctcaaatgacccatgctct

SEQ ID NO: 814296 - DNA, 25 bp, Mus musculus
tggaagctctgtatgaaagtaacct

SEQ ID NO: 814297 - DNA, 25 bp, Mus musculus
tggaagctctgtttgaaagtaacct

SEQ ID NO: 814298 - DNA, 25 bp, Mus musculus
tggaagctgaagcatccagcagaga

SEQ ID NO: 814299 - DNA, 25 bp, Mus musculus
tggaagctgaaggatccagcagaga

SEQ ID NO: 814300 - DNA, 25 bp, Mus musculus
tggaagctgcctctatctctgacac

SEQ ID NO: 814301 - DNA, 25 bp, Mus musculus
tggaagctgcctgtatctctgacac

SEQ ID NO: 814302 - DNA, 25 bp, Mus musculus
tggaagctggccagcgctgtgtcct

SEQ ID NO: 814303 - DNA, 25 bp, Mus musculus
tggaagctggcctgcgctgtgtcct

SEQ ID NO: 814304 - DNA, 25 bp, Mus musculus
tggaagctggcgaaggactcgttac

SEQ ID NO: 814305 - DNA, 25 bp, Mus musculus
tggaagctggcgtaggactcgttac

SEQ ID NO: 814306 - DNA, 25 bp, Mus musculus
tggaagcttcccatagctcgggcca

SEQ ID NO: 814307 - DNA, 25 bp, Mus musculus
tggaagcttcccttagctcgggcca

SEQ ID NO: 814308 - DNA, 25 bp, Mus musculus
tggaagcttggacatgacatcgacc

SEQ ID NO: 814309 - DNA, 25 bp, Mus musculus
tggaagcttggagatgacatcgacc

SEQ ID NO: 814310 - DNA, 25 bp, Mus musculus
tggaaggacttcaaagataacaacg

SEQ ID NO: 814311 - DNA, 25 bp, Mus musculus
tggaaggacttctaagataacaacg

SEQ ID NO: 814312 - DNA, 25 bp, Mus musculus
tggaaggagactataaaacgccagc

SEQ ID NO: 814313 - DNA, 25 bp, Mus musculus
tggaaggagactttaaaacgccagc

SEQ ID NO: 814314 - DNA, 25 bp, Mus musculus
tggaaggagcctcgacatttggaca

SEQ ID NO: 814315 - DNA, 25 bp, Mus musculus
tggaaggagcctggacatttggaca

SEQ ID NO: 814316 - DNA, 25 bp, Mus musculus
tggaaggaggcgagaacatcaagcc

SEQ ID NO: 814317 - DNA, 25 bp, Mus musculus
tggaaggaggcgtgaacatcaagcc

SEQ ID NO: 814318 - DNA, 25 bp, Mus musculus
tggaaggatctgaagccatgcagcg

SEQ ID NO: 814319 - DNA, 25 bp, Mus musculus
tggaaggatctgtagccatgcagcg

SEQ ID NO: 814320 - DNA, 25 bp, Mus musculus
tggaaggattacaagtagcttggct

SEQ ID NO: 814321 - DNA, 25 bp, Mus musculus
tggaaggattactagtagcttggct

SEQ ID NO: 814322 - DNA, 25 bp, Mus musculus
tggaaggattttcctggctgatgaa

SEQ ID NO: 814323 - DNA, 25 bp, Mus musculus
tggaaggattttgctggctgatgaa

SEQ ID NO: 814324 - DNA, 25 bp, Mus musculus
tggaaggcacatcagttctaagcgt

SEQ ID NO: 814325 - DNA, 25 bp, Mus musculus
tggaaggcacatgagttctaagcgt

SEQ ID NO: 814326 - DNA, 25 bp, Mus musculus
tggaaggcattcagccccaccactg

SEQ ID NO: 814327 - DNA, 25 bp, Mus musculus
tggaaggcattctgccccaccactg

SEQ ID NO: 814328 - DNA, 25 bp, Mus musculus
tggaaggcccagacactctgacaga

SEQ ID NO: 814329 - DNA, 25 bp, Mus musculus
tggaaggcccagtcactctgacaga

SEQ ID NO: 814330 - DNA, 25 bp, Mus musculus
tggaaggccctcagctggagcacct

SEQ ID NO: 814331 - DNA, 25 bp, Mus musculus
tggaaggccctctgctggagcacct

SEQ ID NO: 814332 - DNA, 25 bp, Mus musculus
tggaaggcctgaaagacctgctgtt

SEQ ID NO: 814333 - DNA, 25 bp, Mus musculus
tggaaggcctgatagacctgctgtt

SEQ ID NO: 814334 - DNA, 25 bp, Mus musculus
tggaaggcgcctatgccactgagga

SEQ ID NO: 814335 - DNA, 25 bp, Mus musculus
tggaaggcgcctttgccactgagga

SEQ ID NO: 814336 - DNA, 25 bp, Mus musculus
tggaaggcgtggaagtcatcagaag

SEQ ID NO: 814337 - DNA, 25 bp, Mus musculus
tggaaggcgtggtagtcatcagaag

SEQ ID NO: 814338 - DNA, 25 bp, Mus musculus
tggaaggctcctagccggagaccag

SEQ ID NO: 814339 - DNA, 25 bp, Mus musculus
tggaaggctccttgccggagaccag

SEQ ID NO: 814340 - DNA, 25 bp, Mus musculus
tggaaggctctcaaagaacagctgc

SEQ ID NO: 814341 - DNA, 25 bp, Mus musculus
tggaaggctctctaagaacagctgc

SEQ ID NO: 814342 - DNA, 25 bp, Mus musculus
tggaaggctggacctcaccctccga

SEQ ID NO: 814343 - DNA, 25 bp, Mus musculus
tggaaggctggagctcaccctccga

SEQ ID NO: 814344 - DNA, 25 bp, Mus musculus
tggaagggaacaaaggccatcgatg

SEQ ID NO: 814345 - DNA, 25 bp, Mus musculus
tggaagggaacataggccatcgatg

SEQ ID NO: 814346 - DNA, 25 bp, Mus musculus
tggaagggactgcatacttaagttc

SEQ ID NO: 814347 - DNA, 25 bp, Mus musculus
tggaagggactggatacttaagttc

SEQ ID NO: 814348 - DNA, 25 bp, Mus musculus
tggaagggcggcactagaactagca

SEQ ID NO: 814349 - DNA, 25 bp, Mus musculus
tggaagggcggctctagaactagca

SEQ ID NO: 814350 - DNA, 25 bp, Mus musculus
tggaagggctacaagcgcaagccct

SEQ ID NO: 814351 - DNA, 25 bp, Mus musculus
tggaagggctactagcgcaagccct

SEQ ID NO: 814352 - DNA, 25 bp, Mus musculus
tggaagggctcacgtataacagagt

SEQ ID NO: 814353 - DNA, 25 bp, Mus musculus
tggaagggctcaggtataacagagt

SEQ ID NO: 814354 - DNA, 25 bp, Mus musculus
tggaagggctccatcatcaaagacc

SEQ ID NO: 814355 - DNA, 25 bp, Mus musculus
tggaagggctccttcatcaaagacc

SEQ ID NO: 814356 - DNA, 25 bp, Mus musculus
tggaaggtcaacacaaaaggctcaa

SEQ ID NO: 814357 - DNA, 25 bp, Mus musculus
tggaaggtcaactcaaaaggctcaa

SEQ ID NO: 814358 - DNA, 25 bp, Mus musculus
tggaaggtcattcagtctgtgagct

SEQ ID NO: 814359 - DNA, 25 bp, Mus musculus
tggaaggtcattgagtctgtgagct

SEQ ID NO: 814360 - DNA, 25 bp, Mus musculus
tggaaggtccccagaagcaatccac

SEQ ID NO: 814361 - DNA, 25 bp, Mus musculus
tggaaggtcccctgaagcaatccac

SEQ ID NO: 814362 - DNA, 25 bp, Mus musculus
tggaaggtctccaccatcgatggca

SEQ ID NO: 814363 - DNA, 25 bp, Mus musculus
tggaaggtctcctccatcgatggca

SEQ ID NO: 814364 - DNA, 25 bp, Mus musculus
tggaaggtgccaacgcggccctgct

SEQ ID NO: 814365 - DNA, 25 bp, Mus musculus
tggaaggtgccatcgcggccctgct

SEQ ID NO: 814366 - DNA, 25 bp, Mus musculus
tggaaggtggacatcccctaccagg

SEQ ID NO: 814367 - DNA, 25 bp, Mus musculus
tggaaggtggacttcccctaccagg

SEQ ID NO: 814368 - DNA, 25 bp, Mus musculus
tggaaggtgtaaccctgcatacaga

SEQ ID NO: 814369 - DNA, 25 bp, Mus musculus
tggaaggtgtaagcctgcatacaga

SEQ ID NO: 814370 - DNA, 25 bp, Mus musculus
tggaaggtgtgacgtcagcaaggcc

SEQ ID NO: 814371 - DNA, 25 bp, Mus musculus
tggaaggtgtgaggtcagcaaggcc

SEQ ID NO: 814372 - DNA, 25 bp, Mus musculus
tggaaggttaccatggcaaggacca

SEQ ID NO: 814373 - DNA, 25 bp, Mus musculus
tggaaggttaccttggcaaggacca

SEQ ID NO: 814374 - DNA, 25 bp, Mus musculus
tggaaggttgaacctgatgatcacc

SEQ ID NO: 814375 - DNA, 25 bp, Mus musculus
tggaaggttgaagctgatgatcacc

SEQ ID NO: 814376 - DNA, 25 bp, Mus musculus
tggaaggtttatcccacgggctcgc

SEQ ID NO: 814377 - DNA, 25 bp, Mus musculus
tggaaggtttatgccacgggctcgc

SEQ ID NO: 814378 - DNA, 25 bp, Mus musculus
tggaagtaatgaatacaagtagccc

SEQ ID NO: 814379 - DNA, 25 bp, Mus musculus
tggaagtaatgattacaagtagccc

SEQ ID NO: 814380 - DNA, 25 bp, Mus musculus
tggaagtacaagagggatatggctt

SEQ ID NO: 814381 - DNA, 25 bp, Mus musculus
tggaagtacaagtgggatatggctt

SEQ ID NO: 814382 - DNA, 25 bp, Mus musculus
tggaagtacacacagctcagacaca

SEQ ID NO: 814383 - DNA, 25 bp, Mus musculus
tggaagtacacagagctcagacaca

SEQ ID NO: 814384 - DNA, 25 bp, Mus musculus
tggaagtaccaacgtccccatgact

SEQ ID NO: 814385 - DNA, 25 bp, Mus musculus
tggaagtaccaaggtccccatgact

SEQ ID NO: 814386 - DNA, 25 bp, Mus musculus
tggaagtacccacgcaaaaggcgag

SEQ ID NO: 814387 - DNA, 25 bp, Mus musculus
tggaagtacccaggcaaaaggcgag

SEQ ID NO: 814388 - DNA, 25 bp, Mus musculus
tggaagtacttcctgcagctgtgca

SEQ ID NO: 814389 - DNA, 25 bp, Mus musculus
tggaagtacttcgtgcagctgtgca

SEQ ID NO: 814390 - DNA, 25 bp, Mus musculus
tggaagtatatcacagactggcaga

SEQ ID NO: 814391 - DNA, 25 bp, Mus musculus
tggaagtatatctcagactggcaga

SEQ ID NO: 814392 - DNA, 25 bp, Mus musculus
tggaagtatcgacccaaactgtgat

SEQ ID NO: 814393 - DNA, 25 bp, Mus musculus
tggaagtatcgagccaaactgtgat

SEQ ID NO: 814394 - DNA, 25 bp, Mus musculus
tggaagtcaggtcagacaactcagg

SEQ ID NO: 814395 - DNA, 25 bp, Mus musculus
tggaagtcaggtgagacaactcagg

SEQ ID NO: 814396 - DNA, 25 bp, Mus musculus
tggaagtcatcaagccattctgtgt

SEQ ID NO: 814397 - DNA, 25 bp, Mus musculus
tggaagtcatcatgccattctgtgt

SEQ ID NO: 814398 - DNA, 25 bp, Mus musculus
tggaagtccgtaatgccttttggct

SEQ ID NO: 814399 - DNA, 25 bp, Mus musculus
tggaagtccgtattgccttttggct

SEQ ID NO: 814400 - DNA, 25 bp, Mus musculus
tggaagtcggagagcgtgttgaggc

SEQ ID NO: 814401 - DNA, 25 bp, Mus musculus
tggaagtcggagtgcgtgttgaggc

SEQ ID NO: 814402 - DNA, 25 bp, Mus musculus
tggaagtcttcccacagatacaact

SEQ ID NO: 814403 - DNA, 25 bp, Mus musculus
tggaagtcttccgacagatacaact

SEQ ID NO: 814404 - DNA, 25 bp, Mus musculus
tggaagtcttgcagacgccatgtcc

SEQ ID NO: 814405 - DNA, 25 bp, Mus musculus
tggaagtcttgctgacgccatgtcc

SEQ ID NO: 814406 - DNA, 25 bp, Mus musculus
tggaagtgacacaaggaagaactca

SEQ ID NO: 814407 - DNA, 25 bp, Mus musculus
tggaagtgacactaggaagaactca

SEQ ID NO: 814408 - DNA, 25 bp, Mus musculus
tggaagtgattcagctcagtttccc

SEQ ID NO: 814409 - DNA, 25 bp, Mus musculus
tggaagtgattctgctcagtttccc

SEQ ID NO: 814410 - DNA, 25 bp, Mus musculus
tggaagtgcagaacgaaacaatgaa

SEQ ID NO: 814411 - DNA, 25 bp, Mus musculus
tggaagtgcagatcgaaacaatgaa

SEQ ID NO: 814412 - DNA, 25 bp, Mus musculus
tggaagtgctgaaggcaattcagaa

SEQ ID NO: 814413 - DNA, 25 bp, Mus musculus
tggaagtgctgatggcaattcagaa

SEQ ID NO: 814414 - DNA, 25 bp, Mus musculus
tggaagtgggcacggctgctgaggc

SEQ ID NO: 814415 - DNA, 25 bp, Mus musculus
tggaagtgggcagggctgctgaggc

SEQ ID NO: 814416 - DNA, 25 bp, Mus musculus
tggaagtggtggcagtcattcacat

SEQ ID NO: 814417 - DNA, 25 bp, Mus musculus
tggaagtggtgggagtcattcacat

SEQ ID NO: 814418 - DNA, 25 bp, Mus musculus
tggaagtggttgcaaatggcaccta

SEQ ID NO: 814419 - DNA, 25 bp, Mus musculus
tggaagtggttggaaatggcaccta

SEQ ID NO: 814420 - DNA, 25 bp, Mus musculus
tggaagtgtcaaacagaacggccct

SEQ ID NO: 814421 - DNA, 25 bp, Mus musculus
tggaagtgtcaatcagaacggccct

SEQ ID NO: 814422 - DNA, 25 bp, Mus musculus
tggaagttattgactgggtaaaaag

SEQ ID NO: 814423 - DNA, 25 bp, Mus musculus
tggaagttattgtctgggtaaaaag

SEQ ID NO: 814424 - DNA, 25 bp, Mus musculus
tggaagttcgaaaccctggcctgcc

SEQ ID NO: 814425 - DNA, 25 bp, Mus musculus
tggaagttcgaatccctggcctgcc

SEQ ID NO: 814426 - DNA, 25 bp, Mus musculus
tggaagttcgagaaattccacccca

SEQ ID NO: 814427 - DNA, 25 bp, Mus musculus
tggaagttcgagtaattccacccca

SEQ ID NO: 814428 - DNA, 25 bp, Mus musculus
tggaagttgagaaccatgaagtatg

SEQ ID NO: 814429 - DNA, 25 bp, Mus musculus
tggaagttgagatccatgaagtatg

SEQ ID NO: 814430 - DNA, 25 bp, Mus musculus
tggaagtttcaacgctaccacctca

SEQ ID NO: 814431 - DNA, 25 bp, Mus musculus
tggaagtttcaaggctaccacctca

SEQ ID NO: 814432 - DNA, 25 bp, Mus musculus
tggaagttttcaccgctggtcaaat

SEQ ID NO: 814433 - DNA, 25 bp, Mus musculus
tggaagttttcagcgctggtcaaat

SEQ ID NO: 814434 - DNA, 25 bp, Mus musculus
tggaataaaaagattcgatcccagt

SEQ ID NO: 814435 - DNA, 25 bp, Mus musculus
tggaataaaaagtttcgatcccagt

SEQ ID NO: 814436 - DNA, 25 bp, Mus musculus
tggaataaatacagggtgaataccc

SEQ ID NO: 814437 - DNA, 25 bp, Mus musculus
tggaataaatactgggtgaataccc

SEQ ID NO: 814438 - DNA, 25 bp, Mus musculus
tggaataaggagagagtacaatggc

SEQ ID NO: 814439 - DNA, 25 bp, Mus musculus
tggaataaggagtgagtacaatggc

SEQ ID NO: 814440 - DNA, 25 bp, Mus musculus
tggaatacaatgagtccttcccaca

SEQ ID NO: 814441 - DNA, 25 bp, Mus musculus
tggaatacaatgtgtccttcccaca

SEQ ID NO: 814442 - DNA, 25 bp, Mus musculus
tggaatacagttactgaaggagagc

SEQ ID NO: 814443 - DNA, 25 bp, Mus musculus
tggaatacagtttctgaaggagagc

SEQ ID NO: 814444 - DNA, 25 bp, Mus musculus
tggaataccagcagagaccacagcg

SEQ ID NO: 814445 - DNA, 25 bp, Mus musculus
tggaataccagctgagaccacagcg

SEQ ID NO: 814446 - DNA, 25 bp, Mus musculus
tggaataccaggaatgcccgggaca

SEQ ID NO: 814447 - DNA, 25 bp, Mus musculus
tggaataccaggtatgcccgggaca

SEQ ID NO: 814448 - DNA, 25 bp, Mus musculus
tggaataccagtcgcatggcttctt

SEQ ID NO: 814449 - DNA, 25 bp, Mus musculus
tggaataccagtggcatggcttctt

SEQ ID NO: 814450 - DNA, 25 bp, Mus musculus
tggaatacctctacccaagatgaac

SEQ ID NO: 814451 - DNA, 25 bp, Mus musculus
tggaatacctcttcccaagatgaac

SEQ ID NO: 814452 - DNA, 25 bp, Mus musculus
tggaatacctgaagctacaggacgt

SEQ ID NO: 814453 - DNA, 25 bp, Mus musculus
tggaatacctgatgctacaggacgt

SEQ ID NO: 814454 - DNA, 25 bp, Mus musculus
tggaatacgccactgagaagctaca

SEQ ID NO: 814455 - DNA, 25 bp, Mus musculus
tggaatacgccagtgagaagctaca

SEQ ID NO: 814456 - DNA, 25 bp, Mus musculus
tggaatagacctatgaaaacgcggc

SEQ ID NO: 814457 - DNA, 25 bp, Mus musculus
tggaatagacctttgaaaacgcggc

SEQ ID NO: 814458 - DNA, 25 bp, Mus musculus
tggaatagcaatcatgcccgtgact

SEQ ID NO: 814459 - DNA, 25 bp, Mus musculus
tggaatagcaatgatgcccgtgact

SEQ ID NO: 814460 - DNA, 25 bp, Mus musculus
tggaatatcctccagaagaaaatgg

SEQ ID NO: 814461 - DNA, 25 bp, Mus musculus
tggaatatcctcgagaagaaaatgg

SEQ ID NO: 814462 - DNA, 25 bp, Mus musculus
tggaatatctagattttacacacag

SEQ ID NO: 814463 - DNA, 25 bp, Mus musculus
tggaatatctagtttttacacacag

SEQ ID NO: 814464 - DNA, 25 bp, Mus musculus
tggaatatctgaaccaggagctccg

SEQ ID NO: 814465 - DNA, 25 bp, Mus musculus
tggaatatctgatccaggagctccg

SEQ ID NO: 814466 - DNA, 25 bp, Mus musculus
tggaatatttgaacaaagaggcacc

SEQ ID NO: 814467 - DNA, 25 bp, Mus musculus
tggaatatttgatcaaagaggcacc

SEQ ID NO: 814468 - DNA, 25 bp, Mus musculus
tggaatatttggctgttgctgtgat

SEQ ID NO: 814469 - DNA, 25 bp, Mus musculus
tggaatatttgggtgttgctgtgat

SEQ ID NO: 814470 - DNA, 25 bp, Mus musculus
tggaatcaacggaaaaatgcgaagc

SEQ ID NO: 814471 - DNA, 25 bp, Mus musculus
tggaatcaacggtaaaatgcgaagc

SEQ ID NO: 814472 - DNA, 25 bp, Mus musculus
tggaatcacacacctcatggtatgc

SEQ ID NO: 814473 - DNA, 25 bp, Mus musculus
tggaatcacacagctcatggtatgc

SEQ ID NO: 814474 - DNA, 25 bp, Mus musculus
tggaatcaccaaaaggaatctaaac

SEQ ID NO: 814475 - DNA, 25 bp, Mus musculus
tggaatcaccaataggaatctaaac

SEQ ID NO: 814476 - DNA, 25 bp, Mus musculus
tggaatcacttcacggacaatgagg

SEQ ID NO: 814477 - DNA, 25 bp, Mus musculus
tggaatcacttctcggacaatgagg

SEQ ID NO: 814478 - DNA, 25 bp, Mus musculus
tggaatcagggcaacggcaactact

SEQ ID NO: 814479 - DNA, 25 bp, Mus musculus
tggaatcagggctacggcaactact

SEQ ID NO: 814480 - DNA, 25 bp, Mus musculus
tggaatcatccaaaagcatctcaag

SEQ ID NO: 814481 - DNA, 25 bp, Mus musculus
tggaatcatccataagcatctcaag

SEQ ID NO: 814482 - DNA, 25 bp, Mus musculus
tggaatccactgaaccgagctgtcg

SEQ ID NO: 814483 - DNA, 25 bp, Mus musculus
tggaatccactgtaccgagctgtcg

SEQ ID NO: 814484 - DNA, 25 bp, Mus musculus
tggaatccatatctcctgggagctg

SEQ ID NO: 814485 - DNA, 25 bp, Mus musculus
tggaatccatatgtcctgggagctg

SEQ ID NO: 814486 - DNA, 25 bp, Mus musculus
tggaatccatctaatgacatccaga

SEQ ID NO: 814487 - DNA, 25 bp, Mus musculus
tggaatccatcttatgacatccaga

SEQ ID NO: 814488 - DNA, 25 bp, Mus musculus
tggaatcccacgagaaacagtgaga

SEQ ID NO: 814489 - DNA, 25 bp, Mus musculus
tggaatcccacgtgaaacagtgaga

SEQ ID NO: 814490 - DNA, 25 bp, Mus musculus
tggaatcccagtcagttaccttgtt

SEQ ID NO: 814491 - DNA, 25 bp, Mus musculus
tggaatcccagtgagttaccttgtt

SEQ ID NO: 814492 - DNA, 25 bp, Mus musculus
tggaatccccagaagaatcagggcc

SEQ ID NO: 814493 - DNA, 25 bp, Mus musculus
tggaatccccagtagaatcagggcc

SEQ ID NO: 814494 - DNA, 25 bp, Mus musculus
tggaatcccgggagttactgagaac

SEQ ID NO: 814495 - DNA, 25 bp, Mus musculus
tggaatcccgggtgttactgagaac

SEQ ID NO: 814496 - DNA, 25 bp, Mus musculus
tggaatccctccagtggtgtacccc

SEQ ID NO: 814497 - DNA, 25 bp, Mus musculus
tggaatccctcctgtggtgtacccc

SEQ ID NO: 814498 - DNA, 25 bp, Mus musculus
tggaatccctggattccgaggagac

SEQ ID NO: 814499 - DNA, 25 bp, Mus musculus
tggaatccctggtttccgaggagac

SEQ ID NO: 814500 - DNA, 25 bp, Mus musculus
tggaatccggttctccttgcctgca

SEQ ID NO: 814501 - DNA, 25 bp, Mus musculus
tggaatccggttgtccttgcctgca

SEQ ID NO: 814502 - DNA, 25 bp, Mus musculus
tggaatcctgtccaaagcctgtgat

SEQ ID NO: 814503 - DNA, 25 bp, Mus musculus
tggaatcctgtcgaaagcctgtgat

SEQ ID NO: 814504 - DNA, 25 bp, Mus musculus
tggaatcggaccagcaggagataat

SEQ ID NO: 814505 - DNA, 25 bp, Mus musculus
tggaatcggacctgcaggagataat

SEQ ID NO: 814506 - DNA, 25 bp, Mus musculus
tggaatcgtgccagagggaaccctt

SEQ ID NO: 814507 - DNA, 25 bp, Mus musculus
tggaatcgtgcctgagggaaccctt

SEQ ID NO: 814508 - DNA, 25 bp, Mus musculus
tggaatctagagaaccccagccgtg

SEQ ID NO: 814509 - DNA, 25 bp, Mus musculus
tggaatctagagtaccccagccgtg

SEQ ID NO: 814510 - DNA, 25 bp, Mus musculus
tggaatctatcaccacactgggctg

SEQ ID NO: 814511 - DNA, 25 bp, Mus musculus
tggaatctatcagcacactgggctg

SEQ ID NO: 814512 - DNA, 25 bp, Mus musculus
tggaatctatgcaaacgtgaggatg

SEQ ID NO: 814513 - DNA, 25 bp, Mus musculus
tggaatctatgctaacgtgaggatg

SEQ ID NO: 814514 - DNA, 25 bp, Mus musculus
tggaatctcagcacagaaacttggg

SEQ ID NO: 814515 - DNA, 25 bp, Mus musculus
tggaatctcagctcagaaacttggg

SEQ ID NO: 814516 - DNA, 25 bp, Mus musculus
tggaatctgactactatgatctgca

SEQ ID NO: 814517 - DNA, 25 bp, Mus musculus
tggaatctgacttctatgatctgca

SEQ ID NO: 814518 - DNA, 25 bp, Mus musculus
tggaatctgcctcctgatcaccatt

SEQ ID NO: 814519 - DNA, 25 bp, Mus musculus
tggaatctgcctgctgatcaccatt

SEQ ID NO: 814520 - DNA, 25 bp, Mus musculus
tggaatctggctaactgcaagctaa

SEQ ID NO: 814521 - DNA, 25 bp, Mus musculus
tggaatctggcttactgcaagctaa

SEQ ID NO: 814522 - DNA, 25 bp, Mus musculus
tggaatctgtgcacatcattctgag

SEQ ID NO: 814523 - DNA, 25 bp, Mus musculus
tggaatctgtgctcatcattctgag

SEQ ID NO: 814524 - DNA, 25 bp, Mus musculus
tggaatcttttcaatcagaaacaga

SEQ ID NO: 814525 - DNA, 25 bp, Mus musculus
tggaatcttttctatcagaaacaga

SEQ ID NO: 814526 - DNA, 25 bp, Mus musculus
tggaatgaaaagcttgttctccagc

SEQ ID NO: 814527 - DNA, 25 bp, Mus musculus
tggaatgaaaaggttgttctccagc

SEQ ID NO: 814528 - DNA, 25 bp, Mus musculus
tggaatgaaccacaccaccatgact

SEQ ID NO: 814529 - DNA, 25 bp, Mus musculus
tggaatgaaccagaccaccatgact

SEQ ID NO: 814530 - DNA, 25 bp, Mus musculus
tggaatgaagatcgcaaatctggcc

SEQ ID NO: 814531 - DNA, 25 bp, Mus musculus
tggaatgaagatggcaaatctggcc

SEQ ID NO: 814532 - DNA, 25 bp, Mus musculus
tggaatgacaaaccagcaagcgcga

SEQ ID NO: 814533 - DNA, 25 bp, Mus musculus
tggaatgacaaagcagcaagcgcga

SEQ ID NO: 814534 - DNA, 25 bp, Mus musculus
tggaatgacactcacttatgacccg

SEQ ID NO: 814535 - DNA, 25 bp, Mus musculus
tggaatgacactgacttatgacccg

SEQ ID NO: 814536 - DNA, 25 bp, Mus musculus
tggaatgacctgcactacatggacg

SEQ ID NO: 814537 - DNA, 25 bp, Mus musculus
tggaatgacctggactacatggacg

SEQ ID NO: 814538 - DNA, 25 bp, Mus musculus
tggaatgactgccagctacagcacc

SEQ ID NO: 814539 - DNA, 25 bp, Mus musculus
tggaatgactgcgagctacagcacc

SEQ ID NO: 814540 - DNA, 25 bp, Mus musculus
tggaatgagaaactgacgcagtctg

SEQ ID NO: 814541 - DNA, 25 bp, Mus musculus
tggaatgagaaagtgacgcagtctg

SEQ ID NO: 814542 - DNA, 25 bp, Mus musculus
tggaatgagctgaactacatgggtg

SEQ ID NO: 814543 - DNA, 25 bp, Mus musculus
tggaatgagctgtactacatgggtg

SEQ ID NO: 814544 - DNA, 25 bp, Mus musculus
tggaatgatcacctttacctgcagc

SEQ ID NO: 814545 - DNA, 25 bp, Mus musculus
tggaatgatcacgtttacctgcagc

SEQ ID NO: 814546 - DNA, 25 bp, Mus musculus
tggaatgcaaaaaggttgccgagtc

SEQ ID NO: 814547 - DNA, 25 bp, Mus musculus
tggaatgcaaaatggttgccgagtc

SEQ ID NO: 814548 - DNA, 25 bp, Mus musculus
tggaatgccaagatgctctcgaaac

SEQ ID NO: 814549 - DNA, 25 bp, Mus musculus
tggaatgccaagttgctctcgaaac

SEQ ID NO: 814550 - DNA, 25 bp, Mus musculus
tggaatgcctcaaccaagagcagat

SEQ ID NO: 814551 - DNA, 25 bp, Mus musculus
tggaatgcctcatccaagagcagat

SEQ ID NO: 814552 - DNA, 25 bp, Mus musculus
tggaatggccccacatggcatggct

SEQ ID NO: 814553 - DNA, 25 bp, Mus musculus
tggaatggcccctcatggcatggct

SEQ ID NO: 814554 - DNA, 25 bp, Mus musculus
tggaatggcgtgaagaatgcaactg

SEQ ID NO: 814555 - DNA, 25 bp, Mus musculus
tggaatggcgtgtagaatgcaactg

SEQ ID NO: 814556 - DNA, 25 bp, Mus musculus
tggaatggctagatcaggttcatgc

SEQ ID NO: 814557 - DNA, 25 bp, Mus musculus
tggaatggctagttcaggttcatgc

SEQ ID NO: 814558 - DNA, 25 bp, Mus musculus
tggaatgggaccacgtagagaagac

SEQ ID NO: 814559 - DNA, 25 bp, Mus musculus
tggaatgggacctcgtagagaagac

SEQ ID NO: 814560 - DNA, 25 bp, Mus musculus
tggaatggtaacagagccagcgctg

SEQ ID NO: 814561 - DNA, 25 bp, Mus musculus
tggaatggtaactgagccagcgctg

SEQ ID NO: 814562 - DNA, 25 bp, Mus musculus
tggaatgtaactcaaagctggaccc

SEQ ID NO: 814563 - DNA, 25 bp, Mus musculus
tggaatgtaactgaaagctggaccc

SEQ ID NO: 814564 - DNA, 25 bp, Mus musculus
tggaatgtcatgacccactacctac

SEQ ID NO: 814565 - DNA, 25 bp, Mus musculus
tggaatgtcatgtcccactacctac

SEQ ID NO: 814566 - DNA, 25 bp, Mus musculus
tggaatgtgacgaagtggttactga

SEQ ID NO: 814567 - DNA, 25 bp, Mus musculus
tggaatgtgacgtagtggttactga

SEQ ID NO: 814568 - DNA, 25 bp, Mus musculus
tggaatgtgactatgatccccgagg

SEQ ID NO: 814569 - DNA, 25 bp, Mus musculus
tggaatgtgactttgatccccgagg

SEQ ID NO: 814570 - DNA, 25 bp, Mus musculus
tggaattaaacacgcagcagaaacc

SEQ ID NO: 814571 - DNA, 25 bp, Mus musculus
tggaattaaacaggcagcagaaacc

SEQ ID NO: 814572 - DNA, 25 bp, Mus musculus
tggaattaaagtcgtgtcctacggg

SEQ ID NO: 814573 - DNA, 25 bp, Mus musculus
tggaattaaagtggtgtcctacggg

SEQ ID NO: 814574 - DNA, 25 bp, Mus musculus
tggaattaatgtcaggaaatgcaga

SEQ ID NO: 814575 - DNA, 25 bp, Mus musculus
tggaattaatgtgaggaaatgcaga

SEQ ID NO: 814576 - DNA, 25 bp, Mus musculus
tggaattaattgctcaaaatacggt

SEQ ID NO: 814577 - DNA, 25 bp, Mus musculus
tggaattaattggtcaaaatacggt

SEQ ID NO: 814578 - DNA, 25 bp, Mus musculus
tggaattactagcttcgcccagaag

SEQ ID NO: 814579 - DNA, 25 bp, Mus musculus
tggaattactaggttcgcccagaag

SEQ ID NO: 814580 - DNA, 25 bp, Mus musculus
tggaattcacccacctgtatgcacg

SEQ ID NO: 814581 - DNA, 25 bp, Mus musculus
tggaattcaccctcctgtatgcacg

SEQ ID NO: 814582 - DNA, 25 bp, Mus musculus
tggaattcagccatctctatgacca

SEQ ID NO: 814583 - DNA, 25 bp, Mus musculus
tggaattcagccttctctatgacca

SEQ ID NO: 814584 - DNA, 25 bp, Mus musculus
tggaattcaggacggctgctctgac

SEQ ID NO: 814585 - DNA, 25 bp, Mus musculus
tggaattcaggagggctgctctgac

SEQ ID NO: 814586 - DNA, 25 bp, Mus musculus
tggaattccttccaaagtgcagcgt

SEQ ID NO: 814587 - DNA, 25 bp, Mus musculus
tggaattccttcgaaagtgcagcgt

SEQ ID NO: 814588 - DNA, 25 bp, Mus musculus
tggaattctaatctgagtgggcatc

SEQ ID NO: 814589 - DNA, 25 bp, Mus musculus
tggaattctaatgtgagtgggcatc

SEQ ID NO: 814590 - DNA, 25 bp, Mus musculus
tggaattctactcagcgctgccagg

SEQ ID NO: 814591 - DNA, 25 bp, Mus musculus
tggaattctactgagcgctgccagg

SEQ ID NO: 814592 - DNA, 25 bp, Mus musculus
tggaattctcaaagagcaaactctg

SEQ ID NO: 814593 - DNA, 25 bp, Mus musculus
tggaattctcaatgagcaaactctg

SEQ ID NO: 814594 - DNA, 25 bp, Mus musculus
tggaattctccaagaggaactgttc

SEQ ID NO: 814595 - DNA, 25 bp, Mus musculus
tggaattctccatgaggaactgttc

SEQ ID NO: 814596 - DNA, 25 bp, Mus musculus
tggaattctcctatgaggactggag

SEQ ID NO: 814597 - DNA, 25 bp, Mus musculus
tggaattctcctttgaggactggag

SEQ ID NO: 814598 - DNA, 25 bp, Mus musculus
tggaattctggaaacttcagagagc

SEQ ID NO: 814599 - DNA, 25 bp, Mus musculus
tggaattctggatacttcagagagc

SEQ ID NO: 814600 - DNA, 25 bp, Mus musculus
tggaattctgtcaattgtcacagag

SEQ ID NO: 814601 - DNA, 25 bp, Mus musculus
tggaattctgtctattgtcacagag

SEQ ID NO: 814602 - DNA, 25 bp, Mus musculus
tggaattctgttcaggtcaacagtg

SEQ ID NO: 814603 - DNA, 25 bp, Mus musculus
tggaattctgttgaggtcaacagtg

SEQ ID NO: 814604 - DNA, 25 bp, Mus musculus
tggaattgaaccacagaggactgac

SEQ ID NO: 814605 - DNA, 25 bp, Mus musculus
tggaattgaacctcagaggactgac

SEQ ID NO: 814606 - DNA, 25 bp, Mus musculus
tggaattggaaaagcatatgcagaa

SEQ ID NO: 814607 - DNA, 25 bp, Mus musculus
tggaattggaaatgcatatgcagaa

SEQ ID NO: 814608 - DNA, 25 bp, Mus musculus
tggaattgttgtccacgcagcagcc

SEQ ID NO: 814609 - DNA, 25 bp, Mus musculus
tggaattgttgtgcacgcagcagcc

SEQ ID NO: 814610 - DNA, 25 bp, Mus musculus
tggaatttaagaatgcagcctatct

SEQ ID NO: 814611 - DNA, 25 bp, Mus musculus
tggaatttaagattgcagcctatct

SEQ ID NO: 814612 - DNA, 25 bp, Mus musculus
tggaatttccctattcggaggagct

SEQ ID NO: 814613 - DNA, 25 bp, Mus musculus
tggaatttcccttttcggaggagct

SEQ ID NO: 814614 - DNA, 25 bp, Mus musculus
tggaatttgatgagcagccagccta

SEQ ID NO: 814615 - DNA, 25 bp, Mus musculus
tggaatttgatgtgcagccagccta

SEQ ID NO: 814616 - DNA, 25 bp, Mus musculus
tggaatttgcatactcagctgcccc

SEQ ID NO: 814617 - DNA, 25 bp, Mus musculus
tggaatttgcattctcagctgcccc

SEQ ID NO: 814618 - DNA, 25 bp, Mus musculus
tggaatttgtcccaactggctatgg

SEQ ID NO: 814619 - DNA, 25 bp, Mus musculus
tggaatttgtccctcaccactgccg

SEQ ID NO: 814620 - DNA, 25 bp, Mus musculus
tggaatttgtccgaactggctatgg

SEQ ID NO: 814621 - DNA, 25 bp, Mus musculus
tggaatttgtccgtcaccactgccg

SEQ ID NO: 814622 - DNA, 25 bp, Mus musculus
tggaattttatgaacacagagatgc

SEQ ID NO: 814623 - DNA, 25 bp, Mus musculus
tggaattttatgtacacagagatgc

SEQ ID NO: 814624 - DNA, 25 bp, Mus musculus
tggacaaaaaggcatatttcttggg

SEQ ID NO: 814625 - DNA, 25 bp, Mus musculus
tggacaaaaagggatatttcttggg

SEQ ID NO: 814626 - DNA, 25 bp, Mus musculus
tggacaaaagcgctcaagttcatgc

SEQ ID NO: 814627 - DNA, 25 bp, Mus musculus
tggacaaaagcggtcaagttcatgc

SEQ ID NO: 814628 - DNA, 25 bp, Mus musculus
tggacaaaccccacctgttgtgtgc

SEQ ID NO: 814629 - DNA, 25 bp, Mus musculus
tggacaaacccctcctgttgtgtgc

SEQ ID NO: 814630 - DNA, 25 bp, Mus musculus
tggacaaactctcgcgcaagaggaa

SEQ ID NO: 814631 - DNA, 25 bp, Mus musculus
tggacaaactctggcgcaagaggaa

SEQ ID NO: 814632 - DNA, 25 bp, Mus musculus
tggacaaacttaacgctcagaaagt

SEQ ID NO: 814633 - DNA, 25 bp, Mus musculus
tggacaaacttatcgctcagaaagt

SEQ ID NO: 814634 - DNA, 25 bp, Mus musculus
tggacaaacttgatgctaatgtgag

SEQ ID NO: 814635 - DNA, 25 bp, Mus musculus
tggacaaacttgttgctaatgtgag

SEQ ID NO: 814636 - DNA, 25 bp, Mus musculus
tggacaaagcaacctagaggagaga

SEQ ID NO: 814637 - DNA, 25 bp, Mus musculus
tggacaaagcaagctagaggagaga

SEQ ID NO: 814638 - DNA, 25 bp, Mus musculus
tggacaaagcacatcgtacctgacc

SEQ ID NO: 814639 - DNA, 25 bp, Mus musculus
tggacaaagcacttcgtacctgacc

SEQ ID NO: 814640 - DNA, 25 bp, Mus musculus
tggacaaagcagaatctgagacaga

SEQ ID NO: 814641 - DNA, 25 bp, Mus musculus
tggacaaagcagtatctgagacaga

SEQ ID NO: 814642 - DNA, 25 bp, Mus musculus
tggacaaataatcgaaattcgagtc

SEQ ID NO: 814643 - DNA, 25 bp, Mus musculus
tggacaaataatggaaattcgagtc

SEQ ID NO: 814644 - DNA, 25 bp, Mus musculus
tggacaaatccaacgacaataaagc

SEQ ID NO: 814645 - DNA, 25 bp, Mus musculus
tggacaaatccatcgacaataaagc

SEQ ID NO: 814646 - DNA, 25 bp, Mus musculus
tggacaaatccccattgtggcgccc

SEQ ID NO: 814647 - DNA, 25 bp, Mus musculus
tggacaaatcccgattgtggcgccc

SEQ ID NO: 814648 - DNA, 25 bp, Mus musculus
tggacaaatgtccaacctcgttctg

SEQ ID NO: 814649 - DNA, 25 bp, Mus musculus
tggacaaatgtcgaacctcgttctg

SEQ ID NO: 814650 - DNA, 25 bp, Mus musculus
tggacaacatcaaacagcaccaacc

SEQ ID NO: 814651 - DNA, 25 bp, Mus musculus
tggacaacatcatacagcaccaacc

SEQ ID NO: 814652 - DNA, 25 bp, Mus musculus
tggacaacatccatttacacccaga

SEQ ID NO: 814653 - DNA, 25 bp, Mus musculus
tggacaacatccttttacacccaga

SEQ ID NO: 814654 - DNA, 25 bp, Mus musculus
tggacaaccgatagaattactcagc

SEQ ID NO: 814655 - DNA, 25 bp, Mus musculus
tggacaaccgattgaattactcagc

SEQ ID NO: 814656 - DNA, 25 bp, Mus musculus
tggacaaccttgagatcaacacgta

SEQ ID NO: 814657 - DNA, 25 bp, Mus musculus
tggacaaccttgaggctcctcatga

SEQ ID NO: 814658 - DNA, 25 bp, Mus musculus
tggacaaccttgtgatcaacacgta

SEQ ID NO: 814659 - DNA, 25 bp, Mus musculus
tggacaaccttgtggctcctcatga

SEQ ID NO: 814660 - DNA, 25 bp, Mus musculus
tggacaacgatgagctccggcaaca

SEQ ID NO: 814661 - DNA, 25 bp, Mus musculus
tggacaacgatgtgctccggcaaca

SEQ ID NO: 814662 - DNA, 25 bp, Mus musculus
tggacaactccaagtactgccgttt

SEQ ID NO: 814663 - DNA, 25 bp, Mus musculus
tggacaactccatgtactgccgttt

SEQ ID NO: 814664 - DNA, 25 bp, Mus musculus
tggacaactggaaggtgttcctagg

SEQ ID NO: 814665 - DNA, 25 bp, Mus musculus
tggacaactggatggtgttcctagg

SEQ ID NO: 814666 - DNA, 25 bp, Mus musculus
tggacaacttatccaaacctgtggc

SEQ ID NO: 814667 - DNA, 25 bp, Mus musculus
tggacaacttatgcaaacctgtggc

SEQ ID NO: 814668 - DNA, 25 bp, Mus musculus
tggacaacttcaccgagatcatcaa

SEQ ID NO: 814669 - DNA, 25 bp, Mus musculus
tggacaacttcagcgagatcatcaa

SEQ ID NO: 814670 - DNA, 25 bp, Mus musculus
tggacaacttctcggcatgtgtgac

SEQ ID NO: 814671 - DNA, 25 bp, Mus musculus
tggacaacttctgggcatgtgtgac

SEQ ID NO: 814672 - DNA, 25 bp, Mus musculus
tggacaacttgccttgcactggcct

SEQ ID NO: 814673 - DNA, 25 bp, Mus musculus
tggacaacttgcgttgcactggcct

SEQ ID NO: 814674 - DNA, 25 bp, Mus musculus
tggacaagagtgcaatttcaggcca

SEQ ID NO: 814675 - DNA, 25 bp, Mus musculus
tggacaagagtggaatttcaggcca

SEQ ID NO: 814676 - DNA, 25 bp, Mus musculus
tggacaagatctcttttctaagacc

SEQ ID NO: 814677 - DNA, 25 bp, Mus musculus
tggacaagatctgttttctaagacc

SEQ ID NO: 814678 - DNA, 25 bp, Mus musculus
tggacaagattgatggctacgaatg

SEQ ID NO: 814679 - DNA, 25 bp, Mus musculus
tggacaagattgttggctacgaatg

SEQ ID NO: 814680 - DNA, 25 bp, Mus musculus
tggacaagatttccccgtgataccc

SEQ ID NO: 814681 - DNA, 25 bp, Mus musculus
tggacaagatttgcccgtgataccc

SEQ ID NO: 814682 - DNA, 25 bp, Mus musculus
tggacaagcagaccttctgctcctc

SEQ ID NO: 814683 - DNA, 25 bp, Mus musculus
tggacaagcagagcttctgctcctc

SEQ ID NO: 814684 - DNA, 25 bp, Mus musculus
tggacaagctccctctgtggcctca

SEQ ID NO: 814685 - DNA, 25 bp, Mus musculus
tggacaagctccgtctgtggcctca

SEQ ID NO: 814686 - DNA, 25 bp, Mus musculus
tggacaagctgtacgtgatcactct

SEQ ID NO: 814687 - DNA, 25 bp, Mus musculus
tggacaagctgttcgtgatcactct

SEQ ID NO: 814688 - DNA, 25 bp, Mus musculus
tggacaaggatccacaagcctggaa

SEQ ID NO: 814689 - DNA, 25 bp, Mus musculus
tggacaaggatcgacaagcctggaa

SEQ ID NO: 814690 - DNA, 25 bp, Mus musculus
tggacaaggcgtagtgaaactggat

SEQ ID NO: 814691 - DNA, 25 bp, Mus musculus
tggacaaggcgttgtgaaactggat

SEQ ID NO: 814692 - DNA, 25 bp, Mus musculus
tggacaaggtctaggtccacccacc

SEQ ID NO: 814693 - DNA, 25 bp, Mus musculus
tggacaaggtcttggtccacccacc

SEQ ID NO: 814694 - DNA, 25 bp, Mus musculus
tggacaaggtggaaacttggaccga

SEQ ID NO: 814695 - DNA, 25 bp, Mus musculus
tggacaaggtggtaacttggaccga

SEQ ID NO: 814696 - DNA, 25 bp, Mus musculus
tggacaagtacaacgctgagaagcc

SEQ ID NO: 814697 - DNA, 25 bp, Mus musculus
tggacaagtacatcgctgagaagcc

SEQ ID NO: 814698 - DNA, 25 bp, Mus musculus
tggacaagttgtactggagaatgta

SEQ ID NO: 814699 - DNA, 25 bp, Mus musculus
tggacaagttgttctggagaatgta

SEQ ID NO: 814700 - DNA, 25 bp, Mus musculus
tggacaatattcctgtagatcaatg

SEQ ID NO: 814701 - DNA, 25 bp, Mus musculus
tggacaatattcgtgtagatcaatg

SEQ ID NO: 814702 - DNA, 25 bp, Mus musculus
tggacaatcactacagatccctgaa

SEQ ID NO: 814703 - DNA, 25 bp, Mus musculus
tggacaatcacttcagatccctgaa

SEQ ID NO: 814704 - DNA, 25 bp, Mus musculus
tggacaatcattagcacagacaagg

SEQ ID NO: 814705 - DNA, 25 bp, Mus musculus
tggacaatcatttgcacagacaagg

SEQ ID NO: 814706 - DNA, 25 bp, Mus musculus
tggacaatctatctcaggacaaatt

SEQ ID NO: 814707 - DNA, 25 bp, Mus musculus
tggacaatctatgtcaggacaaatt

SEQ ID NO: 814708 - DNA, 25 bp, Mus musculus
tggacaatctcaaggatatgctggt

SEQ ID NO: 814709 - DNA, 25 bp, Mus musculus
tggacaatctcatggatatgctggt

SEQ ID NO: 814710 - DNA, 25 bp, Mus musculus
tggacaatggccctggctttgcccg

SEQ ID NO: 814711 - DNA, 25 bp, Mus musculus
tggacaatggccgtggctttgcccg

SEQ ID NO: 814712 - DNA, 25 bp, Mus musculus
tggacaatggctactataccgttaa

SEQ ID NO: 814713 - DNA, 25 bp, Mus musculus
tggacaatggcttctataccgttaa

SEQ ID NO: 814714 - DNA, 25 bp, Mus musculus
tggacaatgtgaaccgctggtttgg

SEQ ID NO: 814715 - DNA, 25 bp, Mus musculus
tggacaatgtgaagctagacaggga

SEQ ID NO: 814716 - DNA, 25 bp, Mus musculus
tggacaatgtgatccgctggtttgg

SEQ ID NO: 814717 - DNA, 25 bp, Mus musculus
tggacaatgtgatgctagacaggga

SEQ ID NO: 814718 - DNA, 25 bp, Mus musculus
tggacaattccaaggcagtccaggg

SEQ ID NO: 814719 - DNA, 25 bp, Mus musculus
tggacaattccatggcagtccaggg

SEQ ID NO: 814720 - DNA, 25 bp, Mus musculus
tggacaattctaagacctcaaggag

SEQ ID NO: 814721 - DNA, 25 bp, Mus musculus
tggacaattctatgacctcaaggag

SEQ ID NO: 814722 - DNA, 25 bp, Mus musculus
tggacaattggcctccaagaccgag

SEQ ID NO: 814723 - DNA, 25 bp, Mus musculus
tggacaattggcgtccaagaccgag

SEQ ID NO: 814724 - DNA, 25 bp, Mus musculus
tggacacaacagagtctgtcggaat

SEQ ID NO: 814725 - DNA, 25 bp, Mus musculus
tggacacaacagtgtctgtcggaat

SEQ ID NO: 814726 - DNA, 25 bp, Mus musculus
tggacacaagcaccggagtcctgct

SEQ ID NO: 814727 - DNA, 25 bp, Mus musculus
tggacacaagcagcggagtcctgct

SEQ ID NO: 814728 - DNA, 25 bp, Mus musculus
tggacacaccacagagatcttgacg

SEQ ID NO: 814729 - DNA, 25 bp, Mus musculus
tggacacaccactgagatcttgacg

SEQ ID NO: 814730 - DNA, 25 bp, Mus musculus
tggacacactacagtattgcttcca

SEQ ID NO: 814731 - DNA, 25 bp, Mus musculus
tggacacactactgtattgcttcca

SEQ ID NO: 814732 - DNA, 25 bp, Mus musculus
tggacacagagcatatatcttctag

SEQ ID NO: 814733 - DNA, 25 bp, Mus musculus
tggacacagagcttatatcttctag

SEQ ID NO: 814734 - DNA, 25 bp, Mus musculus
tggacacagcaacggtctactttgg

SEQ ID NO: 814735 - DNA, 25 bp, Mus musculus
tggacacagcaagggtctactttgg

SEQ ID NO: 814736 - DNA, 25 bp, Mus musculus
tggacacagcagagaaatccgagtg

SEQ ID NO: 814737 - DNA, 25 bp, Mus musculus
tggacacagcagtgaaatccgagtg

SEQ ID NO: 814738 - DNA, 25 bp, Mus musculus
tggacacaggcgacataaggcttca

SEQ ID NO: 814739 - DNA, 25 bp, Mus musculus
tggacacaggcgtcataaggcttca

SEQ ID NO: 814740 - DNA, 25 bp, Mus musculus
tggacacatcctagacttcacctgt

SEQ ID NO: 814741 - DNA, 25 bp, Mus musculus
tggacacatccttgacttcacctgt

SEQ ID NO: 814742 - DNA, 25 bp, Mus musculus
tggacaccaaacaaggtgatttatg

SEQ ID NO: 814743 - DNA, 25 bp, Mus musculus
tggacaccaaactaggtgatttatg

SEQ ID NO: 814744 - DNA, 25 bp, Mus musculus
tggacaccaaccagctagacgctag

SEQ ID NO: 814745 - DNA, 25 bp, Mus musculus
tggacaccaacctgctagacgctag

SEQ ID NO: 814746 - DNA, 25 bp, Mus musculus
tggacaccaatacaacagagtaccc

SEQ ID NO: 814747 - DNA, 25 bp, Mus musculus
tggacaccaatagaacagagtaccc

SEQ ID NO: 814748 - DNA, 25 bp, Mus musculus
tggacaccagtgaaaacagacctga

SEQ ID NO: 814749 - DNA, 25 bp, Mus musculus
tggacaccagtgtaaacagacctga

SEQ ID NO: 814750 - DNA, 25 bp, Mus musculus
tggacaccatcaaacagtactacgt

SEQ ID NO: 814751 - DNA, 25 bp, Mus musculus
tggacaccatcatacagtactacgt

SEQ ID NO: 814752 - DNA, 25 bp, Mus musculus
tggacaccatcgctgtctccggctg

SEQ ID NO: 814753 - DNA, 25 bp, Mus musculus
tggacaccatcggtgtctccggctg

SEQ ID NO: 814754 - DNA, 25 bp, Mus musculus
tggacaccattaagacaaggctgca

SEQ ID NO: 814755 - DNA, 25 bp, Mus musculus
tggacaccattatgacaaggctgca

SEQ ID NO: 814756 - DNA, 25 bp, Mus musculus
tggacaccattgaacaggagaccat

SEQ ID NO: 814757 - DNA, 25 bp, Mus musculus
tggacaccattgtacaggagaccat

SEQ ID NO: 814758 - DNA, 25 bp, Mus musculus
tggacaccatttatagcctccccgg

SEQ ID NO: 814759 - DNA, 25 bp, Mus musculus
tggacaccatttttagcctccccgg

SEQ ID NO: 814760 - DNA, 25 bp, Mus musculus
tggacacccactccctgaagatggt

SEQ ID NO: 814761 - DNA, 25 bp, Mus musculus
tggacacccactgcctgaagatggt

SEQ ID NO: 814762 - DNA, 25 bp, Mus musculus
tggacacccagaaaacctaccagtg

SEQ ID NO: 814763 - DNA, 25 bp, Mus musculus
tggacacccagataacctaccagtg

SEQ ID NO: 814764 - DNA, 25 bp, Mus musculus
tggacacccagtaagtatgcagaca

SEQ ID NO: 814765 - DNA, 25 bp, Mus musculus
tggacacccagttagtatgcagaca

SEQ ID NO: 814766 - DNA, 25 bp, Mus musculus
tggacaccccttcaaggaaagcccg

SEQ ID NO: 814767 - DNA, 25 bp, Mus musculus
tggacaccccttgaaggaaagcccg

SEQ ID NO: 814768 - DNA, 25 bp, Mus musculus
tggacaccctggctaaagaagcatc

SEQ ID NO: 814769 - DNA, 25 bp, Mus musculus
tggacaccctgggtaaagaagcatc

SEQ ID NO: 814770 - DNA, 25 bp, Mus musculus
tggacaccggcaagccattccttca

SEQ ID NO: 814771 - DNA, 25 bp, Mus musculus
tggacaccggcatgccattccttca

SEQ ID NO: 814772 - DNA, 25 bp, Mus musculus
tggacaccggtgaaaacccagaggt

SEQ ID NO: 814773 - DNA, 25 bp, Mus musculus
tggacaccggtgtaaacccagaggt

SEQ ID NO: 814774 - DNA, 25 bp, Mus musculus
tggacacctatgacttcgtgtatga

SEQ ID NO: 814775 - DNA, 25 bp, Mus musculus
tggacacctatgtcttcgtgtatga

SEQ ID NO: 814776 - DNA, 25 bp, Mus musculus
tggacacctgaaactctaatgacct

SEQ ID NO: 814777 - DNA, 25 bp, Mus musculus
tggacacctgaatctctaatgacct

SEQ ID NO: 814778 - DNA, 25 bp, Mus musculus
tggacacctgggaagatgccgtttc

SEQ ID NO: 814779 - DNA, 25 bp, Mus musculus
tggacacctgggtagatgccgtttc

SEQ ID NO: 814780 - DNA, 25 bp, Mus musculus
tggacaccttacaacttgagcctgg

SEQ ID NO: 814781 - DNA, 25 bp, Mus musculus
tggacaccttactacttgagcctgg

SEQ ID NO: 814782 - DNA, 25 bp, Mus musculus
tggacacgacaaccgagtcagctgc

SEQ ID NO: 814783 - DNA, 25 bp, Mus musculus
tggacacgacaagcgagtcagctgc

SEQ ID NO: 814784 - DNA, 25 bp, Mus musculus
tggacacgataccattgttcacttg

SEQ ID NO: 814785 - DNA, 25 bp, Mus musculus
tggacacgatacgattgttcacttg

SEQ ID NO: 814786 - DNA, 25 bp, Mus musculus
tggacacgatgcatcctagcaggcg

SEQ ID NO: 814787 - DNA, 25 bp, Mus musculus
tggacacgatgcttcctagcaggcg

SEQ ID NO: 814788 - DNA, 25 bp, Mus musculus
tggacacggtggcatctggtcattt

SEQ ID NO: 814789 - DNA, 25 bp, Mus musculus
tggacacggtgggatctggtcattt

SEQ ID NO: 814790 - DNA, 25 bp, Mus musculus
tggacactagagcaaaattcatcct

SEQ ID NO: 814791 - DNA, 25 bp, Mus musculus
tggacactagaggaaaattcatcct

SEQ ID NO: 814792 - DNA, 25 bp, Mus musculus
tggacactagcaccatgagagccgc

SEQ ID NO: 814793 - DNA, 25 bp, Mus musculus
tggacactagcagcatgagagccgc

SEQ ID NO: 814794 - DNA, 25 bp, Mus musculus
tggacactatcgatgtcagcaacct

SEQ ID NO: 814795 - DNA, 25 bp, Mus musculus
tggacactatcgttgtcagcaacct

SEQ ID NO: 814796 - DNA, 25 bp, Mus musculus
tggacactcagcacaatgtcactga

SEQ ID NO: 814797 - DNA, 25 bp, Mus musculus
tggacactcagctcaatgtcactga

SEQ ID NO: 814798 - DNA, 25 bp, Mus musculus
tggacactgaagagttacgtttacc

SEQ ID NO: 814799 - DNA, 25 bp, Mus musculus
tggacactgaagtgttacgtttacc

SEQ ID NO: 814800 - DNA, 25 bp, Mus musculus
tggacactggccctcaagagtgact

SEQ ID NO: 814801 - DNA, 25 bp, Mus musculus
tggacactggccgtcaagagtgact

SEQ ID NO: 814802 - DNA, 25 bp, Mus musculus
tggacacttcatatccccgtgagga

SEQ ID NO: 814803 - DNA, 25 bp, Mus musculus
tggacacttcatttccccgtgagga

SEQ ID NO: 814804 - DNA, 25 bp, Mus musculus
tggacacttggcagcacctgagagc

SEQ ID NO: 814805 - DNA, 25 bp, Mus musculus
tggacacttggctgcacctgagagc

SEQ ID NO: 814806 - DNA, 25 bp, Mus musculus
tggacactttgcaaatgacagattt

SEQ ID NO: 814807 - DNA, 25 bp, Mus musculus
tggacactttgctaatgacagattt

SEQ ID NO: 814808 - DNA, 25 bp, Mus musculus
tggacagaaaacatcagctgccctg

SEQ ID NO: 814809 - DNA, 25 bp, Mus musculus
tggacagaaaacttcagctgccctg

SEQ ID NO: 814810 - DNA, 25 bp, Mus musculus
tggacagaaactcatctatgctggc

SEQ ID NO: 814811 - DNA, 25 bp, Mus musculus
tggacagaaactgatctatgctggc

SEQ ID NO: 814812 - DNA, 25 bp, Mus musculus
tggacagaacccctttccactatag

SEQ ID NO: 814813 - DNA, 25 bp, Mus musculus
tggacagaacccgtttccactatag

SEQ ID NO: 814814 - DNA, 25 bp, Mus musculus
tggacagaagacaccatgtagagaa

SEQ ID NO: 814815 - DNA, 25 bp, Mus musculus
tggacagaagactccatgtagagaa

SEQ ID NO: 814816 - DNA, 25 bp, Mus musculus
tggacagaagatagcagaaaatcaa

SEQ ID NO: 814817 - DNA, 25 bp, Mus musculus
tggacagaagattgcagaaaatcaa

SEQ ID NO: 814818 - DNA, 25 bp, Mus musculus
tggacagacaccagaccatggaagt

SEQ ID NO: 814819 - DNA, 25 bp, Mus musculus
tggacagacacctgaccatggaagt

SEQ ID NO: 814820 - DNA, 25 bp, Mus musculus
tggacagacaggagtaacccaggcc

SEQ ID NO: 814821 - DNA, 25 bp, Mus musculus
tggacagacaggtgtaacccaggcc

SEQ ID NO: 814822 - DNA, 25 bp, Mus musculus
tggacagacatgacgatccctctgg

SEQ ID NO: 814823 - DNA, 25 bp, Mus musculus
tggacagacatgtcgatccctctgg

SEQ ID NO: 814824 - DNA, 25 bp, Mus musculus
tggacagagaaaaccggcgatggct

SEQ ID NO: 814825 - DNA, 25 bp, Mus musculus
tggacagagaaatccggcgatggct

SEQ ID NO: 814826 - DNA, 25 bp, Mus musculus
tggacagagcacctcatcttgccac

SEQ ID NO: 814827 - DNA, 25 bp, Mus musculus
tggacagagcacgtcatcttgccac

SEQ ID NO: 814828 - DNA, 25 bp, Mus musculus
tggacagagcccacaaccaactttc

SEQ ID NO: 814829 - DNA, 25 bp, Mus musculus
tggacagagccctcaaccaactttc

SEQ ID NO: 814830 - DNA, 25 bp, Mus musculus
tggacagagtcacgcagctgagatc

SEQ ID NO: 814831 - DNA, 25 bp, Mus musculus
tggacagagtcaggcagctgagatc

SEQ ID NO: 814832 - DNA, 25 bp, Mus musculus
tggacagagtctagtggcctcgtga

SEQ ID NO: 814833 - DNA, 25 bp, Mus musculus
tggacagagtcttgtggcctcgtga

SEQ ID NO: 814834 - DNA, 25 bp, Mus musculus
tggacagagtttcatttgtaaaact

SEQ ID NO: 814835 - DNA, 25 bp, Mus musculus
tggacagagtttgatttgtaaaact

SEQ ID NO: 814836 - DNA, 25 bp, Mus musculus
tggacagatcccatcagcctatgcg

SEQ ID NO: 814837 - DNA, 25 bp, Mus musculus
tggacagatcccttcagcctatgcg

SEQ ID NO: 814838 - DNA, 25 bp, Mus musculus
tggacagatgcccacagaggaacag

SEQ ID NO: 814839 - DNA, 25 bp, Mus musculus
tggacagatgccgacagaggaacag

SEQ ID NO: 814840 - DNA, 25 bp, Mus musculus
tggacagattgcaccatccctcagc

SEQ ID NO: 814841 - DNA, 25 bp, Mus musculus
tggacagattgctccatccctcagc

SEQ ID NO: 814842 - DNA, 25 bp, Mus musculus
tggacagcaaccagatccacagcaa

SEQ ID NO: 814843 - DNA, 25 bp, Mus musculus
tggacagcaacctgatccacagcaa

SEQ ID NO: 814844 - DNA, 25 bp, Mus musculus
tggacagcaactcgcctctctttag

SEQ ID NO: 814845 - DNA, 25 bp, Mus musculus
tggacagcaactggcctctctttag

SEQ ID NO: 814846 - DNA, 25 bp, Mus musculus
tggacagcaatcactcccacttcat

SEQ ID NO: 814847 - DNA, 25 bp, Mus musculus
tggacagcaatctctcccacttcat

SEQ ID NO: 814848 - DNA, 25 bp, Mus musculus
tggacagcaccaaccgtgtcggaga

SEQ ID NO: 814849 - DNA, 25 bp, Mus musculus
tggacagcaccatccgtgtcggaga

SEQ ID NO: 814850 - DNA, 25 bp, Mus musculus
tggacagcaggacgtttccaaagtc

SEQ ID NO: 814851 - DNA, 25 bp, Mus musculus
tggacagcaggaggtttccaaagtc

SEQ ID NO: 814852 - DNA, 25 bp, Mus musculus
tggacagcagtgcatattccttcac

SEQ ID NO: 814853 - DNA, 25 bp, Mus musculus
tggacagcagtggatattccttcac

SEQ ID NO: 814854 - DNA, 25 bp, Mus musculus
tggacagcccctccatgggaaatca

SEQ ID NO: 814855 - DNA, 25 bp, Mus musculus
tggacagcccctgcatgggaaatca

SEQ ID NO: 814856 - DNA, 25 bp, Mus musculus
tggacagccgaactgtaacatctgc

SEQ ID NO: 814857 - DNA, 25 bp, Mus musculus
tggacagccgaagtgtaacatctgc

SEQ ID NO: 814858 - DNA, 25 bp, Mus musculus
tggacagcgaatctggcaaagagat

SEQ ID NO: 814859 - DNA, 25 bp, Mus musculus
tggacagcgaatgtggcaaagagat

SEQ ID NO: 814860 - DNA, 25 bp, Mus musculus
tggacagcgccacagaatcagcctt

SEQ ID NO: 814861 - DNA, 25 bp, Mus musculus
tggacagcgccagagaatcagcctt

SEQ ID NO: 814862 - DNA, 25 bp, Mus musculus
tggacagcgcctctgtcttctggaa

SEQ ID NO: 814863 - DNA, 25 bp, Mus musculus
tggacagcgcctgtgtcttctggaa

SEQ ID NO: 814864 - DNA, 25 bp, Mus musculus
tggacagcgtgtaccgtacccgctc

SEQ ID NO: 814865 - DNA, 25 bp, Mus musculus
tggacagcgtgttccgtacccgctc

SEQ ID NO: 814866 - DNA, 25 bp, Mus musculus
tggacagctcaactccaccaaaaag

SEQ ID NO: 814867 - DNA, 25 bp, Mus musculus
tggacagctcaagtccaccaaaaag

SEQ ID NO: 814868 - DNA, 25 bp, Mus musculus
tggacagctccactagtgggacgcc

SEQ ID NO: 814869 - DNA, 25 bp, Mus musculus
tggacagctccagtagtgggacgcc

SEQ ID NO: 814870 - DNA, 25 bp, Mus musculus
tggacaggacaaccgatccagacgc

SEQ ID NO: 814871 - DNA, 25 bp, Mus musculus
tggacaggacaagcgatccagacgc

SEQ ID NO: 814872 - DNA, 25 bp, Mus musculus
tggacaggatcgaccatcacacctc

SEQ ID NO: 814873 - DNA, 25 bp, Mus musculus
tggacaggatcgtccatcacacctc

SEQ ID NO: 814874 - DNA, 25 bp, Mus musculus
tggacaggcccacttcagcctactg

SEQ ID NO: 814875 - DNA, 25 bp, Mus musculus
tggacaggcccagttcagcctactg

SEQ ID NO: 814876 - DNA, 25 bp, Mus musculus
tggacaggcctcaccatggcttggg

SEQ ID NO: 814877 - DNA, 25 bp, Mus musculus
tggacaggcctctccatggcttggg

SEQ ID NO: 814878 - DNA, 25 bp, Mus musculus
tggacaggcggcattttcctatgtg

SEQ ID NO: 814879 - DNA, 25 bp, Mus musculus
tggacaggcggctttttcctatgtg

SEQ ID NO: 814880 - DNA, 25 bp, Mus musculus
tggacagggactctcctgtcaccac

SEQ ID NO: 814881 - DNA, 25 bp, Mus musculus
tggacagggactgtcctgtcaccac

SEQ ID NO: 814882 - DNA, 25 bp, Mus musculus
tggacagggcccagctcccagctag

SEQ ID NO: 814883 - DNA, 25 bp, Mus musculus
tggacagggccctgctcccagctag

SEQ ID NO: 814884 - DNA, 25 bp, Mus musculus
tggacaggtggtcttttctgagaca

SEQ ID NO: 814885 - DNA, 25 bp, Mus musculus
tggacaggtggtgttttctgagaca

SEQ ID NO: 814886 - DNA, 25 bp, Mus musculus
tggacagtaacactcgtctgcggcc

SEQ ID NO: 814887 - DNA, 25 bp, Mus musculus
tggacagtaacagtcgtctgcggcc

SEQ ID NO: 814888 - DNA, 25 bp, Mus musculus
tggacagtaagactttctgccgggc

SEQ ID NO: 814889 - DNA, 25 bp, Mus musculus
tggacagtaagagtttctgccgggc

SEQ ID NO: 814890 - DNA, 25 bp, Mus musculus
tggacagtaatacaacaccgggaag

SEQ ID NO: 814891 - DNA, 25 bp, Mus musculus
tggacagtaatagaacaccgggaag

SEQ ID NO: 814892 - DNA, 25 bp, Mus musculus
tggacagtacatcggagtggctttc

SEQ ID NO: 814893 - DNA, 25 bp, Mus musculus
tggacagtacatgggagtggctttc

SEQ ID NO: 814894 - DNA, 25 bp, Mus musculus
tggacagtaccgacggcaacgacac

SEQ ID NO: 814895 - DNA, 25 bp, Mus musculus
tggacagtaccgtcggcaacgacac

SEQ ID NO: 814896 - DNA, 25 bp, Mus musculus
tggacagtccccacctcaagtacag

SEQ ID NO: 814897 - DNA, 25 bp, Mus musculus
tggacagtcccctcctcaagtacag

SEQ ID NO: 814898 - DNA, 25 bp, Mus musculus
tggacagtcccgaaagagagctcat

SEQ ID NO: 814899 - DNA, 25 bp, Mus musculus
tggacagtcccgtaagagagctcat

SEQ ID NO: 814900 - DNA, 25 bp, Mus musculus
tggacagtccgtcggcacattgaag

SEQ ID NO: 814901 - DNA, 25 bp, Mus musculus
tggacagtccgtgggcacattgaag

SEQ ID NO: 814902 - DNA, 25 bp, Mus musculus
tggacagtcctcagaagagccgaga

SEQ ID NO: 814903 - DNA, 25 bp, Mus musculus
tggacagtcctctgaagagccgaga

SEQ ID NO: 814904 - DNA, 25 bp, Mus musculus
tggacagtcgatacctgcaagtgag

SEQ ID NO: 814905 - DNA, 25 bp, Mus musculus
tggacagtcgattcctgcaagtgag

SEQ ID NO: 814906 - DNA, 25 bp, Mus musculus
tggacagtctggagtactacagcct

SEQ ID NO: 814907 - DNA, 25 bp, Mus musculus
tggacagtctggtgtactacagcct

SEQ ID NO: 814908 - DNA, 25 bp, Mus musculus
tggacagtgaacaacggtcgggacc

SEQ ID NO: 814909 - DNA, 25 bp, Mus musculus
tggacagtgaactacggtcgggacc

SEQ ID NO: 814910 - DNA, 25 bp, Mus musculus
tggacagtgaatcctacagtaagcc

SEQ ID NO: 814911 - DNA, 25 bp, Mus musculus
tggacagtgaatgctacagtaagcc

SEQ ID NO: 814912 - DNA, 25 bp, Mus musculus
tggacagtgctgatcacaaaacgtg

SEQ ID NO: 814913 - DNA, 25 bp, Mus musculus
tggacagtgctgttcacaaaacgtg

SEQ ID NO: 814914 - DNA, 25 bp, Mus musculus
tggacagtggacactacctcggcat

SEQ ID NO: 814915 - DNA, 25 bp, Mus musculus
tggacagtggactctacctcggcat

SEQ ID NO: 814916 - DNA, 25 bp, Mus musculus
tggacagtggagctacccacaccac

SEQ ID NO: 814917 - DNA, 25 bp, Mus musculus
tggacagtggaggtacccacaccac

SEQ ID NO: 814918 - DNA, 25 bp, Mus musculus
tggacagtggccactaccctggtct

SEQ ID NO: 814919 - DNA, 25 bp, Mus musculus
tggacagtggcctctaccctggtct

SEQ ID NO: 814920 - DNA, 25 bp, Mus musculus
tggacagtgggaagtaactttgcct

SEQ ID NO: 814921 - DNA, 25 bp, Mus musculus
tggacagtgggatgtaactttgcct

SEQ ID NO: 814922 - DNA, 25 bp, Mus musculus
tggacagtgggcactcttgccaacg

SEQ ID NO: 814923 - DNA, 25 bp, Mus musculus
tggacagtgggctctcttgccaacg

SEQ ID NO: 814924 - DNA, 25 bp, Mus musculus
tggacagttccccaaaccagttcag

SEQ ID NO: 814925 - DNA, 25 bp, Mus musculus
tggacagttcccgaaaccagttcag

SEQ ID NO: 814926 - DNA, 25 bp, Mus musculus
tggacataaagcagaccaggcccta

SEQ ID NO: 814927 - DNA, 25 bp, Mus musculus
tggacataaagctgaccaggcccta

SEQ ID NO: 814928 - DNA, 25 bp, Mus musculus
tggacataagccagcagctctggag

SEQ ID NO: 814929 - DNA, 25 bp, Mus musculus
tggacataagcctgcagctctggag

SEQ ID NO: 814930 - DNA, 25 bp, Mus musculus
tggacatacatcacaagcccgtgac

SEQ ID NO: 814931 - DNA, 25 bp, Mus musculus
tggacatacatctcaagcccgtgac

SEQ ID NO: 814932 - DNA, 25 bp, Mus musculus
tggacatagccaagtcccaggatgc

SEQ ID NO: 814933 - DNA, 25 bp, Mus musculus
tggacatagccatgtcccaggatgc

SEQ ID NO: 814934 - DNA, 25 bp, Mus musculus
tggacatatggaaactatagattag

SEQ ID NO: 814935 - DNA, 25 bp, Mus musculus
tggacatatggatactatagattag

SEQ ID NO: 814936 - DNA, 25 bp, Mus musculus
tggacatcagggaggcaattggact

SEQ ID NO: 814937 - DNA, 25 bp, Mus musculus
tggacatcagggtggcaattggact

SEQ ID NO: 814938 - DNA, 25 bp, Mus musculus
tggacatcatgcatggactactggc

SEQ ID NO: 814939 - DNA, 25 bp, Mus musculus
tggacatcatgcttggactactggc

SEQ ID NO: 814940 - DNA, 25 bp, Mus musculus
tggacatcgcatccttctactggac

SEQ ID NO: 814941 - DNA, 25 bp, Mus musculus
tggacatcgcatgcttctactggac

SEQ ID NO: 814942 - DNA, 25 bp, Mus musculus
tggacatcgcctccgctgatgtgct

SEQ ID NO: 814943 - DNA, 25 bp, Mus musculus
tggacatcgcctgcgctgatgtgct

SEQ ID NO: 814944 - DNA, 25 bp, Mus musculus
tggacatctacccttcgagccggga

SEQ ID NO: 814945 - DNA, 25 bp, Mus musculus
tggacatctaccgttcgagccggga

SEQ ID NO: 814946 - DNA, 25 bp, Mus musculus
tggacatggactcatatccagaggc

SEQ ID NO: 814947 - DNA, 25 bp, Mus musculus
tggacatggactgatatccagaggc

SEQ ID NO: 814948 - DNA, 25 bp, Mus musculus
tggacatggagaaccatgcctatcg

SEQ ID NO: 814949 - DNA, 25 bp, Mus musculus
tggacatggagatccatgcctatcg

SEQ ID NO: 814950 - DNA, 25 bp, Mus musculus
tggacatggagcaccgagcagcgca

SEQ ID NO: 814951 - DNA, 25 bp, Mus musculus
tggacatggagctccgagcagcgca

SEQ ID NO: 814952 - DNA, 25 bp, Mus musculus
tggacatggcctccgaactcatgca

SEQ ID NO: 814953 - DNA, 25 bp, Mus musculus
tggacatggcctgcgaactcatgca

SEQ ID NO: 814954 - DNA, 25 bp, Mus musculus
tggacatggtccagaaatgtctccg

SEQ ID NO: 814955 - DNA, 25 bp, Mus musculus
tggacatggtcctgaaatgtctccg

SEQ ID NO: 814956 - DNA, 25 bp, Mus musculus
tggacatgtccccaaaatcacaaga

SEQ ID NO: 814957 - DNA, 25 bp, Mus musculus
tggacatgtcccgaaaatcacaaga

SEQ ID NO: 814958 - DNA, 25 bp, Mus musculus
tggacatgttggctttatctttaaa

SEQ ID NO: 814959 - DNA, 25 bp, Mus musculus
tggacatgttgggtttatctttaaa

SEQ ID NO: 814960 - DNA, 25 bp, Mus musculus
tggacattaattcatccgtgaaggg

SEQ ID NO: 814961 - DNA, 25 bp, Mus musculus
tggacattaattgatccgtgaaggg

SEQ ID NO: 814962 - DNA, 25 bp, Mus musculus
tggacattattgattccctgaggaa

SEQ ID NO: 814963 - DNA, 25 bp, Mus musculus
tggacattattgtttccctgaggaa

SEQ ID NO: 814964 - DNA, 25 bp, Mus musculus
tggacattcacaagatgaaccagtg

SEQ ID NO: 814965 - DNA, 25 bp, Mus musculus
tggacattcacatgatgaaccagtg

SEQ ID NO: 814966 - DNA, 25 bp, Mus musculus
tggacattcctgaggttgacctagt

SEQ ID NO: 814967 - DNA, 25 bp, Mus musculus
tggacattcctgtggttgacctagt

SEQ ID NO: 814968 - DNA, 25 bp, Mus musculus
tggacattgacacgctcatgaccaa

SEQ ID NO: 814969 - DNA, 25 bp, Mus musculus
tggacattgacaggctcatgaccaa

SEQ ID NO: 814970 - DNA, 25 bp, Mus musculus
tggacattgaccagtcgtccctgcg

SEQ ID NO: 814971 - DNA, 25 bp, Mus musculus
tggacattgacctgtcgtccctgcg

SEQ ID NO: 814972 - DNA, 25 bp, Mus musculus
tggacattgtgcaccaggtcgccat

SEQ ID NO: 814973 - DNA, 25 bp, Mus musculus
tggacattgtgctccaggtcgccat

SEQ ID NO: 814974 - DNA, 25 bp, Mus musculus
tggacattgtggcatcgctttgaag

SEQ ID NO: 814975 - DNA, 25 bp, Mus musculus
tggacattgtgggatcgctttgaag

SEQ ID NO: 814976 - DNA, 25 bp, Mus musculus
tggacatttgagcaacagacagcag

SEQ ID NO: 814977 - DNA, 25 bp, Mus musculus
tggacatttgaggaacagacagcag

SEQ ID NO: 814978 - DNA, 25 bp, Mus musculus
tggacatttttgaggatctgcccgg

SEQ ID NO: 814979 - DNA, 25 bp, Mus musculus
tggacatttttgtggatctgcccgg

SEQ ID NO: 814980 - DNA, 25 bp, Mus musculus
tggaccaaaaggacaagcagttcgt

SEQ ID NO: 814981 - DNA, 25 bp, Mus musculus
tggaccaaaaggtcaagcagttcgt

SEQ ID NO: 814982 - DNA, 25 bp, Mus musculus
tggaccaaatccaagaccagtttaa

SEQ ID NO: 814983 - DNA, 25 bp, Mus musculus
tggaccaaatcctagaccagtttaa

SEQ ID NO: 814984 - DNA, 25 bp, Mus musculus
tggaccaaatgtaacctcagagaga

SEQ ID NO: 814985 - DNA, 25 bp, Mus musculus
tggaccaaatgttacctcagagaga

SEQ ID NO: 814986 - DNA, 25 bp, Mus musculus
tggaccaacacaagctcagcaggga

SEQ ID NO: 814987 - DNA, 25 bp, Mus musculus
tggaccaacacatgctcagcaggga

SEQ ID NO: 814988 - DNA, 25 bp, Mus musculus
tggaccaagtcacaataccgtgaac

SEQ ID NO: 814989 - DNA, 25 bp, Mus musculus
tggaccaagtcagaataccgtgaac

SEQ ID NO: 814990 - DNA, 25 bp, Mus musculus
tggaccaagtctcgccgtgagaagc

SEQ ID NO: 814991 - DNA, 25 bp, Mus musculus
tggaccaagtctggccgtgagaagc

SEQ ID NO: 814992 - DNA, 25 bp, Mus musculus
tggaccaatccaaggagggctgcag

SEQ ID NO: 814993 - DNA, 25 bp, Mus musculus
tggaccaatccatggagggctgcag

SEQ ID NO: 814994 - DNA, 25 bp, Mus musculus
tggaccaatcggagagagaaggtca

SEQ ID NO: 814995 - DNA, 25 bp, Mus musculus
tggaccaatcggtgagagaaggtca

SEQ ID NO: 814996 - DNA, 25 bp, Mus musculus
tggaccacaacccagcaaaatctca

SEQ ID NO: 814997 - DNA, 25 bp, Mus musculus
tggaccacaaccgagcaaaatctca

SEQ ID NO: 814998 - DNA, 25 bp, Mus musculus
tggaccacacttcccttatttaagc

SEQ ID NO: 814999 - DNA, 25 bp, Mus musculus
tggaccacacttgccttatttaagc

SEQ ID NO: 815000 - DNA, 25 bp, Mus musculus
tggaccacagtcattgagcgcacct

SEQ ID NO: 815001 - DNA, 25 bp, Mus musculus
tggaccacagtctttgagcgcacct

SEQ ID NO: 815002 - DNA, 25 bp, Mus musculus
tggaccacccctcggttctatggct

SEQ ID NO: 815003 - DNA, 25 bp, Mus musculus
tggaccacccctgggttctatggct

SEQ ID NO: 815004 - DNA, 25 bp, Mus musculus
tggaccacctccctctaggcagtac

SEQ ID NO: 815005 - DNA, 25 bp, Mus musculus
tggaccacctccgtctaggcagtac

SEQ ID NO: 815006 - DNA, 25 bp, Mus musculus
tggaccacgcccacaatgacatgac

SEQ ID NO: 815007 - DNA, 25 bp, Mus musculus
tggaccacgccctcaatgacatgac

SEQ ID NO: 815008 - DNA, 25 bp, Mus musculus
tggaccacgtggagccaatgatctc

SEQ ID NO: 815009 - DNA, 25 bp, Mus musculus
tggaccacgtggaggcaaatcctcc

SEQ ID NO: 815010 - DNA, 25 bp, Mus musculus
tggaccacgtggtgccaatgatctc

SEQ ID NO: 815011 - DNA, 25 bp, Mus musculus
tggaccacgtggtggcaaatcctcc

SEQ ID NO: 815012 - DNA, 25 bp, Mus musculus
tggaccactataatgaaattaagcg

SEQ ID NO: 815013 - DNA, 25 bp, Mus musculus
tggaccactatattgaaattaagcg

SEQ ID NO: 815014 - DNA, 25 bp, Mus musculus
tggaccactcatctgtgggacctca

SEQ ID NO: 815015 - DNA, 25 bp, Mus musculus
tggaccactcatgtgtgggacctca

SEQ ID NO: 815016 - DNA, 25 bp, Mus musculus
tggaccactttgagtctgactgcag

SEQ ID NO: 815017 - DNA, 25 bp, Mus musculus
tggaccactttgtgtctgactgcag

SEQ ID NO: 815018 - DNA, 25 bp, Mus musculus
tggaccagaatgaggttatggctcc

SEQ ID NO: 815019 - DNA, 25 bp, Mus musculus
tggaccagaatgtggttatggctcc

SEQ ID NO: 815020 - DNA, 25 bp, Mus musculus
tggaccagcacaacctcaagcaaaa

SEQ ID NO: 815021 - DNA, 25 bp, Mus musculus
tggaccagcacatcctcaagcaaaa

SEQ ID NO: 815022 - DNA, 25 bp, Mus musculus
tggaccagcagaatcagaacggctc

SEQ ID NO: 815023 - DNA, 25 bp, Mus musculus
tggaccagcagattcagaacggctc

SEQ ID NO: 815024 - DNA, 25 bp, Mus musculus
tggaccagcgaaatcagctcctgga

SEQ ID NO: 815025 - DNA, 25 bp, Mus musculus
tggaccagcgaattcagctcctgga

SEQ ID NO: 815026 - DNA, 25 bp, Mus musculus
tggaccagcgcaatcagcggctaga

SEQ ID NO: 815027 - DNA, 25 bp, Mus musculus
tggaccagcgcattcagcggctaga

SEQ ID NO: 815028 - DNA, 25 bp, Mus musculus
tggaccagctataccttcagttgtg

SEQ ID NO: 815029 - DNA, 25 bp, Mus musculus
tggaccagctattccttcagttgtg

SEQ ID NO: 815030 - DNA, 25 bp, Mus musculus
tggaccaggcgacctcaggaatttc

SEQ ID NO: 815031 - DNA, 25 bp, Mus musculus
tggaccaggcgagctcaggaatttc

SEQ ID NO: 815032 - DNA, 25 bp, Mus musculus
tggaccagggcaacgatcccaatag

SEQ ID NO: 815033 - DNA, 25 bp, Mus musculus
tggaccagggcatcgatcccaatag

SEQ ID NO: 815034 - DNA, 25 bp, Mus musculus
tggaccagtatgaaaccaaagagtg

SEQ ID NO: 815035 - DNA, 25 bp, Mus musculus
tggaccagtatgtaaccaaagagtg

SEQ ID NO: 815036 - DNA, 25 bp, Mus musculus
tggaccagttcacgaagcatcagca

SEQ ID NO: 815037 - DNA, 25 bp, Mus musculus
tggaccagttcaggaagcatcagca

SEQ ID NO: 815038 - DNA, 25 bp, Mus musculus
tggaccatagccagcacacactgag

SEQ ID NO: 815039 - DNA, 25 bp, Mus musculus
tggaccatagcctgcacacactgag

SEQ ID NO: 815040 - DNA, 25 bp, Mus musculus
tggaccatagttactcctccaacac

SEQ ID NO: 815041 - DNA, 25 bp, Mus musculus
tggaccatagtttctcctccaacac

SEQ ID NO: 815042 - DNA, 25 bp, Mus musculus
tggaccatcagcaagaaccaaaggc

SEQ ID NO: 815043 - DNA, 25 bp, Mus musculus
tggaccatcagctagaaccaaaggc

SEQ ID NO: 815044 - DNA, 25 bp, Mus musculus
tggaccatcctgagctacgtaataa

SEQ ID NO: 815045 - DNA, 25 bp, Mus musculus
tggaccatcctgtgctacgtaataa

SEQ ID NO: 815046 - DNA, 25 bp, Mus musculus
tggaccatctatccctatgacagag

SEQ ID NO: 815047 - DNA, 25 bp, Mus musculus
tggaccatctatgcctatgacagag

SEQ ID NO: 815048 - DNA, 25 bp, Mus musculus
tggaccatgtacagtgaccatattg

SEQ ID NO: 815049 - DNA, 25 bp, Mus musculus
tggaccatgtactgtgaccatattg

SEQ ID NO: 815050 - DNA, 25 bp, Mus musculus
tggaccatgtccatgtgtacaaaag

SEQ ID NO: 815051 - DNA, 25 bp, Mus musculus
tggaccatgtccttgtgtacaaaag

SEQ ID NO: 815052 - DNA, 25 bp, Mus musculus
tggaccatgtgtatcctgacgctgg

SEQ ID NO: 815053 - DNA, 25 bp, Mus musculus
tggaccatgtgtttcctgacgctgg

SEQ ID NO: 815054 - DNA, 25 bp, Mus musculus
tggaccattcctcaagtctcaaagg

SEQ ID NO: 815055 - DNA, 25 bp, Mus musculus
tggaccattcctgaagtctcaaagg

SEQ ID NO: 815056 - DNA, 25 bp, Mus musculus
tggaccatttcgacctttaggcacc

SEQ ID NO: 815057 - DNA, 25 bp, Mus musculus
tggaccatttcgtcctttaggcacc

SEQ ID NO: 815058 - DNA, 25 bp, Mus musculus
tggacccaaattagaaagtgatttc

SEQ ID NO: 815059 - DNA, 25 bp, Mus musculus
tggacccaaatttgaaagtgatttc

SEQ ID NO: 815060 - DNA, 25 bp, Mus musculus
tggacccaacagaactctgatcatc

SEQ ID NO: 815061 - DNA, 25 bp, Mus musculus
tggacccaacagtactctgatcatc

SEQ ID NO: 815062 - DNA, 25 bp, Mus musculus
tggacccaacgcagctcacagatgc

SEQ ID NO: 815063 - DNA, 25 bp, Mus musculus
tggacccaacgctgctcacagatgc

SEQ ID NO: 815064 - DNA, 25 bp, Mus musculus
tggacccacacaccagggtctgcaa

SEQ ID NO: 815065 - DNA, 25 bp, Mus musculus
tggacccacacagcagggtctgcaa

SEQ ID NO: 815066 - DNA, 25 bp, Mus musculus
tggacccacactaggaactagcctc

SEQ ID NO: 815067 - DNA, 25 bp, Mus musculus
tggacccacactcttacgacacagt

SEQ ID NO: 815068 - DNA, 25 bp, Mus musculus
tggacccacactgttacgacacagt

SEQ ID NO: 815069 - DNA, 25 bp, Mus musculus
tggacccacacttggaactagcctc

SEQ ID NO: 815070 - DNA, 25 bp, Mus musculus
tggacccaccgaagaaagcagtcct

SEQ ID NO: 815071 - DNA, 25 bp, Mus musculus
tggacccaccgatgaaagcagtcct

SEQ ID NO: 815072 - DNA, 25 bp, Mus musculus
tggacccagaacctgtaggagcctt

SEQ ID NO: 815073 - DNA, 25 bp, Mus musculus
tggacccagaacgtgtaggagcctt

SEQ ID NO: 815074 - DNA, 25 bp, Mus musculus
tggacccagaatagcccttcgcagg

SEQ ID NO: 815075 - DNA, 25 bp, Mus musculus
tggacccagaattgcccttcgcagg

SEQ ID NO: 815076 - DNA, 25 bp, Mus musculus
tggacccagcctcccagaaaacaga

SEQ ID NO: 815077 - DNA, 25 bp, Mus musculus
tggacccagcctgccagaaaacaga

SEQ ID NO: 815078 - DNA, 25 bp, Mus musculus
tggacccagcggaactttgatagct

SEQ ID NO: 815079 - DNA, 25 bp, Mus musculus
tggacccagcggtactttgatagct

SEQ ID NO: 815080 - DNA, 25 bp, Mus musculus
tggacccagtatagcggcattaact

SEQ ID NO: 815081 - DNA, 25 bp, Mus musculus
tggacccagtattgcggcattaact

SEQ ID NO: 815082 - DNA, 25 bp, Mus musculus
tggacccatgagagaacctagagtc

SEQ ID NO: 815083 - DNA, 25 bp, Mus musculus
tggacccatgagtgaacctagagtc

SEQ ID NO: 815084 - DNA, 25 bp, Mus musculus
tggaccccaagccttagtaaacata

SEQ ID NO: 815085 - DNA, 25 bp, Mus musculus
tggaccccaagcgttagtaaacata

SEQ ID NO: 815086 - DNA, 25 bp, Mus musculus
tggaccccaccaaggataccatcat

SEQ ID NO: 815087 - DNA, 25 bp, Mus musculus
tggaccccaccatggataccatcat

SEQ ID NO: 815088 - DNA, 25 bp, Mus musculus
tggaccccagaaatgcagaagtatt

SEQ ID NO: 815089 - DNA, 25 bp, Mus musculus
tggaccccagaattgcagaagtatt

SEQ ID NO: 815090 - DNA, 25 bp, Mus musculus
tggaccccatgcatgctgaggcgcc

SEQ ID NO: 815091 - DNA, 25 bp, Mus musculus
tggaccccatgcttgctgaggcgcc

SEQ ID NO: 815092 - DNA, 25 bp, Mus musculus
tggaccccgatcagtaccaggactt

SEQ ID NO: 815093 - DNA, 25 bp, Mus musculus
tggaccccgatctgtaccaggactt

SEQ ID NO: 815094 - DNA, 25 bp, Mus musculus
tggaccccgcgcagcggattgacag

SEQ ID NO: 815095 - DNA, 25 bp, Mus musculus
tggaccccgcgctgcggattgacag

SEQ ID NO: 815096 - DNA, 25 bp, Mus musculus
tggaccccgtgaaggacatgctgat

SEQ ID NO: 815097 - DNA, 25 bp, Mus musculus
tggaccccgtgatggacatgctgat

SEQ ID NO: 815098 - DNA, 25 bp, Mus musculus
tggaccccgttaccaatcaaaatct

SEQ ID NO: 815099 - DNA, 25 bp, Mus musculus
tggaccccgttagcaatcaaaatct

SEQ ID NO: 815100 - DNA, 25 bp, Mus musculus
tggacccctatgataagaagctgct

SEQ ID NO: 815101 - DNA, 25 bp, Mus musculus
tggacccctatgttaagaagctgct

SEQ ID NO: 815102 - DNA, 25 bp, Mus musculus
tggacccctctcaacaagttcagct

SEQ ID NO: 815103 - DNA, 25 bp, Mus musculus
tggacccctctctacaagttcagct

SEQ ID NO: 815104 - DNA, 25 bp, Mus musculus
tggacccctgaacgtaacccctgat

SEQ ID NO: 815105 - DNA, 25 bp, Mus musculus
tggacccctgaaggtaacccctgat

SEQ ID NO: 815106 - DNA, 25 bp, Mus musculus
tggacccctgagcactggaaggaca

SEQ ID NO: 815107 - DNA, 25 bp, Mus musculus
tggacccctgaggactggaaggaca

SEQ ID NO: 815108 - DNA, 25 bp, Mus musculus
tggacccctgtgacattgttggaca

SEQ ID NO: 815109 - DNA, 25 bp, Mus musculus
tggacccctgtgtcattgttggaca

SEQ ID NO: 815110 - DNA, 25 bp, Mus musculus
tggaccccttgcactgtaacatggc

SEQ ID NO: 815111 - DNA, 25 bp, Mus musculus
tggaccccttgctctgtaacatggc

SEQ ID NO: 815112 - DNA, 25 bp, Mus musculus
tggacccggcacagcagcgactgta

SEQ ID NO: 815113 - DNA, 25 bp, Mus musculus
tggacccggcactgcagcgactgta

SEQ ID NO: 815114 - DNA, 25 bp, Mus musculus
tggacccgggcgatgtggacaactt

SEQ ID NO: 815115 - DNA, 25 bp, Mus musculus
tggacccgggcgttgtggacaactt

SEQ ID NO: 815116 - DNA, 25 bp, Mus musculus
tggacccggttaccacggaagagca

SEQ ID NO: 815117 - DNA, 25 bp, Mus musculus
tggacccggttagcacggaagagca

SEQ ID NO: 815118 - DNA, 25 bp, Mus musculus
tggacccgtctcagctgcttgtgga

SEQ ID NO: 815119 - DNA, 25 bp, Mus musculus
tggacccgtctctgctgcttgtgga

SEQ ID NO: 815120 - DNA, 25 bp, Mus musculus
tggaccctcacaataccacagagct

SEQ ID NO: 815121 - DNA, 25 bp, Mus musculus
tggaccctcacattaccacagagct

SEQ ID NO: 815122 - DNA, 25 bp, Mus musculus
tggaccctctacaagcctcctgagt

SEQ ID NO: 815123 - DNA, 25 bp, Mus musculus
tggaccctctactagcctcctgagt

SEQ ID NO: 815124 - DNA, 25 bp, Mus musculus
tggaccctctttatcgccatccttg

SEQ ID NO: 815125 - DNA, 25 bp, Mus musculus
tggaccctctttttcgccatccttg

SEQ ID NO: 815126 - DNA, 25 bp, Mus musculus
tggaccctgacaaagtacctgaact

SEQ ID NO: 815127 - DNA, 25 bp, Mus musculus
tggaccctgacatagtacctgaact

SEQ ID NO: 815128 - DNA, 25 bp, Mus musculus
tggaccctgccacatacgggcagtt

SEQ ID NO: 815129 - DNA, 25 bp, Mus musculus
tggaccctgccagatacgggcagtt

SEQ ID NO: 815130 - DNA, 25 bp, Mus musculus
tggaccctggttatccccgaaacat

SEQ ID NO: 815131 - DNA, 25 bp, Mus musculus
tggaccctggttttccccgaaacat

SEQ ID NO: 815132 - DNA, 25 bp, Mus musculus
tggaccctgtgtcctattagactga

SEQ ID NO: 815133 - DNA, 25 bp, Mus musculus
tggaccctgtgtgctattagactga

SEQ ID NO: 815134 - DNA, 25 bp, Mus musculus
tggacccttttccaggtaccaccag

SEQ ID NO: 815135 - DNA, 25 bp, Mus musculus
tggacccttttcgaggtaccaccag

SEQ ID NO: 815136 - DNA, 25 bp, Mus musculus
tggaccgaagcaaacagacagtggt

SEQ ID NO: 815137 - DNA, 25 bp, Mus musculus
tggaccgaagcatacagacagtggt

SEQ ID NO: 815138 - DNA, 25 bp, Mus musculus
tggaccgagacacgctcacaaagcc

SEQ ID NO: 815139 - DNA, 25 bp, Mus musculus
tggaccgagacaggctcacaaagcc

SEQ ID NO: 815140 - DNA, 25 bp, Mus musculus
tggaccgaggcaccagcagtcacca

SEQ ID NO: 815141 - DNA, 25 bp, Mus musculus
tggaccgaggcagcagcagtcacca

SEQ ID NO: 815142 - DNA, 25 bp, Mus musculus
tggaccgagtgacagagttcctcca

SEQ ID NO: 815143 - DNA, 25 bp, Mus musculus
tggaccgagtgagagagttcctcca

SEQ ID NO: 815144 - DNA, 25 bp, Mus musculus
tggaccgatcggcactgcacaggac

SEQ ID NO: 815145 - DNA, 25 bp, Mus musculus
tggaccgatcgggactgcacaggac

SEQ ID NO: 815146 - DNA, 25 bp, Mus musculus
tggaccgcagcaagatccggtcagt

SEQ ID NO: 815147 - DNA, 25 bp, Mus musculus
tggaccgcagcatgatccggtcagt

SEQ ID NO: 815148 - DNA, 25 bp, Mus musculus
tggaccgcattgaggccttgacctc

SEQ ID NO: 815149 - DNA, 25 bp, Mus musculus
tggaccgcattgtggccttgacctc

SEQ ID NO: 815150 - DNA, 25 bp, Mus musculus
tggaccgccagtcaggacagtgtct

SEQ ID NO: 815151 - DNA, 25 bp, Mus musculus
tggaccgccagtgaggacagtgtct

SEQ ID NO: 815152 - DNA, 25 bp, Mus musculus
tggaccgcgagcaactggtgcagaa

SEQ ID NO: 815153 - DNA, 25 bp, Mus musculus
tggaccgcgagcacgtgtacgagct

SEQ ID NO: 815154 - DNA, 25 bp, Mus musculus
tggaccgcgagctactggtgcagaa

SEQ ID NO: 815155 - DNA, 25 bp, Mus musculus
tggaccgcgagctcgtgtacgagct

SEQ ID NO: 815156 - DNA, 25 bp, Mus musculus
tggaccggagcacttgccagattgc

SEQ ID NO: 815157 - DNA, 25 bp, Mus musculus
tggaccggagcagttgccagattgc

SEQ ID NO: 815158 - DNA, 25 bp, Mus musculus
tggaccggattacagaccctaacta

SEQ ID NO: 815159 - DNA, 25 bp, Mus musculus
tggaccggattagagaccctaacta

SEQ ID NO: 815160 - DNA, 25 bp, Mus musculus
tggaccgtaaccctcgcttgcaatg

SEQ ID NO: 815161 - DNA, 25 bp, Mus musculus
tggaccgtaaccgtcgcttgcaatg

SEQ ID NO: 815162 - DNA, 25 bp, Mus musculus
tggaccgtgcggacttgctcgtccc

SEQ ID NO: 815163 - DNA, 25 bp, Mus musculus
tggaccgtgcggtcttgctcgtccc

SEQ ID NO: 815164 - DNA, 25 bp, Mus musculus
tggaccgttgccagagcaacttaga

SEQ ID NO: 815165 - DNA, 25 bp, Mus musculus
tggaccgttgcctgagcaacttaga

SEQ ID NO: 815166 - DNA, 25 bp, Mus musculus
tggacctaagcaagggcctgtcgag

SEQ ID NO: 815167 - DNA, 25 bp, Mus musculus
tggacctaagcatgggcctgtcgag

SEQ ID NO: 815168 - DNA, 25 bp, Mus musculus
tggacctaggtcagccgagtgtagt

SEQ ID NO: 815169 - DNA, 25 bp, Mus musculus
tggacctaggtctgccgagtgtagt

SEQ ID NO: 815170 - DNA, 25 bp, Mus musculus
tggacctagtcaccctcagaaagaa

SEQ ID NO: 815171 - DNA, 25 bp, Mus musculus
tggacctagtcagcctcagaaagaa

SEQ ID NO: 815172 - DNA, 25 bp, Mus musculus
tggacctcagttccccttcaaaggg

SEQ ID NO: 815173 - DNA, 25 bp, Mus musculus
tggacctcagttgcccttcaaaggg

SEQ ID NO: 815174 - DNA, 25 bp, Mus musculus
tggacctcatcaccattgccctgat

SEQ ID NO: 815175 - DNA, 25 bp, Mus musculus
tggacctcatcagcattgccctgat

SEQ ID NO: 815176 - DNA, 25 bp, Mus musculus
tggacctccaacagaagaactggca

SEQ ID NO: 815177 - DNA, 25 bp, Mus musculus
tggacctccaacattctggtcggaa

SEQ ID NO: 815178 - DNA, 25 bp, Mus musculus
tggacctccaaccagaccacttttg

SEQ ID NO: 815179 - DNA, 25 bp, Mus musculus
tggacctccaacgagaccacttttg

SEQ ID NO: 815180 - DNA, 25 bp, Mus musculus
tggacctccaactgaagaactggca

SEQ ID NO: 815181 - DNA, 25 bp, Mus musculus
tggacctccaactttctggtcggaa

SEQ ID NO: 815182 - DNA, 25 bp, Mus musculus
tggacctccgagaatagtgtctgga

SEQ ID NO: 815183 - DNA, 25 bp, Mus musculus
tggacctccgagtatagtgtctgga

SEQ ID NO: 815184 - DNA, 25 bp, Mus musculus
tggacctcgataaggctaaaacgcc

SEQ ID NO: 815185 - DNA, 25 bp, Mus musculus
tggacctcgatatggctaaaacgcc

SEQ ID NO: 815186 - DNA, 25 bp, Mus musculus
tggacctcgatgcacctggcagcat

SEQ ID NO: 815187 - DNA, 25 bp, Mus musculus
tggacctcgatggacctggcagcat

SEQ ID NO: 815188 - DNA, 25 bp, Mus musculus
tggacctcggctatcagcagaggca

SEQ ID NO: 815189 - DNA, 25 bp, Mus musculus
tggacctcggctttcagcagaggca

SEQ ID NO: 815190 - DNA, 25 bp, Mus musculus
tggacctcggtgcacagttacgaac

SEQ ID NO: 815191 - DNA, 25 bp, Mus musculus
tggacctcggtggacagttacgaac

SEQ ID NO: 815192 - DNA, 25 bp, Mus musculus
tggacctcgtttctgcctgtgacat

SEQ ID NO: 815193 - DNA, 25 bp, Mus musculus
tggacctcgtttgtgcctgtgacat

SEQ ID NO: 815194 - DNA, 25 bp, Mus musculus
tggacctctattagatgcactggcc

SEQ ID NO: 815195 - DNA, 25 bp, Mus musculus
tggacctctatttgatgcactggcc

SEQ ID NO: 815196 - DNA, 25 bp, Mus musculus
tggacctctgctctctacattgctg

SEQ ID NO: 815197 - DNA, 25 bp, Mus musculus
tggacctctgctgtctacattgctg

SEQ ID NO: 815198 - DNA, 25 bp, Mus musculus
tggacctctggaaagacagttaact

SEQ ID NO: 815199 - DNA, 25 bp, Mus musculus
tggacctctggatagacagttaact

SEQ ID NO: 815200 - DNA, 25 bp, Mus musculus
tggacctgagtgacattaaacacct

SEQ ID NO: 815201 - DNA, 25 bp, Mus musculus
tggacctgagtgtcattaaacacct

SEQ ID NO: 815202 - DNA, 25 bp, Mus musculus
tggacctgcaagacagaaatgagaa

SEQ ID NO: 815203 - DNA, 25 bp, Mus musculus
tggacctgcaagtcagaaatgagaa

SEQ ID NO: 815204 - DNA, 25 bp, Mus musculus
tggacctgcagacctaggtggcaca

SEQ ID NO: 815205 - DNA, 25 bp, Mus musculus
tggacctgcagagctaggtggcaca

SEQ ID NO: 815206 - DNA, 25 bp, Mus musculus
tggacctgcagcagggacaggactt

SEQ ID NO: 815207 - DNA, 25 bp, Mus musculus
tggacctgcagctgggacaggactt

SEQ ID NO: 815208 - DNA, 25 bp, Mus musculus
tggacctgcagtcgtccaagcctgc

SEQ ID NO: 815209 - DNA, 25 bp, Mus musculus
tggacctgcagtggtccaagcctgc

SEQ ID NO: 815210 - DNA, 25 bp, Mus musculus
tggacctgcccaatgagagccagct

SEQ ID NO: 815211 - DNA, 25 bp, Mus musculus
tggacctgcccattgagagccagct

SEQ ID NO: 815212 - DNA, 25 bp, Mus musculus
tggacctgcctaagacatcccgaga

SEQ ID NO: 815213 - DNA, 25 bp, Mus musculus
tggacctgcctatgacatcccgaga

SEQ ID NO: 815214 - DNA, 25 bp, Mus musculus
tggacctgctgtcgaatttggacaa

SEQ ID NO: 815215 - DNA, 25 bp, Mus musculus
tggacctgctgtggaatttggacaa

SEQ ID NO: 815216 - DNA, 25 bp, Mus musculus
tggacctgcttgcaaccttccactg

SEQ ID NO: 815217 - DNA, 25 bp, Mus musculus
tggacctgcttggaaccttccactg

SEQ ID NO: 815218 - DNA, 25 bp, Mus musculus
tggacctggaaactaccatcacact

SEQ ID NO: 815219 - DNA, 25 bp, Mus musculus
tggacctggaaagtaccatcacact

SEQ ID NO: 815220 - DNA, 25 bp, Mus musculus
tggacctggaagctacttctggcaa

SEQ ID NO: 815221 - DNA, 25 bp, Mus musculus
tggacctggaaggtacttctggcaa

SEQ ID NO: 815222 - DNA, 25 bp, Mus musculus
tggacctggacaagggctgcaccgt

SEQ ID NO: 815223 - DNA, 25 bp, Mus musculus
tggacctggacatgggctgcaccgt

SEQ ID NO: 815224 - DNA, 25 bp, Mus musculus
tggacctggactacgtgggcaagtt

SEQ ID NO: 815225 - DNA, 25 bp, Mus musculus
tggacctggacttcgtgggcaagtt

SEQ ID NO: 815226 - DNA, 25 bp, Mus musculus
tggacctggagaagtttctttcctg

SEQ ID NO: 815227 - DNA, 25 bp, Mus musculus
tggacctggagatgtttctttcctg

SEQ ID NO: 815228 - DNA, 25 bp, Mus musculus
tggacctggatgacatagctgaaga

SEQ ID NO: 815229 - DNA, 25 bp, Mus musculus
tggacctggatgtcatagctgaaga

SEQ ID NO: 815230 - DNA, 25 bp, Mus musculus
tggacctggccacccgaggcaacga

SEQ ID NO: 815231 - DNA, 25 bp, Mus musculus
tggacctggccagccgaggcaacga

SEQ ID NO: 815232 - DNA, 25 bp, Mus musculus
tggacctgggtacgacccgcagttt

SEQ ID NO: 815233 - DNA, 25 bp, Mus musculus
tggacctgggtaggacccgcagttt

SEQ ID NO: 815234 - DNA, 25 bp, Mus musculus
tggacctggtctagtgctctccaac

SEQ ID NO: 815235 - DNA, 25 bp, Mus musculus
tggacctggtcttgtgctctccaac

SEQ ID NO: 815236 - DNA, 25 bp, Mus musculus
tggaccttccaaacaagtcggcgcg

SEQ ID NO: 815237 - DNA, 25 bp, Mus musculus
tggaccttccaatcaagtcggcgcg

SEQ ID NO: 815238 - DNA, 25 bp, Mus musculus
tggaccttcgagacgggctgcaccg

SEQ ID NO: 815239 - DNA, 25 bp, Mus musculus
tggaccttcgagtcgggctgcaccg

SEQ ID NO: 815240 - DNA, 25 bp, Mus musculus
tggaccttctctccgctgaagaacg

SEQ ID NO: 815241 - DNA, 25 bp, Mus musculus
tggaccttctctgcgctgaagaacg

SEQ ID NO: 815242 - DNA, 25 bp, Mus musculus
tggaccttgaagacccagagcctga

SEQ ID NO: 815243 - DNA, 25 bp, Mus musculus
tggaccttgaagtcccagagcctga

SEQ ID NO: 815244 - DNA, 25 bp, Mus musculus
tggaccttgcccagaaacacttgag

SEQ ID NO: 815245 - DNA, 25 bp, Mus musculus
tggaccttgccctgaaacacttgag

SEQ ID NO: 815246 - DNA, 25 bp, Mus musculus
tggaccttgtaaaaactgcaaaatg

SEQ ID NO: 815247 - DNA, 25 bp, Mus musculus
tggaccttgtaataactgcaaaatg

SEQ ID NO: 815248 - DNA, 25 bp, Mus musculus
tggacctttaccagtgcatgatggc

SEQ ID NO: 815249 - DNA, 25 bp, Mus musculus
tggacctttacctgtgcatgatggc

SEQ ID NO: 815250 - DNA, 25 bp, Mus musculus
tggacgaaaccaacatcatctttca

SEQ ID NO: 815251 - DNA, 25 bp, Mus musculus
tggacgaaaccatcatcatctttca

SEQ ID NO: 815252 - DNA, 25 bp, Mus musculus
tggacgaacgtcacgtgacacggaa

SEQ ID NO: 815253 - DNA, 25 bp, Mus musculus
tggacgaacgtctcgtgacacggaa

SEQ ID NO: 815254 - DNA, 25 bp, Mus musculus
tggacgaagcaacatcagctctgga

SEQ ID NO: 815255 - DNA, 25 bp, Mus musculus
tggacgaagcaagatcagctctgga

SEQ ID NO: 815256 - DNA, 25 bp, Mus musculus
tggacgaagcagaagcaagcctgtt

SEQ ID NO: 815257 - DNA, 25 bp, Mus musculus
tggacgaagcagtagcaagcctgtt

SEQ ID NO: 815258 - DNA, 25 bp, Mus musculus
tggacgaatgtgagacgggcacaca

SEQ ID NO: 815259 - DNA, 25 bp, Mus musculus
tggacgaatgtgtgacgggcacaca

SEQ ID NO: 815260 - DNA, 25 bp, Mus musculus
tggacgacacctatctcttagctgg

SEQ ID NO: 815261 - DNA, 25 bp, Mus musculus
tggacgacacctttctcttagctgg

SEQ ID NO: 815262 - DNA, 25 bp, Mus musculus
tggacgaccagcctgtaacagttaa

SEQ ID NO: 815263 - DNA, 25 bp, Mus musculus
tggacgaccagcgtgtaacagttaa

SEQ ID NO: 815264 - DNA, 25 bp, Mus musculus
tggacgaccagtactggcccgagga

SEQ ID NO: 815265 - DNA, 25 bp, Mus musculus
tggacgaccagttctggcccgagga

SEQ ID NO: 815266 - DNA, 25 bp, Mus musculus
tggacgacctcaaggtgcttcagcc

SEQ ID NO: 815267 - DNA, 25 bp, Mus musculus
tggacgacctcatggtgcttcagcc

SEQ ID NO: 815268 - DNA, 25 bp, Mus musculus
tggacgacgcgcacttgctcctaca

SEQ ID NO: 815269 - DNA, 25 bp, Mus musculus
tggacgacgcgctcttgctcctaca

SEQ ID NO: 815270 - DNA, 25 bp, Mus musculus
tggacgagccatcaagtgccaagga

SEQ ID NO: 815271 - DNA, 25 bp, Mus musculus
tggacgagccatgaagtgccaagga

SEQ ID NO: 815272 - DNA, 25 bp, Mus musculus
tggacgagcgaaatctaacgacccc

SEQ ID NO: 815273 - DNA, 25 bp, Mus musculus
tggacgagcgaattctaacgacccc

SEQ ID NO: 815274 - DNA, 25 bp, Mus musculus
tggacgaggacaacctagagactgc

SEQ ID NO: 815275 - DNA, 25 bp, Mus musculus
tggacgaggacatcctagagactgc

SEQ ID NO: 815276 - DNA, 25 bp, Mus musculus
tggacgagtccaacgcgggacgcac

SEQ ID NO: 815277 - DNA, 25 bp, Mus musculus
tggacgagtccatcgcgggacgcac

SEQ ID NO: 815278 - DNA, 25 bp, Mus musculus
tggacgagtgtgcaacagactcaca

SEQ ID NO: 815279 - DNA, 25 bp, Mus musculus
tggacgagtgtggaacagactcaca

SEQ ID NO: 815280 - DNA, 25 bp, Mus musculus
tggacgagttcaaatgtgattacct

SEQ ID NO: 815281 - DNA, 25 bp, Mus musculus
tggacgagttcatatgtgattacct

SEQ ID NO: 815282 - DNA, 25 bp, Mus musculus
tggacgatagcaccagtgagtccag

SEQ ID NO: 815283 - DNA, 25 bp, Mus musculus
tggacgatagcagcagtgagtccag

SEQ ID NO: 815284 - DNA, 25 bp, Mus musculus
tggacgatgaatatatcagttcttc

SEQ ID NO: 815285 - DNA, 25 bp, Mus musculus
tggacgatgaatttatcagttcttc

SEQ ID NO: 815286 - DNA, 25 bp, Mus musculus
tggacgcaccggagtttgtgcctga

SEQ ID NO: 815287 - DNA, 25 bp, Mus musculus
tggacgcaccggtgtttgtgcctga

SEQ ID NO: 815288 - DNA, 25 bp, Mus musculus
tggacgcagcagacggcaaataatt

SEQ ID NO: 815289 - DNA, 25 bp, Mus musculus
tggacgcagcagtcggcaaataatt

SEQ ID NO: 815290 - DNA, 25 bp, Mus musculus
tggacgcaggcaacatcaagctgac

SEQ ID NO: 815291 - DNA, 25 bp, Mus musculus
tggacgcaggcatcatcaagctgac

SEQ ID NO: 815292 - DNA, 25 bp, Mus musculus
tggacgccaaccagtgtcaggtgat

SEQ ID NO: 815293 - DNA, 25 bp, Mus musculus
tggacgccaacctgtgtcaggtgat

SEQ ID NO: 815294 - DNA, 25 bp, Mus musculus
tggacgccaaggacgtcgccgtgct

SEQ ID NO: 815295 - DNA, 25 bp, Mus musculus
tggacgccaaggtcgtcgccgtgct

SEQ ID NO: 815296 - DNA, 25 bp, Mus musculus
tggacgccagcaactacgtcaggga

SEQ ID NO: 815297 - DNA, 25 bp, Mus musculus
tggacgccagcatctacgtcaggga

SEQ ID NO: 815298 - DNA, 25 bp, Mus musculus
tggacgccagtactggtatatgctg

SEQ ID NO: 815299 - DNA, 25 bp, Mus musculus
tggacgccagtagtggtatatgctg

SEQ ID NO: 815300 - DNA, 25 bp, Mus musculus
tggacgcccagaagatgaaaagggc

SEQ ID NO: 815301 - DNA, 25 bp, Mus musculus
tggacgcccagatgatgaaaagggc

SEQ ID NO: 815302 - DNA, 25 bp, Mus musculus
tggacgcccgaacagacttcacctt

SEQ ID NO: 815303 - DNA, 25 bp, Mus musculus
tggacgcccgaagagacttcacctt

SEQ ID NO: 815304 - DNA, 25 bp, Mus musculus
tggacgccgccgactccgtttgtct

SEQ ID NO: 815305 - DNA, 25 bp, Mus musculus
tggacgccgccgtctccgtttgtct

SEQ ID NO: 815306 - DNA, 25 bp, Mus musculus
tggacgccgcgaacagccgccatga

SEQ ID NO: 815307 - DNA, 25 bp, Mus musculus
tggacgccgcgatcagccgccatga

SEQ ID NO: 815308 - DNA, 25 bp, Mus musculus
tggacgcgcctgacatgatcatgaa

SEQ ID NO: 815309 - DNA, 25 bp, Mus musculus
tggacgcgcctgtcatgatcatgaa

SEQ ID NO: 815310 - DNA, 25 bp, Mus musculus
tggacgctatctctccccgtggcag

SEQ ID NO: 815311 - DNA, 25 bp, Mus musculus
tggacgctatctgtccccgtggcag

SEQ ID NO: 815312 - DNA, 25 bp, Mus musculus
tggacgctcttgatggaaggatact

SEQ ID NO: 815313 - DNA, 25 bp, Mus musculus
tggacgctcttgttggaaggatact

SEQ ID NO: 815314 - DNA, 25 bp, Mus musculus
tggacgctgctgacctgcgcatgtc

SEQ ID NO: 815315 - DNA, 25 bp, Mus musculus
tggacgctgctgtcctgcgcatgtc

SEQ ID NO: 815316 - DNA, 25 bp, Mus musculus
tggacgcttctgctcttggccttca

SEQ ID NO: 815317 - DNA, 25 bp, Mus musculus
tggacgcttctggtcttggccttca

SEQ ID NO: 815318 - DNA, 25 bp, Mus musculus
tggacggacgagatgaggccatcaa

SEQ ID NO: 815319 - DNA, 25 bp, Mus musculus
tggacggacgagttgaggccatcaa

SEQ ID NO: 815320 - DNA, 25 bp, Mus musculus
tggacggagaggagtacccaccttc

SEQ ID NO: 815321 - DNA, 25 bp, Mus musculus
tggacggagaggtgtacccaccttc

SEQ ID NO: 815322 - DNA, 25 bp, Mus musculus
tggacggagtaaccaggcttgcctc

SEQ ID NO: 815323 - DNA, 25 bp, Mus musculus
tggacggagtaagcaggcttgcctc

SEQ ID NO: 815324 - DNA, 25 bp, Mus musculus
tggacggcaacccttgcggctcaca

SEQ ID NO: 815325 - DNA, 25 bp, Mus musculus
tggacggcaaccgttgcggctcaca

SEQ ID NO: 815326 - DNA, 25 bp, Mus musculus
tggacggcactgctcacaggcctgc

SEQ ID NO: 815327 - DNA, 25 bp, Mus musculus
tggacggcactggtcacaggcctgc

SEQ ID NO: 815328 - DNA, 25 bp, Mus musculus
tggacggcatgaccatcagagagaa

SEQ ID NO: 815329 - DNA, 25 bp, Mus musculus
tggacggcatgagcatcagagagaa

SEQ ID NO: 815330 - DNA, 25 bp, Mus musculus
tggacggcattaagaattcaagctg

SEQ ID NO: 815331 - DNA, 25 bp, Mus musculus
tggacggcattatgaattcaagctg

SEQ ID NO: 815332 - DNA, 25 bp, Mus musculus
tggacggcgatgaagtcatcataac

SEQ ID NO: 815333 - DNA, 25 bp, Mus musculus
tggacggcgatgtagtcatcataac

SEQ ID NO: 815334 - DNA, 25 bp, Mus musculus
tggacggcgtgaatacctacaattg

SEQ ID NO: 815335 - DNA, 25 bp, Mus musculus
tggacggcgtgattacctacaattg

SEQ ID NO: 815336 - DNA, 25 bp, Mus musculus
tggacgggaccacctgagctttcgt

SEQ ID NO: 815337 - DNA, 25 bp, Mus musculus
tggacgggaccagctgagctttcgt

SEQ ID NO: 815338 - DNA, 25 bp, Mus musculus
tggacgggctctcgacgaccatcac

SEQ ID NO: 815339 - DNA, 25 bp, Mus musculus
tggacgggctctctctgcatacgaa

SEQ ID NO: 815340 - DNA, 25 bp, Mus musculus
tggacgggctctggacgaccatcac

SEQ ID NO: 815341 - DNA, 25 bp, Mus musculus
tggacgggctctgtctgcatacgaa

SEQ ID NO: 815342 - DNA, 25 bp, Mus musculus
tggacggtgtccagatggaactgca

SEQ ID NO: 815343 - DNA, 25 bp, Mus musculus
tggacggtgtcctgatggaactgca

SEQ ID NO: 815344 - DNA, 25 bp, Mus musculus
tggacgtatggtccaatggtcagaa

SEQ ID NO: 815345 - DNA, 25 bp, Mus musculus
tggacgtatggtgcaatggtcagaa

SEQ ID NO: 815346 - DNA, 25 bp, Mus musculus
tggacgtattgccttgggctctcag

SEQ ID NO: 815347 - DNA, 25 bp, Mus musculus
tggacgtattgcgttgggctctcag

SEQ ID NO: 815348 - DNA, 25 bp, Mus musculus
tggacgtcactccaagggccgttgc

SEQ ID NO: 815349 - DNA, 25 bp, Mus musculus
tggacgtcactcgaagggccgttgc

SEQ ID NO: 815350 - DNA, 25 bp, Mus musculus
tggacgtcacttagctagacccagg

SEQ ID NO: 815351 - DNA, 25 bp, Mus musculus
tggacgtcactttgctagacccagg

SEQ ID NO: 815352 - DNA, 25 bp, Mus musculus
tggacgtcatcacgaagttgtggaa

SEQ ID NO: 815353 - DNA, 25 bp, Mus musculus
tggacgtcatcaggaagttgtggaa

SEQ ID NO: 815354 - DNA, 25 bp, Mus musculus
tggacgtccaagcagagatacggct

SEQ ID NO: 815355 - DNA, 25 bp, Mus musculus
tggacgtccaaggagagatacggct

SEQ ID NO: 815356 - DNA, 25 bp, Mus musculus
tggacgtccagtacgatgagggatt

SEQ ID NO: 815357 - DNA, 25 bp, Mus musculus
tggacgtccagttcgatgagggatt

SEQ ID NO: 815358 - DNA, 25 bp, Mus musculus
tggacgtcctcacattgagttggag

SEQ ID NO: 815359 - DNA, 25 bp, Mus musculus
tggacgtcctcagattgagttggag

SEQ ID NO: 815360 - DNA, 25 bp, Mus musculus
tggacgtggtcacgtaggaccctca

SEQ ID NO: 815361 - DNA, 25 bp, Mus musculus
tggacgtggtcaggtaggaccctca

SEQ ID NO: 815362 - DNA, 25 bp, Mus musculus
tggacgttgccgaatgatactgaag

SEQ ID NO: 815363 - DNA, 25 bp, Mus musculus
tggacgttgccgtatgatactgaag

SEQ ID NO: 815364 - DNA, 25 bp, Mus musculus
tggactaaacttctctactataagt

SEQ ID NO: 815365 - DNA, 25 bp, Mus musculus
tggactaaacttgtctactataagt

SEQ ID NO: 815366 - DNA, 25 bp, Mus musculus
tggactaagttaagaccaagaaaca

SEQ ID NO: 815367 - DNA, 25 bp, Mus musculus
tggactaagttatgaccaagaaaca

SEQ ID NO: 815368 - DNA, 25 bp, Mus musculus
tggactaatgccatgtgatcctcta

SEQ ID NO: 815369 - DNA, 25 bp, Mus musculus
tggactaatgccttgtgatcctcta

SEQ ID NO: 815370 - DNA, 25 bp, Mus musculus
tggactacaaacctgtgtgattcac

SEQ ID NO: 815371 - DNA, 25 bp, Mus musculus
tggactacaaacgtgtgtgattcac

SEQ ID NO: 815372 - DNA, 25 bp, Mus musculus
tggactacacaaacggtacacagaa

SEQ ID NO: 815373 - DNA, 25 bp, Mus musculus
tggactacacaatcggtacacagaa

SEQ ID NO: 815374 - DNA, 25 bp, Mus musculus
tggactacagcacaaccatccaagc

SEQ ID NO: 815375 - DNA, 25 bp, Mus musculus
tggactacagcagaaccatccaagc

SEQ ID NO: 815376 - DNA, 25 bp, Mus musculus
tggactacagctagcacagggaatt

SEQ ID NO: 815377 - DNA, 25 bp, Mus musculus
tggactacagcttgcacagggaatt

SEQ ID NO: 815378 - DNA, 25 bp, Mus musculus
tggactactcggagggcttgtccgc

SEQ ID NO: 815379 - DNA, 25 bp, Mus musculus
tggactactcggtgggcttgtccgc

SEQ ID NO: 815380 - DNA, 25 bp, Mus musculus
tggactacttgcagagttcaggagg

SEQ ID NO: 815381 - DNA, 25 bp, Mus musculus
tggactacttgctgagttcaggagg

SEQ ID NO: 815382 - DNA, 25 bp, Mus musculus
tggactagagctcagaacccttctg

SEQ ID NO: 815383 - DNA, 25 bp, Mus musculus
tggactagagctgagaacccttctg

SEQ ID NO: 815384 - DNA, 25 bp, Mus musculus
tggactagagtaacagcctgaatgc

SEQ ID NO: 815385 - DNA, 25 bp, Mus musculus
tggactagagtatcagcctgaatgc

SEQ ID NO: 815386 - DNA, 25 bp, Mus musculus
tggactagcaaaagagaatgaatct

SEQ ID NO: 815387 - DNA, 25 bp, Mus musculus
tggactagcaaatgagaatgaatct

SEQ ID NO: 815388 - DNA, 25 bp, Mus musculus
tggactagcattctcaacactttgg

SEQ ID NO: 815389 - DNA, 25 bp, Mus musculus
tggactagcattgtcaacactttgg

SEQ ID NO: 815390 - DNA, 25 bp, Mus musculus
tggactagctcaactcatggccctg

SEQ ID NO: 815391 - DNA, 25 bp, Mus musculus
tggactagctcatctcatggccctg

SEQ ID NO: 815392 - DNA, 25 bp, Mus musculus
tggactagtgatcgcagcgccattt

SEQ ID NO: 815393 - DNA, 25 bp, Mus musculus
tggactagtgatggcagcgccattt

SEQ ID NO: 815394 - DNA, 25 bp, Mus musculus
tggactatacgacactgcaggacag

SEQ ID NO: 815395 - DNA, 25 bp, Mus musculus
tggactatacgagactgcaggacag

SEQ ID NO: 815396 - DNA, 25 bp, Mus musculus
tggactatcttccatcacgtggtcg

SEQ ID NO: 815397 - DNA, 25 bp, Mus musculus
tggactatcttcgatcacgtggtcg

SEQ ID NO: 815398 - DNA, 25 bp, Mus musculus
tggactattccacttcaccgtcaga

SEQ ID NO: 815399 - DNA, 25 bp, Mus musculus
tggactattccagttcaccgtcaga

SEQ ID NO: 815400 - DNA, 25 bp, Mus musculus
tggactcaactgcagcgtcgctaga

SEQ ID NO: 815401 - DNA, 25 bp, Mus musculus
tggactcaactggagcgtcgctaga

SEQ ID NO: 815402 - DNA, 25 bp, Mus musculus
tggactcacaccctatcactacata

SEQ ID NO: 815403 - DNA, 25 bp, Mus musculus
tggactcacaccgtatcactacata

SEQ ID NO: 815404 - DNA, 25 bp, Mus musculus
tggactcacattattgtcccagctg

SEQ ID NO: 815405 - DNA, 25 bp, Mus musculus
tggactcacattcactacttcaaca

SEQ ID NO: 815406 - DNA, 25 bp, Mus musculus
tggactcacattgactacttcaaca

SEQ ID NO: 815407 - DNA, 25 bp, Mus musculus
tggactcacatttttgtcccagctg

SEQ ID NO: 815408 - DNA, 25 bp, Mus musculus
tggactcacccgaaggcggctttga

SEQ ID NO: 815409 - DNA, 25 bp, Mus musculus
tggactcacccgtaggcggctttga

SEQ ID NO: 815410 - DNA, 25 bp, Mus musculus
tggactcagacaaacgaagaagctt

SEQ ID NO: 815411 - DNA, 25 bp, Mus musculus
tggactcagacatacgaagaagctt

SEQ ID NO: 815412 - DNA, 25 bp, Mus musculus
tggactcagcctaggttcggatgac

SEQ ID NO: 815413 - DNA, 25 bp, Mus musculus
tggactcagccttggttcggatgac

SEQ ID NO: 815414 - DNA, 25 bp, Mus musculus
tggactcagcttcaaagaaggcaat

SEQ ID NO: 815415 - DNA, 25 bp, Mus musculus
tggactcagcttgaaagaaggcaat

SEQ ID NO: 815416 - DNA, 25 bp, Mus musculus
tggactcagtttcgccagaacactg

SEQ ID NO: 815417 - DNA, 25 bp, Mus musculus
tggactcagtttggccagaacactg

SEQ ID NO: 815418 - DNA, 25 bp, Mus musculus
tggactcatcaacactcgattcagc

SEQ ID NO: 815419 - DNA, 25 bp, Mus musculus
tggactcatcaagactcgattcagc

SEQ ID NO: 815420 - DNA, 25 bp, Mus musculus
tggactcatccgaaatggacgtgac

SEQ ID NO: 815421 - DNA, 25 bp, Mus musculus
tggactcatccgtaatggacgtgac

SEQ ID NO: 815422 - DNA, 25 bp, Mus musculus
tggactcatgcacagaacactatgc

SEQ ID NO: 815423 - DNA, 25 bp, Mus musculus
tggactcatgcagagaacactatgc

SEQ ID NO: 815424 - DNA, 25 bp, Mus musculus
tggactccaccaagcaaatcagaac

SEQ ID NO: 815425 - DNA, 25 bp, Mus musculus
tggactccaccatgcaaatcagaac

SEQ ID NO: 815426 - DNA, 25 bp, Mus musculus
tggactccacctctcgaattatgga

SEQ ID NO: 815427 - DNA, 25 bp, Mus musculus
tggactccacctgtcgaattatgga

SEQ ID NO: 815428 - DNA, 25 bp, Mus musculus
tggactccactacctaagcgactgt

SEQ ID NO: 815429 - DNA, 25 bp, Mus musculus
tggactccactagctaagcgactgt

SEQ ID NO: 815430 - DNA, 25 bp, Mus musculus
tggactccagctaccgctatggatg

SEQ ID NO: 815431 - DNA, 25 bp, Mus musculus
tggactccagcttccgctatggatg

SEQ ID NO: 815432 - DNA, 25 bp, Mus musculus
tggactccagtcagaactcctcagt

SEQ ID NO: 815433 - DNA, 25 bp, Mus musculus
tggactccagtctgaactcctcagt

SEQ ID NO: 815434 - DNA, 25 bp, Mus musculus
tggactccatgtccatcagtatggg

SEQ ID NO: 815435 - DNA, 25 bp, Mus musculus
tggactccatgtgcatcagtatggg

SEQ ID NO: 815436 - DNA, 25 bp, Mus musculus
tggactcccccgatgcccaggagag

SEQ ID NO: 815437 - DNA, 25 bp, Mus musculus
tggactcccccgttgcccaggagag

SEQ ID NO: 815438 - DNA, 25 bp, Mus musculus
tggactcccggcatcctaacagtga

SEQ ID NO: 815439 - DNA, 25 bp, Mus musculus
tggactcccggcttcctaacagtga

SEQ ID NO: 815440 - DNA, 25 bp, Mus musculus
tggactccctgtatagggtccccag

SEQ ID NO: 815441 - DNA, 25 bp, Mus musculus
tggactccctgtttagggtccccag

SEQ ID NO: 815442 - DNA, 25 bp, Mus musculus
tggactccgagtcaagctttagctt

SEQ ID NO: 815443 - DNA, 25 bp, Mus musculus
tggactccgagtgaagctttagctt

SEQ ID NO: 815444 - DNA, 25 bp, Mus musculus
tggactccggcactgtcctagactt

SEQ ID NO: 815445 - DNA, 25 bp, Mus musculus
tggactccggcagtgtcctagactt

SEQ ID NO: 815446 - DNA, 25 bp, Mus musculus
tggactcctacacaatgcgcttctg

SEQ ID NO: 815447 - DNA, 25 bp, Mus musculus
tggactcctacagaatgcgcttctg

SEQ ID NO: 815448 - DNA, 25 bp, Mus musculus
tggactcctattcgaaaagtgcatc

SEQ ID NO: 815449 - DNA, 25 bp, Mus musculus
tggactcctattggaaaagtgcatc

SEQ ID NO: 815450 - DNA, 25 bp, Mus musculus
tggactcctctaactccagatacag

SEQ ID NO: 815451 - DNA, 25 bp, Mus musculus
tggactcctctatctccagatacag

SEQ ID NO: 815452 - DNA, 25 bp, Mus musculus
tggactcgctacagaagcaggaact

SEQ ID NO: 815453 - DNA, 25 bp, Mus musculus
tggactcgctactgaagcaggaact

SEQ ID NO: 815454 - DNA, 25 bp, Mus musculus
tggactcgctccaccttacagctga

SEQ ID NO: 815455 - DNA, 25 bp, Mus musculus
tggactcgctcctccttacagctga

SEQ ID NO: 815456 - DNA, 25 bp, Mus musculus
tggactcggaggcaagactcagacc

SEQ ID NO: 815457 - DNA, 25 bp, Mus musculus
tggactcggagggaagactcagacc

SEQ ID NO: 815458 - DNA, 25 bp, Mus musculus
tggactcggatcaccacccatcaga

SEQ ID NO: 815459 - DNA, 25 bp, Mus musculus
tggactcggatctccacccatcaga

SEQ ID NO: 815460 - DNA, 25 bp, Mus musculus
tggactcggcggaaccgaaggatct

SEQ ID NO: 815461 - DNA, 25 bp, Mus musculus
tggactcggcggtaccgaaggatct

SEQ ID NO: 815462 - DNA, 25 bp, Mus musculus
tggactcgggacagcccatgatgac

SEQ ID NO: 815463 - DNA, 25 bp, Mus musculus
tggactcgggactgcccatgatgac

SEQ ID NO: 815464 - DNA, 25 bp, Mus musculus
tggactcggttcaactcccacagct

SEQ ID NO: 815465 - DNA, 25 bp, Mus musculus
tggactcggttctactcccacagct

SEQ ID NO: 815466 - DNA, 25 bp, Mus musculus
tggactctacctcggcatgaacgag

SEQ ID NO: 815467 - DNA, 25 bp, Mus musculus
tggactctacctgggcatgaacgag

SEQ ID NO: 815468 - DNA, 25 bp, Mus musculus
tggactctatgtccaatgtgatata

SEQ ID NO: 815469 - DNA, 25 bp, Mus musculus
tggactctatgtgcaatgtgatata

SEQ ID NO: 815470 - DNA, 25 bp, Mus musculus
tggactctgagcaccttacctgcca

SEQ ID NO: 815471 - DNA, 25 bp, Mus musculus
tggactctgagctccttacctgcca

SEQ ID NO: 815472 - DNA, 25 bp, Mus musculus
tggactctgaggagctcacccaggg

SEQ ID NO: 815473 - DNA, 25 bp, Mus musculus
tggactctgaggtgctcacccaggg

SEQ ID NO: 815474 - DNA, 25 bp, Mus musculus
tggactctgctgaggcgtcttggcc

SEQ ID NO: 815475 - DNA, 25 bp, Mus musculus
tggactctgctgtggcgtcttggcc

SEQ ID NO: 815476 - DNA, 25 bp, Mus musculus
tggactctggaacgcgttaggtttc

SEQ ID NO: 815477 - DNA, 25 bp, Mus musculus
tggactctggaaggcgttaggtttc

SEQ ID NO: 815478 - DNA, 25 bp, Mus musculus
tggactcttctaatcaagactgtca

SEQ ID NO: 815479 - DNA, 25 bp, Mus musculus
tggactcttctattcaagactgtca

SEQ ID NO: 815480 - DNA, 25 bp, Mus musculus
tggactgaagccagcatagccacct

SEQ ID NO: 815481 - DNA, 25 bp, Mus musculus
tggactgaagcctgcatagccacct

SEQ ID NO: 815482 - DNA, 25 bp, Mus musculus
tggactgaatctcactgacttggga

SEQ ID NO: 815483 - DNA, 25 bp, Mus musculus
tggactgaatctgactgacttggga

SEQ ID NO: 815484 - DNA, 25 bp, Mus musculus
tggactgacacgcactacgtgggac

SEQ ID NO: 815485 - DNA, 25 bp, Mus musculus
tggactgacacggactacgtgggac

SEQ ID NO: 815486 - DNA, 25 bp, Mus musculus
tggactgactctaaagatgcagaat

SEQ ID NO: 815487 - DNA, 25 bp, Mus musculus
tggactgactcttaagatgcagaat

SEQ ID NO: 815488 - DNA, 25 bp, Mus musculus
tggactgagacgatgcacgccatgg

SEQ ID NO: 815489 - DNA, 25 bp, Mus musculus
tggactgagacgttgcacgccatgg

SEQ ID NO: 815490 - DNA, 25 bp, Mus musculus
tggactgagcacctttgttttgaaa

SEQ ID NO: 815491 - DNA, 25 bp, Mus musculus
tggactgagcacgtttgttttgaaa

SEQ ID NO: 815492 - DNA, 25 bp, Mus musculus
tggactgagccgacgctgtcgccgt

SEQ ID NO: 815493 - DNA, 25 bp, Mus musculus
tggactgagccgtcgctgtcgccgt

SEQ ID NO: 815494 - DNA, 25 bp, Mus musculus
tggactgagctgagcgcctttggct

SEQ ID NO: 815495 - DNA, 25 bp, Mus musculus
tggactgagctgtgcgcctttggct

SEQ ID NO: 815496 - DNA, 25 bp, Mus musculus
tggactgaggtgctgcagatcaatc

SEQ ID NO: 815497 - DNA, 25 bp, Mus musculus
tggactgaggtggtgcagatcaatc

SEQ ID NO: 815498 - DNA, 25 bp, Mus musculus
tggactgagtttccacagtagcttc

SEQ ID NO: 815499 - DNA, 25 bp, Mus musculus
tggactgagtttgcacagtagcttc

SEQ ID NO: 815500 - DNA, 25 bp, Mus musculus
tggactgatgctcgaaatactctgc

SEQ ID NO: 815501 - DNA, 25 bp, Mus musculus
tggactgatgctggaaatactctgc

SEQ ID NO: 815502 - DNA, 25 bp, Mus musculus
tggactgatgtgagcaattgctctt

SEQ ID NO: 815503 - DNA, 25 bp, Mus musculus
tggactgatgtgtgcaattgctctt

SEQ ID NO: 815504 - DNA, 25 bp, Mus musculus
tggactgcaaatcagacccacctgc

SEQ ID NO: 815505 - DNA, 25 bp, Mus musculus
tggactgcaaatgagacccacctgc

SEQ ID NO: 815506 - DNA, 25 bp, Mus musculus
tggactgcaagtacacggtgccacc

SEQ ID NO: 815507 - DNA, 25 bp, Mus musculus
tggactgcaagttcacggtgccacc

SEQ ID NO: 815508 - DNA, 25 bp, Mus musculus
tggactgcccacatgctatggagag

SEQ ID NO: 815509 - DNA, 25 bp, Mus musculus
tggactgcccacttgctatggagag

SEQ ID NO: 815510 - DNA, 25 bp, Mus musculus
tggactgcgcctaggacctgatgag

SEQ ID NO: 815511 - DNA, 25 bp, Mus musculus
tggactgcgccttggacctgatgag

SEQ ID NO: 815512 - DNA, 25 bp, Mus musculus
tggactgctggaacagaccccggga

SEQ ID NO: 815513 - DNA, 25 bp, Mus musculus
tggactgctggactcaatgagagaa

SEQ ID NO: 815514 - DNA, 25 bp, Mus musculus
tggactgctggagtcaatgagagaa

SEQ ID NO: 815515 - DNA, 25 bp, Mus musculus
tggactgctggatcagaccccggga

SEQ ID NO: 815516 - DNA, 25 bp, Mus musculus
tggactgctgtcaagtatgtataga

SEQ ID NO: 815517 - DNA, 25 bp, Mus musculus
tggactgctgtctagtatgtataga

SEQ ID NO: 815518 - DNA, 25 bp, Mus musculus
tggactggaccacaatgcgagacag

SEQ ID NO: 815519 - DNA, 25 bp, Mus musculus
tggactggaccagaatgcgagacag

SEQ ID NO: 815520 - DNA, 25 bp, Mus musculus
tggactggagccaacaagcagcagc

SEQ ID NO: 815521 - DNA, 25 bp, Mus musculus
tggactggagcctacaagcagcagc

SEQ ID NO: 815522 - DNA, 25 bp, Mus musculus
tggactggagtaatatcagacagct

SEQ ID NO: 815523 - DNA, 25 bp, Mus musculus
tggactggagtattatcagacagct

SEQ ID NO: 815524 - DNA, 25 bp, Mus musculus
tggactggatggatgcccagaccaa

SEQ ID NO: 815525 - DNA, 25 bp, Mus musculus
tggactggatggttgcccagaccaa

SEQ ID NO: 815526 - DNA, 25 bp, Mus musculus
tggactgggatgagcaccatggtca

SEQ ID NO: 815527 - DNA, 25 bp, Mus musculus
tggactgggatgtgcaccatggtca

SEQ ID NO: 815528 - DNA, 25 bp, Mus musculus
tggactggtatcagaacacttctcc

SEQ ID NO: 815529 - DNA, 25 bp, Mus musculus
tggactggtatctgaacacttctcc

SEQ ID NO: 815530 - DNA, 25 bp, Mus musculus
tggactggttttcacctagcagctc

SEQ ID NO: 815531 - DNA, 25 bp, Mus musculus
tggactggttttgacctagcagctc

SEQ ID NO: 815532 - DNA, 25 bp, Mus musculus
tggactgtaactcagggcctgagca

SEQ ID NO: 815533 - DNA, 25 bp, Mus musculus
tggactgtaactgagggcctgagca

SEQ ID NO: 815534 - DNA, 25 bp, Mus musculus
tggactgtaccgagctgatgactgc

SEQ ID NO: 815535 - DNA, 25 bp, Mus musculus
tggactgtaccgtgctgatgactgc

SEQ ID NO: 815536 - DNA, 25 bp, Mus musculus
tggactgtccatctgttctcacgga

SEQ ID NO: 815537 - DNA, 25 bp, Mus musculus
tggactgtccatgtgttctcacgga

SEQ ID NO: 815538 - DNA, 25 bp, Mus musculus
tggactgtcccgactgggtcctggc

SEQ ID NO: 815539 - DNA, 25 bp, Mus musculus
tggactgtcccgtctgggtcctggc

SEQ ID NO: 815540 - DNA, 25 bp, Mus musculus
tggactgtctgcacctcttgaagat

SEQ ID NO: 815541 - DNA, 25 bp, Mus musculus
tggactgtctgctcctcttgaagat

SEQ ID NO: 815542 - DNA, 25 bp, Mus musculus
tggactgtgagaagtatgggcttac

SEQ ID NO: 815543 - DNA, 25 bp, Mus musculus
tggactgtgagatgtatgggcttac

SEQ ID NO: 815544 - DNA, 25 bp, Mus musculus
tggactgtggaaactgttatgcccg

SEQ ID NO: 815545 - DNA, 25 bp, Mus musculus
tggactgtggaatctgttatgcccg

SEQ ID NO: 815546 - DNA, 25 bp, Mus musculus
tggactgttacactgcgaactggaa

SEQ ID NO: 815547 - DNA, 25 bp, Mus musculus
tggactgttacagtgcgaactggaa

SEQ ID NO: 815548 - DNA, 25 bp, Mus musculus
tggactgttctcacgctcaaggcaa

SEQ ID NO: 815549 - DNA, 25 bp, Mus musculus
tggactgttctctcgctcaaggcaa

SEQ ID NO: 815550 - DNA, 25 bp, Mus musculus
tggacttaacttactttacagagac

SEQ ID NO: 815551 - DNA, 25 bp, Mus musculus
tggacttaactttctttacagagac

SEQ ID NO: 815552 - DNA, 25 bp, Mus musculus
tggacttaagagaggaaacctagcc

SEQ ID NO: 815553 - DNA, 25 bp, Mus musculus
tggacttaagagtggaaacctagcc

SEQ ID NO: 815554 - DNA, 25 bp, Mus musculus
tggacttaattcagatatgatggaa

SEQ ID NO: 815555 - DNA, 25 bp, Mus musculus
tggacttaattctgatatgatggaa

SEQ ID NO: 815556 - DNA, 25 bp, Mus musculus
tggacttagatgaggagcaacttgg

SEQ ID NO: 815557 - DNA, 25 bp, Mus musculus
tggacttagatgtggagcaacttgg

SEQ ID NO: 815558 - DNA, 25 bp, Mus musculus
tggacttatcacatggacctcgggt

SEQ ID NO: 815559 - DNA, 25 bp, Mus musculus
tggacttatcacttggacctcgggt

SEQ ID NO: 815560 - DNA, 25 bp, Mus musculus
tggacttcaaggactcaggcttctt

SEQ ID NO: 815561 - DNA, 25 bp, Mus musculus
tggacttcaaggctcagctgtgtga

SEQ ID NO: 815562 - DNA, 25 bp, Mus musculus
tggacttcaagggtcagctgtgtga

SEQ ID NO: 815563 - DNA, 25 bp, Mus musculus
tggacttcaaggtctcaggcttctt

SEQ ID NO: 815564 - DNA, 25 bp, Mus musculus
tggacttcaccacttttggagattg

SEQ ID NO: 815565 - DNA, 25 bp, Mus musculus
tggacttcaccagttttggagattg

SEQ ID NO: 815566 - DNA, 25 bp, Mus musculus
tggacttcatggaaacggaaaattc

SEQ ID NO: 815567 - DNA, 25 bp, Mus musculus
tggacttcatggtaacggaaaattc

SEQ ID NO: 815568 - DNA, 25 bp, Mus musculus
tggacttccaaacaaacaataagac

SEQ ID NO: 815569 - DNA, 25 bp, Mus musculus
tggacttccaaagaaacaataagac

SEQ ID NO: 815570 - DNA, 25 bp, Mus musculus
tggacttccaccctgtcacaatggc

SEQ ID NO: 815571 - DNA, 25 bp, Mus musculus
tggacttccaccgtgtcacaatggc

SEQ ID NO: 815572 - DNA, 25 bp, Mus musculus
tggacttccaggctgttacatacaa

SEQ ID NO: 815573 - DNA, 25 bp, Mus musculus
tggacttccagggtgttacatacaa

SEQ ID NO: 815574 - DNA, 25 bp, Mus musculus
tggacttcctcgacattctcctggg

SEQ ID NO: 815575 - DNA, 25 bp, Mus musculus
tggacttcctcgtcattctcctggg

SEQ ID NO: 815576 - DNA, 25 bp, Mus musculus
tggacttctacaagcctgtggtgtg

SEQ ID NO: 815577 - DNA, 25 bp, Mus musculus
tggacttctacatgcctgtggtgtg

SEQ ID NO: 815578 - DNA, 25 bp, Mus musculus
tggacttctaccagccgacgtgcat

SEQ ID NO: 815579 - DNA, 25 bp, Mus musculus
tggacttctacctgccgacgtgcat

SEQ ID NO: 815580 - DNA, 25 bp, Mus musculus
tggacttcttctctgggattgtcac

SEQ ID NO: 815581 - DNA, 25 bp, Mus musculus
tggacttcttctgtgggattgtcac

SEQ ID NO: 815582 - DNA, 25 bp, Mus musculus
tggacttcttggatggcagcgccag

SEQ ID NO: 815583 - DNA, 25 bp, Mus musculus
tggacttcttggttggcagcgccag

SEQ ID NO: 815584 - DNA, 25 bp, Mus musculus
tggacttgacacctcttctgtggcc

SEQ ID NO: 815585 - DNA, 25 bp, Mus musculus
tggacttgacacgtcttctgtggcc

SEQ ID NO: 815586 - DNA, 25 bp, Mus musculus
tggacttgacctcaatcacaaacaa

SEQ ID NO: 815587 - DNA, 25 bp, Mus musculus
tggacttgacctgaatcacaaacaa

SEQ ID NO: 815588 - DNA, 25 bp, Mus musculus
tggacttgacgcaagaagctcgcag

SEQ ID NO: 815589 - DNA, 25 bp, Mus musculus
tggacttgacgctagaagctcgcag

SEQ ID NO: 815590 - DNA, 25 bp, Mus musculus
tggacttgactcagactgcagcgcc

SEQ ID NO: 815591 - DNA, 25 bp, Mus musculus
tggacttgactctgactgcagcgcc

SEQ ID NO: 815592 - DNA, 25 bp, Mus musculus
tggacttggccgacgagtgtgctca

SEQ ID NO: 815593 - DNA, 25 bp, Mus musculus
tggacttggccgtcgagtgtgctca

SEQ ID NO: 815594 - DNA, 25 bp, Mus musculus
tggacttggctactctctgctagag

SEQ ID NO: 815595 - DNA, 25 bp, Mus musculus
tggacttggctagtctctgctagag

SEQ ID NO: 815596 - DNA, 25 bp, Mus musculus
tggacttggtccaccatgctgccca

SEQ ID NO: 815597 - DNA, 25 bp, Mus musculus
tggacttggtcctccatgctgccca

SEQ ID NO: 815598 - DNA, 25 bp, Mus musculus
tggacttgtgtgctatgcctgttcg

SEQ ID NO: 815599 - DNA, 25 bp, Mus musculus
tggacttgtgtggtatgcctgttcg

SEQ ID NO: 815600 - DNA, 25 bp, Mus musculus
tggactttacacagctgttgcccag

SEQ ID NO: 815601 - DNA, 25 bp, Mus musculus
tggactttacactgctgttgcccag

SEQ ID NO: 815602 - DNA, 25 bp, Mus musculus
tggactttacatactcacgcctgtt

SEQ ID NO: 815603 - DNA, 25 bp, Mus musculus
tggactttacattctcacgcctgtt

SEQ ID NO: 815604 - DNA, 25 bp, Mus musculus
tggactttcagaaacagcccgtgcc

SEQ ID NO: 815605 - DNA, 25 bp, Mus musculus
tggactttcagatacagcccgtgcc

SEQ ID NO: 815606 - DNA, 25 bp, Mus musculus
tggactttccttcccggaggcggca

SEQ ID NO: 815607 - DNA, 25 bp, Mus musculus
tggactttccttgccggaggcggca

SEQ ID NO: 815608 - DNA, 25 bp, Mus musculus
tggactttctataggacaggacata

SEQ ID NO: 815609 - DNA, 25 bp, Mus musculus
tggactttctattggacaggacata

SEQ ID NO: 815610 - DNA, 25 bp, Mus musculus
tggacttttacaaggcgcggcttca

SEQ ID NO: 815611 - DNA, 25 bp, Mus musculus
tggacttttacatggcgcggcttca

SEQ ID NO: 815612 - DNA, 25 bp, Mus musculus
tggagaaaaagtaactcaagacagc

SEQ ID NO: 815613 - DNA, 25 bp, Mus musculus
tggagaaaaagttactcaagacagc

SEQ ID NO: 815614 - DNA, 25 bp, Mus musculus
tggagaaaaatacccactcattgtc

SEQ ID NO: 815615 - DNA, 25 bp, Mus musculus
tggagaaaaatagccactcattgtc

SEQ ID NO: 815616 - DNA, 25 bp, Mus musculus
tggagaaaacccacagaagagttta

SEQ ID NO: 815617 - DNA, 25 bp, Mus musculus
tggagaaaaccctcagaagagttta

SEQ ID NO: 815618 - DNA, 25 bp, Mus musculus
tggagaaaatctcatcgtccctggg

SEQ ID NO: 815619 - DNA, 25 bp, Mus musculus
tggagaaaatctgatcgtccctggg

SEQ ID NO: 815620 - DNA, 25 bp, Mus musculus
tggagaaaatggagccaataaacac

SEQ ID NO: 815621 - DNA, 25 bp, Mus musculus
tggagaaaatggcttagtcacatac

SEQ ID NO: 815622 - DNA, 25 bp, Mus musculus
tggagaaaatgggttagtcacatac

SEQ ID NO: 815623 - DNA, 25 bp, Mus musculus
tggagaaaatggtgccaataaacac

SEQ ID NO: 815624 - DNA, 25 bp, Mus musculus
tggagaaaccacatgctctagagcc

SEQ ID NO: 815625 - DNA, 25 bp, Mus musculus
tggagaaaccacttgctctagagcc

SEQ ID NO: 815626 - DNA, 25 bp, Mus musculus
tggagaaaccagagaccaccagatg

SEQ ID NO: 815627 - DNA, 25 bp, Mus musculus
tggagaaaccagtgaccaccagatg

SEQ ID NO: 815628 - DNA, 25 bp, Mus musculus
tggagaaaccgcacgctttgctgtg

SEQ ID NO: 815629 - DNA, 25 bp, Mus musculus
tggagaaaccgctcgctttgctgtg

SEQ ID NO: 815630 - DNA, 25 bp, Mus musculus
tggagaaacgcacgatgaacctgcc

SEQ ID NO: 815631 - DNA, 25 bp, Mus musculus
tggagaaacgcaggatgaacctgcc

SEQ ID NO: 815632 - DNA, 25 bp, Mus musculus
tggagaaacgtccaaggcgtcaatt

SEQ ID NO: 815633 - DNA, 25 bp, Mus musculus
tggagaaacgtcgaaggcgtcaatt

SEQ ID NO: 815634 - DNA, 25 bp, Mus musculus
tggagaaactgaccctcttacagga

SEQ ID NO: 815635 - DNA, 25 bp, Mus musculus
tggagaaactgagcctcttacagga

SEQ ID NO: 815636 - DNA, 25 bp, Mus musculus
tggagaaactggaagaggtaacagc

SEQ ID NO: 815637 - DNA, 25 bp, Mus musculus
tggagaaactggctcttctctggga

SEQ ID NO: 815638 - DNA, 25 bp, Mus musculus
tggagaaactgggtcttctctggga

SEQ ID NO: 815639 - DNA, 25 bp, Mus musculus
tggagaaactggtagaggtaacagc

SEQ ID NO: 815640 - DNA, 25 bp, Mus musculus
tggagaaagccgaagccggcaccgg

SEQ ID NO: 815641 - DNA, 25 bp, Mus musculus
tggagaaagccgtagccggcaccgg

SEQ ID NO: 815642 - DNA, 25 bp, Mus musculus
tggagaaagcctcggccagcctgta

SEQ ID NO: 815643 - DNA, 25 bp, Mus musculus
tggagaaagcctgggccagcctgta

SEQ ID NO: 815644 - DNA, 25 bp, Mus musculus
tggagaaaggccagtacgaatgctc

SEQ ID NO: 815645 - DNA, 25 bp, Mus musculus
tggagaaaggcctgtacgaatgctc

SEQ ID NO: 815646 - DNA, 25 bp, Mus musculus
tggagaaagtgcacagtctcttccg

SEQ ID NO: 815647 - DNA, 25 bp, Mus musculus
tggagaaagtgctcagtctcttccg

SEQ ID NO: 815648 - DNA, 25 bp, Mus musculus
tggagaaatctaagacgacatcgct

SEQ ID NO: 815649 - DNA, 25 bp, Mus musculus
tggagaaatctatgacgacatcgct

SEQ ID NO: 815650 - DNA, 25 bp, Mus musculus
tggagaaatctgaggactatcacct

SEQ ID NO: 815651 - DNA, 25 bp, Mus musculus
tggagaaatctgtggactatcacct

SEQ ID NO: 815652 - DNA, 25 bp, Mus musculus
tggagaaatgaacaacgctgtaagg

SEQ ID NO: 815653 - DNA, 25 bp, Mus musculus
tggagaaatgaagaacgctgtaagg

SEQ ID NO: 815654 - DNA, 25 bp, Mus musculus
tggagaaatgcaatcaacattggcc

SEQ ID NO: 815655 - DNA, 25 bp, Mus musculus
tggagaaatgcattcaacattggcc

SEQ ID NO: 815656 - DNA, 25 bp, Mus musculus
tggagaaatttacgatgccttggac

SEQ ID NO: 815657 - DNA, 25 bp, Mus musculus
tggagaaatttaggatgccttggac

SEQ ID NO: 815658 - DNA, 25 bp, Mus musculus
tggagaacacccagtttgacgcggc

SEQ ID NO: 815659 - DNA, 25 bp, Mus musculus
tggagaacaccctgtttgacgcggc

SEQ ID NO: 815660 - DNA, 25 bp, Mus musculus
tggagaacaccgcagagaggctctt

SEQ ID NO: 815661 - DNA, 25 bp, Mus musculus
tggagaacaccggagagaggctctt

SEQ ID NO: 815662 - DNA, 25 bp, Mus musculus
tggagaacatgaccaggacacactt

SEQ ID NO: 815663 - DNA, 25 bp, Mus musculus
tggagaacatgagcaggacacactt

SEQ ID NO: 815664 - DNA, 25 bp, Mus musculus
tggagaacattgaactctactggaa

SEQ ID NO: 815665 - DNA, 25 bp, Mus musculus
tggagaacattgtactctactggaa

SEQ ID NO: 815666 - DNA, 25 bp, Mus musculus
tggagaaccaggaccttccaccagt

SEQ ID NO: 815667 - DNA, 25 bp, Mus musculus
tggagaaccaggtccttccaccagt

SEQ ID NO: 815668 - DNA, 25 bp, Mus musculus
tggagaacccagctcatgctgatgg

SEQ ID NO: 815669 - DNA, 25 bp, Mus musculus
tggagaacccaggtcatgctgatgg

SEQ ID NO: 815670 - DNA, 25 bp, Mus musculus
tggagaaccccaatgacattgtcat

SEQ ID NO: 815671 - DNA, 25 bp, Mus musculus
tggagaaccccattgacattgtcat

SEQ ID NO: 815672 - DNA, 25 bp, Mus musculus
tggagaacccggcaagcccgtcact

SEQ ID NO: 815673 - DNA, 25 bp, Mus musculus
tggagaacccgggaagcccgtcact

SEQ ID NO: 815674 - DNA, 25 bp, Mus musculus
tggagaaccgtaaggacatcgccca

SEQ ID NO: 815675 - DNA, 25 bp, Mus musculus
tggagaaccgtatggacatcgccca

SEQ ID NO: 815676 - DNA, 25 bp, Mus musculus
tggagaacctcaagctggacaagga

SEQ ID NO: 815677 - DNA, 25 bp, Mus musculus
tggagaacctcatgctggacaagga

SEQ ID NO: 815678 - DNA, 25 bp, Mus musculus
tggagaacctgactatccgagaagt

SEQ ID NO: 815679 - DNA, 25 bp, Mus musculus
tggagaacctgagtatccgagaagt

SEQ ID NO: 815680 - DNA, 25 bp, Mus musculus
tggagaacgaggatgatcgcagcat

SEQ ID NO: 815681 - DNA, 25 bp, Mus musculus
tggagaacgaggttgatcgcagcat

SEQ ID NO: 815682 - DNA, 25 bp, Mus musculus
tggagaacgccgagctcaaggctgt

SEQ ID NO: 815683 - DNA, 25 bp, Mus musculus
tggagaacgccgtgctcaaggctgt

SEQ ID NO: 815684 - DNA, 25 bp, Mus musculus
tggagaacgctcacacaaagaccgt

SEQ ID NO: 815685 - DNA, 25 bp, Mus musculus
tggagaacgctctcacaaagaccgt

SEQ ID NO: 815686 - DNA, 25 bp, Mus musculus
tggagaacggctctttccttcactt

SEQ ID NO: 815687 - DNA, 25 bp, Mus musculus
tggagaacggctgtttccttcactt

SEQ ID NO: 815688 - DNA, 25 bp, Mus musculus
tggagaactacaatccccggcagcg

SEQ ID NO: 815689 - DNA, 25 bp, Mus musculus
tggagaactacattccccggcagcg

SEQ ID NO: 815690 - DNA, 25 bp, Mus musculus
tggagaactacgagggaatcataca

SEQ ID NO: 815691 - DNA, 25 bp, Mus musculus
tggagaactacgtgggaatcataca

SEQ ID NO: 815692 - DNA, 25 bp, Mus musculus
tggagaactcctagcgaagaacttg

SEQ ID NO: 815693 - DNA, 25 bp, Mus musculus
tggagaactccttgcgaagaacttg

SEQ ID NO: 815694 - DNA, 25 bp, Mus musculus
tggagaactctcagggtagcattcg

SEQ ID NO: 815695 - DNA, 25 bp, Mus musculus
tggagaactctctgggtagcattcg

SEQ ID NO: 815696 - DNA, 25 bp, Mus musculus
tggagaactgccaggttccagactt

SEQ ID NO: 815697 - DNA, 25 bp, Mus musculus
tggagaactgcctggttccagactt

SEQ ID NO: 815698 - DNA, 25 bp, Mus musculus
tggagaagaaaaacctactaagcct

SEQ ID NO: 815699 - DNA, 25 bp, Mus musculus
tggagaagaaaatcctactaagcct

SEQ ID NO: 815700 - DNA, 25 bp, Mus musculus
tggagaagaaatcccttctatgcct

SEQ ID NO: 815701 - DNA, 25 bp, Mus musculus
tggagaagaaatgccttctatgcct

SEQ ID NO: 815702 - DNA, 25 bp, Mus musculus
tggagaagaagcctcactattggtc

SEQ ID NO: 815703 - DNA, 25 bp, Mus musculus
tggagaagaagcgtcactattggtc

SEQ ID NO: 815704 - DNA, 25 bp, Mus musculus
tggagaagacctcaaacatgacttt

SEQ ID NO: 815705 - DNA, 25 bp, Mus musculus
tggagaagacctgaaacatgacttt

SEQ ID NO: 815706 - DNA, 25 bp, Mus musculus
tggagaagactacaccaagccacct

SEQ ID NO: 815707 - DNA, 25 bp, Mus musculus
tggagaagactagaccaagccacct

SEQ ID NO: 815708 - DNA, 25 bp, Mus musculus
tggagaagagctagaaaccccacca

SEQ ID NO: 815709 - DNA, 25 bp, Mus musculus
tggagaagagcttgaaaccccacca

SEQ ID NO: 815710 - DNA, 25 bp, Mus musculus
tggagaagagggacacaaaaagcat

SEQ ID NO: 815711 - DNA, 25 bp, Mus musculus
tggagaagagggtcacaaaaagcat

SEQ ID NO: 815712 - DNA, 25 bp, Mus musculus
tggagaagatccagcctcgggtcat

SEQ ID NO: 815713 - DNA, 25 bp, Mus musculus
tggagaagatcctgcctcgggtcat

SEQ ID NO: 815714 - DNA, 25 bp, Mus musculus
tggagaagatgaatgtatttgatac

SEQ ID NO: 815715 - DNA, 25 bp, Mus musculus
tggagaagatgattgtatttgatac

SEQ ID NO: 815716 - DNA, 25 bp, Mus musculus
tggagaagcaacatagtagagctac

SEQ ID NO: 815717 - DNA, 25 bp, Mus musculus
tggagaagcaacttagtagagctac

SEQ ID NO: 815718 - DNA, 25 bp, Mus musculus
tggagaagcacaactctcagcagag

SEQ ID NO: 815719 - DNA, 25 bp, Mus musculus
tggagaagcacatctctcagcagag

SEQ ID NO: 815720 - DNA, 25 bp, Mus musculus
tggagaagccccagcgtacattgat

SEQ ID NO: 815721 - DNA, 25 bp, Mus musculus
tggagaagcccctgcgtacattgat

SEQ ID NO: 815722 - DNA, 25 bp, Mus musculus
tggagaagccgaacatacggtggaa

SEQ ID NO: 815723 - DNA, 25 bp, Mus musculus
tggagaagccgatcatacggtggaa

SEQ ID NO: 815724 - DNA, 25 bp, Mus musculus
tggagaagctaaaaggagaacttga

SEQ ID NO: 815725 - DNA, 25 bp, Mus musculus
tggagaagctaataggagaacttga

SEQ ID NO: 815726 - DNA, 25 bp, Mus musculus
tggagaagctagactctcagcaggt

SEQ ID NO: 815727 - DNA, 25 bp, Mus musculus
tggagaagctagtctctcagcaggt

SEQ ID NO: 815728 - DNA, 25 bp, Mus musculus
tggagaagctgaacatgcaagccat

SEQ ID NO: 815729 - DNA, 25 bp, Mus musculus
tggagaagctgatcatgcaagccat

SEQ ID NO: 815730 - DNA, 25 bp, Mus musculus
tggagaaggaaaccagtgagctcaa

SEQ ID NO: 815731 - DNA, 25 bp, Mus musculus
tggagaaggaaagcagtgagctcaa

SEQ ID NO: 815732 - DNA, 25 bp, Mus musculus
tggagaaggcagactaccagggtcc

SEQ ID NO: 815733 - DNA, 25 bp, Mus musculus
tggagaaggcagtctaccagggtcc

SEQ ID NO: 815734 - DNA, 25 bp, Mus musculus
tggagaaggcgtacatcaaggactg

SEQ ID NO: 815735 - DNA, 25 bp, Mus musculus
tggagaaggcgttcatcaaggactg

SEQ ID NO: 815736 - DNA, 25 bp, Mus musculus
tggagaagggctatatccctgcgct

SEQ ID NO: 815737 - DNA, 25 bp, Mus musculus
tggagaagggctttatccctgcgct

SEQ ID NO: 815738 - DNA, 25 bp, Mus musculus
tggagaaggttacctctacccatca

SEQ ID NO: 815739 - DNA, 25 bp, Mus musculus
tggagaaggttagctctacccatca

SEQ ID NO: 815740 - DNA, 25 bp, Mus musculus
tggagaagtacgcaccgctgaagcc

SEQ ID NO: 815741 - DNA, 25 bp, Mus musculus
tggagaagtacggaccgctgaagcc

SEQ ID NO: 815742 - DNA, 25 bp, Mus musculus
tggagaagtcagaggcctcccggca

SEQ ID NO: 815743 - DNA, 25 bp, Mus musculus
tggagaagtcagtggcctcccggca

SEQ ID NO: 815744 - DNA, 25 bp, Mus musculus
tggagaagtctccatgtgccagcac

SEQ ID NO: 815745 - DNA, 25 bp, Mus musculus
tggagaagtctcgatgtgccagcac

SEQ ID NO: 815746 - DNA, 25 bp, Mus musculus
tggagaagtgccagcccaactccat

SEQ ID NO: 815747 - DNA, 25 bp, Mus musculus
tggagaagtgcctgcccaactccat

SEQ ID NO: 815748 - DNA, 25 bp, Mus musculus
tggagaagttcaactcatctatctc

SEQ ID NO: 815749 - DNA, 25 bp, Mus musculus
tggagaagttcatctcatctatctc

SEQ ID NO: 815750 - DNA, 25 bp, Mus musculus
tggagaataaatctggacattcctg

SEQ ID NO: 815751 - DNA, 25 bp, Mus musculus
tggagaataaatgtggacattcctg

SEQ ID NO: 815752 - DNA, 25 bp, Mus musculus
tggagaatactaacccgctggactg

SEQ ID NO: 815753 - DNA, 25 bp, Mus musculus
tggagaatactatcccgctggactg

SEQ ID NO: 815754 - DNA, 25 bp, Mus musculus
tggagaatcaggaaaaagcaccatt

SEQ ID NO: 815755 - DNA, 25 bp, Mus musculus
tggagaatcaggtaaaagcaccatt

SEQ ID NO: 815756 - DNA, 25 bp, Mus musculus
tggagaatccttccgtagcagaggc

SEQ ID NO: 815757 - DNA, 25 bp, Mus musculus
tggagaatccttgcgtagcagaggc

SEQ ID NO: 815758 - DNA, 25 bp, Mus musculus
tggagaatctggagaagaaaaacct

SEQ ID NO: 815759 - DNA, 25 bp, Mus musculus
tggagaatctggtgaagaaaaacct

SEQ ID NO: 815760 - DNA, 25 bp, Mus musculus
tggagaatgaagaccttgccgtagc

SEQ ID NO: 815761 - DNA, 25 bp, Mus musculus
tggagaatgaagtccttgccgtagc

SEQ ID NO: 815762 - DNA, 25 bp, Mus musculus
tggagaatgcacacgcttctgtcgg

SEQ ID NO: 815763 - DNA, 25 bp, Mus musculus
tggagaatgcactcgcttctgtcgg

SEQ ID NO: 815764 - DNA, 25 bp, Mus musculus
tggagaatgtaaacctgatcttaga

SEQ ID NO: 815765 - DNA, 25 bp, Mus musculus
tggagaatgtaatcctgatcttaga

SEQ ID NO: 815766 - DNA, 25 bp, Mus musculus
tggagaatgtctagacctgatcgag

SEQ ID NO: 815767 - DNA, 25 bp, Mus musculus
tggagaatgtcttgacctgatcgag

SEQ ID NO: 815768 - DNA, 25 bp, Mus musculus
tggagaattcacaccgagtcttcag

SEQ ID NO: 815769 - DNA, 25 bp, Mus musculus
tggagaattcactccgagtcttcag

SEQ ID NO: 815770 - DNA, 25 bp, Mus musculus
tggagaattcccaaaggaagcacct

SEQ ID NO: 815771 - DNA, 25 bp, Mus musculus
tggagaattccctaaggaagcacct

SEQ ID NO: 815772 - DNA, 25 bp, Mus musculus
tggagacaaaatacttgatgattcc

SEQ ID NO: 815773 - DNA, 25 bp, Mus musculus
tggagacaaaattcttgatgattcc

SEQ ID NO: 815774 - DNA, 25 bp, Mus musculus
tggagacaacccagaaatccaggaa

SEQ ID NO: 815775 - DNA, 25 bp, Mus musculus
tggagacaaccctgaaatccaggaa

SEQ ID NO: 815776 - DNA, 25 bp, Mus musculus
tggagacacaccatccatgtactgt

SEQ ID NO: 815777 - DNA, 25 bp, Mus musculus
tggagacacaccttccatgtactgt

SEQ ID NO: 815778 - DNA, 25 bp, Mus musculus
tggagacagaagcacctgtatccac

SEQ ID NO: 815779 - DNA, 25 bp, Mus musculus
tggagacagaaggacctgtatccac

SEQ ID NO: 815780 - DNA, 25 bp, Mus musculus
tggagacagagaacgagttctacag

SEQ ID NO: 815781 - DNA, 25 bp, Mus musculus
tggagacagagaccccagataatta

SEQ ID NO: 815782 - DNA, 25 bp, Mus musculus
tggagacagagagcccagataatta

SEQ ID NO: 815783 - DNA, 25 bp, Mus musculus
tggagacagagatcgagttctacag

SEQ ID NO: 815784 - DNA, 25 bp, Mus musculus
tggagacagagtaaaagctggagac

SEQ ID NO: 815785 - DNA, 25 bp, Mus musculus
tggagacagagtaaatgcagtttgc

SEQ ID NO: 815786 - DNA, 25 bp, Mus musculus
tggagacagagttaaagctggagac

SEQ ID NO: 815787 - DNA, 25 bp, Mus musculus
tggagacagagttaatgcagtttgc

SEQ ID NO: 815788 - DNA, 25 bp, Mus musculus
tggagacaggtcacagcagcaagag

SEQ ID NO: 815789 - DNA, 25 bp, Mus musculus
tggagacaggtctcagcagcaagag

SEQ ID NO: 815790 - DNA, 25 bp, Mus musculus
tggagacatcacctccttgtcatta

SEQ ID NO: 815791 - DNA, 25 bp, Mus musculus
tggagacatcacgtccttgtcatta

SEQ ID NO: 815792 - DNA, 25 bp, Mus musculus
tggagacatgaaaggactcagccct

SEQ ID NO: 815793 - DNA, 25 bp, Mus musculus
tggagacatgaatggactcagccct

SEQ ID NO: 815794 - DNA, 25 bp, Mus musculus
tggagacattccaacacagcttcat

SEQ ID NO: 815795 - DNA, 25 bp, Mus musculus
tggagacattcctacacagcttcat

SEQ ID NO: 815796 - DNA, 25 bp, Mus musculus
tggagaccaaacctgacaaggctgt

SEQ ID NO: 815797 - DNA, 25 bp, Mus musculus
tggagaccaaacctgtgataacctg

SEQ ID NO: 815798 - DNA, 25 bp, Mus musculus
tggagaccaaacgtgacaaggctgt

SEQ ID NO: 815799 - DNA, 25 bp, Mus musculus
tggagaccaaacgtgtgataacctg

SEQ ID NO: 815800 - DNA, 25 bp, Mus musculus
tggagaccaatgctaacagcactgt

SEQ ID NO: 815801 - DNA, 25 bp, Mus musculus
tggagaccaatggtaacagcactgt

SEQ ID NO: 815802 - DNA, 25 bp, Mus musculus
tggagaccacacacttggaattacg

SEQ ID NO: 815803 - DNA, 25 bp, Mus musculus
tggagaccacactcttggaattacg

SEQ ID NO: 815804 - DNA, 25 bp, Mus musculus
tggagaccagagagaccaactggtc

SEQ ID NO: 815805 - DNA, 25 bp, Mus musculus
tggagaccagagcactgacaaatac

SEQ ID NO: 815806 - DNA, 25 bp, Mus musculus
tggagaccagaggactgacaaatac

SEQ ID NO: 815807 - DNA, 25 bp, Mus musculus
tggagaccagagtgaccaactggtc

SEQ ID NO: 815808 - DNA, 25 bp, Mus musculus
tggagaccaggacccctgggccttt

SEQ ID NO: 815809 - DNA, 25 bp, Mus musculus
tggagaccaggagccctgggccttt

SEQ ID NO: 815810 - DNA, 25 bp, Mus musculus
tggagaccatgacggccttccgcag

SEQ ID NO: 815811 - DNA, 25 bp, Mus musculus
tggagaccatgagggccttccgcag

SEQ ID NO: 815812 - DNA, 25 bp, Mus musculus
tggagacccagactaccgtggtagc

SEQ ID NO: 815813 - DNA, 25 bp, Mus musculus
tggagacccagagtaccgtggtagc

SEQ ID NO: 815814 - DNA, 25 bp, Mus musculus
tggagaccccaacggcgatcatttc

SEQ ID NO: 815815 - DNA, 25 bp, Mus musculus
tggagaccccaagggcgatcatttc

SEQ ID NO: 815816 - DNA, 25 bp, Mus musculus
tggagaccccacctgtgctgagcca

SEQ ID NO: 815817 - DNA, 25 bp, Mus musculus
tggagaccccacgtgtgctgagcca

SEQ ID NO: 815818 - DNA, 25 bp, Mus musculus
tggagaccccatagctctgaactac

SEQ ID NO: 815819 - DNA, 25 bp, Mus musculus
tggagaccccattgctctgaactac

SEQ ID NO: 815820 - DNA, 25 bp, Mus musculus
tggagaccccctccgttacagaagc

SEQ ID NO: 815821 - DNA, 25 bp, Mus musculus
tggagaccccctgcgttacagaagc

SEQ ID NO: 815822 - DNA, 25 bp, Mus musculus
tggagaccccttcgatgccaaaacg

SEQ ID NO: 815823 - DNA, 25 bp, Mus musculus
tggagaccccttggatgccaaaacg

SEQ ID NO: 815824 - DNA, 25 bp, Mus musculus
tggagaccctcactgcaagatctgc

SEQ ID NO: 815825 - DNA, 25 bp, Mus musculus
tggagaccctcagtgcaagatctgc

SEQ ID NO: 815826 - DNA, 25 bp, Mus musculus
tggagaccctctcagtcccttgcat

SEQ ID NO: 815827 - DNA, 25 bp, Mus musculus
tggagaccctctgagtcccttgcat

SEQ ID NO: 815828 - DNA, 25 bp, Mus musculus
tggagacccttacacacctggcttc

SEQ ID NO: 815829 - DNA, 25 bp, Mus musculus
tggagacccttagacacctggcttc

SEQ ID NO: 815830 - DNA, 25 bp, Mus musculus
tggagaccgagaatgcctagatggc

SEQ ID NO: 815831 - DNA, 25 bp, Mus musculus
tggagaccgagaccctgcgattcct

SEQ ID NO: 815832 - DNA, 25 bp, Mus musculus
tggagaccgagagcctgcgattcct

SEQ ID NO: 815833 - DNA, 25 bp, Mus musculus
tggagaccgagattgcctagatggc

SEQ ID NO: 815834 - DNA, 25 bp, Mus musculus
tggagaccgcgcacggagctttgcc

SEQ ID NO: 815835 - DNA, 25 bp, Mus musculus
tggagaccgcgctcggagctttgcc

SEQ ID NO: 815836 - DNA, 25 bp, Mus musculus
tggagaccgggcagtttgctacagt

SEQ ID NO: 815837 - DNA, 25 bp, Mus musculus
tggagaccgggctgtttgctacagt

SEQ ID NO: 815838 - DNA, 25 bp, Mus musculus
tggagacctgccagctaatgactgt

SEQ ID NO: 815839 - DNA, 25 bp, Mus musculus
tggagacctgcctgctaatgactgt

SEQ ID NO: 815840 - DNA, 25 bp, Mus musculus
tggagacctggcaccctgcaaggtg

SEQ ID NO: 815841 - DNA, 25 bp, Mus musculus
tggagacctggctccctgcaaggtg

SEQ ID NO: 815842 - DNA, 25 bp, Mus musculus
tggagaccttgtctatggccgagaa

SEQ ID NO: 815843 - DNA, 25 bp, Mus musculus
tggagaccttgtgtatggccgagaa

SEQ ID NO: 815844 - DNA, 25 bp, Mus musculus
tggagacgctgcctacctgtgtccc

SEQ ID NO: 815845 - DNA, 25 bp, Mus musculus
tggagacgctgcgtacctgtgtccc

SEQ ID NO: 815846 - DNA, 25 bp, Mus musculus
tggagacgggttagttcttctatgt

SEQ ID NO: 815847 - DNA, 25 bp, Mus musculus
tggagacgggtttgttcttctatgt

SEQ ID NO: 815848 - DNA, 25 bp, Mus musculus
tggagacggtcaagcagaaactcga

SEQ ID NO: 815849 - DNA, 25 bp, Mus musculus
tggagacggtcatgcagaaactcga

SEQ ID NO: 815850 - DNA, 25 bp, Mus musculus
tggagacgtctaatgaccattctcc

SEQ ID NO: 815851 - DNA, 25 bp, Mus musculus
tggagacgtctattgaccattctcc

SEQ ID NO: 815852 - DNA, 25 bp, Mus musculus
tggagacgttgcatatccaccgaga

SEQ ID NO: 815853 - DNA, 25 bp, Mus musculus
tggagacgttgcttatccaccgaga

SEQ ID NO: 815854 - DNA, 25 bp, Mus musculus
tggagactaacccaccaacaggaaa

SEQ ID NO: 815855 - DNA, 25 bp, Mus musculus
tggagactaaccgaccaacaggaaa

SEQ ID NO: 815856 - DNA, 25 bp, Mus musculus
tggagactaggacaacctcagaaac

SEQ ID NO: 815857 - DNA, 25 bp, Mus musculus
tggagactaggagaacctcagaaac

SEQ ID NO: 815858 - DNA, 25 bp, Mus musculus
tggagactcagaagatggcgaagat

SEQ ID NO: 815859 - DNA, 25 bp, Mus musculus
tggagactcagatgatggcgaagat

SEQ ID NO: 815860 - DNA, 25 bp, Mus musculus
tggagactcagtataaccttcaaac

SEQ ID NO: 815861 - DNA, 25 bp, Mus musculus
tggagactcagtttaaccttcaaac

SEQ ID NO: 815862 - DNA, 25 bp, Mus musculus
tggagactccataaaaaagatcatc

SEQ ID NO: 815863 - DNA, 25 bp, Mus musculus
tggagactccattaaaaagatcatc

SEQ ID NO: 815864 - DNA, 25 bp, Mus musculus
tggagactctggcagctcaagccct

SEQ ID NO: 815865 - DNA, 25 bp, Mus musculus
tggagactctgggagctcaagccct

SEQ ID NO: 815866 - DNA, 25 bp, Mus musculus
tggagactgcatccggatcactgag

SEQ ID NO: 815867 - DNA, 25 bp, Mus musculus
tggagactgcatgcggatcactgag

SEQ ID NO: 815868 - DNA, 25 bp, Mus musculus
tggagactgctcagaaagtagagac

SEQ ID NO: 815869 - DNA, 25 bp, Mus musculus
tggagactgctctgaaagtagagac

SEQ ID NO: 815870 - DNA, 25 bp, Mus musculus
tggagactggctaaccatctttctg

SEQ ID NO: 815871 - DNA, 25 bp, Mus musculus
tggagactggcttaccatctttctg

SEQ ID NO: 815872 - DNA, 25 bp, Mus musculus
tggagactgggtagggacatcccac

SEQ ID NO: 815873 - DNA, 25 bp, Mus musculus
tggagactgggttgggacatcccac

SEQ ID NO: 815874 - DNA, 25 bp, Mus musculus
tggagactgttgaatacaagaatat

SEQ ID NO: 815875 - DNA, 25 bp, Mus musculus
tggagactgttgtatacaagaatat

SEQ ID NO: 815876 - DNA, 25 bp, Mus musculus
tggagacttcaaattgccacgagac

SEQ ID NO: 815877 - DNA, 25 bp, Mus musculus
tggagacttcaatttgccacgagac

SEQ ID NO: 815878 - DNA, 25 bp, Mus musculus
tggagacttcagctgcaaagaggaa

SEQ ID NO: 815879 - DNA, 25 bp, Mus musculus
tggagacttcaggtgcaaagaggaa

SEQ ID NO: 815880 - DNA, 25 bp, Mus musculus
tggagacttcatccctgctgttgag

SEQ ID NO: 815881 - DNA, 25 bp, Mus musculus
tggagacttcatgcctgctgttgag

SEQ ID NO: 815882 - DNA, 25 bp, Mus musculus
tggagactttgccatgtgtaagaac

SEQ ID NO: 815883 - DNA, 25 bp, Mus musculus
tggagactttgcgatgtgtaagaac

SEQ ID NO: 815884 - DNA, 25 bp, Mus musculus
tggagagaacctcctcactcacctt

SEQ ID NO: 815885 - DNA, 25 bp, Mus musculus
tggagagaacctgctcactcacctt

SEQ ID NO: 815886 - DNA, 25 bp, Mus musculus
tggagagaatgacgtatacaagcag

SEQ ID NO: 815887 - DNA, 25 bp, Mus musculus
tggagagaatgaggtatacaagcag

SEQ ID NO: 815888 - DNA, 25 bp, Mus musculus
tggagagacccactgcctgtggatc

SEQ ID NO: 815889 - DNA, 25 bp, Mus musculus
tggagagacccagtgcctgtggatc

SEQ ID NO: 815890 - DNA, 25 bp, Mus musculus
tggagagacctacatccaaagacgg

SEQ ID NO: 815891 - DNA, 25 bp, Mus musculus
tggagagacctagatccaaagacgg

SEQ ID NO: 815892 - DNA, 25 bp, Mus musculus
tggagagacgccactgcacctagct

SEQ ID NO: 815893 - DNA, 25 bp, Mus musculus
tggagagacgcctctgcacctagct

SEQ ID NO: 815894 - DNA, 25 bp, Mus musculus
tggagagactctaccagagggatag

SEQ ID NO: 815895 - DNA, 25 bp, Mus musculus
tggagagactcttccagagggatag

SEQ ID NO: 815896 - DNA, 25 bp, Mus musculus
tggagagactgcacgccgaatacag

SEQ ID NO: 815897 - DNA, 25 bp, Mus musculus
tggagagactgcatgtaagctcgct

SEQ ID NO: 815898 - DNA, 25 bp, Mus musculus
tggagagactgccaaaacagacacc

SEQ ID NO: 815899 - DNA, 25 bp, Mus musculus
tggagagactgcgaaaacagacacc

SEQ ID NO: 815900 - DNA, 25 bp, Mus musculus
tggagagactgctcgccgaatacag

SEQ ID NO: 815901 - DNA, 25 bp, Mus musculus
tggagagactgcttgtaagctcgct

SEQ ID NO: 815902 - DNA, 25 bp, Mus musculus
tggagagagagcaggttgtcatctt

SEQ ID NO: 815903 - DNA, 25 bp, Mus musculus
tggagagagagctggttgtcatctt

SEQ ID NO: 815904 - DNA, 25 bp, Mus musculus
tggagagagcaaacctgccatgggc

SEQ ID NO: 815905 - DNA, 25 bp, Mus musculus
tggagagagcaatcctgccatgggc

SEQ ID NO: 815906 - DNA, 25 bp, Mus musculus
tggagagagcagacgtcctctcggc

SEQ ID NO: 815907 - DNA, 25 bp, Mus musculus
tggagagagcagtcgtcctctcggc

SEQ ID NO: 815908 - DNA, 25 bp, Mus musculus
tggagagagctcatacagagcttgc

SEQ ID NO: 815909 - DNA, 25 bp, Mus musculus
tggagagagctcttacagagcttgc

SEQ ID NO: 815910 - DNA, 25 bp, Mus musculus
tggagagagtcaatgtcctagacac

SEQ ID NO: 815911 - DNA, 25 bp, Mus musculus
tggagagagtcattgtcctagacac

SEQ ID NO: 815912 - DNA, 25 bp, Mus musculus
tggagagatgtcagcctctccgctt

SEQ ID NO: 815913 - DNA, 25 bp, Mus musculus
tggagagatgtctgcctctccgctt

SEQ ID NO: 815914 - DNA, 25 bp, Mus musculus
tggagagattccctacaaagatgta

SEQ ID NO: 815915 - DNA, 25 bp, Mus musculus
tggagagattccgtacaaagatgta

SEQ ID NO: 815916 - DNA, 25 bp, Mus musculus
tggagagcaactcgactgtccatgt

SEQ ID NO: 815917 - DNA, 25 bp, Mus musculus
tggagagcaactggactgtccatgt

SEQ ID NO: 815918 - DNA, 25 bp, Mus musculus
tggagagcaaggaaagataccagct

SEQ ID NO: 815919 - DNA, 25 bp, Mus musculus
tggagagcaaggtaagataccagct

SEQ ID NO: 815920 - DNA, 25 bp, Mus musculus
tggagagcacttcaggaaccactcg

SEQ ID NO: 815921 - DNA, 25 bp, Mus musculus
tggagagcacttgaggaaccactcg

SEQ ID NO: 815922 - DNA, 25 bp, Mus musculus
tggagagcatcaagagacttatatc

SEQ ID NO: 815923 - DNA, 25 bp, Mus musculus
tggagagcatcatgagacttatatc

SEQ ID NO: 815924 - DNA, 25 bp, Mus musculus
tggagagccagtactcatcccttgg

SEQ ID NO: 815925 - DNA, 25 bp, Mus musculus
tggagagccagttctcatcccttgg

SEQ ID NO: 815926 - DNA, 25 bp, Mus musculus
tggagagcgccgaggctcttcctct

SEQ ID NO: 815927 - DNA, 25 bp, Mus musculus
tggagagcgccgtggctcttcctct

SEQ ID NO: 815928 - DNA, 25 bp, Mus musculus
tggagagcgcgcagggcgtgttacc

SEQ ID NO: 815929 - DNA, 25 bp, Mus musculus
tggagagcgcgctgggcgtgttacc

SEQ ID NO: 815930 - DNA, 25 bp, Mus musculus
tggagagctcctcgcgtctgaatga

SEQ ID NO: 815931 - DNA, 25 bp, Mus musculus
tggagagctcctggcgtctgaatga

SEQ ID NO: 815932 - DNA, 25 bp, Mus musculus
tggagagctgatcatctctgccgtg

SEQ ID NO: 815933 - DNA, 25 bp, Mus musculus
tggagagctgatgatctctgccgtg

SEQ ID NO: 815934 - DNA, 25 bp, Mus musculus
tggagagctgccacaatcagaacct

SEQ ID NO: 815935 - DNA, 25 bp, Mus musculus
tggagagctgcctcaatcagaacct

SEQ ID NO: 815936 - DNA, 25 bp, Mus musculus
tggagagctgtcattccaagcactc

SEQ ID NO: 815937 - DNA, 25 bp, Mus musculus
tggagagctgtctttccaagcactc

SEQ ID NO: 815938 - DNA, 25 bp, Mus musculus
tggagagcttcacccagggctccat

SEQ ID NO: 815939 - DNA, 25 bp, Mus musculus
tggagagcttcagccagggctccat

SEQ ID NO: 815940 - DNA, 25 bp, Mus musculus
tggagagcttttctgtggcatcact

SEQ ID NO: 815941 - DNA, 25 bp, Mus musculus
tggagagcttttgtgtggcatcact

SEQ ID NO: 815942 - DNA, 25 bp, Mus musculus
tggagaggaagcacgggaatatctc

SEQ ID NO: 815943 - DNA, 25 bp, Mus musculus
tggagaggaagctcgggaatatctc

SEQ ID NO: 815944 - DNA, 25 bp, Mus musculus
tggagaggactgacttggatcaaca

SEQ ID NO: 815945 - DNA, 25 bp, Mus musculus
tggagaggactgtcttggatcaaca

SEQ ID NO: 815946 - DNA, 25 bp, Mus musculus
tggagaggagctccatgcaaccaga

SEQ ID NO: 815947 - DNA, 25 bp, Mus musculus
tggagaggagctgcatgcaaccaga

SEQ ID NO: 815948 - DNA, 25 bp, Mus musculus
tggagaggatcgacggctcagccct

SEQ ID NO: 815949 - DNA, 25 bp, Mus musculus
tggagaggatcgtcggctcagccct

SEQ ID NO: 815950 - DNA, 25 bp, Mus musculus
tggagaggcagacactacaaagtaa

SEQ ID NO: 815951 - DNA, 25 bp, Mus musculus
tggagaggcagagactacaaagtaa

SEQ ID NO: 815952 - DNA, 25 bp, Mus musculus
tggagaggccagaaccttcaatggc

SEQ ID NO: 815953 - DNA, 25 bp, Mus musculus
tggagaggccagtaccttcaatggc

SEQ ID NO: 815954 - DNA, 25 bp, Mus musculus
tggagagggcaaaccgttagaagtc

SEQ ID NO: 815955 - DNA, 25 bp, Mus musculus
tggagagggcaatccgttagaagtc

SEQ ID NO: 815956 - DNA, 25 bp, Mus musculus
tggagagggcgcagcagagtctggc

SEQ ID NO: 815957 - DNA, 25 bp, Mus musculus
tggagagggcgctgcagagtctggc

SEQ ID NO: 815958 - DNA, 25 bp, Mus musculus
tggagaggtgacagcttgcagttct

SEQ ID NO: 815959 - DNA, 25 bp, Mus musculus
tggagaggtgactgcttgcagttct

SEQ ID NO: 815960 - DNA, 25 bp, Mus musculus
tggagagtacccactgacagctatg

SEQ ID NO: 815961 - DNA, 25 bp, Mus musculus
tggagagtaccctctgacagctatg

SEQ ID NO: 815962 - DNA, 25 bp, Mus musculus
tggagagtccacacaaaagctttct

SEQ ID NO: 815963 - DNA, 25 bp, Mus musculus
tggagagtccactcaaaagctttct

SEQ ID NO: 815964 - DNA, 25 bp, Mus musculus
tggagagtccatcgtggttatttca

SEQ ID NO: 815965 - DNA, 25 bp, Mus musculus
tggagagtccatggtggttatttca

SEQ ID NO: 815966 - DNA, 25 bp, Mus musculus
tggagagtccggcttagtgagcgcc

SEQ ID NO: 815967 - DNA, 25 bp, Mus musculus
tggagagtccgggttagtgagcgcc

SEQ ID NO: 815968 - DNA, 25 bp, Mus musculus
tggagagtgaagagcagaatcttcg

SEQ ID NO: 815969 - DNA, 25 bp, Mus musculus
tggagagtgaagtgcagaatcttcg

SEQ ID NO: 815970 - DNA, 25 bp, Mus musculus
tggagagtgactcggccattaatgt

SEQ ID NO: 815971 - DNA, 25 bp, Mus musculus
tggagagtgactgggccattaatgt

SEQ ID NO: 815972 - DNA, 25 bp, Mus musculus
tggagagtgccaccgcagcattaga

SEQ ID NO: 815973 - DNA, 25 bp, Mus musculus
tggagagtgccagcgcagcattaga

SEQ ID NO: 815974 - DNA, 25 bp, Mus musculus
tggagagtgtatcacctcatttccg

SEQ ID NO: 815975 - DNA, 25 bp, Mus musculus
tggagagtgtatgacctcatttccg

SEQ ID NO: 815976 - DNA, 25 bp, Mus musculus
tggagagtgttaagtttgccattct

SEQ ID NO: 815977 - DNA, 25 bp, Mus musculus
tggagagtgttatgtttgccattct

SEQ ID NO: 815978 - DNA, 25 bp, Mus musculus
tggagagttagacctgagtaagaca

SEQ ID NO: 815979 - DNA, 25 bp, Mus musculus
tggagagttagagctgagtaagaca

SEQ ID NO: 815980 - DNA, 25 bp, Mus musculus
tggagagttgttctctctgcgctat

SEQ ID NO: 815981 - DNA, 25 bp, Mus musculus
tggagagttgttgtctctgcgctat

SEQ ID NO: 815982 - DNA, 25 bp, Mus musculus
tggagataaaccacgaatgcagacg

SEQ ID NO: 815983 - DNA, 25 bp, Mus musculus
tggagataaacctcgaatgcagacg

SEQ ID NO: 815984 - DNA, 25 bp, Mus musculus
tggagataatcaccaggcgcacaca

SEQ ID NO: 815985 - DNA, 25 bp, Mus musculus
tggagataatcagcaggcgcacaca

SEQ ID NO: 815986 - DNA, 25 bp, Mus musculus
tggagataatctcgaacgacagtat

SEQ ID NO: 815987 - DNA, 25 bp, Mus musculus
tggagataatctggaacgacagtat

SEQ ID NO: 815988 - DNA, 25 bp, Mus musculus
tggagatagaggagcctagcagcct

SEQ ID NO: 815989 - DNA, 25 bp, Mus musculus
tggagatagaggtgcctagcagcct

SEQ ID NO: 815990 - DNA, 25 bp, Mus musculus
tggagatagatccaggcagaattgc

SEQ ID NO: 815991 - DNA, 25 bp, Mus musculus
tggagatagatcgaggcagaattgc

SEQ ID NO: 815992 - DNA, 25 bp, Mus musculus
tggagatagcaaactcgaaagcttc

SEQ ID NO: 815993 - DNA, 25 bp, Mus musculus
tggagatagcaatctcgaaagcttc

SEQ ID NO: 815994 - DNA, 25 bp, Mus musculus
tggagatcaccaagctgtcccaggg

SEQ ID NO: 815995 - DNA, 25 bp, Mus musculus
tggagatcaccaccagcattctctg

SEQ ID NO: 815996 - DNA, 25 bp, Mus musculus
tggagatcaccagcagcattctctg

SEQ ID NO: 815997 - DNA, 25 bp, Mus musculus
tggagatcaccatgctgtcccaggg

SEQ ID NO: 815998 - DNA, 25 bp, Mus musculus
tggagatcacggacgagaaggacaa

SEQ ID NO: 815999 - DNA, 25 bp, Mus musculus
tggagatcacggtcgagaaggacaa

SEQ ID NO: 816000 - DNA, 25 bp, Mus musculus
tggagatcatgacacagaagaagca

SEQ ID NO: 816001 - DNA, 25 bp, Mus musculus
tggagatcatgagacagaagaagca

SEQ ID NO: 816002 - DNA, 25 bp, Mus musculus
tggagatcattaatgccaccactgg

SEQ ID NO: 816003 - DNA, 25 bp, Mus musculus
tggagatcattattgccaccactgg

SEQ ID NO: 816004 - DNA, 25 bp, Mus musculus
tggagatcattgctggcatcctggc

SEQ ID NO: 816005 - DNA, 25 bp, Mus musculus
tggagatcattggtggcatcctggc

SEQ ID NO: 816006 - DNA, 25 bp, Mus musculus
tggagatccctgcaaccgtgactgc

SEQ ID NO: 816007 - DNA, 25 bp, Mus musculus
tggagatccctggaaccgtgactgc

SEQ ID NO: 816008 - DNA, 25 bp, Mus musculus
tggagatcgaaacgcctatactggg

SEQ ID NO: 816009 - DNA, 25 bp, Mus musculus
tggagatcgaaaggcctatactggg

SEQ ID NO: 816010 - DNA, 25 bp, Mus musculus
tggagatcgttcagaccatgaacag

SEQ ID NO: 816011 - DNA, 25 bp, Mus musculus
tggagatcgttctgaccatgaacag

SEQ ID NO: 816012 - DNA, 25 bp, Mus musculus
tggagatctggcaggtgtacctcga

SEQ ID NO: 816013 - DNA, 25 bp, Mus musculus
tggagatctggctggtgtacctcga

SEQ ID NO: 816014 - DNA, 25 bp, Mus musculus
tggagatgaaaaccgacctcttgat

SEQ ID NO: 816015 - DNA, 25 bp, Mus musculus
tggagatgaaaagcgacctcttgat

SEQ ID NO: 816016 - DNA, 25 bp, Mus musculus
tggagatgaagcatcctcactaggg

SEQ ID NO: 816017 - DNA, 25 bp, Mus musculus
tggagatgaagcttcctcactaggg

SEQ ID NO: 816018 - DNA, 25 bp, Mus musculus
tggagatgaccacgaaattcatgtc

SEQ ID NO: 816019 - DNA, 25 bp, Mus musculus
tggagatgaccaggaaattcatgtc

SEQ ID NO: 816020 - DNA, 25 bp, Mus musculus
tggagatgactccatccggtaccca

SEQ ID NO: 816021 - DNA, 25 bp, Mus musculus
tggagatgactcgatccggtaccca

SEQ ID NO: 816022 - DNA, 25 bp, Mus musculus
tggagatgagccaatcttccacatt

SEQ ID NO: 816023 - DNA, 25 bp, Mus musculus
tggagatgagcccaaatcgaatcgc

SEQ ID NO: 816024 - DNA, 25 bp, Mus musculus
tggagatgagccgaaatcgaatcgc

SEQ ID NO: 816025 - DNA, 25 bp, Mus musculus
tggagatgagcctatcttccacatt

SEQ ID NO: 816026 - DNA, 25 bp, Mus musculus
tggagatgaggcacaagtcagaaac

SEQ ID NO: 816027 - DNA, 25 bp, Mus musculus
tggagatgaggctcaagtcagaaac

SEQ ID NO: 816028 - DNA, 25 bp, Mus musculus
tggagatgagtactatacactgtcc

SEQ ID NO: 816029 - DNA, 25 bp, Mus musculus
tggagatgagtagtatacactgtcc

SEQ ID NO: 816030 - DNA, 25 bp, Mus musculus
tggagatgagttactcaaaataggg

SEQ ID NO: 816031 - DNA, 25 bp, Mus musculus
tggagatgagtttctcaaaataggg

SEQ ID NO: 816032 - DNA, 25 bp, Mus musculus
tggagatgatggagccctccacacc

SEQ ID NO: 816033 - DNA, 25 bp, Mus musculus
tggagatgatggtgccctccacacc

SEQ ID NO: 816034 - DNA, 25 bp, Mus musculus
tggagatgcacacctgtgagctcag

SEQ ID NO: 816035 - DNA, 25 bp, Mus musculus
tggagatgcacagctgtgagctcag

SEQ ID NO: 816036 - DNA, 25 bp, Mus musculus
tggagatgcaggagagccatggaga

SEQ ID NO: 816037 - DNA, 25 bp, Mus musculus
tggagatgcaggtgagccatggaga

SEQ ID NO: 816038 - DNA, 25 bp, Mus musculus
tggagatgccccaaggaaactatac

SEQ ID NO: 816039 - DNA, 25 bp, Mus musculus
tggagatgcccctaggaaactatac

SEQ ID NO: 816040 - DNA, 25 bp, Mus musculus
tggagatgcccgaccaagaacatca

SEQ ID NO: 816041 - DNA, 25 bp, Mus musculus
tggagatgcccgtccaagaacatca

SEQ ID NO: 816042 - DNA, 25 bp, Mus musculus
tggagatggacccaaattagaaagt

SEQ ID NO: 816043 - DNA, 25 bp, Mus musculus
tggagatggaccgaaattagaaagt

SEQ ID NO: 816044 - DNA, 25 bp, Mus musculus
tggagatggccaagttccgatacat

SEQ ID NO: 816045 - DNA, 25 bp, Mus musculus
tggagatggccacgtcaattatgaa

SEQ ID NO: 816046 - DNA, 25 bp, Mus musculus
tggagatggccaggtcaattatgaa

SEQ ID NO: 816047 - DNA, 25 bp, Mus musculus
tggagatggccatgttccgatacat

SEQ ID NO: 816048 - DNA, 25 bp, Mus musculus
tggagatgtactccgaagagccctt

SEQ ID NO: 816049 - DNA, 25 bp, Mus musculus
tggagatgtactgcgaagagccctt

SEQ ID NO: 816050 - DNA, 25 bp, Mus musculus
tggagattaaccctgactacgctgc

SEQ ID NO: 816051 - DNA, 25 bp, Mus musculus
tggagattaaccgtgactacgctgc

SEQ ID NO: 816052 - DNA, 25 bp, Mus musculus
tggagattaagcactgcctgctgtc

SEQ ID NO: 816053 - DNA, 25 bp, Mus musculus
tggagattaagctctgcctgctgtc

SEQ ID NO: 816054 - DNA, 25 bp, Mus musculus
tggagattcagcaagcaaaagccag

SEQ ID NO: 816055 - DNA, 25 bp, Mus musculus
tggagattcagctagcaaaagccag

SEQ ID NO: 816056 - DNA, 25 bp, Mus musculus
tggagattctgcagacaaaggatgt

SEQ ID NO: 816057 - DNA, 25 bp, Mus musculus
tggagattctgctgacaaaggatgt

SEQ ID NO: 816058 - DNA, 25 bp, Mus musculus
tggagattgtatacgcctcgctggg

SEQ ID NO: 816059 - DNA, 25 bp, Mus musculus
tggagattgtattcgcctcgctggg

SEQ ID NO: 816060 - DNA, 25 bp, Mus musculus
tggagatttcaaagtggcagctact

SEQ ID NO: 816061 - DNA, 25 bp, Mus musculus
tggagatttcaatgtggcagctact

SEQ ID NO: 816062 - DNA, 25 bp, Mus musculus
tggagatttctgatgcagtgagtga

SEQ ID NO: 816063 - DNA, 25 bp, Mus musculus
tggagatttctgttgcagtgagtga

SEQ ID NO: 816064 - DNA, 25 bp, Mus musculus
tggagcaaaacccaggaagtacgac

SEQ ID NO: 816065 - DNA, 25 bp, Mus musculus
tggagcaaaaccgaggaagtacgac

SEQ ID NO: 816066 - DNA, 25 bp, Mus musculus
tggagcaaacctcaagccagctgtg

SEQ ID NO: 816067 - DNA, 25 bp, Mus musculus
tggagcaaacctgaagccagctgtg

SEQ ID NO: 816068 - DNA, 25 bp, Mus musculus
tggagcaaagccaagacagtatcgc

SEQ ID NO: 816069 - DNA, 25 bp, Mus musculus
tggagcaaagcctagacagtatcgc

SEQ ID NO: 816070 - DNA, 25 bp, Mus musculus
tggagcaacagacggcctgatctac

SEQ ID NO: 816071 - DNA, 25 bp, Mus musculus
tggagcaacagagggcctgatctac

SEQ ID NO: 816072 - DNA, 25 bp, Mus musculus
tggagcaaccgcaaatccaatttgg

SEQ ID NO: 816073 - DNA, 25 bp, Mus musculus
tggagcaaccgctaatccaatttgg

SEQ ID NO: 816074 - DNA, 25 bp, Mus musculus
tggagcaaccggcagaaggcaaaac

SEQ ID NO: 816075 - DNA, 25 bp, Mus musculus
tggagcaaccgggagaaggcaaaac

SEQ ID NO: 816076 - DNA, 25 bp, Mus musculus
tggagcaagacacataaagccccgc

SEQ ID NO: 816077 - DNA, 25 bp, Mus musculus
tggagcaagacagataaagccccgc

SEQ ID NO: 816078 - DNA, 25 bp, Mus musculus
tggagcaagccaagctggatgctct

SEQ ID NO: 816079 - DNA, 25 bp, Mus musculus
tggagcaagccatgctggatgctct

SEQ ID NO: 816080 - DNA, 25 bp, Mus musculus
tggagcaagttacaaaagcccctgc

SEQ ID NO: 816081 - DNA, 25 bp, Mus musculus
tggagcaagttagaaaagcccctgc

SEQ ID NO: 816082 - DNA, 25 bp, Mus musculus
tggagcaatacaactgccaagagac

SEQ ID NO: 816083 - DNA, 25 bp, Mus musculus
tggagcaatacatctgccaagagac

SEQ ID NO: 816084 - DNA, 25 bp, Mus musculus
tggagcaatcgaagatcttttacag

SEQ ID NO: 816085 - DNA, 25 bp, Mus musculus
tggagcaatcgatgatcttttacag

SEQ ID NO: 816086 - DNA, 25 bp, Mus musculus
tggagcacaaaaactggacgaggcc

SEQ ID NO: 816087 - DNA, 25 bp, Mus musculus
tggagcacaaaatctggacgaggcc

SEQ ID NO: 816088 - DNA, 25 bp, Mus musculus
tggagcacaactacaaagctgggag

SEQ ID NO: 816089 - DNA, 25 bp, Mus musculus
tggagcacaacttcaaagctgggag

SEQ ID NO: 816090 - DNA, 25 bp, Mus musculus
tggagcacagcaagaaataccccgg

SEQ ID NO: 816091 - DNA, 25 bp, Mus musculus
tggagcacagcatgaaataccccgg

SEQ ID NO: 816092 - DNA, 25 bp, Mus musculus
tggagcacagcgaccagtgcgctgt

SEQ ID NO: 816093 - DNA, 25 bp, Mus musculus
tggagcacagcgtccagtgcgctgt

SEQ ID NO: 816094 - DNA, 25 bp, Mus musculus
tggagcacccggacaccgagttacc

SEQ ID NO: 816095 - DNA, 25 bp, Mus musculus
tggagcacccggtcaccgagttacc

SEQ ID NO: 816096 - DNA, 25 bp, Mus musculus
tggagcactccaacatgtacccggt

SEQ ID NO: 816097 - DNA, 25 bp, Mus musculus
tggagcactccatcatgtacccggt

SEQ ID NO: 816098 - DNA, 25 bp, Mus musculus
tggagcactcgaacctggacaggcc

SEQ ID NO: 816099 - DNA, 25 bp, Mus musculus
tggagcactcgatcctggacaggcc

SEQ ID NO: 816100 - DNA, 25 bp, Mus musculus
tggagcactttcacaaatacatggg

SEQ ID NO: 816101 - DNA, 25 bp, Mus musculus
tggagcactttctcaaatacatggg

SEQ ID NO: 816102 - DNA, 25 bp, Mus musculus
tggagcagaagcagtcccgcctgga

SEQ ID NO: 816103 - DNA, 25 bp, Mus musculus
tggagcagaagctgtcccgcctgga

SEQ ID NO: 816104 - DNA, 25 bp, Mus musculus
tggagcagagagacaacagatgtaa

SEQ ID NO: 816105 - DNA, 25 bp, Mus musculus
tggagcagagagtcaacagatgtaa

SEQ ID NO: 816106 - DNA, 25 bp, Mus musculus
tggagcagaggaagcgagtcactca

SEQ ID NO: 816107 - DNA, 25 bp, Mus musculus
tggagcagaggatgcgagtcactca

SEQ ID NO: 816108 - DNA, 25 bp, Mus musculus
tggagcagcaacagccagtgcacca

SEQ ID NO: 816109 - DNA, 25 bp, Mus musculus
tggagcagcaactgccagtgcacca

SEQ ID NO: 816110 - DNA, 25 bp, Mus musculus
tggagcagctcaagcgccattactg

SEQ ID NO: 816111 - DNA, 25 bp, Mus musculus
tggagcagctcatgcgccattactg

SEQ ID NO: 816112 - DNA, 25 bp, Mus musculus
tggagcagctcccaccgttttctca

SEQ ID NO: 816113 - DNA, 25 bp, Mus musculus
tggagcagctccgaccgttttctca

SEQ ID NO: 816114 - DNA, 25 bp, Mus musculus
tggagcagctgtagtcaatgcattt

SEQ ID NO: 816115 - DNA, 25 bp, Mus musculus
tggagcagctgttgtcaatgcattt

SEQ ID NO: 816116 - DNA, 25 bp, Mus musculus
tggagcagcttgagacgtccgactc

SEQ ID NO: 816117 - DNA, 25 bp, Mus musculus
tggagcagcttgtgacgtccgactc

SEQ ID NO: 816118 - DNA, 25 bp, Mus musculus
tggagcaggaacagcctctgtggcc

SEQ ID NO: 816119 - DNA, 25 bp, Mus musculus
tggagcaggaactgcctctgtggcc

SEQ ID NO: 816120 - DNA, 25 bp, Mus musculus
tggagcaggtccagcagctcttccc

SEQ ID NO: 816121 - DNA, 25 bp, Mus musculus
tggagcaggtcctgcagctcttccc

SEQ ID NO: 816122 - DNA, 25 bp, Mus musculus
tggagcagtacaaggacgaccagta

SEQ ID NO: 816123 - DNA, 25 bp, Mus musculus
tggagcagtacatggacgaccagta

SEQ ID NO: 816124 - DNA, 25 bp, Mus musculus
tggagcagtcctacttcaatgactg

SEQ ID NO: 816125 - DNA, 25 bp, Mus musculus
tggagcagtccttcttcaatgactg

SEQ ID NO: 816126 - DNA, 25 bp, Mus musculus
tggagcagtgcaagtgcccctctct

SEQ ID NO: 816127 - DNA, 25 bp, Mus musculus
tggagcagtgcatgtgcccctctct

SEQ ID NO: 816128 - DNA, 25 bp, Mus musculus
tggagcagttcaatggccaagcgcc

SEQ ID NO: 816129 - DNA, 25 bp, Mus musculus
tggagcagttcattggccaagcgcc

SEQ ID NO: 816130 - DNA, 25 bp, Mus musculus
tggagcatacaaccgatgaagatct

SEQ ID NO: 816131 - DNA, 25 bp, Mus musculus
tggagcatacaagcgatgaagatct

SEQ ID NO: 816132 - DNA, 25 bp, Mus musculus
tggagcataccaacagctctccttg

SEQ ID NO: 816133 - DNA, 25 bp, Mus musculus
tggagcataccatcagctctccttg

SEQ ID NO: 816134 - DNA, 25 bp, Mus musculus
tggagcatatccaacgccgtcaccg

SEQ ID NO: 816135 - DNA, 25 bp, Mus musculus
tggagcatatcctacgccgtcaccg

SEQ ID NO: 816136 - DNA, 25 bp, Mus musculus
tggagcatcccgcaggccttctgtg

SEQ ID NO: 816137 - DNA, 25 bp, Mus musculus
tggagcatcccggaggccttctgtg

SEQ ID NO: 816138 - DNA, 25 bp, Mus musculus
tggagcatgcgaaccggcacctgct

SEQ ID NO: 816139 - DNA, 25 bp, Mus musculus
tggagcatgcgatccggcacctgct

SEQ ID NO: 816140 - DNA, 25 bp, Mus musculus
tggagcatgcggacctacacactaa

SEQ ID NO: 816141 - DNA, 25 bp, Mus musculus
tggagcatgcggtcctacacactaa

SEQ ID NO: 816142 - DNA, 25 bp, Mus musculus
tggagcatgctaagtcggcggctac

SEQ ID NO: 816143 - DNA, 25 bp, Mus musculus
tggagcatgctatgtcggcggctac

SEQ ID NO: 816144 - DNA, 25 bp, Mus musculus
tggagcattaatatgggagcaatcc

SEQ ID NO: 816145 - DNA, 25 bp, Mus musculus
tggagcattaatttgggagcaatcc

SEQ ID NO: 816146 - DNA, 25 bp, Mus musculus
tggagcattcctagcagaggagagc

SEQ ID NO: 816147 - DNA, 25 bp, Mus musculus
tggagcattccttgcagaggagagc

SEQ ID NO: 816148 - DNA, 25 bp, Mus musculus
tggagccaactcagatccagctcag

SEQ ID NO: 816149 - DNA, 25 bp, Mus musculus
tggagccaactctgatccagctcag

SEQ ID NO: 816150 - DNA, 25 bp, Mus musculus
tggagccaacttcaggcgttacaat

SEQ ID NO: 816151 - DNA, 25 bp, Mus musculus
tggagccaacttgaggcgttacaat

SEQ ID NO: 816152 - DNA, 25 bp, Mus musculus
tggagccaatcactaatcctgttgc

SEQ ID NO: 816153 - DNA, 25 bp, Mus musculus
tggagccaatcagtaatcctgttgc

SEQ ID NO: 816154 - DNA, 25 bp, Mus musculus
tggagccacaaactgagtctagatt

SEQ ID NO: 816155 - DNA, 25 bp, Mus musculus
tggagccacaaagtgagtctagatt

SEQ ID NO: 816156 - DNA, 25 bp, Mus musculus
tggagccacatgacacagcagtgtg

SEQ ID NO: 816157 - DNA, 25 bp, Mus musculus
tggagccacatgtcacagcagtgtg

SEQ ID NO: 816158 - DNA, 25 bp, Mus musculus
tggagccagaacagtgccaaatact

SEQ ID NO: 816159 - DNA, 25 bp, Mus musculus
tggagccagaactgtgccaaatact

SEQ ID NO: 816160 - DNA, 25 bp, Mus musculus
tggagccagcaaagcgctctgtgcc

SEQ ID NO: 816161 - DNA, 25 bp, Mus musculus
tggagccagcaatgcgctctgtgcc

SEQ ID NO: 816162 - DNA, 25 bp, Mus musculus
tggagccagcaccaacattctcagg

SEQ ID NO: 816163 - DNA, 25 bp, Mus musculus
tggagccagcacgaacattctcagg

SEQ ID NO: 816164 - DNA, 25 bp, Mus musculus
tggagccagccaaacaagagctgtt

SEQ ID NO: 816165 - DNA, 25 bp, Mus musculus
tggagccagccatacaagagctgtt

SEQ ID NO: 816166 - DNA, 25 bp, Mus musculus
tggagccagctacccatactaattt

SEQ ID NO: 816167 - DNA, 25 bp, Mus musculus
tggagccagctaccggttcgcgacc

SEQ ID NO: 816168 - DNA, 25 bp, Mus musculus
tggagccagctagccatactaattt

SEQ ID NO: 816169 - DNA, 25 bp, Mus musculus
tggagccagctagcggttcgcgacc

SEQ ID NO: 816170 - DNA, 25 bp, Mus musculus
tggagccagggcaaaggagttcacc

SEQ ID NO: 816171 - DNA, 25 bp, Mus musculus
tggagccagggctaaggagttcacc

SEQ ID NO: 816172 - DNA, 25 bp, Mus musculus
tggagccatcgtaaatgccatcggg

SEQ ID NO: 816173 - DNA, 25 bp, Mus musculus
tggagccatcgttaatgccatcggg

SEQ ID NO: 816174 - DNA, 25 bp, Mus musculus
tggagccatggtactggccgatggt

SEQ ID NO: 816175 - DNA, 25 bp, Mus musculus
tggagccatggtagtcccggcctgc

SEQ ID NO: 816176 - DNA, 25 bp, Mus musculus
tggagccatggttctggccgatggt

SEQ ID NO: 816177 - DNA, 25 bp, Mus musculus
tggagccatggttgtcccggcctgc

SEQ ID NO: 816178 - DNA, 25 bp, Mus musculus
tggagccattatcgcacgcatcgcc

SEQ ID NO: 816179 - DNA, 25 bp, Mus musculus
tggagccattatggcacgcatcgcc

SEQ ID NO: 816180 - DNA, 25 bp, Mus musculus
tggagcccaaggaggttcccctgat

SEQ ID NO: 816181 - DNA, 25 bp, Mus musculus
tggagcccaaggtggttcccctgat

SEQ ID NO: 816182 - DNA, 25 bp, Mus musculus
tggagcccacgaattcatctctggg

SEQ ID NO: 816183 - DNA, 25 bp, Mus musculus
tggagcccacgatttcatctctggg

SEQ ID NO: 816184 - DNA, 25 bp, Mus musculus
tggagcccagaactgtaagaaatac

SEQ ID NO: 816185 - DNA, 25 bp, Mus musculus
tggagcccagaagtgtaagaaatac

SEQ ID NO: 816186 - DNA, 25 bp, Mus musculus
tggagcccagcaaagagtatgagcc

SEQ ID NO: 816187 - DNA, 25 bp, Mus musculus
tggagcccagcatagagtatgagcc

SEQ ID NO: 816188 - DNA, 25 bp, Mus musculus
tggagcccatcccagggagactcct

SEQ ID NO: 816189 - DNA, 25 bp, Mus musculus
tggagcccatccgagggagactcct

SEQ ID NO: 816190 - DNA, 25 bp, Mus musculus
tggagccccagaccgaactaatttc

SEQ ID NO: 816191 - DNA, 25 bp, Mus musculus
tggagccccagagcgaactaatttc

SEQ ID NO: 816192 - DNA, 25 bp, Mus musculus
tggagcccctaactcaggattctgt

SEQ ID NO: 816193 - DNA, 25 bp, Mus musculus
tggagcccctaagtcaggattctgt

SEQ ID NO: 816194 - DNA, 25 bp, Mus musculus
tggagcccctataccaacaaacgaa

SEQ ID NO: 816195 - DNA, 25 bp, Mus musculus
tggagcccctattccaacaaacgaa

SEQ ID NO: 816196 - DNA, 25 bp, Mus musculus
tggagccctctgctcctacaggact

SEQ ID NO: 816197 - DNA, 25 bp, Mus musculus
tggagccctctggtcctacaggact

SEQ ID NO: 816198 - DNA, 25 bp, Mus musculus
tggagccctgttaggcctctgacaa

SEQ ID NO: 816199 - DNA, 25 bp, Mus musculus
tggagccctgtttggcctctgacaa

SEQ ID NO: 816200 - DNA, 25 bp, Mus musculus
tggagccgccacatcgaagcgtctt

SEQ ID NO: 816201 - DNA, 25 bp, Mus musculus
tggagccgccacttcgaagcgtctt

SEQ ID NO: 816202 - DNA, 25 bp, Mus musculus
tggagccggagcctacattctgtcg

SEQ ID NO: 816203 - DNA, 25 bp, Mus musculus
tggagccggagcgtacattctgtcg

SEQ ID NO: 816204 - DNA, 25 bp, Mus musculus
tggagccggcaacggctcaagcctt

SEQ ID NO: 816205 - DNA, 25 bp, Mus musculus
tggagccggcaagggctcaagcctt

SEQ ID NO: 816206 - DNA, 25 bp, Mus musculus
tggagccgtcgccttcggcaaacag

SEQ ID NO: 816207 - DNA, 25 bp, Mus musculus
tggagccgtcgcgttcggcaaacag

SEQ ID NO: 816208 - DNA, 25 bp, Mus musculus
tggagcctcgacataagcctgtctt

SEQ ID NO: 816209 - DNA, 25 bp, Mus musculus
tggagcctcgacttaagcctgtctt

SEQ ID NO: 816210 - DNA, 25 bp, Mus musculus
tggagcctcggcatcagattagaac

SEQ ID NO: 816211 - DNA, 25 bp, Mus musculus
tggagcctcggcttcagattagaac

SEQ ID NO: 816212 - DNA, 25 bp, Mus musculus
tggagcctctgaatgtattagcccc

SEQ ID NO: 816213 - DNA, 25 bp, Mus musculus
tggagcctctgattgtattagcccc

SEQ ID NO: 816214 - DNA, 25 bp, Mus musculus
tggagcctgccgaaaagcaccatag

SEQ ID NO: 816215 - DNA, 25 bp, Mus musculus
tggagcctgccgtaaagcaccatag

SEQ ID NO: 816216 - DNA, 25 bp, Mus musculus
tggagcctggaaacccacagtgggc

SEQ ID NO: 816217 - DNA, 25 bp, Mus musculus
tggagcctggaatcccacagtgggc

SEQ ID NO: 816218 - DNA, 25 bp, Mus musculus
tggagcctgggcctgatccttttca

SEQ ID NO: 816219 - DNA, 25 bp, Mus musculus
tggagcctgggcgtgatccttttca

SEQ ID NO: 816220 - DNA, 25 bp, Mus musculus
tggagcctgtgcacaagtggagaaa

SEQ ID NO: 816221 - DNA, 25 bp, Mus musculus
tggagcctgtgctcaagtggagaaa

SEQ ID NO: 816222 - DNA, 25 bp, Mus musculus
tggagccttcctataaccacgcagg

SEQ ID NO: 816223 - DNA, 25 bp, Mus musculus
tggagccttcctttaaccacgcagg

SEQ ID NO: 816224 - DNA, 25 bp, Mus musculus
tggagccttctactgcgagtgtctc

SEQ ID NO: 816225 - DNA, 25 bp, Mus musculus
tggagccttctagtgcgagtgtctc

SEQ ID NO: 816226 - DNA, 25 bp, Mus musculus
tggagccttctgatgcacaaacctc

SEQ ID NO: 816227 - DNA, 25 bp, Mus musculus
tggagccttctgttgcacaaacctc

SEQ ID NO: 816228 - DNA, 25 bp, Mus musculus
tggagccttggaacctggagtccct

SEQ ID NO: 816229 - DNA, 25 bp, Mus musculus
tggagccttggatcctggagtccct

SEQ ID NO: 816230 - DNA, 25 bp, Mus musculus
tggagcgacaccagaagatccacac

SEQ ID NO: 816231 - DNA, 25 bp, Mus musculus
tggagcgacacctgaagatccacac

SEQ ID NO: 816232 - DNA, 25 bp, Mus musculus
tggagcgacagcatctccggtgcct

SEQ ID NO: 816233 - DNA, 25 bp, Mus musculus
tggagcgacagcttctccggtgcct

SEQ ID NO: 816234 - DNA, 25 bp, Mus musculus
tggagcgacattaaaagcggcagca

SEQ ID NO: 816235 - DNA, 25 bp, Mus musculus
tggagcgacatttaaagcggcagca

SEQ ID NO: 816236 - DNA, 25 bp, Mus musculus
tggagcgacggaagccacagttgct

SEQ ID NO: 816237 - DNA, 25 bp, Mus musculus
tggagcgacggatgccacagttgct

SEQ ID NO: 816238 - DNA, 25 bp, Mus musculus
tggagcgacgtccaacccttttgaa

SEQ ID NO: 816239 - DNA, 25 bp, Mus musculus
tggagcgacgtcgaacccttttgaa

SEQ ID NO: 816240 - DNA, 25 bp, Mus musculus
tggagcgactgcaaaaagaacaaga

SEQ ID NO: 816241 - DNA, 25 bp, Mus musculus
tggagcgactgctaaaagaacaaga

SEQ ID NO: 816242 - DNA, 25 bp, Mus musculus
tggagcgattcaatttcaactctga

SEQ ID NO: 816243 - DNA, 25 bp, Mus musculus
tggagcgattcattttcaactctga

SEQ ID NO: 816244 - DNA, 25 bp, Mus musculus
tggagcgattctcccgccagctcag

SEQ ID NO: 816245 - DNA, 25 bp, Mus musculus
tggagcgattctgccgccagctcag

SEQ ID NO: 816246 - DNA, 25 bp, Mus musculus
tggagcgattgtcataaggctgaca

SEQ ID NO: 816247 - DNA, 25 bp, Mus musculus
tggagcgattgtgataaggctgaca

SEQ ID NO: 816248 - DNA, 25 bp, Mus musculus
tggagcgccaggagggccacacaca

SEQ ID NO: 816249 - DNA, 25 bp, Mus musculus
tggagcgccaggtgggccacacaca

SEQ ID NO: 816250 - DNA, 25 bp, Mus musculus
tggagcgcctgcaccagtcattctt

SEQ ID NO: 816251 - DNA, 25 bp, Mus musculus
tggagcgcctgctccagtcattctt

SEQ ID NO: 816252 - DNA, 25 bp, Mus musculus
tggagcgctccaactacagtgactt

SEQ ID NO: 816253 - DNA, 25 bp, Mus musculus
tggagcgctccatctacagtgactt

SEQ ID NO: 816254 - DNA, 25 bp, Mus musculus
tggagcgctgcaccagctttctggt

SEQ ID NO: 816255 - DNA, 25 bp, Mus musculus
tggagcgctgcagcagctttctggt

SEQ ID NO: 816256 - DNA, 25 bp, Mus musculus
tggagcggacagaagccaccctgga

SEQ ID NO: 816257 - DNA, 25 bp, Mus musculus
tggagcggacagtagccaccctgga

SEQ ID NO: 816258 - DNA, 25 bp, Mus musculus
tggagcggacctcctgttatgaagc

SEQ ID NO: 816259 - DNA, 25 bp, Mus musculus
tggagcggacctgctgttatgaagc

SEQ ID NO: 816260 - DNA, 25 bp, Mus musculus
tggagcggactgacaaagaagtgct

SEQ ID NO: 816261 - DNA, 25 bp, Mus musculus
tggagcggactgtcaaagaagtgct

SEQ ID NO: 816262 - DNA, 25 bp, Mus musculus
tggagcggataaagatgcccaggac

SEQ ID NO: 816263 - DNA, 25 bp, Mus musculus
tggagcggataatgatgcccaggac

SEQ ID NO: 816264 - DNA, 25 bp, Mus musculus
tggagcggataccaatggacagcat

SEQ ID NO: 816265 - DNA, 25 bp, Mus musculus
tggagcggatacgaatggacagcat

SEQ ID NO: 816266 - DNA, 25 bp, Mus musculus
tggagcggcagcagatcagccagtt

SEQ ID NO: 816267 - DNA, 25 bp, Mus musculus
tggagcggcagctgatcagccagtt

SEQ ID NO: 816268 - DNA, 25 bp, Mus musculus
tggagcggctctccgacagactgct

SEQ ID NO: 816269 - DNA, 25 bp, Mus musculus
tggagcggctctgcgacagactgct

SEQ ID NO: 816270 - DNA, 25 bp, Mus musculus
tggagcggcttcaccgcccgagaac

SEQ ID NO: 816271 - DNA, 25 bp, Mus musculus
tggagcggcttctccgcccgagaac

SEQ ID NO: 816272 - DNA, 25 bp, Mus musculus
tggagcgggattacagcagatacaa

SEQ ID NO: 816273 - DNA, 25 bp, Mus musculus
tggagcgggatttcagcagatacaa

SEQ ID NO: 816274 - DNA, 25 bp, Mus musculus
tggagcggttccagcggagactcca

SEQ ID NO: 816275 - DNA, 25 bp, Mus musculus
tggagcggttcctgcggagactcca

SEQ ID NO: 816276 - DNA, 25 bp, Mus musculus
tggagcgtcagacttaacaggaagc

SEQ ID NO: 816277 - DNA, 25 bp, Mus musculus
tggagcgtcagagttaacaggaagc

SEQ ID NO: 816278 - DNA, 25 bp, Mus musculus
tggagcgtcatcaactgtgtgcagt

SEQ ID NO: 816279 - DNA, 25 bp, Mus musculus
tggagcgtcatctactgtgtgcagt

SEQ ID NO: 816280 - DNA, 25 bp, Mus musculus
tggagcgtcccacaatcgcttcgaa

SEQ ID NO: 816281 - DNA, 25 bp, Mus musculus
tggagcgtcccagaatcgcttcgaa

SEQ ID NO: 816282 - DNA, 25 bp, Mus musculus
tggagcgtgtctacagccaacggag

SEQ ID NO: 816283 - DNA, 25 bp, Mus musculus
tggagcgtgtcttcagccaacggag

SEQ ID NO: 816284 - DNA, 25 bp, Mus musculus
tggagctaagttcccagtcaagtgg

SEQ ID NO: 816285 - DNA, 25 bp, Mus musculus
tggagctaagttgccagtcaagtgg

SEQ ID NO: 816286 - DNA, 25 bp, Mus musculus
tggagctaatccaaggaggtttcct

SEQ ID NO: 816287 - DNA, 25 bp, Mus musculus
tggagctaatcctaggaggtttcct

SEQ ID NO: 816288 - DNA, 25 bp, Mus musculus
tggagctaccgaaattgaattggct

SEQ ID NO: 816289 - DNA, 25 bp, Mus musculus
tggagctaccgatattgaattggct

SEQ ID NO: 816290 - DNA, 25 bp, Mus musculus
tggagctactctccaaggtgtacag

SEQ ID NO: 816291 - DNA, 25 bp, Mus musculus
tggagctactctgcaaggtgtacag

SEQ ID NO: 816292 - DNA, 25 bp, Mus musculus
tggagctactgaaccagctggacgg

SEQ ID NO: 816293 - DNA, 25 bp, Mus musculus
tggagctactgatccagctggacgg

SEQ ID NO: 816294 - DNA, 25 bp, Mus musculus
tggagctagagtatgcaccctgcag

SEQ ID NO: 816295 - DNA, 25 bp, Mus musculus
tggagctagagtttgcaccctgcag

SEQ ID NO: 816296 - DNA, 25 bp, Mus musculus
tggagctagttccaggccctcggta

SEQ ID NO: 816297 - DNA, 25 bp, Mus musculus
tggagctagttcgaggccctcggta

SEQ ID NO: 816298 - DNA, 25 bp, Mus musculus
tggagctcagagaggcttttgccaa

SEQ ID NO: 816299 - DNA, 25 bp, Mus musculus
tggagctcagagtggcttttgccaa

SEQ ID NO: 816300 - DNA, 25 bp, Mus musculus
tggagctcagtgagcctgctgacta

SEQ ID NO: 816301 - DNA, 25 bp, Mus musculus
tggagctcagtgtgcctgctgacta

SEQ ID NO: 816302 - DNA, 25 bp, Mus musculus
tggagctcataaagtgagaaagaga

SEQ ID NO: 816303 - DNA, 25 bp, Mus musculus
tggagctcataatgtgagaaagaga

SEQ ID NO: 816304 - DNA, 25 bp, Mus musculus
tggagctcatcacgctgctgcggct

SEQ ID NO: 816305 - DNA, 25 bp, Mus musculus
tggagctcatcaggctgctgcggct

SEQ ID NO: 816306 - DNA, 25 bp, Mus musculus
tggagctcatgcagtacctccctca

SEQ ID NO: 816307 - DNA, 25 bp, Mus musculus
tggagctcatgctgtacctccctca

SEQ ID NO: 816308 - DNA, 25 bp, Mus musculus
tggagctccacgaaggatccttaga

SEQ ID NO: 816309 - DNA, 25 bp, Mus musculus
tggagctccacgtaggatccttaga

SEQ ID NO: 816310 - DNA, 25 bp, Mus musculus
tggagctccgccctggcggcgtggg

SEQ ID NO: 816311 - DNA, 25 bp, Mus musculus
tggagctccgccgtggcggcgtggg

SEQ ID NO: 816312 - DNA, 25 bp, Mus musculus
tggagctcctggctctcacaggcta

SEQ ID NO: 816313 - DNA, 25 bp, Mus musculus
tggagctcctgggtctcacaggcta

SEQ ID NO: 816314 - DNA, 25 bp, Mus musculus
tggagctcctttaactacagactgg

SEQ ID NO: 816315 - DNA, 25 bp, Mus musculus
tggagctccttttactacagactgg

SEQ ID NO: 816316 - DNA, 25 bp, Mus musculus
tggagctcgtctcagaaaaatgttt

SEQ ID NO: 816317 - DNA, 25 bp, Mus musculus
tggagctcgtctgagaaaaatgttt

SEQ ID NO: 816318 - DNA, 25 bp, Mus musculus
tggagctgaactctctgctgctgct

SEQ ID NO: 816319 - DNA, 25 bp, Mus musculus
tggagctgaactgtctgctgctgct

SEQ ID NO: 816320 - DNA, 25 bp, Mus musculus
tggagctgacgccatcacctacata

SEQ ID NO: 816321 - DNA, 25 bp, Mus musculus
tggagctgacgcgatcacctacata

SEQ ID NO: 816322 - DNA, 25 bp, Mus musculus
tggagctgagccaagtgacaatcac

SEQ ID NO: 816323 - DNA, 25 bp, Mus musculus
tggagctgagcctagtgacaatcac

SEQ ID NO: 816324 - DNA, 25 bp, Mus musculus
tggagctgagtgagagtcaccctgc

SEQ ID NO: 816325 - DNA, 25 bp, Mus musculus
tggagctgagtgtgagtcaccctgc

SEQ ID NO: 816326 - DNA, 25 bp, Mus musculus
tggagctgatccacagcctcaggct

SEQ ID NO: 816327 - DNA, 25 bp, Mus musculus
tggagctgatcctcagcctcaggct

SEQ ID NO: 816328 - DNA, 25 bp, Mus musculus
tggagctgcatcagtagcaccgagc

SEQ ID NO: 816329 - DNA, 25 bp, Mus musculus
tggagctgcatctgtagcaccgagc

SEQ ID NO: 816330 - DNA, 25 bp, Mus musculus
tggagctgccacagagacatcctgc

SEQ ID NO: 816331 - DNA, 25 bp, Mus musculus
tggagctgccactgagacatcctgc

SEQ ID NO: 816332 - DNA, 25 bp, Mus musculus
tggagctgcgctagcacatggtgtc

SEQ ID NO: 816333 - DNA, 25 bp, Mus musculus
tggagctgcgcttgcacatggtgtc

SEQ ID NO: 816334 - DNA, 25 bp, Mus musculus
tggagctgcggtccacacttgtgct

SEQ ID NO: 816335 - DNA, 25 bp, Mus musculus
tggagctgcggtgcacacttgtgct

SEQ ID NO: 816336 - DNA, 25 bp, Mus musculus
tggagctgctgtactggaagaacac

SEQ ID NO: 816337 - DNA, 25 bp, Mus musculus
tggagctgctgttctggaagaacac

SEQ ID NO: 816338 - DNA, 25 bp, Mus musculus
tggagctgggcaacgaacggcttct

SEQ ID NO: 816339 - DNA, 25 bp, Mus musculus
tggagctgggcatcgaacggcttct

SEQ ID NO: 816340 - DNA, 25 bp, Mus musculus
tggagctggtacaatactgccacgc

SEQ ID NO: 816341 - DNA, 25 bp, Mus musculus
tggagctggtactatactgccacgc

SEQ ID NO: 816342 - DNA, 25 bp, Mus musculus
tggagctggtgtcaagtatctgtca

SEQ ID NO: 816343 - DNA, 25 bp, Mus musculus
tggagctggtgtgaagtatctgtca

SEQ ID NO: 816344 - DNA, 25 bp, Mus musculus
tggagctgtaaaaccacccacaaac

SEQ ID NO: 816345 - DNA, 25 bp, Mus musculus
tggagctgtaaatccacccacaaac

SEQ ID NO: 816346 - DNA, 25 bp, Mus musculus
tggagctgtgggactccctggccct

SEQ ID NO: 816347 - DNA, 25 bp, Mus musculus
tggagctgtgggtctccctggccct

SEQ ID NO: 816348 - DNA, 25 bp, Mus musculus
tggagctgtgtgacacagcctgtga

SEQ ID NO: 816349 - DNA, 25 bp, Mus musculus
tggagctgtgtgtcacagcctgtga

SEQ ID NO: 816350 - DNA, 25 bp, Mus musculus
tggagcttattaatggttatcccct

SEQ ID NO: 816351 - DNA, 25 bp, Mus musculus
tggagcttattattggttatcccct

SEQ ID NO: 816352 - DNA, 25 bp, Mus musculus
tggagcttcattctctctgcggagc

SEQ ID NO: 816353 - DNA, 25 bp, Mus musculus
tggagcttcattgtctctgcggagc

SEQ ID NO: 816354 - DNA, 25 bp, Mus musculus
tggagcttctccaggctgccaagaa

SEQ ID NO: 816355 - DNA, 25 bp, Mus musculus
tggagcttctcctggctgccaagaa

SEQ ID NO: 816356 - DNA, 25 bp, Mus musculus
tggagctttagtcgtaaaagcgaaa

SEQ ID NO: 816357 - DNA, 25 bp, Mus musculus
tggagctttagtggtaaaagcgaaa

SEQ ID NO: 816358 - DNA, 25 bp, Mus musculus
tggagcttttgaagagtgctgtgct

SEQ ID NO: 816359 - DNA, 25 bp, Mus musculus
tggagcttttgatgagtgctgtgct

SEQ ID NO: 816360 - DNA, 25 bp, Mus musculus
tggaggaaaacacctgtccacggtg

SEQ ID NO: 816361 - DNA, 25 bp, Mus musculus
tggaggaaaacagctgtccacggtg

SEQ ID NO: 816362 - DNA, 25 bp, Mus musculus
tggaggaacaaactactgaacagga

SEQ ID NO: 816363 - DNA, 25 bp, Mus musculus
tggaggaacaaagtactgaacagga

SEQ ID NO: 816364 - DNA, 25 bp, Mus musculus
tggaggaacaccactgctctacgct

SEQ ID NO: 816365 - DNA, 25 bp, Mus musculus
tggaggaacacctctgctctacgct

SEQ ID NO: 816366 - DNA, 25 bp, Mus musculus
tggaggaactgcacaccagccgccg

SEQ ID NO: 816367 - DNA, 25 bp, Mus musculus
tggaggaactgcaccgccaccgctg

SEQ ID NO: 816368 - DNA, 25 bp, Mus musculus
tggaggaactgctcaccagccgccg

SEQ ID NO: 816369 - DNA, 25 bp, Mus musculus
tggaggaactgctccgccaccgctg

SEQ ID NO: 816370 - DNA, 25 bp, Mus musculus
tggaggaacttcagagcataataaa

SEQ ID NO: 816371 - DNA, 25 bp, Mus musculus
tggaggaacttctgagcataataaa

SEQ ID NO: 816372 - DNA, 25 bp, Mus musculus
tggaggaagagaacgaccacctgcg

SEQ ID NO: 816373 - DNA, 25 bp, Mus musculus
tggaggaagagatcgaccacctgcg

SEQ ID NO: 816374 - DNA, 25 bp, Mus musculus
tggaggaagatgctgagcccatctt

SEQ ID NO: 816375 - DNA, 25 bp, Mus musculus
tggaggaagatggtgagcccatctt

SEQ ID NO: 816376 - DNA, 25 bp, Mus musculus
tggaggaagccaacacgggagattt

SEQ ID NO: 816377 - DNA, 25 bp, Mus musculus
tggaggaagccatcacgggagattt

SEQ ID NO: 816378 - DNA, 25 bp, Mus musculus
tggaggaagccccatactgacctcc

SEQ ID NO: 816379 - DNA, 25 bp, Mus musculus
tggaggaagcccgatactgacctcc

SEQ ID NO: 816380 - DNA, 25 bp, Mus musculus
tggaggaagctaccgcagcagtggc

SEQ ID NO: 816381 - DNA, 25 bp, Mus musculus
tggaggaagctagcgcagcagtggc

SEQ ID NO: 816382 - DNA, 25 bp, Mus musculus
tggaggaataggcagactgaggaag

SEQ ID NO: 816383 - DNA, 25 bp, Mus musculus
tggaggaatagggagactgaggaag

SEQ ID NO: 816384 - DNA, 25 bp, Mus musculus
tggaggaatcgtcttcgtcgtcatc

SEQ ID NO: 816385 - DNA, 25 bp, Mus musculus
tggaggaatcgtgttcgtcgtcatc

SEQ ID NO: 816386 - DNA, 25 bp, Mus musculus
tggaggaattagaaaagggactcca

SEQ ID NO: 816387 - DNA, 25 bp, Mus musculus
tggaggaattagtaaagggactcca

SEQ ID NO: 816388 - DNA, 25 bp, Mus musculus
tggaggacaacaatcctcgagctcg

SEQ ID NO: 816389 - DNA, 25 bp, Mus musculus
tggaggacaacattcctcgagctcg

SEQ ID NO: 816390 - DNA, 25 bp, Mus musculus
tggaggacacaaacgcccaggtact

SEQ ID NO: 816391 - DNA, 25 bp, Mus musculus
tggaggacacaacccacctacttgc

SEQ ID NO: 816392 - DNA, 25 bp, Mus musculus
tggaggacacaagccacctacttgc

SEQ ID NO: 816393 - DNA, 25 bp, Mus musculus
tggaggacacaatcgcccaggtact

SEQ ID NO: 816394 - DNA, 25 bp, Mus musculus
tggaggacagcaactaccagcacct

SEQ ID NO: 816395 - DNA, 25 bp, Mus musculus
tggaggacagcatctaccagcacct

SEQ ID NO: 816396 - DNA, 25 bp, Mus musculus
tggaggaccacccactgtgccgttg

SEQ ID NO: 816397 - DNA, 25 bp, Mus musculus
tggaggaccaccgactgtgccgttg

SEQ ID NO: 816398 - DNA, 25 bp, Mus musculus
tggaggaccacgctcgttttcttct

SEQ ID NO: 816399 - DNA, 25 bp, Mus musculus
tggaggaccacggtcgttttcttct

SEQ ID NO: 816400 - DNA, 25 bp, Mus musculus
tggaggaccagcacgggaagccata

SEQ ID NO: 816401 - DNA, 25 bp, Mus musculus
tggaggaccagctcgggaagccata

SEQ ID NO: 816402 - DNA, 25 bp, Mus musculus
tggaggacccctactttgtagtgaa

SEQ ID NO: 816403 - DNA, 25 bp, Mus musculus
tggaggaccccttctttgtagtgaa

SEQ ID NO: 816404 - DNA, 25 bp, Mus musculus
tggaggaccctcacccctgaatgct

SEQ ID NO: 816405 - DNA, 25 bp, Mus musculus
tggaggaccctctcccctgaatgct

SEQ ID NO: 816406 - DNA, 25 bp, Mus musculus
tggaggaccgtgacagacagctgca

SEQ ID NO: 816407 - DNA, 25 bp, Mus musculus
tggaggaccgtgtcagacagctgca

SEQ ID NO: 816408 - DNA, 25 bp, Mus musculus
tggaggacctgtctgtcctcagccc

SEQ ID NO: 816409 - DNA, 25 bp, Mus musculus
tggaggacctgtgtgtcctcagccc

SEQ ID NO: 816410 - DNA, 25 bp, Mus musculus
tggaggacggaaacctgcttgtcac

SEQ ID NO: 816411 - DNA, 25 bp, Mus musculus
tggaggacggaatcctgcttgtcac

SEQ ID NO: 816412 - DNA, 25 bp, Mus musculus
tggaggactcaaacggacatctttc

SEQ ID NO: 816413 - DNA, 25 bp, Mus musculus
tggaggactcaatcggacatctttc

SEQ ID NO: 816414 - DNA, 25 bp, Mus musculus
tggaggactccgctatctatcagtg

SEQ ID NO: 816415 - DNA, 25 bp, Mus musculus
tggaggactccggtatctatcagtg

SEQ ID NO: 816416 - DNA, 25 bp, Mus musculus
tggaggacttagaagatctaacctc

SEQ ID NO: 816417 - DNA, 25 bp, Mus musculus
tggaggacttagtagatctaacctc

SEQ ID NO: 816418 - DNA, 25 bp, Mus musculus
tggaggacttcaagccccagaatac

SEQ ID NO: 816419 - DNA, 25 bp, Mus musculus
tggaggacttcatgccccagaatac

SEQ ID NO: 816420 - DNA, 25 bp, Mus musculus
tggaggacttgcaggtcttagcagc

SEQ ID NO: 816421 - DNA, 25 bp, Mus musculus
tggaggacttgctggtcttagcagc

SEQ ID NO: 816422 - DNA, 25 bp, Mus musculus
tggaggactttgaccagcacaagat

SEQ ID NO: 816423 - DNA, 25 bp, Mus musculus
tggaggactttgtccagcacaagat

SEQ ID NO: 816424 - DNA, 25 bp, Mus musculus
tggaggagaagcaacaacgtgaccc

SEQ ID NO: 816425 - DNA, 25 bp, Mus musculus
tggaggagaagctacaacgtgaccc

SEQ ID NO: 816426 - DNA, 25 bp, Mus musculus
tggaggagactgatcaggccaagta

SEQ ID NO: 816427 - DNA, 25 bp, Mus musculus
tggaggagactgttcaggccaagta

SEQ ID NO: 816428 - DNA, 25 bp, Mus musculus
tggaggagagacacgggaaattaca

SEQ ID NO: 816429 - DNA, 25 bp, Mus musculus
tggaggagagactcgggaaattaca

SEQ ID NO: 816430 - DNA, 25 bp, Mus musculus
tggaggagagctctgtgcatcccct

SEQ ID NO: 816431 - DNA, 25 bp, Mus musculus
tggaggagagctgtgtgcatcccct

SEQ ID NO: 816432 - DNA, 25 bp, Mus musculus
tggaggagcaacagttcttcaagcc

SEQ ID NO: 816433 - DNA, 25 bp, Mus musculus
tggaggagcaactgttcttcaagcc

SEQ ID NO: 816434 - DNA, 25 bp, Mus musculus
tggaggagcagaacttactacagca

SEQ ID NO: 816435 - DNA, 25 bp, Mus musculus
tggaggagcagatcttactacagca

SEQ ID NO: 816436 - DNA, 25 bp, Mus musculus
tggaggagcccaaacaagccaatgg

SEQ ID NO: 816437 - DNA, 25 bp, Mus musculus
tggaggagcccatacaagccaatgg

SEQ ID NO: 816438 - DNA, 25 bp, Mus musculus
tggaggagcctcaggggtacacacc

SEQ ID NO: 816439 - DNA, 25 bp, Mus musculus
tggaggagcctctggggtacacacc

SEQ ID NO: 816440 - DNA, 25 bp, Mus musculus
tggaggagcggacgcaggtgcctgt

SEQ ID NO: 816441 - DNA, 25 bp, Mus musculus
tggaggagcggaggcaggtgcctgt

SEQ ID NO: 816442 - DNA, 25 bp, Mus musculus
tggaggagcttcaccagcacacaga

SEQ ID NO: 816443 - DNA, 25 bp, Mus musculus
tggaggagcttctccagcacacaga

SEQ ID NO: 816444 - DNA, 25 bp, Mus musculus
tggaggagggcaaggctttcaccat

SEQ ID NO: 816445 - DNA, 25 bp, Mus musculus
tggaggagggcatggctttcaccat

SEQ ID NO: 816446 - DNA, 25 bp, Mus musculus
tggaggagtaaacacagcgatgccc

SEQ ID NO: 816447 - DNA, 25 bp, Mus musculus
tggaggagtaaagacagcgatgccc

SEQ ID NO: 816448 - DNA, 25 bp, Mus musculus
tggaggagtacaccaggtgccacct

SEQ ID NO: 816449 - DNA, 25 bp, Mus musculus
tggaggagtacagcaggtgccacct

SEQ ID NO: 816450 - DNA, 25 bp, Mus musculus
tggaggagtactacatgagagagac

SEQ ID NO: 816451 - DNA, 25 bp, Mus musculus
tggaggagtactactttgagcagca

SEQ ID NO: 816452 - DNA, 25 bp, Mus musculus
tggaggagtacttcatgagagagac

SEQ ID NO: 816453 - DNA, 25 bp, Mus musculus
tggaggagtacttctttgagcagca

SEQ ID NO: 816454 - DNA, 25 bp, Mus musculus
tggaggagtcacagcacacccgagt

SEQ ID NO: 816455 - DNA, 25 bp, Mus musculus
tggaggagtcactgcacacccgagt

SEQ ID NO: 816456 - DNA, 25 bp, Mus musculus
tggaggagtctgcagcgcagctgct

SEQ ID NO: 816457 - DNA, 25 bp, Mus musculus
tggaggagtctggagcgcagctgct

SEQ ID NO: 816458 - DNA, 25 bp, Mus musculus
tggaggagtttcaggcttgcctaag

SEQ ID NO: 816459 - DNA, 25 bp, Mus musculus
tggaggagtttctggcttgcctaag

SEQ ID NO: 816460 - DNA, 25 bp, Mus musculus
tggaggatagacagtgcggctacat

SEQ ID NO: 816461 - DNA, 25 bp, Mus musculus
tggaggatagactgtgcggctacat

SEQ ID NO: 816462 - DNA, 25 bp, Mus musculus
tggaggatccggaagtctactgtcc

SEQ ID NO: 816463 - DNA, 25 bp, Mus musculus
tggaggatccggtagtctactgtcc

SEQ ID NO: 816464 - DNA, 25 bp, Mus musculus
tggaggatgacaacgtggacccctc

SEQ ID NO: 816465 - DNA, 25 bp, Mus musculus
tggaggatgacatcgtggacccctc

SEQ ID NO: 816466 - DNA, 25 bp, Mus musculus
tggaggatgacccaagacagctgca

SEQ ID NO: 816467 - DNA, 25 bp, Mus musculus
tggaggatgaccgaagacagctgca

SEQ ID NO: 816468 - DNA, 25 bp, Mus musculus
tggaggatgacgatcccgtccaggc

SEQ ID NO: 816469 - DNA, 25 bp, Mus musculus
tggaggatgacgttcccgtccaggc

SEQ ID NO: 816470 - DNA, 25 bp, Mus musculus
tggaggatgcatcttgccaggcact

SEQ ID NO: 816471 - DNA, 25 bp, Mus musculus
tggaggatgcatgttgccaggcact

SEQ ID NO: 816472 - DNA, 25 bp, Mus musculus
tggaggatggctacgacaccattcc

SEQ ID NO: 816473 - DNA, 25 bp, Mus musculus
tggaggatggcttcgacaccattcc

SEQ ID NO: 816474 - DNA, 25 bp, Mus musculus
tggaggattcggacaagcacctcct

SEQ ID NO: 816475 - DNA, 25 bp, Mus musculus
tggaggattcggtcaagcacctcct

SEQ ID NO: 816476 - DNA, 25 bp, Mus musculus
tggaggattggcagtcaactccttt

SEQ ID NO: 816477 - DNA, 25 bp, Mus musculus
tggaggattggctgtcaactccttt

SEQ ID NO: 816478 - DNA, 25 bp, Mus musculus
tggaggatttcaatgcacagccggc

SEQ ID NO: 816479 - DNA, 25 bp, Mus musculus
tggaggatttcattgcacagccggc

SEQ ID NO: 816480 - DNA, 25 bp, Mus musculus
tggaggcaaaggctattttgtacga

SEQ ID NO: 816481 - DNA, 25 bp, Mus musculus
tggaggcaaagggtattttgtacga

SEQ ID NO: 816482 - DNA, 25 bp, Mus musculus
tggaggcaacgcatccaactcctgc

SEQ ID NO: 816483 - DNA, 25 bp, Mus musculus
tggaggcaacgcttccaactcctgc

SEQ ID NO: 816484 - DNA, 25 bp, Mus musculus
tggaggcaatgtacaaccagggcta

SEQ ID NO: 816485 - DNA, 25 bp, Mus musculus
tggaggcaatgttcaaccagggcta

SEQ ID NO: 816486 - DNA, 25 bp, Mus musculus
tggaggcacccgagtttgagatccc

SEQ ID NO: 816487 - DNA, 25 bp, Mus musculus
tggaggcacccgtgtttgagatccc

SEQ ID NO: 816488 - DNA, 25 bp, Mus musculus
tggaggcactggaccctcttgttgc

SEQ ID NO: 816489 - DNA, 25 bp, Mus musculus
tggaggcactggtccctcttgttgc

SEQ ID NO: 816490 - DNA, 25 bp, Mus musculus
tggaggcactgtagtgatgaagtca

SEQ ID NO: 816491 - DNA, 25 bp, Mus musculus
tggaggcactgttgtgatgaagtca

SEQ ID NO: 816492 - DNA, 25 bp, Mus musculus
tggaggcagcataaatagctctaca

SEQ ID NO: 816493 - DNA, 25 bp, Mus musculus
tggaggcagcattaatagctctaca

SEQ ID NO: 816494 - DNA, 25 bp, Mus musculus
tggaggcagcgacgaggaggcagct

SEQ ID NO: 816495 - DNA, 25 bp, Mus musculus
tggaggcagcgaggaggaggcagct

SEQ ID NO: 816496 - DNA, 25 bp, Mus musculus
tggaggcagcggattctcagatgct

SEQ ID NO: 816497 - DNA, 25 bp, Mus musculus
tggaggcagcggtttctcagatgct

SEQ ID NO: 816498 - DNA, 25 bp, Mus musculus
tggaggcagcgtcaccaaaaagcgc

SEQ ID NO: 816499 - DNA, 25 bp, Mus musculus
tggaggcagcgtgaccaaaaagcgc

SEQ ID NO: 816500 - DNA, 25 bp, Mus musculus
tggaggcagctccaggtacctccta

SEQ ID NO: 816501 - DNA, 25 bp, Mus musculus
tggaggcagctcgaggtacctccta

SEQ ID NO: 816502 - DNA, 25 bp, Mus musculus
tggaggcagtctctcaggagcacat

SEQ ID NO: 816503 - DNA, 25 bp, Mus musculus
tggaggcagtctgtcaggagcacat

SEQ ID NO: 816504 - DNA, 25 bp, Mus musculus
tggaggcatctacagttcacaggca

SEQ ID NO: 816505 - DNA, 25 bp, Mus musculus
tggaggcatctagagttcacaggca

SEQ ID NO: 816506 - DNA, 25 bp, Mus musculus
tggaggcatgcacaagtttgaactt

SEQ ID NO: 816507 - DNA, 25 bp, Mus musculus
tggaggcatgcagaagtttgaactt

SEQ ID NO: 816508 - DNA, 25 bp, Mus musculus
tggaggccaaaaactgtcatcaaat

SEQ ID NO: 816509 - DNA, 25 bp, Mus musculus
tggaggccaaaatctgtcatcaaat

SEQ ID NO: 816510 - DNA, 25 bp, Mus musculus
tggaggccaagtatcccacagtccc

SEQ ID NO: 816511 - DNA, 25 bp, Mus musculus
tggaggccaagtttcccacagtccc

SEQ ID NO: 816512 - DNA, 25 bp, Mus musculus
tggaggccacctctctagcagaaga

SEQ ID NO: 816513 - DNA, 25 bp, Mus musculus
tggaggccacctgtctagcagaaga

SEQ ID NO: 816514 - DNA, 25 bp, Mus musculus
tggaggccatgcattgccaaaggtc

SEQ ID NO: 816515 - DNA, 25 bp, Mus musculus
tggaggccatgctttgccaaaggtc

SEQ ID NO: 816516 - DNA, 25 bp, Mus musculus
tggaggcccacaaagcgaacactct

SEQ ID NO: 816517 - DNA, 25 bp, Mus musculus
tggaggcccacaagagaggtcacat

SEQ ID NO: 816518 - DNA, 25 bp, Mus musculus
tggaggcccacatagcgaacactct

SEQ ID NO: 816519 - DNA, 25 bp, Mus musculus
tggaggcccacatgagaggtcacat

SEQ ID NO: 816520 - DNA, 25 bp, Mus musculus
tggaggcccctgctgtctacgtgtt

SEQ ID NO: 816521 - DNA, 25 bp, Mus musculus
tggaggcccctggtgtctacgtgtt

SEQ ID NO: 816522 - DNA, 25 bp, Mus musculus
tggaggcccgaactctactccatca

SEQ ID NO: 816523 - DNA, 25 bp, Mus musculus
tggaggcccgaagtctactccatca

SEQ ID NO: 816524 - DNA, 25 bp, Mus musculus
tggaggccctacagaaacagatgga

SEQ ID NO: 816525 - DNA, 25 bp, Mus musculus
tggaggccctactgaaacagatgga

SEQ ID NO: 816526 - DNA, 25 bp, Mus musculus
tggaggccgtaaagattcaggagct

SEQ ID NO: 816527 - DNA, 25 bp, Mus musculus
tggaggccgtaatgattcaggagct

SEQ ID NO: 816528 - DNA, 25 bp, Mus musculus
tggaggcctcgaatccgctattatc

SEQ ID NO: 816529 - DNA, 25 bp, Mus musculus
tggaggcctcgattccgctattatc

SEQ ID NO: 816530 - DNA, 25 bp, Mus musculus
tggaggcctgcactcatttacgtgc

SEQ ID NO: 816531 - DNA, 25 bp, Mus musculus
tggaggcctgcagtcatttacgtgc

SEQ ID NO: 816532 - DNA, 25 bp, Mus musculus
tggaggccttacagggtattcttcg

SEQ ID NO: 816533 - DNA, 25 bp, Mus musculus
tggaggccttactgggtattcttcg

SEQ ID NO: 816534 - DNA, 25 bp, Mus musculus
tggaggcgacagctacatcattctg

SEQ ID NO: 816535 - DNA, 25 bp, Mus musculus
tggaggcgacaggtacatcattctg

SEQ ID NO: 816536 - DNA, 25 bp, Mus musculus
tggaggcgcagccaaccacactggc

SEQ ID NO: 816537 - DNA, 25 bp, Mus musculus
tggaggcgcagcgaaccacactggc

SEQ ID NO: 816538 - DNA, 25 bp, Mus musculus
tggaggcgcaggagatcctccgcac

SEQ ID NO: 816539 - DNA, 25 bp, Mus musculus
tggaggcgcaggtgatcctccgcac

SEQ ID NO: 816540 - DNA, 25 bp, Mus musculus
tggaggcgcatcagtcgaaggctca

SEQ ID NO: 816541 - DNA, 25 bp, Mus musculus
tggaggcgcatctgtcgaaggctca

SEQ ID NO: 816542 - DNA, 25 bp, Mus musculus
tggaggcgccatcacagacgccact

SEQ ID NO: 816543 - DNA, 25 bp, Mus musculus
tggaggcgccatgacagacgccact

SEQ ID NO: 816544 - DNA, 25 bp, Mus musculus
tggaggcgcctgagcctcgaaagcc

SEQ ID NO: 816545 - DNA, 25 bp, Mus musculus
tggaggcgcctgtgcctcgaaagcc

SEQ ID NO: 816546 - DNA, 25 bp, Mus musculus
tggaggcgccttaatggtgcttcct

SEQ ID NO: 816547 - DNA, 25 bp, Mus musculus
tggaggcgcctttatggtgcttcct

SEQ ID NO: 816548 - DNA, 25 bp, Mus musculus
tggaggcgctggcacacatgttcat

SEQ ID NO: 816549 - DNA, 25 bp, Mus musculus
tggaggcgctgggacacatgttcat

SEQ ID NO: 816550 - DNA, 25 bp, Mus musculus
tggaggcggcaaagcacaactttcc

SEQ ID NO: 816551 - DNA, 25 bp, Mus musculus
tggaggcggcaatgcacaactttcc

SEQ ID NO: 816552 - DNA, 25 bp, Mus musculus
tggaggcggtgactggtcagcgtgg

SEQ ID NO: 816553 - DNA, 25 bp, Mus musculus
tggaggcggtgagtggtcagcgtgg

SEQ ID NO: 816554 - DNA, 25 bp, Mus musculus
tggaggctaaggacttgtttcggaa

SEQ ID NO: 816555 - DNA, 25 bp, Mus musculus
tggaggctaaggtcttgtttcggaa

SEQ ID NO: 816556 - DNA, 25 bp, Mus musculus
tggaggctaatcaccaatttcttat

SEQ ID NO: 816557 - DNA, 25 bp, Mus musculus
tggaggctaatctccaatttcttat

SEQ ID NO: 816558 - DNA, 25 bp, Mus musculus
tggaggctattgagcgcattgctga

SEQ ID NO: 816559 - DNA, 25 bp, Mus musculus
tggaggctattgtgcgcattgctga

SEQ ID NO: 816560 - DNA, 25 bp, Mus musculus
tggaggctcaccagcgggtgaaata

SEQ ID NO: 816561 - DNA, 25 bp, Mus musculus
tggaggctcacctgcgggtgaaata

SEQ ID NO: 816562 - DNA, 25 bp, Mus musculus
tggaggctgaccacgcgacgcctgt

SEQ ID NO: 816563 - DNA, 25 bp, Mus musculus
tggaggctgacctcgcgacgcctgt

SEQ ID NO: 816564 - DNA, 25 bp, Mus musculus
tggaggctgcttcttcccggatgac

SEQ ID NO: 816565 - DNA, 25 bp, Mus musculus
tggaggctgcttgttcccggatgac

SEQ ID NO: 816566 - DNA, 25 bp, Mus musculus
tggaggctggttcaaacgcaacgtc

SEQ ID NO: 816567 - DNA, 25 bp, Mus musculus
tggaggctggttgaaacgcaacgtc

SEQ ID NO: 816568 - DNA, 25 bp, Mus musculus
tggaggctgtcaatgccttgctgga

SEQ ID NO: 816569 - DNA, 25 bp, Mus musculus
tggaggctgtcattgccttgctgga

SEQ ID NO: 816570 - DNA, 25 bp, Mus musculus
tggaggctgttgaagaccttcagag

SEQ ID NO: 816571 - DNA, 25 bp, Mus musculus
tggaggctgttgtagaccttcagag

SEQ ID NO: 816572 - DNA, 25 bp, Mus musculus
tggagggaaaagaacgaccagcttg

SEQ ID NO: 816573 - DNA, 25 bp, Mus musculus
tggagggaaaagtacgaccagcttg

SEQ ID NO: 816574 - DNA, 25 bp, Mus musculus
tggagggacctcatatcccatctga

SEQ ID NO: 816575 - DNA, 25 bp, Mus musculus
tggagggacctcttatcccatctga

SEQ ID NO: 816576 - DNA, 25 bp, Mus musculus
tggagggactgtacttacacagcct

SEQ ID NO: 816577 - DNA, 25 bp, Mus musculus
tggagggactgttcttacacagcct

SEQ ID NO: 816578 - DNA, 25 bp, Mus musculus
tggagggagactctgacttccacat

SEQ ID NO: 816579 - DNA, 25 bp, Mus musculus
tggagggagactgtgacttccacat

SEQ ID NO: 816580 - DNA, 25 bp, Mus musculus
tggagggagagcactgccatgaccc

SEQ ID NO: 816581 - DNA, 25 bp, Mus musculus
tggagggagagctctgccatgaccc

SEQ ID NO: 816582 - DNA, 25 bp, Mus musculus
tggagggagcatcagacaccctgga

SEQ ID NO: 816583 - DNA, 25 bp, Mus musculus
tggagggagcatgagacaccctgga

SEQ ID NO: 816584 - DNA, 25 bp, Mus musculus
tggagggatgttcatggcactcacc

SEQ ID NO: 816585 - DNA, 25 bp, Mus musculus
tggagggatgttgatggcactcacc

SEQ ID NO: 816586 - DNA, 25 bp, Mus musculus
tggagggcaaccctcctgtcaacca

SEQ ID NO: 816587 - DNA, 25 bp, Mus musculus
tggagggcaaccgtcctgtcaacca

SEQ ID NO: 816588 - DNA, 25 bp, Mus musculus
tggagggcagcacaactcatcggca

SEQ ID NO: 816589 - DNA, 25 bp, Mus musculus
tggagggcagcagaactcatcggca

SEQ ID NO: 816590 - DNA, 25 bp, Mus musculus
tggagggcatatagcttttgcaagc

SEQ ID NO: 816591 - DNA, 25 bp, Mus musculus
tggagggcatattgcttttgcaagc

SEQ ID NO: 816592 - DNA, 25 bp, Mus musculus
tggagggccccaattccctcaaggc

SEQ ID NO: 816593 - DNA, 25 bp, Mus musculus
tggagggccccatttccctcaaggc

SEQ ID NO: 816594 - DNA, 25 bp, Mus musculus
tggagggcgacccactcatcatggt

SEQ ID NO: 816595 - DNA, 25 bp, Mus musculus
tggagggcgaccgactcatcatggt

SEQ ID NO: 816596 - DNA, 25 bp, Mus musculus
tggagggctgcaccaaatgcatcaa

SEQ ID NO: 816597 - DNA, 25 bp, Mus musculus
tggagggctgcagcaaatgcatcaa

SEQ ID NO: 816598 - DNA, 25 bp, Mus musculus
tggagggcttgcatgatggacactt

SEQ ID NO: 816599 - DNA, 25 bp, Mus musculus
tggagggcttgcttgatggacactt

SEQ ID NO: 816600 - DNA, 25 bp, Mus musculus
tggagggcttgtacatgaacactgg

SEQ ID NO: 816601 - DNA, 25 bp, Mus musculus
tggagggcttgttcatgaacactgg

SEQ ID NO: 816602 - DNA, 25 bp, Mus musculus
tggagggtccccaaggtcttctcgt

SEQ ID NO: 816603 - DNA, 25 bp, Mus musculus
tggagggtcccctaggtcttctcgt

SEQ ID NO: 816604 - DNA, 25 bp, Mus musculus
tggagggtggtgactgactccccaa

SEQ ID NO: 816605 - DNA, 25 bp, Mus musculus
tggagggtggtgtctgactccccaa

SEQ ID NO: 816606 - DNA, 25 bp, Mus musculus
tggagggttcccacgtagccacttc

SEQ ID NO: 816607 - DNA, 25 bp, Mus musculus
tggagggttccctcgtagccacttc

SEQ ID NO: 816608 - DNA, 25 bp, Mus musculus
tggagggttctcagtaccacctata

SEQ ID NO: 816609 - DNA, 25 bp, Mus musculus
tggagggttctctgtaccacctata

SEQ ID NO: 816610 - DNA, 25 bp, Mus musculus
tggagggtttctatgacagtcagct

SEQ ID NO: 816611 - DNA, 25 bp, Mus musculus
tggagggtttctttgacagtcagct

SEQ ID NO: 816612 - DNA, 25 bp, Mus musculus
tggaggtacataatgtgcaaaatgt

SEQ ID NO: 816613 - DNA, 25 bp, Mus musculus
tggaggtacatattgtgcaaaatgt

SEQ ID NO: 816614 - DNA, 25 bp, Mus musculus
tggaggtagaacatcccgcagccaa

SEQ ID NO: 816615 - DNA, 25 bp, Mus musculus
tggaggtagaacttcccgcagccaa

SEQ ID NO: 816616 - DNA, 25 bp, Mus musculus
tggaggtccaagaccagcgctgtga

SEQ ID NO: 816617 - DNA, 25 bp, Mus musculus
tggaggtccaagtccagcgctgtga

SEQ ID NO: 816618 - DNA, 25 bp, Mus musculus
tggaggtccactatattctcaaaat

SEQ ID NO: 816619 - DNA, 25 bp, Mus musculus
tggaggtccactttattctcaaaat

SEQ ID NO: 816620 - DNA, 25 bp, Mus musculus
tggaggtcctcgcagcttctgtttc

SEQ ID NO: 816621 - DNA, 25 bp, Mus musculus
tggaggtcctcggagcttctgtttc

SEQ ID NO: 816622 - DNA, 25 bp, Mus musculus
tggaggtcgagtatgaaacactgcc

SEQ ID NO: 816623 - DNA, 25 bp, Mus musculus
tggaggtcgagtttgaaacactgcc

SEQ ID NO: 816624 - DNA, 25 bp, Mus musculus
tggaggtcgtctatttcgggccgtc

SEQ ID NO: 816625 - DNA, 25 bp, Mus musculus
tggaggtcgtctttttcgggccgtc

SEQ ID NO: 816626 - DNA, 25 bp, Mus musculus
tggaggtcgttgcagtcactcgtct

SEQ ID NO: 816627 - DNA, 25 bp, Mus musculus
tggaggtcgttggagtcactcgtct

SEQ ID NO: 816628 - DNA, 25 bp, Mus musculus
tggaggtctacacccagagcttctc

SEQ ID NO: 816629 - DNA, 25 bp, Mus musculus
tggaggtctacagccagagcttctc

SEQ ID NO: 816630 - DNA, 25 bp, Mus musculus
tggaggtctaccagactgatgaatt

SEQ ID NO: 816631 - DNA, 25 bp, Mus musculus
tggaggtctacctgactgatgaatt

SEQ ID NO: 816632 - DNA, 25 bp, Mus musculus
tggaggtctacgaatccctgcctga

SEQ ID NO: 816633 - DNA, 25 bp, Mus musculus
tggaggtctacgtatccctgcctga

SEQ ID NO: 816634 - DNA, 25 bp, Mus musculus
tggaggtctcctctctggcaatgag

SEQ ID NO: 816635 - DNA, 25 bp, Mus musculus
tggaggtctcctgtctggcaatgag

SEQ ID NO: 816636 - DNA, 25 bp, Mus musculus
tggaggtctggcctgcaagcccaca

SEQ ID NO: 816637 - DNA, 25 bp, Mus musculus
tggaggtctggcgtgcaagcccaca

SEQ ID NO: 816638 - DNA, 25 bp, Mus musculus
tggaggtcttacagtcaatgcgagc

SEQ ID NO: 816639 - DNA, 25 bp, Mus musculus
tggaggtcttactgtcaatgcgagc

SEQ ID NO: 816640 - DNA, 25 bp, Mus musculus
tggaggtctttaatttcccaaagat

SEQ ID NO: 816641 - DNA, 25 bp, Mus musculus
tggaggtctttattttcccaaagat

SEQ ID NO: 816642 - DNA, 25 bp, Mus musculus
tggaggtgaaaaccccaccattcgt

SEQ ID NO: 816643 - DNA, 25 bp, Mus musculus
tggaggtgaaaagcccaccattcgt

SEQ ID NO: 816644 - DNA, 25 bp, Mus musculus
tggaggtgaatgatgaatgccgcat

SEQ ID NO: 816645 - DNA, 25 bp, Mus musculus
tggaggtgaatgttgaatgccgcat

SEQ ID NO: 816646 - DNA, 25 bp, Mus musculus
tggaggtgacacacagaaaaatctg

SEQ ID NO: 816647 - DNA, 25 bp, Mus musculus
tggaggtgacactcagaaaaatctg

SEQ ID NO: 816648 - DNA, 25 bp, Mus musculus
tggaggtgagcaacgcagatgtttt

SEQ ID NO: 816649 - DNA, 25 bp, Mus musculus
tggaggtgagcatcgcagatgtttt

SEQ ID NO: 816650 - DNA, 25 bp, Mus musculus
tggaggtgagctccgccattccgat

SEQ ID NO: 816651 - DNA, 25 bp, Mus musculus
tggaggtgagctgcgccattccgat

SEQ ID NO: 816652 - DNA, 25 bp, Mus musculus
tggaggtgccccatcaggctgagat

SEQ ID NO: 816653 - DNA, 25 bp, Mus musculus
tggaggtgccccttcaggctgagat

SEQ ID NO: 816654 - DNA, 25 bp, Mus musculus
tggaggtggagcaaccgaaattgaa

SEQ ID NO: 816655 - DNA, 25 bp, Mus musculus
tggaggtggagctaccgaaattgaa

SEQ ID NO: 816656 - DNA, 25 bp, Mus musculus
tggaggtggcccaccggatcctgac

SEQ ID NO: 816657 - DNA, 25 bp, Mus musculus
tggaggtggccctccggatcctgac

SEQ ID NO: 816658 - DNA, 25 bp, Mus musculus
tggaggtgttagaacatgaagaaga

SEQ ID NO: 816659 - DNA, 25 bp, Mus musculus
tggaggtgttagtacatgaagaaga

SEQ ID NO: 816660 - DNA, 25 bp, Mus musculus
tggaggttactgagtcgtccaatca

SEQ ID NO: 816661 - DNA, 25 bp, Mus musculus
tggaggttactgtgtcgtccaatca

SEQ ID NO: 816662 - DNA, 25 bp, Mus musculus
tggaggttataaagccttggataac

SEQ ID NO: 816663 - DNA, 25 bp, Mus musculus
tggaggttataatgccttggataac

SEQ ID NO: 816664 - DNA, 25 bp, Mus musculus
tggaggttccacataccttagctct

SEQ ID NO: 816665 - DNA, 25 bp, Mus musculus
tggaggttccacttaccttagctct

SEQ ID NO: 816666 - DNA, 25 bp, Mus musculus
tggagtaaaactagtgcttactggt

SEQ ID NO: 816667 - DNA, 25 bp, Mus musculus
tggagtaaaacttgtgcttactggt

SEQ ID NO: 816668 - DNA, 25 bp, Mus musculus
tggagtaaatctactctcaaccact

SEQ ID NO: 816669 - DNA, 25 bp, Mus musculus
tggagtaaatcttctctcaaccact

SEQ ID NO: 816670 - DNA, 25 bp, Mus musculus
tggagtaagaaacagacgtctgtca

SEQ ID NO: 816671 - DNA, 25 bp, Mus musculus
tggagtaagaaagagacgtctgtca

SEQ ID NO: 816672 - DNA, 25 bp, Mus musculus
tggagtaagtcgagaagtgtttgac

SEQ ID NO: 816673 - DNA, 25 bp, Mus musculus
tggagtaagtcgtgaagtgtttgac

SEQ ID NO: 816674 - DNA, 25 bp, Mus musculus
tggagtaatcctatcccagaatgtg

SEQ ID NO: 816675 - DNA, 25 bp, Mus musculus
tggagtaatcctttcccagaatgtg

SEQ ID NO: 816676 - DNA, 25 bp, Mus musculus
tggagtacacacacgataaagacac

SEQ ID NO: 816677 - DNA, 25 bp, Mus musculus
tggagtacacactcgataaagacac

SEQ ID NO: 816678 - DNA, 25 bp, Mus musculus
tggagtacagccaggagcaccagct

SEQ ID NO: 816679 - DNA, 25 bp, Mus musculus
tggagtacagcctggagcaccagct

SEQ ID NO: 816680 - DNA, 25 bp, Mus musculus
tggagtacatggagacaggctccct

SEQ ID NO: 816681 - DNA, 25 bp, Mus musculus
tggagtacatggtgacaggctccct

SEQ ID NO: 816682 - DNA, 25 bp, Mus musculus
tggagtaccacactcctcatctaca

SEQ ID NO: 816683 - DNA, 25 bp, Mus musculus
tggagtaccacagtcctcatctaca

SEQ ID NO: 816684 - DNA, 25 bp, Mus musculus
tggagtaccgctattacaagcagct

SEQ ID NO: 816685 - DNA, 25 bp, Mus musculus
tggagtaccgcttttacaagcagct

SEQ ID NO: 816686 - DNA, 25 bp, Mus musculus
tggagtacgaggacccagaagctgc

SEQ ID NO: 816687 - DNA, 25 bp, Mus musculus
tggagtacgaggtcccagaagctgc

SEQ ID NO: 816688 - DNA, 25 bp, Mus musculus
tggagtacgtgcacaccaagagcct

SEQ ID NO: 816689 - DNA, 25 bp, Mus musculus
tggagtacgtgctcaccaagagcct

SEQ ID NO: 816690 - DNA, 25 bp, Mus musculus
tggagtactatcagatccccttcct

SEQ ID NO: 816691 - DNA, 25 bp, Mus musculus
tggagtactatctgatccccttcct

SEQ ID NO: 816692 - DNA, 25 bp, Mus musculus
tggagtactcggatactttgaattc

SEQ ID NO: 816693 - DNA, 25 bp, Mus musculus
tggagtactcggttactttgaattc

SEQ ID NO: 816694 - DNA, 25 bp, Mus musculus
tggagtactgcgacatgaacaatga

SEQ ID NO: 816695 - DNA, 25 bp, Mus musculus
tggagtactgcgtcatgaacaatga

SEQ ID NO: 816696 - DNA, 25 bp, Mus musculus
tggagtactgctataaccccagcca

SEQ ID NO: 816697 - DNA, 25 bp, Mus musculus
tggagtactgctttaaccccagcca

SEQ ID NO: 816698 - DNA, 25 bp, Mus musculus
tggagtacttctagctctggaaggt

SEQ ID NO: 816699 - DNA, 25 bp, Mus musculus
tggagtacttcttgctctggaaggt

SEQ ID NO: 816700 - DNA, 25 bp, Mus musculus
tggagtagctgacctttaatagaac

SEQ ID NO: 816701 - DNA, 25 bp, Mus musculus
tggagtagctgagctttaatagaac

SEQ ID NO: 816702 - DNA, 25 bp, Mus musculus
tggagtatttcgacagcgcatcgaa

SEQ ID NO: 816703 - DNA, 25 bp, Mus musculus
tggagtatttcgtcagcgcatcgaa

SEQ ID NO: 816704 - DNA, 25 bp, Mus musculus
tggagtcaaaatccgggcccctcat

SEQ ID NO: 816705 - DNA, 25 bp, Mus musculus
tggagtcaaaatgcgggcccctcat

SEQ ID NO: 816706 - DNA, 25 bp, Mus musculus
tggagtcaaaggaaagctaggcaga

SEQ ID NO: 816707 - DNA, 25 bp, Mus musculus
tggagtcaaaggtaagctaggcaga

SEQ ID NO: 816708 - DNA, 25 bp, Mus musculus
tggagtcaaagtcgcctccacacat

SEQ ID NO: 816709 - DNA, 25 bp, Mus musculus
tggagtcaaagtggcctccacacat

SEQ ID NO: 816710 - DNA, 25 bp, Mus musculus
tggagtcaattgagccacgtcatga

SEQ ID NO: 816711 - DNA, 25 bp, Mus musculus
tggagtcaattgtgccacgtcatga

SEQ ID NO: 816712 - DNA, 25 bp, Mus musculus
tggagtcacacaagctaaagacggg

SEQ ID NO: 816713 - DNA, 25 bp, Mus musculus
tggagtcacacatgctaaagacggg

SEQ ID NO: 816714 - DNA, 25 bp, Mus musculus
tggagtcacccacggtctgctagcg

SEQ ID NO: 816715 - DNA, 25 bp, Mus musculus
tggagtcacccagggtctgctagcg

SEQ ID NO: 816716 - DNA, 25 bp, Mus musculus
tggagtcactcccagtatcattgac

SEQ ID NO: 816717 - DNA, 25 bp, Mus musculus
tggagtcactccgagtatcattgac

SEQ ID NO: 816718 - DNA, 25 bp, Mus musculus
tggagtcactcgacttcttgtagct

SEQ ID NO: 816719 - DNA, 25 bp, Mus musculus
tggagtcactcgtcttcttgtagct

SEQ ID NO: 816720 - DNA, 25 bp, Mus musculus
tggagtcagaccacaatggcctgcg

SEQ ID NO: 816721 - DNA, 25 bp, Mus musculus
tggagtcagacctcaatggcctgcg

SEQ ID NO: 816722 - DNA, 25 bp, Mus musculus
tggagtcagtggaaaagaccacgaa

SEQ ID NO: 816723 - DNA, 25 bp, Mus musculus
tggagtcagtggtaaagaccacgaa

SEQ ID NO: 816724 - DNA, 25 bp, Mus musculus
tggagtcataagagggcagccgtct

SEQ ID NO: 816725 - DNA, 25 bp, Mus musculus
tggagtcataagtgggcagccgtct

SEQ ID NO: 816726 - DNA, 25 bp, Mus musculus
tggagtcatcaaagcacctgagaca

SEQ ID NO: 816727 - DNA, 25 bp, Mus musculus
tggagtcatcaatgcacctgagaca

SEQ ID NO: 816728 - DNA, 25 bp, Mus musculus
tggagtcatccaacaatcacatctc

SEQ ID NO: 816729 - DNA, 25 bp, Mus musculus
tggagtcatccatcaatcacatctc

SEQ ID NO: 816730 - DNA, 25 bp, Mus musculus
tggagtcatcgaactcgctgtggat

SEQ ID NO: 816731 - DNA, 25 bp, Mus musculus
tggagtcatcgatctcgctgtggat

SEQ ID NO: 816732 - DNA, 25 bp, Mus musculus
tggagtccaacaaggaagggacccg

SEQ ID NO: 816733 - DNA, 25 bp, Mus musculus
tggagtccaacatggaagggacccg

SEQ ID NO: 816734 - DNA, 25 bp, Mus musculus
tggagtccaaggcttctcggatgcc

SEQ ID NO: 816735 - DNA, 25 bp, Mus musculus
tggagtccaagggttctcggatgcc

SEQ ID NO: 816736 - DNA, 25 bp, Mus musculus
tggagtccagttaaactatcccacc

SEQ ID NO: 816737 - DNA, 25 bp, Mus musculus
tggagtccagtttaactatcccacc

SEQ ID NO: 816738 - DNA, 25 bp, Mus musculus
tggagtcccagaatattaatgagct

SEQ ID NO: 816739 - DNA, 25 bp, Mus musculus
tggagtcccagattattaatgagct

SEQ ID NO: 816740 - DNA, 25 bp, Mus musculus
tggagtcccattagagacttcttgc

SEQ ID NO: 816741 - DNA, 25 bp, Mus musculus
tggagtcccatttgagacttcttgc

SEQ ID NO: 816742 - DNA, 25 bp, Mus musculus
tggagtcccgctagctccaagcgca

SEQ ID NO: 816743 - DNA, 25 bp, Mus musculus
tggagtcccgcttgctccaagcgca

SEQ ID NO: 816744 - DNA, 25 bp, Mus musculus
tggagtccctgaacactagcacgca

SEQ ID NO: 816745 - DNA, 25 bp, Mus musculus
tggagtccctgatcactagcacgca

SEQ ID NO: 816746 - DNA, 25 bp, Mus musculus
tggagtccctgtctaccaagctctg

SEQ ID NO: 816747 - DNA, 25 bp, Mus musculus
tggagtccctgtgtaccaagctctg

SEQ ID NO: 816748 - DNA, 25 bp, Mus musculus
tggagtccgctgaaatggctgtgtt

SEQ ID NO: 816749 - DNA, 25 bp, Mus musculus
tggagtccgctgtaatggctgtgtt

SEQ ID NO: 816750 - DNA, 25 bp, Mus musculus
tggagtccgcttacaacgcctttaa

SEQ ID NO: 816751 - DNA, 25 bp, Mus musculus
tggagtccgctttcaacgcctttaa

SEQ ID NO: 816752 - DNA, 25 bp, Mus musculus
tggagtcctcacataacaacaagtt

SEQ ID NO: 816753 - DNA, 25 bp, Mus musculus
tggagtcctcacttaacaacaagtt

SEQ ID NO: 816754 - DNA, 25 bp, Mus musculus
tggagtcgaatcagaagcaggtaga

SEQ ID NO: 816755 - DNA, 25 bp, Mus musculus
tggagtcgaatctgaagcaggtaga

SEQ ID NO: 816756 - DNA, 25 bp, Mus musculus
tggagtcgcaggatccccaatgacc

SEQ ID NO: 816757 - DNA, 25 bp, Mus musculus
tggagtcgcaggttccccaatgacc

SEQ ID NO: 816758 - DNA, 25 bp, Mus musculus
tggagtcgctcgacggcgtgcttcc

SEQ ID NO: 816759 - DNA, 25 bp, Mus musculus
tggagtcgctcgtcggcgtgcttcc

SEQ ID NO: 816760 - DNA, 25 bp, Mus musculus
tggagtctagcgacagttagtgcac

SEQ ID NO: 816761 - DNA, 25 bp, Mus musculus
tggagtctagcgtcagttagtgcac

SEQ ID NO: 816762 - DNA, 25 bp, Mus musculus
tggagtctatgcagggcacagctac

SEQ ID NO: 816763 - DNA, 25 bp, Mus musculus
tggagtctatgctgggcacagctac

SEQ ID NO: 816764 - DNA, 25 bp, Mus musculus
tggagtctatgtccacactcccgtg

SEQ ID NO: 816765 - DNA, 25 bp, Mus musculus
tggagtctatgtgcacactcccgtg

SEQ ID NO: 816766 - DNA, 25 bp, Mus musculus
tggagtctcataacccaagggcatg

SEQ ID NO: 816767 - DNA, 25 bp, Mus musculus
tggagtctcatatcccaagggcatg

SEQ ID NO: 816768 - DNA, 25 bp, Mus musculus
tggagtctccttctttctaacccgg

SEQ ID NO: 816769 - DNA, 25 bp, Mus musculus
tggagtctccttgtttctaacccgg

SEQ ID NO: 816770 - DNA, 25 bp, Mus musculus
tggagtctctccaggtccaccctgg

SEQ ID NO: 816771 - DNA, 25 bp, Mus musculus
tggagtctctccatgctcgagctat

SEQ ID NO: 816772 - DNA, 25 bp, Mus musculus
tggagtctctcctggtccaccctgg

SEQ ID NO: 816773 - DNA, 25 bp, Mus musculus
tggagtctctccttgctcgagctat

SEQ ID NO: 816774 - DNA, 25 bp, Mus musculus
tggagtctgaaaacaccatctacct

SEQ ID NO: 816775 - DNA, 25 bp, Mus musculus
tggagtctgaaatcaccatctacct

SEQ ID NO: 816776 - DNA, 25 bp, Mus musculus
tggagtctgactcactgcagaggct

SEQ ID NO: 816777 - DNA, 25 bp, Mus musculus
tggagtctgactgactgcagaggct

SEQ ID NO: 816778 - DNA, 25 bp, Mus musculus
tggagtctgccacatacagcaacag

SEQ ID NO: 816779 - DNA, 25 bp, Mus musculus
tggagtctgccagatacagcaacag

SEQ ID NO: 816780 - DNA, 25 bp, Mus musculus
tggagtctgccccacaggcgtctgc

SEQ ID NO: 816781 - DNA, 25 bp, Mus musculus
tggagtctgcccgacaggcgtctgc

SEQ ID NO: 816782 - DNA, 25 bp, Mus musculus
tggagtcttatactgtcaaccaggg

SEQ ID NO: 816783 - DNA, 25 bp, Mus musculus
tggagtcttatagtgtcaaccaggg

SEQ ID NO: 816784 - DNA, 25 bp, Mus musculus
tggagtcttcgtcccgagtctctcc

SEQ ID NO: 816785 - DNA, 25 bp, Mus musculus
tggagtcttcgtgccgagtctctcc

SEQ ID NO: 816786 - DNA, 25 bp, Mus musculus
tggagtctttcaccaatcttctaaa

SEQ ID NO: 816787 - DNA, 25 bp, Mus musculus
tggagtctttcagcaatcttctaaa

SEQ ID NO: 816788 - DNA, 25 bp, Mus musculus
tggagtgacaggaaaaacagctggc

SEQ ID NO: 816789 - DNA, 25 bp, Mus musculus
tggagtgacaggtaaaacagctggc

SEQ ID NO: 816790 - DNA, 25 bp, Mus musculus
tggagtgactgaacaacaaggctgt

SEQ ID NO: 816791 - DNA, 25 bp, Mus musculus
tggagtgactgatcaacaaggctgt

SEQ ID NO: 816792 - DNA, 25 bp, Mus musculus
tggagtgagggcaacggttcacaca

SEQ ID NO: 816793 - DNA, 25 bp, Mus musculus
tggagtgagggctacggttcacaca

SEQ ID NO: 816794 - DNA, 25 bp, Mus musculus
tggagtgagtggaaacttccagact

SEQ ID NO: 816795 - DNA, 25 bp, Mus musculus
tggagtgagtggtaacttccagact

SEQ ID NO: 816796 - DNA, 25 bp, Mus musculus
tggagtgcaagaactcacccattgc

SEQ ID NO: 816797 - DNA, 25 bp, Mus musculus
tggagtgcaagatctcacccattgc

SEQ ID NO: 816798 - DNA, 25 bp, Mus musculus
tggagtgcacccctggattccagcg

SEQ ID NO: 816799 - DNA, 25 bp, Mus musculus
tggagtgcacccgtggattccagcg

SEQ ID NO: 816800 - DNA, 25 bp, Mus musculus
tggagtgcactaataccgctcctgg

SEQ ID NO: 816801 - DNA, 25 bp, Mus musculus
tggagtgcactattaccgctcctgg

SEQ ID NO: 816802 - DNA, 25 bp, Mus musculus
tggagtgccaagagaccggcctgcc

SEQ ID NO: 816803 - DNA, 25 bp, Mus musculus
tggagtgccaagtgaccggcctgcc

SEQ ID NO: 816804 - DNA, 25 bp, Mus musculus
tggagtgccagtcaatgataaagat

SEQ ID NO: 816805 - DNA, 25 bp, Mus musculus
tggagtgccagtgaatgataaagat

SEQ ID NO: 816806 - DNA, 25 bp, Mus musculus
tggagtggatctcggccaaactgaa

SEQ ID NO: 816807 - DNA, 25 bp, Mus musculus
tggagtggatctgggccaaactgaa

SEQ ID NO: 816808 - DNA, 25 bp, Mus musculus
tggagtggcctcacaggctgacagt

SEQ ID NO: 816809 - DNA, 25 bp, Mus musculus
tggagtggcctctcaggctgacagt

SEQ ID NO: 816810 - DNA, 25 bp, Mus musculus
tggagtggctaaatgaacactcaga

SEQ ID NO: 816811 - DNA, 25 bp, Mus musculus
tggagtggctaattgaacactcaga

SEQ ID NO: 816812 - DNA, 25 bp, Mus musculus
tggagtgggccaagaggatcccaca

SEQ ID NO: 816813 - DNA, 25 bp, Mus musculus
tggagtgggccatgaggatcccaca

SEQ ID NO: 816814 - DNA, 25 bp, Mus musculus
tggagtggtgccaagaggtcaccaa

SEQ ID NO: 816815 - DNA, 25 bp, Mus musculus
tggagtggtgcctagaggtcaccaa

SEQ ID NO: 816816 - DNA, 25 bp, Mus musculus
tggagtgtatgtacggccacaaagg

SEQ ID NO: 816817 - DNA, 25 bp, Mus musculus
tggagtgtatgttcggccacaaagg

SEQ ID NO: 816818 - DNA, 25 bp, Mus musculus
tggagtgtccgcagcctacatcatt

SEQ ID NO: 816819 - DNA, 25 bp, Mus musculus
tggagtgtccgctgcctacatcatt

SEQ ID NO: 816820 - DNA, 25 bp, Mus musculus
tggagtgtctgtcgccttcatcctg

SEQ ID NO: 816821 - DNA, 25 bp, Mus musculus
tggagtgtctgtggccttcatcctg

SEQ ID NO: 816822 - DNA, 25 bp, Mus musculus
tggagttaagtaatcggagaaacag

SEQ ID NO: 816823 - DNA, 25 bp, Mus musculus
tggagttaagtattcggagaaacag

SEQ ID NO: 816824 - DNA, 25 bp, Mus musculus
tggagttaataccaccgacaaggaa

SEQ ID NO: 816825 - DNA, 25 bp, Mus musculus
tggagttaatacgaccgacaaggaa

SEQ ID NO: 816826 - DNA, 25 bp, Mus musculus
tggagttacacccagttttcccagt

SEQ ID NO: 816827 - DNA, 25 bp, Mus musculus
tggagttacaccgagttttcccagt

SEQ ID NO: 816828 - DNA, 25 bp, Mus musculus
tggagttatacacagataaggacac

SEQ ID NO: 816829 - DNA, 25 bp, Mus musculus
tggagttatacagagataaggacac

SEQ ID NO: 816830 - DNA, 25 bp, Mus musculus
tggagttatcctaatgagcactcat

SEQ ID NO: 816831 - DNA, 25 bp, Mus musculus
tggagttatccttatgagcactcat

SEQ ID NO: 816832 - DNA, 25 bp, Mus musculus
tggagttcaacaaagcttctaccct

SEQ ID NO: 816833 - DNA, 25 bp, Mus musculus
tggagttcaacatagcttctaccct

SEQ ID NO: 816834 - DNA, 25 bp, Mus musculus
tggagttcaagcaagcataattcag

SEQ ID NO: 816835 - DNA, 25 bp, Mus musculus
tggagttcaagctagcataattcag

SEQ ID NO: 816836 - DNA, 25 bp, Mus musculus
tggagttcacccataaccatgatgt

SEQ ID NO: 816837 - DNA, 25 bp, Mus musculus
tggagttcacccttaaccatgatgt

SEQ ID NO: 816838 - DNA, 25 bp, Mus musculus
tggagttcactaagactaacaacgg

SEQ ID NO: 816839 - DNA, 25 bp, Mus musculus
tggagttcactatgactaacaacgg

SEQ ID NO: 816840 - DNA, 25 bp, Mus musculus
tggagttcatccagtagcgctgcag

SEQ ID NO: 816841 - DNA, 25 bp, Mus musculus
tggagttcatcctgtagcgctgcag

SEQ ID NO: 816842 - DNA, 25 bp, Mus musculus
tggagttccactccaaggtgtacag

SEQ ID NO: 816843 - DNA, 25 bp, Mus musculus
tggagttccactgcaaggtgtacag

SEQ ID NO: 816844 - DNA, 25 bp, Mus musculus
tggagttccatgagaagagcccaga

SEQ ID NO: 816845 - DNA, 25 bp, Mus musculus
tggagttccatgtgaagagcccaga

SEQ ID NO: 816846 - DNA, 25 bp, Mus musculus
tggagttccccacattgaagtcact

SEQ ID NO: 816847 - DNA, 25 bp, Mus musculus
tggagttccccacgacttacggagg

SEQ ID NO: 816848 - DNA, 25 bp, Mus musculus
tggagttccccagattgaagtcact

SEQ ID NO: 816849 - DNA, 25 bp, Mus musculus
tggagttccccaggacttacggagg

SEQ ID NO: 816850 - DNA, 25 bp, Mus musculus
tggagttcctggctaagatgactaa

SEQ ID NO: 816851 - DNA, 25 bp, Mus musculus
tggagttcctgggtaagatgactaa

SEQ ID NO: 816852 - DNA, 25 bp, Mus musculus
tggagttcgaggactcacaggaccc

SEQ ID NO: 816853 - DNA, 25 bp, Mus musculus
tggagttcgaggtctcacaggaccc

SEQ ID NO: 816854 - DNA, 25 bp, Mus musculus
tggagttctccaaggctgcggcact

SEQ ID NO: 816855 - DNA, 25 bp, Mus musculus
tggagttctccatggctgcggcact

SEQ ID NO: 816856 - DNA, 25 bp, Mus musculus
tggagttgcaagcatccaattcgag

SEQ ID NO: 816857 - DNA, 25 bp, Mus musculus
tggagttgcaaggatccaattcgag

SEQ ID NO: 816858 - DNA, 25 bp, Mus musculus
tggagttgcatgaattcgtctttgc

SEQ ID NO: 816859 - DNA, 25 bp, Mus musculus
tggagttgcatgtattcgtctttgc

SEQ ID NO: 816860 - DNA, 25 bp, Mus musculus
tggagttgctcccttttctgtcaaa

SEQ ID NO: 816861 - DNA, 25 bp, Mus musculus
tggagttgctccgttttctgtcaaa

SEQ ID NO: 816862 - DNA, 25 bp, Mus musculus
tggagttggccaccacatagtagta

SEQ ID NO: 816863 - DNA, 25 bp, Mus musculus
tggagttggccagcacatagtagta

SEQ ID NO: 816864 - DNA, 25 bp, Mus musculus
tggagttggcccactgatgtcccct

SEQ ID NO: 816865 - DNA, 25 bp, Mus musculus
tggagttggccctctgatgtcccct

SEQ ID NO: 816866 - DNA, 25 bp, Mus musculus
tggagttggcctatctggcaattgc

SEQ ID NO: 816867 - DNA, 25 bp, Mus musculus
tggagttggcctttctggcaattgc

SEQ ID NO: 816868 - DNA, 25 bp, Mus musculus
tggagttgttcacatgctcttaaca

SEQ ID NO: 816869 - DNA, 25 bp, Mus musculus
tggagttgttcagatgctcttaaca

SEQ ID NO: 816870 - DNA, 25 bp, Mus musculus
tggagtttaaacaaattgaacctga

SEQ ID NO: 816871 - DNA, 25 bp, Mus musculus
tggagtttaaactaattgaacctga

SEQ ID NO: 816872 - DNA, 25 bp, Mus musculus
tggagtttccaaatacactgattgg

SEQ ID NO: 816873 - DNA, 25 bp, Mus musculus
tggagtttccaacaccaacgctgcc

SEQ ID NO: 816874 - DNA, 25 bp, Mus musculus
tggagtttccaagaccaacgctgcc

SEQ ID NO: 816875 - DNA, 25 bp, Mus musculus
tggagtttccaattacactgattgg

SEQ ID NO: 816876 - DNA, 25 bp, Mus musculus
tggagtttcccaatgccaccacgag

SEQ ID NO: 816877 - DNA, 25 bp, Mus musculus
tggagtttcccattgccaccacgag

SEQ ID NO: 816878 - DNA, 25 bp, Mus musculus
tggagtttgacaccccatcggtcct

SEQ ID NO: 816879 - DNA, 25 bp, Mus musculus
tggagtttgacagcccatcggtcct

SEQ ID NO: 816880 - DNA, 25 bp, Mus musculus
tggagtttgatccaaattcaaaccc

SEQ ID NO: 816881 - DNA, 25 bp, Mus musculus
tggagtttgatcgaaattcaaaccc

SEQ ID NO: 816882 - DNA, 25 bp, Mus musculus
tggagtttgcccctgctcaccagtt

SEQ ID NO: 816883 - DNA, 25 bp, Mus musculus
tggagtttgcccgtgctcaccagtt

SEQ ID NO: 816884 - DNA, 25 bp, Mus musculus
tggagtttggaaccagaaagacgaa

SEQ ID NO: 816885 - DNA, 25 bp, Mus musculus
tggagtttggaagcagaaagacgaa

SEQ ID NO: 816886 - DNA, 25 bp, Mus musculus
tggagtttgtggatggccaactgcc

SEQ ID NO: 816887 - DNA, 25 bp, Mus musculus
tggagtttgtggttggccaactgcc

SEQ ID NO: 816888 - DNA, 25 bp, Mus musculus
tggagtttttcaagaagcttgtctc

SEQ ID NO: 816889 - DNA, 25 bp, Mus musculus
tggagtttttcatgaagcttgtctc

SEQ ID NO: 816890 - DNA, 25 bp, Mus musculus
tggataaaacaaagtacagttcact

SEQ ID NO: 816891 - DNA, 25 bp, Mus musculus
tggataaaacaatgtacagttcact

SEQ ID NO: 816892 - DNA, 25 bp, Mus musculus
tggataaaaccgacaaacttgacct

SEQ ID NO: 816893 - DNA, 25 bp, Mus musculus
tggataaaaccgtcaaacttgacct

SEQ ID NO: 816894 - DNA, 25 bp, Mus musculus
tggataaaataaccaatggttctcg

SEQ ID NO: 816895 - DNA, 25 bp, Mus musculus
tggataaaataagcaatggttctcg

SEQ ID NO: 816896 - DNA, 25 bp, Mus musculus
tggataaaatggaagaatcgtacac

SEQ ID NO: 816897 - DNA, 25 bp, Mus musculus
tggataaaatggtagaatcgtacac

SEQ ID NO: 816898 - DNA, 25 bp, Mus musculus
tggataaacagcacgggatatctct

SEQ ID NO: 816899 - DNA, 25 bp, Mus musculus
tggataaacagctcgggatatctct

SEQ ID NO: 816900 - DNA, 25 bp, Mus musculus
tggataaaccgaatactccatgagt

SEQ ID NO: 816901 - DNA, 25 bp, Mus musculus
tggataaaccgattactccatgagt

SEQ ID NO: 816902 - DNA, 25 bp, Mus musculus
tggataaacctgcatactatcctac

SEQ ID NO: 816903 - DNA, 25 bp, Mus musculus
tggataaacctggatactatcctac

SEQ ID NO: 816904 - DNA, 25 bp, Mus musculus
tggataaagccgaacctggtgtttg

SEQ ID NO: 816905 - DNA, 25 bp, Mus musculus
tggataaagccgtacctggtgtttg

SEQ ID NO: 816906 - DNA, 25 bp, Mus musculus
tggataaagttaccatcttcagtct

SEQ ID NO: 816907 - DNA, 25 bp, Mus musculus
tggataaagttagcatcttcagtct

SEQ ID NO: 816908 - DNA, 25 bp, Mus musculus
tggataaatgaaccccaagaagctg

SEQ ID NO: 816909 - DNA, 25 bp, Mus musculus
tggataaatgaagcccaagaagctg

SEQ ID NO: 816910 - DNA, 25 bp, Mus musculus
tggataaatgatctgcactgccctg

SEQ ID NO: 816911 - DNA, 25 bp, Mus musculus
tggataaatgatgtgcactgccctg

SEQ ID NO: 816912 - DNA, 25 bp, Mus musculus
tggataacagggaaatcccagagct

SEQ ID NO: 816913 - DNA, 25 bp, Mus musculus
tggataacagggtaatcccagagct

SEQ ID NO: 816914 - DNA, 25 bp, Mus musculus
tggataaccacgaaatgactaatca

SEQ ID NO: 816915 - DNA, 25 bp, Mus musculus
tggataaccacgtaatgactaatca

SEQ ID NO: 816916 - DNA, 25 bp, Mus musculus
tggataactttgaatcaccggatag

SEQ ID NO: 816917 - DNA, 25 bp, Mus musculus
tggataactttgtatcaccggatag

SEQ ID NO: 816918 - DNA, 25 bp, Mus musculus
tggataagaaacagctggctgtgcc

SEQ ID NO: 816919 - DNA, 25 bp, Mus musculus
tggataagaaactgctggctgtgcc

SEQ ID NO: 816920 - DNA, 25 bp, Mus musculus
tggataagaccaaaggagcagtgac

SEQ ID NO: 816921 - DNA, 25 bp, Mus musculus
tggataagaccataggagcagtgac

SEQ ID NO: 816922 - DNA, 25 bp, Mus musculus
tggataagggcaacgcattgactca

SEQ ID NO: 816923 - DNA, 25 bp, Mus musculus
tggataagggcatcgcattgactca

SEQ ID NO: 816924 - DNA, 25 bp, Mus musculus
tggataagttggctctaggcccaga

SEQ ID NO: 816925 - DNA, 25 bp, Mus musculus
tggataagttgggtctaggcccaga

SEQ ID NO: 816926 - DNA, 25 bp, Mus musculus
tggataatatcacccacgtccctgg

SEQ ID NO: 816927 - DNA, 25 bp, Mus musculus
tggataatatcagccacgtccctgg

SEQ ID NO: 816928 - DNA, 25 bp, Mus musculus
tggataatgccacgcagtctgctga

SEQ ID NO: 816929 - DNA, 25 bp, Mus musculus
tggataatgccaggcagtctgctga

SEQ ID NO: 816930 - DNA, 25 bp, Mus musculus
tggatacaaaacagtttccgaaatg

SEQ ID NO: 816931 - DNA, 25 bp, Mus musculus
tggatacaaaactgtttccgaaatg

SEQ ID NO: 816932 - DNA, 25 bp, Mus musculus
tggatacaagtgcaactgtcctctg

SEQ ID NO: 816933 - DNA, 25 bp, Mus musculus
tggatacaagtggaactgtcctctg

SEQ ID NO: 816934 - DNA, 25 bp, Mus musculus
tggatacagcctatttccggaagcc

SEQ ID NO: 816935 - DNA, 25 bp, Mus musculus
tggatacagcctttttccggaagcc

SEQ ID NO: 816936 - DNA, 25 bp, Mus musculus
tggatacaggctcagcagctccagg

SEQ ID NO: 816937 - DNA, 25 bp, Mus musculus
tggatacaggctgagcagctccagg

SEQ ID NO: 816938 - DNA, 25 bp, Mus musculus
tggataccatgacagaaacacctcg

SEQ ID NO: 816939 - DNA, 25 bp, Mus musculus
tggataccatgagagaaacacctcg

SEQ ID NO: 816940 - DNA, 25 bp, Mus musculus
tggataccccacagcacgctgcagt

SEQ ID NO: 816941 - DNA, 25 bp, Mus musculus
tggataccccactgcacgctgcagt

SEQ ID NO: 816942 - DNA, 25 bp, Mus musculus
tggataccctccctcatgttatcaa

SEQ ID NO: 816943 - DNA, 25 bp, Mus musculus
tggataccctccgtcatgttatcaa

SEQ ID NO: 816944 - DNA, 25 bp, Mus musculus
tggataccctgtataacaccaagtt

SEQ ID NO: 816945 - DNA, 25 bp, Mus musculus
tggataccctgtttaacaccaagtt

SEQ ID NO: 816946 - DNA, 25 bp, Mus musculus
tggatactatatcacaacgcgggcc

SEQ ID NO: 816947 - DNA, 25 bp, Mus musculus
tggatactatatgacaacgcgggcc

SEQ ID NO: 816948 - DNA, 25 bp, Mus musculus
tggatacttcctcctggacccgagg

SEQ ID NO: 816949 - DNA, 25 bp, Mus musculus
tggatacttcctgctggacccgagg

SEQ ID NO: 816950 - DNA, 25 bp, Mus musculus
tggatactttctctggcagtcctcc

SEQ ID NO: 816951 - DNA, 25 bp, Mus musculus
tggatactttctgtggcagtcctcc

SEQ ID NO: 816952 - DNA, 25 bp, Mus musculus
tggatactttgacgtcacccacgat

SEQ ID NO: 816953 - DNA, 25 bp, Mus musculus
tggatactttgaggtcacccacgat

SEQ ID NO: 816954 - DNA, 25 bp, Mus musculus
tggatagaaaataaggaactcctcc

SEQ ID NO: 816955 - DNA, 25 bp, Mus musculus
tggatagaaaattaggaactcctcc

SEQ ID NO: 816956 - DNA, 25 bp, Mus musculus
tggatagaaacaatttgaaacggtc

SEQ ID NO: 816957 - DNA, 25 bp, Mus musculus
tggatagaaacattttgaaacggtc

SEQ ID NO: 816958 - DNA, 25 bp, Mus musculus
tggatagaactcagaacagcttgcc

SEQ ID NO: 816959 - DNA, 25 bp, Mus musculus
tggatagaactctgaacagcttgcc

SEQ ID NO: 816960 - DNA, 25 bp, Mus musculus
tggatagaagaaatgaccatggtca

SEQ ID NO: 816961 - DNA, 25 bp, Mus musculus
tggatagaagaattgaccatggtca

SEQ ID NO: 816962 - DNA, 25 bp, Mus musculus
tggatagaattaagaaacagctacg

SEQ ID NO: 816963 - DNA, 25 bp, Mus musculus
tggatagaattatgaaacagctacg

SEQ ID NO: 816964 - DNA, 25 bp, Mus musculus
tggatagacgccaagaactatgtgg

SEQ ID NO: 816965 - DNA, 25 bp, Mus musculus
tggatagacgcctagaactatgtgg

SEQ ID NO: 816966 - DNA, 25 bp, Mus musculus
tggatagacgctctccagaaagcac

SEQ ID NO: 816967 - DNA, 25 bp, Mus musculus
tggatagacgctgtccagaaagcac

SEQ ID NO: 816968 - DNA, 25 bp, Mus musculus
tggatagcaagccagttgcaatttg

SEQ ID NO: 816969 - DNA, 25 bp, Mus musculus
tggatagcaagcgagttgcaatttg

SEQ ID NO: 816970 - DNA, 25 bp, Mus musculus
tggatagccagtcgtgtcaaggcct

SEQ ID NO: 816971 - DNA, 25 bp, Mus musculus
tggatagccagtggtgtcaaggcct

SEQ ID NO: 816972 - DNA, 25 bp, Mus musculus
tggatagctgttccgggcttaccaa

SEQ ID NO: 816973 - DNA, 25 bp, Mus musculus
tggatagctgttgcgggcttaccaa

SEQ ID NO: 816974 - DNA, 25 bp, Mus musculus
tggataggcgttctgttgagccaca

SEQ ID NO: 816975 - DNA, 25 bp, Mus musculus
tggataggcgttgtgttgagccaca

SEQ ID NO: 816976 - DNA, 25 bp, Mus musculus
tggataggctctatcacagcttgag

SEQ ID NO: 816977 - DNA, 25 bp, Mus musculus
tggataggctctttcacagcttgag

SEQ ID NO: 816978 - DNA, 25 bp, Mus musculus
tggatagtcctcagcagatctgtga

SEQ ID NO: 816979 - DNA, 25 bp, Mus musculus
tggatagtcctctgcagatctgtga

SEQ ID NO: 816980 - DNA, 25 bp, Mus musculus
tggatagtgaagctaagaaactact

SEQ ID NO: 816981 - DNA, 25 bp, Mus musculus
tggatagtgaaggtaagaaactact

SEQ ID NO: 816982 - DNA, 25 bp, Mus musculus
tggatagttggaagagcagacaaga

SEQ ID NO: 816983 - DNA, 25 bp, Mus musculus
tggatagttggatgagcagacaaga

SEQ ID NO: 816984 - DNA, 25 bp, Mus musculus
tggatataactgatatcaatgctcc

SEQ ID NO: 816985 - DNA, 25 bp, Mus musculus
tggatataactgttatcaatgctcc

SEQ ID NO: 816986 - DNA, 25 bp, Mus musculus
tggatatccccacccacgctgaaag

SEQ ID NO: 816987 - DNA, 25 bp, Mus musculus
tggatatccccagccacgctgaaag

SEQ ID NO: 816988 - DNA, 25 bp, Mus musculus
tggatatccgagaaccaggaagctc

SEQ ID NO: 816989 - DNA, 25 bp, Mus musculus
tggatatccgagtaccaggaagctc

SEQ ID NO: 816990 - DNA, 25 bp, Mus musculus
tggatatccggaaagacactgccca

SEQ ID NO: 816991 - DNA, 25 bp, Mus musculus
tggatatccggatagacactgccca

SEQ ID NO: 816992 - DNA, 25 bp, Mus musculus
tggatatcctatagacctgctactc

SEQ ID NO: 816993 - DNA, 25 bp, Mus musculus
tggatatcctattgacctgctactc

SEQ ID NO: 816994 - DNA, 25 bp, Mus musculus
tggatatcgtccatcatgctagctg

SEQ ID NO: 816995 - DNA, 25 bp, Mus musculus
tggatatcgtccttcatgctagctg

SEQ ID NO: 816996 - DNA, 25 bp, Mus musculus
tggatatcttgtccgtccgagaggc

SEQ ID NO: 816997 - DNA, 25 bp, Mus musculus
tggatatcttgtgcgtccgagaggc

SEQ ID NO: 816998 - DNA, 25 bp, Mus musculus
tggatatgacccatacgccaatcct

SEQ ID NO: 816999 - DNA, 25 bp, Mus musculus
tggatatgacccttacgccaatcct

SEQ ID NO: 817000 - DNA, 25 bp, Mus musculus
tggatatgatccagttaaacttttt

SEQ ID NO: 817001 - DNA, 25 bp, Mus musculus
tggatatgatcctgttaaacttttt

SEQ ID NO: 817002 - DNA, 25 bp, Mus musculus
tggatatgcccacaagtcccagaac

SEQ ID NO: 817003 - DNA, 25 bp, Mus musculus
tggatatgcccagaagtcccagaac

SEQ ID NO: 817004 - DNA, 25 bp, Mus musculus
tggatatggcgcaagaaggagaatg

SEQ ID NO: 817005 - DNA, 25 bp, Mus musculus
tggatatggcgctagaaggagaatg

SEQ ID NO: 817006 - DNA, 25 bp, Mus musculus
tggatatgtaaaaggagagactatc

SEQ ID NO: 817007 - DNA, 25 bp, Mus musculus
tggatatgtaaatggagagactatc

SEQ ID NO: 817008 - DNA, 25 bp, Mus musculus
tggatattaccaaccctaaagcggt

SEQ ID NO: 817009 - DNA, 25 bp, Mus musculus
tggatattaccatccctaaagcggt

SEQ ID NO: 817010 - DNA, 25 bp, Mus musculus
tggatattccagcagccacgtaaag

SEQ ID NO: 817011 - DNA, 25 bp, Mus musculus
tggatattccaggagccacgtaaag

SEQ ID NO: 817012 - DNA, 25 bp, Mus musculus
tggatattcctccacggtgcaccgg

SEQ ID NO: 817013 - DNA, 25 bp, Mus musculus
tggatattcctcgacggtgcaccgg

SEQ ID NO: 817014 - DNA, 25 bp, Mus musculus
tggatattctttcttcaagctctta

SEQ ID NO: 817015 - DNA, 25 bp, Mus musculus
tggatattctttgttcaagctctta

SEQ ID NO: 817016 - DNA, 25 bp, Mus musculus
tggatattgactcgtgtccccacaa

SEQ ID NO: 817017 - DNA, 25 bp, Mus musculus
tggatattgactggtgtccccacaa

SEQ ID NO: 817018 - DNA, 25 bp, Mus musculus
tggatcaaaaccaacttcaaagtct

SEQ ID NO: 817019 - DNA, 25 bp, Mus musculus
tggatcaaaaccattggcggtgtga

SEQ ID NO: 817020 - DNA, 25 bp, Mus musculus
tggatcaaaacctacttcaaagtct

SEQ ID NO: 817021 - DNA, 25 bp, Mus musculus
tggatcaaaacctttggcggtgtga

SEQ ID NO: 817022 - DNA, 25 bp, Mus musculus
tggatcaacagcaaaccagcccatt

SEQ ID NO: 817023 - DNA, 25 bp, Mus musculus
tggatcaacagctaaccagcccatt

SEQ ID NO: 817024 - DNA, 25 bp, Mus musculus
tggatcaagccaagacagaatgttt

SEQ ID NO: 817025 - DNA, 25 bp, Mus musculus
tggatcaagccatgacagaatgttt

SEQ ID NO: 817026 - DNA, 25 bp, Mus musculus
tggatcaagtcgcaactaggagttg

SEQ ID NO: 817027 - DNA, 25 bp, Mus musculus
tggatcaagtcggaactaggagttg

SEQ ID NO: 817028 - DNA, 25 bp, Mus musculus
tggatcacagatagaattcagctgc

SEQ ID NO: 817029 - DNA, 25 bp, Mus musculus
tggatcacagattgaattcagctgc

SEQ ID NO: 817030 - DNA, 25 bp, Mus musculus
tggatcaccagtatcctgggcaagg

SEQ ID NO: 817031 - DNA, 25 bp, Mus musculus
tggatcaccagtttcctgggcaagg

SEQ ID NO: 817032 - DNA, 25 bp, Mus musculus
tggatcacctctctggcccagtctg

SEQ ID NO: 817033 - DNA, 25 bp, Mus musculus
tggatcacctctgtggcccagtctg

SEQ ID NO: 817034 - DNA, 25 bp, Mus musculus
tggatcagacatagaatatctggac

SEQ ID NO: 817035 - DNA, 25 bp, Mus musculus
tggatcagacattgaatatctggac

SEQ ID NO: 817036 - DNA, 25 bp, Mus musculus
tggatcagcagtatgatggagcccc

SEQ ID NO: 817037 - DNA, 25 bp, Mus musculus
tggatcagcagtttgatggagcccc

SEQ ID NO: 817038 - DNA, 25 bp, Mus musculus
tggatcagccacagtccgtacgctg

SEQ ID NO: 817039 - DNA, 25 bp, Mus musculus
tggatcagccactgtccgtacgctg

SEQ ID NO: 817040 - DNA, 25 bp, Mus musculus
tggatcagcctgaacctcctgtggg

SEQ ID NO: 817041 - DNA, 25 bp, Mus musculus
tggatcagcctgtacctcctgtggg

SEQ ID NO: 817042 - DNA, 25 bp, Mus musculus
tggatcagcgagagtccccactcaa

SEQ ID NO: 817043 - DNA, 25 bp, Mus musculus
tggatcagcgagtgtccccactcaa

SEQ ID NO: 817044 - DNA, 25 bp, Mus musculus
tggatcagctaccaagtggagaaga

SEQ ID NO: 817045 - DNA, 25 bp, Mus musculus
tggatcagctacgaagtggagaaga

SEQ ID NO: 817046 - DNA, 25 bp, Mus musculus
tggatcagtgcgagaaccaggaact

SEQ ID NO: 817047 - DNA, 25 bp, Mus musculus
tggatcagtgcgtgaaccaggaact

SEQ ID NO: 817048 - DNA, 25 bp, Mus musculus
tggatcataaaaacctaactgctaa

SEQ ID NO: 817049 - DNA, 25 bp, Mus musculus
tggatcataaaatcctaactgctaa

SEQ ID NO: 817050 - DNA, 25 bp, Mus musculus
tggatcatacatacaagatgcatgt

SEQ ID NO: 817051 - DNA, 25 bp, Mus musculus
tggatcatacattcaagatgcatgt

SEQ ID NO: 817052 - DNA, 25 bp, Mus musculus
tggatcatacctacagcaaacatgt

SEQ ID NO: 817053 - DNA, 25 bp, Mus musculus
tggatcataccttcagcaaacatgt

SEQ ID NO: 817054 - DNA, 25 bp, Mus musculus
tggatcataggtaagcagcctcttt

SEQ ID NO: 817055 - DNA, 25 bp, Mus musculus
tggatcataggttagcagcctcttt

SEQ ID NO: 817056 - DNA, 25 bp, Mus musculus
tggatcatctcaacaaaggaaggct

SEQ ID NO: 817057 - DNA, 25 bp, Mus musculus
tggatcatctcatcaaaggaaggct

SEQ ID NO: 817058 - DNA, 25 bp, Mus musculus
tggatcatctggacccaagggtgac

SEQ ID NO: 817059 - DNA, 25 bp, Mus musculus
tggatcatctggtcccaagggtgac

SEQ ID NO: 817060 - DNA, 25 bp, Mus musculus
tggatcatggacctcctcgtctgca

SEQ ID NO: 817061 - DNA, 25 bp, Mus musculus
tggatcatggacgtcctcgtctgca

SEQ ID NO: 817062 - DNA, 25 bp, Mus musculus
tggatcatgtttacattgaccaaga

SEQ ID NO: 817063 - DNA, 25 bp, Mus musculus
tggatcatgttttcattgaccaaga

SEQ ID NO: 817064 - DNA, 25 bp, Mus musculus
tggatcattcgactccggaagggct

SEQ ID NO: 817065 - DNA, 25 bp, Mus musculus
tggatcattcgagtccggaagggct

SEQ ID NO: 817066 - DNA, 25 bp, Mus musculus
tggatccaaccaatgacatccgcat

SEQ ID NO: 817067 - DNA, 25 bp, Mus musculus
tggatccaaccattgacatccgcat

SEQ ID NO: 817068 - DNA, 25 bp, Mus musculus
tggatccaagcccacgtgcagtgtg

SEQ ID NO: 817069 - DNA, 25 bp, Mus musculus
tggatccaagccgacgtgcagtgtg

SEQ ID NO: 817070 - DNA, 25 bp, Mus musculus
tggatccaccgcaacatctactgga

SEQ ID NO: 817071 - DNA, 25 bp, Mus musculus
tggatccaccgctacatctactgga

SEQ ID NO: 817072 - DNA, 25 bp, Mus musculus
tggatccagacccaagcttgtttga

SEQ ID NO: 817073 - DNA, 25 bp, Mus musculus
tggatccagaccgaagcttgtttga

SEQ ID NO: 817074 - DNA, 25 bp, Mus musculus
tggatccagcccagctgcgctcagg

SEQ ID NO: 817075 - DNA, 25 bp, Mus musculus
tggatccagccctgctgcgctcagg

SEQ ID NO: 817076 - DNA, 25 bp, Mus musculus
tggatccaggtgctcaaggaagaca

SEQ ID NO: 817077 - DNA, 25 bp, Mus musculus
tggatccaggtggtcaaggaagaca

SEQ ID NO: 817078 - DNA, 25 bp, Mus musculus
tggatccatactacatcatgcctga

SEQ ID NO: 817079 - DNA, 25 bp, Mus musculus
tggatccatacttcatcatgcctga

SEQ ID NO: 817080 - DNA, 25 bp, Mus musculus
tggatccattcaagagacaacaatg

SEQ ID NO: 817081 - DNA, 25 bp, Mus musculus
tggatccattcatgagacaacaatg

SEQ ID NO: 817082 - DNA, 25 bp, Mus musculus
tggatcccaagtctgctgctcagaa

SEQ ID NO: 817083 - DNA, 25 bp, Mus musculus
tggatcccaagtgtgctgctcagaa

SEQ ID NO: 817084 - DNA, 25 bp, Mus musculus
tggatcccctcccataggtagcaga

SEQ ID NO: 817085 - DNA, 25 bp, Mus musculus
tggatcccctccgataggtagcaga

SEQ ID NO: 817086 - DNA, 25 bp, Mus musculus
tggatcccgcaaaaacccttgcaga

SEQ ID NO: 817087 - DNA, 25 bp, Mus musculus
tggatcccgcaataacccttgcaga

SEQ ID NO: 817088 - DNA, 25 bp, Mus musculus
tggatccctgttccaagatgtacct

SEQ ID NO: 817089 - DNA, 25 bp, Mus musculus
tggatccctgttgcaagatgtacct

SEQ ID NO: 817090 - DNA, 25 bp, Mus musculus
tggatccggaatattgagaactcac

SEQ ID NO: 817091 - DNA, 25 bp, Mus musculus
tggatccggaattttgagaactcac

SEQ ID NO: 817092 - DNA, 25 bp, Mus musculus
tggatcctacagaaggcccactgtg

SEQ ID NO: 817093 - DNA, 25 bp, Mus musculus
tggatcctacagtaggcccactgtg

SEQ ID NO: 817094 - DNA, 25 bp, Mus musculus
tggatcctatgcacagaagtatgga

SEQ ID NO: 817095 - DNA, 25 bp, Mus musculus
tggatcctatgctcagaagtatgga

SEQ ID NO: 817096 - DNA, 25 bp, Mus musculus
tggatcctcctacccaacagggaac

SEQ ID NO: 817097 - DNA, 25 bp, Mus musculus
tggatcctcctagccaacagggaac

SEQ ID NO: 817098 - DNA, 25 bp, Mus musculus
tggatcctcttcctggcgatcctcg

SEQ ID NO: 817099 - DNA, 25 bp, Mus musculus
tggatcctcttcgtggcgatcctcg

SEQ ID NO: 817100 - DNA, 25 bp, Mus musculus
tggatcctgaggacatcgacctgac

SEQ ID NO: 817101 - DNA, 25 bp, Mus musculus
tggatcctgaggtcatcgacctgac

SEQ ID NO: 817102 - DNA, 25 bp, Mus musculus
tggatcctgcttagctgcgcccagg

SEQ ID NO: 817103 - DNA, 25 bp, Mus musculus
tggatcctgctttgctgcgcccagg

SEQ ID NO: 817104 - DNA, 25 bp, Mus musculus
tggatcctggacaagtggcccagta

SEQ ID NO: 817105 - DNA, 25 bp, Mus musculus
tggatcctggactagtggcccagta

SEQ ID NO: 817106 - DNA, 25 bp, Mus musculus
tggatcctgtggagcctcatggtga

SEQ ID NO: 817107 - DNA, 25 bp, Mus musculus
tggatcctgtggtgcctcatggtga

SEQ ID NO: 817108 - DNA, 25 bp, Mus musculus
tggatcgacagaatcgcatctgtgg

SEQ ID NO: 817109 - DNA, 25 bp, Mus musculus
tggatcgacagattcgcatctgtgg

SEQ ID NO: 817110 - DNA, 25 bp, Mus musculus
tggatcgaccgtcagtggcaatatg

SEQ ID NO: 817111 - DNA, 25 bp, Mus musculus
tggatcgaccgtgagtggcaatatg

SEQ ID NO: 817112 - DNA, 25 bp, Mus musculus
tggatcgccatcactgcacctgtcg

SEQ ID NO: 817113 - DNA, 25 bp, Mus musculus
tggatcgccatctctgcacctgtcg

SEQ ID NO: 817114 - DNA, 25 bp, Mus musculus
tggatcgccctgaacaatctactgc

SEQ ID NO: 817115 - DNA, 25 bp, Mus musculus
tggatcgccctgtacaatctactgc

SEQ ID NO: 817116 - DNA, 25 bp, Mus musculus
tggatcgcctgtccttagggatccc

SEQ ID NO: 817117 - DNA, 25 bp, Mus musculus
tggatcgcctgtgcttagggatccc

SEQ ID NO: 817118 - DNA, 25 bp, Mus musculus
tggatcggatgaaggcaaatatgcg

SEQ ID NO: 817119 - DNA, 25 bp, Mus musculus
tggatcggatgatggcaaatatgcg

SEQ ID NO: 817120 - DNA, 25 bp, Mus musculus
tggatcggcggaaacattgcttcac

SEQ ID NO: 817121 - DNA, 25 bp, Mus musculus
tggatcggcggatacattgcttcac

SEQ ID NO: 817122 - DNA, 25 bp, Mus musculus
tggatcgggcaaagcgctagctggg

SEQ ID NO: 817123 - DNA, 25 bp, Mus musculus
tggatcgggcaatgcgctagctggg

SEQ ID NO: 817124 - DNA, 25 bp, Mus musculus
tggatcggtactagctgctggtcac

SEQ ID NO: 817125 - DNA, 25 bp, Mus musculus
tggatcggtacttgctgctggtcac

SEQ ID NO: 817126 - DNA, 25 bp, Mus musculus
tggatcgtcaggaacattgatgtct

SEQ ID NO: 817127 - DNA, 25 bp, Mus musculus
tggatcgtcaggtacattgatgtct

SEQ ID NO: 817128 - DNA, 25 bp, Mus musculus
tggatcgtcgtcatccaagtggttt

SEQ ID NO: 817129 - DNA, 25 bp, Mus musculus
tggatcgtcgtcttccaagtggttt

SEQ ID NO: 817130 - DNA, 25 bp, Mus musculus
tggatcgttctacggccctaccatg

SEQ ID NO: 817131 - DNA, 25 bp, Mus musculus
tggatcgttctagggccctaccatg

SEQ ID NO: 817132 - DNA, 25 bp, Mus musculus
tggatctaaccaccaatccccaggg

SEQ ID NO: 817133 - DNA, 25 bp, Mus musculus
tggatctaaccagcaatccccaggg

SEQ ID NO: 817134 - DNA, 25 bp, Mus musculus
tggatctacaggagcagagtatgca

SEQ ID NO: 817135 - DNA, 25 bp, Mus musculus
tggatctacaggtgcagagtatgca

SEQ ID NO: 817136 - DNA, 25 bp, Mus musculus
tggatctacctcaagcagctagcag

SEQ ID NO: 817137 - DNA, 25 bp, Mus musculus
tggatctacctctagcagctagcag

SEQ ID NO: 817138 - DNA, 25 bp, Mus musculus
tggatctactacagaactagctaag

SEQ ID NO: 817139 - DNA, 25 bp, Mus musculus
tggatctactactgaactagctaag

SEQ ID NO: 817140 - DNA, 25 bp, Mus musculus
tggatctacttcatggcgtggtctg

SEQ ID NO: 817141 - DNA, 25 bp, Mus musculus
tggatctacttcttggcgtggtctg

SEQ ID NO: 817142 - DNA, 25 bp, Mus musculus
tggatctagccacacagaagttcag

SEQ ID NO: 817143 - DNA, 25 bp, Mus musculus
tggatctagccagacagaagttcag

SEQ ID NO: 817144 - DNA, 25 bp, Mus musculus
tggatctagggaagaggaaccacag

SEQ ID NO: 817145 - DNA, 25 bp, Mus musculus
tggatctagggatgaggaaccacag

SEQ ID NO: 817146 - DNA, 25 bp, Mus musculus
tggatctcatagagggaagactcat

SEQ ID NO: 817147 - DNA, 25 bp, Mus musculus
tggatctcatagtgggaagactcat

SEQ ID NO: 817148 - DNA, 25 bp, Mus musculus
tggatctcatcacctgggaactgga

SEQ ID NO: 817149 - DNA, 25 bp, Mus musculus
tggatctcatcagctgggaactgga

SEQ ID NO: 817150 - DNA, 25 bp, Mus musculus
tggatctcattacgcagaactaggg

SEQ ID NO: 817151 - DNA, 25 bp, Mus musculus
tggatctcattaggcagaactaggg

SEQ ID NO: 817152 - DNA, 25 bp, Mus musculus
tggatctccctgacgagcaacagga

SEQ ID NO: 817153 - DNA, 25 bp, Mus musculus
tggatctccctgtcgagcaacagga

SEQ ID NO: 817154 - DNA, 25 bp, Mus musculus
tggatctcctccaaggcccttgata

SEQ ID NO: 817155 - DNA, 25 bp, Mus musculus
tggatctcctcctaggcccttgata

SEQ ID NO: 817156 - DNA, 25 bp, Mus musculus
tggatctcggctaggtgtgacccgc

SEQ ID NO: 817157 - DNA, 25 bp, Mus musculus
tggatctcggcttggtgtgacccgc

SEQ ID NO: 817158 - DNA, 25 bp, Mus musculus
tggatctctagcctctgtcccttac

SEQ ID NO: 817159 - DNA, 25 bp, Mus musculus
tggatctctagcgtctgtcccttac

SEQ ID NO: 817160 - DNA, 25 bp, Mus musculus
tggatctcttgaccctgtcagctgc

SEQ ID NO: 817161 - DNA, 25 bp, Mus musculus
tggatctcttgagcctgtcagctgc

SEQ ID NO: 817162 - DNA, 25 bp, Mus musculus
tggatctgatgcacctaaggaaagt

SEQ ID NO: 817163 - DNA, 25 bp, Mus musculus
tggatctgatgctcctaaggaaagt

SEQ ID NO: 817164 - DNA, 25 bp, Mus musculus
tggatctgcagacaccggactccta

SEQ ID NO: 817165 - DNA, 25 bp, Mus musculus
tggatctgcagagaccggactccta

SEQ ID NO: 817166 - DNA, 25 bp, Mus musculus
tggatctgcagcatcaggccaaggt

SEQ ID NO: 817167 - DNA, 25 bp, Mus musculus
tggatctgcagcttcaggccaaggt

SEQ ID NO: 817168 - DNA, 25 bp, Mus musculus
tggatctgcaggaattgcccctgca

SEQ ID NO: 817169 - DNA, 25 bp, Mus musculus
tggatctgcaggtattgcccctgca

SEQ ID NO: 817170 - DNA, 25 bp, Mus musculus
tggatctgccttactaccatggctg

SEQ ID NO: 817171 - DNA, 25 bp, Mus musculus
tggatctgcctttctaccatggctg

SEQ ID NO: 817172 - DNA, 25 bp, Mus musculus
tggatctgcgcgatcccaacgcgct

SEQ ID NO: 817173 - DNA, 25 bp, Mus musculus
tggatctgcgcgttcccaacgcgct

SEQ ID NO: 817174 - DNA, 25 bp, Mus musculus
tggatctgctcaagctgaaccgcag

SEQ ID NO: 817175 - DNA, 25 bp, Mus musculus
tggatctgctcatgctgaaccgcag

SEQ ID NO: 817176 - DNA, 25 bp, Mus musculus
tggatcttcagaagaagcaaagcca

SEQ ID NO: 817177 - DNA, 25 bp, Mus musculus
tggatcttcagatgaagcaaagcca

SEQ ID NO: 817178 - DNA, 25 bp, Mus musculus
tggatcttgaggcaacgaactatga

SEQ ID NO: 817179 - DNA, 25 bp, Mus musculus
tggatcttgagggaacgaactatga

SEQ ID NO: 817180 - DNA, 25 bp, Mus musculus
tggatcttgggactctactgtgaag

SEQ ID NO: 817181 - DNA, 25 bp, Mus musculus
tggatcttgggagtctactgtgaag

SEQ ID NO: 817182 - DNA, 25 bp, Mus musculus
tggatgaaaacacaataggctactt

SEQ ID NO: 817183 - DNA, 25 bp, Mus musculus
tggatgaaaacagaataggctactt

SEQ ID NO: 817184 - DNA, 25 bp, Mus musculus
tggatgaaaccgaaatcaggagttt

SEQ ID NO: 817185 - DNA, 25 bp, Mus musculus
tggatgaaaccgtaatcaggagttt

SEQ ID NO: 817186 - DNA, 25 bp, Mus musculus
tggatgaaagcactgttcgcaagct

SEQ ID NO: 817187 - DNA, 25 bp, Mus musculus
tggatgaaagcagtgttcgcaagct

SEQ ID NO: 817188 - DNA, 25 bp, Mus musculus
tggatgaacaagaccccagacggca

SEQ ID NO: 817189 - DNA, 25 bp, Mus musculus
tggatgaacaagtccccagacggca

SEQ ID NO: 817190 - DNA, 25 bp, Mus musculus
tggatgaaccagctaccgctcttgg

SEQ ID NO: 817191 - DNA, 25 bp, Mus musculus
tggatgaaccaggtaccgctcttgg

SEQ ID NO: 817192 - DNA, 25 bp, Mus musculus
tggatgaaccttccgaaaatggtgc

SEQ ID NO: 817193 - DNA, 25 bp, Mus musculus
tggatgaaccttgcgaaaatggtgc

SEQ ID NO: 817194 - DNA, 25 bp, Mus musculus
tggatgaactgaacaatgaggagct

SEQ ID NO: 817195 - DNA, 25 bp, Mus musculus
tggatgaactgatcaatgaggagct

SEQ ID NO: 817196 - DNA, 25 bp, Mus musculus
tggatgaagaccatattcggaagct

SEQ ID NO: 817197 - DNA, 25 bp, Mus musculus
tggatgaagaccttattcggaagct

SEQ ID NO: 817198 - DNA, 25 bp, Mus musculus
tggatgaatgaaattgagaagtggc

SEQ ID NO: 817199 - DNA, 25 bp, Mus musculus
tggatgaatgaatttgagaagtggc

SEQ ID NO: 817200 - DNA, 25 bp, Mus musculus
tggatgacaaccaggctcccttttt

SEQ ID NO: 817201 - DNA, 25 bp, Mus musculus
tggatgacaacctggctcccttttt

SEQ ID NO: 817202 - DNA, 25 bp, Mus musculus
tggatgacacaccagtcttgcatgt

SEQ ID NO: 817203 - DNA, 25 bp, Mus musculus
tggatgacacacgagtcttgcatgt

SEQ ID NO: 817204 - DNA, 25 bp, Mus musculus
tggatgacacagagcggtacaccaa

SEQ ID NO: 817205 - DNA, 25 bp, Mus musculus
tggatgacacagcaaataacccttc

SEQ ID NO: 817206 - DNA, 25 bp, Mus musculus
tggatgacacaggaaataacccttc

SEQ ID NO: 817207 - DNA, 25 bp, Mus musculus
tggatgacacagtgcggtacaccaa

SEQ ID NO: 817208 - DNA, 25 bp, Mus musculus
tggatgacagcaacagttactggag

SEQ ID NO: 817209 - DNA, 25 bp, Mus musculus
tggatgacagcatcagttactggag

SEQ ID NO: 817210 - DNA, 25 bp, Mus musculus
tggatgacatagaaagggcagtaga

SEQ ID NO: 817211 - DNA, 25 bp, Mus musculus
tggatgacatagtaagggcagtaga

SEQ ID NO: 817212 - DNA, 25 bp, Mus musculus
tggatgacattcagtttgaggacac

SEQ ID NO: 817213 - DNA, 25 bp, Mus musculus
tggatgacattctgtttgaggacac

SEQ ID NO: 817214 - DNA, 25 bp, Mus musculus
tggatgaccccaaatggacactttg

SEQ ID NO: 817215 - DNA, 25 bp, Mus musculus
tggatgaccccatatggacactttg

SEQ ID NO: 817216 - DNA, 25 bp, Mus musculus
tggatgaccttgaaaccttgcataa

SEQ ID NO: 817217 - DNA, 25 bp, Mus musculus
tggatgaccttgtaaccttgcataa

SEQ ID NO: 817218 - DNA, 25 bp, Mus musculus
tggatgacgtagagatggagaacta

SEQ ID NO: 817219 - DNA, 25 bp, Mus musculus
tggatgacgtagtgatggagaacta

SEQ ID NO: 817220 - DNA, 25 bp, Mus musculus
tggatgactacaaccgccgggtcac

SEQ ID NO: 817221 - DNA, 25 bp, Mus musculus
tggatgactacatccgccgggtcac

SEQ ID NO: 817222 - DNA, 25 bp, Mus musculus
tggatgactcctatcgcaagtgggc

SEQ ID NO: 817223 - DNA, 25 bp, Mus musculus
tggatgactcctttcgcaagtgggc

SEQ ID NO: 817224 - DNA, 25 bp, Mus musculus
tggatgactctgattcacttggcga

SEQ ID NO: 817225 - DNA, 25 bp, Mus musculus
tggatgactctgtttcacttggcga

SEQ ID NO: 817226 - DNA, 25 bp, Mus musculus
tggatgactgtccaggaaacaactg

SEQ ID NO: 817227 - DNA, 25 bp, Mus musculus
tggatgactgtcgaggaaacaactg

SEQ ID NO: 817228 - DNA, 25 bp, Mus musculus
tggatgacttggacactcaggagag

SEQ ID NO: 817229 - DNA, 25 bp, Mus musculus
tggatgacttggtcactcaggagag

SEQ ID NO: 817230 - DNA, 25 bp, Mus musculus
tggatgagagagctcccgacaagca

SEQ ID NO: 817231 - DNA, 25 bp, Mus musculus
tggatgagagaggtcccgacaagca

SEQ ID NO: 817232 - DNA, 25 bp, Mus musculus
tggatgagatgtacacgagatgcat

SEQ ID NO: 817233 - DNA, 25 bp, Mus musculus
tggatgagatgttcacgagatgcat

SEQ ID NO: 817234 - DNA, 25 bp, Mus musculus
tggatgagcctaacccaggtgtcgg

SEQ ID NO: 817235 - DNA, 25 bp, Mus musculus
tggatgagcctatcccaggtgtcgg

SEQ ID NO: 817236 - DNA, 25 bp, Mus musculus
tggatgagcgatccagaagagtccc

SEQ ID NO: 817237 - DNA, 25 bp, Mus musculus
tggatgagcgatgcagaagagtccc

SEQ ID NO: 817238 - DNA, 25 bp, Mus musculus
tggatgaggagaatgtgtcgccctt

SEQ ID NO: 817239 - DNA, 25 bp, Mus musculus
tggatgaggagattgtgtcgccctt

SEQ ID NO: 817240 - DNA, 25 bp, Mus musculus
tggatgaggatcctctggaagatct

SEQ ID NO: 817241 - DNA, 25 bp, Mus musculus
tggatgaggatcgtctggaagatct

SEQ ID NO: 817242 - DNA, 25 bp, Mus musculus
tggatgaggcagacctgctcaaaac

SEQ ID NO: 817243 - DNA, 25 bp, Mus musculus
tggatgaggcagtcctgctcaaaac

SEQ ID NO: 817244 - DNA, 25 bp, Mus musculus
tggatgaggcctacgttcagcccga

SEQ ID NO: 817245 - DNA, 25 bp, Mus musculus
tggatgaggccttcgttcagcccga

SEQ ID NO: 817246 - DNA, 25 bp, Mus musculus
tggatgagtacccaccacctggagg

SEQ ID NO: 817247 - DNA, 25 bp, Mus musculus
tggatgagtaccgaccacctggagg

SEQ ID NO: 817248 - DNA, 25 bp, Mus musculus
tggatgagtcagctgccgacagatt

SEQ ID NO: 817249 - DNA, 25 bp, Mus musculus
tggatgagtcaggtgccgacagatt

SEQ ID NO: 817250 - DNA, 25 bp, Mus musculus
tggatgatgactacacagcccaaga

SEQ ID NO: 817251 - DNA, 25 bp, Mus musculus
tggatgatgacttcacagcccaaga

SEQ ID NO: 817252 - DNA, 25 bp, Mus musculus
tggatgatgcctaaagacttattga

SEQ ID NO: 817253 - DNA, 25 bp, Mus musculus
tggatgatgccttaagacttattga

SEQ ID NO: 817254 - DNA, 25 bp, Mus musculus
tggatgatggcacaaacatcagtaa

SEQ ID NO: 817255 - DNA, 25 bp, Mus musculus
tggatgatggcagaaacatcagtaa

SEQ ID NO: 817256 - DNA, 25 bp, Mus musculus
tggatgatgggaatctgaaagagct

SEQ ID NO: 817257 - DNA, 25 bp, Mus musculus
tggatgatgggattctgaaagagct

SEQ ID NO: 817258 - DNA, 25 bp, Mus musculus
tggatgattcttaggtgtctctctt

SEQ ID NO: 817259 - DNA, 25 bp, Mus musculus
tggatgattctttggtgtctctctt

SEQ ID NO: 817260 - DNA, 25 bp, Mus musculus
tggatgcaggcaatgaatccagaga

SEQ ID NO: 817261 - DNA, 25 bp, Mus musculus
tggatgcaggcattgaatccagaga

SEQ ID NO: 817262 - DNA, 25 bp, Mus musculus
tggatgcatccaaccaggacctggg

SEQ ID NO: 817263 - DNA, 25 bp, Mus musculus
tggatgcatccatccaggacctggg

SEQ ID NO: 817264 - DNA, 25 bp, Mus musculus
tggatgcatctaaggaagaaggaaa

SEQ ID NO: 817265 - DNA, 25 bp, Mus musculus
tggatgcatctatggaagaaggaaa

SEQ ID NO: 817266 - DNA, 25 bp, Mus musculus
tggatgcatgcacaccctttctacc

SEQ ID NO: 817267 - DNA, 25 bp, Mus musculus
tggatgcatgcagaccctttctacc

SEQ ID NO: 817268 - DNA, 25 bp, Mus musculus
tggatgccaccactgagagagactt

SEQ ID NO: 817269 - DNA, 25 bp, Mus musculus
tggatgccaccagtgagagagactt

SEQ ID NO: 817270 - DNA, 25 bp, Mus musculus
tggatgccacggcactctcctgagc

SEQ ID NO: 817271 - DNA, 25 bp, Mus musculus
tggatgccacgggactctcctgagc

SEQ ID NO: 817272 - DNA, 25 bp, Mus musculus
tggatgccactgaccacgctgagga

SEQ ID NO: 817273 - DNA, 25 bp, Mus musculus
tggatgccactgtccacgctgagga

SEQ ID NO: 817274 - DNA, 25 bp, Mus musculus
tggatgccatgacctacaaccaggc

SEQ ID NO: 817275 - DNA, 25 bp, Mus musculus
tggatgccatgagctacaaccaggc

SEQ ID NO: 817276 - DNA, 25 bp, Mus musculus
tggatgccattgagaaagcccagga

SEQ ID NO: 817277 - DNA, 25 bp, Mus musculus
tggatgccattgtgaaagcccagga

SEQ ID NO: 817278 - DNA, 25 bp, Mus musculus
tggatgccccaaactggacagaagg

SEQ ID NO: 817279 - DNA, 25 bp, Mus musculus
tggatgccccaatctggacagaagg

SEQ ID NO: 817280 - DNA, 25 bp, Mus musculus
tggatgccctgacccaagtgtgcct

SEQ ID NO: 817281 - DNA, 25 bp, Mus musculus
tggatgccctgagccaagtgtgcct

SEQ ID NO: 817282 - DNA, 25 bp, Mus musculus
tggatgcccttgatggctgcccaga

SEQ ID NO: 817283 - DNA, 25 bp, Mus musculus
tggatgcccttgttggctgcccaga

SEQ ID NO: 817284 - DNA, 25 bp, Mus musculus
tggatgccgattccaaagattttaa

SEQ ID NO: 817285 - DNA, 25 bp, Mus musculus
tggatgccgattgcaaagattttaa

SEQ ID NO: 817286 - DNA, 25 bp, Mus musculus
tggatgccgccaacgctgccctggt

SEQ ID NO: 817287 - DNA, 25 bp, Mus musculus
tggatgccgccatcgctgccctggt

SEQ ID NO: 817288 - DNA, 25 bp, Mus musculus
tggatgcctgccagtacatcctgga

SEQ ID NO: 817289 - DNA, 25 bp, Mus musculus
tggatgcctgcctgtacatcctgga

SEQ ID NO: 817290 - DNA, 25 bp, Mus musculus
tggatgcctggcatcaacgagcgca

SEQ ID NO: 817291 - DNA, 25 bp, Mus musculus
tggatgcctggcttcaacgagcgca

SEQ ID NO: 817292 - DNA, 25 bp, Mus musculus
tggatgccttggatggtctgtgttc

SEQ ID NO: 817293 - DNA, 25 bp, Mus musculus
tggatgccttggttggtctgtgttc

SEQ ID NO: 817294 - DNA, 25 bp, Mus musculus
tggatgcgagctctcaagaagcatg

SEQ ID NO: 817295 - DNA, 25 bp, Mus musculus
tggatgcgagctgtcaagaagcatg

SEQ ID NO: 817296 - DNA, 25 bp, Mus musculus
tggatgcgattgaccttgagaacct

SEQ ID NO: 817297 - DNA, 25 bp, Mus musculus
tggatgcgattgtccttgagaacct

SEQ ID NO: 817298 - DNA, 25 bp, Mus musculus
tggatgcggcccacatggcctgtgt

SEQ ID NO: 817299 - DNA, 25 bp, Mus musculus
tggatgcggccctcatggcctgtgt

SEQ ID NO: 817300 - DNA, 25 bp, Mus musculus
tggatgcgtatgctcaccttgaacc

SEQ ID NO: 817301 - DNA, 25 bp, Mus musculus
tggatgcgtatggtcaccttgaacc

SEQ ID NO: 817302 - DNA, 25 bp, Mus musculus
tggatgcgtctcagcctttgcggct

SEQ ID NO: 817303 - DNA, 25 bp, Mus musculus
tggatgcgtctctgcctttgcggct

SEQ ID NO: 817304 - DNA, 25 bp, Mus musculus
tggatgctcacccaaaggcaaaagt

SEQ ID NO: 817305 - DNA, 25 bp, Mus musculus
tggatgctcaccgaaaggcaaaagt

SEQ ID NO: 817306 - DNA, 25 bp, Mus musculus
tggatgctctttaggaacagcagaa

SEQ ID NO: 817307 - DNA, 25 bp, Mus musculus
tggatgctcttttggaacagcagaa

SEQ ID NO: 817308 - DNA, 25 bp, Mus musculus
tggatgctgcagacttcatcaagtt

SEQ ID NO: 817309 - DNA, 25 bp, Mus musculus
tggatgctgcagtcttcatcaagtt

SEQ ID NO: 817310 - DNA, 25 bp, Mus musculus
tggatgctgttcactactggatttc

SEQ ID NO: 817311 - DNA, 25 bp, Mus musculus
tggatgctgttctctactggatttc

SEQ ID NO: 817312 - DNA, 25 bp, Mus musculus
tggatgcttgcacaataaagtagtt

SEQ ID NO: 817313 - DNA, 25 bp, Mus musculus
tggatgcttgcagaataaagtagtt

SEQ ID NO: 817314 - DNA, 25 bp, Mus musculus
tggatgctttaaacaagatcaagaa

SEQ ID NO: 817315 - DNA, 25 bp, Mus musculus
tggatgctttaatcaagatcaagaa

SEQ ID NO: 817316 - DNA, 25 bp, Mus musculus
tggatggaaatcataaactcactct

SEQ ID NO: 817317 - DNA, 25 bp, Mus musculus
tggatggaaatcttaaactcactct

SEQ ID NO: 817318 - DNA, 25 bp, Mus musculus
tggatggaaggacacatcccaaaga

SEQ ID NO: 817319 - DNA, 25 bp, Mus musculus
tggatggaaggagacatcccaaaga

SEQ ID NO: 817320 - DNA, 25 bp, Mus musculus
tggatggaccatcgatacagaagca

SEQ ID NO: 817321 - DNA, 25 bp, Mus musculus
tggatggaccatggatacagaagca

SEQ ID NO: 817322 - DNA, 25 bp, Mus musculus
tggatggactcactaccaacggtgt

SEQ ID NO: 817323 - DNA, 25 bp, Mus musculus
tggatggactcagtaccaacggtgt

SEQ ID NO: 817324 - DNA, 25 bp, Mus musculus
tggatggactgacaggtgtttccca

SEQ ID NO: 817325 - DNA, 25 bp, Mus musculus
tggatggactgagaggtgtttccca

SEQ ID NO: 817326 - DNA, 25 bp, Mus musculus
tggatggagacgaaggccccaacac

SEQ ID NO: 817327 - DNA, 25 bp, Mus musculus
tggatggagacgtaggccccaacac

SEQ ID NO: 817328 - DNA, 25 bp, Mus musculus
tggatggatgctcagacaaaaaaga

SEQ ID NO: 817329 - DNA, 25 bp, Mus musculus
tggatggatgctgagacaaaaaaga

SEQ ID NO: 817330 - DNA, 25 bp, Mus musculus
tggatggcaatacactgacttttat

SEQ ID NO: 817331 - DNA, 25 bp, Mus musculus
tggatggcaatagactgacttttat

SEQ ID NO: 817332 - DNA, 25 bp, Mus musculus
tggatggcaatgcaaagatgaccct

SEQ ID NO: 817333 - DNA, 25 bp, Mus musculus
tggatggcaatggaaagatgaccct

SEQ ID NO: 817334 - DNA, 25 bp, Mus musculus
tggatggccgggactactgcagttc

SEQ ID NO: 817335 - DNA, 25 bp, Mus musculus
tggatggccgggtctactgcagttc

SEQ ID NO: 817336 - DNA, 25 bp, Mus musculus
tggatggctccactcagacgtgccg

SEQ ID NO: 817337 - DNA, 25 bp, Mus musculus
tggatggctccagtcagacgtgccg

SEQ ID NO: 817338 - DNA, 25 bp, Mus musculus
tggatggctcgaagcactacgtgct

SEQ ID NO: 817339 - DNA, 25 bp, Mus musculus
tggatggctcgatgcactacgtgct

SEQ ID NO: 817340 - DNA, 25 bp, Mus musculus
tggatggctgaacttgatgttttcc

SEQ ID NO: 817341 - DNA, 25 bp, Mus musculus
tggatggctgaagttgatgttttcc

SEQ ID NO: 817342 - DNA, 25 bp, Mus musculus
tggatggctgcaacatgactatggc

SEQ ID NO: 817343 - DNA, 25 bp, Mus musculus
tggatggctgcatcatgactatggc

SEQ ID NO: 817344 - DNA, 25 bp, Mus musculus
tggatggctttgatcctgcacactt

SEQ ID NO: 817345 - DNA, 25 bp, Mus musculus
tggatggctttgttcctgcacactt

SEQ ID NO: 817346 - DNA, 25 bp, Mus musculus
tggatgggcatgacctgcgaactct

SEQ ID NO: 817347 - DNA, 25 bp, Mus musculus
tggatgggcatgtcctgcgaactct

SEQ ID NO: 817348 - DNA, 25 bp, Mus musculus
tggatgggtattccatgttcaacca

SEQ ID NO: 817349 - DNA, 25 bp, Mus musculus
tggatgggtattgcatgttcaacca

SEQ ID NO: 817350 - DNA, 25 bp, Mus musculus
tggatggtcactccttagccaaggc

SEQ ID NO: 817351 - DNA, 25 bp, Mus musculus
tggatggtcactgcttagccaaggc

SEQ ID NO: 817352 - DNA, 25 bp, Mus musculus
tggatggtgcaacggattttaaaga

SEQ ID NO: 817353 - DNA, 25 bp, Mus musculus
tggatggtgcaagggattttaaaga

SEQ ID NO: 817354 - DNA, 25 bp, Mus musculus
tggatggttcctcagaacgtggaca

SEQ ID NO: 817355 - DNA, 25 bp, Mus musculus
tggatggttcctgagaacgtggaca

SEQ ID NO: 817356 - DNA, 25 bp, Mus musculus
tggatgtacacacactacaattgga

SEQ ID NO: 817357 - DNA, 25 bp, Mus musculus
tggatgtacacagactacaattgga

SEQ ID NO: 817358 - DNA, 25 bp, Mus musculus
tggatgtaccctcgtgatggccctc

SEQ ID NO: 817359 - DNA, 25 bp, Mus musculus
tggatgtaccctggtgatggccctc

SEQ ID NO: 817360 - DNA, 25 bp, Mus musculus
tggatgtcaagcaccgctcacttat

SEQ ID NO: 817361 - DNA, 25 bp, Mus musculus
tggatgtcaagctccgctcacttat

SEQ ID NO: 817362 - DNA, 25 bp, Mus musculus
tggatgtcaccaagacagagagtat

SEQ ID NO: 817363 - DNA, 25 bp, Mus musculus
tggatgtcaccatgacagagagtat

SEQ ID NO: 817364 - DNA, 25 bp, Mus musculus
tggatgtcactgaagacttctctga

SEQ ID NO: 817365 - DNA, 25 bp, Mus musculus
tggatgtcactgtagacttctctga

SEQ ID NO: 817366 - DNA, 25 bp, Mus musculus
tggatgtcatcaaggagtcccgaga

SEQ ID NO: 817367 - DNA, 25 bp, Mus musculus
tggatgtcatcatggagtcccgaga

SEQ ID NO: 817368 - DNA, 25 bp, Mus musculus
tggatgtcctgaagcacctagaaaa

SEQ ID NO: 817369 - DNA, 25 bp, Mus musculus
tggatgtcctgatgcacctagaaaa

SEQ ID NO: 817370 - DNA, 25 bp, Mus musculus
tggatgtcctgtcccaggccaagtc

SEQ ID NO: 817371 - DNA, 25 bp, Mus musculus
tggatgtcctgtgccaggccaagtc

SEQ ID NO: 817372 - DNA, 25 bp, Mus musculus
tggatgtcctttctttcgattcaac

SEQ ID NO: 817373 - DNA, 25 bp, Mus musculus
tggatgtcctttgtttcgattcaac

SEQ ID NO: 817374 - DNA, 25 bp, Mus musculus
tggatgtctacgacatgacacagcc

SEQ ID NO: 817375 - DNA, 25 bp, Mus musculus
tggatgtctacgtcatgacacagcc

SEQ ID NO: 817376 - DNA, 25 bp, Mus musculus
tggatgtcttcacaccgcatctcaa

SEQ ID NO: 817377 - DNA, 25 bp, Mus musculus
tggatgtcttcagaccgcatctcaa

SEQ ID NO: 817378 - DNA, 25 bp, Mus musculus
tggatgtcttctcttttgggatcgt

SEQ ID NO: 817379 - DNA, 25 bp, Mus musculus
tggatgtcttctgttttgggatcgt

SEQ ID NO: 817380 - DNA, 25 bp, Mus musculus
tggatgtgaatcaggactcagagct

SEQ ID NO: 817381 - DNA, 25 bp, Mus musculus
tggatgtgaatctggactcagagct

SEQ ID NO: 817382 - DNA, 25 bp, Mus musculus
tggatgtgatcactctcaaggaaga

SEQ ID NO: 817383 - DNA, 25 bp, Mus musculus
tggatgtgatcagtctcaaggaaga

SEQ ID NO: 817384 - DNA, 25 bp, Mus musculus
tggatgtgatttcgccagaaaaaga

SEQ ID NO: 817385 - DNA, 25 bp, Mus musculus
tggatgtgatttggccagaaaaaga

SEQ ID NO: 817386 - DNA, 25 bp, Mus musculus
tggatgtgcacaaatcaggaaatgt

SEQ ID NO: 817387 - DNA, 25 bp, Mus musculus
tggatgtgcacatatcaggaaatgt

SEQ ID NO: 817388 - DNA, 25 bp, Mus musculus
tggatgtgcacccactttgaagaac

SEQ ID NO: 817389 - DNA, 25 bp, Mus musculus
tggatgtgcaccgactttgaagaac

SEQ ID NO: 817390 - DNA, 25 bp, Mus musculus
tggatgtgcactactggaaagcctt

SEQ ID NO: 817391 - DNA, 25 bp, Mus musculus
tggatgtgcacttctggaaagcctt

SEQ ID NO: 817392 - DNA, 25 bp, Mus musculus
tggatgtgcatgatcatcagtgtga

SEQ ID NO: 817393 - DNA, 25 bp, Mus musculus
tggatgtgcatgttcatcagtgtga

SEQ ID NO: 817394 - DNA, 25 bp, Mus musculus
tggatgtgcggcaacaacatgtccg

SEQ ID NO: 817395 - DNA, 25 bp, Mus musculus
tggatgtgcggctacaacatgtccg

SEQ ID NO: 817396 - DNA, 25 bp, Mus musculus
tggatgtgctgaagtacagccagaa

SEQ ID NO: 817397 - DNA, 25 bp, Mus musculus
tggatgtgctgatgtacagccagaa

SEQ ID NO: 817398 - DNA, 25 bp, Mus musculus
tggatgtggtttatgccaaccgccc

SEQ ID NO: 817399 - DNA, 25 bp, Mus musculus
tggatgtggtttttgccaaccgccc

SEQ ID NO: 817400 - DNA, 25 bp, Mus musculus
tggatgtgtcatctattgccaaaca

SEQ ID NO: 817401 - DNA, 25 bp, Mus musculus
tggatgtgtcatgtattgccaaaca

SEQ ID NO: 817402 - DNA, 25 bp, Mus musculus
tggatgttcggaaggaaagatgccc

SEQ ID NO: 817403 - DNA, 25 bp, Mus musculus
tggatgttcggatggaaagatgccc

SEQ ID NO: 817404 - DNA, 25 bp, Mus musculus
tggatgttggcacctacattctgaa

SEQ ID NO: 817405 - DNA, 25 bp, Mus musculus
tggatgttggcagctacattctgaa

SEQ ID NO: 817406 - DNA, 25 bp, Mus musculus
tggatgttttctaccgccagacttg

SEQ ID NO: 817407 - DNA, 25 bp, Mus musculus
tggatgttttcttccgccagacttg

SEQ ID NO: 817408 - DNA, 25 bp, Mus musculus
tggattaagaatcgctaggatgcct

SEQ ID NO: 817409 - DNA, 25 bp, Mus musculus
tggattaagaatggctaggatgcct

SEQ ID NO: 817410 - DNA, 25 bp, Mus musculus
tggattaattaaagaaatgattgcc

SEQ ID NO: 817411 - DNA, 25 bp, Mus musculus
tggattaattaatgaaatgattgcc

SEQ ID NO: 817412 - DNA, 25 bp, Mus musculus
tggattagaaatcgtggccaccttg

SEQ ID NO: 817413 - DNA, 25 bp, Mus musculus
tggattagaaatggtggccaccttg

SEQ ID NO: 817414 - DNA, 25 bp, Mus musculus
tggattagatcaccaatcaccaaca

SEQ ID NO: 817415 - DNA, 25 bp, Mus musculus
tggattagatcagcaatcaccaaca

SEQ ID NO: 817416 - DNA, 25 bp, Mus musculus
tggattatatcaagggtggctgcca

SEQ ID NO: 817417 - DNA, 25 bp, Mus musculus
tggattatatcatgggtggctgcca

SEQ ID NO: 817418 - DNA, 25 bp, Mus musculus
tggattcagtggaggaccgccaagc

SEQ ID NO: 817419 - DNA, 25 bp, Mus musculus
tggattcagtggtggaccgccaagc

SEQ ID NO: 817420 - DNA, 25 bp, Mus musculus
tggattcatctgaaggtgccctgcg

SEQ ID NO: 817421 - DNA, 25 bp, Mus musculus
tggattcatctgcacctctggatag

SEQ ID NO: 817422 - DNA, 25 bp, Mus musculus
tggattcatctggacctctggatag

SEQ ID NO: 817423 - DNA, 25 bp, Mus musculus
tggattcatctgtaggtgccctgcg

SEQ ID NO: 817424 - DNA, 25 bp, Mus musculus
tggattcatgagagttagcgctggc

SEQ ID NO: 817425 - DNA, 25 bp, Mus musculus
tggattcatgagtgttagcgctggc

SEQ ID NO: 817426 - DNA, 25 bp, Mus musculus
tggattccaacccaggtgctatcaa

SEQ ID NO: 817427 - DNA, 25 bp, Mus musculus
tggattccaaccgaggtgctatcaa

SEQ ID NO: 817428 - DNA, 25 bp, Mus musculus
tggattcccaacaaacattactctg

SEQ ID NO: 817429 - DNA, 25 bp, Mus musculus
tggattcccaactaacattactctg

SEQ ID NO: 817430 - DNA, 25 bp, Mus musculus
tggattccggctaaaagtttgtggc

SEQ ID NO: 817431 - DNA, 25 bp, Mus musculus
tggattccggcttaaagtttgtggc

SEQ ID NO: 817432 - DNA, 25 bp, Mus musculus
tggattcggagaacagcccctacct

SEQ ID NO: 817433 - DNA, 25 bp, Mus musculus
tggattcggagatcagcccctacct

SEQ ID NO: 817434 - DNA, 25 bp, Mus musculus
tggattcgtcgacaagacctgcagc

SEQ ID NO: 817435 - DNA, 25 bp, Mus musculus
tggattcgtcgagaagacctgcagc

SEQ ID NO: 817436 - DNA, 25 bp, Mus musculus
tggattctacagaggaggatgctgt

SEQ ID NO: 817437 - DNA, 25 bp, Mus musculus
tggattctacagtggaggatgctgt

SEQ ID NO: 817438 - DNA, 25 bp, Mus musculus
tggattctacttaaaccttccgaag

SEQ ID NO: 817439 - DNA, 25 bp, Mus musculus
tggattctactttaaccttccgaag

SEQ ID NO: 817440 - DNA, 25 bp, Mus musculus
tggattctagacactggcctcctgg

SEQ ID NO: 817441 - DNA, 25 bp, Mus musculus
tggattctagactctggcctcctgg

SEQ ID NO: 817442 - DNA, 25 bp, Mus musculus
tggattctccggctcctgtctcaac

SEQ ID NO: 817443 - DNA, 25 bp, Mus musculus
tggattctccgggtcctgtctcaac

SEQ ID NO: 817444 - DNA, 25 bp, Mus musculus
tggattctcgacatcaaaggataca

SEQ ID NO: 817445 - DNA, 25 bp, Mus musculus
tggattctcgacttcaaaggataca

SEQ ID NO: 817446 - DNA, 25 bp, Mus musculus
tggattctcgatataggaagggaac

SEQ ID NO: 817447 - DNA, 25 bp, Mus musculus
tggattctcgatttaggaagggaac

SEQ ID NO: 817448 - DNA, 25 bp, Mus musculus
tggattctgggtcgtcagagccaca

SEQ ID NO: 817449 - DNA, 25 bp, Mus musculus
tggattctgggtggtcagagccaca

SEQ ID NO: 817450 - DNA, 25 bp, Mus musculus
tggattcttgcacacaagaacagct

SEQ ID NO: 817451 - DNA, 25 bp, Mus musculus
tggattcttgcagacaagaacagct

SEQ ID NO: 817452 - DNA, 25 bp, Mus musculus
tggattcttggcagtcagcagtctg

SEQ ID NO: 817453 - DNA, 25 bp, Mus musculus
tggattcttggctgtcagcagtctg

SEQ ID NO: 817454 - DNA, 25 bp, Mus musculus
tggattcttttgagcagttggcact

SEQ ID NO: 817455 - DNA, 25 bp, Mus musculus
tggattcttttgtgcagttggcact

SEQ ID NO: 817456 - DNA, 25 bp, Mus musculus
tggattgagcccagatacttcagaa

SEQ ID NO: 817457 - DNA, 25 bp, Mus musculus
tggattgagccctgatacttcagaa

SEQ ID NO: 817458 - DNA, 25 bp, Mus musculus
tggattgatcctcatgacttcccgc

SEQ ID NO: 817459 - DNA, 25 bp, Mus musculus
tggattgatcctgatgacttcccgc

SEQ ID NO: 817460 - DNA, 25 bp, Mus musculus
tggattgatgatctcagaacagaga

SEQ ID NO: 817461 - DNA, 25 bp, Mus musculus
tggattgatgatgtcagaacagaga

SEQ ID NO: 817462 - DNA, 25 bp, Mus musculus
tggattgcagcaaaccaacagtgaa

SEQ ID NO: 817463 - DNA, 25 bp, Mus musculus
tggattgcagcataccaacagtgaa

SEQ ID NO: 817464 - DNA, 25 bp, Mus musculus
tggattgcctccagaagacgactgg

SEQ ID NO: 817465 - DNA, 25 bp, Mus musculus
tggattgcctcctgaagacgactgg

SEQ ID NO: 817466 - DNA, 25 bp, Mus musculus
tggattgcgtgcacttgctcccgac

SEQ ID NO: 817467 - DNA, 25 bp, Mus musculus
tggattgcgtgctcttgctcccgac

SEQ ID NO: 817468 - DNA, 25 bp, Mus musculus
tggattggattaacacgccagaact

SEQ ID NO: 817469 - DNA, 25 bp, Mus musculus
tggattggattatcacgccagaact

SEQ ID NO: 817470 - DNA, 25 bp, Mus musculus
tggattggccaaccagggcaacaac

SEQ ID NO: 817471 - DNA, 25 bp, Mus musculus
tggattggccaagcagggcaacaac

SEQ ID NO: 817472 - DNA, 25 bp, Mus musculus
tggattggcctacttctacctgatg

SEQ ID NO: 817473 - DNA, 25 bp, Mus musculus
tggattggcctagttctacctgatg

SEQ ID NO: 817474 - DNA, 25 bp, Mus musculus
tggattggctcgcttgattgaagac

SEQ ID NO: 817475 - DNA, 25 bp, Mus musculus
tggattggctcggttgattgaagac

SEQ ID NO: 817476 - DNA, 25 bp, Mus musculus
tggattgggctccagtcctttcctc

SEQ ID NO: 817477 - DNA, 25 bp, Mus musculus
tggattgggctcgagtcctttcctc

SEQ ID NO: 817478 - DNA, 25 bp, Mus musculus
tggatttagcatatcaggaggtgtc

SEQ ID NO: 817479 - DNA, 25 bp, Mus musculus
tggatttagcatttcaggaggtgtc

SEQ ID NO: 817480 - DNA, 25 bp, Mus musculus
tggatttcaattcccagtcctctga

SEQ ID NO: 817481 - DNA, 25 bp, Mus musculus
tggatttcaattgccagtcctctga

SEQ ID NO: 817482 - DNA, 25 bp, Mus musculus
tggatttcagaactacctgtgagga

SEQ ID NO: 817483 - DNA, 25 bp, Mus musculus
tggatttcagaagtacctgtgagga

SEQ ID NO: 817484 - DNA, 25 bp, Mus musculus
tggatttcatacaaattttctggag

SEQ ID NO: 817485 - DNA, 25 bp, Mus musculus
tggatttcatactaattttctggag

SEQ ID NO: 817486 - DNA, 25 bp, Mus musculus
tggatttcattcattggcctcggaa

SEQ ID NO: 817487 - DNA, 25 bp, Mus musculus
tggatttcattctttggcctcggaa

SEQ ID NO: 817488 - DNA, 25 bp, Mus musculus
tggatttccacgacgagcagaagcg

SEQ ID NO: 817489 - DNA, 25 bp, Mus musculus
tggatttccacgtcgagcagaagcg

SEQ ID NO: 817490 - DNA, 25 bp, Mus musculus
tggatttccgtaaacagagccgaac

SEQ ID NO: 817491 - DNA, 25 bp, Mus musculus
tggatttccgtatacagagccgaac

SEQ ID NO: 817492 - DNA, 25 bp, Mus musculus
tggatttcggaaattcggataaggg

SEQ ID NO: 817493 - DNA, 25 bp, Mus musculus
tggatttcggaatttcggataaggg

SEQ ID NO: 817494 - DNA, 25 bp, Mus musculus
tggatttcgttaaatcccctttaga

SEQ ID NO: 817495 - DNA, 25 bp, Mus musculus
tggatttcgttatatcccctttaga

SEQ ID NO: 817496 - DNA, 25 bp, Mus musculus
tggatttctctcacgaaggacccgc

SEQ ID NO: 817497 - DNA, 25 bp, Mus musculus
tggatttctctctcgaaggacccgc

SEQ ID NO: 817498 - DNA, 25 bp, Mus musculus
tggatttctgaacttcaatgttgcc

SEQ ID NO: 817499 - DNA, 25 bp, Mus musculus
tggatttctgaagttcaatgttgcc

SEQ ID NO: 817500 - DNA, 25 bp, Mus musculus
tggatttctgggacactcttcaagc

SEQ ID NO: 817501 - DNA, 25 bp, Mus musculus
tggatttctgggtcactcttcaagc

SEQ ID NO: 817502 - DNA, 25 bp, Mus musculus
tggatttgatcccacatggaggcaa

SEQ ID NO: 817503 - DNA, 25 bp, Mus musculus
tggatttgatccgacatggaggcaa

SEQ ID NO: 817504 - DNA, 25 bp, Mus musculus
tggatttgccagcttcaaaagtttc

SEQ ID NO: 817505 - DNA, 25 bp, Mus musculus
tggatttgccaggttcaaaagtttc

SEQ ID NO: 817506 - DNA, 25 bp, Mus musculus
tggatttgccccatgccagctctgt

SEQ ID NO: 817507 - DNA, 25 bp, Mus musculus
tggatttgccccttgccagctctgt

SEQ ID NO: 817508 - DNA, 25 bp, Mus musculus
tggatttgctgaaagagcttaagaa

SEQ ID NO: 817509 - DNA, 25 bp, Mus musculus
tggatttgctgatagagcttaagaa

SEQ ID NO: 817510 - DNA, 25 bp, Mus musculus
tggatttggactaagatttggagca

SEQ ID NO: 817511 - DNA, 25 bp, Mus musculus
tggatttggacttagatttggagca

SEQ ID NO: 817512 - DNA, 25 bp, Mus musculus
tggatttggaggaacgaactaagaa

SEQ ID NO: 817513 - DNA, 25 bp, Mus musculus
tggatttggaggtacgaactaagaa

SEQ ID NO: 817514 - DNA, 25 bp, Mus musculus
tggatttggtgaccacactgtgacc

SEQ ID NO: 817515 - DNA, 25 bp, Mus musculus
tggatttggtgagcacactgtgacc

SEQ ID NO: 817516 - DNA, 25 bp, Mus musculus
tggatttgtaagctttgaaaggcat

SEQ ID NO: 817517 - DNA, 25 bp, Mus musculus
tggatttgtaaggtttgaaaggcat

SEQ ID NO: 817518 - DNA, 25 bp, Mus musculus
tggattttattcactgacctcaggc

SEQ ID NO: 817519 - DNA, 25 bp, Mus musculus
tggattttattctctgacctcaggc

SEQ ID NO: 817520 - DNA, 25 bp, Mus musculus
tggcaaaaaggcaaaatcggagact

SEQ ID NO: 817521 - DNA, 25 bp, Mus musculus
tggcaaaaaggctaaatcggagact

SEQ ID NO: 817522 - DNA, 25 bp, Mus musculus
tggcaaaaatacagaagccgacttt

SEQ ID NO: 817523 - DNA, 25 bp, Mus musculus
tggcaaaaatactgaagccgacttt

SEQ ID NO: 817524 - DNA, 25 bp, Mus musculus
tggcaaaacatgatacaaaaggaaa

SEQ ID NO: 817525 - DNA, 25 bp, Mus musculus
tggcaaaacatgttacaaaaggaaa

SEQ ID NO: 817526 - DNA, 25 bp, Mus musculus
tggcaaaagcacactcctgggagtc

SEQ ID NO: 817527 - DNA, 25 bp, Mus musculus
tggcaaaagcactctcctgggagtc

SEQ ID NO: 817528 - DNA, 25 bp, Mus musculus
tggcaaaaggagaagcttccagaat

SEQ ID NO: 817529 - DNA, 25 bp, Mus musculus
tggcaaaaggagtagcttccagaat

SEQ ID NO: 817530 - DNA, 25 bp, Mus musculus
tggcaaaatcaacgatatcaaagac

SEQ ID NO: 817531 - DNA, 25 bp, Mus musculus
tggcaaaatcaaggatatcaaagac

SEQ ID NO: 817532 - DNA, 25 bp, Mus musculus
tggcaaacccaaaacgccgggagtc

SEQ ID NO: 817533 - DNA, 25 bp, Mus musculus
tggcaaacccaatacgccgggagtc

SEQ ID NO: 817534 - DNA, 25 bp, Mus musculus
tggcaaacctggagggcttggcaga

SEQ ID NO: 817535 - DNA, 25 bp, Mus musculus
tggcaaacctggtgggcttggcaga

SEQ ID NO: 817536 - DNA, 25 bp, Mus musculus
tggcaaacgagaagtgcacagcact

SEQ ID NO: 817537 - DNA, 25 bp, Mus musculus
tggcaaacgagatgtgcacagcact

SEQ ID NO: 817538 - DNA, 25 bp, Mus musculus
tggcaaacggacagttgcttcccag

SEQ ID NO: 817539 - DNA, 25 bp, Mus musculus
tggcaaacggactgttgcttcccag

SEQ ID NO: 817540 - DNA, 25 bp, Mus musculus
tggcaaactgttctgtgaggcagct

SEQ ID NO: 817541 - DNA, 25 bp, Mus musculus
tggcaaactgttgtgtgaggcagct

SEQ ID NO: 817542 - DNA, 25 bp, Mus musculus
tggcaaagaaagctctagctcccga

SEQ ID NO: 817543 - DNA, 25 bp, Mus musculus
tggcaaagaaaggtctagctcccga

SEQ ID NO: 817544 - DNA, 25 bp, Mus musculus
tggcaaagacaacttcacactgatc

SEQ ID NO: 817545 - DNA, 25 bp, Mus musculus
tggcaaagacaagttcacactgatc

SEQ ID NO: 817546 - DNA, 25 bp, Mus musculus
tggcaaagacgcagagcccttgtac

SEQ ID NO: 817547 - DNA, 25 bp, Mus musculus
tggcaaagacgctgagcccttgtac

SEQ ID NO: 817548 - DNA, 25 bp, Mus musculus
tggcaaagacgtctcagatgagaag

SEQ ID NO: 817549 - DNA, 25 bp, Mus musculus
tggcaaagacgtgtcagatgagaag

SEQ ID NO: 817550 - DNA, 25 bp, Mus musculus
tggcaaagaggaatacagtaatagg

SEQ ID NO: 817551 - DNA, 25 bp, Mus musculus
tggcaaagaggaccacccacaggaa

SEQ ID NO: 817552 - DNA, 25 bp, Mus musculus
tggcaaagaggagcacccacaggaa

SEQ ID NO: 817553 - DNA, 25 bp, Mus musculus
tggcaaagaggattacagtaatagg

SEQ ID NO: 817554 - DNA, 25 bp, Mus musculus
tggcaaagccaacaaagcactgacg

SEQ ID NO: 817555 - DNA, 25 bp, Mus musculus
tggcaaagccaagaaagcactgacg

SEQ ID NO: 817556 - DNA, 25 bp, Mus musculus
tggcaaagctcccacaggagctcag

SEQ ID NO: 817557 - DNA, 25 bp, Mus musculus
tggcaaagctccgacaggagctcag

SEQ ID NO: 817558 - DNA, 25 bp, Mus musculus
tggcaaagctgacggccctacaggt

SEQ ID NO: 817559 - DNA, 25 bp, Mus musculus
tggcaaagctgagggccctacaggt

SEQ ID NO: 817560 - DNA, 25 bp, Mus musculus
tggcaaaggattacacagcaagaag

SEQ ID NO: 817561 - DNA, 25 bp, Mus musculus
tggcaaaggatttcacagcaagaag

SEQ ID NO: 817562 - DNA, 25 bp, Mus musculus
tggcaaaggttgaccatgtccagat

SEQ ID NO: 817563 - DNA, 25 bp, Mus musculus
tggcaaaggttgtccatgtccagat

SEQ ID NO: 817564 - DNA, 25 bp, Mus musculus
tggcaaagtcctatccagagaatac

SEQ ID NO: 817565 - DNA, 25 bp, Mus musculus
tggcaaagtcctcacccctgaagag

SEQ ID NO: 817566 - DNA, 25 bp, Mus musculus
tggcaaagtcctgacccctgaagag

SEQ ID NO: 817567 - DNA, 25 bp, Mus musculus
tggcaaagtcctttccagagaatac

SEQ ID NO: 817568 - DNA, 25 bp, Mus musculus
tggcaaatacaaaggcaatggtcgt

SEQ ID NO: 817569 - DNA, 25 bp, Mus musculus
tggcaaatacaatggcaatggtcgt

SEQ ID NO: 817570 - DNA, 25 bp, Mus musculus
tggcaaatgaaactggagccttctt

SEQ ID NO: 817571 - DNA, 25 bp, Mus musculus
tggcaaatgaaagtggagccttctt

SEQ ID NO: 817572 - DNA, 25 bp, Mus musculus
tggcaaatgcaaacatgaactgttg

SEQ ID NO: 817573 - DNA, 25 bp, Mus musculus
tggcaaatgcaaatgcaagttcaga

SEQ ID NO: 817574 - DNA, 25 bp, Mus musculus
tggcaaatgcaatcatgaactgttg

SEQ ID NO: 817575 - DNA, 25 bp, Mus musculus
tggcaaatgcaattgcaagttcaga

SEQ ID NO: 817576 - DNA, 25 bp, Mus musculus
tggcaaatggctctcaccaactcag

SEQ ID NO: 817577 - DNA, 25 bp, Mus musculus
tggcaaatggctgtcaccaactcag

SEQ ID NO: 817578 - DNA, 25 bp, Mus musculus
tggcaaatggttccccactctaatt

SEQ ID NO: 817579 - DNA, 25 bp, Mus musculus
tggcaaatggttgcccactctaatt

SEQ ID NO: 817580 - DNA, 25 bp, Mus musculus
tggcaaatgtaaaaagaagaactgc

SEQ ID NO: 817581 - DNA, 25 bp, Mus musculus
tggcaaatgtaataagaagaactgc

SEQ ID NO: 817582 - DNA, 25 bp, Mus musculus
tggcaacaagatcaccaaggttgat

SEQ ID NO: 817583 - DNA, 25 bp, Mus musculus
tggcaacaagatgaccaaggttgat

SEQ ID NO: 817584 - DNA, 25 bp, Mus musculus
tggcaacacatgcaggtctaaaccg

SEQ ID NO: 817585 - DNA, 25 bp, Mus musculus
tggcaacacatggaggtctaaaccg

SEQ ID NO: 817586 - DNA, 25 bp, Mus musculus
tggcaacagaacaggagagaacacc

SEQ ID NO: 817587 - DNA, 25 bp, Mus musculus
tggcaacagaactggagagaacacc

SEQ ID NO: 817588 - DNA, 25 bp, Mus musculus
tggcaacagacacggcgtcccagca

SEQ ID NO: 817589 - DNA, 25 bp, Mus musculus
tggcaacagacagggcgtcccagca

SEQ ID NO: 817590 - DNA, 25 bp, Mus musculus
tggcaacagagacagccggatcctc

SEQ ID NO: 817591 - DNA, 25 bp, Mus musculus
tggcaacagagagagccggatcctc

SEQ ID NO: 817592 - DNA, 25 bp, Mus musculus
tggcaacagcgaagacattggtgtg

SEQ ID NO: 817593 - DNA, 25 bp, Mus musculus
tggcaacagcgatgacattggtgtg

SEQ ID NO: 817594 - DNA, 25 bp, Mus musculus
tggcaacagctgacagttaccttct

SEQ ID NO: 817595 - DNA, 25 bp, Mus musculus
tggcaacagctgtcagttaccttct

SEQ ID NO: 817596 - DNA, 25 bp, Mus musculus
tggcaacatcgccaagacccatgat

SEQ ID NO: 817597 - DNA, 25 bp, Mus musculus
tggcaacatcgcgaagacccatgat

SEQ ID NO: 817598 - DNA, 25 bp, Mus musculus
tggcaaccagtcatgtacagattct

SEQ ID NO: 817599 - DNA, 25 bp, Mus musculus
tggcaaccagtcttgtacagattct

SEQ ID NO: 817600 - DNA, 25 bp, Mus musculus
tggcaaccgaatcctggcccagcat

SEQ ID NO: 817601 - DNA, 25 bp, Mus musculus
tggcaaccgaatgctggcccagcat

SEQ ID NO: 817602 - DNA, 25 bp, Mus musculus
tggcaaccgggaactcctctgtggg

SEQ ID NO: 817603 - DNA, 25 bp, Mus musculus
tggcaaccgggatctcctctgtggg

SEQ ID NO: 817604 - DNA, 25 bp, Mus musculus
tggcaacctatgaaaccctgaatat

SEQ ID NO: 817605 - DNA, 25 bp, Mus musculus
tggcaacctatgtaaccctgaatat

SEQ ID NO: 817606 - DNA, 25 bp, Mus musculus
tggcaaccttcaccatgacgctggc

SEQ ID NO: 817607 - DNA, 25 bp, Mus musculus
tggcaaccttcagcatgacgctggc

SEQ ID NO: 817608 - DNA, 25 bp, Mus musculus
tggcaacggatacatcagctgcaat

SEQ ID NO: 817609 - DNA, 25 bp, Mus musculus
tggcaacggatagatcagctgcaat

SEQ ID NO: 817610 - DNA, 25 bp, Mus musculus
tggcaactaatcagttcccgctgtc

SEQ ID NO: 817611 - DNA, 25 bp, Mus musculus
tggcaactaatctgttcccgctgtc

SEQ ID NO: 817612 - DNA, 25 bp, Mus musculus
tggcaactcaagcacagccatggtg

SEQ ID NO: 817613 - DNA, 25 bp, Mus musculus
tggcaactcaaggacagccatggtg

SEQ ID NO: 817614 - DNA, 25 bp, Mus musculus
tggcaagaacgcagtcaccctgaag

SEQ ID NO: 817615 - DNA, 25 bp, Mus musculus
tggcaagaacgctgtcaccctgaag

SEQ ID NO: 817616 - DNA, 25 bp, Mus musculus
tggcaagaagccagtcaaagagaac

SEQ ID NO: 817617 - DNA, 25 bp, Mus musculus
tggcaagaagcctgtcaaagagaac

SEQ ID NO: 817618 - DNA, 25 bp, Mus musculus
tggcaagaatttcgctcccgtattc

SEQ ID NO: 817619 - DNA, 25 bp, Mus musculus
tggcaagaatttggctcccgtattc

SEQ ID NO: 817620 - DNA, 25 bp, Mus musculus
tggcaagaccgaatctgttgagtac

SEQ ID NO: 817621 - DNA, 25 bp, Mus musculus
tggcaagaccgattctgttgagtac

SEQ ID NO: 817622 - DNA, 25 bp, Mus musculus
tggcaagactcacgaatcccaaatt

SEQ ID NO: 817623 - DNA, 25 bp, Mus musculus
tggcaagactcaggaatcccaaatt

SEQ ID NO: 817624 - DNA, 25 bp, Mus musculus
tggcaagagagtagacaagagtaat

SEQ ID NO: 817625 - DNA, 25 bp, Mus musculus
tggcaagagagttgacaagagtaat

SEQ ID NO: 817626 - DNA, 25 bp, Mus musculus
tggcaagagcagcaatagttgcatc

SEQ ID NO: 817627 - DNA, 25 bp, Mus musculus
tggcaagagcaggaatagttgcatc

SEQ ID NO: 817628 - DNA, 25 bp, Mus musculus
tggcaagagtcaccgaccctctggg

SEQ ID NO: 817629 - DNA, 25 bp, Mus musculus
tggcaagagtcagcgaccctctggg

SEQ ID NO: 817630 - DNA, 25 bp, Mus musculus
tggcaagcacaacaacatcattaac

SEQ ID NO: 817631 - DNA, 25 bp, Mus musculus
tggcaagcacaacggctatggtttt

SEQ ID NO: 817632 - DNA, 25 bp, Mus musculus
tggcaagcacaagaacatcattaac

SEQ ID NO: 817633 - DNA, 25 bp, Mus musculus
tggcaagcacaagggctatggtttt

SEQ ID NO: 817634 - DNA, 25 bp, Mus musculus
tggcaagctgaacgacaactccggc

SEQ ID NO: 817635 - DNA, 25 bp, Mus musculus
tggcaagctgaaggacaactccggc

SEQ ID NO: 817636 - DNA, 25 bp, Mus musculus
tggcaagctgccacctgagttttgt

SEQ ID NO: 817637 - DNA, 25 bp, Mus musculus
tggcaagctgcctcctgagttttgt

SEQ ID NO: 817638 - DNA, 25 bp, Mus musculus
tggcaagctggcaaacggactgttg

SEQ ID NO: 817639 - DNA, 25 bp, Mus musculus
tggcaagctggctaacggactgttg

SEQ ID NO: 817640 - DNA, 25 bp, Mus musculus
tggcaagcttacctcccaactatca

SEQ ID NO: 817641 - DNA, 25 bp, Mus musculus
tggcaagcttacgtcccaactatca

SEQ ID NO: 817642 - DNA, 25 bp, Mus musculus
tggcaagcttcaaatccaacgaatg

SEQ ID NO: 817643 - DNA, 25 bp, Mus musculus
tggcaagcttcatatccaacgaatg

SEQ ID NO: 817644 - DNA, 25 bp, Mus musculus
tggcaagcttccacacacctctgga

SEQ ID NO: 817645 - DNA, 25 bp, Mus musculus
tggcaagcttcctcacacctctgga

SEQ ID NO: 817646 - DNA, 25 bp, Mus musculus
tggcaaggaaaacccagtctgtctg

SEQ ID NO: 817647 - DNA, 25 bp, Mus musculus
tggcaaggaaaagccagtctgtctg

SEQ ID NO: 817648 - DNA, 25 bp, Mus musculus
tggcaaggcagtcttgacaagagct

SEQ ID NO: 817649 - DNA, 25 bp, Mus musculus
tggcaaggcagtgttgacaagagct

SEQ ID NO: 817650 - DNA, 25 bp, Mus musculus
tggcaagggcccacaagtaagtgaa

SEQ ID NO: 817651 - DNA, 25 bp, Mus musculus
tggcaagggccctcaagtaagtgaa

SEQ ID NO: 817652 - DNA, 25 bp, Mus musculus
tggcaaggtcatacccagtcacacc

SEQ ID NO: 817653 - DNA, 25 bp, Mus musculus
tggcaaggtcattcccagtcacacc

SEQ ID NO: 817654 - DNA, 25 bp, Mus musculus
tggcaagtaccaccctatggagtat

SEQ ID NO: 817655 - DNA, 25 bp, Mus musculus
tggcaagtaccagcctatggagtat

SEQ ID NO: 817656 - DNA, 25 bp, Mus musculus
tggcaagtctttcttccaagccaga

SEQ ID NO: 817657 - DNA, 25 bp, Mus musculus
tggcaagtctttgttccaagccaga

SEQ ID NO: 817658 - DNA, 25 bp, Mus musculus
tggcaagtggcgagtgccgcgggtc

SEQ ID NO: 817659 - DNA, 25 bp, Mus musculus
tggcaagtggcgtgtgccgcgggtc

SEQ ID NO: 817660 - DNA, 25 bp, Mus musculus
tggcaataaactcttggtggaacca

SEQ ID NO: 817661 - DNA, 25 bp, Mus musculus
tggcaataaactgttggtggaacca

SEQ ID NO: 817662 - DNA, 25 bp, Mus musculus
tggcaataggataaaacgggttact

SEQ ID NO: 817663 - DNA, 25 bp, Mus musculus
tggcaataggattaaacgggttact

SEQ ID NO: 817664 - DNA, 25 bp, Mus musculus
tggcaatcaaggatgctcatgctaa

SEQ ID NO: 817665 - DNA, 25 bp, Mus musculus
tggcaatcaaggttgctcatgctaa

SEQ ID NO: 817666 - DNA, 25 bp, Mus musculus
tggcaatcagatcgcgtttaagcaa

SEQ ID NO: 817667 - DNA, 25 bp, Mus musculus
tggcaatcagatggcgtttaagcaa

SEQ ID NO: 817668 - DNA, 25 bp, Mus musculus
tggcaatccttaactttgtgacagt

SEQ ID NO: 817669 - DNA, 25 bp, Mus musculus
tggcaatccttatctttgtgacagt

SEQ ID NO: 817670 - DNA, 25 bp, Mus musculus
tggcaatgaagcacccctctgctgt

SEQ ID NO: 817671 - DNA, 25 bp, Mus musculus
tggcaatgaagccactgccgctggt

SEQ ID NO: 817672 - DNA, 25 bp, Mus musculus
tggcaatgaagcgactgccgctggt

SEQ ID NO: 817673 - DNA, 25 bp, Mus musculus
tggcaatgaagctcccctctgctgt

SEQ ID NO: 817674 - DNA, 25 bp, Mus musculus
tggcaatgcagtatgcgcccagtgc

SEQ ID NO: 817675 - DNA, 25 bp, Mus musculus
tggcaatgcagtttgcgcccagtgc

SEQ ID NO: 817676 - DNA, 25 bp, Mus musculus
tggcaatgcgaacacagtatacaac

SEQ ID NO: 817677 - DNA, 25 bp, Mus musculus
tggcaatgcgaagacagtatacaac

SEQ ID NO: 817678 - DNA, 25 bp, Mus musculus
tggcaatgctatcatcatcgtggtg

SEQ ID NO: 817679 - DNA, 25 bp, Mus musculus
tggcaatgctatgatcatcgtggtg

SEQ ID NO: 817680 - DNA, 25 bp, Mus musculus
tggcaatgtcacctacaagaagaga

SEQ ID NO: 817681 - DNA, 25 bp, Mus musculus
tggcaatgtcacgtacaagaagaga

SEQ ID NO: 817682 - DNA, 25 bp, Mus musculus
tggcaatgtgcgagtgtactccatc

SEQ ID NO: 817683 - DNA, 25 bp, Mus musculus
tggcaatgtgcgtgtgtactccatc

SEQ ID NO: 817684 - DNA, 25 bp, Mus musculus
tggcaattgctgcagaagatttttc

SEQ ID NO: 817685 - DNA, 25 bp, Mus musculus
tggcaattgctggagaagatttttc

SEQ ID NO: 817686 - DNA, 25 bp, Mus musculus
tggcaattggagatctctcccgact

SEQ ID NO: 817687 - DNA, 25 bp, Mus musculus
tggcaattggagttctctcccgact

SEQ ID NO: 817688 - DNA, 25 bp, Mus musculus
tggcacaaacatcagtaagcttctc

SEQ ID NO: 817689 - DNA, 25 bp, Mus musculus
tggcacaaacatgagtaagcttctc

SEQ ID NO: 817690 - DNA, 25 bp, Mus musculus
tggcacaaaggaccagcgcatcctg

SEQ ID NO: 817691 - DNA, 25 bp, Mus musculus
tggcacaaaggagcagcgcatcctg

SEQ ID NO: 817692 - DNA, 25 bp, Mus musculus
tggcacaagaccagcttccgctgtg

SEQ ID NO: 817693 - DNA, 25 bp, Mus musculus
tggcacaagacctgcttccgctgtg

SEQ ID NO: 817694 - DNA, 25 bp, Mus musculus
tggcacaagtctatctccttccaga

SEQ ID NO: 817695 - DNA, 25 bp, Mus musculus
tggcacaagtctttctccttccaga

SEQ ID NO: 817696 - DNA, 25 bp, Mus musculus
tggcacacaaaacctttcaccgtta

SEQ ID NO: 817697 - DNA, 25 bp, Mus musculus
tggcacacaaaagctttcaccgtta

SEQ ID NO: 817698 - DNA, 25 bp, Mus musculus
tggcacacccagaactgtaacaaca

SEQ ID NO: 817699 - DNA, 25 bp, Mus musculus
tggcacacccagtactgtaacaaca

SEQ ID NO: 817700 - DNA, 25 bp, Mus musculus
tggcacaccccgaacagctgtacag

SEQ ID NO: 817701 - DNA, 25 bp, Mus musculus
tggcacaccccgtacagctgtacag

SEQ ID NO: 817702 - DNA, 25 bp, Mus musculus
tggcacaccgtcagtggaggctcac

SEQ ID NO: 817703 - DNA, 25 bp, Mus musculus
tggcacaccgtctgtggaggctcac

SEQ ID NO: 817704 - DNA, 25 bp, Mus musculus
tggcacacctcaatccaggaagtgg

SEQ ID NO: 817705 - DNA, 25 bp, Mus musculus
tggcacacctcattccaggaagtgg

SEQ ID NO: 817706 - DNA, 25 bp, Mus musculus
tggcacacgaaacttccaggacttt

SEQ ID NO: 817707 - DNA, 25 bp, Mus musculus
tggcacacgaaagttccaggacttt

SEQ ID NO: 817708 - DNA, 25 bp, Mus musculus
tggcacacgcttatctcccggtggt

SEQ ID NO: 817709 - DNA, 25 bp, Mus musculus
tggcacacgcttttctcccggtggt

SEQ ID NO: 817710 - DNA, 25 bp, Mus musculus
tggcacacttcaagaacatcctggg

SEQ ID NO: 817711 - DNA, 25 bp, Mus musculus
tggcacacttcatgaacatcctggg

SEQ ID NO: 817712 - DNA, 25 bp, Mus musculus
tggcacagaattccaccgatgcaag

SEQ ID NO: 817713 - DNA, 25 bp, Mus musculus
tggcacagaattgcaccgatgcaag

SEQ ID NO: 817714 - DNA, 25 bp, Mus musculus
tggcacagacacctcggagcattct

SEQ ID NO: 817715 - DNA, 25 bp, Mus musculus
tggcacagacacgtcggagcattct

SEQ ID NO: 817716 - DNA, 25 bp, Mus musculus
tggcacagacgtcagcgaatggtac

SEQ ID NO: 817717 - DNA, 25 bp, Mus musculus
tggcacagacgtgagcgaatggtac

SEQ ID NO: 817718 - DNA, 25 bp, Mus musculus
tggcacagagaacagtgagctccag

SEQ ID NO: 817719 - DNA, 25 bp, Mus musculus
tggcacagagaagagtgagctccag

SEQ ID NO: 817720 - DNA, 25 bp, Mus musculus
tggcacagatacctgacgcccgagg

SEQ ID NO: 817721 - DNA, 25 bp, Mus musculus
tggcacagatacgtgacgcccgagg

SEQ ID NO: 817722 - DNA, 25 bp, Mus musculus
tggcacagcggtccttagaagcagg

SEQ ID NO: 817723 - DNA, 25 bp, Mus musculus
tggcacagcggtgcttagaagcagg

SEQ ID NO: 817724 - DNA, 25 bp, Mus musculus
tggcacaggaccagctacagcggct

SEQ ID NO: 817725 - DNA, 25 bp, Mus musculus
tggcacaggacctgctacagcggct

SEQ ID NO: 817726 - DNA, 25 bp, Mus musculus
tggcacagtccccttcgacagagtc

SEQ ID NO: 817727 - DNA, 25 bp, Mus musculus
tggcacagtcccgttcgacagagtc

SEQ ID NO: 817728 - DNA, 25 bp, Mus musculus
tggcacagttgcagctgcagcaaca

SEQ ID NO: 817729 - DNA, 25 bp, Mus musculus
tggcacagttgctgctgcagcaaca

SEQ ID NO: 817730 - DNA, 25 bp, Mus musculus
tggcacatacacatgccttgtggag

SEQ ID NO: 817731 - DNA, 25 bp, Mus musculus
tggcacatacacttgccttgtggag

SEQ ID NO: 817732 - DNA, 25 bp, Mus musculus
tggcacatcccacacaaggaaattg

SEQ ID NO: 817733 - DNA, 25 bp, Mus musculus
tggcacatcccagacaaggaaattg

SEQ ID NO: 817734 - DNA, 25 bp, Mus musculus
tggcacatcttaaagggccacactc

SEQ ID NO: 817735 - DNA, 25 bp, Mus musculus
tggcacatcttatagggccacactc

SEQ ID NO: 817736 - DNA, 25 bp, Mus musculus
tggcaccagagcagccagcttcact

SEQ ID NO: 817737 - DNA, 25 bp, Mus musculus
tggcaccagagctgccagcttcact

SEQ ID NO: 817738 - DNA, 25 bp, Mus musculus
tggcaccagagtcgtctagcttcgg

SEQ ID NO: 817739 - DNA, 25 bp, Mus musculus
tggcaccagagtggtctagcttcgg

SEQ ID NO: 817740 - DNA, 25 bp, Mus musculus
tggcaccagggaccaagcatgagac

SEQ ID NO: 817741 - DNA, 25 bp, Mus musculus
tggcaccagggagcaagcatgagac

SEQ ID NO: 817742 - DNA, 25 bp, Mus musculus
tggcaccatgaacatctggacttcg

SEQ ID NO: 817743 - DNA, 25 bp, Mus musculus
tggcaccatgaagatctggacttcg

SEQ ID NO: 817744 - DNA, 25 bp, Mus musculus
tggcaccatgttactctccttgagc

SEQ ID NO: 817745 - DNA, 25 bp, Mus musculus
tggcaccatgtttctctccttgagc

SEQ ID NO: 817746 - DNA, 25 bp, Mus musculus
tggcaccattaccaccaaggagctg

SEQ ID NO: 817747 - DNA, 25 bp, Mus musculus
tggcaccattacgaccaaggagctg

SEQ ID NO: 817748 - DNA, 25 bp, Mus musculus
tggcacccagtgatcctggccagac

SEQ ID NO: 817749 - DNA, 25 bp, Mus musculus
tggcacccagtgttcctggccagac

SEQ ID NO: 817750 - DNA, 25 bp, Mus musculus
tggcaccccgttcttatgtctctgg

SEQ ID NO: 817751 - DNA, 25 bp, Mus musculus
tggcaccccgttgttatgtctctgg

SEQ ID NO: 817752 - DNA, 25 bp, Mus musculus
tggcacccctgaaggacctgaggcc

SEQ ID NO: 817753 - DNA, 25 bp, Mus musculus
tggcacccctgatggacctgaggcc

SEQ ID NO: 817754 - DNA, 25 bp, Mus musculus
tggcaccctaatattagttccgtca

SEQ ID NO: 817755 - DNA, 25 bp, Mus musculus
tggcaccctaattttagttccgtca

SEQ ID NO: 817756 - DNA, 25 bp, Mus musculus
tggcaccctgcaaggtggaagaaaa

SEQ ID NO: 817757 - DNA, 25 bp, Mus musculus
tggcaccctgcatggtggaagaaaa

SEQ ID NO: 817758 - DNA, 25 bp, Mus musculus
tggcacctagcaagctgaaaccagg

SEQ ID NO: 817759 - DNA, 25 bp, Mus musculus
tggcacctagcatgctgaaaccagg

SEQ ID NO: 817760 - DNA, 25 bp, Mus musculus
tggcacctatggacaagtctataag

SEQ ID NO: 817761 - DNA, 25 bp, Mus musculus
tggcacctatggtcaagtctataag

SEQ ID NO: 817762 - DNA, 25 bp, Mus musculus
tggcacctccagagtctgcggtctt

SEQ ID NO: 817763 - DNA, 25 bp, Mus musculus
tggcacctccagtgtctgcggtctt

SEQ ID NO: 817764 - DNA, 25 bp, Mus musculus
tggcacctgggaagaatatctggag

SEQ ID NO: 817765 - DNA, 25 bp, Mus musculus
tggcacctgggatgaatatctggag

SEQ ID NO: 817766 - DNA, 25 bp, Mus musculus
tggcacctgggcaactcaccagaag

SEQ ID NO: 817767 - DNA, 25 bp, Mus musculus
tggcacctgggctactcaccagaag

SEQ ID NO: 817768 - DNA, 25 bp, Mus musculus
tggcacctgtctcgacaagattgat

SEQ ID NO: 817769 - DNA, 25 bp, Mus musculus
tggcacctgtctggacaagattgat

SEQ ID NO: 817770 - DNA, 25 bp, Mus musculus
tggcacctgtgacgactacacagat

SEQ ID NO: 817771 - DNA, 25 bp, Mus musculus
tggcacctgtgaggactacacagat

SEQ ID NO: 817772 - DNA, 25 bp, Mus musculus
tggcacgacgccctcagcaggaaaa

SEQ ID NO: 817773 - DNA, 25 bp, Mus musculus
tggcacgacgccgtcagcaggaaaa

SEQ ID NO: 817774 - DNA, 25 bp, Mus musculus
tggcacgagctgatgccagccagct

SEQ ID NO: 817775 - DNA, 25 bp, Mus musculus
tggcacgagctgttgccagccagct

SEQ ID NO: 817776 - DNA, 25 bp, Mus musculus
tggcacgaggttatgaagttctacg

SEQ ID NO: 817777 - DNA, 25 bp, Mus musculus
tggcacgaggttttgaagttctacg

SEQ ID NO: 817778 - DNA, 25 bp, Mus musculus
tggcacgccactaccagtgcacaga

SEQ ID NO: 817779 - DNA, 25 bp, Mus musculus
tggcacgccacttccagtgcacaga

SEQ ID NO: 817780 - DNA, 25 bp, Mus musculus
tggcacgggatactgaaaggacaca

SEQ ID NO: 817781 - DNA, 25 bp, Mus musculus
tggcacgggatagtgaaaggacaca

SEQ ID NO: 817782 - DNA, 25 bp, Mus musculus
tggcacgggcgccatcatcgctatc

SEQ ID NO: 817783 - DNA, 25 bp, Mus musculus
tggcacgggcgcgatcatcgctatc

SEQ ID NO: 817784 - DNA, 25 bp, Mus musculus
tggcacgtcgttatgcccttacatt

SEQ ID NO: 817785 - DNA, 25 bp, Mus musculus
tggcacgtcgttttgcccttacatt

SEQ ID NO: 817786 - DNA, 25 bp, Mus musculus
tggcactcagcacactgacggctgt

SEQ ID NO: 817787 - DNA, 25 bp, Mus musculus
tggcactcagcagactgacggctgt

SEQ ID NO: 817788 - DNA, 25 bp, Mus musculus
tggcactcagtacctggtctacacg

SEQ ID NO: 817789 - DNA, 25 bp, Mus musculus
tggcactcagtagctggtctacacg

SEQ ID NO: 817790 - DNA, 25 bp, Mus musculus
tggcactcctggaacaagtgaacgc

SEQ ID NO: 817791 - DNA, 25 bp, Mus musculus
tggcactcctggtacaagtgaacgc

SEQ ID NO: 817792 - DNA, 25 bp, Mus musculus
tggcactctggtctacactattaag

SEQ ID NO: 817793 - DNA, 25 bp, Mus musculus
tggcactctggtgtacactattaag

SEQ ID NO: 817794 - DNA, 25 bp, Mus musculus
tggcactcttcacagacacaggcta

SEQ ID NO: 817795 - DNA, 25 bp, Mus musculus
tggcactcttcagagacacaggcta

SEQ ID NO: 817796 - DNA, 25 bp, Mus musculus
tggcactgatccacaaccgatcatt

SEQ ID NO: 817797 - DNA, 25 bp, Mus musculus
tggcactgatcctcaaccgatcatt

SEQ ID NO: 817798 - DNA, 25 bp, Mus musculus
tggcactgatggaattggaaaagca

SEQ ID NO: 817799 - DNA, 25 bp, Mus musculus
tggcactgatggtattggaaaagca

SEQ ID NO: 817800 - DNA, 25 bp, Mus musculus
tggcactgccagcacgacgtccgag

SEQ ID NO: 817801 - DNA, 25 bp, Mus musculus
tggcactgccaggacgacgtccgag

SEQ ID NO: 817802 - DNA, 25 bp, Mus musculus
tggcactgcccgagaggccctgagt

SEQ ID NO: 817803 - DNA, 25 bp, Mus musculus
tggcactgcccgtgaggccctgagt

SEQ ID NO: 817804 - DNA, 25 bp, Mus musculus
tggcactgcctgaggtcctggcctg

SEQ ID NO: 817805 - DNA, 25 bp, Mus musculus
tggcactgcctgtggtcctggcctg

SEQ ID NO: 817806 - DNA, 25 bp, Mus musculus
tggcactggacaccctcatgaagtg

SEQ ID NO: 817807 - DNA, 25 bp, Mus musculus
tggcactggacagcctcatgaagtg

SEQ ID NO: 817808 - DNA, 25 bp, Mus musculus
tggcactggggaaaacaggccctga

SEQ ID NO: 817809 - DNA, 25 bp, Mus musculus
tggcactggggataacaggccctga

SEQ ID NO: 817810 - DNA, 25 bp, Mus musculus
tggcacttaagtcacagtgtcccct

SEQ ID NO: 817811 - DNA, 25 bp, Mus musculus
tggcacttaagtgacagtgtcccct

SEQ ID NO: 817812 - DNA, 25 bp, Mus musculus
tggcacttccagctactggctctgg

SEQ ID NO: 817813 - DNA, 25 bp, Mus musculus
tggcacttccaggtactggctctgg

SEQ ID NO: 817814 - DNA, 25 bp, Mus musculus
tggcagaaaacaacatccttgaggc

SEQ ID NO: 817815 - DNA, 25 bp, Mus musculus
tggcagaaaacatcatccttgaggc

SEQ ID NO: 817816 - DNA, 25 bp, Mus musculus
tggcagaaactgaaaccttggcggc

SEQ ID NO: 817817 - DNA, 25 bp, Mus musculus
tggcagaaactgtaaccttggcggc

SEQ ID NO: 817818 - DNA, 25 bp, Mus musculus
tggcagaaaggaaatcatgctcttc

SEQ ID NO: 817819 - DNA, 25 bp, Mus musculus
tggcagaaaggatatcatgctcttc

SEQ ID NO: 817820 - DNA, 25 bp, Mus musculus
tggcagaacagaaaggacacctcct

SEQ ID NO: 817821 - DNA, 25 bp, Mus musculus
tggcagaacagataggacacctcct

SEQ ID NO: 817822 - DNA, 25 bp, Mus musculus
tggcagaacagtccagtctcctggg

SEQ ID NO: 817823 - DNA, 25 bp, Mus musculus
tggcagaacagtgcagtctcctggg

SEQ ID NO: 817824 - DNA, 25 bp, Mus musculus
tggcagaacatcatacctacctgga

SEQ ID NO: 817825 - DNA, 25 bp, Mus musculus
tggcagaacatcttacctacctgga

SEQ ID NO: 817826 - DNA, 25 bp, Mus musculus
tggcagaactgtaccacatccgcct

SEQ ID NO: 817827 - DNA, 25 bp, Mus musculus
tggcagaactgttccacatccgcct

SEQ ID NO: 817828 - DNA, 25 bp, Mus musculus
tggcagaaggcacaggtcactcccc

SEQ ID NO: 817829 - DNA, 25 bp, Mus musculus
tggcagaaggcagaggtcactcccc

SEQ ID NO: 817830 - DNA, 25 bp, Mus musculus
tggcagaatatgaagcacggatcgt

SEQ ID NO: 817831 - DNA, 25 bp, Mus musculus
tggcagaatatgtagcacggatcgt

SEQ ID NO: 817832 - DNA, 25 bp, Mus musculus
tggcagaatgtgagaccctgcggca

SEQ ID NO: 817833 - DNA, 25 bp, Mus musculus
tggcagaatgtgtgaccctgcggca

SEQ ID NO: 817834 - DNA, 25 bp, Mus musculus
tggcagacacagcatgggaatctct

SEQ ID NO: 817835 - DNA, 25 bp, Mus musculus
tggcagacacaggatgggaatctct

SEQ ID NO: 817836 - DNA, 25 bp, Mus musculus
tggcagacgccccaagattgttgtg

SEQ ID NO: 817837 - DNA, 25 bp, Mus musculus
tggcagacgcccgaagattgttgtg

SEQ ID NO: 817838 - DNA, 25 bp, Mus musculus
tggcagacgggacggaattctctct

SEQ ID NO: 817839 - DNA, 25 bp, Mus musculus
tggcagacgggagggaattctctct

SEQ ID NO: 817840 - DNA, 25 bp, Mus musculus
tggcagagaactcctttgccaggaa

SEQ ID NO: 817841 - DNA, 25 bp, Mus musculus
tggcagagaactgctttgccaggaa

SEQ ID NO: 817842 - DNA, 25 bp, Mus musculus
tggcagagaagaaggcttccatcgg

SEQ ID NO: 817843 - DNA, 25 bp, Mus musculus
tggcagagaagatggcttccatcgg

SEQ ID NO: 817844 - DNA, 25 bp, Mus musculus
tggcagagatcacactagccctggg

SEQ ID NO: 817845 - DNA, 25 bp, Mus musculus
tggcagagatcagactagccctggg

SEQ ID NO: 817846 - DNA, 25 bp, Mus musculus
tggcagagatcgacgcgctctacga

SEQ ID NO: 817847 - DNA, 25 bp, Mus musculus
tggcagagatcgtcgcgctctacga

SEQ ID NO: 817848 - DNA, 25 bp, Mus musculus
tggcagagatctatgggcccgacag

SEQ ID NO: 817849 - DNA, 25 bp, Mus musculus
tggcagagatctttgggcccgacag

SEQ ID NO: 817850 - DNA, 25 bp, Mus musculus
tggcagagatgccacctccattaat

SEQ ID NO: 817851 - DNA, 25 bp, Mus musculus
tggcagagatgcgacctccattaat

SEQ ID NO: 817852 - DNA, 25 bp, Mus musculus
tggcagagcacaatgagaagatggt

SEQ ID NO: 817853 - DNA, 25 bp, Mus musculus
tggcagagcacattgagaagatggt

SEQ ID NO: 817854 - DNA, 25 bp, Mus musculus
tggcagagcagtactccccacctga

SEQ ID NO: 817855 - DNA, 25 bp, Mus musculus
tggcagagcagttctccccacctga

SEQ ID NO: 817856 - DNA, 25 bp, Mus musculus
tggcagagccacacgtagtcttgac

SEQ ID NO: 817857 - DNA, 25 bp, Mus musculus
tggcagagccactcgtagtcttgac

SEQ ID NO: 817858 - DNA, 25 bp, Mus musculus
tggcagagcgtcaccgaaacaagta

SEQ ID NO: 817859 - DNA, 25 bp, Mus musculus
tggcagagcgtctccgaaacaagta

SEQ ID NO: 817860 - DNA, 25 bp, Mus musculus
tggcagagctctactaccggaagct

SEQ ID NO: 817861 - DNA, 25 bp, Mus musculus
tggcagagctcttctaccggaagct

SEQ ID NO: 817862 - DNA, 25 bp, Mus musculus
tggcagaggaggagtacctcctaca

SEQ ID NO: 817863 - DNA, 25 bp, Mus musculus
tggcagaggaggtgtacctcctaca

SEQ ID NO: 817864 - DNA, 25 bp, Mus musculus
tggcagaggcatacctgagtccagg

SEQ ID NO: 817865 - DNA, 25 bp, Mus musculus
tggcagaggcattcctgagtccagg

SEQ ID NO: 817866 - DNA, 25 bp, Mus musculus
tggcagagtacacccacagtgcagg

SEQ ID NO: 817867 - DNA, 25 bp, Mus musculus
tggcagagtacacggccaagatcgc

SEQ ID NO: 817868 - DNA, 25 bp, Mus musculus
tggcagagtacagccacagtgcagg

SEQ ID NO: 817869 - DNA, 25 bp, Mus musculus
tggcagagtacagggccaagatcgc

SEQ ID NO: 817870 - DNA, 25 bp, Mus musculus
tggcagagtctgcatctccatcctg

SEQ ID NO: 817871 - DNA, 25 bp, Mus musculus
tggcagagtctggatctccatcctg

SEQ ID NO: 817872 - DNA, 25 bp, Mus musculus
tggcagagtcttatcattccttctc

SEQ ID NO: 817873 - DNA, 25 bp, Mus musculus
tggcagagtcttttcattccttctc

SEQ ID NO: 817874 - DNA, 25 bp, Mus musculus
tggcagagttccagagtacctatgt

SEQ ID NO: 817875 - DNA, 25 bp, Mus musculus
tggcagagttcctgagtacctatgt

SEQ ID NO: 817876 - DNA, 25 bp, Mus musculus
tggcagatacaacaggcctgtttgg

SEQ ID NO: 817877 - DNA, 25 bp, Mus musculus
tggcagatacaagaggcctgtttgg

SEQ ID NO: 817878 - DNA, 25 bp, Mus musculus
tggcagatatggatgagctcttctc

SEQ ID NO: 817879 - DNA, 25 bp, Mus musculus
tggcagatatggttgagctcttctc

SEQ ID NO: 817880 - DNA, 25 bp, Mus musculus
tggcagatccagatgcactatgaga

SEQ ID NO: 817881 - DNA, 25 bp, Mus musculus
tggcagatccagttgcactatgaga

SEQ ID NO: 817882 - DNA, 25 bp, Mus musculus
tggcagatcgctatgggcgccttga

SEQ ID NO: 817883 - DNA, 25 bp, Mus musculus
tggcagatcgctttgggcgccttga

SEQ ID NO: 817884 - DNA, 25 bp, Mus musculus
tggcagatgataacttactggaaga

SEQ ID NO: 817885 - DNA, 25 bp, Mus musculus
tggcagatgatatcttactggaaga

SEQ ID NO: 817886 - DNA, 25 bp, Mus musculus
tggcagatggtaagtggtacaaacc

SEQ ID NO: 817887 - DNA, 25 bp, Mus musculus
tggcagatggtatgtggtacaaacc

SEQ ID NO: 817888 - DNA, 25 bp, Mus musculus
tggcagattgaacgcagggcattct

SEQ ID NO: 817889 - DNA, 25 bp, Mus musculus
tggcagattgaaggcagggcattct

SEQ ID NO: 817890 - DNA, 25 bp, Mus musculus
tggcagatttcaaccatcagcagcg

SEQ ID NO: 817891 - DNA, 25 bp, Mus musculus
tggcagatttcatccatcagcagcg

SEQ ID NO: 817892 - DNA, 25 bp, Mus musculus
tggcagcaaagacccaaactcttcg

SEQ ID NO: 817893 - DNA, 25 bp, Mus musculus
tggcagcaaagacccttcggaagac

SEQ ID NO: 817894 - DNA, 25 bp, Mus musculus
tggcagcaaagagccaaactcttcg

SEQ ID NO: 817895 - DNA, 25 bp, Mus musculus
tggcagcaaagagccttcggaagac

SEQ ID NO: 817896 - DNA, 25 bp, Mus musculus
tggcagcaacaactctcaagactgg

SEQ ID NO: 817897 - DNA, 25 bp, Mus musculus
tggcagcaacaagtctcaagactgg

SEQ ID NO: 817898 - DNA, 25 bp, Mus musculus
tggcagcaaccaatagacccaacag

SEQ ID NO: 817899 - DNA, 25 bp, Mus musculus
tggcagcaaccattagacccaacag

SEQ ID NO: 817900 - DNA, 25 bp, Mus musculus
tggcagcaccacaaacaccatgagc

SEQ ID NO: 817901 - DNA, 25 bp, Mus musculus
tggcagcaccactaacaccatgagc

SEQ ID NO: 817902 - DNA, 25 bp, Mus musculus
tggcagcaccgacagaccaagatgg

SEQ ID NO: 817903 - DNA, 25 bp, Mus musculus
tggcagcaccgagagaccaagatgg

SEQ ID NO: 817904 - DNA, 25 bp, Mus musculus
tggcagcactcaacacttgccacgg

SEQ ID NO: 817905 - DNA, 25 bp, Mus musculus
tggcagcactcatcacttgccacgg

SEQ ID NO: 817906 - DNA, 25 bp, Mus musculus
tggcagcactccaagcattgaggaa

SEQ ID NO: 817907 - DNA, 25 bp, Mus musculus
tggcagcactcctagcattgaggaa

SEQ ID NO: 817908 - DNA, 25 bp, Mus musculus
tggcagcagacaatcaaggcggagc

SEQ ID NO: 817909 - DNA, 25 bp, Mus musculus
tggcagcagacattcaaggcggagc

SEQ ID NO: 817910 - DNA, 25 bp, Mus musculus
tggcagcagcaaatcctattgagtc

SEQ ID NO: 817911 - DNA, 25 bp, Mus musculus
tggcagcagcaattcctattgagtc

SEQ ID NO: 817912 - DNA, 25 bp, Mus musculus
tggcagcagcgtacaagatcctggc

SEQ ID NO: 817913 - DNA, 25 bp, Mus musculus
tggcagcagcgttcaagatcctggc

SEQ ID NO: 817914 - DNA, 25 bp, Mus musculus
tggcagcaggcaattctggaggctc

SEQ ID NO: 817915 - DNA, 25 bp, Mus musculus
tggcagcaggcatttctggaggctc

SEQ ID NO: 817916 - DNA, 25 bp, Mus musculus
tggcagcaggtaaccaatgggtgaa

SEQ ID NO: 817917 - DNA, 25 bp, Mus musculus
tggcagcaggtatccaatgggtgaa

SEQ ID NO: 817918 - DNA, 25 bp, Mus musculus
tggcagcagtagctggctacttgat

SEQ ID NO: 817919 - DNA, 25 bp, Mus musculus
tggcagcagtaggtggctacttgat

SEQ ID NO: 817920 - DNA, 25 bp, Mus musculus
tggcagcagtgactgaagactcccc

SEQ ID NO: 817921 - DNA, 25 bp, Mus musculus
tggcagcagtgagtgaagactcccc

SEQ ID NO: 817922 - DNA, 25 bp, Mus musculus
tggcagcatggaccctgcgtttcac

SEQ ID NO: 817923 - DNA, 25 bp, Mus musculus
tggcagcatggagcctgcgtttcac

SEQ ID NO: 817924 - DNA, 25 bp, Mus musculus
tggcagcatttaaggaactcaagaa

SEQ ID NO: 817925 - DNA, 25 bp, Mus musculus
tggcagcatttatggaactcaagaa

SEQ ID NO: 817926 - DNA, 25 bp, Mus musculus
tggcagccagatatcgggccgtacg

SEQ ID NO: 817927 - DNA, 25 bp, Mus musculus
tggcagccagatttcgggccgtacg

SEQ ID NO: 817928 - DNA, 25 bp, Mus musculus
tggcagccagcgaagcacagataaa

SEQ ID NO: 817929 - DNA, 25 bp, Mus musculus
tggcagccagcgtagcacagataaa

SEQ ID NO: 817930 - DNA, 25 bp, Mus musculus
tggcagccatcaataaaatccgcat

SEQ ID NO: 817931 - DNA, 25 bp, Mus musculus
tggcagccatcattaaaatccgcat

SEQ ID NO: 817932 - DNA, 25 bp, Mus musculus
tggcagccatggagggctatgccct

SEQ ID NO: 817933 - DNA, 25 bp, Mus musculus
tggcagccatggtgggctatgccct

SEQ ID NO: 817934 - DNA, 25 bp, Mus musculus
tggcagcccagccaagtcctgataa

SEQ ID NO: 817935 - DNA, 25 bp, Mus musculus
tggcagcccagcgaagtcctgataa

SEQ ID NO: 817936 - DNA, 25 bp, Mus musculus
tggcagcccctgagatgtagcaggc

SEQ ID NO: 817937 - DNA, 25 bp, Mus musculus
tggcagcccctgtgatgtagcaggc

SEQ ID NO: 817938 - DNA, 25 bp, Mus musculus
tggcagccctacagcccgtccagtt

SEQ ID NO: 817939 - DNA, 25 bp, Mus musculus
tggcagccctactgcccgtccagtt

SEQ ID NO: 817940 - DNA, 25 bp, Mus musculus
tggcagcccttgaaagacgccaggc

SEQ ID NO: 817941 - DNA, 25 bp, Mus musculus
tggcagcccttgtaagacgccaggc

SEQ ID NO: 817942 - DNA, 25 bp, Mus musculus
tggcagccgacacacatcgatggca

SEQ ID NO: 817943 - DNA, 25 bp, Mus musculus
tggcagccgacagacatcgatggca

SEQ ID NO: 817944 - DNA, 25 bp, Mus musculus
tggcagccgccgacttcacaaagga

SEQ ID NO: 817945 - DNA, 25 bp, Mus musculus
tggcagccgccgtcttcacaaagga

SEQ ID NO: 817946 - DNA, 25 bp, Mus musculus
tggcagcctcaaaattccttacaag

SEQ ID NO: 817947 - DNA, 25 bp, Mus musculus
tggcagcctcaatattccttacaag

SEQ ID NO: 817948 - DNA, 25 bp, Mus musculus
tggcagcctcgaacctcatctactt

SEQ ID NO: 817949 - DNA, 25 bp, Mus musculus
tggcagcctcgatcctcatctactt

SEQ ID NO: 817950 - DNA, 25 bp, Mus musculus
tggcagcctgccatgtctggagcgt

SEQ ID NO: 817951 - DNA, 25 bp, Mus musculus
tggcagcctgccttgtctggagcgt

SEQ ID NO: 817952 - DNA, 25 bp, Mus musculus
tggcagcctgcgagggcttccgctt

SEQ ID NO: 817953 - DNA, 25 bp, Mus musculus
tggcagcctgcgtgggcttccgctt

SEQ ID NO: 817954 - DNA, 25 bp, Mus musculus
tggcagcgaaacctacctacgagga

SEQ ID NO: 817955 - DNA, 25 bp, Mus musculus
tggcagcgaaacgtacctacgagga

SEQ ID NO: 817956 - DNA, 25 bp, Mus musculus
tggcagcgagtcactcggaactgag

SEQ ID NO: 817957 - DNA, 25 bp, Mus musculus
tggcagcgagtctctcggaactgag

SEQ ID NO: 817958 - DNA, 25 bp, Mus musculus
tggcagcgcaaacgcacacaggtca

SEQ ID NO: 817959 - DNA, 25 bp, Mus musculus
tggcagcgcaaaggcacacaggtca

SEQ ID NO: 817960 - DNA, 25 bp, Mus musculus
tggcagcgctgtctgagctcatgcc

SEQ ID NO: 817961 - DNA, 25 bp, Mus musculus
tggcagcgctgtgtgagctcatgcc

SEQ ID NO: 817962 - DNA, 25 bp, Mus musculus
tggcagcggcaacctctttgtacag

SEQ ID NO: 817963 - DNA, 25 bp, Mus musculus
tggcagcggcaagctctttgtacag

SEQ ID NO: 817964 - DNA, 25 bp, Mus musculus
tggcagcgtggaaaggaccaagtct

SEQ ID NO: 817965 - DNA, 25 bp, Mus musculus
tggcagcgtggataggaccaagtct

SEQ ID NO: 817966 - DNA, 25 bp, Mus musculus
tggcagctaactcccaagggtcgat

SEQ ID NO: 817967 - DNA, 25 bp, Mus musculus
tggcagctaactgccaagggtcgat

SEQ ID NO: 817968 - DNA, 25 bp, Mus musculus
tggcagctacatcccttaccaagct

SEQ ID NO: 817969 - DNA, 25 bp, Mus musculus
tggcagctacatgccttaccaagct

SEQ ID NO: 817970 - DNA, 25 bp, Mus musculus
tggcagctcagcagcaagagtctgc

SEQ ID NO: 817971 - DNA, 25 bp, Mus musculus
tggcagctcagctgcaagagtctgc

SEQ ID NO: 817972 - DNA, 25 bp, Mus musculus
tggcagctcgagctctggatattcc

SEQ ID NO: 817973 - DNA, 25 bp, Mus musculus
tggcagctcgaggtctggatattcc

SEQ ID NO: 817974 - DNA, 25 bp, Mus musculus
tggcagctgagaacctaagagcaga

SEQ ID NO: 817975 - DNA, 25 bp, Mus musculus
tggcagctgagatcctaagagcaga

SEQ ID NO: 817976 - DNA, 25 bp, Mus musculus
tggcagctgcaaaggagaaccccaa

SEQ ID NO: 817977 - DNA, 25 bp, Mus musculus
tggcagctgcaatggagaaccccaa

SEQ ID NO: 817978 - DNA, 25 bp, Mus musculus
tggcagctgccgacggtgacgattc

SEQ ID NO: 817979 - DNA, 25 bp, Mus musculus
tggcagctgccgtcggtgacgattc

SEQ ID NO: 817980 - DNA, 25 bp, Mus musculus
tggcagctgcgacccttcatgaggc

SEQ ID NO: 817981 - DNA, 25 bp, Mus musculus
tggcagctgcgagccttcatgaggc

SEQ ID NO: 817982 - DNA, 25 bp, Mus musculus
tggcagctggagctcccgaagctct

SEQ ID NO: 817983 - DNA, 25 bp, Mus musculus
tggcagctggaggtcccgaagctct

SEQ ID NO: 817984 - DNA, 25 bp, Mus musculus
tggcagctgggaactacctaacttg

SEQ ID NO: 817985 - DNA, 25 bp, Mus musculus
tggcagctgggatctacctaacttg

SEQ ID NO: 817986 - DNA, 25 bp, Mus musculus
tggcagctgtaactgtggaagacct

SEQ ID NO: 817987 - DNA, 25 bp, Mus musculus
tggcagctgtaagtgtggaagacct

SEQ ID NO: 817988 - DNA, 25 bp, Mus musculus
tggcagctgtgaaactctgccgcct

SEQ ID NO: 817989 - DNA, 25 bp, Mus musculus
tggcagctgtgatactctgccgcct

SEQ ID NO: 817990 - DNA, 25 bp, Mus musculus
tggcagcttataacactgacaaggt

SEQ ID NO: 817991 - DNA, 25 bp, Mus musculus
tggcagcttatatcactgacaaggt

SEQ ID NO: 817992 - DNA, 25 bp, Mus musculus
tggcagcttcctaccggtgcctgag

SEQ ID NO: 817993 - DNA, 25 bp, Mus musculus
tggcagcttccttccggtgcctgag

SEQ ID NO: 817994 - DNA, 25 bp, Mus musculus
tggcagctttgcaacgacatctcgg

SEQ ID NO: 817995 - DNA, 25 bp, Mus musculus
tggcagctttgctacgacatctcgg

SEQ ID NO: 817996 - DNA, 25 bp, Mus musculus
tggcaggaaagcaggatgccctgac

SEQ ID NO: 817997 - DNA, 25 bp, Mus musculus
tggcaggaaagctggatgccctgac

SEQ ID NO: 817998 - DNA, 25 bp, Mus musculus
tggcaggacatgctgtctgagttcc

SEQ ID NO: 817999 - DNA, 25 bp, Mus musculus
tggcaggacatggtgtctgagttcc

SEQ ID NO: 818000 - DNA, 25 bp, Mus musculus
tggcaggaccgtactggccattgac

SEQ ID NO: 818001 - DNA, 25 bp, Mus musculus
tggcaggaccgttctggccattgac

SEQ ID NO: 818002 - DNA, 25 bp, Mus musculus
tggcaggacctgaatgaaggtcaga

SEQ ID NO: 818003 - DNA, 25 bp, Mus musculus
tggcaggacctgtatgaaggtcaga

SEQ ID NO: 818004 - DNA, 25 bp, Mus musculus
tggcaggacgtacttctcacagcat

SEQ ID NO: 818005 - DNA, 25 bp, Mus musculus
tggcaggacgtagttctcacagcat

SEQ ID NO: 818006 - DNA, 25 bp, Mus musculus
tggcaggactcaagatacactccgc

SEQ ID NO: 818007 - DNA, 25 bp, Mus musculus
tggcaggactcatgatacactccgc

SEQ ID NO: 818008 - DNA, 25 bp, Mus musculus
tggcaggagaaaccgcagtctctgt

SEQ ID NO: 818009 - DNA, 25 bp, Mus musculus
tggcaggagaaagcgcagtctctgt

SEQ ID NO: 818010 - DNA, 25 bp, Mus musculus
tggcaggagacaatcgaacagacgt

SEQ ID NO: 818011 - DNA, 25 bp, Mus musculus
tggcaggagacattcgaacagacgt

SEQ ID NO: 818012 - DNA, 25 bp, Mus musculus
tggcaggatccaccctagaaaggat

SEQ ID NO: 818013 - DNA, 25 bp, Mus musculus
tggcaggatccagcctagaaaggat

SEQ ID NO: 818014 - DNA, 25 bp, Mus musculus
tggcaggatcccaggaagcagccct

SEQ ID NO: 818015 - DNA, 25 bp, Mus musculus
tggcaggatccctggaagcagccct

SEQ ID NO: 818016 - DNA, 25 bp, Mus musculus
tggcaggcaacaaagacacagtggc

SEQ ID NO: 818017 - DNA, 25 bp, Mus musculus
tggcaggcaacatagacacagtggc

SEQ ID NO: 818018 - DNA, 25 bp, Mus musculus
tggcaggcagccacgtgagtccaca

SEQ ID NO: 818019 - DNA, 25 bp, Mus musculus
tggcaggcagcctcgtgagtccaca

SEQ ID NO: 818020 - DNA, 25 bp, Mus musculus
tggcaggcagtgaacgagccgactc

SEQ ID NO: 818021 - DNA, 25 bp, Mus musculus
tggcaggcagtgtacgagccgactc

SEQ ID NO: 818022 - DNA, 25 bp, Mus musculus
tggcaggcatcccaggacatcctgg

SEQ ID NO: 818023 - DNA, 25 bp, Mus musculus
tggcaggcatccgaggacatcctgg

SEQ ID NO: 818024 - DNA, 25 bp, Mus musculus
tggcaggccctcagctggtacagat

SEQ ID NO: 818025 - DNA, 25 bp, Mus musculus
tggcaggccctctgctggtacagat

SEQ ID NO: 818026 - DNA, 25 bp, Mus musculus
tggcaggcgaagactcctgcaaggc

SEQ ID NO: 818027 - DNA, 25 bp, Mus musculus
tggcaggcgaagtctcctgcaaggc

SEQ ID NO: 818028 - DNA, 25 bp, Mus musculus
tggcaggcgcgaataattactggga

SEQ ID NO: 818029 - DNA, 25 bp, Mus musculus
tggcaggcgcgattaattactggga

SEQ ID NO: 818030 - DNA, 25 bp, Mus musculus
tggcaggcgctgacagataccactg

SEQ ID NO: 818031 - DNA, 25 bp, Mus musculus
tggcaggcgctgtcagataccactg

SEQ ID NO: 818032 - DNA, 25 bp, Mus musculus
tggcaggctctaagcctctgagaac

SEQ ID NO: 818033 - DNA, 25 bp, Mus musculus
tggcaggctctatgcctctgagaac

SEQ ID NO: 818034 - DNA, 25 bp, Mus musculus
tggcagggcattcttgctctgagcc

SEQ ID NO: 818035 - DNA, 25 bp, Mus musculus
tggcagggcattgttgctctgagcc

SEQ ID NO: 818036 - DNA, 25 bp, Mus musculus
tggcaggtccgcatcctagtacttg

SEQ ID NO: 818037 - DNA, 25 bp, Mus musculus
tggcaggtccgcttcctagtacttg

SEQ ID NO: 818038 - DNA, 25 bp, Mus musculus
tggcaggtgcaacaagaacttccgc

SEQ ID NO: 818039 - DNA, 25 bp, Mus musculus
tggcaggtgcaagaagaacttccgc

SEQ ID NO: 818040 - DNA, 25 bp, Mus musculus
tggcaggtgtacagctctgcccagg

SEQ ID NO: 818041 - DNA, 25 bp, Mus musculus
tggcaggtgtactgctctgcccagg

SEQ ID NO: 818042 - DNA, 25 bp, Mus musculus
tggcagtaccttctcccgattacat

SEQ ID NO: 818043 - DNA, 25 bp, Mus musculus
tggcagtaccttgtcccgattacat

SEQ ID NO: 818044 - DNA, 25 bp, Mus musculus
tggcagtagcccacgaagtcaggct

SEQ ID NO: 818045 - DNA, 25 bp, Mus musculus
tggcagtagccctcgaagtcaggct

SEQ ID NO: 818046 - DNA, 25 bp, Mus musculus
tggcagtcagcactctgcggagctt

SEQ ID NO: 818047 - DNA, 25 bp, Mus musculus
tggcagtcagcagtctgcggagctt

SEQ ID NO: 818048 - DNA, 25 bp, Mus musculus
tggcagtcccagcagcaattgcagc

SEQ ID NO: 818049 - DNA, 25 bp, Mus musculus
tggcagtcccaggagcaattgcagc

SEQ ID NO: 818050 - DNA, 25 bp, Mus musculus
tggcagtccttgatagaagcagcgc

SEQ ID NO: 818051 - DNA, 25 bp, Mus musculus
tggcagtccttgttagaagcagcgc

SEQ ID NO: 818052 - DNA, 25 bp, Mus musculus
tggcagtcgaacagacaaccacctg

SEQ ID NO: 818053 - DNA, 25 bp, Mus musculus
tggcagtcgaactgacaaccacctg

SEQ ID NO: 818054 - DNA, 25 bp, Mus musculus
tggcagtctctacctttctggcgct

SEQ ID NO: 818055 - DNA, 25 bp, Mus musculus
tggcagtctctagctttctggcgct

SEQ ID NO: 818056 - DNA, 25 bp, Mus musculus
tggcagtgaagaagctctttccaac

SEQ ID NO: 818057 - DNA, 25 bp, Mus musculus
tggcagtgaagatgctctttccaac

SEQ ID NO: 818058 - DNA, 25 bp, Mus musculus
tggcagtgaccaaggcactacacgg

SEQ ID NO: 818059 - DNA, 25 bp, Mus musculus
tggcagtgaccatggcactacacgg

SEQ ID NO: 818060 - DNA, 25 bp, Mus musculus
tggcagtgacgtcgtggagcgacaa

SEQ ID NO: 818061 - DNA, 25 bp, Mus musculus
tggcagtgacgtggtggagcgacaa

SEQ ID NO: 818062 - DNA, 25 bp, Mus musculus
tggcagtgagccaccaaacaagcgt

SEQ ID NO: 818063 - DNA, 25 bp, Mus musculus
tggcagtgagcctccaaacaagcgt

SEQ ID NO: 818064 - DNA, 25 bp, Mus musculus
tggcagtgattcacgaagccccgtc

SEQ ID NO: 818065 - DNA, 25 bp, Mus musculus
tggcagtgattctcgaagccccgtc

SEQ ID NO: 818066 - DNA, 25 bp, Mus musculus
tggcagtgcatcagcaaggatggct

SEQ ID NO: 818067 - DNA, 25 bp, Mus musculus
tggcagtgcatctgcaaggatggct

SEQ ID NO: 818068 - DNA, 25 bp, Mus musculus
tggcagtggcaaagacagccgtaaa

SEQ ID NO: 818069 - DNA, 25 bp, Mus musculus
tggcagtggcaatgacagccgtaaa

SEQ ID NO: 818070 - DNA, 25 bp, Mus musculus
tggcagtggctcagcttgtagcctt

SEQ ID NO: 818071 - DNA, 25 bp, Mus musculus
tggcagtggctctgcttgtagcctt

SEQ ID NO: 818072 - DNA, 25 bp, Mus musculus
tggcagtggtcgacagaattgtaca

SEQ ID NO: 818073 - DNA, 25 bp, Mus musculus
tggcagtggtcgtcagaattgtaca

SEQ ID NO: 818074 - DNA, 25 bp, Mus musculus
tggcagtggtgtactatggaaccga

SEQ ID NO: 818075 - DNA, 25 bp, Mus musculus
tggcagtggtgttctatggaaccga

SEQ ID NO: 818076 - DNA, 25 bp, Mus musculus
tggcagtggttgaactgctcttggc

SEQ ID NO: 818077 - DNA, 25 bp, Mus musculus
tggcagtggttgtactgctcttggc

SEQ ID NO: 818078 - DNA, 25 bp, Mus musculus
tggcagtgtgtgcaatgcatcctga

SEQ ID NO: 818079 - DNA, 25 bp, Mus musculus
tggcagtgtgtggaatgcatcctga

SEQ ID NO: 818080 - DNA, 25 bp, Mus musculus
tggcagtgttgccattgccagcaag

SEQ ID NO: 818081 - DNA, 25 bp, Mus musculus
tggcagtgttgcgattgccagcaag

SEQ ID NO: 818082 - DNA, 25 bp, Mus musculus
tggcagtgttttatggcggtctgtc

SEQ ID NO: 818083 - DNA, 25 bp, Mus musculus
tggcagtgttttttggcggtctgtc

SEQ ID NO: 818084 - DNA, 25 bp, Mus musculus
tggcagttaccaccacaaacgcagc

SEQ ID NO: 818085 - DNA, 25 bp, Mus musculus
tggcagttaccagcacaaacgcagc

SEQ ID NO: 818086 - DNA, 25 bp, Mus musculus
tggcagttcaaccaacgtcgacatc

SEQ ID NO: 818087 - DNA, 25 bp, Mus musculus
tggcagttcaacgaacgtcgacatc

SEQ ID NO: 818088 - DNA, 25 bp, Mus musculus
tggcagttggcaacagcagatcgtg

SEQ ID NO: 818089 - DNA, 25 bp, Mus musculus
tggcagttggcatcagcagatcgtg

SEQ ID NO: 818090 - DNA, 25 bp, Mus musculus
tggcagttgtaacaccctccagaag

SEQ ID NO: 818091 - DNA, 25 bp, Mus musculus
tggcagttgtaagaccctccagaag

SEQ ID NO: 818092 - DNA, 25 bp, Mus musculus
tggcagtttcaaaggatgagaaggt

SEQ ID NO: 818093 - DNA, 25 bp, Mus musculus
tggcagtttcaatggatgagaaggt

SEQ ID NO: 818094 - DNA, 25 bp, Mus musculus
tggcataatgccctatcggaagctg

SEQ ID NO: 818095 - DNA, 25 bp, Mus musculus
tggcataatgccgtatcggaagctg

SEQ ID NO: 818096 - DNA, 25 bp, Mus musculus
tggcatacaaggacaggtgccagtg

SEQ ID NO: 818097 - DNA, 25 bp, Mus musculus
tggcatacaaggtcaggtgccagtg

SEQ ID NO: 818098 - DNA, 25 bp, Mus musculus
tggcataccctcctggaggagcctg

SEQ ID NO: 818099 - DNA, 25 bp, Mus musculus
tggcataccctcgtggaggagcctg

SEQ ID NO: 818100 - DNA, 25 bp, Mus musculus
tggcatagaagcaagcaagcggaat

SEQ ID NO: 818101 - DNA, 25 bp, Mus musculus
tggcatagaagctagcaagcggaat

SEQ ID NO: 818102 - DNA, 25 bp, Mus musculus
tggcatagatataactcaacctttg

SEQ ID NO: 818103 - DNA, 25 bp, Mus musculus
tggcatagatattactcaacctttg

SEQ ID NO: 818104 - DNA, 25 bp, Mus musculus
tggcatagccatcgagttcccctgg

SEQ ID NO: 818105 - DNA, 25 bp, Mus musculus
tggcatagccatggagttcccctgg

SEQ ID NO: 818106 - DNA, 25 bp, Mus musculus
tggcatatgaatagtccactgcatt

SEQ ID NO: 818107 - DNA, 25 bp, Mus musculus
tggcatatgaattgtccactgcatt

SEQ ID NO: 818108 - DNA, 25 bp, Mus musculus
tggcatatgcttcccactgcagagg

SEQ ID NO: 818109 - DNA, 25 bp, Mus musculus
tggcatatgcttgccactgcagagg

SEQ ID NO: 818110 - DNA, 25 bp, Mus musculus
tggcatattatgagtttctgaaagt

SEQ ID NO: 818111 - DNA, 25 bp, Mus musculus
tggcatattatgtgtttctgaaagt

SEQ ID NO: 818112 - DNA, 25 bp, Mus musculus
tggcatcaacacagtcaacttcagg

SEQ ID NO: 818113 - DNA, 25 bp, Mus musculus
tggcatcaacactgtcaacttcagg

SEQ ID NO: 818114 - DNA, 25 bp, Mus musculus
tggcatcaccaacagtcagctcaag

SEQ ID NO: 818115 - DNA, 25 bp, Mus musculus
tggcatcaccaagagtcagctcaag

SEQ ID NO: 818116 - DNA, 25 bp, Mus musculus
tggcatcacgagagggcagttcact

SEQ ID NO: 818117 - DNA, 25 bp, Mus musculus
tggcatcacgagtgggcagttcact

SEQ ID NO: 818118 - DNA, 25 bp, Mus musculus
tggcatcactcaccgtccttcagaa

SEQ ID NO: 818119 - DNA, 25 bp, Mus musculus
tggcatcactcagcgtccttcagaa

SEQ ID NO: 818120 - DNA, 25 bp, Mus musculus
tggcatcagaaaagggtcttatgac

SEQ ID NO: 818121 - DNA, 25 bp, Mus musculus
tggcatcagaaatgggtcttatgac

SEQ ID NO: 818122 - DNA, 25 bp, Mus musculus
tggcatcagattactgttacgaatg

SEQ ID NO: 818123 - DNA, 25 bp, Mus musculus
tggcatcagatttctgttacgaatg

SEQ ID NO: 818124 - DNA, 25 bp, Mus musculus
tggcatcaggaacaggagtgtcacc

SEQ ID NO: 818125 - DNA, 25 bp, Mus musculus
tggcatcaggaagaggagtgtcacc

SEQ ID NO: 818126 - DNA, 25 bp, Mus musculus
tggcatcatattaaccctgcttggg

SEQ ID NO: 818127 - DNA, 25 bp, Mus musculus
tggcatcatatttaccctgcttggg

SEQ ID NO: 818128 - DNA, 25 bp, Mus musculus
tggcatccacatccagcacattgca

SEQ ID NO: 818129 - DNA, 25 bp, Mus musculus
tggcatccacatgcagcacattgca

SEQ ID NO: 818130 - DNA, 25 bp, Mus musculus
tggcatccatgaccaaggccacgga

SEQ ID NO: 818131 - DNA, 25 bp, Mus musculus
tggcatccatgagcaaggccacgga

SEQ ID NO: 818132 - DNA, 25 bp, Mus musculus
tggcatcccaacaatgttttgctgg

SEQ ID NO: 818133 - DNA, 25 bp, Mus musculus
tggcatcccaactatgttttgctgg

SEQ ID NO: 818134 - DNA, 25 bp, Mus musculus
tggcatccgacacatacgagcagat

SEQ ID NO: 818135 - DNA, 25 bp, Mus musculus
tggcatccgacagatacgagcagat

SEQ ID NO: 818136 - DNA, 25 bp, Mus musculus
tggcatcctcacacttggaatctcc

SEQ ID NO: 818137 - DNA, 25 bp, Mus musculus
tggcatcctcactcttggaatctcc

SEQ ID NO: 818138 - DNA, 25 bp, Mus musculus
tggcatcctggcctatgtctattat

SEQ ID NO: 818139 - DNA, 25 bp, Mus musculus
tggcatcctggcgtatgtctattat

SEQ ID NO: 818140 - DNA, 25 bp, Mus musculus
tggcatccttaaccaagccatagac

SEQ ID NO: 818141 - DNA, 25 bp, Mus musculus
tggcatccttaagcaagccatagac

SEQ ID NO: 818142 - DNA, 25 bp, Mus musculus
tggcatcgacgtagacaaatgggat

SEQ ID NO: 818143 - DNA, 25 bp, Mus musculus
tggcatcgacgttgacaaatgggat

SEQ ID NO: 818144 - DNA, 25 bp, Mus musculus
tggcatcgcaggacaagacctcaat

SEQ ID NO: 818145 - DNA, 25 bp, Mus musculus
tggcatcgcaggtcaagacctcaat

SEQ ID NO: 818146 - DNA, 25 bp, Mus musculus
tggcatcgccttagaccacatgaag

SEQ ID NO: 818147 - DNA, 25 bp, Mus musculus
tggcatcgcctttgaccacatgaag

SEQ ID NO: 818148 - DNA, 25 bp, Mus musculus
tggcatcgtagaaacccacttcacc

SEQ ID NO: 818149 - DNA, 25 bp, Mus musculus
tggcatcgtagatacccacttcacc

SEQ ID NO: 818150 - DNA, 25 bp, Mus musculus
tggcatcgtgatctacgcacctgcg

SEQ ID NO: 818151 - DNA, 25 bp, Mus musculus
tggcatcgtgatgtacgcacctgcg

SEQ ID NO: 818152 - DNA, 25 bp, Mus musculus
tggcatctacttacccaaacaagta

SEQ ID NO: 818153 - DNA, 25 bp, Mus musculus
tggcatctactttcccaaacaagta

SEQ ID NO: 818154 - DNA, 25 bp, Mus musculus
tggcatctatgaactcaggcgaatg

SEQ ID NO: 818155 - DNA, 25 bp, Mus musculus
tggcatctatgatctcaggcgaatg

SEQ ID NO: 818156 - DNA, 25 bp, Mus musculus
tggcatctctctcacctgtgctatt

SEQ ID NO: 818157 - DNA, 25 bp, Mus musculus
tggcatctctctgacctgtgctatt

SEQ ID NO: 818158 - DNA, 25 bp, Mus musculus
tggcatctggatacaaacacgtggt

SEQ ID NO: 818159 - DNA, 25 bp, Mus musculus
tggcatctggattcaaacacgtggt

SEQ ID NO: 818160 - DNA, 25 bp, Mus musculus
tggcatctgtagagacagaccgtgg

SEQ ID NO: 818161 - DNA, 25 bp, Mus musculus
tggcatctgtagtgacagaccgtgg

SEQ ID NO: 818162 - DNA, 25 bp, Mus musculus
tggcatcttcatcagctccagaggt

SEQ ID NO: 818163 - DNA, 25 bp, Mus musculus
tggcatcttcatgagctccagaggt

SEQ ID NO: 818164 - DNA, 25 bp, Mus musculus
tggcatgaatgcatacatggcatat

SEQ ID NO: 818165 - DNA, 25 bp, Mus musculus
tggcatgaatgcttacatggcatat

SEQ ID NO: 818166 - DNA, 25 bp, Mus musculus
tggcatgcactaactcgagaagagc

SEQ ID NO: 818167 - DNA, 25 bp, Mus musculus
tggcatgcactatctcgagaagagc

SEQ ID NO: 818168 - DNA, 25 bp, Mus musculus
tggcatgccgacaacatccgtggta

SEQ ID NO: 818169 - DNA, 25 bp, Mus musculus
tggcatgccgactacatccgtggta

SEQ ID NO: 818170 - DNA, 25 bp, Mus musculus
tggcatgcctgcagaggtgctctgc

SEQ ID NO: 818171 - DNA, 25 bp, Mus musculus
tggcatgcctgctgaggtgctctgc

SEQ ID NO: 818172 - DNA, 25 bp, Mus musculus
tggcatgcgcatacacatttctctt

SEQ ID NO: 818173 - DNA, 25 bp, Mus musculus
tggcatgcgcattcacatttctctt

SEQ ID NO: 818174 - DNA, 25 bp, Mus musculus
tggcatgctgggacacagtgaagct

SEQ ID NO: 818175 - DNA, 25 bp, Mus musculus
tggcatgctgggtcacagtgaagct

SEQ ID NO: 818176 - DNA, 25 bp, Mus musculus
tggcatgctgtaccctcacagagac

SEQ ID NO: 818177 - DNA, 25 bp, Mus musculus
tggcatgctgtagcctcacagagac

SEQ ID NO: 818178 - DNA, 25 bp, Mus musculus
tggcatggcagcatacgggccttcg

SEQ ID NO: 818179 - DNA, 25 bp, Mus musculus
tggcatggcagcttacgggccttcg

SEQ ID NO: 818180 - DNA, 25 bp, Mus musculus
tggcatgtacaaagagactgtctac

SEQ ID NO: 818181 - DNA, 25 bp, Mus musculus
tggcatgtacaatgagactgtctac

SEQ ID NO: 818182 - DNA, 25 bp, Mus musculus
tggcatgtagtacccacaacccaga

SEQ ID NO: 818183 - DNA, 25 bp, Mus musculus
tggcatgtagtagccacaacccaga

SEQ ID NO: 818184 - DNA, 25 bp, Mus musculus
tggcatgtatgaaaaaattcttctc

SEQ ID NO: 818185 - DNA, 25 bp, Mus musculus
tggcatgtatgataaaattcttctc

SEQ ID NO: 818186 - DNA, 25 bp, Mus musculus
tggcatgtattgcatgttgttcctg

SEQ ID NO: 818187 - DNA, 25 bp, Mus musculus
tggcatgtattggatgttgttcctg

SEQ ID NO: 818188 - DNA, 25 bp, Mus musculus
tggcatgttgtaactcgagagcaag

SEQ ID NO: 818189 - DNA, 25 bp, Mus musculus
tggcatgttgtatctcgagagcaag

SEQ ID NO: 818190 - DNA, 25 bp, Mus musculus
tggcattagagcagggtgtgtcccc

SEQ ID NO: 818191 - DNA, 25 bp, Mus musculus
tggcattagagctgggtgtgtcccc

SEQ ID NO: 818192 - DNA, 25 bp, Mus musculus
tggcattccagtccccaagtacttg

SEQ ID NO: 818193 - DNA, 25 bp, Mus musculus
tggcattccagtgcccaagtacttg

SEQ ID NO: 818194 - DNA, 25 bp, Mus musculus
tggcattccgggagccaaccccaaa

SEQ ID NO: 818195 - DNA, 25 bp, Mus musculus
tggcattccgggtgccaaccccaaa

SEQ ID NO: 818196 - DNA, 25 bp, Mus musculus
tggcattccggtcgaggagctcttc

SEQ ID NO: 818197 - DNA, 25 bp, Mus musculus
tggcattccggtggaggagctcttc

SEQ ID NO: 818198 - DNA, 25 bp, Mus musculus
tggcattcctatagctgtgcctacg

SEQ ID NO: 818199 - DNA, 25 bp, Mus musculus
tggcattcctattgctgtgcctacg

SEQ ID NO: 818200 - DNA, 25 bp, Mus musculus
tggcattcctctatgaactcactga

SEQ ID NO: 818201 - DNA, 25 bp, Mus musculus
tggcattcctctttgaactcactga

SEQ ID NO: 818202 - DNA, 25 bp, Mus musculus
tggcattcctggactcccaggccgg

SEQ ID NO: 818203 - DNA, 25 bp, Mus musculus
tggcattcctggtctcccaggccgg

SEQ ID NO: 818204 - DNA, 25 bp, Mus musculus
tggcattccttcaaacaggattatt

SEQ ID NO: 818205 - DNA, 25 bp, Mus musculus
tggcattccttctaacaggattatt

SEQ ID NO: 818206 - DNA, 25 bp, Mus musculus
tggcattcgccgaagtctagagcct

SEQ ID NO: 818207 - DNA, 25 bp, Mus musculus
tggcattcgccgtagtctagagcct

SEQ ID NO: 818208 - DNA, 25 bp, Mus musculus
tggcattctgtgctcatccagagac

SEQ ID NO: 818209 - DNA, 25 bp, Mus musculus
tggcattctgtggtcatccagagac

SEQ ID NO: 818210 - DNA, 25 bp, Mus musculus
tggcattgacccatgagtgagtact

SEQ ID NO: 818211 - DNA, 25 bp, Mus musculus
tggcattgacccttgagtgagtact

SEQ ID NO: 818212 - DNA, 25 bp, Mus musculus
tggcattgaggcagatgacaacccc

SEQ ID NO: 818213 - DNA, 25 bp, Mus musculus
tggcattgaggctgatgacaacccc

SEQ ID NO: 818214 - DNA, 25 bp, Mus musculus
tggcattgccggctctcatttcgct

SEQ ID NO: 818215 - DNA, 25 bp, Mus musculus
tggcattgccgggtctcatttcgct

SEQ ID NO: 818216 - DNA, 25 bp, Mus musculus
tggcattgctcgagtgcctcttgct

SEQ ID NO: 818217 - DNA, 25 bp, Mus musculus
tggcattgctcgtgtgcctcttgct

SEQ ID NO: 818218 - DNA, 25 bp, Mus musculus
tggcattgctgaagtactcgctgcc

SEQ ID NO: 818219 - DNA, 25 bp, Mus musculus
tggcattgctgatgtactcgctgcc

SEQ ID NO: 818220 - DNA, 25 bp, Mus musculus
tggcattgcttaagcaggaactggc

SEQ ID NO: 818221 - DNA, 25 bp, Mus musculus
tggcattgcttatgcaggaactggc

SEQ ID NO: 818222 - DNA, 25 bp, Mus musculus
tggcattggcttcgcatctaatggg

SEQ ID NO: 818223 - DNA, 25 bp, Mus musculus
tggcattggcttggcatctaatggg

SEQ ID NO: 818224 - DNA, 25 bp, Mus musculus
tggcattgtccactacaacgactgg

SEQ ID NO: 818225 - DNA, 25 bp, Mus musculus
tggcattgtccagtacaacgactgg

SEQ ID NO: 818226 - DNA, 25 bp, Mus musculus
tggcattgtgcaccccattctttag

SEQ ID NO: 818227 - DNA, 25 bp, Mus musculus
tggcattgtgcagcccattctttag

SEQ ID NO: 818228 - DNA, 25 bp, Mus musculus
tggcattgtggcaggtaacagctct

SEQ ID NO: 818229 - DNA, 25 bp, Mus musculus
tggcattgtggccttctttaccagc

SEQ ID NO: 818230 - DNA, 25 bp, Mus musculus
tggcattgtggcgttctttaccagc

SEQ ID NO: 818231 - DNA, 25 bp, Mus musculus
tggcattgtggctggtaacagctct

SEQ ID NO: 818232 - DNA, 25 bp, Mus musculus
tggcatttacctcaagttgcaaata

SEQ ID NO: 818233 - DNA, 25 bp, Mus musculus
tggcatttacctgaagttgcaaata

SEQ ID NO: 818234 - DNA, 25 bp, Mus musculus
tggcatttattgctacagatggagc

SEQ ID NO: 818235 - DNA, 25 bp, Mus musculus
tggcatttattggtacagatggagc

SEQ ID NO: 818236 - DNA, 25 bp, Mus musculus
tggcatttcgtcctgagcgcagccc

SEQ ID NO: 818237 - DNA, 25 bp, Mus musculus
tggcatttcgtcgtgagcgcagccc

SEQ ID NO: 818238 - DNA, 25 bp, Mus musculus
tggcatttgcaaatcatcagactgc

SEQ ID NO: 818239 - DNA, 25 bp, Mus musculus
tggcatttgcaattcatcagactgc

SEQ ID NO: 818240 - DNA, 25 bp, Mus musculus
tggccaaaacggagagtaaggaaag

SEQ ID NO: 818241 - DNA, 25 bp, Mus musculus
tggccaaaacggtgagtaaggaaag

SEQ ID NO: 818242 - DNA, 25 bp, Mus musculus
tggccaaaagtgattccactaccaa

SEQ ID NO: 818243 - DNA, 25 bp, Mus musculus
tggccaaaagtgtttccactaccaa

SEQ ID NO: 818244 - DNA, 25 bp, Mus musculus
tggccaaacgtacacaagtatgagc

SEQ ID NO: 818245 - DNA, 25 bp, Mus musculus
tggccaaacgtagacaagtatgagc

SEQ ID NO: 818246 - DNA, 25 bp, Mus musculus
tggccaaagccaatggcctggagat

SEQ ID NO: 818247 - DNA, 25 bp, Mus musculus
tggccaaagccattggcctggagat

SEQ ID NO: 818248 - DNA, 25 bp, Mus musculus
tggccaaagccgaggcaacagaagc

SEQ ID NO: 818249 - DNA, 25 bp, Mus musculus
tggccaaagccgtggcaacagaagc

SEQ ID NO: 818250 - DNA, 25 bp, Mus musculus
tggccaaagcgtcctgccctgtgct

SEQ ID NO: 818251 - DNA, 25 bp, Mus musculus
tggccaaagcgtgctgccctgtgct

SEQ ID NO: 818252 - DNA, 25 bp, Mus musculus
tggccaaagctgaccccagatgcat

SEQ ID NO: 818253 - DNA, 25 bp, Mus musculus
tggccaaagctgtccccagatgcat

SEQ ID NO: 818254 - DNA, 25 bp, Mus musculus
tggccaaagtggagtatgtcaggaa

SEQ ID NO: 818255 - DNA, 25 bp, Mus musculus
tggccaaagtggtgtatgtcaggaa

SEQ ID NO: 818256 - DNA, 25 bp, Mus musculus
tggccaaccgcaaagataaagcatc

SEQ ID NO: 818257 - DNA, 25 bp, Mus musculus
tggccaaccgcatagataaagcatc

SEQ ID NO: 818258 - DNA, 25 bp, Mus musculus
tggccaacgcccagcaggtccagat

SEQ ID NO: 818259 - DNA, 25 bp, Mus musculus
tggccaacgccctgcaggtccagat

SEQ ID NO: 818260 - DNA, 25 bp, Mus musculus
tggccaactcagagtccacgctgat

SEQ ID NO: 818261 - DNA, 25 bp, Mus musculus
tggccaactcagtgtccacgctgat

SEQ ID NO: 818262 - DNA, 25 bp, Mus musculus
tggccaagaagtactttgctcagat

SEQ ID NO: 818263 - DNA, 25 bp, Mus musculus
tggccaagaagttctttgctcagat

SEQ ID NO: 818264 - DNA, 25 bp, Mus musculus
tggccaagaccgaggcgtatttcta

SEQ ID NO: 818265 - DNA, 25 bp, Mus musculus
tggccaagaccgtggcgtatttcta

SEQ ID NO: 818266 - DNA, 25 bp, Mus musculus
tggccaagcagacgtaagtctttgc

SEQ ID NO: 818267 - DNA, 25 bp, Mus musculus
tggccaagcagaggtaagtctttgc

SEQ ID NO: 818268 - DNA, 25 bp, Mus musculus
tggccaagccaacccacggtgatat

SEQ ID NO: 818269 - DNA, 25 bp, Mus musculus
tggccaagccaagccacggtgatat

SEQ ID NO: 818270 - DNA, 25 bp, Mus musculus
tggccaagccgactcacttagagct

SEQ ID NO: 818271 - DNA, 25 bp, Mus musculus
tggccaagccgagtcacttagagct

SEQ ID NO: 818272 - DNA, 25 bp, Mus musculus
tggccaagcctgcttcttactcggc

SEQ ID NO: 818273 - DNA, 25 bp, Mus musculus
tggccaagcctggttcttactcggc

SEQ ID NO: 818274 - DNA, 25 bp, Mus musculus
tggccaagcgaccaggagtcaagct

SEQ ID NO: 818275 - DNA, 25 bp, Mus musculus
tggccaagcgacgaggagtcaagct

SEQ ID NO: 818276 - DNA, 25 bp, Mus musculus
tggccaagcgcgcagatttcgtcgc

SEQ ID NO: 818277 - DNA, 25 bp, Mus musculus
tggccaagcgcggagatttcgtcgc

SEQ ID NO: 818278 - DNA, 25 bp, Mus musculus
tggccaagctaacgaaaccattccc

SEQ ID NO: 818279 - DNA, 25 bp, Mus musculus
tggccaagctaaggaaaccattccc

SEQ ID NO: 818280 - DNA, 25 bp, Mus musculus
tggccaagctgcagaacaacttttc

SEQ ID NO: 818281 - DNA, 25 bp, Mus musculus
tggccaagctgctgaacaacttttc

SEQ ID NO: 818282 - DNA, 25 bp, Mus musculus
tggccaagctgtacatgaacacgca

SEQ ID NO: 818283 - DNA, 25 bp, Mus musculus
tggccaagctgttcatgaacacgca

SEQ ID NO: 818284 - DNA, 25 bp, Mus musculus
tggccaaggacaagcggagctgcct

SEQ ID NO: 818285 - DNA, 25 bp, Mus musculus
tggccaaggacatgcggagctgcct

SEQ ID NO: 818286 - DNA, 25 bp, Mus musculus
tggccaaggagcagcgactcaactt

SEQ ID NO: 818287 - DNA, 25 bp, Mus musculus
tggccaaggagctgcgactcaactt

SEQ ID NO: 818288 - DNA, 25 bp, Mus musculus
tggccaaggagtacatcgaccctga

SEQ ID NO: 818289 - DNA, 25 bp, Mus musculus
tggccaaggagtcgtgcttcaaacc

SEQ ID NO: 818290 - DNA, 25 bp, Mus musculus
tggccaaggagtggtgcttcaaacc

SEQ ID NO: 818291 - DNA, 25 bp, Mus musculus
tggccaaggagttcatcgaccctga

SEQ ID NO: 818292 - DNA, 25 bp, Mus musculus
tggccaaggataaagtcagtctgac

SEQ ID NO: 818293 - DNA, 25 bp, Mus musculus
tggccaaggatatagtcagtctgac

SEQ ID NO: 818294 - DNA, 25 bp, Mus musculus
tggccaaggccaaccgggaatggta

SEQ ID NO: 818295 - DNA, 25 bp, Mus musculus
tggccaaggccatccgggaatggta

SEQ ID NO: 818296 - DNA, 25 bp, Mus musculus
tggccaagtcacaccagaagatagg

SEQ ID NO: 818297 - DNA, 25 bp, Mus musculus
tggccaagtcactccagaagatagg

SEQ ID NO: 818298 - DNA, 25 bp, Mus musculus
tggccaagttgtacgtgaagctcaa

SEQ ID NO: 818299 - DNA, 25 bp, Mus musculus
tggccaagttgttcgtgaagctcaa

SEQ ID NO: 818300 - DNA, 25 bp, Mus musculus
tggccaataatgagaccggcgtcat

SEQ ID NO: 818301 - DNA, 25 bp, Mus musculus
tggccaataatgtgaccggcgtcat

SEQ ID NO: 818302 - DNA, 25 bp, Mus musculus
tggccaatacgacagggctgtgacc

SEQ ID NO: 818303 - DNA, 25 bp, Mus musculus
tggccaatacgagagggctgtgacc

SEQ ID NO: 818304 - DNA, 25 bp, Mus musculus
tggccaatcctgatcctgatggctc

SEQ ID NO: 818305 - DNA, 25 bp, Mus musculus
tggccaatcctgttcctgatggctc

SEQ ID NO: 818306 - DNA, 25 bp, Mus musculus
tggccaatcgggaattttctccaaa

SEQ ID NO: 818307 - DNA, 25 bp, Mus musculus
tggccaatcgggtattttctccaaa

SEQ ID NO: 818308 - DNA, 25 bp, Mus musculus
tggccaatgaggagtctgaacacaa

SEQ ID NO: 818309 - DNA, 25 bp, Mus musculus
tggccaatgaggtgtctgaacacaa

SEQ ID NO: 818310 - DNA, 25 bp, Mus musculus
tggccaatggatctgtgatgtctcg

SEQ ID NO: 818311 - DNA, 25 bp, Mus musculus
tggccaatggatgtgtgatgtctcg

SEQ ID NO: 818312 - DNA, 25 bp, Mus musculus
tggccacaagagctctgtgtgccat

SEQ ID NO: 818313 - DNA, 25 bp, Mus musculus
tggccacaagaggtctgtgtgccat

SEQ ID NO: 818314 - DNA, 25 bp, Mus musculus
tggccacaaggcagcagtgtatata

SEQ ID NO: 818315 - DNA, 25 bp, Mus musculus
tggccacaaggctgcagtgtatata

SEQ ID NO: 818316 - DNA, 25 bp, Mus musculus
tggccacaatttcgagtaggagctg

SEQ ID NO: 818317 - DNA, 25 bp, Mus musculus
tggccacaatttggagtaggagctg

SEQ ID NO: 818318 - DNA, 25 bp, Mus musculus
tggccacacaggcagccctattgtt

SEQ ID NO: 818319 - DNA, 25 bp, Mus musculus
tggccacacagggagccctattgtt

SEQ ID NO: 818320 - DNA, 25 bp, Mus musculus
tggccacactagctgctggtgaagc

SEQ ID NO: 818321 - DNA, 25 bp, Mus musculus
tggccacactaggtgctggtgaagc

SEQ ID NO: 818322 - DNA, 25 bp, Mus musculus
tggccacactcaccgggaggatcca

SEQ ID NO: 818323 - DNA, 25 bp, Mus musculus
tggccacactcagcgggaggatcca

SEQ ID NO: 818324 - DNA, 25 bp, Mus musculus
tggccacagactacatgcagcaggt

SEQ ID NO: 818325 - DNA, 25 bp, Mus musculus
tggccacagactagcagaaccgagt

SEQ ID NO: 818326 - DNA, 25 bp, Mus musculus
tggccacagacttcatgcagcaggt

SEQ ID NO: 818327 - DNA, 25 bp, Mus musculus
tggccacagacttgcagaaccgagt

SEQ ID NO: 818328 - DNA, 25 bp, Mus musculus
tggccacagagccacctacggagac

SEQ ID NO: 818329 - DNA, 25 bp, Mus musculus
tggccacagagcgacctacggagac

SEQ ID NO: 818330 - DNA, 25 bp, Mus musculus
tggccacagcatctctctctagtag

SEQ ID NO: 818331 - DNA, 25 bp, Mus musculus
tggccacagcatgtctctctagtag

SEQ ID NO: 818332 - DNA, 25 bp, Mus musculus
tggccacagcttcctaaccaaagag

SEQ ID NO: 818333 - DNA, 25 bp, Mus musculus
tggccacagcttgctaaccaaagag

SEQ ID NO: 818334 - DNA, 25 bp, Mus musculus
tggccacagggaactgtgtttgttt

SEQ ID NO: 818335 - DNA, 25 bp, Mus musculus
tggccacagggatctgtgtttgttt

SEQ ID NO: 818336 - DNA, 25 bp, Mus musculus
tggccacaggtcacaacgatgggca

SEQ ID NO: 818337 - DNA, 25 bp, Mus musculus
tggccacaggtctcaacgatgggca

SEQ ID NO: 818338 - DNA, 25 bp, Mus musculus
tggccacatccaaccaacatggtgg

SEQ ID NO: 818339 - DNA, 25 bp, Mus musculus
tggccacatccatccaacatggtgg

SEQ ID NO: 818340 - DNA, 25 bp, Mus musculus
tggccacattatcaggaactcaccc

SEQ ID NO: 818341 - DNA, 25 bp, Mus musculus
tggccacattatgaggaactcaccc

SEQ ID NO: 818342 - DNA, 25 bp, Mus musculus
tggccacatttaaggagataatctg

SEQ ID NO: 818343 - DNA, 25 bp, Mus musculus
tggccacatttatggagataatctg

SEQ ID NO: 818344 - DNA, 25 bp, Mus musculus
tggccaccaactcatctgccgagag

SEQ ID NO: 818345 - DNA, 25 bp, Mus musculus
tggccaccaactgatctgccgagag

SEQ ID NO: 818346 - DNA, 25 bp, Mus musculus
tggccaccacagagacgctggaaaa

SEQ ID NO: 818347 - DNA, 25 bp, Mus musculus
tggccaccacagtgacgctggaaaa

SEQ ID NO: 818348 - DNA, 25 bp, Mus musculus
tggccaccacatacttgcaaacgtc

SEQ ID NO: 818349 - DNA, 25 bp, Mus musculus
tggccaccacattcttgcaaacgtc

SEQ ID NO: 818350 - DNA, 25 bp, Mus musculus
tggccaccagaacaaacttctgcac

SEQ ID NO: 818351 - DNA, 25 bp, Mus musculus
tggccaccagaagaaacttctgcac

SEQ ID NO: 818352 - DNA, 25 bp, Mus musculus
tggccaccagcccaatcatcaaata

SEQ ID NO: 818353 - DNA, 25 bp, Mus musculus
tggccaccagccgaatcatcaaata

SEQ ID NO: 818354 - DNA, 25 bp, Mus musculus
tggccacccagtactttgctgatag

SEQ ID NO: 818355 - DNA, 25 bp, Mus musculus
tggccacccagttctttgctgatag

SEQ ID NO: 818356 - DNA, 25 bp, Mus musculus
tggccaccctacagatcatcaatga

SEQ ID NO: 818357 - DNA, 25 bp, Mus musculus
tggccaccctactgatcatcaatga

SEQ ID NO: 818358 - DNA, 25 bp, Mus musculus
tggccaccctctataatgttctaag

SEQ ID NO: 818359 - DNA, 25 bp, Mus musculus
tggccaccctctttaatgttctaag

SEQ ID NO: 818360 - DNA, 25 bp, Mus musculus
tggccaccgtgaccccgattgtgga

SEQ ID NO: 818361 - DNA, 25 bp, Mus musculus
tggccaccgtgagcccgattgtgga

SEQ ID NO: 818362 - DNA, 25 bp, Mus musculus
tggccaccgtttccagcctgcaggg

SEQ ID NO: 818363 - DNA, 25 bp, Mus musculus
tggccaccgtttgcagcctgcaggg

SEQ ID NO: 818364 - DNA, 25 bp, Mus musculus
tggccacctatgaggtgcagctgct

SEQ ID NO: 818365 - DNA, 25 bp, Mus musculus
tggccacctatgtggtgcagctgct

SEQ ID NO: 818366 - DNA, 25 bp, Mus musculus
tggccacctcgaatccagtgtcaga

SEQ ID NO: 818367 - DNA, 25 bp, Mus musculus
tggccacctcgattccagtgtcaga

SEQ ID NO: 818368 - DNA, 25 bp, Mus musculus
tggccacctgcccacctgatgaatt

SEQ ID NO: 818369 - DNA, 25 bp, Mus musculus
tggccacctgccgacctgatgaatt

SEQ ID NO: 818370 - DNA, 25 bp, Mus musculus
tggccacctgctatccctggataac

SEQ ID NO: 818371 - DNA, 25 bp, Mus musculus
tggccacctgctttccctggataac

SEQ ID NO: 818372 - DNA, 25 bp, Mus musculus
tggccacgcggaagagtatgttgtt

SEQ ID NO: 818373 - DNA, 25 bp, Mus musculus
tggccacgcggatgagtatgttgtt

SEQ ID NO: 818374 - DNA, 25 bp, Mus musculus
tggccacggataacaacagacagaa

SEQ ID NO: 818375 - DNA, 25 bp, Mus musculus
tggccacggatatcaacagacagaa

SEQ ID NO: 818376 - DNA, 25 bp, Mus musculus
tggccacggtcaaggccaacatcac

SEQ ID NO: 818377 - DNA, 25 bp, Mus musculus
tggccacggtcatggccaacatcac

SEQ ID NO: 818378 - DNA, 25 bp, Mus musculus
tggccacgtggaaggacaagtctca

SEQ ID NO: 818379 - DNA, 25 bp, Mus musculus
tggccacgtggatggacaagtctca

SEQ ID NO: 818380 - DNA, 25 bp, Mus musculus
tggccactaatgctgcagtcactgt

SEQ ID NO: 818381 - DNA, 25 bp, Mus musculus
tggccactaatggtgcagtcactgt

SEQ ID NO: 818382 - DNA, 25 bp, Mus musculus
tggccactccaaacaaagctgaaat

SEQ ID NO: 818383 - DNA, 25 bp, Mus musculus
tggccactccaatcaaagctgaaat

SEQ ID NO: 818384 - DNA, 25 bp, Mus musculus
tggccactgaagctgatgccaaggc

SEQ ID NO: 818385 - DNA, 25 bp, Mus musculus
tggccactgaaggtgatgccaaggc

SEQ ID NO: 818386 - DNA, 25 bp, Mus musculus
tggccactgatgagatgcggccccg

SEQ ID NO: 818387 - DNA, 25 bp, Mus musculus
tggccactgatgtgatgcggccccg

SEQ ID NO: 818388 - DNA, 25 bp, Mus musculus
tggccactgccaccaattgggatga

SEQ ID NO: 818389 - DNA, 25 bp, Mus musculus
tggccactgccagcaattgggatga

SEQ ID NO: 818390 - DNA, 25 bp, Mus musculus
tggccactggagacatctctacatt

SEQ ID NO: 818391 - DNA, 25 bp, Mus musculus
tggccactggagtcatctctacatt

SEQ ID NO: 818392 - DNA, 25 bp, Mus musculus
tggccagaagatccttgagaagatg

SEQ ID NO: 818393 - DNA, 25 bp, Mus musculus
tggccagaagatcggccaattccag

SEQ ID NO: 818394 - DNA, 25 bp, Mus musculus
tggccagaagatgcttgagaagatg

SEQ ID NO: 818395 - DNA, 25 bp, Mus musculus
tggccagaagatgggccaattccag

SEQ ID NO: 818396 - DNA, 25 bp, Mus musculus
tggccagacagtccatgatgaagtg

SEQ ID NO: 818397 - DNA, 25 bp, Mus musculus
tggccagacagtgcatgatgaagtg

SEQ ID NO: 818398 - DNA, 25 bp, Mus musculus
tggccagaccatcgcgtgcctagtg

SEQ ID NO: 818399 - DNA, 25 bp, Mus musculus
tggccagaccatggcgtgcctagtg

SEQ ID NO: 818400 - DNA, 25 bp, Mus musculus
tggccagactagaaaccagatcgtc

SEQ ID NO: 818401 - DNA, 25 bp, Mus musculus
tggccagactagtaaccagatcgtc

SEQ ID NO: 818402 - DNA, 25 bp, Mus musculus
tggccagagccacatcaagttgctg

SEQ ID NO: 818403 - DNA, 25 bp, Mus musculus
tggccagagccagatcaagttgctg

SEQ ID NO: 818404 - DNA, 25 bp, Mus musculus
tggccagagtgtcttcatcaccaag

SEQ ID NO: 818405 - DNA, 25 bp, Mus musculus
tggccagagtgtgttcatcaccaag

SEQ ID NO: 818406 - DNA, 25 bp, Mus musculus
tggccagatggaaagcccctggaga

SEQ ID NO: 818407 - DNA, 25 bp, Mus musculus
tggccagatggatagcccctggaga

SEQ ID NO: 818408 - DNA, 25 bp, Mus musculus
tggccagattgccagttaccctctg

SEQ ID NO: 818409 - DNA, 25 bp, Mus musculus
tggccagattgcgagttaccctctg

SEQ ID NO: 818410 - DNA, 25 bp, Mus musculus
tggccagcaaccagatgggcagtgc

SEQ ID NO: 818411 - DNA, 25 bp, Mus musculus
tggccagcaacctgatgggcagtgc

SEQ ID NO: 818412 - DNA, 25 bp, Mus musculus
tggccagcaactacatcagtcccaa

SEQ ID NO: 818413 - DNA, 25 bp, Mus musculus
tggccagcaacttcatcagtcccaa

SEQ ID NO: 818414 - DNA, 25 bp, Mus musculus
tggccagcaagcagggtcgccatga

SEQ ID NO: 818415 - DNA, 25 bp, Mus musculus
tggccagcaagcatgtaggcatgac

SEQ ID NO: 818416 - DNA, 25 bp, Mus musculus
tggccagcaagctgggtcgccatga

SEQ ID NO: 818417 - DNA, 25 bp, Mus musculus
tggccagcaagcttgtaggcatgac

SEQ ID NO: 818418 - DNA, 25 bp, Mus musculus
tggccagcacaaacagctccggcag

SEQ ID NO: 818419 - DNA, 25 bp, Mus musculus
tggccagcacaatcagctccggcag

SEQ ID NO: 818420 - DNA, 25 bp, Mus musculus
tggccagccgccatcaagagggcag

SEQ ID NO: 818421 - DNA, 25 bp, Mus musculus
tggccagccgccttcaagagggcag

SEQ ID NO: 818422 - DNA, 25 bp, Mus musculus
tggccagccttgacaacgttaggaa

SEQ ID NO: 818423 - DNA, 25 bp, Mus musculus
tggccagccttgtcaacgttaggaa

SEQ ID NO: 818424 - DNA, 25 bp, Mus musculus
tggccagctttacgaaagaccccgt

SEQ ID NO: 818425 - DNA, 25 bp, Mus musculus
tggccagctttacgataatatgatc

SEQ ID NO: 818426 - DNA, 25 bp, Mus musculus
tggccagctttaggaaagaccccgt

SEQ ID NO: 818427 - DNA, 25 bp, Mus musculus
tggccagctttaggataatatgatc

SEQ ID NO: 818428 - DNA, 25 bp, Mus musculus
tggccaggaaggacctcgtggactt

SEQ ID NO: 818429 - DNA, 25 bp, Mus musculus
tggccaggaaggtcctcgtggactt

SEQ ID NO: 818430 - DNA, 25 bp, Mus musculus
tggccaggacctcaacaagctcagc

SEQ ID NO: 818431 - DNA, 25 bp, Mus musculus
tggccaggacctgaacaagctcagc

SEQ ID NO: 818432 - DNA, 25 bp, Mus musculus
tggccaggactacccacaggttgga

SEQ ID NO: 818433 - DNA, 25 bp, Mus musculus
tggccaggactagccacaggttgga

SEQ ID NO: 818434 - DNA, 25 bp, Mus musculus
tggccaggcagcagaaagaagatct

SEQ ID NO: 818435 - DNA, 25 bp, Mus musculus
tggccaggcagctgaaagaagatct

SEQ ID NO: 818436 - DNA, 25 bp, Mus musculus
tggccagggagaagtactgtccacc

SEQ ID NO: 818437 - DNA, 25 bp, Mus musculus
tggccagggagatgtactgtccacc

SEQ ID NO: 818438 - DNA, 25 bp, Mus musculus
tggccagggatccacatgtgcgcat

SEQ ID NO: 818439 - DNA, 25 bp, Mus musculus
tggccagggatcgacatgtgcgcat

SEQ ID NO: 818440 - DNA, 25 bp, Mus musculus
tggccagggttaaaccacacatacc

SEQ ID NO: 818441 - DNA, 25 bp, Mus musculus
tggccagggttataccacacatacc

SEQ ID NO: 818442 - DNA, 25 bp, Mus musculus
tggccagtatgtccccagaattgtg

SEQ ID NO: 818443 - DNA, 25 bp, Mus musculus
tggccagtatgtgcccagaattgtg

SEQ ID NO: 818444 - DNA, 25 bp, Mus musculus
tggccagtccccagtctccgggtaa

SEQ ID NO: 818445 - DNA, 25 bp, Mus musculus
tggccagtcccctgtctccgggtaa

SEQ ID NO: 818446 - DNA, 25 bp, Mus musculus
tggccagtcggcacacaaacctgga

SEQ ID NO: 818447 - DNA, 25 bp, Mus musculus
tggccagtcggctcacaaacctgga

SEQ ID NO: 818448 - DNA, 25 bp, Mus musculus
tggccagtcgggagaccacccgtct

SEQ ID NO: 818449 - DNA, 25 bp, Mus musculus
tggccagtcgggtgaccacccgtct

SEQ ID NO: 818450 - DNA, 25 bp, Mus musculus
tggccagtctccacatcacaaaggg

SEQ ID NO: 818451 - DNA, 25 bp, Mus musculus
tggccagtctcctcatcacaaaggg

SEQ ID NO: 818452 - DNA, 25 bp, Mus musculus
tggccagtgtggcagcatcatgcca

SEQ ID NO: 818453 - DNA, 25 bp, Mus musculus
tggccagtgtgggagcatcatgcca

SEQ ID NO: 818454 - DNA, 25 bp, Mus musculus
tggccagttcggcttccctgtggtt

SEQ ID NO: 818455 - DNA, 25 bp, Mus musculus
tggccagttcgggttccctgtggtt

SEQ ID NO: 818456 - DNA, 25 bp, Mus musculus
tggccagtttcaagccaggagaaag

SEQ ID NO: 818457 - DNA, 25 bp, Mus musculus
tggccagtttcatgccaggagaaag

SEQ ID NO: 818458 - DNA, 25 bp, Mus musculus
tggccagtttgtccgccctgggact

SEQ ID NO: 818459 - DNA, 25 bp, Mus musculus
tggccagtttgtgcgccctgggact

SEQ ID NO: 818460 - DNA, 25 bp, Mus musculus
tggccataaacgaagtgaaaacaaa

SEQ ID NO: 818461 - DNA, 25 bp, Mus musculus
tggccataaacgtagtgaaaacaaa

SEQ ID NO: 818462 - DNA, 25 bp, Mus musculus
tggccataaggcagcctcagtgggc

SEQ ID NO: 818463 - DNA, 25 bp, Mus musculus
tggccataaggctgcctcagtgggc

SEQ ID NO: 818464 - DNA, 25 bp, Mus musculus
tggccatacccacgacacactggtg

SEQ ID NO: 818465 - DNA, 25 bp, Mus musculus
tggccatacccaggacacactggtg

SEQ ID NO: 818466 - DNA, 25 bp, Mus musculus
tggccatactcactgcactgctgaa

SEQ ID NO: 818467 - DNA, 25 bp, Mus musculus
tggccatactcagtgcactgctgaa

SEQ ID NO: 818468 - DNA, 25 bp, Mus musculus
tggccatcaatacgctctgcaaaga

SEQ ID NO: 818469 - DNA, 25 bp, Mus musculus
tggccatcaataggctctgcaaaga

SEQ ID NO: 818470 - DNA, 25 bp, Mus musculus
tggccatcatgcctcaaaccagatc

SEQ ID NO: 818471 - DNA, 25 bp, Mus musculus
tggccatcatgcgtcaaaccagatc

SEQ ID NO: 818472 - DNA, 25 bp, Mus musculus
tggccatccatcactccgggaagat

SEQ ID NO: 818473 - DNA, 25 bp, Mus musculus
tggccatccatctctccgggaagat

SEQ ID NO: 818474 - DNA, 25 bp, Mus musculus
tggccatcccaaaagacaccactgg

SEQ ID NO: 818475 - DNA, 25 bp, Mus musculus
tggccatcccaatagacaccactgg

SEQ ID NO: 818476 - DNA, 25 bp, Mus musculus
tggccatccccgagggtgatcgtta

SEQ ID NO: 818477 - DNA, 25 bp, Mus musculus
tggccatccccgtgggtgatcgtta

SEQ ID NO: 818478 - DNA, 25 bp, Mus musculus
tggccatcctaccacagtgacggca

SEQ ID NO: 818479 - DNA, 25 bp, Mus musculus
tggccatcctacgacagtgacggca

SEQ ID NO: 818480 - DNA, 25 bp, Mus musculus
tggccatcctgcaggcaattgtgaa

SEQ ID NO: 818481 - DNA, 25 bp, Mus musculus
tggccatcctgctggcaattgtgaa

SEQ ID NO: 818482 - DNA, 25 bp, Mus musculus
tggccatccttacaggagcctatcg

SEQ ID NO: 818483 - DNA, 25 bp, Mus musculus
tggccatccttagaggagcctatcg

SEQ ID NO: 818484 - DNA, 25 bp, Mus musculus
tggccatcggaaagagatcagactc

SEQ ID NO: 818485 - DNA, 25 bp, Mus musculus
tggccatcggaaaggcctctctgga

SEQ ID NO: 818486 - DNA, 25 bp, Mus musculus
tggccatcggaatgagatcagactc

SEQ ID NO: 818487 - DNA, 25 bp, Mus musculus
tggccatcggaatggcctctctgga

SEQ ID NO: 818488 - DNA, 25 bp, Mus musculus
tggccatcgtcaatggcattctggt

SEQ ID NO: 818489 - DNA, 25 bp, Mus musculus
tggccatcgtcattggcattctggt

SEQ ID NO: 818490 - DNA, 25 bp, Mus musculus
tggccatcgtgaaggccatgggcaa

SEQ ID NO: 818491 - DNA, 25 bp, Mus musculus
tggccatcgtgatggccatgggcaa

SEQ ID NO: 818492 - DNA, 25 bp, Mus musculus
tggccatctacgacacaatgcagta

SEQ ID NO: 818493 - DNA, 25 bp, Mus musculus
tggccatctacgtcacaatgcagta

SEQ ID NO: 818494 - DNA, 25 bp, Mus musculus
tggccatctcccagggtcattgtga

SEQ ID NO: 818495 - DNA, 25 bp, Mus musculus
tggccatctccctgggtcattgtga

SEQ ID NO: 818496 - DNA, 25 bp, Mus musculus
tggccatgacgaatcagatcctcct

SEQ ID NO: 818497 - DNA, 25 bp, Mus musculus
tggccatgacgattcagatcctcct

SEQ ID NO: 818498 - DNA, 25 bp, Mus musculus
tggccatgaggtaggatgcctcatc

SEQ ID NO: 818499 - DNA, 25 bp, Mus musculus
tggccatgaggttggatgcctcatc

SEQ ID NO: 818500 - DNA, 25 bp, Mus musculus
tggccatgcaaaaaatcttcgcccg

SEQ ID NO: 818501 - DNA, 25 bp, Mus musculus
tggccatgcaaataatcttcgcccg

SEQ ID NO: 818502 - DNA, 25 bp, Mus musculus
tggccatgcactctgcgatacgctg

SEQ ID NO: 818503 - DNA, 25 bp, Mus musculus
tggccatgcactgtgcgatacgctg

SEQ ID NO: 818504 - DNA, 25 bp, Mus musculus
tggccatgcatccttggagaggaac

SEQ ID NO: 818505 - DNA, 25 bp, Mus musculus
tggccatgcatcgttggagaggaac

SEQ ID NO: 818506 - DNA, 25 bp, Mus musculus
tggccatgccatcgtggtcactggc

SEQ ID NO: 818507 - DNA, 25 bp, Mus musculus
tggccatgccatggtggtcactggc

SEQ ID NO: 818508 - DNA, 25 bp, Mus musculus
tggccatgcctcaggccgttgacca

SEQ ID NO: 818509 - DNA, 25 bp, Mus musculus
tggccatgcctctggccgttgacca

SEQ ID NO: 818510 - DNA, 25 bp, Mus musculus
tggccatgcgcaagctggtgcgctc

SEQ ID NO: 818511 - DNA, 25 bp, Mus musculus
tggccatgcgcatgctggtgcgctc

SEQ ID NO: 818512 - DNA, 25 bp, Mus musculus
tggccatgctggagtggaacctcta

SEQ ID NO: 818513 - DNA, 25 bp, Mus musculus
tggccatgctggtgtggaacctcta

SEQ ID NO: 818514 - DNA, 25 bp, Mus musculus
tggccatggaaacgattggagataa

SEQ ID NO: 818515 - DNA, 25 bp, Mus musculus
tggccatggaaaggattggagataa

SEQ ID NO: 818516 - DNA, 25 bp, Mus musculus
tggccatggacaccgaagggctttt

SEQ ID NO: 818517 - DNA, 25 bp, Mus musculus
tggccatggacacgaagtcctcatc

SEQ ID NO: 818518 - DNA, 25 bp, Mus musculus
tggccatggacagcgaagggctttt

SEQ ID NO: 818519 - DNA, 25 bp, Mus musculus
tggccatggacaggaagtcctcatc

SEQ ID NO: 818520 - DNA, 25 bp, Mus musculus
tggccatggcccagagctctcagca

SEQ ID NO: 818521 - DNA, 25 bp, Mus musculus
tggccatggccctgagctctcagca

SEQ ID NO: 818522 - DNA, 25 bp, Mus musculus
tggccatgggcaagaccccaagtct

SEQ ID NO: 818523 - DNA, 25 bp, Mus musculus
tggccatgggcatgaccccaagtct

SEQ ID NO: 818524 - DNA, 25 bp, Mus musculus
tggccatggtccaccgcaccgtgga

SEQ ID NO: 818525 - DNA, 25 bp, Mus musculus
tggccatggtcctccgcaccgtgga

SEQ ID NO: 818526 - DNA, 25 bp, Mus musculus
tggccattccgcagtacagacactg

SEQ ID NO: 818527 - DNA, 25 bp, Mus musculus
tggccattccgctgtacagacactg

SEQ ID NO: 818528 - DNA, 25 bp, Mus musculus
tggccattctctatttaccaccagt

SEQ ID NO: 818529 - DNA, 25 bp, Mus musculus
tggccattctctttttaccaccagt

SEQ ID NO: 818530 - DNA, 25 bp, Mus musculus
tggccattgaagagccaggccctgg

SEQ ID NO: 818531 - DNA, 25 bp, Mus musculus
tggccattgaagtgccaggccctgg

SEQ ID NO: 818532 - DNA, 25 bp, Mus musculus
tggccattgctgagggaacctcctt

SEQ ID NO: 818533 - DNA, 25 bp, Mus musculus
tggccattgctgtgggaacctcctt

SEQ ID NO: 818534 - DNA, 25 bp, Mus musculus
tggccatttgtcatccctgagtctt

SEQ ID NO: 818535 - DNA, 25 bp, Mus musculus
tggccatttgtcttccctgagtctt

SEQ ID NO: 818536 - DNA, 25 bp, Mus musculus
tggcccaaccttatcttgggagatg

SEQ ID NO: 818537 - DNA, 25 bp, Mus musculus
tggcccaaccttttcttgggagatg

SEQ ID NO: 818538 - DNA, 25 bp, Mus musculus
tggcccaagtagcagtgactactca

SEQ ID NO: 818539 - DNA, 25 bp, Mus musculus
tggcccaagtaggagtgactactca

SEQ ID NO: 818540 - DNA, 25 bp, Mus musculus
tggcccacacagctagttctaatgc

SEQ ID NO: 818541 - DNA, 25 bp, Mus musculus
tggcccacacaggtagttctaatgc

SEQ ID NO: 818542 - DNA, 25 bp, Mus musculus
tggcccacagaaaggatggccttct

SEQ ID NO: 818543 - DNA, 25 bp, Mus musculus
tggcccacagaatggatggccttct

SEQ ID NO: 818544 - DNA, 25 bp, Mus musculus
tggcccacagagacgctgctctatg

SEQ ID NO: 818545 - DNA, 25 bp, Mus musculus
tggcccacagagtcgctgctctatg

SEQ ID NO: 818546 - DNA, 25 bp, Mus musculus
tggcccacagcgatgagtgcagctg

SEQ ID NO: 818547 - DNA, 25 bp, Mus musculus
tggcccacagcgttgagtgcagctg

SEQ ID NO: 818548 - DNA, 25 bp, Mus musculus
tggcccacagctcagattgcggtca

SEQ ID NO: 818549 - DNA, 25 bp, Mus musculus
tggcccacagctgagattgcggtca

SEQ ID NO: 818550 - DNA, 25 bp, Mus musculus
tggcccaccggaaggctatgaagag

SEQ ID NO: 818551 - DNA, 25 bp, Mus musculus
tggcccaccggatggctatgaagag

SEQ ID NO: 818552 - DNA, 25 bp, Mus musculus
tggcccacttacactatctgaggac

SEQ ID NO: 818553 - DNA, 25 bp, Mus musculus
tggcccacttactctatctgaggac

SEQ ID NO: 818554 - DNA, 25 bp, Mus musculus
tggcccagaagtcctggaatgattc

SEQ ID NO: 818555 - DNA, 25 bp, Mus musculus
tggcccagaagtgctggaatgattc

SEQ ID NO: 818556 - DNA, 25 bp, Mus musculus
tggcccagacgtcactggtggttca

SEQ ID NO: 818557 - DNA, 25 bp, Mus musculus
tggcccagacgtgactggtggttca

SEQ ID NO: 818558 - DNA, 25 bp, Mus musculus
tggcccagatacaacagaatgctgt

SEQ ID NO: 818559 - DNA, 25 bp, Mus musculus
tggcccagatactacagaatgctgt

SEQ ID NO: 818560 - DNA, 25 bp, Mus musculus
tggcccagcaccaacttctggtgac

SEQ ID NO: 818561 - DNA, 25 bp, Mus musculus
tggcccagcacctacttctggtgac

SEQ ID NO: 818562 - DNA, 25 bp, Mus musculus
tggcccagcagcagatgaccagctc

SEQ ID NO: 818563 - DNA, 25 bp, Mus musculus
tggcccagcagctgatgaccagctc

SEQ ID NO: 818564 - DNA, 25 bp, Mus musculus
tggcccagccttctcgccctcagtg

SEQ ID NO: 818565 - DNA, 25 bp, Mus musculus
tggcccagccttgtcgccctcagtg

SEQ ID NO: 818566 - DNA, 25 bp, Mus musculus
tggcccagcgagataggtgcttcct

SEQ ID NO: 818567 - DNA, 25 bp, Mus musculus
tggcccagcgagttaggtgcttcct

SEQ ID NO: 818568 - DNA, 25 bp, Mus musculus
tggcccagctgcatttgaacagcca

SEQ ID NO: 818569 - DNA, 25 bp, Mus musculus
tggcccagctgcttttgaacagcca

SEQ ID NO: 818570 - DNA, 25 bp, Mus musculus
tggcccaggacaaccgcaagttcgt

SEQ ID NO: 818571 - DNA, 25 bp, Mus musculus
tggcccaggacatccgcaagttcgt

SEQ ID NO: 818572 - DNA, 25 bp, Mus musculus
tggcccaggagaatcaatgagtatc

SEQ ID NO: 818573 - DNA, 25 bp, Mus musculus
tggcccaggagattcaatgagtatc

SEQ ID NO: 818574 - DNA, 25 bp, Mus musculus
tggcccagggtaactgcctggaact

SEQ ID NO: 818575 - DNA, 25 bp, Mus musculus
tggcccagggtatctgcctggaact

SEQ ID NO: 818576 - DNA, 25 bp, Mus musculus
tggcccagggtcagagccctgctca

SEQ ID NO: 818577 - DNA, 25 bp, Mus musculus
tggcccagggtctgagccctgctca

SEQ ID NO: 818578 - DNA, 25 bp, Mus musculus
tggcccaggtgaacagctgccagta

SEQ ID NO: 818579 - DNA, 25 bp, Mus musculus
tggcccaggtgatcagctgccagta

SEQ ID NO: 818580 - DNA, 25 bp, Mus musculus
tggcccaggtgcacgcagaaaatgg

SEQ ID NO: 818581 - DNA, 25 bp, Mus musculus
tggcccaggtgctcgcagaaaatgg

SEQ ID NO: 818582 - DNA, 25 bp, Mus musculus
tggcccaggtgtatgtccacggaga

SEQ ID NO: 818583 - DNA, 25 bp, Mus musculus
tggcccaggtgtttgtccacggaga

SEQ ID NO: 818584 - DNA, 25 bp, Mus musculus
tggcccatagagctttcgacaatga

SEQ ID NO: 818585 - DNA, 25 bp, Mus musculus
tggcccatagaggtttcgacaatga

SEQ ID NO: 818586 - DNA, 25 bp, Mus musculus
tggcccatatggaggagtccagccc

SEQ ID NO: 818587 - DNA, 25 bp, Mus musculus
tggcccatatggtggagtccagccc

SEQ ID NO: 818588 - DNA, 25 bp, Mus musculus
tggcccatccccatggtgacagagc

SEQ ID NO: 818589 - DNA, 25 bp, Mus musculus
tggcccatccccttggtgacagagc

SEQ ID NO: 818590 - DNA, 25 bp, Mus musculus
tggcccatccttccattgttttacg

SEQ ID NO: 818591 - DNA, 25 bp, Mus musculus
tggcccatccttgcattgttttacg

SEQ ID NO: 818592 - DNA, 25 bp, Mus musculus
tggcccatctggagatcaccactga

SEQ ID NO: 818593 - DNA, 25 bp, Mus musculus
tggcccatctggtgatcaccactga

SEQ ID NO: 818594 - DNA, 25 bp, Mus musculus
tggcccatgatgcacacaactgcct

SEQ ID NO: 818595 - DNA, 25 bp, Mus musculus
tggcccatgatggacacaactgcct

SEQ ID NO: 818596 - DNA, 25 bp, Mus musculus
tggcccattaccatgacaactacgg

SEQ ID NO: 818597 - DNA, 25 bp, Mus musculus
tggcccattaccttgacaactacgg

SEQ ID NO: 818598 - DNA, 25 bp, Mus musculus
tggcccattctaagttcaccagtgg

SEQ ID NO: 818599 - DNA, 25 bp, Mus musculus
tggcccattctatgttcaccagtgg

SEQ ID NO: 818600 - DNA, 25 bp, Mus musculus
tggccccaaacgagtgtgacttctg

SEQ ID NO: 818601 - DNA, 25 bp, Mus musculus
tggccccaaacgtgtgtgacttctg

SEQ ID NO: 818602 - DNA, 25 bp, Mus musculus
tggccccaaaggacatgacattttt

SEQ ID NO: 818603 - DNA, 25 bp, Mus musculus
tggccccaaaggtcatgacattttt

SEQ ID NO: 818604 - DNA, 25 bp, Mus musculus
tggccccaagttatatccatgaagt

SEQ ID NO: 818605 - DNA, 25 bp, Mus musculus
tggccccaagttttatccatgaagt

SEQ ID NO: 818606 - DNA, 25 bp, Mus musculus
tggccccacagaagctgcgagaact

SEQ ID NO: 818607 - DNA, 25 bp, Mus musculus
tggccccacagatgctgcgagaact

SEQ ID NO: 818608 - DNA, 25 bp, Mus musculus
tggccccagagaccatcttcaacag

SEQ ID NO: 818609 - DNA, 25 bp, Mus musculus
tggccccagagagcatcttcaacag

SEQ ID NO: 818610 - DNA, 25 bp, Mus musculus
tggccccagattagagtctcgcgct

SEQ ID NO: 818611 - DNA, 25 bp, Mus musculus
tggccccagatttgagtctcgcgct

SEQ ID NO: 818612 - DNA, 25 bp, Mus musculus
tggccccagcagaaagaacttcaga

SEQ ID NO: 818613 - DNA, 25 bp, Mus musculus
tggccccagcagtaagaacttcaga

SEQ ID NO: 818614 - DNA, 25 bp, Mus musculus
tggccccagctgacagtctcaatga

SEQ ID NO: 818615 - DNA, 25 bp, Mus musculus
tggccccagctgtcagtctcaatga

SEQ ID NO: 818616 - DNA, 25 bp, Mus musculus
tggccccaggtgacctccagtgcag

SEQ ID NO: 818617 - DNA, 25 bp, Mus musculus
tggccccaggtgtcctccagtgcag

SEQ ID NO: 818618 - DNA, 25 bp, Mus musculus
tggcccccgatgagctaccaggttt

SEQ ID NO: 818619 - DNA, 25 bp, Mus musculus
tggcccccgatgtgctaccaggttt

SEQ ID NO: 818620 - DNA, 25 bp, Mus musculus
tggccccctcagagcagcaaaagct

SEQ ID NO: 818621 - DNA, 25 bp, Mus musculus
tggccccctcagtgcagcaaaagct

SEQ ID NO: 818622 - DNA, 25 bp, Mus musculus
tggccccgggatagagactcagatc

SEQ ID NO: 818623 - DNA, 25 bp, Mus musculus
tggccccgggattgagactcagatc

SEQ ID NO: 818624 - DNA, 25 bp, Mus musculus
tggccccgtatcacagtctactggt

SEQ ID NO: 818625 - DNA, 25 bp, Mus musculus
tggccccgtatctcagtctactggt

SEQ ID NO: 818626 - DNA, 25 bp, Mus musculus
tggccccgttggcctggcttcttct

SEQ ID NO: 818627 - DNA, 25 bp, Mus musculus
tggccccgttgggctggcttcttct

SEQ ID NO: 818628 - DNA, 25 bp, Mus musculus
tggcccctccaaaggctcatgaagt

SEQ ID NO: 818629 - DNA, 25 bp, Mus musculus
tggcccctccaatggctcatgaagt

SEQ ID NO: 818630 - DNA, 25 bp, Mus musculus
tggcccctctcaagcatttcctgga

SEQ ID NO: 818631 - DNA, 25 bp, Mus musculus
tggcccctctcatgcatttcctgga

SEQ ID NO: 818632 - DNA, 25 bp, Mus musculus
tggcccctgaagatctagatgattc

SEQ ID NO: 818633 - DNA, 25 bp, Mus musculus
tggcccctgaagttctagatgattc

SEQ ID NO: 818634 - DNA, 25 bp, Mus musculus
tggcccctgactacagcatgatggg

SEQ ID NO: 818635 - DNA, 25 bp, Mus musculus
tggcccctgacttcagcatgatggg

SEQ ID NO: 818636 - DNA, 25 bp, Mus musculus
tggcccctgagaataccctgatgtc

SEQ ID NO: 818637 - DNA, 25 bp, Mus musculus
tggcccctgagattaccctgatgtc

SEQ ID NO: 818638 - DNA, 25 bp, Mus musculus
tggcccctgagcagtttggagaagt

SEQ ID NO: 818639 - DNA, 25 bp, Mus musculus
tggcccctgagctgtttggagaagt

SEQ ID NO: 818640 - DNA, 25 bp, Mus musculus
tggcccctgtgtaggctcctgtgga

SEQ ID NO: 818641 - DNA, 25 bp, Mus musculus
tggcccctgtgttggctcctgtgga

SEQ ID NO: 818642 - DNA, 25 bp, Mus musculus
tggccccttggcatagtcctgagag

SEQ ID NO: 818643 - DNA, 25 bp, Mus musculus
tggccccttggcttagtcctgagag

SEQ ID NO: 818644 - DNA, 25 bp, Mus musculus
tggcccgagactatgagaagaacta

SEQ ID NO: 818645 - DNA, 25 bp, Mus musculus
tggcccgagactttgagaagaacta

SEQ ID NO: 818646 - DNA, 25 bp, Mus musculus
tggcccgatgccactgaaattgtga

SEQ ID NO: 818647 - DNA, 25 bp, Mus musculus
tggcccgatgcctctgaaattgtga

SEQ ID NO: 818648 - DNA, 25 bp, Mus musculus
tggcccgccatgatggacaagctgt

SEQ ID NO: 818649 - DNA, 25 bp, Mus musculus
tggcccgccatgttggacaagctgt

SEQ ID NO: 818650 - DNA, 25 bp, Mus musculus
tggcccgctgctcagacttctgcat

SEQ ID NO: 818651 - DNA, 25 bp, Mus musculus
tggcccgctgctgagacttctgcat

SEQ ID NO: 818652 - DNA, 25 bp, Mus musculus
tggcccgcttcgaacagctcatcag

SEQ ID NO: 818653 - DNA, 25 bp, Mus musculus
tggcccgcttcgtacagctcatcag

SEQ ID NO: 818654 - DNA, 25 bp, Mus musculus
tggcccgcttttaatggcagcatgg

SEQ ID NO: 818655 - DNA, 25 bp, Mus musculus
tggcccgctttttatggcagcatgg

SEQ ID NO: 818656 - DNA, 25 bp, Mus musculus
tggcccggaacaaggcccggcttcg

SEQ ID NO: 818657 - DNA, 25 bp, Mus musculus
tggcccggaacatggcccggcttcg

SEQ ID NO: 818658 - DNA, 25 bp, Mus musculus
tggcccggacgaagctgctgagccc

SEQ ID NO: 818659 - DNA, 25 bp, Mus musculus
tggcccggacgatgctgctgagccc

SEQ ID NO: 818660 - DNA, 25 bp, Mus musculus
tggcccggaggaactggatatccga

SEQ ID NO: 818661 - DNA, 25 bp, Mus musculus
tggcccggaggatctggatatccga

SEQ ID NO: 818662 - DNA, 25 bp, Mus musculus
tggcccggatggacatgctcggcct

SEQ ID NO: 818663 - DNA, 25 bp, Mus musculus
tggcccggatggtcatgctcggcct

SEQ ID NO: 818664 - DNA, 25 bp, Mus musculus
tggcccggcagcataagccttccat

SEQ ID NO: 818665 - DNA, 25 bp, Mus musculus
tggcccggcagcttaagccttccat

SEQ ID NO: 818666 - DNA, 25 bp, Mus musculus
tggcccggtccacgagggactctgt

SEQ ID NO: 818667 - DNA, 25 bp, Mus musculus
tggcccggtccaggagggactctgt

SEQ ID NO: 818668 - DNA, 25 bp, Mus musculus
tggcccggtctgcaataaacaccca

SEQ ID NO: 818669 - DNA, 25 bp, Mus musculus
tggcccggtctggaataaacaccca

SEQ ID NO: 818670 - DNA, 25 bp, Mus musculus
tggcccgtaagcaggtcatcatcga

SEQ ID NO: 818671 - DNA, 25 bp, Mus musculus
tggcccgtaagctggtcatcatcga

SEQ ID NO: 818672 - DNA, 25 bp, Mus musculus
tggcccgtacccctttggcattgat

SEQ ID NO: 818673 - DNA, 25 bp, Mus musculus
tggcccgtacccgtttggcattgat

SEQ ID NO: 818674 - DNA, 25 bp, Mus musculus
tggcccgtgaagaacagtggtaaac

SEQ ID NO: 818675 - DNA, 25 bp, Mus musculus
tggcccgtgaagtacagtggtaaac

SEQ ID NO: 818676 - DNA, 25 bp, Mus musculus
tggcccgtgataaaaccatggtggc

SEQ ID NO: 818677 - DNA, 25 bp, Mus musculus
tggcccgtgatataaccatggtggc

SEQ ID NO: 818678 - DNA, 25 bp, Mus musculus
tggcccgtgcctacagcctagctaa

SEQ ID NO: 818679 - DNA, 25 bp, Mus musculus
tggcccgtgccttcagcctagctaa

SEQ ID NO: 818680 - DNA, 25 bp, Mus musculus
tggcccgtggacaggataagcagat

SEQ ID NO: 818681 - DNA, 25 bp, Mus musculus
tggcccgtggactggataagcagat

SEQ ID NO: 818682 - DNA, 25 bp, Mus musculus
tggcccgtggctccatgaccgtcgt

SEQ ID NO: 818683 - DNA, 25 bp, Mus musculus
tggcccgtggctgcatgaccgtcgt

SEQ ID NO: 818684 - DNA, 25 bp, Mus musculus
tggcccgttctcatctgcagatcat

SEQ ID NO: 818685 - DNA, 25 bp, Mus musculus
tggcccgttctcttctgcagatcat

SEQ ID NO: 818686 - DNA, 25 bp, Mus musculus
tggcccgtttccctggtacttgtgg

SEQ ID NO: 818687 - DNA, 25 bp, Mus musculus
tggcccgtttccgtggtacttgtgg

SEQ ID NO: 818688 - DNA, 25 bp, Mus musculus
tggccctaatgcacccttgtcatgg

SEQ ID NO: 818689 - DNA, 25 bp, Mus musculus
tggccctaatgctcccttgtcatgg

SEQ ID NO: 818690 - DNA, 25 bp, Mus musculus
tggccctactgaaagtcctgctagt

SEQ ID NO: 818691 - DNA, 25 bp, Mus musculus
tggccctactgatagtcctgctagt

SEQ ID NO: 818692 - DNA, 25 bp, Mus musculus
tggccctatcacagtcagaggctga

SEQ ID NO: 818693 - DNA, 25 bp, Mus musculus
tggccctatcactgtcagaggctga

SEQ ID NO: 818694 - DNA, 25 bp, Mus musculus
tggccctatgggagctgaagaactt

SEQ ID NO: 818695 - DNA, 25 bp, Mus musculus
tggccctatgggtgctgaagaactt

SEQ ID NO: 818696 - DNA, 25 bp, Mus musculus
tggccctcatgacagaagaaggcgc

SEQ ID NO: 818697 - DNA, 25 bp, Mus musculus
tggccctcatgagagaagaaggcgc

SEQ ID NO: 818698 - DNA, 25 bp, Mus musculus
tggccctcattgagaaggcactggc

SEQ ID NO: 818699 - DNA, 25 bp, Mus musculus
tggccctcattgtgaaggcactggc

SEQ ID NO: 818700 - DNA, 25 bp, Mus musculus
tggccctccggtacatgaagcagga

SEQ ID NO: 818701 - DNA, 25 bp, Mus musculus
tggccctccggttcatgaagcagga

SEQ ID NO: 818702 - DNA, 25 bp, Mus musculus
tggccctcgaccaggttcattgcag

SEQ ID NO: 818703 - DNA, 25 bp, Mus musculus
tggccctcgacctggttcattgcag

SEQ ID NO: 818704 - DNA, 25 bp, Mus musculus
tggccctcttgaaccatgggtggag

SEQ ID NO: 818705 - DNA, 25 bp, Mus musculus
tggccctcttgatccatgggtggag

SEQ ID NO: 818706 - DNA, 25 bp, Mus musculus
tggccctgaaccctctgagactgtg

SEQ ID NO: 818707 - DNA, 25 bp, Mus musculus
tggccctgaaccgtctgagactgtg

SEQ ID NO: 818708 - DNA, 25 bp, Mus musculus
tggccctgagctacggtgtggaaca

SEQ ID NO: 818709 - DNA, 25 bp, Mus musculus
tggccctgagcttcggtgtggaaca

SEQ ID NO: 818710 - DNA, 25 bp, Mus musculus
tggccctgatcaagacaagttcagt

SEQ ID NO: 818711 - DNA, 25 bp, Mus musculus
tggccctgatcatgacaagttcagt

SEQ ID NO: 818712 - DNA, 25 bp, Mus musculus
tggccctgatggagaagcgtatgtc

SEQ ID NO: 818713 - DNA, 25 bp, Mus musculus
tggccctgatggtgaagcgtatgtc

SEQ ID NO: 818714 - DNA, 25 bp, Mus musculus
tggccctgattgaggcctatcagcg

SEQ ID NO: 818715 - DNA, 25 bp, Mus musculus
tggccctgattgtggcctatcagcg

SEQ ID NO: 818716 - DNA, 25 bp, Mus musculus
tggccctgcaacctgggtgacctgt

SEQ ID NO: 818717 - DNA, 25 bp, Mus musculus
tggccctgcaacgtgggtgacctgt

SEQ ID NO: 818718 - DNA, 25 bp, Mus musculus
tggccctgcgtcacatggtggagca

SEQ ID NO: 818719 - DNA, 25 bp, Mus musculus
tggccctgcgtctcatggtggagca

SEQ ID NO: 818720 - DNA, 25 bp, Mus musculus
tggccctggaacaggagcgaatcct

SEQ ID NO: 818721 - DNA, 25 bp, Mus musculus
tggccctggaactggagcgaatcct

SEQ ID NO: 818722 - DNA, 25 bp, Mus musculus
tggccctggagcaccacgaaggatc

SEQ ID NO: 818723 - DNA, 25 bp, Mus musculus
tggccctggagctccacgaaggatc

SEQ ID NO: 818724 - DNA, 25 bp, Mus musculus
tggccctggccccaaacgagtgtga

SEQ ID NO: 818725 - DNA, 25 bp, Mus musculus
tggccctggcccgaaacgagtgtga

SEQ ID NO: 818726 - DNA, 25 bp, Mus musculus
tggccctggtggctcgagctcataa

SEQ ID NO: 818727 - DNA, 25 bp, Mus musculus
tggccctggtgggtcgagctcataa

SEQ ID NO: 818728 - DNA, 25 bp, Mus musculus
tggccctgtcagacccattggaggt

SEQ ID NO: 818729 - DNA, 25 bp, Mus musculus
tggccctgtcagtcccattggaggt

SEQ ID NO: 818730 - DNA, 25 bp, Mus musculus
tggcccttactaagcacggcccgtt

SEQ ID NO: 818731 - DNA, 25 bp, Mus musculus
tggcccttactatgcacggcccgtt

SEQ ID NO: 818732 - DNA, 25 bp, Mus musculus
tggcccttcgggatatgaccagtaa

SEQ ID NO: 818733 - DNA, 25 bp, Mus musculus
tggcccttcgggttatgaccagtaa

SEQ ID NO: 818734 - DNA, 25 bp, Mus musculus
tggcccttctctcggtagcagggct

SEQ ID NO: 818735 - DNA, 25 bp, Mus musculus
tggcccttctctgggtagcagggct

SEQ ID NO: 818736 - DNA, 25 bp, Mus musculus
tggcccttgggtcaaggctacccct

SEQ ID NO: 818737 - DNA, 25 bp, Mus musculus
tggcccttgggtgaaggctacccct

SEQ ID NO: 818738 - DNA, 25 bp, Mus musculus
tggcccttgtgccagagagtagcaa

SEQ ID NO: 818739 - DNA, 25 bp, Mus musculus
tggcccttgtgcgagagagtagcaa

SEQ ID NO: 818740 - DNA, 25 bp, Mus musculus
tggccctttaagcaccagcctgctg

SEQ ID NO: 818741 - DNA, 25 bp, Mus musculus
tggccctttaaggaccagcctgctg

SEQ ID NO: 818742 - DNA, 25 bp, Mus musculus
tggccctttgatcatggagcgcccc

SEQ ID NO: 818743 - DNA, 25 bp, Mus musculus
tggccctttgatgatggagcgcccc

SEQ ID NO: 818744 - DNA, 25 bp, Mus musculus
tggccgaaacacagacaaaaatggg

SEQ ID NO: 818745 - DNA, 25 bp, Mus musculus
tggccgaaacactgacaaaaatggg

SEQ ID NO: 818746 - DNA, 25 bp, Mus musculus
tggccgaagccaactcctacgtgga

SEQ ID NO: 818747 - DNA, 25 bp, Mus musculus
tggccgaagccatctcctacgtgga

SEQ ID NO: 818748 - DNA, 25 bp, Mus musculus
tggccgaatgcgctacacctaccag

SEQ ID NO: 818749 - DNA, 25 bp, Mus musculus
tggccgaatgcggtacacctaccag

SEQ ID NO: 818750 - DNA, 25 bp, Mus musculus
tggccgacaagaaccacagtgtgag

SEQ ID NO: 818751 - DNA, 25 bp, Mus musculus
tggccgacaagatccacagtgtgag

SEQ ID NO: 818752 - DNA, 25 bp, Mus musculus
tggccgacagcgacaaggagttcca

SEQ ID NO: 818753 - DNA, 25 bp, Mus musculus
tggccgacagcgtcaaggagttcca

SEQ ID NO: 818754 - DNA, 25 bp, Mus musculus
tggccgacaggaccttccatctcat

SEQ ID NO: 818755 - DNA, 25 bp, Mus musculus
tggccgacaggagcttccatctcat

SEQ ID NO: 818756 - DNA, 25 bp, Mus musculus
tggccgacagttactgaagtatgtg

SEQ ID NO: 818757 - DNA, 25 bp, Mus musculus
tggccgacagtttctgaagtatgtg

SEQ ID NO: 818758 - DNA, 25 bp, Mus musculus
tggccgactctgcaggtcagccaca

SEQ ID NO: 818759 - DNA, 25 bp, Mus musculus
tggccgactctggaggtcagccaca

SEQ ID NO: 818760 - DNA, 25 bp, Mus musculus
tggccgactgctcagccaccagtga

SEQ ID NO: 818761 - DNA, 25 bp, Mus musculus
tggccgactgctgagccaccagtga

SEQ ID NO: 818762 - DNA, 25 bp, Mus musculus
tggccgagatggaataccaggaatg

SEQ ID NO: 818763 - DNA, 25 bp, Mus musculus
tggccgagatggagtactgagtccc

SEQ ID NO: 818764 - DNA, 25 bp, Mus musculus
tggccgagatggtataccaggaatg

SEQ ID NO: 818765 - DNA, 25 bp, Mus musculus
tggccgagatggtgtactgagtccc

SEQ ID NO: 818766 - DNA, 25 bp, Mus musculus
tggccgagctaccttccggatagag

SEQ ID NO: 818767 - DNA, 25 bp, Mus musculus
tggccgagctacgttccggatagag

SEQ ID NO: 818768 - DNA, 25 bp, Mus musculus
tggccgagggagatctctctagctc

SEQ ID NO: 818769 - DNA, 25 bp, Mus musculus
tggccgagggagttctctctagctc

SEQ ID NO: 818770 - DNA, 25 bp, Mus musculus
tggccgagggcgagttgctgaggtc

SEQ ID NO: 818771 - DNA, 25 bp, Mus musculus
tggccgagggcgtgttgctgaggtc

SEQ ID NO: 818772 - DNA, 25 bp, Mus musculus
tggccgagtcgaaggaatctcctcc

SEQ ID NO: 818773 - DNA, 25 bp, Mus musculus
tggccgagtcgatggaatctcctcc

SEQ ID NO: 818774 - DNA, 25 bp, Mus musculus
tggccgatctgaagaattcactggg

SEQ ID NO: 818775 - DNA, 25 bp, Mus musculus
tggccgatctgatgaattcactggg

SEQ ID NO: 818776 - DNA, 25 bp, Mus musculus
tggccgatcttcagcatcacgtgag

SEQ ID NO: 818777 - DNA, 25 bp, Mus musculus
tggccgatcttctgcatcacgtgag

SEQ ID NO: 818778 - DNA, 25 bp, Mus musculus
tggccgcactgaactggccattaag

SEQ ID NO: 818779 - DNA, 25 bp, Mus musculus
tggccgcactgatctggccattaag

SEQ ID NO: 818780 - DNA, 25 bp, Mus musculus
tggccgcagcctaccctagtgcctg

SEQ ID NO: 818781 - DNA, 25 bp, Mus musculus
tggccgcagccttccctagtgcctg

SEQ ID NO: 818782 - DNA, 25 bp, Mus musculus
tggccgcagctgagtgaagcgctca

SEQ ID NO: 818783 - DNA, 25 bp, Mus musculus
tggccgcagctgtgtgaagcgctca

SEQ ID NO: 818784 - DNA, 25 bp, Mus musculus
tggccgcagtgcaacgccagtacaa

SEQ ID NO: 818785 - DNA, 25 bp, Mus musculus
tggccgcagtgctacgccagtacaa

SEQ ID NO: 818786 - DNA, 25 bp, Mus musculus
tggccgcatcagatttgccctccgg

SEQ ID NO: 818787 - DNA, 25 bp, Mus musculus
tggccgcatcagttttgccctccgg

SEQ ID NO: 818788 - DNA, 25 bp, Mus musculus
tggccgccagggacagatcatctac

SEQ ID NO: 818789 - DNA, 25 bp, Mus musculus
tggccgccagggtcagatcatctac

SEQ ID NO: 818790 - DNA, 25 bp, Mus musculus
tggccgccataacaccgtgaagtaa

SEQ ID NO: 818791 - DNA, 25 bp, Mus musculus
tggccgccataagaccgtgaagtaa

SEQ ID NO: 818792 - DNA, 25 bp, Mus musculus
tggccgccatcaaggttatggacgt

SEQ ID NO: 818793 - DNA, 25 bp, Mus musculus
tggccgccatcatggttatggacgt

SEQ ID NO: 818794 - DNA, 25 bp, Mus musculus
tggccgccatgcagtttgagaagca

SEQ ID NO: 818795 - DNA, 25 bp, Mus musculus
tggccgccatgctgtttgagaagca

SEQ ID NO: 818796 - DNA, 25 bp, Mus musculus
tggccgccatggatgccaacggcta

SEQ ID NO: 818797 - DNA, 25 bp, Mus musculus
tggccgccatggttgccaacggcta

SEQ ID NO: 818798 - DNA, 25 bp, Mus musculus
tggccgccattgagcccactagctg

SEQ ID NO: 818799 - DNA, 25 bp, Mus musculus
tggccgccattgtgcccactagctg

SEQ ID NO: 818800 - DNA, 25 bp, Mus musculus
tggccgccccacatccgttggagtg

SEQ ID NO: 818801 - DNA, 25 bp, Mus musculus
tggccgccccacttccgttggagtg

SEQ ID NO: 818802 - DNA, 25 bp, Mus musculus
tggccgccctgcaaggcatccgtgt

SEQ ID NO: 818803 - DNA, 25 bp, Mus musculus
tggccgccctgctaggcatccgtgt

SEQ ID NO: 818804 - DNA, 25 bp, Mus musculus
tggccgccgagtacatccagcagtt

SEQ ID NO: 818805 - DNA, 25 bp, Mus musculus
tggccgccgagttcatccagcagtt

SEQ ID NO: 818806 - DNA, 25 bp, Mus musculus
tggccgccgccaatttagcgttttg

SEQ ID NO: 818807 - DNA, 25 bp, Mus musculus
tggccgccgccattttagcgttttg

SEQ ID NO: 818808 - DNA, 25 bp, Mus musculus
tggccgcggttcatgttaagtgagc

SEQ ID NO: 818809 - DNA, 25 bp, Mus musculus
tggccgcggttcttgttaagtgagc

SEQ ID NO: 818810 - DNA, 25 bp, Mus musculus
tggccgctcagcacggcatggatga

SEQ ID NO: 818811 - DNA, 25 bp, Mus musculus
tggccgctcagctcggcatggatga

SEQ ID NO: 818812 - DNA, 25 bp, Mus musculus
tggccgctccttcgtggttgaccat

SEQ ID NO: 818813 - DNA, 25 bp, Mus musculus
tggccgctccttggtggttgaccat

SEQ ID NO: 818814 - DNA, 25 bp, Mus musculus
tggccgctgcagagcagcaacactc

SEQ ID NO: 818815 - DNA, 25 bp, Mus musculus
tggccgctgcagtgcagcaacactc

SEQ ID NO: 818816 - DNA, 25 bp, Mus musculus
tggccgctgccaagtggaattcact

SEQ ID NO: 818817 - DNA, 25 bp, Mus musculus
tggccgctgccatgtggaattcact

SEQ ID NO: 818818 - DNA, 25 bp, Mus musculus
tggccgctgcgtctccagaaacttt

SEQ ID NO: 818819 - DNA, 25 bp, Mus musculus
tggccgctgcgtgtccagaaacttt

SEQ ID NO: 818820 - DNA, 25 bp, Mus musculus
tggccgctggaacggccacatccat

SEQ ID NO: 818821 - DNA, 25 bp, Mus musculus
tggccgctggaagggccacatccat

SEQ ID NO: 818822 - DNA, 25 bp, Mus musculus
tggccggagtaacgcagaacttcgc

SEQ ID NO: 818823 - DNA, 25 bp, Mus musculus
tggccggagtaaggcagaacttcgc

SEQ ID NO: 818824 - DNA, 25 bp, Mus musculus
tggccggcagtgagcggcaatccaa

SEQ ID NO: 818825 - DNA, 25 bp, Mus musculus
tggccggcagtgtgcggcaatccaa

SEQ ID NO: 818826 - DNA, 25 bp, Mus musculus
tggccggcatttcgacacggaagtc

SEQ ID NO: 818827 - DNA, 25 bp, Mus musculus
tggccggcatttggacacggaagtc

SEQ ID NO: 818828 - DNA, 25 bp, Mus musculus
tggccggccacaacagatctggtgc

SEQ ID NO: 818829 - DNA, 25 bp, Mus musculus
tggccggccacatcagatctggtgc

SEQ ID NO: 818830 - DNA, 25 bp, Mus musculus
tggccggcctcaatgactcgctcat

SEQ ID NO: 818831 - DNA, 25 bp, Mus musculus
tggccggcctcattgactcgctcat

SEQ ID NO: 818832 - DNA, 25 bp, Mus musculus
tggccggctatgatatcgccctggt

SEQ ID NO: 818833 - DNA, 25 bp, Mus musculus
tggccggctatgttatcgccctggt

SEQ ID NO: 818834 - DNA, 25 bp, Mus musculus
tggccgggcgtcagtacattcaatg

SEQ ID NO: 818835 - DNA, 25 bp, Mus musculus
tggccgggcgtctgtacattcaatg

SEQ ID NO: 818836 - DNA, 25 bp, Mus musculus
tggccgggctgactcactccgttgt

SEQ ID NO: 818837 - DNA, 25 bp, Mus musculus
tggccgggctgagtcactccgttgt

SEQ ID NO: 818838 - DNA, 25 bp, Mus musculus
tggccgggtcatctctacttggatc

SEQ ID NO: 818839 - DNA, 25 bp, Mus musculus
tggccgggtcatgtctacttggatc

SEQ ID NO: 818840 - DNA, 25 bp, Mus musculus
tggccgggtttcctgggcgaaggcg

SEQ ID NO: 818841 - DNA, 25 bp, Mus musculus
tggccgggtttcgtgggcgaaggcg

SEQ ID NO: 818842 - DNA, 25 bp, Mus musculus
tggccggtgaacacaaacagggcgc

SEQ ID NO: 818843 - DNA, 25 bp, Mus musculus
tggccggtgaactcaaacagggcgc

SEQ ID NO: 818844 - DNA, 25 bp, Mus musculus
tggccggttaccagctctactgtcc

SEQ ID NO: 818845 - DNA, 25 bp, Mus musculus
tggccggttacctgctctactgtcc

SEQ ID NO: 818846 - DNA, 25 bp, Mus musculus
tggccggttgccctcacagggacat

SEQ ID NO: 818847 - DNA, 25 bp, Mus musculus
tggccggttgccgtcacagggacat

SEQ ID NO: 818848 - DNA, 25 bp, Mus musculus
tggccgtaccccagacttctttggc

SEQ ID NO: 818849 - DNA, 25 bp, Mus musculus
tggccgtacccctgacttctttggc

SEQ ID NO: 818850 - DNA, 25 bp, Mus musculus
tggccgtacgcacattcaaggagct

SEQ ID NO: 818851 - DNA, 25 bp, Mus musculus
tggccgtacgcagattcaaggagct

SEQ ID NO: 818852 - DNA, 25 bp, Mus musculus
tggccgtaggtgctcgcggccaccg

SEQ ID NO: 818853 - DNA, 25 bp, Mus musculus
tggccgtaggtggtcgcggccaccg

SEQ ID NO: 818854 - DNA, 25 bp, Mus musculus
tggccgtattatacttattctagag

SEQ ID NO: 818855 - DNA, 25 bp, Mus musculus
tggccgtattattcttattctagag

SEQ ID NO: 818856 - DNA, 25 bp, Mus musculus
tggccgtccctcagtaaatagcaaa

SEQ ID NO: 818857 - DNA, 25 bp, Mus musculus
tggccgtccctctgtaaatagcaaa

SEQ ID NO: 818858 - DNA, 25 bp, Mus musculus
tggccgtcggttatctgagggaaca

SEQ ID NO: 818859 - DNA, 25 bp, Mus musculus
tggccgtcggttttctgagggaaca

SEQ ID NO: 818860 - DNA, 25 bp, Mus musculus
tggccgtcttttccagcctgcagag

SEQ ID NO: 818861 - DNA, 25 bp, Mus musculus
tggccgtcttttgcagcctgcagag

SEQ ID NO: 818862 - DNA, 25 bp, Mus musculus
tggccgtgataaagggcttccggaa

SEQ ID NO: 818863 - DNA, 25 bp, Mus musculus
tggccgtgataatgggcttccggaa

SEQ ID NO: 818864 - DNA, 25 bp, Mus musculus
tggccgtgatgtccccatgcctctg

SEQ ID NO: 818865 - DNA, 25 bp, Mus musculus
tggccgtgatgtgcccatgcctctg

SEQ ID NO: 818866 - DNA, 25 bp, Mus musculus
tggccgtgctcactgaccagaagga

SEQ ID NO: 818867 - DNA, 25 bp, Mus musculus
tggccgtgctcagtgaccagaagga

SEQ ID NO: 818868 - DNA, 25 bp, Mus musculus
tggccgtggtaaagaccaggtagca

SEQ ID NO: 818869 - DNA, 25 bp, Mus musculus
tggccgtggtaatgaccaggtagca

SEQ ID NO: 818870 - DNA, 25 bp, Mus musculus
tggccgtgttctctgactcagcaag

SEQ ID NO: 818871 - DNA, 25 bp, Mus musculus
tggccgtgttctgtgactcagcaag

SEQ ID NO: 818872 - DNA, 25 bp, Mus musculus
tggccgtttactacctctttgctga

SEQ ID NO: 818873 - DNA, 25 bp, Mus musculus
tggccgtttacttcctctttgctga

SEQ ID NO: 818874 - DNA, 25 bp, Mus musculus
tggcctaagttgcttccagagtcac

SEQ ID NO: 818875 - DNA, 25 bp, Mus musculus
tggcctaagttggttccagagtcac

SEQ ID NO: 818876 - DNA, 25 bp, Mus musculus
tggcctaatgaaaacctggtgtgtg

SEQ ID NO: 818877 - DNA, 25 bp, Mus musculus
tggcctaatgaatacctggtgtgtg

SEQ ID NO: 818878 - DNA, 25 bp, Mus musculus
tggcctaattcgaggaaggatacag

SEQ ID NO: 818879 - DNA, 25 bp, Mus musculus
tggcctaattcgtggaaggatacag

SEQ ID NO: 818880 - DNA, 25 bp, Mus musculus
tggcctacaagcaatccccactgag

SEQ ID NO: 818881 - DNA, 25 bp, Mus musculus
tggcctacaagctatccccactgag

SEQ ID NO: 818882 - DNA, 25 bp, Mus musculus
tggcctacagtaagctttctttcag

SEQ ID NO: 818883 - DNA, 25 bp, Mus musculus
tggcctacagtatgctttctttcag

SEQ ID NO: 818884 - DNA, 25 bp, Mus musculus
tggcctacatagctgttgctatttg

SEQ ID NO: 818885 - DNA, 25 bp, Mus musculus
tggcctacataggtgttgctatttg

SEQ ID NO: 818886 - DNA, 25 bp, Mus musculus
tggcctacctggagacacgtctggc

SEQ ID NO: 818887 - DNA, 25 bp, Mus musculus
tggcctacctggctgccaagcctag

SEQ ID NO: 818888 - DNA, 25 bp, Mus musculus
tggcctacctgggtgccaagcctag

SEQ ID NO: 818889 - DNA, 25 bp, Mus musculus
tggcctacctggtgacacgtctggc

SEQ ID NO: 818890 - DNA, 25 bp, Mus musculus
tggcctaccttaatgcagaccaagg

SEQ ID NO: 818891 - DNA, 25 bp, Mus musculus
tggcctaccttattgcagaccaagg

SEQ ID NO: 818892 - DNA, 25 bp, Mus musculus
tggcctactcggaggcccattggac

SEQ ID NO: 818893 - DNA, 25 bp, Mus musculus
tggcctactcggtggcccattggac

SEQ ID NO: 818894 - DNA, 25 bp, Mus musculus
tggcctactgccagacgtttctctt

SEQ ID NO: 818895 - DNA, 25 bp, Mus musculus
tggcctactgcctgacgtttctctt

SEQ ID NO: 818896 - DNA, 25 bp, Mus musculus
tggcctagagagagacactcggtat

SEQ ID NO: 818897 - DNA, 25 bp, Mus musculus
tggcctagagagtgacactcggtat

SEQ ID NO: 818898 - DNA, 25 bp, Mus musculus
tggcctaggccaaggtcacccttaa

SEQ ID NO: 818899 - DNA, 25 bp, Mus musculus
tggcctaggccatggtcacccttaa

SEQ ID NO: 818900 - DNA, 25 bp, Mus musculus
tggcctaggtggatgcgtatctgaa

SEQ ID NO: 818901 - DNA, 25 bp, Mus musculus
tggcctaggtggttgcgtatctgaa

SEQ ID NO: 818902 - DNA, 25 bp, Mus musculus
tggcctatgctgaccggctggagac

SEQ ID NO: 818903 - DNA, 25 bp, Mus musculus
tggcctatgctgtccggctggagac

SEQ ID NO: 818904 - DNA, 25 bp, Mus musculus
tggcctatggtgagaccactcaggc

SEQ ID NO: 818905 - DNA, 25 bp, Mus musculus
tggcctatggtgtgaccactcaggc

SEQ ID NO: 818906 - DNA, 25 bp, Mus musculus
tggcctatggttcatggtttgatca

SEQ ID NO: 818907 - DNA, 25 bp, Mus musculus
tggcctatggttgatggtttgatca

SEQ ID NO: 818908 - DNA, 25 bp, Mus musculus
tggcctcaacagagaagggtatgct

SEQ ID NO: 818909 - DNA, 25 bp, Mus musculus
tggcctcaacagtgaagggtatgct

SEQ ID NO: 818910 - DNA, 25 bp, Mus musculus
tggcctcaacatctacaatctctat

SEQ ID NO: 818911 - DNA, 25 bp, Mus musculus
tggcctcaacatgtacaatctctat

SEQ ID NO: 818912 - DNA, 25 bp, Mus musculus
tggcctcaactcctcaaaagtctgg

SEQ ID NO: 818913 - DNA, 25 bp, Mus musculus
tggcctcaactcgtcaaaagtctgg

SEQ ID NO: 818914 - DNA, 25 bp, Mus musculus
tggcctcaaggaaaggcgctccccg

SEQ ID NO: 818915 - DNA, 25 bp, Mus musculus
tggcctcaaggataggcgctccccg

SEQ ID NO: 818916 - DNA, 25 bp, Mus musculus
tggcctcaatgtaaagcttttctgg

SEQ ID NO: 818917 - DNA, 25 bp, Mus musculus
tggcctcaatgttaagcttttctgg

SEQ ID NO: 818918 - DNA, 25 bp, Mus musculus
tggcctcacaccaaccggacaggaa

SEQ ID NO: 818919 - DNA, 25 bp, Mus musculus
tggcctcacacctaccggacaggaa

SEQ ID NO: 818920 - DNA, 25 bp, Mus musculus
tggcctcacagccaaccagcgattt

SEQ ID NO: 818921 - DNA, 25 bp, Mus musculus
tggcctcacagcgaaccagcgattt

SEQ ID NO: 818922 - DNA, 25 bp, Mus musculus
tggcctcaccttctacatccgggaa

SEQ ID NO: 818923 - DNA, 25 bp, Mus musculus
tggcctcaccttgtacatccgggaa

SEQ ID NO: 818924 - DNA, 25 bp, Mus musculus
tggcctcagccgagggtgtcacaca

SEQ ID NO: 818925 - DNA, 25 bp, Mus musculus
tggcctcagccgtgggtgtcacaca

SEQ ID NO: 818926 - DNA, 25 bp, Mus musculus
tggcctcaggaactggcacccattg

SEQ ID NO: 818927 - DNA, 25 bp, Mus musculus
tggcctcaggaagtggcacccattg

SEQ ID NO: 818928 - DNA, 25 bp, Mus musculus
tggcctcaggccagaatccactatg

SEQ ID NO: 818929 - DNA, 25 bp, Mus musculus
tggcctcaggcctgaatccactatg

SEQ ID NO: 818930 - DNA, 25 bp, Mus musculus
tggcctcagggccatgcggatggag

SEQ ID NO: 818931 - DNA, 25 bp, Mus musculus
tggcctcagggcgatgcggatggag

SEQ ID NO: 818932 - DNA, 25 bp, Mus musculus
tggcctcatccgaaacctgtctcgg

SEQ ID NO: 818933 - DNA, 25 bp, Mus musculus
tggcctcatccgtaacctgtctcgg

SEQ ID NO: 818934 - DNA, 25 bp, Mus musculus
tggcctcattcgagtcgttgcgtcg

SEQ ID NO: 818935 - DNA, 25 bp, Mus musculus
tggcctcattcgtgtcgttgcgtcg

SEQ ID NO: 818936 - DNA, 25 bp, Mus musculus
tggcctccagacaaccgtgagcttg

SEQ ID NO: 818937 - DNA, 25 bp, Mus musculus
tggcctccagacctagtaaagtaaa

SEQ ID NO: 818938 - DNA, 25 bp, Mus musculus
tggcctccagacgtagtaaagtaaa

SEQ ID NO: 818939 - DNA, 25 bp, Mus musculus
tggcctccagactaccgtgagcttg

SEQ ID NO: 818940 - DNA, 25 bp, Mus musculus
tggcctccaggaacgcagagggctt

SEQ ID NO: 818941 - DNA, 25 bp, Mus musculus
tggcctccaggatcgcagagggctt

SEQ ID NO: 818942 - DNA, 25 bp, Mus musculus
tggcctccagtcattgaagaagcca

SEQ ID NO: 818943 - DNA, 25 bp, Mus musculus
tggcctccagtctttgaagaagcca

SEQ ID NO: 818944 - DNA, 25 bp, Mus musculus
tggcctccatcactgtgtgtggtaa

SEQ ID NO: 818945 - DNA, 25 bp, Mus musculus
tggcctccatcagtgtgtgtggtaa

SEQ ID NO: 818946 - DNA, 25 bp, Mus musculus
tggcctccccatcgccaacctgagt

SEQ ID NO: 818947 - DNA, 25 bp, Mus musculus
tggcctccccatggccaacctgagt

SEQ ID NO: 818948 - DNA, 25 bp, Mus musculus
tggcctccctcgaggaagtgccctt

SEQ ID NO: 818949 - DNA, 25 bp, Mus musculus
tggcctccctcgtggaagtgccctt

SEQ ID NO: 818950 - DNA, 25 bp, Mus musculus
tggcctcccttccagagactactat

SEQ ID NO: 818951 - DNA, 25 bp, Mus musculus
tggcctcccttcgagagactactat

SEQ ID NO: 818952 - DNA, 25 bp, Mus musculus
tggcctcctcctcttaactgcagga

SEQ ID NO: 818953 - DNA, 25 bp, Mus musculus
tggcctcctcctgttaactgcagga

SEQ ID NO: 818954 - DNA, 25 bp, Mus musculus
tggcctcctcgccttgatcaatgaa

SEQ ID NO: 818955 - DNA, 25 bp, Mus musculus
tggcctcctcgcgttgatcaatgaa

SEQ ID NO: 818956 - DNA, 25 bp, Mus musculus
tggcctcctgatagagaacgctcag

SEQ ID NO: 818957 - DNA, 25 bp, Mus musculus
tggcctcctgattgagaacgctcag

SEQ ID NO: 818958 - DNA, 25 bp, Mus musculus
tggcctcctgggatcggcgcctttc

SEQ ID NO: 818959 - DNA, 25 bp, Mus musculus
tggcctcctgggttcggcgcctttc

SEQ ID NO: 818960 - DNA, 25 bp, Mus musculus
tggcctcgcccaacaaatgatcagc

SEQ ID NO: 818961 - DNA, 25 bp, Mus musculus
tggcctcgcccatcaaatgatcagc

SEQ ID NO: 818962 - DNA, 25 bp, Mus musculus
tggcctcgggatcacacttgtcact

SEQ ID NO: 818963 - DNA, 25 bp, Mus musculus
tggcctcgggatgacacttgtcact

SEQ ID NO: 818964 - DNA, 25 bp, Mus musculus
tggcctctacccaggtctcatctgg

SEQ ID NO: 818965 - DNA, 25 bp, Mus musculus
tggcctctaccctggtctcatctgg

SEQ ID NO: 818966 - DNA, 25 bp, Mus musculus
tggcctctcataagcaagaacaaga

SEQ ID NO: 818967 - DNA, 25 bp, Mus musculus
tggcctctcatatgcaagaacaaga

SEQ ID NO: 818968 - DNA, 25 bp, Mus musculus
tggcctctcgtacccctgaggagat

SEQ ID NO: 818969 - DNA, 25 bp, Mus musculus
tggcctctcgtagccctgaggagat

SEQ ID NO: 818970 - DNA, 25 bp, Mus musculus
tggcctctgatgatctgagggatgt

SEQ ID NO: 818971 - DNA, 25 bp, Mus musculus
tggcctctgatgttctgagggatgt

SEQ ID NO: 818972 - DNA, 25 bp, Mus musculus
tggcctctgccaagggccctgtgag

SEQ ID NO: 818973 - DNA, 25 bp, Mus musculus
tggcctctgccatgggccctgtgag

SEQ ID NO: 818974 - DNA, 25 bp, Mus musculus
tggcctctggagacttaaagcaagt

SEQ ID NO: 818975 - DNA, 25 bp, Mus musculus
tggcctctggagtcttaaagcaagt

SEQ ID NO: 818976 - DNA, 25 bp, Mus musculus
tggcctctgttacactcctgtgtgg

SEQ ID NO: 818977 - DNA, 25 bp, Mus musculus
tggcctctgttagactcctgtgtgg

SEQ ID NO: 818978 - DNA, 25 bp, Mus musculus
tggcctcttctacctgctggacgag

SEQ ID NO: 818979 - DNA, 25 bp, Mus musculus
tggcctcttctagctgctggacgag

SEQ ID NO: 818980 - DNA, 25 bp, Mus musculus
tggcctcttgatcagtactggtgac

SEQ ID NO: 818981 - DNA, 25 bp, Mus musculus
tggcctcttgatgagtactggtgac

SEQ ID NO: 818982 - DNA, 25 bp, Mus musculus
tggcctcttggaaaactgtatggaa

SEQ ID NO: 818983 - DNA, 25 bp, Mus musculus
tggcctcttggataactgtatggaa

SEQ ID NO: 818984 - DNA, 25 bp, Mus musculus
tggcctctttagacaagacagtggg

SEQ ID NO: 818985 - DNA, 25 bp, Mus musculus
tggcctctttagtcaagacagtggg

SEQ ID NO: 818986 - DNA, 25 bp, Mus musculus
tggcctctttgcctccctgggaatg

SEQ ID NO: 818987 - DNA, 25 bp, Mus musculus
tggcctctttgcgtccctgggaatg

SEQ ID NO: 818988 - DNA, 25 bp, Mus musculus
tggcctgaaaatccgaccttgtatc

SEQ ID NO: 818989 - DNA, 25 bp, Mus musculus
tggcctgaaaatgcgaccttgtatc

SEQ ID NO: 818990 - DNA, 25 bp, Mus musculus
tggcctgaaggaaatgcgtttggct

SEQ ID NO: 818991 - DNA, 25 bp, Mus musculus
tggcctgaaggaccatcagataatc

SEQ ID NO: 818992 - DNA, 25 bp, Mus musculus
tggcctgaaggagcatcagataatc

SEQ ID NO: 818993 - DNA, 25 bp, Mus musculus
tggcctgaaggatatgcgtttggct

SEQ ID NO: 818994 - DNA, 25 bp, Mus musculus
tggcctgacactctggcccctgtgg

SEQ ID NO: 818995 - DNA, 25 bp, Mus musculus
tggcctgacactgtggcccctgtgg

SEQ ID NO: 818996 - DNA, 25 bp, Mus musculus
tggcctgaccagagccttgggtcag

SEQ ID NO: 818997 - DNA, 25 bp, Mus musculus
tggcctgaccagtgccttgggtcag

SEQ ID NO: 818998 - DNA, 25 bp, Mus musculus
tggcctgacctacaggtgcagctgc

SEQ ID NO: 818999 - DNA, 25 bp, Mus musculus
tggcctgacctagaggtgcagctgc

SEQ ID NO: 819000 - DNA, 25 bp, Mus musculus
tggcctgactgaccttcacagcttg

SEQ ID NO: 819001 - DNA, 25 bp, Mus musculus
tggcctgactgagcttcacagcttg

SEQ ID NO: 819002 - DNA, 25 bp, Mus musculus
tggcctgagcaacttctcggaatac

SEQ ID NO: 819003 - DNA, 25 bp, Mus musculus
tggcctgagcaagttctcggaatac

SEQ ID NO: 819004 - DNA, 25 bp, Mus musculus
tggcctgagccaagtacctcatttg

SEQ ID NO: 819005 - DNA, 25 bp, Mus musculus
tggcctgagccatgtacctcatttg

SEQ ID NO: 819006 - DNA, 25 bp, Mus musculus
tggcctgagcgtagttgtgacaaca

SEQ ID NO: 819007 - DNA, 25 bp, Mus musculus
tggcctgagcgttgttgtgacaaca

SEQ ID NO: 819008 - DNA, 25 bp, Mus musculus
tggcctgagtcgcattacccaccag

SEQ ID NO: 819009 - DNA, 25 bp, Mus musculus
tggcctgagtcggattacccaccag

SEQ ID NO: 819010 - DNA, 25 bp, Mus musculus
tggcctgatgtacatgttcacacct

SEQ ID NO: 819011 - DNA, 25 bp, Mus musculus
tggcctgatgtagatgttcacacct

SEQ ID NO: 819012 - DNA, 25 bp, Mus musculus
tggcctgatgtcaaaccccgagaga

SEQ ID NO: 819013 - DNA, 25 bp, Mus musculus
tggcctgatgtctaaccccgagaga

SEQ ID NO: 819014 - DNA, 25 bp, Mus musculus
tggcctgattgcatttgccagctac

SEQ ID NO: 819015 - DNA, 25 bp, Mus musculus
tggcctgattgcttttgccagctac

SEQ ID NO: 819016 - DNA, 25 bp, Mus musculus
tggcctgattggagttcaataaaca

SEQ ID NO: 819017 - DNA, 25 bp, Mus musculus
tggcctgattggtgttcaataaaca

SEQ ID NO: 819018 - DNA, 25 bp, Mus musculus
tggcctgcaaagcttaccgggactt

SEQ ID NO: 819019 - DNA, 25 bp, Mus musculus
tggcctgcaaaggttaccgggactt

SEQ ID NO: 819020 - DNA, 25 bp, Mus musculus
tggcctgcaccaactggaagcgagt

SEQ ID NO: 819021 - DNA, 25 bp, Mus musculus
tggcctgcaccatctggaagcgagt

SEQ ID NO: 819022 - DNA, 25 bp, Mus musculus
tggcctgcagctagctcccgatggg

SEQ ID NO: 819023 - DNA, 25 bp, Mus musculus
tggcctgcagcttgctcccgatggg

SEQ ID NO: 819024 - DNA, 25 bp, Mus musculus
tggcctgcaggcctacacagaagtg

SEQ ID NO: 819025 - DNA, 25 bp, Mus musculus
tggcctgcaggcgtacacagaagtg

SEQ ID NO: 819026 - DNA, 25 bp, Mus musculus
tggcctgcagtcactggagacctca

SEQ ID NO: 819027 - DNA, 25 bp, Mus musculus
tggcctgcagtctctggagacctca

SEQ ID NO: 819028 - DNA, 25 bp, Mus musculus
tggcctgcatgaatgtgaactttgc

SEQ ID NO: 819029 - DNA, 25 bp, Mus musculus
tggcctgcatgattgtgaactttgc

SEQ ID NO: 819030 - DNA, 25 bp, Mus musculus
tggcctgcggccattgttcgagaag

SEQ ID NO: 819031 - DNA, 25 bp, Mus musculus
tggcctgcggcctttgttcgagaag

SEQ ID NO: 819032 - DNA, 25 bp, Mus musculus
tggcctgcgttcatcgggcgagcct

SEQ ID NO: 819033 - DNA, 25 bp, Mus musculus
tggcctgcgttcttcgggcgagcct

SEQ ID NO: 819034 - DNA, 25 bp, Mus musculus
tggcctgctggaccgagacacgctc

SEQ ID NO: 819035 - DNA, 25 bp, Mus musculus
tggcctgctggagcgagacacgctc

SEQ ID NO: 819036 - DNA, 25 bp, Mus musculus
tggcctggaaaacgttaagtactga

SEQ ID NO: 819037 - DNA, 25 bp, Mus musculus
tggcctggaaaaggttaagtactga

SEQ ID NO: 819038 - DNA, 25 bp, Mus musculus
tggcctggaaacaggctcctgccct

SEQ ID NO: 819039 - DNA, 25 bp, Mus musculus
tggcctggaaactggctcctgccct

SEQ ID NO: 819040 - DNA, 25 bp, Mus musculus
tggcctggactgcaaagagggagct

SEQ ID NO: 819041 - DNA, 25 bp, Mus musculus
tggcctggactggaaagagggagct

SEQ ID NO: 819042 - DNA, 25 bp, Mus musculus
tggcctggagataaagctctgcctg

SEQ ID NO: 819043 - DNA, 25 bp, Mus musculus
tggcctggagattaagctctgcctg

SEQ ID NO: 819044 - DNA, 25 bp, Mus musculus
tggcctggcagtatgggccttgtac

SEQ ID NO: 819045 - DNA, 25 bp, Mus musculus
tggcctggcagtttgggccttgtac

SEQ ID NO: 819046 - DNA, 25 bp, Mus musculus
tggcctggcatacatgttcacacct

SEQ ID NO: 819047 - DNA, 25 bp, Mus musculus
tggcctggcatagatgttcacacct

SEQ ID NO: 819048 - DNA, 25 bp, Mus musculus
tggcctggcatgcaaactacacacc

SEQ ID NO: 819049 - DNA, 25 bp, Mus musculus
tggcctggcatggaaactacacacc

SEQ ID NO: 819050 - DNA, 25 bp, Mus musculus
tggcctggcctaactgaatggttca

SEQ ID NO: 819051 - DNA, 25 bp, Mus musculus
tggcctggcctaagccgttcctcag

SEQ ID NO: 819052 - DNA, 25 bp, Mus musculus
tggcctggcctatctgaatggttca

SEQ ID NO: 819053 - DNA, 25 bp, Mus musculus
tggcctggcctatgccgttcctcag

SEQ ID NO: 819054 - DNA, 25 bp, Mus musculus
tggcctggcctcactgacgtctagg

SEQ ID NO: 819055 - DNA, 25 bp, Mus musculus
tggcctggcctctctgacgtctagg

SEQ ID NO: 819056 - DNA, 25 bp, Mus musculus
tggcctggctcgagatgtgcacaac

SEQ ID NO: 819057 - DNA, 25 bp, Mus musculus
tggcctggctcgtgatgtgcacaac

SEQ ID NO: 819058 - DNA, 25 bp, Mus musculus
tggcctggctgtcgcaacacaactt

SEQ ID NO: 819059 - DNA, 25 bp, Mus musculus
tggcctggctgtggcaacacaactt

SEQ ID NO: 819060 - DNA, 25 bp, Mus musculus
tggcctgggaaaccatcctgatgga

SEQ ID NO: 819061 - DNA, 25 bp, Mus musculus
tggcctgggaaagcatcctgatgga

SEQ ID NO: 819062 - DNA, 25 bp, Mus musculus
tggcctgggcctaagaagcagcacc

SEQ ID NO: 819063 - DNA, 25 bp, Mus musculus
tggcctgggccttagaagcagcacc

SEQ ID NO: 819064 - DNA, 25 bp, Mus musculus
tggcctgggtgtcctgagccccttt

SEQ ID NO: 819065 - DNA, 25 bp, Mus musculus
tggcctgggtgtgctgagccccttt

SEQ ID NO: 819066 - DNA, 25 bp, Mus musculus
tggcctgtaggcaacttggtcttgg

SEQ ID NO: 819067 - DNA, 25 bp, Mus musculus
tggcctgtaggctacttggtcttgg

SEQ ID NO: 819068 - DNA, 25 bp, Mus musculus
tggcctgtcactagcctgtcttgtt

SEQ ID NO: 819069 - DNA, 25 bp, Mus musculus
tggcctgtcacttgcctgtcttgtt

SEQ ID NO: 819070 - DNA, 25 bp, Mus musculus
tggcctgtctgaccgttaatgacgt

SEQ ID NO: 819071 - DNA, 25 bp, Mus musculus
tggcctgtctgagcgttaatgacgt

SEQ ID NO: 819072 - DNA, 25 bp, Mus musculus
tggcctgtgccccaggtagcatcgt

SEQ ID NO: 819073 - DNA, 25 bp, Mus musculus
tggcctgtgcccgaggtagcatcgt

SEQ ID NO: 819074 - DNA, 25 bp, Mus musculus
tggcctgtgccgaacagaccctgct

SEQ ID NO: 819075 - DNA, 25 bp, Mus musculus
tggcctgtgccgtacagaccctgct

SEQ ID NO: 819076 - DNA, 25 bp, Mus musculus
tggcctgtgcctcgatgaggcaccc

SEQ ID NO: 819077 - DNA, 25 bp, Mus musculus
tggcctgtgcctggatgaggcaccc

SEQ ID NO: 819078 - DNA, 25 bp, Mus musculus
tggcctgtgtctccaggtccaaccg

SEQ ID NO: 819079 - DNA, 25 bp, Mus musculus
tggcctgtgtctgcaggtccaaccg

SEQ ID NO: 819080 - DNA, 25 bp, Mus musculus
tggcctgttcctcagcgccagaggc

SEQ ID NO: 819081 - DNA, 25 bp, Mus musculus
tggcctgttcctgagcgccagaggc

SEQ ID NO: 819082 - DNA, 25 bp, Mus musculus
tggcctgtttccagggtcgagcaga

SEQ ID NO: 819083 - DNA, 25 bp, Mus musculus
tggcctgtttcctgggtcgagcaga

SEQ ID NO: 819084 - DNA, 25 bp, Mus musculus
tggccttacaaaagccagaaggcct

SEQ ID NO: 819085 - DNA, 25 bp, Mus musculus
tggccttacaaatgccagaaggcct

SEQ ID NO: 819086 - DNA, 25 bp, Mus musculus
tggccttaccaaccaggaagattgc

SEQ ID NO: 819087 - DNA, 25 bp, Mus musculus
tggccttaccaagcaggaagattgc

SEQ ID NO: 819088 - DNA, 25 bp, Mus musculus
tggccttaccatcgtgtgtccctgc

SEQ ID NO: 819089 - DNA, 25 bp, Mus musculus
tggccttaccatggtgtgtccctgc

SEQ ID NO: 819090 - DNA, 25 bp, Mus musculus
tggccttactacattgggtttggct

SEQ ID NO: 819091 - DNA, 25 bp, Mus musculus
tggccttactactttgggtttggct

SEQ ID NO: 819092 - DNA, 25 bp, Mus musculus
tggccttagagcaccaaccggcagt

SEQ ID NO: 819093 - DNA, 25 bp, Mus musculus
tggccttagagctccaaccggcagt

SEQ ID NO: 819094 - DNA, 25 bp, Mus musculus
tggccttagaggacaatgagttcgt

SEQ ID NO: 819095 - DNA, 25 bp, Mus musculus
tggccttagaggtcaatgagttcgt

SEQ ID NO: 819096 - DNA, 25 bp, Mus musculus
tggccttagtggaccttaccgtcat

SEQ ID NO: 819097 - DNA, 25 bp, Mus musculus
tggccttagtggtccttaccgtcat

SEQ ID NO: 819098 - DNA, 25 bp, Mus musculus
tggccttatggaccaaggacaccat

SEQ ID NO: 819099 - DNA, 25 bp, Mus musculus
tggccttatggagcaaggacaccat

SEQ ID NO: 819100 - DNA, 25 bp, Mus musculus
tggccttcaaacaccggatcaacaa

SEQ ID NO: 819101 - DNA, 25 bp, Mus musculus
tggccttcaaactccggatcaacaa

SEQ ID NO: 819102 - DNA, 25 bp, Mus musculus
tggccttcaagacggagatgtcgtc

SEQ ID NO: 819103 - DNA, 25 bp, Mus musculus
tggccttcaagagggagatgtcgtc

SEQ ID NO: 819104 - DNA, 25 bp, Mus musculus
tggccttcatccagttcctcttcat

SEQ ID NO: 819105 - DNA, 25 bp, Mus musculus
tggccttcatcctgttcctcttcat

SEQ ID NO: 819106 - DNA, 25 bp, Mus musculus
tggccttcatcgatttcacagaagc

SEQ ID NO: 819107 - DNA, 25 bp, Mus musculus
tggccttcatcgttttcacagaagc

SEQ ID NO: 819108 - DNA, 25 bp, Mus musculus
tggccttcatggagacttccggagg

SEQ ID NO: 819109 - DNA, 25 bp, Mus musculus
tggccttcatggtgacttccggagg

SEQ ID NO: 819110 - DNA, 25 bp, Mus musculus
tggccttccaacctacgtagcagaa

SEQ ID NO: 819111 - DNA, 25 bp, Mus musculus
tggccttccaacgtacgtagcagaa

SEQ ID NO: 819112 - DNA, 25 bp, Mus musculus
tggccttccaatcgacaccacggag

SEQ ID NO: 819113 - DNA, 25 bp, Mus musculus
tggccttccaatggacaccacggag

SEQ ID NO: 819114 - DNA, 25 bp, Mus musculus
tggccttccaggactctaacgacgt

SEQ ID NO: 819115 - DNA, 25 bp, Mus musculus
tggccttccaggtctctaacgacgt

SEQ ID NO: 819116 - DNA, 25 bp, Mus musculus
tggccttcctccctggcttctttgg

SEQ ID NO: 819117 - DNA, 25 bp, Mus musculus
tggccttcctccgtggcttctttgg

SEQ ID NO: 819118 - DNA, 25 bp, Mus musculus
tggccttcgctgatagctacgtcag

SEQ ID NO: 819119 - DNA, 25 bp, Mus musculus
tggccttcgctgttagctacgtcag

SEQ ID NO: 819120 - DNA, 25 bp, Mus musculus
tggccttcgtcaccaagactcgggt

SEQ ID NO: 819121 - DNA, 25 bp, Mus musculus
tggccttcgtcagcaagactcgggt

SEQ ID NO: 819122 - DNA, 25 bp, Mus musculus
tggccttctgccagggcacatcagc

SEQ ID NO: 819123 - DNA, 25 bp, Mus musculus
tggccttctgcctgggcacatcagc

SEQ ID NO: 819124 - DNA, 25 bp, Mus musculus
tggccttctggacattctacaaccc

SEQ ID NO: 819125 - DNA, 25 bp, Mus musculus
tggccttctggagattctacaaccc

SEQ ID NO: 819126 - DNA, 25 bp, Mus musculus
tggccttctgtgatgaggactacaa

SEQ ID NO: 819127 - DNA, 25 bp, Mus musculus
tggccttctgtgttgaggactacaa

SEQ ID NO: 819128 - DNA, 25 bp, Mus musculus
tggccttgaaaaacgctgggcgaat

SEQ ID NO: 819129 - DNA, 25 bp, Mus musculus
tggccttgaaaatcgctgggcgaat

SEQ ID NO: 819130 - DNA, 25 bp, Mus musculus
tggccttgaactaggtggttctgat

SEQ ID NO: 819131 - DNA, 25 bp, Mus musculus
tggccttgaacttggtggttctgat

SEQ ID NO: 819132 - DNA, 25 bp, Mus musculus
tggccttggactagaacatatgaca

SEQ ID NO: 819133 - DNA, 25 bp, Mus musculus
tggccttggactaggccagtctggc

SEQ ID NO: 819134 - DNA, 25 bp, Mus musculus
tggccttggacttgaacatatgaca

SEQ ID NO: 819135 - DNA, 25 bp, Mus musculus
tggccttggacttggccagtctggc

SEQ ID NO: 819136 - DNA, 25 bp, Mus musculus
tggccttggcgcaatgggacaacca

SEQ ID NO: 819137 - DNA, 25 bp, Mus musculus
tggccttggcgctatgggacaacca

SEQ ID NO: 819138 - DNA, 25 bp, Mus musculus
tggccttgggccagacccagtcaga

SEQ ID NO: 819139 - DNA, 25 bp, Mus musculus
tggccttgggcctgacccagtcaga

SEQ ID NO: 819140 - DNA, 25 bp, Mus musculus
tggccttggtagacagagcccttcc

SEQ ID NO: 819141 - DNA, 25 bp, Mus musculus
tggccttggtagtcagagcccttcc

SEQ ID NO: 819142 - DNA, 25 bp, Mus musculus
tggccttgtcttcgagtacgcattg

SEQ ID NO: 819143 - DNA, 25 bp, Mus musculus
tggccttgtcttggagtacgcattg

SEQ ID NO: 819144 - DNA, 25 bp, Mus musculus
tggcctttagcgcttcatccttggt

SEQ ID NO: 819145 - DNA, 25 bp, Mus musculus
tggcctttagcggttcatccttggt

SEQ ID NO: 819146 - DNA, 25 bp, Mus musculus
tggcctttatttcgagacgggtttg

SEQ ID NO: 819147 - DNA, 25 bp, Mus musculus
tggcctttatttggagacgggtttg

SEQ ID NO: 819148 - DNA, 25 bp, Mus musculus
tggccttttggacagcagcagctgc

SEQ ID NO: 819149 - DNA, 25 bp, Mus musculus
tggccttttggagagcagcagctgc

SEQ ID NO: 819150 - DNA, 25 bp, Mus musculus
tggcgaagccccaagtctttggcag

SEQ ID NO: 819151 - DNA, 25 bp, Mus musculus
tggcgaagcccctagtctttggcag

SEQ ID NO: 819152 - DNA, 25 bp, Mus musculus
tggcgaagcggacgccatcttcaaa

SEQ ID NO: 819153 - DNA, 25 bp, Mus musculus
tggcgaagcggaggccatcttcaaa

SEQ ID NO: 819154 - DNA, 25 bp, Mus musculus
tggcgaaggcacaggcagcgctctt

SEQ ID NO: 819155 - DNA, 25 bp, Mus musculus
tggcgaaggcactggcagcgctctt

SEQ ID NO: 819156 - DNA, 25 bp, Mus musculus
tggcgaagtcttctttgagagccct

SEQ ID NO: 819157 - DNA, 25 bp, Mus musculus
tggcgaagtcttgtttgagagccct

SEQ ID NO: 819158 - DNA, 25 bp, Mus musculus
tggcgacagaacctatagcagagtg

SEQ ID NO: 819159 - DNA, 25 bp, Mus musculus
tggcgacagaacgtatagcagagtg

SEQ ID NO: 819160 - DNA, 25 bp, Mus musculus
tggcgaccatgccatgccaccagtg

SEQ ID NO: 819161 - DNA, 25 bp, Mus musculus
tggcgaccatgcgatgccaccagtg

SEQ ID NO: 819162 - DNA, 25 bp, Mus musculus
tggcgacccggtatgttttcagccg

SEQ ID NO: 819163 - DNA, 25 bp, Mus musculus
tggcgacccggtttgttttcagccg

SEQ ID NO: 819164 - DNA, 25 bp, Mus musculus
tggcgacctgctacagcttcgctgt

SEQ ID NO: 819165 - DNA, 25 bp, Mus musculus
tggcgacctgcttcagcttcgctgt

SEQ ID NO: 819166 - DNA, 25 bp, Mus musculus
tggcgacgccgtcagtaagtgacaa

SEQ ID NO: 819167 - DNA, 25 bp, Mus musculus
tggcgacgccgtgagtaagtgacaa

SEQ ID NO: 819168 - DNA, 25 bp, Mus musculus
tggcgactacccagccaatgcagag

SEQ ID NO: 819169 - DNA, 25 bp, Mus musculus
tggcgactaccctgccaatgcagag

SEQ ID NO: 819170 - DNA, 25 bp, Mus musculus
tggcgactaggaccctgtgacccag

SEQ ID NO: 819171 - DNA, 25 bp, Mus musculus
tggcgactaggagcctgtgacccag

SEQ ID NO: 819172 - DNA, 25 bp, Mus musculus
tggcgactccaaactgcatgaaacc

SEQ ID NO: 819173 - DNA, 25 bp, Mus musculus
tggcgactccaatctgcatgaaacc

SEQ ID NO: 819174 - DNA, 25 bp, Mus musculus
tggcgagacactacgggaccagata

SEQ ID NO: 819175 - DNA, 25 bp, Mus musculus
tggcgagacacttcgggaccagata

SEQ ID NO: 819176 - DNA, 25 bp, Mus musculus
tggcgagacattccaagtttggcat

SEQ ID NO: 819177 - DNA, 25 bp, Mus musculus
tggcgagacattgcaagtttggcat

SEQ ID NO: 819178 - DNA, 25 bp, Mus musculus
tggcgagaccacattctgttgcact

SEQ ID NO: 819179 - DNA, 25 bp, Mus musculus
tggcgagaccactttctgttgcact

SEQ ID NO: 819180 - DNA, 25 bp, Mus musculus
tggcgagagcttcccacttactctt

SEQ ID NO: 819181 - DNA, 25 bp, Mus musculus
tggcgagagcttgccacttactctt

SEQ ID NO: 819182 - DNA, 25 bp, Mus musculus
tggcgagatgttctcccacctacgg

SEQ ID NO: 819183 - DNA, 25 bp, Mus musculus
tggcgagatgttgtcccacctacgg

SEQ ID NO: 819184 - DNA, 25 bp, Mus musculus
tggcgagccgatccagcactgtttc

SEQ ID NO: 819185 - DNA, 25 bp, Mus musculus
tggcgagccgatgcagcactgtttc

SEQ ID NO: 819186 - DNA, 25 bp, Mus musculus
tggcgagcgccaatggttaccttca

SEQ ID NO: 819187 - DNA, 25 bp, Mus musculus
tggcgagcgccattggttaccttca

SEQ ID NO: 819188 - DNA, 25 bp, Mus musculus
tggcgagcttatccaggaagacctg

SEQ ID NO: 819189 - DNA, 25 bp, Mus musculus
tggcgagcttatgcaggaagacctg

SEQ ID NO: 819190 - DNA, 25 bp, Mus musculus
tggcgaggactcaccaagggaccta

SEQ ID NO: 819191 - DNA, 25 bp, Mus musculus
tggcgaggactctccaagggaccta

SEQ ID NO: 819192 - DNA, 25 bp, Mus musculus
tggcgaggatgacgacattgctacc

SEQ ID NO: 819193 - DNA, 25 bp, Mus musculus
tggcgaggatgaggacattgctacc

SEQ ID NO: 819194 - DNA, 25 bp, Mus musculus
tggcgaggctttcctacaacgctga

SEQ ID NO: 819195 - DNA, 25 bp, Mus musculus
tggcgaggctttgctacaacgctga

SEQ ID NO: 819196 - DNA, 25 bp, Mus musculus
tggcgagggaagcaaccttcagccc

SEQ ID NO: 819197 - DNA, 25 bp, Mus musculus
tggcgagggaaggaaccttcagccc

SEQ ID NO: 819198 - DNA, 25 bp, Mus musculus
tggcgagggccaactgtgctataac

SEQ ID NO: 819199 - DNA, 25 bp, Mus musculus
tggcgagggccatctgtgctataac

SEQ ID NO: 819200 - DNA, 25 bp, Mus musculus
tggcgagtctctacaaggcttagca

SEQ ID NO: 819201 - DNA, 25 bp, Mus musculus
tggcgagtctcttcaaggcttagca

SEQ ID NO: 819202 - DNA, 25 bp, Mus musculus
tggcgagttagaagctgcccctcac

SEQ ID NO: 819203 - DNA, 25 bp, Mus musculus
tggcgagttagatgctgcccctcac

SEQ ID NO: 819204 - DNA, 25 bp, Mus musculus
tggcgatatcggcatcggaaccccg

SEQ ID NO: 819205 - DNA, 25 bp, Mus musculus
tggcgatatcgggatcggaaccccg

SEQ ID NO: 819206 - DNA, 25 bp, Mus musculus
tggcgatctacaattggcatgcttc

SEQ ID NO: 819207 - DNA, 25 bp, Mus musculus
tggcgatctacatttggcatgcttc

SEQ ID NO: 819208 - DNA, 25 bp, Mus musculus
tggcgatgagccacggaaagtgctc

SEQ ID NO: 819209 - DNA, 25 bp, Mus musculus
tggcgatgagcctcggaaagtgctc

SEQ ID NO: 819210 - DNA, 25 bp, Mus musculus
tggcgatgcaggctttccagaaacc

SEQ ID NO: 819211 - DNA, 25 bp, Mus musculus
tggcgatgcagggtttccagaaacc

SEQ ID NO: 819212 - DNA, 25 bp, Mus musculus
tggcgatgctctccgtcccttggat

SEQ ID NO: 819213 - DNA, 25 bp, Mus musculus
tggcgatgctctgcgtcccttggat

SEQ ID NO: 819214 - DNA, 25 bp, Mus musculus
tggcgatggatcaaggagtttacca

SEQ ID NO: 819215 - DNA, 25 bp, Mus musculus
tggcgatggatctaggagtttacca

SEQ ID NO: 819216 - DNA, 25 bp, Mus musculus
tggcgatgttagaccaaggaaactg

SEQ ID NO: 819217 - DNA, 25 bp, Mus musculus
tggcgatgttagtccaaggaaactg

SEQ ID NO: 819218 - DNA, 25 bp, Mus musculus
tggcgattggcaccttttccaccgg

SEQ ID NO: 819219 - DNA, 25 bp, Mus musculus
tggcgattggcagcttttccaccgg

SEQ ID NO: 819220 - DNA, 25 bp, Mus musculus
tggcgatttgaccacaacagggagt

SEQ ID NO: 819221 - DNA, 25 bp, Mus musculus
tggcgatttgacgacaacagggagt

SEQ ID NO: 819222 - DNA, 25 bp, Mus musculus
tggcgcagaaccctgactcgccgtt

SEQ ID NO: 819223 - DNA, 25 bp, Mus musculus
tggcgcagaaccgtgactcgccgtt

SEQ ID NO: 819224 - DNA, 25 bp, Mus musculus
tggcgcagtagtagcaggacctcta

SEQ ID NO: 819225 - DNA, 25 bp, Mus musculus
tggcgcagtagttgcaggacctcta

SEQ ID NO: 819226 - DNA, 25 bp, Mus musculus
tggcgcagtcctctatgacaagtac

SEQ ID NO: 819227 - DNA, 25 bp, Mus musculus
tggcgcagtcctgtatgacaagtac

SEQ ID NO: 819228 - DNA, 25 bp, Mus musculus
tggcgccagacaatccaatgggaga

SEQ ID NO: 819229 - DNA, 25 bp, Mus musculus
tggcgccagacattccaatgggaga

SEQ ID NO: 819230 - DNA, 25 bp, Mus musculus
tggcgccaggtcaacacgcatgcgc

SEQ ID NO: 819231 - DNA, 25 bp, Mus musculus
tggcgccaggtctacacgcatgcgc

SEQ ID NO: 819232 - DNA, 25 bp, Mus musculus
tggcgccagtccctggacaagcttc

SEQ ID NO: 819233 - DNA, 25 bp, Mus musculus
tggcgccagtccgtggacaagcttc

SEQ ID NO: 819234 - DNA, 25 bp, Mus musculus
tggcgccatcagaggttaccctgcc

SEQ ID NO: 819235 - DNA, 25 bp, Mus musculus
tggcgccatcagtggttaccctgcc

SEQ ID NO: 819236 - DNA, 25 bp, Mus musculus
tggcgcccggttaaaatgcaggttg

SEQ ID NO: 819237 - DNA, 25 bp, Mus musculus
tggcgcccggtttaaatgcaggttg

SEQ ID NO: 819238 - DNA, 25 bp, Mus musculus
tggcgcctactcaggtacccacagg

SEQ ID NO: 819239 - DNA, 25 bp, Mus musculus
tggcgcctactctggtacccacagg

SEQ ID NO: 819240 - DNA, 25 bp, Mus musculus
tggcgcctagcgactcggagaatgt

SEQ ID NO: 819241 - DNA, 25 bp, Mus musculus
tggcgcctagcgtctcggagaatgt

SEQ ID NO: 819242 - DNA, 25 bp, Mus musculus
tggcgcctatgactacgatgaactt

SEQ ID NO: 819243 - DNA, 25 bp, Mus musculus
tggcgcctatgagtacgatgaactt

SEQ ID NO: 819244 - DNA, 25 bp, Mus musculus
tggcgcctgcggaatcagagaactt

SEQ ID NO: 819245 - DNA, 25 bp, Mus musculus
tggcgcctgcggtatcagagaactt

SEQ ID NO: 819246 - DNA, 25 bp, Mus musculus
tggcgcctgggcattaatggctcca

SEQ ID NO: 819247 - DNA, 25 bp, Mus musculus
tggcgcctgggctttaatggctcca

SEQ ID NO: 819248 - DNA, 25 bp, Mus musculus
tggcgcgcagaccagctcctgagct

SEQ ID NO: 819249 - DNA, 25 bp, Mus musculus
tggcgcgcagacgagctcctgagct

SEQ ID NO: 819250 - DNA, 25 bp, Mus musculus
tggcgcgcatgaccagcgaagctcc

SEQ ID NO: 819251 - DNA, 25 bp, Mus musculus
tggcgcgcatgagcagcgaagctcc

SEQ ID NO: 819252 - DNA, 25 bp, Mus musculus
tggcgcgcatggagctcttcatata

SEQ ID NO: 819253 - DNA, 25 bp, Mus musculus
tggcgcgcatggtgctcttcatata

SEQ ID NO: 819254 - DNA, 25 bp, Mus musculus
tggcgcgccggcaagtggcctttcc

SEQ ID NO: 819255 - DNA, 25 bp, Mus musculus
tggcgcgccggctagtggcctttcc

SEQ ID NO: 819256 - DNA, 25 bp, Mus musculus
tggcgcgcgccgactttctccagaa

SEQ ID NO: 819257 - DNA, 25 bp, Mus musculus
tggcgcgcgccgtctttctccagaa

SEQ ID NO: 819258 - DNA, 25 bp, Mus musculus
tggcgcggcacaagcagcagctgtt

SEQ ID NO: 819259 - DNA, 25 bp, Mus musculus
tggcgcggcacatgcagcagctgtt

SEQ ID NO: 819260 - DNA, 25 bp, Mus musculus
tggcgcgtctgcagtacatgaagga

SEQ ID NO: 819261 - DNA, 25 bp, Mus musculus
tggcgcgtctgctgtacatgaagga

SEQ ID NO: 819262 - DNA, 25 bp, Mus musculus
tggcgcgtgcgtaatctgcgccccg

SEQ ID NO: 819263 - DNA, 25 bp, Mus musculus
tggcgcgtgcgttatctgcgccccg

SEQ ID NO: 819264 - DNA, 25 bp, Mus musculus
tggcgctacaggcaacactgagtct

SEQ ID NO: 819265 - DNA, 25 bp, Mus musculus
tggcgctacagggaacactgagtct

SEQ ID NO: 819266 - DNA, 25 bp, Mus musculus
tggcgctaccacatcgagggctttt

SEQ ID NO: 819267 - DNA, 25 bp, Mus musculus
tggcgctaccacttcgagggctttt

SEQ ID NO: 819268 - DNA, 25 bp, Mus musculus
tggcgctattgcagggccagcggca

SEQ ID NO: 819269 - DNA, 25 bp, Mus musculus
tggcgctattgctgggccagcggca

SEQ ID NO: 819270 - DNA, 25 bp, Mus musculus
tggcgctcagcgatgcagatgtaca

SEQ ID NO: 819271 - DNA, 25 bp, Mus musculus
tggcgctcagcgttgcagatgtaca

SEQ ID NO: 819272 - DNA, 25 bp, Mus musculus
tggcgctcatccatctggtgcagga

SEQ ID NO: 819273 - DNA, 25 bp, Mus musculus
tggcgctcatccttctggtgcagga

SEQ ID NO: 819274 - DNA, 25 bp, Mus musculus
tggcgctccgatatgctgcaacagg

SEQ ID NO: 819275 - DNA, 25 bp, Mus musculus
tggcgctccgatttgctgcaacagg

SEQ ID NO: 819276 - DNA, 25 bp, Mus musculus
tggcgctcgcctcggagagtccctt

SEQ ID NO: 819277 - DNA, 25 bp, Mus musculus
tggcgctcgcctgggagagtccctt

SEQ ID NO: 819278 - DNA, 25 bp, Mus musculus
tggcgctcgtctaccgagggacttt

SEQ ID NO: 819279 - DNA, 25 bp, Mus musculus
tggcgctcgtcttccgagggacttt

SEQ ID NO: 819280 - DNA, 25 bp, Mus musculus
tggcgctctaccagcttgctctcag

SEQ ID NO: 819281 - DNA, 25 bp, Mus musculus
tggcgctctacctgcttgctctcag

SEQ ID NO: 819282 - DNA, 25 bp, Mus musculus
tggcgctctctgcttgctgctgctc

SEQ ID NO: 819283 - DNA, 25 bp, Mus musculus
tggcgctctctggttgctgctgctc

SEQ ID NO: 819284 - DNA, 25 bp, Mus musculus
tggcgctcttgtatttgacattgga

SEQ ID NO: 819285 - DNA, 25 bp, Mus musculus
tggcgctcttgtttttgacattgga

SEQ ID NO: 819286 - DNA, 25 bp, Mus musculus
tggcgctctttaatccctggcaggc

SEQ ID NO: 819287 - DNA, 25 bp, Mus musculus
tggcgctctttattccctggcaggc

SEQ ID NO: 819288 - DNA, 25 bp, Mus musculus
tggcgctgacgacatattgaagccc

SEQ ID NO: 819289 - DNA, 25 bp, Mus musculus
tggcgctgacgagatattgaagccc

SEQ ID NO: 819290 - DNA, 25 bp, Mus musculus
tggcgctgcacacggttcttatcat

SEQ ID NO: 819291 - DNA, 25 bp, Mus musculus
tggcgctgcacagggttcttatcat

SEQ ID NO: 819292 - DNA, 25 bp, Mus musculus
tggcgctggctaaggagtcccttct

SEQ ID NO: 819293 - DNA, 25 bp, Mus musculus
tggcgctggctatggagtcccttct

SEQ ID NO: 819294 - DNA, 25 bp, Mus musculus
tggcgctggcttatccgccgttaac

SEQ ID NO: 819295 - DNA, 25 bp, Mus musculus
tggcgctggcttttccgccgttaac

SEQ ID NO: 819296 - DNA, 25 bp, Mus musculus
tggcgctgtgcgcactgtcgccttc

SEQ ID NO: 819297 - DNA, 25 bp, Mus musculus
tggcgctgtgcggactgtcgccttc

SEQ ID NO: 819298 - DNA, 25 bp, Mus musculus
tggcgctgtgtcacggacaggcaca

SEQ ID NO: 819299 - DNA, 25 bp, Mus musculus
tggcgctgtgtctcggacaggcaca

SEQ ID NO: 819300 - DNA, 25 bp, Mus musculus
tggcgcttaaggactacgcgatcga

SEQ ID NO: 819301 - DNA, 25 bp, Mus musculus
tggcgcttaaggtctacgcgatcga

SEQ ID NO: 819302 - DNA, 25 bp, Mus musculus
tggcggaaatctctacacccgtgtc

SEQ ID NO: 819303 - DNA, 25 bp, Mus musculus
tggcggaaatctgtacacccgtgtc

SEQ ID NO: 819304 - DNA, 25 bp, Mus musculus
tggcggaagcgtacgtctcccagat

SEQ ID NO: 819305 - DNA, 25 bp, Mus musculus
tggcggaagcgttcgtctcccagat

SEQ ID NO: 819306 - DNA, 25 bp, Mus musculus
tggcggaaggacatggacactgtct

SEQ ID NO: 819307 - DNA, 25 bp, Mus musculus
tggcggaaggacttggacactgtct

SEQ ID NO: 819308 - DNA, 25 bp, Mus musculus
tggcggacaaaaccattcgaagtat

SEQ ID NO: 819309 - DNA, 25 bp, Mus musculus
tggcggacaaaagcattcgaagtat

SEQ ID NO: 819310 - DNA, 25 bp, Mus musculus
tggcggacctcaaccgcatcttaca

SEQ ID NO: 819311 - DNA, 25 bp, Mus musculus
tggcggacctcatccgcatcttaca

SEQ ID NO: 819312 - DNA, 25 bp, Mus musculus
tggcggagaacaattatgaagccct

SEQ ID NO: 819313 - DNA, 25 bp, Mus musculus
tggcggagaacatttatgaagccct

SEQ ID NO: 819314 - DNA, 25 bp, Mus musculus
tggcggagaaggaaaatctctcagc

SEQ ID NO: 819315 - DNA, 25 bp, Mus musculus
tggcggagaaggtaaatctctcagc

SEQ ID NO: 819316 - DNA, 25 bp, Mus musculus
tggcggagcaggacaaactgaagaa

SEQ ID NO: 819317 - DNA, 25 bp, Mus musculus
tggcggagcaggtcaaactgaagaa

SEQ ID NO: 819318 - DNA, 25 bp, Mus musculus
tggcggagctgcaccccgacgtgtt

SEQ ID NO: 819319 - DNA, 25 bp, Mus musculus
tggcggagctgctccccgacgtgtt

SEQ ID NO: 819320 - DNA, 25 bp, Mus musculus
tggcggatccggaacccacactcaa

SEQ ID NO: 819321 - DNA, 25 bp, Mus musculus
tggcggatccggtacccacactcaa

SEQ ID NO: 819322 - DNA, 25 bp, Mus musculus
tggcggatgatcacaccgatgaata

SEQ ID NO: 819323 - DNA, 25 bp, Mus musculus
tggcggatgatctcaccgatgaata

SEQ ID NO: 819324 - DNA, 25 bp, Mus musculus
tggcggcactgaagtacacagacac

SEQ ID NO: 819325 - DNA, 25 bp, Mus musculus
tggcggcactgatgtacacagacac

SEQ ID NO: 819326 - DNA, 25 bp, Mus musculus
tggcggcaggaaccagcaattactg

SEQ ID NO: 819327 - DNA, 25 bp, Mus musculus
tggcggcaggaagcagcaattactg

SEQ ID NO: 819328 - DNA, 25 bp, Mus musculus
tggcggcccaggatgagttctaccg

SEQ ID NO: 819329 - DNA, 25 bp, Mus musculus
tggcggcccaggttgagttctaccg

SEQ ID NO: 819330 - DNA, 25 bp, Mus musculus
tggcggccgagcatgacttcggctc

SEQ ID NO: 819331 - DNA, 25 bp, Mus musculus
tggcggccgagcttgacttcggctc

SEQ ID NO: 819332 - DNA, 25 bp, Mus musculus
tggcggcggaaaccttgttagtcct

SEQ ID NO: 819333 - DNA, 25 bp, Mus musculus
tggcggcggaaagcttgttagtcct

SEQ ID NO: 819334 - DNA, 25 bp, Mus musculus
tggcggcggacgacttcaggctcaa

SEQ ID NO: 819335 - DNA, 25 bp, Mus musculus
tggcggcggacgtcttcaggctcaa

SEQ ID NO: 819336 - DNA, 25 bp, Mus musculus
tggcggctcaaaagatcgaggtgct

SEQ ID NO: 819337 - DNA, 25 bp, Mus musculus
tggcggctcaaatgatcgaggtgct

SEQ ID NO: 819338 - DNA, 25 bp, Mus musculus
tggcggctgaagaacatcaacagca

SEQ ID NO: 819339 - DNA, 25 bp, Mus musculus
tggcggctgaagtacatcaacagca

SEQ ID NO: 819340 - DNA, 25 bp, Mus musculus
tggcggcttctgagggccatgccaa

SEQ ID NO: 819341 - DNA, 25 bp, Mus musculus
tggcggcttctgtgggccatgccaa

SEQ ID NO: 819342 - DNA, 25 bp, Mus musculus
tggcggcttttcaacctggacttac

SEQ ID NO: 819343 - DNA, 25 bp, Mus musculus
tggcggcttttctacctggacttac

SEQ ID NO: 819344 - DNA, 25 bp, Mus musculus
tggcgggaagaactaaaactgcact

SEQ ID NO: 819345 - DNA, 25 bp, Mus musculus
tggcgggaagaagtaaaactgcact

SEQ ID NO: 819346 - DNA, 25 bp, Mus musculus
tggcgggacccacaccagacagacg

SEQ ID NO: 819347 - DNA, 25 bp, Mus musculus
tggcgggacccagaccagacagacg

SEQ ID NO: 819348 - DNA, 25 bp, Mus musculus
tggcgggatgcacgttatgactatc

SEQ ID NO: 819349 - DNA, 25 bp, Mus musculus
tggcgggatgcaggttatgactatc

SEQ ID NO: 819350 - DNA, 25 bp, Mus musculus
tggcgggcactcagcagcgcctgca

SEQ ID NO: 819351 - DNA, 25 bp, Mus musculus
tggcgggcactctgcagcgcctgca

SEQ ID NO: 819352 - DNA, 25 bp, Mus musculus
tggcgggtagacaacaccctgagct

SEQ ID NO: 819353 - DNA, 25 bp, Mus musculus
tggcgggtagactacaccctgagct

SEQ ID NO: 819354 - DNA, 25 bp, Mus musculus
tggcgggtgcctagctttcatactg

SEQ ID NO: 819355 - DNA, 25 bp, Mus musculus
tggcgggtgccttgctttcatactg

SEQ ID NO: 819356 - DNA, 25 bp, Mus musculus
tggcggtatttcagcttattgaact

SEQ ID NO: 819357 - DNA, 25 bp, Mus musculus
tggcggtatttctgcttattgaact

SEQ ID NO: 819358 - DNA, 25 bp, Mus musculus
tggcggtccctgaagctgtgttttc

SEQ ID NO: 819359 - DNA, 25 bp, Mus musculus
tggcggtccctgtagctgtgttttc

SEQ ID NO: 819360 - DNA, 25 bp, Mus musculus
tggcggtgccgccttttctcagact

SEQ ID NO: 819361 - DNA, 25 bp, Mus musculus
tggcggtgccgcgttttctcagact

SEQ ID NO: 819362 - DNA, 25 bp, Mus musculus
tggcggtgcgtgaccgccccttcaa

SEQ ID NO: 819363 - DNA, 25 bp, Mus musculus
tggcggtgcgtgtccgccccttcaa

SEQ ID NO: 819364 - DNA, 25 bp, Mus musculus
tggcggtggaatacaatgtgtcctt

SEQ ID NO: 819365 - DNA, 25 bp, Mus musculus
tggcggtggaattcaatgtgtcctt

SEQ ID NO: 819366 - DNA, 25 bp, Mus musculus
tggcggtggggcctctcctcatcct

SEQ ID NO: 819367 - DNA, 25 bp, Mus musculus
tggcggtggggcgtctcctcatcct

SEQ ID NO: 819368 - DNA, 25 bp, Mus musculus
tggcggtgtgcgacactccacacga

SEQ ID NO: 819369 - DNA, 25 bp, Mus musculus
tggcggtgtgcgtcactccacacga

SEQ ID NO: 819370 - DNA, 25 bp, Mus musculus
tggcggtgttcgagggtataaatca

SEQ ID NO: 819371 - DNA, 25 bp, Mus musculus
tggcggtgttcgtgggtataaatca

SEQ ID NO: 819372 - DNA, 25 bp, Mus musculus
tggcgtaatgccagcaaactgaact

SEQ ID NO: 819373 - DNA, 25 bp, Mus musculus
tggcgtaatgcctgcaaactgaact

SEQ ID NO: 819374 - DNA, 25 bp, Mus musculus
tggcgtagtcaaaggccagccctcg

SEQ ID NO: 819375 - DNA, 25 bp, Mus musculus
tggcgtagtcaatggccagccctcg

SEQ ID NO: 819376 - DNA, 25 bp, Mus musculus
tggcgtattggtcctgtctttcgga

SEQ ID NO: 819377 - DNA, 25 bp, Mus musculus
tggcgtattggtgctgtctttcgga

SEQ ID NO: 819378 - DNA, 25 bp, Mus musculus
tggcgtcaccgcagctaaggagaag

SEQ ID NO: 819379 - DNA, 25 bp, Mus musculus
tggcgtcaccgctgctaaggagaag

SEQ ID NO: 819380 - DNA, 25 bp, Mus musculus
tggcgtcacgggacctctgctccgt

SEQ ID NO: 819381 - DNA, 25 bp, Mus musculus
tggcgtcacgggtcctctgctccgt

SEQ ID NO: 819382 - DNA, 25 bp, Mus musculus
tggcgtcagtcaaaacacagacctg

SEQ ID NO: 819383 - DNA, 25 bp, Mus musculus
tggcgtcagtcataacacagacctg

SEQ ID NO: 819384 - DNA, 25 bp, Mus musculus
tggcgtcatccaacgcgatgtcaaa

SEQ ID NO: 819385 - DNA, 25 bp, Mus musculus
tggcgtcatccatcgcgatgtcaaa

SEQ ID NO: 819386 - DNA, 25 bp, Mus musculus
tggcgtcctctccaagcctaagtgg

SEQ ID NO: 819387 - DNA, 25 bp, Mus musculus
tggcgtcctctcgaagcctaagtgg

SEQ ID NO: 819388 - DNA, 25 bp, Mus musculus
tggcgtctaatgagcaggacagtga

SEQ ID NO: 819389 - DNA, 25 bp, Mus musculus
tggcgtctaatgtgcaggacagtga

SEQ ID NO: 819390 - DNA, 25 bp, Mus musculus
tggcgtctgaccctttcttccggcg

SEQ ID NO: 819391 - DNA, 25 bp, Mus musculus
tggcgtctgaccgtttcttccggcg

SEQ ID NO: 819392 - DNA, 25 bp, Mus musculus
tggcgtctggaacgtgccttacatc

SEQ ID NO: 819393 - DNA, 25 bp, Mus musculus
tggcgtctggaaggtgccttacatc

SEQ ID NO: 819394 - DNA, 25 bp, Mus musculus
tggcgtcttagacatgagagtttcc

SEQ ID NO: 819395 - DNA, 25 bp, Mus musculus
tggcgtcttagagatgagagtttcc

SEQ ID NO: 819396 - DNA, 25 bp, Mus musculus
tggcgtgaaaccaccaatgatgatg

SEQ ID NO: 819397 - DNA, 25 bp, Mus musculus
tggcgtgaaacctccaatgatgatg

SEQ ID NO: 819398 - DNA, 25 bp, Mus musculus
tggcgtgaaccgctgcattctgtgt

SEQ ID NO: 819399 - DNA, 25 bp, Mus musculus
tggcgtgaaccggtgcattctgtgt

SEQ ID NO: 819400 - DNA, 25 bp, Mus musculus
tggcgtgcaccgactggctcaatgt

SEQ ID NO: 819401 - DNA, 25 bp, Mus musculus
tggcgtgcaccgtctggctcaatgt

SEQ ID NO: 819402 - DNA, 25 bp, Mus musculus
tggcgtggacccaccaaagtggatc

SEQ ID NO: 819403 - DNA, 25 bp, Mus musculus
tggcgtggaccctccaaagtggatc

SEQ ID NO: 819404 - DNA, 25 bp, Mus musculus
tggcgtggccatacttatctgaggg

SEQ ID NO: 819405 - DNA, 25 bp, Mus musculus
tggcgtggccattcttatctgaggg

SEQ ID NO: 819406 - DNA, 25 bp, Mus musculus
tggcgtggtcaaaatcgttcccgga

SEQ ID NO: 819407 - DNA, 25 bp, Mus musculus
tggcgtggtcaatatcgttcccgga

SEQ ID NO: 819408 - DNA, 25 bp, Mus musculus
tggcgtgtgataccgaagacccaac

SEQ ID NO: 819409 - DNA, 25 bp, Mus musculus
tggcgtgtgatagcgaagacccaac

SEQ ID NO: 819410 - DNA, 25 bp, Mus musculus
tggcgtgtgcaaatgcagatgcctt

SEQ ID NO: 819411 - DNA, 25 bp, Mus musculus
tggcgtgtgcaattgcagatgcctt

SEQ ID NO: 819412 - DNA, 25 bp, Mus musculus
tggcgtgttcaactagtaagggtta

SEQ ID NO: 819413 - DNA, 25 bp, Mus musculus
tggcgtgttcaactgcggaatagct

SEQ ID NO: 819414 - DNA, 25 bp, Mus musculus
tggcgtgttcaagtagtaagggtta

SEQ ID NO: 819415 - DNA, 25 bp, Mus musculus
tggcgtgttcaagtgcggaatagct

SEQ ID NO: 819416 - DNA, 25 bp, Mus musculus
tggcgttaggctataccatctttgt

SEQ ID NO: 819417 - DNA, 25 bp, Mus musculus
tggcgttaggctttaccatctttgt

SEQ ID NO: 819418 - DNA, 25 bp, Mus musculus
tggcgttatgcaaagcctacacgtt

SEQ ID NO: 819419 - DNA, 25 bp, Mus musculus
tggcgttatgcatagcctacacgtt

SEQ ID NO: 819420 - DNA, 25 bp, Mus musculus
tggcgttcagtcagatctatcgttt

SEQ ID NO: 819421 - DNA, 25 bp, Mus musculus
tggcgttcagtctgatctatcgttt

SEQ ID NO: 819422 - DNA, 25 bp, Mus musculus
tggcgttgaaacagtcctctgagac

SEQ ID NO: 819423 - DNA, 25 bp, Mus musculus
tggcgttgaaactgtcctctgagac

SEQ ID NO: 819424 - DNA, 25 bp, Mus musculus
tggcgttgaaccatggcctagacaa

SEQ ID NO: 819425 - DNA, 25 bp, Mus musculus
tggcgttgaaccttggcctagacaa

SEQ ID NO: 819426 - DNA, 25 bp, Mus musculus
tggcgttggaaacacagtactgatc

SEQ ID NO: 819427 - DNA, 25 bp, Mus musculus
tggcgttggaaagacagtactgatc

SEQ ID NO: 819428 - DNA, 25 bp, Mus musculus
tggcgtttggaacagactgcacaca

SEQ ID NO: 819429 - DNA, 25 bp, Mus musculus
tggcgtttggaagagactgcacaca

SEQ ID NO: 819430 - DNA, 25 bp, Mus musculus
tggctaaaagctcactctgggcact

SEQ ID NO: 819431 - DNA, 25 bp, Mus musculus
tggctaaaagctgactctgggcact

SEQ ID NO: 819432 - DNA, 25 bp, Mus musculus
tggctaaagtaaaagggatgtggca

SEQ ID NO: 819433 - DNA, 25 bp, Mus musculus
tggctaaagtaatagggatgtggca

SEQ ID NO: 819434 - DNA, 25 bp, Mus musculus
tggctaacggctactctgaacattt

SEQ ID NO: 819435 - DNA, 25 bp, Mus musculus
tggctaacggcttctctgaacattt

SEQ ID NO: 819436 - DNA, 25 bp, Mus musculus
tggctaacttccagcttgtcaacag

SEQ ID NO: 819437 - DNA, 25 bp, Mus musculus
tggctaacttcctgcttgtcaacag

SEQ ID NO: 819438 - DNA, 25 bp, Mus musculus
tggctaagctgcactcctccagtca

SEQ ID NO: 819439 - DNA, 25 bp, Mus musculus
tggctaagctgctctcctccagtca

SEQ ID NO: 819440 - DNA, 25 bp, Mus musculus
tggctaagggagacagtgcttcact

SEQ ID NO: 819441 - DNA, 25 bp, Mus musculus
tggctaagggagtcagtgcttcact

SEQ ID NO: 819442 - DNA, 25 bp, Mus musculus
tggctaagtatgcaggccaccggta

SEQ ID NO: 819443 - DNA, 25 bp, Mus musculus
tggctaagtatggaggccaccggta

SEQ ID NO: 819444 - DNA, 25 bp, Mus musculus
tggctaatcaagagtgaaaaacctg

SEQ ID NO: 819445 - DNA, 25 bp, Mus musculus
tggctaatcaagtgtgaaaaacctg

SEQ ID NO: 819446 - DNA, 25 bp, Mus musculus
tggctaatgggaagagcctccagcc

SEQ ID NO: 819447 - DNA, 25 bp, Mus musculus
tggctaatgggatgagcctccagcc

SEQ ID NO: 819448 - DNA, 25 bp, Mus musculus
tggctaattgaacactcagaagatc

SEQ ID NO: 819449 - DNA, 25 bp, Mus musculus
tggctaattgaagactcagaagatc

SEQ ID NO: 819450 - DNA, 25 bp, Mus musculus
tggctacaagccactcagcctgatg

SEQ ID NO: 819451 - DNA, 25 bp, Mus musculus
tggctacaagcctctcagcctgatg

SEQ ID NO: 819452 - DNA, 25 bp, Mus musculus
tggctacaaggtacagtacacacct

SEQ ID NO: 819453 - DNA, 25 bp, Mus musculus
tggctacaaggttcagtacacacct

SEQ ID NO: 819454 - DNA, 25 bp, Mus musculus
tggctacaagttacatgagcactgt

SEQ ID NO: 819455 - DNA, 25 bp, Mus musculus
tggctacaagtttcatgagcactgt

SEQ ID NO: 819456 - DNA, 25 bp, Mus musculus
tggctacaattacgccgttgatctg

SEQ ID NO: 819457 - DNA, 25 bp, Mus musculus
tggctacaattaggccgttgatctg

SEQ ID NO: 819458 - DNA, 25 bp, Mus musculus
tggctacacactagtcaccctcaga

SEQ ID NO: 819459 - DNA, 25 bp, Mus musculus
tggctacacacttgtcaccctcaga

SEQ ID NO: 819460 - DNA, 25 bp, Mus musculus
tggctacagagaaaaggcagctccg

SEQ ID NO: 819461 - DNA, 25 bp, Mus musculus
tggctacagagataaggcagctccg

SEQ ID NO: 819462 - DNA, 25 bp, Mus musculus
tggctacagcaaacactaaggaacc

SEQ ID NO: 819463 - DNA, 25 bp, Mus musculus
tggctacagcaatcactaaggaacc

SEQ ID NO: 819464 - DNA, 25 bp, Mus musculus
tggctacagcgccaagtacaccttc

SEQ ID NO: 819465 - DNA, 25 bp, Mus musculus
tggctacagcgcgaagtacaccttc

SEQ ID NO: 819466 - DNA, 25 bp, Mus musculus
tggctacagctgaaagatgatgaac

SEQ ID NO: 819467 - DNA, 25 bp, Mus musculus
tggctacagctgtaagatgatgaac

SEQ ID NO: 819468 - DNA, 25 bp, Mus musculus
tggctacaggctctgtcctccggct

SEQ ID NO: 819469 - DNA, 25 bp, Mus musculus
tggctacaggctgtgtcctccggct

SEQ ID NO: 819470 - DNA, 25 bp, Mus musculus
tggctacagtggaaatggcatccag

SEQ ID NO: 819471 - DNA, 25 bp, Mus musculus
tggctacagtggtaatggcatccag

SEQ ID NO: 819472 - DNA, 25 bp, Mus musculus
tggctacatccaatacgggcagact

SEQ ID NO: 819473 - DNA, 25 bp, Mus musculus
tggctacatccattacgggcagact

SEQ ID NO: 819474 - DNA, 25 bp, Mus musculus
tggctaccaatgacactcagcagga

SEQ ID NO: 819475 - DNA, 25 bp, Mus musculus
tggctaccaatgtcactcagcagga

SEQ ID NO: 819476 - DNA, 25 bp, Mus musculus
tggctaccacagaaacaggacaagg

SEQ ID NO: 819477 - DNA, 25 bp, Mus musculus
tggctaccacagtaacaggacaagg

SEQ ID NO: 819478 - DNA, 25 bp, Mus musculus
tggctaccagtaactccgtgtctaa

SEQ ID NO: 819479 - DNA, 25 bp, Mus musculus
tggctaccagtatctccgtgtctaa

SEQ ID NO: 819480 - DNA, 25 bp, Mus musculus
tggctaccatcgaacacacagccag

SEQ ID NO: 819481 - DNA, 25 bp, Mus musculus
tggctaccatcgtacacacagccag

SEQ ID NO: 819482 - DNA, 25 bp, Mus musculus
tggctacccaggaagtagcactaca

SEQ ID NO: 819483 - DNA, 25 bp, Mus musculus
tggctacccaggtagtagcactaca

SEQ ID NO: 819484 - DNA, 25 bp, Mus musculus
tggctaccccttaatggcagcgtgt

SEQ ID NO: 819485 - DNA, 25 bp, Mus musculus
tggctacccctttatggcagcgtgt

SEQ ID NO: 819486 - DNA, 25 bp, Mus musculus
tggctaccgggaagtctaagggata

SEQ ID NO: 819487 - DNA, 25 bp, Mus musculus
tggctaccgggatgtctaagggata

SEQ ID NO: 819488 - DNA, 25 bp, Mus musculus
tggctaccgtcaccctcgtgggagt

SEQ ID NO: 819489 - DNA, 25 bp, Mus musculus
tggctaccgtcagcctcgtgggagt

SEQ ID NO: 819490 - DNA, 25 bp, Mus musculus
tggctacctgaaccaagagggaaag

SEQ ID NO: 819491 - DNA, 25 bp, Mus musculus
tggctacctgaagcaagagggaaag

SEQ ID NO: 819492 - DNA, 25 bp, Mus musculus
tggctacctgagagaagatggagaa

SEQ ID NO: 819493 - DNA, 25 bp, Mus musculus
tggctacctgagtgaagatggagaa

SEQ ID NO: 819494 - DNA, 25 bp, Mus musculus
tggctacctgccaaatgtgctgggc

SEQ ID NO: 819495 - DNA, 25 bp, Mus musculus
tggctacctgcctaatgtgctgggc

SEQ ID NO: 819496 - DNA, 25 bp, Mus musculus
tggctacctggaacatgcagggcca

SEQ ID NO: 819497 - DNA, 25 bp, Mus musculus
tggctacctggatcatgcagggcca

SEQ ID NO: 819498 - DNA, 25 bp, Mus musculus
tggctacgagccagaagtcgtcgct

SEQ ID NO: 819499 - DNA, 25 bp, Mus musculus
tggctacgagcctgaagtcgtcgct

SEQ ID NO: 819500 - DNA, 25 bp, Mus musculus
tggctacgcatccatcgtcattgtg

SEQ ID NO: 819501 - DNA, 25 bp, Mus musculus
tggctacgcatcgatcgtcattgtg

SEQ ID NO: 819502 - DNA, 25 bp, Mus musculus
tggctacgccatcatggcagatggt

SEQ ID NO: 819503 - DNA, 25 bp, Mus musculus
tggctacgccatgatggcagatggt

SEQ ID NO: 819504 - DNA, 25 bp, Mus musculus
tggctacgccgcacagctggagcag

SEQ ID NO: 819505 - DNA, 25 bp, Mus musculus
tggctacgccgctcagctggagcag

SEQ ID NO: 819506 - DNA, 25 bp, Mus musculus
tggctacggagtaggctttgatctg

SEQ ID NO: 819507 - DNA, 25 bp, Mus musculus
tggctacggagttggctttgatctg

SEQ ID NO: 819508 - DNA, 25 bp, Mus musculus
tggctacggattatgcagagaacga

SEQ ID NO: 819509 - DNA, 25 bp, Mus musculus
tggctacggattttgcagagaacga

SEQ ID NO: 819510 - DNA, 25 bp, Mus musculus
tggctacgtccacggacatctctgg

SEQ ID NO: 819511 - DNA, 25 bp, Mus musculus
tggctacgtccagggacatctctgg

SEQ ID NO: 819512 - DNA, 25 bp, Mus musculus
tggctactagagaaacaatctatcg

SEQ ID NO: 819513 - DNA, 25 bp, Mus musculus
tggctactagagtaacaatctatcg

SEQ ID NO: 819514 - DNA, 25 bp, Mus musculus
tggctactcaaaacgggtccacctg

SEQ ID NO: 819515 - DNA, 25 bp, Mus musculus
tggctactcaaatcgggtccacctg

SEQ ID NO: 819516 - DNA, 25 bp, Mus musculus
tggctactcaggatccacctgtcac

SEQ ID NO: 819517 - DNA, 25 bp, Mus musculus
tggctactcaggttccacctgtcac

SEQ ID NO: 819518 - DNA, 25 bp, Mus musculus
tggctactccatacacacttacctg

SEQ ID NO: 819519 - DNA, 25 bp, Mus musculus
tggctactccattcacacttacctg

SEQ ID NO: 819520 - DNA, 25 bp, Mus musculus
tggctactcggtcgtgctgcacagc

SEQ ID NO: 819521 - DNA, 25 bp, Mus musculus
tggctactcggtggtgctgcacagc

SEQ ID NO: 819522 - DNA, 25 bp, Mus musculus
tggctactcgtaatcgtggtcatgt

SEQ ID NO: 819523 - DNA, 25 bp, Mus musculus
tggctactcgtattcgtggtcatgt

SEQ ID NO: 819524 - DNA, 25 bp, Mus musculus
tggctactctctcctagagcgcctg

SEQ ID NO: 819525 - DNA, 25 bp, Mus musculus
tggctactctctgctagagcgcctg

SEQ ID NO: 819526 - DNA, 25 bp, Mus musculus
tggctactctggagttgaagtccga

SEQ ID NO: 819527 - DNA, 25 bp, Mus musculus
tggctactctggtgttgaagtccga

SEQ ID NO: 819528 - DNA, 25 bp, Mus musculus
tggctactgtcacgcatcggcctga

SEQ ID NO: 819529 - DNA, 25 bp, Mus musculus
tggctactgtcaggcatcggcctga

SEQ ID NO: 819530 - DNA, 25 bp, Mus musculus
tggctacttcaacagcaaagactca

SEQ ID NO: 819531 - DNA, 25 bp, Mus musculus
tggctacttcaagagcaaagactca

SEQ ID NO: 819532 - DNA, 25 bp, Mus musculus
tggctacttcctcgcaggacggagc

SEQ ID NO: 819533 - DNA, 25 bp, Mus musculus
tggctacttcctggcaggacggagc

SEQ ID NO: 819534 - DNA, 25 bp, Mus musculus
tggctagacgaacacacactggtca

SEQ ID NO: 819535 - DNA, 25 bp, Mus musculus
tggctagacgaagacacactggtca

SEQ ID NO: 819536 - DNA, 25 bp, Mus musculus
tggctagatcagcttcatgcactga

SEQ ID NO: 819537 - DNA, 25 bp, Mus musculus
tggctagatcaggttcatgcactga

SEQ ID NO: 819538 - DNA, 25 bp, Mus musculus
tggctagatcctcggtggacccttc

SEQ ID NO: 819539 - DNA, 25 bp, Mus musculus
tggctagatcctgggtggacccttc

SEQ ID NO: 819540 - DNA, 25 bp, Mus musculus
tggctagcagtgaaggtacagaact

SEQ ID NO: 819541 - DNA, 25 bp, Mus musculus
tggctagcagtgtaggtacagaact

SEQ ID NO: 819542 - DNA, 25 bp, Mus musculus
tggctagctctgacacaaatgcaaa

SEQ ID NO: 819543 - DNA, 25 bp, Mus musculus
tggctagctctgtcacaaatgcaaa

SEQ ID NO: 819544 - DNA, 25 bp, Mus musculus
tggctaggtttcagcggtcgcgtca

SEQ ID NO: 819545 - DNA, 25 bp, Mus musculus
tggctaggtttctgcggtcgcgtca

SEQ ID NO: 819546 - DNA, 25 bp, Mus musculus
tggctagtttcgaagtaacctgttt

SEQ ID NO: 819547 - DNA, 25 bp, Mus musculus
tggctagtttcgtagtaacctgttt

SEQ ID NO: 819548 - DNA, 25 bp, Mus musculus
tggctataacctccgtgccctggct

SEQ ID NO: 819549 - DNA, 25 bp, Mus musculus
tggctataacctgcgtgccctggct

SEQ ID NO: 819550 - DNA, 25 bp, Mus musculus
tggctatcaaagcaatcgactactg

SEQ ID NO: 819551 - DNA, 25 bp, Mus musculus
tggctatcaaagctgcagataatta

SEQ ID NO: 819552 - DNA, 25 bp, Mus musculus
tggctatcaaaggaatcgactactg

SEQ ID NO: 819553 - DNA, 25 bp, Mus musculus
tggctatcaaaggtgcagataatta

SEQ ID NO: 819554 - DNA, 25 bp, Mus musculus
tggctatcatgacaaccacaccggt

SEQ ID NO: 819555 - DNA, 25 bp, Mus musculus
tggctatcatgagaaccacaccggt

SEQ ID NO: 819556 - DNA, 25 bp, Mus musculus
tggctatcctacatctttaccctgc

SEQ ID NO: 819557 - DNA, 25 bp, Mus musculus
tggctatcctacttctttaccctgc

SEQ ID NO: 819558 - DNA, 25 bp, Mus musculus
tggctatcctcaactacttgagcag

SEQ ID NO: 819559 - DNA, 25 bp, Mus musculus
tggctatcctcatctacttgagcag

SEQ ID NO: 819560 - DNA, 25 bp, Mus musculus
tggctatcgactacactgcctccaa

SEQ ID NO: 819561 - DNA, 25 bp, Mus musculus
tggctatcgacttcactgcctccaa

SEQ ID NO: 819562 - DNA, 25 bp, Mus musculus
tggctatcttgcactacctggcaca

SEQ ID NO: 819563 - DNA, 25 bp, Mus musculus
tggctatcttgctctacctggcaca

SEQ ID NO: 819564 - DNA, 25 bp, Mus musculus
tggctatgacatcccctatgctggg

SEQ ID NO: 819565 - DNA, 25 bp, Mus musculus
tggctatgacatgccctatgctggg

SEQ ID NO: 819566 - DNA, 25 bp, Mus musculus
tggctatgaggtagttggacttgac

SEQ ID NO: 819567 - DNA, 25 bp, Mus musculus
tggctatgaggttgttggacttgac

SEQ ID NO: 819568 - DNA, 25 bp, Mus musculus
tggctatggcatactgccccaaaga

SEQ ID NO: 819569 - DNA, 25 bp, Mus musculus
tggctatggcattctgccccaaaga

SEQ ID NO: 819570 - DNA, 25 bp, Mus musculus
tggctatggcgacacgtcgacctga

SEQ ID NO: 819571 - DNA, 25 bp, Mus musculus
tggctatggcgagacgtcgacctga

SEQ ID NO: 819572 - DNA, 25 bp, Mus musculus
tggctattacctatgttcgtgagaa

SEQ ID NO: 819573 - DNA, 25 bp, Mus musculus
tggctattacctttgttcgtgagaa

SEQ ID NO: 819574 - DNA, 25 bp, Mus musculus
tggctattcggaaactgtccattcc

SEQ ID NO: 819575 - DNA, 25 bp, Mus musculus
tggctattcggatactgtccattcc

SEQ ID NO: 819576 - DNA, 25 bp, Mus musculus
tggctattgctgctctcgccaacag

SEQ ID NO: 819577 - DNA, 25 bp, Mus musculus
tggctattgctggtctcgccaacag

SEQ ID NO: 819578 - DNA, 25 bp, Mus musculus
tggctattggctaggagtgccgaca

SEQ ID NO: 819579 - DNA, 25 bp, Mus musculus
tggctattggcttggagtgccgaca

SEQ ID NO: 819580 - DNA, 25 bp, Mus musculus
tggctattttgtccctgcagttccg

SEQ ID NO: 819581 - DNA, 25 bp, Mus musculus
tggctattttgtgcctgcagttccg

SEQ ID NO: 819582 - DNA, 25 bp, Mus musculus
tggctcaaactcacattcgagcagt

SEQ ID NO: 819583 - DNA, 25 bp, Mus musculus
tggctcaaactctcattcgagcagt

SEQ ID NO: 819584 - DNA, 25 bp, Mus musculus
tggctcaacatcactgtcttcgcag

SEQ ID NO: 819585 - DNA, 25 bp, Mus musculus
tggctcaacatctctgtcttcgcag

SEQ ID NO: 819586 - DNA, 25 bp, Mus musculus
tggctcaacggaagaaactcacaga

SEQ ID NO: 819587 - DNA, 25 bp, Mus musculus
tggctcaacggatgaaactcacaga

SEQ ID NO: 819588 - DNA, 25 bp, Mus musculus
tggctcaagaccaatggaagagtga

SEQ ID NO: 819589 - DNA, 25 bp, Mus musculus
tggctcaagacctatggaagagtga

SEQ ID NO: 819590 - DNA, 25 bp, Mus musculus
tggctcaattaacaaacatcaggga

SEQ ID NO: 819591 - DNA, 25 bp, Mus musculus
tggctcaattaagaaacatcaggga

SEQ ID NO: 819592 - DNA, 25 bp, Mus musculus
tggctcacagcccaactctaatgtc

SEQ ID NO: 819593 - DNA, 25 bp, Mus musculus
tggctcacagccgaactctaatgtc

SEQ ID NO: 819594 - DNA, 25 bp, Mus musculus
tggctcacagtgagtgctccctacc

SEQ ID NO: 819595 - DNA, 25 bp, Mus musculus
tggctcacagtgtgtgctccctacc

SEQ ID NO: 819596 - DNA, 25 bp, Mus musculus
tggctcacatgaagacaaggctagt

SEQ ID NO: 819597 - DNA, 25 bp, Mus musculus
tggctcacatgatgacaaggctagt

SEQ ID NO: 819598 - DNA, 25 bp, Mus musculus
tggctcaccatgattgatgcggtgc

SEQ ID NO: 819599 - DNA, 25 bp, Mus musculus
tggctcaccatgtttgatgcggtgc

SEQ ID NO: 819600 - DNA, 25 bp, Mus musculus
tggctcacccgtactaacatgtgaa

SEQ ID NO: 819601 - DNA, 25 bp, Mus musculus
tggctcacccgttctaacatgtgaa

SEQ ID NO: 819602 - DNA, 25 bp, Mus musculus
tggctcacctgaagactgtgcagtt

SEQ ID NO: 819603 - DNA, 25 bp, Mus musculus
tggctcacctgatgactgtgcagtt

SEQ ID NO: 819604 - DNA, 25 bp, Mus musculus
tggctcacctttcgtgctctcacgg

SEQ ID NO: 819605 - DNA, 25 bp, Mus musculus
tggctcacctttggtgctctcacgg

SEQ ID NO: 819606 - DNA, 25 bp, Mus musculus
tggctcacggtgacttcttgctaaa

SEQ ID NO: 819607 - DNA, 25 bp, Mus musculus
tggctcacggtgtcttcttgctaaa

SEQ ID NO: 819608 - DNA, 25 bp, Mus musculus
tggctcacgtggacgcagtaatccg

SEQ ID NO: 819609 - DNA, 25 bp, Mus musculus
tggctcacgtggtcgcagtaatccg

SEQ ID NO: 819610 - DNA, 25 bp, Mus musculus
tggctcactgtcctgcccaaacagc

SEQ ID NO: 819611 - DNA, 25 bp, Mus musculus
tggctcactgtcgtgcccaaacagc

SEQ ID NO: 819612 - DNA, 25 bp, Mus musculus
tggctcactgtgacccatgcagtgg

SEQ ID NO: 819613 - DNA, 25 bp, Mus musculus
tggctcactgtgtcccatgcagtgg

SEQ ID NO: 819614 - DNA, 25 bp, Mus musculus
tggctcacttgccaaaggaaatgac

SEQ ID NO: 819615 - DNA, 25 bp, Mus musculus
tggctcacttgcgaaaggaaatgac

SEQ ID NO: 819616 - DNA, 25 bp, Mus musculus
tggctcagacaacaagaactgtctg

SEQ ID NO: 819617 - DNA, 25 bp, Mus musculus
tggctcagacaagaagaactgtctg

SEQ ID NO: 819618 - DNA, 25 bp, Mus musculus
tggctcagacgaagccacatgcagg

SEQ ID NO: 819619 - DNA, 25 bp, Mus musculus
tggctcagacgatgccacatgcagg

SEQ ID NO: 819620 - DNA, 25 bp, Mus musculus
tggctcagaggaagaatggccaaca

SEQ ID NO: 819621 - DNA, 25 bp, Mus musculus
tggctcagaggatgaatggccaaca

SEQ ID NO: 819622 - DNA, 25 bp, Mus musculus
tggctcagcacaagctaggctttag

SEQ ID NO: 819623 - DNA, 25 bp, Mus musculus
tggctcagcacacctcgttgctcag

SEQ ID NO: 819624 - DNA, 25 bp, Mus musculus
tggctcagcacagctcgttgctcag

SEQ ID NO: 819625 - DNA, 25 bp, Mus musculus
tggctcagcacatgctaggctttag

SEQ ID NO: 819626 - DNA, 25 bp, Mus musculus
tggctcagctcgacccggcagggct

SEQ ID NO: 819627 - DNA, 25 bp, Mus musculus
tggctcagctcgtcccggcagggct

SEQ ID NO: 819628 - DNA, 25 bp, Mus musculus
tggctcagcttgaagccttttctgc

SEQ ID NO: 819629 - DNA, 25 bp, Mus musculus
tggctcagcttgtagccttttctgc

SEQ ID NO: 819630 - DNA, 25 bp, Mus musculus
tggctcaggaaacggcacccagtgc

SEQ ID NO: 819631 - DNA, 25 bp, Mus musculus
tggctcaggaaagggcacccagtgc

SEQ ID NO: 819632 - DNA, 25 bp, Mus musculus
tggctcaggccaaacgatggctcta

SEQ ID NO: 819633 - DNA, 25 bp, Mus musculus
tggctcaggccatacgatggctcta

SEQ ID NO: 819634 - DNA, 25 bp, Mus musculus
tggctcaggctcaactactacctct

SEQ ID NO: 819635 - DNA, 25 bp, Mus musculus
tggctcaggctctactactacctct

SEQ ID NO: 819636 - DNA, 25 bp, Mus musculus
tggctcaggctgaaaacgctcggtc

SEQ ID NO: 819637 - DNA, 25 bp, Mus musculus
tggctcaggctgtaaacgctcggtc

SEQ ID NO: 819638 - DNA, 25 bp, Mus musculus
tggctcagggaaagacgcaacccat

SEQ ID NO: 819639 - DNA, 25 bp, Mus musculus
tggctcagggaatgacgcaacccat

SEQ ID NO: 819640 - DNA, 25 bp, Mus musculus
tggctcaggtctccagcaggttccg

SEQ ID NO: 819641 - DNA, 25 bp, Mus musculus
tggctcaggtctgcagcaggttccg

SEQ ID NO: 819642 - DNA, 25 bp, Mus musculus
tggctcagtacgctaaacacatagg

SEQ ID NO: 819643 - DNA, 25 bp, Mus musculus
tggctcagtacggtaaacacatagg

SEQ ID NO: 819644 - DNA, 25 bp, Mus musculus
tggctcagtcagcaagacgcgcaag

SEQ ID NO: 819645 - DNA, 25 bp, Mus musculus
tggctcagtcaggaagacgcgcaag

SEQ ID NO: 819646 - DNA, 25 bp, Mus musculus
tggctcagtggtagccgaccccatg

SEQ ID NO: 819647 - DNA, 25 bp, Mus musculus
tggctcagtggttgccgaccccatg

SEQ ID NO: 819648 - DNA, 25 bp, Mus musculus
tggctcagttgactttagaacccac

SEQ ID NO: 819649 - DNA, 25 bp, Mus musculus
tggctcagttgagtttagaacccac

SEQ ID NO: 819650 - DNA, 25 bp, Mus musculus
tggctcagttgcagacatccatccg

SEQ ID NO: 819651 - DNA, 25 bp, Mus musculus
tggctcagttgcaggcagcctatca

SEQ ID NO: 819652 - DNA, 25 bp, Mus musculus
tggctcagttgctgacatccatccg

SEQ ID NO: 819653 - DNA, 25 bp, Mus musculus
tggctcagttgctggcagcctatca

SEQ ID NO: 819654 - DNA, 25 bp, Mus musculus
tggctcagttttctggcgccttctg

SEQ ID NO: 819655 - DNA, 25 bp, Mus musculus
tggctcagttttgtggcgccttctg

SEQ ID NO: 819656 - DNA, 25 bp, Mus musculus
tggctcatacttaggagcttctgtc

SEQ ID NO: 819657 - DNA, 25 bp, Mus musculus
tggctcatactttggagcttctgtc

SEQ ID NO: 819658 - DNA, 25 bp, Mus musculus
tggctcatctgcagggacagtgcct

SEQ ID NO: 819659 - DNA, 25 bp, Mus musculus
tggctcatctgctgggacagtgcct

SEQ ID NO: 819660 - DNA, 25 bp, Mus musculus
tggctcatgatgctcataattgtct

SEQ ID NO: 819661 - DNA, 25 bp, Mus musculus
tggctcatgatggtcataattgtct

SEQ ID NO: 819662 - DNA, 25 bp, Mus musculus
tggctcattggaaaatttcgggatc

SEQ ID NO: 819663 - DNA, 25 bp, Mus musculus
tggctcattggataatttcgggatc

SEQ ID NO: 819664 - DNA, 25 bp, Mus musculus
tggctccaaactcctcgtcaagatg

SEQ ID NO: 819665 - DNA, 25 bp, Mus musculus
tggctccaaactgctcgtcaagatg

SEQ ID NO: 819666 - DNA, 25 bp, Mus musculus
tggctccaacaacggaattggcaaa

SEQ ID NO: 819667 - DNA, 25 bp, Mus musculus
tggctccaacaagggaattggcaaa

SEQ ID NO: 819668 - DNA, 25 bp, Mus musculus
tggctccaacacctgtcttaataag

SEQ ID NO: 819669 - DNA, 25 bp, Mus musculus
tggctccaacacgtgtcttaataag

SEQ ID NO: 819670 - DNA, 25 bp, Mus musculus
tggctccaacttccaaggttttatc

SEQ ID NO: 819671 - DNA, 25 bp, Mus musculus
tggctccaacttgcaaggttttatc

SEQ ID NO: 819672 - DNA, 25 bp, Mus musculus
tggctccactaaagatgtcaaagtc

SEQ ID NO: 819673 - DNA, 25 bp, Mus musculus
tggctccactaatgatgtcaaagtc

SEQ ID NO: 819674 - DNA, 25 bp, Mus musculus
tggctccagaagatatccagagtct

SEQ ID NO: 819675 - DNA, 25 bp, Mus musculus
tggctccagaagttatccagagtct

SEQ ID NO: 819676 - DNA, 25 bp, Mus musculus
tggctccagaggcattgttcgaccg

SEQ ID NO: 819677 - DNA, 25 bp, Mus musculus
tggctccagagggattgttcgaccg

SEQ ID NO: 819678 - DNA, 25 bp, Mus musculus
tggctccagcagacatccgagtgac

SEQ ID NO: 819679 - DNA, 25 bp, Mus musculus
tggctccagcagtcatccgagtgac

SEQ ID NO: 819680 - DNA, 25 bp, Mus musculus
tggctccattgcaggcctagcagag

SEQ ID NO: 819681 - DNA, 25 bp, Mus musculus
tggctccattgctggcctagcagag

SEQ ID NO: 819682 - DNA, 25 bp, Mus musculus
tggctccattttagaatcccgtgta

SEQ ID NO: 819683 - DNA, 25 bp, Mus musculus
tggctccatttttgaatcccgtgta

SEQ ID NO: 819684 - DNA, 25 bp, Mus musculus
tggctccccaggatgtgggtgtctt

SEQ ID NO: 819685 - DNA, 25 bp, Mus musculus
tggctccccaggttgtgggtgtctt

SEQ ID NO: 819686 - DNA, 25 bp, Mus musculus
tggctcccgcgaagctagcggcacg

SEQ ID NO: 819687 - DNA, 25 bp, Mus musculus
tggctcccgcgatgctagcggcacg

SEQ ID NO: 819688 - DNA, 25 bp, Mus musculus
tggctcccggaaagctcaaaccttc

SEQ ID NO: 819689 - DNA, 25 bp, Mus musculus
tggctcccggaatgctcaaaccttc

SEQ ID NO: 819690 - DNA, 25 bp, Mus musculus
tggctcccgtatactgctgcaatcc

SEQ ID NO: 819691 - DNA, 25 bp, Mus musculus
tggctcccgtattctgctgcaatcc

SEQ ID NO: 819692 - DNA, 25 bp, Mus musculus
tggctccctctacaggcagggctcc

SEQ ID NO: 819693 - DNA, 25 bp, Mus musculus
tggctccctctagaggcagggctcc

SEQ ID NO: 819694 - DNA, 25 bp, Mus musculus
tggctccgaggacacgttcagctac

SEQ ID NO: 819695 - DNA, 25 bp, Mus musculus
tggctccgaggagacgttcagctac

SEQ ID NO: 819696 - DNA, 25 bp, Mus musculus
tggctcctacaaatgtcactgcaac

SEQ ID NO: 819697 - DNA, 25 bp, Mus musculus
tggctcctacaattgtcactgcaac

SEQ ID NO: 819698 - DNA, 25 bp, Mus musculus
tggctcctacatccaggattatggg

SEQ ID NO: 819699 - DNA, 25 bp, Mus musculus
tggctcctacatgcaggattatggg

SEQ ID NO: 819700 - DNA, 25 bp, Mus musculus
tggctcctacccattcattgacttc

SEQ ID NO: 819701 - DNA, 25 bp, Mus musculus
tggctcctaccctttcattgacttc

SEQ ID NO: 819702 - DNA, 25 bp, Mus musculus
tggctcctatcactgctactgccgt

SEQ ID NO: 819703 - DNA, 25 bp, Mus musculus
tggctcctatcagtgctactgccgt

SEQ ID NO: 819704 - DNA, 25 bp, Mus musculus
tggctcctatgtactaccgaggatc

SEQ ID NO: 819705 - DNA, 25 bp, Mus musculus
tggctcctatgttctaccgaggatc

SEQ ID NO: 819706 - DNA, 25 bp, Mus musculus
tggctcctccagagatagcaatggg

SEQ ID NO: 819707 - DNA, 25 bp, Mus musculus
tggctcctccagtgatagcaatggg

SEQ ID NO: 819708 - DNA, 25 bp, Mus musculus
tggctcctcccaaagctggctagtc

SEQ ID NO: 819709 - DNA, 25 bp, Mus musculus
tggctcctcccatagctggctagtc

SEQ ID NO: 819710 - DNA, 25 bp, Mus musculus
tggctcctcggtcactctaggatgc

SEQ ID NO: 819711 - DNA, 25 bp, Mus musculus
tggctcctcggtgactctaggatgc

SEQ ID NO: 819712 - DNA, 25 bp, Mus musculus
tggctcctgggacccaaggctcttg

SEQ ID NO: 819713 - DNA, 25 bp, Mus musculus
tggctcctgggagccaaggctcttg

SEQ ID NO: 819714 - DNA, 25 bp, Mus musculus
tggctcctgtccacttcccgggagg

SEQ ID NO: 819715 - DNA, 25 bp, Mus musculus
tggctcctgtcctcttcccgggagg

SEQ ID NO: 819716 - DNA, 25 bp, Mus musculus
tggctccttatgagagatatcagtt

SEQ ID NO: 819717 - DNA, 25 bp, Mus musculus
tggctccttatgtgagatatcagtt

SEQ ID NO: 819718 - DNA, 25 bp, Mus musculus
tggctccttccacgcaagacatttt

SEQ ID NO: 819719 - DNA, 25 bp, Mus musculus
tggctccttccaggcaagacatttt

SEQ ID NO: 819720 - DNA, 25 bp, Mus musculus
tggctccttcggctactccgggatg

SEQ ID NO: 819721 - DNA, 25 bp, Mus musculus
tggctccttcgggtactccgggatg

SEQ ID NO: 819722 - DNA, 25 bp, Mus musculus
tggctcctttcaccagcagtactgg

SEQ ID NO: 819723 - DNA, 25 bp, Mus musculus
tggctcctttcagcagcagtactgg

SEQ ID NO: 819724 - DNA, 25 bp, Mus musculus
tggctcctttttctacccttaaatg

SEQ ID NO: 819725 - DNA, 25 bp, Mus musculus
tggctcctttttgtacccttaaatg

SEQ ID NO: 819726 - DNA, 25 bp, Mus musculus
tggctcgaaaaccagacaagctaac

SEQ ID NO: 819727 - DNA, 25 bp, Mus musculus
tggctcgaaaacgagacaagctaac

SEQ ID NO: 819728 - DNA, 25 bp, Mus musculus
tggctcgacagaatggcaagatgct

SEQ ID NO: 819729 - DNA, 25 bp, Mus musculus
tggctcgacagattggcaagatgct

SEQ ID NO: 819730 - DNA, 25 bp, Mus musculus
tggctcgagatgagcacaacctgga

SEQ ID NO: 819731 - DNA, 25 bp, Mus musculus
tggctcgagatgtgcacaacctgga

SEQ ID NO: 819732 - DNA, 25 bp, Mus musculus
tggctcgccactctttggcgttcat

SEQ ID NO: 819733 - DNA, 25 bp, Mus musculus
tggctcgccactgtttggcgttcat

SEQ ID NO: 819734 - DNA, 25 bp, Mus musculus
tggctcgctgccatgactggctgga

SEQ ID NO: 819735 - DNA, 25 bp, Mus musculus
tggctcgctgccttgactggctgga

SEQ ID NO: 819736 - DNA, 25 bp, Mus musculus
tggctcggcagtacaacctgatccc

SEQ ID NO: 819737 - DNA, 25 bp, Mus musculus
tggctcggcagttcaacctgatccc

SEQ ID NO: 819738 - DNA, 25 bp, Mus musculus
tggctcgggcctctgagcatctttg

SEQ ID NO: 819739 - DNA, 25 bp, Mus musculus
tggctcgggcctgtgagcatctttg

SEQ ID NO: 819740 - DNA, 25 bp, Mus musculus
tggctcggtgcactgatgacttcaa

SEQ ID NO: 819741 - DNA, 25 bp, Mus musculus
tggctcggtgcagtgatgacttcaa

SEQ ID NO: 819742 - DNA, 25 bp, Mus musculus
tggctcggttaaagagtaactacca

SEQ ID NO: 819743 - DNA, 25 bp, Mus musculus
tggctcggttaatgagtaactacca

SEQ ID NO: 819744 - DNA, 25 bp, Mus musculus
tggctcgtgggcaatggacacacga

SEQ ID NO: 819745 - DNA, 25 bp, Mus musculus
tggctcgtgggctatggacacacga

SEQ ID NO: 819746 - DNA, 25 bp, Mus musculus
tggctctaaaggagatccggctgca

SEQ ID NO: 819747 - DNA, 25 bp, Mus musculus
tggctctaaaggtgatccggctgca

SEQ ID NO: 819748 - DNA, 25 bp, Mus musculus
tggctctacgcacaattcaatgaaa

SEQ ID NO: 819749 - DNA, 25 bp, Mus musculus
tggctctacgcagaattcaatgaaa

SEQ ID NO: 819750 - DNA, 25 bp, Mus musculus
tggctctacttgaggctcccttcga

SEQ ID NO: 819751 - DNA, 25 bp, Mus musculus
tggctctacttgtggctcccttcga

SEQ ID NO: 819752 - DNA, 25 bp, Mus musculus
tggctctagagaaggtaaattgact

SEQ ID NO: 819753 - DNA, 25 bp, Mus musculus
tggctctagagatggtaaattgact

SEQ ID NO: 819754 - DNA, 25 bp, Mus musculus
tggctctaggtcaaataaatattgc

SEQ ID NO: 819755 - DNA, 25 bp, Mus musculus
tggctctaggtctaataaatattgc

SEQ ID NO: 819756 - DNA, 25 bp, Mus musculus
tggctctatggcactacgggctgct

SEQ ID NO: 819757 - DNA, 25 bp, Mus musculus
tggctctatggctctacgggctgct

SEQ ID NO: 819758 - DNA, 25 bp, Mus musculus
tggctctcaaccagctgtcgctaca

SEQ ID NO: 819759 - DNA, 25 bp, Mus musculus
tggctctcaacctgctgtcgctaca

SEQ ID NO: 819760 - DNA, 25 bp, Mus musculus
tggctctcaccacatgatcctaact

SEQ ID NO: 819761 - DNA, 25 bp, Mus musculus
tggctctcaccagatgatcctaact

SEQ ID NO: 819762 - DNA, 25 bp, Mus musculus
tggctctcagagattgcttctctac

SEQ ID NO: 819763 - DNA, 25 bp, Mus musculus
tggctctcagagtttgcttctctac

SEQ ID NO: 819764 - DNA, 25 bp, Mus musculus
tggctctcagcaaccatcgtcttcg

SEQ ID NO: 819765 - DNA, 25 bp, Mus musculus
tggctctcagcatccatcgtcttcg

SEQ ID NO: 819766 - DNA, 25 bp, Mus musculus
tggctctccaagcaaatacaaggtg

SEQ ID NO: 819767 - DNA, 25 bp, Mus musculus
tggctctccaaggaaatacaaggtg

SEQ ID NO: 819768 - DNA, 25 bp, Mus musculus
tggctctcccatccacatagagaac

SEQ ID NO: 819769 - DNA, 25 bp, Mus musculus
tggctctcccatgcacatagagaac

SEQ ID NO: 819770 - DNA, 25 bp, Mus musculus
tggctctcgacacggaggtgaccaa

SEQ ID NO: 819771 - DNA, 25 bp, Mus musculus
tggctctcgacagggaggtgaccaa

SEQ ID NO: 819772 - DNA, 25 bp, Mus musculus
tggctctcgcccacatcgagagcgg

SEQ ID NO: 819773 - DNA, 25 bp, Mus musculus
tggctctcgccctcatcgagagcgg

SEQ ID NO: 819774 - DNA, 25 bp, Mus musculus
tggctctcgggacaatagcctgctt

SEQ ID NO: 819775 - DNA, 25 bp, Mus musculus
tggctctcgggagaatagcctgctt

SEQ ID NO: 819776 - DNA, 25 bp, Mus musculus
tggctctcgtgtcgtcatcatggac

SEQ ID NO: 819777 - DNA, 25 bp, Mus musculus
tggctctcgtgtggtcatcatggac

SEQ ID NO: 819778 - DNA, 25 bp, Mus musculus
tggctctctgatcgacgactacttg

SEQ ID NO: 819779 - DNA, 25 bp, Mus musculus
tggctctctgatggacgactacttg

SEQ ID NO: 819780 - DNA, 25 bp, Mus musculus
tggctctcttacactttcgcaggaa

SEQ ID NO: 819781 - DNA, 25 bp, Mus musculus
tggctctcttactctttcgcaggaa

SEQ ID NO: 819782 - DNA, 25 bp, Mus musculus
tggctctgaaatctgatcctcatgc

SEQ ID NO: 819783 - DNA, 25 bp, Mus musculus
tggctctgaaatgtgatcctcatgc

SEQ ID NO: 819784 - DNA, 25 bp, Mus musculus
tggctctgaagaaagtgttgatgga

SEQ ID NO: 819785 - DNA, 25 bp, Mus musculus
tggctctgaagatagtgttgatgga

SEQ ID NO: 819786 - DNA, 25 bp, Mus musculus
tggctctgaggactgcacagttatg

SEQ ID NO: 819787 - DNA, 25 bp, Mus musculus
tggctctgaggagtgcacagttatg

SEQ ID NO: 819788 - DNA, 25 bp, Mus musculus
tggctctgatgtcctttcgagaagc

SEQ ID NO: 819789 - DNA, 25 bp, Mus musculus
tggctctgatgtgctttcgagaagc

SEQ ID NO: 819790 - DNA, 25 bp, Mus musculus
tggctctgcctgactggctggaccc

SEQ ID NO: 819791 - DNA, 25 bp, Mus musculus
tggctctgcctgtctggctggaccc

SEQ ID NO: 819792 - DNA, 25 bp, Mus musculus
tggctctgccttcggacctacagct

SEQ ID NO: 819793 - DNA, 25 bp, Mus musculus
tggctctgccttgggacctacagct

SEQ ID NO: 819794 - DNA, 25 bp, Mus musculus
tggctctgcgcgagcgcaatgtgct

SEQ ID NO: 819795 - DNA, 25 bp, Mus musculus
tggctctgcgcgtgcgcaatgtgct

SEQ ID NO: 819796 - DNA, 25 bp, Mus musculus
tggctctgctgtactctggatatga

SEQ ID NO: 819797 - DNA, 25 bp, Mus musculus
tggctctgctgttctctggatatga

SEQ ID NO: 819798 - DNA, 25 bp, Mus musculus
tggctctgcttccagggaacgtgtc

SEQ ID NO: 819799 - DNA, 25 bp, Mus musculus
tggctctgcttcgagggaacgtgtc

SEQ ID NO: 819800 - DNA, 25 bp, Mus musculus
tggctctggcatacctgcgggcatc

SEQ ID NO: 819801 - DNA, 25 bp, Mus musculus
tggctctggcattcctgcgggcatc

SEQ ID NO: 819802 - DNA, 25 bp, Mus musculus
tggctctggtccagtggacagaaag

SEQ ID NO: 819803 - DNA, 25 bp, Mus musculus
tggctctggtcctgtggacagaaag

SEQ ID NO: 819804 - DNA, 25 bp, Mus musculus
tggctctgtcaaagttctccgtggc

SEQ ID NO: 819805 - DNA, 25 bp, Mus musculus
tggctctgtcaatgttctccgtggc

SEQ ID NO: 819806 - DNA, 25 bp, Mus musculus
tggctctgtgtgctcatcccgaagt

SEQ ID NO: 819807 - DNA, 25 bp, Mus musculus
tggctctgtgtggtcatcccgaagt

SEQ ID NO: 819808 - DNA, 25 bp, Mus musculus
tggctctgttgacggacctacacga

SEQ ID NO: 819809 - DNA, 25 bp, Mus musculus
tggctctgttgagggacctacacga

SEQ ID NO: 819810 - DNA, 25 bp, Mus musculus
tggctcttcatgctttccaaggtca

SEQ ID NO: 819811 - DNA, 25 bp, Mus musculus
tggctcttcatggtttccaaggtca

SEQ ID NO: 819812 - DNA, 25 bp, Mus musculus
tggctcttggccaagctgagtgtac

SEQ ID NO: 819813 - DNA, 25 bp, Mus musculus
tggctcttggcctagctgagtgtac

SEQ ID NO: 819814 - DNA, 25 bp, Mus musculus
tggctcttggcgagaccctcgagga

SEQ ID NO: 819815 - DNA, 25 bp, Mus musculus
tggctcttggcgtgaccctcgagga

SEQ ID NO: 819816 - DNA, 25 bp, Mus musculus
tggctctttgatactgagggaaaca

SEQ ID NO: 819817 - DNA, 25 bp, Mus musculus
tggctctttgattctgagggaaaca

SEQ ID NO: 819818 - DNA, 25 bp, Mus musculus
tggctgaaacacctcgtcatcaacg

SEQ ID NO: 819819 - DNA, 25 bp, Mus musculus
tggctgaaacacgtcgtcatcaacg

SEQ ID NO: 819820 - DNA, 25 bp, Mus musculus
tggctgaaacagcacgactggacct

SEQ ID NO: 819821 - DNA, 25 bp, Mus musculus
tggctgaaacaggacgactggacct

SEQ ID NO: 819822 - DNA, 25 bp, Mus musculus
tggctgaacagaaaccattccctgt

SEQ ID NO: 819823 - DNA, 25 bp, Mus musculus
tggctgaacagataccattccctgt

SEQ ID NO: 819824 - DNA, 25 bp, Mus musculus
tggctgaagagaacaggcgcctctc

SEQ ID NO: 819825 - DNA, 25 bp, Mus musculus
tggctgaagagatcaggcgcctctc

SEQ ID NO: 819826 - DNA, 25 bp, Mus musculus
tggctgaagctcagggtatcctgtg

SEQ ID NO: 819827 - DNA, 25 bp, Mus musculus
tggctgaagctctgggtatcctgtg

SEQ ID NO: 819828 - DNA, 25 bp, Mus musculus
tggctgaaggccacaaagcaagctt

SEQ ID NO: 819829 - DNA, 25 bp, Mus musculus
tggctgaaggcctcaaagcaagctt

SEQ ID NO: 819830 - DNA, 25 bp, Mus musculus
tggctgaaggcgaactgaaggatat

SEQ ID NO: 819831 - DNA, 25 bp, Mus musculus
tggctgaaggcgtactgaaggatat

SEQ ID NO: 819832 - DNA, 25 bp, Mus musculus
tggctgaatactagaaactggagtt

SEQ ID NO: 819833 - DNA, 25 bp, Mus musculus
tggctgaatacttgaaactggagtt

SEQ ID NO: 819834 - DNA, 25 bp, Mus musculus
tggctgacaccaagggcgtaaagag

SEQ ID NO: 819835 - DNA, 25 bp, Mus musculus
tggctgacaccatgggcgtaaagag

SEQ ID NO: 819836 - DNA, 25 bp, Mus musculus
tggctgacagttagacagttgggca

SEQ ID NO: 819837 - DNA, 25 bp, Mus musculus
tggctgacagtttgacagttgggca

SEQ ID NO: 819838 - DNA, 25 bp, Mus musculus
tggctgaccccactggagcctttgg

SEQ ID NO: 819839 - DNA, 25 bp, Mus musculus
tggctgaccccagtggagcctttgg

SEQ ID NO: 819840 - DNA, 25 bp, Mus musculus
tggctgacctccacagcgcagatca

SEQ ID NO: 819841 - DNA, 25 bp, Mus musculus
tggctgacctcctcagcgcagatca

SEQ ID NO: 819842 - DNA, 25 bp, Mus musculus
tggctgacctgcagacggaccagcg

SEQ ID NO: 819843 - DNA, 25 bp, Mus musculus
tggctgacctgctgacggaccagcg

SEQ ID NO: 819844 - DNA, 25 bp, Mus musculus
tggctgacgcggctgacctctcaca

SEQ ID NO: 819845 - DNA, 25 bp, Mus musculus
tggctgacgcgggtgacctctcaca

SEQ ID NO: 819846 - DNA, 25 bp, Mus musculus
tggctgacgtgtcccagtatcatgt

SEQ ID NO: 819847 - DNA, 25 bp, Mus musculus
tggctgacgtgtgccagtatcatgt

SEQ ID NO: 819848 - DNA, 25 bp, Mus musculus
tggctgactcccaagggcaatggca

SEQ ID NO: 819849 - DNA, 25 bp, Mus musculus
tggctgactccctagggcaatggca

SEQ ID NO: 819850 - DNA, 25 bp, Mus musculus
tggctgactctgacgttatgctcaa

SEQ ID NO: 819851 - DNA, 25 bp, Mus musculus
tggctgactctgtcgttatgctcaa

SEQ ID NO: 819852 - DNA, 25 bp, Mus musculus
tggctgactgctcaatacttattgc

SEQ ID NO: 819853 - DNA, 25 bp, Mus musculus
tggctgactgctgaatacttattgc

SEQ ID NO: 819854 - DNA, 25 bp, Mus musculus
tggctgactgtgagaagaaagtcaa

SEQ ID NO: 819855 - DNA, 25 bp, Mus musculus
tggctgactgtgtgaagaaagtcaa

SEQ ID NO: 819856 - DNA, 25 bp, Mus musculus
tggctgactgttctgccaccagtga

SEQ ID NO: 819857 - DNA, 25 bp, Mus musculus
tggctgactgttgtgccaccagtga

SEQ ID NO: 819858 - DNA, 25 bp, Mus musculus
tggctgacttttaaccctgggtgca

SEQ ID NO: 819859 - DNA, 25 bp, Mus musculus
tggctgactttttaccctgggtgca

SEQ ID NO: 819860 - DNA, 25 bp, Mus musculus
tggctgagaacactagcaacgtgcg

SEQ ID NO: 819861 - DNA, 25 bp, Mus musculus
tggctgagaacagtagcaacgtgcg

SEQ ID NO: 819862 - DNA, 25 bp, Mus musculus
tggctgagcaagattcccaccatcc

SEQ ID NO: 819863 - DNA, 25 bp, Mus musculus
tggctgagcaagtttcccaccatcc

SEQ ID NO: 819864 - DNA, 25 bp, Mus musculus
tggctgagccagactacatagaaga

SEQ ID NO: 819865 - DNA, 25 bp, Mus musculus
tggctgagccagtctacatagaaga

SEQ ID NO: 819866 - DNA, 25 bp, Mus musculus
tggctgagcccaactacctctgttt

SEQ ID NO: 819867 - DNA, 25 bp, Mus musculus
tggctgagcccatctacctctgttt

SEQ ID NO: 819868 - DNA, 25 bp, Mus musculus
tggctgagcgagcatctgagctacc

SEQ ID NO: 819869 - DNA, 25 bp, Mus musculus
tggctgagcgaggatctgagctacc

SEQ ID NO: 819870 - DNA, 25 bp, Mus musculus
tggctgagcggcagggagacgccaa

SEQ ID NO: 819871 - DNA, 25 bp, Mus musculus
tggctgagcggctgggagacgccaa

SEQ ID NO: 819872 - DNA, 25 bp, Mus musculus
tggctgagctgtagaccggaagaac

SEQ ID NO: 819873 - DNA, 25 bp, Mus musculus
tggctgagctgttgaccggaagaac

SEQ ID NO: 819874 - DNA, 25 bp, Mus musculus
tggctgagcttgaacatgatgtcag

SEQ ID NO: 819875 - DNA, 25 bp, Mus musculus
tggctgagcttgatgctggcatttc

SEQ ID NO: 819876 - DNA, 25 bp, Mus musculus
tggctgagcttgtacatgatgtcag

SEQ ID NO: 819877 - DNA, 25 bp, Mus musculus
tggctgagcttgttgctggcatttc

SEQ ID NO: 819878 - DNA, 25 bp, Mus musculus
tggctgaggagcaccgaacatctct

SEQ ID NO: 819879 - DNA, 25 bp, Mus musculus
tggctgaggagctccgaacatctct

SEQ ID NO: 819880 - DNA, 25 bp, Mus musculus
tggctgaggaggaatcaggtaccaa

SEQ ID NO: 819881 - DNA, 25 bp, Mus musculus
tggctgaggaggtatcaggtaccaa

SEQ ID NO: 819882 - DNA, 25 bp, Mus musculus
tggctgaggcctagaaccaagtgac

SEQ ID NO: 819883 - DNA, 25 bp, Mus musculus
tggctgaggccttgaaccaagtgac

SEQ ID NO: 819884 - DNA, 25 bp, Mus musculus
tggctgagggttatgaatcccgacc

SEQ ID NO: 819885 - DNA, 25 bp, Mus musculus
tggctgagggttttgaatcccgacc

SEQ ID NO: 819886 - DNA, 25 bp, Mus musculus
tggctgaggtgaagggcaaacatta

SEQ ID NO: 819887 - DNA, 25 bp, Mus musculus
tggctgaggtgatgggcaaacatta

SEQ ID NO: 819888 - DNA, 25 bp, Mus musculus
tggctgagtcagcaaggcctcagat

SEQ ID NO: 819889 - DNA, 25 bp, Mus musculus
tggctgagtcaggaaggcctcagat

SEQ ID NO: 819890 - DNA, 25 bp, Mus musculus
tggctgagttacagactcacccgga

SEQ ID NO: 819891 - DNA, 25 bp, Mus musculus
tggctgagttactgactcacccgga

SEQ ID NO: 819892 - DNA, 25 bp, Mus musculus
tggctgatacctactaccgcatcca

SEQ ID NO: 819893 - DNA, 25 bp, Mus musculus
tggctgataccttctaccgcatcca

SEQ ID NO: 819894 - DNA, 25 bp, Mus musculus
tggctgatagctacaaccccaggga

SEQ ID NO: 819895 - DNA, 25 bp, Mus musculus
tggctgatagcttcaaccccaggga

SEQ ID NO: 819896 - DNA, 25 bp, Mus musculus
tggctgatgaccaatgttggtgctg

SEQ ID NO: 819897 - DNA, 25 bp, Mus musculus
tggctgatgacctatgttggtgctg

SEQ ID NO: 819898 - DNA, 25 bp, Mus musculus
tggctgatgctgagctgtccagaag

SEQ ID NO: 819899 - DNA, 25 bp, Mus musculus
tggctgatgctgtgctgtccagaag

SEQ ID NO: 819900 - DNA, 25 bp, Mus musculus
tggctgatgtataaagacaagcggg

SEQ ID NO: 819901 - DNA, 25 bp, Mus musculus
tggctgatgtattaagacaagcggg

SEQ ID NO: 819902 - DNA, 25 bp, Mus musculus
tggctgattcccagctgacctcgga

SEQ ID NO: 819903 - DNA, 25 bp, Mus musculus
tggctgattccctgctgacctcgga

SEQ ID NO: 819904 - DNA, 25 bp, Mus musculus
tggctgcaagcacatactggtgcct

SEQ ID NO: 819905 - DNA, 25 bp, Mus musculus
tggctgcaagcagatactggtgcct

SEQ ID NO: 819906 - DNA, 25 bp, Mus musculus
tggctgcaattgcatgaaatcccaa

SEQ ID NO: 819907 - DNA, 25 bp, Mus musculus
tggctgcaattggatgaaatcccaa

SEQ ID NO: 819908 - DNA, 25 bp, Mus musculus
tggctgcaccgtcacattgctggag

SEQ ID NO: 819909 - DNA, 25 bp, Mus musculus
tggctgcaccgtgacattgctggag

SEQ ID NO: 819910 - DNA, 25 bp, Mus musculus
tggctgcagaaacacttcggactct

SEQ ID NO: 819911 - DNA, 25 bp, Mus musculus
tggctgcagaaagacttcggactct

SEQ ID NO: 819912 - DNA, 25 bp, Mus musculus
tggctgcagagtcattcagcgtatc

SEQ ID NO: 819913 - DNA, 25 bp, Mus musculus
tggctgcagagtgattcagcgtatc

SEQ ID NO: 819914 - DNA, 25 bp, Mus musculus
tggctgcagatacaccttaacaagg

SEQ ID NO: 819915 - DNA, 25 bp, Mus musculus
tggctgcagatagaccttaacaagg

SEQ ID NO: 819916 - DNA, 25 bp, Mus musculus
tggctgcagcatctcgggcatttct

SEQ ID NO: 819917 - DNA, 25 bp, Mus musculus
tggctgcagcatgtcgggcatttct

SEQ ID NO: 819918 - DNA, 25 bp, Mus musculus
tggctgcagcgaaacctgcccggtt

SEQ ID NO: 819919 - DNA, 25 bp, Mus musculus
tggctgcagcgatacctgcccggtt

SEQ ID NO: 819920 - DNA, 25 bp, Mus musculus
tggctgcagcgcacagtctccgcag

SEQ ID NO: 819921 - DNA, 25 bp, Mus musculus
tggctgcagcgctcagtctccgcag

SEQ ID NO: 819922 - DNA, 25 bp, Mus musculus
tggctgcagcttctattgccaacat

SEQ ID NO: 819923 - DNA, 25 bp, Mus musculus
tggctgcagcttgtattgccaacat

SEQ ID NO: 819924 - DNA, 25 bp, Mus musculus
tggctgcaggaactctagtgcattc

SEQ ID NO: 819925 - DNA, 25 bp, Mus musculus
tggctgcaggaagtctagtgcattc

SEQ ID NO: 819926 - DNA, 25 bp, Mus musculus
tggctgcaggagatagatcgctacg

SEQ ID NO: 819927 - DNA, 25 bp, Mus musculus
tggctgcaggagttagatcgctacg

SEQ ID NO: 819928 - DNA, 25 bp, Mus musculus
tggctgcatctgcaggatacgtgaa

SEQ ID NO: 819929 - DNA, 25 bp, Mus musculus
tggctgcatctggaggatacgtgaa

SEQ ID NO: 819930 - DNA, 25 bp, Mus musculus
tggctgccaccgcaagagttgcctc

SEQ ID NO: 819931 - DNA, 25 bp, Mus musculus
tggctgccaccggaagagttgcctc

SEQ ID NO: 819932 - DNA, 25 bp, Mus musculus
tggctgccacgccagcaggatttgc

SEQ ID NO: 819933 - DNA, 25 bp, Mus musculus
tggctgccacgcgagcaggatttgc

SEQ ID NO: 819934 - DNA, 25 bp, Mus musculus
tggctgccactgataccaatggaga

SEQ ID NO: 819935 - DNA, 25 bp, Mus musculus
tggctgccactgttaccaatggaga

SEQ ID NO: 819936 - DNA, 25 bp, Mus musculus
tggctgccagcaacaggaaggaggg

SEQ ID NO: 819937 - DNA, 25 bp, Mus musculus
tggctgccagcatcaggaaggaggg

SEQ ID NO: 819938 - DNA, 25 bp, Mus musculus
tggctgcccctaccatgtcagttcg

SEQ ID NO: 819939 - DNA, 25 bp, Mus musculus
tggctgcccctagcatgtcagttcg

SEQ ID NO: 819940 - DNA, 25 bp, Mus musculus
tggctgcccgatactctcgttcaga

SEQ ID NO: 819941 - DNA, 25 bp, Mus musculus
tggctgcccgattctctcgttcaga

SEQ ID NO: 819942 - DNA, 25 bp, Mus musculus
tggctgccctggatagcctggtaca

SEQ ID NO: 819943 - DNA, 25 bp, Mus musculus
tggctgccctggttagcctggtaca

SEQ ID NO: 819944 - DNA, 25 bp, Mus musculus
tggctgccggccagtcatgcttgtg

SEQ ID NO: 819945 - DNA, 25 bp, Mus musculus
tggctgccggcctgtcatgcttgtg

SEQ ID NO: 819946 - DNA, 25 bp, Mus musculus
tggctgccgtagctgccgttctcta

SEQ ID NO: 819947 - DNA, 25 bp, Mus musculus
tggctgccgtaggtgccgttctcta

SEQ ID NO: 819948 - DNA, 25 bp, Mus musculus
tggctgccgtgaaccagaaagcgtt

SEQ ID NO: 819949 - DNA, 25 bp, Mus musculus
tggctgccgtgatccagaaagcgtt

SEQ ID NO: 819950 - DNA, 25 bp, Mus musculus
tggctgcctcaaaatgacctgcttg

SEQ ID NO: 819951 - DNA, 25 bp, Mus musculus
tggctgcctcaatatgacctgcttg

SEQ ID NO: 819952 - DNA, 25 bp, Mus musculus
tggctgcctcttagactctactctg

SEQ ID NO: 819953 - DNA, 25 bp, Mus musculus
tggctgcctcttatctatcctgttt

SEQ ID NO: 819954 - DNA, 25 bp, Mus musculus
tggctgcctctttgactctactctg

SEQ ID NO: 819955 - DNA, 25 bp, Mus musculus
tggctgcctcttttctatcctgttt

SEQ ID NO: 819956 - DNA, 25 bp, Mus musculus
tggctgcctgcaagatcataaagga

SEQ ID NO: 819957 - DNA, 25 bp, Mus musculus
tggctgcctgcatgatcataaagga

SEQ ID NO: 819958 - DNA, 25 bp, Mus musculus
tggctgcctgctagattatccttac

SEQ ID NO: 819959 - DNA, 25 bp, Mus musculus
tggctgcctgcttgattatccttac

SEQ ID NO: 819960 - DNA, 25 bp, Mus musculus
tggctgccttctcccgttccgggtt

SEQ ID NO: 819961 - DNA, 25 bp, Mus musculus
tggctgccttctgccgttccgggtt

SEQ ID NO: 819962 - DNA, 25 bp, Mus musculus
tggctgccttgaccagacacaccaa

SEQ ID NO: 819963 - DNA, 25 bp, Mus musculus
tggctgccttgagcagacacaccaa

SEQ ID NO: 819964 - DNA, 25 bp, Mus musculus
tggctgcgcagaccccttttcagtc

SEQ ID NO: 819965 - DNA, 25 bp, Mus musculus
tggctgcgcagagcccttttcagtc

SEQ ID NO: 819966 - DNA, 25 bp, Mus musculus
tggctgcgcagtacgggcattatga

SEQ ID NO: 819967 - DNA, 25 bp, Mus musculus
tggctgcgcagttcgggcattatga

SEQ ID NO: 819968 - DNA, 25 bp, Mus musculus
tggctgcggatgagtgacgcacttc

SEQ ID NO: 819969 - DNA, 25 bp, Mus musculus
tggctgcggatgtgtgacgcacttc

SEQ ID NO: 819970 - DNA, 25 bp, Mus musculus
tggctgcggtggacaggaaccagtt

SEQ ID NO: 819971 - DNA, 25 bp, Mus musculus
tggctgcggtggtcaggaaccagtt

SEQ ID NO: 819972 - DNA, 25 bp, Mus musculus
tggctgcgtcctactgcagaagcat

SEQ ID NO: 819973 - DNA, 25 bp, Mus musculus
tggctgcgtccttctgcagaagcat

SEQ ID NO: 819974 - DNA, 25 bp, Mus musculus
tggctgctatcaccttgatcatcgg

SEQ ID NO: 819975 - DNA, 25 bp, Mus musculus
tggctgctatcagcttgatcatcgg

SEQ ID NO: 819976 - DNA, 25 bp, Mus musculus
tggctgctcattcctctgatcttcc

SEQ ID NO: 819977 - DNA, 25 bp, Mus musculus
tggctgctcattgctctgatcttcc

SEQ ID NO: 819978 - DNA, 25 bp, Mus musculus
tggctgctccggaggccctcgctga

SEQ ID NO: 819979 - DNA, 25 bp, Mus musculus
tggctgctccggtggccctcgctga

SEQ ID NO: 819980 - DNA, 25 bp, Mus musculus
tggctgctcttaaggaactagaagt

SEQ ID NO: 819981 - DNA, 25 bp, Mus musculus
tggctgctcttatggaactagaagt

SEQ ID NO: 819982 - DNA, 25 bp, Mus musculus
tggctgctctttatctggagccgcc

SEQ ID NO: 819983 - DNA, 25 bp, Mus musculus
tggctgctctttttctggagccgcc

SEQ ID NO: 819984 - DNA, 25 bp, Mus musculus
tggctgctgaccatcttagctgcaa

SEQ ID NO: 819985 - DNA, 25 bp, Mus musculus
tggctgctgaccttcttagctgcaa

SEQ ID NO: 819986 - DNA, 25 bp, Mus musculus
tggctgctgagtccccaaactgaga

SEQ ID NO: 819987 - DNA, 25 bp, Mus musculus
tggctgctgagtgcccaaactgaga

SEQ ID NO: 819988 - DNA, 25 bp, Mus musculus
tggctgctgccacgaggccgccatt

SEQ ID NO: 819989 - DNA, 25 bp, Mus musculus
tggctgctgccaggaggccgccatt

SEQ ID NO: 819990 - DNA, 25 bp, Mus musculus
tggctgctggcaccagtgttcgact

SEQ ID NO: 819991 - DNA, 25 bp, Mus musculus
tggctgctggcagcagtgttcgact

SEQ ID NO: 819992 - DNA, 25 bp, Mus musculus
tggctgctggttacccacccttctt

SEQ ID NO: 819993 - DNA, 25 bp, Mus musculus
tggctgctggtttcccacccttctt

SEQ ID NO: 819994 - DNA, 25 bp, Mus musculus
tggctgctgtaaagtgatccgtcac

SEQ ID NO: 819995 - DNA, 25 bp, Mus musculus
tggctgctgtaatgtgatccgtcac

SEQ ID NO: 819996 - DNA, 25 bp, Mus musculus
tggctgcttgatcccttgctgaatg

SEQ ID NO: 819997 - DNA, 25 bp, Mus musculus
tggctgcttgatgccttgctgaatg

SEQ ID NO: 819998 - DNA, 25 bp, Mus musculus
tggctgcttggtctccagtccgttg

SEQ ID NO: 819999 - DNA, 25 bp, Mus musculus
tggctgcttggtgtccagtccgttg

SEQ ID NO: 820000 - DNA, 25 bp, Mus musculus
tggctggaaacaaggcgtcgcgcaa

SEQ ID NO: 820001 - DNA, 25 bp, Mus musculus
tggctggaaacatggcgtcgcgcaa

SEQ ID NO: 820002 - DNA, 25 bp, Mus musculus
tggctggaaagaacacctggtttag

SEQ ID NO: 820003 - DNA, 25 bp, Mus musculus
tggctggaaagatcacctggtttag

SEQ ID NO: 820004 - DNA, 25 bp, Mus musculus
tggctggaacaaagtggctcacatc

SEQ ID NO: 820005 - DNA, 25 bp, Mus musculus
tggctggaacaatgtggctcacatc

SEQ ID NO: 820006 - DNA, 25 bp, Mus musculus
tggctggaacgcacagatcaccctg

SEQ ID NO: 820007 - DNA, 25 bp, Mus musculus
tggctggaacgctcagatcaccctg

SEQ ID NO: 820008 - DNA, 25 bp, Mus musculus
tggctggaacggaccatgcgatccg

SEQ ID NO: 820009 - DNA, 25 bp, Mus musculus
tggctggaacggtccatgcgatccg

SEQ ID NO: 820010 - DNA, 25 bp, Mus musculus
tggctggacaaaattgacagacgtt

SEQ ID NO: 820011 - DNA, 25 bp, Mus musculus
tggctggacaaatttgacagacgtt

SEQ ID NO: 820012 - DNA, 25 bp, Mus musculus
tggctggacaagctgtgcatgattc

SEQ ID NO: 820013 - DNA, 25 bp, Mus musculus
tggctggacaaggtgtgcatgattc

SEQ ID NO: 820014 - DNA, 25 bp, Mus musculus
tggctggaccatcacctagctgacc

SEQ ID NO: 820015 - DNA, 25 bp, Mus musculus
tggctggaccatgacctagctgacc

SEQ ID NO: 820016 - DNA, 25 bp, Mus musculus
tggctggaccccaccaaggaaatca

SEQ ID NO: 820017 - DNA, 25 bp, Mus musculus
tggctggacccctccaaggaaatca

SEQ ID NO: 820018 - DNA, 25 bp, Mus musculus
tggctggaccggctcgtgaactact

SEQ ID NO: 820019 - DNA, 25 bp, Mus musculus
tggctggaccgggtcgtgaactact

SEQ ID NO: 820020 - DNA, 25 bp, Mus musculus
tggctggagacaagaatggactcag

SEQ ID NO: 820021 - DNA, 25 bp, Mus musculus
tggctggagacatgaatggactcag

SEQ ID NO: 820022 - DNA, 25 bp, Mus musculus
tggctggagctactcaggcactccc

SEQ ID NO: 820023 - DNA, 25 bp, Mus musculus
tggctggagctagtcaggcactccc

SEQ ID NO: 820024 - DNA, 25 bp, Mus musculus
tggctggaggccagtttggacttta

SEQ ID NO: 820025 - DNA, 25 bp, Mus musculus
tggctggaggcctgtttggacttta

SEQ ID NO: 820026 - DNA, 25 bp, Mus musculus
tggctggagtctccgaatatgagct

SEQ ID NO: 820027 - DNA, 25 bp, Mus musculus
tggctggagtctgcgaatatgagct

SEQ ID NO: 820028 - DNA, 25 bp, Mus musculus
tggctggatcccaatcttcgatatg

SEQ ID NO: 820029 - DNA, 25 bp, Mus musculus
tggctggatccctatcttcgatatg

SEQ ID NO: 820030 - DNA, 25 bp, Mus musculus
tggctggatcgtactagggccctac

SEQ ID NO: 820031 - DNA, 25 bp, Mus musculus
tggctggatcgttctagggccctac

SEQ ID NO: 820032 - DNA, 25 bp, Mus musculus
tggctggcatcccacatggcatgag

SEQ ID NO: 820033 - DNA, 25 bp, Mus musculus
tggctggcatccgacatggcatgag

SEQ ID NO: 820034 - DNA, 25 bp, Mus musculus
tggctggcatttcactggaacacgc

SEQ ID NO: 820035 - DNA, 25 bp, Mus musculus
tggctggcatttgactggaacacgc

SEQ ID NO: 820036 - DNA, 25 bp, Mus musculus
tggctggctaaacttcggatgatga

SEQ ID NO: 820037 - DNA, 25 bp, Mus musculus
tggctggctaaagttcggatgatga

SEQ ID NO: 820038 - DNA, 25 bp, Mus musculus
tggctggctaccatgggtctaactg

SEQ ID NO: 820039 - DNA, 25 bp, Mus musculus
tggctggctaccttgggtctaactg

SEQ ID NO: 820040 - DNA, 25 bp, Mus musculus
tggctggctcacagcctcggtttag

SEQ ID NO: 820041 - DNA, 25 bp, Mus musculus
tggctggctcactgcctcggtttag

SEQ ID NO: 820042 - DNA, 25 bp, Mus musculus
tggctgggagaaaatagaggaccct

SEQ ID NO: 820043 - DNA, 25 bp, Mus musculus
tggctgggagaatatagaggaccct

SEQ ID NO: 820044 - DNA, 25 bp, Mus musculus
tggctgggcacacggtaaactcttc

SEQ ID NO: 820045 - DNA, 25 bp, Mus musculus
tggctgggcacagggtaaactcttc

SEQ ID NO: 820046 - DNA, 25 bp, Mus musculus
tggctgggcactcaacatgaaggaa

SEQ ID NO: 820047 - DNA, 25 bp, Mus musculus
tggctgggcactgaacatgaaggaa

SEQ ID NO: 820048 - DNA, 25 bp, Mus musculus
tggctgggcaggaaaagggtagctg

SEQ ID NO: 820049 - DNA, 25 bp, Mus musculus
tggctgggcaggtaaagggtagctg

SEQ ID NO: 820050 - DNA, 25 bp, Mus musculus
tggctgggctgaatgctatccagat

SEQ ID NO: 820051 - DNA, 25 bp, Mus musculus
tggctgggctgattgctatccagat

SEQ ID NO: 820052 - DNA, 25 bp, Mus musculus
tggctgggtatgaatgcagaatccc

SEQ ID NO: 820053 - DNA, 25 bp, Mus musculus
tggctgggtatgtatgcagaatccc

SEQ ID NO: 820054 - DNA, 25 bp, Mus musculus
tggctgggtgacatttgaccgcagt

SEQ ID NO: 820055 - DNA, 25 bp, Mus musculus
tggctgggtgacttttgaccgcagt

SEQ ID NO: 820056 - DNA, 25 bp, Mus musculus
tggctggtacatcctgctggtcacc

SEQ ID NO: 820057 - DNA, 25 bp, Mus musculus
tggctggtacatgctgctggtcacc

SEQ ID NO: 820058 - DNA, 25 bp, Mus musculus
tggctgtaaactagacctaaagacc

SEQ ID NO: 820059 - DNA, 25 bp, Mus musculus
tggctgtaaacttgacctaaagacc

SEQ ID NO: 820060 - DNA, 25 bp, Mus musculus
tggctgtagacacctggacacagct

SEQ ID NO: 820061 - DNA, 25 bp, Mus musculus
tggctgtagacagctggacacagct

SEQ ID NO: 820062 - DNA, 25 bp, Mus musculus
tggctgtataggattcttccttcag

SEQ ID NO: 820063 - DNA, 25 bp, Mus musculus
tggctgtataggtttcttccttcag

SEQ ID NO: 820064 - DNA, 25 bp, Mus musculus
tggctgtatcctacacgtatcgtta

SEQ ID NO: 820065 - DNA, 25 bp, Mus musculus
tggctgtatccttcacgtatcgtta

SEQ ID NO: 820066 - DNA, 25 bp, Mus musculus
tggctgtatcggaggagaacccagc

SEQ ID NO: 820067 - DNA, 25 bp, Mus musculus
tggctgtatcggtggagaacccagc

SEQ ID NO: 820068 - DNA, 25 bp, Mus musculus
tggctgtatgcactcactgccctgg

SEQ ID NO: 820069 - DNA, 25 bp, Mus musculus
tggctgtatgcagtcactgccctgg

SEQ ID NO: 820070 - DNA, 25 bp, Mus musculus
tggctgtcatcactcagagggcctg

SEQ ID NO: 820071 - DNA, 25 bp, Mus musculus
tggctgtcatcagtcagagggcctg

SEQ ID NO: 820072 - DNA, 25 bp, Mus musculus
tggctgtccctgcagctagtgttgt

SEQ ID NO: 820073 - DNA, 25 bp, Mus musculus
tggctgtccctggagctagtgttgt

SEQ ID NO: 820074 - DNA, 25 bp, Mus musculus
tggctgtcgctgatcatccaggtgg

SEQ ID NO: 820075 - DNA, 25 bp, Mus musculus
tggctgtcgctgttcatccaggtgg

SEQ ID NO: 820076 - DNA, 25 bp, Mus musculus
tggctgtgaaacatgagtgattcta

SEQ ID NO: 820077 - DNA, 25 bp, Mus musculus
tggctgtgaaacttgagtgattcta

SEQ ID NO: 820078 - DNA, 25 bp, Mus musculus
tggctgtgaacacctctgtgtcaac

SEQ ID NO: 820079 - DNA, 25 bp, Mus musculus
tggctgtgaacagctctgtgtcaac

SEQ ID NO: 820080 - DNA, 25 bp, Mus musculus
tggctgtgagacatgcaaccggccc

SEQ ID NO: 820081 - DNA, 25 bp, Mus musculus
tggctgtgagacttgcaaccggccc

SEQ ID NO: 820082 - DNA, 25 bp, Mus musculus
tggctgtgattgcagactcccgacc

SEQ ID NO: 820083 - DNA, 25 bp, Mus musculus
tggctgtgattggagactcccgacc

SEQ ID NO: 820084 - DNA, 25 bp, Mus musculus
tggctgtgccccagttggactcaag

SEQ ID NO: 820085 - DNA, 25 bp, Mus musculus
tggctgtgcccctgttggactcaag

SEQ ID NO: 820086 - DNA, 25 bp, Mus musculus
tggctgtgcgccacgaggttacaga

SEQ ID NO: 820087 - DNA, 25 bp, Mus musculus
tggctgtgcgcctcgaggttacaga

SEQ ID NO: 820088 - DNA, 25 bp, Mus musculus
tggctgtgcgctcgaacagccctga

SEQ ID NO: 820089 - DNA, 25 bp, Mus musculus
tggctgtgcgctggaacagccctga

SEQ ID NO: 820090 - DNA, 25 bp, Mus musculus
tggctgtgctttccacctatctgcc

SEQ ID NO: 820091 - DNA, 25 bp, Mus musculus
tggctgtgctttgcacctatctgcc

SEQ ID NO: 820092 - DNA, 25 bp, Mus musculus
tggctgtggatcatgagaatgtcag

SEQ ID NO: 820093 - DNA, 25 bp, Mus musculus
tggctgtggatcttgagaatgtcag

SEQ ID NO: 820094 - DNA, 25 bp, Mus musculus
tggctgtggatgagaacgagctcct

SEQ ID NO: 820095 - DNA, 25 bp, Mus musculus
tggctgtggatgtgaacgagctcct

SEQ ID NO: 820096 - DNA, 25 bp, Mus musculus
tggctgtggcctatgccgcaaagcg

SEQ ID NO: 820097 - DNA, 25 bp, Mus musculus
tggctgtggcctttgccgcaaagcg

SEQ ID NO: 820098 - DNA, 25 bp, Mus musculus
tggctgtggctgacaacgtcgtcct

SEQ ID NO: 820099 - DNA, 25 bp, Mus musculus
tggctgtggctgtcaacgtcgtcct

SEQ ID NO: 820100 - DNA, 25 bp, Mus musculus
tggctgtggcttcccttacggctag

SEQ ID NO: 820101 - DNA, 25 bp, Mus musculus
tggctgtggcttgccttacggctag

SEQ ID NO: 820102 - DNA, 25 bp, Mus musculus
tggctgtgggagaaatgatcgtttc

SEQ ID NO: 820103 - DNA, 25 bp, Mus musculus
tggctgtgggagtaatgatcgtttc

SEQ ID NO: 820104 - DNA, 25 bp, Mus musculus
tggctgtggtttatccatttggaag

SEQ ID NO: 820105 - DNA, 25 bp, Mus musculus
tggctgtggtttttccatttggaag

SEQ ID NO: 820106 - DNA, 25 bp, Mus musculus
tggctgttccccaatgaaggacact

SEQ ID NO: 820107 - DNA, 25 bp, Mus musculus
tggctgttcccctatgaaggacact

SEQ ID NO: 820108 - DNA, 25 bp, Mus musculus
tggctgttctacctggcatccagaa

SEQ ID NO: 820109 - DNA, 25 bp, Mus musculus
tggctgttctacgtggcatccagaa

SEQ ID NO: 820110 - DNA, 25 bp, Mus musculus
tggctgtttgctccgttttcatgac

SEQ ID NO: 820111 - DNA, 25 bp, Mus musculus
tggctgtttgctgcgttttcatgac

SEQ ID NO: 820112 - DNA, 25 bp, Mus musculus
tggcttacaagcagggaagtaatgt

SEQ ID NO: 820113 - DNA, 25 bp, Mus musculus
tggcttacaagctgggaagtaatgt

SEQ ID NO: 820114 - DNA, 25 bp, Mus musculus
tggcttacagccagtcagagatgga

SEQ ID NO: 820115 - DNA, 25 bp, Mus musculus
tggcttacagcctgtcagagatgga

SEQ ID NO: 820116 - DNA, 25 bp, Mus musculus
tggcttacatccatacaccgattta

SEQ ID NO: 820117 - DNA, 25 bp, Mus musculus
tggcttacatccttacaccgattta

SEQ ID NO: 820118 - DNA, 25 bp, Mus musculus
tggcttaccactcgctagcctgctg

SEQ ID NO: 820119 - DNA, 25 bp, Mus musculus
tggcttaccactggctagcctgctg

SEQ ID NO: 820120 - DNA, 25 bp, Mus musculus
tggcttacttgtacggcgcctcgcc

SEQ ID NO: 820121 - DNA, 25 bp, Mus musculus
tggcttacttgttcggcgcctcgcc

SEQ ID NO: 820122 - DNA, 25 bp, Mus musculus
tggcttagaaagcattatgagtgac

SEQ ID NO: 820123 - DNA, 25 bp, Mus musculus
tggcttagaaaggattatgagtgac

SEQ ID NO: 820124 - DNA, 25 bp, Mus musculus
tggcttagacctaccggggcccagc

SEQ ID NO: 820125 - DNA, 25 bp, Mus musculus
tggcttagaccttccggggcccagc

SEQ ID NO: 820126 - DNA, 25 bp, Mus musculus
tggcttagcaccatggcggccgcga

SEQ ID NO: 820127 - DNA, 25 bp, Mus musculus
tggcttagcaccttggcggccgcga

SEQ ID NO: 820128 - DNA, 25 bp, Mus musculus
tggcttagtctacatgaagtatgac

SEQ ID NO: 820129 - DNA, 25 bp, Mus musculus
tggcttagtctagatgaagtatgac

SEQ ID NO: 820130 - DNA, 25 bp, Mus musculus
tggcttatcttcattgtgctgggcc

SEQ ID NO: 820131 - DNA, 25 bp, Mus musculus
tggcttatcttctttgtgctgggcc

SEQ ID NO: 820132 - DNA, 25 bp, Mus musculus
tggcttatttgccttcactctcagc

SEQ ID NO: 820133 - DNA, 25 bp, Mus musculus
tggcttatttgcgttcactctcagc

SEQ ID NO: 820134 - DNA, 25 bp, Mus musculus
tggcttcaaaatctctgggaatggc

SEQ ID NO: 820135 - DNA, 25 bp, Mus musculus
tggcttcaaaatgtctgggaatggc

SEQ ID NO: 820136 - DNA, 25 bp, Mus musculus
tggcttcaagccatcgggtcagcct

SEQ ID NO: 820137 - DNA, 25 bp, Mus musculus
tggcttcaagccttcgggtcagcct

SEQ ID NO: 820138 - DNA, 25 bp, Mus musculus
tggcttcaaggtaacttcgcggagt

SEQ ID NO: 820139 - DNA, 25 bp, Mus musculus
tggcttcaaggtaccagggctcggt

SEQ ID NO: 820140 - DNA, 25 bp, Mus musculus
tggcttcaaggttacttcgcggagt

SEQ ID NO: 820141 - DNA, 25 bp, Mus musculus
tggcttcaaggttccagggctcggt

SEQ ID NO: 820142 - DNA, 25 bp, Mus musculus
tggcttcaagtcacccaagggaggt

SEQ ID NO: 820143 - DNA, 25 bp, Mus musculus
tggcttcaagtctcccaagggaggt

SEQ ID NO: 820144 - DNA, 25 bp, Mus musculus
tggcttcaatgtcccaggagaaaga

SEQ ID NO: 820145 - DNA, 25 bp, Mus musculus
tggcttcaatgtgccaggagaaaga

SEQ ID NO: 820146 - DNA, 25 bp, Mus musculus
tggcttcaccggacctaaaaatggg

SEQ ID NO: 820147 - DNA, 25 bp, Mus musculus
tggcttcaccggtcctaaaaatggg

SEQ ID NO: 820148 - DNA, 25 bp, Mus musculus
tggcttcactgcattggctcttctg

SEQ ID NO: 820149 - DNA, 25 bp, Mus musculus
tggcttcactgctttggctcttctg

SEQ ID NO: 820150 - DNA, 25 bp, Mus musculus
tggcttcagaaaacacttatgcaga

SEQ ID NO: 820151 - DNA, 25 bp, Mus musculus
tggcttcagaaatcacttatgcaga

SEQ ID NO: 820152 - DNA, 25 bp, Mus musculus
tggcttcagaccaccgtcacagaga

SEQ ID NO: 820153 - DNA, 25 bp, Mus musculus
tggcttcagacctccgtcacagaga

SEQ ID NO: 820154 - DNA, 25 bp, Mus musculus
tggcttcagagaccactcatgaaca

SEQ ID NO: 820155 - DNA, 25 bp, Mus musculus
tggcttcagagagcactcatgaaca

SEQ ID NO: 820156 - DNA, 25 bp, Mus musculus
tggcttcagcgaacagtgagggtac

SEQ ID NO: 820157 - DNA, 25 bp, Mus musculus
tggcttcagcgatcagtgagggtac

SEQ ID NO: 820158 - DNA, 25 bp, Mus musculus
tggcttcagctgcagagtctcatga

SEQ ID NO: 820159 - DNA, 25 bp, Mus musculus
tggcttcagctggagagtctcatga

SEQ ID NO: 820160 - DNA, 25 bp, Mus musculus
tggcttcaggacacgctacgttttc

SEQ ID NO: 820161 - DNA, 25 bp, Mus musculus
tggcttcaggactcgctacgttttc

SEQ ID NO: 820162 - DNA, 25 bp, Mus musculus
tggcttcatattaggaaaatctctc

SEQ ID NO: 820163 - DNA, 25 bp, Mus musculus
tggcttcatatttggaaaatctctc

SEQ ID NO: 820164 - DNA, 25 bp, Mus musculus
tggcttccaaccagagcagtaccct

SEQ ID NO: 820165 - DNA, 25 bp, Mus musculus
tggcttccaacctgagcagtaccct

SEQ ID NO: 820166 - DNA, 25 bp, Mus musculus
tggcttccagctctaatagaactcc

SEQ ID NO: 820167 - DNA, 25 bp, Mus musculus
tggcttccagctctttctatggcaa

SEQ ID NO: 820168 - DNA, 25 bp, Mus musculus
tggcttccagctgtaatagaactcc

SEQ ID NO: 820169 - DNA, 25 bp, Mus musculus
tggcttccagctgtttctatggcaa

SEQ ID NO: 820170 - DNA, 25 bp, Mus musculus
tggcttcccaggcaaagatggacgt

SEQ ID NO: 820171 - DNA, 25 bp, Mus musculus
tggcttcccagggaaagatggacgt

SEQ ID NO: 820172 - DNA, 25 bp, Mus musculus
tggcttccccttaggctgtctcatc

SEQ ID NO: 820173 - DNA, 25 bp, Mus musculus
tggcttcccctttggctgtctcatc

SEQ ID NO: 820174 - DNA, 25 bp, Mus musculus
tggcttccggagacaataccaggat

SEQ ID NO: 820175 - DNA, 25 bp, Mus musculus
tggcttccggagtcaataccaggat

SEQ ID NO: 820176 - DNA, 25 bp, Mus musculus
tggcttccggttagcaacagtagct

SEQ ID NO: 820177 - DNA, 25 bp, Mus musculus
tggcttccggtttgcaacagtagct

SEQ ID NO: 820178 - DNA, 25 bp, Mus musculus
tggcttccgttgctgtggctaacaa

SEQ ID NO: 820179 - DNA, 25 bp, Mus musculus
tggcttccgttggtgtggctaacaa

SEQ ID NO: 820180 - DNA, 25 bp, Mus musculus
tggcttccgtttccccttatcaaag

SEQ ID NO: 820181 - DNA, 25 bp, Mus musculus
tggcttccgtttgcccttatcaaag

SEQ ID NO: 820182 - DNA, 25 bp, Mus musculus
tggcttcctataaccgtcctgagga

SEQ ID NO: 820183 - DNA, 25 bp, Mus musculus
tggcttcctatatccgtcctgagga

SEQ ID NO: 820184 - DNA, 25 bp, Mus musculus
tggcttcctggaagtaagcacagga

SEQ ID NO: 820185 - DNA, 25 bp, Mus musculus
tggcttcctggatgtaagcacagga

SEQ ID NO: 820186 - DNA, 25 bp, Mus musculus
tggcttcctggtcgaacaccatgta

SEQ ID NO: 820187 - DNA, 25 bp, Mus musculus
tggcttcctggtggaacaccatgta

SEQ ID NO: 820188 - DNA, 25 bp, Mus musculus
tggcttcgaggtactcagaccccag

SEQ ID NO: 820189 - DNA, 25 bp, Mus musculus
tggcttcgaggttctcagaccccag

SEQ ID NO: 820190 - DNA, 25 bp, Mus musculus
tggcttcgccacaaaccatgcagaa

SEQ ID NO: 820191 - DNA, 25 bp, Mus musculus
tggcttcgccactaaccatgcagaa

SEQ ID NO: 820192 - DNA, 25 bp, Mus musculus
tggcttcgtcctccttcgcgattat

SEQ ID NO: 820193 - DNA, 25 bp, Mus musculus
tggcttcgtcctgcttcgcgattat

SEQ ID NO: 820194 - DNA, 25 bp, Mus musculus
tggcttctatgtcgcgccaaatgga

SEQ ID NO: 820195 - DNA, 25 bp, Mus musculus
tggcttctatgtggcgccaaatgga

SEQ ID NO: 820196 - DNA, 25 bp, Mus musculus
tggcttctcagaactccttgttgga

SEQ ID NO: 820197 - DNA, 25 bp, Mus musculus
tggcttctcagatctccttgttgga

SEQ ID NO: 820198 - DNA, 25 bp, Mus musculus
tggcttctcaggcaacttctgtgag

SEQ ID NO: 820199 - DNA, 25 bp, Mus musculus
tggcttctcagggaacttctgtgag

SEQ ID NO: 820200 - DNA, 25 bp, Mus musculus
tggcttctcccacggaggccagttc

SEQ ID NO: 820201 - DNA, 25 bp, Mus musculus
tggcttctcccagggaggccagttc

SEQ ID NO: 820202 - DNA, 25 bp, Mus musculus
tggcttctccgtcgagttttaccgg

SEQ ID NO: 820203 - DNA, 25 bp, Mus musculus
tggcttctccgtggagttttaccgg

SEQ ID NO: 820204 - DNA, 25 bp, Mus musculus
tggcttctgatgacaatggccagga

SEQ ID NO: 820205 - DNA, 25 bp, Mus musculus
tggcttctgatgtcaatggccagga

SEQ ID NO: 820206 - DNA, 25 bp, Mus musculus
tggcttctgctaagtcaatgacata

SEQ ID NO: 820207 - DNA, 25 bp, Mus musculus
tggcttctgctatgtcaatgacata

SEQ ID NO: 820208 - DNA, 25 bp, Mus musculus
tggcttctgggcagcacagccgcag

SEQ ID NO: 820209 - DNA, 25 bp, Mus musculus
tggcttctgggctgcacagccgcag

SEQ ID NO: 820210 - DNA, 25 bp, Mus musculus
tggcttctgtcccaaggaaggacag

SEQ ID NO: 820211 - DNA, 25 bp, Mus musculus
tggcttctgtccgaaggaaggacag

SEQ ID NO: 820212 - DNA, 25 bp, Mus musculus
tggcttctgtgaaggagcctgtcac

SEQ ID NO: 820213 - DNA, 25 bp, Mus musculus
tggcttctgtgacaacacggacggc

SEQ ID NO: 820214 - DNA, 25 bp, Mus musculus
tggcttctgtgagaacacggacggc

SEQ ID NO: 820215 - DNA, 25 bp, Mus musculus
tggcttctgtgatggagcctgtcac

SEQ ID NO: 820216 - DNA, 25 bp, Mus musculus
tggcttcttcagagtttgctacttc

SEQ ID NO: 820217 - DNA, 25 bp, Mus musculus
tggcttcttcagatggcgcaagtct

SEQ ID NO: 820218 - DNA, 25 bp, Mus musculus
tggcttcttcagtgtttgctacttc

SEQ ID NO: 820219 - DNA, 25 bp, Mus musculus
tggcttcttcagttggcgcaagtct

SEQ ID NO: 820220 - DNA, 25 bp, Mus musculus
tggcttcttttactctggtgctggg

SEQ ID NO: 820221 - DNA, 25 bp, Mus musculus
tggcttcttttagtctggtgctggg

SEQ ID NO: 820222 - DNA, 25 bp, Mus musculus
tggcttgacaaaaggagaggaaccc

SEQ ID NO: 820223 - DNA, 25 bp, Mus musculus
tggcttgacaaatggagaggaaccc

SEQ ID NO: 820224 - DNA, 25 bp, Mus musculus
tggcttgacccaaccccatgagatg

SEQ ID NO: 820225 - DNA, 25 bp, Mus musculus
tggcttgacccatccccatgagatg

SEQ ID NO: 820226 - DNA, 25 bp, Mus musculus
tggcttgactggaaacaatatcata

SEQ ID NO: 820227 - DNA, 25 bp, Mus musculus
tggcttgactggtaacaatatcata

SEQ ID NO: 820228 - DNA, 25 bp, Mus musculus
tggcttgctaatcgccttctacttt

SEQ ID NO: 820229 - DNA, 25 bp, Mus musculus
tggcttgctaatggccttctacttt

SEQ ID NO: 820230 - DNA, 25 bp, Mus musculus
tggcttgctgtgaaggacgaacacc

SEQ ID NO: 820231 - DNA, 25 bp, Mus musculus
tggcttgctgtgaatccggtggatt

SEQ ID NO: 820232 - DNA, 25 bp, Mus musculus
tggcttgctgtgtaggacgaacacc

SEQ ID NO: 820233 - DNA, 25 bp, Mus musculus
tggcttgctgtgtatccggtggatt

SEQ ID NO: 820234 - DNA, 25 bp, Mus musculus
tggcttggaagcctcccaggttcct

SEQ ID NO: 820235 - DNA, 25 bp, Mus musculus
tggcttggaagcgtcccaggttcct

SEQ ID NO: 820236 - DNA, 25 bp, Mus musculus
tggcttggatccagaagcatattgc

SEQ ID NO: 820237 - DNA, 25 bp, Mus musculus
tggcttggatcctgaagcatattgc

SEQ ID NO: 820238 - DNA, 25 bp, Mus musculus
tggcttggcagaaccctatgtgaag

SEQ ID NO: 820239 - DNA, 25 bp, Mus musculus
tggcttggcagatccctatgtgaag

SEQ ID NO: 820240 - DNA, 25 bp, Mus musculus
tggcttggcagcaggcaattctgga

SEQ ID NO: 820241 - DNA, 25 bp, Mus musculus
tggcttggcagctggcaattctgga

SEQ ID NO: 820242 - DNA, 25 bp, Mus musculus
tggcttggccggatgccctcacagg

SEQ ID NO: 820243 - DNA, 25 bp, Mus musculus
tggcttggccggttgccctcacagg

SEQ ID NO: 820244 - DNA, 25 bp, Mus musculus
tggcttggcctgcaaatatcatgca

SEQ ID NO: 820245 - DNA, 25 bp, Mus musculus
tggcttggcctggaaatatcatgca

SEQ ID NO: 820246 - DNA, 25 bp, Mus musculus
tggcttggctcgacaatttactaat

SEQ ID NO: 820247 - DNA, 25 bp, Mus musculus
tggcttggctcgtcaatttactaat

SEQ ID NO: 820248 - DNA, 25 bp, Mus musculus
tggcttggctgtcgcgcgagccact

SEQ ID NO: 820249 - DNA, 25 bp, Mus musculus
tggcttggctgtggcgcgagccact

SEQ ID NO: 820250 - DNA, 25 bp, Mus musculus
tggcttgggcaaccttactcctccg

SEQ ID NO: 820251 - DNA, 25 bp, Mus musculus
tggcttgggcaagcttactcctccg

SEQ ID NO: 820252 - DNA, 25 bp, Mus musculus
tggcttgtcagaatctcctcaggaa

SEQ ID NO: 820253 - DNA, 25 bp, Mus musculus
tggcttgtcagattctcctcaggaa

SEQ ID NO: 820254 - DNA, 25 bp, Mus musculus
tggcttgtgccaatcccgtgactgt

SEQ ID NO: 820255 - DNA, 25 bp, Mus musculus
tggcttgtgccattcccgtgactgt

SEQ ID NO: 820256 - DNA, 25 bp, Mus musculus
tggcttgtgggcatcctaaaattcc

SEQ ID NO: 820257 - DNA, 25 bp, Mus musculus
tggcttgtgggcttcctaaaattcc

SEQ ID NO: 820258 - DNA, 25 bp, Mus musculus
tggcttgttgttacactgacgggac

SEQ ID NO: 820259 - DNA, 25 bp, Mus musculus
tggcttgttgtttcactgacgggac

SEQ ID NO: 820260 - DNA, 25 bp, Mus musculus
tggctttaatggagcagacctgaga

SEQ ID NO: 820261 - DNA, 25 bp, Mus musculus
tggctttaatggtgcagacctgaga

SEQ ID NO: 820262 - DNA, 25 bp, Mus musculus
tggctttaccaacgccttaggccac

SEQ ID NO: 820263 - DNA, 25 bp, Mus musculus
tggctttaccaaggccttaggccac

SEQ ID NO: 820264 - DNA, 25 bp, Mus musculus
tggctttacttaactcggctctcgg

SEQ ID NO: 820265 - DNA, 25 bp, Mus musculus
tggctttacttatctcggctctcgg

SEQ ID NO: 820266 - DNA, 25 bp, Mus musculus
tggctttcaacgagttcttcctcct

SEQ ID NO: 820267 - DNA, 25 bp, Mus musculus
tggctttcaacgtgttcttcctcct

SEQ ID NO: 820268 - DNA, 25 bp, Mus musculus
tggctttcactcacaattccctcag

SEQ ID NO: 820269 - DNA, 25 bp, Mus musculus
tggctttcactctcaattccctcag

SEQ ID NO: 820270 - DNA, 25 bp, Mus musculus
tggctttccagcaggcccagaattg

SEQ ID NO: 820271 - DNA, 25 bp, Mus musculus
tggctttccagctggcccagaattg

SEQ ID NO: 820272 - DNA, 25 bp, Mus musculus
tggctttccatgaacgtcttaatgc

SEQ ID NO: 820273 - DNA, 25 bp, Mus musculus
tggctttccatgtacgtcttaatgc

SEQ ID NO: 820274 - DNA, 25 bp, Mus musculus
tggctttcctggacatcatggtcct

SEQ ID NO: 820275 - DNA, 25 bp, Mus musculus
tggctttcctggtcatcatggtcct

SEQ ID NO: 820276 - DNA, 25 bp, Mus musculus
tggctttcggttatctcgtcaggaa

SEQ ID NO: 820277 - DNA, 25 bp, Mus musculus
tggctttcggttttctcgtcaggaa

SEQ ID NO: 820278 - DNA, 25 bp, Mus musculus
tggctttctgaacactgagactgaa

SEQ ID NO: 820279 - DNA, 25 bp, Mus musculus
tggctttctgaagactgagactgaa

SEQ ID NO: 820280 - DNA, 25 bp, Mus musculus
tggctttctgctcatctagggtggc

SEQ ID NO: 820281 - DNA, 25 bp, Mus musculus
tggctttctgctgatctagggtggc

SEQ ID NO: 820282 - DNA, 25 bp, Mus musculus
tggctttgaccaccatgtcaccggg

SEQ ID NO: 820283 - DNA, 25 bp, Mus musculus
tggctttgaccagcatgtcaccggg

SEQ ID NO: 820284 - DNA, 25 bp, Mus musculus
tggctttgactcactcttcctgctt

SEQ ID NO: 820285 - DNA, 25 bp, Mus musculus
tggctttgactctctcttcctgctt

SEQ ID NO: 820286 - DNA, 25 bp, Mus musculus
tggctttgagacaggtgacttcgtc

SEQ ID NO: 820287 - DNA, 25 bp, Mus musculus
tggctttgagactggtgacttcgtc

SEQ ID NO: 820288 - DNA, 25 bp, Mus musculus
tggctttgattcagaaagccatgcg

SEQ ID NO: 820289 - DNA, 25 bp, Mus musculus
tggctttgattctgaaagccatgcg

SEQ ID NO: 820290 - DNA, 25 bp, Mus musculus
tggctttgcacccaacatcctggag

SEQ ID NO: 820291 - DNA, 25 bp, Mus musculus
tggctttgcaccgaacatcctggag

SEQ ID NO: 820292 - DNA, 25 bp, Mus musculus
tggctttgcagcagcagtgactaca

SEQ ID NO: 820293 - DNA, 25 bp, Mus musculus
tggctttgcagctgcagtgactaca

SEQ ID NO: 820294 - DNA, 25 bp, Mus musculus
tggctttgcgggacgcattcacctc

SEQ ID NO: 820295 - DNA, 25 bp, Mus musculus
tggctttgcgggtcgcattcacctc

SEQ ID NO: 820296 - DNA, 25 bp, Mus musculus
tggctttgctgaaagtaattccttg

SEQ ID NO: 820297 - DNA, 25 bp, Mus musculus
tggctttgctgatagtaattccttg

SEQ ID NO: 820298 - DNA, 25 bp, Mus musculus
tggctttggcatagccctgagcacc

SEQ ID NO: 820299 - DNA, 25 bp, Mus musculus
tggctttggcattgccctgagcacc

SEQ ID NO: 820300 - DNA, 25 bp, Mus musculus
tggctttggccacgtttttctcctt

SEQ ID NO: 820301 - DNA, 25 bp, Mus musculus
tggctttggccaggtttttctcctt

SEQ ID NO: 820302 - DNA, 25 bp, Mus musculus
tggctttggcccagccgatcgtggt

SEQ ID NO: 820303 - DNA, 25 bp, Mus musculus
tggctttggccctgccgatcgtggt

SEQ ID NO: 820304 - DNA, 25 bp, Mus musculus
tggctttggttcagtaacagggaaa

SEQ ID NO: 820305 - DNA, 25 bp, Mus musculus
tggctttggttctgtaacagggaaa

SEQ ID NO: 820306 - DNA, 25 bp, Mus musculus
tggctttgtcagcttcaaagacccc

SEQ ID NO: 820307 - DNA, 25 bp, Mus musculus
tggctttgtcaggttcaaagacccc

SEQ ID NO: 820308 - DNA, 25 bp, Mus musculus
tggctttgtccaacaccagccctga

SEQ ID NO: 820309 - DNA, 25 bp, Mus musculus
tggctttgtccatcaccagccctga

SEQ ID NO: 820310 - DNA, 25 bp, Mus musculus
tggcttttgtaaagaagaggaggaa

SEQ ID NO: 820311 - DNA, 25 bp, Mus musculus
tggcttttgtaatgaagaggaggaa

SEQ ID NO: 820312 - DNA, 25 bp, Mus musculus
tggctttttgagaaccaccggccca

SEQ ID NO: 820313 - DNA, 25 bp, Mus musculus
tggctttttgagtaccaccggccca

SEQ ID NO: 820314 - DNA, 25 bp, Mus musculus
tgggaaaaacaacgagcccctgaga

SEQ ID NO: 820315 - DNA, 25 bp, Mus musculus
tgggaaaaacaaggagcccctgaga

SEQ ID NO: 820316 - DNA, 25 bp, Mus musculus
tgggaaaaagcaattcgccaggccc

SEQ ID NO: 820317 - DNA, 25 bp, Mus musculus
tgggaaaaagcatttcgccaggccc

SEQ ID NO: 820318 - DNA, 25 bp, Mus musculus
tgggaaaaaggaaatgcggattctc

SEQ ID NO: 820319 - DNA, 25 bp, Mus musculus
tgggaaaaaggatatgcggattctc

SEQ ID NO: 820320 - DNA, 25 bp, Mus musculus
tgggaaaaatagacccctgtgaatt

SEQ ID NO: 820321 - DNA, 25 bp, Mus musculus
tgggaaaaatagtcccctgtgaatt

SEQ ID NO: 820322 - DNA, 25 bp, Mus musculus
tgggaaaaatttcgtccaaatactg

SEQ ID NO: 820323 - DNA, 25 bp, Mus musculus
tgggaaaaatttggtccaaatactg

SEQ ID NO: 820324 - DNA, 25 bp, Mus musculus
tgggaaaacaatcaagctacagata

SEQ ID NO: 820325 - DNA, 25 bp, Mus musculus
tgggaaaacaatgaagctacagata

SEQ ID NO: 820326 - DNA, 25 bp, Mus musculus
tgggaaaacactcttggcacgagct

SEQ ID NO: 820327 - DNA, 25 bp, Mus musculus
tgggaaaacactgttggcacgagct

SEQ ID NO: 820328 - DNA, 25 bp, Mus musculus
tgggaaaacaggctccagtccgtgc

SEQ ID NO: 820329 - DNA, 25 bp, Mus musculus
tgggaaaacagggtccagtccgtgc

SEQ ID NO: 820330 - DNA, 25 bp, Mus musculus
tgggaaaaccgcaagaagatgctag

SEQ ID NO: 820331 - DNA, 25 bp, Mus musculus
tgggaaaaccgcaattattgcctaa

SEQ ID NO: 820332 - DNA, 25 bp, Mus musculus
tgggaaaaccgctagaagatgctag

SEQ ID NO: 820333 - DNA, 25 bp, Mus musculus
tgggaaaaccgctattattgcctaa

SEQ ID NO: 820334 - DNA, 25 bp, Mus musculus
tgggaaaacctaccgcaacgaatgt

SEQ ID NO: 820335 - DNA, 25 bp, Mus musculus
tgggaaaacctagcgcaacgaatgt

SEQ ID NO: 820336 - DNA, 25 bp, Mus musculus
tgggaaaactgaagtgacgggctac

SEQ ID NO: 820337 - DNA, 25 bp, Mus musculus
tgggaaaactgatgtgacgggctac

SEQ ID NO: 820338 - DNA, 25 bp, Mus musculus
tgggaaaagaggaccacctggccct

SEQ ID NO: 820339 - DNA, 25 bp, Mus musculus
tgggaaaagaggtccacctggccct

SEQ ID NO: 820340 - DNA, 25 bp, Mus musculus
tgggaaaagatacccgaagctgttc

SEQ ID NO: 820341 - DNA, 25 bp, Mus musculus
tgggaaaagatagccgaagctgttc

SEQ ID NO: 820342 - DNA, 25 bp, Mus musculus
tgggaaaagcaccatctccacggag

SEQ ID NO: 820343 - DNA, 25 bp, Mus musculus
tgggaaaagcacgatctccacggag

SEQ ID NO: 820344 - DNA, 25 bp, Mus musculus
tgggaaaagctaacccgagccaact

SEQ ID NO: 820345 - DNA, 25 bp, Mus musculus
tgggaaaagctatcccgagccaact

SEQ ID NO: 820346 - DNA, 25 bp, Mus musculus
tgggaaaaggcacttgcaaccaggt

SEQ ID NO: 820347 - DNA, 25 bp, Mus musculus
tgggaaaaggcagttgcaaccaggt

SEQ ID NO: 820348 - DNA, 25 bp, Mus musculus
tgggaaaagtctccaagttgtcaaa

SEQ ID NO: 820349 - DNA, 25 bp, Mus musculus
tgggaaaagtctgcaagttgtcaaa

SEQ ID NO: 820350 - DNA, 25 bp, Mus musculus
tgggaaaatactcggctattaaact

SEQ ID NO: 820351 - DNA, 25 bp, Mus musculus
tgggaaaatactgggctattaaact

SEQ ID NO: 820352 - DNA, 25 bp, Mus musculus
tgggaaaatccgctaaattggcagt

SEQ ID NO: 820353 - DNA, 25 bp, Mus musculus
tgggaaaatccggtaaattggcagt

SEQ ID NO: 820354 - DNA, 25 bp, Mus musculus
tgggaaaatggactttaatgattaa

SEQ ID NO: 820355 - DNA, 25 bp, Mus musculus
tgggaaaatggagtttaatgattaa

SEQ ID NO: 820356 - DNA, 25 bp, Mus musculus
tgggaaacaaaaccatgtcatttgc

SEQ ID NO: 820357 - DNA, 25 bp, Mus musculus
tgggaaacaaaagcatgtcatttgc

SEQ ID NO: 820358 - DNA, 25 bp, Mus musculus
tgggaaacacacacttggcgagaac

SEQ ID NO: 820359 - DNA, 25 bp, Mus musculus
tgggaaacacactcttggcgagaac

SEQ ID NO: 820360 - DNA, 25 bp, Mus musculus
tgggaaacagctcagtcttcaccct

SEQ ID NO: 820361 - DNA, 25 bp, Mus musculus
tgggaaacagctgagtcttcaccct

SEQ ID NO: 820362 - DNA, 25 bp, Mus musculus
tgggaaacagtcactacggctgcaa

SEQ ID NO: 820363 - DNA, 25 bp, Mus musculus
tgggaaacagtctctacggctgcaa

SEQ ID NO: 820364 - DNA, 25 bp, Mus musculus
tgggaaacataacaacattatcaac

SEQ ID NO: 820365 - DNA, 25 bp, Mus musculus
tgggaaacataagaacattatcaac

SEQ ID NO: 820366 - DNA, 25 bp, Mus musculus
tgggaaacccatcgaagtcaacaat

SEQ ID NO: 820367 - DNA, 25 bp, Mus musculus
tgggaaacccatggaagtcaacaat

SEQ ID NO: 820368 - DNA, 25 bp, Mus musculus
tgggaaaccgaaacgacgacgtcac

SEQ ID NO: 820369 - DNA, 25 bp, Mus musculus
tgggaaaccgaatcgacgacgtcac

SEQ ID NO: 820370 - DNA, 25 bp, Mus musculus
tgggaaacggctcaagaattacaac

SEQ ID NO: 820371 - DNA, 25 bp, Mus musculus
tgggaaacggctgaagaattacaac

SEQ ID NO: 820372 - DNA, 25 bp, Mus musculus
tgggaaactcagctccagtctgcag

SEQ ID NO: 820373 - DNA, 25 bp, Mus musculus
tgggaaactcaggtccagtctgcag

SEQ ID NO: 820374 - DNA, 25 bp, Mus musculus
tgggaaactctactccgtggatgac

SEQ ID NO: 820375 - DNA, 25 bp, Mus musculus
tgggaaactctagtccgtggatgac

SEQ ID NO: 820376 - DNA, 25 bp, Mus musculus
tgggaaactctccaaggacattctg

SEQ ID NO: 820377 - DNA, 25 bp, Mus musculus
tgggaaactctcgaaggacattctg

SEQ ID NO: 820378 - DNA, 25 bp, Mus musculus
tgggaaacttcaccttccagtccaa

SEQ ID NO: 820379 - DNA, 25 bp, Mus musculus
tgggaaacttcagcttccagtccaa

SEQ ID NO: 820380 - DNA, 25 bp, Mus musculus
tgggaaagaagcctgaccaaatggc

SEQ ID NO: 820381 - DNA, 25 bp, Mus musculus
tgggaaagaagcgtgaccaaatggc

SEQ ID NO: 820382 - DNA, 25 bp, Mus musculus
tgggaaagccaaagcgcctatttac

SEQ ID NO: 820383 - DNA, 25 bp, Mus musculus
tgggaaagccaatgcgcctatttac

SEQ ID NO: 820384 - DNA, 25 bp, Mus musculus
tgggaaagcgatcgcagtcaccagt

SEQ ID NO: 820385 - DNA, 25 bp, Mus musculus
tgggaaagcgatggcagtcaccagt

SEQ ID NO: 820386 - DNA, 25 bp, Mus musculus
tgggaaagctcccttgaccaagcct

SEQ ID NO: 820387 - DNA, 25 bp, Mus musculus
tgggaaagctccgttgaccaagcct

SEQ ID NO: 820388 - DNA, 25 bp, Mus musculus
tgggaaaggctacactcaggacaac

SEQ ID NO: 820389 - DNA, 25 bp, Mus musculus
tgggaaaggctagactcaggacaac

SEQ ID NO: 820390 - DNA, 25 bp, Mus musculus
tgggaaagggctctggcttctatcc

SEQ ID NO: 820391 - DNA, 25 bp, Mus musculus
tgggaaagggctgtggcttctatcc

SEQ ID NO: 820392 - DNA, 25 bp, Mus musculus
tgggaaaggtctcatcaaggctgcc

SEQ ID NO: 820393 - DNA, 25 bp, Mus musculus
tgggaaaggtctgatcaaggctgcc

SEQ ID NO: 820394 - DNA, 25 bp, Mus musculus
tgggaaagtcagacacaaggctcat

SEQ ID NO: 820395 - DNA, 25 bp, Mus musculus
tgggaaagtcagtcacaaggctcat

SEQ ID NO: 820396 - DNA, 25 bp, Mus musculus
tgggaaagtggaaatcatagcaaca

SEQ ID NO: 820397 - DNA, 25 bp, Mus musculus
tgggaaagtggatatcatagcaaca

SEQ ID NO: 820398 - DNA, 25 bp, Mus musculus
tgggaaatacttccagagccagcca

SEQ ID NO: 820399 - DNA, 25 bp, Mus musculus
tgggaaatacttcgagctgtgcctg

SEQ ID NO: 820400 - DNA, 25 bp, Mus musculus
tgggaaatacttgcagagccagcca

SEQ ID NO: 820401 - DNA, 25 bp, Mus musculus
tgggaaatacttggagctgtgcctg

SEQ ID NO: 820402 - DNA, 25 bp, Mus musculus
tgggaaatatatcatccttttaagt

SEQ ID NO: 820403 - DNA, 25 bp, Mus musculus
tgggaaatatatgatccttttaagt

SEQ ID NO: 820404 - DNA, 25 bp, Mus musculus
tgggaaatatggagcccaggatgat

SEQ ID NO: 820405 - DNA, 25 bp, Mus musculus
tgggaaatatggtgcccaggatgat

SEQ ID NO: 820406 - DNA, 25 bp, Mus musculus
tgggaaatccaaagacaagcttgac

SEQ ID NO: 820407 - DNA, 25 bp, Mus musculus
tgggaaatccaatgacaagcttgac

SEQ ID NO: 820408 - DNA, 25 bp, Mus musculus
tgggaaatccagcattgtgtgtcgt

SEQ ID NO: 820409 - DNA, 25 bp, Mus musculus
tgggaaatccaggattgtgtgtcgt

SEQ ID NO: 820410 - DNA, 25 bp, Mus musculus
tgggaaatcccaagatttagtggac

SEQ ID NO: 820411 - DNA, 25 bp, Mus musculus
tgggaaatcccatgatttagtggac

SEQ ID NO: 820412 - DNA, 25 bp, Mus musculus
tgggaaatcgctaccgttcggtgtc

SEQ ID NO: 820413 - DNA, 25 bp, Mus musculus
tgggaaatcgcttccgttcggtgtc

SEQ ID NO: 820414 - DNA, 25 bp, Mus musculus
tgggaaatgcaacaatccgaatggc

SEQ ID NO: 820415 - DNA, 25 bp, Mus musculus
tgggaaatgcaagaatccgaatggc

SEQ ID NO: 820416 - DNA, 25 bp, Mus musculus
tgggaaatgcccctctcctcctgtg

SEQ ID NO: 820417 - DNA, 25 bp, Mus musculus
tgggaaatgcccgtctcctcctgtg

SEQ ID NO: 820418 - DNA, 25 bp, Mus musculus
tgggaaatttaacggaagggcacat

SEQ ID NO: 820419 - DNA, 25 bp, Mus musculus
tgggaaatttaagggaagggcacat

SEQ ID NO: 820420 - DNA, 25 bp, Mus musculus
tgggaacaaagtctcaacaatggtc

SEQ ID NO: 820421 - DNA, 25 bp, Mus musculus
tgggaacaaagtgtcaacaatggtc

SEQ ID NO: 820422 - DNA, 25 bp, Mus musculus
tgggaacaaccaaagctgttgggat

SEQ ID NO: 820423 - DNA, 25 bp, Mus musculus
tgggaacaaccatagctgttgggat

SEQ ID NO: 820424 - DNA, 25 bp, Mus musculus
tgggaacaagatcagcatcctcctt

SEQ ID NO: 820425 - DNA, 25 bp, Mus musculus
tgggaacaagatgagcatcctcctt

SEQ ID NO: 820426 - DNA, 25 bp, Mus musculus
tgggaacacaccacagcaggatcga

SEQ ID NO: 820427 - DNA, 25 bp, Mus musculus
tgggaacacacctcagcaggatcga

SEQ ID NO: 820428 - DNA, 25 bp, Mus musculus
tgggaacaccatactacatgtcacc

SEQ ID NO: 820429 - DNA, 25 bp, Mus musculus
tgggaacaccattctacatgtcacc

SEQ ID NO: 820430 - DNA, 25 bp, Mus musculus
tgggaacactcaaccaactggccat

SEQ ID NO: 820431 - DNA, 25 bp, Mus musculus
tgggaacactcatccaactggccat

SEQ ID NO: 820432 - DNA, 25 bp, Mus musculus
tgggaacactgcacaccttggtcaa

SEQ ID NO: 820433 - DNA, 25 bp, Mus musculus
tgggaacactgctcaccttggtcaa

SEQ ID NO: 820434 - DNA, 25 bp, Mus musculus
tgggaacagatactccagtccacct

SEQ ID NO: 820435 - DNA, 25 bp, Mus musculus
tgggaacagatagtccagtccacct

SEQ ID NO: 820436 - DNA, 25 bp, Mus musculus
tgggaacagatgacccaggtgccct

SEQ ID NO: 820437 - DNA, 25 bp, Mus musculus
tgggaacagatgtcccaggtgccct

SEQ ID NO: 820438 - DNA, 25 bp, Mus musculus
tgggaacagattagccacagctagc

SEQ ID NO: 820439 - DNA, 25 bp, Mus musculus
tgggaacagatttgccacagctagc

SEQ ID NO: 820440 - DNA, 25 bp, Mus musculus
tgggaacagcatacacacagcatca

SEQ ID NO: 820441 - DNA, 25 bp, Mus musculus
tgggaacagcattcacacagcatca

SEQ ID NO: 820442 - DNA, 25 bp, Mus musculus
tgggaacagcccatccagagcctct

SEQ ID NO: 820443 - DNA, 25 bp, Mus musculus
tgggaacagcccttccagagcctct

SEQ ID NO: 820444 - DNA, 25 bp, Mus musculus
tgggaacagcctaagctactccaaa

SEQ ID NO: 820445 - DNA, 25 bp, Mus musculus
tgggaacagccttagctactccaaa

SEQ ID NO: 820446 - DNA, 25 bp, Mus musculus
tgggaacagcgaagggaaactatct

SEQ ID NO: 820447 - DNA, 25 bp, Mus musculus
tgggaacagcgatgggaaactatct

SEQ ID NO: 820448 - DNA, 25 bp, Mus musculus
tgggaacagggtcactttgagccaa

SEQ ID NO: 820449 - DNA, 25 bp, Mus musculus
tgggaacagggtgactttgagccaa

SEQ ID NO: 820450 - DNA, 25 bp, Mus musculus
tgggaacagtccctactaaccaagc

SEQ ID NO: 820451 - DNA, 25 bp, Mus musculus
tgggaacagtccgtactaaccaagc

SEQ ID NO: 820452 - DNA, 25 bp, Mus musculus
tgggaacatagaatcggagcccctg

SEQ ID NO: 820453 - DNA, 25 bp, Mus musculus
tgggaacatagattcggagcccctg

SEQ ID NO: 820454 - DNA, 25 bp, Mus musculus
tgggaacatgctaaatacaaatggt

SEQ ID NO: 820455 - DNA, 25 bp, Mus musculus
tgggaacatgcttaatacaaatggt

SEQ ID NO: 820456 - DNA, 25 bp, Mus musculus
tgggaacattcgaataaaaatcaag

SEQ ID NO: 820457 - DNA, 25 bp, Mus musculus
tgggaacattcgtataaaaatcaag

SEQ ID NO: 820458 - DNA, 25 bp, Mus musculus
tgggaaccaaaacacaagagtgaaa

SEQ ID NO: 820459 - DNA, 25 bp, Mus musculus
tgggaaccaaaagacaagagtgaaa

SEQ ID NO: 820460 - DNA, 25 bp, Mus musculus
tgggaaccaggcagatcacttcttg

SEQ ID NO: 820461 - DNA, 25 bp, Mus musculus
tgggaaccaggctgatcacttcttg

SEQ ID NO: 820462 - DNA, 25 bp, Mus musculus
tgggaacccaaaaagtgctgtcttc

SEQ ID NO: 820463 - DNA, 25 bp, Mus musculus
tgggaacccaaatagtgctgtcttc

SEQ ID NO: 820464 - DNA, 25 bp, Mus musculus
tgggaacccaacatcctttggtcct

SEQ ID NO: 820465 - DNA, 25 bp, Mus musculus
tgggaacccaacttcctttggtcct

SEQ ID NO: 820466 - DNA, 25 bp, Mus musculus
tgggaacccaccactgagacaaggg

SEQ ID NO: 820467 - DNA, 25 bp, Mus musculus
tgggaacccacctctgagacaaggg

SEQ ID NO: 820468 - DNA, 25 bp, Mus musculus
tgggaaccccaacttttgacattga

SEQ ID NO: 820469 - DNA, 25 bp, Mus musculus
tgggaaccccaagttttgacattga

SEQ ID NO: 820470 - DNA, 25 bp, Mus musculus
tgggaacccgctctatctgatactg

SEQ ID NO: 820471 - DNA, 25 bp, Mus musculus
tgggaacccgctgtatctgatactg

SEQ ID NO: 820472 - DNA, 25 bp, Mus musculus
tgggaaccgcgtcattccaaagtgg

SEQ ID NO: 820473 - DNA, 25 bp, Mus musculus
tgggaaccgcgtgattccaaagtgg

SEQ ID NO: 820474 - DNA, 25 bp, Mus musculus
tgggaaccggcacaaccactgggct

SEQ ID NO: 820475 - DNA, 25 bp, Mus musculus
tgggaaccggcagaaccactgggct

SEQ ID NO: 820476 - DNA, 25 bp, Mus musculus
tgggaacctgatcattcaacaaaag

SEQ ID NO: 820477 - DNA, 25 bp, Mus musculus
tgggaacctgatgattcaacaaaag

SEQ ID NO: 820478 - DNA, 25 bp, Mus musculus
tgggaacgaccacctgagcaaaaac

SEQ ID NO: 820479 - DNA, 25 bp, Mus musculus
tgggaacgaccagctgagcaaaaac

SEQ ID NO: 820480 - DNA, 25 bp, Mus musculus
tgggaacgatacagaaagaacgggc

SEQ ID NO: 820481 - DNA, 25 bp, Mus musculus
tgggaacgatactgaaagaacgggc

SEQ ID NO: 820482 - DNA, 25 bp, Mus musculus
tgggaacgccaaaatagccgccaga

SEQ ID NO: 820483 - DNA, 25 bp, Mus musculus
tgggaacgccaatatagccgccaga

SEQ ID NO: 820484 - DNA, 25 bp, Mus musculus
tgggaacgcctcagtatgtggcctg

SEQ ID NO: 820485 - DNA, 25 bp, Mus musculus
tgggaacgcctctgtatgtggcctg

SEQ ID NO: 820486 - DNA, 25 bp, Mus musculus
tgggaacggttcagtgctaacatca

SEQ ID NO: 820487 - DNA, 25 bp, Mus musculus
tgggaacggttctgtgctaacatca

SEQ ID NO: 820488 - DNA, 25 bp, Mus musculus
tgggaacgtgctccagtccatcctg

SEQ ID NO: 820489 - DNA, 25 bp, Mus musculus
tgggaacgtgctgcagtccatcctg

SEQ ID NO: 820490 - DNA, 25 bp, Mus musculus
tgggaactagatactgttcgtgaaa

SEQ ID NO: 820491 - DNA, 25 bp, Mus musculus
tgggaactagattctgttcgtgaaa

SEQ ID NO: 820492 - DNA, 25 bp, Mus musculus
tgggaactagtaacagaaactccaa

SEQ ID NO: 820493 - DNA, 25 bp, Mus musculus
tgggaactagtatcagaaactccaa

SEQ ID NO: 820494 - DNA, 25 bp, Mus musculus
tgggaactcaccacctagcagcagt

SEQ ID NO: 820495 - DNA, 25 bp, Mus musculus
tgggaactcacctcctagcagcagt

SEQ ID NO: 820496 - DNA, 25 bp, Mus musculus
tgggaactcactactcgggaagaaa

SEQ ID NO: 820497 - DNA, 25 bp, Mus musculus
tgggaactcacttctcgggaagaaa

SEQ ID NO: 820498 - DNA, 25 bp, Mus musculus
tgggaactccacactctgaggcact

SEQ ID NO: 820499 - DNA, 25 bp, Mus musculus
tgggaactccactctctgaggcact

SEQ ID NO: 820500 - DNA, 25 bp, Mus musculus
tgggaactccgaaccctgcagaaga

SEQ ID NO: 820501 - DNA, 25 bp, Mus musculus
tgggaactccgatccctgcagaaga

SEQ ID NO: 820502 - DNA, 25 bp, Mus musculus
tgggaactctggaggtctcgctccg

SEQ ID NO: 820503 - DNA, 25 bp, Mus musculus
tgggaactctggtggtctcgctccg

SEQ ID NO: 820504 - DNA, 25 bp, Mus musculus
tgggaactggagacccttacacacc

SEQ ID NO: 820505 - DNA, 25 bp, Mus musculus
tgggaactggagtcccttacacacc

SEQ ID NO: 820506 - DNA, 25 bp, Mus musculus
tgggaactggccaaaactgtttttg

SEQ ID NO: 820507 - DNA, 25 bp, Mus musculus
tgggaactggcctaaactgtttttg

SEQ ID NO: 820508 - DNA, 25 bp, Mus musculus
tgggaactgggaaccttgatctgaa

SEQ ID NO: 820509 - DNA, 25 bp, Mus musculus
tgggaactgggatccttgatctgaa

SEQ ID NO: 820510 - DNA, 25 bp, Mus musculus
tgggaactttgtccagtaacagtca

SEQ ID NO: 820511 - DNA, 25 bp, Mus musculus
tgggaactttgtgcagtaacagtca

SEQ ID NO: 820512 - DNA, 25 bp, Mus musculus
tgggaagaaaccaaagaccaagaag

SEQ ID NO: 820513 - DNA, 25 bp, Mus musculus
tgggaagaaacctaagaccaagaag

SEQ ID NO: 820514 - DNA, 25 bp, Mus musculus
tgggaagaaagcaggcagtctctac

SEQ ID NO: 820515 - DNA, 25 bp, Mus musculus
tgggaagaaagctggcagtctctac

SEQ ID NO: 820516 - DNA, 25 bp, Mus musculus
tgggaagaaataagaggcagacatg

SEQ ID NO: 820517 - DNA, 25 bp, Mus musculus
tgggaagaaatatgaggcagacatg

SEQ ID NO: 820518 - DNA, 25 bp, Mus musculus
tgggaagaaccaatgagacacagac

SEQ ID NO: 820519 - DNA, 25 bp, Mus musculus
tgggaagaaccattgagacacagac

SEQ ID NO: 820520 - DNA, 25 bp, Mus musculus
tgggaagaagatcctaattaaagtg

SEQ ID NO: 820521 - DNA, 25 bp, Mus musculus
tgggaagaagatgctaattaaagtg

SEQ ID NO: 820522 - DNA, 25 bp, Mus musculus
tgggaagaatccaaatgcggaccag

SEQ ID NO: 820523 - DNA, 25 bp, Mus musculus
tgggaagaatcctaatgcggaccag

SEQ ID NO: 820524 - DNA, 25 bp, Mus musculus
tgggaagacataagccagccccacc

SEQ ID NO: 820525 - DNA, 25 bp, Mus musculus
tgggaagacatatgccagccccacc

SEQ ID NO: 820526 - DNA, 25 bp, Mus musculus
tgggaagacatcactactggttcag

SEQ ID NO: 820527 - DNA, 25 bp, Mus musculus
tgggaagacatctctactggttcag

SEQ ID NO: 820528 - DNA, 25 bp, Mus musculus
tgggaagacatgatgacctttggtc

SEQ ID NO: 820529 - DNA, 25 bp, Mus musculus
tgggaagacatgttgacctttggtc

SEQ ID NO: 820530 - DNA, 25 bp, Mus musculus
tgggaagacccaccaacattggaca

SEQ ID NO: 820531 - DNA, 25 bp, Mus musculus
tgggaagacccagcaacattggaca

SEQ ID NO: 820532 - DNA, 25 bp, Mus musculus
tgggaagacgacatgcctggagttc

SEQ ID NO: 820533 - DNA, 25 bp, Mus musculus
tgggaagacgacttgcctggagttc

SEQ ID NO: 820534 - DNA, 25 bp, Mus musculus
tgggaagagaaaccatccgaacatt

SEQ ID NO: 820535 - DNA, 25 bp, Mus musculus
tgggaagagaaagcatccgaacatt

SEQ ID NO: 820536 - DNA, 25 bp, Mus musculus
tgggaagagggaactacaagcatcc

SEQ ID NO: 820537 - DNA, 25 bp, Mus musculus
tgggaagagggatctacaagcatcc

SEQ ID NO: 820538 - DNA, 25 bp, Mus musculus
tgggaagataccagaacatgacctg

SEQ ID NO: 820539 - DNA, 25 bp, Mus musculus
tgggaagatacctgaacatgacctg

SEQ ID NO: 820540 - DNA, 25 bp, Mus musculus
tgggaagatccaagtaggctacaag

SEQ ID NO: 820541 - DNA, 25 bp, Mus musculus
tgggaagatccatgtaggctacaag

SEQ ID NO: 820542 - DNA, 25 bp, Mus musculus
tgggaagatcccagcagctgttacc

SEQ ID NO: 820543 - DNA, 25 bp, Mus musculus
tgggaagatccctgcagctgttacc

SEQ ID NO: 820544 - DNA, 25 bp, Mus musculus
tgggaagatcctcaactcctccaag

SEQ ID NO: 820545 - DNA, 25 bp, Mus musculus
tgggaagatcctgaactcctccaag

SEQ ID NO: 820546 - DNA, 25 bp, Mus musculus
tgggaagatcgtctccacaaaggcg

SEQ ID NO: 820547 - DNA, 25 bp, Mus musculus
tgggaagatcgtgtccacaaaggcg

SEQ ID NO: 820548 - DNA, 25 bp, Mus musculus
tgggaagatgaaaacaaaggcagga

SEQ ID NO: 820549 - DNA, 25 bp, Mus musculus
tgggaagatgaatacaaaggcagga

SEQ ID NO: 820550 - DNA, 25 bp, Mus musculus
tgggaagatgctcaaattaccttgc

SEQ ID NO: 820551 - DNA, 25 bp, Mus musculus
tgggaagatgctgaaattaccttgc

SEQ ID NO: 820552 - DNA, 25 bp, Mus musculus
tgggaagcacagaggtacagaagac

SEQ ID NO: 820553 - DNA, 25 bp, Mus musculus
tgggaagcacagtggtacagaagac

SEQ ID NO: 820554 - DNA, 25 bp, Mus musculus
tgggaagcagtacctcggatccact

SEQ ID NO: 820555 - DNA, 25 bp, Mus musculus
tgggaagcagtagctcggatccact

SEQ ID NO: 820556 - DNA, 25 bp, Mus musculus
tgggaagcccgaccatcttgggcac

SEQ ID NO: 820557 - DNA, 25 bp, Mus musculus
tgggaagcccgagcatcttgggcac

SEQ ID NO: 820558 - DNA, 25 bp, Mus musculus
tgggaagccctgattgccagcctct

SEQ ID NO: 820559 - DNA, 25 bp, Mus musculus
tgggaagccctgtttgccagcctct

SEQ ID NO: 820560 - DNA, 25 bp, Mus musculus
tgggaagcctgtcgtacctccttta

SEQ ID NO: 820561 - DNA, 25 bp, Mus musculus
tgggaagcctgtggtacctccttta

SEQ ID NO: 820562 - DNA, 25 bp, Mus musculus
tgggaagctataacaagtacaagta

SEQ ID NO: 820563 - DNA, 25 bp, Mus musculus
tgggaagctatatcaagtacaagta

SEQ ID NO: 820564 - DNA, 25 bp, Mus musculus
tgggaagctgtactgccacaaggac

SEQ ID NO: 820565 - DNA, 25 bp, Mus musculus
tgggaagctgtagtgccacaaggac

SEQ ID NO: 820566 - DNA, 25 bp, Mus musculus
tgggaaggatctatttaagcctatt

SEQ ID NO: 820567 - DNA, 25 bp, Mus musculus
tgggaaggatctttttaagcctatt

SEQ ID NO: 820568 - DNA, 25 bp, Mus musculus
tgggaaggccaaacggatgatcatc

SEQ ID NO: 820569 - DNA, 25 bp, Mus musculus
tgggaaggccaatcggatgatcatc

SEQ ID NO: 820570 - DNA, 25 bp, Mus musculus
tgggaaggccagaccaaagaccatc

SEQ ID NO: 820571 - DNA, 25 bp, Mus musculus
tgggaaggccagtccaaagaccatc

SEQ ID NO: 820572 - DNA, 25 bp, Mus musculus
tgggaaggccccaatgtggtccata

SEQ ID NO: 820573 - DNA, 25 bp, Mus musculus
tgggaaggcccctatgtggtccata

SEQ ID NO: 820574 - DNA, 25 bp, Mus musculus
tgggaaggcctgactgttgatgaca

SEQ ID NO: 820575 - DNA, 25 bp, Mus musculus
tgggaaggcctgtctgttgatgaca

SEQ ID NO: 820576 - DNA, 25 bp, Mus musculus
tgggaaggctttaggttggaaatca

SEQ ID NO: 820577 - DNA, 25 bp, Mus musculus
tgggaaggcttttggttggaaatca

SEQ ID NO: 820578 - DNA, 25 bp, Mus musculus
tgggaagggacaacagaggcacttt

SEQ ID NO: 820579 - DNA, 25 bp, Mus musculus
tgggaagggacatcagaggcacttt

SEQ ID NO: 820580 - DNA, 25 bp, Mus musculus
tgggaagggagaaatacgtaaatgc

SEQ ID NO: 820581 - DNA, 25 bp, Mus musculus
tgggaagggagatatacgtaaatgc

SEQ ID NO: 820582 - DNA, 25 bp, Mus musculus
tgggaaggtataagatcacctcaaa

SEQ ID NO: 820583 - DNA, 25 bp, Mus musculus
tgggaaggtatatgatcacctcaaa

SEQ ID NO: 820584 - DNA, 25 bp, Mus musculus
tgggaaggtcttagctagatcagaa

SEQ ID NO: 820585 - DNA, 25 bp, Mus musculus
tgggaaggtctttgctagatcagaa

SEQ ID NO: 820586 - DNA, 25 bp, Mus musculus
tgggaaggtgctagtccccctggct

SEQ ID NO: 820587 - DNA, 25 bp, Mus musculus
tgggaaggtgcttgtccccctggct

SEQ ID NO: 820588 - DNA, 25 bp, Mus musculus
tgggaagtacatctgccggatcata

SEQ ID NO: 820589 - DNA, 25 bp, Mus musculus
tgggaagtacatgtgccggatcata

SEQ ID NO: 820590 - DNA, 25 bp, Mus musculus
tgggaagtagcaacaaccctgtgac

SEQ ID NO: 820591 - DNA, 25 bp, Mus musculus
tgggaagtagcatcaaccctgtgac

SEQ ID NO: 820592 - DNA, 25 bp, Mus musculus
tgggaagtcactactggagttagcc

SEQ ID NO: 820593 - DNA, 25 bp, Mus musculus
tgggaagtcacttctggagttagcc

SEQ ID NO: 820594 - DNA, 25 bp, Mus musculus
tgggaagtcattagtatcgaagctc

SEQ ID NO: 820595 - DNA, 25 bp, Mus musculus
tgggaagtcatttgtatcgaagctc

SEQ ID NO: 820596 - DNA, 25 bp, Mus musculus
tgggaagtctttcaccatgcaggga

SEQ ID NO: 820597 - DNA, 25 bp, Mus musculus
tgggaagtctttgaccatgcaggga

SEQ ID NO: 820598 - DNA, 25 bp, Mus musculus
tgggaagtgccaactgctttgtaga

SEQ ID NO: 820599 - DNA, 25 bp, Mus musculus
tgggaagtgccatctgctttgtaga

SEQ ID NO: 820600 - DNA, 25 bp, Mus musculus
tgggaagtgggacatcctaaacgac

SEQ ID NO: 820601 - DNA, 25 bp, Mus musculus
tgggaagtgggagatcctaaacgac

SEQ ID NO: 820602 - DNA, 25 bp, Mus musculus
tgggaagttgcgctatgaaatagat

SEQ ID NO: 820603 - DNA, 25 bp, Mus musculus
tgggaagttgcggtatgaaatagat

SEQ ID NO: 820604 - DNA, 25 bp, Mus musculus
tgggaatactcacagtgcagtgtct

SEQ ID NO: 820605 - DNA, 25 bp, Mus musculus
tgggaatactcagagtgcagtgtct

SEQ ID NO: 820606 - DNA, 25 bp, Mus musculus
tgggaatatctaaagcaccccactg

SEQ ID NO: 820607 - DNA, 25 bp, Mus musculus
tgggaatatctatagcaccccactg

SEQ ID NO: 820608 - DNA, 25 bp, Mus musculus
tgggaatcagagaccaaaagctcgg

SEQ ID NO: 820609 - DNA, 25 bp, Mus musculus
tgggaatcagagtccaaaagctcgg

SEQ ID NO: 820610 - DNA, 25 bp, Mus musculus
tgggaatcccaaaggacggtgcgat

SEQ ID NO: 820611 - DNA, 25 bp, Mus musculus
tgggaatcccaatggacggtgcgat

SEQ ID NO: 820612 - DNA, 25 bp, Mus musculus
tgggaatcgcagcattagagccgtt

SEQ ID NO: 820613 - DNA, 25 bp, Mus musculus
tgggaatcgcaggattagagccgtt

SEQ ID NO: 820614 - DNA, 25 bp, Mus musculus
tgggaatctctgacacccttctggg

SEQ ID NO: 820615 - DNA, 25 bp, Mus musculus
tgggaatctctgcatcactgtgtcc

SEQ ID NO: 820616 - DNA, 25 bp, Mus musculus
tgggaatctctggatcactgtgtcc

SEQ ID NO: 820617 - DNA, 25 bp, Mus musculus
tgggaatctctgtcacccttctggg

SEQ ID NO: 820618 - DNA, 25 bp, Mus musculus
tgggaatctgcactatgacctccac

SEQ ID NO: 820619 - DNA, 25 bp, Mus musculus
tgggaatctgcagtatgacctccac

SEQ ID NO: 820620 - DNA, 25 bp, Mus musculus
tgggaatgacctaaaaaacttgatt

SEQ ID NO: 820621 - DNA, 25 bp, Mus musculus
tgggaatgacctcactaacttcact

SEQ ID NO: 820622 - DNA, 25 bp, Mus musculus
tgggaatgacctgactaacttcact

SEQ ID NO: 820623 - DNA, 25 bp, Mus musculus
tgggaatgaccttaaaaacttgatt

SEQ ID NO: 820624 - DNA, 25 bp, Mus musculus
tgggaatgacgacagccaaagaagt

SEQ ID NO: 820625 - DNA, 25 bp, Mus musculus
tgggaatgacgagagccaaagaagt

SEQ ID NO: 820626 - DNA, 25 bp, Mus musculus
tgggaatgcagtcccagcaatgctg

SEQ ID NO: 820627 - DNA, 25 bp, Mus musculus
tgggaatgcagtgccagcaatgctg

SEQ ID NO: 820628 - DNA, 25 bp, Mus musculus
tgggaatgccacaatttctcatgcc

SEQ ID NO: 820629 - DNA, 25 bp, Mus musculus
tgggaatgccactatttctcatgcc

SEQ ID NO: 820630 - DNA, 25 bp, Mus musculus
tgggaatgctaaaacgggactgatg

SEQ ID NO: 820631 - DNA, 25 bp, Mus musculus
tgggaatgctaatacgggactgatg

SEQ ID NO: 820632 - DNA, 25 bp, Mus musculus
tgggaatggctaaattagcgctgcc

SEQ ID NO: 820633 - DNA, 25 bp, Mus musculus
tgggaatggctatattagcgctgcc

SEQ ID NO: 820634 - DNA, 25 bp, Mus musculus
tgggaatgtcagcacctcaacagaa

SEQ ID NO: 820635 - DNA, 25 bp, Mus musculus
tgggaatgtcaggacctcaacagaa

SEQ ID NO: 820636 - DNA, 25 bp, Mus musculus
tgggaattacacaccggccagccgg

SEQ ID NO: 820637 - DNA, 25 bp, Mus musculus
tgggaattacactccggccagccgg

SEQ ID NO: 820638 - DNA, 25 bp, Mus musculus
tgggaattatgacagtaaaaagcac

SEQ ID NO: 820639 - DNA, 25 bp, Mus musculus
tgggaattatgagagtaaaaagcac

SEQ ID NO: 820640 - DNA, 25 bp, Mus musculus
tgggaattgaacagtgtgcccctcc

SEQ ID NO: 820641 - DNA, 25 bp, Mus musculus
tgggaattgaactgtgtgcccctcc

SEQ ID NO: 820642 - DNA, 25 bp, Mus musculus
tgggaattggccattccgctgtaca

SEQ ID NO: 820643 - DNA, 25 bp, Mus musculus
tgggaattggcctttccgctgtaca

SEQ ID NO: 820644 - DNA, 25 bp, Mus musculus
tgggaatttgtcaggccaccactga

SEQ ID NO: 820645 - DNA, 25 bp, Mus musculus
tgggaatttgtctggccaccactga

SEQ ID NO: 820646 - DNA, 25 bp, Mus musculus
tgggacaacatcacatgctggcgcc

SEQ ID NO: 820647 - DNA, 25 bp, Mus musculus
tgggacaacatctcatgctggcgcc

SEQ ID NO: 820648 - DNA, 25 bp, Mus musculus
tgggacaagaacattcgccaggcct

SEQ ID NO: 820649 - DNA, 25 bp, Mus musculus
tgggacaagaactttcgccaggcct

SEQ ID NO: 820650 - DNA, 25 bp, Mus musculus
tgggacaagattccagtctccctcc

SEQ ID NO: 820651 - DNA, 25 bp, Mus musculus
tgggacaagattgcagtctccctcc

SEQ ID NO: 820652 - DNA, 25 bp, Mus musculus
tgggacaagcacaagccaaccacat

SEQ ID NO: 820653 - DNA, 25 bp, Mus musculus
tgggacaagcactagccaaccacat

SEQ ID NO: 820654 - DNA, 25 bp, Mus musculus
tgggacaagtgtcagcaccaatacc

SEQ ID NO: 820655 - DNA, 25 bp, Mus musculus
tgggacaagtgtgagcaccaatacc

SEQ ID NO: 820656 - DNA, 25 bp, Mus musculus
tgggacaagtttacaggctgctgct

SEQ ID NO: 820657 - DNA, 25 bp, Mus musculus
tgggacaagttttcaggctgctgct

SEQ ID NO: 820658 - DNA, 25 bp, Mus musculus
tgggacacagaacaagccagctcga

SEQ ID NO: 820659 - DNA, 25 bp, Mus musculus
tgggacacagaagaagccagctcga

SEQ ID NO: 820660 - DNA, 25 bp, Mus musculus
tgggacacagagattaaattacagc

SEQ ID NO: 820661 - DNA, 25 bp, Mus musculus
tgggacacagagtttaaattacagc

SEQ ID NO: 820662 - DNA, 25 bp, Mus musculus
tgggacacatccaaagtcatgggtg

SEQ ID NO: 820663 - DNA, 25 bp, Mus musculus
tgggacacatcctaagtcatgggtg

SEQ ID NO: 820664 - DNA, 25 bp, Mus musculus
tgggacacatgcacggccgtgtgca

SEQ ID NO: 820665 - DNA, 25 bp, Mus musculus
tgggacacatgcaggaattaggaca

SEQ ID NO: 820666 - DNA, 25 bp, Mus musculus
tgggacacatgctcggccgtgtgca

SEQ ID NO: 820667 - DNA, 25 bp, Mus musculus
tgggacacatgctggaattaggaca

SEQ ID NO: 820668 - DNA, 25 bp, Mus musculus
tgggacaccgggacatagaggaaat

SEQ ID NO: 820669 - DNA, 25 bp, Mus musculus
tgggacaccgggtcatagaggaaat

SEQ ID NO: 820670 - DNA, 25 bp, Mus musculus
tgggacactcctccatcttcaagaa

SEQ ID NO: 820671 - DNA, 25 bp, Mus musculus
tgggacactcctgcatcttcaagaa

SEQ ID NO: 820672 - DNA, 25 bp, Mus musculus
tgggacagagggaacaaacaagaag

SEQ ID NO: 820673 - DNA, 25 bp, Mus musculus
tgggacagagggtacaaacaagaag

SEQ ID NO: 820674 - DNA, 25 bp, Mus musculus
tgggacagcaaaccgcagagcaatc

SEQ ID NO: 820675 - DNA, 25 bp, Mus musculus
tgggacagcaaagcgcagagcaatc

SEQ ID NO: 820676 - DNA, 25 bp, Mus musculus
tgggacagcatcatgaccagaggga

SEQ ID NO: 820677 - DNA, 25 bp, Mus musculus
tgggacagcatcttgaccagaggga

SEQ ID NO: 820678 - DNA, 25 bp, Mus musculus
tgggacagcgcaccctaagctgatt

SEQ ID NO: 820679 - DNA, 25 bp, Mus musculus
tgggacagcgcagcctaagctgatt

SEQ ID NO: 820680 - DNA, 25 bp, Mus musculus
tgggacagctttaaccgaggcgatg

SEQ ID NO: 820681 - DNA, 25 bp, Mus musculus
tgggacagcttttaccgaggcgatg

SEQ ID NO: 820682 - DNA, 25 bp, Mus musculus
tgggacaggcagaccgattccgcag

SEQ ID NO: 820683 - DNA, 25 bp, Mus musculus
tgggacaggcagtccgattccgcag

SEQ ID NO: 820684 - DNA, 25 bp, Mus musculus
tgggacagggaacaccctgattgct

SEQ ID NO: 820685 - DNA, 25 bp, Mus musculus
tgggacagggaagaccctgattgct

SEQ ID NO: 820686 - DNA, 25 bp, Mus musculus
tgggacagggctatcggctccttgc

SEQ ID NO: 820687 - DNA, 25 bp, Mus musculus
tgggacagggctttcggctccttgc

SEQ ID NO: 820688 - DNA, 25 bp, Mus musculus
tgggacagtgcccacacccttggtg

SEQ ID NO: 820689 - DNA, 25 bp, Mus musculus
tgggacagtgccgacacccttggtg

SEQ ID NO: 820690 - DNA, 25 bp, Mus musculus
tgggacagttaccagaagaggttct

SEQ ID NO: 820691 - DNA, 25 bp, Mus musculus
tgggacagttacgagaagaggttct

SEQ ID NO: 820692 - DNA, 25 bp, Mus musculus
tgggacagttgccacagtctaaaca

SEQ ID NO: 820693 - DNA, 25 bp, Mus musculus
tgggacagttgcgacagtctaaaca

SEQ ID NO: 820694 - DNA, 25 bp, Mus musculus
tgggacatcatcagactccaacacc

SEQ ID NO: 820695 - DNA, 25 bp, Mus musculus
tgggacatcatctgactccaacacc

SEQ ID NO: 820696 - DNA, 25 bp, Mus musculus
tgggacatccccatcacttacggtg

SEQ ID NO: 820697 - DNA, 25 bp, Mus musculus
tgggacatccccttcacttacggtg

SEQ ID NO: 820698 - DNA, 25 bp, Mus musculus
tgggacatgtcaacgctggatgcct

SEQ ID NO: 820699 - DNA, 25 bp, Mus musculus
tgggacatgtcatcgctggatgcct

SEQ ID NO: 820700 - DNA, 25 bp, Mus musculus
tgggaccaagatacacagttcctcc

SEQ ID NO: 820701 - DNA, 25 bp, Mus musculus
tgggaccaagattcacagttcctcc

SEQ ID NO: 820702 - DNA, 25 bp, Mus musculus
tgggaccaaggcaacaggcaagctt

SEQ ID NO: 820703 - DNA, 25 bp, Mus musculus
tgggaccaaggctacaggcaagctt

SEQ ID NO: 820704 - DNA, 25 bp, Mus musculus
tgggaccaatccaccagctgacaag

SEQ ID NO: 820705 - DNA, 25 bp, Mus musculus
tgggaccaatcctccagctgacaag

SEQ ID NO: 820706 - DNA, 25 bp, Mus musculus
tgggaccaatttaccccctgtcact

SEQ ID NO: 820707 - DNA, 25 bp, Mus musculus
tgggaccaatttagcctattggaat

SEQ ID NO: 820708 - DNA, 25 bp, Mus musculus
tgggaccaattttccccctgtcact

SEQ ID NO: 820709 - DNA, 25 bp, Mus musculus
tgggaccaattttgcctattggaat

SEQ ID NO: 820710 - DNA, 25 bp, Mus musculus
tgggaccacatcaggcaagcgggtt

SEQ ID NO: 820711 - DNA, 25 bp, Mus musculus
tgggaccacatctggcaagcgggtt

SEQ ID NO: 820712 - DNA, 25 bp, Mus musculus
tgggaccacccgcttgggagcctgg

SEQ ID NO: 820713 - DNA, 25 bp, Mus musculus
tgggaccacccggttgggagcctgg

SEQ ID NO: 820714 - DNA, 25 bp, Mus musculus
tgggaccaccttcggttgccctctt

SEQ ID NO: 820715 - DNA, 25 bp, Mus musculus
tgggaccaccttgggttgccctctt

SEQ ID NO: 820716 - DNA, 25 bp, Mus musculus
tgggaccacgtacagaagaccttcc

SEQ ID NO: 820717 - DNA, 25 bp, Mus musculus
tgggaccacgtagagaagaccttcc

SEQ ID NO: 820718 - DNA, 25 bp, Mus musculus
tgggaccagacaccagtgacatcag

SEQ ID NO: 820719 - DNA, 25 bp, Mus musculus
tgggaccagacagcagtgacatcag

SEQ ID NO: 820720 - DNA, 25 bp, Mus musculus
tgggaccagcaactgaaccttgcct

SEQ ID NO: 820721 - DNA, 25 bp, Mus musculus
tgggaccagcaagtgaaccttgcct

SEQ ID NO: 820722 - DNA, 25 bp, Mus musculus
tgggacccaccacagtatttcgagc

SEQ ID NO: 820723 - DNA, 25 bp, Mus musculus
tgggacccaccagagtatttcgagc

SEQ ID NO: 820724 - DNA, 25 bp, Mus musculus
tgggacccaggcaatgtcagaagtc

SEQ ID NO: 820725 - DNA, 25 bp, Mus musculus
tgggacccaggctatgtcagaagtc

SEQ ID NO: 820726 - DNA, 25 bp, Mus musculus
tgggacccaggtccgtcagcagatc

SEQ ID NO: 820727 - DNA, 25 bp, Mus musculus
tgggacccaggtgcgtcagcagatc

SEQ ID NO: 820728 - DNA, 25 bp, Mus musculus
tgggacccatttctaaaaggagagc

SEQ ID NO: 820729 - DNA, 25 bp, Mus musculus
tgggacccatttgtaaaaggagagc

SEQ ID NO: 820730 - DNA, 25 bp, Mus musculus
tgggacccctggactttctgcgtgc

SEQ ID NO: 820731 - DNA, 25 bp, Mus musculus
tgggacccctggtctttctgcgtgc

SEQ ID NO: 820732 - DNA, 25 bp, Mus musculus
tgggacccctgtccgtactctgcga

SEQ ID NO: 820733 - DNA, 25 bp, Mus musculus
tgggacccctgtgcgtactctgcga

SEQ ID NO: 820734 - DNA, 25 bp, Mus musculus
tgggaccctggtcactacgagaatg

SEQ ID NO: 820735 - DNA, 25 bp, Mus musculus
tgggaccctggtgactacgagaatg

SEQ ID NO: 820736 - DNA, 25 bp, Mus musculus
tgggacccttccaggtcagcgctgc

SEQ ID NO: 820737 - DNA, 25 bp, Mus musculus
tgggacccttcctggtcagcgctgc

SEQ ID NO: 820738 - DNA, 25 bp, Mus musculus
tgggaccggctacacagaacaactg

SEQ ID NO: 820739 - DNA, 25 bp, Mus musculus
tgggaccggctagacagaacaactg

SEQ ID NO: 820740 - DNA, 25 bp, Mus musculus
tgggaccggttaatgacctccctgg

SEQ ID NO: 820741 - DNA, 25 bp, Mus musculus
tgggaccggttattgacctccctgg

SEQ ID NO: 820742 - DNA, 25 bp, Mus musculus
tgggacctacctctgcaatgttaac

SEQ ID NO: 820743 - DNA, 25 bp, Mus musculus
tgggacctacctgtgcaatgttaac

SEQ ID NO: 820744 - DNA, 25 bp, Mus musculus
tgggacctccttcgagcaaaagtca

SEQ ID NO: 820745 - DNA, 25 bp, Mus musculus
tgggacctccttggagcaaaagtca

SEQ ID NO: 820746 - DNA, 25 bp, Mus musculus
tgggacctctccctccaggaaaggt

SEQ ID NO: 820747 - DNA, 25 bp, Mus musculus
tgggacctctccgtccaggaaaggt

SEQ ID NO: 820748 - DNA, 25 bp, Mus musculus
tgggacctgagaatgcaaagttgct

SEQ ID NO: 820749 - DNA, 25 bp, Mus musculus
tgggacctgagattgcaaagttgct

SEQ ID NO: 820750 - DNA, 25 bp, Mus musculus
tgggacctgagcactgggcacaaga

SEQ ID NO: 820751 - DNA, 25 bp, Mus musculus
tgggacctgagctctgggcacaaga

SEQ ID NO: 820752 - DNA, 25 bp, Mus musculus
tgggacctgccacctttgagactct

SEQ ID NO: 820753 - DNA, 25 bp, Mus musculus
tgggacctgccagctttgagactct

SEQ ID NO: 820754 - DNA, 25 bp, Mus musculus
tgggaccttggccacactgcagtac

SEQ ID NO: 820755 - DNA, 25 bp, Mus musculus
tgggaccttggcgacactgcagtac

SEQ ID NO: 820756 - DNA, 25 bp, Mus musculus
tgggaccttttgctcacaaagaggg

SEQ ID NO: 820757 - DNA, 25 bp, Mus musculus
tgggaccttttggtcacaaagaggg

SEQ ID NO: 820758 - DNA, 25 bp, Mus musculus
tgggacgactccctggcaaaaatcc

SEQ ID NO: 820759 - DNA, 25 bp, Mus musculus
tgggacgactccgtggcaaaaatcc

SEQ ID NO: 820760 - DNA, 25 bp, Mus musculus
tgggacgcacatactaatgataacg

SEQ ID NO: 820761 - DNA, 25 bp, Mus musculus
tgggacgcacattctaatgataacg

SEQ ID NO: 820762 - DNA, 25 bp, Mus musculus
tgggacgccagaatgtctctggcaa

SEQ ID NO: 820763 - DNA, 25 bp, Mus musculus
tgggacgccagattgtctctggcaa

SEQ ID NO: 820764 - DNA, 25 bp, Mus musculus
tgggacgcctccctcctacaaattg

SEQ ID NO: 820765 - DNA, 25 bp, Mus musculus
tgggacgcctccgtcctacaaattg

SEQ ID NO: 820766 - DNA, 25 bp, Mus musculus
tgggacgcggcgatctgctccttgc

SEQ ID NO: 820767 - DNA, 25 bp, Mus musculus
tgggacgcggcgttctgctccttgc

SEQ ID NO: 820768 - DNA, 25 bp, Mus musculus
tgggacggaagcctcctacttttgg

SEQ ID NO: 820769 - DNA, 25 bp, Mus musculus
tgggacggaagcgtcctacttttgg

SEQ ID NO: 820770 - DNA, 25 bp, Mus musculus
tgggacggccttcatcctgggaaac

SEQ ID NO: 820771 - DNA, 25 bp, Mus musculus
tgggacggccttgatcctgggaaac

SEQ ID NO: 820772 - DNA, 25 bp, Mus musculus
tgggacgttggacaacatgccgcct

SEQ ID NO: 820773 - DNA, 25 bp, Mus musculus
tgggacgttggagaacatgccgcct

SEQ ID NO: 820774 - DNA, 25 bp, Mus musculus
tgggactacagtcacagcgtggaac

SEQ ID NO: 820775 - DNA, 25 bp, Mus musculus
tgggactacagtgacagcgtggaac

SEQ ID NO: 820776 - DNA, 25 bp, Mus musculus
tgggactacctccagacagtgcatc

SEQ ID NO: 820777 - DNA, 25 bp, Mus musculus
tgggactacctcgagacagtgcatc

SEQ ID NO: 820778 - DNA, 25 bp, Mus musculus
tgggactagaggacaaaaatacttc

SEQ ID NO: 820779 - DNA, 25 bp, Mus musculus
tgggactagaggtcaaaaatacttc

SEQ ID NO: 820780 - DNA, 25 bp, Mus musculus
tgggactccaacatatacaaaagac

SEQ ID NO: 820781 - DNA, 25 bp, Mus musculus
tgggactccaacttatacaaaagac

SEQ ID NO: 820782 - DNA, 25 bp, Mus musculus
tgggactcgggcaaatgagacaaaa

SEQ ID NO: 820783 - DNA, 25 bp, Mus musculus
tgggactcgggctaatgagacaaaa

SEQ ID NO: 820784 - DNA, 25 bp, Mus musculus
tgggactctagcctctgaactggac

SEQ ID NO: 820785 - DNA, 25 bp, Mus musculus
tgggactctagcgtctgaactggac

SEQ ID NO: 820786 - DNA, 25 bp, Mus musculus
tgggactctcctacacagactcctt

SEQ ID NO: 820787 - DNA, 25 bp, Mus musculus
tgggactctccttcacagactcctt

SEQ ID NO: 820788 - DNA, 25 bp, Mus musculus
tgggactctctcctggtaccccaag

SEQ ID NO: 820789 - DNA, 25 bp, Mus musculus
tgggactctctcgtggtaccccaag

SEQ ID NO: 820790 - DNA, 25 bp, Mus musculus
tgggactgagaacctattagaatct

SEQ ID NO: 820791 - DNA, 25 bp, Mus musculus
tgggactgagaagctattagaatct

SEQ ID NO: 820792 - DNA, 25 bp, Mus musculus
tgggactgagcccacgcctaagaac

SEQ ID NO: 820793 - DNA, 25 bp, Mus musculus
tgggactgagccgacgcctaagaac

SEQ ID NO: 820794 - DNA, 25 bp, Mus musculus
tgggactgctcacaagacagatgca

SEQ ID NO: 820795 - DNA, 25 bp, Mus musculus
tgggactgctcagaagacagatgca

SEQ ID NO: 820796 - DNA, 25 bp, Mus musculus
tgggactgctctcaagatatagatg

SEQ ID NO: 820797 - DNA, 25 bp, Mus musculus
tgggactgctctgaagatatagatg

SEQ ID NO: 820798 - DNA, 25 bp, Mus musculus
tgggactgcttcctattccacgacg

SEQ ID NO: 820799 - DNA, 25 bp, Mus musculus
tgggactgcttcgtattccacgacg

SEQ ID NO: 820800 - DNA, 25 bp, Mus musculus
tgggactgcttgatcttacacgacg

SEQ ID NO: 820801 - DNA, 25 bp, Mus musculus
tgggactgcttgttcttacacgacg

SEQ ID NO: 820802 - DNA, 25 bp, Mus musculus
tgggactggaagatatacctgttac

SEQ ID NO: 820803 - DNA, 25 bp, Mus musculus
tgggactggaagttatacctgttac

SEQ ID NO: 820804 - DNA, 25 bp, Mus musculus
tgggactggacgcacttccaaggaa

SEQ ID NO: 820805 - DNA, 25 bp, Mus musculus
tgggactggacggacttccaaggaa

SEQ ID NO: 820806 - DNA, 25 bp, Mus musculus
tgggactgtgtcaccagcattctgc

SEQ ID NO: 820807 - DNA, 25 bp, Mus musculus
tgggactgtgtctccagcattctgc

SEQ ID NO: 820808 - DNA, 25 bp, Mus musculus
tgggacttctctacacgctggcttg

SEQ ID NO: 820809 - DNA, 25 bp, Mus musculus
tgggacttctcttcacgctggcttg

SEQ ID NO: 820810 - DNA, 25 bp, Mus musculus
tgggacttgccacagatgatcagga

SEQ ID NO: 820811 - DNA, 25 bp, Mus musculus
tgggacttgccagagatgatcagga

SEQ ID NO: 820812 - DNA, 25 bp, Mus musculus
tgggacttggtaagcggctccaaca

SEQ ID NO: 820813 - DNA, 25 bp, Mus musculus
tgggacttggtatgcggctccaaca

SEQ ID NO: 820814 - DNA, 25 bp, Mus musculus
tgggactttaatccctaggaaacag

SEQ ID NO: 820815 - DNA, 25 bp, Mus musculus
tgggactttaatgcctaggaaacag

SEQ ID NO: 820816 - DNA, 25 bp, Mus musculus
tgggagaaaactagactgacccatc

SEQ ID NO: 820817 - DNA, 25 bp, Mus musculus
tgggagaaaacttgactgacccatc

SEQ ID NO: 820818 - DNA, 25 bp, Mus musculus
tgggagaaaatacaggaccctcagt

SEQ ID NO: 820819 - DNA, 25 bp, Mus musculus
tgggagaaaatagaggaccctcagt

SEQ ID NO: 820820 - DNA, 25 bp, Mus musculus
tgggagaaatctcggaacggcaacc

SEQ ID NO: 820821 - DNA, 25 bp, Mus musculus
tgggagaaatctgggaacggcaacc

SEQ ID NO: 820822 - DNA, 25 bp, Mus musculus
tgggagaacaaaatcgtgcgcatag

SEQ ID NO: 820823 - DNA, 25 bp, Mus musculus
tgggagaacaaattcgtgcgcatag

SEQ ID NO: 820824 - DNA, 25 bp, Mus musculus
tgggagaagaccattgacattgacc

SEQ ID NO: 820825 - DNA, 25 bp, Mus musculus
tgggagaagacctttgacattgacc

SEQ ID NO: 820826 - DNA, 25 bp, Mus musculus
tgggagaagatcagtcctttgttct

SEQ ID NO: 820827 - DNA, 25 bp, Mus musculus
tgggagaagatctgtcctttgttct

SEQ ID NO: 820828 - DNA, 25 bp, Mus musculus
tgggagaagcaccagtcaactgtga

SEQ ID NO: 820829 - DNA, 25 bp, Mus musculus
tgggagaagcacgagtcaactgtga

SEQ ID NO: 820830 - DNA, 25 bp, Mus musculus
tgggagaagcccagcgtactcaagt

SEQ ID NO: 820831 - DNA, 25 bp, Mus musculus
tgggagaagccctgcgtactcaagt

SEQ ID NO: 820832 - DNA, 25 bp, Mus musculus
tgggagaataaccacctgctcgtta

SEQ ID NO: 820833 - DNA, 25 bp, Mus musculus
tgggagaataacgacctgctcgtta

SEQ ID NO: 820834 - DNA, 25 bp, Mus musculus
tgggagaatctcatcctggctatgc

SEQ ID NO: 820835 - DNA, 25 bp, Mus musculus
tgggagaatctcttcctggctatgc

SEQ ID NO: 820836 - DNA, 25 bp, Mus musculus
tgggagaatgctcgctaccttagag

SEQ ID NO: 820837 - DNA, 25 bp, Mus musculus
tgggagaatgctggctaccttagag

SEQ ID NO: 820838 - DNA, 25 bp, Mus musculus
tgggagacacacaatacaaaggaaa

SEQ ID NO: 820839 - DNA, 25 bp, Mus musculus
tgggagacacactatacaaaggaaa

SEQ ID NO: 820840 - DNA, 25 bp, Mus musculus
tgggagacacatcacccctgggtgt

SEQ ID NO: 820841 - DNA, 25 bp, Mus musculus
tgggagacacatgacccctgggtgt

SEQ ID NO: 820842 - DNA, 25 bp, Mus musculus
tgggagacacctacttgggacgtaa

SEQ ID NO: 820843 - DNA, 25 bp, Mus musculus
tgggagacaccttcttgggacgtaa

SEQ ID NO: 820844 - DNA, 25 bp, Mus musculus
tgggagacagcacgacgcaggctgg

SEQ ID NO: 820845 - DNA, 25 bp, Mus musculus
tgggagacagcaggacgcaggctgg

SEQ ID NO: 820846 - DNA, 25 bp, Mus musculus
tgggagacagtgctgaatgcaattt

SEQ ID NO: 820847 - DNA, 25 bp, Mus musculus
tgggagacagtggtgaatgcaattt

SEQ ID NO: 820848 - DNA, 25 bp, Mus musculus
tgggagaccaaaccaacacctacaa

SEQ ID NO: 820849 - DNA, 25 bp, Mus musculus
tgggagaccaaagcaacacctacaa

SEQ ID NO: 820850 - DNA, 25 bp, Mus musculus
tgggagaccacgacccatacaagca

SEQ ID NO: 820851 - DNA, 25 bp, Mus musculus
tgggagaccacgtcccatacaagca

SEQ ID NO: 820852 - DNA, 25 bp, Mus musculus
tgggagaccctgctgtggccaaatc

SEQ ID NO: 820853 - DNA, 25 bp, Mus musculus
tgggagaccctggtgtggccaaatc

SEQ ID NO: 820854 - DNA, 25 bp, Mus musculus
tgggagacgtgaacgcactcagcga

SEQ ID NO: 820855 - DNA, 25 bp, Mus musculus
tgggagacgtgatcgcactcagcga

SEQ ID NO: 820856 - DNA, 25 bp, Mus musculus
tgggagagaagaacctcttcatcag

SEQ ID NO: 820857 - DNA, 25 bp, Mus musculus
tgggagagaagatcctcttcatcag

SEQ ID NO: 820858 - DNA, 25 bp, Mus musculus
tgggagagacttatgaattagttcg

SEQ ID NO: 820859 - DNA, 25 bp, Mus musculus
tgggagagacttttgaattagttcg

SEQ ID NO: 820860 - DNA, 25 bp, Mus musculus
tgggagagagaacctaatgaagact

SEQ ID NO: 820861 - DNA, 25 bp, Mus musculus
tgggagagagaagctaatgaagact

SEQ ID NO: 820862 - DNA, 25 bp, Mus musculus
tgggagagagccatctcaccaaaca

SEQ ID NO: 820863 - DNA, 25 bp, Mus musculus
tgggagagagccttctcaccaaaca

SEQ ID NO: 820864 - DNA, 25 bp, Mus musculus
tgggagagcagcactcaggaaagtc

SEQ ID NO: 820865 - DNA, 25 bp, Mus musculus
tgggagagcagctctcaggaaagtc

SEQ ID NO: 820866 - DNA, 25 bp, Mus musculus
tgggagagccagaaaccttcctctt

SEQ ID NO: 820867 - DNA, 25 bp, Mus musculus
tgggagagccagtaaccttcctctt

SEQ ID NO: 820868 - DNA, 25 bp, Mus musculus
tgggagaggctaagaagcagcttca

SEQ ID NO: 820869 - DNA, 25 bp, Mus musculus
tgggagaggctatgaagcagcttca

SEQ ID NO: 820870 - DNA, 25 bp, Mus musculus
tgggagagtcccattctccggcgct

SEQ ID NO: 820871 - DNA, 25 bp, Mus musculus
tgggagagtccctttctccggcgct

SEQ ID NO: 820872 - DNA, 25 bp, Mus musculus
tgggagatacaaagtcctccgaaaa

SEQ ID NO: 820873 - DNA, 25 bp, Mus musculus
tgggagatacaatgtcctccgaaaa

SEQ ID NO: 820874 - DNA, 25 bp, Mus musculus
tgggagatagataacaatccgaaag

SEQ ID NO: 820875 - DNA, 25 bp, Mus musculus
tgggagatagattacaatccgaaag

SEQ ID NO: 820876 - DNA, 25 bp, Mus musculus
tgggagatcctgctcctcatggctt

SEQ ID NO: 820877 - DNA, 25 bp, Mus musculus
tgggagatcctggtcctcatggctt

SEQ ID NO: 820878 - DNA, 25 bp, Mus musculus
tgggagatgccaatccctcagtgga

SEQ ID NO: 820879 - DNA, 25 bp, Mus musculus
tgggagatgccattccctcagtgga

SEQ ID NO: 820880 - DNA, 25 bp, Mus musculus
tgggagatgctgacccggctttttc

SEQ ID NO: 820881 - DNA, 25 bp, Mus musculus
tgggagatgctgtcccggctttttc

SEQ ID NO: 820882 - DNA, 25 bp, Mus musculus
tgggagcaacaactccttgaagaaa

SEQ ID NO: 820883 - DNA, 25 bp, Mus musculus
tgggagcaacaagtccttgaagaaa

SEQ ID NO: 820884 - DNA, 25 bp, Mus musculus
tgggagcaagaacccttacacctgc

SEQ ID NO: 820885 - DNA, 25 bp, Mus musculus
tgggagcaagaagccttacacctgc

SEQ ID NO: 820886 - DNA, 25 bp, Mus musculus
tgggagcaagtacacagagttcaac

SEQ ID NO: 820887 - DNA, 25 bp, Mus musculus
tgggagcaagtagacagagttcaac

SEQ ID NO: 820888 - DNA, 25 bp, Mus musculus
tgggagcaccttatccaaactggct

SEQ ID NO: 820889 - DNA, 25 bp, Mus musculus
tgggagcaccttttccaaactggct

SEQ ID NO: 820890 - DNA, 25 bp, Mus musculus
tgggagcagcttacatccagcacag

SEQ ID NO: 820891 - DNA, 25 bp, Mus musculus
tgggagcagctttcatccagcacag

SEQ ID NO: 820892 - DNA, 25 bp, Mus musculus
tgggagcaggagaatacataaaaag

SEQ ID NO: 820893 - DNA, 25 bp, Mus musculus
tgggagcaggagtatacataaaaag

SEQ ID NO: 820894 - DNA, 25 bp, Mus musculus
tgggagcatcctaggtcactggctt

SEQ ID NO: 820895 - DNA, 25 bp, Mus musculus
tgggagcatccttggtcactggctt

SEQ ID NO: 820896 - DNA, 25 bp, Mus musculus
tgggagcatcttccatactctgtgc

SEQ ID NO: 820897 - DNA, 25 bp, Mus musculus
tgggagcatcttgcatactctgtgc

SEQ ID NO: 820898 - DNA, 25 bp, Mus musculus
tgggagcatgaacagccccacagac

SEQ ID NO: 820899 - DNA, 25 bp, Mus musculus
tgggagcatgaagagccccacagac

SEQ ID NO: 820900 - DNA, 25 bp, Mus musculus
tgggagccacgtcagtcactgggct

SEQ ID NO: 820901 - DNA, 25 bp, Mus musculus
tgggagccacgtgagtcactgggct

SEQ ID NO: 820902 - DNA, 25 bp, Mus musculus
tgggagcccagactgcctatatcgg

SEQ ID NO: 820903 - DNA, 25 bp, Mus musculus
tgggagcccagagtgcctatatcgg

SEQ ID NO: 820904 - DNA, 25 bp, Mus musculus
tgggagcccatgaggtattgactgc

SEQ ID NO: 820905 - DNA, 25 bp, Mus musculus
tgggagcccatgtggtattgactgc

SEQ ID NO: 820906 - DNA, 25 bp, Mus musculus
tgggagccccatagttgaagggttc

SEQ ID NO: 820907 - DNA, 25 bp, Mus musculus
tgggagccccattgttgaagggttc

SEQ ID NO: 820908 - DNA, 25 bp, Mus musculus
tgggagccctaaatgcggagcgact

SEQ ID NO: 820909 - DNA, 25 bp, Mus musculus
tgggagccctaattgcggagcgact

SEQ ID NO: 820910 - DNA, 25 bp, Mus musculus
tgggagccctgaagtacgacatgct

SEQ ID NO: 820911 - DNA, 25 bp, Mus musculus
tgggagccctgatgtacgacatgct

SEQ ID NO: 820912 - DNA, 25 bp, Mus musculus
tgggagccgtgcagaactcctgtga

SEQ ID NO: 820913 - DNA, 25 bp, Mus musculus
tgggagccgtgctgaactcctgtga

SEQ ID NO: 820914 - DNA, 25 bp, Mus musculus
tgggagcctagaagaccccaagaat

SEQ ID NO: 820915 - DNA, 25 bp, Mus musculus
tgggagcctagatgaccccaagaat

SEQ ID NO: 820916 - DNA, 25 bp, Mus musculus
tgggagcctccgactgaagctgaga

SEQ ID NO: 820917 - DNA, 25 bp, Mus musculus
tgggagcctccgtctgaagctgaga

SEQ ID NO: 820918 - DNA, 25 bp, Mus musculus
tgggagcctgtcaggccttaatagg

SEQ ID NO: 820919 - DNA, 25 bp, Mus musculus
tgggagcctgtctggccttaatagg

SEQ ID NO: 820920 - DNA, 25 bp, Mus musculus
tgggagccttgacgccttgatgcct

SEQ ID NO: 820921 - DNA, 25 bp, Mus musculus
tgggagccttgaggccttgatgcct

SEQ ID NO: 820922 - DNA, 25 bp, Mus musculus
tgggagcgctatacagcattaaggt

SEQ ID NO: 820923 - DNA, 25 bp, Mus musculus
tgggagcgctattcagcattaaggt

SEQ ID NO: 820924 - DNA, 25 bp, Mus musculus
tgggagctacatctgcaagtgtcac

SEQ ID NO: 820925 - DNA, 25 bp, Mus musculus
tgggagctacatgtgcaagtgtcac

SEQ ID NO: 820926 - DNA, 25 bp, Mus musculus
tgggagctgactagaatcaaactgg

SEQ ID NO: 820927 - DNA, 25 bp, Mus musculus
tgggagctgacttgaatcaaactgg

SEQ ID NO: 820928 - DNA, 25 bp, Mus musculus
tgggagctgtacctgccccacaagc

SEQ ID NO: 820929 - DNA, 25 bp, Mus musculus
tgggagctgtacgtgccccacaagc

SEQ ID NO: 820930 - DNA, 25 bp, Mus musculus
tgggagcttctgagttattccagcc

SEQ ID NO: 820931 - DNA, 25 bp, Mus musculus
tgggagcttctgtgttattccagcc

SEQ ID NO: 820932 - DNA, 25 bp, Mus musculus
tgggagctttgtactggttgccttc

SEQ ID NO: 820933 - DNA, 25 bp, Mus musculus
tgggagctttgtcgttcatgatatt

SEQ ID NO: 820934 - DNA, 25 bp, Mus musculus
tgggagctttgtggttcatgatatt

SEQ ID NO: 820935 - DNA, 25 bp, Mus musculus
tgggagctttgttctggttgccttc

SEQ ID NO: 820936 - DNA, 25 bp, Mus musculus
tgggaggactgccagagctctttta

SEQ ID NO: 820937 - DNA, 25 bp, Mus musculus
tgggaggactgcgagagctctttta

SEQ ID NO: 820938 - DNA, 25 bp, Mus musculus
tgggaggagaatccaatatcaactg

SEQ ID NO: 820939 - DNA, 25 bp, Mus musculus
tgggaggagaatgcaatatcaactg

SEQ ID NO: 820940 - DNA, 25 bp, Mus musculus
tgggaggagacacacttgatctgcc

SEQ ID NO: 820941 - DNA, 25 bp, Mus musculus
tgggaggagacagacttgatctgcc

SEQ ID NO: 820942 - DNA, 25 bp, Mus musculus
tgggaggagtcacagaaaagttcta

SEQ ID NO: 820943 - DNA, 25 bp, Mus musculus
tgggaggagtcagagaaaagttcta

SEQ ID NO: 820944 - DNA, 25 bp, Mus musculus
tgggaggagtgtatcttaaagcgcc

SEQ ID NO: 820945 - DNA, 25 bp, Mus musculus
tgggaggagtgtttcttaaagcgcc

SEQ ID NO: 820946 - DNA, 25 bp, Mus musculus
tgggaggagtttccacaagacctgt

SEQ ID NO: 820947 - DNA, 25 bp, Mus musculus
tgggaggagtttgcacaagacctgt

SEQ ID NO: 820948 - DNA, 25 bp, Mus musculus
tgggaggataccagcccttactctg

SEQ ID NO: 820949 - DNA, 25 bp, Mus musculus
tgggaggatacctgcccttactctg

SEQ ID NO: 820950 - DNA, 25 bp, Mus musculus
tgggaggcaatgagtcgagcatcta

SEQ ID NO: 820951 - DNA, 25 bp, Mus musculus
tgggaggcaatgtgtcgagcatcta

SEQ ID NO: 820952 - DNA, 25 bp, Mus musculus
tgggaggcacctaggaccccaaggt

SEQ ID NO: 820953 - DNA, 25 bp, Mus musculus
tgggaggcaccttggaccccaaggt

SEQ ID NO: 820954 - DNA, 25 bp, Mus musculus
tgggaggcagctctagtccagaact

SEQ ID NO: 820955 - DNA, 25 bp, Mus musculus
tgggaggcagctgtagtccagaact

SEQ ID NO: 820956 - DNA, 25 bp, Mus musculus
tgggaggccaccaagaccaatgatg

SEQ ID NO: 820957 - DNA, 25 bp, Mus musculus
tgggaggccacctagaccaatgatg

SEQ ID NO: 820958 - DNA, 25 bp, Mus musculus
tgggaggccgacagtaccaccaaat

SEQ ID NO: 820959 - DNA, 25 bp, Mus musculus
tgggaggccgactgtaccaccaaat

SEQ ID NO: 820960 - DNA, 25 bp, Mus musculus
tgggaggccgagatccagacctgcc

SEQ ID NO: 820961 - DNA, 25 bp, Mus musculus
tgggaggccgagttccagacctgcc

SEQ ID NO: 820962 - DNA, 25 bp, Mus musculus
tgggaggtacccaaaatgccaactc

SEQ ID NO: 820963 - DNA, 25 bp, Mus musculus
tgggaggtaccctaaatgccaactc

SEQ ID NO: 820964 - DNA, 25 bp, Mus musculus
tgggaggtccgacttctcgtcccca

SEQ ID NO: 820965 - DNA, 25 bp, Mus musculus
tgggaggtccgagttctcgtcccca

SEQ ID NO: 820966 - DNA, 25 bp, Mus musculus
tgggaggtcgacaaatcagaaccaa

SEQ ID NO: 820967 - DNA, 25 bp, Mus musculus
tgggaggtcgactaatcagaaccaa

SEQ ID NO: 820968 - DNA, 25 bp, Mus musculus
tgggaggtctgaaaagcccttggaa

SEQ ID NO: 820969 - DNA, 25 bp, Mus musculus
tgggaggtctgataagcccttggaa

SEQ ID NO: 820970 - DNA, 25 bp, Mus musculus
tgggagtaacagcaaacatcaggat

SEQ ID NO: 820971 - DNA, 25 bp, Mus musculus
tgggagtaacaggaaacatcaggat

SEQ ID NO: 820972 - DNA, 25 bp, Mus musculus
tgggagtacgaaattcagcagcaac

SEQ ID NO: 820973 - DNA, 25 bp, Mus musculus
tgggagtacgaatttcagcagcaac

SEQ ID NO: 820974 - DNA, 25 bp, Mus musculus
tgggagtactacagctgttgttacc

SEQ ID NO: 820975 - DNA, 25 bp, Mus musculus
tgggagtactactgctgttgttacc

SEQ ID NO: 820976 - DNA, 25 bp, Mus musculus
tgggagtatggccaccctactccac

SEQ ID NO: 820977 - DNA, 25 bp, Mus musculus
tgggagtatggcgaccctactccac

SEQ ID NO: 820978 - DNA, 25 bp, Mus musculus
tgggagtcatccactatacactggt

SEQ ID NO: 820979 - DNA, 25 bp, Mus musculus
tgggagtcatcctctatacactggt

SEQ ID NO: 820980 - DNA, 25 bp, Mus musculus
tgggagtccaaaatccagggtgcag

SEQ ID NO: 820981 - DNA, 25 bp, Mus musculus
tgggagtccaaattccagggtgcag

SEQ ID NO: 820982 - DNA, 25 bp, Mus musculus
tgggagtccattctacagatctgcg

SEQ ID NO: 820983 - DNA, 25 bp, Mus musculus
tgggagtccattgtacagatctgcg

SEQ ID NO: 820984 - DNA, 25 bp, Mus musculus
tgggagtcctacaacaaaactgagg

SEQ ID NO: 820985 - DNA, 25 bp, Mus musculus
tgggagtcctactacaaaactgagg

SEQ ID NO: 820986 - DNA, 25 bp, Mus musculus
tgggagtctacaacaaagggcttgg

SEQ ID NO: 820987 - DNA, 25 bp, Mus musculus
tgggagtctacatcaaagggcttgg

SEQ ID NO: 820988 - DNA, 25 bp, Mus musculus
tgggagtgactcaaatgattccatc

SEQ ID NO: 820989 - DNA, 25 bp, Mus musculus
tgggagtgactctaatgattccatc

SEQ ID NO: 820990 - DNA, 25 bp, Mus musculus
tgggagtgctgcacctgtcagtcgc

SEQ ID NO: 820991 - DNA, 25 bp, Mus musculus
tgggagtgctgctcctgtcagtcgc

SEQ ID NO: 820992 - DNA, 25 bp, Mus musculus
tgggagttcttgagcttcgccgaga

SEQ ID NO: 820993 - DNA, 25 bp, Mus musculus
tgggagttcttgtgcttcgccgaga

SEQ ID NO: 820994 - DNA, 25 bp, Mus musculus
tgggagttgtagatccaggcccggg

SEQ ID NO: 820995 - DNA, 25 bp, Mus musculus
tgggagttgtagttccaggcccggg

SEQ ID NO: 820996 - DNA, 25 bp, Mus musculus
tgggagtttccactccctttctgat

SEQ ID NO: 820997 - DNA, 25 bp, Mus musculus
tgggagtttccagtccctttctgat

SEQ ID NO: 820998 - DNA, 25 bp, Mus musculus
tgggagtttgtcagcaaggtttaca

SEQ ID NO: 820999 - DNA, 25 bp, Mus musculus
tgggagtttgtctgcaaggtttaca

SEQ ID NO: 821000 - DNA, 25 bp, Mus musculus
tgggataaacccaactgttgtaggt

SEQ ID NO: 821001 - DNA, 25 bp, Mus musculus
tgggataaaccctactgttgtaggt

SEQ ID NO: 821002 - DNA, 25 bp, Mus musculus
tgggataaactcatcttccacaaga

SEQ ID NO: 821003 - DNA, 25 bp, Mus musculus
tgggataaactcttcttccacaaga

SEQ ID NO: 821004 - DNA, 25 bp, Mus musculus
tgggataattacagtgtgaaaaaac

SEQ ID NO: 821005 - DNA, 25 bp, Mus musculus
tgggataattactgtgtgaaaaaac

SEQ ID NO: 821006 - DNA, 25 bp, Mus musculus
tgggatacaaagaaccagaaagacc

SEQ ID NO: 821007 - DNA, 25 bp, Mus musculus
tgggatacaaagtaccagaaagacc

SEQ ID NO: 821008 - DNA, 25 bp, Mus musculus
tgggatacaagcaagaaagatctga

SEQ ID NO: 821009 - DNA, 25 bp, Mus musculus
tgggatacaagctagaaagatctga

SEQ ID NO: 821010 - DNA, 25 bp, Mus musculus
tgggataccacacagaaggagcatc

SEQ ID NO: 821011 - DNA, 25 bp, Mus musculus
tgggataccacagagaaggagcatc

SEQ ID NO: 821012 - DNA, 25 bp, Mus musculus
tgggataccagcaaaaaagacttaa

SEQ ID NO: 821013 - DNA, 25 bp, Mus musculus
tgggataccagctaaaaagacttaa

SEQ ID NO: 821014 - DNA, 25 bp, Mus musculus
tgggatatgaatcacagcacagctc

SEQ ID NO: 821015 - DNA, 25 bp, Mus musculus
tgggatatgaatgacagcacagctc

SEQ ID NO: 821016 - DNA, 25 bp, Mus musculus
tgggatatgctgcatttagccaaga

SEQ ID NO: 821017 - DNA, 25 bp, Mus musculus
tgggatatgctggatttagccaaga

SEQ ID NO: 821018 - DNA, 25 bp, Mus musculus
tgggatatgtagatccaaccccggc

SEQ ID NO: 821019 - DNA, 25 bp, Mus musculus
tgggatatgtagttccaaccccggc

SEQ ID NO: 821020 - DNA, 25 bp, Mus musculus
tgggatcaaacacctcgcaaattac

SEQ ID NO: 821021 - DNA, 25 bp, Mus musculus
tgggatcaaacacgtccatgcattc

SEQ ID NO: 821022 - DNA, 25 bp, Mus musculus
tgggatcaaacagctcgcaaattac

SEQ ID NO: 821023 - DNA, 25 bp, Mus musculus
tgggatcaaacaggtccatgcattc

SEQ ID NO: 821024 - DNA, 25 bp, Mus musculus
tgggatcaagacatcagaccaccgt

SEQ ID NO: 821025 - DNA, 25 bp, Mus musculus
tgggatcaagacttcagaccaccgt

SEQ ID NO: 821026 - DNA, 25 bp, Mus musculus
tgggatcacactacccctgaggagg

SEQ ID NO: 821027 - DNA, 25 bp, Mus musculus
tgggatcacacttcccctgaggagg

SEQ ID NO: 821028 - DNA, 25 bp, Mus musculus
tgggatcactaccaccttgaactct

SEQ ID NO: 821029 - DNA, 25 bp, Mus musculus
tgggatcactacgaccttgaactct

SEQ ID NO: 821030 - DNA, 25 bp, Mus musculus
tgggatcagctgagcaagacaaacc

SEQ ID NO: 821031 - DNA, 25 bp, Mus musculus
tgggatcagctgtgcaagacaaacc

SEQ ID NO: 821032 - DNA, 25 bp, Mus musculus
tgggatcagggtcggcaacggaccg

SEQ ID NO: 821033 - DNA, 25 bp, Mus musculus
tgggatcagggtgggcaacggaccg

SEQ ID NO: 821034 - DNA, 25 bp, Mus musculus
tgggatccaacgacagtaagtacag

SEQ ID NO: 821035 - DNA, 25 bp, Mus musculus
tgggatccaacgtcagtaagtacag

SEQ ID NO: 821036 - DNA, 25 bp, Mus musculus
tgggatccatctcaacctcagagag

SEQ ID NO: 821037 - DNA, 25 bp, Mus musculus
tgggatccatctgaacctcagagag

SEQ ID NO: 821038 - DNA, 25 bp, Mus musculus
tgggatcccggcactcaggcgcact

SEQ ID NO: 821039 - DNA, 25 bp, Mus musculus
tgggatcccggctctcaggcgcact

SEQ ID NO: 821040 - DNA, 25 bp, Mus musculus
tgggatccctgactaatgacagttt

SEQ ID NO: 821041 - DNA, 25 bp, Mus musculus
tgggatccctgagtaatgacagttt

SEQ ID NO: 821042 - DNA, 25 bp, Mus musculus
tgggatcctcagagtctggtgtgaa

SEQ ID NO: 821043 - DNA, 25 bp, Mus musculus
tgggatcctcagtgtctggtgtgaa

SEQ ID NO: 821044 - DNA, 25 bp, Mus musculus
tgggatcctgccagcgtcccggcag

SEQ ID NO: 821045 - DNA, 25 bp, Mus musculus
tgggatcctgcctgcgtcccggcag

SEQ ID NO: 821046 - DNA, 25 bp, Mus musculus
tgggatcctgggaaaattttggttg

SEQ ID NO: 821047 - DNA, 25 bp, Mus musculus
tgggatcctgggtaaattttggttg

SEQ ID NO: 821048 - DNA, 25 bp, Mus musculus
tgggatcctgtcattcagctccaaa

SEQ ID NO: 821049 - DNA, 25 bp, Mus musculus
tgggatcctgtctttcagctccaaa

SEQ ID NO: 821050 - DNA, 25 bp, Mus musculus
tgggatccttcaccggccctgagtg

SEQ ID NO: 821051 - DNA, 25 bp, Mus musculus
tgggatccttcagcggccctgagtg

SEQ ID NO: 821052 - DNA, 25 bp, Mus musculus
tgggatccttggcacacataaaaga

SEQ ID NO: 821053 - DNA, 25 bp, Mus musculus
tgggatccttgggacacataaaaga

SEQ ID NO: 821054 - DNA, 25 bp, Mus musculus
tgggatcgacaacagtccacttgct

SEQ ID NO: 821055 - DNA, 25 bp, Mus musculus
tgggatcgacaagagtccacttgct

SEQ ID NO: 821056 - DNA, 25 bp, Mus musculus
tgggatcgccgccactggagcccaa

SEQ ID NO: 821057 - DNA, 25 bp, Mus musculus
tgggatcgccgcgactggagcccaa

SEQ ID NO: 821058 - DNA, 25 bp, Mus musculus
tgggatcgcgtgcacattgccaaga

SEQ ID NO: 821059 - DNA, 25 bp, Mus musculus
tgggatcgcgtggacattgccaaga

SEQ ID NO: 821060 - DNA, 25 bp, Mus musculus
tgggatctacctaacttggaggcaa

SEQ ID NO: 821061 - DNA, 25 bp, Mus musculus
tgggatctaccttacttggaggcaa

SEQ ID NO: 821062 - DNA, 25 bp, Mus musculus
tgggatctagccattcagaaaacgg

SEQ ID NO: 821063 - DNA, 25 bp, Mus musculus
tgggatctagcctttcagaaaacgg

SEQ ID NO: 821064 - DNA, 25 bp, Mus musculus
tgggatctcaatcaaggcaagcacc

SEQ ID NO: 821065 - DNA, 25 bp, Mus musculus
tgggatctcaatgaaggcaagcacc

SEQ ID NO: 821066 - DNA, 25 bp, Mus musculus
tgggatctcacaacgcaagtagctg

SEQ ID NO: 821067 - DNA, 25 bp, Mus musculus
tgggatctcacatcgcaagtagctg

SEQ ID NO: 821068 - DNA, 25 bp, Mus musculus
tgggatctcagacgactctgtaaaa

SEQ ID NO: 821069 - DNA, 25 bp, Mus musculus
tgggatctcagaggactctgtaaaa

SEQ ID NO: 821070 - DNA, 25 bp, Mus musculus
tgggatctcccacactcttgaaggc

SEQ ID NO: 821071 - DNA, 25 bp, Mus musculus
tgggatctcccagactcttgaaggc

SEQ ID NO: 821072 - DNA, 25 bp, Mus musculus
tgggatctgaaccaaagcccaagcc

SEQ ID NO: 821073 - DNA, 25 bp, Mus musculus
tgggatctgaacgaaagcccaagcc

SEQ ID NO: 821074 - DNA, 25 bp, Mus musculus
tgggatcttagtctttgttctgtac

SEQ ID NO: 821075 - DNA, 25 bp, Mus musculus
tgggatcttagtgtttgttctgtac

SEQ ID NO: 821076 - DNA, 25 bp, Mus musculus
tgggatgaaaatctctactacacag

SEQ ID NO: 821077 - DNA, 25 bp, Mus musculus
tgggatgaaaatgtctactacacag

SEQ ID NO: 821078 - DNA, 25 bp, Mus musculus
tgggatgaagatctctcgaccacct

SEQ ID NO: 821079 - DNA, 25 bp, Mus musculus
tgggatgaagatgtctcgaccacct

SEQ ID NO: 821080 - DNA, 25 bp, Mus musculus
tgggatgacataaacaatgttggac

SEQ ID NO: 821081 - DNA, 25 bp, Mus musculus
tgggatgacatatacaatgttggac

SEQ ID NO: 821082 - DNA, 25 bp, Mus musculus
tgggatgaccagctagcatctcaga

SEQ ID NO: 821083 - DNA, 25 bp, Mus musculus
tgggatgaccaggtagcatctcaga

SEQ ID NO: 821084 - DNA, 25 bp, Mus musculus
tgggatgacctcagccggcctccgg

SEQ ID NO: 821085 - DNA, 25 bp, Mus musculus
tgggatgacctctgccggcctccgg

SEQ ID NO: 821086 - DNA, 25 bp, Mus musculus
tgggatgagaacacctcagccgggc

SEQ ID NO: 821087 - DNA, 25 bp, Mus musculus
tgggatgagaactcctcagccgggc

SEQ ID NO: 821088 - DNA, 25 bp, Mus musculus
tgggatgagagtactggcagcttcc

SEQ ID NO: 821089 - DNA, 25 bp, Mus musculus
tgggatgagagttctggcagcttcc

SEQ ID NO: 821090 - DNA, 25 bp, Mus musculus
tgggatgatactcgtcatggctttc

SEQ ID NO: 821091 - DNA, 25 bp, Mus musculus
tgggatgatactggtcatggctttc

SEQ ID NO: 821092 - DNA, 25 bp, Mus musculus
tgggatgatctgaaccacaagaggc

SEQ ID NO: 821093 - DNA, 25 bp, Mus musculus
tgggatgatctgtaccacaagaggc

SEQ ID NO: 821094 - DNA, 25 bp, Mus musculus
tgggatgctaaacaaggacctgtga

SEQ ID NO: 821095 - DNA, 25 bp, Mus musculus
tgggatgctaaagaaggacctgtga

SEQ ID NO: 821096 - DNA, 25 bp, Mus musculus
tgggatgctgatcaacaagcctcca

SEQ ID NO: 821097 - DNA, 25 bp, Mus musculus
tgggatgctgatgaacaagcctcca

SEQ ID NO: 821098 - DNA, 25 bp, Mus musculus
tgggatgctgttaaccctgggtctg

SEQ ID NO: 821099 - DNA, 25 bp, Mus musculus
tgggatgctgtttaccctgggtctg

SEQ ID NO: 821100 - DNA, 25 bp, Mus musculus
tgggatggaaatactgtcttatctg

SEQ ID NO: 821101 - DNA, 25 bp, Mus musculus
tgggatggaaattctgtcttatctg

SEQ ID NO: 821102 - DNA, 25 bp, Mus musculus
tgggatggactgcacactgatcaca

SEQ ID NO: 821103 - DNA, 25 bp, Mus musculus
tgggatggactggacactgatcaca

SEQ ID NO: 821104 - DNA, 25 bp, Mus musculus
tgggatggatcaccttgcacacgct

SEQ ID NO: 821105 - DNA, 25 bp, Mus musculus
tgggatggatcagcttgcacacgct

SEQ ID NO: 821106 - DNA, 25 bp, Mus musculus
tgggatggctgtacatcgggctcat

SEQ ID NO: 821107 - DNA, 25 bp, Mus musculus
tgggatggctgttcatcgggctcat

SEQ ID NO: 821108 - DNA, 25 bp, Mus musculus
tgggatggcttcacggcccgtgcca

SEQ ID NO: 821109 - DNA, 25 bp, Mus musculus
tgggatggcttctcggcccgtgcca

SEQ ID NO: 821110 - DNA, 25 bp, Mus musculus
tgggatgggagaaaacacctctgac

SEQ ID NO: 821111 - DNA, 25 bp, Mus musculus
tgggatgggagataacacctctgac

SEQ ID NO: 821112 - DNA, 25 bp, Mus musculus
tgggatggtccaactaagcgctggt

SEQ ID NO: 821113 - DNA, 25 bp, Mus musculus
tgggatggtccatctaagcgctggt

SEQ ID NO: 821114 - DNA, 25 bp, Mus musculus
tgggatgtaccacgtataaactgtg

SEQ ID NO: 821115 - DNA, 25 bp, Mus musculus
tgggatgtaccaggtataaactgtg

SEQ ID NO: 821116 - DNA, 25 bp, Mus musculus
tgggatgtcccgagatgtgtacagc

SEQ ID NO: 821117 - DNA, 25 bp, Mus musculus
tgggatgtcccgtgatgtgtacagc

SEQ ID NO: 821118 - DNA, 25 bp, Mus musculus
tgggatgtctgaagatcagacagtt

SEQ ID NO: 821119 - DNA, 25 bp, Mus musculus
tgggatgtctgatgatcagacagtt

SEQ ID NO: 821120 - DNA, 25 bp, Mus musculus
tgggatgttcatcatggtaatggaa

SEQ ID NO: 821121 - DNA, 25 bp, Mus musculus
tgggatgttcatgatggtaatggaa

SEQ ID NO: 821122 - DNA, 25 bp, Mus musculus
tgggatgttggaacaaggacctgta

SEQ ID NO: 821123 - DNA, 25 bp, Mus musculus
tgggatgttggatcaaggacctgta

SEQ ID NO: 821124 - DNA, 25 bp, Mus musculus
tgggattaaataaggaagggcaagt

SEQ ID NO: 821125 - DNA, 25 bp, Mus musculus
tgggattaaatatggaagggcaagt

SEQ ID NO: 821126 - DNA, 25 bp, Mus musculus
tgggattaacaacacatagaacctg

SEQ ID NO: 821127 - DNA, 25 bp, Mus musculus
tgggattaacaagacatagaacctg

SEQ ID NO: 821128 - DNA, 25 bp, Mus musculus
tgggattaatctcagcaattgggag

SEQ ID NO: 821129 - DNA, 25 bp, Mus musculus
tgggattaatctgagcaattgggag

SEQ ID NO: 821130 - DNA, 25 bp, Mus musculus
tgggattcctctactggccagcaac

SEQ ID NO: 821131 - DNA, 25 bp, Mus musculus
tgggattcctcttctggccagcaac

SEQ ID NO: 821132 - DNA, 25 bp, Mus musculus
tgggattctgccagctggtgatgtt

SEQ ID NO: 821133 - DNA, 25 bp, Mus musculus
tgggattctgcctgctggtgatgtt

SEQ ID NO: 821134 - DNA, 25 bp, Mus musculus
tgggattgcaacctagacagctggt

SEQ ID NO: 821135 - DNA, 25 bp, Mus musculus
tgggattgcaacgtagacagctggt

SEQ ID NO: 821136 - DNA, 25 bp, Mus musculus
tgggattgccctcactgaagcagac

SEQ ID NO: 821137 - DNA, 25 bp, Mus musculus
tgggattgccctgactgaagcagac

SEQ ID NO: 821138 - DNA, 25 bp, Mus musculus
tgggattggacaagaccaccctacc

SEQ ID NO: 821139 - DNA, 25 bp, Mus musculus
tgggattggacatgaccaccctacc

SEQ ID NO: 821140 - DNA, 25 bp, Mus musculus
tgggattggctaagacctccagcat

SEQ ID NO: 821141 - DNA, 25 bp, Mus musculus
tgggattggctatgacctccagcat

SEQ ID NO: 821142 - DNA, 25 bp, Mus musculus
tgggattggtcaaaccaccaattgc

SEQ ID NO: 821143 - DNA, 25 bp, Mus musculus
tgggattggtcataccaccaattgc

SEQ ID NO: 821144 - DNA, 25 bp, Mus musculus
tgggattgtaaacatgactcaatgc

SEQ ID NO: 821145 - DNA, 25 bp, Mus musculus
tgggattgtaaagatgactcaatgc

SEQ ID NO: 821146 - DNA, 25 bp, Mus musculus
tgggatttcactctgtcctcccatc

SEQ ID NO: 821147 - DNA, 25 bp, Mus musculus
tgggatttcactgtgtcctcccatc

SEQ ID NO: 821148 - DNA, 25 bp, Mus musculus
tgggatttccttctttgcctgtctc

SEQ ID NO: 821149 - DNA, 25 bp, Mus musculus
tgggatttccttgtttgcctgtctc

SEQ ID NO: 821150 - DNA, 25 bp, Mus musculus
tgggattttacacgtggtgtcacct

SEQ ID NO: 821151 - DNA, 25 bp, Mus musculus
tgggattttacaggtggtgtcacct

SEQ ID NO: 821152 - DNA, 25 bp, Mus musculus
tgggattttccacccgacacaacct

SEQ ID NO: 821153 - DNA, 25 bp, Mus musculus
tgggattttccagccgacacaacct

SEQ ID NO: 821154 - DNA, 25 bp, Mus musculus
tgggcaaaagagatggcttgaatca

SEQ ID NO: 821155 - DNA, 25 bp, Mus musculus
tgggcaaaagagttggcttgaatca

SEQ ID NO: 821156 - DNA, 25 bp, Mus musculus
tgggcaaaatccacagcgtggagaa

SEQ ID NO: 821157 - DNA, 25 bp, Mus musculus
tgggcaaaatcctcagcgtggagaa

SEQ ID NO: 821158 - DNA, 25 bp, Mus musculus
tgggcaaacattatgggatggtacc

SEQ ID NO: 821159 - DNA, 25 bp, Mus musculus
tgggcaaacattttgggatggtacc

SEQ ID NO: 821160 - DNA, 25 bp, Mus musculus
tgggcaaactcaagaagcatgagac

SEQ ID NO: 821161 - DNA, 25 bp, Mus musculus
tgggcaaactcatgaagcatgagac

SEQ ID NO: 821162 - DNA, 25 bp, Mus musculus
tgggcaaagtgcaaacgcccaccca

SEQ ID NO: 821163 - DNA, 25 bp, Mus musculus
tgggcaaagtgctaacgcccaccca

SEQ ID NO: 821164 - DNA, 25 bp, Mus musculus
tgggcaaagtgtatcgacaggacag

SEQ ID NO: 821165 - DNA, 25 bp, Mus musculus
tgggcaaagtgtttcgacaggacag

SEQ ID NO: 821166 - DNA, 25 bp, Mus musculus
tgggcaaatatcagcagatggactg

SEQ ID NO: 821167 - DNA, 25 bp, Mus musculus
tgggcaaatatctgcagatggactg

SEQ ID NO: 821168 - DNA, 25 bp, Mus musculus
tgggcaacaacaccaagtagccaga

SEQ ID NO: 821169 - DNA, 25 bp, Mus musculus
tgggcaacaacagcaagtagccaga

SEQ ID NO: 821170 - DNA, 25 bp, Mus musculus
tgggcaaccaaaactgttggctttt

SEQ ID NO: 821171 - DNA, 25 bp, Mus musculus
tgggcaaccaaatctgttggctttt

SEQ ID NO: 821172 - DNA, 25 bp, Mus musculus
tgggcaaccacaacttcaacagtgc

SEQ ID NO: 821173 - DNA, 25 bp, Mus musculus
tgggcaaccacatcttcaacagtgc

SEQ ID NO: 821174 - DNA, 25 bp, Mus musculus
tgggcaaccattccaaggagcttac

SEQ ID NO: 821175 - DNA, 25 bp, Mus musculus
tgggcaaccattgcaaggagcttac

SEQ ID NO: 821176 - DNA, 25 bp, Mus musculus
tgggcaacccggacagccaggagct

SEQ ID NO: 821177 - DNA, 25 bp, Mus musculus
tgggcaacccggtcagccaggagct

SEQ ID NO: 821178 - DNA, 25 bp, Mus musculus
tgggcaactatgacagtgagctccg

SEQ ID NO: 821179 - DNA, 25 bp, Mus musculus
tgggcaactatgtcagtgagctccg

SEQ ID NO: 821180 - DNA, 25 bp, Mus musculus
tgggcaactgccacacggtgggccc

SEQ ID NO: 821181 - DNA, 25 bp, Mus musculus
tgggcaactgcctcacggtgggccc

SEQ ID NO: 821182 - DNA, 25 bp, Mus musculus
tgggcaagaacgaacaggacattaa

SEQ ID NO: 821183 - DNA, 25 bp, Mus musculus
tgggcaagaacgtacaggacattaa

SEQ ID NO: 821184 - DNA, 25 bp, Mus musculus
tgggcaagaactagggacccagact

SEQ ID NO: 821185 - DNA, 25 bp, Mus musculus
tgggcaagaacttgggacccagact

SEQ ID NO: 821186 - DNA, 25 bp, Mus musculus
tgggcaagaagactacgatcgcctg

SEQ ID NO: 821187 - DNA, 25 bp, Mus musculus
tgggcaagaagagtacgatcgcctg

SEQ ID NO: 821188 - DNA, 25 bp, Mus musculus
tgggcaagaagcacaggacacagag

SEQ ID NO: 821189 - DNA, 25 bp, Mus musculus
tgggcaagaagctcaggacacagag

SEQ ID NO: 821190 - DNA, 25 bp, Mus musculus
tgggcaagagcacagagatcctcaa

SEQ ID NO: 821191 - DNA, 25 bp, Mus musculus
tgggcaagagcagagagatcctcaa

SEQ ID NO: 821192 - DNA, 25 bp, Mus musculus
tgggcaagcagtactcttcctgtac

SEQ ID NO: 821193 - DNA, 25 bp, Mus musculus
tgggcaagcagttctcttcctgtac

SEQ ID NO: 821194 - DNA, 25 bp, Mus musculus
tgggcaagctagaggctcccgaatc

SEQ ID NO: 821195 - DNA, 25 bp, Mus musculus
tgggcaagctagtggctcccgaatc

SEQ ID NO: 821196 - DNA, 25 bp, Mus musculus
tgggcaaggaccacttccacagagc

SEQ ID NO: 821197 - DNA, 25 bp, Mus musculus
tgggcaaggacctcttccacagagc

SEQ ID NO: 821198 - DNA, 25 bp, Mus musculus
tgggcaaggccgaggctgagcggat

SEQ ID NO: 821199 - DNA, 25 bp, Mus musculus
tgggcaaggccgtggctgagcggat

SEQ ID NO: 821200 - DNA, 25 bp, Mus musculus
tgggcaaggtccacatcgtggactg

SEQ ID NO: 821201 - DNA, 25 bp, Mus musculus
tgggcaaggtcctcatcgtggactg

SEQ ID NO: 821202 - DNA, 25 bp, Mus musculus
tgggcaagtcagctactcagggacc

SEQ ID NO: 821203 - DNA, 25 bp, Mus musculus
tgggcaagtcaggtactcagggacc

SEQ ID NO: 821204 - DNA, 25 bp, Mus musculus
tgggcaagtcttctcgcagtcctct

SEQ ID NO: 821205 - DNA, 25 bp, Mus musculus
tgggcaagtcttgtcgcagtcctct

SEQ ID NO: 821206 - DNA, 25 bp, Mus musculus
tgggcaatacataccttgcattgca

SEQ ID NO: 821207 - DNA, 25 bp, Mus musculus
tgggcaatacattccttgcattgca

SEQ ID NO: 821208 - DNA, 25 bp, Mus musculus
tgggcaatatgaacgtgattgtgct

SEQ ID NO: 821209 - DNA, 25 bp, Mus musculus
tgggcaatatgatcgtgattgtgct

SEQ ID NO: 821210 - DNA, 25 bp, Mus musculus
tgggcaatgcgcctgaaagcatcca

SEQ ID NO: 821211 - DNA, 25 bp, Mus musculus
tgggcaatgcgcgtgaaagcatcca

SEQ ID NO: 821212 - DNA, 25 bp, Mus musculus
tgggcaatggacacacgactgatct

SEQ ID NO: 821213 - DNA, 25 bp, Mus musculus
tgggcaatggactcacgactgatct

SEQ ID NO: 821214 - DNA, 25 bp, Mus musculus
tgggcaatggttccttcattgagca

SEQ ID NO: 821215 - DNA, 25 bp, Mus musculus
tgggcaatggttgcttcattgagca

SEQ ID NO: 821216 - DNA, 25 bp, Mus musculus
tgggcaatgtatcctaccactgagc

SEQ ID NO: 821217 - DNA, 25 bp, Mus musculus
tgggcaatgtatgctaccactgagc

SEQ ID NO: 821218 - DNA, 25 bp, Mus musculus
tgggcacaacaacggttacaaagga

SEQ ID NO: 821219 - DNA, 25 bp, Mus musculus
tgggcacaacaagggttacaaagga

SEQ ID NO: 821220 - DNA, 25 bp, Mus musculus
tgggcacaagaactggatcatccag

SEQ ID NO: 821221 - DNA, 25 bp, Mus musculus
tgggcacaagaagtggatcatccag

SEQ ID NO: 821222 - DNA, 25 bp, Mus musculus
tgggcacaatgcaggaaaggatcac

SEQ ID NO: 821223 - DNA, 25 bp, Mus musculus
tgggcacaatgctggaaaggatcac

SEQ ID NO: 821224 - DNA, 25 bp, Mus musculus
tgggcacacgtgaacgctggagcac

SEQ ID NO: 821225 - DNA, 25 bp, Mus musculus
tgggcacacgtgtacgctggagcac

SEQ ID NO: 821226 - DNA, 25 bp, Mus musculus
tgggcacactcgctgcctacgttgg

SEQ ID NO: 821227 - DNA, 25 bp, Mus musculus
tgggcacactcggtgcctacgttgg

SEQ ID NO: 821228 - DNA, 25 bp, Mus musculus
tgggcacacttccacctccatgtaa

SEQ ID NO: 821229 - DNA, 25 bp, Mus musculus
tgggcacacttcgacctccatgtaa

SEQ ID NO: 821230 - DNA, 25 bp, Mus musculus
tgggcacagataccttgaagaagct

SEQ ID NO: 821231 - DNA, 25 bp, Mus musculus
tgggcacagatagcttgaagaagct

SEQ ID NO: 821232 - DNA, 25 bp, Mus musculus
tgggcacagcccaactgggcctgaa

SEQ ID NO: 821233 - DNA, 25 bp, Mus musculus
tgggcacagccctactgggcctgaa

SEQ ID NO: 821234 - DNA, 25 bp, Mus musculus
tgggcacagctaccctgtggccact

SEQ ID NO: 821235 - DNA, 25 bp, Mus musculus
tgggcacagctacttaaccagggtt

SEQ ID NO: 821236 - DNA, 25 bp, Mus musculus
tgggcacagctagcctgtggccact

SEQ ID NO: 821237 - DNA, 25 bp, Mus musculus
tgggcacagctagttaaccagggtt

SEQ ID NO: 821238 - DNA, 25 bp, Mus musculus
tgggcacagcttactccaaactggt

SEQ ID NO: 821239 - DNA, 25 bp, Mus musculus
tgggcacagctttctccaaactggt

SEQ ID NO: 821240 - DNA, 25 bp, Mus musculus
tgggcacagtaaacgtgggtgaact

SEQ ID NO: 821241 - DNA, 25 bp, Mus musculus
tgggcacagtaatcgtgggtgaact

SEQ ID NO: 821242 - DNA, 25 bp, Mus musculus
tgggcacagtctcgtttaaagagac

SEQ ID NO: 821243 - DNA, 25 bp, Mus musculus
tgggcacagtctggtttaaagagac

SEQ ID NO: 821244 - DNA, 25 bp, Mus musculus
tgggcacagtgcagaaagtgatctc

SEQ ID NO: 821245 - DNA, 25 bp, Mus musculus
tgggcacagtgctgaaagtgatctc

SEQ ID NO: 821246 - DNA, 25 bp, Mus musculus
tgggcacatgtcagaggtccaagcc

SEQ ID NO: 821247 - DNA, 25 bp, Mus musculus
tgggcacatgtctgaggtccaagcc

SEQ ID NO: 821248 - DNA, 25 bp, Mus musculus
tgggcaccaaagaacctgtaaacgt

SEQ ID NO: 821249 - DNA, 25 bp, Mus musculus
tgggcaccaaagtacctgtaaacgt

SEQ ID NO: 821250 - DNA, 25 bp, Mus musculus
tgggcaccaccacaagcaaggctgg

SEQ ID NO: 821251 - DNA, 25 bp, Mus musculus
tgggcaccaccagaagcaaggctgg

SEQ ID NO: 821252 - DNA, 25 bp, Mus musculus
tgggcaccagacagggtcacgcctt

SEQ ID NO: 821253 - DNA, 25 bp, Mus musculus
tgggcaccagactgggtcacgcctt

SEQ ID NO: 821254 - DNA, 25 bp, Mus musculus
tgggcaccatagcaacacaaaaagc

SEQ ID NO: 821255 - DNA, 25 bp, Mus musculus
tgggcaccataggaacacaaaaagc

SEQ ID NO: 821256 - DNA, 25 bp, Mus musculus
tgggcaccatgaaccggaaaacact

SEQ ID NO: 821257 - DNA, 25 bp, Mus musculus
tgggcaccatgatccggaaaacact

SEQ ID NO: 821258 - DNA, 25 bp, Mus musculus
tgggcacccattcattatgcatgct

SEQ ID NO: 821259 - DNA, 25 bp, Mus musculus
tgggcacccattgattatgcatgct

SEQ ID NO: 821260 - DNA, 25 bp, Mus musculus
tgggcaccccgacttgcaatcggct

SEQ ID NO: 821261 - DNA, 25 bp, Mus musculus
tgggcaccccgagttgcaatcggct

SEQ ID NO: 821262 - DNA, 25 bp, Mus musculus
tgggcaccgctgctgtcaaggcaca

SEQ ID NO: 821263 - DNA, 25 bp, Mus musculus
tgggcaccgctggtgtcaaggcaca

SEQ ID NO: 821264 - DNA, 25 bp, Mus musculus
tgggcacctggcagtcatgtatact

SEQ ID NO: 821265 - DNA, 25 bp, Mus musculus
tgggcacctggctgtcatgtatact

SEQ ID NO: 821266 - DNA, 25 bp, Mus musculus
tgggcaccttcaacggagtctacct

SEQ ID NO: 821267 - DNA, 25 bp, Mus musculus
tgggcaccttcatcggagtctacct

SEQ ID NO: 821268 - DNA, 25 bp, Mus musculus
tgggcaccttctccgcaggtcgtga

SEQ ID NO: 821269 - DNA, 25 bp, Mus musculus
tgggcaccttctgcgcaggtcgtga

SEQ ID NO: 821270 - DNA, 25 bp, Mus musculus
tgggcacgaaatacaccatcttcga

SEQ ID NO: 821271 - DNA, 25 bp, Mus musculus
tgggcacgaaattcaccatcttcga

SEQ ID NO: 821272 - DNA, 25 bp, Mus musculus
tgggcacggatactgcaaatgcaac

SEQ ID NO: 821273 - DNA, 25 bp, Mus musculus
tgggcacggatagtgcaaatgcaac

SEQ ID NO: 821274 - DNA, 25 bp, Mus musculus
tgggcacggtggacggcatcgactt

SEQ ID NO: 821275 - DNA, 25 bp, Mus musculus
tgggcacggtggtcggcatcgactt

SEQ ID NO: 821276 - DNA, 25 bp, Mus musculus
tgggcacgtcatcacagacatcgtg

SEQ ID NO: 821277 - DNA, 25 bp, Mus musculus
tgggcacgtcatcagcaactaggga

SEQ ID NO: 821278 - DNA, 25 bp, Mus musculus
tgggcacgtcatgacagacatcgtg

SEQ ID NO: 821279 - DNA, 25 bp, Mus musculus
tgggcacgtcatgagcaactaggga

SEQ ID NO: 821280 - DNA, 25 bp, Mus musculus
tgggcacgttggctaaggtcacccc

SEQ ID NO: 821281 - DNA, 25 bp, Mus musculus
tgggcacgttgggtaaggtcacccc

SEQ ID NO: 821282 - DNA, 25 bp, Mus musculus
tgggcactcacaagccaatggctgg

SEQ ID NO: 821283 - DNA, 25 bp, Mus musculus
tgggcactcacatgccaatggctgg

SEQ ID NO: 821284 - DNA, 25 bp, Mus musculus
tgggcactcccaattacaggctacg

SEQ ID NO: 821285 - DNA, 25 bp, Mus musculus
tgggcactcccatttacaggctacg

SEQ ID NO: 821286 - DNA, 25 bp, Mus musculus
tgggcactgaaaacacctggctcct

SEQ ID NO: 821287 - DNA, 25 bp, Mus musculus
tgggcactgaaaaccaacgtcctca

SEQ ID NO: 821288 - DNA, 25 bp, Mus musculus
tgggcactgaaatcacctggctcct

SEQ ID NO: 821289 - DNA, 25 bp, Mus musculus
tgggcactgaaatccaacgtcctca

SEQ ID NO: 821290 - DNA, 25 bp, Mus musculus
tgggcactgaacatgaaggaactga

SEQ ID NO: 821291 - DNA, 25 bp, Mus musculus
tgggcactgaacttgaaggaactga

SEQ ID NO: 821292 - DNA, 25 bp, Mus musculus
tgggcactgatcagggcaaactcat

SEQ ID NO: 821293 - DNA, 25 bp, Mus musculus
tgggcactgatctgggcaaactcat

SEQ ID NO: 821294 - DNA, 25 bp, Mus musculus
tgggcactgcaccaggcagaattcc

SEQ ID NO: 821295 - DNA, 25 bp, Mus musculus
tgggcactgcacgaggcagaattcc

SEQ ID NO: 821296 - DNA, 25 bp, Mus musculus
tgggcactgctcagcgcggctagca

SEQ ID NO: 821297 - DNA, 25 bp, Mus musculus
tgggcactgctctgcgcggctagca

SEQ ID NO: 821298 - DNA, 25 bp, Mus musculus
tgggcactggagagacgcctctgca

SEQ ID NO: 821299 - DNA, 25 bp, Mus musculus
tgggcactggagtgacgcctctgca

SEQ ID NO: 821300 - DNA, 25 bp, Mus musculus
tgggcactggtgcttctgcgctaac

SEQ ID NO: 821301 - DNA, 25 bp, Mus musculus
tgggcactggtggttctgcgctaac

SEQ ID NO: 821302 - DNA, 25 bp, Mus musculus
tgggcactgtccacacgggagctgc

SEQ ID NO: 821303 - DNA, 25 bp, Mus musculus
tgggcactgtcctcacgggagctgc

SEQ ID NO: 821304 - DNA, 25 bp, Mus musculus
tgggcagaagcaccgcatcgccatc

SEQ ID NO: 821305 - DNA, 25 bp, Mus musculus
tgggcagaagcagcgcatcgccatc

SEQ ID NO: 821306 - DNA, 25 bp, Mus musculus
tgggcagaagtacgagacaccatta

SEQ ID NO: 821307 - DNA, 25 bp, Mus musculus
tgggcagaagtaggagacaccatta

SEQ ID NO: 821308 - DNA, 25 bp, Mus musculus
tgggcagaatctctcgccaagagct

SEQ ID NO: 821309 - DNA, 25 bp, Mus musculus
tgggcagaatctgtcgccaagagct

SEQ ID NO: 821310 - DNA, 25 bp, Mus musculus
tgggcagacaccaaaacagctgttt

SEQ ID NO: 821311 - DNA, 25 bp, Mus musculus
tgggcagacaccacacactattgtc

SEQ ID NO: 821312 - DNA, 25 bp, Mus musculus
tgggcagacacctaaacagctgttt

SEQ ID NO: 821313 - DNA, 25 bp, Mus musculus
tgggcagacacctcacactattgtc

SEQ ID NO: 821314 - DNA, 25 bp, Mus musculus
tgggcagacagtagccattccccag

SEQ ID NO: 821315 - DNA, 25 bp, Mus musculus
tgggcagacagttgccattccccag

SEQ ID NO: 821316 - DNA, 25 bp, Mus musculus
tgggcagactcactaccagacactg

SEQ ID NO: 821317 - DNA, 25 bp, Mus musculus
tgggcagactcagtaccagacactg

SEQ ID NO: 821318 - DNA, 25 bp, Mus musculus
tgggcagagctcattgggtcttcct

SEQ ID NO: 821319 - DNA, 25 bp, Mus musculus
tgggcagagctctttgggtcttcct

SEQ ID NO: 821320 - DNA, 25 bp, Mus musculus
tgggcagagcttcgagatccacacc

SEQ ID NO: 821321 - DNA, 25 bp, Mus musculus
tgggcagagcttggagatccacacc

SEQ ID NO: 821322 - DNA, 25 bp, Mus musculus
tgggcagatctgaaggcactggcac

SEQ ID NO: 821323 - DNA, 25 bp, Mus musculus
tgggcagatctgtaggcactggcac

SEQ ID NO: 821324 - DNA, 25 bp, Mus musculus
tgggcagcacagactaaggtatcac

SEQ ID NO: 821325 - DNA, 25 bp, Mus musculus
tgggcagcacagtctaaggtatcac

SEQ ID NO: 821326 - DNA, 25 bp, Mus musculus
tgggcagcagaacttgaacgccatc

SEQ ID NO: 821327 - DNA, 25 bp, Mus musculus
tgggcagcagaagttgaacgccatc

SEQ ID NO: 821328 - DNA, 25 bp, Mus musculus
tgggcagcaggtattgtacggtaca

SEQ ID NO: 821329 - DNA, 25 bp, Mus musculus
tgggcagcaggttttgtacggtaca

SEQ ID NO: 821330 - DNA, 25 bp, Mus musculus
tgggcagcatcaatgtcacaattcc

SEQ ID NO: 821331 - DNA, 25 bp, Mus musculus
tgggcagcatcattgtcacaattcc

SEQ ID NO: 821332 - DNA, 25 bp, Mus musculus
tgggcagcatcgcagagattgactt

SEQ ID NO: 821333 - DNA, 25 bp, Mus musculus
tgggcagcatcggagagattgactt

SEQ ID NO: 821334 - DNA, 25 bp, Mus musculus
tgggcagcattaccagctcctgtac

SEQ ID NO: 821335 - DNA, 25 bp, Mus musculus
tgggcagcattagcagctcctgtac

SEQ ID NO: 821336 - DNA, 25 bp, Mus musculus
tgggcagccaggcaagttcatttcc

SEQ ID NO: 821337 - DNA, 25 bp, Mus musculus
tgggcagccagggaagttcatttcc

SEQ ID NO: 821338 - DNA, 25 bp, Mus musculus
tgggcagcccatacctcgggtggaa

SEQ ID NO: 821339 - DNA, 25 bp, Mus musculus
tgggcagcccattcctcgggtggaa

SEQ ID NO: 821340 - DNA, 25 bp, Mus musculus
tgggcagcccttcgacacgatgaag

SEQ ID NO: 821341 - DNA, 25 bp, Mus musculus
tgggcagcccttggacacgatgaag

SEQ ID NO: 821342 - DNA, 25 bp, Mus musculus
tgggcagccgtgcaggttccctttc

SEQ ID NO: 821343 - DNA, 25 bp, Mus musculus
tgggcagccgtggaggttccctttc

SEQ ID NO: 821344 - DNA, 25 bp, Mus musculus
tgggcagcgcccattcagaccctta

SEQ ID NO: 821345 - DNA, 25 bp, Mus musculus
tgggcagcgccctttcagaccctta

SEQ ID NO: 821346 - DNA, 25 bp, Mus musculus
tgggcagcgctgagtgaacagcacc

SEQ ID NO: 821347 - DNA, 25 bp, Mus musculus
tgggcagcgctgtgtgaacagcacc

SEQ ID NO: 821348 - DNA, 25 bp, Mus musculus
tgggcagctatacagcctacttcac

SEQ ID NO: 821349 - DNA, 25 bp, Mus musculus
tgggcagctatagagcctacttcac

SEQ ID NO: 821350 - DNA, 25 bp, Mus musculus
tgggcagctgatcacacatctgggc

SEQ ID NO: 821351 - DNA, 25 bp, Mus musculus
tgggcagctgatgacacatctgggc

SEQ ID NO: 821352 - DNA, 25 bp, Mus musculus
tgggcagcttcaccacataaagatc

SEQ ID NO: 821353 - DNA, 25 bp, Mus musculus
tgggcagcttcagcacataaagatc

SEQ ID NO: 821354 - DNA, 25 bp, Mus musculus
tgggcaggaacaagggcaatctagt

SEQ ID NO: 821355 - DNA, 25 bp, Mus musculus
tgggcaggaacatgggcaatctagt

SEQ ID NO: 821356 - DNA, 25 bp, Mus musculus
tgggcaggacccagtacgaagtcct

SEQ ID NO: 821357 - DNA, 25 bp, Mus musculus
tgggcaggaccctgtacgaagtcct

SEQ ID NO: 821358 - DNA, 25 bp, Mus musculus
tgggcaggagctactctctgcatca

SEQ ID NO: 821359 - DNA, 25 bp, Mus musculus
tgggcaggagcttctctctgcatca

SEQ ID NO: 821360 - DNA, 25 bp, Mus musculus
tgggcaggcagaaccaatggtctta

SEQ ID NO: 821361 - DNA, 25 bp, Mus musculus
tgggcaggcagatccaatggtctta

SEQ ID NO: 821362 - DNA, 25 bp, Mus musculus
tgggcagggctcagaacacccctga

SEQ ID NO: 821363 - DNA, 25 bp, Mus musculus
tgggcagggctctgaacacccctga

SEQ ID NO: 821364 - DNA, 25 bp, Mus musculus
tgggcaggtacaccaaggcttgcta

SEQ ID NO: 821365 - DNA, 25 bp, Mus musculus
tgggcaggtacagcaaggcttgcta

SEQ ID NO: 821366 - DNA, 25 bp, Mus musculus
tgggcaggtcaacagaaagccccat

SEQ ID NO: 821367 - DNA, 25 bp, Mus musculus
tgggcaggtcaagagaaagccccat

SEQ ID NO: 821368 - DNA, 25 bp, Mus musculus
tgggcagtacaaagccttctaaatc

SEQ ID NO: 821369 - DNA, 25 bp, Mus musculus
tgggcagtacaatgccttctaaatc

SEQ ID NO: 821370 - DNA, 25 bp, Mus musculus
tgggcagtcccacaaagaaaagatc

SEQ ID NO: 821371 - DNA, 25 bp, Mus musculus
tgggcagtcccagaaagaaaagatc

SEQ ID NO: 821372 - DNA, 25 bp, Mus musculus
tgggcagtgcccaccagaggacagc

SEQ ID NO: 821373 - DNA, 25 bp, Mus musculus
tgggcagtgccctccagaggacagc

SEQ ID NO: 821374 - DNA, 25 bp, Mus musculus
tgggcagtgctaccagagatcaaga

SEQ ID NO: 821375 - DNA, 25 bp, Mus musculus
tgggcagtgctagcagagatcaaga

SEQ ID NO: 821376 - DNA, 25 bp, Mus musculus
tgggcagttccacaaaggtggcatc

SEQ ID NO: 821377 - DNA, 25 bp, Mus musculus
tgggcagttccagaaaggtggcatc

SEQ ID NO: 821378 - DNA, 25 bp, Mus musculus
tgggcagttggcaccatagaggatc

SEQ ID NO: 821379 - DNA, 25 bp, Mus musculus
tgggcagttggctccatagaggatc

SEQ ID NO: 821380 - DNA, 25 bp, Mus musculus
tgggcataaagtccatgtgggactc

SEQ ID NO: 821381 - DNA, 25 bp, Mus musculus
tgggcataaagtgcatgtgggactc

SEQ ID NO: 821382 - DNA, 25 bp, Mus musculus
tgggcataactaaccccgaaggcaa

SEQ ID NO: 821383 - DNA, 25 bp, Mus musculus
tgggcataactatccccgaaggcaa

SEQ ID NO: 821384 - DNA, 25 bp, Mus musculus
tgggcataccagcagtcagaggcct

SEQ ID NO: 821385 - DNA, 25 bp, Mus musculus
tgggcataccaggagtcagaggcct

SEQ ID NO: 821386 - DNA, 25 bp, Mus musculus
tgggcatagtcactaggcaaaggaa

SEQ ID NO: 821387 - DNA, 25 bp, Mus musculus
tgggcatagtcagtaggcaaaggaa

SEQ ID NO: 821388 - DNA, 25 bp, Mus musculus
tgggcatataaactccgaaactgct

SEQ ID NO: 821389 - DNA, 25 bp, Mus musculus
tgggcatataaagtccgaaactgct

SEQ ID NO: 821390 - DNA, 25 bp, Mus musculus
tgggcatcatccatcggaaatttag

SEQ ID NO: 821391 - DNA, 25 bp, Mus musculus
tgggcatcatccttcggaaatttag

SEQ ID NO: 821392 - DNA, 25 bp, Mus musculus
tgggcatcatgtcatcaccaaacga

SEQ ID NO: 821393 - DNA, 25 bp, Mus musculus
tgggcatcatgtgatcaccaaacga

SEQ ID NO: 821394 - DNA, 25 bp, Mus musculus
tgggcatcctcaaaaggctctcacc

SEQ ID NO: 821395 - DNA, 25 bp, Mus musculus
tgggcatcctcataaggctctcacc

SEQ ID NO: 821396 - DNA, 25 bp, Mus musculus
tgggcatcctcgaggtcagcacact

SEQ ID NO: 821397 - DNA, 25 bp, Mus musculus
tgggcatcctcgtggtcagcacact

SEQ ID NO: 821398 - DNA, 25 bp, Mus musculus
tgggcatcgctcctgtccacaggaa

SEQ ID NO: 821399 - DNA, 25 bp, Mus musculus
tgggcatcgctcgtgtccacaggaa

SEQ ID NO: 821400 - DNA, 25 bp, Mus musculus
tgggcatcggacctgcctatgccat

SEQ ID NO: 821401 - DNA, 25 bp, Mus musculus
tgggcatcggacgtgcctatgccat

SEQ ID NO: 821402 - DNA, 25 bp, Mus musculus
tgggcatctacaagcagggccttaa

SEQ ID NO: 821403 - DNA, 25 bp, Mus musculus
tgggcatctacatgcagggccttaa

SEQ ID NO: 821404 - DNA, 25 bp, Mus musculus
tgggcatctactctggcatgaagac

SEQ ID NO: 821405 - DNA, 25 bp, Mus musculus
tgggcatctactgtggcatgaagac

SEQ ID NO: 821406 - DNA, 25 bp, Mus musculus
tgggcatctctgagaactccatcat

SEQ ID NO: 821407 - DNA, 25 bp, Mus musculus
tgggcatctctgtgaactccatcat

SEQ ID NO: 821408 - DNA, 25 bp, Mus musculus
tgggcatctgccacatcttaatagt

SEQ ID NO: 821409 - DNA, 25 bp, Mus musculus
tgggcatctgcctcatcttaatagt

SEQ ID NO: 821410 - DNA, 25 bp, Mus musculus
tgggcatgacctccgaactctcaac

SEQ ID NO: 821411 - DNA, 25 bp, Mus musculus
tgggcatgacctgcgaactctcaac

SEQ ID NO: 821412 - DNA, 25 bp, Mus musculus
tgggcatgatctacaccgtgggata

SEQ ID NO: 821413 - DNA, 25 bp, Mus musculus
tgggcatgatcttcaccgtgggata

SEQ ID NO: 821414 - DNA, 25 bp, Mus musculus
tgggcatgcctcaccctagtcaggg

SEQ ID NO: 821415 - DNA, 25 bp, Mus musculus
tgggcatgcctctccctagtcaggg

SEQ ID NO: 821416 - DNA, 25 bp, Mus musculus
tgggcatgcggtatctgaccctcac

SEQ ID NO: 821417 - DNA, 25 bp, Mus musculus
tgggcatgcggtttctgaccctcac

SEQ ID NO: 821418 - DNA, 25 bp, Mus musculus
tgggcatgctcacctggccatacag

SEQ ID NO: 821419 - DNA, 25 bp, Mus musculus
tgggcatgctcagctggccatacag

SEQ ID NO: 821420 - DNA, 25 bp, Mus musculus
tgggcatgctcgatccttggatctg

SEQ ID NO: 821421 - DNA, 25 bp, Mus musculus
tgggcatgctcgttccttggatctg

SEQ ID NO: 821422 - DNA, 25 bp, Mus musculus
tgggcatgctttcctacagcgctga

SEQ ID NO: 821423 - DNA, 25 bp, Mus musculus
tgggcatgctttgctacagcgctga

SEQ ID NO: 821424 - DNA, 25 bp, Mus musculus
tgggcatggtaaaaaggaccacctt

SEQ ID NO: 821425 - DNA, 25 bp, Mus musculus
tgggcatggtaataaggaccacctt

SEQ ID NO: 821426 - DNA, 25 bp, Mus musculus
tgggcatgtacccagtcagtgtaga

SEQ ID NO: 821427 - DNA, 25 bp, Mus musculus
tgggcatgtaccgagtcagtgtaga

SEQ ID NO: 821428 - DNA, 25 bp, Mus musculus
tgggcatgtcagaagtctcggcgtc

SEQ ID NO: 821429 - DNA, 25 bp, Mus musculus
tgggcatgtcagtagtctcggcgtc

SEQ ID NO: 821430 - DNA, 25 bp, Mus musculus
tgggcatgtccgacgtgtacctccg

SEQ ID NO: 821431 - DNA, 25 bp, Mus musculus
tgggcatgtccgtcgtgtacctccg

SEQ ID NO: 821432 - DNA, 25 bp, Mus musculus
tgggcattcatcagcgcattggctc

SEQ ID NO: 821433 - DNA, 25 bp, Mus musculus
tgggcattcatctgcgcattggctc

SEQ ID NO: 821434 - DNA, 25 bp, Mus musculus
tgggcattcattagctttagctgaa

SEQ ID NO: 821435 - DNA, 25 bp, Mus musculus
tgggcattcatttgctttagctgaa

SEQ ID NO: 821436 - DNA, 25 bp, Mus musculus
tgggcattctggaccgtaaccctcg

SEQ ID NO: 821437 - DNA, 25 bp, Mus musculus
tgggcattctggtccgtaaccctcg

SEQ ID NO: 821438 - DNA, 25 bp, Mus musculus
tgggcattgactacagtttggtggc

SEQ ID NO: 821439 - DNA, 25 bp, Mus musculus
tgggcattgacttcagtttggtggc

SEQ ID NO: 821440 - DNA, 25 bp, Mus musculus
tgggcatttatgagcagcaggagac

SEQ ID NO: 821441 - DNA, 25 bp, Mus musculus
tgggcatttatgtgcagcaggagac

SEQ ID NO: 821442 - DNA, 25 bp, Mus musculus
tgggccaaagatatcattttcctgg

SEQ ID NO: 821443 - DNA, 25 bp, Mus musculus
tgggccaaagatttcattttcctgg

SEQ ID NO: 821444 - DNA, 25 bp, Mus musculus
tgggccaacacgagtctttatgtca

SEQ ID NO: 821445 - DNA, 25 bp, Mus musculus
tgggccaacacgtgtctttatgtca

SEQ ID NO: 821446 - DNA, 25 bp, Mus musculus
tgggccaacattaagctactcagca

SEQ ID NO: 821447 - DNA, 25 bp, Mus musculus
tgggccaacatttagctactcagca

SEQ ID NO: 821448 - DNA, 25 bp, Mus musculus
tgggccaactctcggtcccaagagg

SEQ ID NO: 821449 - DNA, 25 bp, Mus musculus
tgggccaactctgggtcccaagagg

SEQ ID NO: 821450 - DNA, 25 bp, Mus musculus
tgggccaaggccaggattacttcta

SEQ ID NO: 821451 - DNA, 25 bp, Mus musculus
tgggccaaggcctggattacttcta

SEQ ID NO: 821452 - DNA, 25 bp, Mus musculus
tgggccacaacaacatcgtgcgctg

SEQ ID NO: 821453 - DNA, 25 bp, Mus musculus
tgggccacaacatcatcgtgcgctg

SEQ ID NO: 821454 - DNA, 25 bp, Mus musculus
tgggccacactgactctgccctgaa

SEQ ID NO: 821455 - DNA, 25 bp, Mus musculus
tgggccacactgtctctgccctgaa

SEQ ID NO: 821456 - DNA, 25 bp, Mus musculus
tgggccacagtcagggtttggacca

SEQ ID NO: 821457 - DNA, 25 bp, Mus musculus
tgggccacagtctgggtttggacca

SEQ ID NO: 821458 - DNA, 25 bp, Mus musculus
tgggccaccctgagggtcacattcc

SEQ ID NO: 821459 - DNA, 25 bp, Mus musculus
tgggccaccctgtgggtcacattcc

SEQ ID NO: 821460 - DNA, 25 bp, Mus musculus
tgggccacctgtccgtgtgtcacca

SEQ ID NO: 821461 - DNA, 25 bp, Mus musculus
tgggccacctgtgcgtgtgtcacca

SEQ ID NO: 821462 - DNA, 25 bp, Mus musculus
tgggccacgcgacatagcttagcta

SEQ ID NO: 821463 - DNA, 25 bp, Mus musculus
tgggccacgcgagatagcttagcta

SEQ ID NO: 821464 - DNA, 25 bp, Mus musculus
tgggccacgtgacagcacgaaatct

SEQ ID NO: 821465 - DNA, 25 bp, Mus musculus
tgggccacgtgagagcacgaaatct

SEQ ID NO: 821466 - DNA, 25 bp, Mus musculus
tgggccactgctattccctgggaag

SEQ ID NO: 821467 - DNA, 25 bp, Mus musculus
tgggccactgcttttccctgggaag

SEQ ID NO: 821468 - DNA, 25 bp, Mus musculus
tgggccacttaccttgcaagtacag

SEQ ID NO: 821469 - DNA, 25 bp, Mus musculus
tgggccacttacgttgcaagtacag

SEQ ID NO: 821470 - DNA, 25 bp, Mus musculus
tgggccagagctaccgggagcaact

SEQ ID NO: 821471 - DNA, 25 bp, Mus musculus
tgggccagagcttccgggagcaact

SEQ ID NO: 821472 - DNA, 25 bp, Mus musculus
tgggccagcaagatccaaaaccagc

SEQ ID NO: 821473 - DNA, 25 bp, Mus musculus
tgggccagcaagttccaaaaccagc

SEQ ID NO: 821474 - DNA, 25 bp, Mus musculus
tgggccagctgaaccaggctgtgca

SEQ ID NO: 821475 - DNA, 25 bp, Mus musculus
tgggccagctgatccaggctgtgca

SEQ ID NO: 821476 - DNA, 25 bp, Mus musculus
tgggccaggactatcgtgagagatt

SEQ ID NO: 821477 - DNA, 25 bp, Mus musculus
tgggccaggactttcgtgagagatt

SEQ ID NO: 821478 - DNA, 25 bp, Mus musculus
tgggccaggatcacccatacacaga

SEQ ID NO: 821479 - DNA, 25 bp, Mus musculus
tgggccaggatctcccatacacaga

SEQ ID NO: 821480 - DNA, 25 bp, Mus musculus
tgggccaggctccatgccgtcaaga

SEQ ID NO: 821481 - DNA, 25 bp, Mus musculus
tgggccaggctcgatgccgtcaaga

SEQ ID NO: 821482 - DNA, 25 bp, Mus musculus
tgggccagtttcagcttttcaggac

SEQ ID NO: 821483 - DNA, 25 bp, Mus musculus
tgggccagtttctgcttttcaggac

SEQ ID NO: 821484 - DNA, 25 bp, Mus musculus
tgggccatcaaacaaggactggcga

SEQ ID NO: 821485 - DNA, 25 bp, Mus musculus
tgggccatcaaagaaggactggcga

SEQ ID NO: 821486 - DNA, 25 bp, Mus musculus
tgggccatcccaaggagcgatgctt

SEQ ID NO: 821487 - DNA, 25 bp, Mus musculus
tgggccatcccatggagcgatgctt

SEQ ID NO: 821488 - DNA, 25 bp, Mus musculus
tgggccatgcagagttggccatcaa

SEQ ID NO: 821489 - DNA, 25 bp, Mus musculus
tgggccatgcagtgttggccatcaa

SEQ ID NO: 821490 - DNA, 25 bp, Mus musculus
tgggccatgctgaatggagtctcga

SEQ ID NO: 821491 - DNA, 25 bp, Mus musculus
tgggccatgctgtatggagtctcga

SEQ ID NO: 821492 - DNA, 25 bp, Mus musculus
tgggccatgtggacaaagccctggc

SEQ ID NO: 821493 - DNA, 25 bp, Mus musculus
tgggccatgtggtcaaagccctggc

SEQ ID NO: 821494 - DNA, 25 bp, Mus musculus
tgggcccaacacctatacctgcgtg

SEQ ID NO: 821495 - DNA, 25 bp, Mus musculus
tgggcccaacacgtatacctgcgtg

SEQ ID NO: 821496 - DNA, 25 bp, Mus musculus
tgggcccaaggcaccttcaaattac

SEQ ID NO: 821497 - DNA, 25 bp, Mus musculus
tgggcccaaggctccttcaaattac

SEQ ID NO: 821498 - DNA, 25 bp, Mus musculus
tgggcccacacgctttctgtcgtag

SEQ ID NO: 821499 - DNA, 25 bp, Mus musculus
tgggcccacacggtttctgtcgtag

SEQ ID NO: 821500 - DNA, 25 bp, Mus musculus
tgggcccacagtcttctcgcaatgt

SEQ ID NO: 821501 - DNA, 25 bp, Mus musculus
tgggcccacagtgttctcgcaatgt

SEQ ID NO: 821502 - DNA, 25 bp, Mus musculus
tgggcccactgcaaccatagctgga

SEQ ID NO: 821503 - DNA, 25 bp, Mus musculus
tgggcccactgctaccatagctgga

SEQ ID NO: 821504 - DNA, 25 bp, Mus musculus
tgggcccagaagcttccctcatcat

SEQ ID NO: 821505 - DNA, 25 bp, Mus musculus
tgggcccagaaggttccctcatcat

SEQ ID NO: 821506 - DNA, 25 bp, Mus musculus
tgggcccagcccaggcaaccgggaa

SEQ ID NO: 821507 - DNA, 25 bp, Mus musculus
tgggcccagccctggcaaccgggaa

SEQ ID NO: 821508 - DNA, 25 bp, Mus musculus
tgggccccaaagcaccaatgatgga

SEQ ID NO: 821509 - DNA, 25 bp, Mus musculus
tgggccccaaaggaccaatgatgga

SEQ ID NO: 821510 - DNA, 25 bp, Mus musculus
tgggccccacggatggccctacagg

SEQ ID NO: 821511 - DNA, 25 bp, Mus musculus
tgggccccacggttggccctacagg

SEQ ID NO: 821512 - DNA, 25 bp, Mus musculus
tgggccccactcctgacggagaata

SEQ ID NO: 821513 - DNA, 25 bp, Mus musculus
tgggccccactcgtgacggagaata

SEQ ID NO: 821514 - DNA, 25 bp, Mus musculus
tgggccccgcccagaaggacgcagt

SEQ ID NO: 821515 - DNA, 25 bp, Mus musculus
tgggccccgccctgaaggacgcagt

SEQ ID NO: 821516 - DNA, 25 bp, Mus musculus
tgggccccggaactttcttcagctt

SEQ ID NO: 821517 - DNA, 25 bp, Mus musculus
tgggccccggaagtttcttcagctt

SEQ ID NO: 821518 - DNA, 25 bp, Mus musculus
tgggcccctcagcaccatcagagga

SEQ ID NO: 821519 - DNA, 25 bp, Mus musculus
tgggcccctcaggaccatcagagga

SEQ ID NO: 821520 - DNA, 25 bp, Mus musculus
tgggcccctgaacgatccactgctt

SEQ ID NO: 821521 - DNA, 25 bp, Mus musculus
tgggcccctgaaggatccactgctt

SEQ ID NO: 821522 - DNA, 25 bp, Mus musculus
tgggcccctgcaccgttaagcagga

SEQ ID NO: 821523 - DNA, 25 bp, Mus musculus
tgggcccctgcagcgttaagcagga

SEQ ID NO: 821524 - DNA, 25 bp, Mus musculus
tgggcccctgctacgacaaggtcct

SEQ ID NO: 821525 - DNA, 25 bp, Mus musculus
tgggcccctgcttcgacaaggtcct

SEQ ID NO: 821526 - DNA, 25 bp, Mus musculus
tgggcccctttcaacagaggaggtg

SEQ ID NO: 821527 - DNA, 25 bp, Mus musculus
tgggcccctttctacagaggaggtg

SEQ ID NO: 821528 - DNA, 25 bp, Mus musculus
tgggcccggatgagcacccggacac

SEQ ID NO: 821529 - DNA, 25 bp, Mus musculus
tgggcccggatgtgcacccggacac

SEQ ID NO: 821530 - DNA, 25 bp, Mus musculus
tgggccctagaacttcccgaagcga

SEQ ID NO: 821531 - DNA, 25 bp, Mus musculus
tgggccctagaagttcccgaagcga

SEQ ID NO: 821532 - DNA, 25 bp, Mus musculus
tgggccctatgacagccgtgatgac

SEQ ID NO: 821533 - DNA, 25 bp, Mus musculus
tgggccctatgagagccgtgatgac

SEQ ID NO: 821534 - DNA, 25 bp, Mus musculus
tgggccctcaacatggaaatctgtg

SEQ ID NO: 821535 - DNA, 25 bp, Mus musculus
tgggccctcaacttggaaatctgtg

SEQ ID NO: 821536 - DNA, 25 bp, Mus musculus
tgggccctcagaagaccggattgta

SEQ ID NO: 821537 - DNA, 25 bp, Mus musculus
tgggccctcagatgaccggattgta

SEQ ID NO: 821538 - DNA, 25 bp, Mus musculus
tgggccctcgaacaattgagagtct

SEQ ID NO: 821539 - DNA, 25 bp, Mus musculus
tgggccctcgaagaattgagagtct

SEQ ID NO: 821540 - DNA, 25 bp, Mus musculus
tgggccctcgttccagtgcctgtgc

SEQ ID NO: 821541 - DNA, 25 bp, Mus musculus
tgggccctcgttgcagtgcctgtgc

SEQ ID NO: 821542 - DNA, 25 bp, Mus musculus
tgggccctggctccattaacctaaa

SEQ ID NO: 821543 - DNA, 25 bp, Mus musculus
tgggccctggctgcattaacctaaa

SEQ ID NO: 821544 - DNA, 25 bp, Mus musculus
tgggccctggtgctataccttggac

SEQ ID NO: 821545 - DNA, 25 bp, Mus musculus
tgggccctggtggtataccttggac

SEQ ID NO: 821546 - DNA, 25 bp, Mus musculus
tgggccctgtgcagaacttattcgg

SEQ ID NO: 821547 - DNA, 25 bp, Mus musculus
tgggccctgtgctgaacttattcgg

SEQ ID NO: 821548 - DNA, 25 bp, Mus musculus
tgggcccttcgtcagaaaatgggac

SEQ ID NO: 821549 - DNA, 25 bp, Mus musculus
tgggcccttcgtgagaaaatgggac

SEQ ID NO: 821550 - DNA, 25 bp, Mus musculus
tgggccgaatacaaatgcgaacaag

SEQ ID NO: 821551 - DNA, 25 bp, Mus musculus
tgggccgaatactaatgcgaacaag

SEQ ID NO: 821552 - DNA, 25 bp, Mus musculus
tgggccgactcacaaacgccaaaat

SEQ ID NO: 821553 - DNA, 25 bp, Mus musculus
tgggccgactcagaaacgccaaaat

SEQ ID NO: 821554 - DNA, 25 bp, Mus musculus
tgggccgagaaccacactaaggagc

SEQ ID NO: 821555 - DNA, 25 bp, Mus musculus
tgggccgagaacgacactaaggagc

SEQ ID NO: 821556 - DNA, 25 bp, Mus musculus
tgggccgagctcatctcagctgcca

SEQ ID NO: 821557 - DNA, 25 bp, Mus musculus
tgggccgagctcttctcagctgcca

SEQ ID NO: 821558 - DNA, 25 bp, Mus musculus
tgggccgagtggacatcgaattcac

SEQ ID NO: 821559 - DNA, 25 bp, Mus musculus
tgggccgagtggtcatcgaattcac

SEQ ID NO: 821560 - DNA, 25 bp, Mus musculus
tgggccgccaggccagtcccaagat

SEQ ID NO: 821561 - DNA, 25 bp, Mus musculus
tgggccgccagggcagtcccaagat

SEQ ID NO: 821562 - DNA, 25 bp, Mus musculus
tgggccgcccagagcaccaagttgg

SEQ ID NO: 821563 - DNA, 25 bp, Mus musculus
tgggccgcccagtgcaccaagttgg

SEQ ID NO: 821564 - DNA, 25 bp, Mus musculus
tgggccgccctcaggattgccctgt

SEQ ID NO: 821565 - DNA, 25 bp, Mus musculus
tgggccgccctctggattgccctgt

SEQ ID NO: 821566 - DNA, 25 bp, Mus musculus
tgggccgccgtcctacttacgtgga

SEQ ID NO: 821567 - DNA, 25 bp, Mus musculus
tgggccgccgtcgtacttacgtgga

SEQ ID NO: 821568 - DNA, 25 bp, Mus musculus
tgggccgctacaaagagatgctgaa

SEQ ID NO: 821569 - DNA, 25 bp, Mus musculus
tgggccgctacatagagatgctgaa

SEQ ID NO: 821570 - DNA, 25 bp, Mus musculus
tgggccgcttctacagctcggagac

SEQ ID NO: 821571 - DNA, 25 bp, Mus musculus
tgggccgcttcttcagctcggagac

SEQ ID NO: 821572 - DNA, 25 bp, Mus musculus
tgggccggcaccctcatagcatcag

SEQ ID NO: 821573 - DNA, 25 bp, Mus musculus
tgggccggcaccgtcatagcatcag

SEQ ID NO: 821574 - DNA, 25 bp, Mus musculus
tgggccggcgcaacactcagggctt

SEQ ID NO: 821575 - DNA, 25 bp, Mus musculus
tgggccggcgcatcactcagggctt

SEQ ID NO: 821576 - DNA, 25 bp, Mus musculus
tgggccgggactataccatctttcg

SEQ ID NO: 821577 - DNA, 25 bp, Mus musculus
tgggccgggactttaccatctttcg

SEQ ID NO: 821578 - DNA, 25 bp, Mus musculus
tgggccggtggtctacatcatgcca

SEQ ID NO: 821579 - DNA, 25 bp, Mus musculus
tgggccggtggtgtacatcatgcca

SEQ ID NO: 821580 - DNA, 25 bp, Mus musculus
tgggccggttttctgcacccctgga

SEQ ID NO: 821581 - DNA, 25 bp, Mus musculus
tgggccggttttgtgcacccctgga

SEQ ID NO: 821582 - DNA, 25 bp, Mus musculus
tgggccgtgctgatggtcacattgc

SEQ ID NO: 821583 - DNA, 25 bp, Mus musculus
tgggccgtgctgttggtcacattgc

SEQ ID NO: 821584 - DNA, 25 bp, Mus musculus
tgggcctaagccaccgggctcagtt

SEQ ID NO: 821585 - DNA, 25 bp, Mus musculus
tgggcctaagcctccgggctcagtt

SEQ ID NO: 821586 - DNA, 25 bp, Mus musculus
tgggcctaatggaacccctaagtgg

SEQ ID NO: 821587 - DNA, 25 bp, Mus musculus
tgggcctaatggtacccctaagtgg

SEQ ID NO: 821588 - DNA, 25 bp, Mus musculus
tgggcctagacacccaatggaggct

SEQ ID NO: 821589 - DNA, 25 bp, Mus musculus
tgggcctagacagccaatggaggct

SEQ ID NO: 821590 - DNA, 25 bp, Mus musculus
tgggcctagaggctgatctgtccct

SEQ ID NO: 821591 - DNA, 25 bp, Mus musculus
tgggcctagagggtgatctgtccct

SEQ ID NO: 821592 - DNA, 25 bp, Mus musculus
tgggcctatacaagagagaaacctc

SEQ ID NO: 821593 - DNA, 25 bp, Mus musculus
tgggcctatacatgagagaaacctc

SEQ ID NO: 821594 - DNA, 25 bp, Mus musculus
tgggcctatgagcttggcagcttcc

SEQ ID NO: 821595 - DNA, 25 bp, Mus musculus
tgggcctatgaggttggcagcttcc

SEQ ID NO: 821596 - DNA, 25 bp, Mus musculus
tgggcctatgtcatgcttcatctct

SEQ ID NO: 821597 - DNA, 25 bp, Mus musculus
tgggcctatgtcttgcttcatctct

SEQ ID NO: 821598 - DNA, 25 bp, Mus musculus
tgggcctcaccaccaagaagtcagg

SEQ ID NO: 821599 - DNA, 25 bp, Mus musculus
tgggcctcaccagcaagaagtcagg

SEQ ID NO: 821600 - DNA, 25 bp, Mus musculus
tgggcctcacgcagggtctctggct

SEQ ID NO: 821601 - DNA, 25 bp, Mus musculus
tgggcctcacgctgggtctctggct

SEQ ID NO: 821602 - DNA, 25 bp, Mus musculus
tgggcctcagccattggagaaattg

SEQ ID NO: 821603 - DNA, 25 bp, Mus musculus
tgggcctcagcctttggagaaattg

SEQ ID NO: 821604 - DNA, 25 bp, Mus musculus
tgggcctcaggaaacaccaaactca

SEQ ID NO: 821605 - DNA, 25 bp, Mus musculus
tgggcctcaggatacaccaaactca

SEQ ID NO: 821606 - DNA, 25 bp, Mus musculus
tgggcctcatctcttttgtcttaat

SEQ ID NO: 821607 - DNA, 25 bp, Mus musculus
tgggcctcatctgttttgtcttaat

SEQ ID NO: 821608 - DNA, 25 bp, Mus musculus
tgggcctcatgcagtaccacaggag

SEQ ID NO: 821609 - DNA, 25 bp, Mus musculus
tgggcctcatgctgtaccacaggag

SEQ ID NO: 821610 - DNA, 25 bp, Mus musculus
tgggcctcatgtatatctactggac

SEQ ID NO: 821611 - DNA, 25 bp, Mus musculus
tgggcctcatgtttatctactggac

SEQ ID NO: 821612 - DNA, 25 bp, Mus musculus
tgggcctcctagataggcagaagga

SEQ ID NO: 821613 - DNA, 25 bp, Mus musculus
tgggcctcctagttaggcagaagga

SEQ ID NO: 821614 - DNA, 25 bp, Mus musculus
tgggcctcgtcgacttctggaacaa

SEQ ID NO: 821615 - DNA, 25 bp, Mus musculus
tgggcctcgtcgtcttctggaacaa

SEQ ID NO: 821616 - DNA, 25 bp, Mus musculus
tgggcctgaagaccatgatcaagga

SEQ ID NO: 821617 - DNA, 25 bp, Mus musculus
tgggcctgaagagcatgatcaagga

SEQ ID NO: 821618 - DNA, 25 bp, Mus musculus
tgggcctgacagagcaaagggtaac

SEQ ID NO: 821619 - DNA, 25 bp, Mus musculus
tgggcctgacagtgcaaagggtaac

SEQ ID NO: 821620 - DNA, 25 bp, Mus musculus
tgggcctgaggaagtgatcaacttc

SEQ ID NO: 821621 - DNA, 25 bp, Mus musculus
tgggcctgaggatgtgatcaacttc

SEQ ID NO: 821622 - DNA, 25 bp, Mus musculus
tgggcctgcatcctgcccacggagt

SEQ ID NO: 821623 - DNA, 25 bp, Mus musculus
tgggcctgcatcgtgcccacggagt

SEQ ID NO: 821624 - DNA, 25 bp, Mus musculus
tgggcctgccacctatcagtacttt

SEQ ID NO: 821625 - DNA, 25 bp, Mus musculus
tgggcctgccacgtatcagtacttt

SEQ ID NO: 821626 - DNA, 25 bp, Mus musculus
tgggcctgcgccaggcgtcctcttt

SEQ ID NO: 821627 - DNA, 25 bp, Mus musculus
tgggcctgcgcctggcgtcctcttt

SEQ ID NO: 821628 - DNA, 25 bp, Mus musculus
tgggcctgcgctatcaggagctgtc

SEQ ID NO: 821629 - DNA, 25 bp, Mus musculus
tgggcctgcgctttcaggagctgtc

SEQ ID NO: 821630 - DNA, 25 bp, Mus musculus
tgggcctgctacaaggcaagggcat

SEQ ID NO: 821631 - DNA, 25 bp, Mus musculus
tgggcctgctactaggcaagggcat

SEQ ID NO: 821632 - DNA, 25 bp, Mus musculus
tgggcctgctccagcaactctgtgg

SEQ ID NO: 821633 - DNA, 25 bp, Mus musculus
tgggcctgctcctgcaactctgtgg

SEQ ID NO: 821634 - DNA, 25 bp, Mus musculus
tgggcctggataaccaatggcggca

SEQ ID NO: 821635 - DNA, 25 bp, Mus musculus
tgggcctggatatccaatggcggca

SEQ ID NO: 821636 - DNA, 25 bp, Mus musculus
tgggcctgggcaactgctatgatat

SEQ ID NO: 821637 - DNA, 25 bp, Mus musculus
tgggcctgggcatctgctatgatat

SEQ ID NO: 821638 - DNA, 25 bp, Mus musculus
tgggcctgggtcatccccttcttga

SEQ ID NO: 821639 - DNA, 25 bp, Mus musculus
tgggcctgggtcttccccttcttga

SEQ ID NO: 821640 - DNA, 25 bp, Mus musculus
tgggcctgtggcatcgaagtttttt

SEQ ID NO: 821641 - DNA, 25 bp, Mus musculus
tgggcctgtggcttcgaagtttttt

SEQ ID NO: 821642 - DNA, 25 bp, Mus musculus
tgggccttagcaccttcgatttcct

SEQ ID NO: 821643 - DNA, 25 bp, Mus musculus
tgggccttagcagcttcgatttcct

SEQ ID NO: 821644 - DNA, 25 bp, Mus musculus
tgggccttcttcaggttcgtgggtt

SEQ ID NO: 821645 - DNA, 25 bp, Mus musculus
tgggccttcttcatgtagctggtgc

SEQ ID NO: 821646 - DNA, 25 bp, Mus musculus
tgggccttcttctggttcgtgggtt

SEQ ID NO: 821647 - DNA, 25 bp, Mus musculus
tgggccttcttcttgtagctggtgc

SEQ ID NO: 821648 - DNA, 25 bp, Mus musculus
tgggccttgcctaaaggttcagagc

SEQ ID NO: 821649 - DNA, 25 bp, Mus musculus
tgggccttgccttaaggttcagagc

SEQ ID NO: 821650 - DNA, 25 bp, Mus musculus
tgggccttgcggctcgctgtctcat

SEQ ID NO: 821651 - DNA, 25 bp, Mus musculus
tgggccttgcgggtcgctgtctcat

SEQ ID NO: 821652 - DNA, 25 bp, Mus musculus
tgggccttgctgctggccgtattat

SEQ ID NO: 821653 - DNA, 25 bp, Mus musculus
tgggccttgctggtggccgtattat

SEQ ID NO: 821654 - DNA, 25 bp, Mus musculus
tgggcgaagctcaaggccaacattc

SEQ ID NO: 821655 - DNA, 25 bp, Mus musculus
tgggcgaagctctaggccaacattc

SEQ ID NO: 821656 - DNA, 25 bp, Mus musculus
tgggcgaatccccatccgcctggag

SEQ ID NO: 821657 - DNA, 25 bp, Mus musculus
tgggcgaatcccgatccgcctggag

SEQ ID NO: 821658 - DNA, 25 bp, Mus musculus
tgggcgacaccaacgaacgagccat

SEQ ID NO: 821659 - DNA, 25 bp, Mus musculus
tgggcgacaccatcgaacgagccat

SEQ ID NO: 821660 - DNA, 25 bp, Mus musculus
tgggcgacatagattacagagaatc

SEQ ID NO: 821661 - DNA, 25 bp, Mus musculus
tgggcgacatagtttacagagaatc

SEQ ID NO: 821662 - DNA, 25 bp, Mus musculus
tgggcgactgcgactcggtcattcc

SEQ ID NO: 821663 - DNA, 25 bp, Mus musculus
tgggcgactgcgtctcggtcattcc

SEQ ID NO: 821664 - DNA, 25 bp, Mus musculus
tgggcgagatgtagcttatgctttt

SEQ ID NO: 821665 - DNA, 25 bp, Mus musculus
tgggcgagatgttgcttatgctttt

SEQ ID NO: 821666 - DNA, 25 bp, Mus musculus
tgggcgagcttccaccgcacatctt

SEQ ID NO: 821667 - DNA, 25 bp, Mus musculus
tgggcgagcttcgaccgcacatctt

SEQ ID NO: 821668 - DNA, 25 bp, Mus musculus
tgggcgaggacaacattggtcttaa

SEQ ID NO: 821669 - DNA, 25 bp, Mus musculus
tgggcgaggacatcattggtcttaa

SEQ ID NO: 821670 - DNA, 25 bp, Mus musculus
tgggcgatgctgaccttgagagaca

SEQ ID NO: 821671 - DNA, 25 bp, Mus musculus
tgggcgatgctgtccttgagagaca

SEQ ID NO: 821672 - DNA, 25 bp, Mus musculus
tgggcgcaaaccagtgactgtggcc

SEQ ID NO: 821673 - DNA, 25 bp, Mus musculus
tgggcgcaaacctgtgactgtggcc

SEQ ID NO: 821674 - DNA, 25 bp, Mus musculus
tgggcgcaggaaacattgaccaggc

SEQ ID NO: 821675 - DNA, 25 bp, Mus musculus
tgggcgcaggaatcattgaccaggc

SEQ ID NO: 821676 - DNA, 25 bp, Mus musculus
tgggcgcagggactttccctctcag

SEQ ID NO: 821677 - DNA, 25 bp, Mus musculus
tgggcgcagggagtttccctctcag

SEQ ID NO: 821678 - DNA, 25 bp, Mus musculus
tgggcgccataaaccgttgcctgaa

SEQ ID NO: 821679 - DNA, 25 bp, Mus musculus
tgggcgccataatccgttgcctgaa

SEQ ID NO: 821680 - DNA, 25 bp, Mus musculus
tgggcgcccaaactgcccactggat

SEQ ID NO: 821681 - DNA, 25 bp, Mus musculus
tgggcgcccaaagtgcccactggat

SEQ ID NO: 821682 - DNA, 25 bp, Mus musculus
tgggcgccgatgaggacttcctgct

SEQ ID NO: 821683 - DNA, 25 bp, Mus musculus
tgggcgccgatgtggacttcctgct

SEQ ID NO: 821684 - DNA, 25 bp, Mus musculus
tgggcgccgcgaaccaccatcaagt

SEQ ID NO: 821685 - DNA, 25 bp, Mus musculus
tgggcgccgcgatccaccatcaagt

SEQ ID NO: 821686 - DNA, 25 bp, Mus musculus
tgggcgccgcgtacttcctgtccag

SEQ ID NO: 821687 - DNA, 25 bp, Mus musculus
tgggcgccgcgttcttcctgtccag

SEQ ID NO: 821688 - DNA, 25 bp, Mus musculus
tgggcgcctacgagcttgtctacta

SEQ ID NO: 821689 - DNA, 25 bp, Mus musculus
tgggcgcctacgtgcttgtctacta

SEQ ID NO: 821690 - DNA, 25 bp, Mus musculus
tgggcgcctcgcatctagcttagct

SEQ ID NO: 821691 - DNA, 25 bp, Mus musculus
tgggcgcctcgcttctagcttagct

SEQ ID NO: 821692 - DNA, 25 bp, Mus musculus
tgggcgccttagacctggccaagaa

SEQ ID NO: 821693 - DNA, 25 bp, Mus musculus
tgggcgccttagtcctggccaagaa

SEQ ID NO: 821694 - DNA, 25 bp, Mus musculus
tgggcgcgagcaccattgcctacct

SEQ ID NO: 821695 - DNA, 25 bp, Mus musculus
tgggcgcgagcagcattgcctacct

SEQ ID NO: 821696 - DNA, 25 bp, Mus musculus
tgggcgcgctggaagtgttccctct

SEQ ID NO: 821697 - DNA, 25 bp, Mus musculus
tgggcgcgctggtagtgttccctct

SEQ ID NO: 821698 - DNA, 25 bp, Mus musculus
tgggcgctccgcacactgttgcgtc

SEQ ID NO: 821699 - DNA, 25 bp, Mus musculus
tgggcgctccgctcactgttgcgtc

SEQ ID NO: 821700 - DNA, 25 bp, Mus musculus
tgggcgctggcaaccgcgagatcac

SEQ ID NO: 821701 - DNA, 25 bp, Mus musculus
tgggcgctggcatccgcgagatcac

SEQ ID NO: 821702 - DNA, 25 bp, Mus musculus
tgggcgcttataagcctcggagaac

SEQ ID NO: 821703 - DNA, 25 bp, Mus musculus
tgggcgcttatatgcctcggagaac

SEQ ID NO: 821704 - DNA, 25 bp, Mus musculus
tgggcggaagaaccattttggcaaa

SEQ ID NO: 821705 - DNA, 25 bp, Mus musculus
tgggcggaagaagcattttggcaaa

SEQ ID NO: 821706 - DNA, 25 bp, Mus musculus
tgggcggaattaatgaaatgaagct

SEQ ID NO: 821707 - DNA, 25 bp, Mus musculus
tgggcggaattattgaaatgaagct

SEQ ID NO: 821708 - DNA, 25 bp, Mus musculus
tgggcggagttaagatacctacacc

SEQ ID NO: 821709 - DNA, 25 bp, Mus musculus
tgggcggagttatgatacctacacc

SEQ ID NO: 821710 - DNA, 25 bp, Mus musculus
tgggcggcatggcaaatgcaaacat

SEQ ID NO: 821711 - DNA, 25 bp, Mus musculus
tgggcggcatgggaaatgcaaacat

SEQ ID NO: 821712 - DNA, 25 bp, Mus musculus
tgggcggcgaccaccctaggcctag

SEQ ID NO: 821713 - DNA, 25 bp, Mus musculus
tgggcggcgacctccctaggcctag

SEQ ID NO: 821714 - DNA, 25 bp, Mus musculus
tgggcggcggcgcttgactttcggg

SEQ ID NO: 821715 - DNA, 25 bp, Mus musculus
tgggcggcggcggttgactttcggg

SEQ ID NO: 821716 - DNA, 25 bp, Mus musculus
tgggcggctcttagtcgaagctaga

SEQ ID NO: 821717 - DNA, 25 bp, Mus musculus
tgggcggctctttgtcgaagctaga

SEQ ID NO: 821718 - DNA, 25 bp, Mus musculus
tgggcggcttacagcgaccacgctg

SEQ ID NO: 821719 - DNA, 25 bp, Mus musculus
tgggcggcttactgcgaccacgctg

SEQ ID NO: 821720 - DNA, 25 bp, Mus musculus
tgggcgggaccactaggaaaacaca

SEQ ID NO: 821721 - DNA, 25 bp, Mus musculus
tgggcgggaccagtaggaaaacaca

SEQ ID NO: 821722 - DNA, 25 bp, Mus musculus
tgggcggtatccatcgactggcatc

SEQ ID NO: 821723 - DNA, 25 bp, Mus musculus
tgggcggtatccttcgactggcatc

SEQ ID NO: 821724 - DNA, 25 bp, Mus musculus
tgggcgtaggtgacatgatctcaca

SEQ ID NO: 821725 - DNA, 25 bp, Mus musculus
tgggcgtaggtgtcatgatctcaca

SEQ ID NO: 821726 - DNA, 25 bp, Mus musculus
tgggcgtatggtcaaaaggttcaca

SEQ ID NO: 821727 - DNA, 25 bp, Mus musculus
tgggcgtatggtgaaaaggttcaca

SEQ ID NO: 821728 - DNA, 25 bp, Mus musculus
tgggcgtcagctacaccttttttgg

SEQ ID NO: 821729 - DNA, 25 bp, Mus musculus
tgggcgtcagcttcaccttttttgg

SEQ ID NO: 821730 - DNA, 25 bp, Mus musculus
tgggcgtctccacagtaaccgctgc

SEQ ID NO: 821731 - DNA, 25 bp, Mus musculus
tgggcgtctccagagtaaccgctgc

SEQ ID NO: 821732 - DNA, 25 bp, Mus musculus
tgggcgtctcctcatggtggattta

SEQ ID NO: 821733 - DNA, 25 bp, Mus musculus
tgggcgtctcctgatggtggattta

SEQ ID NO: 821734 - DNA, 25 bp, Mus musculus
tgggcgtcttgaagagcagaaatct

SEQ ID NO: 821735 - DNA, 25 bp, Mus musculus
tgggcgtcttgatgagcagaaatct

SEQ ID NO: 821736 - DNA, 25 bp, Mus musculus
tgggcgtgaccgcttggatctcacc

SEQ ID NO: 821737 - DNA, 25 bp, Mus musculus
tgggcgtgaccggttggatctcacc

SEQ ID NO: 821738 - DNA, 25 bp, Mus musculus
tgggcgtgccgcagctaattacaaa

SEQ ID NO: 821739 - DNA, 25 bp, Mus musculus
tgggcgtgccgctgctaattacaaa

SEQ ID NO: 821740 - DNA, 25 bp, Mus musculus
tgggcgtgcgtcaggattacatctc

SEQ ID NO: 821741 - DNA, 25 bp, Mus musculus
tgggcgtgcgtctggattacatctc

SEQ ID NO: 821742 - DNA, 25 bp, Mus musculus
tgggcgtggcagagctcaaccgctt

SEQ ID NO: 821743 - DNA, 25 bp, Mus musculus
tgggcgtggcagtgctcaaccgctt

SEQ ID NO: 821744 - DNA, 25 bp, Mus musculus
tgggcgtgtcacctgtgcctagtcc

SEQ ID NO: 821745 - DNA, 25 bp, Mus musculus
tgggcgtgtcacgtgtgcctagtcc

SEQ ID NO: 821746 - DNA, 25 bp, Mus musculus
tgggctaaacagcacaatcggtcca

SEQ ID NO: 821747 - DNA, 25 bp, Mus musculus
tgggctaaacaggacaatcggtcca

SEQ ID NO: 821748 - DNA, 25 bp, Mus musculus
tgggctaacaatataaaggtctcct

SEQ ID NO: 821749 - DNA, 25 bp, Mus musculus
tgggctaacaatttaaaggtctcct

SEQ ID NO: 821750 - DNA, 25 bp, Mus musculus
tgggctaactaccacctagaaaacg

SEQ ID NO: 821751 - DNA, 25 bp, Mus musculus
tgggctaactacgacctagaaaacg

SEQ ID NO: 821752 - DNA, 25 bp, Mus musculus
tgggctacacaacaaaatgctgctc

SEQ ID NO: 821753 - DNA, 25 bp, Mus musculus
tgggctacacaagaaaatgctgctc

SEQ ID NO: 821754 - DNA, 25 bp, Mus musculus
tgggctacacgcagggcgccaacca

SEQ ID NO: 821755 - DNA, 25 bp, Mus musculus
tgggctacacgctgggcgccaacca

SEQ ID NO: 821756 - DNA, 25 bp, Mus musculus
tgggctacagtgagtagtatacgtt

SEQ ID NO: 821757 - DNA, 25 bp, Mus musculus
tgggctacagtgtgtagtatacgtt

SEQ ID NO: 821758 - DNA, 25 bp, Mus musculus
tgggctacatgtatttccgtgaccg

SEQ ID NO: 821759 - DNA, 25 bp, Mus musculus
tgggctacatgtttttccgtgaccg

SEQ ID NO: 821760 - DNA, 25 bp, Mus musculus
tgggctaccacaacgtgtacaagga

SEQ ID NO: 821761 - DNA, 25 bp, Mus musculus
tgggctaccacatcgtgtacaagga

SEQ ID NO: 821762 - DNA, 25 bp, Mus musculus
tgggctaccaccaggtcggtgttga

SEQ ID NO: 821763 - DNA, 25 bp, Mus musculus
tgggctaccacctggtcggtgttga

SEQ ID NO: 821764 - DNA, 25 bp, Mus musculus
tgggctaccagtcggctcctatcct

SEQ ID NO: 821765 - DNA, 25 bp, Mus musculus
tgggctaccagtgggctcctatcct

SEQ ID NO: 821766 - DNA, 25 bp, Mus musculus
tgggctaccggcacttcgattgtgc

SEQ ID NO: 821767 - DNA, 25 bp, Mus musculus
tgggctaccggctcttcgattgtgc

SEQ ID NO: 821768 - DNA, 25 bp, Mus musculus
tgggctaccgtgaggcctaaccgtg

SEQ ID NO: 821769 - DNA, 25 bp, Mus musculus
tgggctaccgtgtggcctaaccgtg

SEQ ID NO: 821770 - DNA, 25 bp, Mus musculus
tgggctacctctcggagctttaagg

SEQ ID NO: 821771 - DNA, 25 bp, Mus musculus
tgggctacctctgggagctttaagg

SEQ ID NO: 821772 - DNA, 25 bp, Mus musculus
tgggctacctgccagtgcagactgt

SEQ ID NO: 821773 - DNA, 25 bp, Mus musculus
tgggctacctgcgagtgcagactgt

SEQ ID NO: 821774 - DNA, 25 bp, Mus musculus
tgggctatgcccagctcagtggcat

SEQ ID NO: 821775 - DNA, 25 bp, Mus musculus
tgggctatgccctgctcagtggcat

SEQ ID NO: 821776 - DNA, 25 bp, Mus musculus
tgggctatgtgtaggccacgctgct

SEQ ID NO: 821777 - DNA, 25 bp, Mus musculus
tgggctatgtgttggccacgctgct

SEQ ID NO: 821778 - DNA, 25 bp, Mus musculus
tgggctcaaggccttgtcactgaag

SEQ ID NO: 821779 - DNA, 25 bp, Mus musculus
tgggctcaaggcgttgtcactgaag

SEQ ID NO: 821780 - DNA, 25 bp, Mus musculus
tgggctcaagtactacaggatgatg

SEQ ID NO: 821781 - DNA, 25 bp, Mus musculus
tgggctcaagtagtacaggatgatg

SEQ ID NO: 821782 - DNA, 25 bp, Mus musculus
tgggctcacccaattggcaggaggt

SEQ ID NO: 821783 - DNA, 25 bp, Mus musculus
tgggctcacccatttggcaggaggt

SEQ ID NO: 821784 - DNA, 25 bp, Mus musculus
tgggctcactcgctctagggaaccg

SEQ ID NO: 821785 - DNA, 25 bp, Mus musculus
tgggctcactcggtctagggaaccg

SEQ ID NO: 821786 - DNA, 25 bp, Mus musculus
tgggctcagacacggctgtcaacgc

SEQ ID NO: 821787 - DNA, 25 bp, Mus musculus
tgggctcagacagggctgtcaacgc

SEQ ID NO: 821788 - DNA, 25 bp, Mus musculus
tgggctcagcacaaggcggccccta

SEQ ID NO: 821789 - DNA, 25 bp, Mus musculus
tgggctcagcactaggcggccccta

SEQ ID NO: 821790 - DNA, 25 bp, Mus musculus
tgggctcagcctaccgagaagagac

SEQ ID NO: 821791 - DNA, 25 bp, Mus musculus
tgggctcagccttccgagaagagac

SEQ ID NO: 821792 - DNA, 25 bp, Mus musculus
tgggctccaacaacggaacctctgt

SEQ ID NO: 821793 - DNA, 25 bp, Mus musculus
tgggctccaacatcggaacctctgt

SEQ ID NO: 821794 - DNA, 25 bp, Mus musculus
tgggctccacgaagagactcaacat

SEQ ID NO: 821795 - DNA, 25 bp, Mus musculus
tgggctccacgatgagactcaacat

SEQ ID NO: 821796 - DNA, 25 bp, Mus musculus
tgggctccagcgagtacccggttcg

SEQ ID NO: 821797 - DNA, 25 bp, Mus musculus
tgggctccagcgtgtacccggttcg

SEQ ID NO: 821798 - DNA, 25 bp, Mus musculus
tgggctccccgaaagggacctgtgc

SEQ ID NO: 821799 - DNA, 25 bp, Mus musculus
tgggctccccgatagggacctgtgc

SEQ ID NO: 821800 - DNA, 25 bp, Mus musculus
tgggctccctgcaagttgaggacga

SEQ ID NO: 821801 - DNA, 25 bp, Mus musculus
tgggctccctgctagttgaggacga

SEQ ID NO: 821802 - DNA, 25 bp, Mus musculus
tgggctcccttactcactatgtgca

SEQ ID NO: 821803 - DNA, 25 bp, Mus musculus
tgggctcccttagtcactatgtgca

SEQ ID NO: 821804 - DNA, 25 bp, Mus musculus
tgggctccgcagacttcccagagct

SEQ ID NO: 821805 - DNA, 25 bp, Mus musculus
tgggctccgcagtcttcccagagct

SEQ ID NO: 821806 - DNA, 25 bp, Mus musculus
tgggctccgcttctgtgctgctcaa

SEQ ID NO: 821807 - DNA, 25 bp, Mus musculus
tgggctccgcttgtgtgctgctcaa

SEQ ID NO: 821808 - DNA, 25 bp, Mus musculus
tgggctccgggcctcgtttcacaca

SEQ ID NO: 821809 - DNA, 25 bp, Mus musculus
tgggctccgggcgtcgtttcacaca

SEQ ID NO: 821810 - DNA, 25 bp, Mus musculus
tgggctccgtaccaagattgcacaa

SEQ ID NO: 821811 - DNA, 25 bp, Mus musculus
tgggctccgtacgaagattgcacaa

SEQ ID NO: 821812 - DNA, 25 bp, Mus musculus
tgggctccttgaacggccagactgg

SEQ ID NO: 821813 - DNA, 25 bp, Mus musculus
tgggctccttgatcggccagactgg

SEQ ID NO: 821814 - DNA, 25 bp, Mus musculus
tgggctcgcccaccgtgcacaaggt

SEQ ID NO: 821815 - DNA, 25 bp, Mus musculus
tgggctcgcccagcgtgcacaaggt

SEQ ID NO: 821816 - DNA, 25 bp, Mus musculus
tgggctcgcctacatcacaagtttg

SEQ ID NO: 821817 - DNA, 25 bp, Mus musculus
tgggctcgcctagatcacaagtttg

SEQ ID NO: 821818 - DNA, 25 bp, Mus musculus
tgggctcgtcgaccacatgaggaca

SEQ ID NO: 821819 - DNA, 25 bp, Mus musculus
tgggctcgtcgagcacatgaggaca

SEQ ID NO: 821820 - DNA, 25 bp, Mus musculus
tgggctcgtgagatcctgcaggtct

SEQ ID NO: 821821 - DNA, 25 bp, Mus musculus
tgggctcgtgagttcctgcaggtct

SEQ ID NO: 821822 - DNA, 25 bp, Mus musculus
tgggctctacagaatattccacctg

SEQ ID NO: 821823 - DNA, 25 bp, Mus musculus
tgggctctacagtatattccacctg

SEQ ID NO: 821824 - DNA, 25 bp, Mus musculus
tgggctctacatcgtcacagagtac

SEQ ID NO: 821825 - DNA, 25 bp, Mus musculus
tgggctctacatggtcacagagtac

SEQ ID NO: 821826 - DNA, 25 bp, Mus musculus
tgggctctagcacctccttggagac

SEQ ID NO: 821827 - DNA, 25 bp, Mus musculus
tgggctctagcagctccttggagac

SEQ ID NO: 821828 - DNA, 25 bp, Mus musculus
tgggctctatttcgtggccacaacc

SEQ ID NO: 821829 - DNA, 25 bp, Mus musculus
tgggctctatttggtggccacaacc

SEQ ID NO: 821830 - DNA, 25 bp, Mus musculus
tgggctctcatcctcagattctgag

SEQ ID NO: 821831 - DNA, 25 bp, Mus musculus
tgggctctcatcgtcagattctgag

SEQ ID NO: 821832 - DNA, 25 bp, Mus musculus
tgggctctctagatgaaaagatgaa

SEQ ID NO: 821833 - DNA, 25 bp, Mus musculus
tgggctctctagttgaaaagatgaa

SEQ ID NO: 821834 - DNA, 25 bp, Mus musculus
tgggctctgagcaggagagtgccat

SEQ ID NO: 821835 - DNA, 25 bp, Mus musculus
tgggctctgagctggagagtgccat

SEQ ID NO: 821836 - DNA, 25 bp, Mus musculus
tgggctctgccactcacgtgcagca

SEQ ID NO: 821837 - DNA, 25 bp, Mus musculus
tgggctctgccagtcacgtgcagca

SEQ ID NO: 821838 - DNA, 25 bp, Mus musculus
tgggctctggcaaccagtatggaga

SEQ ID NO: 821839 - DNA, 25 bp, Mus musculus
tgggctctggcaattctctcttcat

SEQ ID NO: 821840 - DNA, 25 bp, Mus musculus
tgggctctggcatccagtatggaga

SEQ ID NO: 821841 - DNA, 25 bp, Mus musculus
tgggctctggcatttctctcttcat

SEQ ID NO: 821842 - DNA, 25 bp, Mus musculus
tgggctctgtcaacgtggggaactt

SEQ ID NO: 821843 - DNA, 25 bp, Mus musculus
tgggctctgtcatcgtggggaactt

SEQ ID NO: 821844 - DNA, 25 bp, Mus musculus
tgggctctgtggagacctcgtcatg

SEQ ID NO: 821845 - DNA, 25 bp, Mus musculus
tgggctctgtggtgacctcgtcatg

SEQ ID NO: 821846 - DNA, 25 bp, Mus musculus
tgggctcttcccatccaattatgta

SEQ ID NO: 821847 - DNA, 25 bp, Mus musculus
tgggctcttcccttccaattatgta

SEQ ID NO: 821848 - DNA, 25 bp, Mus musculus
tgggctcttcttcaccacgggagac

SEQ ID NO: 821849 - DNA, 25 bp, Mus musculus
tgggctcttcttgaccacgggagac

SEQ ID NO: 821850 - DNA, 25 bp, Mus musculus
tgggctgaaactatggcagaaactg

SEQ ID NO: 821851 - DNA, 25 bp, Mus musculus
tgggctgaaactttggcagaaactg

SEQ ID NO: 821852 - DNA, 25 bp, Mus musculus
tgggctgaccaccaggaacactaaa

SEQ ID NO: 821853 - DNA, 25 bp, Mus musculus
tgggctgaccacgaggaacactaaa

SEQ ID NO: 821854 - DNA, 25 bp, Mus musculus
tgggctgacgcgatccgcagctcac

SEQ ID NO: 821855 - DNA, 25 bp, Mus musculus
tgggctgacgcgttccgcagctcac

SEQ ID NO: 821856 - DNA, 25 bp, Mus musculus
tgggctgactcactggctgaatgac

SEQ ID NO: 821857 - DNA, 25 bp, Mus musculus
tgggctgactcagtggctgaatgac

SEQ ID NO: 821858 - DNA, 25 bp, Mus musculus
tgggctgagcctaaaatctccagac

SEQ ID NO: 821859 - DNA, 25 bp, Mus musculus
tgggctgagccttaaatctccagac

SEQ ID NO: 821860 - DNA, 25 bp, Mus musculus
tgggctgagtggagattatatctca

SEQ ID NO: 821861 - DNA, 25 bp, Mus musculus
tgggctgagtggtgattatatctca

SEQ ID NO: 821862 - DNA, 25 bp, Mus musculus
tgggctgatcgaaccccactccatg

SEQ ID NO: 821863 - DNA, 25 bp, Mus musculus
tgggctgatcgatccccactccatg

SEQ ID NO: 821864 - DNA, 25 bp, Mus musculus
tgggctgattgaagcaggtttagaa

SEQ ID NO: 821865 - DNA, 25 bp, Mus musculus
tgggctgattgatgcaggtttagaa

SEQ ID NO: 821866 - DNA, 25 bp, Mus musculus
tgggctgcagtgacacccttcaaag

SEQ ID NO: 821867 - DNA, 25 bp, Mus musculus
tgggctgcagtgtcacccttcaaag

SEQ ID NO: 821868 - DNA, 25 bp, Mus musculus
tgggctgcatctcaaaagccatggg

SEQ ID NO: 821869 - DNA, 25 bp, Mus musculus
tgggctgcatctgaaaagccatggg

SEQ ID NO: 821870 - DNA, 25 bp, Mus musculus
tgggctgccatcagggacaagtacc

SEQ ID NO: 821871 - DNA, 25 bp, Mus musculus
tgggctgccatctgggacaagtacc

SEQ ID NO: 821872 - DNA, 25 bp, Mus musculus
tgggctgcccgaaaggcagtgctca

SEQ ID NO: 821873 - DNA, 25 bp, Mus musculus
tgggctgcccgataggcagtgctca

SEQ ID NO: 821874 - DNA, 25 bp, Mus musculus
tgggctgccctacctcaaggtcctg

SEQ ID NO: 821875 - DNA, 25 bp, Mus musculus
tgggctgccctagctcaaggtcctg

SEQ ID NO: 821876 - DNA, 25 bp, Mus musculus
tgggctgccggcagtttgtcacagc

SEQ ID NO: 821877 - DNA, 25 bp, Mus musculus
tgggctgccggctgtttgtcacagc

SEQ ID NO: 821878 - DNA, 25 bp, Mus musculus
tgggctgcctgccagccattgtcct

SEQ ID NO: 821879 - DNA, 25 bp, Mus musculus
tgggctgcctgcgagccattgtcct

SEQ ID NO: 821880 - DNA, 25 bp, Mus musculus
tgggctgcttacagagcacggcccc

SEQ ID NO: 821881 - DNA, 25 bp, Mus musculus
tgggctgcttactgagcacggcccc

SEQ ID NO: 821882 - DNA, 25 bp, Mus musculus
tgggctgcttttcccactgatgagc

SEQ ID NO: 821883 - DNA, 25 bp, Mus musculus
tgggctgcttttgccactgatgagc

SEQ ID NO: 821884 - DNA, 25 bp, Mus musculus
tgggctggaaccagacctacagcaa

SEQ ID NO: 821885 - DNA, 25 bp, Mus musculus
tgggctggaacctgacctacagcaa

SEQ ID NO: 821886 - DNA, 25 bp, Mus musculus
tgggctggacttactattggacagg

SEQ ID NO: 821887 - DNA, 25 bp, Mus musculus
tgggctggactttctattggacagg

SEQ ID NO: 821888 - DNA, 25 bp, Mus musculus
tgggctggagacacatcgccctctc

SEQ ID NO: 821889 - DNA, 25 bp, Mus musculus
tgggctggagactcatcgccctctc

SEQ ID NO: 821890 - DNA, 25 bp, Mus musculus
tgggctggcacaacaatcccgggag

SEQ ID NO: 821891 - DNA, 25 bp, Mus musculus
tgggctggcacatcaatcccgggag

SEQ ID NO: 821892 - DNA, 25 bp, Mus musculus
tgggctggcacgaggtgtccaccac

SEQ ID NO: 821893 - DNA, 25 bp, Mus musculus
tgggctggcacgtggtgtccaccac

SEQ ID NO: 821894 - DNA, 25 bp, Mus musculus
tgggctggccatagaggtgactcac

SEQ ID NO: 821895 - DNA, 25 bp, Mus musculus
tgggctggccatattcacacggttc

SEQ ID NO: 821896 - DNA, 25 bp, Mus musculus
tgggctggccattgaggtgactcac

SEQ ID NO: 821897 - DNA, 25 bp, Mus musculus
tgggctggccattttcacacggttc

SEQ ID NO: 821898 - DNA, 25 bp, Mus musculus
tgggctggccctcatcatgacaagt

SEQ ID NO: 821899 - DNA, 25 bp, Mus musculus
tgggctggccctgatcatgacaagt

SEQ ID NO: 821900 - DNA, 25 bp, Mus musculus
tgggctggcgggaagactacaccct

SEQ ID NO: 821901 - DNA, 25 bp, Mus musculus
tgggctggcgggtagactacaccct

SEQ ID NO: 821902 - DNA, 25 bp, Mus musculus
tgggctggctttaacattcgtggaa

SEQ ID NO: 821903 - DNA, 25 bp, Mus musculus
tgggctggcttttacattcgtggaa

SEQ ID NO: 821904 - DNA, 25 bp, Mus musculus
tgggctgggtgactaccccgtctct

SEQ ID NO: 821905 - DNA, 25 bp, Mus musculus
tgggctgggtgagtaccccgtctct

SEQ ID NO: 821906 - DNA, 25 bp, Mus musculus
tgggctggttttcatttcatgatcc

SEQ ID NO: 821907 - DNA, 25 bp, Mus musculus
tgggctggttttgatttcatgatcc

SEQ ID NO: 821908 - DNA, 25 bp, Mus musculus
tgggctgtaacgactctgaagtgct

SEQ ID NO: 821909 - DNA, 25 bp, Mus musculus
tgggctgtaacgtctctgaagtgct

SEQ ID NO: 821910 - DNA, 25 bp, Mus musculus
tgggctgtactacaagcttcataat

SEQ ID NO: 821911 - DNA, 25 bp, Mus musculus
tgggctgtactagaagcttcataat

SEQ ID NO: 821912 - DNA, 25 bp, Mus musculus
tgggctgtagaacttaagagacccc

SEQ ID NO: 821913 - DNA, 25 bp, Mus musculus
tgggctgtagaagttaagagacccc

SEQ ID NO: 821914 - DNA, 25 bp, Mus musculus
tgggctgtcaagcactgtgacctgc

SEQ ID NO: 821915 - DNA, 25 bp, Mus musculus
tgggctgtcaaggactgtgacctgc

SEQ ID NO: 821916 - DNA, 25 bp, Mus musculus
tgggctgtccaaatccactctcaac

SEQ ID NO: 821917 - DNA, 25 bp, Mus musculus
tgggctgtccaattccactctcaac

SEQ ID NO: 821918 - DNA, 25 bp, Mus musculus
tgggctgtgactagctgcctccagc

SEQ ID NO: 821919 - DNA, 25 bp, Mus musculus
tgggctgtgacttgctgcctccagc

SEQ ID NO: 821920 - DNA, 25 bp, Mus musculus
tgggctgtgatccattaggctgctt

SEQ ID NO: 821921 - DNA, 25 bp, Mus musculus
tgggctgtgatcgattaggctgctt

SEQ ID NO: 821922 - DNA, 25 bp, Mus musculus
tgggctgtgtggaattccagagaat

SEQ ID NO: 821923 - DNA, 25 bp, Mus musculus
tgggctgtgtggtattccagagaat

SEQ ID NO: 821924 - DNA, 25 bp, Mus musculus
tgggctgttgtacccctgcattgac

SEQ ID NO: 821925 - DNA, 25 bp, Mus musculus
tgggctgttgtagccctgcattgac

SEQ ID NO: 821926 - DNA, 25 bp, Mus musculus
tgggctgttgttcgagacacgttcc

SEQ ID NO: 821927 - DNA, 25 bp, Mus musculus
tgggctgttgttggagacacgttcc

SEQ ID NO: 821928 - DNA, 25 bp, Mus musculus
tgggcttacagaccaggacagagac

SEQ ID NO: 821929 - DNA, 25 bp, Mus musculus
tgggcttacagactgcaatactgga

SEQ ID NO: 821930 - DNA, 25 bp, Mus musculus
tgggcttacagagcaggacagagac

SEQ ID NO: 821931 - DNA, 25 bp, Mus musculus
tgggcttacagagtgcaatactgga

SEQ ID NO: 821932 - DNA, 25 bp, Mus musculus
tgggcttacctcactgctttccgga

SEQ ID NO: 821933 - DNA, 25 bp, Mus musculus
tgggcttacctctctgctttccgga

SEQ ID NO: 821934 - DNA, 25 bp, Mus musculus
tgggcttactgtagagatgtttgga

SEQ ID NO: 821935 - DNA, 25 bp, Mus musculus
tgggcttactgttgagatgtttgga

SEQ ID NO: 821936 - DNA, 25 bp, Mus musculus
tgggcttagcacaccagatggctga

SEQ ID NO: 821937 - DNA, 25 bp, Mus musculus
tgggcttagcactccagatggctga

SEQ ID NO: 821938 - DNA, 25 bp, Mus musculus
tgggcttagcatcgacattaaaggg

SEQ ID NO: 821939 - DNA, 25 bp, Mus musculus
tgggcttagcatggacattaaaggg

SEQ ID NO: 821940 - DNA, 25 bp, Mus musculus
tgggcttagctcatgctccccagca

SEQ ID NO: 821941 - DNA, 25 bp, Mus musculus
tgggcttagctcttgctccccagca

SEQ ID NO: 821942 - DNA, 25 bp, Mus musculus
tgggcttaggtcacaatcagattcg

SEQ ID NO: 821943 - DNA, 25 bp, Mus musculus
tgggcttaggtctcaatcagattcg

SEQ ID NO: 821944 - DNA, 25 bp, Mus musculus
tgggcttattacacaactgtggatc

SEQ ID NO: 821945 - DNA, 25 bp, Mus musculus
tgggcttattactcaactgtggatc

SEQ ID NO: 821946 - DNA, 25 bp, Mus musculus
tgggcttcaacaacgtcggtgggac

SEQ ID NO: 821947 - DNA, 25 bp, Mus musculus
tgggcttcaacatcgtcggtgggac

SEQ ID NO: 821948 - DNA, 25 bp, Mus musculus
tgggcttcaatccaccgtccaagat

SEQ ID NO: 821949 - DNA, 25 bp, Mus musculus
tgggcttcaatcgaccgtccaagat

SEQ ID NO: 821950 - DNA, 25 bp, Mus musculus
tgggcttcacagaaggtcctgcccc

SEQ ID NO: 821951 - DNA, 25 bp, Mus musculus
tgggcttcacagtaggtcctgcccc

SEQ ID NO: 821952 - DNA, 25 bp, Mus musculus
tgggcttcacggacccaagcagaag

SEQ ID NO: 821953 - DNA, 25 bp, Mus musculus
tgggcttcacggtcccaagcagaag

SEQ ID NO: 821954 - DNA, 25 bp, Mus musculus
tgggcttcagaccacaaagtagtag

SEQ ID NO: 821955 - DNA, 25 bp, Mus musculus
tgggcttcagacgacaaagtagtag

SEQ ID NO: 821956 - DNA, 25 bp, Mus musculus
tgggcttccatacacacatgagcgc

SEQ ID NO: 821957 - DNA, 25 bp, Mus musculus
tgggcttccatagacacatgagcgc

SEQ ID NO: 821958 - DNA, 25 bp, Mus musculus
tgggcttccatcagactgcggcaca

SEQ ID NO: 821959 - DNA, 25 bp, Mus musculus
tgggcttccatctgactgcggcaca

SEQ ID NO: 821960 - DNA, 25 bp, Mus musculus
tgggcttcccaaatcccttggcaga

SEQ ID NO: 821961 - DNA, 25 bp, Mus musculus
tgggcttcccaacattcttgcctgt

SEQ ID NO: 821962 - DNA, 25 bp, Mus musculus
tgggcttcccaagattcttgcctgt

SEQ ID NO: 821963 - DNA, 25 bp, Mus musculus
tgggcttcccaattcccttggcaga

SEQ ID NO: 821964 - DNA, 25 bp, Mus musculus
tgggcttcccagctaagttcttaga

SEQ ID NO: 821965 - DNA, 25 bp, Mus musculus
tgggcttcccaggtaagttcttaga

SEQ ID NO: 821966 - DNA, 25 bp, Mus musculus
tgggcttcctcaaggcgagcatcag

SEQ ID NO: 821967 - DNA, 25 bp, Mus musculus
tgggcttcctcatggcgagcatcag

SEQ ID NO: 821968 - DNA, 25 bp, Mus musculus
tgggcttcgatacacgagtgactgt

SEQ ID NO: 821969 - DNA, 25 bp, Mus musculus
tgggcttcgatagacgagtgactgt

SEQ ID NO: 821970 - DNA, 25 bp, Mus musculus
tgggcttctaccatgggctctcaag

SEQ ID NO: 821971 - DNA, 25 bp, Mus musculus
tgggcttctaccttgggctctcaag

SEQ ID NO: 821972 - DNA, 25 bp, Mus musculus
tgggcttctcccagaaattttactt

SEQ ID NO: 821973 - DNA, 25 bp, Mus musculus
tgggcttctccctgaaattttactt

SEQ ID NO: 821974 - DNA, 25 bp, Mus musculus
tgggcttctgctcatcattctgatc

SEQ ID NO: 821975 - DNA, 25 bp, Mus musculus
tgggcttctgctgatcattctgatc

SEQ ID NO: 821976 - DNA, 25 bp, Mus musculus
tgggcttcttacaggtgcttctccc

SEQ ID NO: 821977 - DNA, 25 bp, Mus musculus
tgggcttcttactggtgcttctccc

SEQ ID NO: 821978 - DNA, 25 bp, Mus musculus
tgggcttgaacactatgctattaag

SEQ ID NO: 821979 - DNA, 25 bp, Mus musculus
tgggcttgaacagtatgctattaag

SEQ ID NO: 821980 - DNA, 25 bp, Mus musculus
tgggcttggaagatgagaaccatga

SEQ ID NO: 821981 - DNA, 25 bp, Mus musculus
tgggcttggaagttgagaaccatga

SEQ ID NO: 821982 - DNA, 25 bp, Mus musculus
tgggcttgtccaacttcaacagtcg

SEQ ID NO: 821983 - DNA, 25 bp, Mus musculus
tgggcttgtccatcttcaacagtcg

SEQ ID NO: 821984 - DNA, 25 bp, Mus musculus
tgggcttgtgcacaaaatcatggag

SEQ ID NO: 821985 - DNA, 25 bp, Mus musculus
tgggcttgtgcagaaaatcatggag

SEQ ID NO: 821986 - DNA, 25 bp, Mus musculus
tgggctttactgcactcttcaagga

SEQ ID NO: 821987 - DNA, 25 bp, Mus musculus
tgggctttactggactcttcaagga

SEQ ID NO: 821988 - DNA, 25 bp, Mus musculus
tgggctttcgctatgatgtggcatg

SEQ ID NO: 821989 - DNA, 25 bp, Mus musculus
tgggctttcgctttgatgtggcatg

SEQ ID NO: 821990 - DNA, 25 bp, Mus musculus
tgggctttctctaccgtttccttag

SEQ ID NO: 821991 - DNA, 25 bp, Mus musculus
tgggctttctcttccgtttccttag

SEQ ID NO: 821992 - DNA, 25 bp, Mus musculus
tgggctttgccaacagctaacaaat

SEQ ID NO: 821993 - DNA, 25 bp, Mus musculus
tgggctttgccatcagctaacaaat

SEQ ID NO: 821994 - DNA, 25 bp, Mus musculus
tgggctttgcccaacccaggttgac

SEQ ID NO: 821995 - DNA, 25 bp, Mus musculus
tgggctttgccctacccaggttgac

SEQ ID NO: 821996 - DNA, 25 bp, Mus musculus
tgggctttggagatcctctctcacc

SEQ ID NO: 821997 - DNA, 25 bp, Mus musculus
tgggctttggagttcctctctcacc

SEQ ID NO: 821998 - DNA, 25 bp, Mus musculus
tgggctttggctaccgtctggccct

SEQ ID NO: 821999 - DNA, 25 bp, Mus musculus
tgggctttggcttccgtctggccct

SEQ ID NO: 822000 - DNA, 25 bp, Mus musculus
tgggctttgtatcccaaattcgatc

SEQ ID NO: 822001 - DNA, 25 bp, Mus musculus
tgggctttgtatgccaaattcgatc

SEQ ID NO: 822002 - DNA, 25 bp, Mus musculus
tgggcttttgctagaactgttgggc

SEQ ID NO: 822003 - DNA, 25 bp, Mus musculus
tgggcttttgcttgaactgttgggc

SEQ ID NO: 822004 - DNA, 25 bp, Mus musculus
tgggctttttgcacattggcgtggc

SEQ ID NO: 822005 - DNA, 25 bp, Mus musculus
tgggctttttgctcattggcgtggc

SEQ ID NO: 822006 - DNA, 25 bp, Mus musculus
tggggaggacctctacttctctgtg

SEQ ID NO: 822007 - DNA, 25 bp, Mus musculus
tggggaggacctgtacttctctgtg

SEQ ID NO: 822008 - DNA, 25 bp, Mus musculus
tggggatacatccatcaggggtcac

SEQ ID NO: 822009 - DNA, 25 bp, Mus musculus
tggggatacatcgatcaggggtcac

SEQ ID NO: 822010 - DNA, 25 bp, Mus musculus
tggggcagccccaacctatttccgg

SEQ ID NO: 822011 - DNA, 25 bp, Mus musculus
tggggcagcccctacctatttccgg

SEQ ID NO: 822012 - DNA, 25 bp, Mus musculus
tggggcccaagtccgacgactgcct

SEQ ID NO: 822013 - DNA, 25 bp, Mus musculus
tggggcccaagtgcgacgactgcct

SEQ ID NO: 822014 - DNA, 25 bp, Mus musculus
tggggcctgccgcttctctgactgc

SEQ ID NO: 822015 - DNA, 25 bp, Mus musculus
tggggcctgccggttctctgactgc

SEQ ID NO: 822016 - DNA, 25 bp, Mus musculus
tggggcgagactattctaaacagtt

SEQ ID NO: 822017 - DNA, 25 bp, Mus musculus
tggggcgagacttttctaaacagtt

SEQ ID NO: 822018 - DNA, 25 bp, Mus musculus
tgggggcaagaaccacagaattact

SEQ ID NO: 822019 - DNA, 25 bp, Mus musculus
tgggggcaagaagcacagaattact

SEQ ID NO: 822020 - DNA, 25 bp, Mus musculus
tgggggttactccaataaagccatg

SEQ ID NO: 822021 - DNA, 25 bp, Mus musculus
tgggggttactcgaataaagccatg

SEQ ID NO: 822022 - DNA, 25 bp, Mus musculus
tggggttgtctaaggaaaagctctg

SEQ ID NO: 822023 - DNA, 25 bp, Mus musculus
tggggttgtctatggaaaagctctg

SEQ ID NO: 822024 - DNA, 25 bp, Mus musculus
tgggtaaaaccaaagacagccgctt

SEQ ID NO: 822025 - DNA, 25 bp, Mus musculus
tgggtaaaaccatagacagccgctt

SEQ ID NO: 822026 - DNA, 25 bp, Mus musculus
tgggtaaaatggatgccacctacca

SEQ ID NO: 822027 - DNA, 25 bp, Mus musculus
tgggtaaaatggttgccacctacca

SEQ ID NO: 822028 - DNA, 25 bp, Mus musculus
tgggtaaagagtaaataaggtgact

SEQ ID NO: 822029 - DNA, 25 bp, Mus musculus
tgggtaaagagttaataaggtgact

SEQ ID NO: 822030 - DNA, 25 bp, Mus musculus
tgggtaaagcagagaccaccctgat

SEQ ID NO: 822031 - DNA, 25 bp, Mus musculus
tgggtaaagcagtgaccaccctgat

SEQ ID NO: 822032 - DNA, 25 bp, Mus musculus
tgggtaaagccacactgaactgaga

SEQ ID NO: 822033 - DNA, 25 bp, Mus musculus
tgggtaaagccagactgaactgaga

SEQ ID NO: 822034 - DNA, 25 bp, Mus musculus
tgggtaaatgtcatgaacaaagcta

SEQ ID NO: 822035 - DNA, 25 bp, Mus musculus
tgggtaaatgtcttgaacaaagcta

SEQ ID NO: 822036 - DNA, 25 bp, Mus musculus
tgggtaacagatatataccactgct

SEQ ID NO: 822037 - DNA, 25 bp, Mus musculus
tgggtaacagatttataccactgct

SEQ ID NO: 822038 - DNA, 25 bp, Mus musculus
tgggtaacagccatgtcaccgcctc

SEQ ID NO: 822039 - DNA, 25 bp, Mus musculus
tgggtaacagccttgtcaccgcctc

SEQ ID NO: 822040 - DNA, 25 bp, Mus musculus
tgggtaaccccaaaccatctgtgtc

SEQ ID NO: 822041 - DNA, 25 bp, Mus musculus
tgggtaaccccataccatctgtgtc

SEQ ID NO: 822042 - DNA, 25 bp, Mus musculus
tgggtaactctgactcaatggaaac

SEQ ID NO: 822043 - DNA, 25 bp, Mus musculus
tgggtaactctgtctcaatggaaac

SEQ ID NO: 822044 - DNA, 25 bp, Mus musculus
tgggtaaggagacagctcatgacaa

SEQ ID NO: 822045 - DNA, 25 bp, Mus musculus
tgggtaaggagagagctcatgacaa

SEQ ID NO: 822046 - DNA, 25 bp, Mus musculus
tgggtacaactgagtggcagacatc

SEQ ID NO: 822047 - DNA, 25 bp, Mus musculus
tgggtacaactgtgtggcagacatc

SEQ ID NO: 822048 - DNA, 25 bp, Mus musculus
tgggtacaccctatgcccagttcct

SEQ ID NO: 822049 - DNA, 25 bp, Mus musculus
tgggtacaccctttgcccagttcct

SEQ ID NO: 822050 - DNA, 25 bp, Mus musculus
tgggtacagagacaccactggttga

SEQ ID NO: 822051 - DNA, 25 bp, Mus musculus
tgggtacagagagaccactggttga

SEQ ID NO: 822052 - DNA, 25 bp, Mus musculus
tgggtacatcagcatcgacgattac

SEQ ID NO: 822053 - DNA, 25 bp, Mus musculus
tgggtacatcaggatcgacgattac

SEQ ID NO: 822054 - DNA, 25 bp, Mus musculus
tgggtacatcttagacacgccctcc

SEQ ID NO: 822055 - DNA, 25 bp, Mus musculus
tgggtacatctttgacacgccctcc

SEQ ID NO: 822056 - DNA, 25 bp, Mus musculus
tgggtacatgagacagccttgaagc

SEQ ID NO: 822057 - DNA, 25 bp, Mus musculus
tgggtacatgagtcagccttgaagc

SEQ ID NO: 822058 - DNA, 25 bp, Mus musculus
tgggtaccaccaataagaaatccgg

SEQ ID NO: 822059 - DNA, 25 bp, Mus musculus
tgggtaccaccattaagaaatccgg

SEQ ID NO: 822060 - DNA, 25 bp, Mus musculus
tgggtaccagagaccatacgctggc

SEQ ID NO: 822061 - DNA, 25 bp, Mus musculus
tgggtaccagagtccatacgctggc

SEQ ID NO: 822062 - DNA, 25 bp, Mus musculus
tgggtaccagatagcagtggagact

SEQ ID NO: 822063 - DNA, 25 bp, Mus musculus
tgggtaccagattgcagtggagact

SEQ ID NO: 822064 - DNA, 25 bp, Mus musculus
tgggtacccttgctgacagatacct

SEQ ID NO: 822065 - DNA, 25 bp, Mus musculus
tgggtacccttggtgacagatacct

SEQ ID NO: 822066 - DNA, 25 bp, Mus musculus
tgggtaccgatgcagccattttccg

SEQ ID NO: 822067 - DNA, 25 bp, Mus musculus
tgggtaccgatggagccattttccg

SEQ ID NO: 822068 - DNA, 25 bp, Mus musculus
tgggtacctgtacagttcctggcag

SEQ ID NO: 822069 - DNA, 25 bp, Mus musculus
tgggtacctgtagagttcctggcag

SEQ ID NO: 822070 - DNA, 25 bp, Mus musculus
tgggtaccttcacccgttacgagag

SEQ ID NO: 822071 - DNA, 25 bp, Mus musculus
tgggtaccttcagccgttacgagag

SEQ ID NO: 822072 - DNA, 25 bp, Mus musculus
tgggtacctttgcaaacaatgataa

SEQ ID NO: 822073 - DNA, 25 bp, Mus musculus
tgggtacctttggaaacaatgataa

SEQ ID NO: 822074 - DNA, 25 bp, Mus musculus
tgggtacgaagacaaccacaccaat

SEQ ID NO: 822075 - DNA, 25 bp, Mus musculus
tgggtacgaagagaaccacaccaat

SEQ ID NO: 822076 - DNA, 25 bp, Mus musculus
tgggtactaccaagccaatgcggtt

SEQ ID NO: 822077 - DNA, 25 bp, Mus musculus
tgggtactaccatgccaatgcggtt

SEQ ID NO: 822078 - DNA, 25 bp, Mus musculus
tgggtactatctcccaagccgggag

SEQ ID NO: 822079 - DNA, 25 bp, Mus musculus
tgggtactatctgccaagccgggag

SEQ ID NO: 822080 - DNA, 25 bp, Mus musculus
tgggtactccaactgctgacttagg

SEQ ID NO: 822081 - DNA, 25 bp, Mus musculus
tgggtactccaagtgctgacttagg

SEQ ID NO: 822082 - DNA, 25 bp, Mus musculus
tgggtactgactccccggcaatgca

SEQ ID NO: 822083 - DNA, 25 bp, Mus musculus
tgggtactgactgcccggcaatgca

SEQ ID NO: 822084 - DNA, 25 bp, Mus musculus
tgggtagactttcgaactacttgaa

SEQ ID NO: 822085 - DNA, 25 bp, Mus musculus
tgggtagactttggaactacttgaa

SEQ ID NO: 822086 - DNA, 25 bp, Mus musculus
tgggtagcattaaattttgccctca

SEQ ID NO: 822087 - DNA, 25 bp, Mus musculus
tgggtagcattatattttgccctca

SEQ ID NO: 822088 - DNA, 25 bp, Mus musculus
tgggtagctgaaccctctgtgccca

SEQ ID NO: 822089 - DNA, 25 bp, Mus musculus
tgggtagctgaagcctctgtgccca

SEQ ID NO: 822090 - DNA, 25 bp, Mus musculus
tgggtaggcagaacgacatgagttc

SEQ ID NO: 822091 - DNA, 25 bp, Mus musculus
tgggtaggcagatcgacatgagttc

SEQ ID NO: 822092 - DNA, 25 bp, Mus musculus
tgggtagtaaaaccactcttacctg

SEQ ID NO: 822093 - DNA, 25 bp, Mus musculus
tgggtagtaaaagcactcttacctg

SEQ ID NO: 822094 - DNA, 25 bp, Mus musculus
tgggtatcagcgaggttagctacac

SEQ ID NO: 822095 - DNA, 25 bp, Mus musculus
tgggtatcagcgtggttagctacac

SEQ ID NO: 822096 - DNA, 25 bp, Mus musculus
tgggtatccaaaagttgggaaatcc

SEQ ID NO: 822097 - DNA, 25 bp, Mus musculus
tgggtatccaaatgttgggaaatcc

SEQ ID NO: 822098 - DNA, 25 bp, Mus musculus
tgggtatcctgcacttcgagctgct

SEQ ID NO: 822099 - DNA, 25 bp, Mus musculus
tgggtatcctgctcttcgagctgct

SEQ ID NO: 822100 - DNA, 25 bp, Mus musculus
tgggtatcggaaccatgcttggaaa

SEQ ID NO: 822101 - DNA, 25 bp, Mus musculus
tgggtatcggaagcatgcttggaaa

SEQ ID NO: 822102 - DNA, 25 bp, Mus musculus
tgggtatctcgaccggtcctctcag

SEQ ID NO: 822103 - DNA, 25 bp, Mus musculus
tgggtatctcgagcggtcctctcag

SEQ ID NO: 822104 - DNA, 25 bp, Mus musculus
tgggtatgaatgcagaatcccactt

SEQ ID NO: 822105 - DNA, 25 bp, Mus musculus
tgggtatgaatggagaatcccactt

SEQ ID NO: 822106 - DNA, 25 bp, Mus musculus
tgggtatgctagaagcaagaattcg

SEQ ID NO: 822107 - DNA, 25 bp, Mus musculus
tgggtatgctagtagcaagaattcg

SEQ ID NO: 822108 - DNA, 25 bp, Mus musculus
tgggtatggagaaggaggcccggca

SEQ ID NO: 822109 - DNA, 25 bp, Mus musculus
tgggtatggagatggaggcccggca

SEQ ID NO: 822110 - DNA, 25 bp, Mus musculus
tgggtatggtatcgccacttcacac

SEQ ID NO: 822111 - DNA, 25 bp, Mus musculus
tgggtatggtatggccacttcacac

SEQ ID NO: 822112 - DNA, 25 bp, Mus musculus
tgggtattagcaccctagttacaga

SEQ ID NO: 822113 - DNA, 25 bp, Mus musculus
tgggtattagcagcctagttacaga

SEQ ID NO: 822114 - DNA, 25 bp, Mus musculus
tgggtattgggaatcctcttctggc

SEQ ID NO: 822115 - DNA, 25 bp, Mus musculus
tgggtattgggattcctcttctggc

SEQ ID NO: 822116 - DNA, 25 bp, Mus musculus
tgggtatttactaacgttggtgcct

SEQ ID NO: 822117 - DNA, 25 bp, Mus musculus
tgggtatttacttacgttggtgcct

SEQ ID NO: 822118 - DNA, 25 bp, Mus musculus
tgggtcaaacagatctggagatctg

SEQ ID NO: 822119 - DNA, 25 bp, Mus musculus
tgggtcaaacagttctggagatctg

SEQ ID NO: 822120 - DNA, 25 bp, Mus musculus
tgggtcaaataccactgcccgcagc

SEQ ID NO: 822121 - DNA, 25 bp, Mus musculus
tgggtcaaatacgactgcccgcagc

SEQ ID NO: 822122 - DNA, 25 bp, Mus musculus
tgggtcaagcccaggattctatgag

SEQ ID NO: 822123 - DNA, 25 bp, Mus musculus
tgggtcaagccctggattctatgag

SEQ ID NO: 822124 - DNA, 25 bp, Mus musculus
tgggtcaaggctacccctaccagta

SEQ ID NO: 822125 - DNA, 25 bp, Mus musculus
tgggtcaaggctagcagacacagct

SEQ ID NO: 822126 - DNA, 25 bp, Mus musculus
tgggtcaaggcttcccctaccagta

SEQ ID NO: 822127 - DNA, 25 bp, Mus musculus
tgggtcaaggcttgcagacacagct

SEQ ID NO: 822128 - DNA, 25 bp, Mus musculus
tgggtcaataggcttgatctttgct

SEQ ID NO: 822129 - DNA, 25 bp, Mus musculus
tgggtcaatagggttgatctttgct

SEQ ID NO: 822130 - DNA, 25 bp, Mus musculus
tgggtcacaaggagagcgccacaga

SEQ ID NO: 822131 - DNA, 25 bp, Mus musculus
tgggtcacaaggtgagcgccacaga

SEQ ID NO: 822132 - DNA, 25 bp, Mus musculus
tgggtcacctatcagctgaatcagc

SEQ ID NO: 822133 - DNA, 25 bp, Mus musculus
tgggtcacctatgagctgaatcagc

SEQ ID NO: 822134 - DNA, 25 bp, Mus musculus
tgggtcacgtggcactgcggctggt

SEQ ID NO: 822135 - DNA, 25 bp, Mus musculus
tgggtcacgtgggactgcggctggt

SEQ ID NO: 822136 - DNA, 25 bp, Mus musculus
tgggtcagacttacaggagaagctg

SEQ ID NO: 822137 - DNA, 25 bp, Mus musculus
tgggtcagactttcaggagaagctg

SEQ ID NO: 822138 - DNA, 25 bp, Mus musculus
tgggtcagcctgcagaatatagcct

SEQ ID NO: 822139 - DNA, 25 bp, Mus musculus
tgggtcagcctggagaatatagcct

SEQ ID NO: 822140 - DNA, 25 bp, Mus musculus
tgggtcagccttagctcggcccggc

SEQ ID NO: 822141 - DNA, 25 bp, Mus musculus
tgggtcagcctttgctcggcccggc

SEQ ID NO: 822142 - DNA, 25 bp, Mus musculus
tgggtcagcgcaccatgcaatgcca

SEQ ID NO: 822143 - DNA, 25 bp, Mus musculus
tgggtcagcgcagcatgcaatgcca

SEQ ID NO: 822144 - DNA, 25 bp, Mus musculus
tgggtcaggacacgtcagtggcagc

SEQ ID NO: 822145 - DNA, 25 bp, Mus musculus
tgggtcaggacaggtcagtggcagc

SEQ ID NO: 822146 - DNA, 25 bp, Mus musculus
tgggtcaggtaactagttgtgcctt

SEQ ID NO: 822147 - DNA, 25 bp, Mus musculus
tgggtcaggtaagtagttgtgcctt

SEQ ID NO: 822148 - DNA, 25 bp, Mus musculus
tgggtccacctgcactactatggca

SEQ ID NO: 822149 - DNA, 25 bp, Mus musculus
tgggtccacctggactactatggca

SEQ ID NO: 822150 - DNA, 25 bp, Mus musculus
tgggtccagaggctgccgacccaca

SEQ ID NO: 822151 - DNA, 25 bp, Mus musculus
tgggtccagagggtgccgacccaca

SEQ ID NO: 822152 - DNA, 25 bp, Mus musculus
tgggtccaggatagccgtcagtgcc

SEQ ID NO: 822153 - DNA, 25 bp, Mus musculus
tgggtccaggattgccgtcagtgcc

SEQ ID NO: 822154 - DNA, 25 bp, Mus musculus
tgggtccataagatataaacatcgg

SEQ ID NO: 822155 - DNA, 25 bp, Mus musculus
tgggtccataagttataaacatcgg

SEQ ID NO: 822156 - DNA, 25 bp, Mus musculus
tgggtcccagccaaaaggtcacctt

SEQ ID NO: 822157 - DNA, 25 bp, Mus musculus
tgggtcccagcctaaaggtcacctt

SEQ ID NO: 822158 - DNA, 25 bp, Mus musculus
tgggtcccatgccattaaccatgtg

SEQ ID NO: 822159 - DNA, 25 bp, Mus musculus
tgggtcccatgcgattaaccatgtg

SEQ ID NO: 822160 - DNA, 25 bp, Mus musculus
tgggtccccagaaaaagctaagatg

SEQ ID NO: 822161 - DNA, 25 bp, Mus musculus
tgggtccccagataaagctaagatg

SEQ ID NO: 822162 - DNA, 25 bp, Mus musculus
tgggtccccgctaaggttcacaagc

SEQ ID NO: 822163 - DNA, 25 bp, Mus musculus
tgggtccccgctattcttgcgccga

SEQ ID NO: 822164 - DNA, 25 bp, Mus musculus
tgggtccccgcttaggttcacaagc

SEQ ID NO: 822165 - DNA, 25 bp, Mus musculus
tgggtccccgcttttcttgcgccga

SEQ ID NO: 822166 - DNA, 25 bp, Mus musculus
tgggtcccctgaactgcctctgctg

SEQ ID NO: 822167 - DNA, 25 bp, Mus musculus
tgggtcccctgatctgcctctgctg

SEQ ID NO: 822168 - DNA, 25 bp, Mus musculus
tgggtccgagcaacccgcggcttcg

SEQ ID NO: 822169 - DNA, 25 bp, Mus musculus
tgggtccgagcatcccgcggcttcg

SEQ ID NO: 822170 - DNA, 25 bp, Mus musculus
tgggtccgccctactctgtcatcag

SEQ ID NO: 822171 - DNA, 25 bp, Mus musculus
tgggtccgcccttctctgtcatcag

SEQ ID NO: 822172 - DNA, 25 bp, Mus musculus
tgggtccggaagagccatgtgaaca

SEQ ID NO: 822173 - DNA, 25 bp, Mus musculus
tgggtccggaagtgccatgtgaaca

SEQ ID NO: 822174 - DNA, 25 bp, Mus musculus
tgggtccggagtcccgcatccatct

SEQ ID NO: 822175 - DNA, 25 bp, Mus musculus
tgggtccggagtgccgcatccatct

SEQ ID NO: 822176 - DNA, 25 bp, Mus musculus
tgggtcctaaggccgcgctaaaaat

SEQ ID NO: 822177 - DNA, 25 bp, Mus musculus
tgggtcctaagggcgcgctaaaaat

SEQ ID NO: 822178 - DNA, 25 bp, Mus musculus
tgggtcctagccagccacagggcaa

SEQ ID NO: 822179 - DNA, 25 bp, Mus musculus
tgggtcctagcctgccacagggcaa

SEQ ID NO: 822180 - DNA, 25 bp, Mus musculus
tgggtcctctggatgtcccctggag

SEQ ID NO: 822181 - DNA, 25 bp, Mus musculus
tgggtcctctggttgtcccctggag

SEQ ID NO: 822182 - DNA, 25 bp, Mus musculus
tgggtcctgcttatgtatgtccatg

SEQ ID NO: 822183 - DNA, 25 bp, Mus musculus
tgggtcctgcttttgtatgtccatg

SEQ ID NO: 822184 - DNA, 25 bp, Mus musculus
tgggtcctggctataccaaggcctt

SEQ ID NO: 822185 - DNA, 25 bp, Mus musculus
tgggtcctggctttaccaaggcctt

SEQ ID NO: 822186 - DNA, 25 bp, Mus musculus
tgggtcctgtcccttctcggatgat

SEQ ID NO: 822187 - DNA, 25 bp, Mus musculus
tgggtcctgtccgttctcggatgat

SEQ ID NO: 822188 - DNA, 25 bp, Mus musculus
tgggtcgaaaagacccagagcagga

SEQ ID NO: 822189 - DNA, 25 bp, Mus musculus
tgggtcgaaaagtcccagagcagga

SEQ ID NO: 822190 - DNA, 25 bp, Mus musculus
tgggtcgaatccaaacataagtccg

SEQ ID NO: 822191 - DNA, 25 bp, Mus musculus
tgggtcgaatcctaacataagtccg

SEQ ID NO: 822192 - DNA, 25 bp, Mus musculus
tgggtcgatatcaggtaagggatac

SEQ ID NO: 822193 - DNA, 25 bp, Mus musculus
tgggtcgatatctggtaagggatac

SEQ ID NO: 822194 - DNA, 25 bp, Mus musculus
tgggtcgatcccacttggcaagaat

SEQ ID NO: 822195 - DNA, 25 bp, Mus musculus
tgggtcgatccctcttggcaagaat

SEQ ID NO: 822196 - DNA, 25 bp, Mus musculus
tgggtcgcatgcagctggtgaccaa

SEQ ID NO: 822197 - DNA, 25 bp, Mus musculus
tgggtcgcatgctgctggtgaccaa

SEQ ID NO: 822198 - DNA, 25 bp, Mus musculus
tgggtcgccggcatcttcttccacg

SEQ ID NO: 822199 - DNA, 25 bp, Mus musculus
tgggtcgccggcttcttcttccacg

SEQ ID NO: 822200 - DNA, 25 bp, Mus musculus
tgggtcggcactcagaccggcatcc

SEQ ID NO: 822201 - DNA, 25 bp, Mus musculus
tgggtcggcactgagaccggcatcc

SEQ ID NO: 822202 - DNA, 25 bp, Mus musculus
tgggtcggtcccaccgacacacgag

SEQ ID NO: 822203 - DNA, 25 bp, Mus musculus
tgggtcggtccctccgacacacgag

SEQ ID NO: 822204 - DNA, 25 bp, Mus musculus
tgggtcggtgtcattcgctacctga

SEQ ID NO: 822205 - DNA, 25 bp, Mus musculus
tgggtcggtgtctttcgctacctga

SEQ ID NO: 822206 - DNA, 25 bp, Mus musculus
tgggtcgtcaccctctacaacagca

SEQ ID NO: 822207 - DNA, 25 bp, Mus musculus
tgggtcgtcaccgtctacaacagca

SEQ ID NO: 822208 - DNA, 25 bp, Mus musculus
tgggtcgtgggcagcgccgacctgg

SEQ ID NO: 822209 - DNA, 25 bp, Mus musculus
tgggtcgtgggctgcgccgacctgg

SEQ ID NO: 822210 - DNA, 25 bp, Mus musculus
tgggtctccaggaccatcagtttga

SEQ ID NO: 822211 - DNA, 25 bp, Mus musculus
tgggtctccaggtccatcagtttga

SEQ ID NO: 822212 - DNA, 25 bp, Mus musculus
tgggtctccatccacaacagagaag

SEQ ID NO: 822213 - DNA, 25 bp, Mus musculus
tgggtctccatcgacaacagagaag

SEQ ID NO: 822214 - DNA, 25 bp, Mus musculus
tgggtctcccaaatccagaagacaa

SEQ ID NO: 822215 - DNA, 25 bp, Mus musculus
tgggtctcccaattccagaagacaa

SEQ ID NO: 822216 - DNA, 25 bp, Mus musculus
tgggtctctcagacatgcataatga

SEQ ID NO: 822217 - DNA, 25 bp, Mus musculus
tgggtctctcagtcatgcataatga

SEQ ID NO: 822218 - DNA, 25 bp, Mus musculus
tgggtctgaagacgcccaaacccga

SEQ ID NO: 822219 - DNA, 25 bp, Mus musculus
tgggtctgaagaggcccaaacccga

SEQ ID NO: 822220 - DNA, 25 bp, Mus musculus
tgggtctgaaggcagagctattatc

SEQ ID NO: 822221 - DNA, 25 bp, Mus musculus
tgggtctgaagggagagctattatc

SEQ ID NO: 822222 - DNA, 25 bp, Mus musculus
tgggtctgacctagatgcgagctgt

SEQ ID NO: 822223 - DNA, 25 bp, Mus musculus
tgggtctgaccttgatgcgagctgt

SEQ ID NO: 822224 - DNA, 25 bp, Mus musculus
tgggtctgcagacatgtggctttgg

SEQ ID NO: 822225 - DNA, 25 bp, Mus musculus
tgggtctgcagagatgtggctttgg

SEQ ID NO: 822226 - DNA, 25 bp, Mus musculus
tgggtctgctccaccgtgccaggat

SEQ ID NO: 822227 - DNA, 25 bp, Mus musculus
tgggtctgctcctccgtgccaggat

SEQ ID NO: 822228 - DNA, 25 bp, Mus musculus
tgggtctgctggaagcgctgctccc

SEQ ID NO: 822229 - DNA, 25 bp, Mus musculus
tgggtctgctggtagcgctgctccc

SEQ ID NO: 822230 - DNA, 25 bp, Mus musculus
tgggtctggccgctctcctgacatg

SEQ ID NO: 822231 - DNA, 25 bp, Mus musculus
tgggtctggccggtctcctgacatg

SEQ ID NO: 822232 - DNA, 25 bp, Mus musculus
tgggtctgggtcaagctgcatggaa

SEQ ID NO: 822233 - DNA, 25 bp, Mus musculus
tgggtctgggtctagctgcatggaa

SEQ ID NO: 822234 - DNA, 25 bp, Mus musculus
tgggtctggttcaggatcccacgaa

SEQ ID NO: 822235 - DNA, 25 bp, Mus musculus
tgggtctggttctggatcccacgaa

SEQ ID NO: 822236 - DNA, 25 bp, Mus musculus
tgggtcttaccactctttggttcta

SEQ ID NO: 822237 - DNA, 25 bp, Mus musculus
tgggtcttaccagtctttggttcta

SEQ ID NO: 822238 - DNA, 25 bp, Mus musculus
tgggtcttatgacattggcatggcc

SEQ ID NO: 822239 - DNA, 25 bp, Mus musculus
tgggtcttatgagattggcatggcc

SEQ ID NO: 822240 - DNA, 25 bp, Mus musculus
tgggtcttcaggcacatgcatcagc

SEQ ID NO: 822241 - DNA, 25 bp, Mus musculus
tgggtcttcagggacatgcatcagc

SEQ ID NO: 822242 - DNA, 25 bp, Mus musculus
tgggtcttccgcaggattgcgaagt

SEQ ID NO: 822243 - DNA, 25 bp, Mus musculus
tgggtcttccgctggattgcgaagt

SEQ ID NO: 822244 - DNA, 25 bp, Mus musculus
tgggtcttctctcggattcctgtcc

SEQ ID NO: 822245 - DNA, 25 bp, Mus musculus
tgggtcttctctgggattcctgtcc

SEQ ID NO: 822246 - DNA, 25 bp, Mus musculus
tgggtcttggtgctctccatttcac

SEQ ID NO: 822247 - DNA, 25 bp, Mus musculus
tgggtcttggtggtctccatttcac

SEQ ID NO: 822248 - DNA, 25 bp, Mus musculus
tgggtcttgtcaatccaggagagtg

SEQ ID NO: 822249 - DNA, 25 bp, Mus musculus
tgggtcttgtcattccaggagagtg

SEQ ID NO: 822250 - DNA, 25 bp, Mus musculus
tgggtcttgttacagtttatctggg

SEQ ID NO: 822251 - DNA, 25 bp, Mus musculus
tgggtcttgttagagtttatctggg

SEQ ID NO: 822252 - DNA, 25 bp, Mus musculus
tgggtgaacacgagctggagatctg

SEQ ID NO: 822253 - DNA, 25 bp, Mus musculus
tgggtgaacacgtgctggagatctg

SEQ ID NO: 822254 - DNA, 25 bp, Mus musculus
tgggtgaagaagctattagcacttt

SEQ ID NO: 822255 - DNA, 25 bp, Mus musculus
tgggtgaagaaggtattagcacttt

SEQ ID NO: 822256 - DNA, 25 bp, Mus musculus
tgggtgacaggtacaatcgaaagta

SEQ ID NO: 822257 - DNA, 25 bp, Mus musculus
tgggtgacaggttcaatcgaaagta

SEQ ID NO: 822258 - DNA, 25 bp, Mus musculus
tgggtgacagtgagtaccttcctcc

SEQ ID NO: 822259 - DNA, 25 bp, Mus musculus
tgggtgacagtgtgtaccttcctcc

SEQ ID NO: 822260 - DNA, 25 bp, Mus musculus
tgggtgacatccaataaagtcatgg

SEQ ID NO: 822261 - DNA, 25 bp, Mus musculus
tgggtgacatcctataaagtcatgg

SEQ ID NO: 822262 - DNA, 25 bp, Mus musculus
tgggtgacatctctacctccttgcg

SEQ ID NO: 822263 - DNA, 25 bp, Mus musculus
tgggtgacatctgtacctccttgcg

SEQ ID NO: 822264 - DNA, 25 bp, Mus musculus
tgggtgacatgaccaacagcgactt

SEQ ID NO: 822265 - DNA, 25 bp, Mus musculus
tgggtgacatgagcaacagcgactt

SEQ ID NO: 822266 - DNA, 25 bp, Mus musculus
tgggtgacgcccaataagatcgccg

SEQ ID NO: 822267 - DNA, 25 bp, Mus musculus
tgggtgacgccctataagatcgccg

SEQ ID NO: 822268 - DNA, 25 bp, Mus musculus
tgggtgacttttcaccgcagtgtta

SEQ ID NO: 822269 - DNA, 25 bp, Mus musculus
tgggtgacttttgaccgcagtgtta

SEQ ID NO: 822270 - DNA, 25 bp, Mus musculus
tgggtgagaaaacaggccacgactt

SEQ ID NO: 822271 - DNA, 25 bp, Mus musculus
tgggtgagaaaagaggccacgactt

SEQ ID NO: 822272 - DNA, 25 bp, Mus musculus
tgggtgagcaagcacattaagaagc

SEQ ID NO: 822273 - DNA, 25 bp, Mus musculus
tgggtgagcaaggacattaagaagc

SEQ ID NO: 822274 - DNA, 25 bp, Mus musculus
tgggtgagcctcctggcttcctgca

SEQ ID NO: 822275 - DNA, 25 bp, Mus musculus
tgggtgagcctcgtggcttcctgca

SEQ ID NO: 822276 - DNA, 25 bp, Mus musculus
tgggtgagctccaactacccctggg

SEQ ID NO: 822277 - DNA, 25 bp, Mus musculus
tgggtgagctcctactacccctggg

SEQ ID NO: 822278 - DNA, 25 bp, Mus musculus
tgggtgaggaaccacctttggctat

SEQ ID NO: 822279 - DNA, 25 bp, Mus musculus
tgggtgaggaacgacctttggctat

SEQ ID NO: 822280 - DNA, 25 bp, Mus musculus
tgggtgagggcaacagctccatcac

SEQ ID NO: 822281 - DNA, 25 bp, Mus musculus
tgggtgagggcatcagctccatcac

SEQ ID NO: 822282 - DNA, 25 bp, Mus musculus
tgggtgagtgccacctccctgtcaa

SEQ ID NO: 822283 - DNA, 25 bp, Mus musculus
tgggtgagtgcctcctccctgtcaa

SEQ ID NO: 822284 - DNA, 25 bp, Mus musculus
tgggtgatacctccctgaggatatt

SEQ ID NO: 822285 - DNA, 25 bp, Mus musculus
tgggtgatacctgcctgaggatatt

SEQ ID NO: 822286 - DNA, 25 bp, Mus musculus
tgggtgatcacccactgtgcctcca

SEQ ID NO: 822287 - DNA, 25 bp, Mus musculus
tgggtgatcaccgactgtgcctcca

SEQ ID NO: 822288 - DNA, 25 bp, Mus musculus
tgggtgatggaacgcctgcttcttt

SEQ ID NO: 822289 - DNA, 25 bp, Mus musculus
tgggtgatggaaggcctgcttcttt

SEQ ID NO: 822290 - DNA, 25 bp, Mus musculus
tgggtgatgttcaggaggccaagat

SEQ ID NO: 822291 - DNA, 25 bp, Mus musculus
tgggtgatgttctggaggccaagat

SEQ ID NO: 822292 - DNA, 25 bp, Mus musculus
tgggtgcaggcaatcacacatggac

SEQ ID NO: 822293 - DNA, 25 bp, Mus musculus
tgggtgcaggcattcacacatggac

SEQ ID NO: 822294 - DNA, 25 bp, Mus musculus
tgggtgcaggtcctttgctttgctt

SEQ ID NO: 822295 - DNA, 25 bp, Mus musculus
tgggtgcaggtcgtttgctttgctt

SEQ ID NO: 822296 - DNA, 25 bp, Mus musculus
tgggtgcatacaaccagtgtttgcc

SEQ ID NO: 822297 - DNA, 25 bp, Mus musculus
tgggtgcatacatccagtgtttgcc

SEQ ID NO: 822298 - DNA, 25 bp, Mus musculus
tgggtgccagcaaacccttcagatt

SEQ ID NO: 822299 - DNA, 25 bp, Mus musculus
tgggtgccagcaagacctttgttgt

SEQ ID NO: 822300 - DNA, 25 bp, Mus musculus
tgggtgccagcatacccttcagatt

SEQ ID NO: 822301 - DNA, 25 bp, Mus musculus
tgggtgccagcatgacctttgttgt

SEQ ID NO: 822302 - DNA, 25 bp, Mus musculus
tgggtgcccacgacctgctgagctc

SEQ ID NO: 822303 - DNA, 25 bp, Mus musculus
tgggtgcccacgtcctgctgagctc

SEQ ID NO: 822304 - DNA, 25 bp, Mus musculus
tgggtgcccgttagcaggaaacagt

SEQ ID NO: 822305 - DNA, 25 bp, Mus musculus
tgggtgcccgtttgcaggaaacagt

SEQ ID NO: 822306 - DNA, 25 bp, Mus musculus
tgggtgccctaaccatgtggcatgc

SEQ ID NO: 822307 - DNA, 25 bp, Mus musculus
tgggtgccctaagcatgtggcatgc

SEQ ID NO: 822308 - DNA, 25 bp, Mus musculus
tgggtgcctcaccaaattataaagg

SEQ ID NO: 822309 - DNA, 25 bp, Mus musculus
tgggtgcctcacgaaattataaagg

SEQ ID NO: 822310 - DNA, 25 bp, Mus musculus
tgggtgcctgcaaaagacatcagta

SEQ ID NO: 822311 - DNA, 25 bp, Mus musculus
tgggtgcctgcataagacatcagta

SEQ ID NO: 822312 - DNA, 25 bp, Mus musculus
tgggtgctgagaaccacgtggcttc

SEQ ID NO: 822313 - DNA, 25 bp, Mus musculus
tgggtgctgagatccacgtggcttc

SEQ ID NO: 822314 - DNA, 25 bp, Mus musculus
tgggtgctgctcaacgtctatgact

SEQ ID NO: 822315 - DNA, 25 bp, Mus musculus
tgggtgctgctctacgtctatgact

SEQ ID NO: 822316 - DNA, 25 bp, Mus musculus
tgggtgctgtcgaccccatcatgga

SEQ ID NO: 822317 - DNA, 25 bp, Mus musculus
tgggtgctgtcgtccccatcatgga

SEQ ID NO: 822318 - DNA, 25 bp, Mus musculus
tgggtgcttccaatgcagaacaact

SEQ ID NO: 822319 - DNA, 25 bp, Mus musculus
tgggtgcttccattgcagaacaact

SEQ ID NO: 822320 - DNA, 25 bp, Mus musculus
tgggtggaaactacagtcatctgat

SEQ ID NO: 822321 - DNA, 25 bp, Mus musculus
tgggtggaaacttcagtcatctgat

SEQ ID NO: 822322 - DNA, 25 bp, Mus musculus
tgggtggaccagaaacttaacaacg

SEQ ID NO: 822323 - DNA, 25 bp, Mus musculus
tgggtggaccagtaacttaacaacg

SEQ ID NO: 822324 - DNA, 25 bp, Mus musculus
tgggtggaccatccgtcttcatctt

SEQ ID NO: 822325 - DNA, 25 bp, Mus musculus
tgggtggaccatgcgtcttcatctt

SEQ ID NO: 822326 - DNA, 25 bp, Mus musculus
tgggtggacctgcaagctacttctg

SEQ ID NO: 822327 - DNA, 25 bp, Mus musculus
tgggtggacctggaagctacttctg

SEQ ID NO: 822328 - DNA, 25 bp, Mus musculus
tgggtggataagaatgccagactta

SEQ ID NO: 822329 - DNA, 25 bp, Mus musculus
tgggtggataagtatgccagactta

SEQ ID NO: 822330 - DNA, 25 bp, Mus musculus
tgggtggatactcacatgaactgtg

SEQ ID NO: 822331 - DNA, 25 bp, Mus musculus
tgggtggatactgacatgaactgtg

SEQ ID NO: 822332 - DNA, 25 bp, Mus musculus
tgggtggatttgctgctcagcctcc

SEQ ID NO: 822333 - DNA, 25 bp, Mus musculus
tgggtggatttggtgctcagcctcc

SEQ ID NO: 822334 - DNA, 25 bp, Mus musculus
tgggtggccagtagcatcagataac

SEQ ID NO: 822335 - DNA, 25 bp, Mus musculus
tgggtggccagttgcatcagataac

SEQ ID NO: 822336 - DNA, 25 bp, Mus musculus
tgggtggctccccataccccggtgt

SEQ ID NO: 822337 - DNA, 25 bp, Mus musculus
tgggtggctcccgataccccggtgt

SEQ ID NO: 822338 - DNA, 25 bp, Mus musculus
tgggtggctctcctgtggtcatcat

SEQ ID NO: 822339 - DNA, 25 bp, Mus musculus
tgggtggctctcgtgtggtcatcat

SEQ ID NO: 822340 - DNA, 25 bp, Mus musculus
tgggtggctgcaactccacaccctg

SEQ ID NO: 822341 - DNA, 25 bp, Mus musculus
tgggtggctgcatctccacaccctg

SEQ ID NO: 822342 - DNA, 25 bp, Mus musculus
tgggtggcttctcctcttttaggac

SEQ ID NO: 822343 - DNA, 25 bp, Mus musculus
tgggtggcttctgctcttttaggac

SEQ ID NO: 822344 - DNA, 25 bp, Mus musculus
tgggtgggaagaaccaatgagacac

SEQ ID NO: 822345 - DNA, 25 bp, Mus musculus
tgggtgggaagatccaatgagacac

SEQ ID NO: 822346 - DNA, 25 bp, Mus musculus
tgggtgggatggctggccttggcgc

SEQ ID NO: 822347 - DNA, 25 bp, Mus musculus
tgggtgggatgggtggccttggcgc

SEQ ID NO: 822348 - DNA, 25 bp, Mus musculus
tgggtgggccagaacatcactcaac

SEQ ID NO: 822349 - DNA, 25 bp, Mus musculus
tgggtgggccagtacatcactcaac

SEQ ID NO: 822350 - DNA, 25 bp, Mus musculus
tgggtggtagtgcttgacacatcaa

SEQ ID NO: 822351 - DNA, 25 bp, Mus musculus
tgggtggtagtggttgacacatcaa

SEQ ID NO: 822352 - DNA, 25 bp, Mus musculus
tgggtggtgaataagtcatctcagt

SEQ ID NO: 822353 - DNA, 25 bp, Mus musculus
tgggtggtgaattagtcatctcagt

SEQ ID NO: 822354 - DNA, 25 bp, Mus musculus
tgggtggtgccaagacccacaccac

SEQ ID NO: 822355 - DNA, 25 bp, Mus musculus
tgggtggtgccatgacccacaccac

SEQ ID NO: 822356 - DNA, 25 bp, Mus musculus
tgggtgtccactagtacgtgatgtc

SEQ ID NO: 822357 - DNA, 25 bp, Mus musculus
tgggtgtccacttgtacgtgatgtc

SEQ ID NO: 822358 - DNA, 25 bp, Mus musculus
tgggtgtccccacttttcctcctga

SEQ ID NO: 822359 - DNA, 25 bp, Mus musculus
tgggtgtccccagttttcctcctga

SEQ ID NO: 822360 - DNA, 25 bp, Mus musculus
tgggtgtctggaaccatctgggcca

SEQ ID NO: 822361 - DNA, 25 bp, Mus musculus
tgggtgtctggatccatctgggcca

SEQ ID NO: 822362 - DNA, 25 bp, Mus musculus
tgggtgtcttctatggctctactac

SEQ ID NO: 822363 - DNA, 25 bp, Mus musculus
tgggtgtcttctcggagcttcagaa

SEQ ID NO: 822364 - DNA, 25 bp, Mus musculus
tgggtgtcttctgggagcttcagaa

SEQ ID NO: 822365 - DNA, 25 bp, Mus musculus
tgggtgtcttctttggctctactac

SEQ ID NO: 822366 - DNA, 25 bp, Mus musculus
tgggtgtgacctccttcaagcggaa

SEQ ID NO: 822367 - DNA, 25 bp, Mus musculus
tgggtgtgacctgcttcaagcggaa

SEQ ID NO: 822368 - DNA, 25 bp, Mus musculus
tgggtgtgcagaaccttacatgcgc

SEQ ID NO: 822369 - DNA, 25 bp, Mus musculus
tgggtgtgcagatccttacatgcgc

SEQ ID NO: 822370 - DNA, 25 bp, Mus musculus
tgggtgtgctacctgacctttgtgc

SEQ ID NO: 822371 - DNA, 25 bp, Mus musculus
tgggtgtgctacgtgacctttgtgc

SEQ ID NO: 822372 - DNA, 25 bp, Mus musculus
tgggtgtggcatccctgactatcaa

SEQ ID NO: 822373 - DNA, 25 bp, Mus musculus
tgggtgtggcatgcctgactatcaa

SEQ ID NO: 822374 - DNA, 25 bp, Mus musculus
tgggtgtggccacaacaccgatact

SEQ ID NO: 822375 - DNA, 25 bp, Mus musculus
tgggtgtggccagaacaccgatact

SEQ ID NO: 822376 - DNA, 25 bp, Mus musculus
tgggtgtgtaaacagttcaaggacc

SEQ ID NO: 822377 - DNA, 25 bp, Mus musculus
tgggtgtgtaaagagttcaaggacc

SEQ ID NO: 822378 - DNA, 25 bp, Mus musculus
tgggtgtgttttactaagcatcgtc

SEQ ID NO: 822379 - DNA, 25 bp, Mus musculus
tgggtgtgtttttctaagcatcgtc

SEQ ID NO: 822380 - DNA, 25 bp, Mus musculus
tgggtgttccagctgggccctagaa

SEQ ID NO: 822381 - DNA, 25 bp, Mus musculus
tgggtgttccaggtgggccctagaa

SEQ ID NO: 822382 - DNA, 25 bp, Mus musculus
tgggtgttccttccggagtctccac

SEQ ID NO: 822383 - DNA, 25 bp, Mus musculus
tgggtgttccttgcggagtctccac

SEQ ID NO: 822384 - DNA, 25 bp, Mus musculus
tgggtgttctggacatttatggctt

SEQ ID NO: 822385 - DNA, 25 bp, Mus musculus
tgggtgttctggtcatttatggctt

SEQ ID NO: 822386 - DNA, 25 bp, Mus musculus
tgggtgttgccaaggacttgatact

SEQ ID NO: 822387 - DNA, 25 bp, Mus musculus
tgggtgttgccatggacttgatact

SEQ ID NO: 822388 - DNA, 25 bp, Mus musculus
tgggtgtttcatcccatttctgtga

SEQ ID NO: 822389 - DNA, 25 bp, Mus musculus
tgggtgtttcatgccatttctgtga

SEQ ID NO: 822390 - DNA, 25 bp, Mus musculus
tgggttaaaggaccagttagaactc

SEQ ID NO: 822391 - DNA, 25 bp, Mus musculus
tgggttaaaggagcagttagaactc

SEQ ID NO: 822392 - DNA, 25 bp, Mus musculus
tgggttaactttcggaaatgcaagt

SEQ ID NO: 822393 - DNA, 25 bp, Mus musculus
tgggttaactttgggaaatgcaagt

SEQ ID NO: 822394 - DNA, 25 bp, Mus musculus
tgggttaccaaaaagtcctataagg

SEQ ID NO: 822395 - DNA, 25 bp, Mus musculus
tgggttaccaaatagtcctataagg

SEQ ID NO: 822396 - DNA, 25 bp, Mus musculus
tgggttaccagtcggagatcttcag

SEQ ID NO: 822397 - DNA, 25 bp, Mus musculus
tgggttaccagtgggagatcttcag

SEQ ID NO: 822398 - DNA, 25 bp, Mus musculus
tgggttacctcaccctgtcttagca

SEQ ID NO: 822399 - DNA, 25 bp, Mus musculus
tgggttacctcagcctgtcttagca

SEQ ID NO: 822400 - DNA, 25 bp, Mus musculus
tgggttatccgcagtctccagcggt

SEQ ID NO: 822401 - DNA, 25 bp, Mus musculus
tgggttatccgctgtctccagcggt

SEQ ID NO: 822402 - DNA, 25 bp, Mus musculus
tgggttcaagacctggccgggtcac

SEQ ID NO: 822403 - DNA, 25 bp, Mus musculus
tgggttcaagacgtggccgggtcac

SEQ ID NO: 822404 - DNA, 25 bp, Mus musculus
tgggttcaagccatgccaggcctgc

SEQ ID NO: 822405 - DNA, 25 bp, Mus musculus
tgggttcaagccttgccaggcctgc

SEQ ID NO: 822406 - DNA, 25 bp, Mus musculus
tgggttcagaacagggaccaaagcc

SEQ ID NO: 822407 - DNA, 25 bp, Mus musculus
tgggttcagaactgggaccaaagcc

SEQ ID NO: 822408 - DNA, 25 bp, Mus musculus
tgggttcagcagctcgtcagaaaag

SEQ ID NO: 822409 - DNA, 25 bp, Mus musculus
tgggttcagcaggtcgtcagaaaag

SEQ ID NO: 822410 - DNA, 25 bp, Mus musculus
tgggttcagcgaacaatctcagagc

SEQ ID NO: 822411 - DNA, 25 bp, Mus musculus
tgggttcagcgatcaatctcagagc

SEQ ID NO: 822412 - DNA, 25 bp, Mus musculus
tgggttcagcggacccacccacgag

SEQ ID NO: 822413 - DNA, 25 bp, Mus musculus
tgggttcagcggtcccacccacgag

SEQ ID NO: 822414 - DNA, 25 bp, Mus musculus
tgggttcccaccaagccaaagacgt

SEQ ID NO: 822415 - DNA, 25 bp, Mus musculus
tgggttcccacctagccaaagacgt

SEQ ID NO: 822416 - DNA, 25 bp, Mus musculus
tgggttcccctactacagttcttgc

SEQ ID NO: 822417 - DNA, 25 bp, Mus musculus
tgggttcccctagtacagttcttgc

SEQ ID NO: 822418 - DNA, 25 bp, Mus musculus
tgggttccctcacggctatgacaca

SEQ ID NO: 822419 - DNA, 25 bp, Mus musculus
tgggttccctcagggctatgacaca

SEQ ID NO: 822420 - DNA, 25 bp, Mus musculus
tgggttccgccaagactgagaaaac

SEQ ID NO: 822421 - DNA, 25 bp, Mus musculus
tgggttccgccatgactgagaaaac

SEQ ID NO: 822422 - DNA, 25 bp, Mus musculus
tgggttcctctgaccgtgcttggcg

SEQ ID NO: 822423 - DNA, 25 bp, Mus musculus
tgggttcctctgtccgtgcttggcg

SEQ ID NO: 822424 - DNA, 25 bp, Mus musculus
tgggttcgacacacatcctatgaat

SEQ ID NO: 822425 - DNA, 25 bp, Mus musculus
tgggttcgacactcatcctatgaat

SEQ ID NO: 822426 - DNA, 25 bp, Mus musculus
tgggttctacatcggcactagggtc

SEQ ID NO: 822427 - DNA, 25 bp, Mus musculus
tgggttctacatgggcactagggtc

SEQ ID NO: 822428 - DNA, 25 bp, Mus musculus
tgggttctatgaagagtgcttacgg

SEQ ID NO: 822429 - DNA, 25 bp, Mus musculus
tgggttctatgatgagtgcttacgg

SEQ ID NO: 822430 - DNA, 25 bp, Mus musculus
tgggttctcaatcatgaagatgttt

SEQ ID NO: 822431 - DNA, 25 bp, Mus musculus
tgggttctcaatgatgaagatgttt

SEQ ID NO: 822432 - DNA, 25 bp, Mus musculus
tgggttctctggacgccatggagaa

SEQ ID NO: 822433 - DNA, 25 bp, Mus musculus
tgggttctctggtcgccatggagaa

SEQ ID NO: 822434 - DNA, 25 bp, Mus musculus
tgggttctgagcacgtggacacgta

SEQ ID NO: 822435 - DNA, 25 bp, Mus musculus
tgggttctgagctcgtggacacgta

SEQ ID NO: 822436 - DNA, 25 bp, Mus musculus
tgggttctgtctcgaatacctcccc

SEQ ID NO: 822437 - DNA, 25 bp, Mus musculus
tgggttctgtctggaatacctcccc

SEQ ID NO: 822438 - DNA, 25 bp, Mus musculus
tgggttgaagacactcctggcccgg

SEQ ID NO: 822439 - DNA, 25 bp, Mus musculus
tgggttgaagactctcctggcccgg

SEQ ID NO: 822440 - DNA, 25 bp, Mus musculus
tgggttgcaggcctttttccaggtt

SEQ ID NO: 822441 - DNA, 25 bp, Mus musculus
tgggttgcaggcgtttttccaggtt

SEQ ID NO: 822442 - DNA, 25 bp, Mus musculus
tgggttgccctcataacaaagttgg

SEQ ID NO: 822443 - DNA, 25 bp, Mus musculus
tgggttgccctcttaacaaagttgg

SEQ ID NO: 822444 - DNA, 25 bp, Mus musculus
tgggttgcctggatctggtgcccca

SEQ ID NO: 822445 - DNA, 25 bp, Mus musculus
tgggttgcctggttctggtgcccca

SEQ ID NO: 822446 - DNA, 25 bp, Mus musculus
tgggttgcctgtcagaattacaaga

SEQ ID NO: 822447 - DNA, 25 bp, Mus musculus
tgggttgcctgtgagaattacaaga

SEQ ID NO: 822448 - DNA, 25 bp, Mus musculus
tgggttgctggcactggccaagttt

SEQ ID NO: 822449 - DNA, 25 bp, Mus musculus
tgggttgctggctctggccaagttt

SEQ ID NO: 822450 - DNA, 25 bp, Mus musculus
tgggttggctgcatgtgcgcaaaca

SEQ ID NO: 822451 - DNA, 25 bp, Mus musculus
tgggttggctgcttgtgcgcaaaca

SEQ ID NO: 822452 - DNA, 25 bp, Mus musculus
tgggttggctggaacgccttcatca

SEQ ID NO: 822453 - DNA, 25 bp, Mus musculus
tgggttggctggtacgccttcatca

SEQ ID NO: 822454 - DNA, 25 bp, Mus musculus
tgggttgggccacctcttcactgct

SEQ ID NO: 822455 - DNA, 25 bp, Mus musculus
tgggttgggccagctcttcactgct

SEQ ID NO: 822456 - DNA, 25 bp, Mus musculus
tgggttgggctacctgtcccattgt

SEQ ID NO: 822457 - DNA, 25 bp, Mus musculus
tgggttgggctagctgtcccattgt

SEQ ID NO: 822458 - DNA, 25 bp, Mus musculus
tgggttgtcaacatctgcaatagca

SEQ ID NO: 822459 - DNA, 25 bp, Mus musculus
tgggttgtcaacttctgcaatagca

SEQ ID NO: 822460 - DNA, 25 bp, Mus musculus
tgggttgttcccagctgtgactgct

SEQ ID NO: 822461 - DNA, 25 bp, Mus musculus
tgggttgttccctgctgtgactgct

SEQ ID NO: 822462 - DNA, 25 bp, Mus musculus
tgggttgttgcgacaaggcccagac

SEQ ID NO: 822463 - DNA, 25 bp, Mus musculus
tgggttgttgcgtcaaggcccagac

SEQ ID NO: 822464 - DNA, 25 bp, Mus musculus
tgggtttaattcaccccagcatacc

SEQ ID NO: 822465 - DNA, 25 bp, Mus musculus
tgggtttaattctccccagcatacc

SEQ ID NO: 822466 - DNA, 25 bp, Mus musculus
tgggtttacgatcaagatgttggca

SEQ ID NO: 822467 - DNA, 25 bp, Mus musculus
tgggtttacgatgaagatgttggca

SEQ ID NO: 822468 - DNA, 25 bp, Mus musculus
tgggtttactgcagctccatctccc

SEQ ID NO: 822469 - DNA, 25 bp, Mus musculus
tgggtttactgctgctccatctccc

SEQ ID NO: 822470 - DNA, 25 bp, Mus musculus
tgggtttagtggacacagaaatgga

SEQ ID NO: 822471 - DNA, 25 bp, Mus musculus
tgggtttagtggtcacagaaatgga

SEQ ID NO: 822472 - DNA, 25 bp, Mus musculus
tgggtttatagtcgccactgtcgaa

SEQ ID NO: 822473 - DNA, 25 bp, Mus musculus
tgggtttatagtggccactgtcgaa

SEQ ID NO: 822474 - DNA, 25 bp, Mus musculus
tgggtttattgaccagatcgatgga

SEQ ID NO: 822475 - DNA, 25 bp, Mus musculus
tgggtttattgagcagatcgatgga

SEQ ID NO: 822476 - DNA, 25 bp, Mus musculus
tgggtttcaccgagttctctgtttg

SEQ ID NO: 822477 - DNA, 25 bp, Mus musculus
tgggtttcaccgtgttctctgtttg

SEQ ID NO: 822478 - DNA, 25 bp, Mus musculus
tgggtttcagtgaagcgctatgtcc

SEQ ID NO: 822479 - DNA, 25 bp, Mus musculus
tgggtttcagtgtagcgctatgtcc

SEQ ID NO: 822480 - DNA, 25 bp, Mus musculus
tgggtttcgcttactgagaatcatc

SEQ ID NO: 822481 - DNA, 25 bp, Mus musculus
tgggtttcgctttctgagaatcatc

SEQ ID NO: 822482 - DNA, 25 bp, Mus musculus
tgggtttctcatccaggctgtcgac

SEQ ID NO: 822483 - DNA, 25 bp, Mus musculus
tgggtttctcatgcaggctgtcgac

SEQ ID NO: 822484 - DNA, 25 bp, Mus musculus
tgggtttgacaaaccctaagacatt

SEQ ID NO: 822485 - DNA, 25 bp, Mus musculus
tgggtttgacaatccctaagacatt

SEQ ID NO: 822486 - DNA, 25 bp, Mus musculus
tgggttttcccaacactctgcgtgg

SEQ ID NO: 822487 - DNA, 25 bp, Mus musculus
tgggttttcccatcactctgcgtgg

SEQ ID NO: 822488 - DNA, 25 bp, Mus musculus
tgggttttgcctctgcttgttgttg

SEQ ID NO: 822489 - DNA, 25 bp, Mus musculus
tgggttttgcctgtgcttgttgttg

SEQ ID NO: 822490 - DNA, 25 bp, Mus musculus
tgggttttgtctatggttgctacgt

SEQ ID NO: 822491 - DNA, 25 bp, Mus musculus
tgggttttgtctttggttgctacgt

SEQ ID NO: 822492 - DNA, 25 bp, Mus musculus
tgggtttttcgactgctgaccccag

SEQ ID NO: 822493 - DNA, 25 bp, Mus musculus
tgggtttttcgagtgctgaccccag

SEQ ID NO: 822494 - DNA, 25 bp, Mus musculus
tggtaaaaccatatcagaacctgcc

SEQ ID NO: 822495 - DNA, 25 bp, Mus musculus
tggtaaaaccatttcagaacctgcc

SEQ ID NO: 822496 - DNA, 25 bp, Mus musculus
tggtaaaaccggagcccctcttcag

SEQ ID NO: 822497 - DNA, 25 bp, Mus musculus
tggtaaaaccggtgcccctcttcag

SEQ ID NO: 822498 - DNA, 25 bp, Mus musculus
tggtaaaagacaccttgaagaggca

SEQ ID NO: 822499 - DNA, 25 bp, Mus musculus
tggtaaaagacagcttgaagaggca

SEQ ID NO: 822500 - DNA, 25 bp, Mus musculus
tggtaaaagccaagggttatccagc

SEQ ID NO: 822501 - DNA, 25 bp, Mus musculus
tggtaaaagccatgggttatccagc

SEQ ID NO: 822502 - DNA, 25 bp, Mus musculus
tggtaaacaataagatctccaagat

SEQ ID NO: 822503 - DNA, 25 bp, Mus musculus
tggtaaacaatatgatctccaagat

SEQ ID NO: 822504 - DNA, 25 bp, Mus musculus
tggtaaacagaaagctacctttcgg

SEQ ID NO: 822505 - DNA, 25 bp, Mus musculus
tggtaaacagaatgctacctttcgg

SEQ ID NO: 822506 - DNA, 25 bp, Mus musculus
tggtaaactaacaacacggtgcaag

SEQ ID NO: 822507 - DNA, 25 bp, Mus musculus
tggtaaactaactacacggtgcaag

SEQ ID NO: 822508 - DNA, 25 bp, Mus musculus
tggtaaactcttcggcgccagccca

SEQ ID NO: 822509 - DNA, 25 bp, Mus musculus
tggtaaactcttgggcgccagccca

SEQ ID NO: 822510 - DNA, 25 bp, Mus musculus
tggtaaactgtgagagataattaac

SEQ ID NO: 822511 - DNA, 25 bp, Mus musculus
tggtaaactgtgtgagataattaac

SEQ ID NO: 822512 - DNA, 25 bp, Mus musculus
tggtaaagacgaatggcctccggga

SEQ ID NO: 822513 - DNA, 25 bp, Mus musculus
tggtaaagacgattggcctccggga

SEQ ID NO: 822514 - DNA, 25 bp, Mus musculus
tggtaaagcaccagggacaacagct

SEQ ID NO: 822515 - DNA, 25 bp, Mus musculus
tggtaaagcacctgggacaacagct

SEQ ID NO: 822516 - DNA, 25 bp, Mus musculus
tggtaaagccggagatggagctcac

SEQ ID NO: 822517 - DNA, 25 bp, Mus musculus
tggtaaagccggtgatggagctcac

SEQ ID NO: 822518 - DNA, 25 bp, Mus musculus
tggtaaaggcctcggctggtgtttg

SEQ ID NO: 822519 - DNA, 25 bp, Mus musculus
tggtaaaggcctgggctggtgtttg

SEQ ID NO: 822520 - DNA, 25 bp, Mus musculus
tggtaacagaccatgatcttctggg

SEQ ID NO: 822521 - DNA, 25 bp, Mus musculus
tggtaacagaccttgatcttctggg

SEQ ID NO: 822522 - DNA, 25 bp, Mus musculus
tggtaacagggcacactccagagga

SEQ ID NO: 822523 - DNA, 25 bp, Mus musculus
tggtaacagggctcactccagagga

SEQ ID NO: 822524 - DNA, 25 bp, Mus musculus
tggtaacaggtaatgcacagacatg

SEQ ID NO: 822525 - DNA, 25 bp, Mus musculus
tggtaacaggtattgcacagacatg

SEQ ID NO: 822526 - DNA, 25 bp, Mus musculus
tggtaaccaaccctagggtacagag

SEQ ID NO: 822527 - DNA, 25 bp, Mus musculus
tggtaaccaaccgtagggtacagag

SEQ ID NO: 822528 - DNA, 25 bp, Mus musculus
tggtaaccgagcactctgttttctt

SEQ ID NO: 822529 - DNA, 25 bp, Mus musculus
tggtaaccgagctctctgttttctt

SEQ ID NO: 822530 - DNA, 25 bp, Mus musculus
tggtaaccgtccagaagctcctcag

SEQ ID NO: 822531 - DNA, 25 bp, Mus musculus
tggtaaccgtcctgaagctcctcag

SEQ ID NO: 822532 - DNA, 25 bp, Mus musculus
tggtaactactgaggttggtgtgca

SEQ ID NO: 822533 - DNA, 25 bp, Mus musculus
tggtaactactgtggttggtgtgca

SEQ ID NO: 822534 - DNA, 25 bp, Mus musculus
tggtaactgggaacttgtgggaaac

SEQ ID NO: 822535 - DNA, 25 bp, Mus musculus
tggtaactgggatcttgtgggaaac

SEQ ID NO: 822536 - DNA, 25 bp, Mus musculus
tggtaacttcgtccggctcatccag

SEQ ID NO: 822537 - DNA, 25 bp, Mus musculus
tggtaacttcgtgcggctcatccag

SEQ ID NO: 822538 - DNA, 25 bp, Mus musculus
tggtaacttgttctgcggagcgaac

SEQ ID NO: 822539 - DNA, 25 bp, Mus musculus
tggtaacttgttgtgcggagcgaac

SEQ ID NO: 822540 - DNA, 25 bp, Mus musculus
tggtaagagtataactcaaaaggcc

SEQ ID NO: 822541 - DNA, 25 bp, Mus musculus
tggtaagagtattactcaaaaggcc

SEQ ID NO: 822542 - DNA, 25 bp, Mus musculus
tggtaagataaaagctttcctaacg

SEQ ID NO: 822543 - DNA, 25 bp, Mus musculus
tggtaagataaatgctttcctaacg

SEQ ID NO: 822544 - DNA, 25 bp, Mus musculus
tggtaagatccacttcatgatgcca

SEQ ID NO: 822545 - DNA, 25 bp, Mus musculus
tggtaagatccagttcatgatgcca

SEQ ID NO: 822546 - DNA, 25 bp, Mus musculus
tggtaagattggacccaagaagcct

SEQ ID NO: 822547 - DNA, 25 bp, Mus musculus
tggtaagattggtcccaagaagcct

SEQ ID NO: 822548 - DNA, 25 bp, Mus musculus
tggtaagcactgagccaatgaggga

SEQ ID NO: 822549 - DNA, 25 bp, Mus musculus
tggtaagcactgtgccaatgaggga

SEQ ID NO: 822550 - DNA, 25 bp, Mus musculus
tggtaagctgccacgctggatccag

SEQ ID NO: 822551 - DNA, 25 bp, Mus musculus
tggtaagctgcctcgctggatccag

SEQ ID NO: 822552 - DNA, 25 bp, Mus musculus
tggtaagggccaatctgctcacaca

SEQ ID NO: 822553 - DNA, 25 bp, Mus musculus
tggtaagggccattctgctcacaca

SEQ ID NO: 822554 - DNA, 25 bp, Mus musculus
tggtaataccccatccctgagtcta

SEQ ID NO: 822555 - DNA, 25 bp, Mus musculus
tggtaataccccttccctgagtcta

SEQ ID NO: 822556 - DNA, 25 bp, Mus musculus
tggtaatgaccacgtagcaatcagc

SEQ ID NO: 822557 - DNA, 25 bp, Mus musculus
tggtaatgaccaggtagcaatcagc

SEQ ID NO: 822558 - DNA, 25 bp, Mus musculus
tggtaatgcccgaaggagcggacac

SEQ ID NO: 822559 - DNA, 25 bp, Mus musculus
tggtaatgcccgtaggagcggacac

SEQ ID NO: 822560 - DNA, 25 bp, Mus musculus
tggtaatggaacacagcacatattt

SEQ ID NO: 822561 - DNA, 25 bp, Mus musculus
tggtaatggaactcagcacatattt

SEQ ID NO: 822562 - DNA, 25 bp, Mus musculus
tggtaatggaagagatatcccgggc

SEQ ID NO: 822563 - DNA, 25 bp, Mus musculus
tggtaatggaagtgatatcccgggc

SEQ ID NO: 822564 - DNA, 25 bp, Mus musculus
tggtaattcatgcagactacaagaa

SEQ ID NO: 822565 - DNA, 25 bp, Mus musculus
tggtaattcatggagactacaagaa

SEQ ID NO: 822566 - DNA, 25 bp, Mus musculus
tggtacaaacccaggcgtcttctcc

SEQ ID NO: 822567 - DNA, 25 bp, Mus musculus
tggtacaaaccctggcgtcttctcc

SEQ ID NO: 822568 - DNA, 25 bp, Mus musculus
tggtacaagacaaaggagatcctgc

SEQ ID NO: 822569 - DNA, 25 bp, Mus musculus
tggtacaagacataggagatcctgc

SEQ ID NO: 822570 - DNA, 25 bp, Mus musculus
tggtacaatacacctgggagactgg

SEQ ID NO: 822571 - DNA, 25 bp, Mus musculus
tggtacaatacagctgggagactgg

SEQ ID NO: 822572 - DNA, 25 bp, Mus musculus
tggtacaatactcccacgcccagat

SEQ ID NO: 822573 - DNA, 25 bp, Mus musculus
tggtacaatactgccacgcccagat

SEQ ID NO: 822574 - DNA, 25 bp, Mus musculus
tggtacacacaaccaaagagctagg

SEQ ID NO: 822575 - DNA, 25 bp, Mus musculus
tggtacacacaagcaaagagctagg

SEQ ID NO: 822576 - DNA, 25 bp, Mus musculus
tggtacacagtgcacaaagcccctg

SEQ ID NO: 822577 - DNA, 25 bp, Mus musculus
tggtacacagtggacaaagcccctg

SEQ ID NO: 822578 - DNA, 25 bp, Mus musculus
tggtacacatggctcgacaatgcgt

SEQ ID NO: 822579 - DNA, 25 bp, Mus musculus
tggtacacatgggtcgacaatgcgt

SEQ ID NO: 822580 - DNA, 25 bp, Mus musculus
tggtacacccgaccagttccttcaa

SEQ ID NO: 822581 - DNA, 25 bp, Mus musculus
tggtacacccgagcagttccttcaa

SEQ ID NO: 822582 - DNA, 25 bp, Mus musculus
tggtacacgaacaggagctcagggc

SEQ ID NO: 822583 - DNA, 25 bp, Mus musculus
tggtacacgaactggagctcagggc

SEQ ID NO: 822584 - DNA, 25 bp, Mus musculus
tggtacagaggaacaaggctgtgga

SEQ ID NO: 822585 - DNA, 25 bp, Mus musculus
tggtacagaggatcaaggctgtgga

SEQ ID NO: 822586 - DNA, 25 bp, Mus musculus
tggtacagagggaaatgtaggaacc

SEQ ID NO: 822587 - DNA, 25 bp, Mus musculus
tggtacagagggtaatgtaggaacc

SEQ ID NO: 822588 - DNA, 25 bp, Mus musculus
tggtacagatggagcactatgggaa

SEQ ID NO: 822589 - DNA, 25 bp, Mus musculus
tggtacagatggtgcactatgggaa

SEQ ID NO: 822590 - DNA, 25 bp, Mus musculus
tggtacagattcagccctgcaccga

SEQ ID NO: 822591 - DNA, 25 bp, Mus musculus
tggtacagattctgccctgcaccga

SEQ ID NO: 822592 - DNA, 25 bp, Mus musculus
tggtacagcaggaatctccagcgcc

SEQ ID NO: 822593 - DNA, 25 bp, Mus musculus
tggtacagcaggtatctccagcgcc

SEQ ID NO: 822594 - DNA, 25 bp, Mus musculus
tggtacagccaactctcagcttctg

SEQ ID NO: 822595 - DNA, 25 bp, Mus musculus
tggtacagccaagtctcagcttctg

SEQ ID NO: 822596 - DNA, 25 bp, Mus musculus
tggtacagccatcataaaaacggct

SEQ ID NO: 822597 - DNA, 25 bp, Mus musculus
tggtacagccatgataaaaacggct

SEQ ID NO: 822598 - DNA, 25 bp, Mus musculus
tggtacagcgcccacctggaatact

SEQ ID NO: 822599 - DNA, 25 bp, Mus musculus
tggtacagcgccgacctggaatact

SEQ ID NO: 822600 - DNA, 25 bp, Mus musculus
tggtacagggttagtcctggccgta

SEQ ID NO: 822601 - DNA, 25 bp, Mus musculus
tggtacagggtttgtcctggccgta

SEQ ID NO: 822602 - DNA, 25 bp, Mus musculus
tggtacagttcaagatcaagaggca

SEQ ID NO: 822603 - DNA, 25 bp, Mus musculus
tggtacagttcatgatcaagaggca

SEQ ID NO: 822604 - DNA, 25 bp, Mus musculus
tggtacagttggagaggacactcag

SEQ ID NO: 822605 - DNA, 25 bp, Mus musculus
tggtacagttggtgaggacactcag

SEQ ID NO: 822606 - DNA, 25 bp, Mus musculus
tggtacatcacccaaagacatctct

SEQ ID NO: 822607 - DNA, 25 bp, Mus musculus
tggtacatcaccgaaagacatctct

SEQ ID NO: 822608 - DNA, 25 bp, Mus musculus
tggtacatcctgctggtcaccagtg

SEQ ID NO: 822609 - DNA, 25 bp, Mus musculus
tggtacatcctggtggtcaccagtg

SEQ ID NO: 822610 - DNA, 25 bp, Mus musculus
tggtacatgctgaagccttttctcg

SEQ ID NO: 822611 - DNA, 25 bp, Mus musculus
tggtacatgctgcttccgcttgcgc

SEQ ID NO: 822612 - DNA, 25 bp, Mus musculus
tggtacatgctggttccgcttgcgc

SEQ ID NO: 822613 - DNA, 25 bp, Mus musculus
tggtacatgctgtagccttttctcg

SEQ ID NO: 822614 - DNA, 25 bp, Mus musculus
tggtaccaagtcacagatcggcctt

SEQ ID NO: 822615 - DNA, 25 bp, Mus musculus
tggtaccaagtctcagatcggcctt

SEQ ID NO: 822616 - DNA, 25 bp, Mus musculus
tggtaccagctacgccctccaggga

SEQ ID NO: 822617 - DNA, 25 bp, Mus musculus
tggtaccagctaggccctccaggga

SEQ ID NO: 822618 - DNA, 25 bp, Mus musculus
tggtaccagcttcgccttgtgtaac

SEQ ID NO: 822619 - DNA, 25 bp, Mus musculus
tggtaccagcttggccttgtgtaac

SEQ ID NO: 822620 - DNA, 25 bp, Mus musculus
tggtaccatcgacctgtgcctggtg

SEQ ID NO: 822621 - DNA, 25 bp, Mus musculus
tggtaccatcgagctgtgcctggtg

SEQ ID NO: 822622 - DNA, 25 bp, Mus musculus
tggtaccatgccatacggatgtggc

SEQ ID NO: 822623 - DNA, 25 bp, Mus musculus
tggtaccatgccttacggatgtggc

SEQ ID NO: 822624 - DNA, 25 bp, Mus musculus
tggtaccatgttaacttcctgccct

SEQ ID NO: 822625 - DNA, 25 bp, Mus musculus
tggtaccatgtttacttcctgccct

SEQ ID NO: 822626 - DNA, 25 bp, Mus musculus
tggtacccaaagcacagtaaagccg

SEQ ID NO: 822627 - DNA, 25 bp, Mus musculus
tggtacccaaaggacagtaaagccg

SEQ ID NO: 822628 - DNA, 25 bp, Mus musculus
tggtacccacacatgacactgagaa

SEQ ID NO: 822629 - DNA, 25 bp, Mus musculus
tggtacccacacttgacactgagaa

SEQ ID NO: 822630 - DNA, 25 bp, Mus musculus
tggtacccacgcaggctgaagccat

SEQ ID NO: 822631 - DNA, 25 bp, Mus musculus
tggtacccacgctggctgaagccat

SEQ ID NO: 822632 - DNA, 25 bp, Mus musculus
tggtacccacttcccatgcagaggc

SEQ ID NO: 822633 - DNA, 25 bp, Mus musculus
tggtacccacttgccatgcagaggc

SEQ ID NO: 822634 - DNA, 25 bp, Mus musculus
tggtacccagcactctacggtgcct

SEQ ID NO: 822635 - DNA, 25 bp, Mus musculus
tggtacccagcagtctacggtgcct

SEQ ID NO: 822636 - DNA, 25 bp, Mus musculus
tggtaccccagtaagacatggaggg

SEQ ID NO: 822637 - DNA, 25 bp, Mus musculus
tggtaccccagttagacatggaggg

SEQ ID NO: 822638 - DNA, 25 bp, Mus musculus
tggtacccgggcattgactcaacag

SEQ ID NO: 822639 - DNA, 25 bp, Mus musculus
tggtacccgggctttgactcaacag

SEQ ID NO: 822640 - DNA, 25 bp, Mus musculus
tggtaccctagaaaaaactgcactg

SEQ ID NO: 822641 - DNA, 25 bp, Mus musculus
tggtaccctagataaaactgcactg

SEQ ID NO: 822642 - DNA, 25 bp, Mus musculus
tggtaccgcaggatccaggaaagca

SEQ ID NO: 822643 - DNA, 25 bp, Mus musculus
tggtaccgcaggttccaggaaagca

SEQ ID NO: 822644 - DNA, 25 bp, Mus musculus
tggtaccgtgcactatcggtcccgg

SEQ ID NO: 822645 - DNA, 25 bp, Mus musculus
tggtaccgtgcagtatcggtcccgg

SEQ ID NO: 822646 - DNA, 25 bp, Mus musculus
tggtacctactgctacctgggcaga

SEQ ID NO: 822647 - DNA, 25 bp, Mus musculus
tggtacctactggtacctgggcaga

SEQ ID NO: 822648 - DNA, 25 bp, Mus musculus
tggtacctcaagcatgaggcccggc

SEQ ID NO: 822649 - DNA, 25 bp, Mus musculus
tggtacctcaaggatgaggcccggc

SEQ ID NO: 822650 - DNA, 25 bp, Mus musculus
tggtacctccccagagggtatcgga

SEQ ID NO: 822651 - DNA, 25 bp, Mus musculus
tggtacctcccctgagggtatcgga

SEQ ID NO: 822652 - DNA, 25 bp, Mus musculus
tggtacctgccaagacagctatggt

SEQ ID NO: 822653 - DNA, 25 bp, Mus musculus
tggtacctgccatgacagctatggt

SEQ ID NO: 822654 - DNA, 25 bp, Mus musculus
tggtacctgcccagatgggagatgc

SEQ ID NO: 822655 - DNA, 25 bp, Mus musculus
tggtacctgccctgatgggagatgc

SEQ ID NO: 822656 - DNA, 25 bp, Mus musculus
tggtacctgttgcagcccggttgct

SEQ ID NO: 822657 - DNA, 25 bp, Mus musculus
tggtacctgttggagcccggttgct

SEQ ID NO: 822658 - DNA, 25 bp, Mus musculus
tggtaccttccaacttggtcaacaa

SEQ ID NO: 822659 - DNA, 25 bp, Mus musculus
tggtaccttccatcttggtcaacaa

SEQ ID NO: 822660 - DNA, 25 bp, Mus musculus
tggtaccttcttagtcagagatgca

SEQ ID NO: 822661 - DNA, 25 bp, Mus musculus
tggtaccttctttgtcagagatgca

SEQ ID NO: 822662 - DNA, 25 bp, Mus musculus
tggtacgaaactccacccatcgagg

SEQ ID NO: 822663 - DNA, 25 bp, Mus musculus
tggtacgaaactgcacccatcgagg

SEQ ID NO: 822664 - DNA, 25 bp, Mus musculus
tggtacgaactccacaggtcctggg

SEQ ID NO: 822665 - DNA, 25 bp, Mus musculus
tggtacgaactcgacaggtcctggg

SEQ ID NO: 822666 - DNA, 25 bp, Mus musculus
tggtacgaagggatatcgggctctc

SEQ ID NO: 822667 - DNA, 25 bp, Mus musculus
tggtacgaagggttatcgggctctc

SEQ ID NO: 822668 - DNA, 25 bp, Mus musculus
tggtacgaatcaatgcctccggagg

SEQ ID NO: 822669 - DNA, 25 bp, Mus musculus
tggtacgaatcattgcctccggagg

SEQ ID NO: 822670 - DNA, 25 bp, Mus musculus
tggtacgccaccaggatgcctgtga

SEQ ID NO: 822671 - DNA, 25 bp, Mus musculus
tggtacgccacctggatgcctgtga

SEQ ID NO: 822672 - DNA, 25 bp, Mus musculus
tggtacggctacatctgccctctgt

SEQ ID NO: 822673 - DNA, 25 bp, Mus musculus
tggtacggctacttctgccctctgt

SEQ ID NO: 822674 - DNA, 25 bp, Mus musculus
tggtacgggagaaagaaccgccaag

SEQ ID NO: 822675 - DNA, 25 bp, Mus musculus
tggtacgggagatagaaccgccaag

SEQ ID NO: 822676 - DNA, 25 bp, Mus musculus
tggtacggtttgcagagactcttcc

SEQ ID NO: 822677 - DNA, 25 bp, Mus musculus
tggtacggtttggagagactcttcc

SEQ ID NO: 822678 - DNA, 25 bp, Mus musculus
tggtacgtcagcctggagagaaaaa

SEQ ID NO: 822679 - DNA, 25 bp, Mus musculus
tggtacgtcagcgtggagagaaaaa

SEQ ID NO: 822680 - DNA, 25 bp, Mus musculus
tggtacgtgggcagagtgcgggagc

SEQ ID NO: 822681 - DNA, 25 bp, Mus musculus
tggtacgtgggctgagtgcgggagc

SEQ ID NO: 822682 - DNA, 25 bp, Mus musculus
tggtactacatcacaccaaggctca

SEQ ID NO: 822683 - DNA, 25 bp, Mus musculus
tggtactacatctcaccaaggctca

SEQ ID NO: 822684 - DNA, 25 bp, Mus musculus
tggtactaccaacagagcacagtct

SEQ ID NO: 822685 - DNA, 25 bp, Mus musculus
tggtactaccaagagagcacagtct

SEQ ID NO: 822686 - DNA, 25 bp, Mus musculus
tggtactcctggagctgtgggtctc

SEQ ID NO: 822687 - DNA, 25 bp, Mus musculus
tggtactcctggtgctgtgggtctc

SEQ ID NO: 822688 - DNA, 25 bp, Mus musculus
tggtactctcaacccagtggacgaa

SEQ ID NO: 822689 - DNA, 25 bp, Mus musculus
tggtactctcaagccagtggacgaa

SEQ ID NO: 822690 - DNA, 25 bp, Mus musculus
tggtactgctcacgctaataagaag

SEQ ID NO: 822691 - DNA, 25 bp, Mus musculus
tggtactgctcaggctaataagaag

SEQ ID NO: 822692 - DNA, 25 bp, Mus musculus
tggtactggcagcagaccctcggca

SEQ ID NO: 822693 - DNA, 25 bp, Mus musculus
tggtactggcaggagaccctcggca

SEQ ID NO: 822694 - DNA, 25 bp, Mus musculus
tggtactttggaaaacttggccgca

SEQ ID NO: 822695 - DNA, 25 bp, Mus musculus
tggtactttggataacttggccgca

SEQ ID NO: 822696 - DNA, 25 bp, Mus musculus
tggtagaagagtaaatcctttctgg

SEQ ID NO: 822697 - DNA, 25 bp, Mus musculus
tggtagaagagttaatcctttctgg

SEQ ID NO: 822698 - DNA, 25 bp, Mus musculus
tggtagacaggaccctcacagacat

SEQ ID NO: 822699 - DNA, 25 bp, Mus musculus
tggtagacaggagcctcacagacat

SEQ ID NO: 822700 - DNA, 25 bp, Mus musculus
tggtagagatcgacgggatgaaact

SEQ ID NO: 822701 - DNA, 25 bp, Mus musculus
tggtagagatcgtcgggatgaaact

SEQ ID NO: 822702 - DNA, 25 bp, Mus musculus
tggtagagcaagactactcccattc

SEQ ID NO: 822703 - DNA, 25 bp, Mus musculus
tggtagagcaagtctactcccattc

SEQ ID NO: 822704 - DNA, 25 bp, Mus musculus
tggtagagcctgactttgtgatgac

SEQ ID NO: 822705 - DNA, 25 bp, Mus musculus
tggtagagcctgtctttgtgatgac

SEQ ID NO: 822706 - DNA, 25 bp, Mus musculus
tggtagaggcctagtctgcttccct

SEQ ID NO: 822707 - DNA, 25 bp, Mus musculus
tggtagaggccttgtctgcttccct

SEQ ID NO: 822708 - DNA, 25 bp, Mus musculus
tggtagaggcggcaaacctcctcat

SEQ ID NO: 822709 - DNA, 25 bp, Mus musculus
tggtagaggcgggaaacctcctcat

SEQ ID NO: 822710 - DNA, 25 bp, Mus musculus
tggtagagtcagacatcaacggcct

SEQ ID NO: 822711 - DNA, 25 bp, Mus musculus
tggtagagtcagtcatcaacggcct

SEQ ID NO: 822712 - DNA, 25 bp, Mus musculus
tggtagatgccactcctggccagcg

SEQ ID NO: 822713 - DNA, 25 bp, Mus musculus
tggtagatgccagtcctggccagcg

SEQ ID NO: 822714 - DNA, 25 bp, Mus musculus
tggtagcagtaaaagcagccattcg

SEQ ID NO: 822715 - DNA, 25 bp, Mus musculus
tggtagcagtaatagcagccattcg

SEQ ID NO: 822716 - DNA, 25 bp, Mus musculus
tggtagcagtgaatgacccattcat

SEQ ID NO: 822717 - DNA, 25 bp, Mus musculus
tggtagcagtgattgacccattcat

SEQ ID NO: 822718 - DNA, 25 bp, Mus musculus
tggtagccaaacaggaattgattga

SEQ ID NO: 822719 - DNA, 25 bp, Mus musculus
tggtagccaaactggaattgattga

SEQ ID NO: 822720 - DNA, 25 bp, Mus musculus
tggtagccaagaagtccctcacaga

SEQ ID NO: 822721 - DNA, 25 bp, Mus musculus
tggtagccaagatgtccctcacaga

SEQ ID NO: 822722 - DNA, 25 bp, Mus musculus
tggtagccatccatcctcccagcag

SEQ ID NO: 822723 - DNA, 25 bp, Mus musculus
tggtagccatccttcctcccagcag

SEQ ID NO: 822724 - DNA, 25 bp, Mus musculus
tggtagcccagtatgatcccaaggg

SEQ ID NO: 822725 - DNA, 25 bp, Mus musculus
tggtagcccagtttgatcccaaggg

SEQ ID NO: 822726 - DNA, 25 bp, Mus musculus
tggtagccctggaaggcattgccag

SEQ ID NO: 822727 - DNA, 25 bp, Mus musculus
tggtagccctggtaggcattgccag

SEQ ID NO: 822728 - DNA, 25 bp, Mus musculus
tggtagcggcgcactccttcgtctt

SEQ ID NO: 822729 - DNA, 25 bp, Mus musculus
tggtagcggcgctctccttcgtctt

SEQ ID NO: 822730 - DNA, 25 bp, Mus musculus
tggtagctcccaattactgtgggtg

SEQ ID NO: 822731 - DNA, 25 bp, Mus musculus
tggtagctcccatttactgtgggtg

SEQ ID NO: 822732 - DNA, 25 bp, Mus musculus
tggtagctctcgaaacccgtgaaga

SEQ ID NO: 822733 - DNA, 25 bp, Mus musculus
tggtagctctcgtaacccgtgaaga

SEQ ID NO: 822734 - DNA, 25 bp, Mus musculus
tggtagctgatacccaagagtacat

SEQ ID NO: 822735 - DNA, 25 bp, Mus musculus
tggtagctgatagccaagagtacat

SEQ ID NO: 822736 - DNA, 25 bp, Mus musculus
tggtagctgggtactaccatgccaa

SEQ ID NO: 822737 - DNA, 25 bp, Mus musculus
tggtagctgggttctaccatgccaa

SEQ ID NO: 822738 - DNA, 25 bp, Mus musculus
tggtagctttggagggacattcaac

SEQ ID NO: 822739 - DNA, 25 bp, Mus musculus
tggtagctttggtgggacattcaac

SEQ ID NO: 822740 - DNA, 25 bp, Mus musculus
tggtaggcaattagatcagtgatcc

SEQ ID NO: 822741 - DNA, 25 bp, Mus musculus
tggtaggcaatttgatcagtgatcc

SEQ ID NO: 822742 - DNA, 25 bp, Mus musculus
tggtaggctgctacacacctcagag

SEQ ID NO: 822743 - DNA, 25 bp, Mus musculus
tggtaggctgcttcacacctcagag

SEQ ID NO: 822744 - DNA, 25 bp, Mus musculus
tggtaggtcccacgttcagacaaga

SEQ ID NO: 822745 - DNA, 25 bp, Mus musculus
tggtaggtcccaggttcagacaaga

SEQ ID NO: 822746 - DNA, 25 bp, Mus musculus
tggtaggtgagaagctgagcctcca

SEQ ID NO: 822747 - DNA, 25 bp, Mus musculus
tggtaggtgagatgctgagcctcca

SEQ ID NO: 822748 - DNA, 25 bp, Mus musculus
tggtagtagtggagaccacactact

SEQ ID NO: 822749 - DNA, 25 bp, Mus musculus
tggtagtagtggtgaccacactact

SEQ ID NO: 822750 - DNA, 25 bp, Mus musculus
tggtagtattttcgcaggaccagca

SEQ ID NO: 822751 - DNA, 25 bp, Mus musculus
tggtagtattttggcaggaccagca

SEQ ID NO: 822752 - DNA, 25 bp, Mus musculus
tggtagtccaacaagcaatgctgat

SEQ ID NO: 822753 - DNA, 25 bp, Mus musculus
tggtagtccaactagcaatgctgat

SEQ ID NO: 822754 - DNA, 25 bp, Mus musculus
tggtagtccactccacaggctacat

SEQ ID NO: 822755 - DNA, 25 bp, Mus musculus
tggtagtccactgcacaggctacat

SEQ ID NO: 822756 - DNA, 25 bp, Mus musculus
tggtagtcctccatatgcagcccct

SEQ ID NO: 822757 - DNA, 25 bp, Mus musculus
tggtagtcctccttatgcagcccct

SEQ ID NO: 822758 - DNA, 25 bp, Mus musculus
tggtagtgaccaccccagcagtcac

SEQ ID NO: 822759 - DNA, 25 bp, Mus musculus
tggtagtgaccagcccagcagtcac

SEQ ID NO: 822760 - DNA, 25 bp, Mus musculus
tggtagtggagaaccggcaccccaa

SEQ ID NO: 822761 - DNA, 25 bp, Mus musculus
tggtagtggagatccggcaccccaa

SEQ ID NO: 822762 - DNA, 25 bp, Mus musculus
tggtataatgctcaccaaagatggc

SEQ ID NO: 822763 - DNA, 25 bp, Mus musculus
tggtataatgctgaccaaagatggc

SEQ ID NO: 822764 - DNA, 25 bp, Mus musculus
tggtataccaccaaaacctgtgtgg

SEQ ID NO: 822765 - DNA, 25 bp, Mus musculus
tggtataccacctaaacctgtgtgg

SEQ ID NO: 822766 - DNA, 25 bp, Mus musculus
tggtataccagtatggaaacttttc

SEQ ID NO: 822767 - DNA, 25 bp, Mus musculus
tggtataccagtttggaaacttttc

SEQ ID NO: 822768 - DNA, 25 bp, Mus musculus
tggtatactcacaacctcttctttg

SEQ ID NO: 822769 - DNA, 25 bp, Mus musculus
tggtatactcactacctcttctttg

SEQ ID NO: 822770 - DNA, 25 bp, Mus musculus
tggtatatatgcacaagtcactttg

SEQ ID NO: 822771 - DNA, 25 bp, Mus musculus
tggtatatatgctcaagtcactttg

SEQ ID NO: 822772 - DNA, 25 bp, Mus musculus
tggtatcaaactcaatggagactgc

SEQ ID NO: 822773 - DNA, 25 bp, Mus musculus
tggtatcaaactgaatggagactgc

SEQ ID NO: 822774 - DNA, 25 bp, Mus musculus
tggtatcacctaagaccgcaaggac

SEQ ID NO: 822775 - DNA, 25 bp, Mus musculus
tggtatcacctatgaccgcaaggac

SEQ ID NO: 822776 - DNA, 25 bp, Mus musculus
tggtatcagtaaccagcccttcccg

SEQ ID NO: 822777 - DNA, 25 bp, Mus musculus
tggtatcagtaagcagcccttcccg

SEQ ID NO: 822778 - DNA, 25 bp, Mus musculus
tggtatcagtggcaccactcagaac

SEQ ID NO: 822779 - DNA, 25 bp, Mus musculus
tggtatcagtgggaccactcagaac

SEQ ID NO: 822780 - DNA, 25 bp, Mus musculus
tggtatccccatcaccgcgacgggc

SEQ ID NO: 822781 - DNA, 25 bp, Mus musculus
tggtatccccatgaccgcgacgggc

SEQ ID NO: 822782 - DNA, 25 bp, Mus musculus
tggtatccctaaaggtgtggctgat

SEQ ID NO: 822783 - DNA, 25 bp, Mus musculus
tggtatccctaatggtgtggctgat

SEQ ID NO: 822784 - DNA, 25 bp, Mus musculus
tggtatccgcacacgaagcaatgga

SEQ ID NO: 822785 - DNA, 25 bp, Mus musculus
tggtatccgcactcgaagcaatgga

SEQ ID NO: 822786 - DNA, 25 bp, Mus musculus
tggtatcgcctaagctgtgccccac

SEQ ID NO: 822787 - DNA, 25 bp, Mus musculus
tggtatcgcctatgctgtgccccac

SEQ ID NO: 822788 - DNA, 25 bp, Mus musculus
tggtatcggatcaagcagagcattg

SEQ ID NO: 822789 - DNA, 25 bp, Mus musculus
tggtatcggatctagcagagcattg

SEQ ID NO: 822790 - DNA, 25 bp, Mus musculus
tggtatctccgacggacacacggta

SEQ ID NO: 822791 - DNA, 25 bp, Mus musculus
tggtatctccgagggacacacggta

SEQ ID NO: 822792 - DNA, 25 bp, Mus musculus
tggtatctcttgaagccgtccaccc

SEQ ID NO: 822793 - DNA, 25 bp, Mus musculus
tggtatctcttgtagccgtccaccc

SEQ ID NO: 822794 - DNA, 25 bp, Mus musculus
tggtatctgcgacagtttgggaatc

SEQ ID NO: 822795 - DNA, 25 bp, Mus musculus
tggtatctgcgagagtttgggaatc

SEQ ID NO: 822796 - DNA, 25 bp, Mus musculus
tggtatctggaaccccgattcgaag

SEQ ID NO: 822797 - DNA, 25 bp, Mus musculus
tggtatctggaagcccgattcgaag

SEQ ID NO: 822798 - DNA, 25 bp, Mus musculus
tggtatctgtatacatggatgtaca

SEQ ID NO: 822799 - DNA, 25 bp, Mus musculus
tggtatctgtattcatggatgtaca

SEQ ID NO: 822800 - DNA, 25 bp, Mus musculus
tggtatgaactacaggcaagagact

SEQ ID NO: 822801 - DNA, 25 bp, Mus musculus
tggtatgaactagaggcaagagact

SEQ ID NO: 822802 - DNA, 25 bp, Mus musculus
tggtatgattggcagccttcctgac

SEQ ID NO: 822803 - DNA, 25 bp, Mus musculus
tggtatgattgggagccttcctgac

SEQ ID NO: 822804 - DNA, 25 bp, Mus musculus
tggtatgcaatcagcattagtgatg

SEQ ID NO: 822805 - DNA, 25 bp, Mus musculus
tggtatgcaatctgcattagtgatg

SEQ ID NO: 822806 - DNA, 25 bp, Mus musculus
tggtatgcctcaacaactgtgctgt

SEQ ID NO: 822807 - DNA, 25 bp, Mus musculus
tggtatgcctcatcaactgtgctgt

SEQ ID NO: 822808 - DNA, 25 bp, Mus musculus
tggtatgcctccacaactgtgccat

SEQ ID NO: 822809 - DNA, 25 bp, Mus musculus
tggtatgcctcctcaactgtgccat

SEQ ID NO: 822810 - DNA, 25 bp, Mus musculus
tggtatgcctgacactcacctgggc

SEQ ID NO: 822811 - DNA, 25 bp, Mus musculus
tggtatgcctgagactcacctgggc

SEQ ID NO: 822812 - DNA, 25 bp, Mus musculus
tggtatgctcctcaggccctgcaga

SEQ ID NO: 822813 - DNA, 25 bp, Mus musculus
tggtatgctcctgaggccctgcaga

SEQ ID NO: 822814 - DNA, 25 bp, Mus musculus
tggtatggtgtaaatagagctgtta

SEQ ID NO: 822815 - DNA, 25 bp, Mus musculus
tggtatggtgtatatagagctgtta

SEQ ID NO: 822816 - DNA, 25 bp, Mus musculus
tggtattaatccagaagtaagaaga

SEQ ID NO: 822817 - DNA, 25 bp, Mus musculus
tggtattaatcctgaagtaagaaga

SEQ ID NO: 822818 - DNA, 25 bp, Mus musculus
tggtattagggcattcggaacagga

SEQ ID NO: 822819 - DNA, 25 bp, Mus musculus
tggtattagggctttcggaacagga

SEQ ID NO: 822820 - DNA, 25 bp, Mus musculus
tggtattatcgacactcaattctcc

SEQ ID NO: 822821 - DNA, 25 bp, Mus musculus
tggtattatcgagactcaattctcc

SEQ ID NO: 822822 - DNA, 25 bp, Mus musculus
tggtattcatcacaatccatcagtc

SEQ ID NO: 822823 - DNA, 25 bp, Mus musculus
tggtattcatcagaatccatcagtc

SEQ ID NO: 822824 - DNA, 25 bp, Mus musculus
tggtattcatcgaggcggtgtccgt

SEQ ID NO: 822825 - DNA, 25 bp, Mus musculus
tggtattcatcgtggcggtgtccgt

SEQ ID NO: 822826 - DNA, 25 bp, Mus musculus
tggtattgaagtctctgcagcagcc

SEQ ID NO: 822827 - DNA, 25 bp, Mus musculus
tggtattgaagtgtctgcagcagcc

SEQ ID NO: 822828 - DNA, 25 bp, Mus musculus
tggtattgagatcaaccgccagacc

SEQ ID NO: 822829 - DNA, 25 bp, Mus musculus
tggtattgagatgaaccgccagacc

SEQ ID NO: 822830 - DNA, 25 bp, Mus musculus
tggtattgaggaaaacagtgaagtc

SEQ ID NO: 822831 - DNA, 25 bp, Mus musculus
tggtattgaggataacagtgaagtc

SEQ ID NO: 822832 - DNA, 25 bp, Mus musculus
tggtattgttccacatggttacagc

SEQ ID NO: 822833 - DNA, 25 bp, Mus musculus
tggtattgttcctcatggttacagc

SEQ ID NO: 822834 - DNA, 25 bp, Mus musculus
tggtatttaagacgcttttggaagt

SEQ ID NO: 822835 - DNA, 25 bp, Mus musculus
tggtatttaagaggcttttggaagt

SEQ ID NO: 822836 - DNA, 25 bp, Mus musculus
tggtatttgccaaggttctacggtc

SEQ ID NO: 822837 - DNA, 25 bp, Mus musculus
tggtatttgccatggttctacggtc

SEQ ID NO: 822838 - DNA, 25 bp, Mus musculus
tggtatttggtcacatagtgtagta

SEQ ID NO: 822839 - DNA, 25 bp, Mus musculus
tggtatttggtctcatagtgtagta

SEQ ID NO: 822840 - DNA, 25 bp, Mus musculus
tggtattttcttctccctttcagag

SEQ ID NO: 822841 - DNA, 25 bp, Mus musculus
tggtattttcttgtccctttcagag

SEQ ID NO: 822842 - DNA, 25 bp, Mus musculus
tggtattttgatcccaaggaacggg

SEQ ID NO: 822843 - DNA, 25 bp, Mus musculus
tggtattttgatgccaaggaacggg

SEQ ID NO: 822844 - DNA, 25 bp, Mus musculus
tggtcaaaacccctgccttgggagg

SEQ ID NO: 822845 - DNA, 25 bp, Mus musculus
tggtcaaaacccgtgccttgggagg

SEQ ID NO: 822846 - DNA, 25 bp, Mus musculus
tggtcaaactcgagcccccgtggat

SEQ ID NO: 822847 - DNA, 25 bp, Mus musculus
tggtcaaactcgtgcccccgtggat

SEQ ID NO: 822848 - DNA, 25 bp, Mus musculus
tggtcaaagacaactgccggagact

SEQ ID NO: 822849 - DNA, 25 bp, Mus musculus
tggtcaaagacatctgccggagact

SEQ ID NO: 822850 - DNA, 25 bp, Mus musculus
tggtcaaagcccacattgtatttgg

SEQ ID NO: 822851 - DNA, 25 bp, Mus musculus
tggtcaaagccctcattgtatttgg

SEQ ID NO: 822852 - DNA, 25 bp, Mus musculus
tggtcaaagttcaccatattcagag

SEQ ID NO: 822853 - DNA, 25 bp, Mus musculus
tggtcaaagttctccatattcagag

SEQ ID NO: 822854 - DNA, 25 bp, Mus musculus
tggtcaacaagaagaatgcgctcat

SEQ ID NO: 822855 - DNA, 25 bp, Mus musculus
tggtcaacaagatgaatgcgctcat

SEQ ID NO: 822856 - DNA, 25 bp, Mus musculus
tggtcaacagcaagacctccctgta

SEQ ID NO: 822857 - DNA, 25 bp, Mus musculus
tggtcaacagcatgacctccctgta

SEQ ID NO: 822858 - DNA, 25 bp, Mus musculus
tggtcaacatggctatcagcgtggt

SEQ ID NO: 822859 - DNA, 25 bp, Mus musculus
tggtcaacatgggtatcagcgtggt

SEQ ID NO: 822860 - DNA, 25 bp, Mus musculus
tggtcaacctgcagggggcctgcac

SEQ ID NO: 822861 - DNA, 25 bp, Mus musculus
tggtcaacctgctgggggcctgcac

SEQ ID NO: 822862 - DNA, 25 bp, Mus musculus
tggtcaacgtagacttctcatggag

SEQ ID NO: 822863 - DNA, 25 bp, Mus musculus
tggtcaacgtagtcttctcatggag

SEQ ID NO: 822864 - DNA, 25 bp, Mus musculus
tggtcaactgtgaacctgtgtgtca

SEQ ID NO: 822865 - DNA, 25 bp, Mus musculus
tggtcaactgtgtacctgtgtgtca

SEQ ID NO: 822866 - DNA, 25 bp, Mus musculus
tggtcaagaattaggagaaggaact

SEQ ID NO: 822867 - DNA, 25 bp, Mus musculus
tggtcaagaatttggagaaggaact

SEQ ID NO: 822868 - DNA, 25 bp, Mus musculus
tggtcaagagataccaccagtcagg

SEQ ID NO: 822869 - DNA, 25 bp, Mus musculus
tggtcaagagattccaccagtcagg

SEQ ID NO: 822870 - DNA, 25 bp, Mus musculus
tggtcaagatgcagttctcaggaag

SEQ ID NO: 822871 - DNA, 25 bp, Mus musculus
tggtcaagatgctgttctcaggaag

SEQ ID NO: 822872 - DNA, 25 bp, Mus musculus
tggtcaagattaaagtacccagaag

SEQ ID NO: 822873 - DNA, 25 bp, Mus musculus
tggtcaagattatagtacccagaag

SEQ ID NO: 822874 - DNA, 25 bp, Mus musculus
tggtcaagcactctacgttgatggg

SEQ ID NO: 822875 - DNA, 25 bp, Mus musculus
tggtcaagcactgtacgttgatggg

SEQ ID NO: 822876 - DNA, 25 bp, Mus musculus
tggtcaaggacaccgtgctctactc

SEQ ID NO: 822877 - DNA, 25 bp, Mus musculus
tggtcaaggacagcgtgctctactc

SEQ ID NO: 822878 - DNA, 25 bp, Mus musculus
tggtcaagtaccaagcgtcagctag

SEQ ID NO: 822879 - DNA, 25 bp, Mus musculus
tggtcaagtacctagcgtcagctag

SEQ ID NO: 822880 - DNA, 25 bp, Mus musculus
tggtcaataccaagcctgagaaggc

SEQ ID NO: 822881 - DNA, 25 bp, Mus musculus
tggtcaataccatgcctgagaaggc

SEQ ID NO: 822882 - DNA, 25 bp, Mus musculus
tggtcaatacggacttcacgttggt

SEQ ID NO: 822883 - DNA, 25 bp, Mus musculus
tggtcaatacggtcttcacgttggt

SEQ ID NO: 822884 - DNA, 25 bp, Mus musculus
tggtcaatatcgatcccggattcgg

SEQ ID NO: 822885 - DNA, 25 bp, Mus musculus
tggtcaatatcgttcccggattcgg

SEQ ID NO: 822886 - DNA, 25 bp, Mus musculus
tggtcaatctgtacaaggccagtgt

SEQ ID NO: 822887 - DNA, 25 bp, Mus musculus
tggtcaatctgttcaaggccagtgt

SEQ ID NO: 822888 - DNA, 25 bp, Mus musculus
tggtcaattgcactttacacccggg

SEQ ID NO: 822889 - DNA, 25 bp, Mus musculus
tggtcaattgcagtttacacccggg

SEQ ID NO: 822890 - DNA, 25 bp, Mus musculus
tggtcacaatctcttataggaaacc

SEQ ID NO: 822891 - DNA, 25 bp, Mus musculus
tggtcacaatctgttataggaaacc

SEQ ID NO: 822892 - DNA, 25 bp, Mus musculus
tggtcacactctacgacaatgaaga

SEQ ID NO: 822893 - DNA, 25 bp, Mus musculus
tggtcacactcttcgacaatgaaga

SEQ ID NO: 822894 - DNA, 25 bp, Mus musculus
tggtcacagataccagtagcatcaa

SEQ ID NO: 822895 - DNA, 25 bp, Mus musculus
tggtcacagatagcagtagcatcaa

SEQ ID NO: 822896 - DNA, 25 bp, Mus musculus
tggtcacagcccactgtttgctgcg

SEQ ID NO: 822897 - DNA, 25 bp, Mus musculus
tggtcacagccctctgtttgctgcg

SEQ ID NO: 822898 - DNA, 25 bp, Mus musculus
tggtcacagtccatgtccagagctc

SEQ ID NO: 822899 - DNA, 25 bp, Mus musculus
tggtcacagtccttgtccagagctc

SEQ ID NO: 822900 - DNA, 25 bp, Mus musculus
tggtcacatactcagaatctctctc

SEQ ID NO: 822901 - DNA, 25 bp, Mus musculus
tggtcacatactgagaatctctctc

SEQ ID NO: 822902 - DNA, 25 bp, Mus musculus
tggtcacattttccccacgctggga

SEQ ID NO: 822903 - DNA, 25 bp, Mus musculus
tggtcacattttgcccacgctggga

SEQ ID NO: 822904 - DNA, 25 bp, Mus musculus
tggtcaccaccaccatcggcatgtg

SEQ ID NO: 822905 - DNA, 25 bp, Mus musculus
tggtcaccaccagcatcggcatgtg

SEQ ID NO: 822906 - DNA, 25 bp, Mus musculus
tggtcaccagccaggtggcccttca

SEQ ID NO: 822907 - DNA, 25 bp, Mus musculus
tggtcaccagcctggtggcccttca

SEQ ID NO: 822908 - DNA, 25 bp, Mus musculus
tggtcaccatcacagctgctggtgt

SEQ ID NO: 822909 - DNA, 25 bp, Mus musculus
tggtcaccatcagagctgctggtgt

SEQ ID NO: 822910 - DNA, 25 bp, Mus musculus
tggtcaccatggagcactctgcgaa

SEQ ID NO: 822911 - DNA, 25 bp, Mus musculus
tggtcaccatggtgcactctgcgaa

SEQ ID NO: 822912 - DNA, 25 bp, Mus musculus
tggtcaccctctaagctagtgggct

SEQ ID NO: 822913 - DNA, 25 bp, Mus musculus
tggtcaccctcttagctagtgggct

SEQ ID NO: 822914 - DNA, 25 bp, Mus musculus
tggtcacctcttcgaaaagccataa

SEQ ID NO: 822915 - DNA, 25 bp, Mus musculus
tggtcacctcttggaaaagccataa

SEQ ID NO: 822916 - DNA, 25 bp, Mus musculus
tggtcacctgcactaccagccaaaa

SEQ ID NO: 822917 - DNA, 25 bp, Mus musculus
tggtcacctgcagtaccagccaaaa

SEQ ID NO: 822918 - DNA, 25 bp, Mus musculus
tggtcacctggacagtcctgaggct

SEQ ID NO: 822919 - DNA, 25 bp, Mus musculus
tggtcacctggagagtcctgaggct

SEQ ID NO: 822920 - DNA, 25 bp, Mus musculus
tggtcacgagcgagctcaacctcga

SEQ ID NO: 822921 - DNA, 25 bp, Mus musculus
tggtcacgagcgtgctcaacctcga

SEQ ID NO: 822922 - DNA, 25 bp, Mus musculus
tggtcacgtatcaccacggcaggga

SEQ ID NO: 822923 - DNA, 25 bp, Mus musculus
tggtcacgtatctccacggcaggga

SEQ ID NO: 822924 - DNA, 25 bp, Mus musculus
tggtcacgtctgcagatgatctgga

SEQ ID NO: 822925 - DNA, 25 bp, Mus musculus
tggtcacgtctggagatgatctgga

SEQ ID NO: 822926 - DNA, 25 bp, Mus musculus
tggtcacgtgctagactcgcgacag

SEQ ID NO: 822927 - DNA, 25 bp, Mus musculus
tggtcacgtgcttgactcgcgacag

SEQ ID NO: 822928 - DNA, 25 bp, Mus musculus
tggtcactcaataaatggaacagat

SEQ ID NO: 822929 - DNA, 25 bp, Mus musculus
tggtcactcaattaatggaacagat

SEQ ID NO: 822930 - DNA, 25 bp, Mus musculus
tggtcactctggcaacacttcgtaa

SEQ ID NO: 822931 - DNA, 25 bp, Mus musculus
tggtcactctgggaacacttcgtaa

SEQ ID NO: 822932 - DNA, 25 bp, Mus musculus
tggtcactgagtctgaagggaaaca

SEQ ID NO: 822933 - DNA, 25 bp, Mus musculus
tggtcactgagtgtgaagggaaaca

SEQ ID NO: 822934 - DNA, 25 bp, Mus musculus
tggtcactgtcaataaacaagctgt

SEQ ID NO: 822935 - DNA, 25 bp, Mus musculus
tggtcactgtcattaaacaagctgt

SEQ ID NO: 822936 - DNA, 25 bp, Mus musculus
tggtcactgttacaacgattgagta

SEQ ID NO: 822937 - DNA, 25 bp, Mus musculus
tggtcactgttagaacgattgagta

SEQ ID NO: 822938 - DNA, 25 bp, Mus musculus
tggtcactttaaagccgcataactc

SEQ ID NO: 822939 - DNA, 25 bp, Mus musculus
tggtcactttaatgccgcataactc

SEQ ID NO: 822940 - DNA, 25 bp, Mus musculus
tggtcactttataggaggcagcccc

SEQ ID NO: 822941 - DNA, 25 bp, Mus musculus
tggtcactttattggaggcagcccc

SEQ ID NO: 822942 - DNA, 25 bp, Mus musculus
tggtcagaaaacacaatatggcctc

SEQ ID NO: 822943 - DNA, 25 bp, Mus musculus
tggtcagaaaactcaatatggcctc

SEQ ID NO: 822944 - DNA, 25 bp, Mus musculus
tggtcagaagataacattccacggt

SEQ ID NO: 822945 - DNA, 25 bp, Mus musculus
tggtcagaagattacattccacggt

SEQ ID NO: 822946 - DNA, 25 bp, Mus musculus
tggtcagaatctaaagctccattgc

SEQ ID NO: 822947 - DNA, 25 bp, Mus musculus
tggtcagaatcttaagctccattgc

SEQ ID NO: 822948 - DNA, 25 bp, Mus musculus
tggtcagagtatctagctcctcaga

SEQ ID NO: 822949 - DNA, 25 bp, Mus musculus
tggtcagagtatgtagctcctcaga

SEQ ID NO: 822950 - DNA, 25 bp, Mus musculus
tggtcagatccaactatggcagttt

SEQ ID NO: 822951 - DNA, 25 bp, Mus musculus
tggtcagatccatctatggcagttt

SEQ ID NO: 822952 - DNA, 25 bp, Mus musculus
tggtcagcacagatggtaaactgtg

SEQ ID NO: 822953 - DNA, 25 bp, Mus musculus
tggtcagcacagttggtaaactgtg

SEQ ID NO: 822954 - DNA, 25 bp, Mus musculus
tggtcagcagtcacgggcacctgct

SEQ ID NO: 822955 - DNA, 25 bp, Mus musculus
tggtcagcagtctcgggcacctgct

SEQ ID NO: 822956 - DNA, 25 bp, Mus musculus
tggtcagccaataaggtgtttgaag

SEQ ID NO: 822957 - DNA, 25 bp, Mus musculus
tggtcagccaattaggtgtttgaag

SEQ ID NO: 822958 - DNA, 25 bp, Mus musculus
tggtcagcccctcgaattccgagga

SEQ ID NO: 822959 - DNA, 25 bp, Mus musculus
tggtcagcccctggaattccgagga

SEQ ID NO: 822960 - DNA, 25 bp, Mus musculus
tggtcagctacccactatgccgctt

SEQ ID NO: 822961 - DNA, 25 bp, Mus musculus
tggtcagctaccgactatgccgctt

SEQ ID NO: 822962 - DNA, 25 bp, Mus musculus
tggtcagctcacaaaccagcacatc

SEQ ID NO: 822963 - DNA, 25 bp, Mus musculus
tggtcagctcactaaccagcacatc

SEQ ID NO: 822964 - DNA, 25 bp, Mus musculus
tggtcagctccccaactcctgagag

SEQ ID NO: 822965 - DNA, 25 bp, Mus musculus
tggtcagctcccgaactcctgagag

SEQ ID NO: 822966 - DNA, 25 bp, Mus musculus
tggtcagctctaagacatggaaagc

SEQ ID NO: 822967 - DNA, 25 bp, Mus musculus
tggtcagctctatgacatggaaagc

SEQ ID NO: 822968 - DNA, 25 bp, Mus musculus
tggtcagctgctccactcagatgcc

SEQ ID NO: 822969 - DNA, 25 bp, Mus musculus
tggtcagctgctgcactcagatgcc

SEQ ID NO: 822970 - DNA, 25 bp, Mus musculus
tggtcaggaatgaggagtacagatc

SEQ ID NO: 822971 - DNA, 25 bp, Mus musculus
tggtcaggaatgtggagtacagatc

SEQ ID NO: 822972 - DNA, 25 bp, Mus musculus
tggtcaggacctattggcttcccct

SEQ ID NO: 822973 - DNA, 25 bp, Mus musculus
tggtcaggaccttttggcttcccct

SEQ ID NO: 822974 - DNA, 25 bp, Mus musculus
tggtcaggctggcactgtgccacca

SEQ ID NO: 822975 - DNA, 25 bp, Mus musculus
tggtcaggctgggactgtgccacca

SEQ ID NO: 822976 - DNA, 25 bp, Mus musculus
tggtcaggtaggaccctcagcccca

SEQ ID NO: 822977 - DNA, 25 bp, Mus musculus
tggtcaggtaggtccctcagcccca

SEQ ID NO: 822978 - DNA, 25 bp, Mus musculus
tggtcagtcgccagagttctgtgat

SEQ ID NO: 822979 - DNA, 25 bp, Mus musculus
tggtcagtcgcctgagttctgtgat

SEQ ID NO: 822980 - DNA, 25 bp, Mus musculus
tggtcagtctgcatgttgtacagcc

SEQ ID NO: 822981 - DNA, 25 bp, Mus musculus
tggtcagtctgcttgttgtacagcc

SEQ ID NO: 822982 - DNA, 25 bp, Mus musculus
tggtcagtgagcagaagcggcctcc

SEQ ID NO: 822983 - DNA, 25 bp, Mus musculus
tggtcagtgagctgaagcggcctcc

SEQ ID NO: 822984 - DNA, 25 bp, Mus musculus
tggtcagtgccactgaatcacagac

SEQ ID NO: 822985 - DNA, 25 bp, Mus musculus
tggtcagtgccagtgaatcacagac

SEQ ID NO: 822986 - DNA, 25 bp, Mus musculus
tggtcagtgccgagtctcctgcaga

SEQ ID NO: 822987 - DNA, 25 bp, Mus musculus
tggtcagtgccgtgtctcctgcaga

SEQ ID NO: 822988 - DNA, 25 bp, Mus musculus
tggtcagttatgatcccaggatcag

SEQ ID NO: 822989 - DNA, 25 bp, Mus musculus
tggtcagttatgttcccaggatcag

SEQ ID NO: 822990 - DNA, 25 bp, Mus musculus
tggtcagtttgtactacaacacggt

SEQ ID NO: 822991 - DNA, 25 bp, Mus musculus
tggtcagtttgttctacaacacggt

SEQ ID NO: 822992 - DNA, 25 bp, Mus musculus
tggtcataaatacaaacgtgggcaa

SEQ ID NO: 822993 - DNA, 25 bp, Mus musculus
tggtcataaatagaaacgtgggcaa

SEQ ID NO: 822994 - DNA, 25 bp, Mus musculus
tggtcatcatcgagagcgacctgga

SEQ ID NO: 822995 - DNA, 25 bp, Mus musculus
tggtcatcatcgtgagcgacctgga

SEQ ID NO: 822996 - DNA, 25 bp, Mus musculus
tggtcatccactagccgggcttgtt

SEQ ID NO: 822997 - DNA, 25 bp, Mus musculus
tggtcatccacttgccgggcttgtt

SEQ ID NO: 822998 - DNA, 25 bp, Mus musculus
tggtcatcccttccatcgtccgtaa

SEQ ID NO: 822999 - DNA, 25 bp, Mus musculus
tggtcatcccttgcatcgtccgtaa

SEQ ID NO: 823000 - DNA, 25 bp, Mus musculus
tggtcatcgggtccccacattccag

SEQ ID NO: 823001 - DNA, 25 bp, Mus musculus
tggtcatcgggtgcccacattccag

SEQ ID NO: 823002 - DNA, 25 bp, Mus musculus
tggtcatctctgcagactccctgga

SEQ ID NO: 823003 - DNA, 25 bp, Mus musculus
tggtcatctctggagactccctgga

SEQ ID NO: 823004 - DNA, 25 bp, Mus musculus
tggtcatcttggcttagccatcaac

SEQ ID NO: 823005 - DNA, 25 bp, Mus musculus
tggtcatcttgggttagccatcaac

SEQ ID NO: 823006 - DNA, 25 bp, Mus musculus
tggtcatgaatgcattagataacag

SEQ ID NO: 823007 - DNA, 25 bp, Mus musculus
tggtcatgaatggattagataacag

SEQ ID NO: 823008 - DNA, 25 bp, Mus musculus
tggtcatggtgaacattgcacatta

SEQ ID NO: 823009 - DNA, 25 bp, Mus musculus
tggtcatggtgatcattgcacatta

SEQ ID NO: 823010 - DNA, 25 bp, Mus musculus
tggtcatgtgacaccagatacttct

SEQ ID NO: 823011 - DNA, 25 bp, Mus musculus
tggtcatgtgactccagatacttct

SEQ ID NO: 823012 - DNA, 25 bp, Mus musculus
tggtcattcatcacttggacgaatg

SEQ ID NO: 823013 - DNA, 25 bp, Mus musculus
tggtcattcatctcttggacgaatg

SEQ ID NO: 823014 - DNA, 25 bp, Mus musculus
tggtcattggcaagctggcctggcc

SEQ ID NO: 823015 - DNA, 25 bp, Mus musculus
tggtcattggcatgctggcctggcc

SEQ ID NO: 823016 - DNA, 25 bp, Mus musculus
tggtcattggccatccagcacaggg

SEQ ID NO: 823017 - DNA, 25 bp, Mus musculus
tggtcattggccttccagcacaggg

SEQ ID NO: 823018 - DNA, 25 bp, Mus musculus
tggtccaacagacagttacgcagcc

SEQ ID NO: 823019 - DNA, 25 bp, Mus musculus
tggtccaacagagagttacgcagcc

SEQ ID NO: 823020 - DNA, 25 bp, Mus musculus
tggtccaagacaactgggcttatgg

SEQ ID NO: 823021 - DNA, 25 bp, Mus musculus
tggtccaagacatctgggcttatgg

SEQ ID NO: 823022 - DNA, 25 bp, Mus musculus
tggtccaagataatttcacctatgc

SEQ ID NO: 823023 - DNA, 25 bp, Mus musculus
tggtccaagatattttcacctatgc

SEQ ID NO: 823024 - DNA, 25 bp, Mus musculus
tggtccacaccaactatgacgaata

SEQ ID NO: 823025 - DNA, 25 bp, Mus musculus
tggtccacaccatctatgacgaata

SEQ ID NO: 823026 - DNA, 25 bp, Mus musculus
tggtccaccaaccagctgaggaaca

SEQ ID NO: 823027 - DNA, 25 bp, Mus musculus
tggtccaccaacgagctgaggaaca

SEQ ID NO: 823028 - DNA, 25 bp, Mus musculus
tggtccaccggactccagttgtaga

SEQ ID NO: 823029 - DNA, 25 bp, Mus musculus
tggtccaccggagtccagttgtaga

SEQ ID NO: 823030 - DNA, 25 bp, Mus musculus
tggtccacgcctccctggctatgaa

SEQ ID NO: 823031 - DNA, 25 bp, Mus musculus
tggtccacgcctgcctggctatgaa

SEQ ID NO: 823032 - DNA, 25 bp, Mus musculus
tggtccacgtcaccataagaggctt

SEQ ID NO: 823033 - DNA, 25 bp, Mus musculus
tggtccacgtcagcataagaggctt

SEQ ID NO: 823034 - DNA, 25 bp, Mus musculus
tggtccacgttcatgcttggtgctg

SEQ ID NO: 823035 - DNA, 25 bp, Mus musculus
tggtccacgttcttgcttggtgctg

SEQ ID NO: 823036 - DNA, 25 bp, Mus musculus
tggtccagacagcagacacgaactc

SEQ ID NO: 823037 - DNA, 25 bp, Mus musculus
tggtccagacaggagacacgaactc

SEQ ID NO: 823038 - DNA, 25 bp, Mus musculus
tggtccagacggaggaaatggaaac

SEQ ID NO: 823039 - DNA, 25 bp, Mus musculus
tggtccagacggtggaaatggaaac

SEQ ID NO: 823040 - DNA, 25 bp, Mus musculus
tggtccagaggaccccgtatggatt

SEQ ID NO: 823041 - DNA, 25 bp, Mus musculus
tggtccagaggagcccgtatggatt

SEQ ID NO: 823042 - DNA, 25 bp, Mus musculus
tggtccagcaaacgaaaaacagtga

SEQ ID NO: 823043 - DNA, 25 bp, Mus musculus
tggtccagcaaaggaaaaacagtga

SEQ ID NO: 823044 - DNA, 25 bp, Mus musculus
tggtccagcccgatccttttatgta

SEQ ID NO: 823045 - DNA, 25 bp, Mus musculus
tggtccagcccgttccttttatgta

SEQ ID NO: 823046 - DNA, 25 bp, Mus musculus
tggtccagcggacaataacatatct

SEQ ID NO: 823047 - DNA, 25 bp, Mus musculus
tggtccagcggagaataacatatct

SEQ ID NO: 823048 - DNA, 25 bp, Mus musculus
tggtccagctgcacgagcgcttcta

SEQ ID NO: 823049 - DNA, 25 bp, Mus musculus
tggtccagctgctcgagcgcttcta

SEQ ID NO: 823050 - DNA, 25 bp, Mus musculus
tggtccagctgtattaattgagtgc

SEQ ID NO: 823051 - DNA, 25 bp, Mus musculus
tggtccagctgttttaattgagtgc

SEQ ID NO: 823052 - DNA, 25 bp, Mus musculus
tggtccaggcctatgtcggtgacgt

SEQ ID NO: 823053 - DNA, 25 bp, Mus musculus
tggtccaggcctttgtcggtgacgt

SEQ ID NO: 823054 - DNA, 25 bp, Mus musculus
tggtccagggtcacaattaaacact

SEQ ID NO: 823055 - DNA, 25 bp, Mus musculus
tggtccagggtctcaattaaacact

SEQ ID NO: 823056 - DNA, 25 bp, Mus musculus
tggtccagtggtcgaattacacacg

SEQ ID NO: 823057 - DNA, 25 bp, Mus musculus
tggtccagtggtggaattacacacg

SEQ ID NO: 823058 - DNA, 25 bp, Mus musculus
tggtccagttctctgcgacgctgtg

SEQ ID NO: 823059 - DNA, 25 bp, Mus musculus
tggtccagttctgtgcgacgctgtg

SEQ ID NO: 823060 - DNA, 25 bp, Mus musculus
tggtccagtttgaatcagatctcag

SEQ ID NO: 823061 - DNA, 25 bp, Mus musculus
tggtccagtttgtatcagatctcag

SEQ ID NO: 823062 - DNA, 25 bp, Mus musculus
tggtccatatctcaagggccatgat

SEQ ID NO: 823063 - DNA, 25 bp, Mus musculus
tggtccatatctgaagggccatgat

SEQ ID NO: 823064 - DNA, 25 bp, Mus musculus
tggtccatgactcgctgtacagcta

SEQ ID NO: 823065 - DNA, 25 bp, Mus musculus
tggtccatgactggctgtacagcta

SEQ ID NO: 823066 - DNA, 25 bp, Mus musculus
tggtccatgctaataaaagaccagt

SEQ ID NO: 823067 - DNA, 25 bp, Mus musculus
tggtccatgctattaaaagaccagt

SEQ ID NO: 823068 - DNA, 25 bp, Mus musculus
tggtccattgaaaggaatagaactg

SEQ ID NO: 823069 - DNA, 25 bp, Mus musculus
tggtccattgaatggaatagaactg

SEQ ID NO: 823070 - DNA, 25 bp, Mus musculus
tggtccattgtacaggccaagatct

SEQ ID NO: 823071 - DNA, 25 bp, Mus musculus
tggtccattgtagaggccaagatct

SEQ ID NO: 823072 - DNA, 25 bp, Mus musculus
tggtcccactctctgacatgaacgc

SEQ ID NO: 823073 - DNA, 25 bp, Mus musculus
tggtcccactctgtgacatgaacgc

SEQ ID NO: 823074 - DNA, 25 bp, Mus musculus
tggtccccagatacaagctgcagct

SEQ ID NO: 823075 - DNA, 25 bp, Mus musculus
tggtccccagattcaagctgcagct

SEQ ID NO: 823076 - DNA, 25 bp, Mus musculus
tggtccccaggaagatggccatcag

SEQ ID NO: 823077 - DNA, 25 bp, Mus musculus
tggtccccaggatgatggccatcag

SEQ ID NO: 823078 - DNA, 25 bp, Mus musculus
tggtcccctacaacatcatgctcat

SEQ ID NO: 823079 - DNA, 25 bp, Mus musculus
tggtcccctacatcatcatgctcat

SEQ ID NO: 823080 - DNA, 25 bp, Mus musculus
tggtcccctggacagctttcttagg

SEQ ID NO: 823081 - DNA, 25 bp, Mus musculus
tggtcccctggagagctttcttagg

SEQ ID NO: 823082 - DNA, 25 bp, Mus musculus
tggtcccgcaggcaaagctcatgga

SEQ ID NO: 823083 - DNA, 25 bp, Mus musculus
tggtcccgcagggaaagctcatgga

SEQ ID NO: 823084 - DNA, 25 bp, Mus musculus
tggtcccgtcgtccctgaatttatc

SEQ ID NO: 823085 - DNA, 25 bp, Mus musculus
tggtcccgtcgtgcctgaatttatc

SEQ ID NO: 823086 - DNA, 25 bp, Mus musculus
tggtccctacggatgagtcccaggc

SEQ ID NO: 823087 - DNA, 25 bp, Mus musculus
tggtccctacggttgagtcccaggc

SEQ ID NO: 823088 - DNA, 25 bp, Mus musculus
tggtccctcaccaatattatggagt

SEQ ID NO: 823089 - DNA, 25 bp, Mus musculus
tggtccctcacctatattatggagt

SEQ ID NO: 823090 - DNA, 25 bp, Mus musculus
tggtccctccctagatcaggcaggt

SEQ ID NO: 823091 - DNA, 25 bp, Mus musculus
tggtccctcccttgatcaggcaggt

SEQ ID NO: 823092 - DNA, 25 bp, Mus musculus
tggtccctgaacctgaagccagctc

SEQ ID NO: 823093 - DNA, 25 bp, Mus musculus
tggtccctgaacgtgaagccagctc

SEQ ID NO: 823094 - DNA, 25 bp, Mus musculus
tggtccctgacaaccaagagatccg

SEQ ID NO: 823095 - DNA, 25 bp, Mus musculus
tggtccctgacatccaagagatccg

SEQ ID NO: 823096 - DNA, 25 bp, Mus musculus
tggtccctgagtcacttggagcagt

SEQ ID NO: 823097 - DNA, 25 bp, Mus musculus
tggtccctgagtgacttggagcagt

SEQ ID NO: 823098 - DNA, 25 bp, Mus musculus
tggtccctgatactcctgctggtcg

SEQ ID NO: 823099 - DNA, 25 bp, Mus musculus
tggtccctgatagtcctgctggtcg

SEQ ID NO: 823100 - DNA, 25 bp, Mus musculus
tggtccctgccacaaccttggagag

SEQ ID NO: 823101 - DNA, 25 bp, Mus musculus
tggtccctgccagaaccttggagag

SEQ ID NO: 823102 - DNA, 25 bp, Mus musculus
tggtccctgggaagaacagctggta

SEQ ID NO: 823103 - DNA, 25 bp, Mus musculus
tggtccctgggatgaacagctggta

SEQ ID NO: 823104 - DNA, 25 bp, Mus musculus
tggtccgacccacagtgtggcgctc

SEQ ID NO: 823105 - DNA, 25 bp, Mus musculus
tggtccgacccagagtgtggcgctc

SEQ ID NO: 823106 - DNA, 25 bp, Mus musculus
tggtccgagagaagcctaggcacaa

SEQ ID NO: 823107 - DNA, 25 bp, Mus musculus
tggtccgagagatgcctaggcacaa

SEQ ID NO: 823108 - DNA, 25 bp, Mus musculus
tggtccgagctgagtccatccagac

SEQ ID NO: 823109 - DNA, 25 bp, Mus musculus
tggtccgagctgtgtccatccagac

SEQ ID NO: 823110 - DNA, 25 bp, Mus musculus
tggtccgcacataggcagagattcg

SEQ ID NO: 823111 - DNA, 25 bp, Mus musculus
tggtccgcacattggcagagattcg

SEQ ID NO: 823112 - DNA, 25 bp, Mus musculus
tggtccgcagatctcccatgccttg

SEQ ID NO: 823113 - DNA, 25 bp, Mus musculus
tggtccgcagatgtcccatgccttg

SEQ ID NO: 823114 - DNA, 25 bp, Mus musculus
tggtccgcagcacgtatggctgtca

SEQ ID NO: 823115 - DNA, 25 bp, Mus musculus
tggtccgcagcaggtatggctgtca

SEQ ID NO: 823116 - DNA, 25 bp, Mus musculus
tggtccgccctgagatagcattaga

SEQ ID NO: 823117 - DNA, 25 bp, Mus musculus
tggtccgccctgtgatagcattaga

SEQ ID NO: 823118 - DNA, 25 bp, Mus musculus
tggtccggaccccttggactatgtt

SEQ ID NO: 823119 - DNA, 25 bp, Mus musculus
tggtccggacccgttggactatgtt

SEQ ID NO: 823120 - DNA, 25 bp, Mus musculus
tggtccgtattcactgcttccaggg

SEQ ID NO: 823121 - DNA, 25 bp, Mus musculus
tggtccgtattctctgcttccaggg

SEQ ID NO: 823122 - DNA, 25 bp, Mus musculus
tggtccgtgcctcgctgcagaccaa

SEQ ID NO: 823123 - DNA, 25 bp, Mus musculus
tggtccgtgcctggctgcagaccaa

SEQ ID NO: 823124 - DNA, 25 bp, Mus musculus
tggtccgtgggtctggaacacttac

SEQ ID NO: 823125 - DNA, 25 bp, Mus musculus
tggtccgtgggtgtggaacacttac

SEQ ID NO: 823126 - DNA, 25 bp, Mus musculus
tggtcctacaggactctgacaccta

SEQ ID NO: 823127 - DNA, 25 bp, Mus musculus
tggtcctacaggtctctgacaccta

SEQ ID NO: 823128 - DNA, 25 bp, Mus musculus
tggtcctcagtgaccggaaagtgtt

SEQ ID NO: 823129 - DNA, 25 bp, Mus musculus
tggtcctcagtgcaaaaaatttcgt

SEQ ID NO: 823130 - DNA, 25 bp, Mus musculus
tggtcctcagtggaaaaaatttcgt

SEQ ID NO: 823131 - DNA, 25 bp, Mus musculus
tggtcctcagtgtccggaaagtgtt

SEQ ID NO: 823132 - DNA, 25 bp, Mus musculus
tggtcctcatgcaggccttcggcag

SEQ ID NO: 823133 - DNA, 25 bp, Mus musculus
tggtcctcatgctggccttcggcag

SEQ ID NO: 823134 - DNA, 25 bp, Mus musculus
tggtcctccaggaagaggtcctaag

SEQ ID NO: 823135 - DNA, 25 bp, Mus musculus
tggtcctccaggtagaggtcctaag

SEQ ID NO: 823136 - DNA, 25 bp, Mus musculus
tggtcctcgtgacaaacatctatgg

SEQ ID NO: 823137 - DNA, 25 bp, Mus musculus
tggtcctcgtgagaaacatctatgg

SEQ ID NO: 823138 - DNA, 25 bp, Mus musculus
tggtcctctgagacaccgcacaagc

SEQ ID NO: 823139 - DNA, 25 bp, Mus musculus
tggtcctctgagtcaccgcacaagc

SEQ ID NO: 823140 - DNA, 25 bp, Mus musculus
tggtcctctgcaactatgttatggt

SEQ ID NO: 823141 - DNA, 25 bp, Mus musculus
tggtcctctgcatctatgttatggt

SEQ ID NO: 823142 - DNA, 25 bp, Mus musculus
tggtcctgacaacccagcttgtagg

SEQ ID NO: 823143 - DNA, 25 bp, Mus musculus
tggtcctgacaagccagcttgtagg

SEQ ID NO: 823144 - DNA, 25 bp, Mus musculus
tggtcctgagtacctccagtttcca

SEQ ID NO: 823145 - DNA, 25 bp, Mus musculus
tggtcctgagtagctccagtttcca

SEQ ID NO: 823146 - DNA, 25 bp, Mus musculus
tggtcctgagtcagcagaggcttcc

SEQ ID NO: 823147 - DNA, 25 bp, Mus musculus
tggtcctgagtctgcagaggcttcc

SEQ ID NO: 823148 - DNA, 25 bp, Mus musculus
tggtcctgctgaacctgctgagtgc

SEQ ID NO: 823149 - DNA, 25 bp, Mus musculus
tggtcctgctgatcctgctgagtgc

SEQ ID NO: 823150 - DNA, 25 bp, Mus musculus
tggtcctggccaactggtgtctgtt

SEQ ID NO: 823151 - DNA, 25 bp, Mus musculus
tggtcctggccatctggtgtctgtt

SEQ ID NO: 823152 - DNA, 25 bp, Mus musculus
tggtcctggctgagggcgctcactc

SEQ ID NO: 823153 - DNA, 25 bp, Mus musculus
tggtcctggctgtgggcgctcactc

SEQ ID NO: 823154 - DNA, 25 bp, Mus musculus
tggtcctggcttacctcatgctcca

SEQ ID NO: 823155 - DNA, 25 bp, Mus musculus
tggtcctggctttcctcatgctcca

SEQ ID NO: 823156 - DNA, 25 bp, Mus musculus
tggtcctgtactcgtaggcaaagag

SEQ ID NO: 823157 - DNA, 25 bp, Mus musculus
tggtcctgtactctatgagtagtgg

SEQ ID NO: 823158 - DNA, 25 bp, Mus musculus
tggtcctgtactggtaggcaaagag

SEQ ID NO: 823159 - DNA, 25 bp, Mus musculus
tggtcctgtactgtatgagtagtgg

SEQ ID NO: 823160 - DNA, 25 bp, Mus musculus
tggtcctgtggacttgcgagcaatc

SEQ ID NO: 823161 - DNA, 25 bp, Mus musculus
tggtcctgtggagttgcgagcaatc

SEQ ID NO: 823162 - DNA, 25 bp, Mus musculus
tggtccttcagaccgagggctccat

SEQ ID NO: 823163 - DNA, 25 bp, Mus musculus
tggtccttcagagcgagggctccat

SEQ ID NO: 823164 - DNA, 25 bp, Mus musculus
tggtccttcaggaatgcttggatgc

SEQ ID NO: 823165 - DNA, 25 bp, Mus musculus
tggtccttcaggtatgcttggatgc

SEQ ID NO: 823166 - DNA, 25 bp, Mus musculus
tggtccttccctaaagactctggag

SEQ ID NO: 823167 - DNA, 25 bp, Mus musculus
tggtccttcccttaagactctggag

SEQ ID NO: 823168 - DNA, 25 bp, Mus musculus
tggtccttcctgagttgtccgcgcc

SEQ ID NO: 823169 - DNA, 25 bp, Mus musculus
tggtccttcctgtgttgtccgcgcc

SEQ ID NO: 823170 - DNA, 25 bp, Mus musculus
tggtccttgatgaggctcaccactg

SEQ ID NO: 823171 - DNA, 25 bp, Mus musculus
tggtccttgatgtggctcaccactg

SEQ ID NO: 823172 - DNA, 25 bp, Mus musculus
tggtcgaaatggctatggagctaaa

SEQ ID NO: 823173 - DNA, 25 bp, Mus musculus
tggtcgaaatgggtatggagctaaa

SEQ ID NO: 823174 - DNA, 25 bp, Mus musculus
tggtcgacctggatccccaggacct

SEQ ID NO: 823175 - DNA, 25 bp, Mus musculus
tggtcgacctggttccccaggacct

SEQ ID NO: 823176 - DNA, 25 bp, Mus musculus
tggtcgacgctccatgataaagcct

SEQ ID NO: 823177 - DNA, 25 bp, Mus musculus
tggtcgacgctcgatgataaagcct

SEQ ID NO: 823178 - DNA, 25 bp, Mus musculus
tggtcgagaagcaagggtcatagct

SEQ ID NO: 823179 - DNA, 25 bp, Mus musculus
tggtcgagaagctagggtcatagct

SEQ ID NO: 823180 - DNA, 25 bp, Mus musculus
tggtcgagccatctgtagaagagca

SEQ ID NO: 823181 - DNA, 25 bp, Mus musculus
tggtcgagccatgtgtagaagagca

SEQ ID NO: 823182 - DNA, 25 bp, Mus musculus
tggtcgcaaggccaatgtgaacctg

SEQ ID NO: 823183 - DNA, 25 bp, Mus musculus
tggtcgcaaggcgaatgtgaacctg

SEQ ID NO: 823184 - DNA, 25 bp, Mus musculus
tggtcgcaagtgagtgacaaaggct

SEQ ID NO: 823185 - DNA, 25 bp, Mus musculus
tggtcgcaagtgtgtgacaaaggct

SEQ ID NO: 823186 - DNA, 25 bp, Mus musculus
tggtcgcacaataatgaaagactcg

SEQ ID NO: 823187 - DNA, 25 bp, Mus musculus
tggtcgcacaattatgaaagactcg

SEQ ID NO: 823188 - DNA, 25 bp, Mus musculus
tggtcgcacaccacagtaaggaatg

SEQ ID NO: 823189 - DNA, 25 bp, Mus musculus
tggtcgcacacctcagtaaggaatg

SEQ ID NO: 823190 - DNA, 25 bp, Mus musculus
tggtcgcagtctcctgacttatggc

SEQ ID NO: 823191 - DNA, 25 bp, Mus musculus
tggtcgcagtctgctgacttatggc

SEQ ID NO: 823192 - DNA, 25 bp, Mus musculus
tggtcgccgcgtacccaggatcagt

SEQ ID NO: 823193 - DNA, 25 bp, Mus musculus
tggtcgccgcgttcccaggatcagt

SEQ ID NO: 823194 - DNA, 25 bp, Mus musculus
tggtcgcctattacaagaatcttcg

SEQ ID NO: 823195 - DNA, 25 bp, Mus musculus
tggtcgcctatttcaagaatcttcg

SEQ ID NO: 823196 - DNA, 25 bp, Mus musculus
tggtcgcgcccgaagtgtaacactt

SEQ ID NO: 823197 - DNA, 25 bp, Mus musculus
tggtcgcgcccgtagtgtaacactt

SEQ ID NO: 823198 - DNA, 25 bp, Mus musculus
tggtcgctccctcgactcggttcta

SEQ ID NO: 823199 - DNA, 25 bp, Mus musculus
tggtcgctccctggactcggttcta

SEQ ID NO: 823200 - DNA, 25 bp, Mus musculus
tggtcgcttcttcatcaccaacaag

SEQ ID NO: 823201 - DNA, 25 bp, Mus musculus
tggtcgcttcttgatcaccaacaag

SEQ ID NO: 823202 - DNA, 25 bp, Mus musculus
tggtcggactttagcacgatctggg

SEQ ID NO: 823203 - DNA, 25 bp, Mus musculus
tggtcggacttttgcacgatctggg

SEQ ID NO: 823204 - DNA, 25 bp, Mus musculus
tggtcggagacactttaaaaggaga

SEQ ID NO: 823205 - DNA, 25 bp, Mus musculus
tggtcggagacagtttaaaaggaga

SEQ ID NO: 823206 - DNA, 25 bp, Mus musculus
tggtcggcaacaaaacggatctggg

SEQ ID NO: 823207 - DNA, 25 bp, Mus musculus
tggtcggcaacataacggatctggg

SEQ ID NO: 823208 - DNA, 25 bp, Mus musculus
tggtcgggatacacaatggaatgtc

SEQ ID NO: 823209 - DNA, 25 bp, Mus musculus
tggtcgggatactcaatggaatgtc

SEQ ID NO: 823210 - DNA, 25 bp, Mus musculus
tggtcggtcgttacccttgaaggca

SEQ ID NO: 823211 - DNA, 25 bp, Mus musculus
tggtcggtcgtttcccttgaaggca

SEQ ID NO: 823212 - DNA, 25 bp, Mus musculus
tggtcgtcctctacctgatcatcgg

SEQ ID NO: 823213 - DNA, 25 bp, Mus musculus
tggtcgtcctcttcctgatcatcgg

SEQ ID NO: 823214 - DNA, 25 bp, Mus musculus
tggtcgtcctttccaacatgggtgt

SEQ ID NO: 823215 - DNA, 25 bp, Mus musculus
tggtcgtcctttgcaacatgggtgt

SEQ ID NO: 823216 - DNA, 25 bp, Mus musculus
tggtcgtctctcacctggtcacata

SEQ ID NO: 823217 - DNA, 25 bp, Mus musculus
tggtcgtctctctcctggtcacata

SEQ ID NO: 823218 - DNA, 25 bp, Mus musculus
tggtcgtgaacactgatctcttaca

SEQ ID NO: 823219 - DNA, 25 bp, Mus musculus
tggtcgtgaacagtgatctcttaca

SEQ ID NO: 823220 - DNA, 25 bp, Mus musculus
tggtcgtgccatagaatcaacttga

SEQ ID NO: 823221 - DNA, 25 bp, Mus musculus
tggtcgtgccattgaatcaacttga

SEQ ID NO: 823222 - DNA, 25 bp, Mus musculus
tggtcgtggcatacccctatgacat

SEQ ID NO: 823223 - DNA, 25 bp, Mus musculus
tggtcgtggcattcccctatgacat

SEQ ID NO: 823224 - DNA, 25 bp, Mus musculus
tggtcgtgttacctttcccagacac

SEQ ID NO: 823225 - DNA, 25 bp, Mus musculus
tggtcgtgttacgtttcccagacac

SEQ ID NO: 823226 - DNA, 25 bp, Mus musculus
tggtcgttccccattctgttctgga

SEQ ID NO: 823227 - DNA, 25 bp, Mus musculus
tggtcgttcccctttctgttctgga

SEQ ID NO: 823228 - DNA, 25 bp, Mus musculus
tggtcgtttggtcaagcaacatgca

SEQ ID NO: 823229 - DNA, 25 bp, Mus musculus
tggtcgtttggtgaagcaacatgca

SEQ ID NO: 823230 - DNA, 25 bp, Mus musculus
tggtctaaagagaaaacctgcgatc

SEQ ID NO: 823231 - DNA, 25 bp, Mus musculus
tggtctaaagagtaaacctgcgatc

SEQ ID NO: 823232 - DNA, 25 bp, Mus musculus
tggtctacaactcctctggcacgga

SEQ ID NO: 823233 - DNA, 25 bp, Mus musculus
tggtctacaactgctctggcacgga

SEQ ID NO: 823234 - DNA, 25 bp, Mus musculus
tggtctacaatccaacagtgagctg

SEQ ID NO: 823235 - DNA, 25 bp, Mus musculus
tggtctacaatcgaacagtgagctg

SEQ ID NO: 823236 - DNA, 25 bp, Mus musculus
tggtctacacacagtcagagattct

SEQ ID NO: 823237 - DNA, 25 bp, Mus musculus
tggtctacacactgtcagagattct

SEQ ID NO: 823238 - DNA, 25 bp, Mus musculus
tggtctacactgaagccaccagtac

SEQ ID NO: 823239 - DNA, 25 bp, Mus musculus
tggtctacactgtagccaccagtac

SEQ ID NO: 823240 - DNA, 25 bp, Mus musculus
tggtctacatggacacaacaggcag

SEQ ID NO: 823241 - DNA, 25 bp, Mus musculus
tggtctacatggtcacaacaggcag

SEQ ID NO: 823242 - DNA, 25 bp, Mus musculus
tggtctactagcactccctaaggct

SEQ ID NO: 823243 - DNA, 25 bp, Mus musculus
tggtctactagctctccctaaggct

SEQ ID NO: 823244 - DNA, 25 bp, Mus musculus
tggtctactctaagataactctggt

SEQ ID NO: 823245 - DNA, 25 bp, Mus musculus
tggtctactctatgataactctggt

SEQ ID NO: 823246 - DNA, 25 bp, Mus musculus
tggtctacttcacaaactttggcaa

SEQ ID NO: 823247 - DNA, 25 bp, Mus musculus
tggtctacttcagaaactttggcaa

SEQ ID NO: 823248 - DNA, 25 bp, Mus musculus
tggtctaggttacattgctggctcc

SEQ ID NO: 823249 - DNA, 25 bp, Mus musculus
tggtctaggttagattgctggctcc

SEQ ID NO: 823250 - DNA, 25 bp, Mus musculus
tggtctatcacaccactcatgtacc

SEQ ID NO: 823251 - DNA, 25 bp, Mus musculus
tggtctatcacagcactcatgtacc

SEQ ID NO: 823252 - DNA, 25 bp, Mus musculus
tggtctatgaggacatctttgatgc

SEQ ID NO: 823253 - DNA, 25 bp, Mus musculus
tggtctatgaggtcatctttgatgc

SEQ ID NO: 823254 - DNA, 25 bp, Mus musculus
tggtctatgagtcaatgccttcctc

SEQ ID NO: 823255 - DNA, 25 bp, Mus musculus
tggtctatgagtgaatgccttcctc

SEQ ID NO: 823256 - DNA, 25 bp, Mus musculus
tggtctatgggaccagcatgttcgt

SEQ ID NO: 823257 - DNA, 25 bp, Mus musculus
tggtctatgggagcagcatgttcgt

SEQ ID NO: 823258 - DNA, 25 bp, Mus musculus
tggtctcaaatcacagtttgcatac

SEQ ID NO: 823259 - DNA, 25 bp, Mus musculus
tggtctcaaatctcagtttgcatac

SEQ ID NO: 823260 - DNA, 25 bp, Mus musculus
tggtctcaagagcagagattgacat

SEQ ID NO: 823261 - DNA, 25 bp, Mus musculus
tggtctcaagaggagagattgacat

SEQ ID NO: 823262 - DNA, 25 bp, Mus musculus
tggtctcagaccactgtgcacgggt

SEQ ID NO: 823263 - DNA, 25 bp, Mus musculus
tggtctcagacctctgtgcacgggt

SEQ ID NO: 823264 - DNA, 25 bp, Mus musculus
tggtctcagcgactcctgggatccc

SEQ ID NO: 823265 - DNA, 25 bp, Mus musculus
tggtctcagcgagtcctgggatccc

SEQ ID NO: 823266 - DNA, 25 bp, Mus musculus
tggtctcattaaaggaggcgctgcc

SEQ ID NO: 823267 - DNA, 25 bp, Mus musculus
tggtctcattaatggaggcgctgcc

SEQ ID NO: 823268 - DNA, 25 bp, Mus musculus
tggtctccaatgctgctgtcaaccc

SEQ ID NO: 823269 - DNA, 25 bp, Mus musculus
tggtctccaatggtgctgtcaaccc

SEQ ID NO: 823270 - DNA, 25 bp, Mus musculus
tggtctccatgcaggcatcaagcag

SEQ ID NO: 823271 - DNA, 25 bp, Mus musculus
tggtctccatgctggcatcaagcag

SEQ ID NO: 823272 - DNA, 25 bp, Mus musculus
tggtctccatggacgtcctgttctg

SEQ ID NO: 823273 - DNA, 25 bp, Mus musculus
tggtctccatggtcgtcctgttctg

SEQ ID NO: 823274 - DNA, 25 bp, Mus musculus
tggtctcccaggcattaagggtccc

SEQ ID NO: 823275 - DNA, 25 bp, Mus musculus
tggtctcccagggattaagggtccc

SEQ ID NO: 823276 - DNA, 25 bp, Mus musculus
tggtctccgccgctacttctctgaa

SEQ ID NO: 823277 - DNA, 25 bp, Mus musculus
tggtctccgccggtacttctctgaa

SEQ ID NO: 823278 - DNA, 25 bp, Mus musculus
tggtctccgttaagactgtgaacaa

SEQ ID NO: 823279 - DNA, 25 bp, Mus musculus
tggtctccgttatgactgtgaacaa

SEQ ID NO: 823280 - DNA, 25 bp, Mus musculus
tggtctcctaccaaccgcacctgga

SEQ ID NO: 823281 - DNA, 25 bp, Mus musculus
tggtctcctacctaccgcacctgga

SEQ ID NO: 823282 - DNA, 25 bp, Mus musculus
tggtctcctggaacctctgatacag

SEQ ID NO: 823283 - DNA, 25 bp, Mus musculus
tggtctcctggatcctctgatacag

SEQ ID NO: 823284 - DNA, 25 bp, Mus musculus
tggtctccttcccactctcggtgga

SEQ ID NO: 823285 - DNA, 25 bp, Mus musculus
tggtctccttccgactctcggtgga

SEQ ID NO: 823286 - DNA, 25 bp, Mus musculus
tggtctcgggcaaggcgcccagtcc

SEQ ID NO: 823287 - DNA, 25 bp, Mus musculus
tggtctcgggcatggcgcccagtcc

SEQ ID NO: 823288 - DNA, 25 bp, Mus musculus
tggtctcgtaccacttcttgttctg

SEQ ID NO: 823289 - DNA, 25 bp, Mus musculus
tggtctcgtacctcttcttgttctg

SEQ ID NO: 823290 - DNA, 25 bp, Mus musculus
tggtctctaaaaactgcctcaattt

SEQ ID NO: 823291 - DNA, 25 bp, Mus musculus
tggtctctaaaatctgcctcaattt

SEQ ID NO: 823292 - DNA, 25 bp, Mus musculus
tggtctctcaagcttatacctccat

SEQ ID NO: 823293 - DNA, 25 bp, Mus musculus
tggtctctcaaggttatacctccat

SEQ ID NO: 823294 - DNA, 25 bp, Mus musculus
tggtctctccacatgctgctgtgca

SEQ ID NO: 823295 - DNA, 25 bp, Mus musculus
tggtctctccacttgctgctgtgca

SEQ ID NO: 823296 - DNA, 25 bp, Mus musculus
tggtctctcgggaacatctgtggca

SEQ ID NO: 823297 - DNA, 25 bp, Mus musculus
tggtctctcgggtacatctgtggca

SEQ ID NO: 823298 - DNA, 25 bp, Mus musculus
tggtctctctggcacctcatgactt

SEQ ID NO: 823299 - DNA, 25 bp, Mus musculus
tggtctctctgggacctcatgactt

SEQ ID NO: 823300 - DNA, 25 bp, Mus musculus
tggtctctgacactctggaagcctt

SEQ ID NO: 823301 - DNA, 25 bp, Mus musculus
tggtctctgacagtctggaagcctt

SEQ ID NO: 823302 - DNA, 25 bp, Mus musculus
tggtctctgcaaacatcaccgtcag

SEQ ID NO: 823303 - DNA, 25 bp, Mus musculus
tggtctctgcaatcatcaccgtcag

SEQ ID NO: 823304 - DNA, 25 bp, Mus musculus
tggtctctgcatcccgggataagac

SEQ ID NO: 823305 - DNA, 25 bp, Mus musculus
tggtctctgcatgccgggataagac

SEQ ID NO: 823306 - DNA, 25 bp, Mus musculus
tggtctctgggaataactgccatag

SEQ ID NO: 823307 - DNA, 25 bp, Mus musculus
tggtctctgggattaactgccatag

SEQ ID NO: 823308 - DNA, 25 bp, Mus musculus
tggtctctgtgtagttggcggtccc

SEQ ID NO: 823309 - DNA, 25 bp, Mus musculus
tggtctctgtgttgttggcggtccc

SEQ ID NO: 823310 - DNA, 25 bp, Mus musculus
tggtctcttagcagccagtgctaaa

SEQ ID NO: 823311 - DNA, 25 bp, Mus musculus
tggtctcttagctgccagtgctaaa

SEQ ID NO: 823312 - DNA, 25 bp, Mus musculus
tggtctcttaggagctaaggcctct

SEQ ID NO: 823313 - DNA, 25 bp, Mus musculus
tggtctcttaggtgctaaggcctct

SEQ ID NO: 823314 - DNA, 25 bp, Mus musculus
tggtctcttcttcagttttacagag

SEQ ID NO: 823315 - DNA, 25 bp, Mus musculus
tggtctcttcttgagttttacagag

SEQ ID NO: 823316 - DNA, 25 bp, Mus musculus
tggtctgaccataagcaccttgcac

SEQ ID NO: 823317 - DNA, 25 bp, Mus musculus
tggtctgaccattagcaccttgcac

SEQ ID NO: 823318 - DNA, 25 bp, Mus musculus
tggtctgactcaactgtgaactgga

SEQ ID NO: 823319 - DNA, 25 bp, Mus musculus
tggtctgactcatctgtgaactgga

SEQ ID NO: 823320 - DNA, 25 bp, Mus musculus
tggtctgagcatctctgccatgcgg

SEQ ID NO: 823321 - DNA, 25 bp, Mus musculus
tggtctgagcatgtctgccatgcgg

SEQ ID NO: 823322 - DNA, 25 bp, Mus musculus
tggtctgatagcataccaactggat

SEQ ID NO: 823323 - DNA, 25 bp, Mus musculus
tggtctgatagcttaccaactggat

SEQ ID NO: 823324 - DNA, 25 bp, Mus musculus
tggtctgatgatacacagtggagac

SEQ ID NO: 823325 - DNA, 25 bp, Mus musculus
tggtctgatgattcacagtggagac

SEQ ID NO: 823326 - DNA, 25 bp, Mus musculus
tggtctgattcacaaggacgtgcca

SEQ ID NO: 823327 - DNA, 25 bp, Mus musculus
tggtctgattcagaaggacgtgcca

SEQ ID NO: 823328 - DNA, 25 bp, Mus musculus
tggtctgctgtaccccggtctgcag

SEQ ID NO: 823329 - DNA, 25 bp, Mus musculus
tggtctgctgtagcccggtctgcag

SEQ ID NO: 823330 - DNA, 25 bp, Mus musculus
tggtctggacccaaacgctgtccac

SEQ ID NO: 823331 - DNA, 25 bp, Mus musculus
tggtctggaccctaacgctgtccac

SEQ ID NO: 823332 - DNA, 25 bp, Mus musculus
tggtctggcccgaagcgtccagctg

SEQ ID NO: 823333 - DNA, 25 bp, Mus musculus
tggtctggcccgtagcgtccagctg

SEQ ID NO: 823334 - DNA, 25 bp, Mus musculus
tggtctggctccaatcactggttcc

SEQ ID NO: 823335 - DNA, 25 bp, Mus musculus
tggtctggctcctatcactggttcc

SEQ ID NO: 823336 - DNA, 25 bp, Mus musculus
tggtctgggtctcagtccaggccca

SEQ ID NO: 823337 - DNA, 25 bp, Mus musculus
tggtctgggtctgagtccaggccca

SEQ ID NO: 823338 - DNA, 25 bp, Mus musculus
tggtctggttatcccctcagtgtac

SEQ ID NO: 823339 - DNA, 25 bp, Mus musculus
tggtctggttatgccctcagtgtac

SEQ ID NO: 823340 - DNA, 25 bp, Mus musculus
tggtctgtaaagattccattggctt

SEQ ID NO: 823341 - DNA, 25 bp, Mus musculus
tggtctgtaaagtttccattggctt

SEQ ID NO: 823342 - DNA, 25 bp, Mus musculus
tggtctgtcaccctctccctttaaa

SEQ ID NO: 823343 - DNA, 25 bp, Mus musculus
tggtctgtcaccgtctccctttaaa

SEQ ID NO: 823344 - DNA, 25 bp, Mus musculus
tggtctgtccaccatggtctccagt

SEQ ID NO: 823345 - DNA, 25 bp, Mus musculus
tggtctgtccacgatggtctccagt

SEQ ID NO: 823346 - DNA, 25 bp, Mus musculus
tggtctgtctccatttacccacaag

SEQ ID NO: 823347 - DNA, 25 bp, Mus musculus
tggtctgtctccttttacccacaag

SEQ ID NO: 823348 - DNA, 25 bp, Mus musculus
tggtctgtctgtagacccaagtcag

SEQ ID NO: 823349 - DNA, 25 bp, Mus musculus
tggtctgtctgttgacccaagtcag

SEQ ID NO: 823350 - DNA, 25 bp, Mus musculus
tggtctgtgatgagaacggctctaa

SEQ ID NO: 823351 - DNA, 25 bp, Mus musculus
tggtctgtgatgtgaacggctctaa

SEQ ID NO: 823352 - DNA, 25 bp, Mus musculus
tggtctgtgtccacttttcctaaag

SEQ ID NO: 823353 - DNA, 25 bp, Mus musculus
tggtctgtgtcctcttttcctaaag

SEQ ID NO: 823354 - DNA, 25 bp, Mus musculus
tggtctgtgtctctaatgcatcgta

SEQ ID NO: 823355 - DNA, 25 bp, Mus musculus
tggtctgtgtctgtaatgcatcgta

SEQ ID NO: 823356 - DNA, 25 bp, Mus musculus
tggtctgttctaccccacagtttcc

SEQ ID NO: 823357 - DNA, 25 bp, Mus musculus
tggtctgttctagcccacagtttcc

SEQ ID NO: 823358 - DNA, 25 bp, Mus musculus
tggtcttaacttcactcccatgtag

SEQ ID NO: 823359 - DNA, 25 bp, Mus musculus
tggtcttaacttgactcccatgtag

SEQ ID NO: 823360 - DNA, 25 bp, Mus musculus
tggtcttcaccacaggagctcccag

SEQ ID NO: 823361 - DNA, 25 bp, Mus musculus
tggtcttcaccagaggagctcccag

SEQ ID NO: 823362 - DNA, 25 bp, Mus musculus
tggtcttcactgaggatgagaaaat

SEQ ID NO: 823363 - DNA, 25 bp, Mus musculus
tggtcttcactgtggatgagaaaat

SEQ ID NO: 823364 - DNA, 25 bp, Mus musculus
tggtcttcatggcatacaaggacag

SEQ ID NO: 823365 - DNA, 25 bp, Mus musculus
tggtcttcatgggatacaaggacag

SEQ ID NO: 823366 - DNA, 25 bp, Mus musculus
tggtcttcgactcataggcgcccac

SEQ ID NO: 823367 - DNA, 25 bp, Mus musculus
tggtcttcgactgataggcgcccac

SEQ ID NO: 823368 - DNA, 25 bp, Mus musculus
tggtcttcgtgcctggccctgagca

SEQ ID NO: 823369 - DNA, 25 bp, Mus musculus
tggtcttcgtgcgtggccctgagca

SEQ ID NO: 823370 - DNA, 25 bp, Mus musculus
tggtcttctatcagccctcggagtg

SEQ ID NO: 823371 - DNA, 25 bp, Mus musculus
tggtcttctatctgccctcggagtg

SEQ ID NO: 823372 - DNA, 25 bp, Mus musculus
tggtcttgaccaaacacccttaggt

SEQ ID NO: 823373 - DNA, 25 bp, Mus musculus
tggtcttgaccatacacccttaggt

SEQ ID NO: 823374 - DNA, 25 bp, Mus musculus
tggtcttgcccaacttcacatggag

SEQ ID NO: 823375 - DNA, 25 bp, Mus musculus
tggtcttgcccatcttcacatggag

SEQ ID NO: 823376 - DNA, 25 bp, Mus musculus
tggtcttgcgtgaggctcggctctc

SEQ ID NO: 823377 - DNA, 25 bp, Mus musculus
tggtcttgcgtgtggctcggctctc

SEQ ID NO: 823378 - DNA, 25 bp, Mus musculus
tggtcttgctcacatatcccaagtc

SEQ ID NO: 823379 - DNA, 25 bp, Mus musculus
tggtcttgctcagatatcccaagtc

SEQ ID NO: 823380 - DNA, 25 bp, Mus musculus
tggtcttgctccactgagatcagct

SEQ ID NO: 823381 - DNA, 25 bp, Mus musculus
tggtcttgctcctctgagatcagct

SEQ ID NO: 823382 - DNA, 25 bp, Mus musculus
tggtcttggagacaacctgctcact

SEQ ID NO: 823383 - DNA, 25 bp, Mus musculus
tggtcttggagagaacctgctcact

SEQ ID NO: 823384 - DNA, 25 bp, Mus musculus
tggtcttggcccagagcaacgttgc

SEQ ID NO: 823385 - DNA, 25 bp, Mus musculus
tggtcttggccctgagcaacgttgc

SEQ ID NO: 823386 - DNA, 25 bp, Mus musculus
tggtcttggctacgccaaccacggc

SEQ ID NO: 823387 - DNA, 25 bp, Mus musculus
tggtcttggctaggccaaccacggc

SEQ ID NO: 823388 - DNA, 25 bp, Mus musculus
tggtcttgggcaccctgttcattgg

SEQ ID NO: 823389 - DNA, 25 bp, Mus musculus
tggtcttgggcagcctgttcattgg

SEQ ID NO: 823390 - DNA, 25 bp, Mus musculus
tggtctttattcaacatgttggtgg

SEQ ID NO: 823391 - DNA, 25 bp, Mus musculus
tggtctttattctacatgttggtgg

SEQ ID NO: 823392 - DNA, 25 bp, Mus musculus
tggtctttcctgcaattctaatctg

SEQ ID NO: 823393 - DNA, 25 bp, Mus musculus
tggtctttcctggaattctaatctg

SEQ ID NO: 823394 - DNA, 25 bp, Mus musculus
tggtctttctatcgccagggccgta

SEQ ID NO: 823395 - DNA, 25 bp, Mus musculus
tggtctttctatggccagggccgta

SEQ ID NO: 823396 - DNA, 25 bp, Mus musculus
tggtctttgaagactgcaaggttcc

SEQ ID NO: 823397 - DNA, 25 bp, Mus musculus
tggtctttgaagtctgcaaggttcc

SEQ ID NO: 823398 - DNA, 25 bp, Mus musculus
tggtctttgcctcctaaaaacgcgg

SEQ ID NO: 823399 - DNA, 25 bp, Mus musculus
tggtctttgcctgctaaaaacgcgg

SEQ ID NO: 823400 - DNA, 25 bp, Mus musculus
tggtcttttggacggccagagttca

SEQ ID NO: 823401 - DNA, 25 bp, Mus musculus
tggtcttttggagggccagagttca

SEQ ID NO: 823402 - DNA, 25 bp, Mus musculus
tggtcttttgtcactgtcacgtgcc

SEQ ID NO: 823403 - DNA, 25 bp, Mus musculus
tggtcttttgtctctgtcacgtgcc

SEQ ID NO: 823404 - DNA, 25 bp, Mus musculus
tggtctttttgaattgaaagcagct

SEQ ID NO: 823405 - DNA, 25 bp, Mus musculus
tggtctttttgatttgaaagcagct

SEQ ID NO: 823406 - DNA, 25 bp, Mus musculus
tggtgaaaaacaacctgaaccccag

SEQ ID NO: 823407 - DNA, 25 bp, Mus musculus
tggtgaaaaacatcctgaaccccag

SEQ ID NO: 823408 - DNA, 25 bp, Mus musculus
tggtgaaaacgactctgggcctcaa

SEQ ID NO: 823409 - DNA, 25 bp, Mus musculus
tggtgaaaacgagtctgggcctcaa

SEQ ID NO: 823410 - DNA, 25 bp, Mus musculus
tggtgaaaagggactaaatctctaa

SEQ ID NO: 823411 - DNA, 25 bp, Mus musculus
tggtgaaaagggtctaaatctctaa

SEQ ID NO: 823412 - DNA, 25 bp, Mus musculus
tggtgaaaaggtacacagggcacga

SEQ ID NO: 823413 - DNA, 25 bp, Mus musculus
tggtgaaaaggttcacagggcacga

SEQ ID NO: 823414 - DNA, 25 bp, Mus musculus
tggtgaaaattactgacggatctcc

SEQ ID NO: 823415 - DNA, 25 bp, Mus musculus
tggtgaaaattagtgacggatctcc

SEQ ID NO: 823416 - DNA, 25 bp, Mus musculus
tggtgaaagactacatgacaactcc

SEQ ID NO: 823417 - DNA, 25 bp, Mus musculus
tggtgaaagacttcatgacaactcc

SEQ ID NO: 823418 - DNA, 25 bp, Mus musculus
tggtgaaagaggagaaagaatttgc

SEQ ID NO: 823419 - DNA, 25 bp, Mus musculus
tggtgaaagaggtgaaagaatttgc

SEQ ID NO: 823420 - DNA, 25 bp, Mus musculus
tggtgaaagtgcacgtttgattaga

SEQ ID NO: 823421 - DNA, 25 bp, Mus musculus
tggtgaaagtgctcgtttgattaga

SEQ ID NO: 823422 - DNA, 25 bp, Mus musculus
tggtgaaataaccaaagaggacttg

SEQ ID NO: 823423 - DNA, 25 bp, Mus musculus
tggtgaaataacgaaagaggacttg

SEQ ID NO: 823424 - DNA, 25 bp, Mus musculus
tggtgaaatacacgacgtagtagcc

SEQ ID NO: 823425 - DNA, 25 bp, Mus musculus
tggtgaaatacaggacgtagtagcc

SEQ ID NO: 823426 - DNA, 25 bp, Mus musculus
tggtgaacaaggaaggccgctacgt

SEQ ID NO: 823427 - DNA, 25 bp, Mus musculus
tggtgaacaaggtaggccgctacgt

SEQ ID NO: 823428 - DNA, 25 bp, Mus musculus
tggtgaacactgcatagaactcaga

SEQ ID NO: 823429 - DNA, 25 bp, Mus musculus
tggtgaacactggatagaactcaga

SEQ ID NO: 823430 - DNA, 25 bp, Mus musculus
tggtgaaccgatcgatgtaccctgg

SEQ ID NO: 823431 - DNA, 25 bp, Mus musculus
tggtgaaccgatggatgtaccctgg

SEQ ID NO: 823432 - DNA, 25 bp, Mus musculus
tggtgaaccgcgagttcgacaagct

SEQ ID NO: 823433 - DNA, 25 bp, Mus musculus
tggtgaaccgcgtgttcgacaagct

SEQ ID NO: 823434 - DNA, 25 bp, Mus musculus
tggtgaaccgctatcagagggccaa

SEQ ID NO: 823435 - DNA, 25 bp, Mus musculus
tggtgaaccgctttcagagggccaa

SEQ ID NO: 823436 - DNA, 25 bp, Mus musculus
tggtgaacgccaagagccgagcatg

SEQ ID NO: 823437 - DNA, 25 bp, Mus musculus
tggtgaacgccatgagccgagcatg

SEQ ID NO: 823438 - DNA, 25 bp, Mus musculus
tggtgaacgccgagcgcaagctgca

SEQ ID NO: 823439 - DNA, 25 bp, Mus musculus
tggtgaacgccgtgcgcaagctgca

SEQ ID NO: 823440 - DNA, 25 bp, Mus musculus
tggtgaacggttccagccctgctat

SEQ ID NO: 823441 - DNA, 25 bp, Mus musculus
tggtgaacggttgcagccctgctat

SEQ ID NO: 823442 - DNA, 25 bp, Mus musculus
tggtgaacttccaatggacgtaccc

SEQ ID NO: 823443 - DNA, 25 bp, Mus musculus
tggtgaacttcctatggacgtaccc

SEQ ID NO: 823444 - DNA, 25 bp, Mus musculus
tggtgaagaagacgcagaagctttc

SEQ ID NO: 823445 - DNA, 25 bp, Mus musculus
tggtgaagaagaggcagaagctttc

SEQ ID NO: 823446 - DNA, 25 bp, Mus musculus
tggtgaagacaaaatctgtgtgcct

SEQ ID NO: 823447 - DNA, 25 bp, Mus musculus
tggtgaagacaatatctgtgtgcct

SEQ ID NO: 823448 - DNA, 25 bp, Mus musculus
tggtgaagacataccccagcctggt

SEQ ID NO: 823449 - DNA, 25 bp, Mus musculus
tggtgaagacattccccagcctggt

SEQ ID NO: 823450 - DNA, 25 bp, Mus musculus
tggtgaagatctacggcaagatatg

SEQ ID NO: 823451 - DNA, 25 bp, Mus musculus
tggtgaagatcttcggcaagatatg

SEQ ID NO: 823452 - DNA, 25 bp, Mus musculus
tggtgaagattcagaagcacgtcac

SEQ ID NO: 823453 - DNA, 25 bp, Mus musculus
tggtgaagattctgaagcacgtcac

SEQ ID NO: 823454 - DNA, 25 bp, Mus musculus
tggtgaagcagtactggcaggccac

SEQ ID NO: 823455 - DNA, 25 bp, Mus musculus
tggtgaagcagttctggcaggccac

SEQ ID NO: 823456 - DNA, 25 bp, Mus musculus
tggtgaagccatccactcctgagtt

SEQ ID NO: 823457 - DNA, 25 bp, Mus musculus
tggtgaagccatgcactcctgagtt

SEQ ID NO: 823458 - DNA, 25 bp, Mus musculus
tggtgaagcccacccgaggatgtct

SEQ ID NO: 823459 - DNA, 25 bp, Mus musculus
tggtgaagcccagccgaggatgtct

SEQ ID NO: 823460 - DNA, 25 bp, Mus musculus
tggtgaagccggcattgccctacct

SEQ ID NO: 823461 - DNA, 25 bp, Mus musculus
tggtgaagccgggattgccctacct

SEQ ID NO: 823462 - DNA, 25 bp, Mus musculus
tggtgaagctaaagcagatcgagca

SEQ ID NO: 823463 - DNA, 25 bp, Mus musculus
tggtgaagctaatgcagatcgagca

SEQ ID NO: 823464 - DNA, 25 bp, Mus musculus
tggtgaagctacacaatacacgcca

SEQ ID NO: 823465 - DNA, 25 bp, Mus musculus
tggtgaagctactcaatacacgcca

SEQ ID NO: 823466 - DNA, 25 bp, Mus musculus
tggtgaagctctaggcctctacaac

SEQ ID NO: 823467 - DNA, 25 bp, Mus musculus
tggtgaagctcttggcctctacaac

SEQ ID NO: 823468 - DNA, 25 bp, Mus musculus
tggtgaagtatgacccgcacacact

SEQ ID NO: 823469 - DNA, 25 bp, Mus musculus
tggtgaagtatgtcccgcacacact

SEQ ID NO: 823470 - DNA, 25 bp, Mus musculus
tggtgaagtctgagttgaaagcttg

SEQ ID NO: 823471 - DNA, 25 bp, Mus musculus
tggtgaagtctgtgttgaaagcttg

SEQ ID NO: 823472 - DNA, 25 bp, Mus musculus
tggtgaagtcttccgttgcctgctt

SEQ ID NO: 823473 - DNA, 25 bp, Mus musculus
tggtgaagtcttgcgttgcctgctt

SEQ ID NO: 823474 - DNA, 25 bp, Mus musculus
tggtgaataactatggcagccggcc

SEQ ID NO: 823475 - DNA, 25 bp, Mus musculus
tggtgaataactttggcagccggcc

SEQ ID NO: 823476 - DNA, 25 bp, Mus musculus
tggtgaatactgctctaaagacgtc

SEQ ID NO: 823477 - DNA, 25 bp, Mus musculus
tggtgaatactggtctaaagacgtc

SEQ ID NO: 823478 - DNA, 25 bp, Mus musculus
tggtgaatcatcagctaattccctg

SEQ ID NO: 823479 - DNA, 25 bp, Mus musculus
tggtgaatcatctgctaattccctg

SEQ ID NO: 823480 - DNA, 25 bp, Mus musculus
tggtgaatcccacaaaaatcagagc

SEQ ID NO: 823481 - DNA, 25 bp, Mus musculus
tggtgaatcccagaaaaatcagagc

SEQ ID NO: 823482 - DNA, 25 bp, Mus musculus
tggtgaatgagaatgtcagcctcgt

SEQ ID NO: 823483 - DNA, 25 bp, Mus musculus
tggtgaatgagattgtcagcctcgt

SEQ ID NO: 823484 - DNA, 25 bp, Mus musculus
tggtgaatgccgcaattccagccta

SEQ ID NO: 823485 - DNA, 25 bp, Mus musculus
tggtgaatgccggaattccagccta

SEQ ID NO: 823486 - DNA, 25 bp, Mus musculus
tggtgaatggctaccgccaccagaa

SEQ ID NO: 823487 - DNA, 25 bp, Mus musculus
tggtgaatggcttccgccaccagaa

SEQ ID NO: 823488 - DNA, 25 bp, Mus musculus
tggtgaatttacagtaccgccgcct

SEQ ID NO: 823489 - DNA, 25 bp, Mus musculus
tggtgaatttactgtaccgccgcct

SEQ ID NO: 823490 - DNA, 25 bp, Mus musculus
tggtgacacagtacaacccctcaga

SEQ ID NO: 823491 - DNA, 25 bp, Mus musculus
tggtgacacagttcaacccctcaga

SEQ ID NO: 823492 - DNA, 25 bp, Mus musculus
tggtgacacatcacaagacttggga

SEQ ID NO: 823493 - DNA, 25 bp, Mus musculus
tggtgacacatctcaagacttggga

SEQ ID NO: 823494 - DNA, 25 bp, Mus musculus
tggtgacaccttctcacaggacttc

SEQ ID NO: 823495 - DNA, 25 bp, Mus musculus
tggtgacaccttgtcacaggacttc

SEQ ID NO: 823496 - DNA, 25 bp, Mus musculus
tggtgacactggcatcatccttcat

SEQ ID NO: 823497 - DNA, 25 bp, Mus musculus
tggtgacactgggatcatccttcat

SEQ ID NO: 823498 - DNA, 25 bp, Mus musculus
tggtgacaggttccaaggccactgc

SEQ ID NO: 823499 - DNA, 25 bp, Mus musculus
tggtgacaggttgcaaggccactgc

SEQ ID NO: 823500 - DNA, 25 bp, Mus musculus
tggtgacagtggagtcccagcacca

SEQ ID NO: 823501 - DNA, 25 bp, Mus musculus
tggtgacagtggattatgcagagac

SEQ ID NO: 823502 - DNA, 25 bp, Mus musculus
tggtgacagtggtgtcccagcacca

SEQ ID NO: 823503 - DNA, 25 bp, Mus musculus
tggtgacagtggtttatgcagagac

SEQ ID NO: 823504 - DNA, 25 bp, Mus musculus
tggtgacagttcaggtgcagagttc

SEQ ID NO: 823505 - DNA, 25 bp, Mus musculus
tggtgacagttctggtgcagagttc

SEQ ID NO: 823506 - DNA, 25 bp, Mus musculus
tggtgacatcacaagcttataccca

SEQ ID NO: 823507 - DNA, 25 bp, Mus musculus
tggtgacatcactagcttataccca

SEQ ID NO: 823508 - DNA, 25 bp, Mus musculus
tggtgacattcccggaagagaacac

SEQ ID NO: 823509 - DNA, 25 bp, Mus musculus
tggtgacattccgggaagagaacac

SEQ ID NO: 823510 - DNA, 25 bp, Mus musculus
tggtgaccacctactgggaagcact

SEQ ID NO: 823511 - DNA, 25 bp, Mus musculus
tggtgaccaccttctgggaagcact

SEQ ID NO: 823512 - DNA, 25 bp, Mus musculus
tggtgaccagccagacatccgatgt

SEQ ID NO: 823513 - DNA, 25 bp, Mus musculus
tggtgaccagcctgacatccgatgt

SEQ ID NO: 823514 - DNA, 25 bp, Mus musculus
tggtgaccaggcatggctatggcat

SEQ ID NO: 823515 - DNA, 25 bp, Mus musculus
tggtgaccaggcttggctatggcat

SEQ ID NO: 823516 - DNA, 25 bp, Mus musculus
tggtgaccatgtcagcgtcactggc

SEQ ID NO: 823517 - DNA, 25 bp, Mus musculus
tggtgaccatgtgagcgtcactggc

SEQ ID NO: 823518 - DNA, 25 bp, Mus musculus
tggtgaccattaatcgttctgctcg

SEQ ID NO: 823519 - DNA, 25 bp, Mus musculus
tggtgaccattattcgttctgctcg

SEQ ID NO: 823520 - DNA, 25 bp, Mus musculus
tggtgacccaacagactgccttaaa

SEQ ID NO: 823521 - DNA, 25 bp, Mus musculus
tggtgacccaactgactgccttaaa

SEQ ID NO: 823522 - DNA, 25 bp, Mus musculus
tggtgaccctggacctaaaggagac

SEQ ID NO: 823523 - DNA, 25 bp, Mus musculus
tggtgaccctggtcctaaaggagac

SEQ ID NO: 823524 - DNA, 25 bp, Mus musculus
tggtgaccgaccctagctgctatga

SEQ ID NO: 823525 - DNA, 25 bp, Mus musculus
tggtgaccgaccgtagctgctatga

SEQ ID NO: 823526 - DNA, 25 bp, Mus musculus
tggtgaccggatatgccgcctatga

SEQ ID NO: 823527 - DNA, 25 bp, Mus musculus
tggtgaccggatttgccgcctatga

SEQ ID NO: 823528 - DNA, 25 bp, Mus musculus
tggtgaccgtggcatccgaatcttt

SEQ ID NO: 823529 - DNA, 25 bp, Mus musculus
tggtgaccgtgggatccgaatcttt

SEQ ID NO: 823530 - DNA, 25 bp, Mus musculus
tggtgacctccaattgcaacaaaaa

SEQ ID NO: 823531 - DNA, 25 bp, Mus musculus
tggtgacctccatttgcaacaaaaa

SEQ ID NO: 823532 - DNA, 25 bp, Mus musculus
tggtgaccttcaaacagctgcttga

SEQ ID NO: 823533 - DNA, 25 bp, Mus musculus
tggtgaccttcatacagctgcttga

SEQ ID NO: 823534 - DNA, 25 bp, Mus musculus
tggtgacggtctccaaaattaccac

SEQ ID NO: 823535 - DNA, 25 bp, Mus musculus
tggtgacggtctgcaaaattaccac

SEQ ID NO: 823536 - DNA, 25 bp, Mus musculus
tggtgactataacgaaggagatgct

SEQ ID NO: 823537 - DNA, 25 bp, Mus musculus
tggtgactataaggaaggagatgct

SEQ ID NO: 823538 - DNA, 25 bp, Mus musculus
tggtgactcacgaccgcctgtcact

SEQ ID NO: 823539 - DNA, 25 bp, Mus musculus
tggtgactcacgtccgcctgtcact

SEQ ID NO: 823540 - DNA, 25 bp, Mus musculus
tggtgactcagcagctgtccaagtc

SEQ ID NO: 823541 - DNA, 25 bp, Mus musculus
tggtgactcagctgctgtccaagtc

SEQ ID NO: 823542 - DNA, 25 bp, Mus musculus
tggtgactcctgatctgaactctcg

SEQ ID NO: 823543 - DNA, 25 bp, Mus musculus
tggtgactcctgttctgaactctcg

SEQ ID NO: 823544 - DNA, 25 bp, Mus musculus
tggtgactgcacaatggacatccgg

SEQ ID NO: 823545 - DNA, 25 bp, Mus musculus
tggtgactgcactatggacatccgg

SEQ ID NO: 823546 - DNA, 25 bp, Mus musculus
tggtgactgtccaggcctgattcag

SEQ ID NO: 823547 - DNA, 25 bp, Mus musculus
tggtgactgtccctattgtagtaag

SEQ ID NO: 823548 - DNA, 25 bp, Mus musculus
tggtgactgtccgtattgtagtaag

SEQ ID NO: 823549 - DNA, 25 bp, Mus musculus
tggtgactgtcctggcctgattcag

SEQ ID NO: 823550 - DNA, 25 bp, Mus musculus
tggtgactgtctacaattccatgac

SEQ ID NO: 823551 - DNA, 25 bp, Mus musculus
tggtgactgtcttcaattccatgac

SEQ ID NO: 823552 - DNA, 25 bp, Mus musculus
tggtgacttccactgtgacagcttg

SEQ ID NO: 823553 - DNA, 25 bp, Mus musculus
tggtgacttccagtgtgacagcttg

SEQ ID NO: 823554 - DNA, 25 bp, Mus musculus
tggtgacttcgtctcattctcagaa

SEQ ID NO: 823555 - DNA, 25 bp, Mus musculus
tggtgacttcgtgtcattctcagaa

SEQ ID NO: 823556 - DNA, 25 bp, Mus musculus
tggtgactttatcttccccagggaa

SEQ ID NO: 823557 - DNA, 25 bp, Mus musculus
tggtgactttatgttccccagggaa

SEQ ID NO: 823558 - DNA, 25 bp, Mus musculus
tggtgagaaaccaacccctcacggg

SEQ ID NO: 823559 - DNA, 25 bp, Mus musculus
tggtgagaaacctacccctcacggg

SEQ ID NO: 823560 - DNA, 25 bp, Mus musculus
tggtgagaccagagggaagtacttc

SEQ ID NO: 823561 - DNA, 25 bp, Mus musculus
tggtgagaccagcacgcgtctccag

SEQ ID NO: 823562 - DNA, 25 bp, Mus musculus
tggtgagaccaggacgcgtctccag

SEQ ID NO: 823563 - DNA, 25 bp, Mus musculus
tggtgagaccagtgggaagtacttc

SEQ ID NO: 823564 - DNA, 25 bp, Mus musculus
tggtgagacgcacggctacatatac

SEQ ID NO: 823565 - DNA, 25 bp, Mus musculus
tggtgagacgcagggctacatatac

SEQ ID NO: 823566 - DNA, 25 bp, Mus musculus
tggtgagactacatacagcctggca

SEQ ID NO: 823567 - DNA, 25 bp, Mus musculus
tggtgagactacttacagcctggca

SEQ ID NO: 823568 - DNA, 25 bp, Mus musculus
tggtgagagtctcgatagaaacaat

SEQ ID NO: 823569 - DNA, 25 bp, Mus musculus
tggtgagagtctggatagaaacaat

SEQ ID NO: 823570 - DNA, 25 bp, Mus musculus
tggtgagcaagcacagcgagacctt

SEQ ID NO: 823571 - DNA, 25 bp, Mus musculus
tggtgagcaagctcagcgagacctt

SEQ ID NO: 823572 - DNA, 25 bp, Mus musculus
tggtgagcacctccgtgagcttctt

SEQ ID NO: 823573 - DNA, 25 bp, Mus musculus
tggtgagcacctgcgtgagcttctt

SEQ ID NO: 823574 - DNA, 25 bp, Mus musculus
tggtgagcacgtaccagtatccaga

SEQ ID NO: 823575 - DNA, 25 bp, Mus musculus
tggtgagcacgttccagtatccaga

SEQ ID NO: 823576 - DNA, 25 bp, Mus musculus
tggtgagcccctacctctcagatct

SEQ ID NO: 823577 - DNA, 25 bp, Mus musculus
tggtgagccccttcctctcagatct

SEQ ID NO: 823578 - DNA, 25 bp, Mus musculus
tggtgagcgataagctgtaccagcg

SEQ ID NO: 823579 - DNA, 25 bp, Mus musculus
tggtgagcgatatgctgtaccagcg

SEQ ID NO: 823580 - DNA, 25 bp, Mus musculus
tggtgagcggccaccacccaaacga

SEQ ID NO: 823581 - DNA, 25 bp, Mus musculus
tggtgagcggcctccacccaaacga

SEQ ID NO: 823582 - DNA, 25 bp, Mus musculus
tggtgagctgctagtttgggacctc

SEQ ID NO: 823583 - DNA, 25 bp, Mus musculus
tggtgagctgcttgtttgggacctc

SEQ ID NO: 823584 - DNA, 25 bp, Mus musculus
tggtgaggataacaacgcgtctgtc

SEQ ID NO: 823585 - DNA, 25 bp, Mus musculus
tggtgaggataagaacgcgtctgtc

SEQ ID NO: 823586 - DNA, 25 bp, Mus musculus
tggtgaggcctcaggactttgagaa

SEQ ID NO: 823587 - DNA, 25 bp, Mus musculus
tggtgaggcctctggactttgagaa

SEQ ID NO: 823588 - DNA, 25 bp, Mus musculus
tggtgaggtgagcttcaaacattct

SEQ ID NO: 823589 - DNA, 25 bp, Mus musculus
tggtgaggtgaggttcaaacattct

SEQ ID NO: 823590 - DNA, 25 bp, Mus musculus
tggtgagtagcactcggtacccaga

SEQ ID NO: 823591 - DNA, 25 bp, Mus musculus
tggtgagtagcagtcggtacccaga

SEQ ID NO: 823592 - DNA, 25 bp, Mus musculus
tggtgagtagctccctgtttcccta

SEQ ID NO: 823593 - DNA, 25 bp, Mus musculus
tggtgagtagctgcctgtttcccta

SEQ ID NO: 823594 - DNA, 25 bp, Mus musculus
tggtgagtttttactgggccccttg

SEQ ID NO: 823595 - DNA, 25 bp, Mus musculus
tggtgagttttttctgggccccttg

SEQ ID NO: 823596 - DNA, 25 bp, Mus musculus
tggtgataatacctacctcgtaggg

SEQ ID NO: 823597 - DNA, 25 bp, Mus musculus
tggtgataatacgtacctcgtaggg

SEQ ID NO: 823598 - DNA, 25 bp, Mus musculus
tggtgatactctccctctacattgt

SEQ ID NO: 823599 - DNA, 25 bp, Mus musculus
tggtgatactctgcctctacattgt

SEQ ID NO: 823600 - DNA, 25 bp, Mus musculus
tggtgatattttcagcaagagcaac

SEQ ID NO: 823601 - DNA, 25 bp, Mus musculus
tggtgatattttgagcaagagcaac

SEQ ID NO: 823602 - DNA, 25 bp, Mus musculus
tggtgatcagcacctcagaggattc

SEQ ID NO: 823603 - DNA, 25 bp, Mus musculus
tggtgatcagcagctcagaggattc

SEQ ID NO: 823604 - DNA, 25 bp, Mus musculus
tggtgatcgaccaccgcaactacga

SEQ ID NO: 823605 - DNA, 25 bp, Mus musculus
tggtgatcgacctccgcaactacga

SEQ ID NO: 823606 - DNA, 25 bp, Mus musculus
tggtgatcgcccagcaagacctact

SEQ ID NO: 823607 - DNA, 25 bp, Mus musculus
tggtgatcgccctgcaagacctact

SEQ ID NO: 823608 - DNA, 25 bp, Mus musculus
tggtgatcgtgcagaccgggtccat

SEQ ID NO: 823609 - DNA, 25 bp, Mus musculus
tggtgatcgtgctgaccgggtccat

SEQ ID NO: 823610 - DNA, 25 bp, Mus musculus
tggtgatctaagatcacgcctcctg

SEQ ID NO: 823611 - DNA, 25 bp, Mus musculus
tggtgatctaagttcacgcctcctg

SEQ ID NO: 823612 - DNA, 25 bp, Mus musculus
tggtgatgacaacagccaggctgcc

SEQ ID NO: 823613 - DNA, 25 bp, Mus musculus
tggtgatgacaagagccaggctgcc

SEQ ID NO: 823614 - DNA, 25 bp, Mus musculus
tggtgatgagagaggccaacctgcc

SEQ ID NO: 823615 - DNA, 25 bp, Mus musculus
tggtgatgagagtggccaacctgcc

SEQ ID NO: 823616 - DNA, 25 bp, Mus musculus
tggtgatgagttcctcaactttctt

SEQ ID NO: 823617 - DNA, 25 bp, Mus musculus
tggtgatgagttgctcaactttctt

SEQ ID NO: 823618 - DNA, 25 bp, Mus musculus
tggtgatgcagtacattaatactgc

SEQ ID NO: 823619 - DNA, 25 bp, Mus musculus
tggtgatgcagttcattaatactgc

SEQ ID NO: 823620 - DNA, 25 bp, Mus musculus
tggtgatgccacatcgtgctagcaa

SEQ ID NO: 823621 - DNA, 25 bp, Mus musculus
tggtgatgccacttcgtgctagcaa

SEQ ID NO: 823622 - DNA, 25 bp, Mus musculus
tggtgatgctacacattgggctgct

SEQ ID NO: 823623 - DNA, 25 bp, Mus musculus
tggtgatgctactcattgggctgct

SEQ ID NO: 823624 - DNA, 25 bp, Mus musculus
tggtgatgctgaacctggactcgga

SEQ ID NO: 823625 - DNA, 25 bp, Mus musculus
tggtgatgctgatcctggactcgga

SEQ ID NO: 823626 - DNA, 25 bp, Mus musculus
tggtgatgctggacggcaacaaaac

SEQ ID NO: 823627 - DNA, 25 bp, Mus musculus
tggtgatgctggagacggttcctca

SEQ ID NO: 823628 - DNA, 25 bp, Mus musculus
tggtgatgctggtcggcaacaaaac

SEQ ID NO: 823629 - DNA, 25 bp, Mus musculus
tggtgatgctggtgacggttcctca

SEQ ID NO: 823630 - DNA, 25 bp, Mus musculus
tggtgatggaaccttgctagttcgc

SEQ ID NO: 823631 - DNA, 25 bp, Mus musculus
tggtgatggaacgttgctagttcgc

SEQ ID NO: 823632 - DNA, 25 bp, Mus musculus
tggtgatggcacaaacttcgttctg

SEQ ID NO: 823633 - DNA, 25 bp, Mus musculus
tggtgatggcactaacttcgttctg

SEQ ID NO: 823634 - DNA, 25 bp, Mus musculus
tggtgatggcccctcatgaaccgtt

SEQ ID NO: 823635 - DNA, 25 bp, Mus musculus
tggtgatggcccgtcatgaaccgtt

SEQ ID NO: 823636 - DNA, 25 bp, Mus musculus
tggtgatgggcaccgaactcaccca

SEQ ID NO: 823637 - DNA, 25 bp, Mus musculus
tggtgatgggcagcgaactcaccca

SEQ ID NO: 823638 - DNA, 25 bp, Mus musculus
tggtgattaccaactcaagctaatt

SEQ ID NO: 823639 - DNA, 25 bp, Mus musculus
tggtgattaccatctcaagctaatt

SEQ ID NO: 823640 - DNA, 25 bp, Mus musculus
tggtgattgaccagttcatggcagg

SEQ ID NO: 823641 - DNA, 25 bp, Mus musculus
tggtgattgacctgttcatggcagg

SEQ ID NO: 823642 - DNA, 25 bp, Mus musculus
tggtgattgttcacggcagccagga

SEQ ID NO: 823643 - DNA, 25 bp, Mus musculus
tggtgattgttctcggcagccagga

SEQ ID NO: 823644 - DNA, 25 bp, Mus musculus
tggtgcaaagacaacagctatgtga

SEQ ID NO: 823645 - DNA, 25 bp, Mus musculus
tggtgcaaagactacagctatgtga

SEQ ID NO: 823646 - DNA, 25 bp, Mus musculus
tggtgcaagaggaacgagacccaga

SEQ ID NO: 823647 - DNA, 25 bp, Mus musculus
tggtgcaagaggtacgagacccaga

SEQ ID NO: 823648 - DNA, 25 bp, Mus musculus
tggtgcaagtgtcgtagctatcgac

SEQ ID NO: 823649 - DNA, 25 bp, Mus musculus
tggtgcaagtgtggtagctatcgac

SEQ ID NO: 823650 - DNA, 25 bp, Mus musculus
tggtgcaccacaagaagacgacttg

SEQ ID NO: 823651 - DNA, 25 bp, Mus musculus
tggtgcaccacatgaagacgacttg

SEQ ID NO: 823652 - DNA, 25 bp, Mus musculus
tggtgcacctgcacctgtgcatctg

SEQ ID NO: 823653 - DNA, 25 bp, Mus musculus
tggtgcacctgctcctgtgcatctg

SEQ ID NO: 823654 - DNA, 25 bp, Mus musculus
tggtgcactatgctcacagctgtct

SEQ ID NO: 823655 - DNA, 25 bp, Mus musculus
tggtgcactatggtcacagctgtct

SEQ ID NO: 823656 - DNA, 25 bp, Mus musculus
tggtgcactgaacagccaccctgtg

SEQ ID NO: 823657 - DNA, 25 bp, Mus musculus
tggtgcactgaagagccaccctgtg

SEQ ID NO: 823658 - DNA, 25 bp, Mus musculus
tggtgcagagcaaagatgatgtgat

SEQ ID NO: 823659 - DNA, 25 bp, Mus musculus
tggtgcagagcaagaccctacactg

SEQ ID NO: 823660 - DNA, 25 bp, Mus musculus
tggtgcagagcatagatgatgtgat

SEQ ID NO: 823661 - DNA, 25 bp, Mus musculus
tggtgcagagcatgaccctacactg

SEQ ID NO: 823662 - DNA, 25 bp, Mus musculus
tggtgcagcaagaacgaaaacgtac

SEQ ID NO: 823663 - DNA, 25 bp, Mus musculus
tggtgcagcaagtacgaaaacgtac

SEQ ID NO: 823664 - DNA, 25 bp, Mus musculus
tggtgcagcacgctacactctactg

SEQ ID NO: 823665 - DNA, 25 bp, Mus musculus
tggtgcagcacggtacactctactg

SEQ ID NO: 823666 - DNA, 25 bp, Mus musculus
tggtgcagccatagaagccgggatt

SEQ ID NO: 823667 - DNA, 25 bp, Mus musculus
tggtgcagccattgaagccgggatt

SEQ ID NO: 823668 - DNA, 25 bp, Mus musculus
tggtgcagcccaaaccacgatggct

SEQ ID NO: 823669 - DNA, 25 bp, Mus musculus
tggtgcagcccataccacgatggct

SEQ ID NO: 823670 - DNA, 25 bp, Mus musculus
tggtgcagctacaccaataattggc

SEQ ID NO: 823671 - DNA, 25 bp, Mus musculus
tggtgcagctactccaataattggc

SEQ ID NO: 823672 - DNA, 25 bp, Mus musculus
tggtgcagctcaacatggatgctta

SEQ ID NO: 823673 - DNA, 25 bp, Mus musculus
tggtgcagctcatcatggatgctta

SEQ ID NO: 823674 - DNA, 25 bp, Mus musculus
tggtgcagctgcaacaaggcctgga

SEQ ID NO: 823675 - DNA, 25 bp, Mus musculus
tggtgcagctgctacaaggcctgga

SEQ ID NO: 823676 - DNA, 25 bp, Mus musculus
tggtgcaggagcatgccaagaccaa

SEQ ID NO: 823677 - DNA, 25 bp, Mus musculus
tggtgcaggagcttgccaagaccaa

SEQ ID NO: 823678 - DNA, 25 bp, Mus musculus
tggtgcagggccatctcagtatgcc

SEQ ID NO: 823679 - DNA, 25 bp, Mus musculus
tggtgcagggccttctcagtatgcc

SEQ ID NO: 823680 - DNA, 25 bp, Mus musculus
tggtgcatcttcataggcctgggag

SEQ ID NO: 823681 - DNA, 25 bp, Mus musculus
tggtgcatcttcttaggcctgggag

SEQ ID NO: 823682 - DNA, 25 bp, Mus musculus
tggtgcatgcgcaccaaggaagtgt

SEQ ID NO: 823683 - DNA, 25 bp, Mus musculus
tggtgcatgcgctccaaggaagtgt

SEQ ID NO: 823684 - DNA, 25 bp, Mus musculus
tggtgccaacatagacctggactct

SEQ ID NO: 823685 - DNA, 25 bp, Mus musculus
tggtgccaacattgacctggactct

SEQ ID NO: 823686 - DNA, 25 bp, Mus musculus
tggtgccaaccactggatcaagttt

SEQ ID NO: 823687 - DNA, 25 bp, Mus musculus
tggtgccaaccagtggatcaagttt

SEQ ID NO: 823688 - DNA, 25 bp, Mus musculus
tggtgccaagagctcaccaacggct

SEQ ID NO: 823689 - DNA, 25 bp, Mus musculus
tggtgccaagaggtcaccaacggct

SEQ ID NO: 823690 - DNA, 25 bp, Mus musculus
tggtgccaagataattgaagttggg

SEQ ID NO: 823691 - DNA, 25 bp, Mus musculus
tggtgccaagattattgaagttggg

SEQ ID NO: 823692 - DNA, 25 bp, Mus musculus
tggtgccacataagcagtaacgggt

SEQ ID NO: 823693 - DNA, 25 bp, Mus musculus
tggtgccacatatgcagtaacgggt

SEQ ID NO: 823694 - DNA, 25 bp, Mus musculus
tggtgccagtccatgcaggatccct

SEQ ID NO: 823695 - DNA, 25 bp, Mus musculus
tggtgccagtccttgcaggatccct

SEQ ID NO: 823696 - DNA, 25 bp, Mus musculus
tggtgccagtgaacagggtgaccct

SEQ ID NO: 823697 - DNA, 25 bp, Mus musculus
tggtgccagtgatcagggtgaccct

SEQ ID NO: 823698 - DNA, 25 bp, Mus musculus
tggtgccatgaaccgaccagtccaa

SEQ ID NO: 823699 - DNA, 25 bp, Mus musculus
tggtgccatgaagcgaccagtccaa

SEQ ID NO: 823700 - DNA, 25 bp, Mus musculus
tggtgcccacagagtacatgaaggt

SEQ ID NO: 823701 - DNA, 25 bp, Mus musculus
tggtgcccacagtgtacatgaaggt

SEQ ID NO: 823702 - DNA, 25 bp, Mus musculus
tggtgcccacccaggtagagcctgc

SEQ ID NO: 823703 - DNA, 25 bp, Mus musculus
tggtgcccaccctggtagagcctgc

SEQ ID NO: 823704 - DNA, 25 bp, Mus musculus
tggtgcccaggtcaacaccacggat

SEQ ID NO: 823705 - DNA, 25 bp, Mus musculus
tggtgcccaggtgaacaccacggat

SEQ ID NO: 823706 - DNA, 25 bp, Mus musculus
tggtgccccactcaagaacattagt

SEQ ID NO: 823707 - DNA, 25 bp, Mus musculus
tggtgccccactgaagaacattagt

SEQ ID NO: 823708 - DNA, 25 bp, Mus musculus
tggtgccccatcaccgggacgttct

SEQ ID NO: 823709 - DNA, 25 bp, Mus musculus
tggtgccccatctccgggacgttct

SEQ ID NO: 823710 - DNA, 25 bp, Mus musculus
tggtgcccctgactgctcacggcaa

SEQ ID NO: 823711 - DNA, 25 bp, Mus musculus
tggtgcccctgagtgctcacggcaa

SEQ ID NO: 823712 - DNA, 25 bp, Mus musculus
tggtgcccgaaaccagcctagcatt

SEQ ID NO: 823713 - DNA, 25 bp, Mus musculus
tggtgcccgaaagcagcctagcatt

SEQ ID NO: 823714 - DNA, 25 bp, Mus musculus
tggtgccctatcaactcaaaatgtg

SEQ ID NO: 823715 - DNA, 25 bp, Mus musculus
tggtgccctatctactcaaaatgtg

SEQ ID NO: 823716 - DNA, 25 bp, Mus musculus
tggtgccctctgcaatgaccacagg

SEQ ID NO: 823717 - DNA, 25 bp, Mus musculus
tggtgccctctggaatgaccacagg

SEQ ID NO: 823718 - DNA, 25 bp, Mus musculus
tggtgccctgccattcctgagcagg

SEQ ID NO: 823719 - DNA, 25 bp, Mus musculus
tggtgccctgcctttcctgagcagg

SEQ ID NO: 823720 - DNA, 25 bp, Mus musculus
tggtgccctgtccatcgcagctata

SEQ ID NO: 823721 - DNA, 25 bp, Mus musculus
tggtgccctgtcgatcgcagctata

SEQ ID NO: 823722 - DNA, 25 bp, Mus musculus
tggtgccctgtgcactggatcctcc

SEQ ID NO: 823723 - DNA, 25 bp, Mus musculus
tggtgccctgtggactggatcctcc

SEQ ID NO: 823724 - DNA, 25 bp, Mus musculus
tggtgccctgttctgacatctgctg

SEQ ID NO: 823725 - DNA, 25 bp, Mus musculus
tggtgccctgttgtgacatctgctg

SEQ ID NO: 823726 - DNA, 25 bp, Mus musculus
tggtgccgagccaagacccgcggct

SEQ ID NO: 823727 - DNA, 25 bp, Mus musculus
tggtgccgagcctagacccgcggct

SEQ ID NO: 823728 - DNA, 25 bp, Mus musculus
tggtgccgcccaccaagggctgact

SEQ ID NO: 823729 - DNA, 25 bp, Mus musculus
tggtgccgcccagcaagggctgact

SEQ ID NO: 823730 - DNA, 25 bp, Mus musculus
tggtgcctaaggatgctcagccctg

SEQ ID NO: 823731 - DNA, 25 bp, Mus musculus
tggtgcctaaggttgctcagccctg

SEQ ID NO: 823732 - DNA, 25 bp, Mus musculus
tggtgcctactgaaaaatctatcgt

SEQ ID NO: 823733 - DNA, 25 bp, Mus musculus
tggtgcctactgtaaaatctatcgt

SEQ ID NO: 823734 - DNA, 25 bp, Mus musculus
tggtgcctgcagactcttagacatg

SEQ ID NO: 823735 - DNA, 25 bp, Mus musculus
tggtgcctgcagtctcttagacatg

SEQ ID NO: 823736 - DNA, 25 bp, Mus musculus
tggtgcctgccgcacactgggaacc

SEQ ID NO: 823737 - DNA, 25 bp, Mus musculus
tggtgcctgccggacactgggaacc

SEQ ID NO: 823738 - DNA, 25 bp, Mus musculus
tggtgcctggaacatcacaggtccc

SEQ ID NO: 823739 - DNA, 25 bp, Mus musculus
tggtgcctggaagatcacaggtccc

SEQ ID NO: 823740 - DNA, 25 bp, Mus musculus
tggtgcctggtcagtccaccatggt

SEQ ID NO: 823741 - DNA, 25 bp, Mus musculus
tggtgcctggtctgtccaccatggt

SEQ ID NO: 823742 - DNA, 25 bp, Mus musculus
tggtgcctgtgcaggacagcgcttc

SEQ ID NO: 823743 - DNA, 25 bp, Mus musculus
tggtgcctgtgctggacagcgcttc

SEQ ID NO: 823744 - DNA, 25 bp, Mus musculus
tggtgcctgtttcagcccagaagag

SEQ ID NO: 823745 - DNA, 25 bp, Mus musculus
tggtgcctgtttgagcccagaagag

SEQ ID NO: 823746 - DNA, 25 bp, Mus musculus
tggtgccttctgatcatgatcagct

SEQ ID NO: 823747 - DNA, 25 bp, Mus musculus
tggtgccttctgttcatgatcagct

SEQ ID NO: 823748 - DNA, 25 bp, Mus musculus
tggtgcgaccgactcctctggaagt

SEQ ID NO: 823749 - DNA, 25 bp, Mus musculus
tggtgcgaccgagtcctctggaagt

SEQ ID NO: 823750 - DNA, 25 bp, Mus musculus
tggtgcgacttgactttttcagtgc

SEQ ID NO: 823751 - DNA, 25 bp, Mus musculus
tggtgcgacttgtctttttcagtgc

SEQ ID NO: 823752 - DNA, 25 bp, Mus musculus
tggtgcgctcacagaccatggttga

SEQ ID NO: 823753 - DNA, 25 bp, Mus musculus
tggtgcgctcactgaccatggttga

SEQ ID NO: 823754 - DNA, 25 bp, Mus musculus
tggtgcgcttgcagagtgctgccca

SEQ ID NO: 823755 - DNA, 25 bp, Mus musculus
tggtgcgcttgctgagtgctgccca

SEQ ID NO: 823756 - DNA, 25 bp, Mus musculus
tggtgcgctttcaattctctgtcag

SEQ ID NO: 823757 - DNA, 25 bp, Mus musculus
tggtgcgctttctattctctgtcag

SEQ ID NO: 823758 - DNA, 25 bp, Mus musculus
tggtgcggcacaccagatgtttata

SEQ ID NO: 823759 - DNA, 25 bp, Mus musculus
tggtgcggcacagcagatgtttata

SEQ ID NO: 823760 - DNA, 25 bp, Mus musculus
tggtgcgggtctaaaagagcgttcc

SEQ ID NO: 823761 - DNA, 25 bp, Mus musculus
tggtgcgggtcttaaagagcgttcc

SEQ ID NO: 823762 - DNA, 25 bp, Mus musculus
tggtgctaaccaacttcctcatcag

SEQ ID NO: 823763 - DNA, 25 bp, Mus musculus
tggtgctaaccatcttcctcatcag

SEQ ID NO: 823764 - DNA, 25 bp, Mus musculus
tggtgctaatatcccatcaacatga

SEQ ID NO: 823765 - DNA, 25 bp, Mus musculus
tggtgctaatatgccatcaacatga

SEQ ID NO: 823766 - DNA, 25 bp, Mus musculus
tggtgctataccatggacccggata

SEQ ID NO: 823767 - DNA, 25 bp, Mus musculus
tggtgctataccttggacccggata

SEQ ID NO: 823768 - DNA, 25 bp, Mus musculus
tggtgctatctaaatccgccgtagg

SEQ ID NO: 823769 - DNA, 25 bp, Mus musculus
tggtgctatctatatccgccgtagg

SEQ ID NO: 823770 - DNA, 25 bp, Mus musculus
tggtgctatgggaactactgactgg

SEQ ID NO: 823771 - DNA, 25 bp, Mus musculus
tggtgctatgggtactactgactgg

SEQ ID NO: 823772 - DNA, 25 bp, Mus musculus
tggtgctcaagcaggtcttcaggaa

SEQ ID NO: 823773 - DNA, 25 bp, Mus musculus
tggtgctcaagctggtcttcaggaa

SEQ ID NO: 823774 - DNA, 25 bp, Mus musculus
tggtgctcacgaccatcgctggctg

SEQ ID NO: 823775 - DNA, 25 bp, Mus musculus
tggtgctcacgagcatcgctggctg

SEQ ID NO: 823776 - DNA, 25 bp, Mus musculus
tggtgctcatccctaccttcagagg

SEQ ID NO: 823777 - DNA, 25 bp, Mus musculus
tggtgctcatccgtaccttcagagg

SEQ ID NO: 823778 - DNA, 25 bp, Mus musculus
tggtgctccatcacctactacgagc

SEQ ID NO: 823779 - DNA, 25 bp, Mus musculus
tggtgctccatctcctactacgagc

SEQ ID NO: 823780 - DNA, 25 bp, Mus musculus
tggtgctcctatattgttctcagct

SEQ ID NO: 823781 - DNA, 25 bp, Mus musculus
tggtgctcctattttgttctcagct

SEQ ID NO: 823782 - DNA, 25 bp, Mus musculus
tggtgctctcgtcaatgagttgtac

SEQ ID NO: 823783 - DNA, 25 bp, Mus musculus
tggtgctctcgtgaatgagttgtac

SEQ ID NO: 823784 - DNA, 25 bp, Mus musculus
tggtgctcttggcttaagaggacct

SEQ ID NO: 823785 - DNA, 25 bp, Mus musculus
tggtgctcttgggttaagaggacct

SEQ ID NO: 823786 - DNA, 25 bp, Mus musculus
tggtgctgacagaactcatggaact

SEQ ID NO: 823787 - DNA, 25 bp, Mus musculus
tggtgctgacagtactcatggaact

SEQ ID NO: 823788 - DNA, 25 bp, Mus musculus
tggtgctgagcacgaacttcgtgca

SEQ ID NO: 823789 - DNA, 25 bp, Mus musculus
tggtgctgagcaggaacttcgtgca

SEQ ID NO: 823790 - DNA, 25 bp, Mus musculus
tggtgctgatgtacacacgcagagt

SEQ ID NO: 823791 - DNA, 25 bp, Mus musculus
tggtgctgatgttcacacgcagagt

SEQ ID NO: 823792 - DNA, 25 bp, Mus musculus
tggtgctgctggaccgtggactgac

SEQ ID NO: 823793 - DNA, 25 bp, Mus musculus
tggtgctgctggtccgtggactgac

SEQ ID NO: 823794 - DNA, 25 bp, Mus musculus
tggtgctggatccatcgggctataa

SEQ ID NO: 823795 - DNA, 25 bp, Mus musculus
tggtgctggatcgatcgggctataa

SEQ ID NO: 823796 - DNA, 25 bp, Mus musculus
tggtgctggccaagcagctgctgct

SEQ ID NO: 823797 - DNA, 25 bp, Mus musculus
tggtgctggccatgcagctgctgct

SEQ ID NO: 823798 - DNA, 25 bp, Mus musculus
tggtgctggtgtcctcatagttgcc

SEQ ID NO: 823799 - DNA, 25 bp, Mus musculus
tggtgctggtgtgctcatagttgcc

SEQ ID NO: 823800 - DNA, 25 bp, Mus musculus
tggtgctgtccccagaccgagacga

SEQ ID NO: 823801 - DNA, 25 bp, Mus musculus
tggtgctgtcccgagaccgagacga

SEQ ID NO: 823802 - DNA, 25 bp, Mus musculus
tggtgctgtcttcaatcaagtagcc

SEQ ID NO: 823803 - DNA, 25 bp, Mus musculus
tggtgctgtcttgaatcaagtagcc

SEQ ID NO: 823804 - DNA, 25 bp, Mus musculus
tggtgcttaaaaacttcatcagggc

SEQ ID NO: 823805 - DNA, 25 bp, Mus musculus
tggtgcttaaaatcttcatcagggc

SEQ ID NO: 823806 - DNA, 25 bp, Mus musculus
tggtgcttactaattacatgttccc

SEQ ID NO: 823807 - DNA, 25 bp, Mus musculus
tggtgcttactatttacatgttccc

SEQ ID NO: 823808 - DNA, 25 bp, Mus musculus
tggtgcttcacaactcgacctggtt

SEQ ID NO: 823809 - DNA, 25 bp, Mus musculus
tggtgcttcacatctcgacctggtt

SEQ ID NO: 823810 - DNA, 25 bp, Mus musculus
tggtgcttcccacagcagtaggaat

SEQ ID NO: 823811 - DNA, 25 bp, Mus musculus
tggtgcttcccagagcagtaggaat

SEQ ID NO: 823812 - DNA, 25 bp, Mus musculus
tggtgcttcctgatccacgtgcaag

SEQ ID NO: 823813 - DNA, 25 bp, Mus musculus
tggtgcttcctgttccacgtgcaag

SEQ ID NO: 823814 - DNA, 25 bp, Mus musculus
tggtgcttgaaaatgagggcgccca

SEQ ID NO: 823815 - DNA, 25 bp, Mus musculus
tggtgcttgaaattgagggcgccca

SEQ ID NO: 823816 - DNA, 25 bp, Mus musculus
tggtgcttggctaggccctaaagtt

SEQ ID NO: 823817 - DNA, 25 bp, Mus musculus
tggtgcttggcttggccctaaagtt

SEQ ID NO: 823818 - DNA, 25 bp, Mus musculus
tggtgcttgtgaagcttcagccaag

SEQ ID NO: 823819 - DNA, 25 bp, Mus musculus
tggtgcttgtgatgcttcagccaag

SEQ ID NO: 823820 - DNA, 25 bp, Mus musculus
tggtgctttccgctccgtttctacg

SEQ ID NO: 823821 - DNA, 25 bp, Mus musculus
tggtgctttccggtccgtttctacg

SEQ ID NO: 823822 - DNA, 25 bp, Mus musculus
tggtgctttgataccggacacggtg

SEQ ID NO: 823823 - DNA, 25 bp, Mus musculus
tggtgctttgattccggacacggtg

SEQ ID NO: 823824 - DNA, 25 bp, Mus musculus
tggtgcttttgcaggtagtttgcag

SEQ ID NO: 823825 - DNA, 25 bp, Mus musculus
tggtgcttttgctggtagtttgcag

SEQ ID NO: 823826 - DNA, 25 bp, Mus musculus
tggtggaaaaccaaaagcctgttgg

SEQ ID NO: 823827 - DNA, 25 bp, Mus musculus
tggtggaaaacctaaagcctgttgg

SEQ ID NO: 823828 - DNA, 25 bp, Mus musculus
tggtggaaagctaacctctggcaga

SEQ ID NO: 823829 - DNA, 25 bp, Mus musculus
tggtggaaagcttacctctggcaga

SEQ ID NO: 823830 - DNA, 25 bp, Mus musculus
tggtggaaatttcccagtaactgca

SEQ ID NO: 823831 - DNA, 25 bp, Mus musculus
tggtggaaatttgccagtaactgca

SEQ ID NO: 823832 - DNA, 25 bp, Mus musculus
tggtggaaccaaccacggtggacac

SEQ ID NO: 823833 - DNA, 25 bp, Mus musculus
tggtggaaccaagcacggtggacac

SEQ ID NO: 823834 - DNA, 25 bp, Mus musculus
tggtggaaccccaggagatgcccct

SEQ ID NO: 823835 - DNA, 25 bp, Mus musculus
tggtggaacccctggagatgcccct

SEQ ID NO: 823836 - DNA, 25 bp, Mus musculus
tggtggaactctatggaaacagcct

SEQ ID NO: 823837 - DNA, 25 bp, Mus musculus
tggtggaactctttggaaacagcct

SEQ ID NO: 823838 - DNA, 25 bp, Mus musculus
tggtggaagattactctgagaagtg

SEQ ID NO: 823839 - DNA, 25 bp, Mus musculus
tggtggaagatttctctgagaagtg

SEQ ID NO: 823840 - DNA, 25 bp, Mus musculus
tggtggaagctcaggacaaggtcct

SEQ ID NO: 823841 - DNA, 25 bp, Mus musculus
tggtggaagctcctaaccagccctg

SEQ ID NO: 823842 - DNA, 25 bp, Mus musculus
tggtggaagctcgtaaccagccctg

SEQ ID NO: 823843 - DNA, 25 bp, Mus musculus
tggtggaagctctggacaaggtcct

SEQ ID NO: 823844 - DNA, 25 bp, Mus musculus
tggtggaagggaaccacactgtgta

SEQ ID NO: 823845 - DNA, 25 bp, Mus musculus
tggtggaagggatccacactgtgta

SEQ ID NO: 823846 - DNA, 25 bp, Mus musculus
tggtggaagtcaccctgcacccagt

SEQ ID NO: 823847 - DNA, 25 bp, Mus musculus
tggtggaagtcagcctgcacccagt

SEQ ID NO: 823848 - DNA, 25 bp, Mus musculus
tggtggacaactccacttcgttctg

SEQ ID NO: 823849 - DNA, 25 bp, Mus musculus
tggtggacaactgcacttcgttctg

SEQ ID NO: 823850 - DNA, 25 bp, Mus musculus
tggtggacatttaccggaaactggg

SEQ ID NO: 823851 - DNA, 25 bp, Mus musculus
tggtggacattttccggaaactggg

SEQ ID NO: 823852 - DNA, 25 bp, Mus musculus
tggtggaccccaaggacatcgatga

SEQ ID NO: 823853 - DNA, 25 bp, Mus musculus
tggtggaccccatggacatcgatga

SEQ ID NO: 823854 - DNA, 25 bp, Mus musculus
tggtggacgaatctgacccagacgt

SEQ ID NO: 823855 - DNA, 25 bp, Mus musculus
tggtggacgaatgtgacccagacgt

SEQ ID NO: 823856 - DNA, 25 bp, Mus musculus
tggtggacggccacatcagccctgc

SEQ ID NO: 823857 - DNA, 25 bp, Mus musculus
tggtggacggcctcatcagccctgc

SEQ ID NO: 823858 - DNA, 25 bp, Mus musculus
tggtggactatcatcgatcacgtgg

SEQ ID NO: 823859 - DNA, 25 bp, Mus musculus
tggtggactatcttcgatcacgtgg

SEQ ID NO: 823860 - DNA, 25 bp, Mus musculus
tggtggactgagacctcctacagcc

SEQ ID NO: 823861 - DNA, 25 bp, Mus musculus
tggtggactgagtcctcctacagcc

SEQ ID NO: 823862 - DNA, 25 bp, Mus musculus
tggtggacttctaccagccgacgtg

SEQ ID NO: 823863 - DNA, 25 bp, Mus musculus
tggtggacttcttccagccgacgtg

SEQ ID NO: 823864 - DNA, 25 bp, Mus musculus
tggtggagaaacagcctgacagccc

SEQ ID NO: 823865 - DNA, 25 bp, Mus musculus
tggtggagaaactgcctgacagccc

SEQ ID NO: 823866 - DNA, 25 bp, Mus musculus
tggtggagaccacagtgagctcatt

SEQ ID NO: 823867 - DNA, 25 bp, Mus musculus
tggtggagaccagagtgagctcatt

SEQ ID NO: 823868 - DNA, 25 bp, Mus musculus
tggtggagatccatcagtacgctgg

SEQ ID NO: 823869 - DNA, 25 bp, Mus musculus
tggtggagatccttcagtacgctgg

SEQ ID NO: 823870 - DNA, 25 bp, Mus musculus
tggtggagatttcccgggctcaaaa

SEQ ID NO: 823871 - DNA, 25 bp, Mus musculus
tggtggagatttgccgggctcaaaa

SEQ ID NO: 823872 - DNA, 25 bp, Mus musculus
tggtggagcagtccagtttgccatt

SEQ ID NO: 823873 - DNA, 25 bp, Mus musculus
tggtggagcagtgcagtttgccatt

SEQ ID NO: 823874 - DNA, 25 bp, Mus musculus
tggtggagccagagacagactacct

SEQ ID NO: 823875 - DNA, 25 bp, Mus musculus
tggtggagccagtgacagactacct

SEQ ID NO: 823876 - DNA, 25 bp, Mus musculus
tggtggagctcaacgagaagctcct

SEQ ID NO: 823877 - DNA, 25 bp, Mus musculus
tggtggagctcatcgagaagctcct

SEQ ID NO: 823878 - DNA, 25 bp, Mus musculus
tggtggagggctagtacatgaacac

SEQ ID NO: 823879 - DNA, 25 bp, Mus musculus
tggtggagggcttgtacatgaacac

SEQ ID NO: 823880 - DNA, 25 bp, Mus musculus
tggtggagtatgacttcagtggctc

SEQ ID NO: 823881 - DNA, 25 bp, Mus musculus
tggtggagtatgtcttcagtggctc

SEQ ID NO: 823882 - DNA, 25 bp, Mus musculus
tggtggagtcagacctcaatggcct

SEQ ID NO: 823883 - DNA, 25 bp, Mus musculus
tggtggagtcagtcctcaatggcct

SEQ ID NO: 823884 - DNA, 25 bp, Mus musculus
tggtggagttccatgagaagagccc

SEQ ID NO: 823885 - DNA, 25 bp, Mus musculus
tggtggagttccttgagaagagccc

SEQ ID NO: 823886 - DNA, 25 bp, Mus musculus
tggtggatacctctcgtgggcccta

SEQ ID NO: 823887 - DNA, 25 bp, Mus musculus
tggtggatacctgtcgtgggcccta

SEQ ID NO: 823888 - DNA, 25 bp, Mus musculus
tggtggatataacagagtgaaagtc

SEQ ID NO: 823889 - DNA, 25 bp, Mus musculus
tggtggatataagagagtgaaagtc

SEQ ID NO: 823890 - DNA, 25 bp, Mus musculus
tggtggatccaaccaatgacatccg

SEQ ID NO: 823891 - DNA, 25 bp, Mus musculus
tggtggatccaagcaatgacatccg

SEQ ID NO: 823892 - DNA, 25 bp, Mus musculus
tggtggatcgatacagcacccctgc

SEQ ID NO: 823893 - DNA, 25 bp, Mus musculus
tggtggatcgattcagcacccctgc

SEQ ID NO: 823894 - DNA, 25 bp, Mus musculus
tggtggatgacaagctgccctgtga

SEQ ID NO: 823895 - DNA, 25 bp, Mus musculus
tggtggatgacatgctgccctgtga

SEQ ID NO: 823896 - DNA, 25 bp, Mus musculus
tggtggatgcctactctcgccagag

SEQ ID NO: 823897 - DNA, 25 bp, Mus musculus
tggtggatgccttctctcgccagag

SEQ ID NO: 823898 - DNA, 25 bp, Mus musculus
tggtggatgggaattaaatgtgcaa

SEQ ID NO: 823899 - DNA, 25 bp, Mus musculus
tggtggatgggatttaaatgtgcaa

SEQ ID NO: 823900 - DNA, 25 bp, Mus musculus
tggtggattgccatacgtcctcaca

SEQ ID NO: 823901 - DNA, 25 bp, Mus musculus
tggtggattgccttacgtcctcaca

SEQ ID NO: 823902 - DNA, 25 bp, Mus musculus
tggtggcaaagaaaggtctagctcc

SEQ ID NO: 823903 - DNA, 25 bp, Mus musculus
tggtggcaaagataggtctagctcc

SEQ ID NO: 823904 - DNA, 25 bp, Mus musculus
tggtggcaaagcacaagtctctgcg

SEQ ID NO: 823905 - DNA, 25 bp, Mus musculus
tggtggcaaagctcaagtctctgcg

SEQ ID NO: 823906 - DNA, 25 bp, Mus musculus
tggtggcaatgaccagtcacagtac

SEQ ID NO: 823907 - DNA, 25 bp, Mus musculus
tggtggcaatgagcagtcacagtac

SEQ ID NO: 823908 - DNA, 25 bp, Mus musculus
tggtggcaccacatctgggcgccta

SEQ ID NO: 823909 - DNA, 25 bp, Mus musculus
tggtggcaccacttctgggcgccta

SEQ ID NO: 823910 - DNA, 25 bp, Mus musculus
tggtggcaccatcgagaacctcagc

SEQ ID NO: 823911 - DNA, 25 bp, Mus musculus
tggtggcaccatggagaacctcagc

SEQ ID NO: 823912 - DNA, 25 bp, Mus musculus
tggtggcagagcacattgagaagat

SEQ ID NO: 823913 - DNA, 25 bp, Mus musculus
tggtggcagagctcattgagaagat

SEQ ID NO: 823914 - DNA, 25 bp, Mus musculus
tggtggcagagtacaatcaaagatg

SEQ ID NO: 823915 - DNA, 25 bp, Mus musculus
tggtggcagagttcaatcaaagatg

SEQ ID NO: 823916 - DNA, 25 bp, Mus musculus
tggtggcagcaacggatttatagct

SEQ ID NO: 823917 - DNA, 25 bp, Mus musculus
tggtggcagcaagggatttatagct

SEQ ID NO: 823918 - DNA, 25 bp, Mus musculus
tggtggcagctcaagacccggcaag

SEQ ID NO: 823919 - DNA, 25 bp, Mus musculus
tggtggcagctctagacccggcaag

SEQ ID NO: 823920 - DNA, 25 bp, Mus musculus
tggtggccaaccaggactttgtaga

SEQ ID NO: 823921 - DNA, 25 bp, Mus musculus
tggtggccaacctggactttgtaga

SEQ ID NO: 823922 - DNA, 25 bp, Mus musculus
tggtggccaagaacctggccctgct

SEQ ID NO: 823923 - DNA, 25 bp, Mus musculus
tggtggccaagatcctggccctgct

SEQ ID NO: 823924 - DNA, 25 bp, Mus musculus
tggtggccacaaccttagaaaacgt

SEQ ID NO: 823925 - DNA, 25 bp, Mus musculus
tggtggccacaagcttagaaaacgt

SEQ ID NO: 823926 - DNA, 25 bp, Mus musculus
tggtggcccactcagcctttgctgc

SEQ ID NO: 823927 - DNA, 25 bp, Mus musculus
tggtggcccactgagcctttgctgc

SEQ ID NO: 823928 - DNA, 25 bp, Mus musculus
tggtggccccaaaggacatgacatt

SEQ ID NO: 823929 - DNA, 25 bp, Mus musculus
tggtggccccaatggacatgacatt

SEQ ID NO: 823930 - DNA, 25 bp, Mus musculus
tggtggcccgctacattcgcataaa

SEQ ID NO: 823931 - DNA, 25 bp, Mus musculus
tggtggcccgcttcattcgcataaa

SEQ ID NO: 823932 - DNA, 25 bp, Mus musculus
tggtggccctagacaacaagattga

SEQ ID NO: 823933 - DNA, 25 bp, Mus musculus
tggtggccctagtcaacaagattga

SEQ ID NO: 823934 - DNA, 25 bp, Mus musculus
tggtggccctccagacaggaacagc

SEQ ID NO: 823935 - DNA, 25 bp, Mus musculus
tggtggccctcctgacaggaacagc

SEQ ID NO: 823936 - DNA, 25 bp, Mus musculus
tggtggcccttgcttaataaagatt

SEQ ID NO: 823937 - DNA, 25 bp, Mus musculus
tggtggcccttggttaataaagatt

SEQ ID NO: 823938 - DNA, 25 bp, Mus musculus
tggtggccgctgcatttgatgccct

SEQ ID NO: 823939 - DNA, 25 bp, Mus musculus
tggtggccgctggatttgatgccct

SEQ ID NO: 823940 - DNA, 25 bp, Mus musculus
tggtggcctgatagcttttgccagc

SEQ ID NO: 823941 - DNA, 25 bp, Mus musculus
tggtggcctgattgcttttgccagc

SEQ ID NO: 823942 - DNA, 25 bp, Mus musculus
tggtggcctgtcagagcgttaatga

SEQ ID NO: 823943 - DNA, 25 bp, Mus musculus
tggtggcctgtctgagcgttaatga

SEQ ID NO: 823944 - DNA, 25 bp, Mus musculus
tggtggccttacacatgcattataa

SEQ ID NO: 823945 - DNA, 25 bp, Mus musculus
tggtggccttactcatgcattataa

SEQ ID NO: 823946 - DNA, 25 bp, Mus musculus
tggtggccttatagactccaaaggc

SEQ ID NO: 823947 - DNA, 25 bp, Mus musculus
tggtggccttattgactccaaaggc

SEQ ID NO: 823948 - DNA, 25 bp, Mus musculus
tggtggcctttgaccgccatctcta

SEQ ID NO: 823949 - DNA, 25 bp, Mus musculus
tggtggcctttgtccgccatctcta

SEQ ID NO: 823950 - DNA, 25 bp, Mus musculus
tggtggcgactgactgaagaagcct

SEQ ID NO: 823951 - DNA, 25 bp, Mus musculus
tggtggcgactgtctgaagaagcct

SEQ ID NO: 823952 - DNA, 25 bp, Mus musculus
tggtggcgagctcactagtacgatc

SEQ ID NO: 823953 - DNA, 25 bp, Mus musculus
tggtggcgagctgactagtacgatc

SEQ ID NO: 823954 - DNA, 25 bp, Mus musculus
tggtggcgctaacgactcttgcctg

SEQ ID NO: 823955 - DNA, 25 bp, Mus musculus
tggtggcgctaaggactcttgcctg

SEQ ID NO: 823956 - DNA, 25 bp, Mus musculus
tggtggctatttagtgcctgcagtt

SEQ ID NO: 823957 - DNA, 25 bp, Mus musculus
tggtggctattttgtgcctgcagtt

SEQ ID NO: 823958 - DNA, 25 bp, Mus musculus
tggtggctcaagagatccccattta

SEQ ID NO: 823959 - DNA, 25 bp, Mus musculus
tggtggctcaagtgatccccattta

SEQ ID NO: 823960 - DNA, 25 bp, Mus musculus
tggtggctcaggcaatgacgcaacc

SEQ ID NO: 823961 - DNA, 25 bp, Mus musculus
tggtggctcagggaatgacgcaacc

SEQ ID NO: 823962 - DNA, 25 bp, Mus musculus
tggtggctcctacccagctcagggc

SEQ ID NO: 823963 - DNA, 25 bp, Mus musculus
tggtggctcctagccagctcagggc

SEQ ID NO: 823964 - DNA, 25 bp, Mus musculus
tggtggctcctgaaaggacctgcgt

SEQ ID NO: 823965 - DNA, 25 bp, Mus musculus
tggtggctcctgtaaggacctgcgt

SEQ ID NO: 823966 - DNA, 25 bp, Mus musculus
tggtggctcgcgaagaagcaaaagc

SEQ ID NO: 823967 - DNA, 25 bp, Mus musculus
tggtggctcgcgtagaagcaaaagc

SEQ ID NO: 823968 - DNA, 25 bp, Mus musculus
tggtggctctaaaggtgatccggct

SEQ ID NO: 823969 - DNA, 25 bp, Mus musculus
tggtggctctaatggtgatccggct

SEQ ID NO: 823970 - DNA, 25 bp, Mus musculus
tggtggctctatcctagcatctttg

SEQ ID NO: 823971 - DNA, 25 bp, Mus musculus
tggtggctctatgctagcatctttg

SEQ ID NO: 823972 - DNA, 25 bp, Mus musculus
tggtggctgaaactgcggcccatca

SEQ ID NO: 823973 - DNA, 25 bp, Mus musculus
tggtggctgaaagtgcggcccatca

SEQ ID NO: 823974 - DNA, 25 bp, Mus musculus
tggtggctgcggagctgttcatcac

SEQ ID NO: 823975 - DNA, 25 bp, Mus musculus
tggtggctgcggtgctgttcatcac

SEQ ID NO: 823976 - DNA, 25 bp, Mus musculus
tggtggctgttccactttacagcga

SEQ ID NO: 823977 - DNA, 25 bp, Mus musculus
tggtggctgttcgactttacagcga

SEQ ID NO: 823978 - DNA, 25 bp, Mus musculus
tggtggcttcaaagctactgttgca

SEQ ID NO: 823979 - DNA, 25 bp, Mus musculus
tggtggcttcaatgctactgttgca

SEQ ID NO: 823980 - DNA, 25 bp, Mus musculus
tggtggcttcccagacagtacagag

SEQ ID NO: 823981 - DNA, 25 bp, Mus musculus
tggtggcttccctgacagtacagag

SEQ ID NO: 823982 - DNA, 25 bp, Mus musculus
tggtggcttgaaaaagattgacccc

SEQ ID NO: 823983 - DNA, 25 bp, Mus musculus
tggtggcttgaataagattgacccc

SEQ ID NO: 823984 - DNA, 25 bp, Mus musculus
tggtgggacctccacatggacagac

SEQ ID NO: 823985 - DNA, 25 bp, Mus musculus
tggtgggacctcgacatggacagac

SEQ ID NO: 823986 - DNA, 25 bp, Mus musculus
tggtgggacttcagcaagtgcttcc

SEQ ID NO: 823987 - DNA, 25 bp, Mus musculus
tggtgggacttctgcaagtgcttcc

SEQ ID NO: 823988 - DNA, 25 bp, Mus musculus
tggtgggagaatcctggctacctta

SEQ ID NO: 823989 - DNA, 25 bp, Mus musculus
tggtgggagaatgctggctacctta

SEQ ID NO: 823990 - DNA, 25 bp, Mus musculus
tggtgggagcacagatcataggaac

SEQ ID NO: 823991 - DNA, 25 bp, Mus musculus
tggtgggagcactgatcataggaac

SEQ ID NO: 823992 - DNA, 25 bp, Mus musculus
tggtgggagccaccagttacaacgc

SEQ ID NO: 823993 - DNA, 25 bp, Mus musculus
tggtgggagccagcagttacaacgc

SEQ ID NO: 823994 - DNA, 25 bp, Mus musculus
tggtgggattttccttagatggtct

SEQ ID NO: 823995 - DNA, 25 bp, Mus musculus
tggtgggattttgcttagatggtct

SEQ ID NO: 823996 - DNA, 25 bp, Mus musculus
tggtgggcaaggattaccttttgtg

SEQ ID NO: 823997 - DNA, 25 bp, Mus musculus
tggtgggcaaggtttaccttttgtg

SEQ ID NO: 823998 - DNA, 25 bp, Mus musculus
tggtgggcagctctcatcacttatg

SEQ ID NO: 823999 - DNA, 25 bp, Mus musculus
tggtgggcagctgtcatcacttatg

SEQ ID NO: 824000 - DNA, 25 bp, Mus musculus
tggtgggcatagacctgggctttca

SEQ ID NO: 824001 - DNA, 25 bp, Mus musculus
tggtgggcatagtcctgggctttca

SEQ ID NO: 824002 - DNA, 25 bp, Mus musculus
tggtgggccacaattaggaaattgt

SEQ ID NO: 824003 - DNA, 25 bp, Mus musculus
tggtgggccacatttaggaaattgt

SEQ ID NO: 824004 - DNA, 25 bp, Mus musculus
tggtgggcccaaacctccaagtggg

SEQ ID NO: 824005 - DNA, 25 bp, Mus musculus
tggtgggcccaatcctccaagtggg

SEQ ID NO: 824006 - DNA, 25 bp, Mus musculus
tggtgggtcgagaccagtcctccat

SEQ ID NO: 824007 - DNA, 25 bp, Mus musculus
tggtgggtcgagtccagtcctccat

SEQ ID NO: 824008 - DNA, 25 bp, Mus musculus
tggtgggtgccaccatgacctttgt

SEQ ID NO: 824009 - DNA, 25 bp, Mus musculus
tggtgggtgccagcatgacctttgt

SEQ ID NO: 824010 - DNA, 25 bp, Mus musculus
tggtgggtgccgcaccccagaacat

SEQ ID NO: 824011 - DNA, 25 bp, Mus musculus
tggtgggtgccggaccccagaacat

SEQ ID NO: 824012 - DNA, 25 bp, Mus musculus
tggtgggtgtggagttggcggtggt

SEQ ID NO: 824013 - DNA, 25 bp, Mus musculus
tggtgggtgtggtgttggcggtggt

SEQ ID NO: 824014 - DNA, 25 bp, Mus musculus
tggtggtaaccacaaaagctggcct

SEQ ID NO: 824015 - DNA, 25 bp, Mus musculus
tggtggtaaccagaaaagctggcct

SEQ ID NO: 824016 - DNA, 25 bp, Mus musculus
tggtggtaccatcgctatctgctcc

SEQ ID NO: 824017 - DNA, 25 bp, Mus musculus
tggtggtaccatggctatctgctcc

SEQ ID NO: 824018 - DNA, 25 bp, Mus musculus
tggtggtagtaaccattcaataccg

SEQ ID NO: 824019 - DNA, 25 bp, Mus musculus
tggtggtagtaagcattcaataccg

SEQ ID NO: 824020 - DNA, 25 bp, Mus musculus
tggtggtatcttcattgtcctggca

SEQ ID NO: 824021 - DNA, 25 bp, Mus musculus
tggtggtatcttgattgtcctggca

SEQ ID NO: 824022 - DNA, 25 bp, Mus musculus
tggtggtattgtacctcatggttac

SEQ ID NO: 824023 - DNA, 25 bp, Mus musculus
tggtggtattgttcctcatggttac

SEQ ID NO: 824024 - DNA, 25 bp, Mus musculus
tggtggtcaccaaggagcactctgc

SEQ ID NO: 824025 - DNA, 25 bp, Mus musculus
tggtggtcaccatggagcactctgc

SEQ ID NO: 824026 - DNA, 25 bp, Mus musculus
tggtggtcagcacagttggtaaact

SEQ ID NO: 824027 - DNA, 25 bp, Mus musculus
tggtggtcagcagagttggtaaact

SEQ ID NO: 824028 - DNA, 25 bp, Mus musculus
tggtggtcatcccactggagctcgc

SEQ ID NO: 824029 - DNA, 25 bp, Mus musculus
tggtggtcatccgactggagctcgc

SEQ ID NO: 824030 - DNA, 25 bp, Mus musculus
tggtggtccacaaagccccagaatc

SEQ ID NO: 824031 - DNA, 25 bp, Mus musculus
tggtggtccacatagccccagaatc

SEQ ID NO: 824032 - DNA, 25 bp, Mus musculus
tggtggtccagacgctcttccaggt

SEQ ID NO: 824033 - DNA, 25 bp, Mus musculus
tggtggtccagaggctcttccaggt

SEQ ID NO: 824034 - DNA, 25 bp, Mus musculus
tggtggtccgtacaggcgctcccta

SEQ ID NO: 824035 - DNA, 25 bp, Mus musculus
tggtggtccgtagaggcgctcccta

SEQ ID NO: 824036 - DNA, 25 bp, Mus musculus
tggtggtcctctatggtggtgttca

SEQ ID NO: 824037 - DNA, 25 bp, Mus musculus
tggtggtcctctttggtggtgttca

SEQ ID NO: 824038 - DNA, 25 bp, Mus musculus
tggtggtcctgcacggagtgcactc

SEQ ID NO: 824039 - DNA, 25 bp, Mus musculus
tggtggtcctgctcggagtgcactc

SEQ ID NO: 824040 - DNA, 25 bp, Mus musculus
tggtggtcctggctacttggattat

SEQ ID NO: 824041 - DNA, 25 bp, Mus musculus
tggtggtcctgggtacttggattat

SEQ ID NO: 824042 - DNA, 25 bp, Mus musculus
tggtggtcgtccattccaacatggg

SEQ ID NO: 824043 - DNA, 25 bp, Mus musculus
tggtggtcgtcctttccaacatggg

SEQ ID NO: 824044 - DNA, 25 bp, Mus musculus
tggtggtctctaccgggctcttgca

SEQ ID NO: 824045 - DNA, 25 bp, Mus musculus
tggtggtctctagcgggctcttgca

SEQ ID NO: 824046 - DNA, 25 bp, Mus musculus
tggtggtctctgacactctggaagc

SEQ ID NO: 824047 - DNA, 25 bp, Mus musculus
tggtggtctctgtcactctggaagc

SEQ ID NO: 824048 - DNA, 25 bp, Mus musculus
tggtggtctgtaccactcttctaaa

SEQ ID NO: 824049 - DNA, 25 bp, Mus musculus
tggtggtctgtagcactcttctaaa

SEQ ID NO: 824050 - DNA, 25 bp, Mus musculus
tggtggtgattgatcacggcagcca

SEQ ID NO: 824051 - DNA, 25 bp, Mus musculus
tggtggtgattgttcacggcagcca

SEQ ID NO: 824052 - DNA, 25 bp, Mus musculus
tggtggtggccacatacacttgtga

SEQ ID NO: 824053 - DNA, 25 bp, Mus musculus
tggtggtggccagatacacttgtga

SEQ ID NO: 824054 - DNA, 25 bp, Mus musculus
tggtggtggctacgttaccttcaac

SEQ ID NO: 824055 - DNA, 25 bp, Mus musculus
tggtggtggctaggttaccttcaac

SEQ ID NO: 824056 - DNA, 25 bp, Mus musculus
tggtggtgtatcacggacactcaga

SEQ ID NO: 824057 - DNA, 25 bp, Mus musculus
tggtggtgtatctcggacactcaga

SEQ ID NO: 824058 - DNA, 25 bp, Mus musculus
tggtggtgtgcccatcatcacgccg

SEQ ID NO: 824059 - DNA, 25 bp, Mus musculus
tggtggtgtgccgatcatcacgccg

SEQ ID NO: 824060 - DNA, 25 bp, Mus musculus
tggtggtgtggccactgaattcact

SEQ ID NO: 824061 - DNA, 25 bp, Mus musculus
tggtggtgtggcgactgaattcact

SEQ ID NO: 824062 - DNA, 25 bp, Mus musculus
tggtggttctatcgcgccctcttgg

SEQ ID NO: 824063 - DNA, 25 bp, Mus musculus
tggtggttctatggcgccctcttgg

SEQ ID NO: 824064 - DNA, 25 bp, Mus musculus
tggtggttgcccctctcaacattgt

SEQ ID NO: 824065 - DNA, 25 bp, Mus musculus
tggtggttgcccgtctcaacattgt

SEQ ID NO: 824066 - DNA, 25 bp, Mus musculus
tggtggttggagaccaagcacctca

SEQ ID NO: 824067 - DNA, 25 bp, Mus musculus
tggtggttggagtccaagcacctca

SEQ ID NO: 824068 - DNA, 25 bp, Mus musculus
tggtggttgttaaggtgatctgttc

SEQ ID NO: 824069 - DNA, 25 bp, Mus musculus
tggtggttgttatggtgatctgttc

SEQ ID NO: 824070 - DNA, 25 bp, Mus musculus
tggtggttttggctcacccatggat

SEQ ID NO: 824071 - DNA, 25 bp, Mus musculus
tggtggttttgggtcacccatggat

SEQ ID NO: 824072 - DNA, 25 bp, Mus musculus
tggtgtaaaagtagtgagttccccg

SEQ ID NO: 824073 - DNA, 25 bp, Mus musculus
tggtgtaaaagttgtgagttccccg

SEQ ID NO: 824074 - DNA, 25 bp, Mus musculus
tggtgtaactctccatgaggccttg

SEQ ID NO: 824075 - DNA, 25 bp, Mus musculus
tggtgtaactctgcatgaggccttg

SEQ ID NO: 824076 - DNA, 25 bp, Mus musculus
tggtgtaatgaaactcaacccagcc

SEQ ID NO: 824077 - DNA, 25 bp, Mus musculus
tggtgtaatgaatctcaacccagcc

SEQ ID NO: 824078 - DNA, 25 bp, Mus musculus
tggtgtacaataatacttgaagact

SEQ ID NO: 824079 - DNA, 25 bp, Mus musculus
tggtgtacaatattacttgaagact

SEQ ID NO: 824080 - DNA, 25 bp, Mus musculus
tggtgtacacaaaagcatccagatt

SEQ ID NO: 824081 - DNA, 25 bp, Mus musculus
tggtgtacacaatagcatccagatt

SEQ ID NO: 824082 - DNA, 25 bp, Mus musculus
tggtgtacctggctctcgtggattt

SEQ ID NO: 824083 - DNA, 25 bp, Mus musculus
tggtgtacctgggtctcgtggattt

SEQ ID NO: 824084 - DNA, 25 bp, Mus musculus
tggtgtacgagcaggaacagccgct

SEQ ID NO: 824085 - DNA, 25 bp, Mus musculus
tggtgtacgagctggaacagccgct

SEQ ID NO: 824086 - DNA, 25 bp, Mus musculus
tggtgtacgcccactacgggcggtc

SEQ ID NO: 824087 - DNA, 25 bp, Mus musculus
tggtgtacgccctctacgggcggtc

SEQ ID NO: 824088 - DNA, 25 bp, Mus musculus
tggtgtactacaccctcagcttcca

SEQ ID NO: 824089 - DNA, 25 bp, Mus musculus
tggtgtactacagcctcagcttcca

SEQ ID NO: 824090 - DNA, 25 bp, Mus musculus
tggtgtactccccacggacaggcat

SEQ ID NO: 824091 - DNA, 25 bp, Mus musculus
tggtgtactcccgacggacaggcat

SEQ ID NO: 824092 - DNA, 25 bp, Mus musculus
tggtgtacttcccagatggctacat

SEQ ID NO: 824093 - DNA, 25 bp, Mus musculus
tggtgtacttccgagatggctacat

SEQ ID NO: 824094 - DNA, 25 bp, Mus musculus
tggtgtatcctgcagctttcaatct

SEQ ID NO: 824095 - DNA, 25 bp, Mus musculus
tggtgtatcctggagctttcaatct

SEQ ID NO: 824096 - DNA, 25 bp, Mus musculus
tggtgtatgcctattgtgggttgca

SEQ ID NO: 824097 - DNA, 25 bp, Mus musculus
tggtgtatgccttttgtgggttgca

SEQ ID NO: 824098 - DNA, 25 bp, Mus musculus
tggtgtcaagccatgtatagataaa

SEQ ID NO: 824099 - DNA, 25 bp, Mus musculus
tggtgtcaagccttgtatagataaa

SEQ ID NO: 824100 - DNA, 25 bp, Mus musculus
tggtgtcaagtaactgtcagaagac

SEQ ID NO: 824101 - DNA, 25 bp, Mus musculus
tggtgtcaagtatctgtcagaagac

SEQ ID NO: 824102 - DNA, 25 bp, Mus musculus
tggtgtcagcgccaccaccgttctg

SEQ ID NO: 824103 - DNA, 25 bp, Mus musculus
tggtgtcagcgcgaccaccgttctg

SEQ ID NO: 824104 - DNA, 25 bp, Mus musculus
tggtgtccacacctggcagcctgcg

SEQ ID NO: 824105 - DNA, 25 bp, Mus musculus
tggtgtccacacgtggcagcctgcg

SEQ ID NO: 824106 - DNA, 25 bp, Mus musculus
tggtgtccacatagattcaggatca

SEQ ID NO: 824107 - DNA, 25 bp, Mus musculus
tggtgtccacattgattcaggatca

SEQ ID NO: 824108 - DNA, 25 bp, Mus musculus
tggtgtccacttaaaagtagtagga

SEQ ID NO: 824109 - DNA, 25 bp, Mus musculus
tggtgtccacttagagttacctgac

SEQ ID NO: 824110 - DNA, 25 bp, Mus musculus
tggtgtccactttaaagtagtagga

SEQ ID NO: 824111 - DNA, 25 bp, Mus musculus
tggtgtccactttgagttacctgac

SEQ ID NO: 824112 - DNA, 25 bp, Mus musculus
tggtgtccagatccgtgtccctggc

SEQ ID NO: 824113 - DNA, 25 bp, Mus musculus
tggtgtccagatgcgtgtccctggc

SEQ ID NO: 824114 - DNA, 25 bp, Mus musculus
tggtgtccagctctggccagatgct

SEQ ID NO: 824115 - DNA, 25 bp, Mus musculus
tggtgtccagctgtggccagatgct

SEQ ID NO: 824116 - DNA, 25 bp, Mus musculus
tggtgtcccaggaattacgggtcct

SEQ ID NO: 824117 - DNA, 25 bp, Mus musculus
tggtgtcccaggtattacgggtcct

SEQ ID NO: 824118 - DNA, 25 bp, Mus musculus
tggtgtccgcctacagtttccagca

SEQ ID NO: 824119 - DNA, 25 bp, Mus musculus
tggtgtccgccttcagtttccagca

SEQ ID NO: 824120 - DNA, 25 bp, Mus musculus
tggtgtccgggtacgggcccctcat

SEQ ID NO: 824121 - DNA, 25 bp, Mus musculus
tggtgtccgggttcgggcccctcat

SEQ ID NO: 824122 - DNA, 25 bp, Mus musculus
tggtgtcctccaacctgcgagatgg

SEQ ID NO: 824123 - DNA, 25 bp, Mus musculus
tggtgtcctccatcctgcgagatgg

SEQ ID NO: 824124 - DNA, 25 bp, Mus musculus
tggtgtcctgcacctaccagctggc

SEQ ID NO: 824125 - DNA, 25 bp, Mus musculus
tggtgtcctgcagctaccagctggc

SEQ ID NO: 824126 - DNA, 25 bp, Mus musculus
tggtgtcgacagcaaaatgcctctg

SEQ ID NO: 824127 - DNA, 25 bp, Mus musculus
tggtgtcgacaggaaaatgcctctg

SEQ ID NO: 824128 - DNA, 25 bp, Mus musculus
tggtgtcgagaaatctccaggaggc

SEQ ID NO: 824129 - DNA, 25 bp, Mus musculus
tggtgtcgagaattctccaggaggc

SEQ ID NO: 824130 - DNA, 25 bp, Mus musculus
tggtgtctaactaagcgcctcgctt

SEQ ID NO: 824131 - DNA, 25 bp, Mus musculus
tggtgtctaacttagcgcctcgctt

SEQ ID NO: 824132 - DNA, 25 bp, Mus musculus
tggtgtctacaaaaccggaggactg

SEQ ID NO: 824133 - DNA, 25 bp, Mus musculus
tggtgtctacaataccggaggactg

SEQ ID NO: 824134 - DNA, 25 bp, Mus musculus
tggtgtctacacctgcaagctgagc

SEQ ID NO: 824135 - DNA, 25 bp, Mus musculus
tggtgtctacacgtgcaagctgagc

SEQ ID NO: 824136 - DNA, 25 bp, Mus musculus
tggtgtctacccagtgcgcatggtg

SEQ ID NO: 824137 - DNA, 25 bp, Mus musculus
tggtgtctaccctgtgcgcatggtg

SEQ ID NO: 824138 - DNA, 25 bp, Mus musculus
tggtgtctagcaatcacatcattgg

SEQ ID NO: 824139 - DNA, 25 bp, Mus musculus
tggtgtctagcattcacatcattgg

SEQ ID NO: 824140 - DNA, 25 bp, Mus musculus
tggtgtctagtgcaagcggaaccat

SEQ ID NO: 824141 - DNA, 25 bp, Mus musculus
tggtgtctagtggaagcggaaccat

SEQ ID NO: 824142 - DNA, 25 bp, Mus musculus
tggtgtctataacagtgtaatcgcc

SEQ ID NO: 824143 - DNA, 25 bp, Mus musculus
tggtgtctataagagtgtaatcgcc

SEQ ID NO: 824144 - DNA, 25 bp, Mus musculus
tggtgtctccaacaaaggctggcct

SEQ ID NO: 824145 - DNA, 25 bp, Mus musculus
tggtgtctccaagaaaggctggcct

SEQ ID NO: 824146 - DNA, 25 bp, Mus musculus
tggtgtctcgagaaaagccctacgc

SEQ ID NO: 824147 - DNA, 25 bp, Mus musculus
tggtgtctcgagtaaagccctacgc

SEQ ID NO: 824148 - DNA, 25 bp, Mus musculus
tggtgtctctcaaggccattgggtg

SEQ ID NO: 824149 - DNA, 25 bp, Mus musculus
tggtgtctctcatggccattgggtg

SEQ ID NO: 824150 - DNA, 25 bp, Mus musculus
tggtgtctctcgaagattcatcccc

SEQ ID NO: 824151 - DNA, 25 bp, Mus musculus
tggtgtctctcgtagattcatcccc

SEQ ID NO: 824152 - DNA, 25 bp, Mus musculus
tggtgtctctctatgggaatcgtcg

SEQ ID NO: 824153 - DNA, 25 bp, Mus musculus
tggtgtctctctttgggaatcgtcg

SEQ ID NO: 824154 - DNA, 25 bp, Mus musculus
tggtgtctctgcaggtgccagctga

SEQ ID NO: 824155 - DNA, 25 bp, Mus musculus
tggtgtctctgctggtgccagctga

SEQ ID NO: 824156 - DNA, 25 bp, Mus musculus
tggtgtctgagcctctctagcctct

SEQ ID NO: 824157 - DNA, 25 bp, Mus musculus
tggtgtctgagcgtctctagcctct

SEQ ID NO: 824158 - DNA, 25 bp, Mus musculus
tggtgtctgcccagatgtctgtgag

SEQ ID NO: 824159 - DNA, 25 bp, Mus musculus
tggtgtctgccctgatgtctgtgag

SEQ ID NO: 824160 - DNA, 25 bp, Mus musculus
tggtgtctgtacacttccagcccct

SEQ ID NO: 824161 - DNA, 25 bp, Mus musculus
tggtgtctgtactcttccagcccct

SEQ ID NO: 824162 - DNA, 25 bp, Mus musculus
tggtgtcttaacaatgcatgacagg

SEQ ID NO: 824163 - DNA, 25 bp, Mus musculus
tggtgtcttaactatgcatgacagg

SEQ ID NO: 824164 - DNA, 25 bp, Mus musculus
tggtgtgaacacagcctcgattgct

SEQ ID NO: 824165 - DNA, 25 bp, Mus musculus
tggtgtgaacactgcctcgattgct

SEQ ID NO: 824166 - DNA, 25 bp, Mus musculus
tggtgtgacctcaggctcattcccc

SEQ ID NO: 824167 - DNA, 25 bp, Mus musculus
tggtgtgacctctggctcattcccc

SEQ ID NO: 824168 - DNA, 25 bp, Mus musculus
tggtgtgcaacacccgtattctcag

SEQ ID NO: 824169 - DNA, 25 bp, Mus musculus
tggtgtgcaacagccgtattctcag

SEQ ID NO: 824170 - DNA, 25 bp, Mus musculus
tggtgtgcacccaaggagattgaga

SEQ ID NO: 824171 - DNA, 25 bp, Mus musculus
tggtgtgcaccctaggagattgaga

SEQ ID NO: 824172 - DNA, 25 bp, Mus musculus
tggtgtgcatttaactgagtctctc

SEQ ID NO: 824173 - DNA, 25 bp, Mus musculus
tggtgtgcattttactgagtctctc

SEQ ID NO: 824174 - DNA, 25 bp, Mus musculus
tggtgtgcccatcatcacgccgacg

SEQ ID NO: 824175 - DNA, 25 bp, Mus musculus
tggtgtgcccatgatcacgccgacg

SEQ ID NO: 824176 - DNA, 25 bp, Mus musculus
tggtgtgcgtcaacgtccgatcccc

SEQ ID NO: 824177 - DNA, 25 bp, Mus musculus
tggtgtgcgtcatcgtccgatcccc

SEQ ID NO: 824178 - DNA, 25 bp, Mus musculus
tggtgtgcttagctacaaggctctg

SEQ ID NO: 824179 - DNA, 25 bp, Mus musculus
tggtgtgcttaggtacaaggctctg

SEQ ID NO: 824180 - DNA, 25 bp, Mus musculus
tggtgtggacatcgatgataaaaac

SEQ ID NO: 824181 - DNA, 25 bp, Mus musculus
tggtgtggacatggatgataaaaac

SEQ ID NO: 824182 - DNA, 25 bp, Mus musculus
tggtgtggacctcggcctcccaaga

SEQ ID NO: 824183 - DNA, 25 bp, Mus musculus
tggtgtggacctgggcctcccaaga

SEQ ID NO: 824184 - DNA, 25 bp, Mus musculus
tggtgtggatggagcccccgcctct

SEQ ID NO: 824185 - DNA, 25 bp, Mus musculus
tggtgtggatggtgcccccgcctct

SEQ ID NO: 824186 - DNA, 25 bp, Mus musculus
tggtgtggccaacgcagctacaaaa

SEQ ID NO: 824187 - DNA, 25 bp, Mus musculus
tggtgtggccaaggcagctacaaaa

SEQ ID NO: 824188 - DNA, 25 bp, Mus musculus
tggtgtggccagaccatcgctgcca

SEQ ID NO: 824189 - DNA, 25 bp, Mus musculus
tggtgtggccagtccatcgctgcca

SEQ ID NO: 824190 - DNA, 25 bp, Mus musculus
tggtgtggccatagcagcacctccg

SEQ ID NO: 824191 - DNA, 25 bp, Mus musculus
tggtgtggccattgcagcacctccg

SEQ ID NO: 824192 - DNA, 25 bp, Mus musculus
tggtgtggcctcaaccattccttgg

SEQ ID NO: 824193 - DNA, 25 bp, Mus musculus
tggtgtggcctctaccattccttgg

SEQ ID NO: 824194 - DNA, 25 bp, Mus musculus
tggtgtggccttcattcctggaatg

SEQ ID NO: 824195 - DNA, 25 bp, Mus musculus
tggtgtggccttgattcctggaatg

SEQ ID NO: 824196 - DNA, 25 bp, Mus musculus
tggtgtggtagcaaaactctcacca

SEQ ID NO: 824197 - DNA, 25 bp, Mus musculus
tggtgtggtagctaaactctcacca

SEQ ID NO: 824198 - DNA, 25 bp, Mus musculus
tggtgtggtcataaatacaaacgtg

SEQ ID NO: 824199 - DNA, 25 bp, Mus musculus
tggtgtggtcattaatacaaacgtg

SEQ ID NO: 824200 - DNA, 25 bp, Mus musculus
tggtgtggttcgagtaagaattgaa

SEQ ID NO: 824201 - DNA, 25 bp, Mus musculus
tggtgtggttcgtgtaagaattgaa

SEQ ID NO: 824202 - DNA, 25 bp, Mus musculus
tggtgtgtcagaaccggaaaaagtt

SEQ ID NO: 824203 - DNA, 25 bp, Mus musculus
tggtgtgtcagatccggaaaaagtt

SEQ ID NO: 824204 - DNA, 25 bp, Mus musculus
tggtgtgtgaagataacccagaaca

SEQ ID NO: 824205 - DNA, 25 bp, Mus musculus
tggtgtgtgaagttaacccagaaca

SEQ ID NO: 824206 - DNA, 25 bp, Mus musculus
tggtgtgtgcccacaaattaagaac

SEQ ID NO: 824207 - DNA, 25 bp, Mus musculus
tggtgtgtgccctcaaattaagaac

SEQ ID NO: 824208 - DNA, 25 bp, Mus musculus
tggtgtgttcgcctcccgctcttct

SEQ ID NO: 824209 - DNA, 25 bp, Mus musculus
tggtgtgttcgcgtcccgctcttct

SEQ ID NO: 824210 - DNA, 25 bp, Mus musculus
tggtgtgttgctaaggaagctcctg

SEQ ID NO: 824211 - DNA, 25 bp, Mus musculus
tggtgtgttgcttaggaagctcctg

SEQ ID NO: 824212 - DNA, 25 bp, Mus musculus
tggtgtgtttggaaataagcaggac

SEQ ID NO: 824213 - DNA, 25 bp, Mus musculus
tggtgtgtttggtaataagcaggac

SEQ ID NO: 824214 - DNA, 25 bp, Mus musculus
tggtgttaccgaagacaagctggaa

SEQ ID NO: 824215 - DNA, 25 bp, Mus musculus
tggtgttaccgatgacaagctggaa

SEQ ID NO: 824216 - DNA, 25 bp, Mus musculus
tggtgttacttcataagggccttgg

SEQ ID NO: 824217 - DNA, 25 bp, Mus musculus
tggtgttacttcttaagggccttgg

SEQ ID NO: 824218 - DNA, 25 bp, Mus musculus
tggtgttagtgccagactcacgagc

SEQ ID NO: 824219 - DNA, 25 bp, Mus musculus
tggtgttagtgcgagactcacgagc

SEQ ID NO: 824220 - DNA, 25 bp, Mus musculus
tggtgttcagtgagggcgaggccca

SEQ ID NO: 824221 - DNA, 25 bp, Mus musculus
tggtgttcagtgtgggcgaggccca

SEQ ID NO: 824222 - DNA, 25 bp, Mus musculus
tggtgttccaggactccagggcaag

SEQ ID NO: 824223 - DNA, 25 bp, Mus musculus
tggtgttccaggtctccagggcaag

SEQ ID NO: 824224 - DNA, 25 bp, Mus musculus
tggtgttccgacacctgaagcgatg

SEQ ID NO: 824225 - DNA, 25 bp, Mus musculus
tggtgttccgactcctgaagcgatg

SEQ ID NO: 824226 - DNA, 25 bp, Mus musculus
tggtgttcctctcggtccacagcct

SEQ ID NO: 824227 - DNA, 25 bp, Mus musculus
tggtgttcctctgggtccacagcct

SEQ ID NO: 824228 - DNA, 25 bp, Mus musculus
tggtgttcgaggcttatccgatgcc

SEQ ID NO: 824229 - DNA, 25 bp, Mus musculus
tggtgttcgagggttatccgatgcc

SEQ ID NO: 824230 - DNA, 25 bp, Mus musculus
tggtgttcttgaccaaccaagatgg

SEQ ID NO: 824231 - DNA, 25 bp, Mus musculus
tggtgttcttgagcaaccaagatgg

SEQ ID NO: 824232 - DNA, 25 bp, Mus musculus
tggtgttgaagtcatgaacctgatg

SEQ ID NO: 824233 - DNA, 25 bp, Mus musculus
tggtgttgaagtgatgaacctgatg

SEQ ID NO: 824234 - DNA, 25 bp, Mus musculus
tggtgttgaccgattctctgtaaaa

SEQ ID NO: 824235 - DNA, 25 bp, Mus musculus
tggtgttgaccgtttctctgtaaaa

SEQ ID NO: 824236 - DNA, 25 bp, Mus musculus
tggtgttgcagccaccacagacttg

SEQ ID NO: 824237 - DNA, 25 bp, Mus musculus
tggtgttgcagcgaccacagacttg

SEQ ID NO: 824238 - DNA, 25 bp, Mus musculus
tggtgttggaaacagtaacctcctg

SEQ ID NO: 824239 - DNA, 25 bp, Mus musculus
tggtgttggaaagagtaacctcctg

SEQ ID NO: 824240 - DNA, 25 bp, Mus musculus
tggtgttgggcaagaaagaaacctt

SEQ ID NO: 824241 - DNA, 25 bp, Mus musculus
tggtgttgggcatgaaagaaacctt

SEQ ID NO: 824242 - DNA, 25 bp, Mus musculus
tggtgtttatctcgacgacctcacg

SEQ ID NO: 824243 - DNA, 25 bp, Mus musculus
tggtgtttatctggacgacctcacg

SEQ ID NO: 824244 - DNA, 25 bp, Mus musculus
tggtgtttcccacgtgctgtccaca

SEQ ID NO: 824245 - DNA, 25 bp, Mus musculus
tggtgtttcccaggtgctgtccaca

SEQ ID NO: 824246 - DNA, 25 bp, Mus musculus
tggtgtttgcctcccaagggaactg

SEQ ID NO: 824247 - DNA, 25 bp, Mus musculus
tggtgtttgcctgccaagggaactg

SEQ ID NO: 824248 - DNA, 25 bp, Mus musculus
tggtgtttgcttaacagatgggctt

SEQ ID NO: 824249 - DNA, 25 bp, Mus musculus
tggtgtttgctttacagatgggctt

SEQ ID NO: 824250 - DNA, 25 bp, Mus musculus
tggtgttttagtagtgccatgcacc

SEQ ID NO: 824251 - DNA, 25 bp, Mus musculus
tggtgttttagttgtgccatgcacc

SEQ ID NO: 824252 - DNA, 25 bp, Mus musculus
tggtgttttctccactcaaagcaac

SEQ ID NO: 824253 - DNA, 25 bp, Mus musculus
tggtgttttctcgactcaaagcaac

SEQ ID NO: 824254 - DNA, 25 bp, Mus musculus
tggttaaaaccacccttgcagagga

SEQ ID NO: 824255 - DNA, 25 bp, Mus musculus
tggttaaaaccagccttgcagagga

SEQ ID NO: 824256 - DNA, 25 bp, Mus musculus
tggttaaaggcaatggctcttcttc

SEQ ID NO: 824257 - DNA, 25 bp, Mus musculus
tggttaaaggcattggctcttcttc

SEQ ID NO: 824258 - DNA, 25 bp, Mus musculus
tggttaacctctcaaaggatgactg

SEQ ID NO: 824259 - DNA, 25 bp, Mus musculus
tggttaacctctgaaaggatgactg

SEQ ID NO: 824260 - DNA, 25 bp, Mus musculus
tggttaatattcagtgcgaggcttc

SEQ ID NO: 824261 - DNA, 25 bp, Mus musculus
tggttaatattctgtgcgaggcttc

SEQ ID NO: 824262 - DNA, 25 bp, Mus musculus
tggttaatccctagctggccctcag

SEQ ID NO: 824263 - DNA, 25 bp, Mus musculus
tggttaatcccttgctggccctcag

SEQ ID NO: 824264 - DNA, 25 bp, Mus musculus
tggttacaggataacgattgcgccc

SEQ ID NO: 824265 - DNA, 25 bp, Mus musculus
tggttacaggattacgattgcgccc

SEQ ID NO: 824266 - DNA, 25 bp, Mus musculus
tggttacatcaactgccgggacctg

SEQ ID NO: 824267 - DNA, 25 bp, Mus musculus
tggttacatcaagtgccgggacctg

SEQ ID NO: 824268 - DNA, 25 bp, Mus musculus
tggttaccatcacaatcatgcctac

SEQ ID NO: 824269 - DNA, 25 bp, Mus musculus
tggttaccatcagaatcatgcctac

SEQ ID NO: 824270 - DNA, 25 bp, Mus musculus
tggttaccgaaaagggccagacttt

SEQ ID NO: 824271 - DNA, 25 bp, Mus musculus
tggttaccgaaatgggccagacttt

SEQ ID NO: 824272 - DNA, 25 bp, Mus musculus
tggttaccggttagcagaaagtagg

SEQ ID NO: 824273 - DNA, 25 bp, Mus musculus
tggttaccggtttgcagaaagtagg

SEQ ID NO: 824274 - DNA, 25 bp, Mus musculus
tggttaccttgtcgtacagacctcc

SEQ ID NO: 824275 - DNA, 25 bp, Mus musculus
tggttaccttgtggtacagacctcc

SEQ ID NO: 824276 - DNA, 25 bp, Mus musculus
tggttacgagatagaccatcaaaca

SEQ ID NO: 824277 - DNA, 25 bp, Mus musculus
tggttacgagattgaccatcaaaca

SEQ ID NO: 824278 - DNA, 25 bp, Mus musculus
tggttacgcaggacgcaagtgtgtc

SEQ ID NO: 824279 - DNA, 25 bp, Mus musculus
tggttacgcaggtcgcaagtgtgtc

SEQ ID NO: 824280 - DNA, 25 bp, Mus musculus
tggttactgactcctgtgcccctgg

SEQ ID NO: 824281 - DNA, 25 bp, Mus musculus
tggttactgactgctgtgcccctgg

SEQ ID NO: 824282 - DNA, 25 bp, Mus musculus
tggttactgctgagggtgtgaactc

SEQ ID NO: 824283 - DNA, 25 bp, Mus musculus
tggttactgctgtgggtgtgaactc

SEQ ID NO: 824284 - DNA, 25 bp, Mus musculus
tggttagaatatcgacagccagctg

SEQ ID NO: 824285 - DNA, 25 bp, Mus musculus
tggttagaatatggacagccagctg

SEQ ID NO: 824286 - DNA, 25 bp, Mus musculus
tggttagacactctgcgcatgcggc

SEQ ID NO: 824287 - DNA, 25 bp, Mus musculus
tggttagacactgtgcgcatgcggc

SEQ ID NO: 824288 - DNA, 25 bp, Mus musculus
tggttagcctgcagggcacctggtc

SEQ ID NO: 824289 - DNA, 25 bp, Mus musculus
tggttagcctgctgggcacctggtc

SEQ ID NO: 824290 - DNA, 25 bp, Mus musculus
tggttagctacactttgaaggatat

SEQ ID NO: 824291 - DNA, 25 bp, Mus musculus
tggttagctacagtttgaaggatat

SEQ ID NO: 824292 - DNA, 25 bp, Mus musculus
tggttaggaaaaatgcagccctgtg

SEQ ID NO: 824293 - DNA, 25 bp, Mus musculus
tggttaggaaaattgcagccctgtg

SEQ ID NO: 824294 - DNA, 25 bp, Mus musculus
tggttaggaactccgctcaagtcct

SEQ ID NO: 824295 - DNA, 25 bp, Mus musculus
tggttaggaactgcgctcaagtcct

SEQ ID NO: 824296 - DNA, 25 bp, Mus musculus
tggttatagataaaagctcagagcc

SEQ ID NO: 824297 - DNA, 25 bp, Mus musculus
tggttatagatataagctcagagcc

SEQ ID NO: 824298 - DNA, 25 bp, Mus musculus
tggttatataaaccagctgctagag

SEQ ID NO: 824299 - DNA, 25 bp, Mus musculus
tggttatataaagcagctgctagag

SEQ ID NO: 824300 - DNA, 25 bp, Mus musculus
tggttatatctgataacccctaccg

SEQ ID NO: 824301 - DNA, 25 bp, Mus musculus
tggttatatctgttaacccctaccg

SEQ ID NO: 824302 - DNA, 25 bp, Mus musculus
tggttatcccagagggatattgtgg

SEQ ID NO: 824303 - DNA, 25 bp, Mus musculus
tggttatcccagtgggatattgtgg

SEQ ID NO: 824304 - DNA, 25 bp, Mus musculus
tggttatcgaagaagtggccgagat

SEQ ID NO: 824305 - DNA, 25 bp, Mus musculus
tggttatcgaagtagtggccgagat

SEQ ID NO: 824306 - DNA, 25 bp, Mus musculus
tggttatgacccatgctcttcagtg

SEQ ID NO: 824307 - DNA, 25 bp, Mus musculus
tggttatgacccttgctcttcagtg

SEQ ID NO: 824308 - DNA, 25 bp, Mus musculus
tggttatggctgacgtgtcccagta

SEQ ID NO: 824309 - DNA, 25 bp, Mus musculus
tggttatggctgtcgtgtcccagta

SEQ ID NO: 824310 - DNA, 25 bp, Mus musculus
tggttatggcttcccaatttctcgt

SEQ ID NO: 824311 - DNA, 25 bp, Mus musculus
tggttatggcttgccaatttctcgt

SEQ ID NO: 824312 - DNA, 25 bp, Mus musculus
tggttatgtcctacggagttacctg

SEQ ID NO: 824313 - DNA, 25 bp, Mus musculus
tggttatgtccttcggagttacctg

SEQ ID NO: 824314 - DNA, 25 bp, Mus musculus
tggttcaagactattaaagaaggct

SEQ ID NO: 824315 - DNA, 25 bp, Mus musculus
tggttcaagacttttaaagaaggct

SEQ ID NO: 824316 - DNA, 25 bp, Mus musculus
tggttcacaagaaaacggagcgcct

SEQ ID NO: 824317 - DNA, 25 bp, Mus musculus
tggttcacaagataacggagcgcct

SEQ ID NO: 824318 - DNA, 25 bp, Mus musculus
tggttcacagacacatctattatcc

SEQ ID NO: 824319 - DNA, 25 bp, Mus musculus
tggttcacagactcatctattatcc

SEQ ID NO: 824320 - DNA, 25 bp, Mus musculus
tggttcaccgttaacaaaggccttg

SEQ ID NO: 824321 - DNA, 25 bp, Mus musculus
tggttcaccgtttacaaaggccttg

SEQ ID NO: 824322 - DNA, 25 bp, Mus musculus
tggttcacctgtcaccttgcgccag

SEQ ID NO: 824323 - DNA, 25 bp, Mus musculus
tggttcacctgtgaccttgcgccag

SEQ ID NO: 824324 - DNA, 25 bp, Mus musculus
tggttcactatgatatctgaggagg

SEQ ID NO: 824325 - DNA, 25 bp, Mus musculus
tggttcactatgttatctgaggagg

SEQ ID NO: 824326 - DNA, 25 bp, Mus musculus
tggttcactggaacaccaaatatgg

SEQ ID NO: 824327 - DNA, 25 bp, Mus musculus
tggttcactggatcaccaaatatgg

SEQ ID NO: 824328 - DNA, 25 bp, Mus musculus
tggttcagaagaagattgatatggc

SEQ ID NO: 824329 - DNA, 25 bp, Mus musculus
tggttcagaagatgattgatatggc

SEQ ID NO: 824330 - DNA, 25 bp, Mus musculus
tggttcagatccctgtggccgagat

SEQ ID NO: 824331 - DNA, 25 bp, Mus musculus
tggttcagatccgtgtggccgagat

SEQ ID NO: 824332 - DNA, 25 bp, Mus musculus
tggttcagcacaccgggacctctga

SEQ ID NO: 824333 - DNA, 25 bp, Mus musculus
tggttcagcacagcgggacctctga

SEQ ID NO: 824334 - DNA, 25 bp, Mus musculus
tggttcagccacaccatgttcatgg

SEQ ID NO: 824335 - DNA, 25 bp, Mus musculus
tggttcagccactccatgttcatgg

SEQ ID NO: 824336 - DNA, 25 bp, Mus musculus
tggttcagcggcagttctttgctgg

SEQ ID NO: 824337 - DNA, 25 bp, Mus musculus
tggttcagcggctgttctttgctgg

SEQ ID NO: 824338 - DNA, 25 bp, Mus musculus
tggttcagctcacatggacaacggg

SEQ ID NO: 824339 - DNA, 25 bp, Mus musculus
tggttcagctcagatggacaacggg

SEQ ID NO: 824340 - DNA, 25 bp, Mus musculus
tggttcagggcacagtcaacaaact

SEQ ID NO: 824341 - DNA, 25 bp, Mus musculus
tggttcagggcagagtcaacaaact

SEQ ID NO: 824342 - DNA, 25 bp, Mus musculus
tggttcagtgccacacatggtcatg

SEQ ID NO: 824343 - DNA, 25 bp, Mus musculus
tggttcagtgcctcacatggtcatg

SEQ ID NO: 824344 - DNA, 25 bp, Mus musculus
tggttcatacaacctgccaggcaga

SEQ ID NO: 824345 - DNA, 25 bp, Mus musculus
tggttcatacaagctgccaggcaga

SEQ ID NO: 824346 - DNA, 25 bp, Mus musculus
tggttcatcctcacgtacttcggca

SEQ ID NO: 824347 - DNA, 25 bp, Mus musculus
tggttcatcctctcgtacttcggca

SEQ ID NO: 824348 - DNA, 25 bp, Mus musculus
tggttcatcggaacaccaagcagat

SEQ ID NO: 824349 - DNA, 25 bp, Mus musculus
tggttcatcggatcaccaagcagat

SEQ ID NO: 824350 - DNA, 25 bp, Mus musculus
tggttcatgataatccctctggctc

SEQ ID NO: 824351 - DNA, 25 bp, Mus musculus
tggttcatgatattccctctggctc

SEQ ID NO: 824352 - DNA, 25 bp, Mus musculus
tggttcatgtacctgctgagctggc

SEQ ID NO: 824353 - DNA, 25 bp, Mus musculus
tggttcatgtacgtgctgagctggc

SEQ ID NO: 824354 - DNA, 25 bp, Mus musculus
tggttccactcacgcttacggacta

SEQ ID NO: 824355 - DNA, 25 bp, Mus musculus
tggttccactcaggcttacggacta

SEQ ID NO: 824356 - DNA, 25 bp, Mus musculus
tggttccagcagatctatgcaaggc

SEQ ID NO: 824357 - DNA, 25 bp, Mus musculus
tggttccagcagttctatgcaaggc

SEQ ID NO: 824358 - DNA, 25 bp, Mus musculus
tggttccagggcacaaccggacgtg

SEQ ID NO: 824359 - DNA, 25 bp, Mus musculus
tggttccagggctcaaccggacgtg

SEQ ID NO: 824360 - DNA, 25 bp, Mus musculus
tggttccagtgcacaccgttgagga

SEQ ID NO: 824361 - DNA, 25 bp, Mus musculus
tggttccagtgctcaccgttgagga

SEQ ID NO: 824362 - DNA, 25 bp, Mus musculus
tggttcccactcatgcctatgcggt

SEQ ID NO: 824363 - DNA, 25 bp, Mus musculus
tggttcccactcttgcctatgcggt

SEQ ID NO: 824364 - DNA, 25 bp, Mus musculus
tggttcccaggcagctgaaccggat

SEQ ID NO: 824365 - DNA, 25 bp, Mus musculus
tggttcccaggctgctgaaccggat

SEQ ID NO: 824366 - DNA, 25 bp, Mus musculus
tggttccccatcatcacggaggcgg

SEQ ID NO: 824367 - DNA, 25 bp, Mus musculus
tggttccccatcttcacggaggcgg

SEQ ID NO: 824368 - DNA, 25 bp, Mus musculus
tggttccccgggaacgctcagacag

SEQ ID NO: 824369 - DNA, 25 bp, Mus musculus
tggttccccgggtacgctcagacag

SEQ ID NO: 824370 - DNA, 25 bp, Mus musculus
tggttcccctccaatactctgtaga

SEQ ID NO: 824371 - DNA, 25 bp, Mus musculus
tggttcccctcctatactctgtaga

SEQ ID NO: 824372 - DNA, 25 bp, Mus musculus
tggttcccgctgctcccagattggc

SEQ ID NO: 824373 - DNA, 25 bp, Mus musculus
tggttcccgctggtcccagattggc

SEQ ID NO: 824374 - DNA, 25 bp, Mus musculus
tggttccgactgcagtccaacaagg

SEQ ID NO: 824375 - DNA, 25 bp, Mus musculus
tggttccgactggagtccaacaagg

SEQ ID NO: 824376 - DNA, 25 bp, Mus musculus
tggttccgggcactgttacccaagg

SEQ ID NO: 824377 - DNA, 25 bp, Mus musculus
tggttccgggcagtgttacccaagg

SEQ ID NO: 824378 - DNA, 25 bp, Mus musculus
tggttccgtggcacacatggtttta

SEQ ID NO: 824379 - DNA, 25 bp, Mus musculus
tggttccgtggctcacatggtttta

SEQ ID NO: 824380 - DNA, 25 bp, Mus musculus
tggttccgtggtcgatgcagccatc

SEQ ID NO: 824381 - DNA, 25 bp, Mus musculus
tggttccgtggtggatgcagccatc

SEQ ID NO: 824382 - DNA, 25 bp, Mus musculus
tggttccgtttacctccttgccctg

SEQ ID NO: 824383 - DNA, 25 bp, Mus musculus
tggttccgtttagctccttgccctg

SEQ ID NO: 824384 - DNA, 25 bp, Mus musculus
tggttcctaccgctgcatcctggac

SEQ ID NO: 824385 - DNA, 25 bp, Mus musculus
tggttcctaccggtgcatcctggac

SEQ ID NO: 824386 - DNA, 25 bp, Mus musculus
tggttcctcagtagttcttaaagcc

SEQ ID NO: 824387 - DNA, 25 bp, Mus musculus
tggttcctcagttgttcttaaagcc

SEQ ID NO: 824388 - DNA, 25 bp, Mus musculus
tggttcctccaacatttggacagag

SEQ ID NO: 824389 - DNA, 25 bp, Mus musculus
tggttcctccaagatttggacagag

SEQ ID NO: 824390 - DNA, 25 bp, Mus musculus
tggttcctctttacataacggcgtg

SEQ ID NO: 824391 - DNA, 25 bp, Mus musculus
tggttcctcttttcataacggcgtg

SEQ ID NO: 824392 - DNA, 25 bp, Mus musculus
tggttcctggtccttttacgcccag

SEQ ID NO: 824393 - DNA, 25 bp, Mus musculus
tggttcctggtcgttttacgcccag

SEQ ID NO: 824394 - DNA, 25 bp, Mus musculus
tggttccttcaacagacggagcaag

SEQ ID NO: 824395 - DNA, 25 bp, Mus musculus
tggttccttcaagagacggagcaag

SEQ ID NO: 824396 - DNA, 25 bp, Mus musculus
tggttccttgcaaaatacacatggg

SEQ ID NO: 824397 - DNA, 25 bp, Mus musculus
tggttccttgcataatacacatggg

SEQ ID NO: 824398 - DNA, 25 bp, Mus musculus
tggttcgaaacccagaccagcgtaa

SEQ ID NO: 824399 - DNA, 25 bp, Mus musculus
tggttcgaaaccgagaccagcgtaa

SEQ ID NO: 824400 - DNA, 25 bp, Mus musculus
tggttcggagcaacagttcgggccc

SEQ ID NO: 824401 - DNA, 25 bp, Mus musculus
tggttcggagcatcagttcgggccc

SEQ ID NO: 824402 - DNA, 25 bp, Mus musculus
tggttcgtcctacgctcacaacgcg

SEQ ID NO: 824403 - DNA, 25 bp, Mus musculus
tggttcgtcctaggctcacaacgcg

SEQ ID NO: 824404 - DNA, 25 bp, Mus musculus
tggttcgtggccaagctgtacatga

SEQ ID NO: 824405 - DNA, 25 bp, Mus musculus
tggttcgtggcctagctgtacatga

SEQ ID NO: 824406 - DNA, 25 bp, Mus musculus
tggttcgtgggtatctgcttcctgg

SEQ ID NO: 824407 - DNA, 25 bp, Mus musculus
tggttcgtgggtttctgcttcctgg

SEQ ID NO: 824408 - DNA, 25 bp, Mus musculus
tggttctacttgagccgtctttggc

SEQ ID NO: 824409 - DNA, 25 bp, Mus musculus
tggttctacttgtgccgtctttggc

SEQ ID NO: 824410 - DNA, 25 bp, Mus musculus
tggttctagtgacccctacatcaga

SEQ ID NO: 824411 - DNA, 25 bp, Mus musculus
tggttctagtgagccctacatcaga

SEQ ID NO: 824412 - DNA, 25 bp, Mus musculus
tggttctatggaaggatatcagccc

SEQ ID NO: 824413 - DNA, 25 bp, Mus musculus
tggttctatggatggatatcagccc

SEQ ID NO: 824414 - DNA, 25 bp, Mus musculus
tggttctcaagtcagaagcatgttc

SEQ ID NO: 824415 - DNA, 25 bp, Mus musculus
tggttctcaagtgagaagcatgttc

SEQ ID NO: 824416 - DNA, 25 bp, Mus musculus
tggttctcaggcacatcggcaacct

SEQ ID NO: 824417 - DNA, 25 bp, Mus musculus
tggttctcaggctcatcggcaacct

SEQ ID NO: 824418 - DNA, 25 bp, Mus musculus
tggttctccgaaacatggtggaccc

SEQ ID NO: 824419 - DNA, 25 bp, Mus musculus
tggttctccgaatcatggtggaccc

SEQ ID NO: 824420 - DNA, 25 bp, Mus musculus
tggttctcgtgtatcacagcagccc

SEQ ID NO: 824421 - DNA, 25 bp, Mus musculus
tggttctcgtgtttcacagcagccc

SEQ ID NO: 824422 - DNA, 25 bp, Mus musculus
tggttctctaaacccaatagtttct

SEQ ID NO: 824423 - DNA, 25 bp, Mus musculus
tggttctctaaagccaatagtttct

SEQ ID NO: 824424 - DNA, 25 bp, Mus musculus
tggttctcttcactccctgcagtta

SEQ ID NO: 824425 - DNA, 25 bp, Mus musculus
tggttctcttcagtccctgcagtta

SEQ ID NO: 824426 - DNA, 25 bp, Mus musculus
tggttctgaccaaaactctgcctgc

SEQ ID NO: 824427 - DNA, 25 bp, Mus musculus
tggttctgaccataactctgcctgc

SEQ ID NO: 824428 - DNA, 25 bp, Mus musculus
tggttctgactacaaacagtatgtg

SEQ ID NO: 824429 - DNA, 25 bp, Mus musculus
tggttctgactagaaacagtatgtg

SEQ ID NO: 824430 - DNA, 25 bp, Mus musculus
tggttctggaaacccgacagaagct

SEQ ID NO: 824431 - DNA, 25 bp, Mus musculus
tggttctggaaagccgacagaagct

SEQ ID NO: 824432 - DNA, 25 bp, Mus musculus
tggttctggctcaggattgcatctg

SEQ ID NO: 824433 - DNA, 25 bp, Mus musculus
tggttctggctctggattgcatctg

SEQ ID NO: 824434 - DNA, 25 bp, Mus musculus
tggttctggtctctgctggccatct

SEQ ID NO: 824435 - DNA, 25 bp, Mus musculus
tggttctggtctgtgctggccatct

SEQ ID NO: 824436 - DNA, 25 bp, Mus musculus
tggttcttccttcccgacaagaggc

SEQ ID NO: 824437 - DNA, 25 bp, Mus musculus
tggttcttccttgccgacaagaggc

SEQ ID NO: 824438 - DNA, 25 bp, Mus musculus
tggttcttgccaagctgtacgagaa

SEQ ID NO: 824439 - DNA, 25 bp, Mus musculus
tggttcttgccatgctgtacgagaa

SEQ ID NO: 824440 - DNA, 25 bp, Mus musculus
tggttcttgcgcctcatcctgggca

SEQ ID NO: 824441 - DNA, 25 bp, Mus musculus
tggttcttgcgcgtcatcctgggca

SEQ ID NO: 824442 - DNA, 25 bp, Mus musculus
tggttctttttacgcggcttcattt

SEQ ID NO: 824443 - DNA, 25 bp, Mus musculus
tggttctttttaggcggcttcattt

SEQ ID NO: 824444 - DNA, 25 bp, Mus musculus
tggttgaagaatagatcgcagcccg

SEQ ID NO: 824445 - DNA, 25 bp, Mus musculus
tggttgaagaattgatcgcagcccg

SEQ ID NO: 824446 - DNA, 25 bp, Mus musculus
tggttgaagccactgcaatgcagga

SEQ ID NO: 824447 - DNA, 25 bp, Mus musculus
tggttgaagccagtgcaatgcagga

SEQ ID NO: 824448 - DNA, 25 bp, Mus musculus
tggttgaaggatccccgcctgtcag

SEQ ID NO: 824449 - DNA, 25 bp, Mus musculus
tggttgaaggatgcccgcctgtcag

SEQ ID NO: 824450 - DNA, 25 bp, Mus musculus
tggttgaagtctccaccctagagcc

SEQ ID NO: 824451 - DNA, 25 bp, Mus musculus
tggttgaagtctgcaccctagagcc

SEQ ID NO: 824452 - DNA, 25 bp, Mus musculus
tggttgaattcaccaacagccctga

SEQ ID NO: 824453 - DNA, 25 bp, Mus musculus
tggttgaattcagcaacagccctga

SEQ ID NO: 824454 - DNA, 25 bp, Mus musculus
tggttgaccaggacggacattcgct

SEQ ID NO: 824455 - DNA, 25 bp, Mus musculus
tggttgaccaggtcggacattcgct

SEQ ID NO: 824456 - DNA, 25 bp, Mus musculus
tggttgacctaaacagaagacatag

SEQ ID NO: 824457 - DNA, 25 bp, Mus musculus
tggttgacctaatcagaagacatag

SEQ ID NO: 824458 - DNA, 25 bp, Mus musculus
tggttgacgctgcacaaagatgtgc

SEQ ID NO: 824459 - DNA, 25 bp, Mus musculus
tggttgacgctggacaaagatgtgc

SEQ ID NO: 824460 - DNA, 25 bp, Mus musculus
tggttgactcaaaaggactaatagt

SEQ ID NO: 824461 - DNA, 25 bp, Mus musculus
tggttgactcaataggactaatagt

SEQ ID NO: 824462 - DNA, 25 bp, Mus musculus
tggttgagccaaactctagctgaag

SEQ ID NO: 824463 - DNA, 25 bp, Mus musculus
tggttgagccaatctctagctgaag

SEQ ID NO: 824464 - DNA, 25 bp, Mus musculus
tggttgagctagagccccacccaga

SEQ ID NO: 824465 - DNA, 25 bp, Mus musculus
tggttgagctagtgccccacccaga

SEQ ID NO: 824466 - DNA, 25 bp, Mus musculus
tggttgaggacccagtttccaactt

SEQ ID NO: 824467 - DNA, 25 bp, Mus musculus
tggttgaggaccgagtttccaactt

SEQ ID NO: 824468 - DNA, 25 bp, Mus musculus
tggttgatgaatccagcggtgatca

SEQ ID NO: 824469 - DNA, 25 bp, Mus musculus
tggttgatgaatgcagcggtgatca

SEQ ID NO: 824470 - DNA, 25 bp, Mus musculus
tggttgatgagaaccttcacgtgcc

SEQ ID NO: 824471 - DNA, 25 bp, Mus musculus
tggttgatgagatccttcacgtgcc

SEQ ID NO: 824472 - DNA, 25 bp, Mus musculus
tggttgatgtgtctccctgtgtgaa

SEQ ID NO: 824473 - DNA, 25 bp, Mus musculus
tggttgatgtgtgtccctgtgtgaa

SEQ ID NO: 824474 - DNA, 25 bp, Mus musculus
tggttgattatgatagaaaacaagc

SEQ ID NO: 824475 - DNA, 25 bp, Mus musculus
tggttgattatgttagaaaacaagc

SEQ ID NO: 824476 - DNA, 25 bp, Mus musculus
tggttgcagaagagcctaaagagca

SEQ ID NO: 824477 - DNA, 25 bp, Mus musculus
tggttgcagaagtgcctaaagagca

SEQ ID NO: 824478 - DNA, 25 bp, Mus musculus
tggttgcagagactaccaacggtac

SEQ ID NO: 824479 - DNA, 25 bp, Mus musculus
tggttgcagagagtaccaacggtac

SEQ ID NO: 824480 - DNA, 25 bp, Mus musculus
tggttgcagggacagatttagctca

SEQ ID NO: 824481 - DNA, 25 bp, Mus musculus
tggttgcagggagagatttagctca

SEQ ID NO: 824482 - DNA, 25 bp, Mus musculus
tggttgccacatctgggaaagaaaa

SEQ ID NO: 824483 - DNA, 25 bp, Mus musculus
tggttgccacatgtgggaaagaaaa

SEQ ID NO: 824484 - DNA, 25 bp, Mus musculus
tggttgccaggcaccaggatggccc

SEQ ID NO: 824485 - DNA, 25 bp, Mus musculus
tggttgccaggctccaggatggccc

SEQ ID NO: 824486 - DNA, 25 bp, Mus musculus
tggttgccctacacctctgggaagc

SEQ ID NO: 824487 - DNA, 25 bp, Mus musculus
tggttgccctactcctctgggaagc

SEQ ID NO: 824488 - DNA, 25 bp, Mus musculus
tggttgcgaaagagaaacaacaggc

SEQ ID NO: 824489 - DNA, 25 bp, Mus musculus
tggttgcgaaagtgaaacaacaggc

SEQ ID NO: 824490 - DNA, 25 bp, Mus musculus
tggttgcgtcctccaaagagtttga

SEQ ID NO: 824491 - DNA, 25 bp, Mus musculus
tggttgcgtcctgcaaagagtttga

SEQ ID NO: 824492 - DNA, 25 bp, Mus musculus
tggttgctaagacactctggctcgc

SEQ ID NO: 824493 - DNA, 25 bp, Mus musculus
tggttgctaagagactctggctcgc

SEQ ID NO: 824494 - DNA, 25 bp, Mus musculus
tggttgctccccaactgctgatggc

SEQ ID NO: 824495 - DNA, 25 bp, Mus musculus
tggttgctcccctactgctgatggc

SEQ ID NO: 824496 - DNA, 25 bp, Mus musculus
tggttgctgcggctacgaaaactac

SEQ ID NO: 824497 - DNA, 25 bp, Mus musculus
tggttgctgcgggtacgaaaactac

SEQ ID NO: 824498 - DNA, 25 bp, Mus musculus
tggttggaaaccctttggctgtagt

SEQ ID NO: 824499 - DNA, 25 bp, Mus musculus
tggttggaaaccgtttggctgtagt

SEQ ID NO: 824500 - DNA, 25 bp, Mus musculus
tggttggaaatcactgcttgttcag

SEQ ID NO: 824501 - DNA, 25 bp, Mus musculus
tggttggaaatctctgcttgttcag

SEQ ID NO: 824502 - DNA, 25 bp, Mus musculus
tggttggaatagaagagcacactgt

SEQ ID NO: 824503 - DNA, 25 bp, Mus musculus
tggttggaatagtagagcacactgt

SEQ ID NO: 824504 - DNA, 25 bp, Mus musculus
tggttggaatgtaaaggcggcccct

SEQ ID NO: 824505 - DNA, 25 bp, Mus musculus
tggttggaatgttaaggcggcccct

SEQ ID NO: 824506 - DNA, 25 bp, Mus musculus
tggttggagaccaagcacctcatga

SEQ ID NO: 824507 - DNA, 25 bp, Mus musculus
tggttggagacctagcacctcatga

SEQ ID NO: 824508 - DNA, 25 bp, Mus musculus
tggttggcacccacacttaccggag

SEQ ID NO: 824509 - DNA, 25 bp, Mus musculus
tggttggcaccctcacttaccggag

SEQ ID NO: 824510 - DNA, 25 bp, Mus musculus
tggttggctatccagacttcctgct

SEQ ID NO: 824511 - DNA, 25 bp, Mus musculus
tggttggctatcgagacttcctgct

SEQ ID NO: 824512 - DNA, 25 bp, Mus musculus
tggttggtgtcacattatcatgagc

SEQ ID NO: 824513 - DNA, 25 bp, Mus musculus
tggttggtgtcagattatcatgagc

SEQ ID NO: 824514 - DNA, 25 bp, Mus musculus
tggttggttacaacacaaactacag

SEQ ID NO: 824515 - DNA, 25 bp, Mus musculus
tggttggttacatcacaaactacag

SEQ ID NO: 824516 - DNA, 25 bp, Mus musculus
tggttggttactaacgagttcaggg

SEQ ID NO: 824517 - DNA, 25 bp, Mus musculus
tggttggttacttacgagttcaggg

SEQ ID NO: 824518 - DNA, 25 bp, Mus musculus
tggttggttgacacaaaaggactaa

SEQ ID NO: 824519 - DNA, 25 bp, Mus musculus
tggttggttgactcaaaaggactaa

SEQ ID NO: 824520 - DNA, 25 bp, Mus musculus
tggttgtatactcgaaatgctcaga

SEQ ID NO: 824521 - DNA, 25 bp, Mus musculus
tggttgtatactggaaatgctcaga

SEQ ID NO: 824522 - DNA, 25 bp, Mus musculus
tggttgtctacccttggacccagcg

SEQ ID NO: 824523 - DNA, 25 bp, Mus musculus
tggttgtctaccgttggacccagcg

SEQ ID NO: 824524 - DNA, 25 bp, Mus musculus
tggttgtctccaagctctgagctgt

SEQ ID NO: 824525 - DNA, 25 bp, Mus musculus
tggttgtctccatgctctgagctgt

SEQ ID NO: 824526 - DNA, 25 bp, Mus musculus
tggttgtctgacatctgatcgctga

SEQ ID NO: 824527 - DNA, 25 bp, Mus musculus
tggttgtctgacttctgatcgctga

SEQ ID NO: 824528 - DNA, 25 bp, Mus musculus
tggttgtcttccagcacttctgccc

SEQ ID NO: 824529 - DNA, 25 bp, Mus musculus
tggttgtcttcctgcacttctgccc

SEQ ID NO: 824530 - DNA, 25 bp, Mus musculus
tggttgtgagggagaaaatcctcga

SEQ ID NO: 824531 - DNA, 25 bp, Mus musculus
tggttgtgagggtgaaaatcctcga

SEQ ID NO: 824532 - DNA, 25 bp, Mus musculus
tggttgtggacacacctccagggac

SEQ ID NO: 824533 - DNA, 25 bp, Mus musculus
tggttgtggacagacctccagggac

SEQ ID NO: 824534 - DNA, 25 bp, Mus musculus
tggttgtgggctagtcacctctgct

SEQ ID NO: 824535 - DNA, 25 bp, Mus musculus
tggttgtgggcttgtcacctctgct

SEQ ID NO: 824536 - DNA, 25 bp, Mus musculus
tggttgtgtacaagactgatggcaa

SEQ ID NO: 824537 - DNA, 25 bp, Mus musculus
tggttgtgtacatgactgatggcaa

SEQ ID NO: 824538 - DNA, 25 bp, Mus musculus
tggttgttatggagatctgttctgc

SEQ ID NO: 824539 - DNA, 25 bp, Mus musculus
tggttgttatggtgatctgttctgc

SEQ ID NO: 824540 - DNA, 25 bp, Mus musculus
tggttgttcacaaccacggaggcgg

SEQ ID NO: 824541 - DNA, 25 bp, Mus musculus
tggttgttcacatccacggaggcgg

SEQ ID NO: 824542 - DNA, 25 bp, Mus musculus
tggttgttggaaacagtcaagttgc

SEQ ID NO: 824543 - DNA, 25 bp, Mus musculus
tggttgttggaatcagtcaagttgc

SEQ ID NO: 824544 - DNA, 25 bp, Mus musculus
tggtttaaaaaacgagaatgtggtg

SEQ ID NO: 824545 - DNA, 25 bp, Mus musculus
tggtttaaaaaaggagaatgtggtg

SEQ ID NO: 824546 - DNA, 25 bp, Mus musculus
tggtttacaataatcaagatgacta

SEQ ID NO: 824547 - DNA, 25 bp, Mus musculus
tggtttacaatattcaagatgacta

SEQ ID NO: 824548 - DNA, 25 bp, Mus musculus
tggtttacaggcaaacccagtagag

SEQ ID NO: 824549 - DNA, 25 bp, Mus musculus
tggtttacaggctaacccagtagag

SEQ ID NO: 824550 - DNA, 25 bp, Mus musculus
tggtttaccgttcagaaggcctcct

SEQ ID NO: 824551 - DNA, 25 bp, Mus musculus
tggtttaccgttgagaaggcctcct

SEQ ID NO: 824552 - DNA, 25 bp, Mus musculus
tggtttacctgacgccctgaggatt

SEQ ID NO: 824553 - DNA, 25 bp, Mus musculus
tggtttacctgaggccctgaggatt

SEQ ID NO: 824554 - DNA, 25 bp, Mus musculus
tggtttacgaagagcagtcaaagtg

SEQ ID NO: 824555 - DNA, 25 bp, Mus musculus
tggtttacgaagtgcagtcaaagtg

SEQ ID NO: 824556 - DNA, 25 bp, Mus musculus
tggtttagacccacagaaaataaag

SEQ ID NO: 824557 - DNA, 25 bp, Mus musculus
tggtttagaccctcagaaaataaag

SEQ ID NO: 824558 - DNA, 25 bp, Mus musculus
tggtttagcagtcaaccttcacagc

SEQ ID NO: 824559 - DNA, 25 bp, Mus musculus
tggtttagcagtgaaccttcacagc

SEQ ID NO: 824560 - DNA, 25 bp, Mus musculus
tggtttaggaatctgaggctgtata

SEQ ID NO: 824561 - DNA, 25 bp, Mus musculus
tggtttaggaatgtgaggctgtata

SEQ ID NO: 824562 - DNA, 25 bp, Mus musculus
tggtttataacaagtctcacgagga

SEQ ID NO: 824563 - DNA, 25 bp, Mus musculus
tggtttataacatgtctcacgagga

SEQ ID NO: 824564 - DNA, 25 bp, Mus musculus
tggtttatcatcaacaaagttggga

SEQ ID NO: 824565 - DNA, 25 bp, Mus musculus
tggtttatcatctacaaagttggga

SEQ ID NO: 824566 - DNA, 25 bp, Mus musculus
tggtttatgatccatctctgtgaga

SEQ ID NO: 824567 - DNA, 25 bp, Mus musculus
tggtttatgatcgatctctgtgaga

SEQ ID NO: 824568 - DNA, 25 bp, Mus musculus
tggtttcaaaggcagcttcgttact

SEQ ID NO: 824569 - DNA, 25 bp, Mus musculus
tggtttcaaagggagcttcgttact

SEQ ID NO: 824570 - DNA, 25 bp, Mus musculus
tggtttcaccatcgaaatgaatgcc

SEQ ID NO: 824571 - DNA, 25 bp, Mus musculus
tggtttcaccatggaaatgaatgcc

SEQ ID NO: 824572 - DNA, 25 bp, Mus musculus
tggtttcaccccaacatcactggtg

SEQ ID NO: 824573 - DNA, 25 bp, Mus musculus
tggtttcacccctacatcactggtg

SEQ ID NO: 824574 - DNA, 25 bp, Mus musculus
tggtttcaccctcaacgacgatgga

SEQ ID NO: 824575 - DNA, 25 bp, Mus musculus
tggtttcaccctgaacgacgatgga

SEQ ID NO: 824576 - DNA, 25 bp, Mus musculus
tggtttcagtggatcaggaggcagt

SEQ ID NO: 824577 - DNA, 25 bp, Mus musculus
tggtttcagtggttcaggaggcagt

SEQ ID NO: 824578 - DNA, 25 bp, Mus musculus
tggtttcattcaacacaactgtacc

SEQ ID NO: 824579 - DNA, 25 bp, Mus musculus
tggtttcattcatcacaactgtacc

SEQ ID NO: 824580 - DNA, 25 bp, Mus musculus
tggtttccagccaagtttgtggagg

SEQ ID NO: 824581 - DNA, 25 bp, Mus musculus
tggtttccagcctagtttgtggagg

SEQ ID NO: 824582 - DNA, 25 bp, Mus musculus
tggtttcccactaaaccccagagtg

SEQ ID NO: 824583 - DNA, 25 bp, Mus musculus
tggtttcccacttaaccccagagtg

SEQ ID NO: 824584 - DNA, 25 bp, Mus musculus
tggtttcccctgcaaagggctctgc

SEQ ID NO: 824585 - DNA, 25 bp, Mus musculus
tggtttcccctggaaagggctctgc

SEQ ID NO: 824586 - DNA, 25 bp, Mus musculus
tggtttccgagacaagaaagtgctg

SEQ ID NO: 824587 - DNA, 25 bp, Mus musculus
tggtttccgagagaagaaagtgctg

SEQ ID NO: 824588 - DNA, 25 bp, Mus musculus
tggtttccgaggagacaaaggagat

SEQ ID NO: 824589 - DNA, 25 bp, Mus musculus
tggtttccgaggtgacaaaggagat

SEQ ID NO: 824590 - DNA, 25 bp, Mus musculus
tggtttcggcccatttacaaggcct

SEQ ID NO: 824591 - DNA, 25 bp, Mus musculus
tggtttcggcccttttacaaggcct

SEQ ID NO: 824592 - DNA, 25 bp, Mus musculus
tggtttcggccgagagcttcatgca

SEQ ID NO: 824593 - DNA, 25 bp, Mus musculus
tggtttcggccgtgagcttcatgca

SEQ ID NO: 824594 - DNA, 25 bp, Mus musculus
tggtttctacacatgcaaggcggtc

SEQ ID NO: 824595 - DNA, 25 bp, Mus musculus
tggtttctacacttgcaaggcggtc

SEQ ID NO: 824596 - DNA, 25 bp, Mus musculus
tggtttctatctctgaacagaagct

SEQ ID NO: 824597 - DNA, 25 bp, Mus musculus
tggtttctatctgtgaacagaagct

SEQ ID NO: 824598 - DNA, 25 bp, Mus musculus
tggtttctatgaagccaatgagaca

SEQ ID NO: 824599 - DNA, 25 bp, Mus musculus
tggtttctatgatgccaatgagaca

SEQ ID NO: 824600 - DNA, 25 bp, Mus musculus
tggtttctcagtatgagaaacagaa

SEQ ID NO: 824601 - DNA, 25 bp, Mus musculus
tggtttctcagtttgagaaacagaa

SEQ ID NO: 824602 - DNA, 25 bp, Mus musculus
tggtttctggccccgcatcatactc

SEQ ID NO: 824603 - DNA, 25 bp, Mus musculus
tggtttctggccgcgcatcatactc

SEQ ID NO: 824604 - DNA, 25 bp, Mus musculus
tggtttctgggacttccgtggacct

SEQ ID NO: 824605 - DNA, 25 bp, Mus musculus
tggtttctgggagttccgtggacct

SEQ ID NO: 824606 - DNA, 25 bp, Mus musculus
tggtttctgtagaatgactctgtgg

SEQ ID NO: 824607 - DNA, 25 bp, Mus musculus
tggtttctgtagtatgactctgtgg

SEQ ID NO: 824608 - DNA, 25 bp, Mus musculus
tggtttgaacacaccaggaatgttc

SEQ ID NO: 824609 - DNA, 25 bp, Mus musculus
tggtttgaacactccaggaatgttc

SEQ ID NO: 824610 - DNA, 25 bp, Mus musculus
tggtttgacactcattgagctctgg

SEQ ID NO: 824611 - DNA, 25 bp, Mus musculus
tggtttgacactgattgagctctgg

SEQ ID NO: 824612 - DNA, 25 bp, Mus musculus
tggtttgaccacatcaagggctgga

SEQ ID NO: 824613 - DNA, 25 bp, Mus musculus
tggtttgaccacttcaagggctgga

SEQ ID NO: 824614 - DNA, 25 bp, Mus musculus
tggtttgactaacaatggtcccata

SEQ ID NO: 824615 - DNA, 25 bp, Mus musculus
tggtttgactaagaatggtcccata

SEQ ID NO: 824616 - DNA, 25 bp, Mus musculus
tggtttgactgccagaaggatgact

SEQ ID NO: 824617 - DNA, 25 bp, Mus musculus
tggtttgactgcgagaaggatgact

SEQ ID NO: 824618 - DNA, 25 bp, Mus musculus
tggtttgagaccacccggagagaga

SEQ ID NO: 824619 - DNA, 25 bp, Mus musculus
tggtttgagacctcccggagagaga

SEQ ID NO: 824620 - DNA, 25 bp, Mus musculus
tggtttgagccaacccagtttggca

SEQ ID NO: 824621 - DNA, 25 bp, Mus musculus
tggtttgagccatcccagtttggca

SEQ ID NO: 824622 - DNA, 25 bp, Mus musculus
tggtttgatctcactactaaggact

SEQ ID NO: 824623 - DNA, 25 bp, Mus musculus
tggtttgatctctctactaaggact

SEQ ID NO: 824624 - DNA, 25 bp, Mus musculus
tggtttgcaccgcattgcccgtgga

SEQ ID NO: 824625 - DNA, 25 bp, Mus musculus
tggtttgcaccggattgcccgtgga

SEQ ID NO: 824626 - DNA, 25 bp, Mus musculus
tggtttgccagccataggcgctgaa

SEQ ID NO: 824627 - DNA, 25 bp, Mus musculus
tggtttgccagcgataggcgctgaa

SEQ ID NO: 824628 - DNA, 25 bp, Mus musculus
tggtttgccatgcaacgacttgaaa

SEQ ID NO: 824629 - DNA, 25 bp, Mus musculus
tggtttgccatggaacgacttgaaa

SEQ ID NO: 824630 - DNA, 25 bp, Mus musculus
tggtttgcggagagataaagagttc

SEQ ID NO: 824631 - DNA, 25 bp, Mus musculus
tggtttgcggagtgataaagagttc

SEQ ID NO: 824632 - DNA, 25 bp, Mus musculus
tggtttggatttaacagaagtggcc

SEQ ID NO: 824633 - DNA, 25 bp, Mus musculus
tggtttggattttacagaagtggcc

SEQ ID NO: 824634 - DNA, 25 bp, Mus musculus
tggtttggctacctgaaccaagagg

SEQ ID NO: 824635 - DNA, 25 bp, Mus musculus
tggtttggctacgtgaaccaagagg

SEQ ID NO: 824636 - DNA, 25 bp, Mus musculus
tggtttgggatcatgagaagactcc

SEQ ID NO: 824637 - DNA, 25 bp, Mus musculus
tggtttgggatcttgagaagactcc

SEQ ID NO: 824638 - DNA, 25 bp, Mus musculus
tggtttgtatgaactgccaggactg

SEQ ID NO: 824639 - DNA, 25 bp, Mus musculus
tggtttgtatgatctgccaggactg

SEQ ID NO: 824640 - DNA, 25 bp, Mus musculus
tggtttgtccagatcgccatggcct

SEQ ID NO: 824641 - DNA, 25 bp, Mus musculus
tggtttgtccagttcgccatggcct

SEQ ID NO: 824642 - DNA, 25 bp, Mus musculus
tggtttgttttcagcaagatacaga

SEQ ID NO: 824643 - DNA, 25 bp, Mus musculus
tggtttgttttctgcaagatacaga

SEQ ID NO: 824644 - DNA, 25 bp, Mus musculus
tggttttaagagaggaaagctagct

SEQ ID NO: 824645 - DNA, 25 bp, Mus musculus
tggttttaagagtggaaagctagct

SEQ ID NO: 824646 - DNA, 25 bp, Mus musculus
tggttttaagcaccccaggcaatta

SEQ ID NO: 824647 - DNA, 25 bp, Mus musculus
tggttttaagcagcccaggcaatta

SEQ ID NO: 824648 - DNA, 25 bp, Mus musculus
tggttttactgaaatctcagaaggg

SEQ ID NO: 824649 - DNA, 25 bp, Mus musculus
tggttttactgatatctcagaaggg

SEQ ID NO: 824650 - DNA, 25 bp, Mus musculus
tggttttagtttaggtgagccatgg

SEQ ID NO: 824651 - DNA, 25 bp, Mus musculus
tggttttagttttggtgagccatgg

SEQ ID NO: 824652 - DNA, 25 bp, Mus musculus
tggttttatctgaacacagccgtgc

SEQ ID NO: 824653 - DNA, 25 bp, Mus musculus
tggttttatctgtacacagccgtgc

SEQ ID NO: 824654 - DNA, 25 bp, Mus musculus
tggttttcaaatccatgctgagaca

SEQ ID NO: 824655 - DNA, 25 bp, Mus musculus
tggttttcaaatgcatgctgagaca

SEQ ID NO: 824656 - DNA, 25 bp, Mus musculus
tggttttcagtcaccggcacagcaa

SEQ ID NO: 824657 - DNA, 25 bp, Mus musculus
tggttttcagtctccggcacagcaa

SEQ ID NO: 824658 - DNA, 25 bp, Mus musculus
tggttttcatccagtgtgtgatcaa

SEQ ID NO: 824659 - DNA, 25 bp, Mus musculus
tggttttcatcctgtgtgtgatcaa

SEQ ID NO: 824660 - DNA, 25 bp, Mus musculus
tggttttcatgtcgtagtgaaggca

SEQ ID NO: 824661 - DNA, 25 bp, Mus musculus
tggttttcatgtggtagtgaaggca

SEQ ID NO: 824662 - DNA, 25 bp, Mus musculus
tggttttcccgtaatttcagcactt

SEQ ID NO: 824663 - DNA, 25 bp, Mus musculus
tggttttcccgttatttcagcactt

SEQ ID NO: 824664 - DNA, 25 bp, Mus musculus
tggttttcctggacgccctgggttg

SEQ ID NO: 824665 - DNA, 25 bp, Mus musculus
tggttttcctggtcgccctgggttg

SEQ ID NO: 824666 - DNA, 25 bp, Mus musculus
tggttttcggaacgtggtgagcatc

SEQ ID NO: 824667 - DNA, 25 bp, Mus musculus
tggttttcggaaggtggtgagcatc

SEQ ID NO: 824668 - DNA, 25 bp, Mus musculus
tggttttcgggcactccgagaggac

SEQ ID NO: 824669 - DNA, 25 bp, Mus musculus
tggttttcgggctctccgagaggac

SEQ ID NO: 824670 - DNA, 25 bp, Mus musculus
tggttttctccaaatgaaaagatcc

SEQ ID NO: 824671 - DNA, 25 bp, Mus musculus
tggttttctccatatgaaaagatcc

SEQ ID NO: 824672 - DNA, 25 bp, Mus musculus
tggttttcttatcccttcagctcta

SEQ ID NO: 824673 - DNA, 25 bp, Mus musculus
tggttttcttatgccttcagctcta

SEQ ID NO: 824674 - DNA, 25 bp, Mus musculus
tggttttctttcactactgcgtggt

SEQ ID NO: 824675 - DNA, 25 bp, Mus musculus
tggttttctttctctactgcgtggt

SEQ ID NO: 824676 - DNA, 25 bp, Mus musculus
tggttttgaatgaagtcgacaagga

SEQ ID NO: 824677 - DNA, 25 bp, Mus musculus
tggttttgaatgtagtcgacaagga

SEQ ID NO: 824678 - DNA, 25 bp, Mus musculus
tggttttgagttcactttgagactc

SEQ ID NO: 824679 - DNA, 25 bp, Mus musculus
tggttttgagttgactttgagactc

SEQ ID NO: 824680 - DNA, 25 bp, Mus musculus
tggttttgcagacgctcacaatatt

SEQ ID NO: 824681 - DNA, 25 bp, Mus musculus
tggttttgcagaggctcacaatatt

SEQ ID NO: 824682 - DNA, 25 bp, Mus musculus
tggttttggacaacctgctggagct

SEQ ID NO: 824683 - DNA, 25 bp, Mus musculus
tggttttggacatcctgctggagct

SEQ ID NO: 824684 - DNA, 25 bp, Mus musculus
tggttttggctcacccatggatatc

SEQ ID NO: 824685 - DNA, 25 bp, Mus musculus
tggttttggctctcccatggatatc

SEQ ID NO: 824686 - DNA, 25 bp, Mus musculus
tggttttgggatacgtgtacagagc

SEQ ID NO: 824687 - DNA, 25 bp, Mus musculus
tggttttgggattcgtgtacagagc

SEQ ID NO: 824688 - DNA, 25 bp, Mus musculus
tggttttgggctctaactgctccag

SEQ ID NO: 824689 - DNA, 25 bp, Mus musculus
tggttttgggctgtaactgctccag

SEQ ID NO: 824690 - DNA, 25 bp, Mus musculus
tggttttgtcatcctcacctctaaa

SEQ ID NO: 824691 - DNA, 25 bp, Mus musculus
tggttttgtcatgctcacctctaaa

SEQ ID NO: 824692 - DNA, 25 bp, Mus musculus
tgtaaaaacacacggaggatgcagt

SEQ ID NO: 824693 - DNA, 25 bp, Mus musculus
tgtaaaaacacagggaggatgcagt

SEQ ID NO: 824694 - DNA, 25 bp, Mus musculus
tgtaaaaaccctcactctgtcgcag

SEQ ID NO: 824695 - DNA, 25 bp, Mus musculus
tgtaaaaaccctgactctgtcgcag

SEQ ID NO: 824696 - DNA, 25 bp, Mus musculus
tgtaaaaaccgtagcacaagctttg

SEQ ID NO: 824697 - DNA, 25 bp, Mus musculus
tgtaaaaaccgttgcacaagctttg

SEQ ID NO: 824698 - DNA, 25 bp, Mus musculus
tgtaaaaagaaccagaagatggttg

SEQ ID NO: 824699 - DNA, 25 bp, Mus musculus
tgtaaaaagaacgagaagatggttg

SEQ ID NO: 824700 - DNA, 25 bp, Mus musculus
tgtaaaaatagacccacctgatctg

SEQ ID NO: 824701 - DNA, 25 bp, Mus musculus
tgtaaaaatagagccacctgatctg

SEQ ID NO: 824702 - DNA, 25 bp, Mus musculus
tgtaaaaattctcatcgtggagatc

SEQ ID NO: 824703 - DNA, 25 bp, Mus musculus
tgtaaaaattctgatcgtggagatc

SEQ ID NO: 824704 - DNA, 25 bp, Mus musculus
tgtaaaaccaccatagaagccatcc

SEQ ID NO: 824705 - DNA, 25 bp, Mus musculus
tgtaaaaccaccttagaagccatcc

SEQ ID NO: 824706 - DNA, 25 bp, Mus musculus
tgtaaaaccggtaagatcaagtgcc

SEQ ID NO: 824707 - DNA, 25 bp, Mus musculus
tgtaaaaccggttagatcaagtgcc

SEQ ID NO: 824708 - DNA, 25 bp, Mus musculus
tgtaaaactgctatatcccagtccc

SEQ ID NO: 824709 - DNA, 25 bp, Mus musculus
tgtaaaactgctttatcccagtccc

SEQ ID NO: 824710 - DNA, 25 bp, Mus musculus
tgtaaaacttcacatcattgctgag

SEQ ID NO: 824711 - DNA, 25 bp, Mus musculus
tgtaaaacttcagatcattgctgag

SEQ ID NO: 824712 - DNA, 25 bp, Mus musculus
tgtaaaagcacacaccattgagtgg

SEQ ID NO: 824713 - DNA, 25 bp, Mus musculus
tgtaaaagcacagaccattgagtgg

SEQ ID NO: 824714 - DNA, 25 bp, Mus musculus
tgtaaaagctgaaggctccaggagc

SEQ ID NO: 824715 - DNA, 25 bp, Mus musculus
tgtaaaagctgatggctccaggagc

SEQ ID NO: 824716 - DNA, 25 bp, Mus musculus
tgtaaaaggactcacttggaagccc

SEQ ID NO: 824717 - DNA, 25 bp, Mus musculus
tgtaaaaggactgacttggaagccc

SEQ ID NO: 824718 - DNA, 25 bp, Mus musculus
tgtaaaaggatcacaggtcgcccag

SEQ ID NO: 824719 - DNA, 25 bp, Mus musculus
tgtaaaaggatctcaggtcgcccag

SEQ ID NO: 824720 - DNA, 25 bp, Mus musculus
tgtaaaaggatgctatgctcatgtt

SEQ ID NO: 824721 - DNA, 25 bp, Mus musculus
tgtaaaaggatggtatgctcatgtt

SEQ ID NO: 824722 - DNA, 25 bp, Mus musculus
tgtaaaatcaagagccgacaacaac

SEQ ID NO: 824723 - DNA, 25 bp, Mus musculus
tgtaaaatcaagtgccgacaacaac

SEQ ID NO: 824724 - DNA, 25 bp, Mus musculus
tgtaaaatctttagaggacctcctt

SEQ ID NO: 824725 - DNA, 25 bp, Mus musculus
tgtaaaatcttttgaggacctcctt

SEQ ID NO: 824726 - DNA, 25 bp, Mus musculus
tgtaaaattggacaagaagaaagcc

SEQ ID NO: 824727 - DNA, 25 bp, Mus musculus
tgtaaaattggagaagaagaaagcc

SEQ ID NO: 824728 - DNA, 25 bp, Mus musculus
tgtaaacaacgtcctctgtcatggc

SEQ ID NO: 824729 - DNA, 25 bp, Mus musculus
tgtaaacaacgtgctctgtcatggc

SEQ ID NO: 824730 - DNA, 25 bp, Mus musculus
tgtaaacaaggcacaaacagcaatc

SEQ ID NO: 824731 - DNA, 25 bp, Mus musculus
tgtaaacaaggctcaaacagcaatc

SEQ ID NO: 824732 - DNA, 25 bp, Mus musculus
tgtaaacacaacactcgaggccaac

SEQ ID NO: 824733 - DNA, 25 bp, Mus musculus
tgtaaacacaactctcgaggccaac

SEQ ID NO: 824734 - DNA, 25 bp, Mus musculus
tgtaaacaccgccactgatgatgac

SEQ ID NO: 824735 - DNA, 25 bp, Mus musculus
tgtaaacaccgcgactgatgatgac

SEQ ID NO: 824736 - DNA, 25 bp, Mus musculus
tgtaaacacggaaagaactgcccca

SEQ ID NO: 824737 - DNA, 25 bp, Mus musculus
tgtaaacacggatagaactgcccca

SEQ ID NO: 824738 - DNA, 25 bp, Mus musculus
tgtaaacagaataaaagttcctctc

SEQ ID NO: 824739 - DNA, 25 bp, Mus musculus
tgtaaacagaattaaagttcctctc

SEQ ID NO: 824740 - DNA, 25 bp, Mus musculus
tgtaaacagagtagcacagcgccag

SEQ ID NO: 824741 - DNA, 25 bp, Mus musculus
tgtaaacagagttgcacagcgccag

SEQ ID NO: 824742 - DNA, 25 bp, Mus musculus
tgtaaacagcacattgacactgtcc

SEQ ID NO: 824743 - DNA, 25 bp, Mus musculus
tgtaaacagcactttgacactgtcc

SEQ ID NO: 824744 - DNA, 25 bp, Mus musculus
tgtaaacatgccataagctttgctg

SEQ ID NO: 824745 - DNA, 25 bp, Mus musculus
tgtaaacatgccttaagctttgctg

SEQ ID NO: 824746 - DNA, 25 bp, Mus musculus
tgtaaaccaataactaagacagccc

SEQ ID NO: 824747 - DNA, 25 bp, Mus musculus
tgtaaaccaatatctaagacagccc

SEQ ID NO: 824748 - DNA, 25 bp, Mus musculus
tgtaaacgacatagacgagtcatcc

SEQ ID NO: 824749 - DNA, 25 bp, Mus musculus
tgtaaacgacattgacgagtcatcc

SEQ ID NO: 824750 - DNA, 25 bp, Mus musculus
tgtaaacggaggaggcatccggtcc

SEQ ID NO: 824751 - DNA, 25 bp, Mus musculus
tgtaaacggaggtggcatccggtcc

SEQ ID NO: 824752 - DNA, 25 bp, Mus musculus
tgtaaacgtgaaagctgtactcacc

SEQ ID NO: 824753 - DNA, 25 bp, Mus musculus
tgtaaacgtgaatgctgtactcacc

SEQ ID NO: 824754 - DNA, 25 bp, Mus musculus
tgtaaacgtgtcctcgatgaccggc

SEQ ID NO: 824755 - DNA, 25 bp, Mus musculus
tgtaaacgtgtcgtcgatgaccggc

SEQ ID NO: 824756 - DNA, 25 bp, Mus musculus
tgtaaactaaggaaacccactgtct

SEQ ID NO: 824757 - DNA, 25 bp, Mus musculus
tgtaaactaaggtaacccactgtct

SEQ ID NO: 824758 - DNA, 25 bp, Mus musculus
tgtaaactcgatcatgctcattggc

SEQ ID NO: 824759 - DNA, 25 bp, Mus musculus
tgtaaactcgatgatgctcattggc

SEQ ID NO: 824760 - DNA, 25 bp, Mus musculus
tgtaaactctagcagatacccggaa

SEQ ID NO: 824761 - DNA, 25 bp, Mus musculus
tgtaaactctaggagatacccggaa

SEQ ID NO: 824762 - DNA, 25 bp, Mus musculus
tgtaaactctttcacagacagacct

SEQ ID NO: 824763 - DNA, 25 bp, Mus musculus
tgtaaactctttgacagacagacct

SEQ ID NO: 824764 - DNA, 25 bp, Mus musculus
tgtaaactggccattcgtgaatcta

SEQ ID NO: 824765 - DNA, 25 bp, Mus musculus
tgtaaactggcctttcgtgaatcta

SEQ ID NO: 824766 - DNA, 25 bp, Mus musculus
tgtaaacttgcacaatctaatggct

SEQ ID NO: 824767 - DNA, 25 bp, Mus musculus
tgtaaacttgcagaatctaatggct

SEQ ID NO: 824768 - DNA, 25 bp, Mus musculus
tgtaaacttggtcggacagggccca

SEQ ID NO: 824769 - DNA, 25 bp, Mus musculus
tgtaaacttggtgggacagggccca

SEQ ID NO: 824770 - DNA, 25 bp, Mus musculus
tgtaaagaagtcctcctccaggtcc

SEQ ID NO: 824771 - DNA, 25 bp, Mus musculus
tgtaaagaagtcgtcctccaggtcc

SEQ ID NO: 824772 - DNA, 25 bp, Mus musculus
tgtaaagacaccctggccaactgta

SEQ ID NO: 824773 - DNA, 25 bp, Mus musculus
tgtaaagacaccgtggccaactgta

SEQ ID NO: 824774 - DNA, 25 bp, Mus musculus
tgtaaagactgaccagcctgtaggc

SEQ ID NO: 824775 - DNA, 25 bp, Mus musculus
tgtaaagactgagcagcctgtaggc

SEQ ID NO: 824776 - DNA, 25 bp, Mus musculus
tgtaaagcaattctagatcagtttg

SEQ ID NO: 824777 - DNA, 25 bp, Mus musculus
tgtaaagcaattgtagatcagtttg

SEQ ID NO: 824778 - DNA, 25 bp, Mus musculus
tgtaaagcatttcagatgcaacttg

SEQ ID NO: 824779 - DNA, 25 bp, Mus musculus
tgtaaagcatttgagatgcaacttg

SEQ ID NO: 824780 - DNA, 25 bp, Mus musculus
tgtaaagccccgaatagagcctata

SEQ ID NO: 824781 - DNA, 25 bp, Mus musculus
tgtaaagccccgtatagagcctata

SEQ ID NO: 824782 - DNA, 25 bp, Mus musculus
tgtaaagcccctaacctgcatccta

SEQ ID NO: 824783 - DNA, 25 bp, Mus musculus
tgtaaagccccttacctgcatccta

SEQ ID NO: 824784 - DNA, 25 bp, Mus musculus
tgtaaagcgccaaaacctgtctgta

SEQ ID NO: 824785 - DNA, 25 bp, Mus musculus
tgtaaagcgccataacctgtctgta

SEQ ID NO: 824786 - DNA, 25 bp, Mus musculus
tgtaaagctcctcattgaaaacgga

SEQ ID NO: 824787 - DNA, 25 bp, Mus musculus
tgtaaagctcctgattgaaaacgga

SEQ ID NO: 824788 - DNA, 25 bp, Mus musculus
tgtaaaggatataccagccaccctg

SEQ ID NO: 824789 - DNA, 25 bp, Mus musculus
tgtaaaggatattccagccaccctg

SEQ ID NO: 824790 - DNA, 25 bp, Mus musculus
tgtaaaggatgccacaacgatcgct

SEQ ID NO: 824791 - DNA, 25 bp, Mus musculus
tgtaaaggatgcgacaacgatcgct

SEQ ID NO: 824792 - DNA, 25 bp, Mus musculus
tgtaaaggtgttagttccgtgactg

SEQ ID NO: 824793 - DNA, 25 bp, Mus musculus
tgtaaaggtgtttgttccgtgactg

SEQ ID NO: 824794 - DNA, 25 bp, Mus musculus
tgtaaagtcagacgaccaaacctgt

SEQ ID NO: 824795 - DNA, 25 bp, Mus musculus
tgtaaagtcagaggaccaaacctgt

SEQ ID NO: 824796 - DNA, 25 bp, Mus musculus
tgtaaagtctttagcacaatcacgc

SEQ ID NO: 824797 - DNA, 25 bp, Mus musculus
tgtaaagtcttttgcacaatcacgc

SEQ ID NO: 824798 - DNA, 25 bp, Mus musculus
tgtaaatacagacccgagttcgctg

SEQ ID NO: 824799 - DNA, 25 bp, Mus musculus
tgtaaatacagagccgagttcgctg

SEQ ID NO: 824800 - DNA, 25 bp, Mus musculus
tgtaaatagacactgactaccagct

SEQ ID NO: 824801 - DNA, 25 bp, Mus musculus
tgtaaatagacagtgactaccagct

SEQ ID NO: 824802 - DNA, 25 bp, Mus musculus
tgtaaataggacaaagtttgactgt

SEQ ID NO: 824803 - DNA, 25 bp, Mus musculus
tgtaaataggactaagtttgactgt

SEQ ID NO: 824804 - DNA, 25 bp, Mus musculus
tgtaaatatcccacaacagacacag

SEQ ID NO: 824805 - DNA, 25 bp, Mus musculus
tgtaaatatccctcaacagacacag

SEQ ID NO: 824806 - DNA, 25 bp, Mus musculus
tgtaaatcaccccaaaaatgtgaag

SEQ ID NO: 824807 - DNA, 25 bp, Mus musculus
tgtaaatcacccgaaaaatgtgaag

SEQ ID NO: 824808 - DNA, 25 bp, Mus musculus
tgtaaatccaacatttcgaggttat

SEQ ID NO: 824809 - DNA, 25 bp, Mus musculus
tgtaaatccaacttttcgaggttat

SEQ ID NO: 824810 - DNA, 25 bp, Mus musculus
tgtaaatccgctctctgtcaccttg

SEQ ID NO: 824811 - DNA, 25 bp, Mus musculus
tgtaaatccgctgtctgtcaccttg

SEQ ID NO: 824812 - DNA, 25 bp, Mus musculus
tgtaaatccttacacgcttgagaat

SEQ ID NO: 824813 - DNA, 25 bp, Mus musculus
tgtaaatccttagacgcttgagaat

SEQ ID NO: 824814 - DNA, 25 bp, Mus musculus
tgtaaatctacaaggggtcactgct

SEQ ID NO: 824815 - DNA, 25 bp, Mus musculus
tgtaaatctacatggggtcactgct

SEQ ID NO: 824816 - DNA, 25 bp, Mus musculus
tgtaaatctcggagaccccacaagg

SEQ ID NO: 824817 - DNA, 25 bp, Mus musculus
tgtaaatctcggtgaccccacaagg

SEQ ID NO: 824818 - DNA, 25 bp, Mus musculus
tgtaaatgaaaaagctgctactgag

SEQ ID NO: 824819 - DNA, 25 bp, Mus musculus
tgtaaatgaaaatgctgctactgag

SEQ ID NO: 824820 - DNA, 25 bp, Mus musculus
tgtaaatgatcgagttccgtgggct

SEQ ID NO: 824821 - DNA, 25 bp, Mus musculus
tgtaaatgatcgtgttccgtgggct

SEQ ID NO: 824822 - DNA, 25 bp, Mus musculus
tgtaaatgccttaattgaaaaccca

SEQ ID NO: 824823 - DNA, 25 bp, Mus musculus
tgtaaatgcctttattgaaaaccca

SEQ ID NO: 824824 - DNA, 25 bp, Mus musculus
tgtaaatgtgttcgtcccaccacgg

SEQ ID NO: 824825 - DNA, 25 bp, Mus musculus
tgtaaatgtgttggtcccaccacgg

SEQ ID NO: 824826 - DNA, 25 bp, Mus musculus
tgtaaatgttcaagcaccctgcctg

SEQ ID NO: 824827 - DNA, 25 bp, Mus musculus
tgtaaatgttcatgcaccctgcctg

SEQ ID NO: 824828 - DNA, 25 bp, Mus musculus
tgtaaattataccactgacttcatc

SEQ ID NO: 824829 - DNA, 25 bp, Mus musculus
tgtaaattatacgactgacttcatc

SEQ ID NO: 824830 - DNA, 25 bp, Mus musculus
tgtaaattcaccagccactcggagt

SEQ ID NO: 824831 - DNA, 25 bp, Mus musculus
tgtaaattcacctgccactcggagt

SEQ ID NO: 824832 - DNA, 25 bp, Mus musculus
tgtaacaagcccacgccagaggata

SEQ ID NO: 824833 - DNA, 25 bp, Mus musculus
tgtaacaagccctcgccagaggata

SEQ ID NO: 824834 - DNA, 25 bp, Mus musculus
tgtaacaaggagaacctcagcctgg

SEQ ID NO: 824835 - DNA, 25 bp, Mus musculus
tgtaacaaggagtacctcagcctgg

SEQ ID NO: 824836 - DNA, 25 bp, Mus musculus
tgtaacaaggccatccatcaggtct

SEQ ID NO: 824837 - DNA, 25 bp, Mus musculus
tgtaacaaggccttccatcaggtct

SEQ ID NO: 824838 - DNA, 25 bp, Mus musculus
tgtaacaagggtacaacctgaagga

SEQ ID NO: 824839 - DNA, 25 bp, Mus musculus
tgtaacaagggttcaacctgaagga

SEQ ID NO: 824840 - DNA, 25 bp, Mus musculus
tgtaacaagtaacaccactcagagg

SEQ ID NO: 824841 - DNA, 25 bp, Mus musculus
tgtaacaagtaagaccactcagagg

SEQ ID NO: 824842 - DNA, 25 bp, Mus musculus
tgtaacaataaaccgggtctcctct

SEQ ID NO: 824843 - DNA, 25 bp, Mus musculus
tgtaacaataaagcgggtctcctct

SEQ ID NO: 824844 - DNA, 25 bp, Mus musculus
tgtaacaatggcaaccttgatgcca

SEQ ID NO: 824845 - DNA, 25 bp, Mus musculus
tgtaacaatggctaccttgatgcca

SEQ ID NO: 824846 - DNA, 25 bp, Mus musculus
tgtaacagaagtcaaaacagacatc

SEQ ID NO: 824847 - DNA, 25 bp, Mus musculus
tgtaacagaagtgaaaacagacatc

SEQ ID NO: 824848 - DNA, 25 bp, Mus musculus
tgtaacagagccagactggtttcct

SEQ ID NO: 824849 - DNA, 25 bp, Mus musculus
tgtaacagagcctgactggtttcct

SEQ ID NO: 824850 - DNA, 25 bp, Mus musculus
tgtaacagatgtcaaccgggaaagc

SEQ ID NO: 824851 - DNA, 25 bp, Mus musculus
tgtaacagatgtgaaccgggaaagc

SEQ ID NO: 824852 - DNA, 25 bp, Mus musculus
tgtaacagcagaaagctatggaata

SEQ ID NO: 824853 - DNA, 25 bp, Mus musculus
tgtaacagcagatagctatggaata

SEQ ID NO: 824854 - DNA, 25 bp, Mus musculus
tgtaacagcagcagcgtcggaggaa

SEQ ID NO: 824855 - DNA, 25 bp, Mus musculus
tgtaacagcagctgcgtcggaggaa

SEQ ID NO: 824856 - DNA, 25 bp, Mus musculus
tgtaacagctaacaacattcacata

SEQ ID NO: 824857 - DNA, 25 bp, Mus musculus
tgtaacagctaagaacattcacata

SEQ ID NO: 824858 - DNA, 25 bp, Mus musculus
tgtaacagtgatcagtgccagctct

SEQ ID NO: 824859 - DNA, 25 bp, Mus musculus
tgtaacagtgatgagtgccagctct

SEQ ID NO: 824860 - DNA, 25 bp, Mus musculus
tgtaacagttaaatccctgcctggc

SEQ ID NO: 824861 - DNA, 25 bp, Mus musculus
tgtaacagttaattccctgcctggc

SEQ ID NO: 824862 - DNA, 25 bp, Mus musculus
tgtaacatcaataaaggctgtggct

SEQ ID NO: 824863 - DNA, 25 bp, Mus musculus
tgtaacatcaattaaggctgtggct

SEQ ID NO: 824864 - DNA, 25 bp, Mus musculus
tgtaacatcatgaatgcttcagctg

SEQ ID NO: 824865 - DNA, 25 bp, Mus musculus
tgtaacatcatgtatgcttcagctg

SEQ ID NO: 824866 - DNA, 25 bp, Mus musculus
tgtaacatgcagaaccaacatggga

SEQ ID NO: 824867 - DNA, 25 bp, Mus musculus
tgtaacatgcagtaccaacatggga

SEQ ID NO: 824868 - DNA, 25 bp, Mus musculus
tgtaacattctcagcgatggttgag

SEQ ID NO: 824869 - DNA, 25 bp, Mus musculus
tgtaacattctctgcgatggttgag

SEQ ID NO: 824870 - DNA, 25 bp, Mus musculus
tgtaaccaaaagagtccactcccct

SEQ ID NO: 824871 - DNA, 25 bp, Mus musculus
tgtaaccaaaagtgtccactcccct

SEQ ID NO: 824872 - DNA, 25 bp, Mus musculus
tgtaaccagaccacaggccagtgtc

SEQ ID NO: 824873 - DNA, 25 bp, Mus musculus
tgtaaccagacctcaggccagtgtc

SEQ ID NO: 824874 - DNA, 25 bp, Mus musculus
tgtaacccaagtactaccttcagtg

SEQ ID NO: 824875 - DNA, 25 bp, Mus musculus
tgtaacccaagttctaccttcagtg

SEQ ID NO: 824876 - DNA, 25 bp, Mus musculus
tgtaacctcacgcagattggtggcc

SEQ ID NO: 824877 - DNA, 25 bp, Mus musculus
tgtaacctcacggagattggtggcc

SEQ ID NO: 824878 - DNA, 25 bp, Mus musculus
tgtaacctggccaacagtgggaagc

SEQ ID NO: 824879 - DNA, 25 bp, Mus musculus
tgtaacctggcctacagtgggaagc

SEQ ID NO: 824880 - DNA, 25 bp, Mus musculus
tgtaaccttgctccgctatggagaa

SEQ ID NO: 824881 - DNA, 25 bp, Mus musculus
tgtaaccttgctgcgctatggagaa

SEQ ID NO: 824882 - DNA, 25 bp, Mus musculus
tgtaacgacactctcaagcagctga

SEQ ID NO: 824883 - DNA, 25 bp, Mus musculus
tgtaacgacactgtcaagcagctga

SEQ ID NO: 824884 - DNA, 25 bp, Mus musculus
tgtaacggtcatactttctcagcag

SEQ ID NO: 824885 - DNA, 25 bp, Mus musculus
tgtaacggtcattctttctcagcag

SEQ ID NO: 824886 - DNA, 25 bp, Mus musculus
tgtaacgtcattccttgttcacagg

SEQ ID NO: 824887 - DNA, 25 bp, Mus musculus
tgtaacgtcattgcttgttcacagg

SEQ ID NO: 824888 - DNA, 25 bp, Mus musculus
tgtaacgtgaccatccacaaccgct

SEQ ID NO: 824889 - DNA, 25 bp, Mus musculus
tgtaacgtgaccttccacaaccgct

SEQ ID NO: 824890 - DNA, 25 bp, Mus musculus
tgtaactatggaaacggaggctgtc

SEQ ID NO: 824891 - DNA, 25 bp, Mus musculus
tgtaactatggatacggaggctgtc

SEQ ID NO: 824892 - DNA, 25 bp, Mus musculus
tgtaactcaaagctggaccccacac

SEQ ID NO: 824893 - DNA, 25 bp, Mus musculus
tgtaactcaaaggtggaccccacac

SEQ ID NO: 824894 - DNA, 25 bp, Mus musculus
tgtaactccagaaacacaatgtgcc

SEQ ID NO: 824895 - DNA, 25 bp, Mus musculus
tgtaactccagatacacaatgtgcc

SEQ ID NO: 824896 - DNA, 25 bp, Mus musculus
tgtaactccgcacgaactgggcatc

SEQ ID NO: 824897 - DNA, 25 bp, Mus musculus
tgtaactccgcaggaactgggcatc

SEQ ID NO: 824898 - DNA, 25 bp, Mus musculus
tgtaactctcgtacccctgtggcct

SEQ ID NO: 824899 - DNA, 25 bp, Mus musculus
tgtaactctcgttcccctgtggcct

SEQ ID NO: 824900 - DNA, 25 bp, Mus musculus
tgtaactctgcaagaggccttggct

SEQ ID NO: 824901 - DNA, 25 bp, Mus musculus
tgtaactctgcatgaggccttggct

SEQ ID NO: 824902 - DNA, 25 bp, Mus musculus
tgtaactggaccaccaactttctgg

SEQ ID NO: 824903 - DNA, 25 bp, Mus musculus
tgtaactggacctccaactttctgg

SEQ ID NO: 824904 - DNA, 25 bp, Mus musculus
tgtaactggcaaaataattggaaac

SEQ ID NO: 824905 - DNA, 25 bp, Mus musculus
tgtaactggcaatataattggaaac

SEQ ID NO: 824906 - DNA, 25 bp, Mus musculus
tgtaactgtaaaatcaagagccgac

SEQ ID NO: 824907 - DNA, 25 bp, Mus musculus
tgtaactgtaaattcaagagccgac

SEQ ID NO: 824908 - DNA, 25 bp, Mus musculus
tgtaactgtgccatgatgtcagctt

SEQ ID NO: 824909 - DNA, 25 bp, Mus musculus
tgtaactgtgccttgatgtcagctt

SEQ ID NO: 824910 - DNA, 25 bp, Mus musculus
tgtaacttgccaacctatggctgcc

SEQ ID NO: 824911 - DNA, 25 bp, Mus musculus
tgtaacttgccatcctatggctgcc

SEQ ID NO: 824912 - DNA, 25 bp, Mus musculus
tgtaacttgggacttaagtatccct

SEQ ID NO: 824913 - DNA, 25 bp, Mus musculus
tgtaacttgggagttaagtatccct

SEQ ID NO: 824914 - DNA, 25 bp, Mus musculus
tgtaactttctgcttgaaaaactag

SEQ ID NO: 824915 - DNA, 25 bp, Mus musculus
tgtaactttctggttgaaaaactag

SEQ ID NO: 824916 - DNA, 25 bp, Mus musculus
tgtaactttgtgacagcgtgcagtc

SEQ ID NO: 824917 - DNA, 25 bp, Mus musculus
tgtaactttgtgtcagcgtgcagtc

SEQ ID NO: 824918 - DNA, 25 bp, Mus musculus
tgtaagaaaacaccagagcagctgc

SEQ ID NO: 824919 - DNA, 25 bp, Mus musculus
tgtaagaaaacagcagagcagctgc

SEQ ID NO: 824920 - DNA, 25 bp, Mus musculus
tgtaagaaaactcacctccatcctc

SEQ ID NO: 824921 - DNA, 25 bp, Mus musculus
tgtaagaaaactgacctccatcctc

SEQ ID NO: 824922 - DNA, 25 bp, Mus musculus
tgtaagaactttcaccactatggct

SEQ ID NO: 824923 - DNA, 25 bp, Mus musculus
tgtaagaactttgaccactatggct

SEQ ID NO: 824924 - DNA, 25 bp, Mus musculus
tgtaagaagaaacacgggaagagcc

SEQ ID NO: 824925 - DNA, 25 bp, Mus musculus
tgtaagaagaaagacgggaagagcc

SEQ ID NO: 824926 - DNA, 25 bp, Mus musculus
tgtaagaatacaaagttgggcctcc

SEQ ID NO: 824927 - DNA, 25 bp, Mus musculus
tgtaagaatacatagttgggcctcc

SEQ ID NO: 824928 - DNA, 25 bp, Mus musculus
tgtaagagagatcttatcacctcca

SEQ ID NO: 824929 - DNA, 25 bp, Mus musculus
tgtaagagagatgttatcacctcca

SEQ ID NO: 824930 - DNA, 25 bp, Mus musculus
tgtaagagtcacatcatccaagact

SEQ ID NO: 824931 - DNA, 25 bp, Mus musculus
tgtaagagtcacttcatccaagact

SEQ ID NO: 824932 - DNA, 25 bp, Mus musculus
tgtaagagtggaatcaactgcccca

SEQ ID NO: 824933 - DNA, 25 bp, Mus musculus
tgtaagagtggattcaactgcccca

SEQ ID NO: 824934 - DNA, 25 bp, Mus musculus
tgtaagattacaaaagacttgttcc

SEQ ID NO: 824935 - DNA, 25 bp, Mus musculus
tgtaagattacataagacttgttcc

SEQ ID NO: 824936 - DNA, 25 bp, Mus musculus
tgtaagcacaggagcatgaacactt

SEQ ID NO: 824937 - DNA, 25 bp, Mus musculus
tgtaagcacaggtgcatgaacactt

SEQ ID NO: 824938 - DNA, 25 bp, Mus musculus
tgtaagcaccttaggagaagggacc

SEQ ID NO: 824939 - DNA, 25 bp, Mus musculus
tgtaagcacctttggagaagggacc

SEQ ID NO: 824940 - DNA, 25 bp, Mus musculus
tgtaagcacgcccattctccagtca

SEQ ID NO: 824941 - DNA, 25 bp, Mus musculus
tgtaagcacgccgattctccagtca

SEQ ID NO: 824942 - DNA, 25 bp, Mus musculus
tgtaagcagcctaatcgacgctttc

SEQ ID NO: 824943 - DNA, 25 bp, Mus musculus
tgtaagcagccttatcgacgctttc

SEQ ID NO: 824944 - DNA, 25 bp, Mus musculus
tgtaagcagcgaaagggtgatccgt

SEQ ID NO: 824945 - DNA, 25 bp, Mus musculus
tgtaagcagcgatagggtgatccgt

SEQ ID NO: 824946 - DNA, 25 bp, Mus musculus
tgtaagcagctactaaggaccatag

SEQ ID NO: 824947 - DNA, 25 bp, Mus musculus
tgtaagcagctagtaaggaccatag

SEQ ID NO: 824948 - DNA, 25 bp, Mus musculus
tgtaagcagttcacactatggcagc

SEQ ID NO: 824949 - DNA, 25 bp, Mus musculus
tgtaagcagttctcactatggcagc

SEQ ID NO: 824950 - DNA, 25 bp, Mus musculus
tgtaagcagttgctcaggtcctagt

SEQ ID NO: 824951 - DNA, 25 bp, Mus musculus
tgtaagcagttggtcaggtcctagt

SEQ ID NO: 824952 - DNA, 25 bp, Mus musculus
tgtaagccaaaaccaccaagatgtc

SEQ ID NO: 824953 - DNA, 25 bp, Mus musculus
tgtaagccaaaagcaccaagatgtc

SEQ ID NO: 824954 - DNA, 25 bp, Mus musculus
tgtaagccagcccagcatgcatgaa

SEQ ID NO: 824955 - DNA, 25 bp, Mus musculus
tgtaagccagccgagcatgcatgaa

SEQ ID NO: 824956 - DNA, 25 bp, Mus musculus
tgtaagccatgtccggactgtgcgc

SEQ ID NO: 824957 - DNA, 25 bp, Mus musculus
tgtaagccatgtgcggactgtgcgc

SEQ ID NO: 824958 - DNA, 25 bp, Mus musculus
tgtaagcccctcctcatggagtggt

SEQ ID NO: 824959 - DNA, 25 bp, Mus musculus
tgtaagcccctcgtcatggagtggt

SEQ ID NO: 824960 - DNA, 25 bp, Mus musculus
tgtaagccgcagatattgaacttcc

SEQ ID NO: 824961 - DNA, 25 bp, Mus musculus
tgtaagccgcagttattgaacttcc

SEQ ID NO: 824962 - DNA, 25 bp, Mus musculus
tgtaagcctcaacatgacagtgaag

SEQ ID NO: 824963 - DNA, 25 bp, Mus musculus
tgtaagcctcaagatgacagtgaag

SEQ ID NO: 824964 - DNA, 25 bp, Mus musculus
tgtaagcgcctgctacacaagaaca

SEQ ID NO: 824965 - DNA, 25 bp, Mus musculus
tgtaagcgcctggtacacaagaaca

SEQ ID NO: 824966 - DNA, 25 bp, Mus musculus
tgtaagctgaggcaaactccaaccc

SEQ ID NO: 824967 - DNA, 25 bp, Mus musculus
tgtaagctgagggaaactccaaccc

SEQ ID NO: 824968 - DNA, 25 bp, Mus musculus
tgtaagctgccaagactgtctctga

SEQ ID NO: 824969 - DNA, 25 bp, Mus musculus
tgtaagctgccatgactgtctctga

SEQ ID NO: 824970 - DNA, 25 bp, Mus musculus
tgtaagctgctgagtatggatctca

SEQ ID NO: 824971 - DNA, 25 bp, Mus musculus
tgtaagctgctgtgtatggatctca

SEQ ID NO: 824972 - DNA, 25 bp, Mus musculus
tgtaaggaccagagttttccagctg

SEQ ID NO: 824973 - DNA, 25 bp, Mus musculus
tgtaaggaccagtgttttccagctg

SEQ ID NO: 824974 - DNA, 25 bp, Mus musculus
tgtaaggacggtacagatgagcctg

SEQ ID NO: 824975 - DNA, 25 bp, Mus musculus
tgtaaggacggttcagatgagcctg

SEQ ID NO: 824976 - DNA, 25 bp, Mus musculus
tgtaaggaggacaacccagacttcg

SEQ ID NO: 824977 - DNA, 25 bp, Mus musculus
tgtaaggaggactacccagacttcg

SEQ ID NO: 824978 - DNA, 25 bp, Mus musculus
tgtaaggattccagatgggattagt

SEQ ID NO: 824979 - DNA, 25 bp, Mus musculus
tgtaaggattcctgatgggattagt

SEQ ID NO: 824980 - DNA, 25 bp, Mus musculus
tgtaagggacctaaaacgtcactgg

SEQ ID NO: 824981 - DNA, 25 bp, Mus musculus
tgtaagggaccttaaacgtcactgg

SEQ ID NO: 824982 - DNA, 25 bp, Mus musculus
tgtaagggccaaccttgtggacttt

SEQ ID NO: 824983 - DNA, 25 bp, Mus musculus
tgtaagggccaagcttgtggacttt

SEQ ID NO: 824984 - DNA, 25 bp, Mus musculus
tgtaaggtctccaattatatagggc

SEQ ID NO: 824985 - DNA, 25 bp, Mus musculus
tgtaaggtctcctattatatagggc

SEQ ID NO: 824986 - DNA, 25 bp, Mus musculus
tgtaaggtggcacgtctcggccaca

SEQ ID NO: 824987 - DNA, 25 bp, Mus musculus
tgtaaggtggcaggtctcggccaca

SEQ ID NO: 824988 - DNA, 25 bp, Mus musculus
tgtaaggtgtacagcgatccgcagc

SEQ ID NO: 824989 - DNA, 25 bp, Mus musculus
tgtaaggtgtactgcgatccgcagc

SEQ ID NO: 824990 - DNA, 25 bp, Mus musculus
tgtaagtaagtaacgctgaggtcgc

SEQ ID NO: 824991 - DNA, 25 bp, Mus musculus
tgtaagtaagtatcgctgaggtcgc

SEQ ID NO: 824992 - DNA, 25 bp, Mus musculus
tgtaagtacagcaagcaaactctta

SEQ ID NO: 824993 - DNA, 25 bp, Mus musculus
tgtaagtacagctagcaaactctta

SEQ ID NO: 824994 - DNA, 25 bp, Mus musculus
tgtaagtagaaaaatccatgacccc

SEQ ID NO: 824995 - DNA, 25 bp, Mus musculus
tgtaagtagaaatatccatgacccc

SEQ ID NO: 824996 - DNA, 25 bp, Mus musculus
tgtaagtgacacatgttctccctca

SEQ ID NO: 824997 - DNA, 25 bp, Mus musculus
tgtaagtgacacttgttctccctca

SEQ ID NO: 824998 - DNA, 25 bp, Mus musculus
tgtaagtggcgccatgcccgactcc

SEQ ID NO: 824999 - DNA, 25 bp, Mus musculus
tgtaagtggcgcgatgcccgactcc

SEQ ID NO: 825000 - DNA, 25 bp, Mus musculus
tgtaagttaaagatcctccatggag

SEQ ID NO: 825001 - DNA, 25 bp, Mus musculus
tgtaagttaaagttcctccatggag

SEQ ID NO: 825002 - DNA, 25 bp, Mus musculus
tgtaagttggagaaacacacacctg

SEQ ID NO: 825003 - DNA, 25 bp, Mus musculus
tgtaagttggagtaacacacacctg

SEQ ID NO: 825004 - DNA, 25 bp, Mus musculus
tgtaataaccacataccctaaatca

SEQ ID NO: 825005 - DNA, 25 bp, Mus musculus
tgtaataaccacttaccctaaatca

SEQ ID NO: 825006 - DNA, 25 bp, Mus musculus
tgtaatagaccaaatccgcccaggg

SEQ ID NO: 825007 - DNA, 25 bp, Mus musculus
tgtaatagaccatatccgcccaggg

SEQ ID NO: 825008 - DNA, 25 bp, Mus musculus
tgtaatagcccgatccttcaaagtg

SEQ ID NO: 825009 - DNA, 25 bp, Mus musculus
tgtaatagcccgttccttcaaagtg

SEQ ID NO: 825010 - DNA, 25 bp, Mus musculus
tgtaatagcgagaacagtcaggctg

SEQ ID NO: 825011 - DNA, 25 bp, Mus musculus
tgtaatagcgagtacagtcaggctg

SEQ ID NO: 825012 - DNA, 25 bp, Mus musculus
tgtaatagtaacaagcagacccagc

SEQ ID NO: 825013 - DNA, 25 bp, Mus musculus
tgtaatagtaactagcagacccagc

SEQ ID NO: 825014 - DNA, 25 bp, Mus musculus
tgtaatcaacagaaagattcaatcc

SEQ ID NO: 825015 - DNA, 25 bp, Mus musculus
tgtaatcaacagtaagattcaatcc

SEQ ID NO: 825016 - DNA, 25 bp, Mus musculus
tgtaatcaacccagctgaacagctc

SEQ ID NO: 825017 - DNA, 25 bp, Mus musculus
tgtaatcaaccctgctgaacagctc

SEQ ID NO: 825018 - DNA, 25 bp, Mus musculus
tgtaatcctaacatgcaggaggctg

SEQ ID NO: 825019 - DNA, 25 bp, Mus musculus
tgtaatcctaacttgcaggaggctg

SEQ ID NO: 825020 - DNA, 25 bp, Mus musculus
tgtaatcggaagaagccggccatcc

SEQ ID NO: 825021 - DNA, 25 bp, Mus musculus
tgtaatcggaagtagccggccatcc

SEQ ID NO: 825022 - DNA, 25 bp, Mus musculus
tgtaatcggattagcccagagccct

SEQ ID NO: 825023 - DNA, 25 bp, Mus musculus
tgtaatcggatttgcccagagccct

SEQ ID NO: 825024 - DNA, 25 bp, Mus musculus
tgtaatctacgtcaactggctcaac

SEQ ID NO: 825025 - DNA, 25 bp, Mus musculus
tgtaatctacgtgaactggctcaac

SEQ ID NO: 825026 - DNA, 25 bp, Mus musculus
tgtaatctgcctctcaaagtggtgt

SEQ ID NO: 825027 - DNA, 25 bp, Mus musculus
tgtaatctgcctgtcaaagtggtgt

SEQ ID NO: 825028 - DNA, 25 bp, Mus musculus
tgtaatcttcctattcttggcggcc

SEQ ID NO: 825029 - DNA, 25 bp, Mus musculus
tgtaatcttccttttcttggcggcc

SEQ ID NO: 825030 - DNA, 25 bp, Mus musculus
tgtaatgaccctcccaaatccagga

SEQ ID NO: 825031 - DNA, 25 bp, Mus musculus
tgtaatgaccctgccaaatccagga

SEQ ID NO: 825032 - DNA, 25 bp, Mus musculus
tgtaatgagcctagaaggtctgccc

SEQ ID NO: 825033 - DNA, 25 bp, Mus musculus
tgtaatgagccttgaaggtctgccc

SEQ ID NO: 825034 - DNA, 25 bp, Mus musculus
tgtaatgcaccacgtactggccctg

SEQ ID NO: 825035 - DNA, 25 bp, Mus musculus
tgtaatgcaccaggtactggccctg

SEQ ID NO: 825036 - DNA, 25 bp, Mus musculus
tgtaatgccaccaactccattggct

SEQ ID NO: 825037 - DNA, 25 bp, Mus musculus
tgtaatgccacctactccattggct

SEQ ID NO: 825038 - DNA, 25 bp, Mus musculus
tgtaatgcttcacacaaaatcatag

SEQ ID NO: 825039 - DNA, 25 bp, Mus musculus
tgtaatgcttcagacaaaatcatag

SEQ ID NO: 825040 - DNA, 25 bp, Mus musculus
tgtaatggaccacgaacatgcgtcc

SEQ ID NO: 825041 - DNA, 25 bp, Mus musculus
tgtaatggaccaggaacatgcgtcc

SEQ ID NO: 825042 - DNA, 25 bp, Mus musculus
tgtaatggcaaacgaggtcacttcc

SEQ ID NO: 825043 - DNA, 25 bp, Mus musculus
tgtaatggcaaaggaggtcacttcc

SEQ ID NO: 825044 - DNA, 25 bp, Mus musculus
tgtaatgggcaaagatgagagagaa

SEQ ID NO: 825045 - DNA, 25 bp, Mus musculus
tgtaatgggcaatgatgagagagaa

SEQ ID NO: 825046 - DNA, 25 bp, Mus musculus
tgtaatgtcaccaagtaagccaggc

SEQ ID NO: 825047 - DNA, 25 bp, Mus musculus
tgtaatgtcacctagtaagccaggc

SEQ ID NO: 825048 - DNA, 25 bp, Mus musculus
tgtaatgtgcacaagcatgagcccc

SEQ ID NO: 825049 - DNA, 25 bp, Mus musculus
tgtaatgtgcactagcatgagcccc

SEQ ID NO: 825050 - DNA, 25 bp, Mus musculus
tgtaatgttccccttcatgtgaccc

SEQ ID NO: 825051 - DNA, 25 bp, Mus musculus
tgtaatgttcccgttcatgtgaccc

SEQ ID NO: 825052 - DNA, 25 bp, Mus musculus
tgtaattaaatgaaccaaaatcgga

SEQ ID NO: 825053 - DNA, 25 bp, Mus musculus
tgtaattaaatgtaccaaaatcgga

SEQ ID NO: 825054 - DNA, 25 bp, Mus musculus
tgtaattcccagaacaaaagaccct

SEQ ID NO: 825055 - DNA, 25 bp, Mus musculus
tgtaattcccagtacaaaagaccct

SEQ ID NO: 825056 - DNA, 25 bp, Mus musculus
tgtaattctcgcctcgaccctataa

SEQ ID NO: 825057 - DNA, 25 bp, Mus musculus
tgtaattctcgcgtcgaccctataa

SEQ ID NO: 825058 - DNA, 25 bp, Mus musculus
tgtaattgaatcatatgagaagccc

SEQ ID NO: 825059 - DNA, 25 bp, Mus musculus
tgtaattgaatcttatgagaagccc

SEQ ID NO: 825060 - DNA, 25 bp, Mus musculus
tgtaattgccatcaaccaagacccc

SEQ ID NO: 825061 - DNA, 25 bp, Mus musculus
tgtaattgccatgaaccaagacccc

SEQ ID NO: 825062 - DNA, 25 bp, Mus musculus
tgtaattggagtatttcaagaagct

SEQ ID NO: 825063 - DNA, 25 bp, Mus musculus
tgtaattggagtttttcaagaagct

SEQ ID NO: 825064 - DNA, 25 bp, Mus musculus
tgtaattggcttagcttttggagcc

SEQ ID NO: 825065 - DNA, 25 bp, Mus musculus
tgtaattggctttgcttttggagcc

SEQ ID NO: 825066 - DNA, 25 bp, Mus musculus
tgtaattgttgccaccatcagtttt

SEQ ID NO: 825067 - DNA, 25 bp, Mus musculus
tgtaattgttgcgaccatcagtttt

SEQ ID NO: 825068 - DNA, 25 bp, Mus musculus
tgtaatttataaccgtgatgttggg

SEQ ID NO: 825069 - DNA, 25 bp, Mus musculus
tgtaatttataagcgtgatgttggg

SEQ ID NO: 825070 - DNA, 25 bp, Mus musculus
tgtacaaaatacaataaaggcactg

SEQ ID NO: 825071 - DNA, 25 bp, Mus musculus
tgtacaaaatacctatgggcaagtg

SEQ ID NO: 825072 - DNA, 25 bp, Mus musculus
tgtacaaaatacgtatgggcaagtg

SEQ ID NO: 825073 - DNA, 25 bp, Mus musculus
tgtacaaaatactataaaggcactg

SEQ ID NO: 825074 - DNA, 25 bp, Mus musculus
tgtacaaaatgtcttactaccgctt

SEQ ID NO: 825075 - DNA, 25 bp, Mus musculus
tgtacaaaatgtgttactaccgctt

SEQ ID NO: 825076 - DNA, 25 bp, Mus musculus
tgtacaaagagactgtctactctgc

SEQ ID NO: 825077 - DNA, 25 bp, Mus musculus
tgtacaaagagagtgtctactctgc

SEQ ID NO: 825078 - DNA, 25 bp, Mus musculus
tgtacaaattgaagctaggagagat

SEQ ID NO: 825079 - DNA, 25 bp, Mus musculus
tgtacaaattgatgctaggagagat

SEQ ID NO: 825080 - DNA, 25 bp, Mus musculus
tgtacaaccctaacaagatcttcgg

SEQ ID NO: 825081 - DNA, 25 bp, Mus musculus
tgtacaaccctatcaagatcttcgg

SEQ ID NO: 825082 - DNA, 25 bp, Mus musculus
tgtacaacctgaccttacagcgggc

SEQ ID NO: 825083 - DNA, 25 bp, Mus musculus
tgtacaacctgagcttacagcgggc

SEQ ID NO: 825084 - DNA, 25 bp, Mus musculus
tgtacaacctggaaactacattcta

SEQ ID NO: 825085 - DNA, 25 bp, Mus musculus
tgtacaacctggtaactacattcta

SEQ ID NO: 825086 - DNA, 25 bp, Mus musculus
tgtacaacggctaggctccaaaacg

SEQ ID NO: 825087 - DNA, 25 bp, Mus musculus
tgtacaacggcttggctccaaaacg

SEQ ID NO: 825088 - DNA, 25 bp, Mus musculus
tgtacaacgtcaccgagagcaacgc

SEQ ID NO: 825089 - DNA, 25 bp, Mus musculus
tgtacaacgtcagcgagagcaacgc

SEQ ID NO: 825090 - DNA, 25 bp, Mus musculus
tgtacaacttgcaaacagccattca

SEQ ID NO: 825091 - DNA, 25 bp, Mus musculus
tgtacaacttgctaacagccattca

SEQ ID NO: 825092 - DNA, 25 bp, Mus musculus
tgtacaagaccaatacaccctgctg

SEQ ID NO: 825093 - DNA, 25 bp, Mus musculus
tgtacaagaccattacaccctgctg

SEQ ID NO: 825094 - DNA, 25 bp, Mus musculus
tgtacaagatcacactaccggactt

SEQ ID NO: 825095 - DNA, 25 bp, Mus musculus
tgtacaagatcagactaccggactt

SEQ ID NO: 825096 - DNA, 25 bp, Mus musculus
tgtacaagcagaagggtgtattccc

SEQ ID NO: 825097 - DNA, 25 bp, Mus musculus
tgtacaagcagatgggtgtattccc

SEQ ID NO: 825098 - DNA, 25 bp, Mus musculus
tgtacaagcattccaataacaaggc

SEQ ID NO: 825099 - DNA, 25 bp, Mus musculus
tgtacaagcattgcaataacaaggc

SEQ ID NO: 825100 - DNA, 25 bp, Mus musculus
tgtacaaggacgcaggcgtcgccat

SEQ ID NO: 825101 - DNA, 25 bp, Mus musculus
tgtacaaggacggaggcgtcgccat

SEQ ID NO: 825102 - DNA, 25 bp, Mus musculus
tgtacaaggaggctcagttctatcc

SEQ ID NO: 825103 - DNA, 25 bp, Mus musculus
tgtacaaggagggtcagttctatcc

SEQ ID NO: 825104 - DNA, 25 bp, Mus musculus
tgtacaaggcctccatcaagtaccc

SEQ ID NO: 825105 - DNA, 25 bp, Mus musculus
tgtacaaggcctgcatcaagtaccc

SEQ ID NO: 825106 - DNA, 25 bp, Mus musculus
tgtacaagtcaccaagccagaagga

SEQ ID NO: 825107 - DNA, 25 bp, Mus musculus
tgtacaagtcacgaagccagaagga

SEQ ID NO: 825108 - DNA, 25 bp, Mus musculus
tgtacaagtttgagtgcgagccgga

SEQ ID NO: 825109 - DNA, 25 bp, Mus musculus
tgtacaagtttgtgtgcgagccgga

SEQ ID NO: 825110 - DNA, 25 bp, Mus musculus
tgtacaataaatacatccgccgggc

SEQ ID NO: 825111 - DNA, 25 bp, Mus musculus
tgtacaataaattcatccgccgggc

SEQ ID NO: 825112 - DNA, 25 bp, Mus musculus
tgtacaatcgaaatccaggcagcgt

SEQ ID NO: 825113 - DNA, 25 bp, Mus musculus
tgtacaatcgaattccaggcagcgt

SEQ ID NO: 825114 - DNA, 25 bp, Mus musculus
tgtacaatctacagctcagccctga

SEQ ID NO: 825115 - DNA, 25 bp, Mus musculus
tgtacaatctactgctcagccctga

SEQ ID NO: 825116 - DNA, 25 bp, Mus musculus
tgtacaatggctccgccgtgcaggt

SEQ ID NO: 825117 - DNA, 25 bp, Mus musculus
tgtacaatggctgcgccgtgcaggt

SEQ ID NO: 825118 - DNA, 25 bp, Mus musculus
tgtacaatgtacacactggtactta

SEQ ID NO: 825119 - DNA, 25 bp, Mus musculus
tgtacaatgtactcactggtactta

SEQ ID NO: 825120 - DNA, 25 bp, Mus musculus
tgtacaattcgtcaggcagctgagg

SEQ ID NO: 825121 - DNA, 25 bp, Mus musculus
tgtacaattcgtgaggcagctgagg

SEQ ID NO: 825122 - DNA, 25 bp, Mus musculus
tgtacacaagaaagaaaagccagct

SEQ ID NO: 825123 - DNA, 25 bp, Mus musculus
tgtacacaagaatgaaaagccagct

SEQ ID NO: 825124 - DNA, 25 bp, Mus musculus
tgtacacaatagcatccagatttgg

SEQ ID NO: 825125 - DNA, 25 bp, Mus musculus
tgtacacaataggatccagatttgg

SEQ ID NO: 825126 - DNA, 25 bp, Mus musculus
tgtacacagaagcagtggcggatct

SEQ ID NO: 825127 - DNA, 25 bp, Mus musculus
tgtacacagaaggagtggcggatct

SEQ ID NO: 825128 - DNA, 25 bp, Mus musculus
tgtacacagaatctagaataagtcc

SEQ ID NO: 825129 - DNA, 25 bp, Mus musculus
tgtacacagaatgtagaataagtcc

SEQ ID NO: 825130 - DNA, 25 bp, Mus musculus
tgtacacagagccttacatgggtct

SEQ ID NO: 825131 - DNA, 25 bp, Mus musculus
tgtacacagagcgttacatgggtct

SEQ ID NO: 825132 - DNA, 25 bp, Mus musculus
tgtacacaggcaagaccgtgctggg

SEQ ID NO: 825133 - DNA, 25 bp, Mus musculus
tgtacacaggcatgaccgtgctggg

SEQ ID NO: 825134 - DNA, 25 bp, Mus musculus
tgtacacagtgacctgataaggctg

SEQ ID NO: 825135 - DNA, 25 bp, Mus musculus
tgtacacagtgagctgataaggctg

SEQ ID NO: 825136 - DNA, 25 bp, Mus musculus
tgtacacattccagctaggcattat

SEQ ID NO: 825137 - DNA, 25 bp, Mus musculus
tgtacacattcctgctaggcattat

SEQ ID NO: 825138 - DNA, 25 bp, Mus musculus
tgtacaccatcaagaatcccatcgg

SEQ ID NO: 825139 - DNA, 25 bp, Mus musculus
tgtacaccatcatgaatcccatcgg

SEQ ID NO: 825140 - DNA, 25 bp, Mus musculus
tgtacacccgccacatggcaagtcg

SEQ ID NO: 825141 - DNA, 25 bp, Mus musculus
tgtacacccgcctcatggcaagtcg

SEQ ID NO: 825142 - DNA, 25 bp, Mus musculus
tgtacaccgagtcctactgtggcct

SEQ ID NO: 825143 - DNA, 25 bp, Mus musculus
tgtacaccgagtgctactgtggcct

SEQ ID NO: 825144 - DNA, 25 bp, Mus musculus
tgtacaccggagagctgtaccccac

SEQ ID NO: 825145 - DNA, 25 bp, Mus musculus
tgtacaccggagtgctgtaccccac

SEQ ID NO: 825146 - DNA, 25 bp, Mus musculus
tgtacaccgtcaccgacgtgccgga

SEQ ID NO: 825147 - DNA, 25 bp, Mus musculus
tgtacaccgtcagcgacgtgccgga

SEQ ID NO: 825148 - DNA, 25 bp, Mus musculus
tgtacaccttatctggagcaggaga

SEQ ID NO: 825149 - DNA, 25 bp, Mus musculus
tgtacaccttatgtggagcaggaga

SEQ ID NO: 825150 - DNA, 25 bp, Mus musculus
tgtacacgagccatctcgcctgctg

SEQ ID NO: 825151 - DNA, 25 bp, Mus musculus
tgtacacgagccttctcgcctgctg

SEQ ID NO: 825152 - DNA, 25 bp, Mus musculus
tgtacacgaggaaggagagcgccaa

SEQ ID NO: 825153 - DNA, 25 bp, Mus musculus
tgtacacgaggatggagagcgccaa

SEQ ID NO: 825154 - DNA, 25 bp, Mus musculus
tgtacactaccactgacgggcaaac

SEQ ID NO: 825155 - DNA, 25 bp, Mus musculus
tgtacactaccagtgacgggcaaac

SEQ ID NO: 825156 - DNA, 25 bp, Mus musculus
tgtacactcgggaacaggctctctt

SEQ ID NO: 825157 - DNA, 25 bp, Mus musculus
tgtacactcgggtacaggctctctt

SEQ ID NO: 825158 - DNA, 25 bp, Mus musculus
tgtacagaaacactctgaaagaatc

SEQ ID NO: 825159 - DNA, 25 bp, Mus musculus
tgtacagaaacagtctgaaagaatc

SEQ ID NO: 825160 - DNA, 25 bp, Mus musculus
tgtacagaaatcacgctcaaggaag

SEQ ID NO: 825161 - DNA, 25 bp, Mus musculus
tgtacagaaatctcgctcaaggaag

SEQ ID NO: 825162 - DNA, 25 bp, Mus musculus
tgtacagaagagagggcatgatgcc

SEQ ID NO: 825163 - DNA, 25 bp, Mus musculus
tgtacagaagagtgggcatgatgcc

SEQ ID NO: 825164 - DNA, 25 bp, Mus musculus
tgtacagaagcaatccgggagctct

SEQ ID NO: 825165 - DNA, 25 bp, Mus musculus
tgtacagaagcattccgggagctct

SEQ ID NO: 825166 - DNA, 25 bp, Mus musculus
tgtacagaaggcaatggatgaaaga

SEQ ID NO: 825167 - DNA, 25 bp, Mus musculus
tgtacagaaggctatggatgaaaga

SEQ ID NO: 825168 - DNA, 25 bp, Mus musculus
tgtacagacctgagcagtgggccct

SEQ ID NO: 825169 - DNA, 25 bp, Mus musculus
tgtacagacctgtgcagtgggccct

SEQ ID NO: 825170 - DNA, 25 bp, Mus musculus
tgtacagacggacatcaaacatggt

SEQ ID NO: 825171 - DNA, 25 bp, Mus musculus
tgtacagacggagatcaaacatggt

SEQ ID NO: 825172 - DNA, 25 bp, Mus musculus
tgtacagactccagtgaatatttgt

SEQ ID NO: 825173 - DNA, 25 bp, Mus musculus
tgtacagactcctgtgaatatttgt

SEQ ID NO: 825174 - DNA, 25 bp, Mus musculus
tgtacagagaacctggtgtggacca

SEQ ID NO: 825175 - DNA, 25 bp, Mus musculus
tgtacagagaacgtggtgtggacca

SEQ ID NO: 825176 - DNA, 25 bp, Mus musculus
tgtacagagaatcgctggtcccctc

SEQ ID NO: 825177 - DNA, 25 bp, Mus musculus
tgtacagagaatggctggtcccctc

SEQ ID NO: 825178 - DNA, 25 bp, Mus musculus
tgtacagagctgcagctagtcaaat

SEQ ID NO: 825179 - DNA, 25 bp, Mus musculus
tgtacagagctggagctagtcaaat

SEQ ID NO: 825180 - DNA, 25 bp, Mus musculus
tgtacagcacgcagcagggcggcct

SEQ ID NO: 825181 - DNA, 25 bp, Mus musculus
tgtacagcacgctgcagggcggcct

SEQ ID NO: 825182 - DNA, 25 bp, Mus musculus
tgtacagcactaaccccaggatgca

SEQ ID NO: 825183 - DNA, 25 bp, Mus musculus
tgtacagcactatccccaggatgca

SEQ ID NO: 825184 - DNA, 25 bp, Mus musculus
tgtacagcagtgaggcctaagggct

SEQ ID NO: 825185 - DNA, 25 bp, Mus musculus
tgtacagcagtgtggcctaagggct

SEQ ID NO: 825186 - DNA, 25 bp, Mus musculus
tgtacagcatgaacgatgtgcgccg

SEQ ID NO: 825187 - DNA, 25 bp, Mus musculus
tgtacagcatgatcgatgtgcgccg

SEQ ID NO: 825188 - DNA, 25 bp, Mus musculus
tgtacagcgtagaccctgccacttt

SEQ ID NO: 825189 - DNA, 25 bp, Mus musculus
tgtacagcgtagtccctgccacttt

SEQ ID NO: 825190 - DNA, 25 bp, Mus musculus
tgtacagcgtcaaataggctttgcc

SEQ ID NO: 825191 - DNA, 25 bp, Mus musculus
tgtacagcgtcatataggctttgcc

SEQ ID NO: 825192 - DNA, 25 bp, Mus musculus
tgtacagctgacagcactacaggtc

SEQ ID NO: 825193 - DNA, 25 bp, Mus musculus
tgtacagctgactgcactacaggtc

SEQ ID NO: 825194 - DNA, 25 bp, Mus musculus
tgtacagctgccagcctttcctgtt

SEQ ID NO: 825195 - DNA, 25 bp, Mus musculus
tgtacagctgcctgcctttcctgtt

SEQ ID NO: 825196 - DNA, 25 bp, Mus musculus
tgtacagctgggaccagcgggagaa

SEQ ID NO: 825197 - DNA, 25 bp, Mus musculus
tgtacagctgggtccagcgggagaa

SEQ ID NO: 825198 - DNA, 25 bp, Mus musculus
tgtacagctgtccaaaatcatccca

SEQ ID NO: 825199 - DNA, 25 bp, Mus musculus
tgtacagctgtcgaaaatcatccca

SEQ ID NO: 825200 - DNA, 25 bp, Mus musculus
tgtacaggcacccactataagagtg

SEQ ID NO: 825201 - DNA, 25 bp, Mus musculus
tgtacaggcaccgactataagagtg

SEQ ID NO: 825202 - DNA, 25 bp, Mus musculus
tgtacaggcctaagtacagggcaga

SEQ ID NO: 825203 - DNA, 25 bp, Mus musculus
tgtacaggcctatgtacagggcaga

SEQ ID NO: 825204 - DNA, 25 bp, Mus musculus
tgtacaggcggacattgacagagtt

SEQ ID NO: 825205 - DNA, 25 bp, Mus musculus
tgtacaggcggagattgacagagtt

SEQ ID NO: 825206 - DNA, 25 bp, Mus musculus
tgtacagggtgaaccaggtgtcaga

SEQ ID NO: 825207 - DNA, 25 bp, Mus musculus
tgtacagggtgatccaggtgtcaga

SEQ ID NO: 825208 - DNA, 25 bp, Mus musculus
tgtacaggtcctagcccataagtgc

SEQ ID NO: 825209 - DNA, 25 bp, Mus musculus
tgtacaggtccttgcccataagtgc

SEQ ID NO: 825210 - DNA, 25 bp, Mus musculus
tgtacaggtggtaattacagaccct

SEQ ID NO: 825211 - DNA, 25 bp, Mus musculus
tgtacaggtggttattacagaccct

SEQ ID NO: 825212 - DNA, 25 bp, Mus musculus
tgtacagtagcacgctgtaactgag

SEQ ID NO: 825213 - DNA, 25 bp, Mus musculus
tgtacagtagcaggctgtaactgag

SEQ ID NO: 825214 - DNA, 25 bp, Mus musculus
tgtacagtctgtaccgagagcctga

SEQ ID NO: 825215 - DNA, 25 bp, Mus musculus
tgtacagtctgttccgagagcctga

SEQ ID NO: 825216 - DNA, 25 bp, Mus musculus
tgtacagtcttcagcgtgaccagga

SEQ ID NO: 825217 - DNA, 25 bp, Mus musculus
tgtacagtcttctgcgtgaccagga

SEQ ID NO: 825218 - DNA, 25 bp, Mus musculus
tgtacagtgagcaccttgaaggtga

SEQ ID NO: 825219 - DNA, 25 bp, Mus musculus
tgtacagtgagctccttgaaggtga

SEQ ID NO: 825220 - DNA, 25 bp, Mus musculus
tgtacagtgggcaacctcgggcaga

SEQ ID NO: 825221 - DNA, 25 bp, Mus musculus
tgtacagtgggctacctcgggcaga

SEQ ID NO: 825222 - DNA, 25 bp, Mus musculus
tgtacagttcatcctgaacaatcac

SEQ ID NO: 825223 - DNA, 25 bp, Mus musculus
tgtacagttcatgctgaacaatcac

SEQ ID NO: 825224 - DNA, 25 bp, Mus musculus
tgtacagttcctcgcagtccctgag

SEQ ID NO: 825225 - DNA, 25 bp, Mus musculus
tgtacagttcctggcagtccctgag

SEQ ID NO: 825226 - DNA, 25 bp, Mus musculus
tgtacagttggcactcacacatcag

SEQ ID NO: 825227 - DNA, 25 bp, Mus musculus
tgtacagttggctctcacacatcag

SEQ ID NO: 825228 - DNA, 25 bp, Mus musculus
tgtacagttgttacccagcagccag

SEQ ID NO: 825229 - DNA, 25 bp, Mus musculus
tgtacagttgtttcccagcagccag

SEQ ID NO: 825230 - DNA, 25 bp, Mus musculus
tgtacataagccaaagatctggacc

SEQ ID NO: 825231 - DNA, 25 bp, Mus musculus
tgtacataagcctaagatctggacc

SEQ ID NO: 825232 - DNA, 25 bp, Mus musculus
tgtacatagccaagccagacatctc

SEQ ID NO: 825233 - DNA, 25 bp, Mus musculus
tgtacatagccaccggaacagtcgt

SEQ ID NO: 825234 - DNA, 25 bp, Mus musculus
tgtacatagccagcggaacagtcgt

SEQ ID NO: 825235 - DNA, 25 bp, Mus musculus
tgtacatagccatgccagacatctc

SEQ ID NO: 825236 - DNA, 25 bp, Mus musculus
tgtacatatctgattcagacaagag

SEQ ID NO: 825237 - DNA, 25 bp, Mus musculus
tgtacatatctgtttcagacaagag

SEQ ID NO: 825238 - DNA, 25 bp, Mus musculus
tgtacatcaatcataactgaagatg

SEQ ID NO: 825239 - DNA, 25 bp, Mus musculus
tgtacatcaatcttaactgaagatg

SEQ ID NO: 825240 - DNA, 25 bp, Mus musculus
tgtacatcacatcaaggcctgacag

SEQ ID NO: 825241 - DNA, 25 bp, Mus musculus
tgtacatcacatcactctttcaagt

SEQ ID NO: 825242 - DNA, 25 bp, Mus musculus
tgtacatcacatgaaggcctgacag

SEQ ID NO: 825243 - DNA, 25 bp, Mus musculus
tgtacatcacatgactctttcaagt

SEQ ID NO: 825244 - DNA, 25 bp, Mus musculus
tgtacatcctctcttctatttctga

SEQ ID NO: 825245 - DNA, 25 bp, Mus musculus
tgtacatcctctgttctatttctga

SEQ ID NO: 825246 - DNA, 25 bp, Mus musculus
tgtacatcggagacatccaggccag

SEQ ID NO: 825247 - DNA, 25 bp, Mus musculus
tgtacatcggagtcatccaggccag

SEQ ID NO: 825248 - DNA, 25 bp, Mus musculus
tgtacatcgggcacatccttctcaa

SEQ ID NO: 825249 - DNA, 25 bp, Mus musculus
tgtacatcgggctcatccttctcaa

SEQ ID NO: 825250 - DNA, 25 bp, Mus musculus
tgtacatcttccctgtccactggca

SEQ ID NO: 825251 - DNA, 25 bp, Mus musculus
tgtacatcttccgtgtccactggca

SEQ ID NO: 825252 - DNA, 25 bp, Mus musculus
tgtacatgaacacgcacccgggtcg

SEQ ID NO: 825253 - DNA, 25 bp, Mus musculus
tgtacatgaacaggcacccgggtcg

SEQ ID NO: 825254 - DNA, 25 bp, Mus musculus
tgtacatgctctactttctgcagcg

SEQ ID NO: 825255 - DNA, 25 bp, Mus musculus
tgtacatgctcttctttctgcagcg

SEQ ID NO: 825256 - DNA, 25 bp, Mus musculus
tgtacatggaaaccaaggcacaagc

SEQ ID NO: 825257 - DNA, 25 bp, Mus musculus
tgtacatggaaagcaaggcacaagc

SEQ ID NO: 825258 - DNA, 25 bp, Mus musculus
tgtacatgggctatgacacagtggt

SEQ ID NO: 825259 - DNA, 25 bp, Mus musculus
tgtacatgggctttgacacagtggt

SEQ ID NO: 825260 - DNA, 25 bp, Mus musculus
tgtacatggtgcaagacgagcagct

SEQ ID NO: 825261 - DNA, 25 bp, Mus musculus
tgtacatggtgctagacgagcagct

SEQ ID NO: 825262 - DNA, 25 bp, Mus musculus
tgtacatgtagtcgctgcagaggcc

SEQ ID NO: 825263 - DNA, 25 bp, Mus musculus
tgtacatgtagtggctgcagaggcc

SEQ ID NO: 825264 - DNA, 25 bp, Mus musculus
tgtacatgtcccagtttatccgtag

SEQ ID NO: 825265 - DNA, 25 bp, Mus musculus
tgtacatgtccctgtttatccgtag

SEQ ID NO: 825266 - DNA, 25 bp, Mus musculus
tgtacatgtgcaagccagccttcgt

SEQ ID NO: 825267 - DNA, 25 bp, Mus musculus
tgtacatgtgcatgccagccttcgt

SEQ ID NO: 825268 - DNA, 25 bp, Mus musculus
tgtacatgttccacgcgggattccg

SEQ ID NO: 825269 - DNA, 25 bp, Mus musculus
tgtacatgttcctcgcgggattccg

SEQ ID NO: 825270 - DNA, 25 bp, Mus musculus
tgtacatgttggaagccgtagcaca

SEQ ID NO: 825271 - DNA, 25 bp, Mus musculus
tgtacatgttggtagccgtagcaca

SEQ ID NO: 825272 - DNA, 25 bp, Mus musculus
tgtacattcaacattggatcctggg

SEQ ID NO: 825273 - DNA, 25 bp, Mus musculus
tgtacattcaactttggatcctggg

SEQ ID NO: 825274 - DNA, 25 bp, Mus musculus
tgtacattcttacaaagcacctact

SEQ ID NO: 825275 - DNA, 25 bp, Mus musculus
tgtacattcttagaaagcacctact

SEQ ID NO: 825276 - DNA, 25 bp, Mus musculus
tgtacattggagaggtgtctcccac

SEQ ID NO: 825277 - DNA, 25 bp, Mus musculus
tgtacattggagtggtgtctcccac

SEQ ID NO: 825278 - DNA, 25 bp, Mus musculus
tgtacattggccctgcttgtgggct

SEQ ID NO: 825279 - DNA, 25 bp, Mus musculus
tgtacattggccgtgcttgtgggct

SEQ ID NO: 825280 - DNA, 25 bp, Mus musculus
tgtaccaaatcccaggccagctgtt

SEQ ID NO: 825281 - DNA, 25 bp, Mus musculus
tgtaccaaatccgaggccagctgtt

SEQ ID NO: 825282 - DNA, 25 bp, Mus musculus
tgtaccaacatcaaccagagtctct

SEQ ID NO: 825283 - DNA, 25 bp, Mus musculus
tgtaccaacatctaccagagtctct

SEQ ID NO: 825284 - DNA, 25 bp, Mus musculus
tgtaccaacctgacaaagatgatgc

SEQ ID NO: 825285 - DNA, 25 bp, Mus musculus
tgtaccaacctgtcaaagatgatgc

SEQ ID NO: 825286 - DNA, 25 bp, Mus musculus
tgtaccaacttcctatgcggcaccg

SEQ ID NO: 825287 - DNA, 25 bp, Mus musculus
tgtaccaacttcgtatgcggcaccg

SEQ ID NO: 825288 - DNA, 25 bp, Mus musculus
tgtaccaagaccagcagcccgttgg

SEQ ID NO: 825289 - DNA, 25 bp, Mus musculus
tgtaccaagacctgcagcccgttgg

SEQ ID NO: 825290 - DNA, 25 bp, Mus musculus
tgtaccacacaaatcctgagggcca

SEQ ID NO: 825291 - DNA, 25 bp, Mus musculus
tgtaccacacaattcctgagggcca

SEQ ID NO: 825292 - DNA, 25 bp, Mus musculus
tgtaccacctataatgattccaatt

SEQ ID NO: 825293 - DNA, 25 bp, Mus musculus
tgtaccacctattatgattccaatt

SEQ ID NO: 825294 - DNA, 25 bp, Mus musculus
tgtaccacctcacgatcagtgccga

SEQ ID NO: 825295 - DNA, 25 bp, Mus musculus
tgtaccacctcaggatcagtgccga

SEQ ID NO: 825296 - DNA, 25 bp, Mus musculus
tgtaccactaccataggtcagtccg

SEQ ID NO: 825297 - DNA, 25 bp, Mus musculus
tgtaccactaccttaggtcagtccg

SEQ ID NO: 825298 - DNA, 25 bp, Mus musculus
tgtaccactcctctgctcaagctga

SEQ ID NO: 825299 - DNA, 25 bp, Mus musculus
tgtaccactcctgtgctcaagctga

SEQ ID NO: 825300 - DNA, 25 bp, Mus musculus
tgtaccacttctaccggactcagaa

SEQ ID NO: 825301 - DNA, 25 bp, Mus musculus
tgtaccacttcttccggactcagaa

SEQ ID NO: 825302 - DNA, 25 bp, Mus musculus
tgtaccactttgcagagaaagccaa

SEQ ID NO: 825303 - DNA, 25 bp, Mus musculus
tgtaccactttggagagaaagccaa

SEQ ID NO: 825304 - DNA, 25 bp, Mus musculus
tgtaccagagagagttataaagacc

SEQ ID NO: 825305 - DNA, 25 bp, Mus musculus
tgtaccagagagtgttataaagacc

SEQ ID NO: 825306 - DNA, 25 bp, Mus musculus
tgtaccagagcccaaagaaccgtct

SEQ ID NO: 825307 - DNA, 25 bp, Mus musculus
tgtaccagagccgaaagaaccgtct

SEQ ID NO: 825308 - DNA, 25 bp, Mus musculus
tgtaccagctcaccaagggctctgc

SEQ ID NO: 825309 - DNA, 25 bp, Mus musculus
tgtaccagctcagcaagggctctgc

SEQ ID NO: 825310 - DNA, 25 bp, Mus musculus
tgtaccagctctcactgcagcgaga

SEQ ID NO: 825311 - DNA, 25 bp, Mus musculus
tgtaccagctctgactgcagcgaga

SEQ ID NO: 825312 - DNA, 25 bp, Mus musculus
tgtaccaggaataacagaaggttct

SEQ ID NO: 825313 - DNA, 25 bp, Mus musculus
tgtaccaggaattacagaaggttct

SEQ ID NO: 825314 - DNA, 25 bp, Mus musculus
tgtaccaggagactctcggactgag

SEQ ID NO: 825315 - DNA, 25 bp, Mus musculus
tgtaccaggagagtctcggactgag

SEQ ID NO: 825316 - DNA, 25 bp, Mus musculus
tgtaccagtgtaagccttttcaatg

SEQ ID NO: 825317 - DNA, 25 bp, Mus musculus
tgtaccagtgtatgccttttcaatg

SEQ ID NO: 825318 - DNA, 25 bp, Mus musculus
tgtaccataattaaacgatgcccca

SEQ ID NO: 825319 - DNA, 25 bp, Mus musculus
tgtaccataatttaacgatgcccca

SEQ ID NO: 825320 - DNA, 25 bp, Mus musculus
tgtaccatattactcataagcccgg

SEQ ID NO: 825321 - DNA, 25 bp, Mus musculus
tgtaccatattagtcataagcccgg

SEQ ID NO: 825322 - DNA, 25 bp, Mus musculus
tgtaccatcatcctccgtggtggcg

SEQ ID NO: 825323 - DNA, 25 bp, Mus musculus
tgtaccatcatcgtccgtggtggcg

SEQ ID NO: 825324 - DNA, 25 bp, Mus musculus
tgtaccatgcagcagctaattggct

SEQ ID NO: 825325 - DNA, 25 bp, Mus musculus
tgtaccatgcaggagctaattggct

SEQ ID NO: 825326 - DNA, 25 bp, Mus musculus
tgtaccatggcaaccaagactatga

SEQ ID NO: 825327 - DNA, 25 bp, Mus musculus
tgtaccatggcatccaagactatga

SEQ ID NO: 825328 - DNA, 25 bp, Mus musculus
tgtaccatgtcaatgaaaagccgtc

SEQ ID NO: 825329 - DNA, 25 bp, Mus musculus
tgtaccatgtcattgaaaagccgtc

SEQ ID NO: 825330 - DNA, 25 bp, Mus musculus
tgtaccatgtgaacaaaaagcggag

SEQ ID NO: 825331 - DNA, 25 bp, Mus musculus
tgtaccatgtgatcaaaaagcggag

SEQ ID NO: 825332 - DNA, 25 bp, Mus musculus
tgtaccattgaaacattggtctgct

SEQ ID NO: 825333 - DNA, 25 bp, Mus musculus
tgtaccattgaatcattggtctgct

SEQ ID NO: 825334 - DNA, 25 bp, Mus musculus
tgtacccaccaaatccatggcgaga

SEQ ID NO: 825335 - DNA, 25 bp, Mus musculus
tgtacccaccaattccatggcgaga

SEQ ID NO: 825336 - DNA, 25 bp, Mus musculus
tgtacccaccctcggacaagaactt

SEQ ID NO: 825337 - DNA, 25 bp, Mus musculus
tgtacccaccctgggacaagaactt

SEQ ID NO: 825338 - DNA, 25 bp, Mus musculus
tgtacccaccttccgtggaacaggc

SEQ ID NO: 825339 - DNA, 25 bp, Mus musculus
tgtacccaccttgcgtggaacaggc

SEQ ID NO: 825340 - DNA, 25 bp, Mus musculus
tgtacccacggcagtctttctgaag

SEQ ID NO: 825341 - DNA, 25 bp, Mus musculus
tgtacccacggctgtctttctgaag

SEQ ID NO: 825342 - DNA, 25 bp, Mus musculus
tgtacccagaataagaagtgtctct

SEQ ID NO: 825343 - DNA, 25 bp, Mus musculus
tgtacccagaattagaagtgtctct

SEQ ID NO: 825344 - DNA, 25 bp, Mus musculus
tgtacccagcctcactatgaggcca

SEQ ID NO: 825345 - DNA, 25 bp, Mus musculus
tgtacccagcctgactatgaggcca

SEQ ID NO: 825346 - DNA, 25 bp, Mus musculus
tgtacccagctgaacaccagagtgg

SEQ ID NO: 825347 - DNA, 25 bp, Mus musculus
tgtacccagctgtacaccagagtgg

SEQ ID NO: 825348 - DNA, 25 bp, Mus musculus
tgtacccatgtccaagatcgctgac

SEQ ID NO: 825349 - DNA, 25 bp, Mus musculus
tgtacccatgtcgaagatcgctgac

SEQ ID NO: 825350 - DNA, 25 bp, Mus musculus
tgtaccccggtaactccctgaagca

SEQ ID NO: 825351 - DNA, 25 bp, Mus musculus
tgtaccccggtatctccctgaagca

SEQ ID NO: 825352 - DNA, 25 bp, Mus musculus
tgtacccgacttccctgtgctgctg

SEQ ID NO: 825353 - DNA, 25 bp, Mus musculus
tgtacccgacttgcctgtgctgctg

SEQ ID NO: 825354 - DNA, 25 bp, Mus musculus
tgtacccggcagacagcactgacgt

SEQ ID NO: 825355 - DNA, 25 bp, Mus musculus
tgtacccggcagtcagcactgacgt

SEQ ID NO: 825356 - DNA, 25 bp, Mus musculus
tgtacccgtggtctgtgattcaagc

SEQ ID NO: 825357 - DNA, 25 bp, Mus musculus
tgtacccgtggtgtgtgattcaagc

SEQ ID NO: 825358 - DNA, 25 bp, Mus musculus
tgtaccctataaaatcctgacaccc

SEQ ID NO: 825359 - DNA, 25 bp, Mus musculus
tgtaccctataatatcctgacaccc

SEQ ID NO: 825360 - DNA, 25 bp, Mus musculus
tgtaccctgagcactaccgcaagta

SEQ ID NO: 825361 - DNA, 25 bp, Mus musculus
tgtaccctgagctctaccgcaagta

SEQ ID NO: 825362 - DNA, 25 bp, Mus musculus
tgtaccctggacaatggccgtctgc

SEQ ID NO: 825363 - DNA, 25 bp, Mus musculus
tgtaccctggactatggccgtctgc

SEQ ID NO: 825364 - DNA, 25 bp, Mus musculus
tgtaccctttccaggaacatattgg

SEQ ID NO: 825365 - DNA, 25 bp, Mus musculus
tgtaccctttcctggaacatattgg

SEQ ID NO: 825366 - DNA, 25 bp, Mus musculus
tgtaccgaacaacgcttcctcaaga

SEQ ID NO: 825367 - DNA, 25 bp, Mus musculus
tgtaccgaacaaggcttcctcaaga

SEQ ID NO: 825368 - DNA, 25 bp, Mus musculus
tgtaccgagaaccatccttgcatga

SEQ ID NO: 825369 - DNA, 25 bp, Mus musculus
tgtaccgagaacgatccttgcatga

SEQ ID NO: 825370 - DNA, 25 bp, Mus musculus
tgtaccgaggctacagtaagatgcc

SEQ ID NO: 825371 - DNA, 25 bp, Mus musculus
tgtaccgaggctataaaagcacagt

SEQ ID NO: 825372 - DNA, 25 bp, Mus musculus
tgtaccgaggcttcagtaagatgcc

SEQ ID NO: 825373 - DNA, 25 bp, Mus musculus
tgtaccgaggctttaaaagcacagt

SEQ ID NO: 825374 - DNA, 25 bp, Mus musculus
tgtaccgcaagacgagctatcccca

SEQ ID NO: 825375 - DNA, 25 bp, Mus musculus
tgtaccgcaagaggagctatcccca

SEQ ID NO: 825376 - DNA, 25 bp, Mus musculus
tgtaccgcatccagtttaacgagag

SEQ ID NO: 825377 - DNA, 25 bp, Mus musculus
tgtaccgcatcctgtttaacgagag

SEQ ID NO: 825378 - DNA, 25 bp, Mus musculus
tgtaccgccagtattccgagggctg

SEQ ID NO: 825379 - DNA, 25 bp, Mus musculus
tgtaccgccagttttccgagggctg

SEQ ID NO: 825380 - DNA, 25 bp, Mus musculus
tgtaccgccgacactcagaagttct

SEQ ID NO: 825381 - DNA, 25 bp, Mus musculus
tgtaccgccgactctcagaagttct

SEQ ID NO: 825382 - DNA, 25 bp, Mus musculus
tgtaccgccgctctaagctggagga

SEQ ID NO: 825383 - DNA, 25 bp, Mus musculus
tgtaccgccgctgtaagctggagga

SEQ ID NO: 825384 - DNA, 25 bp, Mus musculus
tgtaccgcgcgcagtatgcgttccg

SEQ ID NO: 825385 - DNA, 25 bp, Mus musculus
tgtaccgcgcgctgtatgcgttccg

SEQ ID NO: 825386 - DNA, 25 bp, Mus musculus
tgtaccgctcgcacccatacgatga

SEQ ID NO: 825387 - DNA, 25 bp, Mus musculus
tgtaccgctcgctcccatacgatga

SEQ ID NO: 825388 - DNA, 25 bp, Mus musculus
tgtaccgctgcgacatctgccagat

SEQ ID NO: 825389 - DNA, 25 bp, Mus musculus
tgtaccgctgcgtcatctgccagat

SEQ ID NO: 825390 - DNA, 25 bp, Mus musculus
tgtaccgggaccctgttacagacat

SEQ ID NO: 825391 - DNA, 25 bp, Mus musculus
tgtaccgggaccgtgttacagacat

SEQ ID NO: 825392 - DNA, 25 bp, Mus musculus
tgtaccgggcgacacgaaagcagtt

SEQ ID NO: 825393 - DNA, 25 bp, Mus musculus
tgtaccgggcgagacgaaagcagtt

SEQ ID NO: 825394 - DNA, 25 bp, Mus musculus
tgtaccgggtaacctgcttgccagc

SEQ ID NO: 825395 - DNA, 25 bp, Mus musculus
tgtaccgggtaagctgcttgccagc

SEQ ID NO: 825396 - DNA, 25 bp, Mus musculus
tgtaccggttcaactggaaccactg

SEQ ID NO: 825397 - DNA, 25 bp, Mus musculus
tgtaccggttcatctggaaccactg

SEQ ID NO: 825398 - DNA, 25 bp, Mus musculus
tgtaccgtctggacagcttgcaccc

SEQ ID NO: 825399 - DNA, 25 bp, Mus musculus
tgtaccgtctggtcagcttgcaccc

SEQ ID NO: 825400 - DNA, 25 bp, Mus musculus
tgtaccgtgcatcaagagcttcctg

SEQ ID NO: 825401 - DNA, 25 bp, Mus musculus
tgtaccgtgcatgaagagcttcctg

SEQ ID NO: 825402 - DNA, 25 bp, Mus musculus
tgtacctaaaccatgggctcccctt

SEQ ID NO: 825403 - DNA, 25 bp, Mus musculus
tgtacctaaaccttgggctcccctt

SEQ ID NO: 825404 - DNA, 25 bp, Mus musculus
tgtacctaaactcgtgactgagttc

SEQ ID NO: 825405 - DNA, 25 bp, Mus musculus
tgtacctaaactggtgactgagttc

SEQ ID NO: 825406 - DNA, 25 bp, Mus musculus
tgtacctacagactcgtggctccaa

SEQ ID NO: 825407 - DNA, 25 bp, Mus musculus
tgtacctacagagtcgtggctccaa

SEQ ID NO: 825408 - DNA, 25 bp, Mus musculus
tgtacctagctcaagacgaggagag

SEQ ID NO: 825409 - DNA, 25 bp, Mus musculus
tgtacctagctctagacgaggagag

SEQ ID NO: 825410 - DNA, 25 bp, Mus musculus
tgtacctcacacagccctttgcttg

SEQ ID NO: 825411 - DNA, 25 bp, Mus musculus
tgtacctcacactgccctttgcttg

SEQ ID NO: 825412 - DNA, 25 bp, Mus musculus
tgtacctcattgcaattgcagccat

SEQ ID NO: 825413 - DNA, 25 bp, Mus musculus
tgtacctcattggaattgcagccat

SEQ ID NO: 825414 - DNA, 25 bp, Mus musculus
tgtacctccacaccatcattgtggg

SEQ ID NO: 825415 - DNA, 25 bp, Mus musculus
tgtacctccacagcatcattgtggg

SEQ ID NO: 825416 - DNA, 25 bp, Mus musculus
tgtacctccgcaccagaacagcgat

SEQ ID NO: 825417 - DNA, 25 bp, Mus musculus
tgtacctccgcagcagaacagcgat

SEQ ID NO: 825418 - DNA, 25 bp, Mus musculus
tgtacctctgttactctcagcctgg

SEQ ID NO: 825419 - DNA, 25 bp, Mus musculus
tgtacctctgtttctctcagcctgg

SEQ ID NO: 825420 - DNA, 25 bp, Mus musculus
tgtacctgaaagagggcttccaggg

SEQ ID NO: 825421 - DNA, 25 bp, Mus musculus
tgtacctgaaagtgggcttccaggg

SEQ ID NO: 825422 - DNA, 25 bp, Mus musculus
tgtacctgaactatgccgagattgg

SEQ ID NO: 825423 - DNA, 25 bp, Mus musculus
tgtacctgaactttgccgagattgg

SEQ ID NO: 825424 - DNA, 25 bp, Mus musculus
tgtacctgaatcagtgctgccttgg

SEQ ID NO: 825425 - DNA, 25 bp, Mus musculus
tgtacctgaatctgtgctgccttgg

SEQ ID NO: 825426 - DNA, 25 bp, Mus musculus
tgtacctgagagaaatatgaatgaa

SEQ ID NO: 825427 - DNA, 25 bp, Mus musculus
tgtacctgagagtaatatgaatgaa

SEQ ID NO: 825428 - DNA, 25 bp, Mus musculus
tgtacctgatccaggcctgggcaca

SEQ ID NO: 825429 - DNA, 25 bp, Mus musculus
tgtacctgatcctggcctgggcaca

SEQ ID NO: 825430 - DNA, 25 bp, Mus musculus
tgtacctgccacaagaagtcattgg

SEQ ID NO: 825431 - DNA, 25 bp, Mus musculus
tgtacctgccactagaagtcattgg

SEQ ID NO: 825432 - DNA, 25 bp, Mus musculus
tgtacctgccgcagtcattggatga

SEQ ID NO: 825433 - DNA, 25 bp, Mus musculus
tgtacctgccgctgtcattggatga

SEQ ID NO: 825434 - DNA, 25 bp, Mus musculus
tgtacctgcgacagctacagcgaat

SEQ ID NO: 825435 - DNA, 25 bp, Mus musculus
tgtacctgcgactgctacagcgaat

SEQ ID NO: 825436 - DNA, 25 bp, Mus musculus
tgtacctgctggacctgacttgaga

SEQ ID NO: 825437 - DNA, 25 bp, Mus musculus
tgtacctgctggtcctgacttgaga

SEQ ID NO: 825438 - DNA, 25 bp, Mus musculus
tgtacctgggtcacgtggatttcca

SEQ ID NO: 825439 - DNA, 25 bp, Mus musculus
tgtacctgggtctcgtggatttcca

SEQ ID NO: 825440 - DNA, 25 bp, Mus musculus
tgtacctgggtgacaagaacgcact

SEQ ID NO: 825441 - DNA, 25 bp, Mus musculus
tgtacctgggtgtcaagaacgcact

SEQ ID NO: 825442 - DNA, 25 bp, Mus musculus
tgtacctgtcaaactggatggccta

SEQ ID NO: 825443 - DNA, 25 bp, Mus musculus
tgtacctgtcaatctggatggccta

SEQ ID NO: 825444 - DNA, 25 bp, Mus musculus
tgtacctgtcacagcctacactggg

SEQ ID NO: 825445 - DNA, 25 bp, Mus musculus
tgtacctgtcactgcctacactggg

SEQ ID NO: 825446 - DNA, 25 bp, Mus musculus
tgtacctgtggtcgtatcctgaggg

SEQ ID NO: 825447 - DNA, 25 bp, Mus musculus
tgtacctgtggtggtatcctgaggg

SEQ ID NO: 825448 - DNA, 25 bp, Mus musculus
tgtacctgtgtcctagaggagtata

SEQ ID NO: 825449 - DNA, 25 bp, Mus musculus
tgtacctgtgtcgtagaggagtata

SEQ ID NO: 825450 - DNA, 25 bp, Mus musculus
tgtacctgtgtgaacatatggcttc

SEQ ID NO: 825451 - DNA, 25 bp, Mus musculus
tgtacctgtgtgtacatatggcttc

SEQ ID NO: 825452 - DNA, 25 bp, Mus musculus
tgtaccttaggcaacaaaactaaat

SEQ ID NO: 825453 - DNA, 25 bp, Mus musculus
tgtaccttaggctacaaaactaaat

SEQ ID NO: 825454 - DNA, 25 bp, Mus musculus
tgtaccttcatcaagtccaaccttg

SEQ ID NO: 825455 - DNA, 25 bp, Mus musculus
tgtaccttcatctagtccaaccttg

SEQ ID NO: 825456 - DNA, 25 bp, Mus musculus
tgtaccttccgcagtgtcaacgtgc

SEQ ID NO: 825457 - DNA, 25 bp, Mus musculus
tgtaccttccgctgtgtcaacgtgc

SEQ ID NO: 825458 - DNA, 25 bp, Mus musculus
tgtaccttctgaaccatcggttgaa

SEQ ID NO: 825459 - DNA, 25 bp, Mus musculus
tgtaccttctgatccatcggttgaa

SEQ ID NO: 825460 - DNA, 25 bp, Mus musculus
tgtaccttgaacaggctgccactcg

SEQ ID NO: 825461 - DNA, 25 bp, Mus musculus
tgtaccttgaactggctgccactcg

SEQ ID NO: 825462 - DNA, 25 bp, Mus musculus
tgtaccttggcacctcctttcttag

SEQ ID NO: 825463 - DNA, 25 bp, Mus musculus
tgtaccttggcagctcctttcttag

SEQ ID NO: 825464 - DNA, 25 bp, Mus musculus
tgtacctttgtcaacggtcaacaga

SEQ ID NO: 825465 - DNA, 25 bp, Mus musculus
tgtacctttgtctacggtcaacaga

SEQ ID NO: 825466 - DNA, 25 bp, Mus musculus
tgtacgaaatgcacatcggccagtc

SEQ ID NO: 825467 - DNA, 25 bp, Mus musculus
tgtacgaaatgctcatcggccagtc

SEQ ID NO: 825468 - DNA, 25 bp, Mus musculus
tgtacgaacgacactgtggcgagga

SEQ ID NO: 825469 - DNA, 25 bp, Mus musculus
tgtacgaacgactctgtggcgagga

SEQ ID NO: 825470 - DNA, 25 bp, Mus musculus
tgtacgaacttacccgggagcttgg

SEQ ID NO: 825471 - DNA, 25 bp, Mus musculus
tgtacgaacttagccgggagcttgg

SEQ ID NO: 825472 - DNA, 25 bp, Mus musculus
tgtacgagacatactagaactcggg

SEQ ID NO: 825473 - DNA, 25 bp, Mus musculus
tgtacgagacattctagaactcggg

SEQ ID NO: 825474 - DNA, 25 bp, Mus musculus
tgtacgagcagcagtcagggaagta

SEQ ID NO: 825475 - DNA, 25 bp, Mus musculus
tgtacgagcagctgtcagggaagta

SEQ ID NO: 825476 - DNA, 25 bp, Mus musculus
tgtacgagcctgatccagcctgggt

SEQ ID NO: 825477 - DNA, 25 bp, Mus musculus
tgtacgagcctgttccagcctgggt

SEQ ID NO: 825478 - DNA, 25 bp, Mus musculus
tgtacgagctacagccacagcggct

SEQ ID NO: 825479 - DNA, 25 bp, Mus musculus
tgtacgagctactgccacagcggct

SEQ ID NO: 825480 - DNA, 25 bp, Mus musculus
tgtacgaggccaagtttacacagta

SEQ ID NO: 825481 - DNA, 25 bp, Mus musculus
tgtacgaggccatgtttacacagta

SEQ ID NO: 825482 - DNA, 25 bp, Mus musculus
tgtacgagggctatgcagcagtcac

SEQ ID NO: 825483 - DNA, 25 bp, Mus musculus
tgtacgagggctttgcagcagtcac

SEQ ID NO: 825484 - DNA, 25 bp, Mus musculus
tgtacgaggtcaaatttctgagtgg

SEQ ID NO: 825485 - DNA, 25 bp, Mus musculus
tgtacgaggtcatatttctgagtgg

SEQ ID NO: 825486 - DNA, 25 bp, Mus musculus
tgtacgaggtgccttcgccaccgga

SEQ ID NO: 825487 - DNA, 25 bp, Mus musculus
tgtacgaggtgcgttcgccaccgga

SEQ ID NO: 825488 - DNA, 25 bp, Mus musculus
tgtacgcaggcgacctcagctacgg

SEQ ID NO: 825489 - DNA, 25 bp, Mus musculus
tgtacgcaggcgtcctcagctacgg

SEQ ID NO: 825490 - DNA, 25 bp, Mus musculus
tgtacgcatgttctggtcactgacc

SEQ ID NO: 825491 - DNA, 25 bp, Mus musculus
tgtacgcatgttgtggtcactgacc

SEQ ID NO: 825492 - DNA, 25 bp, Mus musculus
tgtacgccaagaacttctatggagg

SEQ ID NO: 825493 - DNA, 25 bp, Mus musculus
tgtacgccaagatcttctatggagg

SEQ ID NO: 825494 - DNA, 25 bp, Mus musculus
tgtacgccataaccttgtctccctg

SEQ ID NO: 825495 - DNA, 25 bp, Mus musculus
tgtacgccataagcttgtctccctg

SEQ ID NO: 825496 - DNA, 25 bp, Mus musculus
tgtacgccatccctctgtgccagtg

SEQ ID NO: 825497 - DNA, 25 bp, Mus musculus
tgtacgccatccgtctgtgccagtg

SEQ ID NO: 825498 - DNA, 25 bp, Mus musculus
tgtacgcccactacgggcggtcgga

SEQ ID NO: 825499 - DNA, 25 bp, Mus musculus
tgtacgcccacttcgggcggtcgga

SEQ ID NO: 825500 - DNA, 25 bp, Mus musculus
tgtacgctcatcagtattatatgca

SEQ ID NO: 825501 - DNA, 25 bp, Mus musculus
tgtacgctcatctgtattatatgca

SEQ ID NO: 825502 - DNA, 25 bp, Mus musculus
tgtacgctgaagagcccaacatcga

SEQ ID NO: 825503 - DNA, 25 bp, Mus musculus
tgtacgctgaagtgcccaacatcga

SEQ ID NO: 825504 - DNA, 25 bp, Mus musculus
tgtacgctggagcaccagtttctag

SEQ ID NO: 825505 - DNA, 25 bp, Mus musculus
tgtacgctggaggaccagtttctag

SEQ ID NO: 825506 - DNA, 25 bp, Mus musculus
tgtacgctgtgacattcgctacaca

SEQ ID NO: 825507 - DNA, 25 bp, Mus musculus
tgtacgctgtgagattcgctacaca

SEQ ID NO: 825508 - DNA, 25 bp, Mus musculus
tgtacggacccgaagcggacattgt

SEQ ID NO: 825509 - DNA, 25 bp, Mus musculus
tgtacggacccgtagcggacattgt

SEQ ID NO: 825510 - DNA, 25 bp, Mus musculus
tgtacggagatcaatctgacctttg

SEQ ID NO: 825511 - DNA, 25 bp, Mus musculus
tgtacggagatctatctgacctttg

SEQ ID NO: 825512 - DNA, 25 bp, Mus musculus
tgtacggcatggattggtatgcaga

SEQ ID NO: 825513 - DNA, 25 bp, Mus musculus
tgtacggcatggtttggtatgcaga

SEQ ID NO: 825514 - DNA, 25 bp, Mus musculus
tgtacggcctcactgaagctatcgc

SEQ ID NO: 825515 - DNA, 25 bp, Mus musculus
tgtacggcctcagtgaagctatcgc

SEQ ID NO: 825516 - DNA, 25 bp, Mus musculus
tgtacggctgcccagtcatccagaa

SEQ ID NO: 825517 - DNA, 25 bp, Mus musculus
tgtacggctgccgagtcatccagaa

SEQ ID NO: 825518 - DNA, 25 bp, Mus musculus
tgtacggcttatcttctccaactgc

SEQ ID NO: 825519 - DNA, 25 bp, Mus musculus
tgtacggcttatgttctccaactgc

SEQ ID NO: 825520 - DNA, 25 bp, Mus musculus
tgtacggcttctaggaggtcaacaa

SEQ ID NO: 825521 - DNA, 25 bp, Mus musculus
tgtacggcttcttggaggtcaacaa

SEQ ID NO: 825522 - DNA, 25 bp, Mus musculus
tgtacgggatcaaatgcgccaagtg

SEQ ID NO: 825523 - DNA, 25 bp, Mus musculus
tgtacgggatcatatgcgccaagtg

SEQ ID NO: 825524 - DNA, 25 bp, Mus musculus
tgtacggtcagcatctagctttgta

SEQ ID NO: 825525 - DNA, 25 bp, Mus musculus
tgtacggtcagcttctagctttgta

SEQ ID NO: 825526 - DNA, 25 bp, Mus musculus
tgtacggtgagaaggttggattggg

SEQ ID NO: 825527 - DNA, 25 bp, Mus musculus
tgtacggtgagatggttggattggg

SEQ ID NO: 825528 - DNA, 25 bp, Mus musculus
tgtacggtgccaataaattcactgg

SEQ ID NO: 825529 - DNA, 25 bp, Mus musculus
tgtacggtgccattaaattcactgg

SEQ ID NO: 825530 - DNA, 25 bp, Mus musculus
tgtacgtctaccagcgaggtttgac

SEQ ID NO: 825531 - DNA, 25 bp, Mus musculus
tgtacgtctacctgcgaggtttgac

SEQ ID NO: 825532 - DNA, 25 bp, Mus musculus
tgtacgtgaacaagactagcggccc

SEQ ID NO: 825533 - DNA, 25 bp, Mus musculus
tgtacgtgaacatgactagcggccc

SEQ ID NO: 825534 - DNA, 25 bp, Mus musculus
tgtacgtgagccaggacaactccgt

SEQ ID NO: 825535 - DNA, 25 bp, Mus musculus
tgtacgtgagcctggacaactccgt

SEQ ID NO: 825536 - DNA, 25 bp, Mus musculus
tgtacgtgctccagagtcgtcggta

SEQ ID NO: 825537 - DNA, 25 bp, Mus musculus
tgtacgtgctcctgagtcgtcggta

SEQ ID NO: 825538 - DNA, 25 bp, Mus musculus
tgtacgtgctggaggaacacccctt

SEQ ID NO: 825539 - DNA, 25 bp, Mus musculus
tgtacgtgctggtggaacacccctt

SEQ ID NO: 825540 - DNA, 25 bp, Mus musculus
tgtacgtggcttaccatgacccgca

SEQ ID NO: 825541 - DNA, 25 bp, Mus musculus
tgtacgtggctttccatgacccgca

SEQ ID NO: 825542 - DNA, 25 bp, Mus musculus
tgtacgtgtcttacaacaagaagga

SEQ ID NO: 825543 - DNA, 25 bp, Mus musculus
tgtacgtgtctttcaacaagaagga

SEQ ID NO: 825544 - DNA, 25 bp, Mus musculus
tgtactaacagacgactttaaaggt

SEQ ID NO: 825545 - DNA, 25 bp, Mus musculus
tgtactaacagaggactttaaaggt

SEQ ID NO: 825546 - DNA, 25 bp, Mus musculus
tgtactacaccacagtgcgggccct

SEQ ID NO: 825547 - DNA, 25 bp, Mus musculus
tgtactacaccagagtgcgggccct

SEQ ID NO: 825548 - DNA, 25 bp, Mus musculus
tgtactacacccacaacgtgctgcg

SEQ ID NO: 825549 - DNA, 25 bp, Mus musculus
tgtactacaccctcaacgtgctgcg

SEQ ID NO: 825550 - DNA, 25 bp, Mus musculus
tgtactacactaaccgggccctgtg

SEQ ID NO: 825551 - DNA, 25 bp, Mus musculus
tgtactacactatccgggccctgtg

SEQ ID NO: 825552 - DNA, 25 bp, Mus musculus
tgtactacatttccctggacctaag

SEQ ID NO: 825553 - DNA, 25 bp, Mus musculus
tgtactacatttgcctggacctaag

SEQ ID NO: 825554 - DNA, 25 bp, Mus musculus
tgtactaccaaactgaggagcaagt

SEQ ID NO: 825555 - DNA, 25 bp, Mus musculus
tgtactaccaaagtgaggagcaagt

SEQ ID NO: 825556 - DNA, 25 bp, Mus musculus
tgtactaccaagacctaaattttgg

SEQ ID NO: 825557 - DNA, 25 bp, Mus musculus
tgtactaccaagtcctaaattttgg

SEQ ID NO: 825558 - DNA, 25 bp, Mus musculus
tgtactacccagctcaagatcaagg

SEQ ID NO: 825559 - DNA, 25 bp, Mus musculus
tgtactacccaggtcaagatcaagg

SEQ ID NO: 825560 - DNA, 25 bp, Mus musculus
tgtactacgacgcagagctgcaggc

SEQ ID NO: 825561 - DNA, 25 bp, Mus musculus
tgtactacgacggagagctgcaggc

SEQ ID NO: 825562 - DNA, 25 bp, Mus musculus
tgtactactggtacagcggcctcgg

SEQ ID NO: 825563 - DNA, 25 bp, Mus musculus
tgtactactggttcagcggcctcgg

SEQ ID NO: 825564 - DNA, 25 bp, Mus musculus
tgtactacttgacttcctaacctgg

SEQ ID NO: 825565 - DNA, 25 bp, Mus musculus
tgtactacttgagttcctaacctgg

SEQ ID NO: 825566 - DNA, 25 bp, Mus musculus
tgtactagcctacagacctgagtct

SEQ ID NO: 825567 - DNA, 25 bp, Mus musculus
tgtactagcctagagacctgagtct

SEQ ID NO: 825568 - DNA, 25 bp, Mus musculus
tgtactagctgacatcgagtgcctg

SEQ ID NO: 825569 - DNA, 25 bp, Mus musculus
tgtactagctgagatcgagtgcctg

SEQ ID NO: 825570 - DNA, 25 bp, Mus musculus
tgtactagggaaaggctgtctggct

SEQ ID NO: 825571 - DNA, 25 bp, Mus musculus
tgtactagggaatggctgtctggct

SEQ ID NO: 825572 - DNA, 25 bp, Mus musculus
tgtactaggtctaaggcagacacaa

SEQ ID NO: 825573 - DNA, 25 bp, Mus musculus
tgtactaggtcttaggcagacacaa

SEQ ID NO: 825574 - DNA, 25 bp, Mus musculus
tgtactattatcaagagacagaggc

SEQ ID NO: 825575 - DNA, 25 bp, Mus musculus
tgtactattatctagagacagaggc

SEQ ID NO: 825576 - DNA, 25 bp, Mus musculus
tgtactcaaagacggaagcttcgtg

SEQ ID NO: 825577 - DNA, 25 bp, Mus musculus
tgtactcaaagagggaagcttcgtg

SEQ ID NO: 825578 - DNA, 25 bp, Mus musculus
tgtactcaagataaaaactgttggg

SEQ ID NO: 825579 - DNA, 25 bp, Mus musculus
tgtactcaagattaaaactgttggg

SEQ ID NO: 825580 - DNA, 25 bp, Mus musculus
tgtactcaccggagagcctcagtct

SEQ ID NO: 825581 - DNA, 25 bp, Mus musculus
tgtactcaccggtgagcctcagtct

SEQ ID NO: 825582 - DNA, 25 bp, Mus musculus
tgtactcacctgctgagcgaaggac

SEQ ID NO: 825583 - DNA, 25 bp, Mus musculus
tgtactcacctggtgagcgaaggac

SEQ ID NO: 825584 - DNA, 25 bp, Mus musculus
tgtactcactgtaacaagcaccgct

SEQ ID NO: 825585 - DNA, 25 bp, Mus musculus
tgtactcactgttacaagcaccgct

SEQ ID NO: 825586 - DNA, 25 bp, Mus musculus
tgtactcagtgtctatgggccggat

SEQ ID NO: 825587 - DNA, 25 bp, Mus musculus
tgtactcagtgtgtatgggccggat

SEQ ID NO: 825588 - DNA, 25 bp, Mus musculus
tgtactcatcagaggtgaccaggca

SEQ ID NO: 825589 - DNA, 25 bp, Mus musculus
tgtactcatcagtggtgaccaggca

SEQ ID NO: 825590 - DNA, 25 bp, Mus musculus
tgtactcatcgacagcagataccag

SEQ ID NO: 825591 - DNA, 25 bp, Mus musculus
tgtactcatcgagagcagataccag

SEQ ID NO: 825592 - DNA, 25 bp, Mus musculus
tgtactccataacctgaccaccttg

SEQ ID NO: 825593 - DNA, 25 bp, Mus musculus
tgtactccataagctgaccaccttg

SEQ ID NO: 825594 - DNA, 25 bp, Mus musculus
tgtactccattcctatgacctcagg

SEQ ID NO: 825595 - DNA, 25 bp, Mus musculus
tgtactccattcgtatgacctcagg

SEQ ID NO: 825596 - DNA, 25 bp, Mus musculus
tgtactccgtgccaaataaggtgga

SEQ ID NO: 825597 - DNA, 25 bp, Mus musculus
tgtactccgtgcgaaataaggtgga

SEQ ID NO: 825598 - DNA, 25 bp, Mus musculus
tgtactcctgggacatcgttgtcca

SEQ ID NO: 825599 - DNA, 25 bp, Mus musculus
tgtactcctgggtcatcgttgtcca

SEQ ID NO: 825600 - DNA, 25 bp, Mus musculus
tgtactcggtgtacaaccccaacaa

SEQ ID NO: 825601 - DNA, 25 bp, Mus musculus
tgtactcggtgttcaaccccaacaa

SEQ ID NO: 825602 - DNA, 25 bp, Mus musculus
tgtactcgtgcactaagtgtacgta

SEQ ID NO: 825603 - DNA, 25 bp, Mus musculus
tgtactcgtgcagtaagtgtacgta

SEQ ID NO: 825604 - DNA, 25 bp, Mus musculus
tgtactctactgcttcctgaatggg

SEQ ID NO: 825605 - DNA, 25 bp, Mus musculus
tgtactctactggttcctgaatggg

SEQ ID NO: 825606 - DNA, 25 bp, Mus musculus
tgtactctagaaagactctcgcccc

SEQ ID NO: 825607 - DNA, 25 bp, Mus musculus
tgtactctagaatgactctcgcccc

SEQ ID NO: 825608 - DNA, 25 bp, Mus musculus
tgtactctattaaccagacgatatg

SEQ ID NO: 825609 - DNA, 25 bp, Mus musculus
tgtactctattatccagacgatatg

SEQ ID NO: 825610 - DNA, 25 bp, Mus musculus
tgtactctgatcaacacacctcggg

SEQ ID NO: 825611 - DNA, 25 bp, Mus musculus
tgtactctgatctacacacctcggg

SEQ ID NO: 825612 - DNA, 25 bp, Mus musculus
tgtactctgcaaaccaagccctcag

SEQ ID NO: 825613 - DNA, 25 bp, Mus musculus
tgtactctgcaatccaagccctcag

SEQ ID NO: 825614 - DNA, 25 bp, Mus musculus
tgtactgaacatcggtttgatttct

SEQ ID NO: 825615 - DNA, 25 bp, Mus musculus
tgtactgaacatgggtttgatttct

SEQ ID NO: 825616 - DNA, 25 bp, Mus musculus
tgtactgagcagagagcttgaatct

SEQ ID NO: 825617 - DNA, 25 bp, Mus musculus
tgtactgagcagtgagcttgaatct

SEQ ID NO: 825618 - DNA, 25 bp, Mus musculus
tgtactgagccgcaaggacaagaca

SEQ ID NO: 825619 - DNA, 25 bp, Mus musculus
tgtactgagccggaaggacaagaca

SEQ ID NO: 825620 - DNA, 25 bp, Mus musculus
tgtactgcaagtcgcgctaccagag

SEQ ID NO: 825621 - DNA, 25 bp, Mus musculus
tgtactgcaagtggcgctaccagag

SEQ ID NO: 825622 - DNA, 25 bp, Mus musculus
tgtactgcagctaggacggtagaca

SEQ ID NO: 825623 - DNA, 25 bp, Mus musculus
tgtactgcagcttggacggtagaca

SEQ ID NO: 825624 - DNA, 25 bp, Mus musculus
tgtactgccacaaggactactgggc

SEQ ID NO: 825625 - DNA, 25 bp, Mus musculus
tgtactgccacatggactactgggc

SEQ ID NO: 825626 - DNA, 25 bp, Mus musculus
tgtactgcctataccctgcgctggt

SEQ ID NO: 825627 - DNA, 25 bp, Mus musculus
tgtactgcctattccctgcgctggt

SEQ ID NO: 825628 - DNA, 25 bp, Mus musculus
tgtactgcgcaaaactgggcggtga

SEQ ID NO: 825629 - DNA, 25 bp, Mus musculus
tgtactgcgcaatactgggcggtga

SEQ ID NO: 825630 - DNA, 25 bp, Mus musculus
tgtactggaacaaggtcgacctgaa

SEQ ID NO: 825631 - DNA, 25 bp, Mus musculus
tgtactggaacatggtcgacctgaa

SEQ ID NO: 825632 - DNA, 25 bp, Mus musculus
tgtactggagaaagtatcagaggat

SEQ ID NO: 825633 - DNA, 25 bp, Mus musculus
tgtactggagaatgtatcagaggat

SEQ ID NO: 825634 - DNA, 25 bp, Mus musculus
tgtactggagaccatgacggccttc

SEQ ID NO: 825635 - DNA, 25 bp, Mus musculus
tgtactggagacgatgacggccttc

SEQ ID NO: 825636 - DNA, 25 bp, Mus musculus
tgtactggagcaaggtcgtcctgag

SEQ ID NO: 825637 - DNA, 25 bp, Mus musculus
tgtactggagcatggtcgtcctgag

SEQ ID NO: 825638 - DNA, 25 bp, Mus musculus
tgtactggagctctccacatccttg

SEQ ID NO: 825639 - DNA, 25 bp, Mus musculus
tgtactggagctgtccacatccttg

SEQ ID NO: 825640 - DNA, 25 bp, Mus musculus
tgtactggcccgatatgacacatgc

SEQ ID NO: 825641 - DNA, 25 bp, Mus musculus
tgtactggcccgttatgacacatgc

SEQ ID NO: 825642 - DNA, 25 bp, Mus musculus
tgtactggctctctcaatgttctcc

SEQ ID NO: 825643 - DNA, 25 bp, Mus musculus
tgtactggctctgtcaatgttctcc

SEQ ID NO: 825644 - DNA, 25 bp, Mus musculus
tgtactgggaggaaggcagccctat

SEQ ID NO: 825645 - DNA, 25 bp, Mus musculus
tgtactgggaggtaggcagccctat

SEQ ID NO: 825646 - DNA, 25 bp, Mus musculus
tgtactgggcacaactgctcagcca

SEQ ID NO: 825647 - DNA, 25 bp, Mus musculus
tgtactgggcactactgctcagcca

SEQ ID NO: 825648 - DNA, 25 bp, Mus musculus
tgtactggtgttcttaaccctcaga

SEQ ID NO: 825649 - DNA, 25 bp, Mus musculus
tgtactggtgttgttaaccctcaga

SEQ ID NO: 825650 - DNA, 25 bp, Mus musculus
tgtactgtcacaccacctgggcaag

SEQ ID NO: 825651 - DNA, 25 bp, Mus musculus
tgtactgtcacagcacctgggcaag

SEQ ID NO: 825652 - DNA, 25 bp, Mus musculus
tgtactgtccccacggtcggagagt

SEQ ID NO: 825653 - DNA, 25 bp, Mus musculus
tgtactgtcccctcggtcggagagt

SEQ ID NO: 825654 - DNA, 25 bp, Mus musculus
tgtactgtgtgtaggcagacagagt

SEQ ID NO: 825655 - DNA, 25 bp, Mus musculus
tgtactgtgtgttggcagacagagt

SEQ ID NO: 825656 - DNA, 25 bp, Mus musculus
tgtacttcaccaatggccacctgta

SEQ ID NO: 825657 - DNA, 25 bp, Mus musculus
tgtacttcaccattggccacctgta

SEQ ID NO: 825658 - DNA, 25 bp, Mus musculus
tgtacttcagctactttgcaccact

SEQ ID NO: 825659 - DNA, 25 bp, Mus musculus
tgtacttcagcttctttgcaccact

SEQ ID NO: 825660 - DNA, 25 bp, Mus musculus
tgtacttcagtcagtaacagcccgg

SEQ ID NO: 825661 - DNA, 25 bp, Mus musculus
tgtacttcagtctgtaacagcccgg

SEQ ID NO: 825662 - DNA, 25 bp, Mus musculus
tgtacttcatctagagggctgctcc

SEQ ID NO: 825663 - DNA, 25 bp, Mus musculus
tgtacttcatcttgagggctgctcc

SEQ ID NO: 825664 - DNA, 25 bp, Mus musculus
tgtacttcccgcagatcagcagtgt

SEQ ID NO: 825665 - DNA, 25 bp, Mus musculus
tgtacttcccgctgatcagcagtgt

SEQ ID NO: 825666 - DNA, 25 bp, Mus musculus
tgtacttcccttagctgtaaacaat

SEQ ID NO: 825667 - DNA, 25 bp, Mus musculus
tgtacttccctttgctgtaaacaat

SEQ ID NO: 825668 - DNA, 25 bp, Mus musculus
tgtacttccgagatggctacatgcc

SEQ ID NO: 825669 - DNA, 25 bp, Mus musculus
tgtacttccgagttggctacatgcc

SEQ ID NO: 825670 - DNA, 25 bp, Mus musculus
tgtacttctagtcgccgcgggactg

SEQ ID NO: 825671 - DNA, 25 bp, Mus musculus
tgtacttctagtggccgcgggactg

SEQ ID NO: 825672 - DNA, 25 bp, Mus musculus
tgtacttggctaaaagtctggcaga

SEQ ID NO: 825673 - DNA, 25 bp, Mus musculus
tgtacttggctataagtctggcaga

SEQ ID NO: 825674 - DNA, 25 bp, Mus musculus
tgtacttgggatagtgtcaggagca

SEQ ID NO: 825675 - DNA, 25 bp, Mus musculus
tgtacttgggattgtgtcaggagca

SEQ ID NO: 825676 - DNA, 25 bp, Mus musculus
tgtacttgtcctcaaatggtgccac

SEQ ID NO: 825677 - DNA, 25 bp, Mus musculus
tgtacttgtcctgaaatggtgccac

SEQ ID NO: 825678 - DNA, 25 bp, Mus musculus
tgtacttgttcgagcatcgctgaaa

SEQ ID NO: 825679 - DNA, 25 bp, Mus musculus
tgtacttgttcgtgcatcgctgaaa

SEQ ID NO: 825680 - DNA, 25 bp, Mus musculus
tgtactttatgcagaatggctcctg

SEQ ID NO: 825681 - DNA, 25 bp, Mus musculus
tgtactttatgctgaatggctcctg

SEQ ID NO: 825682 - DNA, 25 bp, Mus musculus
tgtactttgaagactgtatgcagct

SEQ ID NO: 825683 - DNA, 25 bp, Mus musculus
tgtactttgaagtctgtatgcagct

SEQ ID NO: 825684 - DNA, 25 bp, Mus musculus
tgtagaaaaacgaagagcggcactg

SEQ ID NO: 825685 - DNA, 25 bp, Mus musculus
tgtagaaaaacgtagagcggcactg

SEQ ID NO: 825686 - DNA, 25 bp, Mus musculus
tgtagaaattctaatgaggcctacc

SEQ ID NO: 825687 - DNA, 25 bp, Mus musculus
tgtagaaattcttatgaggcctacc

SEQ ID NO: 825688 - DNA, 25 bp, Mus musculus
tgtagaacacctaatatcccaaatg

SEQ ID NO: 825689 - DNA, 25 bp, Mus musculus
tgtagaacaccttatatcccaaatg

SEQ ID NO: 825690 - DNA, 25 bp, Mus musculus
tgtagaagaaagaaattgtcctgtc

SEQ ID NO: 825691 - DNA, 25 bp, Mus musculus
tgtagaagaaagtaattgtcctgtc

SEQ ID NO: 825692 - DNA, 25 bp, Mus musculus
tgtagaagccaccaacagtatgacg

SEQ ID NO: 825693 - DNA, 25 bp, Mus musculus
tgtagaagccacgaacagtatgacg

SEQ ID NO: 825694 - DNA, 25 bp, Mus musculus
tgtagaaggaggcaatttccacgcc

SEQ ID NO: 825695 - DNA, 25 bp, Mus musculus
tgtagaaggagggaatttccacgcc

SEQ ID NO: 825696 - DNA, 25 bp, Mus musculus
tgtagaatcggtcagcacacaccgg

SEQ ID NO: 825697 - DNA, 25 bp, Mus musculus
tgtagaatcggtgagcacacaccgg

SEQ ID NO: 825698 - DNA, 25 bp, Mus musculus
tgtagaatggctctgtgttgttaga

SEQ ID NO: 825699 - DNA, 25 bp, Mus musculus
tgtagaatggctgtgtgttgttaga

SEQ ID NO: 825700 - DNA, 25 bp, Mus musculus
tgtagacaacaacattcgcagtggg

SEQ ID NO: 825701 - DNA, 25 bp, Mus musculus
tgtagacaacaagattcgcagtggg

SEQ ID NO: 825702 - DNA, 25 bp, Mus musculus
tgtagacacctaagaccattattct

SEQ ID NO: 825703 - DNA, 25 bp, Mus musculus
tgtagacacctatgaccattattct

SEQ ID NO: 825704 - DNA, 25 bp, Mus musculus
tgtagacacttgagggaagccggca

SEQ ID NO: 825705 - DNA, 25 bp, Mus musculus
tgtagacacttgtgggaagccggca

SEQ ID NO: 825706 - DNA, 25 bp, Mus musculus
tgtagacagcatcactggagcagtc

SEQ ID NO: 825707 - DNA, 25 bp, Mus musculus
tgtagacagcatgactggagcagtc

SEQ ID NO: 825708 - DNA, 25 bp, Mus musculus
tgtagacagtctatcaccggacaca

SEQ ID NO: 825709 - DNA, 25 bp, Mus musculus
tgtagacagtctttcaccggacaca

SEQ ID NO: 825710 - DNA, 25 bp, Mus musculus
tgtagacagtgcactgaagccactg

SEQ ID NO: 825711 - DNA, 25 bp, Mus musculus
tgtagacagtgctctgaagccactg

SEQ ID NO: 825712 - DNA, 25 bp, Mus musculus
tgtagacagtggagctcctcacgct

SEQ ID NO: 825713 - DNA, 25 bp, Mus musculus
tgtagacagtggtgctcctcacgct

SEQ ID NO: 825714 - DNA, 25 bp, Mus musculus
tgtagacatcgtctgtcttgcaggg

SEQ ID NO: 825715 - DNA, 25 bp, Mus musculus
tgtagacatcgtgtgtcttgcaggg

SEQ ID NO: 825716 - DNA, 25 bp, Mus musculus
tgtagacatggtactaaatgatgga

SEQ ID NO: 825717 - DNA, 25 bp, Mus musculus
tgtagacatggttctaaatgatgga

SEQ ID NO: 825718 - DNA, 25 bp, Mus musculus
tgtagacattcccttgaaccccagc

SEQ ID NO: 825719 - DNA, 25 bp, Mus musculus
tgtagacattccgttgaaccccagc

SEQ ID NO: 825720 - DNA, 25 bp, Mus musculus
tgtagacattgtcaccatgtaacgg

SEQ ID NO: 825721 - DNA, 25 bp, Mus musculus
tgtagacattgtgaccatgtaacgg

SEQ ID NO: 825722 - DNA, 25 bp, Mus musculus
tgtagaccagtgctgtcaagccctt

SEQ ID NO: 825723 - DNA, 25 bp, Mus musculus
tgtagaccagtggtgtcaagccctt

SEQ ID NO: 825724 - DNA, 25 bp, Mus musculus
tgtagacccaagacagaaagaacca

SEQ ID NO: 825725 - DNA, 25 bp, Mus musculus
tgtagacccaagtcagaaagaacca

SEQ ID NO: 825726 - DNA, 25 bp, Mus musculus
tgtagacccagtctcagcatcatgg

SEQ ID NO: 825727 - DNA, 25 bp, Mus musculus
tgtagacccagtgtcagcatcatgg

SEQ ID NO: 825728 - DNA, 25 bp, Mus musculus
tgtagacccattcctgtgaaagcag

SEQ ID NO: 825729 - DNA, 25 bp, Mus musculus
tgtagacccattgctgtgaaagcag

SEQ ID NO: 825730 - DNA, 25 bp, Mus musculus
tgtagaccctatactgggccaccag

SEQ ID NO: 825731 - DNA, 25 bp, Mus musculus
tgtagaccctattctgggccaccag

SEQ ID NO: 825732 - DNA, 25 bp, Mus musculus
tgtagaccctctacactatttctgt

SEQ ID NO: 825733 - DNA, 25 bp, Mus musculus
tgtagaccctcttcactatttctgt

SEQ ID NO: 825734 - DNA, 25 bp, Mus musculus
tgtagacctcttccgtaatgcggga

SEQ ID NO: 825735 - DNA, 25 bp, Mus musculus
tgtagacctcttgcgtaatgcggga

SEQ ID NO: 825736 - DNA, 25 bp, Mus musculus
tgtagacctgcaagtttgtaatccc

SEQ ID NO: 825737 - DNA, 25 bp, Mus musculus
tgtagacctgcatgtttgtaatccc

SEQ ID NO: 825738 - DNA, 25 bp, Mus musculus
tgtagacctggacaagtaccaccac

SEQ ID NO: 825739 - DNA, 25 bp, Mus musculus
tgtagacctggagaagtaccaccac

SEQ ID NO: 825740 - DNA, 25 bp, Mus musculus
tgtagacgcggcatctcggtgactg

SEQ ID NO: 825741 - DNA, 25 bp, Mus musculus
tgtagacgcggcttctcggtgactg

SEQ ID NO: 825742 - DNA, 25 bp, Mus musculus
tgtagacggcccatgctcactgcct

SEQ ID NO: 825743 - DNA, 25 bp, Mus musculus
tgtagacggcccttgctcactgcct

SEQ ID NO: 825744 - DNA, 25 bp, Mus musculus
tgtagactacaccaaaatgaagcct

SEQ ID NO: 825745 - DNA, 25 bp, Mus musculus
tgtagactacacgaaaatgaagcct

SEQ ID NO: 825746 - DNA, 25 bp, Mus musculus
tgtagactagaaatagtgagtccgg

SEQ ID NO: 825747 - DNA, 25 bp, Mus musculus
tgtagactagaattagtgagtccgg

SEQ ID NO: 825748 - DNA, 25 bp, Mus musculus
tgtagactatttctaacagcagaaa

SEQ ID NO: 825749 - DNA, 25 bp, Mus musculus
tgtagactatttgtaacagcagaaa

SEQ ID NO: 825750 - DNA, 25 bp, Mus musculus
tgtagactcaagatccaaaatatat

SEQ ID NO: 825751 - DNA, 25 bp, Mus musculus
tgtagactcaagttccaaaatatat

SEQ ID NO: 825752 - DNA, 25 bp, Mus musculus
tgtagactctgaagacctgattagc

SEQ ID NO: 825753 - DNA, 25 bp, Mus musculus
tgtagactctgatgacctgattagc

SEQ ID NO: 825754 - DNA, 25 bp, Mus musculus
tgtagactgcagagggagacaccct

SEQ ID NO: 825755 - DNA, 25 bp, Mus musculus
tgtagactgcagtgggagacaccct

SEQ ID NO: 825756 - DNA, 25 bp, Mus musculus
tgtagacttccaagatgttcaggac

SEQ ID NO: 825757 - DNA, 25 bp, Mus musculus
tgtagacttccatgatgttcaggac

SEQ ID NO: 825758 - DNA, 25 bp, Mus musculus
tgtagacttcgaatccatcagtgga

SEQ ID NO: 825759 - DNA, 25 bp, Mus musculus
tgtagacttcgattccatcagtgga

SEQ ID NO: 825760 - DNA, 25 bp, Mus musculus
tgtagacttgacactgagcaccaga

SEQ ID NO: 825761 - DNA, 25 bp, Mus musculus
tgtagacttgactctgagcaccaga

SEQ ID NO: 825762 - DNA, 25 bp, Mus musculus
tgtagagaatgcaacgcctgcctga

SEQ ID NO: 825763 - DNA, 25 bp, Mus musculus
tgtagagaatgctacgcctgcctga

SEQ ID NO: 825764 - DNA, 25 bp, Mus musculus
tgtagagatctgcatgaaacagcat

SEQ ID NO: 825765 - DNA, 25 bp, Mus musculus
tgtagagatctggatgaaacagcat

SEQ ID NO: 825766 - DNA, 25 bp, Mus musculus
tgtagagcagacacggattccagcc

SEQ ID NO: 825767 - DNA, 25 bp, Mus musculus
tgtagagcagactcggattccagcc

SEQ ID NO: 825768 - DNA, 25 bp, Mus musculus
tgtagagccaccagattgtgttgtg

SEQ ID NO: 825769 - DNA, 25 bp, Mus musculus
tgtagagccacctgattgtgttgtg

SEQ ID NO: 825770 - DNA, 25 bp, Mus musculus
tgtagagccctcaaaccacactcag

SEQ ID NO: 825771 - DNA, 25 bp, Mus musculus
tgtagagccctctaaccacactcag

SEQ ID NO: 825772 - DNA, 25 bp, Mus musculus
tgtagaggactaatgatcgctgcgg

SEQ ID NO: 825773 - DNA, 25 bp, Mus musculus
tgtagaggactattgatcgctgcgg

SEQ ID NO: 825774 - DNA, 25 bp, Mus musculus
tgtagaggagcaccgagcctcagct

SEQ ID NO: 825775 - DNA, 25 bp, Mus musculus
tgtagaggagcagcgagcctcagct

SEQ ID NO: 825776 - DNA, 25 bp, Mus musculus
tgtagaggccacataccaccttggg

SEQ ID NO: 825777 - DNA, 25 bp, Mus musculus
tgtagaggccacttaccaccttggg

SEQ ID NO: 825778 - DNA, 25 bp, Mus musculus
tgtagaggcctgcttcttcagtaag

SEQ ID NO: 825779 - DNA, 25 bp, Mus musculus
tgtagaggcctggttcttcagtaag

SEQ ID NO: 825780 - DNA, 25 bp, Mus musculus
tgtagagtatttagagggccagacc

SEQ ID NO: 825781 - DNA, 25 bp, Mus musculus
tgtagagtattttgagggccagacc

SEQ ID NO: 825782 - DNA, 25 bp, Mus musculus
tgtagagtcaagactgagacctggg

SEQ ID NO: 825783 - DNA, 25 bp, Mus musculus
tgtagagtcaagtctgagacctggg

SEQ ID NO: 825784 - DNA, 25 bp, Mus musculus
tgtagagttacgaaagaacctagcc

SEQ ID NO: 825785 - DNA, 25 bp, Mus musculus
tgtagagttacgtaagaacctagcc

SEQ ID NO: 825786 - DNA, 25 bp, Mus musculus
tgtagataacctcaagtgtgtgacc

SEQ ID NO: 825787 - DNA, 25 bp, Mus musculus
tgtagataacctgaagtgtgtgacc

SEQ ID NO: 825788 - DNA, 25 bp, Mus musculus
tgtagatacacaccccggaagaacg

SEQ ID NO: 825789 - DNA, 25 bp, Mus musculus
tgtagatacacagcccggaagaacg

SEQ ID NO: 825790 - DNA, 25 bp, Mus musculus
tgtagatcaagaataacagttcctc

SEQ ID NO: 825791 - DNA, 25 bp, Mus musculus
tgtagatcaagattaacagttcctc

SEQ ID NO: 825792 - DNA, 25 bp, Mus musculus
tgtagatcgtgaccagtatgagtcc

SEQ ID NO: 825793 - DNA, 25 bp, Mus musculus
tgtagatcgtgagcagtatgagtcc

SEQ ID NO: 825794 - DNA, 25 bp, Mus musculus
tgtagatgagtgacaagacaacaac

SEQ ID NO: 825795 - DNA, 25 bp, Mus musculus
tgtagatgagtgtcaagacaacaac

SEQ ID NO: 825796 - DNA, 25 bp, Mus musculus
tgtagatgcaatataccagcctagt

SEQ ID NO: 825797 - DNA, 25 bp, Mus musculus
tgtagatgcaatttaccagcctagt

SEQ ID NO: 825798 - DNA, 25 bp, Mus musculus
tgtagatggccgagatggaatacca

SEQ ID NO: 825799 - DNA, 25 bp, Mus musculus
tgtagatggccgtgatggaatacca

SEQ ID NO: 825800 - DNA, 25 bp, Mus musculus
tgtagatgtcttacgtcccagcaac

SEQ ID NO: 825801 - DNA, 25 bp, Mus musculus
tgtagatgtctttcgtcccagcaac

SEQ ID NO: 825802 - DNA, 25 bp, Mus musculus
tgtagatttattcgctgtgggagaa

SEQ ID NO: 825803 - DNA, 25 bp, Mus musculus
tgtagatttattggctgtgggagaa

SEQ ID NO: 825804 - DNA, 25 bp, Mus musculus
tgtagcaaaccacgcagagacatgt

SEQ ID NO: 825805 - DNA, 25 bp, Mus musculus
tgtagcaaaccaggcagagacatgt

SEQ ID NO: 825806 - DNA, 25 bp, Mus musculus
tgtagcaagaagaagggccagcctg

SEQ ID NO: 825807 - DNA, 25 bp, Mus musculus
tgtagcaagaagtagggccagcctg

SEQ ID NO: 825808 - DNA, 25 bp, Mus musculus
tgtagcaaggtgatggtgcttccca

SEQ ID NO: 825809 - DNA, 25 bp, Mus musculus
tgtagcaaggtgttggtgcttccca

SEQ ID NO: 825810 - DNA, 25 bp, Mus musculus
tgtagcactcttctaaagtgaacag

SEQ ID NO: 825811 - DNA, 25 bp, Mus musculus
tgtagcactcttgtaaagtgaacag

SEQ ID NO: 825812 - DNA, 25 bp, Mus musculus
tgtagcagagatcagcactctccct

SEQ ID NO: 825813 - DNA, 25 bp, Mus musculus
tgtagcagagatgagcactctccct

SEQ ID NO: 825814 - DNA, 25 bp, Mus musculus
tgtagcagcccacaggtatatggtg

SEQ ID NO: 825815 - DNA, 25 bp, Mus musculus
tgtagcagcccagaggtatatggtg

SEQ ID NO: 825816 - DNA, 25 bp, Mus musculus
tgtagcagctgacaaatcaacgcgt

SEQ ID NO: 825817 - DNA, 25 bp, Mus musculus
tgtagcagctgagaaatcaacgcgt

SEQ ID NO: 825818 - DNA, 25 bp, Mus musculus
tgtagcagctgcagttgatctggat

SEQ ID NO: 825819 - DNA, 25 bp, Mus musculus
tgtagcagctgctgttgatctggat

SEQ ID NO: 825820 - DNA, 25 bp, Mus musculus
tgtagcaggcttcactcggttccct

SEQ ID NO: 825821 - DNA, 25 bp, Mus musculus
tgtagcaggcttcattggaaccctg

SEQ ID NO: 825822 - DNA, 25 bp, Mus musculus
tgtagcaggcttgactcggttccct

SEQ ID NO: 825823 - DNA, 25 bp, Mus musculus
tgtagcaggcttgattggaaccctg

SEQ ID NO: 825824 - DNA, 25 bp, Mus musculus
tgtagcatcaaaccccatgcaatca

SEQ ID NO: 825825 - DNA, 25 bp, Mus musculus
tgtagcatcaaagcccatgcaatca

SEQ ID NO: 825826 - DNA, 25 bp, Mus musculus
tgtagcatgaacaacggcagctgtg

SEQ ID NO: 825827 - DNA, 25 bp, Mus musculus
tgtagcatgaactacggcagctgtg

SEQ ID NO: 825828 - DNA, 25 bp, Mus musculus
tgtagccaacctaactgtcacggac

SEQ ID NO: 825829 - DNA, 25 bp, Mus musculus
tgtagccaaccttactgtcacggac

SEQ ID NO: 825830 - DNA, 25 bp, Mus musculus
tgtagccaagacatcaaacatggag

SEQ ID NO: 825831 - DNA, 25 bp, Mus musculus
tgtagccaagacttcaaacatggag

SEQ ID NO: 825832 - DNA, 25 bp, Mus musculus
tgtagccagaagcacgtactcaggt

SEQ ID NO: 825833 - DNA, 25 bp, Mus musculus
tgtagccagaaggacgtactcaggt

SEQ ID NO: 825834 - DNA, 25 bp, Mus musculus
tgtagccaggatctagcccagttgg

SEQ ID NO: 825835 - DNA, 25 bp, Mus musculus
tgtagccaggatgtagcccagttgg

SEQ ID NO: 825836 - DNA, 25 bp, Mus musculus
tgtagccagtgaagagatcgcccag

SEQ ID NO: 825837 - DNA, 25 bp, Mus musculus
tgtagccagtgatgagatcgcccag

SEQ ID NO: 825838 - DNA, 25 bp, Mus musculus
tgtagccatcggagaccagatcttg

SEQ ID NO: 825839 - DNA, 25 bp, Mus musculus
tgtagccatcggtgaccagatcttg

SEQ ID NO: 825840 - DNA, 25 bp, Mus musculus
tgtagccatggcacctccgggagga

SEQ ID NO: 825841 - DNA, 25 bp, Mus musculus
tgtagccatggctcctccgggagga

SEQ ID NO: 825842 - DNA, 25 bp, Mus musculus
tgtagcccatacaagtccctaatgt

SEQ ID NO: 825843 - DNA, 25 bp, Mus musculus
tgtagcccatactagtccctaatgt

SEQ ID NO: 825844 - DNA, 25 bp, Mus musculus
tgtagccctgtactcccctcaaata

SEQ ID NO: 825845 - DNA, 25 bp, Mus musculus
tgtagccctgtagtcccctcaaata

SEQ ID NO: 825846 - DNA, 25 bp, Mus musculus
tgtagccgcctcaagaaacatgcgt

SEQ ID NO: 825847 - DNA, 25 bp, Mus musculus
tgtagccgcctctagaaacatgcgt

SEQ ID NO: 825848 - DNA, 25 bp, Mus musculus
tgtagccggtctacgctgagaggca

SEQ ID NO: 825849 - DNA, 25 bp, Mus musculus
tgtagccggtcttcgctgagaggca

SEQ ID NO: 825850 - DNA, 25 bp, Mus musculus
tgtagccgtagacatagtccatctg

SEQ ID NO: 825851 - DNA, 25 bp, Mus musculus
tgtagccgtagagatagtccatctg

SEQ ID NO: 825852 - DNA, 25 bp, Mus musculus
tgtagccgtcatcgtcaccgcattc

SEQ ID NO: 825853 - DNA, 25 bp, Mus musculus
tgtagccgtcatggtcaccgcattc

SEQ ID NO: 825854 - DNA, 25 bp, Mus musculus
tgtagccgtcctcggagcaaggaaa

SEQ ID NO: 825855 - DNA, 25 bp, Mus musculus
tgtagccgtcctgggagcaaggaaa

SEQ ID NO: 825856 - DNA, 25 bp, Mus musculus
tgtagccgtcggaggtcacagctgt

SEQ ID NO: 825857 - DNA, 25 bp, Mus musculus
tgtagccgtcggtggtcacagctgt

SEQ ID NO: 825858 - DNA, 25 bp, Mus musculus
tgtagccgtctgaggcgcctcctgt

SEQ ID NO: 825859 - DNA, 25 bp, Mus musculus
tgtagccgtctgtggcgcctcctgt

SEQ ID NO: 825860 - DNA, 25 bp, Mus musculus
tgtagccgttggagcatttcaatct

SEQ ID NO: 825861 - DNA, 25 bp, Mus musculus
tgtagccgttggtgcatttcaatct

SEQ ID NO: 825862 - DNA, 25 bp, Mus musculus
tgtagcctagctagagggccatgcc

SEQ ID NO: 825863 - DNA, 25 bp, Mus musculus
tgtagcctagctcgtctgagcatct

SEQ ID NO: 825864 - DNA, 25 bp, Mus musculus
tgtagcctagctggtctgagcatct

SEQ ID NO: 825865 - DNA, 25 bp, Mus musculus
tgtagcctagcttgagggccatgcc

SEQ ID NO: 825866 - DNA, 25 bp, Mus musculus
tgtagcctgagacgctttaaagcct

SEQ ID NO: 825867 - DNA, 25 bp, Mus musculus
tgtagcctgagaggctttaaagcct

SEQ ID NO: 825868 - DNA, 25 bp, Mus musculus
tgtagcctgctaccgacactcaagg

SEQ ID NO: 825869 - DNA, 25 bp, Mus musculus
tgtagcctgctagcgacactcaagg

SEQ ID NO: 825870 - DNA, 25 bp, Mus musculus
tgtagcctttctatatctgacccac

SEQ ID NO: 825871 - DNA, 25 bp, Mus musculus
tgtagcctttctttatctgacccac

SEQ ID NO: 825872 - DNA, 25 bp, Mus musculus
tgtagcgatgaaacctcactggcgt

SEQ ID NO: 825873 - DNA, 25 bp, Mus musculus
tgtagcgatgaatcctcactggcgt

SEQ ID NO: 825874 - DNA, 25 bp, Mus musculus
tgtagcgcgcacaataacccagttc

SEQ ID NO: 825875 - DNA, 25 bp, Mus musculus
tgtagcgcgcactataacccagttc

SEQ ID NO: 825876 - DNA, 25 bp, Mus musculus
tgtagctaagcgataagttggaact

SEQ ID NO: 825877 - DNA, 25 bp, Mus musculus
tgtagctaagcgttaagttggaact

SEQ ID NO: 825878 - DNA, 25 bp, Mus musculus
tgtagctacctccatgttgcttctg

SEQ ID NO: 825879 - DNA, 25 bp, Mus musculus
tgtagctacctcgatgttgcttctg

SEQ ID NO: 825880 - DNA, 25 bp, Mus musculus
tgtagctcataccaaggatgtcgcc

SEQ ID NO: 825881 - DNA, 25 bp, Mus musculus
tgtagctcatacgaaggatgtcgcc

SEQ ID NO: 825882 - DNA, 25 bp, Mus musculus
tgtagctccggcagctgtggaattt

SEQ ID NO: 825883 - DNA, 25 bp, Mus musculus
tgtagctccggctgctgtggaattt

SEQ ID NO: 825884 - DNA, 25 bp, Mus musculus
tgtagctccgtcagacatgatggac

SEQ ID NO: 825885 - DNA, 25 bp, Mus musculus
tgtagctccgtctgacatgatggac

SEQ ID NO: 825886 - DNA, 25 bp, Mus musculus
tgtagctcctgccagtagctccgtg

SEQ ID NO: 825887 - DNA, 25 bp, Mus musculus
tgtagctcctgcgagtagctccgtg

SEQ ID NO: 825888 - DNA, 25 bp, Mus musculus
tgtagctcctggagccaaagtctgg

SEQ ID NO: 825889 - DNA, 25 bp, Mus musculus
tgtagctcctggtgccaaagtctgg

SEQ ID NO: 825890 - DNA, 25 bp, Mus musculus
tgtagctcggaccaagaataacctg

SEQ ID NO: 825891 - DNA, 25 bp, Mus musculus
tgtagctcggacgaagaataacctg

SEQ ID NO: 825892 - DNA, 25 bp, Mus musculus
tgtagctctcctaaaccagccttga

SEQ ID NO: 825893 - DNA, 25 bp, Mus musculus
tgtagctctccttaaccagccttga

SEQ ID NO: 825894 - DNA, 25 bp, Mus musculus
tgtagctcttgaagccaccagttgg

SEQ ID NO: 825895 - DNA, 25 bp, Mus musculus
tgtagctcttgatgccaccagttgg

SEQ ID NO: 825896 - DNA, 25 bp, Mus musculus
tgtagctgacaactgtccccgggtg

SEQ ID NO: 825897 - DNA, 25 bp, Mus musculus
tgtagctgacaagtgtccccgggtg

SEQ ID NO: 825898 - DNA, 25 bp, Mus musculus
tgtagctgacagcacatttgaggga

SEQ ID NO: 825899 - DNA, 25 bp, Mus musculus
tgtagctgacaggacatttgaggga

SEQ ID NO: 825900 - DNA, 25 bp, Mus musculus
tgtagctgagaaatgaaactgttgc

SEQ ID NO: 825901 - DNA, 25 bp, Mus musculus
tgtagctgagaattgaaactgttgc

SEQ ID NO: 825902 - DNA, 25 bp, Mus musculus
tgtagctgcaatccacttgcagcag

SEQ ID NO: 825903 - DNA, 25 bp, Mus musculus
tgtagctgcaatgcacttgcagcag

SEQ ID NO: 825904 - DNA, 25 bp, Mus musculus
tgtagctgccacagatgaccgtgtc

SEQ ID NO: 825905 - DNA, 25 bp, Mus musculus
tgtagctgccactgatgaccgtgtc

SEQ ID NO: 825906 - DNA, 25 bp, Mus musculus
tgtagctgccgaagtccacaggaag

SEQ ID NO: 825907 - DNA, 25 bp, Mus musculus
tgtagctgccgatgtccacaggaag

SEQ ID NO: 825908 - DNA, 25 bp, Mus musculus
tgtagctgcgtcagaattctaccgc

SEQ ID NO: 825909 - DNA, 25 bp, Mus musculus
tgtagctgcgtctgaattctaccgc

SEQ ID NO: 825910 - DNA, 25 bp, Mus musculus
tgtagctgtggaaaaatggctggca

SEQ ID NO: 825911 - DNA, 25 bp, Mus musculus
tgtagctgtggataaatggctggca

SEQ ID NO: 825912 - DNA, 25 bp, Mus musculus
tgtagctgttctaaggccaccaggg

SEQ ID NO: 825913 - DNA, 25 bp, Mus musculus
tgtagctgttcttaggccaccaggg

SEQ ID NO: 825914 - DNA, 25 bp, Mus musculus
tgtagcttaaacactaaggccccat

SEQ ID NO: 825915 - DNA, 25 bp, Mus musculus
tgtagcttaaactctaaggccccat

SEQ ID NO: 825916 - DNA, 25 bp, Mus musculus
tgtagcttgggaacatttaatgacc

SEQ ID NO: 825917 - DNA, 25 bp, Mus musculus
tgtagcttgggatcatttaatgacc

SEQ ID NO: 825918 - DNA, 25 bp, Mus musculus
tgtagctttcgtcgacgtttcccgc

SEQ ID NO: 825919 - DNA, 25 bp, Mus musculus
tgtagctttcgtggacgtttcccgc

SEQ ID NO: 825920 - DNA, 25 bp, Mus musculus
tgtaggactggcctcagattcatgc

SEQ ID NO: 825921 - DNA, 25 bp, Mus musculus
tgtaggactggcgtcagattcatgc

SEQ ID NO: 825922 - DNA, 25 bp, Mus musculus
tgtaggagacaaccctctggacgtg

SEQ ID NO: 825923 - DNA, 25 bp, Mus musculus
tgtaggagacaagcctctggacgtg

SEQ ID NO: 825924 - DNA, 25 bp, Mus musculus
tgtaggagcaggcatcagacttttc

SEQ ID NO: 825925 - DNA, 25 bp, Mus musculus
tgtaggagcagggatcagacttttc

SEQ ID NO: 825926 - DNA, 25 bp, Mus musculus
tgtaggagttgcatggcccaaagtg

SEQ ID NO: 825927 - DNA, 25 bp, Mus musculus
tgtaggagttgcttggcccaaagtg

SEQ ID NO: 825928 - DNA, 25 bp, Mus musculus
tgtaggatccatcaagcacaggaca

SEQ ID NO: 825929 - DNA, 25 bp, Mus musculus
tgtaggatccatgaagcacaggaca

SEQ ID NO: 825930 - DNA, 25 bp, Mus musculus
tgtaggatggacacttcacgatagg

SEQ ID NO: 825931 - DNA, 25 bp, Mus musculus
tgtaggatggactcttcacgatagg

SEQ ID NO: 825932 - DNA, 25 bp, Mus musculus
tgtaggcacaggctacaaatccaac

SEQ ID NO: 825933 - DNA, 25 bp, Mus musculus
tgtaggcacagggtacaaatccaac

SEQ ID NO: 825934 - DNA, 25 bp, Mus musculus
tgtaggcacctgacatatacaaggc

SEQ ID NO: 825935 - DNA, 25 bp, Mus musculus
tgtaggcacctgtcatatacaaggc

SEQ ID NO: 825936 - DNA, 25 bp, Mus musculus
tgtaggcaccttatcctggccatcc

SEQ ID NO: 825937 - DNA, 25 bp, Mus musculus
tgtaggcaccttttcctggccatcc

SEQ ID NO: 825938 - DNA, 25 bp, Mus musculus
tgtaggcacgcgagtagacaagaat

SEQ ID NO: 825939 - DNA, 25 bp, Mus musculus
tgtaggcacgcgtgtagacaagaat

SEQ ID NO: 825940 - DNA, 25 bp, Mus musculus
tgtaggcactgaccatcaacaacta

SEQ ID NO: 825941 - DNA, 25 bp, Mus musculus
tgtaggcactgagcatcaacaacta

SEQ ID NO: 825942 - DNA, 25 bp, Mus musculus
tgtaggcagtgcataaacccagggc

SEQ ID NO: 825943 - DNA, 25 bp, Mus musculus
tgtaggcagtgcttaaacccagggc

SEQ ID NO: 825944 - DNA, 25 bp, Mus musculus
tgtaggcagttgactcaattttgcc

SEQ ID NO: 825945 - DNA, 25 bp, Mus musculus
tgtaggcagttgtctcaattttgcc

SEQ ID NO: 825946 - DNA, 25 bp, Mus musculus
tgtaggccccatcctacgcaagagg

SEQ ID NO: 825947 - DNA, 25 bp, Mus musculus
tgtaggccccatgctacgcaagagg

SEQ ID NO: 825948 - DNA, 25 bp, Mus musculus
tgtaggccgtgcacagaaaaaggta

SEQ ID NO: 825949 - DNA, 25 bp, Mus musculus
tgtaggccgtgctcagaaaaaggta

SEQ ID NO: 825950 - DNA, 25 bp, Mus musculus
tgtaggcggctacaaagcttaggct

SEQ ID NO: 825951 - DNA, 25 bp, Mus musculus
tgtaggcggctagaaagcttaggct

SEQ ID NO: 825952 - DNA, 25 bp, Mus musculus
tgtaggcgtcctcaggtcgccatga

SEQ ID NO: 825953 - DNA, 25 bp, Mus musculus
tgtaggcgtcctgaggtcgccatga

SEQ ID NO: 825954 - DNA, 25 bp, Mus musculus
tgtaggctccttcaaacaaagaggc

SEQ ID NO: 825955 - DNA, 25 bp, Mus musculus
tgtaggctccttgaaacaaagaggc

SEQ ID NO: 825956 - DNA, 25 bp, Mus musculus
tgtaggctgcctattccgggcggat

SEQ ID NO: 825957 - DNA, 25 bp, Mus musculus
tgtaggctgccttttccgggcggat

SEQ ID NO: 825958 - DNA, 25 bp, Mus musculus
tgtagggaaacaattcaacgtctcc

SEQ ID NO: 825959 - DNA, 25 bp, Mus musculus
tgtagggaaacatttcaacgtctcc

SEQ ID NO: 825960 - DNA, 25 bp, Mus musculus
tgtagggaaagtcgacaaccaagct

SEQ ID NO: 825961 - DNA, 25 bp, Mus musculus
tgtagggaaagtggacaaccaagct

SEQ ID NO: 825962 - DNA, 25 bp, Mus musculus
tgtagggatcccctgcctgtcaaag

SEQ ID NO: 825963 - DNA, 25 bp, Mus musculus
tgtagggatcccgtgcctgtcaaag

SEQ ID NO: 825964 - DNA, 25 bp, Mus musculus
tgtaggtacgagcagcgtagcacca

SEQ ID NO: 825965 - DNA, 25 bp, Mus musculus
tgtaggtacgaggagcgtagcacca

SEQ ID NO: 825966 - DNA, 25 bp, Mus musculus
tgtaggtcaaatcccaatgtgattt

SEQ ID NO: 825967 - DNA, 25 bp, Mus musculus
tgtaggtcaaatgccaatgtgattt

SEQ ID NO: 825968 - DNA, 25 bp, Mus musculus
tgtaggtctgacctggcactgaaac

SEQ ID NO: 825969 - DNA, 25 bp, Mus musculus
tgtaggtctgacgtggcactgaaac

SEQ ID NO: 825970 - DNA, 25 bp, Mus musculus
tgtaggtcttttactagacactgga

SEQ ID NO: 825971 - DNA, 25 bp, Mus musculus
tgtaggtctttttctagacactgga

SEQ ID NO: 825972 - DNA, 25 bp, Mus musculus
tgtaggtgaagtcctaaaacagtta

SEQ ID NO: 825973 - DNA, 25 bp, Mus musculus
tgtaggtgaagtgctaaaacagtta

SEQ ID NO: 825974 - DNA, 25 bp, Mus musculus
tgtaggtgccatagaaccccagttc

SEQ ID NO: 825975 - DNA, 25 bp, Mus musculus
tgtaggtgccattgaaccccagttc

SEQ ID NO: 825976 - DNA, 25 bp, Mus musculus
tgtaggtgttccctctacaatggat

SEQ ID NO: 825977 - DNA, 25 bp, Mus musculus
tgtaggtgttccgtctacaatggat

SEQ ID NO: 825978 - DNA, 25 bp, Mus musculus
tgtaggttctccaacactggtgaag

SEQ ID NO: 825979 - DNA, 25 bp, Mus musculus
tgtaggttctcctacactggtgaag

SEQ ID NO: 825980 - DNA, 25 bp, Mus musculus
tgtaggttgcaaacagggatctctg

SEQ ID NO: 825981 - DNA, 25 bp, Mus musculus
tgtaggttgcaatcagggatctctg

SEQ ID NO: 825982 - DNA, 25 bp, Mus musculus
tgtagtaaaccactcaagtccaaaa

SEQ ID NO: 825983 - DNA, 25 bp, Mus musculus
tgtagtaaaccagtcaagtccaaaa

SEQ ID NO: 825984 - DNA, 25 bp, Mus musculus
tgtagtaaatgcacactccccaagc

SEQ ID NO: 825985 - DNA, 25 bp, Mus musculus
tgtagtaaatgctcactccccaagc

SEQ ID NO: 825986 - DNA, 25 bp, Mus musculus
tgtagtaacacaaacgtcaggcttt

SEQ ID NO: 825987 - DNA, 25 bp, Mus musculus
tgtagtaacacatacgtcaggcttt

SEQ ID NO: 825988 - DNA, 25 bp, Mus musculus
tgtagtaacagacacgaaaattgtg

SEQ ID NO: 825989 - DNA, 25 bp, Mus musculus
tgtagtaacagagacgaaaattgtg

SEQ ID NO: 825990 - DNA, 25 bp, Mus musculus
tgtagtaccgcacaccacgtcggaa

SEQ ID NO: 825991 - DNA, 25 bp, Mus musculus
tgtagtaccgcagaccacgtcggaa

SEQ ID NO: 825992 - DNA, 25 bp, Mus musculus
tgtagtactccgaatgctatgaatc

SEQ ID NO: 825993 - DNA, 25 bp, Mus musculus
tgtagtactccgtatgctatgaatc

SEQ ID NO: 825994 - DNA, 25 bp, Mus musculus
tgtagtacttagacccaaagctacc

SEQ ID NO: 825995 - DNA, 25 bp, Mus musculus
tgtagtacttagtcccaaagctacc

SEQ ID NO: 825996 - DNA, 25 bp, Mus musculus
tgtagtcaagtaacaggcctcacgc

SEQ ID NO: 825997 - DNA, 25 bp, Mus musculus
tgtagtcaagtatcaggcctcacgc

SEQ ID NO: 825998 - DNA, 25 bp, Mus musculus
tgtagtcaagtcagattgcacactg

SEQ ID NO: 825999 - DNA, 25 bp, Mus musculus
tgtagtcaagtctgattgcacactg

SEQ ID NO: 826000 - DNA, 25 bp, Mus musculus
tgtagtcaccatcacaggaagtctg

SEQ ID NO: 826001 - DNA, 25 bp, Mus musculus
tgtagtcaccatgacaggaagtctg

SEQ ID NO: 826002 - DNA, 25 bp, Mus musculus
tgtagtcactaacagtcggcctgtc

SEQ ID NO: 826003 - DNA, 25 bp, Mus musculus
tgtagtcactaagagtcggcctgtc

SEQ ID NO: 826004 - DNA, 25 bp, Mus musculus
tgtagtcactacaaatcttaaattg

SEQ ID NO: 826005 - DNA, 25 bp, Mus musculus
tgtagtcactactaatcttaaattg

SEQ ID NO: 826006 - DNA, 25 bp, Mus musculus
tgtagtccactaccaccgtgcttgc

SEQ ID NO: 826007 - DNA, 25 bp, Mus musculus
tgtagtccactagcaccgtgcttgc

SEQ ID NO: 826008 - DNA, 25 bp, Mus musculus
tgtagtccaggaatttggcaacatc

SEQ ID NO: 826009 - DNA, 25 bp, Mus musculus
tgtagtccaggattttggcaacatc

SEQ ID NO: 826010 - DNA, 25 bp, Mus musculus
tgtagtccatggaagaaaaatgcct

SEQ ID NO: 826011 - DNA, 25 bp, Mus musculus
tgtagtccatggtagaaaaatgcct

SEQ ID NO: 826012 - DNA, 25 bp, Mus musculus
tgtagtcccctcaaataccgtcctt

SEQ ID NO: 826013 - DNA, 25 bp, Mus musculus
tgtagtcccctctaataccgtcctt

SEQ ID NO: 826014 - DNA, 25 bp, Mus musculus
tgtagtccgaaacttccagattccc

SEQ ID NO: 826015 - DNA, 25 bp, Mus musculus
tgtagtccgaaagttccagattccc

SEQ ID NO: 826016 - DNA, 25 bp, Mus musculus
tgtagtccttgcaaaagtgttactg

SEQ ID NO: 826017 - DNA, 25 bp, Mus musculus
tgtagtccttgctaaagtgttactg

SEQ ID NO: 826018 - DNA, 25 bp, Mus musculus
tgtagtcctttacacactgagaagg

SEQ ID NO: 826019 - DNA, 25 bp, Mus musculus
tgtagtcctttagacactgagaagg

SEQ ID NO: 826020 - DNA, 25 bp, Mus musculus
tgtagtcgcaccaggcaaccaagtg

SEQ ID NO: 826021 - DNA, 25 bp, Mus musculus
tgtagtcgcacctggcaaccaagtg

SEQ ID NO: 826022 - DNA, 25 bp, Mus musculus
tgtagtcgtggcaatcaaatggatc

SEQ ID NO: 826023 - DNA, 25 bp, Mus musculus
tgtagtcgtggctatcaaatggatc

SEQ ID NO: 826024 - DNA, 25 bp, Mus musculus
tgtagtctccggagcaggaaagatg

SEQ ID NO: 826025 - DNA, 25 bp, Mus musculus
tgtagtctccggtgcaggaaagatg

SEQ ID NO: 826026 - DNA, 25 bp, Mus musculus
tgtagtctgtggacacattactctg

SEQ ID NO: 826027 - DNA, 25 bp, Mus musculus
tgtagtctgtggtcacattactctg

SEQ ID NO: 826028 - DNA, 25 bp, Mus musculus
tgtagtcttcaaaatcccgtctggg

SEQ ID NO: 826029 - DNA, 25 bp, Mus musculus
tgtagtcttcaatatcccgtctggg

SEQ ID NO: 826030 - DNA, 25 bp, Mus musculus
tgtagtgaacaacccctggctcttc

SEQ ID NO: 826031 - DNA, 25 bp, Mus musculus
tgtagtgaacaagccctggctcttc

SEQ ID NO: 826032 - DNA, 25 bp, Mus musculus
tgtagtgcctcacccgggcagccga

SEQ ID NO: 826033 - DNA, 25 bp, Mus musculus
tgtagtgcctcagccgggcagccga

SEQ ID NO: 826034 - DNA, 25 bp, Mus musculus
tgtagtggaaaccatattggcgcac

SEQ ID NO: 826035 - DNA, 25 bp, Mus musculus
tgtagtggaaacgatattggcgcac

SEQ ID NO: 826036 - DNA, 25 bp, Mus musculus
tgtagtggccacagttaagtagcct

SEQ ID NO: 826037 - DNA, 25 bp, Mus musculus
tgtagtggccactgttaagtagcct

SEQ ID NO: 826038 - DNA, 25 bp, Mus musculus
tgtagtggccttcattctgcgccag

SEQ ID NO: 826039 - DNA, 25 bp, Mus musculus
tgtagtggccttgattctgcgccag

SEQ ID NO: 826040 - DNA, 25 bp, Mus musculus
tgtagtggcttgagaacctcctgta

SEQ ID NO: 826041 - DNA, 25 bp, Mus musculus
tgtagtggcttgtgaacctcctgta

SEQ ID NO: 826042 - DNA, 25 bp, Mus musculus
tgtagtggtgctatgattccggaca

SEQ ID NO: 826043 - DNA, 25 bp, Mus musculus
tgtagtggtgctttgattccggaca

SEQ ID NO: 826044 - DNA, 25 bp, Mus musculus
tgtagtgtccagagctaatagcatc

SEQ ID NO: 826045 - DNA, 25 bp, Mus musculus
tgtagtgtccagtgctaatagcatc

SEQ ID NO: 826046 - DNA, 25 bp, Mus musculus
tgtagtgtcttactgtcgtccagta

SEQ ID NO: 826047 - DNA, 25 bp, Mus musculus
tgtagtgtcttagtgtcgtccagta

SEQ ID NO: 826048 - DNA, 25 bp, Mus musculus
tgtagtgtgcagaggcgacatcaga

SEQ ID NO: 826049 - DNA, 25 bp, Mus musculus
tgtagtgtgcagtggcgacatcaga

SEQ ID NO: 826050 - DNA, 25 bp, Mus musculus
tgtagtgtgctaccaaatcaggaca

SEQ ID NO: 826051 - DNA, 25 bp, Mus musculus
tgtagtgtgctagcaaatcaggaca

SEQ ID NO: 826052 - DNA, 25 bp, Mus musculus
tgtagttcaggacagccaaccacaa

SEQ ID NO: 826053 - DNA, 25 bp, Mus musculus
tgtagttcaggagagccaaccacaa

SEQ ID NO: 826054 - DNA, 25 bp, Mus musculus
tgtagttccacacggtgctgtacag

SEQ ID NO: 826055 - DNA, 25 bp, Mus musculus
tgtagttccacagggtgctgtacag

SEQ ID NO: 826056 - DNA, 25 bp, Mus musculus
tgtagttccagaaaggtgtacttcc

SEQ ID NO: 826057 - DNA, 25 bp, Mus musculus
tgtagttccagataggtgtacttcc

SEQ ID NO: 826058 - DNA, 25 bp, Mus musculus
tgtagttccggaagccaagccggag

SEQ ID NO: 826059 - DNA, 25 bp, Mus musculus
tgtagttccggatgccaagccggag

SEQ ID NO: 826060 - DNA, 25 bp, Mus musculus
tgtagttcttgtccacaggtgccac

SEQ ID NO: 826061 - DNA, 25 bp, Mus musculus
tgtagttcttgtgcacaggtgccac

SEQ ID NO: 826062 - DNA, 25 bp, Mus musculus
tgtagttgagaacaagtttggcagc

SEQ ID NO: 826063 - DNA, 25 bp, Mus musculus
tgtagttgagaagaagtttggcagc

SEQ ID NO: 826064 - DNA, 25 bp, Mus musculus
tgtagttgcaaccagtctataagct

SEQ ID NO: 826065 - DNA, 25 bp, Mus musculus
tgtagttgcaacgagtctataagct

SEQ ID NO: 826066 - DNA, 25 bp, Mus musculus
tgtagttgccatccacggtataggt

SEQ ID NO: 826067 - DNA, 25 bp, Mus musculus
tgtagttgccatgcacggtataggt

SEQ ID NO: 826068 - DNA, 25 bp, Mus musculus
tgtagttgcggacagcttcagactc

SEQ ID NO: 826069 - DNA, 25 bp, Mus musculus
tgtagttgcggagagcttcagactc

SEQ ID NO: 826070 - DNA, 25 bp, Mus musculus
tgtataaaattgctaccaaaaagga

SEQ ID NO: 826071 - DNA, 25 bp, Mus musculus
tgtataaaattggtaccaaaaagga

SEQ ID NO: 826072 - DNA, 25 bp, Mus musculus
tgtataagactgatcaagcaagaag

SEQ ID NO: 826073 - DNA, 25 bp, Mus musculus
tgtataagactgttcaagcaagaag

SEQ ID NO: 826074 - DNA, 25 bp, Mus musculus
tgtataagggcacactaaaggataa

SEQ ID NO: 826075 - DNA, 25 bp, Mus musculus
tgtataagggcagactaaaggataa

SEQ ID NO: 826076 - DNA, 25 bp, Mus musculus
tgtataatattgacccagtctggcc

SEQ ID NO: 826077 - DNA, 25 bp, Mus musculus
tgtataatattgtcccagtctggcc

SEQ ID NO: 826078 - DNA, 25 bp, Mus musculus
tgtataatcctcatcatgagccagg

SEQ ID NO: 826079 - DNA, 25 bp, Mus musculus
tgtataatcctcttcatgagccagg

SEQ ID NO: 826080 - DNA, 25 bp, Mus musculus
tgtatacaaatgagtacgtggctat

SEQ ID NO: 826081 - DNA, 25 bp, Mus musculus
tgtatacaaatgtgtacgtggctat

SEQ ID NO: 826082 - DNA, 25 bp, Mus musculus
tgtatacaacaacactgccatcgcc

SEQ ID NO: 826083 - DNA, 25 bp, Mus musculus
tgtatacaacaagactgccatcgcc

SEQ ID NO: 826084 - DNA, 25 bp, Mus musculus
tgtatacaacacactgccctgcggg

SEQ ID NO: 826085 - DNA, 25 bp, Mus musculus
tgtatacaacactctgccctgcggg

SEQ ID NO: 826086 - DNA, 25 bp, Mus musculus
tgtatacatgaaccctgtactgtga

SEQ ID NO: 826087 - DNA, 25 bp, Mus musculus
tgtatacatgaagcctgtactgtga

SEQ ID NO: 826088 - DNA, 25 bp, Mus musculus
tgtatacatgccaatcccagaagat

SEQ ID NO: 826089 - DNA, 25 bp, Mus musculus
tgtatacatgcctatcccagaagat

SEQ ID NO: 826090 - DNA, 25 bp, Mus musculus
tgtatacattgccatccaccctgtc

SEQ ID NO: 826091 - DNA, 25 bp, Mus musculus
tgtatacattgcgatccaccctgtc

SEQ ID NO: 826092 - DNA, 25 bp, Mus musculus
tgtataccaggtcggcctgctgacc

SEQ ID NO: 826093 - DNA, 25 bp, Mus musculus
tgtataccaggtgggcctgctgacc

SEQ ID NO: 826094 - DNA, 25 bp, Mus musculus
tgtatacctaatcattatgccgagg

SEQ ID NO: 826095 - DNA, 25 bp, Mus musculus
tgtatacctaatgattatgccgagg

SEQ ID NO: 826096 - DNA, 25 bp, Mus musculus
tgtatacctatcacctctctgcaga

SEQ ID NO: 826097 - DNA, 25 bp, Mus musculus
tgtatacctatctcctctctgcaga

SEQ ID NO: 826098 - DNA, 25 bp, Mus musculus
tgtatactaggtattcctcagccaa

SEQ ID NO: 826099 - DNA, 25 bp, Mus musculus
tgtatactaggttttcctcagccaa

SEQ ID NO: 826100 - DNA, 25 bp, Mus musculus
tgtatactccacacccagagatgta

SEQ ID NO: 826101 - DNA, 25 bp, Mus musculus
tgtatactccactcccagagatgta

SEQ ID NO: 826102 - DNA, 25 bp, Mus musculus
tgtatactctatatttgggcaggaa

SEQ ID NO: 826103 - DNA, 25 bp, Mus musculus
tgtatactctatttttgggcaggaa

SEQ ID NO: 826104 - DNA, 25 bp, Mus musculus
tgtatactctcacctattgctctgt

SEQ ID NO: 826105 - DNA, 25 bp, Mus musculus
tgtatactctcagctattgctctgt

SEQ ID NO: 826106 - DNA, 25 bp, Mus musculus
tgtatactctgcaggagggccgtga

SEQ ID NO: 826107 - DNA, 25 bp, Mus musculus
tgtatactctgctggagggccgtga

SEQ ID NO: 826108 - DNA, 25 bp, Mus musculus
tgtatactggaaatgctcagattgc

SEQ ID NO: 826109 - DNA, 25 bp, Mus musculus
tgtatactggaattgctcagattgc

SEQ ID NO: 826110 - DNA, 25 bp, Mus musculus
tgtatactggcaacgtgatctacgc

SEQ ID NO: 826111 - DNA, 25 bp, Mus musculus
tgtatactggcatcgtgatctacgc

SEQ ID NO: 826112 - DNA, 25 bp, Mus musculus
tgtatacttgtcacccacgtgtggt

SEQ ID NO: 826113 - DNA, 25 bp, Mus musculus
tgtatacttgtctcccacgtgtggt

SEQ ID NO: 826114 - DNA, 25 bp, Mus musculus
tgtatagcagacagcggaacctggg

SEQ ID NO: 826115 - DNA, 25 bp, Mus musculus
tgtatagcagactgcggaacctggg

SEQ ID NO: 826116 - DNA, 25 bp, Mus musculus
tgtatagcatccatgaaggacaacc

SEQ ID NO: 826117 - DNA, 25 bp, Mus musculus
tgtatagcatccttgaaggacaacc

SEQ ID NO: 826118 - DNA, 25 bp, Mus musculus
tgtatagctgcgacacactgcccta

SEQ ID NO: 826119 - DNA, 25 bp, Mus musculus
tgtatagctgcgtcacactgcccta

SEQ ID NO: 826120 - DNA, 25 bp, Mus musculus
tgtatagggacacggtctctggaac

SEQ ID NO: 826121 - DNA, 25 bp, Mus musculus
tgtatagggacagggtctctggaac

SEQ ID NO: 826122 - DNA, 25 bp, Mus musculus
tgtatagggcacacaggtactggct

SEQ ID NO: 826123 - DNA, 25 bp, Mus musculus
tgtatagggcactcaggtactggct

SEQ ID NO: 826124 - DNA, 25 bp, Mus musculus
tgtatagttcctaagccttggcaag

SEQ ID NO: 826125 - DNA, 25 bp, Mus musculus
tgtatagttccttagccttggcaag

SEQ ID NO: 826126 - DNA, 25 bp, Mus musculus
tgtatataaaggctacggagaccgg

SEQ ID NO: 826127 - DNA, 25 bp, Mus musculus
tgtatataaagggtacggagaccgg

SEQ ID NO: 826128 - DNA, 25 bp, Mus musculus
tgtatatcaggtactgctgtgatga

SEQ ID NO: 826129 - DNA, 25 bp, Mus musculus
tgtatatcaggttctgctgtgatga

SEQ ID NO: 826130 - DNA, 25 bp, Mus musculus
tgtatatcagtgagaagcctcaaat

SEQ ID NO: 826131 - DNA, 25 bp, Mus musculus
tgtatatcagtgtgaagcctcaaat

SEQ ID NO: 826132 - DNA, 25 bp, Mus musculus
tgtatatcatctcaggactgactgg

SEQ ID NO: 826133 - DNA, 25 bp, Mus musculus
tgtatatcatctcgattacgtggct

SEQ ID NO: 826134 - DNA, 25 bp, Mus musculus
tgtatatcatctgaggactgactgg

SEQ ID NO: 826135 - DNA, 25 bp, Mus musculus
tgtatatcatctggattacgtggct

SEQ ID NO: 826136 - DNA, 25 bp, Mus musculus
tgtatatgaaatcgccaccctgaag

SEQ ID NO: 826137 - DNA, 25 bp, Mus musculus
tgtatatgaaatggccaccctgaag

SEQ ID NO: 826138 - DNA, 25 bp, Mus musculus
tgtatatgaagaacgaattccttct

SEQ ID NO: 826139 - DNA, 25 bp, Mus musculus
tgtatatgaagatcgaattccttct

SEQ ID NO: 826140 - DNA, 25 bp, Mus musculus
tgtatatgtgctcggtcagttcctg

SEQ ID NO: 826141 - DNA, 25 bp, Mus musculus
tgtatatgtgctgggtcagttcctg

SEQ ID NO: 826142 - DNA, 25 bp, Mus musculus
tgtatattcttaacagcactcagga

SEQ ID NO: 826143 - DNA, 25 bp, Mus musculus
tgtatattcttatcagcactcagga

SEQ ID NO: 826144 - DNA, 25 bp, Mus musculus
tgtatattgaagcatgctccccaga

SEQ ID NO: 826145 - DNA, 25 bp, Mus musculus
tgtatattgaaggatgctccccaga

SEQ ID NO: 826146 - DNA, 25 bp, Mus musculus
tgtatattgcatctacaggatcaca

SEQ ID NO: 826147 - DNA, 25 bp, Mus musculus
tgtatattgcatgtacaggatcaca

SEQ ID NO: 826148 - DNA, 25 bp, Mus musculus
tgtatattgggacaacgtgggcacc

SEQ ID NO: 826149 - DNA, 25 bp, Mus musculus
tgtatattgggagaacgtgggcacc

SEQ ID NO: 826150 - DNA, 25 bp, Mus musculus
tgtatcaaatctagaattcaagttc

SEQ ID NO: 826151 - DNA, 25 bp, Mus musculus
tgtatcaaatcttgaattcaagttc

SEQ ID NO: 826152 - DNA, 25 bp, Mus musculus
tgtatcaacctcaccttcgcgtatg

SEQ ID NO: 826153 - DNA, 25 bp, Mus musculus
tgtatcaacctctccttcgcgtatg

SEQ ID NO: 826154 - DNA, 25 bp, Mus musculus
tgtatcaagggaacagaagcttcgt

SEQ ID NO: 826155 - DNA, 25 bp, Mus musculus
tgtatcaagggatcagaagcttcgt

SEQ ID NO: 826156 - DNA, 25 bp, Mus musculus
tgtatcaatgaacgtgctgcccagc

SEQ ID NO: 826157 - DNA, 25 bp, Mus musculus
tgtatcaatgaaggtgctgcccagc

SEQ ID NO: 826158 - DNA, 25 bp, Mus musculus
tgtatcaatgacacttgacaaagaa

SEQ ID NO: 826159 - DNA, 25 bp, Mus musculus
tgtatcaatgactcttgacaaagaa

SEQ ID NO: 826160 - DNA, 25 bp, Mus musculus
tgtatcaatgcacggccaagtctac

SEQ ID NO: 826161 - DNA, 25 bp, Mus musculus
tgtatcaatgcagggccaagtctac

SEQ ID NO: 826162 - DNA, 25 bp, Mus musculus
tgtatcacaactccacaaatgtgca

SEQ ID NO: 826163 - DNA, 25 bp, Mus musculus
tgtatcacaactgcacaaatgtgca

SEQ ID NO: 826164 - DNA, 25 bp, Mus musculus
tgtatcacgtggatggcgtagacgt

SEQ ID NO: 826165 - DNA, 25 bp, Mus musculus
tgtatcacgtggttggcgtagacgt

SEQ ID NO: 826166 - DNA, 25 bp, Mus musculus
tgtatcacgttaactgccgctgcgg

SEQ ID NO: 826167 - DNA, 25 bp, Mus musculus
tgtatcacgttatctgccgctgcgg

SEQ ID NO: 826168 - DNA, 25 bp, Mus musculus
tgtatcacttgaagctgggctggag

SEQ ID NO: 826169 - DNA, 25 bp, Mus musculus
tgtatcacttgatgctgggctggag

SEQ ID NO: 826170 - DNA, 25 bp, Mus musculus
tgtatcagatctacattgatgagct

SEQ ID NO: 826171 - DNA, 25 bp, Mus musculus
tgtatcagatcttcattgatgagct

SEQ ID NO: 826172 - DNA, 25 bp, Mus musculus
tgtatcagcatgcagtggtttagag

SEQ ID NO: 826173 - DNA, 25 bp, Mus musculus
tgtatcagcatggagtggtttagag

SEQ ID NO: 826174 - DNA, 25 bp, Mus musculus
tgtatcagcattagaaaaccaccca

SEQ ID NO: 826175 - DNA, 25 bp, Mus musculus
tgtatcagcatttgaaaaccaccca

SEQ ID NO: 826176 - DNA, 25 bp, Mus musculus
tgtatcagcggtcagcacatcagtg

SEQ ID NO: 826177 - DNA, 25 bp, Mus musculus
tgtatcagcggtgagcacatcagtg

SEQ ID NO: 826178 - DNA, 25 bp, Mus musculus
tgtatcaggatgaccttccaaggca

SEQ ID NO: 826179 - DNA, 25 bp, Mus musculus
tgtatcaggatgtccttccaaggca

SEQ ID NO: 826180 - DNA, 25 bp, Mus musculus
tgtatcagggttcgcttcccctgcc

SEQ ID NO: 826181 - DNA, 25 bp, Mus musculus
tgtatcagggttggcttcccctgcc

SEQ ID NO: 826182 - DNA, 25 bp, Mus musculus
tgtatcatcctaaccagatcctggc

SEQ ID NO: 826183 - DNA, 25 bp, Mus musculus
tgtatcatcctatccagatcctggc

SEQ ID NO: 826184 - DNA, 25 bp, Mus musculus
tgtatcatcggcaagtcatccgtgg

SEQ ID NO: 826185 - DNA, 25 bp, Mus musculus
tgtatcatcggctagtcatccgtgg

SEQ ID NO: 826186 - DNA, 25 bp, Mus musculus
tgtatcatgcgacaagcaagaaaat

SEQ ID NO: 826187 - DNA, 25 bp, Mus musculus
tgtatcatgcgagaagcaagaaaat

SEQ ID NO: 826188 - DNA, 25 bp, Mus musculus
tgtatcatggcaaacttctactggc

SEQ ID NO: 826189 - DNA, 25 bp, Mus musculus
tgtatcatggcatacttctactggc

SEQ ID NO: 826190 - DNA, 25 bp, Mus musculus
tgtatccacggcagcaggcaatgca

SEQ ID NO: 826191 - DNA, 25 bp, Mus musculus
tgtatccacggctgcaggcaatgca

SEQ ID NO: 826192 - DNA, 25 bp, Mus musculus
tgtatccactgaacatctatctgct

SEQ ID NO: 826193 - DNA, 25 bp, Mus musculus
tgtatccactgatcatctatctgct

SEQ ID NO: 826194 - DNA, 25 bp, Mus musculus
tgtatccagagtctgtacaccagta

SEQ ID NO: 826195 - DNA, 25 bp, Mus musculus
tgtatccagagtgtgtacaccagta

SEQ ID NO: 826196 - DNA, 25 bp, Mus musculus
tgtatccatcgacatttggctgcca

SEQ ID NO: 826197 - DNA, 25 bp, Mus musculus
tgtatccatcgagatttggctgcca

SEQ ID NO: 826198 - DNA, 25 bp, Mus musculus
tgtatccccatcaaacgaccacaga

SEQ ID NO: 826199 - DNA, 25 bp, Mus musculus
tgtatccccatctaacgaccacaga

SEQ ID NO: 826200 - DNA, 25 bp, Mus musculus
tgtatcccctacactgtgctgctga

SEQ ID NO: 826201 - DNA, 25 bp, Mus musculus
tgtatcccctactctgtgctgctga

SEQ ID NO: 826202 - DNA, 25 bp, Mus musculus
tgtatccccttgctcattgtcatcc

SEQ ID NO: 826203 - DNA, 25 bp, Mus musculus
tgtatccccttggtcattgtcatcc

SEQ ID NO: 826204 - DNA, 25 bp, Mus musculus
tgtatcccgcgtcttggcaggctct

SEQ ID NO: 826205 - DNA, 25 bp, Mus musculus
tgtatcccgcgtgttggcaggctct

SEQ ID NO: 826206 - DNA, 25 bp, Mus musculus
tgtatcccggccacgctggatgctt

SEQ ID NO: 826207 - DNA, 25 bp, Mus musculus
tgtatcccggcctcgctggatgctt

SEQ ID NO: 826208 - DNA, 25 bp, Mus musculus
tgtatcccgtcccagtgagcccggg

SEQ ID NO: 826209 - DNA, 25 bp, Mus musculus
tgtatcccgtccgagtgagcccggg

SEQ ID NO: 826210 - DNA, 25 bp, Mus musculus
tgtatcccgtggcactaagtcccaa

SEQ ID NO: 826211 - DNA, 25 bp, Mus musculus
tgtatcccgtgggactaagtcccaa

SEQ ID NO: 826212 - DNA, 25 bp, Mus musculus
tgtatccgtgagcagaccctttgaa

SEQ ID NO: 826213 - DNA, 25 bp, Mus musculus
tgtatccgtgaggagaccctttgaa

SEQ ID NO: 826214 - DNA, 25 bp, Mus musculus
tgtatcctggagctttcaatctgac

SEQ ID NO: 826215 - DNA, 25 bp, Mus musculus
tgtatcctggaggtttcaatctgac

SEQ ID NO: 826216 - DNA, 25 bp, Mus musculus
tgtatccttcagcatgagccggcag

SEQ ID NO: 826217 - DNA, 25 bp, Mus musculus
tgtatccttcaggatgagccggcag

SEQ ID NO: 826218 - DNA, 25 bp, Mus musculus
tgtatccttcatctatctgaccttc

SEQ ID NO: 826219 - DNA, 25 bp, Mus musculus
tgtatccttcatgtatctgaccttc

SEQ ID NO: 826220 - DNA, 25 bp, Mus musculus
tgtatcgacctccagaagtcttgta

SEQ ID NO: 826221 - DNA, 25 bp, Mus musculus
tgtatcgacctcgagaagtcttgta

SEQ ID NO: 826222 - DNA, 25 bp, Mus musculus
tgtatcgagggccttactcaaatcc

SEQ ID NO: 826223 - DNA, 25 bp, Mus musculus
tgtatcgagggcgttactcaaatcc

SEQ ID NO: 826224 - DNA, 25 bp, Mus musculus
tgtatcgcaacacaaatgtcatgtg

SEQ ID NO: 826225 - DNA, 25 bp, Mus musculus
tgtatcgcaacagaaatgtcatgtg

SEQ ID NO: 826226 - DNA, 25 bp, Mus musculus
tgtatcgcacgactctcagccaaac

SEQ ID NO: 826227 - DNA, 25 bp, Mus musculus
tgtatcgcacgagtctcagccaaac

SEQ ID NO: 826228 - DNA, 25 bp, Mus musculus
tgtatcgcccctcagttttgcgaag

SEQ ID NO: 826229 - DNA, 25 bp, Mus musculus
tgtatcgcccctgagttttgcgaag

SEQ ID NO: 826230 - DNA, 25 bp, Mus musculus
tgtatcgcttgtctccatccaggca

SEQ ID NO: 826231 - DNA, 25 bp, Mus musculus
tgtatcgcttgtgtccatccaggca

SEQ ID NO: 826232 - DNA, 25 bp, Mus musculus
tgtatcgggataatatactcgcact

SEQ ID NO: 826233 - DNA, 25 bp, Mus musculus
tgtatcgggatattatactcgcact

SEQ ID NO: 826234 - DNA, 25 bp, Mus musculus
tgtatctaaagcacagactggtccc

SEQ ID NO: 826235 - DNA, 25 bp, Mus musculus
tgtatctaaagctcagactggtccc

SEQ ID NO: 826236 - DNA, 25 bp, Mus musculus
tgtatctaatgaatctcaagccttc

SEQ ID NO: 826237 - DNA, 25 bp, Mus musculus
tgtatctaatgattctcaagccttc

SEQ ID NO: 826238 - DNA, 25 bp, Mus musculus
tgtatctaatttattggaaccagag

SEQ ID NO: 826239 - DNA, 25 bp, Mus musculus
tgtatctaattttttggaaccagag

SEQ ID NO: 826240 - DNA, 25 bp, Mus musculus
tgtatctaccagactcaataggagg

SEQ ID NO: 826241 - DNA, 25 bp, Mus musculus
tgtatctaccagtctcaataggagg

SEQ ID NO: 826242 - DNA, 25 bp, Mus musculus
tgtatctacgttacctgcgctccca

SEQ ID NO: 826243 - DNA, 25 bp, Mus musculus
tgtatctacgtttcctgcgctccca

SEQ ID NO: 826244 - DNA, 25 bp, Mus musculus
tgtatctagacaacactaattgcaa

SEQ ID NO: 826245 - DNA, 25 bp, Mus musculus
tgtatctagacatcactaattgcaa

SEQ ID NO: 826246 - DNA, 25 bp, Mus musculus
tgtatctcagaaacttcaaagtgcc

SEQ ID NO: 826247 - DNA, 25 bp, Mus musculus
tgtatctcagaatcttcaaagtgcc

SEQ ID NO: 826248 - DNA, 25 bp, Mus musculus
tgtatctcagagctcacttttgtcc

SEQ ID NO: 826249 - DNA, 25 bp, Mus musculus
tgtatctcagaggtcacttttgtcc

SEQ ID NO: 826250 - DNA, 25 bp, Mus musculus
tgtatctccagtcgtgtgatgaagc

SEQ ID NO: 826251 - DNA, 25 bp, Mus musculus
tgtatctccagtggtgtgatgaagc

SEQ ID NO: 826252 - DNA, 25 bp, Mus musculus
tgtatctcccggagttaagtggtgg

SEQ ID NO: 826253 - DNA, 25 bp, Mus musculus
tgtatctcccggtgttaagtggtgg

SEQ ID NO: 826254 - DNA, 25 bp, Mus musculus
tgtatctctgccaaggacaccccag

SEQ ID NO: 826255 - DNA, 25 bp, Mus musculus
tgtatctctgccaggacctggcctc

SEQ ID NO: 826256 - DNA, 25 bp, Mus musculus
tgtatctctgcctaggacaccccag

SEQ ID NO: 826257 - DNA, 25 bp, Mus musculus
tgtatctctgcctggacctggcctc

SEQ ID NO: 826258 - DNA, 25 bp, Mus musculus
tgtatctgatatcattcggctacgg

SEQ ID NO: 826259 - DNA, 25 bp, Mus musculus
tgtatctgatatgattcggctacgg

SEQ ID NO: 826260 - DNA, 25 bp, Mus musculus
tgtatctgcagtatgaggaaggact

SEQ ID NO: 826261 - DNA, 25 bp, Mus musculus
tgtatctgcagtttgaggaaggact

SEQ ID NO: 826262 - DNA, 25 bp, Mus musculus
tgtatctgccttaaaaccaaagggc

SEQ ID NO: 826263 - DNA, 25 bp, Mus musculus
tgtatctgcctttaaaccaaagggc

SEQ ID NO: 826264 - DNA, 25 bp, Mus musculus
tgtatctgctgcactgccgttcctt

SEQ ID NO: 826265 - DNA, 25 bp, Mus musculus
tgtatctgctgctctgccgttcctt

SEQ ID NO: 826266 - DNA, 25 bp, Mus musculus
tgtatctggactctcaaaagccaag

SEQ ID NO: 826267 - DNA, 25 bp, Mus musculus
tgtatctggactgtcaaaagccaag

SEQ ID NO: 826268 - DNA, 25 bp, Mus musculus
tgtatctggataatatgcatgcact

SEQ ID NO: 826269 - DNA, 25 bp, Mus musculus
tgtatctggatattatgcatgcact

SEQ ID NO: 826270 - DNA, 25 bp, Mus musculus
tgtatctggcctagcggaacttcga

SEQ ID NO: 826271 - DNA, 25 bp, Mus musculus
tgtatctggccttgcggaacttcga

SEQ ID NO: 826272 - DNA, 25 bp, Mus musculus
tgtatctggctcactgaagaattct

SEQ ID NO: 826273 - DNA, 25 bp, Mus musculus
tgtatctggctctctgaagaattct

SEQ ID NO: 826274 - DNA, 25 bp, Mus musculus
tgtatctgtgccctttgtcttacca

SEQ ID NO: 826275 - DNA, 25 bp, Mus musculus
tgtatctgtgccgtttgtcttacca

SEQ ID NO: 826276 - DNA, 25 bp, Mus musculus
tgtatcttaggaaaccagtgtcacc

SEQ ID NO: 826277 - DNA, 25 bp, Mus musculus
tgtatcttaggataccagtgtcacc

SEQ ID NO: 826278 - DNA, 25 bp, Mus musculus
tgtatgaaaagcatgctaattggac

SEQ ID NO: 826279 - DNA, 25 bp, Mus musculus
tgtatgaaaagcttgctaattggac

SEQ ID NO: 826280 - DNA, 25 bp, Mus musculus
tgtatgaacaatatatcgaccacag

SEQ ID NO: 826281 - DNA, 25 bp, Mus musculus
tgtatgaacaatttatcgaccacag

SEQ ID NO: 826282 - DNA, 25 bp, Mus musculus
tgtatgaagaagatgccgtgcctgg

SEQ ID NO: 826283 - DNA, 25 bp, Mus musculus
tgtatgaagaagttgccgtgcctgg

SEQ ID NO: 826284 - DNA, 25 bp, Mus musculus
tgtatgaagcagaactacagactct

SEQ ID NO: 826285 - DNA, 25 bp, Mus musculus
tgtatgaagcagtactacagactct

SEQ ID NO: 826286 - DNA, 25 bp, Mus musculus
tgtatgaagtataacgggaagatga

SEQ ID NO: 826287 - DNA, 25 bp, Mus musculus
tgtatgaagtattacgggaagatga

SEQ ID NO: 826288 - DNA, 25 bp, Mus musculus
tgtatgaagttgagcctacctcctc

SEQ ID NO: 826289 - DNA, 25 bp, Mus musculus
tgtatgaagttgtgcctacctcctc

SEQ ID NO: 826290 - DNA, 25 bp, Mus musculus
tgtatgacatcaacaccttccagtg

SEQ ID NO: 826291 - DNA, 25 bp, Mus musculus
tgtatgacatcatcaccttccagtg

SEQ ID NO: 826292 - DNA, 25 bp, Mus musculus
tgtatgacatgtaccacactcgcaa

SEQ ID NO: 826293 - DNA, 25 bp, Mus musculus
tgtatgacatgttccacactcgcaa

SEQ ID NO: 826294 - DNA, 25 bp, Mus musculus
tgtatgaccagtactgcaaggacca

SEQ ID NO: 826295 - DNA, 25 bp, Mus musculus
tgtatgaccagttctgcaaggacca

SEQ ID NO: 826296 - DNA, 25 bp, Mus musculus
tgtatgaccatgctgtcaacccagt

SEQ ID NO: 826297 - DNA, 25 bp, Mus musculus
tgtatgaccatggtgtcaacccagt

SEQ ID NO: 826298 - DNA, 25 bp, Mus musculus
tgtatgaccgaaacctggacctgcg

SEQ ID NO: 826299 - DNA, 25 bp, Mus musculus
tgtatgaccgaatcctggacctgcg

SEQ ID NO: 826300 - DNA, 25 bp, Mus musculus
tgtatgactttgacaacagtgggaa

SEQ ID NO: 826301 - DNA, 25 bp, Mus musculus
tgtatgactttgtcaacagtgggaa

SEQ ID NO: 826302 - DNA, 25 bp, Mus musculus
tgtatgagaagaaggtgtgcatctg

SEQ ID NO: 826303 - DNA, 25 bp, Mus musculus
tgtatgagaagatggtgtgcatctg

SEQ ID NO: 826304 - DNA, 25 bp, Mus musculus
tgtatgagaaggacaacacctattt

SEQ ID NO: 826305 - DNA, 25 bp, Mus musculus
tgtatgagaaggtcaacacctattt

SEQ ID NO: 826306 - DNA, 25 bp, Mus musculus
tgtatgagacagacgtgtacgtggt

SEQ ID NO: 826307 - DNA, 25 bp, Mus musculus
tgtatgagacagtcgtgtacgtggt

SEQ ID NO: 826308 - DNA, 25 bp, Mus musculus
tgtatgagatggaagttgacacact

SEQ ID NO: 826309 - DNA, 25 bp, Mus musculus
tgtatgagatggtagttgacacact

SEQ ID NO: 826310 - DNA, 25 bp, Mus musculus
tgtatgagcggaagctcttggcacg

SEQ ID NO: 826311 - DNA, 25 bp, Mus musculus
tgtatgagcggatgctcttggcacg

SEQ ID NO: 826312 - DNA, 25 bp, Mus musculus
tgtatgagctcaccctttgccacgt

SEQ ID NO: 826313 - DNA, 25 bp, Mus musculus
tgtatgagctcagcctttgccacgt

SEQ ID NO: 826314 - DNA, 25 bp, Mus musculus
tgtatgaggtgcatgcagcgtcccg

SEQ ID NO: 826315 - DNA, 25 bp, Mus musculus
tgtatgaggtgcttgcagcgtcccg

SEQ ID NO: 826316 - DNA, 25 bp, Mus musculus
tgtatgagttctcgcaggatgaagc

SEQ ID NO: 826317 - DNA, 25 bp, Mus musculus
tgtatgagttctggcaggatgaagc

SEQ ID NO: 826318 - DNA, 25 bp, Mus musculus
tgtatgataagaagccagtaggacc

SEQ ID NO: 826319 - DNA, 25 bp, Mus musculus
tgtatgataagatgccagtaggacc

SEQ ID NO: 826320 - DNA, 25 bp, Mus musculus
tgtatgatatgcacataagctcttc

SEQ ID NO: 826321 - DNA, 25 bp, Mus musculus
tgtatgatatgctcataagctcttc

SEQ ID NO: 826322 - DNA, 25 bp, Mus musculus
tgtatgatgatgcagtgggtttccc

SEQ ID NO: 826323 - DNA, 25 bp, Mus musculus
tgtatgatgatggagtgggtttccc

SEQ ID NO: 826324 - DNA, 25 bp, Mus musculus
tgtatgatgctgataagggcttcct

SEQ ID NO: 826325 - DNA, 25 bp, Mus musculus
tgtatgatgctgttaagggcttcct

SEQ ID NO: 826326 - DNA, 25 bp, Mus musculus
tgtatgatttgccacatctgaggaa

SEQ ID NO: 826327 - DNA, 25 bp, Mus musculus
tgtatgatttgcgacatctgaggaa

SEQ ID NO: 826328 - DNA, 25 bp, Mus musculus
tgtatgcaaacaaaatcacaacaga

SEQ ID NO: 826329 - DNA, 25 bp, Mus musculus
tgtatgcaaacataatcacaacaga

SEQ ID NO: 826330 - DNA, 25 bp, Mus musculus
tgtatgcacgctaccaggtcacgca

SEQ ID NO: 826331 - DNA, 25 bp, Mus musculus
tgtatgcacgcttccaggtcacgca

SEQ ID NO: 826332 - DNA, 25 bp, Mus musculus
tgtatgcactcactgccctggctct

SEQ ID NO: 826333 - DNA, 25 bp, Mus musculus
tgtatgcactcagtgccctggctct

SEQ ID NO: 826334 - DNA, 25 bp, Mus musculus
tgtatgcagaagaaaaagaagccgt

SEQ ID NO: 826335 - DNA, 25 bp, Mus musculus
tgtatgcagaagtaaaagaagccgt

SEQ ID NO: 826336 - DNA, 25 bp, Mus musculus
tgtatgcagccgagtgtgccacaca

SEQ ID NO: 826337 - DNA, 25 bp, Mus musculus
tgtatgcagccgtgtgtgccacaca

SEQ ID NO: 826338 - DNA, 25 bp, Mus musculus
tgtatgcagctcataaatgctctcg

SEQ ID NO: 826339 - DNA, 25 bp, Mus musculus
tgtatgcagctcttaaatgctctcg

SEQ ID NO: 826340 - DNA, 25 bp, Mus musculus
tgtatgcatccaacgccatcttctc

SEQ ID NO: 826341 - DNA, 25 bp, Mus musculus
tgtatgcatccatcgccatcttctc

SEQ ID NO: 826342 - DNA, 25 bp, Mus musculus
tgtatgccaagacagatttgaccgc

SEQ ID NO: 826343 - DNA, 25 bp, Mus musculus
tgtatgccaagagagatttgaccgc

SEQ ID NO: 826344 - DNA, 25 bp, Mus musculus
tgtatgccatgcctgtcgggaacct

SEQ ID NO: 826345 - DNA, 25 bp, Mus musculus
tgtatgccatgcgtgtcgggaacct

SEQ ID NO: 826346 - DNA, 25 bp, Mus musculus
tgtatgcctggtagatgctgacaag

SEQ ID NO: 826347 - DNA, 25 bp, Mus musculus
tgtatgcctggttgatgctgacaag

SEQ ID NO: 826348 - DNA, 25 bp, Mus musculus
tgtatgccttgcaggtaactcacct

SEQ ID NO: 826349 - DNA, 25 bp, Mus musculus
tgtatgccttgctggtaactcacct

SEQ ID NO: 826350 - DNA, 25 bp, Mus musculus
tgtatgcgaacaacggctctgtgct

SEQ ID NO: 826351 - DNA, 25 bp, Mus musculus
tgtatgcgaacatcggctctgtgct

SEQ ID NO: 826352 - DNA, 25 bp, Mus musculus
tgtatgcgaggtcggaaccttttgc

SEQ ID NO: 826353 - DNA, 25 bp, Mus musculus
tgtatgcgaggtgggaaccttttgc

SEQ ID NO: 826354 - DNA, 25 bp, Mus musculus
tgtatgcgccgtactagagtcccca

SEQ ID NO: 826355 - DNA, 25 bp, Mus musculus
tgtatgcgccgttctagagtcccca

SEQ ID NO: 826356 - DNA, 25 bp, Mus musculus
tgtatgcgtgcaacagtaggcggcc

SEQ ID NO: 826357 - DNA, 25 bp, Mus musculus
tgtatgcgtgcatcagtaggcggcc

SEQ ID NO: 826358 - DNA, 25 bp, Mus musculus
tgtatgctataaactctataccgcc

SEQ ID NO: 826359 - DNA, 25 bp, Mus musculus
tgtatgctataatctctataccgcc

SEQ ID NO: 826360 - DNA, 25 bp, Mus musculus
tgtatgctcctcatgtcctctatga

SEQ ID NO: 826361 - DNA, 25 bp, Mus musculus
tgtatgctcctcttgtcctctatga

SEQ ID NO: 826362 - DNA, 25 bp, Mus musculus
tgtatgctcgagacaaacgcttcca

SEQ ID NO: 826363 - DNA, 25 bp, Mus musculus
tgtatgctcgagtcaaacgcttcca

SEQ ID NO: 826364 - DNA, 25 bp, Mus musculus
tgtatggaaataattgagagccggg

SEQ ID NO: 826365 - DNA, 25 bp, Mus musculus
tgtatggaaatatttgagagccggg

SEQ ID NO: 826366 - DNA, 25 bp, Mus musculus
tgtatggaaatgcactgtatcgacc

SEQ ID NO: 826367 - DNA, 25 bp, Mus musculus
tgtatggaaatggactgtatcgacc

SEQ ID NO: 826368 - DNA, 25 bp, Mus musculus
tgtatggaagtaacagcggtatcat

SEQ ID NO: 826369 - DNA, 25 bp, Mus musculus
tgtatggaagtatcagcggtatcat

SEQ ID NO: 826370 - DNA, 25 bp, Mus musculus
tgtatggacgccaccttggccatca

SEQ ID NO: 826371 - DNA, 25 bp, Mus musculus
tgtatggacgcctccttggccatca

SEQ ID NO: 826372 - DNA, 25 bp, Mus musculus
tgtatggactagcagagatatttcc

SEQ ID NO: 826373 - DNA, 25 bp, Mus musculus
tgtatggactaggagagatatttcc

SEQ ID NO: 826374 - DNA, 25 bp, Mus musculus
tgtatggagacaaaattcttgatga

SEQ ID NO: 826375 - DNA, 25 bp, Mus musculus
tgtatggagacataattcttgatga

SEQ ID NO: 826376 - DNA, 25 bp, Mus musculus
tgtatggcatccagcgggccccacg

SEQ ID NO: 826377 - DNA, 25 bp, Mus musculus
tgtatggcatcctgcgggccccacg

SEQ ID NO: 826378 - DNA, 25 bp, Mus musculus
tgtatggccacacctcaactctggc

SEQ ID NO: 826379 - DNA, 25 bp, Mus musculus
tgtatggccacagctcaactctggc

SEQ ID NO: 826380 - DNA, 25 bp, Mus musculus
tgtatggccccaaccctcatacttt

SEQ ID NO: 826381 - DNA, 25 bp, Mus musculus
tgtatggccccatccctcatacttt

SEQ ID NO: 826382 - DNA, 25 bp, Mus musculus
tgtatggccctcaggtctcgttctt

SEQ ID NO: 826383 - DNA, 25 bp, Mus musculus
tgtatggccctctggtctcgttctt

SEQ ID NO: 826384 - DNA, 25 bp, Mus musculus
tgtatggctaatcatcaagtcttgg

SEQ ID NO: 826385 - DNA, 25 bp, Mus musculus
tgtatggctaatgatcaagtcttgg

SEQ ID NO: 826386 - DNA, 25 bp, Mus musculus
tgtatgggactcaatctattgctgt

SEQ ID NO: 826387 - DNA, 25 bp, Mus musculus
tgtatgggactctatctattgctgt

SEQ ID NO: 826388 - DNA, 25 bp, Mus musculus
tgtatgggcgcaaacactgttaccg

SEQ ID NO: 826389 - DNA, 25 bp, Mus musculus
tgtatgggcgcatacactgttaccg

SEQ ID NO: 826390 - DNA, 25 bp, Mus musculus
tgtatggtacatcgataatccacag

SEQ ID NO: 826391 - DNA, 25 bp, Mus musculus
tgtatggtacatggataatccacag

SEQ ID NO: 826392 - DNA, 25 bp, Mus musculus
tgtatggtgcctccagactcttaga

SEQ ID NO: 826393 - DNA, 25 bp, Mus musculus
tgtatggtgcctgcagactcttaga

SEQ ID NO: 826394 - DNA, 25 bp, Mus musculus
tgtatgtacatgcatcagtgagaac

SEQ ID NO: 826395 - DNA, 25 bp, Mus musculus
tgtatgtacatggatcagtgagaac

SEQ ID NO: 826396 - DNA, 25 bp, Mus musculus
tgtatgtcatcccattcagcatggg

SEQ ID NO: 826397 - DNA, 25 bp, Mus musculus
tgtatgtcatccgattcagcatggg

SEQ ID NO: 826398 - DNA, 25 bp, Mus musculus
tgtatgtcttcgaggatatccggat

SEQ ID NO: 826399 - DNA, 25 bp, Mus musculus
tgtatgtcttcgtggatatccggat

SEQ ID NO: 826400 - DNA, 25 bp, Mus musculus
tgtatgtgaatacccgtgcctggcc

SEQ ID NO: 826401 - DNA, 25 bp, Mus musculus
tgtatgtgaatagccgtgcctggcc

SEQ ID NO: 826402 - DNA, 25 bp, Mus musculus
tgtatgtgacctaaagcatgtaact

SEQ ID NO: 826403 - DNA, 25 bp, Mus musculus
tgtatgtgacctagccattaaccgc

SEQ ID NO: 826404 - DNA, 25 bp, Mus musculus
tgtatgtgaccttaagcatgtaact

SEQ ID NO: 826405 - DNA, 25 bp, Mus musculus
tgtatgtgaccttgccattaaccgc

SEQ ID NO: 826406 - DNA, 25 bp, Mus musculus
tgtatgtgagttcttcagtccccag

SEQ ID NO: 826407 - DNA, 25 bp, Mus musculus
tgtatgtgagttgttcagtccccag

SEQ ID NO: 826408 - DNA, 25 bp, Mus musculus
tgtatgtgatggatctgtctgagca

SEQ ID NO: 826409 - DNA, 25 bp, Mus musculus
tgtatgtgatggttctgtctgagca

SEQ ID NO: 826410 - DNA, 25 bp, Mus musculus
tgtatgtgcaaaagcgctctcatgc

SEQ ID NO: 826411 - DNA, 25 bp, Mus musculus
tgtatgtgcaaatgcgctctcatgc

SEQ ID NO: 826412 - DNA, 25 bp, Mus musculus
tgtatgtgccctccaggcagatgcc

SEQ ID NO: 826413 - DNA, 25 bp, Mus musculus
tgtatgtgccctgcaggcagatgcc

SEQ ID NO: 826414 - DNA, 25 bp, Mus musculus
tgtatgtgcggaaacacacacgtgc

SEQ ID NO: 826415 - DNA, 25 bp, Mus musculus
tgtatgtgcggatacacacacgtgc

SEQ ID NO: 826416 - DNA, 25 bp, Mus musculus
tgtatgtggaaaccacggatgccag

SEQ ID NO: 826417 - DNA, 25 bp, Mus musculus
tgtatgtggaaagcacggatgccag

SEQ ID NO: 826418 - DNA, 25 bp, Mus musculus
tgtatgtgggtacggatagaaccca

SEQ ID NO: 826419 - DNA, 25 bp, Mus musculus
tgtatgtgggtagggatagaaccca

SEQ ID NO: 826420 - DNA, 25 bp, Mus musculus
tgtatgtggtggcattcgcggagac

SEQ ID NO: 826421 - DNA, 25 bp, Mus musculus
tgtatgtggtgggattcgcggagac

SEQ ID NO: 826422 - DNA, 25 bp, Mus musculus
tgtatgtgtgcgagtatgagcgccc

SEQ ID NO: 826423 - DNA, 25 bp, Mus musculus
tgtatgtgtgcgtgtatgagcgccc

SEQ ID NO: 826424 - DNA, 25 bp, Mus musculus
tgtattaaacctcgacttagccctg

SEQ ID NO: 826425 - DNA, 25 bp, Mus musculus
tgtattaaacctggacttagccctg

SEQ ID NO: 826426 - DNA, 25 bp, Mus musculus
tgtattaacccacgctcccatttgc

SEQ ID NO: 826427 - DNA, 25 bp, Mus musculus
tgtattaacccaggctcccatttgc

SEQ ID NO: 826428 - DNA, 25 bp, Mus musculus
tgtattaactaactatatgctccgt

SEQ ID NO: 826429 - DNA, 25 bp, Mus musculus
tgtattaactaagtatatgctccgt

SEQ ID NO: 826430 - DNA, 25 bp, Mus musculus
tgtattaccctccaaagaaacggca

SEQ ID NO: 826431 - DNA, 25 bp, Mus musculus
tgtattaccctcgaaagaaacggca

SEQ ID NO: 826432 - DNA, 25 bp, Mus musculus
tgtattagtagtctatggacttgcc

SEQ ID NO: 826433 - DNA, 25 bp, Mus musculus
tgtattagtagtgtatggacttgcc

SEQ ID NO: 826434 - DNA, 25 bp, Mus musculus
tgtattatacgtctccctgcaccgg

SEQ ID NO: 826435 - DNA, 25 bp, Mus musculus
tgtattatacgtgtccctgcaccgg

SEQ ID NO: 826436 - DNA, 25 bp, Mus musculus
tgtattcaaaggatcccaagcactg

SEQ ID NO: 826437 - DNA, 25 bp, Mus musculus
tgtattcaaaggttcccaagcactg

SEQ ID NO: 826438 - DNA, 25 bp, Mus musculus
tgtattcactgcaccactggctgga

SEQ ID NO: 826439 - DNA, 25 bp, Mus musculus
tgtattcactgctccactggctgga

SEQ ID NO: 826440 - DNA, 25 bp, Mus musculus
tgtattcagagtcaacttcatcggg

SEQ ID NO: 826441 - DNA, 25 bp, Mus musculus
tgtattcagagtgaacttcatcggg

SEQ ID NO: 826442 - DNA, 25 bp, Mus musculus
tgtattcagcacatcgccctgttgc

SEQ ID NO: 826443 - DNA, 25 bp, Mus musculus
tgtattcagcacttcgccctgttgc

SEQ ID NO: 826444 - DNA, 25 bp, Mus musculus
tgtattcagcctccagctttacttt

SEQ ID NO: 826445 - DNA, 25 bp, Mus musculus
tgtattcagcctgcagctttacttt

SEQ ID NO: 826446 - DNA, 25 bp, Mus musculus
tgtattccaatactatgtggccagc

SEQ ID NO: 826447 - DNA, 25 bp, Mus musculus
tgtattccaatagtatgtggccagc

SEQ ID NO: 826448 - DNA, 25 bp, Mus musculus
tgtattccccagaaagtctgtttgc

SEQ ID NO: 826449 - DNA, 25 bp, Mus musculus
tgtattccccagcatatatctcctg

SEQ ID NO: 826450 - DNA, 25 bp, Mus musculus
tgtattccccaggatatatctcctg

SEQ ID NO: 826451 - DNA, 25 bp, Mus musculus
tgtattccccagtaagtctgtttgc

SEQ ID NO: 826452 - DNA, 25 bp, Mus musculus
tgtattccccttctgcaacatcagt

SEQ ID NO: 826453 - DNA, 25 bp, Mus musculus
tgtattccccttgtgcaacatcagt

SEQ ID NO: 826454 - DNA, 25 bp, Mus musculus
tgtattccctacataaggagcaacc

SEQ ID NO: 826455 - DNA, 25 bp, Mus musculus
tgtattccctacttaaggagcaacc

SEQ ID NO: 826456 - DNA, 25 bp, Mus musculus
tgtattccgaagagtttttccagca

SEQ ID NO: 826457 - DNA, 25 bp, Mus musculus
tgtattccgaagtgtttttccagca

SEQ ID NO: 826458 - DNA, 25 bp, Mus musculus
tgtattccgtaaacttcctcaggag

SEQ ID NO: 826459 - DNA, 25 bp, Mus musculus
tgtattccgtaatcttcctcaggag

SEQ ID NO: 826460 - DNA, 25 bp, Mus musculus
tgtattcctggactagtttccctgg

SEQ ID NO: 826461 - DNA, 25 bp, Mus musculus
tgtattcctggagtagtttccctgg

SEQ ID NO: 826462 - DNA, 25 bp, Mus musculus
tgtattctctcacatcccagctgtg

SEQ ID NO: 826463 - DNA, 25 bp, Mus musculus
tgtattctctcacccagcgttccat

SEQ ID NO: 826464 - DNA, 25 bp, Mus musculus
tgtattctctcagatcccagctgtg

SEQ ID NO: 826465 - DNA, 25 bp, Mus musculus
tgtattctctcagccagcgttccat

SEQ ID NO: 826466 - DNA, 25 bp, Mus musculus
tgtattctttgcaacttgaattcaa

SEQ ID NO: 826467 - DNA, 25 bp, Mus musculus
tgtattctttgctacttgaattcaa

SEQ ID NO: 826468 - DNA, 25 bp, Mus musculus
tgtattgaaggactcgttctcagag

SEQ ID NO: 826469 - DNA, 25 bp, Mus musculus
tgtattgaaggagtcgttctcagag

SEQ ID NO: 826470 - DNA, 25 bp, Mus musculus
tgtattgagcagctgccaacgtgct

SEQ ID NO: 826471 - DNA, 25 bp, Mus musculus
tgtattgagcaggtgccaacgtgct

SEQ ID NO: 826472 - DNA, 25 bp, Mus musculus
tgtattgagtaaatccttgtttccc

SEQ ID NO: 826473 - DNA, 25 bp, Mus musculus
tgtattgagtaattccttgtttccc

SEQ ID NO: 826474 - DNA, 25 bp, Mus musculus
tgtattgccagcacaagccacagag

SEQ ID NO: 826475 - DNA, 25 bp, Mus musculus
tgtattgccagctcaagccacagag

SEQ ID NO: 826476 - DNA, 25 bp, Mus musculus
tgtattgcctcacccattactagaa

SEQ ID NO: 826477 - DNA, 25 bp, Mus musculus
tgtattgcctcagccattactagaa

SEQ ID NO: 826478 - DNA, 25 bp, Mus musculus
tgtattggctggatcccaatcttcg

SEQ ID NO: 826479 - DNA, 25 bp, Mus musculus
tgtattggctggttcccaatcttcg

SEQ ID NO: 826480 - DNA, 25 bp, Mus musculus
tgtattgtgcagatgaattgtgagc

SEQ ID NO: 826481 - DNA, 25 bp, Mus musculus
tgtattgtgcagttgaattgtgagc

SEQ ID NO: 826482 - DNA, 25 bp, Mus musculus
tgtattgtgcggcaccagaccgcag

SEQ ID NO: 826483 - DNA, 25 bp, Mus musculus
tgtattgtgcgggaccagaccgcag

SEQ ID NO: 826484 - DNA, 25 bp, Mus musculus
tgtattgttgctccagacacagtga

SEQ ID NO: 826485 - DNA, 25 bp, Mus musculus
tgtattgttgctgcagacacagtga

SEQ ID NO: 826486 - DNA, 25 bp, Mus musculus
tgtatttaaagaaggcgcgagagct

SEQ ID NO: 826487 - DNA, 25 bp, Mus musculus
tgtatttaaagatggcgcgagagct

SEQ ID NO: 826488 - DNA, 25 bp, Mus musculus
tgtatttagaaacctgtttgagctg

SEQ ID NO: 826489 - DNA, 25 bp, Mus musculus
tgtatttagaaagctgtttgagctg

SEQ ID NO: 826490 - DNA, 25 bp, Mus musculus
tgtatttattcgacacaccttggtg

SEQ ID NO: 826491 - DNA, 25 bp, Mus musculus
tgtatttattcgtcacaccttggtg

SEQ ID NO: 826492 - DNA, 25 bp, Mus musculus
tgtatttccacacttttgcctcatg

SEQ ID NO: 826493 - DNA, 25 bp, Mus musculus
tgtatttccacagttttgcctcatg

SEQ ID NO: 826494 - DNA, 25 bp, Mus musculus
tgtatttccagcctctcaatgggta

SEQ ID NO: 826495 - DNA, 25 bp, Mus musculus
tgtatttccagcgtctcaatgggta

SEQ ID NO: 826496 - DNA, 25 bp, Mus musculus
tgtatttctatgagcgcagccggca

SEQ ID NO: 826497 - DNA, 25 bp, Mus musculus
tgtatttctatgtgcgcagccggca

SEQ ID NO: 826498 - DNA, 25 bp, Mus musculus
tgtatttgatagactgggcagtgga

SEQ ID NO: 826499 - DNA, 25 bp, Mus musculus
tgtatttgatagtctgggcagtgga

SEQ ID NO: 826500 - DNA, 25 bp, Mus musculus
tgtatttggaccattactaccatct

SEQ ID NO: 826501 - DNA, 25 bp, Mus musculus
tgtatttggacctttactaccatct

SEQ ID NO: 826502 - DNA, 25 bp, Mus musculus
tgtatttgggtcagactttcaggag

SEQ ID NO: 826503 - DNA, 25 bp, Mus musculus
tgtatttgggtctgactttcaggag

SEQ ID NO: 826504 - DNA, 25 bp, Mus musculus
tgtatttggtgaaccgggtcccaag

SEQ ID NO: 826505 - DNA, 25 bp, Mus musculus
tgtatttggtgatccgggtcccaag

SEQ ID NO: 826506 - DNA, 25 bp, Mus musculus
tgtattttaccaacatcctaccaag

SEQ ID NO: 826507 - DNA, 25 bp, Mus musculus
tgtattttaccatcatcctaccaag

SEQ ID NO: 826508 - DNA, 25 bp, Mus musculus
tgtattttacccagtaggagtggaa

SEQ ID NO: 826509 - DNA, 25 bp, Mus musculus
tgtattttaccctgtaggagtggaa

SEQ ID NO: 826510 - DNA, 25 bp, Mus musculus
tgtattttcatcagagcacccctgt

SEQ ID NO: 826511 - DNA, 25 bp, Mus musculus
tgtattttcatctgagcacccctgt

SEQ ID NO: 826512 - DNA, 25 bp, Mus musculus
tgtattttctagatccaggccgttc

SEQ ID NO: 826513 - DNA, 25 bp, Mus musculus
tgtattttctagttccaggccgttc

SEQ ID NO: 826514 - DNA, 25 bp, Mus musculus
tgtattttcttcaaagccagagatg

SEQ ID NO: 826515 - DNA, 25 bp, Mus musculus
tgtattttcttctaagccagagatg

SEQ ID NO: 826516 - DNA, 25 bp, Mus musculus
tgtattttgttgctccggcggaacg

SEQ ID NO: 826517 - DNA, 25 bp, Mus musculus
tgtattttgttggtccggcggaacg

SEQ ID NO: 826518 - DNA, 25 bp, Mus musculus
tgtcaaaaacccaccggacatagtg

SEQ ID NO: 826519 - DNA, 25 bp, Mus musculus
tgtcaaaaaccctccggacatagtg

SEQ ID NO: 826520 - DNA, 25 bp, Mus musculus
tgtcaaaaaggacgctgctaaaccg

SEQ ID NO: 826521 - DNA, 25 bp, Mus musculus
tgtcaaaaaggaggctgctaaaccg

SEQ ID NO: 826522 - DNA, 25 bp, Mus musculus
tgtcaaaacaccactcccctttgta

SEQ ID NO: 826523 - DNA, 25 bp, Mus musculus
tgtcaaaacacctctcccctttgta

SEQ ID NO: 826524 - DNA, 25 bp, Mus musculus
tgtcaaaagacacatctctcaagaa

SEQ ID NO: 826525 - DNA, 25 bp, Mus musculus
tgtcaaaagacagatctctcaagaa

SEQ ID NO: 826526 - DNA, 25 bp, Mus musculus
tgtcaaaagcacattatgaagcaga

SEQ ID NO: 826527 - DNA, 25 bp, Mus musculus
tgtcaaaagcactttatgaagcaga

SEQ ID NO: 826528 - DNA, 25 bp, Mus musculus
tgtcaaacagaacttggtgcctcct

SEQ ID NO: 826529 - DNA, 25 bp, Mus musculus
tgtcaaacagaagttggtgcctcct

SEQ ID NO: 826530 - DNA, 25 bp, Mus musculus
tgtcaaacagctagagattcctcag

SEQ ID NO: 826531 - DNA, 25 bp, Mus musculus
tgtcaaacagcttgagattcctcag

SEQ ID NO: 826532 - DNA, 25 bp, Mus musculus
tgtcaaacaggccaacaggttaatg

SEQ ID NO: 826533 - DNA, 25 bp, Mus musculus
tgtcaaacaggcgaacaggttaatg

SEQ ID NO: 826534 - DNA, 25 bp, Mus musculus
tgtcaaacccagcacaatccacatg

SEQ ID NO: 826535 - DNA, 25 bp, Mus musculus
tgtcaaacccaggacaatccacatg

SEQ ID NO: 826536 - DNA, 25 bp, Mus musculus
tgtcaaaccccgagagaagaagctc

SEQ ID NO: 826537 - DNA, 25 bp, Mus musculus
tgtcaaaccccgtgagaagaagctc

SEQ ID NO: 826538 - DNA, 25 bp, Mus musculus
tgtcaaacgccacagccagtggaag

SEQ ID NO: 826539 - DNA, 25 bp, Mus musculus
tgtcaaacgccagagccagtggaag

SEQ ID NO: 826540 - DNA, 25 bp, Mus musculus
tgtcaaacgcggataaaagccaagc

SEQ ID NO: 826541 - DNA, 25 bp, Mus musculus
tgtcaaacgcggttaaaagccaagc

SEQ ID NO: 826542 - DNA, 25 bp, Mus musculus
tgtcaaacttctaagccccggaaca

SEQ ID NO: 826543 - DNA, 25 bp, Mus musculus
tgtcaaacttcttagccccggaaca

SEQ ID NO: 826544 - DNA, 25 bp, Mus musculus
tgtcaaagacttcttgaaaggaaac

SEQ ID NO: 826545 - DNA, 25 bp, Mus musculus
tgtcaaagacttgttgaaaggaaac

SEQ ID NO: 826546 - DNA, 25 bp, Mus musculus
tgtcaaagctatcctcctagcgctt

SEQ ID NO: 826547 - DNA, 25 bp, Mus musculus
tgtcaaagctatgctcctagcgctt

SEQ ID NO: 826548 - DNA, 25 bp, Mus musculus
tgtcaaaggaccaggccgagcaggt

SEQ ID NO: 826549 - DNA, 25 bp, Mus musculus
tgtcaaaggacctggccgagcaggt

SEQ ID NO: 826550 - DNA, 25 bp, Mus musculus
tgtcaaagtcggagatctgttgttt

SEQ ID NO: 826551 - DNA, 25 bp, Mus musculus
tgtcaaagtcggtgatctgttgttt

SEQ ID NO: 826552 - DNA, 25 bp, Mus musculus
tgtcaaagtggtcactagccactct

SEQ ID NO: 826553 - DNA, 25 bp, Mus musculus
tgtcaaagtggtgactagccactct

SEQ ID NO: 826554 - DNA, 25 bp, Mus musculus
tgtcaaagtgttcctgagctcccgg

SEQ ID NO: 826555 - DNA, 25 bp, Mus musculus
tgtcaaagtgttgctgagctcccgg

SEQ ID NO: 826556 - DNA, 25 bp, Mus musculus
tgtcaaatatctctctaacaaaagg

SEQ ID NO: 826557 - DNA, 25 bp, Mus musculus
tgtcaaatatctgtctaacaaaagg

SEQ ID NO: 826558 - DNA, 25 bp, Mus musculus
tgtcaaatccaaaaaaggtcaatgg

SEQ ID NO: 826559 - DNA, 25 bp, Mus musculus
tgtcaaatccaataaaggtcaatgg

SEQ ID NO: 826560 - DNA, 25 bp, Mus musculus
tgtcaaatcctgcaaccttccgaga

SEQ ID NO: 826561 - DNA, 25 bp, Mus musculus
tgtcaaatcctggaaccttccgaga

SEQ ID NO: 826562 - DNA, 25 bp, Mus musculus
tgtcaaatgacacgaaccttcctga

SEQ ID NO: 826563 - DNA, 25 bp, Mus musculus
tgtcaaatgacaggaaccttcctga

SEQ ID NO: 826564 - DNA, 25 bp, Mus musculus
tgtcaaatggctcccagaagactgt

SEQ ID NO: 826565 - DNA, 25 bp, Mus musculus
tgtcaaatggctgccagaagactgt

SEQ ID NO: 826566 - DNA, 25 bp, Mus musculus
tgtcaaatgtatctctgccaggacc

SEQ ID NO: 826567 - DNA, 25 bp, Mus musculus
tgtcaaatgtatgtctgccaggacc

SEQ ID NO: 826568 - DNA, 25 bp, Mus musculus
tgtcaaatgttaatcgtaattcaac

SEQ ID NO: 826569 - DNA, 25 bp, Mus musculus
tgtcaaatgttattcgtaattcaac

SEQ ID NO: 826570 - DNA, 25 bp, Mus musculus
tgtcaacaagctacaaatctttgcc

SEQ ID NO: 826571 - DNA, 25 bp, Mus musculus
tgtcaacaagctcgcactggtcttc

SEQ ID NO: 826572 - DNA, 25 bp, Mus musculus
tgtcaacaagctggcactggtcttc

SEQ ID NO: 826573 - DNA, 25 bp, Mus musculus
tgtcaacaagcttcaaatctttgcc

SEQ ID NO: 826574 - DNA, 25 bp, Mus musculus
tgtcaacaatccaaaccagtcagtg

SEQ ID NO: 826575 - DNA, 25 bp, Mus musculus
tgtcaacaatcctaaccagtcagtg

SEQ ID NO: 826576 - DNA, 25 bp, Mus musculus
tgtcaacaatggacccaagtgtcta

SEQ ID NO: 826577 - DNA, 25 bp, Mus musculus
tgtcaacaatggtcccaagtgtcta

SEQ ID NO: 826578 - DNA, 25 bp, Mus musculus
tgtcaacacctaaggctctttcatc

SEQ ID NO: 826579 - DNA, 25 bp, Mus musculus
tgtcaacacctatggctctttcatc

SEQ ID NO: 826580 - DNA, 25 bp, Mus musculus
tgtcaacacgttagggagctacatc

SEQ ID NO: 826581 - DNA, 25 bp, Mus musculus
tgtcaacacgtttgggagctacatc

SEQ ID NO: 826582 - DNA, 25 bp, Mus musculus
tgtcaacagactcgagcgagaggac

SEQ ID NO: 826583 - DNA, 25 bp, Mus musculus
tgtcaacagactggagcgagaggac

SEQ ID NO: 826584 - DNA, 25 bp, Mus musculus
tgtcaacagtgtcggctcctactcc

SEQ ID NO: 826585 - DNA, 25 bp, Mus musculus
tgtcaacagtgtgggctcctactcc

SEQ ID NO: 826586 - DNA, 25 bp, Mus musculus
tgtcaacatcaccataggcgaccct

SEQ ID NO: 826587 - DNA, 25 bp, Mus musculus
tgtcaacatcacgataggcgaccct

SEQ ID NO: 826588 - DNA, 25 bp, Mus musculus
tgtcaacatctccaaggaggcccga

SEQ ID NO: 826589 - DNA, 25 bp, Mus musculus
tgtcaacatctcgaaggaggcccga

SEQ ID NO: 826590 - DNA, 25 bp, Mus musculus
tgtcaacattccactgttacagatg

SEQ ID NO: 826591 - DNA, 25 bp, Mus musculus
tgtcaacattcctctgttacagatg

SEQ ID NO: 826592 - DNA, 25 bp, Mus musculus
tgtcaacatttgacatagcttcaga

SEQ ID NO: 826593 - DNA, 25 bp, Mus musculus
tgtcaacatttgtcatagcttcaga

SEQ ID NO: 826594 - DNA, 25 bp, Mus musculus
tgtcaaccacagagcaaacacggag

SEQ ID NO: 826595 - DNA, 25 bp, Mus musculus
tgtcaaccacagtgcaaacacggag

SEQ ID NO: 826596 - DNA, 25 bp, Mus musculus
tgtcaaccagaacctagagcgcctg

SEQ ID NO: 826597 - DNA, 25 bp, Mus musculus
tgtcaaccagaagctagagcgcctg

SEQ ID NO: 826598 - DNA, 25 bp, Mus musculus
tgtcaacccagtcaaggcccagggt

SEQ ID NO: 826599 - DNA, 25 bp, Mus musculus
tgtcaacccagtgaaggcccagggt

SEQ ID NO: 826600 - DNA, 25 bp, Mus musculus
tgtcaaccgagacaccatagactac

SEQ ID NO: 826601 - DNA, 25 bp, Mus musculus
tgtcaaccgagagaccatagactac

SEQ ID NO: 826602 - DNA, 25 bp, Mus musculus
tgtcaaccgcatcattacagaaaag

SEQ ID NO: 826603 - DNA, 25 bp, Mus musculus
tgtcaaccgcatgattacagaaaag

SEQ ID NO: 826604 - DNA, 25 bp, Mus musculus
tgtcaaccgcctagtgaacacacca

SEQ ID NO: 826605 - DNA, 25 bp, Mus musculus
tgtcaaccgccttgtgaacacacca

SEQ ID NO: 826606 - DNA, 25 bp, Mus musculus
tgtcaaccggaaagcagccgtggaa

SEQ ID NO: 826607 - DNA, 25 bp, Mus musculus
tgtcaaccggaatgcagccgtggaa

SEQ ID NO: 826608 - DNA, 25 bp, Mus musculus
tgtcaacctccaagtggcgacctac

SEQ ID NO: 826609 - DNA, 25 bp, Mus musculus
tgtcaacctccatgtggcgacctac

SEQ ID NO: 826610 - DNA, 25 bp, Mus musculus
tgtcaacctgaaagaggaccctttg

SEQ ID NO: 826611 - DNA, 25 bp, Mus musculus
tgtcaacctgaatgaggaccctttg

SEQ ID NO: 826612 - DNA, 25 bp, Mus musculus
tgtcaacgaccaacatgtcaagcct

SEQ ID NO: 826613 - DNA, 25 bp, Mus musculus
tgtcaacgaccatcatgtcaagcct

SEQ ID NO: 826614 - DNA, 25 bp, Mus musculus
tgtcaacgactaaggcaaaggctgg

SEQ ID NO: 826615 - DNA, 25 bp, Mus musculus
tgtcaacgactatggcaaaggctgg

SEQ ID NO: 826616 - DNA, 25 bp, Mus musculus
tgtcaacgccctcgccaactatgtg

SEQ ID NO: 826617 - DNA, 25 bp, Mus musculus
tgtcaacgccctggccaactatgtg

SEQ ID NO: 826618 - DNA, 25 bp, Mus musculus
tgtcaacggcaaagccatctgcacc

SEQ ID NO: 826619 - DNA, 25 bp, Mus musculus
tgtcaacggcaacaaagtcactgag

SEQ ID NO: 826620 - DNA, 25 bp, Mus musculus
tgtcaacggcaagaaagtcactgag

SEQ ID NO: 826621 - DNA, 25 bp, Mus musculus
tgtcaacggcaatgccatctgcacc

SEQ ID NO: 826622 - DNA, 25 bp, Mus musculus
tgtcaacggctgatgaatgagggcc

SEQ ID NO: 826623 - DNA, 25 bp, Mus musculus
tgtcaacggctgttgaatgagggcc

SEQ ID NO: 826624 - DNA, 25 bp, Mus musculus
tgtcaacgggttcttgctggctccc

SEQ ID NO: 826625 - DNA, 25 bp, Mus musculus
tgtcaacgggttgttgctggctccc

SEQ ID NO: 826626 - DNA, 25 bp, Mus musculus
tgtcaacgtggtaaagcggctcttt

SEQ ID NO: 826627 - DNA, 25 bp, Mus musculus
tgtcaacgtggttaagcggctcttt

SEQ ID NO: 826628 - DNA, 25 bp, Mus musculus
tgtcaactacacagtacgcttcggc

SEQ ID NO: 826629 - DNA, 25 bp, Mus musculus
tgtcaactacactgtacgcttcggc

SEQ ID NO: 826630 - DNA, 25 bp, Mus musculus
tgtcaactactaagggaaccctcat

SEQ ID NO: 826631 - DNA, 25 bp, Mus musculus
tgtcaactactatgggaaccctcat

SEQ ID NO: 826632 - DNA, 25 bp, Mus musculus
tgtcaactattcaggctgttgtgaa

SEQ ID NO: 826633 - DNA, 25 bp, Mus musculus
tgtcaactattctggctgttgtgaa

SEQ ID NO: 826634 - DNA, 25 bp, Mus musculus
tgtcaactccttagaaggcctgagt

SEQ ID NO: 826635 - DNA, 25 bp, Mus musculus
tgtcaactcctttgaaggcctgagt

SEQ ID NO: 826636 - DNA, 25 bp, Mus musculus
tgtcaactgcacagtccctaatgtg

SEQ ID NO: 826637 - DNA, 25 bp, Mus musculus
tgtcaactgcactgtccctaatgtg

SEQ ID NO: 826638 - DNA, 25 bp, Mus musculus
tgtcaactgcttcaacggctaagca

SEQ ID NO: 826639 - DNA, 25 bp, Mus musculus
tgtcaactgcttgaacggctaagca

SEQ ID NO: 826640 - DNA, 25 bp, Mus musculus
tgtcaactgtgtccgattctctcct

SEQ ID NO: 826641 - DNA, 25 bp, Mus musculus
tgtcaactgtgtgcgattctctcct

SEQ ID NO: 826642 - DNA, 25 bp, Mus musculus
tgtcaactgttcctgaaaccaagct

SEQ ID NO: 826643 - DNA, 25 bp, Mus musculus
tgtcaactgttcgtgaaaccaagct

SEQ ID NO: 826644 - DNA, 25 bp, Mus musculus
tgtcaacttccaaaccacttggtcc

SEQ ID NO: 826645 - DNA, 25 bp, Mus musculus
tgtcaacttccataccacttggtcc

SEQ ID NO: 826646 - DNA, 25 bp, Mus musculus
tgtcaactttttactgcggcctggg

SEQ ID NO: 826647 - DNA, 25 bp, Mus musculus
tgtcaacttttttctgcggcctggg

SEQ ID NO: 826648 - DNA, 25 bp, Mus musculus
tgtcaagaaacacgagaaagattgg

SEQ ID NO: 826649 - DNA, 25 bp, Mus musculus
tgtcaagaaacaggagaaagattgg

SEQ ID NO: 826650 - DNA, 25 bp, Mus musculus
tgtcaagaacaacgtaccacccctg

SEQ ID NO: 826651 - DNA, 25 bp, Mus musculus
tgtcaagaacaaggtaccacccctg

SEQ ID NO: 826652 - DNA, 25 bp, Mus musculus
tgtcaagaacagctaagagactcta

SEQ ID NO: 826653 - DNA, 25 bp, Mus musculus
tgtcaagaacaggtaagagactcta

SEQ ID NO: 826654 - DNA, 25 bp, Mus musculus
tgtcaagaatttcgaaggtggtaca

SEQ ID NO: 826655 - DNA, 25 bp, Mus musculus
tgtcaagaatttggaaggtggtaca

SEQ ID NO: 826656 - DNA, 25 bp, Mus musculus
tgtcaagacaaacgagattgaagct

SEQ ID NO: 826657 - DNA, 25 bp, Mus musculus
tgtcaagacaaaggagattgaagct

SEQ ID NO: 826658 - DNA, 25 bp, Mus musculus
tgtcaagacaggctgaaaaaccagg

SEQ ID NO: 826659 - DNA, 25 bp, Mus musculus
tgtcaagacagggtgaaaaaccagg

SEQ ID NO: 826660 - DNA, 25 bp, Mus musculus
tgtcaagagtcacgaaggagagaat

SEQ ID NO: 826661 - DNA, 25 bp, Mus musculus
tgtcaagagtcaggaaggagagaat

SEQ ID NO: 826662 - DNA, 25 bp, Mus musculus
tgtcaagagtgaaaaggtttatacc

SEQ ID NO: 826663 - DNA, 25 bp, Mus musculus
tgtcaagagtgataaggtttatacc

SEQ ID NO: 826664 - DNA, 25 bp, Mus musculus
tgtcaagcaccgagatgtgttggag

SEQ ID NO: 826665 - DNA, 25 bp, Mus musculus
tgtcaagcaccgtgatgtgttggag

SEQ ID NO: 826666 - DNA, 25 bp, Mus musculus
tgtcaagcagagcagacccgagatc

SEQ ID NO: 826667 - DNA, 25 bp, Mus musculus
tgtcaagcagaggagacccgagatc

SEQ ID NO: 826668 - DNA, 25 bp, Mus musculus
tgtcaagcagcacacaagcagctct

SEQ ID NO: 826669 - DNA, 25 bp, Mus musculus
tgtcaagcagcagacaagcagctct

SEQ ID NO: 826670 - DNA, 25 bp, Mus musculus
tgtcaagcatcccaccaccaaggtt

SEQ ID NO: 826671 - DNA, 25 bp, Mus musculus
tgtcaagcatccgaccaccaaggtt

SEQ ID NO: 826672 - DNA, 25 bp, Mus musculus
tgtcaagccagactatcaaccctgt

SEQ ID NO: 826673 - DNA, 25 bp, Mus musculus
tgtcaagccagagtatcaaccctgt

SEQ ID NO: 826674 - DNA, 25 bp, Mus musculus
tgtcaagccattattcgaacagact

SEQ ID NO: 826675 - DNA, 25 bp, Mus musculus
tgtcaagccatttttcgaacagact

SEQ ID NO: 826676 - DNA, 25 bp, Mus musculus
tgtcaagcccgcaggcttccgttgc

SEQ ID NO: 826677 - DNA, 25 bp, Mus musculus
tgtcaagcccgctggcttccgttgc

SEQ ID NO: 826678 - DNA, 25 bp, Mus musculus
tgtcaagcccttacccagagactgg

SEQ ID NO: 826679 - DNA, 25 bp, Mus musculus
tgtcaagccctttcccagagactgg

SEQ ID NO: 826680 - DNA, 25 bp, Mus musculus
tgtcaagcctgaacaggatgctcga

SEQ ID NO: 826681 - DNA, 25 bp, Mus musculus
tgtcaagcctgatcaggatgctcga

SEQ ID NO: 826682 - DNA, 25 bp, Mus musculus
tgtcaagccttccaggtcagaaatg

SEQ ID NO: 826683 - DNA, 25 bp, Mus musculus
tgtcaagccttcgaggtcagaaatg

SEQ ID NO: 826684 - DNA, 25 bp, Mus musculus
tgtcaaggaaataggtctcctaaag

SEQ ID NO: 826685 - DNA, 25 bp, Mus musculus
tgtcaaggaaattggtctcctaaag

SEQ ID NO: 826686 - DNA, 25 bp, Mus musculus
tgtcaaggacggcaagagtatcact

SEQ ID NO: 826687 - DNA, 25 bp, Mus musculus
tgtcaaggacgggaagagtatcact

SEQ ID NO: 826688 - DNA, 25 bp, Mus musculus
tgtcaagggaaaagtaatcctgttg

SEQ ID NO: 826689 - DNA, 25 bp, Mus musculus
tgtcaagggaaatgtaatcctgttg

SEQ ID NO: 826690 - DNA, 25 bp, Mus musculus
tgtcaagggaacaactgaacacaga

SEQ ID NO: 826691 - DNA, 25 bp, Mus musculus
tgtcaagggaactactgaacacaga

SEQ ID NO: 826692 - DNA, 25 bp, Mus musculus
tgtcaagggctacttaatgagttac

SEQ ID NO: 826693 - DNA, 25 bp, Mus musculus
tgtcaagggctagttaatgagttac

SEQ ID NO: 826694 - DNA, 25 bp, Mus musculus
tgtcaaggtccaagccatcaatcaa

SEQ ID NO: 826695 - DNA, 25 bp, Mus musculus
tgtcaaggtccatgccatcaatcaa

SEQ ID NO: 826696 - DNA, 25 bp, Mus musculus
tgtcaaggtcctataattccaatct

SEQ ID NO: 826697 - DNA, 25 bp, Mus musculus
tgtcaaggtcctttaattccaatct

SEQ ID NO: 826698 - DNA, 25 bp, Mus musculus
tgtcaaggtcttatggatcccagag

SEQ ID NO: 826699 - DNA, 25 bp, Mus musculus
tgtcaaggtcttttggatcccagag

SEQ ID NO: 826700 - DNA, 25 bp, Mus musculus
tgtcaagtatgaagaggattgcgag

SEQ ID NO: 826701 - DNA, 25 bp, Mus musculus
tgtcaagtatgatgaggattgcgag

SEQ ID NO: 826702 - DNA, 25 bp, Mus musculus
tgtcaagtcaagcactgggagaagc

SEQ ID NO: 826703 - DNA, 25 bp, Mus musculus
tgtcaagtcaaggactgggagaagc

SEQ ID NO: 826704 - DNA, 25 bp, Mus musculus
tgtcaagtcaatccatcgcaaacgt

SEQ ID NO: 826705 - DNA, 25 bp, Mus musculus
tgtcaagtcaatgcatcgcaaacgt

SEQ ID NO: 826706 - DNA, 25 bp, Mus musculus
tgtcaagtcagaaggccaagtgcag

SEQ ID NO: 826707 - DNA, 25 bp, Mus musculus
tgtcaagtcagatggccaagtgcag

SEQ ID NO: 826708 - DNA, 25 bp, Mus musculus
tgtcaagtcaggaccaagttcatgg

SEQ ID NO: 826709 - DNA, 25 bp, Mus musculus
tgtcaagtcaggtccaagttcatgg

SEQ ID NO: 826710 - DNA, 25 bp, Mus musculus
tgtcaagtcattacctcaatccagg

SEQ ID NO: 826711 - DNA, 25 bp, Mus musculus
tgtcaagtcatttcctcaatccagg

SEQ ID NO: 826712 - DNA, 25 bp, Mus musculus
tgtcaagtccataacggcgctggca

SEQ ID NO: 826713 - DNA, 25 bp, Mus musculus
tgtcaagtccattacggcgctggca

SEQ ID NO: 826714 - DNA, 25 bp, Mus musculus
tgtcaagtcctcaacaggtcccggg

SEQ ID NO: 826715 - DNA, 25 bp, Mus musculus
tgtcaagtcctctacaggtcccggg

SEQ ID NO: 826716 - DNA, 25 bp, Mus musculus
tgtcaagttcttcatcattggtgtg

SEQ ID NO: 826717 - DNA, 25 bp, Mus musculus
tgtcaagttcttgatcattggtgtg

SEQ ID NO: 826718 - DNA, 25 bp, Mus musculus
tgtcaataaccaccagacagactgg

SEQ ID NO: 826719 - DNA, 25 bp, Mus musculus
tgtcaataaccagcagacagactgg

SEQ ID NO: 826720 - DNA, 25 bp, Mus musculus
tgtcaatcaaaacggctgcactcca

SEQ ID NO: 826721 - DNA, 25 bp, Mus musculus
tgtcaatcaaaagggctgcactcca

SEQ ID NO: 826722 - DNA, 25 bp, Mus musculus
tgtcaatcaataagctaagtggtgg

SEQ ID NO: 826723 - DNA, 25 bp, Mus musculus
tgtcaatcaatatgctaagtggtgg

SEQ ID NO: 826724 - DNA, 25 bp, Mus musculus
tgtcaatcacttaccagcccaaagg

SEQ ID NO: 826725 - DNA, 25 bp, Mus musculus
tgtcaatcactttccagcccaaagg

SEQ ID NO: 826726 - DNA, 25 bp, Mus musculus
tgtcaatcatgccaaggtgaaactg

SEQ ID NO: 826727 - DNA, 25 bp, Mus musculus
tgtcaatcatgcgaaggtgaaactg

SEQ ID NO: 826728 - DNA, 25 bp, Mus musculus
tgtcaatcattcacctaaagttggg

SEQ ID NO: 826729 - DNA, 25 bp, Mus musculus
tgtcaatcattctcctaaagttggg

SEQ ID NO: 826730 - DNA, 25 bp, Mus musculus
tgtcaatctaacaatgttaggagcc

SEQ ID NO: 826731 - DNA, 25 bp, Mus musculus
tgtcaatctaactatgttaggagcc

SEQ ID NO: 826732 - DNA, 25 bp, Mus musculus
tgtcaatctcaaactcggtgtggcg

SEQ ID NO: 826733 - DNA, 25 bp, Mus musculus
tgtcaatctcaatctcggtgtggcg

SEQ ID NO: 826734 - DNA, 25 bp, Mus musculus
tgtcaatctcatcaccaaccaggaa

SEQ ID NO: 826735 - DNA, 25 bp, Mus musculus
tgtcaatctcatgaccaaccaggaa

SEQ ID NO: 826736 - DNA, 25 bp, Mus musculus
tgtcaatctgatcgaggagactggc

SEQ ID NO: 826737 - DNA, 25 bp, Mus musculus
tgtcaatctgatggaggagactggc

SEQ ID NO: 826738 - DNA, 25 bp, Mus musculus
tgtcaatgaaaacccgtccagcctc

SEQ ID NO: 826739 - DNA, 25 bp, Mus musculus
tgtcaatgaaaagccgtccagcctc

SEQ ID NO: 826740 - DNA, 25 bp, Mus musculus
tgtcaatgaatgactctccaacccc

SEQ ID NO: 826741 - DNA, 25 bp, Mus musculus
tgtcaatgaatgtctctccaacccc

SEQ ID NO: 826742 - DNA, 25 bp, Mus musculus
tgtcaatgacctagcacatcagctg

SEQ ID NO: 826743 - DNA, 25 bp, Mus musculus
tgtcaatgaccttgcacatcagctg

SEQ ID NO: 826744 - DNA, 25 bp, Mus musculus
tgtcaatgaggacctgcagtcgcgc

SEQ ID NO: 826745 - DNA, 25 bp, Mus musculus
tgtcaatgaggagctgcagtcgcgc

SEQ ID NO: 826746 - DNA, 25 bp, Mus musculus
tgtcaatgagtgactgacccctggg

SEQ ID NO: 826747 - DNA, 25 bp, Mus musculus
tgtcaatgagtgagattcacggccc

SEQ ID NO: 826748 - DNA, 25 bp, Mus musculus
tgtcaatgagtgtctgacccctggg

SEQ ID NO: 826749 - DNA, 25 bp, Mus musculus
tgtcaatgagtgtgattcacggccc

SEQ ID NO: 826750 - DNA, 25 bp, Mus musculus
tgtcaatgatcacagtgccctcgct

SEQ ID NO: 826751 - DNA, 25 bp, Mus musculus
tgtcaatgatcagagtgccctcgct

SEQ ID NO: 826752 - DNA, 25 bp, Mus musculus
tgtcaatgcaagacacaaacttggc

SEQ ID NO: 826753 - DNA, 25 bp, Mus musculus
tgtcaatgcaagtcacaaacttggc

SEQ ID NO: 826754 - DNA, 25 bp, Mus musculus
tgtcaatgccaacaccacagagtga

SEQ ID NO: 826755 - DNA, 25 bp, Mus musculus
tgtcaatgccaagaccacagagtga

SEQ ID NO: 826756 - DNA, 25 bp, Mus musculus
tgtcaatgcctacccctgagaggcc

SEQ ID NO: 826757 - DNA, 25 bp, Mus musculus
tgtcaatgcctagccctgagaggcc

SEQ ID NO: 826758 - DNA, 25 bp, Mus musculus
tgtcaatggatcctcgtcttccaag

SEQ ID NO: 826759 - DNA, 25 bp, Mus musculus
tgtcaatggatcgtcgtcttccaag

SEQ ID NO: 826760 - DNA, 25 bp, Mus musculus
tgtcaatgggacagatcaggaagaa

SEQ ID NO: 826761 - DNA, 25 bp, Mus musculus
tgtcaatgggactgatcaggaagaa

SEQ ID NO: 826762 - DNA, 25 bp, Mus musculus
tgtcaatgggttacacacgggaaga

SEQ ID NO: 826763 - DNA, 25 bp, Mus musculus
tgtcaatgggtttcacacgggaaga

SEQ ID NO: 826764 - DNA, 25 bp, Mus musculus
tgtcaatgtaaactctgtggtcagc

SEQ ID NO: 826765 - DNA, 25 bp, Mus musculus
tgtcaatgtaaagtctgtggtcagc

SEQ ID NO: 826766 - DNA, 25 bp, Mus musculus
tgtcaatgtctccacggcaacggaa

SEQ ID NO: 826767 - DNA, 25 bp, Mus musculus
tgtcaatgtctcgacggcaacggaa

SEQ ID NO: 826768 - DNA, 25 bp, Mus musculus
tgtcaatgtgacagtttagtggaac

SEQ ID NO: 826769 - DNA, 25 bp, Mus musculus
tgtcaatgtgactgtttagtggaac

SEQ ID NO: 826770 - DNA, 25 bp, Mus musculus
tgtcaattagcaccaaaccacgagg

SEQ ID NO: 826771 - DNA, 25 bp, Mus musculus
tgtcaattagcagcaaaccacgagg

SEQ ID NO: 826772 - DNA, 25 bp, Mus musculus
tgtcaatttatgagccaatagcagc

SEQ ID NO: 826773 - DNA, 25 bp, Mus musculus
tgtcaatttatgtgccaatagcagc

SEQ ID NO: 826774 - DNA, 25 bp, Mus musculus
tgtcacaaaccaaggtcactaagcc

SEQ ID NO: 826775 - DNA, 25 bp, Mus musculus
tgtcacaaaccatggtcactaagcc

SEQ ID NO: 826776 - DNA, 25 bp, Mus musculus
tgtcacaaacgaaaggcagctctct

SEQ ID NO: 826777 - DNA, 25 bp, Mus musculus
tgtcacaaacgataggcagctctct

SEQ ID NO: 826778 - DNA, 25 bp, Mus musculus
tgtcacaaacgccagtgcttagaga

SEQ ID NO: 826779 - DNA, 25 bp, Mus musculus
tgtcacaaacgcgagtgcttagaga

SEQ ID NO: 826780 - DNA, 25 bp, Mus musculus
tgtcacaaagggatgccaaggctta

SEQ ID NO: 826781 - DNA, 25 bp, Mus musculus
tgtcacaaagggttgccaaggctta

SEQ ID NO: 826782 - DNA, 25 bp, Mus musculus
tgtcacaacgcactcacgaaaggtc

SEQ ID NO: 826783 - DNA, 25 bp, Mus musculus
tgtcacaacgcagtcacgaaaggtc

SEQ ID NO: 826784 - DNA, 25 bp, Mus musculus
tgtcacaactcacccaacaggaagg

SEQ ID NO: 826785 - DNA, 25 bp, Mus musculus
tgtcacaactcagccaacaggaagg

SEQ ID NO: 826786 - DNA, 25 bp, Mus musculus
tgtcacaagatgctaaaaggctcag

SEQ ID NO: 826787 - DNA, 25 bp, Mus musculus
tgtcacaagatggtaaaaggctcag

SEQ ID NO: 826788 - DNA, 25 bp, Mus musculus
tgtcacaagttaaatatcctcaggg

SEQ ID NO: 826789 - DNA, 25 bp, Mus musculus
tgtcacaagttatatatcctcaggg

SEQ ID NO: 826790 - DNA, 25 bp, Mus musculus
tgtcacaatggcaaccttcaccatg

SEQ ID NO: 826791 - DNA, 25 bp, Mus musculus
tgtcacaatggctaccttcaccatg

SEQ ID NO: 826792 - DNA, 25 bp, Mus musculus
tgtcacacacgtcggcatggatgaa

SEQ ID NO: 826793 - DNA, 25 bp, Mus musculus
tgtcacacacgtgggcatggatgaa

SEQ ID NO: 826794 - DNA, 25 bp, Mus musculus
tgtcacacagtgacaagacagccga

SEQ ID NO: 826795 - DNA, 25 bp, Mus musculus
tgtcacacagtgctgtcaggaggat

SEQ ID NO: 826796 - DNA, 25 bp, Mus musculus
tgtcacacagtggtgtcaggaggat

SEQ ID NO: 826797 - DNA, 25 bp, Mus musculus
tgtcacacagtgtcaagacagccga

SEQ ID NO: 826798 - DNA, 25 bp, Mus musculus
tgtcacaccagcattcgggaggtag

SEQ ID NO: 826799 - DNA, 25 bp, Mus musculus
tgtcacaccagctttcgggaggtag

SEQ ID NO: 826800 - DNA, 25 bp, Mus musculus
tgtcacacctgaacacagacaggcc

SEQ ID NO: 826801 - DNA, 25 bp, Mus musculus
tgtcacacctgatcacagacaggcc

SEQ ID NO: 826802 - DNA, 25 bp, Mus musculus
tgtcacactaggcagctggcttttc

SEQ ID NO: 826803 - DNA, 25 bp, Mus musculus
tgtcacactagggagctggcttttc

SEQ ID NO: 826804 - DNA, 25 bp, Mus musculus
tgtcacagaaagaaaatgtaccacc

SEQ ID NO: 826805 - DNA, 25 bp, Mus musculus
tgtcacagaaagtaaatgtaccacc

SEQ ID NO: 826806 - DNA, 25 bp, Mus musculus
tgtcacagaatgaaaccggcgctct

SEQ ID NO: 826807 - DNA, 25 bp, Mus musculus
tgtcacagaatgtaaccggcgctct

SEQ ID NO: 826808 - DNA, 25 bp, Mus musculus
tgtcacagacaaaggcgtcattgct

SEQ ID NO: 826809 - DNA, 25 bp, Mus musculus
tgtcacagacaatggcgtcattgct

SEQ ID NO: 826810 - DNA, 25 bp, Mus musculus
tgtcacagagaacagtgccagcctg

SEQ ID NO: 826811 - DNA, 25 bp, Mus musculus
tgtcacagagaagagtgccagcctg

SEQ ID NO: 826812 - DNA, 25 bp, Mus musculus
tgtcacagaggacctattccagaga

SEQ ID NO: 826813 - DNA, 25 bp, Mus musculus
tgtcacagaggagctattccagaga

SEQ ID NO: 826814 - DNA, 25 bp, Mus musculus
tgtcacagagtaatcccttcgttcc

SEQ ID NO: 826815 - DNA, 25 bp, Mus musculus
tgtcacagagtattcccttcgttcc

SEQ ID NO: 826816 - DNA, 25 bp, Mus musculus
tgtcacagcctaacggcgtcgtatg

SEQ ID NO: 826817 - DNA, 25 bp, Mus musculus
tgtcacagcctatcggcgtcgtatg

SEQ ID NO: 826818 - DNA, 25 bp, Mus musculus
tgtcacagcgatctgtgcaatcctg

SEQ ID NO: 826819 - DNA, 25 bp, Mus musculus
tgtcacagcgatgtgtgcaatcctg

SEQ ID NO: 826820 - DNA, 25 bp, Mus musculus
tgtcacagcgtcaggagtcatcccg

SEQ ID NO: 826821 - DNA, 25 bp, Mus musculus
tgtcacagcgtctggagtcatcccg

SEQ ID NO: 826822 - DNA, 25 bp, Mus musculus
tgtcacagctgaagctagggctctc

SEQ ID NO: 826823 - DNA, 25 bp, Mus musculus
tgtcacagctgaaggatgcacacag

SEQ ID NO: 826824 - DNA, 25 bp, Mus musculus
tgtcacagctgatgctagggctctc

SEQ ID NO: 826825 - DNA, 25 bp, Mus musculus
tgtcacagctgatggatgcacacag

SEQ ID NO: 826826 - DNA, 25 bp, Mus musculus
tgtcacagttatcgagaaatgcagt

SEQ ID NO: 826827 - DNA, 25 bp, Mus musculus
tgtcacagttatggagaaatgcagt

SEQ ID NO: 826828 - DNA, 25 bp, Mus musculus
tgtcacatcaagatgtcaacagaag

SEQ ID NO: 826829 - DNA, 25 bp, Mus musculus
tgtcacatcaagttgtcaacagaag

SEQ ID NO: 826830 - DNA, 25 bp, Mus musculus
tgtcacatcaggagttttcagtgtg

SEQ ID NO: 826831 - DNA, 25 bp, Mus musculus
tgtcacatcaggtgttttcagtgtg

SEQ ID NO: 826832 - DNA, 25 bp, Mus musculus
tgtcacatgactagtgccacagaca

SEQ ID NO: 826833 - DNA, 25 bp, Mus musculus
tgtcacatgacttgtgccacagaca

SEQ ID NO: 826834 - DNA, 25 bp, Mus musculus
tgtcacatgcttcgtgacaccagtt

SEQ ID NO: 826835 - DNA, 25 bp, Mus musculus
tgtcacatgcttggtgacaccagtt

SEQ ID NO: 826836 - DNA, 25 bp, Mus musculus
tgtcacattagtcgaggccatcaaa

SEQ ID NO: 826837 - DNA, 25 bp, Mus musculus
tgtcacattagtggaggccatcaaa

SEQ ID NO: 826838 - DNA, 25 bp, Mus musculus
tgtcaccaacaacaccaagaagacg

SEQ ID NO: 826839 - DNA, 25 bp, Mus musculus
tgtcaccaacaacctcaagtctctt

SEQ ID NO: 826840 - DNA, 25 bp, Mus musculus
tgtcaccaacaagaccaagaagacg

SEQ ID NO: 826841 - DNA, 25 bp, Mus musculus
tgtcaccaacaagctcaagtctctt

SEQ ID NO: 826842 - DNA, 25 bp, Mus musculus
tgtcaccaacaccattgtggccctg

SEQ ID NO: 826843 - DNA, 25 bp, Mus musculus
tgtcaccaacacgattgtggccctg

SEQ ID NO: 826844 - DNA, 25 bp, Mus musculus
tgtcaccaaggaacgagacagtctt

SEQ ID NO: 826845 - DNA, 25 bp, Mus musculus
tgtcaccaaggatcgagacagtctt

SEQ ID NO: 826846 - DNA, 25 bp, Mus musculus
tgtcaccaatcactgcctttgaggg

SEQ ID NO: 826847 - DNA, 25 bp, Mus musculus
tgtcaccaatcagtgcctttgaggg

SEQ ID NO: 826848 - DNA, 25 bp, Mus musculus
tgtcaccacaagaagtattgcaggg

SEQ ID NO: 826849 - DNA, 25 bp, Mus musculus
tgtcaccacaagtagtattgcaggg

SEQ ID NO: 826850 - DNA, 25 bp, Mus musculus
tgtcaccaccaacgcatcgttgagt

SEQ ID NO: 826851 - DNA, 25 bp, Mus musculus
tgtcaccaccaaggcatcgttgagt

SEQ ID NO: 826852 - DNA, 25 bp, Mus musculus
tgtcaccaccggaatgcctaaacgc

SEQ ID NO: 826853 - DNA, 25 bp, Mus musculus
tgtcaccaccggtatgcctaaacgc

SEQ ID NO: 826854 - DNA, 25 bp, Mus musculus
tgtcaccactctaatccttggaggc

SEQ ID NO: 826855 - DNA, 25 bp, Mus musculus
tgtcaccactcttatccttggaggc

SEQ ID NO: 826856 - DNA, 25 bp, Mus musculus
tgtcaccactgactttctgtttgag

SEQ ID NO: 826857 - DNA, 25 bp, Mus musculus
tgtcaccactgagtttctgtttgag

SEQ ID NO: 826858 - DNA, 25 bp, Mus musculus
tgtcaccactgtagcgacccttgtc

SEQ ID NO: 826859 - DNA, 25 bp, Mus musculus
tgtcaccactgttgcgacccttgtc

SEQ ID NO: 826860 - DNA, 25 bp, Mus musculus
tgtcaccagttgattctgaacacag

SEQ ID NO: 826861 - DNA, 25 bp, Mus musculus
tgtcaccagttgtttctgaacacag

SEQ ID NO: 826862 - DNA, 25 bp, Mus musculus
tgtcaccatactcccagcgtgggtt

SEQ ID NO: 826863 - DNA, 25 bp, Mus musculus
tgtcaccatactgccagcgtgggtt

SEQ ID NO: 826864 - DNA, 25 bp, Mus musculus
tgtcaccatagccattcatgccaaa

SEQ ID NO: 826865 - DNA, 25 bp, Mus musculus
tgtcaccatagcgattcatgccaaa

SEQ ID NO: 826866 - DNA, 25 bp, Mus musculus
tgtcaccatcatccgtgaggcagta

SEQ ID NO: 826867 - DNA, 25 bp, Mus musculus
tgtcaccatcatctcagtcatcaat

SEQ ID NO: 826868 - DNA, 25 bp, Mus musculus
tgtcaccatcatgcgtgaggcagta

SEQ ID NO: 826869 - DNA, 25 bp, Mus musculus
tgtcaccatcatgtcagtcatcaat

SEQ ID NO: 826870 - DNA, 25 bp, Mus musculus
tgtcaccatcctcgcactatttgat

SEQ ID NO: 826871 - DNA, 25 bp, Mus musculus
tgtcaccatcctggcactatttgat

SEQ ID NO: 826872 - DNA, 25 bp, Mus musculus
tgtcacccaaaccactgagcacagg

SEQ ID NO: 826873 - DNA, 25 bp, Mus musculus
tgtcacccaaacgactgagcacagg

SEQ ID NO: 826874 - DNA, 25 bp, Mus musculus
tgtcacccactaaggatacagtgtg

SEQ ID NO: 826875 - DNA, 25 bp, Mus musculus
tgtcacccactatggatacagtgtg

SEQ ID NO: 826876 - DNA, 25 bp, Mus musculus
tgtcacccagagcacatttaagctc

SEQ ID NO: 826877 - DNA, 25 bp, Mus musculus
tgtcacccagaggacatttaagctc

SEQ ID NO: 826878 - DNA, 25 bp, Mus musculus
tgtcacccatatcttaatcaaaaga

SEQ ID NO: 826879 - DNA, 25 bp, Mus musculus
tgtcacccatatgttaatcaaaaga

SEQ ID NO: 826880 - DNA, 25 bp, Mus musculus
tgtcaccccaagacggattagagag

SEQ ID NO: 826881 - DNA, 25 bp, Mus musculus
tgtcaccccaagtcggattagagag

SEQ ID NO: 826882 - DNA, 25 bp, Mus musculus
tgtcaccccactctccgatttggag

SEQ ID NO: 826883 - DNA, 25 bp, Mus musculus
tgtcaccccactgtccgatttggag

SEQ ID NO: 826884 - DNA, 25 bp, Mus musculus
tgtcacccgagacaatccatgagaa

SEQ ID NO: 826885 - DNA, 25 bp, Mus musculus
tgtcacccgagagaatccatgagaa

SEQ ID NO: 826886 - DNA, 25 bp, Mus musculus
tgtcacccgcagagtgactctgagg

SEQ ID NO: 826887 - DNA, 25 bp, Mus musculus
tgtcacccgcagtgtgactctgagg

SEQ ID NO: 826888 - DNA, 25 bp, Mus musculus
tgtcaccctcgaatccgatgctcag

SEQ ID NO: 826889 - DNA, 25 bp, Mus musculus
tgtcaccctcgattccgatgctcag

SEQ ID NO: 826890 - DNA, 25 bp, Mus musculus
tgtcacccttcaaagcccctattag

SEQ ID NO: 826891 - DNA, 25 bp, Mus musculus
tgtcacccttcatagcccctattag

SEQ ID NO: 826892 - DNA, 25 bp, Mus musculus
tgtcacccttctcggactatttgat

SEQ ID NO: 826893 - DNA, 25 bp, Mus musculus
tgtcacccttctgggactatttgat

SEQ ID NO: 826894 - DNA, 25 bp, Mus musculus
tgtcaccgagatcaatggacgcatt

SEQ ID NO: 826895 - DNA, 25 bp, Mus musculus
tgtcaccgagatgaatggacgcatt

SEQ ID NO: 826896 - DNA, 25 bp, Mus musculus
tgtcaccgatagataaaaattggcc

SEQ ID NO: 826897 - DNA, 25 bp, Mus musculus
tgtcaccgatagttaaaaattggcc

SEQ ID NO: 826898 - DNA, 25 bp, Mus musculus
tgtcaccgcaggcacagaagagttc

SEQ ID NO: 826899 - DNA, 25 bp, Mus musculus
tgtcaccgcagggacagaagagttc

SEQ ID NO: 826900 - DNA, 25 bp, Mus musculus
tgtcaccgggctagtggttgcttcc

SEQ ID NO: 826901 - DNA, 25 bp, Mus musculus
tgtcaccgggcttgtggttgcttcc

SEQ ID NO: 826902 - DNA, 25 bp, Mus musculus
tgtcaccgtgacagggcacgtgact

SEQ ID NO: 826903 - DNA, 25 bp, Mus musculus
tgtcaccgtgactgggcacgtgact

SEQ ID NO: 826904 - DNA, 25 bp, Mus musculus
tgtcaccgtttcagcaggcaccatg

SEQ ID NO: 826905 - DNA, 25 bp, Mus musculus
tgtcaccgtttctgcaggcaccatg

SEQ ID NO: 826906 - DNA, 25 bp, Mus musculus
tgtcacctacaaagaatcatgggag

SEQ ID NO: 826907 - DNA, 25 bp, Mus musculus
tgtcacctacaacaagagagccaca

SEQ ID NO: 826908 - DNA, 25 bp, Mus musculus
tgtcacctacaagaagagagccaca

SEQ ID NO: 826909 - DNA, 25 bp, Mus musculus
tgtcacctacaatgaatcatgggag

SEQ ID NO: 826910 - DNA, 25 bp, Mus musculus
tgtcacctactacaagagacggcct

SEQ ID NO: 826911 - DNA, 25 bp, Mus musculus
tgtcacctactagaagagacggcct

SEQ ID NO: 826912 - DNA, 25 bp, Mus musculus
tgtcacctagtcaagtcactctgct

SEQ ID NO: 826913 - DNA, 25 bp, Mus musculus
tgtcacctagtctagtcactctgct

SEQ ID NO: 826914 - DNA, 25 bp, Mus musculus
tgtcacctatttagaagactgaggc

SEQ ID NO: 826915 - DNA, 25 bp, Mus musculus
tgtcacctattttgaagactgaggc

SEQ ID NO: 826916 - DNA, 25 bp, Mus musculus
tgtcacctcacgatcagcctgtgtg

SEQ ID NO: 826917 - DNA, 25 bp, Mus musculus
tgtcacctcacgttcagcctgtgtg

SEQ ID NO: 826918 - DNA, 25 bp, Mus musculus
tgtcacctcagacaatcacaaggga

SEQ ID NO: 826919 - DNA, 25 bp, Mus musculus
tgtcacctcagagaatcacaaggga

SEQ ID NO: 826920 - DNA, 25 bp, Mus musculus
tgtcacctcagcaatgggaaatatc

SEQ ID NO: 826921 - DNA, 25 bp, Mus musculus
tgtcacctcagctatgggaaatatc

SEQ ID NO: 826922 - DNA, 25 bp, Mus musculus
tgtcacctccaacacgcaggaactg

SEQ ID NO: 826923 - DNA, 25 bp, Mus musculus
tgtcacctccaagacgcaggaactg

SEQ ID NO: 826924 - DNA, 25 bp, Mus musculus
tgtcacctccggacttatcatgcag

SEQ ID NO: 826925 - DNA, 25 bp, Mus musculus
tgtcacctccggtcttatcatgcag

SEQ ID NO: 826926 - DNA, 25 bp, Mus musculus
tgtcacctctagatgacatcacgct

SEQ ID NO: 826927 - DNA, 25 bp, Mus musculus
tgtcacctctagttgacatcacgct

SEQ ID NO: 826928 - DNA, 25 bp, Mus musculus
tgtcacctgacccactgtttgttct

SEQ ID NO: 826929 - DNA, 25 bp, Mus musculus
tgtcacctgaccgactgtttgttct

SEQ ID NO: 826930 - DNA, 25 bp, Mus musculus
tgtcacctgagccttggaacatcct

SEQ ID NO: 826931 - DNA, 25 bp, Mus musculus
tgtcacctgagcgttggaacatcct

SEQ ID NO: 826932 - DNA, 25 bp, Mus musculus
tgtcacctggagcagaatcgggtta

SEQ ID NO: 826933 - DNA, 25 bp, Mus musculus
tgtcacctggaggagaatcgggtta

SEQ ID NO: 826934 - DNA, 25 bp, Mus musculus
tgtcacctggctccagactatccga

SEQ ID NO: 826935 - DNA, 25 bp, Mus musculus
tgtcacctggctgcagactatccga

SEQ ID NO: 826936 - DNA, 25 bp, Mus musculus
tgtcacctggtcaacctgcagagac

SEQ ID NO: 826937 - DNA, 25 bp, Mus musculus
tgtcacctggtctacctgcagagac

SEQ ID NO: 826938 - DNA, 25 bp, Mus musculus
tgtcacctgtaacagactggatggg

SEQ ID NO: 826939 - DNA, 25 bp, Mus musculus
tgtcacctgtaagagactggatggg

SEQ ID NO: 826940 - DNA, 25 bp, Mus musculus
tgtcaccttgttcgtcaaagggcca

SEQ ID NO: 826941 - DNA, 25 bp, Mus musculus
tgtcaccttgttggtcaaagggcca

SEQ ID NO: 826942 - DNA, 25 bp, Mus musculus
tgtcacgaacacaacaccacagagt

SEQ ID NO: 826943 - DNA, 25 bp, Mus musculus
tgtcacgaacactacaccacagagt

SEQ ID NO: 826944 - DNA, 25 bp, Mus musculus
tgtcacgatgctctctgccagccag

SEQ ID NO: 826945 - DNA, 25 bp, Mus musculus
tgtcacgatgctgtctgccagccag

SEQ ID NO: 826946 - DNA, 25 bp, Mus musculus
tgtcacgctactcaatgaactgaag

SEQ ID NO: 826947 - DNA, 25 bp, Mus musculus
tgtcacgctactgaatgaactgaag

SEQ ID NO: 826948 - DNA, 25 bp, Mus musculus
tgtcacggatatcggtaaccaaact

SEQ ID NO: 826949 - DNA, 25 bp, Mus musculus
tgtcacggatatgggtaaccaaact

SEQ ID NO: 826950 - DNA, 25 bp, Mus musculus
tgtcacggccgacttcaaggaaacg

SEQ ID NO: 826951 - DNA, 25 bp, Mus musculus
tgtcacggccgagttcaaggaaacg

SEQ ID NO: 826952 - DNA, 25 bp, Mus musculus
tgtcacggcttcagatgatggctac

SEQ ID NO: 826953 - DNA, 25 bp, Mus musculus
tgtcacggcttctgatgatggctac

SEQ ID NO: 826954 - DNA, 25 bp, Mus musculus
tgtcacgggagcaccccgggctcag

SEQ ID NO: 826955 - DNA, 25 bp, Mus musculus
tgtcacgggagctccccgggctcag

SEQ ID NO: 826956 - DNA, 25 bp, Mus musculus
tgtcacgtcggtaaaccaggcacct

SEQ ID NO: 826957 - DNA, 25 bp, Mus musculus
tgtcacgtcggttaaccaggcacct

SEQ ID NO: 826958 - DNA, 25 bp, Mus musculus
tgtcactacaacctgcttccatgat

SEQ ID NO: 826959 - DNA, 25 bp, Mus musculus
tgtcactacaacgtgcttccatgat

SEQ ID NO: 826960 - DNA, 25 bp, Mus musculus
tgtcactagaggagaccaaggaaca

SEQ ID NO: 826961 - DNA, 25 bp, Mus musculus
tgtcactagaggtgaccaaggaaca

SEQ ID NO: 826962 - DNA, 25 bp, Mus musculus
tgtcactagccccaagccaacaaaa

SEQ ID NO: 826963 - DNA, 25 bp, Mus musculus
tgtcactagcccgaagccaacaaaa

SEQ ID NO: 826964 - DNA, 25 bp, Mus musculus
tgtcactatacaaaagctgtcccgt

SEQ ID NO: 826965 - DNA, 25 bp, Mus musculus
tgtcactatacataagctgtcccgt

SEQ ID NO: 826966 - DNA, 25 bp, Mus musculus
tgtcactatgcacgaaggtaacttc

SEQ ID NO: 826967 - DNA, 25 bp, Mus musculus
tgtcactatgcaggaaggtaacttc

SEQ ID NO: 826968 - DNA, 25 bp, Mus musculus
tgtcactcaagaaccggaagtcatg

SEQ ID NO: 826969 - DNA, 25 bp, Mus musculus
tgtcactcaagaccagctgggtggt

SEQ ID NO: 826970 - DNA, 25 bp, Mus musculus
tgtcactcaagagcagctgggtggt

SEQ ID NO: 826971 - DNA, 25 bp, Mus musculus
tgtcactcaagatccggaagtcatg

SEQ ID NO: 826972 - DNA, 25 bp, Mus musculus
tgtcactcctttcggccacaagagg

SEQ ID NO: 826973 - DNA, 25 bp, Mus musculus
tgtcactcctttgggccacaagagg

SEQ ID NO: 826974 - DNA, 25 bp, Mus musculus
tgtcactcgaggctgtgctctgcag

SEQ ID NO: 826975 - DNA, 25 bp, Mus musculus
tgtcactcgagggtgtgctctgcag

SEQ ID NO: 826976 - DNA, 25 bp, Mus musculus
tgtcactcggagaccaaatcctgga

SEQ ID NO: 826977 - DNA, 25 bp, Mus musculus
tgtcactcggagtccaaatcctgga

SEQ ID NO: 826978 - DNA, 25 bp, Mus musculus
tgtcactgaagtattccctgagagc

SEQ ID NO: 826979 - DNA, 25 bp, Mus musculus
tgtcactgaagttttccctgagagc

SEQ ID NO: 826980 - DNA, 25 bp, Mus musculus
tgtcactgaatgctgcccgctacgc

SEQ ID NO: 826981 - DNA, 25 bp, Mus musculus
tgtcactgaatggtgcccgctacgc

SEQ ID NO: 826982 - DNA, 25 bp, Mus musculus
tgtcactgagacagctggatctgca

SEQ ID NO: 826983 - DNA, 25 bp, Mus musculus
tgtcactgagactgctggatctgca

SEQ ID NO: 826984 - DNA, 25 bp, Mus musculus
tgtcactgagcccaaagagccaggg

SEQ ID NO: 826985 - DNA, 25 bp, Mus musculus
tgtcactgagccgaaagagccaggg

SEQ ID NO: 826986 - DNA, 25 bp, Mus musculus
tgtcactgatgaagaccattatcaa

SEQ ID NO: 826987 - DNA, 25 bp, Mus musculus
tgtcactgatgatgaccattatcaa

SEQ ID NO: 826988 - DNA, 25 bp, Mus musculus
tgtcactgatgcagtctgggctccg

SEQ ID NO: 826989 - DNA, 25 bp, Mus musculus
tgtcactgatgctgtctgggctccg

SEQ ID NO: 826990 - DNA, 25 bp, Mus musculus
tgtcactgcaaaagaaactcaaggg

SEQ ID NO: 826991 - DNA, 25 bp, Mus musculus
tgtcactgcaaatgaaactcaaggg

SEQ ID NO: 826992 - DNA, 25 bp, Mus musculus
tgtcactgcactcagttgctggctt

SEQ ID NO: 826993 - DNA, 25 bp, Mus musculus
tgtcactgcactgagttgctggctt

SEQ ID NO: 826994 - DNA, 25 bp, Mus musculus
tgtcactggacccatttgaaaacca

SEQ ID NO: 826995 - DNA, 25 bp, Mus musculus
tgtcactggaccgatttgaaaacca

SEQ ID NO: 826996 - DNA, 25 bp, Mus musculus
tgtcactggcaaacagacatggagt

SEQ ID NO: 826997 - DNA, 25 bp, Mus musculus
tgtcactggcaatcagacatggagt

SEQ ID NO: 826998 - DNA, 25 bp, Mus musculus
tgtcactggcggcaacactctgctt

SEQ ID NO: 826999 - DNA, 25 bp, Mus musculus
tgtcactggcgggaacactctgctt

SEQ ID NO: 827000 - DNA, 25 bp, Mus musculus
tgtcactggtgtctaactaagcgcc

SEQ ID NO: 827001 - DNA, 25 bp, Mus musculus
tgtcactggtgtgtaactaagcgcc

SEQ ID NO: 827002 - DNA, 25 bp, Mus musculus
tgtcacttcccacaagatgatggcc

SEQ ID NO: 827003 - DNA, 25 bp, Mus musculus
tgtcacttcccagaagatgatggcc

SEQ ID NO: 827004 - DNA, 25 bp, Mus musculus
tgtcacttgagaaaatagaaccaac

SEQ ID NO: 827005 - DNA, 25 bp, Mus musculus
tgtcacttgagataatagaaccaac

SEQ ID NO: 827006 - DNA, 25 bp, Mus musculus
tgtcacttgtcacacatgccggtca

SEQ ID NO: 827007 - DNA, 25 bp, Mus musculus
tgtcacttgtcagacatgccggtca

SEQ ID NO: 827008 - DNA, 25 bp, Mus musculus
tgtcagaaacgaaggcagccctggc

SEQ ID NO: 827009 - DNA, 25 bp, Mus musculus
tgtcagaaacgatggcagccctggc

SEQ ID NO: 827010 - DNA, 25 bp, Mus musculus
tgtcagaaagatcgatcttgggacc

SEQ ID NO: 827011 - DNA, 25 bp, Mus musculus
tgtcagaaagatggatcttgggacc

SEQ ID NO: 827012 - DNA, 25 bp, Mus musculus
tgtcagaaatatcgaccagtggttt

SEQ ID NO: 827013 - DNA, 25 bp, Mus musculus
tgtcagaaatatggaccagtggttt

SEQ ID NO: 827014 - DNA, 25 bp, Mus musculus
tgtcagaacactcaatgcaactggg

SEQ ID NO: 827015 - DNA, 25 bp, Mus musculus
tgtcagaacactgaatgcaactggg

SEQ ID NO: 827016 - DNA, 25 bp, Mus musculus
tgtcagaaccgtccgcgctgcaagg

SEQ ID NO: 827017 - DNA, 25 bp, Mus musculus
tgtcagaaccgtgcgcgctgcaagg

SEQ ID NO: 827018 - DNA, 25 bp, Mus musculus
tgtcagaacctgagcattgtgtctc

SEQ ID NO: 827019 - DNA, 25 bp, Mus musculus
tgtcagaacctgtgcattgtgtctc

SEQ ID NO: 827020 - DNA, 25 bp, Mus musculus
tgtcagaactatccaccattactct

SEQ ID NO: 827021 - DNA, 25 bp, Mus musculus
tgtcagaactatgcaccattactct

SEQ ID NO: 827022 - DNA, 25 bp, Mus musculus
tgtcagaacttgaaggcaatccggg

SEQ ID NO: 827023 - DNA, 25 bp, Mus musculus
tgtcagaacttgtaggcaatccggg

SEQ ID NO: 827024 - DNA, 25 bp, Mus musculus
tgtcagaagacaatgccaacaaact

SEQ ID NO: 827025 - DNA, 25 bp, Mus musculus
tgtcagaagacattgccaacaaact

SEQ ID NO: 827026 - DNA, 25 bp, Mus musculus
tgtcagaagttcctgctaaatggat

SEQ ID NO: 827027 - DNA, 25 bp, Mus musculus
tgtcagaagttcgtgctaaatggat

SEQ ID NO: 827028 - DNA, 25 bp, Mus musculus
tgtcagaataccatacacgaaagac

SEQ ID NO: 827029 - DNA, 25 bp, Mus musculus
tgtcagaataccttacacgaaagac

SEQ ID NO: 827030 - DNA, 25 bp, Mus musculus
tgtcagaatatgatgatctccgtcg

SEQ ID NO: 827031 - DNA, 25 bp, Mus musculus
tgtcagaatatgttgatctccgtcg

SEQ ID NO: 827032 - DNA, 25 bp, Mus musculus
tgtcagaatgctaatgcctaggccg

SEQ ID NO: 827033 - DNA, 25 bp, Mus musculus
tgtcagaatgcttatgcctaggccg

SEQ ID NO: 827034 - DNA, 25 bp, Mus musculus
tgtcagaattatcccaaggaggtgg

SEQ ID NO: 827035 - DNA, 25 bp, Mus musculus
tgtcagaattatgccaaggaggtgg

SEQ ID NO: 827036 - DNA, 25 bp, Mus musculus
tgtcagaatttgaagagattgaggg

SEQ ID NO: 827037 - DNA, 25 bp, Mus musculus
tgtcagaatttgtagagattgaggg

SEQ ID NO: 827038 - DNA, 25 bp, Mus musculus
tgtcagacatcaaagctctgatccg

SEQ ID NO: 827039 - DNA, 25 bp, Mus musculus
tgtcagacatcatagctctgatccg

SEQ ID NO: 827040 - DNA, 25 bp, Mus musculus
tgtcagacattcctgcacagatgga

SEQ ID NO: 827041 - DNA, 25 bp, Mus musculus
tgtcagacattcgtgcacagatgga

SEQ ID NO: 827042 - DNA, 25 bp, Mus musculus
tgtcagaccccgagtggcagaggaa

SEQ ID NO: 827043 - DNA, 25 bp, Mus musculus
tgtcagaccccgtgtggcagaggaa

SEQ ID NO: 827044 - DNA, 25 bp, Mus musculus
tgtcagactccacctacgacgaaca

SEQ ID NO: 827045 - DNA, 25 bp, Mus musculus
tgtcagactccagctacgacgaaca

SEQ ID NO: 827046 - DNA, 25 bp, Mus musculus
tgtcagactcctctgctttcggctc

SEQ ID NO: 827047 - DNA, 25 bp, Mus musculus
tgtcagactcctgtgctttcggctc

SEQ ID NO: 827048 - DNA, 25 bp, Mus musculus
tgtcagagaaggagtttaactttct

SEQ ID NO: 827049 - DNA, 25 bp, Mus musculus
tgtcagagaaggtgtttaactttct

SEQ ID NO: 827050 - DNA, 25 bp, Mus musculus
tgtcagagaccaagggagtgtccct

SEQ ID NO: 827051 - DNA, 25 bp, Mus musculus
tgtcagagaccatgggagtgtccct

SEQ ID NO: 827052 - DNA, 25 bp, Mus musculus
tgtcagagactaagaccacagggta

SEQ ID NO: 827053 - DNA, 25 bp, Mus musculus
tgtcagagactatgaccacagggta

SEQ ID NO: 827054 - DNA, 25 bp, Mus musculus
tgtcagagatgcagacagagctggt

SEQ ID NO: 827055 - DNA, 25 bp, Mus musculus
tgtcagagatgctgacagagctggt

SEQ ID NO: 827056 - DNA, 25 bp, Mus musculus
tgtcagagcccaaagagcctgaggc

SEQ ID NO: 827057 - DNA, 25 bp, Mus musculus
tgtcagagcccatagagcctgaggc

SEQ ID NO: 827058 - DNA, 25 bp, Mus musculus
tgtcagagcctgagaacatgcctta

SEQ ID NO: 827059 - DNA, 25 bp, Mus musculus
tgtcagagcctgtgaacatgcctta

SEQ ID NO: 827060 - DNA, 25 bp, Mus musculus
tgtcagaggtgcaaacggagatcct

SEQ ID NO: 827061 - DNA, 25 bp, Mus musculus
tgtcagaggtgctaacggagatcct

SEQ ID NO: 827062 - DNA, 25 bp, Mus musculus
tgtcagagtgggagtcctactacaa

SEQ ID NO: 827063 - DNA, 25 bp, Mus musculus
tgtcagagtgggtgtcctactacaa

SEQ ID NO: 827064 - DNA, 25 bp, Mus musculus
tgtcagatctgtcggaagccttcct

SEQ ID NO: 827065 - DNA, 25 bp, Mus musculus
tgtcagatctgtgggaagccttcct

SEQ ID NO: 827066 - DNA, 25 bp, Mus musculus
tgtcagatgacccttgccatgcagg

SEQ ID NO: 827067 - DNA, 25 bp, Mus musculus
tgtcagatgaccgttgccatgcagg

SEQ ID NO: 827068 - DNA, 25 bp, Mus musculus
tgtcagatgagaagattgcgattac

SEQ ID NO: 827069 - DNA, 25 bp, Mus musculus
tgtcagatgagatgattgcgattac

SEQ ID NO: 827070 - DNA, 25 bp, Mus musculus
tgtcagatgccacgtcttccttggc

SEQ ID NO: 827071 - DNA, 25 bp, Mus musculus
tgtcagatgccaggtcttccttggc

SEQ ID NO: 827072 - DNA, 25 bp, Mus musculus
tgtcagatggtgcatgggaattaaa

SEQ ID NO: 827073 - DNA, 25 bp, Mus musculus
tgtcagatggtggatgggaattaaa

SEQ ID NO: 827074 - DNA, 25 bp, Mus musculus
tgtcagatgtcactgtcactcatcc

SEQ ID NO: 827075 - DNA, 25 bp, Mus musculus
tgtcagatgtcagtgtcactcatcc

SEQ ID NO: 827076 - DNA, 25 bp, Mus musculus
tgtcagattctgagacgcattcaac

SEQ ID NO: 827077 - DNA, 25 bp, Mus musculus
tgtcagattctgtgacgcattcaac

SEQ ID NO: 827078 - DNA, 25 bp, Mus musculus
tgtcagattgatcagcaccaccgga

SEQ ID NO: 827079 - DNA, 25 bp, Mus musculus
tgtcagattgatgagcaccaccgga

SEQ ID NO: 827080 - DNA, 25 bp, Mus musculus
tgtcagcaaagcctatcgaagaatc

SEQ ID NO: 827081 - DNA, 25 bp, Mus musculus
tgtcagcaaagcgtatcgaagaatc

SEQ ID NO: 827082 - DNA, 25 bp, Mus musculus
tgtcagcaacctcaacaggcagttc

SEQ ID NO: 827083 - DNA, 25 bp, Mus musculus
tgtcagcaacctgaacaggcagttc

SEQ ID NO: 827084 - DNA, 25 bp, Mus musculus
tgtcagcaactgagacagaggcctt

SEQ ID NO: 827085 - DNA, 25 bp, Mus musculus
tgtcagcaactgtgacagaggcctt

SEQ ID NO: 827086 - DNA, 25 bp, Mus musculus
tgtcagcacagcagcgaggacacgg

SEQ ID NO: 827087 - DNA, 25 bp, Mus musculus
tgtcagcacagctgcgaggacacgg

SEQ ID NO: 827088 - DNA, 25 bp, Mus musculus
tgtcagcacctcaacagaaagtgct

SEQ ID NO: 827089 - DNA, 25 bp, Mus musculus
tgtcagcacctctacagaaagtgct

SEQ ID NO: 827090 - DNA, 25 bp, Mus musculus
tgtcagcacgtgctatcagcctgcc

SEQ ID NO: 827091 - DNA, 25 bp, Mus musculus
tgtcagcacgtggtatcagcctgcc

SEQ ID NO: 827092 - DNA, 25 bp, Mus musculus
tgtcagcagcggcaaccttgtctca

SEQ ID NO: 827093 - DNA, 25 bp, Mus musculus
tgtcagcagcgggaaccttgtctca

SEQ ID NO: 827094 - DNA, 25 bp, Mus musculus
tgtcagcagcgtcaagagcatttcc

SEQ ID NO: 827095 - DNA, 25 bp, Mus musculus
tgtcagcagcgtgaagagcatttcc

SEQ ID NO: 827096 - DNA, 25 bp, Mus musculus
tgtcagcagggcaccaacatgacgc

SEQ ID NO: 827097 - DNA, 25 bp, Mus musculus
tgtcagcagggctccaacatgacgc

SEQ ID NO: 827098 - DNA, 25 bp, Mus musculus
tgtcagcagttgagaggcacacaaa

SEQ ID NO: 827099 - DNA, 25 bp, Mus musculus
tgtcagcagttgtgaggcacacaaa

SEQ ID NO: 827100 - DNA, 25 bp, Mus musculus
tgtcagcccaagactccaagtactc

SEQ ID NO: 827101 - DNA, 25 bp, Mus musculus
tgtcagcccaagtctccaagtactc

SEQ ID NO: 827102 - DNA, 25 bp, Mus musculus
tgtcagcccagtatcccatcgatca

SEQ ID NO: 827103 - DNA, 25 bp, Mus musculus
tgtcagcccagtttcccatcgatca

SEQ ID NO: 827104 - DNA, 25 bp, Mus musculus
tgtcagcccatactctgagccattg

SEQ ID NO: 827105 - DNA, 25 bp, Mus musculus
tgtcagcccatagtctgagccattg

SEQ ID NO: 827106 - DNA, 25 bp, Mus musculus
tgtcagcccgccagatgacagcttg

SEQ ID NO: 827107 - DNA, 25 bp, Mus musculus
tgtcagcccgcctgatgacagcttg

SEQ ID NO: 827108 - DNA, 25 bp, Mus musculus
tgtcagccgctcacaagctattaga

SEQ ID NO: 827109 - DNA, 25 bp, Mus musculus
tgtcagccgctctcaagctattaga

SEQ ID NO: 827110 - DNA, 25 bp, Mus musculus
tgtcagccggatccttgggcccatt

SEQ ID NO: 827111 - DNA, 25 bp, Mus musculus
tgtcagccggatgcttgggcccatt

SEQ ID NO: 827112 - DNA, 25 bp, Mus musculus
tgtcagcctcaacgcattacgtcac

SEQ ID NO: 827113 - DNA, 25 bp, Mus musculus
tgtcagcctcaaggcattacgtcac

SEQ ID NO: 827114 - DNA, 25 bp, Mus musculus
tgtcagcctgaaatttctcccagcg

SEQ ID NO: 827115 - DNA, 25 bp, Mus musculus
tgtcagcctgaattttctcccagcg

SEQ ID NO: 827116 - DNA, 25 bp, Mus musculus
tgtcagcctttgattttattaagaa

SEQ ID NO: 827117 - DNA, 25 bp, Mus musculus
tgtcagcctttgtttttattaagaa

SEQ ID NO: 827118 - DNA, 25 bp, Mus musculus
tgtcagcgagttcctgctttggaga

SEQ ID NO: 827119 - DNA, 25 bp, Mus musculus
tgtcagcgagttgctgctttggaga

SEQ ID NO: 827120 - DNA, 25 bp, Mus musculus
tgtcagcgcccaactagtgcaagga

SEQ ID NO: 827121 - DNA, 25 bp, Mus musculus
tgtcagcgcccatctagtgcaagga

SEQ ID NO: 827122 - DNA, 25 bp, Mus musculus
tgtcagcgcctcacaggatggaaaa

SEQ ID NO: 827123 - DNA, 25 bp, Mus musculus
tgtcagcgcctctcaggatggaaaa

SEQ ID NO: 827124 - DNA, 25 bp, Mus musculus
tgtcagcgcgggagtttctttcagc

SEQ ID NO: 827125 - DNA, 25 bp, Mus musculus
tgtcagcgcgggtgtttctttcagc

SEQ ID NO: 827126 - DNA, 25 bp, Mus musculus
tgtcagcgctccaaaagcaaatgcc

SEQ ID NO: 827127 - DNA, 25 bp, Mus musculus
tgtcagcgctcctaaagcaaatgcc

SEQ ID NO: 827128 - DNA, 25 bp, Mus musculus
tgtcagcgctgccagcagcccattg

SEQ ID NO: 827129 - DNA, 25 bp, Mus musculus
tgtcagcgctgcgagcagcccattg

SEQ ID NO: 827130 - DNA, 25 bp, Mus musculus
tgtcagcggctccaattttctgcct

SEQ ID NO: 827131 - DNA, 25 bp, Mus musculus
tgtcagcggctcgaattttctgcct

SEQ ID NO: 827132 - DNA, 25 bp, Mus musculus
tgtcagcgtatcatccaggtgaacg

SEQ ID NO: 827133 - DNA, 25 bp, Mus musculus
tgtcagcgtatcttccaggtgaacg

SEQ ID NO: 827134 - DNA, 25 bp, Mus musculus
tgtcagctatgaagcagagtccctg

SEQ ID NO: 827135 - DNA, 25 bp, Mus musculus
tgtcagctatgatgcagagtccctg

SEQ ID NO: 827136 - DNA, 25 bp, Mus musculus
tgtcagctcacacaattccaaagga

SEQ ID NO: 827137 - DNA, 25 bp, Mus musculus
tgtcagctcacagaattccaaagga

SEQ ID NO: 827138 - DNA, 25 bp, Mus musculus
tgtcagctccgcctacaacaaagtg

SEQ ID NO: 827139 - DNA, 25 bp, Mus musculus
tgtcagctccgcgtacaacaaagtg

SEQ ID NO: 827140 - DNA, 25 bp, Mus musculus
tgtcagctccgtccttctgggtgct

SEQ ID NO: 827141 - DNA, 25 bp, Mus musculus
tgtcagctccgtgcttctgggtgct

SEQ ID NO: 827142 - DNA, 25 bp, Mus musculus
tgtcagctcgatagcggcagcacca

SEQ ID NO: 827143 - DNA, 25 bp, Mus musculus
tgtcagctcgattgcggcagcacca

SEQ ID NO: 827144 - DNA, 25 bp, Mus musculus
tgtcagctcgccaaggagcagatac

SEQ ID NO: 827145 - DNA, 25 bp, Mus musculus
tgtcagctcgcctaggagcagatac

SEQ ID NO: 827146 - DNA, 25 bp, Mus musculus
tgtcagctgataccatccctacaag

SEQ ID NO: 827147 - DNA, 25 bp, Mus musculus
tgtcagctgatagcatccctacaag

SEQ ID NO: 827148 - DNA, 25 bp, Mus musculus
tgtcagctgcacaaaggccagtcct

SEQ ID NO: 827149 - DNA, 25 bp, Mus musculus
tgtcagctgcactaaggccagtcct

SEQ ID NO: 827150 - DNA, 25 bp, Mus musculus
tgtcagctgcgcatggaaggaactt

SEQ ID NO: 827151 - DNA, 25 bp, Mus musculus
tgtcagctgcgcttggaaggaactt

SEQ ID NO: 827152 - DNA, 25 bp, Mus musculus
tgtcagcttctgctctcacagcaga

SEQ ID NO: 827153 - DNA, 25 bp, Mus musculus
tgtcagcttctggtctcacagcaga

SEQ ID NO: 827154 - DNA, 25 bp, Mus musculus
tgtcagcttgcaccaactgtgcagg

SEQ ID NO: 827155 - DNA, 25 bp, Mus musculus
tgtcagcttgcagcaactgtgcagg

SEQ ID NO: 827156 - DNA, 25 bp, Mus musculus
tgtcaggaagccaggctcgcctgat

SEQ ID NO: 827157 - DNA, 25 bp, Mus musculus
tgtcaggaagcctggctcgcctgat

SEQ ID NO: 827158 - DNA, 25 bp, Mus musculus
tgtcaggaccctaaaaactcaatca

SEQ ID NO: 827159 - DNA, 25 bp, Mus musculus
tgtcaggacccttaaaactcaatca

SEQ ID NO: 827160 - DNA, 25 bp, Mus musculus
tgtcaggacctacgaaacttttgga

SEQ ID NO: 827161 - DNA, 25 bp, Mus musculus
tgtcaggacctaggaaacttttgga

SEQ ID NO: 827162 - DNA, 25 bp, Mus musculus
tgtcaggagcagaagaaaagggaca

SEQ ID NO: 827163 - DNA, 25 bp, Mus musculus
tgtcaggagcagtagaaaagggaca

SEQ ID NO: 827164 - DNA, 25 bp, Mus musculus
tgtcaggagcccaggaagaccgtgt

SEQ ID NO: 827165 - DNA, 25 bp, Mus musculus
tgtcaggagccctggaagaccgtgt

SEQ ID NO: 827166 - DNA, 25 bp, Mus musculus
tgtcaggaggcaactctggtgactg

SEQ ID NO: 827167 - DNA, 25 bp, Mus musculus
tgtcaggaggcatctctggtgactg

SEQ ID NO: 827168 - DNA, 25 bp, Mus musculus
tgtcaggagtttcccgtggacttag

SEQ ID NO: 827169 - DNA, 25 bp, Mus musculus
tgtcaggagtttgccgtggacttag

SEQ ID NO: 827170 - DNA, 25 bp, Mus musculus
tgtcaggcagaacataccatgtcca

SEQ ID NO: 827171 - DNA, 25 bp, Mus musculus
tgtcaggcagaagataccatgtcca

SEQ ID NO: 827172 - DNA, 25 bp, Mus musculus
tgtcaggccttcagtgattttgcta

SEQ ID NO: 827173 - DNA, 25 bp, Mus musculus
tgtcaggccttctgtgattttgcta

SEQ ID NO: 827174 - DNA, 25 bp, Mus musculus
tgtcaggcttgcaagataacatcaa

SEQ ID NO: 827175 - DNA, 25 bp, Mus musculus
tgtcaggcttgctagataacatcaa

SEQ ID NO: 827176 - DNA, 25 bp, Mus musculus
tgtcagggaactcgatcagagtcca

SEQ ID NO: 827177 - DNA, 25 bp, Mus musculus
tgtcagggaactggatcagagtcca

SEQ ID NO: 827178 - DNA, 25 bp, Mus musculus
tgtcagggcgttcgtcatccccaga

SEQ ID NO: 827179 - DNA, 25 bp, Mus musculus
tgtcagggcgttggtcatccccaga

SEQ ID NO: 827180 - DNA, 25 bp, Mus musculus
tgtcagggtctccagtcacaccatg

SEQ ID NO: 827181 - DNA, 25 bp, Mus musculus
tgtcagggtctcgagtcacaccatg

SEQ ID NO: 827182 - DNA, 25 bp, Mus musculus
tgtcaggtgtttagggtgtagaatt

SEQ ID NO: 827183 - DNA, 25 bp, Mus musculus
tgtcaggtgttttgggtgtagaatt

SEQ ID NO: 827184 - DNA, 25 bp, Mus musculus
tgtcagtacaaacgatcagtacccg

SEQ ID NO: 827185 - DNA, 25 bp, Mus musculus
tgtcagtacaaaggatcagtacccg

SEQ ID NO: 827186 - DNA, 25 bp, Mus musculus
tgtcagtacatgcacaagcaccctg

SEQ ID NO: 827187 - DNA, 25 bp, Mus musculus
tgtcagtacatggacaagcaccctg

SEQ ID NO: 827188 - DNA, 25 bp, Mus musculus
tgtcagtaccaacaaggcacagcgg

SEQ ID NO: 827189 - DNA, 25 bp, Mus musculus
tgtcagtaccaagaaggcacagcgg

SEQ ID NO: 827190 - DNA, 25 bp, Mus musculus
tgtcagtcacagaggagatgaatcc

SEQ ID NO: 827191 - DNA, 25 bp, Mus musculus
tgtcagtcacagtggagatgaatcc

SEQ ID NO: 827192 - DNA, 25 bp, Mus musculus
tgtcagtcaccaaagaataccgcct

SEQ ID NO: 827193 - DNA, 25 bp, Mus musculus
tgtcagtcaccatagaataccgcct

SEQ ID NO: 827194 - DNA, 25 bp, Mus musculus
tgtcagtcacccatggaaatgttgg

SEQ ID NO: 827195 - DNA, 25 bp, Mus musculus
tgtcagtcacccttggaaatgttgg

SEQ ID NO: 827196 - DNA, 25 bp, Mus musculus
tgtcagtccaccacatcccagggtg

SEQ ID NO: 827197 - DNA, 25 bp, Mus musculus
tgtcagtccacctcatcccagggtg

SEQ ID NO: 827198 - DNA, 25 bp, Mus musculus
tgtcagtcccataggaggtcctggc

SEQ ID NO: 827199 - DNA, 25 bp, Mus musculus
tgtcagtcccattggaggtcctggc

SEQ ID NO: 827200 - DNA, 25 bp, Mus musculus
tgtcagtcctgaaggagggctctgc

SEQ ID NO: 827201 - DNA, 25 bp, Mus musculus
tgtcagtcctgatggagggctctgc

SEQ ID NO: 827202 - DNA, 25 bp, Mus musculus
tgtcagtctctacccagacttctct

SEQ ID NO: 827203 - DNA, 25 bp, Mus musculus
tgtcagtctctagccagacttctct

SEQ ID NO: 827204 - DNA, 25 bp, Mus musculus
tgtcagtgaaggaattctggcagta

SEQ ID NO: 827205 - DNA, 25 bp, Mus musculus
tgtcagtgaaggtattctggcagta

SEQ ID NO: 827206 - DNA, 25 bp, Mus musculus
tgtcagtgagacctacccagaaaaa

SEQ ID NO: 827207 - DNA, 25 bp, Mus musculus
tgtcagtgagacgtacccagaaaaa

SEQ ID NO: 827208 - DNA, 25 bp, Mus musculus
tgtcagtgaggcatgagcttccgcc

SEQ ID NO: 827209 - DNA, 25 bp, Mus musculus
tgtcagtgaggcttgagcttccgcc

SEQ ID NO: 827210 - DNA, 25 bp, Mus musculus
tgtcagtgcctcaccggctatcatc

SEQ ID NO: 827211 - DNA, 25 bp, Mus musculus
tgtcagtgcctctccggctatcatc

SEQ ID NO: 827212 - DNA, 25 bp, Mus musculus
tgtcagtgctgtcctttaagggcgc

SEQ ID NO: 827213 - DNA, 25 bp, Mus musculus
tgtcagtgctgtgctttaagggcgc

SEQ ID NO: 827214 - DNA, 25 bp, Mus musculus
tgtcagtggatcagacgacaccaaa

SEQ ID NO: 827215 - DNA, 25 bp, Mus musculus
tgtcagtggatctgacgacaccaaa

SEQ ID NO: 827216 - DNA, 25 bp, Mus musculus
tgtcagtggattccctcggtactct

SEQ ID NO: 827217 - DNA, 25 bp, Mus musculus
tgtcagtggattgcctcggtactct

SEQ ID NO: 827218 - DNA, 25 bp, Mus musculus
tgtcagtggttccaaagttctctcc

SEQ ID NO: 827219 - DNA, 25 bp, Mus musculus
tgtcagtggttcgaaagttctctcc

SEQ ID NO: 827220 - DNA, 25 bp, Mus musculus
tgtcagtgtgataaacaataaaagt

SEQ ID NO: 827221 - DNA, 25 bp, Mus musculus
tgtcagtgtgattaacaataaaagt

SEQ ID NO: 827222 - DNA, 25 bp, Mus musculus
tgtcagtgttgtacatcatggcccc

SEQ ID NO: 827223 - DNA, 25 bp, Mus musculus
tgtcagtgttgttcatcatggcccc

SEQ ID NO: 827224 - DNA, 25 bp, Mus musculus
tgtcagttattgctctgggatccaa

SEQ ID NO: 827225 - DNA, 25 bp, Mus musculus
tgtcagttattggtctgggatccaa

SEQ ID NO: 827226 - DNA, 25 bp, Mus musculus
tgtcagttcccgaccaagttcccgg

SEQ ID NO: 827227 - DNA, 25 bp, Mus musculus
tgtcagttcccgtccaagttcccgg

SEQ ID NO: 827228 - DNA, 25 bp, Mus musculus
tgtcagtttcccagatcgcagggtt

SEQ ID NO: 827229 - DNA, 25 bp, Mus musculus
tgtcagtttccctgatcgcagggtt

SEQ ID NO: 827230 - DNA, 25 bp, Mus musculus
tgtcataaactcattatcagtggat

SEQ ID NO: 827231 - DNA, 25 bp, Mus musculus
tgtcataaactctttatcagtggat

SEQ ID NO: 827232 - DNA, 25 bp, Mus musculus
tgtcataacaggatgagggttcagc

SEQ ID NO: 827233 - DNA, 25 bp, Mus musculus
tgtcataacaggttgagggttcagc

SEQ ID NO: 827234 - DNA, 25 bp, Mus musculus
tgtcataatagtccactcctcggct

SEQ ID NO: 827235 - DNA, 25 bp, Mus musculus
tgtcataatagtgcactcctcggct

SEQ ID NO: 827236 - DNA, 25 bp, Mus musculus
tgtcatacaagtctcgggaagaaga

SEQ ID NO: 827237 - DNA, 25 bp, Mus musculus
tgtcatacaagtgtcgggaagaaga

SEQ ID NO: 827238 - DNA, 25 bp, Mus musculus
tgtcatacccagcagcgtcacatgg

SEQ ID NO: 827239 - DNA, 25 bp, Mus musculus
tgtcatacccaggagcgtcacatgg

SEQ ID NO: 827240 - DNA, 25 bp, Mus musculus
tgtcatagatataggcagagcccag

SEQ ID NO: 827241 - DNA, 25 bp, Mus musculus
tgtcatagatattggcagagcccag

SEQ ID NO: 827242 - DNA, 25 bp, Mus musculus
tgtcatagcatcacctctcggagtg

SEQ ID NO: 827243 - DNA, 25 bp, Mus musculus
tgtcatagcatctcctctcggagtg

SEQ ID NO: 827244 - DNA, 25 bp, Mus musculus
tgtcatagccaactgggactacact

SEQ ID NO: 827245 - DNA, 25 bp, Mus musculus
tgtcatagccaagtgggactacact

SEQ ID NO: 827246 - DNA, 25 bp, Mus musculus
tgtcatagccatcctgagagagcca

SEQ ID NO: 827247 - DNA, 25 bp, Mus musculus
tgtcatagccatgctgagagagcca

SEQ ID NO: 827248 - DNA, 25 bp, Mus musculus
tgtcatagtaacaggcggcaaagtg

SEQ ID NO: 827249 - DNA, 25 bp, Mus musculus
tgtcatagtaactggcggcaaagtg

SEQ ID NO: 827250 - DNA, 25 bp, Mus musculus
tgtcatattatgcacacttgagtac

SEQ ID NO: 827251 - DNA, 25 bp, Mus musculus
tgtcatattatggacacttgagtac

SEQ ID NO: 827252 - DNA, 25 bp, Mus musculus
tgtcatcaaactcctggcgcctctt

SEQ ID NO: 827253 - DNA, 25 bp, Mus musculus
tgtcatcaaactgctggcgcctctt

SEQ ID NO: 827254 - DNA, 25 bp, Mus musculus
tgtcatcaacacctgggctctttgg

SEQ ID NO: 827255 - DNA, 25 bp, Mus musculus
tgtcatcaacacgtgggctctttgg

SEQ ID NO: 827256 - DNA, 25 bp, Mus musculus
tgtcatcaactgctgggcagctgtc

SEQ ID NO: 827257 - DNA, 25 bp, Mus musculus
tgtcatcaactggtgggcagctgtc

SEQ ID NO: 827258 - DNA, 25 bp, Mus musculus
tgtcatcaagctacaagagattcca

SEQ ID NO: 827259 - DNA, 25 bp, Mus musculus
tgtcatcaagctccgttccgtggcc

SEQ ID NO: 827260 - DNA, 25 bp, Mus musculus
tgtcatcaagctgcgttccgtggcc

SEQ ID NO: 827261 - DNA, 25 bp, Mus musculus
tgtcatcaagcttcaagagattcca

SEQ ID NO: 827262 - DNA, 25 bp, Mus musculus
tgtcatcaaggcacggaagctgtcc

SEQ ID NO: 827263 - DNA, 25 bp, Mus musculus
tgtcatcaaggctcggaagctgtcc

SEQ ID NO: 827264 - DNA, 25 bp, Mus musculus
tgtcatcaagtacggaaacaggaag

SEQ ID NO: 827265 - DNA, 25 bp, Mus musculus
tgtcatcaagtagggaaacaggaag

SEQ ID NO: 827266 - DNA, 25 bp, Mus musculus
tgtcatcaatagaactactgccata

SEQ ID NO: 827267 - DNA, 25 bp, Mus musculus
tgtcatcaatagtactactgccata

SEQ ID NO: 827268 - DNA, 25 bp, Mus musculus
tgtcatcaatgcatcgtggtcggtc

SEQ ID NO: 827269 - DNA, 25 bp, Mus musculus
tgtcatcaatgcttcgtggtcggtc

SEQ ID NO: 827270 - DNA, 25 bp, Mus musculus
tgtcatcacactccttaacactgtg

SEQ ID NO: 827271 - DNA, 25 bp, Mus musculus
tgtcatcacactgcttaacactgtg

SEQ ID NO: 827272 - DNA, 25 bp, Mus musculus
tgtcatcaccatcatcaagattgtg

SEQ ID NO: 827273 - DNA, 25 bp, Mus musculus
tgtcatcaccatgatcaagattgtg

SEQ ID NO: 827274 - DNA, 25 bp, Mus musculus
tgtcatcacgccatctacgcgctag

SEQ ID NO: 827275 - DNA, 25 bp, Mus musculus
tgtcatcacgccttctacgcgctag

SEQ ID NO: 827276 - DNA, 25 bp, Mus musculus
tgtcatcacggacccagttagaaga

SEQ ID NO: 827277 - DNA, 25 bp, Mus musculus
tgtcatcacggagccagttagaaga

SEQ ID NO: 827278 - DNA, 25 bp, Mus musculus
tgtcatcagcagcacatggggtcct

SEQ ID NO: 827279 - DNA, 25 bp, Mus musculus
tgtcatcagcaggacatggggtcct

SEQ ID NO: 827280 - DNA, 25 bp, Mus musculus
tgtcatcagcccacctgagttctat

SEQ ID NO: 827281 - DNA, 25 bp, Mus musculus
tgtcatcagccctcctgagttctat

SEQ ID NO: 827282 - DNA, 25 bp, Mus musculus
tgtcatcaggaaatttctgaaggag

SEQ ID NO: 827283 - DNA, 25 bp, Mus musculus
tgtcatcaggaattttctgaaggag

SEQ ID NO: 827284 - DNA, 25 bp, Mus musculus
tgtcatcaggcaccggaaggcagct

SEQ ID NO: 827285 - DNA, 25 bp, Mus musculus
tgtcatcaggcagcggaaggcagct

SEQ ID NO: 827286 - DNA, 25 bp, Mus musculus
tgtcatccacccagagagtaacaac

SEQ ID NO: 827287 - DNA, 25 bp, Mus musculus
tgtcatccaccctgagagtaacaac

SEQ ID NO: 827288 - DNA, 25 bp, Mus musculus
tgtcatccactgagactcttgagca

SEQ ID NO: 827289 - DNA, 25 bp, Mus musculus
tgtcatccactgtgactcttgagca

SEQ ID NO: 827290 - DNA, 25 bp, Mus musculus
tgtcatccatcaacgtctctgtgaa

SEQ ID NO: 827291 - DNA, 25 bp, Mus musculus
tgtcatccatcatcgtctctgtgaa

SEQ ID NO: 827292 - DNA, 25 bp, Mus musculus
tgtcatccatgaagtccacgtccag

SEQ ID NO: 827293 - DNA, 25 bp, Mus musculus
tgtcatccatgatgtccacgtccag

SEQ ID NO: 827294 - DNA, 25 bp, Mus musculus
tgtcatccattacagcggtaatcaa

SEQ ID NO: 827295 - DNA, 25 bp, Mus musculus
tgtcatccattagagcggtaatcaa

SEQ ID NO: 827296 - DNA, 25 bp, Mus musculus
tgtcatcccaggctcttaaatgtgt

SEQ ID NO: 827297 - DNA, 25 bp, Mus musculus
tgtcatcccagggtcttaaatgtgt

SEQ ID NO: 827298 - DNA, 25 bp, Mus musculus
tgtcatcccagtaggcctcactgtg

SEQ ID NO: 827299 - DNA, 25 bp, Mus musculus
tgtcatcccagttggcctcactgtg

SEQ ID NO: 827300 - DNA, 25 bp, Mus musculus
tgtcatcccgcacgcggtagaacct

SEQ ID NO: 827301 - DNA, 25 bp, Mus musculus
tgtcatcccgcaggcggtagaacct

SEQ ID NO: 827302 - DNA, 25 bp, Mus musculus
tgtcatcccgtgaagcgaatgcgca

SEQ ID NO: 827303 - DNA, 25 bp, Mus musculus
tgtcatcccgtgtagcgaatgcgca

SEQ ID NO: 827304 - DNA, 25 bp, Mus musculus
tgtcatccgtatctactctgcaggg

SEQ ID NO: 827305 - DNA, 25 bp, Mus musculus
tgtcatccgtatgtactctgcaggg

SEQ ID NO: 827306 - DNA, 25 bp, Mus musculus
tgtcatcctcctctgccggacggag

SEQ ID NO: 827307 - DNA, 25 bp, Mus musculus
tgtcatcctcctgtgccggacggag

SEQ ID NO: 827308 - DNA, 25 bp, Mus musculus
tgtcatcctgaacaccaacaacttc

SEQ ID NO: 827309 - DNA, 25 bp, Mus musculus
tgtcatcctgaagaccaacaacttc

SEQ ID NO: 827310 - DNA, 25 bp, Mus musculus
tgtcatccttacagtactggagtac

SEQ ID NO: 827311 - DNA, 25 bp, Mus musculus
tgtcatccttactgtactggagtac

SEQ ID NO: 827312 - DNA, 25 bp, Mus musculus
tgtcatcgtgctactgccttcggag

SEQ ID NO: 827313 - DNA, 25 bp, Mus musculus
tgtcatcgtgcttctgccttcggag

SEQ ID NO: 827314 - DNA, 25 bp, Mus musculus
tgtcatcgtggcctgctgcaaccag

SEQ ID NO: 827315 - DNA, 25 bp, Mus musculus
tgtcatcgtggcgtgctgcaaccag

SEQ ID NO: 827316 - DNA, 25 bp, Mus musculus
tgtcatctgaccagtaaagcgcgct

SEQ ID NO: 827317 - DNA, 25 bp, Mus musculus
tgtcatctgacctgtaaagcgcgct

SEQ ID NO: 827318 - DNA, 25 bp, Mus musculus
tgtcatctggccaggctagcgagac

SEQ ID NO: 827319 - DNA, 25 bp, Mus musculus
tgtcatctggcctggctagcgagac

SEQ ID NO: 827320 - DNA, 25 bp, Mus musculus
tgtcatctgttgaccagcccctgaa

SEQ ID NO: 827321 - DNA, 25 bp, Mus musculus
tgtcatctgttgtccagcccctgaa

SEQ ID NO: 827322 - DNA, 25 bp, Mus musculus
tgtcatcttagcaactgcaggctat

SEQ ID NO: 827323 - DNA, 25 bp, Mus musculus
tgtcatcttagctactgcaggctat

SEQ ID NO: 827324 - DNA, 25 bp, Mus musculus
tgtcatgaaacaccaaccagtggct

SEQ ID NO: 827325 - DNA, 25 bp, Mus musculus
tgtcatgaaacagcaaccagtggct

SEQ ID NO: 827326 - DNA, 25 bp, Mus musculus
tgtcatgaactcatgggacatgtgc

SEQ ID NO: 827327 - DNA, 25 bp, Mus musculus
tgtcatgaactcttgggacatgtgc

SEQ ID NO: 827328 - DNA, 25 bp, Mus musculus
tgtcatgatgacctcacagatccca

SEQ ID NO: 827329 - DNA, 25 bp, Mus musculus
tgtcatgatgacgtcacagatccca

SEQ ID NO: 827330 - DNA, 25 bp, Mus musculus
tgtcatgattgacctgtcccacgtg

SEQ ID NO: 827331 - DNA, 25 bp, Mus musculus
tgtcatgattgagctgtcccacgtg

SEQ ID NO: 827332 - DNA, 25 bp, Mus musculus
tgtcatgattgccaaccctaatata

SEQ ID NO: 827333 - DNA, 25 bp, Mus musculus
tgtcatgattgcgaaccctaatata

SEQ ID NO: 827334 - DNA, 25 bp, Mus musculus
tgtcatgctcaccacgcaactgctg

SEQ ID NO: 827335 - DNA, 25 bp, Mus musculus
tgtcatgctcacgacgcaactgctg

SEQ ID NO: 827336 - DNA, 25 bp, Mus musculus
tgtcatggaaagaattgtgctacag

SEQ ID NO: 827337 - DNA, 25 bp, Mus musculus
tgtcatggaaagtattgtgctacag

SEQ ID NO: 827338 - DNA, 25 bp, Mus musculus
tgtcatggacctcaatgtgtagacc

SEQ ID NO: 827339 - DNA, 25 bp, Mus musculus
tgtcatggacctgaatgtgtagacc

SEQ ID NO: 827340 - DNA, 25 bp, Mus musculus
tgtcatggagaaactccagcttggg

SEQ ID NO: 827341 - DNA, 25 bp, Mus musculus
tgtcatggagaatctccagcttggg

SEQ ID NO: 827342 - DNA, 25 bp, Mus musculus
tgtcatggagagacccactgcctgt

SEQ ID NO: 827343 - DNA, 25 bp, Mus musculus
tgtcatggagagtcccactgcctgt

SEQ ID NO: 827344 - DNA, 25 bp, Mus musculus
tgtcatggagatagatcttgatcac

SEQ ID NO: 827345 - DNA, 25 bp, Mus musculus
tgtcatggagattgatcttgatcac

SEQ ID NO: 827346 - DNA, 25 bp, Mus musculus
tgtcatggatcaaacatgctgtcct

SEQ ID NO: 827347 - DNA, 25 bp, Mus musculus
tgtcatggatcatacatgctgtcct

SEQ ID NO: 827348 - DNA, 25 bp, Mus musculus
tgtcatggatgcatccagccctgga

SEQ ID NO: 827349 - DNA, 25 bp, Mus musculus
tgtcatggatgcttccagccctgga

SEQ ID NO: 827350 - DNA, 25 bp, Mus musculus
tgtcatgggcgcatatcctgtgagc

SEQ ID NO: 827351 - DNA, 25 bp, Mus musculus
tgtcatgggcgcttatcctgtgagc

SEQ ID NO: 827352 - DNA, 25 bp, Mus musculus
tgtcatggtaacaactgtggttggt

SEQ ID NO: 827353 - DNA, 25 bp, Mus musculus
tgtcatggtaactactgtggttggt

SEQ ID NO: 827354 - DNA, 25 bp, Mus musculus
tgtcatggtgggattatggctacca

SEQ ID NO: 827355 - DNA, 25 bp, Mus musculus
tgtcatggtgggtttatggctacca

SEQ ID NO: 827356 - DNA, 25 bp, Mus musculus
tgtcattaaaaacagggacgtaccg

SEQ ID NO: 827357 - DNA, 25 bp, Mus musculus
tgtcattaaaaagagggacgtaccg

SEQ ID NO: 827358 - DNA, 25 bp, Mus musculus
tgtcattaaacacctctttaccgga

SEQ ID NO: 827359 - DNA, 25 bp, Mus musculus
tgtcattaaacagctctttaccgga

SEQ ID NO: 827360 - DNA, 25 bp, Mus musculus
tgtcattacacgcagttccttccaa

SEQ ID NO: 827361 - DNA, 25 bp, Mus musculus
tgtcattacacggagttccttccaa

SEQ ID NO: 827362 - DNA, 25 bp, Mus musculus
tgtcattagggacagacggcacact

SEQ ID NO: 827363 - DNA, 25 bp, Mus musculus
tgtcattagggagagacggcacact

SEQ ID NO: 827364 - DNA, 25 bp, Mus musculus
tgtcattatgagcatccgtgtgcag

SEQ ID NO: 827365 - DNA, 25 bp, Mus musculus
tgtcattatgaggatccgtgtgcag

SEQ ID NO: 827366 - DNA, 25 bp, Mus musculus
tgtcattcaagtcagggaagtcgcc

SEQ ID NO: 827367 - DNA, 25 bp, Mus musculus
tgtcattcaagtgagggaagtcgcc

SEQ ID NO: 827368 - DNA, 25 bp, Mus musculus
tgtcattcattaacggaaaacggat

SEQ ID NO: 827369 - DNA, 25 bp, Mus musculus
tgtcattcattatcggaaaacggat

SEQ ID NO: 827370 - DNA, 25 bp, Mus musculus
tgtcattcattgagacatctgctct

SEQ ID NO: 827371 - DNA, 25 bp, Mus musculus
tgtcattcattgtgacatctgctct

SEQ ID NO: 827372 - DNA, 25 bp, Mus musculus
tgtcattcctgtagactataagagt

SEQ ID NO: 827373 - DNA, 25 bp, Mus musculus
tgtcattcctgttgactataagagt

SEQ ID NO: 827374 - DNA, 25 bp, Mus musculus
tgtcattctctacaccctagtcagt

SEQ ID NO: 827375 - DNA, 25 bp, Mus musculus
tgtcattctctagaccctagtcagt

SEQ ID NO: 827376 - DNA, 25 bp, Mus musculus
tgtcattctggaagccaagaacctg

SEQ ID NO: 827377 - DNA, 25 bp, Mus musculus
tgtcattctggatgccaagaacctg

SEQ ID NO: 827378 - DNA, 25 bp, Mus musculus
tgtcattctggtaaggttctcggag

SEQ ID NO: 827379 - DNA, 25 bp, Mus musculus
tgtcattctggttaggttctcggag

SEQ ID NO: 827380 - DNA, 25 bp, Mus musculus
tgtcattcttaaaacgagcacctgc

SEQ ID NO: 827381 - DNA, 25 bp, Mus musculus
tgtcattcttaatacgagcacctgc

SEQ ID NO: 827382 - DNA, 25 bp, Mus musculus
tgtcattgagaacgtgactcagagc

SEQ ID NO: 827383 - DNA, 25 bp, Mus musculus
tgtcattgagaaggtgactcagagc

SEQ ID NO: 827384 - DNA, 25 bp, Mus musculus
tgtcattgagcacttcagccatact

SEQ ID NO: 827385 - DNA, 25 bp, Mus musculus
tgtcattgagcagttcagccatact

SEQ ID NO: 827386 - DNA, 25 bp, Mus musculus
tgtcattggaatacaggagggctgc

SEQ ID NO: 827387 - DNA, 25 bp, Mus musculus
tgtcattggaattcaggagggctgc

SEQ ID NO: 827388 - DNA, 25 bp, Mus musculus
tgtcattggcttcgtcaaggaacac

SEQ ID NO: 827389 - DNA, 25 bp, Mus musculus
tgtcattggcttggtcaaggaacac

SEQ ID NO: 827390 - DNA, 25 bp, Mus musculus
tgtcattggtctcagctttgatttc

SEQ ID NO: 827391 - DNA, 25 bp, Mus musculus
tgtcattggtctgagctttgatttc

SEQ ID NO: 827392 - DNA, 25 bp, Mus musculus
tgtcattgttgcaaacacgatgccc

SEQ ID NO: 827393 - DNA, 25 bp, Mus musculus
tgtcattgttgctaacacgatgccc

SEQ ID NO: 827394 - DNA, 25 bp, Mus musculus
tgtcattgtttgatagaactggttg

SEQ ID NO: 827395 - DNA, 25 bp, Mus musculus
tgtcattgtttgttagaactggttg

SEQ ID NO: 827396 - DNA, 25 bp, Mus musculus
tgtcatttcaaaaccgttcatggca

SEQ ID NO: 827397 - DNA, 25 bp, Mus musculus
tgtcatttcaaatccgttcatggca

SEQ ID NO: 827398 - DNA, 25 bp, Mus musculus
tgtcatttcgctcatggagatgggc

SEQ ID NO: 827399 - DNA, 25 bp, Mus musculus
tgtcatttcgctgatggagatgggc

SEQ ID NO: 827400 - DNA, 25 bp, Mus musculus
tgtcatttgctgatggaaagtcgga

SEQ ID NO: 827401 - DNA, 25 bp, Mus musculus
tgtcatttgctgttggaaagtcgga

SEQ ID NO: 827402 - DNA, 25 bp, Mus musculus
tgtcattttctcatccaaggaactt

SEQ ID NO: 827403 - DNA, 25 bp, Mus musculus
tgtcattttctcttccaaggaactt

SEQ ID NO: 827404 - DNA, 25 bp, Mus musculus
tgtcatttttggaggccttactggg

SEQ ID NO: 827405 - DNA, 25 bp, Mus musculus
tgtcatttttggtggccttactggg

SEQ ID NO: 827406 - DNA, 25 bp, Mus musculus
tgtccaaaaacaatacccggtgtgg

SEQ ID NO: 827407 - DNA, 25 bp, Mus musculus
tgtccaaaaacattacccggtgtgg

SEQ ID NO: 827408 - DNA, 25 bp, Mus musculus
tgtccaaaatggaacagtgagtaaa

SEQ ID NO: 827409 - DNA, 25 bp, Mus musculus
tgtccaaaatggtacagtgagtaaa

SEQ ID NO: 827410 - DNA, 25 bp, Mus musculus
tgtccaaagggcacgatgtgaccat

SEQ ID NO: 827411 - DNA, 25 bp, Mus musculus
tgtccaaagggctcgatgtgaccat

SEQ ID NO: 827412 - DNA, 25 bp, Mus musculus
tgtccaaatcccagctgagcctgag

SEQ ID NO: 827413 - DNA, 25 bp, Mus musculus
tgtccaaatccctgctgagcctgag

SEQ ID NO: 827414 - DNA, 25 bp, Mus musculus
tgtccaaatcttacctacctcaatc

SEQ ID NO: 827415 - DNA, 25 bp, Mus musculus
tgtccaaatctttcctacctcaatc

SEQ ID NO: 827416 - DNA, 25 bp, Mus musculus
tgtccaacagaacagctgagcaggg

SEQ ID NO: 827417 - DNA, 25 bp, Mus musculus
tgtccaacagaagagctgagcaggg

SEQ ID NO: 827418 - DNA, 25 bp, Mus musculus
tgtccaacagtactgtgagcctcat

SEQ ID NO: 827419 - DNA, 25 bp, Mus musculus
tgtccaacagtagtgtgagcctcat

SEQ ID NO: 827420 - DNA, 25 bp, Mus musculus
tgtccaacatgcaacgacttccatg

SEQ ID NO: 827421 - DNA, 25 bp, Mus musculus
tgtccaacatgctacgacttccatg

SEQ ID NO: 827422 - DNA, 25 bp, Mus musculus
tgtccaacccacattgccgtgctgt

SEQ ID NO: 827423 - DNA, 25 bp, Mus musculus
tgtccaacccactttgccgtgctgt

SEQ ID NO: 827424 - DNA, 25 bp, Mus musculus
tgtccaacgaggagggaccccatct

SEQ ID NO: 827425 - DNA, 25 bp, Mus musculus
tgtccaacgaggtgggaccccatct

SEQ ID NO: 827426 - DNA, 25 bp, Mus musculus
tgtccaacgtcacctacaaaaagac

SEQ ID NO: 827427 - DNA, 25 bp, Mus musculus
tgtccaacgtcagctacaaaaagac

SEQ ID NO: 827428 - DNA, 25 bp, Mus musculus
tgtccaacttctcacggagcagtcg

SEQ ID NO: 827429 - DNA, 25 bp, Mus musculus
tgtccaacttctgacggagcagtcg

SEQ ID NO: 827430 - DNA, 25 bp, Mus musculus
tgtccaacttgcatcgtggcagtca

SEQ ID NO: 827431 - DNA, 25 bp, Mus musculus
tgtccaacttgcttcgtggcagtca

SEQ ID NO: 827432 - DNA, 25 bp, Mus musculus
tgtccaagaaacctcgcgtgtccgg

SEQ ID NO: 827433 - DNA, 25 bp, Mus musculus
tgtccaagaaacgtcgcgtgtccgg

SEQ ID NO: 827434 - DNA, 25 bp, Mus musculus
tgtccaagaagaagccatagaagct

SEQ ID NO: 827435 - DNA, 25 bp, Mus musculus
tgtccaagaagatgccatagaagct

SEQ ID NO: 827436 - DNA, 25 bp, Mus musculus
tgtccaagaaggagactagtaatct

SEQ ID NO: 827437 - DNA, 25 bp, Mus musculus
tgtccaagaaggtgactagtaatct

SEQ ID NO: 827438 - DNA, 25 bp, Mus musculus
tgtccaagacttcgctcagcttgtt

SEQ ID NO: 827439 - DNA, 25 bp, Mus musculus
tgtccaagacttggctcagcttgtt

SEQ ID NO: 827440 - DNA, 25 bp, Mus musculus
tgtccaagagcaattcaaaagggaa

SEQ ID NO: 827441 - DNA, 25 bp, Mus musculus
tgtccaagagcatttcaaaagggaa

SEQ ID NO: 827442 - DNA, 25 bp, Mus musculus
tgtccaagagccacatcagcaatga

SEQ ID NO: 827443 - DNA, 25 bp, Mus musculus
tgtccaagagcctcatcagcaatga

SEQ ID NO: 827444 - DNA, 25 bp, Mus musculus
tgtccaagcaggagggcaataaggt

SEQ ID NO: 827445 - DNA, 25 bp, Mus musculus
tgtccaagcaggtgggcaataaggt

SEQ ID NO: 827446 - DNA, 25 bp, Mus musculus
tgtccaaggcccaggtaactacagc

SEQ ID NO: 827447 - DNA, 25 bp, Mus musculus
tgtccaaggccctggtaactacagc

SEQ ID NO: 827448 - DNA, 25 bp, Mus musculus
tgtccaaggcctaaaaggttcaatg

SEQ ID NO: 827449 - DNA, 25 bp, Mus musculus
tgtccaaggccttaaaggttcaatg

SEQ ID NO: 827450 - DNA, 25 bp, Mus musculus
tgtccaagggcgatgcagataccaa

SEQ ID NO: 827451 - DNA, 25 bp, Mus musculus
tgtccaagggcgttgcagataccaa

SEQ ID NO: 827452 - DNA, 25 bp, Mus musculus
tgtccaaggtaaagcagaaatgagc

SEQ ID NO: 827453 - DNA, 25 bp, Mus musculus
tgtccaaggtaatgcagaaatgagc

SEQ ID NO: 827454 - DNA, 25 bp, Mus musculus
tgtccaagtcaacatggtgtgtcag

SEQ ID NO: 827455 - DNA, 25 bp, Mus musculus
tgtccaagtcaagatggtgtgtcag

SEQ ID NO: 827456 - DNA, 25 bp, Mus musculus
tgtccaagtctacagaacaagccaa

SEQ ID NO: 827457 - DNA, 25 bp, Mus musculus
tgtccaagtctagagaacaagccaa

SEQ ID NO: 827458 - DNA, 25 bp, Mus musculus
tgtccaagtgctatggtgcagggac

SEQ ID NO: 827459 - DNA, 25 bp, Mus musculus
tgtccaagtgctttggtgcagggac

SEQ ID NO: 827460 - DNA, 25 bp, Mus musculus
tgtccaatagatcgttcgggccgcg

SEQ ID NO: 827461 - DNA, 25 bp, Mus musculus
tgtccaatagatggttcgggccgcg

SEQ ID NO: 827462 - DNA, 25 bp, Mus musculus
tgtccaatcttgaagaaaggctccg

SEQ ID NO: 827463 - DNA, 25 bp, Mus musculus
tgtccaatcttgtagaaaggctccg

SEQ ID NO: 827464 - DNA, 25 bp, Mus musculus
tgtccaatgcctattcaccaaggca

SEQ ID NO: 827465 - DNA, 25 bp, Mus musculus
tgtccaatgccttttcaccaaggca

SEQ ID NO: 827466 - DNA, 25 bp, Mus musculus
tgtccacaccaaacatgaatggcaa

SEQ ID NO: 827467 - DNA, 25 bp, Mus musculus
tgtccacaccaatcatgaatggcaa

SEQ ID NO: 827468 - DNA, 25 bp, Mus musculus
tgtccacaccggagctagaccgttt

SEQ ID NO: 827469 - DNA, 25 bp, Mus musculus
tgtccacaccggtgctagaccgttt

SEQ ID NO: 827470 - DNA, 25 bp, Mus musculus
tgtccacactagaccgtcctgtctt

SEQ ID NO: 827471 - DNA, 25 bp, Mus musculus
tgtccacactagtccgtcctgtctt

SEQ ID NO: 827472 - DNA, 25 bp, Mus musculus
tgtccacagaacaggagcctgcttc

SEQ ID NO: 827473 - DNA, 25 bp, Mus musculus
tgtccacagaactggagcctgcttc

SEQ ID NO: 827474 - DNA, 25 bp, Mus musculus
tgtccacagattatcaagaggtgtg

SEQ ID NO: 827475 - DNA, 25 bp, Mus musculus
tgtccacagattttcaagaggtgtg

SEQ ID NO: 827476 - DNA, 25 bp, Mus musculus
tgtccacaggctctggaaggccaac

SEQ ID NO: 827477 - DNA, 25 bp, Mus musculus
tgtccacaggctgtggaaggccaac

SEQ ID NO: 827478 - DNA, 25 bp, Mus musculus
tgtccacatatgatagcagtttatc

SEQ ID NO: 827479 - DNA, 25 bp, Mus musculus
tgtccacatatgttagcagtttatc

SEQ ID NO: 827480 - DNA, 25 bp, Mus musculus
tgtccacattcacgcaagaggatgt

SEQ ID NO: 827481 - DNA, 25 bp, Mus musculus
tgtccacattcaggcaagaggatgt

SEQ ID NO: 827482 - DNA, 25 bp, Mus musculus
tgtccaccacacactcggatgttgc

SEQ ID NO: 827483 - DNA, 25 bp, Mus musculus
tgtccaccacactctcggatgttgc

SEQ ID NO: 827484 - DNA, 25 bp, Mus musculus
tgtccaccacagacctcgtgggtcg

SEQ ID NO: 827485 - DNA, 25 bp, Mus musculus
tgtccaccacagtcctcgtgggtcg

SEQ ID NO: 827486 - DNA, 25 bp, Mus musculus
tgtccaccacggaggtggaagccgt

SEQ ID NO: 827487 - DNA, 25 bp, Mus musculus
tgtccaccacggtggtggaagccgt

SEQ ID NO: 827488 - DNA, 25 bp, Mus musculus
tgtccaccatagcattcggctttgt

SEQ ID NO: 827489 - DNA, 25 bp, Mus musculus
tgtccaccataggattcggctttgt

SEQ ID NO: 827490 - DNA, 25 bp, Mus musculus
tgtccaccatgaatgacgggagtgg

SEQ ID NO: 827491 - DNA, 25 bp, Mus musculus
tgtccaccatgacctaaatgactgt

SEQ ID NO: 827492 - DNA, 25 bp, Mus musculus
tgtccaccatgagctaaatgactgt

SEQ ID NO: 827493 - DNA, 25 bp, Mus musculus
tgtccaccatgattgacgggagtgg

SEQ ID NO: 827494 - DNA, 25 bp, Mus musculus
tgtccaccgtctattacccaagcga

SEQ ID NO: 827495 - DNA, 25 bp, Mus musculus
tgtccaccgtcttttacccaagcga

SEQ ID NO: 827496 - DNA, 25 bp, Mus musculus
tgtccacctgggatcgagggtcaca

SEQ ID NO: 827497 - DNA, 25 bp, Mus musculus
tgtccacctgggttcgagggtcaca

SEQ ID NO: 827498 - DNA, 25 bp, Mus musculus
tgtccacctttgcagcctgtttctg

SEQ ID NO: 827499 - DNA, 25 bp, Mus musculus
tgtccacctttggagcctgtttctg

SEQ ID NO: 827500 - DNA, 25 bp, Mus musculus
tgtccacgaagactccctcacagtt

SEQ ID NO: 827501 - DNA, 25 bp, Mus musculus
tgtccacgaagagtccctcacagtt

SEQ ID NO: 827502 - DNA, 25 bp, Mus musculus
tgtccacgcctcaccattgactggg

SEQ ID NO: 827503 - DNA, 25 bp, Mus musculus
tgtccacgcctctccattgactggg

SEQ ID NO: 827504 - DNA, 25 bp, Mus musculus
tgtccacggaagagattgtccagcg

SEQ ID NO: 827505 - DNA, 25 bp, Mus musculus
tgtccacggaagtgattgtccagcg

SEQ ID NO: 827506 - DNA, 25 bp, Mus musculus
tgtccacgggccaggtccgaaatgg

SEQ ID NO: 827507 - DNA, 25 bp, Mus musculus
tgtccacgggcctggtccgaaatgg

SEQ ID NO: 827508 - DNA, 25 bp, Mus musculus
tgtccacggtgcagcagaggcagct

SEQ ID NO: 827509 - DNA, 25 bp, Mus musculus
tgtccacggtgctgcagaggcagct

SEQ ID NO: 827510 - DNA, 25 bp, Mus musculus
tgtccacgtgatcagttttgtaaga

SEQ ID NO: 827511 - DNA, 25 bp, Mus musculus
tgtccacgtgatgagttttgtaaga

SEQ ID NO: 827512 - DNA, 25 bp, Mus musculus
tgtccactacaaagggatgttgtca

SEQ ID NO: 827513 - DNA, 25 bp, Mus musculus
tgtccactacaatgggatgttgtca

SEQ ID NO: 827514 - DNA, 25 bp, Mus musculus
tgtccactagtcagtaaacacttgt

SEQ ID NO: 827515 - DNA, 25 bp, Mus musculus
tgtccactagtctgtaaacacttgt

SEQ ID NO: 827516 - DNA, 25 bp, Mus musculus
tgtccactatttcataaaatccatt

SEQ ID NO: 827517 - DNA, 25 bp, Mus musculus
tgtccactatttgataaaatccatt

SEQ ID NO: 827518 - DNA, 25 bp, Mus musculus
tgtccactcaaaaccttcagctcgg

SEQ ID NO: 827519 - DNA, 25 bp, Mus musculus
tgtccactcaaatccttcagctcgg

SEQ ID NO: 827520 - DNA, 25 bp, Mus musculus
tgtccactctccaagctttatctca

SEQ ID NO: 827521 - DNA, 25 bp, Mus musculus
tgtccactctcctagctttatctca

SEQ ID NO: 827522 - DNA, 25 bp, Mus musculus
tgtccactggcactttggccagctg

SEQ ID NO: 827523 - DNA, 25 bp, Mus musculus
tgtccactggcagtttggccagctg

SEQ ID NO: 827524 - DNA, 25 bp, Mus musculus
tgtccactttaaagtagtaggagac

SEQ ID NO: 827525 - DNA, 25 bp, Mus musculus
tgtccactttaatgtagtaggagac

SEQ ID NO: 827526 - DNA, 25 bp, Mus musculus
tgtccagaaaccagatcaagttatc

SEQ ID NO: 827527 - DNA, 25 bp, Mus musculus
tgtccagaaacctgatcaagttatc

SEQ ID NO: 827528 - DNA, 25 bp, Mus musculus
tgtccagaaagaaatagacgaccgc

SEQ ID NO: 827529 - DNA, 25 bp, Mus musculus
tgtccagaaagatatagacgaccgc

SEQ ID NO: 827530 - DNA, 25 bp, Mus musculus
tgtccagaatgtcgacgttcagttg

SEQ ID NO: 827531 - DNA, 25 bp, Mus musculus
tgtccagaatgtggacgttcagttg

SEQ ID NO: 827532 - DNA, 25 bp, Mus musculus
tgtccagactggcatagtgcctgtg

SEQ ID NO: 827533 - DNA, 25 bp, Mus musculus
tgtccagactgggatagtgcctgtg

SEQ ID NO: 827534 - DNA, 25 bp, Mus musculus
tgtccagactgtcaccgaagcttct

SEQ ID NO: 827535 - DNA, 25 bp, Mus musculus
tgtccagactgtgaccgaagcttct

SEQ ID NO: 827536 - DNA, 25 bp, Mus musculus
tgtccagagaggcacgctacagaag

SEQ ID NO: 827537 - DNA, 25 bp, Mus musculus
tgtccagagagggacgctacagaag

SEQ ID NO: 827538 - DNA, 25 bp, Mus musculus
tgtccagagagtcggctctaaactc

SEQ ID NO: 827539 - DNA, 25 bp, Mus musculus
tgtccagagagtgggctctaaactc

SEQ ID NO: 827540 - DNA, 25 bp, Mus musculus
tgtccagagctaatagcatcggctc

SEQ ID NO: 827541 - DNA, 25 bp, Mus musculus
tgtccagagctaccggagatgagcc

SEQ ID NO: 827542 - DNA, 25 bp, Mus musculus
tgtccagagctagcggagatgagcc

SEQ ID NO: 827543 - DNA, 25 bp, Mus musculus
tgtccagagctattagcatcggctc

SEQ ID NO: 827544 - DNA, 25 bp, Mus musculus
tgtccagagcttcataagacccagg

SEQ ID NO: 827545 - DNA, 25 bp, Mus musculus
tgtccagagcttgataagacccagg

SEQ ID NO: 827546 - DNA, 25 bp, Mus musculus
tgtccagagtgcagtctgatgccca

SEQ ID NO: 827547 - DNA, 25 bp, Mus musculus
tgtccagagtgctgtctgatgccca

SEQ ID NO: 827548 - DNA, 25 bp, Mus musculus
tgtccagatgatagtgctagatgag

SEQ ID NO: 827549 - DNA, 25 bp, Mus musculus
tgtccagatgattgtgctagatgag

SEQ ID NO: 827550 - DNA, 25 bp, Mus musculus
tgtccagattggctgagcccaacta

SEQ ID NO: 827551 - DNA, 25 bp, Mus musculus
tgtccagattgggtgagcccaacta

SEQ ID NO: 827552 - DNA, 25 bp, Mus musculus
tgtccagcatgtcttctccacagtg

SEQ ID NO: 827553 - DNA, 25 bp, Mus musculus
tgtccagcatgtgttctccacagtg

SEQ ID NO: 827554 - DNA, 25 bp, Mus musculus
tgtccagccaacaccacaggaaagt

SEQ ID NO: 827555 - DNA, 25 bp, Mus musculus
tgtccagccaactccacaggaaagt

SEQ ID NO: 827556 - DNA, 25 bp, Mus musculus
tgtccagccacgacatcgaacagtg

SEQ ID NO: 827557 - DNA, 25 bp, Mus musculus
tgtccagccacgtcatcgaacagtg

SEQ ID NO: 827558 - DNA, 25 bp, Mus musculus
tgtccagcgaaccagcaagccagcg

SEQ ID NO: 827559 - DNA, 25 bp, Mus musculus
tgtccagcgaacgagcaagccagcg

SEQ ID NO: 827560 - DNA, 25 bp, Mus musculus
tgtccagcgcttaactggctgtctg

SEQ ID NO: 827561 - DNA, 25 bp, Mus musculus
tgtccagcgctttactggctgtctg

SEQ ID NO: 827562 - DNA, 25 bp, Mus musculus
tgtccagctggcagctcagaccctt

SEQ ID NO: 827563 - DNA, 25 bp, Mus musculus
tgtccagctggctgctcagaccctt

SEQ ID NO: 827564 - DNA, 25 bp, Mus musculus
tgtccagctgtcagatgataaggtc

SEQ ID NO: 827565 - DNA, 25 bp, Mus musculus
tgtccagctgtctgatgataaggtc

SEQ ID NO: 827566 - DNA, 25 bp, Mus musculus
tgtccagcttcacctaggagtcttg

SEQ ID NO: 827567 - DNA, 25 bp, Mus musculus
tgtccagcttcagctaggagtcttg

SEQ ID NO: 827568 - DNA, 25 bp, Mus musculus
tgtccaggaaaactaagttcccaag

SEQ ID NO: 827569 - DNA, 25 bp, Mus musculus
tgtccaggaaaagtaagttcccaag

SEQ ID NO: 827570 - DNA, 25 bp, Mus musculus
tgtccaggaacccatctatgccacg

SEQ ID NO: 827571 - DNA, 25 bp, Mus musculus
tgtccaggaaccgatctatgccacg

SEQ ID NO: 827572 - DNA, 25 bp, Mus musculus
tgtccaggagacatttccgccacct

SEQ ID NO: 827573 - DNA, 25 bp, Mus musculus
tgtccaggagacttttccgccacct

SEQ ID NO: 827574 - DNA, 25 bp, Mus musculus
tgtccaggcaacaggaagccgcttt

SEQ ID NO: 827575 - DNA, 25 bp, Mus musculus
tgtccaggcaactggaagccgcttt

SEQ ID NO: 827576 - DNA, 25 bp, Mus musculus
tgtccaggcagcaccacttgtgtgg

SEQ ID NO: 827577 - DNA, 25 bp, Mus musculus
tgtccaggcagctccacttgtgtgg

SEQ ID NO: 827578 - DNA, 25 bp, Mus musculus
tgtccagggagtaattgggctcact

SEQ ID NO: 827579 - DNA, 25 bp, Mus musculus
tgtccagggagttattgggctcact

SEQ ID NO: 827580 - DNA, 25 bp, Mus musculus
tgtccaggtcttcggcactgagtac

SEQ ID NO: 827581 - DNA, 25 bp, Mus musculus
tgtccaggtcttgggcactgagtac

SEQ ID NO: 827582 - DNA, 25 bp, Mus musculus
tgtccagtagttctcagcgccctgt

SEQ ID NO: 827583 - DNA, 25 bp, Mus musculus
tgtccagtagttgtcagcgccctgt

SEQ ID NO: 827584 - DNA, 25 bp, Mus musculus
tgtccagtccctctcattgatagtg

SEQ ID NO: 827585 - DNA, 25 bp, Mus musculus
tgtccagtccctgtcattgatagtg

SEQ ID NO: 827586 - DNA, 25 bp, Mus musculus
tgtccagtctccatgagcgcatctt

SEQ ID NO: 827587 - DNA, 25 bp, Mus musculus
tgtccagtctccttgagcgcatctt

SEQ ID NO: 827588 - DNA, 25 bp, Mus musculus
tgtccagtctgcaaacaaaaggttg

SEQ ID NO: 827589 - DNA, 25 bp, Mus musculus
tgtccagtctgctaacaaaaggttg

SEQ ID NO: 827590 - DNA, 25 bp, Mus musculus
tgtccagtctgtagcgactcaatct

SEQ ID NO: 827591 - DNA, 25 bp, Mus musculus
tgtccagtctgttgcgactcaatct

SEQ ID NO: 827592 - DNA, 25 bp, Mus musculus
tgtccagtgaaaagagtcgacttcc

SEQ ID NO: 827593 - DNA, 25 bp, Mus musculus
tgtccagtgaaatgagtcgacttcc

SEQ ID NO: 827594 - DNA, 25 bp, Mus musculus
tgtccagtgcaccagtgactaccct

SEQ ID NO: 827595 - DNA, 25 bp, Mus musculus
tgtccagtgcacgagtgactaccct

SEQ ID NO: 827596 - DNA, 25 bp, Mus musculus
tgtccagtgctgaccacggatgcct

SEQ ID NO: 827597 - DNA, 25 bp, Mus musculus
tgtccagtgctgtccacggatgcct

SEQ ID NO: 827598 - DNA, 25 bp, Mus musculus
tgtccagtggcaacagaaaattgcc

SEQ ID NO: 827599 - DNA, 25 bp, Mus musculus
tgtccagtggcatcagaaaattgcc

SEQ ID NO: 827600 - DNA, 25 bp, Mus musculus
tgtccagtgggaacctgcctgcgtc

SEQ ID NO: 827601 - DNA, 25 bp, Mus musculus
tgtccagtgggatcctgcctgcgtc

SEQ ID NO: 827602 - DNA, 25 bp, Mus musculus
tgtccagttactctgggtcaatctg

SEQ ID NO: 827603 - DNA, 25 bp, Mus musculus
tgtccagttactgtgggtcaatctg

SEQ ID NO: 827604 - DNA, 25 bp, Mus musculus
tgtccagttccaaaaccaaagtggt

SEQ ID NO: 827605 - DNA, 25 bp, Mus musculus
tgtccagttccataaccaaagtggt

SEQ ID NO: 827606 - DNA, 25 bp, Mus musculus
tgtccagtttaaatcgccttggcct

SEQ ID NO: 827607 - DNA, 25 bp, Mus musculus
tgtccagtttaaattccgggccaag

SEQ ID NO: 827608 - DNA, 25 bp, Mus musculus
tgtccagtttaattcgccttggcct

SEQ ID NO: 827609 - DNA, 25 bp, Mus musculus
tgtccagtttaatttccgggccaag

SEQ ID NO: 827610 - DNA, 25 bp, Mus musculus
tgtccatatgttagtgccggtacat

SEQ ID NO: 827611 - DNA, 25 bp, Mus musculus
tgtccatatgtttgtgccggtacat

SEQ ID NO: 827612 - DNA, 25 bp, Mus musculus
tgtccatcctgaccaagagcagctc

SEQ ID NO: 827613 - DNA, 25 bp, Mus musculus
tgtccatcctgagcaagagcagctc

SEQ ID NO: 827614 - DNA, 25 bp, Mus musculus
tgtccatcgattcaacgtagaactc

SEQ ID NO: 827615 - DNA, 25 bp, Mus musculus
tgtccatcgattgaacgtagaactc

SEQ ID NO: 827616 - DNA, 25 bp, Mus musculus
tgtccatctgaaagacctagctacg

SEQ ID NO: 827617 - DNA, 25 bp, Mus musculus
tgtccatctgaatgacctagctacg

SEQ ID NO: 827618 - DNA, 25 bp, Mus musculus
tgtccatctgccaccgtgaaggaag

SEQ ID NO: 827619 - DNA, 25 bp, Mus musculus
tgtccatctgcctccgtgaaggaag

SEQ ID NO: 827620 - DNA, 25 bp, Mus musculus
tgtccatctggaattagaagagcgc

SEQ ID NO: 827621 - DNA, 25 bp, Mus musculus
tgtccatctggatttagaagagcgc

SEQ ID NO: 827622 - DNA, 25 bp, Mus musculus
tgtccatcttcacatgtctcttcaa

SEQ ID NO: 827623 - DNA, 25 bp, Mus musculus
tgtccatcttcagatgtctcttcaa

SEQ ID NO: 827624 - DNA, 25 bp, Mus musculus
tgtccatcttgtagaacccagaccg

SEQ ID NO: 827625 - DNA, 25 bp, Mus musculus
tgtccatcttgttgaacccagaccg

SEQ ID NO: 827626 - DNA, 25 bp, Mus musculus
tgtccatgaactcggccattgtggc

SEQ ID NO: 827627 - DNA, 25 bp, Mus musculus
tgtccatgaactgggccattgtggc

SEQ ID NO: 827628 - DNA, 25 bp, Mus musculus
tgtccatgaagcagctgctggactt

SEQ ID NO: 827629 - DNA, 25 bp, Mus musculus
tgtccatgaagctgctgctggactt

SEQ ID NO: 827630 - DNA, 25 bp, Mus musculus
tgtccatgagaacaggcagggaaaa

SEQ ID NO: 827631 - DNA, 25 bp, Mus musculus
tgtccatgagaagaggcagggaaaa

SEQ ID NO: 827632 - DNA, 25 bp, Mus musculus
tgtccatgagatcagtactaaaccc

SEQ ID NO: 827633 - DNA, 25 bp, Mus musculus
tgtccatgagatgagtactaaaccc

SEQ ID NO: 827634 - DNA, 25 bp, Mus musculus
tgtccatgcaagatgttccttagca

SEQ ID NO: 827635 - DNA, 25 bp, Mus musculus
tgtccatgcaagttgttccttagca

SEQ ID NO: 827636 - DNA, 25 bp, Mus musculus
tgtccatgcagtctaggtgacctct

SEQ ID NO: 827637 - DNA, 25 bp, Mus musculus
tgtccatgcagtgtaggtgacctct

SEQ ID NO: 827638 - DNA, 25 bp, Mus musculus
tgtccatgcatcctacccaggttct

SEQ ID NO: 827639 - DNA, 25 bp, Mus musculus
tgtccatgcatcgtacccaggttct

SEQ ID NO: 827640 - DNA, 25 bp, Mus musculus
tgtccatgcgatcgtgcctggagca

SEQ ID NO: 827641 - DNA, 25 bp, Mus musculus
tgtccatgcgatggtgcctggagca

SEQ ID NO: 827642 - DNA, 25 bp, Mus musculus
tgtccatgcggtcgtgtacatcgtg

SEQ ID NO: 827643 - DNA, 25 bp, Mus musculus
tgtccatgcggtggtgtacatcgtg

SEQ ID NO: 827644 - DNA, 25 bp, Mus musculus
tgtccatggcgaacgcaggccccaa

SEQ ID NO: 827645 - DNA, 25 bp, Mus musculus
tgtccatggcgatcgcaggccccaa

SEQ ID NO: 827646 - DNA, 25 bp, Mus musculus
tgtccatggtgcaggcgttctgtca

SEQ ID NO: 827647 - DNA, 25 bp, Mus musculus
tgtccatggtgctggcgttctgtca

SEQ ID NO: 827648 - DNA, 25 bp, Mus musculus
tgtccatgtgaaccaccctcacaag

SEQ ID NO: 827649 - DNA, 25 bp, Mus musculus
tgtccatgtgaagcaccctcacaag

SEQ ID NO: 827650 - DNA, 25 bp, Mus musculus
tgtccattccagcttccatatcaac

SEQ ID NO: 827651 - DNA, 25 bp, Mus musculus
tgtccattccaggttccatatcaac

SEQ ID NO: 827652 - DNA, 25 bp, Mus musculus
tgtccattccctcgccattttgttc

SEQ ID NO: 827653 - DNA, 25 bp, Mus musculus
tgtccattccctggccattttgttc

SEQ ID NO: 827654 - DNA, 25 bp, Mus musculus
tgtccattcctcattagagcaactc

SEQ ID NO: 827655 - DNA, 25 bp, Mus musculus
tgtccattcctctttagagcaactc

SEQ ID NO: 827656 - DNA, 25 bp, Mus musculus
tgtccattgctgacaagtcaatcca

SEQ ID NO: 827657 - DNA, 25 bp, Mus musculus
tgtccattgctgtcaagtcaatcca

SEQ ID NO: 827658 - DNA, 25 bp, Mus musculus
tgtccatttactcctgtcgaaccct

SEQ ID NO: 827659 - DNA, 25 bp, Mus musculus
tgtccatttactgctgtcgaaccct

SEQ ID NO: 827660 - DNA, 25 bp, Mus musculus
tgtccattttacattttatccccat

SEQ ID NO: 827661 - DNA, 25 bp, Mus musculus
tgtccattttactttttatccccat

SEQ ID NO: 827662 - DNA, 25 bp, Mus musculus
tgtcccaaagcgctgtccaccggga

SEQ ID NO: 827663 - DNA, 25 bp, Mus musculus
tgtcccaaagcggtgtccaccggga

SEQ ID NO: 827664 - DNA, 25 bp, Mus musculus
tgtcccaaataaagtgacagtatcc

SEQ ID NO: 827665 - DNA, 25 bp, Mus musculus
tgtcccaaataatgtgacagtatcc

SEQ ID NO: 827666 - DNA, 25 bp, Mus musculus
tgtcccaagaaccatgtcaagccag

SEQ ID NO: 827667 - DNA, 25 bp, Mus musculus
tgtcccaagaacgatgtcaagccag

SEQ ID NO: 827668 - DNA, 25 bp, Mus musculus
tgtcccaagatcaggattggccaag

SEQ ID NO: 827669 - DNA, 25 bp, Mus musculus
tgtcccaagatctggattggccaag

SEQ ID NO: 827670 - DNA, 25 bp, Mus musculus
tgtcccaatgggaacaatctcgaag

SEQ ID NO: 827671 - DNA, 25 bp, Mus musculus
tgtcccaatgggtacaatctcgaag

SEQ ID NO: 827672 - DNA, 25 bp, Mus musculus
tgtcccacagaaagctaacaccctg

SEQ ID NO: 827673 - DNA, 25 bp, Mus musculus
tgtcccacagaatgctaacaccctg

SEQ ID NO: 827674 - DNA, 25 bp, Mus musculus
tgtcccacaggtattcccgctcaga

SEQ ID NO: 827675 - DNA, 25 bp, Mus musculus
tgtcccacaggttttcccgctcaga

SEQ ID NO: 827676 - DNA, 25 bp, Mus musculus
tgtcccacatcacagcagagtttga

SEQ ID NO: 827677 - DNA, 25 bp, Mus musculus
tgtcccacatcagagcagagtttga

SEQ ID NO: 827678 - DNA, 25 bp, Mus musculus
tgtcccacattgctgagcgcatggc

SEQ ID NO: 827679 - DNA, 25 bp, Mus musculus
tgtcccacattggtgagcgcatggc

SEQ ID NO: 827680 - DNA, 25 bp, Mus musculus
tgtcccaccaagacttgttgaagat

SEQ ID NO: 827681 - DNA, 25 bp, Mus musculus
tgtcccaccaagtcttgttgaagat

SEQ ID NO: 827682 - DNA, 25 bp, Mus musculus
tgtcccacgcgtaagcaggtttcct

SEQ ID NO: 827683 - DNA, 25 bp, Mus musculus
tgtcccacgcgttagcaggtttcct

SEQ ID NO: 827684 - DNA, 25 bp, Mus musculus
tgtcccactcggcacatgagctgct

SEQ ID NO: 827685 - DNA, 25 bp, Mus musculus
tgtcccactcgggacatgagctgct

SEQ ID NO: 827686 - DNA, 25 bp, Mus musculus
tgtcccacttgcaaggagatgcagg

SEQ ID NO: 827687 - DNA, 25 bp, Mus musculus
tgtcccacttgctaggagatgcagg

SEQ ID NO: 827688 - DNA, 25 bp, Mus musculus
tgtcccagaagcatgcccaggttgg

SEQ ID NO: 827689 - DNA, 25 bp, Mus musculus
tgtcccagaagcttgcccaggttgg

SEQ ID NO: 827690 - DNA, 25 bp, Mus musculus
tgtcccagaattctcagatccagtg

SEQ ID NO: 827691 - DNA, 25 bp, Mus musculus
tgtcccagaattgtcagatccagtg

SEQ ID NO: 827692 - DNA, 25 bp, Mus musculus
tgtcccagacccaaatctcctggcc

SEQ ID NO: 827693 - DNA, 25 bp, Mus musculus
tgtcccagaccctaatctcctggcc

SEQ ID NO: 827694 - DNA, 25 bp, Mus musculus
tgtcccagacgcacagtcagcgcta

SEQ ID NO: 827695 - DNA, 25 bp, Mus musculus
tgtcccagacgctcagtcagcgcta

SEQ ID NO: 827696 - DNA, 25 bp, Mus musculus
tgtcccagagccagtttaccccaaa

SEQ ID NO: 827697 - DNA, 25 bp, Mus musculus
tgtcccagagcctgtttaccccaaa

SEQ ID NO: 827698 - DNA, 25 bp, Mus musculus
tgtcccagaggaccacggaatctcc

SEQ ID NO: 827699 - DNA, 25 bp, Mus musculus
tgtcccagaggagcacggaatctcc

SEQ ID NO: 827700 - DNA, 25 bp, Mus musculus
tgtcccaggaagaccgggagaagct

SEQ ID NO: 827701 - DNA, 25 bp, Mus musculus
tgtcccaggaagtccgggagaagct

SEQ ID NO: 827702 - DNA, 25 bp, Mus musculus
tgtcccaggaataacgggtcctaag

SEQ ID NO: 827703 - DNA, 25 bp, Mus musculus
tgtcccaggaattacgggtcctaag

SEQ ID NO: 827704 - DNA, 25 bp, Mus musculus
tgtcccaggacaaggactttaagcc

SEQ ID NO: 827705 - DNA, 25 bp, Mus musculus
tgtcccaggacatggactttaagcc

SEQ ID NO: 827706 - DNA, 25 bp, Mus musculus
tgtcccagggaactgcacacaagag

SEQ ID NO: 827707 - DNA, 25 bp, Mus musculus
tgtcccagggaagtgcacacaagag

SEQ ID NO: 827708 - DNA, 25 bp, Mus musculus
tgtcccagggcccaatatctaagcc

SEQ ID NO: 827709 - DNA, 25 bp, Mus musculus
tgtcccagggccgaatatctaagcc

SEQ ID NO: 827710 - DNA, 25 bp, Mus musculus
tgtcccagtcgcctggcgctgtgtt

SEQ ID NO: 827711 - DNA, 25 bp, Mus musculus
tgtcccagtcgcgtggcgctgtgtt

SEQ ID NO: 827712 - DNA, 25 bp, Mus musculus
tgtcccatagaactacgtttcccag

SEQ ID NO: 827713 - DNA, 25 bp, Mus musculus
tgtcccatagaagtacgtttcccag

SEQ ID NO: 827714 - DNA, 25 bp, Mus musculus
tgtcccatctacatctttgtgcagc

SEQ ID NO: 827715 - DNA, 25 bp, Mus musculus
tgtcccatctacttctttgtgcagc

SEQ ID NO: 827716 - DNA, 25 bp, Mus musculus
tgtcccatgatcatcctccagagta

SEQ ID NO: 827717 - DNA, 25 bp, Mus musculus
tgtcccatgatcttcctccagagta

SEQ ID NO: 827718 - DNA, 25 bp, Mus musculus
tgtcccatttaacataggagacaaa

SEQ ID NO: 827719 - DNA, 25 bp, Mus musculus
tgtcccatttaagataggagacaaa

SEQ ID NO: 827720 - DNA, 25 bp, Mus musculus
tgtccccaaggacagtgactacgag

SEQ ID NO: 827721 - DNA, 25 bp, Mus musculus
tgtccccaaggagagtgactacgag

SEQ ID NO: 827722 - DNA, 25 bp, Mus musculus
tgtccccaagtgaggaatggccgca

SEQ ID NO: 827723 - DNA, 25 bp, Mus musculus
tgtccccaagtgtggaatggccgca

SEQ ID NO: 827724 - DNA, 25 bp, Mus musculus
tgtccccaatagcaagacatgctat

SEQ ID NO: 827725 - DNA, 25 bp, Mus musculus
tgtccccaataggaagacatgctat

SEQ ID NO: 827726 - DNA, 25 bp, Mus musculus
tgtccccacatcctcaggtgtctgt

SEQ ID NO: 827727 - DNA, 25 bp, Mus musculus
tgtccccacatcgtcaggtgtctgt

SEQ ID NO: 827728 - DNA, 25 bp, Mus musculus
tgtccccaccaaatgactcatttag

SEQ ID NO: 827729 - DNA, 25 bp, Mus musculus
tgtccccaccaattgactcatttag

SEQ ID NO: 827730 - DNA, 25 bp, Mus musculus
tgtccccactcgctgtttgacatgg

SEQ ID NO: 827731 - DNA, 25 bp, Mus musculus
tgtccccactcggtgtttgacatgg

SEQ ID NO: 827732 - DNA, 25 bp, Mus musculus
tgtccccaggacaaaggtgaaaacg

SEQ ID NO: 827733 - DNA, 25 bp, Mus musculus
tgtccccaggactaaggtgaaaacg

SEQ ID NO: 827734 - DNA, 25 bp, Mus musculus
tgtccccaggatcatttctggcaag

SEQ ID NO: 827735 - DNA, 25 bp, Mus musculus
tgtccccaggatgatttctggcaag

SEQ ID NO: 827736 - DNA, 25 bp, Mus musculus
tgtccccagtggcaaccttgctggg

SEQ ID NO: 827737 - DNA, 25 bp, Mus musculus
tgtccccagtgggaaccttgctggg

SEQ ID NO: 827738 - DNA, 25 bp, Mus musculus
tgtccccatgccaggaggagcatca

SEQ ID NO: 827739 - DNA, 25 bp, Mus musculus
tgtccccatgcctggaggagcatca

SEQ ID NO: 827740 - DNA, 25 bp, Mus musculus
tgtccccatgggaagaactgcactg

SEQ ID NO: 827741 - DNA, 25 bp, Mus musculus
tgtccccatgggtagaactgcactg

SEQ ID NO: 827742 - DNA, 25 bp, Mus musculus
tgtccccattacagcacagcagaga

SEQ ID NO: 827743 - DNA, 25 bp, Mus musculus
tgtccccattactgcacagcagaga

SEQ ID NO: 827744 - DNA, 25 bp, Mus musculus
tgtccccattgtccaagaacctctt

SEQ ID NO: 827745 - DNA, 25 bp, Mus musculus
tgtccccattgtgcaagaacctctt

SEQ ID NO: 827746 - DNA, 25 bp, Mus musculus
tgtccccgaggaccagatgaccttc

SEQ ID NO: 827747 - DNA, 25 bp, Mus musculus
tgtccccgaggagcagatgaccttc

SEQ ID NO: 827748 - DNA, 25 bp, Mus musculus
tgtccccgatgtcgtacgttcaatg

SEQ ID NO: 827749 - DNA, 25 bp, Mus musculus
tgtccccgatgtggtacgttcaatg

SEQ ID NO: 827750 - DNA, 25 bp, Mus musculus
tgtccccgctatacgcgctgcaatt

SEQ ID NO: 827751 - DNA, 25 bp, Mus musculus
tgtccccgctattcgcgctgcaatt

SEQ ID NO: 827752 - DNA, 25 bp, Mus musculus
tgtcccctaaagctgggagcgcgtc

SEQ ID NO: 827753 - DNA, 25 bp, Mus musculus
tgtcccctaaaggtgggagcgcgtc

SEQ ID NO: 827754 - DNA, 25 bp, Mus musculus
tgtcccctccatactgaacaggatg

SEQ ID NO: 827755 - DNA, 25 bp, Mus musculus
tgtcccctccattctgaacaggatg

SEQ ID NO: 827756 - DNA, 25 bp, Mus musculus
tgtcccctctggaggtcccttgtca

SEQ ID NO: 827757 - DNA, 25 bp, Mus musculus
tgtcccctctggtggtcccttgtca

SEQ ID NO: 827758 - DNA, 25 bp, Mus musculus
tgtcccctgagaacctccttttagt

SEQ ID NO: 827759 - DNA, 25 bp, Mus musculus
tgtcccctgagatcctccttttagt

SEQ ID NO: 827760 - DNA, 25 bp, Mus musculus
tgtcccctgcagaactgaagcaagc

SEQ ID NO: 827761 - DNA, 25 bp, Mus musculus
tgtcccctgcagtactgaagcaagc

SEQ ID NO: 827762 - DNA, 25 bp, Mus musculus
tgtcccctgggacttaggcaccttc

SEQ ID NO: 827763 - DNA, 25 bp, Mus musculus
tgtcccctgggagttaggcaccttc

SEQ ID NO: 827764 - DNA, 25 bp, Mus musculus
tgtcccctgtctatgtttccctttt

SEQ ID NO: 827765 - DNA, 25 bp, Mus musculus
tgtcccctgtctttgtttccctttt

SEQ ID NO: 827766 - DNA, 25 bp, Mus musculus
tgtccccttcctccggatatagaca

SEQ ID NO: 827767 - DNA, 25 bp, Mus musculus
tgtccccttcctgcggatatagaca

SEQ ID NO: 827768 - DNA, 25 bp, Mus musculus
tgtccccttggccaattaagggctg

SEQ ID NO: 827769 - DNA, 25 bp, Mus musculus
tgtccccttggcgaattaagggctg

SEQ ID NO: 827770 - DNA, 25 bp, Mus musculus
tgtccccttgtactgggctagaagg

SEQ ID NO: 827771 - DNA, 25 bp, Mus musculus
tgtccccttgtagtgggctagaagg

SEQ ID NO: 827772 - DNA, 25 bp, Mus musculus
tgtcccgaaaatcacaagactgtga

SEQ ID NO: 827773 - DNA, 25 bp, Mus musculus
tgtcccgaaaatgacaagactgtga

SEQ ID NO: 827774 - DNA, 25 bp, Mus musculus
tgtcccgacaccaagtgcacaagag

SEQ ID NO: 827775 - DNA, 25 bp, Mus musculus
tgtcccgacacctagtgcacaagag

SEQ ID NO: 827776 - DNA, 25 bp, Mus musculus
tgtcccgagagaaaacacatgccct

SEQ ID NO: 827777 - DNA, 25 bp, Mus musculus
tgtcccgagagataacacatgccct

SEQ ID NO: 827778 - DNA, 25 bp, Mus musculus
tgtcccgagcctcgaagatagtctg

SEQ ID NO: 827779 - DNA, 25 bp, Mus musculus
tgtcccgagcctggaagatagtctg

SEQ ID NO: 827780 - DNA, 25 bp, Mus musculus
tgtcccgagggcattgttgccatct

SEQ ID NO: 827781 - DNA, 25 bp, Mus musculus
tgtcccgagggctttgttgccatct

SEQ ID NO: 827782 - DNA, 25 bp, Mus musculus
tgtcccgagtctcatcagattgcct

SEQ ID NO: 827783 - DNA, 25 bp, Mus musculus
tgtcccgagtctgatcagattgcct

SEQ ID NO: 827784 - DNA, 25 bp, Mus musculus
tgtcccgatggtcaataccagtcta

SEQ ID NO: 827785 - DNA, 25 bp, Mus musculus
tgtcccgatggtgaataccagtcta

SEQ ID NO: 827786 - DNA, 25 bp, Mus musculus
tgtcccgcatcccagtcatcatgaa

SEQ ID NO: 827787 - DNA, 25 bp, Mus musculus
tgtcccgcatccgagtcatcatgaa

SEQ ID NO: 827788 - DNA, 25 bp, Mus musculus
tgtcccgcgccgaagtcgtcatttg

SEQ ID NO: 827789 - DNA, 25 bp, Mus musculus
tgtcccgcgccgtagtcgtcatttg

SEQ ID NO: 827790 - DNA, 25 bp, Mus musculus
tgtcccgcgtccagctgtggaaact

SEQ ID NO: 827791 - DNA, 25 bp, Mus musculus
tgtcccgcgtcctgctgtggaaact

SEQ ID NO: 827792 - DNA, 25 bp, Mus musculus
tgtcccgcgtgtcagagcccgtgtc

SEQ ID NO: 827793 - DNA, 25 bp, Mus musculus
tgtcccgcgtgtgagagcccgtgtc

SEQ ID NO: 827794 - DNA, 25 bp, Mus musculus
tgtcccgctggtcaatactggtcta

SEQ ID NO: 827795 - DNA, 25 bp, Mus musculus
tgtcccgctggtgaatactggtcta

SEQ ID NO: 827796 - DNA, 25 bp, Mus musculus
tgtcccggacacagagctacaagta

SEQ ID NO: 827797 - DNA, 25 bp, Mus musculus
tgtcccggacactgagctacaagta

SEQ ID NO: 827798 - DNA, 25 bp, Mus musculus
tgtcccggatgacgaaggcatttaa

SEQ ID NO: 827799 - DNA, 25 bp, Mus musculus
tgtcccggatgaggaaggcatttaa

SEQ ID NO: 827800 - DNA, 25 bp, Mus musculus
tgtcccggttcacccgcaatgagtt

SEQ ID NO: 827801 - DNA, 25 bp, Mus musculus
tgtcccggttcagccgcaatgagtt

SEQ ID NO: 827802 - DNA, 25 bp, Mus musculus
tgtcccgtgaccctgcataataaag

SEQ ID NO: 827803 - DNA, 25 bp, Mus musculus
tgtcccgtgaccgtgcataataaag

SEQ ID NO: 827804 - DNA, 25 bp, Mus musculus
tgtcccgttggacgcaaaaccatag

SEQ ID NO: 827805 - DNA, 25 bp, Mus musculus
tgtcccgttggaggcaaaaccatag

SEQ ID NO: 827806 - DNA, 25 bp, Mus musculus
tgtccctaaacgatctacttttctg

SEQ ID NO: 827807 - DNA, 25 bp, Mus musculus
tgtccctaaacgttctacttttctg

SEQ ID NO: 827808 - DNA, 25 bp, Mus musculus
tgtccctaaggtagtacagactcct

SEQ ID NO: 827809 - DNA, 25 bp, Mus musculus
tgtccctaaggttgtacagactcct

SEQ ID NO: 827810 - DNA, 25 bp, Mus musculus
tgtccctaccccaggcaatgctgag

SEQ ID NO: 827811 - DNA, 25 bp, Mus musculus
tgtccctacccctggcaatgctgag

SEQ ID NO: 827812 - DNA, 25 bp, Mus musculus
tgtccctatacgaggacctgtcagc

SEQ ID NO: 827813 - DNA, 25 bp, Mus musculus
tgtccctatacgtggacctgtcagc

SEQ ID NO: 827814 - DNA, 25 bp, Mus musculus
tgtccctcaagtcagtgactttacc

SEQ ID NO: 827815 - DNA, 25 bp, Mus musculus
tgtccctcaagtgagtgactttacc

SEQ ID NO: 827816 - DNA, 25 bp, Mus musculus
tgtccctcaggcaatgagtgccata

SEQ ID NO: 827817 - DNA, 25 bp, Mus musculus
tgtccctcaggctatgagtgccata

SEQ ID NO: 827818 - DNA, 25 bp, Mus musculus
tgtccctcagtaaagaccccaaaca

SEQ ID NO: 827819 - DNA, 25 bp, Mus musculus
tgtccctcagtatagaccccaaaca

SEQ ID NO: 827820 - DNA, 25 bp, Mus musculus
tgtccctcggaaactgaagctccag

SEQ ID NO: 827821 - DNA, 25 bp, Mus musculus
tgtccctcggaatctgaagctccag

SEQ ID NO: 827822 - DNA, 25 bp, Mus musculus
tgtccctcgtctccccatggttgga

SEQ ID NO: 827823 - DNA, 25 bp, Mus musculus
tgtccctcgtctgcccatggttgga

SEQ ID NO: 827824 - DNA, 25 bp, Mus musculus
tgtccctctatgagctgctgagccg

SEQ ID NO: 827825 - DNA, 25 bp, Mus musculus
tgtccctctatgtgctgctgagccg

SEQ ID NO: 827826 - DNA, 25 bp, Mus musculus
tgtccctctggtccttgagccggcg

SEQ ID NO: 827827 - DNA, 25 bp, Mus musculus
tgtccctctggtgcttgagccggcg

SEQ ID NO: 827828 - DNA, 25 bp, Mus musculus
tgtccctcttgcacagcaaccggag

SEQ ID NO: 827829 - DNA, 25 bp, Mus musculus
tgtccctcttgctcagcaaccggag

SEQ ID NO: 827830 - DNA, 25 bp, Mus musculus
tgtccctgaatacacccaggagctt

SEQ ID NO: 827831 - DNA, 25 bp, Mus musculus
tgtccctgaatagacccaggagctt

SEQ ID NO: 827832 - DNA, 25 bp, Mus musculus
tgtccctgagagacgagaagcctgt

SEQ ID NO: 827833 - DNA, 25 bp, Mus musculus
tgtccctgagagtcgagaagcctgt

SEQ ID NO: 827834 - DNA, 25 bp, Mus musculus
tgtccctgcaagagatgggaaggcc

SEQ ID NO: 827835 - DNA, 25 bp, Mus musculus
tgtccctgcaagtgatgggaaggcc

SEQ ID NO: 827836 - DNA, 25 bp, Mus musculus
tgtccctgcagtcagagctccagat

SEQ ID NO: 827837 - DNA, 25 bp, Mus musculus
tgtccctgcagtgagagctccagat

SEQ ID NO: 827838 - DNA, 25 bp, Mus musculus
tgtccctgctcaaaaagataagagt

SEQ ID NO: 827839 - DNA, 25 bp, Mus musculus
tgtccctgctcataaagataagagt

SEQ ID NO: 827840 - DNA, 25 bp, Mus musculus
tgtccctgctgcactgccgtactat

SEQ ID NO: 827841 - DNA, 25 bp, Mus musculus
tgtccctgctgctctgccgtactat

SEQ ID NO: 827842 - DNA, 25 bp, Mus musculus
tgtccctggacccaccgaagaaagc

SEQ ID NO: 827843 - DNA, 25 bp, Mus musculus
tgtccctggaccgaccgaagaaagc

SEQ ID NO: 827844 - DNA, 25 bp, Mus musculus
tgtccctggagcaagtgttgtgtga

SEQ ID NO: 827845 - DNA, 25 bp, Mus musculus
tgtccctggagctagtgttgtgtga

SEQ ID NO: 827846 - DNA, 25 bp, Mus musculus
tgtccctggatgagcatcaatgtac

SEQ ID NO: 827847 - DNA, 25 bp, Mus musculus
tgtccctggatgtgcatcaatgtac

SEQ ID NO: 827848 - DNA, 25 bp, Mus musculus
tgtccctggcctatggagggcatat

SEQ ID NO: 827849 - DNA, 25 bp, Mus musculus
tgtccctggcctttggagggcatat

SEQ ID NO: 827850 - DNA, 25 bp, Mus musculus
tgtccctgggaaacacgagtgtccg

SEQ ID NO: 827851 - DNA, 25 bp, Mus musculus
tgtccctgggaatcacgagtgtccg

SEQ ID NO: 827852 - DNA, 25 bp, Mus musculus
tgtccctgggatcgctgtacatcgg

SEQ ID NO: 827853 - DNA, 25 bp, Mus musculus
tgtccctgggatggctgtacatcgg

SEQ ID NO: 827854 - DNA, 25 bp, Mus musculus
tgtccctgggcaacaggccattgct

SEQ ID NO: 827855 - DNA, 25 bp, Mus musculus
tgtccctgggcatcaggccattgct

SEQ ID NO: 827856 - DNA, 25 bp, Mus musculus
tgtccctggtgaaatccgtggttat

SEQ ID NO: 827857 - DNA, 25 bp, Mus musculus
tgtccctggtgatatccgtggttat

SEQ ID NO: 827858 - DNA, 25 bp, Mus musculus
tgtccctggtgccaggtgtccgtct

SEQ ID NO: 827859 - DNA, 25 bp, Mus musculus
tgtccctggtgcgaggtgtccgtct

SEQ ID NO: 827860 - DNA, 25 bp, Mus musculus
tgtccctggtgtacctggctgagct

SEQ ID NO: 827861 - DNA, 25 bp, Mus musculus
tgtccctggtgttcctggctgagct

SEQ ID NO: 827862 - DNA, 25 bp, Mus musculus
tgtccctgtcctaccgagtcttcga

SEQ ID NO: 827863 - DNA, 25 bp, Mus musculus
tgtccctgtccttccgagtcttcga

SEQ ID NO: 827864 - DNA, 25 bp, Mus musculus
tgtccctgtctcatcagaactgtcc

SEQ ID NO: 827865 - DNA, 25 bp, Mus musculus
tgtccctgtctcttcagaactgtcc

SEQ ID NO: 827866 - DNA, 25 bp, Mus musculus
tgtcccttaggtcagaaagtaactc

SEQ ID NO: 827867 - DNA, 25 bp, Mus musculus
tgtcccttaggtgagaaagtaactc

SEQ ID NO: 827868 - DNA, 25 bp, Mus musculus
tgtcccttctcgcatgatcagaaag

SEQ ID NO: 827869 - DNA, 25 bp, Mus musculus
tgtcccttctcggatgatcagaaag

SEQ ID NO: 827870 - DNA, 25 bp, Mus musculus
tgtcccttgtgaatggctgggaagt

SEQ ID NO: 827871 - DNA, 25 bp, Mus musculus
tgtcccttgtgattggctgggaagt

SEQ ID NO: 827872 - DNA, 25 bp, Mus musculus
tgtccctttatcaactacctgagtg

SEQ ID NO: 827873 - DNA, 25 bp, Mus musculus
tgtccctttatctactacctgagtg

SEQ ID NO: 827874 - DNA, 25 bp, Mus musculus
tgtccgaagagaacttctggccctg

SEQ ID NO: 827875 - DNA, 25 bp, Mus musculus
tgtccgaagagatcttctggccctg

SEQ ID NO: 827876 - DNA, 25 bp, Mus musculus
tgtccgactgcaatctcacgacgtg

SEQ ID NO: 827877 - DNA, 25 bp, Mus musculus
tgtccgactgcattctcacgacgtg

SEQ ID NO: 827878 - DNA, 25 bp, Mus musculus
tgtccgagccctacagtgaaagcag

SEQ ID NO: 827879 - DNA, 25 bp, Mus musculus
tgtccgagcccttcagtgaaagcag

SEQ ID NO: 827880 - DNA, 25 bp, Mus musculus
tgtccgagctgaatgcgcagctgct

SEQ ID NO: 827881 - DNA, 25 bp, Mus musculus
tgtccgagctgattgcgcagctgct

SEQ ID NO: 827882 - DNA, 25 bp, Mus musculus
tgtccgagtttgagacttgtatgtc

SEQ ID NO: 827883 - DNA, 25 bp, Mus musculus
tgtccgagtttgtgacttgtatgtc

SEQ ID NO: 827884 - DNA, 25 bp, Mus musculus
tgtccgatcaaaacgacagtatgac

SEQ ID NO: 827885 - DNA, 25 bp, Mus musculus
tgtccgatcaaatcgacagtatgac

SEQ ID NO: 827886 - DNA, 25 bp, Mus musculus
tgtccgatgtctctatccattttct

SEQ ID NO: 827887 - DNA, 25 bp, Mus musculus
tgtccgatgtctgtatccattttct

SEQ ID NO: 827888 - DNA, 25 bp, Mus musculus
tgtccgcaaatccagccaggatagc

SEQ ID NO: 827889 - DNA, 25 bp, Mus musculus
tgtccgcaaatcgagccaggatagc

SEQ ID NO: 827890 - DNA, 25 bp, Mus musculus
tgtccgcacataagtagacacagca

SEQ ID NO: 827891 - DNA, 25 bp, Mus musculus
tgtccgcacatatgtagacacagca

SEQ ID NO: 827892 - DNA, 25 bp, Mus musculus
tgtccgcagcctacatcattctgat

SEQ ID NO: 827893 - DNA, 25 bp, Mus musculus
tgtccgcagccttcatcattctgat

SEQ ID NO: 827894 - DNA, 25 bp, Mus musculus
tgtccgccaaatacgaacccttcag

SEQ ID NO: 827895 - DNA, 25 bp, Mus musculus
tgtccgccaaattcgaacccttcag

SEQ ID NO: 827896 - DNA, 25 bp, Mus musculus
tgtccgccccatacatgaggagcat

SEQ ID NO: 827897 - DNA, 25 bp, Mus musculus
tgtccgccccattcatgaggagcat

SEQ ID NO: 827898 - DNA, 25 bp, Mus musculus
tgtccgccgggccatgaagccgctt

SEQ ID NO: 827899 - DNA, 25 bp, Mus musculus
tgtccgccgggcgatgaagccgctt

SEQ ID NO: 827900 - DNA, 25 bp, Mus musculus
tgtccgcctacactttccagcagga

SEQ ID NO: 827901 - DNA, 25 bp, Mus musculus
tgtccgcctacagtttccagcagga

SEQ ID NO: 827902 - DNA, 25 bp, Mus musculus
tgtccgcctgccaatcacaggatag

SEQ ID NO: 827903 - DNA, 25 bp, Mus musculus
tgtccgcctgcctatcacaggatag

SEQ ID NO: 827904 - DNA, 25 bp, Mus musculus
tgtccgcgctacagaaacatcagcg

SEQ ID NO: 827905 - DNA, 25 bp, Mus musculus
tgtccgcgctactgaaacatcagcg

SEQ ID NO: 827906 - DNA, 25 bp, Mus musculus
tgtccgctcctgaaggatgacctcg

SEQ ID NO: 827907 - DNA, 25 bp, Mus musculus
tgtccgctcctgtaggatgacctcg

SEQ ID NO: 827908 - DNA, 25 bp, Mus musculus
tgtccgctgacaagatctacacttt

SEQ ID NO: 827909 - DNA, 25 bp, Mus musculus
tgtccgctgacatgatctacacttt

SEQ ID NO: 827910 - DNA, 25 bp, Mus musculus
tgtccgctgggcattgcagctctga

SEQ ID NO: 827911 - DNA, 25 bp, Mus musculus
tgtccgctgggctttgcagctctga

SEQ ID NO: 827912 - DNA, 25 bp, Mus musculus
tgtccggaacctacatagccaccgt

SEQ ID NO: 827913 - DNA, 25 bp, Mus musculus
tgtccggaaccttcatagccaccgt

SEQ ID NO: 827914 - DNA, 25 bp, Mus musculus
tgtccggatgatctctcgctgacgc

SEQ ID NO: 827915 - DNA, 25 bp, Mus musculus
tgtccggatgatgtctcgctgacgc

SEQ ID NO: 827916 - DNA, 25 bp, Mus musculus
tgtccggcagaacaagcgcctggat

SEQ ID NO: 827917 - DNA, 25 bp, Mus musculus
tgtccggcagaagaagcgcctggat

SEQ ID NO: 827918 - DNA, 25 bp, Mus musculus
tgtccggccagcacattcttaccaa

SEQ ID NO: 827919 - DNA, 25 bp, Mus musculus
tgtccggccagctcattcttaccaa

SEQ ID NO: 827920 - DNA, 25 bp, Mus musculus
tgtccggccatgaggagtaccagat

SEQ ID NO: 827921 - DNA, 25 bp, Mus musculus
tgtccggccatgtggagtaccagat

SEQ ID NO: 827922 - DNA, 25 bp, Mus musculus
tgtccggcccggactgcagccgaga

SEQ ID NO: 827923 - DNA, 25 bp, Mus musculus
tgtccggcccggtctgcagccgaga

SEQ ID NO: 827924 - DNA, 25 bp, Mus musculus
tgtccggcgcatatacaaaaggagg

SEQ ID NO: 827925 - DNA, 25 bp, Mus musculus
tgtccggcgcatttacaaaaggagg

SEQ ID NO: 827926 - DNA, 25 bp, Mus musculus
tgtccgggaataccatgctaggagt

SEQ ID NO: 827927 - DNA, 25 bp, Mus musculus
tgtccgggaatagcatgctaggagt

SEQ ID NO: 827928 - DNA, 25 bp, Mus musculus
tgtccgggacatagtcctgcagaaa

SEQ ID NO: 827929 - DNA, 25 bp, Mus musculus
tgtccgggacattgtcctgcagaaa

SEQ ID NO: 827930 - DNA, 25 bp, Mus musculus
tgtccggtacctcgctgtgacggtc

SEQ ID NO: 827931 - DNA, 25 bp, Mus musculus
tgtccggtacctggctgtgacggtc

SEQ ID NO: 827932 - DNA, 25 bp, Mus musculus
tgtccggtgagcctcgaacgactga

SEQ ID NO: 827933 - DNA, 25 bp, Mus musculus
tgtccggtgagcgtcgaacgactga

SEQ ID NO: 827934 - DNA, 25 bp, Mus musculus
tgtccgtactctccgagtagaggag

SEQ ID NO: 827935 - DNA, 25 bp, Mus musculus
tgtccgtactctgcgagtagaggag

SEQ ID NO: 827936 - DNA, 25 bp, Mus musculus
tgtccgtcataacctcttcttctgt

SEQ ID NO: 827937 - DNA, 25 bp, Mus musculus
tgtccgtcataagctcttcttctgt

SEQ ID NO: 827938 - DNA, 25 bp, Mus musculus
tgtccgtcatcaccttggtcagctg

SEQ ID NO: 827939 - DNA, 25 bp, Mus musculus
tgtccgtcatcagcttggtcagctg

SEQ ID NO: 827940 - DNA, 25 bp, Mus musculus
tgtccgtcatccactgcggaatcat

SEQ ID NO: 827941 - DNA, 25 bp, Mus musculus
tgtccgtcatcctctgcggaatcat

SEQ ID NO: 827942 - DNA, 25 bp, Mus musculus
tgtccgtctcctctggtaggttcca

SEQ ID NO: 827943 - DNA, 25 bp, Mus musculus
tgtccgtctcctgtggtaggttcca

SEQ ID NO: 827944 - DNA, 25 bp, Mus musculus
tgtccgtgaccaccggcttgtatct

SEQ ID NO: 827945 - DNA, 25 bp, Mus musculus
tgtccgtgaccagcggcttgtatct

SEQ ID NO: 827946 - DNA, 25 bp, Mus musculus
tgtccgtgcgaaagcgctgccacca

SEQ ID NO: 827947 - DNA, 25 bp, Mus musculus
tgtccgtgcgaatgcgctgccacca

SEQ ID NO: 827948 - DNA, 25 bp, Mus musculus
tgtccgtggaatcccttattgatga

SEQ ID NO: 827949 - DNA, 25 bp, Mus musculus
tgtccgtggaatgccttattgatga

SEQ ID NO: 827950 - DNA, 25 bp, Mus musculus
tgtccgtggtggacagaatctgcgt

SEQ ID NO: 827951 - DNA, 25 bp, Mus musculus
tgtccgtggtggtcagaatctgcgt

SEQ ID NO: 827952 - DNA, 25 bp, Mus musculus
tgtccgtgtcccaggccatcttcgt

SEQ ID NO: 827953 - DNA, 25 bp, Mus musculus
tgtccgtgtccctggccatcttcgt

SEQ ID NO: 827954 - DNA, 25 bp, Mus musculus
tgtccgttcacgagcagaaagcttg

SEQ ID NO: 827955 - DNA, 25 bp, Mus musculus
tgtccgttcacgtgcagaaagcttg

SEQ ID NO: 827956 - DNA, 25 bp, Mus musculus
tgtccgttcagacctcggcaccatg

SEQ ID NO: 827957 - DNA, 25 bp, Mus musculus
tgtccgttcagagctcggcaccatg

SEQ ID NO: 827958 - DNA, 25 bp, Mus musculus
tgtccgttcttgcttgccatgtata

SEQ ID NO: 827959 - DNA, 25 bp, Mus musculus
tgtccgttcttggttgccatgtata

SEQ ID NO: 827960 - DNA, 25 bp, Mus musculus
tgtcctaaacccagattaccggcag

SEQ ID NO: 827961 - DNA, 25 bp, Mus musculus
tgtcctaaaccctgattaccggcag

SEQ ID NO: 827962 - DNA, 25 bp, Mus musculus
tgtcctaaactcatggcacttgcgg

SEQ ID NO: 827963 - DNA, 25 bp, Mus musculus
tgtcctaaactcttggcacttgcgg

SEQ ID NO: 827964 - DNA, 25 bp, Mus musculus
tgtcctaacaagcagggacccagct

SEQ ID NO: 827965 - DNA, 25 bp, Mus musculus
tgtcctaacaaggagggacccagct

SEQ ID NO: 827966 - DNA, 25 bp, Mus musculus
tgtcctaaggaaccaaacaataccc

SEQ ID NO: 827967 - DNA, 25 bp, Mus musculus
tgtcctaaggaagcaaacaataccc

SEQ ID NO: 827968 - DNA, 25 bp, Mus musculus
tgtcctaatggcacagacactggaa

SEQ ID NO: 827969 - DNA, 25 bp, Mus musculus
tgtcctaatggctcagacactggaa

SEQ ID NO: 827970 - DNA, 25 bp, Mus musculus
tgtcctacaagacgttcttaatttg

SEQ ID NO: 827971 - DNA, 25 bp, Mus musculus
tgtcctacaagaggttcttaatttg

SEQ ID NO: 827972 - DNA, 25 bp, Mus musculus
tgtcctacacggacaccacagtgac

SEQ ID NO: 827973 - DNA, 25 bp, Mus musculus
tgtcctacacggtcaccacagtgac

SEQ ID NO: 827974 - DNA, 25 bp, Mus musculus
tgtcctacaggacgcttcccgtaag

SEQ ID NO: 827975 - DNA, 25 bp, Mus musculus
tgtcctacaggaggcttcccgtaag

SEQ ID NO: 827976 - DNA, 25 bp, Mus musculus
tgtcctacagtaaagaaacctctga

SEQ ID NO: 827977 - DNA, 25 bp, Mus musculus
tgtcctacagtatagaaacctctga

SEQ ID NO: 827978 - DNA, 25 bp, Mus musculus
tgtcctaccagtcagatccagtgtg

SEQ ID NO: 827979 - DNA, 25 bp, Mus musculus
tgtcctaccagtgagatccagtgtg

SEQ ID NO: 827980 - DNA, 25 bp, Mus musculus
tgtcctaccctgcattcagcaaatc

SEQ ID NO: 827981 - DNA, 25 bp, Mus musculus
tgtcctaccctggattcagcaaatc

SEQ ID NO: 827982 - DNA, 25 bp, Mus musculus
tgtcctaccgccactacgacgagat

SEQ ID NO: 827983 - DNA, 25 bp, Mus musculus
tgtcctaccgcctctacgacgagat

SEQ ID NO: 827984 - DNA, 25 bp, Mus musculus
tgtcctaccgggaaaaaggtctctg

SEQ ID NO: 827985 - DNA, 25 bp, Mus musculus
tgtcctaccgggtaaaaggtctctg

SEQ ID NO: 827986 - DNA, 25 bp, Mus musculus
tgtcctacctgaacgtcactcgaaa

SEQ ID NO: 827987 - DNA, 25 bp, Mus musculus
tgtcctacctgatcgtcactcgaaa

SEQ ID NO: 827988 - DNA, 25 bp, Mus musculus
tgtcctacgatgagcagctgctcca

SEQ ID NO: 827989 - DNA, 25 bp, Mus musculus
tgtcctacgatgtgcagctgctcca

SEQ ID NO: 827990 - DNA, 25 bp, Mus musculus
tgtcctacggatagaacatcgagat

SEQ ID NO: 827991 - DNA, 25 bp, Mus musculus
tgtcctacggattgaacatcgagat

SEQ ID NO: 827992 - DNA, 25 bp, Mus musculus
tgtcctagatagaatgaagccaaat

SEQ ID NO: 827993 - DNA, 25 bp, Mus musculus
tgtcctagatagtatgaagccaaat

SEQ ID NO: 827994 - DNA, 25 bp, Mus musculus
tgtcctagccttcgtggcctattac

SEQ ID NO: 827995 - DNA, 25 bp, Mus musculus
tgtcctagccttggtggcctattac

SEQ ID NO: 827996 - DNA, 25 bp, Mus musculus
tgtcctagctgtactgcgatccccg

SEQ ID NO: 827997 - DNA, 25 bp, Mus musculus
tgtcctagctgttctgcgatccccg

SEQ ID NO: 827998 - DNA, 25 bp, Mus musculus
tgtcctagtgcccattgtctgtcgc

SEQ ID NO: 827999 - DNA, 25 bp, Mus musculus
tgtcctagtgccgattgtctgtcgc

SEQ ID NO: 828000 - DNA, 25 bp, Mus musculus
tgtcctatgagtctgtcactggtgg

SEQ ID NO: 828001 - DNA, 25 bp, Mus musculus
tgtcctatgagtgtgtcactggtgg

SEQ ID NO: 828002 - DNA, 25 bp, Mus musculus
tgtcctattagcaataccaggtggg

SEQ ID NO: 828003 - DNA, 25 bp, Mus musculus
tgtcctattagctataccaggtggg

SEQ ID NO: 828004 - DNA, 25 bp, Mus musculus
tgtcctcacagccatttgaaagagc

SEQ ID NO: 828005 - DNA, 25 bp, Mus musculus
tgtcctcacagcgatttgaaagagc

SEQ ID NO: 828006 - DNA, 25 bp, Mus musculus
tgtcctcaccataccgagaggcact

SEQ ID NO: 828007 - DNA, 25 bp, Mus musculus
tgtcctcaccattccgagaggcact

SEQ ID NO: 828008 - DNA, 25 bp, Mus musculus
tgtcctcaccccaagagcaagaaga

SEQ ID NO: 828009 - DNA, 25 bp, Mus musculus
tgtcctcacccctagagcaagaaga

SEQ ID NO: 828010 - DNA, 25 bp, Mus musculus
tgtcctcacgccaatgtcctttctt

SEQ ID NO: 828011 - DNA, 25 bp, Mus musculus
tgtcctcacgcctatgtcctttctt

SEQ ID NO: 828012 - DNA, 25 bp, Mus musculus
tgtcctcacgggagctgctgtggct

SEQ ID NO: 828013 - DNA, 25 bp, Mus musculus
tgtcctcacgggtgctgctgtggct

SEQ ID NO: 828014 - DNA, 25 bp, Mus musculus
tgtcctcactcaaggctgtgggtcc

SEQ ID NO: 828015 - DNA, 25 bp, Mus musculus
tgtcctcactcatggctgtgggtcc

SEQ ID NO: 828016 - DNA, 25 bp, Mus musculus
tgtcctcactctcagcggcggcgag

SEQ ID NO: 828017 - DNA, 25 bp, Mus musculus
tgtcctcactctccatttaaagcga

SEQ ID NO: 828018 - DNA, 25 bp, Mus musculus
tgtcctcactctgagcggcggcgag

SEQ ID NO: 828019 - DNA, 25 bp, Mus musculus
tgtcctcactctgcatttaaagcga

SEQ ID NO: 828020 - DNA, 25 bp, Mus musculus
tgtcctcaggctcctcgatgtacca

SEQ ID NO: 828021 - DNA, 25 bp, Mus musculus
tgtcctcaggctgctcgatgtacca

SEQ ID NO: 828022 - DNA, 25 bp, Mus musculus
tgtcctcaggtcagtatcccctatc

SEQ ID NO: 828023 - DNA, 25 bp, Mus musculus
tgtcctcaggtctgtatcccctatc

SEQ ID NO: 828024 - DNA, 25 bp, Mus musculus
tgtcctcatgtacctgaatgccact

SEQ ID NO: 828025 - DNA, 25 bp, Mus musculus
tgtcctcatgtagctgaatgccact

SEQ ID NO: 828026 - DNA, 25 bp, Mus musculus
tgtcctcattgtccaaaggagtgga

SEQ ID NO: 828027 - DNA, 25 bp, Mus musculus
tgtcctcattgtgcaaaggagtgga

SEQ ID NO: 828028 - DNA, 25 bp, Mus musculus
tgtcctccaggaatgcaactccaca

SEQ ID NO: 828029 - DNA, 25 bp, Mus musculus
tgtcctccaggattgcaactccaca

SEQ ID NO: 828030 - DNA, 25 bp, Mus musculus
tgtcctccagtgaccacctaaagga

SEQ ID NO: 828031 - DNA, 25 bp, Mus musculus
tgtcctccagtgtccacctaaagga

SEQ ID NO: 828032 - DNA, 25 bp, Mus musculus
tgtcctccccgtcgagaagcacttg

SEQ ID NO: 828033 - DNA, 25 bp, Mus musculus
tgtcctccccgtggagaagcacttg

SEQ ID NO: 828034 - DNA, 25 bp, Mus musculus
tgtcctcccctgaggatcgggcaat

SEQ ID NO: 828035 - DNA, 25 bp, Mus musculus
tgtcctcccctgtggatcgggcaat

SEQ ID NO: 828036 - DNA, 25 bp, Mus musculus
tgtcctccccttacagcagagaaga

SEQ ID NO: 828037 - DNA, 25 bp, Mus musculus
tgtcctcccctttcagcagagaaga

SEQ ID NO: 828038 - DNA, 25 bp, Mus musculus
tgtcctcccttaaacatggcctctt

SEQ ID NO: 828039 - DNA, 25 bp, Mus musculus
tgtcctcccttatacatggcctctt

SEQ ID NO: 828040 - DNA, 25 bp, Mus musculus
tgtcctccctttaaccagtgctgct

SEQ ID NO: 828041 - DNA, 25 bp, Mus musculus
tgtcctcccttttaccagtgctgct

SEQ ID NO: 828042 - DNA, 25 bp, Mus musculus
tgtcctccggaaacgacaacccagg

SEQ ID NO: 828043 - DNA, 25 bp, Mus musculus
tgtcctccggaatcgacaacccagg

SEQ ID NO: 828044 - DNA, 25 bp, Mus musculus
tgtcctcctgtgatgcagcttgtag

SEQ ID NO: 828045 - DNA, 25 bp, Mus musculus
tgtcctcctgtgttgcagcttgtag

SEQ ID NO: 828046 - DNA, 25 bp, Mus musculus
tgtcctccttgtcggaaaatgccag

SEQ ID NO: 828047 - DNA, 25 bp, Mus musculus
tgtcctccttgtgggaaaatgccag

SEQ ID NO: 828048 - DNA, 25 bp, Mus musculus
tgtcctccttttctttggcagctct

SEQ ID NO: 828049 - DNA, 25 bp, Mus musculus
tgtcctccttttgtttggcagctct

SEQ ID NO: 828050 - DNA, 25 bp, Mus musculus
tgtcctcgaggtcagttgtgtccca

SEQ ID NO: 828051 - DNA, 25 bp, Mus musculus
tgtcctcgaggtgagttgtgtccca

SEQ ID NO: 828052 - DNA, 25 bp, Mus musculus
tgtcctcgatgaaatgctaccgcag

SEQ ID NO: 828053 - DNA, 25 bp, Mus musculus
tgtcctcgatgatatgctaccgcag

SEQ ID NO: 828054 - DNA, 25 bp, Mus musculus
tgtcctcgccttctgtcgattatca

SEQ ID NO: 828055 - DNA, 25 bp, Mus musculus
tgtcctcgccttgtgtcgattatca

SEQ ID NO: 828056 - DNA, 25 bp, Mus musculus
tgtcctcgcgacagtggcgtcgtct

SEQ ID NO: 828057 - DNA, 25 bp, Mus musculus
tgtcctcgcgactgtggcgtcgtct

SEQ ID NO: 828058 - DNA, 25 bp, Mus musculus
tgtcctcggacactgatcaatcatg

SEQ ID NO: 828059 - DNA, 25 bp, Mus musculus
tgtcctcggacagtgatcaatcatg

SEQ ID NO: 828060 - DNA, 25 bp, Mus musculus
tgtcctctcagaatatgtgggctcc

SEQ ID NO: 828061 - DNA, 25 bp, Mus musculus
tgtcctctcagattatgtgggctcc

SEQ ID NO: 828062 - DNA, 25 bp, Mus musculus
tgtcctctcatcagggacctcaagc

SEQ ID NO: 828063 - DNA, 25 bp, Mus musculus
tgtcctctcatctgggacctcaagc

SEQ ID NO: 828064 - DNA, 25 bp, Mus musculus
tgtcctctctggagatcaggataca

SEQ ID NO: 828065 - DNA, 25 bp, Mus musculus
tgtcctctctggtgatcaggataca

SEQ ID NO: 828066 - DNA, 25 bp, Mus musculus
tgtcctctgagtaccgggaatatgc

SEQ ID NO: 828067 - DNA, 25 bp, Mus musculus
tgtcctctgagttccgggaatatgc

SEQ ID NO: 828068 - DNA, 25 bp, Mus musculus
tgtcctctgcctaccgctgacaata

SEQ ID NO: 828069 - DNA, 25 bp, Mus musculus
tgtcctctgccttccgctgacaata

SEQ ID NO: 828070 - DNA, 25 bp, Mus musculus
tgtcctctgcttcggaacagcctta

SEQ ID NO: 828071 - DNA, 25 bp, Mus musculus
tgtcctctgcttgggaacagcctta

SEQ ID NO: 828072 - DNA, 25 bp, Mus musculus
tgtcctctgggacaacgcctttgca

SEQ ID NO: 828073 - DNA, 25 bp, Mus musculus
tgtcctctgggagaacgcctttgca

SEQ ID NO: 828074 - DNA, 25 bp, Mus musculus
tgtcctctgggcatcggctcggcgc

SEQ ID NO: 828075 - DNA, 25 bp, Mus musculus
tgtcctctgggcttcggctcggcgc

SEQ ID NO: 828076 - DNA, 25 bp, Mus musculus
tgtcctctgtccagagctggttctg

SEQ ID NO: 828077 - DNA, 25 bp, Mus musculus
tgtcctctgtcctgagctggttctg

SEQ ID NO: 828078 - DNA, 25 bp, Mus musculus
tgtcctctttagaagccaccatggg

SEQ ID NO: 828079 - DNA, 25 bp, Mus musculus
tgtcctctttagtagccaccatggg

SEQ ID NO: 828080 - DNA, 25 bp, Mus musculus
tgtcctgaaacacagaatagcaggg

SEQ ID NO: 828081 - DNA, 25 bp, Mus musculus
tgtcctgaaacagagaatagcaggg

SEQ ID NO: 828082 - DNA, 25 bp, Mus musculus
tgtcctgaacataccaatccctttg

SEQ ID NO: 828083 - DNA, 25 bp, Mus musculus
tgtcctgaacattccaatccctttg

SEQ ID NO: 828084 - DNA, 25 bp, Mus musculus
tgtcctgaaggaacagctcccaagc

SEQ ID NO: 828085 - DNA, 25 bp, Mus musculus
tgtcctgaaggacaactttattagt

SEQ ID NO: 828086 - DNA, 25 bp, Mus musculus
tgtcctgaaggagaactttattagt

SEQ ID NO: 828087 - DNA, 25 bp, Mus musculus
tgtcctgaaggatcagctcccaagc

SEQ ID NO: 828088 - DNA, 25 bp, Mus musculus
tgtcctgaataacaccaaagaagct

SEQ ID NO: 828089 - DNA, 25 bp, Mus musculus
tgtcctgaataagaccaaagaagct

SEQ ID NO: 828090 - DNA, 25 bp, Mus musculus
tgtcctgactacactgtgagggccc

SEQ ID NO: 828091 - DNA, 25 bp, Mus musculus
tgtcctgactactctgtgagggccc

SEQ ID NO: 828092 - DNA, 25 bp, Mus musculus
tgtcctgactggaatctgctgtgtg

SEQ ID NO: 828093 - DNA, 25 bp, Mus musculus
tgtcctgactggtatctgctgtgtg

SEQ ID NO: 828094 - DNA, 25 bp, Mus musculus
tgtcctgagcgacattaaagttggc

SEQ ID NO: 828095 - DNA, 25 bp, Mus musculus
tgtcctgagcgagattaaagttggc

SEQ ID NO: 828096 - DNA, 25 bp, Mus musculus
tgtcctgagtgcacggccatcgacg

SEQ ID NO: 828097 - DNA, 25 bp, Mus musculus
tgtcctgagtgctcggccatcgacg

SEQ ID NO: 828098 - DNA, 25 bp, Mus musculus
tgtcctgatcagcaggtcccaagat

SEQ ID NO: 828099 - DNA, 25 bp, Mus musculus
tgtcctgatcaggaggtcccaagat

SEQ ID NO: 828100 - DNA, 25 bp, Mus musculus
tgtcctgatcataggagagttgcta

SEQ ID NO: 828101 - DNA, 25 bp, Mus musculus
tgtcctgatcattggagagttgcta

SEQ ID NO: 828102 - DNA, 25 bp, Mus musculus
tgtcctgatcttaggcgtccccagc

SEQ ID NO: 828103 - DNA, 25 bp, Mus musculus
tgtcctgatctttggcgtccccagc

SEQ ID NO: 828104 - DNA, 25 bp, Mus musculus
tgtcctgatgcacctagaaaattgg

SEQ ID NO: 828105 - DNA, 25 bp, Mus musculus
tgtcctgatgcagctagaaaattgg

SEQ ID NO: 828106 - DNA, 25 bp, Mus musculus
tgtcctgatgggaaaggctacactc

SEQ ID NO: 828107 - DNA, 25 bp, Mus musculus
tgtcctgatgggtaaggctacactc

SEQ ID NO: 828108 - DNA, 25 bp, Mus musculus
tgtcctgattttcccacgacctgga

SEQ ID NO: 828109 - DNA, 25 bp, Mus musculus
tgtcctgattttgccacgacctgga

SEQ ID NO: 828110 - DNA, 25 bp, Mus musculus
tgtcctgcacagacaagattgccag

SEQ ID NO: 828111 - DNA, 25 bp, Mus musculus
tgtcctgcacagtcaagattgccag

SEQ ID NO: 828112 - DNA, 25 bp, Mus musculus
tgtcctgcagaaaacagagccagtt

SEQ ID NO: 828113 - DNA, 25 bp, Mus musculus
tgtcctgcagaatacagagccagtt

SEQ ID NO: 828114 - DNA, 25 bp, Mus musculus
tgtcctgcaggcagcggaactccca

SEQ ID NO: 828115 - DNA, 25 bp, Mus musculus
tgtcctgcaggctgcggaactccca

SEQ ID NO: 828116 - DNA, 25 bp, Mus musculus
tgtcctgcagtgaatgatctagcca

SEQ ID NO: 828117 - DNA, 25 bp, Mus musculus
tgtcctgcagtgtatgatctagcca

SEQ ID NO: 828118 - DNA, 25 bp, Mus musculus
tgtcctgcatcgatctgggctgacc

SEQ ID NO: 828119 - DNA, 25 bp, Mus musculus
tgtcctgcatcgttctgggctgacc

SEQ ID NO: 828120 - DNA, 25 bp, Mus musculus
tgtcctgcatgacatagaatacaga

SEQ ID NO: 828121 - DNA, 25 bp, Mus musculus
tgtcctgcatgagatagaatacaga

SEQ ID NO: 828122 - DNA, 25 bp, Mus musculus
tgtcctgcattaaagacgtggccat

SEQ ID NO: 828123 - DNA, 25 bp, Mus musculus
tgtcctgcattatagacgtggccat

SEQ ID NO: 828124 - DNA, 25 bp, Mus musculus
tgtcctgcattcagggctacagcat

SEQ ID NO: 828125 - DNA, 25 bp, Mus musculus
tgtcctgcattctgggctacagcat

SEQ ID NO: 828126 - DNA, 25 bp, Mus musculus
tgtcctgccatacattatacaagac

SEQ ID NO: 828127 - DNA, 25 bp, Mus musculus
tgtcctgccatagattatacaagac

SEQ ID NO: 828128 - DNA, 25 bp, Mus musculus
tgtcctgctactcgtgtggagcccc

SEQ ID NO: 828129 - DNA, 25 bp, Mus musculus
tgtcctgctactggtgtggagcccc

SEQ ID NO: 828130 - DNA, 25 bp, Mus musculus
tgtcctgctgcacgtctttctgtgg

SEQ ID NO: 828131 - DNA, 25 bp, Mus musculus
tgtcctgctgcaggtctttctgtgg

SEQ ID NO: 828132 - DNA, 25 bp, Mus musculus
tgtcctgctgcccattcttagatga

SEQ ID NO: 828133 - DNA, 25 bp, Mus musculus
tgtcctgctgccgattcttagatga

SEQ ID NO: 828134 - DNA, 25 bp, Mus musculus
tgtcctgctgcgatgcaaacgggat

SEQ ID NO: 828135 - DNA, 25 bp, Mus musculus
tgtcctgctgcgttgcaaacgggat

SEQ ID NO: 828136 - DNA, 25 bp, Mus musculus
tgtcctgctggtcgacttcaggcca

SEQ ID NO: 828137 - DNA, 25 bp, Mus musculus
tgtcctgctggtggacttcaggcca

SEQ ID NO: 828138 - DNA, 25 bp, Mus musculus
tgtcctgcttagaacagattgcctc

SEQ ID NO: 828139 - DNA, 25 bp, Mus musculus
tgtcctgcttagtacagattgcctc

SEQ ID NO: 828140 - DNA, 25 bp, Mus musculus
tgtcctggagagctggtaccagcta

SEQ ID NO: 828141 - DNA, 25 bp, Mus musculus
tgtcctggagaggtggtaccagcta

SEQ ID NO: 828142 - DNA, 25 bp, Mus musculus
tgtcctggagatctctaataaaccc

SEQ ID NO: 828143 - DNA, 25 bp, Mus musculus
tgtcctggagatgtctaataaaccc

SEQ ID NO: 828144 - DNA, 25 bp, Mus musculus
tgtcctggagccactcaccggagag

SEQ ID NO: 828145 - DNA, 25 bp, Mus musculus
tgtcctggagcctctcaccggagag

SEQ ID NO: 828146 - DNA, 25 bp, Mus musculus
tgtcctggaggaagcgtataccaca

SEQ ID NO: 828147 - DNA, 25 bp, Mus musculus
tgtcctggaggatgcgtataccaca

SEQ ID NO: 828148 - DNA, 25 bp, Mus musculus
tgtcctggagggagtcagactgctt

SEQ ID NO: 828149 - DNA, 25 bp, Mus musculus
tgtcctggagggtgtcagactgctt

SEQ ID NO: 828150 - DNA, 25 bp, Mus musculus
tgtcctggagtaaagatggagaagc

SEQ ID NO: 828151 - DNA, 25 bp, Mus musculus
tgtcctggagtatagatggagaagc

SEQ ID NO: 828152 - DNA, 25 bp, Mus musculus
tgtcctggagtcactgtatattgag

SEQ ID NO: 828153 - DNA, 25 bp, Mus musculus
tgtcctggagtctctgtatattgag

SEQ ID NO: 828154 - DNA, 25 bp, Mus musculus
tgtcctggagtgacctttttggtgc

SEQ ID NO: 828155 - DNA, 25 bp, Mus musculus
tgtcctggagtgtcctttttggtgc

SEQ ID NO: 828156 - DNA, 25 bp, Mus musculus
tgtcctggcctgattcaggtgccaa

SEQ ID NO: 828157 - DNA, 25 bp, Mus musculus
tgtcctggcctgtttcaggtgccaa

SEQ ID NO: 828158 - DNA, 25 bp, Mus musculus
tgtcctggctcaaaaagcagttggc

SEQ ID NO: 828159 - DNA, 25 bp, Mus musculus
tgtcctggctcataaagcagttggc

SEQ ID NO: 828160 - DNA, 25 bp, Mus musculus
tgtcctggctgtatgcactcactgc

SEQ ID NO: 828161 - DNA, 25 bp, Mus musculus
tgtcctggctgtttgcactcactgc

SEQ ID NO: 828162 - DNA, 25 bp, Mus musculus
tgtcctgggaaaacgggtgattcgc

SEQ ID NO: 828163 - DNA, 25 bp, Mus musculus
tgtcctgggaaatcgggtgattcgc

SEQ ID NO: 828164 - DNA, 25 bp, Mus musculus
tgtcctgggcatagactacagtttg

SEQ ID NO: 828165 - DNA, 25 bp, Mus musculus
tgtcctgggcattgactacagtttg

SEQ ID NO: 828166 - DNA, 25 bp, Mus musculus
tgtcctgggcttcaacagtatgcta

SEQ ID NO: 828167 - DNA, 25 bp, Mus musculus
tgtcctgggcttgaacagtatgcta

SEQ ID NO: 828168 - DNA, 25 bp, Mus musculus
tgtcctgggtatctactggctaata

SEQ ID NO: 828169 - DNA, 25 bp, Mus musculus
tgtcctgggtatgtactggctaata

SEQ ID NO: 828170 - DNA, 25 bp, Mus musculus
tgtcctggtcaacgcccaagggtta

SEQ ID NO: 828171 - DNA, 25 bp, Mus musculus
tgtcctggtcaaggcccaagggtta

SEQ ID NO: 828172 - DNA, 25 bp, Mus musculus
tgtcctgtagctacacattccaggt

SEQ ID NO: 828173 - DNA, 25 bp, Mus musculus
tgtcctgtagcttcacattccaggt

SEQ ID NO: 828174 - DNA, 25 bp, Mus musculus
tgtcctgtcattaccagcaaatcaa

SEQ ID NO: 828175 - DNA, 25 bp, Mus musculus
tgtcctgtcatttccagcaaatcaa

SEQ ID NO: 828176 - DNA, 25 bp, Mus musculus
tgtcctgtccagacgttctgaccag

SEQ ID NO: 828177 - DNA, 25 bp, Mus musculus
tgtcctgtccagtcgttctgaccag

SEQ ID NO: 828178 - DNA, 25 bp, Mus musculus
tgtcctgtccatcgcgaacgcaggc

SEQ ID NO: 828179 - DNA, 25 bp, Mus musculus
tgtcctgtccatggcgaacgcaggc

SEQ ID NO: 828180 - DNA, 25 bp, Mus musculus
tgtcctgtccttcgcaatcataatg

SEQ ID NO: 828181 - DNA, 25 bp, Mus musculus
tgtcctgtccttggcaatcataatg

SEQ ID NO: 828182 - DNA, 25 bp, Mus musculus
tgtcctgtcgacaccggtctcattg

SEQ ID NO: 828183 - DNA, 25 bp, Mus musculus
tgtcctgtcgactccggtctcattg

SEQ ID NO: 828184 - DNA, 25 bp, Mus musculus
tgtcctgtgcacctgtccactgctt

SEQ ID NO: 828185 - DNA, 25 bp, Mus musculus
tgtcctgtgcacgtgtccactgctt

SEQ ID NO: 828186 - DNA, 25 bp, Mus musculus
tgtcctgtgcatctgacatttcgcc

SEQ ID NO: 828187 - DNA, 25 bp, Mus musculus
tgtcctgtgcatgtgacatttcgcc

SEQ ID NO: 828188 - DNA, 25 bp, Mus musculus
tgtcctgtggcacattaacaaaaca

SEQ ID NO: 828189 - DNA, 25 bp, Mus musculus
tgtcctgtggcagattaacaaaaca

SEQ ID NO: 828190 - DNA, 25 bp, Mus musculus
tgtcctgtgtgactctccatatcaa

SEQ ID NO: 828191 - DNA, 25 bp, Mus musculus
tgtcctgtgtgagtctccatatcaa

SEQ ID NO: 828192 - DNA, 25 bp, Mus musculus
tgtcctgttagaacaagaatttaca

SEQ ID NO: 828193 - DNA, 25 bp, Mus musculus
tgtcctgttagatcaagaatttaca

SEQ ID NO: 828194 - DNA, 25 bp, Mus musculus
tgtcctgttcggaggtatgtcgctg

SEQ ID NO: 828195 - DNA, 25 bp, Mus musculus
tgtcctgttcggtggtatgtcgctg

SEQ ID NO: 828196 - DNA, 25 bp, Mus musculus
tgtcctgtttttccataccatgcgt

SEQ ID NO: 828197 - DNA, 25 bp, Mus musculus
tgtcctgtttttgcataccatgcgt

SEQ ID NO: 828198 - DNA, 25 bp, Mus musculus
tgtccttcaagaacccaaaactgaa

SEQ ID NO: 828199 - DNA, 25 bp, Mus musculus
tgtccttcaagatcccaaaactgaa

SEQ ID NO: 828200 - DNA, 25 bp, Mus musculus
tgtccttcaagcaccaagaagggag

SEQ ID NO: 828201 - DNA, 25 bp, Mus musculus
tgtccttcaagctccaagaagggag

SEQ ID NO: 828202 - DNA, 25 bp, Mus musculus
tgtccttcacggaacaaccagcgac

SEQ ID NO: 828203 - DNA, 25 bp, Mus musculus
tgtccttcacggtacaaccagcgac

SEQ ID NO: 828204 - DNA, 25 bp, Mus musculus
tgtccttccaagagagcctaggcga

SEQ ID NO: 828205 - DNA, 25 bp, Mus musculus
tgtccttccaagtgagcctaggcga

SEQ ID NO: 828206 - DNA, 25 bp, Mus musculus
tgtccttccagacttcgcagcagtc

SEQ ID NO: 828207 - DNA, 25 bp, Mus musculus
tgtccttccagagttcgcagcagtc

SEQ ID NO: 828208 - DNA, 25 bp, Mus musculus
tgtccttccgcactcgcccctgaag

SEQ ID NO: 828209 - DNA, 25 bp, Mus musculus
tgtccttccgcagtcgcccctgaag

SEQ ID NO: 828210 - DNA, 25 bp, Mus musculus
tgtccttcctgacaggccggattgt

SEQ ID NO: 828211 - DNA, 25 bp, Mus musculus
tgtccttcctgagaggccggattgt

SEQ ID NO: 828212 - DNA, 25 bp, Mus musculus
tgtccttcggaaacagcattcttgt

SEQ ID NO: 828213 - DNA, 25 bp, Mus musculus
tgtccttcggaatcagcattcttgt

SEQ ID NO: 828214 - DNA, 25 bp, Mus musculus
tgtccttcggagatacctggtggac

SEQ ID NO: 828215 - DNA, 25 bp, Mus musculus
tgtccttcggagttacctggtggac

SEQ ID NO: 828216 - DNA, 25 bp, Mus musculus
tgtccttgagccacgaggtctcctt

SEQ ID NO: 828217 - DNA, 25 bp, Mus musculus
tgtccttgagcctcgaggtctcctt

SEQ ID NO: 828218 - DNA, 25 bp, Mus musculus
tgtccttgatcaccatcgaatgttt

SEQ ID NO: 828219 - DNA, 25 bp, Mus musculus
tgtccttgatcagcatcgaatgttt

SEQ ID NO: 828220 - DNA, 25 bp, Mus musculus
tgtccttgattgcatacctgggcca

SEQ ID NO: 828221 - DNA, 25 bp, Mus musculus
tgtccttgattggatacctgggcca

SEQ ID NO: 828222 - DNA, 25 bp, Mus musculus
tgtccttgcccgagtgtcttcagag

SEQ ID NO: 828223 - DNA, 25 bp, Mus musculus
tgtccttgcccgtgtgtcttcagag

SEQ ID NO: 828224 - DNA, 25 bp, Mus musculus
tgtccttgctcacaataaactgggc

SEQ ID NO: 828225 - DNA, 25 bp, Mus musculus
tgtccttgctcagaataaactgggc

SEQ ID NO: 828226 - DNA, 25 bp, Mus musculus
tgtccttgctgacagtgcttctggg

SEQ ID NO: 828227 - DNA, 25 bp, Mus musculus
tgtccttgctgagagtgcttctggg

SEQ ID NO: 828228 - DNA, 25 bp, Mus musculus
tgtccttgtgtaccagtttcctgag

SEQ ID NO: 828229 - DNA, 25 bp, Mus musculus
tgtccttgtgtagcagtttcctgag

SEQ ID NO: 828230 - DNA, 25 bp, Mus musculus
tgtccttgttcaacgctggcgatga

SEQ ID NO: 828231 - DNA, 25 bp, Mus musculus
tgtccttgttcatcgctggcgatga

SEQ ID NO: 828232 - DNA, 25 bp, Mus musculus
tgtccttgttcgctggcccgtgcca

SEQ ID NO: 828233 - DNA, 25 bp, Mus musculus
tgtccttgttcggtggcccgtgcca

SEQ ID NO: 828234 - DNA, 25 bp, Mus musculus
tgtcctttaaacagtgcagcgagct

SEQ ID NO: 828235 - DNA, 25 bp, Mus musculus
tgtcctttaaactgtgcagcgagct

SEQ ID NO: 828236 - DNA, 25 bp, Mus musculus
tgtcctttctttcgattcaaccaca

SEQ ID NO: 828237 - DNA, 25 bp, Mus musculus
tgtcctttctttggattcaaccaca

SEQ ID NO: 828238 - DNA, 25 bp, Mus musculus
tgtcctttggagacgccggaagatg

SEQ ID NO: 828239 - DNA, 25 bp, Mus musculus
tgtcctttggagtcgccggaagatg

SEQ ID NO: 828240 - DNA, 25 bp, Mus musculus
tgtcctttgtctagaatgaatcgca

SEQ ID NO: 828241 - DNA, 25 bp, Mus musculus
tgtcctttgtcttgaatgaatcgca

SEQ ID NO: 828242 - DNA, 25 bp, Mus musculus
tgtccttttaggatgcggccttggc

SEQ ID NO: 828243 - DNA, 25 bp, Mus musculus
tgtccttttaggttgcggccttggc

SEQ ID NO: 828244 - DNA, 25 bp, Mus musculus
tgtccttttctgagttacagtgccc

SEQ ID NO: 828245 - DNA, 25 bp, Mus musculus
tgtccttttctgtgttacagtgccc

SEQ ID NO: 828246 - DNA, 25 bp, Mus musculus
tgtcgaacctcgatctgtggctgtg

SEQ ID NO: 828247 - DNA, 25 bp, Mus musculus
tgtcgaacctcgttctgtggctgtg

SEQ ID NO: 828248 - DNA, 25 bp, Mus musculus
tgtcgaactgggattgaacggcagc

SEQ ID NO: 828249 - DNA, 25 bp, Mus musculus
tgtcgaactgggtttgaacggcagc

SEQ ID NO: 828250 - DNA, 25 bp, Mus musculus
tgtcgaagaaaaagccacggccatg

SEQ ID NO: 828251 - DNA, 25 bp, Mus musculus
tgtcgaagaaaatgccacggccatg

SEQ ID NO: 828252 - DNA, 25 bp, Mus musculus
tgtcgaaggactcccttctaggtga

SEQ ID NO: 828253 - DNA, 25 bp, Mus musculus
tgtcgaaggactccttgagcatcct

SEQ ID NO: 828254 - DNA, 25 bp, Mus musculus
tgtcgaaggactgccttctaggtga

SEQ ID NO: 828255 - DNA, 25 bp, Mus musculus
tgtcgaaggactgcttgagcatcct

SEQ ID NO: 828256 - DNA, 25 bp, Mus musculus
tgtcgaataccgaccaactgtgtct

SEQ ID NO: 828257 - DNA, 25 bp, Mus musculus
tgtcgaataccgtccaactgtgtct

SEQ ID NO: 828258 - DNA, 25 bp, Mus musculus
tgtcgaatcctacagccatgcaggc

SEQ ID NO: 828259 - DNA, 25 bp, Mus musculus
tgtcgaatcctagagccatgcaggc

SEQ ID NO: 828260 - DNA, 25 bp, Mus musculus
tgtcgaatgaggagagaaaccttct

SEQ ID NO: 828261 - DNA, 25 bp, Mus musculus
tgtcgaatgaggtgagaaaccttct

SEQ ID NO: 828262 - DNA, 25 bp, Mus musculus
tgtcgaatgctacaagaaggctctt

SEQ ID NO: 828263 - DNA, 25 bp, Mus musculus
tgtcgaatgctagaagaaggctctt

SEQ ID NO: 828264 - DNA, 25 bp, Mus musculus
tgtcgacacagcagtgcgccatgtg

SEQ ID NO: 828265 - DNA, 25 bp, Mus musculus
tgtcgacacagctgtgcgccatgtg

SEQ ID NO: 828266 - DNA, 25 bp, Mus musculus
tgtcgacaccggactcattgagaag

SEQ ID NO: 828267 - DNA, 25 bp, Mus musculus
tgtcgacaccggtctcattgagaag

SEQ ID NO: 828268 - DNA, 25 bp, Mus musculus
tgtcgaccccatcatggagaagttc

SEQ ID NO: 828269 - DNA, 25 bp, Mus musculus
tgtcgaccccatgatggagaagttc

SEQ ID NO: 828270 - DNA, 25 bp, Mus musculus
tgtcgacctactcgagaagatgctc

SEQ ID NO: 828271 - DNA, 25 bp, Mus musculus
tgtcgacctactggagaagatgctc

SEQ ID NO: 828272 - DNA, 25 bp, Mus musculus
tgtcgacctgcacgacctgggtcat

SEQ ID NO: 828273 - DNA, 25 bp, Mus musculus
tgtcgacctgcaggacctgggtcat

SEQ ID NO: 828274 - DNA, 25 bp, Mus musculus
tgtcgacgatttcacctgggagcct

SEQ ID NO: 828275 - DNA, 25 bp, Mus musculus
tgtcgacgatttgacctgggagcct

SEQ ID NO: 828276 - DNA, 25 bp, Mus musculus
tgtcgactccgtctggagttcccca

SEQ ID NO: 828277 - DNA, 25 bp, Mus musculus
tgtcgactccgtgtggagttcccca

SEQ ID NO: 828278 - DNA, 25 bp, Mus musculus
tgtcgactggcaacccagaggcaag

SEQ ID NO: 828279 - DNA, 25 bp, Mus musculus
tgtcgactggcatcccagaggcaag

SEQ ID NO: 828280 - DNA, 25 bp, Mus musculus
tgtcgagaatatcactaacccaggc

SEQ ID NO: 828281 - DNA, 25 bp, Mus musculus
tgtcgagaatatgactaacccaggc

SEQ ID NO: 828282 - DNA, 25 bp, Mus musculus
tgtcgagaattcaccaggaggccag

SEQ ID NO: 828283 - DNA, 25 bp, Mus musculus
tgtcgagaattctccaggaggccag

SEQ ID NO: 828284 - DNA, 25 bp, Mus musculus
tgtcgagaccgtatcagtccatcat

SEQ ID NO: 828285 - DNA, 25 bp, Mus musculus
tgtcgagaccgtttcagtccatcat

SEQ ID NO: 828286 - DNA, 25 bp, Mus musculus
tgtcgagagctgcaattctgcacct

SEQ ID NO: 828287 - DNA, 25 bp, Mus musculus
tgtcgagagctggaattctgcacct

SEQ ID NO: 828288 - DNA, 25 bp, Mus musculus
tgtcgagaggcccaagtgtccactt

SEQ ID NO: 828289 - DNA, 25 bp, Mus musculus
tgtcgagaggccgaagtgtccactt

SEQ ID NO: 828290 - DNA, 25 bp, Mus musculus
tgtcgagatggcaattttaactgcc

SEQ ID NO: 828291 - DNA, 25 bp, Mus musculus
tgtcgagatggctattttaactgcc

SEQ ID NO: 828292 - DNA, 25 bp, Mus musculus
tgtcgagcaaagaccgtcagcttga

SEQ ID NO: 828293 - DNA, 25 bp, Mus musculus
tgtcgagcaaagtccgtcagcttga

SEQ ID NO: 828294 - DNA, 25 bp, Mus musculus
tgtcgagcatcaaccaggaggcgct

SEQ ID NO: 828295 - DNA, 25 bp, Mus musculus
tgtcgagcatcatccaggaggcgct

SEQ ID NO: 828296 - DNA, 25 bp, Mus musculus
tgtcgagccttgcaattgatgcagc

SEQ ID NO: 828297 - DNA, 25 bp, Mus musculus
tgtcgagccttggaattgatgcagc

SEQ ID NO: 828298 - DNA, 25 bp, Mus musculus
tgtcgagcgatgatgacaagggctt

SEQ ID NO: 828299 - DNA, 25 bp, Mus musculus
tgtcgagcgatgttgacaagggctt

SEQ ID NO: 828300 - DNA, 25 bp, Mus musculus
tgtcgagctctcctggctttgaaga

SEQ ID NO: 828301 - DNA, 25 bp, Mus musculus
tgtcgagctctcgtggctttgaaga

SEQ ID NO: 828302 - DNA, 25 bp, Mus musculus
tgtcgatcagaaaaccttccacttc

SEQ ID NO: 828303 - DNA, 25 bp, Mus musculus
tgtcgatcagaataccttccacttc

SEQ ID NO: 828304 - DNA, 25 bp, Mus musculus
tgtcgatgatcccaagattcctcag

SEQ ID NO: 828305 - DNA, 25 bp, Mus musculus
tgtcgatgatccgaagattcctcag

SEQ ID NO: 828306 - DNA, 25 bp, Mus musculus
tgtcgatgcaaaatcaaccaacagc

SEQ ID NO: 828307 - DNA, 25 bp, Mus musculus
tgtcgatgcaaattcaaccaacagc

SEQ ID NO: 828308 - DNA, 25 bp, Mus musculus
tgtcgatgccccagaacgggctgaa

SEQ ID NO: 828309 - DNA, 25 bp, Mus musculus
tgtcgatgcccctgaacgggctgaa

SEQ ID NO: 828310 - DNA, 25 bp, Mus musculus
tgtcgatgcctcagtcaatcactcc

SEQ ID NO: 828311 - DNA, 25 bp, Mus musculus
tgtcgatgcctctgtcaatcactcc

SEQ ID NO: 828312 - DNA, 25 bp, Mus musculus
tgtcgcaaaccgcacatcaattgct

SEQ ID NO: 828313 - DNA, 25 bp, Mus musculus
tgtcgcaaaccggacatcaattgct

SEQ ID NO: 828314 - DNA, 25 bp, Mus musculus
tgtcgcaagcacatcatccaggcca

SEQ ID NO: 828315 - DNA, 25 bp, Mus musculus
tgtcgcaagcacttcatccaggcca

SEQ ID NO: 828316 - DNA, 25 bp, Mus musculus
tgtcgcactggcagccgttctggtc

SEQ ID NO: 828317 - DNA, 25 bp, Mus musculus
tgtcgcactggctgccgttctggtc

SEQ ID NO: 828318 - DNA, 25 bp, Mus musculus
tgtcgcagagatcaaccccaatgta

SEQ ID NO: 828319 - DNA, 25 bp, Mus musculus
tgtcgcagagatgaaccccaatgta

SEQ ID NO: 828320 - DNA, 25 bp, Mus musculus
tgtcgcagcgctcatcaagtcctga

SEQ ID NO: 828321 - DNA, 25 bp, Mus musculus
tgtcgcagcgctgatcaagtcctga

SEQ ID NO: 828322 - DNA, 25 bp, Mus musculus
tgtcgcagctgtatcccaagtaatg

SEQ ID NO: 828323 - DNA, 25 bp, Mus musculus
tgtcgcagctgtttcccaagtaatg

SEQ ID NO: 828324 - DNA, 25 bp, Mus musculus
tgtcgccatggtcactgcctcaaca

SEQ ID NO: 828325 - DNA, 25 bp, Mus musculus
tgtcgccatggtgactgcctcaaca

SEQ ID NO: 828326 - DNA, 25 bp, Mus musculus
tgtcgccgctcgatgcagtagccgc

SEQ ID NO: 828327 - DNA, 25 bp, Mus musculus
tgtcgccgctcgttgcagtagccgc

SEQ ID NO: 828328 - DNA, 25 bp, Mus musculus
tgtcgcctcatcacccgagagagct

SEQ ID NO: 828329 - DNA, 25 bp, Mus musculus
tgtcgcctcatctcccgagagagct

SEQ ID NO: 828330 - DNA, 25 bp, Mus musculus
tgtcgcctcctgaagaacatgagct

SEQ ID NO: 828331 - DNA, 25 bp, Mus musculus
tgtcgcctcctgtagaacatgagct

SEQ ID NO: 828332 - DNA, 25 bp, Mus musculus
tgtcgcctgcaaatcaggacgctca

SEQ ID NO: 828333 - DNA, 25 bp, Mus musculus
tgtcgcctgcaattcaggacgctca

SEQ ID NO: 828334 - DNA, 25 bp, Mus musculus
tgtcgcctgtatcgccaacaacagc

SEQ ID NO: 828335 - DNA, 25 bp, Mus musculus
tgtcgcctgtatggccaacaacagc

SEQ ID NO: 828336 - DNA, 25 bp, Mus musculus
tgtcgcctttagaaccttggccctg

SEQ ID NO: 828337 - DNA, 25 bp, Mus musculus
tgtcgcctttagtaccttggccctg

SEQ ID NO: 828338 - DNA, 25 bp, Mus musculus
tgtcgcctttgcacccggctcatag

SEQ ID NO: 828339 - DNA, 25 bp, Mus musculus
tgtcgcctttgcagaggaagcagat

SEQ ID NO: 828340 - DNA, 25 bp, Mus musculus
tgtcgcctttgctcccggctcatag

SEQ ID NO: 828341 - DNA, 25 bp, Mus musculus
tgtcgcctttgctgaggaagcagat

SEQ ID NO: 828342 - DNA, 25 bp, Mus musculus
tgtcgcgaaggcagccagtgcctgt

SEQ ID NO: 828343 - DNA, 25 bp, Mus musculus
tgtcgcgaaggctgccagtgcctgt

SEQ ID NO: 828344 - DNA, 25 bp, Mus musculus
tgtcgcgagcccctgtgggcacact

SEQ ID NO: 828345 - DNA, 25 bp, Mus musculus
tgtcgcgagcccgtgtgggcacact

SEQ ID NO: 828346 - DNA, 25 bp, Mus musculus
tgtcgcgcacagacttgactgacta

SEQ ID NO: 828347 - DNA, 25 bp, Mus musculus
tgtcgcgcacagtcttgactgacta

SEQ ID NO: 828348 - DNA, 25 bp, Mus musculus
tgtcgcggaacacgctgctccgcag

SEQ ID NO: 828349 - DNA, 25 bp, Mus musculus
tgtcgcggaacaggctgctccgcag

SEQ ID NO: 828350 - DNA, 25 bp, Mus musculus
tgtcgcggcacgagttcctcaccgg

SEQ ID NO: 828351 - DNA, 25 bp, Mus musculus
tgtcgcggcacgtgttcctcaccgg

SEQ ID NO: 828352 - DNA, 25 bp, Mus musculus
tgtcgcgtcctgctttaaggatgtc

SEQ ID NO: 828353 - DNA, 25 bp, Mus musculus
tgtcgcgtcctggtttaaggatgtc

SEQ ID NO: 828354 - DNA, 25 bp, Mus musculus
tgtcgctaaccaaggcgtctggaga

SEQ ID NO: 828355 - DNA, 25 bp, Mus musculus
tgtcgctaaccatggcgtctggaga

SEQ ID NO: 828356 - DNA, 25 bp, Mus musculus
tgtcgctacagaagaccacactgat

SEQ ID NO: 828357 - DNA, 25 bp, Mus musculus
tgtcgctacagatgaccacactgat

SEQ ID NO: 828358 - DNA, 25 bp, Mus musculus
tgtcgctatggacgcaggattgact

SEQ ID NO: 828359 - DNA, 25 bp, Mus musculus
tgtcgctatggaggcaggattgact

SEQ ID NO: 828360 - DNA, 25 bp, Mus musculus
tgtcgctcaaggctttcggccactt

SEQ ID NO: 828361 - DNA, 25 bp, Mus musculus
tgtcgctcaagggtttcggccactt

SEQ ID NO: 828362 - DNA, 25 bp, Mus musculus
tgtcgctcatccagggcctggtgta

SEQ ID NO: 828363 - DNA, 25 bp, Mus musculus
tgtcgctcatcctgggcctggtgta

SEQ ID NO: 828364 - DNA, 25 bp, Mus musculus
tgtcgctctgagaccgtggtacctg

SEQ ID NO: 828365 - DNA, 25 bp, Mus musculus
tgtcgctctgagtccgtggtacctg

SEQ ID NO: 828366 - DNA, 25 bp, Mus musculus
tgtcgctgatggaaacctaacggtg

SEQ ID NO: 828367 - DNA, 25 bp, Mus musculus
tgtcgctgatggtaacctaacggtg

SEQ ID NO: 828368 - DNA, 25 bp, Mus musculus
tgtcgctgcagacagggccacgacc

SEQ ID NO: 828369 - DNA, 25 bp, Mus musculus
tgtcgctgcagagagggccacgacc

SEQ ID NO: 828370 - DNA, 25 bp, Mus musculus
tgtcgctgcctaccttttgcctttc

SEQ ID NO: 828371 - DNA, 25 bp, Mus musculus
tgtcgctgcctagcttttgcctttc

SEQ ID NO: 828372 - DNA, 25 bp, Mus musculus
tgtcgctggatacaagtgcaactgt

SEQ ID NO: 828373 - DNA, 25 bp, Mus musculus
tgtcgctggatagaagtgcaactgt

SEQ ID NO: 828374 - DNA, 25 bp, Mus musculus
tgtcgctgggaacgtcatgcttgcc

SEQ ID NO: 828375 - DNA, 25 bp, Mus musculus
tgtcgctgggaaggtcatgcttgcc

SEQ ID NO: 828376 - DNA, 25 bp, Mus musculus
tgtcgctggtgactaagaactatga

SEQ ID NO: 828377 - DNA, 25 bp, Mus musculus
tgtcgctggtgagtaagaactatga

SEQ ID NO: 828378 - DNA, 25 bp, Mus musculus
tgtcgctgtcctagaaggcactccg

SEQ ID NO: 828379 - DNA, 25 bp, Mus musculus
tgtcgctgtccttgaaggcactccg

SEQ ID NO: 828380 - DNA, 25 bp, Mus musculus
tgtcggaaatcgaagccatccagga

SEQ ID NO: 828381 - DNA, 25 bp, Mus musculus
tgtcggaaatcgtagccatccagga

SEQ ID NO: 828382 - DNA, 25 bp, Mus musculus
tgtcggaacaggagaccgaagctgc

SEQ ID NO: 828383 - DNA, 25 bp, Mus musculus
tgtcggaacaggtgaccgaagctgc

SEQ ID NO: 828384 - DNA, 25 bp, Mus musculus
tgtcggacaacgaccacctggtgtg

SEQ ID NO: 828385 - DNA, 25 bp, Mus musculus
tgtcggacaacgtccacctggtgtg

SEQ ID NO: 828386 - DNA, 25 bp, Mus musculus
tgtcggacacaacctgctgctggtc

SEQ ID NO: 828387 - DNA, 25 bp, Mus musculus
tgtcggacacaagctgctgctggtc

SEQ ID NO: 828388 - DNA, 25 bp, Mus musculus
tgtcggacctggaatctgagatgga

SEQ ID NO: 828389 - DNA, 25 bp, Mus musculus
tgtcggacctggtatctgagatgga

SEQ ID NO: 828390 - DNA, 25 bp, Mus musculus
tgtcggacgcttccagctgatccag

SEQ ID NO: 828391 - DNA, 25 bp, Mus musculus
tgtcggacgcttgcagctgatccag

SEQ ID NO: 828392 - DNA, 25 bp, Mus musculus
tgtcggatgacgagcagcccttgaa

SEQ ID NO: 828393 - DNA, 25 bp, Mus musculus
tgtcggatgacgtgcagcccttgaa

SEQ ID NO: 828394 - DNA, 25 bp, Mus musculus
tgtcggcacagtaaccaaaaccgag

SEQ ID NO: 828395 - DNA, 25 bp, Mus musculus
tgtcggcacagttaccaaaaccgag

SEQ ID NO: 828396 - DNA, 25 bp, Mus musculus
tgtcggcactccaagtttcaacaga

SEQ ID NO: 828397 - DNA, 25 bp, Mus musculus
tgtcggcactcctagtttcaacaga

SEQ ID NO: 828398 - DNA, 25 bp, Mus musculus
tgtcggcagtacatcgaggcctctg

SEQ ID NO: 828399 - DNA, 25 bp, Mus musculus
tgtcggcagtacttcgaggcctctg

SEQ ID NO: 828400 - DNA, 25 bp, Mus musculus
tgtcggccgcctagaacctgaaggg

SEQ ID NO: 828401 - DNA, 25 bp, Mus musculus
tgtcggccgccttgaacctgaaggg

SEQ ID NO: 828402 - DNA, 25 bp, Mus musculus
tgtcggccgcgtacattccattcgg

SEQ ID NO: 828403 - DNA, 25 bp, Mus musculus
tgtcggccgcgttcattccattcgg

SEQ ID NO: 828404 - DNA, 25 bp, Mus musculus
tgtcggccgtgtagaccgcggttct

SEQ ID NO: 828405 - DNA, 25 bp, Mus musculus
tgtcggccgtgttgaccgcggttct

SEQ ID NO: 828406 - DNA, 25 bp, Mus musculus
tgtcggcgacccagcaaggcaggct

SEQ ID NO: 828407 - DNA, 25 bp, Mus musculus
tgtcggcgaccctgcaaggcaggct

SEQ ID NO: 828408 - DNA, 25 bp, Mus musculus
tgtcggctcactcataggctgtcac

SEQ ID NO: 828409 - DNA, 25 bp, Mus musculus
tgtcggctcactgataggctgtcac

SEQ ID NO: 828410 - DNA, 25 bp, Mus musculus
tgtcggctcagtaggacgattccat

SEQ ID NO: 828411 - DNA, 25 bp, Mus musculus
tgtcggctcagttggacgattccat

SEQ ID NO: 828412 - DNA, 25 bp, Mus musculus
tgtcggctgccaacctgctcatcgt

SEQ ID NO: 828413 - DNA, 25 bp, Mus musculus
tgtcggctgccatcctgctcatcgt

SEQ ID NO: 828414 - DNA, 25 bp, Mus musculus
tgtcggcttcccagtgggcgacagc

SEQ ID NO: 828415 - DNA, 25 bp, Mus musculus
tgtcggcttccctgtgggcgacagc

SEQ ID NO: 828416 - DNA, 25 bp, Mus musculus
tgtcgggctactcacagcttctcag

SEQ ID NO: 828417 - DNA, 25 bp, Mus musculus
tgtcgggctactgacagcttctcag

SEQ ID NO: 828418 - DNA, 25 bp, Mus musculus
tgtcgggctccgactcctgcagctt

SEQ ID NO: 828419 - DNA, 25 bp, Mus musculus
tgtcgggctccgtctcctgcagctt

SEQ ID NO: 828420 - DNA, 25 bp, Mus musculus
tgtcggggctgcaactgtctttggc

SEQ ID NO: 828421 - DNA, 25 bp, Mus musculus
tgtcggggctgctactgtctttggc

SEQ ID NO: 828422 - DNA, 25 bp, Mus musculus
tgtcgggtcgcgctgtctcccagca

SEQ ID NO: 828423 - DNA, 25 bp, Mus musculus
tgtcgggtcgcggtgtctcccagca

SEQ ID NO: 828424 - DNA, 25 bp, Mus musculus
tgtcgggtgtaccactctagcctgc

SEQ ID NO: 828425 - DNA, 25 bp, Mus musculus
tgtcgggtgtacgactctagcctgc

SEQ ID NO: 828426 - DNA, 25 bp, Mus musculus
tgtcggtacctcaccaaggtcttgg

SEQ ID NO: 828427 - DNA, 25 bp, Mus musculus
tgtcggtacctctccaaggtcttgg

SEQ ID NO: 828428 - DNA, 25 bp, Mus musculus
tgtcggtgacccagtccactgtggc

SEQ ID NO: 828429 - DNA, 25 bp, Mus musculus
tgtcggtgaccctgtccactgtggc

SEQ ID NO: 828430 - DNA, 25 bp, Mus musculus
tgtcggtgacgtccactacaaggag

SEQ ID NO: 828431 - DNA, 25 bp, Mus musculus
tgtcggtgacgtgcactacaaggag

SEQ ID NO: 828432 - DNA, 25 bp, Mus musculus
tgtcgtaagaggacagacaaatgtg

SEQ ID NO: 828433 - DNA, 25 bp, Mus musculus
tgtcgtaagaggtcagacaaatgtg

SEQ ID NO: 828434 - DNA, 25 bp, Mus musculus
tgtcgtaggcatccccgtgaccgaa

SEQ ID NO: 828435 - DNA, 25 bp, Mus musculus
tgtcgtaggcatgcccgtgaccgaa

SEQ ID NO: 828436 - DNA, 25 bp, Mus musculus
tgtcgtatagacaagaagacttatc

SEQ ID NO: 828437 - DNA, 25 bp, Mus musculus
tgtcgtatagactagaagacttatc

SEQ ID NO: 828438 - DNA, 25 bp, Mus musculus
tgtcgtatgtgacagatgcccctga

SEQ ID NO: 828439 - DNA, 25 bp, Mus musculus
tgtcgtatgtgagagatgcccctga

SEQ ID NO: 828440 - DNA, 25 bp, Mus musculus
tgtcgtcaccgtcaggacaagtgta

SEQ ID NO: 828441 - DNA, 25 bp, Mus musculus
tgtcgtcaccgtgaggacaagtgta

SEQ ID NO: 828442 - DNA, 25 bp, Mus musculus
tgtcgtcacctgcaccctgcttagg

SEQ ID NO: 828443 - DNA, 25 bp, Mus musculus
tgtcgtcacctggaccctgcttagg

SEQ ID NO: 828444 - DNA, 25 bp, Mus musculus
tgtcgtcatggacaccatcgctgtg

SEQ ID NO: 828445 - DNA, 25 bp, Mus musculus
tgtcgtcatggagaccatcgctgtg

SEQ ID NO: 828446 - DNA, 25 bp, Mus musculus
tgtcgtcatgtacctctactatgga

SEQ ID NO: 828447 - DNA, 25 bp, Mus musculus
tgtcgtcatgtagctctactatgga

SEQ ID NO: 828448 - DNA, 25 bp, Mus musculus
tgtcgtccaccaacgagtgaggaag

SEQ ID NO: 828449 - DNA, 25 bp, Mus musculus
tgtcgtccaccatcgagtgaggaag

SEQ ID NO: 828450 - DNA, 25 bp, Mus musculus
tgtcgtccgtgtctaacagtgcgcc

SEQ ID NO: 828451 - DNA, 25 bp, Mus musculus
tgtcgtccgtgtgtaacagtgcgcc

SEQ ID NO: 828452 - DNA, 25 bp, Mus musculus
tgtcgtcgctacatattctgcattt

SEQ ID NO: 828453 - DNA, 25 bp, Mus musculus
tgtcgtcgctacttattctgcattt

SEQ ID NO: 828454 - DNA, 25 bp, Mus musculus
tgtcgtctatggacgaagtgtctgg

SEQ ID NO: 828455 - DNA, 25 bp, Mus musculus
tgtcgtctatggtcgaagtgtctgg

SEQ ID NO: 828456 - DNA, 25 bp, Mus musculus
tgtcgtctctcgcagcctcctttgt

SEQ ID NO: 828457 - DNA, 25 bp, Mus musculus
tgtcgtctctcggagcctcctttgt

SEQ ID NO: 828458 - DNA, 25 bp, Mus musculus
tgtcgtcttgggaaaagaagacctt

SEQ ID NO: 828459 - DNA, 25 bp, Mus musculus
tgtcgtcttgggtaaagaagacctt

SEQ ID NO: 828460 - DNA, 25 bp, Mus musculus
tgtcgtctttcacaaaggccttcac

SEQ ID NO: 828461 - DNA, 25 bp, Mus musculus
tgtcgtctttcagaaaggccttcac

SEQ ID NO: 828462 - DNA, 25 bp, Mus musculus
tgtcgtgaatcaccccaacatggac

SEQ ID NO: 828463 - DNA, 25 bp, Mus musculus
tgtcgtgaatcagcccaacatggac

SEQ ID NO: 828464 - DNA, 25 bp, Mus musculus
tgtcgtgaccctcattgggatgagt

SEQ ID NO: 828465 - DNA, 25 bp, Mus musculus
tgtcgtgaccctgattgggatgagt

SEQ ID NO: 828466 - DNA, 25 bp, Mus musculus
tgtcgtgtatgaaagaagctgatgc

SEQ ID NO: 828467 - DNA, 25 bp, Mus musculus
tgtcgtgtatgatagaagctgatgc

SEQ ID NO: 828468 - DNA, 25 bp, Mus musculus
tgtcgtgtcaccctttctgcaggca

SEQ ID NO: 828469 - DNA, 25 bp, Mus musculus
tgtcgtgtcaccgtttctgcaggca

SEQ ID NO: 828470 - DNA, 25 bp, Mus musculus
tgtcgtgtcatgcacatacatctca

SEQ ID NO: 828471 - DNA, 25 bp, Mus musculus
tgtcgtgtcatggacatacatctca

SEQ ID NO: 828472 - DNA, 25 bp, Mus musculus
tgtcgtgtgaccagatgtccctccc

SEQ ID NO: 828473 - DNA, 25 bp, Mus musculus
tgtcgtgtgacctgatgtccctccc

SEQ ID NO: 828474 - DNA, 25 bp, Mus musculus
tgtcgttaaactatcccagctctgg

SEQ ID NO: 828475 - DNA, 25 bp, Mus musculus
tgtcgttaaactttcccagctctgg

SEQ ID NO: 828476 - DNA, 25 bp, Mus musculus
tgtcgttaccaaatccgccaagaaa

SEQ ID NO: 828477 - DNA, 25 bp, Mus musculus
tgtcgttaccaattccgccaagaaa

SEQ ID NO: 828478 - DNA, 25 bp, Mus musculus
tgtcgttagtaaataatcatgttga

SEQ ID NO: 828479 - DNA, 25 bp, Mus musculus
tgtcgttagtaattaatcatgttga

SEQ ID NO: 828480 - DNA, 25 bp, Mus musculus
tgtcgttcccctcacaaggaaacat

SEQ ID NO: 828481 - DNA, 25 bp, Mus musculus
tgtcgttcccctgacaaggaaacat

SEQ ID NO: 828482 - DNA, 25 bp, Mus musculus
tgtcgttgccagagccagggttatg

SEQ ID NO: 828483 - DNA, 25 bp, Mus musculus
tgtcgttgccagtgccagggttatg

SEQ ID NO: 828484 - DNA, 25 bp, Mus musculus
tgtcgttgccgacctggctttgcgc

SEQ ID NO: 828485 - DNA, 25 bp, Mus musculus
tgtcgttgccgagctggctttgcgc

SEQ ID NO: 828486 - DNA, 25 bp, Mus musculus
tgtcgttgttgcagcgctctctctt

SEQ ID NO: 828487 - DNA, 25 bp, Mus musculus
tgtcgttgttgctgcgctctctctt

SEQ ID NO: 828488 - DNA, 25 bp, Mus musculus
tgtcgtttcatccacggctccaagg

SEQ ID NO: 828489 - DNA, 25 bp, Mus musculus
tgtcgtttcatcgacggctccaagg

SEQ ID NO: 828490 - DNA, 25 bp, Mus musculus
tgtcgtttcccactaaaagcctgag

SEQ ID NO: 828491 - DNA, 25 bp, Mus musculus
tgtcgtttcccagtaaaagcctgag

SEQ ID NO: 828492 - DNA, 25 bp, Mus musculus
tgtcgtttgcgaattccatcgtctt

SEQ ID NO: 828493 - DNA, 25 bp, Mus musculus
tgtcgtttgcgatttccatcgtctt

SEQ ID NO: 828494 - DNA, 25 bp, Mus musculus
tgtcgtttggtcactttaaagccgc

SEQ ID NO: 828495 - DNA, 25 bp, Mus musculus
tgtcgtttggtctctttaaagccgc

SEQ ID NO: 828496 - DNA, 25 bp, Mus musculus
tgtctaaacagacgcttcagtcggc

SEQ ID NO: 828497 - DNA, 25 bp, Mus musculus
tgtctaaacagaggcttcagtcggc

SEQ ID NO: 828498 - DNA, 25 bp, Mus musculus
tgtctaaaccaacagatgcttatta

SEQ ID NO: 828499 - DNA, 25 bp, Mus musculus
tgtctaaaccaagagatgcttatta

SEQ ID NO: 828500 - DNA, 25 bp, Mus musculus
tgtctaaagggccaagttctggatg

SEQ ID NO: 828501 - DNA, 25 bp, Mus musculus
tgtctaaagggcgaagttctggatg

SEQ ID NO: 828502 - DNA, 25 bp, Mus musculus
tgtctaaagttcaccactagctgac

SEQ ID NO: 828503 - DNA, 25 bp, Mus musculus
tgtctaaagttctccactagctgac

SEQ ID NO: 828504 - DNA, 25 bp, Mus musculus
tgtctaacaaaacgtctcccagaga

SEQ ID NO: 828505 - DNA, 25 bp, Mus musculus
tgtctaacaaaaggtctcccagaga

SEQ ID NO: 828506 - DNA, 25 bp, Mus musculus
tgtctaacaagacgaatggcatcga

SEQ ID NO: 828507 - DNA, 25 bp, Mus musculus
tgtctaacaagaggaatggcatcga

SEQ ID NO: 828508 - DNA, 25 bp, Mus musculus
tgtctaacccctccgaaacagaatc

SEQ ID NO: 828509 - DNA, 25 bp, Mus musculus
tgtctaacccctgcgaaacagaatc

SEQ ID NO: 828510 - DNA, 25 bp, Mus musculus
tgtctaaccctgaaatgatggtcca

SEQ ID NO: 828511 - DNA, 25 bp, Mus musculus
tgtctaaccctgtaatgatggtcca

SEQ ID NO: 828512 - DNA, 25 bp, Mus musculus
tgtctaacctaccaccccagagtga

SEQ ID NO: 828513 - DNA, 25 bp, Mus musculus
tgtctaacctacgaccccagagtga

SEQ ID NO: 828514 - DNA, 25 bp, Mus musculus
tgtctaacgaccacacacagcagga

SEQ ID NO: 828515 - DNA, 25 bp, Mus musculus
tgtctaacgacctcacacagcagga

SEQ ID NO: 828516 - DNA, 25 bp, Mus musculus
tgtctacaaaaacggacgattccgg

SEQ ID NO: 828517 - DNA, 25 bp, Mus musculus
tgtctacaaaaagggacgattccgg

SEQ ID NO: 828518 - DNA, 25 bp, Mus musculus
tgtctacaaccacagctctgggcgc

SEQ ID NO: 828519 - DNA, 25 bp, Mus musculus
tgtctacaaccagagctctgggcgc

SEQ ID NO: 828520 - DNA, 25 bp, Mus musculus
tgtctacaaggtcgccgagtacgcc

SEQ ID NO: 828521 - DNA, 25 bp, Mus musculus
tgtctacaaggtggccgagtacgcc

SEQ ID NO: 828522 - DNA, 25 bp, Mus musculus
tgtctacacgaacagcgcagagttt

SEQ ID NO: 828523 - DNA, 25 bp, Mus musculus
tgtctacacgaagagcgcagagttt

SEQ ID NO: 828524 - DNA, 25 bp, Mus musculus
tgtctacagaaactgctaatagctt

SEQ ID NO: 828525 - DNA, 25 bp, Mus musculus
tgtctacagaaagtgctaatagctt

SEQ ID NO: 828526 - DNA, 25 bp, Mus musculus
tgtctacagcaaaggccgaatgcgg

SEQ ID NO: 828527 - DNA, 25 bp, Mus musculus
tgtctacagcaatggccgaatgcgg

SEQ ID NO: 828528 - DNA, 25 bp, Mus musculus
tgtctacagcatcctgcatgtcggg

SEQ ID NO: 828529 - DNA, 25 bp, Mus musculus
tgtctacagcatgctgcatgtcggg

SEQ ID NO: 828530 - DNA, 25 bp, Mus musculus
tgtctacaggaacttcaagaagatc

SEQ ID NO: 828531 - DNA, 25 bp, Mus musculus
tgtctacaggaagttcaagaagatc

SEQ ID NO: 828532 - DNA, 25 bp, Mus musculus
tgtctacaggatctgggaacactgg

SEQ ID NO: 828533 - DNA, 25 bp, Mus musculus
tgtctacaggatgtgggaacactgg

SEQ ID NO: 828534 - DNA, 25 bp, Mus musculus
tgtctacagtgaccctgttttctcc

SEQ ID NO: 828535 - DNA, 25 bp, Mus musculus
tgtctacagtgagcctgttttctcc

SEQ ID NO: 828536 - DNA, 25 bp, Mus musculus
tgtctacagtggaccaggagagccc

SEQ ID NO: 828537 - DNA, 25 bp, Mus musculus
tgtctacagtggtccaggagagccc

SEQ ID NO: 828538 - DNA, 25 bp, Mus musculus
tgtctaccaagaactgacccagttg

SEQ ID NO: 828539 - DNA, 25 bp, Mus musculus
tgtctaccaagatctgacccagttg

SEQ ID NO: 828540 - DNA, 25 bp, Mus musculus
tgtctaccaagcactgctctcgggc

SEQ ID NO: 828541 - DNA, 25 bp, Mus musculus
tgtctaccaagctctgctctcgggc

SEQ ID NO: 828542 - DNA, 25 bp, Mus musculus
tgtctacctggcaacggtacacctg

SEQ ID NO: 828543 - DNA, 25 bp, Mus musculus
tgtctacctggctacggtacacctg

SEQ ID NO: 828544 - DNA, 25 bp, Mus musculus
tgtctacgacaaattcactagttgc

SEQ ID NO: 828545 - DNA, 25 bp, Mus musculus
tgtctacgacaatttcactagttgc

SEQ ID NO: 828546 - DNA, 25 bp, Mus musculus
tgtctacgaggccattccggacttg

SEQ ID NO: 828547 - DNA, 25 bp, Mus musculus
tgtctacgaggcgattccggacttg

SEQ ID NO: 828548 - DNA, 25 bp, Mus musculus
tgtctacggtcaacagacagtgttc

SEQ ID NO: 828549 - DNA, 25 bp, Mus musculus
tgtctacggtcatcagacagtgttc

SEQ ID NO: 828550 - DNA, 25 bp, Mus musculus
tgtctactaattaaacaacacggag

SEQ ID NO: 828551 - DNA, 25 bp, Mus musculus
tgtctactaatttaacaacacggag

SEQ ID NO: 828552 - DNA, 25 bp, Mus musculus
tgtctactggacagcacctgcaatt

SEQ ID NO: 828553 - DNA, 25 bp, Mus musculus
tgtctactggactgcacctgcaatt

SEQ ID NO: 828554 - DNA, 25 bp, Mus musculus
tgtctactggttccccatcttcacg

SEQ ID NO: 828555 - DNA, 25 bp, Mus musculus
tgtctactggttgcccatcttcacg

SEQ ID NO: 828556 - DNA, 25 bp, Mus musculus
tgtctactgtctacattccgggctg

SEQ ID NO: 828557 - DNA, 25 bp, Mus musculus
tgtctactgtcttcattccgggctg

SEQ ID NO: 828558 - DNA, 25 bp, Mus musculus
tgtctacttactcatggtcacaatg

SEQ ID NO: 828559 - DNA, 25 bp, Mus musculus
tgtctacttactgatggtcacaatg

SEQ ID NO: 828560 - DNA, 25 bp, Mus musculus
tgtctacttcatctatgaagccctg

SEQ ID NO: 828561 - DNA, 25 bp, Mus musculus
tgtctacttcatgtatgaagccctg

SEQ ID NO: 828562 - DNA, 25 bp, Mus musculus
tgtctagaaggcaggactgaggcca

SEQ ID NO: 828563 - DNA, 25 bp, Mus musculus
tgtctagaaggctggactgaggcca

SEQ ID NO: 828564 - DNA, 25 bp, Mus musculus
tgtctagacccactcctgagcagag

SEQ ID NO: 828565 - DNA, 25 bp, Mus musculus
tgtctagacccagtcctgagcagag

SEQ ID NO: 828566 - DNA, 25 bp, Mus musculus
tgtctagagctgatgctgcgctgcg

SEQ ID NO: 828567 - DNA, 25 bp, Mus musculus
tgtctagagctgttgctgcgctgcg

SEQ ID NO: 828568 - DNA, 25 bp, Mus musculus
tgtctagatgatctcgcaaccacag

SEQ ID NO: 828569 - DNA, 25 bp, Mus musculus
tgtctagatgatgtcgcaaccacag

SEQ ID NO: 828570 - DNA, 25 bp, Mus musculus
tgtctagattggctgaaataatttc

SEQ ID NO: 828571 - DNA, 25 bp, Mus musculus
tgtctagattgggtgaaataatttc

SEQ ID NO: 828572 - DNA, 25 bp, Mus musculus
tgtctagcaaatcgaaaaagtgcaa

SEQ ID NO: 828573 - DNA, 25 bp, Mus musculus
tgtctagcaaatggaaaaagtgcaa

SEQ ID NO: 828574 - DNA, 25 bp, Mus musculus
tgtctagcaagaacaagtatatatc

SEQ ID NO: 828575 - DNA, 25 bp, Mus musculus
tgtctagcaagatcaagtatatatc

SEQ ID NO: 828576 - DNA, 25 bp, Mus musculus
tgtctagccaccaggctgtgtacgg

SEQ ID NO: 828577 - DNA, 25 bp, Mus musculus
tgtctagccacctggctgtgtacgg

SEQ ID NO: 828578 - DNA, 25 bp, Mus musculus
tgtctagcgtacagcacaacagtgc

SEQ ID NO: 828579 - DNA, 25 bp, Mus musculus
tgtctagcgtactgcacaacagtgc

SEQ ID NO: 828580 - DNA, 25 bp, Mus musculus
tgtctagcgtttcacagaagcttgc

SEQ ID NO: 828581 - DNA, 25 bp, Mus musculus
tgtctagcgtttgacagaagcttgc

SEQ ID NO: 828582 - DNA, 25 bp, Mus musculus
tgtctaggacctcgcaacagcagtc

SEQ ID NO: 828583 - DNA, 25 bp, Mus musculus
tgtctaggacctggcaacagcagtc

SEQ ID NO: 828584 - DNA, 25 bp, Mus musculus
tgtctaggacggagctacagctgca

SEQ ID NO: 828585 - DNA, 25 bp, Mus musculus
tgtctaggacggtgctacagctgca

SEQ ID NO: 828586 - DNA, 25 bp, Mus musculus
tgtctaggagcaaggtacatcagga

SEQ ID NO: 828587 - DNA, 25 bp, Mus musculus
tgtctaggagcatggtacatcagga

SEQ ID NO: 828588 - DNA, 25 bp, Mus musculus
tgtctaggagctcgcatgatgtgca

SEQ ID NO: 828589 - DNA, 25 bp, Mus musculus
tgtctaggagctggcatgatgtgca

SEQ ID NO: 828590 - DNA, 25 bp, Mus musculus
tgtctaggccacaccccaggaactt

SEQ ID NO: 828591 - DNA, 25 bp, Mus musculus
tgtctaggccactccccaggaactt

SEQ ID NO: 828592 - DNA, 25 bp, Mus musculus
tgtctagtcaaacgagcagatctca

SEQ ID NO: 828593 - DNA, 25 bp, Mus musculus
tgtctagtcaaaggagcagatctca

SEQ ID NO: 828594 - DNA, 25 bp, Mus musculus
tgtctagtgacaatgccagagcaga

SEQ ID NO: 828595 - DNA, 25 bp, Mus musculus
tgtctagtgacattgccagagcaga

SEQ ID NO: 828596 - DNA, 25 bp, Mus musculus
tgtctataagagagtaatcgccaac

SEQ ID NO: 828597 - DNA, 25 bp, Mus musculus
tgtctataagagtgtaatcgccaac

SEQ ID NO: 828598 - DNA, 25 bp, Mus musculus
tgtctataatccagcagccattgct

SEQ ID NO: 828599 - DNA, 25 bp, Mus musculus
tgtctataatcctgcagccattgct

SEQ ID NO: 828600 - DNA, 25 bp, Mus musculus
tgtctataccacattatctggagga

SEQ ID NO: 828601 - DNA, 25 bp, Mus musculus
tgtctataccactttatctggagga

SEQ ID NO: 828602 - DNA, 25 bp, Mus musculus
tgtctatagagaaacagacccatcc

SEQ ID NO: 828603 - DNA, 25 bp, Mus musculus
tgtctatagagatacagacccatcc

SEQ ID NO: 828604 - DNA, 25 bp, Mus musculus
tgtctatatagcagaattgctggct

SEQ ID NO: 828605 - DNA, 25 bp, Mus musculus
tgtctatatagctgaattgctggct

SEQ ID NO: 828606 - DNA, 25 bp, Mus musculus
tgtctatatcacctccaaatgctgt

SEQ ID NO: 828607 - DNA, 25 bp, Mus musculus
tgtctatatcacgtccaaatgctgt

SEQ ID NO: 828608 - DNA, 25 bp, Mus musculus
tgtctatcaaggcagtgtgtgccaa

SEQ ID NO: 828609 - DNA, 25 bp, Mus musculus
tgtctatcaagggagtgtgtgccaa

SEQ ID NO: 828610 - DNA, 25 bp, Mus musculus
tgtctatccactcctacgtcagggc

SEQ ID NO: 828611 - DNA, 25 bp, Mus musculus
tgtctatccactgctacgtcagggc

SEQ ID NO: 828612 - DNA, 25 bp, Mus musculus
tgtctatccataaacccaggctggc

SEQ ID NO: 828613 - DNA, 25 bp, Mus musculus
tgtctatccatatacccaggctggc

SEQ ID NO: 828614 - DNA, 25 bp, Mus musculus
tgtctatgagcactcatgtgaagcc

SEQ ID NO: 828615 - DNA, 25 bp, Mus musculus
tgtctatgagcagtcatgtgaagcc

SEQ ID NO: 828616 - DNA, 25 bp, Mus musculus
tgtctatgagctaaagcaccccaga

SEQ ID NO: 828617 - DNA, 25 bp, Mus musculus
tgtctatgagctccaggtcccatct

SEQ ID NO: 828618 - DNA, 25 bp, Mus musculus
tgtctatgagctgcaggtcccatct

SEQ ID NO: 828619 - DNA, 25 bp, Mus musculus
tgtctatgagcttaagcaccccaga

SEQ ID NO: 828620 - DNA, 25 bp, Mus musculus
tgtctatgccctcccaaattcaacg

SEQ ID NO: 828621 - DNA, 25 bp, Mus musculus
tgtctatgccctgccaaattcaacg

SEQ ID NO: 828622 - DNA, 25 bp, Mus musculus
tgtctatgctccagaatatttaacc

SEQ ID NO: 828623 - DNA, 25 bp, Mus musculus
tgtctatgctcctgaatatttaacc

SEQ ID NO: 828624 - DNA, 25 bp, Mus musculus
tgtctatgctgtcccctcgccttac

SEQ ID NO: 828625 - DNA, 25 bp, Mus musculus
tgtctatgctgtctgccattctcgt

SEQ ID NO: 828626 - DNA, 25 bp, Mus musculus
tgtctatgctgtgccctcgccttac

SEQ ID NO: 828627 - DNA, 25 bp, Mus musculus
tgtctatgctgtgtgccattctcgt

SEQ ID NO: 828628 - DNA, 25 bp, Mus musculus
tgtctatggttgctacgtggtcagc

SEQ ID NO: 828629 - DNA, 25 bp, Mus musculus
tgtctatggttggtacgtggtcagc

SEQ ID NO: 828630 - DNA, 25 bp, Mus musculus
tgtctatgtagcagatgtaacagct

SEQ ID NO: 828631 - DNA, 25 bp, Mus musculus
tgtctatgtagctgatgtaacagct

SEQ ID NO: 828632 - DNA, 25 bp, Mus musculus
tgtctatgttgtctctccctacagg

SEQ ID NO: 828633 - DNA, 25 bp, Mus musculus
tgtctatgttgtgtctccctacagg

SEQ ID NO: 828634 - DNA, 25 bp, Mus musculus
tgtctatgtttgctcctcactgctt

SEQ ID NO: 828635 - DNA, 25 bp, Mus musculus
tgtctatgtttggtcctcactgctt

SEQ ID NO: 828636 - DNA, 25 bp, Mus musculus
tgtctattcaggactggaccaggaa

SEQ ID NO: 828637 - DNA, 25 bp, Mus musculus
tgtctattcaggatctcaccgtcaa

SEQ ID NO: 828638 - DNA, 25 bp, Mus musculus
tgtctattcaggtctggaccaggaa

SEQ ID NO: 828639 - DNA, 25 bp, Mus musculus
tgtctattcaggttctcaccgtcaa

SEQ ID NO: 828640 - DNA, 25 bp, Mus musculus
tgtctattcataacaggcatggtaa

SEQ ID NO: 828641 - DNA, 25 bp, Mus musculus
tgtctattcatatcaggcatggtaa

SEQ ID NO: 828642 - DNA, 25 bp, Mus musculus
tgtctcaaaccacgtgaaaaagtca

SEQ ID NO: 828643 - DNA, 25 bp, Mus musculus
tgtctcaaaccaggtgaaaaagtca

SEQ ID NO: 828644 - DNA, 25 bp, Mus musculus
tgtctcaacacaagttctgagcaaa

SEQ ID NO: 828645 - DNA, 25 bp, Mus musculus
tgtctcaacacatgttctgagcaaa

SEQ ID NO: 828646 - DNA, 25 bp, Mus musculus
tgtctcaaccgacagaggccagcgc

SEQ ID NO: 828647 - DNA, 25 bp, Mus musculus
tgtctcaaccgagagaggccagcgc

SEQ ID NO: 828648 - DNA, 25 bp, Mus musculus
tgtctcaatccaaagaagtcttgga

SEQ ID NO: 828649 - DNA, 25 bp, Mus musculus
tgtctcaatccatagaagtcttgga

SEQ ID NO: 828650 - DNA, 25 bp, Mus musculus
tgtctcaatgtgattgatgtgcaga

SEQ ID NO: 828651 - DNA, 25 bp, Mus musculus
tgtctcaatgtgtttgatgtgcaga

SEQ ID NO: 828652 - DNA, 25 bp, Mus musculus
tgtctcaattttccctgaatcgcca

SEQ ID NO: 828653 - DNA, 25 bp, Mus musculus
tgtctcaattttgcctgaatcgcca

SEQ ID NO: 828654 - DNA, 25 bp, Mus musculus
tgtctcacaaaccagcacaattgtg

SEQ ID NO: 828655 - DNA, 25 bp, Mus musculus
tgtctcacaaacgagcacaattgtg

SEQ ID NO: 828656 - DNA, 25 bp, Mus musculus
tgtctcacctctaggtggcaaccac

SEQ ID NO: 828657 - DNA, 25 bp, Mus musculus
tgtctcacctcttggtggcaaccac

SEQ ID NO: 828658 - DNA, 25 bp, Mus musculus
tgtctcacttggagagcatggtcct

SEQ ID NO: 828659 - DNA, 25 bp, Mus musculus
tgtctcacttggtgagcatggtcct

SEQ ID NO: 828660 - DNA, 25 bp, Mus musculus
tgtctcagactccaagccgaggttc

SEQ ID NO: 828661 - DNA, 25 bp, Mus musculus
tgtctcagactcgaagccgaggttc

SEQ ID NO: 828662 - DNA, 25 bp, Mus musculus
tgtctcagatcaagaggctcctcag

SEQ ID NO: 828663 - DNA, 25 bp, Mus musculus
tgtctcagatcatgaggctcctcag

SEQ ID NO: 828664 - DNA, 25 bp, Mus musculus
tgtctcagcacacggaaacttgtat

SEQ ID NO: 828665 - DNA, 25 bp, Mus musculus
tgtctcagcacagggaaacttgtat

SEQ ID NO: 828666 - DNA, 25 bp, Mus musculus
tgtctcagcctcaggctcaagctgc

SEQ ID NO: 828667 - DNA, 25 bp, Mus musculus
tgtctcagcctctggctcaagctgc

SEQ ID NO: 828668 - DNA, 25 bp, Mus musculus
tgtctcagccttccttgtgctgggt

SEQ ID NO: 828669 - DNA, 25 bp, Mus musculus
tgtctcagccttgcttgtgctgggt

SEQ ID NO: 828670 - DNA, 25 bp, Mus musculus
tgtctcaggccaaggcgaagctgct

SEQ ID NO: 828671 - DNA, 25 bp, Mus musculus
tgtctcaggccatggcgaagctgct

SEQ ID NO: 828672 - DNA, 25 bp, Mus musculus
tgtctcaggcgactcattaccccag

SEQ ID NO: 828673 - DNA, 25 bp, Mus musculus
tgtctcaggcgagtcattaccccag

SEQ ID NO: 828674 - DNA, 25 bp, Mus musculus
tgtctcaggtggatacgcgtctgcc

SEQ ID NO: 828675 - DNA, 25 bp, Mus musculus
tgtctcaggtggttacgcgtctgcc

SEQ ID NO: 828676 - DNA, 25 bp, Mus musculus
tgtctcatctccacttgtccctggt

SEQ ID NO: 828677 - DNA, 25 bp, Mus musculus
tgtctcatctcctcttgtccctggt

SEQ ID NO: 828678 - DNA, 25 bp, Mus musculus
tgtctcatgtgtccctagctggttt

SEQ ID NO: 828679 - DNA, 25 bp, Mus musculus
tgtctcatgtgtgcctagctggttt

SEQ ID NO: 828680 - DNA, 25 bp, Mus musculus
tgtctcattcagagtaccgcatcca

SEQ ID NO: 828681 - DNA, 25 bp, Mus musculus
tgtctcattcagtgtaccgcatcca

SEQ ID NO: 828682 - DNA, 25 bp, Mus musculus
tgtctcatttgtcgaggccctcgaa

SEQ ID NO: 828683 - DNA, 25 bp, Mus musculus
tgtctcatttgtggaggccctcgaa

SEQ ID NO: 828684 - DNA, 25 bp, Mus musculus
tgtctccaaaggctatgtctttcag

SEQ ID NO: 828685 - DNA, 25 bp, Mus musculus
tgtctccaaagggtatgtctttcag

SEQ ID NO: 828686 - DNA, 25 bp, Mus musculus
tgtctccaaatacagtcccagagtt

SEQ ID NO: 828687 - DNA, 25 bp, Mus musculus
tgtctccaaatagagtcccagagtt

SEQ ID NO: 828688 - DNA, 25 bp, Mus musculus
tgtctccaacgacagtggcatctac

SEQ ID NO: 828689 - DNA, 25 bp, Mus musculus
tgtctccaacgagagtggcatctac

SEQ ID NO: 828690 - DNA, 25 bp, Mus musculus
tgtctccaagagctatgagtgcgcc

SEQ ID NO: 828691 - DNA, 25 bp, Mus musculus
tgtctccaagaggtatgagtgcgcc

SEQ ID NO: 828692 - DNA, 25 bp, Mus musculus
tgtctccaaggaaactgaaaaaacc

SEQ ID NO: 828693 - DNA, 25 bp, Mus musculus
tgtctccaaggacgatcccaaagcc

SEQ ID NO: 828694 - DNA, 25 bp, Mus musculus
tgtctccaaggaggatcccaaagcc

SEQ ID NO: 828695 - DNA, 25 bp, Mus musculus
tgtctccaaggatactgaaaaaacc

SEQ ID NO: 828696 - DNA, 25 bp, Mus musculus
tgtctccacggcaacggaagaagat

SEQ ID NO: 828697 - DNA, 25 bp, Mus musculus
tgtctccacggctacggaagaagat

SEQ ID NO: 828698 - DNA, 25 bp, Mus musculus
tgtctccactgcacttgttgctgct

SEQ ID NO: 828699 - DNA, 25 bp, Mus musculus
tgtctccactgctcttgttgctgct

SEQ ID NO: 828700 - DNA, 25 bp, Mus musculus
tgtctccagaccaccagtgaccttg

SEQ ID NO: 828701 - DNA, 25 bp, Mus musculus
tgtctccagacctccagtgaccttg

SEQ ID NO: 828702 - DNA, 25 bp, Mus musculus
tgtctccagagaagcaggcaagttg

SEQ ID NO: 828703 - DNA, 25 bp, Mus musculus
tgtctccagagatgcaggcaagttg

SEQ ID NO: 828704 - DNA, 25 bp, Mus musculus
tgtctccagcatcaggcttccagag

SEQ ID NO: 828705 - DNA, 25 bp, Mus musculus
tgtctccagcatgaggcttccagag

SEQ ID NO: 828706 - DNA, 25 bp, Mus musculus
tgtctccagtcgcaagggctctaac

SEQ ID NO: 828707 - DNA, 25 bp, Mus musculus
tgtctccagtcggaagggctctaac

SEQ ID NO: 828708 - DNA, 25 bp, Mus musculus
tgtctccatcgtcgccatatttggc

SEQ ID NO: 828709 - DNA, 25 bp, Mus musculus
tgtctccatcgtggccatatttggc

SEQ ID NO: 828710 - DNA, 25 bp, Mus musculus
tgtctccatgaacctaaaagcagaa

SEQ ID NO: 828711 - DNA, 25 bp, Mus musculus
tgtctccatgaagctaaaagcagaa

SEQ ID NO: 828712 - DNA, 25 bp, Mus musculus
tgtctcccaatacaggaatatgacc

SEQ ID NO: 828713 - DNA, 25 bp, Mus musculus
tgtctcccaatagaggaatatgacc

SEQ ID NO: 828714 - DNA, 25 bp, Mus musculus
tgtctcccagcgagggtaccaagaa

SEQ ID NO: 828715 - DNA, 25 bp, Mus musculus
tgtctcccagcgtgggtaccaagaa

SEQ ID NO: 828716 - DNA, 25 bp, Mus musculus
tgtctcccagttcggtgcagcagca

SEQ ID NO: 828717 - DNA, 25 bp, Mus musculus
tgtctcccagttctggccagctttg

SEQ ID NO: 828718 - DNA, 25 bp, Mus musculus
tgtctcccagttgggtgcagcagca

SEQ ID NO: 828719 - DNA, 25 bp, Mus musculus
tgtctcccagttgtggccagctttg

SEQ ID NO: 828720 - DNA, 25 bp, Mus musculus
tgtctcccctgaccactagctgaag

SEQ ID NO: 828721 - DNA, 25 bp, Mus musculus
tgtctcccctgagcactagctgaag

SEQ ID NO: 828722 - DNA, 25 bp, Mus musculus
tgtctccctgggagaccctctactg

SEQ ID NO: 828723 - DNA, 25 bp, Mus musculus
tgtctccctgggtgaccctctactg

SEQ ID NO: 828724 - DNA, 25 bp, Mus musculus
tgtctcccttaacggtgatggtgag

SEQ ID NO: 828725 - DNA, 25 bp, Mus musculus
tgtctcccttaagggtgatggtgag

SEQ ID NO: 828726 - DNA, 25 bp, Mus musculus
tgtctcccttgacccaggtacagtc

SEQ ID NO: 828727 - DNA, 25 bp, Mus musculus
tgtctcccttgagccaggtacagtc

SEQ ID NO: 828728 - DNA, 25 bp, Mus musculus
tgtctccgaagaacaagacagtgaa

SEQ ID NO: 828729 - DNA, 25 bp, Mus musculus
tgtctccgaagatcaagacagtgaa

SEQ ID NO: 828730 - DNA, 25 bp, Mus musculus
tgtctccgacgcattccacaaagca

SEQ ID NO: 828731 - DNA, 25 bp, Mus musculus
tgtctccgacgctttccacaaagca

SEQ ID NO: 828732 - DNA, 25 bp, Mus musculus
tgtctccgagtgagcggcaatgtgt

SEQ ID NO: 828733 - DNA, 25 bp, Mus musculus
tgtctccgagtgtgcggcaatgtgt

SEQ ID NO: 828734 - DNA, 25 bp, Mus musculus
tgtctccgccctcaaggcgaatgga

SEQ ID NO: 828735 - DNA, 25 bp, Mus musculus
tgtctccgccctgaaggcgaatgga

SEQ ID NO: 828736 - DNA, 25 bp, Mus musculus
tgtctccgctccaccaggatctttg

SEQ ID NO: 828737 - DNA, 25 bp, Mus musculus
tgtctccgctcctccaggatctttg

SEQ ID NO: 828738 - DNA, 25 bp, Mus musculus
tgtctccgggagcatgagcctctgt

SEQ ID NO: 828739 - DNA, 25 bp, Mus musculus
tgtctccgggaggatgagcctctgt

SEQ ID NO: 828740 - DNA, 25 bp, Mus musculus
tgtctccgggtaaagcccacctagt

SEQ ID NO: 828741 - DNA, 25 bp, Mus musculus
tgtctccgggtatagcccacctagt

SEQ ID NO: 828742 - DNA, 25 bp, Mus musculus
tgtctccgtgttcctctatggagga

SEQ ID NO: 828743 - DNA, 25 bp, Mus musculus
tgtctccgtgttgctctatggagga

SEQ ID NO: 828744 - DNA, 25 bp, Mus musculus
tgtctcctacagaaacactcagtat

SEQ ID NO: 828745 - DNA, 25 bp, Mus musculus
tgtctcctacagtaacactcagtat

SEQ ID NO: 828746 - DNA, 25 bp, Mus musculus
tgtctcctcggcactaatgatctgg

SEQ ID NO: 828747 - DNA, 25 bp, Mus musculus
tgtctcctcggctctaatgatctgg

SEQ ID NO: 828748 - DNA, 25 bp, Mus musculus
tgtctcctgacacagctgaccctga

SEQ ID NO: 828749 - DNA, 25 bp, Mus musculus
tgtctcctgacagagctgaccctga

SEQ ID NO: 828750 - DNA, 25 bp, Mus musculus
tgtctccttgaacaggtttatcccc

SEQ ID NO: 828751 - DNA, 25 bp, Mus musculus
tgtctccttgaagaggtttatcccc

SEQ ID NO: 828752 - DNA, 25 bp, Mus musculus
tgtctcgagggaagccacgagttct

SEQ ID NO: 828753 - DNA, 25 bp, Mus musculus
tgtctcgagggatgccacgagttct

SEQ ID NO: 828754 - DNA, 25 bp, Mus musculus
tgtctcggacccattctaccacagg

SEQ ID NO: 828755 - DNA, 25 bp, Mus musculus
tgtctcggaccctttctaccacagg

SEQ ID NO: 828756 - DNA, 25 bp, Mus musculus
tgtctcggatcgaatccctcactcg

SEQ ID NO: 828757 - DNA, 25 bp, Mus musculus
tgtctcggatcgtatccctcactcg

SEQ ID NO: 828758 - DNA, 25 bp, Mus musculus
tgtctcggcaagaacggcgtcttcg

SEQ ID NO: 828759 - DNA, 25 bp, Mus musculus
tgtctcggcaagtacggcgtcttcg

SEQ ID NO: 828760 - DNA, 25 bp, Mus musculus
tgtctcggctgcactggaggcgcct

SEQ ID NO: 828761 - DNA, 25 bp, Mus musculus
tgtctcggctgctctggaggcgcct

SEQ ID NO: 828762 - DNA, 25 bp, Mus musculus
tgtctcgggctactcagggcgaaca

SEQ ID NO: 828763 - DNA, 25 bp, Mus musculus
tgtctcgggctagtcagggcgaaca

SEQ ID NO: 828764 - DNA, 25 bp, Mus musculus
tgtctcgtcatgagactcaccctct

SEQ ID NO: 828765 - DNA, 25 bp, Mus musculus
tgtctcgtcatgtgactcaccctct

SEQ ID NO: 828766 - DNA, 25 bp, Mus musculus
tgtctcgtgtctccgctcaggcgat

SEQ ID NO: 828767 - DNA, 25 bp, Mus musculus
tgtctcgtgtctcgagtacgatgag

SEQ ID NO: 828768 - DNA, 25 bp, Mus musculus
tgtctcgtgtctgcgctcaggcgat

SEQ ID NO: 828769 - DNA, 25 bp, Mus musculus
tgtctcgtgtctggagtacgatgag

SEQ ID NO: 828770 - DNA, 25 bp, Mus musculus
tgtctctagacaaagtcgtgaccca

SEQ ID NO: 828771 - DNA, 25 bp, Mus musculus
tgtctctagacatagtcgtgaccca

SEQ ID NO: 828772 - DNA, 25 bp, Mus musculus
tgtctctaggacagggagcaggctt

SEQ ID NO: 828773 - DNA, 25 bp, Mus musculus
tgtctctaggactgggagcaggctt

SEQ ID NO: 828774 - DNA, 25 bp, Mus musculus
tgtctctagggtccagggccaaagt

SEQ ID NO: 828775 - DNA, 25 bp, Mus musculus
tgtctctagggtgcagggccaaagt

SEQ ID NO: 828776 - DNA, 25 bp, Mus musculus
tgtctctatccaacgctgtggcgag

SEQ ID NO: 828777 - DNA, 25 bp, Mus musculus
tgtctctatccatcgctgtggcgag

SEQ ID NO: 828778 - DNA, 25 bp, Mus musculus
tgtctctcatgacgtcagcacgcag

SEQ ID NO: 828779 - DNA, 25 bp, Mus musculus
tgtctctcatgaggtcagcacgcag

SEQ ID NO: 828780 - DNA, 25 bp, Mus musculus
tgtctctcattgaggtggcacagaa

SEQ ID NO: 828781 - DNA, 25 bp, Mus musculus
tgtctctcattgtggtggcacagaa

SEQ ID NO: 828782 - DNA, 25 bp, Mus musculus
tgtctctcctagatcaaccctgagg

SEQ ID NO: 828783 - DNA, 25 bp, Mus musculus
tgtctctcctagttcaaccctgagg

SEQ ID NO: 828784 - DNA, 25 bp, Mus musculus
tgtctctcgagtccggttcctgtcg

SEQ ID NO: 828785 - DNA, 25 bp, Mus musculus
tgtctctcgagtgcggttcctgtcg

SEQ ID NO: 828786 - DNA, 25 bp, Mus musculus
tgtctctcgggtagtctctgccatg

SEQ ID NO: 828787 - DNA, 25 bp, Mus musculus
tgtctctcgggttgtctctgccatg

SEQ ID NO: 828788 - DNA, 25 bp, Mus musculus
tgtctctcggtccaggaagcgcgct

SEQ ID NO: 828789 - DNA, 25 bp, Mus musculus
tgtctctcggtcgaggaagcgcgct

SEQ ID NO: 828790 - DNA, 25 bp, Mus musculus
tgtctctcgtacagcaggcttcgag

SEQ ID NO: 828791 - DNA, 25 bp, Mus musculus
tgtctctcgtactgcaggcttcgag

SEQ ID NO: 828792 - DNA, 25 bp, Mus musculus
tgtctctctcagcacactgggttcc

SEQ ID NO: 828793 - DNA, 25 bp, Mus musculus
tgtctctctcaggacactgggttcc

SEQ ID NO: 828794 - DNA, 25 bp, Mus musculus
tgtctctcttaaacattccttgtcc

SEQ ID NO: 828795 - DNA, 25 bp, Mus musculus
tgtctctcttaatcattccttgtcc

SEQ ID NO: 828796 - DNA, 25 bp, Mus musculus
tgtctctcttctcagcactgcaggc

SEQ ID NO: 828797 - DNA, 25 bp, Mus musculus
tgtctctcttctgagcactgcaggc

SEQ ID NO: 828798 - DNA, 25 bp, Mus musculus
tgtctctgaagaagtgccccatgat

SEQ ID NO: 828799 - DNA, 25 bp, Mus musculus
tgtctctgaagatgtgccccatgat

SEQ ID NO: 828800 - DNA, 25 bp, Mus musculus
tgtctctgaatgagagcaggtctcc

SEQ ID NO: 828801 - DNA, 25 bp, Mus musculus
tgtctctgaatgtgagcaggtctcc

SEQ ID NO: 828802 - DNA, 25 bp, Mus musculus
tgtctctgcagaccttggctccaga

SEQ ID NO: 828803 - DNA, 25 bp, Mus musculus
tgtctctgcagagcttggctccaga

SEQ ID NO: 828804 - DNA, 25 bp, Mus musculus
tgtctctgcaggagccagctgatga

SEQ ID NO: 828805 - DNA, 25 bp, Mus musculus
tgtctctgcaggtgccagctgatga

SEQ ID NO: 828806 - DNA, 25 bp, Mus musculus
tgtctctgccacaataaaggtttgc

SEQ ID NO: 828807 - DNA, 25 bp, Mus musculus
tgtctctgccactataaaggtttgc

SEQ ID NO: 828808 - DNA, 25 bp, Mus musculus
tgtctctgctacctgccctatgctg

SEQ ID NO: 828809 - DNA, 25 bp, Mus musculus
tgtctctgctacgtgccctatgctg

SEQ ID NO: 828810 - DNA, 25 bp, Mus musculus
tgtctctggacaaatcacctatgtg

SEQ ID NO: 828811 - DNA, 25 bp, Mus musculus
tgtctctggacatatcacctatgtg

SEQ ID NO: 828812 - DNA, 25 bp, Mus musculus
tgtctctggagcatggcaggctgct

SEQ ID NO: 828813 - DNA, 25 bp, Mus musculus
tgtctctggagcttggcaggctgct

SEQ ID NO: 828814 - DNA, 25 bp, Mus musculus
tgtctctgggccaaccttcaaggag

SEQ ID NO: 828815 - DNA, 25 bp, Mus musculus
tgtctctgggcctaccttcaaggag

SEQ ID NO: 828816 - DNA, 25 bp, Mus musculus
tgtctctgggttacaccatgcacaa

SEQ ID NO: 828817 - DNA, 25 bp, Mus musculus
tgtctctgggtttcaccatgcacaa

SEQ ID NO: 828818 - DNA, 25 bp, Mus musculus
tgtctctgtagtctcaggaggacaa

SEQ ID NO: 828819 - DNA, 25 bp, Mus musculus
tgtctctgtagtgtcaggaggacaa

SEQ ID NO: 828820 - DNA, 25 bp, Mus musculus
tgtctctgtcaaagatcacagtgcc

SEQ ID NO: 828821 - DNA, 25 bp, Mus musculus
tgtctctgtcaatgatcacagtgcc

SEQ ID NO: 828822 - DNA, 25 bp, Mus musculus
tgtctcttcaaactgcccagggtgg

SEQ ID NO: 828823 - DNA, 25 bp, Mus musculus
tgtctcttcaaagtgcccagggtgg

SEQ ID NO: 828824 - DNA, 25 bp, Mus musculus
tgtctcttcagacacccatgcctgg

SEQ ID NO: 828825 - DNA, 25 bp, Mus musculus
tgtctcttcagagacccatgcctgg

SEQ ID NO: 828826 - DNA, 25 bp, Mus musculus
tgtctcttctgcaggtcccggtcca

SEQ ID NO: 828827 - DNA, 25 bp, Mus musculus
tgtctcttctgctggtcccggtcca

SEQ ID NO: 828828 - DNA, 25 bp, Mus musculus
tgtctcttgggcagtgaattttacc

SEQ ID NO: 828829 - DNA, 25 bp, Mus musculus
tgtctcttgggctgtgaattttacc

SEQ ID NO: 828830 - DNA, 25 bp, Mus musculus
tgtctctttgacacgggagcagaag

SEQ ID NO: 828831 - DNA, 25 bp, Mus musculus
tgtctctttgactcgggagcagaag

SEQ ID NO: 828832 - DNA, 25 bp, Mus musculus
tgtctgaaagacatccacaaagaca

SEQ ID NO: 828833 - DNA, 25 bp, Mus musculus
tgtctgaaagacttccacaaagaca

SEQ ID NO: 828834 - DNA, 25 bp, Mus musculus
tgtctgaaagatcccaaagcagagt

SEQ ID NO: 828835 - DNA, 25 bp, Mus musculus
tgtctgaaagatgccaaagcagagt

SEQ ID NO: 828836 - DNA, 25 bp, Mus musculus
tgtctgaacacaccattgtccagga

SEQ ID NO: 828837 - DNA, 25 bp, Mus musculus
tgtctgaacacagcattgtccagga

SEQ ID NO: 828838 - DNA, 25 bp, Mus musculus
tgtctgaactatcccagcaaggtgc

SEQ ID NO: 828839 - DNA, 25 bp, Mus musculus
tgtctgaactatgccagcaaggtgc

SEQ ID NO: 828840 - DNA, 25 bp, Mus musculus
tgtctgaagaagaacagttccagga

SEQ ID NO: 828841 - DNA, 25 bp, Mus musculus
tgtctgaagaagtacagttccagga

SEQ ID NO: 828842 - DNA, 25 bp, Mus musculus
tgtctgaagacaacgtggccaaagt

SEQ ID NO: 828843 - DNA, 25 bp, Mus musculus
tgtctgaagacatcgtggccaaagt

SEQ ID NO: 828844 - DNA, 25 bp, Mus musculus
tgtctgaaggagcaatcgacatgca

SEQ ID NO: 828845 - DNA, 25 bp, Mus musculus
tgtctgaaggaggaatcgacatgca

SEQ ID NO: 828846 - DNA, 25 bp, Mus musculus
tgtctgaagtcaagcccaggatggt

SEQ ID NO: 828847 - DNA, 25 bp, Mus musculus
tgtctgaagtcatgcccaggatggt

SEQ ID NO: 828848 - DNA, 25 bp, Mus musculus
tgtctgacaccaagatagctgtcct

SEQ ID NO: 828849 - DNA, 25 bp, Mus musculus
tgtctgacaccatgatagctgtcct

SEQ ID NO: 828850 - DNA, 25 bp, Mus musculus
tgtctgaccgagagtccatgcccta

SEQ ID NO: 828851 - DNA, 25 bp, Mus musculus
tgtctgaccgagtgtccatgcccta

SEQ ID NO: 828852 - DNA, 25 bp, Mus musculus
tgtctgaccgtcaagagagtgctct

SEQ ID NO: 828853 - DNA, 25 bp, Mus musculus
tgtctgaccgtctagagagtgctct

SEQ ID NO: 828854 - DNA, 25 bp, Mus musculus
tgtctgaccgtgcacagaaatggtg

SEQ ID NO: 828855 - DNA, 25 bp, Mus musculus
tgtctgaccgtggacagaaatggtg

SEQ ID NO: 828856 - DNA, 25 bp, Mus musculus
tgtctgacctagaacagcgcctgga

SEQ ID NO: 828857 - DNA, 25 bp, Mus musculus
tgtctgacctagtacagcgcctgga

SEQ ID NO: 828858 - DNA, 25 bp, Mus musculus
tgtctgacctctcaagccttgaaga

SEQ ID NO: 828859 - DNA, 25 bp, Mus musculus
tgtctgacctctgaagccttgaaga

SEQ ID NO: 828860 - DNA, 25 bp, Mus musculus
tgtctgacctgaaagccgagaagct

SEQ ID NO: 828861 - DNA, 25 bp, Mus musculus
tgtctgacctgatagccgagaagct

SEQ ID NO: 828862 - DNA, 25 bp, Mus musculus
tgtctgacctgtagctggtctgagg

SEQ ID NO: 828863 - DNA, 25 bp, Mus musculus
tgtctgacctgttgctggtctgagg

SEQ ID NO: 828864 - DNA, 25 bp, Mus musculus
tgtctgacgacgagaagtacctgtg

SEQ ID NO: 828865 - DNA, 25 bp, Mus musculus
tgtctgacgacgtgaagtacctgtg

SEQ ID NO: 828866 - DNA, 25 bp, Mus musculus
tgtctgactaccagatccttcggga

SEQ ID NO: 828867 - DNA, 25 bp, Mus musculus
tgtctgactacctgatccttcggga

SEQ ID NO: 828868 - DNA, 25 bp, Mus musculus
tgtctgactattatccaaaaccata

SEQ ID NO: 828869 - DNA, 25 bp, Mus musculus
tgtctgactattttccaaaaccata

SEQ ID NO: 828870 - DNA, 25 bp, Mus musculus
tgtctgactcccacagtgtttcatg

SEQ ID NO: 828871 - DNA, 25 bp, Mus musculus
tgtctgactccctcagtgtttcatg

SEQ ID NO: 828872 - DNA, 25 bp, Mus musculus
tgtctgactgaaccacagccagctg

SEQ ID NO: 828873 - DNA, 25 bp, Mus musculus
tgtctgactgaagcacagccagctg

SEQ ID NO: 828874 - DNA, 25 bp, Mus musculus
tgtctgactgtgctgtcccgaggca

SEQ ID NO: 828875 - DNA, 25 bp, Mus musculus
tgtctgactgtggtgtcccgaggca

SEQ ID NO: 828876 - DNA, 25 bp, Mus musculus
tgtctgacttgtatccgaaggctga

SEQ ID NO: 828877 - DNA, 25 bp, Mus musculus
tgtctgacttgtttccgaaggctga

SEQ ID NO: 828878 - DNA, 25 bp, Mus musculus
tgtctgagcggacgcagctatacaa

SEQ ID NO: 828879 - DNA, 25 bp, Mus musculus
tgtctgagcggaggcagctatacaa

SEQ ID NO: 828880 - DNA, 25 bp, Mus musculus
tgtctgagcggcctgaagattcccc

SEQ ID NO: 828881 - DNA, 25 bp, Mus musculus
tgtctgagcggcgtgaagattcccc

SEQ ID NO: 828882 - DNA, 25 bp, Mus musculus
tgtctgagctcaccgatgaagccag

SEQ ID NO: 828883 - DNA, 25 bp, Mus musculus
tgtctgagctcagcgatgaagccag

SEQ ID NO: 828884 - DNA, 25 bp, Mus musculus
tgtctgaggagaccccttctgcggc

SEQ ID NO: 828885 - DNA, 25 bp, Mus musculus
tgtctgaggagagcccttctgcggc

SEQ ID NO: 828886 - DNA, 25 bp, Mus musculus
tgtctgaggatgagaagtccatacc

SEQ ID NO: 828887 - DNA, 25 bp, Mus musculus
tgtctgaggatgtgaagtccatacc

SEQ ID NO: 828888 - DNA, 25 bp, Mus musculus
tgtctgagtctcctcggcaaactgt

SEQ ID NO: 828889 - DNA, 25 bp, Mus musculus
tgtctgagtctcgtcggcaaactgt

SEQ ID NO: 828890 - DNA, 25 bp, Mus musculus
tgtctgatcacaagcaataccaaag

SEQ ID NO: 828891 - DNA, 25 bp, Mus musculus
tgtctgatcacatgcaataccaaag

SEQ ID NO: 828892 - DNA, 25 bp, Mus musculus
tgtctgatccagagaaaaggcgggc

SEQ ID NO: 828893 - DNA, 25 bp, Mus musculus
tgtctgatccagtgaaaaggcgggc

SEQ ID NO: 828894 - DNA, 25 bp, Mus musculus
tgtctgatgagaccaattgagatct

SEQ ID NO: 828895 - DNA, 25 bp, Mus musculus
tgtctgatgagagcaattgagatct

SEQ ID NO: 828896 - DNA, 25 bp, Mus musculus
tgtctgatgtgcagaagcgagtgca

SEQ ID NO: 828897 - DNA, 25 bp, Mus musculus
tgtctgatgtgctgaagcgagtgca

SEQ ID NO: 828898 - DNA, 25 bp, Mus musculus
tgtctgatgttgaaaagttcatgcc

SEQ ID NO: 828899 - DNA, 25 bp, Mus musculus
tgtctgatgttgtaaagttcatgcc

SEQ ID NO: 828900 - DNA, 25 bp, Mus musculus
tgtctgattccccttacgatgaaca

SEQ ID NO: 828901 - DNA, 25 bp, Mus musculus
tgtctgattcccgttacgatgaaca

SEQ ID NO: 828902 - DNA, 25 bp, Mus musculus
tgtctgatttatctcttacgtgtgg

SEQ ID NO: 828903 - DNA, 25 bp, Mus musculus
tgtctgatttatgtcttacgtgtgg

SEQ ID NO: 828904 - DNA, 25 bp, Mus musculus
tgtctgcaacgtaaacaactcctgc

SEQ ID NO: 828905 - DNA, 25 bp, Mus musculus
tgtctgcaacgttaacaactcctgc

SEQ ID NO: 828906 - DNA, 25 bp, Mus musculus
tgtctgcaccgcctagaagaggaac

SEQ ID NO: 828907 - DNA, 25 bp, Mus musculus
tgtctgcaccgcgtagaagaggaac

SEQ ID NO: 828908 - DNA, 25 bp, Mus musculus
tgtctgcacggtcgtacctgccaag

SEQ ID NO: 828909 - DNA, 25 bp, Mus musculus
tgtctgcacggtggtacctgccaag

SEQ ID NO: 828910 - DNA, 25 bp, Mus musculus
tgtctgcactgacgagttacattca

SEQ ID NO: 828911 - DNA, 25 bp, Mus musculus
tgtctgcactgaggagttacattca

SEQ ID NO: 828912 - DNA, 25 bp, Mus musculus
tgtctgcactgcacccggatacttg

SEQ ID NO: 828913 - DNA, 25 bp, Mus musculus
tgtctgcactgctcccggatacttg

SEQ ID NO: 828914 - DNA, 25 bp, Mus musculus
tgtctgcagaacaggtgccttggca

SEQ ID NO: 828915 - DNA, 25 bp, Mus musculus
tgtctgcagaactggtgccttggca

SEQ ID NO: 828916 - DNA, 25 bp, Mus musculus
tgtctgcagaagaggtttgagccca

SEQ ID NO: 828917 - DNA, 25 bp, Mus musculus
tgtctgcagaagtggtttgagccca

SEQ ID NO: 828918 - DNA, 25 bp, Mus musculus
tgtctgcagacaagtcggaccatag

SEQ ID NO: 828919 - DNA, 25 bp, Mus musculus
tgtctgcagacatgtcggaccatag

SEQ ID NO: 828920 - DNA, 25 bp, Mus musculus
tgtctgcagcggagggatgacacca

SEQ ID NO: 828921 - DNA, 25 bp, Mus musculus
tgtctgcagcggtgggatgacacca

SEQ ID NO: 828922 - DNA, 25 bp, Mus musculus
tgtctgcagtcgctggtaaccgctg

SEQ ID NO: 828923 - DNA, 25 bp, Mus musculus
tgtctgcagtcggtggtaaccgctg

SEQ ID NO: 828924 - DNA, 25 bp, Mus musculus
tgtctgcagtgcagtgtgacgatga

SEQ ID NO: 828925 - DNA, 25 bp, Mus musculus
tgtctgcagtgcagttagaatcact

SEQ ID NO: 828926 - DNA, 25 bp, Mus musculus
tgtctgcagtgctgtgtgacgatga

SEQ ID NO: 828927 - DNA, 25 bp, Mus musculus
tgtctgcagtgctgttagaatcact

SEQ ID NO: 828928 - DNA, 25 bp, Mus musculus
tgtctgcagtgtccattgtcggcga

SEQ ID NO: 828929 - DNA, 25 bp, Mus musculus
tgtctgcagtgtgcattgtcggcga

SEQ ID NO: 828930 - DNA, 25 bp, Mus musculus
tgtctgcatcagctgtacccgtact

SEQ ID NO: 828931 - DNA, 25 bp, Mus musculus
tgtctgcatcaggtgtacccgtact

SEQ ID NO: 828932 - DNA, 25 bp, Mus musculus
tgtctgcatggtcgtggtattgttc

SEQ ID NO: 828933 - DNA, 25 bp, Mus musculus
tgtctgcatggtggtggtattgttc

SEQ ID NO: 828934 - DNA, 25 bp, Mus musculus
tgtctgccaaggaggttctcagcgc

SEQ ID NO: 828935 - DNA, 25 bp, Mus musculus
tgtctgccaaggtggttctcagcgc

SEQ ID NO: 828936 - DNA, 25 bp, Mus musculus
tgtctgccagaacaccgagcccttt

SEQ ID NO: 828937 - DNA, 25 bp, Mus musculus
tgtctgccagaacgtggccctgagt

SEQ ID NO: 828938 - DNA, 25 bp, Mus musculus
tgtctgccagaagaccgagcccttt

SEQ ID NO: 828939 - DNA, 25 bp, Mus musculus
tgtctgccagaaggtggccctgagt

SEQ ID NO: 828940 - DNA, 25 bp, Mus musculus
tgtctgccatgtcacctctttaata

SEQ ID NO: 828941 - DNA, 25 bp, Mus musculus
tgtctgccatgtgacctctttaata

SEQ ID NO: 828942 - DNA, 25 bp, Mus musculus
tgtctgcccactcaatagtaatcac

SEQ ID NO: 828943 - DNA, 25 bp, Mus musculus
tgtctgcccactgaatagtaatcac

SEQ ID NO: 828944 - DNA, 25 bp, Mus musculus
tgtctgccccttccaactgaatggt

SEQ ID NO: 828945 - DNA, 25 bp, Mus musculus
tgtctgccccttgcaactgaatggt

SEQ ID NO: 828946 - DNA, 25 bp, Mus musculus
tgtctgcctgtgcatgaagccggcc

SEQ ID NO: 828947 - DNA, 25 bp, Mus musculus
tgtctgcctgtggatgaagccggcc

SEQ ID NO: 828948 - DNA, 25 bp, Mus musculus
tgtctgccttatagggcagaatccc

SEQ ID NO: 828949 - DNA, 25 bp, Mus musculus
tgtctgccttattgggcagaatccc

SEQ ID NO: 828950 - DNA, 25 bp, Mus musculus
tgtctgcgctcacccagctcatggt

SEQ ID NO: 828951 - DNA, 25 bp, Mus musculus
tgtctgcgctcagccagctcatggt

SEQ ID NO: 828952 - DNA, 25 bp, Mus musculus
tgtctgcggccgaagtgagctttgc

SEQ ID NO: 828953 - DNA, 25 bp, Mus musculus
tgtctgcggccgtagtgagctttgc

SEQ ID NO: 828954 - DNA, 25 bp, Mus musculus
tgtctgctatgacgccgctgctcgg

SEQ ID NO: 828955 - DNA, 25 bp, Mus musculus
tgtctgctatgaggccgctgctcgg

SEQ ID NO: 828956 - DNA, 25 bp, Mus musculus
tgtctgctctgaatggtgcccacac

SEQ ID NO: 828957 - DNA, 25 bp, Mus musculus
tgtctgctctgattggtgcccacac

SEQ ID NO: 828958 - DNA, 25 bp, Mus musculus
tgtctgctctgcattgccgatatcc

SEQ ID NO: 828959 - DNA, 25 bp, Mus musculus
tgtctgctctgctttgccgatatcc

SEQ ID NO: 828960 - DNA, 25 bp, Mus musculus
tgtctgctgagaagggaaactcttt

SEQ ID NO: 828961 - DNA, 25 bp, Mus musculus
tgtctgctgagatgggaaactcttt

SEQ ID NO: 828962 - DNA, 25 bp, Mus musculus
tgtctgctgcgaaagccatcgcaga

SEQ ID NO: 828963 - DNA, 25 bp, Mus musculus
tgtctgctgcgatagccatcgcaga

SEQ ID NO: 828964 - DNA, 25 bp, Mus musculus
tgtctgcttgtaattcattgccccg

SEQ ID NO: 828965 - DNA, 25 bp, Mus musculus
tgtctgcttgtatttcattgccccg

SEQ ID NO: 828966 - DNA, 25 bp, Mus musculus
tgtctggaaccgcactgaactgctg

SEQ ID NO: 828967 - DNA, 25 bp, Mus musculus
tgtctggaaccggactgaactgctg

SEQ ID NO: 828968 - DNA, 25 bp, Mus musculus
tgtctggaagccagccgtgctagga

SEQ ID NO: 828969 - DNA, 25 bp, Mus musculus
tgtctggaagcctgccgtgctagga

SEQ ID NO: 828970 - DNA, 25 bp, Mus musculus
tgtctggacagtccgtcggcacatt

SEQ ID NO: 828971 - DNA, 25 bp, Mus musculus
tgtctggacagtgcgtcggcacatt

SEQ ID NO: 828972 - DNA, 25 bp, Mus musculus
tgtctggagaccctaactacctgca

SEQ ID NO: 828973 - DNA, 25 bp, Mus musculus
tgtctggagaccgtaactacctgca

SEQ ID NO: 828974 - DNA, 25 bp, Mus musculus
tgtctggagtaccatgagcactaca

SEQ ID NO: 828975 - DNA, 25 bp, Mus musculus
tgtctggagtacgatgagcactaca

SEQ ID NO: 828976 - DNA, 25 bp, Mus musculus
tgtctggatacaacaactacctgga

SEQ ID NO: 828977 - DNA, 25 bp, Mus musculus
tgtctggatacatcaactacctgga

SEQ ID NO: 828978 - DNA, 25 bp, Mus musculus
tgtctggatgagcaaatgaacgcct

SEQ ID NO: 828979 - DNA, 25 bp, Mus musculus
tgtctggatgaggaaatgaacgcct

SEQ ID NO: 828980 - DNA, 25 bp, Mus musculus
tgtctggatgccaacaacagtctga

SEQ ID NO: 828981 - DNA, 25 bp, Mus musculus
tgtctggatgcctacaacagtctga

SEQ ID NO: 828982 - DNA, 25 bp, Mus musculus
tgtctggcaaggcagtcttgacaag

SEQ ID NO: 828983 - DNA, 25 bp, Mus musculus
tgtctggcaagggagtcttgacaag

SEQ ID NO: 828984 - DNA, 25 bp, Mus musculus
tgtctggcacacagtgcaaatgctt

SEQ ID NO: 828985 - DNA, 25 bp, Mus musculus
tgtctggcacactgtgcaaatgctt

SEQ ID NO: 828986 - DNA, 25 bp, Mus musculus
tgtctggcacagaacatacctgctc

SEQ ID NO: 828987 - DNA, 25 bp, Mus musculus
tgtctggcacagtacatacctgctc

SEQ ID NO: 828988 - DNA, 25 bp, Mus musculus
tgtctggccaggatcccttccaagg

SEQ ID NO: 828989 - DNA, 25 bp, Mus musculus
tgtctggccaggttcccttccaagg

SEQ ID NO: 828990 - DNA, 25 bp, Mus musculus
tgtctggccgctcatgtgcctctca

SEQ ID NO: 828991 - DNA, 25 bp, Mus musculus
tgtctggccgctgatgtgcctctca

SEQ ID NO: 828992 - DNA, 25 bp, Mus musculus
tgtctggcctttagcgcttcatcct

SEQ ID NO: 828993 - DNA, 25 bp, Mus musculus
tgtctggccttttgcgcttcatcct

SEQ ID NO: 828994 - DNA, 25 bp, Mus musculus
tgtctggcggcgcaaaccttgttag

SEQ ID NO: 828995 - DNA, 25 bp, Mus musculus
tgtctggcggcggaaaccttgttag

SEQ ID NO: 828996 - DNA, 25 bp, Mus musculus
tgtctggctgatctccgggagcctt

SEQ ID NO: 828997 - DNA, 25 bp, Mus musculus
tgtctggctgatgtccgggagcctt

SEQ ID NO: 828998 - DNA, 25 bp, Mus musculus
tgtctggctggaaacatggcgtcgc

SEQ ID NO: 828999 - DNA, 25 bp, Mus musculus
tgtctggctggatacatggcgtcgc

SEQ ID NO: 829000 - DNA, 25 bp, Mus musculus
tgtctgggaaaacaattcaggattt

SEQ ID NO: 829001 - DNA, 25 bp, Mus musculus
tgtctgggaaaagaattcaggattt

SEQ ID NO: 829002 - DNA, 25 bp, Mus musculus
tgtctgggaagacatggatatcaac

SEQ ID NO: 829003 - DNA, 25 bp, Mus musculus
tgtctgggaagagatggatatcaac

SEQ ID NO: 829004 - DNA, 25 bp, Mus musculus
tgtctgggacaacatcacatgctgg

SEQ ID NO: 829005 - DNA, 25 bp, Mus musculus
tgtctgggacaagatcacatgctgg

SEQ ID NO: 829006 - DNA, 25 bp, Mus musculus
tgtctgggacccagggtatccgcaa

SEQ ID NO: 829007 - DNA, 25 bp, Mus musculus
tgtctgggaccctgggtatccgcaa

SEQ ID NO: 829008 - DNA, 25 bp, Mus musculus
tgtctgggagataaggatccgcgct

SEQ ID NO: 829009 - DNA, 25 bp, Mus musculus
tgtctgggagattaggatccgcgct

SEQ ID NO: 829010 - DNA, 25 bp, Mus musculus
tgtctgggcaaccaaaactgttggc

SEQ ID NO: 829011 - DNA, 25 bp, Mus musculus
tgtctgggcaacgaaaactgttggc

SEQ ID NO: 829012 - DNA, 25 bp, Mus musculus
tgtctgggcccacatcttttctgtg

SEQ ID NO: 829013 - DNA, 25 bp, Mus musculus
tgtctgggcccagatcttttctgtg

SEQ ID NO: 829014 - DNA, 25 bp, Mus musculus
tgtctgggtagcacacagcctacca

SEQ ID NO: 829015 - DNA, 25 bp, Mus musculus
tgtctgggtagctcacagcctacca

SEQ ID NO: 829016 - DNA, 25 bp, Mus musculus
tgtctgggttggaaaagactcccag

SEQ ID NO: 829017 - DNA, 25 bp, Mus musculus
tgtctgggttggtaaagactcccag

SEQ ID NO: 829018 - DNA, 25 bp, Mus musculus
tgtctggtacccacaaagctgatgc

SEQ ID NO: 829019 - DNA, 25 bp, Mus musculus
tgtctggtaccctcaaagctgatgc

SEQ ID NO: 829020 - DNA, 25 bp, Mus musculus
tgtctggtagacacgagaagattcc

SEQ ID NO: 829021 - DNA, 25 bp, Mus musculus
tgtctggtagactcgagaagattcc

SEQ ID NO: 829022 - DNA, 25 bp, Mus musculus
tgtctggtcctcatcgttaaactgc

SEQ ID NO: 829023 - DNA, 25 bp, Mus musculus
tgtctggtcctcttcgttaaactgc

SEQ ID NO: 829024 - DNA, 25 bp, Mus musculus
tgtctggtctcaaacctggcaacct

SEQ ID NO: 829025 - DNA, 25 bp, Mus musculus
tgtctggtctcatacctggcaacct

SEQ ID NO: 829026 - DNA, 25 bp, Mus musculus
tgtctggtctttagggatcctactc

SEQ ID NO: 829027 - DNA, 25 bp, Mus musculus
tgtctggtcttttgggatcctactc

SEQ ID NO: 829028 - DNA, 25 bp, Mus musculus
tgtctggtgagaaggttcgcaccac

SEQ ID NO: 829029 - DNA, 25 bp, Mus musculus
tgtctggtgagatggttcgcaccac

SEQ ID NO: 829030 - DNA, 25 bp, Mus musculus
tgtctggtgctcaaggtgcggcaca

SEQ ID NO: 829031 - DNA, 25 bp, Mus musculus
tgtctggtgctctaggtgcggcaca

SEQ ID NO: 829032 - DNA, 25 bp, Mus musculus
tgtctggttggcagagtacctacac

SEQ ID NO: 829033 - DNA, 25 bp, Mus musculus
tgtctggttggctgagtacctacac

SEQ ID NO: 829034 - DNA, 25 bp, Mus musculus
tgtctgtaacaaccaaggcggcaca

SEQ ID NO: 829035 - DNA, 25 bp, Mus musculus
tgtctgtaacaagcaaggcggcaca

SEQ ID NO: 829036 - DNA, 25 bp, Mus musculus
tgtctgtagacccaagtcagaaaga

SEQ ID NO: 829037 - DNA, 25 bp, Mus musculus
tgtctgtagaccgaagtcagaaaga

SEQ ID NO: 829038 - DNA, 25 bp, Mus musculus
tgtctgtattcgattcacctttccc

SEQ ID NO: 829039 - DNA, 25 bp, Mus musculus
tgtctgtattcgtttcacctttccc

SEQ ID NO: 829040 - DNA, 25 bp, Mus musculus
tgtctgtcacgtcgacgctcctggc

SEQ ID NO: 829041 - DNA, 25 bp, Mus musculus
tgtctgtcacgtggacgctcctggc

SEQ ID NO: 829042 - DNA, 25 bp, Mus musculus
tgtctgtcatcaatagtactactgc

SEQ ID NO: 829043 - DNA, 25 bp, Mus musculus
tgtctgtcatcattagtactactgc

SEQ ID NO: 829044 - DNA, 25 bp, Mus musculus
tgtctgtcatctacagcgtcctggc

SEQ ID NO: 829045 - DNA, 25 bp, Mus musculus
tgtctgtcatcttcagcgtcctggc

SEQ ID NO: 829046 - DNA, 25 bp, Mus musculus
tgtctgtcatggataaccacaatgt

SEQ ID NO: 829047 - DNA, 25 bp, Mus musculus
tgtctgtcatggttaaccacaatgt

SEQ ID NO: 829048 - DNA, 25 bp, Mus musculus
tgtctgtcctacatctggctcatgg

SEQ ID NO: 829049 - DNA, 25 bp, Mus musculus
tgtctgtcctacttctggctcatgg

SEQ ID NO: 829050 - DNA, 25 bp, Mus musculus
tgtctgtcctgtccgggtgactccg

SEQ ID NO: 829051 - DNA, 25 bp, Mus musculus
tgtctgtcctgtgcgggtgactccg

SEQ ID NO: 829052 - DNA, 25 bp, Mus musculus
tgtctgtccttcatgccataggcaa

SEQ ID NO: 829053 - DNA, 25 bp, Mus musculus
tgtctgtccttcttgccataggcaa

SEQ ID NO: 829054 - DNA, 25 bp, Mus musculus
tgtctgtctaccctgtaggtctggg

SEQ ID NO: 829055 - DNA, 25 bp, Mus musculus
tgtctgtctaccgtgtaggtctggg

SEQ ID NO: 829056 - DNA, 25 bp, Mus musculus
tgtctgtctgcaaagtccggcgtca

SEQ ID NO: 829057 - DNA, 25 bp, Mus musculus
tgtctgtctgcatagtccggcgtca

SEQ ID NO: 829058 - DNA, 25 bp, Mus musculus
tgtctgtcttctcctctaaggcacc

SEQ ID NO: 829059 - DNA, 25 bp, Mus musculus
tgtctgtcttctgctctaaggcacc

SEQ ID NO: 829060 - DNA, 25 bp, Mus musculus
tgtctgtgaccaatgataaccttga

SEQ ID NO: 829061 - DNA, 25 bp, Mus musculus
tgtctgtgaccattgataaccttga

SEQ ID NO: 829062 - DNA, 25 bp, Mus musculus
tgtctgtgactgcttaccgtcccct

SEQ ID NO: 829063 - DNA, 25 bp, Mus musculus
tgtctgtgactggttaccgtcccct

SEQ ID NO: 829064 - DNA, 25 bp, Mus musculus
tgtctgtgcagtatcttggaagatg

SEQ ID NO: 829065 - DNA, 25 bp, Mus musculus
tgtctgtgcagtttcttggaagatg

SEQ ID NO: 829066 - DNA, 25 bp, Mus musculus
tgtctgtgccctacgagaagcattc

SEQ ID NO: 829067 - DNA, 25 bp, Mus musculus
tgtctgtgcccttcgagaagcattc

SEQ ID NO: 829068 - DNA, 25 bp, Mus musculus
tgtctgtgcttcatggaattgccaa

SEQ ID NO: 829069 - DNA, 25 bp, Mus musculus
tgtctgtgcttcttggaattgccaa

SEQ ID NO: 829070 - DNA, 25 bp, Mus musculus
tgtctgtggcagcacgacagtgaca

SEQ ID NO: 829071 - DNA, 25 bp, Mus musculus
tgtctgtggcaggacgacagtgaca

SEQ ID NO: 829072 - DNA, 25 bp, Mus musculus
tgtctgtggccacagtcccggctac

SEQ ID NO: 829073 - DNA, 25 bp, Mus musculus
tgtctgtggccagagtcccggctac

SEQ ID NO: 829074 - DNA, 25 bp, Mus musculus
tgtctgtggcctcccagagatgtcc

SEQ ID NO: 829075 - DNA, 25 bp, Mus musculus
tgtctgtggcctgccagagatgtcc

SEQ ID NO: 829076 - DNA, 25 bp, Mus musculus
tgtctgtggctccattctctgccct

SEQ ID NO: 829077 - DNA, 25 bp, Mus musculus
tgtctgtggctcgattctctgccct

SEQ ID NO: 829078 - DNA, 25 bp, Mus musculus
tgtctgtgggagagactcaaatgat

SEQ ID NO: 829079 - DNA, 25 bp, Mus musculus
tgtctgtgggagtgactcaaatgat

SEQ ID NO: 829080 - DNA, 25 bp, Mus musculus
tgtctgtgtccgctttggcctcgac

SEQ ID NO: 829081 - DNA, 25 bp, Mus musculus
tgtctgtgtccggtttggcctcgac

SEQ ID NO: 829082 - DNA, 25 bp, Mus musculus
tgtctgtgtctgagatgagggtttc

SEQ ID NO: 829083 - DNA, 25 bp, Mus musculus
tgtctgtgtctgtgatgagggtttc

SEQ ID NO: 829084 - DNA, 25 bp, Mus musculus
tgtctgtgtggacggcgacccactc

SEQ ID NO: 829085 - DNA, 25 bp, Mus musculus
tgtctgtgtggagggcgacccactc

SEQ ID NO: 829086 - DNA, 25 bp, Mus musculus
tgtctgttagccagcacttctgctc

SEQ ID NO: 829087 - DNA, 25 bp, Mus musculus
tgtctgttagcctgcacttctgctc

SEQ ID NO: 829088 - DNA, 25 bp, Mus musculus
tgtctgttcaatcagggctccaaaa

SEQ ID NO: 829089 - DNA, 25 bp, Mus musculus
tgtctgttcaatgagggctccaaaa

SEQ ID NO: 829090 - DNA, 25 bp, Mus musculus
tgtctgttcagcagtcagcattctg

SEQ ID NO: 829091 - DNA, 25 bp, Mus musculus
tgtctgttcagctgtcagcattctg

SEQ ID NO: 829092 - DNA, 25 bp, Mus musculus
tgtctgttcctgattatgcatcctt

SEQ ID NO: 829093 - DNA, 25 bp, Mus musculus
tgtctgttcctgtttatgcatcctt

SEQ ID NO: 829094 - DNA, 25 bp, Mus musculus
tgtctgttctcactcatcaacggag

SEQ ID NO: 829095 - DNA, 25 bp, Mus musculus
tgtctgttctcagtcatcaacggag

SEQ ID NO: 829096 - DNA, 25 bp, Mus musculus
tgtctgttctctcggtactatctgc

SEQ ID NO: 829097 - DNA, 25 bp, Mus musculus
tgtctgttctctgggtactatctgc

SEQ ID NO: 829098 - DNA, 25 bp, Mus musculus
tgtctgtttatgagagctggactag

SEQ ID NO: 829099 - DNA, 25 bp, Mus musculus
tgtctgtttatgtgagctggactag

SEQ ID NO: 829100 - DNA, 25 bp, Mus musculus
tgtcttaaacccaagatggtccccg

SEQ ID NO: 829101 - DNA, 25 bp, Mus musculus
tgtcttaaaccctagatggtccccg

SEQ ID NO: 829102 - DNA, 25 bp, Mus musculus
tgtcttaaatcgctactatgtccct

SEQ ID NO: 829103 - DNA, 25 bp, Mus musculus
tgtcttaaatcggtactatgtccct

SEQ ID NO: 829104 - DNA, 25 bp, Mus musculus
tgtcttaaatgacgaaaacgtgccc

SEQ ID NO: 829105 - DNA, 25 bp, Mus musculus
tgtcttaaatgaggaaaacgtgccc

SEQ ID NO: 829106 - DNA, 25 bp, Mus musculus
tgtcttaacaatcatgtgaaaagcc

SEQ ID NO: 829107 - DNA, 25 bp, Mus musculus
tgtcttaacaatgatgtgaaaagcc

SEQ ID NO: 829108 - DNA, 25 bp, Mus musculus
tgtcttaatctcatcactaaacagg

SEQ ID NO: 829109 - DNA, 25 bp, Mus musculus
tgtcttaatctcttcactaaacagg

SEQ ID NO: 829110 - DNA, 25 bp, Mus musculus
tgtcttacacagaggccgagtgggc

SEQ ID NO: 829111 - DNA, 25 bp, Mus musculus
tgtcttacacagtggccgagtgggc

SEQ ID NO: 829112 - DNA, 25 bp, Mus musculus
tgtcttacatgaaaagcatcagtag

SEQ ID NO: 829113 - DNA, 25 bp, Mus musculus
tgtcttacatgataagcatcagtag

SEQ ID NO: 829114 - DNA, 25 bp, Mus musculus
tgtcttaccataaagaatggactga

SEQ ID NO: 829115 - DNA, 25 bp, Mus musculus
tgtcttaccatatagaatggactga

SEQ ID NO: 829116 - DNA, 25 bp, Mus musculus
tgtcttagagccatataccaattag

SEQ ID NO: 829117 - DNA, 25 bp, Mus musculus
tgtcttagagccttataccaattag

SEQ ID NO: 829118 - DNA, 25 bp, Mus musculus
tgtcttagctggacacgacaaccga

SEQ ID NO: 829119 - DNA, 25 bp, Mus musculus
tgtcttagctggtcacgacaaccga

SEQ ID NO: 829120 - DNA, 25 bp, Mus musculus
tgtcttagttgtccacttgaggctg

SEQ ID NO: 829121 - DNA, 25 bp, Mus musculus
tgtcttagttgtgcacttgaggctg

SEQ ID NO: 829122 - DNA, 25 bp, Mus musculus
tgtcttataacaacctctcgcagga

SEQ ID NO: 829123 - DNA, 25 bp, Mus musculus
tgtcttataacatcctctcgcagga

SEQ ID NO: 829124 - DNA, 25 bp, Mus musculus
tgtcttatacaacgacagtgtggag

SEQ ID NO: 829125 - DNA, 25 bp, Mus musculus
tgtcttatacaaggacagtgtggag

SEQ ID NO: 829126 - DNA, 25 bp, Mus musculus
tgtcttatacacaggagacttcaga

SEQ ID NO: 829127 - DNA, 25 bp, Mus musculus
tgtcttatacactggagacttcaga

SEQ ID NO: 829128 - DNA, 25 bp, Mus musculus
tgtcttatcctccttgtgaagatgc

SEQ ID NO: 829129 - DNA, 25 bp, Mus musculus
tgtcttatcctcgttgtgaagatgc

SEQ ID NO: 829130 - DNA, 25 bp, Mus musculus
tgtcttatctagcatgacagatgca

SEQ ID NO: 829131 - DNA, 25 bp, Mus musculus
tgtcttatctaggatgacagatgca

SEQ ID NO: 829132 - DNA, 25 bp, Mus musculus
tgtcttatctatcgcccagctgcgt

SEQ ID NO: 829133 - DNA, 25 bp, Mus musculus
tgtcttatctatggcccagctgcgt

SEQ ID NO: 829134 - DNA, 25 bp, Mus musculus
tgtcttcaacctcgtggaactggaa

SEQ ID NO: 829135 - DNA, 25 bp, Mus musculus
tgtcttcaacctggtggaactggaa

SEQ ID NO: 829136 - DNA, 25 bp, Mus musculus
tgtcttcacgcacgcccattggaaa

SEQ ID NO: 829137 - DNA, 25 bp, Mus musculus
tgtcttcacgcaggcccattggaaa

SEQ ID NO: 829138 - DNA, 25 bp, Mus musculus
tgtcttcagaagagaagccaaacgc

SEQ ID NO: 829139 - DNA, 25 bp, Mus musculus
tgtcttcagaagtgaagccaaacgc

SEQ ID NO: 829140 - DNA, 25 bp, Mus musculus
tgtcttcagactcagctgacccgtt

SEQ ID NO: 829141 - DNA, 25 bp, Mus musculus
tgtcttcagactgagctgacccgtt

SEQ ID NO: 829142 - DNA, 25 bp, Mus musculus
tgtcttcagcaaagatcagtttcca

SEQ ID NO: 829143 - DNA, 25 bp, Mus musculus
tgtcttcagcaatgatcagtttcca

SEQ ID NO: 829144 - DNA, 25 bp, Mus musculus
tgtcttcagcgtcccaattgtctat

SEQ ID NO: 829145 - DNA, 25 bp, Mus musculus
tgtcttcagcgtgccaattgtctat

SEQ ID NO: 829146 - DNA, 25 bp, Mus musculus
tgtcttcagtgccatagtcaacaac

SEQ ID NO: 829147 - DNA, 25 bp, Mus musculus
tgtcttcagtgcgatagtcaacaac

SEQ ID NO: 829148 - DNA, 25 bp, Mus musculus
tgtcttcatcaaagactggatcttg

SEQ ID NO: 829149 - DNA, 25 bp, Mus musculus
tgtcttcatcaatgactggatcttg

SEQ ID NO: 829150 - DNA, 25 bp, Mus musculus
tgtcttcatcttcatgagcggcagg

SEQ ID NO: 829151 - DNA, 25 bp, Mus musculus
tgtcttcatcttgatgagcggcagg

SEQ ID NO: 829152 - DNA, 25 bp, Mus musculus
tgtcttcatgatccaggacctgggc

SEQ ID NO: 829153 - DNA, 25 bp, Mus musculus
tgtcttcatgatgcaggacctgggc

SEQ ID NO: 829154 - DNA, 25 bp, Mus musculus
tgtcttcatggtcgtggcgcagtcc

SEQ ID NO: 829155 - DNA, 25 bp, Mus musculus
tgtcttcatggtggtggcgcagtcc

SEQ ID NO: 829156 - DNA, 25 bp, Mus musculus
tgtcttccaagtacaatgacatcgt

SEQ ID NO: 829157 - DNA, 25 bp, Mus musculus
tgtcttccaagttcaatgacatcgt

SEQ ID NO: 829158 - DNA, 25 bp, Mus musculus
tgtcttccaccccttcaattgagag

SEQ ID NO: 829159 - DNA, 25 bp, Mus musculus
tgtcttccacccgttcaattgagag

SEQ ID NO: 829160 - DNA, 25 bp, Mus musculus
tgtcttccagatacgtaagacagaa

SEQ ID NO: 829161 - DNA, 25 bp, Mus musculus
tgtcttccagattcgtaagacagaa

SEQ ID NO: 829162 - DNA, 25 bp, Mus musculus
tgtcttccaggaagtcagatttgtc

SEQ ID NO: 829163 - DNA, 25 bp, Mus musculus
tgtcttccaggatgtcagatttgtc

SEQ ID NO: 829164 - DNA, 25 bp, Mus musculus
tgtcttccatcgaggtggcaatctg

SEQ ID NO: 829165 - DNA, 25 bp, Mus musculus
tgtcttccatcgtggtggcaatctg

SEQ ID NO: 829166 - DNA, 25 bp, Mus musculus
tgtcttcccaaacgcaaaggcagca

SEQ ID NO: 829167 - DNA, 25 bp, Mus musculus
tgtcttcccaaaggcaaaggcagca

SEQ ID NO: 829168 - DNA, 25 bp, Mus musculus
tgtcttccgctaatggattaccacc

SEQ ID NO: 829169 - DNA, 25 bp, Mus musculus
tgtcttccgctattggattaccacc

SEQ ID NO: 829170 - DNA, 25 bp, Mus musculus
tgtcttccgtgcaggctttcggcag

SEQ ID NO: 829171 - DNA, 25 bp, Mus musculus
tgtcttccgtgctggctttcggcag

SEQ ID NO: 829172 - DNA, 25 bp, Mus musculus
tgtcttccgtttcccttgaactcta

SEQ ID NO: 829173 - DNA, 25 bp, Mus musculus
tgtcttccgtttgccttgaactcta

SEQ ID NO: 829174 - DNA, 25 bp, Mus musculus
tgtcttcctgttctaaaccacgtgg

SEQ ID NO: 829175 - DNA, 25 bp, Mus musculus
tgtcttcctgttgtaaaccacgtgg

SEQ ID NO: 829176 - DNA, 25 bp, Mus musculus
tgtcttcgccacacaatcatatcta

SEQ ID NO: 829177 - DNA, 25 bp, Mus musculus
tgtcttcgccactcaatcatatcta

SEQ ID NO: 829178 - DNA, 25 bp, Mus musculus
tgtcttctaaaacagcaagagaaga

SEQ ID NO: 829179 - DNA, 25 bp, Mus musculus
tgtcttctaaaagagcaagagaaga

SEQ ID NO: 829180 - DNA, 25 bp, Mus musculus
tgtcttctaagtaccaacatcctgt

SEQ ID NO: 829181 - DNA, 25 bp, Mus musculus
tgtcttctaagttccaacatcctgt

SEQ ID NO: 829182 - DNA, 25 bp, Mus musculus
tgtcttctacaaagtcatcgattat

SEQ ID NO: 829183 - DNA, 25 bp, Mus musculus
tgtcttctacaatgtcatcgattat

SEQ ID NO: 829184 - DNA, 25 bp, Mus musculus
tgtcttctagacaggtagttgaatc

SEQ ID NO: 829185 - DNA, 25 bp, Mus musculus
tgtcttctagactggtagttgaatc

SEQ ID NO: 829186 - DNA, 25 bp, Mus musculus
tgtcttctcagaatgctccccgggt

SEQ ID NO: 829187 - DNA, 25 bp, Mus musculus
tgtcttctcagattgctccccgggt

SEQ ID NO: 829188 - DNA, 25 bp, Mus musculus
tgtcttctcagcatcaagcaaggat

SEQ ID NO: 829189 - DNA, 25 bp, Mus musculus
tgtcttctcagcttcaagcaaggat

SEQ ID NO: 829190 - DNA, 25 bp, Mus musculus
tgtcttctccatccaaagagcagca

SEQ ID NO: 829191 - DNA, 25 bp, Mus musculus
tgtcttctccatgcaaagagcagca

SEQ ID NO: 829192 - DNA, 25 bp, Mus musculus
tgtcttctcggaccttcagaaccag

SEQ ID NO: 829193 - DNA, 25 bp, Mus musculus
tgtcttctcggagcttcagaaccag

SEQ ID NO: 829194 - DNA, 25 bp, Mus musculus
tgtcttctcgtcagcagagagccct

SEQ ID NO: 829195 - DNA, 25 bp, Mus musculus
tgtcttctcgtctgcagagagccct

SEQ ID NO: 829196 - DNA, 25 bp, Mus musculus
tgtcttctctggcatccatctttaa

SEQ ID NO: 829197 - DNA, 25 bp, Mus musculus
tgtcttctctgggatccatctttaa

SEQ ID NO: 829198 - DNA, 25 bp, Mus musculus
tgtcttctggaacgccagtactcgc

SEQ ID NO: 829199 - DNA, 25 bp, Mus musculus
tgtcttctggaaggccagtactcgc

SEQ ID NO: 829200 - DNA, 25 bp, Mus musculus
tgtcttctggatcagtaccgaccac

SEQ ID NO: 829201 - DNA, 25 bp, Mus musculus
tgtcttctggatgagtaccgaccac

SEQ ID NO: 829202 - DNA, 25 bp, Mus musculus
tgtcttcttaccattaaagggaggg

SEQ ID NO: 829203 - DNA, 25 bp, Mus musculus
tgtcttcttacctttaaagggaggg

SEQ ID NO: 829204 - DNA, 25 bp, Mus musculus
tgtcttcttctgagggacgtctgct

SEQ ID NO: 829205 - DNA, 25 bp, Mus musculus
tgtcttcttctgtgggacgtctgct

SEQ ID NO: 829206 - DNA, 25 bp, Mus musculus
tgtcttgaaaggagtcatagcctca

SEQ ID NO: 829207 - DNA, 25 bp, Mus musculus
tgtcttgaaaggtgtcatagcctca

SEQ ID NO: 829208 - DNA, 25 bp, Mus musculus
tgtcttgaagaaagcgcggactaat

SEQ ID NO: 829209 - DNA, 25 bp, Mus musculus
tgtcttgaagaatgcgcggactaat

SEQ ID NO: 829210 - DNA, 25 bp, Mus musculus
tgtcttgacagaccatcctcggtgg

SEQ ID NO: 829211 - DNA, 25 bp, Mus musculus
tgtcttgacagagcatcctcggtgg

SEQ ID NO: 829212 - DNA, 25 bp, Mus musculus
tgtcttgacctcctatgaaagctgc

SEQ ID NO: 829213 - DNA, 25 bp, Mus musculus
tgtcttgacctcgtatgaaagctgc

SEQ ID NO: 829214 - DNA, 25 bp, Mus musculus
tgtcttgagctgctctttcggaccc

SEQ ID NO: 829215 - DNA, 25 bp, Mus musculus
tgtcttgagctggtctttcggaccc

SEQ ID NO: 829216 - DNA, 25 bp, Mus musculus
tgtcttgagtggaaaattttgcatc

SEQ ID NO: 829217 - DNA, 25 bp, Mus musculus
tgtcttgagtggtaaattttgcatc

SEQ ID NO: 829218 - DNA, 25 bp, Mus musculus
tgtcttgatccactaggtccaggga

SEQ ID NO: 829219 - DNA, 25 bp, Mus musculus
tgtcttgatccagtaggtccaggga

SEQ ID NO: 829220 - DNA, 25 bp, Mus musculus
tgtcttgccgggacgtctatgcaaa

SEQ ID NO: 829221 - DNA, 25 bp, Mus musculus
tgtcttgccgggtcgtctatgcaaa

SEQ ID NO: 829222 - DNA, 25 bp, Mus musculus
tgtcttgcctaccattcaaaacacg

SEQ ID NO: 829223 - DNA, 25 bp, Mus musculus
tgtcttgcctacgattcaaaacacg

SEQ ID NO: 829224 - DNA, 25 bp, Mus musculus
tgtcttgcctatcaaccacaaagag

SEQ ID NO: 829225 - DNA, 25 bp, Mus musculus
tgtcttgcctatgaaccacaaagag

SEQ ID NO: 829226 - DNA, 25 bp, Mus musculus
tgtcttggagacagacctggtgcct

SEQ ID NO: 829227 - DNA, 25 bp, Mus musculus
tgtcttggagactgacctggtgcct

SEQ ID NO: 829228 - DNA, 25 bp, Mus musculus
tgtcttggatcaaaaccaggaagag

SEQ ID NO: 829229 - DNA, 25 bp, Mus musculus
tgtcttggatcataaccaggaagag

SEQ ID NO: 829230 - DNA, 25 bp, Mus musculus
tgtcttggcacacccctttggataa

SEQ ID NO: 829231 - DNA, 25 bp, Mus musculus
tgtcttggcacagccctttggataa

SEQ ID NO: 829232 - DNA, 25 bp, Mus musculus
tgtcttgggcaccaaattcaccatc

SEQ ID NO: 829233 - DNA, 25 bp, Mus musculus
tgtcttgggcacgaaattcaccatc

SEQ ID NO: 829234 - DNA, 25 bp, Mus musculus
tgtcttgggcggaatggcaacactc

SEQ ID NO: 829235 - DNA, 25 bp, Mus musculus
tgtcttgggcggtatggcaacactc

SEQ ID NO: 829236 - DNA, 25 bp, Mus musculus
tgtcttgggtggacaacacgttctc

SEQ ID NO: 829237 - DNA, 25 bp, Mus musculus
tgtcttgggtggtcaacacgttctc

SEQ ID NO: 829238 - DNA, 25 bp, Mus musculus
tgtcttgtcattcccctgtgtcatg

SEQ ID NO: 829239 - DNA, 25 bp, Mus musculus
tgtcttgtcattgccctgtgtcatg

SEQ ID NO: 829240 - DNA, 25 bp, Mus musculus
tgtcttgtgaggcttcaggacatcc

SEQ ID NO: 829241 - DNA, 25 bp, Mus musculus
tgtcttgtgagggttcaggacatcc

SEQ ID NO: 829242 - DNA, 25 bp, Mus musculus
tgtcttgtggagaaggtctagccca

SEQ ID NO: 829243 - DNA, 25 bp, Mus musculus
tgtcttgtggagtaggtctagccca

SEQ ID NO: 829244 - DNA, 25 bp, Mus musculus
tgtcttgttgaaccaccaggccagc

SEQ ID NO: 829245 - DNA, 25 bp, Mus musculus
tgtcttgttgaagcaccaggccagc

SEQ ID NO: 829246 - DNA, 25 bp, Mus musculus
tgtcttgtttttcctctctcccagg

SEQ ID NO: 829247 - DNA, 25 bp, Mus musculus
tgtcttgtttttgctctctcccagg

SEQ ID NO: 829248 - DNA, 25 bp, Mus musculus
tgtctttaaatgaagctgaaatatg

SEQ ID NO: 829249 - DNA, 25 bp, Mus musculus
tgtctttaaatgtagctgaaatatg

SEQ ID NO: 829250 - DNA, 25 bp, Mus musculus
tgtctttacactaacaacggccgtg

SEQ ID NO: 829251 - DNA, 25 bp, Mus musculus
tgtctttacacttacaacggccgtg

SEQ ID NO: 829252 - DNA, 25 bp, Mus musculus
tgtctttaccacatacaagctcatg

SEQ ID NO: 829253 - DNA, 25 bp, Mus musculus
tgtctttaccacttacaagctcatg

SEQ ID NO: 829254 - DNA, 25 bp, Mus musculus
tgtctttacccgctagttcctggca

SEQ ID NO: 829255 - DNA, 25 bp, Mus musculus
tgtctttacccggtagttcctggca

SEQ ID NO: 829256 - DNA, 25 bp, Mus musculus
tgtctttatacactgctctcaccac

SEQ ID NO: 829257 - DNA, 25 bp, Mus musculus
tgtctttatacagtgctctcaccac

SEQ ID NO: 829258 - DNA, 25 bp, Mus musculus
tgtctttcatgaattccgaaatggc

SEQ ID NO: 829259 - DNA, 25 bp, Mus musculus
tgtctttcatgatttccgaaatggc

SEQ ID NO: 829260 - DNA, 25 bp, Mus musculus
tgtctttcctgacggagacttcggc

SEQ ID NO: 829261 - DNA, 25 bp, Mus musculus
tgtctttcctgagggagacttcggc

SEQ ID NO: 829262 - DNA, 25 bp, Mus musculus
tgtctttctccaaaataatgaataa

SEQ ID NO: 829263 - DNA, 25 bp, Mus musculus
tgtctttctccataataatgaataa

SEQ ID NO: 829264 - DNA, 25 bp, Mus musculus
tgtctttcttgacagcaggtgctgc

SEQ ID NO: 829265 - DNA, 25 bp, Mus musculus
tgtctttcttgagagcaggtgctgc

SEQ ID NO: 829266 - DNA, 25 bp, Mus musculus
tgtctttgaaagagccctgtcctct

SEQ ID NO: 829267 - DNA, 25 bp, Mus musculus
tgtctttgaaagtgccctgtcctct

SEQ ID NO: 829268 - DNA, 25 bp, Mus musculus
tgtctttgagttagacgtcttcacc

SEQ ID NO: 829269 - DNA, 25 bp, Mus musculus
tgtctttgagtttgacgtcttcacc

SEQ ID NO: 829270 - DNA, 25 bp, Mus musculus
tgtctttgatgtactacatgaggga

SEQ ID NO: 829271 - DNA, 25 bp, Mus musculus
tgtctttgatgttctacatgaggga

SEQ ID NO: 829272 - DNA, 25 bp, Mus musculus
tgtctttgccaacatgagccgggaa

SEQ ID NO: 829273 - DNA, 25 bp, Mus musculus
tgtctttgccaagatgagccgggaa

SEQ ID NO: 829274 - DNA, 25 bp, Mus musculus
tgtctttgccacctttgaagcagga

SEQ ID NO: 829275 - DNA, 25 bp, Mus musculus
tgtctttgccacgtttgaagcagga

SEQ ID NO: 829276 - DNA, 25 bp, Mus musculus
tgtctttgctcacacctgaacgagt

SEQ ID NO: 829277 - DNA, 25 bp, Mus musculus
tgtctttgctcagacctgaacgagt

SEQ ID NO: 829278 - DNA, 25 bp, Mus musculus
tgtctttgtccgcttccagcctgaa

SEQ ID NO: 829279 - DNA, 25 bp, Mus musculus
tgtctttgtccggttccagcctgaa

SEQ ID NO: 829280 - DNA, 25 bp, Mus musculus
tgtctttgtgaaccagtggcaggtt

SEQ ID NO: 829281 - DNA, 25 bp, Mus musculus
tgtctttgtgaagcagtggcaggtt

SEQ ID NO: 829282 - DNA, 25 bp, Mus musculus
tgtctttgtgggactgcgaccgaaa

SEQ ID NO: 829283 - DNA, 25 bp, Mus musculus
tgtctttgtgggtctgcgaccgaaa

SEQ ID NO: 829284 - DNA, 25 bp, Mus musculus
tgtcttttaaaactggcatcatttc

SEQ ID NO: 829285 - DNA, 25 bp, Mus musculus
tgtcttttaaaagtggcatcatttc

SEQ ID NO: 829286 - DNA, 25 bp, Mus musculus
tgtcttttaggaagtgcccagcaaa

SEQ ID NO: 829287 - DNA, 25 bp, Mus musculus
tgtcttttaggatgtgcccagcaaa

SEQ ID NO: 829288 - DNA, 25 bp, Mus musculus
tgtcttttccccaccggcgtctagg

SEQ ID NO: 829289 - DNA, 25 bp, Mus musculus
tgtcttttcccctccggcgtctagg

SEQ ID NO: 829290 - DNA, 25 bp, Mus musculus
tgtcttttcgctcctcactggcaga

SEQ ID NO: 829291 - DNA, 25 bp, Mus musculus
tgtcttttcgctgctcactggcaga

SEQ ID NO: 829292 - DNA, 25 bp, Mus musculus
tgtcttttctcaaggtctcggagcc

SEQ ID NO: 829293 - DNA, 25 bp, Mus musculus
tgtcttttctcatggtctcggagcc

SEQ ID NO: 829294 - DNA, 25 bp, Mus musculus
tgtcttttgcaaagtgcacctttgg

SEQ ID NO: 829295 - DNA, 25 bp, Mus musculus
tgtcttttgcaatgtgcacctttgg

SEQ ID NO: 829296 - DNA, 25 bp, Mus musculus
tgtctttttgcacaacccagattcc

SEQ ID NO: 829297 - DNA, 25 bp, Mus musculus
tgtctttttgcagaacccagattcc

SEQ ID NO: 829298 - DNA, 25 bp, Mus musculus
tgtctttttggtctccatgctcgga

SEQ ID NO: 829299 - DNA, 25 bp, Mus musculus
tgtctttttggtgtccatgctcgga

SEQ ID NO: 829300 - DNA, 25 bp, Mus musculus
tgtgaaaaaggacctcgtaacctgc

SEQ ID NO: 829301 - DNA, 25 bp, Mus musculus
tgtgaaaaaggagctcgtaacctgc

SEQ ID NO: 829302 - DNA, 25 bp, Mus musculus
tgtgaaaacaacaactcttgacctg

SEQ ID NO: 829303 - DNA, 25 bp, Mus musculus
tgtgaaaacaactactcttgacctg

SEQ ID NO: 829304 - DNA, 25 bp, Mus musculus
tgtgaaaagcccatgtcgccatggg

SEQ ID NO: 829305 - DNA, 25 bp, Mus musculus
tgtgaaaagcccttgtcgccatggg

SEQ ID NO: 829306 - DNA, 25 bp, Mus musculus
tgtgaaaagggcacctttacggctt

SEQ ID NO: 829307 - DNA, 25 bp, Mus musculus
tgtgaaaagggctcctttacggctt

SEQ ID NO: 829308 - DNA, 25 bp, Mus musculus
tgtgaaaatctcacagctgactgcc

SEQ ID NO: 829309 - DNA, 25 bp, Mus musculus
tgtgaaaatctctcagctgactgcc

SEQ ID NO: 829310 - DNA, 25 bp, Mus musculus
tgtgaaaatgacaatggaggaagaa

SEQ ID NO: 829311 - DNA, 25 bp, Mus musculus
tgtgaaaatgactatggaggaagaa

SEQ ID NO: 829312 - DNA, 25 bp, Mus musculus
tgtgaaacaaacagtgtgggcgtgc

SEQ ID NO: 829313 - DNA, 25 bp, Mus musculus
tgtgaaacaaactgtgtgggcgtgc

SEQ ID NO: 829314 - DNA, 25 bp, Mus musculus
tgtgaaacagttcacctaaacagcc

SEQ ID NO: 829315 - DNA, 25 bp, Mus musculus
tgtgaaacagttgacctaaacagcc

SEQ ID NO: 829316 - DNA, 25 bp, Mus musculus
tgtgaaacatcactgctagccatgc

SEQ ID NO: 829317 - DNA, 25 bp, Mus musculus
tgtgaaacatcagtgctagccatgc

SEQ ID NO: 829318 - DNA, 25 bp, Mus musculus
tgtgaaacatgactgattctaagga

SEQ ID NO: 829319 - DNA, 25 bp, Mus musculus
tgtgaaacatgagtgattctaagga

SEQ ID NO: 829320 - DNA, 25 bp, Mus musculus
tgtgaaacatttctgcaacaagacc

SEQ ID NO: 829321 - DNA, 25 bp, Mus musculus
tgtgaaacatttgtgcaacaagacc

SEQ ID NO: 829322 - DNA, 25 bp, Mus musculus
tgtgaaactcttccgggtccggatg

SEQ ID NO: 829323 - DNA, 25 bp, Mus musculus
tgtgaaactcttgcgggtccggatg

SEQ ID NO: 829324 - DNA, 25 bp, Mus musculus
tgtgaaacttgtcgagaagtcagag

SEQ ID NO: 829325 - DNA, 25 bp, Mus musculus
tgtgaaacttgtggagaagtcagag

SEQ ID NO: 829326 - DNA, 25 bp, Mus musculus
tgtgaaagatggcattctcctggcc

SEQ ID NO: 829327 - DNA, 25 bp, Mus musculus
tgtgaaagatgggattctcctggcc

SEQ ID NO: 829328 - DNA, 25 bp, Mus musculus
tgtgaaagcaagacctaagagagga

SEQ ID NO: 829329 - DNA, 25 bp, Mus musculus
tgtgaaagcaagtcctaagagagga

SEQ ID NO: 829330 - DNA, 25 bp, Mus musculus
tgtgaaagcattcatggaatgtgct

SEQ ID NO: 829331 - DNA, 25 bp, Mus musculus
tgtgaaagcattgatggaatgtgct

SEQ ID NO: 829332 - DNA, 25 bp, Mus musculus
tgtgaaagcgcacaagctggcagta

SEQ ID NO: 829333 - DNA, 25 bp, Mus musculus
tgtgaaagcgcagaagctggcagta

SEQ ID NO: 829334 - DNA, 25 bp, Mus musculus
tgtgaaaggatcacctgtgaaaatc

SEQ ID NO: 829335 - DNA, 25 bp, Mus musculus
tgtgaaaggatctcctgtgaaaatc

SEQ ID NO: 829336 - DNA, 25 bp, Mus musculus
tgtgaaaggccgaacttggaccttg

SEQ ID NO: 829337 - DNA, 25 bp, Mus musculus
tgtgaaaggccgtacttggaccttg

SEQ ID NO: 829338 - DNA, 25 bp, Mus musculus
tgtgaaagtcccagcgtcaatgcct

SEQ ID NO: 829339 - DNA, 25 bp, Mus musculus
tgtgaaagtccctgcgtcaatgcct

SEQ ID NO: 829340 - DNA, 25 bp, Mus musculus
tgtgaaatcaagcttgcccagccca

SEQ ID NO: 829341 - DNA, 25 bp, Mus musculus
tgtgaaatcaaggttgcccagccca

SEQ ID NO: 829342 - DNA, 25 bp, Mus musculus
tgtgaaatggaaacaaccaaagggc

SEQ ID NO: 829343 - DNA, 25 bp, Mus musculus
tgtgaaatggaatcaaccaaagggc

SEQ ID NO: 829344 - DNA, 25 bp, Mus musculus
tgtgaaattgttcctgctaacatct

SEQ ID NO: 829345 - DNA, 25 bp, Mus musculus
tgtgaaattgttgctgctaacatct

SEQ ID NO: 829346 - DNA, 25 bp, Mus musculus
tgtgaaatttgaaccgtaccacgac

SEQ ID NO: 829347 - DNA, 25 bp, Mus musculus
tgtgaaatttgatccgtaccacgac

SEQ ID NO: 829348 - DNA, 25 bp, Mus musculus
tgtgaacaagccaggcactttcttc

SEQ ID NO: 829349 - DNA, 25 bp, Mus musculus
tgtgaacaagcctggcactttcttc

SEQ ID NO: 829350 - DNA, 25 bp, Mus musculus
tgtgaacaaggacattaccgagcag

SEQ ID NO: 829351 - DNA, 25 bp, Mus musculus
tgtgaacaaggagattaccgagcag

SEQ ID NO: 829352 - DNA, 25 bp, Mus musculus
tgtgaacacagaaggctccttccat

SEQ ID NO: 829353 - DNA, 25 bp, Mus musculus
tgtgaacacagatggctccttccat

SEQ ID NO: 829354 - DNA, 25 bp, Mus musculus
tgtgaacaccggagcggagctcacc

SEQ ID NO: 829355 - DNA, 25 bp, Mus musculus
tgtgaacaccggtgcggagctcacc

SEQ ID NO: 829356 - DNA, 25 bp, Mus musculus
tgtgaacacgacctgaaagattcgg

SEQ ID NO: 829357 - DNA, 25 bp, Mus musculus
tgtgaacacgacgtgaaagattcgg

SEQ ID NO: 829358 - DNA, 25 bp, Mus musculus
tgtgaacactctaaagacactcatc

SEQ ID NO: 829359 - DNA, 25 bp, Mus musculus
tgtgaacactcttaagacactcatc

SEQ ID NO: 829360 - DNA, 25 bp, Mus musculus
tgtgaacagttcctgggcaagaacg

SEQ ID NO: 829361 - DNA, 25 bp, Mus musculus
tgtgaacagttcgtgggcaagaacg

SEQ ID NO: 829362 - DNA, 25 bp, Mus musculus
tgtgaacatcccaagagtactccat

SEQ ID NO: 829363 - DNA, 25 bp, Mus musculus
tgtgaacatccctagagtactccat

SEQ ID NO: 829364 - DNA, 25 bp, Mus musculus
tgtgaacatctacagaaaaggaggg

SEQ ID NO: 829365 - DNA, 25 bp, Mus musculus
tgtgaacatctagagaaaaggaggg

SEQ ID NO: 829366 - DNA, 25 bp, Mus musculus
tgtgaacatggcaacgcctcatcgt

SEQ ID NO: 829367 - DNA, 25 bp, Mus musculus
tgtgaacatggctacgcctcatcgt

SEQ ID NO: 829368 - DNA, 25 bp, Mus musculus
tgtgaacatggtcgagtttgctgta

SEQ ID NO: 829369 - DNA, 25 bp, Mus musculus
tgtgaacatggtggagtttgctgta

SEQ ID NO: 829370 - DNA, 25 bp, Mus musculus
tgtgaaccaagccaagacatataga

SEQ ID NO: 829371 - DNA, 25 bp, Mus musculus
tgtgaaccaagcgaagacatataga

SEQ ID NO: 829372 - DNA, 25 bp, Mus musculus
tgtgaaccacaacaataacccgtat

SEQ ID NO: 829373 - DNA, 25 bp, Mus musculus
tgtgaaccacaagaataacccgtat

SEQ ID NO: 829374 - DNA, 25 bp, Mus musculus
tgtgaaccaggaaggcagtgactag

SEQ ID NO: 829375 - DNA, 25 bp, Mus musculus
tgtgaaccaggatggcagtgactag

SEQ ID NO: 829376 - DNA, 25 bp, Mus musculus
tgtgaaccatgaatctctgaaggga

SEQ ID NO: 829377 - DNA, 25 bp, Mus musculus
tgtgaaccatgattctctgaaggga

SEQ ID NO: 829378 - DNA, 25 bp, Mus musculus
tgtgaacccagtcgagttctgccgc

SEQ ID NO: 829379 - DNA, 25 bp, Mus musculus
tgtgaacccagtggagttctgccgc

SEQ ID NO: 829380 - DNA, 25 bp, Mus musculus
tgtgaacccctgagagcccaatccc

SEQ ID NO: 829381 - DNA, 25 bp, Mus musculus
tgtgaacccctgtgagcccaatccc

SEQ ID NO: 829382 - DNA, 25 bp, Mus musculus
tgtgaaccgagccaacaatggactc

SEQ ID NO: 829383 - DNA, 25 bp, Mus musculus
tgtgaaccgagcgaacaatggactc

SEQ ID NO: 829384 - DNA, 25 bp, Mus musculus
tgtgaaccgcatctctccgggagct

SEQ ID NO: 829385 - DNA, 25 bp, Mus musculus
tgtgaaccgcatgtctccgggagct

SEQ ID NO: 829386 - DNA, 25 bp, Mus musculus
tgtgaacctgtacttaaaggagaag

SEQ ID NO: 829387 - DNA, 25 bp, Mus musculus
tgtgaacctgtagttaaaggagaag

SEQ ID NO: 829388 - DNA, 25 bp, Mus musculus
tgtgaacgactacacacaagttgaa

SEQ ID NO: 829389 - DNA, 25 bp, Mus musculus
tgtgaacgactagacacaagttgaa

SEQ ID NO: 829390 - DNA, 25 bp, Mus musculus
tgtgaacgagtgagaagacttgaac

SEQ ID NO: 829391 - DNA, 25 bp, Mus musculus
tgtgaacgagtgtgaagacttgaac

SEQ ID NO: 829392 - DNA, 25 bp, Mus musculus
tgtgaacgccaacaactacaagaac

SEQ ID NO: 829393 - DNA, 25 bp, Mus musculus
tgtgaacgccaacgcttaccacgca

SEQ ID NO: 829394 - DNA, 25 bp, Mus musculus
tgtgaacgccaagaactacaagaac

SEQ ID NO: 829395 - DNA, 25 bp, Mus musculus
tgtgaacgccaaggcttaccacgca

SEQ ID NO: 829396 - DNA, 25 bp, Mus musculus
tgtgaacgccttcagagtaaagtct

SEQ ID NO: 829397 - DNA, 25 bp, Mus musculus
tgtgaacgccttgagagtaaagtct

SEQ ID NO: 829398 - DNA, 25 bp, Mus musculus
tgtgaacgcgacatcaacgagtgct

SEQ ID NO: 829399 - DNA, 25 bp, Mus musculus
tgtgaacgcgacttcaacgagtgct

SEQ ID NO: 829400 - DNA, 25 bp, Mus musculus
tgtgaacggcacaacaatcgaagga

SEQ ID NO: 829401 - DNA, 25 bp, Mus musculus
tgtgaacggcactacaatcgaagga

SEQ ID NO: 829402 - DNA, 25 bp, Mus musculus
tgtgaacgtgtgcagactgatgcct

SEQ ID NO: 829403 - DNA, 25 bp, Mus musculus
tgtgaacgtgtggagactgatgcct

SEQ ID NO: 829404 - DNA, 25 bp, Mus musculus
tgtgaactaaatcggcatacaacgg

SEQ ID NO: 829405 - DNA, 25 bp, Mus musculus
tgtgaactaaatgggcatacaacgg

SEQ ID NO: 829406 - DNA, 25 bp, Mus musculus
tgtgaactacagcatgcatttccgc

SEQ ID NO: 829407 - DNA, 25 bp, Mus musculus
tgtgaactacaggatgcatttccgc

SEQ ID NO: 829408 - DNA, 25 bp, Mus musculus
tgtgaactatatcgtagcacctgtg

SEQ ID NO: 829409 - DNA, 25 bp, Mus musculus
tgtgaactatatggtagcacctgtg

SEQ ID NO: 829410 - DNA, 25 bp, Mus musculus
tgtgaactatgacgaggagcctgac

SEQ ID NO: 829411 - DNA, 25 bp, Mus musculus
tgtgaactatgaggaggagcctgac

SEQ ID NO: 829412 - DNA, 25 bp, Mus musculus
tgtgaactatggcattcctgcccac

SEQ ID NO: 829413 - DNA, 25 bp, Mus musculus
tgtgaactatgggattcctgcccac

SEQ ID NO: 829414 - DNA, 25 bp, Mus musculus
tgtgaactcatcaacaagagtggag

SEQ ID NO: 829415 - DNA, 25 bp, Mus musculus
tgtgaactcatctacaagagtggag

SEQ ID NO: 829416 - DNA, 25 bp, Mus musculus
tgtgaactgcccaatgtgccctgca

SEQ ID NO: 829417 - DNA, 25 bp, Mus musculus
tgtgaactgcccattatacgtcgtg

SEQ ID NO: 829418 - DNA, 25 bp, Mus musculus
tgtgaactgccctatgtgccctgca

SEQ ID NO: 829419 - DNA, 25 bp, Mus musculus
tgtgaactgccctttatacgtcgtg

SEQ ID NO: 829420 - DNA, 25 bp, Mus musculus
tgtgaactgtccattccaggttcca

SEQ ID NO: 829421 - DNA, 25 bp, Mus musculus
tgtgaactgtcctttccaggttcca

SEQ ID NO: 829422 - DNA, 25 bp, Mus musculus
tgtgaactgttcacttcaccctctg

SEQ ID NO: 829423 - DNA, 25 bp, Mus musculus
tgtgaactgttctcttcaccctctg

SEQ ID NO: 829424 - DNA, 25 bp, Mus musculus
tgtgaacttgtaccacgagctgatg

SEQ ID NO: 829425 - DNA, 25 bp, Mus musculus
tgtgaacttgtagcacgagctgatg

SEQ ID NO: 829426 - DNA, 25 bp, Mus musculus
tgtgaactttcaattcatagaggac

SEQ ID NO: 829427 - DNA, 25 bp, Mus musculus
tgtgaactttcatttcatagaggac

SEQ ID NO: 829428 - DNA, 25 bp, Mus musculus
tgtgaagaaatgcatcgaaaactcc

SEQ ID NO: 829429 - DNA, 25 bp, Mus musculus
tgtgaagaaatggatcgaaaactcc

SEQ ID NO: 829430 - DNA, 25 bp, Mus musculus
tgtgaagaacagagcccaccccata

SEQ ID NO: 829431 - DNA, 25 bp, Mus musculus
tgtgaagaacagtgcccaccccata

SEQ ID NO: 829432 - DNA, 25 bp, Mus musculus
tgtgaagaacggacagagtggctaa

SEQ ID NO: 829433 - DNA, 25 bp, Mus musculus
tgtgaagaacggtcagagtggctaa

SEQ ID NO: 829434 - DNA, 25 bp, Mus musculus
tgtgaagaagacacagcacaaagtc

SEQ ID NO: 829435 - DNA, 25 bp, Mus musculus
tgtgaagaagactcagcacaaagtc

SEQ ID NO: 829436 - DNA, 25 bp, Mus musculus
tgtgaagaatcactggaactccact

SEQ ID NO: 829437 - DNA, 25 bp, Mus musculus
tgtgaagaatcagtggaactccact

SEQ ID NO: 829438 - DNA, 25 bp, Mus musculus
tgtgaagaatccctccaaaatgcca

SEQ ID NO: 829439 - DNA, 25 bp, Mus musculus
tgtgaagaatccgtccaaaatgcca

SEQ ID NO: 829440 - DNA, 25 bp, Mus musculus
tgtgaagaatggatctggcgacatg

SEQ ID NO: 829441 - DNA, 25 bp, Mus musculus
tgtgaagaatggttctggcgacatg

SEQ ID NO: 829442 - DNA, 25 bp, Mus musculus
tgtgaagacaggaatggtccccact

SEQ ID NO: 829443 - DNA, 25 bp, Mus musculus
tgtgaagacaggtatggtccccact

SEQ ID NO: 829444 - DNA, 25 bp, Mus musculus
tgtgaagacttgaacgggcctgcag

SEQ ID NO: 829445 - DNA, 25 bp, Mus musculus
tgtgaagacttgtacgggcctgcag

SEQ ID NO: 829446 - DNA, 25 bp, Mus musculus
tgtgaagagaatagctgaactttct

SEQ ID NO: 829447 - DNA, 25 bp, Mus musculus
tgtgaagagaattgctgaactttct

SEQ ID NO: 829448 - DNA, 25 bp, Mus musculus
tgtgaagagactcctgcagaatccg

SEQ ID NO: 829449 - DNA, 25 bp, Mus musculus
tgtgaagagactgctgcagaatccg

SEQ ID NO: 829450 - DNA, 25 bp, Mus musculus
tgtgaagagataccagtgccaggcc

SEQ ID NO: 829451 - DNA, 25 bp, Mus musculus
tgtgaagagatagcagtgccaggcc

SEQ ID NO: 829452 - DNA, 25 bp, Mus musculus
tgtgaagagctcctacttctgactg

SEQ ID NO: 829453 - DNA, 25 bp, Mus musculus
tgtgaagagctcgtacttctgactg

SEQ ID NO: 829454 - DNA, 25 bp, Mus musculus
tgtgaagagggacgagttctccacc

SEQ ID NO: 829455 - DNA, 25 bp, Mus musculus
tgtgaagagggaggagttctccacc

SEQ ID NO: 829456 - DNA, 25 bp, Mus musculus
tgtgaagatacaccagaaggccctg

SEQ ID NO: 829457 - DNA, 25 bp, Mus musculus
tgtgaagatacagcagaaggccctg

SEQ ID NO: 829458 - DNA, 25 bp, Mus musculus
tgtgaagatgacaaagagtgacgat

SEQ ID NO: 829459 - DNA, 25 bp, Mus musculus
tgtgaagatgactaagagtgacgat

SEQ ID NO: 829460 - DNA, 25 bp, Mus musculus
tgtgaagatgctcaactccctgctc

SEQ ID NO: 829461 - DNA, 25 bp, Mus musculus
tgtgaagatgctgaactccctgctc

SEQ ID NO: 829462 - DNA, 25 bp, Mus musculus
tgtgaagcagtacagctcttacaac

SEQ ID NO: 829463 - DNA, 25 bp, Mus musculus
tgtgaagcagtagagctcttacaac

SEQ ID NO: 829464 - DNA, 25 bp, Mus musculus
tgtgaagcagtgcaagcaacagctt

SEQ ID NO: 829465 - DNA, 25 bp, Mus musculus
tgtgaagcagtggaagcaacagctt

SEQ ID NO: 829466 - DNA, 25 bp, Mus musculus
tgtgaagcattacgccgacaaccga

SEQ ID NO: 829467 - DNA, 25 bp, Mus musculus
tgtgaagcattaggccgacaaccga

SEQ ID NO: 829468 - DNA, 25 bp, Mus musculus
tgtgaagccatcatcacccacttta

SEQ ID NO: 829469 - DNA, 25 bp, Mus musculus
tgtgaagccatcttcacccacttta

SEQ ID NO: 829470 - DNA, 25 bp, Mus musculus
tgtgaagcccaaacactaaaaaagg

SEQ ID NO: 829471 - DNA, 25 bp, Mus musculus
tgtgaagcccaatcactaaaaaagg

SEQ ID NO: 829472 - DNA, 25 bp, Mus musculus
tgtgaagcccgacgtcagcgtctac

SEQ ID NO: 829473 - DNA, 25 bp, Mus musculus
tgtgaagcccgaggtcagcgtctac

SEQ ID NO: 829474 - DNA, 25 bp, Mus musculus
tgtgaagccctgatacaactattgc

SEQ ID NO: 829475 - DNA, 25 bp, Mus musculus
tgtgaagccctgttacaactattgc

SEQ ID NO: 829476 - DNA, 25 bp, Mus musculus
tgtgaagcctagagacgtgggaaac

SEQ ID NO: 829477 - DNA, 25 bp, Mus musculus
tgtgaagcctagtgacgtgggaaac

SEQ ID NO: 829478 - DNA, 25 bp, Mus musculus
tgtgaagcctataagcaccaaggaa

SEQ ID NO: 829479 - DNA, 25 bp, Mus musculus
tgtgaagcctattagcaccaaggaa

SEQ ID NO: 829480 - DNA, 25 bp, Mus musculus
tgtgaagcgacaacctcccaggctt

SEQ ID NO: 829481 - DNA, 25 bp, Mus musculus
tgtgaagcgacatcctcccaggctt

SEQ ID NO: 829482 - DNA, 25 bp, Mus musculus
tgtgaagctcaacggcgtagttctc

SEQ ID NO: 829483 - DNA, 25 bp, Mus musculus
tgtgaagctcaagggcgtagttctc

SEQ ID NO: 829484 - DNA, 25 bp, Mus musculus
tgtgaagctgaccacaatgagtgcc

SEQ ID NO: 829485 - DNA, 25 bp, Mus musculus
tgtgaagctgacgacaatgagtgcc

SEQ ID NO: 829486 - DNA, 25 bp, Mus musculus
tgtgaagctgctacaagcaatcgta

SEQ ID NO: 829487 - DNA, 25 bp, Mus musculus
tgtgaagctgcttcaagcaatcgta

SEQ ID NO: 829488 - DNA, 25 bp, Mus musculus
tgtgaagcttaacctcctgatgata

SEQ ID NO: 829489 - DNA, 25 bp, Mus musculus
tgtgaagcttaagctcctgatgata

SEQ ID NO: 829490 - DNA, 25 bp, Mus musculus
tgtgaaggagaaagcctcgaatggt

SEQ ID NO: 829491 - DNA, 25 bp, Mus musculus
tgtgaaggagaatgcctcgaatggt

SEQ ID NO: 829492 - DNA, 25 bp, Mus musculus
tgtgaaggaggcacttgtggacaaa

SEQ ID NO: 829493 - DNA, 25 bp, Mus musculus
tgtgaaggaggctcttgtggacaaa

SEQ ID NO: 829494 - DNA, 25 bp, Mus musculus
tgtgaaggatataacatcctgctgc

SEQ ID NO: 829495 - DNA, 25 bp, Mus musculus
tgtgaaggatattacatcctgctgc

SEQ ID NO: 829496 - DNA, 25 bp, Mus musculus
tgtgaaggatggcttcccagagtct

SEQ ID NO: 829497 - DNA, 25 bp, Mus musculus
tgtgaaggatgggttcccagagtct

SEQ ID NO: 829498 - DNA, 25 bp, Mus musculus
tgtgaaggccagaggccttgcagca

SEQ ID NO: 829499 - DNA, 25 bp, Mus musculus
tgtgaaggccagtggccttgcagca

SEQ ID NO: 829500 - DNA, 25 bp, Mus musculus
tgtgaaggcgacatgtacaatgact

SEQ ID NO: 829501 - DNA, 25 bp, Mus musculus
tgtgaaggcgacttgtacaatgact

SEQ ID NO: 829502 - DNA, 25 bp, Mus musculus
tgtgaaggcgagatccatgaaggac

SEQ ID NO: 829503 - DNA, 25 bp, Mus musculus
tgtgaaggcgagttccatgaaggac

SEQ ID NO: 829504 - DNA, 25 bp, Mus musculus
tgtgaaggctgtcgtggtgcccgct

SEQ ID NO: 829505 - DNA, 25 bp, Mus musculus
tgtgaaggctgtggtggtgcccgct

SEQ ID NO: 829506 - DNA, 25 bp, Mus musculus
tgtgaagggagaaaagcttactcgc

SEQ ID NO: 829507 - DNA, 25 bp, Mus musculus
tgtgaagggagataagcttactcgc

SEQ ID NO: 829508 - DNA, 25 bp, Mus musculus
tgtgaaggtacactcatcagagctg

SEQ ID NO: 829509 - DNA, 25 bp, Mus musculus
tgtgaaggtacagtcatcagagctg

SEQ ID NO: 829510 - DNA, 25 bp, Mus musculus
tgtgaaggtcccagaagagttactc

SEQ ID NO: 829511 - DNA, 25 bp, Mus musculus
tgtgaaggtccctgaagagttactc

SEQ ID NO: 829512 - DNA, 25 bp, Mus musculus
tgtgaaggtctcataccagctagaa

SEQ ID NO: 829513 - DNA, 25 bp, Mus musculus
tgtgaaggtctcttaccagctagaa

SEQ ID NO: 829514 - DNA, 25 bp, Mus musculus
tgtgaaggttcactcattccagatg

SEQ ID NO: 829515 - DNA, 25 bp, Mus musculus
tgtgaaggttcagtcattccagatg

SEQ ID NO: 829516 - DNA, 25 bp, Mus musculus
tgtgaagtgaccaatgacaagaccc

SEQ ID NO: 829517 - DNA, 25 bp, Mus musculus
tgtgaagtgacctatgacaagaccc

SEQ ID NO: 829518 - DNA, 25 bp, Mus musculus
tgtgaagtgtgcatgtccccatcag

SEQ ID NO: 829519 - DNA, 25 bp, Mus musculus
tgtgaagtgtgcttgtccccatcag

SEQ ID NO: 829520 - DNA, 25 bp, Mus musculus
tgtgaagttactcatgaaaactcac

SEQ ID NO: 829521 - DNA, 25 bp, Mus musculus
tgtgaagttactgatgaaaactcac

SEQ ID NO: 829522 - DNA, 25 bp, Mus musculus
tgtgaagttaggcaggattctcgcc

SEQ ID NO: 829523 - DNA, 25 bp, Mus musculus
tgtgaagttagggaggattctcgcc

SEQ ID NO: 829524 - DNA, 25 bp, Mus musculus
tgtgaagttggacctccgagaatag

SEQ ID NO: 829525 - DNA, 25 bp, Mus musculus
tgtgaagttggagctccgagaatag

SEQ ID NO: 829526 - DNA, 25 bp, Mus musculus
tgtgaagttgttcggacgatgcaac

SEQ ID NO: 829527 - DNA, 25 bp, Mus musculus
tgtgaagttgttgggacgatgcaac

SEQ ID NO: 829528 - DNA, 25 bp, Mus musculus
tgtgaatacccacccgcctgtaatg

SEQ ID NO: 829529 - DNA, 25 bp, Mus musculus
tgtgaatacccagccgcctgtaatg

SEQ ID NO: 829530 - DNA, 25 bp, Mus musculus
tgtgaatagcaacaggaactcgcac

SEQ ID NO: 829531 - DNA, 25 bp, Mus musculus
tgtgaatagcaagaggaactcgcac

SEQ ID NO: 829532 - DNA, 25 bp, Mus musculus
tgtgaatatcagcagtgcccttcgg

SEQ ID NO: 829533 - DNA, 25 bp, Mus musculus
tgtgaatatcaggagtgcccttcgg

SEQ ID NO: 829534 - DNA, 25 bp, Mus musculus
tgtgaatatctcagcctgccagcac

SEQ ID NO: 829535 - DNA, 25 bp, Mus musculus
tgtgaatatctctgcctgccagcac

SEQ ID NO: 829536 - DNA, 25 bp, Mus musculus
tgtgaatattaccaccgcctgaaga

SEQ ID NO: 829537 - DNA, 25 bp, Mus musculus
tgtgaatattacgaccgcctgaaga

SEQ ID NO: 829538 - DNA, 25 bp, Mus musculus
tgtgaatcagtactctggaaggcac

SEQ ID NO: 829539 - DNA, 25 bp, Mus musculus
tgtgaatcagtagtctggaaggcac

SEQ ID NO: 829540 - DNA, 25 bp, Mus musculus
tgtgaatctaagactgaagttggct

SEQ ID NO: 829541 - DNA, 25 bp, Mus musculus
tgtgaatctaagtctgaagttggct

SEQ ID NO: 829542 - DNA, 25 bp, Mus musculus
tgtgaatctagacctgcctctcgat

SEQ ID NO: 829543 - DNA, 25 bp, Mus musculus
tgtgaatctagagctgcctctcgat

SEQ ID NO: 829544 - DNA, 25 bp, Mus musculus
tgtgaatctcatagcactgcagagg

SEQ ID NO: 829545 - DNA, 25 bp, Mus musculus
tgtgaatctcattgcactgcagagg

SEQ ID NO: 829546 - DNA, 25 bp, Mus musculus
tgtgaatgacaacctgcccacgttc

SEQ ID NO: 829547 - DNA, 25 bp, Mus musculus
tgtgaatgacaactcctggtcccct

SEQ ID NO: 829548 - DNA, 25 bp, Mus musculus
tgtgaatgacaagctgcccacgttc

SEQ ID NO: 829549 - DNA, 25 bp, Mus musculus
tgtgaatgacaagtcctggtcccct

SEQ ID NO: 829550 - DNA, 25 bp, Mus musculus
tgtgaatgacatagacatctttgag

SEQ ID NO: 829551 - DNA, 25 bp, Mus musculus
tgtgaatgacattgacatctttgag

SEQ ID NO: 829552 - DNA, 25 bp, Mus musculus
tgtgaatgagtgactaggcaggacc

SEQ ID NO: 829553 - DNA, 25 bp, Mus musculus
tgtgaatgagtgcatctccgggcaa

SEQ ID NO: 829554 - DNA, 25 bp, Mus musculus
tgtgaatgagtggatctccgggcaa

SEQ ID NO: 829555 - DNA, 25 bp, Mus musculus
tgtgaatgagtgtctaggcaggacc

SEQ ID NO: 829556 - DNA, 25 bp, Mus musculus
tgtgaatgattgcaacttccaagcc

SEQ ID NO: 829557 - DNA, 25 bp, Mus musculus
tgtgaatgattggaacttccaagcc

SEQ ID NO: 829558 - DNA, 25 bp, Mus musculus
tgtgaatgcaaacctctgccaggct

SEQ ID NO: 829559 - DNA, 25 bp, Mus musculus
tgtgaatgcaaagctctgccaggct

SEQ ID NO: 829560 - DNA, 25 bp, Mus musculus
tgtgaatgggaaacgctactttgaa

SEQ ID NO: 829561 - DNA, 25 bp, Mus musculus
tgtgaatgggaatcgctactttgaa

SEQ ID NO: 829562 - DNA, 25 bp, Mus musculus
tgtgaattatgaccccatggatgaa

SEQ ID NO: 829563 - DNA, 25 bp, Mus musculus
tgtgaattatgagcccatggatgaa

SEQ ID NO: 829564 - DNA, 25 bp, Mus musculus
tgtgaattcagactacgaactcacc

SEQ ID NO: 829565 - DNA, 25 bp, Mus musculus
tgtgaattcagagtacgaactcacc

SEQ ID NO: 829566 - DNA, 25 bp, Mus musculus
tgtgaatttcgactttctcggagtc

SEQ ID NO: 829567 - DNA, 25 bp, Mus musculus
tgtgaatttcgagtttctcggagtc

SEQ ID NO: 829568 - DNA, 25 bp, Mus musculus
tgtgaatttggtcgctgaaaacctc

SEQ ID NO: 829569 - DNA, 25 bp, Mus musculus
tgtgaatttggtggctgaaaacctc

SEQ ID NO: 829570 - DNA, 25 bp, Mus musculus
tgtgacaaacgaagcagcgactatt

SEQ ID NO: 829571 - DNA, 25 bp, Mus musculus
tgtgacaaacgatgcagcgactatt

SEQ ID NO: 829572 - DNA, 25 bp, Mus musculus
tgtgacaaatacaggagaaatatca

SEQ ID NO: 829573 - DNA, 25 bp, Mus musculus
tgtgacaaatactggagaaatatca

SEQ ID NO: 829574 - DNA, 25 bp, Mus musculus
tgtgacaaatttagtggccatccca

SEQ ID NO: 829575 - DNA, 25 bp, Mus musculus
tgtgacaaattttgtggccatccca

SEQ ID NO: 829576 - DNA, 25 bp, Mus musculus
tgtgacaacacactcaacggaggct

SEQ ID NO: 829577 - DNA, 25 bp, Mus musculus
tgtgacaacacactttctgatggct

SEQ ID NO: 829578 - DNA, 25 bp, Mus musculus
tgtgacaacacagtcaacggaggct

SEQ ID NO: 829579 - DNA, 25 bp, Mus musculus
tgtgacaacacagtttctgatggct

SEQ ID NO: 829580 - DNA, 25 bp, Mus musculus
tgtgacaacatcacaacatgctgag

SEQ ID NO: 829581 - DNA, 25 bp, Mus musculus
tgtgacaacatctcaacatgctgag

SEQ ID NO: 829582 - DNA, 25 bp, Mus musculus
tgtgacaaccagagggattgccagc

SEQ ID NO: 829583 - DNA, 25 bp, Mus musculus
tgtgacaaccagtgggattgccagc

SEQ ID NO: 829584 - DNA, 25 bp, Mus musculus
tgtgacaactgcaacgagtggttcc

SEQ ID NO: 829585 - DNA, 25 bp, Mus musculus
tgtgacaactgctacgagtggttcc

SEQ ID NO: 829586 - DNA, 25 bp, Mus musculus
tgtgacaactgtccccagaaagata

SEQ ID NO: 829587 - DNA, 25 bp, Mus musculus
tgtgacaactgtgcccagaaagata

SEQ ID NO: 829588 - DNA, 25 bp, Mus musculus
tgtgacaagcagaacggcaactacc

SEQ ID NO: 829589 - DNA, 25 bp, Mus musculus
tgtgacaagcagtacggcaactacc

SEQ ID NO: 829590 - DNA, 25 bp, Mus musculus
tgtgacaagctgctcaaggaagttc

SEQ ID NO: 829591 - DNA, 25 bp, Mus musculus
tgtgacaagctggtcaaggaagttc

SEQ ID NO: 829592 - DNA, 25 bp, Mus musculus
tgtgacaatacacgctgccacacca

SEQ ID NO: 829593 - DNA, 25 bp, Mus musculus
tgtgacaatacaggctgccacacca

SEQ ID NO: 829594 - DNA, 25 bp, Mus musculus
tgtgacaatgtgctacttatctgga

SEQ ID NO: 829595 - DNA, 25 bp, Mus musculus
tgtgacaatgtggtacttatctgga

SEQ ID NO: 829596 - DNA, 25 bp, Mus musculus
tgtgacacagtgcagcaatacatct

SEQ ID NO: 829597 - DNA, 25 bp, Mus musculus
tgtgacacagtggagcaatacatct

SEQ ID NO: 829598 - DNA, 25 bp, Mus musculus
tgtgacacatccctacatagtggag

SEQ ID NO: 829599 - DNA, 25 bp, Mus musculus
tgtgacacatccgtacatagtggag

SEQ ID NO: 829600 - DNA, 25 bp, Mus musculus
tgtgacaccaatcctgtattgcctc

SEQ ID NO: 829601 - DNA, 25 bp, Mus musculus
tgtgacaccaatgctgtattgcctc

SEQ ID NO: 829602 - DNA, 25 bp, Mus musculus
tgtgacaccacaacctcgaaggatc

SEQ ID NO: 829603 - DNA, 25 bp, Mus musculus
tgtgacaccacatcctcgaaggatc

SEQ ID NO: 829604 - DNA, 25 bp, Mus musculus
tgtgacacgcctccctaactagaga

SEQ ID NO: 829605 - DNA, 25 bp, Mus musculus
tgtgacacgcctgcctaactagaga

SEQ ID NO: 829606 - DNA, 25 bp, Mus musculus
tgtgacactgtcctctgggcgaaga

SEQ ID NO: 829607 - DNA, 25 bp, Mus musculus
tgtgacactgtcgtctgggcgaaga

SEQ ID NO: 829608 - DNA, 25 bp, Mus musculus
tgtgacacttttcatcctgtgtggg

SEQ ID NO: 829609 - DNA, 25 bp, Mus musculus
tgtgacacttttgatcctgtgtggg

SEQ ID NO: 829610 - DNA, 25 bp, Mus musculus
tgtgacagaaagacaaccatggttg

SEQ ID NO: 829611 - DNA, 25 bp, Mus musculus
tgtgacagaaagtcaaccatggttg

SEQ ID NO: 829612 - DNA, 25 bp, Mus musculus
tgtgacagaaggagtaacagacctc

SEQ ID NO: 829613 - DNA, 25 bp, Mus musculus
tgtgacagaaggtgtaacagacctc

SEQ ID NO: 829614 - DNA, 25 bp, Mus musculus
tgtgacagagacaatgctgacagcc

SEQ ID NO: 829615 - DNA, 25 bp, Mus musculus
tgtgacagagactatgctgacagcc

SEQ ID NO: 829616 - DNA, 25 bp, Mus musculus
tgtgacagagggagaactagctagc

SEQ ID NO: 829617 - DNA, 25 bp, Mus musculus
tgtgacagagggtgaactagctagc

SEQ ID NO: 829618 - DNA, 25 bp, Mus musculus
tgtgacagcctcaacaacagatgcg

SEQ ID NO: 829619 - DNA, 25 bp, Mus musculus
tgtgacagcctctacaacagatgcg

SEQ ID NO: 829620 - DNA, 25 bp, Mus musculus
tgtgacagctacagccatgatgatt

SEQ ID NO: 829621 - DNA, 25 bp, Mus musculus
tgtgacagctactgccatgatgatt

SEQ ID NO: 829622 - DNA, 25 bp, Mus musculus
tgtgacaggagacctgccatggcct

SEQ ID NO: 829623 - DNA, 25 bp, Mus musculus
tgtgacaggagagctgccatggcct

SEQ ID NO: 829624 - DNA, 25 bp, Mus musculus
tgtgacaggtaacgagaacttctcc

SEQ ID NO: 829625 - DNA, 25 bp, Mus musculus
tgtgacaggtaactgcccagctctg

SEQ ID NO: 829626 - DNA, 25 bp, Mus musculus
tgtgacaggtaaggagaacttctcc

SEQ ID NO: 829627 - DNA, 25 bp, Mus musculus
tgtgacaggtaagtgcccagctctg

SEQ ID NO: 829628 - DNA, 25 bp, Mus musculus
tgtgacagtcatcatcagggcctga

SEQ ID NO: 829629 - DNA, 25 bp, Mus musculus
tgtgacagtcatgatcagggcctga

SEQ ID NO: 829630 - DNA, 25 bp, Mus musculus
tgtgacagtggcatacacctcaact

SEQ ID NO: 829631 - DNA, 25 bp, Mus musculus
tgtgacagtggcttacacctcaact

SEQ ID NO: 829632 - DNA, 25 bp, Mus musculus
tgtgacatatcactgtaaggaaata

SEQ ID NO: 829633 - DNA, 25 bp, Mus musculus
tgtgacatatcagtgtaaggaaata

SEQ ID NO: 829634 - DNA, 25 bp, Mus musculus
tgtgacatcaacaacaacgagtgtg

SEQ ID NO: 829635 - DNA, 25 bp, Mus musculus
tgtgacatcaactacaacgagtgtg

SEQ ID NO: 829636 - DNA, 25 bp, Mus musculus
tgtgacatccaaaggaccggaacct

SEQ ID NO: 829637 - DNA, 25 bp, Mus musculus
tgtgacatccaatggaccggaacct

SEQ ID NO: 829638 - DNA, 25 bp, Mus musculus
tgtgacatcctcagatgacccttgg

SEQ ID NO: 829639 - DNA, 25 bp, Mus musculus
tgtgacatcctctgatgacccttgg

SEQ ID NO: 829640 - DNA, 25 bp, Mus musculus
tgtgacatcctgcacagcagtgatg

SEQ ID NO: 829641 - DNA, 25 bp, Mus musculus
tgtgacatcctggacagcagtgatg

SEQ ID NO: 829642 - DNA, 25 bp, Mus musculus
tgtgacatgccaactctgctttggt

SEQ ID NO: 829643 - DNA, 25 bp, Mus musculus
tgtgacatgccatctctgctttggt

SEQ ID NO: 829644 - DNA, 25 bp, Mus musculus
tgtgacatgctgattcctgcgcagc

SEQ ID NO: 829645 - DNA, 25 bp, Mus musculus
tgtgacatgctgtttcctgcgcagc

SEQ ID NO: 829646 - DNA, 25 bp, Mus musculus
tgtgacattcgcaactgcactcagg

SEQ ID NO: 829647 - DNA, 25 bp, Mus musculus
tgtgacattcgctactgcactcagg

SEQ ID NO: 829648 - DNA, 25 bp, Mus musculus
tgtgacattctaaccattcttcggg

SEQ ID NO: 829649 - DNA, 25 bp, Mus musculus
tgtgacattctatccattcttcggg

SEQ ID NO: 829650 - DNA, 25 bp, Mus musculus
tgtgacattgttcgacagttctacc

SEQ ID NO: 829651 - DNA, 25 bp, Mus musculus
tgtgacattgttggacagttctacc

SEQ ID NO: 829652 - DNA, 25 bp, Mus musculus
tgtgacatttcccataccagacctt

SEQ ID NO: 829653 - DNA, 25 bp, Mus musculus
tgtgacatttccgataccagacctt

SEQ ID NO: 829654 - DNA, 25 bp, Mus musculus
tgtgaccaaagtcgccgtgaagatg

SEQ ID NO: 829655 - DNA, 25 bp, Mus musculus
tgtgaccaaagtggccgtgaagatg

SEQ ID NO: 829656 - DNA, 25 bp, Mus musculus
tgtgaccaaataagtccctttcccc

SEQ ID NO: 829657 - DNA, 25 bp, Mus musculus
tgtgaccaaatatgtccctttcccc

SEQ ID NO: 829658 - DNA, 25 bp, Mus musculus
tgtgaccaattccaaggtgaaattt

SEQ ID NO: 829659 - DNA, 25 bp, Mus musculus
tgtgaccaattcgaaggtgaaattt

SEQ ID NO: 829660 - DNA, 25 bp, Mus musculus
tgtgaccacagcagtatcagaagtc

SEQ ID NO: 829661 - DNA, 25 bp, Mus musculus
tgtgaccacagctgtatcagaagtc

SEQ ID NO: 829662 - DNA, 25 bp, Mus musculus
tgtgaccacagtagcatcaaccacc

SEQ ID NO: 829663 - DNA, 25 bp, Mus musculus
tgtgaccacagttgcatcaaccacc

SEQ ID NO: 829664 - DNA, 25 bp, Mus musculus
tgtgaccacataagaaacctgccag

SEQ ID NO: 829665 - DNA, 25 bp, Mus musculus
tgtgaccacatatgaaacctgccag

SEQ ID NO: 829666 - DNA, 25 bp, Mus musculus
tgtgaccagaccagagcatgtgttg

SEQ ID NO: 829667 - DNA, 25 bp, Mus musculus
tgtgaccagacctgagcatgtgttg

SEQ ID NO: 829668 - DNA, 25 bp, Mus musculus
tgtgaccagcacaagtgtcaaccgc

SEQ ID NO: 829669 - DNA, 25 bp, Mus musculus
tgtgaccagcactagtgtcaaccgc

SEQ ID NO: 829670 - DNA, 25 bp, Mus musculus
tgtgaccagcatagtaagaccttac

SEQ ID NO: 829671 - DNA, 25 bp, Mus musculus
tgtgaccagcattgtaagaccttac

SEQ ID NO: 829672 - DNA, 25 bp, Mus musculus
tgtgaccagggcatcgagacctcac

SEQ ID NO: 829673 - DNA, 25 bp, Mus musculus
tgtgaccagggcttcgagacctcac

SEQ ID NO: 829674 - DNA, 25 bp, Mus musculus
tgtgaccagtagagccagattatgc

SEQ ID NO: 829675 - DNA, 25 bp, Mus musculus
tgtgaccagtagtgccagattatgc

SEQ ID NO: 829676 - DNA, 25 bp, Mus musculus
tgtgaccatcacaggctcaccggtc

SEQ ID NO: 829677 - DNA, 25 bp, Mus musculus
tgtgaccatcactggctcaccggtc

SEQ ID NO: 829678 - DNA, 25 bp, Mus musculus
tgtgaccatcatctacaagggccgc

SEQ ID NO: 829679 - DNA, 25 bp, Mus musculus
tgtgaccatcatgtacaagggccgc

SEQ ID NO: 829680 - DNA, 25 bp, Mus musculus
tgtgaccatgtcaccctggcattag

SEQ ID NO: 829681 - DNA, 25 bp, Mus musculus
tgtgaccatgtctccctggcattag

SEQ ID NO: 829682 - DNA, 25 bp, Mus musculus
tgtgaccatgtgcacgtgtatggca

SEQ ID NO: 829683 - DNA, 25 bp, Mus musculus
tgtgaccatgtggacgtgtatggca

SEQ ID NO: 829684 - DNA, 25 bp, Mus musculus
tgtgaccattatagccacaactact

SEQ ID NO: 829685 - DNA, 25 bp, Mus musculus
tgtgaccattattgccacaactact

SEQ ID NO: 829686 - DNA, 25 bp, Mus musculus
tgtgacccaaggatttatcagatcc

SEQ ID NO: 829687 - DNA, 25 bp, Mus musculus
tgtgacccaaggttttatcagatcc

SEQ ID NO: 829688 - DNA, 25 bp, Mus musculus
tgtgacccagcaagctctagtgaga

SEQ ID NO: 829689 - DNA, 25 bp, Mus musculus
tgtgacccagcatgctctagtgaga

SEQ ID NO: 829690 - DNA, 25 bp, Mus musculus
tgtgacccagccaagaaagatgagc

SEQ ID NO: 829691 - DNA, 25 bp, Mus musculus
tgtgacccagcctagaaagatgagc

SEQ ID NO: 829692 - DNA, 25 bp, Mus musculus
tgtgacccaggaaatgaacttgagg

SEQ ID NO: 829693 - DNA, 25 bp, Mus musculus
tgtgacccaggatatgaacttgagg

SEQ ID NO: 829694 - DNA, 25 bp, Mus musculus
tgtgacccatgcatattaccgagat

SEQ ID NO: 829695 - DNA, 25 bp, Mus musculus
tgtgacccatgcttattaccgagat

SEQ ID NO: 829696 - DNA, 25 bp, Mus musculus
tgtgacccccttacctgtgatacgc

SEQ ID NO: 829697 - DNA, 25 bp, Mus musculus
tgtgaccccctttcctgtgatacgc

SEQ ID NO: 829698 - DNA, 25 bp, Mus musculus
tgtgacccgatgataccagccaagt

SEQ ID NO: 829699 - DNA, 25 bp, Mus musculus
tgtgacccgatgttaccagccaagt

SEQ ID NO: 829700 - DNA, 25 bp, Mus musculus
tgtgacccgccaacagctggatggt

SEQ ID NO: 829701 - DNA, 25 bp, Mus musculus
tgtgacccgccactggcgagtcatg

SEQ ID NO: 829702 - DNA, 25 bp, Mus musculus
tgtgacccgccagtggcgagtcatg

SEQ ID NO: 829703 - DNA, 25 bp, Mus musculus
tgtgacccgccatcagctggatggt

SEQ ID NO: 829704 - DNA, 25 bp, Mus musculus
tgtgacccgtatcggcatatatgtg

SEQ ID NO: 829705 - DNA, 25 bp, Mus musculus
tgtgacccgtatgggcatatatgtg

SEQ ID NO: 829706 - DNA, 25 bp, Mus musculus
tgtgaccctaaacagagcagcagtg

SEQ ID NO: 829707 - DNA, 25 bp, Mus musculus
tgtgaccctaaagagagcagcagtg

SEQ ID NO: 829708 - DNA, 25 bp, Mus musculus
tgtgaccctaggacaaattgtggct

SEQ ID NO: 829709 - DNA, 25 bp, Mus musculus
tgtgaccctaggtcaaattgtggct

SEQ ID NO: 829710 - DNA, 25 bp, Mus musculus
tgtgaccctggaccaagtgcgcttc

SEQ ID NO: 829711 - DNA, 25 bp, Mus musculus
tgtgaccctggagcaagtgcgcttc

SEQ ID NO: 829712 - DNA, 25 bp, Mus musculus
tgtgaccctttacttcccctaatgt

SEQ ID NO: 829713 - DNA, 25 bp, Mus musculus
tgtgaccctttagttcccctaatgt

SEQ ID NO: 829714 - DNA, 25 bp, Mus musculus
tgtgaccgacacaggcaagatgcag

SEQ ID NO: 829715 - DNA, 25 bp, Mus musculus
tgtgaccgacactggcaagatgcag

SEQ ID NO: 829716 - DNA, 25 bp, Mus musculus
tgtgaccgagatcacagatgacctg

SEQ ID NO: 829717 - DNA, 25 bp, Mus musculus
tgtgaccgagatgacagatgacctg

SEQ ID NO: 829718 - DNA, 25 bp, Mus musculus
tgtgaccgccaaaaaacttcgatgg

SEQ ID NO: 829719 - DNA, 25 bp, Mus musculus
tgtgaccgccaataaacttcgatgg

SEQ ID NO: 829720 - DNA, 25 bp, Mus musculus
tgtgaccgcctcactgtagctaagc

SEQ ID NO: 829721 - DNA, 25 bp, Mus musculus
tgtgaccgcctctctgtagctaagc

SEQ ID NO: 829722 - DNA, 25 bp, Mus musculus
tgtgaccgtcaacatttcagtagaa

SEQ ID NO: 829723 - DNA, 25 bp, Mus musculus
tgtgaccgtcaagatttcagtagaa

SEQ ID NO: 829724 - DNA, 25 bp, Mus musculus
tgtgaccgtgaacatgactgcaagg

SEQ ID NO: 829725 - DNA, 25 bp, Mus musculus
tgtgaccgtgaagatgactgcaagg

SEQ ID NO: 829726 - DNA, 25 bp, Mus musculus
tgtgaccgtgtaagagacagtgctt

SEQ ID NO: 829727 - DNA, 25 bp, Mus musculus
tgtgaccgtgtatgagacagtgctt

SEQ ID NO: 829728 - DNA, 25 bp, Mus musculus
tgtgaccgtttgcagaaaaccctca

SEQ ID NO: 829729 - DNA, 25 bp, Mus musculus
tgtgaccgtttggagaaaaccctca

SEQ ID NO: 829730 - DNA, 25 bp, Mus musculus
tgtgacctagaaatgctcacctttt

SEQ ID NO: 829731 - DNA, 25 bp, Mus musculus
tgtgacctagaattgctcacctttt

SEQ ID NO: 829732 - DNA, 25 bp, Mus musculus
tgtgacctcagaacaataaatgtga

SEQ ID NO: 829733 - DNA, 25 bp, Mus musculus
tgtgacctcagactctgacactgag

SEQ ID NO: 829734 - DNA, 25 bp, Mus musculus
tgtgacctcagagtctgacactgag

SEQ ID NO: 829735 - DNA, 25 bp, Mus musculus
tgtgacctcagatcaataaatgtga

SEQ ID NO: 829736 - DNA, 25 bp, Mus musculus
tgtgacctccacaaaaggaaatgag

SEQ ID NO: 829737 - DNA, 25 bp, Mus musculus
tgtgacctccactaaaggaaatgag

SEQ ID NO: 829738 - DNA, 25 bp, Mus musculus
tgtgacctccggcaagatcatcgag

SEQ ID NO: 829739 - DNA, 25 bp, Mus musculus
tgtgacctccgggaagatcatcgag

SEQ ID NO: 829740 - DNA, 25 bp, Mus musculus
tgtgacctctccatgcagtcagtgg

SEQ ID NO: 829741 - DNA, 25 bp, Mus musculus
tgtgacctctccttgcagtcagtgg

SEQ ID NO: 829742 - DNA, 25 bp, Mus musculus
tgtgacctctgtacagcccactgtt

SEQ ID NO: 829743 - DNA, 25 bp, Mus musculus
tgtgacctctgtcgatgacagcaac

SEQ ID NO: 829744 - DNA, 25 bp, Mus musculus
tgtgacctctgtggatgacagcaac

SEQ ID NO: 829745 - DNA, 25 bp, Mus musculus
tgtgacctctgttcagcccactgtt

SEQ ID NO: 829746 - DNA, 25 bp, Mus musculus
tgtgacctgaatccagaaagatgtc

SEQ ID NO: 829747 - DNA, 25 bp, Mus musculus
tgtgacctgaatgcagaaagatgtc

SEQ ID NO: 829748 - DNA, 25 bp, Mus musculus
tgtgacctgaccacaaagaaagtag

SEQ ID NO: 829749 - DNA, 25 bp, Mus musculus
tgtgacctgacctcaaagaaagtag

SEQ ID NO: 829750 - DNA, 25 bp, Mus musculus
tgtgacctgcatcgcttccaaccag

SEQ ID NO: 829751 - DNA, 25 bp, Mus musculus
tgtgacctgcatggcttccaaccag

SEQ ID NO: 829752 - DNA, 25 bp, Mus musculus
tgtgacctgcctcgatccagatgct

SEQ ID NO: 829753 - DNA, 25 bp, Mus musculus
tgtgacctgcctggatccagatgct

SEQ ID NO: 829754 - DNA, 25 bp, Mus musculus
tgtgacctgctcactctcacagagt

SEQ ID NO: 829755 - DNA, 25 bp, Mus musculus
tgtgacctgctctctctcacagagt

SEQ ID NO: 829756 - DNA, 25 bp, Mus musculus
tgtgaccttatcacccagaatccgg

SEQ ID NO: 829757 - DNA, 25 bp, Mus musculus
tgtgaccttatctcccagaatccgg

SEQ ID NO: 829758 - DNA, 25 bp, Mus musculus
tgtgaccttcccaaacaggcggtgc

SEQ ID NO: 829759 - DNA, 25 bp, Mus musculus
tgtgaccttccctaacaggcggtgc

SEQ ID NO: 829760 - DNA, 25 bp, Mus musculus
tgtgaccttctcacggattttgacg

SEQ ID NO: 829761 - DNA, 25 bp, Mus musculus
tgtgaccttctctcggattttgacg

SEQ ID NO: 829762 - DNA, 25 bp, Mus musculus
tgtgaccttgccattaaccgcgctc

SEQ ID NO: 829763 - DNA, 25 bp, Mus musculus
tgtgaccttgcctttaaccgcgctc

SEQ ID NO: 829764 - DNA, 25 bp, Mus musculus
tgtgacctttctagggacaggagca

SEQ ID NO: 829765 - DNA, 25 bp, Mus musculus
tgtgacctttcttgggacaggagca

SEQ ID NO: 829766 - DNA, 25 bp, Mus musculus
tgtgacgaacatctggaatctagac

SEQ ID NO: 829767 - DNA, 25 bp, Mus musculus
tgtgacgaacatgtggaatctagac

SEQ ID NO: 829768 - DNA, 25 bp, Mus musculus
tgtgacgaagtgcttactgactgct

SEQ ID NO: 829769 - DNA, 25 bp, Mus musculus
tgtgacgaagtggttactgactgct

SEQ ID NO: 829770 - DNA, 25 bp, Mus musculus
tgtgacgacattcaggacgacttag

SEQ ID NO: 829771 - DNA, 25 bp, Mus musculus
tgtgacgacattgaggacgacttag

SEQ ID NO: 829772 - DNA, 25 bp, Mus musculus
tgtgacgaccctactgttgtggcct

SEQ ID NO: 829773 - DNA, 25 bp, Mus musculus
tgtgacgacccttctgttgtggcct

SEQ ID NO: 829774 - DNA, 25 bp, Mus musculus
tgtgacgactacacagatggccgag

SEQ ID NO: 829775 - DNA, 25 bp, Mus musculus
tgtgacgactactcagatggccgag

SEQ ID NO: 829776 - DNA, 25 bp, Mus musculus
tgtgacgagaagctactacagaggt

SEQ ID NO: 829777 - DNA, 25 bp, Mus musculus
tgtgacgagaaggtactacagaggt

SEQ ID NO: 829778 - DNA, 25 bp, Mus musculus
tgtgacgaggagatccagtactgcc

SEQ ID NO: 829779 - DNA, 25 bp, Mus musculus
tgtgacgaggagttccagtactgcc

SEQ ID NO: 829780 - DNA, 25 bp, Mus musculus
tgtgacgatgagataatgctgacca

SEQ ID NO: 829781 - DNA, 25 bp, Mus musculus
tgtgacgatgagttaatgctgacca

SEQ ID NO: 829782 - DNA, 25 bp, Mus musculus
tgtgacgcattcaacattcccctca

SEQ ID NO: 829783 - DNA, 25 bp, Mus musculus
tgtgacgcattctacattcccctca

SEQ ID NO: 829784 - DNA, 25 bp, Mus musculus
tgtgacggctgtcaggcagttctct

SEQ ID NO: 829785 - DNA, 25 bp, Mus musculus
tgtgacggctgtgaggcagttctct

SEQ ID NO: 829786 - DNA, 25 bp, Mus musculus
tgtgacggcttacttgatgccctca

SEQ ID NO: 829787 - DNA, 25 bp, Mus musculus
tgtgacggcttagttgatgccctca

SEQ ID NO: 829788 - DNA, 25 bp, Mus musculus
tgtgacgtataaccgcgatgggtca

SEQ ID NO: 829789 - DNA, 25 bp, Mus musculus
tgtgacgtataagcgcgatgggtca

SEQ ID NO: 829790 - DNA, 25 bp, Mus musculus
tgtgacgtatctcttcaaacagctg

SEQ ID NO: 829791 - DNA, 25 bp, Mus musculus
tgtgacgtatctgttcaaacagctg

SEQ ID NO: 829792 - DNA, 25 bp, Mus musculus
tgtgacgtcatgatccaaataccag

SEQ ID NO: 829793 - DNA, 25 bp, Mus musculus
tgtgacgtcatgttccaaataccag

SEQ ID NO: 829794 - DNA, 25 bp, Mus musculus
tgtgacgtctgcatgtgcccctaca

SEQ ID NO: 829795 - DNA, 25 bp, Mus musculus
tgtgacgtctgcttgtgcccctaca

SEQ ID NO: 829796 - DNA, 25 bp, Mus musculus
tgtgacgtgccacctgagacgctct

SEQ ID NO: 829797 - DNA, 25 bp, Mus musculus
tgtgacgtgccagctgagacgctct

SEQ ID NO: 829798 - DNA, 25 bp, Mus musculus
tgtgacgtggtcaaaggacaggtcc

SEQ ID NO: 829799 - DNA, 25 bp, Mus musculus
tgtgacgtggtctaaggacaggtcc

SEQ ID NO: 829800 - DNA, 25 bp, Mus musculus
tgtgacgtgtagagcgtgacctcct

SEQ ID NO: 829801 - DNA, 25 bp, Mus musculus
tgtgacgtgtagtgcgtgacctcct

SEQ ID NO: 829802 - DNA, 25 bp, Mus musculus
tgtgacgtgtgcacagacgagctgc

SEQ ID NO: 829803 - DNA, 25 bp, Mus musculus
tgtgacgtgtgctcagacgagctgc

SEQ ID NO: 829804 - DNA, 25 bp, Mus musculus
tgtgactaccacacgggtgaaccac

SEQ ID NO: 829805 - DNA, 25 bp, Mus musculus
tgtgactaccactcgggtgaaccac

SEQ ID NO: 829806 - DNA, 25 bp, Mus musculus
tgtgactactccatacatgtggaca

SEQ ID NO: 829807 - DNA, 25 bp, Mus musculus
tgtgactactccttacatgtggaca

SEQ ID NO: 829808 - DNA, 25 bp, Mus musculus
tgtgactactgaaatcctggatgga

SEQ ID NO: 829809 - DNA, 25 bp, Mus musculus
tgtgactactgatatcctggatgga

SEQ ID NO: 829810 - DNA, 25 bp, Mus musculus
tgtgactactgcagagaagcggcct

SEQ ID NO: 829811 - DNA, 25 bp, Mus musculus
tgtgactactgctgagaagcggcct

SEQ ID NO: 829812 - DNA, 25 bp, Mus musculus
tgtgactatcaacgactcattcctg

SEQ ID NO: 829813 - DNA, 25 bp, Mus musculus
tgtgactatcaaggactcattcctg

SEQ ID NO: 829814 - DNA, 25 bp, Mus musculus
tgtgactatgacacaagtctccctt

SEQ ID NO: 829815 - DNA, 25 bp, Mus musculus
tgtgactatgactcaagtctccctt

SEQ ID NO: 829816 - DNA, 25 bp, Mus musculus
tgtgactatggcactgctcctgcag

SEQ ID NO: 829817 - DNA, 25 bp, Mus musculus
tgtgactatggctctgctcctgcag

SEQ ID NO: 829818 - DNA, 25 bp, Mus musculus
tgtgactatgggaaccacaggcgct

SEQ ID NO: 829819 - DNA, 25 bp, Mus musculus
tgtgactatgggtaccacaggcgct

SEQ ID NO: 829820 - DNA, 25 bp, Mus musculus
tgtgactcacgcatctctaaaggag

SEQ ID NO: 829821 - DNA, 25 bp, Mus musculus
tgtgactcacgcttctctaaaggag

SEQ ID NO: 829822 - DNA, 25 bp, Mus musculus
tgtgactccaacaagatggcgactg

SEQ ID NO: 829823 - DNA, 25 bp, Mus musculus
tgtgactccaactagatggcgactg

SEQ ID NO: 829824 - DNA, 25 bp, Mus musculus
tgtgactccacgctcccggagtagg

SEQ ID NO: 829825 - DNA, 25 bp, Mus musculus
tgtgactccacggtcccggagtagg

SEQ ID NO: 829826 - DNA, 25 bp, Mus musculus
tgtgactccctacagccctgtacaa

SEQ ID NO: 829827 - DNA, 25 bp, Mus musculus
tgtgactccctagagccctgtacaa

SEQ ID NO: 829828 - DNA, 25 bp, Mus musculus
tgtgactcctaacccagagaagttg

SEQ ID NO: 829829 - DNA, 25 bp, Mus musculus
tgtgactcctaagccagagaagttg

SEQ ID NO: 829830 - DNA, 25 bp, Mus musculus
tgtgactcgggactgaaaaccacca

SEQ ID NO: 829831 - DNA, 25 bp, Mus musculus
tgtgactcgggagtgaaaaccacca

SEQ ID NO: 829832 - DNA, 25 bp, Mus musculus
tgtgactctgccactgatgagcaga

SEQ ID NO: 829833 - DNA, 25 bp, Mus musculus
tgtgactctgcctctgatgagcaga

SEQ ID NO: 829834 - DNA, 25 bp, Mus musculus
tgtgactctgtgagcaagcccagca

SEQ ID NO: 829835 - DNA, 25 bp, Mus musculus
tgtgactctgtgtgcaagcccagca

SEQ ID NO: 829836 - DNA, 25 bp, Mus musculus
tgtgactcttctacctttcctagga

SEQ ID NO: 829837 - DNA, 25 bp, Mus musculus
tgtgactcttcttcctttcctagga

SEQ ID NO: 829838 - DNA, 25 bp, Mus musculus
tgtgactgaactctgaacgtgagct

SEQ ID NO: 829839 - DNA, 25 bp, Mus musculus
tgtgactgaactgtgaacgtgagct

SEQ ID NO: 829840 - DNA, 25 bp, Mus musculus
tgtgactgaagaaacacctgaactg

SEQ ID NO: 829841 - DNA, 25 bp, Mus musculus
tgtgactgaagatacacctgaactg

SEQ ID NO: 829842 - DNA, 25 bp, Mus musculus
tgtgactgagtaccgccttgatggc

SEQ ID NO: 829843 - DNA, 25 bp, Mus musculus
tgtgactgagtagcgccttgatggc

SEQ ID NO: 829844 - DNA, 25 bp, Mus musculus
tgtgactgatccagcctatgaagat

SEQ ID NO: 829845 - DNA, 25 bp, Mus musculus
tgtgactgatcctgcctatgaagat

SEQ ID NO: 829846 - DNA, 25 bp, Mus musculus
tgtgactgcaaaagatgcagagaga

SEQ ID NO: 829847 - DNA, 25 bp, Mus musculus
tgtgactgcaaatgatgcagagaga

SEQ ID NO: 829848 - DNA, 25 bp, Mus musculus
tgtgactgcaggcccggctttgacc

SEQ ID NO: 829849 - DNA, 25 bp, Mus musculus
tgtgactgcagggccggctttgacc

SEQ ID NO: 829850 - DNA, 25 bp, Mus musculus
tgtgactgcagtaccctagggcaag

SEQ ID NO: 829851 - DNA, 25 bp, Mus musculus
tgtgactgcagttccctagggcaag

SEQ ID NO: 829852 - DNA, 25 bp, Mus musculus
tgtgactgctaacacaccaggaggc

SEQ ID NO: 829853 - DNA, 25 bp, Mus musculus
tgtgactgctaagacaccaggaggc

SEQ ID NO: 829854 - DNA, 25 bp, Mus musculus
tgtgactgctatcatcccaacatgg

SEQ ID NO: 829855 - DNA, 25 bp, Mus musculus
tgtgactgctatgatcccaacatgg

SEQ ID NO: 829856 - DNA, 25 bp, Mus musculus
tgtgactgctgtcattcaggcgcca

SEQ ID NO: 829857 - DNA, 25 bp, Mus musculus
tgtgactgctgtgattcaggcgcca

SEQ ID NO: 829858 - DNA, 25 bp, Mus musculus
tgtgactgcttaccgtcccctcggt

SEQ ID NO: 829859 - DNA, 25 bp, Mus musculus
tgtgactgcttagcgtcccctcggt

SEQ ID NO: 829860 - DNA, 25 bp, Mus musculus
tgtgactggaccctccattctccat

SEQ ID NO: 829861 - DNA, 25 bp, Mus musculus
tgtgactggaccgtccattctccat

SEQ ID NO: 829862 - DNA, 25 bp, Mus musculus
tgtgactggcgcactggactgcaaa

SEQ ID NO: 829863 - DNA, 25 bp, Mus musculus
tgtgactggcgctctggactgcaaa

SEQ ID NO: 829864 - DNA, 25 bp, Mus musculus
tgtgactgtaccaggaaggaggccc

SEQ ID NO: 829865 - DNA, 25 bp, Mus musculus
tgtgactgtacctggaaggaggccc

SEQ ID NO: 829866 - DNA, 25 bp, Mus musculus
tgtgactgtcatcctgaatttctgc

SEQ ID NO: 829867 - DNA, 25 bp, Mus musculus
tgtgactgtcatgctgaatttctgc

SEQ ID NO: 829868 - DNA, 25 bp, Mus musculus
tgtgactgtgttcctgacgcctcgg

SEQ ID NO: 829869 - DNA, 25 bp, Mus musculus
tgtgactgtgttgctgacgcctcgg

SEQ ID NO: 829870 - DNA, 25 bp, Mus musculus
tgtgactgttcgatccctccaccga

SEQ ID NO: 829871 - DNA, 25 bp, Mus musculus
tgtgactgttcgttccctccaccga

SEQ ID NO: 829872 - DNA, 25 bp, Mus musculus
tgtgactgttgtcagcgagctcccc

SEQ ID NO: 829873 - DNA, 25 bp, Mus musculus
tgtgactgttgtgagcgagctcccc

SEQ ID NO: 829874 - DNA, 25 bp, Mus musculus
tgtgacttccaacaactacgtgacg

SEQ ID NO: 829875 - DNA, 25 bp, Mus musculus
tgtgacttccaagaactacgtgacg

SEQ ID NO: 829876 - DNA, 25 bp, Mus musculus
tgtgacttctaacagtaacactgga

SEQ ID NO: 829877 - DNA, 25 bp, Mus musculus
tgtgacttctaagagtaacactgga

SEQ ID NO: 829878 - DNA, 25 bp, Mus musculus
tgtgacttctccaacggaaggcccg

SEQ ID NO: 829879 - DNA, 25 bp, Mus musculus
tgtgacttctccacagcactcgcct

SEQ ID NO: 829880 - DNA, 25 bp, Mus musculus
tgtgacttctcctacggaaggcccg

SEQ ID NO: 829881 - DNA, 25 bp, Mus musculus
tgtgacttctcctcagcactcgcct

SEQ ID NO: 829882 - DNA, 25 bp, Mus musculus
tgtgacttgaagatccatggtttgg

SEQ ID NO: 829883 - DNA, 25 bp, Mus musculus
tgtgacttgaagttccatggtttgg

SEQ ID NO: 829884 - DNA, 25 bp, Mus musculus
tgtgacttggaaattccgaggacaa

SEQ ID NO: 829885 - DNA, 25 bp, Mus musculus
tgtgacttggaatttccgaggacaa

SEQ ID NO: 829886 - DNA, 25 bp, Mus musculus
tgtgacttggagcacattttcagaa

SEQ ID NO: 829887 - DNA, 25 bp, Mus musculus
tgtgacttggaggacattttcagaa

SEQ ID NO: 829888 - DNA, 25 bp, Mus musculus
tgtgacttgggacacctggtgactc

SEQ ID NO: 829889 - DNA, 25 bp, Mus musculus
tgtgacttgggagacctggtgactc

SEQ ID NO: 829890 - DNA, 25 bp, Mus musculus
tgtgactttcttccttaagcaacag

SEQ ID NO: 829891 - DNA, 25 bp, Mus musculus
tgtgactttcttgcttaagcaacag

SEQ ID NO: 829892 - DNA, 25 bp, Mus musculus
tgtgactttgcccaggtcccgtcag

SEQ ID NO: 829893 - DNA, 25 bp, Mus musculus
tgtgactttgccgaggtcccgtcag

SEQ ID NO: 829894 - DNA, 25 bp, Mus musculus
tgtgacttttctcttgccctcagcc

SEQ ID NO: 829895 - DNA, 25 bp, Mus musculus
tgtgacttttctgttgccctcagcc

SEQ ID NO: 829896 - DNA, 25 bp, Mus musculus
tgtgagaaagaactggacgaatgtc

SEQ ID NO: 829897 - DNA, 25 bp, Mus musculus
tgtgagaaagaagtggacgaatgtc

SEQ ID NO: 829898 - DNA, 25 bp, Mus musculus
tgtgagaaaggcagcaataacgctg

SEQ ID NO: 829899 - DNA, 25 bp, Mus musculus
tgtgagaaaggctgcaataacgctg

SEQ ID NO: 829900 - DNA, 25 bp, Mus musculus
tgtgagaacacaccgggctcctacc

SEQ ID NO: 829901 - DNA, 25 bp, Mus musculus
tgtgagaacacacgtggcggctacc

SEQ ID NO: 829902 - DNA, 25 bp, Mus musculus
tgtgagaacacagcgggctcctacc

SEQ ID NO: 829903 - DNA, 25 bp, Mus musculus
tgtgagaacacaggtggcggctacc

SEQ ID NO: 829904 - DNA, 25 bp, Mus musculus
tgtgagaacatgctcgcgttcccca

SEQ ID NO: 829905 - DNA, 25 bp, Mus musculus
tgtgagaacatggtcgcgttcccca

SEQ ID NO: 829906 - DNA, 25 bp, Mus musculus
tgtgagaacattcccggccacctga

SEQ ID NO: 829907 - DNA, 25 bp, Mus musculus
tgtgagaacattgccggccacctga

SEQ ID NO: 829908 - DNA, 25 bp, Mus musculus
tgtgagaaccttcaccatggccggg

SEQ ID NO: 829909 - DNA, 25 bp, Mus musculus
tgtgagaaccttgaccatggccggg

SEQ ID NO: 829910 - DNA, 25 bp, Mus musculus
tgtgagaacgctagccccacttggt

SEQ ID NO: 829911 - DNA, 25 bp, Mus musculus
tgtgagaacgcttgccccacttggt

SEQ ID NO: 829912 - DNA, 25 bp, Mus musculus
tgtgagaacggtcccagaagagact

SEQ ID NO: 829913 - DNA, 25 bp, Mus musculus
tgtgagaacggtgccagaagagact

SEQ ID NO: 829914 - DNA, 25 bp, Mus musculus
tgtgagaacgtgcaaggctccttcc

SEQ ID NO: 829915 - DNA, 25 bp, Mus musculus
tgtgagaacgtggaaggctccttcc

SEQ ID NO: 829916 - DNA, 25 bp, Mus musculus
tgtgagaacttgacccctttgctgg

SEQ ID NO: 829917 - DNA, 25 bp, Mus musculus
tgtgagaacttgtcccctttgctgg

SEQ ID NO: 829918 - DNA, 25 bp, Mus musculus
tgtgagaagtgtcacccaggaacat

SEQ ID NO: 829919 - DNA, 25 bp, Mus musculus
tgtgagaagtgtgacccaggaacat

SEQ ID NO: 829920 - DNA, 25 bp, Mus musculus
tgtgagacaacgctggagctcctct

SEQ ID NO: 829921 - DNA, 25 bp, Mus musculus
tgtgagacaacggtggagctcctct

SEQ ID NO: 829922 - DNA, 25 bp, Mus musculus
tgtgagactgtcatcgggaacaaat

SEQ ID NO: 829923 - DNA, 25 bp, Mus musculus
tgtgagactgtcttcgggaacaaat

SEQ ID NO: 829924 - DNA, 25 bp, Mus musculus
tgtgagagcaagaaaccccaggctg

SEQ ID NO: 829925 - DNA, 25 bp, Mus musculus
tgtgagagcaagtaaccccaggctg

SEQ ID NO: 829926 - DNA, 25 bp, Mus musculus
tgtgagagttcaagggaaaaccact

SEQ ID NO: 829927 - DNA, 25 bp, Mus musculus
tgtgagagttcatgggaaaaccact

SEQ ID NO: 829928 - DNA, 25 bp, Mus musculus
tgtgagatcacaacagggccacccc

SEQ ID NO: 829929 - DNA, 25 bp, Mus musculus
tgtgagatcacatcagggccacccc

SEQ ID NO: 829930 - DNA, 25 bp, Mus musculus
tgtgagatctggatttactgaaatc

SEQ ID NO: 829931 - DNA, 25 bp, Mus musculus
tgtgagatctggttttactgaaatc

SEQ ID NO: 829932 - DNA, 25 bp, Mus musculus
tgtgagatgatccagaagtctgtga

SEQ ID NO: 829933 - DNA, 25 bp, Mus musculus
tgtgagatgatcgagaagtctgtga

SEQ ID NO: 829934 - DNA, 25 bp, Mus musculus
tgtgagatgctcattgaacatggta

SEQ ID NO: 829935 - DNA, 25 bp, Mus musculus
tgtgagatgctctttgaacatggta

SEQ ID NO: 829936 - DNA, 25 bp, Mus musculus
tgtgagattctcctggtcaatgagt

SEQ ID NO: 829937 - DNA, 25 bp, Mus musculus
tgtgagattctcgtggtcaatgagt

SEQ ID NO: 829938 - DNA, 25 bp, Mus musculus
tgtgagcaaagtattcctggaagag

SEQ ID NO: 829939 - DNA, 25 bp, Mus musculus
tgtgagcaaagttttcctggaagag

SEQ ID NO: 829940 - DNA, 25 bp, Mus musculus
tgtgagcaacacattggaccctggg

SEQ ID NO: 829941 - DNA, 25 bp, Mus musculus
tgtgagcaacactttggaccctggg

SEQ ID NO: 829942 - DNA, 25 bp, Mus musculus
tgtgagcacactcttagtttctggc

SEQ ID NO: 829943 - DNA, 25 bp, Mus musculus
tgtgagcacactgttagtttctggc

SEQ ID NO: 829944 - DNA, 25 bp, Mus musculus
tgtgagcaccccaactgcctataga

SEQ ID NO: 829945 - DNA, 25 bp, Mus musculus
tgtgagcacccctactgcctataga

SEQ ID NO: 829946 - DNA, 25 bp, Mus musculus
tgtgagcaccgaaaccacacgtgta

SEQ ID NO: 829947 - DNA, 25 bp, Mus musculus
tgtgagcaccgataccacacgtgta

SEQ ID NO: 829948 - DNA, 25 bp, Mus musculus
tgtgagcaccttaacctcctggaga

SEQ ID NO: 829949 - DNA, 25 bp, Mus musculus
tgtgagcacctttacctcctggaga

SEQ ID NO: 829950 - DNA, 25 bp, Mus musculus
tgtgagcacttcctctcttctttta

SEQ ID NO: 829951 - DNA, 25 bp, Mus musculus
tgtgagcacttcgtctcttctttta

SEQ ID NO: 829952 - DNA, 25 bp, Mus musculus
tgtgagcagcgcatcactgagaagg

SEQ ID NO: 829953 - DNA, 25 bp, Mus musculus
tgtgagcagcgcttcactgagaagg

SEQ ID NO: 829954 - DNA, 25 bp, Mus musculus
tgtgagccacggaacaggtctgtct

SEQ ID NO: 829955 - DNA, 25 bp, Mus musculus
tgtgagccacggataaaaagcagct

SEQ ID NO: 829956 - DNA, 25 bp, Mus musculus
tgtgagccacggtacaggtctgtct

SEQ ID NO: 829957 - DNA, 25 bp, Mus musculus
tgtgagccacggttaaaaagcagct

SEQ ID NO: 829958 - DNA, 25 bp, Mus musculus
tgtgagccacttaaccccagatgag

SEQ ID NO: 829959 - DNA, 25 bp, Mus musculus
tgtgagccactttaccccagatgag

SEQ ID NO: 829960 - DNA, 25 bp, Mus musculus
tgtgagccagtcatggcagaaaccc

SEQ ID NO: 829961 - DNA, 25 bp, Mus musculus
tgtgagccagtcttggcagaaaccc

SEQ ID NO: 829962 - DNA, 25 bp, Mus musculus
tgtgagcccaagagcctagtgcagt

SEQ ID NO: 829963 - DNA, 25 bp, Mus musculus
tgtgagcccaagtgcctagtgcagt

SEQ ID NO: 829964 - DNA, 25 bp, Mus musculus
tgtgagcccattcccatgacagtgc

SEQ ID NO: 829965 - DNA, 25 bp, Mus musculus
tgtgagcccattgccatgacagtgc

SEQ ID NO: 829966 - DNA, 25 bp, Mus musculus
tgtgagccccagatctcctcgatgg

SEQ ID NO: 829967 - DNA, 25 bp, Mus musculus
tgtgagccccagttctcctcgatgg

SEQ ID NO: 829968 - DNA, 25 bp, Mus musculus
tgtgagccctgcacagtgaacgagt

SEQ ID NO: 829969 - DNA, 25 bp, Mus musculus
tgtgagccctgctcagtgaacgagt

SEQ ID NO: 829970 - DNA, 25 bp, Mus musculus
tgtgagccgccaaggccgattgtta

SEQ ID NO: 829971 - DNA, 25 bp, Mus musculus
tgtgagccgccatggccgattgtta

SEQ ID NO: 829972 - DNA, 25 bp, Mus musculus
tgtgagccggccatctggtgctcca

SEQ ID NO: 829973 - DNA, 25 bp, Mus musculus
tgtgagccggccttctggtgctcca

SEQ ID NO: 829974 - DNA, 25 bp, Mus musculus
tgtgagccgggcaatgaggtcaccc

SEQ ID NO: 829975 - DNA, 25 bp, Mus musculus
tgtgagccgggctatgaggtcaccc

SEQ ID NO: 829976 - DNA, 25 bp, Mus musculus
tgtgagcctcagaggcacattccca

SEQ ID NO: 829977 - DNA, 25 bp, Mus musculus
tgtgagcctcagtggcacattccca

SEQ ID NO: 829978 - DNA, 25 bp, Mus musculus
tgtgagcctgagacgcagcagcttg

SEQ ID NO: 829979 - DNA, 25 bp, Mus musculus
tgtgagcctgagtcgcagcagcttg

SEQ ID NO: 829980 - DNA, 25 bp, Mus musculus
tgtgagcgacatcagggcatcctct

SEQ ID NO: 829981 - DNA, 25 bp, Mus musculus
tgtgagcgacatgagggcatcctct

SEQ ID NO: 829982 - DNA, 25 bp, Mus musculus
tgtgagcgaccactaacccaggaag

SEQ ID NO: 829983 - DNA, 25 bp, Mus musculus
tgtgagcgaccagtaacccaggaag

SEQ ID NO: 829984 - DNA, 25 bp, Mus musculus
tgtgagcgccccagctctgagggct

SEQ ID NO: 829985 - DNA, 25 bp, Mus musculus
tgtgagcgcccctgctctgagggct

SEQ ID NO: 829986 - DNA, 25 bp, Mus musculus
tgtgagcggaagatcccaactgaag

SEQ ID NO: 829987 - DNA, 25 bp, Mus musculus
tgtgagcggaagttcccaactgaag

SEQ ID NO: 829988 - DNA, 25 bp, Mus musculus
tgtgagcgtaatcaacacctggtcc

SEQ ID NO: 829989 - DNA, 25 bp, Mus musculus
tgtgagcgtaatgaacacctggtcc

SEQ ID NO: 829990 - DNA, 25 bp, Mus musculus
tgtgagcgtgtcattcccgcacttc

SEQ ID NO: 829991 - DNA, 25 bp, Mus musculus
tgtgagcgtgtctttcccgcacttc

SEQ ID NO: 829992 - DNA, 25 bp, Mus musculus
tgtgagcgtgttctcctggccctgt

SEQ ID NO: 829993 - DNA, 25 bp, Mus musculus
tgtgagcgtgttgtcctggccctgt

SEQ ID NO: 829994 - DNA, 25 bp, Mus musculus
tgtgagctactaaactcgcattctg

SEQ ID NO: 829995 - DNA, 25 bp, Mus musculus
tgtgagctactatactcgcattctg

SEQ ID NO: 829996 - DNA, 25 bp, Mus musculus
tgtgagctcacacccgagattgcag

SEQ ID NO: 829997 - DNA, 25 bp, Mus musculus
tgtgagctcacagccgagattgcag

SEQ ID NO: 829998 - DNA, 25 bp, Mus musculus
tgtgagctccttcctgacagaggcg

SEQ ID NO: 829999 - DNA, 25 bp, Mus musculus
tgtgagctccttgctgacagaggcg

SEQ ID NO: 830000 - DNA, 25 bp, Mus musculus
tgtgagctgaacagcattcccaagg

SEQ ID NO: 830001 - DNA, 25 bp, Mus musculus
tgtgagctgaacctctccgtgactg

SEQ ID NO: 830002 - DNA, 25 bp, Mus musculus
tgtgagctgaacgtctccgtgactg

SEQ ID NO: 830003 - DNA, 25 bp, Mus musculus
tgtgagctgaactgcattcccaagg

SEQ ID NO: 830004 - DNA, 25 bp, Mus musculus
tgtgagctgcccagaggtcttccgg

SEQ ID NO: 830005 - DNA, 25 bp, Mus musculus
tgtgagctgccctgaggtcttccgg

SEQ ID NO: 830006 - DNA, 25 bp, Mus musculus
tgtgagctgcgtcgctcctctctga

SEQ ID NO: 830007 - DNA, 25 bp, Mus musculus
tgtgagctgcgtggctcctctctga

SEQ ID NO: 830008 - DNA, 25 bp, Mus musculus
tgtgagctgctcaagaacctggtgc

SEQ ID NO: 830009 - DNA, 25 bp, Mus musculus
tgtgagctgctctagaacctggtgc

SEQ ID NO: 830010 - DNA, 25 bp, Mus musculus
tgtgagctggacaagcttgctttcc

SEQ ID NO: 830011 - DNA, 25 bp, Mus musculus
tgtgagctggaccagagcaacaccc

SEQ ID NO: 830012 - DNA, 25 bp, Mus musculus
tgtgagctggacgagagcaacaccc

SEQ ID NO: 830013 - DNA, 25 bp, Mus musculus
tgtgagctggactagcttgctttcc

SEQ ID NO: 830014 - DNA, 25 bp, Mus musculus
tgtgagctggcaatgtgggccttcc

SEQ ID NO: 830015 - DNA, 25 bp, Mus musculus
tgtgagctggcattgtgggccttcc

SEQ ID NO: 830016 - DNA, 25 bp, Mus musculus
tgtgagcttgcgctttgtcccctgg

SEQ ID NO: 830017 - DNA, 25 bp, Mus musculus
tgtgagcttgcggtttgtcccctgg

SEQ ID NO: 830018 - DNA, 25 bp, Mus musculus
tgtgaggaaaaaccaggcagctaaa

SEQ ID NO: 830019 - DNA, 25 bp, Mus musculus
tgtgaggaaaaagcaggcagctaaa

SEQ ID NO: 830020 - DNA, 25 bp, Mus musculus
tgtgaggaaattcttggccctcatg

SEQ ID NO: 830021 - DNA, 25 bp, Mus musculus
tgtgaggaaattgttggccctcatg

SEQ ID NO: 830022 - DNA, 25 bp, Mus musculus
tgtgaggaatggcactgactctgcc

SEQ ID NO: 830023 - DNA, 25 bp, Mus musculus
tgtgaggaatgggactgactctgcc

SEQ ID NO: 830024 - DNA, 25 bp, Mus musculus
tgtgaggacagaacacagtcctttc

SEQ ID NO: 830025 - DNA, 25 bp, Mus musculus
tgtgaggacagatcacagtcctttc

SEQ ID NO: 830026 - DNA, 25 bp, Mus musculus
tgtgaggacagcaggccagttcttg

SEQ ID NO: 830027 - DNA, 25 bp, Mus musculus
tgtgaggacagctggccagttcttg

SEQ ID NO: 830028 - DNA, 25 bp, Mus musculus
tgtgaggacgagcacacctgtttca

SEQ ID NO: 830029 - DNA, 25 bp, Mus musculus
tgtgaggacgaggacacctgtttca

SEQ ID NO: 830030 - DNA, 25 bp, Mus musculus
tgtgaggccaaacagtcccctcctg

SEQ ID NO: 830031 - DNA, 25 bp, Mus musculus
tgtgaggccaaagagtcccctcctg

SEQ ID NO: 830032 - DNA, 25 bp, Mus musculus
tgtgaggctcaacactgctgggaac

SEQ ID NO: 830033 - DNA, 25 bp, Mus musculus
tgtgaggctcaagactgctgggaac

SEQ ID NO: 830034 - DNA, 25 bp, Mus musculus
tgtgaggctcttcttgtgaagaagc

SEQ ID NO: 830035 - DNA, 25 bp, Mus musculus
tgtgaggctcttgttgtgaagaagc

SEQ ID NO: 830036 - DNA, 25 bp, Mus musculus
tgtgagggccaaagagaaagagcta

SEQ ID NO: 830037 - DNA, 25 bp, Mus musculus
tgtgagggccaatgagaaagagcta

SEQ ID NO: 830038 - DNA, 25 bp, Mus musculus
tgtgagggtgatctcaatgaatgtc

SEQ ID NO: 830039 - DNA, 25 bp, Mus musculus
tgtgagggtgatgtcaatgaatgtc

SEQ ID NO: 830040 - DNA, 25 bp, Mus musculus
tgtgagggtggaattcagctctgac

SEQ ID NO: 830041 - DNA, 25 bp, Mus musculus
tgtgagggtggatttcagctctgac

SEQ ID NO: 830042 - DNA, 25 bp, Mus musculus
tgtgaggtgaatcgccgcaggtacc

SEQ ID NO: 830043 - DNA, 25 bp, Mus musculus
tgtgaggtgaatggccgcaggtacc

SEQ ID NO: 830044 - DNA, 25 bp, Mus musculus
tgtgaggtgcaactacacagaggcc

SEQ ID NO: 830045 - DNA, 25 bp, Mus musculus
tgtgaggtgcaagtacacagaggcc

SEQ ID NO: 830046 - DNA, 25 bp, Mus musculus
tgtgaggtgttgctgtacgattcct

SEQ ID NO: 830047 - DNA, 25 bp, Mus musculus
tgtgaggtgttggtgtacgattcct

SEQ ID NO: 830048 - DNA, 25 bp, Mus musculus
tgtgaggttcctacgttgtgttgat

SEQ ID NO: 830049 - DNA, 25 bp, Mus musculus
tgtgaggttccttcgttgtgttgat

SEQ ID NO: 830050 - DNA, 25 bp, Mus musculus
tgtgaggtttgtctttggaaccacc

SEQ ID NO: 830051 - DNA, 25 bp, Mus musculus
tgtgaggtttgtgtttggaaccacc

SEQ ID NO: 830052 - DNA, 25 bp, Mus musculus
tgtgagtacttgctcagaatcaaag

SEQ ID NO: 830053 - DNA, 25 bp, Mus musculus
tgtgagtacttggtcagaatcaaag

SEQ ID NO: 830054 - DNA, 25 bp, Mus musculus
tgtgagtatacgctaacaccaaccc

SEQ ID NO: 830055 - DNA, 25 bp, Mus musculus
tgtgagtatacggtaacaccaaccc

SEQ ID NO: 830056 - DNA, 25 bp, Mus musculus
tgtgagtcagcaaccaacagtgaat

SEQ ID NO: 830057 - DNA, 25 bp, Mus musculus
tgtgagtcagcatccaacagtgaat

SEQ ID NO: 830058 - DNA, 25 bp, Mus musculus
tgtgagtcaggaatatgtcaatggg

SEQ ID NO: 830059 - DNA, 25 bp, Mus musculus
tgtgagtcaggattatgtcaatggg

SEQ ID NO: 830060 - DNA, 25 bp, Mus musculus
tgtgagtcagtcaagtcccaacaac

SEQ ID NO: 830061 - DNA, 25 bp, Mus musculus
tgtgagtcagtctagtcccaacaac

SEQ ID NO: 830062 - DNA, 25 bp, Mus musculus
tgtgagtcattaacagtcctaactg

SEQ ID NO: 830063 - DNA, 25 bp, Mus musculus
tgtgagtcattatcagtcctaactg

SEQ ID NO: 830064 - DNA, 25 bp, Mus musculus
tgtgagtccactcctcatcgtcggc

SEQ ID NO: 830065 - DNA, 25 bp, Mus musculus
tgtgagtccactgctcatcgtcggc

SEQ ID NO: 830066 - DNA, 25 bp, Mus musculus
tgtgagtccagtcaagctgaagact

SEQ ID NO: 830067 - DNA, 25 bp, Mus musculus
tgtgagtccagtgaagctgaagact

SEQ ID NO: 830068 - DNA, 25 bp, Mus musculus
tgtgagtccattaattgacgaaagc

SEQ ID NO: 830069 - DNA, 25 bp, Mus musculus
tgtgagtccatttattgacgaaagc

SEQ ID NO: 830070 - DNA, 25 bp, Mus musculus
tgtgagtccccaatctagagccaaa

SEQ ID NO: 830071 - DNA, 25 bp, Mus musculus
tgtgagtccccattctagagccaaa

SEQ ID NO: 830072 - DNA, 25 bp, Mus musculus
tgtgagtcgaatcatgctggccttc

SEQ ID NO: 830073 - DNA, 25 bp, Mus musculus
tgtgagtcgaatgatgctggccttc

SEQ ID NO: 830074 - DNA, 25 bp, Mus musculus
tgtgagtcgtgacctggcgggacac

SEQ ID NO: 830075 - DNA, 25 bp, Mus musculus
tgtgagtcgtgagctggcgggacac

SEQ ID NO: 830076 - DNA, 25 bp, Mus musculus
tgtgagtctacacgattctggaacc

SEQ ID NO: 830077 - DNA, 25 bp, Mus musculus
tgtgagtctacaggattctggaacc

SEQ ID NO: 830078 - DNA, 25 bp, Mus musculus
tgtgagtctatgaaggagcagctgc

SEQ ID NO: 830079 - DNA, 25 bp, Mus musculus
tgtgagtctatgtaggagcagctgc

SEQ ID NO: 830080 - DNA, 25 bp, Mus musculus
tgtgagtctcttccccatccatctt

SEQ ID NO: 830081 - DNA, 25 bp, Mus musculus
tgtgagtctcttgcccatccatctt

SEQ ID NO: 830082 - DNA, 25 bp, Mus musculus
tgtgagtctgacaaattccactgtg

SEQ ID NO: 830083 - DNA, 25 bp, Mus musculus
tgtgagtctgactaattccactgtg

SEQ ID NO: 830084 - DNA, 25 bp, Mus musculus
tgtgagtctgctccacctgtgtgtc

SEQ ID NO: 830085 - DNA, 25 bp, Mus musculus
tgtgagtctgctgcacctgtgtgtc

SEQ ID NO: 830086 - DNA, 25 bp, Mus musculus
tgtgagtctttgaatcaagtagcac

SEQ ID NO: 830087 - DNA, 25 bp, Mus musculus
tgtgagtctttgtatcaagtagcac

SEQ ID NO: 830088 - DNA, 25 bp, Mus musculus
tgtgagtgaacaagaacccaagcag

SEQ ID NO: 830089 - DNA, 25 bp, Mus musculus
tgtgagtgaacatgaacccaagcag

SEQ ID NO: 830090 - DNA, 25 bp, Mus musculus
tgtgagtgaccacacagccgcagcg

SEQ ID NO: 830091 - DNA, 25 bp, Mus musculus
tgtgagtgaccagacagccgcagcg

SEQ ID NO: 830092 - DNA, 25 bp, Mus musculus
tgtgagtgactgatccccacacata

SEQ ID NO: 830093 - DNA, 25 bp, Mus musculus
tgtgagtgactgttccccacacata

SEQ ID NO: 830094 - DNA, 25 bp, Mus musculus
tgtgagtgagacagccaatgagccg

SEQ ID NO: 830095 - DNA, 25 bp, Mus musculus
tgtgagtgagactgccaatgagccg

SEQ ID NO: 830096 - DNA, 25 bp, Mus musculus
tgtgagtgagatcgacgccctctac

SEQ ID NO: 830097 - DNA, 25 bp, Mus musculus
tgtgagtgagatggacgccctctac

SEQ ID NO: 830098 - DNA, 25 bp, Mus musculus
tgtgagtgaggacacattgaaagaa

SEQ ID NO: 830099 - DNA, 25 bp, Mus musculus
tgtgagtgaggagacattgaaagaa

SEQ ID NO: 830100 - DNA, 25 bp, Mus musculus
tgtgagtgatcccaagggtccaccc

SEQ ID NO: 830101 - DNA, 25 bp, Mus musculus
tgtgagtgatccgaagggtccaccc

SEQ ID NO: 830102 - DNA, 25 bp, Mus musculus
tgtgagtgcatcagctcttagtttc

SEQ ID NO: 830103 - DNA, 25 bp, Mus musculus
tgtgagtgcatctgctcttagtttc

SEQ ID NO: 830104 - DNA, 25 bp, Mus musculus
tgtgagtgctttagacaacgctctg

SEQ ID NO: 830105 - DNA, 25 bp, Mus musculus
tgtgagtgctttcgctaaatttggg

SEQ ID NO: 830106 - DNA, 25 bp, Mus musculus
tgtgagtgctttggctaaatttggg

SEQ ID NO: 830107 - DNA, 25 bp, Mus musculus
tgtgagtgcttttgacaacgctctg

SEQ ID NO: 830108 - DNA, 25 bp, Mus musculus
tgtgagttcaacagcaacatccggg

SEQ ID NO: 830109 - DNA, 25 bp, Mus musculus
tgtgagttcaactgcaacatccggg

SEQ ID NO: 830110 - DNA, 25 bp, Mus musculus
tgtgagttccttccccgggcttctg

SEQ ID NO: 830111 - DNA, 25 bp, Mus musculus
tgtgagttccttgcccgggcttctg

SEQ ID NO: 830112 - DNA, 25 bp, Mus musculus
tgtgagttctgcagccatgccttca

SEQ ID NO: 830113 - DNA, 25 bp, Mus musculus
tgtgagttctgctgccatgccttca

SEQ ID NO: 830114 - DNA, 25 bp, Mus musculus
tgtgagttctgtcacacgtaagatc

SEQ ID NO: 830115 - DNA, 25 bp, Mus musculus
tgtgagttctgtcataagtgcttca

SEQ ID NO: 830116 - DNA, 25 bp, Mus musculus
tgtgagttctgtgacacgtaagatc

SEQ ID NO: 830117 - DNA, 25 bp, Mus musculus
tgtgagttctgtgataagtgcttca

SEQ ID NO: 830118 - DNA, 25 bp, Mus musculus
tgtgataaggctcacattgactggg

SEQ ID NO: 830119 - DNA, 25 bp, Mus musculus
tgtgataaggctgacattgactggg

SEQ ID NO: 830120 - DNA, 25 bp, Mus musculus
tgtgataatttcagagggccagcct

SEQ ID NO: 830121 - DNA, 25 bp, Mus musculus
tgtgataatttctgagggccagcct

SEQ ID NO: 830122 - DNA, 25 bp, Mus musculus
tgtgatacaggacagcaatggccag

SEQ ID NO: 830123 - DNA, 25 bp, Mus musculus
tgtgatacaggagagcaatggccag

SEQ ID NO: 830124 - DNA, 25 bp, Mus musculus
tgtgatactagaccccatgcaggaa

SEQ ID NO: 830125 - DNA, 25 bp, Mus musculus
tgtgatactagagcccatgcaggaa

SEQ ID NO: 830126 - DNA, 25 bp, Mus musculus
tgtgatactgccctgaatgtgattg

SEQ ID NO: 830127 - DNA, 25 bp, Mus musculus
tgtgatactgccgtgaatgtgattg

SEQ ID NO: 830128 - DNA, 25 bp, Mus musculus
tgtgatagaacacggcacagctgca

SEQ ID NO: 830129 - DNA, 25 bp, Mus musculus
tgtgatagaacagggcacagctgca

SEQ ID NO: 830130 - DNA, 25 bp, Mus musculus
tgtgatagaagtcagcaatagaccc

SEQ ID NO: 830131 - DNA, 25 bp, Mus musculus
tgtgatagaagtgagcaatagaccc

SEQ ID NO: 830132 - DNA, 25 bp, Mus musculus
tgtgatagaatgagaagaaacgccc

SEQ ID NO: 830133 - DNA, 25 bp, Mus musculus
tgtgatagaatgtgaagaaacgccc

SEQ ID NO: 830134 - DNA, 25 bp, Mus musculus
tgtgatagtcctcagcggataccaa

SEQ ID NO: 830135 - DNA, 25 bp, Mus musculus
tgtgatagtcctgagcggataccaa

SEQ ID NO: 830136 - DNA, 25 bp, Mus musculus
tgtgatatcagactttgtaattcca

SEQ ID NO: 830137 - DNA, 25 bp, Mus musculus
tgtgatatcagagtttgtaattcca

SEQ ID NO: 830138 - DNA, 25 bp, Mus musculus
tgtgatatcatcacctgagctggct

SEQ ID NO: 830139 - DNA, 25 bp, Mus musculus
tgtgatatcatctcctgagctggct

SEQ ID NO: 830140 - DNA, 25 bp, Mus musculus
tgtgatatggacattgggatgagaa

SEQ ID NO: 830141 - DNA, 25 bp, Mus musculus
tgtgatatggactttgggatgagaa

SEQ ID NO: 830142 - DNA, 25 bp, Mus musculus
tgtgatatgtaaccaagggtgactt

SEQ ID NO: 830143 - DNA, 25 bp, Mus musculus
tgtgatatgtaagcaagggtgactt

SEQ ID NO: 830144 - DNA, 25 bp, Mus musculus
tgtgatatgtcccttgtgaatggct

SEQ ID NO: 830145 - DNA, 25 bp, Mus musculus
tgtgatatgtccgttgtgaatggct

SEQ ID NO: 830146 - DNA, 25 bp, Mus musculus
tgtgatattgccatcaactgggccg

SEQ ID NO: 830147 - DNA, 25 bp, Mus musculus
tgtgatattgccttcaactgggccg

SEQ ID NO: 830148 - DNA, 25 bp, Mus musculus
tgtgatcactaccacgtcggctcag

SEQ ID NO: 830149 - DNA, 25 bp, Mus musculus
tgtgatcactacgacgtcggctcag

SEQ ID NO: 830150 - DNA, 25 bp, Mus musculus
tgtgatcagcaacagtgacgtgaag

SEQ ID NO: 830151 - DNA, 25 bp, Mus musculus
tgtgatcagcaagagtgacgtgaag

SEQ ID NO: 830152 - DNA, 25 bp, Mus musculus
tgtgatcagcatagagcgggcctac

SEQ ID NO: 830153 - DNA, 25 bp, Mus musculus
tgtgatcagcattgagcgggcctac

SEQ ID NO: 830154 - DNA, 25 bp, Mus musculus
tgtgatcaggatccaggatggaacc

SEQ ID NO: 830155 - DNA, 25 bp, Mus musculus
tgtgatcaggatgcaggatggaacc

SEQ ID NO: 830156 - DNA, 25 bp, Mus musculus
tgtgatcagtatagagggcattgga

SEQ ID NO: 830157 - DNA, 25 bp, Mus musculus
tgtgatcagtattgagggcattgga

SEQ ID NO: 830158 - DNA, 25 bp, Mus musculus
tgtgatcagtcactgctcctccggg

SEQ ID NO: 830159 - DNA, 25 bp, Mus musculus
tgtgatcagtcagtgctcctccggg

SEQ ID NO: 830160 - DNA, 25 bp, Mus musculus
tgtgatcagttaatcctaacgctgg

SEQ ID NO: 830161 - DNA, 25 bp, Mus musculus
tgtgatcagttattcctaacgctgg

SEQ ID NO: 830162 - DNA, 25 bp, Mus musculus
tgtgatcatcacagccaaccgggtg

SEQ ID NO: 830163 - DNA, 25 bp, Mus musculus
tgtgatcatcactgccaaccgggtg

SEQ ID NO: 830164 - DNA, 25 bp, Mus musculus
tgtgatcatcatcgatgctgacctc

SEQ ID NO: 830165 - DNA, 25 bp, Mus musculus
tgtgatcatcatggatgctgacctc

SEQ ID NO: 830166 - DNA, 25 bp, Mus musculus
tgtgatcatcctcggtcttgccttt

SEQ ID NO: 830167 - DNA, 25 bp, Mus musculus
tgtgatcatcctgggtcttgccttt

SEQ ID NO: 830168 - DNA, 25 bp, Mus musculus
tgtgatccacacctgaaatgctaaa

SEQ ID NO: 830169 - DNA, 25 bp, Mus musculus
tgtgatccacacgtgaaatgctaaa

SEQ ID NO: 830170 - DNA, 25 bp, Mus musculus
tgtgatccacctcatggacattgcc

SEQ ID NO: 830171 - DNA, 25 bp, Mus musculus
tgtgatccacctgatggacattgcc

SEQ ID NO: 830172 - DNA, 25 bp, Mus musculus
tgtgatccagcacaaagaaaaatgc

SEQ ID NO: 830173 - DNA, 25 bp, Mus musculus
tgtgatccagcagaaagaaaaatgc

SEQ ID NO: 830174 - DNA, 25 bp, Mus musculus
tgtgatccagccaggccgaggtttt

SEQ ID NO: 830175 - DNA, 25 bp, Mus musculus
tgtgatccagcctggccgaggtttt

SEQ ID NO: 830176 - DNA, 25 bp, Mus musculus
tgtgatcccggcagacagaacccga

SEQ ID NO: 830177 - DNA, 25 bp, Mus musculus
tgtgatcccggcatcaggctcgttg

SEQ ID NO: 830178 - DNA, 25 bp, Mus musculus
tgtgatcccggctgacagaacccga

SEQ ID NO: 830179 - DNA, 25 bp, Mus musculus
tgtgatcccggcttcaggctcgttg

SEQ ID NO: 830180 - DNA, 25 bp, Mus musculus
tgtgatccctataaaaggcctgctg

SEQ ID NO: 830181 - DNA, 25 bp, Mus musculus
tgtgatccctattaaaggcctgctg

SEQ ID NO: 830182 - DNA, 25 bp, Mus musculus
tgtgatccgaaactatggcaacctc

SEQ ID NO: 830183 - DNA, 25 bp, Mus musculus
tgtgatccgaaagtatggcaacctc

SEQ ID NO: 830184 - DNA, 25 bp, Mus musculus
tgtgatccgagtcaggacgcaacgc

SEQ ID NO: 830185 - DNA, 25 bp, Mus musculus
tgtgatccgagtgaggacgcaacgc

SEQ ID NO: 830186 - DNA, 25 bp, Mus musculus
tgtgatccgattcaagcctcaggtg

SEQ ID NO: 830187 - DNA, 25 bp, Mus musculus
tgtgatccgattgaagcctcaggtg

SEQ ID NO: 830188 - DNA, 25 bp, Mus musculus
tgtgatccgtcaagtgaaagctgcg

SEQ ID NO: 830189 - DNA, 25 bp, Mus musculus
tgtgatccgtcatgtgaaagctgcg

SEQ ID NO: 830190 - DNA, 25 bp, Mus musculus
tgtgatcctcataattcctgtggac

SEQ ID NO: 830191 - DNA, 25 bp, Mus musculus
tgtgatcctcatcgatgagacgctc

SEQ ID NO: 830192 - DNA, 25 bp, Mus musculus
tgtgatcctcatggatgagacgctc

SEQ ID NO: 830193 - DNA, 25 bp, Mus musculus
tgtgatcctcattattcctgtggac

SEQ ID NO: 830194 - DNA, 25 bp, Mus musculus
tgtgatcctggacgcgtacctgcga

SEQ ID NO: 830195 - DNA, 25 bp, Mus musculus
tgtgatcctggaggcgtacctgcga

SEQ ID NO: 830196 - DNA, 25 bp, Mus musculus
tgtgatcgacaaacaacatctagga

SEQ ID NO: 830197 - DNA, 25 bp, Mus musculus
tgtgatcgacaactgcattgcattg

SEQ ID NO: 830198 - DNA, 25 bp, Mus musculus
tgtgatcgacaagtgcattgcattg

SEQ ID NO: 830199 - DNA, 25 bp, Mus musculus
tgtgatcgacaatcaacatctagga

SEQ ID NO: 830200 - DNA, 25 bp, Mus musculus
tgtgatcgattacgctgcttcaatc

SEQ ID NO: 830201 - DNA, 25 bp, Mus musculus
tgtgatcgattaggctgcttcaatc

SEQ ID NO: 830202 - DNA, 25 bp, Mus musculus
tgtgatcgctggctattaccaagct

SEQ ID NO: 830203 - DNA, 25 bp, Mus musculus
tgtgatcgctgggtattaccaagct

SEQ ID NO: 830204 - DNA, 25 bp, Mus musculus
tgtgatctatcaattcttccacccc

SEQ ID NO: 830205 - DNA, 25 bp, Mus musculus
tgtgatctatcatttcttccacccc

SEQ ID NO: 830206 - DNA, 25 bp, Mus musculus
tgtgatctcactccttaatgagccc

SEQ ID NO: 830207 - DNA, 25 bp, Mus musculus
tgtgatctcactcttggccgggctg

SEQ ID NO: 830208 - DNA, 25 bp, Mus musculus
tgtgatctcactgcttaatgagccc

SEQ ID NO: 830209 - DNA, 25 bp, Mus musculus
tgtgatctcactgttggccgggctg

SEQ ID NO: 830210 - DNA, 25 bp, Mus musculus
tgtgatctgtacaccagcagaggca

SEQ ID NO: 830211 - DNA, 25 bp, Mus musculus
tgtgatctgtactccagcagaggca

SEQ ID NO: 830212 - DNA, 25 bp, Mus musculus
tgtgatcttgaaccaggcagaaaat

SEQ ID NO: 830213 - DNA, 25 bp, Mus musculus
tgtgatcttgaagcaggcagaaaat

SEQ ID NO: 830214 - DNA, 25 bp, Mus musculus
tgtgatgaaaatcgctccaagggct

SEQ ID NO: 830215 - DNA, 25 bp, Mus musculus
tgtgatgaaaatggctccaagggct

SEQ ID NO: 830216 - DNA, 25 bp, Mus musculus
tgtgatgaacgaagcctggagactc

SEQ ID NO: 830217 - DNA, 25 bp, Mus musculus
tgtgatgaacgatgcctggagactc

SEQ ID NO: 830218 - DNA, 25 bp, Mus musculus
tgtgatgaactaaccagcatggtcc

SEQ ID NO: 830219 - DNA, 25 bp, Mus musculus
tgtgatgaactatccagcatggtcc

SEQ ID NO: 830220 - DNA, 25 bp, Mus musculus
tgtgatgaaggccatattctaaaaa

SEQ ID NO: 830221 - DNA, 25 bp, Mus musculus
tgtgatgaaggcgatattctaaaaa

SEQ ID NO: 830222 - DNA, 25 bp, Mus musculus
tgtgatgacaaacgccacagagaca

SEQ ID NO: 830223 - DNA, 25 bp, Mus musculus
tgtgatgacaaaggccacagagaca

SEQ ID NO: 830224 - DNA, 25 bp, Mus musculus
tgtgatgagcgcaccgtcagacttt

SEQ ID NO: 830225 - DNA, 25 bp, Mus musculus
tgtgatgagcgctccgtcagacttt

SEQ ID NO: 830226 - DNA, 25 bp, Mus musculus
tgtgatgagctaaagtgccaaattt

SEQ ID NO: 830227 - DNA, 25 bp, Mus musculus
tgtgatgagctatagtgccaaattt

SEQ ID NO: 830228 - DNA, 25 bp, Mus musculus
tgtgatgatgtcaccacaagaagta

SEQ ID NO: 830229 - DNA, 25 bp, Mus musculus
tgtgatgatgtctccacaagaagta

SEQ ID NO: 830230 - DNA, 25 bp, Mus musculus
tgtgatgcaagaccctggtggtacc

SEQ ID NO: 830231 - DNA, 25 bp, Mus musculus
tgtgatgcaagagcctggtggtacc

SEQ ID NO: 830232 - DNA, 25 bp, Mus musculus
tgtgatgcagctcatagaaacctcc

SEQ ID NO: 830233 - DNA, 25 bp, Mus musculus
tgtgatgcagctgatagaaacctcc

SEQ ID NO: 830234 - DNA, 25 bp, Mus musculus
tgtgatgcagggaattacgggcccc

SEQ ID NO: 830235 - DNA, 25 bp, Mus musculus
tgtgatgcagggtattacgggcccc

SEQ ID NO: 830236 - DNA, 25 bp, Mus musculus
tgtgatgcaggtacactttacaaaa

SEQ ID NO: 830237 - DNA, 25 bp, Mus musculus
tgtgatgcaggttcactttacaaaa

SEQ ID NO: 830238 - DNA, 25 bp, Mus musculus
tgtgatgccaagcatatccgagggc

SEQ ID NO: 830239 - DNA, 25 bp, Mus musculus
tgtgatgccaaggatatccgagggc

SEQ ID NO: 830240 - DNA, 25 bp, Mus musculus
tgtgatgccaatctcctggagactg

SEQ ID NO: 830241 - DNA, 25 bp, Mus musculus
tgtgatgccaatgtcctggagactg

SEQ ID NO: 830242 - DNA, 25 bp, Mus musculus
tgtgatgctgctcgaacagtaccac

SEQ ID NO: 830243 - DNA, 25 bp, Mus musculus
tgtgatgctgctggaacagtaccac

SEQ ID NO: 830244 - DNA, 25 bp, Mus musculus
tgtgatgcttctcgacacctgggac

SEQ ID NO: 830245 - DNA, 25 bp, Mus musculus
tgtgatgcttctggacacctgggac

SEQ ID NO: 830246 - DNA, 25 bp, Mus musculus
tgtgatggacaaatcccggaatgcc

SEQ ID NO: 830247 - DNA, 25 bp, Mus musculus
tgtgatggacaattcccggaatgcc

SEQ ID NO: 830248 - DNA, 25 bp, Mus musculus
tgtgatggactcatgctctcctaga

SEQ ID NO: 830249 - DNA, 25 bp, Mus musculus
tgtgatggactcttgctctcctaga

SEQ ID NO: 830250 - DNA, 25 bp, Mus musculus
tgtgatggcacacacgagtacaaca

SEQ ID NO: 830251 - DNA, 25 bp, Mus musculus
tgtgatggcacagacgagtacaaca

SEQ ID NO: 830252 - DNA, 25 bp, Mus musculus
tgtgatggccgtcactatcgtgaag

SEQ ID NO: 830253 - DNA, 25 bp, Mus musculus
tgtgatggccgtgactatcgtgaag

SEQ ID NO: 830254 - DNA, 25 bp, Mus musculus
tgtgatggccttcctctttgaactg

SEQ ID NO: 830255 - DNA, 25 bp, Mus musculus
tgtgatggccttgctctttgaactg

SEQ ID NO: 830256 - DNA, 25 bp, Mus musculus
tgtgatgggatcatctggaaaaaag

SEQ ID NO: 830257 - DNA, 25 bp, Mus musculus
tgtgatgggatcttctggaaaaaag

SEQ ID NO: 830258 - DNA, 25 bp, Mus musculus
tgtgatggtactcgcctattggtgt

SEQ ID NO: 830259 - DNA, 25 bp, Mus musculus
tgtgatggtactggcctattggtgt

SEQ ID NO: 830260 - DNA, 25 bp, Mus musculus
tgtgatgtcacacctgaacacagac

SEQ ID NO: 830261 - DNA, 25 bp, Mus musculus
tgtgatgtcacagctgaacacagac

SEQ ID NO: 830262 - DNA, 25 bp, Mus musculus
tgtgatgtcactaccccaaactatg

SEQ ID NO: 830263 - DNA, 25 bp, Mus musculus
tgtgatgtcacttccccaaactatg

SEQ ID NO: 830264 - DNA, 25 bp, Mus musculus
tgtgatgtctacaatcctcagagca

SEQ ID NO: 830265 - DNA, 25 bp, Mus musculus
tgtgatgtctactatcctcagagca

SEQ ID NO: 830266 - DNA, 25 bp, Mus musculus
tgtgatgtctccagatttcattccg

SEQ ID NO: 830267 - DNA, 25 bp, Mus musculus
tgtgatgtctcctgatttcattccg

SEQ ID NO: 830268 - DNA, 25 bp, Mus musculus
tgtgatgtgaagagaatagctgaac

SEQ ID NO: 830269 - DNA, 25 bp, Mus musculus
tgtgatgtgaagtgaatagctgaac

SEQ ID NO: 830270 - DNA, 25 bp, Mus musculus
tgtgatgtgacccagagccagcctc

SEQ ID NO: 830271 - DNA, 25 bp, Mus musculus
tgtgatgtgaccgagagccagcctc

SEQ ID NO: 830272 - DNA, 25 bp, Mus musculus
tgtgatgtgcaaccccttctacaac

SEQ ID NO: 830273 - DNA, 25 bp, Mus musculus
tgtgatgtgcaagcccttctacaac

SEQ ID NO: 830274 - DNA, 25 bp, Mus musculus
tgtgatgtggtaccagtagtccaag

SEQ ID NO: 830275 - DNA, 25 bp, Mus musculus
tgtgatgtggtagcagtagtccaag

SEQ ID NO: 830276 - DNA, 25 bp, Mus musculus
tgtgatgttgagagtgtctgctcca

SEQ ID NO: 830277 - DNA, 25 bp, Mus musculus
tgtgatgttgagtgtgtctgctcca

SEQ ID NO: 830278 - DNA, 25 bp, Mus musculus
tgtgattacggacacaggacggccc

SEQ ID NO: 830279 - DNA, 25 bp, Mus musculus
tgtgattacggagacaggacggccc

SEQ ID NO: 830280 - DNA, 25 bp, Mus musculus
tgtgattagctactgtgagagatac

SEQ ID NO: 830281 - DNA, 25 bp, Mus musculus
tgtgattagctagtgtgagagatac

SEQ ID NO: 830282 - DNA, 25 bp, Mus musculus
tgtgattagctgcaattggcctcca

SEQ ID NO: 830283 - DNA, 25 bp, Mus musculus
tgtgattagctggaattggcctcca

SEQ ID NO: 830284 - DNA, 25 bp, Mus musculus
tgtgattataagatgccgttagagg

SEQ ID NO: 830285 - DNA, 25 bp, Mus musculus
tgtgattataagttgccgttagagg

SEQ ID NO: 830286 - DNA, 25 bp, Mus musculus
tgtgattatcatcggcttagccgtg

SEQ ID NO: 830287 - DNA, 25 bp, Mus musculus
tgtgattatcatgggcttagccgtg

SEQ ID NO: 830288 - DNA, 25 bp, Mus musculus
tgtgattcacctcgtgacagatgcc

SEQ ID NO: 830289 - DNA, 25 bp, Mus musculus
tgtgattcacctggtgacagatgcc

SEQ ID NO: 830290 - DNA, 25 bp, Mus musculus
tgtgattcactacaagggtttggtg

SEQ ID NO: 830291 - DNA, 25 bp, Mus musculus
tgtgattcactagaagggtttggtg

SEQ ID NO: 830292 - DNA, 25 bp, Mus musculus
tgtgattcagtacagctgtgaagag

SEQ ID NO: 830293 - DNA, 25 bp, Mus musculus
tgtgattcagtagagctgtgaagag

SEQ ID NO: 830294 - DNA, 25 bp, Mus musculus
tgtgattcagtgaggaaacctcgag

SEQ ID NO: 830295 - DNA, 25 bp, Mus musculus
tgtgattcagtgtggaaacctcgag

SEQ ID NO: 830296 - DNA, 25 bp, Mus musculus
tgtgattcatccctggcctcggaaa

SEQ ID NO: 830297 - DNA, 25 bp, Mus musculus
tgtgattcatccgtggcctcggaaa

SEQ ID NO: 830298 - DNA, 25 bp, Mus musculus
tgtgattcccgtcgctagtaccgtg

SEQ ID NO: 830299 - DNA, 25 bp, Mus musculus
tgtgattcccgtggctagtaccgtg

SEQ ID NO: 830300 - DNA, 25 bp, Mus musculus
tgtgattctgttccccttcacagca

SEQ ID NO: 830301 - DNA, 25 bp, Mus musculus
tgtgattctgttgcccttcacagca

SEQ ID NO: 830302 - DNA, 25 bp, Mus musculus
tgtgattcttgaaaccaatggaccc

SEQ ID NO: 830303 - DNA, 25 bp, Mus musculus
tgtgattcttgataccaatggaccc

SEQ ID NO: 830304 - DNA, 25 bp, Mus musculus
tgtgattgacatctcaggactgagg

SEQ ID NO: 830305 - DNA, 25 bp, Mus musculus
tgtgattgacatgtcaggactgagg

SEQ ID NO: 830306 - DNA, 25 bp, Mus musculus
tgtgattgagcacaggcagtgtact

SEQ ID NO: 830307 - DNA, 25 bp, Mus musculus
tgtgattgagcactttgaagactta

SEQ ID NO: 830308 - DNA, 25 bp, Mus musculus
tgtgattgagcagaggcagtgtact

SEQ ID NO: 830309 - DNA, 25 bp, Mus musculus
tgtgattgagcagtttgaagactta

SEQ ID NO: 830310 - DNA, 25 bp, Mus musculus
tgtgattggccgcagcctggttatc

SEQ ID NO: 830311 - DNA, 25 bp, Mus musculus
tgtgattggccggagcctggttatc

SEQ ID NO: 830312 - DNA, 25 bp, Mus musculus
tgtgattggctacaaacagacagga

SEQ ID NO: 830313 - DNA, 25 bp, Mus musculus
tgtgattggctagaaacagacagga

SEQ ID NO: 830314 - DNA, 25 bp, Mus musculus
tgtgattgggctcttgtacccctgc

SEQ ID NO: 830315 - DNA, 25 bp, Mus musculus
tgtgattgggctgttgtacccctgc

SEQ ID NO: 830316 - DNA, 25 bp, Mus musculus
tgtgattggtatagacgacgaggac

SEQ ID NO: 830317 - DNA, 25 bp, Mus musculus
tgtgattggtattgacgacgaggac

SEQ ID NO: 830318 - DNA, 25 bp, Mus musculus
tgtgattgtactcgcacgggctact

SEQ ID NO: 830319 - DNA, 25 bp, Mus musculus
tgtgattgtactggcacgggctact

SEQ ID NO: 830320 - DNA, 25 bp, Mus musculus
tgtgattgtcacagcctccaacttc

SEQ ID NO: 830321 - DNA, 25 bp, Mus musculus
tgtgattgtcaccatccaccagcct

SEQ ID NO: 830322 - DNA, 25 bp, Mus musculus
tgtgattgtcacgatccaccagcct

SEQ ID NO: 830323 - DNA, 25 bp, Mus musculus
tgtgattgtcactgcctccaacttc

SEQ ID NO: 830324 - DNA, 25 bp, Mus musculus
tgtgattgtgagagagacacgcctt

SEQ ID NO: 830325 - DNA, 25 bp, Mus musculus
tgtgattgtgagtgagacacgcctt

SEQ ID NO: 830326 - DNA, 25 bp, Mus musculus
tgtgatttcaaaactgaaccaaaga

SEQ ID NO: 830327 - DNA, 25 bp, Mus musculus
tgtgatttcaaatctgaaccaaaga

SEQ ID NO: 830328 - DNA, 25 bp, Mus musculus
tgtgatttctgacatagcaagaact

SEQ ID NO: 830329 - DNA, 25 bp, Mus musculus
tgtgatttctgagatagcaagaact

SEQ ID NO: 830330 - DNA, 25 bp, Mus musculus
tgtgatttctttcaggatggaagag

SEQ ID NO: 830331 - DNA, 25 bp, Mus musculus
tgtgatttctttgaggatggaagag

SEQ ID NO: 830332 - DNA, 25 bp, Mus musculus
tgtgattttcccagtcagcgactgg

SEQ ID NO: 830333 - DNA, 25 bp, Mus musculus
tgtgattttccctgtcagcgactgg

SEQ ID NO: 830334 - DNA, 25 bp, Mus musculus
tgtgattttgctctgactgccaaga

SEQ ID NO: 830335 - DNA, 25 bp, Mus musculus
tgtgattttgctgtgactgccaaga

SEQ ID NO: 830336 - DNA, 25 bp, Mus musculus
tgtgcaaaactaagagctctacatg

SEQ ID NO: 830337 - DNA, 25 bp, Mus musculus
tgtgcaaaactatgagctctacatg

SEQ ID NO: 830338 - DNA, 25 bp, Mus musculus
tgtgcaaaatgaccttgctggcccc

SEQ ID NO: 830339 - DNA, 25 bp, Mus musculus
tgtgcaaaatgagcttgctggcccc

SEQ ID NO: 830340 - DNA, 25 bp, Mus musculus
tgtgcaaacgcaaagactgaagatt

SEQ ID NO: 830341 - DNA, 25 bp, Mus musculus
tgtgcaaacgcatagactgaagatt

SEQ ID NO: 830342 - DNA, 25 bp, Mus musculus
tgtgcaaagaatcccgcggtacgaa

SEQ ID NO: 830343 - DNA, 25 bp, Mus musculus
tgtgcaaagaatgccgcggtacgaa

SEQ ID NO: 830344 - DNA, 25 bp, Mus musculus
tgtgcaaagatcaacagacgggctg

SEQ ID NO: 830345 - DNA, 25 bp, Mus musculus
tgtgcaaagatctacagacgggctg

SEQ ID NO: 830346 - DNA, 25 bp, Mus musculus
tgtgcaaagccactgtgtcatcgat

SEQ ID NO: 830347 - DNA, 25 bp, Mus musculus
tgtgcaaagccagtgtgtcatcgat

SEQ ID NO: 830348 - DNA, 25 bp, Mus musculus
tgtgcaaagcggatcttagaacgtg

SEQ ID NO: 830349 - DNA, 25 bp, Mus musculus
tgtgcaaagcggttcttagaacgtg

SEQ ID NO: 830350 - DNA, 25 bp, Mus musculus
tgtgcaaatagtcgtgtgcctgccc

SEQ ID NO: 830351 - DNA, 25 bp, Mus musculus
tgtgcaaatagtggtgtgcctgccc

SEQ ID NO: 830352 - DNA, 25 bp, Mus musculus
tgtgcaaatctaacatcatggcctc

SEQ ID NO: 830353 - DNA, 25 bp, Mus musculus
tgtgcaaatctatcatcatggcctc

SEQ ID NO: 830354 - DNA, 25 bp, Mus musculus
tgtgcaaatgacaccactctcccga

SEQ ID NO: 830355 - DNA, 25 bp, Mus musculus
tgtgcaaatgactccactctcccga

SEQ ID NO: 830356 - DNA, 25 bp, Mus musculus
tgtgcaacaaagagcaggtgctttc

SEQ ID NO: 830357 - DNA, 25 bp, Mus musculus
tgtgcaacaaagtgcaggtgctttc

SEQ ID NO: 830358 - DNA, 25 bp, Mus musculus
tgtgcaacaattcttcctggagccc

SEQ ID NO: 830359 - DNA, 25 bp, Mus musculus
tgtgcaacaattgttcctggagccc

SEQ ID NO: 830360 - DNA, 25 bp, Mus musculus
tgtgcaacacgaccacttagagatg

SEQ ID NO: 830361 - DNA, 25 bp, Mus musculus
tgtgcaacacgagcacttagagatg

SEQ ID NO: 830362 - DNA, 25 bp, Mus musculus
tgtgcaacagaaccaagacaagccc

SEQ ID NO: 830363 - DNA, 25 bp, Mus musculus
tgtgcaacagaagcaagacaagccc

SEQ ID NO: 830364 - DNA, 25 bp, Mus musculus
tgtgcaaccgacctggatgagccag

SEQ ID NO: 830365 - DNA, 25 bp, Mus musculus
tgtgcaaccgacgtggatgagccag

SEQ ID NO: 830366 - DNA, 25 bp, Mus musculus
tgtgcaaccttgactgccaagaaga

SEQ ID NO: 830367 - DNA, 25 bp, Mus musculus
tgtgcaaccttgtctgccaagaaga

SEQ ID NO: 830368 - DNA, 25 bp, Mus musculus
tgtgcaacgaataaaagctaaagac

SEQ ID NO: 830369 - DNA, 25 bp, Mus musculus
tgtgcaacgaatctggcaacacctt

SEQ ID NO: 830370 - DNA, 25 bp, Mus musculus
tgtgcaacgaatgtggcaacacctt

SEQ ID NO: 830371 - DNA, 25 bp, Mus musculus
tgtgcaacgaattaaagctaaagac

SEQ ID NO: 830372 - DNA, 25 bp, Mus musculus
tgtgcaacgccaacaagttcctaac

SEQ ID NO: 830373 - DNA, 25 bp, Mus musculus
tgtgcaacgccatcaagttcctaac

SEQ ID NO: 830374 - DNA, 25 bp, Mus musculus
tgtgcaacttatattggcctaatac

SEQ ID NO: 830375 - DNA, 25 bp, Mus musculus
tgtgcaacttattttggcctaatac

SEQ ID NO: 830376 - DNA, 25 bp, Mus musculus
tgtgcaacttgacgaatcaccctcg

SEQ ID NO: 830377 - DNA, 25 bp, Mus musculus
tgtgcaacttgaggaatcaccctcg

SEQ ID NO: 830378 - DNA, 25 bp, Mus musculus
tgtgcaagaactctgagccccaggt

SEQ ID NO: 830379 - DNA, 25 bp, Mus musculus
tgtgcaagaactgtgagccccaggt

SEQ ID NO: 830380 - DNA, 25 bp, Mus musculus
tgtgcaagatccctgaagggcgctt

SEQ ID NO: 830381 - DNA, 25 bp, Mus musculus
tgtgcaagatccgtgaagggcgctt

SEQ ID NO: 830382 - DNA, 25 bp, Mus musculus
tgtgcaagatgacctgccacaagaa

SEQ ID NO: 830383 - DNA, 25 bp, Mus musculus
tgtgcaagatgagctgccacaagaa

SEQ ID NO: 830384 - DNA, 25 bp, Mus musculus
tgtgcaagatgtaccagcctgagaa

SEQ ID NO: 830385 - DNA, 25 bp, Mus musculus
tgtgcaagatgttccagcctgagaa

SEQ ID NO: 830386 - DNA, 25 bp, Mus musculus
tgtgcaagattcacccggcacagaa

SEQ ID NO: 830387 - DNA, 25 bp, Mus musculus
tgtgcaagattctcccggcacagaa

SEQ ID NO: 830388 - DNA, 25 bp, Mus musculus
tgtgcaagcactcagcaaatctaag

SEQ ID NO: 830389 - DNA, 25 bp, Mus musculus
tgtgcaagcactgagcaaatctaag

SEQ ID NO: 830390 - DNA, 25 bp, Mus musculus
tgtgcaaggagtacgctggtcccaa

SEQ ID NO: 830391 - DNA, 25 bp, Mus musculus
tgtgcaaggagttcgctggtcccaa

SEQ ID NO: 830392 - DNA, 25 bp, Mus musculus
tgtgcaaggccaagttgccatcgtc

SEQ ID NO: 830393 - DNA, 25 bp, Mus musculus
tgtgcaaggccatgttgccatcgtc

SEQ ID NO: 830394 - DNA, 25 bp, Mus musculus
tgtgcaaggcctccacccggattcg

SEQ ID NO: 830395 - DNA, 25 bp, Mus musculus
tgtgcaaggcctgcacccggattcg

SEQ ID NO: 830396 - DNA, 25 bp, Mus musculus
tgtgcaagggcacgcccaacaagct

SEQ ID NO: 830397 - DNA, 25 bp, Mus musculus
tgtgcaagggcaggcccaacaagct

SEQ ID NO: 830398 - DNA, 25 bp, Mus musculus
tgtgcaataacaagcagaaagcccg

SEQ ID NO: 830399 - DNA, 25 bp, Mus musculus
tgtgcaataacatgcagaaagcccg

SEQ ID NO: 830400 - DNA, 25 bp, Mus musculus
tgtgcaatacttaagacgccctcgc

SEQ ID NO: 830401 - DNA, 25 bp, Mus musculus
tgtgcaatactttagacgccctcgc

SEQ ID NO: 830402 - DNA, 25 bp, Mus musculus
tgtgcaatcgcacaagcacgtggga

SEQ ID NO: 830403 - DNA, 25 bp, Mus musculus
tgtgcaatcgcagaagcacgtggga

SEQ ID NO: 830404 - DNA, 25 bp, Mus musculus
tgtgcaatcgctctacaaccacctg

SEQ ID NO: 830405 - DNA, 25 bp, Mus musculus
tgtgcaatcgctgtacaaccacctg

SEQ ID NO: 830406 - DNA, 25 bp, Mus musculus
tgtgcaatgtgaagaatccctccaa

SEQ ID NO: 830407 - DNA, 25 bp, Mus musculus
tgtgcaatgtgatgaatccctccaa

SEQ ID NO: 830408 - DNA, 25 bp, Mus musculus
tgtgcaattttaacacctgctttca

SEQ ID NO: 830409 - DNA, 25 bp, Mus musculus
tgtgcaattttatcacctgctttca

SEQ ID NO: 830410 - DNA, 25 bp, Mus musculus
tgtgcacaacacagccatgcgagat

SEQ ID NO: 830411 - DNA, 25 bp, Mus musculus
tgtgcacaacactgccatgcgagat

SEQ ID NO: 830412 - DNA, 25 bp, Mus musculus
tgtgcacaagaaccgggtacaagat

SEQ ID NO: 830413 - DNA, 25 bp, Mus musculus
tgtgcacaagaagcgggtacaagat

SEQ ID NO: 830414 - DNA, 25 bp, Mus musculus
tgtgcacacaaacacagcctgtcta

SEQ ID NO: 830415 - DNA, 25 bp, Mus musculus
tgtgcacacaaagacagcctgtcta

SEQ ID NO: 830416 - DNA, 25 bp, Mus musculus
tgtgcacacattaaagaaaactatg

SEQ ID NO: 830417 - DNA, 25 bp, Mus musculus
tgtgcacacatttaagaaaactatg

SEQ ID NO: 830418 - DNA, 25 bp, Mus musculus
tgtgcacagaatacagaagcccagc

SEQ ID NO: 830419 - DNA, 25 bp, Mus musculus
tgtgcacagaattcagaagcccagc

SEQ ID NO: 830420 - DNA, 25 bp, Mus musculus
tgtgcacagacgagctgcttggagc

SEQ ID NO: 830421 - DNA, 25 bp, Mus musculus
tgtgcacagacgtgctgcttggagc

SEQ ID NO: 830422 - DNA, 25 bp, Mus musculus
tgtgcacagaggagacgctgccgat

SEQ ID NO: 830423 - DNA, 25 bp, Mus musculus
tgtgcacagaggtgacgctgccgat

SEQ ID NO: 830424 - DNA, 25 bp, Mus musculus
tgtgcacaggaacgcagagtctccg

SEQ ID NO: 830425 - DNA, 25 bp, Mus musculus
tgtgcacaggaaggcagagtctccg

SEQ ID NO: 830426 - DNA, 25 bp, Mus musculus
tgtgcacatgaaccccccgcaggtg

SEQ ID NO: 830427 - DNA, 25 bp, Mus musculus
tgtgcacatgaagcccccgcaggtg

SEQ ID NO: 830428 - DNA, 25 bp, Mus musculus
tgtgcaccacaaatgccgggagaag

SEQ ID NO: 830429 - DNA, 25 bp, Mus musculus
tgtgcaccacaattgccgggagaag

SEQ ID NO: 830430 - DNA, 25 bp, Mus musculus
tgtgcaccactgcttcgctgagaca

SEQ ID NO: 830431 - DNA, 25 bp, Mus musculus
tgtgcaccactggttcgctgagaca

SEQ ID NO: 830432 - DNA, 25 bp, Mus musculus
tgtgcaccagctctgctatgtttga

SEQ ID NO: 830433 - DNA, 25 bp, Mus musculus
tgtgcaccagctgtgctatgtttga

SEQ ID NO: 830434 - DNA, 25 bp, Mus musculus
tgtgcaccaggtcgccatctggcag

SEQ ID NO: 830435 - DNA, 25 bp, Mus musculus
tgtgcaccaggtggccatctggcag

SEQ ID NO: 830436 - DNA, 25 bp, Mus musculus
tgtgcaccatccctatgagcttcgt

SEQ ID NO: 830437 - DNA, 25 bp, Mus musculus
tgtgcaccatccgtatgagcttcgt

SEQ ID NO: 830438 - DNA, 25 bp, Mus musculus
tgtgcacccggcattgctagtgctg

SEQ ID NO: 830439 - DNA, 25 bp, Mus musculus
tgtgcacccggctttgctagtgctg

SEQ ID NO: 830440 - DNA, 25 bp, Mus musculus
tgtgcaccgcctcataaagggagag

SEQ ID NO: 830441 - DNA, 25 bp, Mus musculus
tgtgcaccgcctgataaagggagag

SEQ ID NO: 830442 - DNA, 25 bp, Mus musculus
tgtgcacgaggtcccttattcaagg

SEQ ID NO: 830443 - DNA, 25 bp, Mus musculus
tgtgcacgaggtgccttattcaagg

SEQ ID NO: 830444 - DNA, 25 bp, Mus musculus
tgtgcacgcagtcttctcagctcct

SEQ ID NO: 830445 - DNA, 25 bp, Mus musculus
tgtgcacgcagtgttctcagctcct

SEQ ID NO: 830446 - DNA, 25 bp, Mus musculus
tgtgcacggagcaccgaggcatcct

SEQ ID NO: 830447 - DNA, 25 bp, Mus musculus
tgtgcacggagctccgaggcatcct

SEQ ID NO: 830448 - DNA, 25 bp, Mus musculus
tgtgcacgtgtaaggcatggtccct

SEQ ID NO: 830449 - DNA, 25 bp, Mus musculus
tgtgcacgtgtatggcatggtccct

SEQ ID NO: 830450 - DNA, 25 bp, Mus musculus
tgtgcacgttctagtcatgcctcag

SEQ ID NO: 830451 - DNA, 25 bp, Mus musculus
tgtgcacgttcttgtcatgcctcag

SEQ ID NO: 830452 - DNA, 25 bp, Mus musculus
tgtgcactgagccacacggccctga

SEQ ID NO: 830453 - DNA, 25 bp, Mus musculus
tgtgcactgagcgacacggccctga

SEQ ID NO: 830454 - DNA, 25 bp, Mus musculus
tgtgcactgcggctacacccggtgc

SEQ ID NO: 830455 - DNA, 25 bp, Mus musculus
tgtgcactgcgggtacacccggtgc

SEQ ID NO: 830456 - DNA, 25 bp, Mus musculus
tgtgcactggctctcgggacaatag

SEQ ID NO: 830457 - DNA, 25 bp, Mus musculus
tgtgcactggctgtcgggacaatag

SEQ ID NO: 830458 - DNA, 25 bp, Mus musculus
tgtgcactgggcacccacaactgct

SEQ ID NO: 830459 - DNA, 25 bp, Mus musculus
tgtgcactgggctcccacaactgct

SEQ ID NO: 830460 - DNA, 25 bp, Mus musculus
tgtgcactgtgtcgcgggcctggga

SEQ ID NO: 830461 - DNA, 25 bp, Mus musculus
tgtgcactgtgtggcgggcctggga

SEQ ID NO: 830462 - DNA, 25 bp, Mus musculus
tgtgcactgttcaaagggaaggaca

SEQ ID NO: 830463 - DNA, 25 bp, Mus musculus
tgtgcactgttctaagggaaggaca

SEQ ID NO: 830464 - DNA, 25 bp, Mus musculus
tgtgcactttgaatctgtctctgcc

SEQ ID NO: 830465 - DNA, 25 bp, Mus musculus
tgtgcactttgattctgtctctgcc

SEQ ID NO: 830466 - DNA, 25 bp, Mus musculus
tgtgcagaaccgagtatataagtcg

SEQ ID NO: 830467 - DNA, 25 bp, Mus musculus
tgtgcagaaccgtgtatataagtcg

SEQ ID NO: 830468 - DNA, 25 bp, Mus musculus
tgtgcagaacctaacatgcgcatct

SEQ ID NO: 830469 - DNA, 25 bp, Mus musculus
tgtgcagaaccttacatgcgcatct

SEQ ID NO: 830470 - DNA, 25 bp, Mus musculus
tgtgcagaaggcctcgtggtcttcc

SEQ ID NO: 830471 - DNA, 25 bp, Mus musculus
tgtgcagaaggcgtcgtggtcttcc

SEQ ID NO: 830472 - DNA, 25 bp, Mus musculus
tgtgcagaagtcaaagcgggaacct

SEQ ID NO: 830473 - DNA, 25 bp, Mus musculus
tgtgcagaagtcaggaacaagggcc

SEQ ID NO: 830474 - DNA, 25 bp, Mus musculus
tgtgcagaagtctaagcgggaacct

SEQ ID NO: 830475 - DNA, 25 bp, Mus musculus
tgtgcagaagtctggaacaagggcc

SEQ ID NO: 830476 - DNA, 25 bp, Mus musculus
tgtgcagaatatcattaccgagttg

SEQ ID NO: 830477 - DNA, 25 bp, Mus musculus
tgtgcagaatatgattaccgagttg

SEQ ID NO: 830478 - DNA, 25 bp, Mus musculus
tgtgcagacaccatagaaaagggtt

SEQ ID NO: 830479 - DNA, 25 bp, Mus musculus
tgtgcagacaccttagaaaagggtt

SEQ ID NO: 830480 - DNA, 25 bp, Mus musculus
tgtgcagactagactgctgccctca

SEQ ID NO: 830481 - DNA, 25 bp, Mus musculus
tgtgcagactagtctgctgccctca

SEQ ID NO: 830482 - DNA, 25 bp, Mus musculus
tgtgcagagaacaccaagttcttag

SEQ ID NO: 830483 - DNA, 25 bp, Mus musculus
tgtgcagagaactccaagttcttag

SEQ ID NO: 830484 - DNA, 25 bp, Mus musculus
tgtgcagagcagatagtaaggttcc

SEQ ID NO: 830485 - DNA, 25 bp, Mus musculus
tgtgcagagcagttagtaaggttcc

SEQ ID NO: 830486 - DNA, 25 bp, Mus musculus
tgtgcagaggcgacatcagaagatc

SEQ ID NO: 830487 - DNA, 25 bp, Mus musculus
tgtgcagaggcgtcatcagaagatc

SEQ ID NO: 830488 - DNA, 25 bp, Mus musculus
tgtgcagagggcaatatcctcaacg

SEQ ID NO: 830489 - DNA, 25 bp, Mus musculus
tgtgcagagggctatatcctcaacg

SEQ ID NO: 830490 - DNA, 25 bp, Mus musculus
tgtgcagagtgtagtgcctcacccg

SEQ ID NO: 830491 - DNA, 25 bp, Mus musculus
tgtgcagagtgttgtgcctcacccg

SEQ ID NO: 830492 - DNA, 25 bp, Mus musculus
tgtgcagagttccacggcaccgact

SEQ ID NO: 830493 - DNA, 25 bp, Mus musculus
tgtgcagagttcgacggcaccgact

SEQ ID NO: 830494 - DNA, 25 bp, Mus musculus
tgtgcagatccccttgctcctgggc

SEQ ID NO: 830495 - DNA, 25 bp, Mus musculus
tgtgcagatcccgttgctcctgggc

SEQ ID NO: 830496 - DNA, 25 bp, Mus musculus
tgtgcagatgtaaatcaagctggtt

SEQ ID NO: 830497 - DNA, 25 bp, Mus musculus
tgtgcagatgtatatcaagctggtt

SEQ ID NO: 830498 - DNA, 25 bp, Mus musculus
tgtgcagcagagaagacaataccga

SEQ ID NO: 830499 - DNA, 25 bp, Mus musculus
tgtgcagcagagtagacaataccga

SEQ ID NO: 830500 - DNA, 25 bp, Mus musculus
tgtgcagccatacacattgttctct

SEQ ID NO: 830501 - DNA, 25 bp, Mus musculus
tgtgcagccatagacattgttctct

SEQ ID NO: 830502 - DNA, 25 bp, Mus musculus
tgtgcagcccagcaaggaagattcc

SEQ ID NO: 830503 - DNA, 25 bp, Mus musculus
tgtgcagcccaggaaggaagattcc

SEQ ID NO: 830504 - DNA, 25 bp, Mus musculus
tgtgcagcccctaaggaatagcagg

SEQ ID NO: 830505 - DNA, 25 bp, Mus musculus
tgtgcagccccttaggaatagcagg

SEQ ID NO: 830506 - DNA, 25 bp, Mus musculus
tgtgcagccgctctctgaacaaact

SEQ ID NO: 830507 - DNA, 25 bp, Mus musculus
tgtgcagccgctgtctgaacaaact

SEQ ID NO: 830508 - DNA, 25 bp, Mus musculus
tgtgcagcctccctcgctggacgtg

SEQ ID NO: 830509 - DNA, 25 bp, Mus musculus
tgtgcagcctccgtcgctggacgtg

SEQ ID NO: 830510 - DNA, 25 bp, Mus musculus
tgtgcagcggagaagtcgctcacca

SEQ ID NO: 830511 - DNA, 25 bp, Mus musculus
tgtgcagcggagtagtcgctcacca

SEQ ID NO: 830512 - DNA, 25 bp, Mus musculus
tgtgcagcggctacagtctcgagtg

SEQ ID NO: 830513 - DNA, 25 bp, Mus musculus
tgtgcagcggcttcagtctcgagtg

SEQ ID NO: 830514 - DNA, 25 bp, Mus musculus
tgtgcagctcagacacctcagcagc

SEQ ID NO: 830515 - DNA, 25 bp, Mus musculus
tgtgcagctcagtcacctcagcagc

SEQ ID NO: 830516 - DNA, 25 bp, Mus musculus
tgtgcagctcctacttctactgctg

SEQ ID NO: 830517 - DNA, 25 bp, Mus musculus
tgtgcagctccttcttctactgctg

SEQ ID NO: 830518 - DNA, 25 bp, Mus musculus
tgtgcagctgcgcttttcgccttat

SEQ ID NO: 830519 - DNA, 25 bp, Mus musculus
tgtgcagctgcggttttcgccttat

SEQ ID NO: 830520 - DNA, 25 bp, Mus musculus
tgtgcagctgtgacatccacaggcc

SEQ ID NO: 830521 - DNA, 25 bp, Mus musculus
tgtgcagctgtgtcatccacaggcc

SEQ ID NO: 830522 - DNA, 25 bp, Mus musculus
tgtgcaggacataggaaaccctcac

SEQ ID NO: 830523 - DNA, 25 bp, Mus musculus
tgtgcaggacattggaaaccctcac

SEQ ID NO: 830524 - DNA, 25 bp, Mus musculus
tgtgcaggagttagtgagaccagaa

SEQ ID NO: 830525 - DNA, 25 bp, Mus musculus
tgtgcaggagtttgtgagaccagaa

SEQ ID NO: 830526 - DNA, 25 bp, Mus musculus
tgtgcaggcactcgctgaaaggaaa

SEQ ID NO: 830527 - DNA, 25 bp, Mus musculus
tgtgcaggcactggctgaaaggaaa

SEQ ID NO: 830528 - DNA, 25 bp, Mus musculus
tgtgcaggcaggaacaagggtcact

SEQ ID NO: 830529 - DNA, 25 bp, Mus musculus
tgtgcaggcaggtacaagggtcact

SEQ ID NO: 830530 - DNA, 25 bp, Mus musculus
tgtgcaggccatcaaccgcatctgc

SEQ ID NO: 830531 - DNA, 25 bp, Mus musculus
tgtgcaggccatgaaccgcatctgc

SEQ ID NO: 830532 - DNA, 25 bp, Mus musculus
tgtgcaggcgacatctcactctgag

SEQ ID NO: 830533 - DNA, 25 bp, Mus musculus
tgtgcaggcgacttctcactctgag

SEQ ID NO: 830534 - DNA, 25 bp, Mus musculus
tgtgcaggctctacagatctctctg

SEQ ID NO: 830535 - DNA, 25 bp, Mus musculus
tgtgcaggctcttcagatctctctg

SEQ ID NO: 830536 - DNA, 25 bp, Mus musculus
tgtgcaggggtcaaaaatcaatctc

SEQ ID NO: 830537 - DNA, 25 bp, Mus musculus
tgtgcaggggtctaaaatcaatctc

SEQ ID NO: 830538 - DNA, 25 bp, Mus musculus
tgtgcagggtcaaagtccctcacac

SEQ ID NO: 830539 - DNA, 25 bp, Mus musculus
tgtgcagggtcatagtccctcacac

SEQ ID NO: 830540 - DNA, 25 bp, Mus musculus
tgtgcaggtggaagccaacttggac

SEQ ID NO: 830541 - DNA, 25 bp, Mus musculus
tgtgcaggtggatgccaacttggac

SEQ ID NO: 830542 - DNA, 25 bp, Mus musculus
tgtgcaggtgttcaccatgggcaat

SEQ ID NO: 830543 - DNA, 25 bp, Mus musculus
tgtgcaggtgttgaccatgggcaat

SEQ ID NO: 830544 - DNA, 25 bp, Mus musculus
tgtgcagtacggagtggccggcagc

SEQ ID NO: 830545 - DNA, 25 bp, Mus musculus
tgtgcagtacggtgtggccggcagc

SEQ ID NO: 830546 - DNA, 25 bp, Mus musculus
tgtgcagtactgacaccagaagttc

SEQ ID NO: 830547 - DNA, 25 bp, Mus musculus
tgtgcagtactgtcaccagaagttc

SEQ ID NO: 830548 - DNA, 25 bp, Mus musculus
tgtgcagtagacatcccagtagtgg

SEQ ID NO: 830549 - DNA, 25 bp, Mus musculus
tgtgcagtagacttcccagtagtgg

SEQ ID NO: 830550 - DNA, 25 bp, Mus musculus
tgtgcagtatgaatatttagacccc

SEQ ID NO: 830551 - DNA, 25 bp, Mus musculus
tgtgcagtatgattatttagacccc

SEQ ID NO: 830552 - DNA, 25 bp, Mus musculus
tgtgcagtattaacagctccgtcgt

SEQ ID NO: 830553 - DNA, 25 bp, Mus musculus
tgtgcagtattatcagctccgtcgt

SEQ ID NO: 830554 - DNA, 25 bp, Mus musculus
tgtgcagtattcagccaccctcagg

SEQ ID NO: 830555 - DNA, 25 bp, Mus musculus
tgtgcagtattctgccaccctcagg

SEQ ID NO: 830556 - DNA, 25 bp, Mus musculus
tgtgcagtccgaagaacgacttcag

SEQ ID NO: 830557 - DNA, 25 bp, Mus musculus
tgtgcagtccgatgaacgacttcag

SEQ ID NO: 830558 - DNA, 25 bp, Mus musculus
tgtgcagtgccgctgatgacttact

SEQ ID NO: 830559 - DNA, 25 bp, Mus musculus
tgtgcagtgccggtgatgacttact

SEQ ID NO: 830560 - DNA, 25 bp, Mus musculus
tgtgcagtggctctgcaacgccaac

SEQ ID NO: 830561 - DNA, 25 bp, Mus musculus
tgtgcagtggctgtgcaacgccaac

SEQ ID NO: 830562 - DNA, 25 bp, Mus musculus
tgtgcagtgtaactcttcaggctgt

SEQ ID NO: 830563 - DNA, 25 bp, Mus musculus
tgtgcagtgtaagtcttcaggctgt

SEQ ID NO: 830564 - DNA, 25 bp, Mus musculus
tgtgcagttgtcattttggccatcc

SEQ ID NO: 830565 - DNA, 25 bp, Mus musculus
tgtgcagttgtctttttggccatcc

SEQ ID NO: 830566 - DNA, 25 bp, Mus musculus
tgtgcagttttgcaaactcactgtc

SEQ ID NO: 830567 - DNA, 25 bp, Mus musculus
tgtgcagttttggaaactcactgtc

SEQ ID NO: 830568 - DNA, 25 bp, Mus musculus
tgtgcatacccacagtcctgctgct

SEQ ID NO: 830569 - DNA, 25 bp, Mus musculus
tgtgcatacccagagtcctgctgct

SEQ ID NO: 830570 - DNA, 25 bp, Mus musculus
tgtgcataccttcgagactacggtc

SEQ ID NO: 830571 - DNA, 25 bp, Mus musculus
tgtgcataccttggagactacggtc

SEQ ID NO: 830572 - DNA, 25 bp, Mus musculus
tgtgcatatacaatttggtcatacg

SEQ ID NO: 830573 - DNA, 25 bp, Mus musculus
tgtgcatatacattttggtcatacg

SEQ ID NO: 830574 - DNA, 25 bp, Mus musculus
tgtgcatatggaagacactggaccc

SEQ ID NO: 830575 - DNA, 25 bp, Mus musculus
tgtgcatatggatgacactggaccc

SEQ ID NO: 830576 - DNA, 25 bp, Mus musculus
tgtgcatcaccaaggcgacagacct

SEQ ID NO: 830577 - DNA, 25 bp, Mus musculus
tgtgcatcaccatggcgacagacct

SEQ ID NO: 830578 - DNA, 25 bp, Mus musculus
tgtgcatcactacgccaccaggata

SEQ ID NO: 830579 - DNA, 25 bp, Mus musculus
tgtgcatcactaggccaccaggata

SEQ ID NO: 830580 - DNA, 25 bp, Mus musculus
tgtgcatcagcccatggctgcctac

SEQ ID NO: 830581 - DNA, 25 bp, Mus musculus
tgtgcatcagccgatggctgcctac

SEQ ID NO: 830582 - DNA, 25 bp, Mus musculus
tgtgcatccgccagcgcaaagggtt

SEQ ID NO: 830583 - DNA, 25 bp, Mus musculus
tgtgcatccgcctgcgcaaagggtt

SEQ ID NO: 830584 - DNA, 25 bp, Mus musculus
tgtgcatccgttcctgcagctcgtc

SEQ ID NO: 830585 - DNA, 25 bp, Mus musculus
tgtgcatccgttgctgcagctcgtc

SEQ ID NO: 830586 - DNA, 25 bp, Mus musculus
tgtgcatcgcggagatcgccaagga

SEQ ID NO: 830587 - DNA, 25 bp, Mus musculus
tgtgcatcgcggtgatcgccaagga

SEQ ID NO: 830588 - DNA, 25 bp, Mus musculus
tgtgcatctgaacgccttctatccg

SEQ ID NO: 830589 - DNA, 25 bp, Mus musculus
tgtgcatctgaaggccttctatccg

SEQ ID NO: 830590 - DNA, 25 bp, Mus musculus
tgtgcatctgatcgaccctgttgtc

SEQ ID NO: 830591 - DNA, 25 bp, Mus musculus
tgtgcatctgatggaccctgttgtc

SEQ ID NO: 830592 - DNA, 25 bp, Mus musculus
tgtgcatctggtaaagcaccaggga

SEQ ID NO: 830593 - DNA, 25 bp, Mus musculus
tgtgcatctggttaagcaccaggga

SEQ ID NO: 830594 - DNA, 25 bp, Mus musculus
tgtgcatctttacaactagcaatgg

SEQ ID NO: 830595 - DNA, 25 bp, Mus musculus
tgtgcatctttagaactagcaatgg

SEQ ID NO: 830596 - DNA, 25 bp, Mus musculus
tgtgcatgagtcaggccaacgtgcc

SEQ ID NO: 830597 - DNA, 25 bp, Mus musculus
tgtgcatgagtctggccaacgtgcc

SEQ ID NO: 830598 - DNA, 25 bp, Mus musculus
tgtgcatgcaagaccatggacagaa

SEQ ID NO: 830599 - DNA, 25 bp, Mus musculus
tgtgcatgcaagtccatggacagaa

SEQ ID NO: 830600 - DNA, 25 bp, Mus musculus
tgtgcatgcacacgcctatagcagg

SEQ ID NO: 830601 - DNA, 25 bp, Mus musculus
tgtgcatgcacaggcctatagcagg

SEQ ID NO: 830602 - DNA, 25 bp, Mus musculus
tgtgcatgcgagactttgtgcggcc

SEQ ID NO: 830603 - DNA, 25 bp, Mus musculus
tgtgcatgcgagtctttgtgcggcc

SEQ ID NO: 830604 - DNA, 25 bp, Mus musculus
tgtgcatggaggactttccccttcc

SEQ ID NO: 830605 - DNA, 25 bp, Mus musculus
tgtgcatggaggtctttccccttcc

SEQ ID NO: 830606 - DNA, 25 bp, Mus musculus
tgtgcatggtgtcacctaccaggag

SEQ ID NO: 830607 - DNA, 25 bp, Mus musculus
tgtgcatggtgtgacctaccaggag

SEQ ID NO: 830608 - DNA, 25 bp, Mus musculus
tgtgcatgtccaagtgtaccaatgc

SEQ ID NO: 830609 - DNA, 25 bp, Mus musculus
tgtgcatgtccatgtgtaccaatgc

SEQ ID NO: 830610 - DNA, 25 bp, Mus musculus
tgtgcattaaggagagcctacggct

SEQ ID NO: 830611 - DNA, 25 bp, Mus musculus
tgtgcattaaggtgagcctacggct

SEQ ID NO: 830612 - DNA, 25 bp, Mus musculus
tgtgcattagagacctgctgtgtaa

SEQ ID NO: 830613 - DNA, 25 bp, Mus musculus
tgtgcattagagtcctgctgtgtaa

SEQ ID NO: 830614 - DNA, 25 bp, Mus musculus
tgtgcattcagtccccaggaaccgt

SEQ ID NO: 830615 - DNA, 25 bp, Mus musculus
tgtgcattcagtgcccaggaaccgt

SEQ ID NO: 830616 - DNA, 25 bp, Mus musculus
tgtgcattctcactctgtaaagagg

SEQ ID NO: 830617 - DNA, 25 bp, Mus musculus
tgtgcattctcagtctgtaaagagg

SEQ ID NO: 830618 - DNA, 25 bp, Mus musculus
tgtgcattgcttcaggaacgaaggt

SEQ ID NO: 830619 - DNA, 25 bp, Mus musculus
tgtgcattgcttgaggaacgaaggt

SEQ ID NO: 830620 - DNA, 25 bp, Mus musculus
tgtgcattgtcgccgaggaaagcat

SEQ ID NO: 830621 - DNA, 25 bp, Mus musculus
tgtgcattgtcggcgaggaaagcat

SEQ ID NO: 830622 - DNA, 25 bp, Mus musculus
tgtgcatttactactccaggatggg

SEQ ID NO: 830623 - DNA, 25 bp, Mus musculus
tgtgcatttacttctccaggatggg

SEQ ID NO: 830624 - DNA, 25 bp, Mus musculus
tgtgcattttacagagtctctcagg

SEQ ID NO: 830625 - DNA, 25 bp, Mus musculus
tgtgcattttactgagtctctcagg

SEQ ID NO: 830626 - DNA, 25 bp, Mus musculus
tgtgccaaaaagaaatccacccatc

SEQ ID NO: 830627 - DNA, 25 bp, Mus musculus
tgtgccaaaaagtaatccacccatc

SEQ ID NO: 830628 - DNA, 25 bp, Mus musculus
tgtgccaaagatccaggtgtgccct

SEQ ID NO: 830629 - DNA, 25 bp, Mus musculus
tgtgccaaagatgcaggtgtgccct

SEQ ID NO: 830630 - DNA, 25 bp, Mus musculus
tgtgccaaagcaattcatgacgaga

SEQ ID NO: 830631 - DNA, 25 bp, Mus musculus
tgtgccaaagcatttcatgacgaga

SEQ ID NO: 830632 - DNA, 25 bp, Mus musculus
tgtgccaaagccctgaaatatcata

SEQ ID NO: 830633 - DNA, 25 bp, Mus musculus
tgtgccaaagccgtgaaatatcata

SEQ ID NO: 830634 - DNA, 25 bp, Mus musculus
tgtgccaaccacacctagatgcagt

SEQ ID NO: 830635 - DNA, 25 bp, Mus musculus
tgtgccaaccactcctagatgcagt

SEQ ID NO: 830636 - DNA, 25 bp, Mus musculus
tgtgccaaccggaaccttgctatga

SEQ ID NO: 830637 - DNA, 25 bp, Mus musculus
tgtgccaaccggtaccttgctatga

SEQ ID NO: 830638 - DNA, 25 bp, Mus musculus
tgtgccaagcttcccaacgtgaggg

SEQ ID NO: 830639 - DNA, 25 bp, Mus musculus
tgtgccaagcttgccaacgtgaggg

SEQ ID NO: 830640 - DNA, 25 bp, Mus musculus
tgtgccaaggcactcagacctggag

SEQ ID NO: 830641 - DNA, 25 bp, Mus musculus
tgtgccaaggcagtcagacctggag

SEQ ID NO: 830642 - DNA, 25 bp, Mus musculus
tgtgccaagtggcagcagaccttta

SEQ ID NO: 830643 - DNA, 25 bp, Mus musculus
tgtgccaagtgggagcagaccttta

SEQ ID NO: 830644 - DNA, 25 bp, Mus musculus
tgtgccaatggcctgctcatctacc

SEQ ID NO: 830645 - DNA, 25 bp, Mus musculus
tgtgccaatggcgtgctcatctacc

SEQ ID NO: 830646 - DNA, 25 bp, Mus musculus
tgtgccacaacacttggcttaagtg

SEQ ID NO: 830647 - DNA, 25 bp, Mus musculus
tgtgccacaacagttggcttaagtg

SEQ ID NO: 830648 - DNA, 25 bp, Mus musculus
tgtgccacacagcaatgtcgagaac

SEQ ID NO: 830649 - DNA, 25 bp, Mus musculus
tgtgccacacagctagccctggacg

SEQ ID NO: 830650 - DNA, 25 bp, Mus musculus
tgtgccacacaggaatgtcgagaac

SEQ ID NO: 830651 - DNA, 25 bp, Mus musculus
tgtgccacacaggtagccctggacg

SEQ ID NO: 830652 - DNA, 25 bp, Mus musculus
tgtgccacacggaagattttcagaa

SEQ ID NO: 830653 - DNA, 25 bp, Mus musculus
tgtgccacacggtagattttcagaa

SEQ ID NO: 830654 - DNA, 25 bp, Mus musculus
tgtgccaccaccacaagggcagaat

SEQ ID NO: 830655 - DNA, 25 bp, Mus musculus
tgtgccaccacctcaagggcagaat

SEQ ID NO: 830656 - DNA, 25 bp, Mus musculus
tgtgccaccactcgagctcagtgtg

SEQ ID NO: 830657 - DNA, 25 bp, Mus musculus
tgtgccaccactggagctcagtgtg

SEQ ID NO: 830658 - DNA, 25 bp, Mus musculus
tgtgccacccttcatctgtggactc

SEQ ID NO: 830659 - DNA, 25 bp, Mus musculus
tgtgccacccttgatctgtggactc

SEQ ID NO: 830660 - DNA, 25 bp, Mus musculus
tgtgccacgcttcgtgcagcaatgc

SEQ ID NO: 830661 - DNA, 25 bp, Mus musculus
tgtgccacgcttggtgcagcaatgc

SEQ ID NO: 830662 - DNA, 25 bp, Mus musculus
tgtgccacgtcacccaatgagaagc

SEQ ID NO: 830663 - DNA, 25 bp, Mus musculus
tgtgccacgtcagccaatgagaagc

SEQ ID NO: 830664 - DNA, 25 bp, Mus musculus
tgtgccactggtctcagcgcaaact

SEQ ID NO: 830665 - DNA, 25 bp, Mus musculus
tgtgccactggtgtcagcgcaaact

SEQ ID NO: 830666 - DNA, 25 bp, Mus musculus
tgtgccagacaacagccatgaagat

SEQ ID NO: 830667 - DNA, 25 bp, Mus musculus
tgtgccagacaagagccatgaagat

SEQ ID NO: 830668 - DNA, 25 bp, Mus musculus
tgtgccagacaccattgacgagaga

SEQ ID NO: 830669 - DNA, 25 bp, Mus musculus
tgtgccagacacgattgacgagaga

SEQ ID NO: 830670 - DNA, 25 bp, Mus musculus
tgtgccagaccacaccaagatgtga

SEQ ID NO: 830671 - DNA, 25 bp, Mus musculus
tgtgccagaccagaccaagatgtga

SEQ ID NO: 830672 - DNA, 25 bp, Mus musculus
tgtgccagagagactgggtgcctct

SEQ ID NO: 830673 - DNA, 25 bp, Mus musculus
tgtgccagagagtctgggtgcctct

SEQ ID NO: 830674 - DNA, 25 bp, Mus musculus
tgtgccagatacatttcaagaataa

SEQ ID NO: 830675 - DNA, 25 bp, Mus musculus
tgtgccagatacttttcaagaataa

SEQ ID NO: 830676 - DNA, 25 bp, Mus musculus
tgtgccagcacaccatgcaagaacg

SEQ ID NO: 830677 - DNA, 25 bp, Mus musculus
tgtgccagcacagcatgcaagaacg

SEQ ID NO: 830678 - DNA, 25 bp, Mus musculus
tgtgccagccctcccgggatcgtga

SEQ ID NO: 830679 - DNA, 25 bp, Mus musculus
tgtgccagccctcctaattgtgaag

SEQ ID NO: 830680 - DNA, 25 bp, Mus musculus
tgtgccagccctgccgggatcgtga

SEQ ID NO: 830681 - DNA, 25 bp, Mus musculus
tgtgccagccctgctaattgtgaag

SEQ ID NO: 830682 - DNA, 25 bp, Mus musculus
tgtgccagccggagtatatccacat

SEQ ID NO: 830683 - DNA, 25 bp, Mus musculus
tgtgccagccggtgtatatccacat

SEQ ID NO: 830684 - DNA, 25 bp, Mus musculus
tgtgccagcggtatatgtcaggaaa

SEQ ID NO: 830685 - DNA, 25 bp, Mus musculus
tgtgccagcggtttatgtcaggaaa

SEQ ID NO: 830686 - DNA, 25 bp, Mus musculus
tgtgccaggaaaacacggtgcccat

SEQ ID NO: 830687 - DNA, 25 bp, Mus musculus
tgtgccaggaaatcacggtgcccat

SEQ ID NO: 830688 - DNA, 25 bp, Mus musculus
tgtgccaggcacagatctcaagata

SEQ ID NO: 830689 - DNA, 25 bp, Mus musculus
tgtgccaggcactgatctcaagata

SEQ ID NO: 830690 - DNA, 25 bp, Mus musculus
tgtgccaggctgacttctagagtct

SEQ ID NO: 830691 - DNA, 25 bp, Mus musculus
tgtgccaggctgtcttctagagtct

SEQ ID NO: 830692 - DNA, 25 bp, Mus musculus
tgtgccaggcttagcataaaccaag

SEQ ID NO: 830693 - DNA, 25 bp, Mus musculus
tgtgccaggctttgcataaaccaag

SEQ ID NO: 830694 - DNA, 25 bp, Mus musculus
tgtgccaggttaccctttctaaccc

SEQ ID NO: 830695 - DNA, 25 bp, Mus musculus
tgtgccaggttagcctttctaaccc

SEQ ID NO: 830696 - DNA, 25 bp, Mus musculus
tgtgccaggttgctaggacccaaga

SEQ ID NO: 830697 - DNA, 25 bp, Mus musculus
tgtgccaggttggtaggacccaaga

SEQ ID NO: 830698 - DNA, 25 bp, Mus musculus
tgtgccagtctcactccgcaggcaa

SEQ ID NO: 830699 - DNA, 25 bp, Mus musculus
tgtgccagtctctctccgcaggcaa

SEQ ID NO: 830700 - DNA, 25 bp, Mus musculus
tgtgccagtggcatgtacaaagaga

SEQ ID NO: 830701 - DNA, 25 bp, Mus musculus
tgtgccagtggcttgtacaaagaga

SEQ ID NO: 830702 - DNA, 25 bp, Mus musculus
tgtgccagttctccagccgaggctt

SEQ ID NO: 830703 - DNA, 25 bp, Mus musculus
tgtgccagttctgcagccgaggctt

SEQ ID NO: 830704 - DNA, 25 bp, Mus musculus
tgtgccatcctaaaagaaactgtga

SEQ ID NO: 830705 - DNA, 25 bp, Mus musculus
tgtgccatcctataagaaactgtga

SEQ ID NO: 830706 - DNA, 25 bp, Mus musculus
tgtgccatctatccaacaattcctg

SEQ ID NO: 830707 - DNA, 25 bp, Mus musculus
tgtgccatctatgcaacaattcctg

SEQ ID NO: 830708 - DNA, 25 bp, Mus musculus
tgtgccatctgcaggaaccacatta

SEQ ID NO: 830709 - DNA, 25 bp, Mus musculus
tgtgccatctgctggaaccacatta

SEQ ID NO: 830710 - DNA, 25 bp, Mus musculus
tgtgccatgaagcaagctgcctgct

SEQ ID NO: 830711 - DNA, 25 bp, Mus musculus
tgtgccatgaaggaagctgcctgct

SEQ ID NO: 830712 - DNA, 25 bp, Mus musculus
tgtgccatgatcaaccttgccacca

SEQ ID NO: 830713 - DNA, 25 bp, Mus musculus
tgtgccatgatctaccttgccacca

SEQ ID NO: 830714 - DNA, 25 bp, Mus musculus
tgtgccatgggcaccttctccgcag

SEQ ID NO: 830715 - DNA, 25 bp, Mus musculus
tgtgccatgggctccttctccgcag

SEQ ID NO: 830716 - DNA, 25 bp, Mus musculus
tgtgccattagccagtccttcaccg

SEQ ID NO: 830717 - DNA, 25 bp, Mus musculus
tgtgccattagcgagtccttcaccg

SEQ ID NO: 830718 - DNA, 25 bp, Mus musculus
tgtgccattctccaagctacagctg

SEQ ID NO: 830719 - DNA, 25 bp, Mus musculus
tgtgccattctcgaagctacagctg

SEQ ID NO: 830720 - DNA, 25 bp, Mus musculus
tgtgcccaacaacagagatgataag

SEQ ID NO: 830721 - DNA, 25 bp, Mus musculus
tgtgcccaacaagagagatgataag

SEQ ID NO: 830722 - DNA, 25 bp, Mus musculus
tgtgcccaaggacatctcacctgac

SEQ ID NO: 830723 - DNA, 25 bp, Mus musculus
tgtgcccaaggagatctcacctgac

SEQ ID NO: 830724 - DNA, 25 bp, Mus musculus
tgtgcccacccaagtgagtatctga

SEQ ID NO: 830725 - DNA, 25 bp, Mus musculus
tgtgcccacccatgtgagtatctga

SEQ ID NO: 830726 - DNA, 25 bp, Mus musculus
tgtgcccactagctgcattggagct

SEQ ID NO: 830727 - DNA, 25 bp, Mus musculus
tgtgcccactaggtgcattggagct

SEQ ID NO: 830728 - DNA, 25 bp, Mus musculus
tgtgcccactctctcgtaaaactcg

SEQ ID NO: 830729 - DNA, 25 bp, Mus musculus
tgtgcccactctgtcgtaaaactcg

SEQ ID NO: 830730 - DNA, 25 bp, Mus musculus
tgtgcccatagaccatgctgtcagt

SEQ ID NO: 830731 - DNA, 25 bp, Mus musculus
tgtgcccatagagcatgctgtcagt

SEQ ID NO: 830732 - DNA, 25 bp, Mus musculus
tgtgcccatcccaactcgagattct

SEQ ID NO: 830733 - DNA, 25 bp, Mus musculus
tgtgcccatccctactcgagattct

SEQ ID NO: 830734 - DNA, 25 bp, Mus musculus
tgtgcccatctgaggtgcgctgtcc

SEQ ID NO: 830735 - DNA, 25 bp, Mus musculus
tgtgcccatctgtggtgcgctgtcc

SEQ ID NO: 830736 - DNA, 25 bp, Mus musculus
tgtgcccattcgcaggaagagaagt

SEQ ID NO: 830737 - DNA, 25 bp, Mus musculus
tgtgcccattcggaggaagagaagt

SEQ ID NO: 830738 - DNA, 25 bp, Mus musculus
tgtgccccaagactgggacgtttcc

SEQ ID NO: 830739 - DNA, 25 bp, Mus musculus
tgtgccccaagagtgggacgtttcc

SEQ ID NO: 830740 - DNA, 25 bp, Mus musculus
tgtgccccagggacgttctctgaca

SEQ ID NO: 830741 - DNA, 25 bp, Mus musculus
tgtgccccagggtcgttctctgaca

SEQ ID NO: 830742 - DNA, 25 bp, Mus musculus
tgtgccccggtgagtcctctcaggg

SEQ ID NO: 830743 - DNA, 25 bp, Mus musculus
tgtgccccggtgtgtcctctcaggg

SEQ ID NO: 830744 - DNA, 25 bp, Mus musculus
tgtgccccgtgaaaaggtcttccag

SEQ ID NO: 830745 - DNA, 25 bp, Mus musculus
tgtgccccgtgataaggtcttccag

SEQ ID NO: 830746 - DNA, 25 bp, Mus musculus
tgtgcccgaaacatggataatcctg

SEQ ID NO: 830747 - DNA, 25 bp, Mus musculus
tgtgcccgaaacttggataatcctg

SEQ ID NO: 830748 - DNA, 25 bp, Mus musculus
tgtgcccgaggtagcatcgtggcca

SEQ ID NO: 830749 - DNA, 25 bp, Mus musculus
tgtgcccgaggttgcatcgtggcca

SEQ ID NO: 830750 - DNA, 25 bp, Mus musculus
tgtgcccgcctgcagcagttcctgg

SEQ ID NO: 830751 - DNA, 25 bp, Mus musculus
tgtgcccgcctggagcagttcctgg

SEQ ID NO: 830752 - DNA, 25 bp, Mus musculus
tgtgcccgtactaacatctactgaa

SEQ ID NO: 830753 - DNA, 25 bp, Mus musculus
tgtgcccgtacttacatctactgaa

SEQ ID NO: 830754 - DNA, 25 bp, Mus musculus
tgtgcccgtgcacatgccaaaggcc

SEQ ID NO: 830755 - DNA, 25 bp, Mus musculus
tgtgcccgtgcagatgccaaaggcc

SEQ ID NO: 830756 - DNA, 25 bp, Mus musculus
tgtgccctacacatgctaagtcata

SEQ ID NO: 830757 - DNA, 25 bp, Mus musculus
tgtgccctacacttgctaagtcata

SEQ ID NO: 830758 - DNA, 25 bp, Mus musculus
tgtgccctgaacatctaataaaggc

SEQ ID NO: 830759 - DNA, 25 bp, Mus musculus
tgtgccctgaacttctaataaaggc

SEQ ID NO: 830760 - DNA, 25 bp, Mus musculus
tgtgccctgacgacatgactgccaa

SEQ ID NO: 830761 - DNA, 25 bp, Mus musculus
tgtgccctgacgtcatgactgccaa

SEQ ID NO: 830762 - DNA, 25 bp, Mus musculus
tgtgccctgcacatgcgaagacgtg

SEQ ID NO: 830763 - DNA, 25 bp, Mus musculus
tgtgccctgcacttgcgaagacgtg

SEQ ID NO: 830764 - DNA, 25 bp, Mus musculus
tgtgccctgccgctgtttcaacttc

SEQ ID NO: 830765 - DNA, 25 bp, Mus musculus
tgtgccctgccggtgtttcaacttc

SEQ ID NO: 830766 - DNA, 25 bp, Mus musculus
tgtgccctgggcattatagtcctta

SEQ ID NO: 830767 - DNA, 25 bp, Mus musculus
tgtgccctgggctttatagtcctta

SEQ ID NO: 830768 - DNA, 25 bp, Mus musculus
tgtgccctgtttactgatgcagaat

SEQ ID NO: 830769 - DNA, 25 bp, Mus musculus
tgtgccctgttttctgatgcagaat

SEQ ID NO: 830770 - DNA, 25 bp, Mus musculus
tgtgcccttacgagatggcattgat

SEQ ID NO: 830771 - DNA, 25 bp, Mus musculus
tgtgcccttacgtgatggcattgat

SEQ ID NO: 830772 - DNA, 25 bp, Mus musculus
tgtgcccttatgcaaagaggactgt

SEQ ID NO: 830773 - DNA, 25 bp, Mus musculus
tgtgcccttatggaaagaggactgt

SEQ ID NO: 830774 - DNA, 25 bp, Mus musculus
tgtgcccttcgacaagcattccaca

SEQ ID NO: 830775 - DNA, 25 bp, Mus musculus
tgtgcccttcgagaagcattccaca

SEQ ID NO: 830776 - DNA, 25 bp, Mus musculus
tgtgcccttggaacaactgccacgt

SEQ ID NO: 830777 - DNA, 25 bp, Mus musculus
tgtgcccttggatcaactgccacgt

SEQ ID NO: 830778 - DNA, 25 bp, Mus musculus
tgtgcccttggcctgtgttacatat

SEQ ID NO: 830779 - DNA, 25 bp, Mus musculus
tgtgcccttggcgtgtgttacatat

SEQ ID NO: 830780 - DNA, 25 bp, Mus musculus
tgtgcccttgttatcagatagaagc

SEQ ID NO: 830781 - DNA, 25 bp, Mus musculus
tgtgcccttgttttcagatagaagc

SEQ ID NO: 830782 - DNA, 25 bp, Mus musculus
tgtgccgaaaatacctacaaatcag

SEQ ID NO: 830783 - DNA, 25 bp, Mus musculus
tgtgccgaaaattcctacaaatcag

SEQ ID NO: 830784 - DNA, 25 bp, Mus musculus
tgtgccgaccatcagccggatgaca

SEQ ID NO: 830785 - DNA, 25 bp, Mus musculus
tgtgccgaccatgagccggatgaca

SEQ ID NO: 830786 - DNA, 25 bp, Mus musculus
tgtgccgactacatggagcagtgca

SEQ ID NO: 830787 - DNA, 25 bp, Mus musculus
tgtgccgactacttggagcagtgca

SEQ ID NO: 830788 - DNA, 25 bp, Mus musculus
tgtgccgatactctcaaacgccaga

SEQ ID NO: 830789 - DNA, 25 bp, Mus musculus
tgtgccgatactgtcaaacgccaga

SEQ ID NO: 830790 - DNA, 25 bp, Mus musculus
tgtgccgcagctctgcctcgggcat

SEQ ID NO: 830791 - DNA, 25 bp, Mus musculus
tgtgccgcagctgtgcctcgggcat

SEQ ID NO: 830792 - DNA, 25 bp, Mus musculus
tgtgccgctgttacgaagagaagca

SEQ ID NO: 830793 - DNA, 25 bp, Mus musculus
tgtgccgctgtttcgaagagaagca

SEQ ID NO: 830794 - DNA, 25 bp, Mus musculus
tgtgccggctaaactgttccaagga

SEQ ID NO: 830795 - DNA, 25 bp, Mus musculus
tgtgccggctaatctgttccaagga

SEQ ID NO: 830796 - DNA, 25 bp, Mus musculus
tgtgccgggagccttgtccatacct

SEQ ID NO: 830797 - DNA, 25 bp, Mus musculus
tgtgccgggagcgttgtccatacct

SEQ ID NO: 830798 - DNA, 25 bp, Mus musculus
tgtgccgggatgcttcgcagaccca

SEQ ID NO: 830799 - DNA, 25 bp, Mus musculus
tgtgccgggatggttcgcagaccca

SEQ ID NO: 830800 - DNA, 25 bp, Mus musculus
tgtgccgggtatctacaccagagtt

SEQ ID NO: 830801 - DNA, 25 bp, Mus musculus
tgtgccgggtatgtacaccagagtt

SEQ ID NO: 830802 - DNA, 25 bp, Mus musculus
tgtgccggtacaatcattctgaaga

SEQ ID NO: 830803 - DNA, 25 bp, Mus musculus
tgtgccggtacattcattctgaaga

SEQ ID NO: 830804 - DNA, 25 bp, Mus musculus
tgtgccgtacagaccctgctacgca

SEQ ID NO: 830805 - DNA, 25 bp, Mus musculus
tgtgccgtacagtccctgctacgca

SEQ ID NO: 830806 - DNA, 25 bp, Mus musculus
tgtgccgttgccctacaggctacac

SEQ ID NO: 830807 - DNA, 25 bp, Mus musculus
tgtgccgttgccgtacaggctacac

SEQ ID NO: 830808 - DNA, 25 bp, Mus musculus
tgtgcctaccgtcctagccatcaag

SEQ ID NO: 830809 - DNA, 25 bp, Mus musculus
tgtgcctaccgtgctagccatcaag

SEQ ID NO: 830810 - DNA, 25 bp, Mus musculus
tgtgcctagagaaacacagctctct

SEQ ID NO: 830811 - DNA, 25 bp, Mus musculus
tgtgcctagagatacacagctctct

SEQ ID NO: 830812 - DNA, 25 bp, Mus musculus
tgtgcctagtggacggagacacttt

SEQ ID NO: 830813 - DNA, 25 bp, Mus musculus
tgtgcctagtggtcggagacacttt

SEQ ID NO: 830814 - DNA, 25 bp, Mus musculus
tgtgcctataagctgtgcaaggttg

SEQ ID NO: 830815 - DNA, 25 bp, Mus musculus
tgtgcctataaggtgtgcaaggttg

SEQ ID NO: 830816 - DNA, 25 bp, Mus musculus
tgtgcctcaccacagagcagtgggt

SEQ ID NO: 830817 - DNA, 25 bp, Mus musculus
tgtgcctcaccagagagcagtgggt

SEQ ID NO: 830818 - DNA, 25 bp, Mus musculus
tgtgcctcagacattcactacgata

SEQ ID NO: 830819 - DNA, 25 bp, Mus musculus
tgtgcctcagactttcactacgata

SEQ ID NO: 830820 - DNA, 25 bp, Mus musculus
tgtgcctccattctgctgcttttga

SEQ ID NO: 830821 - DNA, 25 bp, Mus musculus
tgtgcctccattgtgctgcttttga

SEQ ID NO: 830822 - DNA, 25 bp, Mus musculus
tgtgcctcccacaaggaaccttacg

SEQ ID NO: 830823 - DNA, 25 bp, Mus musculus
tgtgcctcccactaggaaccttacg

SEQ ID NO: 830824 - DNA, 25 bp, Mus musculus
tgtgcctcccagagtaacatgtggt

SEQ ID NO: 830825 - DNA, 25 bp, Mus musculus
tgtgcctcccagtgtaacatgtggt

SEQ ID NO: 830826 - DNA, 25 bp, Mus musculus
tgtgcctccgggacgggaactacaa

SEQ ID NO: 830827 - DNA, 25 bp, Mus musculus
tgtgcctccgggtcgggaactacaa

SEQ ID NO: 830828 - DNA, 25 bp, Mus musculus
tgtgcctccggtatccatttgctcc

SEQ ID NO: 830829 - DNA, 25 bp, Mus musculus
tgtgcctccggtttccatttgctcc

SEQ ID NO: 830830 - DNA, 25 bp, Mus musculus
tgtgcctcctctaagaacttgttgg

SEQ ID NO: 830831 - DNA, 25 bp, Mus musculus
tgtgcctcctcttagaacttgttgg

SEQ ID NO: 830832 - DNA, 25 bp, Mus musculus
tgtgcctcctgaagtgggtagcatg

SEQ ID NO: 830833 - DNA, 25 bp, Mus musculus
tgtgcctcctgatgtgggtagcatg

SEQ ID NO: 830834 - DNA, 25 bp, Mus musculus
tgtgcctcggcaaagacgtggacac

SEQ ID NO: 830835 - DNA, 25 bp, Mus musculus
tgtgcctcggcatagacgtggacac

SEQ ID NO: 830836 - DNA, 25 bp, Mus musculus
tgtgcctcgggcagtctttgtggac

SEQ ID NO: 830837 - DNA, 25 bp, Mus musculus
tgtgcctcgggctgtctttgtggac

SEQ ID NO: 830838 - DNA, 25 bp, Mus musculus
tgtgcctctatcagtccacagttga

SEQ ID NO: 830839 - DNA, 25 bp, Mus musculus
tgtgcctctatctgtccacagttga

SEQ ID NO: 830840 - DNA, 25 bp, Mus musculus
tgtgcctctgagcaccaataaatcc

SEQ ID NO: 830841 - DNA, 25 bp, Mus musculus
tgtgcctctgaggaccaataaatcc

SEQ ID NO: 830842 - DNA, 25 bp, Mus musculus
tgtgcctcttagaggccaacatgaa

SEQ ID NO: 830843 - DNA, 25 bp, Mus musculus
tgtgcctcttagtggccaacatgaa

SEQ ID NO: 830844 - DNA, 25 bp, Mus musculus
tgtgcctctttgactcagagactgc

SEQ ID NO: 830845 - DNA, 25 bp, Mus musculus
tgtgcctctttgtctcagagactgc

SEQ ID NO: 830846 - DNA, 25 bp, Mus musculus
tgtgcctgaaaccaatatcctgtct

SEQ ID NO: 830847 - DNA, 25 bp, Mus musculus
tgtgcctgaaacgaatatcctgtct

SEQ ID NO: 830848 - DNA, 25 bp, Mus musculus
tgtgcctgaggcaaatctgctctga

SEQ ID NO: 830849 - DNA, 25 bp, Mus musculus
tgtgcctgaggctaatctgctctga

SEQ ID NO: 830850 - DNA, 25 bp, Mus musculus
tgtgcctgagtcacctaaccgaaga

SEQ ID NO: 830851 - DNA, 25 bp, Mus musculus
tgtgcctgagtctcctaaccgaaga

SEQ ID NO: 830852 - DNA, 25 bp, Mus musculus
tgtgcctgataacagccattcccca

SEQ ID NO: 830853 - DNA, 25 bp, Mus musculus
tgtgcctgataagagccattcccca

SEQ ID NO: 830854 - DNA, 25 bp, Mus musculus
tgtgcctgatgaacacgcagttggc

SEQ ID NO: 830855 - DNA, 25 bp, Mus musculus
tgtgcctgatgatcacgcagttggc

SEQ ID NO: 830856 - DNA, 25 bp, Mus musculus
tgtgcctgcagcagactcgctccag

SEQ ID NO: 830857 - DNA, 25 bp, Mus musculus
tgtgcctgcagctgactcgctccag

SEQ ID NO: 830858 - DNA, 25 bp, Mus musculus
tgtgcctgcccactaaggctgaagg

SEQ ID NO: 830859 - DNA, 25 bp, Mus musculus
tgtgcctgcccagtaaggctgaagg

SEQ ID NO: 830860 - DNA, 25 bp, Mus musculus
tgtgcctggagactcaactctgcga

SEQ ID NO: 830861 - DNA, 25 bp, Mus musculus
tgtgcctggagagtcaactctgcga

SEQ ID NO: 830862 - DNA, 25 bp, Mus musculus
tgtgcctggatgaggcacccgtctc

SEQ ID NO: 830863 - DNA, 25 bp, Mus musculus
tgtgcctggatgtggcacccgtctc

SEQ ID NO: 830864 - DNA, 25 bp, Mus musculus
tgtgcctggctccatccgtacggct

SEQ ID NO: 830865 - DNA, 25 bp, Mus musculus
tgtgcctggctcgatccgtacggct

SEQ ID NO: 830866 - DNA, 25 bp, Mus musculus
tgtgcctgggctaccccgtttcctg

SEQ ID NO: 830867 - DNA, 25 bp, Mus musculus
tgtgcctgggcttccccgtttcctg

SEQ ID NO: 830868 - DNA, 25 bp, Mus musculus
tgtgcctggtccagtactctatgag

SEQ ID NO: 830869 - DNA, 25 bp, Mus musculus
tgtgcctggtcctgtactctatgag

SEQ ID NO: 830870 - DNA, 25 bp, Mus musculus
tgtgcctgtcaaacaacagcctggg

SEQ ID NO: 830871 - DNA, 25 bp, Mus musculus
tgtgcctgtcaatcaacagcctggg

SEQ ID NO: 830872 - DNA, 25 bp, Mus musculus
tgtgcctgtcgtagaaagtcttcag

SEQ ID NO: 830873 - DNA, 25 bp, Mus musculus
tgtgcctgtcgttgaaagtcttcag

SEQ ID NO: 830874 - DNA, 25 bp, Mus musculus
tgtgcctgtggacgaacttttcaag

SEQ ID NO: 830875 - DNA, 25 bp, Mus musculus
tgtgcctgtggaggaacttttcaag

SEQ ID NO: 830876 - DNA, 25 bp, Mus musculus
tgtgccttaataataaacactcctc

SEQ ID NO: 830877 - DNA, 25 bp, Mus musculus
tgtgccttaatattaaacactcctc

SEQ ID NO: 830878 - DNA, 25 bp, Mus musculus
tgtgccttacatagtgggaatcaac

SEQ ID NO: 830879 - DNA, 25 bp, Mus musculus
tgtgccttacattgtgggaatcaac

SEQ ID NO: 830880 - DNA, 25 bp, Mus musculus
tgtgccttactaacaccctggaggt

SEQ ID NO: 830881 - DNA, 25 bp, Mus musculus
tgtgccttactatcaccctggaggt

SEQ ID NO: 830882 - DNA, 25 bp, Mus musculus
tgtgccttaggaaggtttgggcatt

SEQ ID NO: 830883 - DNA, 25 bp, Mus musculus
tgtgccttaggatggtttgggcatt

SEQ ID NO: 830884 - DNA, 25 bp, Mus musculus
tgtgccttcccgagatgaaatcgaa

SEQ ID NO: 830885 - DNA, 25 bp, Mus musculus
tgtgccttcccgtgatgaaatcgaa

SEQ ID NO: 830886 - DNA, 25 bp, Mus musculus
tgtgccttcctgaggtttgccattc

SEQ ID NO: 830887 - DNA, 25 bp, Mus musculus
tgtgccttcctgtggtttgccattc

SEQ ID NO: 830888 - DNA, 25 bp, Mus musculus
tgtgccttctgccttacggttgcat

SEQ ID NO: 830889 - DNA, 25 bp, Mus musculus
tgtgccttctgcgttacggttgcat

SEQ ID NO: 830890 - DNA, 25 bp, Mus musculus
tgtgccttcttccagtgtttctgct

SEQ ID NO: 830891 - DNA, 25 bp, Mus musculus
tgtgccttcttccatggcgaggttg

SEQ ID NO: 830892 - DNA, 25 bp, Mus musculus
tgtgccttcttcgagtgtttctgct

SEQ ID NO: 830893 - DNA, 25 bp, Mus musculus
tgtgccttcttcgatggcgaggttg

SEQ ID NO: 830894 - DNA, 25 bp, Mus musculus
tgtgccttgcttctgggaacttaaa

SEQ ID NO: 830895 - DNA, 25 bp, Mus musculus
tgtgccttgcttgtgggaacttaaa

SEQ ID NO: 830896 - DNA, 25 bp, Mus musculus
tgtgccttggtcagtctactgggtc

SEQ ID NO: 830897 - DNA, 25 bp, Mus musculus
tgtgccttggtctgtctactgggtc

SEQ ID NO: 830898 - DNA, 25 bp, Mus musculus
tgtgccttgtgccagatgtcactgc

SEQ ID NO: 830899 - DNA, 25 bp, Mus musculus
tgtgccttgtgcgagatgtcactgc

SEQ ID NO: 830900 - DNA, 25 bp, Mus musculus
tgtgccttgttgattctggtcccgg

SEQ ID NO: 830901 - DNA, 25 bp, Mus musculus
tgtgccttgttgtttctggtcccgg

SEQ ID NO: 830902 - DNA, 25 bp, Mus musculus
tgtgcctttattctgcggagagact

SEQ ID NO: 830903 - DNA, 25 bp, Mus musculus
tgtgcctttattgtgcggagagact

SEQ ID NO: 830904 - DNA, 25 bp, Mus musculus
tgtgcctttgtcaacgccagacagg

SEQ ID NO: 830905 - DNA, 25 bp, Mus musculus
tgtgcctttgtctacgccagacagg

SEQ ID NO: 830906 - DNA, 25 bp, Mus musculus
tgtgccttttgaagtgccagagagc

SEQ ID NO: 830907 - DNA, 25 bp, Mus musculus
tgtgccttttgatgtgccagagagc

SEQ ID NO: 830908 - DNA, 25 bp, Mus musculus
tgtgcgaaacaacccctatgatgtg

SEQ ID NO: 830909 - DNA, 25 bp, Mus musculus
tgtgcgaaacaagccctatgatgtg

SEQ ID NO: 830910 - DNA, 25 bp, Mus musculus
tgtgcgacctgcagctgggtctcag

SEQ ID NO: 830911 - DNA, 25 bp, Mus musculus
tgtgcgacctgctgctgggtctcag

SEQ ID NO: 830912 - DNA, 25 bp, Mus musculus
tgtgcgagtggaaaggaacatgaaa

SEQ ID NO: 830913 - DNA, 25 bp, Mus musculus
tgtgcgagtggataggaacatgaaa

SEQ ID NO: 830914 - DNA, 25 bp, Mus musculus
tgtgcgatcttgaacagtggaggcc

SEQ ID NO: 830915 - DNA, 25 bp, Mus musculus
tgtgcgatcttgtacagtggaggcc

SEQ ID NO: 830916 - DNA, 25 bp, Mus musculus
tgtgcgcaagtccacacctgtgtcc

SEQ ID NO: 830917 - DNA, 25 bp, Mus musculus
tgtgcgcaagtcgacacctgtgtcc

SEQ ID NO: 830918 - DNA, 25 bp, Mus musculus
tgtgcgcacagacagcactggctct

SEQ ID NO: 830919 - DNA, 25 bp, Mus musculus
tgtgcgcacagagagcactggctct

SEQ ID NO: 830920 - DNA, 25 bp, Mus musculus
tgtgcgcagcctcagtcttagcctg

SEQ ID NO: 830921 - DNA, 25 bp, Mus musculus
tgtgcgcagcctgagtcttagcctg

SEQ ID NO: 830922 - DNA, 25 bp, Mus musculus
tgtgcgcagtgtccttcacggaaca

SEQ ID NO: 830923 - DNA, 25 bp, Mus musculus
tgtgcgcagtgtgcttcacggaaca

SEQ ID NO: 830924 - DNA, 25 bp, Mus musculus
tgtgcgccagatcgcagacctgtca

SEQ ID NO: 830925 - DNA, 25 bp, Mus musculus
tgtgcgccagatggcagacctgtca

SEQ ID NO: 830926 - DNA, 25 bp, Mus musculus
tgtgcgccatggacgaagcagaagc

SEQ ID NO: 830927 - DNA, 25 bp, Mus musculus
tgtgcgccatggtcgaagcagaagc

SEQ ID NO: 830928 - DNA, 25 bp, Mus musculus
tgtgcgccccagatggagtcctgga

SEQ ID NO: 830929 - DNA, 25 bp, Mus musculus
tgtgcgccccagttggagtcctgga

SEQ ID NO: 830930 - DNA, 25 bp, Mus musculus
tgtgcgccttgaccgagttcgagga

SEQ ID NO: 830931 - DNA, 25 bp, Mus musculus
tgtgcgccttgagcgagttcgagga

SEQ ID NO: 830932 - DNA, 25 bp, Mus musculus
tgtgcgcgccatccgagagatgaat

SEQ ID NO: 830933 - DNA, 25 bp, Mus musculus
tgtgcgcgccatgcgagagatgaat

SEQ ID NO: 830934 - DNA, 25 bp, Mus musculus
tgtgcgcgctcaacctgctgtatac

SEQ ID NO: 830935 - DNA, 25 bp, Mus musculus
tgtgcgcgctcatcctgctgtatac

SEQ ID NO: 830936 - DNA, 25 bp, Mus musculus
tgtgcgcgctccaagagtgtatttg

SEQ ID NO: 830937 - DNA, 25 bp, Mus musculus
tgtgcgcgctcctagagtgtatttg

SEQ ID NO: 830938 - DNA, 25 bp, Mus musculus
tgtgcgcgttgaatcagccacaggc

SEQ ID NO: 830939 - DNA, 25 bp, Mus musculus
tgtgcgcgttgattcagccacaggc

SEQ ID NO: 830940 - DNA, 25 bp, Mus musculus
tgtgcgcgtttgcaactaacccgga

SEQ ID NO: 830941 - DNA, 25 bp, Mus musculus
tgtgcgcgtttggaactaacccgga

SEQ ID NO: 830942 - DNA, 25 bp, Mus musculus
tgtgcgctcccgctacatctgtagt

SEQ ID NO: 830943 - DNA, 25 bp, Mus musculus
tgtgcgctcccggtacatctgtagt

SEQ ID NO: 830944 - DNA, 25 bp, Mus musculus
tgtgcgctgctgagttggcctctct

SEQ ID NO: 830945 - DNA, 25 bp, Mus musculus
tgtgcgctgctgtgttggcctctct

SEQ ID NO: 830946 - DNA, 25 bp, Mus musculus
tgtgcgctgggcaacgtgactctcc

SEQ ID NO: 830947 - DNA, 25 bp, Mus musculus
tgtgcgctgggctacgtgactctcc

SEQ ID NO: 830948 - DNA, 25 bp, Mus musculus
tgtgcggaaacacacacgtgcaccc

SEQ ID NO: 830949 - DNA, 25 bp, Mus musculus
tgtgcggaaacagacacgtgcaccc

SEQ ID NO: 830950 - DNA, 25 bp, Mus musculus
tgtgcggaaaggagcatgtgccaac

SEQ ID NO: 830951 - DNA, 25 bp, Mus musculus
tgtgcggaaaggtgcatgtgccaac

SEQ ID NO: 830952 - DNA, 25 bp, Mus musculus
tgtgcggacctgcattatggacaat

SEQ ID NO: 830953 - DNA, 25 bp, Mus musculus
tgtgcggacctggattatggacaat

SEQ ID NO: 830954 - DNA, 25 bp, Mus musculus
tgtgcggacgttcccggaagcttaa

SEQ ID NO: 830955 - DNA, 25 bp, Mus musculus
tgtgcggacgttgccggaagcttaa

SEQ ID NO: 830956 - DNA, 25 bp, Mus musculus
tgtgcggactgtactacctgttcgc

SEQ ID NO: 830957 - DNA, 25 bp, Mus musculus
tgtgcggactgttctacctgttcgc

SEQ ID NO: 830958 - DNA, 25 bp, Mus musculus
tgtgcggagtccatctggctgtgcc

SEQ ID NO: 830959 - DNA, 25 bp, Mus musculus
tgtgcggagtccttctggctgtgcc

SEQ ID NO: 830960 - DNA, 25 bp, Mus musculus
tgtgcggcaacaacatgtccgctcc

SEQ ID NO: 830961 - DNA, 25 bp, Mus musculus
tgtgcggcaacatcatgtccgctcc

SEQ ID NO: 830962 - DNA, 25 bp, Mus musculus
tgtgcggccctcagtgcctacgaca

SEQ ID NO: 830963 - DNA, 25 bp, Mus musculus
tgtgcggccctctgtgcctacgaca

SEQ ID NO: 830964 - DNA, 25 bp, Mus musculus
tgtgcggcgcctagacttttttgag

SEQ ID NO: 830965 - DNA, 25 bp, Mus musculus
tgtgcggcgccttgacttttttgag

SEQ ID NO: 830966 - DNA, 25 bp, Mus musculus
tgtgcggcggccattcctgtgcgcc

SEQ ID NO: 830967 - DNA, 25 bp, Mus musculus
tgtgcggcggcctttcctgtgcgcc

SEQ ID NO: 830968 - DNA, 25 bp, Mus musculus
tgtgcgggacgtctgggcagcctgc

SEQ ID NO: 830969 - DNA, 25 bp, Mus musculus
tgtgcgggacgtgtgggcagcctgc

SEQ ID NO: 830970 - DNA, 25 bp, Mus musculus
tgtgcgggagccatgacctcgctga

SEQ ID NO: 830971 - DNA, 25 bp, Mus musculus
tgtgcgggagccttgacctcgctga

SEQ ID NO: 830972 - DNA, 25 bp, Mus musculus
tgtgcgggatgcctttcagcaaatc

SEQ ID NO: 830973 - DNA, 25 bp, Mus musculus
tgtgcgggatgcgtttcagcaaatc

SEQ ID NO: 830974 - DNA, 25 bp, Mus musculus
tgtgcgggcaaactctggcagccaa

SEQ ID NO: 830975 - DNA, 25 bp, Mus musculus
tgtgcgggcaaagtctggcagccaa

SEQ ID NO: 830976 - DNA, 25 bp, Mus musculus
tgtgcgggtgccaacaaaagcaagc

SEQ ID NO: 830977 - DNA, 25 bp, Mus musculus
tgtgcgggtgcctacaaaagcaagc

SEQ ID NO: 830978 - DNA, 25 bp, Mus musculus
tgtgcggtctgcatcacgacaggga

SEQ ID NO: 830979 - DNA, 25 bp, Mus musculus
tgtgcggtctgcttcacgacaggga

SEQ ID NO: 830980 - DNA, 25 bp, Mus musculus
tgtgcggtgatcaaaacttctaccc

SEQ ID NO: 830981 - DNA, 25 bp, Mus musculus
tgtgcggtgatctaaacttctaccc

SEQ ID NO: 830982 - DNA, 25 bp, Mus musculus
tgtgcggtgctccgctacaccaagc

SEQ ID NO: 830983 - DNA, 25 bp, Mus musculus
tgtgcggtgctcggctacaccaagc

SEQ ID NO: 830984 - DNA, 25 bp, Mus musculus
tgtgcgtaccagagaagcaataaaa

SEQ ID NO: 830985 - DNA, 25 bp, Mus musculus
tgtgcgtaccagtgaagcaataaaa

SEQ ID NO: 830986 - DNA, 25 bp, Mus musculus
tgtgcgtcaggacatgagtcagcac

SEQ ID NO: 830987 - DNA, 25 bp, Mus musculus
tgtgcgtcaggagatgagtcagcac

SEQ ID NO: 830988 - DNA, 25 bp, Mus musculus
tgtgcgtccgagaggcaacaaagtt

SEQ ID NO: 830989 - DNA, 25 bp, Mus musculus
tgtgcgtccgagtggcaacaaagtt

SEQ ID NO: 830990 - DNA, 25 bp, Mus musculus
tgtgcgtcctgcatcaatgacctat

SEQ ID NO: 830991 - DNA, 25 bp, Mus musculus
tgtgcgtcctgcttcaatgacctat

SEQ ID NO: 830992 - DNA, 25 bp, Mus musculus
tgtgcgtcctttatctccattggat

SEQ ID NO: 830993 - DNA, 25 bp, Mus musculus
tgtgcgtcctttctgtccattgatt

SEQ ID NO: 830994 - DNA, 25 bp, Mus musculus
tgtgcgtcctttgtgtccattgatt

SEQ ID NO: 830995 - DNA, 25 bp, Mus musculus
tgtgcgtcctttttctccattggat

SEQ ID NO: 830996 - DNA, 25 bp, Mus musculus
tgtgcgtctaaacggtggtgcccac

SEQ ID NO: 830997 - DNA, 25 bp, Mus musculus
tgtgcgtctaaagggtggtgcccac

SEQ ID NO: 830998 - DNA, 25 bp, Mus musculus
tgtgcgtcttctagttcgctgcctg

SEQ ID NO: 830999 - DNA, 25 bp, Mus musculus
tgtgcgtcttcttgttcgctgcctg

SEQ ID NO: 831000 - DNA, 25 bp, Mus musculus
tgtgcgtgacaacgagatgaactcc

SEQ ID NO: 831001 - DNA, 25 bp, Mus musculus
tgtgcgtgacaaggagatgaactcc

SEQ ID NO: 831002 - DNA, 25 bp, Mus musculus
tgtgcgtggtaacgtggacaccctt

SEQ ID NO: 831003 - DNA, 25 bp, Mus musculus
tgtgcgtggtaaggtggacaccctt

SEQ ID NO: 831004 - DNA, 25 bp, Mus musculus
tgtgcgtgtcacctctagatgacat

SEQ ID NO: 831005 - DNA, 25 bp, Mus musculus
tgtgcgtgtcacgtctagatgacat

SEQ ID NO: 831006 - DNA, 25 bp, Mus musculus
tgtgcgtgtggcaagaacctccttg

SEQ ID NO: 831007 - DNA, 25 bp, Mus musculus
tgtgcgtgtggctagaacctccttg

SEQ ID NO: 831008 - DNA, 25 bp, Mus musculus
tgtgcgttccatccaattggacggg

SEQ ID NO: 831009 - DNA, 25 bp, Mus musculus
tgtgcgttccatgcaattggacggg

SEQ ID NO: 831010 - DNA, 25 bp, Mus musculus
tgtgctaaagcactccgtgccaggt

SEQ ID NO: 831011 - DNA, 25 bp, Mus musculus
tgtgctaaagcagtccgtgccaggt

SEQ ID NO: 831012 - DNA, 25 bp, Mus musculus
tgtgctaaagccagccagaaatgtg

SEQ ID NO: 831013 - DNA, 25 bp, Mus musculus
tgtgctaaagcctgccagaaatgtg

SEQ ID NO: 831014 - DNA, 25 bp, Mus musculus
tgtgctaaagctcagccgcctagct

SEQ ID NO: 831015 - DNA, 25 bp, Mus musculus
tgtgctaaagctgagccgcctagct

SEQ ID NO: 831016 - DNA, 25 bp, Mus musculus
tgtgctaagactctcattctcagtc

SEQ ID NO: 831017 - DNA, 25 bp, Mus musculus
tgtgctaagactgtcattctcagtc

SEQ ID NO: 831018 - DNA, 25 bp, Mus musculus
tgtgctaaggccatgctagaaaacg

SEQ ID NO: 831019 - DNA, 25 bp, Mus musculus
tgtgctaaggccttgctagaaaacg

SEQ ID NO: 831020 - DNA, 25 bp, Mus musculus
tgtgctaatgaaaatgcccataaag

SEQ ID NO: 831021 - DNA, 25 bp, Mus musculus
tgtgctaatgaatatgcccataaag

SEQ ID NO: 831022 - DNA, 25 bp, Mus musculus
tgtgctaatttaaccagactgactc

SEQ ID NO: 831023 - DNA, 25 bp, Mus musculus
tgtgctaatttatccagactgactc

SEQ ID NO: 831024 - DNA, 25 bp, Mus musculus
tgtgctacacggaggaagaagccaa

SEQ ID NO: 831025 - DNA, 25 bp, Mus musculus
tgtgctacacggtggaagaagccaa

SEQ ID NO: 831026 - DNA, 25 bp, Mus musculus
tgtgctacagcgctgctgtcacact

SEQ ID NO: 831027 - DNA, 25 bp, Mus musculus
tgtgctacagcggtgctgtcacact

SEQ ID NO: 831028 - DNA, 25 bp, Mus musculus
tgtgctacatgtacgtcaatctggc

SEQ ID NO: 831029 - DNA, 25 bp, Mus musculus
tgtgctacatgttcgtcaatctggc

SEQ ID NO: 831030 - DNA, 25 bp, Mus musculus
tgtgctacctcaccatcaaggaaat

SEQ ID NO: 831031 - DNA, 25 bp, Mus musculus
tgtgctacctcagcatcaaggaaat

SEQ ID NO: 831032 - DNA, 25 bp, Mus musculus
tgtgctacctgaaggccgggtcatc

SEQ ID NO: 831033 - DNA, 25 bp, Mus musculus
tgtgctacctgatggccgggtcatc

SEQ ID NO: 831034 - DNA, 25 bp, Mus musculus
tgtgctagcgtaagttgtcgctttg

SEQ ID NO: 831035 - DNA, 25 bp, Mus musculus
tgtgctagcgtatgttgtcgctttg

SEQ ID NO: 831036 - DNA, 25 bp, Mus musculus
tgtgctaggaggcaacactacattc

SEQ ID NO: 831037 - DNA, 25 bp, Mus musculus
tgtgctaggagggaacactacattc

SEQ ID NO: 831038 - DNA, 25 bp, Mus musculus
tgtgctaggtgtacacgaagcagag

SEQ ID NO: 831039 - DNA, 25 bp, Mus musculus
tgtgctaggtgttcacgaagcagag

SEQ ID NO: 831040 - DNA, 25 bp, Mus musculus
tgtgctagtcctcagggacttgacc

SEQ ID NO: 831041 - DNA, 25 bp, Mus musculus
tgtgctagtcctgagggacttgacc

SEQ ID NO: 831042 - DNA, 25 bp, Mus musculus
tgtgctagtcggatccaagagctat

SEQ ID NO: 831043 - DNA, 25 bp, Mus musculus
tgtgctagtcggttccaagagctat

SEQ ID NO: 831044 - DNA, 25 bp, Mus musculus
tgtgctagttgacgagtaccagatg

SEQ ID NO: 831045 - DNA, 25 bp, Mus musculus
tgtgctagttgaggagtaccagatg

SEQ ID NO: 831046 - DNA, 25 bp, Mus musculus
tgtgctataaccaccctggatccta

SEQ ID NO: 831047 - DNA, 25 bp, Mus musculus
tgtgctataacctccctggatccta

SEQ ID NO: 831048 - DNA, 25 bp, Mus musculus
tgtgctatagaaccgagatatccct

SEQ ID NO: 831049 - DNA, 25 bp, Mus musculus
tgtgctatagaagcgagatatccct

SEQ ID NO: 831050 - DNA, 25 bp, Mus musculus
tgtgctataggaattgctccctggg

SEQ ID NO: 831051 - DNA, 25 bp, Mus musculus
tgtgctataggatttgctccctggg

SEQ ID NO: 831052 - DNA, 25 bp, Mus musculus
tgtgctatcaacaccctgccctgtt

SEQ ID NO: 831053 - DNA, 25 bp, Mus musculus
tgtgctatcaactccctgccctgtt

SEQ ID NO: 831054 - DNA, 25 bp, Mus musculus
tgtgctatctatcggagagactgtg

SEQ ID NO: 831055 - DNA, 25 bp, Mus musculus
tgtgctatctatgggagagactgtg

SEQ ID NO: 831056 - DNA, 25 bp, Mus musculus
tgtgctatgccaaagaataccaagg

SEQ ID NO: 831057 - DNA, 25 bp, Mus musculus
tgtgctatgccatagaataccaagg

SEQ ID NO: 831058 - DNA, 25 bp, Mus musculus
tgtgctatgcctcttcgttcgggag

SEQ ID NO: 831059 - DNA, 25 bp, Mus musculus
tgtgctatgcctgttcgttcgggag

SEQ ID NO: 831060 - DNA, 25 bp, Mus musculus
tgtgctatggatcccccctgaacac

SEQ ID NO: 831061 - DNA, 25 bp, Mus musculus
tgtgctatggatgccccctgaacac

SEQ ID NO: 831062 - DNA, 25 bp, Mus musculus
tgtgctcaaaccatttagagaaaat

SEQ ID NO: 831063 - DNA, 25 bp, Mus musculus
tgtgctcaaaccttttagagaaaat

SEQ ID NO: 831064 - DNA, 25 bp, Mus musculus
tgtgctcaactaccttgccactcgg

SEQ ID NO: 831065 - DNA, 25 bp, Mus musculus
tgtgctcaactagcttgccactcgg

SEQ ID NO: 831066 - DNA, 25 bp, Mus musculus
tgtgctcaacttcgcttatgcccag

SEQ ID NO: 831067 - DNA, 25 bp, Mus musculus
tgtgctcaacttggcttatgcccag

SEQ ID NO: 831068 - DNA, 25 bp, Mus musculus
tgtgctcacaatcgagtataaggta

SEQ ID NO: 831069 - DNA, 25 bp, Mus musculus
tgtgctcacaatggagtataaggta

SEQ ID NO: 831070 - DNA, 25 bp, Mus musculus
tgtgctcacgatcagaccagaaccg

SEQ ID NO: 831071 - DNA, 25 bp, Mus musculus
tgtgctcacgatgagaccagaaccg

SEQ ID NO: 831072 - DNA, 25 bp, Mus musculus
tgtgctcagagaaaagtgaccactc

SEQ ID NO: 831073 - DNA, 25 bp, Mus musculus
tgtgctcagagataagtgaccactc

SEQ ID NO: 831074 - DNA, 25 bp, Mus musculus
tgtgctcagccaatgtgacagtcct

SEQ ID NO: 831075 - DNA, 25 bp, Mus musculus
tgtgctcagccattgtgacagtcct

SEQ ID NO: 831076 - DNA, 25 bp, Mus musculus
tgtgctcagtccagagctactcggg

SEQ ID NO: 831077 - DNA, 25 bp, Mus musculus
tgtgctcagtcctgagctactcggg

SEQ ID NO: 831078 - DNA, 25 bp, Mus musculus
tgtgctcagtgaaggcaaagccacc

SEQ ID NO: 831079 - DNA, 25 bp, Mus musculus
tgtgctcagtgatggcaaagccacc

SEQ ID NO: 831080 - DNA, 25 bp, Mus musculus
tgtgctcattaacattgacccgtgt

SEQ ID NO: 831081 - DNA, 25 bp, Mus musculus
tgtgctcattaagattgacccgtgt

SEQ ID NO: 831082 - DNA, 25 bp, Mus musculus
tgtgctccagaacccaaagttttga

SEQ ID NO: 831083 - DNA, 25 bp, Mus musculus
tgtgctccagaagccaaagttttga

SEQ ID NO: 831084 - DNA, 25 bp, Mus musculus
tgtgctccagagcagcagttcatcc

SEQ ID NO: 831085 - DNA, 25 bp, Mus musculus
tgtgctccagaggagcagttcatcc

SEQ ID NO: 831086 - DNA, 25 bp, Mus musculus
tgtgctccccaacgacgtggaggat

SEQ ID NO: 831087 - DNA, 25 bp, Mus musculus
tgtgctccccaaggacgtggaggat

SEQ ID NO: 831088 - DNA, 25 bp, Mus musculus
tgtgctccgcagcatgcgggctcct

SEQ ID NO: 831089 - DNA, 25 bp, Mus musculus
tgtgctccgcaggatgcgggctcct

SEQ ID NO: 831090 - DNA, 25 bp, Mus musculus
tgtgctcctacgagaaacctgagca

SEQ ID NO: 831091 - DNA, 25 bp, Mus musculus
tgtgctcctacgtgaaacctgagca

SEQ ID NO: 831092 - DNA, 25 bp, Mus musculus
tgtgctcctgaacaacggagccaac

SEQ ID NO: 831093 - DNA, 25 bp, Mus musculus
tgtgctcctgaagaacggagccaac

SEQ ID NO: 831094 - DNA, 25 bp, Mus musculus
tgtgctcctgcacgtctatgacgct

SEQ ID NO: 831095 - DNA, 25 bp, Mus musculus
tgtgctcctgcaggtctatgacgct

SEQ ID NO: 831096 - DNA, 25 bp, Mus musculus
tgtgctcctggcagttgagctgctc

SEQ ID NO: 831097 - DNA, 25 bp, Mus musculus
tgtgctcctggctgttgagctgctc

SEQ ID NO: 831098 - DNA, 25 bp, Mus musculus
tgtgctccttcgagattccctcagg

SEQ ID NO: 831099 - DNA, 25 bp, Mus musculus
tgtgctccttcgtgattccctcagg

SEQ ID NO: 831100 - DNA, 25 bp, Mus musculus
tgtgctcgaaaacgatgtccagaaa

SEQ ID NO: 831101 - DNA, 25 bp, Mus musculus
tgtgctcgaaaaggatgtccagaaa

SEQ ID NO: 831102 - DNA, 25 bp, Mus musculus
tgtgctcgatgacgactcctactta

SEQ ID NO: 831103 - DNA, 25 bp, Mus musculus
tgtgctcgatgaggactcctactta

SEQ ID NO: 831104 - DNA, 25 bp, Mus musculus
tgtgctcggtaaactcccagctgga

SEQ ID NO: 831105 - DNA, 25 bp, Mus musculus
tgtgctcggtaatctcccagctgga

SEQ ID NO: 831106 - DNA, 25 bp, Mus musculus
tgtgctcggtcgatcctcgtgctga

SEQ ID NO: 831107 - DNA, 25 bp, Mus musculus
tgtgctcggtcgttcctcgtgctga

SEQ ID NO: 831108 - DNA, 25 bp, Mus musculus
tgtgctcgtctccagagactcggag

SEQ ID NO: 831109 - DNA, 25 bp, Mus musculus
tgtgctcgtctcgagagactcggag

SEQ ID NO: 831110 - DNA, 25 bp, Mus musculus
tgtgctctacttcacctggctggca

SEQ ID NO: 831111 - DNA, 25 bp, Mus musculus
tgtgctctacttgacctggctggca

SEQ ID NO: 831112 - DNA, 25 bp, Mus musculus
tgtgctctcaacaagtttggttggt

SEQ ID NO: 831113 - DNA, 25 bp, Mus musculus
tgtgctctcaactagtttggttggt

SEQ ID NO: 831114 - DNA, 25 bp, Mus musculus
tgtgctctcactcttaagggttctg

SEQ ID NO: 831115 - DNA, 25 bp, Mus musculus
tgtgctctcactgttaagggttctg

SEQ ID NO: 831116 - DNA, 25 bp, Mus musculus
tgtgctctcccgcagtcctctgcag

SEQ ID NO: 831117 - DNA, 25 bp, Mus musculus
tgtgctctcccggagtcctctgcag

SEQ ID NO: 831118 - DNA, 25 bp, Mus musculus
tgtgctctcgcaactcctgatcgcg

SEQ ID NO: 831119 - DNA, 25 bp, Mus musculus
tgtgctctcgcatctcctgatcgcg

SEQ ID NO: 831120 - DNA, 25 bp, Mus musculus
tgtgctctgagcagataaagcctgg

SEQ ID NO: 831121 - DNA, 25 bp, Mus musculus
tgtgctctgagctgataaagcctgg

SEQ ID NO: 831122 - DNA, 25 bp, Mus musculus
tgtgctctgcaacatttggctccaa

SEQ ID NO: 831123 - DNA, 25 bp, Mus musculus
tgtgctctgcaagatttggctccaa

SEQ ID NO: 831124 - DNA, 25 bp, Mus musculus
tgtgctctgcgtaccaatgccctgt

SEQ ID NO: 831125 - DNA, 25 bp, Mus musculus
tgtgctctgcgttccaatgccctgt

SEQ ID NO: 831126 - DNA, 25 bp, Mus musculus
tgtgctcttcttagcctacagtgac

SEQ ID NO: 831127 - DNA, 25 bp, Mus musculus
tgtgctcttctttgcctacagtgac

SEQ ID NO: 831128 - DNA, 25 bp, Mus musculus
tgtgctgaacgcagcccaaagtatc

SEQ ID NO: 831129 - DNA, 25 bp, Mus musculus
tgtgctgaacgctgcccaaagtatc

SEQ ID NO: 831130 - DNA, 25 bp, Mus musculus
tgtgctgaacttagaactgccacca

SEQ ID NO: 831131 - DNA, 25 bp, Mus musculus
tgtgctgaactttgaactgccacca

SEQ ID NO: 831132 - DNA, 25 bp, Mus musculus
tgtgctgaagtacagccagaaagac

SEQ ID NO: 831133 - DNA, 25 bp, Mus musculus
tgtgctgaagtagagccagaaagac

SEQ ID NO: 831134 - DNA, 25 bp, Mus musculus
tgtgctgaagtccagtcttggctca

SEQ ID NO: 831135 - DNA, 25 bp, Mus musculus
tgtgctgaagtcgagtcttggctca

SEQ ID NO: 831136 - DNA, 25 bp, Mus musculus
tgtgctgaattacaccaaaatgtaa

SEQ ID NO: 831137 - DNA, 25 bp, Mus musculus
tgtgctgaattagaccaaaatgtaa

SEQ ID NO: 831138 - DNA, 25 bp, Mus musculus
tgtgctgacattcctatgatgttaa

SEQ ID NO: 831139 - DNA, 25 bp, Mus musculus
tgtgctgacattgctatgatgttaa

SEQ ID NO: 831140 - DNA, 25 bp, Mus musculus
tgtgctgaccagagatcagtcctcc

SEQ ID NO: 831141 - DNA, 25 bp, Mus musculus
tgtgctgaccagtgatcagtcctcc

SEQ ID NO: 831142 - DNA, 25 bp, Mus musculus
tgtgctgaccttctgattccagtga

SEQ ID NO: 831143 - DNA, 25 bp, Mus musculus
tgtgctgaccttgtgattccagtga

SEQ ID NO: 831144 - DNA, 25 bp, Mus musculus
tgtgctgactatcctgagcaagatg

SEQ ID NO: 831145 - DNA, 25 bp, Mus musculus
tgtgctgactatgctgagcaagatg

SEQ ID NO: 831146 - DNA, 25 bp, Mus musculus
tgtgctgactgactacccatctcct

SEQ ID NO: 831147 - DNA, 25 bp, Mus musculus
tgtgctgactgagtacccatctcct

SEQ ID NO: 831148 - DNA, 25 bp, Mus musculus
tgtgctgaggctcgaatctctgcac

SEQ ID NO: 831149 - DNA, 25 bp, Mus musculus
tgtgctgaggctctactttgatgat

SEQ ID NO: 831150 - DNA, 25 bp, Mus musculus
tgtgctgaggctggaatctctgcac

SEQ ID NO: 831151 - DNA, 25 bp, Mus musculus
tgtgctgaggctgtactttgatgat

SEQ ID NO: 831152 - DNA, 25 bp, Mus musculus
tgtgctgataacatcgagaagtgtt

SEQ ID NO: 831153 - DNA, 25 bp, Mus musculus
tgtgctgataacttcgagaagtgtt

SEQ ID NO: 831154 - DNA, 25 bp, Mus musculus
tgtgctgatcctcactgctgctttg

SEQ ID NO: 831155 - DNA, 25 bp, Mus musculus
tgtgctgatcctgactgctgctttg

SEQ ID NO: 831156 - DNA, 25 bp, Mus musculus
tgtgctgcaacgatgaaagcggcga

SEQ ID NO: 831157 - DNA, 25 bp, Mus musculus
tgtgctgcaacgttgaaagcggcga

SEQ ID NO: 831158 - DNA, 25 bp, Mus musculus
tgtgctgcaagacgcactggacaag

SEQ ID NO: 831159 - DNA, 25 bp, Mus musculus
tgtgctgcaagaggcactggacaag

SEQ ID NO: 831160 - DNA, 25 bp, Mus musculus
tgtgctgcacttcagacatgcggga

SEQ ID NO: 831161 - DNA, 25 bp, Mus musculus
tgtgctgcacttgagacatgcggga

SEQ ID NO: 831162 - DNA, 25 bp, Mus musculus
tgtgctgccaacattgagaacttat

SEQ ID NO: 831163 - DNA, 25 bp, Mus musculus
tgtgctgccaactttgagaacttat

SEQ ID NO: 831164 - DNA, 25 bp, Mus musculus
tgtgctgcccctcttgctcggttgg

SEQ ID NO: 831165 - DNA, 25 bp, Mus musculus
tgtgctgcccctgttgctcggttgg

SEQ ID NO: 831166 - DNA, 25 bp, Mus musculus
tgtgctgctaatcgatacccagggt

SEQ ID NO: 831167 - DNA, 25 bp, Mus musculus
tgtgctgctaatggatacccagggt

SEQ ID NO: 831168 - DNA, 25 bp, Mus musculus
tgtgctgctacaagaacttcacagg

SEQ ID NO: 831169 - DNA, 25 bp, Mus musculus
tgtgctgctacatgaacttcacagg

SEQ ID NO: 831170 - DNA, 25 bp, Mus musculus
tgtgctgctcaaactctactcggat

SEQ ID NO: 831171 - DNA, 25 bp, Mus musculus
tgtgctgctcaatctctactcggat

SEQ ID NO: 831172 - DNA, 25 bp, Mus musculus
tgtgctgctcataatgcccctggtg

SEQ ID NO: 831173 - DNA, 25 bp, Mus musculus
tgtgctgctcattatgcccctggtg

SEQ ID NO: 831174 - DNA, 25 bp, Mus musculus
tgtgctgctctcaagcaaggctgtg

SEQ ID NO: 831175 - DNA, 25 bp, Mus musculus
tgtgctgctctctagcaaggctgtg

SEQ ID NO: 831176 - DNA, 25 bp, Mus musculus
tgtgctgctgacactgacctcaact

SEQ ID NO: 831177 - DNA, 25 bp, Mus musculus
tgtgctgctgactctgacctcaact

SEQ ID NO: 831178 - DNA, 25 bp, Mus musculus
tgtgctgctggaccatgacagccta

SEQ ID NO: 831179 - DNA, 25 bp, Mus musculus
tgtgctgctggagcatgacagccta

SEQ ID NO: 831180 - DNA, 25 bp, Mus musculus
tgtgctggagaccatacaatcagtg

SEQ ID NO: 831181 - DNA, 25 bp, Mus musculus
tgtgctggagacgatacaatcagtg

SEQ ID NO: 831182 - DNA, 25 bp, Mus musculus
tgtgctggagctcagctgtccacag

SEQ ID NO: 831183 - DNA, 25 bp, Mus musculus
tgtgctggagctgagctgtccacag

SEQ ID NO: 831184 - DNA, 25 bp, Mus musculus
tgtgctggagtaagcaaacctcgta

SEQ ID NO: 831185 - DNA, 25 bp, Mus musculus
tgtgctggagtatgcaaacctcgta

SEQ ID NO: 831186 - DNA, 25 bp, Mus musculus
tgtgctggatacatcatgtcaccgg

SEQ ID NO: 831187 - DNA, 25 bp, Mus musculus
tgtgctggatacttcatgtcaccgg

SEQ ID NO: 831188 - DNA, 25 bp, Mus musculus
tgtgctggcccaaccttgcattgtt

SEQ ID NO: 831189 - DNA, 25 bp, Mus musculus
tgtgctggcccatccttgcattgtt

SEQ ID NO: 831190 - DNA, 25 bp, Mus musculus
tgtgctggcctacgacgaagctccc

SEQ ID NO: 831191 - DNA, 25 bp, Mus musculus
tgtgctggcctacttgggaaacccc

SEQ ID NO: 831192 - DNA, 25 bp, Mus musculus
tgtgctggcctaggacgaagctccc

SEQ ID NO: 831193 - DNA, 25 bp, Mus musculus
tgtgctggcctagttgggaaacccc

SEQ ID NO: 831194 - DNA, 25 bp, Mus musculus
tgtgctgggaaactgctgcctgccc

SEQ ID NO: 831195 - DNA, 25 bp, Mus musculus
tgtgctgggaaagtgctgcctgccc

SEQ ID NO: 831196 - DNA, 25 bp, Mus musculus
tgtgctgggatgatacgggtattat

SEQ ID NO: 831197 - DNA, 25 bp, Mus musculus
tgtgctgggatgttacgggtattat

SEQ ID NO: 831198 - DNA, 25 bp, Mus musculus
tgtgctgggcagaatctggaaccac

SEQ ID NO: 831199 - DNA, 25 bp, Mus musculus
tgtgctgggcagtatctggaaccac

SEQ ID NO: 831200 - DNA, 25 bp, Mus musculus
tgtgctgggcccactttatgccacc

SEQ ID NO: 831201 - DNA, 25 bp, Mus musculus
tgtgctgggccctctttatgccacc

SEQ ID NO: 831202 - DNA, 25 bp, Mus musculus
tgtgctggtagaaccaccaccattg

SEQ ID NO: 831203 - DNA, 25 bp, Mus musculus
tgtgctggtagatccaccaccattg

SEQ ID NO: 831204 - DNA, 25 bp, Mus musculus
tgtgctggtaggaacgacttgcatc

SEQ ID NO: 831205 - DNA, 25 bp, Mus musculus
tgtgctggtaggtacgacttgcatc

SEQ ID NO: 831206 - DNA, 25 bp, Mus musculus
tgtgctggtctccatcaccctggag

SEQ ID NO: 831207 - DNA, 25 bp, Mus musculus
tgtgctggtctcgatcaccctggag

SEQ ID NO: 831208 - DNA, 25 bp, Mus musculus
tgtgctggtgaaacagaccatcgcg

SEQ ID NO: 831209 - DNA, 25 bp, Mus musculus
tgtgctggtgaacgtggatacttcc

SEQ ID NO: 831210 - DNA, 25 bp, Mus musculus
tgtgctggtgaaggtggatacttcc

SEQ ID NO: 831211 - DNA, 25 bp, Mus musculus
tgtgctggtgaatcagaccatcgcg

SEQ ID NO: 831212 - DNA, 25 bp, Mus musculus
tgtgctggtgatctgtcacactagg

SEQ ID NO: 831213 - DNA, 25 bp, Mus musculus
tgtgctggtgatgtgtcacactagg

SEQ ID NO: 831214 - DNA, 25 bp, Mus musculus
tgtgctggtggcagctctcacagtg

SEQ ID NO: 831215 - DNA, 25 bp, Mus musculus
tgtgctggtggctgctctcacagtg

SEQ ID NO: 831216 - DNA, 25 bp, Mus musculus
tgtgctggtggtagccaagaagtcc

SEQ ID NO: 831217 - DNA, 25 bp, Mus musculus
tgtgctggtggttgccaagaagtcc

SEQ ID NO: 831218 - DNA, 25 bp, Mus musculus
tgtgctggtgttacggtgtgtcttc

SEQ ID NO: 831219 - DNA, 25 bp, Mus musculus
tgtgctggtgtttcggtgtgtcttc

SEQ ID NO: 831220 - DNA, 25 bp, Mus musculus
tgtgctgtacacaaaggctttgcaa

SEQ ID NO: 831221 - DNA, 25 bp, Mus musculus
tgtgctgtacactaaggctttgcaa

SEQ ID NO: 831222 - DNA, 25 bp, Mus musculus
tgtgctgtacggcaaacgcggtaaa

SEQ ID NO: 831223 - DNA, 25 bp, Mus musculus
tgtgctgtacgggaaacgcggtaaa

SEQ ID NO: 831224 - DNA, 25 bp, Mus musculus
tgtgctgtatgacctctcaccaatg

SEQ ID NO: 831225 - DNA, 25 bp, Mus musculus
tgtgctgtatgagctctcaccaatg

SEQ ID NO: 831226 - DNA, 25 bp, Mus musculus
tgtgctgtcccacagcctgtttacc

SEQ ID NO: 831227 - DNA, 25 bp, Mus musculus
tgtgctgtcccagagcctgtttacc

SEQ ID NO: 831228 - DNA, 25 bp, Mus musculus
tgtgctgtccgcacccagtttgttc

SEQ ID NO: 831229 - DNA, 25 bp, Mus musculus
tgtgctgtccgctcccagtttgttc

SEQ ID NO: 831230 - DNA, 25 bp, Mus musculus
tgtgctgtcctccctggagcgcaca

SEQ ID NO: 831231 - DNA, 25 bp, Mus musculus
tgtgctgtcctcgctggagcgcaca

SEQ ID NO: 831232 - DNA, 25 bp, Mus musculus
tgtgctgtgctaaaattctcgactc

SEQ ID NO: 831233 - DNA, 25 bp, Mus musculus
tgtgctgtgctataattctcgactc

SEQ ID NO: 831234 - DNA, 25 bp, Mus musculus
tgtgctgtgggtaatccatgttacc

SEQ ID NO: 831235 - DNA, 25 bp, Mus musculus
tgtgctgtgggttatccatgttacc

SEQ ID NO: 831236 - DNA, 25 bp, Mus musculus
tgtgctgttagcctcccttgtgtcg

SEQ ID NO: 831237 - DNA, 25 bp, Mus musculus
tgtgctgttagcgtcccttgtgtcg

SEQ ID NO: 831238 - DNA, 25 bp, Mus musculus
tgtgctgttgaacaatttccccttg

SEQ ID NO: 831239 - DNA, 25 bp, Mus musculus
tgtgctgttgaagaatttccccttg

SEQ ID NO: 831240 - DNA, 25 bp, Mus musculus
tgtgctgttggcagcccttctgggc

SEQ ID NO: 831241 - DNA, 25 bp, Mus musculus
tgtgctgttggctgcccttctgggc

SEQ ID NO: 831242 - DNA, 25 bp, Mus musculus
tgtgcttacagcagccagggagaga

SEQ ID NO: 831243 - DNA, 25 bp, Mus musculus
tgtgcttacagctgccagggagaga

SEQ ID NO: 831244 - DNA, 25 bp, Mus musculus
tgtgcttagagacaaagtcactttg

SEQ ID NO: 831245 - DNA, 25 bp, Mus musculus
tgtgcttagagagaaagtcactttg

SEQ ID NO: 831246 - DNA, 25 bp, Mus musculus
tgtgcttagcaaagttgtgaatgcc

SEQ ID NO: 831247 - DNA, 25 bp, Mus musculus
tgtgcttagcaatgttgtgaatgcc

SEQ ID NO: 831248 - DNA, 25 bp, Mus musculus
tgtgcttagcgtctccgaaaactcg

SEQ ID NO: 831249 - DNA, 25 bp, Mus musculus
tgtgcttagcgtgtccgaaaactcg

SEQ ID NO: 831250 - DNA, 25 bp, Mus musculus
tgtgcttagctacaaggctctgctg

SEQ ID NO: 831251 - DNA, 25 bp, Mus musculus
tgtgcttagctagaaggctctgctg

SEQ ID NO: 831252 - DNA, 25 bp, Mus musculus
tgtgcttagtcaccgtgacccgcgc

SEQ ID NO: 831253 - DNA, 25 bp, Mus musculus
tgtgcttagtcagcgtgacccgcgc

SEQ ID NO: 831254 - DNA, 25 bp, Mus musculus
tgtgcttatcaaccctgctgacagg

SEQ ID NO: 831255 - DNA, 25 bp, Mus musculus
tgtgcttatcaagcctgctgacagg

SEQ ID NO: 831256 - DNA, 25 bp, Mus musculus
tgtgcttatcctaagacctcctcac

SEQ ID NO: 831257 - DNA, 25 bp, Mus musculus
tgtgcttatccttagacctcctcac

SEQ ID NO: 831258 - DNA, 25 bp, Mus musculus
tgtgcttcaccacgcatgagcccat

SEQ ID NO: 831259 - DNA, 25 bp, Mus musculus
tgtgcttcaccaggcatgagcccat

SEQ ID NO: 831260 - DNA, 25 bp, Mus musculus
tgtgcttcagagcatcctcgctgtc

SEQ ID NO: 831261 - DNA, 25 bp, Mus musculus
tgtgcttcagaggatcctcgctgtc

SEQ ID NO: 831262 - DNA, 25 bp, Mus musculus
tgtgcttcagccagaccagggaaat

SEQ ID NO: 831263 - DNA, 25 bp, Mus musculus
tgtgcttcagcctgaccagggaaat

SEQ ID NO: 831264 - DNA, 25 bp, Mus musculus
tgtgcttcatggaattgccaatgaa

SEQ ID NO: 831265 - DNA, 25 bp, Mus musculus
tgtgcttcatggtattgccaatgaa

SEQ ID NO: 831266 - DNA, 25 bp, Mus musculus
tgtgcttccctgacttatggctgta

SEQ ID NO: 831267 - DNA, 25 bp, Mus musculus
tgtgcttccctgtcttatggctgta

SEQ ID NO: 831268 - DNA, 25 bp, Mus musculus
tgtgcttccggcaacatcaacaccg

SEQ ID NO: 831269 - DNA, 25 bp, Mus musculus
tgtgcttccggctacatcaacaccg

SEQ ID NO: 831270 - DNA, 25 bp, Mus musculus
tgtgcttcctcgactactccagtaa

SEQ ID NO: 831271 - DNA, 25 bp, Mus musculus
tgtgcttcctcgtctactccagtaa

SEQ ID NO: 831272 - DNA, 25 bp, Mus musculus
tgtgcttcgcgactacctgatgtct

SEQ ID NO: 831273 - DNA, 25 bp, Mus musculus
tgtgcttcgcgagtacctgatgtct

SEQ ID NO: 831274 - DNA, 25 bp, Mus musculus
tgtgcttctcacaacgctacgtgcc

SEQ ID NO: 831275 - DNA, 25 bp, Mus musculus
tgtgcttctcacctgaaggcttgta

SEQ ID NO: 831276 - DNA, 25 bp, Mus musculus
tgtgcttctcacgtgaaggcttgta

SEQ ID NO: 831277 - DNA, 25 bp, Mus musculus
tgtgcttctcactacgctacgtgcc

SEQ ID NO: 831278 - DNA, 25 bp, Mus musculus
tgtgcttctcggagtcctcccagtt

SEQ ID NO: 831279 - DNA, 25 bp, Mus musculus
tgtgcttctcggtgtcctcccagtt

SEQ ID NO: 831280 - DNA, 25 bp, Mus musculus
tgtgcttctgccaaaagtggtgaac

SEQ ID NO: 831281 - DNA, 25 bp, Mus musculus
tgtgcttctgcctaaagtggtgaac

SEQ ID NO: 831282 - DNA, 25 bp, Mus musculus
tgtgcttctgtaaatggcaatgaaa

SEQ ID NO: 831283 - DNA, 25 bp, Mus musculus
tgtgcttctgtatatggcaatgaaa

SEQ ID NO: 831284 - DNA, 25 bp, Mus musculus
tgtgcttgagagcaaccaagtgttt

SEQ ID NO: 831285 - DNA, 25 bp, Mus musculus
tgtgcttgagaggaaccaagtgttt

SEQ ID NO: 831286 - DNA, 25 bp, Mus musculus
tgtgcttgccgacctaagagcggtc

SEQ ID NO: 831287 - DNA, 25 bp, Mus musculus
tgtgcttgccgagctaagagcggtc

SEQ ID NO: 831288 - DNA, 25 bp, Mus musculus
tgtgcttgcttcaccccaagctggc

SEQ ID NO: 831289 - DNA, 25 bp, Mus musculus
tgtgcttgcttctccccaagctggc

SEQ ID NO: 831290 - DNA, 25 bp, Mus musculus
tgtgcttggaatcgtggagtattct

SEQ ID NO: 831291 - DNA, 25 bp, Mus musculus
tgtgcttggaatggtggagtattct

SEQ ID NO: 831292 - DNA, 25 bp, Mus musculus
tgtgcttggcacaaactgcagtggc

SEQ ID NO: 831293 - DNA, 25 bp, Mus musculus
tgtgcttggcactaactgcagtggc

SEQ ID NO: 831294 - DNA, 25 bp, Mus musculus
tgtgcttggcctctgttagactcct

SEQ ID NO: 831295 - DNA, 25 bp, Mus musculus
tgtgcttggcctgtgttagactcct

SEQ ID NO: 831296 - DNA, 25 bp, Mus musculus
tgtgcttggtgcaggataaatctgg

SEQ ID NO: 831297 - DNA, 25 bp, Mus musculus
tgtgcttggtgctggataaatctgg

SEQ ID NO: 831298 - DNA, 25 bp, Mus musculus
tgtgctttaaaccaagagcccttcg

SEQ ID NO: 831299 - DNA, 25 bp, Mus musculus
tgtgctttaaacgaagagcccttcg

SEQ ID NO: 831300 - DNA, 25 bp, Mus musculus
tgtgctttcgagaagcctcccagcc

SEQ ID NO: 831301 - DNA, 25 bp, Mus musculus
tgtgctttcgagtagcctcccagcc

SEQ ID NO: 831302 - DNA, 25 bp, Mus musculus
tgtgctttctatcctggccatctat

SEQ ID NO: 831303 - DNA, 25 bp, Mus musculus
tgtgctttctatgctggccatctat

SEQ ID NO: 831304 - DNA, 25 bp, Mus musculus
tgtgctttgctcagagacaagtgct

SEQ ID NO: 831305 - DNA, 25 bp, Mus musculus
tgtgctttgctctgagacaagtgct

SEQ ID NO: 831306 - DNA, 25 bp, Mus musculus
tgtgctttgcttaaccctgggaacc

SEQ ID NO: 831307 - DNA, 25 bp, Mus musculus
tgtgctttgctttaccctgggaacc

SEQ ID NO: 831308 - DNA, 25 bp, Mus musculus
tgtgcttttaatcactcacctgtgc

SEQ ID NO: 831309 - DNA, 25 bp, Mus musculus
tgtgcttttaatgactcacctgtgc

SEQ ID NO: 831310 - DNA, 25 bp, Mus musculus
tgtgcttttcataagcagtacaaac

SEQ ID NO: 831311 - DNA, 25 bp, Mus musculus
tgtgcttttcatcggcatcatcatc

SEQ ID NO: 831312 - DNA, 25 bp, Mus musculus
tgtgcttttcatgggcatcatcatc

SEQ ID NO: 831313 - DNA, 25 bp, Mus musculus
tgtgcttttcattagcagtacaaac

SEQ ID NO: 831314 - DNA, 25 bp, Mus musculus
tgtggaaaaataccttcttgaaaag

SEQ ID NO: 831315 - DNA, 25 bp, Mus musculus
tgtggaaaaatagcttcttgaaaag

SEQ ID NO: 831316 - DNA, 25 bp, Mus musculus
tgtggaaaaattacacctatcgacg

SEQ ID NO: 831317 - DNA, 25 bp, Mus musculus
tgtggaaaaatttcacctatcgacg

SEQ ID NO: 831318 - DNA, 25 bp, Mus musculus
tgtggaaaacatcgcgagctgatac

SEQ ID NO: 831319 - DNA, 25 bp, Mus musculus
tgtggaaaacatggcgagctgatac

SEQ ID NO: 831320 - DNA, 25 bp, Mus musculus
tgtggaaaacccacaagggatcttc

SEQ ID NO: 831321 - DNA, 25 bp, Mus musculus
tgtggaaaaccctcaagggatcttc

SEQ ID NO: 831322 - DNA, 25 bp, Mus musculus
tgtggaaacagccagtagagagtac

SEQ ID NO: 831323 - DNA, 25 bp, Mus musculus
tgtggaaacagcgagtagagagtac

SEQ ID NO: 831324 - DNA, 25 bp, Mus musculus
tgtggaaacatcacagttgacagtg

SEQ ID NO: 831325 - DNA, 25 bp, Mus musculus
tgtggaaacatctcagttgacagtg

SEQ ID NO: 831326 - DNA, 25 bp, Mus musculus
tgtggaaaccacagtctaccttagg

SEQ ID NO: 831327 - DNA, 25 bp, Mus musculus
tgtggaaaccactgtctaccttagg

SEQ ID NO: 831328 - DNA, 25 bp, Mus musculus
tgtggaaacctacaccgaggaggac

SEQ ID NO: 831329 - DNA, 25 bp, Mus musculus
tgtggaaacctagaccgaggaggac

SEQ ID NO: 831330 - DNA, 25 bp, Mus musculus
tgtggaaagagcacactttactcgg

SEQ ID NO: 831331 - DNA, 25 bp, Mus musculus
tgtggaaagagctcactttactcgg

SEQ ID NO: 831332 - DNA, 25 bp, Mus musculus
tgtggaaagcacagagacgtgaaga

SEQ ID NO: 831333 - DNA, 25 bp, Mus musculus
tgtggaaagcactgagacgtgaaga

SEQ ID NO: 831334 - DNA, 25 bp, Mus musculus
tgtggaaagcatactaaactgggtg

SEQ ID NO: 831335 - DNA, 25 bp, Mus musculus
tgtggaaagcattctaaactgggtg

SEQ ID NO: 831336 - DNA, 25 bp, Mus musculus
tgtggaaagcttcgatttaagatag

SEQ ID NO: 831337 - DNA, 25 bp, Mus musculus
tgtggaaagcttggatttaagatag

SEQ ID NO: 831338 - DNA, 25 bp, Mus musculus
tgtggaaagtcgctatacgctgctg

SEQ ID NO: 831339 - DNA, 25 bp, Mus musculus
tgtggaaagtcggtatacgctgctg

SEQ ID NO: 831340 - DNA, 25 bp, Mus musculus
tgtggaaatatgattgtggaccccg

SEQ ID NO: 831341 - DNA, 25 bp, Mus musculus
tgtggaaatatgtttgtggaccccg

SEQ ID NO: 831342 - DNA, 25 bp, Mus musculus
tgtggaaatggacgcagcacccggg

SEQ ID NO: 831343 - DNA, 25 bp, Mus musculus
tgtggaaatggaggcagcacccggg

SEQ ID NO: 831344 - DNA, 25 bp, Mus musculus
tgtggaacaaacctataccccagct

SEQ ID NO: 831345 - DNA, 25 bp, Mus musculus
tgtggaacaaacgtataccccagct

SEQ ID NO: 831346 - DNA, 25 bp, Mus musculus
tgtggaacagttacgagtgcacgtc

SEQ ID NO: 831347 - DNA, 25 bp, Mus musculus
tgtggaacagtttcgagtgcacgtc

SEQ ID NO: 831348 - DNA, 25 bp, Mus musculus
tgtggaacatcgctcacgggacaag

SEQ ID NO: 831349 - DNA, 25 bp, Mus musculus
tgtggaacatcggtcacgggacaag

SEQ ID NO: 831350 - DNA, 25 bp, Mus musculus
tgtggaacgcaaccggctagatgac

SEQ ID NO: 831351 - DNA, 25 bp, Mus musculus
tgtggaacgcaagcggctagatgac

SEQ ID NO: 831352 - DNA, 25 bp, Mus musculus
tgtggaacggctatgcaaactggca

SEQ ID NO: 831353 - DNA, 25 bp, Mus musculus
tgtggaacggctttgcaaactggca

SEQ ID NO: 831354 - DNA, 25 bp, Mus musculus
tgtggaactcacaggaccttcgctt

SEQ ID NO: 831355 - DNA, 25 bp, Mus musculus
tgtggaactcactggaccttcgctt

SEQ ID NO: 831356 - DNA, 25 bp, Mus musculus
tgtggaactcctcaacctgctgcca

SEQ ID NO: 831357 - DNA, 25 bp, Mus musculus
tgtggaactcctgaacctgctgcca

SEQ ID NO: 831358 - DNA, 25 bp, Mus musculus
tgtggaactgatcggccctaaactc

SEQ ID NO: 831359 - DNA, 25 bp, Mus musculus
tgtggaactgatgggccctaaactc

SEQ ID NO: 831360 - DNA, 25 bp, Mus musculus
tgtggaagaaatacggtgacaagag

SEQ ID NO: 831361 - DNA, 25 bp, Mus musculus
tgtggaagaaattcggtgacaagag

SEQ ID NO: 831362 - DNA, 25 bp, Mus musculus
tgtggaagacaacgctgaagtacac

SEQ ID NO: 831363 - DNA, 25 bp, Mus musculus
tgtggaagacaaggctgaagtacac

SEQ ID NO: 831364 - DNA, 25 bp, Mus musculus
tgtggaagacatctactgtgaaggc

SEQ ID NO: 831365 - DNA, 25 bp, Mus musculus
tgtggaagacatgtactgtgaaggc

SEQ ID NO: 831366 - DNA, 25 bp, Mus musculus
tgtggaagaggaaaccacctgctat

SEQ ID NO: 831367 - DNA, 25 bp, Mus musculus
tgtggaagaggataccacctgctat

SEQ ID NO: 831368 - DNA, 25 bp, Mus musculus
tgtggaagatgtcgcttctgatgac

SEQ ID NO: 831369 - DNA, 25 bp, Mus musculus
tgtggaagatgtggcttctgatgac

SEQ ID NO: 831370 - DNA, 25 bp, Mus musculus
tgtggaagattaccactcgaggccc

SEQ ID NO: 831371 - DNA, 25 bp, Mus musculus
tgtggaagattagcactcgaggccc

SEQ ID NO: 831372 - DNA, 25 bp, Mus musculus
tgtggaagcaatccgattggttact

SEQ ID NO: 831373 - DNA, 25 bp, Mus musculus
tgtggaagcaatgcgattggttact

SEQ ID NO: 831374 - DNA, 25 bp, Mus musculus
tgtggaagccaaatgggactgtgtc

SEQ ID NO: 831375 - DNA, 25 bp, Mus musculus
tgtggaagccaattgggactgtgtc

SEQ ID NO: 831376 - DNA, 25 bp, Mus musculus
tgtggaagccacctttcagagacag

SEQ ID NO: 831377 - DNA, 25 bp, Mus musculus
tgtggaagccacgtttcagagacag

SEQ ID NO: 831378 - DNA, 25 bp, Mus musculus
tgtggaagccttagctgctccgctg

SEQ ID NO: 831379 - DNA, 25 bp, Mus musculus
tgtggaagcctttgctgctccgctg

SEQ ID NO: 831380 - DNA, 25 bp, Mus musculus
tgtggaagctctctgcttctagagt

SEQ ID NO: 831381 - DNA, 25 bp, Mus musculus
tgtggaagctctgtgcttctagagt

SEQ ID NO: 831382 - DNA, 25 bp, Mus musculus
tgtggaaggaagatctggctgtttt

SEQ ID NO: 831383 - DNA, 25 bp, Mus musculus
tgtggaaggaagttctggctgtttt

SEQ ID NO: 831384 - DNA, 25 bp, Mus musculus
tgtggaaggaataagtctagaaaac

SEQ ID NO: 831385 - DNA, 25 bp, Mus musculus
tgtggaaggaattagtctagaaaac

SEQ ID NO: 831386 - DNA, 25 bp, Mus musculus
tgtggaaggatcaacagtcaattgt

SEQ ID NO: 831387 - DNA, 25 bp, Mus musculus
tgtggaaggatctacagtcaattgt

SEQ ID NO: 831388 - DNA, 25 bp, Mus musculus
tgtggaaggcagagaaggattcttt

SEQ ID NO: 831389 - DNA, 25 bp, Mus musculus
tgtggaaggcagtgaaggattcttt

SEQ ID NO: 831390 - DNA, 25 bp, Mus musculus
tgtggaaggcctccggcataactca

SEQ ID NO: 831391 - DNA, 25 bp, Mus musculus
tgtggaaggcctgcggcataactca

SEQ ID NO: 831392 - DNA, 25 bp, Mus musculus
tgtggaaggtcaactcaaaaggctc

SEQ ID NO: 831393 - DNA, 25 bp, Mus musculus
tgtggaaggtcatctcaaaaggctc

SEQ ID NO: 831394 - DNA, 25 bp, Mus musculus
tgtggaaggtctccatcgagcacca

SEQ ID NO: 831395 - DNA, 25 bp, Mus musculus
tgtggaaggtctgcatcgagcacca

SEQ ID NO: 831396 - DNA, 25 bp, Mus musculus
tgtggaagtcaaagttcagccctga

SEQ ID NO: 831397 - DNA, 25 bp, Mus musculus
tgtggaagtcaatgttcagccctga

SEQ ID NO: 831398 - DNA, 25 bp, Mus musculus
tgtggaagtctaagcatgggcaccg

SEQ ID NO: 831399 - DNA, 25 bp, Mus musculus
tgtggaagtctatgcatgggcaccg

SEQ ID NO: 831400 - DNA, 25 bp, Mus musculus
tgtggaagtgctccaatcagggtac

SEQ ID NO: 831401 - DNA, 25 bp, Mus musculus
tgtggaagtgctgcaatcagggtac

SEQ ID NO: 831402 - DNA, 25 bp, Mus musculus
tgtggaagttcacacagagccgatg

SEQ ID NO: 831403 - DNA, 25 bp, Mus musculus
tgtggaagttcagacagagccgatg

SEQ ID NO: 831404 - DNA, 25 bp, Mus musculus
tgtggaatagctactccagcaatga

SEQ ID NO: 831405 - DNA, 25 bp, Mus musculus
tgtggaatagcttctccagcaatga

SEQ ID NO: 831406 - DNA, 25 bp, Mus musculus
tgtggaatatctcatccaggagctc

SEQ ID NO: 831407 - DNA, 25 bp, Mus musculus
tgtggaatatctgatccaggagctc

SEQ ID NO: 831408 - DNA, 25 bp, Mus musculus
tgtggaatccatcatgagagataag

SEQ ID NO: 831409 - DNA, 25 bp, Mus musculus
tgtggaatccatgatgagagataag

SEQ ID NO: 831410 - DNA, 25 bp, Mus musculus
tgtggaatctggctaactgcaagct

SEQ ID NO: 831411 - DNA, 25 bp, Mus musculus
tgtggaatctgggtaactgcaagct

SEQ ID NO: 831412 - DNA, 25 bp, Mus musculus
tgtggaatgacgacacccagtccta

SEQ ID NO: 831413 - DNA, 25 bp, Mus musculus
tgtggaatgacgtcacccagtccta

SEQ ID NO: 831414 - DNA, 25 bp, Mus musculus
tgtggaatgagaagcactcctcaag

SEQ ID NO: 831415 - DNA, 25 bp, Mus musculus
tgtggaatgagatgcactcctcaag

SEQ ID NO: 831416 - DNA, 25 bp, Mus musculus
tgtggaatgggtacccacctccacg

SEQ ID NO: 831417 - DNA, 25 bp, Mus musculus
tgtggaatgggttcccacctccacg

SEQ ID NO: 831418 - DNA, 25 bp, Mus musculus
tgtggaatgtgtcgaagctctcctg

SEQ ID NO: 831419 - DNA, 25 bp, Mus musculus
tgtggaatgtgtggaagctctcctg

SEQ ID NO: 831420 - DNA, 25 bp, Mus musculus
tgtggaattaggatgcatttgcctt

SEQ ID NO: 831421 - DNA, 25 bp, Mus musculus
tgtggaattaggttgcatttgcctt

SEQ ID NO: 831422 - DNA, 25 bp, Mus musculus
tgtggacaaagtcgcgttcacaggc

SEQ ID NO: 831423 - DNA, 25 bp, Mus musculus
tgtggacaaagtggcgttcacaggc

SEQ ID NO: 831424 - DNA, 25 bp, Mus musculus
tgtggacaaatgacgaacctcgttc

SEQ ID NO: 831425 - DNA, 25 bp, Mus musculus
tgtggacaaatgtcgaacctcgttc

SEQ ID NO: 831426 - DNA, 25 bp, Mus musculus
tgtggacaacctatccatgaaatat

SEQ ID NO: 831427 - DNA, 25 bp, Mus musculus
tgtggacaacctttccatgaaatat

SEQ ID NO: 831428 - DNA, 25 bp, Mus musculus
tgtggacaatcactgggcactccgg

SEQ ID NO: 831429 - DNA, 25 bp, Mus musculus
tgtggacaatcagtgggcactccgg

SEQ ID NO: 831430 - DNA, 25 bp, Mus musculus
tgtggacaatgcaggaaggcaacac

SEQ ID NO: 831431 - DNA, 25 bp, Mus musculus
tgtggacaatgctggaaggcaacac

SEQ ID NO: 831432 - DNA, 25 bp, Mus musculus
tgtggacacactacagtattgcttc

SEQ ID NO: 831433 - DNA, 25 bp, Mus musculus
tgtggacacactcacttctgcgtgc

SEQ ID NO: 831434 - DNA, 25 bp, Mus musculus
tgtggacacactctactaggccctg

SEQ ID NO: 831435 - DNA, 25 bp, Mus musculus
tgtggacacactgacttctgcgtgc

SEQ ID NO: 831436 - DNA, 25 bp, Mus musculus
tgtggacacactgtactaggccctg

SEQ ID NO: 831437 - DNA, 25 bp, Mus musculus
tgtggacacacttcagtattgcttc

SEQ ID NO: 831438 - DNA, 25 bp, Mus musculus
tgtggacacaggcacatctcttctg

SEQ ID NO: 831439 - DNA, 25 bp, Mus musculus
tgtggacacagggacatctcttctg

SEQ ID NO: 831440 - DNA, 25 bp, Mus musculus
tgtggacaccggaaggagatactat

SEQ ID NO: 831441 - DNA, 25 bp, Mus musculus
tgtggacaccggtaggagatactat

SEQ ID NO: 831442 - DNA, 25 bp, Mus musculus
tgtggacacctcaggttttcagtgt

SEQ ID NO: 831443 - DNA, 25 bp, Mus musculus
tgtggacacctctggttttcagtgt

SEQ ID NO: 831444 - DNA, 25 bp, Mus musculus
tgtggacacgtcacaggaacacgtc

SEQ ID NO: 831445 - DNA, 25 bp, Mus musculus
tgtggacacgtcacctacccctgtg

SEQ ID NO: 831446 - DNA, 25 bp, Mus musculus
tgtggacacgtctcaggaacacgtc

SEQ ID NO: 831447 - DNA, 25 bp, Mus musculus
tgtggacacgtctcctacccctgtg

SEQ ID NO: 831448 - DNA, 25 bp, Mus musculus
tgtggacagccaacaccctcttcat

SEQ ID NO: 831449 - DNA, 25 bp, Mus musculus
tgtggacagccatcaccctcttcat

SEQ ID NO: 831450 - DNA, 25 bp, Mus musculus
tgtggacaggatatcaccaccaagc

SEQ ID NO: 831451 - DNA, 25 bp, Mus musculus
tgtggacaggatttcaccaccaagc

SEQ ID NO: 831452 - DNA, 25 bp, Mus musculus
tgtggacataagactaacttactaa

SEQ ID NO: 831453 - DNA, 25 bp, Mus musculus
tgtggacataagtctaacttactaa

SEQ ID NO: 831454 - DNA, 25 bp, Mus musculus
tgtggacataatactggctcatcac

SEQ ID NO: 831455 - DNA, 25 bp, Mus musculus
tgtggacataattctggctcatcac

SEQ ID NO: 831456 - DNA, 25 bp, Mus musculus
tgtggacatcgaacccaccatccag

SEQ ID NO: 831457 - DNA, 25 bp, Mus musculus
tgtggacatcgatcccaccatccag

SEQ ID NO: 831458 - DNA, 25 bp, Mus musculus
tgtggacatcggatacccaaggaga

SEQ ID NO: 831459 - DNA, 25 bp, Mus musculus
tgtggacatcggttacccaaggaga

SEQ ID NO: 831460 - DNA, 25 bp, Mus musculus
tgtggacatgaactcttctcgcaac

SEQ ID NO: 831461 - DNA, 25 bp, Mus musculus
tgtggacatgaagtcttctcgcaac

SEQ ID NO: 831462 - DNA, 25 bp, Mus musculus
tgtggacatggaagataaaaacaat

SEQ ID NO: 831463 - DNA, 25 bp, Mus musculus
tgtggacatggatgataaaaacaat

SEQ ID NO: 831464 - DNA, 25 bp, Mus musculus
tgtggacatgggagggaaccaacaa

SEQ ID NO: 831465 - DNA, 25 bp, Mus musculus
tgtggacatgggtgggaaccaacaa

SEQ ID NO: 831466 - DNA, 25 bp, Mus musculus
tgtggacattacaccctcttacaga

SEQ ID NO: 831467 - DNA, 25 bp, Mus musculus
tgtggacattactccctcttacaga

SEQ ID NO: 831468 - DNA, 25 bp, Mus musculus
tgtggacattggagttaagtattcg

SEQ ID NO: 831469 - DNA, 25 bp, Mus musculus
tgtggacattggtgttaagtattcg

SEQ ID NO: 831470 - DNA, 25 bp, Mus musculus
tgtggaccacctagtgctgaccgtt

SEQ ID NO: 831471 - DNA, 25 bp, Mus musculus
tgtggaccaccttgtgctgaccgtt

SEQ ID NO: 831472 - DNA, 25 bp, Mus musculus
tgtggaccacgacaactgggtgtcc

SEQ ID NO: 831473 - DNA, 25 bp, Mus musculus
tgtggaccacgagaactgggtgtcc

SEQ ID NO: 831474 - DNA, 25 bp, Mus musculus
tgtggaccacttagtgtctgactgc

SEQ ID NO: 831475 - DNA, 25 bp, Mus musculus
tgtggaccactttgtgtctgactgc

SEQ ID NO: 831476 - DNA, 25 bp, Mus musculus
tgtggaccaggtcggtggctatacc

SEQ ID NO: 831477 - DNA, 25 bp, Mus musculus
tgtggaccaggtgggtggctatacc

SEQ ID NO: 831478 - DNA, 25 bp, Mus musculus
tgtggaccagtaagaaaccaaagag

SEQ ID NO: 831479 - DNA, 25 bp, Mus musculus
tgtggaccagtatgaaaccaaagag

SEQ ID NO: 831480 - DNA, 25 bp, Mus musculus
tgtggaccagtcacagcaagcatac

SEQ ID NO: 831481 - DNA, 25 bp, Mus musculus
tgtggaccagtctcagcaagcatac

SEQ ID NO: 831482 - DNA, 25 bp, Mus musculus
tgtggacccagacatggccaaaagc

SEQ ID NO: 831483 - DNA, 25 bp, Mus musculus
tgtggacccagagatggccaaaagc

SEQ ID NO: 831484 - DNA, 25 bp, Mus musculus
tgtggacccatcaggactgtcagaa

SEQ ID NO: 831485 - DNA, 25 bp, Mus musculus
tgtggacccatctggactgtcagaa

SEQ ID NO: 831486 - DNA, 25 bp, Mus musculus
tgtggaccccggagagcagtgtgac

SEQ ID NO: 831487 - DNA, 25 bp, Mus musculus
tgtggaccccggtgagcagtgtgac

SEQ ID NO: 831488 - DNA, 25 bp, Mus musculus
tgtggaccctgtaccccagggtcag

SEQ ID NO: 831489 - DNA, 25 bp, Mus musculus
tgtggaccctgttccccagggtcag

SEQ ID NO: 831490 - DNA, 25 bp, Mus musculus
tgtggaccgtgcagtggccacacta

SEQ ID NO: 831491 - DNA, 25 bp, Mus musculus
tgtggaccgtgctgtggccacacta

SEQ ID NO: 831492 - DNA, 25 bp, Mus musculus
tgtggaccgtgtcatcaatgtgaac

SEQ ID NO: 831493 - DNA, 25 bp, Mus musculus
tgtggaccgtgtgatcaatgtgaac

SEQ ID NO: 831494 - DNA, 25 bp, Mus musculus
tgtggaccgtttcctgccactgcgg

SEQ ID NO: 831495 - DNA, 25 bp, Mus musculus
tgtggaccgtttgctgccactgcgg

SEQ ID NO: 831496 - DNA, 25 bp, Mus musculus
tgtggacctcgtatctgcctgtgac

SEQ ID NO: 831497 - DNA, 25 bp, Mus musculus
tgtggacctcgtttctgcctgtgac

SEQ ID NO: 831498 - DNA, 25 bp, Mus musculus
tgtggacctctgctgtcaagcctac

SEQ ID NO: 831499 - DNA, 25 bp, Mus musculus
tgtggacctctggtgtcaagcctac

SEQ ID NO: 831500 - DNA, 25 bp, Mus musculus
tgtggacctgaaagtcccaatagga

SEQ ID NO: 831501 - DNA, 25 bp, Mus musculus
tgtggacctgaacaacgtctgctgc

SEQ ID NO: 831502 - DNA, 25 bp, Mus musculus
tgtggacctgaagaacgtctgctgc

SEQ ID NO: 831503 - DNA, 25 bp, Mus musculus
tgtggacctgaatgtcccaatagga

SEQ ID NO: 831504 - DNA, 25 bp, Mus musculus
tgtggacctggtccctatggatgac

SEQ ID NO: 831505 - DNA, 25 bp, Mus musculus
tgtggacctggtgcctatggatgac

SEQ ID NO: 831506 - DNA, 25 bp, Mus musculus
tgtggacctttcatcaagtagctga

SEQ ID NO: 831507 - DNA, 25 bp, Mus musculus
tgtggacctttcttcaagtagctga

SEQ ID NO: 831508 - DNA, 25 bp, Mus musculus
tgtggacgaatgacagctcatgccc

SEQ ID NO: 831509 - DNA, 25 bp, Mus musculus
tgtggacgaatgtcagctcatgccc

SEQ ID NO: 831510 - DNA, 25 bp, Mus musculus
tgtggacgacatctgcatagcgaag

SEQ ID NO: 831511 - DNA, 25 bp, Mus musculus
tgtggacgacatgtgcatagcgaag

SEQ ID NO: 831512 - DNA, 25 bp, Mus musculus
tgtggacgagtgagcaacagactca

SEQ ID NO: 831513 - DNA, 25 bp, Mus musculus
tgtggacgagtgtgcaacagactca

SEQ ID NO: 831514 - DNA, 25 bp, Mus musculus
tgtggacgcagcatataagccaggc

SEQ ID NO: 831515 - DNA, 25 bp, Mus musculus
tgtggacgcagcttataagccaggc

SEQ ID NO: 831516 - DNA, 25 bp, Mus musculus
tgtggacgctggcaatgctttcaag

SEQ ID NO: 831517 - DNA, 25 bp, Mus musculus
tgtggacgctgggaatgctttcaag

SEQ ID NO: 831518 - DNA, 25 bp, Mus musculus
tgtggacgcttcacctgcgtagtga

SEQ ID NO: 831519 - DNA, 25 bp, Mus musculus
tgtggacgcttctcctgcgtagtga

SEQ ID NO: 831520 - DNA, 25 bp, Mus musculus
tgtggacggcgtcaatacctacaat

SEQ ID NO: 831521 - DNA, 25 bp, Mus musculus
tgtggacggcgtgaatacctacaat

SEQ ID NO: 831522 - DNA, 25 bp, Mus musculus
tgtggacggctactgagaaaagaac

SEQ ID NO: 831523 - DNA, 25 bp, Mus musculus
tgtggacggctagtgagaaaagaac

SEQ ID NO: 831524 - DNA, 25 bp, Mus musculus
tgtggacggtcgaccattgctgcag

SEQ ID NO: 831525 - DNA, 25 bp, Mus musculus
tgtggacggtcgtccattgctgcag

SEQ ID NO: 831526 - DNA, 25 bp, Mus musculus
tgtggacgtgcgagtccctggcttt

SEQ ID NO: 831527 - DNA, 25 bp, Mus musculus
tgtggacgtgcgtgtccctggcttt

SEQ ID NO: 831528 - DNA, 25 bp, Mus musculus
tgtggactacataaatagggaggct

SEQ ID NO: 831529 - DNA, 25 bp, Mus musculus
tgtggactacataagaccagccagc

SEQ ID NO: 831530 - DNA, 25 bp, Mus musculus
tgtggactacattaatagggaggct

SEQ ID NO: 831531 - DNA, 25 bp, Mus musculus
tgtggactacattagaccagccagc

SEQ ID NO: 831532 - DNA, 25 bp, Mus musculus
tgtggactaccactcccgtgaggta

SEQ ID NO: 831533 - DNA, 25 bp, Mus musculus
tgtggactaccagtcccgtgaggta

SEQ ID NO: 831534 - DNA, 25 bp, Mus musculus
tgtggactatccagagccgtaactg

SEQ ID NO: 831535 - DNA, 25 bp, Mus musculus
tgtggactatcctgagccgtaactg

SEQ ID NO: 831536 - DNA, 25 bp, Mus musculus
tgtggactcactctcgaccagtgct

SEQ ID NO: 831537 - DNA, 25 bp, Mus musculus
tgtggactcactgtcgaccagtgct

SEQ ID NO: 831538 - DNA, 25 bp, Mus musculus
tgtggactcccacgggcacttcatt

SEQ ID NO: 831539 - DNA, 25 bp, Mus musculus
tgtggactcccaggggcacttcatt

SEQ ID NO: 831540 - DNA, 25 bp, Mus musculus
tgtggactccctcttcctgaagacc

SEQ ID NO: 831541 - DNA, 25 bp, Mus musculus
tgtggactccctgttcctgaagacc

SEQ ID NO: 831542 - DNA, 25 bp, Mus musculus
tgtggactcgtacccctatcatgca

SEQ ID NO: 831543 - DNA, 25 bp, Mus musculus
tgtggactcgtagccctatcatgca

SEQ ID NO: 831544 - DNA, 25 bp, Mus musculus
tgtggactctgtcgctgttctacgt

SEQ ID NO: 831545 - DNA, 25 bp, Mus musculus
tgtggactctgtggctgttctacgt

SEQ ID NO: 831546 - DNA, 25 bp, Mus musculus
tgtggactgcgaaggcttttccacc

SEQ ID NO: 831547 - DNA, 25 bp, Mus musculus
tgtggactgcgatggcttttccacc

SEQ ID NO: 831548 - DNA, 25 bp, Mus musculus
tgtggactgcttacctctggcttgg

SEQ ID NO: 831549 - DNA, 25 bp, Mus musculus
tgtggactgctttcctctggcttgg

SEQ ID NO: 831550 - DNA, 25 bp, Mus musculus
tgtggactgtagcaaaggacctcaa

SEQ ID NO: 831551 - DNA, 25 bp, Mus musculus
tgtggactgtaggaaaggacctcaa

SEQ ID NO: 831552 - DNA, 25 bp, Mus musculus
tgtggacttaacagaagaagggtta

SEQ ID NO: 831553 - DNA, 25 bp, Mus musculus
tgtggacttaactgaagaagggtta

SEQ ID NO: 831554 - DNA, 25 bp, Mus musculus
tgtggacttccacactctgaaactg

SEQ ID NO: 831555 - DNA, 25 bp, Mus musculus
tgtggacttccagactctgaaactg

SEQ ID NO: 831556 - DNA, 25 bp, Mus musculus
tgtggacttgcacattacagtacag

SEQ ID NO: 831557 - DNA, 25 bp, Mus musculus
tgtggacttgcagattacagtacag

SEQ ID NO: 831558 - DNA, 25 bp, Mus musculus
tgtggactttgactctgctgaagac

SEQ ID NO: 831559 - DNA, 25 bp, Mus musculus
tgtggactttgagtctgctgaagac

SEQ ID NO: 831560 - DNA, 25 bp, Mus musculus
tgtggagaaaacaatgaacatatcc

SEQ ID NO: 831561 - DNA, 25 bp, Mus musculus
tgtggagaaaactatgaacatatcc

SEQ ID NO: 831562 - DNA, 25 bp, Mus musculus
tgtggagaaccacgtgcgctacgcc

SEQ ID NO: 831563 - DNA, 25 bp, Mus musculus
tgtggagaaccaggtgcgctacgcc

SEQ ID NO: 831564 - DNA, 25 bp, Mus musculus
tgtggagaacctagtacagagcctg

SEQ ID NO: 831565 - DNA, 25 bp, Mus musculus
tgtggagaaccttgtacagagcctg

SEQ ID NO: 831566 - DNA, 25 bp, Mus musculus
tgtggagaagacatctgaagagcac

SEQ ID NO: 831567 - DNA, 25 bp, Mus musculus
tgtggagaagacttctgaagagcac

SEQ ID NO: 831568 - DNA, 25 bp, Mus musculus
tgtggagaagcactgacagcagcct

SEQ ID NO: 831569 - DNA, 25 bp, Mus musculus
tgtggagaagcagtgacagcagcct

SEQ ID NO: 831570 - DNA, 25 bp, Mus musculus
tgtggagaatctaaacttgaccggc

SEQ ID NO: 831571 - DNA, 25 bp, Mus musculus
tgtggagaatctccgcacctacaac

SEQ ID NO: 831572 - DNA, 25 bp, Mus musculus
tgtggagaatctgcgcacctacaac

SEQ ID NO: 831573 - DNA, 25 bp, Mus musculus
tgtggagaatcttaacttgaccggc

SEQ ID NO: 831574 - DNA, 25 bp, Mus musculus
tgtggagacaccatatggctcggtc

SEQ ID NO: 831575 - DNA, 25 bp, Mus musculus
tgtggagacaccttatggctcggtc

SEQ ID NO: 831576 - DNA, 25 bp, Mus musculus
tgtggagacagaattcattgctttc

SEQ ID NO: 831577 - DNA, 25 bp, Mus musculus
tgtggagacagatttcattgctttc

SEQ ID NO: 831578 - DNA, 25 bp, Mus musculus
tgtggagacagtagagtacaaaaac

SEQ ID NO: 831579 - DNA, 25 bp, Mus musculus
tgtggagacagttgagtacaaaaac

SEQ ID NO: 831580 - DNA, 25 bp, Mus musculus
tgtggagaccacagatgatgggacc

SEQ ID NO: 831581 - DNA, 25 bp, Mus musculus
tgtggagaccactgatgatgggacc

SEQ ID NO: 831582 - DNA, 25 bp, Mus musculus
tgtggagaccagaataaattccctg

SEQ ID NO: 831583 - DNA, 25 bp, Mus musculus
tgtggagaccagtataaattccctg

SEQ ID NO: 831584 - DNA, 25 bp, Mus musculus
tgtggagacgcaccctgaagcccag

SEQ ID NO: 831585 - DNA, 25 bp, Mus musculus
tgtggagacgcagcctgaagcccag

SEQ ID NO: 831586 - DNA, 25 bp, Mus musculus
tgtggagactgtagaatacaagaat

SEQ ID NO: 831587 - DNA, 25 bp, Mus musculus
tgtggagactgtcggaagctttaca

SEQ ID NO: 831588 - DNA, 25 bp, Mus musculus
tgtggagactgtgggaagctttaca

SEQ ID NO: 831589 - DNA, 25 bp, Mus musculus
tgtggagactgttgaatacaagaat

SEQ ID NO: 831590 - DNA, 25 bp, Mus musculus
tgtggagagttccttcagcaccatc

SEQ ID NO: 831591 - DNA, 25 bp, Mus musculus
tgtggagagttcgttcagcaccatc

SEQ ID NO: 831592 - DNA, 25 bp, Mus musculus
tgtggagatgctcatcaaagaacag

SEQ ID NO: 831593 - DNA, 25 bp, Mus musculus
tgtggagatgctgatcaaagaacag

SEQ ID NO: 831594 - DNA, 25 bp, Mus musculus
tgtggagatgttagcccggacactt

SEQ ID NO: 831595 - DNA, 25 bp, Mus musculus
tgtggagatgtttgcccggacactt

SEQ ID NO: 831596 - DNA, 25 bp, Mus musculus
tgtggagcaacccatcgtacctcgt

SEQ ID NO: 831597 - DNA, 25 bp, Mus musculus
tgtggagcaaccgatcgtacctcgt

SEQ ID NO: 831598 - DNA, 25 bp, Mus musculus
tgtggagcacatattcagacaaggg

SEQ ID NO: 831599 - DNA, 25 bp, Mus musculus
tgtggagcacattttcagacaaggg

SEQ ID NO: 831600 - DNA, 25 bp, Mus musculus
tgtggagcacggacgggtctatgtt

SEQ ID NO: 831601 - DNA, 25 bp, Mus musculus
tgtggagcacggtcgggtctatgtt

SEQ ID NO: 831602 - DNA, 25 bp, Mus musculus
tgtggagcactgcacaaacaatgga

SEQ ID NO: 831603 - DNA, 25 bp, Mus musculus
tgtggagcactggacaaacaatgga

SEQ ID NO: 831604 - DNA, 25 bp, Mus musculus
tgtggagcagtccttcttcaatgac

SEQ ID NO: 831605 - DNA, 25 bp, Mus musculus
tgtggagcagtcgttcttcaatgac

SEQ ID NO: 831606 - DNA, 25 bp, Mus musculus
tgtggagcatctcgaaactggtcat

SEQ ID NO: 831607 - DNA, 25 bp, Mus musculus
tgtggagcatctggaaactggtcat

SEQ ID NO: 831608 - DNA, 25 bp, Mus musculus
tgtggagccagccatacaagagctg

SEQ ID NO: 831609 - DNA, 25 bp, Mus musculus
tgtggagccagcgatacaagagctg

SEQ ID NO: 831610 - DNA, 25 bp, Mus musculus
tgtggagcccagaacagaggattct

SEQ ID NO: 831611 - DNA, 25 bp, Mus musculus
tgtggagcccagtacagaggattct

SEQ ID NO: 831612 - DNA, 25 bp, Mus musculus
tgtggagccgaacgaacccgtatgt

SEQ ID NO: 831613 - DNA, 25 bp, Mus musculus
tgtggagccgaaggaacccgtatgt

SEQ ID NO: 831614 - DNA, 25 bp, Mus musculus
tgtggagccgatacacttggccagg

SEQ ID NO: 831615 - DNA, 25 bp, Mus musculus
tgtggagccgattcacttggccagg

SEQ ID NO: 831616 - DNA, 25 bp, Mus musculus
tgtggagcctcgcaatcattttact

SEQ ID NO: 831617 - DNA, 25 bp, Mus musculus
tgtggagcctcgctgtcattctcta

SEQ ID NO: 831618 - DNA, 25 bp, Mus musculus
tgtggagcctcggaatcattttact

SEQ ID NO: 831619 - DNA, 25 bp, Mus musculus
tgtggagcctcggtgtcattctcta

SEQ ID NO: 831620 - DNA, 25 bp, Mus musculus
tgtggagcctgtcaaaagacggtct

SEQ ID NO: 831621 - DNA, 25 bp, Mus musculus
tgtggagcctgtgaaaagacggtct

SEQ ID NO: 831622 - DNA, 25 bp, Mus musculus
tgtggagcgattctgccgccagctc

SEQ ID NO: 831623 - DNA, 25 bp, Mus musculus
tgtggagcgattgtgccgccagctc

SEQ ID NO: 831624 - DNA, 25 bp, Mus musculus
tgtggagctagacagtgaccttgcc

SEQ ID NO: 831625 - DNA, 25 bp, Mus musculus
tgtggagctagagagtgaccttgcc

SEQ ID NO: 831626 - DNA, 25 bp, Mus musculus
tgtggagctcctcgcagatatcgtg

SEQ ID NO: 831627 - DNA, 25 bp, Mus musculus
tgtggagctcctggcagatatcgtg

SEQ ID NO: 831628 - DNA, 25 bp, Mus musculus
tgtggagctcgtctgagaaaaatgt

SEQ ID NO: 831629 - DNA, 25 bp, Mus musculus
tgtggagctcgtgtgagaaaaatgt

SEQ ID NO: 831630 - DNA, 25 bp, Mus musculus
tgtggaggaactacagagcataata

SEQ ID NO: 831631 - DNA, 25 bp, Mus musculus
tgtggaggaacttcagagcataata

SEQ ID NO: 831632 - DNA, 25 bp, Mus musculus
tgtggaggctaccatcctcgaggaa

SEQ ID NO: 831633 - DNA, 25 bp, Mus musculus
tgtggaggctacgatcctcgaggaa

SEQ ID NO: 831634 - DNA, 25 bp, Mus musculus
tgtggaggctcaatccagaccagtg

SEQ ID NO: 831635 - DNA, 25 bp, Mus musculus
tgtggaggctcattccagaccagtg

SEQ ID NO: 831636 - DNA, 25 bp, Mus musculus
tgtggaggcttcaggtgaaattgca

SEQ ID NO: 831637 - DNA, 25 bp, Mus musculus
tgtggaggcttctggtgaaattgca

SEQ ID NO: 831638 - DNA, 25 bp, Mus musculus
tgtggagggtccagaatgagctcat

SEQ ID NO: 831639 - DNA, 25 bp, Mus musculus
tgtggagggtcctgaatgagctcat

SEQ ID NO: 831640 - DNA, 25 bp, Mus musculus
tgtggaggtcatactttgcagccct

SEQ ID NO: 831641 - DNA, 25 bp, Mus musculus
tgtggaggtcattctttgcagccct

SEQ ID NO: 831642 - DNA, 25 bp, Mus musculus
tgtggagtaccactttgcagtaaac

SEQ ID NO: 831643 - DNA, 25 bp, Mus musculus
tgtggagtaccagtttgcagtaaac

SEQ ID NO: 831644 - DNA, 25 bp, Mus musculus
tgtggagtacgcctccaaaggcaat

SEQ ID NO: 831645 - DNA, 25 bp, Mus musculus
tgtggagtacgcgtccaaaggcaat

SEQ ID NO: 831646 - DNA, 25 bp, Mus musculus
tgtggagtatctaattctctacagc

SEQ ID NO: 831647 - DNA, 25 bp, Mus musculus
tgtggagtatcttattctctacagc

SEQ ID NO: 831648 - DNA, 25 bp, Mus musculus
tgtggagtcagacaatgtcaacgtg

SEQ ID NO: 831649 - DNA, 25 bp, Mus musculus
tgtggagtcagagaatgtcaacgtg

SEQ ID NO: 831650 - DNA, 25 bp, Mus musculus
tgtggagtccgtcaagaatggctta

SEQ ID NO: 831651 - DNA, 25 bp, Mus musculus
tgtggagtccgtgaagaatggctta

SEQ ID NO: 831652 - DNA, 25 bp, Mus musculus
tgtggagtcgcacaacgacccaaag

SEQ ID NO: 831653 - DNA, 25 bp, Mus musculus
tgtggagtcgcagaacgacccaaag

SEQ ID NO: 831654 - DNA, 25 bp, Mus musculus
tgtggagtggaaagaaatcaatgct

SEQ ID NO: 831655 - DNA, 25 bp, Mus musculus
tgtggagtggaatgaaatcaatgct

SEQ ID NO: 831656 - DNA, 25 bp, Mus musculus
tgtggagtgtacagtcatcccttag

SEQ ID NO: 831657 - DNA, 25 bp, Mus musculus
tgtggagtgtactgtcatcccttag

SEQ ID NO: 831658 - DNA, 25 bp, Mus musculus
tgtggagttagcagcgggaaacact

SEQ ID NO: 831659 - DNA, 25 bp, Mus musculus
tgtggagttagctgcgggaaacact

SEQ ID NO: 831660 - DNA, 25 bp, Mus musculus
tgtggagtttggaggccacacttct

SEQ ID NO: 831661 - DNA, 25 bp, Mus musculus
tgtggagtttggtggccacacttct

SEQ ID NO: 831662 - DNA, 25 bp, Mus musculus
tgtggagtttgtagtggcagaccct

SEQ ID NO: 831663 - DNA, 25 bp, Mus musculus
tgtggagtttgttgtggcagaccct

SEQ ID NO: 831664 - DNA, 25 bp, Mus musculus
tgtggataaactacgagagcagctc

SEQ ID NO: 831665 - DNA, 25 bp, Mus musculus
tgtggataaacttcgagagcagctc

SEQ ID NO: 831666 - DNA, 25 bp, Mus musculus
tgtggataacaccaaccaagtggaa

SEQ ID NO: 831667 - DNA, 25 bp, Mus musculus
tgtggataacacgaaccaagtggaa

SEQ ID NO: 831668 - DNA, 25 bp, Mus musculus
tgtggatagcaaccgagttgcaatt

SEQ ID NO: 831669 - DNA, 25 bp, Mus musculus
tgtggatagcaagcgagttgcaatt

SEQ ID NO: 831670 - DNA, 25 bp, Mus musculus
tgtggatagtgaagctaagaaacta

SEQ ID NO: 831671 - DNA, 25 bp, Mus musculus
tgtggatagtgatgctaagaaacta

SEQ ID NO: 831672 - DNA, 25 bp, Mus musculus
tgtggatcaaggaaatgggaagttt

SEQ ID NO: 831673 - DNA, 25 bp, Mus musculus
tgtggatcaaggtaatgggaagttt

SEQ ID NO: 831674 - DNA, 25 bp, Mus musculus
tgtggatcataaaatcctaactgct

SEQ ID NO: 831675 - DNA, 25 bp, Mus musculus
tgtggatcataatatcctaactgct

SEQ ID NO: 831676 - DNA, 25 bp, Mus musculus
tgtggatcattgaggccgttctctc

SEQ ID NO: 831677 - DNA, 25 bp, Mus musculus
tgtggatcattgtggccgttctctc

SEQ ID NO: 831678 - DNA, 25 bp, Mus musculus
tgtggatcctggaaaaagtctcccc

SEQ ID NO: 831679 - DNA, 25 bp, Mus musculus
tgtggatcctggtaaaagtctcccc

SEQ ID NO: 831680 - DNA, 25 bp, Mus musculus
tgtggatcgcctctgcttagggatc

SEQ ID NO: 831681 - DNA, 25 bp, Mus musculus
tgtggatcgcctgtgcttagggatc

SEQ ID NO: 831682 - DNA, 25 bp, Mus musculus
tgtggatctagcaaccttaaaggag

SEQ ID NO: 831683 - DNA, 25 bp, Mus musculus
tgtggatctagctaccttaaaggag

SEQ ID NO: 831684 - DNA, 25 bp, Mus musculus
tgtggatctaggcaagaggaaccac

SEQ ID NO: 831685 - DNA, 25 bp, Mus musculus
tgtggatctagggaagaggaaccac

SEQ ID NO: 831686 - DNA, 25 bp, Mus musculus
tgtggatctcatcgtacaggacctg

SEQ ID NO: 831687 - DNA, 25 bp, Mus musculus
tgtggatctcatggtacaggacctg

SEQ ID NO: 831688 - DNA, 25 bp, Mus musculus
tgtggatcttgacgcaacgaactat

SEQ ID NO: 831689 - DNA, 25 bp, Mus musculus
tgtggatcttgaggcaacgaactat

SEQ ID NO: 831690 - DNA, 25 bp, Mus musculus
tgtggatgaaaaagtatagcgatgc

SEQ ID NO: 831691 - DNA, 25 bp, Mus musculus
tgtggatgaaaatgtatagcgatgc

SEQ ID NO: 831692 - DNA, 25 bp, Mus musculus
tgtggatgacggctgtcgcatccat

SEQ ID NO: 831693 - DNA, 25 bp, Mus musculus
tgtggatgacgggtgtcgcatccat

SEQ ID NO: 831694 - DNA, 25 bp, Mus musculus
tgtggatgacttcgacactcaggag

SEQ ID NO: 831695 - DNA, 25 bp, Mus musculus
tgtggatgacttggacactcaggag

SEQ ID NO: 831696 - DNA, 25 bp, Mus musculus
tgtggatgagctccgtccctttcag

SEQ ID NO: 831697 - DNA, 25 bp, Mus musculus
tgtggatgagctgcgtccctttcag

SEQ ID NO: 831698 - DNA, 25 bp, Mus musculus
tgtggatgatacagcactgtgcccg

SEQ ID NO: 831699 - DNA, 25 bp, Mus musculus
tgtggatgatactgcactgtgcccg

SEQ ID NO: 831700 - DNA, 25 bp, Mus musculus
tgtggatgcacaacttctggaccta

SEQ ID NO: 831701 - DNA, 25 bp, Mus musculus
tgtggatgcacatcttctggaccta

SEQ ID NO: 831702 - DNA, 25 bp, Mus musculus
tgtggatgcagcagacaaccgaaaa

SEQ ID NO: 831703 - DNA, 25 bp, Mus musculus
tgtggatgcagctgacaaccgaaaa

SEQ ID NO: 831704 - DNA, 25 bp, Mus musculus
tgtggatgccttaaaagaagctggc

SEQ ID NO: 831705 - DNA, 25 bp, Mus musculus
tgtggatgcctttaaagaagctggc

SEQ ID NO: 831706 - DNA, 25 bp, Mus musculus
tgtggatgctaaagcaatctttact

SEQ ID NO: 831707 - DNA, 25 bp, Mus musculus
tgtggatgctaatgcaatctttact

SEQ ID NO: 831708 - DNA, 25 bp, Mus musculus
tgtggatgctgtccacaagaccctg

SEQ ID NO: 831709 - DNA, 25 bp, Mus musculus
tgtggatgctgtgcacaagaccctg

SEQ ID NO: 831710 - DNA, 25 bp, Mus musculus
tgtggatggatcagagaaaaagata

SEQ ID NO: 831711 - DNA, 25 bp, Mus musculus
tgtggatggatctgagaaaaagata

SEQ ID NO: 831712 - DNA, 25 bp, Mus musculus
tgtggatggcaaagcaaagatgacc

SEQ ID NO: 831713 - DNA, 25 bp, Mus musculus
tgtggatggcaatgcaaagatgacc

SEQ ID NO: 831714 - DNA, 25 bp, Mus musculus
tgtggatggccaccttgcccatcaa

SEQ ID NO: 831715 - DNA, 25 bp, Mus musculus
tgtggatggccagcttgcccatcaa

SEQ ID NO: 831716 - DNA, 25 bp, Mus musculus
tgtggatggccgaatgtgctcagtc

SEQ ID NO: 831717 - DNA, 25 bp, Mus musculus
tgtggatggccgagagtggagctca

SEQ ID NO: 831718 - DNA, 25 bp, Mus musculus
tgtggatggccgtatgtgctcagtc

SEQ ID NO: 831719 - DNA, 25 bp, Mus musculus
tgtggatggccgtgagtggagctca

SEQ ID NO: 831720 - DNA, 25 bp, Mus musculus
tgtggatggtttccaattccgggat

SEQ ID NO: 831721 - DNA, 25 bp, Mus musculus
tgtggatggtttgcaattccgggat

SEQ ID NO: 831722 - DNA, 25 bp, Mus musculus
tgtggatgtagtacccctgcctggc

SEQ ID NO: 831723 - DNA, 25 bp, Mus musculus
tgtggatgtagttcccctgcctggc

SEQ ID NO: 831724 - DNA, 25 bp, Mus musculus
tgtggatgtgaccaataccactttc

SEQ ID NO: 831725 - DNA, 25 bp, Mus musculus
tgtggatgtgacgaataccactttc

SEQ ID NO: 831726 - DNA, 25 bp, Mus musculus
tgtggattcttgcagacaagaacag

SEQ ID NO: 831727 - DNA, 25 bp, Mus musculus
tgtggattcttggagacaagaacag

SEQ ID NO: 831728 - DNA, 25 bp, Mus musculus
tgtggatttcaacatacgaactata

SEQ ID NO: 831729 - DNA, 25 bp, Mus musculus
tgtggatttcaagatacgaactata

SEQ ID NO: 831730 - DNA, 25 bp, Mus musculus
tgtggatttcatagcttacgatgtg

SEQ ID NO: 831731 - DNA, 25 bp, Mus musculus
tgtggatttcattgcttacgatgtg

SEQ ID NO: 831732 - DNA, 25 bp, Mus musculus
tgtggattttaaccccaacggcaca

SEQ ID NO: 831733 - DNA, 25 bp, Mus musculus
tgtggattttaagcccaacggcaca

SEQ ID NO: 831734 - DNA, 25 bp, Mus musculus
tgtggattttgacacaatctcactg

SEQ ID NO: 831735 - DNA, 25 bp, Mus musculus
tgtggattttgagacaatctcactg

SEQ ID NO: 831736 - DNA, 25 bp, Mus musculus
tgtggcaaaacaagttggtgatgcc

SEQ ID NO: 831737 - DNA, 25 bp, Mus musculus
tgtggcaaaacatgttggtgatgcc

SEQ ID NO: 831738 - DNA, 25 bp, Mus musculus
tgtggcaaacccaatacgccgggag

SEQ ID NO: 831739 - DNA, 25 bp, Mus musculus
tgtggcaaaccctatacgccgggag

SEQ ID NO: 831740 - DNA, 25 bp, Mus musculus
tgtggcaaatcacacagcagtcctt

SEQ ID NO: 831741 - DNA, 25 bp, Mus musculus
tgtggcaaatcagacagcagtcctt

SEQ ID NO: 831742 - DNA, 25 bp, Mus musculus
tgtggcaaatgaaactggagccttc

SEQ ID NO: 831743 - DNA, 25 bp, Mus musculus
tgtggcaaatgatactggagccttc

SEQ ID NO: 831744 - DNA, 25 bp, Mus musculus
tgtggcaacaacaacgttacctaca

SEQ ID NO: 831745 - DNA, 25 bp, Mus musculus
tgtggcaacaactacgttacctaca

SEQ ID NO: 831746 - DNA, 25 bp, Mus musculus
tgtggcaacgctctctgaacgggtc

SEQ ID NO: 831747 - DNA, 25 bp, Mus musculus
tgtggcaacgctgtctgaacgggtc

SEQ ID NO: 831748 - DNA, 25 bp, Mus musculus
tgtggcaaggcaaccctctagagaa

SEQ ID NO: 831749 - DNA, 25 bp, Mus musculus
tgtggcaaggcatccctctagagaa

SEQ ID NO: 831750 - DNA, 25 bp, Mus musculus
tgtggcaagtgcacctccaagtact

SEQ ID NO: 831751 - DNA, 25 bp, Mus musculus
tgtggcaagtgcaggatcagaacac

SEQ ID NO: 831752 - DNA, 25 bp, Mus musculus
tgtggcaagtgcatcaaacggaact

SEQ ID NO: 831753 - DNA, 25 bp, Mus musculus
tgtggcaagtgctcctccaagtact

SEQ ID NO: 831754 - DNA, 25 bp, Mus musculus
tgtggcaagtgctggatcagaacac

SEQ ID NO: 831755 - DNA, 25 bp, Mus musculus
tgtggcaagtgcttcaaacggaact

SEQ ID NO: 831756 - DNA, 25 bp, Mus musculus
tgtggcaataaactgttggtggaac

SEQ ID NO: 831757 - DNA, 25 bp, Mus musculus
tgtggcaataaagtgttggtggaac

SEQ ID NO: 831758 - DNA, 25 bp, Mus musculus
tgtggcacacatcacagactcccag

SEQ ID NO: 831759 - DNA, 25 bp, Mus musculus
tgtggcacacatgacagactcccag

SEQ ID NO: 831760 - DNA, 25 bp, Mus musculus
tgtggcacagaacgctttcgcaatg

SEQ ID NO: 831761 - DNA, 25 bp, Mus musculus
tgtggcacagaaggctttcgcaatg

SEQ ID NO: 831762 - DNA, 25 bp, Mus musculus
tgtggcacatttaccaaacaccatc

SEQ ID NO: 831763 - DNA, 25 bp, Mus musculus
tgtggcacattttccaaacaccatc

SEQ ID NO: 831764 - DNA, 25 bp, Mus musculus
tgtggcacccagagatcctggccag

SEQ ID NO: 831765 - DNA, 25 bp, Mus musculus
tgtggcacccagtgatcctggccag

SEQ ID NO: 831766 - DNA, 25 bp, Mus musculus
tgtggcaccgtaaaagatagagcgg

SEQ ID NO: 831767 - DNA, 25 bp, Mus musculus
tgtggcaccgtataagatagagcgg

SEQ ID NO: 831768 - DNA, 25 bp, Mus musculus
tgtggcactgatcccctacgctttg

SEQ ID NO: 831769 - DNA, 25 bp, Mus musculus
tgtggcactgatgccctacgctttg

SEQ ID NO: 831770 - DNA, 25 bp, Mus musculus
tgtggcacttctcgtaagcactccg

SEQ ID NO: 831771 - DNA, 25 bp, Mus musculus
tgtggcacttctggtaagcactccg

SEQ ID NO: 831772 - DNA, 25 bp, Mus musculus
tgtggcagaaaacacctattccctg

SEQ ID NO: 831773 - DNA, 25 bp, Mus musculus
tgtggcagaaaagacctattccctg

SEQ ID NO: 831774 - DNA, 25 bp, Mus musculus
tgtggcagaaagagctttggaatat

SEQ ID NO: 831775 - DNA, 25 bp, Mus musculus
tgtggcagaaagtgctttggaatat

SEQ ID NO: 831776 - DNA, 25 bp, Mus musculus
tgtggcagaagacgtgacccagacc

SEQ ID NO: 831777 - DNA, 25 bp, Mus musculus
tgtggcagaagaggtgacccagacc

SEQ ID NO: 831778 - DNA, 25 bp, Mus musculus
tgtggcagagcacgaaatcgtaaag

SEQ ID NO: 831779 - DNA, 25 bp, Mus musculus
tgtggcagagcaggaaatcgtaaag

SEQ ID NO: 831780 - DNA, 25 bp, Mus musculus
tgtggcagaggcctgaacatagaac

SEQ ID NO: 831781 - DNA, 25 bp, Mus musculus
tgtggcagaggcgtgaacatagaac

SEQ ID NO: 831782 - DNA, 25 bp, Mus musculus
tgtggcagcagccttcaagatcctg

SEQ ID NO: 831783 - DNA, 25 bp, Mus musculus
tgtggcagcagcgttcaagatcctg

SEQ ID NO: 831784 - DNA, 25 bp, Mus musculus
tgtggcagccagatatcgggccgta

SEQ ID NO: 831785 - DNA, 25 bp, Mus musculus
tgtggcagccagttatcgggccgta

SEQ ID NO: 831786 - DNA, 25 bp, Mus musculus
tgtggcagcccaatgaagtagcagg

SEQ ID NO: 831787 - DNA, 25 bp, Mus musculus
tgtggcagcccattgaagtagcagg

SEQ ID NO: 831788 - DNA, 25 bp, Mus musculus
tgtggcagctacaggcgcaatgact

SEQ ID NO: 831789 - DNA, 25 bp, Mus musculus
tgtggcagctactggcgcaatgact

SEQ ID NO: 831790 - DNA, 25 bp, Mus musculus
tgtggcagctcgaggtctggatatt

SEQ ID NO: 831791 - DNA, 25 bp, Mus musculus
tgtggcagctcgtggtctggatatt

SEQ ID NO: 831792 - DNA, 25 bp, Mus musculus
tgtggcagctgcctggatatataag

SEQ ID NO: 831793 - DNA, 25 bp, Mus musculus
tgtggcagctgcgtggatatataag

SEQ ID NO: 831794 - DNA, 25 bp, Mus musculus
tgtggcaggtcacagccagtttgca

SEQ ID NO: 831795 - DNA, 25 bp, Mus musculus
tgtggcaggtcagagccagtttgca

SEQ ID NO: 831796 - DNA, 25 bp, Mus musculus
tgtggcaggtgcaagaagaacttcc

SEQ ID NO: 831797 - DNA, 25 bp, Mus musculus
tgtggcaggtgccaatcaatatacc

SEQ ID NO: 831798 - DNA, 25 bp, Mus musculus
tgtggcaggtgcgaatcaatatacc

SEQ ID NO: 831799 - DNA, 25 bp, Mus musculus
tgtggcaggtgctagaagaacttcc

SEQ ID NO: 831800 - DNA, 25 bp, Mus musculus
tgtggcagtgtgaaggttctccaac

SEQ ID NO: 831801 - DNA, 25 bp, Mus musculus
tgtggcagtgtgatgctcaagcaag

SEQ ID NO: 831802 - DNA, 25 bp, Mus musculus
tgtggcagtgtgtaggttctccaac

SEQ ID NO: 831803 - DNA, 25 bp, Mus musculus
tgtggcagtgtgttgctcaagcaag

SEQ ID NO: 831804 - DNA, 25 bp, Mus musculus
tgtggcatcaaaacctgcagggagg

SEQ ID NO: 831805 - DNA, 25 bp, Mus musculus
tgtggcatcaaatcctgcagggagg

SEQ ID NO: 831806 - DNA, 25 bp, Mus musculus
tgtggcatcatgcaccaactcatcg

SEQ ID NO: 831807 - DNA, 25 bp, Mus musculus
tgtggcatcatggaccaactcatcg

SEQ ID NO: 831808 - DNA, 25 bp, Mus musculus
tgtggcatcattccacgctctgccg

SEQ ID NO: 831809 - DNA, 25 bp, Mus musculus
tgtggcatcattgcacgctctgccg

SEQ ID NO: 831810 - DNA, 25 bp, Mus musculus
tgtggcatcccgacagaactggaga

SEQ ID NO: 831811 - DNA, 25 bp, Mus musculus
tgtggcatcccgtcagaactggaga

SEQ ID NO: 831812 - DNA, 25 bp, Mus musculus
tgtggcatccggaacagctccgtgt

SEQ ID NO: 831813 - DNA, 25 bp, Mus musculus
tgtggcatccggtacagctccgtgt

SEQ ID NO: 831814 - DNA, 25 bp, Mus musculus
tgtggcatcgtcctcttgggtgtct

SEQ ID NO: 831815 - DNA, 25 bp, Mus musculus
tgtggcatcgtcgtcttgggtgtct

SEQ ID NO: 831816 - DNA, 25 bp, Mus musculus
tgtggcatcgttcgctatcagtgca

SEQ ID NO: 831817 - DNA, 25 bp, Mus musculus
tgtggcatcgttggctatcagtgca

SEQ ID NO: 831818 - DNA, 25 bp, Mus musculus
tgtggcatctctacccactctgagg

SEQ ID NO: 831819 - DNA, 25 bp, Mus musculus
tgtggcatctcttcccactctgagg

SEQ ID NO: 831820 - DNA, 25 bp, Mus musculus
tgtggcatgaaaagtgccccagcct

SEQ ID NO: 831821 - DNA, 25 bp, Mus musculus
tgtggcatgaaatgtgccccagcct

SEQ ID NO: 831822 - DNA, 25 bp, Mus musculus
tgtggcatgaagaccctcgagtggc

SEQ ID NO: 831823 - DNA, 25 bp, Mus musculus
tgtggcatgaagtccctcgagtggc

SEQ ID NO: 831824 - DNA, 25 bp, Mus musculus
tgtggcatgaccctcgccacatcgg

SEQ ID NO: 831825 - DNA, 25 bp, Mus musculus
tgtggcatgaccgtcgccacatcgg

SEQ ID NO: 831826 - DNA, 25 bp, Mus musculus
tgtggcatgccaccatgtaacctgg

SEQ ID NO: 831827 - DNA, 25 bp, Mus musculus
tgtggcatgccagcatgtaacctgg

SEQ ID NO: 831828 - DNA, 25 bp, Mus musculus
tgtggcatgtgtccccatgaagctc

SEQ ID NO: 831829 - DNA, 25 bp, Mus musculus
tgtggcatgtgtgcccatgaagctc

SEQ ID NO: 831830 - DNA, 25 bp, Mus musculus
tgtggcattaacagcaagcggcgag

SEQ ID NO: 831831 - DNA, 25 bp, Mus musculus
tgtggcattaactgcaagcggcgag

SEQ ID NO: 831832 - DNA, 25 bp, Mus musculus
tgtggcattaagctgccttctcgtt

SEQ ID NO: 831833 - DNA, 25 bp, Mus musculus
tgtggcattaaggtgccttctcgtt

SEQ ID NO: 831834 - DNA, 25 bp, Mus musculus
tgtggccaagcacaaagtagtgaga

SEQ ID NO: 831835 - DNA, 25 bp, Mus musculus
tgtggccaagcagaaagtagtgaga

SEQ ID NO: 831836 - DNA, 25 bp, Mus musculus
tgtggccaagtcaaaccgctgattt

SEQ ID NO: 831837 - DNA, 25 bp, Mus musculus
tgtggccaagtctaaccgctgattt

SEQ ID NO: 831838 - DNA, 25 bp, Mus musculus
tgtggccaatgcagagctggttcgc

SEQ ID NO: 831839 - DNA, 25 bp, Mus musculus
tgtggccaatgctgagctggttcgc

SEQ ID NO: 831840 - DNA, 25 bp, Mus musculus
tgtggccacaaaagagactgagggc

SEQ ID NO: 831841 - DNA, 25 bp, Mus musculus
tgtggccacaaatgagactgagggc

SEQ ID NO: 831842 - DNA, 25 bp, Mus musculus
tgtggccacaacaccgatacttgtc

SEQ ID NO: 831843 - DNA, 25 bp, Mus musculus
tgtggccacaactccgatacttgtc

SEQ ID NO: 831844 - DNA, 25 bp, Mus musculus
tgtggccacattagttcttgggatc

SEQ ID NO: 831845 - DNA, 25 bp, Mus musculus
tgtggccacatttgttcttgggatc

SEQ ID NO: 831846 - DNA, 25 bp, Mus musculus
tgtggccactgtcacttctgccgtg

SEQ ID NO: 831847 - DNA, 25 bp, Mus musculus
tgtggccactgtgacttctgccgtg

SEQ ID NO: 831848 - DNA, 25 bp, Mus musculus
tgtggccagaaaaagttcgaggcct

SEQ ID NO: 831849 - DNA, 25 bp, Mus musculus
tgtggccagaaatagttcgaggcct

SEQ ID NO: 831850 - DNA, 25 bp, Mus musculus
tgtggccagaatacacattttggaa

SEQ ID NO: 831851 - DNA, 25 bp, Mus musculus
tgtggccagaattcacattttggaa

SEQ ID NO: 831852 - DNA, 25 bp, Mus musculus
tgtggccagccacatgcaactttgt

SEQ ID NO: 831853 - DNA, 25 bp, Mus musculus
tgtggccagccagatgcaactttgt

SEQ ID NO: 831854 - DNA, 25 bp, Mus musculus
tgtggccaggacagtcgcctccaca

SEQ ID NO: 831855 - DNA, 25 bp, Mus musculus
tgtggccaggacctcaacaagctca

SEQ ID NO: 831856 - DNA, 25 bp, Mus musculus
tgtggccaggacgtcaacaagctca

SEQ ID NO: 831857 - DNA, 25 bp, Mus musculus
tgtggccaggactgtcgcctccaca

SEQ ID NO: 831858 - DNA, 25 bp, Mus musculus
tgtggccaggtcacaccaggcagtt

SEQ ID NO: 831859 - DNA, 25 bp, Mus musculus
tgtggccaggtctcaccaggcagtt

SEQ ID NO: 831860 - DNA, 25 bp, Mus musculus
tgtggccagtgtaccccgtgccgtg

SEQ ID NO: 831861 - DNA, 25 bp, Mus musculus
tgtggccagtgttccccgtgccgtg

SEQ ID NO: 831862 - DNA, 25 bp, Mus musculus
tgtggccatactcactgcactgctg

SEQ ID NO: 831863 - DNA, 25 bp, Mus musculus
tgtggccatactgactgcactgctg

SEQ ID NO: 831864 - DNA, 25 bp, Mus musculus
tgtggccatcatccctcaaaccaga

SEQ ID NO: 831865 - DNA, 25 bp, Mus musculus
tgtggccatcatgcctcaaaccaga

SEQ ID NO: 831866 - DNA, 25 bp, Mus musculus
tgtggccatgcgagagatctacgac

SEQ ID NO: 831867 - DNA, 25 bp, Mus musculus
tgtggccatgcgtgagatctacgac

SEQ ID NO: 831868 - DNA, 25 bp, Mus musculus
tgtggccatgctcaaagccagcgct

SEQ ID NO: 831869 - DNA, 25 bp, Mus musculus
tgtggccatgctgaaagccagcgct

SEQ ID NO: 831870 - DNA, 25 bp, Mus musculus
tgtggccatggaactaactgctggg

SEQ ID NO: 831871 - DNA, 25 bp, Mus musculus
tgtggccatggatctaactgctggg

SEQ ID NO: 831872 - DNA, 25 bp, Mus musculus
tgtggccattctctttttaccacca

SEQ ID NO: 831873 - DNA, 25 bp, Mus musculus
tgtggccattctgtttttaccacca

SEQ ID NO: 831874 - DNA, 25 bp, Mus musculus
tgtggcccacaacacacccaggtgc

SEQ ID NO: 831875 - DNA, 25 bp, Mus musculus
tgtggcccacaagacacccaggtgc

SEQ ID NO: 831876 - DNA, 25 bp, Mus musculus
tgtggcccagccctacctttggtgg

SEQ ID NO: 831877 - DNA, 25 bp, Mus musculus
tgtggcccagccgtacctttggtgg

SEQ ID NO: 831878 - DNA, 25 bp, Mus musculus
tgtggcccaggtccacgcagaaaat

SEQ ID NO: 831879 - DNA, 25 bp, Mus musculus
tgtggcccaggtcgatgataacagc

SEQ ID NO: 831880 - DNA, 25 bp, Mus musculus
tgtggcccaggtgcacgcagaaaat

SEQ ID NO: 831881 - DNA, 25 bp, Mus musculus
tgtggcccaggtggatgataacagc

SEQ ID NO: 831882 - DNA, 25 bp, Mus musculus
tgtggcccatgtcacgatgctgtct

SEQ ID NO: 831883 - DNA, 25 bp, Mus musculus
tgtggcccatgtgacgatgctgtct

SEQ ID NO: 831884 - DNA, 25 bp, Mus musculus
tgtggccccaaacacagagtgtgta

SEQ ID NO: 831885 - DNA, 25 bp, Mus musculus
tgtggccccaaagacagagtgtgta

SEQ ID NO: 831886 - DNA, 25 bp, Mus musculus
tgtggccccgggagtcaaaagtgtc

SEQ ID NO: 831887 - DNA, 25 bp, Mus musculus
tgtggccccgggtgtcaaaagtgtc

SEQ ID NO: 831888 - DNA, 25 bp, Mus musculus
tgtggcccctggatcagctgacagg

SEQ ID NO: 831889 - DNA, 25 bp, Mus musculus
tgtggcccctggttcagctgacagg

SEQ ID NO: 831890 - DNA, 25 bp, Mus musculus
tgtggcccgggacacagatgcccac

SEQ ID NO: 831891 - DNA, 25 bp, Mus musculus
tgtggcccgggagacagatgcccac

SEQ ID NO: 831892 - DNA, 25 bp, Mus musculus
tgtggccctatgatctagaatagtc

SEQ ID NO: 831893 - DNA, 25 bp, Mus musculus
tgtggccctatgttctagaatagtc

SEQ ID NO: 831894 - DNA, 25 bp, Mus musculus
tgtggccctcacagaattaagctgg

SEQ ID NO: 831895 - DNA, 25 bp, Mus musculus
tgtggccctcactgaattaagctgg

SEQ ID NO: 831896 - DNA, 25 bp, Mus musculus
tgtggccctggcaaggttcagaacg

SEQ ID NO: 831897 - DNA, 25 bp, Mus musculus
tgtggccctggctaggttcagaacg

SEQ ID NO: 831898 - DNA, 25 bp, Mus musculus
tgtggcccttacaatgcacggcccg

SEQ ID NO: 831899 - DNA, 25 bp, Mus musculus
tgtggcccttactatgcacggcccg

SEQ ID NO: 831900 - DNA, 25 bp, Mus musculus
tgtggcccttcaatctgccgtgagt

SEQ ID NO: 831901 - DNA, 25 bp, Mus musculus
tgtggcccttcattctgccgtgagt

SEQ ID NO: 831902 - DNA, 25 bp, Mus musculus
tgtggcccttttcctctgagatttg

SEQ ID NO: 831903 - DNA, 25 bp, Mus musculus
tgtggcccttttgctctgagatttg

SEQ ID NO: 831904 - DNA, 25 bp, Mus musculus
tgtggccgacacacatgagggtcat

SEQ ID NO: 831905 - DNA, 25 bp, Mus musculus
tgtggccgacactcatgagggtcat

SEQ ID NO: 831906 - DNA, 25 bp, Mus musculus
tgtggccgaggtagagaaggtggct

SEQ ID NO: 831907 - DNA, 25 bp, Mus musculus
tgtggccgaggttgagaaggtggct

SEQ ID NO: 831908 - DNA, 25 bp, Mus musculus
tgtggccgccaccaaagttaatcag

SEQ ID NO: 831909 - DNA, 25 bp, Mus musculus
tgtggccgccaccactccaggttgg

SEQ ID NO: 831910 - DNA, 25 bp, Mus musculus
tgtggccgccacgaaagttaatcag

SEQ ID NO: 831911 - DNA, 25 bp, Mus musculus
tgtggccgccacgactccaggttgg

SEQ ID NO: 831912 - DNA, 25 bp, Mus musculus
tgtggccgccatcaggcttggtatc

SEQ ID NO: 831913 - DNA, 25 bp, Mus musculus
tgtggccgccatgaggcttggtatc

SEQ ID NO: 831914 - DNA, 25 bp, Mus musculus
tgtggccgcccaattctctgctcag

SEQ ID NO: 831915 - DNA, 25 bp, Mus musculus
tgtggccgcccatttctctgctcag

SEQ ID NO: 831916 - DNA, 25 bp, Mus musculus
tgtggccgctccatcgtggttgacc

SEQ ID NO: 831917 - DNA, 25 bp, Mus musculus
tgtggccgctccttcgtggttgacc

SEQ ID NO: 831918 - DNA, 25 bp, Mus musculus
tgtggccggccccatgtatccggaa

SEQ ID NO: 831919 - DNA, 25 bp, Mus musculus
tgtggccggcccgatgtatccggaa

SEQ ID NO: 831920 - DNA, 25 bp, Mus musculus
tgtggccgggcccagacaaaatgta

SEQ ID NO: 831921 - DNA, 25 bp, Mus musculus
tgtggccgggccgagacaaaatgta

SEQ ID NO: 831922 - DNA, 25 bp, Mus musculus
tgtggccgtacgagggaataaccag

SEQ ID NO: 831923 - DNA, 25 bp, Mus musculus
tgtggccgtacgtgggaataaccag

SEQ ID NO: 831924 - DNA, 25 bp, Mus musculus
tgtggccgtcataggcatcgatgag

SEQ ID NO: 831925 - DNA, 25 bp, Mus musculus
tgtggccgtcattggcatcgatgag

SEQ ID NO: 831926 - DNA, 25 bp, Mus musculus
tgtggccgttctctctgctgtcatc

SEQ ID NO: 831927 - DNA, 25 bp, Mus musculus
tgtggccgttctgtctgctgtcatc

SEQ ID NO: 831928 - DNA, 25 bp, Mus musculus
tgtggcctcaaccattccttggtgc

SEQ ID NO: 831929 - DNA, 25 bp, Mus musculus
tgtggcctcaacgattccttggtgc

SEQ ID NO: 831930 - DNA, 25 bp, Mus musculus
tgtggcctcactcctgcagtcagta

SEQ ID NO: 831931 - DNA, 25 bp, Mus musculus
tgtggcctcactgctgcagtcagta

SEQ ID NO: 831932 - DNA, 25 bp, Mus musculus
tgtggcctcagaattcttctagtac

SEQ ID NO: 831933 - DNA, 25 bp, Mus musculus
tgtggcctcagatttcttctagtac

SEQ ID NO: 831934 - DNA, 25 bp, Mus musculus
tgtggcctcccacagatgtccagtc

SEQ ID NO: 831935 - DNA, 25 bp, Mus musculus
tgtggcctcccagagatgtccagtc

SEQ ID NO: 831936 - DNA, 25 bp, Mus musculus
tgtggcctcggaccagtcctcgcat

SEQ ID NO: 831937 - DNA, 25 bp, Mus musculus
tgtggcctcggagcagtcctcgcat

SEQ ID NO: 831938 - DNA, 25 bp, Mus musculus
tgtggcctcggcaagactggctgca

SEQ ID NO: 831939 - DNA, 25 bp, Mus musculus
tgtggcctcggctagactggctgca

SEQ ID NO: 831940 - DNA, 25 bp, Mus musculus
tgtggcctctgtacatcaagacctg

SEQ ID NO: 831941 - DNA, 25 bp, Mus musculus
tgtggcctctgttcatcaagacctg

SEQ ID NO: 831942 - DNA, 25 bp, Mus musculus
tgtggcctgaagaccatgtgttcat

SEQ ID NO: 831943 - DNA, 25 bp, Mus musculus
tgtggcctgaagtccatgtgttcat

SEQ ID NO: 831944 - DNA, 25 bp, Mus musculus
tgtggcctgatccttcctatgcaga

SEQ ID NO: 831945 - DNA, 25 bp, Mus musculus
tgtggcctgatcgttcctatgcaga

SEQ ID NO: 831946 - DNA, 25 bp, Mus musculus
tgtggcctgatgctagacaactgga

SEQ ID NO: 831947 - DNA, 25 bp, Mus musculus
tgtggcctgatggtagacaactgga

SEQ ID NO: 831948 - DNA, 25 bp, Mus musculus
tgtggcctggcccttttctacgctc

SEQ ID NO: 831949 - DNA, 25 bp, Mus musculus
tgtggcctggccgttttctacgctc

SEQ ID NO: 831950 - DNA, 25 bp, Mus musculus
tgtggcctggctattcggaaactgt

SEQ ID NO: 831951 - DNA, 25 bp, Mus musculus
tgtggcctggcttttcggaaactgt

SEQ ID NO: 831952 - DNA, 25 bp, Mus musculus
tgtggcctgggactccgagtgcggg

SEQ ID NO: 831953 - DNA, 25 bp, Mus musculus
tgtggcctgggagtccgagtgcggg

SEQ ID NO: 831954 - DNA, 25 bp, Mus musculus
tgtggcctgtataaccctctctggt

SEQ ID NO: 831955 - DNA, 25 bp, Mus musculus
tgtggcctgtattaccctctctggt

SEQ ID NO: 831956 - DNA, 25 bp, Mus musculus
tgtggccttcatcagtgcagtcgga

SEQ ID NO: 831957 - DNA, 25 bp, Mus musculus
tgtggccttcatgagtgcagtcgga

SEQ ID NO: 831958 - DNA, 25 bp, Mus musculus
tgtggccttcttaaccagctaccag

SEQ ID NO: 831959 - DNA, 25 bp, Mus musculus
tgtggccttctttaccagctaccag

SEQ ID NO: 831960 - DNA, 25 bp, Mus musculus
tgtggccttgttattaccgcagggc

SEQ ID NO: 831961 - DNA, 25 bp, Mus musculus
tgtggccttgtttttaccgcagggc

SEQ ID NO: 831962 - DNA, 25 bp, Mus musculus
tgtggcctttacaaatcattttaac

SEQ ID NO: 831963 - DNA, 25 bp, Mus musculus
tgtggcctttactaatcattttaac

SEQ ID NO: 831964 - DNA, 25 bp, Mus musculus
tgtggcctttggagctccgatagga

SEQ ID NO: 831965 - DNA, 25 bp, Mus musculus
tgtggcctttggtgctccgatagga

SEQ ID NO: 831966 - DNA, 25 bp, Mus musculus
tgtggcctttgtcacgggctccctg

SEQ ID NO: 831967 - DNA, 25 bp, Mus musculus
tgtggcctttgtgacgggctccctg

SEQ ID NO: 831968 - DNA, 25 bp, Mus musculus
tgtggcgaaggcagtgtgaaaatcc

SEQ ID NO: 831969 - DNA, 25 bp, Mus musculus
tgtggcgaaggctgtgtgaaaatcc

SEQ ID NO: 831970 - DNA, 25 bp, Mus musculus
tgtggcgaagtcatgtttgagagcc

SEQ ID NO: 831971 - DNA, 25 bp, Mus musculus
tgtggcgaagtcttgtttgagagcc

SEQ ID NO: 831972 - DNA, 25 bp, Mus musculus
tgtggcgagcaacaccaagtgtagc

SEQ ID NO: 831973 - DNA, 25 bp, Mus musculus
tgtggcgagcaagaccaagtgtagc

SEQ ID NO: 831974 - DNA, 25 bp, Mus musculus
tgtggcgatcacagaagagtctaag

SEQ ID NO: 831975 - DNA, 25 bp, Mus musculus
tgtggcgatcactgaagagtctaag

SEQ ID NO: 831976 - DNA, 25 bp, Mus musculus
tgtggcgatcatctccgaggatgac

SEQ ID NO: 831977 - DNA, 25 bp, Mus musculus
tgtggcgatcatgtccgaggatgac

SEQ ID NO: 831978 - DNA, 25 bp, Mus musculus
tgtggcgatctgcactgtcccgact

SEQ ID NO: 831979 - DNA, 25 bp, Mus musculus
tgtggcgatctggactgtcccgact

SEQ ID NO: 831980 - DNA, 25 bp, Mus musculus
tgtggcgccacaacctctttttcca

SEQ ID NO: 831981 - DNA, 25 bp, Mus musculus
tgtggcgccacatcctctttttcca

SEQ ID NO: 831982 - DNA, 25 bp, Mus musculus
tgtggcgcccgcattcctggcagat

SEQ ID NO: 831983 - DNA, 25 bp, Mus musculus
tgtggcgcccgctttcctggcagat

SEQ ID NO: 831984 - DNA, 25 bp, Mus musculus
tgtggcgcccgtactactcagtgta

SEQ ID NO: 831985 - DNA, 25 bp, Mus musculus
tgtggcgcccgttctactcagtgta

SEQ ID NO: 831986 - DNA, 25 bp, Mus musculus
tgtggcgctactaccgagactactt

SEQ ID NO: 831987 - DNA, 25 bp, Mus musculus
tgtggcgctacttccgagactactt

SEQ ID NO: 831988 - DNA, 25 bp, Mus musculus
tgtggcgctgccagcgctaattaac

SEQ ID NO: 831989 - DNA, 25 bp, Mus musculus
tgtggcgctgcctgcgctaattaac

SEQ ID NO: 831990 - DNA, 25 bp, Mus musculus
tgtggcggataaccacgaattgctc

SEQ ID NO: 831991 - DNA, 25 bp, Mus musculus
tgtggcggataagcacgaattgctc

SEQ ID NO: 831992 - DNA, 25 bp, Mus musculus
tgtggcggcgggaaaaaatgcctat

SEQ ID NO: 831993 - DNA, 25 bp, Mus musculus
tgtggcggcgggtaaaaatgcctat

SEQ ID NO: 831994 - DNA, 25 bp, Mus musculus
tgtggcgggcacagaaatccagctg

SEQ ID NO: 831995 - DNA, 25 bp, Mus musculus
tgtggcgggcactgaaatccagctg

SEQ ID NO: 831996 - DNA, 25 bp, Mus musculus
tgtggcgggtaaaaaggaaacactg

SEQ ID NO: 831997 - DNA, 25 bp, Mus musculus
tgtggcgggtaataaggaaacactg

SEQ ID NO: 831998 - DNA, 25 bp, Mus musculus
tgtggcgtaaggatcagaaactatc

SEQ ID NO: 831999 - DNA, 25 bp, Mus musculus
tgtggcgtaaggttcagaaactatc

SEQ ID NO: 832000 - DNA, 25 bp, Mus musculus
tgtggcgtcacaatcagaagcctat

SEQ ID NO: 832001 - DNA, 25 bp, Mus musculus
tgtggcgtcacattcagaagcctat

SEQ ID NO: 832002 - DNA, 25 bp, Mus musculus
tgtggcgtgaacagggcagaacctt

SEQ ID NO: 832003 - DNA, 25 bp, Mus musculus
tgtggcgtgaactgggcagaacctt

SEQ ID NO: 832004 - DNA, 25 bp, Mus musculus
tgtggcgtgcagaactacaccaact

SEQ ID NO: 832005 - DNA, 25 bp, Mus musculus
tgtggcgtgcagtactacaccaact

SEQ ID NO: 832006 - DNA, 25 bp, Mus musculus
tgtggctaactacaaccagagtaca

SEQ ID NO: 832007 - DNA, 25 bp, Mus musculus
tgtggctaactagaaccagagtaca

SEQ ID NO: 832008 - DNA, 25 bp, Mus musculus
tgtggctaagagcacatcatcatat

SEQ ID NO: 832009 - DNA, 25 bp, Mus musculus
tgtggctaagaggacatcatcatat

SEQ ID NO: 832010 - DNA, 25 bp, Mus musculus
tgtggctaatgactacccagtaggg

SEQ ID NO: 832011 - DNA, 25 bp, Mus musculus
tgtggctaatgagtacccagtaggg

SEQ ID NO: 832012 - DNA, 25 bp, Mus musculus
tgtggctacaggaaccaatctgtct

SEQ ID NO: 832013 - DNA, 25 bp, Mus musculus
tgtggctacaggtaccaatctgtct

SEQ ID NO: 832014 - DNA, 25 bp, Mus musculus
tgtggctacattctacccgctgagt

SEQ ID NO: 832015 - DNA, 25 bp, Mus musculus
tgtggctacattgtacccgctgagt

SEQ ID NO: 832016 - DNA, 25 bp, Mus musculus
tgtggctaccttcaacggcaagaag

SEQ ID NO: 832017 - DNA, 25 bp, Mus musculus
tgtggctaccttgaacggcaagaag

SEQ ID NO: 832018 - DNA, 25 bp, Mus musculus
tgtggctactacaacacagctgtga

SEQ ID NO: 832019 - DNA, 25 bp, Mus musculus
tgtggctactactacacagctgtga

SEQ ID NO: 832020 - DNA, 25 bp, Mus musculus
tgtggctactgcaagaacaagttgg

SEQ ID NO: 832021 - DNA, 25 bp, Mus musculus
tgtggctactgctagaacaagttgg

SEQ ID NO: 832022 - DNA, 25 bp, Mus musculus
tgtggctagaaaaacaaacctccct

SEQ ID NO: 832023 - DNA, 25 bp, Mus musculus
tgtggctagaaatacaaacctccct

SEQ ID NO: 832024 - DNA, 25 bp, Mus musculus
tgtggctagaacatccctgcagacg

SEQ ID NO: 832025 - DNA, 25 bp, Mus musculus
tgtggctagaaccatctgacacctc

SEQ ID NO: 832026 - DNA, 25 bp, Mus musculus
tgtggctagaacctccttggtggta

SEQ ID NO: 832027 - DNA, 25 bp, Mus musculus
tgtggctagaacgatctgacacctc

SEQ ID NO: 832028 - DNA, 25 bp, Mus musculus
tgtggctagaacgtccttggtggta

SEQ ID NO: 832029 - DNA, 25 bp, Mus musculus
tgtggctagaacttccctgcagacg

SEQ ID NO: 832030 - DNA, 25 bp, Mus musculus
tgtggctatccacgccttgtgggca

SEQ ID NO: 832031 - DNA, 25 bp, Mus musculus
tgtggctatccaggccttgtgggca

SEQ ID NO: 832032 - DNA, 25 bp, Mus musculus
tgtggctatcttcctctacctggca

SEQ ID NO: 832033 - DNA, 25 bp, Mus musculus
tgtggctatcttgctctacctggca

SEQ ID NO: 832034 - DNA, 25 bp, Mus musculus
tgtggctatggcacgaaagttgcag

SEQ ID NO: 832035 - DNA, 25 bp, Mus musculus
tgtggctatggctcgaaagttgcag

SEQ ID NO: 832036 - DNA, 25 bp, Mus musculus
tgtggctatttgacattgaattgtc

SEQ ID NO: 832037 - DNA, 25 bp, Mus musculus
tgtggctatttgtcattgaattgtc

SEQ ID NO: 832038 - DNA, 25 bp, Mus musculus
tgtggctcacggagccgaagttaac

SEQ ID NO: 832039 - DNA, 25 bp, Mus musculus
tgtggctcacggtgccgaagttaac

SEQ ID NO: 832040 - DNA, 25 bp, Mus musculus
tgtggctcactcaatgagggaacca

SEQ ID NO: 832041 - DNA, 25 bp, Mus musculus
tgtggctcactctatgagggaacca

SEQ ID NO: 832042 - DNA, 25 bp, Mus musculus
tgtggctcagcacatcccgtgtgct

SEQ ID NO: 832043 - DNA, 25 bp, Mus musculus
tgtggctcagcagatcccgtgtgct

SEQ ID NO: 832044 - DNA, 25 bp, Mus musculus
tgtggctcccacagtggtgtgtcca

SEQ ID NO: 832045 - DNA, 25 bp, Mus musculus
tgtggctcccactgtggtgtgtcca

SEQ ID NO: 832046 - DNA, 25 bp, Mus musculus
tgtggctcccgacagtgcccatgct

SEQ ID NO: 832047 - DNA, 25 bp, Mus musculus
tgtggctcccgagagtgcccatgct

SEQ ID NO: 832048 - DNA, 25 bp, Mus musculus
tgtggctccctccactcaagtgtca

SEQ ID NO: 832049 - DNA, 25 bp, Mus musculus
tgtggctccctcgactcaagtgtca

SEQ ID NO: 832050 - DNA, 25 bp, Mus musculus
tgtggctcccttcgactccaattca

SEQ ID NO: 832051 - DNA, 25 bp, Mus musculus
tgtggctcccttggactccaattca

SEQ ID NO: 832052 - DNA, 25 bp, Mus musculus
tgtggctcctgacagaataatttcc

SEQ ID NO: 832053 - DNA, 25 bp, Mus musculus
tgtggctcctgagagaataatttcc

SEQ ID NO: 832054 - DNA, 25 bp, Mus musculus
tgtggctcgaagcataatatcaaac

SEQ ID NO: 832055 - DNA, 25 bp, Mus musculus
tgtggctcgaaggataatatcaaac

SEQ ID NO: 832056 - DNA, 25 bp, Mus musculus
tgtggctcgcagacccatgaagaag

SEQ ID NO: 832057 - DNA, 25 bp, Mus musculus
tgtggctcgcagtcccatgaagaag

SEQ ID NO: 832058 - DNA, 25 bp, Mus musculus
tgtggctcgcggaccctgcttctca

SEQ ID NO: 832059 - DNA, 25 bp, Mus musculus
tgtggctcgcggtccctgcttctca

SEQ ID NO: 832060 - DNA, 25 bp, Mus musculus
tgtggctcgttacggaacatccatc

SEQ ID NO: 832061 - DNA, 25 bp, Mus musculus
tgtggctcgttagggaacatccatc

SEQ ID NO: 832062 - DNA, 25 bp, Mus musculus
tgtggctctacacgatgggcaagct

SEQ ID NO: 832063 - DNA, 25 bp, Mus musculus
tgtggctctacaggatgggcaagct

SEQ ID NO: 832064 - DNA, 25 bp, Mus musculus
tgtggctctggacatggatcttgct

SEQ ID NO: 832065 - DNA, 25 bp, Mus musculus
tgtggctctggagatggatcttgct

SEQ ID NO: 832066 - DNA, 25 bp, Mus musculus
tgtggctctggcagcaacaaatttg

SEQ ID NO: 832067 - DNA, 25 bp, Mus musculus
tgtggctctggctgcaacaaatttg

SEQ ID NO: 832068 - DNA, 25 bp, Mus musculus
tgtggctctgttcacaccaccctgt

SEQ ID NO: 832069 - DNA, 25 bp, Mus musculus
tgtggctctgttgacaccaccctgt

SEQ ID NO: 832070 - DNA, 25 bp, Mus musculus
tgtggctcttcaagatttcccagca

SEQ ID NO: 832071 - DNA, 25 bp, Mus musculus
tgtggctcttcatgatttcccagca

SEQ ID NO: 832072 - DNA, 25 bp, Mus musculus
tgtggctcttccaaagtaacatgtc

SEQ ID NO: 832073 - DNA, 25 bp, Mus musculus
tgtggctcttcctaagtaacatgtc

SEQ ID NO: 832074 - DNA, 25 bp, Mus musculus
tgtggctgacccaagacaactgtaa

SEQ ID NO: 832075 - DNA, 25 bp, Mus musculus
tgtggctgaccctagacaactgtaa

SEQ ID NO: 832076 - DNA, 25 bp, Mus musculus
tgtggctgactcagacgttatgctc

SEQ ID NO: 832077 - DNA, 25 bp, Mus musculus
tgtggctgactctgacgttatgctc

SEQ ID NO: 832078 - DNA, 25 bp, Mus musculus
tgtggctgagcacgatgcccctaac

SEQ ID NO: 832079 - DNA, 25 bp, Mus musculus
tgtggctgagcaggatgcccctaac

SEQ ID NO: 832080 - DNA, 25 bp, Mus musculus
tgtggctgagccagggattcagctc

SEQ ID NO: 832081 - DNA, 25 bp, Mus musculus
tgtggctgagcctgggattcagctc

SEQ ID NO: 832082 - DNA, 25 bp, Mus musculus
tgtggctgagcgacctggtacgaac

SEQ ID NO: 832083 - DNA, 25 bp, Mus musculus
tgtggctgagcgtcctggtacgaac

SEQ ID NO: 832084 - DNA, 25 bp, Mus musculus
tgtggctgcagaatggctattacct

SEQ ID NO: 832085 - DNA, 25 bp, Mus musculus
tgtggctgcagattggctattacct

SEQ ID NO: 832086 - DNA, 25 bp, Mus musculus
tgtggctgcatcagagtcagagcct

SEQ ID NO: 832087 - DNA, 25 bp, Mus musculus
tgtggctgcatctgagtcagagcct

SEQ ID NO: 832088 - DNA, 25 bp, Mus musculus
tgtggctgccacaagtaccatcaac

SEQ ID NO: 832089 - DNA, 25 bp, Mus musculus
tgtggctgccacagataccaatgga

SEQ ID NO: 832090 - DNA, 25 bp, Mus musculus
tgtggctgccactagtaccatcaac

SEQ ID NO: 832091 - DNA, 25 bp, Mus musculus
tgtggctgccactgataccaatgga

SEQ ID NO: 832092 - DNA, 25 bp, Mus musculus
tgtggctgctctaggccctgttgag

SEQ ID NO: 832093 - DNA, 25 bp, Mus musculus
tgtggctgctcttggccctgttgag

SEQ ID NO: 832094 - DNA, 25 bp, Mus musculus
tgtggctgctttccaggtgatgaca

SEQ ID NO: 832095 - DNA, 25 bp, Mus musculus
tgtggctgctttgcaggtgatgaca

SEQ ID NO: 832096 - DNA, 25 bp, Mus musculus
tgtggctggaggatctctgctccag

SEQ ID NO: 832097 - DNA, 25 bp, Mus musculus
tgtggctggaggttctctgctccag

SEQ ID NO: 832098 - DNA, 25 bp, Mus musculus
tgtggctggagtattacaacctgga

SEQ ID NO: 832099 - DNA, 25 bp, Mus musculus
tgtggctggagttttacaacctgga

SEQ ID NO: 832100 - DNA, 25 bp, Mus musculus
tgtggctggcacacaatgagatccg

SEQ ID NO: 832101 - DNA, 25 bp, Mus musculus
tgtggctggcactcaatgagatccg

SEQ ID NO: 832102 - DNA, 25 bp, Mus musculus
tgtggctgggcaatgctatgctaca

SEQ ID NO: 832103 - DNA, 25 bp, Mus musculus
tgtggctgggcattgctatgctaca

SEQ ID NO: 832104 - DNA, 25 bp, Mus musculus
tgtggctggtcaagaattccaggct

SEQ ID NO: 832105 - DNA, 25 bp, Mus musculus
tgtggctggtcatgaattccaggct

SEQ ID NO: 832106 - DNA, 25 bp, Mus musculus
tgtggctggtggctactcctattcc

SEQ ID NO: 832107 - DNA, 25 bp, Mus musculus
tgtggctggtgggtactcctattcc

SEQ ID NO: 832108 - DNA, 25 bp, Mus musculus
tgtggctgtaagcagaaccagttcc

SEQ ID NO: 832109 - DNA, 25 bp, Mus musculus
tgtggctgtaaggagaaccagttcc

SEQ ID NO: 832110 - DNA, 25 bp, Mus musculus
tgtggctgtcctagtgggctccatg

SEQ ID NO: 832111 - DNA, 25 bp, Mus musculus
tgtggctgtccttgtgggctccatg

SEQ ID NO: 832112 - DNA, 25 bp, Mus musculus
tgtggctgtctgatccctgggaaag

SEQ ID NO: 832113 - DNA, 25 bp, Mus musculus
tgtggctgtctgttccctgggaaag

SEQ ID NO: 832114 - DNA, 25 bp, Mus musculus
tgtggctgtcttcgccgtggccata

SEQ ID NO: 832115 - DNA, 25 bp, Mus musculus
tgtggctgtcttggccgtggccata

SEQ ID NO: 832116 - DNA, 25 bp, Mus musculus
tgtggctgtgcaccccgacagcatg

SEQ ID NO: 832117 - DNA, 25 bp, Mus musculus
tgtggctgtgcagcccgacagcatg

SEQ ID NO: 832118 - DNA, 25 bp, Mus musculus
tgtggcttacaaagcgtttctgaaa

SEQ ID NO: 832119 - DNA, 25 bp, Mus musculus
tgtggcttacaatgcgtttctgaaa

SEQ ID NO: 832120 - DNA, 25 bp, Mus musculus
tgtggcttacctctatggcatcatc

SEQ ID NO: 832121 - DNA, 25 bp, Mus musculus
tgtggcttacctgtatggcatcatc

SEQ ID NO: 832122 - DNA, 25 bp, Mus musculus
tgtggcttccacacatctcgtatag

SEQ ID NO: 832123 - DNA, 25 bp, Mus musculus
tgtggcttccactcatctcgtatag

SEQ ID NO: 832124 - DNA, 25 bp, Mus musculus
tgtggcttcccactgtatcatctgc

SEQ ID NO: 832125 - DNA, 25 bp, Mus musculus
tgtggcttcccagtgtatcatctgc

SEQ ID NO: 832126 - DNA, 25 bp, Mus musculus
tgtggcttccccattggctgtctca

SEQ ID NO: 832127 - DNA, 25 bp, Mus musculus
tgtggcttcccctttggctgtctca

SEQ ID NO: 832128 - DNA, 25 bp, Mus musculus
tgtggcttccgcagagctcttccga

SEQ ID NO: 832129 - DNA, 25 bp, Mus musculus
tgtggcttccgctgagctcttccga

SEQ ID NO: 832130 - DNA, 25 bp, Mus musculus
tgtggcttccttctactgcgaatgt

SEQ ID NO: 832131 - DNA, 25 bp, Mus musculus
tgtggcttccttgtactgcgaatgt

SEQ ID NO: 832132 - DNA, 25 bp, Mus musculus
tgtggcttctccatcgatgtgcgag

SEQ ID NO: 832133 - DNA, 25 bp, Mus musculus
tgtggcttctccttcgatgtgcgag

SEQ ID NO: 832134 - DNA, 25 bp, Mus musculus
tgtggcttctctcacatatctagta

SEQ ID NO: 832135 - DNA, 25 bp, Mus musculus
tgtggcttctctgacatatctagta

SEQ ID NO: 832136 - DNA, 25 bp, Mus musculus
tgtggcttctgaagacaatggccag

SEQ ID NO: 832137 - DNA, 25 bp, Mus musculus
tgtggcttctgatgacaatggccag

SEQ ID NO: 832138 - DNA, 25 bp, Mus musculus
tgtggcttctgcaatccggaacctc

SEQ ID NO: 832139 - DNA, 25 bp, Mus musculus
tgtggcttctgctatccggaacctc

SEQ ID NO: 832140 - DNA, 25 bp, Mus musculus
tgtggcttctggaacaacttaaagt

SEQ ID NO: 832141 - DNA, 25 bp, Mus musculus
tgtggcttctggtacaacttaaagt

SEQ ID NO: 832142 - DNA, 25 bp, Mus musculus
tgtggcttgaaacgaagccagtcct

SEQ ID NO: 832143 - DNA, 25 bp, Mus musculus
tgtggcttgaaaggaagccagtcct

SEQ ID NO: 832144 - DNA, 25 bp, Mus musculus
tgtggcttgagcaagtggctcatga

SEQ ID NO: 832145 - DNA, 25 bp, Mus musculus
tgtggcttgagctagtggctcatga

SEQ ID NO: 832146 - DNA, 25 bp, Mus musculus
tgtggcttggaaccgtcccaggttc

SEQ ID NO: 832147 - DNA, 25 bp, Mus musculus
tgtggcttggaagcgtcccaggttc

SEQ ID NO: 832148 - DNA, 25 bp, Mus musculus
tgtggcttggttcgtccctggcatt

SEQ ID NO: 832149 - DNA, 25 bp, Mus musculus
tgtggcttggttggtccctggcatt

SEQ ID NO: 832150 - DNA, 25 bp, Mus musculus
tgtggcttgtcacgagctcgactca

SEQ ID NO: 832151 - DNA, 25 bp, Mus musculus
tgtggcttgtcaggagctcgactca

SEQ ID NO: 832152 - DNA, 25 bp, Mus musculus
tgtggctttgcacaagatcaagtgc

SEQ ID NO: 832153 - DNA, 25 bp, Mus musculus
tgtggctttgcagaagatcaagtgc

SEQ ID NO: 832154 - DNA, 25 bp, Mus musculus
tgtggcttttggagcaccgatcgga

SEQ ID NO: 832155 - DNA, 25 bp, Mus musculus
tgtggcttttggtgcaccgatcgga

SEQ ID NO: 832156 - DNA, 25 bp, Mus musculus
tgtgggaacctccttatatccagag

SEQ ID NO: 832157 - DNA, 25 bp, Mus musculus
tgtgggaacctcgttatatccagag

SEQ ID NO: 832158 - DNA, 25 bp, Mus musculus
tgtgggaacgacagaagaacatggc

SEQ ID NO: 832159 - DNA, 25 bp, Mus musculus
tgtgggaacgactgaagaacatggc

SEQ ID NO: 832160 - DNA, 25 bp, Mus musculus
tgtgggaagaccagcctcctcattg

SEQ ID NO: 832161 - DNA, 25 bp, Mus musculus
tgtgggaagacctgcctcctcattg

SEQ ID NO: 832162 - DNA, 25 bp, Mus musculus
tgtgggaagcatatcacctggagcc

SEQ ID NO: 832163 - DNA, 25 bp, Mus musculus
tgtgggaagcatttcacctggagcc

SEQ ID NO: 832164 - DNA, 25 bp, Mus musculus
tgtgggaagccactccaaagtcaag

SEQ ID NO: 832165 - DNA, 25 bp, Mus musculus
tgtgggaagccagtccaaagtcaag

SEQ ID NO: 832166 - DNA, 25 bp, Mus musculus
tgtgggaaggcacttatgacacagc

SEQ ID NO: 832167 - DNA, 25 bp, Mus musculus
tgtgggaaggcagttatgacacagc

SEQ ID NO: 832168 - DNA, 25 bp, Mus musculus
tgtgggaagtacaacgccatggtgc

SEQ ID NO: 832169 - DNA, 25 bp, Mus musculus
tgtgggaagtactacgccatggtgc

SEQ ID NO: 832170 - DNA, 25 bp, Mus musculus
tgtgggaatcatccgctgtgtgcac

SEQ ID NO: 832171 - DNA, 25 bp, Mus musculus
tgtgggaatcatgcgctgtgtgcac

SEQ ID NO: 832172 - DNA, 25 bp, Mus musculus
tgtgggaatcgcagtcaccatcctg

SEQ ID NO: 832173 - DNA, 25 bp, Mus musculus
tgtgggaatcgctgtcaccatcctg

SEQ ID NO: 832174 - DNA, 25 bp, Mus musculus
tgtgggaatctcagtcacccttctg

SEQ ID NO: 832175 - DNA, 25 bp, Mus musculus
tgtgggaatctctgtcacccttctg

SEQ ID NO: 832176 - DNA, 25 bp, Mus musculus
tgtgggacaagcccaagaaagtccg

SEQ ID NO: 832177 - DNA, 25 bp, Mus musculus
tgtgggacaagcgcaagaaagtccg

SEQ ID NO: 832178 - DNA, 25 bp, Mus musculus
tgtgggacagcaattgccgtcagcg

SEQ ID NO: 832179 - DNA, 25 bp, Mus musculus
tgtgggacagcatttgccgtcagcg

SEQ ID NO: 832180 - DNA, 25 bp, Mus musculus
tgtgggacagctattcgggcagcac

SEQ ID NO: 832181 - DNA, 25 bp, Mus musculus
tgtgggacagcttttcgggcagcac

SEQ ID NO: 832182 - DNA, 25 bp, Mus musculus
tgtgggacatggcataggatcatac

SEQ ID NO: 832183 - DNA, 25 bp, Mus musculus
tgtgggacatgggataggatcatac

SEQ ID NO: 832184 - DNA, 25 bp, Mus musculus
tgtgggaccacaaactctaatgaag

SEQ ID NO: 832185 - DNA, 25 bp, Mus musculus
tgtgggaccacatactctaatgaag

SEQ ID NO: 832186 - DNA, 25 bp, Mus musculus
tgtgggacccatctgtgtatcatgc

SEQ ID NO: 832187 - DNA, 25 bp, Mus musculus
tgtgggacccatgtgtgtatcatgc

SEQ ID NO: 832188 - DNA, 25 bp, Mus musculus
tgtgggacccctcagtacttggccc

SEQ ID NO: 832189 - DNA, 25 bp, Mus musculus
tgtgggacccctgagtacttggccc

SEQ ID NO: 832190 - DNA, 25 bp, Mus musculus
tgtgggaccctaatgaactgtcagg

SEQ ID NO: 832191 - DNA, 25 bp, Mus musculus
tgtgggaccctattgaactgtcagg

SEQ ID NO: 832192 - DNA, 25 bp, Mus musculus
tgtgggaccctcaaggacagctgct

SEQ ID NO: 832193 - DNA, 25 bp, Mus musculus
tgtgggaccctctaggacagctgct

SEQ ID NO: 832194 - DNA, 25 bp, Mus musculus
tgtgggaccgaaatgcttcaacaac

SEQ ID NO: 832195 - DNA, 25 bp, Mus musculus
tgtgggaccgaattgcttcaacaac

SEQ ID NO: 832196 - DNA, 25 bp, Mus musculus
tgtgggacggaaccctcctactttt

SEQ ID NO: 832197 - DNA, 25 bp, Mus musculus
tgtgggacggaagcctcctactttt

SEQ ID NO: 832198 - DNA, 25 bp, Mus musculus
tgtgggactcacaacaatcgtggag

SEQ ID NO: 832199 - DNA, 25 bp, Mus musculus
tgtgggactcactacaatcgtggag

SEQ ID NO: 832200 - DNA, 25 bp, Mus musculus
tgtgggactgtccaatctgcagttt

SEQ ID NO: 832201 - DNA, 25 bp, Mus musculus
tgtgggactgtcgaatctgcagttt

SEQ ID NO: 832202 - DNA, 25 bp, Mus musculus
tgtgggacttagagtatgtgtgact

SEQ ID NO: 832203 - DNA, 25 bp, Mus musculus
tgtgggacttagtgtatgtgtgact

SEQ ID NO: 832204 - DNA, 25 bp, Mus musculus
tgtgggagaaccagtcgatgatccg

SEQ ID NO: 832205 - DNA, 25 bp, Mus musculus
tgtgggagaacctgtcgatgatccg

SEQ ID NO: 832206 - DNA, 25 bp, Mus musculus
tgtgggagaagaagtttacgatgat

SEQ ID NO: 832207 - DNA, 25 bp, Mus musculus
tgtgggagaagatgtttacgatgat

SEQ ID NO: 832208 - DNA, 25 bp, Mus musculus
tgtgggagagcacacgcctccctgt

SEQ ID NO: 832209 - DNA, 25 bp, Mus musculus
tgtgggagagcagacgcctccctgt

SEQ ID NO: 832210 - DNA, 25 bp, Mus musculus
tgtgggagatagataacaatccgaa

SEQ ID NO: 832211 - DNA, 25 bp, Mus musculus
tgtgggagatagttaacaatccgaa

SEQ ID NO: 832212 - DNA, 25 bp, Mus musculus
tgtgggagatgacctcacggtaacc

SEQ ID NO: 832213 - DNA, 25 bp, Mus musculus
tgtgggagatgagctcacggtaacc

SEQ ID NO: 832214 - DNA, 25 bp, Mus musculus
tgtgggagcctaacactacatgctg

SEQ ID NO: 832215 - DNA, 25 bp, Mus musculus
tgtgggagcctatcactacatgctg

SEQ ID NO: 832216 - DNA, 25 bp, Mus musculus
tgtgggagccttagggcagccttcc

SEQ ID NO: 832217 - DNA, 25 bp, Mus musculus
tgtgggagcctttgggcagccttcc

SEQ ID NO: 832218 - DNA, 25 bp, Mus musculus
tgtgggagcttccatgagtcgttct

SEQ ID NO: 832219 - DNA, 25 bp, Mus musculus
tgtgggagcttcgatgagtcgttct

SEQ ID NO: 832220 - DNA, 25 bp, Mus musculus
tgtgggaggattccctgaaaatgcc

SEQ ID NO: 832221 - DNA, 25 bp, Mus musculus
tgtgggaggattgcctgaaaatgcc

SEQ ID NO: 832222 - DNA, 25 bp, Mus musculus
tgtgggaggtctaaaccctgaagcc

SEQ ID NO: 832223 - DNA, 25 bp, Mus musculus
tgtgggaggtcttaaccctgaagcc

SEQ ID NO: 832224 - DNA, 25 bp, Mus musculus
tgtgggagtgacacaaatgattcca

SEQ ID NO: 832225 - DNA, 25 bp, Mus musculus
tgtgggagtgactcaaatgattcca

SEQ ID NO: 832226 - DNA, 25 bp, Mus musculus
tgtgggagtttaaccgagacatcct

SEQ ID NO: 832227 - DNA, 25 bp, Mus musculus
tgtgggagtttatccgagacatcct

SEQ ID NO: 832228 - DNA, 25 bp, Mus musculus
tgtgggataccaaggccgagcttcc

SEQ ID NO: 832229 - DNA, 25 bp, Mus musculus
tgtgggataccatggccgagcttcc

SEQ ID NO: 832230 - DNA, 25 bp, Mus musculus
tgtgggatccttcgcacacataaaa

SEQ ID NO: 832231 - DNA, 25 bp, Mus musculus
tgtgggatccttggcacacataaaa

SEQ ID NO: 832232 - DNA, 25 bp, Mus musculus
tgtgggattcctacggcccaggaaa

SEQ ID NO: 832233 - DNA, 25 bp, Mus musculus
tgtgggattccttcggcccaggaaa

SEQ ID NO: 832234 - DNA, 25 bp, Mus musculus
tgtgggcaacataaaatgactgtct

SEQ ID NO: 832235 - DNA, 25 bp, Mus musculus
tgtgggcaacattaaatgactgtct

SEQ ID NO: 832236 - DNA, 25 bp, Mus musculus
tgtgggcaaccaaaacctgaactca

SEQ ID NO: 832237 - DNA, 25 bp, Mus musculus
tgtgggcaaccataacctgaactca

SEQ ID NO: 832238 - DNA, 25 bp, Mus musculus
tgtgggcaagagagcgctcactatt

SEQ ID NO: 832239 - DNA, 25 bp, Mus musculus
tgtgggcaagagtgcgctcactatt

SEQ ID NO: 832240 - DNA, 25 bp, Mus musculus
tgtgggcacaaaaactaccatccgc

SEQ ID NO: 832241 - DNA, 25 bp, Mus musculus
tgtgggcacaaatactaccatccgc

SEQ ID NO: 832242 - DNA, 25 bp, Mus musculus
tgtgggcacacaagctggagtccca

SEQ ID NO: 832243 - DNA, 25 bp, Mus musculus
tgtgggcacacatgctggagtccca

SEQ ID NO: 832244 - DNA, 25 bp, Mus musculus
tgtgggcacataccagcccgagcct

SEQ ID NO: 832245 - DNA, 25 bp, Mus musculus
tgtgggcacatagcagcccgagcct

SEQ ID NO: 832246 - DNA, 25 bp, Mus musculus
tgtgggcaccaactatcgaagcgag

SEQ ID NO: 832247 - DNA, 25 bp, Mus musculus
tgtgggcaccaagtatcgaagcgag

SEQ ID NO: 832248 - DNA, 25 bp, Mus musculus
tgtgggcaccgcatccatgtactgg

SEQ ID NO: 832249 - DNA, 25 bp, Mus musculus
tgtgggcaccgcttccatgtactgg

SEQ ID NO: 832250 - DNA, 25 bp, Mus musculus
tgtgggcactctcagccccagtatg

SEQ ID NO: 832251 - DNA, 25 bp, Mus musculus
tgtgggcactctgagccccagtatg

SEQ ID NO: 832252 - DNA, 25 bp, Mus musculus
tgtgggcagaagcttaacagaatcc

SEQ ID NO: 832253 - DNA, 25 bp, Mus musculus
tgtgggcagaaggttaacagaatcc

SEQ ID NO: 832254 - DNA, 25 bp, Mus musculus
tgtgggcagccactcaagcacaaag

SEQ ID NO: 832255 - DNA, 25 bp, Mus musculus
tgtgggcagccagtcaagcacaaag

SEQ ID NO: 832256 - DNA, 25 bp, Mus musculus
tgtgggcagtgccagatgaatttcc

SEQ ID NO: 832257 - DNA, 25 bp, Mus musculus
tgtgggcagtgcgagatgaatttcc

SEQ ID NO: 832258 - DNA, 25 bp, Mus musculus
tgtgggcatcaacgcccggcaacct

SEQ ID NO: 832259 - DNA, 25 bp, Mus musculus
tgtgggcatcaaggcccggcaacct

SEQ ID NO: 832260 - DNA, 25 bp, Mus musculus
tgtgggcatccgcagctcgtacatc

SEQ ID NO: 832261 - DNA, 25 bp, Mus musculus
tgtgggcatccggagctcgtacatc

SEQ ID NO: 832262 - DNA, 25 bp, Mus musculus
tgtgggcatggcagacaaatctgtc

SEQ ID NO: 832263 - DNA, 25 bp, Mus musculus
tgtgggcatggctgacaaatctgtc

SEQ ID NO: 832264 - DNA, 25 bp, Mus musculus
tgtgggcatgtccaagagcttccgc

SEQ ID NO: 832265 - DNA, 25 bp, Mus musculus
tgtgggcatgtcgaagagcttccgc

SEQ ID NO: 832266 - DNA, 25 bp, Mus musculus
tgtgggccagcaacccaaatcgttc

SEQ ID NO: 832267 - DNA, 25 bp, Mus musculus
tgtgggccagcatcccaaatcgttc

SEQ ID NO: 832268 - DNA, 25 bp, Mus musculus
tgtgggccaggtcaaaacgcaaccc

SEQ ID NO: 832269 - DNA, 25 bp, Mus musculus
tgtgggccaggtgaaaacgcaaccc

SEQ ID NO: 832270 - DNA, 25 bp, Mus musculus
tgtgggccccttcacacatggcaaa

SEQ ID NO: 832271 - DNA, 25 bp, Mus musculus
tgtgggccccttgacacatggcaaa

SEQ ID NO: 832272 - DNA, 25 bp, Mus musculus
tgtgggccctaaaaagtacgtctga

SEQ ID NO: 832273 - DNA, 25 bp, Mus musculus
tgtgggccctaataagtacgtctga

SEQ ID NO: 832274 - DNA, 25 bp, Mus musculus
tgtgggccctgaacaaaaggtcaag

SEQ ID NO: 832275 - DNA, 25 bp, Mus musculus
tgtgggccctgatcaaaaggtcaag

SEQ ID NO: 832276 - DNA, 25 bp, Mus musculus
tgtgggcccttcagacccctactga

SEQ ID NO: 832277 - DNA, 25 bp, Mus musculus
tgtgggcccttctgacccctactga

SEQ ID NO: 832278 - DNA, 25 bp, Mus musculus
tgtgggccgaaaccgagaagcacta

SEQ ID NO: 832279 - DNA, 25 bp, Mus musculus
tgtgggccgaaagcgagaagcacta

SEQ ID NO: 832280 - DNA, 25 bp, Mus musculus
tgtgggccgaagctgaccaactccc

SEQ ID NO: 832281 - DNA, 25 bp, Mus musculus
tgtgggccgaaggtgaccaactccc

SEQ ID NO: 832282 - DNA, 25 bp, Mus musculus
tgtgggccgcacagctgagaaactg

SEQ ID NO: 832283 - DNA, 25 bp, Mus musculus
tgtgggccgcactgctgagaaactg

SEQ ID NO: 832284 - DNA, 25 bp, Mus musculus
tgtgggccgcatcttcaaacagttc

SEQ ID NO: 832285 - DNA, 25 bp, Mus musculus
tgtgggccgcatgttcaaacagttc

SEQ ID NO: 832286 - DNA, 25 bp, Mus musculus
tgtgggccgctccttccgaggcttt

SEQ ID NO: 832287 - DNA, 25 bp, Mus musculus
tgtgggccgctcgttccgaggcttt

SEQ ID NO: 832288 - DNA, 25 bp, Mus musculus
tgtgggccgtgcagttggtcacatt

SEQ ID NO: 832289 - DNA, 25 bp, Mus musculus
tgtgggccgtgctgttggtcacatt

SEQ ID NO: 832290 - DNA, 25 bp, Mus musculus
tgtgggcgaacaatgtccccgtggc

SEQ ID NO: 832291 - DNA, 25 bp, Mus musculus
tgtgggcgaacattgtccccgtggc

SEQ ID NO: 832292 - DNA, 25 bp, Mus musculus
tgtgggctagtcacctctgctggtc

SEQ ID NO: 832293 - DNA, 25 bp, Mus musculus
tgtgggctagtctcctctgctggtc

SEQ ID NO: 832294 - DNA, 25 bp, Mus musculus
tgtgggctccatagagtacctcaag

SEQ ID NO: 832295 - DNA, 25 bp, Mus musculus
tgtgggctccattgagtacctcaag

SEQ ID NO: 832296 - DNA, 25 bp, Mus musculus
tgtgggctccctcaagaagtttctc

SEQ ID NO: 832297 - DNA, 25 bp, Mus musculus
tgtgggctccctgaagaagtttctc

SEQ ID NO: 832298 - DNA, 25 bp, Mus musculus
tgtgggctcttcacccacacaattt

SEQ ID NO: 832299 - DNA, 25 bp, Mus musculus
tgtgggctcttctcccacacaattt

SEQ ID NO: 832300 - DNA, 25 bp, Mus musculus
tgtgggctgaaaacccaagctgcgg

SEQ ID NO: 832301 - DNA, 25 bp, Mus musculus
tgtgggctgaaatcccaagctgcgg

SEQ ID NO: 832302 - DNA, 25 bp, Mus musculus
tgtgggctgcagatgggtctcctcc

SEQ ID NO: 832303 - DNA, 25 bp, Mus musculus
tgtgggctgcagttgggtctcctcc

SEQ ID NO: 832304 - DNA, 25 bp, Mus musculus
tgtgggctgtacaacaagcttcata

SEQ ID NO: 832305 - DNA, 25 bp, Mus musculus
tgtgggctgtactacaagcttcata

SEQ ID NO: 832306 - DNA, 25 bp, Mus musculus
tgtgggctgtccaattccactctca

SEQ ID NO: 832307 - DNA, 25 bp, Mus musculus
tgtgggctgtcctattccactctca

SEQ ID NO: 832308 - DNA, 25 bp, Mus musculus
tgtgggcttccacactcacctggag

SEQ ID NO: 832309 - DNA, 25 bp, Mus musculus
tgtgggcttccagactcacctggag

SEQ ID NO: 832310 - DNA, 25 bp, Mus musculus
tgtggggtcaccagacatggttgcc

SEQ ID NO: 832311 - DNA, 25 bp, Mus musculus
tgtggggtcacctgacatggttgcc

SEQ ID NO: 832312 - DNA, 25 bp, Mus musculus
tgtgggtaccaactctagacgcggc

SEQ ID NO: 832313 - DNA, 25 bp, Mus musculus
tgtgggtaccaagtctagacgcggc

SEQ ID NO: 832314 - DNA, 25 bp, Mus musculus
tgtgggtaccagcaactgaaccttc

SEQ ID NO: 832315 - DNA, 25 bp, Mus musculus
tgtgggtaccaggaactgaaccttc

SEQ ID NO: 832316 - DNA, 25 bp, Mus musculus
tgtgggtaccttcatttccagagag

SEQ ID NO: 832317 - DNA, 25 bp, Mus musculus
tgtgggtaccttgatttccagagag

SEQ ID NO: 832318 - DNA, 25 bp, Mus musculus
tgtgggtagcaaaaatttgaacctt

SEQ ID NO: 832319 - DNA, 25 bp, Mus musculus
tgtgggtagcaataatttgaacctt

SEQ ID NO: 832320 - DNA, 25 bp, Mus musculus
tgtgggtatttacttacgttggtgc

SEQ ID NO: 832321 - DNA, 25 bp, Mus musculus
tgtgggtatttagttacgttggtgc

SEQ ID NO: 832322 - DNA, 25 bp, Mus musculus
tgtgggtcacggaatgaaaatgaga

SEQ ID NO: 832323 - DNA, 25 bp, Mus musculus
tgtgggtcacggtatgaaaatgaga

SEQ ID NO: 832324 - DNA, 25 bp, Mus musculus
tgtgggtcagctcagtacatggccc

SEQ ID NO: 832325 - DNA, 25 bp, Mus musculus
tgtgggtcagctgagtacatggccc

SEQ ID NO: 832326 - DNA, 25 bp, Mus musculus
tgtgggtcattcacaaggctgcacc

SEQ ID NO: 832327 - DNA, 25 bp, Mus musculus
tgtgggtcattctcaaggctgcacc

SEQ ID NO: 832328 - DNA, 25 bp, Mus musculus
tgtgggtccctcaggtctggcacaa

SEQ ID NO: 832329 - DNA, 25 bp, Mus musculus
tgtgggtccctctggtctggcacaa

SEQ ID NO: 832330 - DNA, 25 bp, Mus musculus
tgtgggtcggtgacagagcaacctt

SEQ ID NO: 832331 - DNA, 25 bp, Mus musculus
tgtgggtcggtgtcagagcaacctt

SEQ ID NO: 832332 - DNA, 25 bp, Mus musculus
tgtgggtctgcgaacatgcagttct

SEQ ID NO: 832333 - DNA, 25 bp, Mus musculus
tgtgggtctgcgtacatgcagttct

SEQ ID NO: 832334 - DNA, 25 bp, Mus musculus
tgtgggtctttgctcttgcttttgg

SEQ ID NO: 832335 - DNA, 25 bp, Mus musculus
tgtgggtctttggtcttgcttttgg

SEQ ID NO: 832336 - DNA, 25 bp, Mus musculus
tgtgggtgagaaccttctacctgga

SEQ ID NO: 832337 - DNA, 25 bp, Mus musculus
tgtgggtgagaagcttctacctgga

SEQ ID NO: 832338 - DNA, 25 bp, Mus musculus
tgtgggtgatacctccctgaggata

SEQ ID NO: 832339 - DNA, 25 bp, Mus musculus
tgtgggtgatacgtccctgaggata

SEQ ID NO: 832340 - DNA, 25 bp, Mus musculus
tgtgggtgcagtcgtgaccatcatc

SEQ ID NO: 832341 - DNA, 25 bp, Mus musculus
tgtgggtgcagtggtgaccatcatc

SEQ ID NO: 832342 - DNA, 25 bp, Mus musculus
tgtgggtgccatcgtctccagcaac

SEQ ID NO: 832343 - DNA, 25 bp, Mus musculus
tgtgggtgccatggtctccagcaac

SEQ ID NO: 832344 - DNA, 25 bp, Mus musculus
tgtgggtgcccaacatgatgtccta

SEQ ID NO: 832345 - DNA, 25 bp, Mus musculus
tgtgggtgcccatcatgatgtccta

SEQ ID NO: 832346 - DNA, 25 bp, Mus musculus
tgtgggtggccaagcctagaagaca

SEQ ID NO: 832347 - DNA, 25 bp, Mus musculus
tgtgggtggccatgcctagaagaca

SEQ ID NO: 832348 - DNA, 25 bp, Mus musculus
tgtgggtgggcgcaggagccagtga

SEQ ID NO: 832349 - DNA, 25 bp, Mus musculus
tgtgggtgggcggaggagccagtga

SEQ ID NO: 832350 - DNA, 25 bp, Mus musculus
tgtgggtgggtaaaggacctacact

SEQ ID NO: 832351 - DNA, 25 bp, Mus musculus
tgtgggtgggtataggacctacact

SEQ ID NO: 832352 - DNA, 25 bp, Mus musculus
tgtgggtgtaccctttcctggaaca

SEQ ID NO: 832353 - DNA, 25 bp, Mus musculus
tgtgggtgtaccgtttcctggaaca

SEQ ID NO: 832354 - DNA, 25 bp, Mus musculus
tgtgggtgtcacatatagagaaagc

SEQ ID NO: 832355 - DNA, 25 bp, Mus musculus
tgtgggtgtcacttatagagaaagc

SEQ ID NO: 832356 - DNA, 25 bp, Mus musculus
tgtgggttccctagagactctggta

SEQ ID NO: 832357 - DNA, 25 bp, Mus musculus
tgtgggttcccttgagactctggta

SEQ ID NO: 832358 - DNA, 25 bp, Mus musculus
tgtgggttgggcaacgacttctcaa

SEQ ID NO: 832359 - DNA, 25 bp, Mus musculus
tgtgggttgggctacgacttctcaa

SEQ ID NO: 832360 - DNA, 25 bp, Mus musculus
tgtgggttgtgaaaatgttctatag

SEQ ID NO: 832361 - DNA, 25 bp, Mus musculus
tgtgggttgtgataatgttctatag

SEQ ID NO: 832362 - DNA, 25 bp, Mus musculus
tgtgggtttaccctccagcctgtca

SEQ ID NO: 832363 - DNA, 25 bp, Mus musculus
tgtgggtttaccgtccagcctgtca

SEQ ID NO: 832364 - DNA, 25 bp, Mus musculus
tgtgggtttgatcactatgagcccg

SEQ ID NO: 832365 - DNA, 25 bp, Mus musculus
tgtgggtttgatgactatgagcccg

SEQ ID NO: 832366 - DNA, 25 bp, Mus musculus
tgtggtaaaccaactggcggcagcc

SEQ ID NO: 832367 - DNA, 25 bp, Mus musculus
tgtggtaaaccatctggcggcagcc

SEQ ID NO: 832368 - DNA, 25 bp, Mus musculus
tgtggtaaactgaaactgggcaacc

SEQ ID NO: 832369 - DNA, 25 bp, Mus musculus
tgtggtaaactgtaactgggcaacc

SEQ ID NO: 832370 - DNA, 25 bp, Mus musculus
tgtggtaacactagggagcctggcc

SEQ ID NO: 832371 - DNA, 25 bp, Mus musculus
tgtggtaacacttgggagcctggcc

SEQ ID NO: 832372 - DNA, 25 bp, Mus musculus
tgtggtaagcgacatccggagaaca

SEQ ID NO: 832373 - DNA, 25 bp, Mus musculus
tgtggtaagcgagatccggagaaca

SEQ ID NO: 832374 - DNA, 25 bp, Mus musculus
tgtggtaatagtctcatcggctgcc

SEQ ID NO: 832375 - DNA, 25 bp, Mus musculus
tgtggtaatagtgtcatcggctgcc

SEQ ID NO: 832376 - DNA, 25 bp, Mus musculus
tgtggtacagacctccagatgttct

SEQ ID NO: 832377 - DNA, 25 bp, Mus musculus
tgtggtacagacgtccagatgttct

SEQ ID NO: 832378 - DNA, 25 bp, Mus musculus
tgtggtacagttaaaagatacagac

SEQ ID NO: 832379 - DNA, 25 bp, Mus musculus
tgtggtacagtttaaagatacagac

SEQ ID NO: 832380 - DNA, 25 bp, Mus musculus
tgtggtacccgacgttgagagccta

SEQ ID NO: 832381 - DNA, 25 bp, Mus musculus
tgtggtacccgaggttgagagccta

SEQ ID NO: 832382 - DNA, 25 bp, Mus musculus
tgtggtacctacagctacctgggca

SEQ ID NO: 832383 - DNA, 25 bp, Mus musculus
tgtggtacctactgctacctgggca

SEQ ID NO: 832384 - DNA, 25 bp, Mus musculus
tgtggtacgttcattctgataagac

SEQ ID NO: 832385 - DNA, 25 bp, Mus musculus
tgtggtacgttctttctgataagac

SEQ ID NO: 832386 - DNA, 25 bp, Mus musculus
tgtggtactagcaccgtggaccctg

SEQ ID NO: 832387 - DNA, 25 bp, Mus musculus
tgtggtactagctccgtggaccctg

SEQ ID NO: 832388 - DNA, 25 bp, Mus musculus
tgtggtagaacgatccaaggacttc

SEQ ID NO: 832389 - DNA, 25 bp, Mus musculus
tgtggtagaacgttccaaggacttc

SEQ ID NO: 832390 - DNA, 25 bp, Mus musculus
tgtggtagacaaagataagaggaac

SEQ ID NO: 832391 - DNA, 25 bp, Mus musculus
tgtggtagacaatgataagaggaac

SEQ ID NO: 832392 - DNA, 25 bp, Mus musculus
tgtggtagacacagctcatggtaaa

SEQ ID NO: 832393 - DNA, 25 bp, Mus musculus
tgtggtagacactgctcatggtaaa

SEQ ID NO: 832394 - DNA, 25 bp, Mus musculus
tgtggtagacctaaagaagaatctg

SEQ ID NO: 832395 - DNA, 25 bp, Mus musculus
tgtggtagaccttaagaagaatctg

SEQ ID NO: 832396 - DNA, 25 bp, Mus musculus
tgtggtagatgtaaacctgtttgga

SEQ ID NO: 832397 - DNA, 25 bp, Mus musculus
tgtggtagatgttaacctgtttgga

SEQ ID NO: 832398 - DNA, 25 bp, Mus musculus
tgtggtagccctcgtaggcattgcc

SEQ ID NO: 832399 - DNA, 25 bp, Mus musculus
tgtggtagccctggtaggcattgcc

SEQ ID NO: 832400 - DNA, 25 bp, Mus musculus
tgtggtagctatcgacaacaaaata

SEQ ID NO: 832401 - DNA, 25 bp, Mus musculus
tgtggtagctatggacaacaaaata

SEQ ID NO: 832402 - DNA, 25 bp, Mus musculus
tgtggtagctgaaacccaagagtac

SEQ ID NO: 832403 - DNA, 25 bp, Mus musculus
tgtggtagctgatacccaagagtac

SEQ ID NO: 832404 - DNA, 25 bp, Mus musculus
tgtggtagtccactgcacaggctac

SEQ ID NO: 832405 - DNA, 25 bp, Mus musculus
tgtggtagtccagtgcacaggctac

SEQ ID NO: 832406 - DNA, 25 bp, Mus musculus
tgtggtataacacaccttcatctag

SEQ ID NO: 832407 - DNA, 25 bp, Mus musculus
tgtggtataacagaccttcatctag

SEQ ID NO: 832408 - DNA, 25 bp, Mus musculus
tgtggtatcaaccaaaagctcttgg

SEQ ID NO: 832409 - DNA, 25 bp, Mus musculus
tgtggtatcaacgaaaagctcttgg

SEQ ID NO: 832410 - DNA, 25 bp, Mus musculus
tgtggtatctctagtagccgtccac

SEQ ID NO: 832411 - DNA, 25 bp, Mus musculus
tgtggtatctcttgtagccgtccac

SEQ ID NO: 832412 - DNA, 25 bp, Mus musculus
tgtggtatgccgaagatttacaggc

SEQ ID NO: 832413 - DNA, 25 bp, Mus musculus
tgtggtatgccgtagatttacaggc

SEQ ID NO: 832414 - DNA, 25 bp, Mus musculus
tgtggtatgctaactggccctctcc

SEQ ID NO: 832415 - DNA, 25 bp, Mus musculus
tgtggtatgctatctggccctctcc

SEQ ID NO: 832416 - DNA, 25 bp, Mus musculus
tgtggtcaaaccagcattgctcctg

SEQ ID NO: 832417 - DNA, 25 bp, Mus musculus
tgtggtcaaacctgcattgctcctg

SEQ ID NO: 832418 - DNA, 25 bp, Mus musculus
tgtggtcaaattctcagttcctagc

SEQ ID NO: 832419 - DNA, 25 bp, Mus musculus
tgtggtcaaattgtcagttcctagc

SEQ ID NO: 832420 - DNA, 25 bp, Mus musculus
tgtggtcaacaaccacagagtctct

SEQ ID NO: 832421 - DNA, 25 bp, Mus musculus
tgtggtcaacaagcacagagtctct

SEQ ID NO: 832422 - DNA, 25 bp, Mus musculus
tgtggtcaacacactaggactgatc

SEQ ID NO: 832423 - DNA, 25 bp, Mus musculus
tgtggtcaacactctaggactgatc

SEQ ID NO: 832424 - DNA, 25 bp, Mus musculus
tgtggtcaagaacagcatgacgtcc

SEQ ID NO: 832425 - DNA, 25 bp, Mus musculus
tgtggtcaagaagagcatgacgtcc

SEQ ID NO: 832426 - DNA, 25 bp, Mus musculus
tgtggtcaagctattgctttaggac

SEQ ID NO: 832427 - DNA, 25 bp, Mus musculus
tgtggtcaagcttttgctttaggac

SEQ ID NO: 832428 - DNA, 25 bp, Mus musculus
tgtggtcaatggagtctgaagatgc

SEQ ID NO: 832429 - DNA, 25 bp, Mus musculus
tgtggtcaatggtgtctgaagatgc

SEQ ID NO: 832430 - DNA, 25 bp, Mus musculus
tgtggtcaccgcatcagctaccagg

SEQ ID NO: 832431 - DNA, 25 bp, Mus musculus
tgtggtcaccgcttcagctaccagg

SEQ ID NO: 832432 - DNA, 25 bp, Mus musculus
tgtggtcactgtaagaacgattgag

SEQ ID NO: 832433 - DNA, 25 bp, Mus musculus
tgtggtcactgttagaacgattgag

SEQ ID NO: 832434 - DNA, 25 bp, Mus musculus
tgtggtcagacaacttcatggattt

SEQ ID NO: 832435 - DNA, 25 bp, Mus musculus
tgtggtcagacatcttcatggattt

SEQ ID NO: 832436 - DNA, 25 bp, Mus musculus
tgtggtcagcacctttcccatgggc

SEQ ID NO: 832437 - DNA, 25 bp, Mus musculus
tgtggtcagcacgtttcccatgggc

SEQ ID NO: 832438 - DNA, 25 bp, Mus musculus
tgtggtcaggctccccttgaatgct

SEQ ID NO: 832439 - DNA, 25 bp, Mus musculus
tgtggtcaggctgcccttgaatgct

SEQ ID NO: 832440 - DNA, 25 bp, Mus musculus
tgtggtcataaaaacaaacgtgggc

SEQ ID NO: 832441 - DNA, 25 bp, Mus musculus
tgtggtcataaatacaaacgtgggc

SEQ ID NO: 832442 - DNA, 25 bp, Mus musculus
tgtggtcattttcagcaggacagct

SEQ ID NO: 832443 - DNA, 25 bp, Mus musculus
tgtggtcattttgagcaggacagct

SEQ ID NO: 832444 - DNA, 25 bp, Mus musculus
tgtggtccacgacggaatggcatat

SEQ ID NO: 832445 - DNA, 25 bp, Mus musculus
tgtggtccacgagggaatggcatat

SEQ ID NO: 832446 - DNA, 25 bp, Mus musculus
tgtggtccagatcccaccaatagcc

SEQ ID NO: 832447 - DNA, 25 bp, Mus musculus
tgtggtccagatgccaccaatagcc

SEQ ID NO: 832448 - DNA, 25 bp, Mus musculus
tgtggtccagcacgaaagactgatg

SEQ ID NO: 832449 - DNA, 25 bp, Mus musculus
tgtggtccagcaggaaagactgatg

SEQ ID NO: 832450 - DNA, 25 bp, Mus musculus
tgtggtccatcactaaaaaacaact

SEQ ID NO: 832451 - DNA, 25 bp, Mus musculus
tgtggtccatcagtaaaaaacaact

SEQ ID NO: 832452 - DNA, 25 bp, Mus musculus
tgtggtccatggaaaaagcttgatg

SEQ ID NO: 832453 - DNA, 25 bp, Mus musculus
tgtggtccatggtaaaagcttgatg

SEQ ID NO: 832454 - DNA, 25 bp, Mus musculus
tgtggtccattgacgctcgttccgg

SEQ ID NO: 832455 - DNA, 25 bp, Mus musculus
tgtggtccattgtcgctcgttccgg

SEQ ID NO: 832456 - DNA, 25 bp, Mus musculus
tgtggtccctacaatggctcaaggc

SEQ ID NO: 832457 - DNA, 25 bp, Mus musculus
tgtggtccctactatggctcaaggc

SEQ ID NO: 832458 - DNA, 25 bp, Mus musculus
tgtggtcccttcaccgacttgcttg

SEQ ID NO: 832459 - DNA, 25 bp, Mus musculus
tgtggtcccttctccgacttgcttg

SEQ ID NO: 832460 - DNA, 25 bp, Mus musculus
tgtggtccggaacatcctgcgtccc

SEQ ID NO: 832461 - DNA, 25 bp, Mus musculus
tgtggtccggaagatcctgcgtccc

SEQ ID NO: 832462 - DNA, 25 bp, Mus musculus
tgtggtcctcgacggttctatggca

SEQ ID NO: 832463 - DNA, 25 bp, Mus musculus
tgtggtcctcgagggttctatggca

SEQ ID NO: 832464 - DNA, 25 bp, Mus musculus
tgtggtcctgagacacttcagtact

SEQ ID NO: 832465 - DNA, 25 bp, Mus musculus
tgtggtcctgagtcacttcagtact

SEQ ID NO: 832466 - DNA, 25 bp, Mus musculus
tgtggtcctggcagaccctaggcaa

SEQ ID NO: 832467 - DNA, 25 bp, Mus musculus
tgtggtcctggctgaccctaggcaa

SEQ ID NO: 832468 - DNA, 25 bp, Mus musculus
tgtggtcctgtgcactacagtccag

SEQ ID NO: 832469 - DNA, 25 bp, Mus musculus
tgtggtcctgtggactacagtccag

SEQ ID NO: 832470 - DNA, 25 bp, Mus musculus
tgtggtccttaacctgctcatggca

SEQ ID NO: 832471 - DNA, 25 bp, Mus musculus
tgtggtccttaagctgctcatggca

SEQ ID NO: 832472 - DNA, 25 bp, Mus musculus
tgtggtccttccagatcaggctgtg

SEQ ID NO: 832473 - DNA, 25 bp, Mus musculus
tgtggtccttcctgatcaggctgtg

SEQ ID NO: 832474 - DNA, 25 bp, Mus musculus
tgtggtcgaatcagggcattggcct

SEQ ID NO: 832475 - DNA, 25 bp, Mus musculus
tgtggtcgaatctgggcattggcct

SEQ ID NO: 832476 - DNA, 25 bp, Mus musculus
tgtggtcgtgttacctttcccagac

SEQ ID NO: 832477 - DNA, 25 bp, Mus musculus
tgtggtcgtgtttcctttcccagac

SEQ ID NO: 832478 - DNA, 25 bp, Mus musculus
tgtggtctacctcaacccagaagaa

SEQ ID NO: 832479 - DNA, 25 bp, Mus musculus
tgtggtctacctgaacccagaagaa

SEQ ID NO: 832480 - DNA, 25 bp, Mus musculus
tgtggtctacgaattgtttctcatc

SEQ ID NO: 832481 - DNA, 25 bp, Mus musculus
tgtggtctacgatttgtttctcatc

SEQ ID NO: 832482 - DNA, 25 bp, Mus musculus
tgtggtctatgacacgttcatgctg

SEQ ID NO: 832483 - DNA, 25 bp, Mus musculus
tgtggtctatgagacgttcatgctg

SEQ ID NO: 832484 - DNA, 25 bp, Mus musculus
tgtggtctatggcagcagcatgttc

SEQ ID NO: 832485 - DNA, 25 bp, Mus musculus
tgtggtctatgggagcagcatgttc

SEQ ID NO: 832486 - DNA, 25 bp, Mus musculus
tgtggtctcggcagttaaggaagca

SEQ ID NO: 832487 - DNA, 25 bp, Mus musculus
tgtggtctcggctgttaaggaagca

SEQ ID NO: 832488 - DNA, 25 bp, Mus musculus
tgtggtctcttacctcatcctggct

SEQ ID NO: 832489 - DNA, 25 bp, Mus musculus
tgtggtctcttagctcatcctggct

SEQ ID NO: 832490 - DNA, 25 bp, Mus musculus
tgtggtctgcttcagtgacttcgag

SEQ ID NO: 832491 - DNA, 25 bp, Mus musculus
tgtggtctgcttgagtgacttcgag

SEQ ID NO: 832492 - DNA, 25 bp, Mus musculus
tgtggtcttcaacatcctgcggcgc

SEQ ID NO: 832493 - DNA, 25 bp, Mus musculus
tgtggtcttcaagatcctgcggcgc

SEQ ID NO: 832494 - DNA, 25 bp, Mus musculus
tgtggtcttcagcatcgatggttct

SEQ ID NO: 832495 - DNA, 25 bp, Mus musculus
tgtggtcttcaggatcgatggttct

SEQ ID NO: 832496 - DNA, 25 bp, Mus musculus
tgtggtcttccaagccaaggaggtc

SEQ ID NO: 832497 - DNA, 25 bp, Mus musculus
tgtggtcttccatgccaaggaggtc

SEQ ID NO: 832498 - DNA, 25 bp, Mus musculus
tgtggtcttcgaagaagctcacaac

SEQ ID NO: 832499 - DNA, 25 bp, Mus musculus
tgtggtcttcgatgaagctcacaac

SEQ ID NO: 832500 - DNA, 25 bp, Mus musculus
tgtggtcttcttcctgcccaggaga

SEQ ID NO: 832501 - DNA, 25 bp, Mus musculus
tgtggtcttcttgctgcccaggaga

SEQ ID NO: 832502 - DNA, 25 bp, Mus musculus
tgtggtcttgtcatccagattcgta

SEQ ID NO: 832503 - DNA, 25 bp, Mus musculus
tgtggtcttgtcttccagattcgta

SEQ ID NO: 832504 - DNA, 25 bp, Mus musculus
tgtggtctttggaaccataatgtta

SEQ ID NO: 832505 - DNA, 25 bp, Mus musculus
tgtggtctttggtaccataatgtta

SEQ ID NO: 832506 - DNA, 25 bp, Mus musculus
tgtggtgaaattagaacccaccgcc

SEQ ID NO: 832507 - DNA, 25 bp, Mus musculus
tgtggtgaaatttgaacccaccgcc

SEQ ID NO: 832508 - DNA, 25 bp, Mus musculus
tgtggtgaacgacacaatagccttt

SEQ ID NO: 832509 - DNA, 25 bp, Mus musculus
tgtggtgaacgagacaatagccttt

SEQ ID NO: 832510 - DNA, 25 bp, Mus musculus
tgtggtgaagacaatatctgtgtgc

SEQ ID NO: 832511 - DNA, 25 bp, Mus musculus
tgtggtgaagactatatctgtgtgc

SEQ ID NO: 832512 - DNA, 25 bp, Mus musculus
tgtggtgacagtccttgatctcttc

SEQ ID NO: 832513 - DNA, 25 bp, Mus musculus
tgtggtgacagtgcttgatctcttc

SEQ ID NO: 832514 - DNA, 25 bp, Mus musculus
tgtggtgaccaaagccaaacggacc

SEQ ID NO: 832515 - DNA, 25 bp, Mus musculus
tgtggtgaccaatgccaaacggacc

SEQ ID NO: 832516 - DNA, 25 bp, Mus musculus
tgtggtgaccagcaccacggagccc

SEQ ID NO: 832517 - DNA, 25 bp, Mus musculus
tgtggtgaccaggaccacggagccc

SEQ ID NO: 832518 - DNA, 25 bp, Mus musculus
tgtggtgacgacaaccatggctgga

SEQ ID NO: 832519 - DNA, 25 bp, Mus musculus
tgtggtgacgactaccatggctgga

SEQ ID NO: 832520 - DNA, 25 bp, Mus musculus
tgtggtgacgcgatattacagagcc

SEQ ID NO: 832521 - DNA, 25 bp, Mus musculus
tgtggtgacgcgttattacagagcc

SEQ ID NO: 832522 - DNA, 25 bp, Mus musculus
tgtggtgactcgctactacagagca

SEQ ID NO: 832523 - DNA, 25 bp, Mus musculus
tgtggtgactcggtactacagagca

SEQ ID NO: 832524 - DNA, 25 bp, Mus musculus
tgtggtgaggtcagcactactgcct

SEQ ID NO: 832525 - DNA, 25 bp, Mus musculus
tgtggtgaggtctgcactactgcct

SEQ ID NO: 832526 - DNA, 25 bp, Mus musculus
tgtggtgatgctcagcgctgcccat

SEQ ID NO: 832527 - DNA, 25 bp, Mus musculus
tgtggtgatgctgagcgctgcccat

SEQ ID NO: 832528 - DNA, 25 bp, Mus musculus
tgtggtgattgaaggcatgcctccg

SEQ ID NO: 832529 - DNA, 25 bp, Mus musculus
tgtggtgattgatggcatgcctccg

SEQ ID NO: 832530 - DNA, 25 bp, Mus musculus
tgtggtgcacagacggtatatgcag

SEQ ID NO: 832531 - DNA, 25 bp, Mus musculus
tgtggtgcacagtcggtatatgcag

SEQ ID NO: 832532 - DNA, 25 bp, Mus musculus
tgtggtgcagccatggccatgcaaa

SEQ ID NO: 832533 - DNA, 25 bp, Mus musculus
tgtggtgcagccttggccatgcaaa

SEQ ID NO: 832534 - DNA, 25 bp, Mus musculus
tgtggtgcatctacataggcctggg

SEQ ID NO: 832535 - DNA, 25 bp, Mus musculus
tgtggtgcatcttcataggcctggg

SEQ ID NO: 832536 - DNA, 25 bp, Mus musculus
tgtggtgcctggactgtccaccatg

SEQ ID NO: 832537 - DNA, 25 bp, Mus musculus
tgtggtgcctggtctgtccaccatg

SEQ ID NO: 832538 - DNA, 25 bp, Mus musculus
tgtggtgccttcagacaagggcaac

SEQ ID NO: 832539 - DNA, 25 bp, Mus musculus
tgtggtgccttctgacaagggcaac

SEQ ID NO: 832540 - DNA, 25 bp, Mus musculus
tgtggtgcgcatcggaatctacacg

SEQ ID NO: 832541 - DNA, 25 bp, Mus musculus
tgtggtgcgcatgggaatctacacg

SEQ ID NO: 832542 - DNA, 25 bp, Mus musculus
tgtggtgctctcatcagctacctaa

SEQ ID NO: 832543 - DNA, 25 bp, Mus musculus
tgtggtgctctcttcagctacctaa

SEQ ID NO: 832544 - DNA, 25 bp, Mus musculus
tgtggtgcttgtagcctgacgccct

SEQ ID NO: 832545 - DNA, 25 bp, Mus musculus
tgtggtgcttgttgcctgacgccct

SEQ ID NO: 832546 - DNA, 25 bp, Mus musculus
tgtggtggacaccacacaaggcaaa

SEQ ID NO: 832547 - DNA, 25 bp, Mus musculus
tgtggtggacacgacacaaggcaaa

SEQ ID NO: 832548 - DNA, 25 bp, Mus musculus
tgtggtggacttatgacagatctag

SEQ ID NO: 832549 - DNA, 25 bp, Mus musculus
tgtggtggacttttgacagatctag

SEQ ID NO: 832550 - DNA, 25 bp, Mus musculus
tgtggtggagcccatgccagtgcct

SEQ ID NO: 832551 - DNA, 25 bp, Mus musculus
tgtggtggagccgatgccagtgcct

SEQ ID NO: 832552 - DNA, 25 bp, Mus musculus
tgtggtggcaccctgatccacccga

SEQ ID NO: 832553 - DNA, 25 bp, Mus musculus
tgtggtggcacccttgacttccact

SEQ ID NO: 832554 - DNA, 25 bp, Mus musculus
tgtggtggcaccgtgatccacccga

SEQ ID NO: 832555 - DNA, 25 bp, Mus musculus
tgtggtggcaccgttgacttccact

SEQ ID NO: 832556 - DNA, 25 bp, Mus musculus
tgtggtggccacacagtgaagccat

SEQ ID NO: 832557 - DNA, 25 bp, Mus musculus
tgtggtggccactcagtgaagccat

SEQ ID NO: 832558 - DNA, 25 bp, Mus musculus
tgtggtggccctagacaacaagatt

SEQ ID NO: 832559 - DNA, 25 bp, Mus musculus
tgtggtggccctcggctggtcagct

SEQ ID NO: 832560 - DNA, 25 bp, Mus musculus
tgtggtggccctgggctggtcagct

SEQ ID NO: 832561 - DNA, 25 bp, Mus musculus
tgtggtggcccttgacaacaagatt

SEQ ID NO: 832562 - DNA, 25 bp, Mus musculus
tgtggtgggactcggcccgttggga

SEQ ID NO: 832563 - DNA, 25 bp, Mus musculus
tgtggtgggactgggcccgttggga

SEQ ID NO: 832564 - DNA, 25 bp, Mus musculus
tgtggtgggagcaacaaatcggccc

SEQ ID NO: 832565 - DNA, 25 bp, Mus musculus
tgtggtgggagctacaaatcggccc

SEQ ID NO: 832566 - DNA, 25 bp, Mus musculus
tgtggtggtggcataatcttaaaat

SEQ ID NO: 832567 - DNA, 25 bp, Mus musculus
tgtggtggtggcttaatcttaaaat

SEQ ID NO: 832568 - DNA, 25 bp, Mus musculus
tgtggtggttatcctcacctgctcc

SEQ ID NO: 832569 - DNA, 25 bp, Mus musculus
tgtggtggttatgctcacctgctcc

SEQ ID NO: 832570 - DNA, 25 bp, Mus musculus
tgtggtgtacctcccacaagaagtc

SEQ ID NO: 832571 - DNA, 25 bp, Mus musculus
tgtggtgtacctgccacaagaagtc

SEQ ID NO: 832572 - DNA, 25 bp, Mus musculus
tgtggtgtacttccgagatggctac

SEQ ID NO: 832573 - DNA, 25 bp, Mus musculus
tgtggtgtacttgcgagatggctac

SEQ ID NO: 832574 - DNA, 25 bp, Mus musculus
tgtggtgtccacatatgatagcagt

SEQ ID NO: 832575 - DNA, 25 bp, Mus musculus
tgtggtgtccacttatgatagcagt

SEQ ID NO: 832576 - DNA, 25 bp, Mus musculus
tgtggtgtcccgacaatccctgaag

SEQ ID NO: 832577 - DNA, 25 bp, Mus musculus
tgtggtgtcccgtcaatccctgaag

SEQ ID NO: 832578 - DNA, 25 bp, Mus musculus
tgtggtgtccgcctacagtttccag

SEQ ID NO: 832579 - DNA, 25 bp, Mus musculus
tgtggtgtccgcgtacagtttccag

SEQ ID NO: 832580 - DNA, 25 bp, Mus musculus
tgtggtgtgcatcagtctggccaac

SEQ ID NO: 832581 - DNA, 25 bp, Mus musculus
tgtggtgtgcatgagtctggccaac

SEQ ID NO: 832582 - DNA, 25 bp, Mus musculus
tgtggtgttacactggtatctgcag

SEQ ID NO: 832583 - DNA, 25 bp, Mus musculus
tgtggtgttacagtggtatctgcag

SEQ ID NO: 832584 - DNA, 25 bp, Mus musculus
tgtggtgttcacagcccgatatctg

SEQ ID NO: 832585 - DNA, 25 bp, Mus musculus
tgtggtgttcactgcccgatatctg

SEQ ID NO: 832586 - DNA, 25 bp, Mus musculus
tgtggtgttcagagtcactacccag

SEQ ID NO: 832587 - DNA, 25 bp, Mus musculus
tgtggtgttcagtgtcactacccag

SEQ ID NO: 832588 - DNA, 25 bp, Mus musculus
tgtggtgttgctcctactgaagtac

SEQ ID NO: 832589 - DNA, 25 bp, Mus musculus
tgtggtgttgctgctactgaagtac

SEQ ID NO: 832590 - DNA, 25 bp, Mus musculus
tgtggttaccaacaaagatggtgac

SEQ ID NO: 832591 - DNA, 25 bp, Mus musculus
tgtggttaccaagaaagatggtgac

SEQ ID NO: 832592 - DNA, 25 bp, Mus musculus
tgtggttacctgcagttctccaggc

SEQ ID NO: 832593 - DNA, 25 bp, Mus musculus
tgtggttacctggagttctccaggc

SEQ ID NO: 832594 - DNA, 25 bp, Mus musculus
tgtggttatgacacctatgttcgct

SEQ ID NO: 832595 - DNA, 25 bp, Mus musculus
tgtggttatgactcctatgttcgct

SEQ ID NO: 832596 - DNA, 25 bp, Mus musculus
tgtggttatgctcgtcccggccatc

SEQ ID NO: 832597 - DNA, 25 bp, Mus musculus
tgtggttatgctggtcccggccatc

SEQ ID NO: 832598 - DNA, 25 bp, Mus musculus
tgtggttccacaatgcctaagaaag

SEQ ID NO: 832599 - DNA, 25 bp, Mus musculus
tgtggttccacattgcctaagaaag

SEQ ID NO: 832600 - DNA, 25 bp, Mus musculus
tgtggttccccacaaatgctccagg

SEQ ID NO: 832601 - DNA, 25 bp, Mus musculus
tgtggttccccagaaatgctccagg

SEQ ID NO: 832602 - DNA, 25 bp, Mus musculus
tgtggttcggcaatgtgggcctcaa

SEQ ID NO: 832603 - DNA, 25 bp, Mus musculus
tgtggttcggcattgtgggcctcaa

SEQ ID NO: 832604 - DNA, 25 bp, Mus musculus
tgtggttcgtcaaccttccaagcac

SEQ ID NO: 832605 - DNA, 25 bp, Mus musculus
tgtggttcgtcatccttccaagcac

SEQ ID NO: 832606 - DNA, 25 bp, Mus musculus
tgtggttctcaactcagaagcatgt

SEQ ID NO: 832607 - DNA, 25 bp, Mus musculus
tgtggttctcaagtcagaagcatgt

SEQ ID NO: 832608 - DNA, 25 bp, Mus musculus
tgtggttctgacaacaaacagtatg

SEQ ID NO: 832609 - DNA, 25 bp, Mus musculus
tgtggttctgactacaaacagtatg

SEQ ID NO: 832610 - DNA, 25 bp, Mus musculus
tgtggttgataactgtgccatctgc

SEQ ID NO: 832611 - DNA, 25 bp, Mus musculus
tgtggttgataagtgtgccatctgc

SEQ ID NO: 832612 - DNA, 25 bp, Mus musculus
tgtggttgccatcactgacactgaa

SEQ ID NO: 832613 - DNA, 25 bp, Mus musculus
tgtggttgccatgactgacactgaa

SEQ ID NO: 832614 - DNA, 25 bp, Mus musculus
tgtggttgcgtcatgatccacagac

SEQ ID NO: 832615 - DNA, 25 bp, Mus musculus
tgtggttgcgtcttgatccacagac

SEQ ID NO: 832616 - DNA, 25 bp, Mus musculus
tgtggttgctggagctctgctccag

SEQ ID NO: 832617 - DNA, 25 bp, Mus musculus
tgtggttgctggtgctctgctccag

SEQ ID NO: 832618 - DNA, 25 bp, Mus musculus
tgtggttggagtaaatgacactgag

SEQ ID NO: 832619 - DNA, 25 bp, Mus musculus
tgtggttggagtacccctacaccat

SEQ ID NO: 832620 - DNA, 25 bp, Mus musculus
tgtggttggagttaatgacactgag

SEQ ID NO: 832621 - DNA, 25 bp, Mus musculus
tgtggttggagttcccctacaccat

SEQ ID NO: 832622 - DNA, 25 bp, Mus musculus
tgtggttggccaactgccttggaga

SEQ ID NO: 832623 - DNA, 25 bp, Mus musculus
tgtggttggccatctgccttggaga

SEQ ID NO: 832624 - DNA, 25 bp, Mus musculus
tgtggttgtaataactacagttgcc

SEQ ID NO: 832625 - DNA, 25 bp, Mus musculus
tgtggttgtaattactacagttgcc

SEQ ID NO: 832626 - DNA, 25 bp, Mus musculus
tgtggttgtcaccaagattgacatg

SEQ ID NO: 832627 - DNA, 25 bp, Mus musculus
tgtggttgtcacgaagattgacatg

SEQ ID NO: 832628 - DNA, 25 bp, Mus musculus
tgtggtttctatcacagtcagcgcc

SEQ ID NO: 832629 - DNA, 25 bp, Mus musculus
tgtggtttctatgacagtcagcgcc

SEQ ID NO: 832630 - DNA, 25 bp, Mus musculus
tgtggtttgcaacacgaagcagaac

SEQ ID NO: 832631 - DNA, 25 bp, Mus musculus
tgtggtttgcaagacgaagcagaac

SEQ ID NO: 832632 - DNA, 25 bp, Mus musculus
tgtggtttgccaatcactcctacca

SEQ ID NO: 832633 - DNA, 25 bp, Mus musculus
tgtggtttgccattcactcctacca

SEQ ID NO: 832634 - DNA, 25 bp, Mus musculus
tgtggttttagcactttctgctgaa

SEQ ID NO: 832635 - DNA, 25 bp, Mus musculus
tgtggttttagctctttctgctgaa

SEQ ID NO: 832636 - DNA, 25 bp, Mus musculus
tgtggtttttgccaaccgcccagac

SEQ ID NO: 832637 - DNA, 25 bp, Mus musculus
tgtggtttttgcgaaccgcccagac

SEQ ID NO: 832638 - DNA, 25 bp, Mus musculus
tgtgtaaacaatactatggctcagt

SEQ ID NO: 832639 - DNA, 25 bp, Mus musculus
tgtgtaaacaattctatggctcagt

SEQ ID NO: 832640 - DNA, 25 bp, Mus musculus
tgtgtaaacccaacttttgccaagc

SEQ ID NO: 832641 - DNA, 25 bp, Mus musculus
tgtgtaaacccatcttttgccaagc

SEQ ID NO: 832642 - DNA, 25 bp, Mus musculus
tgtgtaaaccttagtgccccttgtg

SEQ ID NO: 832643 - DNA, 25 bp, Mus musculus
tgtgtaaacctttgtgccccttgtg

SEQ ID NO: 832644 - DNA, 25 bp, Mus musculus
tgtgtaacctgcctgaattcttcaa

SEQ ID NO: 832645 - DNA, 25 bp, Mus musculus
tgtgtaacctgcgtgaattcttcaa

SEQ ID NO: 832646 - DNA, 25 bp, Mus musculus
tgtgtaactgaacgctggcttacag

SEQ ID NO: 832647 - DNA, 25 bp, Mus musculus
tgtgtaactgaaggctggcttacag

SEQ ID NO: 832648 - DNA, 25 bp, Mus musculus
tgtgtaagctcactggatccaggga

SEQ ID NO: 832649 - DNA, 25 bp, Mus musculus
tgtgtaagctcagtggatccaggga

SEQ ID NO: 832650 - DNA, 25 bp, Mus musculus
tgtgtaagtcagagcagcgtccatc

SEQ ID NO: 832651 - DNA, 25 bp, Mus musculus
tgtgtaagtcagtgcagcgtccatc

SEQ ID NO: 832652 - DNA, 25 bp, Mus musculus
tgtgtaataaagatgccgtcgggtg

SEQ ID NO: 832653 - DNA, 25 bp, Mus musculus
tgtgtaataaagttgccgtcgggtg

SEQ ID NO: 832654 - DNA, 25 bp, Mus musculus
tgtgtaatccacaccctgcattaaa

SEQ ID NO: 832655 - DNA, 25 bp, Mus musculus
tgtgtaatccactccctgcattaaa

SEQ ID NO: 832656 - DNA, 25 bp, Mus musculus
tgtgtaatccttccctcagcgagct

SEQ ID NO: 832657 - DNA, 25 bp, Mus musculus
tgtgtaatccttgcctcagcgagct

SEQ ID NO: 832658 - DNA, 25 bp, Mus musculus
tgtgtaatctgcctgtcaaagtggt

SEQ ID NO: 832659 - DNA, 25 bp, Mus musculus
tgtgtaatctgcgtgtcaaagtggt

SEQ ID NO: 832660 - DNA, 25 bp, Mus musculus
tgtgtaatgacaaagagcggtttgc

SEQ ID NO: 832661 - DNA, 25 bp, Mus musculus
tgtgtaatgacatagagcggtttgc

SEQ ID NO: 832662 - DNA, 25 bp, Mus musculus
tgtgtacaaacaccagacatccagg

SEQ ID NO: 832663 - DNA, 25 bp, Mus musculus
tgtgtacaaacagcagacatccagg

SEQ ID NO: 832664 - DNA, 25 bp, Mus musculus
tgtgtacaacctaggcactcagctc

SEQ ID NO: 832665 - DNA, 25 bp, Mus musculus
tgtgtacaaccttggcactcagctc

SEQ ID NO: 832666 - DNA, 25 bp, Mus musculus
tgtgtacagccccagtctttgcagt

SEQ ID NO: 832667 - DNA, 25 bp, Mus musculus
tgtgtacagcccgagtctttgcagt

SEQ ID NO: 832668 - DNA, 25 bp, Mus musculus
tgtgtacatcaaacataactgaaga

SEQ ID NO: 832669 - DNA, 25 bp, Mus musculus
tgtgtacatcaatcataactgaaga

SEQ ID NO: 832670 - DNA, 25 bp, Mus musculus
tgtgtaccaaggactgaagccacct

SEQ ID NO: 832671 - DNA, 25 bp, Mus musculus
tgtgtaccaaggtctgaagccacct

SEQ ID NO: 832672 - DNA, 25 bp, Mus musculus
tgtgtacccatcaacagtgcccaag

SEQ ID NO: 832673 - DNA, 25 bp, Mus musculus
tgtgtacccatctacagtgcccaag

SEQ ID NO: 832674 - DNA, 25 bp, Mus musculus
tgtgtaccccggaaactccctgaag

SEQ ID NO: 832675 - DNA, 25 bp, Mus musculus
tgtgtaccccggtaactccctgaag

SEQ ID NO: 832676 - DNA, 25 bp, Mus musculus
tgtgtaccttgaagtcattgacaag

SEQ ID NO: 832677 - DNA, 25 bp, Mus musculus
tgtgtaccttgatgtcattgacaag

SEQ ID NO: 832678 - DNA, 25 bp, Mus musculus
tgtgtacgcaatcaaaatcctgcgc

SEQ ID NO: 832679 - DNA, 25 bp, Mus musculus
tgtgtacgcaatgaaaatcctgcgc

SEQ ID NO: 832680 - DNA, 25 bp, Mus musculus
tgtgtacgcgctcagagagcaatat

SEQ ID NO: 832681 - DNA, 25 bp, Mus musculus
tgtgtacgcgctgagagagcaatat

SEQ ID NO: 832682 - DNA, 25 bp, Mus musculus
tgtgtacgtgttcttccatctgtgg

SEQ ID NO: 832683 - DNA, 25 bp, Mus musculus
tgtgtacgtgttgttccatctgtgg

SEQ ID NO: 832684 - DNA, 25 bp, Mus musculus
tgtgtacgttccatcacaccttcac

SEQ ID NO: 832685 - DNA, 25 bp, Mus musculus
tgtgtacgttccttcacaccttcac

SEQ ID NO: 832686 - DNA, 25 bp, Mus musculus
tgtgtactcaggcttctatgtggcc

SEQ ID NO: 832687 - DNA, 25 bp, Mus musculus
tgtgtactcagggttctatgtggcc

SEQ ID NO: 832688 - DNA, 25 bp, Mus musculus
tgtgtactcccgagaccggaagttt

SEQ ID NO: 832689 - DNA, 25 bp, Mus musculus
tgtgtactcccgtgaccggaagttt

SEQ ID NO: 832690 - DNA, 25 bp, Mus musculus
tgtgtactctgcagatagtctgggt

SEQ ID NO: 832691 - DNA, 25 bp, Mus musculus
tgtgtactctgctgatagtctgggt

SEQ ID NO: 832692 - DNA, 25 bp, Mus musculus
tgtgtactgggcaaagggttatacc

SEQ ID NO: 832693 - DNA, 25 bp, Mus musculus
tgtgtactgggctaagggttatacc

SEQ ID NO: 832694 - DNA, 25 bp, Mus musculus
tgtgtactgtggaggaattgcttcg

SEQ ID NO: 832695 - DNA, 25 bp, Mus musculus
tgtgtactgtggtggaattgcttcg

SEQ ID NO: 832696 - DNA, 25 bp, Mus musculus
tgtgtactgtttcggcctgctctct

SEQ ID NO: 832697 - DNA, 25 bp, Mus musculus
tgtgtactgtttgggcctgctctct

SEQ ID NO: 832698 - DNA, 25 bp, Mus musculus
tgtgtacttaaaacaggccacgtgg

SEQ ID NO: 832699 - DNA, 25 bp, Mus musculus
tgtgtacttaaatcaggccacgtgg

SEQ ID NO: 832700 - DNA, 25 bp, Mus musculus
tgtgtacttcatcctatcgcttggg

SEQ ID NO: 832701 - DNA, 25 bp, Mus musculus
tgtgtacttcatgctatcgcttggg

SEQ ID NO: 832702 - DNA, 25 bp, Mus musculus
tgtgtacttccgaatgaaggacgag

SEQ ID NO: 832703 - DNA, 25 bp, Mus musculus
tgtgtacttccgtatgaaggacgag

SEQ ID NO: 832704 - DNA, 25 bp, Mus musculus
tgtgtacttggcaaaaagtctggca

SEQ ID NO: 832705 - DNA, 25 bp, Mus musculus
tgtgtacttggctaaaagtctggca

SEQ ID NO: 832706 - DNA, 25 bp, Mus musculus
tgtgtacttgtaccaaagataacgc

SEQ ID NO: 832707 - DNA, 25 bp, Mus musculus
tgtgtacttgtagcaaagataacgc

SEQ ID NO: 832708 - DNA, 25 bp, Mus musculus
tgtgtagaccggaacctgcgaagga

SEQ ID NO: 832709 - DNA, 25 bp, Mus musculus
tgtgtagaccggtacctgcgaagga

SEQ ID NO: 832710 - DNA, 25 bp, Mus musculus
tgtgtagacgaaagcagcctgcgga

SEQ ID NO: 832711 - DNA, 25 bp, Mus musculus
tgtgtagacgaatgcagcctgcgga

SEQ ID NO: 832712 - DNA, 25 bp, Mus musculus
tgtgtagactggatggtgccttttg

SEQ ID NO: 832713 - DNA, 25 bp, Mus musculus
tgtgtagactggttggtgccttttg

SEQ ID NO: 832714 - DNA, 25 bp, Mus musculus
tgtgtagagcctcaggagaccacgt

SEQ ID NO: 832715 - DNA, 25 bp, Mus musculus
tgtgtagagcctgaggagaccacgt

SEQ ID NO: 832716 - DNA, 25 bp, Mus musculus
tgtgtagaggtgaaagccttctgtc

SEQ ID NO: 832717 - DNA, 25 bp, Mus musculus
tgtgtagaggtgtaagccttctgtc

SEQ ID NO: 832718 - DNA, 25 bp, Mus musculus
tgtgtagcacccacactggccttga

SEQ ID NO: 832719 - DNA, 25 bp, Mus musculus
tgtgtagcaccctcactggccttga

SEQ ID NO: 832720 - DNA, 25 bp, Mus musculus
tgtgtagccaccaatgttttaggca

SEQ ID NO: 832721 - DNA, 25 bp, Mus musculus
tgtgtagccacctatgttttaggca

SEQ ID NO: 832722 - DNA, 25 bp, Mus musculus
tgtgtagctcatccagaaccagagg

SEQ ID NO: 832723 - DNA, 25 bp, Mus musculus
tgtgtagctcatgcagaaccagagg

SEQ ID NO: 832724 - DNA, 25 bp, Mus musculus
tgtgtaggcatgagcttctgtcctg

SEQ ID NO: 832725 - DNA, 25 bp, Mus musculus
tgtgtaggcatgtgcttctgtcctg

SEQ ID NO: 832726 - DNA, 25 bp, Mus musculus
tgtgtagggcaaatgcggaatatat

SEQ ID NO: 832727 - DNA, 25 bp, Mus musculus
tgtgtagggcaattgcggaatatat

SEQ ID NO: 832728 - DNA, 25 bp, Mus musculus
tgtgtataacgcaccacacccagga

SEQ ID NO: 832729 - DNA, 25 bp, Mus musculus
tgtgtataacgctccacacccagga

SEQ ID NO: 832730 - DNA, 25 bp, Mus musculus
tgtgtataagacagttcaagcaaga

SEQ ID NO: 832731 - DNA, 25 bp, Mus musculus
tgtgtataagactgttcaagcaaga

SEQ ID NO: 832732 - DNA, 25 bp, Mus musculus
tgtgtatactctatatttgggcagg

SEQ ID NO: 832733 - DNA, 25 bp, Mus musculus
tgtgtatactctttatttgggcagg

SEQ ID NO: 832734 - DNA, 25 bp, Mus musculus
tgtgtataggtgcatggacagcaac

SEQ ID NO: 832735 - DNA, 25 bp, Mus musculus
tgtgtataggtggatggacagcaac

SEQ ID NO: 832736 - DNA, 25 bp, Mus musculus
tgtgtatatcatattgtcagcgctc

SEQ ID NO: 832737 - DNA, 25 bp, Mus musculus
tgtgtatatcattttgtcagcgctc

SEQ ID NO: 832738 - DNA, 25 bp, Mus musculus
tgtgtatcacctagactgcttcgcc

SEQ ID NO: 832739 - DNA, 25 bp, Mus musculus
tgtgtatcaccttgactgcttcgcc

SEQ ID NO: 832740 - DNA, 25 bp, Mus musculus
tgtgtatcatgcagacattccgcag

SEQ ID NO: 832741 - DNA, 25 bp, Mus musculus
tgtgtatcatgctgacattccgcag

SEQ ID NO: 832742 - DNA, 25 bp, Mus musculus
tgtgtatcccttagaccatctggag

SEQ ID NO: 832743 - DNA, 25 bp, Mus musculus
tgtgtatccctttgaccatctggag

SEQ ID NO: 832744 - DNA, 25 bp, Mus musculus
tgtgtatccgtacgcttctttgaga

SEQ ID NO: 832745 - DNA, 25 bp, Mus musculus
tgtgtatccgtaggcttctttgaga

SEQ ID NO: 832746 - DNA, 25 bp, Mus musculus
tgtgtatcctgcaaagaagcacctg

SEQ ID NO: 832747 - DNA, 25 bp, Mus musculus
tgtgtatcctgctaagaagcacctg

SEQ ID NO: 832748 - DNA, 25 bp, Mus musculus
tgtgtatcgccactttactgacagc

SEQ ID NO: 832749 - DNA, 25 bp, Mus musculus
tgtgtatcgccagtttactgacagc

SEQ ID NO: 832750 - DNA, 25 bp, Mus musculus
tgtgtatcggcgctcccgcaggtcc

SEQ ID NO: 832751 - DNA, 25 bp, Mus musculus
tgtgtatcggcggtcccgcaggtcc

SEQ ID NO: 832752 - DNA, 25 bp, Mus musculus
tgtgtatctctactacgatcctgat

SEQ ID NO: 832753 - DNA, 25 bp, Mus musculus
tgtgtatctctagtacgatcctgat

SEQ ID NO: 832754 - DNA, 25 bp, Mus musculus
tgtgtatctgcaaaactgggtacat

SEQ ID NO: 832755 - DNA, 25 bp, Mus musculus
tgtgtatctgcataactgggtacat

SEQ ID NO: 832756 - DNA, 25 bp, Mus musculus
tgtgtatgaccgagcgaccagggca

SEQ ID NO: 832757 - DNA, 25 bp, Mus musculus
tgtgtatgaccgtgcgaccagggca

SEQ ID NO: 832758 - DNA, 25 bp, Mus musculus
tgtgtatgagctcagcctttgccac

SEQ ID NO: 832759 - DNA, 25 bp, Mus musculus
tgtgtatgagctgagcctttgccac

SEQ ID NO: 832760 - DNA, 25 bp, Mus musculus
tgtgtatgatcgcatgcgagcagat

SEQ ID NO: 832761 - DNA, 25 bp, Mus musculus
tgtgtatgatcggatgcgagcagat

SEQ ID NO: 832762 - DNA, 25 bp, Mus musculus
tgtgtatgatttagaccgcttctcc

SEQ ID NO: 832763 - DNA, 25 bp, Mus musculus
tgtgtatgattttgaccgcttctcc

SEQ ID NO: 832764 - DNA, 25 bp, Mus musculus
tgtgtatgctgaagtccttcgtggc

SEQ ID NO: 832765 - DNA, 25 bp, Mus musculus
tgtgtatgctgatgtccttcgtggc

SEQ ID NO: 832766 - DNA, 25 bp, Mus musculus
tgtgtatggccgagaagacgcttgt

SEQ ID NO: 832767 - DNA, 25 bp, Mus musculus
tgtgtatggccgtgaagacgcttgt

SEQ ID NO: 832768 - DNA, 25 bp, Mus musculus
tgtgtatggctgcaatccatgcagg

SEQ ID NO: 832769 - DNA, 25 bp, Mus musculus
tgtgtatggctggaatccatgcagg

SEQ ID NO: 832770 - DNA, 25 bp, Mus musculus
tgtgtatggtgcctgcagactctta

SEQ ID NO: 832771 - DNA, 25 bp, Mus musculus
tgtgtatggtgcgtgcagactctta

SEQ ID NO: 832772 - DNA, 25 bp, Mus musculus
tgtgtatggtgtcgtaaaggcctac

SEQ ID NO: 832773 - DNA, 25 bp, Mus musculus
tgtgtatggtgtggtaaaggcctac

SEQ ID NO: 832774 - DNA, 25 bp, Mus musculus
tgtgtatgtaacaggccggcctgac

SEQ ID NO: 832775 - DNA, 25 bp, Mus musculus
tgtgtatgtaactggccggcctgac

SEQ ID NO: 832776 - DNA, 25 bp, Mus musculus
tgtgtatgtcatcaacaagggctgc

SEQ ID NO: 832777 - DNA, 25 bp, Mus musculus
tgtgtatgtcatgaacaagggctgc

SEQ ID NO: 832778 - DNA, 25 bp, Mus musculus
tgtgtatgtgaccagcactagtgtc

SEQ ID NO: 832779 - DNA, 25 bp, Mus musculus
tgtgtatgtgacgagcactagtgtc

SEQ ID NO: 832780 - DNA, 25 bp, Mus musculus
tgtgtattgccaaccagttccctga

SEQ ID NO: 832781 - DNA, 25 bp, Mus musculus
tgtgtattgccatccagttccctga

SEQ ID NO: 832782 - DNA, 25 bp, Mus musculus
tgtgtatttcttcaatggaaggctc

SEQ ID NO: 832783 - DNA, 25 bp, Mus musculus
tgtgtatttcttgaatggaaggctc

SEQ ID NO: 832784 - DNA, 25 bp, Mus musculus
tgtgtcaacacacagggctccttca

SEQ ID NO: 832785 - DNA, 25 bp, Mus musculus
tgtgtcaacacagagggctccttca

SEQ ID NO: 832786 - DNA, 25 bp, Mus musculus
tgtgtcaacaccaagggcagctacg

SEQ ID NO: 832787 - DNA, 25 bp, Mus musculus
tgtgtcaacacccatcagtcctcag

SEQ ID NO: 832788 - DNA, 25 bp, Mus musculus
tgtgtcaacaccgatcagtcctcag

SEQ ID NO: 832789 - DNA, 25 bp, Mus musculus
tgtgtcaacacctagggcagctacg

SEQ ID NO: 832790 - DNA, 25 bp, Mus musculus
tgtgtcaactttccctcctttaact

SEQ ID NO: 832791 - DNA, 25 bp, Mus musculus
tgtgtcaactttgcctcctttaact

SEQ ID NO: 832792 - DNA, 25 bp, Mus musculus
tgtgtcaatctcatcaccaaccagg

SEQ ID NO: 832793 - DNA, 25 bp, Mus musculus
tgtgtcaatctcttcaccaaccagg

SEQ ID NO: 832794 - DNA, 25 bp, Mus musculus
tgtgtcaatgagacctacaagaaga

SEQ ID NO: 832795 - DNA, 25 bp, Mus musculus
tgtgtcaatgagtcctacaagaaga

SEQ ID NO: 832796 - DNA, 25 bp, Mus musculus
tgtgtcaatgttacaggaattttgg

SEQ ID NO: 832797 - DNA, 25 bp, Mus musculus
tgtgtcaatgtttcaggaattttgg

SEQ ID NO: 832798 - DNA, 25 bp, Mus musculus
tgtgtcacacgcacccgatgtggac

SEQ ID NO: 832799 - DNA, 25 bp, Mus musculus
tgtgtcacacgctcccgatgtggac

SEQ ID NO: 832800 - DNA, 25 bp, Mus musculus
tgtgtcacactacggagctggcttt

SEQ ID NO: 832801 - DNA, 25 bp, Mus musculus
tgtgtcacactagggagctggcttt

SEQ ID NO: 832802 - DNA, 25 bp, Mus musculus
tgtgtcacagatagtattacataga

SEQ ID NO: 832803 - DNA, 25 bp, Mus musculus
tgtgtcacagatcataaggacctcc

SEQ ID NO: 832804 - DNA, 25 bp, Mus musculus
tgtgtcacagatgataaggacctcc

SEQ ID NO: 832805 - DNA, 25 bp, Mus musculus
tgtgtcacagattgtattacataga

SEQ ID NO: 832806 - DNA, 25 bp, Mus musculus
tgtgtcacaggtcgtgagctcttca

SEQ ID NO: 832807 - DNA, 25 bp, Mus musculus
tgtgtcacaggtggtgagctcttca

SEQ ID NO: 832808 - DNA, 25 bp, Mus musculus
tgtgtcaccaccaccgaccagcagg

SEQ ID NO: 832809 - DNA, 25 bp, Mus musculus
tgtgtcaccacctccgaccagcagg

SEQ ID NO: 832810 - DNA, 25 bp, Mus musculus
tgtgtcaccctgaccacgtctatct

SEQ ID NO: 832811 - DNA, 25 bp, Mus musculus
tgtgtcaccctgtccacgtctatct

SEQ ID NO: 832812 - DNA, 25 bp, Mus musculus
tgtgtcaccgatccttgtcaggccg

SEQ ID NO: 832813 - DNA, 25 bp, Mus musculus
tgtgtcaccgatgcttgtcaggccg

SEQ ID NO: 832814 - DNA, 25 bp, Mus musculus
tgtgtcaccgtcacttttaaccatg

SEQ ID NO: 832815 - DNA, 25 bp, Mus musculus
tgtgtcaccgtctcttttaaccatg

SEQ ID NO: 832816 - DNA, 25 bp, Mus musculus
tgtgtcacctacatccagaacgagc

SEQ ID NO: 832817 - DNA, 25 bp, Mus musculus
tgtgtcacctacttccagaacgagc

SEQ ID NO: 832818 - DNA, 25 bp, Mus musculus
tgtgtcacgggaagacagagattgt

SEQ ID NO: 832819 - DNA, 25 bp, Mus musculus
tgtgtcacgggatgacagagattgt

SEQ ID NO: 832820 - DNA, 25 bp, Mus musculus
tgtgtcagaaatcctgcaaaagaat

SEQ ID NO: 832821 - DNA, 25 bp, Mus musculus
tgtgtcagaaatgctgcaaaagaat

SEQ ID NO: 832822 - DNA, 25 bp, Mus musculus
tgtgtcagaacacacccacttccta

SEQ ID NO: 832823 - DNA, 25 bp, Mus musculus
tgtgtcagaacagacccacttccta

SEQ ID NO: 832824 - DNA, 25 bp, Mus musculus
tgtgtcagaaggcaagattctaacc

SEQ ID NO: 832825 - DNA, 25 bp, Mus musculus
tgtgtcagaagggaagattctaacc

SEQ ID NO: 832826 - DNA, 25 bp, Mus musculus
tgtgtcagagaaagctcatgttgct

SEQ ID NO: 832827 - DNA, 25 bp, Mus musculus
tgtgtcagagaatgctcatgttgct

SEQ ID NO: 832828 - DNA, 25 bp, Mus musculus
tgtgtcagatgccaaccaacatgtc

SEQ ID NO: 832829 - DNA, 25 bp, Mus musculus
tgtgtcagatgcgaaccaacatgtc

SEQ ID NO: 832830 - DNA, 25 bp, Mus musculus
tgtgtcagccaaccaaatgaagccc

SEQ ID NO: 832831 - DNA, 25 bp, Mus musculus
tgtgtcagccaagcaaatgaagccc

SEQ ID NO: 832832 - DNA, 25 bp, Mus musculus
tgtgtcaggaaaatagcaagccagg

SEQ ID NO: 832833 - DNA, 25 bp, Mus musculus
tgtgtcaggaaattagcaagccagg

SEQ ID NO: 832834 - DNA, 25 bp, Mus musculus
tgtgtcaggagacctcaactggagc

SEQ ID NO: 832835 - DNA, 25 bp, Mus musculus
tgtgtcaggagagctcaactggagc

SEQ ID NO: 832836 - DNA, 25 bp, Mus musculus
tgtgtcaggcagctgtgaccataga

SEQ ID NO: 832837 - DNA, 25 bp, Mus musculus
tgtgtcaggcaggtgtgaccataga

SEQ ID NO: 832838 - DNA, 25 bp, Mus musculus
tgtgtcagtatcctttagcccagtg

SEQ ID NO: 832839 - DNA, 25 bp, Mus musculus
tgtgtcagtatcgtttagcccagtg

SEQ ID NO: 832840 - DNA, 25 bp, Mus musculus
tgtgtcagttccagaggaatccaga

SEQ ID NO: 832841 - DNA, 25 bp, Mus musculus
tgtgtcagttcctgaggaatccaga

SEQ ID NO: 832842 - DNA, 25 bp, Mus musculus
tgtgtcatcaagagctcagtgggtg

SEQ ID NO: 832843 - DNA, 25 bp, Mus musculus
tgtgtcatcaagtgctcagtgggtg

SEQ ID NO: 832844 - DNA, 25 bp, Mus musculus
tgtgtcatcagaatctttaaactac

SEQ ID NO: 832845 - DNA, 25 bp, Mus musculus
tgtgtcatcagattctttaaactac

SEQ ID NO: 832846 - DNA, 25 bp, Mus musculus
tgtgtcatctgtagctattgccacc

SEQ ID NO: 832847 - DNA, 25 bp, Mus musculus
tgtgtcatctgttgctattgccacc

SEQ ID NO: 832848 - DNA, 25 bp, Mus musculus
tgtgtcatcttcaggagatcagagc

SEQ ID NO: 832849 - DNA, 25 bp, Mus musculus
tgtgtcatcttctggagatcagagc

SEQ ID NO: 832850 - DNA, 25 bp, Mus musculus
tgtgtcatgaggagtcacattcccc

SEQ ID NO: 832851 - DNA, 25 bp, Mus musculus
tgtgtcatgaggtgtcacattcccc

SEQ ID NO: 832852 - DNA, 25 bp, Mus musculus
tgtgtcatggagagacccactgcct

SEQ ID NO: 832853 - DNA, 25 bp, Mus musculus
tgtgtcatggagtgacccactgcct

SEQ ID NO: 832854 - DNA, 25 bp, Mus musculus
tgtgtcatggccctccattggcttc

SEQ ID NO: 832855 - DNA, 25 bp, Mus musculus
tgtgtcatggccgtccattggcttc

SEQ ID NO: 832856 - DNA, 25 bp, Mus musculus
tgtgtcattggtactgctcaggcta

SEQ ID NO: 832857 - DNA, 25 bp, Mus musculus
tgtgtcattggttctgctcaggcta

SEQ ID NO: 832858 - DNA, 25 bp, Mus musculus
tgtgtccaaagtcgagaaatacgag

SEQ ID NO: 832859 - DNA, 25 bp, Mus musculus
tgtgtccaaagtggagaaatacgag

SEQ ID NO: 832860 - DNA, 25 bp, Mus musculus
tgtgtccaacacaagggcctttccc

SEQ ID NO: 832861 - DNA, 25 bp, Mus musculus
tgtgtccaacactagggcctttccc

SEQ ID NO: 832862 - DNA, 25 bp, Mus musculus
tgtgtccaactgaatatagctgcca

SEQ ID NO: 832863 - DNA, 25 bp, Mus musculus
tgtgtccaactgtatatagctgcca

SEQ ID NO: 832864 - DNA, 25 bp, Mus musculus
tgtgtccacacacgcggaatgtgcc

SEQ ID NO: 832865 - DNA, 25 bp, Mus musculus
tgtgtccacacaggcggaatgtgcc

SEQ ID NO: 832866 - DNA, 25 bp, Mus musculus
tgtgtccacatcctgcagcagagtc

SEQ ID NO: 832867 - DNA, 25 bp, Mus musculus
tgtgtccacatcgtgcagcagagtc

SEQ ID NO: 832868 - DNA, 25 bp, Mus musculus
tgtgtccaccacagacctcgtgggt

SEQ ID NO: 832869 - DNA, 25 bp, Mus musculus
tgtgtccaccactgacctcgtgggt

SEQ ID NO: 832870 - DNA, 25 bp, Mus musculus
tgtgtccacgacagtttaaatattc

SEQ ID NO: 832871 - DNA, 25 bp, Mus musculus
tgtgtccacgactgtttaaatattc

SEQ ID NO: 832872 - DNA, 25 bp, Mus musculus
tgtgtccacggcacgggtgttctct

SEQ ID NO: 832873 - DNA, 25 bp, Mus musculus
tgtgtccacggctcgggtgttctct

SEQ ID NO: 832874 - DNA, 25 bp, Mus musculus
tgtgtccactaacagccaagttcga

SEQ ID NO: 832875 - DNA, 25 bp, Mus musculus
tgtgtccactaagagccaagttcga

SEQ ID NO: 832876 - DNA, 25 bp, Mus musculus
tgtgtccactgtataaatgtaatga

SEQ ID NO: 832877 - DNA, 25 bp, Mus musculus
tgtgtccactgtttaaatgtaatga

SEQ ID NO: 832878 - DNA, 25 bp, Mus musculus
tgtgtccagccgctatgtccatcca

SEQ ID NO: 832879 - DNA, 25 bp, Mus musculus
tgtgtccagccggtatgtccatcca

SEQ ID NO: 832880 - DNA, 25 bp, Mus musculus
tgtgtccagcttctaccatgccttt

SEQ ID NO: 832881 - DNA, 25 bp, Mus musculus
tgtgtccagcttgtaccatgccttt

SEQ ID NO: 832882 - DNA, 25 bp, Mus musculus
tgtgtccaggtcctagaccccaagt

SEQ ID NO: 832883 - DNA, 25 bp, Mus musculus
tgtgtccaggtcgtagaccccaagt

SEQ ID NO: 832884 - DNA, 25 bp, Mus musculus
tgtgtccagtttaagcataaagcag

SEQ ID NO: 832885 - DNA, 25 bp, Mus musculus
tgtgtccagttttagcataaagcag

SEQ ID NO: 832886 - DNA, 25 bp, Mus musculus
tgtgtccatccgcatcctcgatgag

SEQ ID NO: 832887 - DNA, 25 bp, Mus musculus
tgtgtccatccggatcctcgatgag

SEQ ID NO: 832888 - DNA, 25 bp, Mus musculus
tgtgtccatggcatgtgttcacctg

SEQ ID NO: 832889 - DNA, 25 bp, Mus musculus
tgtgtccatggcttgtgttcacctg

SEQ ID NO: 832890 - DNA, 25 bp, Mus musculus
tgtgtcccacctctttgaaggtctt

SEQ ID NO: 832891 - DNA, 25 bp, Mus musculus
tgtgtcccacctgtttgaaggtctt

SEQ ID NO: 832892 - DNA, 25 bp, Mus musculus
tgtgtcccagctcgtcacacagaag

SEQ ID NO: 832893 - DNA, 25 bp, Mus musculus
tgtgtcccagctggtcacacagaag

SEQ ID NO: 832894 - DNA, 25 bp, Mus musculus
tgtgtccccaagcaaagtatgtcca

SEQ ID NO: 832895 - DNA, 25 bp, Mus musculus
tgtgtccccaaggaaagtatgtcca

SEQ ID NO: 832896 - DNA, 25 bp, Mus musculus
tgtgtccccactccgtcgagtgaat

SEQ ID NO: 832897 - DNA, 25 bp, Mus musculus
tgtgtccccactgcgtcgagtgaat

SEQ ID NO: 832898 - DNA, 25 bp, Mus musculus
tgtgtccccctcactttgtcctttg

SEQ ID NO: 832899 - DNA, 25 bp, Mus musculus
tgtgtccccctctctttgtcctttg

SEQ ID NO: 832900 - DNA, 25 bp, Mus musculus
tgtgtcccgggcaagaaagatacag

SEQ ID NO: 832901 - DNA, 25 bp, Mus musculus
tgtgtcccgggctagaaagatacag

SEQ ID NO: 832902 - DNA, 25 bp, Mus musculus
tgtgtccctgcactgtggtaaaagt

SEQ ID NO: 832903 - DNA, 25 bp, Mus musculus
tgtgtccctgcagtgtggtaaaagt

SEQ ID NO: 832904 - DNA, 25 bp, Mus musculus
tgtgtcccttgtacagagctgtcag

SEQ ID NO: 832905 - DNA, 25 bp, Mus musculus
tgtgtcccttgttcagagctgtcag

SEQ ID NO: 832906 - DNA, 25 bp, Mus musculus
tgtgtccgctttcgcctcgacaact

SEQ ID NO: 832907 - DNA, 25 bp, Mus musculus
tgtgtccgctttggcctcgacaact

SEQ ID NO: 832908 - DNA, 25 bp, Mus musculus
tgtgtccgtcatcctctgcggaatc

SEQ ID NO: 832909 - DNA, 25 bp, Mus musculus
tgtgtccgtcatgctctgcggaatc

SEQ ID NO: 832910 - DNA, 25 bp, Mus musculus
tgtgtccgtggaagagactatcaag

SEQ ID NO: 832911 - DNA, 25 bp, Mus musculus
tgtgtccgtggatgagactatcaag

SEQ ID NO: 832912 - DNA, 25 bp, Mus musculus
tgtgtccgttggacaacagagagtg

SEQ ID NO: 832913 - DNA, 25 bp, Mus musculus
tgtgtccgttggtcaacagagagtg

SEQ ID NO: 832914 - DNA, 25 bp, Mus musculus
tgtgtcctcacaccgatttgaaaga

SEQ ID NO: 832915 - DNA, 25 bp, Mus musculus
tgtgtcctcacagcgatttgaaaga

SEQ ID NO: 832916 - DNA, 25 bp, Mus musculus
tgtgtcctcagtccctgtgtccgag

SEQ ID NO: 832917 - DNA, 25 bp, Mus musculus
tgtgtcctcagtgcctgtgtccgag

SEQ ID NO: 832918 - DNA, 25 bp, Mus musculus
tgtgtcctccatcaacctctttgat

SEQ ID NO: 832919 - DNA, 25 bp, Mus musculus
tgtgtcctccatgaacctctttgat

SEQ ID NO: 832920 - DNA, 25 bp, Mus musculus
tgtgtcctccgcatatgtcagtaca

SEQ ID NO: 832921 - DNA, 25 bp, Mus musculus
tgtgtcctccgcttatgtcagtaca

SEQ ID NO: 832922 - DNA, 25 bp, Mus musculus
tgtgtcctcgctctggtcctcatgc

SEQ ID NO: 832923 - DNA, 25 bp, Mus musculus
tgtgtcctcgctgtggtcctcatgc

SEQ ID NO: 832924 - DNA, 25 bp, Mus musculus
tgtgtcctctaacagtcagcccaag

SEQ ID NO: 832925 - DNA, 25 bp, Mus musculus
tgtgtcctctaagagtcagcccaag

SEQ ID NO: 832926 - DNA, 25 bp, Mus musculus
tgtgtcctctgtccgaataataaag

SEQ ID NO: 832927 - DNA, 25 bp, Mus musculus
tgtgtcctctgtgcgaataataaag

SEQ ID NO: 832928 - DNA, 25 bp, Mus musculus
tgtgtcctgaagcacgagaccttcc

SEQ ID NO: 832929 - DNA, 25 bp, Mus musculus
tgtgtcctgaaggacgagaccttcc

SEQ ID NO: 832930 - DNA, 25 bp, Mus musculus
tgtgtcctgaccatggtaccactgc

SEQ ID NO: 832931 - DNA, 25 bp, Mus musculus
tgtgtcctgaccttggtaccactgc

SEQ ID NO: 832932 - DNA, 25 bp, Mus musculus
tgtgtcctgagccttcataagaagt

SEQ ID NO: 832933 - DNA, 25 bp, Mus musculus
tgtgtcctgagcgttcataagaagt

SEQ ID NO: 832934 - DNA, 25 bp, Mus musculus
tgtgtcctgatcattggcgtcccca

SEQ ID NO: 832935 - DNA, 25 bp, Mus musculus
tgtgtcctgatctttggcgtcccca

SEQ ID NO: 832936 - DNA, 25 bp, Mus musculus
tgtgtcctgtccataataaatgagc

SEQ ID NO: 832937 - DNA, 25 bp, Mus musculus
tgtgtcctgtccttaataaatgagc

SEQ ID NO: 832938 - DNA, 25 bp, Mus musculus
tgtgtcctgttcagacagcgccacc

SEQ ID NO: 832939 - DNA, 25 bp, Mus musculus
tgtgtcctgttctgacagcgccacc

SEQ ID NO: 832940 - DNA, 25 bp, Mus musculus
tgtgtcctttgtcgacgagccgcac

SEQ ID NO: 832941 - DNA, 25 bp, Mus musculus
tgtgtcctttgtggacgagccgcac

SEQ ID NO: 832942 - DNA, 25 bp, Mus musculus
tgtgtcgaacctccataagattctg

SEQ ID NO: 832943 - DNA, 25 bp, Mus musculus
tgtgtcgaacctgcataagattctg

SEQ ID NO: 832944 - DNA, 25 bp, Mus musculus
tgtgtcgagaacagggctttggcac

SEQ ID NO: 832945 - DNA, 25 bp, Mus musculus
tgtgtcgagaactgggctttggcac

SEQ ID NO: 832946 - DNA, 25 bp, Mus musculus
tgtgtcgccgccaggactacatcac

SEQ ID NO: 832947 - DNA, 25 bp, Mus musculus
tgtgtcgccgcctggactacatcac

SEQ ID NO: 832948 - DNA, 25 bp, Mus musculus
tgtgtcgccttgagcgcttatgact

SEQ ID NO: 832949 - DNA, 25 bp, Mus musculus
tgtgtcgccttgtgcgcttatgact

SEQ ID NO: 832950 - DNA, 25 bp, Mus musculus
tgtgtcggacatcgtcatgtttagc

SEQ ID NO: 832951 - DNA, 25 bp, Mus musculus
tgtgtcggacatggtcatgtttagc

SEQ ID NO: 832952 - DNA, 25 bp, Mus musculus
tgtgtcggcagtagttgaatatggt

SEQ ID NO: 832953 - DNA, 25 bp, Mus musculus
tgtgtcggcagttgttgaatatggt

SEQ ID NO: 832954 - DNA, 25 bp, Mus musculus
tgtgtcggtaccactccaaggtctt

SEQ ID NO: 832955 - DNA, 25 bp, Mus musculus
tgtgtcggtacctctccaaggtctt

SEQ ID NO: 832956 - DNA, 25 bp, Mus musculus
tgtgtcgtggctctcaccacatgat

SEQ ID NO: 832957 - DNA, 25 bp, Mus musculus
tgtgtcgtggctgtcaccacatgat

SEQ ID NO: 832958 - DNA, 25 bp, Mus musculus
tgtgtctacaaaatggaagatttga

SEQ ID NO: 832959 - DNA, 25 bp, Mus musculus
tgtgtctacaaattggaagatttga

SEQ ID NO: 832960 - DNA, 25 bp, Mus musculus
tgtgtctacaacaactcactagggc

SEQ ID NO: 832961 - DNA, 25 bp, Mus musculus
tgtgtctacaactactcactagggc

SEQ ID NO: 832962 - DNA, 25 bp, Mus musculus
tgtgtctaggagaatccatcgtgtg

SEQ ID NO: 832963 - DNA, 25 bp, Mus musculus
tgtgtctaggagtatccatcgtgtg

SEQ ID NO: 832964 - DNA, 25 bp, Mus musculus
tgtgtctagtgaaccccaagaagag

SEQ ID NO: 832965 - DNA, 25 bp, Mus musculus
tgtgtctagtgatccccaagaagag

SEQ ID NO: 832966 - DNA, 25 bp, Mus musculus
tgtgtctatcaacggagtgtgtgcc

SEQ ID NO: 832967 - DNA, 25 bp, Mus musculus
tgtgtctatcaagggagtgtgtgcc

SEQ ID NO: 832968 - DNA, 25 bp, Mus musculus
tgtgtctcaactcgcttctcaatgt

SEQ ID NO: 832969 - DNA, 25 bp, Mus musculus
tgtgtctcaactggcttctcaatgt

SEQ ID NO: 832970 - DNA, 25 bp, Mus musculus
tgtgtctcaagcaaaaccatgagga

SEQ ID NO: 832971 - DNA, 25 bp, Mus musculus
tgtgtctcaagctaaaccatgagga

SEQ ID NO: 832972 - DNA, 25 bp, Mus musculus
tgtgtctcattcaagtaataaatgg

SEQ ID NO: 832973 - DNA, 25 bp, Mus musculus
tgtgtctcattctagtaataaatgg

SEQ ID NO: 832974 - DNA, 25 bp, Mus musculus
tgtgtctccaggaagaacctccggt

SEQ ID NO: 832975 - DNA, 25 bp, Mus musculus
tgtgtctccaggtagaacctccggt

SEQ ID NO: 832976 - DNA, 25 bp, Mus musculus
tgtgtctccattctggagaggctgc

SEQ ID NO: 832977 - DNA, 25 bp, Mus musculus
tgtgtctccattgtggagaggctgc

SEQ ID NO: 832978 - DNA, 25 bp, Mus musculus
tgtgtctcgaatataagctagccct

SEQ ID NO: 832979 - DNA, 25 bp, Mus musculus
tgtgtctcgaatttaagctagccct

SEQ ID NO: 832980 - DNA, 25 bp, Mus musculus
tgtgtctctcgtactgcaggcttcg

SEQ ID NO: 832981 - DNA, 25 bp, Mus musculus
tgtgtctctcgttctgcaggcttcg

SEQ ID NO: 832982 - DNA, 25 bp, Mus musculus
tgtgtctctgccatagctgttcgca

SEQ ID NO: 832983 - DNA, 25 bp, Mus musculus
tgtgtctctgccttagctgttcgca

SEQ ID NO: 832984 - DNA, 25 bp, Mus musculus
tgtgtctctggtacaaccagctcgc

SEQ ID NO: 832985 - DNA, 25 bp, Mus musculus
tgtgtctctggttcaaccagctcgc

SEQ ID NO: 832986 - DNA, 25 bp, Mus musculus
tgtgtctctgtcctcagcgttctcg

SEQ ID NO: 832987 - DNA, 25 bp, Mus musculus
tgtgtctctgtcgtcagcgttctcg

SEQ ID NO: 832988 - DNA, 25 bp, Mus musculus
tgtgtctctgttagctagagcttgg

SEQ ID NO: 832989 - DNA, 25 bp, Mus musculus
tgtgtctctgtttgctagagcttgg

SEQ ID NO: 832990 - DNA, 25 bp, Mus musculus
tgtgtctgatctagctaggaccgct

SEQ ID NO: 832991 - DNA, 25 bp, Mus musculus
tgtgtctgatcttgctaggaccgct

SEQ ID NO: 832992 - DNA, 25 bp, Mus musculus
tgtgtctgccgaacccaggcatgat

SEQ ID NO: 832993 - DNA, 25 bp, Mus musculus
tgtgtctgccgatcccaggcatgat

SEQ ID NO: 832994 - DNA, 25 bp, Mus musculus
tgtgtctgctctcagttcttccgcg

SEQ ID NO: 832995 - DNA, 25 bp, Mus musculus
tgtgtctgctctgagttcttccgcg

SEQ ID NO: 832996 - DNA, 25 bp, Mus musculus
tgtgtctggcaacgcagtcttgaca

SEQ ID NO: 832997 - DNA, 25 bp, Mus musculus
tgtgtctggcaaggcagtcttgaca

SEQ ID NO: 832998 - DNA, 25 bp, Mus musculus
tgtgtctggccaaaggtatgcctct

SEQ ID NO: 832999 - DNA, 25 bp, Mus musculus
tgtgtctggccataggtatgcctct

SEQ ID NO: 833000 - DNA, 25 bp, Mus musculus
tgtgtctggcttcgcaattttttcc

SEQ ID NO: 833001 - DNA, 25 bp, Mus musculus
tgtgtctggcttggcaattttttcc

SEQ ID NO: 833002 - DNA, 25 bp, Mus musculus
tgtgtctgggatcagtgacagctca

SEQ ID NO: 833003 - DNA, 25 bp, Mus musculus
tgtgtctgggatgagtgacagctca

SEQ ID NO: 833004 - DNA, 25 bp, Mus musculus
tgtgtctggtccagtttgaggacga

SEQ ID NO: 833005 - DNA, 25 bp, Mus musculus
tgtgtctggtcctgtttgaggacga

SEQ ID NO: 833006 - DNA, 25 bp, Mus musculus
tgtgtctggtctcgtttcccttgag

SEQ ID NO: 833007 - DNA, 25 bp, Mus musculus
tgtgtctggtctggtttcccttgag

SEQ ID NO: 833008 - DNA, 25 bp, Mus musculus
tgtgtctgtagcagtccaacagttt

SEQ ID NO: 833009 - DNA, 25 bp, Mus musculus
tgtgtctgtagctgtccaacagttt

SEQ ID NO: 833010 - DNA, 25 bp, Mus musculus
tgtgtctgtatgacccacccgaggt

SEQ ID NO: 833011 - DNA, 25 bp, Mus musculus
tgtgtctgtatgtcccacccgaggt

SEQ ID NO: 833012 - DNA, 25 bp, Mus musculus
tgtgtctgtgaactacgaccgccag

SEQ ID NO: 833013 - DNA, 25 bp, Mus musculus
tgtgtctgtgaagtacgaccgccag

SEQ ID NO: 833014 - DNA, 25 bp, Mus musculus
tgtgtcttaggacgctggagattct

SEQ ID NO: 833015 - DNA, 25 bp, Mus musculus
tgtgtcttaggaggctggagattct

SEQ ID NO: 833016 - DNA, 25 bp, Mus musculus
tgtgtcttcaccagactgtggagtg

SEQ ID NO: 833017 - DNA, 25 bp, Mus musculus
tgtgtcttcacctgactgtggagtg

SEQ ID NO: 833018 - DNA, 25 bp, Mus musculus
tgtgtcttcctccacggatgctagg

SEQ ID NO: 833019 - DNA, 25 bp, Mus musculus
tgtgtcttcctcgacggatgctagg

SEQ ID NO: 833020 - DNA, 25 bp, Mus musculus
tgtgtcttctggaacgccagtactc

SEQ ID NO: 833021 - DNA, 25 bp, Mus musculus
tgtgtcttctggtacgccagtactc

SEQ ID NO: 833022 - DNA, 25 bp, Mus musculus
tgtgtctttctaccgaagtccacgg

SEQ ID NO: 833023 - DNA, 25 bp, Mus musculus
tgtgtctttctagcgaagtccacgg

SEQ ID NO: 833024 - DNA, 25 bp, Mus musculus
tgtgtgaaagaccagaacggcaacc

SEQ ID NO: 833025 - DNA, 25 bp, Mus musculus
tgtgtgaaagacgagaacggcaacc

SEQ ID NO: 833026 - DNA, 25 bp, Mus musculus
tgtgtgaaatccaaagtggactgca

SEQ ID NO: 833027 - DNA, 25 bp, Mus musculus
tgtgtgaaatcctaagtggactgca

SEQ ID NO: 833028 - DNA, 25 bp, Mus musculus
tgtgtgaacagaagagagtccaggt

SEQ ID NO: 833029 - DNA, 25 bp, Mus musculus
tgtgtgaacagatgagagtccaggt

SEQ ID NO: 833030 - DNA, 25 bp, Mus musculus
tgtgtgaacgacaccaggctggctt

SEQ ID NO: 833031 - DNA, 25 bp, Mus musculus
tgtgtgaacgactccaggctggctt

SEQ ID NO: 833032 - DNA, 25 bp, Mus musculus
tgtgtgaagaaactcaaagaagaga

SEQ ID NO: 833033 - DNA, 25 bp, Mus musculus
tgtgtgaagaaagtcaaagaagaga

SEQ ID NO: 833034 - DNA, 25 bp, Mus musculus
tgtgtgaagaagaccaaactcccac

SEQ ID NO: 833035 - DNA, 25 bp, Mus musculus
tgtgtgaagaagtccaaactcccac

SEQ ID NO: 833036 - DNA, 25 bp, Mus musculus
tgtgtgaagagactcccctaagagg

SEQ ID NO: 833037 - DNA, 25 bp, Mus musculus
tgtgtgaagagagtcccctaagagg

SEQ ID NO: 833038 - DNA, 25 bp, Mus musculus
tgtgtgaagcaaaaggcgaacctca

SEQ ID NO: 833039 - DNA, 25 bp, Mus musculus
tgtgtgaagcaataggcgaacctca

SEQ ID NO: 833040 - DNA, 25 bp, Mus musculus
tgtgtgaagccccacgtcagcgtct

SEQ ID NO: 833041 - DNA, 25 bp, Mus musculus
tgtgtgaagcccgacgtcagcgtct

SEQ ID NO: 833042 - DNA, 25 bp, Mus musculus
tgtgtgaagcttaaaaggaacctac

SEQ ID NO: 833043 - DNA, 25 bp, Mus musculus
tgtgtgaagctttaaaggaacctac

SEQ ID NO: 833044 - DNA, 25 bp, Mus musculus
tgtgtgaagtagcttcctccctcag

SEQ ID NO: 833045 - DNA, 25 bp, Mus musculus
tgtgtgaagtaggttcctccctcag

SEQ ID NO: 833046 - DNA, 25 bp, Mus musculus
tgtgtgaagtgacctatgacaagac

SEQ ID NO: 833047 - DNA, 25 bp, Mus musculus
tgtgtgaagtgagctatgacaagac

SEQ ID NO: 833048 - DNA, 25 bp, Mus musculus
tgtgtgaatgcaaacgccgccaggc

SEQ ID NO: 833049 - DNA, 25 bp, Mus musculus
tgtgtgaatgcatacgccgccaggc

SEQ ID NO: 833050 - DNA, 25 bp, Mus musculus
tgtgtgacagacctgcacacgtgca

SEQ ID NO: 833051 - DNA, 25 bp, Mus musculus
tgtgtgacagacgtgcacacgtgca

SEQ ID NO: 833052 - DNA, 25 bp, Mus musculus
tgtgtgacagtcagagacctcttct

SEQ ID NO: 833053 - DNA, 25 bp, Mus musculus
tgtgtgacagtctgagacctcttct

SEQ ID NO: 833054 - DNA, 25 bp, Mus musculus
tgtgtgacattgatgccccattgct

SEQ ID NO: 833055 - DNA, 25 bp, Mus musculus
tgtgtgacattgttgccccattgct

SEQ ID NO: 833056 - DNA, 25 bp, Mus musculus
tgtgtgacccacagagctactgtcc

SEQ ID NO: 833057 - DNA, 25 bp, Mus musculus
tgtgtgacccactgagctactgtcc

SEQ ID NO: 833058 - DNA, 25 bp, Mus musculus
tgtgtgacgggcacacacaactgcc

SEQ ID NO: 833059 - DNA, 25 bp, Mus musculus
tgtgtgacgggctcacacaactgcc

SEQ ID NO: 833060 - DNA, 25 bp, Mus musculus
tgtgtgacttcaccggccatcttgg

SEQ ID NO: 833061 - DNA, 25 bp, Mus musculus
tgtgtgacttcagcggccatcttgg

SEQ ID NO: 833062 - DNA, 25 bp, Mus musculus
tgtgtgacttggaaaccaaattaca

SEQ ID NO: 833063 - DNA, 25 bp, Mus musculus
tgtgtgacttggtaaccaaattaca

SEQ ID NO: 833064 - DNA, 25 bp, Mus musculus
tgtgtgagaacaatgccggccacct

SEQ ID NO: 833065 - DNA, 25 bp, Mus musculus
tgtgtgagaacattgccggccacct

SEQ ID NO: 833066 - DNA, 25 bp, Mus musculus
tgtgtgagaaccatgaccatggccg

SEQ ID NO: 833067 - DNA, 25 bp, Mus musculus
tgtgtgagaaccttgaccatggccg

SEQ ID NO: 833068 - DNA, 25 bp, Mus musculus
tgtgtgagaccgagtgcacggacat

SEQ ID NO: 833069 - DNA, 25 bp, Mus musculus
tgtgtgagaccgtgtgcacggacat

SEQ ID NO: 833070 - DNA, 25 bp, Mus musculus
tgtgtgagatacagcatcgtgtacg

SEQ ID NO: 833071 - DNA, 25 bp, Mus musculus
tgtgtgagatactgcatcgtgtacg

SEQ ID NO: 833072 - DNA, 25 bp, Mus musculus
tgtgtgagcagcattgagaacatgg

SEQ ID NO: 833073 - DNA, 25 bp, Mus musculus
tgtgtgagcagctttgagaacatgg

SEQ ID NO: 833074 - DNA, 25 bp, Mus musculus
tgtgtgagccatccttgagtggcaa

SEQ ID NO: 833075 - DNA, 25 bp, Mus musculus
tgtgtgagccatgcttgagtggcaa

SEQ ID NO: 833076 - DNA, 25 bp, Mus musculus
tgtgtgagccgacggcctcctcagt

SEQ ID NO: 833077 - DNA, 25 bp, Mus musculus
tgtgtgagccgagggcctcctcagt

SEQ ID NO: 833078 - DNA, 25 bp, Mus musculus
tgtgtgagcctcagtacaggaatct

SEQ ID NO: 833079 - DNA, 25 bp, Mus musculus
tgtgtgagcctctgtacaggaatct

SEQ ID NO: 833080 - DNA, 25 bp, Mus musculus
tgtgtgagcctgagcagttcgctgt

SEQ ID NO: 833081 - DNA, 25 bp, Mus musculus
tgtgtgagcctgagtcgcagcagct

SEQ ID NO: 833082 - DNA, 25 bp, Mus musculus
tgtgtgagcctgtgcagttcgctgt

SEQ ID NO: 833083 - DNA, 25 bp, Mus musculus
tgtgtgagcctgtgtcgcagcagct

SEQ ID NO: 833084 - DNA, 25 bp, Mus musculus
tgtgtgagctctcttgttccaccga

SEQ ID NO: 833085 - DNA, 25 bp, Mus musculus
tgtgtgagctctgttgttccaccga

SEQ ID NO: 833086 - DNA, 25 bp, Mus musculus
tgtgtgagctggacgagagcaacac

SEQ ID NO: 833087 - DNA, 25 bp, Mus musculus
tgtgtgagctggtcgagagcaacac

SEQ ID NO: 833088 - DNA, 25 bp, Mus musculus
tgtgtgaggaatccacagacactct

SEQ ID NO: 833089 - DNA, 25 bp, Mus musculus
tgtgtgaggaatgcacagacactct

SEQ ID NO: 833090 - DNA, 25 bp, Mus musculus
tgtgtgaggcaaatctgcagtttca

SEQ ID NO: 833091 - DNA, 25 bp, Mus musculus
tgtgtgaggcaattctgcagtttca

SEQ ID NO: 833092 - DNA, 25 bp, Mus musculus
tgtgtgagttcaactgcaacatccg

SEQ ID NO: 833093 - DNA, 25 bp, Mus musculus
tgtgtgagttcatctgcaacatccg

SEQ ID NO: 833094 - DNA, 25 bp, Mus musculus
tgtgtgagtttaaccgggccaaccc

SEQ ID NO: 833095 - DNA, 25 bp, Mus musculus
tgtgtgagtttatccgggccaaccc

SEQ ID NO: 833096 - DNA, 25 bp, Mus musculus
tgtgtgatacataagtcctgtctgc

SEQ ID NO: 833097 - DNA, 25 bp, Mus musculus
tgtgtgatacattagtcctgtctgc

SEQ ID NO: 833098 - DNA, 25 bp, Mus musculus
tgtgtgatcaatcctatgtttgcca

SEQ ID NO: 833099 - DNA, 25 bp, Mus musculus
tgtgtgatcaatgctatgtttgcca

SEQ ID NO: 833100 - DNA, 25 bp, Mus musculus
tgtgtgatccacatccacacccttg

SEQ ID NO: 833101 - DNA, 25 bp, Mus musculus
tgtgtgatccacttccacacccttg

SEQ ID NO: 833102 - DNA, 25 bp, Mus musculus
tgtgtgatgatcacctagcaagagt

SEQ ID NO: 833103 - DNA, 25 bp, Mus musculus
tgtgtgatgatctcctagcaagagt

SEQ ID NO: 833104 - DNA, 25 bp, Mus musculus
tgtgtgatgcagacctggcgaaaga

SEQ ID NO: 833105 - DNA, 25 bp, Mus musculus
tgtgtgatgcagtcctggcgaaaga

SEQ ID NO: 833106 - DNA, 25 bp, Mus musculus
tgtgtgatggctatccccgttcggc

SEQ ID NO: 833107 - DNA, 25 bp, Mus musculus
tgtgtgatggctttccccgttcggc

SEQ ID NO: 833108 - DNA, 25 bp, Mus musculus
tgtgtgatgtcacgtctatgtccac

SEQ ID NO: 833109 - DNA, 25 bp, Mus musculus
tgtgtgatgtcaggtctatgtccac

SEQ ID NO: 833110 - DNA, 25 bp, Mus musculus
tgtgtgattcacaagaagggtttgg

SEQ ID NO: 833111 - DNA, 25 bp, Mus musculus
tgtgtgattcactagaagggtttgg

SEQ ID NO: 833112 - DNA, 25 bp, Mus musculus
tgtgtgattcagagaggaaacctcg

SEQ ID NO: 833113 - DNA, 25 bp, Mus musculus
tgtgtgattcagtgaggaaacctcg

SEQ ID NO: 833114 - DNA, 25 bp, Mus musculus
tgtgtgatttctcacatagcaagaa

SEQ ID NO: 833115 - DNA, 25 bp, Mus musculus
tgtgtgatttctgacatagcaagaa

SEQ ID NO: 833116 - DNA, 25 bp, Mus musculus
tgtgtgcaacatagcaacctgaacc

SEQ ID NO: 833117 - DNA, 25 bp, Mus musculus
tgtgtgcaacattgcaacctgaacc

SEQ ID NO: 833118 - DNA, 25 bp, Mus musculus
tgtgtgcaagccctgctatgtgaag

SEQ ID NO: 833119 - DNA, 25 bp, Mus musculus
tgtgtgcaagccgtgctatgtgaag

SEQ ID NO: 833120 - DNA, 25 bp, Mus musculus
tgtgtgcaagggaagagcagacccc

SEQ ID NO: 833121 - DNA, 25 bp, Mus musculus
tgtgtgcaagggtagagcagacccc

SEQ ID NO: 833122 - DNA, 25 bp, Mus musculus
tgtgtgcaatgtcaagaatccctcc

SEQ ID NO: 833123 - DNA, 25 bp, Mus musculus
tgtgtgcaatgtgaagaatccctcc

SEQ ID NO: 833124 - DNA, 25 bp, Mus musculus
tgtgtgcacagaatggacgcactta

SEQ ID NO: 833125 - DNA, 25 bp, Mus musculus
tgtgtgcacagattggacgcactta

SEQ ID NO: 833126 - DNA, 25 bp, Mus musculus
tgtgtgcacagcctgcaagaagcag

SEQ ID NO: 833127 - DNA, 25 bp, Mus musculus
tgtgtgcacagcgtgcaagaagcag

SEQ ID NO: 833128 - DNA, 25 bp, Mus musculus
tgtgtgcacgcacagctactccttc

SEQ ID NO: 833129 - DNA, 25 bp, Mus musculus
tgtgtgcacgcagagctactccttc

SEQ ID NO: 833130 - DNA, 25 bp, Mus musculus
tgtgtgcacgtgagcatgtatattg

SEQ ID NO: 833131 - DNA, 25 bp, Mus musculus
tgtgtgcacgtgtgcatgtatattg

SEQ ID NO: 833132 - DNA, 25 bp, Mus musculus
tgtgtgcactggctgtcaaaacacc

SEQ ID NO: 833133 - DNA, 25 bp, Mus musculus
tgtgtgcactgggtgtcaaaacacc

SEQ ID NO: 833134 - DNA, 25 bp, Mus musculus
tgtgtgcagattctaacagagttgc

SEQ ID NO: 833135 - DNA, 25 bp, Mus musculus
tgtgtgcagattgtaacagagttgc

SEQ ID NO: 833136 - DNA, 25 bp, Mus musculus
tgtgtgcagccaccccttgcgtggg

SEQ ID NO: 833137 - DNA, 25 bp, Mus musculus
tgtgtgcagccagcccttgcgtggg

SEQ ID NO: 833138 - DNA, 25 bp, Mus musculus
tgtgtgcagtggcatcaaaattccc

SEQ ID NO: 833139 - DNA, 25 bp, Mus musculus
tgtgtgcagtgggatcaaaattccc

SEQ ID NO: 833140 - DNA, 25 bp, Mus musculus
tgtgtgcatcccagacaggcactgg

SEQ ID NO: 833141 - DNA, 25 bp, Mus musculus
tgtgtgcatccctgacaggcactgg

SEQ ID NO: 833142 - DNA, 25 bp, Mus musculus
tgtgtgcatctacctcatcagctgc

SEQ ID NO: 833143 - DNA, 25 bp, Mus musculus
tgtgtgcatctagctcatcagctgc

SEQ ID NO: 833144 - DNA, 25 bp, Mus musculus
tgtgtgcatctgatcagccccgtgg

SEQ ID NO: 833145 - DNA, 25 bp, Mus musculus
tgtgtgcatctgttcagccccgtgg

SEQ ID NO: 833146 - DNA, 25 bp, Mus musculus
tgtgtgcattacagacaccagcctg

SEQ ID NO: 833147 - DNA, 25 bp, Mus musculus
tgtgtgcattactgacaccagcctg

SEQ ID NO: 833148 - DNA, 25 bp, Mus musculus
tgtgtgccaccgactgcctctttag

SEQ ID NO: 833149 - DNA, 25 bp, Mus musculus
tgtgtgccaccgtctgcctctttag

SEQ ID NO: 833150 - DNA, 25 bp, Mus musculus
tgtgtgccagaaaaggttccgtcag

SEQ ID NO: 833151 - DNA, 25 bp, Mus musculus
tgtgtgccagaataggttccgtcag

SEQ ID NO: 833152 - DNA, 25 bp, Mus musculus
tgtgtgccattaatgaggacctgct

SEQ ID NO: 833153 - DNA, 25 bp, Mus musculus
tgtgtgccattattgaggacctgct

SEQ ID NO: 833154 - DNA, 25 bp, Mus musculus
tgtgtgcccatgaagctcccacaga

SEQ ID NO: 833155 - DNA, 25 bp, Mus musculus
tgtgtgcccatgtagctcccacaga

SEQ ID NO: 833156 - DNA, 25 bp, Mus musculus
tgtgtgcccattcccaagcgtgagc

SEQ ID NO: 833157 - DNA, 25 bp, Mus musculus
tgtgtgcccattgccaagcgtgagc

SEQ ID NO: 833158 - DNA, 25 bp, Mus musculus
tgtgtgccctgcaggccgcaccggt

SEQ ID NO: 833159 - DNA, 25 bp, Mus musculus
tgtgtgccctgctggccgcaccggt

SEQ ID NO: 833160 - DNA, 25 bp, Mus musculus
tgtgtgcccttgcagaaagcaaggc

SEQ ID NO: 833161 - DNA, 25 bp, Mus musculus
tgtgtgcccttggagaaagcaaggc

SEQ ID NO: 833162 - DNA, 25 bp, Mus musculus
tgtgtgccgatactgtcaaacgcca

SEQ ID NO: 833163 - DNA, 25 bp, Mus musculus
tgtgtgccgatagtgtcaaacgcca

SEQ ID NO: 833164 - DNA, 25 bp, Mus musculus
tgtgtgccgcggcatgctgtcctcc

SEQ ID NO: 833165 - DNA, 25 bp, Mus musculus
tgtgtgccgcgggatgctgtcctcc

SEQ ID NO: 833166 - DNA, 25 bp, Mus musculus
tgtgtgccgctcatgctacagccag

SEQ ID NO: 833167 - DNA, 25 bp, Mus musculus
tgtgtgccgctcttgctacagccag

SEQ ID NO: 833168 - DNA, 25 bp, Mus musculus
tgtgtgcctcagcccagtggctatg

SEQ ID NO: 833169 - DNA, 25 bp, Mus musculus
tgtgtgcctcaggccagtggctatg

SEQ ID NO: 833170 - DNA, 25 bp, Mus musculus
tgtgtgcctcggaccttctgttgct

SEQ ID NO: 833171 - DNA, 25 bp, Mus musculus
tgtgtgcctcggtccttctgttgct

SEQ ID NO: 833172 - DNA, 25 bp, Mus musculus
tgtgtgccttgcctcctaccaagat

SEQ ID NO: 833173 - DNA, 25 bp, Mus musculus
tgtgtgccttgcgtcctaccaagat

SEQ ID NO: 833174 - DNA, 25 bp, Mus musculus
tgtgtgcgactcagcctttgagcag

SEQ ID NO: 833175 - DNA, 25 bp, Mus musculus
tgtgtgcgactctgcctttgagcag

SEQ ID NO: 833176 - DNA, 25 bp, Mus musculus
tgtgtgcgattcactcctgatggga

SEQ ID NO: 833177 - DNA, 25 bp, Mus musculus
tgtgtgcgattctctcctgatggga

SEQ ID NO: 833178 - DNA, 25 bp, Mus musculus
tgtgtgcgcaaccagagcactggct

SEQ ID NO: 833179 - DNA, 25 bp, Mus musculus
tgtgtgcgcaacgagagcactggct

SEQ ID NO: 833180 - DNA, 25 bp, Mus musculus
tgtgtgcgcagcagcctctgttctt

SEQ ID NO: 833181 - DNA, 25 bp, Mus musculus
tgtgtgcgcagctgcctctgttctt

SEQ ID NO: 833182 - DNA, 25 bp, Mus musculus
tgtgtgcgctgcagagttggcctct

SEQ ID NO: 833183 - DNA, 25 bp, Mus musculus
tgtgtgcgctgctgagttggcctct

SEQ ID NO: 833184 - DNA, 25 bp, Mus musculus
tgtgtgcgtgtacagcatgaacgat

SEQ ID NO: 833185 - DNA, 25 bp, Mus musculus
tgtgtgcgtgtagagcatgaacgat

SEQ ID NO: 833186 - DNA, 25 bp, Mus musculus
tgtgtgcgtgtcacctctagatgac

SEQ ID NO: 833187 - DNA, 25 bp, Mus musculus
tgtgtgcgtgtctcctctagatgac

SEQ ID NO: 833188 - DNA, 25 bp, Mus musculus
tgtgtgcgttccatccaattggacg

SEQ ID NO: 833189 - DNA, 25 bp, Mus musculus
tgtgtgcgttccttccaattggacg

SEQ ID NO: 833190 - DNA, 25 bp, Mus musculus
tgtgtgctagtgcacactggacggc

SEQ ID NO: 833191 - DNA, 25 bp, Mus musculus
tgtgtgctagtggacactggacggc

SEQ ID NO: 833192 - DNA, 25 bp, Mus musculus
tgtgtgctatctctctggaggagta

SEQ ID NO: 833193 - DNA, 25 bp, Mus musculus
tgtgtgctatctgtctggaggagta

SEQ ID NO: 833194 - DNA, 25 bp, Mus musculus
tgtgtgctccatagctccaaaaggc

SEQ ID NO: 833195 - DNA, 25 bp, Mus musculus
tgtgtgctccattgctccaaaaggc

SEQ ID NO: 833196 - DNA, 25 bp, Mus musculus
tgtgtgctcctcatgtgcacctact

SEQ ID NO: 833197 - DNA, 25 bp, Mus musculus
tgtgtgctcctcttgtgcacctact

SEQ ID NO: 833198 - DNA, 25 bp, Mus musculus
tgtgtgctcggccctctttctgctc

SEQ ID NO: 833199 - DNA, 25 bp, Mus musculus
tgtgtgctcggcgctctttctgctc

SEQ ID NO: 833200 - DNA, 25 bp, Mus musculus
tgtgtgctctacatccacgaagcct

SEQ ID NO: 833201 - DNA, 25 bp, Mus musculus
tgtgtgctctacttccacgaagcct

SEQ ID NO: 833202 - DNA, 25 bp, Mus musculus
tgtgtgctctctacaacattaggtc

SEQ ID NO: 833203 - DNA, 25 bp, Mus musculus
tgtgtgctctcttcaacattaggtc

SEQ ID NO: 833204 - DNA, 25 bp, Mus musculus
tgtgtgctgcacatgagacatgcgg

SEQ ID NO: 833205 - DNA, 25 bp, Mus musculus
tgtgtgctgcacttgagacatgcgg

SEQ ID NO: 833206 - DNA, 25 bp, Mus musculus
tgtgtgctgcctactcagatcgtgt

SEQ ID NO: 833207 - DNA, 25 bp, Mus musculus
tgtgtgctgccttctcagatcgtgt

SEQ ID NO: 833208 - DNA, 25 bp, Mus musculus
tgtgtgctgcgcacatgaggccgct

SEQ ID NO: 833209 - DNA, 25 bp, Mus musculus
tgtgtgctgcgctcatgaggccgct

SEQ ID NO: 833210 - DNA, 25 bp, Mus musculus
tgtgtgctggccaacgacgaagctc

SEQ ID NO: 833211 - DNA, 25 bp, Mus musculus
tgtgtgctggcctacgacgaagctc

SEQ ID NO: 833212 - DNA, 25 bp, Mus musculus
tgtgtgctggttccggcctgcatac

SEQ ID NO: 833213 - DNA, 25 bp, Mus musculus
tgtgtgctggttgcggcctgcatac

SEQ ID NO: 833214 - DNA, 25 bp, Mus musculus
tgtgtgcttaaaacaggcttccttt

SEQ ID NO: 833215 - DNA, 25 bp, Mus musculus
tgtgtgcttaaatcaggcttccttt

SEQ ID NO: 833216 - DNA, 25 bp, Mus musculus
tgtgtgcttcaccaggcatgagccc

SEQ ID NO: 833217 - DNA, 25 bp, Mus musculus
tgtgtgcttcacgaggcatgagccc

SEQ ID NO: 833218 - DNA, 25 bp, Mus musculus
tgtgtgcttcatcttcatggccggg

SEQ ID NO: 833219 - DNA, 25 bp, Mus musculus
tgtgtgcttcatgttcatggccggg

SEQ ID NO: 833220 - DNA, 25 bp, Mus musculus
tgtgtgcttcctagtcatcaattcc

SEQ ID NO: 833221 - DNA, 25 bp, Mus musculus
tgtgtgcttccttgtcatcaattcc

SEQ ID NO: 833222 - DNA, 25 bp, Mus musculus
tgtgtgcttggccaccacgaaactg

SEQ ID NO: 833223 - DNA, 25 bp, Mus musculus
tgtgtgcttggcgaccacgaaactg

SEQ ID NO: 833224 - DNA, 25 bp, Mus musculus
tgtgtgcttgtgagatttcattgtt

SEQ ID NO: 833225 - DNA, 25 bp, Mus musculus
tgtgtgcttgtgtgatttcattgtt

SEQ ID NO: 833226 - DNA, 25 bp, Mus musculus
tgtgtggaacctagtggaaccatct

SEQ ID NO: 833227 - DNA, 25 bp, Mus musculus
tgtgtggaaccttgtggaaccatct

SEQ ID NO: 833228 - DNA, 25 bp, Mus musculus
tgtgtggaagacaaccgcattccag

SEQ ID NO: 833229 - DNA, 25 bp, Mus musculus
tgtgtggaagactaccgcattccag

SEQ ID NO: 833230 - DNA, 25 bp, Mus musculus
tgtgtggacatgaccacaacctgca

SEQ ID NO: 833231 - DNA, 25 bp, Mus musculus
tgtgtggacatgtccacaacctgca

SEQ ID NO: 833232 - DNA, 25 bp, Mus musculus
tgtgtggacattcgcgaaaccagag

SEQ ID NO: 833233 - DNA, 25 bp, Mus musculus
tgtgtggacattggcgaaaccagag

SEQ ID NO: 833234 - DNA, 25 bp, Mus musculus
tgtgtggaccaacctgtagtaccgc

SEQ ID NO: 833235 - DNA, 25 bp, Mus musculus
tgtgtggaccaagctgtagtaccgc

SEQ ID NO: 833236 - DNA, 25 bp, Mus musculus
tgtgtggacggcctgaatacctaca

SEQ ID NO: 833237 - DNA, 25 bp, Mus musculus
tgtgtggacggcgtgaatacctaca

SEQ ID NO: 833238 - DNA, 25 bp, Mus musculus
tgtgtggactacatgcagagttcag

SEQ ID NO: 833239 - DNA, 25 bp, Mus musculus
tgtgtggactacttgcagagttcag

SEQ ID NO: 833240 - DNA, 25 bp, Mus musculus
tgtgtggactgaactcaagctggcc

SEQ ID NO: 833241 - DNA, 25 bp, Mus musculus
tgtgtggactgatctcaagctggcc

SEQ ID NO: 833242 - DNA, 25 bp, Mus musculus
tgtgtggagagaccgtctgtctcca

SEQ ID NO: 833243 - DNA, 25 bp, Mus musculus
tgtgtggagagagcgtctgtctcca

SEQ ID NO: 833244 - DNA, 25 bp, Mus musculus
tgtgtggagatgctcatcaaagaac

SEQ ID NO: 833245 - DNA, 25 bp, Mus musculus
tgtgtggagatggtcatcaaagaac

SEQ ID NO: 833246 - DNA, 25 bp, Mus musculus
tgtgtggagccactactgtctttgg

SEQ ID NO: 833247 - DNA, 25 bp, Mus musculus
tgtgtggagccagtactgtctttgg

SEQ ID NO: 833248 - DNA, 25 bp, Mus musculus
tgtgtggagcctaagccctctggtg

SEQ ID NO: 833249 - DNA, 25 bp, Mus musculus
tgtgtggagccttagccctctggtg

SEQ ID NO: 833250 - DNA, 25 bp, Mus musculus
tgtgtggaggtcatacagtcaatgc

SEQ ID NO: 833251 - DNA, 25 bp, Mus musculus
tgtgtggaggtcttacagtcaatgc

SEQ ID NO: 833252 - DNA, 25 bp, Mus musculus
tgtgtggatcttatgccgcaccagg

SEQ ID NO: 833253 - DNA, 25 bp, Mus musculus
tgtgtggatcttttgccgcaccagg

SEQ ID NO: 833254 - DNA, 25 bp, Mus musculus
tgtgtggatgctctgcacaagaccc

SEQ ID NO: 833255 - DNA, 25 bp, Mus musculus
tgtgtggatgctgtgcacaagaccc

SEQ ID NO: 833256 - DNA, 25 bp, Mus musculus
tgtgtggatggcagaatctgctttg

SEQ ID NO: 833257 - DNA, 25 bp, Mus musculus
tgtgtggatggctgaatctgctttg

SEQ ID NO: 833258 - DNA, 25 bp, Mus musculus
tgtgtggatgttaggcgtgacactc

SEQ ID NO: 833259 - DNA, 25 bp, Mus musculus
tgtgtggatgtttggcgtgacactc

SEQ ID NO: 833260 - DNA, 25 bp, Mus musculus
tgtgtggcaaaaagatacttgcaag

SEQ ID NO: 833261 - DNA, 25 bp, Mus musculus
tgtgtggcaaaatgatacttgcaag

SEQ ID NO: 833262 - DNA, 25 bp, Mus musculus
tgtgtggcacacatcgcaccaaggt

SEQ ID NO: 833263 - DNA, 25 bp, Mus musculus
tgtgtggcacacttcgcaccaaggt

SEQ ID NO: 833264 - DNA, 25 bp, Mus musculus
tgtgtggcacgaagagtccccatga

SEQ ID NO: 833265 - DNA, 25 bp, Mus musculus
tgtgtggcacgatgagtccccatga

SEQ ID NO: 833266 - DNA, 25 bp, Mus musculus
tgtgtggcactaagagtgacctgct

SEQ ID NO: 833267 - DNA, 25 bp, Mus musculus
tgtgtggcactatgagtgacctgct

SEQ ID NO: 833268 - DNA, 25 bp, Mus musculus
tgtgtggcagaaaaccttgtaggag

SEQ ID NO: 833269 - DNA, 25 bp, Mus musculus
tgtgtggcagaataccttgtaggag

SEQ ID NO: 833270 - DNA, 25 bp, Mus musculus
tgtgtggccaaaaacagcctgggca

SEQ ID NO: 833271 - DNA, 25 bp, Mus musculus
tgtgtggccaaatacagcctgggca

SEQ ID NO: 833272 - DNA, 25 bp, Mus musculus
tgtgtggccgatctcactgcgcatt

SEQ ID NO: 833273 - DNA, 25 bp, Mus musculus
tgtgtggccgatgtcactgcgcatt

SEQ ID NO: 833274 - DNA, 25 bp, Mus musculus
tgtgtggctactcttggctaccagc

SEQ ID NO: 833275 - DNA, 25 bp, Mus musculus
tgtgtggctactgttggctaccagc

SEQ ID NO: 833276 - DNA, 25 bp, Mus musculus
tgtgtggctcgcagacccatgaaga

SEQ ID NO: 833277 - DNA, 25 bp, Mus musculus
tgtgtggctcgctgacccatgaaga

SEQ ID NO: 833278 - DNA, 25 bp, Mus musculus
tgtgtggctgcaattgctgtgtctg

SEQ ID NO: 833279 - DNA, 25 bp, Mus musculus
tgtgtggctgcatttgctgtgtctg

SEQ ID NO: 833280 - DNA, 25 bp, Mus musculus
tgtgtggctgccaccagaagtacgc

SEQ ID NO: 833281 - DNA, 25 bp, Mus musculus
tgtgtggctgcctccagaagtacgc

SEQ ID NO: 833282 - DNA, 25 bp, Mus musculus
tgtgtggctggcaaccatgggtcta

SEQ ID NO: 833283 - DNA, 25 bp, Mus musculus
tgtgtggctggctaccatgggtcta

SEQ ID NO: 833284 - DNA, 25 bp, Mus musculus
tgtgtggcttctccatacactggga

SEQ ID NO: 833285 - DNA, 25 bp, Mus musculus
tgtgtggcttctgcatacactggga

SEQ ID NO: 833286 - DNA, 25 bp, Mus musculus
tgtgtgggaccgctgcctacaaccc

SEQ ID NO: 833287 - DNA, 25 bp, Mus musculus
tgtgtgggaccggtgcctacaaccc

SEQ ID NO: 833288 - DNA, 25 bp, Mus musculus
tgtgtgggacttcgcgtgaaaccac

SEQ ID NO: 833289 - DNA, 25 bp, Mus musculus
tgtgtgggacttggcgtgaaaccac

SEQ ID NO: 833290 - DNA, 25 bp, Mus musculus
tgtgtgggcagcatcatcctagcgg

SEQ ID NO: 833291 - DNA, 25 bp, Mus musculus
tgtgtgggcagcttcatcctagcgg

SEQ ID NO: 833292 - DNA, 25 bp, Mus musculus
tgtgtgggcatcagccagcttccag

SEQ ID NO: 833293 - DNA, 25 bp, Mus musculus
tgtgtgggcatctgccagcttccag

SEQ ID NO: 833294 - DNA, 25 bp, Mus musculus
tgtgtgggccacaataaccatcgct

SEQ ID NO: 833295 - DNA, 25 bp, Mus musculus
tgtgtgggccactataaccatcgct

SEQ ID NO: 833296 - DNA, 25 bp, Mus musculus
tgtgtgggctgtagagcctcagctt

SEQ ID NO: 833297 - DNA, 25 bp, Mus musculus
tgtgtgggctgttgagcctcagctt

SEQ ID NO: 833298 - DNA, 25 bp, Mus musculus
tgtgtggtaagacgtcaaaatgatt

SEQ ID NO: 833299 - DNA, 25 bp, Mus musculus
tgtgtggtaagaggtcaaaatgatt

SEQ ID NO: 833300 - DNA, 25 bp, Mus musculus
tgtgtggtcgtgatacctttcccag

SEQ ID NO: 833301 - DNA, 25 bp, Mus musculus
tgtgtggtcgtgttacctttcccag

SEQ ID NO: 833302 - DNA, 25 bp, Mus musculus
tgtgtggtgaccaagcagggttccc

SEQ ID NO: 833303 - DNA, 25 bp, Mus musculus
tgtgtggtgacctagcagggttccc

SEQ ID NO: 833304 - DNA, 25 bp, Mus musculus
tgtgtggtgagcagccgccttgcca

SEQ ID NO: 833305 - DNA, 25 bp, Mus musculus
tgtgtggtgagctgccgccttgcca

SEQ ID NO: 833306 - DNA, 25 bp, Mus musculus
tgtgtggtgattcatggcatgcctc

SEQ ID NO: 833307 - DNA, 25 bp, Mus musculus
tgtgtggtgattgatggcatgcctc

SEQ ID NO: 833308 - DNA, 25 bp, Mus musculus
tgtgtggtgctcacgagcatcgctg

SEQ ID NO: 833309 - DNA, 25 bp, Mus musculus
tgtgtggtgctctcgagcatcgctg

SEQ ID NO: 833310 - DNA, 25 bp, Mus musculus
tgtgtggtggatcttccagaatccc

SEQ ID NO: 833311 - DNA, 25 bp, Mus musculus
tgtgtggtggatgttccagaatccc

SEQ ID NO: 833312 - DNA, 25 bp, Mus musculus
tgtgtggtgtgtcgagaccgggcca

SEQ ID NO: 833313 - DNA, 25 bp, Mus musculus
tgtgtggtgtgtggagaccgggcca

SEQ ID NO: 833314 - DNA, 25 bp, Mus musculus
tgtgtggtgttacttccgcctggaa

SEQ ID NO: 833315 - DNA, 25 bp, Mus musculus
tgtgtggtgttagttccgcctggaa

SEQ ID NO: 833316 - DNA, 25 bp, Mus musculus
tgtgtggtttggacgaattccaact

SEQ ID NO: 833317 - DNA, 25 bp, Mus musculus
tgtgtggtttggtcgaattccaact

SEQ ID NO: 833318 - DNA, 25 bp, Mus musculus
tgtgtgtaagccagaggaccgcttg

SEQ ID NO: 833319 - DNA, 25 bp, Mus musculus
tgtgtgtaagcctgaggaccgcttg

SEQ ID NO: 833320 - DNA, 25 bp, Mus musculus
tgtgtgtacagtagcaggctgtaac

SEQ ID NO: 833321 - DNA, 25 bp, Mus musculus
tgtgtgtacagttgcaggctgtaac

SEQ ID NO: 833322 - DNA, 25 bp, Mus musculus
tgtgtgtagacaccctgaccagtga

SEQ ID NO: 833323 - DNA, 25 bp, Mus musculus
tgtgtgtagacagcctgaccagtga

SEQ ID NO: 833324 - DNA, 25 bp, Mus musculus
tgtgtgtagtacactatctgtgagt

SEQ ID NO: 833325 - DNA, 25 bp, Mus musculus
tgtgtgtagtactctatctgtgagt

SEQ ID NO: 833326 - DNA, 25 bp, Mus musculus
tgtgtgtataagactgttcaagcaa

SEQ ID NO: 833327 - DNA, 25 bp, Mus musculus
tgtgtgtataagtctgttcaagcaa

SEQ ID NO: 833328 - DNA, 25 bp, Mus musculus
tgtgtgtataggagcatggacagca

SEQ ID NO: 833329 - DNA, 25 bp, Mus musculus
tgtgtgtataggtgcatggacagca

SEQ ID NO: 833330 - DNA, 25 bp, Mus musculus
tgtgtgtatatgcaacgctgcgcta

SEQ ID NO: 833331 - DNA, 25 bp, Mus musculus
tgtgtgtatatggaacgctgcgcta

SEQ ID NO: 833332 - DNA, 25 bp, Mus musculus
tgtgtgtatcttatgggcagtggtt

SEQ ID NO: 833333 - DNA, 25 bp, Mus musculus
tgtgtgtatcttttgggcagtggtt

SEQ ID NO: 833334 - DNA, 25 bp, Mus musculus
tgtgtgtccagtctgagccccggct

SEQ ID NO: 833335 - DNA, 25 bp, Mus musculus
tgtgtgtccagtgtgagccccggct

SEQ ID NO: 833336 - DNA, 25 bp, Mus musculus
tgtgtgtccgccctgcttcttggga

SEQ ID NO: 833337 - DNA, 25 bp, Mus musculus
tgtgtgtccgccgtgcttcttggga

SEQ ID NO: 833338 - DNA, 25 bp, Mus musculus
tgtgtgtcctcaacttggagttgcc

SEQ ID NO: 833339 - DNA, 25 bp, Mus musculus
tgtgtgtcctcatcttggagttgcc

SEQ ID NO: 833340 - DNA, 25 bp, Mus musculus
tgtgtgtcgcagaaaacaaaaacca

SEQ ID NO: 833341 - DNA, 25 bp, Mus musculus
tgtgtgtcgcagtaaacaaaaacca

SEQ ID NO: 833342 - DNA, 25 bp, Mus musculus
tgtgtgtcgctcagagaccgtggta

SEQ ID NO: 833343 - DNA, 25 bp, Mus musculus
tgtgtgtcgctctgagaccgtggta

SEQ ID NO: 833344 - DNA, 25 bp, Mus musculus
tgtgtgtctagtcaaccccaagaag

SEQ ID NO: 833345 - DNA, 25 bp, Mus musculus
tgtgtgtctagtgaaccccaagaag

SEQ ID NO: 833346 - DNA, 25 bp, Mus musculus
tgtgtgtctctcctactgcaggctt

SEQ ID NO: 833347 - DNA, 25 bp, Mus musculus
tgtgtgtctctcgtactgcaggctt

SEQ ID NO: 833348 - DNA, 25 bp, Mus musculus
tgtgtgtctctgaccatccagactc

SEQ ID NO: 833349 - DNA, 25 bp, Mus musculus
tgtgtgtctctgtccatccagactc

SEQ ID NO: 833350 - DNA, 25 bp, Mus musculus
tgtgtgtctggcaaggcagtcttga

SEQ ID NO: 833351 - DNA, 25 bp, Mus musculus
tgtgtgtctggctaggcagtcttga

SEQ ID NO: 833352 - DNA, 25 bp, Mus musculus
tgtgtgtgacacagatcacatggag

SEQ ID NO: 833353 - DNA, 25 bp, Mus musculus
tgtgtgtgacactgatcacatggag

SEQ ID NO: 833354 - DNA, 25 bp, Mus musculus
tgtgtgtgacagaggttatcatact

SEQ ID NO: 833355 - DNA, 25 bp, Mus musculus
tgtgtgtgacagtggttatcatact

SEQ ID NO: 833356 - DNA, 25 bp, Mus musculus
tgtgtgtgagcccagggcctcctca

SEQ ID NO: 833357 - DNA, 25 bp, Mus musculus
tgtgtgtgagccgagggcctcctca

SEQ ID NO: 833358 - DNA, 25 bp, Mus musculus
tgtgtgtgcagtagtctgggaccct

SEQ ID NO: 833359 - DNA, 25 bp, Mus musculus
tgtgtgtgcagttgtctgggaccct

SEQ ID NO: 833360 - DNA, 25 bp, Mus musculus
tgtgtgtgcctcacatcggctggac

SEQ ID NO: 833361 - DNA, 25 bp, Mus musculus
tgtgtgtgcctctcatcggctggac

SEQ ID NO: 833362 - DNA, 25 bp, Mus musculus
tgtgtgtgcgccagatctgtgctgt

SEQ ID NO: 833363 - DNA, 25 bp, Mus musculus
tgtgtgtgcgcctgatctgtgctgt

SEQ ID NO: 833364 - DNA, 25 bp, Mus musculus
tgtgtgtgcgctcgacccagttggg

SEQ ID NO: 833365 - DNA, 25 bp, Mus musculus
tgtgtgtgcgctggacccagttggg

SEQ ID NO: 833366 - DNA, 25 bp, Mus musculus
tgtgtgtgctcaagtatctattcga

SEQ ID NO: 833367 - DNA, 25 bp, Mus musculus
tgtgtgtgctcatgtatctattcga

SEQ ID NO: 833368 - DNA, 25 bp, Mus musculus
tgtgtgtgctgacacgagaacccag

SEQ ID NO: 833369 - DNA, 25 bp, Mus musculus
tgtgtgtgctgagacgagaacccag

SEQ ID NO: 833370 - DNA, 25 bp, Mus musculus
tgtgtgtgcttaaaacaggcttcct

SEQ ID NO: 833371 - DNA, 25 bp, Mus musculus
tgtgtgtgcttataacaggcttcct

SEQ ID NO: 833372 - DNA, 25 bp, Mus musculus
tgtgtgtggactctagtttccgcaa

SEQ ID NO: 833373 - DNA, 25 bp, Mus musculus
tgtgtgtggactgtagtttccgcaa

SEQ ID NO: 833374 - DNA, 25 bp, Mus musculus
tgtgtgtgtctcaatctcgcgtcta

SEQ ID NO: 833375 - DNA, 25 bp, Mus musculus
tgtgtgtgtctctatctcgcgtcta

SEQ ID NO: 833376 - DNA, 25 bp, Mus musculus
tgtgtgtgttggaggaagctcttcc

SEQ ID NO: 833377 - DNA, 25 bp, Mus musculus
tgtgtgtgttggtggaagctcttcc

SEQ ID NO: 833378 - DNA, 25 bp, Mus musculus
tgtgtgttacccagctgtgatacca

SEQ ID NO: 833379 - DNA, 25 bp, Mus musculus
tgtgtgttaccctgctgtgatacca

SEQ ID NO: 833380 - DNA, 25 bp, Mus musculus
tgtgtgttcccgatcatctttgagg

SEQ ID NO: 833381 - DNA, 25 bp, Mus musculus
tgtgtgttcccgttcatctttgagg

SEQ ID NO: 833382 - DNA, 25 bp, Mus musculus
tgtgtgttctggaccatccatggac

SEQ ID NO: 833383 - DNA, 25 bp, Mus musculus
tgtgtgttctggtccatccatggac

SEQ ID NO: 833384 - DNA, 25 bp, Mus musculus
tgtgtgttcttaaacggcgctcagc

SEQ ID NO: 833385 - DNA, 25 bp, Mus musculus
tgtgtgttcttatacggcgctcagc

SEQ ID NO: 833386 - DNA, 25 bp, Mus musculus
tgtgtgttgaaaagaccaagaaatg

SEQ ID NO: 833387 - DNA, 25 bp, Mus musculus
tgtgtgttgaaatgaccaagaaatg

SEQ ID NO: 833388 - DNA, 25 bp, Mus musculus
tgtgtgtttccaaaatggcggcggc

SEQ ID NO: 833389 - DNA, 25 bp, Mus musculus
tgtgtgtttccataatggcggcggc

SEQ ID NO: 833390 - DNA, 25 bp, Mus musculus
tgtgtgtttgttctttgaactgtcg

SEQ ID NO: 833391 - DNA, 25 bp, Mus musculus
tgtgtgtttgttgtttgaactgtcg

SEQ ID NO: 833392 - DNA, 25 bp, Mus musculus
tgtgtgttttgacccagcacagtta

SEQ ID NO: 833393 - DNA, 25 bp, Mus musculus
tgtgtgttttgagccagcacagtta

SEQ ID NO: 833394 - DNA, 25 bp, Mus musculus
tgtgttaagcaacgccggcaagcag

SEQ ID NO: 833395 - DNA, 25 bp, Mus musculus
tgtgttaagcaaggccggcaagcag

SEQ ID NO: 833396 - DNA, 25 bp, Mus musculus
tgtgttaccaagcttatggtcaccc

SEQ ID NO: 833397 - DNA, 25 bp, Mus musculus
tgtgttaccaaggttatggtcaccc

SEQ ID NO: 833398 - DNA, 25 bp, Mus musculus
tgtgttacttgcctggcctcaaccg

SEQ ID NO: 833399 - DNA, 25 bp, Mus musculus
tgtgttacttgcgtggcctcaaccg

SEQ ID NO: 833400 - DNA, 25 bp, Mus musculus
tgtgttagaaagaggtaaatcttca

SEQ ID NO: 833401 - DNA, 25 bp, Mus musculus
tgtgttagaaagtggtaaatcttca

SEQ ID NO: 833402 - DNA, 25 bp, Mus musculus
tgtgttagcaaaaggaaacactgca

SEQ ID NO: 833403 - DNA, 25 bp, Mus musculus
tgtgttagcaaatggaaacactgca

SEQ ID NO: 833404 - DNA, 25 bp, Mus musculus
tgtgttagctgtcagaatgactgct

SEQ ID NO: 833405 - DNA, 25 bp, Mus musculus
tgtgttagctgtgagaatgactgct

SEQ ID NO: 833406 - DNA, 25 bp, Mus musculus
tgtgttaggaaacaaactggacctt

SEQ ID NO: 833407 - DNA, 25 bp, Mus musculus
tgtgttaggaaagaaactggacctt

SEQ ID NO: 833408 - DNA, 25 bp, Mus musculus
tgtgttagtcttctgaggacctcga

SEQ ID NO: 833409 - DNA, 25 bp, Mus musculus
tgtgttagtcttgtgaggacctcga

SEQ ID NO: 833410 - DNA, 25 bp, Mus musculus
tgtgttagtgtgctctacgaattgt

SEQ ID NO: 833411 - DNA, 25 bp, Mus musculus
tgtgttagtgtggtctacgaattgt

SEQ ID NO: 833412 - DNA, 25 bp, Mus musculus
tgtgttatattgcttgcaagctggt

SEQ ID NO: 833413 - DNA, 25 bp, Mus musculus
tgtgttatattggttgcaagctggt

SEQ ID NO: 833414 - DNA, 25 bp, Mus musculus
tgtgttatcttacggccaggccaat

SEQ ID NO: 833415 - DNA, 25 bp, Mus musculus
tgtgttatcttagggccaggccaat

SEQ ID NO: 833416 - DNA, 25 bp, Mus musculus
tgtgttattcccaggccctattgcc

SEQ ID NO: 833417 - DNA, 25 bp, Mus musculus
tgtgttattccctggccctattgcc

SEQ ID NO: 833418 - DNA, 25 bp, Mus musculus
tgtgttattgaaccacaactgggtt

SEQ ID NO: 833419 - DNA, 25 bp, Mus musculus
tgtgttattgaagcacaactgggtt

SEQ ID NO: 833420 - DNA, 25 bp, Mus musculus
tgtgttcaacaactccatataagga

SEQ ID NO: 833421 - DNA, 25 bp, Mus musculus
tgtgttcaacaagtccatataagga

SEQ ID NO: 833422 - DNA, 25 bp, Mus musculus
tgtgttcacaccagatgagtctctg

SEQ ID NO: 833423 - DNA, 25 bp, Mus musculus
tgtgttcacacctgatgagtctctg

SEQ ID NO: 833424 - DNA, 25 bp, Mus musculus
tgtgttcacactccctgcagggaga

SEQ ID NO: 833425 - DNA, 25 bp, Mus musculus
tgtgttcacactgcctgcagggaga

SEQ ID NO: 833426 - DNA, 25 bp, Mus musculus
tgtgttcacagcatttgacctaacc

SEQ ID NO: 833427 - DNA, 25 bp, Mus musculus
tgtgttcacagcttttgacctaacc

SEQ ID NO: 833428 - DNA, 25 bp, Mus musculus
tgtgttcaccgacacttggcggcca

SEQ ID NO: 833429 - DNA, 25 bp, Mus musculus
tgtgttcaccgagacttggcggcca

SEQ ID NO: 833430 - DNA, 25 bp, Mus musculus
tgtgttcacttcaatgtagccgtcg

SEQ ID NO: 833431 - DNA, 25 bp, Mus musculus
tgtgttcacttctatgtagccgtcg

SEQ ID NO: 833432 - DNA, 25 bp, Mus musculus
tgtgttcagatacttggttcccagc

SEQ ID NO: 833433 - DNA, 25 bp, Mus musculus
tgtgttcagatagttggttcccagc

SEQ ID NO: 833434 - DNA, 25 bp, Mus musculus
tgtgttcagctccaagcccaaattc

SEQ ID NO: 833435 - DNA, 25 bp, Mus musculus
tgtgttcagctcgaagcccaaattc

SEQ ID NO: 833436 - DNA, 25 bp, Mus musculus
tgtgttcaggtacagagatgctcca

SEQ ID NO: 833437 - DNA, 25 bp, Mus musculus
tgtgttcaggtagagagatgctcca

SEQ ID NO: 833438 - DNA, 25 bp, Mus musculus
tgtgttcagtgcacccagcctttga

SEQ ID NO: 833439 - DNA, 25 bp, Mus musculus
tgtgttcagtgctcccagcctttga

SEQ ID NO: 833440 - DNA, 25 bp, Mus musculus
tgtgttcatcacaaaagcagggaga

SEQ ID NO: 833441 - DNA, 25 bp, Mus musculus
tgtgttcatcactaaagcagggaga

SEQ ID NO: 833442 - DNA, 25 bp, Mus musculus
tgtgttcatccacgaggctccctag

SEQ ID NO: 833443 - DNA, 25 bp, Mus musculus
tgtgttcatccaggaggctccctag

SEQ ID NO: 833444 - DNA, 25 bp, Mus musculus
tgtgttcattgaccagcccacacca

SEQ ID NO: 833445 - DNA, 25 bp, Mus musculus
tgtgttcattgagcagcccacacca

SEQ ID NO: 833446 - DNA, 25 bp, Mus musculus
tgtgttccatatcacaagacaagga

SEQ ID NO: 833447 - DNA, 25 bp, Mus musculus
tgtgttccatatgacaagacaagga

SEQ ID NO: 833448 - DNA, 25 bp, Mus musculus
tgtgttcccaacacggagccttggg

SEQ ID NO: 833449 - DNA, 25 bp, Mus musculus
tgtgttcccaactcggagccttggg

SEQ ID NO: 833450 - DNA, 25 bp, Mus musculus
tgtgttcccagcaatggctttctgc

SEQ ID NO: 833451 - DNA, 25 bp, Mus musculus
tgtgttcccagctatggctttctgc

SEQ ID NO: 833452 - DNA, 25 bp, Mus musculus
tgtgttcccggaagcgccggtttga

SEQ ID NO: 833453 - DNA, 25 bp, Mus musculus
tgtgttcccggatgcgccggtttga

SEQ ID NO: 833454 - DNA, 25 bp, Mus musculus
tgtgttcccggtcttgccacagtgc

SEQ ID NO: 833455 - DNA, 25 bp, Mus musculus
tgtgttcccggtgttgccacagtgc

SEQ ID NO: 833456 - DNA, 25 bp, Mus musculus
tgtgttcccgtccatgcacaagtac

SEQ ID NO: 833457 - DNA, 25 bp, Mus musculus
tgtgttcccgtcgatgcacaagtac

SEQ ID NO: 833458 - DNA, 25 bp, Mus musculus
tgtgttcccttcactaggcacttcg

SEQ ID NO: 833459 - DNA, 25 bp, Mus musculus
tgtgttcccttctctaggcacttcg

SEQ ID NO: 833460 - DNA, 25 bp, Mus musculus
tgtgttccgacaaatacctaaagtt

SEQ ID NO: 833461 - DNA, 25 bp, Mus musculus
tgtgttccgacatatacctaaagtt

SEQ ID NO: 833462 - DNA, 25 bp, Mus musculus
tgtgttccgcgcctcttgctctcga

SEQ ID NO: 833463 - DNA, 25 bp, Mus musculus
tgtgttccgcgcgtcttgctctcga

SEQ ID NO: 833464 - DNA, 25 bp, Mus musculus
tgtgttcctcatcaactgggccaag

SEQ ID NO: 833465 - DNA, 25 bp, Mus musculus
tgtgttcctcatgaactgggccaag

SEQ ID NO: 833466 - DNA, 25 bp, Mus musculus
tgtgttcctgaaagcctcgtctctg

SEQ ID NO: 833467 - DNA, 25 bp, Mus musculus
tgtgttcctgaacgccaagacccgg

SEQ ID NO: 833468 - DNA, 25 bp, Mus musculus
tgtgttcctgaaggccaagacccgg

SEQ ID NO: 833469 - DNA, 25 bp, Mus musculus
tgtgttcctgaatgcctcgtctctg

SEQ ID NO: 833470 - DNA, 25 bp, Mus musculus
tgtgttcctgcccaggacaactgcc

SEQ ID NO: 833471 - DNA, 25 bp, Mus musculus
tgtgttcctgccgaggacaactgcc

SEQ ID NO: 833472 - DNA, 25 bp, Mus musculus
tgtgttcctgctcttcgcagtgtcc

SEQ ID NO: 833473 - DNA, 25 bp, Mus musculus
tgtgttcctgctgttcgcagtgtcc

SEQ ID NO: 833474 - DNA, 25 bp, Mus musculus
tgtgttcctggtcgtttacaaagcc

SEQ ID NO: 833475 - DNA, 25 bp, Mus musculus
tgtgttcctggtggtttacaaagcc

SEQ ID NO: 833476 - DNA, 25 bp, Mus musculus
tgtgttccttctacaagtacagagt

SEQ ID NO: 833477 - DNA, 25 bp, Mus musculus
tgtgttccttcttcaagtacagagt

SEQ ID NO: 833478 - DNA, 25 bp, Mus musculus
tgtgttcgcaatagacttctacctg

SEQ ID NO: 833479 - DNA, 25 bp, Mus musculus
tgtgttcgcaattgacttctacctg

SEQ ID NO: 833480 - DNA, 25 bp, Mus musculus
tgtgttcgcgggatgcccgcacaaa

SEQ ID NO: 833481 - DNA, 25 bp, Mus musculus
tgtgttcgcgggttgcccgcacaaa

SEQ ID NO: 833482 - DNA, 25 bp, Mus musculus
tgtgttctaagcagaagcaacctct

SEQ ID NO: 833483 - DNA, 25 bp, Mus musculus
tgtgttctaagctgaagcaacctct

SEQ ID NO: 833484 - DNA, 25 bp, Mus musculus
tgtgttctacttagcatccgttcct

SEQ ID NO: 833485 - DNA, 25 bp, Mus musculus
tgtgttctactttgcatccgttcct

SEQ ID NO: 833486 - DNA, 25 bp, Mus musculus
tgtgttctagctatgagcgctgccg

SEQ ID NO: 833487 - DNA, 25 bp, Mus musculus
tgtgttctagctttgagcgctgccg

SEQ ID NO: 833488 - DNA, 25 bp, Mus musculus
tgtgttctatgaaaggctgcatgag

SEQ ID NO: 833489 - DNA, 25 bp, Mus musculus
tgtgttctatgataggctgcatgag

SEQ ID NO: 833490 - DNA, 25 bp, Mus musculus
tgtgttctccgtagtgttttcctcc

SEQ ID NO: 833491 - DNA, 25 bp, Mus musculus
tgtgttctccgttgtgttttcctcc

SEQ ID NO: 833492 - DNA, 25 bp, Mus musculus
tgtgttctgaacacttgcttcgaga

SEQ ID NO: 833493 - DNA, 25 bp, Mus musculus
tgtgttctgaactcttgcttcgaga

SEQ ID NO: 833494 - DNA, 25 bp, Mus musculus
tgtgttctggaaacggagtcaatga

SEQ ID NO: 833495 - DNA, 25 bp, Mus musculus
tgtgttctggaatcggagtcaatga

SEQ ID NO: 833496 - DNA, 25 bp, Mus musculus
tgtgttctgtgtaccgctcctgggt

SEQ ID NO: 833497 - DNA, 25 bp, Mus musculus
tgtgttctgtgttccgctcctgggt

SEQ ID NO: 833498 - DNA, 25 bp, Mus musculus
tgtgttgaatgtattacttcgaggc

SEQ ID NO: 833499 - DNA, 25 bp, Mus musculus
tgtgttgaatgttttacttcgaggc

SEQ ID NO: 833500 - DNA, 25 bp, Mus musculus
tgtgttgacacaccaggagcttgca

SEQ ID NO: 833501 - DNA, 25 bp, Mus musculus
tgtgttgacacagcaggagcttgca

SEQ ID NO: 833502 - DNA, 25 bp, Mus musculus
tgtgttgagtcaccaaagaagattt

SEQ ID NO: 833503 - DNA, 25 bp, Mus musculus
tgtgttgagtcagcaaagaagattt

SEQ ID NO: 833504 - DNA, 25 bp, Mus musculus
tgtgttgagtgcaaacgtgtcccaa

SEQ ID NO: 833505 - DNA, 25 bp, Mus musculus
tgtgttgagtgctaacgtgtcccaa

SEQ ID NO: 833506 - DNA, 25 bp, Mus musculus
tgtgttgatgaccactactctggag

SEQ ID NO: 833507 - DNA, 25 bp, Mus musculus
tgtgttgatgacgactactctggag

SEQ ID NO: 833508 - DNA, 25 bp, Mus musculus
tgtgttgcagctagtagaccctgat

SEQ ID NO: 833509 - DNA, 25 bp, Mus musculus
tgtgttgcagcttgtagaccctgat

SEQ ID NO: 833510 - DNA, 25 bp, Mus musculus
tgtgttgcttagcaagctcctgctg

SEQ ID NO: 833511 - DNA, 25 bp, Mus musculus
tgtgttgcttaggaagctcctgctg

SEQ ID NO: 833512 - DNA, 25 bp, Mus musculus
tgtgttgcttgcctgggtagtcccc

SEQ ID NO: 833513 - DNA, 25 bp, Mus musculus
tgtgttgcttgcgtgggtagtcccc

SEQ ID NO: 833514 - DNA, 25 bp, Mus musculus
tgtgttggacagaggatgtgactct

SEQ ID NO: 833515 - DNA, 25 bp, Mus musculus
tgtgttggacagtggatgtgactct

SEQ ID NO: 833516 - DNA, 25 bp, Mus musculus
tgtgttggcgatctgacagaaaatc

SEQ ID NO: 833517 - DNA, 25 bp, Mus musculus
tgtgttggcgatgtgacagaaaatc

SEQ ID NO: 833518 - DNA, 25 bp, Mus musculus
tgtgttggcttcatcagatggcgca

SEQ ID NO: 833519 - DNA, 25 bp, Mus musculus
tgtgttggcttcttcagatggcgca

SEQ ID NO: 833520 - DNA, 25 bp, Mus musculus
tgtgttggtgcacccaaccaccaac

SEQ ID NO: 833521 - DNA, 25 bp, Mus musculus
tgtgttggtgcagccaaccaccaac

SEQ ID NO: 833522 - DNA, 25 bp, Mus musculus
tgtgttggtgttagccaggctctca

SEQ ID NO: 833523 - DNA, 25 bp, Mus musculus
tgtgttggtgtttgccaggctctca

SEQ ID NO: 833524 - DNA, 25 bp, Mus musculus
tgtgttgtccctcgtctacctgtgc

SEQ ID NO: 833525 - DNA, 25 bp, Mus musculus
tgtgttgtccctggtctacctgtgc

SEQ ID NO: 833526 - DNA, 25 bp, Mus musculus
tgtgttgtgctcagtaattgggtaa

SEQ ID NO: 833527 - DNA, 25 bp, Mus musculus
tgtgttgtgctctgtaattgggtaa

SEQ ID NO: 833528 - DNA, 25 bp, Mus musculus
tgtgttgtgcttactatcctggcca

SEQ ID NO: 833529 - DNA, 25 bp, Mus musculus
tgtgttgtgctttctatcctggcca

SEQ ID NO: 833530 - DNA, 25 bp, Mus musculus
tgtgtttcaacgataccgcctggag

SEQ ID NO: 833531 - DNA, 25 bp, Mus musculus
tgtgtttcaacgttaccgcctggag

SEQ ID NO: 833532 - DNA, 25 bp, Mus musculus
tgtgtttcacgtacaagcctgtgat

SEQ ID NO: 833533 - DNA, 25 bp, Mus musculus
tgtgtttcacgttcaagcctgtgat

SEQ ID NO: 833534 - DNA, 25 bp, Mus musculus
tgtgtttcagtgactaccccatccc

SEQ ID NO: 833535 - DNA, 25 bp, Mus musculus
tgtgtttcagtgtctaccccatccc

SEQ ID NO: 833536 - DNA, 25 bp, Mus musculus
tgtgtttccacacccgaggctgtgt

SEQ ID NO: 833537 - DNA, 25 bp, Mus musculus
tgtgtttccacagccgaggctgtgt

SEQ ID NO: 833538 - DNA, 25 bp, Mus musculus
tgtgtttccaccacaatcttcagga

SEQ ID NO: 833539 - DNA, 25 bp, Mus musculus
tgtgtttccacctcaatcttcagga

SEQ ID NO: 833540 - DNA, 25 bp, Mus musculus
tgtgtttccagaccgaatctcagcc

SEQ ID NO: 833541 - DNA, 25 bp, Mus musculus
tgtgtttccagagcgaatctcagcc

SEQ ID NO: 833542 - DNA, 25 bp, Mus musculus
tgtgtttccccaagggcagcgatag

SEQ ID NO: 833543 - DNA, 25 bp, Mus musculus
tgtgtttccccatgggcagcgatag

SEQ ID NO: 833544 - DNA, 25 bp, Mus musculus
tgtgtttctagaactactttgagag

SEQ ID NO: 833545 - DNA, 25 bp, Mus musculus
tgtgtttctagatctactttgagag

SEQ ID NO: 833546 - DNA, 25 bp, Mus musculus
tgtgtttctcttcgtccctcctgaa

SEQ ID NO: 833547 - DNA, 25 bp, Mus musculus
tgtgtttctcttggtccctcctgaa

SEQ ID NO: 833548 - DNA, 25 bp, Mus musculus
tgtgtttctggtcgaactctatgga

SEQ ID NO: 833549 - DNA, 25 bp, Mus musculus
tgtgtttctggtggaactctatgga

SEQ ID NO: 833550 - DNA, 25 bp, Mus musculus
tgtgtttgaccaacggatgaagtgc

SEQ ID NO: 833551 - DNA, 25 bp, Mus musculus
tgtgtttgaccatcggatgaagtgc

SEQ ID NO: 833552 - DNA, 25 bp, Mus musculus
tgtgtttgagcgcttccagtctgtc

SEQ ID NO: 833553 - DNA, 25 bp, Mus musculus
tgtgtttgagcggttccagtctgtc

SEQ ID NO: 833554 - DNA, 25 bp, Mus musculus
tgtgtttgccagctaccaggtgaac

SEQ ID NO: 833555 - DNA, 25 bp, Mus musculus
tgtgtttgccaggtaccaggtgaac

SEQ ID NO: 833556 - DNA, 25 bp, Mus musculus
tgtgtttgcggccactattccacgc

SEQ ID NO: 833557 - DNA, 25 bp, Mus musculus
tgtgtttgcggcgactattccacgc

SEQ ID NO: 833558 - DNA, 25 bp, Mus musculus
tgtgtttgctctcactcactccagg

SEQ ID NO: 833559 - DNA, 25 bp, Mus musculus
tgtgtttgctctgactcactccagg

SEQ ID NO: 833560 - DNA, 25 bp, Mus musculus
tgtgtttgcttcctgtgttgttgtc

SEQ ID NO: 833561 - DNA, 25 bp, Mus musculus
tgtgtttgcttcgtgtgttgttgtc

SEQ ID NO: 833562 - DNA, 25 bp, Mus musculus
tgtgtttgggccagcttaggacctg

SEQ ID NO: 833563 - DNA, 25 bp, Mus musculus
tgtgtttgggcctgcttaggacctg

SEQ ID NO: 833564 - DNA, 25 bp, Mus musculus
tgtgtttgtccaccagacccaggac

SEQ ID NO: 833565 - DNA, 25 bp, Mus musculus
tgtgtttgtccagcagacccaggac

SEQ ID NO: 833566 - DNA, 25 bp, Mus musculus
tgtgtttgtccccacaggccagcag

SEQ ID NO: 833567 - DNA, 25 bp, Mus musculus
tgtgtttgtcccgacaggccagcag

SEQ ID NO: 833568 - DNA, 25 bp, Mus musculus
tgtgtttgtgtcagtagcctagaag

SEQ ID NO: 833569 - DNA, 25 bp, Mus musculus
tgtgtttgtgtctgtagcctagaag

SEQ ID NO: 833570 - DNA, 25 bp, Mus musculus
tgtgttttactaagcatcgtctttc

SEQ ID NO: 833571 - DNA, 25 bp, Mus musculus
tgtgttttactatgcatcgtctttc

SEQ ID NO: 833572 - DNA, 25 bp, Mus musculus
tgtgttttcaagaggctcgtatgag

SEQ ID NO: 833573 - DNA, 25 bp, Mus musculus
tgtgttttcaagtggctcgtatgag

SEQ ID NO: 833574 - DNA, 25 bp, Mus musculus
tgtgttttccccaatgtaggtgaat

SEQ ID NO: 833575 - DNA, 25 bp, Mus musculus
tgtgttttcccctatgtaggtgaat

SEQ ID NO: 833576 - DNA, 25 bp, Mus musculus
tgtgttttcctgatccgggctcggg

SEQ ID NO: 833577 - DNA, 25 bp, Mus musculus
tgtgttttcctgttccgggctcggg

SEQ ID NO: 833578 - DNA, 25 bp, Mus musculus
tgtgttttcggtaacaccaatggga

SEQ ID NO: 833579 - DNA, 25 bp, Mus musculus
tgtgttttcggttacaccaatggga

SEQ ID NO: 833580 - DNA, 25 bp, Mus musculus
tgtgttttctctctcaagtactgca

SEQ ID NO: 833581 - DNA, 25 bp, Mus musculus
tgtgttttctctgtcaagtactgca

SEQ ID NO: 833582 - DNA, 25 bp, Mus musculus
tgttaaaaccctcatcataactggt

SEQ ID NO: 833583 - DNA, 25 bp, Mus musculus
tgttaaaaccctgatcataactggt

SEQ ID NO: 833584 - DNA, 25 bp, Mus musculus
tgttaaaagactcctgaataaactg

SEQ ID NO: 833585 - DNA, 25 bp, Mus musculus
tgttaaaagactgctgaataaactg

SEQ ID NO: 833586 - DNA, 25 bp, Mus musculus
tgttaaaagattcagtaagagactc

SEQ ID NO: 833587 - DNA, 25 bp, Mus musculus
tgttaaaagattgagtaagagactc

SEQ ID NO: 833588 - DNA, 25 bp, Mus musculus
tgttaaaatcctcaagcagcaagac

SEQ ID NO: 833589 - DNA, 25 bp, Mus musculus
tgttaaaatcctgaagcagcaagac

SEQ ID NO: 833590 - DNA, 25 bp, Mus musculus
tgttaaacgaatactggaaaatcca

SEQ ID NO: 833591 - DNA, 25 bp, Mus musculus
tgttaaacgaattctggaaaatcca

SEQ ID NO: 833592 - DNA, 25 bp, Mus musculus
tgttaaagactccactgtgactcgg

SEQ ID NO: 833593 - DNA, 25 bp, Mus musculus
tgttaaagactcgactgtgactcgg

SEQ ID NO: 833594 - DNA, 25 bp, Mus musculus
tgttaaagagaccagcacgcacatc

SEQ ID NO: 833595 - DNA, 25 bp, Mus musculus
tgttaaagagacgagcacgcacatc

SEQ ID NO: 833596 - DNA, 25 bp, Mus musculus
tgttaaaggatcaccacgatgcctg

SEQ ID NO: 833597 - DNA, 25 bp, Mus musculus
tgttaaaggatcatgatgactctga

SEQ ID NO: 833598 - DNA, 25 bp, Mus musculus
tgttaaaggatctccacgatgcctg

SEQ ID NO: 833599 - DNA, 25 bp, Mus musculus
tgttaaaggatcttgatgactctga

SEQ ID NO: 833600 - DNA, 25 bp, Mus musculus
tgttaaaggcacaggtgtcttccca

SEQ ID NO: 833601 - DNA, 25 bp, Mus musculus
tgttaaaggcactggtgtcttccca

SEQ ID NO: 833602 - DNA, 25 bp, Mus musculus
tgttaaatccagcttgtgctgccca

SEQ ID NO: 833603 - DNA, 25 bp, Mus musculus
tgttaaatccaggttgtgctgccca

SEQ ID NO: 833604 - DNA, 25 bp, Mus musculus
tgttaaatgactactgggctcgcct

SEQ ID NO: 833605 - DNA, 25 bp, Mus musculus
tgttaaatgacttctgggctcgcct

SEQ ID NO: 833606 - DNA, 25 bp, Mus musculus
tgttaaatttctaaccagcctgagt

SEQ ID NO: 833607 - DNA, 25 bp, Mus musculus
tgttaaatttcttaccagcctgagt

SEQ ID NO: 833608 - DNA, 25 bp, Mus musculus
tgttaacaacccaccagatttctac

SEQ ID NO: 833609 - DNA, 25 bp, Mus musculus
tgttaacaaccctccagatttctac

SEQ ID NO: 833610 - DNA, 25 bp, Mus musculus
tgttaacattaacgagatctgttgg

SEQ ID NO: 833611 - DNA, 25 bp, Mus musculus
tgttaacattaaggagatctgttgg

SEQ ID NO: 833612 - DNA, 25 bp, Mus musculus
tgttaaccagaacgtaaccctgagt

SEQ ID NO: 833613 - DNA, 25 bp, Mus musculus
tgttaaccagaaggtaaccctgagt

SEQ ID NO: 833614 - DNA, 25 bp, Mus musculus
tgttaaccatgaagatgtttttgag

SEQ ID NO: 833615 - DNA, 25 bp, Mus musculus
tgttaaccatgatgatgtttttgag

SEQ ID NO: 833616 - DNA, 25 bp, Mus musculus
tgttaacccaacaagctcattggct

SEQ ID NO: 833617 - DNA, 25 bp, Mus musculus
tgttaacccaactagctcattggct

SEQ ID NO: 833618 - DNA, 25 bp, Mus musculus
tgttaacccagcagcactattgtga

SEQ ID NO: 833619 - DNA, 25 bp, Mus musculus
tgttaacccagctgcactattgtga

SEQ ID NO: 833620 - DNA, 25 bp, Mus musculus
tgttaaccctcacagcatgggtctg

SEQ ID NO: 833621 - DNA, 25 bp, Mus musculus
tgttaaccctcagagcatgggtctg

SEQ ID NO: 833622 - DNA, 25 bp, Mus musculus
tgttaaccgtggagtgtccctggga

SEQ ID NO: 833623 - DNA, 25 bp, Mus musculus
tgttaaccgtggtgtgtccctggga

SEQ ID NO: 833624 - DNA, 25 bp, Mus musculus
tgttaactacaaccaccgtgtgcag

SEQ ID NO: 833625 - DNA, 25 bp, Mus musculus
tgttaactacaagcaccgtgtgcag

SEQ ID NO: 833626 - DNA, 25 bp, Mus musculus
tgttaactactaagtcgacacagct

SEQ ID NO: 833627 - DNA, 25 bp, Mus musculus
tgttaactactatgtcgacacagct

SEQ ID NO: 833628 - DNA, 25 bp, Mus musculus
tgttaactcattccagcaaactaca

SEQ ID NO: 833629 - DNA, 25 bp, Mus musculus
tgttaactcattgcagcaaactaca

SEQ ID NO: 833630 - DNA, 25 bp, Mus musculus
tgttaactggaacgagctgatcatg

SEQ ID NO: 833631 - DNA, 25 bp, Mus musculus
tgttaactggaaggagctgatcatg

SEQ ID NO: 833632 - DNA, 25 bp, Mus musculus
tgttaagaataaccagctccgggct

SEQ ID NO: 833633 - DNA, 25 bp, Mus musculus
tgttaagaataagcagctccgggct

SEQ ID NO: 833634 - DNA, 25 bp, Mus musculus
tgttaagaatcacttacaggagctg

SEQ ID NO: 833635 - DNA, 25 bp, Mus musculus
tgttaagaatcagttacaggagctg

SEQ ID NO: 833636 - DNA, 25 bp, Mus musculus
tgttaagacaatcaggtaatgcatt

SEQ ID NO: 833637 - DNA, 25 bp, Mus musculus
tgttaagacaatgaggtaatgcatt

SEQ ID NO: 833638 - DNA, 25 bp, Mus musculus
tgttaagagtgccaaaggagtgtca

SEQ ID NO: 833639 - DNA, 25 bp, Mus musculus
tgttaagagtgcgaaaggagtgtca

SEQ ID NO: 833640 - DNA, 25 bp, Mus musculus
tgttaagcttatcaaaactctgtgt

SEQ ID NO: 833641 - DNA, 25 bp, Mus musculus
tgttaagcttatgaaaactctgtgt

SEQ ID NO: 833642 - DNA, 25 bp, Mus musculus
tgttaaggaagcaatgccaaggtcc

SEQ ID NO: 833643 - DNA, 25 bp, Mus musculus
tgttaaggaagctatgccaaggtcc

SEQ ID NO: 833644 - DNA, 25 bp, Mus musculus
tgttaaggccaaagaacagattgaa

SEQ ID NO: 833645 - DNA, 25 bp, Mus musculus
tgttaaggccaatgaacagattgaa

SEQ ID NO: 833646 - DNA, 25 bp, Mus musculus
tgttaagggaccatggaccaaagag

SEQ ID NO: 833647 - DNA, 25 bp, Mus musculus
tgttaagggaccttggaccaaagag

SEQ ID NO: 833648 - DNA, 25 bp, Mus musculus
tgttaaggtacaaccaaatagccct

SEQ ID NO: 833649 - DNA, 25 bp, Mus musculus
tgttaaggtacatccaaatagccct

SEQ ID NO: 833650 - DNA, 25 bp, Mus musculus
tgttaaggtatgcagcatgagcaga

SEQ ID NO: 833651 - DNA, 25 bp, Mus musculus
tgttaaggtatggagcatgagcaga

SEQ ID NO: 833652 - DNA, 25 bp, Mus musculus
tgttaagtagaaactggactcatcc

SEQ ID NO: 833653 - DNA, 25 bp, Mus musculus
tgttaagtagaatctggactcatcc

SEQ ID NO: 833654 - DNA, 25 bp, Mus musculus
tgttaatactccagttaaggaacag

SEQ ID NO: 833655 - DNA, 25 bp, Mus musculus
tgttaatactcctgttaaggaacag

SEQ ID NO: 833656 - DNA, 25 bp, Mus musculus
tgttaatagcatcaaaagaagccga

SEQ ID NO: 833657 - DNA, 25 bp, Mus musculus
tgttaatagcatgaaaagaagccga

SEQ ID NO: 833658 - DNA, 25 bp, Mus musculus
tgttaatatgctcctgtcttatggg

SEQ ID NO: 833659 - DNA, 25 bp, Mus musculus
tgttaatatgctgctgtcttatggg

SEQ ID NO: 833660 - DNA, 25 bp, Mus musculus
tgttaatattctcaaagcccatggg

SEQ ID NO: 833661 - DNA, 25 bp, Mus musculus
tgttaatattctgaaagcccatggg

SEQ ID NO: 833662 - DNA, 25 bp, Mus musculus
tgttaatgaagaaactttcaaggag

SEQ ID NO: 833663 - DNA, 25 bp, Mus musculus
tgttaatgaagatactttcaaggag

SEQ ID NO: 833664 - DNA, 25 bp, Mus musculus
tgttaatgaaggagggcagaagata

SEQ ID NO: 833665 - DNA, 25 bp, Mus musculus
tgttaatgaaggtgggcagaagata

SEQ ID NO: 833666 - DNA, 25 bp, Mus musculus
tgttaatgcacaagcgtagggaccc

SEQ ID NO: 833667 - DNA, 25 bp, Mus musculus
tgttaatgcacatgcgtagggaccc

SEQ ID NO: 833668 - DNA, 25 bp, Mus musculus
tgttaatggaacagagaaaaagacc

SEQ ID NO: 833669 - DNA, 25 bp, Mus musculus
tgttaatggaactgagaaaaagacc

SEQ ID NO: 833670 - DNA, 25 bp, Mus musculus
tgttaatggaccagcaagacagaaa

SEQ ID NO: 833671 - DNA, 25 bp, Mus musculus
tgttaatggacctgcaagacagaaa

SEQ ID NO: 833672 - DNA, 25 bp, Mus musculus
tgttaattcccaacaggccacagga

SEQ ID NO: 833673 - DNA, 25 bp, Mus musculus
tgttaattcccatcaggccacagga

SEQ ID NO: 833674 - DNA, 25 bp, Mus musculus
tgttaattctggatacatgcaggat

SEQ ID NO: 833675 - DNA, 25 bp, Mus musculus
tgttaattctggttacatgcaggat

SEQ ID NO: 833676 - DNA, 25 bp, Mus musculus
tgttaattgactcgcacacaagggt

SEQ ID NO: 833677 - DNA, 25 bp, Mus musculus
tgttaattgactggcacacaagggt

SEQ ID NO: 833678 - DNA, 25 bp, Mus musculus
tgttacaacgtgctggtcattgtgc

SEQ ID NO: 833679 - DNA, 25 bp, Mus musculus
tgttacaacgtggtggtcattgtgc

SEQ ID NO: 833680 - DNA, 25 bp, Mus musculus
tgttacaatcttcggcttttgctag

SEQ ID NO: 833681 - DNA, 25 bp, Mus musculus
tgttacaatcttgggcttttgctag

SEQ ID NO: 833682 - DNA, 25 bp, Mus musculus
tgttacactgcgaactggaatccac

SEQ ID NO: 833683 - DNA, 25 bp, Mus musculus
tgttacactgcgtactggaatccac

SEQ ID NO: 833684 - DNA, 25 bp, Mus musculus
tgttacagaataagctggctctgga

SEQ ID NO: 833685 - DNA, 25 bp, Mus musculus
tgttacagaatatgctggctctgga

SEQ ID NO: 833686 - DNA, 25 bp, Mus musculus
tgttacagatgaatgtcgaagaaag

SEQ ID NO: 833687 - DNA, 25 bp, Mus musculus
tgttacagatgacctggatgctccc

SEQ ID NO: 833688 - DNA, 25 bp, Mus musculus
tgttacagatgagctggatgctccc

SEQ ID NO: 833689 - DNA, 25 bp, Mus musculus
tgttacagatgattgtcgaagaaag

SEQ ID NO: 833690 - DNA, 25 bp, Mus musculus
tgttacagcaaactttagagcattt

SEQ ID NO: 833691 - DNA, 25 bp, Mus musculus
tgttacagcaaagtttagagcattt

SEQ ID NO: 833692 - DNA, 25 bp, Mus musculus
tgttacagcaacaagaagagcgata

SEQ ID NO: 833693 - DNA, 25 bp, Mus musculus
tgttacagcaactagaagagcgata

SEQ ID NO: 833694 - DNA, 25 bp, Mus musculus
tgttacagcagccaacttattggca

SEQ ID NO: 833695 - DNA, 25 bp, Mus musculus
tgttacagcagcgaacttattggca

SEQ ID NO: 833696 - DNA, 25 bp, Mus musculus
tgttacaggtatcctaagaaggccc

SEQ ID NO: 833697 - DNA, 25 bp, Mus musculus
tgttacaggtatgctaagaaggccc

SEQ ID NO: 833698 - DNA, 25 bp, Mus musculus
tgttacagtgatcccgccgccaaga

SEQ ID NO: 833699 - DNA, 25 bp, Mus musculus
tgttacagtgatgccgccgccaaga

SEQ ID NO: 833700 - DNA, 25 bp, Mus musculus
tgttacagtggtatctgcagttctg

SEQ ID NO: 833701 - DNA, 25 bp, Mus musculus
tgttacagtggtttctgcagttctg

SEQ ID NO: 833702 - DNA, 25 bp, Mus musculus
tgttacagttggatttctcaccaga

SEQ ID NO: 833703 - DNA, 25 bp, Mus musculus
tgttacagttggttttctcaccaga

SEQ ID NO: 833704 - DNA, 25 bp, Mus musculus
tgttacataaaacctgtgagcagcg

SEQ ID NO: 833705 - DNA, 25 bp, Mus musculus
tgttacataaaagctgtgagcagcg

SEQ ID NO: 833706 - DNA, 25 bp, Mus musculus
tgttacatcagaactcagccttcag

SEQ ID NO: 833707 - DNA, 25 bp, Mus musculus
tgttacatcagatctcagccttcag

SEQ ID NO: 833708 - DNA, 25 bp, Mus musculus
tgttacatctgcagcaaacctcagg

SEQ ID NO: 833709 - DNA, 25 bp, Mus musculus
tgttacatctgctgcaaacctcagg

SEQ ID NO: 833710 - DNA, 25 bp, Mus musculus
tgttaccacggacctggacagctgg

SEQ ID NO: 833711 - DNA, 25 bp, Mus musculus
tgttaccacggagctggacagctgg

SEQ ID NO: 833712 - DNA, 25 bp, Mus musculus
tgttaccactacataaaactcctgt

SEQ ID NO: 833713 - DNA, 25 bp, Mus musculus
tgttaccactacttaaaactcctgt

SEQ ID NO: 833714 - DNA, 25 bp, Mus musculus
tgttaccagataaatatgggtggcc

SEQ ID NO: 833715 - DNA, 25 bp, Mus musculus
tgttaccagatatatatgggtggcc

SEQ ID NO: 833716 - DNA, 25 bp, Mus musculus
tgttaccagtgcaatggagtcccat

SEQ ID NO: 833717 - DNA, 25 bp, Mus musculus
tgttaccagtgctatggagtcccat

SEQ ID NO: 833718 - DNA, 25 bp, Mus musculus
tgttaccatcttcgcactctggctt

SEQ ID NO: 833719 - DNA, 25 bp, Mus musculus
tgttaccatcttggcactctggctt

SEQ ID NO: 833720 - DNA, 25 bp, Mus musculus
tgttaccccagaagtagcagtgtcc

SEQ ID NO: 833721 - DNA, 25 bp, Mus musculus
tgttaccccagatgtagcagtgtcc

SEQ ID NO: 833722 - DNA, 25 bp, Mus musculus
tgttaccctgtgacgtgctggtgcg

SEQ ID NO: 833723 - DNA, 25 bp, Mus musculus
tgttaccctgtgcaccatggtgtcc

SEQ ID NO: 833724 - DNA, 25 bp, Mus musculus
tgttaccctgtggaccatggtgtcc

SEQ ID NO: 833725 - DNA, 25 bp, Mus musculus
tgttaccctgtgtcgtgctggtgcg

SEQ ID NO: 833726 - DNA, 25 bp, Mus musculus
tgttacctagcactaagctgacaga

SEQ ID NO: 833727 - DNA, 25 bp, Mus musculus
tgttacctagcagtaagctgacaga

SEQ ID NO: 833728 - DNA, 25 bp, Mus musculus
tgttacctcaagaggcggagacctg

SEQ ID NO: 833729 - DNA, 25 bp, Mus musculus
tgttacctcaagtggcggagacctg

SEQ ID NO: 833730 - DNA, 25 bp, Mus musculus
tgttacctccaacagtccttgcaag

SEQ ID NO: 833731 - DNA, 25 bp, Mus musculus
tgttacctccaagagtccttgcaag

SEQ ID NO: 833732 - DNA, 25 bp, Mus musculus
tgttacctccgcaactcacaagggc

SEQ ID NO: 833733 - DNA, 25 bp, Mus musculus
tgttacctccgctactcacaagggc

SEQ ID NO: 833734 - DNA, 25 bp, Mus musculus
tgttacctctgcacgctgtattctt

SEQ ID NO: 833735 - DNA, 25 bp, Mus musculus
tgttacctctgctcgctgtattctt

SEQ ID NO: 833736 - DNA, 25 bp, Mus musculus
tgttacctgccaagccaggaagtgg

SEQ ID NO: 833737 - DNA, 25 bp, Mus musculus
tgttacctgccatgccaggaagtgg

SEQ ID NO: 833738 - DNA, 25 bp, Mus musculus
tgttacctgtggctcctgctctcca

SEQ ID NO: 833739 - DNA, 25 bp, Mus musculus
tgttacctgtgggtcctgctctcca

SEQ ID NO: 833740 - DNA, 25 bp, Mus musculus
tgttacctgttcaatgacagagcct

SEQ ID NO: 833741 - DNA, 25 bp, Mus musculus
tgttacctgttctatgacagagcct

SEQ ID NO: 833742 - DNA, 25 bp, Mus musculus
tgttacgaatgtcttggtgagccac

SEQ ID NO: 833743 - DNA, 25 bp, Mus musculus
tgttacgaatgtgttggtgagccac

SEQ ID NO: 833744 - DNA, 25 bp, Mus musculus
tgttacgccatgaaaatatcctggg

SEQ ID NO: 833745 - DNA, 25 bp, Mus musculus
tgttacgccatgtaaatatcctggg

SEQ ID NO: 833746 - DNA, 25 bp, Mus musculus
tgttacgccctgacggctctgcagt

SEQ ID NO: 833747 - DNA, 25 bp, Mus musculus
tgttacgccctgtcggctctgcagt

SEQ ID NO: 833748 - DNA, 25 bp, Mus musculus
tgttacggacaacatgaggattgcc

SEQ ID NO: 833749 - DNA, 25 bp, Mus musculus
tgttacggacaagatgaggattgcc

SEQ ID NO: 833750 - DNA, 25 bp, Mus musculus
tgttacggaggtcacggacttcacc

SEQ ID NO: 833751 - DNA, 25 bp, Mus musculus
tgttacggaggtgacggacttcacc

SEQ ID NO: 833752 - DNA, 25 bp, Mus musculus
tgttacgggtataatttgacaaaga

SEQ ID NO: 833753 - DNA, 25 bp, Mus musculus
tgttacgggtattatttgacaaaga

SEQ ID NO: 833754 - DNA, 25 bp, Mus musculus
tgttacgtgcttatggccaggcggc

SEQ ID NO: 833755 - DNA, 25 bp, Mus musculus
tgttacgtgcttttggccaggcggc

SEQ ID NO: 833756 - DNA, 25 bp, Mus musculus
tgttactagacacccaaatgaagtg

SEQ ID NO: 833757 - DNA, 25 bp, Mus musculus
tgttactagacagccaaatgaagtg

SEQ ID NO: 833758 - DNA, 25 bp, Mus musculus
tgttactagaggaggagatcccgtc

SEQ ID NO: 833759 - DNA, 25 bp, Mus musculus
tgttactagaggtggagatcccgtc

SEQ ID NO: 833760 - DNA, 25 bp, Mus musculus
tgttactcatgcctcccgtgctgag

SEQ ID NO: 833761 - DNA, 25 bp, Mus musculus
tgttactcatgcgtcccgtgctgag

SEQ ID NO: 833762 - DNA, 25 bp, Mus musculus
tgttactcgtctagtgacttcctgt

SEQ ID NO: 833763 - DNA, 25 bp, Mus musculus
tgttactcgtcttgtgacttcctgt

SEQ ID NO: 833764 - DNA, 25 bp, Mus musculus
tgttactctcctagagctaaaagag

SEQ ID NO: 833765 - DNA, 25 bp, Mus musculus
tgttactctccttgagctaaaagag

SEQ ID NO: 833766 - DNA, 25 bp, Mus musculus
tgttactgaggtcacaagcctgccc

SEQ ID NO: 833767 - DNA, 25 bp, Mus musculus
tgttactgaggtgacaagcctgccc

SEQ ID NO: 833768 - DNA, 25 bp, Mus musculus
tgttactgtgacaaccgtcccaact

SEQ ID NO: 833769 - DNA, 25 bp, Mus musculus
tgttactgtgactaccgtcccaact

SEQ ID NO: 833770 - DNA, 25 bp, Mus musculus
tgttacttcttcactgtggcccaga

SEQ ID NO: 833771 - DNA, 25 bp, Mus musculus
tgttacttcttctctgtggcccaga

SEQ ID NO: 833772 - DNA, 25 bp, Mus musculus
tgttacttgaaacccagcaggaagg

SEQ ID NO: 833773 - DNA, 25 bp, Mus musculus
tgttacttgaaagccagcaggaagg

SEQ ID NO: 833774 - DNA, 25 bp, Mus musculus
tgttagaacaccacctagagaagga

SEQ ID NO: 833775 - DNA, 25 bp, Mus musculus
tgttagaacacctcctagagaagga

SEQ ID NO: 833776 - DNA, 25 bp, Mus musculus
tgttagaacgatagagtaggactta

SEQ ID NO: 833777 - DNA, 25 bp, Mus musculus
tgttagaacgattgagtaggactta

SEQ ID NO: 833778 - DNA, 25 bp, Mus musculus
tgttagaactctatgaacaaaaccg

SEQ ID NO: 833779 - DNA, 25 bp, Mus musculus
tgttagaactctttgaacaaaaccg

SEQ ID NO: 833780 - DNA, 25 bp, Mus musculus
tgttagaccctcatcctgaaggagc

SEQ ID NO: 833781 - DNA, 25 bp, Mus musculus
tgttagaccctcttcctgaaggagc

SEQ ID NO: 833782 - DNA, 25 bp, Mus musculus
tgttagacctctccatttcccagca

SEQ ID NO: 833783 - DNA, 25 bp, Mus musculus
tgttagacctctgcatttcccagca

SEQ ID NO: 833784 - DNA, 25 bp, Mus musculus
tgttagactcccaccaacggaagtc

SEQ ID NO: 833785 - DNA, 25 bp, Mus musculus
tgttagactccctccaacggaagtc

SEQ ID NO: 833786 - DNA, 25 bp, Mus musculus
tgttagagaccacttgtagcaatgg

SEQ ID NO: 833787 - DNA, 25 bp, Mus musculus
tgttagagaccagttgtagcaatgg

SEQ ID NO: 833788 - DNA, 25 bp, Mus musculus
tgttagagcagacttcagaggcccc

SEQ ID NO: 833789 - DNA, 25 bp, Mus musculus
tgttagagcagagttcagaggcccc

SEQ ID NO: 833790 - DNA, 25 bp, Mus musculus
tgttagaggcccagaaggaatatga

SEQ ID NO: 833791 - DNA, 25 bp, Mus musculus
tgttagaggccctgaaggaatatga

SEQ ID NO: 833792 - DNA, 25 bp, Mus musculus
tgttagatttggattctccggctcc

SEQ ID NO: 833793 - DNA, 25 bp, Mus musculus
tgttagatttggtttctccggctcc

SEQ ID NO: 833794 - DNA, 25 bp, Mus musculus
tgttagcacattcatttcatcagag

SEQ ID NO: 833795 - DNA, 25 bp, Mus musculus
tgttagcacattgatttcatcagag

SEQ ID NO: 833796 - DNA, 25 bp, Mus musculus
tgttagcaggtcacgtgtgcacagc

SEQ ID NO: 833797 - DNA, 25 bp, Mus musculus
tgttagcaggtctcgtgtgcacagc

SEQ ID NO: 833798 - DNA, 25 bp, Mus musculus
tgttagccaagacaaatagatacgg

SEQ ID NO: 833799 - DNA, 25 bp, Mus musculus
tgttagccaagagaaatagatacgg

SEQ ID NO: 833800 - DNA, 25 bp, Mus musculus
tgttagccagatacactcgccagta

SEQ ID NO: 833801 - DNA, 25 bp, Mus musculus
tgttagccagattcactcgccagta

SEQ ID NO: 833802 - DNA, 25 bp, Mus musculus
tgttagcctgctaacataaatgtcc

SEQ ID NO: 833803 - DNA, 25 bp, Mus musculus
tgttagcctgcttacataaatgtcc

SEQ ID NO: 833804 - DNA, 25 bp, Mus musculus
tgttagcgcatcacatagtagctgg

SEQ ID NO: 833805 - DNA, 25 bp, Mus musculus
tgttagcgcatctcatagtagctgg

SEQ ID NO: 833806 - DNA, 25 bp, Mus musculus
tgttaggaaggcaagccctcctgag

SEQ ID NO: 833807 - DNA, 25 bp, Mus musculus
tgttaggaaggctagccctcctgag

SEQ ID NO: 833808 - DNA, 25 bp, Mus musculus
tgttaggacctgaggatctacaaag

SEQ ID NO: 833809 - DNA, 25 bp, Mus musculus
tgttaggacctgtggatctacaaag

SEQ ID NO: 833810 - DNA, 25 bp, Mus musculus
tgttaggactcccagctgtcatcca

SEQ ID NO: 833811 - DNA, 25 bp, Mus musculus
tgttaggactccgagctgtcatcca

SEQ ID NO: 833812 - DNA, 25 bp, Mus musculus
tgttagggagagcagtcgtatcatc

SEQ ID NO: 833813 - DNA, 25 bp, Mus musculus
tgttagggagaggagtcgtatcatc

SEQ ID NO: 833814 - DNA, 25 bp, Mus musculus
tgttaggtagagaacattaaaggtc

SEQ ID NO: 833815 - DNA, 25 bp, Mus musculus
tgttaggtagagtacattaaaggtc

SEQ ID NO: 833816 - DNA, 25 bp, Mus musculus
tgttagtaacctcgccgggagcaga

SEQ ID NO: 833817 - DNA, 25 bp, Mus musculus
tgttagtaacctggccgggagcaga

SEQ ID NO: 833818 - DNA, 25 bp, Mus musculus
tgttagtccacgcttatcagcaagc

SEQ ID NO: 833819 - DNA, 25 bp, Mus musculus
tgttagtccacggttatcagcaagc

SEQ ID NO: 833820 - DNA, 25 bp, Mus musculus
tgttagtccaggagtacacggccct

SEQ ID NO: 833821 - DNA, 25 bp, Mus musculus
tgttagtccaggtgtacacggccct

SEQ ID NO: 833822 - DNA, 25 bp, Mus musculus
tgttagtcggtaagcagagtttaaa

SEQ ID NO: 833823 - DNA, 25 bp, Mus musculus
tgttagtcggtatgcagagtttaaa

SEQ ID NO: 833824 - DNA, 25 bp, Mus musculus
tgttagtctttgctctcagcattgg

SEQ ID NO: 833825 - DNA, 25 bp, Mus musculus
tgttagtctttggtctcagcattgg

SEQ ID NO: 833826 - DNA, 25 bp, Mus musculus
tgttagtgaggtagtctatggagcc

SEQ ID NO: 833827 - DNA, 25 bp, Mus musculus
tgttagtgaggttgtctatggagcc

SEQ ID NO: 833828 - DNA, 25 bp, Mus musculus
tgttagtgtgaaaataatggtacca

SEQ ID NO: 833829 - DNA, 25 bp, Mus musculus
tgttagtgtgaatataatggtacca

SEQ ID NO: 833830 - DNA, 25 bp, Mus musculus
tgttagttcaccattgacatatggc

SEQ ID NO: 833831 - DNA, 25 bp, Mus musculus
tgttagttcacctttgacatatggc

SEQ ID NO: 833832 - DNA, 25 bp, Mus musculus
tgttagttccggctccttgagacac

SEQ ID NO: 833833 - DNA, 25 bp, Mus musculus
tgttagttccgggtccttgagacac

SEQ ID NO: 833834 - DNA, 25 bp, Mus musculus
tgttagttctgacgcattgtttcac

SEQ ID NO: 833835 - DNA, 25 bp, Mus musculus
tgttagttctgaggcattgtttcac

SEQ ID NO: 833836 - DNA, 25 bp, Mus musculus
tgttataaacgacggccatggcagt

SEQ ID NO: 833837 - DNA, 25 bp, Mus musculus
tgttataaacgagggccatggcagt

SEQ ID NO: 833838 - DNA, 25 bp, Mus musculus
tgttataggcggaaagagagaaacc

SEQ ID NO: 833839 - DNA, 25 bp, Mus musculus
tgttataggcggtaagagagaaacc

SEQ ID NO: 833840 - DNA, 25 bp, Mus musculus
tgttatatcaatcacggagtctgga

SEQ ID NO: 833841 - DNA, 25 bp, Mus musculus
tgttatatcaatgacggagtctgga

SEQ ID NO: 833842 - DNA, 25 bp, Mus musculus
tgttatatccagctcagacttgcga

SEQ ID NO: 833843 - DNA, 25 bp, Mus musculus
tgttatatccaggtcagacttgcga

SEQ ID NO: 833844 - DNA, 25 bp, Mus musculus
tgttatattgctagcaagctggtat

SEQ ID NO: 833845 - DNA, 25 bp, Mus musculus
tgttatattgcttgcaagctggtat

SEQ ID NO: 833846 - DNA, 25 bp, Mus musculus
tgttatcaatcacacgggaggctac

SEQ ID NO: 833847 - DNA, 25 bp, Mus musculus
tgttatcaatcagacgggaggctac

SEQ ID NO: 833848 - DNA, 25 bp, Mus musculus
tgttatcagggcactgggccagagt

SEQ ID NO: 833849 - DNA, 25 bp, Mus musculus
tgttatcagggctctgggccagagt

SEQ ID NO: 833850 - DNA, 25 bp, Mus musculus
tgttatcatgcacatcatcaaggaa

SEQ ID NO: 833851 - DNA, 25 bp, Mus musculus
tgttatcatgcagatcatcaaggaa

SEQ ID NO: 833852 - DNA, 25 bp, Mus musculus
tgttatccaaatctatctcagtctc

SEQ ID NO: 833853 - DNA, 25 bp, Mus musculus
tgttatccaaatgtatctcagtctc

SEQ ID NO: 833854 - DNA, 25 bp, Mus musculus
tgttatccaagacgtcagagactcc

SEQ ID NO: 833855 - DNA, 25 bp, Mus musculus
tgttatccaagaggtcagagactcc

SEQ ID NO: 833856 - DNA, 25 bp, Mus musculus
tgttatcccactcataaaaactaag

SEQ ID NO: 833857 - DNA, 25 bp, Mus musculus
tgttatcccactgataaaaactaag

SEQ ID NO: 833858 - DNA, 25 bp, Mus musculus
tgttatcctactaaacgaagaatca

SEQ ID NO: 833859 - DNA, 25 bp, Mus musculus
tgttatcctacttaacgaagaatca

SEQ ID NO: 833860 - DNA, 25 bp, Mus musculus
tgttatcctaggctaaccccagcca

SEQ ID NO: 833861 - DNA, 25 bp, Mus musculus
tgttatcctagggtaaccccagcca

SEQ ID NO: 833862 - DNA, 25 bp, Mus musculus
tgttatcctcaaccacaacttcgag

SEQ ID NO: 833863 - DNA, 25 bp, Mus musculus
tgttatcctcaagcacaacttcgag

SEQ ID NO: 833864 - DNA, 25 bp, Mus musculus
tgttatccttacacatcgggtggcc

SEQ ID NO: 833865 - DNA, 25 bp, Mus musculus
tgttatccttactcatcgggtggcc

SEQ ID NO: 833866 - DNA, 25 bp, Mus musculus
tgttatcctttgagaacaggctgac

SEQ ID NO: 833867 - DNA, 25 bp, Mus musculus
tgttatcctttgtgaacaggctgac

SEQ ID NO: 833868 - DNA, 25 bp, Mus musculus
tgttatcgtctgactctcttgacat

SEQ ID NO: 833869 - DNA, 25 bp, Mus musculus
tgttatcgtctgtctctcttgacat

SEQ ID NO: 833870 - DNA, 25 bp, Mus musculus
tgttatctgataagtggatgggacg

SEQ ID NO: 833871 - DNA, 25 bp, Mus musculus
tgttatctgatatgtggatgggacg

SEQ ID NO: 833872 - DNA, 25 bp, Mus musculus
tgttatctggccctaccagagctag

SEQ ID NO: 833873 - DNA, 25 bp, Mus musculus
tgttatctggccgtaccagagctag

SEQ ID NO: 833874 - DNA, 25 bp, Mus musculus
tgttatgaaatgcaagacagtctcc

SEQ ID NO: 833875 - DNA, 25 bp, Mus musculus
tgttatgaaatggaagacagtctcc

SEQ ID NO: 833876 - DNA, 25 bp, Mus musculus
tgttatgacaccaatgcggcagaca

SEQ ID NO: 833877 - DNA, 25 bp, Mus musculus
tgttatgacacctatgcggcagaca

SEQ ID NO: 833878 - DNA, 25 bp, Mus musculus
tgttatgagacactgaaggcctggc

SEQ ID NO: 833879 - DNA, 25 bp, Mus musculus
tgttatgagacagtgaaggcctggc

SEQ ID NO: 833880 - DNA, 25 bp, Mus musculus
tgttatgcacatccctttggcccct

SEQ ID NO: 833881 - DNA, 25 bp, Mus musculus
tgttatgcacatgcctttggcccct

SEQ ID NO: 833882 - DNA, 25 bp, Mus musculus
tgttatgcccgtcacctgaatggtg

SEQ ID NO: 833883 - DNA, 25 bp, Mus musculus
tgttatgcccgtgacctgaatggtg

SEQ ID NO: 833884 - DNA, 25 bp, Mus musculus
tgttatggatcacaacaacaacacc

SEQ ID NO: 833885 - DNA, 25 bp, Mus musculus
tgttatggatcagaacaacaacacc

SEQ ID NO: 833886 - DNA, 25 bp, Mus musculus
tgttatggctccagggaccgcagac

SEQ ID NO: 833887 - DNA, 25 bp, Mus musculus
tgttatggctcctgggaccgcagac

SEQ ID NO: 833888 - DNA, 25 bp, Mus musculus
tgttatgtcaaacgccaaacctctg

SEQ ID NO: 833889 - DNA, 25 bp, Mus musculus
tgttatgtcaaaggccaaacctctg

SEQ ID NO: 833890 - DNA, 25 bp, Mus musculus
tgttatgtcactacccacaaaggcc

SEQ ID NO: 833891 - DNA, 25 bp, Mus musculus
tgttatgtcacttcccacaaaggcc

SEQ ID NO: 833892 - DNA, 25 bp, Mus musculus
tgttattatcagcagatgcccacag

SEQ ID NO: 833893 - DNA, 25 bp, Mus musculus
tgttattatcaggagatgcccacag

SEQ ID NO: 833894 - DNA, 25 bp, Mus musculus
tgttattatcctagtatccttggtc

SEQ ID NO: 833895 - DNA, 25 bp, Mus musculus
tgttattatccttgtatccttggtc

SEQ ID NO: 833896 - DNA, 25 bp, Mus musculus
tgttattcctggattgaggcctcac

SEQ ID NO: 833897 - DNA, 25 bp, Mus musculus
tgttattcctggtttgaggcctcac

SEQ ID NO: 833898 - DNA, 25 bp, Mus musculus
tgttattcttttaggaccaaggaca

SEQ ID NO: 833899 - DNA, 25 bp, Mus musculus
tgttattctttttggaccaaggaca

SEQ ID NO: 833900 - DNA, 25 bp, Mus musculus
tgttattgaagcacaactgggtttg

SEQ ID NO: 833901 - DNA, 25 bp, Mus musculus
tgttattgaagctcaactgggtttg

SEQ ID NO: 833902 - DNA, 25 bp, Mus musculus
tgttattgataaaaaagcgtgttcc

SEQ ID NO: 833903 - DNA, 25 bp, Mus musculus
tgttattgataataaagcgtgttcc

SEQ ID NO: 833904 - DNA, 25 bp, Mus musculus
tgttattgctcactgggcgcagcaa

SEQ ID NO: 833905 - DNA, 25 bp, Mus musculus
tgttattgctcagtgggcgcagcaa

SEQ ID NO: 833906 - DNA, 25 bp, Mus musculus
tgttattggtccacgtactacttgg

SEQ ID NO: 833907 - DNA, 25 bp, Mus musculus
tgttattggtcctcgtactacttgg

SEQ ID NO: 833908 - DNA, 25 bp, Mus musculus
tgttattgttacagctcagctggtt

SEQ ID NO: 833909 - DNA, 25 bp, Mus musculus
tgttattgttactgctcagctggtt

SEQ ID NO: 833910 - DNA, 25 bp, Mus musculus
tgttatttattgaatgaccaatcag

SEQ ID NO: 833911 - DNA, 25 bp, Mus musculus
tgttatttattgtatgaccaatcag

SEQ ID NO: 833912 - DNA, 25 bp, Mus musculus
tgttatttgggcaatacataccttg

SEQ ID NO: 833913 - DNA, 25 bp, Mus musculus
tgttatttgggctatacataccttg

SEQ ID NO: 833914 - DNA, 25 bp, Mus musculus
tgttcaaaagctccgcttcacatac

SEQ ID NO: 833915 - DNA, 25 bp, Mus musculus
tgttcaaaagctgcgcttcacatac

SEQ ID NO: 833916 - DNA, 25 bp, Mus musculus
tgttcaaactgcacttgatcgggaa

SEQ ID NO: 833917 - DNA, 25 bp, Mus musculus
tgttcaaactgctcttgatcgggaa

SEQ ID NO: 833918 - DNA, 25 bp, Mus musculus
tgttcaaagacaatttttccctccg

SEQ ID NO: 833919 - DNA, 25 bp, Mus musculus
tgttcaaagacattttttccctccg

SEQ ID NO: 833920 - DNA, 25 bp, Mus musculus
tgttcaacaaacaggaggtggacaa

SEQ ID NO: 833921 - DNA, 25 bp, Mus musculus
tgttcaacaaactggaggtggacaa

SEQ ID NO: 833922 - DNA, 25 bp, Mus musculus
tgttcaacaccaacgctaccattgt

SEQ ID NO: 833923 - DNA, 25 bp, Mus musculus
tgttcaacaccatcgctaccattgt

SEQ ID NO: 833924 - DNA, 25 bp, Mus musculus
tgttcaaccatcaggctgtggctgc

SEQ ID NO: 833925 - DNA, 25 bp, Mus musculus
tgttcaaccatctggctgtggctgc

SEQ ID NO: 833926 - DNA, 25 bp, Mus musculus
tgttcaacccagaggagcgcagttg

SEQ ID NO: 833927 - DNA, 25 bp, Mus musculus
tgttcaacccagtggagcgcagttg

SEQ ID NO: 833928 - DNA, 25 bp, Mus musculus
tgttcaactgagacctgtagatgag

SEQ ID NO: 833929 - DNA, 25 bp, Mus musculus
tgttcaactgagtcctgtagatgag

SEQ ID NO: 833930 - DNA, 25 bp, Mus musculus
tgttcaagagacagacaacgatcag

SEQ ID NO: 833931 - DNA, 25 bp, Mus musculus
tgttcaagagactgacaacgatcag

SEQ ID NO: 833932 - DNA, 25 bp, Mus musculus
tgttcaagcaggcactgtagaccag

SEQ ID NO: 833933 - DNA, 25 bp, Mus musculus
tgttcaagcagggactgtagaccag

SEQ ID NO: 833934 - DNA, 25 bp, Mus musculus
tgttcaagccacctgtacaattgga

SEQ ID NO: 833935 - DNA, 25 bp, Mus musculus
tgttcaagccacgtgtacaattgga

SEQ ID NO: 833936 - DNA, 25 bp, Mus musculus
tgttcaagcccacaaatgccttatg

SEQ ID NO: 833937 - DNA, 25 bp, Mus musculus
tgttcaagcccagaaatgccttatg

SEQ ID NO: 833938 - DNA, 25 bp, Mus musculus
tgttcaagccctcgagatcacctaa

SEQ ID NO: 833939 - DNA, 25 bp, Mus musculus
tgttcaagccctggagatcacctaa

SEQ ID NO: 833940 - DNA, 25 bp, Mus musculus
tgttcaaggagcaccacagctggtt

SEQ ID NO: 833941 - DNA, 25 bp, Mus musculus
tgttcaaggagctccacagctggtt

SEQ ID NO: 833942 - DNA, 25 bp, Mus musculus
tgttcaaggcataggagcagcctca

SEQ ID NO: 833943 - DNA, 25 bp, Mus musculus
tgttcaaggcattggagcagcctca

SEQ ID NO: 833944 - DNA, 25 bp, Mus musculus
tgttcaagtaccagtatcacagcca

SEQ ID NO: 833945 - DNA, 25 bp, Mus musculus
tgttcaagtacctgtatcacagcca

SEQ ID NO: 833946 - DNA, 25 bp, Mus musculus
tgttcaagtgcgcaatagctgtggc

SEQ ID NO: 833947 - DNA, 25 bp, Mus musculus
tgttcaagtgcggaatagctgtggc

SEQ ID NO: 833948 - DNA, 25 bp, Mus musculus
tgttcaagttctatgtggaggagtt

SEQ ID NO: 833949 - DNA, 25 bp, Mus musculus
tgttcaagttctttgtggaggagtt

SEQ ID NO: 833950 - DNA, 25 bp, Mus musculus
tgttcaatctatctgtctcatctcc

SEQ ID NO: 833951 - DNA, 25 bp, Mus musculus
tgttcaatctatgtgtctcatctcc

SEQ ID NO: 833952 - DNA, 25 bp, Mus musculus
tgttcaatgaccagagttcctcgga

SEQ ID NO: 833953 - DNA, 25 bp, Mus musculus
tgttcaatgacctgagttcctcgga

SEQ ID NO: 833954 - DNA, 25 bp, Mus musculus
tgttcaatgagtagcggagcgacct

SEQ ID NO: 833955 - DNA, 25 bp, Mus musculus
tgttcaatgagttgcggagcgacct

SEQ ID NO: 833956 - DNA, 25 bp, Mus musculus
tgttcaatgcctcagttccctggag

SEQ ID NO: 833957 - DNA, 25 bp, Mus musculus
tgttcaatgcctctacagttccacg

SEQ ID NO: 833958 - DNA, 25 bp, Mus musculus
tgttcaatgcctgagttccctggag

SEQ ID NO: 833959 - DNA, 25 bp, Mus musculus
tgttcaatgcctgtacagttccacg

SEQ ID NO: 833960 - DNA, 25 bp, Mus musculus
tgttcaatggttagacactactgat

SEQ ID NO: 833961 - DNA, 25 bp, Mus musculus
tgttcaatggtttgacactactgat

SEQ ID NO: 833962 - DNA, 25 bp, Mus musculus
tgttcaatgtcccttatggtgtggg

SEQ ID NO: 833963 - DNA, 25 bp, Mus musculus
tgttcaatgtccgttatggtgtggg

SEQ ID NO: 833964 - DNA, 25 bp, Mus musculus
tgttcaatgtgacagaggcccagag

SEQ ID NO: 833965 - DNA, 25 bp, Mus musculus
tgttcaatgtgagagaggcccagag

SEQ ID NO: 833966 - DNA, 25 bp, Mus musculus
tgttcaattatacaccagggcatct

SEQ ID NO: 833967 - DNA, 25 bp, Mus musculus
tgttcaattatagaccagggcatct

SEQ ID NO: 833968 - DNA, 25 bp, Mus musculus
tgttcaatttagacagggatgctga

SEQ ID NO: 833969 - DNA, 25 bp, Mus musculus
tgttcaatttagtcagggatgctga

SEQ ID NO: 833970 - DNA, 25 bp, Mus musculus
tgttcacacccgcaaggtcactgga

SEQ ID NO: 833971 - DNA, 25 bp, Mus musculus
tgttcacacccggaaggtcactgga

SEQ ID NO: 833972 - DNA, 25 bp, Mus musculus
tgttcacacctgatgagtctctgga

SEQ ID NO: 833973 - DNA, 25 bp, Mus musculus
tgttcacacctgttgagtctctgga

SEQ ID NO: 833974 - DNA, 25 bp, Mus musculus
tgttcacactccctgcagggagaat

SEQ ID NO: 833975 - DNA, 25 bp, Mus musculus
tgttcacactccgtgcagggagaat

SEQ ID NO: 833976 - DNA, 25 bp, Mus musculus
tgttcacaggagctttggcaaaaca

SEQ ID NO: 833977 - DNA, 25 bp, Mus musculus
tgttcacaggaggtttggcaaaaca

SEQ ID NO: 833978 - DNA, 25 bp, Mus musculus
tgttcacatcagcaggtatggaggc

SEQ ID NO: 833979 - DNA, 25 bp, Mus musculus
tgttcacatcaggaggtatggaggc

SEQ ID NO: 833980 - DNA, 25 bp, Mus musculus
tgttcacatcttccctatagacagg

SEQ ID NO: 833981 - DNA, 25 bp, Mus musculus
tgttcacatcttgcctatagacagg

SEQ ID NO: 833982 - DNA, 25 bp, Mus musculus
tgttcacattgaaccgaagttcatc

SEQ ID NO: 833983 - DNA, 25 bp, Mus musculus
tgttcacattgatccgaagttcatc

SEQ ID NO: 833984 - DNA, 25 bp, Mus musculus
tgttcaccaacgatgagggaagaca

SEQ ID NO: 833985 - DNA, 25 bp, Mus musculus
tgttcaccaacgttgagggaagaca

SEQ ID NO: 833986 - DNA, 25 bp, Mus musculus
tgttcaccaactaaaactgccaaaa

SEQ ID NO: 833987 - DNA, 25 bp, Mus musculus
tgttcaccaacttaaactgccaaaa

SEQ ID NO: 833988 - DNA, 25 bp, Mus musculus
tgttcaccaccacacagtgccagtt

SEQ ID NO: 833989 - DNA, 25 bp, Mus musculus
tgttcaccaccagacagtgccagtt

SEQ ID NO: 833990 - DNA, 25 bp, Mus musculus
tgttcaccatggaggctgggaacta

SEQ ID NO: 833991 - DNA, 25 bp, Mus musculus
tgttcaccatggtggctgggaacta

SEQ ID NO: 833992 - DNA, 25 bp, Mus musculus
tgttcacccggcattccaactgtgc

SEQ ID NO: 833993 - DNA, 25 bp, Mus musculus
tgttcacccggctttccaactgtgc

SEQ ID NO: 833994 - DNA, 25 bp, Mus musculus
tgttcaccctgaagacgatggctgt

SEQ ID NO: 833995 - DNA, 25 bp, Mus musculus
tgttcaccctgatgacgatggctgt

SEQ ID NO: 833996 - DNA, 25 bp, Mus musculus
tgttcacccttgaagtccacccggg

SEQ ID NO: 833997 - DNA, 25 bp, Mus musculus
tgttcacccttgtagtccacccggg

SEQ ID NO: 833998 - DNA, 25 bp, Mus musculus
tgttcaccgagccaggcgttattcc

SEQ ID NO: 833999 - DNA, 25 bp, Mus musculus
tgttcaccgagcgaggcgttattcc

SEQ ID NO: 834000 - DNA, 25 bp, Mus musculus
tgttcacctaacctttgctctgagg

SEQ ID NO: 834001 - DNA, 25 bp, Mus musculus
tgttcacctaacgtttgctctgagg

SEQ ID NO: 834002 - DNA, 25 bp, Mus musculus
tgttcacctcacaaaatcagttctg

SEQ ID NO: 834003 - DNA, 25 bp, Mus musculus
tgttcacctcactaaatcagttctg

SEQ ID NO: 834004 - DNA, 25 bp, Mus musculus
tgttcacctgataccgtccttgtgc

SEQ ID NO: 834005 - DNA, 25 bp, Mus musculus
tgttcacctgattccgtccttgtgc

SEQ ID NO: 834006 - DNA, 25 bp, Mus musculus
tgttcacgatgactggataggctgc

SEQ ID NO: 834007 - DNA, 25 bp, Mus musculus
tgttcacgatgagtggataggctgc

SEQ ID NO: 834008 - DNA, 25 bp, Mus musculus
tgttcacgcgagctctggagtacct

SEQ ID NO: 834009 - DNA, 25 bp, Mus musculus
tgttcacgcgaggtctggagtacct

SEQ ID NO: 834010 - DNA, 25 bp, Mus musculus
tgttcacgtggaaaccgtctctgtg

SEQ ID NO: 834011 - DNA, 25 bp, Mus musculus
tgttcacgtggataccgtctctgtg

SEQ ID NO: 834012 - DNA, 25 bp, Mus musculus
tgttcacgtggcattcacatggcgt

SEQ ID NO: 834013 - DNA, 25 bp, Mus musculus
tgttcacgtggctttcacatggcgt

SEQ ID NO: 834014 - DNA, 25 bp, Mus musculus
tgttcacgttcacgacaggcttccc

SEQ ID NO: 834015 - DNA, 25 bp, Mus musculus
tgttcacgttcaggacaggcttccc

SEQ ID NO: 834016 - DNA, 25 bp, Mus musculus
tgttcactacctagggactcttaca

SEQ ID NO: 834017 - DNA, 25 bp, Mus musculus
tgttcactaccttgggactcttaca

SEQ ID NO: 834018 - DNA, 25 bp, Mus musculus
tgttcactacgactgtattccggga

SEQ ID NO: 834019 - DNA, 25 bp, Mus musculus
tgttcactacgagtgtattccggga

SEQ ID NO: 834020 - DNA, 25 bp, Mus musculus
tgttcactagcacagtagagttccg

SEQ ID NO: 834021 - DNA, 25 bp, Mus musculus
tgttcactagcagagtagagttccg

SEQ ID NO: 834022 - DNA, 25 bp, Mus musculus
tgttcactatgccagaggatgatta

SEQ ID NO: 834023 - DNA, 25 bp, Mus musculus
tgttcactatgcgagaggatgatta

SEQ ID NO: 834024 - DNA, 25 bp, Mus musculus
tgttcactcagacgagaggcctttc

SEQ ID NO: 834025 - DNA, 25 bp, Mus musculus
tgttcactcagaggagaggcctttc

SEQ ID NO: 834026 - DNA, 25 bp, Mus musculus
tgttcactgccaaccataagcacta

SEQ ID NO: 834027 - DNA, 25 bp, Mus musculus
tgttcactgccatccataagcacta

SEQ ID NO: 834028 - DNA, 25 bp, Mus musculus
tgttcactgccccatatctggacct

SEQ ID NO: 834029 - DNA, 25 bp, Mus musculus
tgttcactgcccgatatctggacct

SEQ ID NO: 834030 - DNA, 25 bp, Mus musculus
tgttcacttcaaaaaggaatacggg

SEQ ID NO: 834031 - DNA, 25 bp, Mus musculus
tgttcacttcaactacccatcgaga

SEQ ID NO: 834032 - DNA, 25 bp, Mus musculus
tgttcacttcaagtacccatcgaga

SEQ ID NO: 834033 - DNA, 25 bp, Mus musculus
tgttcacttcaataaggaatacggg

SEQ ID NO: 834034 - DNA, 25 bp, Mus musculus
tgttcagaaacaatccaggccgttc

SEQ ID NO: 834035 - DNA, 25 bp, Mus musculus
tgttcagaaacattccaggccgttc

SEQ ID NO: 834036 - DNA, 25 bp, Mus musculus
tgttcagaaccaatagaggcacagt

SEQ ID NO: 834037 - DNA, 25 bp, Mus musculus
tgttcagaaccattagaggcacagt

SEQ ID NO: 834038 - DNA, 25 bp, Mus musculus
tgttcagaacttattgaaaaaacac

SEQ ID NO: 834039 - DNA, 25 bp, Mus musculus
tgttcagaactttttgaaaaaacac

SEQ ID NO: 834040 - DNA, 25 bp, Mus musculus
tgttcagaagcaacctgcagttggg

SEQ ID NO: 834041 - DNA, 25 bp, Mus musculus
tgttcagaagcatcctgcagttggg

SEQ ID NO: 834042 - DNA, 25 bp, Mus musculus
tgttcagaagctcaacaagttcttg

SEQ ID NO: 834043 - DNA, 25 bp, Mus musculus
tgttcagaagctgaacaagttcttg

SEQ ID NO: 834044 - DNA, 25 bp, Mus musculus
tgttcagacggacaacgatccgttc

SEQ ID NO: 834045 - DNA, 25 bp, Mus musculus
tgttcagacggagaacgatccgttc

SEQ ID NO: 834046 - DNA, 25 bp, Mus musculus
tgttcagaggcgctgagacgtaacc

SEQ ID NO: 834047 - DNA, 25 bp, Mus musculus
tgttcagaggcggtgagacgtaacc

SEQ ID NO: 834048 - DNA, 25 bp, Mus musculus
tgttcagagttaacttgaccaagga

SEQ ID NO: 834049 - DNA, 25 bp, Mus musculus
tgttcagagttatcttgaccaagga

SEQ ID NO: 834050 - DNA, 25 bp, Mus musculus
tgttcagatacactaccaccctgga

SEQ ID NO: 834051 - DNA, 25 bp, Mus musculus
tgttcagatacagtaccaccctgga

SEQ ID NO: 834052 - DNA, 25 bp, Mus musculus
tgttcagcaaacatcctgaagcaga

SEQ ID NO: 834053 - DNA, 25 bp, Mus musculus
tgttcagcaaacttcctgaagcaga

SEQ ID NO: 834054 - DNA, 25 bp, Mus musculus
tgttcagcaccgaaaaggagatcct

SEQ ID NO: 834055 - DNA, 25 bp, Mus musculus
tgttcagcaccgtaaaggagatcct

SEQ ID NO: 834056 - DNA, 25 bp, Mus musculus
tgttcagcactaacagcttcaatga

SEQ ID NO: 834057 - DNA, 25 bp, Mus musculus
tgttcagcactatcagcttcaatga

SEQ ID NO: 834058 - DNA, 25 bp, Mus musculus
tgttcagcagttcacagctgcccag

SEQ ID NO: 834059 - DNA, 25 bp, Mus musculus
tgttcagcagttgacagctgcccag

SEQ ID NO: 834060 - DNA, 25 bp, Mus musculus
tgttcagcatatcaagagacacaac

SEQ ID NO: 834061 - DNA, 25 bp, Mus musculus
tgttcagcatatgaagagacacaac

SEQ ID NO: 834062 - DNA, 25 bp, Mus musculus
tgttcagcatcacatatacacattg

SEQ ID NO: 834063 - DNA, 25 bp, Mus musculus
tgttcagcatcagatatacacattg

SEQ ID NO: 834064 - DNA, 25 bp, Mus musculus
tgttcagcatctcccaaattcaatg

SEQ ID NO: 834065 - DNA, 25 bp, Mus musculus
tgttcagcatctgccaaattcaatg

SEQ ID NO: 834066 - DNA, 25 bp, Mus musculus
tgttcagccaggaagtgagactgca

SEQ ID NO: 834067 - DNA, 25 bp, Mus musculus
tgttcagccaggtagtgagactgca

SEQ ID NO: 834068 - DNA, 25 bp, Mus musculus
tgttcagccagtacagatacttctt

SEQ ID NO: 834069 - DNA, 25 bp, Mus musculus
tgttcagccagttcagatacttctt

SEQ ID NO: 834070 - DNA, 25 bp, Mus musculus
tgttcagccattcggcaaccagcct

SEQ ID NO: 834071 - DNA, 25 bp, Mus musculus
tgttcagccattgggcaaccagcct

SEQ ID NO: 834072 - DNA, 25 bp, Mus musculus
tgttcagccttgctgcattggaggc

SEQ ID NO: 834073 - DNA, 25 bp, Mus musculus
tgttcagccttggtgcattggaggc

SEQ ID NO: 834074 - DNA, 25 bp, Mus musculus
tgttcagcgctcagctcaccaagtg

SEQ ID NO: 834075 - DNA, 25 bp, Mus musculus
tgttcagcgctctgctcaccaagtg

SEQ ID NO: 834076 - DNA, 25 bp, Mus musculus
tgttcagcggcaacgatgatcatct

SEQ ID NO: 834077 - DNA, 25 bp, Mus musculus
tgttcagcggcatcgatgatcatct

SEQ ID NO: 834078 - DNA, 25 bp, Mus musculus
tgttcagctaccctgtcaaccctga

SEQ ID NO: 834079 - DNA, 25 bp, Mus musculus
tgttcagctaccgtgtcaaccctga

SEQ ID NO: 834080 - DNA, 25 bp, Mus musculus
tgttcaggaacccaactcgcattgt

SEQ ID NO: 834081 - DNA, 25 bp, Mus musculus
tgttcaggaaccgaactcgcattgt

SEQ ID NO: 834082 - DNA, 25 bp, Mus musculus
tgttcaggaaggatggtgacgcctc

SEQ ID NO: 834083 - DNA, 25 bp, Mus musculus
tgttcaggaaggttggtgacgcctc

SEQ ID NO: 834084 - DNA, 25 bp, Mus musculus
tgttcaggacagacatagaaacaga

SEQ ID NO: 834085 - DNA, 25 bp, Mus musculus
tgttcaggacagtcatagaaacaga

SEQ ID NO: 834086 - DNA, 25 bp, Mus musculus
tgttcaggacgcctacaccttacgc

SEQ ID NO: 834087 - DNA, 25 bp, Mus musculus
tgttcaggacgcgtacaccttacgc

SEQ ID NO: 834088 - DNA, 25 bp, Mus musculus
tgttcaggccaactagaaccccaga

SEQ ID NO: 834089 - DNA, 25 bp, Mus musculus
tgttcaggccaagtagaaccccaga

SEQ ID NO: 834090 - DNA, 25 bp, Mus musculus
tgttcagtacttatcccctttcaca

SEQ ID NO: 834091 - DNA, 25 bp, Mus musculus
tgttcagtacttttcccctttcaca

SEQ ID NO: 834092 - DNA, 25 bp, Mus musculus
tgttcagtctggacacggaagccct

SEQ ID NO: 834093 - DNA, 25 bp, Mus musculus
tgttcagtctggtcacggaagccct

SEQ ID NO: 834094 - DNA, 25 bp, Mus musculus
tgttcagtgaaaccaaggtggtaga

SEQ ID NO: 834095 - DNA, 25 bp, Mus musculus
tgttcagtgaaagcaaggtggtaga

SEQ ID NO: 834096 - DNA, 25 bp, Mus musculus
tgttcagtgacccagggattcccga

SEQ ID NO: 834097 - DNA, 25 bp, Mus musculus
tgttcagtgaccgagggattcccga

SEQ ID NO: 834098 - DNA, 25 bp, Mus musculus
tgttcagtgccacactggcgggcat

SEQ ID NO: 834099 - DNA, 25 bp, Mus musculus
tgttcagtgccagactggcgggcat

SEQ ID NO: 834100 - DNA, 25 bp, Mus musculus
tgttcagtgggtcgcacacctcatt

SEQ ID NO: 834101 - DNA, 25 bp, Mus musculus
tgttcagtgggtggcacacctcatt

SEQ ID NO: 834102 - DNA, 25 bp, Mus musculus
tgttcagtggtacatataccgcgct

SEQ ID NO: 834103 - DNA, 25 bp, Mus musculus
tgttcagtggtagatataccgcgct

SEQ ID NO: 834104 - DNA, 25 bp, Mus musculus
tgttcagtgtcacaaccgttgacct

SEQ ID NO: 834105 - DNA, 25 bp, Mus musculus
tgttcagtgtcagaaccgttgacct

SEQ ID NO: 834106 - DNA, 25 bp, Mus musculus
tgttcagttctaacgacgcttcaag

SEQ ID NO: 834107 - DNA, 25 bp, Mus musculus
tgttcagttctatcgacgcttcaag

SEQ ID NO: 834108 - DNA, 25 bp, Mus musculus
tgttcagttggcactactgccttga

SEQ ID NO: 834109 - DNA, 25 bp, Mus musculus
tgttcagttggctctactgccttga

SEQ ID NO: 834110 - DNA, 25 bp, Mus musculus
tgttcagtttatctgggattgctgc

SEQ ID NO: 834111 - DNA, 25 bp, Mus musculus
tgttcagtttatgtgggattgctgc

SEQ ID NO: 834112 - DNA, 25 bp, Mus musculus
tgttcataggaacgcctctggctgg

SEQ ID NO: 834113 - DNA, 25 bp, Mus musculus
tgttcataggaaggcctctggctgg

SEQ ID NO: 834114 - DNA, 25 bp, Mus musculus
tgttcatcacagctacgggcattgt

SEQ ID NO: 834115 - DNA, 25 bp, Mus musculus
tgttcatcacaggtacgggcattgt

SEQ ID NO: 834116 - DNA, 25 bp, Mus musculus
tgttcatcacggcaattatcattct

SEQ ID NO: 834117 - DNA, 25 bp, Mus musculus
tgttcatcacgggaattatcattct

SEQ ID NO: 834118 - DNA, 25 bp, Mus musculus
tgttcatccagtaccagtgcagact

SEQ ID NO: 834119 - DNA, 25 bp, Mus musculus
tgttcatccagttccagtgcagact

SEQ ID NO: 834120 - DNA, 25 bp, Mus musculus
tgttcatcccgcatggtggtttctt

SEQ ID NO: 834121 - DNA, 25 bp, Mus musculus
tgttcatcccgcttggtggtttctt

SEQ ID NO: 834122 - DNA, 25 bp, Mus musculus
tgttcatcgccacagaatattctgc

SEQ ID NO: 834123 - DNA, 25 bp, Mus musculus
tgttcatcgccagagaatattctgc

SEQ ID NO: 834124 - DNA, 25 bp, Mus musculus
tgttcatcgtgcatgagatctgtgg

SEQ ID NO: 834125 - DNA, 25 bp, Mus musculus
tgttcatcgtgcttgagatctgtgg

SEQ ID NO: 834126 - DNA, 25 bp, Mus musculus
tgttcatctactacaggaaccagaa

SEQ ID NO: 834127 - DNA, 25 bp, Mus musculus
tgttcatctacttcaggaaccagaa

SEQ ID NO: 834128 - DNA, 25 bp, Mus musculus
tgttcatctatactacgttggtggg

SEQ ID NO: 834129 - DNA, 25 bp, Mus musculus
tgttcatctatagtacgttggtggg

SEQ ID NO: 834130 - DNA, 25 bp, Mus musculus
tgttcatctccacttacatggtgtt

SEQ ID NO: 834131 - DNA, 25 bp, Mus musculus
tgttcatctccagttacatggtgtt

SEQ ID NO: 834132 - DNA, 25 bp, Mus musculus
tgttcatgaacaagcagagtctgaa

SEQ ID NO: 834133 - DNA, 25 bp, Mus musculus
tgttcatgaacatgcagagtctgaa

SEQ ID NO: 834134 - DNA, 25 bp, Mus musculus
tgttcatgacccaccttcactttga

SEQ ID NO: 834135 - DNA, 25 bp, Mus musculus
tgttcatgaccctccttcactttga

SEQ ID NO: 834136 - DNA, 25 bp, Mus musculus
tgttcatgactgacaacgggctccg

SEQ ID NO: 834137 - DNA, 25 bp, Mus musculus
tgttcatgactgtcaacgggctccg

SEQ ID NO: 834138 - DNA, 25 bp, Mus musculus
tgttcatgcaaaacacgttaacaag

SEQ ID NO: 834139 - DNA, 25 bp, Mus musculus
tgttcatgcaaatcacgttaacaag

SEQ ID NO: 834140 - DNA, 25 bp, Mus musculus
tgttcatggaaacctccgccaagct

SEQ ID NO: 834141 - DNA, 25 bp, Mus musculus
tgttcatggaaagctccgccaagct

SEQ ID NO: 834142 - DNA, 25 bp, Mus musculus
tgttcatgttctagtgagcacgggc

SEQ ID NO: 834143 - DNA, 25 bp, Mus musculus
tgttcatgttcttgtgagcacgggc

SEQ ID NO: 834144 - DNA, 25 bp, Mus musculus
tgttcatgttttcggggtcaccgta

SEQ ID NO: 834145 - DNA, 25 bp, Mus musculus
tgttcatgttttgggggtcaccgta

SEQ ID NO: 834146 - DNA, 25 bp, Mus musculus
tgttcattacagcaggcagactacg

SEQ ID NO: 834147 - DNA, 25 bp, Mus musculus
tgttcattacagctgacaagggtct

SEQ ID NO: 834148 - DNA, 25 bp, Mus musculus
tgttcattacaggaggcagactacg

SEQ ID NO: 834149 - DNA, 25 bp, Mus musculus
tgttcattacaggtgacaagggtct

SEQ ID NO: 834150 - DNA, 25 bp, Mus musculus
tgttcattccacagtgcctcttagt

SEQ ID NO: 834151 - DNA, 25 bp, Mus musculus
tgttcattccactgtgcctcttagt

SEQ ID NO: 834152 - DNA, 25 bp, Mus musculus
tgttcattccctctggccatctggt

SEQ ID NO: 834153 - DNA, 25 bp, Mus musculus
tgttcattccctgtggccatctggt

SEQ ID NO: 834154 - DNA, 25 bp, Mus musculus
tgttcattctgtatcgctcgctcgg

SEQ ID NO: 834155 - DNA, 25 bp, Mus musculus
tgttcattctgtttcgctcgctcgg

SEQ ID NO: 834156 - DNA, 25 bp, Mus musculus
tgttcattgcttctaaaaactcggg

SEQ ID NO: 834157 - DNA, 25 bp, Mus musculus
tgttcattgcttctggtcctgaaaa

SEQ ID NO: 834158 - DNA, 25 bp, Mus musculus
tgttcattgcttgtaaaaactcggg

SEQ ID NO: 834159 - DNA, 25 bp, Mus musculus
tgttcattgcttgtggtcctgaaaa

SEQ ID NO: 834160 - DNA, 25 bp, Mus musculus
tgttcattggaaatctgccccggga

SEQ ID NO: 834161 - DNA, 25 bp, Mus musculus
tgttcattggaattctgccccggga

SEQ ID NO: 834162 - DNA, 25 bp, Mus musculus
tgttcattgggaaatcatcaggcat

SEQ ID NO: 834163 - DNA, 25 bp, Mus musculus
tgttcattgggatatcatcaggcat

SEQ ID NO: 834164 - DNA, 25 bp, Mus musculus
tgttcattgtggcagtcacctgtag

SEQ ID NO: 834165 - DNA, 25 bp, Mus musculus
tgttcattgtgggagtcacctgtag

SEQ ID NO: 834166 - DNA, 25 bp, Mus musculus
tgttcatttattcttctgggaggaa

SEQ ID NO: 834167 - DNA, 25 bp, Mus musculus
tgttcatttattgttctgggaggaa

SEQ ID NO: 834168 - DNA, 25 bp, Mus musculus
tgttccaaacagagatgctgttctg

SEQ ID NO: 834169 - DNA, 25 bp, Mus musculus
tgttccaaacagtgatgctgttctg

SEQ ID NO: 834170 - DNA, 25 bp, Mus musculus
tgttccaaagccaaatgcagagtgt

SEQ ID NO: 834171 - DNA, 25 bp, Mus musculus
tgttccaaagcctaatgcagagtgt

SEQ ID NO: 834172 - DNA, 25 bp, Mus musculus
tgttccaaaggaaaatcctggcaga

SEQ ID NO: 834173 - DNA, 25 bp, Mus musculus
tgttccaaaggataatcctggcaga

SEQ ID NO: 834174 - DNA, 25 bp, Mus musculus
tgttccaagaggcagggtccagacc

SEQ ID NO: 834175 - DNA, 25 bp, Mus musculus
tgttccaagagggagggtccagacc

SEQ ID NO: 834176 - DNA, 25 bp, Mus musculus
tgttccaagataaggacgccatgct

SEQ ID NO: 834177 - DNA, 25 bp, Mus musculus
tgttccaagatatggacgccatgct

SEQ ID NO: 834178 - DNA, 25 bp, Mus musculus
tgttccaagccacacattgctcgga

SEQ ID NO: 834179 - DNA, 25 bp, Mus musculus
tgttccaagccagacattgctcgga

SEQ ID NO: 834180 - DNA, 25 bp, Mus musculus
tgttccaataagactggccgcttcc

SEQ ID NO: 834181 - DNA, 25 bp, Mus musculus
tgttccaataagtctggccgcttcc

SEQ ID NO: 834182 - DNA, 25 bp, Mus musculus
tgttccacaagcatcaggtcatcag

SEQ ID NO: 834183 - DNA, 25 bp, Mus musculus
tgttccacaagcttcaggtcatcag

SEQ ID NO: 834184 - DNA, 25 bp, Mus musculus
tgttccacagaaaccctagccagag

SEQ ID NO: 834185 - DNA, 25 bp, Mus musculus
tgttccacagaatccctagccagag

SEQ ID NO: 834186 - DNA, 25 bp, Mus musculus
tgttccacatagagcctgaagaggg

SEQ ID NO: 834187 - DNA, 25 bp, Mus musculus
tgttccacatagtgcctgaagaggg

SEQ ID NO: 834188 - DNA, 25 bp, Mus musculus
tgttccaccgacaaccggatgcgct

SEQ ID NO: 834189 - DNA, 25 bp, Mus musculus
tgttccaccgactaccggatgcgct

SEQ ID NO: 834190 - DNA, 25 bp, Mus musculus
tgttccacgaacacaagccaggaag

SEQ ID NO: 834191 - DNA, 25 bp, Mus musculus
tgttccacgaactcaagccaggaag

SEQ ID NO: 834192 - DNA, 25 bp, Mus musculus
tgttccactcacaactcacaacttt

SEQ ID NO: 834193 - DNA, 25 bp, Mus musculus
tgttccactcactactcacaacttt

SEQ ID NO: 834194 - DNA, 25 bp, Mus musculus
tgttccacttgtatgcactgtgtgc

SEQ ID NO: 834195 - DNA, 25 bp, Mus musculus
tgttccacttgtccccgacctggag

SEQ ID NO: 834196 - DNA, 25 bp, Mus musculus
tgttccacttgtgcccgacctggag

SEQ ID NO: 834197 - DNA, 25 bp, Mus musculus
tgttccacttgtttgcactgtgtgc

SEQ ID NO: 834198 - DNA, 25 bp, Mus musculus
tgttccagaactatttgaggaccca

SEQ ID NO: 834199 - DNA, 25 bp, Mus musculus
tgttccagaactttttgaggaccca

SEQ ID NO: 834200 - DNA, 25 bp, Mus musculus
tgttccagaagaacatcagtctccc

SEQ ID NO: 834201 - DNA, 25 bp, Mus musculus
tgttccagaagatcatcagtctccc

SEQ ID NO: 834202 - DNA, 25 bp, Mus musculus
tgttccagactacgctgggcatgct

SEQ ID NO: 834203 - DNA, 25 bp, Mus musculus
tgttccagactaggctgggcatgct

SEQ ID NO: 834204 - DNA, 25 bp, Mus musculus
tgttccagcaaaaggcggcctcgtt

SEQ ID NO: 834205 - DNA, 25 bp, Mus musculus
tgttccagcaaatggcggcctcgtt

SEQ ID NO: 834206 - DNA, 25 bp, Mus musculus
tgttccagcgagaactggtgtccct

SEQ ID NO: 834207 - DNA, 25 bp, Mus musculus
tgttccagcgagtactggtgtccct

SEQ ID NO: 834208 - DNA, 25 bp, Mus musculus
tgttccagctaaatgacattgcccg

SEQ ID NO: 834209 - DNA, 25 bp, Mus musculus
tgttccagctaattgacattgcccg

SEQ ID NO: 834210 - DNA, 25 bp, Mus musculus
tgttccaggaatccgctgtgcgctc

SEQ ID NO: 834211 - DNA, 25 bp, Mus musculus
tgttccaggaatgcgctgtgcgctc

SEQ ID NO: 834212 - DNA, 25 bp, Mus musculus
tgttccaggcataccttaactacta

SEQ ID NO: 834213 - DNA, 25 bp, Mus musculus
tgttccaggcattccttaactacta

SEQ ID NO: 834214 - DNA, 25 bp, Mus musculus
tgttccaggtctccagggcaagaca

SEQ ID NO: 834215 - DNA, 25 bp, Mus musculus
tgttccaggtctgcagggcaagaca

SEQ ID NO: 834216 - DNA, 25 bp, Mus musculus
tgttccaggttgaggtaatgctcgt

SEQ ID NO: 834217 - DNA, 25 bp, Mus musculus
tgttccaggttgtggtaatgctcgt

SEQ ID NO: 834218 - DNA, 25 bp, Mus musculus
tgttccagtacacatgaccatgggt

SEQ ID NO: 834219 - DNA, 25 bp, Mus musculus
tgttccagtacagatgaccatgggt

SEQ ID NO: 834220 - DNA, 25 bp, Mus musculus
tgttccagtcaacttctcggcaaag

SEQ ID NO: 834221 - DNA, 25 bp, Mus musculus
tgttccagtcaagttctcggcaaag

SEQ ID NO: 834222 - DNA, 25 bp, Mus musculus
tgttccagtggcacagtaaccatcc

SEQ ID NO: 834223 - DNA, 25 bp, Mus musculus
tgttccagtggctcagtaaccatcc

SEQ ID NO: 834224 - DNA, 25 bp, Mus musculus
tgttccagttacaaagatggtagta

SEQ ID NO: 834225 - DNA, 25 bp, Mus musculus
tgttccagttactaagatggtagta

SEQ ID NO: 834226 - DNA, 25 bp, Mus musculus
tgttccagttgtacaacagacgatc

SEQ ID NO: 834227 - DNA, 25 bp, Mus musculus
tgttccagttgttcaacagacgatc

SEQ ID NO: 834228 - DNA, 25 bp, Mus musculus
tgttccatagctaggactgttcccc

SEQ ID NO: 834229 - DNA, 25 bp, Mus musculus
tgttccatagcttggactgttcccc

SEQ ID NO: 834230 - DNA, 25 bp, Mus musculus
tgttccatcaacagggatggcagca

SEQ ID NO: 834231 - DNA, 25 bp, Mus musculus
tgttccatcaactgggatggcagca

SEQ ID NO: 834232 - DNA, 25 bp, Mus musculus
tgttccatgactcaagagggcagcc

SEQ ID NO: 834233 - DNA, 25 bp, Mus musculus
tgttccatgactgaagagggcagcc

SEQ ID NO: 834234 - DNA, 25 bp, Mus musculus
tgttccatgcccattcgggcaagga

SEQ ID NO: 834235 - DNA, 25 bp, Mus musculus
tgttccatgccctttcgggcaagga

SEQ ID NO: 834236 - DNA, 25 bp, Mus musculus
tgttccatgtgtcggagcacctcag

SEQ ID NO: 834237 - DNA, 25 bp, Mus musculus
tgttccatgtgtgggagcacctcag

SEQ ID NO: 834238 - DNA, 25 bp, Mus musculus
tgttcccactgaatagttcccatga

SEQ ID NO: 834239 - DNA, 25 bp, Mus musculus
tgttcccactgattagttcccatga

SEQ ID NO: 834240 - DNA, 25 bp, Mus musculus
tgttcccagatgagaagctagtcag

SEQ ID NO: 834241 - DNA, 25 bp, Mus musculus
tgttcccagatgtgaagctagtcag

SEQ ID NO: 834242 - DNA, 25 bp, Mus musculus
tgttcccagctaatgctcaggagat

SEQ ID NO: 834243 - DNA, 25 bp, Mus musculus
tgttcccagctattgctcaggagat

SEQ ID NO: 834244 - DNA, 25 bp, Mus musculus
tgttcccaggacactagcttgcttg

SEQ ID NO: 834245 - DNA, 25 bp, Mus musculus
tgttcccaggactctagcttgcttg

SEQ ID NO: 834246 - DNA, 25 bp, Mus musculus
tgttcccaggatcaggtgactgatg

SEQ ID NO: 834247 - DNA, 25 bp, Mus musculus
tgttcccaggatgaggtgactgatg

SEQ ID NO: 834248 - DNA, 25 bp, Mus musculus
tgttcccattacacaattctgtggc

SEQ ID NO: 834249 - DNA, 25 bp, Mus musculus
tgttcccattactcaattctgtggc

SEQ ID NO: 834250 - DNA, 25 bp, Mus musculus
tgttccccacccaggaaatagatgt

SEQ ID NO: 834251 - DNA, 25 bp, Mus musculus
tgttccccaccctggaaatagatgt

SEQ ID NO: 834252 - DNA, 25 bp, Mus musculus
tgttccccgatgagcttttcccagc

SEQ ID NO: 834253 - DNA, 25 bp, Mus musculus
tgttccccgatgtgcttttcccagc

SEQ ID NO: 834254 - DNA, 25 bp, Mus musculus
tgttcccctgacatctccggaggtg

SEQ ID NO: 834255 - DNA, 25 bp, Mus musculus
tgttcccctgacttctccggaggtg

SEQ ID NO: 834256 - DNA, 25 bp, Mus musculus
tgttcccctgtgcaaagaggactgt

SEQ ID NO: 834257 - DNA, 25 bp, Mus musculus
tgttcccctgtggaaagaggactgt

SEQ ID NO: 834258 - DNA, 25 bp, Mus musculus
tgttccccttcaagtgacccctgaa

SEQ ID NO: 834259 - DNA, 25 bp, Mus musculus
tgttccccttcatgtgacccctgaa

SEQ ID NO: 834260 - DNA, 25 bp, Mus musculus
tgttcccgaacaaggaggcctatgc

SEQ ID NO: 834261 - DNA, 25 bp, Mus musculus
tgttcccgaacatggaggcctatgc

SEQ ID NO: 834262 - DNA, 25 bp, Mus musculus
tgttcccgaacccacatgactatgt

SEQ ID NO: 834263 - DNA, 25 bp, Mus musculus
tgttcccgaaccgacatgactatgt

SEQ ID NO: 834264 - DNA, 25 bp, Mus musculus
tgttcccgagacaccgctatgcggt

SEQ ID NO: 834265 - DNA, 25 bp, Mus musculus
tgttcccgagactccgctatgcggt

SEQ ID NO: 834266 - DNA, 25 bp, Mus musculus
tgttcccgaggactgtgacacgtag

SEQ ID NO: 834267 - DNA, 25 bp, Mus musculus
tgttcccgaggagtgtgacacgtag

SEQ ID NO: 834268 - DNA, 25 bp, Mus musculus
tgttcccgatgtcactagcgagcac

SEQ ID NO: 834269 - DNA, 25 bp, Mus musculus
tgttcccgatgtgactagcgagcac

SEQ ID NO: 834270 - DNA, 25 bp, Mus musculus
tgttcccgctttctcaacgacacaa

SEQ ID NO: 834271 - DNA, 25 bp, Mus musculus
tgttcccgctttgtcaacgacacaa

SEQ ID NO: 834272 - DNA, 25 bp, Mus musculus
tgttcccggctgagcatggtagcag

SEQ ID NO: 834273 - DNA, 25 bp, Mus musculus
tgttcccggctgtgcatggtagcag

SEQ ID NO: 834274 - DNA, 25 bp, Mus musculus
tgttcccgggctctcagtgcgattc

SEQ ID NO: 834275 - DNA, 25 bp, Mus musculus
tgttcccgggctgtcagtgcgattc

SEQ ID NO: 834276 - DNA, 25 bp, Mus musculus
tgttcccggtgtagccacagtgcct

SEQ ID NO: 834277 - DNA, 25 bp, Mus musculus
tgttcccggtgttgccacagtgcct

SEQ ID NO: 834278 - DNA, 25 bp, Mus musculus
tgttcccgtctaactgagcgtgctc

SEQ ID NO: 834279 - DNA, 25 bp, Mus musculus
tgttcccgtctatctgagcgtgctc

SEQ ID NO: 834280 - DNA, 25 bp, Mus musculus
tgttccctatggaaatcattcctat

SEQ ID NO: 834281 - DNA, 25 bp, Mus musculus
tgttccctatggtaatcattcctat

SEQ ID NO: 834282 - DNA, 25 bp, Mus musculus
tgttccctcagcagccacggactga

SEQ ID NO: 834283 - DNA, 25 bp, Mus musculus
tgttccctcagctgccacggactga

SEQ ID NO: 834284 - DNA, 25 bp, Mus musculus
tgttccctccaactatatcagattc

SEQ ID NO: 834285 - DNA, 25 bp, Mus musculus
tgttccctccaagtatatcagattc

SEQ ID NO: 834286 - DNA, 25 bp, Mus musculus
tgttccctcttcaggtagcagcggg

SEQ ID NO: 834287 - DNA, 25 bp, Mus musculus
tgttccctcttctggtagcagcggg

SEQ ID NO: 834288 - DNA, 25 bp, Mus musculus
tgttccctgccaccctaattgatgc

SEQ ID NO: 834289 - DNA, 25 bp, Mus musculus
tgttccctgccagcctaattgatgc

SEQ ID NO: 834290 - DNA, 25 bp, Mus musculus
tgttccctgctaatggcagcattga

SEQ ID NO: 834291 - DNA, 25 bp, Mus musculus
tgttccctgctattggcagcattga

SEQ ID NO: 834292 - DNA, 25 bp, Mus musculus
tgttccctggaaatgctaagcagac

SEQ ID NO: 834293 - DNA, 25 bp, Mus musculus
tgttccctggaattgctaagcagac

SEQ ID NO: 834294 - DNA, 25 bp, Mus musculus
tgttccctgtctcacaatgggaagg

SEQ ID NO: 834295 - DNA, 25 bp, Mus musculus
tgttccctgtctgacaatgggaagg

SEQ ID NO: 834296 - DNA, 25 bp, Mus musculus
tgttcccttctcaaggcacttcgga

SEQ ID NO: 834297 - DNA, 25 bp, Mus musculus
tgttcccttctctaggcacttcgga

SEQ ID NO: 834298 - DNA, 25 bp, Mus musculus
tgttccgaaaccaggtcatcatccc

SEQ ID NO: 834299 - DNA, 25 bp, Mus musculus
tgttccgaaacctggtcatcatccc

SEQ ID NO: 834300 - DNA, 25 bp, Mus musculus
tgttccgaatgccaggaatccctca

SEQ ID NO: 834301 - DNA, 25 bp, Mus musculus
tgttccgaatgcgaggaatccctca

SEQ ID NO: 834302 - DNA, 25 bp, Mus musculus
tgttccgacgtcaggccgaggccaa

SEQ ID NO: 834303 - DNA, 25 bp, Mus musculus
tgttccgacgtctggccgaggccaa

SEQ ID NO: 834304 - DNA, 25 bp, Mus musculus
tgttccgactccagaagcgatgcgc

SEQ ID NO: 834305 - DNA, 25 bp, Mus musculus
tgttccgactcctgaagcgatgcgc

SEQ ID NO: 834306 - DNA, 25 bp, Mus musculus
tgttccgagcccagttccaatatcg

SEQ ID NO: 834307 - DNA, 25 bp, Mus musculus
tgttccgagccctgttccaatatcg

SEQ ID NO: 834308 - DNA, 25 bp, Mus musculus
tgttccgagtgtccatcctgcgccg

SEQ ID NO: 834309 - DNA, 25 bp, Mus musculus
tgttccgagtgtgcatcctgcgccg

SEQ ID NO: 834310 - DNA, 25 bp, Mus musculus
tgttccgcacagcagcaaagtgtgc

SEQ ID NO: 834311 - DNA, 25 bp, Mus musculus
tgttccgcacaggagcaaagtgtgc

SEQ ID NO: 834312 - DNA, 25 bp, Mus musculus
tgttccgcccaccactgagaacaag

SEQ ID NO: 834313 - DNA, 25 bp, Mus musculus
tgttccgcccacgactgagaacaag

SEQ ID NO: 834314 - DNA, 25 bp, Mus musculus
tgttccgcctgcagctgatcctgtt

SEQ ID NO: 834315 - DNA, 25 bp, Mus musculus
tgttccgcctgctgctgatcctgtt

SEQ ID NO: 834316 - DNA, 25 bp, Mus musculus
tgttccgctctaccatgaagcctgt

SEQ ID NO: 834317 - DNA, 25 bp, Mus musculus
tgttccgctctagcatgaagcctgt

SEQ ID NO: 834318 - DNA, 25 bp, Mus musculus
tgttccgctgtacaggtgacctgac

SEQ ID NO: 834319 - DNA, 25 bp, Mus musculus
tgttccgctgtagaggtgacctgac

SEQ ID NO: 834320 - DNA, 25 bp, Mus musculus
tgttccggaactatgacgtggatgg

SEQ ID NO: 834321 - DNA, 25 bp, Mus musculus
tgttccggaactttgacgtggatgg

SEQ ID NO: 834322 - DNA, 25 bp, Mus musculus
tgttccggagctcggccattcacac

SEQ ID NO: 834323 - DNA, 25 bp, Mus musculus
tgttccggagctgggccattcacac

SEQ ID NO: 834324 - DNA, 25 bp, Mus musculus
tgttccggatctcacctgttatagt

SEQ ID NO: 834325 - DNA, 25 bp, Mus musculus
tgttccggatctgacctgttatagt

SEQ ID NO: 834326 - DNA, 25 bp, Mus musculus
tgttccggcagaacgtggatgctca

SEQ ID NO: 834327 - DNA, 25 bp, Mus musculus
tgttccggcagatcgtggatgctca

SEQ ID NO: 834328 - DNA, 25 bp, Mus musculus
tgttccggtttaaccaccctgagca

SEQ ID NO: 834329 - DNA, 25 bp, Mus musculus
tgttccggtttatccaccctgagca

SEQ ID NO: 834330 - DNA, 25 bp, Mus musculus
tgttccgtaagaacactaatgccaa

SEQ ID NO: 834331 - DNA, 25 bp, Mus musculus
tgttccgtaagatcactaatgccaa

SEQ ID NO: 834332 - DNA, 25 bp, Mus musculus
tgttccgtgcaacatgactctaacg

SEQ ID NO: 834333 - DNA, 25 bp, Mus musculus
tgttccgtgcaagatgactctaacg

SEQ ID NO: 834334 - DNA, 25 bp, Mus musculus
tgttcctaaccaccattttacagaa

SEQ ID NO: 834335 - DNA, 25 bp, Mus musculus
tgttcctaaccagcattttacagaa

SEQ ID NO: 834336 - DNA, 25 bp, Mus musculus
tgttcctaagtacccagttgccatg

SEQ ID NO: 834337 - DNA, 25 bp, Mus musculus
tgttcctaagtagccagttgccatg

SEQ ID NO: 834338 - DNA, 25 bp, Mus musculus
tgttcctacaagagagtcagaaaga

SEQ ID NO: 834339 - DNA, 25 bp, Mus musculus
tgttcctacaagtgagtcagaaaga

SEQ ID NO: 834340 - DNA, 25 bp, Mus musculus
tgttcctactgcaggcctgtgaaga

SEQ ID NO: 834341 - DNA, 25 bp, Mus musculus
tgttcctactgctggcctgtgaaga

SEQ ID NO: 834342 - DNA, 25 bp, Mus musculus
tgttcctagccgacttgcctttctc

SEQ ID NO: 834343 - DNA, 25 bp, Mus musculus
tgttcctagccgtcttgcctttctc

SEQ ID NO: 834344 - DNA, 25 bp, Mus musculus
tgttcctcaaagacattcaagctgt

SEQ ID NO: 834345 - DNA, 25 bp, Mus musculus
tgttcctcaaagtcattcaagctgt

SEQ ID NO: 834346 - DNA, 25 bp, Mus musculus
tgttcctcactcagttcaagcacaa

SEQ ID NO: 834347 - DNA, 25 bp, Mus musculus
tgttcctcactctgttcaagcacaa

SEQ ID NO: 834348 - DNA, 25 bp, Mus musculus
tgttcctcatggatacagcttctac

SEQ ID NO: 834349 - DNA, 25 bp, Mus musculus
tgttcctcatggttacagcttctac

SEQ ID NO: 834350 - DNA, 25 bp, Mus musculus
tgttcctccagaatctcggacctcg

SEQ ID NO: 834351 - DNA, 25 bp, Mus musculus
tgttcctccagattctcggacctcg

SEQ ID NO: 834352 - DNA, 25 bp, Mus musculus
tgttcctcccatcgtgggaggccct

SEQ ID NO: 834353 - DNA, 25 bp, Mus musculus
tgttcctcccatggtgggaggccct

SEQ ID NO: 834354 - DNA, 25 bp, Mus musculus
tgttcctccgagagcggcattacgg

SEQ ID NO: 834355 - DNA, 25 bp, Mus musculus
tgttcctccgagtgcggcattacgg

SEQ ID NO: 834356 - DNA, 25 bp, Mus musculus
tgttcctcctgtacaaggcagggac

SEQ ID NO: 834357 - DNA, 25 bp, Mus musculus
tgttcctcctgttcaaggcagggac

SEQ ID NO: 834358 - DNA, 25 bp, Mus musculus
tgttcctctactcccactggtgagc

SEQ ID NO: 834359 - DNA, 25 bp, Mus musculus
tgttcctctactgccactggtgagc

SEQ ID NO: 834360 - DNA, 25 bp, Mus musculus
tgttcctctgagcattactgaccgc

SEQ ID NO: 834361 - DNA, 25 bp, Mus musculus
tgttcctctgaggattactgaccgc

SEQ ID NO: 834362 - DNA, 25 bp, Mus musculus
tgttcctcttgaatgtgatcctcca

SEQ ID NO: 834363 - DNA, 25 bp, Mus musculus
tgttcctcttgattgtgatcctcca

SEQ ID NO: 834364 - DNA, 25 bp, Mus musculus
tgttcctcttgtacctgctggatgt

SEQ ID NO: 834365 - DNA, 25 bp, Mus musculus
tgttcctcttgttcctgctggatgt

SEQ ID NO: 834366 - DNA, 25 bp, Mus musculus
tgttcctgaaaaccagggattgcct

SEQ ID NO: 834367 - DNA, 25 bp, Mus musculus
tgttcctgaaaagcagggattgcct

SEQ ID NO: 834368 - DNA, 25 bp, Mus musculus
tgttcctgaaaccaagctagaagtt

SEQ ID NO: 834369 - DNA, 25 bp, Mus musculus
tgttcctgaaacgaagctagaagtt

SEQ ID NO: 834370 - DNA, 25 bp, Mus musculus
tgttcctgacttcataaaccgcggg

SEQ ID NO: 834371 - DNA, 25 bp, Mus musculus
tgttcctgacttccaagcaggccac

SEQ ID NO: 834372 - DNA, 25 bp, Mus musculus
tgttcctgacttcgaaacactattc

SEQ ID NO: 834373 - DNA, 25 bp, Mus musculus
tgttcctgacttgataaaccgcggg

SEQ ID NO: 834374 - DNA, 25 bp, Mus musculus
tgttcctgacttgcaagcaggccac

SEQ ID NO: 834375 - DNA, 25 bp, Mus musculus
tgttcctgacttggaaacactattc

SEQ ID NO: 834376 - DNA, 25 bp, Mus musculus
tgttcctgatgaagtccagcctatc

SEQ ID NO: 834377 - DNA, 25 bp, Mus musculus
tgttcctgatgatgtccagcctatc

SEQ ID NO: 834378 - DNA, 25 bp, Mus musculus
tgttcctgattaagcatccttccat

SEQ ID NO: 834379 - DNA, 25 bp, Mus musculus
tgttcctgattatgcatccttccat

SEQ ID NO: 834380 - DNA, 25 bp, Mus musculus
tgttcctgcacaacgcggtgctagt

SEQ ID NO: 834381 - DNA, 25 bp, Mus musculus
tgttcctgcacacttcattggctgg

SEQ ID NO: 834382 - DNA, 25 bp, Mus musculus
tgttcctgcacagttcattggctgg

SEQ ID NO: 834383 - DNA, 25 bp, Mus musculus
tgttcctgcacatcgcggtgctagt

SEQ ID NO: 834384 - DNA, 25 bp, Mus musculus
tgttcctgcgccacatgatcttggc

SEQ ID NO: 834385 - DNA, 25 bp, Mus musculus
tgttcctgcgcctcatgatcttggc

SEQ ID NO: 834386 - DNA, 25 bp, Mus musculus
tgttcctgctgaagcgaggccttct

SEQ ID NO: 834387 - DNA, 25 bp, Mus musculus
tgttcctgctgatgcgaggccttct

SEQ ID NO: 834388 - DNA, 25 bp, Mus musculus
tgttcctgcttgattgcttcagcgt

SEQ ID NO: 834389 - DNA, 25 bp, Mus musculus
tgttcctgcttgtttgcttcagcgt

SEQ ID NO: 834390 - DNA, 25 bp, Mus musculus
tgttcctggacaacaatccctgggt

SEQ ID NO: 834391 - DNA, 25 bp, Mus musculus
tgttcctggacatcaatccctgggt

SEQ ID NO: 834392 - DNA, 25 bp, Mus musculus
tgttcctggcacatcattgcaccct

SEQ ID NO: 834393 - DNA, 25 bp, Mus musculus
tgttcctggcacttcattgcaccct

SEQ ID NO: 834394 - DNA, 25 bp, Mus musculus
tgttcctggcgcctcagcaagcact

SEQ ID NO: 834395 - DNA, 25 bp, Mus musculus
tgttcctggcgcgtcagcaagcact

SEQ ID NO: 834396 - DNA, 25 bp, Mus musculus
tgttcctgggcgacggcagaacacc

SEQ ID NO: 834397 - DNA, 25 bp, Mus musculus
tgttcctgggcgtcggcagaacacc

SEQ ID NO: 834398 - DNA, 25 bp, Mus musculus
tgttcctggtggattacaaagcctt

SEQ ID NO: 834399 - DNA, 25 bp, Mus musculus
tgttcctggtggctaacttcctgct

SEQ ID NO: 834400 - DNA, 25 bp, Mus musculus
tgttcctggtgggtaacttcctgct

SEQ ID NO: 834401 - DNA, 25 bp, Mus musculus
tgttcctggtggtttacaaagcctt

SEQ ID NO: 834402 - DNA, 25 bp, Mus musculus
tgttcctggtgtctctagcaacctg

SEQ ID NO: 834403 - DNA, 25 bp, Mus musculus
tgttcctggtgtgtctagcaacctg

SEQ ID NO: 834404 - DNA, 25 bp, Mus musculus
tgttcctgtaccacctcaggatcag

SEQ ID NO: 834405 - DNA, 25 bp, Mus musculus
tgttcctgtacctcctcaggatcag

SEQ ID NO: 834406 - DNA, 25 bp, Mus musculus
tgttcctgtcccaggtgttcctggc

SEQ ID NO: 834407 - DNA, 25 bp, Mus musculus
tgttcctgtccctggtgttcctggc

SEQ ID NO: 834408 - DNA, 25 bp, Mus musculus
tgttcctgtctacgctcctagtgcc

SEQ ID NO: 834409 - DNA, 25 bp, Mus musculus
tgttcctgtctaggctcctagtgcc

SEQ ID NO: 834410 - DNA, 25 bp, Mus musculus
tgttcctgtggaagtcgtgggtgac

SEQ ID NO: 834411 - DNA, 25 bp, Mus musculus
tgttcctgtggacaaagtggcctct

SEQ ID NO: 834412 - DNA, 25 bp, Mus musculus
tgttcctgtggagaaagtggcctct

SEQ ID NO: 834413 - DNA, 25 bp, Mus musculus
tgttcctgtggatgtcgtgggtgac

SEQ ID NO: 834414 - DNA, 25 bp, Mus musculus
tgttcctgtgtaagagcaagcgacc

SEQ ID NO: 834415 - DNA, 25 bp, Mus musculus
tgttcctgtgtatgagcaagcgacc

SEQ ID NO: 834416 - DNA, 25 bp, Mus musculus
tgttcctgttctcttgccgttccaa

SEQ ID NO: 834417 - DNA, 25 bp, Mus musculus
tgttcctgttctgttgccgttccaa

SEQ ID NO: 834418 - DNA, 25 bp, Mus musculus
tgttccttacataggaattgtgacg

SEQ ID NO: 834419 - DNA, 25 bp, Mus musculus
tgttccttacattggaattgtgacg

SEQ ID NO: 834420 - DNA, 25 bp, Mus musculus
tgttccttccggagtcctgaagacg

SEQ ID NO: 834421 - DNA, 25 bp, Mus musculus
tgttccttccggtgtcctgaagacg

SEQ ID NO: 834422 - DNA, 25 bp, Mus musculus
tgttcctttgtacattcccctgaga

SEQ ID NO: 834423 - DNA, 25 bp, Mus musculus
tgttcctttgtagattcccctgaga

SEQ ID NO: 834424 - DNA, 25 bp, Mus musculus
tgttccttttgaattccaagcagaa

SEQ ID NO: 834425 - DNA, 25 bp, Mus musculus
tgttccttttgatttccaagcagaa

SEQ ID NO: 834426 - DNA, 25 bp, Mus musculus
tgttcgaaatggcaatgaggcacag

SEQ ID NO: 834427 - DNA, 25 bp, Mus musculus
tgttcgaaatgggaatgaggcacag

SEQ ID NO: 834428 - DNA, 25 bp, Mus musculus
tgttcgaagcctacacaacctggcc

SEQ ID NO: 834429 - DNA, 25 bp, Mus musculus
tgttcgaagccttcacaacctggcc

SEQ ID NO: 834430 - DNA, 25 bp, Mus musculus
tgttcgaaggtgatcttcatatgaa

SEQ ID NO: 834431 - DNA, 25 bp, Mus musculus
tgttcgaaggtgttcttcatatgaa

SEQ ID NO: 834432 - DNA, 25 bp, Mus musculus
tgttcgaagtcaatgaaacggaaaa

SEQ ID NO: 834433 - DNA, 25 bp, Mus musculus
tgttcgaagtcattgaaacggaaaa

SEQ ID NO: 834434 - DNA, 25 bp, Mus musculus
tgttcgaccgcgagtacacacacca

SEQ ID NO: 834435 - DNA, 25 bp, Mus musculus
tgttcgaccgcgtgtacacacacca

SEQ ID NO: 834436 - DNA, 25 bp, Mus musculus
tgttcgacctggaggtgaactgcct

SEQ ID NO: 834437 - DNA, 25 bp, Mus musculus
tgttcgacctggtggtgaactgcct

SEQ ID NO: 834438 - DNA, 25 bp, Mus musculus
tgttcgacgtgaagaacgctttcta

SEQ ID NO: 834439 - DNA, 25 bp, Mus musculus
tgttcgacgtgatgaacgctttcta

SEQ ID NO: 834440 - DNA, 25 bp, Mus musculus
tgttcgacgtggctcccgagagcgt

SEQ ID NO: 834441 - DNA, 25 bp, Mus musculus
tgttcgacgtgggtcccgagagcgt

SEQ ID NO: 834442 - DNA, 25 bp, Mus musculus
tgttcgacttccaccaggcagtgga

SEQ ID NO: 834443 - DNA, 25 bp, Mus musculus
tgttcgacttcctccaggcagtgga

SEQ ID NO: 834444 - DNA, 25 bp, Mus musculus
tgttcgagaaggatctccagccaac

SEQ ID NO: 834445 - DNA, 25 bp, Mus musculus
tgttcgagaaggttctccagccaac

SEQ ID NO: 834446 - DNA, 25 bp, Mus musculus
tgttcgagcagtacaacattcctgc

SEQ ID NO: 834447 - DNA, 25 bp, Mus musculus
tgttcgagcagttcaacattcctgc

SEQ ID NO: 834448 - DNA, 25 bp, Mus musculus
tgttcgagctgaacctcatggagga

SEQ ID NO: 834449 - DNA, 25 bp, Mus musculus
tgttcgagctgatcctcatggagga

SEQ ID NO: 834450 - DNA, 25 bp, Mus musculus
tgttcgaggcccagcaggagacaag

SEQ ID NO: 834451 - DNA, 25 bp, Mus musculus
tgttcgaggccctgcaggagacaag

SEQ ID NO: 834452 - DNA, 25 bp, Mus musculus
tgttcgaggctcagggtttactcct

SEQ ID NO: 834453 - DNA, 25 bp, Mus musculus
tgttcgaggctctgggtttactcct

SEQ ID NO: 834454 - DNA, 25 bp, Mus musculus
tgttcgagggtgaccacagggtctc

SEQ ID NO: 834455 - DNA, 25 bp, Mus musculus
tgttcgagggtgtccacagggtctc

SEQ ID NO: 834456 - DNA, 25 bp, Mus musculus
tgttcgagtcatccctactgatgac

SEQ ID NO: 834457 - DNA, 25 bp, Mus musculus
tgttcgagtcatgcctactgatgac

SEQ ID NO: 834458 - DNA, 25 bp, Mus musculus
tgttcgataactctccagctgtgac

SEQ ID NO: 834459 - DNA, 25 bp, Mus musculus
tgttcgataactgtccagctgtgac

SEQ ID NO: 834460 - DNA, 25 bp, Mus musculus
tgttcgatgccgaggatggagccac

SEQ ID NO: 834461 - DNA, 25 bp, Mus musculus
tgttcgatgccgtggatggagccac

SEQ ID NO: 834462 - DNA, 25 bp, Mus musculus
tgttcgcaagctccagagctgcctg

SEQ ID NO: 834463 - DNA, 25 bp, Mus musculus
tgttcgcaagctgcagagctgcctg

SEQ ID NO: 834464 - DNA, 25 bp, Mus musculus
tgttcgcacaggatagtgatgcacc

SEQ ID NO: 834465 - DNA, 25 bp, Mus musculus
tgttcgcacaggttagtgatgcacc

SEQ ID NO: 834466 - DNA, 25 bp, Mus musculus
tgttcgcccctcaagaatggcatga

SEQ ID NO: 834467 - DNA, 25 bp, Mus musculus
tgttcgcccctctagaatggcatga

SEQ ID NO: 834468 - DNA, 25 bp, Mus musculus
tgttcgcgggatccccgcacaaaac

SEQ ID NO: 834469 - DNA, 25 bp, Mus musculus
tgttcgcgggatgcccgcacaaaac

SEQ ID NO: 834470 - DNA, 25 bp, Mus musculus
tgttcgctccagcactctgactctg

SEQ ID NO: 834471 - DNA, 25 bp, Mus musculus
tgttcgctccaggactctgactctg

SEQ ID NO: 834472 - DNA, 25 bp, Mus musculus
tgttcgctcgctactgctgttccaa

SEQ ID NO: 834473 - DNA, 25 bp, Mus musculus
tgttcgctcgcttctgctgttccaa

SEQ ID NO: 834474 - DNA, 25 bp, Mus musculus
tgttcgctggatcatgacaccattc

SEQ ID NO: 834475 - DNA, 25 bp, Mus musculus
tgttcgctggatgatgacaccattc

SEQ ID NO: 834476 - DNA, 25 bp, Mus musculus
tgttcggaaaccacttatcctgggc

SEQ ID NO: 834477 - DNA, 25 bp, Mus musculus
tgttcggaaacctcttatcctgggc

SEQ ID NO: 834478 - DNA, 25 bp, Mus musculus
tgttcggaaggaaagatgcccagtg

SEQ ID NO: 834479 - DNA, 25 bp, Mus musculus
tgttcggaaggatagatgcccagtg

SEQ ID NO: 834480 - DNA, 25 bp, Mus musculus
tgttcggagattatgggcacggcat

SEQ ID NO: 834481 - DNA, 25 bp, Mus musculus
tgttcggagattttgggcacggcat

SEQ ID NO: 834482 - DNA, 25 bp, Mus musculus
tgttcggatcttcggcagcctgctg

SEQ ID NO: 834483 - DNA, 25 bp, Mus musculus
tgttcggatcttgggcagcctgctg

SEQ ID NO: 834484 - DNA, 25 bp, Mus musculus
tgttcggatgtcacaggagaagcag

SEQ ID NO: 834485 - DNA, 25 bp, Mus musculus
tgttcggatgtctcaggagaagcag

SEQ ID NO: 834486 - DNA, 25 bp, Mus musculus
tgttcggcaagcatggtgtcctgct

SEQ ID NO: 834487 - DNA, 25 bp, Mus musculus
tgttcggcaagcttggtgtcctgct

SEQ ID NO: 834488 - DNA, 25 bp, Mus musculus
tgttcggctagacctgcgacgacac

SEQ ID NO: 834489 - DNA, 25 bp, Mus musculus
tgttcggctagagctgcgacgacac

SEQ ID NO: 834490 - DNA, 25 bp, Mus musculus
tgttcgggacagaacgccaccccga

SEQ ID NO: 834491 - DNA, 25 bp, Mus musculus
tgttcgggacagtacgccaccccga

SEQ ID NO: 834492 - DNA, 25 bp, Mus musculus
tgttcgggagccaaaaggaagactg

SEQ ID NO: 834493 - DNA, 25 bp, Mus musculus
tgttcgggagcctaaaggaagactg

SEQ ID NO: 834494 - DNA, 25 bp, Mus musculus
tgttcggtattgacaaggacgccat

SEQ ID NO: 834495 - DNA, 25 bp, Mus musculus
tgttcggtattgtcaaggacgccat

SEQ ID NO: 834496 - DNA, 25 bp, Mus musculus
tgttcgtaccggaagcatctcggtg

SEQ ID NO: 834497 - DNA, 25 bp, Mus musculus
tgttcgtaccggtagcatctcggtg

SEQ ID NO: 834498 - DNA, 25 bp, Mus musculus
tgttcgtcaagaactcgcagcccaa

SEQ ID NO: 834499 - DNA, 25 bp, Mus musculus
tgttcgtcaagatctcgcagcccaa

SEQ ID NO: 834500 - DNA, 25 bp, Mus musculus
tgttcgtcatgccttgtttccaggt

SEQ ID NO: 834501 - DNA, 25 bp, Mus musculus
tgttcgtcatgcgttgtttccaggt

SEQ ID NO: 834502 - DNA, 25 bp, Mus musculus
tgttcgtcgccaacaacggagacca

SEQ ID NO: 834503 - DNA, 25 bp, Mus musculus
tgttcgtcgccatcaacggagacca

SEQ ID NO: 834504 - DNA, 25 bp, Mus musculus
tgttcgtgaaatcttccaaaatggc

SEQ ID NO: 834505 - DNA, 25 bp, Mus musculus
tgttcgtgaaatgttccaaaatggc

SEQ ID NO: 834506 - DNA, 25 bp, Mus musculus
tgttcgtgcacaactagaccacatc

SEQ ID NO: 834507 - DNA, 25 bp, Mus musculus
tgttcgtgcacatctagaccacatc

SEQ ID NO: 834508 - DNA, 25 bp, Mus musculus
tgttcgtgcagcagatgcccatcct

SEQ ID NO: 834509 - DNA, 25 bp, Mus musculus
tgttcgtgcagctgatgcccatcct

SEQ ID NO: 834510 - DNA, 25 bp, Mus musculus
tgttcgtgccaacgaacatcctgac

SEQ ID NO: 834511 - DNA, 25 bp, Mus musculus
tgttcgtgccaaggaacatcctgac

SEQ ID NO: 834512 - DNA, 25 bp, Mus musculus
tgttcgtggaagagcaggtctacgg

SEQ ID NO: 834513 - DNA, 25 bp, Mus musculus
tgttcgtggaagtgcaggtctacgg

SEQ ID NO: 834514 - DNA, 25 bp, Mus musculus
tgttcgtggacgcagctgttgtatc

SEQ ID NO: 834515 - DNA, 25 bp, Mus musculus
tgttcgtggacggagctgttgtatc

SEQ ID NO: 834516 - DNA, 25 bp, Mus musculus
tgttcgtggactcgattaacaaggt

SEQ ID NO: 834517 - DNA, 25 bp, Mus musculus
tgttcgtggactggattaacaaggt

SEQ ID NO: 834518 - DNA, 25 bp, Mus musculus
tgttcgtgggctccagtgtcaccct

SEQ ID NO: 834519 - DNA, 25 bp, Mus musculus
tgttcgtgggctgcagtgtcaccct

SEQ ID NO: 834520 - DNA, 25 bp, Mus musculus
tgttcgtgggtaaaaatcacgccag

SEQ ID NO: 834521 - DNA, 25 bp, Mus musculus
tgttcgtgggtataaatcacgccag

SEQ ID NO: 834522 - DNA, 25 bp, Mus musculus
tgttcgtgggtcagaaaggctctgc

SEQ ID NO: 834523 - DNA, 25 bp, Mus musculus
tgttcgtgggtctgaaaggctctgc

SEQ ID NO: 834524 - DNA, 25 bp, Mus musculus
tgttcgttcacgaggctgaggtgat

SEQ ID NO: 834525 - DNA, 25 bp, Mus musculus
tgttcgttcacgtggctgaggtgat

SEQ ID NO: 834526 - DNA, 25 bp, Mus musculus
tgttcgttcttgcagcaacatcccc

SEQ ID NO: 834527 - DNA, 25 bp, Mus musculus
tgttcgttcttggagcaacatcccc

SEQ ID NO: 834528 - DNA, 25 bp, Mus musculus
tgttcgttggaaaggacctgtgacc

SEQ ID NO: 834529 - DNA, 25 bp, Mus musculus
tgttcgttggaatggacctgtgacc

SEQ ID NO: 834530 - DNA, 25 bp, Mus musculus
tgttctaaggtacacaggagttggc

SEQ ID NO: 834531 - DNA, 25 bp, Mus musculus
tgttctaaggtagacaggagttggc

SEQ ID NO: 834532 - DNA, 25 bp, Mus musculus
tgttctacattgaggctttgtttgg

SEQ ID NO: 834533 - DNA, 25 bp, Mus musculus
tgttctacattgtggctttgtttgg

SEQ ID NO: 834534 - DNA, 25 bp, Mus musculus
tgttctaccaaaacacatgatgcta

SEQ ID NO: 834535 - DNA, 25 bp, Mus musculus
tgttctaccaaatcacatgatgcta

SEQ ID NO: 834536 - DNA, 25 bp, Mus musculus
tgttctaccatcatggccacttcag

SEQ ID NO: 834537 - DNA, 25 bp, Mus musculus
tgttctaccatcttggccacttcag

SEQ ID NO: 834538 - DNA, 25 bp, Mus musculus
tgttctaccttccttacgagcacgg

SEQ ID NO: 834539 - DNA, 25 bp, Mus musculus
tgttctaccttcgttacgagcacgg

SEQ ID NO: 834540 - DNA, 25 bp, Mus musculus
tgttctacgtctcagatggagtgtg

SEQ ID NO: 834541 - DNA, 25 bp, Mus musculus
tgttctacgtctgagatggagtgtg

SEQ ID NO: 834542 - DNA, 25 bp, Mus musculus
tgttctactttgcatccgttcctct

SEQ ID NO: 834543 - DNA, 25 bp, Mus musculus
tgttctactttggatccgttcctct

SEQ ID NO: 834544 - DNA, 25 bp, Mus musculus
tgttctagtgaacctgctacagcaa

SEQ ID NO: 834545 - DNA, 25 bp, Mus musculus
tgttctagtgaagctgctacagcaa

SEQ ID NO: 834546 - DNA, 25 bp, Mus musculus
tgttctatacgacgcaactgcagtg

SEQ ID NO: 834547 - DNA, 25 bp, Mus musculus
tgttctatacgaggcaactgcagtg

SEQ ID NO: 834548 - DNA, 25 bp, Mus musculus
tgttctatagttatcaggataagct

SEQ ID NO: 834549 - DNA, 25 bp, Mus musculus
tgttctatagttttcaggataagct

SEQ ID NO: 834550 - DNA, 25 bp, Mus musculus
tgttctatcacgaacacgggcacgt

SEQ ID NO: 834551 - DNA, 25 bp, Mus musculus
tgttctatcacgtacacgggcacgt

SEQ ID NO: 834552 - DNA, 25 bp, Mus musculus
tgttctatcagcagctctcaggcgc

SEQ ID NO: 834553 - DNA, 25 bp, Mus musculus
tgttctatcagctgctctcaggcgc

SEQ ID NO: 834554 - DNA, 25 bp, Mus musculus
tgttctatgaaacgctgcatgagag

SEQ ID NO: 834555 - DNA, 25 bp, Mus musculus
tgttctatgaaaggctgcatgagag

SEQ ID NO: 834556 - DNA, 25 bp, Mus musculus
tgttctatgaccactgcctgctgtt

SEQ ID NO: 834557 - DNA, 25 bp, Mus musculus
tgttctatgacctctgcctgctgtt

SEQ ID NO: 834558 - DNA, 25 bp, Mus musculus
tgttctatggaactagacaccaggt

SEQ ID NO: 834559 - DNA, 25 bp, Mus musculus
tgttctatggaagtagacaccaggt

SEQ ID NO: 834560 - DNA, 25 bp, Mus musculus
tgttctatgtccctttccccgtggg

SEQ ID NO: 834561 - DNA, 25 bp, Mus musculus
tgttctatgtccgtttccccgtggg

SEQ ID NO: 834562 - DNA, 25 bp, Mus musculus
tgttctattccaagattcctctctg

SEQ ID NO: 834563 - DNA, 25 bp, Mus musculus
tgttctattccatgattcctctctg

SEQ ID NO: 834564 - DNA, 25 bp, Mus musculus
tgttctattctccagttgacttccc

SEQ ID NO: 834565 - DNA, 25 bp, Mus musculus
tgttctattctcgagttgacttccc

SEQ ID NO: 834566 - DNA, 25 bp, Mus musculus
tgttctcaaagacgagatgctcctg

SEQ ID NO: 834567 - DNA, 25 bp, Mus musculus
tgttctcaaagaggagatgctcctg

SEQ ID NO: 834568 - DNA, 25 bp, Mus musculus
tgttctcaagaacggaaaggacatc

SEQ ID NO: 834569 - DNA, 25 bp, Mus musculus
tgttctcaagaagggaaaggacatc

SEQ ID NO: 834570 - DNA, 25 bp, Mus musculus
tgttctcacaaaagatccctcctaa

SEQ ID NO: 834571 - DNA, 25 bp, Mus musculus
tgttctcacaaatgatccctcctaa

SEQ ID NO: 834572 - DNA, 25 bp, Mus musculus
tgttctcacagaattctgccccagg

SEQ ID NO: 834573 - DNA, 25 bp, Mus musculus
tgttctcacagatttctgccccagg

SEQ ID NO: 834574 - DNA, 25 bp, Mus musculus
tgttctcacaggcatggcagtttct

SEQ ID NO: 834575 - DNA, 25 bp, Mus musculus
tgttctcacagggatggcagtttct

SEQ ID NO: 834576 - DNA, 25 bp, Mus musculus
tgttctcacataaggcctagctttt

SEQ ID NO: 834577 - DNA, 25 bp, Mus musculus
tgttctcacatatggcctagctttt

SEQ ID NO: 834578 - DNA, 25 bp, Mus musculus
tgttctcaccagatcagtttcagag

SEQ ID NO: 834579 - DNA, 25 bp, Mus musculus
tgttctcaccagttcagtttcagag

SEQ ID NO: 834580 - DNA, 25 bp, Mus musculus
tgttctcagaataagatcgtcgacc

SEQ ID NO: 834581 - DNA, 25 bp, Mus musculus
tgttctcagaattagatcgtcgacc

SEQ ID NO: 834582 - DNA, 25 bp, Mus musculus
tgttctcagactaagccactctttg

SEQ ID NO: 834583 - DNA, 25 bp, Mus musculus
tgttctcagacttagccactctttg

SEQ ID NO: 834584 - DNA, 25 bp, Mus musculus
tgttctcaggccaggagtacacact

SEQ ID NO: 834585 - DNA, 25 bp, Mus musculus
tgttctcaggcctggagtacacact

SEQ ID NO: 834586 - DNA, 25 bp, Mus musculus
tgttctccagaaacgatttcagcat

SEQ ID NO: 834587 - DNA, 25 bp, Mus musculus
tgttctccagaatcgatttcagcat

SEQ ID NO: 834588 - DNA, 25 bp, Mus musculus
tgttctccagacagtgcaatcgcct

SEQ ID NO: 834589 - DNA, 25 bp, Mus musculus
tgttctccagactgtgcaatcgcct

SEQ ID NO: 834590 - DNA, 25 bp, Mus musculus
tgttctccagtcactaaggagctgt

SEQ ID NO: 834591 - DNA, 25 bp, Mus musculus
tgttctccagtctctaaggagctgt

SEQ ID NO: 834592 - DNA, 25 bp, Mus musculus
tgttctcccaccaacggcggattgg

SEQ ID NO: 834593 - DNA, 25 bp, Mus musculus
tgttctcccacctacggcggattgg

SEQ ID NO: 834594 - DNA, 25 bp, Mus musculus
tgttctccctgactgattgctgcct

SEQ ID NO: 834595 - DNA, 25 bp, Mus musculus
tgttctccctgagtgattgctgcct

SEQ ID NO: 834596 - DNA, 25 bp, Mus musculus
tgttctccctggaaccgaggcttcg

SEQ ID NO: 834597 - DNA, 25 bp, Mus musculus
tgttctccctggtaccgaggcttcg

SEQ ID NO: 834598 - DNA, 25 bp, Mus musculus
tgttctccgaggaccgggcccgctt

SEQ ID NO: 834599 - DNA, 25 bp, Mus musculus
tgttctccgaggtccgggcccgctt

SEQ ID NO: 834600 - DNA, 25 bp, Mus musculus
tgttctccgcggagctcagctccaa

SEQ ID NO: 834601 - DNA, 25 bp, Mus musculus
tgttctccgcggtgctcagctccaa

SEQ ID NO: 834602 - DNA, 25 bp, Mus musculus
tgttctcctggcaccccgttcttat

SEQ ID NO: 834603 - DNA, 25 bp, Mus musculus
tgttctcctggctccccgttcttat

SEQ ID NO: 834604 - DNA, 25 bp, Mus musculus
tgttctcgaacccattccgggtgaa

SEQ ID NO: 834605 - DNA, 25 bp, Mus musculus
tgttctcgaaccgattccgggtgaa

SEQ ID NO: 834606 - DNA, 25 bp, Mus musculus
tgttctcgggctaggctcatgtgaa

SEQ ID NO: 834607 - DNA, 25 bp, Mus musculus
tgttctcgggcttggctcatgtgaa

SEQ ID NO: 834608 - DNA, 25 bp, Mus musculus
tgttctctaacaagggtcgccctgc

SEQ ID NO: 834609 - DNA, 25 bp, Mus musculus
tgttctctaacatgggtcgccctgc

SEQ ID NO: 834610 - DNA, 25 bp, Mus musculus
tgttctctaaccaggcctctgacga

SEQ ID NO: 834611 - DNA, 25 bp, Mus musculus
tgttctctaacctggcctctgacga

SEQ ID NO: 834612 - DNA, 25 bp, Mus musculus
tgttctctcgaaaccatcggagtcg

SEQ ID NO: 834613 - DNA, 25 bp, Mus musculus
tgttctctcgaatccatcggagtcg

SEQ ID NO: 834614 - DNA, 25 bp, Mus musculus
tgttctctcggactcaactctggtt

SEQ ID NO: 834615 - DNA, 25 bp, Mus musculus
tgttctctcggagtcaactctggtt

SEQ ID NO: 834616 - DNA, 25 bp, Mus musculus
tgttctctgagaacacaagtctgtc

SEQ ID NO: 834617 - DNA, 25 bp, Mus musculus
tgttctctgagatcacaagtctgtc

SEQ ID NO: 834618 - DNA, 25 bp, Mus musculus
tgttctctgcacacctgactgggat

SEQ ID NO: 834619 - DNA, 25 bp, Mus musculus
tgttctctgcactcctgactgggat

SEQ ID NO: 834620 - DNA, 25 bp, Mus musculus
tgttctctgcagacattttggattg

SEQ ID NO: 834621 - DNA, 25 bp, Mus musculus
tgttctctgcagatgagtggccgga

SEQ ID NO: 834622 - DNA, 25 bp, Mus musculus
tgttctctgcagtcattttggattg

SEQ ID NO: 834623 - DNA, 25 bp, Mus musculus
tgttctctgcagttgagtggccgga

SEQ ID NO: 834624 - DNA, 25 bp, Mus musculus
tgttctctgggtactatctgccaag

SEQ ID NO: 834625 - DNA, 25 bp, Mus musculus
tgttctctgggttctatctgccaag

SEQ ID NO: 834626 - DNA, 25 bp, Mus musculus
tgttctctgtagagctggtggcgtt

SEQ ID NO: 834627 - DNA, 25 bp, Mus musculus
tgttctctgtagtgctggtggcgtt

SEQ ID NO: 834628 - DNA, 25 bp, Mus musculus
tgttctcttccacctactgttgcag

SEQ ID NO: 834629 - DNA, 25 bp, Mus musculus
tgttctcttccagctactgttgcag

SEQ ID NO: 834630 - DNA, 25 bp, Mus musculus
tgttctcttggaatacaactacgtg

SEQ ID NO: 834631 - DNA, 25 bp, Mus musculus
tgttctcttggattacaactacgtg

SEQ ID NO: 834632 - DNA, 25 bp, Mus musculus
tgttctgaatggcaacaagttctgg

SEQ ID NO: 834633 - DNA, 25 bp, Mus musculus
tgttctgaatgggaacaagttctgg

SEQ ID NO: 834634 - DNA, 25 bp, Mus musculus
tgttctgactgcagcagccgtctca

SEQ ID NO: 834635 - DNA, 25 bp, Mus musculus
tgttctgactgctgcagccgtctca

SEQ ID NO: 834636 - DNA, 25 bp, Mus musculus
tgttctgagccaagaagtgaccaag

SEQ ID NO: 834637 - DNA, 25 bp, Mus musculus
tgttctgagccatgaagtgaccaag

SEQ ID NO: 834638 - DNA, 25 bp, Mus musculus
tgttctgagtgcacgcctagttaag

SEQ ID NO: 834639 - DNA, 25 bp, Mus musculus
tgttctgagtgctcgcctagttaag

SEQ ID NO: 834640 - DNA, 25 bp, Mus musculus
tgttctgatcgtaaagcttgtggct

SEQ ID NO: 834641 - DNA, 25 bp, Mus musculus
tgttctgatcgttaagcttgtggct

SEQ ID NO: 834642 - DNA, 25 bp, Mus musculus
tgttctgcacttaacctggagggaa

SEQ ID NO: 834643 - DNA, 25 bp, Mus musculus
tgttctgcactttacctggagggaa

SEQ ID NO: 834644 - DNA, 25 bp, Mus musculus
tgttctgcagcacagctcctccttg

SEQ ID NO: 834645 - DNA, 25 bp, Mus musculus
tgttctgcagcagagctcctccttg

SEQ ID NO: 834646 - DNA, 25 bp, Mus musculus
tgttctgcagtaccctcgagcgatc

SEQ ID NO: 834647 - DNA, 25 bp, Mus musculus
tgttctgcagtagcctcgagcgatc

SEQ ID NO: 834648 - DNA, 25 bp, Mus musculus
tgttctgccatcagaccacccgtag

SEQ ID NO: 834649 - DNA, 25 bp, Mus musculus
tgttctgccatctgaccacccgtag

SEQ ID NO: 834650 - DNA, 25 bp, Mus musculus
tgttctgccatgaaccatgccgtcc

SEQ ID NO: 834651 - DNA, 25 bp, Mus musculus
tgttctgccatgtaccatgccgtcc

SEQ ID NO: 834652 - DNA, 25 bp, Mus musculus
tgttctgccttacagatcctggacc

SEQ ID NO: 834653 - DNA, 25 bp, Mus musculus
tgttctgccttagagatcctggacc

SEQ ID NO: 834654 - DNA, 25 bp, Mus musculus
tgttctgcgtacatcctttcccttg

SEQ ID NO: 834655 - DNA, 25 bp, Mus musculus
tgttctgcgtacttcctttcccttg

SEQ ID NO: 834656 - DNA, 25 bp, Mus musculus
tgttctgctcgtcgctcagaggagc

SEQ ID NO: 834657 - DNA, 25 bp, Mus musculus
tgttctgctcgtggctcagaggagc

SEQ ID NO: 834658 - DNA, 25 bp, Mus musculus
tgttctggaactatcagtgatcccc

SEQ ID NO: 834659 - DNA, 25 bp, Mus musculus
tgttctggaactttcagtgatcccc

SEQ ID NO: 834660 - DNA, 25 bp, Mus musculus
tgttctggatacctgctccaggcaa

SEQ ID NO: 834661 - DNA, 25 bp, Mus musculus
tgttctggatacgtgctccaggcaa

SEQ ID NO: 834662 - DNA, 25 bp, Mus musculus
tgttctggctgcagccaactcagtg

SEQ ID NO: 834663 - DNA, 25 bp, Mus musculus
tgttctggctgctgccaactcagtg

SEQ ID NO: 834664 - DNA, 25 bp, Mus musculus
tgttctgggaaaatgctcgacgctg

SEQ ID NO: 834665 - DNA, 25 bp, Mus musculus
tgttctgggaaattgctcgacgctg

SEQ ID NO: 834666 - DNA, 25 bp, Mus musculus
tgttctgggagacactccgccctgt

SEQ ID NO: 834667 - DNA, 25 bp, Mus musculus
tgttctgggagagactccgccctgt

SEQ ID NO: 834668 - DNA, 25 bp, Mus musculus
tgttctggtccaaccatggacatag

SEQ ID NO: 834669 - DNA, 25 bp, Mus musculus
tgttctggtccatccatggacatag

SEQ ID NO: 834670 - DNA, 25 bp, Mus musculus
tgttctggtcccatacctaatagga

SEQ ID NO: 834671 - DNA, 25 bp, Mus musculus
tgttctggtcccttacctaatagga

SEQ ID NO: 834672 - DNA, 25 bp, Mus musculus
tgttctggtgacacgtcagcttctc

SEQ ID NO: 834673 - DNA, 25 bp, Mus musculus
tgttctggtgactcgtcagcttctc

SEQ ID NO: 834674 - DNA, 25 bp, Mus musculus
tgttctggttccagcgaagtgagat

SEQ ID NO: 834675 - DNA, 25 bp, Mus musculus
tgttctggttcctgcgaagtgagat

SEQ ID NO: 834676 - DNA, 25 bp, Mus musculus
tgttctggttggaggatctactcga

SEQ ID NO: 834677 - DNA, 25 bp, Mus musculus
tgttctggttggtggatctactcga

SEQ ID NO: 834678 - DNA, 25 bp, Mus musculus
tgttctgtagtgagtttaccctcat

SEQ ID NO: 834679 - DNA, 25 bp, Mus musculus
tgttctgtagtgtgtttaccctcat

SEQ ID NO: 834680 - DNA, 25 bp, Mus musculus
tgttctgtatcaagcgagaagcaag

SEQ ID NO: 834681 - DNA, 25 bp, Mus musculus
tgttctgtatcatgcgagaagcaag

SEQ ID NO: 834682 - DNA, 25 bp, Mus musculus
tgttctgtcagaagtcaccaaggaa

SEQ ID NO: 834683 - DNA, 25 bp, Mus musculus
tgttctgtcagatgtcaccaaggaa

SEQ ID NO: 834684 - DNA, 25 bp, Mus musculus
tgttctgtcagtcgggaaacggcat

SEQ ID NO: 834685 - DNA, 25 bp, Mus musculus
tgttctgtcagtggggaaacggcat

SEQ ID NO: 834686 - DNA, 25 bp, Mus musculus
tgttctgtcgtcagcaacctgcaag

SEQ ID NO: 834687 - DNA, 25 bp, Mus musculus
tgttctgtcgtctgcaacctgcaag

SEQ ID NO: 834688 - DNA, 25 bp, Mus musculus
tgttctgtctagctccagtggctcc

SEQ ID NO: 834689 - DNA, 25 bp, Mus musculus
tgttctgtctaggtccagtggctcc

SEQ ID NO: 834690 - DNA, 25 bp, Mus musculus
tgttctgtgactctactttccagga

SEQ ID NO: 834691 - DNA, 25 bp, Mus musculus
tgttctgtgactgtactttccagga

SEQ ID NO: 834692 - DNA, 25 bp, Mus musculus
tgttctgtgcaacggtgaggattac

SEQ ID NO: 834693 - DNA, 25 bp, Mus musculus
tgttctgtgcaagggtgaggattac

SEQ ID NO: 834694 - DNA, 25 bp, Mus musculus
tgttctgtgctgctggttgtcatcc

SEQ ID NO: 834695 - DNA, 25 bp, Mus musculus
tgttctgtgctggtggttgtcatcc

SEQ ID NO: 834696 - DNA, 25 bp, Mus musculus
tgttctgtgtaaaatcctgccctga

SEQ ID NO: 834697 - DNA, 25 bp, Mus musculus
tgttctgtgtaatatcctgccctga

SEQ ID NO: 834698 - DNA, 25 bp, Mus musculus
tgttctgttgcccttccaactcttc

SEQ ID NO: 834699 - DNA, 25 bp, Mus musculus
tgttctgttgccgttccaactcttc

SEQ ID NO: 834700 - DNA, 25 bp, Mus musculus
tgttcttaaagccacagcgctccct

SEQ ID NO: 834701 - DNA, 25 bp, Mus musculus
tgttcttaaagcgacagcgctccct

SEQ ID NO: 834702 - DNA, 25 bp, Mus musculus
tgttcttaagaaccctgtggtagac

SEQ ID NO: 834703 - DNA, 25 bp, Mus musculus
tgttcttaagaagcctgtggtagac

SEQ ID NO: 834704 - DNA, 25 bp, Mus musculus
tgttcttaagtaagaagaagtggac

SEQ ID NO: 834705 - DNA, 25 bp, Mus musculus
tgttcttaagtatgaagaagtggac

SEQ ID NO: 834706 - DNA, 25 bp, Mus musculus
tgttcttacacgacgtggacctcct

SEQ ID NO: 834707 - DNA, 25 bp, Mus musculus
tgttcttacacgtcgtggacctcct

SEQ ID NO: 834708 - DNA, 25 bp, Mus musculus
tgttcttagagcaagacaatcagca

SEQ ID NO: 834709 - DNA, 25 bp, Mus musculus
tgttcttagagctagacaatcagca

SEQ ID NO: 834710 - DNA, 25 bp, Mus musculus
tgttcttagatgatgcagaatcaca

SEQ ID NO: 834711 - DNA, 25 bp, Mus musculus
tgttcttagatgttgcagaatcaca

SEQ ID NO: 834712 - DNA, 25 bp, Mus musculus
tgttcttagcagagtgtgacacagt

SEQ ID NO: 834713 - DNA, 25 bp, Mus musculus
tgttcttagcagtgtgtgacacagt

SEQ ID NO: 834714 - DNA, 25 bp, Mus musculus
tgttcttagtctagtatccgaggga

SEQ ID NO: 834715 - DNA, 25 bp, Mus musculus
tgttcttagtcttgtatccgaggga

SEQ ID NO: 834716 - DNA, 25 bp, Mus musculus
tgttcttattccaacaataaaagtg

SEQ ID NO: 834717 - DNA, 25 bp, Mus musculus
tgttcttattcctacaataaaagtg

SEQ ID NO: 834718 - DNA, 25 bp, Mus musculus
tgttcttattgacgccccagtttgc

SEQ ID NO: 834719 - DNA, 25 bp, Mus musculus
tgttcttattgaggccccagtttgc

SEQ ID NO: 834720 - DNA, 25 bp, Mus musculus
tgttcttcatccaagcatgtcgtgg

SEQ ID NO: 834721 - DNA, 25 bp, Mus musculus
tgttcttcatcctagcatgtcgtgg

SEQ ID NO: 834722 - DNA, 25 bp, Mus musculus
tgttcttcatctctccgctcacagg

SEQ ID NO: 834723 - DNA, 25 bp, Mus musculus
tgttcttcatctgtccgctcacagg

SEQ ID NO: 834724 - DNA, 25 bp, Mus musculus
tgttcttcctgtatcctgcctcagt

SEQ ID NO: 834725 - DNA, 25 bp, Mus musculus
tgttcttcctgtttcctgcctcagt

SEQ ID NO: 834726 - DNA, 25 bp, Mus musculus
tgttcttcgagaccctgcagcggcg

SEQ ID NO: 834727 - DNA, 25 bp, Mus musculus
tgttcttcgagagcctgcagcggcg

SEQ ID NO: 834728 - DNA, 25 bp, Mus musculus
tgttcttctatgattaatcctcggg

SEQ ID NO: 834729 - DNA, 25 bp, Mus musculus
tgttcttctatgtttaatcctcggg

SEQ ID NO: 834730 - DNA, 25 bp, Mus musculus
tgttcttctccacgacttgtcatga

SEQ ID NO: 834731 - DNA, 25 bp, Mus musculus
tgttcttctccaggacttgtcatga

SEQ ID NO: 834732 - DNA, 25 bp, Mus musculus
tgttcttctgtgatggaatgattgc

SEQ ID NO: 834733 - DNA, 25 bp, Mus musculus
tgttcttctgtgttggaatgattgc

SEQ ID NO: 834734 - DNA, 25 bp, Mus musculus
tgttcttgaagcagtggtgaccgtg

SEQ ID NO: 834735 - DNA, 25 bp, Mus musculus
tgttcttgaagctgtggtgaccgtg

SEQ ID NO: 834736 - DNA, 25 bp, Mus musculus
tgttcttgcagaatatccagatttc

SEQ ID NO: 834737 - DNA, 25 bp, Mus musculus
tgttcttgcagattatccagatttc

SEQ ID NO: 834738 - DNA, 25 bp, Mus musculus
tgttcttgcagtcctgtgaggaagt

SEQ ID NO: 834739 - DNA, 25 bp, Mus musculus
tgttcttgcagtgctgtgaggaagt

SEQ ID NO: 834740 - DNA, 25 bp, Mus musculus
tgttcttgctcaccctcgctatttg

SEQ ID NO: 834741 - DNA, 25 bp, Mus musculus
tgttcttgctcagcctcgctatttg

SEQ ID NO: 834742 - DNA, 25 bp, Mus musculus
tgttcttgctctaggcagaggcctc

SEQ ID NO: 834743 - DNA, 25 bp, Mus musculus
tgttcttgctcttggcagaggcctc

SEQ ID NO: 834744 - DNA, 25 bp, Mus musculus
tgttcttgctgtcaccacctgtagg

SEQ ID NO: 834745 - DNA, 25 bp, Mus musculus
tgttcttgctgtgaccacctgtagg

SEQ ID NO: 834746 - DNA, 25 bp, Mus musculus
tgttcttggctcagctgaaggatga

SEQ ID NO: 834747 - DNA, 25 bp, Mus musculus
tgttcttggctctgctgaaggatga

SEQ ID NO: 834748 - DNA, 25 bp, Mus musculus
tgttcttggtcaaatcatgaagaat

SEQ ID NO: 834749 - DNA, 25 bp, Mus musculus
tgttcttggtcatatcatgaagaat

SEQ ID NO: 834750 - DNA, 25 bp, Mus musculus
tgttcttggtgcaccctgcctatga

SEQ ID NO: 834751 - DNA, 25 bp, Mus musculus
tgttcttggtgctccctgcctatga

SEQ ID NO: 834752 - DNA, 25 bp, Mus musculus
tgttcttggttcatggcactggcac

SEQ ID NO: 834753 - DNA, 25 bp, Mus musculus
tgttcttggttcttggcactggcac

SEQ ID NO: 834754 - DNA, 25 bp, Mus musculus
tgttcttgtgccctacacatgctaa

SEQ ID NO: 834755 - DNA, 25 bp, Mus musculus
tgttcttgtgccgtacacatgctaa

SEQ ID NO: 834756 - DNA, 25 bp, Mus musculus
tgttctttacgtctccatggcctgc

SEQ ID NO: 834757 - DNA, 25 bp, Mus musculus
tgttctttacgtgtccatggcctgc

SEQ ID NO: 834758 - DNA, 25 bp, Mus musculus
tgttctttagatcactattgctagg

SEQ ID NO: 834759 - DNA, 25 bp, Mus musculus
tgttctttagatgactattgctagg

SEQ ID NO: 834760 - DNA, 25 bp, Mus musculus
tgttctttcagcagggttgcaggcc

SEQ ID NO: 834761 - DNA, 25 bp, Mus musculus
tgttctttcagctgggttgcaggcc

SEQ ID NO: 834762 - DNA, 25 bp, Mus musculus
tgttctttggccacacactacccaa

SEQ ID NO: 834763 - DNA, 25 bp, Mus musculus
tgttctttggcctcacactacccaa

SEQ ID NO: 834764 - DNA, 25 bp, Mus musculus
tgttctttggctattcccactggtc

SEQ ID NO: 834765 - DNA, 25 bp, Mus musculus
tgttctttggcttttcccactggtc

SEQ ID NO: 834766 - DNA, 25 bp, Mus musculus
tgttctttgggacccttgggaaagc

SEQ ID NO: 834767 - DNA, 25 bp, Mus musculus
tgttctttgggagccttgggaaagc

SEQ ID NO: 834768 - DNA, 25 bp, Mus musculus
tgttcttttcttactggaaagtgag

SEQ ID NO: 834769 - DNA, 25 bp, Mus musculus
tgttcttttctttctggaaagtgag

SEQ ID NO: 834770 - DNA, 25 bp, Mus musculus
tgttcttttgtaaaggcttatgtcc

SEQ ID NO: 834771 - DNA, 25 bp, Mus musculus
tgttcttttgtataggcttatgtcc

SEQ ID NO: 834772 - DNA, 25 bp, Mus musculus
tgttgaaaacccagtctaccaccct

SEQ ID NO: 834773 - DNA, 25 bp, Mus musculus
tgttgaaaaccctgtctaccaccct

SEQ ID NO: 834774 - DNA, 25 bp, Mus musculus
tgttgaaaagatctccatgctggaa

SEQ ID NO: 834775 - DNA, 25 bp, Mus musculus
tgttgaaaagatgtccatgctggaa

SEQ ID NO: 834776 - DNA, 25 bp, Mus musculus
tgttgaaagccacatctggagagtc

SEQ ID NO: 834777 - DNA, 25 bp, Mus musculus
tgttgaaagccagatctggagagtc

SEQ ID NO: 834778 - DNA, 25 bp, Mus musculus
tgttgaaaggacaaaagcacgccaa

SEQ ID NO: 834779 - DNA, 25 bp, Mus musculus
tgttgaaaggactaaagcacgccaa

SEQ ID NO: 834780 - DNA, 25 bp, Mus musculus
tgttgaaatcctattggataaaggt

SEQ ID NO: 834781 - DNA, 25 bp, Mus musculus
tgttgaaatccttttggataaaggt

SEQ ID NO: 834782 - DNA, 25 bp, Mus musculus
tgttgaaatgagaaccacaggctgg

SEQ ID NO: 834783 - DNA, 25 bp, Mus musculus
tgttgaaatgagtaccacaggctgg

SEQ ID NO: 834784 - DNA, 25 bp, Mus musculus
tgttgaaatggacacagtgaacgtc

SEQ ID NO: 834785 - DNA, 25 bp, Mus musculus
tgttgaaatggagacagtgaacgtc

SEQ ID NO: 834786 - DNA, 25 bp, Mus musculus
tgttgaacagatagaccctagcacc

SEQ ID NO: 834787 - DNA, 25 bp, Mus musculus
tgttgaacagattgaccctagcacc

SEQ ID NO: 834788 - DNA, 25 bp, Mus musculus
tgttgaacaggaaacagggcatcgc

SEQ ID NO: 834789 - DNA, 25 bp, Mus musculus
tgttgaacaggatacagggcatcgc

SEQ ID NO: 834790 - DNA, 25 bp, Mus musculus
tgttgaaccctgacatgagtcttgc

SEQ ID NO: 834791 - DNA, 25 bp, Mus musculus
tgttgaaccctgtcatgagtcttgc

SEQ ID NO: 834792 - DNA, 25 bp, Mus musculus
tgttgaacgggcagaccggaagctg

SEQ ID NO: 834793 - DNA, 25 bp, Mus musculus
tgttgaacgggctgaccggaagctg

SEQ ID NO: 834794 - DNA, 25 bp, Mus musculus
tgttgaacggttcacaccagtgcct

SEQ ID NO: 834795 - DNA, 25 bp, Mus musculus
tgttgaacggttgacaccagtgcct

SEQ ID NO: 834796 - DNA, 25 bp, Mus musculus
tgttgaactgaacgccgaagatttc

SEQ ID NO: 834797 - DNA, 25 bp, Mus musculus
tgttgaactgaaggccgaagatttc

SEQ ID NO: 834798 - DNA, 25 bp, Mus musculus
tgttgaagagaacgtcggtcccttc

SEQ ID NO: 834799 - DNA, 25 bp, Mus musculus
tgttgaagagaaggtcggtcccttc

SEQ ID NO: 834800 - DNA, 25 bp, Mus musculus
tgttgaagaggactaccaaaatctc

SEQ ID NO: 834801 - DNA, 25 bp, Mus musculus
tgttgaagaggagtaccaaaatctc

SEQ ID NO: 834802 - DNA, 25 bp, Mus musculus
tgttgaagaggccacaggagttcca

SEQ ID NO: 834803 - DNA, 25 bp, Mus musculus
tgttgaagaggcgacaggagttcca

SEQ ID NO: 834804 - DNA, 25 bp, Mus musculus
tgttgaagatttcaatgaagaggtc

SEQ ID NO: 834805 - DNA, 25 bp, Mus musculus
tgttgaagatttgaatgaagaggtc

SEQ ID NO: 834806 - DNA, 25 bp, Mus musculus
tgttgaagcatcaccagtcgtggct

SEQ ID NO: 834807 - DNA, 25 bp, Mus musculus
tgttgaagcatctccagtcgtggct

SEQ ID NO: 834808 - DNA, 25 bp, Mus musculus
tgttgaagccgcagtctccactctt

SEQ ID NO: 834809 - DNA, 25 bp, Mus musculus
tgttgaagccgctgtctccactctt

SEQ ID NO: 834810 - DNA, 25 bp, Mus musculus
tgttgaagctgcagaagtggactca

SEQ ID NO: 834811 - DNA, 25 bp, Mus musculus
tgttgaagctgctgaagtggactca

SEQ ID NO: 834812 - DNA, 25 bp, Mus musculus
tgttgaaggcacaccctgaagaccc

SEQ ID NO: 834813 - DNA, 25 bp, Mus musculus
tgttgaaggcactccctgaagaccc

SEQ ID NO: 834814 - DNA, 25 bp, Mus musculus
tgttgaagggttccatgacgccatc

SEQ ID NO: 834815 - DNA, 25 bp, Mus musculus
tgttgaagggttgcatgacgccatc

SEQ ID NO: 834816 - DNA, 25 bp, Mus musculus
tgttgaagtcgcaggaccaggcagc

SEQ ID NO: 834817 - DNA, 25 bp, Mus musculus
tgttgaagtcgctggaccaggcagc

SEQ ID NO: 834818 - DNA, 25 bp, Mus musculus
tgttgaagtttcaaagcaagccatg

SEQ ID NO: 834819 - DNA, 25 bp, Mus musculus
tgttgaagtttctaagcaagccatg

SEQ ID NO: 834820 - DNA, 25 bp, Mus musculus
tgttgaatactgcatcattggcgtc

SEQ ID NO: 834821 - DNA, 25 bp, Mus musculus
tgttgaatactggatcattggcgtc

SEQ ID NO: 834822 - DNA, 25 bp, Mus musculus
tgttgaatatctcgagtgttcttct

SEQ ID NO: 834823 - DNA, 25 bp, Mus musculus
tgttgaatatctggagtgttcttct

SEQ ID NO: 834824 - DNA, 25 bp, Mus musculus
tgttgaatgttcaccaccaagagcg

SEQ ID NO: 834825 - DNA, 25 bp, Mus musculus
tgttgaatgttctccaccaagagcg

SEQ ID NO: 834826 - DNA, 25 bp, Mus musculus
tgttgaattcttcctgcaacttgga

SEQ ID NO: 834827 - DNA, 25 bp, Mus musculus
tgttgaattcttgctgcaacttgga

SEQ ID NO: 834828 - DNA, 25 bp, Mus musculus
tgttgaattgaaaaggcccactggg

SEQ ID NO: 834829 - DNA, 25 bp, Mus musculus
tgttgaattgaataggcccactggg

SEQ ID NO: 834830 - DNA, 25 bp, Mus musculus
tgttgacaacggctattgtggaaca

SEQ ID NO: 834831 - DNA, 25 bp, Mus musculus
tgttgacaacgggtattgtggaaca

SEQ ID NO: 834832 - DNA, 25 bp, Mus musculus
tgttgacaagccagctggaatcgca

SEQ ID NO: 834833 - DNA, 25 bp, Mus musculus
tgttgacaagcctgctggaatcgca

SEQ ID NO: 834834 - DNA, 25 bp, Mus musculus
tgttgacagaatctgcccgcatgca

SEQ ID NO: 834835 - DNA, 25 bp, Mus musculus
tgttgacagaatgtgcccgcatgca

SEQ ID NO: 834836 - DNA, 25 bp, Mus musculus
tgttgaccacagcacccagttccag

SEQ ID NO: 834837 - DNA, 25 bp, Mus musculus
tgttgaccacaggacccagttccag

SEQ ID NO: 834838 - DNA, 25 bp, Mus musculus
tgttgacccaggagtggtccaccgg

SEQ ID NO: 834839 - DNA, 25 bp, Mus musculus
tgttgacccaggtgtggtccaccgg

SEQ ID NO: 834840 - DNA, 25 bp, Mus musculus
tgttgacccggaagcaattcaggaa

SEQ ID NO: 834841 - DNA, 25 bp, Mus musculus
tgttgacccggatgcaattcaggaa

SEQ ID NO: 834842 - DNA, 25 bp, Mus musculus
tgttgaccgcggatctccaggacgt

SEQ ID NO: 834843 - DNA, 25 bp, Mus musculus
tgttgaccgcggttctccaggacgt

SEQ ID NO: 834844 - DNA, 25 bp, Mus musculus
tgttgacctatacagaagaagagcc

SEQ ID NO: 834845 - DNA, 25 bp, Mus musculus
tgttgacctatagagaagaagagcc

SEQ ID NO: 834846 - DNA, 25 bp, Mus musculus
tgttgacctcctctactggagagac

SEQ ID NO: 834847 - DNA, 25 bp, Mus musculus
tgttgacctcctgtactggagagac

SEQ ID NO: 834848 - DNA, 25 bp, Mus musculus
tgttgacctggtcgtgaacactgat

SEQ ID NO: 834849 - DNA, 25 bp, Mus musculus
tgttgacctggtggtgaacactgat

SEQ ID NO: 834850 - DNA, 25 bp, Mus musculus
tgttgactatggcaaaaagtccaag

SEQ ID NO: 834851 - DNA, 25 bp, Mus musculus
tgttgactatgggaaaaagtccaag

SEQ ID NO: 834852 - DNA, 25 bp, Mus musculus
tgttgactccaaagccaaaacacgg

SEQ ID NO: 834853 - DNA, 25 bp, Mus musculus
tgttgactccaatgccaaaacacgg

SEQ ID NO: 834854 - DNA, 25 bp, Mus musculus
tgttgactccacctgtgaggaccgt

SEQ ID NO: 834855 - DNA, 25 bp, Mus musculus
tgttgactccacgtgtgaggaccgt

SEQ ID NO: 834856 - DNA, 25 bp, Mus musculus
tgttgactggacaagtaacctgctg

SEQ ID NO: 834857 - DNA, 25 bp, Mus musculus
tgttgactggactagtaacctgctg

SEQ ID NO: 834858 - DNA, 25 bp, Mus musculus
tgttgactttgacagtcctgcagca

SEQ ID NO: 834859 - DNA, 25 bp, Mus musculus
tgttgactttgagagtcctgcagca

SEQ ID NO: 834860 - DNA, 25 bp, Mus musculus
tgttgagaactgaccaggcctctgg

SEQ ID NO: 834861 - DNA, 25 bp, Mus musculus
tgttgagaactgtccaggcctctgg

SEQ ID NO: 834862 - DNA, 25 bp, Mus musculus
tgttgagacgagattcccaggtgat

SEQ ID NO: 834863 - DNA, 25 bp, Mus musculus
tgttgagacgagtttcccaggtgat

SEQ ID NO: 834864 - DNA, 25 bp, Mus musculus
tgttgagagtcacccagatgctgct

SEQ ID NO: 834865 - DNA, 25 bp, Mus musculus
tgttgagagtcagccagatgctgct

SEQ ID NO: 834866 - DNA, 25 bp, Mus musculus
tgttgagcaacaacagtcttcttgg

SEQ ID NO: 834867 - DNA, 25 bp, Mus musculus
tgttgagcaacatcagtcttcttgg

SEQ ID NO: 834868 - DNA, 25 bp, Mus musculus
tgttgagcatcacatctgtcctgct

SEQ ID NO: 834869 - DNA, 25 bp, Mus musculus
tgttgagcatcagatctgtcctgct

SEQ ID NO: 834870 - DNA, 25 bp, Mus musculus
tgttgagctagccttccagactgtc

SEQ ID NO: 834871 - DNA, 25 bp, Mus musculus
tgttgagctagcgttccagactgtc

SEQ ID NO: 834872 - DNA, 25 bp, Mus musculus
tgttgagcttctcgatgcagcaaga

SEQ ID NO: 834873 - DNA, 25 bp, Mus musculus
tgttgagcttctggatgcagcaaga

SEQ ID NO: 834874 - DNA, 25 bp, Mus musculus
tgttgaggaaagcttgaacacagct

SEQ ID NO: 834875 - DNA, 25 bp, Mus musculus
tgttgaggaaaggttgaacacagct

SEQ ID NO: 834876 - DNA, 25 bp, Mus musculus
tgttgaggaccaatatgagatggga

SEQ ID NO: 834877 - DNA, 25 bp, Mus musculus
tgttgaggaccattatgagatggga

SEQ ID NO: 834878 - DNA, 25 bp, Mus musculus
tgttgagggctcacaacagtcccct

SEQ ID NO: 834879 - DNA, 25 bp, Mus musculus
tgttgagggctctcaacagtcccct

SEQ ID NO: 834880 - DNA, 25 bp, Mus musculus
tgttgaggtccaagtcagcgcagtt

SEQ ID NO: 834881 - DNA, 25 bp, Mus musculus
tgttgaggtccatgtcagcgcagtt

SEQ ID NO: 834882 - DNA, 25 bp, Mus musculus
tgttgagtctagaccacattctcgc

SEQ ID NO: 834883 - DNA, 25 bp, Mus musculus
tgttgagtctagtccacattctcgc

SEQ ID NO: 834884 - DNA, 25 bp, Mus musculus
tgttgagtgctaccaatcccaaact

SEQ ID NO: 834885 - DNA, 25 bp, Mus musculus
tgttgagtgctagcaatcccaaact

SEQ ID NO: 834886 - DNA, 25 bp, Mus musculus
tgttgataaagcagaaaccacttgc

SEQ ID NO: 834887 - DNA, 25 bp, Mus musculus
tgttgataaagctgaaaccacttgc

SEQ ID NO: 834888 - DNA, 25 bp, Mus musculus
tgttgatagcctcagaaagcctgcc

SEQ ID NO: 834889 - DNA, 25 bp, Mus musculus
tgttgatagcctgagaaagcctgcc

SEQ ID NO: 834890 - DNA, 25 bp, Mus musculus
tgttgatatagcactgttagccaag

SEQ ID NO: 834891 - DNA, 25 bp, Mus musculus
tgttgatatagctctgttagccaag

SEQ ID NO: 834892 - DNA, 25 bp, Mus musculus
tgttgatatcctctttggaaatgag

SEQ ID NO: 834893 - DNA, 25 bp, Mus musculus
tgttgatatcctgtttggaaatgag

SEQ ID NO: 834894 - DNA, 25 bp, Mus musculus
tgttgatcagagcaagatttttacc

SEQ ID NO: 834895 - DNA, 25 bp, Mus musculus
tgttgatcagaggaagatttttacc

SEQ ID NO: 834896 - DNA, 25 bp, Mus musculus
tgttgatccacaacttgcggcccag

SEQ ID NO: 834897 - DNA, 25 bp, Mus musculus
tgttgatccacatcttgcggcccag

SEQ ID NO: 834898 - DNA, 25 bp, Mus musculus
tgttgatctttccactgtggataag

SEQ ID NO: 834899 - DNA, 25 bp, Mus musculus
tgttgatctttcgactgtggataag

SEQ ID NO: 834900 - DNA, 25 bp, Mus musculus
tgttgatgagagagtcctagagaca

SEQ ID NO: 834901 - DNA, 25 bp, Mus musculus
tgttgatgagagtgtcctagagaca

SEQ ID NO: 834902 - DNA, 25 bp, Mus musculus
tgttgatgccatatagagtggaaag

SEQ ID NO: 834903 - DNA, 25 bp, Mus musculus
tgttgatgccatttagagtggaaag

SEQ ID NO: 834904 - DNA, 25 bp, Mus musculus
tgttgatggagaaggtttgcctgca

SEQ ID NO: 834905 - DNA, 25 bp, Mus musculus
tgttgatggagatggtttgcctgca

SEQ ID NO: 834906 - DNA, 25 bp, Mus musculus
tgttgatgtccacattgaccaggag

SEQ ID NO: 834907 - DNA, 25 bp, Mus musculus
tgttgatgtccagattgaccaggag

SEQ ID NO: 834908 - DNA, 25 bp, Mus musculus
tgttgatgtgtcatctagattcccc

SEQ ID NO: 834909 - DNA, 25 bp, Mus musculus
tgttgatgtgtcttctagattcccc

SEQ ID NO: 834910 - DNA, 25 bp, Mus musculus
tgttgattgggtctacaagaccatc

SEQ ID NO: 834911 - DNA, 25 bp, Mus musculus
tgttgattgggtgtacaagaccatc

SEQ ID NO: 834912 - DNA, 25 bp, Mus musculus
tgttgatttctcctatactgtgggc

SEQ ID NO: 834913 - DNA, 25 bp, Mus musculus
tgttgatttctcgtatactgtgggc

SEQ ID NO: 834914 - DNA, 25 bp, Mus musculus
tgttgcaaaatcaactccctgaagg

SEQ ID NO: 834915 - DNA, 25 bp, Mus musculus
tgttgcaaaatctactccctgaagg

SEQ ID NO: 834916 - DNA, 25 bp, Mus musculus
tgttgcaatcaaccaagtgcccgtg

SEQ ID NO: 834917 - DNA, 25 bp, Mus musculus
tgttgcaatcaagcaagtgcccgtg

SEQ ID NO: 834918 - DNA, 25 bp, Mus musculus
tgttgcaatccaagaggctatggag

SEQ ID NO: 834919 - DNA, 25 bp, Mus musculus
tgttgcaatccatgaggctatggag

SEQ ID NO: 834920 - DNA, 25 bp, Mus musculus
tgttgcaatcgaagcaaggcatgca

SEQ ID NO: 834921 - DNA, 25 bp, Mus musculus
tgttgcaatcgatgcaaggcatgca

SEQ ID NO: 834922 - DNA, 25 bp, Mus musculus
tgttgcacccagctgtgcttgggca

SEQ ID NO: 834923 - DNA, 25 bp, Mus musculus
tgttgcacccaggtgtgcttgggca

SEQ ID NO: 834924 - DNA, 25 bp, Mus musculus
tgttgcacgagcacatcaagatgct

SEQ ID NO: 834925 - DNA, 25 bp, Mus musculus
tgttgcacgagctcatcaagatgct

SEQ ID NO: 834926 - DNA, 25 bp, Mus musculus
tgttgcactctcaggagaacgtgga

SEQ ID NO: 834927 - DNA, 25 bp, Mus musculus
tgttgcactctctggagaacgtgga

SEQ ID NO: 834928 - DNA, 25 bp, Mus musculus
tgttgcactgaaactcccacttggg

SEQ ID NO: 834929 - DNA, 25 bp, Mus musculus
tgttgcactgaatctcccacttggg

SEQ ID NO: 834930 - DNA, 25 bp, Mus musculus
tgttgcactggtcgactgagacctc

SEQ ID NO: 834931 - DNA, 25 bp, Mus musculus
tgttgcactggtggactgagacctc

SEQ ID NO: 834932 - DNA, 25 bp, Mus musculus
tgttgcagatgtccctgttcctcca

SEQ ID NO: 834933 - DNA, 25 bp, Mus musculus
tgttgcagatgtgcctgttcctcca

SEQ ID NO: 834934 - DNA, 25 bp, Mus musculus
tgttgcaggactacacacagcaggt

SEQ ID NO: 834935 - DNA, 25 bp, Mus musculus
tgttgcaggacttcacacagcaggt

SEQ ID NO: 834936 - DNA, 25 bp, Mus musculus
tgttgcagttccagacatcaccagg

SEQ ID NO: 834937 - DNA, 25 bp, Mus musculus
tgttgcagttcctgacatcaccagg

SEQ ID NO: 834938 - DNA, 25 bp, Mus musculus
tgttgccacaacagcagtagaaggg

SEQ ID NO: 834939 - DNA, 25 bp, Mus musculus
tgttgccacaactgcagtagaaggg

SEQ ID NO: 834940 - DNA, 25 bp, Mus musculus
tgttgccacgatcggctctttccag

SEQ ID NO: 834941 - DNA, 25 bp, Mus musculus
tgttgccacgatgggctctttccag

SEQ ID NO: 834942 - DNA, 25 bp, Mus musculus
tgttgccactttagactataaccgg

SEQ ID NO: 834943 - DNA, 25 bp, Mus musculus
tgttgccacttttgactataaccgg

SEQ ID NO: 834944 - DNA, 25 bp, Mus musculus
tgttgccagattccccggctggagc

SEQ ID NO: 834945 - DNA, 25 bp, Mus musculus
tgttgccagattgcccggctggagc

SEQ ID NO: 834946 - DNA, 25 bp, Mus musculus
tgttgccagcaaaggccggaccagg

SEQ ID NO: 834947 - DNA, 25 bp, Mus musculus
tgttgccagcaatggccggaccagg

SEQ ID NO: 834948 - DNA, 25 bp, Mus musculus
tgttgccaggacaaacacccgagac

SEQ ID NO: 834949 - DNA, 25 bp, Mus musculus
tgttgccaggactaacacccgagac

SEQ ID NO: 834950 - DNA, 25 bp, Mus musculus
tgttgccagtgtagtggtctccttc

SEQ ID NO: 834951 - DNA, 25 bp, Mus musculus
tgttgccagtgttgtggtctccttc

SEQ ID NO: 834952 - DNA, 25 bp, Mus musculus
tgttgccatccacggagtgaagaca

SEQ ID NO: 834953 - DNA, 25 bp, Mus musculus
tgttgccatccagggagtgaagaca

SEQ ID NO: 834954 - DNA, 25 bp, Mus musculus
tgttgcccacctacaacgaacggga

SEQ ID NO: 834955 - DNA, 25 bp, Mus musculus
tgttgcccaccttcaacgaacggga

SEQ ID NO: 834956 - DNA, 25 bp, Mus musculus
tgttgcccagtcagggtctctgcca

SEQ ID NO: 834957 - DNA, 25 bp, Mus musculus
tgttgcccagtctgggtctctgcca

SEQ ID NO: 834958 - DNA, 25 bp, Mus musculus
tgttgcccatttccagggccaagag

SEQ ID NO: 834959 - DNA, 25 bp, Mus musculus
tgttgcccatttgcagggccaagag

SEQ ID NO: 834960 - DNA, 25 bp, Mus musculus
tgttgccccacaagccactgcaaat

SEQ ID NO: 834961 - DNA, 25 bp, Mus musculus
tgttgccccacatgccactgcaaat

SEQ ID NO: 834962 - DNA, 25 bp, Mus musculus
tgttgccctctgagtccatgaaggt

SEQ ID NO: 834963 - DNA, 25 bp, Mus musculus
tgttgccctctgtgtccatgaaggt

SEQ ID NO: 834964 - DNA, 25 bp, Mus musculus
tgttgccgaatacggttcacctggg

SEQ ID NO: 834965 - DNA, 25 bp, Mus musculus
tgttgccgaatagggttcacctggg

SEQ ID NO: 834966 - DNA, 25 bp, Mus musculus
tgttgccgacagaccgaacgaaggt

SEQ ID NO: 834967 - DNA, 25 bp, Mus musculus
tgttgccgacagtccgaacgaaggt

SEQ ID NO: 834968 - DNA, 25 bp, Mus musculus
tgttgccgctgcacagtacagaaga

SEQ ID NO: 834969 - DNA, 25 bp, Mus musculus
tgttgccgctgctcagtacagaaga

SEQ ID NO: 834970 - DNA, 25 bp, Mus musculus
tgttgccgggagacaccactgtcat

SEQ ID NO: 834971 - DNA, 25 bp, Mus musculus
tgttgccgggagtcaccactgtcat

SEQ ID NO: 834972 - DNA, 25 bp, Mus musculus
tgttgccgtcaaccatgtctgcagt

SEQ ID NO: 834973 - DNA, 25 bp, Mus musculus
tgttgccgtcaagcatgtctgcagt

SEQ ID NO: 834974 - DNA, 25 bp, Mus musculus
tgttgccgttccaactcttcttgga

SEQ ID NO: 834975 - DNA, 25 bp, Mus musculus
tgttgccgttcctactcttcttgga

SEQ ID NO: 834976 - DNA, 25 bp, Mus musculus
tgttgccgttgtagtctgagactcg

SEQ ID NO: 834977 - DNA, 25 bp, Mus musculus
tgttgccgttgttgtctgagactcg

SEQ ID NO: 834978 - DNA, 25 bp, Mus musculus
tgttgcctaaggacgtccaccacta

SEQ ID NO: 834979 - DNA, 25 bp, Mus musculus
tgttgcctaaggtcgtccaccacta

SEQ ID NO: 834980 - DNA, 25 bp, Mus musculus
tgttgcctacatatccatcagctga

SEQ ID NO: 834981 - DNA, 25 bp, Mus musculus
tgttgcctacatttccatcagctga

SEQ ID NO: 834982 - DNA, 25 bp, Mus musculus
tgttgcctatcccaggaagtgctgc

SEQ ID NO: 834983 - DNA, 25 bp, Mus musculus
tgttgcctatccgaggaagtgctgc

SEQ ID NO: 834984 - DNA, 25 bp, Mus musculus
tgttgcctatgtagccaaagaccct

SEQ ID NO: 834985 - DNA, 25 bp, Mus musculus
tgttgcctatgttgccaaagaccct

SEQ ID NO: 834986 - DNA, 25 bp, Mus musculus
tgttgcctggcccttaagcttggag

SEQ ID NO: 834987 - DNA, 25 bp, Mus musculus
tgttgcctggccgttaagcttggag

SEQ ID NO: 834988 - DNA, 25 bp, Mus musculus
tgttgccttctgacaaagaccctcc

SEQ ID NO: 834989 - DNA, 25 bp, Mus musculus
tgttgccttctgtcaaagaccctcc

SEQ ID NO: 834990 - DNA, 25 bp, Mus musculus
tgttgcgaccatcagttttgggatg

SEQ ID NO: 834991 - DNA, 25 bp, Mus musculus
tgttgcgaccatgagttttgggatg

SEQ ID NO: 834992 - DNA, 25 bp, Mus musculus
tgttgcgagctcagcgtaagaacaa

SEQ ID NO: 834993 - DNA, 25 bp, Mus musculus
tgttgcgagctctgcgtaagaacaa

SEQ ID NO: 834994 - DNA, 25 bp, Mus musculus
tgttgcgagtgaaccatgttggccc

SEQ ID NO: 834995 - DNA, 25 bp, Mus musculus
tgttgcgagtgatccatgttggccc

SEQ ID NO: 834996 - DNA, 25 bp, Mus musculus
tgttgcgatgcaagaagtcttcctg

SEQ ID NO: 834997 - DNA, 25 bp, Mus musculus
tgttgcgatgcatgaagtcttcctg

SEQ ID NO: 834998 - DNA, 25 bp, Mus musculus
tgttgcgatttgaacccagtgcccg

SEQ ID NO: 834999 - DNA, 25 bp, Mus musculus
tgttgcgatttgtacccagtgcccg

SEQ ID NO: 835000 - DNA, 25 bp, Mus musculus
tgttgcgccagcacgggtgccacag

SEQ ID NO: 835001 - DNA, 25 bp, Mus musculus
tgttgcgccagctcgggtgccacag

SEQ ID NO: 835002 - DNA, 25 bp, Mus musculus
tgttgcgccattacccgctgctact

SEQ ID NO: 835003 - DNA, 25 bp, Mus musculus
tgttgcgccatttcccgctgctact

SEQ ID NO: 835004 - DNA, 25 bp, Mus musculus
tgttgcgctgacacgagattcagag

SEQ ID NO: 835005 - DNA, 25 bp, Mus musculus
tgttgcgctgactcgagattcagag

SEQ ID NO: 835006 - DNA, 25 bp, Mus musculus
tgttgcgctgcacacccgcttggcg

SEQ ID NO: 835007 - DNA, 25 bp, Mus musculus
tgttgcgctgcagacccgcttggcg

SEQ ID NO: 835008 - DNA, 25 bp, Mus musculus
tgttgcgctggaaagaagatccttc

SEQ ID NO: 835009 - DNA, 25 bp, Mus musculus
tgttgcgctggatagaagatccttc

SEQ ID NO: 835010 - DNA, 25 bp, Mus musculus
tgttgcggaggcattatcccctggc

SEQ ID NO: 835011 - DNA, 25 bp, Mus musculus
tgttgcggaggctttatcccctggc

SEQ ID NO: 835012 - DNA, 25 bp, Mus musculus
tgttgctaaattctgtgatgctgag

SEQ ID NO: 835013 - DNA, 25 bp, Mus musculus
tgttgctaaattgtgtgatgctgag

SEQ ID NO: 835014 - DNA, 25 bp, Mus musculus
tgttgctaacacagggtatgggaag

SEQ ID NO: 835015 - DNA, 25 bp, Mus musculus
tgttgctaacactgggtatgggaag

SEQ ID NO: 835016 - DNA, 25 bp, Mus musculus
tgttgctaccacatatccagacaag

SEQ ID NO: 835017 - DNA, 25 bp, Mus musculus
tgttgctaccacttatccagacaag

SEQ ID NO: 835018 - DNA, 25 bp, Mus musculus
tgttgctagcgtagcctgcggcgct

SEQ ID NO: 835019 - DNA, 25 bp, Mus musculus
tgttgctagcgttgcctgcggcgct

SEQ ID NO: 835020 - DNA, 25 bp, Mus musculus
tgttgctagtgtagctgatcttggc

SEQ ID NO: 835021 - DNA, 25 bp, Mus musculus
tgttgctagtgttgctgatcttggc

SEQ ID NO: 835022 - DNA, 25 bp, Mus musculus
tgttgctatggacgcaagccatccg

SEQ ID NO: 835023 - DNA, 25 bp, Mus musculus
tgttgctatggaggcaagccatccg

SEQ ID NO: 835024 - DNA, 25 bp, Mus musculus
tgttgctatggccttgaaaacggct

SEQ ID NO: 835025 - DNA, 25 bp, Mus musculus
tgttgctatggcgttgaaaacggct

SEQ ID NO: 835026 - DNA, 25 bp, Mus musculus
tgttgctcctttcggccgcggcact

SEQ ID NO: 835027 - DNA, 25 bp, Mus musculus
tgttgctcctttgggccgcggcact

SEQ ID NO: 835028 - DNA, 25 bp, Mus musculus
tgttgctcgttacatcagagatgcc

SEQ ID NO: 835029 - DNA, 25 bp, Mus musculus
tgttgctcgttagatcagagatgcc

SEQ ID NO: 835030 - DNA, 25 bp, Mus musculus
tgttgctctctgagatcttccccag

SEQ ID NO: 835031 - DNA, 25 bp, Mus musculus
tgttgctctctgtgatcttccccag

SEQ ID NO: 835032 - DNA, 25 bp, Mus musculus
tgttgctcttcgactccaccatcgt

SEQ ID NO: 835033 - DNA, 25 bp, Mus musculus
tgttgctcttcgtctccaccatcgt

SEQ ID NO: 835034 - DNA, 25 bp, Mus musculus
tgttgctgaagaacaaagagtcact

SEQ ID NO: 835035 - DNA, 25 bp, Mus musculus
tgttgctgaagatcaaagagtcact

SEQ ID NO: 835036 - DNA, 25 bp, Mus musculus
tgttgctgacaacgctctgaagtac

SEQ ID NO: 835037 - DNA, 25 bp, Mus musculus
tgttgctgacaaggctctgaagtac

SEQ ID NO: 835038 - DNA, 25 bp, Mus musculus
tgttgctgacagagctgagccctcc

SEQ ID NO: 835039 - DNA, 25 bp, Mus musculus
tgttgctgacagtgctgagccctcc

SEQ ID NO: 835040 - DNA, 25 bp, Mus musculus
tgttgctgacccatatgaccagtcc

SEQ ID NO: 835041 - DNA, 25 bp, Mus musculus
tgttgctgacccttatgaccagtcc

SEQ ID NO: 835042 - DNA, 25 bp, Mus musculus
tgttgctgacgcctcggaaaaagag

SEQ ID NO: 835043 - DNA, 25 bp, Mus musculus
tgttgctgacgcgtcggaaaaagag

SEQ ID NO: 835044 - DNA, 25 bp, Mus musculus
tgttgctgaggtccgcacagcatcc

SEQ ID NO: 835045 - DNA, 25 bp, Mus musculus
tgttgctgaggtgcgcacagcatcc

SEQ ID NO: 835046 - DNA, 25 bp, Mus musculus
tgttgctgagtgcatccagcgaagc

SEQ ID NO: 835047 - DNA, 25 bp, Mus musculus
tgttgctgagtggatccagcgaagc

SEQ ID NO: 835048 - DNA, 25 bp, Mus musculus
tgttgctgcacactttatttcctgt

SEQ ID NO: 835049 - DNA, 25 bp, Mus musculus
tgttgctgcacagtttatttcctgt

SEQ ID NO: 835050 - DNA, 25 bp, Mus musculus
tgttgctgcactagtccatcctcag

SEQ ID NO: 835051 - DNA, 25 bp, Mus musculus
tgttgctgcacttgtccatcctcag

SEQ ID NO: 835052 - DNA, 25 bp, Mus musculus
tgttgctgcagcattacctggaatg

SEQ ID NO: 835053 - DNA, 25 bp, Mus musculus
tgttgctgcagctttacctggaatg

SEQ ID NO: 835054 - DNA, 25 bp, Mus musculus
tgttgctgcccacagcttgacagga

SEQ ID NO: 835055 - DNA, 25 bp, Mus musculus
tgttgctgcccagagcttgacagga

SEQ ID NO: 835056 - DNA, 25 bp, Mus musculus
tgttgctgccttcatggtggagccc

SEQ ID NO: 835057 - DNA, 25 bp, Mus musculus
tgttgctgccttgatggtggagccc

SEQ ID NO: 835058 - DNA, 25 bp, Mus musculus
tgttgctgctgtcaacgatttggga

SEQ ID NO: 835059 - DNA, 25 bp, Mus musculus
tgttgctgctgtgaacgatttggga

SEQ ID NO: 835060 - DNA, 25 bp, Mus musculus
tgttgctggactcgtgccgagccaa

SEQ ID NO: 835061 - DNA, 25 bp, Mus musculus
tgttgctggactggtgccgagccaa

SEQ ID NO: 835062 - DNA, 25 bp, Mus musculus
tgttgctggcttaattgtcctactt

SEQ ID NO: 835063 - DNA, 25 bp, Mus musculus
tgttgctggctttattgtcctactt

SEQ ID NO: 835064 - DNA, 25 bp, Mus musculus
tgttgctgtctacgaggacctgcga

SEQ ID NO: 835065 - DNA, 25 bp, Mus musculus
tgttgctgtctaggaggacctgcga

SEQ ID NO: 835066 - DNA, 25 bp, Mus musculus
tgttgctgtgctagccagacctggc

SEQ ID NO: 835067 - DNA, 25 bp, Mus musculus
tgttgctgtgcttgccagacctggc

SEQ ID NO: 835068 - DNA, 25 bp, Mus musculus
tgttgctgtggaagcaatccgattg

SEQ ID NO: 835069 - DNA, 25 bp, Mus musculus
tgttgctgtggatgcaatccgattg

SEQ ID NO: 835070 - DNA, 25 bp, Mus musculus
tgttgctgtggcaacttcttcagca

SEQ ID NO: 835071 - DNA, 25 bp, Mus musculus
tgttgctgtggctacttcttcagca

SEQ ID NO: 835072 - DNA, 25 bp, Mus musculus
tgttgctgttgaactggaaaaagtg

SEQ ID NO: 835073 - DNA, 25 bp, Mus musculus
tgttgctgttgatctggaaaaagtg

SEQ ID NO: 835074 - DNA, 25 bp, Mus musculus
tgttgcttaagaccttggcaagacc

SEQ ID NO: 835075 - DNA, 25 bp, Mus musculus
tgttgcttaagagcttggcaagacc

SEQ ID NO: 835076 - DNA, 25 bp, Mus musculus
tgttgcttacaaactaccagtagga

SEQ ID NO: 835077 - DNA, 25 bp, Mus musculus
tgttgcttacaatctaccagtagga

SEQ ID NO: 835078 - DNA, 25 bp, Mus musculus
tgttgcttaggaagctcctgctgtg

SEQ ID NO: 835079 - DNA, 25 bp, Mus musculus
tgttgcttaggatgctcctgctgtg

SEQ ID NO: 835080 - DNA, 25 bp, Mus musculus
tgttgcttcccaccagattcagaca

SEQ ID NO: 835081 - DNA, 25 bp, Mus musculus
tgttgcttcccagcagattcagaca

SEQ ID NO: 835082 - DNA, 25 bp, Mus musculus
tgttgcttgcgccacttctcttaac

SEQ ID NO: 835083 - DNA, 25 bp, Mus musculus
tgttgcttgcgcgacttctcttaac

SEQ ID NO: 835084 - DNA, 25 bp, Mus musculus
tgttgcttggtacagattcctgctg

SEQ ID NO: 835085 - DNA, 25 bp, Mus musculus
tgttgcttggtagagattcctgctg

SEQ ID NO: 835086 - DNA, 25 bp, Mus musculus
tgttgctttctcacaaagccccggg

SEQ ID NO: 835087 - DNA, 25 bp, Mus musculus
tgttgctttctctcaaagccccggg

SEQ ID NO: 835088 - DNA, 25 bp, Mus musculus
tgttggaaaacgatgtggcgtttga

SEQ ID NO: 835089 - DNA, 25 bp, Mus musculus
tgttggaaaacgttgtggcgtttga

SEQ ID NO: 835090 - DNA, 25 bp, Mus musculus
tgttggaaatgaatctgtccagtga

SEQ ID NO: 835091 - DNA, 25 bp, Mus musculus
tgttggaaatgattctgtccagtga

SEQ ID NO: 835092 - DNA, 25 bp, Mus musculus
tgttggaacaagcacctgtattcac

SEQ ID NO: 835093 - DNA, 25 bp, Mus musculus
tgttggaacaaggacctgtattcac

SEQ ID NO: 835094 - DNA, 25 bp, Mus musculus
tgttggaaccttcaaaactattgga

SEQ ID NO: 835095 - DNA, 25 bp, Mus musculus
tgttggaaccttgaaaactattgga

SEQ ID NO: 835096 - DNA, 25 bp, Mus musculus
tgttggaagagtacaaggccgatgc

SEQ ID NO: 835097 - DNA, 25 bp, Mus musculus
tgttggaagagttcaaggccgatgc

SEQ ID NO: 835098 - DNA, 25 bp, Mus musculus
tgttggaaggccaggagaactctga

SEQ ID NO: 835099 - DNA, 25 bp, Mus musculus
tgttggaaggccctgctgcccgctt

SEQ ID NO: 835100 - DNA, 25 bp, Mus musculus
tgttggaaggccgtgctgcccgctt

SEQ ID NO: 835101 - DNA, 25 bp, Mus musculus
tgttggaaggcctggagaactctga

SEQ ID NO: 835102 - DNA, 25 bp, Mus musculus
tgttggaatgaccttttttctgctg

SEQ ID NO: 835103 - DNA, 25 bp, Mus musculus
tgttggaatgacgttttttctgctg

SEQ ID NO: 835104 - DNA, 25 bp, Mus musculus
tgttggacagacacaacttcacaat

SEQ ID NO: 835105 - DNA, 25 bp, Mus musculus
tgttggacagactcaacttcacaat

SEQ ID NO: 835106 - DNA, 25 bp, Mus musculus
tgttggacagcaatcatacagtggg

SEQ ID NO: 835107 - DNA, 25 bp, Mus musculus
tgttggacagcattcatacagtggg

SEQ ID NO: 835108 - DNA, 25 bp, Mus musculus
tgttggacagtaagactttctgccg

SEQ ID NO: 835109 - DNA, 25 bp, Mus musculus
tgttggacagtatgactttctgccg

SEQ ID NO: 835110 - DNA, 25 bp, Mus musculus
tgttggaccacactgtgccacgacc

SEQ ID NO: 835111 - DNA, 25 bp, Mus musculus
tgttggaccacagtgtgccacgacc

SEQ ID NO: 835112 - DNA, 25 bp, Mus musculus
tgttggaccagtctcacagagaggc

SEQ ID NO: 835113 - DNA, 25 bp, Mus musculus
tgttggaccagtgtcacagagaggc

SEQ ID NO: 835114 - DNA, 25 bp, Mus musculus
tgttggacccctccatgagctggca

SEQ ID NO: 835115 - DNA, 25 bp, Mus musculus
tgttggacccctgcatgagctggca

SEQ ID NO: 835116 - DNA, 25 bp, Mus musculus
tgttggaccctcacaaagagtaagg

SEQ ID NO: 835117 - DNA, 25 bp, Mus musculus
tgttggaccctctcaaagagtaagg

SEQ ID NO: 835118 - DNA, 25 bp, Mus musculus
tgttggaccgggagtccccattcgt

SEQ ID NO: 835119 - DNA, 25 bp, Mus musculus
tgttggaccgggtgtccccattcgt

SEQ ID NO: 835120 - DNA, 25 bp, Mus musculus
tgttggacctaaaggagaacctggg

SEQ ID NO: 835121 - DNA, 25 bp, Mus musculus
tgttggacctaatggagaacctggg

SEQ ID NO: 835122 - DNA, 25 bp, Mus musculus
tgttggagaactcaaaatgactcag

SEQ ID NO: 835123 - DNA, 25 bp, Mus musculus
tgttggagaactgaaaatgactcag

SEQ ID NO: 835124 - DNA, 25 bp, Mus musculus
tgttggagacaccttccccgtgggc

SEQ ID NO: 835125 - DNA, 25 bp, Mus musculus
tgttggagacacgttccccgtgggc

SEQ ID NO: 835126 - DNA, 25 bp, Mus musculus
tgttggagagtcacttaatgggcct

SEQ ID NO: 835127 - DNA, 25 bp, Mus musculus
tgttggagagtctcttaatgggcct

SEQ ID NO: 835128 - DNA, 25 bp, Mus musculus
tgttggagagttcccctctcagaat

SEQ ID NO: 835129 - DNA, 25 bp, Mus musculus
tgttggagagttgccctctcagaat

SEQ ID NO: 835130 - DNA, 25 bp, Mus musculus
tgttggagattaagaaggcatcaag

SEQ ID NO: 835131 - DNA, 25 bp, Mus musculus
tgttggagattatgaaggcatcaag

SEQ ID NO: 835132 - DNA, 25 bp, Mus musculus
tgttggagccctcctatcagatgcc

SEQ ID NO: 835133 - DNA, 25 bp, Mus musculus
tgttggagccctgctatcagatgcc

SEQ ID NO: 835134 - DNA, 25 bp, Mus musculus
tgttggagctcccatgcagagcacc

SEQ ID NO: 835135 - DNA, 25 bp, Mus musculus
tgttggagctccgatgcagagcacc

SEQ ID NO: 835136 - DNA, 25 bp, Mus musculus
tgttggagctcgagcagatgaagaa

SEQ ID NO: 835137 - DNA, 25 bp, Mus musculus
tgttggagctcgtgcagatgaagaa

SEQ ID NO: 835138 - DNA, 25 bp, Mus musculus
tgttggaggactaagaagatctaac

SEQ ID NO: 835139 - DNA, 25 bp, Mus musculus
tgttggaggacttagaagatctaac

SEQ ID NO: 835140 - DNA, 25 bp, Mus musculus
tgttggaggtgacctccgccattcc

SEQ ID NO: 835141 - DNA, 25 bp, Mus musculus
tgttggaggtgagctccgccattcc

SEQ ID NO: 835142 - DNA, 25 bp, Mus musculus
tgttggatagatcttctgggcacac

SEQ ID NO: 835143 - DNA, 25 bp, Mus musculus
tgttggatagatgttctgggcacac

SEQ ID NO: 835144 - DNA, 25 bp, Mus musculus
tgttggatgaacaagcacccctgga

SEQ ID NO: 835145 - DNA, 25 bp, Mus musculus
tgttggatgaactagcacccctgga

SEQ ID NO: 835146 - DNA, 25 bp, Mus musculus
tgttggatggaacgacacatcccaa

SEQ ID NO: 835147 - DNA, 25 bp, Mus musculus
tgttggatggaaggacacatcccaa

SEQ ID NO: 835148 - DNA, 25 bp, Mus musculus
tgttggattagtccgtccagagcct

SEQ ID NO: 835149 - DNA, 25 bp, Mus musculus
tgttggattagtgcgtccagagcct

SEQ ID NO: 835150 - DNA, 25 bp, Mus musculus
tgttggattccaagctaagccagct

SEQ ID NO: 835151 - DNA, 25 bp, Mus musculus
tgttggattccatgctaagccagct

SEQ ID NO: 835152 - DNA, 25 bp, Mus musculus
tgttggattctgatgcctgggcacc

SEQ ID NO: 835153 - DNA, 25 bp, Mus musculus
tgttggattctgttgcctgggcacc

SEQ ID NO: 835154 - DNA, 25 bp, Mus musculus
tgttggcaaagacaacttcacactg

SEQ ID NO: 835155 - DNA, 25 bp, Mus musculus
tgttggcaaagagaacttcacactg

SEQ ID NO: 835156 - DNA, 25 bp, Mus musculus
tgttggcaagaacgtggaaagtcac

SEQ ID NO: 835157 - DNA, 25 bp, Mus musculus
tgttggcaagaaggtggaaagtcac

SEQ ID NO: 835158 - DNA, 25 bp, Mus musculus
tgttggcacagcctctactgaagac

SEQ ID NO: 835159 - DNA, 25 bp, Mus musculus
tgttggcacagcgtctactgaagac

SEQ ID NO: 835160 - DNA, 25 bp, Mus musculus
tgttggcactaaagaaagcattggg

SEQ ID NO: 835161 - DNA, 25 bp, Mus musculus
tgttggcactaatgaaagcattggg

SEQ ID NO: 835162 - DNA, 25 bp, Mus musculus
tgttggcactgaagataagaattct

SEQ ID NO: 835163 - DNA, 25 bp, Mus musculus
tgttggcactgatgataagaattct

SEQ ID NO: 835164 - DNA, 25 bp, Mus musculus
tgttggcactttacaagaaccatcg

SEQ ID NO: 835165 - DNA, 25 bp, Mus musculus
tgttggcacttttcaagaaccatcg

SEQ ID NO: 835166 - DNA, 25 bp, Mus musculus
tgttggcaggctctgcgcagaagcc

SEQ ID NO: 835167 - DNA, 25 bp, Mus musculus
tgttggcaggctgtgcgcagaagcc

SEQ ID NO: 835168 - DNA, 25 bp, Mus musculus
tgttggcagtacacgagtgaaggac

SEQ ID NO: 835169 - DNA, 25 bp, Mus musculus
tgttggcagtactcgagtgaaggac

SEQ ID NO: 835170 - DNA, 25 bp, Mus musculus
tgttggcagtgcagtggtgctccat

SEQ ID NO: 835171 - DNA, 25 bp, Mus musculus
tgttggcagtgctgtggtgctccat

SEQ ID NO: 835172 - DNA, 25 bp, Mus musculus
tgttggcataaccacaggctgtact

SEQ ID NO: 835173 - DNA, 25 bp, Mus musculus
tgttggcataacgacaggctgtact

SEQ ID NO: 835174 - DNA, 25 bp, Mus musculus
tgttggccaggaactttcacgacag

SEQ ID NO: 835175 - DNA, 25 bp, Mus musculus
tgttggccaggatctttcacgacag

SEQ ID NO: 835176 - DNA, 25 bp, Mus musculus
tgttggccatgaaggatcaggccag

SEQ ID NO: 835177 - DNA, 25 bp, Mus musculus
tgttggccatgatggatcaggccag

SEQ ID NO: 835178 - DNA, 25 bp, Mus musculus
tgttggccctgacaatcactgccag

SEQ ID NO: 835179 - DNA, 25 bp, Mus musculus
tgttggccctgagaatcactgccag

SEQ ID NO: 835180 - DNA, 25 bp, Mus musculus
tgttggccctttactgctgacgcac

SEQ ID NO: 835181 - DNA, 25 bp, Mus musculus
tgttggcccttttctgctgacgcac

SEQ ID NO: 835182 - DNA, 25 bp, Mus musculus
tgttggccgcatcggcatcgagatc

SEQ ID NO: 835183 - DNA, 25 bp, Mus musculus
tgttggccgcatgggcatcgagatc

SEQ ID NO: 835184 - DNA, 25 bp, Mus musculus
tgttggccgctgacaatgcccttaa

SEQ ID NO: 835185 - DNA, 25 bp, Mus musculus
tgttggccgctgtcaatgcccttaa

SEQ ID NO: 835186 - DNA, 25 bp, Mus musculus
tgttggcctcgactgctgcaactgc

SEQ ID NO: 835187 - DNA, 25 bp, Mus musculus
tgttggcctcgagtgctgcaactgc

SEQ ID NO: 835188 - DNA, 25 bp, Mus musculus
tgttggcctgacagtactgagccaa

SEQ ID NO: 835189 - DNA, 25 bp, Mus musculus
tgttggcctgactgtactgagccaa

SEQ ID NO: 835190 - DNA, 25 bp, Mus musculus
tgttggccttacaggcaagcacctt

SEQ ID NO: 835191 - DNA, 25 bp, Mus musculus
tgttggccttactggcaagcacctt

SEQ ID NO: 835192 - DNA, 25 bp, Mus musculus
tgttggccttctacagcccagtagg

SEQ ID NO: 835193 - DNA, 25 bp, Mus musculus
tgttggccttctcatctcaacgtta

SEQ ID NO: 835194 - DNA, 25 bp, Mus musculus
tgttggccttctgatctcaacgtta

SEQ ID NO: 835195 - DNA, 25 bp, Mus musculus
tgttggccttcttcagcccagtagg

SEQ ID NO: 835196 - DNA, 25 bp, Mus musculus
tgttggctacaacttccaagagtcc

SEQ ID NO: 835197 - DNA, 25 bp, Mus musculus
tgttggctacaagttccaagagtcc

SEQ ID NO: 835198 - DNA, 25 bp, Mus musculus
tgttggctacgacatatggtaatac

SEQ ID NO: 835199 - DNA, 25 bp, Mus musculus
tgttggctacgagatatggtaatac

SEQ ID NO: 835200 - DNA, 25 bp, Mus musculus
tgttggctcaataaagaaacatcag

SEQ ID NO: 835201 - DNA, 25 bp, Mus musculus
tgttggctcaattaagaaacatcag

SEQ ID NO: 835202 - DNA, 25 bp, Mus musculus
tgttggctcctgaggacgagctccc

SEQ ID NO: 835203 - DNA, 25 bp, Mus musculus
tgttggctcctgtggacgagctccc

SEQ ID NO: 835204 - DNA, 25 bp, Mus musculus
tgttggctcgatcctgaagtcccga

SEQ ID NO: 835205 - DNA, 25 bp, Mus musculus
tgttggctcgatgctgaagtcccga

SEQ ID NO: 835206 - DNA, 25 bp, Mus musculus
tgttggctgagaacacatgaggacc

SEQ ID NO: 835207 - DNA, 25 bp, Mus musculus
tgttggctgagatcacatgaggacc

SEQ ID NO: 835208 - DNA, 25 bp, Mus musculus
tgttggctgccactgtacagcgcca

SEQ ID NO: 835209 - DNA, 25 bp, Mus musculus
tgttggctgccagtgtacagcgcca

SEQ ID NO: 835210 - DNA, 25 bp, Mus musculus
tgttggctgcgcaggcccggctcaa

SEQ ID NO: 835211 - DNA, 25 bp, Mus musculus
tgttggctgcgctggcccggctcaa

SEQ ID NO: 835212 - DNA, 25 bp, Mus musculus
tgttggctgctgactcattgggtct

SEQ ID NO: 835213 - DNA, 25 bp, Mus musculus
tgttggctgctgtctcattgggtct

SEQ ID NO: 835214 - DNA, 25 bp, Mus musculus
tgttggctggaaagcctgttctgca

SEQ ID NO: 835215 - DNA, 25 bp, Mus musculus
tgttggctggaatgcctgttctgca

SEQ ID NO: 835216 - DNA, 25 bp, Mus musculus
tgttggcttcttcagatggcgcaag

SEQ ID NO: 835217 - DNA, 25 bp, Mus musculus
tgttggcttcttgagatggcgcaag

SEQ ID NO: 835218 - DNA, 25 bp, Mus musculus
tgttggcttgccatcccacaagacg

SEQ ID NO: 835219 - DNA, 25 bp, Mus musculus
tgttggcttgccttcccacaagacg

SEQ ID NO: 835220 - DNA, 25 bp, Mus musculus
tgttggctttatcctggactatgga

SEQ ID NO: 835221 - DNA, 25 bp, Mus musculus
tgttggctttatgctggactatgga

SEQ ID NO: 835222 - DNA, 25 bp, Mus musculus
tgttggctttctcaacactgagact

SEQ ID NO: 835223 - DNA, 25 bp, Mus musculus
tgttggctttctgaacactgagact

SEQ ID NO: 835224 - DNA, 25 bp, Mus musculus
tgttggctttggagagcttcttctg

SEQ ID NO: 835225 - DNA, 25 bp, Mus musculus
tgttggctttggagttctacacccc

SEQ ID NO: 835226 - DNA, 25 bp, Mus musculus
tgttggctttggtgagcttcttctg

SEQ ID NO: 835227 - DNA, 25 bp, Mus musculus
tgttggctttggtgttctacacccc

SEQ ID NO: 835228 - DNA, 25 bp, Mus musculus
tgttggcttttgagaaaactgtcaa

SEQ ID NO: 835229 - DNA, 25 bp, Mus musculus
tgttggcttttgtgaaaactgtcaa

SEQ ID NO: 835230 - DNA, 25 bp, Mus musculus
tgttgggaaaccactcagtcctgag

SEQ ID NO: 835231 - DNA, 25 bp, Mus musculus
tgttgggaaacctctcagtcctgag

SEQ ID NO: 835232 - DNA, 25 bp, Mus musculus
tgttgggaaatccagcttcatcaac

SEQ ID NO: 835233 - DNA, 25 bp, Mus musculus
tgttgggaaatcgagcttcatcaac

SEQ ID NO: 835234 - DNA, 25 bp, Mus musculus
tgttgggaacagacaagaaccaatg

SEQ ID NO: 835235 - DNA, 25 bp, Mus musculus
tgttgggaacagtcaagaaccaatg

SEQ ID NO: 835236 - DNA, 25 bp, Mus musculus
tgttgggaataaaacctgtgcaggt

SEQ ID NO: 835237 - DNA, 25 bp, Mus musculus
tgttgggaataatacctgtgcaggt

SEQ ID NO: 835238 - DNA, 25 bp, Mus musculus
tgttgggacaaacgagcaatcactg

SEQ ID NO: 835239 - DNA, 25 bp, Mus musculus
tgttgggacaaaggagcaatcactg

SEQ ID NO: 835240 - DNA, 25 bp, Mus musculus
tgttgggacacactcggtcagcagc

SEQ ID NO: 835241 - DNA, 25 bp, Mus musculus
tgttgggacacagtcggtcagcagc

SEQ ID NO: 835242 - DNA, 25 bp, Mus musculus
tgttgggattcgaggctacagtcac

SEQ ID NO: 835243 - DNA, 25 bp, Mus musculus
tgttgggattcgtggctacagtcac

SEQ ID NO: 835244 - DNA, 25 bp, Mus musculus
tgttgggcaaatcggagctctgaat

SEQ ID NO: 835245 - DNA, 25 bp, Mus musculus
tgttgggcaaatgggagctctgaat

SEQ ID NO: 835246 - DNA, 25 bp, Mus musculus
tgttgggcaaccattccaaggagct

SEQ ID NO: 835247 - DNA, 25 bp, Mus musculus
tgttgggcaacctttccaaggagct

SEQ ID NO: 835248 - DNA, 25 bp, Mus musculus
tgttgggcacatcgattataagtat

SEQ ID NO: 835249 - DNA, 25 bp, Mus musculus
tgttgggcacatggattataagtat

SEQ ID NO: 835250 - DNA, 25 bp, Mus musculus
tgttgggcccacagcagtactcttg

SEQ ID NO: 835251 - DNA, 25 bp, Mus musculus
tgttgggcccactgcagtactcttg

SEQ ID NO: 835252 - DNA, 25 bp, Mus musculus
tgttgggcccagcacctcctgaaag

SEQ ID NO: 835253 - DNA, 25 bp, Mus musculus
tgttgggcccaggacctcctgaaag

SEQ ID NO: 835254 - DNA, 25 bp, Mus musculus
tgttgggccgaacagacaccgccct

SEQ ID NO: 835255 - DNA, 25 bp, Mus musculus
tgttgggccgaagagacaccgccct

SEQ ID NO: 835256 - DNA, 25 bp, Mus musculus
tgttgggctcagaccaagatcggct

SEQ ID NO: 835257 - DNA, 25 bp, Mus musculus
tgttgggctcagtccaagatcggct

SEQ ID NO: 835258 - DNA, 25 bp, Mus musculus
tgttgggtagacaatgccatgggaa

SEQ ID NO: 835259 - DNA, 25 bp, Mus musculus
tgttgggtagactatgccatgggaa

SEQ ID NO: 835260 - DNA, 25 bp, Mus musculus
tgttgggtcgccataaagtgcgcac

SEQ ID NO: 835261 - DNA, 25 bp, Mus musculus
tgttgggtcgccttaaagtgcgcac

SEQ ID NO: 835262 - DNA, 25 bp, Mus musculus
tgttgggtgctcacctctctgtagg

SEQ ID NO: 835263 - DNA, 25 bp, Mus musculus
tgttgggtgctctcctctctgtagg

SEQ ID NO: 835264 - DNA, 25 bp, Mus musculus
tgttggtaaaggagtgagcacctat

SEQ ID NO: 835265 - DNA, 25 bp, Mus musculus
tgttggtaaaggtgtgagcacctat

SEQ ID NO: 835266 - DNA, 25 bp, Mus musculus
tgttggtacccaatacagtgtagac

SEQ ID NO: 835267 - DNA, 25 bp, Mus musculus
tgttggtacccaccatgtctcaggt

SEQ ID NO: 835268 - DNA, 25 bp, Mus musculus
tgttggtacccagcatgtctcaggt

SEQ ID NO: 835269 - DNA, 25 bp, Mus musculus
tgttggtacccattacagtgtagac

SEQ ID NO: 835270 - DNA, 25 bp, Mus musculus
tgttggtatctcagcggtcttctgg

SEQ ID NO: 835271 - DNA, 25 bp, Mus musculus
tgttggtatctctgcggtcttctgg

SEQ ID NO: 835272 - DNA, 25 bp, Mus musculus
tgttggtcaaccacggctacctagg

SEQ ID NO: 835273 - DNA, 25 bp, Mus musculus
tgttggtcaacctcggctacctagg

SEQ ID NO: 835274 - DNA, 25 bp, Mus musculus
tgttggtcaccaccctggtggccct

SEQ ID NO: 835275 - DNA, 25 bp, Mus musculus
tgttggtcaccagcctggtggccct

SEQ ID NO: 835276 - DNA, 25 bp, Mus musculus
tgttggtccagtagttcgatgcctc

SEQ ID NO: 835277 - DNA, 25 bp, Mus musculus
tgttggtccagttgttcgatgcctc

SEQ ID NO: 835278 - DNA, 25 bp, Mus musculus
tgttggtgaaccatcatctgggtgc

SEQ ID NO: 835279 - DNA, 25 bp, Mus musculus
tgttggtgaaccttcatctgggtgc

SEQ ID NO: 835280 - DNA, 25 bp, Mus musculus
tgttggtgacagcagctgctagtct

SEQ ID NO: 835281 - DNA, 25 bp, Mus musculus
tgttggtgacaggagctgctagtct

SEQ ID NO: 835282 - DNA, 25 bp, Mus musculus
tgttggtgacggcaggatccctttt

SEQ ID NO: 835283 - DNA, 25 bp, Mus musculus
tgttggtgacgggaggatccctttt

SEQ ID NO: 835284 - DNA, 25 bp, Mus musculus
tgttggtgatgcagaacctggactc

SEQ ID NO: 835285 - DNA, 25 bp, Mus musculus
tgttggtgatgctgaacctggactc

SEQ ID NO: 835286 - DNA, 25 bp, Mus musculus
tgttggtgcactaatttcggttcgg

SEQ ID NO: 835287 - DNA, 25 bp, Mus musculus
tgttggtgcacttatttcggttcgg

SEQ ID NO: 835288 - DNA, 25 bp, Mus musculus
tgttggtgcagacgactctgcccag

SEQ ID NO: 835289 - DNA, 25 bp, Mus musculus
tgttggtgcagaggactctgcccag

SEQ ID NO: 835290 - DNA, 25 bp, Mus musculus
tgttggtgcgacatgactttttcag

SEQ ID NO: 835291 - DNA, 25 bp, Mus musculus
tgttggtgcgacttgactttttcag

SEQ ID NO: 835292 - DNA, 25 bp, Mus musculus
tgttggtgctctagctcctagtgcc

SEQ ID NO: 835293 - DNA, 25 bp, Mus musculus
tgttggtgctcttgctcctagtgcc

SEQ ID NO: 835294 - DNA, 25 bp, Mus musculus
tgttggtggcaaagaccagtcacag

SEQ ID NO: 835295 - DNA, 25 bp, Mus musculus
tgttggtggcaatgaccagtcacag

SEQ ID NO: 835296 - DNA, 25 bp, Mus musculus
tgttggtggccaagaacattgactt

SEQ ID NO: 835297 - DNA, 25 bp, Mus musculus
tgttggtggccatgaacattgactt

SEQ ID NO: 835298 - DNA, 25 bp, Mus musculus
tgttggtgtacgattcctgggaagc

SEQ ID NO: 835299 - DNA, 25 bp, Mus musculus
tgttggtgtacgtttcctgggaagc

SEQ ID NO: 835300 - DNA, 25 bp, Mus musculus
tgttggtgtgcaccaactacacccc

SEQ ID NO: 835301 - DNA, 25 bp, Mus musculus
tgttggtgtgcagcaactacacccc

SEQ ID NO: 835302 - DNA, 25 bp, Mus musculus
tgttggttacatcgtgccacccgct

SEQ ID NO: 835303 - DNA, 25 bp, Mus musculus
tgttggttacatggtgccacccgct

SEQ ID NO: 835304 - DNA, 25 bp, Mus musculus
tgttgtacccctccattgacaggca

SEQ ID NO: 835305 - DNA, 25 bp, Mus musculus
tgttgtacccctgcattgacaggca

SEQ ID NO: 835306 - DNA, 25 bp, Mus musculus
tgttgtacgctgagacattcgctac

SEQ ID NO: 835307 - DNA, 25 bp, Mus musculus
tgttgtacgctgtgacattcgctac

SEQ ID NO: 835308 - DNA, 25 bp, Mus musculus
tgttgtactgccattcagcagggca

SEQ ID NO: 835309 - DNA, 25 bp, Mus musculus
tgttgtactgcctttcagcagggca

SEQ ID NO: 835310 - DNA, 25 bp, Mus musculus
tgttgtagacctacagaggtgatca

SEQ ID NO: 835311 - DNA, 25 bp, Mus musculus
tgttgtagaccttcagaggtgatca

SEQ ID NO: 835312 - DNA, 25 bp, Mus musculus
tgttgtattgcacacttgggacttg

SEQ ID NO: 835313 - DNA, 25 bp, Mus musculus
tgttgtattgcagacttgggacttg

SEQ ID NO: 835314 - DNA, 25 bp, Mus musculus
tgttgtcaaccaccatgaacctggc

SEQ ID NO: 835315 - DNA, 25 bp, Mus musculus
tgttgtcaaccagcatgaacctggc

SEQ ID NO: 835316 - DNA, 25 bp, Mus musculus
tgttgtcaccgtctacacctagacc

SEQ ID NO: 835317 - DNA, 25 bp, Mus musculus
tgttgtcaccgtgtacacctagacc

SEQ ID NO: 835318 - DNA, 25 bp, Mus musculus
tgttgtccaactactcacggagcag

SEQ ID NO: 835319 - DNA, 25 bp, Mus musculus
tgttgtccaacttctcacggagcag

SEQ ID NO: 835320 - DNA, 25 bp, Mus musculus
tgttgtccagagcagctccgtgttc

SEQ ID NO: 835321 - DNA, 25 bp, Mus musculus
tgttgtccagaggagctccgtgttc

SEQ ID NO: 835322 - DNA, 25 bp, Mus musculus
tgttgtccagctacggcgggaccga

SEQ ID NO: 835323 - DNA, 25 bp, Mus musculus
tgttgtccagcttcggcgggaccga

SEQ ID NO: 835324 - DNA, 25 bp, Mus musculus
tgttgtcccaggaaagatctatacc

SEQ ID NO: 835325 - DNA, 25 bp, Mus musculus
tgttgtcccaggtaagatctatacc

SEQ ID NO: 835326 - DNA, 25 bp, Mus musculus
tgttgtccgaaaaaagaagctctgg

SEQ ID NO: 835327 - DNA, 25 bp, Mus musculus
tgttgtccgaaataagaagctctgg

SEQ ID NO: 835328 - DNA, 25 bp, Mus musculus
tgttgtccgaagagccagtatcagg

SEQ ID NO: 835329 - DNA, 25 bp, Mus musculus
tgttgtccgaagtgccagtatcagg

SEQ ID NO: 835330 - DNA, 25 bp, Mus musculus
tgttgtccgaggcaaccccaagttg

SEQ ID NO: 835331 - DNA, 25 bp, Mus musculus
tgttgtccgagggaaccccaagttg

SEQ ID NO: 835332 - DNA, 25 bp, Mus musculus
tgttgtccttgaccacgttttccgt

SEQ ID NO: 835333 - DNA, 25 bp, Mus musculus
tgttgtccttgagcacgttttccgt

SEQ ID NO: 835334 - DNA, 25 bp, Mus musculus
tgttgtctaccgactgggtgacagt

SEQ ID NO: 835335 - DNA, 25 bp, Mus musculus
tgttgtctaccgtctgggtgacagt

SEQ ID NO: 835336 - DNA, 25 bp, Mus musculus
tgttgtctcatgagtccctagctgg

SEQ ID NO: 835337 - DNA, 25 bp, Mus musculus
tgttgtctcatgtgtccctagctgg

SEQ ID NO: 835338 - DNA, 25 bp, Mus musculus
tgttgtcttggtctgtcagttagag

SEQ ID NO: 835339 - DNA, 25 bp, Mus musculus
tgttgtcttggtgtgtcagttagag

SEQ ID NO: 835340 - DNA, 25 bp, Mus musculus
tgttgtgaagctcaattctggagac

SEQ ID NO: 835341 - DNA, 25 bp, Mus musculus
tgttgtgaagctgaattctggagac

SEQ ID NO: 835342 - DNA, 25 bp, Mus musculus
tgttgtgactctcttaccagctggt

SEQ ID NO: 835343 - DNA, 25 bp, Mus musculus
tgttgtgactctgttaccagctggt

SEQ ID NO: 835344 - DNA, 25 bp, Mus musculus
tgttgtgagtacactggagagctgc

SEQ ID NO: 835345 - DNA, 25 bp, Mus musculus
tgttgtgagtactctggagagctgc

SEQ ID NO: 835346 - DNA, 25 bp, Mus musculus
tgttgtgcaagacaactgtcctcac

SEQ ID NO: 835347 - DNA, 25 bp, Mus musculus
tgttgtgcaagagaactgtcctcac

SEQ ID NO: 835348 - DNA, 25 bp, Mus musculus
tgttgtgcatagcaagagccctgct

SEQ ID NO: 835349 - DNA, 25 bp, Mus musculus
tgttgtgcataggaagagccctgct

SEQ ID NO: 835350 - DNA, 25 bp, Mus musculus
tgttgtgcatcccttgctgcagctc

SEQ ID NO: 835351 - DNA, 25 bp, Mus musculus
tgttgtgcatccgttgctgcagctc

SEQ ID NO: 835352 - DNA, 25 bp, Mus musculus
tgttgtgccaaactcaaactgctgc

SEQ ID NO: 835353 - DNA, 25 bp, Mus musculus
tgttgtgccaaagtcaaactgctgc

SEQ ID NO: 835354 - DNA, 25 bp, Mus musculus
tgttgtgccccacagtgtagccagg

SEQ ID NO: 835355 - DNA, 25 bp, Mus musculus
tgttgtgccccagagtgtagccagg

SEQ ID NO: 835356 - DNA, 25 bp, Mus musculus
tgttgtgcctttagaagaattcaga

SEQ ID NO: 835357 - DNA, 25 bp, Mus musculus
tgttgtgccttttgaagaattcaga

SEQ ID NO: 835358 - DNA, 25 bp, Mus musculus
tgttgtgcgtgaagacgcaacgtcg

SEQ ID NO: 835359 - DNA, 25 bp, Mus musculus
tgttgtgcgtgatgacgcaacgtcg

SEQ ID NO: 835360 - DNA, 25 bp, Mus musculus
tgttgtgctcctcaagaacggagcc

SEQ ID NO: 835361 - DNA, 25 bp, Mus musculus
tgttgtgctcctgaagaacggagcc

SEQ ID NO: 835362 - DNA, 25 bp, Mus musculus
tgttgtgctgctacctgcgatctag

SEQ ID NO: 835363 - DNA, 25 bp, Mus musculus
tgttgtgctgctctgctcagggtca

SEQ ID NO: 835364 - DNA, 25 bp, Mus musculus
tgttgtgctgctgtgctcagggtca

SEQ ID NO: 835365 - DNA, 25 bp, Mus musculus
tgttgtgctgcttcctgcgatctag

SEQ ID NO: 835366 - DNA, 25 bp, Mus musculus
tgttgtgcttagcaaatgttggctg

SEQ ID NO: 835367 - DNA, 25 bp, Mus musculus
tgttgtgcttaggaaatgttggctg

SEQ ID NO: 835368 - DNA, 25 bp, Mus musculus
tgttgtggaaaaataccttcttgaa

SEQ ID NO: 835369 - DNA, 25 bp, Mus musculus
tgttgtggaaaattaccttcttgaa

SEQ ID NO: 835370 - DNA, 25 bp, Mus musculus
tgttgtggaagccttagctgctccg

SEQ ID NO: 835371 - DNA, 25 bp, Mus musculus
tgttgtggaagcgttagctgctccg

SEQ ID NO: 835372 - DNA, 25 bp, Mus musculus
tgttgtggattgctgctcatgaccc

SEQ ID NO: 835373 - DNA, 25 bp, Mus musculus
tgttgtggattggtgctcatgaccc

SEQ ID NO: 835374 - DNA, 25 bp, Mus musculus
tgttgtggcgatatccctaatagga

SEQ ID NO: 835375 - DNA, 25 bp, Mus musculus
tgttgtggcgatttccctaatagga

SEQ ID NO: 835376 - DNA, 25 bp, Mus musculus
tgttgtggttttcggatacgtgtac

SEQ ID NO: 835377 - DNA, 25 bp, Mus musculus
tgttgtggttttgggatacgtgtac

SEQ ID NO: 835378 - DNA, 25 bp, Mus musculus
tgttgtgtcctcagtgaatttggcc

SEQ ID NO: 835379 - DNA, 25 bp, Mus musculus
tgttgtgtcctctgtgaatttggcc

SEQ ID NO: 835380 - DNA, 25 bp, Mus musculus
tgttgtgtctgtcgcttccctggga

SEQ ID NO: 835381 - DNA, 25 bp, Mus musculus
tgttgtgtctgtggcttccctggga

SEQ ID NO: 835382 - DNA, 25 bp, Mus musculus
tgttgtgtggcccacagttgtgagg

SEQ ID NO: 835383 - DNA, 25 bp, Mus musculus
tgttgtgtggccgacagttgtgagg

SEQ ID NO: 835384 - DNA, 25 bp, Mus musculus
tgttgtgtggtcagatagaacccca

SEQ ID NO: 835385 - DNA, 25 bp, Mus musculus
tgttgtgtggtctgatagaacccca

SEQ ID NO: 835386 - DNA, 25 bp, Mus musculus
tgttgtgtttttcagggacgaattc

SEQ ID NO: 835387 - DNA, 25 bp, Mus musculus
tgttgtgtttttgagggacgaattc

SEQ ID NO: 835388 - DNA, 25 bp, Mus musculus
tgttgttaactaccccaaagtacag

SEQ ID NO: 835389 - DNA, 25 bp, Mus musculus
tgttgttaactagcccaaagtacag

SEQ ID NO: 835390 - DNA, 25 bp, Mus musculus
tgttgttaagcacaagattcacgtc

SEQ ID NO: 835391 - DNA, 25 bp, Mus musculus
tgttgttaagcagaagattcacgtc

SEQ ID NO: 835392 - DNA, 25 bp, Mus musculus
tgttgttaatggaacagggttagtc

SEQ ID NO: 835393 - DNA, 25 bp, Mus musculus
tgttgttaatggtacagggttagtc

SEQ ID NO: 835394 - DNA, 25 bp, Mus musculus
tgttgttacagcaaagtttagagca

SEQ ID NO: 835395 - DNA, 25 bp, Mus musculus
tgttgttacagctaagtttagagca

SEQ ID NO: 835396 - DNA, 25 bp, Mus musculus
tgttgttacttgacggccaactgaa

SEQ ID NO: 835397 - DNA, 25 bp, Mus musculus
tgttgttacttgtcggccaactgaa

SEQ ID NO: 835398 - DNA, 25 bp, Mus musculus
tgttgttattcgaccccaggaagag

SEQ ID NO: 835399 - DNA, 25 bp, Mus musculus
tgttgttattcgtccccaggaagag

SEQ ID NO: 835400 - DNA, 25 bp, Mus musculus
tgttgttcaagcaatgatcggagac

SEQ ID NO: 835401 - DNA, 25 bp, Mus musculus
tgttgttcaagctatgatcggagac

SEQ ID NO: 835402 - DNA, 25 bp, Mus musculus
tgttgttccagtcaagcgccgagag

SEQ ID NO: 835403 - DNA, 25 bp, Mus musculus
tgttgttccagtgaagcgccgagag

SEQ ID NO: 835404 - DNA, 25 bp, Mus musculus
tgttgttcccaactcggctgttcct

SEQ ID NO: 835405 - DNA, 25 bp, Mus musculus
tgttgttcccaagtcggctgttcct

SEQ ID NO: 835406 - DNA, 25 bp, Mus musculus
tgttgttgagagacagccagatgct

SEQ ID NO: 835407 - DNA, 25 bp, Mus musculus
tgttgttgagagtcagccagatgct

SEQ ID NO: 835408 - DNA, 25 bp, Mus musculus
tgttgttgatccaaaccctgcagtc

SEQ ID NO: 835409 - DNA, 25 bp, Mus musculus
tgttgttgatcctaaccctgcagtc

SEQ ID NO: 835410 - DNA, 25 bp, Mus musculus
tgttgttgcggtcttctggaccatc

SEQ ID NO: 835411 - DNA, 25 bp, Mus musculus
tgttgttgcggtgttctggaccatc

SEQ ID NO: 835412 - DNA, 25 bp, Mus musculus
tgttgttggagacacgttccccgtg

SEQ ID NO: 835413 - DNA, 25 bp, Mus musculus
tgttgttggagacttcccctctcag

SEQ ID NO: 835414 - DNA, 25 bp, Mus musculus
tgttgttggagagacgttccccgtg

SEQ ID NO: 835415 - DNA, 25 bp, Mus musculus
tgttgttggagagttcccctctcag

SEQ ID NO: 835416 - DNA, 25 bp, Mus musculus
tgttgttgttaaccggcaagaggct

SEQ ID NO: 835417 - DNA, 25 bp, Mus musculus
tgttgttgttaagcggcaagaggct

SEQ ID NO: 835418 - DNA, 25 bp, Mus musculus
tgttgttttcttccttggtccgcag

SEQ ID NO: 835419 - DNA, 25 bp, Mus musculus
tgttgttttcttgcttggtccgcag

SEQ ID NO: 835420 - DNA, 25 bp, Mus musculus
tgttgtttttgcctcgtggcctgcg

SEQ ID NO: 835421 - DNA, 25 bp, Mus musculus
tgttgtttttgcgtcgtggcctgcg

SEQ ID NO: 835422 - DNA, 25 bp, Mus musculus
tgtttaaactgcatcaatggagcac

SEQ ID NO: 835423 - DNA, 25 bp, Mus musculus
tgtttaaactgcttcaatggagcac

SEQ ID NO: 835424 - DNA, 25 bp, Mus musculus
tgtttaaatgaaaggtgcgctatcc

SEQ ID NO: 835425 - DNA, 25 bp, Mus musculus
tgtttaaatgaatggtgcgctatcc

SEQ ID NO: 835426 - DNA, 25 bp, Mus musculus
tgtttaacatctacatcaagcgagc

SEQ ID NO: 835427 - DNA, 25 bp, Mus musculus
tgtttaacatcttcatcaagcgagc

SEQ ID NO: 835428 - DNA, 25 bp, Mus musculus
tgtttaaccctgagaacagactgag

SEQ ID NO: 835429 - DNA, 25 bp, Mus musculus
tgtttaaccctgtgaacagactgag

SEQ ID NO: 835430 - DNA, 25 bp, Mus musculus
tgtttaagcagaccatctgcatctg

SEQ ID NO: 835431 - DNA, 25 bp, Mus musculus
tgtttaagcagagcatctgcatctg

SEQ ID NO: 835432 - DNA, 25 bp, Mus musculus
tgtttaagccgcagatccttcgcca

SEQ ID NO: 835433 - DNA, 25 bp, Mus musculus
tgtttaagccgctgatccttcgcca

SEQ ID NO: 835434 - DNA, 25 bp, Mus musculus
tgtttaagcctgacagagccatctg

SEQ ID NO: 835435 - DNA, 25 bp, Mus musculus
tgtttaagcctgtcagagccatctg

SEQ ID NO: 835436 - DNA, 25 bp, Mus musculus
tgtttaagcttgcaggaacgtcctt

SEQ ID NO: 835437 - DNA, 25 bp, Mus musculus
tgtttaagcttggaggaacgtcctt

SEQ ID NO: 835438 - DNA, 25 bp, Mus musculus
tgtttaaggcctatcctatcccaga

SEQ ID NO: 835439 - DNA, 25 bp, Mus musculus
tgtttaaggcctttcctatcccaga

SEQ ID NO: 835440 - DNA, 25 bp, Mus musculus
tgtttaagggctatgcccgccacct

SEQ ID NO: 835441 - DNA, 25 bp, Mus musculus
tgtttaagggctttgcccgccacct

SEQ ID NO: 835442 - DNA, 25 bp, Mus musculus
tgtttaagttgcaaaaatagcagca

SEQ ID NO: 835443 - DNA, 25 bp, Mus musculus
tgtttaagttgctaaaatagcagca

SEQ ID NO: 835444 - DNA, 25 bp, Mus musculus
tgtttaatctacacaagatagaggc

SEQ ID NO: 835445 - DNA, 25 bp, Mus musculus
tgtttaatctactcaagatagaggc

SEQ ID NO: 835446 - DNA, 25 bp, Mus musculus
tgtttacaaaatatgggaagtgtta

SEQ ID NO: 835447 - DNA, 25 bp, Mus musculus
tgtttacaaaatttgggaagtgtta

SEQ ID NO: 835448 - DNA, 25 bp, Mus musculus
tgtttacaacatcattggaggactt

SEQ ID NO: 835449 - DNA, 25 bp, Mus musculus
tgtttacaacatgattggaggactt

SEQ ID NO: 835450 - DNA, 25 bp, Mus musculus
tgtttacaagacagcggacagtggg

SEQ ID NO: 835451 - DNA, 25 bp, Mus musculus
tgtttacaagactgcggacagtggg

SEQ ID NO: 835452 - DNA, 25 bp, Mus musculus
tgtttacacacaaggagtttgagca

SEQ ID NO: 835453 - DNA, 25 bp, Mus musculus
tgtttacacacatggagtttgagca

SEQ ID NO: 835454 - DNA, 25 bp, Mus musculus
tgtttacaccaaagccaagaagcag

SEQ ID NO: 835455 - DNA, 25 bp, Mus musculus
tgtttacaccaatgccaagaagcag

SEQ ID NO: 835456 - DNA, 25 bp, Mus musculus
tgtttacactctcactaggactctg

SEQ ID NO: 835457 - DNA, 25 bp, Mus musculus
tgtttacactctgactaggactctg

SEQ ID NO: 835458 - DNA, 25 bp, Mus musculus
tgtttacacttacaggattctgccc

SEQ ID NO: 835459 - DNA, 25 bp, Mus musculus
tgtttacacttagaggattctgccc

SEQ ID NO: 835460 - DNA, 25 bp, Mus musculus
tgtttacagcatcacagcctgtcgg

SEQ ID NO: 835461 - DNA, 25 bp, Mus musculus
tgtttacagcatgacagcctgtcgg

SEQ ID NO: 835462 - DNA, 25 bp, Mus musculus
tgtttacatccgacttcacgagagg

SEQ ID NO: 835463 - DNA, 25 bp, Mus musculus
tgtttacatccgtcttcacgagagg

SEQ ID NO: 835464 - DNA, 25 bp, Mus musculus
tgtttacatggaactcaggagtctg

SEQ ID NO: 835465 - DNA, 25 bp, Mus musculus
tgtttacatggatctcaggagtctg

SEQ ID NO: 835466 - DNA, 25 bp, Mus musculus
tgtttacattgaacaccggctgatg

SEQ ID NO: 835467 - DNA, 25 bp, Mus musculus
tgtttacattgatcaccggctgatg

SEQ ID NO: 835468 - DNA, 25 bp, Mus musculus
tgtttaccagccacatctggtttta

SEQ ID NO: 835469 - DNA, 25 bp, Mus musculus
tgtttaccagcctcatctggtttta

SEQ ID NO: 835470 - DNA, 25 bp, Mus musculus
tgtttacccgagctattgatataca

SEQ ID NO: 835471 - DNA, 25 bp, Mus musculus
tgtttacccgaggtattgatataca

SEQ ID NO: 835472 - DNA, 25 bp, Mus musculus
tgtttaccgagaccaaatgcacggg

SEQ ID NO: 835473 - DNA, 25 bp, Mus musculus
tgtttaccgagagcaaatgcacggg

SEQ ID NO: 835474 - DNA, 25 bp, Mus musculus
tgtttacctagaagtctggcaaaag

SEQ ID NO: 835475 - DNA, 25 bp, Mus musculus
tgtttacctagatgtctggcaaaag

SEQ ID NO: 835476 - DNA, 25 bp, Mus musculus
tgtttacctcagacatgctccctag

SEQ ID NO: 835477 - DNA, 25 bp, Mus musculus
tgtttacctcagtcatgctccctag

SEQ ID NO: 835478 - DNA, 25 bp, Mus musculus
tgtttacctctcagaagttggagat

SEQ ID NO: 835479 - DNA, 25 bp, Mus musculus
tgtttacctctctgaagttggagat

SEQ ID NO: 835480 - DNA, 25 bp, Mus musculus
tgtttacgaggaaccctatgcagca

SEQ ID NO: 835481 - DNA, 25 bp, Mus musculus
tgtttacgaggatccctatgcagca

SEQ ID NO: 835482 - DNA, 25 bp, Mus musculus
tgtttactatggctgatgatctgga

SEQ ID NO: 835483 - DNA, 25 bp, Mus musculus
tgtttactatgggtgatgatctgga

SEQ ID NO: 835484 - DNA, 25 bp, Mus musculus
tgtttactgggaaggcatcgatgag

SEQ ID NO: 835485 - DNA, 25 bp, Mus musculus
tgtttactgggatggcatcgatgag

SEQ ID NO: 835486 - DNA, 25 bp, Mus musculus
tgtttacttgtgagcccctctcaga

SEQ ID NO: 835487 - DNA, 25 bp, Mus musculus
tgtttacttgtgtgcccctctcaga

SEQ ID NO: 835488 - DNA, 25 bp, Mus musculus
tgtttacttgttacaaacggaatga

SEQ ID NO: 835489 - DNA, 25 bp, Mus musculus
tgtttacttgtttcaaacggaatga

SEQ ID NO: 835490 - DNA, 25 bp, Mus musculus
tgtttactttgaaaattgctgttga

SEQ ID NO: 835491 - DNA, 25 bp, Mus musculus
tgtttactttgacaagtagtgactg

SEQ ID NO: 835492 - DNA, 25 bp, Mus musculus
tgtttactttgagaagtagtgactg

SEQ ID NO: 835493 - DNA, 25 bp, Mus musculus
tgtttactttgataattgctgttga

SEQ ID NO: 835494 - DNA, 25 bp, Mus musculus
tgtttagatatcaccgtagaggccc

SEQ ID NO: 835495 - DNA, 25 bp, Mus musculus
tgtttagatatctccgtagaggccc

SEQ ID NO: 835496 - DNA, 25 bp, Mus musculus
tgtttagcatggagttcagcggccg

SEQ ID NO: 835497 - DNA, 25 bp, Mus musculus
tgtttagcatggtgttcagcggccg

SEQ ID NO: 835498 - DNA, 25 bp, Mus musculus
tgtttagcccctattaaggtcgctt

SEQ ID NO: 835499 - DNA, 25 bp, Mus musculus
tgtttagccccttttaaggtcgctt

SEQ ID NO: 835500 - DNA, 25 bp, Mus musculus
tgtttaggaaggatctttggagcaa

SEQ ID NO: 835501 - DNA, 25 bp, Mus musculus
tgtttaggaaggttctttggagcaa

SEQ ID NO: 835502 - DNA, 25 bp, Mus musculus
tgtttagtccagcaaacattggtca

SEQ ID NO: 835503 - DNA, 25 bp, Mus musculus
tgtttagtccaggaaacattggtca

SEQ ID NO: 835504 - DNA, 25 bp, Mus musculus
tgtttataaagcaaaggcacgctgt

SEQ ID NO: 835505 - DNA, 25 bp, Mus musculus
tgtttataaagctaaggcacgctgt

SEQ ID NO: 835506 - DNA, 25 bp, Mus musculus
tgtttatacaccagttgctcctgtg

SEQ ID NO: 835507 - DNA, 25 bp, Mus musculus
tgtttatacacctgttgctcctgtg

SEQ ID NO: 835508 - DNA, 25 bp, Mus musculus
tgtttatatcccaggcaagcgttgg

SEQ ID NO: 835509 - DNA, 25 bp, Mus musculus
tgtttatatccctggcaagcgttgg

SEQ ID NO: 835510 - DNA, 25 bp, Mus musculus
tgtttatcacgtcaagagaagaagg

SEQ ID NO: 835511 - DNA, 25 bp, Mus musculus
tgtttatcacgtgaagagaagaagg

SEQ ID NO: 835512 - DNA, 25 bp, Mus musculus
tgtttatcatttccactaaagcagg

SEQ ID NO: 835513 - DNA, 25 bp, Mus musculus
tgtttatcatttgcactaaagcagg

SEQ ID NO: 835514 - DNA, 25 bp, Mus musculus
tgtttatccgtacggacctcatctg

SEQ ID NO: 835515 - DNA, 25 bp, Mus musculus
tgtttatccgtagggacctcatctg

SEQ ID NO: 835516 - DNA, 25 bp, Mus musculus
tgtttatcgtgccatcagttgtcaa

SEQ ID NO: 835517 - DNA, 25 bp, Mus musculus
tgtttatcgtgcgatcagttgtcaa

SEQ ID NO: 835518 - DNA, 25 bp, Mus musculus
tgtttatgaaccacagttgcagcac

SEQ ID NO: 835519 - DNA, 25 bp, Mus musculus
tgtttatgaacctcagttgcagcac

SEQ ID NO: 835520 - DNA, 25 bp, Mus musculus
tgtttatgacaaagtagactatctg

SEQ ID NO: 835521 - DNA, 25 bp, Mus musculus
tgtttatgacaatgtagactatctg

SEQ ID NO: 835522 - DNA, 25 bp, Mus musculus
tgtttatgacctcccctagcttggg

SEQ ID NO: 835523 - DNA, 25 bp, Mus musculus
tgtttatgacctgccctagcttggg

SEQ ID NO: 835524 - DNA, 25 bp, Mus musculus
tgtttatgattcaggcctcgccaag

SEQ ID NO: 835525 - DNA, 25 bp, Mus musculus
tgtttatgattctggcctcgccaag

SEQ ID NO: 835526 - DNA, 25 bp, Mus musculus
tgtttatggaagcactgatctgccc

SEQ ID NO: 835527 - DNA, 25 bp, Mus musculus
tgtttatggaaggactgatctgccc

SEQ ID NO: 835528 - DNA, 25 bp, Mus musculus
tgtttatggactcggattctcctct

SEQ ID NO: 835529 - DNA, 25 bp, Mus musculus
tgtttatggactgggattctcctct

SEQ ID NO: 835530 - DNA, 25 bp, Mus musculus
tgtttatggtggataccatgttgga

SEQ ID NO: 835531 - DNA, 25 bp, Mus musculus
tgtttatggtggttaccatgttgga

SEQ ID NO: 835532 - DNA, 25 bp, Mus musculus
tgtttatgtcggctcgcggtgtctc

SEQ ID NO: 835533 - DNA, 25 bp, Mus musculus
tgtttatgtcgggtcgcggtgtctc

SEQ ID NO: 835534 - DNA, 25 bp, Mus musculus
tgtttatgttgcatctgaaacagct

SEQ ID NO: 835535 - DNA, 25 bp, Mus musculus
tgtttatgttgcttctgaaacagct

SEQ ID NO: 835536 - DNA, 25 bp, Mus musculus
tgtttattgatgaccgcagaacacc

SEQ ID NO: 835537 - DNA, 25 bp, Mus musculus
tgtttattgatgtccgcagaacacc

SEQ ID NO: 835538 - DNA, 25 bp, Mus musculus
tgtttatttgatccccactgtgcct

SEQ ID NO: 835539 - DNA, 25 bp, Mus musculus
tgtttatttgatgcccactgtgcct

SEQ ID NO: 835540 - DNA, 25 bp, Mus musculus
tgtttcaaaatacaatcctgggctg

SEQ ID NO: 835541 - DNA, 25 bp, Mus musculus
tgtttcaaaatagaatcctgggctg

SEQ ID NO: 835542 - DNA, 25 bp, Mus musculus
tgtttcaaacggaatgacaagcgag

SEQ ID NO: 835543 - DNA, 25 bp, Mus musculus
tgtttcaaacggtatgacaagcgag

SEQ ID NO: 835544 - DNA, 25 bp, Mus musculus
tgtttcaaatgacaccaaagagctc

SEQ ID NO: 835545 - DNA, 25 bp, Mus musculus
tgtttcaaatgagaccaaagagctc

SEQ ID NO: 835546 - DNA, 25 bp, Mus musculus
tgtttcaaccagaggcagagctgaa

SEQ ID NO: 835547 - DNA, 25 bp, Mus musculus
tgtttcaaccagtggcagagctgaa

SEQ ID NO: 835548 - DNA, 25 bp, Mus musculus
tgtttcaacttcagtgctacaatag

SEQ ID NO: 835549 - DNA, 25 bp, Mus musculus
tgtttcaacttctgtgctacaatag

SEQ ID NO: 835550 - DNA, 25 bp, Mus musculus
tgtttcaagaacctgtccattaatg

SEQ ID NO: 835551 - DNA, 25 bp, Mus musculus
tgtttcaagaacgtgtccattaatg

SEQ ID NO: 835552 - DNA, 25 bp, Mus musculus
tgtttcaagcacagtagtgaaagtg

SEQ ID NO: 835553 - DNA, 25 bp, Mus musculus
tgtttcaagcactgtagtgaaagtg

SEQ ID NO: 835554 - DNA, 25 bp, Mus musculus
tgtttcaaggccaagaacccagaga

SEQ ID NO: 835555 - DNA, 25 bp, Mus musculus
tgtttcaaggccagcacgtgggttg

SEQ ID NO: 835556 - DNA, 25 bp, Mus musculus
tgtttcaaggcctagaacccagaga

SEQ ID NO: 835557 - DNA, 25 bp, Mus musculus
tgtttcaaggcctgcacgtgggttg

SEQ ID NO: 835558 - DNA, 25 bp, Mus musculus
tgtttcacaatcacaagaggctcga

SEQ ID NO: 835559 - DNA, 25 bp, Mus musculus
tgtttcacaatctcaagaggctcga

SEQ ID NO: 835560 - DNA, 25 bp, Mus musculus
tgtttcacagccatgaccggaacca

SEQ ID NO: 835561 - DNA, 25 bp, Mus musculus
tgtttcacagccttgaccggaacca

SEQ ID NO: 835562 - DNA, 25 bp, Mus musculus
tgtttcacaggaagaggccaccagt

SEQ ID NO: 835563 - DNA, 25 bp, Mus musculus
tgtttcacaggatgaggccaccagt

SEQ ID NO: 835564 - DNA, 25 bp, Mus musculus
tgtttcacatgtactacctgccgga

SEQ ID NO: 835565 - DNA, 25 bp, Mus musculus
tgtttcacatgttctacctgccgga

SEQ ID NO: 835566 - DNA, 25 bp, Mus musculus
tgtttcacattaacaagccaagaag

SEQ ID NO: 835567 - DNA, 25 bp, Mus musculus
tgtttcacattatcaagccaagaag

SEQ ID NO: 835568 - DNA, 25 bp, Mus musculus
tgtttcaccgcccattacgagtgct

SEQ ID NO: 835569 - DNA, 25 bp, Mus musculus
tgtttcaccgccgattacgagtgct

SEQ ID NO: 835570 - DNA, 25 bp, Mus musculus
tgtttcactggacccaatattatgg

SEQ ID NO: 835571 - DNA, 25 bp, Mus musculus
tgtttcactggagccaatattatgg

SEQ ID NO: 835572 - DNA, 25 bp, Mus musculus
tgtttcagcgtcaacagagcatgga

SEQ ID NO: 835573 - DNA, 25 bp, Mus musculus
tgtttcagcgtctacagagcatgga

SEQ ID NO: 835574 - DNA, 25 bp, Mus musculus
tgtttcaggatgacgaaccggcagt

SEQ ID NO: 835575 - DNA, 25 bp, Mus musculus
tgtttcaggatgtcgaaccggcagt

SEQ ID NO: 835576 - DNA, 25 bp, Mus musculus
tgtttcagtgagcagcaccctattt

SEQ ID NO: 835577 - DNA, 25 bp, Mus musculus
tgtttcagtgaggagcaccctattt

SEQ ID NO: 835578 - DNA, 25 bp, Mus musculus
tgtttcatactcagacattgctgcg

SEQ ID NO: 835579 - DNA, 25 bp, Mus musculus
tgtttcatactctgacattgctgcg

SEQ ID NO: 835580 - DNA, 25 bp, Mus musculus
tgtttcataggaacatggtggagcc

SEQ ID NO: 835581 - DNA, 25 bp, Mus musculus
tgtttcataggatcatggtggagcc

SEQ ID NO: 835582 - DNA, 25 bp, Mus musculus
tgtttcatccccagacctatgaagg

SEQ ID NO: 835583 - DNA, 25 bp, Mus musculus
tgtttcatcccctgacctatgaagg

SEQ ID NO: 835584 - DNA, 25 bp, Mus musculus
tgtttcatggatccaccacaggatg

SEQ ID NO: 835585 - DNA, 25 bp, Mus musculus
tgtttcatggatgcaccacaggatg

SEQ ID NO: 835586 - DNA, 25 bp, Mus musculus
tgtttcatggctatgggtccctcct

SEQ ID NO: 835587 - DNA, 25 bp, Mus musculus
tgtttcatggctttgggtccctcct

SEQ ID NO: 835588 - DNA, 25 bp, Mus musculus
tgtttcattgggagaattactgggc

SEQ ID NO: 835589 - DNA, 25 bp, Mus musculus
tgtttcattgggtgaattactgggc

SEQ ID NO: 835590 - DNA, 25 bp, Mus musculus
tgtttccaaagaaaatgggcccaac

SEQ ID NO: 835591 - DNA, 25 bp, Mus musculus
tgtttccaaagataatgggcccaac

SEQ ID NO: 835592 - DNA, 25 bp, Mus musculus
tgtttccaaattccactgttggtga

SEQ ID NO: 835593 - DNA, 25 bp, Mus musculus
tgtttccaaattgcactgttggtga

SEQ ID NO: 835594 - DNA, 25 bp, Mus musculus
tgtttccaagtaaacaacctcctgg

SEQ ID NO: 835595 - DNA, 25 bp, Mus musculus
tgtttccaagtatacaacctcctgg

SEQ ID NO: 835596 - DNA, 25 bp, Mus musculus
tgtttccacaggagtcccatgcagg

SEQ ID NO: 835597 - DNA, 25 bp, Mus musculus
tgtttccacaggtgtcccatgcagg

SEQ ID NO: 835598 - DNA, 25 bp, Mus musculus
tgtttccacattcaaatgagtgaga

SEQ ID NO: 835599 - DNA, 25 bp, Mus musculus
tgtttccacattgaaatgagtgaga

SEQ ID NO: 835600 - DNA, 25 bp, Mus musculus
tgtttccaccaacatagcagagccc

SEQ ID NO: 835601 - DNA, 25 bp, Mus musculus
tgtttccaccaagatagcagagccc

SEQ ID NO: 835602 - DNA, 25 bp, Mus musculus
tgtttccagaacagcgcaccgtgag

SEQ ID NO: 835603 - DNA, 25 bp, Mus musculus
tgtttccagaactgcgcaccgtgag

SEQ ID NO: 835604 - DNA, 25 bp, Mus musculus
tgtttccagactctgcttgctctca

SEQ ID NO: 835605 - DNA, 25 bp, Mus musculus
tgtttccagactgtgcttgctctca

SEQ ID NO: 835606 - DNA, 25 bp, Mus musculus
tgtttccaggatcccgattatgagg

SEQ ID NO: 835607 - DNA, 25 bp, Mus musculus
tgtttccaggatgccgattatgagg

SEQ ID NO: 835608 - DNA, 25 bp, Mus musculus
tgtttccatgaaaagactgagcttt

SEQ ID NO: 835609 - DNA, 25 bp, Mus musculus
tgtttccatgaatagactgagcttt

SEQ ID NO: 835610 - DNA, 25 bp, Mus musculus
tgtttcccagaacttctgtggcctg

SEQ ID NO: 835611 - DNA, 25 bp, Mus musculus
tgtttcccagaagttctgtggcctg

SEQ ID NO: 835612 - DNA, 25 bp, Mus musculus
tgtttcccatagagatgagctcgga

SEQ ID NO: 835613 - DNA, 25 bp, Mus musculus
tgtttcccatagtgatgagctcgga

SEQ ID NO: 835614 - DNA, 25 bp, Mus musculus
tgtttcccatggacacacaacgctg

SEQ ID NO: 835615 - DNA, 25 bp, Mus musculus
tgtttcccatggtcacacaacgctg

SEQ ID NO: 835616 - DNA, 25 bp, Mus musculus
tgtttccccagcatggcggacaagg

SEQ ID NO: 835617 - DNA, 25 bp, Mus musculus
tgtttccccagcttggcggacaagg

SEQ ID NO: 835618 - DNA, 25 bp, Mus musculus
tgtttccccgccatgcaaagcttgg

SEQ ID NO: 835619 - DNA, 25 bp, Mus musculus
tgtttccccgccttgcaaagcttgg

SEQ ID NO: 835620 - DNA, 25 bp, Mus musculus
tgtttcccctcaacgggaacctctt

SEQ ID NO: 835621 - DNA, 25 bp, Mus musculus
tgtttcccctcatcgggaacctctt

SEQ ID NO: 835622 - DNA, 25 bp, Mus musculus
tgtttcccctcgagaaaccacatat

SEQ ID NO: 835623 - DNA, 25 bp, Mus musculus
tgtttcccctcgtgaaaccacatat

SEQ ID NO: 835624 - DNA, 25 bp, Mus musculus
tgtttccccttacgatttcatcact

SEQ ID NO: 835625 - DNA, 25 bp, Mus musculus
tgtttccccttaggatttcatcact

SEQ ID NO: 835626 - DNA, 25 bp, Mus musculus
tgtttcccgacactgtggtgacctt

SEQ ID NO: 835627 - DNA, 25 bp, Mus musculus
tgtttcccgacagtgtggtgacctt

SEQ ID NO: 835628 - DNA, 25 bp, Mus musculus
tgtttcccgcggatcgaaattaatg

SEQ ID NO: 835629 - DNA, 25 bp, Mus musculus
tgtttcccgcggctgcggtgcatca

SEQ ID NO: 835630 - DNA, 25 bp, Mus musculus
tgtttcccgcgggtgcggtgcatca

SEQ ID NO: 835631 - DNA, 25 bp, Mus musculus
tgtttcccgcggttcgaaattaatg

SEQ ID NO: 835632 - DNA, 25 bp, Mus musculus
tgtttcccgggaaacctgcaactca

SEQ ID NO: 835633 - DNA, 25 bp, Mus musculus
tgtttcccgggatacctgcaactca

SEQ ID NO: 835634 - DNA, 25 bp, Mus musculus
tgtttcccgttccatctgcgctgaa

SEQ ID NO: 835635 - DNA, 25 bp, Mus musculus
tgtttcccgttcgatctgcgctgaa

SEQ ID NO: 835636 - DNA, 25 bp, Mus musculus
tgtttcccttcaaaggtgtgggatg

SEQ ID NO: 835637 - DNA, 25 bp, Mus musculus
tgtttcccttcataggtgtgggatg

SEQ ID NO: 835638 - DNA, 25 bp, Mus musculus
tgtttccgatccaggtcccgtcgtc

SEQ ID NO: 835639 - DNA, 25 bp, Mus musculus
tgtttccgatcctggtcccgtcgtc

SEQ ID NO: 835640 - DNA, 25 bp, Mus musculus
tgtttcctaggccactaaacctcgg

SEQ ID NO: 835641 - DNA, 25 bp, Mus musculus
tgtttcctaggcgactaaacctcgg

SEQ ID NO: 835642 - DNA, 25 bp, Mus musculus
tgtttcctcaagacagaagcagaga

SEQ ID NO: 835643 - DNA, 25 bp, Mus musculus
tgtttcctcaagtcagaagcagaga

SEQ ID NO: 835644 - DNA, 25 bp, Mus musculus
tgtttcctcgggagtggtgcatgac

SEQ ID NO: 835645 - DNA, 25 bp, Mus musculus
tgtttcctcgggtgtggtgcatgac

SEQ ID NO: 835646 - DNA, 25 bp, Mus musculus
tgtttcctctttctccctaggactc

SEQ ID NO: 835647 - DNA, 25 bp, Mus musculus
tgtttcctctttgtccctaggactc

SEQ ID NO: 835648 - DNA, 25 bp, Mus musculus
tgtttcctgaaaacccattctctga

SEQ ID NO: 835649 - DNA, 25 bp, Mus musculus
tgtttcctgaaatcccattctctga

SEQ ID NO: 835650 - DNA, 25 bp, Mus musculus
tgtttcctgagtcagaacggccaga

SEQ ID NO: 835651 - DNA, 25 bp, Mus musculus
tgtttcctgagtgagaacggccaga

SEQ ID NO: 835652 - DNA, 25 bp, Mus musculus
tgtttcctgataagtggacagccgc

SEQ ID NO: 835653 - DNA, 25 bp, Mus musculus
tgtttcctgatatgtggacagccgc

SEQ ID NO: 835654 - DNA, 25 bp, Mus musculus
tgtttcctggtgctattctggcttt

SEQ ID NO: 835655 - DNA, 25 bp, Mus musculus
tgtttcctggtggtattctggcttt

SEQ ID NO: 835656 - DNA, 25 bp, Mus musculus
tgtttccttcagcttaaatgtcagc

SEQ ID NO: 835657 - DNA, 25 bp, Mus musculus
tgtttccttcaggttaaatgtcagc

SEQ ID NO: 835658 - DNA, 25 bp, Mus musculus
tgtttccttcgcagagggcgtccct

SEQ ID NO: 835659 - DNA, 25 bp, Mus musculus
tgtttccttcgctgagggcgtccct

SEQ ID NO: 835660 - DNA, 25 bp, Mus musculus
tgtttccttgtccatactatacagg

SEQ ID NO: 835661 - DNA, 25 bp, Mus musculus
tgtttccttgtcgatactatacagg

SEQ ID NO: 835662 - DNA, 25 bp, Mus musculus
tgtttcgaaaaaccctgccgcatct

SEQ ID NO: 835663 - DNA, 25 bp, Mus musculus
tgtttcgaaaaagcctgccgcatct

SEQ ID NO: 835664 - DNA, 25 bp, Mus musculus
tgtttcgaaataagcagaacgcaga

SEQ ID NO: 835665 - DNA, 25 bp, Mus musculus
tgtttcgaaatatgcagaacgcaga

SEQ ID NO: 835666 - DNA, 25 bp, Mus musculus
tgtttcgaacagcaatcagacaccc

SEQ ID NO: 835667 - DNA, 25 bp, Mus musculus
tgtttcgaacaggaatcagacaccc

SEQ ID NO: 835668 - DNA, 25 bp, Mus musculus
tgtttcgatggcatcatgttggctc

SEQ ID NO: 835669 - DNA, 25 bp, Mus musculus
tgtttcgatggcttcatgttggctc

SEQ ID NO: 835670 - DNA, 25 bp, Mus musculus
tgtttcgatgtcaaccgctgcggct

SEQ ID NO: 835671 - DNA, 25 bp, Mus musculus
tgtttcgatgtctaccgctgcggct

SEQ ID NO: 835672 - DNA, 25 bp, Mus musculus
tgtttcggaactcaggctcaagcac

SEQ ID NO: 835673 - DNA, 25 bp, Mus musculus
tgtttcggaactgaggctcaagcac

SEQ ID NO: 835674 - DNA, 25 bp, Mus musculus
tgtttcgggcttctctactatgtgc

SEQ ID NO: 835675 - DNA, 25 bp, Mus musculus
tgtttcgggcttgtctactatgtgc

SEQ ID NO: 835676 - DNA, 25 bp, Mus musculus
tgtttcggtcgtacatgccagagga

SEQ ID NO: 835677 - DNA, 25 bp, Mus musculus
tgtttcggtcgttcatgccagagga

SEQ ID NO: 835678 - DNA, 25 bp, Mus musculus
tgtttcgtacgtagggatcagccag

SEQ ID NO: 835679 - DNA, 25 bp, Mus musculus
tgtttcgtacgttgggatcagccag

SEQ ID NO: 835680 - DNA, 25 bp, Mus musculus
tgtttctaaatgcttacagcacaaa

SEQ ID NO: 835681 - DNA, 25 bp, Mus musculus
tgtttctaaatggttacagcacaaa

SEQ ID NO: 835682 - DNA, 25 bp, Mus musculus
tgtttctaatggaagaggttcacat

SEQ ID NO: 835683 - DNA, 25 bp, Mus musculus
tgtttctaatggtagaggttcacat

SEQ ID NO: 835684 - DNA, 25 bp, Mus musculus
tgtttctacaggctgacctctccag

SEQ ID NO: 835685 - DNA, 25 bp, Mus musculus
tgtttctacagggtgacctctccag

SEQ ID NO: 835686 - DNA, 25 bp, Mus musculus
tgtttctaccaacacttcgaggcag

SEQ ID NO: 835687 - DNA, 25 bp, Mus musculus
tgtttctaccaagacttcgaggcag

SEQ ID NO: 835688 - DNA, 25 bp, Mus musculus
tgtttctagataatgagacacagcg

SEQ ID NO: 835689 - DNA, 25 bp, Mus musculus
tgtttctagatattgagacacagcg

SEQ ID NO: 835690 - DNA, 25 bp, Mus musculus
tgtttctagatcacttggagcctgg

SEQ ID NO: 835691 - DNA, 25 bp, Mus musculus
tgtttctagatctcttggagcctgg

SEQ ID NO: 835692 - DNA, 25 bp, Mus musculus
tgtttctaggaaagacgtgctttcc

SEQ ID NO: 835693 - DNA, 25 bp, Mus musculus
tgtttctaggaatgacgtgctttcc

SEQ ID NO: 835694 - DNA, 25 bp, Mus musculus
tgtttctaggatccagtacactgct

SEQ ID NO: 835695 - DNA, 25 bp, Mus musculus
tgtttctaggatgcagtacactgct

SEQ ID NO: 835696 - DNA, 25 bp, Mus musculus
tgtttctagttaatagtggagcccc

SEQ ID NO: 835697 - DNA, 25 bp, Mus musculus
tgtttctagttattagtggagcccc

SEQ ID NO: 835698 - DNA, 25 bp, Mus musculus
tgtttctcaaaacctgagggtcagg

SEQ ID NO: 835699 - DNA, 25 bp, Mus musculus
tgtttctcaaaagctgagggtcagg

SEQ ID NO: 835700 - DNA, 25 bp, Mus musculus
tgtttctcaaccaggagggcaaccc

SEQ ID NO: 835701 - DNA, 25 bp, Mus musculus
tgtttctcaacctggagggcaaccc

SEQ ID NO: 835702 - DNA, 25 bp, Mus musculus
tgtttctcaagacctgacgggccgc

SEQ ID NO: 835703 - DNA, 25 bp, Mus musculus
tgtttctcaagagctgacgggccgc

SEQ ID NO: 835704 - DNA, 25 bp, Mus musculus
tgtttctccgataccacaaagcctg

SEQ ID NO: 835705 - DNA, 25 bp, Mus musculus
tgtttctccgattccacaaagcctg

SEQ ID NO: 835706 - DNA, 25 bp, Mus musculus
tgtttctgaaagagcatgaccacct

SEQ ID NO: 835707 - DNA, 25 bp, Mus musculus
tgtttctgaaagtgcatgaccacct

SEQ ID NO: 835708 - DNA, 25 bp, Mus musculus
tgtttctgagctccctggtaacccc

SEQ ID NO: 835709 - DNA, 25 bp, Mus musculus
tgtttctgagctgcctggtaacccc

SEQ ID NO: 835710 - DNA, 25 bp, Mus musculus
tgtttctgattacttctggaccgcc

SEQ ID NO: 835711 - DNA, 25 bp, Mus musculus
tgtttctgattagttctggaccgcc

SEQ ID NO: 835712 - DNA, 25 bp, Mus musculus
tgtttctgccacctctgtacaaagg

SEQ ID NO: 835713 - DNA, 25 bp, Mus musculus
tgtttctgccacgtctgtacaaagg

SEQ ID NO: 835714 - DNA, 25 bp, Mus musculus
tgtttctgggatctttaggtcccta

SEQ ID NO: 835715 - DNA, 25 bp, Mus musculus
tgtttctgggatgtttaggtcccta

SEQ ID NO: 835716 - DNA, 25 bp, Mus musculus
tgtttctggttcagcttcaagagaa

SEQ ID NO: 835717 - DNA, 25 bp, Mus musculus
tgtttctggttctgcttcaagagaa

SEQ ID NO: 835718 - DNA, 25 bp, Mus musculus
tgtttctgtgtcaccaggaagaacc

SEQ ID NO: 835719 - DNA, 25 bp, Mus musculus
tgtttctgtgtctccaggaagaacc

SEQ ID NO: 835720 - DNA, 25 bp, Mus musculus
tgtttcttaccgaaatggcaccctc

SEQ ID NO: 835721 - DNA, 25 bp, Mus musculus
tgtttcttaccgtaatggcaccctc

SEQ ID NO: 835722 - DNA, 25 bp, Mus musculus
tgtttcttcaccagtcgcctggcca

SEQ ID NO: 835723 - DNA, 25 bp, Mus musculus
tgtttcttcacctgtcgcctggcca

SEQ ID NO: 835724 - DNA, 25 bp, Mus musculus
tgtttcttcactctaaagcagccag

SEQ ID NO: 835725 - DNA, 25 bp, Mus musculus
tgtttcttcactgtaaagcagccag

SEQ ID NO: 835726 - DNA, 25 bp, Mus musculus
tgtttcttccctcggcctctgctgg

SEQ ID NO: 835727 - DNA, 25 bp, Mus musculus
tgtttcttccctgggcctctgctgg

SEQ ID NO: 835728 - DNA, 25 bp, Mus musculus
tgtttctttctcagatcgtgtacag

SEQ ID NO: 835729 - DNA, 25 bp, Mus musculus
tgtttctttctctgatcgtgtacag

SEQ ID NO: 835730 - DNA, 25 bp, Mus musculus
tgtttgaaagctctacaaagcctgt

SEQ ID NO: 835731 - DNA, 25 bp, Mus musculus
tgtttgaaagctgtacaaagcctgt

SEQ ID NO: 835732 - DNA, 25 bp, Mus musculus
tgtttgaaatcgagacgacatctcg

SEQ ID NO: 835733 - DNA, 25 bp, Mus musculus
tgtttgaaatcgtgacgacatctcg

SEQ ID NO: 835734 - DNA, 25 bp, Mus musculus
tgtttgaaattgaaggacaaggccc

SEQ ID NO: 835735 - DNA, 25 bp, Mus musculus
tgtttgaaattgtaggacaaggccc

SEQ ID NO: 835736 - DNA, 25 bp, Mus musculus
tgtttgaaccatcaatcttttactc

SEQ ID NO: 835737 - DNA, 25 bp, Mus musculus
tgtttgaaccatgaatcttttactc

SEQ ID NO: 835738 - DNA, 25 bp, Mus musculus
tgtttgaagtgaacgagactgagaa

SEQ ID NO: 835739 - DNA, 25 bp, Mus musculus
tgtttgaagtgatcgagactgagaa

SEQ ID NO: 835740 - DNA, 25 bp, Mus musculus
tgtttgaattcactgacacgaagga

SEQ ID NO: 835741 - DNA, 25 bp, Mus musculus
tgtttgaattcagtgacacgaagga

SEQ ID NO: 835742 - DNA, 25 bp, Mus musculus
tgtttgaccaacagctctccccagg

SEQ ID NO: 835743 - DNA, 25 bp, Mus musculus
tgtttgaccaactgctctccccagg

SEQ ID NO: 835744 - DNA, 25 bp, Mus musculus
tgtttgaccagtcaggctgagccag

SEQ ID NO: 835745 - DNA, 25 bp, Mus musculus
tgtttgaccagtgaggctgagccag

SEQ ID NO: 835746 - DNA, 25 bp, Mus musculus
tgtttgacctgcagatcctgggagt

SEQ ID NO: 835747 - DNA, 25 bp, Mus musculus
tgtttgacctgctgatcctgggagt

SEQ ID NO: 835748 - DNA, 25 bp, Mus musculus
tgtttgacctggagatcatcaatga

SEQ ID NO: 835749 - DNA, 25 bp, Mus musculus
tgtttgacctggaggcgagcaaaac

SEQ ID NO: 835750 - DNA, 25 bp, Mus musculus
tgtttgacctggtgatcatcaatga

SEQ ID NO: 835751 - DNA, 25 bp, Mus musculus
tgtttgacctggtggcgagcaaaac

SEQ ID NO: 835752 - DNA, 25 bp, Mus musculus
tgtttgaccttcaagatctgtgctg

SEQ ID NO: 835753 - DNA, 25 bp, Mus musculus
tgtttgaccttctagatctgtgctg

SEQ ID NO: 835754 - DNA, 25 bp, Mus musculus
tgtttgactactctgccctacagcg

SEQ ID NO: 835755 - DNA, 25 bp, Mus musculus
tgtttgactactgtgccctacagcg

SEQ ID NO: 835756 - DNA, 25 bp, Mus musculus
tgtttgactcacagttcagcgtcgg

SEQ ID NO: 835757 - DNA, 25 bp, Mus musculus
tgtttgactcactgttcagcgtcgg

SEQ ID NO: 835758 - DNA, 25 bp, Mus musculus
tgtttgactgcacgaaaaacgtgct

SEQ ID NO: 835759 - DNA, 25 bp, Mus musculus
tgtttgactgcaggaaaaacgtgct

SEQ ID NO: 835760 - DNA, 25 bp, Mus musculus
tgtttgagcataaagaccaggacct

SEQ ID NO: 835761 - DNA, 25 bp, Mus musculus
tgtttgagcatatagaccaggacct

SEQ ID NO: 835762 - DNA, 25 bp, Mus musculus
tgtttgagccccaaaaggagccagg

SEQ ID NO: 835763 - DNA, 25 bp, Mus musculus
tgtttgagcccctaaaggagccagg

SEQ ID NO: 835764 - DNA, 25 bp, Mus musculus
tgtttgagcgctaccagtctgtcat

SEQ ID NO: 835765 - DNA, 25 bp, Mus musculus
tgtttgagcgcttccagtctgtcat

SEQ ID NO: 835766 - DNA, 25 bp, Mus musculus
tgtttgagctgtatgacaatgcacc

SEQ ID NO: 835767 - DNA, 25 bp, Mus musculus
tgtttgagctgtttgacaatgcacc

SEQ ID NO: 835768 - DNA, 25 bp, Mus musculus
tgtttgaggatcatgtgtgaaatcc

SEQ ID NO: 835769 - DNA, 25 bp, Mus musculus
tgtttgaggatcttgtgtgaaatcc

SEQ ID NO: 835770 - DNA, 25 bp, Mus musculus
tgtttgagggtcaggtgaagaacct

SEQ ID NO: 835771 - DNA, 25 bp, Mus musculus
tgtttgagggtctggtgaagaacct

SEQ ID NO: 835772 - DNA, 25 bp, Mus musculus
tgtttgagggtgagaagttctttgc

SEQ ID NO: 835773 - DNA, 25 bp, Mus musculus
tgtttgagggtgtgaagttctttgc

SEQ ID NO: 835774 - DNA, 25 bp, Mus musculus
tgtttgagtacacggccagcatgga

SEQ ID NO: 835775 - DNA, 25 bp, Mus musculus
tgtttgagtacagggccagcatgga

SEQ ID NO: 835776 - DNA, 25 bp, Mus musculus
tgtttgagttcacattcatgcagac

SEQ ID NO: 835777 - DNA, 25 bp, Mus musculus
tgtttgagttcagattcatgcagac

SEQ ID NO: 835778 - DNA, 25 bp, Mus musculus
tgtttgatatctacacactttcctg

SEQ ID NO: 835779 - DNA, 25 bp, Mus musculus
tgtttgatatcttcacactttcctg

SEQ ID NO: 835780 - DNA, 25 bp, Mus musculus
tgtttgatcactaggagcctatgga

SEQ ID NO: 835781 - DNA, 25 bp, Mus musculus
tgtttgatcacttggagcctatgga

SEQ ID NO: 835782 - DNA, 25 bp, Mus musculus
tgtttgatctcaagaccatgcgaga

SEQ ID NO: 835783 - DNA, 25 bp, Mus musculus
tgtttgatctcatgaccatgcgaga

SEQ ID NO: 835784 - DNA, 25 bp, Mus musculus
tgtttgatgactactcagaaggcag

SEQ ID NO: 835785 - DNA, 25 bp, Mus musculus
tgtttgatgacttctcagaaggcag

SEQ ID NO: 835786 - DNA, 25 bp, Mus musculus
tgtttgatggaacgtttatcccacg

SEQ ID NO: 835787 - DNA, 25 bp, Mus musculus
tgtttgatggaaggtttatcccacg

SEQ ID NO: 835788 - DNA, 25 bp, Mus musculus
tgtttgattaccaagtggcccatgg

SEQ ID NO: 835789 - DNA, 25 bp, Mus musculus
tgtttgattacctagtggcccatgg

SEQ ID NO: 835790 - DNA, 25 bp, Mus musculus
tgtttgattcatctaagatgtcgcg

SEQ ID NO: 835791 - DNA, 25 bp, Mus musculus
tgtttgattcatgtaagatgtcgcg

SEQ ID NO: 835792 - DNA, 25 bp, Mus musculus
tgtttgcaaaacctcaaagtagggc

SEQ ID NO: 835793 - DNA, 25 bp, Mus musculus
tgtttgcaaaacgtcaaagtagggc

SEQ ID NO: 835794 - DNA, 25 bp, Mus musculus
tgtttgcaaagcacttgcgggctgt

SEQ ID NO: 835795 - DNA, 25 bp, Mus musculus
tgtttgcaaagctcttgcgggctgt

SEQ ID NO: 835796 - DNA, 25 bp, Mus musculus
tgtttgcaaagtctcgagccctcat

SEQ ID NO: 835797 - DNA, 25 bp, Mus musculus
tgtttgcaaagtgtcgagccctcat

SEQ ID NO: 835798 - DNA, 25 bp, Mus musculus
tgtttgcaaatcctcctagttccac

SEQ ID NO: 835799 - DNA, 25 bp, Mus musculus
tgtttgcaaatcgtcctagttccac

SEQ ID NO: 835800 - DNA, 25 bp, Mus musculus
tgtttgcaacaaccatcatggagaa

SEQ ID NO: 835801 - DNA, 25 bp, Mus musculus
tgtttgcaacaagcatcatggagaa

SEQ ID NO: 835802 - DNA, 25 bp, Mus musculus
tgtttgcaagtaaggatgagtgcct

SEQ ID NO: 835803 - DNA, 25 bp, Mus musculus
tgtttgcaagtatggatgagtgcct

SEQ ID NO: 835804 - DNA, 25 bp, Mus musculus
tgtttgcaatctatgacggctttga

SEQ ID NO: 835805 - DNA, 25 bp, Mus musculus
tgtttgcaatctttgacggctttga

SEQ ID NO: 835806 - DNA, 25 bp, Mus musculus
tgtttgcaattcctgccgatcatga

SEQ ID NO: 835807 - DNA, 25 bp, Mus musculus
tgtttgcaattcgtgccgatcatga

SEQ ID NO: 835808 - DNA, 25 bp, Mus musculus
tgtttgcacagaccgttcttgctcc

SEQ ID NO: 835809 - DNA, 25 bp, Mus musculus
tgtttgcacagagcgttcttgctcc

SEQ ID NO: 835810 - DNA, 25 bp, Mus musculus
tgtttgcacatcattgtacaccaat

SEQ ID NO: 835811 - DNA, 25 bp, Mus musculus
tgtttgcacatctttgtacaccaat

SEQ ID NO: 835812 - DNA, 25 bp, Mus musculus
tgtttgcacctcagtaaacaacgtg

SEQ ID NO: 835813 - DNA, 25 bp, Mus musculus
tgtttgcacctctgtaaacaacgtg

SEQ ID NO: 835814 - DNA, 25 bp, Mus musculus
tgtttgcaggtcaggccactaggag

SEQ ID NO: 835815 - DNA, 25 bp, Mus musculus
tgtttgcaggtctggccactaggag

SEQ ID NO: 835816 - DNA, 25 bp, Mus musculus
tgtttgcatttcaggctgtctccct

SEQ ID NO: 835817 - DNA, 25 bp, Mus musculus
tgtttgcatttctggctgtctccct

SEQ ID NO: 835818 - DNA, 25 bp, Mus musculus
tgtttgccaacgaagtccacgtgaa

SEQ ID NO: 835819 - DNA, 25 bp, Mus musculus
tgtttgccaacgtagtccacgtgaa

SEQ ID NO: 835820 - DNA, 25 bp, Mus musculus
tgtttgccaccacgatcgccgagaa

SEQ ID NO: 835821 - DNA, 25 bp, Mus musculus
tgtttgccaccaggatcgccgagaa

SEQ ID NO: 835822 - DNA, 25 bp, Mus musculus
tgtttgccagaaataagtagacgcc

SEQ ID NO: 835823 - DNA, 25 bp, Mus musculus
tgtttgccagaattaagtagacgcc

SEQ ID NO: 835824 - DNA, 25 bp, Mus musculus
tgtttgccagctacgtccctgaaat

SEQ ID NO: 835825 - DNA, 25 bp, Mus musculus
tgtttgccagcttcgtccctgaaat

SEQ ID NO: 835826 - DNA, 25 bp, Mus musculus
tgtttgccagtgcaggcttcaaggt

SEQ ID NO: 835827 - DNA, 25 bp, Mus musculus
tgtttgccagtggaggcttcaaggt

SEQ ID NO: 835828 - DNA, 25 bp, Mus musculus
tgtttgccatggcaacacatgcaca

SEQ ID NO: 835829 - DNA, 25 bp, Mus musculus
tgtttgccatgggaacacatgcaca

SEQ ID NO: 835830 - DNA, 25 bp, Mus musculus
tgtttgccattcatgcagagaggtc

SEQ ID NO: 835831 - DNA, 25 bp, Mus musculus
tgtttgccattcttgcagagaggtc

SEQ ID NO: 835832 - DNA, 25 bp, Mus musculus
tgtttgcccaacacttgtgagcatg

SEQ ID NO: 835833 - DNA, 25 bp, Mus musculus
tgtttgcccaactcttgtgagcatg

SEQ ID NO: 835834 - DNA, 25 bp, Mus musculus
tgtttgcccaagaaccaaagaagtc

SEQ ID NO: 835835 - DNA, 25 bp, Mus musculus
tgtttgcccaagtaccaaagaagtc

SEQ ID NO: 835836 - DNA, 25 bp, Mus musculus
tgtttgcccttcatttgggtgccgg

SEQ ID NO: 835837 - DNA, 25 bp, Mus musculus
tgtttgcccttcttttgggtgccgg

SEQ ID NO: 835838 - DNA, 25 bp, Mus musculus
tgtttgccggccacccgggatggcc

SEQ ID NO: 835839 - DNA, 25 bp, Mus musculus
tgtttgccggcctcccgggatggcc

SEQ ID NO: 835840 - DNA, 25 bp, Mus musculus
tgtttgccggctcaaaactcacaga

SEQ ID NO: 835841 - DNA, 25 bp, Mus musculus
tgtttgccggctgaaaactcacaga

SEQ ID NO: 835842 - DNA, 25 bp, Mus musculus
tgtttgcctatgctacatacccgga

SEQ ID NO: 835843 - DNA, 25 bp, Mus musculus
tgtttgcctatggtacatacccgga

SEQ ID NO: 835844 - DNA, 25 bp, Mus musculus
tgtttgcctgaactgaatttccaga

SEQ ID NO: 835845 - DNA, 25 bp, Mus musculus
tgtttgcctgaagtgaatttccaga

SEQ ID NO: 835846 - DNA, 25 bp, Mus musculus
tgtttgcctgttatgtgagcaaagt

SEQ ID NO: 835847 - DNA, 25 bp, Mus musculus
tgtttgcctgttttgtgagcaaagt

SEQ ID NO: 835848 - DNA, 25 bp, Mus musculus
tgtttgctcccacacagaggacaga

SEQ ID NO: 835849 - DNA, 25 bp, Mus musculus
tgtttgctcccagacagaggacaga

SEQ ID NO: 835850 - DNA, 25 bp, Mus musculus
tgtttgctcttaagcgcggtgcttg

SEQ ID NO: 835851 - DNA, 25 bp, Mus musculus
tgtttgctcttatgcgcggtgcttg

SEQ ID NO: 835852 - DNA, 25 bp, Mus musculus
tgtttgctcttcacaccatcgctac

SEQ ID NO: 835853 - DNA, 25 bp, Mus musculus
tgtttgctcttctcaccatcgctac

SEQ ID NO: 835854 - DNA, 25 bp, Mus musculus
tgtttgctgaacataaagaaatcca

SEQ ID NO: 835855 - DNA, 25 bp, Mus musculus
tgtttgctgaacttaaagaaatcca

SEQ ID NO: 835856 - DNA, 25 bp, Mus musculus
tgtttgctgagtaccttgccagtga

SEQ ID NO: 835857 - DNA, 25 bp, Mus musculus
tgtttgctgagttccttgccagtga

SEQ ID NO: 835858 - DNA, 25 bp, Mus musculus
tgtttgctgcatcctgcatgacacc

SEQ ID NO: 835859 - DNA, 25 bp, Mus musculus
tgtttgctgcatgctgcatgacacc

SEQ ID NO: 835860 - DNA, 25 bp, Mus musculus
tgtttgctggtcctggcttcgtccc

SEQ ID NO: 835861 - DNA, 25 bp, Mus musculus
tgtttgctggtcgtggcttcgtccc

SEQ ID NO: 835862 - DNA, 25 bp, Mus musculus
tgtttgctgtggagttcactgcccg

SEQ ID NO: 835863 - DNA, 25 bp, Mus musculus
tgtttgctgtggtgttcactgcccg

SEQ ID NO: 835864 - DNA, 25 bp, Mus musculus
tgtttgcttataagtcaaactcaaa

SEQ ID NO: 835865 - DNA, 25 bp, Mus musculus
tgtttgcttatatgtcaaactcaaa

SEQ ID NO: 835866 - DNA, 25 bp, Mus musculus
tgtttgcttcctcggcgtcctctga

SEQ ID NO: 835867 - DNA, 25 bp, Mus musculus
tgtttgcttcctgggcgtcctctga

SEQ ID NO: 835868 - DNA, 25 bp, Mus musculus
tgtttgctttacagatgggctttgc

SEQ ID NO: 835869 - DNA, 25 bp, Mus musculus
tgtttgctttactgatgggctttgc

SEQ ID NO: 835870 - DNA, 25 bp, Mus musculus
tgtttgctttgtctacgcacccgta

SEQ ID NO: 835871 - DNA, 25 bp, Mus musculus
tgtttgctttgtgtacgcacccgta

SEQ ID NO: 835872 - DNA, 25 bp, Mus musculus
tgtttggaatgaacattactatcgg

SEQ ID NO: 835873 - DNA, 25 bp, Mus musculus
tgtttggaatgatcattactatcgg

SEQ ID NO: 835874 - DNA, 25 bp, Mus musculus
tgtttggacggcacagccaccatcc

SEQ ID NO: 835875 - DNA, 25 bp, Mus musculus
tgtttggacggctcagccaccatcc

SEQ ID NO: 835876 - DNA, 25 bp, Mus musculus
tgtttggagatcctagagcagatga

SEQ ID NO: 835877 - DNA, 25 bp, Mus musculus
tgtttggagatcgtagagcagatga

SEQ ID NO: 835878 - DNA, 25 bp, Mus musculus
tgtttggatggtaggctgttccgcc

SEQ ID NO: 835879 - DNA, 25 bp, Mus musculus
tgtttggatggtccaacggatttta

SEQ ID NO: 835880 - DNA, 25 bp, Mus musculus
tgtttggatggtgcaacggatttta

SEQ ID NO: 835881 - DNA, 25 bp, Mus musculus
tgtttggatggttggctgttccgcc

SEQ ID NO: 835882 - DNA, 25 bp, Mus musculus
tgtttggcagcacaccatttgtgga

SEQ ID NO: 835883 - DNA, 25 bp, Mus musculus
tgtttggcagcagaccatttgtgga

SEQ ID NO: 835884 - DNA, 25 bp, Mus musculus
tgtttggccaaccaaggagaccttg

SEQ ID NO: 835885 - DNA, 25 bp, Mus musculus
tgtttggccaacgaaggagaccttg

SEQ ID NO: 835886 - DNA, 25 bp, Mus musculus
tgtttggcgtgacactctgggaaat

SEQ ID NO: 835887 - DNA, 25 bp, Mus musculus
tgtttggcgtgagactctgggaaat

SEQ ID NO: 835888 - DNA, 25 bp, Mus musculus
tgtttggctagcaatgagattccgg

SEQ ID NO: 835889 - DNA, 25 bp, Mus musculus
tgtttggctagctatgagattccgg

SEQ ID NO: 835890 - DNA, 25 bp, Mus musculus
tgtttggctgtgacctctttgtggc

SEQ ID NO: 835891 - DNA, 25 bp, Mus musculus
tgtttggctgtgtcctctttgtggc

SEQ ID NO: 835892 - DNA, 25 bp, Mus musculus
tgtttggcttagacttcggcaccac

SEQ ID NO: 835893 - DNA, 25 bp, Mus musculus
tgtttggcttagtcttcggcaccac

SEQ ID NO: 835894 - DNA, 25 bp, Mus musculus
tgtttgggaaaacgtgttcacactc

SEQ ID NO: 835895 - DNA, 25 bp, Mus musculus
tgtttgggaaaaggtgttcacactc

SEQ ID NO: 835896 - DNA, 25 bp, Mus musculus
tgtttgggaaatccaacaatccgaa

SEQ ID NO: 835897 - DNA, 25 bp, Mus musculus
tgtttgggaaatgcaacaatccgaa

SEQ ID NO: 835898 - DNA, 25 bp, Mus musculus
tgtttgggacgtagcattaagtgac

SEQ ID NO: 835899 - DNA, 25 bp, Mus musculus
tgtttgggacgttgcattaagtgac

SEQ ID NO: 835900 - DNA, 25 bp, Mus musculus
tgtttgggatcacgttctccttcac

SEQ ID NO: 835901 - DNA, 25 bp, Mus musculus
tgtttgggatcaggttctccttcac

SEQ ID NO: 835902 - DNA, 25 bp, Mus musculus
tgtttgggatggaagagccatcagt

SEQ ID NO: 835903 - DNA, 25 bp, Mus musculus
tgtttgggatggtagagccatcagt

SEQ ID NO: 835904 - DNA, 25 bp, Mus musculus
tgtttgggccacatcagacagggcc

SEQ ID NO: 835905 - DNA, 25 bp, Mus musculus
tgtttgggccacttcagacagggcc

SEQ ID NO: 835906 - DNA, 25 bp, Mus musculus
tgtttggtacaaacgcttacctccc

SEQ ID NO: 835907 - DNA, 25 bp, Mus musculus
tgtttggtacaatcgcttacctccc

SEQ ID NO: 835908 - DNA, 25 bp, Mus musculus
tgtttggtcagtactgcctgcgtag

SEQ ID NO: 835909 - DNA, 25 bp, Mus musculus
tgtttggtcagttctgcctgcgtag

SEQ ID NO: 835910 - DNA, 25 bp, Mus musculus
tgtttggtcatgcaaaggccaacgg

SEQ ID NO: 835911 - DNA, 25 bp, Mus musculus
tgtttggtcatggaaaggccaacgg

SEQ ID NO: 835912 - DNA, 25 bp, Mus musculus
tgtttggtcgagatccgggcccaac

SEQ ID NO: 835913 - DNA, 25 bp, Mus musculus
tgtttggtcgagttccgggcccaac

SEQ ID NO: 835914 - DNA, 25 bp, Mus musculus
tgtttggtgatgatgtgcaagagct

SEQ ID NO: 835915 - DNA, 25 bp, Mus musculus
tgtttggtgatgttgtgcaagagct

SEQ ID NO: 835916 - DNA, 25 bp, Mus musculus
tgtttggtgccaccttattcctgct

SEQ ID NO: 835917 - DNA, 25 bp, Mus musculus
tgtttggtgccagcttattcctgct

SEQ ID NO: 835918 - DNA, 25 bp, Mus musculus
tgtttggtggccacatcctagaaag

SEQ ID NO: 835919 - DNA, 25 bp, Mus musculus
tgtttggtggcctcatcctagaaag

SEQ ID NO: 835920 - DNA, 25 bp, Mus musculus
tgtttggttctcatactgttgaaag

SEQ ID NO: 835921 - DNA, 25 bp, Mus musculus
tgtttggttctcttactgttgaaag

SEQ ID NO: 835922 - DNA, 25 bp, Mus musculus
tgtttggttttgaaaccgccgccag

SEQ ID NO: 835923 - DNA, 25 bp, Mus musculus
tgtttggttttgtaaccgccgccag

SEQ ID NO: 835924 - DNA, 25 bp, Mus musculus
tgtttgtatgtaatcagccctgggt

SEQ ID NO: 835925 - DNA, 25 bp, Mus musculus
tgtttgtatgtattcagccctgggt

SEQ ID NO: 835926 - DNA, 25 bp, Mus musculus
tgtttgtcaaagctctgtctgagga

SEQ ID NO: 835927 - DNA, 25 bp, Mus musculus
tgtttgtcaaaggtctgtctgagga

SEQ ID NO: 835928 - DNA, 25 bp, Mus musculus
tgtttgtcatggcagtgaacgagaa

SEQ ID NO: 835929 - DNA, 25 bp, Mus musculus
tgtttgtcatgggagtgaacgagaa

SEQ ID NO: 835930 - DNA, 25 bp, Mus musculus
tgtttgtccagcagacccaggacgt

SEQ ID NO: 835931 - DNA, 25 bp, Mus musculus
tgtttgtccagctgacccaggacgt

SEQ ID NO: 835932 - DNA, 25 bp, Mus musculus
tgtttgtctactacaaggactgcga

SEQ ID NO: 835933 - DNA, 25 bp, Mus musculus
tgtttgtctacttcaaggactgcga

SEQ ID NO: 835934 - DNA, 25 bp, Mus musculus
tgtttgtctcaccttggaggatgta

SEQ ID NO: 835935 - DNA, 25 bp, Mus musculus
tgtttgtctcacgttggaggatgta

SEQ ID NO: 835936 - DNA, 25 bp, Mus musculus
tgtttgtgacaaacgatgcagcgac

SEQ ID NO: 835937 - DNA, 25 bp, Mus musculus
tgtttgtgacaatcgatgcagcgac

SEQ ID NO: 835938 - DNA, 25 bp, Mus musculus
tgtttgtgacggcaaacgccaagaa

SEQ ID NO: 835939 - DNA, 25 bp, Mus musculus
tgtttgtgacgggaaacgccaagaa

SEQ ID NO: 835940 - DNA, 25 bp, Mus musculus
tgtttgtgacgtacgcggccatgca

SEQ ID NO: 835941 - DNA, 25 bp, Mus musculus
tgtttgtgacgttcgcggccatgca

SEQ ID NO: 835942 - DNA, 25 bp, Mus musculus
tgtttgtgccagagtctacatctac

SEQ ID NO: 835943 - DNA, 25 bp, Mus musculus
tgtttgtgccagtgtctacatctac

SEQ ID NO: 835944 - DNA, 25 bp, Mus musculus
tgtttgtgcccaaggctgttctgcg

SEQ ID NO: 835945 - DNA, 25 bp, Mus musculus
tgtttgtgcccatggctgttctgcg

SEQ ID NO: 835946 - DNA, 25 bp, Mus musculus
tgtttgtgccggaacattcattctg

SEQ ID NO: 835947 - DNA, 25 bp, Mus musculus
tgtttgtgccggtacattcattctg

SEQ ID NO: 835948 - DNA, 25 bp, Mus musculus
tgtttgtgcggtaggtaccatgtcg

SEQ ID NO: 835949 - DNA, 25 bp, Mus musculus
tgtttgtgcggttggtaccatgtcg

SEQ ID NO: 835950 - DNA, 25 bp, Mus musculus
tgtttgtgctttcttcaaaggcacc

SEQ ID NO: 835951 - DNA, 25 bp, Mus musculus
tgtttgtgctttgttcaaaggcacc

SEQ ID NO: 835952 - DNA, 25 bp, Mus musculus
tgtttgtggacgcatcaggtcctcg

SEQ ID NO: 835953 - DNA, 25 bp, Mus musculus
tgtttgtggacggatcaggtcctcg

SEQ ID NO: 835954 - DNA, 25 bp, Mus musculus
tgtttgtggcaaaaaactgttggtg

SEQ ID NO: 835955 - DNA, 25 bp, Mus musculus
tgtttgtggcaataaactgttggtg

SEQ ID NO: 835956 - DNA, 25 bp, Mus musculus
tgtttgtgggagacaccttctgtta

SEQ ID NO: 835957 - DNA, 25 bp, Mus musculus
tgtttgtgggagtcaccttctgtta

SEQ ID NO: 835958 - DNA, 25 bp, Mus musculus
tgtttgttagccagcgaaggcccca

SEQ ID NO: 835959 - DNA, 25 bp, Mus musculus
tgtttgttagcctgcgaaggcccca

SEQ ID NO: 835960 - DNA, 25 bp, Mus musculus
tgtttgttcaagaggaccgggctca

SEQ ID NO: 835961 - DNA, 25 bp, Mus musculus
tgtttgttcaagtggaccgggctca

SEQ ID NO: 835962 - DNA, 25 bp, Mus musculus
tgtttgttccgtcactgtaggtgga

SEQ ID NO: 835963 - DNA, 25 bp, Mus musculus
tgtttgttccgtgactgtaggtgga

SEQ ID NO: 835964 - DNA, 25 bp, Mus musculus
tgtttgttggtgacctcagtccaga

SEQ ID NO: 835965 - DNA, 25 bp, Mus musculus
tgtttgttggtgtcctcagtccaga

SEQ ID NO: 835966 - DNA, 25 bp, Mus musculus
tgttttaaagtcagaagcggccacg

SEQ ID NO: 835967 - DNA, 25 bp, Mus musculus
tgttttaaagtctgaagcggccacg

SEQ ID NO: 835968 - DNA, 25 bp, Mus musculus
tgttttaacgtcacagggacagcga

SEQ ID NO: 835969 - DNA, 25 bp, Mus musculus
tgttttaacgtctcagggacagcga

SEQ ID NO: 835970 - DNA, 25 bp, Mus musculus
tgttttacggctaaggcctactgaa

SEQ ID NO: 835971 - DNA, 25 bp, Mus musculus
tgttttacggcttaggcctactgaa

SEQ ID NO: 835972 - DNA, 25 bp, Mus musculus
tgttttactaagcatcgtctttcag

SEQ ID NO: 835973 - DNA, 25 bp, Mus musculus
tgttttactaaggatcgtctttcag

SEQ ID NO: 835974 - DNA, 25 bp, Mus musculus
tgttttactgatcctctggccaaag

SEQ ID NO: 835975 - DNA, 25 bp, Mus musculus
tgttttactgatgctctggccaaag

SEQ ID NO: 835976 - DNA, 25 bp, Mus musculus
tgttttacttaaagagctctaggac

SEQ ID NO: 835977 - DNA, 25 bp, Mus musculus
tgttttacttaatgagctctaggac

SEQ ID NO: 835978 - DNA, 25 bp, Mus musculus
tgttttagtagtcccatgcacctgg

SEQ ID NO: 835979 - DNA, 25 bp, Mus musculus
tgttttagtagtgccatgcacctgg

SEQ ID NO: 835980 - DNA, 25 bp, Mus musculus
tgttttataaagcaatgggaaatcc

SEQ ID NO: 835981 - DNA, 25 bp, Mus musculus
tgttttataaaggaatgggaaatcc

SEQ ID NO: 835982 - DNA, 25 bp, Mus musculus
tgttttatatggcatgtcaggtggc

SEQ ID NO: 835983 - DNA, 25 bp, Mus musculus
tgttttatatgggatgtcaggtggc

SEQ ID NO: 835984 - DNA, 25 bp, Mus musculus
tgttttattttgacaggtggccagg

SEQ ID NO: 835985 - DNA, 25 bp, Mus musculus
tgttttattttgtcaggtggccagg

SEQ ID NO: 835986 - DNA, 25 bp, Mus musculus
tgttttcaacagagagcaggttttt

SEQ ID NO: 835987 - DNA, 25 bp, Mus musculus
tgttttcaacagtgagcaggttttt

SEQ ID NO: 835988 - DNA, 25 bp, Mus musculus
tgttttcaaccaatcccttagggat

SEQ ID NO: 835989 - DNA, 25 bp, Mus musculus
tgttttcaaccattcccttagggat

SEQ ID NO: 835990 - DNA, 25 bp, Mus musculus
tgttttcaatgaaggcactgccact

SEQ ID NO: 835991 - DNA, 25 bp, Mus musculus
tgttttcaatgatggcactgccact

SEQ ID NO: 835992 - DNA, 25 bp, Mus musculus
tgttttcacaccacagaaatcccta

SEQ ID NO: 835993 - DNA, 25 bp, Mus musculus
tgttttcacacctcagaaatcccta

SEQ ID NO: 835994 - DNA, 25 bp, Mus musculus
tgttttcacataatccttctcacga

SEQ ID NO: 835995 - DNA, 25 bp, Mus musculus
tgttttcacatattccttctcacga

SEQ ID NO: 835996 - DNA, 25 bp, Mus musculus
tgttttcagccaagaggtcgttcct

SEQ ID NO: 835997 - DNA, 25 bp, Mus musculus
tgttttcagccatgaggtcgttcct

SEQ ID NO: 835998 - DNA, 25 bp, Mus musculus
tgttttcagcccactgtcagctgag

SEQ ID NO: 835999 - DNA, 25 bp, Mus musculus
tgttttcagccctctgtcagctgag

SEQ ID NO: 836000 - DNA, 25 bp, Mus musculus
tgttttccaaagaaacgctcattgg

SEQ ID NO: 836001 - DNA, 25 bp, Mus musculus
tgttttccaaagtaacgctcattgg

SEQ ID NO: 836002 - DNA, 25 bp, Mus musculus
tgttttccaacaacattcctatcag

SEQ ID NO: 836003 - DNA, 25 bp, Mus musculus
tgttttccaacatcattcctatcag

SEQ ID NO: 836004 - DNA, 25 bp, Mus musculus
tgttttccaaccaaccaagaagcac

SEQ ID NO: 836005 - DNA, 25 bp, Mus musculus
tgttttccaacctaccaagaagcac

SEQ ID NO: 836006 - DNA, 25 bp, Mus musculus
tgttttccaatcactcgcgactgta

SEQ ID NO: 836007 - DNA, 25 bp, Mus musculus
tgttttccaatctctcgcgactgta

SEQ ID NO: 836008 - DNA, 25 bp, Mus musculus
tgttttccagatagcccagagttcc

SEQ ID NO: 836009 - DNA, 25 bp, Mus musculus
tgttttccagattgcccagagttcc

SEQ ID NO: 836010 - DNA, 25 bp, Mus musculus
tgttttccagctattggaagccccg

SEQ ID NO: 836011 - DNA, 25 bp, Mus musculus
tgttttccagcttttggaagccccg

SEQ ID NO: 836012 - DNA, 25 bp, Mus musculus
tgttttccatccagttagaatctgg

SEQ ID NO: 836013 - DNA, 25 bp, Mus musculus
tgttttccatcctgttagaatctgg

SEQ ID NO: 836014 - DNA, 25 bp, Mus musculus
tgttttccccagatgaggcacttgg

SEQ ID NO: 836015 - DNA, 25 bp, Mus musculus
tgttttccccagttgaggcacttgg

SEQ ID NO: 836016 - DNA, 25 bp, Mus musculus
tgttttccgagcaccaggacaccag

SEQ ID NO: 836017 - DNA, 25 bp, Mus musculus
tgttttccgagctccaggacaccag

SEQ ID NO: 836018 - DNA, 25 bp, Mus musculus
tgttttccggctctggagggttatc

SEQ ID NO: 836019 - DNA, 25 bp, Mus musculus
tgttttccggctgtggagggttatc

SEQ ID NO: 836020 - DNA, 25 bp, Mus musculus
tgttttccgggacggctccagattc

SEQ ID NO: 836021 - DNA, 25 bp, Mus musculus
tgttttccgggagggctccagattc

SEQ ID NO: 836022 - DNA, 25 bp, Mus musculus
tgttttcctgaacatctatgagcct

SEQ ID NO: 836023 - DNA, 25 bp, Mus musculus
tgttttcctgaagatctatgagcct

SEQ ID NO: 836024 - DNA, 25 bp, Mus musculus
tgttttcctgatccgggctcgggcc

SEQ ID NO: 836025 - DNA, 25 bp, Mus musculus
tgttttcctgatgcgggctcgggcc

SEQ ID NO: 836026 - DNA, 25 bp, Mus musculus
tgttttcctgttccttaggccaaag

SEQ ID NO: 836027 - DNA, 25 bp, Mus musculus
tgttttcctgttgcttaggccaaag

SEQ ID NO: 836028 - DNA, 25 bp, Mus musculus
tgttttccttgtccgcccttgtgat

SEQ ID NO: 836029 - DNA, 25 bp, Mus musculus
tgttttccttgtgcgcccttgtgat

SEQ ID NO: 836030 - DNA, 25 bp, Mus musculus
tgttttcggctaccagtccagcagc

SEQ ID NO: 836031 - DNA, 25 bp, Mus musculus
tgttttcggctagcagtccagcagc

SEQ ID NO: 836032 - DNA, 25 bp, Mus musculus
tgttttctaaggaatccaaaatgct

SEQ ID NO: 836033 - DNA, 25 bp, Mus musculus
tgttttctaaggtatccaaaatgct

SEQ ID NO: 836034 - DNA, 25 bp, Mus musculus
tgttttctacacctcggaagtctgg

SEQ ID NO: 836035 - DNA, 25 bp, Mus musculus
tgttttctacacgtcggaagtctgg

SEQ ID NO: 836036 - DNA, 25 bp, Mus musculus
tgttttctacctccaaggttccagg

SEQ ID NO: 836037 - DNA, 25 bp, Mus musculus
tgttttctacctgcaaggttccagg

SEQ ID NO: 836038 - DNA, 25 bp, Mus musculus
tgttttctacttatctctgtgtgta

SEQ ID NO: 836039 - DNA, 25 bp, Mus musculus
tgttttctacttttctctgtgtgta

SEQ ID NO: 836040 - DNA, 25 bp, Mus musculus
tgttttctcctcaaggtaaccatag

SEQ ID NO: 836041 - DNA, 25 bp, Mus musculus
tgttttctcctctaggtaaccatag

SEQ ID NO: 836042 - DNA, 25 bp, Mus musculus
tgttttctcgaaagctcacagtcgg

SEQ ID NO: 836043 - DNA, 25 bp, Mus musculus
tgttttctcgaatgctcacagtcgg

SEQ ID NO: 836044 - DNA, 25 bp, Mus musculus
tgttttctctctcacacctatccag

SEQ ID NO: 836045 - DNA, 25 bp, Mus musculus
tgttttctctctgacacctatccag

SEQ ID NO: 836046 - DNA, 25 bp, Mus musculus
tgttttctctgcaaggagttgctgc

SEQ ID NO: 836047 - DNA, 25 bp, Mus musculus
tgttttctctgctaggagttgctgc

SEQ ID NO: 836048 - DNA, 25 bp, Mus musculus
tgttttcttctaagaagggtcgaga

SEQ ID NO: 836049 - DNA, 25 bp, Mus musculus
tgttttcttctatgaagggtcgaga

SEQ ID NO: 836050 - DNA, 25 bp, Mus musculus
tgttttcttgaacctagctcggaac

SEQ ID NO: 836051 - DNA, 25 bp, Mus musculus
tgttttcttgaagctagctcggaac

SEQ ID NO: 836052 - DNA, 25 bp, Mus musculus
tgttttgaaaatatgatggaaggca

SEQ ID NO: 836053 - DNA, 25 bp, Mus musculus
tgttttgaaaatttgatggaaggca

SEQ ID NO: 836054 - DNA, 25 bp, Mus musculus
tgttttgactaactgttgaccctac

SEQ ID NO: 836055 - DNA, 25 bp, Mus musculus
tgttttgactaagtgttgaccctac

SEQ ID NO: 836056 - DNA, 25 bp, Mus musculus
tgttttgagacaaactgtgtgaccc

SEQ ID NO: 836057 - DNA, 25 bp, Mus musculus
tgttttgagacatactgtgtgaccc

SEQ ID NO: 836058 - DNA, 25 bp, Mus musculus
tgttttgagtgccatccagttgcga

SEQ ID NO: 836059 - DNA, 25 bp, Mus musculus
tgttttgagtgcgatccagttgcga

SEQ ID NO: 836060 - DNA, 25 bp, Mus musculus
tgttttgagttcaagcggcacgcac

SEQ ID NO: 836061 - DNA, 25 bp, Mus musculus
tgttttgagttctagcggcacgcac

SEQ ID NO: 836062 - DNA, 25 bp, Mus musculus
tgttttgcacaccaatgcagcaggg

SEQ ID NO: 836063 - DNA, 25 bp, Mus musculus
tgttttgcacacgaatgcagcaggg

SEQ ID NO: 836064 - DNA, 25 bp, Mus musculus
tgttttgcacagatgacgacctgtg

SEQ ID NO: 836065 - DNA, 25 bp, Mus musculus
tgttttgcacagttgacgacctgtg

SEQ ID NO: 836066 - DNA, 25 bp, Mus musculus
tgttttgcagcaaacaagcaatgac

SEQ ID NO: 836067 - DNA, 25 bp, Mus musculus
tgttttgcagcatacaagcaatgac

SEQ ID NO: 836068 - DNA, 25 bp, Mus musculus
tgttttgcagtcagcccgcaacagt

SEQ ID NO: 836069 - DNA, 25 bp, Mus musculus
tgttttgcagtctgcccgcaacagt

SEQ ID NO: 836070 - DNA, 25 bp, Mus musculus
tgttttgcagtgaggccaggacaca

SEQ ID NO: 836071 - DNA, 25 bp, Mus musculus
tgttttgcagtgtggccaggacaca

SEQ ID NO: 836072 - DNA, 25 bp, Mus musculus
tgttttgctacgagagtgtacgcca

SEQ ID NO: 836073 - DNA, 25 bp, Mus musculus
tgttttgctacgtgagtgtacgcca

SEQ ID NO: 836074 - DNA, 25 bp, Mus musculus
tgttttggaattaaccggctgagag

SEQ ID NO: 836075 - DNA, 25 bp, Mus musculus
tgttttggaatttaccggctgagag

SEQ ID NO: 836076 - DNA, 25 bp, Mus musculus
tgttttggaccgagtagaggcatgt

SEQ ID NO: 836077 - DNA, 25 bp, Mus musculus
tgttttggaccgtgtagaggcatgt

SEQ ID NO: 836078 - DNA, 25 bp, Mus musculus
tgttttggagtcacacaagctaaag

SEQ ID NO: 836079 - DNA, 25 bp, Mus musculus
tgttttggagtctcacaagctaaag

SEQ ID NO: 836080 - DNA, 25 bp, Mus musculus
tgttttggatccctacttactgaag

SEQ ID NO: 836081 - DNA, 25 bp, Mus musculus
tgttttggatccgtacttactgaag

SEQ ID NO: 836082 - DNA, 25 bp, Mus musculus
tgttttggcagtctgtaacatgccc

SEQ ID NO: 836083 - DNA, 25 bp, Mus musculus
tgttttggcagtgtgtaacatgccc

SEQ ID NO: 836084 - DNA, 25 bp, Mus musculus
tgttttggctggctcacagcctcgg

SEQ ID NO: 836085 - DNA, 25 bp, Mus musculus
tgttttggctgggtcacagcctcgg

SEQ ID NO: 836086 - DNA, 25 bp, Mus musculus
tgttttggctgtcctcagccaagta

SEQ ID NO: 836087 - DNA, 25 bp, Mus musculus
tgttttggctgtgctcagccaagta

SEQ ID NO: 836088 - DNA, 25 bp, Mus musculus
tgttttggtctcaatctgtcagtgt

SEQ ID NO: 836089 - DNA, 25 bp, Mus musculus
tgttttggtctctatctgtcagtgt

SEQ ID NO: 836090 - DNA, 25 bp, Mus musculus
tgttttggtgctcagcaggaacttc

SEQ ID NO: 836091 - DNA, 25 bp, Mus musculus
tgttttggtgctgagcaggaacttc

SEQ ID NO: 836092 - DNA, 25 bp, Mus musculus
tgttttgtagaacactcgtgcctgt

SEQ ID NO: 836093 - DNA, 25 bp, Mus musculus
tgttttgtagaagactcgtgcctgt

SEQ ID NO: 836094 - DNA, 25 bp, Mus musculus
tgttttgtaggtcaaaacagctacc

SEQ ID NO: 836095 - DNA, 25 bp, Mus musculus
tgttttgtaggtgaaaacagctacc

SEQ ID NO: 836096 - DNA, 25 bp, Mus musculus
tgttttgtcccaccttagtcccatt

SEQ ID NO: 836097 - DNA, 25 bp, Mus musculus
tgttttgtcccagcttagtcccatt

SEQ ID NO: 836098 - DNA, 25 bp, Mus musculus
tgttttgtcctaacgcccaaggtgt

SEQ ID NO: 836099 - DNA, 25 bp, Mus musculus
tgttttgtcctatcgcccaaggtgt

SEQ ID NO: 836100 - DNA, 25 bp, Mus musculus
tgttttgtcttaattgtcgctgtgg

SEQ ID NO: 836101 - DNA, 25 bp, Mus musculus
tgttttgtcttatttgtcgctgtgg

SEQ ID NO: 836102 - DNA, 25 bp, Mus musculus
tgtttttaataaatgaagactggca

SEQ ID NO: 836103 - DNA, 25 bp, Mus musculus
tgtttttaataattgaagactggca

SEQ ID NO: 836104 - DNA, 25 bp, Mus musculus
tgtttttaccaaccttcactaccag

SEQ ID NO: 836105 - DNA, 25 bp, Mus musculus
tgtttttaccaagcttcactaccag

SEQ ID NO: 836106 - DNA, 25 bp, Mus musculus
tgtttttagccaattggccctgctg

SEQ ID NO: 836107 - DNA, 25 bp, Mus musculus
tgtttttagccatttggccctgctg

SEQ ID NO: 836108 - DNA, 25 bp, Mus musculus
tgtttttaggtaatcaggctgccac

SEQ ID NO: 836109 - DNA, 25 bp, Mus musculus
tgtttttaggtattcaggctgccac

SEQ ID NO: 836110 - DNA, 25 bp, Mus musculus
tgtttttcacttctggcccaaatga

SEQ ID NO: 836111 - DNA, 25 bp, Mus musculus
tgtttttcacttgtggcccaaatga

SEQ ID NO: 836112 - DNA, 25 bp, Mus musculus
tgtttttcagggacgaattcatacc

SEQ ID NO: 836113 - DNA, 25 bp, Mus musculus
tgtttttcagggtcgaattcatacc

SEQ ID NO: 836114 - DNA, 25 bp, Mus musculus
tgtttttcatctctaaggttatgag

SEQ ID NO: 836115 - DNA, 25 bp, Mus musculus
tgtttttcatctgtaaggttatgag

SEQ ID NO: 836116 - DNA, 25 bp, Mus musculus
tgtttttccactcgcgacgagcggc

SEQ ID NO: 836117 - DNA, 25 bp, Mus musculus
tgtttttccactggcgacgagcggc

SEQ ID NO: 836118 - DNA, 25 bp, Mus musculus
tgtttttcccgccatcctgagtttc

SEQ ID NO: 836119 - DNA, 25 bp, Mus musculus
tgtttttcccgcgatcctgagtttc

SEQ ID NO: 836120 - DNA, 25 bp, Mus musculus
tgtttttctacgagggctccctggt

SEQ ID NO: 836121 - DNA, 25 bp, Mus musculus
tgtttttctacgtgggctccctggt

SEQ ID NO: 836122 - DNA, 25 bp, Mus musculus
tgtttttgacaaacaatcatcacaa

SEQ ID NO: 836123 - DNA, 25 bp, Mus musculus
tgtttttgacaatcaatcatcacaa

SEQ ID NO: 836124 - DNA, 25 bp, Mus musculus
tgtttttgagacagtattccccagc

SEQ ID NO: 836125 - DNA, 25 bp, Mus musculus
tgtttttgagactgtattccccagc

SEQ ID NO: 836126 - DNA, 25 bp, Mus musculus
tgtttttggcctatgagtacagcag

SEQ ID NO: 836127 - DNA, 25 bp, Mus musculus
tgtttttggcctttgagtacagcag

SEQ ID NO: 836128 - DNA, 25 bp, Mus musculus
tgtttttgggatacaacatctgatg

SEQ ID NO: 836129 - DNA, 25 bp, Mus musculus
tgtttttgggattcaacatctgatg

SEQ ID NO: 836130 - DNA, 25 bp, Mus musculus
tgtttttggtttacacttgaagcca

SEQ ID NO: 836131 - DNA, 25 bp, Mus musculus
tgtttttggttttcacttgaagcca

SEQ ID NO: 836132 - DNA, 25 bp, Mus musculus
tgtttttgtctacccttctggtcag

SEQ ID NO: 836133 - DNA, 25 bp, Mus musculus
tgtttttgtctagccttctggtcag

SEQ ID NO: 836134 - DNA, 25 bp, Mus musculus
tgttttttcagaagatgtactcgcc

SEQ ID NO: 836135 - DNA, 25 bp, Mus musculus
tgttttttcagatgatgtactcgcc

SEQ ID NO: 836136 - DNA, 25 bp, Mus musculus
tgttttttcttcacaatgttgggca

SEQ ID NO: 836137 - DNA, 25 bp, Mus musculus
tgttttttcttctcaatgttgggca

SEQ ID NO: 836138 - DNA, 25 bp, Mus musculus
tgttttttggccattatggaaggag

SEQ ID NO: 836139 - DNA, 25 bp, Mus musculus
tgttttttggcctttatggaaggag

SEQ ID NO: 836140 - DNA, 25 bp, Mus musculus
ttaaaaaatggaccgcattactgac

SEQ ID NO: 836141 - DNA, 25 bp, Mus musculus
ttaaaaaatggagcgcattactgac

SEQ ID NO: 836142 - DNA, 25 bp, Mus musculus
ttaaaaacattacgaggattcttgc

SEQ ID NO: 836143 - DNA, 25 bp, Mus musculus
ttaaaaacattaggaggattcttgc

SEQ ID NO: 836144 - DNA, 25 bp, Mus musculus
ttaaaaagcagccacttgcgccagc

SEQ ID NO: 836145 - DNA, 25 bp, Mus musculus
ttaaaaagcagcgacttgcgccagc

SEQ ID NO: 836146 - DNA, 25 bp, Mus musculus
ttaaaaagcgaaagggtcctggagc

SEQ ID NO: 836147 - DNA, 25 bp, Mus musculus
ttaaaaagcgaatgggtcctggagc

SEQ ID NO: 836148 - DNA, 25 bp, Mus musculus
ttaaaaatagacaacctggagcagg

SEQ ID NO: 836149 - DNA, 25 bp, Mus musculus
ttaaaaatagactacctggagcagg

SEQ ID NO: 836150 - DNA, 25 bp, Mus musculus
ttaaaaatcacacacttccagctgc

SEQ ID NO: 836151 - DNA, 25 bp, Mus musculus
ttaaaaatcacagacttccagctgc

SEQ ID NO: 836152 - DNA, 25 bp, Mus musculus
ttaaaaatgagcaataaggccgcca

SEQ ID NO: 836153 - DNA, 25 bp, Mus musculus
ttaaaaatgagctataaggccgcca

SEQ ID NO: 836154 - DNA, 25 bp, Mus musculus
ttaaaacatggcacctgtattcctg

SEQ ID NO: 836155 - DNA, 25 bp, Mus musculus
ttaaaacatggctcctgtattcctg

SEQ ID NO: 836156 - DNA, 25 bp, Mus musculus
ttaaaaccaaaacgaatgatccatc

SEQ ID NO: 836157 - DNA, 25 bp, Mus musculus
ttaaaaccaaaaggaatgatccatc

SEQ ID NO: 836158 - DNA, 25 bp, Mus musculus
ttaaaaccacttctctgagtatggg

SEQ ID NO: 836159 - DNA, 25 bp, Mus musculus
ttaaaaccacttgtctgagtatggg

SEQ ID NO: 836160 - DNA, 25 bp, Mus musculus
ttaaaacccacactatcgtcaggag

SEQ ID NO: 836161 - DNA, 25 bp, Mus musculus
ttaaaacccacagtatcgtcaggag

SEQ ID NO: 836162 - DNA, 25 bp, Mus musculus
ttaaaacggatgcagcaggcctcag

SEQ ID NO: 836163 - DNA, 25 bp, Mus musculus
ttaaaacggatggagcaggcctcag

SEQ ID NO: 836164 - DNA, 25 bp, Mus musculus
ttaaaactatcacgttagtgctggc

SEQ ID NO: 836165 - DNA, 25 bp, Mus musculus
ttaaaactatcaggttagtgctggc

SEQ ID NO: 836166 - DNA, 25 bp, Mus musculus
ttaaaactgtcccaaataatgtgac

SEQ ID NO: 836167 - DNA, 25 bp, Mus musculus
ttaaaactgtccgaaataatgtgac

SEQ ID NO: 836168 - DNA, 25 bp, Mus musculus
ttaaaagaggtcagaatatcgtgct

SEQ ID NO: 836169 - DNA, 25 bp, Mus musculus
ttaaaagaggtctgaatatcgtgct

SEQ ID NO: 836170 - DNA, 25 bp, Mus musculus
ttaaaagcacgtcccatgtttggcc

SEQ ID NO: 836171 - DNA, 25 bp, Mus musculus
ttaaaagcacgtgccatgtttggcc

SEQ ID NO: 836172 - DNA, 25 bp, Mus musculus
ttaaaagccacgatgggcctcgctg

SEQ ID NO: 836173 - DNA, 25 bp, Mus musculus
ttaaaagccacgttgggcctcgctg

SEQ ID NO: 836174 - DNA, 25 bp, Mus musculus
ttaaaagcctcaagctgatgagcag

SEQ ID NO: 836175 - DNA, 25 bp, Mus musculus
ttaaaagcctcatgctgatgagcag

SEQ ID NO: 836176 - DNA, 25 bp, Mus musculus
ttaaaaggagcactgggaccgaaag

SEQ ID NO: 836177 - DNA, 25 bp, Mus musculus
ttaaaaggagcagtgggaccgaaag

SEQ ID NO: 836178 - DNA, 25 bp, Mus musculus
ttaaaaggagttacgcctacgaatg

SEQ ID NO: 836179 - DNA, 25 bp, Mus musculus
ttaaaaggagtttcgcctacgaatg

SEQ ID NO: 836180 - DNA, 25 bp, Mus musculus
ttaaaagggcccattgattccacag

SEQ ID NO: 836181 - DNA, 25 bp, Mus musculus
ttaaaagggccctttgattccacag

SEQ ID NO: 836182 - DNA, 25 bp, Mus musculus
ttaaaagtaacaatacaaccaggca

SEQ ID NO: 836183 - DNA, 25 bp, Mus musculus
ttaaaagtaacattacaaccaggca

SEQ ID NO: 836184 - DNA, 25 bp, Mus musculus
ttaaaagtcatacgccgaggagcat

SEQ ID NO: 836185 - DNA, 25 bp, Mus musculus
ttaaaagtcataggccgaggagcat

SEQ ID NO: 836186 - DNA, 25 bp, Mus musculus
ttaaaataagctcttcctcactctg

SEQ ID NO: 836187 - DNA, 25 bp, Mus musculus
ttaaaataagctgttcctcactctg

SEQ ID NO: 836188 - DNA, 25 bp, Mus musculus
ttaaaatccccgaagatgatgggaa

SEQ ID NO: 836189 - DNA, 25 bp, Mus musculus
ttaaaatccccgtagatgatgggaa

SEQ ID NO: 836190 - DNA, 25 bp, Mus musculus
ttaaaatctccaccccggattacaa

SEQ ID NO: 836191 - DNA, 25 bp, Mus musculus
ttaaaatctccagcccggattacaa

SEQ ID NO: 836192 - DNA, 25 bp, Mus musculus
ttaaaatctggccataattgaggct

SEQ ID NO: 836193 - DNA, 25 bp, Mus musculus
ttaaaatctggcgataattgaggct

SEQ ID NO: 836194 - DNA, 25 bp, Mus musculus
ttaaaatgcagtcggagggtgtctt

SEQ ID NO: 836195 - DNA, 25 bp, Mus musculus
ttaaaatgcagtgggagggtgtctt

SEQ ID NO: 836196 - DNA, 25 bp, Mus musculus
ttaaaatggaaacgaacagtagctc

SEQ ID NO: 836197 - DNA, 25 bp, Mus musculus
ttaaaatggaaaggaacagtagctc

SEQ ID NO: 836198 - DNA, 25 bp, Mus musculus
ttaaaattctacatcgccagtgctg

SEQ ID NO: 836199 - DNA, 25 bp, Mus musculus
ttaaaattctacttcgccagtgctg

SEQ ID NO: 836200 - DNA, 25 bp, Mus musculus
ttaaaattttgcctgactctctgcg

SEQ ID NO: 836201 - DNA, 25 bp, Mus musculus
ttaaaattttgcgtgactctctgcg

SEQ ID NO: 836202 - DNA, 25 bp, Mus musculus
ttaaacaaccaaagtatctcaacct

SEQ ID NO: 836203 - DNA, 25 bp, Mus musculus
ttaaacaaccaatgtatctcaacct

SEQ ID NO: 836204 - DNA, 25 bp, Mus musculus
ttaaacaagttgagtacctccttat

SEQ ID NO: 836205 - DNA, 25 bp, Mus musculus
ttaaacaagttgtgtacctccttat

SEQ ID NO: 836206 - DNA, 25 bp, Mus musculus
ttaaacacatcacaagagtgtgtgc

SEQ ID NO: 836207 - DNA, 25 bp, Mus musculus
ttaaacacatcagaagagtgtgtgc

SEQ ID NO: 836208 - DNA, 25 bp, Mus musculus
ttaaacacggaaacggtcccacagc

SEQ ID NO: 836209 - DNA, 25 bp, Mus musculus
ttaaacacggaatcggtcccacagc

SEQ ID NO: 836210 - DNA, 25 bp, Mus musculus
ttaaacactctgatctgaatctaga

SEQ ID NO: 836211 - DNA, 25 bp, Mus musculus
ttaaacactctgttctgaatctaga

SEQ ID NO: 836212 - DNA, 25 bp, Mus musculus
ttaaacagcacacgatgctctccca

SEQ ID NO: 836213 - DNA, 25 bp, Mus musculus
ttaaacagcacaggatgctctccca

SEQ ID NO: 836214 - DNA, 25 bp, Mus musculus
ttaaacaggaccacagcatgcccat

SEQ ID NO: 836215 - DNA, 25 bp, Mus musculus
ttaaacaggacctcagcatgcccat

SEQ ID NO: 836216 - DNA, 25 bp, Mus musculus
ttaaaccctggcacatctccttcat

SEQ ID NO: 836217 - DNA, 25 bp, Mus musculus
ttaaaccctggctcatctccttcat

SEQ ID NO: 836218 - DNA, 25 bp, Mus musculus
ttaaaccgagggaggcgacttggca

SEQ ID NO: 836219 - DNA, 25 bp, Mus musculus
ttaaaccgagggtggcgacttggca

SEQ ID NO: 836220 - DNA, 25 bp, Mus musculus
ttaaaccttgaaaatgccaccttgg

SEQ ID NO: 836221 - DNA, 25 bp, Mus musculus
ttaaaccttgaatatgccaccttgg

SEQ ID NO: 836222 - DNA, 25 bp, Mus musculus
ttaaactctgtgaaagctatcaggt

SEQ ID NO: 836223 - DNA, 25 bp, Mus musculus
ttaaactctgtgtaagctatcaggt

SEQ ID NO: 836224 - DNA, 25 bp, Mus musculus
ttaaactgcagacctcaggaaatgt

SEQ ID NO: 836225 - DNA, 25 bp, Mus musculus
ttaaactgcagagctcaggaaatgt

SEQ ID NO: 836226 - DNA, 25 bp, Mus musculus
ttaaactgcctgaatcacaatcgcg

SEQ ID NO: 836227 - DNA, 25 bp, Mus musculus
ttaaactgcctgtatcacaatcgcg

SEQ ID NO: 836228 - DNA, 25 bp, Mus musculus
ttaaacttgatgagctcaatgggag

SEQ ID NO: 836229 - DNA, 25 bp, Mus musculus
ttaaacttgatgtgctcaatgggag

SEQ ID NO: 836230 - DNA, 25 bp, Mus musculus
ttaaacttgggacagctgttgggta

SEQ ID NO: 836231 - DNA, 25 bp, Mus musculus
ttaaacttgggacaggaacactcag

SEQ ID NO: 836232 - DNA, 25 bp, Mus musculus
ttaaacttgggagagctgttgggta

SEQ ID NO: 836233 - DNA, 25 bp, Mus musculus
ttaaacttgggagaggaacactcag

SEQ ID NO: 836234 - DNA, 25 bp, Mus musculus
ttaaactttcccagctctggcccga

SEQ ID NO: 836235 - DNA, 25 bp, Mus musculus
ttaaactttccctgctctggcccga

SEQ ID NO: 836236 - DNA, 25 bp, Mus musculus
ttaaagaaacttcgcagctccttgg

SEQ ID NO: 836237 - DNA, 25 bp, Mus musculus
ttaaagaaacttggcagctccttgg

SEQ ID NO: 836238 - DNA, 25 bp, Mus musculus
ttaaagacagcacgctaaaaaggaa

SEQ ID NO: 836239 - DNA, 25 bp, Mus musculus
ttaaagacagcaggctaaaaaggaa

SEQ ID NO: 836240 - DNA, 25 bp, Mus musculus
ttaaagagatgaacagcggcatggc

SEQ ID NO: 836241 - DNA, 25 bp, Mus musculus
ttaaagagatgatcagcggcatggc

SEQ ID NO: 836242 - DNA, 25 bp, Mus musculus
ttaaagagcgcaacgacaacaagcg

SEQ ID NO: 836243 - DNA, 25 bp, Mus musculus
ttaaagagcgcatcgacaacaagcg

SEQ ID NO: 836244 - DNA, 25 bp, Mus musculus
ttaaagagcgttcctttcctgccgc

SEQ ID NO: 836245 - DNA, 25 bp, Mus musculus
ttaaagagcgttgctttcctgccgc

SEQ ID NO: 836246 - DNA, 25 bp, Mus musculus
ttaaagataaaacggaagcaagtgc

SEQ ID NO: 836247 - DNA, 25 bp, Mus musculus
ttaaagataaaagggaagcaagtgc

SEQ ID NO: 836248 - DNA, 25 bp, Mus musculus
ttaaagatcctgagtaccgggcgag

SEQ ID NO: 836249 - DNA, 25 bp, Mus musculus
ttaaagatcctgtgtaccgggcgag

SEQ ID NO: 836250 - DNA, 25 bp, Mus musculus
ttaaagatcgagctccagaagccac

SEQ ID NO: 836251 - DNA, 25 bp, Mus musculus
ttaaagatcgaggtccagaagccac

SEQ ID NO: 836252 - DNA, 25 bp, Mus musculus
ttaaagcagattcctattaaatgga

SEQ ID NO: 836253 - DNA, 25 bp, Mus musculus
ttaaagcagattgctattaaatgga

SEQ ID NO: 836254 - DNA, 25 bp, Mus musculus
ttaaagcagccactgtaatcatggg

SEQ ID NO: 836255 - DNA, 25 bp, Mus musculus
ttaaagcagccagtgtaatcatggg

SEQ ID NO: 836256 - DNA, 25 bp, Mus musculus
ttaaagcagtctctggcgccatcgt

SEQ ID NO: 836257 - DNA, 25 bp, Mus musculus
ttaaagcagtctgtggcgccatcgt

SEQ ID NO: 836258 - DNA, 25 bp, Mus musculus
ttaaagccacgacgcagtgaggagc

SEQ ID NO: 836259 - DNA, 25 bp, Mus musculus
ttaaagccacgaggcagtgaggagc

SEQ ID NO: 836260 - DNA, 25 bp, Mus musculus
ttaaagcttggccagcataccctgt

SEQ ID NO: 836261 - DNA, 25 bp, Mus musculus
ttaaagcttggcgagcataccctgt

SEQ ID NO: 836262 - DNA, 25 bp, Mus musculus
ttaaaggaaggacgttacaggctgc

SEQ ID NO: 836263 - DNA, 25 bp, Mus musculus
ttaaaggaaggaggttacaggctgc

SEQ ID NO: 836264 - DNA, 25 bp, Mus musculus
ttaaaggaatccaaacgcgcagtga

SEQ ID NO: 836265 - DNA, 25 bp, Mus musculus
ttaaaggaatcctaacgcgcagtga

SEQ ID NO: 836266 - DNA, 25 bp, Mus musculus
ttaaaggattcaacacaatggctgg

SEQ ID NO: 836267 - DNA, 25 bp, Mus musculus
ttaaaggattcatcacaatggctgg

SEQ ID NO: 836268 - DNA, 25 bp, Mus musculus
ttaaaggcagatctcgtgccaaaga

SEQ ID NO: 836269 - DNA, 25 bp, Mus musculus
ttaaaggcagatgtcgtgccaaaga

SEQ ID NO: 836270 - DNA, 25 bp, Mus musculus
ttaaaggcgccgactaacggaacag

SEQ ID NO: 836271 - DNA, 25 bp, Mus musculus
ttaaaggcgccgtctaacggaacag

SEQ ID NO: 836272 - DNA, 25 bp, Mus musculus
ttaaaggtcacaaagctgccatcac

SEQ ID NO: 836273 - DNA, 25 bp, Mus musculus
ttaaaggtcacatagctgccatcac

SEQ ID NO: 836274 - DNA, 25 bp, Mus musculus
ttaaaggtccagatggcttggcctg

SEQ ID NO: 836275 - DNA, 25 bp, Mus musculus
ttaaaggtccagttggcttggcctg

SEQ ID NO: 836276 - DNA, 25 bp, Mus musculus
ttaaagtcacctatcataacaaagg

SEQ ID NO: 836277 - DNA, 25 bp, Mus musculus
ttaaagtcacctttcataacaaagg

SEQ ID NO: 836278 - DNA, 25 bp, Mus musculus
ttaaagtcagaaccggccacgctgc

SEQ ID NO: 836279 - DNA, 25 bp, Mus musculus
ttaaagtcagaagcggccacgctgc

SEQ ID NO: 836280 - DNA, 25 bp, Mus musculus
ttaaagtggatccaagagtacctgg

SEQ ID NO: 836281 - DNA, 25 bp, Mus musculus
ttaaagtggatcgaagagtacctgg

SEQ ID NO: 836282 - DNA, 25 bp, Mus musculus
ttaaagtggtgaacatgaagcctgt

SEQ ID NO: 836283 - DNA, 25 bp, Mus musculus
ttaaagtggtgatcatgaagcctgt

SEQ ID NO: 836284 - DNA, 25 bp, Mus musculus
ttaaagttacgacagcagctgctgc

SEQ ID NO: 836285 - DNA, 25 bp, Mus musculus
ttaaagttacgagagcagctgctgc

SEQ ID NO: 836286 - DNA, 25 bp, Mus musculus
ttaaagttcagcccgtggagcggca

SEQ ID NO: 836287 - DNA, 25 bp, Mus musculus
ttaaagttcagcgcgtggagcggca

SEQ ID NO: 836288 - DNA, 25 bp, Mus musculus
ttaaagttgaaaccaagccatgtgg

SEQ ID NO: 836289 - DNA, 25 bp, Mus musculus
ttaaagttgaaagcaagccatgtgg

SEQ ID NO: 836290 - DNA, 25 bp, Mus musculus
ttaaagtttgatcgactctcagtgt

SEQ ID NO: 836291 - DNA, 25 bp, Mus musculus
ttaaagtttgatggactctcagtgt

SEQ ID NO: 836292 - DNA, 25 bp, Mus musculus
ttaaatacccgtctgcagaagccag

SEQ ID NO: 836293 - DNA, 25 bp, Mus musculus
ttaaatacccgtgtgcagaagccag

SEQ ID NO: 836294 - DNA, 25 bp, Mus musculus
ttaaataccgtaagcttcaagcttt

SEQ ID NO: 836295 - DNA, 25 bp, Mus musculus
ttaaataccgtatgcttcaagcttt

SEQ ID NO: 836296 - DNA, 25 bp, Mus musculus
ttaaatacgaaacccaacaaagacg

SEQ ID NO: 836297 - DNA, 25 bp, Mus musculus
ttaaatacgaaagccaacaaagacg

SEQ ID NO: 836298 - DNA, 25 bp, Mus musculus
ttaaatagagcgctcaacgtgcccc

SEQ ID NO: 836299 - DNA, 25 bp, Mus musculus
ttaaatagagcggtcaacgtgcccc

SEQ ID NO: 836300 - DNA, 25 bp, Mus musculus
ttaaatagcagtaggcctccctctc

SEQ ID NO: 836301 - DNA, 25 bp, Mus musculus
ttaaatagcagttggcctccctctc

SEQ ID NO: 836302 - DNA, 25 bp, Mus musculus
ttaaatattagaacactgacagatg

SEQ ID NO: 836303 - DNA, 25 bp, Mus musculus
ttaaatattagatcactgacagatg

SEQ ID NO: 836304 - DNA, 25 bp, Mus musculus
ttaaatgaagataaaaaggcaccat

SEQ ID NO: 836305 - DNA, 25 bp, Mus musculus
ttaaatgaagattaaaaggcaccat

SEQ ID NO: 836306 - DNA, 25 bp, Mus musculus
ttaaatgggcagctcagctcaccgc

SEQ ID NO: 836307 - DNA, 25 bp, Mus musculus
ttaaatgggcaggtcagctcaccgc

SEQ ID NO: 836308 - DNA, 25 bp, Mus musculus
ttaaatgtgtgaaagatcaaaatgg

SEQ ID NO: 836309 - DNA, 25 bp, Mus musculus
ttaaatgtgtgatagatcaaaatgg

SEQ ID NO: 836310 - DNA, 25 bp, Mus musculus
ttaaattactaacagacgagaagtc

SEQ ID NO: 836311 - DNA, 25 bp, Mus musculus
ttaaattactaagagacgagaagtc

SEQ ID NO: 836312 - DNA, 25 bp, Mus musculus
ttaaattcgggacttatcctctcca

SEQ ID NO: 836313 - DNA, 25 bp, Mus musculus
ttaaattcgggagttatcctctcca

SEQ ID NO: 836314 - DNA, 25 bp, Mus musculus
ttaaattctatgctgaagatccatg

SEQ ID NO: 836315 - DNA, 25 bp, Mus musculus
ttaaattctatggtgaagatccatg

SEQ ID NO: 836316 - DNA, 25 bp, Mus musculus
ttaacaaatcggaaaaatatatctc

SEQ ID NO: 836317 - DNA, 25 bp, Mus musculus
ttaacaaatcggtaaaatatatctc

SEQ ID NO: 836318 - DNA, 25 bp, Mus musculus
ttaacaacgacgcactggaggaggc

SEQ ID NO: 836319 - DNA, 25 bp, Mus musculus
ttaacaacgacggactggaggaggc

SEQ ID NO: 836320 - DNA, 25 bp, Mus musculus
ttaacaacggatatgtgcgggatga

SEQ ID NO: 836321 - DNA, 25 bp, Mus musculus
ttaacaacggatttgtgcgggatga

SEQ ID NO: 836322 - DNA, 25 bp, Mus musculus
ttaacaagctgtaggaggcactggg

SEQ ID NO: 836323 - DNA, 25 bp, Mus musculus
ttaacaagctgttggaggcactggg

SEQ ID NO: 836324 - DNA, 25 bp, Mus musculus
ttaacaaggctgctggatttcgtgg

SEQ ID NO: 836325 - DNA, 25 bp, Mus musculus
ttaacaaggctggtggatttcgtgg

SEQ ID NO: 836326 - DNA, 25 bp, Mus musculus
ttaacaagtctcatcgccgaatcag

SEQ ID NO: 836327 - DNA, 25 bp, Mus musculus
ttaacaagtctcttcgccgaatcag

SEQ ID NO: 836328 - DNA, 25 bp, Mus musculus
ttaacaagtgacctgggccgtgctg

SEQ ID NO: 836329 - DNA, 25 bp, Mus musculus
ttaacaagtgacgtgggccgtgctg

SEQ ID NO: 836330 - DNA, 25 bp, Mus musculus
ttaacaatgagtcgcacgacgccgt

SEQ ID NO: 836331 - DNA, 25 bp, Mus musculus
ttaacaatgagtggcacgacgccgt

SEQ ID NO: 836332 - DNA, 25 bp, Mus musculus
ttaacaccatgccttaaaatcatag

SEQ ID NO: 836333 - DNA, 25 bp, Mus musculus
ttaacaccatgcgttaaaatcatag

SEQ ID NO: 836334 - DNA, 25 bp, Mus musculus
ttaacaccttcaagcccattgtctc

SEQ ID NO: 836335 - DNA, 25 bp, Mus musculus
ttaacaccttcatgcccattgtctc

SEQ ID NO: 836336 - DNA, 25 bp, Mus musculus
ttaacacgaaccagtgggcagcctc

SEQ ID NO: 836337 - DNA, 25 bp, Mus musculus
ttaacacgaacctgtgggcagcctc

SEQ ID NO: 836338 - DNA, 25 bp, Mus musculus
ttaacactcccactaacaaaagttg

SEQ ID NO: 836339 - DNA, 25 bp, Mus musculus
ttaacactcccagtaacaaaagttg

SEQ ID NO: 836340 - DNA, 25 bp, Mus musculus
ttaacactgagcctttgagacccat

SEQ ID NO: 836341 - DNA, 25 bp, Mus musculus
ttaacactgagcgtttgagacccat

SEQ ID NO: 836342 - DNA, 25 bp, Mus musculus
ttaacactgtgcactacgactcgga

SEQ ID NO: 836343 - DNA, 25 bp, Mus musculus
ttaacactgtgctctacgactcgga

SEQ ID NO: 836344 - DNA, 25 bp, Mus musculus
ttaacagcagcaaagtcatgccccg

SEQ ID NO: 836345 - DNA, 25 bp, Mus musculus
ttaacagcagcatagtcatgccccg

SEQ ID NO: 836346 - DNA, 25 bp, Mus musculus
ttaacaggacctcatggatcccctg

SEQ ID NO: 836347 - DNA, 25 bp, Mus musculus
ttaacaggacctgatggatcccctg

SEQ ID NO: 836348 - DNA, 25 bp, Mus musculus
ttaacaggcggacccatgactagac

SEQ ID NO: 836349 - DNA, 25 bp, Mus musculus
ttaacaggcggagccatgactagac

SEQ ID NO: 836350 - DNA, 25 bp, Mus musculus
ttaacagtcgttctggccgctttgc

SEQ ID NO: 836351 - DNA, 25 bp, Mus musculus
ttaacagtcgttgtggccgctttgc

SEQ ID NO: 836352 - DNA, 25 bp, Mus musculus
ttaacagtgagtaaccacgtgtacc

SEQ ID NO: 836353 - DNA, 25 bp, Mus musculus
ttaacagtgagttaccacgtgtacc

SEQ ID NO: 836354 - DNA, 25 bp, Mus musculus
ttaacagtgggaagtatcgggtcct

SEQ ID NO: 836355 - DNA, 25 bp, Mus musculus
ttaacagtgggatgtatcgggtcct

SEQ ID NO: 836356 - DNA, 25 bp, Mus musculus
ttaacatagtcgaggtgtctgtggc

SEQ ID NO: 836357 - DNA, 25 bp, Mus musculus
ttaacatagtcgtggtgtctgtggc

SEQ ID NO: 836358 - DNA, 25 bp, Mus musculus
ttaacatgaggaagaaaagtgttgg

SEQ ID NO: 836359 - DNA, 25 bp, Mus musculus
ttaacatgaggatgaaaagtgttgg

SEQ ID NO: 836360 - DNA, 25 bp, Mus musculus
ttaacattctgtcggatccacatgg

SEQ ID NO: 836361 - DNA, 25 bp, Mus musculus
ttaacattctgtgggatccacatgg

SEQ ID NO: 836362 - DNA, 25 bp, Mus musculus
ttaaccactttgcaggcggagacct

SEQ ID NO: 836363 - DNA, 25 bp, Mus musculus
ttaaccactttggaggcggagacct

SEQ ID NO: 836364 - DNA, 25 bp, Mus musculus
ttaaccatcattccagctatcctgc

SEQ ID NO: 836365 - DNA, 25 bp, Mus musculus
ttaaccatcattgcagctatcctgc

SEQ ID NO: 836366 - DNA, 25 bp, Mus musculus
ttaaccatgactcccctgcgggtgt

SEQ ID NO: 836367 - DNA, 25 bp, Mus musculus
ttaaccatgactgccctgcgggtgt

SEQ ID NO: 836368 - DNA, 25 bp, Mus musculus
ttaaccatggaacgaccagggctcg

SEQ ID NO: 836369 - DNA, 25 bp, Mus musculus
ttaaccatggaaggaccagggctcg

SEQ ID NO: 836370 - DNA, 25 bp, Mus musculus
ttaacccagctgcactattgtgaga

SEQ ID NO: 836371 - DNA, 25 bp, Mus musculus
ttaacccagctggactattgtgaga

SEQ ID NO: 836372 - DNA, 25 bp, Mus musculus
ttaacccagttaccaaaactcagat

SEQ ID NO: 836373 - DNA, 25 bp, Mus musculus
ttaacccagttagcaaaactcagat

SEQ ID NO: 836374 - DNA, 25 bp, Mus musculus
ttaacccctgggattagagattggg

SEQ ID NO: 836375 - DNA, 25 bp, Mus musculus
ttaacccctgggtttagagattggg

SEQ ID NO: 836376 - DNA, 25 bp, Mus musculus
ttaaccctccttaacctatcagcaa

SEQ ID NO: 836377 - DNA, 25 bp, Mus musculus
ttaaccctcctttacctatcagcaa

SEQ ID NO: 836378 - DNA, 25 bp, Mus musculus
ttaaccctgaatcctccagaaggaa

SEQ ID NO: 836379 - DNA, 25 bp, Mus musculus
ttaaccctgaatgctccagaaggaa

SEQ ID NO: 836380 - DNA, 25 bp, Mus musculus
ttaaccctgatgcagcatctcatgg

SEQ ID NO: 836381 - DNA, 25 bp, Mus musculus
ttaaccctgatggagcatctcatgg

SEQ ID NO: 836382 - DNA, 25 bp, Mus musculus
ttaaccctgcagaataagaagtgcc

SEQ ID NO: 836383 - DNA, 25 bp, Mus musculus
ttaaccctgcagtataagaagtgcc

SEQ ID NO: 836384 - DNA, 25 bp, Mus musculus
ttaaccctttaccttgtgatcgctg

SEQ ID NO: 836385 - DNA, 25 bp, Mus musculus
ttaaccctttacgttgtgatcgctg

SEQ ID NO: 836386 - DNA, 25 bp, Mus musculus
ttaaccgacaagctcactgacttgc

SEQ ID NO: 836387 - DNA, 25 bp, Mus musculus
ttaaccgacaaggtcactgacttgc

SEQ ID NO: 836388 - DNA, 25 bp, Mus musculus
ttaaccgcgacaacgaagactcagg

SEQ ID NO: 836389 - DNA, 25 bp, Mus musculus
ttaaccgcgacatcgaagactcagg

SEQ ID NO: 836390 - DNA, 25 bp, Mus musculus
ttaaccgcgcttcaggttcctcata

SEQ ID NO: 836391 - DNA, 25 bp, Mus musculus
ttaaccgcgcttgaggttcctcata

SEQ ID NO: 836392 - DNA, 25 bp, Mus musculus
ttaaccggcgctacgacacagagtt

SEQ ID NO: 836393 - DNA, 25 bp, Mus musculus
ttaaccggcgcttcgacacagagtt

SEQ ID NO: 836394 - DNA, 25 bp, Mus musculus
ttaacctctgttcccagggtctgga

SEQ ID NO: 836395 - DNA, 25 bp, Mus musculus
ttaacctctgttgccagggtctgga

SEQ ID NO: 836396 - DNA, 25 bp, Mus musculus
ttaacctgaattagctttctgcttc

SEQ ID NO: 836397 - DNA, 25 bp, Mus musculus
ttaacctgaatttgctttctgcttc

SEQ ID NO: 836398 - DNA, 25 bp, Mus musculus
ttaaccttttatccccagtgctggg

SEQ ID NO: 836399 - DNA, 25 bp, Mus musculus
ttaaccttttatgcccagtgctggg

SEQ ID NO: 836400 - DNA, 25 bp, Mus musculus
ttaacgacccagacaatggaaactg

SEQ ID NO: 836401 - DNA, 25 bp, Mus musculus
ttaacgacccagtcaatggaaactg

SEQ ID NO: 836402 - DNA, 25 bp, Mus musculus
ttaacggtggttactgagggcatcc

SEQ ID NO: 836403 - DNA, 25 bp, Mus musculus
ttaacggtggtttctgagggcatcc

SEQ ID NO: 836404 - DNA, 25 bp, Mus musculus
ttaacgtgtgaacccatcgggaagc

SEQ ID NO: 836405 - DNA, 25 bp, Mus musculus
ttaacgtgtgaagccatcgggaagc

SEQ ID NO: 836406 - DNA, 25 bp, Mus musculus
ttaactaatgagagacgaaccagcg

SEQ ID NO: 836407 - DNA, 25 bp, Mus musculus
ttaactaatgagtgacgaaccagcg

SEQ ID NO: 836408 - DNA, 25 bp, Mus musculus
ttaactacacagatcctgagactgg

SEQ ID NO: 836409 - DNA, 25 bp, Mus musculus
ttaactacacagttcctgagactgg

SEQ ID NO: 836410 - DNA, 25 bp, Mus musculus
ttaactactaccatctcaacagcct

SEQ ID NO: 836411 - DNA, 25 bp, Mus musculus
ttaactactaccttctcaacagcct

SEQ ID NO: 836412 - DNA, 25 bp, Mus musculus
ttaactcattccagcaaactacaaa

SEQ ID NO: 836413 - DNA, 25 bp, Mus musculus
ttaactcattcctgcaaactacaaa

SEQ ID NO: 836414 - DNA, 25 bp, Mus musculus
ttaactccctcaatggaacatacca

SEQ ID NO: 836415 - DNA, 25 bp, Mus musculus
ttaactccctcattggaacatacca

SEQ ID NO: 836416 - DNA, 25 bp, Mus musculus
ttaactctgcggagttccaagaccg

SEQ ID NO: 836417 - DNA, 25 bp, Mus musculus
ttaactctgcggtgttccaagaccg

SEQ ID NO: 836418 - DNA, 25 bp, Mus musculus
ttaactctgctgattgctgcatgct

SEQ ID NO: 836419 - DNA, 25 bp, Mus musculus
ttaactctgctgtttgctgcatgct

SEQ ID NO: 836420 - DNA, 25 bp, Mus musculus
ttaactctgtttcccatggacacac

SEQ ID NO: 836421 - DNA, 25 bp, Mus musculus
ttaactctgtttgccatggacacac

SEQ ID NO: 836422 - DNA, 25 bp, Mus musculus
ttaactcttcggcaaggcagaggcg

SEQ ID NO: 836423 - DNA, 25 bp, Mus musculus
ttaactcttcgggaaggcagaggcg

SEQ ID NO: 836424 - DNA, 25 bp, Mus musculus
ttaactgaggccactggatgtccct

SEQ ID NO: 836425 - DNA, 25 bp, Mus musculus
ttaactgaggcctctggatgtccct

SEQ ID NO: 836426 - DNA, 25 bp, Mus musculus
ttaactgcctctagcagcctctctg

SEQ ID NO: 836427 - DNA, 25 bp, Mus musculus
ttaactgcctcttgcagcctctctg

SEQ ID NO: 836428 - DNA, 25 bp, Mus musculus
ttaactggccttacgtcttccattc

SEQ ID NO: 836429 - DNA, 25 bp, Mus musculus
ttaactggcctttcgtcttccattc

SEQ ID NO: 836430 - DNA, 25 bp, Mus musculus
ttaactgtctgaagagagcaattga

SEQ ID NO: 836431 - DNA, 25 bp, Mus musculus
ttaactgtctgatgagagcaattga

SEQ ID NO: 836432 - DNA, 25 bp, Mus musculus
ttaacttaactgaggtttcatcaag

SEQ ID NO: 836433 - DNA, 25 bp, Mus musculus
ttaacttaactgtggtttcatcaag

SEQ ID NO: 836434 - DNA, 25 bp, Mus musculus
ttaactttggccatagctgtgctca

SEQ ID NO: 836435 - DNA, 25 bp, Mus musculus
ttaactttggccttagctgtgctca

SEQ ID NO: 836436 - DNA, 25 bp, Mus musculus
ttaagaaacaagatgaaggcctgcg

SEQ ID NO: 836437 - DNA, 25 bp, Mus musculus
ttaagaaacaagttgaaggcctgcg

SEQ ID NO: 836438 - DNA, 25 bp, Mus musculus
ttaagaacttggatgacaccattga

SEQ ID NO: 836439 - DNA, 25 bp, Mus musculus
ttaagaacttggttgacaccattga

SEQ ID NO: 836440 - DNA, 25 bp, Mus musculus
ttaagaagactgaactttatctggg

SEQ ID NO: 836441 - DNA, 25 bp, Mus musculus
ttaagaagactgtactttatctggg

SEQ ID NO: 836442 - DNA, 25 bp, Mus musculus
ttaagaagagagaatcctttctgcc

SEQ ID NO: 836443 - DNA, 25 bp, Mus musculus
ttaagaagagagtatcctttctgcc

SEQ ID NO: 836444 - DNA, 25 bp, Mus musculus
ttaagaagccatagtgtagattggg

SEQ ID NO: 836445 - DNA, 25 bp, Mus musculus
ttaagaagccattgtgtagattggg

SEQ ID NO: 836446 - DNA, 25 bp, Mus musculus
ttaagacaaggcagcagagtcccca

SEQ ID NO: 836447 - DNA, 25 bp, Mus musculus
ttaagacaaggctgcagagtcccca

SEQ ID NO: 836448 - DNA, 25 bp, Mus musculus
ttaagacaggaacccaaagagccag

SEQ ID NO: 836449 - DNA, 25 bp, Mus musculus
ttaagacaggaagccaaagagccag

SEQ ID NO: 836450 - DNA, 25 bp, Mus musculus
ttaagactagcgagctgacttcggg

SEQ ID NO: 836451 - DNA, 25 bp, Mus musculus
ttaagactagcgtgctgacttcggg

SEQ ID NO: 836452 - DNA, 25 bp, Mus musculus
ttaagactgagacgacatagggaat

SEQ ID NO: 836453 - DNA, 25 bp, Mus musculus
ttaagactgagaggacatagggaat

SEQ ID NO: 836454 - DNA, 25 bp, Mus musculus
ttaagactgcggaaacggtcgaggt

SEQ ID NO: 836455 - DNA, 25 bp, Mus musculus
ttaagactgcggtaacggtcgaggt

SEQ ID NO: 836456 - DNA, 25 bp, Mus musculus
ttaagagagactcaggagagaagac

SEQ ID NO: 836457 - DNA, 25 bp, Mus musculus
ttaagagagactgaggagagaagac

SEQ ID NO: 836458 - DNA, 25 bp, Mus musculus
ttaagaggcactcccggtaccctct

SEQ ID NO: 836459 - DNA, 25 bp, Mus musculus
ttaagaggcactgccggtaccctct

SEQ ID NO: 836460 - DNA, 25 bp, Mus musculus
ttaagaggcccaccgggtgctagac

SEQ ID NO: 836461 - DNA, 25 bp, Mus musculus
ttaagaggcccagcgggtgctagac

SEQ ID NO: 836462 - DNA, 25 bp, Mus musculus
ttaagaggcggaacccagggtcctg

SEQ ID NO: 836463 - DNA, 25 bp, Mus musculus
ttaagaggcggatcccagggtcctg

SEQ ID NO: 836464 - DNA, 25 bp, Mus musculus
ttaagaggtcaccaaaaggaaggct

SEQ ID NO: 836465 - DNA, 25 bp, Mus musculus
ttaagaggtcacgaaaaggaaggct

SEQ ID NO: 836466 - DNA, 25 bp, Mus musculus
ttaagatgggtgaagccttagcctg

SEQ ID NO: 836467 - DNA, 25 bp, Mus musculus
ttaagatgggtgtagccttagcctg

SEQ ID NO: 836468 - DNA, 25 bp, Mus musculus
ttaagatttaacatttgcctctggg

SEQ ID NO: 836469 - DNA, 25 bp, Mus musculus
ttaagatttaacttttgcctctggg

SEQ ID NO: 836470 - DNA, 25 bp, Mus musculus
ttaagatttccaagtgagggctgga

SEQ ID NO: 836471 - DNA, 25 bp, Mus musculus
ttaagatttccatgtgagggctgga

SEQ ID NO: 836472 - DNA, 25 bp, Mus musculus
ttaagcaccagcctgctgaggcctt

SEQ ID NO: 836473 - DNA, 25 bp, Mus musculus
ttaagcaccagcgtgctgaggcctt

SEQ ID NO: 836474 - DNA, 25 bp, Mus musculus
ttaagcaccgccattgaaagtcatg

SEQ ID NO: 836475 - DNA, 25 bp, Mus musculus
ttaagcaccgcctttgaaagtcatg

SEQ ID NO: 836476 - DNA, 25 bp, Mus musculus
ttaagcagacagatgcgtgatccgg

SEQ ID NO: 836477 - DNA, 25 bp, Mus musculus
ttaagcagacagttgcgtgatccgg

SEQ ID NO: 836478 - DNA, 25 bp, Mus musculus
ttaagcagcggtatctgagtgggcc

SEQ ID NO: 836479 - DNA, 25 bp, Mus musculus
ttaagcagcggtttctgagtgggcc

SEQ ID NO: 836480 - DNA, 25 bp, Mus musculus
ttaagcagcgtcacatcaagaaggt

SEQ ID NO: 836481 - DNA, 25 bp, Mus musculus
ttaagcagcgtctcatcaagaaggt

SEQ ID NO: 836482 - DNA, 25 bp, Mus musculus
ttaagcagggatcttccaagggcca

SEQ ID NO: 836483 - DNA, 25 bp, Mus musculus
ttaagcagggatgttccaagggcca

SEQ ID NO: 836484 - DNA, 25 bp, Mus musculus
ttaagccatcctcagtctgtaaata

SEQ ID NO: 836485 - DNA, 25 bp, Mus musculus
ttaagccatcctgagtctgtaaata

SEQ ID NO: 836486 - DNA, 25 bp, Mus musculus
ttaagccccagaaatgagatccgag

SEQ ID NO: 836487 - DNA, 25 bp, Mus musculus
ttaagccccagatatgagatccgag

SEQ ID NO: 836488 - DNA, 25 bp, Mus musculus
ttaagccctcgcacggtggcggccg

SEQ ID NO: 836489 - DNA, 25 bp, Mus musculus
ttaagccctcgctcggtggcggccg

SEQ ID NO: 836490 - DNA, 25 bp, Mus musculus
ttaagcccttagagccaagcagatg

SEQ ID NO: 836491 - DNA, 25 bp, Mus musculus
ttaagcccttagtgccaagcagatg

SEQ ID NO: 836492 - DNA, 25 bp, Mus musculus
ttaagcctcatgctccacggtggag

SEQ ID NO: 836493 - DNA, 25 bp, Mus musculus
ttaagcctcatggtccacggtggag

SEQ ID NO: 836494 - DNA, 25 bp, Mus musculus
ttaagcctgagtagcctcctggatt

SEQ ID NO: 836495 - DNA, 25 bp, Mus musculus
ttaagcctgagttgcctcctggatt

SEQ ID NO: 836496 - DNA, 25 bp, Mus musculus
ttaagccttttacgctcccctgctg

SEQ ID NO: 836497 - DNA, 25 bp, Mus musculus
ttaagccttttaggctcccctgctg

SEQ ID NO: 836498 - DNA, 25 bp, Mus musculus
ttaagcgaaaccaggtgccggcggc

SEQ ID NO: 836499 - DNA, 25 bp, Mus musculus
ttaagcgaaacctggtgccggcggc

SEQ ID NO: 836500 - DNA, 25 bp, Mus musculus
ttaagcgcgtttcgctggcccgccg

SEQ ID NO: 836501 - DNA, 25 bp, Mus musculus
ttaagcgcgtttggctggcccgccg

SEQ ID NO: 836502 - DNA, 25 bp, Mus musculus
ttaagcggcaagaggctttagcagc

SEQ ID NO: 836503 - DNA, 25 bp, Mus musculus
ttaagcggcaagtggctttagcagc

SEQ ID NO: 836504 - DNA, 25 bp, Mus musculus
ttaagcggctcactctcccggagta

SEQ ID NO: 836505 - DNA, 25 bp, Mus musculus
ttaagcggctcagtctcccggagta

SEQ ID NO: 836506 - DNA, 25 bp, Mus musculus
ttaagcggctctacctgcacaaagc

SEQ ID NO: 836507 - DNA, 25 bp, Mus musculus
ttaagcggctcttcctgcacaaagc

SEQ ID NO: 836508 - DNA, 25 bp, Mus musculus
ttaagcgggacaagcccaaggtggc

SEQ ID NO: 836509 - DNA, 25 bp, Mus musculus
ttaagcgggacatgcccaaggtggc

SEQ ID NO: 836510 - DNA, 25 bp, Mus musculus
ttaagcgggttcaacaccgacagtc

SEQ ID NO: 836511 - DNA, 25 bp, Mus musculus
ttaagcgggttctacaccgacagtc

SEQ ID NO: 836512 - DNA, 25 bp, Mus musculus
ttaagctgacccagctggcaatgct

SEQ ID NO: 836513 - DNA, 25 bp, Mus musculus
ttaagctgaccctgctggcaatgct

SEQ ID NO: 836514 - DNA, 25 bp, Mus musculus
ttaaggaacctgatacacacagcgg

SEQ ID NO: 836515 - DNA, 25 bp, Mus musculus
ttaaggaacctgttacacacagcgg

SEQ ID NO: 836516 - DNA, 25 bp, Mus musculus
ttaaggaactagatggccatgtact

SEQ ID NO: 836517 - DNA, 25 bp, Mus musculus
ttaaggaactagttggccatgtact

SEQ ID NO: 836518 - DNA, 25 bp, Mus musculus
ttaaggacgtcccactttgccagca

SEQ ID NO: 836519 - DNA, 25 bp, Mus musculus
ttaaggacgtccgactttgccagca

SEQ ID NO: 836520 - DNA, 25 bp, Mus musculus
ttaaggagaaccaggacatgccact

SEQ ID NO: 836521 - DNA, 25 bp, Mus musculus
ttaaggagaacctggacatgccact

SEQ ID NO: 836522 - DNA, 25 bp, Mus musculus
ttaaggagagccaacggctgcatcc

SEQ ID NO: 836523 - DNA, 25 bp, Mus musculus
ttaaggagagcctacggctgcatcc

SEQ ID NO: 836524 - DNA, 25 bp, Mus musculus
ttaaggagcttaacaaatgccggga

SEQ ID NO: 836525 - DNA, 25 bp, Mus musculus
ttaaggagcttatcaaatgccggga

SEQ ID NO: 836526 - DNA, 25 bp, Mus musculus
ttaaggaggaggaccagaatctgac

SEQ ID NO: 836527 - DNA, 25 bp, Mus musculus
ttaaggaggaggtccagaatctgac

SEQ ID NO: 836528 - DNA, 25 bp, Mus musculus
ttaaggatcacaaagaccggaccag

SEQ ID NO: 836529 - DNA, 25 bp, Mus musculus
ttaaggatcacatagaccggaccag

SEQ ID NO: 836530 - DNA, 25 bp, Mus musculus
ttaaggcagcttctgctagaatcgc

SEQ ID NO: 836531 - DNA, 25 bp, Mus musculus
ttaaggcagcttgtgctagaatcgc

SEQ ID NO: 836532 - DNA, 25 bp, Mus musculus
ttaaggccacaaaggtacgtgcgct

SEQ ID NO: 836533 - DNA, 25 bp, Mus musculus
ttaaggccacaatggtacgtgcgct

SEQ ID NO: 836534 - DNA, 25 bp, Mus musculus
ttaaggccattaagaatggttctcg

SEQ ID NO: 836535 - DNA, 25 bp, Mus musculus
ttaaggccattatgaatggttctcg

SEQ ID NO: 836536 - DNA, 25 bp, Mus musculus
ttaaggcgtctaagatcaagaagcc

SEQ ID NO: 836537 - DNA, 25 bp, Mus musculus
ttaaggcgtctatgatcaagaagcc

SEQ ID NO: 836538 - DNA, 25 bp, Mus musculus
ttaaggctttcacggcttttcttgg

SEQ ID NO: 836539 - DNA, 25 bp, Mus musculus
ttaaggctttcagggcttttcttgg

SEQ ID NO: 836540 - DNA, 25 bp, Mus musculus
ttaagggaagagcagacaagaactt

SEQ ID NO: 836541 - DNA, 25 bp, Mus musculus
ttaagggaagaggagacaagaactt

SEQ ID NO: 836542 - DNA, 25 bp, Mus musculus
ttaagggaccatcgaccaaagagga

SEQ ID NO: 836543 - DNA, 25 bp, Mus musculus
ttaagggaccatggaccaaagagga

SEQ ID NO: 836544 - DNA, 25 bp, Mus musculus
ttaagggcacgcatccgctgcttcc

SEQ ID NO: 836545 - DNA, 25 bp, Mus musculus
ttaagggcacgcttccgctgcttcc

SEQ ID NO: 836546 - DNA, 25 bp, Mus musculus
ttaagggcttccagctggcgttgcc

SEQ ID NO: 836547 - DNA, 25 bp, Mus musculus
ttaagggcttcctgctggcgttgcc

SEQ ID NO: 836548 - DNA, 25 bp, Mus musculus
ttaaggtatgctatttgaagaaggg

SEQ ID NO: 836549 - DNA, 25 bp, Mus musculus
ttaaggtatgctttttgaagaaggg

SEQ ID NO: 836550 - DNA, 25 bp, Mus musculus
ttaaggtggaaaagaatctgcagcc

SEQ ID NO: 836551 - DNA, 25 bp, Mus musculus
ttaaggtggaaatgaatctgcagcc

SEQ ID NO: 836552 - DNA, 25 bp, Mus musculus
ttaaggtgggccacaaagaagtcgg

SEQ ID NO: 836553 - DNA, 25 bp, Mus musculus
ttaaggtgggcctcaaagaagtcgg

SEQ ID NO: 836554 - DNA, 25 bp, Mus musculus
ttaaggtgtggaacaaccaattcct

SEQ ID NO: 836555 - DNA, 25 bp, Mus musculus
ttaaggtgtggatcaaccaattcct

SEQ ID NO: 836556 - DNA, 25 bp, Mus musculus
ttaaggttatgaatcgccgaagaag

SEQ ID NO: 836557 - DNA, 25 bp, Mus musculus
ttaaggttatgattcgccgaagaag

SEQ ID NO: 836558 - DNA, 25 bp, Mus musculus
ttaagtataggaacacgtggccact

SEQ ID NO: 836559 - DNA, 25 bp, Mus musculus
ttaagtataggatcacgtggccact

SEQ ID NO: 836560 - DNA, 25 bp, Mus musculus
ttaagtcggcagctgtcacgctacg

SEQ ID NO: 836561 - DNA, 25 bp, Mus musculus
ttaagtcggcaggtgtcacgctacg

SEQ ID NO: 836562 - DNA, 25 bp, Mus musculus
ttaagtgacggactccacaagattg

SEQ ID NO: 836563 - DNA, 25 bp, Mus musculus
ttaagtgacggagtccacaagattg

SEQ ID NO: 836564 - DNA, 25 bp, Mus musculus
ttaagtgactgtcgcagacctcagc

SEQ ID NO: 836565 - DNA, 25 bp, Mus musculus
ttaagtgactgtggcagacctcagc

SEQ ID NO: 836566 - DNA, 25 bp, Mus musculus
ttaagtgcacgtatgtacacatgcg

SEQ ID NO: 836567 - DNA, 25 bp, Mus musculus
ttaagtgcacgtttgtacacatgcg

SEQ ID NO: 836568 - DNA, 25 bp, Mus musculus
ttaagtggaatcagactgagagcat

SEQ ID NO: 836569 - DNA, 25 bp, Mus musculus
ttaagtggaatctgactgagagcat

SEQ ID NO: 836570 - DNA, 25 bp, Mus musculus
ttaagtggccggctgcccgctttga

SEQ ID NO: 836571 - DNA, 25 bp, Mus musculus
ttaagtggccgggtgcccgctttga

SEQ ID NO: 836572 - DNA, 25 bp, Mus musculus
ttaagtgtagaaagcccctatgccc

SEQ ID NO: 836573 - DNA, 25 bp, Mus musculus
ttaagtgtagaatgcccctatgccc

SEQ ID NO: 836574 - DNA, 25 bp, Mus musculus
ttaagtgtatcaacaccgccaaccc

SEQ ID NO: 836575 - DNA, 25 bp, Mus musculus
ttaagtgtatcatcaccgccaaccc

SEQ ID NO: 836576 - DNA, 25 bp, Mus musculus
ttaagttacaaaattcagcctgatc

SEQ ID NO: 836577 - DNA, 25 bp, Mus musculus
ttaagttacaaatttcagcctgatc

SEQ ID NO: 836578 - DNA, 25 bp, Mus musculus
ttaagttgcatcatcaaagccagca

SEQ ID NO: 836579 - DNA, 25 bp, Mus musculus
ttaagttgcatcttcaaagccagca

SEQ ID NO: 836580 - DNA, 25 bp, Mus musculus
ttaataaaaggaaggcatctgggct

SEQ ID NO: 836581 - DNA, 25 bp, Mus musculus
ttaataaaaggatggcatctgggct

SEQ ID NO: 836582 - DNA, 25 bp, Mus musculus
ttaataacttctcagactctgtagg

SEQ ID NO: 836583 - DNA, 25 bp, Mus musculus
ttaataacttctgagactctgtagg

SEQ ID NO: 836584 - DNA, 25 bp, Mus musculus
ttaatacactgtatgggctggccag

SEQ ID NO: 836585 - DNA, 25 bp, Mus musculus
ttaatacactgtttgggctggccag

SEQ ID NO: 836586 - DNA, 25 bp, Mus musculus
ttaataccagctcctagtcaaatat

SEQ ID NO: 836587 - DNA, 25 bp, Mus musculus
ttaataccagctgctagtcaaatat

SEQ ID NO: 836588 - DNA, 25 bp, Mus musculus
ttaataccgaaaacaagcagctggc

SEQ ID NO: 836589 - DNA, 25 bp, Mus musculus
ttaataccgaaatcaagcagctggc

SEQ ID NO: 836590 - DNA, 25 bp, Mus musculus
ttaataccgaggcttcctacctcca

SEQ ID NO: 836591 - DNA, 25 bp, Mus musculus
ttaataccgagggttcctacctcca

SEQ ID NO: 836592 - DNA, 25 bp, Mus musculus
ttaatagacttacgaaatgaatacc

SEQ ID NO: 836593 - DNA, 25 bp, Mus musculus
ttaatagacttaggaaatgaatacc

SEQ ID NO: 836594 - DNA, 25 bp, Mus musculus
ttaatagctcggatgcggaggtgct

SEQ ID NO: 836595 - DNA, 25 bp, Mus musculus
ttaatagctcggttgcggaggtgct

SEQ ID NO: 836596 - DNA, 25 bp, Mus musculus
ttaataggacaccaggaggacaatg

SEQ ID NO: 836597 - DNA, 25 bp, Mus musculus
ttaataggacacgaggaggacaatg

SEQ ID NO: 836598 - DNA, 25 bp, Mus musculus
ttaatatcaccacccacagaatgga

SEQ ID NO: 836599 - DNA, 25 bp, Mus musculus
ttaatatcaccagccacagaatgga

SEQ ID NO: 836600 - DNA, 25 bp, Mus musculus
ttaatatgcggccacataggctgtg

SEQ ID NO: 836601 - DNA, 25 bp, Mus musculus
ttaatatgcggcgacataggctgtg

SEQ ID NO: 836602 - DNA, 25 bp, Mus musculus
ttaatcagctcaaacctcctttggg

SEQ ID NO: 836603 - DNA, 25 bp, Mus musculus
ttaatcagctcatacctcctttggg

SEQ ID NO: 836604 - DNA, 25 bp, Mus musculus
ttaatcagcttcaggaacggcggcg

SEQ ID NO: 836605 - DNA, 25 bp, Mus musculus
ttaatcagcttctggaacggcggcg

SEQ ID NO: 836606 - DNA, 25 bp, Mus musculus
ttaatcatggaaaatgcaagtggag

SEQ ID NO: 836607 - DNA, 25 bp, Mus musculus
ttaatcatggaatatgcaagtggag

SEQ ID NO: 836608 - DNA, 25 bp, Mus musculus
ttaatcccaagcctgaggtgatgga

SEQ ID NO: 836609 - DNA, 25 bp, Mus musculus
ttaatcccaagcgtgaggtgatgga

SEQ ID NO: 836610 - DNA, 25 bp, Mus musculus
ttaatcccgggcaccacgaaggtgc

SEQ ID NO: 836611 - DNA, 25 bp, Mus musculus
ttaatcccgggctccacgaaggtgc

SEQ ID NO: 836612 - DNA, 25 bp, Mus musculus
ttaatcgagaatcgcctgctgaaga

SEQ ID NO: 836613 - DNA, 25 bp, Mus musculus
ttaatcgagaatggcctgctgaaga

SEQ ID NO: 836614 - DNA, 25 bp, Mus musculus
ttaatctggtgaccccactggagga

SEQ ID NO: 836615 - DNA, 25 bp, Mus musculus
ttaatctggtgagcccactggagga

SEQ ID NO: 836616 - DNA, 25 bp, Mus musculus
ttaatcttccagagtgagcttgcct

SEQ ID NO: 836617 - DNA, 25 bp, Mus musculus
ttaatcttccagtgtgagcttgcct

SEQ ID NO: 836618 - DNA, 25 bp, Mus musculus
ttaatgaactccaggaagcgccgct

SEQ ID NO: 836619 - DNA, 25 bp, Mus musculus
ttaatgaactcctggaagcgccgct

SEQ ID NO: 836620 - DNA, 25 bp, Mus musculus
ttaatgaagtgccattaccaccacc

SEQ ID NO: 836621 - DNA, 25 bp, Mus musculus
ttaatgaagtgcgattaccaccacc

SEQ ID NO: 836622 - DNA, 25 bp, Mus musculus
ttaatgaatctactggcaaggcacc

SEQ ID NO: 836623 - DNA, 25 bp, Mus musculus
ttaatgaatctagtggcaaggcacc

SEQ ID NO: 836624 - DNA, 25 bp, Mus musculus
ttaatgacctccctggatgttctgg

SEQ ID NO: 836625 - DNA, 25 bp, Mus musculus
ttaatgacctccgtggatgttctgg

SEQ ID NO: 836626 - DNA, 25 bp, Mus musculus
ttaatgagtgcacccagaaccctgg

SEQ ID NO: 836627 - DNA, 25 bp, Mus musculus
ttaatgagtgcagccagaaccctgg

SEQ ID NO: 836628 - DNA, 25 bp, Mus musculus
ttaatgagtgtgagaccgggcagca

SEQ ID NO: 836629 - DNA, 25 bp, Mus musculus
ttaatgagtgtgtgaccgggcagca

SEQ ID NO: 836630 - DNA, 25 bp, Mus musculus
ttaatgccggtgcttactccaaact

SEQ ID NO: 836631 - DNA, 25 bp, Mus musculus
ttaatgccggtggttactccaaact

SEQ ID NO: 836632 - DNA, 25 bp, Mus musculus
ttaatgctgcctaaacagttcggcc

SEQ ID NO: 836633 - DNA, 25 bp, Mus musculus
ttaatgctgccttaacagttcggcc

SEQ ID NO: 836634 - DNA, 25 bp, Mus musculus
ttaatgctgctgataacaaacaaag

SEQ ID NO: 836635 - DNA, 25 bp, Mus musculus
ttaatgctgctgttaacaaacaaag

SEQ ID NO: 836636 - DNA, 25 bp, Mus musculus
ttaatggaaagaagagagtacaccc

SEQ ID NO: 836637 - DNA, 25 bp, Mus musculus
ttaatggaaagatgagagtacaccc

SEQ ID NO: 836638 - DNA, 25 bp, Mus musculus
ttaatggacttacatgtggagcaac

SEQ ID NO: 836639 - DNA, 25 bp, Mus musculus
ttaatggacttagatgtggagcaac

SEQ ID NO: 836640 - DNA, 25 bp, Mus musculus
ttaatggagataaaggtgcccttca

SEQ ID NO: 836641 - DNA, 25 bp, Mus musculus
ttaatggagatataggtgcccttca

SEQ ID NO: 836642 - DNA, 25 bp, Mus musculus
ttaatggagtccagtttaactatcc

SEQ ID NO: 836643 - DNA, 25 bp, Mus musculus
ttaatggagtcctgtttaactatcc

SEQ ID NO: 836644 - DNA, 25 bp, Mus musculus
ttaatggctcagacatccactccct

SEQ ID NO: 836645 - DNA, 25 bp, Mus musculus
ttaatggctcagtcatccactccct

SEQ ID NO: 836646 - DNA, 25 bp, Mus musculus
ttaatgggcaggaccgagaccagcg

SEQ ID NO: 836647 - DNA, 25 bp, Mus musculus
ttaatgggcaggtccgagaccagcg

SEQ ID NO: 836648 - DNA, 25 bp, Mus musculus
ttaatgtatccaaggtgcacagttc

SEQ ID NO: 836649 - DNA, 25 bp, Mus musculus
ttaatgtatccatggtgcacagttc

SEQ ID NO: 836650 - DNA, 25 bp, Mus musculus
ttaatgtcctgcagagccgaagtcc

SEQ ID NO: 836651 - DNA, 25 bp, Mus musculus
ttaatgtcctgctgagccgaagtcc

SEQ ID NO: 836652 - DNA, 25 bp, Mus musculus
ttaatgtgaggaaatgcagacatga

SEQ ID NO: 836653 - DNA, 25 bp, Mus musculus
ttaatgtgaggatatgcagacatga

SEQ ID NO: 836654 - DNA, 25 bp, Mus musculus
ttaatgtggactaaactgaagaagg

SEQ ID NO: 836655 - DNA, 25 bp, Mus musculus
ttaatgtggacttaactgaagaagg

SEQ ID NO: 836656 - DNA, 25 bp, Mus musculus
ttaatgttcatgacgctcttgtgcg

SEQ ID NO: 836657 - DNA, 25 bp, Mus musculus
ttaatgttcatgtcgctcttgtgcg

SEQ ID NO: 836658 - DNA, 25 bp, Mus musculus
ttaattaaagctctcaatctcttcc

SEQ ID NO: 836659 - DNA, 25 bp, Mus musculus
ttaattaaagctgtcaatctcttcc

SEQ ID NO: 836660 - DNA, 25 bp, Mus musculus
ttaattaacaaacaagcaccttgtt

SEQ ID NO: 836661 - DNA, 25 bp, Mus musculus
ttaattaacaaagaagcaccttgtt

SEQ ID NO: 836662 - DNA, 25 bp, Mus musculus
ttaattagaggcagtgatgggcccg

SEQ ID NO: 836663 - DNA, 25 bp, Mus musculus
ttaattagaggctgtgatgggcccg

SEQ ID NO: 836664 - DNA, 25 bp, Mus musculus
ttaattgacaagaaccagttgctaa

SEQ ID NO: 836665 - DNA, 25 bp, Mus musculus
ttaattgacaagtaccagttgctaa

SEQ ID NO: 836666 - DNA, 25 bp, Mus musculus
ttaattgatgggacacacaaggtca

SEQ ID NO: 836667 - DNA, 25 bp, Mus musculus
ttaattgatgggtcacacaaggtca

SEQ ID NO: 836668 - DNA, 25 bp, Mus musculus
ttaattgccatacccatagttgcgg

SEQ ID NO: 836669 - DNA, 25 bp, Mus musculus
ttaattgccatagccatagttgcgg

SEQ ID NO: 836670 - DNA, 25 bp, Mus musculus
ttaattgcccagactcagtctggta

SEQ ID NO: 836671 - DNA, 25 bp, Mus musculus
ttaattgcccagtctcagtctggta

SEQ ID NO: 836672 - DNA, 25 bp, Mus musculus
ttaattgctcaaccccggacaggaa

SEQ ID NO: 836673 - DNA, 25 bp, Mus musculus
ttaattgctcaagcccggacaggaa

SEQ ID NO: 836674 - DNA, 25 bp, Mus musculus
ttaattgtccttataggatgcggcc

SEQ ID NO: 836675 - DNA, 25 bp, Mus musculus
ttaattgtccttttaggatgcggcc

SEQ ID NO: 836676 - DNA, 25 bp, Mus musculus
ttaattttgccgacttacaacttgc

SEQ ID NO: 836677 - DNA, 25 bp, Mus musculus
ttaattttgccgtcttacaacttgc

SEQ ID NO: 836678 - DNA, 25 bp, Mus musculus
ttacaaaaacaacatcctgaaggag

SEQ ID NO: 836679 - DNA, 25 bp, Mus musculus
ttacaaaaacaagatcctgaaggag

SEQ ID NO: 836680 - DNA, 25 bp, Mus musculus
ttacaaaaagttccgacagcccctc

SEQ ID NO: 836681 - DNA, 25 bp, Mus musculus
ttacaaaaagttgcgacagcccctc

SEQ ID NO: 836682 - DNA, 25 bp, Mus musculus
ttacaaaagactagttccacctttg

SEQ ID NO: 836683 - DNA, 25 bp, Mus musculus
ttacaaaagacttgttccacctttg

SEQ ID NO: 836684 - DNA, 25 bp, Mus musculus
ttacaaagaaccaaacagagaagga

SEQ ID NO: 836685 - DNA, 25 bp, Mus musculus
ttacaaagaacctaacagagaagga

SEQ ID NO: 836686 - DNA, 25 bp, Mus musculus
ttacaaagccgtagttgcagcctgt

SEQ ID NO: 836687 - DNA, 25 bp, Mus musculus
ttacaaagccgttgttgcagcctgt

SEQ ID NO: 836688 - DNA, 25 bp, Mus musculus
ttacaaagcgttactgaaaaacagc

SEQ ID NO: 836689 - DNA, 25 bp, Mus musculus
ttacaaagcgtttctgaaaaacagc

SEQ ID NO: 836690 - DNA, 25 bp, Mus musculus
ttacaaaggactcgataattgccgg

SEQ ID NO: 836691 - DNA, 25 bp, Mus musculus
ttacaaaggactggataattgccgg

SEQ ID NO: 836692 - DNA, 25 bp, Mus musculus
ttacaaagtctgcttaaaggccaga

SEQ ID NO: 836693 - DNA, 25 bp, Mus musculus
ttacaaagtctggttaaaggccaga

SEQ ID NO: 836694 - DNA, 25 bp, Mus musculus
ttacaacacggacgcagtcatcatg

SEQ ID NO: 836695 - DNA, 25 bp, Mus musculus
ttacaacacggaggcagtcatcatg

SEQ ID NO: 836696 - DNA, 25 bp, Mus musculus
ttacaacagaacatctcgggccacc

SEQ ID NO: 836697 - DNA, 25 bp, Mus musculus
ttacaacagaacttctcgggccacc

SEQ ID NO: 836698 - DNA, 25 bp, Mus musculus
ttacaacatcataggaggacttgat

SEQ ID NO: 836699 - DNA, 25 bp, Mus musculus
ttacaacatcattggaggacttgat

SEQ ID NO: 836700 - DNA, 25 bp, Mus musculus
ttacaaccaagacaagactgcatgc

SEQ ID NO: 836701 - DNA, 25 bp, Mus musculus
ttacaaccaagagaagactgcatgc

SEQ ID NO: 836702 - DNA, 25 bp, Mus musculus
ttacaacccactacctgaagagcgg

SEQ ID NO: 836703 - DNA, 25 bp, Mus musculus
ttacaacccacttcctgaagagcgg

SEQ ID NO: 836704 - DNA, 25 bp, Mus musculus
ttacaaccgaatcgatccccgggct

SEQ ID NO: 836705 - DNA, 25 bp, Mus musculus
ttacaaccgaatggatccccgggct

SEQ ID NO: 836706 - DNA, 25 bp, Mus musculus
ttacaacctctgaatgacatttggg

SEQ ID NO: 836707 - DNA, 25 bp, Mus musculus
ttacaacctctgtatgacatttggg

SEQ ID NO: 836708 - DNA, 25 bp, Mus musculus
ttacaacctgacacctgtcgttcag

SEQ ID NO: 836709 - DNA, 25 bp, Mus musculus
ttacaacctgactcctgtcgttcag

SEQ ID NO: 836710 - DNA, 25 bp, Mus musculus
ttacaacggtgcacgggaagcaggc

SEQ ID NO: 836711 - DNA, 25 bp, Mus musculus
ttacaacggtgctcgggaagcaggc

SEQ ID NO: 836712 - DNA, 25 bp, Mus musculus
ttacaagaacccacttcgcagcctg

SEQ ID NO: 836713 - DNA, 25 bp, Mus musculus
ttacaagaaccctcttcgcagcctg

SEQ ID NO: 836714 - DNA, 25 bp, Mus musculus
ttacaagaagaaccccatggtggag

SEQ ID NO: 836715 - DNA, 25 bp, Mus musculus
ttacaagaagaagcccatggtggag

SEQ ID NO: 836716 - DNA, 25 bp, Mus musculus
ttacaagaatctagtcggaccaaat

SEQ ID NO: 836717 - DNA, 25 bp, Mus musculus
ttacaagaatcttgtcggaccaaat

SEQ ID NO: 836718 - DNA, 25 bp, Mus musculus
ttacaagacataaattgctcagtgc

SEQ ID NO: 836719 - DNA, 25 bp, Mus musculus
ttacaagacatatattgctcagtgc

SEQ ID NO: 836720 - DNA, 25 bp, Mus musculus
ttacaagattccattgcagctcacc

SEQ ID NO: 836721 - DNA, 25 bp, Mus musculus
ttacaagattcctttgcagctcacc

SEQ ID NO: 836722 - DNA, 25 bp, Mus musculus
ttacaagctgctcaagacggccatg

SEQ ID NO: 836723 - DNA, 25 bp, Mus musculus
ttacaagctgctgaagacggccatg

SEQ ID NO: 836724 - DNA, 25 bp, Mus musculus
ttacaagctggacaacctcgttgcc

SEQ ID NO: 836725 - DNA, 25 bp, Mus musculus
ttacaagctggagaacctcgttgcc

SEQ ID NO: 836726 - DNA, 25 bp, Mus musculus
ttacaagtggacagcctacgatgcc

SEQ ID NO: 836727 - DNA, 25 bp, Mus musculus
ttacaagtggactgcctacgatgcc

SEQ ID NO: 836728 - DNA, 25 bp, Mus musculus
ttacaagttcggcagacacgacttg

SEQ ID NO: 836729 - DNA, 25 bp, Mus musculus
ttacaagttcgggagacacgacttg

SEQ ID NO: 836730 - DNA, 25 bp, Mus musculus
ttacaatcaactcttaagggactag

SEQ ID NO: 836731 - DNA, 25 bp, Mus musculus
ttacaatcaactgttaagggactag

SEQ ID NO: 836732 - DNA, 25 bp, Mus musculus
ttacaatcttggcaagttacattcc

SEQ ID NO: 836733 - DNA, 25 bp, Mus musculus
ttacaatcttgggaagttacattcc

SEQ ID NO: 836734 - DNA, 25 bp, Mus musculus
ttacaatgacaaacagccaattttg

SEQ ID NO: 836735 - DNA, 25 bp, Mus musculus
ttacaatgacaatcagccaattttg

SEQ ID NO: 836736 - DNA, 25 bp, Mus musculus
ttacacaaagttctaatggatctcc

SEQ ID NO: 836737 - DNA, 25 bp, Mus musculus
ttacacaaagttgtaatggatctcc

SEQ ID NO: 836738 - DNA, 25 bp, Mus musculus
ttacacaagcggacaggcagtcaac

SEQ ID NO: 836739 - DNA, 25 bp, Mus musculus
ttacacaagcggtcaggcagtcaac

SEQ ID NO: 836740 - DNA, 25 bp, Mus musculus
ttacacaagggtatccaggcaccgt

SEQ ID NO: 836741 - DNA, 25 bp, Mus musculus
ttacacaagggtttccaggcaccgt

SEQ ID NO: 836742 - DNA, 25 bp, Mus musculus
ttacacagacgacagacttttcacg

SEQ ID NO: 836743 - DNA, 25 bp, Mus musculus
ttacacagacgagagacttttcacg

SEQ ID NO: 836744 - DNA, 25 bp, Mus musculus
ttacacatggaacctcctgtcaagg

SEQ ID NO: 836745 - DNA, 25 bp, Mus musculus
ttacacatggaagctcctgtcaagg

SEQ ID NO: 836746 - DNA, 25 bp, Mus musculus
ttacaccactcacggctacctgggt

SEQ ID NO: 836747 - DNA, 25 bp, Mus musculus
ttacaccactcagggctacctgggt

SEQ ID NO: 836748 - DNA, 25 bp, Mus musculus
ttacaccgcagcacttactgcagtc

SEQ ID NO: 836749 - DNA, 25 bp, Mus musculus
ttacaccgcagctcttactgcagtc

SEQ ID NO: 836750 - DNA, 25 bp, Mus musculus
ttacaccgcccacaacgatgacgaa

SEQ ID NO: 836751 - DNA, 25 bp, Mus musculus
ttacaccgcccagaacgatgacgaa

SEQ ID NO: 836752 - DNA, 25 bp, Mus musculus
ttacaccgggctcagcagagtctgc

SEQ ID NO: 836753 - DNA, 25 bp, Mus musculus
ttacaccgggctgagcagagtctgc

SEQ ID NO: 836754 - DNA, 25 bp, Mus musculus
ttacacctatcgacggagacaaccg

SEQ ID NO: 836755 - DNA, 25 bp, Mus musculus
ttacacctatcgtcggagacaaccg

SEQ ID NO: 836756 - DNA, 25 bp, Mus musculus
ttacacctctttccaggagctcaca

SEQ ID NO: 836757 - DNA, 25 bp, Mus musculus
ttacacctctttgcaggagctcaca

SEQ ID NO: 836758 - DNA, 25 bp, Mus musculus
ttacacgcctaaccagttagcacag

SEQ ID NO: 836759 - DNA, 25 bp, Mus musculus
ttacacgcctaagcagttagcacag

SEQ ID NO: 836760 - DNA, 25 bp, Mus musculus
ttacacggatgccatgcagaactac

SEQ ID NO: 836761 - DNA, 25 bp, Mus musculus
ttacacggatgcgatgcagaactac

SEQ ID NO: 836762 - DNA, 25 bp, Mus musculus
ttacacgtttcccaagatgatgggc

SEQ ID NO: 836763 - DNA, 25 bp, Mus musculus
ttacacgtttccgaagatgatgggc

SEQ ID NO: 836764 - DNA, 25 bp, Mus musculus
ttacactcaagcctggcccgaggaa

SEQ ID NO: 836765 - DNA, 25 bp, Mus musculus
ttacactcaagcgtggcccgaggaa

SEQ ID NO: 836766 - DNA, 25 bp, Mus musculus
ttacagaacttactgtctgccagcc

SEQ ID NO: 836767 - DNA, 25 bp, Mus musculus
ttacagaacttagtgtctgccagcc

SEQ ID NO: 836768 - DNA, 25 bp, Mus musculus
ttacagaagcttcctaggactcacc

SEQ ID NO: 836769 - DNA, 25 bp, Mus musculus
ttacagaagcttgctaggactcacc

SEQ ID NO: 836770 - DNA, 25 bp, Mus musculus
ttacagaagtacacagaatggacag

SEQ ID NO: 836771 - DNA, 25 bp, Mus musculus
ttacagaagtactcagaatggacag

SEQ ID NO: 836772 - DNA, 25 bp, Mus musculus
ttacagacatcaacccggcagacag

SEQ ID NO: 836773 - DNA, 25 bp, Mus musculus
ttacagacatcatcccggcagacag

SEQ ID NO: 836774 - DNA, 25 bp, Mus musculus
ttacagacattacgcagaaaacgga

SEQ ID NO: 836775 - DNA, 25 bp, Mus musculus
ttacagacattaggcagaaaacgga

SEQ ID NO: 836776 - DNA, 25 bp, Mus musculus
ttacagagagaacggctgaggccat

SEQ ID NO: 836777 - DNA, 25 bp, Mus musculus
ttacagagagaagggctgaggccat

SEQ ID NO: 836778 - DNA, 25 bp, Mus musculus
ttacagaggacaagtgggactggcc

SEQ ID NO: 836779 - DNA, 25 bp, Mus musculus
ttacagaggacatgtgggactggcc

SEQ ID NO: 836780 - DNA, 25 bp, Mus musculus
ttacagaggctacattagtgcctgg

SEQ ID NO: 836781 - DNA, 25 bp, Mus musculus
ttacagaggctagattagtgcctgg

SEQ ID NO: 836782 - DNA, 25 bp, Mus musculus
ttacagagtatgcaagacttgcaat

SEQ ID NO: 836783 - DNA, 25 bp, Mus musculus
ttacagagtatggaagacttgcaat

SEQ ID NO: 836784 - DNA, 25 bp, Mus musculus
ttacagatacttcgataagcatggg

SEQ ID NO: 836785 - DNA, 25 bp, Mus musculus
ttacagatacttggataagcatggg

SEQ ID NO: 836786 - DNA, 25 bp, Mus musculus
ttacagatgagcagatgagaggctt

SEQ ID NO: 836787 - DNA, 25 bp, Mus musculus
ttacagatgagctgatgagaggctt

SEQ ID NO: 836788 - DNA, 25 bp, Mus musculus
ttacagcaagttcacaatggcccac

SEQ ID NO: 836789 - DNA, 25 bp, Mus musculus
ttacagcaagttgacaatggcccac

SEQ ID NO: 836790 - DNA, 25 bp, Mus musculus
ttacagcagacccaggcacaagtgg

SEQ ID NO: 836791 - DNA, 25 bp, Mus musculus
ttacagcagaccgaggcacaagtgg

SEQ ID NO: 836792 - DNA, 25 bp, Mus musculus
ttacagccacatcgtacgtcctggg

SEQ ID NO: 836793 - DNA, 25 bp, Mus musculus
ttacagccacatggtacgtcctggg

SEQ ID NO: 836794 - DNA, 25 bp, Mus musculus
ttacagccatgcaggactgcagtga

SEQ ID NO: 836795 - DNA, 25 bp, Mus musculus
ttacagccatgctggactgcagtga

SEQ ID NO: 836796 - DNA, 25 bp, Mus musculus
ttacagcgacctccagaactgcttg

SEQ ID NO: 836797 - DNA, 25 bp, Mus musculus
ttacagcgacctgcagaactgcttg

SEQ ID NO: 836798 - DNA, 25 bp, Mus musculus
ttacagcggctcattgaggagttcc

SEQ ID NO: 836799 - DNA, 25 bp, Mus musculus
ttacagcggctctttgaggagttcc

SEQ ID NO: 836800 - DNA, 25 bp, Mus musculus
ttacagcgttgcatgtcacccagtg

SEQ ID NO: 836801 - DNA, 25 bp, Mus musculus
ttacagcgttgcttgtcacccagtg

SEQ ID NO: 836802 - DNA, 25 bp, Mus musculus
ttacagctcggaccggaacgatgag

SEQ ID NO: 836803 - DNA, 25 bp, Mus musculus
ttacagctcggagcggaacgatgag

SEQ ID NO: 836804 - DNA, 25 bp, Mus musculus
ttacagctgatcatagaaggttgag

SEQ ID NO: 836805 - DNA, 25 bp, Mus musculus
ttacagctgatcttagaaggttgag

SEQ ID NO: 836806 - DNA, 25 bp, Mus musculus
ttacagctgggtacgctttgagtgg

SEQ ID NO: 836807 - DNA, 25 bp, Mus musculus
ttacagctgggttcgctttgagtgg

SEQ ID NO: 836808 - DNA, 25 bp, Mus musculus
ttacagcttctacctacgcaataag

SEQ ID NO: 836809 - DNA, 25 bp, Mus musculus
ttacagcttctagctacgcaataag

SEQ ID NO: 836810 - DNA, 25 bp, Mus musculus
ttacaggacactcaaagggcaatgg

SEQ ID NO: 836811 - DNA, 25 bp, Mus musculus
ttacaggacactgaaagggcaatgg

SEQ ID NO: 836812 - DNA, 25 bp, Mus musculus
ttacaggactcacctcttgaaggca

SEQ ID NO: 836813 - DNA, 25 bp, Mus musculus
ttacaggactcagctcttgaaggca

SEQ ID NO: 836814 - DNA, 25 bp, Mus musculus
ttacaggactgacacatgcattcag

SEQ ID NO: 836815 - DNA, 25 bp, Mus musculus
ttacaggactgagacatgcattcag

SEQ ID NO: 836816 - DNA, 25 bp, Mus musculus
ttacaggagtaaacgacaaaatggc

SEQ ID NO: 836817 - DNA, 25 bp, Mus musculus
ttacaggagtaatcgacaaaatggc

SEQ ID NO: 836818 - DNA, 25 bp, Mus musculus
ttacaggcatggcacctgctggcaa

SEQ ID NO: 836819 - DNA, 25 bp, Mus musculus
ttacaggcatgggacctgctggcaa

SEQ ID NO: 836820 - DNA, 25 bp, Mus musculus
ttacaggcccggcatggtgtccgaa

SEQ ID NO: 836821 - DNA, 25 bp, Mus musculus
ttacaggcccgggatggtgtccgaa

SEQ ID NO: 836822 - DNA, 25 bp, Mus musculus
ttacaggcgccccactgaagataca

SEQ ID NO: 836823 - DNA, 25 bp, Mus musculus
ttacaggcgcccgactgaagataca

SEQ ID NO: 836824 - DNA, 25 bp, Mus musculus
ttacaggcgggcataagtggctggc

SEQ ID NO: 836825 - DNA, 25 bp, Mus musculus
ttacaggcgggcttaagtggctggc

SEQ ID NO: 836826 - DNA, 25 bp, Mus musculus
ttacaggctgatactctccgggcag

SEQ ID NO: 836827 - DNA, 25 bp, Mus musculus
ttacaggctgattctctccgggcag

SEQ ID NO: 836828 - DNA, 25 bp, Mus musculus
ttacaggcttcacttccgcaaatgt

SEQ ID NO: 836829 - DNA, 25 bp, Mus musculus
ttacaggcttcagttccgcaaatgt

SEQ ID NO: 836830 - DNA, 25 bp, Mus musculus
ttacaggttagactggcaagtgcca

SEQ ID NO: 836831 - DNA, 25 bp, Mus musculus
ttacaggttagagtggcaagtgcca

SEQ ID NO: 836832 - DNA, 25 bp, Mus musculus
ttacagtcaagacttgcgacgactg

SEQ ID NO: 836833 - DNA, 25 bp, Mus musculus
ttacagtcaagagttgcgacgactg

SEQ ID NO: 836834 - DNA, 25 bp, Mus musculus
ttacagtctgatcggatgatgaccg

SEQ ID NO: 836835 - DNA, 25 bp, Mus musculus
ttacagtctgatgggatgatgaccg

SEQ ID NO: 836836 - DNA, 25 bp, Mus musculus
ttacagtgtgacatctgggattcag

SEQ ID NO: 836837 - DNA, 25 bp, Mus musculus
ttacagtgtgacttctgggattcag

SEQ ID NO: 836838 - DNA, 25 bp, Mus musculus
ttacagtttttgcaggcagtctgtc

SEQ ID NO: 836839 - DNA, 25 bp, Mus musculus
ttacagtttttggaggcagtctgtc

SEQ ID NO: 836840 - DNA, 25 bp, Mus musculus
ttacataatttcaagaagagaggag

SEQ ID NO: 836841 - DNA, 25 bp, Mus musculus
ttacataatttctagaagagaggag

SEQ ID NO: 836842 - DNA, 25 bp, Mus musculus
ttacatacaacaagccacagtgtgc

SEQ ID NO: 836843 - DNA, 25 bp, Mus musculus
ttacatacaacatgccacagtgtgc

SEQ ID NO: 836844 - DNA, 25 bp, Mus musculus
ttacatagcggtccaacggccgttc

SEQ ID NO: 836845 - DNA, 25 bp, Mus musculus
ttacatagcggtgcaacggccgttc

SEQ ID NO: 836846 - DNA, 25 bp, Mus musculus
ttacatcagcaacattgttgttgag

SEQ ID NO: 836847 - DNA, 25 bp, Mus musculus
ttacatcagcaagattgttgttgag

SEQ ID NO: 836848 - DNA, 25 bp, Mus musculus
ttacatcttctacctggagcctgag

SEQ ID NO: 836849 - DNA, 25 bp, Mus musculus
ttacatcttctagctggagcctgag

SEQ ID NO: 836850 - DNA, 25 bp, Mus musculus
ttacatgcgtcacgcaggagaagtg

SEQ ID NO: 836851 - DNA, 25 bp, Mus musculus
ttacatgcgtcaggcaggagaagtg

SEQ ID NO: 836852 - DNA, 25 bp, Mus musculus
ttacattgaacaccggctgatgatg

SEQ ID NO: 836853 - DNA, 25 bp, Mus musculus
ttacattgaacagcggctgatgatg

SEQ ID NO: 836854 - DNA, 25 bp, Mus musculus
ttacattgcggtcaatccacatttg

SEQ ID NO: 836855 - DNA, 25 bp, Mus musculus
ttacattgcggtgaatccacatttg

SEQ ID NO: 836856 - DNA, 25 bp, Mus musculus
ttacatttcagactcagtccgctag

SEQ ID NO: 836857 - DNA, 25 bp, Mus musculus
ttacatttcagagtcagtccgctag

SEQ ID NO: 836858 - DNA, 25 bp, Mus musculus
ttacatttgcaaaaccaccattggg

SEQ ID NO: 836859 - DNA, 25 bp, Mus musculus
ttacatttgcaataccaccattggg

SEQ ID NO: 836860 - DNA, 25 bp, Mus musculus
ttaccaaaaccgagcgcctcgttca

SEQ ID NO: 836861 - DNA, 25 bp, Mus musculus
ttaccaaaaccgtgcgcctcgttca

SEQ ID NO: 836862 - DNA, 25 bp, Mus musculus
ttaccaacctgtatgggcgccatga

SEQ ID NO: 836863 - DNA, 25 bp, Mus musculus
ttaccaacctgtttgggcgccatga

SEQ ID NO: 836864 - DNA, 25 bp, Mus musculus
ttaccaagctcgagtctcggacaaa

SEQ ID NO: 836865 - DNA, 25 bp, Mus musculus
ttaccaagctcgtgtctcggacaaa

SEQ ID NO: 836866 - DNA, 25 bp, Mus musculus
ttaccaaggatcagaattttctctg

SEQ ID NO: 836867 - DNA, 25 bp, Mus musculus
ttaccaaggatctgaattttctctg

SEQ ID NO: 836868 - DNA, 25 bp, Mus musculus
ttaccaagttgacacactaaggatg

SEQ ID NO: 836869 - DNA, 25 bp, Mus musculus
ttaccaagttgagacactaaggatg

SEQ ID NO: 836870 - DNA, 25 bp, Mus musculus
ttaccaatacttcacctagcacggg

SEQ ID NO: 836871 - DNA, 25 bp, Mus musculus
ttaccaatacttgacctagcacggg

SEQ ID NO: 836872 - DNA, 25 bp, Mus musculus
ttaccaatggctctaccactgtctg

SEQ ID NO: 836873 - DNA, 25 bp, Mus musculus
ttaccaatggctgtaccactgtctg

SEQ ID NO: 836874 - DNA, 25 bp, Mus musculus
ttaccacaaggacccggattgcctg

SEQ ID NO: 836875 - DNA, 25 bp, Mus musculus
ttaccacaaggagccggattgcctg

SEQ ID NO: 836876 - DNA, 25 bp, Mus musculus
ttaccacacaagacattcacttggg

SEQ ID NO: 836877 - DNA, 25 bp, Mus musculus
ttaccacacaagtcattcacttggg

SEQ ID NO: 836878 - DNA, 25 bp, Mus musculus
ttaccacagcccaggcgaaaccagg

SEQ ID NO: 836879 - DNA, 25 bp, Mus musculus
ttaccacagccctggcgaaaccagg

SEQ ID NO: 836880 - DNA, 25 bp, Mus musculus
ttaccacatgacaccggcatccggt

SEQ ID NO: 836881 - DNA, 25 bp, Mus musculus
ttaccacatgactccggcatccggt

SEQ ID NO: 836882 - DNA, 25 bp, Mus musculus
ttaccaccagttactgatttgtgga

SEQ ID NO: 836883 - DNA, 25 bp, Mus musculus
ttaccaccagtttctgatttgtgga

SEQ ID NO: 836884 - DNA, 25 bp, Mus musculus
ttaccaccttggcactgctttacca

SEQ ID NO: 836885 - DNA, 25 bp, Mus musculus
ttaccaccttgggactgctttacca

SEQ ID NO: 836886 - DNA, 25 bp, Mus musculus
ttaccagaacctcacccgggtggcg

SEQ ID NO: 836887 - DNA, 25 bp, Mus musculus
ttaccagaacctgacccgggtggcg

SEQ ID NO: 836888 - DNA, 25 bp, Mus musculus
ttaccagaatgtctgcacgcacagc

SEQ ID NO: 836889 - DNA, 25 bp, Mus musculus
ttaccagaatgtgtgcacgcacagc

SEQ ID NO: 836890 - DNA, 25 bp, Mus musculus
ttaccagcaacaccactaacagcag

SEQ ID NO: 836891 - DNA, 25 bp, Mus musculus
ttaccagcaacagcactaacagcag

SEQ ID NO: 836892 - DNA, 25 bp, Mus musculus
ttaccagcagcgattggaagcccct

SEQ ID NO: 836893 - DNA, 25 bp, Mus musculus
ttaccagcagcgtttggaagcccct

SEQ ID NO: 836894 - DNA, 25 bp, Mus musculus
ttaccagcagctcgcatactcgcag

SEQ ID NO: 836895 - DNA, 25 bp, Mus musculus
ttaccagcagctggcatactcgcag

SEQ ID NO: 836896 - DNA, 25 bp, Mus musculus
ttaccagccacaactggttttagct

SEQ ID NO: 836897 - DNA, 25 bp, Mus musculus
ttaccagccacatctggttttagct

SEQ ID NO: 836898 - DNA, 25 bp, Mus musculus
ttaccagccctactaaaggaggacg

SEQ ID NO: 836899 - DNA, 25 bp, Mus musculus
ttaccagccctagtaaaggaggacg

SEQ ID NO: 836900 - DNA, 25 bp, Mus musculus
ttaccagcgccacccgacttttgtg

SEQ ID NO: 836901 - DNA, 25 bp, Mus musculus
ttaccagcgccagccgacttttgtg

SEQ ID NO: 836902 - DNA, 25 bp, Mus musculus
ttaccagtcagtcacctcaggtcac

SEQ ID NO: 836903 - DNA, 25 bp, Mus musculus
ttaccagtcagtgacctcaggtcac

SEQ ID NO: 836904 - DNA, 25 bp, Mus musculus
ttaccagtgcccatcaggtgcctgc

SEQ ID NO: 836905 - DNA, 25 bp, Mus musculus
ttaccagtgcccttcaggtgcctgc

SEQ ID NO: 836906 - DNA, 25 bp, Mus musculus
ttaccagtgctaaggagtcccattt

SEQ ID NO: 836907 - DNA, 25 bp, Mus musculus
ttaccagtgctatggagtcccattt

SEQ ID NO: 836908 - DNA, 25 bp, Mus musculus
ttaccagttagcagagtaggcggcg

SEQ ID NO: 836909 - DNA, 25 bp, Mus musculus
ttaccagttagctgagtaggcggcg

SEQ ID NO: 836910 - DNA, 25 bp, Mus musculus
ttaccagttctgcagacaccacatg

SEQ ID NO: 836911 - DNA, 25 bp, Mus musculus
ttaccagttctggagacaccacatg

SEQ ID NO: 836912 - DNA, 25 bp, Mus musculus
ttaccataacctcatgcatgcagct

SEQ ID NO: 836913 - DNA, 25 bp, Mus musculus
ttaccataacctgatgcatgcagct

SEQ ID NO: 836914 - DNA, 25 bp, Mus musculus
ttaccatacaagcaaaagataagcg

SEQ ID NO: 836915 - DNA, 25 bp, Mus musculus
ttaccatacaaggaaaagataagcg

SEQ ID NO: 836916 - DNA, 25 bp, Mus musculus
ttaccatcggcgcttccggaagctc

SEQ ID NO: 836917 - DNA, 25 bp, Mus musculus
ttaccatcggcggttccggaagctc

SEQ ID NO: 836918 - DNA, 25 bp, Mus musculus
ttaccatcttggcactctggcttcc

SEQ ID NO: 836919 - DNA, 25 bp, Mus musculus
ttaccatcttgggactctggcttcc

SEQ ID NO: 836920 - DNA, 25 bp, Mus musculus
ttaccatctttcagcccctcaggga

SEQ ID NO: 836921 - DNA, 25 bp, Mus musculus
ttaccatctttctgcccctcaggga

SEQ ID NO: 836922 - DNA, 25 bp, Mus musculus
ttaccatgaaaacatcgccgcagtg

SEQ ID NO: 836923 - DNA, 25 bp, Mus musculus
ttaccatgaaaagatcgccgcagtg

SEQ ID NO: 836924 - DNA, 25 bp, Mus musculus
ttaccatgctaacgaggagggctct

SEQ ID NO: 836925 - DNA, 25 bp, Mus musculus
ttaccatgctaaggaggagggctct

SEQ ID NO: 836926 - DNA, 25 bp, Mus musculus
ttacccacaagtcatccagaactgg

SEQ ID NO: 836927 - DNA, 25 bp, Mus musculus
ttacccacaagtgatccagaactgg

SEQ ID NO: 836928 - DNA, 25 bp, Mus musculus
ttacccactcaaaaggcaagtggcc

SEQ ID NO: 836929 - DNA, 25 bp, Mus musculus
ttacccactcaataggcaagtggcc

SEQ ID NO: 836930 - DNA, 25 bp, Mus musculus
ttacccagacccagcttatccagaa

SEQ ID NO: 836931 - DNA, 25 bp, Mus musculus
ttacccagaccctgcttatccagaa

SEQ ID NO: 836932 - DNA, 25 bp, Mus musculus
ttacccatcgccatcgacttgctgg

SEQ ID NO: 836933 - DNA, 25 bp, Mus musculus
ttacccatcgccttcgacttgctgg

SEQ ID NO: 836934 - DNA, 25 bp, Mus musculus
ttacccctacagaataaaatgcctt

SEQ ID NO: 836935 - DNA, 25 bp, Mus musculus
ttacccctacagtataaaatgcctt

SEQ ID NO: 836936 - DNA, 25 bp, Mus musculus
ttacccgaggtaatgatatacaagc

SEQ ID NO: 836937 - DNA, 25 bp, Mus musculus
ttacccgaggtattgatatacaagc

SEQ ID NO: 836938 - DNA, 25 bp, Mus musculus
ttacccgatcttaacacagaaactg

SEQ ID NO: 836939 - DNA, 25 bp, Mus musculus
ttacccgatctttacacagaaactg

SEQ ID NO: 836940 - DNA, 25 bp, Mus musculus
ttacccgcttcacaacagggggcgc

SEQ ID NO: 836941 - DNA, 25 bp, Mus musculus
ttacccgcttcagaacagggggcgc

SEQ ID NO: 836942 - DNA, 25 bp, Mus musculus
ttacccggacaacgtggtgatcggc

SEQ ID NO: 836943 - DNA, 25 bp, Mus musculus
ttacccggacaaggtggtgatcggc

SEQ ID NO: 836944 - DNA, 25 bp, Mus musculus
ttacccgggcgcatctggattctca

SEQ ID NO: 836945 - DNA, 25 bp, Mus musculus
ttacccgggcgcttctggattctca

SEQ ID NO: 836946 - DNA, 25 bp, Mus musculus
ttacccgtctctcgaaacttgatcg

SEQ ID NO: 836947 - DNA, 25 bp, Mus musculus
ttacccgtctctggaaacttgatcg

SEQ ID NO: 836948 - DNA, 25 bp, Mus musculus
ttaccctagaagaagtgcaagatgg

SEQ ID NO: 836949 - DNA, 25 bp, Mus musculus
ttaccctagaagtagtgcaagatgg

SEQ ID NO: 836950 - DNA, 25 bp, Mus musculus
ttaccctctctgctttgctgcggac

SEQ ID NO: 836951 - DNA, 25 bp, Mus musculus
ttaccctctctggtttgctgcggac

SEQ ID NO: 836952 - DNA, 25 bp, Mus musculus
ttaccctgctacacgcgggagcggc

SEQ ID NO: 836953 - DNA, 25 bp, Mus musculus
ttaccctgctactcgcgggagcggc

SEQ ID NO: 836954 - DNA, 25 bp, Mus musculus
ttacccttctgaaagttaccttcag

SEQ ID NO: 836955 - DNA, 25 bp, Mus musculus
ttacccttctgatagttaccttcag

SEQ ID NO: 836956 - DNA, 25 bp, Mus musculus
ttaccgacgggaatcgctgcgtgga

SEQ ID NO: 836957 - DNA, 25 bp, Mus musculus
ttaccgacgggattcgctgcgtgga

SEQ ID NO: 836958 - DNA, 25 bp, Mus musculus
ttaccgagacgtcgaacgagagctg

SEQ ID NO: 836959 - DNA, 25 bp, Mus musculus
ttaccgagacgtggaacgagagctg

SEQ ID NO: 836960 - DNA, 25 bp, Mus musculus
ttaccgagcaggagcatacattcag

SEQ ID NO: 836961 - DNA, 25 bp, Mus musculus
ttaccgagcaggtgcatacattcag

SEQ ID NO: 836962 - DNA, 25 bp, Mus musculus
ttaccgccaggacgtgaccaaaacg

SEQ ID NO: 836963 - DNA, 25 bp, Mus musculus
ttaccgccaggaggtgaccaaaacg

SEQ ID NO: 836964 - DNA, 25 bp, Mus musculus
ttaccgctcgccacggcaaggaaga

SEQ ID NO: 836965 - DNA, 25 bp, Mus musculus
ttaccgctcgcctcggcaaggaaga

SEQ ID NO: 836966 - DNA, 25 bp, Mus musculus
ttaccggcccagctgcattgccaag

SEQ ID NO: 836967 - DNA, 25 bp, Mus musculus
ttaccggcccaggtgcattgccaag

SEQ ID NO: 836968 - DNA, 25 bp, Mus musculus
ttaccgggactccaagctgacccga

SEQ ID NO: 836969 - DNA, 25 bp, Mus musculus
ttaccgggactcgaagctgacccga

SEQ ID NO: 836970 - DNA, 25 bp, Mus musculus
ttaccgggacttcgcgttagagaag

SEQ ID NO: 836971 - DNA, 25 bp, Mus musculus
ttaccgggacttggcgttagagaag

SEQ ID NO: 836972 - DNA, 25 bp, Mus musculus
ttaccgggatgcagcatccagacaa

SEQ ID NO: 836973 - DNA, 25 bp, Mus musculus
ttaccgggatgctgcatccagacaa

SEQ ID NO: 836974 - DNA, 25 bp, Mus musculus
ttaccggtttgcagaaagtaggatc

SEQ ID NO: 836975 - DNA, 25 bp, Mus musculus
ttaccggtttgctgaaagtaggatc

SEQ ID NO: 836976 - DNA, 25 bp, Mus musculus
ttaccgtacgcaccggtcacgatcg

SEQ ID NO: 836977 - DNA, 25 bp, Mus musculus
ttaccgtacgcagcggtcacgatcg

SEQ ID NO: 836978 - DNA, 25 bp, Mus musculus
ttaccgtgggcacaggaacccagct

SEQ ID NO: 836979 - DNA, 25 bp, Mus musculus
ttaccgtgggcagaggaacccagct

SEQ ID NO: 836980 - DNA, 25 bp, Mus musculus
ttaccgtgtacacctctaaaagcct

SEQ ID NO: 836981 - DNA, 25 bp, Mus musculus
ttaccgtgtacagctctaaaagcct

SEQ ID NO: 836982 - DNA, 25 bp, Mus musculus
ttacctagcggccacatggatgctg

SEQ ID NO: 836983 - DNA, 25 bp, Mus musculus
ttacctagcggcgacatggatgctg

SEQ ID NO: 836984 - DNA, 25 bp, Mus musculus
ttacctagctctcaaaacgctgtct

SEQ ID NO: 836985 - DNA, 25 bp, Mus musculus
ttacctagctctgaaaacgctgtct

SEQ ID NO: 836986 - DNA, 25 bp, Mus musculus
ttacctaggaacagtgcgatttggg

SEQ ID NO: 836987 - DNA, 25 bp, Mus musculus
ttacctaggaactgtgcgatttggg

SEQ ID NO: 836988 - DNA, 25 bp, Mus musculus
ttacctatgaccacagctgtcctga

SEQ ID NO: 836989 - DNA, 25 bp, Mus musculus
ttacctatgacctcagctgtcctga

SEQ ID NO: 836990 - DNA, 25 bp, Mus musculus
ttacctatgctaatgaaaaagtccg

SEQ ID NO: 836991 - DNA, 25 bp, Mus musculus
ttacctatgctattgaaaaagtccg

SEQ ID NO: 836992 - DNA, 25 bp, Mus musculus
ttacctcactgcattccggagcggt

SEQ ID NO: 836993 - DNA, 25 bp, Mus musculus
ttacctcactgctttccggagcggt

SEQ ID NO: 836994 - DNA, 25 bp, Mus musculus
ttacctcactttacaaagaaagacg

SEQ ID NO: 836995 - DNA, 25 bp, Mus musculus
ttacctcacttttcaaagaaagacg

SEQ ID NO: 836996 - DNA, 25 bp, Mus musculus
ttacctcatcaacgcactgtccaag

SEQ ID NO: 836997 - DNA, 25 bp, Mus musculus
ttacctcatcaaggcactgtccaag

SEQ ID NO: 836998 - DNA, 25 bp, Mus musculus
ttacctccaaaacatgagtatgtgt

SEQ ID NO: 836999 - DNA, 25 bp, Mus musculus
ttacctccaaaagatgagtatgtgt

SEQ ID NO: 837000 - DNA, 25 bp, Mus musculus
ttacctccctacattccaagtcagg

SEQ ID NO: 837001 - DNA, 25 bp, Mus musculus
ttacctccctactttccaagtcagg

SEQ ID NO: 837002 - DNA, 25 bp, Mus musculus
ttacctccctagagactctacagct

SEQ ID NO: 837003 - DNA, 25 bp, Mus musculus
ttacctccctagtgactctacagct

SEQ ID NO: 837004 - DNA, 25 bp, Mus musculus
ttacctccctccagagcgaattcgt

SEQ ID NO: 837005 - DNA, 25 bp, Mus musculus
ttacctccctcctgagcgaattcgt

SEQ ID NO: 837006 - DNA, 25 bp, Mus musculus
ttacctccctgtccagaagagcggg

SEQ ID NO: 837007 - DNA, 25 bp, Mus musculus
ttacctccctgtgcagaagagcggg

SEQ ID NO: 837008 - DNA, 25 bp, Mus musculus
ttacctctagatacactacttgtgg

SEQ ID NO: 837009 - DNA, 25 bp, Mus musculus
ttacctctagattcactacttgtgg

SEQ ID NO: 837010 - DNA, 25 bp, Mus musculus
ttacctctgttgctcgggccaccag

SEQ ID NO: 837011 - DNA, 25 bp, Mus musculus
ttacctctgttggtcgggccaccag

SEQ ID NO: 837012 - DNA, 25 bp, Mus musculus
ttacctgaacctcacttagaaattc

SEQ ID NO: 837013 - DNA, 25 bp, Mus musculus
ttacctgaacctgacttagaaattc

SEQ ID NO: 837014 - DNA, 25 bp, Mus musculus
ttacctgaagttacggtgtgacctg

SEQ ID NO: 837015 - DNA, 25 bp, Mus musculus
ttacctgaagtttcggtgtgacctg

SEQ ID NO: 837016 - DNA, 25 bp, Mus musculus
ttacctgaatgtacatggcgcctgc

SEQ ID NO: 837017 - DNA, 25 bp, Mus musculus
ttacctgaatgttcatggcgcctgc

SEQ ID NO: 837018 - DNA, 25 bp, Mus musculus
ttacctgaccccaagcctgacgttg

SEQ ID NO: 837019 - DNA, 25 bp, Mus musculus
ttacctgacccctagcctgacgttg

SEQ ID NO: 837020 - DNA, 25 bp, Mus musculus
ttacctgaggccctgaggatttcct

SEQ ID NO: 837021 - DNA, 25 bp, Mus musculus
ttacctgaggccgtgaggatttcct

SEQ ID NO: 837022 - DNA, 25 bp, Mus musculus
ttacctggaatgcaaagcacacagg

SEQ ID NO: 837023 - DNA, 25 bp, Mus musculus
ttacctggaatggaaagcacacagg

SEQ ID NO: 837024 - DNA, 25 bp, Mus musculus
ttacctggacctcctggcaatgttg

SEQ ID NO: 837025 - DNA, 25 bp, Mus musculus
ttacctggacctgctggcaatgttg

SEQ ID NO: 837026 - DNA, 25 bp, Mus musculus
ttacctggataaagcaacagttggc

SEQ ID NO: 837027 - DNA, 25 bp, Mus musculus
ttacctggataatgcaacagttggc

SEQ ID NO: 837028 - DNA, 25 bp, Mus musculus
ttacctggatgcatgtatactttgc

SEQ ID NO: 837029 - DNA, 25 bp, Mus musculus
ttacctggatgcttgtatactttgc

SEQ ID NO: 837030 - DNA, 25 bp, Mus musculus
ttacctggcgctaccagcctgaagg

SEQ ID NO: 837031 - DNA, 25 bp, Mus musculus
ttacctggcgcttccagcctgaagg

SEQ ID NO: 837032 - DNA, 25 bp, Mus musculus
ttacctgggactcacccaggctggc

SEQ ID NO: 837033 - DNA, 25 bp, Mus musculus
ttacctgggactgacccaggctggc

SEQ ID NO: 837034 - DNA, 25 bp, Mus musculus
ttacctggtggtcctttaccttcag

SEQ ID NO: 837035 - DNA, 25 bp, Mus musculus
ttacctggtggtgctttaccttcag

SEQ ID NO: 837036 - DNA, 25 bp, Mus musculus
ttacctgtcactcaaaaagctcgcg

SEQ ID NO: 837037 - DNA, 25 bp, Mus musculus
ttacctgtcactgaaaaagctcgcg

SEQ ID NO: 837038 - DNA, 25 bp, Mus musculus
ttacctgtccagagcttttgtgaag

SEQ ID NO: 837039 - DNA, 25 bp, Mus musculus
ttacctgtccagtgcttttgtgaag

SEQ ID NO: 837040 - DNA, 25 bp, Mus musculus
ttacctgttgatcacaaaggagaat

SEQ ID NO: 837041 - DNA, 25 bp, Mus musculus
ttacctgttgatgacaaaggagaat

SEQ ID NO: 837042 - DNA, 25 bp, Mus musculus
ttacctgtttgtacacagagagcct

SEQ ID NO: 837043 - DNA, 25 bp, Mus musculus
ttacctgtttgttcacagagagcct

SEQ ID NO: 837044 - DNA, 25 bp, Mus musculus
ttaccttgatgaagctcttatgaag

SEQ ID NO: 837045 - DNA, 25 bp, Mus musculus
ttaccttgatgatgctcttatgaag

SEQ ID NO: 837046 - DNA, 25 bp, Mus musculus
ttaccttgatgcacccagcgaggca

SEQ ID NO: 837047 - DNA, 25 bp, Mus musculus
ttaccttgatgctcccagcgaggca

SEQ ID NO: 837048 - DNA, 25 bp, Mus musculus
ttaccttggtcacggtggctggccc

SEQ ID NO: 837049 - DNA, 25 bp, Mus musculus
ttaccttggtcagggtggctggccc

SEQ ID NO: 837050 - DNA, 25 bp, Mus musculus
ttacctttaggacctccgatccggg

SEQ ID NO: 837051 - DNA, 25 bp, Mus musculus
ttacctttaggagctccgatccggg

SEQ ID NO: 837052 - DNA, 25 bp, Mus musculus
ttacctttattgcaagggaaatcct

SEQ ID NO: 837053 - DNA, 25 bp, Mus musculus
ttacctttattggaagggaaatcct

SEQ ID NO: 837054 - DNA, 25 bp, Mus musculus
ttacgaaatgaaaacctacaagcag

SEQ ID NO: 837055 - DNA, 25 bp, Mus musculus
ttacgaaatgaatacctacaagcag

SEQ ID NO: 837056 - DNA, 25 bp, Mus musculus
ttacgaacatctctgaaggcaaagc

SEQ ID NO: 837057 - DNA, 25 bp, Mus musculus
ttacgaacatctgtgaaggcaaagc

SEQ ID NO: 837058 - DNA, 25 bp, Mus musculus
ttacgaacttcgatatttccagatt

SEQ ID NO: 837059 - DNA, 25 bp, Mus musculus
ttacgaacttcgttatttccagatt

SEQ ID NO: 837060 - DNA, 25 bp, Mus musculus
ttacgaagaagacgcgcggtcagtc

SEQ ID NO: 837061 - DNA, 25 bp, Mus musculus
ttacgaagaagaggcgcggtcagtc

SEQ ID NO: 837062 - DNA, 25 bp, Mus musculus
ttacgaatgtgtaggtgagccacca

SEQ ID NO: 837063 - DNA, 25 bp, Mus musculus
ttacgaatgtgttggtgagccacca

SEQ ID NO: 837064 - DNA, 25 bp, Mus musculus
ttacgaccacgtcgatgaagtcacg

SEQ ID NO: 837065 - DNA, 25 bp, Mus musculus
ttacgaccacgtggatgaagtcacg

SEQ ID NO: 837066 - DNA, 25 bp, Mus musculus
ttacgacgcgctagccgctcaggtg

SEQ ID NO: 837067 - DNA, 25 bp, Mus musculus
ttacgacgcgcttgccgctcaggtg

SEQ ID NO: 837068 - DNA, 25 bp, Mus musculus
ttacgactccacctgggagctgcca

SEQ ID NO: 837069 - DNA, 25 bp, Mus musculus
ttacgactccacgtgggagctgcca

SEQ ID NO: 837070 - DNA, 25 bp, Mus musculus
ttacgagatagaccatcaaacagag

SEQ ID NO: 837071 - DNA, 25 bp, Mus musculus
ttacgagatagagcatcaaacagag

SEQ ID NO: 837072 - DNA, 25 bp, Mus musculus
ttacgagatcctcaactccccagag

SEQ ID NO: 837073 - DNA, 25 bp, Mus musculus
ttacgagatcctgaactccccagag

SEQ ID NO: 837074 - DNA, 25 bp, Mus musculus
ttacgagatggcattgatgaccaga

SEQ ID NO: 837075 - DNA, 25 bp, Mus musculus
ttacgagatggctttgatgaccaga

SEQ ID NO: 837076 - DNA, 25 bp, Mus musculus
ttacgaggaaccctatgcagcatgg

SEQ ID NO: 837077 - DNA, 25 bp, Mus musculus
ttacgaggaaccgtatgcagcatgg

SEQ ID NO: 837078 - DNA, 25 bp, Mus musculus
ttacgagtgcacctcaggcgacaca

SEQ ID NO: 837079 - DNA, 25 bp, Mus musculus
ttacgagtgcacgtcaggcgacaca

SEQ ID NO: 837080 - DNA, 25 bp, Mus musculus
ttacgatgatgtcgatgcctcagac

SEQ ID NO: 837081 - DNA, 25 bp, Mus musculus
ttacgatgatgtggatgcctcagac

SEQ ID NO: 837082 - DNA, 25 bp, Mus musculus
ttacgccaccacatccgagctgagg

SEQ ID NO: 837083 - DNA, 25 bp, Mus musculus
ttacgccaccacttccgagctgagg

SEQ ID NO: 837084 - DNA, 25 bp, Mus musculus
ttacgccatcttagcctgttttaga

SEQ ID NO: 837085 - DNA, 25 bp, Mus musculus
ttacgccatctttgcctgttttaga

SEQ ID NO: 837086 - DNA, 25 bp, Mus musculus
ttacgcctacgaatgttagtgcgta

SEQ ID NO: 837087 - DNA, 25 bp, Mus musculus
ttacgcctacgattgttagtgcgta

SEQ ID NO: 837088 - DNA, 25 bp, Mus musculus
ttacgctgctaaaaaaggccacggc

SEQ ID NO: 837089 - DNA, 25 bp, Mus musculus
ttacgctgctaataaaggccacggc

SEQ ID NO: 837090 - DNA, 25 bp, Mus musculus
ttacggacccggcagcactagctgt

SEQ ID NO: 837091 - DNA, 25 bp, Mus musculus
ttacggacccgggagcactagctgt

SEQ ID NO: 837092 - DNA, 25 bp, Mus musculus
ttacggctccaacaatgcactcgag

SEQ ID NO: 837093 - DNA, 25 bp, Mus musculus
ttacggctccaagaatgcactcgag

SEQ ID NO: 837094 - DNA, 25 bp, Mus musculus
ttacggctctctaccagttgtcaca

SEQ ID NO: 837095 - DNA, 25 bp, Mus musculus
ttacggctctcttccagttgtcaca

SEQ ID NO: 837096 - DNA, 25 bp, Mus musculus
ttacgggcaccgcaagttcatcacc

SEQ ID NO: 837097 - DNA, 25 bp, Mus musculus
ttacgggcaccggaagttcatcacc

SEQ ID NO: 837098 - DNA, 25 bp, Mus musculus
ttacgggctagacgatgaccagcgc

SEQ ID NO: 837099 - DNA, 25 bp, Mus musculus
ttacgggctagaggatgaccagcgc

SEQ ID NO: 837100 - DNA, 25 bp, Mus musculus
ttacggggccttccgacagcctgga

SEQ ID NO: 837101 - DNA, 25 bp, Mus musculus
ttacggggccttgcgacagcctgga

SEQ ID NO: 837102 - DNA, 25 bp, Mus musculus
ttacggtcccgcagctggagcctca

SEQ ID NO: 837103 - DNA, 25 bp, Mus musculus
ttacggtcccgctgctggagcctca

SEQ ID NO: 837104 - DNA, 25 bp, Mus musculus
ttacggtgactcatataaaccacag

SEQ ID NO: 837105 - DNA, 25 bp, Mus musculus
ttacggtgactcttataaaccacag

SEQ ID NO: 837106 - DNA, 25 bp, Mus musculus
ttacgtaagctcacagcatgcccca

SEQ ID NO: 837107 - DNA, 25 bp, Mus musculus
ttacgtaagctctcagcatgcccca

SEQ ID NO: 837108 - DNA, 25 bp, Mus musculus
ttacgtcatgatcttcatcccagcg

SEQ ID NO: 837109 - DNA, 25 bp, Mus musculus
ttacgtcatgatgttcatcccagcg

SEQ ID NO: 837110 - DNA, 25 bp, Mus musculus
ttacgtccccatactgtactaacag

SEQ ID NO: 837111 - DNA, 25 bp, Mus musculus
ttacgtccccattctgtactaacag

SEQ ID NO: 837112 - DNA, 25 bp, Mus musculus
ttacgtgtggccatccgtgaggctg

SEQ ID NO: 837113 - DNA, 25 bp, Mus musculus
ttacgtgtggccttccgtgaggctg

SEQ ID NO: 837114 - DNA, 25 bp, Mus musculus
ttacgttagtacatactcggaagcg

SEQ ID NO: 837115 - DNA, 25 bp, Mus musculus
ttacgttagtacttactcggaagcg

SEQ ID NO: 837116 - DNA, 25 bp, Mus musculus
ttactaaagatcacaggaagagacc

SEQ ID NO: 837117 - DNA, 25 bp, Mus musculus
ttactaaagatctcaggaagagacc

SEQ ID NO: 837118 - DNA, 25 bp, Mus musculus
ttactaacagaccagaagtcttgcc

SEQ ID NO: 837119 - DNA, 25 bp, Mus musculus
ttactaacagacgagaagtcttgcc

SEQ ID NO: 837120 - DNA, 25 bp, Mus musculus
ttactaacccagctcgaaaggacgg

SEQ ID NO: 837121 - DNA, 25 bp, Mus musculus
ttactaacccaggtcgaaaggacgg

SEQ ID NO: 837122 - DNA, 25 bp, Mus musculus
ttactaagagggacgcggccccaca

SEQ ID NO: 837123 - DNA, 25 bp, Mus musculus
ttactaagagggtcgcggccccaca

SEQ ID NO: 837124 - DNA, 25 bp, Mus musculus
ttactaagtaagcagctgtcacaca

SEQ ID NO: 837125 - DNA, 25 bp, Mus musculus
ttactaagtaaggagctgtcacaca

SEQ ID NO: 837126 - DNA, 25 bp, Mus musculus
ttactactgggcagcctcagaatgt

SEQ ID NO: 837127 - DNA, 25 bp, Mus musculus
ttactactgggctgcctcagaatgt

SEQ ID NO: 837128 - DNA, 25 bp, Mus musculus
ttactactttgtcaccagggagatg

SEQ ID NO: 837129 - DNA, 25 bp, Mus musculus
ttactactttgtgaccagggagatg

SEQ ID NO: 837130 - DNA, 25 bp, Mus musculus
ttactagagctaaaaatgaccttgg

SEQ ID NO: 837131 - DNA, 25 bp, Mus musculus
ttactagagctataaatgaccttgg

SEQ ID NO: 837132 - DNA, 25 bp, Mus musculus
ttactatcaatacagatttgcaggg

SEQ ID NO: 837133 - DNA, 25 bp, Mus musculus
ttactatcaatagagatttgcaggg

SEQ ID NO: 837134 - DNA, 25 bp, Mus musculus
ttactcaactgtcgatcgagttaag

SEQ ID NO: 837135 - DNA, 25 bp, Mus musculus
ttactcaactgtggatcgagttaag

SEQ ID NO: 837136 - DNA, 25 bp, Mus musculus
ttactcacagtacgacacccagacg

SEQ ID NO: 837137 - DNA, 25 bp, Mus musculus
ttactcacagtaggacacccagacg

SEQ ID NO: 837138 - DNA, 25 bp, Mus musculus
ttactcactgtgcaaccgtcttggg

SEQ ID NO: 837139 - DNA, 25 bp, Mus musculus
ttactcactgtggaaccgtcttggg

SEQ ID NO: 837140 - DNA, 25 bp, Mus musculus
ttactcaggtaaccccagtgccgtc

SEQ ID NO: 837141 - DNA, 25 bp, Mus musculus
ttactcaggtaagcccagtgccgtc

SEQ ID NO: 837142 - DNA, 25 bp, Mus musculus
ttactcagttgacccggcagagacc

SEQ ID NO: 837143 - DNA, 25 bp, Mus musculus
ttactcagttgagccggcagagacc

SEQ ID NO: 837144 - DNA, 25 bp, Mus musculus
ttactccaagtcagggccaacaagg

SEQ ID NO: 837145 - DNA, 25 bp, Mus musculus
ttactccaagtctgggccaacaagg

SEQ ID NO: 837146 - DNA, 25 bp, Mus musculus
ttactccactccaggaatgaaggcg

SEQ ID NO: 837147 - DNA, 25 bp, Mus musculus
ttactccactcctggaatgaaggcg

SEQ ID NO: 837148 - DNA, 25 bp, Mus musculus
ttactccatatacagaaatcgaagc

SEQ ID NO: 837149 - DNA, 25 bp, Mus musculus
ttactccatatagagaaatcgaagc

SEQ ID NO: 837150 - DNA, 25 bp, Mus musculus
ttactcccaaagctgtccttaacac

SEQ ID NO: 837151 - DNA, 25 bp, Mus musculus
ttactcccaaaggtgtccttaacac

SEQ ID NO: 837152 - DNA, 25 bp, Mus musculus
ttactccgcctcagtcggtgctgca

SEQ ID NO: 837153 - DNA, 25 bp, Mus musculus
ttactccgcctctgtcggtgctgca

SEQ ID NO: 837154 - DNA, 25 bp, Mus musculus
ttactcctcttcagcttcggacagc

SEQ ID NO: 837155 - DNA, 25 bp, Mus musculus
ttactcctcttctgcttcggacagc

SEQ ID NO: 837156 - DNA, 25 bp, Mus musculus
ttactcctgcacagtgacacacgag

SEQ ID NO: 837157 - DNA, 25 bp, Mus musculus
ttactcctgcactgtgacacacgag

SEQ ID NO: 837158 - DNA, 25 bp, Mus musculus
ttactcggagttctggaagagcagc

SEQ ID NO: 837159 - DNA, 25 bp, Mus musculus
ttactcggagttgtggaagagcagc

SEQ ID NO: 837160 - DNA, 25 bp, Mus musculus
ttactctaagttcccctttgcaggg

SEQ ID NO: 837161 - DNA, 25 bp, Mus musculus
ttactctaagttgccctttgcaggg

SEQ ID NO: 837162 - DNA, 25 bp, Mus musculus
ttactctactccactgcagcctggt

SEQ ID NO: 837163 - DNA, 25 bp, Mus musculus
ttactctactcctctgcagcctggt

SEQ ID NO: 837164 - DNA, 25 bp, Mus musculus
ttactctgggcaaggtcactcggga

SEQ ID NO: 837165 - DNA, 25 bp, Mus musculus
ttactctgggcatggtcactcggga

SEQ ID NO: 837166 - DNA, 25 bp, Mus musculus
ttactctttggtcgctgcctgtgtt

SEQ ID NO: 837167 - DNA, 25 bp, Mus musculus
ttactctttggtggctgcctgtgtt

SEQ ID NO: 837168 - DNA, 25 bp, Mus musculus
ttactgaaacagcaagcgtgggact

SEQ ID NO: 837169 - DNA, 25 bp, Mus musculus
ttactgaaacaggaagcgtgggact

SEQ ID NO: 837170 - DNA, 25 bp, Mus musculus
ttactgagcggcaggaggtctctgc

SEQ ID NO: 837171 - DNA, 25 bp, Mus musculus
ttactgagcggctggaggtctctgc

SEQ ID NO: 837172 - DNA, 25 bp, Mus musculus
ttactgagctggctgatccatcatg

SEQ ID NO: 837173 - DNA, 25 bp, Mus musculus
ttactgagctgggtgatccatcatg

SEQ ID NO: 837174 - DNA, 25 bp, Mus musculus
ttactgagtcgtccaatcaggatgc

SEQ ID NO: 837175 - DNA, 25 bp, Mus musculus
ttactgagtcgtgcaatcaggatgc

SEQ ID NO: 837176 - DNA, 25 bp, Mus musculus
ttactgattgatcaggtctgctgtc

SEQ ID NO: 837177 - DNA, 25 bp, Mus musculus
ttactgattgatgaggtctgctgtc

SEQ ID NO: 837178 - DNA, 25 bp, Mus musculus
ttactgcaagcaaaacctagagatg

SEQ ID NO: 837179 - DNA, 25 bp, Mus musculus
ttactgcaagcataacctagagatg

SEQ ID NO: 837180 - DNA, 25 bp, Mus musculus
ttactgcctgggcaccttgtccgca

SEQ ID NO: 837181 - DNA, 25 bp, Mus musculus
ttactgcctggggaccttgtccgca

SEQ ID NO: 837182 - DNA, 25 bp, Mus musculus
ttactgcgggttctcaggagccaga

SEQ ID NO: 837183 - DNA, 25 bp, Mus musculus
ttactgcgggttgtcaggagccaga

SEQ ID NO: 837184 - DNA, 25 bp, Mus musculus
ttactgctacagcaggcgcaggccc

SEQ ID NO: 837185 - DNA, 25 bp, Mus musculus
ttactgctacaggaggcgcaggccc

SEQ ID NO: 837186 - DNA, 25 bp, Mus musculus
ttactgctccagacaatctgggata

SEQ ID NO: 837187 - DNA, 25 bp, Mus musculus
ttactgctccagtcaatctgggata

SEQ ID NO: 837188 - DNA, 25 bp, Mus musculus
ttactgctctgcatgttcttcttca

SEQ ID NO: 837189 - DNA, 25 bp, Mus musculus
ttactgctctgcttgttcttcttca

SEQ ID NO: 837190 - DNA, 25 bp, Mus musculus
ttactgctggaacgttatctttgtc

SEQ ID NO: 837191 - DNA, 25 bp, Mus musculus
ttactgctggaaggttatctttgtc

SEQ ID NO: 837192 - DNA, 25 bp, Mus musculus
ttactgcttctcaacttggaggagt

SEQ ID NO: 837193 - DNA, 25 bp, Mus musculus
ttactgcttctctacttggaggagt

SEQ ID NO: 837194 - DNA, 25 bp, Mus musculus
ttactggaaagaagaaacccgatga

SEQ ID NO: 837195 - DNA, 25 bp, Mus musculus
ttactggaaagatgaaacccgatga

SEQ ID NO: 837196 - DNA, 25 bp, Mus musculus
ttactggaacagaccttcttacagg

SEQ ID NO: 837197 - DNA, 25 bp, Mus musculus
ttactggaacagtccttcttacagg

SEQ ID NO: 837198 - DNA, 25 bp, Mus musculus
ttactggaggtacaacatcccgcag

SEQ ID NO: 837199 - DNA, 25 bp, Mus musculus
ttactggaggtagaacatcccgcag

SEQ ID NO: 837200 - DNA, 25 bp, Mus musculus
ttactggcagaacagttgcccctgc

SEQ ID NO: 837201 - DNA, 25 bp, Mus musculus
ttactggcagaagagttgcccctgc

SEQ ID NO: 837202 - DNA, 25 bp, Mus musculus
ttactgggagcaccagttgttggtc

SEQ ID NO: 837203 - DNA, 25 bp, Mus musculus
ttactgggagcagcagttgttggtc

SEQ ID NO: 837204 - DNA, 25 bp, Mus musculus
ttactgggcaggctcagtcttttgc

SEQ ID NO: 837205 - DNA, 25 bp, Mus musculus
ttactgggcagggtcagtcttttgc

SEQ ID NO: 837206 - DNA, 25 bp, Mus musculus
ttactggtgtacacaatagcatcca

SEQ ID NO: 837207 - DNA, 25 bp, Mus musculus
ttactggtgtactcaatagcatcca

SEQ ID NO: 837208 - DNA, 25 bp, Mus musculus
ttactgtgacaaccgtcccaacttc

SEQ ID NO: 837209 - DNA, 25 bp, Mus musculus
ttactgtgacaagcgtcccaacttc

SEQ ID NO: 837210 - DNA, 25 bp, Mus musculus
ttactgtgcaagattgcggatggag

SEQ ID NO: 837211 - DNA, 25 bp, Mus musculus
ttactgtgcaagtttgcggatggag

SEQ ID NO: 837212 - DNA, 25 bp, Mus musculus
ttactgtgccgacaagccgcaatga

SEQ ID NO: 837213 - DNA, 25 bp, Mus musculus
ttactgtgccgagaagccgcaatga

SEQ ID NO: 837214 - DNA, 25 bp, Mus musculus
ttactgtggaagcaatgatcaagct

SEQ ID NO: 837215 - DNA, 25 bp, Mus musculus
ttactgtggaaggaatgatcaagct

SEQ ID NO: 837216 - DNA, 25 bp, Mus musculus
ttactgttgctcagaagaaggctgc

SEQ ID NO: 837217 - DNA, 25 bp, Mus musculus
ttactgttgctctgaagaaggctgc

SEQ ID NO: 837218 - DNA, 25 bp, Mus musculus
ttactgttgtccagctacggcggga

SEQ ID NO: 837219 - DNA, 25 bp, Mus musculus
ttactgttgtcctgctacggcggga

SEQ ID NO: 837220 - DNA, 25 bp, Mus musculus
ttacttaaacccaggcacatctcct

SEQ ID NO: 837221 - DNA, 25 bp, Mus musculus
ttacttaaaccctggcacatctcct

SEQ ID NO: 837222 - DNA, 25 bp, Mus musculus
ttacttaactgaaccagactttaag

SEQ ID NO: 837223 - DNA, 25 bp, Mus musculus
ttacttaactgatccagactttaag

SEQ ID NO: 837224 - DNA, 25 bp, Mus musculus
ttacttaatgtacattctatgggcg

SEQ ID NO: 837225 - DNA, 25 bp, Mus musculus
ttacttaatgtagattctatgggcg

SEQ ID NO: 837226 - DNA, 25 bp, Mus musculus
ttacttcaaactagtcatgacacag

SEQ ID NO: 837227 - DNA, 25 bp, Mus musculus
ttacttcaaacttgtcatgacacag

SEQ ID NO: 837228 - DNA, 25 bp, Mus musculus
ttacttcagagtaaccagtgttaca

SEQ ID NO: 837229 - DNA, 25 bp, Mus musculus
ttacttcagagttaccagtgttaca

SEQ ID NO: 837230 - DNA, 25 bp, Mus musculus
ttacttcccctcatgatgctggtgt

SEQ ID NO: 837231 - DNA, 25 bp, Mus musculus
ttacttcccctcttgatgctggtgt

SEQ ID NO: 837232 - DNA, 25 bp, Mus musculus
ttacttcctatgattcctgactcag

SEQ ID NO: 837233 - DNA, 25 bp, Mus musculus
ttacttcctatgtttcctgactcag

SEQ ID NO: 837234 - DNA, 25 bp, Mus musculus
ttacttcctgccatgtgaccacaca

SEQ ID NO: 837235 - DNA, 25 bp, Mus musculus
ttacttcctgccttgtgaccacaca

SEQ ID NO: 837236 - DNA, 25 bp, Mus musculus
ttacttgacggccaactgaaaccag

SEQ ID NO: 837237 - DNA, 25 bp, Mus musculus
ttacttgacggcgaactgaaaccag

SEQ ID NO: 837238 - DNA, 25 bp, Mus musculus
ttacttgatgctcagagatcccagg

SEQ ID NO: 837239 - DNA, 25 bp, Mus musculus
ttacttgatgctgagagatcccagg

SEQ ID NO: 837240 - DNA, 25 bp, Mus musculus
ttacttgcggctccgtggtgaagct

SEQ ID NO: 837241 - DNA, 25 bp, Mus musculus
ttacttgcggctgcgtggtgaagct

SEQ ID NO: 837242 - DNA, 25 bp, Mus musculus
ttacttggccgacgttgctgctggt

SEQ ID NO: 837243 - DNA, 25 bp, Mus musculus
ttacttggccgaggttgctgctggt

SEQ ID NO: 837244 - DNA, 25 bp, Mus musculus
ttactttagctgaaaaacaacaaca

SEQ ID NO: 837245 - DNA, 25 bp, Mus musculus
ttactttagctgtaaaacaacaaca

SEQ ID NO: 837246 - DNA, 25 bp, Mus musculus
ttacttttccgacaaaccagcaaga

SEQ ID NO: 837247 - DNA, 25 bp, Mus musculus
ttacttttccgagaaaccagcaaga

SEQ ID NO: 837248 - DNA, 25 bp, Mus musculus
ttagaaaaagcccagaagttatgga

SEQ ID NO: 837249 - DNA, 25 bp, Mus musculus
ttagaaaaagccgagaagttatgga

SEQ ID NO: 837250 - DNA, 25 bp, Mus musculus
ttagaaaagaagcattttgcctctg

SEQ ID NO: 837251 - DNA, 25 bp, Mus musculus
ttagaaaagaaggattttgcctctg

SEQ ID NO: 837252 - DNA, 25 bp, Mus musculus
ttagaaacaagtccttgaccattgg

SEQ ID NO: 837253 - DNA, 25 bp, Mus musculus
ttagaaacaagtgcttgaccattgg

SEQ ID NO: 837254 - DNA, 25 bp, Mus musculus
ttagaaacgtccagcctgtacccac

SEQ ID NO: 837255 - DNA, 25 bp, Mus musculus
ttagaaacgtcctgcctgtacccac

SEQ ID NO: 837256 - DNA, 25 bp, Mus musculus
ttagaaagcccacaggagaccggca

SEQ ID NO: 837257 - DNA, 25 bp, Mus musculus
ttagaaagcccagaggagaccggca

SEQ ID NO: 837258 - DNA, 25 bp, Mus musculus
ttagaaaggcggagtcctggtctac

SEQ ID NO: 837259 - DNA, 25 bp, Mus musculus
ttagaaaggcggtgtcctggtctac

SEQ ID NO: 837260 - DNA, 25 bp, Mus musculus
ttagaacagtggagcctagtgtgtg

SEQ ID NO: 837261 - DNA, 25 bp, Mus musculus
ttagaacagtggtgcctagtgtgtg

SEQ ID NO: 837262 - DNA, 25 bp, Mus musculus
ttagaacgtgaacggccccgcgcct

SEQ ID NO: 837263 - DNA, 25 bp, Mus musculus
ttagaacgtgaagggccccgcgcct

SEQ ID NO: 837264 - DNA, 25 bp, Mus musculus
ttagaactgcagctgtaagaactgg

SEQ ID NO: 837265 - DNA, 25 bp, Mus musculus
ttagaactgcaggtgtaagaactgg

SEQ ID NO: 837266 - DNA, 25 bp, Mus musculus
ttagaagacagtcaagacgatattg

SEQ ID NO: 837267 - DNA, 25 bp, Mus musculus
ttagaagacagtgaagacgatattg

SEQ ID NO: 837268 - DNA, 25 bp, Mus musculus
ttagaagactaacgtgctgtgtggt

SEQ ID NO: 837269 - DNA, 25 bp, Mus musculus
ttagaagactaaggtgctgtgtggt

SEQ ID NO: 837270 - DNA, 25 bp, Mus musculus
ttagaagatcaccaagcagaccact

SEQ ID NO: 837271 - DNA, 25 bp, Mus musculus
ttagaagatcacgaagcagaccact

SEQ ID NO: 837272 - DNA, 25 bp, Mus musculus
ttagaagatctaacctctccagagg

SEQ ID NO: 837273 - DNA, 25 bp, Mus musculus
ttagaagatctatcctctccagagg

SEQ ID NO: 837274 - DNA, 25 bp, Mus musculus
ttagaagcagaactaaaatgaaagc

SEQ ID NO: 837275 - DNA, 25 bp, Mus musculus
ttagaagcagaagtaaaatgaaagc

SEQ ID NO: 837276 - DNA, 25 bp, Mus musculus
ttagaaggagacactaaccagaagc

SEQ ID NO: 837277 - DNA, 25 bp, Mus musculus
ttagaaggagactctaaccagaagc

SEQ ID NO: 837278 - DNA, 25 bp, Mus musculus
ttagaaggcattattcctggagcaa

SEQ ID NO: 837279 - DNA, 25 bp, Mus musculus
ttagaaggcatttttcctggagcaa

SEQ ID NO: 837280 - DNA, 25 bp, Mus musculus
ttagaaggcccgattggaagagagc

SEQ ID NO: 837281 - DNA, 25 bp, Mus musculus
ttagaaggcccgtttggaagagagc

SEQ ID NO: 837282 - DNA, 25 bp, Mus musculus
ttagaagtagcccacagatctcacc

SEQ ID NO: 837283 - DNA, 25 bp, Mus musculus
ttagaagtagccgacagatctcacc

SEQ ID NO: 837284 - DNA, 25 bp, Mus musculus
ttagaagtcctcagcatacactgtg

SEQ ID NO: 837285 - DNA, 25 bp, Mus musculus
ttagaagtcctctgcatacactgtg

SEQ ID NO: 837286 - DNA, 25 bp, Mus musculus
ttagaagttctcaggcctcccacaa

SEQ ID NO: 837287 - DNA, 25 bp, Mus musculus
ttagaagttctctggcctcccacaa

SEQ ID NO: 837288 - DNA, 25 bp, Mus musculus
ttagaataaaatatgcagacatcca

SEQ ID NO: 837289 - DNA, 25 bp, Mus musculus
ttagaataaaatttgcagacatcca

SEQ ID NO: 837290 - DNA, 25 bp, Mus musculus
ttagaatcactcaataagtgccagg

SEQ ID NO: 837291 - DNA, 25 bp, Mus musculus
ttagaatcactctataagtgccagg

SEQ ID NO: 837292 - DNA, 25 bp, Mus musculus
ttagaatgttctaggcctgggcttg

SEQ ID NO: 837293 - DNA, 25 bp, Mus musculus
ttagaatgttcttggcctgggcttg

SEQ ID NO: 837294 - DNA, 25 bp, Mus musculus
ttagacaaacctctggaggcagcat

SEQ ID NO: 837295 - DNA, 25 bp, Mus musculus
ttagacaaacctgtggaggcagcat

SEQ ID NO: 837296 - DNA, 25 bp, Mus musculus
ttagacaagccactcttcgaccagg

SEQ ID NO: 837297 - DNA, 25 bp, Mus musculus
ttagacaagccagtcttcgaccagg

SEQ ID NO: 837298 - DNA, 25 bp, Mus musculus
ttagacagttaacggcccttcggca

SEQ ID NO: 837299 - DNA, 25 bp, Mus musculus
ttagacagttaagggcccttcggca

SEQ ID NO: 837300 - DNA, 25 bp, Mus musculus
ttagaccacttaatcccgggcacca

SEQ ID NO: 837301 - DNA, 25 bp, Mus musculus
ttagaccacttattcccgggcacca

SEQ ID NO: 837302 - DNA, 25 bp, Mus musculus
ttagaccagaggaggtgctgccctc

SEQ ID NO: 837303 - DNA, 25 bp, Mus musculus
ttagaccagaggtggtgctgccctc

SEQ ID NO: 837304 - DNA, 25 bp, Mus musculus
ttagaccagtctaacaagcacgatg

SEQ ID NO: 837305 - DNA, 25 bp, Mus musculus
ttagaccagtcttacaagcacgatg

SEQ ID NO: 837306 - DNA, 25 bp, Mus musculus
ttagaccatgatcatgtcaaggctg

SEQ ID NO: 837307 - DNA, 25 bp, Mus musculus
ttagaccatgatgatgtcaaggctg

SEQ ID NO: 837308 - DNA, 25 bp, Mus musculus
ttagacccccttccctgtttgtttg

SEQ ID NO: 837309 - DNA, 25 bp, Mus musculus
ttagacccccttgcctgtttgtttg

SEQ ID NO: 837310 - DNA, 25 bp, Mus musculus
ttagacccctggagggttgagcacg

SEQ ID NO: 837311 - DNA, 25 bp, Mus musculus
ttagacccctggtgggttgagcacg

SEQ ID NO: 837312 - DNA, 25 bp, Mus musculus
ttagaccgcatcctcactgtgacat

SEQ ID NO: 837313 - DNA, 25 bp, Mus musculus
ttagaccgcatcgtcactgtgacat

SEQ ID NO: 837314 - DNA, 25 bp, Mus musculus
ttagaccggtacatgcccatcactg

SEQ ID NO: 837315 - DNA, 25 bp, Mus musculus
ttagaccggtacttgcccatcactg

SEQ ID NO: 837316 - DNA, 25 bp, Mus musculus
ttagaccggtttaacatgaaccgca

SEQ ID NO: 837317 - DNA, 25 bp, Mus musculus
ttagaccggttttacatgaaccgca

SEQ ID NO: 837318 - DNA, 25 bp, Mus musculus
ttagacctcgcccagcacagggact

SEQ ID NO: 837319 - DNA, 25 bp, Mus musculus
ttagacctcgccgagcacagggact

SEQ ID NO: 837320 - DNA, 25 bp, Mus musculus
ttagacgacctcactaacctggtgg

SEQ ID NO: 837321 - DNA, 25 bp, Mus musculus
ttagacgacctctctaacctggtgg

SEQ ID NO: 837322 - DNA, 25 bp, Mus musculus
ttagactcagagcttccaaggtctg

SEQ ID NO: 837323 - DNA, 25 bp, Mus musculus
ttagactcagaggttccaaggtctg

SEQ ID NO: 837324 - DNA, 25 bp, Mus musculus
ttagactggtttatcatcaggaaag

SEQ ID NO: 837325 - DNA, 25 bp, Mus musculus
ttagactggtttttcatcaggaaag

SEQ ID NO: 837326 - DNA, 25 bp, Mus musculus
ttagagaagtccactgatcccgcag

SEQ ID NO: 837327 - DNA, 25 bp, Mus musculus
ttagagaagtcctctgatcccgcag

SEQ ID NO: 837328 - DNA, 25 bp, Mus musculus
ttagagaagtggctaaatgatgcag

SEQ ID NO: 837329 - DNA, 25 bp, Mus musculus
ttagagaagtgggtaaatgatgcag

SEQ ID NO: 837330 - DNA, 25 bp, Mus musculus
ttagagaccaatcaggaccccgaga

SEQ ID NO: 837331 - DNA, 25 bp, Mus musculus
ttagagaccaatgaggaccccgaga

SEQ ID NO: 837332 - DNA, 25 bp, Mus musculus
ttagagaggcagagaccgaaatccc

SEQ ID NO: 837333 - DNA, 25 bp, Mus musculus
ttagagaggcagtgaccgaaatccc

SEQ ID NO: 837334 - DNA, 25 bp, Mus musculus
ttagagatgtgcctgaacccagacc

SEQ ID NO: 837335 - DNA, 25 bp, Mus musculus
ttagagatgtgcgtgaacccagacc

SEQ ID NO: 837336 - DNA, 25 bp, Mus musculus
ttagagcaagacaatcagcagctga

SEQ ID NO: 837337 - DNA, 25 bp, Mus musculus
ttagagcaagactatcagcagctga

SEQ ID NO: 837338 - DNA, 25 bp, Mus musculus
ttagagcaagggaaggctaagaacc

SEQ ID NO: 837339 - DNA, 25 bp, Mus musculus
ttagagcaagggtaggctaagaacc

SEQ ID NO: 837340 - DNA, 25 bp, Mus musculus
ttagagcagcgcagccgcagcgctg

SEQ ID NO: 837341 - DNA, 25 bp, Mus musculus
ttagagcagcgctgccgcagcgctg

SEQ ID NO: 837342 - DNA, 25 bp, Mus musculus
ttagagcaggtgattgatcttttgg

SEQ ID NO: 837343 - DNA, 25 bp, Mus musculus
ttagagcaggtgtttgatcttttgg

SEQ ID NO: 837344 - DNA, 25 bp, Mus musculus
ttagagcatgataaagcaggaatgt

SEQ ID NO: 837345 - DNA, 25 bp, Mus musculus
ttagagcatgattaagcaggaatgt

SEQ ID NO: 837346 - DNA, 25 bp, Mus musculus
ttagagcgggatagtaacgctgaca

SEQ ID NO: 837347 - DNA, 25 bp, Mus musculus
ttagagcgggattgtaacgctgaca

SEQ ID NO: 837348 - DNA, 25 bp, Mus musculus
ttagagctccaaccggcagtggcgc

SEQ ID NO: 837349 - DNA, 25 bp, Mus musculus
ttagagctccaagcggcagtggcgc

SEQ ID NO: 837350 - DNA, 25 bp, Mus musculus
ttagagctctctacgcagtctgcgc

SEQ ID NO: 837351 - DNA, 25 bp, Mus musculus
ttagagctctcttcgcagtctgcgc

SEQ ID NO: 837352 - DNA, 25 bp, Mus musculus
ttagagctgagtaagacaaagcacg

SEQ ID NO: 837353 - DNA, 25 bp, Mus musculus
ttagagctgagttagacaaagcacg

SEQ ID NO: 837354 - DNA, 25 bp, Mus musculus
ttagaggacaataaactgctcagcc

SEQ ID NO: 837355 - DNA, 25 bp, Mus musculus
ttagaggacaattaactgctcagcc

SEQ ID NO: 837356 - DNA, 25 bp, Mus musculus
ttagaggtgcggagacatggctcct

SEQ ID NO: 837357 - DNA, 25 bp, Mus musculus
ttagaggtgcggtgacatggctcct

SEQ ID NO: 837358 - DNA, 25 bp, Mus musculus
ttagaggttactatgtagggagaag

SEQ ID NO: 837359 - DNA, 25 bp, Mus musculus
ttagaggttactttgtagggagaag

SEQ ID NO: 837360 - DNA, 25 bp, Mus musculus
ttagagttccggctgtttcgtgtga

SEQ ID NO: 837361 - DNA, 25 bp, Mus musculus
ttagagttccgggtgtttcgtgtga

SEQ ID NO: 837362 - DNA, 25 bp, Mus musculus
ttagagttgaatccatgagagagtc

SEQ ID NO: 837363 - DNA, 25 bp, Mus musculus
ttagagttgaatgcatgagagagtc

SEQ ID NO: 837364 - DNA, 25 bp, Mus musculus
ttagagttggcgacctacatctgct

SEQ ID NO: 837365 - DNA, 25 bp, Mus musculus
ttagagttggcgtcctacatctgct

SEQ ID NO: 837366 - DNA, 25 bp, Mus musculus
ttagagtttaaaaatgttcacttca

SEQ ID NO: 837367 - DNA, 25 bp, Mus musculus
ttagagtttaaatatgttcacttca

SEQ ID NO: 837368 - DNA, 25 bp, Mus musculus
ttagatatgaatcggacctttgcag

SEQ ID NO: 837369 - DNA, 25 bp, Mus musculus
ttagatatgaatgggacctttgcag

SEQ ID NO: 837370 - DNA, 25 bp, Mus musculus
ttagatatgactcccgtgcacccag

SEQ ID NO: 837371 - DNA, 25 bp, Mus musculus
ttagatatgactgccgtgcacccag

SEQ ID NO: 837372 - DNA, 25 bp, Mus musculus
ttagatatgctgaccccgactgaga

SEQ ID NO: 837373 - DNA, 25 bp, Mus musculus
ttagatatgctgtccccgactgaga

SEQ ID NO: 837374 - DNA, 25 bp, Mus musculus
ttagatcacagcatttaaggacggg

SEQ ID NO: 837375 - DNA, 25 bp, Mus musculus
ttagatcacagcttttaaggacggg

SEQ ID NO: 837376 - DNA, 25 bp, Mus musculus
ttagatcacgccaagcgccacctga

SEQ ID NO: 837377 - DNA, 25 bp, Mus musculus
ttagatcacgcctagcgccacctga

SEQ ID NO: 837378 - DNA, 25 bp, Mus musculus
ttagatctgtgcattctagccatcg

SEQ ID NO: 837379 - DNA, 25 bp, Mus musculus
ttagatctgtgctttctagccatcg

SEQ ID NO: 837380 - DNA, 25 bp, Mus musculus
ttagatctgtgtcagcgattccagc

SEQ ID NO: 837381 - DNA, 25 bp, Mus musculus
ttagatctgtgtgagcgattccagc

SEQ ID NO: 837382 - DNA, 25 bp, Mus musculus
ttagatgagcctcgagatactgcct

SEQ ID NO: 837383 - DNA, 25 bp, Mus musculus
ttagatgagcctggagatactgcct

SEQ ID NO: 837384 - DNA, 25 bp, Mus musculus
ttagatgcgccacggcttcggtagc

SEQ ID NO: 837385 - DNA, 25 bp, Mus musculus
ttagatgcgccagggcttcggtagc

SEQ ID NO: 837386 - DNA, 25 bp, Mus musculus
ttagatgtggagcaacttggaatcc

SEQ ID NO: 837387 - DNA, 25 bp, Mus musculus
ttagatgtggaggaacttggaatcc

SEQ ID NO: 837388 - DNA, 25 bp, Mus musculus
ttagattagggaatgtatggacttt

SEQ ID NO: 837389 - DNA, 25 bp, Mus musculus
ttagattagggattgtatggacttt

SEQ ID NO: 837390 - DNA, 25 bp, Mus musculus
ttagattcctatcactaccaagtag

SEQ ID NO: 837391 - DNA, 25 bp, Mus musculus
ttagattcctatgactaccaagtag

SEQ ID NO: 837392 - DNA, 25 bp, Mus musculus
ttagattggaacaccgatgccgcct

SEQ ID NO: 837393 - DNA, 25 bp, Mus musculus
ttagattggaactccgatgccgcct

SEQ ID NO: 837394 - DNA, 25 bp, Mus musculus
ttagattgtccccagtctcatcaga

SEQ ID NO: 837395 - DNA, 25 bp, Mus musculus
ttagattgtcccgagtctcatcaga

SEQ ID NO: 837396 - DNA, 25 bp, Mus musculus
ttagatttggatactccggctcctg

SEQ ID NO: 837397 - DNA, 25 bp, Mus musculus
ttagatttggattctccggctcctg

SEQ ID NO: 837398 - DNA, 25 bp, Mus musculus
ttagatttgttgctctctgtccctt

SEQ ID NO: 837399 - DNA, 25 bp, Mus musculus
ttagatttgttggtctctgtccctt

SEQ ID NO: 837400 - DNA, 25 bp, Mus musculus
ttagattttcagatgaattctcccc

SEQ ID NO: 837401 - DNA, 25 bp, Mus musculus
ttagattttcagttgaattctcccc

SEQ ID NO: 837402 - DNA, 25 bp, Mus musculus
ttagcaaacgtgaccccacctggtg

SEQ ID NO: 837403 - DNA, 25 bp, Mus musculus
ttagcaaacgtgtccccacctggtg

SEQ ID NO: 837404 - DNA, 25 bp, Mus musculus
ttagcaaactacctgacctcagcaa

SEQ ID NO: 837405 - DNA, 25 bp, Mus musculus
ttagcaaactacgtgacctcagcaa

SEQ ID NO: 837406 - DNA, 25 bp, Mus musculus
ttagcaacaggtcctgtagatctct

SEQ ID NO: 837407 - DNA, 25 bp, Mus musculus
ttagcaacaggtgctgtagatctct

SEQ ID NO: 837408 - DNA, 25 bp, Mus musculus
ttagcaactacaactctgcagcctg

SEQ ID NO: 837409 - DNA, 25 bp, Mus musculus
ttagcaactacatctctgcagcctg

SEQ ID NO: 837410 - DNA, 25 bp, Mus musculus
ttagcaagcacgaggcacatcttac

SEQ ID NO: 837411 - DNA, 25 bp, Mus musculus
ttagcaagcacgtggcacatcttac

SEQ ID NO: 837412 - DNA, 25 bp, Mus musculus
ttagcaataatccaagatcaacttg

SEQ ID NO: 837413 - DNA, 25 bp, Mus musculus
ttagcaataatcgaagatcaacttg

SEQ ID NO: 837414 - DNA, 25 bp, Mus musculus
ttagcaatcaaaacttaaagtacct

SEQ ID NO: 837415 - DNA, 25 bp, Mus musculus
ttagcaatcaaatcttaaagtacct

SEQ ID NO: 837416 - DNA, 25 bp, Mus musculus
ttagcaatgaatatactgttggcag

SEQ ID NO: 837417 - DNA, 25 bp, Mus musculus
ttagcaatgaatttactgttggcag

SEQ ID NO: 837418 - DNA, 25 bp, Mus musculus
ttagcacactcaacagaagaatctg

SEQ ID NO: 837419 - DNA, 25 bp, Mus musculus
ttagcacactcatcagaagaatctg

SEQ ID NO: 837420 - DNA, 25 bp, Mus musculus
ttagcaccctgaaaaaagaatcgag

SEQ ID NO: 837421 - DNA, 25 bp, Mus musculus
ttagcaccctgataaaagaatcgag

SEQ ID NO: 837422 - DNA, 25 bp, Mus musculus
ttagcactagtaatcgaagcaccaa

SEQ ID NO: 837423 - DNA, 25 bp, Mus musculus
ttagcactagtattcgaagcaccaa

SEQ ID NO: 837424 - DNA, 25 bp, Mus musculus
ttagcactgaatcccgatgcagttg

SEQ ID NO: 837425 - DNA, 25 bp, Mus musculus
ttagcactgaatgccgatgcagttg

SEQ ID NO: 837426 - DNA, 25 bp, Mus musculus
ttagcagagcatctatattgaggat

SEQ ID NO: 837427 - DNA, 25 bp, Mus musculus
ttagcagagcatgtatattgaggat

SEQ ID NO: 837428 - DNA, 25 bp, Mus musculus
ttagcagagcgactggtacagaaca

SEQ ID NO: 837429 - DNA, 25 bp, Mus musculus
ttagcagagcgagtggtacagaaca

SEQ ID NO: 837430 - DNA, 25 bp, Mus musculus
ttagcaggaggcaaatgaaggcccc

SEQ ID NO: 837431 - DNA, 25 bp, Mus musculus
ttagcaggaggctaatgaaggcccc

SEQ ID NO: 837432 - DNA, 25 bp, Mus musculus
ttagcaggggctacctgacacagtg

SEQ ID NO: 837433 - DNA, 25 bp, Mus musculus
ttagcaggggcttcctgacacagtg

SEQ ID NO: 837434 - DNA, 25 bp, Mus musculus
ttagcatcaagaaccaatggagttt

SEQ ID NO: 837435 - DNA, 25 bp, Mus musculus
ttagcatcaagactagtaaccctgg

SEQ ID NO: 837436 - DNA, 25 bp, Mus musculus
ttagcatcaagagtagtaaccctgg

SEQ ID NO: 837437 - DNA, 25 bp, Mus musculus
ttagcatcaagatccaatggagttt

SEQ ID NO: 837438 - DNA, 25 bp, Mus musculus
ttagcatctccacggatgagtaccc

SEQ ID NO: 837439 - DNA, 25 bp, Mus musculus
ttagcatctccagggatgagtaccc

SEQ ID NO: 837440 - DNA, 25 bp, Mus musculus
ttagccaaaaacaaagagatgaaag

SEQ ID NO: 837441 - DNA, 25 bp, Mus musculus
ttagccaaaaactaagagatgaaag

SEQ ID NO: 837442 - DNA, 25 bp, Mus musculus
ttagccaaggccagcaaagtgctga

SEQ ID NO: 837443 - DNA, 25 bp, Mus musculus
ttagccaaggcctgcaaagtgctga

SEQ ID NO: 837444 - DNA, 25 bp, Mus musculus
ttagccagaagcagcggtcctcacc

SEQ ID NO: 837445 - DNA, 25 bp, Mus musculus
ttagccagaagctgcggtcctcacc

SEQ ID NO: 837446 - DNA, 25 bp, Mus musculus
ttagcccacctacagggaggctcct

SEQ ID NO: 837447 - DNA, 25 bp, Mus musculus
ttagcccacctagagggaggctcct

SEQ ID NO: 837448 - DNA, 25 bp, Mus musculus
ttagcccagcgtctgaaggagtctc

SEQ ID NO: 837449 - DNA, 25 bp, Mus musculus
ttagcccagcgtgtgaaggagtctc

SEQ ID NO: 837450 - DNA, 25 bp, Mus musculus
ttagcccagctgaccagcaccaatg

SEQ ID NO: 837451 - DNA, 25 bp, Mus musculus
ttagcccagctgtccagcaccaatg

SEQ ID NO: 837452 - DNA, 25 bp, Mus musculus
ttagccccaggactgagcagcttcc

SEQ ID NO: 837453 - DNA, 25 bp, Mus musculus
ttagccccaggagtgagcagcttcc

SEQ ID NO: 837454 - DNA, 25 bp, Mus musculus
ttagcccctattaaggtcgctttgg

SEQ ID NO: 837455 - DNA, 25 bp, Mus musculus
ttagcccctatttaggtcgctttgg

SEQ ID NO: 837456 - DNA, 25 bp, Mus musculus
ttagcccgtagtctgcagaaactag

SEQ ID NO: 837457 - DNA, 25 bp, Mus musculus
ttagcccgtagtgtgcagaaactag

SEQ ID NO: 837458 - DNA, 25 bp, Mus musculus
ttagccgaagctctagcagagagcg

SEQ ID NO: 837459 - DNA, 25 bp, Mus musculus
ttagccgaagctgtagcagagagcg

SEQ ID NO: 837460 - DNA, 25 bp, Mus musculus
ttagccgggcggagaagttgctcca

SEQ ID NO: 837461 - DNA, 25 bp, Mus musculus
ttagccgggcggtgaagttgctcca

SEQ ID NO: 837462 - DNA, 25 bp, Mus musculus
ttagcctagcatctacagggcccta

SEQ ID NO: 837463 - DNA, 25 bp, Mus musculus
ttagcctagcatgtacagggcccta

SEQ ID NO: 837464 - DNA, 25 bp, Mus musculus
ttagcctagctgatccggttctgga

SEQ ID NO: 837465 - DNA, 25 bp, Mus musculus
ttagcctagctgttccggttctgga

SEQ ID NO: 837466 - DNA, 25 bp, Mus musculus
ttagcctctccacgtccaaactgaa

SEQ ID NO: 837467 - DNA, 25 bp, Mus musculus
ttagcctctccaggtccaaactgaa

SEQ ID NO: 837468 - DNA, 25 bp, Mus musculus
ttagcctctctcatggcccagaaaa

SEQ ID NO: 837469 - DNA, 25 bp, Mus musculus
ttagcctctctcttggcccagaaaa

SEQ ID NO: 837470 - DNA, 25 bp, Mus musculus
ttagccttcaagacgggccttcggg

SEQ ID NO: 837471 - DNA, 25 bp, Mus musculus
ttagccttcaagtcgggccttcggg

SEQ ID NO: 837472 - DNA, 25 bp, Mus musculus
ttagccttcagtccctctcacttaa

SEQ ID NO: 837473 - DNA, 25 bp, Mus musculus
ttagccttcagtgcctctcacttaa

SEQ ID NO: 837474 - DNA, 25 bp, Mus musculus
ttagccttcccgagagcaccttgct

SEQ ID NO: 837475 - DNA, 25 bp, Mus musculus
ttagccttcccgtgagcaccttgct

SEQ ID NO: 837476 - DNA, 25 bp, Mus musculus
ttagccttgtgacgaaaatcgtgga

SEQ ID NO: 837477 - DNA, 25 bp, Mus musculus
ttagccttgtgacggatggaattac

SEQ ID NO: 837478 - DNA, 25 bp, Mus musculus
ttagccttgtgaggaaaatcgtgga

SEQ ID NO: 837479 - DNA, 25 bp, Mus musculus
ttagccttgtgagggatggaattac

SEQ ID NO: 837480 - DNA, 25 bp, Mus musculus
ttagcgacgagcaggaccacgccct

SEQ ID NO: 837481 - DNA, 25 bp, Mus musculus
ttagcgacgagctggaccacgccct

SEQ ID NO: 837482 - DNA, 25 bp, Mus musculus
ttagcgatagggactgcgcgtgcca

SEQ ID NO: 837483 - DNA, 25 bp, Mus musculus
ttagcgatagggtctgcgcgtgcca

SEQ ID NO: 837484 - DNA, 25 bp, Mus musculus
ttagcgatgcaactaagttaaggcc

SEQ ID NO: 837485 - DNA, 25 bp, Mus musculus
ttagcgatgcaagtaagttaaggcc

SEQ ID NO: 837486 - DNA, 25 bp, Mus musculus
ttagcgcctagactactatcagagc

SEQ ID NO: 837487 - DNA, 25 bp, Mus musculus
ttagcgcctagagtactatcagagc

SEQ ID NO: 837488 - DNA, 25 bp, Mus musculus
ttagcgctaatcaaggaaccgccgc

SEQ ID NO: 837489 - DNA, 25 bp, Mus musculus
ttagcgctaatctaggaaccgccgc

SEQ ID NO: 837490 - DNA, 25 bp, Mus musculus
ttagcgctcgatcccgaactagcgg

SEQ ID NO: 837491 - DNA, 25 bp, Mus musculus
ttagcgctcgatgccgaactagcgg

SEQ ID NO: 837492 - DNA, 25 bp, Mus musculus
ttagcgctgccgagctgcgtcacgt

SEQ ID NO: 837493 - DNA, 25 bp, Mus musculus
ttagcgctgccgtgctgcgtcacgt

SEQ ID NO: 837494 - DNA, 25 bp, Mus musculus
ttagcgtcactaacgtcctctgcgg

SEQ ID NO: 837495 - DNA, 25 bp, Mus musculus
ttagcgtcactatcgtcctctgcgg

SEQ ID NO: 837496 - DNA, 25 bp, Mus musculus
ttagctacgttacctgccttagctg

SEQ ID NO: 837497 - DNA, 25 bp, Mus musculus
ttagctacgttagctgccttagctg

SEQ ID NO: 837498 - DNA, 25 bp, Mus musculus
ttagctactaagatcaagtgccatg

SEQ ID NO: 837499 - DNA, 25 bp, Mus musculus
ttagctactaagttcaagtgccatg

SEQ ID NO: 837500 - DNA, 25 bp, Mus musculus
ttagctactcagcatttcccagtgg

SEQ ID NO: 837501 - DNA, 25 bp, Mus musculus
ttagctactcaggatttcccagtgg

SEQ ID NO: 837502 - DNA, 25 bp, Mus musculus
ttagctagataacggacccaaggac

SEQ ID NO: 837503 - DNA, 25 bp, Mus musculus
ttagctagataagggacccaaggac

SEQ ID NO: 837504 - DNA, 25 bp, Mus musculus
ttagctaggctcataaagggatctg

SEQ ID NO: 837505 - DNA, 25 bp, Mus musculus
ttagctaggctcttaaagggatctg

SEQ ID NO: 837506 - DNA, 25 bp, Mus musculus
ttagctatgaaactgagctctaccc

SEQ ID NO: 837507 - DNA, 25 bp, Mus musculus
ttagctatgaaagtgagctctaccc

SEQ ID NO: 837508 - DNA, 25 bp, Mus musculus
ttagctatgggaatgatgacagaat

SEQ ID NO: 837509 - DNA, 25 bp, Mus musculus
ttagctatgggattgatgacagaat

SEQ ID NO: 837510 - DNA, 25 bp, Mus musculus
ttagctcattccaccctttccatta

SEQ ID NO: 837511 - DNA, 25 bp, Mus musculus
ttagctcattcctccctttccatta

SEQ ID NO: 837512 - DNA, 25 bp, Mus musculus
ttagctccagccatacccaatcttg

SEQ ID NO: 837513 - DNA, 25 bp, Mus musculus
ttagctccagccttacccaatcttg

SEQ ID NO: 837514 - DNA, 25 bp, Mus musculus
ttagctcccgagaaagtgtgccaga

SEQ ID NO: 837515 - DNA, 25 bp, Mus musculus
ttagctcccgagtaagtgtgccaga

SEQ ID NO: 837516 - DNA, 25 bp, Mus musculus
ttagctcctaggctgcacagctgga

SEQ ID NO: 837517 - DNA, 25 bp, Mus musculus
ttagctcctagggtgcacagctgga

SEQ ID NO: 837518 - DNA, 25 bp, Mus musculus
ttagctcgggccaagatccgtgtca

SEQ ID NO: 837519 - DNA, 25 bp, Mus musculus
ttagctcgggcctagatccgtgtca

SEQ ID NO: 837520 - DNA, 25 bp, Mus musculus
ttagctgaaaaacaccatggcaaca

SEQ ID NO: 837521 - DNA, 25 bp, Mus musculus
ttagctgaaaaagaccatggcaaca

SEQ ID NO: 837522 - DNA, 25 bp, Mus musculus
ttagctgagggacccggaagcactt

SEQ ID NO: 837523 - DNA, 25 bp, Mus musculus
ttagctgagggagccggaagcactt

SEQ ID NO: 837524 - DNA, 25 bp, Mus musculus
ttagctgccagtcctaaaattctca

SEQ ID NO: 837525 - DNA, 25 bp, Mus musculus
ttagctgccagtgctaaaattctca

SEQ ID NO: 837526 - DNA, 25 bp, Mus musculus
ttagctgccttcattctgccgaatg

SEQ ID NO: 837527 - DNA, 25 bp, Mus musculus
ttagctgccttctttctgccgaatg

SEQ ID NO: 837528 - DNA, 25 bp, Mus musculus
ttagctggacaccacaaccgagtca

SEQ ID NO: 837529 - DNA, 25 bp, Mus musculus
ttagctggacacgacaaccgagtca

SEQ ID NO: 837530 - DNA, 25 bp, Mus musculus
ttagctgtgcaaactgagaaggatc

SEQ ID NO: 837531 - DNA, 25 bp, Mus musculus
ttagctgtgcaatctgagaaggatc

SEQ ID NO: 837532 - DNA, 25 bp, Mus musculus
ttagcttatggcaatcaagagagca

SEQ ID NO: 837533 - DNA, 25 bp, Mus musculus
ttagcttatggctatcaagagagca

SEQ ID NO: 837534 - DNA, 25 bp, Mus musculus
ttagcttcaaggacattaagaaaac

SEQ ID NO: 837535 - DNA, 25 bp, Mus musculus
ttagcttcaaggtcattaagaaaac

SEQ ID NO: 837536 - DNA, 25 bp, Mus musculus
ttagcttcaatgataagctctttgg

SEQ ID NO: 837537 - DNA, 25 bp, Mus musculus
ttagcttcaatgttaagctctttgg

SEQ ID NO: 837538 - DNA, 25 bp, Mus musculus
ttagcttctgccacaatgcctctgg

SEQ ID NO: 837539 - DNA, 25 bp, Mus musculus
ttagcttctgcctcaatgcctctgg

SEQ ID NO: 837540 - DNA, 25 bp, Mus musculus
ttagctttgaaaaaaccgttagtgc

SEQ ID NO: 837541 - DNA, 25 bp, Mus musculus
ttagctttgaaataaccgttagtgc

SEQ ID NO: 837542 - DNA, 25 bp, Mus musculus
ttagctttgagacgaaggttacagt

SEQ ID NO: 837543 - DNA, 25 bp, Mus musculus
ttagctttgagaggaaggttacagt

SEQ ID NO: 837544 - DNA, 25 bp, Mus musculus
ttaggaaacaccactacctcctgcg

SEQ ID NO: 837545 - DNA, 25 bp, Mus musculus
ttaggaaacacctctacctcctgcg

SEQ ID NO: 837546 - DNA, 25 bp, Mus musculus
ttaggaaacccaaccaaatatacaa

SEQ ID NO: 837547 - DNA, 25 bp, Mus musculus
ttaggaaacccatccaaatatacaa

SEQ ID NO: 837548 - DNA, 25 bp, Mus musculus
ttaggaaaggctcgcacggcacaag

SEQ ID NO: 837549 - DNA, 25 bp, Mus musculus
ttaggaaaggctggcacggcacaag

SEQ ID NO: 837550 - DNA, 25 bp, Mus musculus
ttaggaatcagcatcgtgggcggca

SEQ ID NO: 837551 - DNA, 25 bp, Mus musculus
ttaggaatcagcttcgtgggcggca

SEQ ID NO: 837552 - DNA, 25 bp, Mus musculus
ttaggaccggccacgtgtctgcgac

SEQ ID NO: 837553 - DNA, 25 bp, Mus musculus
ttaggaccggcctcgtgtctgcgac

SEQ ID NO: 837554 - DNA, 25 bp, Mus musculus
ttaggagccccaagaagttttttga

SEQ ID NO: 837555 - DNA, 25 bp, Mus musculus
ttaggagccccatgaagttttttga

SEQ ID NO: 837556 - DNA, 25 bp, Mus musculus
ttaggagctccgatccgggagcctg

SEQ ID NO: 837557 - DNA, 25 bp, Mus musculus
ttaggagctccgttccgggagcctg

SEQ ID NO: 837558 - DNA, 25 bp, Mus musculus
ttaggagggtatatcattgttggag

SEQ ID NO: 837559 - DNA, 25 bp, Mus musculus
ttaggagggtatttcattgttggag

SEQ ID NO: 837560 - DNA, 25 bp, Mus musculus
ttaggaggtatgacccagagccacc

SEQ ID NO: 837561 - DNA, 25 bp, Mus musculus
ttaggaggtatgtcccagagccacc

SEQ ID NO: 837562 - DNA, 25 bp, Mus musculus
ttaggatcatacaggtgacagtcgc

SEQ ID NO: 837563 - DNA, 25 bp, Mus musculus
ttaggatcatactggtgacagtcgc

SEQ ID NO: 837564 - DNA, 25 bp, Mus musculus
ttaggatgcggccttggcagcacct

SEQ ID NO: 837565 - DNA, 25 bp, Mus musculus
ttaggatgcggcgttggcagcacct

SEQ ID NO: 837566 - DNA, 25 bp, Mus musculus
ttaggatggtccaaacctgccctcg

SEQ ID NO: 837567 - DNA, 25 bp, Mus musculus
ttaggatggtcctaacctgccctcg

SEQ ID NO: 837568 - DNA, 25 bp, Mus musculus
ttaggcaagcgtcctaccgttcagc

SEQ ID NO: 837569 - DNA, 25 bp, Mus musculus
ttaggcaagcgtgctaccgttcagc

SEQ ID NO: 837570 - DNA, 25 bp, Mus musculus
ttaggcaggccacagctcgacagaa

SEQ ID NO: 837571 - DNA, 25 bp, Mus musculus
ttaggcaggccagagctcgacagaa

SEQ ID NO: 837572 - DNA, 25 bp, Mus musculus
ttaggccagccgaagttagaagact

SEQ ID NO: 837573 - DNA, 25 bp, Mus musculus
ttaggccagccgtagttagaagact

SEQ ID NO: 837574 - DNA, 25 bp, Mus musculus
ttaggccatgtccagacgtgacgtg

SEQ ID NO: 837575 - DNA, 25 bp, Mus musculus
ttaggccatgtcgagacgtgacgtg

SEQ ID NO: 837576 - DNA, 25 bp, Mus musculus
ttaggcccaaggctgggcgccattc

SEQ ID NO: 837577 - DNA, 25 bp, Mus musculus
ttaggcccaagggtgggcgccattc

SEQ ID NO: 837578 - DNA, 25 bp, Mus musculus
ttaggccccagaagcttatcaaccc

SEQ ID NO: 837579 - DNA, 25 bp, Mus musculus
ttaggccccagatgcttatcaaccc

SEQ ID NO: 837580 - DNA, 25 bp, Mus musculus
ttaggccgctttacccagggacaag

SEQ ID NO: 837581 - DNA, 25 bp, Mus musculus
ttaggccgcttttcccagggacaag

SEQ ID NO: 837582 - DNA, 25 bp, Mus musculus
ttaggcctaagaaaccccaggtcag

SEQ ID NO: 837583 - DNA, 25 bp, Mus musculus
ttaggcctaagataccccaggtcag

SEQ ID NO: 837584 - DNA, 25 bp, Mus musculus
ttaggcctcgctcctgaaagcaccg

SEQ ID NO: 837585 - DNA, 25 bp, Mus musculus
ttaggcctcgctgctgaaagcaccg

SEQ ID NO: 837586 - DNA, 25 bp, Mus musculus
ttaggcctgagtctttgctgatggt

SEQ ID NO: 837587 - DNA, 25 bp, Mus musculus
ttaggcctgagtgtttgctgatggt

SEQ ID NO: 837588 - DNA, 25 bp, Mus musculus
ttaggcctttctcaccctgtgtggg

SEQ ID NO: 837589 - DNA, 25 bp, Mus musculus
ttaggcctttctgaccctgtgtggg

SEQ ID NO: 837590 - DNA, 25 bp, Mus musculus
ttaggcgcgatgctttccactgctg

SEQ ID NO: 837591 - DNA, 25 bp, Mus musculus
ttaggcgcgatggtttccactgctg

SEQ ID NO: 837592 - DNA, 25 bp, Mus musculus
ttaggctagtgaagctgtgagctgc

SEQ ID NO: 837593 - DNA, 25 bp, Mus musculus
ttaggctagtgatgctgtgagctgc

SEQ ID NO: 837594 - DNA, 25 bp, Mus musculus
ttaggctcagggatgcgcacagttc

SEQ ID NO: 837595 - DNA, 25 bp, Mus musculus
ttaggctcagggttgcgcacagttc

SEQ ID NO: 837596 - DNA, 25 bp, Mus musculus
ttaggctgcgccagcctgcggatcg

SEQ ID NO: 837597 - DNA, 25 bp, Mus musculus
ttaggctgcgcctgcctgcggatcg

SEQ ID NO: 837598 - DNA, 25 bp, Mus musculus
ttagggaacatccatcacaagccag

SEQ ID NO: 837599 - DNA, 25 bp, Mus musculus
ttagggaacatcgatcacaagccag

SEQ ID NO: 837600 - DNA, 25 bp, Mus musculus
ttagggaacattcccagtaagaggg

SEQ ID NO: 837601 - DNA, 25 bp, Mus musculus
ttagggaacattgccagtaagaggg

SEQ ID NO: 837602 - DNA, 25 bp, Mus musculus
ttagggaagatgaggagcctcccag

SEQ ID NO: 837603 - DNA, 25 bp, Mus musculus
ttagggaagatgtggagcctcccag

SEQ ID NO: 837604 - DNA, 25 bp, Mus musculus
ttagggaaggctctaaagcagccat

SEQ ID NO: 837605 - DNA, 25 bp, Mus musculus
ttagggaaggctgtaaagcagccat

SEQ ID NO: 837606 - DNA, 25 bp, Mus musculus
ttagggacagtcagagctcatggcg

SEQ ID NO: 837607 - DNA, 25 bp, Mus musculus
ttagggacagtctgagctcatggcg

SEQ ID NO: 837608 - DNA, 25 bp, Mus musculus
ttagggccaggcacagactgctttc

SEQ ID NO: 837609 - DNA, 25 bp, Mus musculus
ttagggccaggctcagactgctttc

SEQ ID NO: 837610 - DNA, 25 bp, Mus musculus
ttagggctaggcaatgcggagaccc

SEQ ID NO: 837611 - DNA, 25 bp, Mus musculus
ttagggctaggctatgcggagaccc

SEQ ID NO: 837612 - DNA, 25 bp, Mus musculus
ttagggctttcgcaacaggatgact

SEQ ID NO: 837613 - DNA, 25 bp, Mus musculus
ttagggctttcggaacaggatgact

SEQ ID NO: 837614 - DNA, 25 bp, Mus musculus
ttagggtcagcaaacagctgtcggg

SEQ ID NO: 837615 - DNA, 25 bp, Mus musculus
ttagggtcagcatacagctgtcggg

SEQ ID NO: 837616 - DNA, 25 bp, Mus musculus
ttagggtgtgtccttcgcgcgctcc

SEQ ID NO: 837617 - DNA, 25 bp, Mus musculus
ttagggtgtgtcgttcgcgcgctcc

SEQ ID NO: 837618 - DNA, 25 bp, Mus musculus
ttagggttgatacggctacagcttg

SEQ ID NO: 837619 - DNA, 25 bp, Mus musculus
ttagggttgatagggctacagcttg

SEQ ID NO: 837620 - DNA, 25 bp, Mus musculus
ttaggtacatgacccgcgatgactt

SEQ ID NO: 837621 - DNA, 25 bp, Mus musculus
ttaggtacatgagccgcgatgactt

SEQ ID NO: 837622 - DNA, 25 bp, Mus musculus
ttaggtagccagctatgggagctca

SEQ ID NO: 837623 - DNA, 25 bp, Mus musculus
ttaggtagccaggtatgggagctca

SEQ ID NO: 837624 - DNA, 25 bp, Mus musculus
ttaggtatttctacaccgctgtgtc

SEQ ID NO: 837625 - DNA, 25 bp, Mus musculus
ttaggtatttcttcaccgctgtgtc

SEQ ID NO: 837626 - DNA, 25 bp, Mus musculus
ttaggtcacagcagagtgagtgtcc

SEQ ID NO: 837627 - DNA, 25 bp, Mus musculus
ttaggtcacagctgagtgagtgtcc

SEQ ID NO: 837628 - DNA, 25 bp, Mus musculus
ttaggtcctcatctccgtcttgcag

SEQ ID NO: 837629 - DNA, 25 bp, Mus musculus
ttaggtcctcatgtccgtcttgcag

SEQ ID NO: 837630 - DNA, 25 bp, Mus musculus
ttaggtggagaacttgcattggtca

SEQ ID NO: 837631 - DNA, 25 bp, Mus musculus
ttaggtggagaagttgcattggtca

SEQ ID NO: 837632 - DNA, 25 bp, Mus musculus
ttaggttacccgcttgctgacgcct

SEQ ID NO: 837633 - DNA, 25 bp, Mus musculus
ttaggttacccggttgctgacgcct

SEQ ID NO: 837634 - DNA, 25 bp, Mus musculus
ttagtaaccggtcccgagcagactg

SEQ ID NO: 837635 - DNA, 25 bp, Mus musculus
ttagtaaccggtgccgagcagactg

SEQ ID NO: 837636 - DNA, 25 bp, Mus musculus
ttagtaagccctatgtcagggtgac

SEQ ID NO: 837637 - DNA, 25 bp, Mus musculus
ttagtaagccctttgtcagggtgac

SEQ ID NO: 837638 - DNA, 25 bp, Mus musculus
ttagtagaatttaccagtgttgtgc

SEQ ID NO: 837639 - DNA, 25 bp, Mus musculus
ttagtagaattttccagtgttgtgc

SEQ ID NO: 837640 - DNA, 25 bp, Mus musculus
ttagtagagctaccaacaacaacag

SEQ ID NO: 837641 - DNA, 25 bp, Mus musculus
ttagtagagctagcaacaacaacag

SEQ ID NO: 837642 - DNA, 25 bp, Mus musculus
ttagtagcagcaagaagcgcgtcca

SEQ ID NO: 837643 - DNA, 25 bp, Mus musculus
ttagtagcagcatgaagcgcgtcca

SEQ ID NO: 837644 - DNA, 25 bp, Mus musculus
ttagtaggcgtcagtggcaccacgc

SEQ ID NO: 837645 - DNA, 25 bp, Mus musculus
ttagtaggcgtctgtggcaccacgc

SEQ ID NO: 837646 - DNA, 25 bp, Mus musculus
ttagtatcacccacaccctgcggat

SEQ ID NO: 837647 - DNA, 25 bp, Mus musculus
ttagtatcaccctcaccctgcggat

SEQ ID NO: 837648 - DNA, 25 bp, Mus musculus
ttagtcaccacacaaaagcgcttcc

SEQ ID NO: 837649 - DNA, 25 bp, Mus musculus
ttagtcaccacagaaaagcgcttcc

SEQ ID NO: 837650 - DNA, 25 bp, Mus musculus
ttagtcaccgtgacccgcgcggcgg

SEQ ID NO: 837651 - DNA, 25 bp, Mus musculus
ttagtcaccgtgtcccgcgcggcgg

SEQ ID NO: 837652 - DNA, 25 bp, Mus musculus
ttagtcatcttccagctctatgaga

SEQ ID NO: 837653 - DNA, 25 bp, Mus musculus
ttagtcatcttcgagctctatgaga

SEQ ID NO: 837654 - DNA, 25 bp, Mus musculus
ttagtccatctcatacagggtcagc

SEQ ID NO: 837655 - DNA, 25 bp, Mus musculus
ttagtccatctcttacagggtcagc

SEQ ID NO: 837656 - DNA, 25 bp, Mus musculus
ttagtccctatgagtggtataatcc

SEQ ID NO: 837657 - DNA, 25 bp, Mus musculus
ttagtccctatgtgtggtataatcc

SEQ ID NO: 837658 - DNA, 25 bp, Mus musculus
ttagtcctggccctagatcaggttg

SEQ ID NO: 837659 - DNA, 25 bp, Mus musculus
ttagtcctggccgtagatcaggttg

SEQ ID NO: 837660 - DNA, 25 bp, Mus musculus
ttagtcctggttaatgcagacagac

SEQ ID NO: 837661 - DNA, 25 bp, Mus musculus
ttagtcctggtttatgcagacagac

SEQ ID NO: 837662 - DNA, 25 bp, Mus musculus
ttagtctagaaaacgtgagtgttgg

SEQ ID NO: 837663 - DNA, 25 bp, Mus musculus
ttagtctagaaatcgtgagtgttgg

SEQ ID NO: 837664 - DNA, 25 bp, Mus musculus
ttagtcttaaccagacatcatccca

SEQ ID NO: 837665 - DNA, 25 bp, Mus musculus
ttagtcttaacctgacatcatccca

SEQ ID NO: 837666 - DNA, 25 bp, Mus musculus
ttagtgaacactccttcggtgcagc

SEQ ID NO: 837667 - DNA, 25 bp, Mus musculus
ttagtgaacactgcttcggtgcagc

SEQ ID NO: 837668 - DNA, 25 bp, Mus musculus
ttagtgaccagaaccgtgtgggtgc

SEQ ID NO: 837669 - DNA, 25 bp, Mus musculus
ttagtgaccagatccgtgtgggtgc

SEQ ID NO: 837670 - DNA, 25 bp, Mus musculus
ttagtgagcaggacagacagctgga

SEQ ID NO: 837671 - DNA, 25 bp, Mus musculus
ttagtgagcaggtcagacagctgga

SEQ ID NO: 837672 - DNA, 25 bp, Mus musculus
ttagtgcagtagagtctgaaccagc

SEQ ID NO: 837673 - DNA, 25 bp, Mus musculus
ttagtgcagtagtgtctgaaccagc

SEQ ID NO: 837674 - DNA, 25 bp, Mus musculus
ttagtgctgctcctccagggactga

SEQ ID NO: 837675 - DNA, 25 bp, Mus musculus
ttagtgctgctcgtccagggactga

SEQ ID NO: 837676 - DNA, 25 bp, Mus musculus
ttagtggacatacccaagtcccagg

SEQ ID NO: 837677 - DNA, 25 bp, Mus musculus
ttagtggacatagccaagtcccagg

SEQ ID NO: 837678 - DNA, 25 bp, Mus musculus
ttagtggataacatgaccgttgatc

SEQ ID NO: 837679 - DNA, 25 bp, Mus musculus
ttagtggataacttgaccgttgatc

SEQ ID NO: 837680 - DNA, 25 bp, Mus musculus
ttagtggccagaaggcaccagaggc

SEQ ID NO: 837681 - DNA, 25 bp, Mus musculus
ttagtggccagatggcaccagaggc

SEQ ID NO: 837682 - DNA, 25 bp, Mus musculus
ttagtggccccacgttaaacatatt

SEQ ID NO: 837683 - DNA, 25 bp, Mus musculus
ttagtggccccaggttaaacatatt

SEQ ID NO: 837684 - DNA, 25 bp, Mus musculus
ttagtggctatcctcttgcctgcaa

SEQ ID NO: 837685 - DNA, 25 bp, Mus musculus
ttagtggctatcgtcttgcctgcaa

SEQ ID NO: 837686 - DNA, 25 bp, Mus musculus
ttagtggctcccaaagctcagcgac

SEQ ID NO: 837687 - DNA, 25 bp, Mus musculus
ttagtggctccctaagctcagcgac

SEQ ID NO: 837688 - DNA, 25 bp, Mus musculus
ttagtgggaacaaatttggtgcgcc

SEQ ID NO: 837689 - DNA, 25 bp, Mus musculus
ttagtgggaacatatttggtgcgcc

SEQ ID NO: 837690 - DNA, 25 bp, Mus musculus
ttagtgtatagcatccttgaaggac

SEQ ID NO: 837691 - DNA, 25 bp, Mus musculus
ttagtgtatagcttccttgaaggac

SEQ ID NO: 837692 - DNA, 25 bp, Mus musculus
ttagtgtgaccccaagcgacaggac

SEQ ID NO: 837693 - DNA, 25 bp, Mus musculus
ttagtgtgacccgaagcgacaggac

SEQ ID NO: 837694 - DNA, 25 bp, Mus musculus
ttagtgtgcaggcttttccaacggc

SEQ ID NO: 837695 - DNA, 25 bp, Mus musculus
ttagtgtgcagggttttccaacggc

SEQ ID NO: 837696 - DNA, 25 bp, Mus musculus
ttagttaaagaactcctggattctg

SEQ ID NO: 837697 - DNA, 25 bp, Mus musculus
ttagttaaagaagtcctggattctg

SEQ ID NO: 837698 - DNA, 25 bp, Mus musculus
ttagttcaaacccaggtcacccagc

SEQ ID NO: 837699 - DNA, 25 bp, Mus musculus
ttagttcaaaccgaggtcacccagc

SEQ ID NO: 837700 - DNA, 25 bp, Mus musculus
ttagttccgggtccttgagacaccg

SEQ ID NO: 837701 - DNA, 25 bp, Mus musculus
ttagttccgggtgcttgagacaccg

SEQ ID NO: 837702 - DNA, 25 bp, Mus musculus
ttagtttagagcattcccggcctgc

SEQ ID NO: 837703 - DNA, 25 bp, Mus musculus
ttagtttagagctttcccggcctgc

SEQ ID NO: 837704 - DNA, 25 bp, Mus musculus
ttagtttgcagtcatgtgtgcttcc

SEQ ID NO: 837705 - DNA, 25 bp, Mus musculus
ttagtttgcagtgatgtgtgcttcc

SEQ ID NO: 837706 - DNA, 25 bp, Mus musculus
ttataaagaacacctccaacgatga

SEQ ID NO: 837707 - DNA, 25 bp, Mus musculus
ttataaagaacagctccaacgatga

SEQ ID NO: 837708 - DNA, 25 bp, Mus musculus
ttataaagccttcgataaccaaaag

SEQ ID NO: 837709 - DNA, 25 bp, Mus musculus
ttataaagccttggataaccaaaag

SEQ ID NO: 837710 - DNA, 25 bp, Mus musculus
ttataaaggaggagaatgtgagccc

SEQ ID NO: 837711 - DNA, 25 bp, Mus musculus
ttataaaggaggtgaatgtgagccc

SEQ ID NO: 837712 - DNA, 25 bp, Mus musculus
ttataaatcttgagccatcacaccc

SEQ ID NO: 837713 - DNA, 25 bp, Mus musculus
ttataaatcttgtgccatcacaccc

SEQ ID NO: 837714 - DNA, 25 bp, Mus musculus
ttataacagtgaaaacctacccatg

SEQ ID NO: 837715 - DNA, 25 bp, Mus musculus
ttataacagtgataacctacccatg

SEQ ID NO: 837716 - DNA, 25 bp, Mus musculus
ttataacccagactgcttctcaggg

SEQ ID NO: 837717 - DNA, 25 bp, Mus musculus
ttataacccagagtgcttctcaggg

SEQ ID NO: 837718 - DNA, 25 bp, Mus musculus
ttataaccctctcacgggtgaaggg

SEQ ID NO: 837719 - DNA, 25 bp, Mus musculus
ttataaccctctgacgggtgaaggg

SEQ ID NO: 837720 - DNA, 25 bp, Mus musculus
ttataagtgtacctgcccacagggc

SEQ ID NO: 837721 - DNA, 25 bp, Mus musculus
ttataagtgtacgtgcccacagggc

SEQ ID NO: 837722 - DNA, 25 bp, Mus musculus
ttataagtttgacgagcagagcagg

SEQ ID NO: 837723 - DNA, 25 bp, Mus musculus
ttataagtttgaggagcagagcagg

SEQ ID NO: 837724 - DNA, 25 bp, Mus musculus
ttataatcatagatgatggaagccc

SEQ ID NO: 837725 - DNA, 25 bp, Mus musculus
ttataatcatagttgatggaagccc

SEQ ID NO: 837726 - DNA, 25 bp, Mus musculus
ttataatgacgtcgatgtgcagaag

SEQ ID NO: 837727 - DNA, 25 bp, Mus musculus
ttataatgacgtggatgtgcagaag

SEQ ID NO: 837728 - DNA, 25 bp, Mus musculus
ttatacaactgtaaactaccactgc

SEQ ID NO: 837729 - DNA, 25 bp, Mus musculus
ttatacaactgttaactaccactgc

SEQ ID NO: 837730 - DNA, 25 bp, Mus musculus
ttatacacaggacacttcagactgg

SEQ ID NO: 837731 - DNA, 25 bp, Mus musculus
ttatacacaggagacttcagactgg

SEQ ID NO: 837732 - DNA, 25 bp, Mus musculus
ttatacaccatgatgaaggatcagt

SEQ ID NO: 837733 - DNA, 25 bp, Mus musculus
ttatacaccatgttgaaggatcagt

SEQ ID NO: 837734 - DNA, 25 bp, Mus musculus
ttatacatatttccccagcaccgca

SEQ ID NO: 837735 - DNA, 25 bp, Mus musculus
ttatacatatttgcccagcaccgca

SEQ ID NO: 837736 - DNA, 25 bp, Mus musculus
ttataccaagctccaaagaccctca

SEQ ID NO: 837737 - DNA, 25 bp, Mus musculus
ttataccaagctgcaaagaccctca

SEQ ID NO: 837738 - DNA, 25 bp, Mus musculus
ttatactaagacatggagagggcca

SEQ ID NO: 837739 - DNA, 25 bp, Mus musculus
ttatactaagacttggagagggcca

SEQ ID NO: 837740 - DNA, 25 bp, Mus musculus
ttatactgccctcggatagagctcc

SEQ ID NO: 837741 - DNA, 25 bp, Mus musculus
ttatactgccctgggatagagctcc

SEQ ID NO: 837742 - DNA, 25 bp, Mus musculus
ttatactggttccatgacaaagtac

SEQ ID NO: 837743 - DNA, 25 bp, Mus musculus
ttatactggttcgatgacaaagtac

SEQ ID NO: 837744 - DNA, 25 bp, Mus musculus
ttatagataccccactcctgatggg

SEQ ID NO: 837745 - DNA, 25 bp, Mus musculus
ttatagatacccgactcctgatggg

SEQ ID NO: 837746 - DNA, 25 bp, Mus musculus
ttataggcactcatcaccctgccta

SEQ ID NO: 837747 - DNA, 25 bp, Mus musculus
ttataggcactcttcaccctgccta

SEQ ID NO: 837748 - DNA, 25 bp, Mus musculus
ttataggcggaaagagagaaaccca

SEQ ID NO: 837749 - DNA, 25 bp, Mus musculus
ttataggcggaatgagagaaaccca

SEQ ID NO: 837750 - DNA, 25 bp, Mus musculus
ttataggtgggaccaattttgccta

SEQ ID NO: 837751 - DNA, 25 bp, Mus musculus
ttataggtgggagcaattttgccta

SEQ ID NO: 837752 - DNA, 25 bp, Mus musculus
ttatagtacccacaagaacaccggc

SEQ ID NO: 837753 - DNA, 25 bp, Mus musculus
ttatagtacccagaagaacaccggc

SEQ ID NO: 837754 - DNA, 25 bp, Mus musculus
ttatagtgcaagagtcatggtcggc

SEQ ID NO: 837755 - DNA, 25 bp, Mus musculus
ttatagtgcaagtgtcatggtcggc

SEQ ID NO: 837756 - DNA, 25 bp, Mus musculus
ttatagtggccactgtcgaacacag

SEQ ID NO: 837757 - DNA, 25 bp, Mus musculus
ttatagtggccagtgtcgaacacag

SEQ ID NO: 837758 - DNA, 25 bp, Mus musculus
ttatatatgcagctggatttgggct

SEQ ID NO: 837759 - DNA, 25 bp, Mus musculus
ttatatatgcaggtggatttgggct

SEQ ID NO: 837760 - DNA, 25 bp, Mus musculus
ttatatatttttcgctcacaggagg

SEQ ID NO: 837761 - DNA, 25 bp, Mus musculus
ttatatatttttggctcacaggagg

SEQ ID NO: 837762 - DNA, 25 bp, Mus musculus
ttatatcagtgaaaggcatctgcac

SEQ ID NO: 837763 - DNA, 25 bp, Mus musculus
ttatatcagtgataggcatctgcac

SEQ ID NO: 837764 - DNA, 25 bp, Mus musculus
ttatatcattgaatgccgctatccg

SEQ ID NO: 837765 - DNA, 25 bp, Mus musculus
ttatatcattgattgccgctatccg

SEQ ID NO: 837766 - DNA, 25 bp, Mus musculus
ttatatctatgtcaccttcctggga

SEQ ID NO: 837767 - DNA, 25 bp, Mus musculus
ttatatctatgtgaccttcctggga

SEQ ID NO: 837768 - DNA, 25 bp, Mus musculus
ttatatctgtgacctggagaacagg

SEQ ID NO: 837769 - DNA, 25 bp, Mus musculus
ttatatctgtgagctggagaacagg

SEQ ID NO: 837770 - DNA, 25 bp, Mus musculus
ttatatgccacacaatcctcacatc

SEQ ID NO: 837771 - DNA, 25 bp, Mus musculus
ttatatgccacagaatcctcacatc

SEQ ID NO: 837772 - DNA, 25 bp, Mus musculus
ttatatgggccaaacctatggaggg

SEQ ID NO: 837773 - DNA, 25 bp, Mus musculus
ttatatgggccatacctatggaggg

SEQ ID NO: 837774 - DNA, 25 bp, Mus musculus
ttatattccaggcatatgtgtggcc

SEQ ID NO: 837775 - DNA, 25 bp, Mus musculus
ttatattccagggatatgtgtggcc

SEQ ID NO: 837776 - DNA, 25 bp, Mus musculus
ttatattcccggcaggcccaggagg

SEQ ID NO: 837777 - DNA, 25 bp, Mus musculus
ttatattcccgggaggcccaggagg

SEQ ID NO: 837778 - DNA, 25 bp, Mus musculus
ttatatttccctcactatagcatag

SEQ ID NO: 837779 - DNA, 25 bp, Mus musculus
ttatatttccctgactatagcatag

SEQ ID NO: 837780 - DNA, 25 bp, Mus musculus
ttatatttctagagctgagtctcag

SEQ ID NO: 837781 - DNA, 25 bp, Mus musculus
ttatatttctagtgctgagtctcag

SEQ ID NO: 837782 - DNA, 25 bp, Mus musculus
ttatatttggcacggatgaattccc

SEQ ID NO: 837783 - DNA, 25 bp, Mus musculus
ttatatttggcagggatgaattccc

SEQ ID NO: 837784 - DNA, 25 bp, Mus musculus
ttatcaaaggcaccgactaccagct

SEQ ID NO: 837785 - DNA, 25 bp, Mus musculus
ttatcaaaggcagcgactaccagct

SEQ ID NO: 837786 - DNA, 25 bp, Mus musculus
ttatcaaataatcaggacccctgtg

SEQ ID NO: 837787 - DNA, 25 bp, Mus musculus
ttatcaaataatgaggacccctgtg

SEQ ID NO: 837788 - DNA, 25 bp, Mus musculus
ttatcaacatacaagctagagaagc

SEQ ID NO: 837789 - DNA, 25 bp, Mus musculus
ttatcaacatactagctagagaagc

SEQ ID NO: 837790 - DNA, 25 bp, Mus musculus
ttatcaacccacagcagcgcaatgc

SEQ ID NO: 837791 - DNA, 25 bp, Mus musculus
ttatcaacccactgcagcgcaatgc

SEQ ID NO: 837792 - DNA, 25 bp, Mus musculus
ttatcaaccctgacaaaagctcccg

SEQ ID NO: 837793 - DNA, 25 bp, Mus musculus
ttatcaaccctgtcaaaagctcccg

SEQ ID NO: 837794 - DNA, 25 bp, Mus musculus
ttatcaatcacacggatgaagaagg

SEQ ID NO: 837795 - DNA, 25 bp, Mus musculus
ttatcaatcacagggatgaagaagg

SEQ ID NO: 837796 - DNA, 25 bp, Mus musculus
ttatcaatcatcaggctgacctgct

SEQ ID NO: 837797 - DNA, 25 bp, Mus musculus
ttatcaatcatctggctgacctgct

SEQ ID NO: 837798 - DNA, 25 bp, Mus musculus
ttatcaatgcccctgaggtagctcc

SEQ ID NO: 837799 - DNA, 25 bp, Mus musculus
ttatcaatgcccgtgaggtagctcc

SEQ ID NO: 837800 - DNA, 25 bp, Mus musculus
ttatcaccaggaactagccaccggg

SEQ ID NO: 837801 - DNA, 25 bp, Mus musculus
ttatcaccaggactgtcacgttccc

SEQ ID NO: 837802 - DNA, 25 bp, Mus musculus
ttatcaccaggagtgtcacgttccc

SEQ ID NO: 837803 - DNA, 25 bp, Mus musculus
ttatcaccaggatctagccaccggg

SEQ ID NO: 837804 - DNA, 25 bp, Mus musculus
ttatcaccgacgaaatgagatgacc

SEQ ID NO: 837805 - DNA, 25 bp, Mus musculus
ttatcaccgacgtaatgagatgacc

SEQ ID NO: 837806 - DNA, 25 bp, Mus musculus
ttatcaccgtccatgacccggcagt

SEQ ID NO: 837807 - DNA, 25 bp, Mus musculus
ttatcaccgtccttgacccggcagt

SEQ ID NO: 837808 - DNA, 25 bp, Mus musculus
ttatcagacccaaacaattaccatg

SEQ ID NO: 837809 - DNA, 25 bp, Mus musculus
ttatcagacccatacaattaccatg

SEQ ID NO: 837810 - DNA, 25 bp, Mus musculus
ttatcagactccaagcaatatggct

SEQ ID NO: 837811 - DNA, 25 bp, Mus musculus
ttatcagactcctagcaatatggct

SEQ ID NO: 837812 - DNA, 25 bp, Mus musculus
ttatcagatgcacaggacgcgttcc

SEQ ID NO: 837813 - DNA, 25 bp, Mus musculus
ttatcagatgcagaggacgcgttcc

SEQ ID NO: 837814 - DNA, 25 bp, Mus musculus
ttatcagcaggaatacacagggcct

SEQ ID NO: 837815 - DNA, 25 bp, Mus musculus
ttatcagcaggattacacagggcct

SEQ ID NO: 837816 - DNA, 25 bp, Mus musculus
ttatcagcatggacagcaaccagat

SEQ ID NO: 837817 - DNA, 25 bp, Mus musculus
ttatcagcatggtcagcaaccagat

SEQ ID NO: 837818 - DNA, 25 bp, Mus musculus
ttatcaggaagaagccatttattgg

SEQ ID NO: 837819 - DNA, 25 bp, Mus musculus
ttatcaggaagatgccatttattgg

SEQ ID NO: 837820 - DNA, 25 bp, Mus musculus
ttatcaggatctaatagaccgagga

SEQ ID NO: 837821 - DNA, 25 bp, Mus musculus
ttatcaggatcttatagaccgagga

SEQ ID NO: 837822 - DNA, 25 bp, Mus musculus
ttatcagtacctcgttcacggcagc

SEQ ID NO: 837823 - DNA, 25 bp, Mus musculus
ttatcagtacctggttcacggcagc

SEQ ID NO: 837824 - DNA, 25 bp, Mus musculus
ttatcatcgggaccaccagccgcaa

SEQ ID NO: 837825 - DNA, 25 bp, Mus musculus
ttatcatcgggagcaccagccgcaa

SEQ ID NO: 837826 - DNA, 25 bp, Mus musculus
ttatcatggtaaagggagccatgct

SEQ ID NO: 837827 - DNA, 25 bp, Mus musculus
ttatcatggtaatgggagccatgct

SEQ ID NO: 837828 - DNA, 25 bp, Mus musculus
ttatcatggtctccggaggcggtcc

SEQ ID NO: 837829 - DNA, 25 bp, Mus musculus
ttatcatggtctgcggaggcggtcc

SEQ ID NO: 837830 - DNA, 25 bp, Mus musculus
ttatcattggagctaccaacaggcc

SEQ ID NO: 837831 - DNA, 25 bp, Mus musculus
ttatcattggaggtaccaacaggcc

SEQ ID NO: 837832 - DNA, 25 bp, Mus musculus
ttatccaaaaaacacccaatcatca

SEQ ID NO: 837833 - DNA, 25 bp, Mus musculus
ttatccaaaaaagacccaatcatca

SEQ ID NO: 837834 - DNA, 25 bp, Mus musculus
ttatccaaaaccagggcggccagcg

SEQ ID NO: 837835 - DNA, 25 bp, Mus musculus
ttatccaaaacctgggcggccagcg

SEQ ID NO: 837836 - DNA, 25 bp, Mus musculus
ttatccaagttcaccagttcaggtc

SEQ ID NO: 837837 - DNA, 25 bp, Mus musculus
ttatccaagttctccagttcaggtc

SEQ ID NO: 837838 - DNA, 25 bp, Mus musculus
ttatccaccgccacgatgaggcctt

SEQ ID NO: 837839 - DNA, 25 bp, Mus musculus
ttatccaccgcctcgatgaggcctt

SEQ ID NO: 837840 - DNA, 25 bp, Mus musculus
ttatccagacctcaaaagccccgtt

SEQ ID NO: 837841 - DNA, 25 bp, Mus musculus
ttatccagacctgaaaagccccgtt

SEQ ID NO: 837842 - DNA, 25 bp, Mus musculus
ttatccagagggctgaaccagacag

SEQ ID NO: 837843 - DNA, 25 bp, Mus musculus
ttatccagaggggtgaaccagacag

SEQ ID NO: 837844 - DNA, 25 bp, Mus musculus
ttatccagatctacctcaccacggg

SEQ ID NO: 837845 - DNA, 25 bp, Mus musculus
ttatccagatcttcctcaccacggg

SEQ ID NO: 837846 - DNA, 25 bp, Mus musculus
ttatccaggagccagggcagtccgc

SEQ ID NO: 837847 - DNA, 25 bp, Mus musculus
ttatccaggagcgagggcagtccgc

SEQ ID NO: 837848 - DNA, 25 bp, Mus musculus
ttatccagttcactgccagggtcgg

SEQ ID NO: 837849 - DNA, 25 bp, Mus musculus
ttatccagttcagtgccagggtcgg

SEQ ID NO: 837850 - DNA, 25 bp, Mus musculus
ttatccagttggacccatctatcca

SEQ ID NO: 837851 - DNA, 25 bp, Mus musculus
ttatccagttggtcccatctatcca

SEQ ID NO: 837852 - DNA, 25 bp, Mus musculus
ttatcccatcagctgaaaagttttt

SEQ ID NO: 837853 - DNA, 25 bp, Mus musculus
ttatcccatcaggtgaaaagttttt

SEQ ID NO: 837854 - DNA, 25 bp, Mus musculus
ttatcccggaacagcaaggtgttgg
